United States Patent 11,640,849 (METHODS FOR HISTOLOGICAL DIAGNOSIS AND TREATMENT OF DISEASES) - sequence listing, part 57

SEQ ID NO: 2180706 - protein, 23 aa, Cryptosporidium hominis
RRQLYKTKMCAFYNVGKCTRGNL

SEQ ID NO: 2180707 - protein, 29 aa, Cryptosporidium hominis
RRQSYNIPILRERCLSPMKYVDYYIETLP

SEQ ID NO: 2180708 - protein, 23 aa, Cryptosporidium hominis
RRQYVKLRFSAQVVQCRAYTCLE

SEQ ID NO: 2180709 - protein, 21 aa, Cryptosporidium hominis
RRRGCVLLADLTRGGPVVSAL

SEQ ID NO: 2180710 - protein, 18 aa, Cryptosporidium hominis
RRRIKIRNSHIFNNSDEL

SEQ ID NO: 2180711 - protein, 18 aa, Cryptosporidium hominis
RRRTFCGTYDYLPPEITR

SEQ ID NO: 2180712 - protein, 27 aa, Cryptosporidium hominis
RRRVYDVLNVLLAIGVVRRSVGVGKNL

SEQ ID NO: 2180713 - protein, 17 aa, Cryptosporidium hominis
RRSIGVRIKEEIDVIEG

SEQ ID NO: 2180714 - protein, 20 aa, Cryptosporidium hominis
RRSNDWRVKLLNKRCSLQAT

SEQ ID NO: 2180715 - protein, 17 aa, Cryptosporidium hominis
RRSSWRIISSVEQKEHS

SEQ ID NO: 2180716 - protein, 19 aa, Cryptosporidium hominis
RRSYDISLLKEWYKNNNIS

SEQ ID NO: 2180717 - protein, 27 aa, Cryptosporidium hominis
RRWISKRLAPHYIPKSSLDFLPLDILE

SEQ ID NO: 2180718 - protein, 30 aa, Cryptosporidium hominis
RRWVNCANPKLSHLISNWLGSDSWLTNFDM

SEQ ID NO: 2180719 - protein, 22 aa, Cryptosporidium hominis
RRYIPPPVYRCLSSGYNVFLNE

SEQ ID NO: 2180720 - protein, 17 aa, Cryptosporidium hominis
RRYSMVGNDELLIDTPV

SEQ ID NO: 2180721 - protein, 18 aa, Cryptosporidium hominis
RSACFQAGRAGFVSNEEF

SEQ ID NO: 2180722 - protein, 20 aa, Cryptosporidium hominis
RSAPTLFRHHFSFKDIGIGG

SEQ ID NO: 2180723 - protein, 21 aa, Cryptosporidium hominis
RSDGCKLYLYFDDNVGYTVIT

SEQ ID NO: 2180724 - protein, 19 aa, Cryptosporidium hominis
RSDKSGWSKTLLNGEDLIC

SEQ ID NO: 2180725 - protein, 19 aa, Cryptosporidium hominis
RSDYLKWNSINEEIEFIER

SEQ ID NO: 2180726 - protein, 21 aa, Cryptosporidium hominis
RSEDQGMLVIVASGNYESDRN

SEQ ID NO: 2180727 - protein, 23 aa, Cryptosporidium hominis
RSEFYIDCISPYLSKGIGSIKSN

SEQ ID NO: 2180728 - protein, 21 aa, Cryptosporidium hominis
RSEGAWLYRWEYIPESIDNLF

SEQ ID NO: 2180729 - protein, 19 aa, Cryptosporidium hominis
RSFLSQCPNQDKSYYFNDH

SEQ ID NO: 2180730 - protein, 19 aa, Cryptosporidium hominis
RSGEIPYETSIVLDVVNRE

SEQ ID NO: 2180731 - protein, 22 aa, Cryptosporidium hominis
RSGQDLVKFVFEFENMDLHILS

SEQ ID NO: 2180732 - protein, 22 aa, Cryptosporidium hominis
RSHAILQIEIRSRIFSVTKEST

SEQ ID NO: 2180733 - protein, 25 aa, Cryptosporidium hominis
RSHNECKWEYKVVCNKSGDKNKEFD

SEQ ID NO: 2180734 - protein, 25 aa, Cryptosporidium hominis
RSHNLEFKTSFPYVSNGGVMQVVSN

SEQ ID NO: 2180735 - protein, 17 aa, Cryptosporidium hominis
RSIAECNRRGRSPSLSY

SEQ ID NO: 2180736 - protein, 26 aa, Cryptosporidium hominis
RSIGTGLKRRKCWEMLVDELVKLKNN

SEQ ID NO: 2180737 - protein, 24 aa, Cryptosporidium hominis
RSIIEIHDPLTLYIKNIINYSDKT

SEQ ID NO: 2180738 - protein, 18 aa, Cryptosporidium hominis
RSILPLHRSNILEPEVSI

SEQ ID NO: 2180739 - protein, 19 aa, Cryptosporidium hominis
RSIPVSIKLPSDINNDGSE

SEQ ID NO: 2180740 - protein, 27 aa, Cryptosporidium hominis
RSITFLYKFISGICPKSYGMNVAQLAG

SEQ ID NO: 2180741 - protein, 20 aa, Cryptosporidium hominis
RSIWTEMVLALKNVHDLRIV

SEQ ID NO: 2180742 - protein, 17 aa, Cryptosporidium hominis
RSKAFRESVEYRYKVMY

SEQ ID NO: 2180743 - protein, 17 aa, Cryptosporidium hominis
RSKCRCHYADASVNFNG

SEQ ID NO: 2180744 - protein, 17 aa, Cryptosporidium hominis
RSKGIVLNMNIKMYLNK

SEQ ID NO: 2180745 - protein, 22 aa, Cryptosporidium hominis
RSKHSILEACDYIGQLKKYDFF

SEQ ID NO: 2180746 - protein, 24 aa, Cryptosporidium hominis
RSKIKRRLIVEWAKELCLGGYCKI

SEQ ID NO: 2180747 - protein, 17 aa, Cryptosporidium hominis
RSKILIRTLQTCISVLR

SEQ ID NO: 2180748 - protein, 18 aa, Cryptosporidium hominis
RSKIVPYITREMSIAQLQ

SEQ ID NO: 2180749 - protein, 19 aa, Cryptosporidium hominis
RSKMYVAFEDELKRCDALG

SEQ ID NO: 2180750 - protein, 20 aa, Cryptosporidium hominis
RSKVGSSFVRRFDKTNSCKH

SEQ ID NO: 2180751 - protein, 25 aa, Cryptosporidium hominis
RSKVSRIGFAWVRSIIGTFFNDTYI

SEQ ID NO: 2180752 - protein, 23 aa, Cryptosporidium hominis
RSLEKLLKVWSGSFPQDIVQKLI

SEQ ID NO: 2180753 - protein, 17 aa, Cryptosporidium hominis
RSLKCHVLPKESIHPYI

SEQ ID NO: 2180754 - protein, 19 aa, Cryptosporidium hominis
RSLKRAYFEIREWFDNAVR

SEQ ID NO: 2180755 - protein, 18 aa, Cryptosporidium hominis
RSLNDAIMIVRRAMKSSY

SEQ ID NO: 2180756 - protein, 20 aa, Cryptosporidium hominis
RSLNPLLLFSGDVFNPSIMS

SEQ ID NO: 2180757 - protein, 30 aa, Cryptosporidium hominis
RSLQLGKWRECKDYVFSLSIWDYNQEDLQQ

SEQ ID NO: 2180758 - protein, 19 aa, Cryptosporidium hominis
RSLRTKFPWAMYTRSDFSF

SEQ ID NO: 2180759 - protein, 24 aa, Cryptosporidium hominis
RSMQLLIYRYHLMVAESCLDSLKP

SEQ ID NO: 2180760 - protein, 24 aa, Cryptosporidium hominis
RSNFIYKLKCVFLCHPSLSSTCTI

SEQ ID NO: 2180761 - protein, 20 aa, Cryptosporidium hominis
RSNGARGYCNRRVSSRMNNH

SEQ ID NO: 2180762 - protein, 20 aa, Cryptosporidium hominis
RSNGCLSNWYIKDVSTSGTF

SEQ ID NO: 2180763 - protein, 25 aa, Cryptosporidium hominis
RSNIKSCPVHTAFSYRYQDENFDIL

SEQ ID NO: 2180764 - protein, 26 aa, Cryptosporidium hominis
RSNILSYKMEGDWLIVPEFKEIVSRT

SEQ ID NO: 2180765 - protein, 18 aa, Cryptosporidium hominis
RSNKFSGDGFIFGPTSTN

SEQ ID NO: 2180766 - protein, 29 aa, Cryptosporidium hominis
RSNRKFEFIKCKLINISYAFPSDTEHSIK

SEQ ID NO: 2180767 - protein, 22 aa, Cryptosporidium hominis
RSNRKYVIFCLIAPVNKEIELQ

SEQ ID NO: 2180768 - protein, 21 aa, Cryptosporidium hominis
RSPAGFHLFTTCYWDQANDGS

SEQ ID NO: 2180769 - protein, 27 aa, Cryptosporidium hominis
RSPSPRKDWAFDEAILYPPHPRTGLPK

SEQ ID NO: 2180770 - protein, 19 aa, Cryptosporidium hominis
RSQIDANNLFGCIKNTLEK

SEQ ID NO: 2180771 - protein, 20 aa, Cryptosporidium hominis
RSRITRLPFWSGDVKLNSSR

SEQ ID NO: 2180772 - protein, 24 aa, Cryptosporidium hominis
RSRNRKYLDVFICESENIRDKIEL

SEQ ID NO: 2180773 - protein, 18 aa, Cryptosporidium hominis
RSRSRPRSGSATNESPIN

SEQ ID NO: 2180774 - protein, 17 aa, Cryptosporidium hominis
RSRVHSVTESSIEASQS

SEQ ID NO: 2180775 - protein, 18 aa, Cryptosporidium hominis
RSSADLKAGKSIKDALED

SEQ ID NO: 2180776 - protein, 23 aa, Cryptosporidium hominis
RSSGLKLPFLRNDFVSINEVPTA

SEQ ID NO: 2180777 - protein, 20 aa, Cryptosporidium hominis
RSSIFNIPGIGIVNTDTIPE

SEQ ID NO: 2180778 - protein, 22 aa, Cryptosporidium hominis
RSSIPIFCLRDCQPFAKFACLR

SEQ ID NO: 2180779 - protein, 20 aa, Cryptosporidium hominis
RSSLVPARIIPSLRTEYELP

SEQ ID NO: 2180780 - protein, 25 aa, Cryptosporidium hominis
RSSQPKSAFKRCIEDEIMITTISSF

SEQ ID NO: 2180781 - protein, 19 aa, Cryptosporidium hominis
RSSRHCCRKHHSRKHKKEA

SEQ ID NO: 2180782 - protein, 29 aa, Cryptosporidium hominis
RSSRSHAILRIKIESHINSNDVCVGILNF

SEQ ID NO: 2180783 - protein, 18 aa, Cryptosporidium hominis
RSSSGRSGRKLRNFLSSE

SEQ ID NO: 2180784 - protein, 24 aa, Cryptosporidium hominis
RSSSIKAVLQNVFSRFSSNSNNNN

SEQ ID NO: 2180785 - protein, 25 aa, Cryptosporidium hominis
RSSSIVIGYLMWKYNKSFNDASEYV

SEQ ID NO: 2180786 - protein, 27 aa, Cryptosporidium hominis
RSSSSGGCWIALGGSNGFITLIYLPCA

SEQ ID NO: 2180787 - protein, 22 aa, Cryptosporidium hominis
RSTGIGVSLIFCKQFPQESVYL

SEQ ID NO: 2180788 - protein, 20 aa, Cryptosporidium hominis
RSVLDFDYEKICSVTLREEH

SEQ ID NO: 2180789 - protein, 17 aa, Cryptosporidium hominis
RSVNSLKGYCLTPKQNV

SEQ ID NO: 2180790 - protein, 28 aa, Cryptosporidium hominis
RSWYHIRWFEIQKLLLIENIKSNFLGSS

SEQ ID NO: 2180791 - protein, 25 aa, Cryptosporidium hominis
RSYDPIYWWVDFVLQSNNPCISTYS

SEQ ID NO: 2180792 - protein, 19 aa, Cryptosporidium hominis
RSYQELGMDYDIKLNNEEK

SEQ ID NO: 2180793 - protein, 21 aa, Cryptosporidium hominis
RSYQFKVLRYEYSDNSWNPLL

SEQ ID NO: 2180794 - protein, 19 aa, Cryptosporidium hominis
RSYSSRIESEFNKYSLEKS

SEQ ID NO: 2180795 - protein, 25 aa, Cryptosporidium hominis
RTALHYASACGWLPTMKLLLKYNCD

SEQ ID NO: 2180796 - protein, 17 aa, Cryptosporidium hominis
RTCNCMINENILIYYNE

SEQ ID NO: 2180797 - protein, 20 aa, Cryptosporidium hominis
RTDACFICVIGSELVQKYVG

SEQ ID NO: 2180798 - protein, 25 aa, Cryptosporidium hominis
RTDKIELLRAFLRLSKEDIILLYII

SEQ ID NO: 2180799 - protein, 26 aa, Cryptosporidium hominis
RTETFVTKADGSTVTTVDQVFQDCSK

SEQ ID NO: 2180800 - protein, 23 aa, Cryptosporidium hominis
RTFDSFRCILDVISKDNNSKKFI

SEQ ID NO: 2180801 - protein, 17 aa, Cryptosporidium hominis
RTFGTKAGSGWDVESMF

SEQ ID NO: 2180802 - protein, 19 aa, Cryptosporidium hominis
RTFSEFIYQFKYCDMSAAN

SEQ ID NO: 2180803 - protein, 19 aa, Cryptosporidium hominis
RTGYILSNIPLVIYKVLGN

SEQ ID NO: 2180804 - protein, 21 aa, Cryptosporidium hominis
RTGYMLIYKRKDWAPHQPTCN

SEQ ID NO: 2180805 - protein, 19 aa, Cryptosporidium hominis
RTIGRVRIGKFILDTWYFS

SEQ ID NO: 2180806 - protein, 17 aa, Cryptosporidium hominis
RTIPIELFQELKKKSLE

SEQ ID NO: 2180807 - protein, 25 aa, Cryptosporidium hominis
RTIPKLKYYWVYMLTLDFPNLTFIL

SEQ ID NO: 2180808 - protein, 19 aa, Cryptosporidium hominis
RTKIYCLIQRKMWNQALFL

SEQ ID NO: 2180809 - protein, 27 aa, Cryptosporidium hominis
RTKLCRRSLREGCDFGPLRCQYSHNVY

SEQ ID NO: 2180810 - protein, 28 aa, Cryptosporidium hominis
RTKPCRRSKQMGCDFGITRCQYSHNIYW

SEQ ID NO: 2180811 - protein, 18 aa, Cryptosporidium hominis
RTLCRVCGKHILKQKFAT

SEQ ID NO: 2180812 - protein, 23 aa, Cryptosporidium hominis
RTLEGFYSMEMIQKFRLKSNSDI

SEQ ID NO: 2180813 - protein, 17 aa, Cryptosporidium hominis
RTLPMKISTKFQISNKT

SEQ ID NO: 2180814 - protein, 25 aa, Cryptosporidium hominis
RTLTEWSIEPLSSWISVAEIPLSSL

SEQ ID NO: 2180815 - protein, 18 aa, Cryptosporidium hominis
RTNSSCRILSAAEMKKVF

SEQ ID NO: 2180816 - protein, 20 aa, Cryptosporidium hominis
RTPETFRMGIVYRSPAQQHS

SEQ ID NO: 2180817 - protein, 18 aa, Cryptosporidium hominis
RTPHKFDIGAIYNIPISE

SEQ ID NO: 2180818 - protein, 19 aa, Cryptosporidium hominis
RTPIHCIAYANFIYEEDEQ

SEQ ID NO: 2180819 - protein, 20 aa, Cryptosporidium hominis
RTPRIEVGKKVIISPLNLEL

SEQ ID NO: 2180820 - protein, 17 aa, Cryptosporidium hominis
RTPRPFPQLKFKRKVEN

SEQ ID NO: 2180821 - protein, 29 aa, Cryptosporidium hominis
RTPVNLKKTKLCPFWLSSACSIGENCPFA

SEQ ID NO: 2180822 - protein, 23 aa, Cryptosporidium hominis
RTQDKLVLYCWVDTNELDQNNSI

SEQ ID NO: 2180823 - protein, 20 aa, Cryptosporidium hominis
RTRHVKLVPLGVEIGSNGIS

SEQ ID NO: 2180824 - protein, 19 aa, Cryptosporidium hominis
RTSCGRCGLTYFPSKGDEG

SEQ ID NO: 2180825 - protein, 20 aa, Cryptosporidium hominis
RTSIEIEKPLILNEYQTNSF

SEQ ID NO: 2180826 - protein, 25 aa, Cryptosporidium hominis
RTSVSGKYKWAWTIGDYRLVSDMIW

SEQ ID NO: 2180827 - protein, 17 aa, Cryptosporidium hominis
RTTRWADVEAEEDDLDM

SEQ ID NO: 2180828 - protein, 18 aa, Cryptosporidium hominis
RTTSSSAFERGSNLQSSH

SEQ ID NO: 2180829 - protein, 17 aa, Cryptosporidium hominis
RTTYCYVSFRKDLVETL

SEQ ID NO: 2180830 - protein, 27 aa, Cryptosporidium hominis
RTVGIGAYLARLGHRVIQKAHGAPIVL

SEQ ID NO: 2180831 - protein, 23 aa, Cryptosporidium hominis
RTVRSRLRLFKKMRDRLVNTRDS

SEQ ID NO: 2180832 - protein, 29 aa, Cryptosporidium hominis
RTWICPWHECCLCFRRATQAGGLLIHCSE

SEQ ID NO: 2180833 - protein, 18 aa, Cryptosporidium hominis
RTYLSWRQADCHINNLYN

SEQ ID NO: 2180834 - protein, 17 aa, Cryptosporidium hominis
RTYSKVCIKIILNNVDW

SEQ ID NO: 2180835 - protein, 17 aa, Cryptosporidium hominis
RVAAMSVAARVAKEMGS

SEQ ID NO: 2180836 - protein, 19 aa, Cryptosporidium hominis
RVADCYSNLGLVYRLLGDC

SEQ ID NO: 2180837 - protein, 21 aa, Cryptosporidium hominis
RVCVFNLDDNASWRDLKDYGR

SEQ ID NO: 2180838 - protein, 22 aa, Cryptosporidium hominis
RVEIPLGCLFTPLKESSKLQLV

SEQ ID NO: 2180839 - protein, 36 aa, Cryptosporidium hominis
RVEKSTALHKWRIIRCIIRQIPLWIRYNQLCVRVCP

SEQ ID NO: 2180840 - protein, 29 aa, Cryptosporidium hominis
RVELPCKRWPELLPYLIRLVQNNSDNKMS

SEQ ID NO: 2180841 - protein, 21 aa, Cryptosporidium hominis
RVFLLKFSEIYIPRIHKKGIL

SEQ ID NO: 2180842 - protein, 19 aa, Cryptosporidium hominis
RVGKHCIPTLIEIISTPVN

SEQ ID NO: 2180843 - protein, 20 aa, Cryptosporidium hominis
RVGSIIVISNLMWWINDIHV

SEQ ID NO: 2180844 - protein, 17 aa, Cryptosporidium hominis
RVGSTYYYGFKDKQKKH

SEQ ID NO: 2180845 - protein, 28 aa, Cryptosporidium hominis
RVIELGCGCGLMSLAAAVYSRYFFDSQP

SEQ ID NO: 2180846 - protein, 20 aa, Cryptosporidium hominis
RVIGIFEINDYPTLIRQKIV

SEQ ID NO: 2180847 - protein, 25 aa, Cryptosporidium hominis
RVIKSLKFSFVFFYNQLVNIEGISR

SEQ ID NO: 2180848 - protein, 17 aa, Cryptosporidium hominis
RVIPLTHDFGCDNPKGC

SEQ ID NO: 2180849 - protein, 17 aa, Cryptosporidium hominis
RVISHSRLENSFFVSFD

SEQ ID NO: 2180850 - protein, 17 aa, Cryptosporidium hominis
RVISKFLGHSKFLNLKQ

SEQ ID NO: 2180851 - protein, 25 aa, Cryptosporidium hominis
RVIYWKDLYKSGVISQLMFSYETFV

SEQ ID NO: 2180852 - protein, 17 aa, Cryptosporidium hominis
RVKKSPIVYGFKAEEII

SEQ ID NO: 2180853 - protein, 23 aa, Cryptosporidium hominis
RVKLPGYLDLPGRLSKNLDKGIA

SEQ ID NO: 2180854 - protein, 20 aa, Cryptosporidium hominis
RVLHEISGTPILGVMLDSIW

SEQ ID NO: 2180855 - protein, 22 aa, Cryptosporidium hominis
RVLLSRLQKNLFLLAHLSNQPK

SEQ ID NO: 2180856 - protein, 34 aa, Cryptosporidium hominis
RVLVKVRDWCGSCLLDLIRRCQRLASQNSETGNL

SEQ ID NO: 2180857 - protein, 20 aa, Cryptosporidium hominis
RVMLESNPQLKALREQNPEL

SEQ ID NO: 2180858 - protein, 21 aa, Cryptosporidium hominis
RVMPWMLNIDSFNLPNSNQQP

SEQ ID NO: 2180859 - protein, 19 aa, Cryptosporidium hominis
RVNDCRPLENLVHKKHIML

SEQ ID NO: 2180860 - protein, 20 aa, Cryptosporidium hominis
RVNNTLDLFSRFCKDDLDIL

SEQ ID NO: 2180861 - protein, 24 aa, Cryptosporidium hominis
RVPRSREIIVSGDLVDYACPGEEI

SEQ ID NO: 2180862 - protein, 19 aa, Cryptosporidium hominis
RVPTLLKSTYISTSDSSSN

SEQ ID NO: 2180863 - protein, 17 aa, Cryptosporidium hominis
RVQEMFKSRIYLEKNNN

SEQ ID NO: 2180864 - protein, 19 aa, Cryptosporidium hominis
RVRAALEPYSKYSALYDQC

SEQ ID NO: 2180865 - protein, 18 aa, Cryptosporidium hominis
RVRRISLIIFGLIKEIYQ

SEQ ID NO: 2180866 - protein, 25 aa, Cryptosporidium hominis
RVSCKCNACGYIGALDNNHKITTYI

SEQ ID NO: 2180867 - protein, 21 aa, Cryptosporidium hominis
RVSEFLSCWMRPRSYYDRFEK

SEQ ID NO: 2180868 - protein, 18 aa, Cryptosporidium hominis
RVSSSSFIQGGKRLESIF

SEQ ID NO: 2180869 - protein, 41 aa, Cryptosporidium hominis
RVTNDFYKTSVCRYWKMGVKCDAGVLCRHAHGEAELRKKTN

SEQ ID NO: 2180870 - protein, 24 aa, Cryptosporidium hominis
RVTPSYYPNPMIKIPNQSMDNFKA

SEQ ID NO: 2180871 - protein, 22 aa, Cryptosporidium hominis
RVVIQRIPWRELKEIHHDAQRS

SEQ ID NO: 2180872 - protein, 26 aa, Cryptosporidium hominis
RVWKKEHKSGRVLLRTEFIVPVAPLD

SEQ ID NO: 2180873 - protein, 23 aa, Cryptosporidium hominis
RVYEISILLLIGKKVKEKNFVSA

SEQ ID NO: 2180874 - protein, 20 aa, Cryptosporidium hominis
RWHWINILKCTTIEEFSPYQ

SEQ ID NO: 2180875 - protein, 18 aa, Cryptosporidium hominis
RWKAIGVPIFIEGSQYLR

SEQ ID NO: 2180876 - protein, 25 aa, Cryptosporidium hominis
RWKHYEDFNTLFLQFEEFSTNKEVP

SEQ ID NO: 2180877 - protein, 17 aa, Cryptosporidium hominis
RWQCIVLDEAHRIKNEG

SEQ ID NO: 2180878 - protein, 20 aa, Cryptosporidium hominis
RWSNGEVFEGEYVRGVKCGH

SEQ ID NO: 2180879 - protein, 19 aa, Cryptosporidium hominis
RYAAVIMRQVFSAIAYCHS

SEQ ID NO: 2180880 - protein, 18 aa, Cryptosporidium hominis
RYADIIVHRLLSASIGLE

SEQ ID NO: 2180881 - protein, 18 aa, Cryptosporidium hominis
RYAGVLFKNPQFHERIDC

SEQ ID NO: 2180882 - protein, 22 aa, Cryptosporidium hominis
RYCKTIPLRGVILINKEFTKCV

SEQ ID NO: 2180883 - protein, 22 aa, Cryptosporidium hominis
RYCSRKLHRLRSGLKMKCGRSK

SEQ ID NO: 2180884 - protein, 20 aa, Cryptosporidium hominis
RYCTEIFDYLSLASLIEDRI

SEQ ID NO: 2180885 - protein, 28 aa, Cryptosporidium hominis
RYEDYIRLLPFFKERKYIPLFSNTELDS

SEQ ID NO: 2180886 - protein, 17 aa, Cryptosporidium hominis
RYGRGNSGFQWRDELRN

SEQ ID NO: 2180887 - protein, 26 aa, Cryptosporidium hominis
RYGVEKSYEMALRFYQVNIIGNFGNE

SEQ ID NO: 2180888 - protein, 22 aa, Cryptosporidium hominis
RYIKGRYQRHLDKIKATKSRME

SEQ ID NO: 2180889 - protein, 18 aa, Cryptosporidium hominis
RYILGCSISPLEDKIATY

SEQ ID NO: 2180890 - protein, 20 aa, Cryptosporidium hominis
RYIPVLCPDIIIKEDESSIS

SEQ ID NO: 2180891 - protein, 27 aa, Cryptosporidium hominis
RYKPELDQIYKSLVLTGSMSLESFIQM

SEQ ID NO: 2180892 - protein, 19 aa, Cryptosporidium hominis
RYLANKCSIAARIDNFSTV

SEQ ID NO: 2180893 - protein, 19 aa, Cryptosporidium hominis
RYLDLPASVFPATHTKKTM

SEQ ID NO: 2180894 - protein, 18 aa, Cryptosporidium hominis
RYLELYCRTWGHERKCVQ

SEQ ID NO: 2180895 - protein, 18 aa, Cryptosporidium hominis
RYLKMKSIFQEMVNNHQE

SEQ ID NO: 2180896 - protein, 26 aa, Cryptosporidium hominis
RYLNYKLLIRKIRWVSEQESQENWTE

SEQ ID NO: 2180897 - protein, 20 aa, Cryptosporidium hominis
RYMAPECFYIGRSIDEKSDI

SEQ ID NO: 2180898 - protein, 23 aa, Cryptosporidium hominis
RYNRAGVLGLISIILSHPYDIPF

SEQ ID NO: 2180899 - protein, 30 aa, Cryptosporidium hominis
RYPKRLRTAPLKWYLGERLEYHRDEKNELG

SEQ ID NO: 2180900 - protein, 17 aa, Cryptosporidium hominis
RYRCDKNRTLGLNTQNV

SEQ ID NO: 2180901 - protein, 18 aa, Cryptosporidium hominis
RYRLKQLRKESGSYRSGD

SEQ ID NO: 2180902 - protein, 21 aa, Cryptosporidium hominis
RYSFPEQFFLNDFSEILRDDT

SEQ ID NO: 2180903 - protein, 20 aa, Cryptosporidium hominis
RYSIDYSLSTYLSWLYLNKT

SEQ ID NO: 2180904 - protein, 28 aa, Cryptosporidium hominis
RYSSIEILRSRLLYAINNCVAIDLDAYV

SEQ ID NO: 2180905 - protein, 25 aa, Cryptosporidium hominis
RYTILLECIEELIFKQIVYSKNSDF

SEQ ID NO: 2180906 - protein, 23 aa, Cryptosporidium hominis
RYTQGVELLCWVRGSDQESESLR

SEQ ID NO: 2180907 - protein, 18 aa, Cryptosporidium hominis
RYTQLSIKYFPYSGEYIR

SEQ ID NO: 2180908 - protein, 20 aa, Cryptosporidium hominis
RYVIDCGLCKVKVYNPKIGM

SEQ ID NO: 2180909 - protein, 21 aa, Cryptosporidium hominis
RYVKLKADWWTNSAYFNRERI

SEQ ID NO: 2180910 - protein, 18 aa, Cryptosporidium hominis
RYVPIPKLENFMASSPSL

SEQ ID NO: 2180911 - protein, 22 aa, Cryptosporidium hominis
RYYRSPEICLGLAYNEKIDIWS

SEQ ID NO: 2180912 - protein, 23 aa, Cryptosporidium hominis
SADFKASIVYRVSGYAGKVLFGW

SEQ ID NO: 2180913 - protein, 23 aa, Cryptosporidium hominis
SADKTIKIWGLDFGNIQRSFHAH

SEQ ID NO: 2180914 - protein, 19 aa, Cryptosporidium hominis
SAEPNYKFVSKKKEIETLI

SEQ ID NO: 2180915 - protein, 35 aa, Cryptosporidium hominis
SAESAFKRLAFKRFKSVPLYIEWAPVNLFVSETET

SEQ ID NO: 2180916 - protein, 23 aa, Cryptosporidium hominis
SAEYFLKSGFSVIFFHRKGSHIP

SEQ ID NO: 2180917 - protein, 20 aa, Cryptosporidium hominis
SAFGALLARMLDPNKRVEEA

SEQ ID NO: 2180918 - protein, 24 aa, Cryptosporidium hominis
SAFKDLQGFHAIIIHLIRENIKQI

SEQ ID NO: 2180919 - protein, 29 aa, Cryptosporidium hominis
SAGCIFAELIKRSALFAGHDHLDQLKAII

SEQ ID NO: 2180920 - protein, 19 aa, Cryptosporidium hominis
SAICAKITPGDFVLDACSA

SEQ ID NO: 2180921 - protein, 23 aa, Cryptosporidium hominis
SAIELRNALISRFGIKISSTALF

SEQ ID NO: 2180922 - protein, 29 aa, Cryptosporidium hominis
SAIEPEWLNFYAPHIFKLNINDSNKEDLL

SEQ ID NO: 2180923 - protein, 25 aa, Cryptosporidium hominis
SAIHKSDENFTFWLSLTSDKDQSCQ

SEQ ID NO: 2180924 - protein, 21 aa, Cryptosporidium hominis
SAIKLSLIFSSFVGLSHSISI

SEQ ID NO: 2180925 - protein, 26 aa, Cryptosporidium hominis
SAKLGRGLLLDVIRQISAFGLSFMRL

SEQ ID NO: 2180926 - protein, 17 aa, Cryptosporidium hominis
SAKLLKDEVVFVKNNKL

SEQ ID NO: 2180927 - protein, 18 aa, Cryptosporidium hominis
SALKEERDILSADYKILE

SEQ ID NO: 2180928 - protein, 17 aa, Cryptosporidium hominis
SALKLATDSAVTILKID

SEQ ID NO: 2180929 - protein, 19 aa, Cryptosporidium hominis
SALNKFRFINSNKKPLENE

SEQ ID NO: 2180930 - protein, 18 aa, Cryptosporidium hominis
SALPGIDEALGFATLMQS

SEQ ID NO: 2180931 - protein, 17 aa, Cryptosporidium hominis
SALRKAGVPPGKPSYVY

SEQ ID NO: 2180932 - protein, 18 aa, Cryptosporidium hominis
SALSWKLDGENNLNLNSS

SEQ ID NO: 2180933 - protein, 21 aa, Cryptosporidium hominis
SAMLDCVRDPAKHIIQGLWRK

SEQ ID NO: 2180934 - protein, 24 aa, Cryptosporidium hominis
SARERFKIGIAIVINELENSNDWK

SEQ ID NO: 2180935 - protein, 27 aa, Cryptosporidium hominis
SASAFCRRRLAVVLVQLKFCPNLKDSV

SEQ ID NO: 2180936 - protein, 18 aa, Cryptosporidium hominis
SASCIARTILFFNSKPLN

SEQ ID NO: 2180937 - protein, 31 aa, Cryptosporidium hominis
SASESKMLISFPFFLKYYLSVLTTIRQKHFS

SEQ ID NO: 2180938 - protein, 24 aa, Cryptosporidium hominis
SASIDCLKTLLGVDFKAEDIEVGV

SEQ ID NO: 2180939 - protein, 24 aa, Cryptosporidium hominis
SASPKLKAVIPLFGLLDLAFEIRK

SEQ ID NO: 2180940 - protein, 18 aa, Cryptosporidium hominis
SASREFCGTLVIIFDLWT

SEQ ID NO: 2180941 - protein, 24 aa, Cryptosporidium hominis
SASSFYAQCLKIFSSSYGPESIYG

SEQ ID NO: 2180942 - protein, 25 aa, Cryptosporidium hominis
SASSWKKYHSKVFFGSMDKKRRELL

SEQ ID NO: 2180943 - protein, 20 aa, Cryptosporidium hominis
SASTCKVTNLLNLQDQDTVT

SEQ ID NO: 2180944 - protein, 27 aa, Cryptosporidium hominis
SASTGNHFKPINGFVFDKTSKDLKEVS

SEQ ID NO: 2180945 - protein, 18 aa, Cryptosporidium hominis
SASWCPIYSSSLIAVCDY

SEQ ID NO: 2180946 - protein, 18 aa, Cryptosporidium hominis
SATFPFFGIEPAILDPDT

SEQ ID NO: 2180947 - protein, 18 aa, Cryptosporidium hominis
SATILVIEKGGLWGLGRS

SEQ ID NO: 2180948 - protein, 25 aa, Cryptosporidium hominis
SATSLKAEYIVGAKEGLLCVYCTSK

SEQ ID NO: 2180949 - protein, 28 aa, Cryptosporidium hominis
SAYKKKRFRFNFGIIILHFILANIKNGV

SEQ ID NO: 2180950 - protein, 20 aa, Cryptosporidium hominis
SCDFNIPSRANIDMRSTNAV

SEQ ID NO: 2180951 - protein, 21 aa, Cryptosporidium hominis
SCDLKPKISIRELDRRDEECF

SEQ ID NO: 2180952 - protein, 18 aa, Cryptosporidium hominis
SCESRFSDMNVFKSSPLL

SEQ ID NO: 2180953 - protein, 23 aa, Cryptosporidium hominis
SCFPPPLDCPINLFRQILVLTSE

SEQ ID NO: 2180954 - protein, 23 aa, Cryptosporidium hominis
SCGAGYFFVSIVRFTKGKFDILA

SEQ ID NO: 2180955 - protein, 20 aa, Cryptosporidium hominis
SCGAIDIIMELGVKDLNGIL

SEQ ID NO: 2180956 - protein, 33 aa, Cryptosporidium hominis
SCGNCYLGDAFRCSGCPYKGMPAFKPGEKVSLA

SEQ ID NO: 2180957 - protein, 27 aa, Cryptosporidium hominis
SCGQCADGQCGETCMHRAVNVDGTQGV

SEQ ID NO: 2180958 - protein, 20 aa, Cryptosporidium hominis
SCILEALSEWDSFSQQSKAD

SEQ ID NO: 2180959 - protein, 19 aa, Cryptosporidium hominis
SCIMISYPNSFHNIQLSYL

SEQ ID NO: 2180960 - protein, 25 aa, Cryptosporidium hominis
SCKCCGLTVHWSCYGLGEKMESIND

SEQ ID NO: 2180961 - protein, 19 aa, Cryptosporidium hominis
SCKEIRQSETLILKEQQQT

SEQ ID NO: 2180962 - protein, 25 aa, Cryptosporidium hominis
SCKELWRRCEAKGDIYLGKYNGWYN

SEQ ID NO: 2180963 - protein, 26 aa, Cryptosporidium hominis
SCKIPLHYILTLFIRSRIRRIREKLG

SEQ ID NO: 2180964 - protein, 25 aa, Cryptosporidium hominis
SCKPERIFILAGGFASLSPRYEGCI

SEQ ID NO: 2180965 - protein, 29 aa, Cryptosporidium hominis
SCKYFYKDCVTGSYLPIPLFPDIIVVSSG

SEQ ID NO: 2180966 - protein, 24 aa, Cryptosporidium hominis
SCLNMKYFPPKKIDWNGLLGNNKD

SEQ ID NO: 2180967 - protein, 19 aa, Cryptosporidium hominis
SCMTAPCIPILAAKKLTIE

SEQ ID NO: 2180968 - protein, 18 aa, Cryptosporidium hominis
SCNNCISNATQNEFGDFS

SEQ ID NO: 2180969 - protein, 17 aa, Cryptosporidium hominis
SCNPPFYGIGMNNSSNI

SEQ ID NO: 2180970 - protein, 20 aa, Cryptosporidium hominis
SCNYLKGKWLIGSSTGKIRL

SEQ ID NO: 2180971 - protein, 20 aa, Cryptosporidium hominis
SCPKCKRKVTEIEDPNSINA

SEQ ID NO: 2180972 - protein, 18 aa, Cryptosporidium hominis
SCQSDLYSLNGYLTQEWF

SEQ ID NO: 2180973 - protein, 20 aa, Cryptosporidium hominis
SCRLFINEYVQLLGLLLNKF

SEQ ID NO: 2180974 - protein, 24 aa, Cryptosporidium hominis
SCSAVGKSSLKWNGGGTGSNNGGI

SEQ ID NO: 2180975 - protein, 26 aa, Cryptosporidium hominis
SCSEGYIYEESHLNLGFQAEQQQKPS

SEQ ID NO: 2180976 - protein, 19 aa, Cryptosporidium hominis
SCSTICRDKLFKVNKKTLD

SEQ ID NO: 2180977 - protein, 24 aa, Cryptosporidium hominis
SCVKCNWRLAHSIVEELFIGGYSP

SEQ ID NO: 2180978 - protein, 18 aa, Cryptosporidium hominis
SCVKDASKNLEATSYDLE

SEQ ID NO: 2180979 - protein, 28 aa, Cryptosporidium hominis
SCVLIPNSLCPIKLIGMVFVLSPSPLLQ

SEQ ID NO: 2180980 - protein, 21 aa, Cryptosporidium hominis
SCYYREKSYPIPKNHTNNHLN

SEQ ID NO: 2180981 - protein, 24 aa, Cryptosporidium hominis
SDALVTCCTFFKLFKLHLNSQVDD

SEQ ID NO: 2180982 - protein, 30 aa, Cryptosporidium hominis
SDASEFFFCLECIRSSKLIDTSWMLTTEFE

SEQ ID NO: 2180983 - protein, 18 aa, Cryptosporidium hominis
SDCWSIGCLLLELCSLEK

SEQ ID NO: 2180984 - protein, 17 aa, Cryptosporidium hominis
SDDFCFLLSTKAGGLGI

SEQ ID NO: 2180985 - protein, 19 aa, Cryptosporidium hominis
SDEDIKIPKLEFNDDNIED

SEQ ID NO: 2180986 - protein, 27 aa, Cryptosporidium hominis
SDEFDFRFKAIIGHLTLKFISVFFKPG

SEQ ID NO: 2180987 - protein, 25 aa, Cryptosporidium hominis
SDEFIKCPICLDSDLLVPKISNCGH

SEQ ID NO: 2180988 - protein, 20 aa, Cryptosporidium hominis
SDEILGIGIVFAEDLTRCII

SEQ ID NO: 2180989 - protein, 23 aa, Cryptosporidium hominis
SDELKKTCRLYFDSLNHVIVQST

SEQ ID NO: 2180990 - protein, 23 aa, Cryptosporidium hominis
SDELVLRLRIKNIEPTNNICDNI

SEQ ID NO: 2180991 - protein, 27 aa, Cryptosporidium hominis
SDERILPVLEFCLFGVIFTQSLEDAKK

SEQ ID NO: 2180992 - protein, 18 aa, Cryptosporidium hominis
SDFERCRIVFSYTELIYY

SEQ ID NO: 2180993 - protein, 21 aa, Cryptosporidium hominis
SDFIKILSFKEIMKYSNHTGN

SEQ ID NO: 2180994 - protein, 25 aa, Cryptosporidium hominis
SDFIQEYLPLFAFFMKLSIRVHFDM

SEQ ID NO: 2180995 - protein, 21 aa, Cryptosporidium hominis
SDFQKGSILAAKFKKELDVSI

SEQ ID NO: 2180996 - protein, 24 aa, Cryptosporidium hominis
SDGLTSSWRLWSLTEKKWNNLDLS

SEQ ID NO: 2180997 - protein, 22 aa, Cryptosporidium hominis
SDGPFCKPVFLSKEETNGLPML

SEQ ID NO: 2180998 - protein, 18 aa, Cryptosporidium hominis
SDHCPILLILKTGEFESL

SEQ ID NO: 2180999 - protein, 24 aa, Cryptosporidium hominis
SDHIWKYSKIRNIKGVNNFDERDK

SEQ ID NO: 2181000 - protein, 26 aa, Cryptosporidium hominis
SDHLVDFFLGKVLRSSNSLFYIEKKL

SEQ ID NO: 2181001 - protein, 18 aa, Cryptosporidium hominis
SDHPPVIIPETGSDSDHA

SEQ ID NO: 2181002 - protein, 21 aa, Cryptosporidium hominis
SDHPRSADAFHILSNAYNQIK

SEQ ID NO: 2181003 - protein, 22 aa, Cryptosporidium hominis
SDIDGFNAMINRVISSINEHNP

SEQ ID NO: 2181004 - protein, 18 aa, Cryptosporidium hominis
SDIFKFKQANNINHKYNK

SEQ ID NO: 2181005 - protein, 26 aa, Cryptosporidium hominis
SDIFTAKLKFEGVGNVERSKDTIIIK

SEQ ID NO: 2181006 - protein, 18 aa, Cryptosporidium hominis
SDIIKCLPHKEHVEPLIK

SEQ ID NO: 2181007 - protein, 18 aa, Cryptosporidium hominis
SDILNLTYYGKLYDTNNN

SEQ ID NO: 2181008 - protein, 24 aa, Cryptosporidium hominis
SDILRCMKRQKSLHCDTMDFHVLV

SEQ ID NO: 2181009 - protein, 23 aa, Cryptosporidium hominis
SDISRYKLEFGLCSLEDSKKIHQ

SEQ ID NO: 2181010 - protein, 24 aa, Cryptosporidium hominis
SDIYRPLFKNIFIIGRRGWIQNSF

SEQ ID NO: 2181011 - protein, 22 aa, Cryptosporidium hominis
SDKDILSAVSFQLKNSNEGFAI

SEQ ID NO: 2181012 - protein, 23 aa, Cryptosporidium hominis
SDKILLRYIESIASIDLEAGIAI

SEQ ID NO: 2181013 - protein, 34 aa, Cryptosporidium hominis
SDKISKFYCNLVPYMIKNLWRRLENASYQRVDWS

SEQ ID NO: 2181014 - protein, 20 aa, Cryptosporidium hominis
SDKMFSCFKATPLNKISVVI

SEQ ID NO: 2181015 - protein, 26 aa, Cryptosporidium hominis
SDKNGCWMLSFFLGEYNLRKQVLCDL

SEQ ID NO: 2181016 - protein, 25 aa, Cryptosporidium hominis
SDKSKCGWIQCQVGISGGSSNNLKS

SEQ ID NO: 2181017 - protein, 22 aa, Cryptosporidium hominis
SDLEFPDRVLIGGRTDSEIGKI

SEQ ID NO: 2181018 - protein, 25 aa, Cryptosporidium hominis
SDLEIYILDCLKIVSDIIEESIQDS

SEQ ID NO: 2181019 - protein, 37 aa, Cryptosporidium hominis
SDLEVIKQLRNCNLLYFNKEVVFNCIVDIEQSKLKYS

SEQ ID NO: 2181020 - protein, 25 aa, Cryptosporidium hominis
SDLFIHGSLYHLALMKRREFPEVLL

SEQ ID NO: 2181021 - protein, 18 aa, Cryptosporidium hominis
SDLLGGFCVVNHTIKNIS

SEQ ID NO: 2181022 - protein, 21 aa, Cryptosporidium hominis
SDLLPRPWSKYSVGSSQYNKR

SEQ ID NO: 2181023 - protein, 17 aa, Cryptosporidium hominis
SDLLSLLILKMSQKYKI

SEQ ID NO: 2181024 - protein, 23 aa, Cryptosporidium hominis
SDLPPRRYREFRSRNRRRRRSVS

SEQ ID NO: 2181025 - protein, 17 aa, Cryptosporidium hominis
SDLQFVFAQIPLSVSKP

SEQ ID NO: 2181026 - protein, 31 aa, Cryptosporidium hominis
SDLRKMCVNLVPFPRLHFFMIGFAPLTSRGS

SEQ ID NO: 2181027 - protein, 19 aa, Cryptosporidium hominis
SDLSCIILDDIERLMDFTA

SEQ ID NO: 2181028 - protein, 34 aa, Cryptosporidium hominis
SDLSLGIHLKREWHRLWLVRSFLAFAWESYLEDL

SEQ ID NO: 2181029 - protein, 18 aa, Cryptosporidium hominis
SDLSLPFQALLKIEKFGD

SEQ ID NO: 2181030 - protein, 21 aa, Cryptosporidium hominis
SDLWSTGMAYKIVIITNAGLR

SEQ ID NO: 2181031 - protein, 20 aa, Cryptosporidium hominis
SDMASILMTLYFSKKDSEDL

SEQ ID NO: 2181032 - protein, 19 aa, Cryptosporidium hominis
SDMLFELKKLPLWNDHDNN

SEQ ID NO: 2181033 - protein, 20 aa, Cryptosporidium hominis
SDNACRGVIIAGLPFPSIAD

SEQ ID NO: 2181034 - protein, 25 aa, Cryptosporidium hominis
SDNEFKEIIKILKGIVDELERNETY

SEQ ID NO: 2181035 - protein, 23 aa, Cryptosporidium hominis
SDNGIPLIALWLHSENVGVRERA

SEQ ID NO: 2181036 - protein, 23 aa, Cryptosporidium hominis
SDPEISGGLKLAEMDFGPSPPLG

SEQ ID NO: 2181037 - protein, 21 aa, Cryptosporidium hominis
SDPEKGIAIISAYRLYQNNKN

SEQ ID NO: 2181038 - protein, 18 aa, Cryptosporidium hominis
SDPFRYYLAREGRFGNDI

SEQ ID NO: 2181039 - protein, 17 aa, Cryptosporidium hominis
SDPLVVCSKEETGEHII

SEQ ID NO: 2181040 - protein, 24 aa, Cryptosporidium hominis
SDPRSKYLGNRGVNICRIMREDFG

SEQ ID NO: 2181041 - protein, 21 aa, Cryptosporidium hominis
SDQAIKFLIQDANLNMPKVFG

SEQ ID NO: 2181042 - protein, 17 aa, Cryptosporidium hominis
SDQEWMHRSGIKNQSDN

SEQ ID NO: 2181043 - protein, 26 aa, Cryptosporidium hominis
SDQVCIHYLRGLSWVLGYYYHGVPSW

SEQ ID NO: 2181044 - protein, 23 aa, Cryptosporidium hominis
SDRKSLELAGLWNNILKKVKRKD

SEQ ID NO: 2181045 - protein, 23 aa, Cryptosporidium hominis
SDRSSSNILFPWIYNSDFSIFES

SEQ ID NO: 2181046 - protein, 24 aa, Cryptosporidium hominis
SDSFKAKCPCYKFSKLEESRKFWG

SEQ ID NO: 2181047 - protein, 18 aa, Cryptosporidium hominis
SDSLPYALPLAGTKAQTL

SEQ ID NO: 2181048 - protein, 23 aa, Cryptosporidium hominis
SDSPWINKLYYYWEDNHFYYMLM

SEQ ID NO: 2181049 - protein, 18 aa, Cryptosporidium hominis
SDSSSCSCLCSCTEKSSN

SEQ ID NO: 2181050 - protein, 23 aa, Cryptosporidium hominis
SDSTLLGIGIRVTFHVGSNSQIN

SEQ ID NO: 2181051 - protein, 34 aa, Cryptosporidium hominis
SDSYLGIPIWRFYGRCTQCGNEIVFRTDPKSGDY

SEQ ID NO: 2181052 - protein, 19 aa, Cryptosporidium hominis
SDTALKFISKFQVKLSDFN

SEQ ID NO: 2181053 - protein, 27 aa, Cryptosporidium hominis
SDTQGCMEICITPPLSSELITSNNFYF

SEQ ID NO: 2181054 - protein, 21 aa, Cryptosporidium hominis
SDTRIYHWIRLSSLRLESQMI

SEQ ID NO: 2181055 - protein, 24 aa, Cryptosporidium hominis
SDVCSPPIKLPWSIIFHTLDPTEF

SEQ ID NO: 2181056 - protein, 24 aa, Cryptosporidium hominis
SDVKSIREAINFSINTKNREPDNN

SEQ ID NO: 2181057 - protein, 18 aa, Cryptosporidium hominis
SDVLKSRLLTPAVVVNQL

SEQ ID NO: 2181058 - protein, 26 aa, Cryptosporidium hominis
SDVNECADICWLKGSKVLVNGTISGH

SEQ ID NO: 2181059 - protein, 18 aa, Cryptosporidium hominis
SDVVGGGFQQEDNISSTV

SEQ ID NO: 2181060 - protein, 20 aa, Cryptosporidium hominis
SDYFKNIRAGKIAIYNSDDE

SEQ ID NO: 2181061 - protein, 22 aa, Cryptosporidium hominis
SDYRGKYVVLFFYPLNFTFVCP

SEQ ID NO: 2181062 - protein, 20 aa, Cryptosporidium hominis
SDYRSFSLLCEFGSVKALVN

SEQ ID NO: 2181063 - protein, 25 aa, Cryptosporidium hominis
SEAAELRSQYILRRIKENNCIKNTN

SEQ ID NO: 2181064 - protein, 19 aa, Cryptosporidium hominis
SEACSICLEPVFGLYTRCL

SEQ ID NO: 2181065 - protein, 17 aa, Cryptosporidium hominis
SEAEAQCAELCKDGLVY

SEQ ID NO: 2181066 - protein, 23 aa, Cryptosporidium hominis
SEAIARLLPYHTFYVDEIKSNRV

SEQ ID NO: 2181067 - protein, 32 aa, Cryptosporidium hominis
SECGIKWSTIIKIWRLILDRLVDCKNLELKGL

SEQ ID NO: 2181068 - protein, 20 aa, Cryptosporidium hominis
SECLPSKCIQPICTFNEEPS

SEQ ID NO: 2181069 - protein, 27 aa, Cryptosporidium hominis
SECLRSMRVSVRWLRLASSMHLNLYQI

SEQ ID NO: 2181070 - protein, 27 aa, Cryptosporidium hominis
SEDEILKAAVMKYGLNNWSRVASLLIM

SEQ ID NO: 2181071 - protein, 17 aa, Cryptosporidium hominis
SEDKVPVILGNEASNVI

SEQ ID NO: 2181072 - protein, 26 aa, Cryptosporidium hominis
SEDLLPTSVCPLIIIGEITSDEQKNK

SEQ ID NO: 2181073 - protein, 33 aa, Cryptosporidium hominis
SEDLQAIFRRCYKNSLWRKKEVETNSGLLELEN

SEQ ID NO: 2181074 - protein, 17 aa, Cryptosporidium hominis
SEEGLNCDIYWKNDDFR

SEQ ID NO: 2181075 - protein, 22 aa, Cryptosporidium hominis
SEEIKVLIVGSGRGGLIKSAFN

SEQ ID NO: 2181076 - protein, 21 aa, Cryptosporidium hominis
SEEISCVIRAFINAEVPNSLL

SEQ ID NO: 2181077 - protein, 20 aa, Cryptosporidium hominis
SEESFQWDDHNCQAHPHSQN

SEQ ID NO: 2181078 - protein, 22 aa, Cryptosporidium hominis
SEESLDRFVNRSISKLKPDQKE

SEQ ID NO: 2181079 - protein, 23 aa, Cryptosporidium hominis
SEEVKRYMYVDGLTNKNQGSFYF

SEQ ID NO: 2181080 - protein, 19 aa, Cryptosporidium hominis
SEEWGELYYGIGNESMGDG

SEQ ID NO: 2181081 - protein, 21 aa, Cryptosporidium hominis
SEFAQCIPLSIIKQLERQLGS

SEQ ID NO: 2181082 - protein, 19 aa, Cryptosporidium hominis
SEFIKSRLTSVPLTSCNLL

SEQ ID NO: 2181083 - protein, 17 aa, Cryptosporidium hominis
SEFIPPALELYPLPFPK

SEQ ID NO: 2181084 - protein, 21 aa, Cryptosporidium hominis
SEFKQKGWCQFQSLDDISACV

SEQ ID NO: 2181085 - protein, 22 aa, Cryptosporidium hominis
SEFKTALLTGVTGFVGRILLVK

SEQ ID NO: 2181086 - protein, 20 aa, Cryptosporidium hominis
SEFSERFGIDTLFEKSFEDL

SEQ ID NO: 2181087 - protein, 17 aa, Cryptosporidium hominis
SEFSFKDVNGISVIGIV

SEQ ID NO: 2181088 - protein, 22 aa, Cryptosporidium hominis
SEFSNRLENHFIQLEQLSEHLN

SEQ ID NO: 2181089 - protein, 22 aa, Cryptosporidium hominis
SEFTSRFSFFSSCEIELILESM

SEQ ID NO: 2181090 - protein, 26 aa, Cryptosporidium hominis
SEGEKKVPVAFGLFKLQMGATIIDDL

SEQ ID NO: 2181091 - protein, 21 aa, Cryptosporidium hominis
SEGIEGFLFEEIMPEIKKRKR

SEQ ID NO: 2181092 - protein, 18 aa, Cryptosporidium hominis
SEGPMCLSGLKSQVARNF

SEQ ID NO: 2181093 - protein, 18 aa, Cryptosporidium hominis
SEHIFYCIQYVNRFGEYH

SEQ ID NO: 2181094 - protein, 24 aa, Cryptosporidium hominis
SEHKQRATILTAIFGELYAIKNDF

SEQ ID NO: 2181095 - protein, 25 aa, Cryptosporidium hominis
SEIAISLRRLMKISQVLRKNRISRG

SEQ ID NO: 2181096 - protein, 27 aa, Cryptosporidium hominis
SEIALRVMLLEDEYFLGLEPILDRQSA

SEQ ID NO: 2181097 - protein, 19 aa, Cryptosporidium hominis
SEIALSCGAIDIIMELGVK

SEQ ID NO: 2181098 - protein, 19 aa, Cryptosporidium hominis
SEIGCCFAGMPADFRVILK

SEQ ID NO: 2181099 - protein, 19 aa, Cryptosporidium hominis
SEIGLGLNPDATLKMADSC

SEQ ID NO: 2181100 - protein, 18 aa, Cryptosporidium hominis
SEILDFYSPLLINTIIIH

SEQ ID NO: 2181101 - protein, 23 aa, Cryptosporidium hominis
SEINLVYLDWAIKSSMISPENII

SEQ ID NO: 2181102 - protein, 24 aa, Cryptosporidium hominis
SEIRCLFDGFLSSDLYELRTENNE

SEQ ID NO: 2181103 - protein, 36 aa, Cryptosporidium hominis
SEIRMFIEKYLMYPKDFRRIASFMEYKTIKDCIDFY

SEQ ID NO: 2181104 - protein, 17 aa, Cryptosporidium hominis
SEIRRRLHFSRQKSDIM

SEQ ID NO: 2181105 - protein, 21 aa, Cryptosporidium hominis
SEISCGRSLCLSTKEQYKVIN

SEQ ID NO: 2181106 - protein, 17 aa, Cryptosporidium hominis
SEISGRCLAASLKLQEL

SEQ ID NO: 2181107 - protein, 17 aa, Cryptosporidium hominis
SEISLSSLNSWVTFFES

SEQ ID NO: 2181108 - protein, 21 aa, Cryptosporidium hominis
SEIYTSISRTIIKKCNISDGG

SEQ ID NO: 2181109 - protein, 24 aa, Cryptosporidium hominis
SEKARLRKGITILGGTPGRILDHI

SEQ ID NO: 2181110 - protein, 25 aa, Cryptosporidium hominis
SEKEVLLMFPFIEFYLQTYSKKYNL

SEQ ID NO: 2181111 - protein, 17 aa, Cryptosporidium hominis
SEKGGQIIISFTQLLPV

SEQ ID NO: 2181112 - protein, 18 aa, Cryptosporidium hominis
SEKIKAKVLSEWESTESF

SEQ ID NO: 2181113 - protein, 20 aa, Cryptosporidium hominis
SEKLIYYVIIKKIFSSSIHL

SEQ ID NO: 2181114 - protein, 30 aa, Cryptosporidium hominis
SEKRKERTLKCFIKKLIIENFKSYNGRHII

SEQ ID NO: 2181115 - protein, 23 aa, Cryptosporidium hominis
SEKRLKKNRKYRIKKDAINTEFE

SEQ ID NO: 2181116 - protein, 22 aa, Cryptosporidium hominis
SEKRYMIGLTQPRRIAATSLSN

SEQ ID NO: 2181117 - protein, 17 aa, Cryptosporidium hominis
SEKSFMKKLKFILFQQQ

SEQ ID NO: 2181118 - protein, 27 aa, Cryptosporidium hominis
SELESIVRWSCRLLNISNFRNIPIQIG

SEQ ID NO: 2181119 - protein, 18 aa, Cryptosporidium hominis
SELGGVPFGIEIKIKGFL

SEQ ID NO: 2181120 - protein, 25 aa, Cryptosporidium hominis
SELHTRINTWTGYVEPLLQAQNSRP

SEQ ID NO: 2181121 - protein, 25 aa, Cryptosporidium hominis
SELILPERVNFYFAALRILHQLKRK

SEQ ID NO: 2181122 - protein, 25 aa, Cryptosporidium hominis
SELIPRGKQVLGFDIGIGANCIFSL

SEQ ID NO: 2181123 - protein, 19 aa, Cryptosporidium hominis
SELLVIGWEALKKGESVLV

SEQ ID NO: 2181124 - protein, 20 aa, Cryptosporidium hominis
SELQGKIMLAEKARELLLTR

SEQ ID NO: 2181125 - protein, 22 aa, Cryptosporidium hominis
SELQLQLVGIMDMFMATSPASF

SEQ ID NO: 2181126 - protein, 20 aa, Cryptosporidium hominis
SELQRGIGYVCRKGLKPESP

SEQ ID NO: 2181127 - protein, 22 aa, Cryptosporidium hominis
SELRGWWIKVGQFLSTRGDLLP

SEQ ID NO: 2181128 - protein, 19 aa, Cryptosporidium hominis
SELRKVDVMISHDWPNGIE

SEQ ID NO: 2181129 - protein, 24 aa, Cryptosporidium hominis
SELRRRHSNELQRFETIIDDLKKK

SEQ ID NO: 2181130 - protein, 22 aa, Cryptosporidium hominis
SELSLPPGGPIIQKSEPYGRSS

SEQ ID NO: 2181131 - protein, 20 aa, Cryptosporidium hominis
SENCKYCRANLTGKSGNASG

SEQ ID NO: 2181132 - protein, 21 aa, Cryptosporidium hominis
SENPIRFLGLLECNCDFENCR

SEQ ID NO: 2181133 - protein, 22 aa, Cryptosporidium hominis
SENREIYSSYCMDHETKANSIE

SEQ ID NO: 2181134 - protein, 17 aa, Cryptosporidium hominis
SENRLVYPSALQNDNKP

SEQ ID NO: 2181135 - protein, 25 aa, Cryptosporidium hominis
SEPAFYRQHFSIFFPQILNIAKNIQ

SEQ ID NO: 2181136 - protein, 20 aa, Cryptosporidium hominis
SEPRRLQKSSLYVCRRTGFR

SEQ ID NO: 2181137 - protein, 17 aa, Cryptosporidium hominis
SEQCLVVLDSVYDKLIS

SEQ ID NO: 2181138 - protein, 21 aa, Cryptosporidium hominis
SEQQSGFILNFNFAPNPFFEG

SEQ ID NO: 2181139 - protein, 25 aa, Cryptosporidium hominis
SEQSRAESGLLLLTEKVIEYAKQSP

SEQ ID NO: 2181140 - protein, 19 aa, Cryptosporidium hominis
SEQYKSCSNFYIFEFQACF

SEQ ID NO: 2181141 - protein, 20 aa, Cryptosporidium hominis
SEQYWDLCSFVQEFYKFSTD

SEQ ID NO: 2181142 - protein, 20 aa, Cryptosporidium hominis
SERISALSVRRNLKSQQKFL

SEQ ID NO: 2181143 - protein, 19 aa, Cryptosporidium hominis
SESELKSEHVLEEKSPPSL

SEQ ID NO: 2181144 - protein, 20 aa, Cryptosporidium hominis
SESIIYCCVDKIMDEVKNNY

SEQ ID NO: 2181145 - protein, 24 aa, Cryptosporidium hominis
SESIKLAQELSLRLEISEPNSKSS

SEQ ID NO: 2181146 - protein, 19 aa, Cryptosporidium hominis
SESKLAKDNLEWNKQYNDL

SEQ ID NO: 2181147 - protein, 18 aa, Cryptosporidium hominis
SESLPCVIYLHGNCSSRR

SEQ ID NO: 2181148 - protein, 21 aa, Cryptosporidium hominis
SESPFCLLFGFKEEKSNNYGT

SEQ ID NO: 2181149 - protein, 23 aa, Cryptosporidium hominis
SESRACIFGSKTSRMLQITINYF

SEQ ID NO: 2181150 - protein, 22 aa, Cryptosporidium hominis
SESRSTFKYTSLYDALIKNCYH

SEQ ID NO: 2181151 - protein, 25 aa, Cryptosporidium hominis
SESSARFILKQVVVALIYMHQKEII

SEQ ID NO: 2181152 - protein, 32 aa, Cryptosporidium hominis
SESSKYKWLFRWLPYYYKFGMGYQISKVISKH

SEQ ID NO: 2181153 - protein, 31 aa, Cryptosporidium hominis
SETCIGLHFAYRWALVDLFDTSELFKLVGNR

SEQ ID NO: 2181154 - protein, 21 aa, Cryptosporidium hominis
SETLKLTFLFVREDEKLASLL

SEQ ID NO: 2181155 - protein, 25 aa, Cryptosporidium hominis
SETNRLALMGLDWDNITADDIYVVL

SEQ ID NO: 2181156 - protein, 25 aa, Cryptosporidium hominis
SETYTYIRHTFSWMNNQFGMKLIAP

SEQ ID NO: 2181157 - protein, 18 aa, Cryptosporidium hominis
SEVDPKFCNYDMVSRIMR

SEQ ID NO: 2181158 - protein, 17 aa, Cryptosporidium hominis
SEVGGFFAGEGKWGGCV

SEQ ID NO: 2181159 - protein, 20 aa, Cryptosporidium hominis
SEVGLHCGYSNISIDKPSVD

SEQ ID NO: 2181160 - protein, 28 aa, Cryptosporidium hominis
SEVYLEYTSRFFIDSGLFKKIGGKNKGA

SEQ ID NO: 2181161 - protein, 23 aa, Cryptosporidium hominis
SEWLDEVCFNFGLELDCIEFDEE

SEQ ID NO: 2181162 - protein, 20 aa, Cryptosporidium hominis
SEWMGFYLLHEGMLDSVIFA

SEQ ID NO: 2181163 - protein, 20 aa, Cryptosporidium hominis
SEWMGYLLLYESMLDTVLFC

SEQ ID NO: 2181164 - protein, 19 aa, Cryptosporidium hominis
SEYDCLSFESSEFQNKENE

SEQ ID NO: 2181165 - protein, 17 aa, Cryptosporidium hominis
SEYEVMEKTLIQRKEQL

SEQ ID NO: 2181166 - protein, 18 aa, Cryptosporidium hominis
SEYKIAFPHFYNSLPKFV

SEQ ID NO: 2181167 - protein, 22 aa, Cryptosporidium hominis
SEYKMEISREGDLLKLIQEEIS

SEQ ID NO: 2181168 - protein, 22 aa, Cryptosporidium hominis
SEYRIREFTEVITPNIFSCDLW

SEQ ID NO: 2181169 - protein, 24 aa, Cryptosporidium hominis
SEYRNIPQGLTWIKVVNDRIFAGD

SEQ ID NO: 2181170 - protein, 29 aa, Cryptosporidium hominis
SEYVMKIQCLIKRYWILAHLDRLFWVADV

SEQ ID NO: 2181171 - protein, 18 aa, Cryptosporidium hominis
SFAKRLLGIPNIEDVEKT

SEQ ID NO: 2181172 - protein, 25 aa, Cryptosporidium hominis
SFALSCLYNRLNFVRNVLPDCTYTL

SEQ ID NO: 2181173 - protein, 19 aa, Cryptosporidium hominis
SFCKGYRSIGERRVPFNFT

SEQ ID NO: 2181174 - protein, 30 aa, Cryptosporidium hominis
SFDAAMPIWMIKRFVDLFNVSRTTYCYVSF

SEQ ID NO: 2181175 - protein, 26 aa, Cryptosporidium hominis
SFDIKGCSPEEVLIAGNLIRNSSLEE

SEQ ID NO: 2181176 - protein, 26 aa, Cryptosporidium hominis
SFDPIFMKKCFQRLCGELEMTQNSQY

SEQ ID NO: 2181177 - protein, 25 aa, Cryptosporidium hominis
SFDPSKRISLGFSNLSKGGIKIQSS

SEQ ID NO: 2181178 - protein, 26 aa, Cryptosporidium hominis
SFDRSRLLTRFVIKLILELNDKNKSQ

SEQ ID NO: 2181179 - protein, 19 aa, Cryptosporidium hominis
SFELFKNYITICSIKYKSA

SEQ ID NO: 2181180 - protein, 26 aa, Cryptosporidium hominis
SFEPAHARGALGVMPMPMELPPQPPV

SEQ ID NO: 2181181 - protein, 19 aa, Cryptosporidium hominis
SFESLKLPQFEDSSSSYAE

SEQ ID NO: 2181182 - protein, 24 aa, Cryptosporidium hominis
SFESSLRLLKDVLLVQPNKLDSSN

SEQ ID NO: 2181183 - protein, 22 aa, Cryptosporidium hominis
SFFLKKVPIFVSFSYLNDSIWV

SEQ ID NO: 2181184 - protein, 17 aa, Cryptosporidium hominis
SFFNILINKVFLADLSN

SEQ ID NO: 2181185 - protein, 22 aa, Cryptosporidium hominis
SFFQSCIIQNGLLGLIQALPHI

SEQ ID NO: 2181186 - protein, 20 aa, Cryptosporidium hominis
SFGDLRLIRRCEIDAVSKRH

SEQ ID NO: 2181187 - protein, 18 aa, Cryptosporidium hominis
SFGVKWNPVININYSTNK

SEQ ID NO: 2181188 - protein, 20 aa, Cryptosporidium hominis
SFHSPCIIKRMESLTSTPVT

SEQ ID NO: 2181189 - protein, 19 aa, Cryptosporidium hominis
SFIDLKWILDSTISAKLKR

SEQ ID NO: 2181190 - protein, 26 aa, Cryptosporidium hominis
SFIIKSSQCPIIFSCRMAIVNNSKKE

SEQ ID NO: 2181191 - protein, 17 aa, Cryptosporidium hominis
SFIPPPLFSCTDQKPYI

SEQ ID NO: 2181192 - protein, 18 aa, Cryptosporidium hominis
SFIRKKGNIFGMKLAKKD

SEQ ID NO: 2181193 - protein, 17 aa, Cryptosporidium hominis
SFKFEEPNRIVVKKRKL

SEQ ID NO: 2181194 - protein, 18 aa, Cryptosporidium hominis
SFKPRIYLRFKSLRDPSS

SEQ ID NO: 2181195 - protein, 25 aa, Cryptosporidium hominis
SFKTNKRAGFSFKNFFSKYFGSKKH

SEQ ID NO: 2181196 - protein, 20 aa, Cryptosporidium hominis
SFLPCLRITNAYKYAKYFAV

SEQ ID NO: 2181197 - protein, 17 aa, Cryptosporidium hominis
SFLPPVMLENLPWLHHI

SEQ ID NO: 2181198 - protein, 26 aa, Cryptosporidium hominis
SFLSDLYACMSIGQSIIFVNTRKTAF

SEQ ID NO: 2181199 - protein, 21 aa, Cryptosporidium hominis
SFLSTMWLQNFHKVLNIKDRI

SEQ ID NO: 2181200 - protein, 19 aa, Cryptosporidium hominis
SFNALTIAFASKFKTQIVD

SEQ ID NO: 2181201 - protein, 22 aa, Cryptosporidium hominis
SFNDSWVLYSLLWTSSIKHDAC

SEQ ID NO: 2181202 - protein, 26 aa, Cryptosporidium hominis
SFNEICNMFIYNGCWEGLIVYLTCKL

SEQ ID NO: 2181203 - protein, 18 aa, Cryptosporidium hominis
SFNKCLRYNQFYFSEKNN

SEQ ID NO: 2181204 - protein, 20 aa, Cryptosporidium hominis
SFNNFFLIRETCGFSSNNEC

SEQ ID NO: 2181205 - protein, 21 aa, Cryptosporidium hominis
SFNNTCSWVQYNVLTDSIDHV

SEQ ID NO: 2181206 - protein, 20 aa, Cryptosporidium hominis
SFNRRLIIILNKIYNETLNK

SEQ ID NO: 2181207 - protein, 17 aa, Cryptosporidium hominis
SFPCVAYLGRLLVSASL

SEQ ID NO: 2181208 - protein, 24 aa, Cryptosporidium hominis
SFPGIKADGGFLKVAFQFPPKERL

SEQ ID NO: 2181209 - protein, 25 aa, Cryptosporidium hominis
SFPLPPRYAKILLLTTAYIRKNLIN

SEQ ID NO: 2181210 - protein, 19 aa, Cryptosporidium hominis
SFPPPPPYFRLFDHEDKVT

SEQ ID NO: 2181211 - protein, 17 aa, Cryptosporidium hominis
SFQCPDEKTSVSVGEND

SEQ ID NO: 2181212 - protein, 18 aa, Cryptosporidium hominis
SFRNVYRFVPIPFENRLH

SEQ ID NO: 2181213 - protein, 19 aa, Cryptosporidium hominis
SFRSLRDALEYPICDEQGI

SEQ ID NO: 2181214 - protein, 19 aa, Cryptosporidium hominis
SFRYPEIKIGMGRGNPNSN

SEQ ID NO: 2181215 - protein, 17 aa, Cryptosporidium hominis
SFSEGGLYVNLKNFEAY

SEQ ID NO: 2181216 - protein, 19 aa, Cryptosporidium hominis
SFSIKWWPLNEKFYKHEKL

SEQ ID NO: 2181217 - protein, 28 aa, Cryptosporidium hominis
SFSIQSRWRSFQIRKSFLAILGSRTQAA

SEQ ID NO: 2181218 - protein, 20 aa, Cryptosporidium hominis
SFSNRWRVFATKESNSSIIA

SEQ ID NO: 2181219 - protein, 17 aa, Cryptosporidium hominis
SFSPVEFIAQLKQDNID

SEQ ID NO: 2181220 - protein, 18 aa, Cryptosporidium hominis
SFSRYQIKEVHQIHVDLR

SEQ ID NO: 2181221 - protein, 25 aa, Cryptosporidium hominis
SFSSFEIRFLLTFKGIDKIKSIIQT

SEQ ID NO: 2181222 - protein, 18 aa, Cryptosporidium hominis
SFSSLKVNLDPGYFSTQK

SEQ ID NO: 2181223 - protein, 20 aa, Cryptosporidium hominis
SFSTCRRWMISGRFQDILPK

SEQ ID NO: 2181224 - protein, 24 aa, Cryptosporidium hominis
SFTENRIKRCLNFIQPIEFEKDDD

SEQ ID NO: 2181225 - protein, 25 aa, Cryptosporidium hominis
SFTHVLGLCKPCVFVNKTNKKCRNG

SEQ ID NO: 2181226 - protein, 22 aa, Cryptosporidium hominis
SFTQRNRIGIITGDVSINPDAQ

SEQ ID NO: 2181227 - protein, 25 aa, Cryptosporidium hominis
SFTRRDIIRIYSRFKALDTNQNGEL

SEQ ID NO: 2181228 - protein, 26 aa, Cryptosporidium hominis
SFVACETCTKTGFIMVFGEITTKANV

SEQ ID NO: 2181229 - protein, 18 aa, Cryptosporidium hominis
SFVTGCRDFFIIDKKHST

SEQ ID NO: 2181230 - protein, 24 aa, Cryptosporidium hominis
SFWYTISSLYSFQGKPMLKPLNWL

SEQ ID NO: 2181231 - protein, 23 aa, Cryptosporidium hominis
SGAELALLCRETMMQVIRRTITN

SEQ ID NO: 2181232 - protein, 19 aa, Cryptosporidium hominis
SGAFASVGMPGMYELDPNM

SEQ ID NO: 2181233 - protein, 22 aa, Cryptosporidium hominis
SGAKLIARGYFRHKCGHTYCNE

SEQ ID NO: 2181234 - protein, 18 aa, Cryptosporidium hominis
SGAPPIKIIERIINSCKI

SEQ ID NO: 2181235 - protein, 18 aa, Cryptosporidium hominis
SGAYMARLVAKSIVFSGL

SEQ ID NO: 2181236 - protein, 25 aa, Cryptosporidium hominis
SGDDVIRLYKACDAVVVPSRNEPFG

SEQ ID NO: 2181237 - protein, 30 aa, Cryptosporidium hominis
SGDINGKVHFWDWKTTKNFRSFNAHEGVSI

SEQ ID NO: 2181238 - protein, 23 aa, Cryptosporidium hominis
SGDKRFPLNFLSYLEDVSVEPCL

SEQ ID NO: 2181239 - protein, 26 aa, Cryptosporidium hominis
SGDRKGNICFWQPIQGGSWSVNPVHG

SEQ ID NO: 2181240 - protein, 17 aa, Cryptosporidium hominis
SGDYWDYDGDGKMSDDE

SEQ ID NO: 2181241 - protein, 24 aa, Cryptosporidium hominis
SGENGRIYASVGYESCNGGITEGN

SEQ ID NO: 2181242 - protein, 19 aa, Cryptosporidium hominis
SGESKVLIATDVLSRGIDV

SEQ ID NO: 2181243 - protein, 23 aa, Cryptosporidium hominis
SGETPINVSNTFSLNNGSAKDYQ

SEQ ID NO: 2181244 - protein, 25 aa, Cryptosporidium hominis
SGEVSKILLMEAFAYNKHKQGESIH

SEQ ID NO: 2181245 - protein, 21 aa, Cryptosporidium hominis
SGEWFCPRCIRGRRRRTNNRR

SEQ ID NO: 2181246 - protein, 19 aa, Cryptosporidium hominis
SGFLESIDPSRFSLHKSLN

SEQ ID NO: 2181247 - protein, 19 aa, Cryptosporidium hominis
SGFSINWVLDADWSFLNNH

SEQ ID NO: 2181248 - protein, 19 aa, Cryptosporidium hominis
SGFTGFCTGLIKGVTSSVV

SEQ ID NO: 2181249 - protein, 22 aa, Cryptosporidium hominis
SGGARLNYVFHNWFGNTLFSFD

SEQ ID NO: 2181250 - protein, 25 aa, Cryptosporidium hominis
SGGESLANLCLRIERVLDNLSQNCG

SEQ ID NO: 2181251 - protein, 37 aa, Cryptosporidium hominis
SGGQRSLLALSLILSMLRFKPAPVYILDEIDSALDLG

SEQ ID NO: 2181252 - protein, 20 aa, Cryptosporidium hominis
SGHIHYAPYVPRRAESATNK

SEQ ID NO: 2181253 - protein, 20 aa, Cryptosporidium hominis
SGICKSRMIHFDIVKGRIML

SEQ ID NO: 2181254 - protein, 19 aa, Cryptosporidium hominis
SGICSGINPSKWGGSVLPK

SEQ ID NO: 2181255 - protein, 26 aa, Cryptosporidium hominis
SGIDPRLSEYYLIYADVLLEKEENST

SEQ ID NO: 2181256 - protein, 22 aa, Cryptosporidium hominis
SGIERLLFFQVLQLFHQIDLNN

SEQ ID NO: 2181257 - protein, 25 aa, Cryptosporidium hominis
SGIHREIFLRNSILQIFRNFTDLIG

SEQ ID NO: 2181258 - protein, 18 aa, Cryptosporidium hominis
SGIITRRTDILTKFKSLY

SEQ ID NO: 2181259 - protein, 17 aa, Cryptosporidium hominis
SGIKITPYYAGHVLGAS

SEQ ID NO: 2181260 - protein, 27 aa, Cryptosporidium hominis
SGILFYEFRLPIIYHIIYLLEILRICI

SEQ ID NO: 2181261 - protein, 17 aa, Cryptosporidium hominis
SGINILRAMMPHANITI

SEQ ID NO: 2181262 - protein, 28 aa, Cryptosporidium hominis
SGINTRNKFLWCIEILHQFYYLNLDLLR

SEQ ID NO: 2181263 - protein, 17 aa, Cryptosporidium hominis
SGISDGFTIELFDTDAE

SEQ ID NO: 2181264 - protein, 18 aa, Cryptosporidium hominis
SGISMPIKVPSSIENIMS

SEQ ID NO: 2181265 - protein, 23 aa, Cryptosporidium hominis
SGIYPSFISLGWQRIESLMNTCR

SEQ ID NO: 2181266 - protein, 27 aa, Cryptosporidium hominis
SGKAFPQCVFDHWELINGDPLEKGSKT

SEQ ID NO: 2181267 - protein, 18 aa, Cryptosporidium hominis
SGKELILALIQYYLDNNE

SEQ ID NO: 2181268 - protein, 23 aa, Cryptosporidium hominis
SGKISTKELFKLFSQADSSIQME

SEQ ID NO: 2181269 - protein, 19 aa, Cryptosporidium hominis
SGKLYLLSRLLFHIRSNTK

SEQ ID NO: 2181270 - protein, 22 aa, Cryptosporidium hominis
SGKPGVVGNLSISTGNVSYIDA

SEQ ID NO: 2181271 - protein, 20 aa, Cryptosporidium hominis
SGKQMDWLGLMEGRVYINEN

SEQ ID NO: 2181272 - protein, 26 aa, Cryptosporidium hominis
SGKSYPKKLAFSFLDEIKRLFIEELG

SEQ ID NO: 2181273 - protein, 17 aa, Cryptosporidium hominis
SGKWLPSSFCYPHSSSI

SEQ ID NO: 2181274 - protein, 24 aa, Cryptosporidium hominis
SGKYASCFSKNHFSIFSLFNKHKL

SEQ ID NO: 2181275 - protein, 24 aa, Cryptosporidium hominis
SGLDEKIRVIKYLWETKRDFNIHE

SEQ ID NO: 2181276 - protein, 17 aa, Cryptosporidium hominis
SGLGGIQGMGGFQGLGG

SEQ ID NO: 2181277 - protein, 23 aa, Cryptosporidium hominis
SGLGPRKAKSLAFYLDSHPGPIS

SEQ ID NO: 2181278 - protein, 23 aa, Cryptosporidium hominis
SGLKELNPYYVLQGDSFSSSKIC

SEQ ID NO: 2181279 - protein, 21 aa, Cryptosporidium hominis
SGLSCISHFNKGYIKYIKNEN

SEQ ID NO: 2181280 - protein, 18 aa, Cryptosporidium hominis
SGMFKIMLQSSGIDEKDV

SEQ ID NO: 2181281 - protein, 25 aa, Cryptosporidium hominis
SGMGADILHALGFNRTSNSDDSDTA

SEQ ID NO: 2181282 - protein, 19 aa, Cryptosporidium hominis
SGNGFGYVKLKIESEDDIW

SEQ ID NO: 2181283 - protein, 17 aa, Cryptosporidium hominis
SGNGNWSPTTLGVGGPN

SEQ ID NO: 2181284 - protein, 31 aa, Cryptosporidium hominis
SGNTPKIPTPMPRTKCSGDQGKKPIPKPRTK

SEQ ID NO: 2181285 - protein, 24 aa, Cryptosporidium hominis
SGPEWKCPFGSEIFTGDDIFETAS

SEQ ID NO: 2181286 - protein, 37 aa, Cryptosporidium hominis
SGPHKLRECIPLAILLRNRLKFALTYTEAKYIVMQRL

SEQ ID NO: 2181287 - protein, 23 aa, Cryptosporidium hominis
SGPLEDRKDVFFYLSDDSHYVPR

SEQ ID NO: 2181288 - protein, 20 aa, Cryptosporidium hominis
SGPNLESWLSLQKSSELKNK

SEQ ID NO: 2181289 - protein, 28 aa, Cryptosporidium hominis
SGQEYVPRIAWIRVRRNMNTWQYEDEKV

SEQ ID NO: 2181290 - protein, 32 aa, Cryptosporidium hominis
SGRAGRVRPGKCFRLYTKLSFITEMEVSNVPE

SEQ ID NO: 2181291 - protein, 23 aa, Cryptosporidium hominis
SGRKCVLDTDISPILEKRIRAKI

SEQ ID NO: 2181292 - protein, 19 aa, Cryptosporidium hominis
SGRLYQGVISRYYPKERIF

SEQ ID NO: 2181293 - protein, 27 aa, Cryptosporidium hominis
SGRMKVLLFRFPDYFGSESLRFFDSED

SEQ ID NO: 2181294 - protein, 18 aa, Cryptosporidium hominis
SGSALVIGAGIGSGTLTG

SEQ ID NO: 2181295 - protein, 19 aa, Cryptosporidium hominis
SGSDGPHMFGTSIKNNSDK

SEQ ID NO: 2181296 - protein, 24 aa, Cryptosporidium hominis
SGSEICTRCGVVVEDRVINEEQEW

SEQ ID NO: 2181297 - protein, 23 aa, Cryptosporidium hominis
SGSETPFTLSLEVNPVYIQLIDI

SEQ ID NO: 2181298 - protein, 36 aa, Cryptosporidium hominis
SGSLPTIRRNSMRGRRRYRRTLLRNYEQPLGQNSHG

SEQ ID NO: 2181299 - protein, 29 aa, Cryptosporidium hominis
SGSLSGTVSRIGSPMIIKGNEMNYSQMTK

SEQ ID NO: 2181300 - protein, 23 aa, Cryptosporidium hominis
SGSSISTSIVNWAEKNNVSERAN

SEQ ID NO: 2181301 - protein, 31 aa, Cryptosporidium hominis
SGSYLYKYPRSCIGSRRFSRYNFEIDLDSGC

SEQ ID NO: 2181302 - protein, 24 aa, Cryptosporidium hominis
SGTGLFGPGSLVWIPCPKEVWRPG

SEQ ID NO: 2181303 - protein, 23 aa, Cryptosporidium hominis
SGTKFWRRTLSEFIQKSLKKEDD

SEQ ID NO: 2181304 - protein, 18 aa, Cryptosporidium hominis
SGTMPTLFNKSNLSENNM

SEQ ID NO: 2181305 - protein, 22 aa, Cryptosporidium hominis
SGTMPVPLAVGFGEACKIASSE

SEQ ID NO: 2181306 - protein, 25 aa, Cryptosporidium hominis
SGTWDGKLILWLSLERSKKNSNNDY

SEQ ID NO: 2181307 - protein, 24 aa, Cryptosporidium hominis
SGVDYKGLLACLDDRMNIAMEDTE

SEQ ID NO: 2181308 - protein, 26 aa, Cryptosporidium hominis
SGVEVNPRIAPGVGVNPPTVASGVGI

SEQ ID NO: 2181309 - protein, 18 aa, Cryptosporidium hominis
SGYDFRTLNNFGVVEDIS

SEQ ID NO: 2181310 - protein, 19 aa, Cryptosporidium hominis
SGYKEAWKKGENRYGDKWE

SEQ ID NO: 2181311 - protein, 26 aa, Cryptosporidium hominis
SGYLKKWSPVIGRGWQSRYFALLEQD

SEQ ID NO: 2181312 - protein, 25 aa, Cryptosporidium hominis
SHAQKYFLKKVRGIAPSTLTMDSKL

SEQ ID NO: 2181313 - protein, 17 aa, Cryptosporidium hominis
SHCFGIFMRFINDKHNG

SEQ ID NO: 2181314 - protein, 24 aa, Cryptosporidium hominis
SHCTEFPGNFIFFLAAAVSDFYIP

SEQ ID NO: 2181315 - protein, 27 aa, Cryptosporidium hominis
SHDSNGIYPWVWCDLVTDQDTATPYNS

SEQ ID NO: 2181316 - protein, 20 aa, Cryptosporidium hominis
SHEKLCPVLSIIRASDFNDG

SEQ ID NO: 2181317 - protein, 23 aa, Cryptosporidium hominis
SHEKLLLQRGIEFLKKKLYTLKN

SEQ ID NO: 2181318 - protein, 18 aa, Cryptosporidium hominis
SHEPCISCSMALVHSRIS

SEQ ID NO: 2181319 - protein, 21 aa, Cryptosporidium hominis
SHESVHITVRMRPEKLQQAEM

SEQ ID NO: 2181320 - protein, 20 aa, Cryptosporidium hominis
SHEVVAWIKKILRCEKTGHS

SEQ ID NO: 2181321 - protein, 18 aa, Cryptosporidium hominis
SHFSECLTQFKWINTQGM

SEQ ID NO: 2181322 - protein, 20 aa, Cryptosporidium hominis
SHGEIRFSLLAVVPDKISVT

SEQ ID NO: 2181323 - protein, 25 aa, Cryptosporidium hominis
SHGKEIKFILSMMLFHQTFLNFISI

SEQ ID NO: 2181324 - protein, 24 aa, Cryptosporidium hominis
SHGPKLPLMVTLGIQYAQGYCDIL

SEQ ID NO: 2181325 - protein, 23 aa, Cryptosporidium hominis
SHGVDVRIARIFNTYGPKMLFND

SEQ ID NO: 2181326 - protein, 32 aa, Cryptosporidium hominis
SHGVPMIHIPMLYDSFTSFRFEHDATSFFQSC

SEQ ID NO: 2181327 - protein, 29 aa, Cryptosporidium hominis
SHHPELFLYSIEVSNRLIKLFSKLGGETL

SEQ ID NO: 2181328 - protein, 24 aa, Cryptosporidium hominis
SHICDKIRLLGCMDSEVLRTKIYC

SEQ ID NO: 2181329 - protein, 19 aa, Cryptosporidium hominis
SHIIGVFIKAMRKIQKINS

SEQ ID NO: 2181330 - protein, 20 aa, Cryptosporidium hominis
SHIQGCLTAPVSVDNCEVSS

SEQ ID NO: 2181331 - protein, 25 aa, Cryptosporidium hominis
SHKTLRFLQEKIKSFSVDGDNVAKE

SEQ ID NO: 2181332 - protein, 20 aa, Cryptosporidium hominis
SHKYRIPFHYLIKHPINALK

SEQ ID NO: 2181333 - protein, 29 aa, Cryptosporidium hominis
SHLKHFVLNRMVLFVAYVLEFWRKSRNSE

SEQ ID NO: 2181334 - protein, 21 aa, Cryptosporidium hominis
SHLKIPLKFIYIGYNISQILS

SEQ ID NO: 2181335 - protein, 20 aa, Cryptosporidium hominis
SHLNMGVAVGSNMNQQNQQQ

SEQ ID NO: 2181336 - protein, 21 aa, Cryptosporidium hominis
SHLRYRNALEIERSNHTNELA

SEQ ID NO: 2181337 - protein, 24 aa, Cryptosporidium hominis
SHNDPSVSQDSFFSSDIQNTSKIS

SEQ ID NO: 2181338 - protein, 23 aa, Cryptosporidium hominis
SHNTFPVTFPTPVNRSISNGSNP

SEQ ID NO: 2181339 - protein, 26 aa, Cryptosporidium hominis
SHNVYWPRRCPFYLSDRSALRYLPDI

SEQ ID NO: 2181340 - protein, 18 aa, Cryptosporidium hominis
SHPFKLHIHDLIKDVWHS

SEQ ID NO: 2181341 - protein, 18 aa, Cryptosporidium hominis
SHPHPSKVHYGGEDAHFY

SEQ ID NO: 2181342 - protein, 19 aa, Cryptosporidium hominis
SHPPFDMFDTYMGKSGNIK

SEQ ID NO: 2181343 - protein, 24 aa, Cryptosporidium hominis
SHQRLRSRMLMVASHRQDQTKRII

SEQ ID NO: 2181344 - protein, 18 aa, Cryptosporidium hominis
SHSFCISCVRGSHECPIC

SEQ ID NO: 2181345 - protein, 31 aa, Cryptosporidium hominis
SHSKSAFSVAIRFRPAVCSEINEIENNSIWE

SEQ ID NO: 2181346 - protein, 32 aa, Cryptosporidium hominis
SHSLETICLLFALKIRYPRQIHLIRGNHEDPV

SEQ ID NO: 2181347 - protein, 20 aa, Cryptosporidium hominis
SHVSDPKLSLSHETKFNESL

SEQ ID NO: 2181348 - protein, 17 aa, Cryptosporidium hominis
SHYKESRQCPINKSPSW

SEQ ID NO: 2181349 - protein, 25 aa, Cryptosporidium hominis
SIADRMTLSWSWKEMIDEDFLPITT

SEQ ID NO: 2181350 - protein, 24 aa, Cryptosporidium hominis
SIAKYSYHILICIINIIEDKSFQL

SEQ ID NO: 2181351 - protein, 17 aa, Cryptosporidium hominis
SIAPICKIFESKILSLV

SEQ ID NO: 2181352 - protein, 18 aa, Cryptosporidium hominis
SICTLEFELHRPLYDWLQ

SEQ ID NO: 2181353 - protein, 19 aa, Cryptosporidium hominis
SIDAWRKNQVPSFITSNNR

SEQ ID NO: 2181354 - protein, 25 aa, Cryptosporidium hominis
SIDEGLELLFLVGFREKQAEDQLRY

SEQ ID NO: 2181355 - protein, 23 aa, Cryptosporidium hominis
SIDSQCISYGFGTLDEFETLEQA

SEQ ID NO: 2181356 - protein, 21 aa, Cryptosporidium hominis
SIDVPRTFPELNIFRDQASQE

SEQ ID NO: 2181357 - protein, 24 aa, Cryptosporidium hominis
SIEEYRWKFYQSDPGNWNNLHLET

SEQ ID NO: 2181358 - protein, 18 aa, Cryptosporidium hominis
SIEFPNLKFTVSFDSQII

SEQ ID NO: 2181359 - protein, 23 aa, Cryptosporidium hominis
SIEGVLYDSIEWIDGKFKESNEN

SEQ ID NO: 2181360 - protein, 18 aa, Cryptosporidium hominis
SIEILKHQEIPIENVIRE

SEQ ID NO: 2181361 - protein, 23 aa, Cryptosporidium hominis
SIEKIKIAFLLSIQKELGELHSI

SEQ ID NO: 2181362 - protein, 19 aa, Cryptosporidium hominis
SIEMFKDSLFFIIFDEADR

SEQ ID NO: 2181363 - protein, 31 aa, Cryptosporidium hominis
SIERVSVLSDKGCAFITFEQEEGAKSAIQWN

SEQ ID NO: 2181364 - protein, 23 aa, Cryptosporidium hominis
SIFDMAFKVLFEIFSIDKDLENL

SEQ ID NO: 2181365 - protein, 17 aa, Cryptosporidium hominis
SIFGCTNVDFNIQKVDF

SEQ ID NO: 2181366 - protein, 30 aa, Cryptosporidium hominis
SIFHRDPDLRCCSYLAYPESDESVYGDSEI

SEQ ID NO: 2181367 - protein, 17 aa, Cryptosporidium hominis
SIFPSLILLPQIEFQGI

SEQ ID NO: 2181368 - protein, 27 aa, Cryptosporidium hominis
SIGDYFISRIVKFVSLTPVDFCVMVIL

SEQ ID NO: 2181369 - protein, 22 aa, Cryptosporidium hominis
SIGEYTLRLELHHLSIDEVSCS

SEQ ID NO: 2181370 - protein, 28 aa, Cryptosporidium hominis
SIGYFTLSLSCLKWLLLSDSDNNISIDE

SEQ ID NO: 2181371 - protein, 17 aa, Cryptosporidium hominis
SIHNRYISLKSKIINHN

SEQ ID NO: 2181372 - protein, 22 aa, Cryptosporidium hominis
SIIFPKECIEYIMNRQGAKSSD

SEQ ID NO: 2181373 - protein, 19 aa, Cryptosporidium hominis
SIIKARRSLSHKLRLISQK

SEQ ID NO: 2181374 - protein, 17 aa, Cryptosporidium hominis
SIIPFGIPVWVQNRDDD

SEQ ID NO: 2181375 - protein, 18 aa, Cryptosporidium hominis
SIIPLRAKISSIIEDLNK

SEQ ID NO: 2181376 - protein, 17 aa, Cryptosporidium hominis
SIISGSMALSKRSSINS

SEQ ID NO: 2181377 - protein, 24 aa, Cryptosporidium hominis
SIISKECAHIRALFKEDENQYRQR

SEQ ID NO: 2181378 - protein, 27 aa, Cryptosporidium hominis
SIITGTDIPIVFKLIGRFINGIFPIIS

SEQ ID NO: 2181379 - protein, 25 aa, Cryptosporidium hominis
SIITRNIFKYFSWKNLIRNVNLTYS

SEQ ID NO: 2181380 - protein, 17 aa, Cryptosporidium hominis
SIIWKELSRISAQLSQE

SEQ ID NO: 2181381 - protein, 19 aa, Cryptosporidium hominis
SIKCFKRAIQYDNRYVYAY

SEQ ID NO: 2181382 - protein, 23 aa, Cryptosporidium hominis
SIKEGWKKNSAALLNAFGGNSGS

SEQ ID NO: 2181383 - protein, 19 aa, Cryptosporidium hominis
SIKGEIGYALPTISPGLER

SEQ ID NO: 2181384 - protein, 32 aa, Cryptosporidium hominis
SIKGHAECVEFCKKFNIPLLILGGGGYTIRNV

SEQ ID NO: 2181385 - protein, 18 aa, Cryptosporidium hominis
SIKGWILDFEKIKLNEFK

SEQ ID NO: 2181386 - protein, 36 aa, Cryptosporidium hominis
SIKLFNVDPCFNFKSEFPINITEPFNLVKSNDSFSS

SEQ ID NO: 2181387 - protein, 23 aa, Cryptosporidium hominis
SIKLKKEGILNIGLKPAPKMETL

SEQ ID NO: 2181388 - protein, 18 aa, Cryptosporidium hominis
SIKYEFPKANSLNSPINE

SEQ ID NO: 2181389 - protein, 17 aa, Cryptosporidium hominis
SILAAKFKKELDVSIKT

SEQ ID NO: 2181390 - protein, 32 aa, Cryptosporidium hominis
SILAEIFTFEFLKEFYGVLDFGSVLKVNILAL

SEQ ID NO: 2181391 - protein, 25 aa, Cryptosporidium hominis
SILAVLRFCRQILKIEIGYDSSLEL

SEQ ID NO: 2181392 - protein, 19 aa, Cryptosporidium hominis
SILEYVIVLSLELLFCDPY

SEQ ID NO: 2181393 - protein, 17 aa, Cryptosporidium hominis
SILGRTFGMCILQDFEA

SEQ ID NO: 2181394 - protein, 18 aa, Cryptosporidium hominis
SILHTIYSIKNCKLINSL

SEQ ID NO: 2181395 - protein, 20 aa, Cryptosporidium hominis
SILIMSGICGMRLNAERIST

SEQ ID NO: 2181396 - protein, 37 aa, Cryptosporidium hominis
SILLDNPFRWVLFPIKYSRLWSLYKKYEVSFWTAEVI

SEQ ID NO: 2181397 - protein, 18 aa, Cryptosporidium hominis
SILLKYWLSLEEKLASKN

SEQ ID NO: 2181398 - protein, 17 aa, Cryptosporidium hominis
SILRLIDDYDYEFEEDD

SEQ ID NO: 2181399 - protein, 20 aa, Cryptosporidium hominis
SILSEDKFAIGTSISESQNG

SEQ ID NO: 2181400 - protein, 17 aa, Cryptosporidium hominis
SILSFALSLMEGLFQSI

SEQ ID NO: 2181401 - protein, 25 aa, Cryptosporidium hominis
SILSLFCSTNCYYLYLDLSISLSET

SEQ ID NO: 2181402 - protein, 21 aa, Cryptosporidium hominis
SIMPELSAKVFRTFNASITLE

SEQ ID NO: 2181403 - protein, 17 aa, Cryptosporidium hominis
SIMVEMNHFPNLLYFLN

SEQ ID NO: 2181404 - protein, 19 aa, Cryptosporidium hominis
SINDGSCAICFQKQANLCQ

SEQ ID NO: 2181405 - protein, 28 aa, Cryptosporidium hominis
SINIKIPYRETSHIPSCLFEQDNTNNLD

SEQ ID NO: 2181406 - protein, 18 aa, Cryptosporidium hominis
SINILKQRLKSIQTKLSI

SEQ ID NO: 2181407 - protein, 26 aa, Cryptosporidium hominis
SINISSRFLLIKVLHRGNFGQVYVGL

SEQ ID NO: 2181408 - protein, 23 aa, Cryptosporidium hominis
SIPDVGGVSPVYGFKDNKNEKDG

SEQ ID NO: 2181409 - protein, 23 aa, Cryptosporidium hominis
SIPGFEVNQSLDLDNKIIMVPIT

SEQ ID NO: 2181410 - protein, 17 aa, Cryptosporidium hominis
SIPHESCFQDLEIVSSL

SEQ ID NO: 2181411 - protein, 33 aa, Cryptosporidium hominis
SIPKHIPDFLPIFPPRLDYCDKFISSQCSNGKD

SEQ ID NO: 2181412 - protein, 33 aa, Cryptosporidium hominis
SIPQFRDVILMSFECPHCGFKNNEIQSGGVLQD

SEQ ID NO: 2181413 - protein, 27 aa, Cryptosporidium hominis
SIPVSCLRPGLRWIQLFDANFIDIQCC

SEQ ID NO: 2181414 - protein, 21 aa, Cryptosporidium hominis
SIQAFKIKFEHILIDMESNKD

SEQ ID NO: 2181415 - protein, 26 aa, Cryptosporidium hominis
SIQCCHGSLIFWNYITINWIRMSPSF

SEQ ID NO: 2181416 - protein, 17 aa, Cryptosporidium hominis
SIQECISILTGDWYIQW

SEQ ID NO: 2181417 - protein, 34 aa, Cryptosporidium hominis
SIQFKRSVWLKSHFIRKRIIDNINDFNLQANVSM

SEQ ID NO: 2181418 - protein, 23 aa, Cryptosporidium hominis
SIQKCNCLYCQTQRVRIFGNYLN

SEQ ID NO: 2181419 - protein, 26 aa, Cryptosporidium hominis
SIQLACPRLSTDWGAYYKKPILNSYE

SEQ ID NO: 2181420 - protein, 20 aa, Cryptosporidium hominis
SIQNKLFCLSKIVNTVEQFS

SEQ ID NO: 2181421 - protein, 24 aa, Cryptosporidium hominis
SIQREILRYILIGANSLSSDEAFL

SEQ ID NO: 2181422 - protein, 29 aa, Cryptosporidium hominis
SIRELLQFRCYKPVLTVYEFLKSKNCLDI

SEQ ID NO: 2181423 - protein, 18 aa, Cryptosporidium hominis
SIRLDFDQLLPIIILGND

SEQ ID NO: 2181424 - protein, 22 aa, Cryptosporidium hominis
SIRLFCFEQMKIISGGNLNKRV

SEQ ID NO: 2181425 - protein, 22 aa, Cryptosporidium hominis
SISCALCSHSGGAMKRTNKDGI

SEQ ID NO: 2181426 - protein, 24 aa, Cryptosporidium hominis
SISEIVLTLFCDLENMGISSRELL

SEQ ID NO: 2181427 - protein, 23 aa, Cryptosporidium hominis
SISELRQLIVWELEKVIYSFSEI

SEQ ID NO: 2181428 - protein, 17 aa, Cryptosporidium hominis
SISFPIYKASLIATDNE

SEQ ID NO: 2181429 - protein, 18 aa, Cryptosporidium hominis
SISKSRFDNAYKGTNGIG

SEQ ID NO: 2181430 - protein, 20 aa, Cryptosporidium hominis
SISLFPDRTGFAIGSIEGRC

SEQ ID NO: 2181431 - protein, 35 aa, Cryptosporidium hominis
SISLIKRLRYISSLKLGIFREILFRVENERQPNPN

SEQ ID NO: 2181432 - protein, 25 aa, Cryptosporidium hominis
SISLYCSWTGVLNSGDFTDLFEDLN

SEQ ID NO: 2181433 - protein, 24 aa, Cryptosporidium hominis
SISNSRIVLSFGFDNLIYSGYMLG

SEQ ID NO: 2181434 - protein, 19 aa, Cryptosporidium hominis
SISNYGCSTSSMTNSTSIQ

SEQ ID NO: 2181435 - protein, 23 aa, Cryptosporidium hominis
SISRISTLSSQGFENLYHELDDD

SEQ ID NO: 2181436 - protein, 27 aa, Cryptosporidium hominis
SISSFPWNYIFKCSRDFSLSQFHSELE

SEQ ID NO: 2181437 - protein, 24 aa, Cryptosporidium hominis
SISSNCYTFIQSCEKLTSVELAQL

SEQ ID NO: 2181438 - protein, 27 aa, Cryptosporidium hominis
SISTRLNCLIQDVFDLRKHKWVKKVHK

SEQ ID NO: 2181439 - protein, 23 aa, Cryptosporidium hominis
SISVIKFLRTCLGTRDDFYYRLF

SEQ ID NO: 2181440 - protein, 26 aa, Cryptosporidium hominis
SITMDSWTPKQMKAMELGGNTRLTEI

SEQ ID NO: 2181441 - protein, 18 aa, Cryptosporidium hominis
SITPSCWSFDRNIKTSIL

SEQ ID NO: 2181442 - protein, 26 aa, Cryptosporidium hominis
SIVFGVLRPNAKWRPGRGNSSKSQAT

SEQ ID NO: 2181443 - protein, 32 aa, Cryptosporidium hominis
SIVFSCKYLPFKFFKVRNLDLFLDLNIDKTEL

SEQ ID NO: 2181444 - protein, 17 aa, Cryptosporidium hominis
SIVLGSGVESLTREIAE

SEQ ID NO: 2181445 - protein, 24 aa, Cryptosporidium hominis
SIVPDVNFKPSFIFVPPTPNNRAD

SEQ ID NO: 2181446 - protein, 30 aa, Cryptosporidium hominis
SIVRKCRSGSIFFPYFLPYIAPYFAEAYTT

SEQ ID NO: 2181447 - protein, 19 aa, Cryptosporidium hominis
SIYLKNWLEHFHLNDTHSY

SEQ ID NO: 2181448 - protein, 24 aa, Cryptosporidium hominis
SIYPFYDCQMVKRLVIKYLDLPEG

SEQ ID NO: 2181449 - protein, 18 aa, Cryptosporidium hominis
SIYRKWIYHSSSVIRHFS

SEQ ID NO: 2181450 - protein, 19 aa, Cryptosporidium hominis
SKAASGWSLLQLDPNCEES

SEQ ID NO: 2181451 - protein, 20 aa, Cryptosporidium hominis
SKADYGLMIFADLRYNKKDK

SEQ ID NO: 2181452 - protein, 18 aa, Cryptosporidium hominis
SKAFPINMLFKSSDNNKP

SEQ ID NO: 2181453 - protein, 19 aa, Cryptosporidium hominis
SKALKEWMMRLDPELLSLQ

SEQ ID NO: 2181454 - protein, 18 aa, Cryptosporidium hominis
SKAMKILIQKGDLIERSD

SEQ ID NO: 2181455 - protein, 18 aa, Cryptosporidium hominis
SKARMLNSELLKKQRELS

SEQ ID NO: 2181456 - protein, 25 aa, Cryptosporidium hominis
SKASLRKFLESTIMDSGEDSINNGT

SEQ ID NO: 2181457 - protein, 23 aa, Cryptosporidium hominis
SKCDNPIKTGCHFNEPINYYKAS

SEQ ID NO: 2181458 - protein, 26 aa, Cryptosporidium hominis
SKCISLEILNQVYLELNKVIGKLKEE

SEQ ID NO: 2181459 - protein, 24 aa, Cryptosporidium hominis
SKCKKLRSLMLISNHIRKIKNLDE

SEQ ID NO: 2181460 - protein, 25 aa, Cryptosporidium hominis
SKCLKRNHKSFGIAGLKDRRGITVQ

SEQ ID NO: 2181461 - protein, 19 aa, Cryptosporidium hominis
SKCQNKCCKSCCRKIQQNL

SEQ ID NO: 2181462 - protein, 24 aa, Cryptosporidium hominis
SKCSSKLSGLGMESFSLSKVSNNI

SEQ ID NO: 2181463 - protein, 20 aa, Cryptosporidium hominis
SKDAIPWNLLFIVKLSEKDT

SEQ ID NO: 2181464 - protein, 20 aa, Cryptosporidium hominis
SKDFKNLVIIGPRKVEKLYN

SEQ ID NO: 2181465 - protein, 21 aa, Cryptosporidium hominis
SKDILMQHGWGIGTGSGSGSG

SEQ ID NO: 2181466 - protein, 23 aa, Cryptosporidium hominis
SKDVYCCSWLRKNIFKKYLYEAS

SEQ ID NO: 2181467 - protein, 19 aa, Cryptosporidium hominis
SKEGLFFYILLENNAKKSS

SEQ ID NO: 2181468 - protein, 18 aa, Cryptosporidium hominis
SKEGYAMDWGNSTSNDYL

SEQ ID NO: 2181469 - protein, 25 aa, Cryptosporidium hominis
SKENEFIPCFALDFTKNSVPSSLIL

SEQ ID NO: 2181470 - protein, 19 aa, Cryptosporidium hominis
SKEQFLFSFFDIKRFDYSK

SEQ ID NO: 2181471 - protein, 19 aa, Cryptosporidium hominis
SKEQLKAKLLQAITEGKEG

SEQ ID NO: 2181472 - protein, 20 aa, Cryptosporidium hominis
SKEQVCWAAFKVFDQDGNGK

SEQ ID NO: 2181473 - protein, 27 aa, Cryptosporidium hominis
SKETFTLPPLWHVAALCTLTMLEEEDK

SEQ ID NO: 2181474 - protein, 24 aa, Cryptosporidium hominis
SKEYLDYFFPLFLLECQQSIQRAK

SEQ ID NO: 2181475 - protein, 17 aa, Cryptosporidium hominis
SKEYLKECIKCELQNIN

SEQ ID NO: 2181476 - protein, 21 aa, Cryptosporidium hominis
SKFAKRYCHYCKAELNSDSNK

SEQ ID NO: 2181477 - protein, 30 aa, Cryptosporidium hominis
SKFDYLLCNGCNRAFHWYCVNRPEFRDLKT

SEQ ID NO: 2181478 - protein, 17 aa, Cryptosporidium hominis
SKFELLLSRFFNNISNC

SEQ ID NO: 2181479 - protein, 18 aa, Cryptosporidium hominis
SKFFLKQSLDEWFKSQEI

SEQ ID NO: 2181480 - protein, 24 aa, Cryptosporidium hominis
SKFKFVQQNCRIFLLKDYNINRNT

SEQ ID NO: 2181481 - protein, 25 aa, Cryptosporidium hominis
SKFKSIRYNPEYAITIRQLYEFIKA

SEQ ID NO: 2181482 - protein, 17 aa, Cryptosporidium hominis
SKFPRKMWQVSESVSKF

SEQ ID NO: 2181483 - protein, 17 aa, Cryptosporidium hominis
SKFQRKSLHLKAIQSQN

SEQ ID NO: 2181484 - protein, 19 aa, Cryptosporidium hominis
SKFSATIPAASTIGENVSS

SEQ ID NO: 2181485 - protein, 20 aa, Cryptosporidium hominis
SKFSSIIDFADPNWEGYSEL

SEQ ID NO: 2181486 - protein, 23 aa, Cryptosporidium hominis
SKGAECPKCGQNIGIYPLQGLVF

SEQ ID NO: 2181487 - protein, 17 aa, Cryptosporidium hominis
SKGCHLRTDIISFLHDI

SEQ ID NO: 2181488 - protein, 23 aa, Cryptosporidium hominis
SKGDITSILGFLHHDACDGKLYR

SEQ ID NO: 2181489 - protein, 24 aa, Cryptosporidium hominis
SKGGKDWRAGRCAGNNIIPASTGA

SEQ ID NO: 2181490 - protein, 24 aa, Cryptosporidium hominis
SKGKESLAVMYSRLYDYFTDEDFE

SEQ ID NO: 2181491 - protein, 23 aa, Cryptosporidium hominis
SKGLQNWIYRLFSTYRSNGTSKE

SEQ ID NO: 2181492 - protein, 21 aa, Cryptosporidium hominis
SKGRPFGFVNFENPDSAKAAV

SEQ ID NO: 2181493 - protein, 21 aa, Cryptosporidium hominis
SKGSFGASLFKNPLRVAKIVD

SEQ ID NO: 2181494 - protein, 39 aa, Cryptosporidium hominis
SKHFLISPNFISFIEFWRLYEEMLKHSGVYNFLHNFDGI

SEQ ID NO: 2181495 - protein, 20 aa, Cryptosporidium hominis
SKHIFGGLFGKSSGNVNNAL

SEQ ID NO: 2181496 - protein, 20 aa, Cryptosporidium hominis
SKHRPPWRTSIDNIINAMQE

SEQ ID NO: 2181497 - protein, 19 aa, Cryptosporidium hominis
SKHSFSLQLSDYFRLLIDR

SEQ ID NO: 2181498 - protein, 23 aa, Cryptosporidium hominis
SKHYKKWIDRLTIIEDVVSHCFG

SEQ ID NO: 2181499 - protein, 19 aa, Cryptosporidium hominis
SKIDAGYDTKLDFTHENNK

SEQ ID NO: 2181500 - protein, 26 aa, Cryptosporidium hominis
SKIDFSVFEEGFYRRYKSFFHDRQAD

SEQ ID NO: 2181501 - protein, 17 aa, Cryptosporidium hominis
SKIEYFLTYADNFATGY

SEQ ID NO: 2181502 - protein, 17 aa, Cryptosporidium hominis
SKIFSCEGCGSKTKSKL

SEQ ID NO: 2181503 - protein, 20 aa, Cryptosporidium hominis
SKIFTYWYPYELDIPIKGYF

SEQ ID NO: 2181504 - protein, 20 aa, Cryptosporidium hominis
SKIGRKEILSIHEIKPGLMV

SEQ ID NO: 2181505 - protein, 19 aa, Cryptosporidium hominis
SKIIKLLKFHTSKSGDSTV

SEQ ID NO: 2181506 - protein, 28 aa, Cryptosporidium hominis
SKIIKQGRANSVVVFFDLWIDDGNVLTT

SEQ ID NO: 2181507 - protein, 17 aa, Cryptosporidium hominis
SKILEIFQDGKICKLDS

SEQ ID NO: 2181508 - protein, 19 aa, Cryptosporidium hominis
SKILTYRSGSFIQANSQGY

SEQ ID NO: 2181509 - protein, 23 aa, Cryptosporidium hominis
SKIMQRKGFIESLKLPYMNGDVL

SEQ ID NO: 2181510 - protein, 38 aa, Cryptosporidium hominis
SKIPCINLKILTKDVLKHVIDFNIGRKTNILSIKLGWP

SEQ ID NO: 2181511 - protein, 23 aa, Cryptosporidium hominis
SKIPFSRSELRVIKYMDPDADAE

SEQ ID NO: 2181512 - protein, 25 aa, Cryptosporidium hominis
SKIPLEIKDKVGIKMIKELLADPNC

SEQ ID NO: 2181513 - protein, 18 aa, Cryptosporidium hominis
SKIRCLFFGRFHGDEESA

SEQ ID NO: 2181514 - protein, 24 aa, Cryptosporidium hominis
SKIREVQTGFQFRLQVPMGSILAS

SEQ ID NO: 2181515 - protein, 24 aa, Cryptosporidium hominis
SKISFPREMGIAFSEKTENESLWF

SEQ ID NO: 2181516 - protein, 22 aa, Cryptosporidium hominis
SKISKRFSNLLGKRPSKTYSDV

SEQ ID NO: 2181517 - protein, 17 aa, Cryptosporidium hominis
SKISLKVLKGSLLGRKV

SEQ ID NO: 2181518 - protein, 18 aa, Cryptosporidium hominis
SKISNLYLKIKIKDDNKT

SEQ ID NO: 2181519 - protein, 26 aa, Cryptosporidium hominis
SKKALRFIRKGVFSRAEIELNDPDLV

SEQ ID NO: 2181520 - protein, 25 aa, Cryptosporidium hominis
SKKECTYCRIEFLQHRILKKAFKVF

SEQ ID NO: 2181521 - protein, 30 aa, Cryptosporidium hominis
SKKELFKFMLKNIGPRPIWTNSGAIGDVNS

SEQ ID NO: 2181522 - protein, 18 aa, Cryptosporidium hominis
SKKHPFRLIFARYYDSHI

SEQ ID NO: 2181523 - protein, 17 aa, Cryptosporidium hominis
SKKKIFISENVGNSNNY

SEQ ID NO: 2181524 - protein, 29 aa, Cryptosporidium hominis
SKKLTQDVFKEWNIPPSISNWKNPMGYTV

SEQ ID NO: 2181525 - protein, 23 aa, Cryptosporidium hominis
SKKNRLFYISKICSKKIDKVIPE

SEQ ID NO: 2181526 - protein, 17 aa, Cryptosporidium hominis
SKKRNLISLKFVSSHNV

SEQ ID NO: 2181527 - protein, 20 aa, Cryptosporidium hominis
SKKRRIIMRLSKLKKGLRGE

SEQ ID NO: 2181528 - protein, 23 aa, Cryptosporidium hominis
SKKWLEEFIHNCVINNKKIIHSI

SEQ ID NO: 2181529 - protein, 21 aa, Cryptosporidium hominis
SKLACACLMLAHKIEGVEESW

SEQ ID NO: 2181530 - protein, 23 aa, Cryptosporidium hominis
SKLCDLWSAGVILYILLCGYPPF

SEQ ID NO: 2181531 - protein, 20 aa, Cryptosporidium hominis
SKLDRLCARLEKASSKEKIS

SEQ ID NO: 2181532 - protein, 25 aa, Cryptosporidium hominis
SKLESYLSLCEDLYLGGISKTQSVS

SEQ ID NO: 2181533 - protein, 21 aa, Cryptosporidium hominis
SKLFATILWLSNFVNAHSHNI

SEQ ID NO: 2181534 - protein, 24 aa, Cryptosporidium hominis
SKLFLDVLNKFDWVESCNCFVNQY

SEQ ID NO: 2181535 - protein, 22 aa, Cryptosporidium hominis
SKLHKVRPSKNCVASDQRSRSL

SEQ ID NO: 2181536 - protein, 18 aa, Cryptosporidium hominis
SKLILNWLEDGVFDALEK

SEQ ID NO: 2181537 - protein, 22 aa, Cryptosporidium hominis
SKLINAFDKAKCTSENSQSGTS

SEQ ID NO: 2181538 - protein, 30 aa, Cryptosporidium hominis
SKLKCAPKLYFIIPRIGYLLSLIDTIQDYY

SEQ ID NO: 2181539 - protein, 20 aa, Cryptosporidium hominis
SKLKDFWLSKVQEFNFEDAT

SEQ ID NO: 2181540 - protein, 18 aa, Cryptosporidium hominis
SKLKELHERITFLEKSNS

SEQ ID NO: 2181541 - protein, 25 aa, Cryptosporidium hominis
SKLKKRTPLSWVWNNQIYDQKSESS

SEQ ID NO: 2181542 - protein, 24 aa, Cryptosporidium hominis
SKLKMIDEVCKRVSMNNLSNYFIS

SEQ ID NO: 2181543 - protein, 18 aa, Cryptosporidium hominis
SKLKNLRFLKSVLGKEII

SEQ ID NO: 2181544 - protein, 20 aa, Cryptosporidium hominis
SKLLMKRRDWHAIRLRLHLW

SEQ ID NO: 2181545 - protein, 19 aa, Cryptosporidium hominis
SKLLPLAVVELDVQNECNY

SEQ ID NO: 2181546 - protein, 18 aa, Cryptosporidium hominis
SKLLTCCSFSEDRTLMLT

SEQ ID NO: 2181547 - protein, 26 aa, Cryptosporidium hominis
SKLNFCTFEFMLSPTLIGVPNTRVRY

SEQ ID NO: 2181548 - protein, 25 aa, Cryptosporidium hominis
SKLPYYLFIHFSRFSKANLNLEKNK

SEQ ID NO: 2181549 - protein, 19 aa, Cryptosporidium hominis
SKLQGLLNILSRSQNIIGN

SEQ ID NO: 2181550 - protein, 21 aa, Cryptosporidium hominis
SKLQLCAVPYMLYQVNLASVT

SEQ ID NO: 2181551 - protein, 17 aa, Cryptosporidium hominis
SKLSKLLSYNSTGVPML

SEQ ID NO: 2181552 - protein, 19 aa, Cryptosporidium hominis
SKLVCIGKCKKVVQAFIED

SEQ ID NO: 2181553 - protein, 17 aa, Cryptosporidium hominis
SKMIIFTKVVRLVDVQV

SEQ ID NO: 2181554 - protein, 22 aa, Cryptosporidium hominis
SKMKELRGSMEVIFNEKISSDD

SEQ ID NO: 2181555 - protein, 22 aa, Cryptosporidium hominis
SKMLIYEILRDVFVEDENLVGI

SEQ ID NO: 2181556 - protein, 21 aa, Cryptosporidium hominis
SKMPTRFPPVVFYTPKELGGL

SEQ ID NO: 2181557 - protein, 19 aa, Cryptosporidium hominis
SKMSYKYCKPIIVSSNKVF

SEQ ID NO: 2181558 - protein, 32 aa, Cryptosporidium hominis
SKMTSKLICYNKWCVSGTPIVRSCSNDLIGLL

SEQ ID NO: 2181559 - protein, 19 aa, Cryptosporidium hominis
SKMVKRLRDELGIIRDLKL

SEQ ID NO: 2181560 - protein, 26 aa, Cryptosporidium hominis
SKMVSSGICINAKYELIGNEINIGHT

SEQ ID NO: 2181561 - protein, 25 aa, Cryptosporidium hominis
SKNDGRLRFRANFNLPKKYAGEKIS

SEQ ID NO: 2181562 - protein, 17 aa, Cryptosporidium hominis
SKNELMFSINQRKNDHD

SEQ ID NO: 2181563 - protein, 22 aa, Cryptosporidium hominis
SKNFPKLICESIINWQNEFRQR

SEQ ID NO: 2181564 - protein, 26 aa, Cryptosporidium hominis
SKNKEAFSLIRWIAIADCIALHITGK

SEQ ID NO: 2181565 - protein, 23 aa, Cryptosporidium hominis
SKNNKFRLGITSLQYIARLTPNK

SEQ ID NO: 2181566 - protein, 25 aa, Cryptosporidium hominis
SKNNWGVGFLESFERKKVCQYIRVD

SEQ ID NO: 2181567 - protein, 18 aa, Cryptosporidium hominis
SKNRILIASKMLRGEIWF

SEQ ID NO: 2181568 - protein, 20 aa, Cryptosporidium hominis
SKNSIKKVLKKVSVSHSNTH

SEQ ID NO: 2181569 - protein, 21 aa, Cryptosporidium hominis
SKNVSIWCLVTLESDNILFSG

SEQ ID NO: 2181570 - protein, 21 aa, Cryptosporidium hominis
SKNYRSFASLIKRICTRLRIK

SEQ ID NO: 2181571 - protein, 22 aa, Cryptosporidium hominis
SKPDCLIGFGGGSPMDASKLVR

SEQ ID NO: 2181572 - protein, 24 aa, Cryptosporidium hominis
SKPDKDGIKHVISYIKDSKGSTIK

SEQ ID NO: 2181573 - protein, 33 aa, Cryptosporidium hominis
SKPLIRSISCWCISRFTPWLALQQGQPILNSAF

SEQ ID NO: 2181574 - protein, 24 aa, Cryptosporidium hominis
SKPNTNFSILMGMNSSMSNRIDSA

SEQ ID NO: 2181575 - protein, 19 aa, Cryptosporidium hominis
SKQELLEFQQRVYDSEIIS

SEQ ID NO: 2181576 - protein, 19 aa, Cryptosporidium hominis
SKQLPANWKYQAATASTLV

SEQ ID NO: 2181577 - protein, 19 aa, Cryptosporidium hominis
SKQRVVLKDVGIRPTIGQG

SEQ ID NO: 2181578 - protein, 24 aa, Cryptosporidium hominis
SKQSTAYNIMGWKFARVSRNPKSL

SEQ ID NO: 2181579 - protein, 17 aa, Cryptosporidium hominis
SKRFRDIQQLSGGEKTM

SEQ ID NO: 2181580 - protein, 26 aa, Cryptosporidium hominis
SKRKEEFPNDITIGGTRLVKVCSKYT

SEQ ID NO: 2181581 - protein, 19 aa, Cryptosporidium hominis
SKRKVHRSLWIPPKSYEHA

SEQ ID NO: 2181582 - protein, 26 aa, Cryptosporidium hominis
SKSAYSFDKSHYWFTPDFTLLSNGGG

SEQ ID NO: 2181583 - protein, 19 aa, Cryptosporidium hominis
SKSGNCLNGKVLISNINKS

SEQ ID NO: 2181584 - protein, 23 aa, Cryptosporidium hominis
SKSLCGSDFYLAPELVRQQEYGP

SEQ ID NO: 2181585 - protein, 26 aa, Cryptosporidium hominis
SKSLKRRLSKSLPNLSKSRRGSYSLT

SEQ ID NO: 2181586 - protein, 20 aa, Cryptosporidium hominis
SKSPIRLCNSVGLIDAGYRG

SEQ ID NO: 2181587 - protein, 24 aa, Cryptosporidium hominis
SKSQLPLIRWVMLEILPILHKLNS

SEQ ID NO: 2181588 - protein, 20 aa, Cryptosporidium hominis
SKSRIGSVNDVWLDDGTDSQ

SEQ ID NO: 2181589 - protein, 17 aa, Cryptosporidium hominis
SKSSPVIGCQSLKWDTF

SEQ ID NO: 2181590 - protein, 31 aa, Cryptosporidium hominis
SKSTLYCSTCMCFYCASCAHMNHVSAGSYHD

SEQ ID NO: 2181591 - protein, 18 aa, Cryptosporidium hominis
SKSTSCLSNNMVIITIKD

SEQ ID NO: 2181592 - protein, 21 aa, Cryptosporidium hominis
SKTCPSFQRKGSLRPSPNTQV

SEQ ID NO: 2181593 - protein, 17 aa, Cryptosporidium hominis
SKTDWRARALASTTLSL

SEQ ID NO: 2181594 - protein, 20 aa, Cryptosporidium hominis
SKTKVGCVQLNILDPRNSPD

SEQ ID NO: 2181595 - protein, 29 aa, Cryptosporidium hominis
SKTLFGKGIYCFNHFVIARGKMNKITQSF

SEQ ID NO: 2181596 - protein, 24 aa, Cryptosporidium hominis
SKTRRELLSNWLFYCQCERCNNPT

SEQ ID NO: 2181597 - protein, 21 aa, Cryptosporidium hominis
SKTYLEKHFKEFANCSKDQLI

SEQ ID NO: 2181598 - protein, 17 aa, Cryptosporidium hominis
SKTYSDVQFSKKLSEPK

SEQ ID NO: 2181599 - protein, 18 aa, Cryptosporidium hominis
SKVAQDIINHFSNISYKE

SEQ ID NO: 2181600 - protein, 18 aa, Cryptosporidium hominis
SKVDRVAQSLGLECLGLV

SEQ ID NO: 2181601 - protein, 28 aa, Cryptosporidium hominis
SKVFDWTGKFLASFEFFGEATVNLIQCG

SEQ ID NO: 2181602 - protein, 23 aa, Cryptosporidium hominis
SKVFSSKLIFHWLTHHILTNFLY

SEQ ID NO: 2181603 - protein, 25 aa, Cryptosporidium hominis
SKVPLMHRVLGFPLSFNHANPKTIA

SEQ ID NO: 2181604 - protein, 20 aa, Cryptosporidium hominis
SKVQIISLFYLLGSDLIPVN

SEQ ID NO: 2181605 - protein, 17 aa, Cryptosporidium hominis
SKVQRRAISSSYIMTGS

SEQ ID NO: 2181606 - protein, 17 aa, Cryptosporidium hominis
SKVSFLIDERYTILSAI

SEQ ID NO: 2181607 - protein, 18 aa, Cryptosporidium hominis
SKWGEVKSVNIIRSPESG

SEQ ID NO: 2181608 - protein, 17 aa, Cryptosporidium hominis
SKYAFKILSKMFDKFYY

SEQ ID NO: 2181609 - protein, 17 aa, Cryptosporidium hominis
SKYDMLMAMANNVISLN

SEQ ID NO: 2181610 - protein, 24 aa, Cryptosporidium hominis
SKYGKFIRFKGIFKAKNSIESDHS

SEQ ID NO: 2181611 - protein, 32 aa, Cryptosporidium hominis
SKYHKIPQFINYKLPSAEIKVDGNIVNSGSNS

SEQ ID NO: 2181612 - protein, 21 aa, Cryptosporidium hominis
SKYILNIFEILLLYHKNPELD

SEQ ID NO: 2181613 - protein, 17 aa, Cryptosporidium hominis
SKYLGAAANSWKPIEDG

SEQ ID NO: 2181614 - protein, 17 aa, Cryptosporidium hominis
SKYPPPNNFDFYNLHKY

SEQ ID NO: 2181615 - protein, 19 aa, Cryptosporidium hominis
SKYSASRLEMLSWLRDIAI

SEQ ID NO: 2181616 - protein, 20 aa, Cryptosporidium hominis
SKYSIALEMIAGGRLYNLVV

SEQ ID NO: 2181617 - protein, 24 aa, Cryptosporidium hominis
SKYSNKLLERWIHKLAKKCINISA

SEQ ID NO: 2181618 - protein, 26 aa, Cryptosporidium hominis
SLADKRFVLLVGHQRITIIDTWSRLN

SEQ ID NO: 2181619 - protein, 24 aa, Cryptosporidium hominis
SLAFLQSHFNYWKSRDLGFFILWK

SEQ ID NO: 2181620 - protein, 18 aa, Cryptosporidium hominis
SLAPMYYRGAAAAIVVYD

SEQ ID NO: 2181621 - protein, 20 aa, Cryptosporidium hominis
SLCEEKSALSKSWEEQYNRV

SEQ ID NO: 2181622 - protein, 17 aa, Cryptosporidium hominis
SLCFRVTRRDIEYFQDK

SEQ ID NO: 2181623 - protein, 19 aa, Cryptosporidium hominis
SLCKIQKANSLPIIQSRLG

SEQ ID NO: 2181624 - protein, 17 aa, Cryptosporidium hominis
SLCLLDYDTGIRPFMPY

SEQ ID NO: 2181625 - protein, 20 aa, Cryptosporidium hominis
SLCNDFRRANNFQNVGNNNF

SEQ ID NO: 2181626 - protein, 20 aa, Cryptosporidium hominis
SLCPIIKPLINKPHLYSQIS

SEQ ID NO: 2181627 - protein, 26 aa, Cryptosporidium hominis
SLCVDLWSVGIILFEMLFGGPPLSDP

SEQ ID NO: 2181628 - protein, 19 aa, Cryptosporidium hominis
SLDKFKVPFIRKNIDKSIT

SEQ ID NO: 2181629 - protein, 20 aa, Cryptosporidium hominis
SLEAIIGGGVSWIPKNSTVN

SEQ ID NO: 2181630 - protein, 19 aa, Cryptosporidium hominis
SLEGEKCFVVMIANISPSS

SEQ ID NO: 2181631 - protein, 23 aa, Cryptosporidium hominis
SLEIIRALEIMYYKGYSEEKVDL

SEQ ID NO: 2181632 - protein, 25 aa, Cryptosporidium hominis
SLEILYRPGIPRSYSKFICPSGTDT

SEQ ID NO: 2181633 - protein, 17 aa, Cryptosporidium hominis
SLEIRFIPDDIVDFQFE

SEQ ID NO: 2181634 - protein, 18 aa, Cryptosporidium hominis
SLEISGKYIKFCVDGDDG

SEQ ID NO: 2181635 - protein, 18 aa, Cryptosporidium hominis
SLEKVFRKYSMQEMLIFS

SEQ ID NO: 2181636 - protein, 18 aa, Cryptosporidium hominis
SLESFLFLREKMIEDQKI

SEQ ID NO: 2181637 - protein, 18 aa, Cryptosporidium hominis
SLESGINILRAMMPHANI

SEQ ID NO: 2181638 - protein, 20 aa, Cryptosporidium hominis
SLESKLAWINSLIYSMNTKA

SEQ ID NO: 2181639 - protein, 23 aa, Cryptosporidium hominis
SLEYMRFSTLFLNKLLIGPIQVK

SEQ ID NO: 2181640 - protein, 24 aa, Cryptosporidium hominis
SLFDFCKTIEKFTFHTETQDYRLR

SEQ ID NO: 2181641 - protein, 18 aa, Cryptosporidium hominis
SLFEVFELNFIVPPEIYL

SEQ ID NO: 2181642 - protein, 17 aa, Cryptosporidium hominis
SLFGRPTQVLSIQHINI

SEQ ID NO: 2181643 - protein, 31 aa, Cryptosporidium hominis
SLFKEAIKIGFIDCFRLFTNGNIDWILVSGN

SEQ ID NO: 2181644 - protein, 17 aa, Cryptosporidium hominis
SLFPKSRQLNFLQNHEK

SEQ ID NO: 2181645 - protein, 24 aa, Cryptosporidium hominis
SLFRIPITAPFRKLIRYFRDVAAI

SEQ ID NO: 2181646 - protein, 18 aa, Cryptosporidium hominis
SLFYYFSNNSIYLKCKQF

SEQ ID NO: 2181647 - protein, 22 aa, Cryptosporidium hominis
SLGEAVCGWNIKFPTFSLSTQN

SEQ ID NO: 2181648 - protein, 18 aa, Cryptosporidium hominis
SLGFKPKYDYIFNGNKDH

SEQ ID NO: 2181649 - protein, 18 aa, Cryptosporidium hominis
SLGKRILLSNGRLLSHLP

SEQ ID NO: 2181650 - protein, 23 aa, Cryptosporidium hominis
SLGRISEKWLYTELASSLSEIPG

SEQ ID NO: 2181651 - protein, 20 aa, Cryptosporidium hominis
SLGSEDVFSFPFIDPPSSSS

SEQ ID NO: 2181652 - protein, 33 aa, Cryptosporidium hominis
SLHLLALLWRCYKICEERGYYDLVSSLSVHLIN

SEQ ID NO: 2181653 - protein, 27 aa, Cryptosporidium hominis
SLIGDELRAVLGLSASAIRGVKVSKQQ

SEQ ID NO: 2181654 - protein, 19 aa, Cryptosporidium hominis
SLIGSLSWTVPTDKDDIIL

SEQ ID NO: 2181655 - protein, 21 aa, Cryptosporidium hominis
SLIHWKGDGSNKFSLNSNKIY

SEQ ID NO: 2181656 - protein, 20 aa, Cryptosporidium hominis
SLIKTWEIFRELSMDENEVY

SEQ ID NO: 2181657 - protein, 22 aa, Cryptosporidium hominis
SLIQKRRLSVDWNDSKKKKTGN

SEQ ID NO: 2181658 - protein, 25 aa, Cryptosporidium hominis
SLIRISESLARMELSEWVKKSHVDE

SEQ ID NO: 2181659 - protein, 18 aa, Cryptosporidium hominis
SLIRLCRSVNRLTKHRNK

SEQ ID NO: 2181660 - protein, 21 aa, Cryptosporidium hominis
SLISDSCYKGGPNNEDQIKFT

SEQ ID NO: 2181661 - protein, 26 aa, Cryptosporidium hominis
SLISDVISVLLFRFGALKNTNILNQI

SEQ ID NO: 2181662 - protein, 23 aa, Cryptosporidium hominis
SLISEPFFPLSFSGNLNRYVTED

SEQ ID NO: 2181663 - protein, 18 aa, Cryptosporidium hominis
SLISESFIQGHFIPVNCP

SEQ ID NO: 2181664 - protein, 24 aa, Cryptosporidium hominis
SLISLKTRNCIVFSPHPRTARSSI

SEQ ID NO: 2181665 - protein, 24 aa, Cryptosporidium hominis
SLIYAIECCTSIPPKCQVYVHAEE

SEQ ID NO: 2181666 - protein, 22 aa, Cryptosporidium hominis
SLKCGLCARIDFSSTDKTPDHG

SEQ ID NO: 2181667 - protein, 20 aa, Cryptosporidium hominis
SLKEKFYFDRILCDVPCSSD

SEQ ID NO: 2181668 - protein, 30 aa, Cryptosporidium hominis
SLKELCGLLLSSFCGILDDFGLETQADEQM

SEQ ID NO: 2181669 - protein, 19 aa, Cryptosporidium hominis
SLKEVLINLCLTITEDSKA

SEQ ID NO: 2181670 - protein, 20 aa, Cryptosporidium hominis
SLKFIPNIRIQLGKYFPLSK

SEQ ID NO: 2181671 - protein, 20 aa, Cryptosporidium hominis
SLKFNNLVTEFQLAKKELEM

SEQ ID NO: 2181672 - protein, 19 aa, Cryptosporidium hominis
SLKFPIIIDQVVRSGNLFY

SEQ ID NO: 2181673 - protein, 19 aa, Cryptosporidium hominis
SLKGERVGAVDIGGSFLTK

SEQ ID NO: 2181674 - protein, 23 aa, Cryptosporidium hominis
SLKGGARLKQFLSEISNVTNGIC

SEQ ID NO: 2181675 - protein, 25 aa, Cryptosporidium hominis
SLKIPDFSAELYISGLGYNPKQNTL

SEQ ID NO: 2181676 - protein, 23 aa, Cryptosporidium hominis
SLKIPEYCFRRRNFKGEGELENS

SEQ ID NO: 2181677 - protein, 26 aa, Cryptosporidium hominis
SLKKKERRKVIIAAILEEAKRRKLAE

SEQ ID NO: 2181678 - protein, 23 aa, Cryptosporidium hominis
SLKLKQFLNHDGLHICSEHIINQ

SEQ ID NO: 2181679 - protein, 24 aa, Cryptosporidium hominis
SLKLPMKLANEFSRFVNNDQFTKR

SEQ ID NO: 2181680 - protein, 26 aa, Cryptosporidium hominis
SLKNLLSIYCSLDIDKRFQLADWRER

SEQ ID NO: 2181681 - protein, 28 aa, Cryptosporidium hominis
SLKYWCKLFKVNLLFPPCKSDNIRRVGN

SEQ ID NO: 2181682 - protein, 27 aa, Cryptosporidium hominis
SLLAYLACYMKNWGPHLIVVPTSVMLN

SEQ ID NO: 2181683 - protein, 21 aa, Cryptosporidium hominis
SLLDIPLVWRDKSFGHKNNHI

SEQ ID NO: 2181684 - protein, 18 aa, Cryptosporidium hominis
SLLEIRMIQFFKDRDSIT

SEQ ID NO: 2181685 - protein, 19 aa, Cryptosporidium hominis
SLLEVLYSCRKRKDIDFTV

SEQ ID NO: 2181686 - protein, 20 aa, Cryptosporidium hominis
SLLEYIHGINRLRIVYKDMI

SEQ ID NO: 2181687 - protein, 27 aa, Cryptosporidium hominis
SLLKNEWKKAFYLILGFDEEKMISYSA

SEQ ID NO: 2181688 - protein, 19 aa, Cryptosporidium hominis
SLLKQEWNEDLTLEQGLHL

SEQ ID NO: 2181689 - protein, 17 aa, Cryptosporidium hominis
SLLKSCYPKVIVMTQTA

SEQ ID NO: 2181690 - protein, 23 aa, Cryptosporidium hominis
SLLLKLRLKCIRKQTFTPQKLID

SEQ ID NO: 2181691 - protein, 19 aa, Cryptosporidium hominis
SLLPSLSTPIHWLEYNGDR

SEQ ID NO: 2181692 - protein, 18 aa, Cryptosporidium hominis
SLLQEDRELLGISNIEDE

SEQ ID NO: 2181693 - protein, 18 aa, Cryptosporidium hominis
SLLRYIQVSHYFEKPTVT

SEQ ID NO: 2181694 - protein, 25 aa, Cryptosporidium hominis
SLLSKNWFNPFGMFAGGYKNDEIYK

SEQ ID NO: 2181695 - protein, 19 aa, Cryptosporidium hominis
SLLSLAWKISFQEIEPLPS

SEQ ID NO: 2181696 - protein, 17 aa, Cryptosporidium hominis
SLLSLNSSIIFHKELVN

SEQ ID NO: 2181697 - protein, 19 aa, Cryptosporidium hominis
SLMKSCCYSIGGSSCTDPV

SEQ ID NO: 2181698 - protein, 25 aa, Cryptosporidium hominis
SLMSYRTSSPYAFSPLEEERANKLY

SEQ ID NO: 2181699 - protein, 26 aa, Cryptosporidium hominis
SLNAFKRELIELFKIEVEILNGIQES

SEQ ID NO: 2181700 - protein, 18 aa, Cryptosporidium hominis
SLNHFAINSFYSFIYSTC

SEQ ID NO: 2181701 - protein, 25 aa, Cryptosporidium hominis
SLNIKWCSINKSWISTDAIALTQSS

SEQ ID NO: 2181702 - protein, 31 aa, Cryptosporidium hominis
SLNKLKSHKIFAVFLRYLQKKGIKYPRNNYG

SEQ ID NO: 2181703 - protein, 19 aa, Cryptosporidium hominis
SLNNCQFLRIIPNECKIYN

SEQ ID NO: 2181704 - protein, 20 aa, Cryptosporidium hominis
SLNYIKTFKFHSTEVSSIQF

SEQ ID NO: 2181705 - protein, 19 aa, Cryptosporidium hominis
SLPAERQNSLILKASKIGN

SEQ ID NO: 2181706 - protein, 23 aa, Cryptosporidium hominis
SLPAWSERKTFCKLVKKNQVVIL

SEQ ID NO: 2181707 - protein, 30 aa, Cryptosporidium hominis
SLPVKFFALFEFLKCITFEPAYISNELMNH

SEQ ID NO: 2181708 - protein, 22 aa, Cryptosporidium hominis
SLQRKCELLELSFNLKGQESEI

SEQ ID NO: 2181709 - protein, 25 aa, Cryptosporidium hominis
SLQSNRIVNWSINFSKNVNNVQELY

SEQ ID NO: 2181710 - protein, 25 aa, Cryptosporidium hominis
SLRARAPCVTIEWYPGGRRLVVGTV

SEQ ID NO: 2181711 - protein, 19 aa, Cryptosporidium hominis
SLRHRSWFIQSTCATAGDG

SEQ ID NO: 2181712 - protein, 17 aa, Cryptosporidium hominis
SLRHSFSQKEVVVGQQF

SEQ ID NO: 2181713 - protein, 24 aa, Cryptosporidium hominis
SLRYDLTVPLARYIATSGLDHLKR

SEQ ID NO: 2181714 - protein, 24 aa, Cryptosporidium hominis
SLSCKGYCFSAAPWSQIAAEASLP

SEQ ID NO: 2181715 - protein, 17 aa, Cryptosporidium hominis
SLSCSTGLIANLENSIK

SEQ ID NO: 2181716 - protein, 20 aa, Cryptosporidium hominis
SLSCSWKRYCEQHTLRKKAD

SEQ ID NO: 2181717 - protein, 25 aa, Cryptosporidium hominis
SLSDLRITSIFQKYGQIVSIKRQDP

SEQ ID NO: 2181718 - protein, 19 aa, Cryptosporidium hominis
SLSECYLQCILQDYKTMSI

SEQ ID NO: 2181719 - protein, 23 aa, Cryptosporidium hominis
SLSIFVKDRMTILTFGYSENVEM

SEQ ID NO: 2181720 - protein, 20 aa, Cryptosporidium hominis
SLSKIWGYSIMEHFDSKQED

SEQ ID NO: 2181721 - protein, 19 aa, Cryptosporidium hominis
SLSLSRINGAIIQIVKLSK

SEQ ID NO: 2181722 - protein, 23 aa, Cryptosporidium hominis
SLSNGESFVFLPVQLIPQLLQKT

SEQ ID NO: 2181723 - protein, 18 aa, Cryptosporidium hominis
SLSPDLYESYGIKSYKYE

SEQ ID NO: 2181724 - protein, 23 aa, Cryptosporidium hominis
SLSPKLKFGYFHMFSSQYEEGYK

SEQ ID NO: 2181725 - protein, 21 aa, Cryptosporidium hominis
SLSPPTPFKAVIELPTVDEGS

SEQ ID NO: 2181726 - protein, 21 aa, Cryptosporidium hominis
SLSPSCENLALACADGSIKMF

SEQ ID NO: 2181727 - protein, 19 aa, Cryptosporidium hominis
SLSSPGILASASWDGTVRI

SEQ ID NO: 2181728 - protein, 21 aa, Cryptosporidium hominis
SLSTSHPVQFISFSPSNQQIL

SEQ ID NO: 2181729 - protein, 19 aa, Cryptosporidium hominis
SLSVFKLKFLYFAENITLF

SEQ ID NO: 2181730 - protein, 29 aa, Cryptosporidium hominis
SLTEIENDCSLCLRQIGISNNIPGVVLQC

SEQ ID NO: 2181731 - protein, 28 aa, Cryptosporidium hominis
SLTELYRYLMVYNYLHIIGSIYRHAKNF

SEQ ID NO: 2181732 - protein, 22 aa, Cryptosporidium hominis
SLTGSFGFGWLSKGMMNIKCQE

SEQ ID NO: 2181733 - protein, 23 aa, Cryptosporidium hominis
SLTINRYLSIFFKVLNNNETEDL

SEQ ID NO: 2181734 - protein, 33 aa, Cryptosporidium hominis
SLTMSKLLHFLGFKKTRISNDVDFLVHLDRGIR

SEQ ID NO: 2181735 - protein, 23 aa, Cryptosporidium hominis
SLTRKEKLCLWNCAQNFLESSEF

SEQ ID NO: 2181736 - protein, 21 aa, Cryptosporidium hominis
SLTTLKSGDYWDYDGDGKMSD

SEQ ID NO: 2181737 - protein, 21 aa, Cryptosporidium hominis
SLTVQCFHEIGSTFIKELSAS

SEQ ID NO: 2181738 - protein, 19 aa, Cryptosporidium hominis
SLTYSLKFTRLTINLNPSF

SEQ ID NO: 2181739 - protein, 20 aa, Cryptosporidium hominis
SLVMEPRIEDSFSQIEYVNQ

SEQ ID NO: 2181740 - protein, 25 aa, Cryptosporidium hominis
SLVSNRVSYSFGFRGPSQTIDTACS

SEQ ID NO: 2181741 - protein, 25 aa, Cryptosporidium hominis
SLYELCTRFITTLSITKSVKSFNDN

SEQ ID NO: 2181742 - protein, 18 aa, Cryptosporidium hominis
SLYMENFSPYVLLLQIDI

SEQ ID NO: 2181743 - protein, 25 aa, Cryptosporidium hominis
SLYNEWSTACSFVNTGDVIEIFGGY

SEQ ID NO: 2181744 - protein, 25 aa, Cryptosporidium hominis
SLYSKIGNWYLPNLGKDYVNKPNNT

SEQ ID NO: 2181745 - protein, 22 aa, Cryptosporidium hominis
SMCKHLKQSLLLQNSGRHRFKH

SEQ ID NO: 2181746 - protein, 25 aa, Cryptosporidium hominis
SMDKVCRWNDIHLLVPRGRYEIEVL

SEQ ID NO: 2181747 - protein, 20 aa, Cryptosporidium hominis
SMDLKCMYKVLKMELLKNPF

SEQ ID NO: 2181748 - protein, 24 aa, Cryptosporidium hominis
SMDLPIIRLRVEYECDSQLINSKR

SEQ ID NO: 2181749 - protein, 25 aa, Cryptosporidium hominis
SMDRISPKLPMVLKDFGNMEFLQPT

SEQ ID NO: 2181750 - protein, 21 aa, Cryptosporidium hominis
SMERVCLFLNLANDPTIERIL

SEQ ID NO: 2181751 - protein, 17 aa, Cryptosporidium hominis
SMFDKYIFKNSIFDDEV

SEQ ID NO: 2181752 - protein, 27 aa, Cryptosporidium hominis
SMGGGVQGMGYRGGIGMQDQPNQQGQI

SEQ ID NO: 2181753 - protein, 17 aa, Cryptosporidium hominis
SMGYGFLEFKTSENAKE

SEQ ID NO: 2181754 - protein, 17 aa, Cryptosporidium hominis
SMHKRMTAVRIRKENQV

SEQ ID NO: 2181755 - protein, 23 aa, Cryptosporidium hominis
SMIGSGWHYYHQILNQYKPCQSM

SEQ ID NO: 2181756 - protein, 17 aa, Cryptosporidium hominis
SMIKHNSCLVVFVGGVT

SEQ ID NO: 2181757 - protein, 29 aa, Cryptosporidium hominis
SMKCKNVKPGECFFGLSPPYVGDDQLGHH

SEQ ID NO: 2181758 - protein, 25 aa, Cryptosporidium hominis
SMKEIGDKILMEFSKDELDCIWTDD

SEQ ID NO: 2181759 - protein, 23 aa, Cryptosporidium hominis
SMKGHAWKDIFHDNTVTWLAYYR

SEQ ID NO: 2181760 - protein, 21 aa, Cryptosporidium hominis
SMKISPRSAIIPSSNQSNKKN

SEQ ID NO: 2181761 - protein, 22 aa, Cryptosporidium hominis
SMKLPCAAIIQPFPLLNDFENP

SEQ ID NO: 2181762 - protein, 29 aa, Cryptosporidium hominis
SMLARKLSCFDWFECESSIVSMKIRQKIL

SEQ ID NO: 2181763 - protein, 20 aa, Cryptosporidium hominis
SMNFKVPRVAYLSDRVQSKN

SEQ ID NO: 2181764 - protein, 26 aa, Cryptosporidium hominis
SMNISQDDKINWSLNIGHSGEIYLNI

SEQ ID NO: 2181765 - protein, 19 aa, Cryptosporidium hominis
SMNLGEDFIPYAISVLQLF

SEQ ID NO: 2181766 - protein, 28 aa, Cryptosporidium hominis
SMPESKFLGPLMPWEYYEPWDPILRPTL

SEQ ID NO: 2181767 - protein, 18 aa, Cryptosporidium hominis
SMSIPIDSTNIFKRQLVK

SEQ ID NO: 2181768 - protein, 24 aa, Cryptosporidium hominis
SMTFKDTYLALAYSRDEYISKVNS

SEQ ID NO: 2181769 - protein, 26 aa, Cryptosporidium hominis
SMTRLQMLKIWKGLYYSMWLSDKVLI

SEQ ID NO: 2181770 - protein, 24 aa, Cryptosporidium hominis
SMVSRLGRCYLWLENKDLVTDQMK

SEQ ID NO: 2181771 - protein, 26 aa, Cryptosporidium hominis
SNASFRPRLNTCSVPFSNSNNSSSTN

SEQ ID NO: 2181772 - protein, 22 aa, Cryptosporidium hominis
SNAVELFALIDLELGEVYSNGV

SEQ ID NO: 2181773 - protein, 28 aa, Cryptosporidium hominis
SNCIKQFRLVFGPLFLPRQFIKYPTESE

SEQ ID NO: 2181774 - protein, 24 aa, Cryptosporidium hominis
SNCLPNYLPFPIFVQIIQARKKKL

SEQ ID NO: 2181775 - protein, 21 aa, Cryptosporidium hominis
SNCSNFLKIREFFVGKQYSVS

SEQ ID NO: 2181776 - protein, 27 aa, Cryptosporidium hominis
SNDITEVFSVLGIEAVRRALLRELRTV

SEQ ID NO: 2181777 - protein, 23 aa, Cryptosporidium hominis
SNDWKRRMVPVLNPPNLNKVNQK

SEQ ID NO: 2181778 - protein, 26 aa, Cryptosporidium hominis
SNECVICKRDKFGVATGLGTELPNVI

SEQ ID NO: 2181779 - protein, 25 aa, Cryptosporidium hominis
SNEDFPEYYHDLFPQFNDSSEEKDV

SEQ ID NO: 2181780 - protein, 18 aa, Cryptosporidium hominis
SNEECTILLLDRSFDTAP

SEQ ID NO: 2181781 - protein, 21 aa, Cryptosporidium hominis
SNEFEYIFPCGKDIHNKEGNI

SEQ ID NO: 2181782 - protein, 24 aa, Cryptosporidium hominis
SNEGRGYVLRRILRRAIRYGSQYL

SEQ ID NO: 2181783 - protein, 19 aa, Cryptosporidium hominis
SNEILTWIRNGFFDGKGDL

SEQ ID NO: 2181784 - protein, 30 aa, Cryptosporidium hominis
SNEKSQMIVDQWFGRLRELQNTSISTRLNC

SEQ ID NO: 2181785 - protein, 25 aa, Cryptosporidium hominis
SNERFKIIYWLSLHSNRLKFQSCTF

SEQ ID NO: 2181786 - protein, 25 aa, Cryptosporidium hominis
SNEWYSLDIPFRLKYGHIRRASIQV

SEQ ID NO: 2181787 - protein, 20 aa, Cryptosporidium hominis
SNFDRYCIELEKKKFKWSFL

SEQ ID NO: 2181788 - protein, 32 aa, Cryptosporidium hominis
SNFEGSYAYGLKQGFGKFSWHDGSKYIGNFDA

SEQ ID NO: 2181789 - protein, 23 aa, Cryptosporidium hominis
SNFRAFHKYNRFMKVALTVIAQQ

SEQ ID NO: 2181790 - protein, 19 aa, Cryptosporidium hominis
SNFSYVFIVFYSISDDLNH

SEQ ID NO: 2181791 - protein, 19 aa, Cryptosporidium hominis
SNGEFIMDLYYSFWNHLIS

SEQ ID NO: 2181792 - protein, 22 aa, Cryptosporidium hominis
SNGFKPKVWLWNSFFYTKLTCD

SEQ ID NO: 2181793 - protein, 34 aa, Cryptosporidium hominis
SNGFMLIMVLLYQMGWIDTAILCQMYYVPKTLQE

SEQ ID NO: 2181794 - protein, 27 aa, Cryptosporidium hominis
SNGKDSLLCIDGWGLIEHHKEDTPVSP

SEQ ID NO: 2181795 - protein, 17 aa, Cryptosporidium hominis
SNGLFGQSMSTFGGNQQ

SEQ ID NO: 2181796 - protein, 21 aa, Cryptosporidium hominis
SNGRYDILAILLAYNSSYLRS

SEQ ID NO: 2181797 - protein, 21 aa, Cryptosporidium hominis
SNHAKFTWRDISFALNKVKPR

SEQ ID NO: 2181798 - protein, 17 aa, Cryptosporidium hominis
SNHCNRKSDLSLSSSSI

SEQ ID NO: 2181799 - protein, 23 aa, Cryptosporidium hominis
SNHKSNENIYEFIYNKIGKCENN

SEQ ID NO: 2181800 - protein, 18 aa, Cryptosporidium hominis
SNHMRILLLDPKWKQQKD

SEQ ID NO: 2181801 - protein, 25 aa, Cryptosporidium hominis
SNIARRFGVEMVFFHGRGGSIGRGG

SEQ ID NO: 2181802 - protein, 26 aa, Cryptosporidium hominis
SNIGINLLQKMGWTEGKGLGKEEVGM

SEQ ID NO: 2181803 - protein, 17 aa, Cryptosporidium hominis
SNIGSSCGIEISSGQSP

SEQ ID NO: 2181804 - protein, 47 aa, Cryptosporidium hominis
SNIINRQGLSSIFYPIFPLVCFPDFVRSGANMEHLMVMDMSYSLELF

SEQ ID NO: 2181805 - protein, 25 aa, Cryptosporidium hominis
SNIIPWGRMVNSLGYWASNLDINSF

SEQ ID NO: 2181806 - protein, 24 aa, Cryptosporidium hominis
SNILDSICFVLGITNLSQIRINKL

SEQ ID NO: 2181807 - protein, 19 aa, Cryptosporidium hominis
SNILKLSKYIVIGDEIPKL

SEQ ID NO: 2181808 - protein, 20 aa, Cryptosporidium hominis
SNIMCPGLTSPGGRMEQVEQ

SEQ ID NO: 2181809 - protein, 18 aa, Cryptosporidium hominis
SNINLGLNSPDGHSDKIF

SEQ ID NO: 2181810 - protein, 24 aa, Cryptosporidium hominis
SNIPKLSPIFKVNLSSGVTPLLLP

SEQ ID NO: 2181811 - protein, 23 aa, Cryptosporidium hominis
SNIPVLAPPPVAEYMPVTTPIIM

SEQ ID NO: 2181812 - protein, 24 aa, Cryptosporidium hominis
SNIQLPSNIPIIFDHKEYKDQESL

SEQ ID NO: 2181813 - protein, 18 aa, Cryptosporidium hominis
SNISDLYNSIAFKIVLDC

SEQ ID NO: 2181814 - protein, 24 aa, Cryptosporidium hominis
SNISIPLEYGQIIDYMILGEFGYG

SEQ ID NO: 2181815 - protein, 25 aa, Cryptosporidium hominis
SNISRCAVCGKTITKGTYRLGVPEY

SEQ ID NO: 2181816 - protein, 24 aa, Cryptosporidium hominis
SNITRKWSELMVKYYGVSNDSDKS

SEQ ID NO: 2181817 - protein, 24 aa, Cryptosporidium hominis
SNIVKFFPRYLIYYPQITSQPLNF

SEQ ID NO: 2181818 - protein, 18 aa, Cryptosporidium hominis
SNIYRRGLIEIPPANDAY

SEQ ID NO: 2181819 - protein, 24 aa, Cryptosporidium hominis
SNKDRLSFTCNWEINENAEIRNVY

SEQ ID NO: 2181820 - protein, 25 aa, Cryptosporidium hominis
SNKITEISRAWVLEAEASKQILDNA

SEQ ID NO: 2181821 - protein, 18 aa, Cryptosporidium hominis
SNKIWVWTVQDFSEEQKL

SEQ ID NO: 2181822 - protein, 23 aa, Cryptosporidium hominis
SNKLKGKFLASIFRVSIGHLLDT

SEQ ID NO: 2181823 - protein, 18 aa, Cryptosporidium hominis
SNKLLLKREKFNNIQNKN

SEQ ID NO: 2181824 - protein, 23 aa, Cryptosporidium hominis
SNKLRFPSIYTELISSKVEYEKL

SEQ ID NO: 2181825 - protein, 21 aa, Cryptosporidium hominis
SNKRKRMRRIPSSSRNISSKM

SEQ ID NO: 2181826 - protein, 21 aa, Cryptosporidium hominis
SNLGRKCYFGLEEDLLKEFQV

SEQ ID NO: 2181827 - protein, 23 aa, Cryptosporidium hominis
SNLGRREAILIERERSMDRREAD

SEQ ID NO: 2181828 - protein, 23 aa, Cryptosporidium hominis
SNLHISSIMSFMINLSKEETLLD

SEQ ID NO: 2181829 - protein, 19 aa, Cryptosporidium hominis
SNLKPRLIKNTSIPGILDS

SEQ ID NO: 2181830 - protein, 30 aa, Cryptosporidium hominis
SNLKSLPATLPWLFELNMDRLFPTMHLLWI

SEQ ID NO: 2181831 - protein, 18 aa, Cryptosporidium hominis
SNLLCFKVTLDSIVNIVD

SEQ ID NO: 2181832 - protein, 27 aa, Cryptosporidium hominis
SNLLRIIAGRSFCKECGISTACQHVRC

SEQ ID NO: 2181833 - protein, 22 aa, Cryptosporidium hominis
SNLLRKTNFCLVDYIHKESNIV

SEQ ID NO: 2181834 - protein, 24 aa, Cryptosporidium hominis
SNLMLCIKCNGSGHIIKEKNVLLR

SEQ ID NO: 2181835 - protein, 18 aa, Cryptosporidium hominis
SNLMRYGKKELLNSSEII

SEQ ID NO: 2181836 - protein, 23 aa, Cryptosporidium hominis
SNLNRLSTFIACNNEIEYIESGF

SEQ ID NO: 2181837 - protein, 32 aa, Cryptosporidium hominis
SNLPNSFLERIFLRYNQLFEIFLCQVNNSDSS

SEQ ID NO: 2181838 - protein, 24 aa, Cryptosporidium hominis
SNLQELFDAWMLYINFEKDRMLSI

SEQ ID NO: 2181839 - protein, 23 aa, Cryptosporidium hominis
SNLQVLLSLPFIGRSYDFQVSYL

SEQ ID NO: 2181840 - protein, 21 aa, Cryptosporidium hominis
SNLRLLANFCNIYYCINPTGD

SEQ ID NO: 2181841 - protein, 24 aa, Cryptosporidium hominis
SNLSLKESLQILGDIVLEQFGPFS

SEQ ID NO: 2181842 - protein, 25 aa, Cryptosporidium hominis
SNLSSRLPLPFPIPIQQQPQLQMVN

SEQ ID NO: 2181843 - protein, 18 aa, Cryptosporidium hominis
SNMIIWKLELTKLNGVRK

SEQ ID NO: 2181844 - protein, 26 aa, Cryptosporidium hominis
SNMQMWRRRWEPCLPHILRSPLSIKE

SEQ ID NO: 2181845 - protein, 17 aa, Cryptosporidium hominis
SNNACFSLQSVSELDSL

SEQ ID NO: 2181846 - protein, 18 aa, Cryptosporidium hominis
SNNICTLRDLANSLKRKI

SEQ ID NO: 2181847 - protein, 30 aa, Cryptosporidium hominis
SNNIPGVVLQCCQQVVCEDCYKDELINKNN

SEQ ID NO: 2181848 - protein, 27 aa, Cryptosporidium hominis
SNNKSVPGWGNWCSSVSRIMDLNIREE

SEQ ID NO: 2181849 - protein, 23 aa, Cryptosporidium hominis
SNNMLQYGWKVERHMKNDDLVLF

SEQ ID NO: 2181850 - protein, 17 aa, Cryptosporidium hominis
SNNRLASGYARLIHSFI

SEQ ID NO: 2181851 - protein, 26 aa, Cryptosporidium hominis
SNPIGEAMKLEFPFKISEDHSTNESL

SEQ ID NO: 2181852 - protein, 17 aa, Cryptosporidium hominis
SNPKYEELMEWLIKEQN

SEQ ID NO: 2181853 - protein, 23 aa, Cryptosporidium hominis
SNPMTRLRFLKFEHILDASEFDI

SEQ ID NO: 2181854 - protein, 25 aa, Cryptosporidium hominis
SNPNVIPCVLQESMIDTENSSQHHH

SEQ ID NO: 2181855 - protein, 29 aa, Cryptosporidium hominis
SNPPFLICEFCSGGTLFNLLHGDSKKCLE

SEQ ID NO: 2181856 - protein, 20 aa, Cryptosporidium hominis
SNPPGSFKPSFAQTVGAIVG

SEQ ID NO: 2181857 - protein, 20 aa, Cryptosporidium hominis
SNQFCFIPNGLEIVGYNSTE

SEQ ID NO: 2181858 - protein, 23 aa, Cryptosporidium hominis
SNQKFILRWIDTQLKEWEKLLKC

SEQ ID NO: 2181859 - protein, 25 aa, Cryptosporidium hominis
SNRCFNFKKHLFNQLQVIGQFNKGF

SEQ ID NO: 2181860 - protein, 21 aa, Cryptosporidium hominis
SNREEFLCYYIIYVTLQNMKA

SEQ ID NO: 2181861 - protein, 24 aa, Cryptosporidium hominis
SNRKPVENYSRFEGFERRLENVIK

SEQ ID NO: 2181862 - protein, 23 aa, Cryptosporidium hominis
SNRYKLLYGKTIKWLGSNTPLHI

SEQ ID NO: 2181863 - protein, 44 aa, Cryptosporidium hominis
SNSEKRRAFNWLVREIENYKSLYLQFLCVTLASNIRPGNNSLLI

SEQ ID NO: 2181864 - protein, 31 aa, Cryptosporidium hominis
SNSEYYLFLTWNNCILGYIPINTNKINKVTL

SEQ ID NO: 2181865 - protein, 32 aa, Cryptosporidium hominis
SNSFLSIRIIHYCILRLLKIRKSIDAIYQTIK

SEQ ID NO: 2181866 - protein, 24 aa, Cryptosporidium hominis
SNSFRSANIEVLKLMLPELSTKFK

SEQ ID NO: 2181867 - protein, 19 aa, Cryptosporidium hominis
SNSFYEKVCELVRDDISEV

SEQ ID NO: 2181868 - protein, 19 aa, Cryptosporidium hominis
SNSGGFCEYIIRSAIKELA

SEQ ID NO: 2181869 - protein, 25 aa, Cryptosporidium hominis
SNSKEVIKCKSILGSLTNLSKYLKN

SEQ ID NO: 2181870 - protein, 23 aa, Cryptosporidium hominis
SNSLKAAAAQMILHEINKNRNQL

SEQ ID NO: 2181871 - protein, 21 aa, Cryptosporidium hominis
SNSPFILPQSHSKSVDLNSLQ

SEQ ID NO: 2181872 - protein, 24 aa, Cryptosporidium hominis
SNSQCLPNSRFLSGSSQLEEQLVS

SEQ ID NO: 2181873 - protein, 30 aa, Cryptosporidium hominis
SNSRKILARVRELWLSNIVEGLPRKIAAFI

SEQ ID NO: 2181874 - protein, 25 aa, Cryptosporidium hominis
SNSRLPSLLCVLGKHLLIANLASEA

SEQ ID NO: 2181875 - protein, 24 aa, Cryptosporidium hominis
SNSRSCPRAGSRQVQRKSIERGRS

SEQ ID NO: 2181876 - protein, 26 aa, Cryptosporidium hominis
SNSVGRLSSFFGNRELSGIASSSSLT

SEQ ID NO: 2181877 - protein, 20 aa, Cryptosporidium hominis
SNTCSKIGVNNCYIDPISPG

SEQ ID NO: 2181878 - protein, 24 aa, Cryptosporidium hominis
SNTELKADINALMLLEKQDQTSYI

SEQ ID NO: 2181879 - protein, 17 aa, Cryptosporidium hominis
SNTEWNKCLKIRQICSG

SEQ ID NO: 2181880 - protein, 17 aa, Cryptosporidium hominis
SNTKFLKSFLRSNTKSN

SEQ ID NO: 2181881 - protein, 17 aa, Cryptosporidium hominis
SNTLFKNTRDCPICRNS

SEQ ID NO: 2181882 - protein, 19 aa, Cryptosporidium hominis
SNTNFPRNVNNQSQNVNSM

SEQ ID NO: 2181883 - protein, 21 aa, Cryptosporidium hominis
SNVIDAMLFVFGKRAKHMRLN

SEQ ID NO: 2181884 - protein, 18 aa, Cryptosporidium hominis
SNVLLLLKVDGWDDILLE

SEQ ID NO: 2181885 - protein, 17 aa, Cryptosporidium hominis
SNVPYCPKRENMINNTG

SEQ ID NO: 2181886 - protein, 24 aa, Cryptosporidium hominis
SNVRFSKCRIITLYRELNRFKDNK

SEQ ID NO: 2181887 - protein, 23 aa, Cryptosporidium hominis
SNWEFPIKKINSGSNHVLVLLSN

SEQ ID NO: 2181888 - protein, 17 aa, Cryptosporidium hominis
SNYFFKLPILKTNTNID

SEQ ID NO: 2181889 - protein, 20 aa, Cryptosporidium hominis
SNYLKPGGFFIGSTISCDHI

SEQ ID NO: 2181890 - protein, 24 aa, Cryptosporidium hominis
SNYRNTCRYMKPLIGMLPNNVVET

SEQ ID NO: 2181891 - protein, 21 aa, Cryptosporidium hominis
SNYYATAFLRYLPGINAKNIK

SEQ ID NO: 2181892 - protein, 27 aa, Cryptosporidium hominis
SPACLHLKKFECELCKVYFPTQLRLID

SEQ ID NO: 2181893 - protein, 20 aa, Cryptosporidium hominis
SPADIFGSFGQDVSGQRQSP

SEQ ID NO: 2181894 - protein, 24 aa, Cryptosporidium hominis
SPAEFKSHLEFGEMILKEGKDQFE

SEQ ID NO: 2181895 - protein, 20 aa, Cryptosporidium hominis
SPAIAFRLLGLRNKLVKKPK

SEQ ID NO: 2181896 - protein, 20 aa, Cryptosporidium hominis
SPCQSPIFLILKPEVPKASE

SEQ ID NO: 2181897 - protein, 18 aa, Cryptosporidium hominis
SPDGRYIASASFDKTIRL

SEQ ID NO: 2181898 - protein, 25 aa, Cryptosporidium hominis
SPEAMDLICSLVCEPSQRIKSAKEA

SEQ ID NO: 2181899 - protein, 23 aa, Cryptosporidium hominis
SPEDKQIFCTQYLPHLLTSIKAH

SEQ ID NO: 2181900 - protein, 24 aa, Cryptosporidium hominis
SPEIIWQYYIELMINEKNIEFADS

SEQ ID NO: 2181901 - protein, 18 aa, Cryptosporidium hominis
SPESMRHREYESFHGNGG

SEQ ID NO: 2181902 - protein, 19 aa, Cryptosporidium hominis
SPETMRRIQRDSGRGPRMG

SEQ ID NO: 2181903 - protein, 28 aa, Cryptosporidium hominis
SPFQPEFWSYRILTSMSIKIKDANDNRI

SEQ ID NO: 2181904 - protein, 26 aa, Cryptosporidium hominis
SPFSSKELKRVFSIEFGVLSPELIRK

SEQ ID NO: 2181905 - protein, 17 aa, Cryptosporidium hominis
SPGKALVLLLLIFDENG

SEQ ID NO: 2181906 - protein, 25 aa, Cryptosporidium hominis
SPGPYEWLYNPLLMNLYGNYSAASQ

SEQ ID NO: 2181907 - protein, 22 aa, Cryptosporidium hominis
SPGSCFWLPAGARLYNKLMDFI

SEQ ID NO: 2181908 - protein, 22 aa, Cryptosporidium hominis
SPGTKECIIFLFELALLQDNKL

SEQ ID NO: 2181909 - protein, 20 aa, Cryptosporidium hominis
SPHWKLPLFGDPLFAILKDL

SEQ ID NO: 2181910 - protein, 25 aa, Cryptosporidium hominis
SPIKNSHIYDRFGLETPSGVLLYGP

SEQ ID NO: 2181911 - protein, 18 aa, Cryptosporidium hominis
SPINPYCRVHPREMIQTG

SEQ ID NO: 2181912 - protein, 17 aa, Cryptosporidium hominis
SPIRRAADILVHQMVYD

SEQ ID NO: 2181913 - protein, 18 aa, Cryptosporidium hominis
SPIRRYADIIVHRLLSAS

SEQ ID NO: 2181914 - protein, 18 aa, Cryptosporidium hominis
SPIVYGFKAEEIINDPNL

SEQ ID NO: 2181915 - protein, 23 aa, Cryptosporidium hominis
SPIYKACRRLDIGGYHLDLALKN

SEQ ID NO: 2181916 - protein, 22 aa, Cryptosporidium hominis
SPKGLPIEIIRSSIYQLLTALK

SEQ ID NO: 2181917 - protein, 19 aa, Cryptosporidium hominis
SPKLCPEICFVKSNEKMNL

SEQ ID NO: 2181918 - protein, 18 aa, Cryptosporidium hominis
SPKLEIIGFYSGLPDEKC

SEQ ID NO: 2181919 - protein, 22 aa, Cryptosporidium hominis
SPKRITVCYNHSISHSLIEELM

SEQ ID NO: 2181920 - protein, 24 aa, Cryptosporidium hominis
SPKSGVSGFGRRVMISNRRLLTPR

SEQ ID NO: 2181921 - protein, 17 aa, Cryptosporidium hominis
SPLELGISEYDYLETDS

SEQ ID NO: 2181922 - protein, 20 aa, Cryptosporidium hominis
SPLEVCLSNLIGIDISSINE

SEQ ID NO: 2181923 - protein, 19 aa, Cryptosporidium hominis
SPLLTLIFVRVCNSICNAN

SEQ ID NO: 2181924 - protein, 19 aa, Cryptosporidium hominis
SPLNLFPFNFGVGNSTNNR

SEQ ID NO: 2181925 - protein, 18 aa, Cryptosporidium hominis
SPLVKNALRRLNKSDILF

SEQ ID NO: 2181926 - protein, 27 aa, Cryptosporidium hominis
SPNFNRLRLQFIFFYYDSNRDGLLSID

SEQ ID NO: 2181927 - protein, 18 aa, Cryptosporidium hominis
SPNKCLNAKCKNANDNES

SEQ ID NO: 2181928 - protein, 25 aa, Cryptosporidium hominis
SPNNRRSTESLAMNYRQSSVPPLDQ

SEQ ID NO: 2181929 - protein, 24 aa, Cryptosporidium hominis
SPNSLLKVIDWGFAAKCPKTHKFT

SEQ ID NO: 2181930 - protein, 24 aa, Cryptosporidium hominis
SPNVKTRFPSVITIFSAPNYCDVY

SEQ ID NO: 2181931 - protein, 19 aa, Cryptosporidium hominis
SPPPLPVSCNNSYSRSLNS

SEQ ID NO: 2181932 - protein, 20 aa, Cryptosporidium hominis
SPPPREIWSGANNEQEFVLL

SEQ ID NO: 2181933 - protein, 22 aa, Cryptosporidium hominis
SPRDELGIYFGSDEKIECIYVN

SEQ ID NO: 2181934 - protein, 21 aa, Cryptosporidium hominis
SPRLTRFNIGWDTKQEDQNLS

SEQ ID NO: 2181935 - protein, 20 aa, Cryptosporidium hominis
SPRMIIIRSFDVNKPGEDAQ

SEQ ID NO: 2181936 - protein, 24 aa, Cryptosporidium hominis
SPRNFRRACLEFQQSPPGVLLASD

SEQ ID NO: 2181937 - protein, 26 aa, Cryptosporidium hominis
SPRQIARLLVLISFFRYLPNPLPKIE

SEQ ID NO: 2181938 - protein, 26 aa, Cryptosporidium hominis
SPSHSALYVTLKFPLPNIVQQFLPSI

SEQ ID NO: 2181939 - protein, 25 aa, Cryptosporidium hominis
SPSNSRRSPKMSYSNAVSGGKPSST

SEQ ID NO: 2181940 - protein, 20 aa, Cryptosporidium hominis
SPSSISYRSKCQSHIFSSFT

SEQ ID NO: 2181941 - protein, 21 aa, Cryptosporidium hominis
SPTAFKGFQKRFFKLNLTDNA

SEQ ID NO: 2181942 - protein, 17 aa, Cryptosporidium hominis
SPTLLKRLAEFKHTSTA

SEQ ID NO: 2181943 - protein, 17 aa, Cryptosporidium hominis
SPTLPSPDTVLLDLGLD

SEQ ID NO: 2181944 - protein, 28 aa, Cryptosporidium hominis
SPTPRSGHRMVVWRHYFVVFGGFHDTIR

SEQ ID NO: 2181945 - protein, 17 aa, Cryptosporidium hominis
SPTYRKNVPQTRSNNNT

SEQ ID NO: 2181946 - protein, 20 aa, Cryptosporidium hominis
SPVIGCQSLKWDTFMRRYNT

SEQ ID NO: 2181947 - protein, 34 aa, Cryptosporidium hominis
SPWIDCIGNLKSFKGNYIAPFGLFGHLKIYDFAL

SEQ ID NO: 2181948 - protein, 22 aa, Cryptosporidium hominis
SPYCSIVSLYLWEISNGDYKDK

SEQ ID NO: 2181949 - protein, 18 aa, Cryptosporidium hominis
SPYYCWGNLEPRDLSPNQ

SEQ ID NO: 2181950 - protein, 29 aa, Cryptosporidium hominis
SPYYDRFSLRLPIIMLFESLLKVDLHRER

SEQ ID NO: 2181951 - protein, 25 aa, Cryptosporidium hominis
SQALKEARRTKGIMLHFPAPESDDE

SEQ ID NO: 2181952 - protein, 17 aa, Cryptosporidium hominis
SQASYWMNDCYRPGDVV

SEQ ID NO: 2181953 - protein, 18 aa, Cryptosporidium hominis
SQCNNMYVFPGIGLAAQI

SEQ ID NO: 2181954 - protein, 25 aa, Cryptosporidium hominis
SQDFKFPFIFSKEIRSSKNVGYHRK

SEQ ID NO: 2181955 - protein, 24 aa, Cryptosporidium hominis
SQDLLELFDSLILIKTLMNKKILK

SEQ ID NO: 2181956 - protein, 48 aa, Cryptosporidium hominis
SQEIKLCSNNGIGLSIIYRRLFSYFIQSIIRYHFENIINKDNNQNFQL

SEQ ID NO: 2181957 - protein, 24 aa, Cryptosporidium hominis
SQEVRIPNQFLWRTYNKKIVDRTH

SEQ ID NO: 2181958 - protein, 21 aa, Cryptosporidium hominis
SQFGHIFAFGMNREEARKHLI

SEQ ID NO: 2181959 - protein, 22 aa, Cryptosporidium hominis
SQFNARVGFSGWFGRNHLTPRG

SEQ ID NO: 2181960 - protein, 17 aa, Cryptosporidium hominis
SQGDPMLEGLEHINHEL

SEQ ID NO: 2181961 - protein, 17 aa, Cryptosporidium hominis
SQGGLVNPFLMMQRMSA

SEQ ID NO: 2181962 - protein, 25 aa, Cryptosporidium hominis
SQGHFRPILTHSFQMEYCLCFDPAI

SEQ ID NO: 2181963 - protein, 23 aa, Cryptosporidium hominis
SQHIHEWIDLIFGFKQRGPQAYS

SEQ ID NO: 2181964 - protein, 20 aa, Cryptosporidium hominis
SQILDSHWSILLKHQSSQFN

SEQ ID NO: 2181965 - protein, 18 aa, Cryptosporidium hominis
SQIMGIKPLFPVKPLLSI

SEQ ID NO: 2181966 - protein, 21 aa, Cryptosporidium hominis
SQIPPILGLQLEVSMGQLTNW

SEQ ID NO: 2181967 - protein, 22 aa, Cryptosporidium hominis
SQIRRVKFQPTLSPIAQSPLSE

SEQ ID NO: 2181968 - protein, 19 aa, Cryptosporidium hominis
SQIRWRKETSLESEIEDKD

SEQ ID NO: 2181969 - protein, 24 aa, Cryptosporidium hominis
SQISILFQYNMELFDAYTNNGFND

SEQ ID NO: 2181970 - protein, 18 aa, Cryptosporidium hominis
SQKQRIQAIESFKSSNSA

SEQ ID NO: 2181971 - protein, 26 aa, Cryptosporidium hominis
SQKVVFPCILKIIPQYIFNARDPIIC

SEQ ID NO: 2181972 - protein, 20 aa, Cryptosporidium hominis
SQLIRIAIEIYKETQYLGRR

SEQ ID NO: 2181973 - protein, 22 aa, Cryptosporidium hominis
SQLLSLSGYQCYLLKKIISSSS

SEQ ID NO: 2181974 - protein, 25 aa, Cryptosporidium hominis
SQLQLLLIFILKIYGAMNVSELLNL

SEQ ID NO: 2181975 - protein, 18 aa, Cryptosporidium hominis
SQLREWIEILQSEFDLLR

SEQ ID NO: 2181976 - protein, 17 aa, Cryptosporidium hominis
SQLVFDYRNRPSLDETI

SEQ ID NO: 2181977 - protein, 17 aa, Cryptosporidium hominis
SQMHKSGVLIGFPQNPK

SEQ ID NO: 2181978 - protein, 34 aa, Cryptosporidium hominis
SQNGSQCLCNFCGHTFDIPMDYLRLLQSQIKTQS

SEQ ID NO: 2181979 - protein, 23 aa, Cryptosporidium hominis
SQNKYKFAILAIEFLDKLIKSNI

SEQ ID NO: 2181980 - protein, 26 aa, Cryptosporidium hominis
SQNNPRRVCICIKWNSSHHLEDNERT

SEQ ID NO: 2181981 - protein, 19 aa, Cryptosporidium hominis
SQQNVQVFKTCPGTDDNPS

SEQ ID NO: 2181982 - protein, 24 aa, Cryptosporidium hominis
SQREYYKSIPIVGSIRYKKQKIDL

SEQ ID NO: 2181983 - protein, 25 aa, Cryptosporidium hominis
SQRGLPSIRWVGGVEIELLAIATGA

SEQ ID NO: 2181984 - protein, 23 aa, Cryptosporidium hominis
SQRLKPGDRWFFGETEIIDKQNS

SEQ ID NO: 2181985 - protein, 18 aa, Cryptosporidium hominis
SQRPSISSNGEWLITASN

SEQ ID NO: 2181986 - protein, 19 aa, Cryptosporidium hominis
SQRRPFHERGLGLSVESQV

SEQ ID NO: 2181987 - protein, 19 aa, Cryptosporidium hominis
SQSCIKDGMTVTVPQSVAQ

SEQ ID NO: 2181988 - protein, 20 aa, Cryptosporidium hominis
SQSHTLFYRFLKFIETHLWT

SEQ ID NO: 2181989 - protein, 17 aa, Cryptosporidium hominis
SQSIKSFDFERDIDSQL

SEQ ID NO: 2181990 - protein, 26 aa, Cryptosporidium hominis
SQSRLEWVQTPILYLFDAFIRNEEQF

SEQ ID NO: 2181991 - protein, 33 aa, Cryptosporidium hominis
SQSRTLVRIITIALCSSLMVIRDISVLLKYPLL

SEQ ID NO: 2181992 - protein, 22 aa, Cryptosporidium hominis
SQVCFKENWAIHKLKHQLGGSN

SEQ ID NO: 2181993 - protein, 17 aa, Cryptosporidium hominis
SQVGLLLLNKVQRKSFK

SEQ ID NO: 2181994 - protein, 30 aa, Cryptosporidium hominis
SQVLLPCAHIICIDCYKLISKKSSSNHKLK

SEQ ID NO: 2181995 - protein, 24 aa, Cryptosporidium hominis
SQYCPTIFWNIVRIFHGEIDLGII

SEQ ID NO: 2181996 - protein, 20 aa, Cryptosporidium hominis
SQYFMWEIFIGFTDPNPNTR

SEQ ID NO: 2181997 - protein, 19 aa, Cryptosporidium hominis
SQYNELWKAIIRPPRDRYS

SEQ ID NO: 2181998 - protein, 22 aa, Cryptosporidium hominis
SRAALYRIVLKDSLACQLMTIH

SEQ ID NO: 2181999 - protein, 29 aa, Cryptosporidium hominis
SRAYSPNNCWRMYCSECIMHNFSSIIKQK

SEQ ID NO: 2182000 - protein, 20 aa, Cryptosporidium hominis
SRCAKFRFQPISANSQIERL

SEQ ID NO: 2182001 - protein, 19 aa, Cryptosporidium hominis
SRCALLPTPDYRILNLGGI

SEQ ID NO: 2182002 - protein, 18 aa, Cryptosporidium hominis
SRCGIIAPCCNNEYWCRH

SEQ ID NO: 2182003 - protein, 24 aa, Cryptosporidium hominis
SRCGQCKRYLTYISNILPQRLYCS

SEQ ID NO: 2182004 - protein, 23 aa, Cryptosporidium hominis
SRDFSFYGENFFHTVERGLSKFG

SEQ ID NO: 2182005 - protein, 29 aa, Cryptosporidium hominis
SRDLPYTIDLCLFLGLKMTTLTSKQTTDS

SEQ ID NO: 2182006 - protein, 50 aa, Cryptosporidium hominis
SREELCAFVSYKMRRATELFTFKCSLYQRELKLYLPEPVPKHRRWIDTFD

SEQ ID NO: 2182007 - protein, 23 aa, Cryptosporidium hominis
SREIKRDFCDGVQYKDSIISSRI

SEQ ID NO: 2182008 - protein, 24 aa, Cryptosporidium hominis
SRELHSMGLLSWGSLRSTPDLGNP

SEQ ID NO: 2182009 - protein, 23 aa, Cryptosporidium hominis
SRENCGWNTFSIVSDEKNWRAVF

SEQ ID NO: 2182010 - protein, 18 aa, Cryptosporidium hominis
SRFGNAFHLCREILRLTK

SEQ ID NO: 2182011 - protein, 17 aa, Cryptosporidium hominis
SRFGRFMQLQLGKMGGI

SEQ ID NO: 2182012 - protein, 26 aa, Cryptosporidium hominis
SRFPPDAWHLCCWLLRKNSNERASPI

SEQ ID NO: 2182013 - protein, 33 aa, Cryptosporidium hominis
SRFSSCVACGRFFCHLCILYIRSSNPCSPIAAH

SEQ ID NO: 2182014 - protein, 25 aa, Cryptosporidium hominis
SRGCTKTRGNFMLAIFAALKSTYAY

SEQ ID NO: 2182015 - protein, 21 aa, Cryptosporidium hominis
SRGGSGIGRLTGRGELGSGTT

SEQ ID NO: 2182016 - protein, 19 aa, Cryptosporidium hominis
SRGLNFPKIDTVIQLDPPQ

SEQ ID NO: 2182017 - protein, 23 aa, Cryptosporidium hominis
SRIESKRSISVPVHENQLSNFHC

SEQ ID NO: 2182018 - protein, 21 aa, Cryptosporidium hominis
SRIGGKLSNSVLSRKCSDSRN

SEQ ID NO: 2182019 - protein, 17 aa, Cryptosporidium hominis
SRILCLCQSFFKLEAPG

SEQ ID NO: 2182020 - protein, 34 aa, Cryptosporidium hominis
SRIPNLSKRLECMILRSSFEQLYLESLKWIEEKI

SEQ ID NO: 2182021 - protein, 23 aa, Cryptosporidium hominis
SRIRFEIPDGYKLQKQSIDFWEF

SEQ ID NO: 2182022 - protein, 19 aa, Cryptosporidium hominis
SRITRAHWGMFDQNIISGH

SEQ ID NO: 2182023 - protein, 21 aa, Cryptosporidium hominis
SRKEIGFVSSQFGDNVDKLDS

SEQ ID NO: 2182024 - protein, 19 aa, Cryptosporidium hominis
SRKFKRILSQMGFEEMPTN

SEQ ID NO: 2182025 - protein, 20 aa, Cryptosporidium hominis
SRKILPKVCCLTRDVFKDPV

SEQ ID NO: 2182026 - protein, 18 aa, Cryptosporidium hominis
SRKNYVLIDISIMIEDVD

SEQ ID NO: 2182027 - protein, 18 aa, Cryptosporidium hominis
SRKVVKYTDFDDEDDELD

SEQ ID NO: 2182028 - protein, 24 aa, Cryptosporidium hominis
SRLATPWSGDIIFWQKVMAENAFA

SEQ ID NO: 2182029 - protein, 18 aa, Cryptosporidium hominis
SRLDKLDIVDGFLSKDDD

SEQ ID NO: 2182030 - protein, 17 aa, Cryptosporidium hominis
SRLFPVQNIGIATFPGR

SEQ ID NO: 2182031 - protein, 20 aa, Cryptosporidium hominis
SRLLLCFLTKQILLKGLDLL

SEQ ID NO: 2182032 - protein, 19 aa, Cryptosporidium hominis
SRLLRFAIDEAHCVCQWGF

SEQ ID NO: 2182033 - protein, 31 aa, Cryptosporidium hominis
SRLPLLCFSEVFKLGSCISQSLKVHDNYQKT

SEQ ID NO: 2182034 - protein, 18 aa, Cryptosporidium hominis
SRLRYVFPNNEYYLNSHF

SEQ ID NO: 2182035 - protein, 19 aa, Cryptosporidium hominis
SRLSMKTLMRNSSSSYYGT

SEQ ID NO: 2182036 - protein, 17 aa, Cryptosporidium hominis
SRLTSVPLTSCNLLNDF

SEQ ID NO: 2182037 - protein, 26 aa, Cryptosporidium hominis
SRNFRCINCHDCPKCMATISTNKLDL

SEQ ID NO: 2182038 - protein, 18 aa, Cryptosporidium hominis
SRNIYVIDFGLAKRFRDP

SEQ ID NO: 2182039 - protein, 28 aa, Cryptosporidium hominis
SRNLHLKLLGFLGKRFPPHVTLERNLTK

SEQ ID NO: 2182040 - protein, 22 aa, Cryptosporidium hominis
SRNLPKSIKWHFIGHLQSNKVK

SEQ ID NO: 2182041 - protein, 20 aa, Cryptosporidium hominis
SRNWGEYCGSLVPMNSNDDR

SEQ ID NO: 2182042 - protein, 24 aa, Cryptosporidium hominis
SRPEIFCPEGYLLKDVKRDSSIQG

SEQ ID NO: 2182043 - protein, 20 aa, Cryptosporidium hominis
SRPFPKTKVRYVQRKFQKET

SEQ ID NO: 2182044 - protein, 18 aa, Cryptosporidium hominis
SRPGKPSNRFSVPTVDIS

SEQ ID NO: 2182045 - protein, 19 aa, Cryptosporidium hominis
SRPIYPHPFKRSTAFLLGN

SEQ ID NO: 2182046 - protein, 18 aa, Cryptosporidium hominis
SRPLTLSMSEWYTKKTQK

SEQ ID NO: 2182047 - protein, 20 aa, Cryptosporidium hominis
SRPNIGRFSVNPGNLNVNGA

SEQ ID NO: 2182048 - protein, 20 aa, Cryptosporidium hominis
SRPYAAISVSAMPQNQNRPL

SEQ ID NO: 2182049 - protein, 21 aa, Cryptosporidium hominis
SRQGECVLFCTPKDVPAYSKH

SEQ ID NO: 2182050 - protein, 19 aa, Cryptosporidium hominis
SRQHFRTVLYLILPKLTSV

SEQ ID NO: 2182051 - protein, 20 aa, Cryptosporidium hominis
SRQIRLLSIMGIITILEDDP

SEQ ID NO: 2182052 - protein, 24 aa, Cryptosporidium hominis
SRQKVGQCGIHFTVLREIKIMNEI

SEQ ID NO: 2182053 - protein, 30 aa, Cryptosporidium hominis
SRQLTRYRLAMYFYEFLKSIKMLTEKGNGV

SEQ ID NO: 2182054 - protein, 25 aa, Cryptosporidium hominis
SRQSDPLRCEISKLGAQVESLKSLC

SEQ ID NO: 2182055 - protein, 23 aa, Cryptosporidium hominis
SRQSIFKMLYLKINKNLIEKEKM

SEQ ID NO: 2182056 - protein, 20 aa, Cryptosporidium hominis
SRREIYLLVEHDFKHVFSDD

SEQ ID NO: 2182057 - protein, 18 aa, Cryptosporidium hominis
SRRGHLSSIIKTQFYNAL

SEQ ID NO: 2182058 - protein, 24 aa, Cryptosporidium hominis
SRRKEVFNILKYNSEFNSINSNMN

SEQ ID NO: 2182059 - protein, 17 aa, Cryptosporidium hominis
SRRNLATIFYLKKLKKL

SEQ ID NO: 2182060 - protein, 20 aa, Cryptosporidium hominis
SRRQCSFSEAKYGKEAASLL

SEQ ID NO: 2182061 - protein, 20 aa, Cryptosporidium hominis
SRRSNTCYLVNKRIDMLPEE

SEQ ID NO: 2182062 - protein, 17 aa, Cryptosporidium hominis
SRSEKDLSQDSKISTFE

SEQ ID NO: 2182063 - protein, 20 aa, Cryptosporidium hominis
SRSFGGISRNACIPEVTSFS

SEQ ID NO: 2182064 - protein, 20 aa, Cryptosporidium hominis
SRSGRVRKMRYSNFSNIDNE

SEQ ID NO: 2182065 - protein, 22 aa, Cryptosporidium hominis
SRSLEPFFMWQISILGNCHTPT

SEQ ID NO: 2182066 - protein, 18 aa, Cryptosporidium hominis
SRSRSLLSKNWFNPFGMF

SEQ ID NO: 2182067 - protein, 28 aa, Cryptosporidium hominis
SRTADIWSLGAILYRITYKRHLFQQPIS

SEQ ID NO: 2182068 - protein, 24 aa, Cryptosporidium hominis
SRTFDGIEFFPGFIGLSNFGNNDS

SEQ ID NO: 2182069 - protein, 19 aa, Cryptosporidium hominis
SRTNLIYTYSSNWFASLVN

SEQ ID NO: 2182070 - protein, 19 aa, Cryptosporidium hominis
SRTRSCTVTDEIFKEDACN

SEQ ID NO: 2182071 - protein, 19 aa, Cryptosporidium hominis
SRTRSISRSKSWDVTSPNM

SEQ ID NO: 2182072 - protein, 18 aa, Cryptosporidium hominis
SRTYDFLISIGINPDGIR

SEQ ID NO: 2182073 - protein, 19 aa, Cryptosporidium hominis
SRVGKVCVAIGIDGKVEGC

SEQ ID NO: 2182074 - protein, 24 aa, Cryptosporidium hominis
SRVKDCKFSVGSGSLYAYGVLDSG

SEQ ID NO: 2182075 - protein, 18 aa, Cryptosporidium hominis
SRVNRLSVLSAITSTQQR

SEQ ID NO: 2182076 - protein, 25 aa, Cryptosporidium hominis
SRVPELEGFKFTSIEKSDVRPFEET

SEQ ID NO: 2182077 - protein, 17 aa, Cryptosporidium hominis
SRVSINFSTNENILQIL

SEQ ID NO: 2182078 - protein, 17 aa, Cryptosporidium hominis
SRVVPGGGASEIASNIA

SEQ ID NO: 2182079 - protein, 20 aa, Cryptosporidium hominis
SRWASPYIIKDIVNIIDNQM

SEQ ID NO: 2182080 - protein, 21 aa, Cryptosporidium hominis
SRWISCPSSVSITFSTMKTPE

SEQ ID NO: 2182081 - protein, 29 aa, Cryptosporidium hominis
SRYLVPLFMRCLYSSLLLLYDYSSYLLSF

SEQ ID NO: 2182082 - protein, 29 aa, Cryptosporidium hominis
SRYRILDIIGEGTFGRVFECEDLKRKRKV

SEQ ID NO: 2182083 - protein, 19 aa, Cryptosporidium hominis
SSACPHLAFSAILCAGIDG

SEQ ID NO: 2182084 - protein, 17 aa, Cryptosporidium hominis
SSAFKNKESCVISSVSS

SEQ ID NO: 2182085 - protein, 17 aa, Cryptosporidium hominis
SSAFLCLEKTINKMRSV

SEQ ID NO: 2182086 - protein, 20 aa, Cryptosporidium hominis
SSALASPWMQSILNDPEIFR

SEQ ID NO: 2182087 - protein, 23 aa, Cryptosporidium hominis
SSAPEECRNEWVINRKNKKLEKP

SEQ ID NO: 2182088 - protein, 20 aa, Cryptosporidium hominis
SSASLGFQNGLPLVAGGGLL

SEQ ID NO: 2182089 - protein, 18 aa, Cryptosporidium hominis
SSASTLYPSFGYLYPEGT

SEQ ID NO: 2182090 - protein, 25 aa, Cryptosporidium hominis
SSATKLFILELMAKINKQLNDSGSN

SEQ ID NO: 2182091 - protein, 23 aa, Cryptosporidium hominis
SSAVFRHECAFVLGQIQVVSTAD

SEQ ID NO: 2182092 - protein, 17 aa, Cryptosporidium hominis
SSCCSFYDIIEAGVTIV

SEQ ID NO: 2182093 - protein, 21 aa, Cryptosporidium hominis
SSCDILKLGYIVRRTPNDRES

SEQ ID NO: 2182094 - protein, 17 aa, Cryptosporidium hominis
SSCGIEISSGQSPNKLG

SEQ ID NO: 2182095 - protein, 18 aa, Cryptosporidium hominis
SSCGVGFARVLIERSSFL

SEQ ID NO: 2182096 - protein, 19 aa, Cryptosporidium hominis
SSCLTESTFQLIIDSVSQK

SEQ ID NO: 2182097 - protein, 29 aa, Cryptosporidium hominis
SSDAIKVCRQVWRESYTEMVRFYKTFTPS

SEQ ID NO: 2182098 - protein, 23 aa, Cryptosporidium hominis
SSDEVPHGLTIVKARTISRQTDS

SEQ ID NO: 2182099 - protein, 20 aa, Cryptosporidium hominis
SSDMWGFGCILMELYTGVLL

SEQ ID NO: 2182100 - protein, 17 aa, Cryptosporidium hominis
SSDTFSDVCAYQRQNSM

SEQ ID NO: 2182101 - protein, 17 aa, Cryptosporidium hominis
SSEAFSFERQAELMEKE

SEQ ID NO: 2182102 - protein, 20 aa, Cryptosporidium hominis
SSECDFSWLSNSWMNYYMNW

SEQ ID NO: 2182103 - protein, 19 aa, Cryptosporidium hominis
SSEGAKKSTSNMTVSATTC

SEQ ID NO: 2182104 - protein, 17 aa, Cryptosporidium hominis
SSEIMRKATRLVDQLLI

SEQ ID NO: 2182105 - protein, 29 aa, Cryptosporidium hominis
SSERYKAMCFSPAFKLKFSHNAFVSLGSL

SEQ ID NO: 2182106 - protein, 24 aa, Cryptosporidium hominis
SSESCGEFLPDVGLAPVGETLPLT

SEQ ID NO: 2182107 - protein, 17 aa, Cryptosporidium hominis
SSFACHLNCDLITIQRK

SEQ ID NO: 2182108 - protein, 17 aa, Cryptosporidium hominis
SSFCCCLQTEDNKKNKN

SEQ ID NO: 2182109 - protein, 21 aa, Cryptosporidium hominis
SSFILTIPMFVASITGMRALL

SEQ ID NO: 2182110 - protein, 22 aa, Cryptosporidium hominis
SSFKNSIKFIPPLPYETIRSIK

SEQ ID NO: 2182111 - protein, 23 aa, Cryptosporidium hominis
SSFLENFGNLILNNDWVLFEDNL

SEQ ID NO: 2182112 - protein, 17 aa, Cryptosporidium hominis
SSFPRVVASFIDSQEDL

SEQ ID NO: 2182113 - protein, 23 aa, Cryptosporidium hominis
SSFSEGLQPVFFQRSNSNSGFIA

SEQ ID NO: 2182114 - protein, 20 aa, Cryptosporidium hominis
SSGALAFSVEYIREVRPEMD

SEQ ID NO: 2182115 - protein, 27 aa, Cryptosporidium hominis
SSGEIIKRCDMFFRLVKYEFNEFQAIE

SEQ ID NO: 2182116 - protein, 23 aa, Cryptosporidium hominis
SSGEVTIFFSLKCYKEDEARDLK

SEQ ID NO: 2182117 - protein, 19 aa, Cryptosporidium hominis
SSGICFKPLPNFSNKPYKR

SEQ ID NO: 2182118 - protein, 23 aa, Cryptosporidium hominis
SSGIPKYLLNRLIDQGIRIEFKN

SEQ ID NO: 2182119 - protein, 32 aa, Cryptosporidium hominis
SSGLICKSITPLRERICLACRKNSLLRHNNQK

SEQ ID NO: 2182120 - protein, 19 aa, Cryptosporidium hominis
SSGRFQASNLLLIIESEQA

SEQ ID NO: 2182121 - protein, 19 aa, Cryptosporidium hominis
SSGTKNCEQTACVKIGDLI

SEQ ID NO: 2182122 - protein, 24 aa, Cryptosporidium hominis
SSGTPCIPPFWHANPALLASAASL

SEQ ID NO: 2182123 - protein, 23 aa, Cryptosporidium hominis
SSGYYRLEVDQAPLITVPVVQEI

SEQ ID NO: 2182124 - protein, 19 aa, Cryptosporidium hominis
SSHNKFRFYNHQSDAIKAI

SEQ ID NO: 2182125 - protein, 19 aa, Cryptosporidium hominis
SSIAALWAKAMSKTGGRTG

SEQ ID NO: 2182126 - protein, 18 aa, Cryptosporidium hominis
SSICGGYLNISAECSKGP

SEQ ID NO: 2182127 - protein, 17 aa, Cryptosporidium hominis
SSIEKFINNNQCLLESH

SEQ ID NO: 2182128 - protein, 17 aa, Cryptosporidium hominis
SSIELLQQVCILVSYLS

SEQ ID NO: 2182129 - protein, 19 aa, Cryptosporidium hominis
SSIFVCGDIDEIYCTSTIN

SEQ ID NO: 2182130 - protein, 33 aa, Cryptosporidium hominis
SSIGKSKPSLSLSKLKSFGKTRIISTSRKAKIQ

SEQ ID NO: 2182131 - protein, 22 aa, Cryptosporidium hominis
SSIHGFGLFAKELIKTGEPIIE

SEQ ID NO: 2182132 - protein, 27 aa, Cryptosporidium hominis
SSIIHPLQCILLIIGILRRSLENPNHS

SEQ ID NO: 2182133 - protein, 19 aa, Cryptosporidium hominis
SSIIPIVFIAGEDRNSRQF

SEQ ID NO: 2182134 - protein, 27 aa, Cryptosporidium hominis
SSIKSCLYCGSVLNTIRYISFYCSLDN

SEQ ID NO: 2182135 - protein, 29 aa, Cryptosporidium hominis
SSIKSSELIARYAILSKLILDSGIEESEE

SEQ ID NO: 2182136 - protein, 17 aa, Cryptosporidium hominis
SSIKVESRAFLKEEQET

SEQ ID NO: 2182137 - protein, 21 aa, Cryptosporidium hominis
SSILMEYFLQFGVILDAVVMY

SEQ ID NO: 2182138 - protein, 23 aa, Cryptosporidium hominis
SSILPSPMSIFLSIKEVLIGVIF

SEQ ID NO: 2182139 - protein, 22 aa, Cryptosporidium hominis
SSINRLGFRDILQKEVQYSNKE

SEQ ID NO: 2182140 - protein, 25 aa, Cryptosporidium hominis
SSINTRIVPFISNYYSLLGDSPNSL

SEQ ID NO: 2182141 - protein, 25 aa, Cryptosporidium hominis
SSIPRYSLKNKLVIVFVIGSITFPE

SEQ ID NO: 2182142 - protein, 19 aa, Cryptosporidium hominis
SSIQRPWVLQRLPKEQLAF

SEQ ID NO: 2182143 - protein, 20 aa, Cryptosporidium hominis
SSIRPISKFFLYEETNDKVN

SEQ ID NO: 2182144 - protein, 20 aa, Cryptosporidium hominis
SSISLLLPICNAYYIGQLLA

SEQ ID NO: 2182145 - protein, 26 aa, Cryptosporidium hominis
SSKCLLARGIPDWDFISNDDKISTLQ

SEQ ID NO: 2182146 - protein, 22 aa, Cryptosporidium hominis
SSKDFRLKRLFYASKSQLKNIS

SEQ ID NO: 2182147 - protein, 19 aa, Cryptosporidium hominis
SSKGEFGTFVSFKEKVLPR

SEQ ID NO: 2182148 - protein, 18 aa, Cryptosporidium hominis
SSKGRRWSNNSTTSTISS

SEQ ID NO: 2182149 - protein, 25 aa, Cryptosporidium hominis
SSKKKICPIAGCNFLVVKKFLKRDQ

SEQ ID NO: 2182150 - protein, 21 aa, Cryptosporidium hominis
SSKLFPIDLIPLLSGATTISF

SEQ ID NO: 2182151 - protein, 17 aa, Cryptosporidium hominis
SSKLGAYSRINGVVTLR

SEQ ID NO: 2182152 - protein, 17 aa, Cryptosporidium hominis
SSKNCLKSTFDQDSEQA

SEQ ID NO: 2182153 - protein, 24 aa, Cryptosporidium hominis
SSKNWFCFQCLSLTLRILPSLIYR

SEQ ID NO: 2182154 - protein, 19 aa, Cryptosporidium hominis
SSKPKLLIYSQIISSTDKN

SEQ ID NO: 2182155 - protein, 24 aa, Cryptosporidium hominis
SSKSCIFCNECVNLTKNYGYINPA

SEQ ID NO: 2182156 - protein, 22 aa, Cryptosporidium hominis
SSKWYKYPWRFTFSDFTNKKMI

SEQ ID NO: 2182157 - protein, 23 aa, Cryptosporidium hominis
SSKYSIKDLMAFPDDSLGRRYGE

SEQ ID NO: 2182158 - protein, 18 aa, Cryptosporidium hominis
SSLCKKAIAILHGKPIES

SEQ ID NO: 2182159 - protein, 17 aa, Cryptosporidium hominis
SSLCSFLTSVYSDTEAK

SEQ ID NO: 2182160 - protein, 19 aa, Cryptosporidium hominis
SSLEAFKMIRKNYHASKYK

SEQ ID NO: 2182161 - protein, 18 aa, Cryptosporidium hominis
SSLFLKRTSVLKTEKKSE

SEQ ID NO: 2182162 - protein, 19 aa, Cryptosporidium hominis
SSLGSVVFDCVKRIPDGIL

SEQ ID NO: 2182163 - protein, 22 aa, Cryptosporidium hominis
SSLHRRIRKFLKVHESGNSQFG

SEQ ID NO: 2182164 - protein, 18 aa, Cryptosporidium hominis
SSLICLAQSTLFSGKIKD

SEQ ID NO: 2182165 - protein, 18 aa, Cryptosporidium hominis
SSLIKQLATQPCIRTPTV

SEQ ID NO: 2182166 - protein, 28 aa, Cryptosporidium hominis
SSLINSLKRGYCVKVGAVAGVTRHLQRI

SEQ ID NO: 2182167 - protein, 19 aa, Cryptosporidium hominis
SSLKKRPAVMQGVELVLLR

SEQ ID NO: 2182168 - protein, 23 aa, Cryptosporidium hominis
SSLKKSWLEDFYRFCQTLNPTSA

SEQ ID NO: 2182169 - protein, 30 aa, Cryptosporidium hominis
SSLKSILPILEFCISSRSPLLIIAEEIEGE

SEQ ID NO: 2182170 - protein, 21 aa, Cryptosporidium hominis
SSLLHPYLNIWSNIRSFFNIL

SEQ ID NO: 2182171 - protein, 18 aa, Cryptosporidium hominis
SSLLIGRKELINYVKTRQ

SEQ ID NO: 2182172 - protein, 17 aa, Cryptosporidium hominis
SSLPIVNFIAISILLAR

SEQ ID NO: 2182173 - protein, 21 aa, Cryptosporidium hominis
SSLSRLGRVWSIIDSEETGSI

SEQ ID NO: 2182174 - protein, 26 aa, Cryptosporidium hominis
SSLVSAIALLCGWSGRKAGKDANLNK

SEQ ID NO: 2182175 - protein, 32 aa, Cryptosporidium hominis
SSLYRISRIKLISFTWRKIVLNAKFSSFKTLP

SEQ ID NO: 2182176 - protein, 17 aa, Cryptosporidium hominis
SSMFKDNINLIYLSTNF

SEQ ID NO: 2182177 - protein, 23 aa, Cryptosporidium hominis
SSMLKKYTARYEIQIPPDNQFQI

SEQ ID NO: 2182178 - protein, 22 aa, Cryptosporidium hominis
SSMSRPAFNIKVGGAQNIPPSI

SEQ ID NO: 2182179 - protein, 27 aa, Cryptosporidium hominis
SSNEFCPKVPWLFQLMEYCNSGSLDTL

SEQ ID NO: 2182180 - protein, 36 aa, Cryptosporidium hominis
SSNEGYNKCELFNSWAYKLLHRQSIIAYLQGNISKN

SEQ ID NO: 2182181 - protein, 24 aa, Cryptosporidium hominis
SSNIPENWPKLLPISKTLKSIEIE

SEQ ID NO: 2182182 - protein, 22 aa, Cryptosporidium hominis
SSNIRMGNNSSRLINGSGNGEI

SEQ ID NO: 2182183 - protein, 23 aa, Cryptosporidium hominis
SSNKGIIVPGIFDSATLNSEGVV

SEQ ID NO: 2182184 - protein, 32 aa, Cryptosporidium hominis
SSNKSWKEWFIPKHSIWCLFYFFYQRYPKYTV

SEQ ID NO: 2182185 - protein, 24 aa, Cryptosporidium hominis
SSNNKLLFVNKFVWIRSIPMGRFI

SEQ ID NO: 2182186 - protein, 23 aa, Cryptosporidium hominis
SSNNLPSIVGFSGVSGQSSSEIM

SEQ ID NO: 2182187 - protein, 20 aa, Cryptosporidium hominis
SSNNNLLEWYNSLKQKIKNT

SEQ ID NO: 2182188 - protein, 25 aa, Cryptosporidium hominis
SSNPIIVHFDFFKSYWKSQEIHITL

SEQ ID NO: 2182189 - protein, 19 aa, Cryptosporidium hominis
SSNVPEWLSDLAGPGISLP

SEQ ID NO: 2182190 - protein, 19 aa, Cryptosporidium hominis
SSNYEWIFISSHKLRCRPK

SEQ ID NO: 2182191 - protein, 18 aa, Cryptosporidium hominis
SSPCTIHSINIIGGENGK

SEQ ID NO: 2182192 - protein, 18 aa, Cryptosporidium hominis
SSPDVLVQKGMTFNLSIG

SEQ ID NO: 2182193 - protein, 17 aa, Cryptosporidium hominis
SSPIRKWVKKKRVNYSM

SEQ ID NO: 2182194 - protein, 18 aa, Cryptosporidium hominis
SSPNNIIIIFSGRERHLL

SEQ ID NO: 2182195 - protein, 17 aa, Cryptosporidium hominis
SSPPLALIEEFQSDRKR

SEQ ID NO: 2182196 - protein, 17 aa, Cryptosporidium hominis
SSPPLLFILICSSNTDS

SEQ ID NO: 2182197 - protein, 23 aa, Cryptosporidium hominis
SSPRLLCPEDYILQYSRCIKQIE

SEQ ID NO: 2182198 - protein, 18 aa, Cryptosporidium hominis
SSQGGIYLLFSIKDDPKF

SEQ ID NO: 2182199 - protein, 19 aa, Cryptosporidium hominis
SSQISRIYVGSLDYSLNEA

SEQ ID NO: 2182200 - protein, 22 aa, Cryptosporidium hominis
SSQQRLIYKGRILKDSDSLDGM

SEQ ID NO: 2182201 - protein, 23 aa, Cryptosporidium hominis
SSQSGTFPKFFGVNYPLEENESM

SEQ ID NO: 2182202 - protein, 19 aa, Cryptosporidium hominis
SSQTWVLCGYALHELGNIR

SEQ ID NO: 2182203 - protein, 20 aa, Cryptosporidium hominis
SSQVKQPNWTGGKELSQQNS

SEQ ID NO: 2182204 - protein, 19 aa, Cryptosporidium hominis
SSRADYVICPSTYNEVMEK

SEQ ID NO: 2182205 - protein, 21 aa, Cryptosporidium hominis
SSRIPLTLKEEVFSVNNLISG

SEQ ID NO: 2182206 - protein, 19 aa, Cryptosporidium hominis
SSRLEVLGIGMGQMNNFPE

SEQ ID NO: 2182207 - protein, 22 aa, Cryptosporidium hominis
SSRRFLLPVSECEYSLMNILDD

SEQ ID NO: 2182208 - protein, 17 aa, Cryptosporidium hominis
SSSCCFYLFESNRSEIR

SEQ ID NO: 2182209 - protein, 20 aa, Cryptosporidium hominis
SSSCLKRLDNGGFPRFQDIS

SEQ ID NO: 2182210 - protein, 23 aa, Cryptosporidium hominis
SSSDSGYFCPFYATREIESVCNV

SEQ ID NO: 2182211 - protein, 24 aa, Cryptosporidium hominis
SSSEFKASLYIEYGQLKVGQSYHV

SEQ ID NO: 2182212 - protein, 25 aa, Cryptosporidium hominis
SSSFFFKRVVINPAFYDPNVFQVEI

SEQ ID NO: 2182213 - protein, 17 aa, Cryptosporidium hominis
SSSFGVGIGQQGVSQSI

SEQ ID NO: 2182214 - protein, 22 aa, Cryptosporidium hominis
SSSFSSGMGFQGGVSKSVSTST

SEQ ID NO: 2182215 - protein, 17 aa, Cryptosporidium hominis
SSSGVQAMSLRGGVDLF

SEQ ID NO: 2182216 - protein, 21 aa, Cryptosporidium hominis
SSSHLLKRYIVISRFEDMDEF

SEQ ID NO: 2182217 - protein, 21 aa, Cryptosporidium hominis
SSSIHLLRLSFSMRNISESEL

SEQ ID NO: 2182218 - protein, 26 aa, Cryptosporidium hominis
SSSLDWNTWFCKSVDIAIMQSVEAYS

SEQ ID NO: 2182219 - protein, 24 aa, Cryptosporidium hominis
SSSLLPRRRTIILNIEADHIFNSV

SEQ ID NO: 2182220 - protein, 18 aa, Cryptosporidium hominis
SSSMLPEYITIDRKNKNP

SEQ ID NO: 2182221 - protein, 26 aa, Cryptosporidium hominis
SSSNMKRSFSLEFLSQALGDDTPEKE

SEQ ID NO: 2182222 - protein, 26 aa, Cryptosporidium hominis
SSSRKPRKSLNFEQSPSLTIFSPDTL

SEQ ID NO: 2182223 - protein, 24 aa, Cryptosporidium hominis
SSSSPCYSNFYLICSGFNDHSNTL

SEQ ID NO: 2182224 - protein, 21 aa, Cryptosporidium hominis
SSSSYAECYLEVDGVSHYETH

SEQ ID NO: 2182225 - protein, 17 aa, Cryptosporidium hominis
SSSYIYFLLYNTIIYLE

SEQ ID NO: 2182226 - protein, 18 aa, Cryptosporidium hominis
SSTAALLATRFNKEVPNF

SEQ ID NO: 2182227 - protein, 23 aa, Cryptosporidium hominis
SSTALSTVVAWPRGDGCSEAIDA

SEQ ID NO: 2182228 - protein, 20 aa, Cryptosporidium hominis
SSTCALIKMCRWSQDGKYLA

SEQ ID NO: 2182229 - protein, 21 aa, Cryptosporidium hominis
SSTIRCPKKLISKVNLSNDFK

SEQ ID NO: 2182230 - protein, 25 aa, Cryptosporidium hominis
SSTIRIKLYFLLAFLHSVILERKRY

SEQ ID NO: 2182231 - protein, 26 aa, Cryptosporidium hominis
SSTLKSLFKVGGVFRRCGYLSNSSFN

SEQ ID NO: 2182232 - protein, 24 aa, Cryptosporidium hominis
SSTSLPLPIPLIAKNNQFQGTSGL

SEQ ID NO: 2182233 - protein, 25 aa, Cryptosporidium hominis
SSVLFPRLLTLFFHYPEDQNSKISF

SEQ ID NO: 2182234 - protein, 25 aa, Cryptosporidium hominis
SSVMRIRNSLAFAIHEYFQKNGFLY

SEQ ID NO: 2182235 - protein, 22 aa, Cryptosporidium hominis
SSVRRKNCIKNYLVSSDTEIDD

SEQ ID NO: 2182236 - protein, 17 aa, Cryptosporidium hominis
SSVRSYIHHIGRTARGG

SEQ ID NO: 2182237 - protein, 23 aa, Cryptosporidium hominis
SSWFVSDPWIWLDLIETSFLPLI

SEQ ID NO: 2182238 - protein, 19 aa, Cryptosporidium hominis
SSWIDAIVCDPPYGIRATS

SEQ ID NO: 2182239 - protein, 25 aa, Cryptosporidium hominis
SSYDRGMFHACVYKTKIISAAPPSA

SEQ ID NO: 2182240 - protein, 18 aa, Cryptosporidium hominis
SSYIAIALEDGSWSIRKK

SEQ ID NO: 2182241 - protein, 20 aa, Cryptosporidium hominis
SSYLKSPLILGVEPKNVENF

SEQ ID NO: 2182242 - protein, 18 aa, Cryptosporidium hominis
SSYLPHIYSATLGLKNGF

SEQ ID NO: 2182243 - protein, 27 aa, Cryptosporidium hominis
SSYSDLIYFDICINGIILLDDEFKESN

SEQ ID NO: 2182244 - protein, 17 aa, Cryptosporidium hominis
STAHWKEVNSGEVELDD

SEQ ID NO: 2182245 - protein, 22 aa, Cryptosporidium hominis
STAKRAMRFARARLGTERRAKK

SEQ ID NO: 2182246 - protein, 21 aa, Cryptosporidium hominis
STAMRCIDDVILLSKSLSPIF

SEQ ID NO: 2182247 - protein, 22 aa, Cryptosporidium hominis
STCPTLLSSVSLVFLNIETFGG

SEQ ID NO: 2182248 - protein, 20 aa, Cryptosporidium hominis
STDDFLVFVKRNDKVPLSLV

SEQ ID NO: 2182249 - protein, 19 aa, Cryptosporidium hominis
STDIDICINWILTNIDSIN

SEQ ID NO: 2182250 - protein, 23 aa, Cryptosporidium hominis
STEDARHSVRFENGLVLMTKRFI

SEQ ID NO: 2182251 - protein, 17 aa, Cryptosporidium hominis
STEFCRLLLSPNSTSLI

SEQ ID NO: 2182252 - protein, 18 aa, Cryptosporidium hominis
STEHCCILRCQYFGDMSS

SEQ ID NO: 2182253 - protein, 24 aa, Cryptosporidium hominis
STEKTRIYVPLSIETKDDNAFFSN

SEQ ID NO: 2182254 - protein, 19 aa, Cryptosporidium hominis
STELHGFLPQEKRLENFSK

SEQ ID NO: 2182255 - protein, 19 aa, Cryptosporidium hominis
STELPRYGVPVGLANFSAA

SEQ ID NO: 2182256 - protein, 18 aa, Cryptosporidium hominis
STFEKRVANLFQRLSTIQ

SEQ ID NO: 2182257 - protein, 24 aa, Cryptosporidium hominis
STGCCPPGYYIVYINKVMGKEETI

SEQ ID NO: 2182258 - protein, 25 aa, Cryptosporidium hominis
STHSHSKYRGLHLISNQSDSDSSDP

SEQ ID NO: 2182259 - protein, 22 aa, Cryptosporidium hominis
STIDFDYNWRSIFTDIKRDIQR

SEQ ID NO: 2182260 - protein, 19 aa, Cryptosporidium hominis
STIEDIGWFGTLKSYNKSM

SEQ ID NO: 2182261 - protein, 27 aa, Cryptosporidium hominis
STIEPIRCLRCRAYANPFTCVSQNGSQ

SEQ ID NO: 2182262 - protein, 24 aa, Cryptosporidium hominis
STILSRFDLIFLLKDEKNVERDKL

SEQ ID NO: 2182263 - protein, 19 aa, Cryptosporidium hominis
STIMSRSDISTCEDVISLS

SEQ ID NO: 2182264 - protein, 17 aa, Cryptosporidium hominis
STINEHQIILAIVYQNA

SEQ ID NO: 2182265 - protein, 19 aa, Cryptosporidium hominis
STITCPGISISSSTIETNS

SEQ ID NO: 2182266 - protein, 26 aa, Cryptosporidium hominis
STIYMAYYTICHFFHSDFEGRSKGLM

SEQ ID NO: 2182267 - protein, 22 aa, Cryptosporidium hominis
STKCVEFLKSVSFLPQQILETN

SEQ ID NO: 2182268 - protein, 19 aa, Cryptosporidium hominis
STKDEFLCDSKMIRGADIN

SEQ ID NO: 2182269 - protein, 17 aa, Cryptosporidium hominis
STKHIKYIESLKIELYN

SEQ ID NO: 2182270 - protein, 25 aa, Cryptosporidium hominis
STKNFPGRVFTVGVREAMRCLRHKK

SEQ ID NO: 2182271 - protein, 21 aa, Cryptosporidium hominis
STLDGRCIIWSINEAEQIKYS

SEQ ID NO: 2182272 - protein, 24 aa, Cryptosporidium hominis
STLGLRVSDILKHLFPKLKNTSQR

SEQ ID NO: 2182273 - protein, 34 aa, Cryptosporidium hominis
STLQLGCPADMWALGVTIWCWFYGTLPFQGNSIL

SEQ ID NO: 2182274 - protein, 24 aa, Cryptosporidium hominis
STLRLLCNLRFIKLIQPLIESILE

SEQ ID NO: 2182275 - protein, 23 aa, Cryptosporidium hominis
STLSVELNDDFGYLVNMGSNFEK

SEQ ID NO: 2182276 - protein, 27 aa, Cryptosporidium hominis
STLYCKGSGVVDCIANLPVQDCCEDGC

SEQ ID NO: 2182277 - protein, 20 aa, Cryptosporidium hominis
STLYCLNILFRIYKLEFTEN

SEQ ID NO: 2182278 - protein, 24 aa, Cryptosporidium hominis
STNDEFLLEWNINVPKDLLRFIPN

SEQ ID NO: 2182279 - protein, 25 aa, Cryptosporidium hominis
STNDIGTCCPIVFHISPSEEKDRES

SEQ ID NO: 2182280 - protein, 22 aa, Cryptosporidium hominis
STNIKKALLVHKFLSKPGNTHW

SEQ ID NO: 2182281 - protein, 17 aa, Cryptosporidium hominis
STNIKLHPAFKVGARSF

SEQ ID NO: 2182282 - protein, 18 aa, Cryptosporidium hominis
STNLNNGTWGEIFKQSDL

SEQ ID NO: 2182283 - protein, 24 aa, Cryptosporidium hominis
STNSEIFLTCEVFDSHISDENQCV

SEQ ID NO: 2182284 - protein, 21 aa, Cryptosporidium hominis
STPCKNPLCTLSAEGNLPYNL

SEQ ID NO: 2182285 - protein, 27 aa, Cryptosporidium hominis
STPIISASLYFSFKLYCRNISFNDLLK

SEQ ID NO: 2182286 - protein, 19 aa, Cryptosporidium hominis
STPIKVRIIMSILYISDSL

SEQ ID NO: 2182287 - protein, 23 aa, Cryptosporidium hominis
STPTKLLLWYGQNRIIDLFVKND

SEQ ID NO: 2182288 - protein, 27 aa, Cryptosporidium hominis
STQFLNKLCETRHLFQQGKGAIPDWSK

SEQ ID NO: 2182289 - protein, 21 aa, Cryptosporidium hominis
STQSLKFVMQDVQEHFKRASQ

SEQ ID NO: 2182290 - protein, 36 aa, Cryptosporidium hominis
STRKRYSDFEWLRSTLVIQFPGVFIPPIPKKKKVGR

SEQ ID NO: 2182291 - protein, 24 aa, Cryptosporidium hominis
STRLKSPGGIFFRLIRNQISHEEY

SEQ ID NO: 2182292 - protein, 24 aa, Cryptosporidium hominis
STSCPSCYFSWLRLINSKNGDDNN

SEQ ID NO: 2182293 - protein, 25 aa, Cryptosporidium hominis
STSIKRIMVITSLLSFILMPDSTSF

SEQ ID NO: 2182294 - protein, 17 aa, Cryptosporidium hominis
STSRKNFSPGYRSNSLY

SEQ ID NO: 2182295 - protein, 20 aa, Cryptosporidium hominis
STSSLSCFSIKSKRKYRQYM

SEQ ID NO: 2182296 - protein, 18 aa, Cryptosporidium hominis
STSVYGFPEINSNQRIRF

SEQ ID NO: 2182297 - protein, 24 aa, Cryptosporidium hominis
STTMKVKTTKTITTQEVKPSSEGA

SEQ ID NO: 2182298 - protein, 20 aa, Cryptosporidium hominis
STTPQGFCPTGTQPGMSNFA

SEQ ID NO: 2182299 - protein, 19 aa, Cryptosporidium hominis
STTVKMLSSKSISSKSAIS

SEQ ID NO: 2182300 - protein, 20 aa, Cryptosporidium hominis
STVCIIPCPSTTLASEELKL

SEQ ID NO: 2182301 - protein, 25 aa, Cryptosporidium hominis
STVNFPIELCIISLVIVVKDLVPGY

SEQ ID NO: 2182302 - protein, 26 aa, Cryptosporidium hominis
STVVLMCMEELLQFHLPHHLEALCVF

SEQ ID NO: 2182303 - protein, 25 aa, Cryptosporidium hominis
STVYRKGAEVVRMYETILGREGFRK

SEQ ID NO: 2182304 - protein, 25 aa, Cryptosporidium hominis
STWGRGFVTLCRRLCGAIFETAPTK

SEQ ID NO: 2182305 - protein, 19 aa, Cryptosporidium hominis
STYLKTRMSTIAPNLTYMV

SEQ ID NO: 2182306 - protein, 24 aa, Cryptosporidium hominis
STYVFLKIIKSFTFCLENINNNDY

SEQ ID NO: 2182307 - protein, 23 aa, Cryptosporidium hominis
SVAIIGVSCRLPGRVKSFNDLYE

SEQ ID NO: 2182308 - protein, 23 aa, Cryptosporidium hominis
SVAYICSRFYRAPELMLGATEYT

SEQ ID NO: 2182309 - protein, 26 aa, Cryptosporidium hominis
SVCPTKGCGNRTAWQLRLENCDFGDW

SEQ ID NO: 2182310 - protein, 17 aa, Cryptosporidium hominis
SVCQPISSFGLGIPIQV

SEQ ID NO: 2182311 - protein, 25 aa, Cryptosporidium hominis
SVDNIRWPLLWNNSMRCKMNFLYLK

SEQ ID NO: 2182312 - protein, 28 aa, Cryptosporidium hominis
SVDVDFQRFCLGLGFDINSQNQVICDSQ

SEQ ID NO: 2182313 - protein, 22 aa, Cryptosporidium hominis
SVECSRYHIIALFEDYLDVISP

SEQ ID NO: 2182314 - protein, 17 aa, Cryptosporidium hominis
SVEEGVRIHSKWIQEQN

SEQ ID NO: 2182315 - protein, 18 aa, Cryptosporidium hominis
SVELIFKGLAEFIIMSDK

SEQ ID NO: 2182316 - protein, 19 aa, Cryptosporidium hominis
SVFSDFFLSLSQIFITESN

SEQ ID NO: 2182317 - protein, 18 aa, Cryptosporidium hominis
SVGERWPLNIMSITALEE

SEQ ID NO: 2182318 - protein, 18 aa, Cryptosporidium hominis
SVGFICYSHNGNYIAAAI

SEQ ID NO: 2182319 - protein, 39 aa, Cryptosporidium hominis
SVGGGLPLDLSCWLPQNLTAICNPGFQSSSSSTCATSPY

SEQ ID NO: 2182320 - protein, 18 aa, Cryptosporidium hominis
SVGQCKVPALFISGTNDT

SEQ ID NO: 2182321 - protein, 20 aa, Cryptosporidium hominis
SVGYRPYAIRTFLDEWGMDS

SEQ ID NO: 2182322 - protein, 19 aa, Cryptosporidium hominis
SVHSGHYICYNKRKIDSSI

SEQ ID NO: 2182323 - protein, 28 aa, Cryptosporidium hominis
SVIKKGFLNTISYWSFLRAPPSPKKNVK

SEQ ID NO: 2182324 - protein, 22 aa, Cryptosporidium hominis
SVINKRRGNVFNEELKEGTSTF

SEQ ID NO: 2182325 - protein, 25 aa, Cryptosporidium hominis
SVISCFWKSMVASIEQIYSIESLPL

SEQ ID NO: 2182326 - protein, 17 aa, Cryptosporidium hominis
SVIVGELVKVFSKGSKH

SEQ ID NO: 2182327 - protein, 19 aa, Cryptosporidium hominis
SVKAHWFWEVDIDITVDAV

SEQ ID NO: 2182328 - protein, 26 aa, Cryptosporidium hominis
SVKELKETILHELIHAYLFLTSNDRD

SEQ ID NO: 2182329 - protein, 17 aa, Cryptosporidium hominis
SVKHAVITVPAYFNDSQ

SEQ ID NO: 2182330 - protein, 23 aa, Cryptosporidium hominis
SVKHELKNYFVIIERIAGIFSET

SEQ ID NO: 2182331 - protein, 34 aa, Cryptosporidium hominis
SVKHYDIFESIVLVYRYRLSHLISTAYHLGDTYS

SEQ ID NO: 2182332 - protein, 18 aa, Cryptosporidium hominis
SVLIHKYCINKFEAHNFS

SEQ ID NO: 2182333 - protein, 40 aa, Cryptosporidium hominis
SVLKLKEIISNICSIPVFEIRLVWKDKILSNNALLSSYGI

SEQ ID NO: 2182334 - protein, 18 aa, Cryptosporidium hominis
SVLMKGLDSTGMLIEKKY

SEQ ID NO: 2182335 - protein, 23 aa, Cryptosporidium hominis
SVLRRQLHDQSHFLPSNSLVNSN

SEQ ID NO: 2182336 - protein, 17 aa, Cryptosporidium hominis
SVLSEKVLDIFYNLITF

SEQ ID NO: 2182337 - protein, 19 aa, Cryptosporidium hominis
SVLSPMHRFIRIMGPEICN

SEQ ID NO: 2182338 - protein, 26 aa, Cryptosporidium hominis
SVNFIKRKWFDIVFCLNSETHVLFDR

SEQ ID NO: 2182339 - protein, 25 aa, Cryptosporidium hominis
SVNLNLRVSFSIGKFFEKMETDLKT

SEQ ID NO: 2182340 - protein, 25 aa, Cryptosporidium hominis
SVNSDEMFLELGIHYPMPLPKPWDE

SEQ ID NO: 2182341 - protein, 21 aa, Cryptosporidium hominis
SVPKLFWLSIYYLVNSMKFIS

SEQ ID NO: 2182342 - protein, 23 aa, Cryptosporidium hominis
SVPKSPMTGIHFDRTKPAWAVSY

SEQ ID NO: 2182343 - protein, 17 aa, Cryptosporidium hominis
SVQDILASFGWEDDIIL

SEQ ID NO: 2182344 - protein, 24 aa, Cryptosporidium hominis
SVREEAKLITACKVYTNELESDKE

SEQ ID NO: 2182345 - protein, 20 aa, Cryptosporidium hominis
SVRMLYKLAQMYLYNENGLS

SEQ ID NO: 2182346 - protein, 23 aa, Cryptosporidium hominis
SVSDSTALWGFVENLSRERHLSI

SEQ ID NO: 2182347 - protein, 23 aa, Cryptosporidium hominis
SVSFARRSISLFFGYHYFVLLSF

SEQ ID NO: 2182348 - protein, 25 aa, Cryptosporidium hominis
SVSGNIKSYSKVTFTAPETTTAGAA

SEQ ID NO: 2182349 - protein, 32 aa, Cryptosporidium hominis
SVSKRNSSMVVWRSGFEHIPAVLTHAAVLCSK

SEQ ID NO: 2182350 - protein, 25 aa, Cryptosporidium hominis
SVTKLKDIFIEWKYPAIDFNIDLSE

SEQ ID NO: 2182351 - protein, 32 aa, Cryptosporidium hominis
SVVDSCLKTKFSGRWGSLISSMALKAAETVSI

SEQ ID NO: 2182352 - protein, 28 aa, Cryptosporidium hominis
SVVGAFGMHCVSEMTILLEKVTEICEIP

SEQ ID NO: 2182353 - protein, 17 aa, Cryptosporidium hominis
SVVKALIIPPKGYDGRV

SEQ ID NO: 2182354 - protein, 24 aa, Cryptosporidium hominis
SVVLTELYAFVGLIGEESNVNVYC

SEQ ID NO: 2182355 - protein, 19 aa, Cryptosporidium hominis
SVWYAGIFLSMSFAYEEIS

SEQ ID NO: 2182356 - protein, 31 aa, Cryptosporidium hominis
SWCSDPLCRMWYDMTQFFGFLGEDIIDTDID

SEQ ID NO: 2182357 - protein, 20 aa, Cryptosporidium hominis
SWDTPGLVNGVGNWRILYEP

SEQ ID NO: 2182358 - protein, 23 aa, Cryptosporidium hominis
SWESIKNEILFRILSTKLAQFYT

SEQ ID NO: 2182359 - protein, 18 aa, Cryptosporidium hominis
SWFPETHDSILLKFNHLR

SEQ ID NO: 2182360 - protein, 17 aa, Cryptosporidium hominis
SWFSKTCISNFPEIQKL

SEQ ID NO: 2182361 - protein, 24 aa, Cryptosporidium hominis
SWHPKTRRFVVALKSCESGKTIYK

SEQ ID NO: 2182362 - protein, 24 aa, Cryptosporidium hominis
SWNKIKESYLASGSDDNVICLWDI

SEQ ID NO: 2182363 - protein, 23 aa, Cryptosporidium hominis
SWSKLALFSDFYKLASLHEDNTL

SEQ ID NO: 2182364 - protein, 18 aa, Cryptosporidium hominis
SWVGIKYEKVKYIQIWLH

SEQ ID NO: 2182365 - protein, 24 aa, Cryptosporidium hominis
SYAPISCFNFNYQRPIIYQNTNSR

SEQ ID NO: 2182366 - protein, 21 aa, Cryptosporidium hominis
SYASHALKDAFNVYSLDLQQI

SEQ ID NO: 2182367 - protein, 19 aa, Cryptosporidium hominis
SYCIDTIVIKLNYLKDVVK

SEQ ID NO: 2182368 - protein, 18 aa, Cryptosporidium hominis
SYEKLKQLIEIGNELTIY

SEQ ID NO: 2182369 - protein, 25 aa, Cryptosporidium hominis
SYFILNFILCKSYYLLNIVGNYHQL

SEQ ID NO: 2182370 - protein, 21 aa, Cryptosporidium hominis
SYFLHNSRVSINFSTNENILQ

SEQ ID NO: 2182371 - protein, 24 aa, Cryptosporidium hominis
SYFNIPLLHLWCADHIRFRKGNQA

SEQ ID NO: 2182372 - protein, 18 aa, Cryptosporidium hominis
SYFYKEENLLLLLTVKDI

SEQ ID NO: 2182373 - protein, 17 aa, Cryptosporidium hominis
SYGKLVFLLMDAQKESI

SEQ ID NO: 2182374 - protein, 27 aa, Cryptosporidium hominis
SYGPKCDAWSAGVLLHLLLMGAVPFPG

SEQ ID NO: 2182375 - protein, 18 aa, Cryptosporidium hominis
SYHASSRFIKLRDSFDND

SEQ ID NO: 2182376 - protein, 18 aa, Cryptosporidium hominis
SYHPSPFFVLDEVDAALD

SEQ ID NO: 2182377 - protein, 18 aa, Cryptosporidium hominis
SYHPSWRDDQIFTGIFKK

SEQ ID NO: 2182378 - protein, 20 aa, Cryptosporidium hominis
SYINKWEDLIQILVYEVVSR

SEQ ID NO: 2182379 - protein, 19 aa, Cryptosporidium hominis
SYISYWGYILLELLMDGSQ

SEQ ID NO: 2182380 - protein, 23 aa, Cryptosporidium hominis
SYKERFPMWSLPNIINLLKSEKY

SEQ ID NO: 2182381 - protein, 31 aa, Cryptosporidium hominis
SYKKALEIALKMSWPHFISLLKLLSSRGALH

SEQ ID NO: 2182382 - protein, 20 aa, Cryptosporidium hominis
SYKTATAMSNYFSSMDTSEI

SEQ ID NO: 2182383 - protein, 23 aa, Cryptosporidium hominis
SYLKSSSFLKHYLISETTDSMGN

SEQ ID NO: 2182384 - protein, 22 aa, Cryptosporidium hominis
SYLPFLPSLFIVSSSKPLLRIV

SEQ ID NO: 2182385 - protein, 19 aa, Cryptosporidium hominis
SYLQSRGWTHSPIITNKNL

SEQ ID NO: 2182386 - protein, 24 aa, Cryptosporidium hominis
SYLRRLNTPLGREGKFAKPRQLHN

SEQ ID NO: 2182387 - protein, 18 aa, Cryptosporidium hominis
SYLSDKLLFFLSGLISHS

SEQ ID NO: 2182388 - protein, 19 aa, Cryptosporidium hominis
SYLSGISFDHHIFRLRIIQ

SEQ ID NO: 2182389 - protein, 27 aa, Cryptosporidium hominis
SYLVRLMKRRLIFVSISLLDLLDDENK

SEQ ID NO: 2182390 - protein, 25 aa, Cryptosporidium hominis
SYMAIPIKTPFGIWSNVSMFNEASP

SEQ ID NO: 2182391 - protein, 18 aa, Cryptosporidium hominis
SYMSPRFMRKLEYADSIR

SEQ ID NO: 2182392 - protein, 18 aa, Cryptosporidium hominis
SYNSLGWQGINSNSSKAS

SEQ ID NO: 2182393 - protein, 21 aa, Cryptosporidium hominis
SYPKRISIVQILKELKAIERM

SEQ ID NO: 2182394 - protein, 23 aa, Cryptosporidium hominis
SYPMSGTCRFVEFNRKYDNQDKF

SEQ ID NO: 2182395 - protein, 23 aa, Cryptosporidium hominis
SYPSPLNYWGFPKSCCTSVNEII

SEQ ID NO: 2182396 - protein, 20 aa, Cryptosporidium hominis
SYRQLPIRLADFGVLHRNEF

SEQ ID NO: 2182397 - protein, 23 aa, Cryptosporidium hominis
SYSIPLNIIGKFWDDFFQQGWVP

SEQ ID NO: 2182398 - protein, 19 aa, Cryptosporidium hominis
SYSQFCLVLSFLQQHSSSY

SEQ ID NO: 2182399 - protein, 20 aa, Cryptosporidium hominis
SYSRPSSLQINQIIKQLELL

SEQ ID NO: 2182400 - protein, 19 aa, Cryptosporidium hominis
SYSTYIYKVLKQVHPETGI

SEQ ID NO: 2182401 - protein, 25 aa, Cryptosporidium hominis
SYVRGEIKFVGFLIRQFKGETELFF

SEQ ID NO: 2182402 - protein, 18 aa, Cryptosporidium hominis
SYVYCYIQCWPLVDEFSN

SEQ ID NO: 2182403 - protein, 24 aa, Cryptosporidium hominis
SYWSRTGPFFSIFYQLAHGLILDN

SEQ ID NO: 2182404 - protein, 23 aa, Cryptosporidium hominis
SYYKKRDLFVIILASCSSSIQDS

SEQ ID NO: 2182405 - protein, 17 aa, Cryptosporidium hominis
SYYRLKYTREFSEKILT

SEQ ID NO: 2182406 - protein, 20 aa, Cryptosporidium hominis
SYYYENFVRSLSFGDYSPYE

SEQ ID NO: 2182407 - protein, 17 aa, Cryptosporidium hominis
TACPLVLELDGDLKVTK

SEQ ID NO: 2182408 - protein, 17 aa, Cryptosporidium hominis
TADDCFLRICNRPKRGI

SEQ ID NO: 2182409 - protein, 18 aa, Cryptosporidium hominis
TADRACLQLQSLVDQFND

SEQ ID NO: 2182410 - protein, 26 aa, Cryptosporidium hominis
TAFKILRYLDELRMRENIDFRLKPPL

SEQ ID NO: 2182411 - protein, 17 aa, Cryptosporidium hominis
TAFWNGIDWTASSFAEK

SEQ ID NO: 2182412 - protein, 17 aa, Cryptosporidium hominis
TAGLCTVLSIIQATKKE

SEQ ID NO: 2182413 - protein, 23 aa, Cryptosporidium hominis
TAIGPRFSNIVLQTIMILIKNRA

SEQ ID NO: 2182414 - protein, 23 aa, Cryptosporidium hominis
TAIRYVLKNSFVRGGLLRGLNEV

SEQ ID NO: 2182415 - protein, 17 aa, Cryptosporidium hominis
TAKDVPAGILIEKFAQQ

SEQ ID NO: 2182416 - protein, 20 aa, Cryptosporidium hominis
TAKLYILIEIQRMASVIGNP

SEQ ID NO: 2182417 - protein, 24 aa, Cryptosporidium hominis
TAKNVLYDMMIWYFITYSPGEWSL

SEQ ID NO: 2182418 - protein, 22 aa, Cryptosporidium hominis
TAKRPRAETSFSDKLDSDTLEP

SEQ ID NO: 2182419 - protein, 18 aa, Cryptosporidium hominis
TALKFDGAMFRGRQIKVS

SEQ ID NO: 2182420 - protein, 17 aa, Cryptosporidium hominis
TALTRFTAGIIIVLSSV

SEQ ID NO: 2182421 - protein, 25 aa, Cryptosporidium hominis
TALYFKRMLNIHSIKSSFNRGTSCS

SEQ ID NO: 2182422 - protein, 18 aa, Cryptosporidium hominis
TAMRKGTWVMLKNVHLSS

SEQ ID NO: 2182423 - protein, 17 aa, Cryptosporidium hominis
TANEIQKILSIPVFVNP

SEQ ID NO: 2182424 - protein, 30 aa, Cryptosporidium hominis
TANFPYMVGNTAAFGFPHYSTKPNGHHHPT

SEQ ID NO: 2182425 - protein, 17 aa, Cryptosporidium hominis
TAPLAITLFHWQNSLAL

SEQ ID NO: 2182426 - protein, 17 aa, Cryptosporidium hominis
TAQWRYLRNTLENNQNN

SEQ ID NO: 2182427 - protein, 19 aa, Cryptosporidium hominis
TARSSLCTFFDFCNCFGPR

SEQ ID NO: 2182428 - protein, 22 aa, Cryptosporidium hominis
TASCPWLDGVHTIFGKVVHGKE

SEQ ID NO: 2182429 - protein, 22 aa, Cryptosporidium hominis
TASFCTRLFIVTSLGTWGEIPP

SEQ ID NO: 2182430 - protein, 24 aa, Cryptosporidium hominis
TASPVSWKRFVPVNNFSGTNSGIS

SEQ ID NO: 2182431 - protein, 27 aa, Cryptosporidium hominis
TATQFRFIVDLLRRFHVLDNYCGCTGY

SEQ ID NO: 2182432 - protein, 31 aa, Cryptosporidium hominis
TAWDIGKRGCVAVKLVGNWDSHISPNKVRFF

SEQ ID NO: 2182433 - protein, 19 aa, Cryptosporidium hominis
TAYIKLGFKAAAHSDDGKP

SEQ ID NO: 2182434 - protein, 18 aa, Cryptosporidium hominis
TCAPELALDLFLQGSIMA

SEQ ID NO: 2182435 - protein, 19 aa, Cryptosporidium hominis
TCCSSWDSICATGTKSGHV

SEQ ID NO: 2182436 - protein, 17 aa, Cryptosporidium hominis
TCDIGILVHNDWDKYKD

SEQ ID NO: 2182437 - protein, 22 aa, Cryptosporidium hominis
TCDIRFGSTELWRIQRNLQKFE

SEQ ID NO: 2182438 - protein, 25 aa, Cryptosporidium hominis
TCDLEFCVELFWLLISEISIQEYPK

SEQ ID NO: 2182439 - protein, 19 aa, Cryptosporidium hominis
TCEKTCRRPTFPFVSILAT

SEQ ID NO: 2182440 - protein, 20 aa, Cryptosporidium hominis
TCEPNRYLKLNVEVNLTLEE

SEQ ID NO: 2182441 - protein, 20 aa, Cryptosporidium hominis
TCINDMRKELAILEVEKQKF

SEQ ID NO: 2182442 - protein, 26 aa, Cryptosporidium hominis
TCIRGRPCRIMWCLRDPASRRNNDGN

SEQ ID NO: 2182443 - protein, 19 aa, Cryptosporidium hominis
TCKYIIRQILESVNHLHCL

SEQ ID NO: 2182444 - protein, 21 aa, Cryptosporidium hominis
TCLKSDLTYNIGMLYQPSNNS

SEQ ID NO: 2182445 - protein, 28 aa, Cryptosporidium hominis
TCNYICLFPDIISGPSVEWRNNLSELDK

SEQ ID NO: 2182446 - protein, 22 aa, Cryptosporidium hominis
TCPQLLKWKPPHLNTADFAAIF

SEQ ID NO: 2182447 - protein, 24 aa, Cryptosporidium hominis
TCSDRNCMQCFALLHAHAQTNAGK

SEQ ID NO: 2182448 - protein, 24 aa, Cryptosporidium hominis
TCSNIKGAINILGITGKIFMDVLF

SEQ ID NO: 2182449 - protein, 21 aa, Cryptosporidium hominis
TCTDLGFFFASFTNRFSIFPP

SEQ ID NO: 2182450 - protein, 18 aa, Cryptosporidium hominis
TCVPGVFNYKGAKIQLLD

SEQ ID NO: 2182451 - protein, 22 aa, Cryptosporidium hominis
TCYEFLRPDTVMEMAWKHNCLD

SEQ ID NO: 2182452 - protein, 21 aa, Cryptosporidium hominis
TCYETWYKIIQHFSDKYPSSL

SEQ ID NO: 2182453 - protein, 20 aa, Cryptosporidium hominis
TCYLYNIGNIFGIQPKNEIS

SEQ ID NO: 2182454 - protein, 25 aa, Cryptosporidium hominis
TDDAYKLKSSFGWEHVKGSSKLFFL

SEQ ID NO: 2182455 - protein, 25 aa, Cryptosporidium hominis
TDDLRHIFKTFGVILSCQLIPSIEK

SEQ ID NO: 2182456 - protein, 20 aa, Cryptosporidium hominis
TDDQFIWSSFMFPSGNDDLD

SEQ ID NO: 2182457 - protein, 25 aa, Cryptosporidium hominis
TDEFVHPQLLLKGHSKEGYAMDWGN

SEQ ID NO: 2182458 - protein, 23 aa, Cryptosporidium hominis
TDEKELFRVFATFDINHLMSVIQ

SEQ ID NO: 2182459 - protein, 25 aa, Cryptosporidium hominis
TDELIKNLILFLGIIPEYLFSTNEI

SEQ ID NO: 2182460 - protein, 25 aa, Cryptosporidium hominis
TDFFKENRSIFTFKENFTSMNYCLI

SEQ ID NO: 2182461 - protein, 25 aa, Cryptosporidium hominis
TDGGKLPFDIPLGIVSGRLDLELPY

SEQ ID NO: 2182462 - protein, 26 aa, Cryptosporidium hominis
TDGLKVCGNELCEFLVNVVEPLKSNF

SEQ ID NO: 2182463 - protein, 21 aa, Cryptosporidium hominis
TDHCQRSILSFALSLMEGLFQ

SEQ ID NO: 2182464 - protein, 29 aa, Cryptosporidium hominis
TDHGLSYTRIRFASVQQLFKISYVCDVFD

SEQ ID NO: 2182465 - protein, 20 aa, Cryptosporidium hominis
TDIGLLLFQYSDDWPTRIDG

SEQ ID NO: 2182466 - protein, 24 aa, Cryptosporidium hominis
TDIKSQLNNLSWFLEISSQRNSSL

SEQ ID NO: 2182467 - protein, 18 aa, Cryptosporidium hominis
TDILTKFKSLYMECVKCG

SEQ ID NO: 2182468 - protein, 17 aa, Cryptosporidium hominis
TDINILSFLSFRFELED

SEQ ID NO: 2182469 - protein, 18 aa, Cryptosporidium hominis
TDIRHFAFILFKKNLNVL

SEQ ID NO: 2182470 - protein, 25 aa, Cryptosporidium hominis
TDKDSKVTYKEEYMAQIDSSYTSTT

SEQ ID NO: 2182471 - protein, 18 aa, Cryptosporidium hominis
TDKLRFRSDYSGKIRGHG

SEQ ID NO: 2182472 - protein, 17 aa, Cryptosporidium hominis
TDLECEFGSESEYENKQ

SEQ ID NO: 2182473 - protein, 24 aa, Cryptosporidium hominis
TDLEHNRFLILQGEVELIAQMKPK

SEQ ID NO: 2182474 - protein, 17 aa, Cryptosporidium hominis
TDLLWSFLVSIRDENLI

SEQ ID NO: 2182475 - protein, 20 aa, Cryptosporidium hominis
TDNLKLYYLYESFENKKGTQ

SEQ ID NO: 2182476 - protein, 19 aa, Cryptosporidium hominis
TDNLLNCFDQLFKDEELKS

SEQ ID NO: 2182477 - protein, 26 aa, Cryptosporidium hominis
TDNSAECCLSWNMYQVAYFIKCIGLS

SEQ ID NO: 2182478 - protein, 17 aa, Cryptosporidium hominis
TDNSISFVNPVINIFGG

SEQ ID NO: 2182479 - protein, 17 aa, Cryptosporidium hominis
TDPFYRCPIWDRLKNYK

SEQ ID NO: 2182480 - protein, 20 aa, Cryptosporidium hominis
TDPQIAKMYLEMYPGDMNSA

SEQ ID NO: 2182481 - protein, 23 aa, Cryptosporidium hominis
TDPYFRYRTDFVLKVRAYNYHEY

SEQ ID NO: 2182482 - protein, 18 aa, Cryptosporidium hominis
TDQWREQQQSISFRENRN

SEQ ID NO: 2182483 - protein, 29 aa, Cryptosporidium hominis
TDRREIIELVLEYLHPCRGLDLRLNSLYG

SEQ ID NO: 2182484 - protein, 23 aa, Cryptosporidium hominis
TDRRKAMELACHRVALREHIAIQ

SEQ ID NO: 2182485 - protein, 17 aa, Cryptosporidium hominis
TDSLFKLRIQVIYIIIK

SEQ ID NO: 2182486 - protein, 25 aa, Cryptosporidium hominis
TDSNLLCKIPNGFTFEQAAALPVVA

SEQ ID NO: 2182487 - protein, 20 aa, Cryptosporidium hominis
TDSYLIYSPEVKLLDLQPTS

SEQ ID NO: 2182488 - protein, 18 aa, Cryptosporidium hominis
TDTLKPFVECVRCGVVSH

SEQ ID NO: 2182489 - protein, 25 aa, Cryptosporidium hominis
TEAPRLGIIPKVMTFDGEKILKNGN

SEQ ID NO: 2182490 - protein, 23 aa, Cryptosporidium hominis
TEATCLFPYANMIIPGIINQWMA

SEQ ID NO: 2182491 - protein, 27 aa, Cryptosporidium hominis
TEAYSVDGADAFEFLNILKASKPSDQV

SEQ ID NO: 2182492 - protein, 22 aa, Cryptosporidium hominis
TECGEIIVSLCCEHYTHYIDLS

SEQ ID NO: 2182493 - protein, 24 aa, Cryptosporidium hominis
TECSFPSICIHAALSQQERISRYQ

SEQ ID NO: 2182494 - protein, 27 aa, Cryptosporidium hominis
TEDCFSDKLFSEWVFKLNGKKELYQDS

SEQ ID NO: 2182495 - protein, 37 aa, Cryptosporidium hominis
TEDDTYLLFDLCKEFDLRFIVIHDRYIPPSGKQRTLE

SEQ ID NO: 2182496 - protein, 21 aa, Cryptosporidium hominis
TEDNISLALWDRVYRASCGEL

SEQ ID NO: 2182497 - protein, 19 aa, Cryptosporidium hominis
TEDSIPVIISNNTRLAPQE

SEQ ID NO: 2182498 - protein, 19 aa, Cryptosporidium hominis
TEEKVCIFGSQSFQESVEI

SEQ ID NO: 2182499 - protein, 17 aa, Cryptosporidium hominis
TEEWCLGLDEKPIYRRE

SEQ ID NO: 2182500 - protein, 29 aa, Cryptosporidium hominis
TEFDFFYFRISQILKLKGFDLTETAQDSS

SEQ ID NO: 2182501 - protein, 19 aa, Cryptosporidium hominis
TEFKRKIVALNYPKVYVKN

SEQ ID NO: 2182502 - protein, 24 aa, Cryptosporidium hominis
TEFLREELRFVRGICERAPKCYQS

SEQ ID NO: 2182503 - protein, 22 aa, Cryptosporidium hominis
TEFVHGFIVWFDIEFPAHNSNT

SEQ ID NO: 2182504 - protein, 21 aa, Cryptosporidium hominis
TEFWVWLLDVFIRRRENSHIS

SEQ ID NO: 2182505 - protein, 21 aa, Cryptosporidium hominis
TEIIVELLVYFYSSRSNKSSL

SEQ ID NO: 2182506 - protein, 19 aa, Cryptosporidium hominis
TEIIWRDKPELLSLAEPLA

SEQ ID NO: 2182507 - protein, 23 aa, Cryptosporidium hominis
TEILPIKLFRSMITFLNTRNFSK

SEQ ID NO: 2182508 - protein, 21 aa, Cryptosporidium hominis
TEINEGEPLYRENVISMSNEW

SEQ ID NO: 2182509 - protein, 21 aa, Cryptosporidium hominis
TEIQGKVIGLIFDKTTFYSES

SEQ ID NO: 2182510 - protein, 23 aa, Cryptosporidium hominis
TEISFSIPLFLGSVIDYSVDNNS

SEQ ID NO: 2182511 - protein, 17 aa, Cryptosporidium hominis
TEISHIIDYGITRCEDF

SEQ ID NO: 2182512 - protein, 17 aa, Cryptosporidium hominis
TEIVYFLDIIHNVETVL

SEQ ID NO: 2182513 - protein, 22 aa, Cryptosporidium hominis
TEKEIVNLPGFSPFKLESSQVS

SEQ ID NO: 2182514 - protein, 21 aa, Cryptosporidium hominis
TEKFLKVAVLIGDKDKFEDNE

SEQ ID NO: 2182515 - protein, 25 aa, Cryptosporidium hominis
TEKFSDMYFCHFYKTNIELEKLDKA

SEQ ID NO: 2182516 - protein, 18 aa, Cryptosporidium hominis
TEKFWLENVMNFESDEFA

SEQ ID NO: 2182517 - protein, 22 aa, Cryptosporidium hominis
TEKKKKICLTRAFANTYNIPVI

SEQ ID NO: 2182518 - protein, 24 aa, Cryptosporidium hominis
TEKNCGYKLLPFETRSHNECKWEY

SEQ ID NO: 2182519 - protein, 17 aa, Cryptosporidium hominis
TEKRLGKAKTFLEQTIS

SEQ ID NO: 2182520 - protein, 26 aa, Cryptosporidium hominis
TEKVLGCLYKLYLNGNLYCFAIDEAH

SEQ ID NO: 2182521 - protein, 25 aa, Cryptosporidium hominis
TELAQKFVKIMGHCIGIEFRDPSLI

SEQ ID NO: 2182522 - protein, 23 aa, Cryptosporidium hominis
TELILPCVYSMIKARYYWNQYNK

SEQ ID NO: 2182523 - protein, 17 aa, Cryptosporidium hominis
TELKPIISNKSKLVGGV

SEQ ID NO: 2182524 - protein, 37 aa, Cryptosporidium hominis
TELLLIEWMEAFFAHLRLALLPSDFLVYSHRHDLVCS

SEQ ID NO: 2182525 - protein, 27 aa, Cryptosporidium hominis
TELLLIFDSLYWKDIISRLVELRSNPD

SEQ ID NO: 2182526 - protein, 23 aa, Cryptosporidium hominis
TELLLKSGALLAEAMDSEGYTPI

SEQ ID NO: 2182527 - protein, 17 aa, Cryptosporidium hominis
TELLLKVQRHSFLQLPS

SEQ ID NO: 2182528 - protein, 25 aa, Cryptosporidium hominis
TELNDACKIFELLFFSDNTTHPFFS

SEQ ID NO: 2182529 - protein, 26 aa, Cryptosporidium hominis
TELNEFKSFVSSFGFISFLANLRNEN

SEQ ID NO: 2182530 - protein, 24 aa, Cryptosporidium hominis
TELNSSLNWIWRYNGVVIDTRNIT

SEQ ID NO: 2182531 - protein, 17 aa, Cryptosporidium hominis
TELPKTYVLSSILTGNN

SEQ ID NO: 2182532 - protein, 32 aa, Cryptosporidium hominis
TELPVRRWTQDYKEWLESTLLPAPNADNDNIE

SEQ ID NO: 2182533 - protein, 20 aa, Cryptosporidium hominis
TELSPLDMLQMIGRGGRPQY

SEQ ID NO: 2182534 - protein, 23 aa, Cryptosporidium hominis
TELTFRMSNYFSVGVESRIGIGF

SEQ ID NO: 2182535 - protein, 24 aa, Cryptosporidium hominis
TENCEWRDLPGIERFRHSAWAIKS

SEQ ID NO: 2182536 - protein, 17 aa, Cryptosporidium hominis
TENCTYWSFQGISGVET

SEQ ID NO: 2182537 - protein, 26 aa, Cryptosporidium hominis
TENPELFANILIEWSKKGYQSEKDIF

SEQ ID NO: 2182538 - protein, 24 aa, Cryptosporidium hominis
TENYLKLWLYGFLQRKESCRNALR

SEQ ID NO: 2182539 - protein, 28 aa, Cryptosporidium hominis
TEPVGFLFKKFEELREALQHGLAPISTN

SEQ ID NO: 2182540 - protein, 23 aa, Cryptosporidium hominis
TEQGVFRACCPSGASTGIYEAKE

SEQ ID NO: 2182541 - protein, 27 aa, Cryptosporidium hominis
TEQNKMGPFGWFDGKYTIPGWRTMQMA

SEQ ID NO: 2182542 - protein, 25 aa, Cryptosporidium hominis
TERGVIYRLEFENESNFLFSSSNIS

SEQ ID NO: 2182543 - protein, 19 aa, Cryptosporidium hominis
TERKVRFSIDDLGVSSETK

SEQ ID NO: 2182544 - protein, 41 aa, Cryptosporidium hominis
TERLLSRSSLRRMLNRPSTLFRLPIIERREMNNNMIGIEKK

SEQ ID NO: 2182545 - protein, 23 aa, Cryptosporidium hominis
TESECNLRRAILILETAHTQSFS

SEQ ID NO: 2182546 - protein, 24 aa, Cryptosporidium hominis
TESKYSVSIPSEYIPYARSLDTHW

SEQ ID NO: 2182547 - protein, 18 aa, Cryptosporidium hominis
TESMASFSSGSQSTGIRK

SEQ ID NO: 2182548 - protein, 28 aa, Cryptosporidium hominis
TEVDLRIPCGLFKTFALISSHSIFVQSR

SEQ ID NO: 2182549 - protein, 18 aa, Cryptosporidium hominis
TEVKCLGLEQDSRLCEFI

SEQ ID NO: 2182550 - protein, 18 aa, Cryptosporidium hominis
TEVYSHIIAAYGAKRIIQ

SEQ ID NO: 2182551 - protein, 21 aa, Cryptosporidium hominis
TEWEYRSFINRMFVEIENQNQ

SEQ ID NO: 2182552 - protein, 26 aa, Cryptosporidium hominis
TEYHTRSGFLSSLSRRLWDLEETLSF

SEQ ID NO: 2182553 - protein, 23 aa, Cryptosporidium hominis
TEYSIPFDIRFSKLRKGFSSQNG

SEQ ID NO: 2182554 - protein, 22 aa, Cryptosporidium hominis
TFDIEELLLYSGLEDSSLILLL

SEQ ID NO: 2182555 - protein, 24 aa, Cryptosporidium hominis
TFDRKRTVFIGGLPKFCTEDELRR

SEQ ID NO: 2182556 - protein, 22 aa, Cryptosporidium hominis
TFDVGLTWKNAYYIAEPKVKRP

SEQ ID NO: 2182557 - protein, 26 aa, Cryptosporidium hominis
TFEEINFYFNQVFRELIPNGDAKLIL

SEQ ID NO: 2182558 - protein, 24 aa, Cryptosporidium hominis
TFEFECTTEWSLLRMLEVWLDHLF

SEQ ID NO: 2182559 - protein, 23 aa, Cryptosporidium hominis
TFEWSHEINQIFVALNNSSIIAY

SEQ ID NO: 2182560 - protein, 30 aa, Cryptosporidium hominis
TFFFRQLQCELCKSPLPSSASIKGSRVNIV

SEQ ID NO: 2182561 - protein, 30 aa, Cryptosporidium hominis
TFFGQSGIGYKICDRLGAGSASVVFRCKSV

SEQ ID NO: 2182562 - protein, 25 aa, Cryptosporidium hominis
TFFSDLKLYGSELFTRNCLSKEDLD

SEQ ID NO: 2182563 - protein, 21 aa, Cryptosporidium hominis
TFGIDSIDYIYTRGYNPSNTK

SEQ ID NO: 2182564 - protein, 17 aa, Cryptosporidium hominis
TFGRPCIEITRDESKNS

SEQ ID NO: 2182565 - protein, 22 aa, Cryptosporidium hominis
TFITSLKINRFFKEMKKKEFNL

SEQ ID NO: 2182566 - protein, 17 aa, Cryptosporidium hominis
TFLAKACATEMKGTFLS

SEQ ID NO: 2182567 - protein, 20 aa, Cryptosporidium hominis
TFLATLEKVKLCLSDTTQLR

SEQ ID NO: 2182568 - protein, 17 aa, Cryptosporidium hominis
TFLNDIMESVSLQREAC

SEQ ID NO: 2182569 - protein, 28 aa, Cryptosporidium hominis
TFNEDFRFCRMSKLYKYALRTKMSDLEQ

SEQ ID NO: 2182570 - protein, 25 aa, Cryptosporidium hominis
TFNSKMSIIICLLKNSKIAIYDIIN

SEQ ID NO: 2182571 - protein, 21 aa, Cryptosporidium hominis
TFRPERIVQIADRFNLNASDC

SEQ ID NO: 2182572 - protein, 21 aa, Cryptosporidium hominis
TFSEMLENIFSPLIEALINPK

SEQ ID NO: 2182573 - protein, 24 aa, Cryptosporidium hominis
TFSSLRISPKLILDEYKFYSFNTR

SEQ ID NO: 2182574 - protein, 18 aa, Cryptosporidium hominis
TFSSRKFGFNRAREKAIK

SEQ ID NO: 2182575 - protein, 18 aa, Cryptosporidium hominis
TFTSSLFSLICLKLDGHI

SEQ ID NO: 2182576 - protein, 18 aa, Cryptosporidium hominis
TGATICLTMAQLEDSEES

SEQ ID NO: 2182577 - protein, 18 aa, Cryptosporidium hominis
TGDLFKLIHGNGSRSKAF

SEQ ID NO: 2182578 - protein, 23 aa, Cryptosporidium hominis
TGDSSSCIWKFGQEKTEKLNISW

SEQ ID NO: 2182579 - protein, 23 aa, Cryptosporidium hominis
TGEAIEAYIFVGPIYYQKLKHMV

SEQ ID NO: 2182580 - protein, 22 aa, Cryptosporidium hominis
TGEDLYFRREMVIPPSVEISNL

SEQ ID NO: 2182581 - protein, 22 aa, Cryptosporidium hominis
TGELLMRGPSSFNGYFRNEEET

SEQ ID NO: 2182582 - protein, 25 aa, Cryptosporidium hominis
TGESCIIALCKQWYIEYGGEKWRKD

SEQ ID NO: 2182583 - protein, 18 aa, Cryptosporidium hominis
TGESIKDPFLSKSEGEDI

SEQ ID NO: 2182584 - protein, 17 aa, Cryptosporidium hominis
TGFKCGINYQPPTVVPG

SEQ ID NO: 2182585 - protein, 17 aa, Cryptosporidium hominis
TGGELFDRLSHVGRFSE

SEQ ID NO: 2182586 - protein, 25 aa, Cryptosporidium hominis
TGGKLRLFTEFPFEKIYRDIYQTLY

SEQ ID NO: 2182587 - protein, 26 aa, Cryptosporidium hominis
TGHTLRLLSFPSLLEKGLSKLFSIKQ

SEQ ID NO: 2182588 - protein, 23 aa, Cryptosporidium hominis
TGHVNCGRQAPMFSKGSKIKDMI

SEQ ID NO: 2182589 - protein, 27 aa, Cryptosporidium hominis
TGIDHSYCYKIAWSYEKGRDDYKVMDS

SEQ ID NO: 2182590 - protein, 18 aa, Cryptosporidium hominis
TGIFSWDLTYEEIKRIKC

SEQ ID NO: 2182591 - protein, 18 aa, Cryptosporidium hominis
TGILCMFAAMAGAKHVYG

SEQ ID NO: 2182592 - protein, 19 aa, Cryptosporidium hominis
TGIRFDIIAGQAYYNHEDD

SEQ ID NO: 2182593 - protein, 25 aa, Cryptosporidium hominis
TGKELPRGVPYNHLTEVIISERRFQ

SEQ ID NO: 2182594 - protein, 25 aa, Cryptosporidium hominis
TGKMKFYQLEGLNWMFQLYKHNING

SEQ ID NO: 2182595 - protein, 25 aa, Cryptosporidium hominis
TGKMYLNMNKSCYIGSGHQGETGVG

SEQ ID NO: 2182596 - protein, 23 aa, Cryptosporidium hominis
TGKRQKKSWKRVVNKVCFVGNDF

SEQ ID NO: 2182597 - protein, 17 aa, Cryptosporidium hominis
TGKSIRTEQKWRRNRGR

SEQ ID NO: 2182598 - protein, 17 aa, Cryptosporidium hominis
TGKTMFARKLAKESGLD

SEQ ID NO: 2182599 - protein, 23 aa, Cryptosporidium hominis
TGKWKEALCEYNQISMEVKDNSP

SEQ ID NO: 2182600 - protein, 26 aa, Cryptosporidium hominis
TGLIEKCLKLFLHPTITPVELSARFN

SEQ ID NO: 2182601 - protein, 22 aa, Cryptosporidium hominis
TGLKVAGIDVMFSEIGSAIEEV

SEQ ID NO: 2182602 - protein, 20 aa, Cryptosporidium hominis
TGLLPVDYAYWLTPYNTSIG

SEQ ID NO: 2182603 - protein, 24 aa, Cryptosporidium hominis
TGLRAVPCLYRLTTTSISSKASDK

SEQ ID NO: 2182604 - protein, 21 aa, Cryptosporidium hominis
TGMPKGFAYLEFCEPEAVETA

SEQ ID NO: 2182605 - protein, 21 aa, Cryptosporidium hominis
TGNASLSFINLVKTGGVPGST

SEQ ID NO: 2182606 - protein, 17 aa, Cryptosporidium hominis
TGNCRVIYWKDLYKSGV

SEQ ID NO: 2182607 - protein, 24 aa, Cryptosporidium hominis
TGNKRLHTMTALNVCIKLLDLLIN

SEQ ID NO: 2182608 - protein, 21 aa, Cryptosporidium hominis
TGNSLCCLIEVLIKNNVKEKN

SEQ ID NO: 2182609 - protein, 30 aa, Cryptosporidium hominis
TGPIFDEELLRWIAEAEYLGVSRETAILIA

SEQ ID NO: 2182610 - protein, 25 aa, Cryptosporidium hominis
TGQDGVEFKGIFSLDQPELKLPTEQ

SEQ ID NO: 2182611 - protein, 23 aa, Cryptosporidium hominis
TGRSKGVCYVEFYSVESVLKALK

SEQ ID NO: 2182612 - protein, 22 aa, Cryptosporidium hominis
TGRSRGFGFITFASEESVDAVL

SEQ ID NO: 2182613 - protein, 17 aa, Cryptosporidium hominis
TGSIFVWCLQPYSSKNT

SEQ ID NO: 2182614 - protein, 26 aa, Cryptosporidium hominis
TGSVCAGGLCSIDGAFYAASADQGDA

SEQ ID NO: 2182615 - protein, 17 aa, Cryptosporidium hominis
TGTIVAIPNKDHIIRGL

SEQ ID NO: 2182616 - protein, 24 aa, Cryptosporidium hominis
TGTKLRPVVDFGDDRWVTLSTAEY

SEQ ID NO: 2182617 - protein, 20 aa, Cryptosporidium hominis
TGVPMLGINNIRFNEKTDVE

SEQ ID NO: 2182618 - protein, 23 aa, Cryptosporidium hominis
TGYKSIKSFVLLAYFLNVFGVKD

SEQ ID NO: 2182619 - protein, 18 aa, Cryptosporidium hominis
THDSILLKFNHLRTTFLL

SEQ ID NO: 2182620 - protein, 26 aa, Cryptosporidium hominis
THEGIFLINLAKTWEKIQIAARIIAT

SEQ ID NO: 2182621 - protein, 21 aa, Cryptosporidium hominis
THFGGLPAMIIKKLLVNGPLP

SEQ ID NO: 2182622 - protein, 24 aa, Cryptosporidium hominis
THFMRDFYKRSCFSSLGNMNMYTE

SEQ ID NO: 2182623 - protein, 21 aa, Cryptosporidium hominis
THILYTCIPKGMLEERYRERQ

SEQ ID NO: 2182624 - protein, 24 aa, Cryptosporidium hominis
THKIKRRWELDTPFIHYRNIGFNK

SEQ ID NO: 2182625 - protein, 18 aa, Cryptosporidium hominis
THLEIPLMQNNNVKDGDH

SEQ ID NO: 2182626 - protein, 21 aa, Cryptosporidium hominis
THLFYKTLVYISAISGINSNG

SEQ ID NO: 2182627 - protein, 19 aa, Cryptosporidium hominis
THLLFLNRFSIVFDQLHAI

SEQ ID NO: 2182628 - protein, 27 aa, Cryptosporidium hominis
THPHLRTDALIEIQKWLGLDQNEEQND

SEQ ID NO: 2182629 - protein, 18 aa, Cryptosporidium hominis
THSSLRRVVYNCRQNSAL

SEQ ID NO: 2182630 - protein, 18 aa, Cryptosporidium hominis
THTLCIPFSGAIRDILRQ

SEQ ID NO: 2182631 - protein, 19 aa, Cryptosporidium hominis
THVKLIIQDRIYDWKTPDS

SEQ ID NO: 2182632 - protein, 21 aa, Cryptosporidium hominis
THYDTLELKKDCSKEDICRAY

SEQ ID NO: 2182633 - protein, 23 aa, Cryptosporidium hominis
THYSHPYNFPKASFLPPNTEPSS

SEQ ID NO: 2182634 - protein, 23 aa, Cryptosporidium hominis
TIADFCRRIHKQLLPQMKYALVW

SEQ ID NO: 2182635 - protein, 25 aa, Cryptosporidium hominis
TICKSKRPASVLMISFNSESSVQDK

SEQ ID NO: 2182636 - protein, 24 aa, Cryptosporidium hominis
TIDPNANDGLLFGSFGAVDISKIP

SEQ ID NO: 2182637 - protein, 18 aa, Cryptosporidium hominis
TIDPSFTALHYIIANLSL

SEQ ID NO: 2182638 - protein, 26 aa, Cryptosporidium hominis
TIDSFLRLSSMDSTICTTIQNDTNSN

SEQ ID NO: 2182639 - protein, 23 aa, Cryptosporidium hominis
TIEEITKMVGFWGEKVSFEAIIP

SEQ ID NO: 2182640 - protein, 23 aa, Cryptosporidium hominis
TIEEYKKNIDLFREYIEKDIFEL

SEQ ID NO: 2182641 - protein, 25 aa, Cryptosporidium hominis
TIEGFLYSQVPEIWIKYFETKISEK

SEQ ID NO: 2182642 - protein, 18 aa, Cryptosporidium hominis
TIEKSKLLRDSRSRAMMP

SEQ ID NO: 2182643 - protein, 27 aa, Cryptosporidium hominis
TIELELDYLLGWWLGAREAEFVRMSEA

SEQ ID NO: 2182644 - protein, 18 aa, Cryptosporidium hominis
TIEWARDAFQGIFTSDPQ

SEQ ID NO: 2182645 - protein, 18 aa, Cryptosporidium hominis
TIFAHGFVTAPDGKKMSK

SEQ ID NO: 2182646 - protein, 20 aa, Cryptosporidium hominis
TIFRNCLNPIIVIINNDGYT

SEQ ID NO: 2182647 - protein, 17 aa, Cryptosporidium hominis
TIGQGRRQHGILEAHNN

SEQ ID NO: 2182648 - protein, 27 aa, Cryptosporidium hominis
TIGRSRYFGEWAIIKGFDERTSNVISK

SEQ ID NO: 2182649 - protein, 19 aa, Cryptosporidium hominis
TIGTLRFGIRAKMVKNAPK

SEQ ID NO: 2182650 - protein, 20 aa, Cryptosporidium hominis
TIGTRGRRGYGSGSTTTTTT

SEQ ID NO: 2182651 - protein, 19 aa, Cryptosporidium hominis
TIIECLKASISGELPPSSK

SEQ ID NO: 2182652 - protein, 19 aa, Cryptosporidium hominis
TIIFEEFSPLVVENINKDY

SEQ ID NO: 2182653 - protein, 25 aa, Cryptosporidium hominis
TIIHGPGFIKEGFSFSNAMQNYCEE

SEQ ID NO: 2182654 - protein, 19 aa, Cryptosporidium hominis
TIIQVKILGCLALIDDDEL

SEQ ID NO: 2182655 - protein, 23 aa, Cryptosporidium hominis
TIKVIHPLIRFSLSDEIKEKTYE

SEQ ID NO: 2182656 - protein, 46 aa, Cryptosporidium hominis
TILDKSKPFSLGFTVLIGQCICSFLQEFKKKASLIVKQENKINELF

SEQ ID NO: 2182657 - protein, 24 aa, Cryptosporidium hominis
TILLPEILFFDSLLSMPIYQYIKE

SEQ ID NO: 2182658 - protein, 22 aa, Cryptosporidium hominis
TILLRMIILFLMSGNEEDLQTR

SEQ ID NO: 2182659 - protein, 18 aa, Cryptosporidium hominis
TILSCFESFISKIKTSKN

SEQ ID NO: 2182660 - protein, 26 aa, Cryptosporidium hominis
TILSGLCSCPGFISVCNNKKKIHAIE

SEQ ID NO: 2182661 - protein, 19 aa, Cryptosporidium hominis
TINKGCQIGLFGSNPCSYR

SEQ ID NO: 2182662 - protein, 23 aa, Cryptosporidium hominis
TINPARNCWEFQWPTEEKEQVGF

SEQ ID NO: 2182663 - protein, 25 aa, Cryptosporidium hominis
TINWIRMSPSFLRKIIESDYISCLL

SEQ ID NO: 2182664 - protein, 41 aa, Cryptosporidium hominis
TIPCGHTFCRYCITHNRLLGKKCPVCRQLIGYNFRINMTIH

SEQ ID NO: 2182665 - protein, 22 aa, Cryptosporidium hominis
TIPGICCDIRNPFPGPPACRPI

SEQ ID NO: 2182666 - protein, 21 aa, Cryptosporidium hominis
TIPKARISIIMSDLSSISSKI

SEQ ID NO: 2182667 - protein, 19 aa, Cryptosporidium hominis
TIPLEGGFCSKEEFMERLK

SEQ ID NO: 2182668 - protein, 17 aa, Cryptosporidium hominis
TIPLVRALTGFTCPVTT

SEQ ID NO: 2182669 - protein, 19 aa, Cryptosporidium hominis
TIPTHINGNMFRRKSGSGV

SEQ ID NO: 2182670 - protein, 27 aa, Cryptosporidium hominis
TIPVCNSLLLLRSGFLFASHEFGNHTN

SEQ ID NO: 2182671 - protein, 22 aa, Cryptosporidium hominis
TIRGGFLCDEMGLGKSLEIITL

SEQ ID NO: 2182672 - protein, 21 aa, Cryptosporidium hominis
TIRNLSFILGKIVSNEPETLL

SEQ ID NO: 2182673 - protein, 20 aa, Cryptosporidium hominis
TIRVACRLLIISILLSSLEN

SEQ ID NO: 2182674 - protein, 18 aa, Cryptosporidium hominis
TISEFLKYYIAGLSSNKF

SEQ ID NO: 2182675 - protein, 17 aa, Cryptosporidium hominis
TISEKVINPESKIDEKD

SEQ ID NO: 2182676 - protein, 20 aa, Cryptosporidium hominis
TITTPVKFKKLYNDEHSIQS

SEQ ID NO: 2182677 - protein, 22 aa, Cryptosporidium hominis
TITTYERNLWTAWLQDNKSNQN

SEQ ID NO: 2182678 - protein, 25 aa, Cryptosporidium hominis
TIVPPELVYSGGIQQMYRGNNTAAQ

SEQ ID NO: 2182679 - protein, 24 aa, Cryptosporidium hominis
TIYLEFKESISLSFSNSIQEYRLG

SEQ ID NO: 2182680 - protein, 21 aa, Cryptosporidium hominis
TKDLELILSFYGLDNQNIQGK

SEQ ID NO: 2182681 - protein, 20 aa, Cryptosporidium hominis
TKDSELIWLDSIHNHTKKKP

SEQ ID NO: 2182682 - protein, 20 aa, Cryptosporidium hominis
TKEECINLIGIIFSYVDISN

SEQ ID NO: 2182683 - protein, 20 aa, Cryptosporidium hominis
TKEFSGNALVVYKYEQSIEL

SEQ ID NO: 2182684 - protein, 25 aa, Cryptosporidium hominis
TKEKIRSAINLLDLSNCTTYVEVLE

SEQ ID NO: 2182685 - protein, 22 aa, Cryptosporidium hominis
TKELFLKYTFLRFMPRSFSIKK

SEQ ID NO: 2182686 - protein, 30 aa, Cryptosporidium hominis
TKEMQYQICLLLKALGIPWIDSPGEAEAQA

SEQ ID NO: 2182687 - protein, 17 aa, Cryptosporidium hominis
TKEPAILSLRVYQDKHL

SEQ ID NO: 2182688 - protein, 19 aa, Cryptosporidium hominis
TKERIKASLLLDDSASNDT

SEQ ID NO: 2182689 - protein, 20 aa, Cryptosporidium hominis
TKEYLAWLDPQFFFSGTPAI

SEQ ID NO: 2182690 - protein, 22 aa, Cryptosporidium hominis
TKFGQAVGYKFQIIKKLSDNKE

SEQ ID NO: 2182691 - protein, 26 aa, Cryptosporidium hominis
TKFKIRCSRYLYTLVMKDLEKAKKLE

SEQ ID NO: 2182692 - protein, 18 aa, Cryptosporidium hominis
TKFSASRKTGAFTGINFL

SEQ ID NO: 2182693 - protein, 22 aa, Cryptosporidium hominis
TKFSILRYFNPVGCHPSSLIGE

SEQ ID NO: 2182694 - protein, 21 aa, Cryptosporidium hominis
TKGRFHILDIYPLSIQQRSIK

SEQ ID NO: 2182695 - protein, 20 aa, Cryptosporidium hominis
TKGRLPVCGEDSMDTWYDDL

SEQ ID NO: 2182696 - protein, 20 aa, Cryptosporidium hominis
TKHLYLYLSELLKLNGLGGE

SEQ ID NO: 2182697 - protein, 23 aa, Cryptosporidium hominis
TKHQLEMIFICFPDPHFKKRNWR

SEQ ID NO: 2182698 - protein, 20 aa, Cryptosporidium hominis
TKHYCPFAHGLDELRNPETI

SEQ ID NO: 2182699 - protein, 17 aa, Cryptosporidium hominis
TKIIGGYGIGGDKTVIS

SEQ ID NO: 2182700 - protein, 23 aa, Cryptosporidium hominis
TKIRLQMVDAFWRIQTQPSKRNL

SEQ ID NO: 2182701 - protein, 24 aa, Cryptosporidium hominis
TKKIKEVRNIIKINKNIVNRRLTM

SEQ ID NO: 2182702 - protein, 23 aa, Cryptosporidium hominis
TKKIRFLLRQEKTLKIVANHYVI

SEQ ID NO: 2182703 - protein, 23 aa, Cryptosporidium hominis
TKKVPDGVVCFFSSYLYMEQMLS

SEQ ID NO: 2182704 - protein, 25 aa, Cryptosporidium hominis
TKLCKSQLYSYSWYCYNHLITTLDQ

SEQ ID NO: 2182705 - protein, 23 aa, Cryptosporidium hominis
TKLDCSSLAWARENSRIPNDLDK

SEQ ID NO: 2182706 - protein, 22 aa, Cryptosporidium hominis
TKLIRYGRRALMHLGDTSKLFG

SEQ ID NO: 2182707 - protein, 24 aa, Cryptosporidium hominis
TKLKVKCLKFLNEILLSSKNIFWN

SEQ ID NO: 2182708 - protein, 20 aa, Cryptosporidium hominis
TKLLPLLYRRQLSQIIEEHY

SEQ ID NO: 2182709 - protein, 18 aa, Cryptosporidium hominis
TKLNYIWNVPVMAQSKQI

SEQ ID NO: 2182710 - protein, 17 aa, Cryptosporidium hominis
TKLRCWHIASNYLSNQI

SEQ ID NO: 2182711 - protein, 17 aa, Cryptosporidium hominis
TKMDMLIPRIIYSSRTH

SEQ ID NO: 2182712 - protein, 17 aa, Cryptosporidium hominis
TKMGLILVNNYKKIGSY

SEQ ID NO: 2182713 - protein, 18 aa, Cryptosporidium hominis
TKMPATSTPLIFQNRYQE

SEQ ID NO: 2182714 - protein, 25 aa, Cryptosporidium hominis
TKMSKASVLPGVWHEHLGNISIQKL

SEQ ID NO: 2182715 - protein, 25 aa, Cryptosporidium hominis
TKNAFSLGNTRSFLKYILSNDYRLE

SEQ ID NO: 2182716 - protein, 18 aa, Cryptosporidium hominis
TKNETILSLEFIKNDSNL

SEQ ID NO: 2182717 - protein, 24 aa, Cryptosporidium hominis
TKNHLKNQIPILLASVGISTQDNI

SEQ ID NO: 2182718 - protein, 19 aa, Cryptosporidium hominis
TKNKIGIETKNDLVLNIVQ

SEQ ID NO: 2182719 - protein, 18 aa, Cryptosporidium hominis
TKNLPNIIISWFNFAIEE

SEQ ID NO: 2182720 - protein, 18 aa, Cryptosporidium hominis
TKNNIIWINKLVFRVGIY

SEQ ID NO: 2182721 - protein, 18 aa, Cryptosporidium hominis
TKNPKFVCRTYSSEIPQL

SEQ ID NO: 2182722 - protein, 23 aa, Cryptosporidium hominis
TKPEKLNSFWLGFMSNKNTSSST

SEQ ID NO: 2182723 - protein, 21 aa, Cryptosporidium hominis
TKRKAAMNIDYSYSVSENATR

SEQ ID NO: 2182724 - protein, 19 aa, Cryptosporidium hominis
TKRQYRFYLSTLLAMTVKL

SEQ ID NO: 2182725 - protein, 39 aa, Cryptosporidium hominis
TKSEIPKLDFVVDHLFLWGSPLPAMLVMMFPEYLRSGLT

SEQ ID NO: 2182726 - protein, 22 aa, Cryptosporidium hominis
TKSEPIIACANGFVEDTQGCVQ

SEQ ID NO: 2182727 - protein, 26 aa, Cryptosporidium hominis
TKSGVPWNLGICVGGFPDRVAALRFE

SEQ ID NO: 2182728 - protein, 24 aa, Cryptosporidium hominis
TKSIIEIWIDWKIFPLEYIEGLSS

SEQ ID NO: 2182729 - protein, 21 aa, Cryptosporidium hominis
TKSILKPCINFTQDSTNLIQN

SEQ ID NO: 2182730 - protein, 23 aa, Cryptosporidium hominis
TKSLKGEQKFNVSNIPPNIHSGA

SEQ ID NO: 2182731 - protein, 27 aa, Cryptosporidium hominis
TKSRPFEYLRLTSLGVIGALVKVDDPE

SEQ ID NO: 2182732 - protein, 17 aa, Cryptosporidium hominis
TKSVIFSGINKMFEKIT

SEQ ID NO: 2182733 - protein, 23 aa, Cryptosporidium hominis
TKTLFKYSSWVGGDRDGNPYVTA

SEQ ID NO: 2182734 - protein, 19 aa, Cryptosporidium hominis
TKVRYVLKFGQLSLSRPSV

SEQ ID NO: 2182735 - protein, 24 aa, Cryptosporidium hominis
TKYLSRYKSFYGRLHSPSNNGIQQ

SEQ ID NO: 2182736 - protein, 23 aa, Cryptosporidium hominis
TKYQPFETCRLITDNLSQSPVKN

SEQ ID NO: 2182737 - protein, 28 aa, Cryptosporidium hominis
TKYSHFFNIRIVMFQICREIANILINCN

SEQ ID NO: 2182738 - protein, 19 aa, Cryptosporidium hominis
TKYSNWRISDSLTKPFHFG

SEQ ID NO: 2182739 - protein, 25 aa, Cryptosporidium hominis
TLAWGVNFPAHFAIIKGTEYFDAKL

SEQ ID NO: 2182740 - protein, 23 aa, Cryptosporidium hominis
TLCKEKKEELLIGGLSVCKHIFC

SEQ ID NO: 2182741 - protein, 34 aa, Cryptosporidium hominis
TLDDCWCFNILKKDEWVCVLPLSVKSQEWADSDS

SEQ ID NO: 2182742 - protein, 23 aa, Cryptosporidium hominis
TLDLIKCSDFIIALFGFNDEFQA

SEQ ID NO: 2182743 - protein, 26 aa, Cryptosporidium hominis
TLDTIPWFCSYNKLQVLSNSEYEVME

SEQ ID NO: 2182744 - protein, 18 aa, Cryptosporidium hominis
TLDYLVTPMVRYRDIASN

SEQ ID NO: 2182745 - protein, 33 aa, Cryptosporidium hominis
TLEDEELWPLSSLKSLCEYVGISVKGNRRCILN

SEQ ID NO: 2182746 - protein, 19 aa, Cryptosporidium hominis
TLEEKVECIFEFFLEVFGI

SEQ ID NO: 2182747 - protein, 23 aa, Cryptosporidium hominis
TLELKRLRYFTIKSIPTSISGIN

SEQ ID NO: 2182748 - protein, 19 aa, Cryptosporidium hominis
TLELSELRVPSYLNNSPLI

SEQ ID NO: 2182749 - protein, 23 aa, Cryptosporidium hominis
TLEMKNLSIEWAHRPFFNKKKTS

SEQ ID NO: 2182750 - protein, 25 aa, Cryptosporidium hominis
TLESYKMTGSICYGGVNNKQYIPLK

SEQ ID NO: 2182751 - protein, 23 aa, Cryptosporidium hominis
TLFDGCLCSEVLELERRGLIELI

SEQ ID NO: 2182752 - protein, 18 aa, Cryptosporidium hominis
TLFHVLRQYASLLSDKKH

SEQ ID NO: 2182753 - protein, 28 aa, Cryptosporidium hominis
TLFNKAFCLQKMNILEFVPSKKLSKEMT

SEQ ID NO: 2182754 - protein, 32 aa, Cryptosporidium hominis
TLFRDPECVPREILDIYLAMGVSSEADENIAI

SEQ ID NO: 2182755 - protein, 27 aa, Cryptosporidium hominis
TLGHLLFDFLELFGIVFNYSSTGIRLK

SEQ ID NO: 2182756 - protein, 20 aa, Cryptosporidium hominis
TLHFCEYCLDFFCFEDELIR

SEQ ID NO: 2182757 - protein, 23 aa, Cryptosporidium hominis
TLILKSGFLLPSILNPLTSILVL

SEQ ID NO: 2182758 - protein, 18 aa, Cryptosporidium hominis
TLINEAALIRVNKLYKRF

SEQ ID NO: 2182759 - protein, 17 aa, Cryptosporidium hominis
TLIPLPYPDFSMIAKTR

SEQ ID NO: 2182760 - protein, 25 aa, Cryptosporidium hominis
TLKEIKLKIPITISYYKIKNIFYND

SEQ ID NO: 2182761 - protein, 19 aa, Cryptosporidium hominis
TLKIIIPLMKYMEPVYLRW

SEQ ID NO: 2182762 - protein, 21 aa, Cryptosporidium hominis
TLKIMYPYHVHLARGNHETKN

SEQ ID NO: 2182763 - protein, 24 aa, Cryptosporidium hominis
TLKSLCEFTSRFIIVSTSKGSKRI

SEQ ID NO: 2182764 - protein, 24 aa, Cryptosporidium hominis
TLLDHPWLRIRGVSSDYLENMLAR

SEQ ID NO: 2182765 - protein, 26 aa, Cryptosporidium hominis
TLLETGSDILFFWVARMVMLSFACTD

SEQ ID NO: 2182766 - protein, 20 aa, Cryptosporidium hominis
TLLFNETYLTIKDWKGKQEY

SEQ ID NO: 2182767 - protein, 25 aa, Cryptosporidium hominis
TLLHLIVPIYLKYLRHKNINGNSKN

SEQ ID NO: 2182768 - protein, 17 aa, Cryptosporidium hominis
TLLICSRCKKVAYCNVD

SEQ ID NO: 2182769 - protein, 23 aa, Cryptosporidium hominis
TLLKDFRIAINLEHKENPIEVAN

SEQ ID NO: 2182770 - protein, 24 aa, Cryptosporidium hominis
TLLKKGPEELADWNRYFKRIQSSK

SEQ ID NO: 2182771 - protein, 17 aa, Cryptosporidium hominis
TLLKNGADPNYKNKQGL

SEQ ID NO: 2182772 - protein, 19 aa, Cryptosporidium hominis
TLLRRRNYKELKSIRTIVL

SEQ ID NO: 2182773 - protein, 25 aa, Cryptosporidium hominis
TLNDFLRYFVDIFIEESVSVQLQIL

SEQ ID NO: 2182774 - protein, 27 aa, Cryptosporidium hominis
TLNFRKRDWYSLIAVFLTGAEWQLQSF

SEQ ID NO: 2182775 - protein, 21 aa, Cryptosporidium hominis
TLNGLHVWSFNEAIFTSENDL

SEQ ID NO: 2182776 - protein, 19 aa, Cryptosporidium hominis
TLNIPFKFTTLIEASGNSK

SEQ ID NO: 2182777 - protein, 17 aa, Cryptosporidium hominis
TLNIWKELEQIVGRFWH

SEQ ID NO: 2182778 - protein, 25 aa, Cryptosporidium hominis
TLNREICLFYLPLNLPCMYSVPFIE

SEQ ID NO: 2182779 - protein, 19 aa, Cryptosporidium hominis
TLPLKTVVIIWDYLLANGL

SEQ ID NO: 2182780 - protein, 19 aa, Cryptosporidium hominis
TLRCEKLGKLCSLRGTITR

SEQ ID NO: 2182781 - protein, 19 aa, Cryptosporidium hominis
TLRDYQIYGLNWMISRFKK

SEQ ID NO: 2182782 - protein, 23 aa, Cryptosporidium hominis
TLRGPRSAIIFYRKEVESKIRVK

SEQ ID NO: 2182783 - protein, 20 aa, Cryptosporidium hominis
TLRILPSLIYRIPNLTPGLI

SEQ ID NO: 2182784 - protein, 30 aa, Cryptosporidium hominis
TLRKNPNLFAKWSISFSLGLHRLQRNILLR

SEQ ID NO: 2182785 - protein, 24 aa, Cryptosporidium hominis
TLRPEVKKCSAICSLLEQQFNEVE

SEQ ID NO: 2182786 - protein, 18 aa, Cryptosporidium hominis
TLSELKNDPWMKIKCENE

SEQ ID NO: 2182787 - protein, 23 aa, Cryptosporidium hominis
TLSINLIALIVMIDRENVLIGQL

SEQ ID NO: 2182788 - protein, 28 aa, Cryptosporidium hominis
TLSRYWTHISLIGECFNILKKNDITSIG

SEQ ID NO: 2182789 - protein, 19 aa, Cryptosporidium hominis
TLSWRCNIQKNIGICKQEI

SEQ ID NO: 2182790 - protein, 18 aa, Cryptosporidium hominis
TLTPRKELFLAYIWKNYR

SEQ ID NO: 2182791 - protein, 20 aa, Cryptosporidium hominis
TLVGPGLFLLLSRNILSTIQ

SEQ ID NO: 2182792 - protein, 26 aa, Cryptosporidium hominis
TLVRGRWYHKTCLELLNSESERENHS

SEQ ID NO: 2182793 - protein, 17 aa, Cryptosporidium hominis
TLVTANGINSEWSEVRE

SEQ ID NO: 2182794 - protein, 18 aa, Cryptosporidium hominis
TLVYQVIPFNGIKNILKR

SEQ ID NO: 2182795 - protein, 19 aa, Cryptosporidium hominis
TLYLCKLPYDMTEDSVREL

SEQ ID NO: 2182796 - protein, 21 aa, Cryptosporidium hominis
TMAALALLFAMQSYHPSPFFV

SEQ ID NO: 2182797 - protein, 25 aa, Cryptosporidium hominis
TMLLYEIIRRLSIESRDNFVNMMQN

SEQ ID NO: 2182798 - protein, 26 aa, Cryptosporidium hominis
TMNVCKSNVVSIPYSGGLTKGNYLKF

SEQ ID NO: 2182799 - protein, 23 aa, Cryptosporidium hominis
TMQFFNFRIVKRRHYSSSSNLLK

SEQ ID NO: 2182800 - protein, 18 aa, Cryptosporidium hominis
TMRGVIGCPVCYVPLTID

SEQ ID NO: 2182801 - protein, 19 aa, Cryptosporidium hominis
TMYIAGDIRPFLKNKDCQE

SEQ ID NO: 2182802 - protein, 29 aa, Cryptosporidium hominis
TNASCCITLEWSVCGRFLLASTTSPRLRV

SEQ ID NO: 2182803 - protein, 24 aa, Cryptosporidium hominis
TNCKEEARLTYGHAKEKEIQNQRR

SEQ ID NO: 2182804 - protein, 19 aa, Cryptosporidium hominis
TNDCFKLMLNIIKEFNNRY

SEQ ID NO: 2182805 - protein, 17 aa, Cryptosporidium hominis
TNDQSWIYYIRIVGESS

SEQ ID NO: 2182806 - protein, 25 aa, Cryptosporidium hominis
TNELHKFSKYWLKKLGIPKEVPPSA

SEQ ID NO: 2182807 - protein, 29 aa, Cryptosporidium hominis
TNEQFVCIRFCRRIHQLYSNELSKPIEDY

SEQ ID NO: 2182808 - protein, 23 aa, Cryptosporidium hominis
TNEYLMLYSFPFGGFSSCFQFNF

SEQ ID NO: 2182809 - protein, 20 aa, Cryptosporidium hominis
TNFWLKQHFTQDVTKDGMIP

SEQ ID NO: 2182810 - protein, 19 aa, Cryptosporidium hominis
TNGFFTFWVTYSKIKSSYT

SEQ ID NO: 2182811 - protein, 37 aa, Cryptosporidium hominis
TNHLDILAVTWLENFLKEWDKICVIVSHSRDLLNQVC

SEQ ID NO: 2182812 - protein, 26 aa, Cryptosporidium hominis
TNIDILDLFPIFSWLENPNNFNHPMH

SEQ ID NO: 2182813 - protein, 17 aa, Cryptosporidium hominis
TNIICGGLSISHQLNKI

SEQ ID NO: 2182814 - protein, 20 aa, Cryptosporidium hominis
TNIKSCIMEFFLYSKKELIS

SEQ ID NO: 2182815 - protein, 18 aa, Cryptosporidium hominis
TNILDLVRQFIKIRFPFV

SEQ ID NO: 2182816 - protein, 20 aa, Cryptosporidium hominis
TNINLVMKGRCSVGNISGLK

SEQ ID NO: 2182817 - protein, 26 aa, Cryptosporidium hominis
TNIPEFSALLSILGFYAIEIEAIRDT

SEQ ID NO: 2182818 - protein, 23 aa, Cryptosporidium hominis
TNIPWEIDSGIRRRFERRIYIPL

SEQ ID NO: 2182819 - protein, 17 aa, Cryptosporidium hominis
TNIQLRFHNGQKKVVTL

SEQ ID NO: 2182820 - protein, 17 aa, Cryptosporidium hominis
TNIRWTYYSFYPLILSS

SEQ ID NO: 2182821 - protein, 20 aa, Cryptosporidium hominis
TNIYFPFHFLHIQIVSGLRN

SEQ ID NO: 2182822 - protein, 21 aa, Cryptosporidium hominis
TNKDSWVKKDLDSRRISILEP

SEQ ID NO: 2182823 - protein, 27 aa, Cryptosporidium hominis
TNKEVPIRIRFLINDVIDSRKNNWKSK

SEQ ID NO: 2182824 - protein, 25 aa, Cryptosporidium hominis
TNKKCRNGVHCCFCHFQHKERKRGK

SEQ ID NO: 2182825 - protein, 19 aa, Cryptosporidium hominis
TNKYKVIIVSILYQEDLKL

SEQ ID NO: 2182826 - protein, 25 aa, Cryptosporidium hominis
TNLALWEVSDPIILNTFEKELFAFL

SEQ ID NO: 2182827 - protein, 17 aa, Cryptosporidium hominis
TNLANMFGINQASGANG

SEQ ID NO: 2182828 - protein, 26 aa, Cryptosporidium hominis
TNLGRLRAPLLRNRVVKAAEAANPEV

SEQ ID NO: 2182829 - protein, 23 aa, Cryptosporidium hominis
TNLILYCLKHIFTQLAQSSPESN

SEQ ID NO: 2182830 - protein, 17 aa, Cryptosporidium hominis
TNLNSFYPIDLTKVNGK

SEQ ID NO: 2182831 - protein, 26 aa, Cryptosporidium hominis
TNLVPYPRIHFMLSSYAPIISAEKAF

SEQ ID NO: 2182832 - protein, 20 aa, Cryptosporidium hominis
TNNFLSCIGKLDDEFIHLLF

SEQ ID NO: 2182833 - protein, 25 aa, Cryptosporidium hominis
TNNNLCLGGGLLPVGGTGGGTPVQG

SEQ ID NO: 2182834 - protein, 18 aa, Cryptosporidium hominis
TNPFDLLQGLSHVKLERT

SEQ ID NO: 2182835 - protein, 22 aa, Cryptosporidium hominis
TNPKHSPGWIAAARFEEFVGRI

SEQ ID NO: 2182836 - protein, 24 aa, Cryptosporidium hominis
TNPNCPPPQCYRSYGSNKEDEPMC

SEQ ID NO: 2182837 - protein, 21 aa, Cryptosporidium hominis
TNSAFLACCYMMIRQGKTPGS

SEQ ID NO: 2182838 - protein, 26 aa, Cryptosporidium hominis
TNSIEYWFNRCCLYLSNNDIDNAMTS

SEQ ID NO: 2182839 - protein, 17 aa, Cryptosporidium hominis
TNTKCKFCIKSPDRNIT

SEQ ID NO: 2182840 - protein, 17 aa, Cryptosporidium hominis
TNTRIFSMKSFGRTVVP

SEQ ID NO: 2182841 - protein, 17 aa, Cryptosporidium hominis
TNVCVSTGTSLFGSSLF

SEQ ID NO: 2182842 - protein, 24 aa, Cryptosporidium hominis
TNVDESYLNWGVMHVIREIKHSSL

SEQ ID NO: 2182843 - protein, 26 aa, Cryptosporidium hominis
TNVEDILRISLFFGPEIKDFQKTLDQ

SEQ ID NO: 2182844 - protein, 26 aa, Cryptosporidium hominis
TNWNKFTFPLLEEFSMIQDQIQLVEN

SEQ ID NO: 2182845 - protein, 20 aa, Cryptosporidium hominis
TNYGLKPGYNIMLHSKNVNN

SEQ ID NO: 2182846 - protein, 20 aa, Cryptosporidium hominis
TNYIPEKMMILGVGNIDHSS

SEQ ID NO: 2182847 - protein, 39 aa, Cryptosporidium hominis
TNYQIVCNFKFYTPCIKYLMQFLHDFVAHWSIEKSDQNL

SEQ ID NO: 2182848 - protein, 23 aa, Cryptosporidium hominis
TNYRELSGLFSLPDLLLKDELLC

SEQ ID NO: 2182849 - protein, 22 aa, Cryptosporidium hominis
TPALQKRTYPFISYPSDSESGN

SEQ ID NO: 2182850 - protein, 18 aa, Cryptosporidium hominis
TPEFYIPIFKKLKVSTVI

SEQ ID NO: 2182851 - protein, 26 aa, Cryptosporidium hominis
TPEKVCFIKDLNMYAVAGVKERYKGR

SEQ ID NO: 2182852 - protein, 26 aa, Cryptosporidium hominis
TPEKWESFTRRWWAKSRSFVQDVKLI

SEQ ID NO: 2182853 - protein, 20 aa, Cryptosporidium hominis
TPFEDFRIFDIYLLGQDYVG

SEQ ID NO: 2182854 - protein, 21 aa, Cryptosporidium hominis
TPGSWKAALHASGSVINAVDC

SEQ ID NO: 2182855 - protein, 28 aa, Cryptosporidium hominis
TPHGIPYWLVPVFEFLKLPASSTLSSLD

SEQ ID NO: 2182856 - protein, 24 aa, Cryptosporidium hominis
TPIKNIRSSYMLSRSISPTLTPNN

SEQ ID NO: 2182857 - protein, 21 aa, Cryptosporidium hominis
TPIQAACLVPAIRDRKDIVGA

SEQ ID NO: 2182858 - protein, 23 aa, Cryptosporidium hominis
TPKACSILLRGGSKDVLNELERN

SEQ ID NO: 2182859 - protein, 24 aa, Cryptosporidium hominis
TPKELKLKLIDFLDKKLNWTEIET

SEQ ID NO: 2182860 - protein, 17 aa, Cryptosporidium hominis
TPKGFEFATSERAEQRL

SEQ ID NO: 2182861 - protein, 17 aa, Cryptosporidium hominis
TPKRCSKGKEISNIEYM

SEQ ID NO: 2182862 - protein, 21 aa, Cryptosporidium hominis
TPKRSYLPLITHISSPLSNPS

SEQ ID NO: 2182863 - protein, 19 aa, Cryptosporidium hominis
TPLKIKYPYLTGTYTQLNY

SEQ ID NO: 2182864 - protein, 18 aa, Cryptosporidium hominis
TPLLLGIYGLKFETVRLL

SEQ ID NO: 2182865 - protein, 18 aa, Cryptosporidium hominis
TPLPKVFSISSLNTKHLI

SEQ ID NO: 2182866 - protein, 20 aa, Cryptosporidium hominis
TPLPPSRYLVPLFMRCLYSS

SEQ ID NO: 2182867 - protein, 17 aa, Cryptosporidium hominis
TPLQWACMTNNKELISY

SEQ ID NO: 2182868 - protein, 18 aa, Cryptosporidium hominis
TPLSLLDIPLVWRDKSFG

SEQ ID NO: 2182869 - protein, 20 aa, Cryptosporidium hominis
TPNYLGCLDYVFYTDERLRL

SEQ ID NO: 2182870 - protein, 21 aa, Cryptosporidium hominis
TPPAFKSSPPLLFILICSSNT

SEQ ID NO: 2182871 - protein, 20 aa, Cryptosporidium hominis
TPQTCRLGNASHILRIPKQG

SEQ ID NO: 2182872 - protein, 36 aa, Cryptosporidium hominis
TPQYCYSLLRCLHRVLCCCPRIVGISRLVSTLINLI

SEQ ID NO: 2182873 - protein, 23 aa, Cryptosporidium hominis
TPRNKLRLGGNIHEGIISGRCNT

SEQ ID NO: 2182874 - protein, 17 aa, Cryptosporidium hominis
TPSILGVLLKYFDVSWP

SEQ ID NO: 2182875 - protein, 18 aa, Cryptosporidium hominis
TPSLSYLIQKNFENPTNG

SEQ ID NO: 2182876 - protein, 26 aa, Cryptosporidium hominis
TPSLVFFKKSLKWYLESFHSVHLIPQ

SEQ ID NO: 2182877 - protein, 25 aa, Cryptosporidium hominis
TPSQTTYGKFGVKYETNQSGKTQIK

SEQ ID NO: 2182878 - protein, 19 aa, Cryptosporidium hominis
TPVIPELVGEFIGITRAGF

SEQ ID NO: 2182879 - protein, 17 aa, Cryptosporidium hominis
TPVSFAIVDDKQFQQDS

SEQ ID NO: 2182880 - protein, 20 aa, Cryptosporidium hominis
TPVSKSRRVIDEDSAVKDRK

SEQ ID NO: 2182881 - protein, 23 aa, Cryptosporidium hominis
TPYKNLFVIWDYMIKRSYQELGM

SEQ ID NO: 2182882 - protein, 18 aa, Cryptosporidium hominis
TPYPHTYKPDGYLKNEIS

SEQ ID NO: 2182883 - protein, 17 aa, Cryptosporidium hominis
TPYSCIPVILNRLRQKD

SEQ ID NO: 2182884 - protein, 25 aa, Cryptosporidium hominis
TQDMICHVCSLKLGNKPCALYPNGS

SEQ ID NO: 2182885 - protein, 24 aa, Cryptosporidium hominis
TQELSTLFTFMLEWITISKTVWIS

SEQ ID NO: 2182886 - protein, 28 aa, Cryptosporidium hominis
TQEVSQCILPLPIIHQGPMINGSSRTSS

SEQ ID NO: 2182887 - protein, 26 aa, Cryptosporidium hominis
TQEYLKPGGKLLIFTPFMTTELLQIH

SEQ ID NO: 2182888 - protein, 17 aa, Cryptosporidium hominis
TQFGRGFPENGYPITEK

SEQ ID NO: 2182889 - protein, 24 aa, Cryptosporidium hominis
TQFSSRINRMIKLGLSIDEEDIVD

SEQ ID NO: 2182890 - protein, 18 aa, Cryptosporidium hominis
TQGFLALFAGDTGEIKPE

SEQ ID NO: 2182891 - protein, 19 aa, Cryptosporidium hominis
TQGTLSRQHFRTVLYLILP

SEQ ID NO: 2182892 - protein, 20 aa, Cryptosporidium hominis
TQICPCPECNEEAINGSIHG

SEQ ID NO: 2182893 - protein, 21 aa, Cryptosporidium hominis
TQILEFCLSKLQGLLNILSRS

SEQ ID NO: 2182894 - protein, 23 aa, Cryptosporidium hominis
TQKHMLPLSYKWIGLSRSNHKLL

SEQ ID NO: 2182895 - protein, 30 aa, Cryptosporidium hominis
TQKSIRGIYQWFRKYFKTYYLPNEYWIYKL

SEQ ID NO: 2182896 - protein, 25 aa, Cryptosporidium hominis
TQMIPRSLFDMKFSTPNSNLLLPFE

SEQ ID NO: 2182897 - protein, 25 aa, Cryptosporidium hominis
TQMLICGIPSYLILQFFDKNNMEEY

SEQ ID NO: 2182898 - protein, 25 aa, Cryptosporidium hominis
TQNEELRDSLGIKAQEIEKLQTEKQ

SEQ ID NO: 2182899 - protein, 25 aa, Cryptosporidium hominis
TQNFNWRTPKYIGRNDLETMLASSN

SEQ ID NO: 2182900 - protein, 21 aa, Cryptosporidium hominis
TQNIRMSKVFYYDFSEKEFVS

SEQ ID NO: 2182901 - protein, 21 aa, Cryptosporidium hominis
TQPFFMLLSFIPKLSYDILLA

SEQ ID NO: 2182902 - protein, 23 aa, Cryptosporidium hominis
TQPFFRLDWKVLYDNIKEMPILE

SEQ ID NO: 2182903 - protein, 17 aa, Cryptosporidium hominis
TQPRRVAAMSVAARVAK

SEQ ID NO: 2182904 - protein, 17 aa, Cryptosporidium hominis
TQRCLGFAHILFEKAIE

SEQ ID NO: 2182905 - protein, 21 aa, Cryptosporidium hominis
TQRFSQFWIVNNIINSLFSTN

SEQ ID NO: 2182906 - protein, 19 aa, Cryptosporidium hominis
TQRKCLSILHSLKDIHQLS

SEQ ID NO: 2182907 - protein, 17 aa, Cryptosporidium hominis
TQRRKHRTVKEMVDKYI

SEQ ID NO: 2182908 - protein, 24 aa, Cryptosporidium hominis
TQSFHVDLMFHPPIQNIDKNVANE

SEQ ID NO: 2182909 - protein, 23 aa, Cryptosporidium hominis
TQVKVPINYSFRSLRDALEYPIC

SEQ ID NO: 2182910 - protein, 25 aa, Cryptosporidium hominis
TQVTCLKFLPNLGIIISGDISGGLE

SEQ ID NO: 2182911 - protein, 21 aa, Cryptosporidium hominis
TQYYLYISFKNCIVAKLKINS

SEQ ID NO: 2182912 - protein, 18 aa, Cryptosporidium hominis
TRAHFLAAHIPLYLYPFL

SEQ ID NO: 2182913 - protein, 17 aa, Cryptosporidium hominis
TRARGERVYKPGGKKEW

SEQ ID NO: 2182914 - protein, 17 aa, Cryptosporidium hominis
TRASIPLYLYGDLEPFI

SEQ ID NO: 2182915 - protein, 18 aa, Cryptosporidium hominis
TRCTGFFNCFAARAKFYF

SEQ ID NO: 2182916 - protein, 25 aa, Cryptosporidium hominis
TREFSTEIDYNWFLSPHNRILIENI

SEQ ID NO: 2182917 - protein, 22 aa, Cryptosporidium hominis
TRELCDPEKMISHTAQEDLPVY

SEQ ID NO: 2182918 - protein, 27 aa, Cryptosporidium hominis
TRELSNLCLNYFVRYPFSKGLLKKPKE

SEQ ID NO: 2182919 - protein, 17 aa, Cryptosporidium hominis
TRESGWLKKSVIDQIRE

SEQ ID NO: 2182920 - protein, 19 aa, Cryptosporidium hominis
TRFIACPEGELQKKREVVH

SEQ ID NO: 2182921 - protein, 21 aa, Cryptosporidium hominis
TRFVSYGNFIKWGSRADLEYD

SEQ ID NO: 2182922 - protein, 19 aa, Cryptosporidium hominis
TRGIPWPKVKDFVSSFEPG

SEQ ID NO: 2182923 - protein, 24 aa, Cryptosporidium hominis
TRGRIWCPKGFNVIFPPKALEKYE

SEQ ID NO: 2182924 - protein, 27 aa, Cryptosporidium hominis
TRGTNLLTFKFDYIFSSVSTQHEVFEE

SEQ ID NO: 2182925 - protein, 18 aa, Cryptosporidium hominis
TRHLRGGNRKIIKIPYLA

SEQ ID NO: 2182926 - protein, 23 aa, Cryptosporidium hominis
TRHMSSLWKSYTFTHETLFTMTS

SEQ ID NO: 2182927 - protein, 21 aa, Cryptosporidium hominis
TRIEGPLTFVKHIEASCYIQS

SEQ ID NO: 2182928 - protein, 17 aa, Cryptosporidium hominis
TRIFSMKSFGRTVVPSY

SEQ ID NO: 2182929 - protein, 17 aa, Cryptosporidium hominis
TRIRHFRDSVGRYFRDL

SEQ ID NO: 2182930 - protein, 24 aa, Cryptosporidium hominis
TRKLLPGMYVTISGVFLPVVKEGF

SEQ ID NO: 2182931 - protein, 18 aa, Cryptosporidium hominis
TRLDEACRKKIGTGDDIL

SEQ ID NO: 2182932 - protein, 17 aa, Cryptosporidium hominis
TRLGRGFTLEELSACGI

SEQ ID NO: 2182933 - protein, 17 aa, Cryptosporidium hominis
TRLIFSVQNYQGYPFVL

SEQ ID NO: 2182934 - protein, 26 aa, Cryptosporidium hominis
TRLKVSEGFRVTVFQGRVMWNTEFDM

SEQ ID NO: 2182935 - protein, 21 aa, Cryptosporidium hominis
TRLSLITAFHGAWFCKEATIT

SEQ ID NO: 2182936 - protein, 17 aa, Cryptosporidium hominis
TRMSTIAPNLTYMVGEL

SEQ ID NO: 2182937 - protein, 17 aa, Cryptosporidium hominis
TRNKFAALSLSDDEDDQ

SEQ ID NO: 2182938 - protein, 20 aa, Cryptosporidium hominis
TRPGNVFWNNHMMRNNSILN

SEQ ID NO: 2182939 - protein, 26 aa, Cryptosporidium hominis
TRQFIPRLGAPIYNITSFRKEKVYMD

SEQ ID NO: 2182940 - protein, 23 aa, Cryptosporidium hominis
TRRFLLEFLSFFHRYIPIGILEQ

SEQ ID NO: 2182941 - protein, 22 aa, Cryptosporidium hominis
TRRLVFKSGGDIFGRIRSNQWI

SEQ ID NO: 2182942 - protein, 24 aa, Cryptosporidium hominis
TRRMLMEGRWSFDPNSRLDQTEVI

SEQ ID NO: 2182943 - protein, 21 aa, Cryptosporidium hominis
TRRRLCASSGAIIEYVGNFAF

SEQ ID NO: 2182944 - protein, 21 aa, Cryptosporidium hominis
TRRSLPVYKVRDSLIKLIGEH

SEQ ID NO: 2182945 - protein, 18 aa, Cryptosporidium hominis
TRSGFGVEIYENISDQIS

SEQ ID NO: 2182946 - protein, 21 aa, Cryptosporidium hominis
TRSIRECFVREGQISSISNIK

SEQ ID NO: 2182947 - protein, 20 aa, Cryptosporidium hominis
TRSLIAFALSKGIEDRFLIS

SEQ ID NO: 2182948 - protein, 24 aa, Cryptosporidium hominis
TRSNLQKAISCNFYYNCKTKKVSN

SEQ ID NO: 2182949 - protein, 24 aa, Cryptosporidium hominis
TRSSNDIYRRVDFLIKAFKKRDLN

SEQ ID NO: 2182950 - protein, 20 aa, Cryptosporidium hominis
TRSSTQFLPRIKEINHEKNI

SEQ ID NO: 2182951 - protein, 17 aa, Cryptosporidium hominis
TRSYSCSDEEYISNSNT

SEQ ID NO: 2182952 - protein, 18 aa, Cryptosporidium hominis
TRTAVGIKTIFKVLFSLE

SEQ ID NO: 2182953 - protein, 19 aa, Cryptosporidium hominis
TRVCSKAAYILIKFVNKYL

SEQ ID NO: 2182954 - protein, 25 aa, Cryptosporidium hominis
TRVKQGTYVYGRLMVEAKLVTKPGV

SEQ ID NO: 2182955 - protein, 25 aa, Cryptosporidium hominis
TRVQPRAGRIVTFFIADMHEGEPLC

SEQ ID NO: 2182956 - protein, 21 aa, Cryptosporidium hominis
TRYFFLVLKWNGLQQIVGASG

SEQ ID NO: 2182957 - protein, 17 aa, Cryptosporidium hominis
TRYGGSVIDCSRNGHIN

SEQ ID NO: 2182958 - protein, 21 aa, Cryptosporidium hominis
TRYINYINIWSIELTSENFYE

SEQ ID NO: 2182959 - protein, 22 aa, Cryptosporidium hominis
TRYISYIICLLPYKSHTSDSSL

SEQ ID NO: 2182960 - protein, 19 aa, Cryptosporidium hominis
TRYSQVFLKEIRKRLDSYF

SEQ ID NO: 2182961 - protein, 27 aa, Cryptosporidium hominis
TSAHPWKYRYAAIMAIAQTIEYLPEDD

SEQ ID NO: 2182962 - protein, 25 aa, Cryptosporidium hominis
TSALRRNGWCLALSSGLNEMYSANL

SEQ ID NO: 2182963 - protein, 22 aa, Cryptosporidium hominis
TSARFVQLGFFGALRFGSNRID

SEQ ID NO: 2182964 - protein, 22 aa, Cryptosporidium hominis
TSASKLPCFSLFTNKEYFIQDI

SEQ ID NO: 2182965 - protein, 19 aa, Cryptosporidium hominis
TSCLYLLSIWDKIESIPST

SEQ ID NO: 2182966 - protein, 24 aa, Cryptosporidium hominis
TSCQLPNSMSFIWQNLVQQGSNPM

SEQ ID NO: 2182967 - protein, 18 aa, Cryptosporidium hominis
TSCQPNKFERLIVLDHKS

SEQ ID NO: 2182968 - protein, 27 aa, Cryptosporidium hominis
TSDFGIPRKSSLNSSFSDQMNTNISLS

SEQ ID NO: 2182969 - protein, 29 aa, Cryptosporidium hominis
TSDFGIPVDHVFGFWDWVGGRFSVCSAVG

SEQ ID NO: 2182970 - protein, 23 aa, Cryptosporidium hominis
TSDFTCLEFWDFLSNTLQKSSDK

SEQ ID NO: 2182971 - protein, 25 aa, Cryptosporidium hominis
TSEFGWSANMERIMKAQALRDTSMT

SEQ ID NO: 2182972 - protein, 22 aa, Cryptosporidium hominis
TSELFAIQWFLTLFTYDIADTE

SEQ ID NO: 2182973 - protein, 23 aa, Cryptosporidium hominis
TSELLKFWSKLGFLPVYIRQQVS

SEQ ID NO: 2182974 - protein, 26 aa, Cryptosporidium hominis
TSEPPKYAVSLVMDLSKVPNIDQMKE

SEQ ID NO: 2182975 - protein, 21 aa, Cryptosporidium hominis
TSFEAFHIFKLFVANPNKSPG

SEQ ID NO: 2182976 - protein, 22 aa, Cryptosporidium hominis
TSGDLTYIFGFNSYLHGQKLRE

SEQ ID NO: 2182977 - protein, 29 aa, Cryptosporidium hominis
TSGILCLKDAITLVARRAEIMASLPQNDG

SEQ ID NO: 2182978 - protein, 18 aa, Cryptosporidium hominis
TSGQTFMLSRQWKNQKEN

SEQ ID NO: 2182979 - protein, 23 aa, Cryptosporidium hominis
TSGREWCYVEPQVASQGSKNWNY

SEQ ID NO: 2182980 - protein, 22 aa, Cryptosporidium hominis
TSHIYKACVIVWLLSFNEETVP

SEQ ID NO: 2182981 - protein, 24 aa, Cryptosporidium hominis
TSHNMAVPFVKRSEYQLIDIHDNF

SEQ ID NO: 2182982 - protein, 19 aa, Cryptosporidium hominis
TSHNQIRNGQSYKSNSTGQ

SEQ ID NO: 2182983 - protein, 24 aa, Cryptosporidium hominis
TSHWWLIVICHPHKIFNLMNSSSP

SEQ ID NO: 2182984 - protein, 17 aa, Cryptosporidium hominis
TSIDTCISRLVGESRSV

SEQ ID NO: 2182985 - protein, 24 aa, Cryptosporidium hominis
TSIGQLRLQFIFLYYDTDRNGLLN

SEQ ID NO: 2182986 - protein, 27 aa, Cryptosporidium hominis
TSIGTNRWLLGFEVSGNLKRIIKIVLF

SEQ ID NO: 2182987 - protein, 17 aa, Cryptosporidium hominis
TSIIKVLYDKVSPHETV

SEQ ID NO: 2182988 - protein, 19 aa, Cryptosporidium hominis
TSIIRLYLRFKNLISDRYG

SEQ ID NO: 2182989 - protein, 19 aa, Cryptosporidium hominis
TSILLLLCLLFEKDESERN

SEQ ID NO: 2182990 - protein, 17 aa, Cryptosporidium hominis
TSIPGLRPPPIPISNET

SEQ ID NO: 2182991 - protein, 30 aa, Cryptosporidium hominis
TSITCDFISFSELNWYHFLTIYIVKIKNSL

SEQ ID NO: 2182992 - protein, 18 aa, Cryptosporidium hominis
TSKIFFFFEHYFQIYNLE

SEQ ID NO: 2182993 - protein, 27 aa, Cryptosporidium hominis
TSKLKLSKLAPMTIQFMRDLKTFTNIE

SEQ ID NO: 2182994 - protein, 20 aa, Cryptosporidium hominis
TSKNFPLETEEIISDFKDFF

SEQ ID NO: 2182995 - protein, 18 aa, Cryptosporidium hominis
TSKTLKYLALRYSRNNVK

SEQ ID NO: 2182996 - protein, 28 aa, Cryptosporidium hominis
TSLEVSDPFCYPTPIALSSASNHIEKNE

SEQ ID NO: 2182997 - protein, 22 aa, Cryptosporidium hominis
TSLKKNSVEVDVEEDDFDGLPS

SEQ ID NO: 2182998 - protein, 23 aa, Cryptosporidium hominis
TSLKTGYLYVYRFSNGMPIICKD

SEQ ID NO: 2182999 - protein, 25 aa, Cryptosporidium hominis
TSLLENKCRVVVCSDLLARGIDIRM

SEQ ID NO: 2183000 - protein, 17 aa, Cryptosporidium hominis
TSLRGANPYLILTVLHE

SEQ ID NO: 2183001 - protein, 22 aa, Cryptosporidium hominis
TSLRYLRIWRNSGISVSVTKLV

SEQ ID NO: 2183002 - protein, 22 aa, Cryptosporidium hominis
TSMAIEWTFEDVQAMFEKEELT

SEQ ID NO: 2183003 - protein, 19 aa, Cryptosporidium hominis
TSNIDLGVCSFQVNVPNNI

SEQ ID NO: 2183004 - protein, 18 aa, Cryptosporidium hominis
TSNLCSPTPVISFEDNGV

SEQ ID NO: 2183005 - protein, 28 aa, Cryptosporidium hominis
TSNLRWAFRSLYKFAFGDIAYAKKIGED

SEQ ID NO: 2183006 - protein, 18 aa, Cryptosporidium hominis
TSNPSIKAYSSFESLEDH

SEQ ID NO: 2183007 - protein, 21 aa, Cryptosporidium hominis
TSPQGKLCRSILDIMERRQNS

SEQ ID NO: 2183008 - protein, 19 aa, Cryptosporidium hominis
TSPRKEIYENLKSNLSTTQ

SEQ ID NO: 2183009 - protein, 21 aa, Cryptosporidium hominis
TSQLTALAMLCMDPYYRTIQG

SEQ ID NO: 2183010 - protein, 35 aa, Cryptosporidium hominis
TSRFLIYTCMIGICVLDIKIGKRVLIIGKFETGKR

SEQ ID NO: 2183011 - protein, 36 aa, Cryptosporidium hominis
TSRIVCSWKDIFDRLNCEPLKIEAYKVSTFGDQELH

SEQ ID NO: 2183012 - protein, 18 aa, Cryptosporidium hominis
TSRVLKRLVARDASHCEL

SEQ ID NO: 2183013 - protein, 24 aa, Cryptosporidium hominis
TSSECGKLVFIGGGNGIIYKIYYD

SEQ ID NO: 2183014 - protein, 19 aa, Cryptosporidium hominis
TSSFSSLYCLKQVSNEVAI

SEQ ID NO: 2183015 - protein, 17 aa, Cryptosporidium hominis
TSSLPAYYSSFSSSSRT

SEQ ID NO: 2183016 - protein, 27 aa, Cryptosporidium hominis
TSSPAGLLRLEMIFMYYDKGNKGYWNM

SEQ ID NO: 2183017 - protein, 24 aa, Cryptosporidium hominis
TSTFKIEAYIPIIESLGISQELRS

SEQ ID NO: 2183018 - protein, 18 aa, Cryptosporidium hominis
TSTIFKKKLFIRNLSEST

SEQ ID NO: 2183019 - protein, 17 aa, Cryptosporidium hominis
TSTLDVSLFYDKRLRSW

SEQ ID NO: 2183020 - protein, 22 aa, Cryptosporidium hominis
TSTNLCKLDGGISNPPIAPHRA

SEQ ID NO: 2183021 - protein, 19 aa, Cryptosporidium hominis
TSTTGFIFGSSPFGSSVSG

SEQ ID NO: 2183022 - protein, 20 aa, Cryptosporidium hominis
TSTVPSIHHPDARWMETAET

SEQ ID NO: 2183023 - protein, 24 aa, Cryptosporidium hominis
TSVFTPRKLFGIVITGLGFNMSTC

SEQ ID NO: 2183024 - protein, 18 aa, Cryptosporidium hominis
TSVKLTFNYFLVKQNELF

SEQ ID NO: 2183025 - protein, 33 aa, Cryptosporidium hominis
TSVMLNWEMEFKRWLPCFKVITYFGTPKERQKK

SEQ ID NO: 2183026 - protein, 17 aa, Cryptosporidium hominis
TSVNFPGFHSSRTGSNS

SEQ ID NO: 2183027 - protein, 36 aa, Cryptosporidium hominis
TSVPKSGIRLRLEWDRRRYCFKFTVYQIEEVRDSLG

SEQ ID NO: 2183028 - protein, 29 aa, Cryptosporidium hominis
TSVTNLCYSRELILNGIGNLFPQEAIEYG

SEQ ID NO: 2183029 - protein, 21 aa, Cryptosporidium hominis
TSYDKVCRCYHGPREGETKGR

SEQ ID NO: 2183030 - protein, 25 aa, Cryptosporidium hominis
TSYFFPPSFLRRAIQTAINNNVKVS

SEQ ID NO: 2183031 - protein, 24 aa, Cryptosporidium hominis
TSYILKRLHRGILYYKQKNNYIDS

SEQ ID NO: 2183032 - protein, 17 aa, Cryptosporidium hominis
TSYLPIVLALRRWQLSF

SEQ ID NO: 2183033 - protein, 24 aa, Cryptosporidium hominis
TTDVTRTLFLFGIGEERPTIEQIE

SEQ ID NO: 2183034 - protein, 20 aa, Cryptosporidium hominis
TTDYSCYYDFSNAHEYYQKF

SEQ ID NO: 2183035 - protein, 24 aa, Cryptosporidium hominis
TTEKSYKGTVTRETYSVDGKQTSK

SEQ ID NO: 2183036 - protein, 18 aa, Cryptosporidium hominis
TTEWQVFDTDKWCKIPIS

SEQ ID NO: 2183037 - protein, 22 aa, Cryptosporidium hominis
TTFKQGWTLFTLISTGIPIRDP

SEQ ID NO: 2183038 - protein, 20 aa, Cryptosporidium hominis
TTFNEDWTLFVILSTGVPVY

SEQ ID NO: 2183039 - protein, 17 aa, Cryptosporidium hominis
TTFVGMIYLFFLDIFRV

SEQ ID NO: 2183040 - protein, 21 aa, Cryptosporidium hominis
TTGFCAFPGAQLVEPLYEVVD

SEQ ID NO: 2183041 - protein, 21 aa, Cryptosporidium hominis
TTGIPSWLLKISGKLTKMENS

SEQ ID NO: 2183042 - protein, 22 aa, Cryptosporidium hominis
TTGQLLNCWLPHYKPINKIKLI

SEQ ID NO: 2183043 - protein, 18 aa, Cryptosporidium hominis
TTGQPVVFVGTGQKYFNL

SEQ ID NO: 2183044 - protein, 28 aa, Cryptosporidium hominis
TTGRRPTGLCGAALLISARYHGIPVSSS

SEQ ID NO: 2183045 - protein, 17 aa, Cryptosporidium hominis
TTGRYVSDWSQVFQAQQ

SEQ ID NO: 2183046 - protein, 18 aa, Cryptosporidium hominis
TTHLGLLSIFSYILGVND

SEQ ID NO: 2183047 - protein, 20 aa, Cryptosporidium hominis
TTIGEFLEKCRIKLKSEFKE

SEQ ID NO: 2183048 - protein, 18 aa, Cryptosporidium hominis
TTIPYLDGIWTWIDCNPK

SEQ ID NO: 2183049 - protein, 26 aa, Cryptosporidium hominis
TTISILKNRVQYILNRVHKLTNLEIN

SEQ ID NO: 2183050 - protein, 30 aa, Cryptosporidium hominis
TTKLGGPWEGYFLWDIIRGKILNYRDNINQ

SEQ ID NO: 2183051 - protein, 25 aa, Cryptosporidium hominis
TTKLLEPYCRLFSYSQTENFFGTQN

SEQ ID NO: 2183052 - protein, 40 aa, Cryptosporidium hominis
TTKQIKDSFPLPGIYYFRFKVRVGNTYAWMDPLNDDDIVP

SEQ ID NO: 2183053 - protein, 18 aa, Cryptosporidium hominis
TTKTELFEKVFISPLSIP

SEQ ID NO: 2183054 - protein, 25 aa, Cryptosporidium hominis
TTLCVIPNYILLLFGRNIENELREN

SEQ ID NO: 2183055 - protein, 20 aa, Cryptosporidium hominis
TTLPPKFIVVPMNPLSHYFY

SEQ ID NO: 2183056 - protein, 23 aa, Cryptosporidium hominis
TTNLKSREFFQNDEIGMLRRSSE

SEQ ID NO: 2183057 - protein, 21 aa, Cryptosporidium hominis
  misc_feature (17)..(17): Xaa can be any naturally occurring amino acid
TTNNFPLFGVYSNIINXLNNT

SEQ ID NO: 2183058 - protein, 22 aa, Cryptosporidium hominis
TTPHRPPTCLFLLILPIPPLLR

SEQ ID NO: 2183059 - protein, 20 aa, Cryptosporidium hominis
TTPQCIRGFLADFSFCTDPI

SEQ ID NO: 2183060 - protein, 17 aa, Cryptosporidium hominis
TTPRLKTPIKPVISDNN

SEQ ID NO: 2183061 - protein, 19 aa, Cryptosporidium hominis
TTRIEKILKAAAFMQQLKG

SEQ ID NO: 2183062 - protein, 27 aa, Cryptosporidium hominis
TTSFFRRLDWSPKGEMLVVPTGQYLLN

SEQ ID NO: 2183063 - protein, 36 aa, Cryptosporidium hominis
TTSFPTKSFSIGIGWSRLGLFVLNEYGDGLIQLKSD

SEQ ID NO: 2183064 - protein, 17 aa, Cryptosporidium hominis
TTSIVIIIGEMLRQAER

SEQ ID NO: 2183065 - protein, 18 aa, Cryptosporidium hominis
TTTMRNSCIGMRNNNVAG

SEQ ID NO: 2183066 - protein, 24 aa, Cryptosporidium hominis
TTTMTETFSNGSITSRQIDIEVSK

SEQ ID NO: 2183067 - protein, 23 aa, Cryptosporidium hominis
TTTRSGRFVSLKYGYDDILMSDD

SEQ ID NO: 2183068 - protein, 24 aa, Cryptosporidium hominis
TTTTGICDSASSVSVSGNIKSYSK

SEQ ID NO: 2183069 - protein, 23 aa, Cryptosporidium hominis
TTVIRKALNLSIHRLNNSISNKP

SEQ ID NO: 2183070 - protein, 24 aa, Cryptosporidium hominis
TTVSSPLLPPIAFPTKVIDTNQQN

SEQ ID NO: 2183071 - protein, 22 aa, Cryptosporidium hominis
TTVVMFWEIVKKLDLKLQKKLL

SEQ ID NO: 2183072 - protein, 27 aa, Cryptosporidium hominis
TVARGCALQAAMLSPVIKVREFNMTER

SEQ ID NO: 2183073 - protein, 23 aa, Cryptosporidium hominis
TVCQKLVIVDGIFIILETILCRI

SEQ ID NO: 2183074 - protein, 26 aa, Cryptosporidium hominis
TVCSIWKIERLIGGGSFGDIYLAVNT

SEQ ID NO: 2183075 - protein, 33 aa, Cryptosporidium hominis
TVCTIGKIENGWRFKYIFPIGHSPSVSSFVQIK

SEQ ID NO: 2183076 - protein, 25 aa, Cryptosporidium hominis
TVEDAVNIFSCLDIKKTGTIDLEDL

SEQ ID NO: 2183077 - protein, 20 aa, Cryptosporidium hominis
TVEFVKTVLLPPAPSSQSDL

SEQ ID NO: 2183078 - protein, 22 aa, Cryptosporidium hominis
TVEVPSVCFLKNFEKEGNENKL

SEQ ID NO: 2183079 - protein, 25 aa, Cryptosporidium hominis
TVEYLSSFILELCIDDILTSLDTSI

SEQ ID NO: 2183080 - protein, 19 aa, Cryptosporidium hominis
TVFDAKRLIGRKFDDQAVQ

SEQ ID NO: 2183081 - protein, 17 aa, Cryptosporidium hominis
TVFGKGDGNFRVFKFDN

SEQ ID NO: 2183082 - protein, 30 aa, Cryptosporidium hominis
TVGDCLLGLYYAMLLKWFDYETFDINEYST

SEQ ID NO: 2183083 - protein, 28 aa, Cryptosporidium hominis
TVHPRDNPWYKGCNKLILLGIPSSLRPH

SEQ ID NO: 2183084 - protein, 17 aa, Cryptosporidium hominis
TVIAEKLAVCIDEIKNV

SEQ ID NO: 2183085 - protein, 33 aa, Cryptosporidium hominis
TVIAWTSGVSFNFKSFCFMKFVTSIVGDSSSIS

SEQ ID NO: 2183086 - protein, 18 aa, Cryptosporidium hominis
TVIEAVRQFGFKIDIEYI

SEQ ID NO: 2183087 - protein, 22 aa, Cryptosporidium hominis
TVIEIRCLVLAPQHGNQNSINM

SEQ ID NO: 2183088 - protein, 20 aa, Cryptosporidium hominis
TVIFKAPNWYKIIKSTNEIS

SEQ ID NO: 2183089 - protein, 21 aa, Cryptosporidium hominis
TVKCLSWESSNRFAIVVVDDV

SEQ ID NO: 2183090 - protein, 21 aa, Cryptosporidium hominis
TVKFIGWPGIHIEKEDEKEEI

SEQ ID NO: 2183091 - protein, 24 aa, Cryptosporidium hominis
TVLLKFCFIVWPSLNNTKTEIDAL

SEQ ID NO: 2183092 - protein, 18 aa, Cryptosporidium hominis
TVLLPQIFVDGVCIGNDV

SEQ ID NO: 2183093 - protein, 17 aa, Cryptosporidium hominis
TVLSYTTFDHFFLIKSC

SEQ ID NO: 2183094 - protein, 18 aa, Cryptosporidium hominis
TVMCIEWYQELYKNSSSS

SEQ ID NO: 2183095 - protein, 24 aa, Cryptosporidium hominis
TVNLPRRHPIHIYRESVKMGRTNY

SEQ ID NO: 2183096 - protein, 24 aa, Cryptosporidium hominis
TVPCPWLDGKHVVFGKVLEGMEVV

SEQ ID NO: 2183097 - protein, 26 aa, Cryptosporidium hominis
TVQDYRFLPKQTFRIEDNNFYSNLNQ

SEQ ID NO: 2183098 - protein, 25 aa, Cryptosporidium hominis
TVSFGSGLHGWAFTIEKFARIYAKK

SEQ ID NO: 2183099 - protein, 17 aa, Cryptosporidium hominis
TVSKRLEYITGEIESVN

SEQ ID NO: 2183100 - protein, 17 aa, Cryptosporidium hominis
TVSMCELVFDQQMNYGV

SEQ ID NO: 2183101 - protein, 21 aa, Cryptosporidium hominis
TVSQLYYLIGHMQKLVVQNPE

SEQ ID NO: 2183102 - protein, 24 aa, Cryptosporidium hominis
TVSREMEELKGLKSQMEQKIEEIE

SEQ ID NO: 2183103 - protein, 25 aa, Cryptosporidium hominis
TVSSLCNCVTYFSGSTRSTGPNFHY

SEQ ID NO: 2183104 - protein, 23 aa, Cryptosporidium hominis
TVSSLRWFLLDKKVSFSSLRQDL

SEQ ID NO: 2183105 - protein, 26 aa, Cryptosporidium hominis
TVSVLECGDVPYGKRIHVLPFDDCLE

SEQ ID NO: 2183106 - protein, 18 aa, Cryptosporidium hominis
TVTFLVSFIERLDGESLK

SEQ ID NO: 2183107 - protein, 19 aa, Cryptosporidium hominis
TVVSKIEWKQGKDPTQEVV

SEQ ID NO: 2183108 - protein, 23 aa, Cryptosporidium hominis
TVYKMCYNQVPFRVDTRNGLDPE

SEQ ID NO: 2183109 - protein, 41 aa, Cryptosporidium hominis
TWCSERRTWRICYAPEPGKRVTKSFNPRHYGGLEQALQAAI

SEQ ID NO: 2183110 - protein, 24 aa, Cryptosporidium hominis
TWKEGVYVTIRFKFPKVVKKRFTY

SEQ ID NO: 2183111 - protein, 17 aa, Cryptosporidium hominis
TWLSLSFAVFICLNCSS

SEQ ID NO: 2183112 - protein, 18 aa, Cryptosporidium hominis
TWSCWEIFIKTSRMSIVC

SEQ ID NO: 2183113 - protein, 24 aa, Cryptosporidium hominis
TWVKTCIKAASSMGKFSTDRTIEE

SEQ ID NO: 2183114 - protein, 18 aa, Cryptosporidium hominis
TYCMSFGYDGSDYHGMQI

SEQ ID NO: 2183115 - protein, 19 aa, Cryptosporidium hominis
TYFCPSCLENVPSSEAFSR

SEQ ID NO: 2183116 - protein, 17 aa, Cryptosporidium hominis
TYFSRYYIRKLLQEFNV

SEQ ID NO: 2183117 - protein, 20 aa, Cryptosporidium hominis
TYGGGIWHTWFDRGLGIAGK

SEQ ID NO: 2183118 - protein, 25 aa, Cryptosporidium hominis
TYGLPIDTLTGYPLDPVSLIPFNPE

SEQ ID NO: 2183119 - protein, 28 aa, Cryptosporidium hominis
TYHFGFLGICINPPLALENPLSQKKKQM

SEQ ID NO: 2183120 - protein, 23 aa, Cryptosporidium hominis
TYIKLFCLAGNIIKEEERDYFIS

SEQ ID NO: 2183121 - protein, 19 aa, Cryptosporidium hominis
TYIRIISAINHLWLNDYCS

SEQ ID NO: 2183122 - protein, 18 aa, Cryptosporidium hominis
TYISRTLYLCKLPYDMTE

SEQ ID NO: 2183123 - protein, 20 aa, Cryptosporidium hominis
TYKCLGCKINPNFRKKSNAL

SEQ ID NO: 2183124 - protein, 18 aa, Cryptosporidium hominis
TYKLPEGHIRDHEAKQLW

SEQ ID NO: 2183125 - protein, 19 aa, Cryptosporidium hominis
TYKNVPNWHRDIVRVCENI

SEQ ID NO: 2183126 - protein, 19 aa, Cryptosporidium hominis
TYLADRVILFTGTPGVDCL

SEQ ID NO: 2183127 - protein, 19 aa, Cryptosporidium hominis
TYLIDEFMYLVSELGFLTK

SEQ ID NO: 2183128 - protein, 24 aa, Cryptosporidium hominis
TYLKENNKGWVLRAMNPHPNPSPP

SEQ ID NO: 2183129 - protein, 22 aa, Cryptosporidium hominis
TYLKPYFLEAYRPVKKGDAFLV

SEQ ID NO: 2183130 - protein, 19 aa, Cryptosporidium hominis
TYLNRFYKINSFIIQIQGR

SEQ ID NO: 2183131 - protein, 19 aa, Cryptosporidium hominis
TYLTIKDWKGKQEYYSPYT

SEQ ID NO: 2183132 - protein, 23 aa, Cryptosporidium hominis
TYPWTELAKKLILCTKRKKKDGK

SEQ ID NO: 2183133 - protein, 25 aa, Cryptosporidium hominis
TYSESSYIYKLWAVVCHSGNTLSCG

SEQ ID NO: 2183134 - protein, 25 aa, Cryptosporidium hominis
TYYECFEKWASLLISKYNIIIQDDN

SEQ ID NO: 2183135 - protein, 19 aa, Cryptosporidium hominis
VAAIPRIHKQVGLNFSILD

SEQ ID NO: 2183136 - protein, 19 aa, Cryptosporidium hominis
VACDCILEHGSSDYKFEEK

SEQ ID NO: 2183137 - protein, 18 aa, Cryptosporidium hominis
VADNEGRRDRDFDSERGR

SEQ ID NO: 2183138 - protein, 17 aa, Cryptosporidium hominis
VADSFKFTTVLRAATSG

SEQ ID NO: 2183139 - protein, 25 aa, Cryptosporidium hominis
VADVICKRAEFGKNFGTVLIPDALL

SEQ ID NO: 2183140 - protein, 19 aa, Cryptosporidium hominis
VAEEFLRDCFLSCNLHKII

SEQ ID NO: 2183141 - protein, 25 aa, Cryptosporidium hominis
VAEKCGLNIAAILFCEGVVLDALDW

SEQ ID NO: 2183142 - protein, 21 aa, Cryptosporidium hominis
VAELLWEISCEDLQKKGTEYQ

SEQ ID NO: 2183143 - protein, 22 aa, Cryptosporidium hominis
VAELRIGQFAAVTMCSYPLPLV

SEQ ID NO: 2183144 - protein, 26 aa, Cryptosporidium hominis
VAFKGDPDRILLILNQMERLNEIISM

SEQ ID NO: 2183145 - protein, 17 aa, Cryptosporidium hominis
VAFRASNMVGGFLQRLD

SEQ ID NO: 2183146 - protein, 25 aa, Cryptosporidium hominis
VAGFELSSFLLLLVLERSKISILNS

SEQ ID NO: 2183147 - protein, 19 aa, Cryptosporidium hominis
VAGLLLKKELEYFSKALES

SEQ ID NO: 2183148 - protein, 26 aa, Cryptosporidium hominis
VAIIPLPRWDRVALVRHFDTSGGNSN

SEQ ID NO: 2183149 - protein, 19 aa, Cryptosporidium hominis
VAIKKIHRVFEDLVDCKRI

SEQ ID NO: 2183150 - protein, 31 aa, Cryptosporidium hominis
VAKEGFELLKKCSRSGCLLRKDTDIENKSLH

SEQ ID NO: 2183151 - protein, 28 aa, Cryptosporidium hominis
VAKEMGSRLGGLVGYSIRFEDCTSEETV

SEQ ID NO: 2183152 - protein, 23 aa, Cryptosporidium hominis
VAKGSKSKANWWPFHGSTAGLVC

SEQ ID NO: 2183153 - protein, 21 aa, Cryptosporidium hominis
VAKNCKRRNFLKILQNTKFFQ

SEQ ID NO: 2183154 - protein, 18 aa, Cryptosporidium hominis
VALIKSYFLHNSRVSINF

SEQ ID NO: 2183155 - protein, 17 aa, Cryptosporidium hominis
VAMAPIGFTKCFYGRIQ

SEQ ID NO: 2183156 - protein, 19 aa, Cryptosporidium hominis
VANKLLLNTIRLRVAKKVK

SEQ ID NO: 2183157 - protein, 32 aa, Cryptosporidium hominis
VAPGLCSTNSFLARPEFPKWLGKNSTTNKNKR

SEQ ID NO: 2183158 - protein, 17 aa, Cryptosporidium hominis
VAQFDWVWFDWPHSKIP

SEQ ID NO: 2183159 - protein, 25 aa, Cryptosporidium hominis
VAQMKIGNSFFPFSITVLEESHVDF

SEQ ID NO: 2183160 - protein, 19 aa, Cryptosporidium hominis
VASFGRLFSIKSLGSDQIE

SEQ ID NO: 2183161 - protein, 24 aa, Cryptosporidium hominis
VASGGLFFFEFLYRNTRIYIKRSG

SEQ ID NO: 2183162 - protein, 20 aa, Cryptosporidium hominis
VASMKRLWENKTPKLSSIWR

SEQ ID NO: 2183163 - protein, 26 aa, Cryptosporidium hominis
VASSLHKLKGFFLILVQTELGDIYRI

SEQ ID NO: 2183164 - protein, 23 aa, Cryptosporidium hominis
VATMWNFRKSYIVSEQSNTQLID

SEQ ID NO: 2183165 - protein, 24 aa, Cryptosporidium hominis
VATSGQAAIKCIRSMRHWAYVTFG

SEQ ID NO: 2183166 - protein, 19 aa, Cryptosporidium hominis
VAVRRACYGVLRHVMESGA

SEQ ID NO: 2183167 - protein, 30 aa, Cryptosporidium hominis
VAYDCTFKLRCSRGIAVSKIYAPWTAGGPT

SEQ ID NO: 2183168 - protein, 21 aa, Cryptosporidium hominis
VAYSNIIKVFGMEMNPKQATC

SEQ ID NO: 2183169 - protein, 18 aa, Cryptosporidium hominis
VCCRGSVVQTGRAASLYP

SEQ ID NO: 2183170 - protein, 18 aa, Cryptosporidium hominis
VCEINPGLLRHAIHESTS

SEQ ID NO: 2183171 - protein, 26 aa, Cryptosporidium hominis
VCGLHPAEGPVIWSQYRRFLSHQNEE

SEQ ID NO: 2183172 - protein, 17 aa, Cryptosporidium hominis
VCIPPIPIRAYLIRLAQ

SEQ ID NO: 2183173 - protein, 24 aa, Cryptosporidium hominis
VCIRGCSFFGCNIPFDACSYQMCN

SEQ ID NO: 2183174 - protein, 22 aa, Cryptosporidium hominis
VCKDIPIGKILLEFQNPKTELD

SEQ ID NO: 2183175 - protein, 19 aa, Cryptosporidium hominis
VCNHPDLFEPRTIKTPIVE

SEQ ID NO: 2183176 - protein, 27 aa, Cryptosporidium hominis
VCPTFELLLRKCIIEWEKQIDYIINNK

SEQ ID NO: 2183177 - protein, 21 aa, Cryptosporidium hominis
VCQILELLGLILYEHQKKLTE

SEQ ID NO: 2183178 - protein, 26 aa, Cryptosporidium hominis
VCTASYRLLPEFGFPNGPISGSDALK

SEQ ID NO: 2183179 - protein, 22 aa, Cryptosporidium hominis
VCWDKYRKGLLILGRQISNADT

SEQ ID NO: 2183180 - protein, 23 aa, Cryptosporidium hominis
VDAALDDQYRWSVANLIKKQSIS

SEQ ID NO: 2183181 - protein, 23 aa, Cryptosporidium hominis
VDAPEILQPPAIFIAETNGDIIT

SEQ ID NO: 2183182 - protein, 18 aa, Cryptosporidium hominis
VDDDGYGGGSIFGESVVR

SEQ ID NO: 2183183 - protein, 18 aa, Cryptosporidium hominis
VDEARRLVLFRIPKNKNK

SEQ ID NO: 2183184 - protein, 23 aa, Cryptosporidium hominis
VDEFVLRTPILVKCIIDPHNIMV

SEQ ID NO: 2183185 - protein, 22 aa, Cryptosporidium hominis
VDEVPAILNFSRRLPHPSDGII

SEQ ID NO: 2183186 - protein, 17 aa, Cryptosporidium hominis
VDFDLPILSNFEITPEK

SEQ ID NO: 2183187 - protein, 18 aa, Cryptosporidium hominis
VDFFSLSIHDCYKKIHEL

SEQ ID NO: 2183188 - protein, 18 aa, Cryptosporidium hominis
VDFIPKIYLPYDSIVNAF

SEQ ID NO: 2183189 - protein, 19 aa, Cryptosporidium hominis
VDFVFWSDRLIRLVVENAL

SEQ ID NO: 2183190 - protein, 17 aa, Cryptosporidium hominis
VDGCGIAASTEFIAFPA

SEQ ID NO: 2183191 - protein, 18 aa, Cryptosporidium hominis
VDHPYLIVYGKFNHKKDL

SEQ ID NO: 2183192 - protein, 17 aa, Cryptosporidium hominis
VDIAKSVIITSVPENEN

SEQ ID NO: 2183193 - protein, 18 aa, Cryptosporidium hominis
VDICAMVHGISKDLKGQK

SEQ ID NO: 2183194 - protein, 20 aa, Cryptosporidium hominis
VDIFERISLVLNHLGEISRF

SEQ ID NO: 2183195 - protein, 19 aa, Cryptosporidium hominis
VDIGMPLLAHLKVYTRQSD

SEQ ID NO: 2183196 - protein, 19 aa, Cryptosporidium hominis
VDILCEFADFFVDLASNVA

SEQ ID NO: 2183197 - protein, 17 aa, Cryptosporidium hominis
VDITCPYLPTKNSRRLI

SEQ ID NO: 2183198 - protein, 22 aa, Cryptosporidium hominis
VDIWAIGCIFFEILHLRRPFGL

SEQ ID NO: 2183199 - protein, 18 aa, Cryptosporidium hominis
VDIYSNWIDKCYEVNSME

SEQ ID NO: 2183200 - protein, 21 aa, Cryptosporidium hominis
VDKLCLAELELKIKENESNEK

SEQ ID NO: 2183201 - protein, 19 aa, Cryptosporidium hominis
VDKLVCAMFVLSKDPEVII

SEQ ID NO: 2183202 - protein, 23 aa, Cryptosporidium hominis
VDLLFRLLQYCPKKRITALEALQ

SEQ ID NO: 2183203 - protein, 22 aa, Cryptosporidium hominis
VDLMSLYLKFAHGLDYYSLSTS

SEQ ID NO: 2183204 - protein, 17 aa, Cryptosporidium hominis
VDLPCNIEVYKSLDCES

SEQ ID NO: 2183205 - protein, 18 aa, Cryptosporidium hominis
VDLQARYFISSTLVSFGL

SEQ ID NO: 2183206 - protein, 32 aa, Cryptosporidium hominis
VDLYYWYKDEEFIYLLLDFKISMIPKLHDILL

SEQ ID NO: 2183207 - protein, 30 aa, Cryptosporidium hominis
VDNLPICYIYKYRRESILKENLFKYIPTSV

SEQ ID NO: 2183208 - protein, 17 aa, Cryptosporidium hominis
VDNRICVHDIKFNRTHV

SEQ ID NO: 2183209 - protein, 22 aa, Cryptosporidium hominis
VDNSFLFNEWVEGFSSNNIIIN

SEQ ID NO: 2183210 - protein, 20 aa, Cryptosporidium hominis
VDPEEYCIVAPDTVIHCEGD

SEQ ID NO: 2183211 - protein, 18 aa, Cryptosporidium hominis
VDPEMIKLLPTIDPLRKL

SEQ ID NO: 2183212 - protein, 25 aa, Cryptosporidium hominis
VDPERFKYRLAFQEYLNLLLHVLKN

SEQ ID NO: 2183213 - protein, 27 aa, Cryptosporidium hominis
VDPERRCFRVIGGVMVERTVKTVKPAL

SEQ ID NO: 2183214 - protein, 26 aa, Cryptosporidium hominis
VDPFPKPCYLFAVVAGVLGRLEDKFI

SEQ ID NO: 2183215 - protein, 23 aa, Cryptosporidium hominis
VDPPNPLPVILVSKYVESQCNEI

SEQ ID NO: 2183216 - protein, 17 aa, Cryptosporidium hominis
VDQLLIKTSNDFSNLEG

SEQ ID NO: 2183217 - protein, 17 aa, Cryptosporidium hominis
VDQSFHISIYIPQYIGY

SEQ ID NO: 2183218 - protein, 21 aa, Cryptosporidium hominis
VDSFLPISCEFPESLLPINGV

SEQ ID NO: 2183219 - protein, 17 aa, Cryptosporidium hominis
VDSGVPFRSADSDPSTL

SEQ ID NO: 2183220 - protein, 22 aa, Cryptosporidium hominis
VDSLRDMLYGVGFYNTKAKNLK

SEQ ID NO: 2183221 - protein, 26 aa, Cryptosporidium hominis
VDSMLRRGKLFFSVCASSYQLGKKTE

SEQ ID NO: 2183222 - protein, 20 aa, Cryptosporidium hominis
VDSNICLRLVQLSKEEIRLF

SEQ ID NO: 2183223 - protein, 26 aa, Cryptosporidium hominis
VDSNLRCTAKFLIGVSNDCLRMFSKC

SEQ ID NO: 2183224 - protein, 23 aa, Cryptosporidium hominis
VDSSRFKYTFPTLGYCAINLIET

SEQ ID NO: 2183225 - protein, 18 aa, Cryptosporidium hominis
VDTGMGLERLVSILQNKT

SEQ ID NO: 2183226 - protein, 22 aa, Cryptosporidium hominis
VDTLQRYNCRSIPLEFTPEKVC

SEQ ID NO: 2183227 - protein, 24 aa, Cryptosporidium hominis
VDTVLKLAKLSILRIESEGGGGGG

SEQ ID NO: 2183228 - protein, 24 aa, Cryptosporidium hominis
VEACPIDETFCLALEHGLPPTGGW

SEQ ID NO: 2183229 - protein, 20 aa, Cryptosporidium hominis
VEAIKSEFERIFKNEDSAFN

SEQ ID NO: 2183230 - protein, 17 aa, Cryptosporidium hominis
VEAIVLPMTHKERFEKI

SEQ ID NO: 2183231 - protein, 17 aa, Cryptosporidium hominis
VEALFTCINDMRKELAI

SEQ ID NO: 2183232 - protein, 18 aa, Cryptosporidium hominis
VEALSGAIAFDLKSVLEL

SEQ ID NO: 2183233 - protein, 22 aa, Cryptosporidium hominis
VEAPVFKYGGYKNSSLIINNNK

SEQ ID NO: 2183234 - protein, 17 aa, Cryptosporidium hominis
VECDCVETAIKLYDELD

SEQ ID NO: 2183235 - protein, 28 aa, Cryptosporidium hominis
VECKKCQVKFHFECCISDNIMNLNNLNN

SEQ ID NO: 2183236 - protein, 18 aa, Cryptosporidium hominis
VECLNYLIKQHKKENFEL

SEQ ID NO: 2183237 - protein, 18 aa, Cryptosporidium hominis
VECSCSSIRIVIGSSSVS

SEQ ID NO: 2183238 - protein, 23 aa, Cryptosporidium hominis
VEEIVKILCCVLFTNNYSSNKGS

SEQ ID NO: 2183239 - protein, 17 aa, Cryptosporidium hominis
VEENVDLTKSCLWSILE

SEQ ID NO: 2183240 - protein, 18 aa, Cryptosporidium hominis
VEFGDRPIDGIILTKFDT

SEQ ID NO: 2183241 - protein, 26 aa, Cryptosporidium hominis
VEFYFALLQSIRWPSKLLIKGGPNVK

SEQ ID NO: 2183242 - protein, 21 aa, Cryptosporidium hominis
VEGKKSLAIEAFANALRQIPT

SEQ ID NO: 2183243 - protein, 19 aa, Cryptosporidium hominis
VEGLIRYGLDKEGRPCIFM

SEQ ID NO: 2183244 - protein, 26 aa, Cryptosporidium hominis
VEGLPRKIAAFILQRHGNQIPYDRQF

SEQ ID NO: 2183245 - protein, 17 aa, Cryptosporidium hominis
VEGSVKVPIAIYLEPWH

SEQ ID NO: 2183246 - protein, 17 aa, Cryptosporidium hominis
VEGTFHYGLAEEIYTHF

SEQ ID NO: 2183247 - protein, 28 aa, Cryptosporidium hominis
VEGWYDPRFPTVRGIVRRGLSPSALLQF

SEQ ID NO: 2183248 - protein, 23 aa, Cryptosporidium hominis
VEICPLNVPKLIAFQRPEHYIRF

SEQ ID NO: 2183249 - protein, 18 aa, Cryptosporidium hominis
VEIGERIEFPLLVIVKHL

SEQ ID NO: 2183250 - protein, 21 aa, Cryptosporidium hominis
VEIGFNMLLSFSKLPDIQSEM

SEQ ID NO: 2183251 - protein, 28 aa, Cryptosporidium hominis
VEIHRRYDIKGSWIGRSTPLILQEDKTI

SEQ ID NO: 2183252 - protein, 22 aa, Cryptosporidium hominis
VEIKHFLRLYPPGTTDVRSVKF

SEQ ID NO: 2183253 - protein, 24 aa, Cryptosporidium hominis
VEIKQKLQIWLGFSQISLNIRQAC

SEQ ID NO: 2183254 - protein, 18 aa, Cryptosporidium hominis
VEILGLYPNIPVNIKKHS

SEQ ID NO: 2183255 - protein, 17 aa, Cryptosporidium hominis
VEIMSRITISFGSVLES

SEQ ID NO: 2183256 - protein, 17 aa, Cryptosporidium hominis
VEIRRRSIIDPELVEVD

SEQ ID NO: 2183257 - protein, 17 aa, Cryptosporidium hominis
VEISLYHALSFYNAIYS

SEQ ID NO: 2183258 - protein, 18 aa, Cryptosporidium hominis
VEITRSFCGISIVCNYHK

SEQ ID NO: 2183259 - protein, 17 aa, Cryptosporidium hominis
VEKCIFLSDGRFHLESA

SEQ ID NO: 2183260 - protein, 19 aa, Cryptosporidium hominis
VEKFLKRRPQMKHKEKEGA

SEQ ID NO: 2183261 - protein, 42 aa, Cryptosporidium hominis
VEKKQYGWFWVCPEGGDNCKYRHCLPVGYVIKEQESDDGGDI

SEQ ID NO: 2183262 - protein, 36 aa, Cryptosporidium hominis
VEKKRIFEGLTFFISREVPLLPLAFVIKSFGGKVGW

SEQ ID NO: 2183263 - protein, 17 aa, Cryptosporidium hominis
VELAQLIMIRYLLEIED

SEQ ID NO: 2183264 - protein, 21 aa, Cryptosporidium hominis
VELIKSLYVYRHSKEFCYIES

SEQ ID NO: 2183265 - protein, 17 aa, Cryptosporidium hominis
VELKGVLDQVLLDPNFS

SEQ ID NO: 2183266 - protein, 18 aa, Cryptosporidium hominis
VELLKKLDHPNIMKLFEI

SEQ ID NO: 2183267 - protein, 23 aa, Cryptosporidium hominis
VELNYCLVYGFRAIQSISRKLNL

SEQ ID NO: 2183268 - protein, 31 aa, Cryptosporidium hominis
VELPCHIFMGVIYYQRLRHMVADKAQVRATG

SEQ ID NO: 2183269 - protein, 17 aa, Cryptosporidium hominis
VELPPCYSSSLNYSNMV

SEQ ID NO: 2183270 - protein, 25 aa, Cryptosporidium hominis
VELSARFNHMAAFSLTWPEVIQLCE

SEQ ID NO: 2183271 - protein, 27 aa, Cryptosporidium hominis
VELVLLRLGISFYFSLCQIMDHPFSTN

SEQ ID NO: 2183272 - protein, 25 aa, Cryptosporidium hominis
VELYCIHPSGSCYKYCAMAVGKGRQ

SEQ ID NO: 2183273 - protein, 23 aa, Cryptosporidium hominis
VENIIRRLFKVFLQDFKLSSMYK

SEQ ID NO: 2183274 - protein, 21 aa, Cryptosporidium hominis
VENLLRLLSYHGVMACVGAPP

SEQ ID NO: 2183275 - protein, 25 aa, Cryptosporidium hominis
VENSKFHPFIGIKLEETFIREHQII

SEQ ID NO: 2183276 - protein, 21 aa, Cryptosporidium hominis
VENTRILTPFNIRNGINSIKS

SEQ ID NO: 2183277 - protein, 17 aa, Cryptosporidium hominis
VENVSLWGNSFQEKTQY

SEQ ID NO: 2183278 - protein, 26 aa, Cryptosporidium hominis
VENWLPKRLGGGLGKVRGQEKPESKR

SEQ ID NO: 2183279 - protein, 24 aa, Cryptosporidium hominis
VEPFKSKFLKMFVKKPLEDSTPSV

SEQ ID NO: 2183280 - protein, 25 aa, Cryptosporidium hominis
VEPNLLGFGDNCFYIVNNGPFSQSN

SEQ ID NO: 2183281 - protein, 20 aa, Cryptosporidium hominis
VEPNMTFSIEKIKIGALNLY

SEQ ID NO: 2183282 - protein, 19 aa, Cryptosporidium hominis
VEPYFPGLFAQALSTTNVS

SEQ ID NO: 2183283 - protein, 19 aa, Cryptosporidium hominis
VEQNKCYWLVGFKEERWKK

SEQ ID NO: 2183284 - protein, 24 aa, Cryptosporidium hominis
VERIIEPFPDYMLKKAYNSSKSGK

SEQ ID NO: 2183285 - protein, 20 aa, Cryptosporidium hominis
VERIYTCWITAKASESQKEL

SEQ ID NO: 2183286 - protein, 24 aa, Cryptosporidium hominis
VERKEISHCIGSGTSVFLQDYDIP

SEQ ID NO: 2183287 - protein, 17 aa, Cryptosporidium hominis
VESFSVNILEAISYQDH

SEQ ID NO: 2183288 - protein, 18 aa, Cryptosporidium hominis
VESIKCCEEVLKNEFQDK

SEQ ID NO: 2183289 - protein, 24 aa, Cryptosporidium hominis
VESKLFLDKLWLWHSGKYVNKFKT

SEQ ID NO: 2183290 - protein, 23 aa, Cryptosporidium hominis
VETLLALEFFFPMDSGDLPYEVK

SEQ ID NO: 2183291 - protein, 18 aa, Cryptosporidium hominis
VETLYRMGYLCIIISTRT

SEQ ID NO: 2183292 - protein, 24 aa, Cryptosporidium hominis
VEVELRKCCNHPFQVVGVEEREVA

SEQ ID NO: 2183293 - protein, 17 aa, Cryptosporidium hominis
VEVKPMLASPTIVPESR

SEQ ID NO: 2183294 - protein, 24 aa, Cryptosporidium hominis
VEVLECSKSINNSFCITAKGRMYI

SEQ ID NO: 2183295 - protein, 23 aa, Cryptosporidium hominis
VEVPEVRIVDKFVSKPVTKYVER

SEQ ID NO: 2183296 - protein, 19 aa, Cryptosporidium hominis
VEVPIAFYSAIPVPILIDR

SEQ ID NO: 2183297 - protein, 27 aa, Cryptosporidium hominis
VEVPVEVPIAYPPRIVPVPKPYIVERT

SEQ ID NO: 2183298 - protein, 20 aa, Cryptosporidium hominis
VEYEFSKWINMGDFYLPTGH

SEQ ID NO: 2183299 - protein, 21 aa, Cryptosporidium hominis
VEYIDSRICELRGEKIDLQSS

SEQ ID NO: 2183300 - protein, 23 aa, Cryptosporidium hominis
VEYRMPYIMGIKVVDSIIIESRK

SEQ ID NO: 2183301 - protein, 25 aa, Cryptosporidium hominis
VEYYRKMLEFCLSIFSFELREFDWS

SEQ ID NO: 2183302 - protein, 24 aa, Cryptosporidium hominis
VFAPEILQKVGLTFPTQQAIHAIG

SEQ ID NO: 2183303 - protein, 21 aa, Cryptosporidium hominis
VFCTRMGYSSMTIRGNQIAFR

SEQ ID NO: 2183304 - protein, 25 aa, Cryptosporidium hominis
VFDGHGGSVISEWVSRHIESIFEQE

SEQ ID NO: 2183305 - protein, 24 aa, Cryptosporidium hominis
VFDSSIKVGKLFLVDLAGSEKISK

SEQ ID NO: 2183306 - protein, 18 aa, Cryptosporidium hominis
VFEAHGIKRFQSLGKQFN

SEQ ID NO: 2183307 - protein, 25 aa, Cryptosporidium hominis
VFEEYYLAWHCFRIDECTQIAMDLS

SEQ ID NO: 2183308 - protein, 21 aa, Cryptosporidium hominis
VFENPSLPLTFVLTSITKPSR

SEQ ID NO: 2183309 - protein, 22 aa, Cryptosporidium hominis
VFFEVYRVPALFVSTQAVLSLY

SEQ ID NO: 2183310 - protein, 22 aa, Cryptosporidium hominis
VFFKHILFSTSIEHLNLSRNKI

SEQ ID NO: 2183311 - protein, 22 aa, Cryptosporidium hominis
VFGNLILICPCFDNISTEISKI

SEQ ID NO: 2183312 - protein, 19 aa, Cryptosporidium hominis
VFIEPRNSFELGSVLDSYM

SEQ ID NO: 2183313 - protein, 19 aa, Cryptosporidium hominis
VFIHKGGKFIYNYNSRIDE

SEQ ID NO: 2183314 - protein, 24 aa, Cryptosporidium hominis
VFLNEVRRLTCIFVSVKGLDISTH

SEQ ID NO: 2183315 - protein, 18 aa, Cryptosporidium hominis
VFNFRKSISTLKFLCDSN

SEQ ID NO: 2183316 - protein, 18 aa, Cryptosporidium hominis
VFNKWYYPIRIILFHGKG

SEQ ID NO: 2183317 - protein, 25 aa, Cryptosporidium hominis
VFPSIVGRPKMPGVMVGMDQKDCYV

SEQ ID NO: 2183318 - protein, 20 aa, Cryptosporidium hominis
VFSEKDRWFSLSSVTSPVDI

SEQ ID NO: 2183319 - protein, 17 aa, Cryptosporidium hominis
VFSESIIYCCVDKIMDE

SEQ ID NO: 2183320 - protein, 25 aa, Cryptosporidium hominis
VFTEQELRESLVFTLPGSKFHRLKH

SEQ ID NO: 2183321 - protein, 25 aa, Cryptosporidium hominis
VFTIYRILDTFVFPFSIPNLKQPCL

SEQ ID NO: 2183322 - protein, 18 aa, Cryptosporidium hominis
VGALCFQYISNLPRKFSS

SEQ ID NO: 2183323 - protein, 23 aa, Cryptosporidium hominis
VGCGLSAGLGMGGIMDVGYNQKL

SEQ ID NO: 2183324 - protein, 18 aa, Cryptosporidium hominis
VGDFGLCQQLFSDKGFIN

SEQ ID NO: 2183325 - protein, 42 aa, Cryptosporidium hominis
VGEELPIKDLFFFPSRLLETAAFRPPKNVTWLDAGKTKSSEN

SEQ ID NO: 2183326 - protein, 18 aa, Cryptosporidium hominis
VGELKPRINQALKAELDT

SEQ ID NO: 2183327 - protein, 19 aa, Cryptosporidium hominis
VGESIKFRDGKIVTDLNNL

SEQ ID NO: 2183328 - protein, 19 aa, Cryptosporidium hominis
VGFCGNLLIETKVFNKVGN

SEQ ID NO: 2183329 - protein, 19 aa, Cryptosporidium hominis
VGFNPKYVPTWEVREVPKL

SEQ ID NO: 2183330 - protein, 17 aa, Cryptosporidium hominis
VGGDFSHSVSRLIRVNI

SEQ ID NO: 2183331 - protein, 20 aa, Cryptosporidium hominis
VGGISPPHGIQIGGVIDYKS

SEQ ID NO: 2183332 - protein, 17 aa, Cryptosporidium hominis
VGGLHVWDRHRSTPLQE

SEQ ID NO: 2183333 - protein, 25 aa, Cryptosporidium hominis
VGGPIPCIEFRFLSIPEMDYDAKSY

SEQ ID NO: 2183334 - protein, 18 aa, Cryptosporidium hominis
VGGVVTWNKQNNFVEDML

SEQ ID NO: 2183335 - protein, 24 aa, Cryptosporidium hominis
VGHLRPRSQFFSSVMRIRNSLAFA

SEQ ID NO: 2183336 - protein, 17 aa, Cryptosporidium hominis
VGIGKIFCCHARTRFID

SEQ ID NO: 2183337 - protein, 17 aa, Cryptosporidium hominis
VGIGQQGVSQSINTVQP

SEQ ID NO: 2183338 - protein, 25 aa, Cryptosporidium hominis
VGIICRKCNKMLCSEHIYESEHECM

SEQ ID NO: 2183339 - protein, 22 aa, Cryptosporidium hominis
VGIKEGERLVVLLSKGASQKAA

SEQ ID NO: 2183340 - protein, 26 aa, Cryptosporidium hominis
VGIYGFNCRCGFNFCSTHRYADAHDC

SEQ ID NO: 2183341 - protein, 17 aa, Cryptosporidium hominis
VGLDESRIPKIGLEGSV

SEQ ID NO: 2183342 - protein, 21 aa, Cryptosporidium hominis
VGLGICGGGSGISRHLGISKL

SEQ ID NO: 2183343 - protein, 19 aa, Cryptosporidium hominis
VGLGWGCKVEMNRGGGTMR

SEQ ID NO: 2183344 - protein, 23 aa, Cryptosporidium hominis
VGLKKKRRAIWLGSEVENNAIKE

SEQ ID NO: 2183345 - protein, 24 aa, Cryptosporidium hominis
VGNLFRKIRHGAFSLPGHISDLAK

SEQ ID NO: 2183346 - protein, 28 aa, Cryptosporidium hominis
VGNLPFRRLCLKFGADVTVSEMVLCNEI

SEQ ID NO: 2183347 - protein, 25 aa, Cryptosporidium hominis
VGQKDSRIWGLWAVLDFLNNSRKQS

SEQ ID NO: 2183348 - protein, 24 aa, Cryptosporidium hominis
VGQSYHVLPFSESVKCKAISIHDH

SEQ ID NO: 2183349 - protein, 17 aa, Cryptosporidium hominis
VGQYISRKNEISGLAWP

SEQ ID NO: 2183350 - protein, 21 aa, Cryptosporidium hominis
VGRILLVKLIEEFKNMQIVCL

SEQ ID NO: 2183351 - protein, 19 aa, Cryptosporidium hominis
VGRRMSRRAAGRGTGASRS

SEQ ID NO: 2183352 - protein, 21 aa, Cryptosporidium hominis
VGRSRGCGVVEYSFPEEAQRA

SEQ ID NO: 2183353 - protein, 25 aa, Cryptosporidium hominis
VGSDCLCWRCYFNQRPFFEEMDYSR

SEQ ID NO: 2183354 - protein, 24 aa, Cryptosporidium hominis
VGSEFGRIFFSNWIKSIEEDSKKS

SEQ ID NO: 2183355 - protein, 17 aa, Cryptosporidium hominis
VGSSSFKSNNKADVKTR

SEQ ID NO: 2183356 - protein, 23 aa, Cryptosporidium hominis
VGTHPFKNLSLFDMVYILCEDNT

SEQ ID NO: 2183357 - protein, 27 aa, Cryptosporidium hominis
VGTNMRSKCLLIAIGQMLEDYYCPPYK

SEQ ID NO: 2183358 - protein, 23 aa, Cryptosporidium hominis
VGVESRIGIGFDRYRTKNAVLNK

SEQ ID NO: 2183359 - protein, 19 aa, Cryptosporidium hominis
VGVIDCSWNKIDQVPFHKI

SEQ ID NO: 2183360 - protein, 17 aa, Cryptosporidium hominis
VGYKMLYLDVVKGGKFQ

SEQ ID NO: 2183361 - protein, 19 aa, Cryptosporidium hominis
VGYLKHWDSLTVLRDTLDA

SEQ ID NO: 2183362 - protein, 18 aa, Cryptosporidium hominis
VHAKWSPVCTASYRLLPE

SEQ ID NO: 2183363 - protein, 24 aa, Cryptosporidium hominis
VHDFRLKSILFINWRRYSKKQRIL

SEQ ID NO: 2183364 - protein, 28 aa, Cryptosporidium hominis
VHFPYLPKLRFNASMSTPFSRLAESYSR

SEQ ID NO: 2183365 - protein, 22 aa, Cryptosporidium hominis
VHKPNVRFVIHSSIPDSIDSYY

SEQ ID NO: 2183366 - protein, 20 aa, Cryptosporidium hominis
VHLLDFPNIVIKGSDLSLPF

SEQ ID NO: 2183367 - protein, 18 aa, Cryptosporidium hominis
VHLSNVFSHPKYRSNMEY

SEQ ID NO: 2183368 - protein, 17 aa, Cryptosporidium hominis
VHNEFIAPIALLGSSIE

SEQ ID NO: 2183369 - protein, 21 aa, Cryptosporidium hominis
VHNRLKYKKALKRLKGTQRSM

SEQ ID NO: 2183370 - protein, 17 aa, Cryptosporidium hominis
VHPSMPTAGRVSGVTGL

SEQ ID NO: 2183371 - protein, 17 aa, Cryptosporidium hominis
VHRIGILDICLFNLDRN

SEQ ID NO: 2183372 - protein, 23 aa, Cryptosporidium hominis
VHRNNFRFLLEKSCETLHNTNFV

SEQ ID NO: 2183373 - protein, 21 aa, Cryptosporidium hominis
VHSAMIFNMEIFRNERRKELD

SEQ ID NO: 2183374 - protein, 17 aa, Cryptosporidium hominis
VHTLRANVRYRIGPEDG

SEQ ID NO: 2183375 - protein, 28 aa, Cryptosporidium hominis
VHVLPFPSLCKFFEILFEKGNLFLFQFG

SEQ ID NO: 2183376 - protein, 26 aa, Cryptosporidium hominis
VHVLRVRLSPAFINFLLPKAVDEVKE

SEQ ID NO: 2183377 - protein, 20 aa, Cryptosporidium hominis
VHYKIKISLFDVQNIQVGGS

SEQ ID NO: 2183378 - protein, 22 aa, Cryptosporidium hominis
VIACVGFKMFLGITAETKDWNP

SEQ ID NO: 2183379 - protein, 20 aa, Cryptosporidium hominis
VIALLALPKICCILFLVNPG

SEQ ID NO: 2183380 - protein, 17 aa, Cryptosporidium hominis
VICQVKGIYIPPDSSNP

SEQ ID NO: 2183381 - protein, 25 aa, Cryptosporidium hominis
VIDCKKFGNYVLHIGILLQGKIEIS

SEQ ID NO: 2183382 - protein, 24 aa, Cryptosporidium hominis
VIDDLKSGCNLFEKKSPRDEQLRE

SEQ ID NO: 2183383 - protein, 20 aa, Cryptosporidium hominis
VIDLPTWRRMRTQAELRREL

SEQ ID NO: 2183384 - protein, 19 aa, Cryptosporidium hominis
VIDSLPILNRHGFGPLTIV

SEQ ID NO: 2183385 - protein, 19 aa, Cryptosporidium hominis
VIDSNLIFTILFGSDSLEK

SEQ ID NO: 2183386 - protein, 21 aa, Cryptosporidium hominis
VIEIPFPLLVSKFSYEEEQYS

SEQ ID NO: 2183387 - protein, 18 aa, Cryptosporidium hominis
VIEWLYNLLECCGKLAKL

SEQ ID NO: 2183388 - protein, 22 aa, Cryptosporidium hominis
VIFRCSKWRDILMELISKSHKE

SEQ ID NO: 2183389 - protein, 19 aa, Cryptosporidium hominis
VIFRPCIIGLLEIYNIHCQ

SEQ ID NO: 2183390 - protein, 19 aa, Cryptosporidium hominis
VIGCLKTKIINDIKPYLTK

SEQ ID NO: 2183391 - protein, 21 aa, Cryptosporidium hominis
VIGDNCIIKGCSILDNTVIEN

SEQ ID NO: 2183392 - protein, 29 aa, Cryptosporidium hominis
VIGGMPDWIQLKGIFFRNPFILSSAKQYK

SEQ ID NO: 2183393 - protein, 20 aa, Cryptosporidium hominis
VIGTHPFIKLLTNFVNLVFG

SEQ ID NO: 2183394 - protein, 24 aa, Cryptosporidium hominis
VIHIKFSLPCLINSSVSSLSIESD

SEQ ID NO: 2183395 - protein, 18 aa, Cryptosporidium hominis
VIHKEFPGVFTMAEESTA

SEQ ID NO: 2183396 - protein, 19 aa, Cryptosporidium hominis
VIHLADRVEIIVKIRKIEE

SEQ ID NO: 2183397 - protein, 20 aa, Cryptosporidium hominis
VIHVFPICYKEMIETLQDDN

SEQ ID NO: 2183398 - protein, 18 aa, Cryptosporidium hominis
VIIFFFLYHCAFKNESSF

SEQ ID NO: 2183399 - protein, 24 aa, Cryptosporidium hominis
VIISKEFFCFSSNGFPWWRGIISF

SEQ ID NO: 2183400 - protein, 19 aa, Cryptosporidium hominis
VIKEFKMSQLLISIENSLI

SEQ ID NO: 2183401 - protein, 20 aa, Cryptosporidium hominis
VIKGKLYRNLPFLSSRSNSA

SEQ ID NO: 2183402 - protein, 18 aa, Cryptosporidium hominis
VIKHCKELEGKVEELGWE

SEQ ID NO: 2183403 - protein, 24 aa, Cryptosporidium hominis
VIKIFSLDLYFIWDKEKFACSSFG

SEQ ID NO: 2183404 - protein, 22 aa, Cryptosporidium hominis
VIKKEFSVWGPVDYIRVIPSKN

SEQ ID NO: 2183405 - protein, 20 aa, Cryptosporidium hominis
VIKLSKYVLDCEFRLKKTLL

SEQ ID NO: 2183406 - protein, 19 aa, Cryptosporidium hominis
VIKPDIFFMNGHPGDSICV

SEQ ID NO: 2183407 - protein, 23 aa, Cryptosporidium hominis
VILIPLRLLEEFMSLEEQRSRKI

SEQ ID NO: 2183408 - protein, 20 aa, Cryptosporidium hominis
VILLKLGRRLNILTYKINQL

SEQ ID NO: 2183409 - protein, 23 aa, Cryptosporidium hominis
VILPKANVKFDWVNIGVNQEIIL

SEQ ID NO: 2183410 - protein, 18 aa, Cryptosporidium hominis
VIMSKSIVFLRIAQKKAQ

SEQ ID NO: 2183411 - protein, 23 aa, Cryptosporidium hominis
VINCPQVKYTMRLLDESIYSEQI

SEQ ID NO: 2183412 - protein, 17 aa, Cryptosporidium hominis
VINEVKGSQVFVMRAVN

SEQ ID NO: 2183413 - protein, 25 aa, Cryptosporidium hominis
VINLPIPRRPMILVGPNCKTKKAPN

SEQ ID NO: 2183414 - protein, 23 aa, Cryptosporidium hominis
VINMKPKELLSMVEEAAGTRMYE

SEQ ID NO: 2183415 - protein, 18 aa, Cryptosporidium hominis
VINYLKMRSQEYIAELCS

SEQ ID NO: 2183416 - protein, 24 aa, Cryptosporidium hominis
VIPGSLPGSLNYPSFNTPQQTDEI

SEQ ID NO: 2183417 - protein, 18 aa, Cryptosporidium hominis
VIPVEMKKLNCNEMDEDP

SEQ ID NO: 2183418 - protein, 19 aa, Cryptosporidium hominis
VIQECFNKDVLGFSLDSVS

SEQ ID NO: 2183419 - protein, 23 aa, Cryptosporidium hominis
VIQKDSFCKLTPNSGSNKIWVWT

SEQ ID NO: 2183420 - protein, 24 aa, Cryptosporidium hominis
VIQRSTFHLCPRGFGRTSFRLYES

SEQ ID NO: 2183421 - protein, 26 aa, Cryptosporidium hominis
VIRAHSLGVQAIRFIPKTGHLLLSAG

SEQ ID NO: 2183422 - protein, 20 aa, Cryptosporidium hominis
VIRKHCVYPVIGHKDRILLH

SEQ ID NO: 2183423 - protein, 22 aa, Cryptosporidium hominis
VIRMKILGAKVVCVEFGDKTLK

SEQ ID NO: 2183424 - protein, 21 aa, Cryptosporidium hominis
VISEIFGVTSINFENFTQLSF

SEQ ID NO: 2183425 - protein, 20 aa, Cryptosporidium hominis
VISKKMVRKVLEMIKQIQTE

SEQ ID NO: 2183426 - protein, 21 aa, Cryptosporidium hominis
VITIRMALDYSLSVQQQVSAL

SEQ ID NO: 2183427 - protein, 28 aa, Cryptosporidium hominis
VITLNKFCLRNNMSFLLHLLVFSCLIIN

SEQ ID NO: 2183428 - protein, 22 aa, Cryptosporidium hominis
VITNYLLQDGFLYPNTLLYEGY

SEQ ID NO: 2183429 - protein, 31 aa, Cryptosporidium hominis
VIVGHSMGGLIGFELLKRIKFEQLKDFSAKF

SEQ ID NO: 2183430 - protein, 18 aa, Cryptosporidium hominis
VIVNILYKERIILTEPND

SEQ ID NO: 2183431 - protein, 23 aa, Cryptosporidium hominis
VIWIQQIQECWAKSLELSNLSPD

SEQ ID NO: 2183432 - protein, 21 aa, Cryptosporidium hominis
VIYNILFDWYMIDLRSIEREL

SEQ ID NO: 2183433 - protein, 20 aa, Cryptosporidium hominis
VKAAYRGCRASMCMQLYRQA

SEQ ID NO: 2183434 - protein, 17 aa, Cryptosporidium hominis
VKAGFSKKMEPFVILQT

SEQ ID NO: 2183435 - protein, 20 aa, Cryptosporidium hominis
VKAPKRVSCTGGTDSGTTGD

SEQ ID NO: 2183436 - protein, 24 aa, Cryptosporidium hominis
VKASRKEVFFNVPINFDNTIIHLN

SEQ ID NO: 2183437 - protein, 20 aa, Cryptosporidium hominis
VKCPQLGRFTLRDEGKTIAV

SEQ ID NO: 2183438 - protein, 20 aa, Cryptosporidium hominis
VKDISWKEISGIDILFNLDK

SEQ ID NO: 2183439 - protein, 23 aa, Cryptosporidium hominis
VKDKSRVGVCLDTCHLFAAGYDV

SEQ ID NO: 2183440 - protein, 18 aa, Cryptosporidium hominis
VKDQIWVLISGGDKNKTI

SEQ ID NO: 2183441 - protein, 24 aa, Cryptosporidium hominis
VKDRSDRLALRNAKKQQIEESEKD

SEQ ID NO: 2183442 - protein, 17 aa, Cryptosporidium hominis
VKEIPKIEIQYVEKIVE

SEQ ID NO: 2183443 - protein, 19 aa, Cryptosporidium hominis
VKELLILKKEQVHKLSDLL

SEQ ID NO: 2183444 - protein, 18 aa, Cryptosporidium hominis
VKELVLDGVKLRELTQQD

SEQ ID NO: 2183445 - protein, 22 aa, Cryptosporidium hominis
VKERLLSYFSRDLFEMELRSKF

SEQ ID NO: 2183446 - protein, 31 aa, Cryptosporidium hominis
VKERSKPKCSVAFCETVEFRTVYVTKQERLG

SEQ ID NO: 2183447 - protein, 22 aa, Cryptosporidium hominis
VKFDTRMMKHFSIEDITFNNTI

SEQ ID NO: 2183448 - protein, 28 aa, Cryptosporidium hominis
VKFKDPKFKIAWYFAMRDTLIVDDLDIA

SEQ ID NO: 2183449 - protein, 21 aa, Cryptosporidium hominis
VKFSIEGFWSLITLIPKMVLN

SEQ ID NO: 2183450 - protein, 19 aa, Cryptosporidium hominis
VKGELKCTGQYKKWKANTN

SEQ ID NO: 2183451 - protein, 20 aa, Cryptosporidium hominis
VKGKDIKLSFDVEELNDPIL

SEQ ID NO: 2183452 - protein, 18 aa, Cryptosporidium hominis
VKGLNMLFVLCSGNNVLS

SEQ ID NO: 2183453 - protein, 22 aa, Cryptosporidium hominis
VKGNALVCFVVLKDSGNRTFDL

SEQ ID NO: 2183454 - protein, 25 aa, Cryptosporidium hominis
VKGSDASVVAPIFVQILHLKSKSMI

SEQ ID NO: 2183455 - protein, 18 aa, Cryptosporidium hominis
VKHIKSSYGVKVTFKLEN

SEQ ID NO: 2183456 - protein, 18 aa, Cryptosporidium hominis
VKIACIDFPLKQYRMQMG

SEQ ID NO: 2183457 - protein, 25 aa, Cryptosporidium hominis
VKIDNIRFGLDYNNIGSISSMLMNN

SEQ ID NO: 2183458 - protein, 38 aa, Cryptosporidium hominis
VKIEYLHRRGRLVSIVELLFRYIFHFERNEIRIRLSLP

SEQ ID NO: 2183459 - protein, 19 aa, Cryptosporidium hominis
VKIFGELTLMVSEPSVRAF

SEQ ID NO: 2183460 - protein, 17 aa, Cryptosporidium hominis
VKIGDLICTPQNDIDVK

SEQ ID NO: 2183461 - protein, 20 aa, Cryptosporidium hominis
VKILGCLALIDDDELDWKVV

SEQ ID NO: 2183462 - protein, 21 aa, Cryptosporidium hominis
VKKESWREICKKMNNIKINDD

SEQ ID NO: 2183463 - protein, 19 aa, Cryptosporidium hominis
VKKFSKETGDFGFLSETDF

SEQ ID NO: 2183464 - protein, 29 aa, Cryptosporidium hominis
VKKGDAFLVRGGFRPIEFKVVGVDPEEYC

SEQ ID NO: 2183465 - protein, 25 aa, Cryptosporidium hominis
VKKGLQCMNCKTIIKEGPLCKDCSK

SEQ ID NO: 2183466 - protein, 23 aa, Cryptosporidium hominis
VKKIKKAFCPPGIIEGNPCIEYI

SEQ ID NO: 2183467 - protein, 32 aa, Cryptosporidium hominis
VKKNFKNEVCSKCSKNAECYVHSIFETTHDLS

SEQ ID NO: 2183468 - protein, 19 aa, Cryptosporidium hominis
VKKRLRDLGKISNEEDEED

SEQ ID NO: 2183469 - protein, 20 aa, Cryptosporidium hominis
VKKVVFSLHPSFLNPNRVVE

SEQ ID NO: 2183470 - protein, 24 aa, Cryptosporidium hominis
VKKWVEECIALKPTILNIGQTPFT

SEQ ID NO: 2183471 - protein, 18 aa, Cryptosporidium hominis
VKLEAFFSSLFEFFLKHL

SEQ ID NO: 2183472 - protein, 23 aa, Cryptosporidium hominis
VKLGRFKLRVKQLVKNEDQIPEL

SEQ ID NO: 2183473 - protein, 20 aa, Cryptosporidium hominis
VKLHECDIYSSLFSLINTEE

SEQ ID NO: 2183474 - protein, 19 aa, Cryptosporidium hominis
VKLKYGIQLILGLNGYVWI

SEQ ID NO: 2183475 - protein, 17 aa, Cryptosporidium hominis
VKLLPISNTCYTIIREK

SEQ ID NO: 2183476 - protein, 21 aa, Cryptosporidium hominis
VKLNWSGWFYDHYTINVFPIN

SEQ ID NO: 2183477 - protein, 28 aa, Cryptosporidium hominis
VKLSKKSLKEGFQWLISMEENTGNENYY

SEQ ID NO: 2183478 - protein, 17 aa, Cryptosporidium hominis
VKLYKRGLNGILADEMG

SEQ ID NO: 2183479 - protein, 23 aa, Cryptosporidium hominis
VKMANVCNLTFNVNYGVLSVGEM

SEQ ID NO: 2183480 - protein, 24 aa, Cryptosporidium hominis
VKNYCQRGRMCMFSHTKEEQMYHV

SEQ ID NO: 2183481 - protein, 17 aa, Cryptosporidium hominis
VKPNIVCPIINMDYYSR

SEQ ID NO: 2183482 - protein, 23 aa, Cryptosporidium hominis
VKPPLKPKPKFLAPPKNPKVSHL

SEQ ID NO: 2183483 - protein, 17 aa, Cryptosporidium hominis
VKPRGEKGFSWDPIFNP

SEQ ID NO: 2183484 - protein, 25 aa, Cryptosporidium hominis
VKRFRKALCPIVERLVCSLMMHGRN

SEQ ID NO: 2183485 - protein, 24 aa, Cryptosporidium hominis
VKRNCWPKVRGVSMNPVDHPHGGG

SEQ ID NO: 2183486 - protein, 20 aa, Cryptosporidium hominis
VKRSIKELAQHSLLQKELLK

SEQ ID NO: 2183487 - protein, 21 aa, Cryptosporidium hominis
VKSKVKSIVLFLRANLGINVA

SEQ ID NO: 2183488 - protein, 26 aa, Cryptosporidium hominis
VKSRFKNIESSFRYAYTAAQVLSICI

SEQ ID NO: 2183489 - protein, 22 aa, Cryptosporidium hominis
VKTKGFSVFQFGDEGARQRAIE

SEQ ID NO: 2183490 - protein, 18 aa, Cryptosporidium hominis
VKTPNQFLMIPKKILTQS

SEQ ID NO: 2183491 - protein, 18 aa, Cryptosporidium hominis
VKTRTLVQIRSHAQKYFL

SEQ ID NO: 2183492 - protein, 22 aa, Cryptosporidium hominis
VKVADFGLSRSFVNIRRVTNNI

SEQ ID NO: 2183493 - protein, 18 aa, Cryptosporidium hominis
VKVAMRALGFDPKKEELK

SEQ ID NO: 2183494 - protein, 22 aa, Cryptosporidium hominis
VKVKMRMGNKIWEFTLLCNLND

SEQ ID NO: 2183495 - protein, 19 aa, Cryptosporidium hominis
VKVPSSVELINFNNISMDL

SEQ ID NO: 2183496 - protein, 20 aa, Cryptosporidium hominis
VKVQFVPGVLMFITSGKDNA

SEQ ID NO: 2183497 - protein, 20 aa, Cryptosporidium hominis
VLAHGKWLIKAPYPVFYPST

SEQ ID NO: 2183498 - protein, 26 aa, Cryptosporidium hominis
VLARAIFKSGCEKVDAGLNPMDLLRG

SEQ ID NO: 2183499 - protein, 19 aa, Cryptosporidium hominis
VLDELRGPLKVQYSTGEPE

SEQ ID NO: 2183500 - protein, 26 aa, Cryptosporidium hominis
VLDKLYFYPHFRGVKPSSSLKLKELE

SEQ ID NO: 2183501 - protein, 34 aa, Cryptosporidium hominis
VLDPRSVPCGSFIWWDRRVWEYNFVHMARRLSTN

SEQ ID NO: 2183502 - protein, 23 aa, Cryptosporidium hominis
VLDYEGKEKLGFLNRDILLTDYR

SEQ ID NO: 2183503 - protein, 22 aa, Cryptosporidium hominis
VLEEIKQSIILINESLGSEKYD

SEQ ID NO: 2183504 - protein, 37 aa, Cryptosporidium hominis
VLEESHVDFLFGLDLLKRYQCCIDLHQNALIIGDEKV

SEQ ID NO: 2183505 - protein, 25 aa, Cryptosporidium hominis
VLENGKEIYLYFGPQVDSKVISEIF

SEQ ID NO: 2183506 - protein, 18 aa, Cryptosporidium hominis
VLERRREEYLKKALPASI

SEQ ID NO: 2183507 - protein, 17 aa, Cryptosporidium hominis
VLESMGGSPAWRCNPEF

SEQ ID NO: 2183508 - protein, 22 aa, Cryptosporidium hominis
VLETIKISGFELDKVRDLLTKQ

SEQ ID NO: 2183509 - protein, 23 aa, Cryptosporidium hominis
VLETIPIFGNMGFDQINQSADTD

SEQ ID NO: 2183510 - protein, 23 aa, Cryptosporidium hominis
VLFESAAGYLLCIIDNWEEIGQV

SEQ ID NO: 2183511 - protein, 29 aa, Cryptosporidium hominis
VLFKILFERCFQEYLLLCCDPTESAANAI

SEQ ID NO: 2183512 - protein, 33 aa, Cryptosporidium hominis
VLGFPEYWKRITVMRCMAPVISLSWSPDDCKVV

SEQ ID NO: 2183513 - protein, 19 aa, Cryptosporidium hominis
VLIEKCGKLQSLRPLIYGT

SEQ ID NO: 2183514 - protein, 17 aa, Cryptosporidium hominis
VLIKELPPISANDDELV

SEQ ID NO: 2183515 - protein, 17 aa, Cryptosporidium hominis
VLINLCLTITEDSKADG

SEQ ID NO: 2183516 - protein, 24 aa, Cryptosporidium hominis
VLIVACDTFRAGAIEQLKTHANCL

SEQ ID NO: 2183517 - protein, 18 aa, Cryptosporidium hominis
VLKFLYKVEKGFTDKSLG

SEQ ID NO: 2183518 - protein, 22 aa, Cryptosporidium hominis
VLKNCILRTNIQSISCLKNARI

SEQ ID NO: 2183519 - protein, 19 aa, Cryptosporidium hominis
  misc_feature (19)..(19): Xaa can be any naturally occurring amino acid
VLKNLRKRFYSLLISNRSX

SEQ ID NO: 2183520 - protein, 23 aa, Cryptosporidium hominis
VLKNRIAPKILHFQKLNPHIDTE

SEQ ID NO: 2183521 - protein, 19 aa, Cryptosporidium hominis
VLKNWFIKLPLEYLEQAVS

SEQ ID NO: 2183522 - protein, 20 aa, Cryptosporidium hominis
VLLCGYPPFSAPTDSEVMLK

SEQ ID NO: 2183523 - protein, 18 aa, Cryptosporidium hominis
VLLKKTIRSPQRILRSDF

SEQ ID NO: 2183524 - protein, 17 aa, Cryptosporidium hominis
VLLKLPSIFDLLPQPIE

SEQ ID NO: 2183525 - protein, 22 aa, Cryptosporidium hominis
VLLPDLPVPLSYNKSSGQTTSN

SEQ ID NO: 2183526 - protein, 17 aa, Cryptosporidium hominis
VLLTDFMDTLMIGDISR

SEQ ID NO: 2183527 - protein, 25 aa, Cryptosporidium hominis
VLLYPTDFYQLFLISSDSFAKNNSL

SEQ ID NO: 2183528 - protein, 18 aa, Cryptosporidium hominis
VLNKRLGIEKSVIEEELD

SEQ ID NO: 2183529 - protein, 30 aa, Cryptosporidium hominis
VLNPKVKWISFHGCYDFAYLVKILSSQPLP

SEQ ID NO: 2183530 - protein, 26 aa, Cryptosporidium hominis
VLPGVCSRIACLIPHPVSPGIVLSLT

SEQ ID NO: 2183531 - protein, 24 aa, Cryptosporidium hominis
VLPKESIHPYIFIRSKKKHSSESN

SEQ ID NO: 2183532 - protein, 22 aa, Cryptosporidium hominis
VLPNIFPSISHRPLPVNVCYIK

SEQ ID NO: 2183533 - protein, 27 aa, Cryptosporidium hominis
VLPPIPYFRRPAISRSRINYSNVRRDE

SEQ ID NO: 2183534 - protein, 22 aa, Cryptosporidium hominis
VLPTRYARFNSTLSFKRNDPDL

SEQ ID NO: 2183535 - protein, 17 aa, Cryptosporidium hominis
VLPTSRDPKLWLVKVDR

SEQ ID NO: 2183536 - protein, 17 aa, Cryptosporidium hominis
VLQFIISQYDPRIKISK

SEQ ID NO: 2183537 - protein, 18 aa, Cryptosporidium hominis
VLQLVSLADKRFVLLVGH

SEQ ID NO: 2183538 - protein, 17 aa, Cryptosporidium hominis
VLQRKIIVLSLIVAHNA

SEQ ID NO: 2183539 - protein, 20 aa, Cryptosporidium hominis
VLRGSVTFEIHNNSEIPLEL

SEQ ID NO: 2183540 - protein, 20 aa, Cryptosporidium hominis
VLRGYDRFEEEFGLPDNSSE

SEQ ID NO: 2183541 - protein, 17 aa, Cryptosporidium hominis
VLRKSRYDYEQIYDEDS

SEQ ID NO: 2183542 - protein, 20 aa, Cryptosporidium hominis
VLRKYELVKKLGKGAYGIVW

SEQ ID NO: 2183543 - protein, 17 aa, Cryptosporidium hominis
VLRRIIVFYSSFNEVFE

SEQ ID NO: 2183544 - protein, 17 aa, Cryptosporidium hominis
VLRVWHLYESKDEIISG

SEQ ID NO: 2183545 - protein, 17 aa, Cryptosporidium hominis
VLTGSMSLESFIQMHHQ

SEQ ID NO: 2183546 - protein, 18 aa, Cryptosporidium hominis
VLTMWYRAPEILLGIDKY

SEQ ID NO: 2183547 - protein, 18 aa, Cryptosporidium hominis
VLTVSFHKFGEFFPGTGD

SEQ ID NO: 2183548 - protein, 17 aa, Cryptosporidium hominis
VLVKPWNGNRFMFPRGK

SEQ ID NO: 2183549 - protein, 33 aa, Cryptosporidium hominis
VLVNKDGKSTIAFSKALLARCEQEFKNMPRNMT

SEQ ID NO: 2183550 - protein, 29 aa, Cryptosporidium hominis
VLYELTCLKPPFSGDSLLSLAWKISFQEI

SEQ ID NO: 2183551 - protein, 25 aa, Cryptosporidium hominis
VLYLLYQACRIFKQLGVEYVTIFEP

SEQ ID NO: 2183552 - protein, 18 aa, Cryptosporidium hominis
VMACKRQAEEYGDASNTV

SEQ ID NO: 2183553 - protein, 23 aa, Cryptosporidium hominis
VMADPAGGMSFMPNVAKPVGGHV

SEQ ID NO: 2183554 - protein, 19 aa, Cryptosporidium hominis
VMENYRPGAIVLQCGADSL

SEQ ID NO: 2183555 - protein, 18 aa, Cryptosporidium hominis
VMKCEIDRILRLESGGVI

SEQ ID NO: 2183556 - protein, 19 aa, Cryptosporidium hominis
VMLGGAFPFDERKGNLDRL

SEQ ID NO: 2183557 - protein, 25 aa, Cryptosporidium hominis
VMMFPEYLRSGLTLPKGLAPIQPNE

SEQ ID NO: 2183558 - protein, 19 aa, Cryptosporidium hominis
VMNRWKKLAKYTIENDDDI

SEQ ID NO: 2183559 - protein, 19 aa, Cryptosporidium hominis
VMSDWAKSVIVGRGRIGGI

SEQ ID NO: 2183560 - protein, 26 aa, Cryptosporidium hominis
VMSHVLKCEADFRLLAITLNSLNFNF

SEQ ID NO: 2183561 - protein, 18 aa, Cryptosporidium hominis
VNCISWNPFSENLLLSGS

SEQ ID NO: 2183562 - protein, 18 aa, Cryptosporidium hominis
VNCRELMRSFGWDASDAF

SEQ ID NO: 2183563 - protein, 22 aa, Cryptosporidium hominis
VNCSHISKFIGFNGFTGPLRPY

SEQ ID NO: 2183564 - protein, 23 aa, Cryptosporidium hominis
VNDAMKINNEMLALSKSNNVCSI

SEQ ID NO: 2183565 - protein, 21 aa, Cryptosporidium hominis
VNDIYKRVCYFYSPKNTPKIP

SEQ ID NO: 2183566 - protein, 24 aa, Cryptosporidium hominis
VNDLKWHPSSLSVFGSVSDDGTFA

SEQ ID NO: 2183567 - protein, 24 aa, Cryptosporidium hominis
VNELGKFTGITTWLVVAQGDKYDK

SEQ ID NO: 2183568 - protein, 25 aa, Cryptosporidium hominis
VNFPPIYRFNCGFNSYLHYSHGLSL

SEQ ID NO: 2183569 - protein, 24 aa, Cryptosporidium hominis
VNFRKEIHGTWFITLKTEDLTTKV

SEQ ID NO: 2183570 - protein, 17 aa, Cryptosporidium hominis
VNGQLLYYVNGNFSQGD

SEQ ID NO: 2183571 - protein, 17 aa, Cryptosporidium hominis
VNHMWWVPLLKKIIKED

SEQ ID NO: 2183572 - protein, 21 aa, Cryptosporidium hominis
VNHPFRNIAVFDRSKASNIRD

SEQ ID NO: 2183573 - protein, 22 aa, Cryptosporidium hominis
VNIARKLLEKKLKNGETSSKPI

SEQ ID NO: 2183574 - protein, 18 aa, Cryptosporidium hominis
VNIGLFLHIPFPSFEIFR

SEQ ID NO: 2183575 - protein, 22 aa, Cryptosporidium hominis
VNIIKRLLCRVPEVRMGCSATG

SEQ ID NO: 2183576 - protein, 27 aa, Cryptosporidium hominis
VNIKELICKALSFLRNSIRFCDQIIFF

SEQ ID NO: 2183577 - protein, 27 aa, Cryptosporidium hominis
VNIKNEIIWGFPIVPNITFIKGESNNF

SEQ ID NO: 2183578 - protein, 35 aa, Cryptosporidium hominis
VNIPLNELLDFYGWLCDRCEFEKKFLGTQYLIAFN

SEQ ID NO: 2183579 - protein, 23 aa, Cryptosporidium hominis
VNKCKLNESFYLLIENENNEETD

SEQ ID NO: 2183580 - protein, 28 aa, Cryptosporidium hominis
VNKGCEILEKMNINWNRPDDMLAEMLKT

SEQ ID NO: 2183581 - protein, 25 aa, Cryptosporidium hominis
VNKRLLYKGKVVKIIDYEKEGNEIE

SEQ ID NO: 2183582 - protein, 19 aa, Cryptosporidium hominis
VNKTGIPLEICFINENNIP

SEQ ID NO: 2183583 - protein, 25 aa, Cryptosporidium hominis
VNKVFDFRPGILIKQLNLKSPIFKK

SEQ ID NO: 2183584 - protein, 18 aa, Cryptosporidium hominis
VNMECKRSQGDPMLEGLE

SEQ ID NO: 2183585 - protein, 23 aa, Cryptosporidium hominis
VNNLDGLCIGSRNIRVNAVIQKN

SEQ ID NO: 2183586 - protein, 25 aa, Cryptosporidium hominis
VNNNCRSLFLSHCFGQKGKFQEAFV

SEQ ID NO: 2183587 - protein, 17 aa, Cryptosporidium hominis
VNQRVGLHLSLTRNHHI

SEQ ID NO: 2183588 - protein, 20 aa, Cryptosporidium hominis
VNRFPNLIKLSWNSSPINYY

SEQ ID NO: 2183589 - protein, 26 aa, Cryptosporidium hominis
VNRKGGDRLENWLIKNLCISVFQFSE

SEQ ID NO: 2183590 - protein, 27 aa, Cryptosporidium hominis
VNRNDLRVHPDFRLLYQSSAPFQETNN

SEQ ID NO: 2183591 - protein, 18 aa, Cryptosporidium hominis
VNSLLSRGEKFPFGIQPT

SEQ ID NO: 2183592 - protein, 29 aa, Cryptosporidium hominis
VNSRISKVPVIMFSPSIINFRRFTFSRME

SEQ ID NO: 2183593 - protein, 25 aa, Cryptosporidium hominis
VNTETVFDSGMKIQKTVNKTSTEDV

SEQ ID NO: 2183594 - protein, 23 aa, Cryptosporidium hominis
VNTPFINKINCDYVSNNRKISND

SEQ ID NO: 2183595 - protein, 17 aa, Cryptosporidium hominis
VNTRLFKSWDILRNLVL

SEQ ID NO: 2183596 - protein, 29 aa, Cryptosporidium hominis
VNTWKPRYFRLYPGILCYMKGSKIRKINI

SEQ ID NO: 2183597 - protein, 25 aa, Cryptosporidium hominis
VNVADCLACSGCVTSAEAKLLEDQN

SEQ ID NO: 2183598 - protein, 18 aa, Cryptosporidium hominis
VNVFKRRNIEAVEFSAMG

SEQ ID NO: 2183599 - protein, 26 aa, Cryptosporidium hominis
VNVLDFDVPFSLKFGAFDDLVKLVDD

SEQ ID NO: 2183600 - protein, 18 aa, Cryptosporidium hominis
VNVLKLILQFLLESGLLE

SEQ ID NO: 2183601 - protein, 24 aa, Cryptosporidium hominis
VNWAKEFIMDLYIFSERKKNEMLH

SEQ ID NO: 2183602 - protein, 25 aa, Cryptosporidium hominis
VNYLKYLLYWCEFPYVKYISYPHCI

SEQ ID NO: 2183603 - protein, 18 aa, Cryptosporidium hominis
VNYSAVFHYQGQKVGVVE

SEQ ID NO: 2183604 - protein, 22 aa, Cryptosporidium hominis
VNYSITCAFYTKTCFEKNEAHC

SEQ ID NO: 2183605 - protein, 21 aa, Cryptosporidium hominis
VNYTCWYEGVFNYLSNNLQSI

SEQ ID NO: 2183606 - protein, 28 aa, Cryptosporidium hominis
VNYYDYNLCFIIKILIYLISNVKDGLDL

SEQ ID NO: 2183607 - protein, 25 aa, Cryptosporidium hominis
VPATGRSKVGFLRMFTEDIMDIAKH

SEQ ID NO: 2183608 - protein, 20 aa, Cryptosporidium hominis
VPEELQRHFEIYDGIEGVLG

SEQ ID NO: 2183609 - protein, 29 aa, Cryptosporidium hominis
VPEKILEDGDCCWIHGFVVDVEIDQDGEL

SEQ ID NO: 2183610 - protein, 22 aa, Cryptosporidium hominis
VPFHVRLLKNVVCTQEEGRKSF

SEQ ID NO: 2183611 - protein, 19 aa, Cryptosporidium hominis
VPGDILLFLTGEEEIEQAK

SEQ ID NO: 2183612 - protein, 17 aa, Cryptosporidium hominis
VPGNLLLDILENSVSQW

SEQ ID NO: 2183613 - protein, 22 aa, Cryptosporidium hominis
VPIETSEILINWRESISQEAKS

SEQ ID NO: 2183614 - protein, 18 aa, Cryptosporidium hominis
VPIKENLDDFSIGNTDLR

SEQ ID NO: 2183615 - protein, 22 aa, Cryptosporidium hominis
VPIPGRIIPVPVEVEVEKIVEV

SEQ ID NO: 2183616 - protein, 23 aa, Cryptosporidium hominis
VPKGPMVLFCYFLGKLYMQQDRF

SEQ ID NO: 2183617 - protein, 27 aa, Cryptosporidium hominis
VPKPNEPCERCSLYINNRQLARVISKR

SEQ ID NO: 2183618 - protein, 17 aa, Cryptosporidium hominis
VPKQEIQYVDKFVEVPE

SEQ ID NO: 2183619 - protein, 27 aa, Cryptosporidium hominis
VPLESSDRTQLMWAMITDYCEMIKNTI

SEQ ID NO: 2183620 - protein, 18 aa, Cryptosporidium hominis
VPLKASVTKLALICNNEE

SEQ ID NO: 2183621 - protein, 21 aa, Cryptosporidium hominis
VPLTRRLNVVYIPSTTAVLVH

SEQ ID NO: 2183622 - protein, 23 aa, Cryptosporidium hominis
VPLYCLYCHKLLEGHTSGNIQNV

SEQ ID NO: 2183623 - protein, 23 aa, Cryptosporidium hominis
VPNNDSRCCLIMNKKYFNCENEI

SEQ ID NO: 2183624 - protein, 22 aa, Cryptosporidium hominis
VPNPSTLVCYGFDGKYSIWELE

SEQ ID NO: 2183625 - protein, 24 aa, Cryptosporidium hominis
VPNREAFRPITIQDFNLSLKLVKP

SEQ ID NO: 2183626 - protein, 18 aa, Cryptosporidium hominis
VPNSYYIITEPCVSLYNL

SEQ ID NO: 2183627 - protein, 24 aa, Cryptosporidium hominis
VPPTLFASDNFLHWLKEFNNEAML

SEQ ID NO: 2183628 - protein, 19 aa, Cryptosporidium hominis
VPQDFRWKIWNSLLQISSL

SEQ ID NO: 2183629 - protein, 23 aa, Cryptosporidium hominis
VPQSLKRRFYMQIQFIKYMEKHI

SEQ ID NO: 2183630 - protein, 18 aa, Cryptosporidium hominis
VPRPCLEKLQGNTPLLTG

SEQ ID NO: 2183631 - protein, 21 aa, Cryptosporidium hominis
VPRVFVKGRFIGGCDDTLKLL

SEQ ID NO: 2183632 - protein, 19 aa, Cryptosporidium hominis
VPSTISLSLSYVYRNAVEA

SEQ ID NO: 2183633 - protein, 36 aa, Cryptosporidium hominis
VPTFCNKAKLISCCNARLIPQIPRCDLTKHEDENLM

SEQ ID NO: 2183634 - protein, 17 aa, Cryptosporidium hominis
VPTGVKHLHRKAEEYDI

SEQ ID NO: 2183635 - protein, 37 aa, Cryptosporidium hominis
VPTIRSFCIKQHRHDCFRRRLAEFIIYPPPVMDHRRK

SEQ ID NO: 2183636 - protein, 19 aa, Cryptosporidium hominis
VPTRIWLLWSNEVVLQLFN

SEQ ID NO: 2183637 - protein, 41 aa, Cryptosporidium hominis
VPVGIPPPGCIPIVGGCGTVGVGARQGGGIGDLQQLQQQQH

SEQ ID NO: 2183638 - protein, 17 aa, Cryptosporidium hominis
VPVRRVNPAYIIATSTK

SEQ ID NO: 2183639 - protein, 17 aa, Cryptosporidium hominis
VPVYGDNSNNIAFNYKY

SEQ ID NO: 2183640 - protein, 25 aa, Cryptosporidium hominis
VPWPTFKCRGKPCVDGYFAVGRGEL

SEQ ID NO: 2183641 - protein, 20 aa, Cryptosporidium hominis
VPYMVPKPFVVPVHVPVLEF

SEQ ID NO: 2183642 - protein, 21 aa, Cryptosporidium hominis
VPYSIAMTLTYPEVVTPYNIE

SEQ ID NO: 2183643 - protein, 25 aa, Cryptosporidium hominis
VPYTFRPESILSYFKDIYEEYDYFI

SEQ ID NO: 2183644 - protein, 17 aa, Cryptosporidium hominis
VPYYKDVEVPFVVPRYV

SEQ ID NO: 2183645 - protein, 20 aa, Cryptosporidium hominis
VQAMSLRGGVDLFDSIPETT

SEQ ID NO: 2183646 - protein, 25 aa, Cryptosporidium hominis
VQDANCIVLFGFKTAFGGGRSSGFC

SEQ ID NO: 2183647 - protein, 31 aa, Cryptosporidium hominis
VQDDILCEICRVCGFVIVFAVESEYNEDVIS

SEQ ID NO: 2183648 - protein, 39 aa, Cryptosporidium hominis
VQDKDPFVGYGFLPYIVKMVWEKVRAALEGDLDVIETIK

SEQ ID NO: 2183649 - protein, 25 aa, Cryptosporidium hominis
VQDKFRIPALISLLLSRTGSGKRTV

SEQ ID NO: 2183650 - protein, 24 aa, Cryptosporidium hominis
VQELICSYAALVLSDGGVPVTSEN

SEQ ID NO: 2183651 - protein, 30 aa, Cryptosporidium hominis
VQESLCLGTYRFVDNSNFCNFVISINGEID

SEQ ID NO: 2183652 - protein, 17 aa, Cryptosporidium hominis
VQETEVDSEGNEEETSL

SEQ ID NO: 2183653 - protein, 22 aa, Cryptosporidium hominis
VQFNACNNIESILECEEPKKYK

SEQ ID NO: 2183654 - protein, 25 aa, Cryptosporidium hominis
VQGDFRTYKFPAILIYDNYSLLNGF

SEQ ID NO: 2183655 - protein, 25 aa, Cryptosporidium hominis
VQGGTCAIPGAFGCGKTCISQALSK

SEQ ID NO: 2183656 - protein, 23 aa, Cryptosporidium hominis
VQHIMVALDMLMRIYNNREFPLV

SEQ ID NO: 2183657 - protein, 22 aa, Cryptosporidium hominis
VQHLRYKLKMDDLRKIYSNLHI

SEQ ID NO: 2183658 - protein, 23 aa, Cryptosporidium hominis
VQIESRRGFRQCETYELELELKP

SEQ ID NO: 2183659 - protein, 17 aa, Cryptosporidium hominis
VQIKCKEIESWKNRFHD

SEQ ID NO: 2183660 - protein, 23 aa, Cryptosporidium hominis
VQKRFSEFVLLQSLLVERGLSLL

SEQ ID NO: 2183661 - protein, 19 aa, Cryptosporidium hominis
VQKRSGFSGCIMNTLTCSK

SEQ ID NO: 2183662 - protein, 24 aa, Cryptosporidium hominis
VQNFCPHIPFPPWSGNTTNQNKEE

SEQ ID NO: 2183663 - protein, 36 aa, Cryptosporidium hominis
VQNFLLTEIRPRWYFIRNDCLIFIDSELPLKQSVQN

SEQ ID NO: 2183664 - protein, 32 aa, Cryptosporidium hominis
VQNMYKNPFGWQLDMRLVFYNALKYHKEGNTV

SEQ ID NO: 2183665 - protein, 18 aa, Cryptosporidium hominis
VQNSISFKIEGMVSKNEC

SEQ ID NO: 2183666 - protein, 24 aa, Cryptosporidium hominis
VQNSSFIPTWAWPASLRNNEDLKL

SEQ ID NO: 2183667 - protein, 27 aa, Cryptosporidium hominis
VQQDPRILPELLVRIGQSNPEILQLIT

SEQ ID NO: 2183668 - protein, 37 aa, Cryptosporidium hominis
VQQLFKISYVCDVFDYALSIHCEFGRPRHRDSSKSVQ

SEQ ID NO: 2183669 - protein, 23 aa, Cryptosporidium hominis
VQQRSAILFTILLIKSLTILSPS

SEQ ID NO: 2183670 - protein, 29 aa, Cryptosporidium hominis
VQRIRTPLRYRSSLLGALSNRTNSSCRIL

SEQ ID NO: 2183671 - protein, 22 aa, Cryptosporidium hominis
VQRKWKCHLSVEQEKVEEKIAS

SEQ ID NO: 2183672 - protein, 24 aa, Cryptosporidium hominis
VQSKFRLTYQMILQLSCRHSLKIE

SEQ ID NO: 2183673 - protein, 20 aa, Cryptosporidium hominis
VQSLAKWKRYALKKYELNGL

SEQ ID NO: 2183674 - protein, 18 aa, Cryptosporidium hominis
VQSRCFMATYIPFSQSRK

SEQ ID NO: 2183675 - protein, 18 aa, Cryptosporidium hominis
VQTACIRSNIPLDNVGIY

SEQ ID NO: 2183676 - protein, 18 aa, Cryptosporidium hominis
VQVLPAYRLSRAIDTLFP

SEQ ID NO: 2183677 - protein, 25 aa, Cryptosporidium hominis
VQVRKEPNLGFKSLISSGIKVNVAE

SEQ ID NO: 2183678 - protein, 17 aa, Cryptosporidium hominis
VQYRMHPQISAFPSKHF

SEQ ID NO: 2183679 - protein, 22 aa, Cryptosporidium hominis
VRAGPFGSLFRPDNFIFGQSGA

SEQ ID NO: 2183680 - protein, 25 aa, Cryptosporidium hominis
VRAICRDWWIFSLKYYRNIKYKDNK

SEQ ID NO: 2183681 - protein, 23 aa, Cryptosporidium hominis
VRASVNCFCVPKGSVYNQLVDQF

SEQ ID NO: 2183682 - protein, 18 aa, Cryptosporidium hominis
VRDIWKFQDLYRATGPLQ

SEQ ID NO: 2183683 - protein, 20 aa, Cryptosporidium hominis
VRDRALIYWRLLSTNPEETR

SEQ ID NO: 2183684 - protein, 23 aa, Cryptosporidium hominis
VRDTCAWTIGRIVTFHPTIIFPL

SEQ ID NO: 2183685 - protein, 18 aa, Cryptosporidium hominis
VREQEHWCSRWLGHKQEV

SEQ ID NO: 2183686 - protein, 18 aa, Cryptosporidium hominis
VRFEREYYGSSALETIFS

SEQ ID NO: 2183687 - protein, 24 aa, Cryptosporidium hominis
VRFLQGRLRIGIQQTTVYQALASA

SEQ ID NO: 2183688 - protein, 21 aa, Cryptosporidium hominis
VRGEGCGAILLTKRSEIGGKK

SEQ ID NO: 2183689 - protein, 22 aa, Cryptosporidium hominis
VRGNTHWKSVVFNHLDDRCFVA

SEQ ID NO: 2183690 - protein, 27 aa, Cryptosporidium hominis
VRGSHECPICRSLLKEELWLSKSDQLV

SEQ ID NO: 2183691 - protein, 18 aa, Cryptosporidium hominis
VRHEAGEAIAAIGDDESL

SEQ ID NO: 2183692 - protein, 25 aa, Cryptosporidium hominis
VRIEPEERIRMGIFDDSLVESDVKF

SEQ ID NO: 2183693 - protein, 20 aa, Cryptosporidium hominis
VRIGKFILDTWYFSPLPDEY

SEQ ID NO: 2183694 - protein, 22 aa, Cryptosporidium hominis
VRIIKETLCYIAKDPAAENERP

SEQ ID NO: 2183695 - protein, 20 aa, Cryptosporidium hominis
VRIYLDFEWLTILRSVKANI

SEQ ID NO: 2183696 - protein, 26 aa, Cryptosporidium hominis
VRKGKKICVLDCSVFGRFNAIIPEGM

SEQ ID NO: 2183697 - protein, 22 aa, Cryptosporidium hominis
VRKGPFKTVFVSESIKDLDYTS

SEQ ID NO: 2183698 - protein, 23 aa, Cryptosporidium hominis
VRKKVCIFLSDLLAVYKNNVSLH

SEQ ID NO: 2183699 - protein, 22 aa, Cryptosporidium hominis
VRKRKDKKLSDEEYKNQIDNGE

SEQ ID NO: 2183700 - protein, 17 aa, Cryptosporidium hominis
VRLKKLIENGSLLKLSG

SEQ ID NO: 2183701 - protein, 21 aa, Cryptosporidium hominis
VRLLEPFGRIVAPNIGTLFQT

SEQ ID NO: 2183702 - protein, 19 aa, Cryptosporidium hominis
VRLPIAASMSLILATALSC

SEQ ID NO: 2183703 - protein, 26 aa, Cryptosporidium hominis
VRMSEAWKCKFCNVIEYCQVCPLSKE

SEQ ID NO: 2183704 - protein, 24 aa, Cryptosporidium hominis
VRNSCLTVNFGEIFMDFTRQNLDE

SEQ ID NO: 2183705 - protein, 21 aa, Cryptosporidium hominis
VRPFGCSILLGGLDQDRGVEL

SEQ ID NO: 2183706 - protein, 19 aa, Cryptosporidium hominis
VRPPIQFPIDKVVDLEFEE

SEQ ID NO: 2183707 - protein, 25 aa, Cryptosporidium hominis
VRQFIKIRFPFVLVLNKADIMSESS

SEQ ID NO: 2183708 - protein, 24 aa, Cryptosporidium hominis
VRQYIDMFGCNIVVYFPKKCIEYI

SEQ ID NO: 2183709 - protein, 20 aa, Cryptosporidium hominis
VRRDRVVFLGSPPELPERVN

SEQ ID NO: 2183710 - protein, 20 aa, Cryptosporidium hominis
VRREIPGIPADVSIACVEQE

SEQ ID NO: 2183711 - protein, 22 aa, Cryptosporidium hominis
VRRKTWRVWFITSGGTRATRSF

SEQ ID NO: 2183712 - protein, 27 aa, Cryptosporidium hominis
VRRSNWFLKHVCSFISQKLNEINKSNI

SEQ ID NO: 2183713 - protein, 17 aa, Cryptosporidium hominis
VRRVFAWHPLTKSYSPC

SEQ ID NO: 2183714 - protein, 21 aa, Cryptosporidium hominis
VRSATSFAFQRHIDMGDMTKP

SEQ ID NO: 2183715 - protein, 18 aa, Cryptosporidium hominis
VRSIYKFKGQVHDENEVM

SEQ ID NO: 2183716 - protein, 20 aa, Cryptosporidium hominis
VRTAESFNKVMVEFEAVIGL

SEQ ID NO: 2183717 - protein, 23 aa, Cryptosporidium hominis
VRTGAGVGVGVGFGARVGARAGN

SEQ ID NO: 2183718 - protein, 25 aa, Cryptosporidium hominis
VRTSNELCCLIQCFKNAPLKYIPIC

SEQ ID NO: 2183719 - protein, 18 aa, Cryptosporidium hominis
VRYIEQRSAEGLASPIGF

SEQ ID NO: 2183720 - protein, 22 aa, Cryptosporidium hominis
VSATTCKAGTVQSEAVTSQACY

SEQ ID NO: 2183721 - protein, 28 aa, Cryptosporidium hominis
VSCCPMEMIHRRRHSLSYKPNIKKGVRR

SEQ ID NO: 2183722 - protein, 26 aa, Cryptosporidium hominis
VSCRNCFKELKIKADGLIVGNEIFNV

SEQ ID NO: 2183723 - protein, 18 aa, Cryptosporidium hominis
VSCSQGGCKENQDGWFVS

SEQ ID NO: 2183724 - protein, 23 aa, Cryptosporidium hominis
VSDERRLSIQSSVNGVLGSSGGG

SEQ ID NO: 2183725 - protein, 21 aa, Cryptosporidium hominis
VSDFREIIGYEPFKKEDLDDS

SEQ ID NO: 2183726 - protein, 27 aa, Cryptosporidium hominis
VSDLLICPICEGFFRGATTIRECLHTF

SEQ ID NO: 2183727 - protein, 19 aa, Cryptosporidium hominis
VSDVEFSPFYSCLLVSASQ

SEQ ID NO: 2183728 - protein, 23 aa, Cryptosporidium hominis
VSECIRHNLLYSYPVITERQGEY

SEQ ID NO: 2183729 - protein, 24 aa, Cryptosporidium hominis
VSEFIIELMQKWDSKLCELQYHHL

SEQ ID NO: 2183730 - protein, 25 aa, Cryptosporidium hominis
VSEFIPEIIDFISTIISRGFAYESE

SEQ ID NO: 2183731 - protein, 22 aa, Cryptosporidium hominis
VSEKSILRYAYLKKQAVENKVK

SEQ ID NO: 2183732 - protein, 17 aa, Cryptosporidium hominis
VSERGDLNVSISIESVD

SEQ ID NO: 2183733 - protein, 35 aa, Cryptosporidium hominis
VSFADFKLAAEAFWKMGALPPTFSGFGPQVPQNIN

SEQ ID NO: 2183734 - protein, 17 aa, Cryptosporidium hominis
VSFDKWNLMEFVKGIIC

SEQ ID NO: 2183735 - protein, 19 aa, Cryptosporidium hominis
VSGGGARCRTGRKRRSSRV

SEQ ID NO: 2183736 - protein, 17 aa, Cryptosporidium hominis
VSGGTQFNISVPRNTIV

SEQ ID NO: 2183737 - protein, 20 aa, Cryptosporidium hominis
VSGKLVRWLIQNGGQGEKGQ

SEQ ID NO: 2183738 - protein, 23 aa, Cryptosporidium hominis
VSGLPGLRVKCLILNQLMEKELH

SEQ ID NO: 2183739 - protein, 22 aa, Cryptosporidium hominis
VSGLQLKVLRPFNQESKLILNW

SEQ ID NO: 2183740 - protein, 17 aa, Cryptosporidium hominis
VSGRFSRCFGNNIEGRI

SEQ ID NO: 2183741 - protein, 28 aa, Cryptosporidium hominis
VSGRNKMDFPFDMPSNYSSKYGMKPDGD

SEQ ID NO: 2183742 - protein, 26 aa, Cryptosporidium hominis
VSGVLAEEVCRLFGINRNKIRVIFNG

SEQ ID NO: 2183743 - protein, 24 aa, Cryptosporidium hominis
VSHLKEKPKWIIFTDIIQTKKTYI

SEQ ID NO: 2183744 - protein, 18 aa, Cryptosporidium hominis
VSHVACYGVNIPLNELLD

SEQ ID NO: 2183745 - protein, 25 aa, Cryptosporidium hominis
VSIKNCKNCLIAVACRQIRIHDSHG

SEQ ID NO: 2183746 - protein, 31 aa, Cryptosporidium hominis
VSISELRYIVLICIRWRLQNSSELSSNVSTI

SEQ ID NO: 2183747 - protein, 18 aa, Cryptosporidium hominis
VSISMPIDSSITLNPNQH

SEQ ID NO: 2183748 - protein, 24 aa, Cryptosporidium hominis
VSKKKCRETNEILAKYVNDLASEY

SEQ ID NO: 2183749 - protein, 23 aa, Cryptosporidium hominis
VSKKYLEGFARTFDPMRSLFREN

SEQ ID NO: 2183750 - protein, 20 aa, Cryptosporidium hominis
VSKNFICSFSSLKVNLDPGY

SEQ ID NO: 2183751 - protein, 18 aa, Cryptosporidium hominis
VSKNFLLVCSRIFCYQMI

SEQ ID NO: 2183752 - protein, 20 aa, Cryptosporidium hominis
VSKPSWDGGRLVKLLQGHGL

SEQ ID NO: 2183753 - protein, 26 aa, Cryptosporidium hominis
VSLDHMKWMRGIWNLITFKIFGNSSS

SEQ ID NO: 2183754 - protein, 21 aa, Cryptosporidium hominis
VSLRDSSPFFRNNYEYDHSYS

SEQ ID NO: 2183755 - protein, 18 aa, Cryptosporidium hominis
VSLRMKVMHLCRQKELNI

SEQ ID NO: 2183756 - protein, 20 aa, Cryptosporidium hominis
VSLRSRLTLYIPQENGDTLQ

SEQ ID NO: 2183757 - protein, 17 aa, Cryptosporidium hominis
VSLSSDIANNLEFKQIY

SEQ ID NO: 2183758 - protein, 25 aa, Cryptosporidium hominis
VSMDISGYVSDLSLKNVTTGTKTGE

SEQ ID NO: 2183759 - protein, 17 aa, Cryptosporidium hominis
VSMKMSLGLEYLQEKYF

SEQ ID NO: 2183760 - protein, 28 aa, Cryptosporidium hominis
VSMLPCICLDPKPGHFVLDLCSAPGSKS

SEQ ID NO: 2183761 - protein, 19 aa, Cryptosporidium hominis
VSMPKERWFGYIKDYDGGT

SEQ ID NO: 2183762 - protein, 26 aa, Cryptosporidium hominis
VSNEVLPSWILEKFFVDGGFNVISRL

SEQ ID NO: 2183763 - protein, 20 aa, Cryptosporidium hominis
VSNSGWGIVDVRRLDGARDI

SEQ ID NO: 2183764 - protein, 22 aa, Cryptosporidium hominis
VSPEYVKRVFSLFDINNTGKVG

SEQ ID NO: 2183765 - protein, 20 aa, Cryptosporidium hominis
VSPNFVFKFENNFSDLDMKS

SEQ ID NO: 2183766 - protein, 32 aa, Cryptosporidium hominis
VSPSNYYAVPPAQYILDTSIYSSATPYVAVPA

SEQ ID NO: 2183767 - protein, 32 aa, Cryptosporidium hominis
VSQKKIRPATGIPRSFLRAINFDEEGRLYSEV

SEQ ID NO: 2183768 - protein, 20 aa, Cryptosporidium hominis
VSRFGFVCSDSLSYAVVDCN

SEQ ID NO: 2183769 - protein, 18 aa, Cryptosporidium hominis
VSSIWVVYLSFMEDYENF

SEQ ID NO: 2183770 - protein, 25 aa, Cryptosporidium hominis
VSSMTERGDLCWIMSGTDMLSGSQF

SEQ ID NO: 2183771 - protein, 29 aa, Cryptosporidium hominis
VSSRSHAIFQLSIFLERKKLFNVSANNNP

SEQ ID NO: 2183772 - protein, 26 aa, Cryptosporidium hominis
VSSSIKRTLKFLWAISKGLPIISPST

SEQ ID NO: 2183773 - protein, 34 aa, Cryptosporidium hominis
VSSVKPIMITSLWSCIYKSLRYNMNRYNACEPNA

SEQ ID NO: 2183774 - protein, 23 aa, Cryptosporidium hominis
VSSYFGVIFIITRGGILYIVEPT

SEQ ID NO: 2183775 - protein, 19 aa, Cryptosporidium hominis
VSTFIDYWYRILRFLHKSL

SEQ ID NO: 2183776 - protein, 17 aa, Cryptosporidium hominis
VSTPLLLNDAIVIPMHC

SEQ ID NO: 2183777 - protein, 17 aa, Cryptosporidium hominis
VSVDRDGRFTGIVSDEQ

SEQ ID NO: 2183778 - protein, 18 aa, Cryptosporidium hominis
VSVEPCEGNPDFKKLNSL

SEQ ID NO: 2183779 - protein, 27 aa, Cryptosporidium hominis
VSVVDPRTGRQLKVWDVAKSFSDSISA

SEQ ID NO: 2183780 - protein, 18 aa, Cryptosporidium hominis
VSYGDGWLDSYKIDLPIL

SEQ ID NO: 2183781 - protein, 17 aa, Cryptosporidium hominis
VSYNCENCVRMRNRTMN

SEQ ID NO: 2183782 - protein, 17 aa, Cryptosporidium hominis
VTAANQFLAQQIAMGGG

SEQ ID NO: 2183783 - protein, 24 aa, Cryptosporidium hominis
VTAHKSCFIHYFIYNDINNRISNF

SEQ ID NO: 2183784 - protein, 18 aa, Cryptosporidium hominis
VTAHLIKQMLSAISYCHS

SEQ ID NO: 2183785 - protein, 20 aa, Cryptosporidium hominis
VTCEDWKNLSNWNVDRVKRS

SEQ ID NO: 2183786 - protein, 27 aa, Cryptosporidium hominis
VTCPNCTEIEYIKAHHIIDGPIIGLEW

SEQ ID NO: 2183787 - protein, 17 aa, Cryptosporidium hominis
VTDCSLCTYNISEETDE

SEQ ID NO: 2183788 - protein, 17 aa, Cryptosporidium hominis
VTDIICNSYEPYLSEVG

SEQ ID NO: 2183789 - protein, 26 aa, Cryptosporidium hominis
VTECRRRIIYTGDVSFLLKLHAYLEF

SEQ ID NO: 2183790 - protein, 22 aa, Cryptosporidium hominis
VTELHIKPGVDINVISTPTGPA

SEQ ID NO: 2183791 - protein, 18 aa, Cryptosporidium hominis
VTELNALKHILDDNEIIP

SEQ ID NO: 2183792 - protein, 19 aa, Cryptosporidium hominis
VTELSYYIGVQVAFHSSFS

SEQ ID NO: 2183793 - protein, 22 aa, Cryptosporidium hominis
VTEVKERMQVLLNLVKTKEGSG

SEQ ID NO: 2183794 - protein, 17 aa, Cryptosporidium hominis
VTEYIRTGDLFKLIHGN

SEQ ID NO: 2183795 - protein, 19 aa, Cryptosporidium hominis
VTGLLKFINKWYLPNNMCL

SEQ ID NO: 2183796 - protein, 17 aa, Cryptosporidium hominis
VTGRLRIASILDGEDGG

SEQ ID NO: 2183797 - protein, 17 aa, Cryptosporidium hominis
VTGSWDKTIKFWNGQSQ

SEQ ID NO: 2183798 - protein, 20 aa, Cryptosporidium hominis
VTHIYSFDAAMPIWMIKRFV

SEQ ID NO: 2183799 - protein, 24 aa, Cryptosporidium hominis
VTHPELKTTFYLDIVSIKKNPQSQ

SEQ ID NO: 2183800 - protein, 18 aa, Cryptosporidium hominis
VTIGPGLWGQHAAQQQPS

SEQ ID NO: 2183801 - protein, 19 aa, Cryptosporidium hominis
VTITPKFAASPPKPASGAA

SEQ ID NO: 2183802 - protein, 18 aa, Cryptosporidium hominis
VTKCGKVYTWGQGGRLGH

SEQ ID NO: 2183803 - protein, 17 aa, Cryptosporidium hominis
VTKFYSNHYLKGKWVEC

SEQ ID NO: 2183804 - protein, 17 aa, Cryptosporidium hominis
VTLPLKLFLNINSDEFD

SEQ ID NO: 2183805 - protein, 22 aa, Cryptosporidium hominis
VTLWYRCPELLFGSTKYTHAVD

SEQ ID NO: 2183806 - protein, 24 aa, Cryptosporidium hominis
VTPGHRIPMGLLLGGRDALENELE

SEQ ID NO: 2183807 - protein, 19 aa, Cryptosporidium hominis
VTPPEPKLLGTYINMVPIS

SEQ ID NO: 2183808 - protein, 20 aa, Cryptosporidium hominis
VTPRPNCYDYYNRDPKSHHF

SEQ ID NO: 2183809 - protein, 18 aa, Cryptosporidium hominis
VTQFLRKSVAPFKLANMH

SEQ ID NO: 2183810 - protein, 21 aa, Cryptosporidium hominis
VTRKLSGPDFFDIIRSEHSSS

SEQ ID NO: 2183811 - protein, 22 aa, Cryptosporidium hominis
VTRLSVINMRLRACNLFLHKIE

SEQ ID NO: 2183812 - protein, 17 aa, Cryptosporidium hominis
VTRTGYMLIYKRKDWAP

SEQ ID NO: 2183813 - protein, 25 aa, Cryptosporidium hominis
VTSDILVRIARLFGFNTRFQTGTDE

SEQ ID NO: 2183814 - protein, 25 aa, Cryptosporidium hominis
VTSPEEVFELMALGHKHRAVASTNM

SEQ ID NO: 2183815 - protein, 20 aa, Cryptosporidium hominis
VTSWMSFKALANYIELSDLH

SEQ ID NO: 2183816 - protein, 23 aa, Cryptosporidium hominis
VTTTPELPCYCFVIEASSMALQG

SEQ ID NO: 2183817 - protein, 18 aa, Cryptosporidium hominis
VTVGGWARTVRKQCSDTL

SEQ ID NO: 2183818 - protein, 25 aa, Cryptosporidium hominis
VTVLEPLGASGLRSIRYIKELPHEI

SEQ ID NO: 2183819 - protein, 22 aa, Cryptosporidium hominis
VTVLLCANAEYYLNEHGLSEKC

SEQ ID NO: 2183820 - protein, 33 aa, Cryptosporidium hominis
VVAEYAFRFIVERFRFKGIRLVDCERNCNFDNA

SEQ ID NO: 2183821 - protein, 18 aa, Cryptosporidium hominis
VVCSSHLQGKCKNSDSCP

SEQ ID NO: 2183822 - protein, 25 aa, Cryptosporidium hominis
VVENWSKCINCFISKPSLQDKITER

SEQ ID NO: 2183823 - protein, 27 aa, Cryptosporidium hominis
VVETCGRSICNPCLQFSRVHDVSLFNS

SEQ ID NO: 2183824 - protein, 21 aa, Cryptosporidium hominis
VVFERWDCNIILKEMGKEMAT

SEQ ID NO: 2183825 - protein, 19 aa, Cryptosporidium hominis
VVGKCLFSLSSTKFNSNIK

SEQ ID NO: 2183826 - protein, 26 aa, Cryptosporidium hominis
VVHGSNCNCTSCLKQVGRMGITSSMG

SEQ ID NO: 2183827 - protein, 17 aa, Cryptosporidium hominis
VVHSLTFTSNDIDKLGT

SEQ ID NO: 2183828 - protein, 25 aa, Cryptosporidium hominis
VVHTLCIAASFGPNIVRNHTINRIQ

SEQ ID NO: 2183829 - protein, 18 aa, Cryptosporidium hominis
VVIIWDYLLANGLQSLIS

SEQ ID NO: 2183830 - protein, 25 aa, Cryptosporidium hominis
VVIPSVDSLDHWMMLFLQPLGITCD

SEQ ID NO: 2183831 - protein, 19 aa, Cryptosporidium hominis
VVKLADFGLARVFNTRNRM

SEQ ID NO: 2183832 - protein, 24 aa, Cryptosporidium hominis
VVKLDPFLICHCSNKSNLSRINSN

SEQ ID NO: 2183833 - protein, 21 aa, Cryptosporidium hominis
VVKSYDCIRPKRSSIGDFDND

SEQ ID NO: 2183834 - protein, 22 aa, Cryptosporidium hominis
VVLDALDWSIEFPKPSDYIKRY

SEQ ID NO: 2183835 - protein, 17 aa, Cryptosporidium hominis
VVLRPMYSRKEAETYPE

SEQ ID NO: 2183836 - protein, 18 aa, Cryptosporidium hominis
VVMASSIGSNVYIGKNSI

SEQ ID NO: 2183837 - protein, 20 aa, Cryptosporidium hominis
VVNKAIIIQRVFRMALCRRQ

SEQ ID NO: 2183838 - protein, 17 aa, Cryptosporidium hominis
VVPEISKPQDARVPTLL

SEQ ID NO: 2183839 - protein, 22 aa, Cryptosporidium hominis
VVQLFLEWFGMTYLENEEFKRS

SEQ ID NO: 2183840 - protein, 18 aa, Cryptosporidium hominis
VVREIEWEEVFSINDLRF

SEQ ID NO: 2183841 - protein, 17 aa, Cryptosporidium hominis
VVRFSKDEFHEYQEPTI

SEQ ID NO: 2183842 - protein, 26 aa, Cryptosporidium hominis
VVSDPQICYNPAMIMVILNGYESIYG

SEQ ID NO: 2183843 - protein, 42 aa, Cryptosporidium hominis
VVSGKAYTGPEIDVWSCGVILYALLCGSLPFDDENVGNLFRK

SEQ ID NO: 2183844 - protein, 23 aa, Cryptosporidium hominis
VVTPSGKQTIVFHMLPDCESNNS

SEQ ID NO: 2183845 - protein, 28 aa, Cryptosporidium hominis
VVVIDEWDCSSFYPTGHIVGVLGKAGDL

SEQ ID NO: 2183846 - protein, 27 aa, Cryptosporidium hominis
VVVMPWRTFRFNECACAPYNADFDGDE

SEQ ID NO: 2183847 - protein, 27 aa, Cryptosporidium hominis
VVVNSGVWPFGRIGLLNQSQDSSNSQV

SEQ ID NO: 2183848 - protein, 23 aa, Cryptosporidium hominis
VVYGGGCSEMLMSVSVDELSKRV

SEQ ID NO: 2183849 - protein, 23 aa, Cryptosporidium hominis
VWKSTKIFPKFKCLINNDKKSLS

SEQ ID NO: 2183850 - protein, 30 aa, Cryptosporidium hominis
VYDLPWPIGQRENIMFCFGVDTLKEHDCIM

SEQ ID NO: 2183851 - protein, 30 aa, Cryptosporidium hominis
VYESRRLASFPAIRAKIFEYFLSNACITTV

SEQ ID NO: 2183852 - protein, 17 aa, Cryptosporidium hominis
VYGDNSNNIAFNYKYNF

SEQ ID NO: 2183853 - protein, 28 aa, Cryptosporidium hominis
VYGIPLLCLRGSMPIWYYRKKKNMSLYA

SEQ ID NO: 2183854 - protein, 18 aa, Cryptosporidium hominis
VYHIKELMIKRELEKDER

SEQ ID NO: 2183855 - protein, 22 aa, Cryptosporidium hominis
VYIKRGNSLYFWDKLKYNNQSL

SEQ ID NO: 2183856 - protein, 17 aa, Cryptosporidium hominis
VYIPIFWTSIHRNKVEL

SEQ ID NO: 2183857 - protein, 34 aa, Cryptosporidium hominis
VYIYGEENIRYFLYWRRMRMQLKREERRQLNPTG

SEQ ID NO: 2183858 - protein, 29 aa, Cryptosporidium hominis
VYKDELSSLTVIICWIEECLQNFVYPIQR

SEQ ID NO: 2183859 - protein, 17 aa, Cryptosporidium hominis
VYKRKVQSITIVSKIIL

SEQ ID NO: 2183860 - protein, 20 aa, Cryptosporidium hominis
VYLFPNCIYQEFISVFEKID

SEQ ID NO: 2183861 - protein, 23 aa, Cryptosporidium hominis
VYLLLKRYVDCVDDCRASLKENP

SEQ ID NO: 2183862 - protein, 18 aa, Cryptosporidium hominis
VYLLNEFVHNVRGSHLRY

SEQ ID NO: 2183863 - protein, 18 aa, Cryptosporidium hominis
VYLTLPFMGSNTIIEKNQ

SEQ ID NO: 2183864 - protein, 21 aa, Cryptosporidium hominis
VYNIGVGDWFLIPDNTNYNFS

SEQ ID NO: 2183865 - protein, 19 aa, Cryptosporidium hominis
VYNRPNRKFKKYGRYQQVH

SEQ ID NO: 2183866 - protein, 24 aa, Cryptosporidium hominis
VYPTYDFACPIVDSIEGVTHALRT

SEQ ID NO: 2183867 - protein, 27 aa, Cryptosporidium hominis
VYQIEEVRDSLGYQKKRLIPVDQDELF

SEQ ID NO: 2183868 - protein, 18 aa, Cryptosporidium hominis
VYRSFILKLVIKLNNYFL

SEQ ID NO: 2183869 - protein, 22 aa, Cryptosporidium hominis
VYSFGIILWEMITKKIPHEDLN

SEQ ID NO: 2183870 - protein, 17 aa, Cryptosporidium hominis
VYSSFIFFNNINHQAPS

SEQ ID NO: 2183871 - protein, 17 aa, Cryptosporidium hominis
VYVCVTHLLFASSKEKF

SEQ ID NO: 2183872 - protein, 17 aa, Cryptosporidium hominis
VYYFPRDHVCDFKYCNI

SEQ ID NO: 2183873 - protein, 18 aa, Cryptosporidium hominis
VYYPRAYMYNNIKHNLPD

SEQ ID NO: 2183874 - protein, 18 aa, Cryptosporidium hominis
WAASVLMVTKAFEVKQEY

SEQ ID NO: 2183875 - protein, 30 aa, Cryptosporidium hominis
WAKEDKVPLTFSLRGKKMFLRAKGIQRSLA

SEQ ID NO: 2183876 - protein, 19 aa, Cryptosporidium hominis
WAKSFGWSSYGNMKFMKDD

SEQ ID NO: 2183877 - protein, 30 aa, Cryptosporidium hominis
WAKSVIVGRGRIGGIPVGFILVETRVTEYI

SEQ ID NO: 2183878 - protein, 18 aa, Cryptosporidium hominis
WCFSELKQAENYAASNAS

SEQ ID NO: 2183879 - protein, 30 aa, Cryptosporidium hominis
WCGDLCRRCNSMAGTFCYMAPEILKGERQT

SEQ ID NO: 2183880 - protein, 19 aa, Cryptosporidium hominis
WCHLVELQIASLPASALPA

SEQ ID NO: 2183881 - protein, 17 aa, Cryptosporidium hominis
WCSKGIATGMLRYSGDS

SEQ ID NO: 2183882 - protein, 19 aa, Cryptosporidium hominis
WDAILTCFFLDTAKNIITY

SEQ ID NO: 2183883 - protein, 17 aa, Cryptosporidium hominis
WDASIVMINGKMVRQNI

SEQ ID NO: 2183884 - protein, 23 aa, Cryptosporidium hominis
WDEDRFGLEYDLEIFNIVAVESF

SEQ ID NO: 2183885 - protein, 17 aa, Cryptosporidium hominis
WDFPAGFTPSLSCKGFH

SEQ ID NO: 2183886 - protein, 17 aa, Cryptosporidium hominis
WDGEKFDKVMGYFRKYA

SEQ ID NO: 2183887 - protein, 21 aa, Cryptosporidium hominis
WDGGRLVKLLQGHGLNIENYE

SEQ ID NO: 2183888 - protein, 18 aa, Cryptosporidium hominis
WDHSWGCPGDFSDLPVLN

SEQ ID NO: 2183889 - protein, 18 aa, Cryptosporidium hominis
WDIRKASCGIAERACAFK

SEQ ID NO: 2183890 - protein, 17 aa, Cryptosporidium hominis
WDIRKCSEYTPLYIYKS

SEQ ID NO: 2183891 - protein, 20 aa, Cryptosporidium hominis
WDIWSLGCVLQEFFGNSNPF

SEQ ID NO: 2183892 - protein, 18 aa, Cryptosporidium hominis
WDKEHPILLTSNYNLQDY

SEQ ID NO: 2183893 - protein, 20 aa, Cryptosporidium hominis
WDLITYTAINTFKLHHGDVL

SEQ ID NO: 2183894 - protein, 21 aa, Cryptosporidium hominis
WDLNPRSGFKSYFENSTLYLN

SEQ ID NO: 2183895 - protein, 22 aa, Cryptosporidium hominis
WDLSNLIRIWWHFIPIPHCEIP

SEQ ID NO: 2183896 - protein, 24 aa, Cryptosporidium hominis
WDNKGCVRGGYRNINLPGAQQNSI

SEQ ID NO: 2183897 - protein, 19 aa, Cryptosporidium hominis
WDNKHIPSYLDFYKIYFQD

SEQ ID NO: 2183898 - protein, 17 aa, Cryptosporidium hominis
WDPILRPTLDLGGVMAI

SEQ ID NO: 2183899 - protein, 22 aa, Cryptosporidium hominis
WDRVYRASCGELIYCNLNEIKI

SEQ ID NO: 2183900 - protein, 23 aa, Cryptosporidium hominis
WDSKELIQDFSLKSHKHSITDVN

SEQ ID NO: 2183901 - protein, 17 aa, Cryptosporidium hominis
WDSKLSKIYSIKKKIEE

SEQ ID NO: 2183902 - protein, 29 aa, Cryptosporidium hominis
WDSMILWNDLFVWRNFVFSIIMNLISRSD

SEQ ID NO: 2183903 - protein, 18 aa, Cryptosporidium hominis
WDSPRITPNFGDENDNLL

SEQ ID NO: 2183904 - protein, 17 aa, Cryptosporidium hominis
WDSSLKIAIKREDLNRI

SEQ ID NO: 2183905 - protein, 19 aa, Cryptosporidium hominis
WDTDDIDHWNVPKLTPEDN

SEQ ID NO: 2183906 - protein, 17 aa, Cryptosporidium hominis
WDVRKGPFKTVFVSESI

SEQ ID NO: 2183907 - protein, 20 aa, Cryptosporidium hominis
WDYMIKRSYQELGMDYDIKL

SEQ ID NO: 2183908 - protein, 24 aa, Cryptosporidium hominis
WEALKKGESVLVFCPSKYSVESTA

SEQ ID NO: 2183909 - protein, 21 aa, Cryptosporidium hominis
WEDFVGVCWPGKVKYPDFLNP

SEQ ID NO: 2183910 - protein, 19 aa, Cryptosporidium hominis
WEDIELIGYYPYPTIKMDM

SEQ ID NO: 2183911 - protein, 19 aa, Cryptosporidium hominis
WEDLSNFYLRFNGNCKLLL

SEQ ID NO: 2183912 - protein, 18 aa, Cryptosporidium hominis
WEDNVCSLRQWIKKKMPG

SEQ ID NO: 2183913 - protein, 19 aa, Cryptosporidium hominis
WEEAVKLHFQHIRKKAHEN

SEQ ID NO: 2183914 - protein, 23 aa, Cryptosporidium hominis
WEEIKRIISKYFKIVKEEWRNAT

SEQ ID NO: 2183915 - protein, 18 aa, Cryptosporidium hominis
WEEISTKGIRVVNIQDSS

SEQ ID NO: 2183916 - protein, 19 aa, Cryptosporidium hominis
WEELCKLVNYQGEKQMEDI

SEQ ID NO: 2183917 - protein, 22 aa, Cryptosporidium hominis
WEIFWQELLIYLFFKPILNKNS

SEQ ID NO: 2183918 - protein, 24 aa, Cryptosporidium hominis
WEIKSVLFEEGFKFIQKDKQNISC

SEQ ID NO: 2183919 - protein, 18 aa, Cryptosporidium hominis
WEIVYSCDDFLSSINGVC

SEQ ID NO: 2183920 - protein, 18 aa, Cryptosporidium hominis
WEKNFTRYFNLLLSSLNQ

SEQ ID NO: 2183921 - protein, 18 aa, Cryptosporidium hominis
WEKWYLTHHCTIYYEHTY

SEQ ID NO: 2183922 - protein, 17 aa, Cryptosporidium hominis
WELINGDPLEKGSKTEE

SEQ ID NO: 2183923 - protein, 26 aa, Cryptosporidium hominis
WEMLMLEYHILKILNWDLSINYHEFK

SEQ ID NO: 2183924 - protein, 20 aa, Cryptosporidium hominis
WEMPEPCITPEGKLLTQIEK

SEQ ID NO: 2183925 - protein, 20 aa, Cryptosporidium hominis
WESSNRFAIVVVDDVTRSQT

SEQ ID NO: 2183926 - protein, 23 aa, Cryptosporidium hominis
WESYPNLIEFIIIIDKVFQPLKE

SEQ ID NO: 2183927 - protein, 21 aa, Cryptosporidium hominis
WETAKSCICWLKQHRKQPMNF

SEQ ID NO: 2183928 - protein, 25 aa, Cryptosporidium hominis
WETMNIPLRLVDMIRKRIFSQVNEP

SEQ ID NO: 2183929 - protein, 18 aa, Cryptosporidium hominis
WEYYEPWDPILRPTLDLG

SEQ ID NO: 2183930 - protein, 21 aa, Cryptosporidium hominis
WFDSTKGFGFITPDDGSEDIF

SEQ ID NO: 2183931 - protein, 21 aa, Cryptosporidium hominis
WFEDKSRIWLVIEIAPGGELY

SEQ ID NO: 2183932 - protein, 25 aa, Cryptosporidium hominis
WFFKKFSTKSSYIWLKSKEKYTKST

SEQ ID NO: 2183933 - protein, 17 aa, Cryptosporidium hominis
WFGMTYLENEEFKRSNK

SEQ ID NO: 2183934 - protein, 24 aa, Cryptosporidium hominis
WFHSVIWPAMLLSVGLSLPKTIFA

SEQ ID NO: 2183935 - protein, 29 aa, Cryptosporidium hominis
WFKHFLTPWLKFGTAFDHFSEFINYNLST

SEQ ID NO: 2183936 - protein, 20 aa, Cryptosporidium hominis
WFLNNECGFDSNLNEDFIKK

SEQ ID NO: 2183937 - protein, 20 aa, Cryptosporidium hominis
WFSRIRRISENNIKNELILF

SEQ ID NO: 2183938 - protein, 24 aa, Cryptosporidium hominis
WFVYYRPFLKFFLQNASKLGSICV

SEQ ID NO: 2183939 - protein, 19 aa, Cryptosporidium hominis
WGERLLSYFQFERNADCLI

SEQ ID NO: 2183940 - protein, 17 aa, Cryptosporidium hominis
WGGCFDKMFEALKSLIY

SEQ ID NO: 2183941 - protein, 26 aa, Cryptosporidium hominis
WGNEFELPGLVNIYFVSNDHQNILSI

SEQ ID NO: 2183942 - protein, 28 aa, Cryptosporidium hominis
WGNYLGGAFIRYWKRASTHIFGFRFDLI

SEQ ID NO: 2183943 - protein, 19 aa, Cryptosporidium hominis
WGQIYILNVVAEWKVSTEK

SEQ ID NO: 2183944 - protein, 17 aa, Cryptosporidium hominis
WGQRACYSHHIRSKIKR

SEQ ID NO: 2183945 - protein, 17 aa, Cryptosporidium hominis
WGQYLSLNIEEMENRDK

SEQ ID NO: 2183946 - protein, 26 aa, Cryptosporidium hominis
WGRFYDEYFEAFPLAISETLEINQLM

SEQ ID NO: 2183947 - protein, 62 aa, Cryptosporidium hominis
WGSFKENFYFHWKRIIGACNFKDLHAYRLIFRCLGNLRPSSMPIFILRPIIKQLDEYRKISE

SEQ ID NO: 2183948 - protein, 22 aa, Cryptosporidium hominis
WGSNTYRKAIFEKMKNYLVELS

SEQ ID NO: 2183949 - protein, 17 aa, Cryptosporidium hominis
WGTQFGMLIEYLKEEYP

SEQ ID NO: 2183950 - protein, 24 aa, Cryptosporidium hominis
WGVTPSIFEKVWFHRNITENNEDQ

SEQ ID NO: 2183951 - protein, 27 aa, Cryptosporidium hominis
WHWYTWCKRPDFNLIHREVLGDEVVHV

SEQ ID NO: 2183952 - protein, 17 aa, Cryptosporidium hominis
WIAVHGIHTKQLLLKYI

SEQ ID NO: 2183953 - protein, 25 aa, Cryptosporidium hominis
WIDAKSRDWILEWQTKNGRWSVRKF

SEQ ID NO: 2183954 - protein, 24 aa, Cryptosporidium hominis
WIEAPCRKGGPPAQRFQHVVLFVG

SEQ ID NO: 2183955 - protein, 23 aa, Cryptosporidium hominis
WIEEKIRGLELILNHQRLPLLFK

SEQ ID NO: 2183956 - protein, 21 aa, Cryptosporidium hominis
WIESLRTLRCEKLGKLCSLRG

SEQ ID NO: 2183957 - protein, 18 aa, Cryptosporidium hominis
WIKDNIHVDIPISINTCI

SEQ ID NO: 2183958 - protein, 18 aa, Cryptosporidium hominis
WIMMDRIRESSYKLMEPT

SEQ ID NO: 2183959 - protein, 18 aa, Cryptosporidium hominis
WIMSLPISGKIFLDKGAI

SEQ ID NO: 2183960 - protein, 18 aa, Cryptosporidium hominis
WINHLGLVSELRNYQKDA

SEQ ID NO: 2183961 - protein, 18 aa, Cryptosporidium hominis
WINTQGMLQIIKNYTANK

SEQ ID NO: 2183962 - protein, 23 aa, Cryptosporidium hominis
WIPCPKEVWRPGVVSRVDDSQIS

SEQ ID NO: 2183963 - protein, 20 aa, Cryptosporidium hominis
WIPKKEFNVTLYGHGVDDGR

SEQ ID NO: 2183964 - protein, 17 aa, Cryptosporidium hominis
WIPPEYRWLHFLHLALI

SEQ ID NO: 2183965 - protein, 17 aa, Cryptosporidium hominis
WISEAIWRHQLLCHCIP

SEQ ID NO: 2183966 - protein, 18 aa, Cryptosporidium hominis
WITEFSVSMKMSLGLEYL

SEQ ID NO: 2183967 - protein, 18 aa, Cryptosporidium hominis
WITQKNKYRRIGLSHNSN

SEQ ID NO: 2183968 - protein, 19 aa, Cryptosporidium hominis
WKDCHVLEIQTELIKNIGY

SEQ ID NO: 2183969 - protein, 20 aa, Cryptosporidium hominis
WKDKRLEIRKEELMDELKVQ

SEQ ID NO: 2183970 - protein, 20 aa, Cryptosporidium hominis
WKELSRISAQLSQESLIDET

SEQ ID NO: 2183971 - protein, 17 aa, Cryptosporidium hominis
WKEYYSLKQASEVSLVA

SEQ ID NO: 2183972 - protein, 21 aa, Cryptosporidium hominis
WKFETLCDLYDTLTVTQSIIF

SEQ ID NO: 2183973 - protein, 17 aa, Cryptosporidium hominis
WKFYLDGKFTMVSKKYI

SEQ ID NO: 2183974 - protein, 27 aa, Cryptosporidium hominis
WKGSNKGTKFTICMIGGGSNGKNKYIQ

SEQ ID NO: 2183975 - protein, 20 aa, Cryptosporidium hominis
WKHNCLDATMPFFIQSLRDM

SEQ ID NO: 2183976 - protein, 32 aa, Cryptosporidium hominis
WKIDKSYLDLMVWWRKNYMEFFSSIRNIQLSE

SEQ ID NO: 2183977 - protein, 19 aa, Cryptosporidium hominis
WKIIEDFEPVISYDDYRAA

SEQ ID NO: 2183978 - protein, 20 aa, Cryptosporidium hominis
WKKFPARRIGVVLSGGQASG

SEQ ID NO: 2183979 - protein, 20 aa, Cryptosporidium hominis
WKKGMKQWDSEFSASSHNKQ

SEQ ID NO: 2183980 - protein, 18 aa, Cryptosporidium hominis
WKKPLEILSNDDDFKIEF

SEQ ID NO: 2183981 - protein, 19 aa, Cryptosporidium hominis
WKKRHSYKVFDEFEDEEKN

SEQ ID NO: 2183982 - protein, 18 aa, Cryptosporidium hominis
WKLKHKKRVKKYKDFIDD

SEQ ID NO: 2183983 - protein, 21 aa, Cryptosporidium hominis
WKLRNCIMNIFPYLVSHISFQ

SEQ ID NO: 2183984 - protein, 28 aa, Cryptosporidium hominis
WKMKLINKRGRKSLSYNGSSINEQNSPS

SEQ ID NO: 2183985 - protein, 17 aa, Cryptosporidium hominis
WKNAYYIAEPKVKRPKW

SEQ ID NO: 2183986 - protein, 20 aa, Cryptosporidium hominis
WKNEASQPLGPRSYRERQTL

SEQ ID NO: 2183987 - protein, 20 aa, Cryptosporidium hominis
WKNLSNWNVDRVKRSWTNKR

SEQ ID NO: 2183988 - protein, 18 aa, Cryptosporidium hominis
WKNMNLTVFVFKDELENT

SEQ ID NO: 2183989 - protein, 19 aa, Cryptosporidium hominis
WKPAKSVNISNEFDSAAVS

SEQ ID NO: 2183990 - protein, 19 aa, Cryptosporidium hominis
WKPPHLNTADFAAIFYAES

SEQ ID NO: 2183991 - protein, 20 aa, Cryptosporidium hominis
WKRLETYKDLISCEWGSAKV

SEQ ID NO: 2183992 - protein, 21 aa, Cryptosporidium hominis
WKRVVNKVCFVGNDFTRKPPK

SEQ ID NO: 2183993 - protein, 20 aa, Cryptosporidium hominis
WKSCHPNLIDSNAIKKYLNS

SEQ ID NO: 2183994 - protein, 22 aa, Cryptosporidium hominis
WKSQFLRLVKKLLINYKKTKKA

SEQ ID NO: 2183995 - protein, 20 aa, Cryptosporidium hominis
WKSYGRPIVKRDMKLKNSEG

SEQ ID NO: 2183996 - protein, 21 aa, Cryptosporidium hominis
WKTIFKIYPIYSIIKGEFFIH

SEQ ID NO: 2183997 - protein, 19 aa, Cryptosporidium hominis
WKTIIESLCSPNFPTEFIY

SEQ ID NO: 2183998 - protein, 19 aa, Cryptosporidium hominis
WKVPGQPVQPTWEPEENLN

SEQ ID NO: 2183999 - protein, 21 aa, Cryptosporidium hominis
WKYAKSRSKSIGILLEMSDSN

SEQ ID NO: 2184000 - protein, 25 aa, Cryptosporidium hominis
WKYHNFRLNTLDAMFEIKLNTCANS

SEQ ID NO: 2184001 - protein, 21 aa, Cryptosporidium hominis
WLCNRYPLIVKELKDAIDEET

SEQ ID NO: 2184002 - protein, 19 aa, Cryptosporidium hominis
WLDICKNELYKLIRVKSPK

SEQ ID NO: 2184003 - protein, 17 aa, Cryptosporidium hominis
WLDMKLSQYESKQRKND

SEQ ID NO: 2184004 - protein, 20 aa, Cryptosporidium hominis
WLGWTNGFLSSFRFPHCSRY

SEQ ID NO: 2184005 - protein, 17 aa, Cryptosporidium hominis
WLIGSSTGKIRLCKFEQ

SEQ ID NO: 2184006 - protein, 17 aa, Cryptosporidium hominis
WLIKNLCISVFQFSEHS

SEQ ID NO: 2184007 - protein, 18 aa, Cryptosporidium hominis
WLLCELVWEQVLLELGVK

SEQ ID NO: 2184008 - protein, 17 aa, Cryptosporidium hominis
WLLKRIIASESHENTKY

SEQ ID NO: 2184009 - protein, 19 aa, Cryptosporidium hominis
WLLKYCEHLSEKINSLHEI

SEQ ID NO: 2184010 - protein, 18 aa, Cryptosporidium hominis
WLLTTGFSDKGERQIGVW

SEQ ID NO: 2184011 - protein, 19 aa, Cryptosporidium hominis
WLMGPRCREQFVIRYQSAT

SEQ ID NO: 2184012 - protein, 21 aa, Cryptosporidium hominis
  misc_feature (20)..(20): Xaa can be any naturally occurring amino acid
WLNDYCSRWFISTETDSKHXS

SEQ ID NO: 2184013 - protein, 18 aa, Cryptosporidium hominis
WLNEAIIKFAKFSKHEAK

SEQ ID NO: 2184014 - protein, 33 aa, Cryptosporidium hominis
WLNKFSNQILKGWTSKLFYGWRKELNSEKNIKQ

SEQ ID NO: 2184015 - protein, 17 aa, Cryptosporidium hominis
WLNYTALNSDSWKEIDF

SEQ ID NO: 2184016 - protein, 19 aa, Cryptosporidium hominis
WLPSYNRIEKNKGFFGTWN

SEQ ID NO: 2184017 - protein, 25 aa, Cryptosporidium hominis
WLPTMKLLLKYNCDINRRDHKNWTA

SEQ ID NO: 2184018 - protein, 19 aa, Cryptosporidium hominis
WLRAYWFDDASLISPIRLC

SEQ ID NO: 2184019 - protein, 20 aa, Cryptosporidium hominis
WLRIEIEMWIFNNINSNWSS

SEQ ID NO: 2184020 - protein, 21 aa, Cryptosporidium hominis
WLSNCISCLTSSLKDGIESKP

SEQ ID NO: 2184021 - protein, 19 aa, Cryptosporidium hominis
WLSNSWMNYYMNWFVCFCK

SEQ ID NO: 2184022 - protein, 21 aa, Cryptosporidium hominis
WLSRRASSLTSMVIDKSIGSV

SEQ ID NO: 2184023 - protein, 20 aa, Cryptosporidium hominis
WLYELCDVYLELVKSRFKNI

SEQ ID NO: 2184024 - protein, 23 aa, Cryptosporidium hominis
WLYIRAASILRHLYVRPNVGVGA

SEQ ID NO: 2184025 - protein, 28 aa, Cryptosporidium hominis
WLYKQSRFLKDWRRRWFVLTRNYLASFK

SEQ ID NO: 2184026 - protein, 22 aa, Cryptosporidium hominis
WMISRFKKNVNILLADEMGLGK

SEQ ID NO: 2184027 - protein, 19 aa, Cryptosporidium hominis
WMKNRFIVLIRKRRQLMNL

SEQ ID NO: 2184028 - protein, 20 aa, Cryptosporidium hominis
WMNDCYRPGDVVRCSILSVV

SEQ ID NO: 2184029 - protein, 20 aa, Cryptosporidium hominis
WMRLMYELHEIILKYIEIEK

SEQ ID NO: 2184030 - protein, 22 aa, Cryptosporidium hominis
WMSMKVLRMLVSGLMTYCKLNF

SEQ ID NO: 2184031 - protein, 17 aa, Cryptosporidium hominis
WNDAFILQLFKSKNPNG

SEQ ID NO: 2184032 - protein, 17 aa, Cryptosporidium hominis
WNDFLSFLYSKGHSVDW

SEQ ID NO: 2184033 - protein, 19 aa, Cryptosporidium hominis
WNFDGDLLAAASSDAIIYI

SEQ ID NO: 2184034 - protein, 18 aa, Cryptosporidium hominis
WNFIPREHIAEACDTLKS

SEQ ID NO: 2184035 - protein, 26 aa, Cryptosporidium hominis
WNFYCNYFKCCLEKWSLTNIHASSEY

SEQ ID NO: 2184036 - protein, 17 aa, Cryptosporidium hominis
WNGLPLINLKFVHENLL

SEQ ID NO: 2184037 - protein, 17 aa, Cryptosporidium hominis
WNIIFKLIIVLTPKSSK

SEQ ID NO: 2184038 - protein, 19 aa, Cryptosporidium hominis
WNKCLKIRQICSGNFSYPY

SEQ ID NO: 2184039 - protein, 28 aa, Cryptosporidium hominis
WNKDNLYHWNKQMNVIKNVSSSIVQGYG

SEQ ID NO: 2184040 - protein, 19 aa, Cryptosporidium hominis
WNKEYCLLQSNIFLCHELK

SEQ ID NO: 2184041 - protein, 17 aa, Cryptosporidium hominis
WNLLVLDPYFYSKIRLN

SEQ ID NO: 2184042 - protein, 21 aa, Cryptosporidium hominis
WNMKPLSHMYLANSLIEKIKD

SEQ ID NO: 2184043 - protein, 18 aa, Cryptosporidium hominis
WNMLGFASSRNISSIYKG

SEQ ID NO: 2184044 - protein, 21 aa, Cryptosporidium hominis
WNNVYLLGRYIKFSRRISQSK

SEQ ID NO: 2184045 - protein, 27 aa, Cryptosporidium hominis
WNPVLWKSFQKLVGLSCQYPHELVKIC

SEQ ID NO: 2184046 - protein, 26 aa, Cryptosporidium hominis
WNQTEYKGRMLRINMSADKPQPGSLS

SEQ ID NO: 2184047 - protein, 22 aa, Cryptosporidium hominis
WNRIIQSPLFFDILGQKNTLVN

SEQ ID NO: 2184048 - protein, 20 aa, Cryptosporidium hominis
WNSCGDFVPFIGRVKEGNVM

SEQ ID NO: 2184049 - protein, 24 aa, Cryptosporidium hominis
WNSFADRFGHDFISNNLVLKDKHI

SEQ ID NO: 2184050 - protein, 18 aa, Cryptosporidium hominis
WNSYSKLLPLAVVELDVQ

SEQ ID NO: 2184051 - protein, 18 aa, Cryptosporidium hominis
WNVILGRRLILNRRVGLG

SEQ ID NO: 2184052 - protein, 20 aa, Cryptosporidium hominis
WNVRNILDWEYYKNRLTNTI

SEQ ID NO: 2184053 - protein, 22 aa, Cryptosporidium hominis
WNWQYSLEVELSWFSPTESSIN

SEQ ID NO: 2184054 - protein, 17 aa, Cryptosporidium hominis
WNYSLEWHPFFRPNGNF

SEQ ID NO: 2184055 - protein, 20 aa, Cryptosporidium hominis
WPEIDVSKPIPYVKQKQPSK

SEQ ID NO: 2184056 - protein, 20 aa, Cryptosporidium hominis
WPENDFRLFCGDLGNDVTEE

SEQ ID NO: 2184057 - protein, 24 aa, Cryptosporidium hominis
WPIEVLSLPNIFKGLIKRKKLVNL

SEQ ID NO: 2184058 - protein, 26 aa, Cryptosporidium hominis
WPIKSRLPVWKVWREMNNLLINKSLH

SEQ ID NO: 2184059 - protein, 23 aa, Cryptosporidium hominis
WPITCKKMSHILTREIGFQDLIE

SEQ ID NO: 2184060 - protein, 17 aa, Cryptosporidium hominis
WPLPLLFTKKNMEHYYN

SEQ ID NO: 2184061 - protein, 24 aa, Cryptosporidium hominis
WPPYRWSNNEIFVFKVQDTSVSIF

SEQ ID NO: 2184062 - protein, 17 aa, Cryptosporidium hominis
WPSMQKIATLTGHTYRV

SEQ ID NO: 2184063 - protein, 18 aa, Cryptosporidium hominis
WPSSDGHYTIHWSNTSDL

SEQ ID NO: 2184064 - protein, 20 aa, Cryptosporidium hominis
WPTLTIDWLPNSYKSADGSY

SEQ ID NO: 2184065 - protein, 17 aa, Cryptosporidium hominis
WPTPYKMYEEMSSEITF

SEQ ID NO: 2184066 - protein, 19 aa, Cryptosporidium hominis
WQESLCLVIKKLSENTNMK

SEQ ID NO: 2184067 - protein, 26 aa, Cryptosporidium hominis
WQESSQRWIAQWSDSISGRRITHGFS

SEQ ID NO: 2184068 - protein, 22 aa, Cryptosporidium hominis
WQLQSFPFKTIQDIFTMVKGYH

SEQ ID NO: 2184069 - protein, 28 aa, Cryptosporidium hominis
WQNLLIKWLTYVFKFSERNGISMYESWA

SEQ ID NO: 2184070 - protein, 26 aa, Cryptosporidium hominis
WQVFDTDKWCKIPISDPPSSNLLSID

SEQ ID NO: 2184071 - protein, 17 aa, Cryptosporidium hominis
WQYEISRLLKMDPKMVF

SEQ ID NO: 2184072 - protein, 26 aa, Cryptosporidium hominis
WRFDCSRCTISFSIKRNICERLSLGE

SEQ ID NO: 2184073 - protein, 21 aa, Cryptosporidium hominis
WRIEKPCINIDFVFNNTNVML

SEQ ID NO: 2184074 - protein, 20 aa, Cryptosporidium hominis
WRKIETIFRTLSIDYSKLID

SEQ ID NO: 2184075 - protein, 20 aa, Cryptosporidium hominis
WRKKEVNIIINVGGIPFLLN

SEQ ID NO: 2184076 - protein, 31 aa, Cryptosporidium hominis
WRKSENTLRKLLNWWKTEGFFKRSKHLEDYK

SEQ ID NO: 2184077 - protein, 19 aa, Cryptosporidium hominis
WRLTSYCPLLVQFFGAFIK

SEQ ID NO: 2184078 - protein, 17 aa, Cryptosporidium hominis
WRLYDLITRHFFATISN

SEQ ID NO: 2184079 - protein, 27 aa, Cryptosporidium hominis
WRRLENASYQRVDWSSRQFLGSEVDPK

SEQ ID NO: 2184080 - protein, 22 aa, Cryptosporidium hominis
WRRYHQMNMLWSSVITPIVSPE

SEQ ID NO: 2184081 - protein, 21 aa, Cryptosporidium hominis
WRSILEDLKHLPISFNKLELK

SEQ ID NO: 2184082 - protein, 19 aa, Cryptosporidium hominis
WRTMQMAYESFDFDNFDSK

SEQ ID NO: 2184083 - protein, 23 aa, Cryptosporidium hominis
WRTSEIPNFVSFVGCSLSTTIKY

SEQ ID NO: 2184084 - protein, 17 aa, Cryptosporidium hominis
WRTWGRSDKSGWSKTLL

SEQ ID NO: 2184085 - protein, 17 aa, Cryptosporidium hominis
WRVRGITWHAERKAFIV

SEQ ID NO: 2184086 - protein, 34 aa, Cryptosporidium hominis
WRYISVCSVESKLRVCNACWMKQRKKRDGKCLPL

SEQ ID NO: 2184087 - protein, 21 aa, Cryptosporidium hominis
WRYNYNWKHESCNLVRTLKKK

SEQ ID NO: 2184088 - protein, 22 aa, Cryptosporidium hominis
WRYYYLRQIMIHYIRIATPARK

SEQ ID NO: 2184089 - protein, 25 aa, Cryptosporidium hominis
WSCPSCSSPSLPLFLLFDESYTSHA

SEQ ID NO: 2184090 - protein, 17 aa, Cryptosporidium hominis
WSCSNAKSQWETIIYNF

SEQ ID NO: 2184091 - protein, 26 aa, Cryptosporidium hominis
WSCTDCPLYMPKMCNCGTKGGENLYS

SEQ ID NO: 2184092 - protein, 20 aa, Cryptosporidium hominis
WSDRLIRLVVENALGHLSFT

SEQ ID NO: 2184093 - protein, 20 aa, Cryptosporidium hominis
WSFHFKGIYFFRNISKSNPC

SEQ ID NO: 2184094 - protein, 17 aa, Cryptosporidium hominis
WSIKKALFHPDCIQQLL

SEQ ID NO: 2184095 - protein, 25 aa, Cryptosporidium hominis
WSIPSLKEIYSFNCGKSEQIINIRF

SEQ ID NO: 2184096 - protein, 18 aa, Cryptosporidium hominis
WSKCRFSYSKLFPEEDYF

SEQ ID NO: 2184097 - protein, 17 aa, Cryptosporidium hominis
WSKELKLSYTSLSSGNL

SEQ ID NO: 2184098 - protein, 19 aa, Cryptosporidium hominis
WSKKNGVTISSDWQTQFKQ

SEQ ID NO: 2184099 - protein, 19 aa, Cryptosporidium hominis
WSKRPKKVLPCREKEHEEI

SEQ ID NO: 2184100 - protein, 21 aa, Cryptosporidium hominis
WSLCKNELFFGFYACHHDSNP

SEQ ID NO: 2184101 - protein, 27 aa, Cryptosporidium hominis
WSLCNDKFMLIAYKWSNKESLKEIMEF

SEQ ID NO: 2184102 - protein, 26 aa, Cryptosporidium hominis
WSLGCVLAGLIFKRDPFFCGVDNNDQ

SEQ ID NO: 2184103 - protein, 17 aa, Cryptosporidium hominis
WSLVNWLIYELIPTIIS

SEQ ID NO: 2184104 - protein, 20 aa, Cryptosporidium hominis
WSMMCNPHLISRCDNIQVLD

SEQ ID NO: 2184105 - protein, 17 aa, Cryptosporidium hominis
WSNIKEIFTTKSELRMV

SEQ ID NO: 2184106 - protein, 21 aa, Cryptosporidium hominis
WSNSINWRIFLSKSRSPSLEK

SEQ ID NO: 2184107 - protein, 32 aa, Cryptosporidium hominis
WSNSTKINLSLYWDESSSYLFDNTHSKIILFV

SEQ ID NO: 2184108 - protein, 24 aa, Cryptosporidium hominis
WSPELKILCFKGSRYERRSLIYEM

SEQ ID NO: 2184109 - protein, 17 aa, Cryptosporidium hominis
WSPGEAMFLSDDEDEEL

SEQ ID NO: 2184110 - protein, 18 aa, Cryptosporidium hominis
WSPLGSYFVLGGSGGNLT

SEQ ID NO: 2184111 - protein, 24 aa, Cryptosporidium hominis
WSRLNCGALKIASCPYSKRRINNR

SEQ ID NO: 2184112 - protein, 20 aa, Cryptosporidium hominis
WSSDGLRLSKISFLPIKVEE

SEQ ID NO: 2184113 - protein, 23 aa, Cryptosporidium hominis
WSSRQFLGSEVDPKFCNYDMVSR

SEQ ID NO: 2184114 - protein, 17 aa, Cryptosporidium hominis
WSTCATLHPLLHKLCVI

SEQ ID NO: 2184115 - protein, 17 aa, Cryptosporidium hominis
WSVEKYLSEPFIDRVLK

SEQ ID NO: 2184116 - protein, 17 aa, Cryptosporidium hominis
WSVGCILGELVLQQPLF

SEQ ID NO: 2184117 - protein, 24 aa, Cryptosporidium hominis
WSVGCVMAELVLRKPLFDHNSSTQ

SEQ ID NO: 2184118 - protein, 21 aa, Cryptosporidium hominis
WSVPYDLLFDVYISLLDSSLA

SEQ ID NO: 2184119 - protein, 26 aa, Cryptosporidium hominis
WTDEEHNRFVLALKKFGRNWTLVQQE

SEQ ID NO: 2184120 - protein, 18 aa, Cryptosporidium hominis
WTEGSFWTANVKIIPNSK

SEQ ID NO: 2184121 - protein, 43 aa, Cryptosporidium hominis
WTIGDYRLVSDMIWQVQVCKTYMGRIRIGVCCRGSSEAKNTSQ

SEQ ID NO: 2184122 - protein, 17 aa, Cryptosporidium hominis
WTIPHVILDSLLSCDNP

SEQ ID NO: 2184123 - protein, 20 aa, Cryptosporidium hominis
WTISAREAILLLPRNTILCP

SEQ ID NO: 2184124 - protein, 17 aa, Cryptosporidium hominis
WTISEASNLLKPKDVLI

SEQ ID NO: 2184125 - protein, 17 aa, Cryptosporidium hominis
WTLEGGALVLADEGICL

SEQ ID NO: 2184126 - protein, 17 aa, Cryptosporidium hominis
WTMIKFASIARKSHRLP

SEQ ID NO: 2184127 - protein, 26 aa, Cryptosporidium hominis
WTNPDLKCTLWRSSQPKSAFKRCIED

SEQ ID NO: 2184128 - protein, 17 aa, Cryptosporidium hominis
WTPKFSLCNNSNINRMV

SEQ ID NO: 2184129 - protein, 18 aa, Cryptosporidium hominis
WTSSDSKPHVGFPETALH

SEQ ID NO: 2184130 - protein, 18 aa, Cryptosporidium hominis
WTYFLPILLSSSVSDIEI

SEQ ID NO: 2184131 - protein, 18 aa, Cryptosporidium hominis
WVAVWRLRESLESSYFES

SEQ ID NO: 2184132 - protein, 22 aa, Cryptosporidium hominis
WVECKKALPREIMAGNSNQSNS

SEQ ID NO: 2184133 - protein, 25 aa, Cryptosporidium hominis
WVGLLRPNGIFSRFDCCNKYPTIIE

SEQ ID NO: 2184134 - protein, 17 aa, Cryptosporidium hominis
WVKKKRVNYSMKNSSKS

SEQ ID NO: 2184135 - protein, 19 aa, Cryptosporidium hominis
WVNRIRILLRMRNDAENYY

SEQ ID NO: 2184136 - protein, 24 aa, Cryptosporidium hominis
WVNYKCTFWPAQIIEFSKEQFEVF

SEQ ID NO: 2184137 - protein, 19 aa, Cryptosporidium hominis
WVVTIGRYATYIQRSVGLF

SEQ ID NO: 2184138 - protein, 25 aa, Cryptosporidium hominis
WWMNCKPFAEKACKAVKNHELQIEP

SEQ ID NO: 2184139 - protein, 20 aa, Cryptosporidium hominis
WWQCDGCLKEILPNKKKFDC

SEQ ID NO: 2184140 - protein, 18 aa, Cryptosporidium hominis
WWSVGILMYECLYGGVPF

SEQ ID NO: 2184141 - protein, 19 aa, Cryptosporidium hominis
WYDEREGRSRVFLKATQDI

SEQ ID NO: 2184142 - protein, 17 aa, Cryptosporidium hominis
WYHSHPGFGCWFSGTDV

SEQ ID NO: 2184143 - protein, 19 aa, Cryptosporidium hominis
WYILVPYEYGIPIITETQR

SEQ ID NO: 2184144 - protein, 20 aa, Cryptosporidium hominis
WYNILAREMFNPDYALFRRE

SEQ ID NO: 2184145 - protein, 21 aa, Cryptosporidium hominis
WYRAPEIILCVNRYDKAVDIW

SEQ ID NO: 2184146 - protein, 19 aa, Cryptosporidium hominis
WYRRCMKEYEQQFGEIFLT

SEQ ID NO: 2184147 - protein, 17 aa, Cryptosporidium hominis
YAAPEVLRKEGFFKESD

SEQ ID NO: 2184148 - protein, 17 aa, Cryptosporidium hominis
YAARDGRSQTCMLLLDN

SEQ ID NO: 2184149 - protein, 17 aa, Cryptosporidium hominis
YAARRGYTPLFIDLDPR

SEQ ID NO: 2184150 - protein, 19 aa, Cryptosporidium hominis
YADRWNMKPLSHMYLANSL

SEQ ID NO: 2184151 - protein, 17 aa, Cryptosporidium hominis
YAIKNTTLWLSKYFFGR

SEQ ID NO: 2184152 - protein, 23 aa, Cryptosporidium hominis
YAIWKGAQLFSALRDYQENLWIS

SEQ ID NO: 2184153 - protein, 26 aa, Cryptosporidium hominis
YAKKFKCPICFSNVLLNELVSLRYQI

SEQ ID NO: 2184154 - protein, 21 aa, Cryptosporidium hominis
YAPSGALPYSVPGAVPTHGRL

SEQ ID NO: 2184155 - protein, 17 aa, Cryptosporidium hominis
YAQGRYAPSGALPYSVP

SEQ ID NO: 2184156 - protein, 25 aa, Cryptosporidium hominis
YASDKKLICVIPRYSIIPKETLAFL

SEQ ID NO: 2184157 - protein, 20 aa, Cryptosporidium hominis
YASFGKVCIWGGIDEKNDVL

SEQ ID NO: 2184158 - protein, 19 aa, Cryptosporidium hominis
YASIEPIINIYARMAAHHI

SEQ ID NO: 2184159 - protein, 17 aa, Cryptosporidium hominis
YATKVIIGSCAIFSNGY

SEQ ID NO: 2184160 - protein, 17 aa, Cryptosporidium hominis
YAVFVGEVLSRSPISIQ

SEQ ID NO: 2184161 - protein, 17 aa, Cryptosporidium hominis
YAVRGTPAYELRKEPEM

SEQ ID NO: 2184162 - protein, 22 aa, Cryptosporidium hominis
YCASCKKKILNKEVDEDSVEYH

SEQ ID NO: 2184163 - protein, 17 aa, Cryptosporidium hominis
YCCRSEESFQWDDHNCQ

SEQ ID NO: 2184164 - protein, 27 aa, Cryptosporidium hominis
YCDRSFLKRNLKIHLRYFCGPNSMRTA

SEQ ID NO: 2184165 - protein, 19 aa, Cryptosporidium hominis
YCEEMFKLGKAYVDDTCVE

SEQ ID NO: 2184166 - protein, 24 aa, Cryptosporidium hominis
YCENLCFLSKLFLDHKTLYNSVHL

SEQ ID NO: 2184167 - protein, 25 aa, Cryptosporidium hominis
YCETIPIRFVRQIRVFNLATSKENE

SEQ ID NO: 2184168 - protein, 19 aa, Cryptosporidium hominis
YCHDYGASILCQGNRCNRQ

SEQ ID NO: 2184169 - protein, 21 aa, Cryptosporidium hominis
YCICKCDELDILLERWNPFLL

SEQ ID NO: 2184170 - protein, 17 aa, Cryptosporidium hominis
YCIEIIASNGLFILKII

SEQ ID NO: 2184171 - protein, 18 aa, Cryptosporidium hominis
YCLRLDRMDLNHEFPRVL

SEQ ID NO: 2184172 - protein, 24 aa, Cryptosporidium hominis
YCNISSYTSSPCQSFSTYDGPFLE

SEQ ID NO: 2184173 - protein, 18 aa, Cryptosporidium hominis
YCNLFKWVGIDQIIEKTE

SEQ ID NO: 2184174 - protein, 23 aa, Cryptosporidium hominis
YCPDKIKIFIFRSKSEFFMGKYS

SEQ ID NO: 2184175 - protein, 21 aa, Cryptosporidium hominis
YCPNAFVICITNPLDAMVYYF

SEQ ID NO: 2184176 - protein, 25 aa, Cryptosporidium hominis
  misc_feature (25)..(25): Xaa can be any naturally occurring amino acid
YCSTYPKGYFAFWVTYDPEIHVYIX

SEQ ID NO: 2184177 - protein, 23 aa, Cryptosporidium hominis
YDDKCDIWSIGVMAHILLCGVPP

SEQ ID NO: 2184178 - protein, 18 aa, Cryptosporidium hominis
YDDPEFMKFYSLKLPMKL

SEQ ID NO: 2184179 - protein, 23 aa, Cryptosporidium hominis
YDEIKRYREILSITKSQFNKDET

SEQ ID NO: 2184180 - protein, 24 aa, Cryptosporidium hominis
YDEKCDVWSAGVILYILLSGTPPF

SEQ ID NO: 2184181 - protein, 25 aa, Cryptosporidium hominis
YDERISGLGIGVHWEEISTKGIRVV

SEQ ID NO: 2184182 - protein, 18 aa, Cryptosporidium hominis
YDEYGIGATYDMPVIDSN

SEQ ID NO: 2184183 - protein, 19 aa, Cryptosporidium hominis
YDFDWKKNYIDYAEKLTYQ

SEQ ID NO: 2184184 - protein, 18 aa, Cryptosporidium hominis
YDFGRFAWNGYFDRNKNL

SEQ ID NO: 2184185 - protein, 17 aa, Cryptosporidium hominis
YDFKEIKTPNGIEVKGI

SEQ ID NO: 2184186 - protein, 18 aa, Cryptosporidium hominis
YDFLKDFGGDSLFPNIND

SEQ ID NO: 2184187 - protein, 20 aa, Cryptosporidium hominis
YDGCTVVGSDCLCWRCYFNQ

SEQ ID NO: 2184188 - protein, 17 aa, Cryptosporidium hominis
YDGIEGVLGRGAYSSVF

SEQ ID NO: 2184189 - protein, 18 aa, Cryptosporidium hominis
YDGNCWKSDTYLLDIRKF

SEQ ID NO: 2184190 - protein, 28 aa, Cryptosporidium hominis
YDGQHLDAWFTRSFYKNMLGQPITPSDA

SEQ ID NO: 2184191 - protein, 17 aa, Cryptosporidium hominis
YDIDYLLAFINKNSKEF

SEQ ID NO: 2184192 - protein, 19 aa, Cryptosporidium hominis
YDIFVSFPPIFEASSHLHI

SEQ ID NO: 2184193 - protein, 23 aa, Cryptosporidium hominis
YDIIPRRFLRSFYLSNLSHFTQG

SEQ ID NO: 2184194 - protein, 22 aa, Cryptosporidium hominis
YDIKKSLNYLALQLMLGKEHQI

SEQ ID NO: 2184195 - protein, 26 aa, Cryptosporidium hominis
YDILTLRITSKWELRRICRSIGAVAM

SEQ ID NO: 2184196 - protein, 22 aa, Cryptosporidium hominis
YDKELYRKTSLYDIPNNQLLPP

SEQ ID NO: 2184197 - protein, 18 aa, Cryptosporidium hominis
YDLIKKGLIIEPLRELYK

SEQ ID NO: 2184198 - protein, 30 aa, Cryptosporidium hominis
YDLKPGNIILHRGCCKIADFGLSKQSDQES

SEQ ID NO: 2184199 - protein, 20 aa, Cryptosporidium hominis
YDLNPLNGFIALGTNSTSDG

SEQ ID NO: 2184200 - protein, 17 aa, Cryptosporidium hominis
YDNSGGCIKLIYDSLYT

SEQ ID NO: 2184201 - protein, 18 aa, Cryptosporidium hominis
YDPEFSFCDRKVMGGRER

SEQ ID NO: 2184202 - protein, 22 aa, Cryptosporidium hominis
YDPGNLRPSFSPSASDNLNSLK

SEQ ID NO: 2184203 - protein, 25 aa, Cryptosporidium hominis
YDPIKRILYSISWDQILNFNRFDEL

SEQ ID NO: 2184204 - protein, 29 aa, Cryptosporidium hominis
YDPNVKKWGFKCCKNLKRSSVCSTYNKSK

SEQ ID NO: 2184205 - protein, 29 aa, Cryptosporidium hominis
YDSGFKQKLLDILSIRPNQYGERITSICI

SEQ ID NO: 2184206 - protein, 17 aa, Cryptosporidium hominis
YDSSPSLTHYVDETHGG

SEQ ID NO: 2184207 - protein, 22 aa, Cryptosporidium hominis
YDSWNKITLEWGDIFQKDNNKA

SEQ ID NO: 2184208 - protein, 17 aa, Cryptosporidium hominis
YDTFKLEKMKGNHKTLS

SEQ ID NO: 2184209 - protein, 26 aa, Cryptosporidium hominis
YDVQYGIKFWAHIGGVPQWEMLMLEY

SEQ ID NO: 2184210 - protein, 24 aa, Cryptosporidium hominis
YDWYQRWENMREIIKEYLKFDDKI

SEQ ID NO: 2184211 - protein, 19 aa, Cryptosporidium hominis
YEAFEAFNIANDERALQSL

SEQ ID NO: 2184212 - protein, 26 aa, Cryptosporidium hominis
YEAKRLAEEWRLRYLYSNPNGPNGQQ

SEQ ID NO: 2184213 - protein, 25 aa, Cryptosporidium hominis
YECETRKYYFFFIPDLSEYTIEITL

SEQ ID NO: 2184214 - protein, 17 aa, Cryptosporidium hominis
YECFTGDIMFKGRTNND

SEQ ID NO: 2184215 - protein, 17 aa, Cryptosporidium hominis
YEDIPFPDGLRGSYYDN

SEQ ID NO: 2184216 - protein, 17 aa, Cryptosporidium hominis
YEECLNWSRKIKTAIKV

SEQ ID NO: 2184217 - protein, 19 aa, Cryptosporidium hominis
YEEKVSFTFNNKVLEIVQS

SEQ ID NO: 2184218 - protein, 19 aa, Cryptosporidium hominis
YEEMDHFSLFCPLLHRSAF

SEQ ID NO: 2184219 - protein, 17 aa, Cryptosporidium hominis
YEFFSIARCYATFKEFG

SEQ ID NO: 2184220 - protein, 17 aa, Cryptosporidium hominis
YEFKLDFLKPINKEESR

SEQ ID NO: 2184221 - protein, 17 aa, Cryptosporidium hominis
YEFPQKFAPDVRGNGQS

SEQ ID NO: 2184222 - protein, 26 aa, Cryptosporidium hominis
YEGIASGITHGWVAVWRLRESLESSY

SEQ ID NO: 2184223 - protein, 25 aa, Cryptosporidium hominis
YEGIDYSVAISRARFEELCADYFRA

SEQ ID NO: 2184224 - protein, 28 aa, Cryptosporidium hominis
YEGLEFKVGFGGIWKKSLTELSGGQRSL

SEQ ID NO: 2184225 - protein, 27 aa, Cryptosporidium hominis
YEHKYPGAYHKWKFNAFLEIQKKLDSE

SEQ ID NO: 2184226 - protein, 17 aa, Cryptosporidium hominis
YEIELERARSQEKKLQS

SEQ ID NO: 2184227 - protein, 18 aa, Cryptosporidium hominis
YEIGFPKDCISGLYEIIK

SEQ ID NO: 2184228 - protein, 23 aa, Cryptosporidium hominis
YEIIPFELPIDFITSIYNSGTIS

SEQ ID NO: 2184229 - protein, 19 aa, Cryptosporidium hominis
YEIQLSQPLSREEREQLET

SEQ ID NO: 2184230 - protein, 23 aa, Cryptosporidium hominis
YEIYKRCILNSAFLHSTIPSLPV

SEQ ID NO: 2184231 - protein, 29 aa, Cryptosporidium hominis
YEKIIFIKPIFYSRLTKTLIIYQYPSQLL

SEQ ID NO: 2184232 - protein, 21 aa, Cryptosporidium hominis
YEKSWEISRHRFARAQRSLGN

SEQ ID NO: 2184233 - protein, 27 aa, Cryptosporidium hominis
YELGKEEKAIWCFKLSIHFNPMNVNAY

SEQ ID NO: 2184234 - protein, 18 aa, Cryptosporidium hominis
YELRRINDDLAFIYQQRI

SEQ ID NO: 2184235 - protein, 28 aa, Cryptosporidium hominis
YELSCAEAISACLFFFGFPKQAEKLLGI

SEQ ID NO: 2184236 - protein, 17 aa, Cryptosporidium hominis
YELYRRILHHVRIRLIA

SEQ ID NO: 2184237 - protein, 30 aa, Cryptosporidium hominis
YERIGNCFNEIRFRRKLNFLKDSVRDNRNI

SEQ ID NO: 2184238 - protein, 17 aa, Cryptosporidium hominis
YESGKFINLPSLYNSIK

SEQ ID NO: 2184239 - protein, 18 aa, Cryptosporidium hominis
YESGYSFERPLTKAEDTE

SEQ ID NO: 2184240 - protein, 24 aa, Cryptosporidium hominis
YESSELYGPFLAVHLFDPLFYEGF

SEQ ID NO: 2184241 - protein, 21 aa, Cryptosporidium hominis
YESTFRHPIGPEWNTTAIHNK

SEQ ID NO: 2184242 - protein, 26 aa, Cryptosporidium hominis
YETCPSPRSGVQMVLCPNSDRIFIYG

SEQ ID NO: 2184243 - protein, 17 aa, Cryptosporidium hominis
YETGSLYDPTKVDVFCL

SEQ ID NO: 2184244 - protein, 17 aa, Cryptosporidium hominis
YETIRSIKLLEMNSYTE

SEQ ID NO: 2184245 - protein, 18 aa, Cryptosporidium hominis
YETYKFTGILDEKTLLAI

SEQ ID NO: 2184246 - protein, 27 aa, Cryptosporidium hominis
YEVVSRFVYGIGIPKQKIINFSKTQRR

SEQ ID NO: 2184247 - protein, 18 aa, Cryptosporidium hominis
YEYFYGGGIVCVRPEEIT

SEQ ID NO: 2184248 - protein, 20 aa, Cryptosporidium hominis
YEYGGISLLTFIEEKCSHYN

SEQ ID NO: 2184249 - protein, 21 aa, Cryptosporidium hominis
YEYKDGSVLNGVYQQPFQTQN

SEQ ID NO: 2184250 - protein, 17 aa, Cryptosporidium hominis
YEYVCLLCEYKTVKLIE

SEQ ID NO: 2184251 - protein, 25 aa, Cryptosporidium hominis
YFADLVEAYSLCLIPNKSYLRGMKN

SEQ ID NO: 2184252 - protein, 18 aa, Cryptosporidium hominis
YFCQICSATKTPQWRYIS

SEQ ID NO: 2184253 - protein, 25 aa, Cryptosporidium hominis
YFDGVYKSIFIRIAEYKVKQRSALF

SEQ ID NO: 2184254 - protein, 23 aa, Cryptosporidium hominis
YFDKIRKLWRANWKENGRVKTKG

SEQ ID NO: 2184255 - protein, 20 aa, Cryptosporidium hominis
YFDWLVFRINNPMTNGLMNN

SEQ ID NO: 2184256 - protein, 18 aa, Cryptosporidium hominis
YFEGLDHTFYRSSPVIPL

SEQ ID NO: 2184257 - protein, 24 aa, Cryptosporidium hominis
YFEITCKFEIFPTLVELVIHIDVN

SEQ ID NO: 2184258 - protein, 18 aa, Cryptosporidium hominis
YFEMYYDFEVSKKLKQNE

SEQ ID NO: 2184259 - protein, 25 aa, Cryptosporidium hominis
YFENFLKQWYLSFTNVLLRMLDDTL

SEQ ID NO: 2184260 - protein, 17 aa, Cryptosporidium hominis
YFESLEFTRAFGVLNDE

SEQ ID NO: 2184261 - protein, 17 aa, Cryptosporidium hominis
YFGHIVIDLLFFQAKKF

SEQ ID NO: 2184262 - protein, 21 aa, Cryptosporidium hominis
YFHCKVCCMCYPLSIKETHKC

SEQ ID NO: 2184263 - protein, 21 aa, Cryptosporidium hominis
YFISSTLVSFGLREYAQHISV

SEQ ID NO: 2184264 - protein, 26 aa, Cryptosporidium hominis
YFKHDFRFKVYHKFLDLLPECRNNDI

SEQ ID NO: 2184265 - protein, 32 aa, Cryptosporidium hominis
YFKLCKKAPWKSRYLFEIFRNRQLIIALTTMT

SEQ ID NO: 2184266 - protein, 18 aa, Cryptosporidium hominis
YFLEALHKSCLPKNLQTD

SEQ ID NO: 2184267 - protein, 19 aa, Cryptosporidium hominis
YFLGFGENSNFLGYHMIDD

SEQ ID NO: 2184268 - protein, 24 aa, Cryptosporidium hominis
YFLKDYGVIMSMALSHYAMGFLLK

SEQ ID NO: 2184269 - protein, 17 aa, Cryptosporidium hominis
YFLVNSLVHKFGDKEDK

SEQ ID NO: 2184270 - protein, 24 aa, Cryptosporidium hominis
YFMRHLTEKILINFKGKNSISESI

SEQ ID NO: 2184271 - protein, 18 aa, Cryptosporidium hominis
YFNGTFIDTCRINVQYAF

SEQ ID NO: 2184272 - protein, 26 aa, Cryptosporidium hominis
YFNLHCPMCGRIIPHKFFSNSFKQST

SEQ ID NO: 2184273 - protein, 18 aa, Cryptosporidium hominis
YFNNQGFCEHNFAEICDN

SEQ ID NO: 2184274 - protein, 19 aa, Cryptosporidium hominis
YFNRGSCDYNRYENMYRKV

SEQ ID NO: 2184275 - protein, 23 aa, Cryptosporidium hominis
YFPQRTPRVVSDWFRTLNQKIKE

SEQ ID NO: 2184276 - protein, 19 aa, Cryptosporidium hominis
YFRAYRGRKLFSFNKDSVE

SEQ ID NO: 2184277 - protein, 18 aa, Cryptosporidium hominis
YFRHKCGHTYCNENISNI

SEQ ID NO: 2184278 - protein, 17 aa, Cryptosporidium hominis
YFSAKRYGVEKSYEMAL

SEQ ID NO: 2184279 - protein, 23 aa, Cryptosporidium hominis
YFSCFCRRCHKIINTKLIPNNSR

SEQ ID NO: 2184280 - protein, 19 aa, Cryptosporidium hominis
YFSEWSFTEGDVFRRDQIF

SEQ ID NO: 2184281 - protein, 19 aa, Cryptosporidium hominis
YFSNCGIFSTYWQKHLNFF

SEQ ID NO: 2184282 - protein, 22 aa, Cryptosporidium hominis
YFTDEDFEIIFGYSKFIHNKII

SEQ ID NO: 2184283 - protein, 27 aa, Cryptosporidium hominis
YFTEELCGISLEWSELKSLMKSKDSVN

SEQ ID NO: 2184284 - protein, 25 aa, Cryptosporidium hominis
YFTKTCSSLDYVCLSPLKNLFSEYS

SEQ ID NO: 2184285 - protein, 22 aa, Cryptosporidium hominis
YFTTCKSVEGTFHYGLAEEIYT

SEQ ID NO: 2184286 - protein, 19 aa, Cryptosporidium hominis
YFVDCCIENGLTISRDSKV

SEQ ID NO: 2184287 - protein, 25 aa, Cryptosporidium hominis
YGAKLMIPGVLRFDNGIDVGTEVVM

SEQ ID NO: 2184288 - protein, 22 aa, Cryptosporidium hominis
YGCKKGKLIRVYVIKDKDDLTM

SEQ ID NO: 2184289 - protein, 25 aa, Cryptosporidium hominis
YGDSEIQLKLCIMELYDFLYNKNNS

SEQ ID NO: 2184290 - protein, 30 aa, Cryptosporidium hominis
YGEIKPTFFIGEKKLHITLGLVRAETPQEL

SEQ ID NO: 2184291 - protein, 19 aa, Cryptosporidium hominis
YGESACFALARMIELTYGR

SEQ ID NO: 2184292 - protein, 25 aa, Cryptosporidium hominis
YGEYKRLLEEVSLWEENGYKNGIKF

SEQ ID NO: 2184293 - protein, 25 aa, Cryptosporidium hominis
YGFDVARSEAIAFLKAKQSELQSIG

SEQ ID NO: 2184294 - protein, 19 aa, Cryptosporidium hominis
YGGNCLKLNVVSNAEESPI

SEQ ID NO: 2184295 - protein, 19 aa, Cryptosporidium hominis
YGHLMKLGHCKHVCLMSVI

SEQ ID NO: 2184296 - protein, 17 aa, Cryptosporidium hominis
YGIKQVRIFSNTMRSAV

SEQ ID NO: 2184297 - protein, 22 aa, Cryptosporidium hominis
YGIPKLFPIYIFTSKYTDHKHS

SEQ ID NO: 2184298 - protein, 24 aa, Cryptosporidium hominis
YGIPNIFHGPNWIQMFNTNLNSRN

SEQ ID NO: 2184299 - protein, 24 aa, Cryptosporidium hominis
YGITYRYIAEFSIYNNKLSRMMPL

SEQ ID NO: 2184300 - protein, 17 aa, Cryptosporidium hominis
YGKFDWTDHRCYEGQYI

SEQ ID NO: 2184301 - protein, 21 aa, Cryptosporidium hominis
YGKILNLRIVKDFQGESRGYA

SEQ ID NO: 2184302 - protein, 18 aa, Cryptosporidium hominis
YGKKELLNSSEIISLPKN

SEQ ID NO: 2184303 - protein, 18 aa, Cryptosporidium hominis
YGLLVPFHVRLLKNVVCT

SEQ ID NO: 2184304 - protein, 19 aa, Cryptosporidium hominis
YGLNKVVWCRIHIQESQQD

SEQ ID NO: 2184305 - protein, 19 aa, Cryptosporidium hominis
YGLSCVPDISIIGLNQNNR

SEQ ID NO: 2184306 - protein, 33 aa, Cryptosporidium hominis
YGNHRNCLILVKLQLCFSLLYFVNGNFQECYTN

SEQ ID NO: 2184307 - protein, 24 aa, Cryptosporidium hominis
YGPPGCGKTLLAKAIAKESGANFI

SEQ ID NO: 2184308 - protein, 26 aa, Cryptosporidium hominis
YGQPNYRLNYLKSMKEWEVTTIPIKK

SEQ ID NO: 2184309 - protein, 24 aa, Cryptosporidium hominis
YGQSWDFDQCLDIFTANETILIYG

SEQ ID NO: 2184310 - protein, 20 aa, Cryptosporidium hominis
YGRRIKIGIKKKVGMSDEFE

SEQ ID NO: 2184311 - protein, 20 aa, Cryptosporidium hominis
YGSIKLRIIYKENKYNRTGN

SEQ ID NO: 2184312 - protein, 17 aa, Cryptosporidium hominis
YGSLCITSIVSSYKSKV

SEQ ID NO: 2184313 - protein, 18 aa, Cryptosporidium hominis
YGSVCTAPSLSPTEYKIE

SEQ ID NO: 2184314 - protein, 29 aa, Cryptosporidium hominis
YGTCDLPQSFSRLAAVKGSLQRLGTTIST

SEQ ID NO: 2184315 - protein, 23 aa, Cryptosporidium hominis
YGTCQFPTLGFVVSRYKKIINFR

SEQ ID NO: 2184316 - protein, 22 aa, Cryptosporidium hominis
YGTKEIIFFLGSMRSVDNSFLF

SEQ ID NO: 2184317 - protein, 24 aa, Cryptosporidium hominis
YGTNAPIVRAYKATIQTINSINEF

SEQ ID NO: 2184318 - protein, 18 aa, Cryptosporidium hominis
YGVPVGLANFSAAYCTGL

SEQ ID NO: 2184319 - protein, 17 aa, Cryptosporidium hominis
YHAYKLGTKSMENFVAP

SEQ ID NO: 2184320 - protein, 25 aa, Cryptosporidium hominis
YHEFLETVEIWSAIAGEALIFTGNQ

SEQ ID NO: 2184321 - protein, 18 aa, Cryptosporidium hominis
YHEYYFKQLVNLIQNDDH

SEQ ID NO: 2184322 - protein, 25 aa, Cryptosporidium hominis
YHFQKGEWRAVYGPSKNRQQKSFSV

SEQ ID NO: 2184323 - protein, 19 aa, Cryptosporidium hominis
YHGVNLKVCDVVDHQKISN

SEQ ID NO: 2184324 - protein, 24 aa, Cryptosporidium hominis
YHKRLFRLFLLASYLKRGDKLVNL

SEQ ID NO: 2184325 - protein, 21 aa, Cryptosporidium hominis
YHKSKPIDILGRMFPSSQEDL

SEQ ID NO: 2184326 - protein, 18 aa, Cryptosporidium hominis
YHLIGKCIRSIGKLGKSK

SEQ ID NO: 2184327 - protein, 20 aa, Cryptosporidium hominis
YHLLPFKSLFRLGINENILQ

SEQ ID NO: 2184328 - protein, 20 aa, Cryptosporidium hominis
YHLPSSSYLYLLATAATEIF

SEQ ID NO: 2184329 - protein, 23 aa, Cryptosporidium hominis
YHNGQFCRFLEWIPQSEKPEKGS

SEQ ID NO: 2184330 - protein, 18 aa, Cryptosporidium hominis
YHQPGQAMGLSFSVPKGV

SEQ ID NO: 2184331 - protein, 17 aa, Cryptosporidium hominis
YHTAWDIGKRGCVAVKL

SEQ ID NO: 2184332 - protein, 17 aa, Cryptosporidium hominis
YIADLKMIGEKINKEKE

SEQ ID NO: 2184333 - protein, 18 aa, Cryptosporidium hominis
YIAGKSWLAEEVNNRLKE

SEQ ID NO: 2184334 - protein, 26 aa, Cryptosporidium hominis
YICKPWIKKLLHKWGTGTMEKNATDE

SEQ ID NO: 2184335 - protein, 23 aa, Cryptosporidium hominis
YICPESFADFGLLIFVLSAIHPK

SEQ ID NO: 2184336 - protein, 23 aa, Cryptosporidium hominis
YIDEAKRTFSYRVYYYDNLKLGQ

SEQ ID NO: 2184337 - protein, 18 aa, Cryptosporidium hominis
YIEHCLYLLQLYAKKKSI

SEQ ID NO: 2184338 - protein, 25 aa, Cryptosporidium hominis
YIETNELFKVWSPYIVSPYVLSLYL

SEQ ID NO: 2184339 - protein, 29 aa, Cryptosporidium hominis
YIFGSNTFRIWPTRILLYPVSKSQVPNDH

SEQ ID NO: 2184340 - protein, 17 aa, Cryptosporidium hominis
YIFLIMGQLKVPRNRGE

SEQ ID NO: 2184341 - protein, 17 aa, Cryptosporidium hominis
YIGKFKFIYVVKLKNQR

SEQ ID NO: 2184342 - protein, 17 aa, Cryptosporidium hominis
YIHETSRVFSVDSACRY

SEQ ID NO: 2184343 - protein, 17 aa, Cryptosporidium hominis
YIICKEVNSQSSEEVAP

SEQ ID NO: 2184344 - protein, 20 aa, Cryptosporidium hominis
YIIHCSWGNISKSTIRFEEY

SEQ ID NO: 2184345 - protein, 18 aa, Cryptosporidium hominis
YIKDDFWINYNFLNDSSD

SEQ ID NO: 2184346 - protein, 17 aa, Cryptosporidium hominis
YILDEIDSALDLGHTQN

SEQ ID NO: 2184347 - protein, 19 aa, Cryptosporidium hominis
YILELCLGSTVAQFIACSA

SEQ ID NO: 2184348 - protein, 17 aa, Cryptosporidium hominis
YILIKGILSEYSYFLNI

SEQ ID NO: 2184349 - protein, 23 aa, Cryptosporidium hominis
YILKKRWTEDTVFRNQNRVSQHK

SEQ ID NO: 2184350 - protein, 22 aa, Cryptosporidium hominis
YILLMRRLQSIYLLEPAGSRGV

SEQ ID NO: 2184351 - protein, 24 aa, Cryptosporidium hominis
YILSREIKTSFQISNLSEIKWAEI

SEQ ID NO: 2184352 - protein, 30 aa, Cryptosporidium hominis
YINDQILKWNWYYRMEQLYYDWQGYFFPNI

SEQ ID NO: 2184353 - protein, 18 aa, Cryptosporidium hominis
YINQRGIRGKFMSSSNLQ

SEQ ID NO: 2184354 - protein, 24 aa, Cryptosporidium hominis
YINRSEIKLGSYISSNYNCVILSG

SEQ ID NO: 2184355 - protein, 19 aa, Cryptosporidium hominis
YINSIRLTEIFSIVIKNIS

SEQ ID NO: 2184356 - protein, 24 aa, Cryptosporidium hominis
YINTKICMNYLWNGGINSSRFIKK

SEQ ID NO: 2184357 - protein, 19 aa, Cryptosporidium hominis
YIPASSMGLDMLLMPPTVE

SEQ ID NO: 2184358 - protein, 24 aa, Cryptosporidium hominis
YIPIFKKLKVSTVIRLNKKQYESE

SEQ ID NO: 2184359 - protein, 27 aa, Cryptosporidium hominis
YIPPKGELRGGAWVVVDSNINPEFIEM

SEQ ID NO: 2184360 - protein, 28 aa, Cryptosporidium hominis
YIPYARSLDTHWLKYLLDSGLTMISDDS

SEQ ID NO: 2184361 - protein, 23 aa, Cryptosporidium hominis
YIQEKRKLGVWADNIEVQALSDL

SEQ ID NO: 2184362 - protein, 18 aa, Cryptosporidium hominis
YIQPRCKYNKIFKFTFRS

SEQ ID NO: 2184363 - protein, 25 aa, Cryptosporidium hominis
YIQRINSWWNDIWLIRMRYPRCEGS

SEQ ID NO: 2184364 - protein, 24 aa, Cryptosporidium hominis
YIQSRFRISPTIKTLGCLNKSNKE

SEQ ID NO: 2184365 - protein, 26 aa, Cryptosporidium hominis
YIRHSSQIIPGWYLNKFPSAKNSLSF

SEQ ID NO: 2184366 - protein, 18 aa, Cryptosporidium hominis
YIRKLVVTRYELLSFWYT

SEQ ID NO: 2184367 - protein, 28 aa, Cryptosporidium hominis
YIRNKLPLCFLVLFKLETEYEILFKKSD

SEQ ID NO: 2184368 - protein, 25 aa, Cryptosporidium hominis
YIRTMCVHMGLLLGVGAHMQELRRV

SEQ ID NO: 2184369 - protein, 24 aa, Cryptosporidium hominis
YISCYMCTFNPLKADEVVIFVQTE

SEQ ID NO: 2184370 - protein, 23 aa, Cryptosporidium hominis
YISLITGQLLRWDPDEVTTNLIV

SEQ ID NO: 2184371 - protein, 26 aa, Cryptosporidium hominis
YISTIYCKLNPLFEKALDHYKNTILN

SEQ ID NO: 2184372 - protein, 24 aa, Cryptosporidium hominis
YISYVFKKEFNGWFKFDDDIVTLV

SEQ ID NO: 2184373 - protein, 24 aa, Cryptosporidium hominis
YITPECLAEVCSKLGVSLTDQDAR

SEQ ID NO: 2184374 - protein, 26 aa, Cryptosporidium hominis
YIWHAPCISKGWQLILKRKHIIHNSK

SEQ ID NO: 2184375 - protein, 17 aa, Cryptosporidium hominis
YIYNFKIEKEMKILQLL

SEQ ID NO: 2184376 - protein, 19 aa, Cryptosporidium hominis
YIYSIKGGNLLINNEKDQD

SEQ ID NO: 2184377 - protein, 23 aa, Cryptosporidium hominis
YIYTFRIELKITYQKYSIGDIDS

SEQ ID NO: 2184378 - protein, 25 aa, Cryptosporidium hominis
YKALFPYPKKRFYRVDVLEASIEGY

SEQ ID NO: 2184379 - protein, 18 aa, Cryptosporidium hominis
YKANELIPTLKIIEDRYA

SEQ ID NO: 2184380 - protein, 26 aa, Cryptosporidium hominis
YKDDIKWGHGIYRWSNGEVFEGEYVR

SEQ ID NO: 2184381 - protein, 22 aa, Cryptosporidium hominis
YKDIKKASVVHFIKENVRKAKL

SEQ ID NO: 2184382 - protein, 18 aa, Cryptosporidium hominis
YKDVIPFTDIQNRMMEWN

SEQ ID NO: 2184383 - protein, 19 aa, Cryptosporidium hominis
YKEICTLYPFTDAKQIVMA

SEQ ID NO: 2184384 - protein, 24 aa, Cryptosporidium hominis
YKESCYKKLCEIFDEFAQPYFEKK

SEQ ID NO: 2184385 - protein, 21 aa, Cryptosporidium hominis
YKESRQCPINKSPSWNSFADR

SEQ ID NO: 2184386 - protein, 24 aa, Cryptosporidium hominis
YKEVKEKVFIVGRLIRYVSKALNI

SEQ ID NO: 2184387 - protein, 23 aa, Cryptosporidium hominis
YKEYQLPFIFPFKSLSIGEIAAS

SEQ ID NO: 2184388 - protein, 22 aa, Cryptosporidium hominis
YKEYVELEMKRIIGESDQNALN

SEQ ID NO: 2184389 - protein, 25 aa, Cryptosporidium hominis
YKFIKSCSIGKFSRKQYLRMLLRKK

SEQ ID NO: 2184390 - protein, 17 aa, Cryptosporidium hominis
YKFPVTKSLLPTIYPYL

SEQ ID NO: 2184391 - protein, 17 aa, Cryptosporidium hominis
YKFTNIKSFSNIMKDFG

SEQ ID NO: 2184392 - protein, 17 aa, Cryptosporidium hominis
YKFVISPNIKVPSISEI

SEQ ID NO: 2184393 - protein, 22 aa, Cryptosporidium hominis
YKGDIVESFSFHVQKINISKIS

SEQ ID NO: 2184394 - protein, 19 aa, Cryptosporidium hominis
YKGLGAFPVTDGFRELLVQ

SEQ ID NO: 2184395 - protein, 33 aa, Cryptosporidium hominis
YKGRHISTLFPGFNCPEAIDLIEKMLSFNPKKR

SEQ ID NO: 2184396 - protein, 18 aa, Cryptosporidium hominis
YKIEGPIMTAFQHIQAVA

SEQ ID NO: 2184397 - protein, 26 aa, Cryptosporidium hominis
YKIFEYKMNIEIPKFNDSMDLGFLSK

SEQ ID NO: 2184398 - protein, 17 aa, Cryptosporidium hominis
YKIKWMGYSHLHNTWES

SEQ ID NO: 2184399 - protein, 19 aa, Cryptosporidium hominis
YKIVSKFMSLISHRRSGKG

SEQ ID NO: 2184400 - protein, 17 aa, Cryptosporidium hominis
YKIWKENTSLLYENIMT

SEQ ID NO: 2184401 - protein, 17 aa, Cryptosporidium hominis
YKKKCKICGFELTWEEI

SEQ ID NO: 2184402 - protein, 22 aa, Cryptosporidium hominis
YKKNIIRRQSLIYSKIDSETEK

SEQ ID NO: 2184403 - protein, 34 aa, Cryptosporidium hominis
YKKNRRWKEKWFRRGRKLFVRKFVQQLCENNSRV

SEQ ID NO: 2184404 - protein, 18 aa, Cryptosporidium hominis
YKKREIVQDITLYDLDLA

SEQ ID NO: 2184405 - protein, 25 aa, Cryptosporidium hominis
YKKYPRYFFNDPWPEIDVSKPIPYV

SEQ ID NO: 2184406 - protein, 23 aa, Cryptosporidium hominis
YKLALKECVRYISGSLSINETIS

SEQ ID NO: 2184407 - protein, 25 aa, Cryptosporidium hominis
YKLIPIDHGLCLPDVLDVAQFDWVW

SEQ ID NO: 2184408 - protein, 25 aa, Cryptosporidium hominis
YKLKENVKLLFSFPFKTNSAKVLST

SEQ ID NO: 2184409 - protein, 17 aa, Cryptosporidium hominis
YKLLAFTYNEIMVVILF

SEQ ID NO: 2184410 - protein, 21 aa, Cryptosporidium hominis
YKLLVICDSYIGCDQEFMFSV

SEQ ID NO: 2184411 - protein, 22 aa, Cryptosporidium hominis
YKLNGLGIEFKCEICGNCSYWG

SEQ ID NO: 2184412 - protein, 19 aa, Cryptosporidium hominis
YKMEFSVCDEECNFNPNIS

SEQ ID NO: 2184413 - protein, 22 aa, Cryptosporidium hominis
YKMSIQEWKDFLASIEPKDKRY

SEQ ID NO: 2184414 - protein, 22 aa, Cryptosporidium hominis
YKNDLYRLLARYLVERQDLDLW

SEQ ID NO: 2184415 - protein, 18 aa, Cryptosporidium hominis
YKNFNFRIMILPKVKLTS

SEQ ID NO: 2184416 - protein, 17 aa, Cryptosporidium hominis
YKNGFTVAAVSPPGYGK

SEQ ID NO: 2184417 - protein, 27 aa, Cryptosporidium hominis
YKNKILNWRSGVEWDLDEVLQIRTIFA

SEQ ID NO: 2184418 - protein, 23 aa, Cryptosporidium hominis
YKNRPRLNPNFPTISLEIATEGD

SEQ ID NO: 2184419 - protein, 20 aa, Cryptosporidium hominis
YKNTSIIKDCLKKENISQRN

SEQ ID NO: 2184420 - protein, 29 aa, Cryptosporidium hominis
YKPPFFPKIRSSLQLSTFLIVFLKSLEHK

SEQ ID NO: 2184421 - protein, 41 aa, Cryptosporidium hominis
YKPRSTRARFQVCQHIACYDCVRLALMIQQRYNVKAHCPFC

SEQ ID NO: 2184422 - protein, 19 aa, Cryptosporidium hominis
YKPSRSIIGDQLIQPQSTH

SEQ ID NO: 2184423 - protein, 17 aa, Cryptosporidium hominis
YKQFPMSSSKNYGFSSF

SEQ ID NO: 2184424 - protein, 17 aa, Cryptosporidium hominis
YKQGFAQLRRFYEVRGM

SEQ ID NO: 2184425 - protein, 19 aa, Cryptosporidium hominis
YKQGNGFSVKGKILGNENI

SEQ ID NO: 2184426 - protein, 23 aa, Cryptosporidium hominis
YKRFSRELIEKISYGVDKFELKS

SEQ ID NO: 2184427 - protein, 24 aa, Cryptosporidium hominis
YKRLEHLRESGLLKRSLGGIQNEA

SEQ ID NO: 2184428 - protein, 26 aa, Cryptosporidium hominis
YKRNKKRITGIIKRTSIEIEKPLILN

SEQ ID NO: 2184429 - protein, 27 aa, Cryptosporidium hominis
YKSFNKKSIDGWKVLVDVERGRTVENW

SEQ ID NO: 2184430 - protein, 18 aa, Cryptosporidium hominis
YKSPMVPRKGSNHSYHIS

SEQ ID NO: 2184431 - protein, 19 aa, Cryptosporidium hominis
YKSPTLLRNIIKQGYSSYL

SEQ ID NO: 2184432 - protein, 20 aa, Cryptosporidium hominis
YKSQESFLRNKKEMDSLITM

SEQ ID NO: 2184433 - protein, 19 aa, Cryptosporidium hominis
YKSSLREKDTLIVKLNGSI

SEQ ID NO: 2184434 - protein, 17 aa, Cryptosporidium hominis
YKSSVILREPRVLVDGW

SEQ ID NO: 2184435 - protein, 19 aa, Cryptosporidium hominis
YKTGASLVLSKFINEDHIT

SEQ ID NO: 2184436 - protein, 20 aa, Cryptosporidium hominis
YKTKICEQFQRGDCNTYYCH

SEQ ID NO: 2184437 - protein, 17 aa, Cryptosporidium hominis
YKVLKQVHPETGISKKS

SEQ ID NO: 2184438 - protein, 28 aa, Cryptosporidium hominis
YKVPISVEVCIRSDINLIQNEGDSNESQ

SEQ ID NO: 2184439 - protein, 17 aa, Cryptosporidium hominis
YKVPNFLIDHVNLDINI

SEQ ID NO: 2184440 - protein, 22 aa, Cryptosporidium hominis
YKVRILLCLVDIPPSGAIDAAI

SEQ ID NO: 2184441 - protein, 21 aa, Cryptosporidium hominis
YKVSTSMLFDIQVKRIHEYKR

SEQ ID NO: 2184442 - protein, 17 aa, Cryptosporidium hominis
YKWDKEHPILLTSNYNL

SEQ ID NO: 2184443 - protein, 18 aa, Cryptosporidium hominis
YKYDQRWYITEQNKMGPF

SEQ ID NO: 2184444 - protein, 23 aa, Cryptosporidium hominis
YKYNEAKSLLSILVEHNNYNSEF

SEQ ID NO: 2184445 - protein, 24 aa, Cryptosporidium hominis
YKYPEVTCSYPFVSSPPYVVHYMS

SEQ ID NO: 2184446 - protein, 18 aa, Cryptosporidium hominis
YKYQGYVGAHLIVAGSDS

SEQ ID NO: 2184447 - protein, 21 aa, Cryptosporidium hominis
YLAEMRKLRSKYEAQYNEIYS

SEQ ID NO: 2184448 - protein, 22 aa, Cryptosporidium hominis
YLAKALCSEVWCPMTASYYREY

SEQ ID NO: 2184449 - protein, 34 aa, Cryptosporidium hominis
YLCHNIQCGSIRIVILGVLYRISNILNILSDRYY

SEQ ID NO: 2184450 - protein, 23 aa, Cryptosporidium hominis
YLCIRLRELGCDHIFGVPGDYAL

SEQ ID NO: 2184451 - protein, 25 aa, Cryptosporidium hominis
YLDDIGALCACIRVFQDSLSPTSQH

SEQ ID NO: 2184452 - protein, 18 aa, Cryptosporidium hominis
YLDEFDWKRLRSDILNLT

SEQ ID NO: 2184453 - protein, 28 aa, Cryptosporidium hominis
YLDISFIPQFKCCIDCNPTTIKLNKKMA

SEQ ID NO: 2184454 - protein, 23 aa, Cryptosporidium hominis
YLDLRLTPRVHFYKSFKNSKFKI

SEQ ID NO: 2184455 - protein, 18 aa, Cryptosporidium hominis
YLEKLMNYICEIVKLYWT

SEQ ID NO: 2184456 - protein, 17 aa, Cryptosporidium hominis
YLEKLSYLKIWVPSAHR

SEQ ID NO: 2184457 - protein, 18 aa, Cryptosporidium hominis
YLERVFYPVDERWISILD

SEQ ID NO: 2184458 - protein, 17 aa, Cryptosporidium hominis
YLFRKGYLEPIVMKKGY

SEQ ID NO: 2184459 - protein, 25 aa, Cryptosporidium hominis
YLGFTCLYITIKIERVVNFNFKEMI

SEQ ID NO: 2184460 - protein, 25 aa, Cryptosporidium hominis
YLGISCKLKYFYNIEEFLKDYNAIS

SEQ ID NO: 2184461 - protein, 27 aa, Cryptosporidium hominis
YLHDCYRRQPVLPGLIICGDFNSTPDS

SEQ ID NO: 2184462 - protein, 27 aa, Cryptosporidium hominis
YLHGYNIKNGFKFMSWNDLSASEKINQ

SEQ ID NO: 2184463 - protein, 20 aa, Cryptosporidium hominis
YLHIVLRLLQPVKIEKVSEL

SEQ ID NO: 2184464 - protein, 20 aa, Cryptosporidium hominis
YLHLMCKEFHSELSSFMGIS

SEQ ID NO: 2184465 - protein, 22 aa, Cryptosporidium hominis
YLICTRAGGLGINLVSANHVVM

SEQ ID NO: 2184466 - protein, 22 aa, Cryptosporidium hominis
YLILQFPNWFWRSASEEYIVRW

SEQ ID NO: 2184467 - protein, 20 aa, Cryptosporidium hominis
YLIQEFKKTQGIDLSRDKLA

SEQ ID NO: 2184468 - protein, 20 aa, Cryptosporidium hominis
YLITKLCLDFGIYDSNLFSN

SEQ ID NO: 2184469 - protein, 20 aa, Cryptosporidium hominis
YLKAMLRKYMNAGCKINKIL

SEQ ID NO: 2184470 - protein, 23 aa, Cryptosporidium hominis
YLKELRFLVENTILAVADRNSEN

SEQ ID NO: 2184471 - protein, 21 aa, Cryptosporidium hominis
YLKHDIEVLFLTEGVDEPCIS

SEQ ID NO: 2184472 - protein, 18 aa, Cryptosporidium hominis
YLKLKYLVLRIIFNTNKT

SEQ ID NO: 2184473 - protein, 21 aa, Cryptosporidium hominis
YLKLVPSVIEIFKIVRDAPNR

SEQ ID NO: 2184474 - protein, 18 aa, Cryptosporidium hominis
YLKNGSILFISSCNSTPE

SEQ ID NO: 2184475 - protein, 30 aa, Cryptosporidium hominis
YLKRLRLSFPSKEVFTFLFGDFNTLAISDA

SEQ ID NO: 2184476 - protein, 21 aa, Cryptosporidium hominis
YLKSLLKRKVHSHSSIRVVFP

SEQ ID NO: 2184477 - protein, 26 aa, Cryptosporidium hominis
YLLRKFNWRQIMAIHYFFFLELKIKR

SEQ ID NO: 2184478 - protein, 17 aa, Cryptosporidium hominis
YLLYILEDFVPAFIETI

SEQ ID NO: 2184479 - protein, 17 aa, Cryptosporidium hominis
YLMPEFLLKHVNINNDD

SEQ ID NO: 2184480 - protein, 26 aa, Cryptosporidium hominis
YLNFEGSWKLGGFENAIFLSDTSSYY

SEQ ID NO: 2184481 - protein, 17 aa, Cryptosporidium hominis
YLNFWKRSNGLPVPVDR

SEQ ID NO: 2184482 - protein, 25 aa, Cryptosporidium hominis
YLNGVWIKNGLSFVVSQKYGSFEIY

SEQ ID NO: 2184483 - protein, 23 aa, Cryptosporidium hominis
YLNLYPTPVIECFNQCAYEVVTS

SEQ ID NO: 2184484 - protein, 22 aa, Cryptosporidium hominis
YLNSQNRLPVSIATTTTTTTTT

SEQ ID NO: 2184485 - protein, 17 aa, Cryptosporidium hominis
YLNSVPLLAQIRIECIQ

SEQ ID NO: 2184486 - protein, 18 aa, Cryptosporidium hominis
YLPCATISKIERLYETIN

SEQ ID NO: 2184487 - protein, 22 aa, Cryptosporidium hominis
YLPESVVGYFSFNHIIPNVPTF

SEQ ID NO: 2184488 - protein, 24 aa, Cryptosporidium hominis
YLPTKCPVCLIYLISPNHLAKSFA

SEQ ID NO: 2184489 - protein, 22 aa, Cryptosporidium hominis
YLREKYGILSIIEEKKKDILDE

SEQ ID NO: 2184490 - protein, 22 aa, Cryptosporidium hominis
YLRWSGYPYCRIDGSTPGIERQ

SEQ ID NO: 2184491 - protein, 17 aa, Cryptosporidium hominis
YLSDLRELGSIDIDESV

SEQ ID NO: 2184492 - protein, 26 aa, Cryptosporidium hominis
YLSDLVCCLWGSPGVYGVVTTPFSVR

SEQ ID NO: 2184493 - protein, 20 aa, Cryptosporidium hominis
YLSNIRELLPTCLKKNDLSY

SEQ ID NO: 2184494 - protein, 22 aa, Cryptosporidium hominis
YLSRFPIELGKLIISNIANNNI

SEQ ID NO: 2184495 - protein, 28 aa, Cryptosporidium hominis
YLSSEIIQRWVVICSKLIEQSSLLSETD

SEQ ID NO: 2184496 - protein, 27 aa, Cryptosporidium hominis
YLSTGSFVIRGKKNFLPPLKLEMGCAL

SEQ ID NO: 2184497 - protein, 19 aa, Cryptosporidium hominis
YLSYIECARQCIPNNIEIV

SEQ ID NO: 2184498 - protein, 17 aa, Cryptosporidium hominis
YLTIKCCYLMGRIDEAE

SEQ ID NO: 2184499 - protein, 21 aa, Cryptosporidium hominis
YLTRRVKGVNIGLFLHIPFPS

SEQ ID NO: 2184500 - protein, 18 aa, Cryptosporidium hominis
YLTTILLCDRLIMTGTFT

SEQ ID NO: 2184501 - protein, 20 aa, Cryptosporidium hominis
YLVDEIKLLESILEESKDDH

SEQ ID NO: 2184502 - protein, 17 aa, Cryptosporidium hominis
YLVELSIDSHSSKMVEK

SEQ ID NO: 2184503 - protein, 24 aa, Cryptosporidium hominis
YLVFKRLNIKIIYYCTSNYSHKPC

SEQ ID NO: 2184504 - protein, 47 aa, Cryptosporidium hominis
YLVMIRCSIKFFSLYRHIKRKNACIQICKALRRYVCIKREERERIER

SEQ ID NO: 2184505 - protein, 20 aa, Cryptosporidium hominis
YLVMRHFCTCHSYIDKVVLQ

SEQ ID NO: 2184506 - protein, 18 aa, Cryptosporidium hominis
YLVRKCLSIRLWPDESDP

SEQ ID NO: 2184507 - protein, 27 aa, Cryptosporidium hominis
YLVTCKPGYFLKGLHVFSNTSEDIIQA

SEQ ID NO: 2184508 - protein, 21 aa, Cryptosporidium hominis
YLWDPCSLLFDSIRGSGLAYS

SEQ ID NO: 2184509 - protein, 24 aa, Cryptosporidium hominis
YLYDIRNGLLFYKGVELLTRNIGG

SEQ ID NO: 2184510 - protein, 21 aa, Cryptosporidium hominis
YLYDTMLSYTLEWPTLTIDWL

SEQ ID NO: 2184511 - protein, 18 aa, Cryptosporidium hominis
YMAPEVILGKGYNLSCDA

SEQ ID NO: 2184512 - protein, 21 aa, Cryptosporidium hominis
YMDSSCLNGFLTQGLNSIEML

SEQ ID NO: 2184513 - protein, 17 aa, Cryptosporidium hominis
YMEEVLGSLWCLDNVQG

SEQ ID NO: 2184514 - protein, 24 aa, Cryptosporidium hominis
YMFEYESFCKLRWRDRTLRDLFLN

SEQ ID NO: 2184515 - protein, 26 aa, Cryptosporidium hominis
YMHMRRMNIEMIKGYCLVDAYRHYYP

SEQ ID NO: 2184516 - protein, 19 aa, Cryptosporidium hominis
YMITFPYPYMNGRLHLGHA

SEQ ID NO: 2184517 - protein, 18 aa, Cryptosporidium hominis
YMKDLRIIQGANLKRTVL

SEQ ID NO: 2184518 - protein, 35 aa, Cryptosporidium hominis
YMKKMGLINCNRCPKSYHWSQCLGLDKVPPRTWIC

SEQ ID NO: 2184519 - protein, 19 aa, Cryptosporidium hominis
YMKLQSCDASNQIVKGNSI

SEQ ID NO: 2184520 - protein, 20 aa, Cryptosporidium hominis
YMNAGLQFISAMGIFTEENF

SEQ ID NO: 2184521 - protein, 21 aa, Cryptosporidium hominis
YMNRILIINLIFAIYRSLFYK

SEQ ID NO: 2184522 - protein, 17 aa, Cryptosporidium hominis
YMQSNWTGPPFKIDDGV

SEQ ID NO: 2184523 - protein, 26 aa, Cryptosporidium hominis
YNAKEYLFKAFLIILSLEDNVDAQIK

SEQ ID NO: 2184524 - protein, 17 aa, Cryptosporidium hominis
YNALVVAEKAKLRKIRQ

SEQ ID NO: 2184525 - protein, 23 aa, Cryptosporidium hominis
YNATCISISQNIRMRTQNYENSA

SEQ ID NO: 2184526 - protein, 25 aa, Cryptosporidium hominis
YNDCNKMSLLFSWYTYVPNNELDTS

SEQ ID NO: 2184527 - protein, 20 aa, Cryptosporidium hominis
YNDLFPEFVNNHIFKNCYSF

SEQ ID NO: 2184528 - protein, 17 aa, Cryptosporidium hominis
YNEGIPFVQPMTTDNLK

SEQ ID NO: 2184529 - protein, 19 aa, Cryptosporidium hominis
YNEILRYLLQNEYFVEENV

SEQ ID NO: 2184530 - protein, 27 aa, Cryptosporidium hominis
YNENLLRRKGCLTDKSFTKYYAERIVE

SEQ ID NO: 2184531 - protein, 21 aa, Cryptosporidium hominis
YNENYCNRKSRPANSSSSIIN

SEQ ID NO: 2184532 - protein, 18 aa, Cryptosporidium hominis
YNFELEDFLERYTFKNNF

SEQ ID NO: 2184533 - protein, 17 aa, Cryptosporidium hominis
YNFREFYSVYTPSKEEI

SEQ ID NO: 2184534 - protein, 22 aa, Cryptosporidium hominis
YNGDLLKRVNFDTLYSAYWSPK

SEQ ID NO: 2184535 - protein, 17 aa, Cryptosporidium hominis
YNGFEYGSGLGNSELNN

SEQ ID NO: 2184536 - protein, 18 aa, Cryptosporidium hominis
YNGFNYVYRSFILKLVIK

SEQ ID NO: 2184537 - protein, 18 aa, Cryptosporidium hominis
YNGFSHFLYYSALHLTNT

SEQ ID NO: 2184538 - protein, 30 aa, Cryptosporidium hominis
YNHDFWSKCYVLFCRNIIIIFLVNFTLRSE

SEQ ID NO: 2184539 - protein, 23 aa, Cryptosporidium hominis
YNIFRRNCLTFADELCMVLNVGQ

SEQ ID NO: 2184540 - protein, 22 aa, Cryptosporidium hominis
YNIKDSIGFSAWWDAIEKSKQS

SEQ ID NO: 2184541 - protein, 19 aa, Cryptosporidium hominis
YNINVNFQFKENVHTCSNT

SEQ ID NO: 2184542 - protein, 26 aa, Cryptosporidium hominis
YNISDGPWRACLCRLGYDPRKDPESR

SEQ ID NO: 2184543 - protein, 22 aa, Cryptosporidium hominis
YNISTCNFLKNAISSGINLTVF

SEQ ID NO: 2184544 - protein, 25 aa, Cryptosporidium hominis
YNKDRRAIKSKGRRPYSNTNNQNYN

SEQ ID NO: 2184545 - protein, 17 aa, Cryptosporidium hominis
YNKIFKFTFRSRGEYNN

SEQ ID NO: 2184546 - protein, 19 aa, Cryptosporidium hominis
YNKKIDGFVEFESELAKLR

SEQ ID NO: 2184547 - protein, 22 aa, Cryptosporidium hominis
YNKVKDLFCKKINMVQNDGGLN

SEQ ID NO: 2184548 - protein, 17 aa, Cryptosporidium hominis
YNLFDFYWLFFRTYNGL

SEQ ID NO: 2184549 - protein, 26 aa, Cryptosporidium hominis
YNLRKQVLCDLILPFVSSEAFADLRT

SEQ ID NO: 2184550 - protein, 24 aa, Cryptosporidium hominis
YNLRLESFEFWPLYLRNEKGINIL

SEQ ID NO: 2184551 - protein, 20 aa, Cryptosporidium hominis
YNMACIGMDGYLLGRKSKVL

SEQ ID NO: 2184552 - protein, 41 aa, Cryptosporidium hominis
YNMPQDLLQGFAAVELCNRGWLYYPDSLQWYSKVQNEEKQT

SEQ ID NO: 2184553 - protein, 17 aa, Cryptosporidium hominis
YNNGVGFVNHQNYLEQV

SEQ ID NO: 2184554 - protein, 23 aa, Cryptosporidium hominis
YNNKKYYAIKAFDKDLSKKGIHP

SEQ ID NO: 2184555 - protein, 23 aa, Cryptosporidium hominis
YNNKRSRNGITFRNKMTNEDWEN

SEQ ID NO: 2184556 - protein, 17 aa, Cryptosporidium hominis
YNNLRITTLCVIPNYIL

SEQ ID NO: 2184557 - protein, 18 aa, Cryptosporidium hominis
YNNSWMFEKGPRPYCEYK

SEQ ID NO: 2184558 - protein, 20 aa, Cryptosporidium hominis
YNPLIPWSYGAQIVALNYQA

SEQ ID NO: 2184559 - protein, 17 aa, Cryptosporidium hominis
YNPLLFKNYPQLILSSI

SEQ ID NO: 2184560 - protein, 19 aa, Cryptosporidium hominis
YNPSSFKFTSLIDTNSEEF

SEQ ID NO: 2184561 - protein, 23 aa, Cryptosporidium hominis
YNPTWHCVVGRNFGSYVTHETRH

SEQ ID NO: 2184562 - protein, 24 aa, Cryptosporidium hominis
YNQDRRGRGYGYSGNRQHNHGGSS

SEQ ID NO: 2184563 - protein, 25 aa, Cryptosporidium hominis
YNRFNWKGWVDFHISSIKLNDTFHQ

SEQ ID NO: 2184564 - protein, 24 aa, Cryptosporidium hominis
YNRTFMYRYYFNNIIFSLKTVTNN

SEQ ID NO: 2184565 - protein, 23 aa, Cryptosporidium hominis
YNSKLKLLLGLYKLEINNIEDSS

SEQ ID NO: 2184566 - protein, 22 aa, Cryptosporidium hominis
YNSLWAELQWDGEKFDKVMGYF

SEQ ID NO: 2184567 - protein, 24 aa, Cryptosporidium hominis
YNSRKRVHFLLAIEIADLDDQDYE

SEQ ID NO: 2184568 - protein, 24 aa, Cryptosporidium hominis
YNSTRLVHFSKLYINIIVYQNSFN

SEQ ID NO: 2184569 - protein, 30 aa, Cryptosporidium hominis
YNSWKKQRYSVPWCYENFLQSRALKGAQDV

SEQ ID NO: 2184570 - protein, 19 aa, Cryptosporidium hominis
YNTEFFNQFDVVLNALDNI

SEQ ID NO: 2184571 - protein, 17 aa, Cryptosporidium hominis
YNTEKWSNYSMHNQYYI

SEQ ID NO: 2184572 - protein, 18 aa, Cryptosporidium hominis
YNTIPTFLSEVDYSSQGR

SEQ ID NO: 2184573 - protein, 23 aa, Cryptosporidium hominis
YNTNCPKKIILEIGKMGEKLAFD

SEQ ID NO: 2184574 - protein, 25 aa, Cryptosporidium hominis
YNVAREIFESFILEIKSLWNHQVDI

SEQ ID NO: 2184575 - protein, 24 aa, Cryptosporidium hominis
YNVRARLAARGQKVDFLNAKDAIS

SEQ ID NO: 2184576 - protein, 19 aa, Cryptosporidium hominis
YNWGVKFIINNSTPELLID

SEQ ID NO: 2184577 - protein, 21 aa, Cryptosporidium hominis
YNYGYPIYFLKGLYKENVLDF

SEQ ID NO: 2184578 - protein, 18 aa, Cryptosporidium hominis
YNYNKIQVLMIINDMIQI

SEQ ID NO: 2184579 - protein, 20 aa, Cryptosporidium hominis
YPEILQLFSADKRLIRSLQS

SEQ ID NO: 2184580 - protein, 25 aa, Cryptosporidium hominis
YPEKKRFTIYGALVFENDVRNLLSY

SEQ ID NO: 2184581 - protein, 23 aa, Cryptosporidium hominis
YPEMIRYHFKEAFSVNEGVEARE

SEQ ID NO: 2184582 - protein, 23 aa, Cryptosporidium hominis
YPEMKLKIQLLIEKGFLNENLTI

SEQ ID NO: 2184583 - protein, 20 aa, Cryptosporidium hominis
YPEPRQLLIKKVGDPNMEGV

SEQ ID NO: 2184584 - protein, 28 aa, Cryptosporidium hominis
YPERQSWKVVGHTGISWCVRRKTWRVWF

SEQ ID NO: 2184585 - protein, 24 aa, Cryptosporidium hominis
YPFTFKLCIYFDFKTQIAYYSAFF

SEQ ID NO: 2184586 - protein, 25 aa, Cryptosporidium hominis
YPIDDRLYLWNGLYWIRILDQSKSE

SEQ ID NO: 2184587 - protein, 21 aa, Cryptosporidium hominis
YPKEEYESILFKILSQAMKSI

SEQ ID NO: 2184588 - protein, 17 aa, Cryptosporidium hominis
YPKGFVIANDLDTRRAH

SEQ ID NO: 2184589 - protein, 17 aa, Cryptosporidium hominis
YPKGRRVILIGNDITYQ

SEQ ID NO: 2184590 - protein, 17 aa, Cryptosporidium hominis
YPKPWYKALKKIYNGFN

SEQ ID NO: 2184591 - protein, 26 aa, Cryptosporidium hominis
YPLLEFYKSNYFFSLYEDIDYQTRQT

SEQ ID NO: 2184592 - protein, 20 aa, Cryptosporidium hominis
YPMYVSLAVSVGRLVQNPLA

SEQ ID NO: 2184593 - protein, 34 aa, Cryptosporidium hominis
YPNGNLIHIGSKLIWKIGFDSYYSIYLNVYDQIN

SEQ ID NO: 2184594 - protein, 24 aa, Cryptosporidium hominis
YPNHVLCCRIFILVIQKVSERERK

SEQ ID NO: 2184595 - protein, 19 aa, Cryptosporidium hominis
YPPPIKILKLCLSSLKVIV

SEQ ID NO: 2184596 - protein, 21 aa, Cryptosporidium hominis
YPQRLRFYLDDGSGLILIDWL

SEQ ID NO: 2184597 - protein, 17 aa, Cryptosporidium hominis
YPSIGHFALLGSSNSQL

SEQ ID NO: 2184598 - protein, 28 aa, Cryptosporidium hominis
YPSIQRILRRICKRAIIEFFDAKRSSLI

SEQ ID NO: 2184599 - protein, 26 aa, Cryptosporidium hominis
YPSSPNLWLLYGFIYRKAFPDRVNET

SEQ ID NO: 2184600 - protein, 17 aa, Cryptosporidium hominis
YPTVPYPFSIDSDDGHL

SEQ ID NO: 2184601 - protein, 18 aa, Cryptosporidium hominis
YPVAKSRYAKLVDILHFK

SEQ ID NO: 2184602 - protein, 24 aa, Cryptosporidium hominis
YPVRVLPGMVLKVGQCKMEILPYM

SEQ ID NO: 2184603 - protein, 17 aa, Cryptosporidium hominis
YPVYSSFIFFNNINHQA

SEQ ID NO: 2184604 - protein, 25 aa, Cryptosporidium hominis
YPYMNGRLHLGHAFTLTKADFQARF

SEQ ID NO: 2184605 - protein, 28 aa, Cryptosporidium hominis
YQDEFLHDWTLICTRIENGLKLGDQLRQ

SEQ ID NO: 2184606 - protein, 18 aa, Cryptosporidium hominis
YQEFLRLDFTVMNLNNSL

SEQ ID NO: 2184607 - protein, 17 aa, Cryptosporidium hominis
YQEPEIIFYHPPSSFSI

SEQ ID NO: 2184608 - protein, 26 aa, Cryptosporidium hominis
YQGIRIINILSCLSDLVILEESSTEQ

SEQ ID NO: 2184609 - protein, 26 aa, Cryptosporidium hominis
YQHLLRCANLFLAKNILFTRVKIAEK

SEQ ID NO: 2184610 - protein, 17 aa, Cryptosporidium hominis
YQHPAAWRQSCGARIWS

SEQ ID NO: 2184611 - protein, 18 aa, Cryptosporidium hominis
YQHRVCYVDIDIHHGDGV

SEQ ID NO: 2184612 - protein, 18 aa, Cryptosporidium hominis
YQIEGFVQIVQAFRSYNT

SEQ ID NO: 2184613 - protein, 17 aa, Cryptosporidium hominis
YQIELIILVGFVVKTFK

SEQ ID NO: 2184614 - protein, 17 aa, Cryptosporidium hominis
YQIFLDLFELILEILEG

SEQ ID NO: 2184615 - protein, 24 aa, Cryptosporidium hominis
YQIKYYYYHSMTWPQLLDIATDSN

SEQ ID NO: 2184616 - protein, 18 aa, Cryptosporidium hominis
YQILSLRKVGINLPPYVP

SEQ ID NO: 2184617 - protein, 19 aa, Cryptosporidium hominis
YQILTRIAMDTSLRYSLHL

SEQ ID NO: 2184618 - protein, 25 aa, Cryptosporidium hominis
YQIRCFNQDLPKCMDLLSDIIKNSK

SEQ ID NO: 2184619 - protein, 28 aa, Cryptosporidium hominis
YQIVLSWIYKFLNDFGRLPVNKELPEMH

SEQ ID NO: 2184620 - protein, 19 aa, Cryptosporidium hominis
YQLIPSIVRILSYAKNMFL

SEQ ID NO: 2184621 - protein, 19 aa, Cryptosporidium hominis
YQRCKCLFGSNSLNLRIEL

SEQ ID NO: 2184622 - protein, 20 aa, Cryptosporidium hominis
YQRCNSAPFLTWSIFLIEFL

SEQ ID NO: 2184623 - protein, 18 aa, Cryptosporidium hominis
YQSLELPYRVISIVSGAL

SEQ ID NO: 2184624 - protein, 24 aa, Cryptosporidium hominis
YQTDPSGIALEWKAQAVGQNSKTV

SEQ ID NO: 2184625 - protein, 29 aa, Cryptosporidium hominis
YQVDIKKLWKLNGTVYSRDLLLEYFSNIL

SEQ ID NO: 2184626 - protein, 28 aa, Cryptosporidium hominis
YQYPPCCPNSSLGGSMGYNFGGIDDSNS

SEQ ID NO: 2184627 - protein, 22 aa, Cryptosporidium hominis
YQYRCVPNTKKAGLLTEEVISS

SEQ ID NO: 2184628 - protein, 22 aa, Cryptosporidium hominis
YQYSSPCNGGFYIHSNSDFNSD

SEQ ID NO: 2184629 - protein, 18 aa, Cryptosporidium hominis
YRDCGNFLMAKNCFLVAL

SEQ ID NO: 2184630 - protein, 18 aa, Cryptosporidium hominis
YRDLGFYGVPGRAGVSNV

SEQ ID NO: 2184631 - protein, 17 aa, Cryptosporidium hominis
YRDNYSQLRQLFEKLKE

SEQ ID NO: 2184632 - protein, 22 aa, Cryptosporidium hominis
YRDSKPLKGARITGSLHLTIET

SEQ ID NO: 2184633 - protein, 22 aa, Cryptosporidium hominis
YRELINIVEYIVRMEGSDIIEI

SEQ ID NO: 2184634 - protein, 18 aa, Cryptosporidium hominis
YRELLGYLQMVRRLKDSR

SEQ ID NO: 2184635 - protein, 23 aa, Cryptosporidium hominis
YRENLRKSQLIKMMVHSEKNRIV

SEQ ID NO: 2184636 - protein, 19 aa, Cryptosporidium hominis
YRFDLEMMSLLDSLKYPEL

SEQ ID NO: 2184637 - protein, 18 aa, Cryptosporidium hominis
YRFGELLKELEAKKEGLT

SEQ ID NO: 2184638 - protein, 17 aa, Cryptosporidium hominis
YRFIPDISEEELLNRLP

SEQ ID NO: 2184639 - protein, 20 aa, Cryptosporidium hominis
YRGSYIPRMSPYEFLRNVNN

SEQ ID NO: 2184640 - protein, 23 aa, Cryptosporidium hominis
YRHKELPLNICHFTTLPSTQIWA

SEQ ID NO: 2184641 - protein, 20 aa, Cryptosporidium hominis
YRINHLRSRFIYTKYYLDKE

SEQ ID NO: 2184642 - protein, 25 aa, Cryptosporidium hominis
YRISEPYHWIPFNCDLLFCTKSQQN

SEQ ID NO: 2184643 - protein, 20 aa, Cryptosporidium hominis
YRKDMVVNHNHIWNERNVLE

SEQ ID NO: 2184644 - protein, 21 aa, Cryptosporidium hominis
YRKEFDACLDTLVISGSIKKI

SEQ ID NO: 2184645 - protein, 20 aa, Cryptosporidium hominis
YRKKMEKEFYVVPNTKLSRS

SEQ ID NO: 2184646 - protein, 20 aa, Cryptosporidium hominis
YRKWIDWKPDPSIYIQYSKF

SEQ ID NO: 2184647 - protein, 20 aa, Cryptosporidium hominis
YRLFESCQLILYDVLKDYAL

SEQ ID NO: 2184648 - protein, 21 aa, Cryptosporidium hominis
YRLGDVPPLSFGYLDKNRNEA

SEQ ID NO: 2184649 - protein, 21 aa, Cryptosporidium hominis
YRLIIWKRTFLPQFQNRNQRY

SEQ ID NO: 2184650 - protein, 21 aa, Cryptosporidium hominis
YRLNSIPQFTLYILSSHFDSF

SEQ ID NO: 2184651 - protein, 30 aa, Cryptosporidium hominis
YRLPDERYISLKFLAKFVLNKNIQTEVHDS

SEQ ID NO: 2184652 - protein, 20 aa, Cryptosporidium hominis
YRLQRIESNILYSNDIADIM

SEQ ID NO: 2184653 - protein, 18 aa, Cryptosporidium hominis
YRLSRAIDTLFPKFWEEN

SEQ ID NO: 2184654 - protein, 23 aa, Cryptosporidium hominis
YRMALEEARKALSSNSFNNREDR

SEQ ID NO: 2184655 - protein, 23 aa, Cryptosporidium hominis
YRNEEFIRIGYYVHNVYTDPLLE

SEQ ID NO: 2184656 - protein, 20 aa, Cryptosporidium hominis
YRNFWKRPNYVNKYRNIDSL

SEQ ID NO: 2184657 - protein, 27 aa, Cryptosporidium hominis
YRNKLGCDILYSFKFSPLKNIIIENQQ

SEQ ID NO: 2184658 - protein, 19 aa, Cryptosporidium hominis
YRNPYLPVHAGGVPSQQIY

SEQ ID NO: 2184659 - protein, 19 aa, Cryptosporidium hominis
YRPDFLVPQPSRIPIESIY

SEQ ID NO: 2184660 - protein, 24 aa, Cryptosporidium hominis
YRPKRLKIAILDHIPCDLDSLSIE

SEQ ID NO: 2184661 - protein, 20 aa, Cryptosporidium hominis
YRPPLPLLLTHLKARCKPTT

SEQ ID NO: 2184662 - protein, 31 aa, Cryptosporidium hominis
YRPTPDRIYSFLCGFVNLMRFKEDRWMTYKN

SEQ ID NO: 2184663 - protein, 27 aa, Cryptosporidium hominis
YRQICRTGIAIICRFCGSIIENEAVMQ

SEQ ID NO: 2184664 - protein, 25 aa, Cryptosporidium hominis
YRQKLHPCEICAAFLSETDNDQRLN

SEQ ID NO: 2184665 - protein, 25 aa, Cryptosporidium hominis
YRQNFRLLVFTTRLFLLFIQEMCGG

SEQ ID NO: 2184666 - protein, 21 aa, Cryptosporidium hominis
YRRRSNISGGFQNMAKTSSKI

SEQ ID NO: 2184667 - protein, 20 aa, Cryptosporidium hominis
YRRTCPIGVILVIFEARPEV

SEQ ID NO: 2184668 - protein, 21 aa, Cryptosporidium hominis
YRSFIPSILMNLIIIDKKDIN

SEQ ID NO: 2184669 - protein, 26 aa, Cryptosporidium hominis
YRSPEVIVGAGYDWSADIWSLGCTIF

SEQ ID NO: 2184670 - protein, 24 aa, Cryptosporidium hominis
YRSTAWYPKFLFDKKFIEENIEEA

SEQ ID NO: 2184671 - protein, 19 aa, Cryptosporidium hominis
YRTTYRPPLPLLLTHLKAR

SEQ ID NO: 2184672 - protein, 22 aa, Cryptosporidium hominis
YRVQAAISLRNVFREFVLTPDN

SEQ ID NO: 2184673 - protein, 28 aa, Cryptosporidium hominis
YRVSGYAGKVLFGWDFPAGFTPSLSCKG

SEQ ID NO: 2184674 - protein, 22 aa, Cryptosporidium hominis
YRWGLYDLKSPIVFKPKLETFF

SEQ ID NO: 2184675 - protein, 28 aa, Cryptosporidium hominis
YSAIPVPILIDRAVPVPMELQIIQDILC

SEQ ID NO: 2184676 - protein, 19 aa, Cryptosporidium hominis
YSCEGRISPIFIEGLKRGI

SEQ ID NO: 2184677 - protein, 24 aa, Cryptosporidium hominis
YSDFNCLICFRILQRTMVVKDCLH

SEQ ID NO: 2184678 - protein, 19 aa, Cryptosporidium hominis
YSDKYRYIIFESTDYNYAV

SEQ ID NO: 2184679 - protein, 19 aa, Cryptosporidium hominis
YSELLSYRLLINVINPKIL

SEQ ID NO: 2184680 - protein, 20 aa, Cryptosporidium hominis
YSEVYCLPDGTFAVLKDAKQ

SEQ ID NO: 2184681 - protein, 32 aa, Cryptosporidium hominis
YSFCLLKKGKVIGGVCFRPYFEQRFAEIAFLA

SEQ ID NO: 2184682 - protein, 25 aa, Cryptosporidium hominis
YSFFPQCPNGIIGGIIHYESESNYL

SEQ ID NO: 2184683 - protein, 32 aa, Cryptosporidium hominis
YSFPHQYCHLCFSRFMSLRPFLLKAVQRKWKC

SEQ ID NO: 2184684 - protein, 21 aa, Cryptosporidium hominis
YSFSEGLSFDSFILVNDPRCK

SEQ ID NO: 2184685 - protein, 21 aa, Cryptosporidium hominis
YSGEYIRLTPPVFKIETKESI

SEQ ID NO: 2184686 - protein, 17 aa, Cryptosporidium hominis
YSGFRIVVRPLPPLPFT

SEQ ID NO: 2184687 - protein, 17 aa, Cryptosporidium hominis
YSGRVGTKRMKVIEIPQ

SEQ ID NO: 2184688 - protein, 17 aa, Cryptosporidium hominis
YSGTSYLGSSAKFSNDM

SEQ ID NO: 2184689 - protein, 25 aa, Cryptosporidium hominis
YSHKPCDIKRALNIANTLPRKPTIF

SEQ ID NO: 2184690 - protein, 27 aa, Cryptosporidium hominis
YSHNIYWPRRCPFYLSNQSTIRYIPVL

SEQ ID NO: 2184691 - protein, 26 aa, Cryptosporidium hominis
YSHPILRERIEYFGRFKLDILDSNHL

SEQ ID NO: 2184692 - protein, 24 aa, Cryptosporidium hominis
YSHVLPKLSLRVFGQFVAEDCPIL

SEQ ID NO: 2184693 - protein, 31 aa, Cryptosporidium hominis
YSICQLKPVIHHITSLDLINAVITNNNNNNN

SEQ ID NO: 2184694 - protein, 20 aa, Cryptosporidium hominis
YSINKIFLAIGIHSHESPIS

SEQ ID NO: 2184695 - protein, 24 aa, Cryptosporidium hominis
YSKKIEHLHSLVFDAFHLLSTGKS

SEQ ID NO: 2184696 - protein, 27 aa, Cryptosporidium hominis
YSKLICINFRLPVILTNFMAPTKKMGK

SEQ ID NO: 2184697 - protein, 26 aa, Cryptosporidium hominis
YSKSLLCNLWFRSIKIIQEIQNYNFQ

SEQ ID NO: 2184698 - protein, 18 aa, Cryptosporidium hominis
YSKSNIIYWECFFDNVLT

SEQ ID NO: 2184699 - protein, 26 aa, Cryptosporidium hominis
YSKVCIKIILNNVDWKCVTQFLRKSV

SEQ ID NO: 2184700 - protein, 19 aa, Cryptosporidium hominis
YSLARKDFMMVLNLTQNDR

SEQ ID NO: 2184701 - protein, 17 aa, Cryptosporidium hominis
YSLDIWLSDLIRKLSQN

SEQ ID NO: 2184702 - protein, 35 aa, Cryptosporidium hominis
YSLEWHPFFRPNGNFKYNILKGFQIYIIGYSKTIG

SEQ ID NO: 2184703 - protein, 21 aa, Cryptosporidium hominis
YSLIFRESYPFNENEIKDFDN

SEQ ID NO: 2184704 - protein, 19 aa, Cryptosporidium hominis
YSLIKHVYFLLDTVQEEAK

SEQ ID NO: 2184705 - protein, 18 aa, Cryptosporidium hominis
YSLKSVRSKKNLTISEDV

SEQ ID NO: 2184706 - protein, 17 aa, Cryptosporidium hominis
YSLNGYLTQEWFSEFVN

SEQ ID NO: 2184707 - protein, 17 aa, Cryptosporidium hominis
YSLNQVILWKWPSMQKI

SEQ ID NO: 2184708 - protein, 17 aa, Cryptosporidium hominis
YSLQLKDIQDFFKNNRI

SEQ ID NO: 2184709 - protein, 18 aa, Cryptosporidium hominis
YSLSDVWLTLMDDKSIRC

SEQ ID NO: 2184710 - protein, 30 aa, Cryptosporidium hominis
YSLVYKRLYDCLGPVMFPIAPLKGIKHPRG

SEQ ID NO: 2184711 - protein, 30 aa, Cryptosporidium hominis
YSNGVVLRYYCPFCNGACNCERCLRNQQIR

SEQ ID NO: 2184712 - protein, 18 aa, Cryptosporidium hominis
YSNHYLKGKWVECKRALP

SEQ ID NO: 2184713 - protein, 17 aa, Cryptosporidium hominis
YSNIGIWNSICDTGHGN

SEQ ID NO: 2184714 - protein, 17 aa, Cryptosporidium hominis
YSNLPFPPFQVKITQRF

SEQ ID NO: 2184715 - protein, 20 aa, Cryptosporidium hominis
YSNWLKNEWNIIPDDFPIND

SEQ ID NO: 2184716 - protein, 23 aa, Cryptosporidium hominis
YSPCLCLKDAFPSTTIDLSSEIT

SEQ ID NO: 2184717 - protein, 24 aa, Cryptosporidium hominis
YSPFKGKVIEFLNGRMILNISDNI

SEQ ID NO: 2184718 - protein, 23 aa, Cryptosporidium hominis
YSPGEWSLKPFVVHKGNNNHVNA

SEQ ID NO: 2184719 - protein, 25 aa, Cryptosporidium hominis
YSPTEIKIQPSIFSFDISLDTKKSN

SEQ ID NO: 2184720 - protein, 19 aa, Cryptosporidium hominis
YSPYRKIQESELINMISMM

SEQ ID NO: 2184721 - protein, 26 aa, Cryptosporidium hominis
YSQEGLKNLPPIFLANIEVSPRPDKE

SEQ ID NO: 2184722 - protein, 26 aa, Cryptosporidium hominis
YSQKCLDACVHYISYTLKYLLDNPEE

SEQ ID NO: 2184723 - protein, 21 aa, Cryptosporidium hominis
YSQLILKFVDFDSLLDQVVCD

SEQ ID NO: 2184724 - protein, 25 aa, Cryptosporidium hominis
YSQMIKLCSSFRRMLKLYVASCYYF

SEQ ID NO: 2184725 - protein, 20 aa, Cryptosporidium hominis
YSSCNKINFYQGFANDPVDF

SEQ ID NO: 2184726 - protein, 25 aa, Cryptosporidium hominis
YSSDRPRWYPLLSAAHYGIMVGQDI

SEQ ID NO: 2184727 - protein, 25 aa, Cryptosporidium hominis
YSSKSSEMNLLFPGEEEGDWKELAI

SEQ ID NO: 2184728 - protein, 24 aa, Cryptosporidium hominis
YSSLWRKLPQQIPVRELAMSRYHI

SEQ ID NO: 2184729 - protein, 23 aa, Cryptosporidium hominis
YSSNFIWDLVRSIPIESLNRLYV

SEQ ID NO: 2184730 - protein, 22 aa, Cryptosporidium hominis
YSSNRLAVYGPYQPINLELLDE

SEQ ID NO: 2184731 - protein, 19 aa, Cryptosporidium hominis
YSSPELYLPLSNTPLTFIK

SEQ ID NO: 2184732 - protein, 19 aa, Cryptosporidium hominis
YSSPIIPKILYIESQPLEY

SEQ ID NO: 2184733 - protein, 26 aa, Cryptosporidium hominis
YSSRLPLWHLFSSLCWQGYHNQQECC

SEQ ID NO: 2184734 - protein, 23 aa, Cryptosporidium hominis
YSSSWKYMEYLFLKQAGKSTSAV

SEQ ID NO: 2184735 - protein, 19 aa, Cryptosporidium hominis
YSSVARKGNTYGDIGSYMN

SEQ ID NO: 2184736 - protein, 25 aa, Cryptosporidium hominis
YSTDFKGKVKLVFEEALTIIEDHVR

SEQ ID NO: 2184737 - protein, 23 aa, Cryptosporidium hominis
YSTFSLLLEFGFNIEKESGHPFN

SEQ ID NO: 2184738 - protein, 20 aa, Cryptosporidium hominis
YSTILAFKVGEEFDLEDERS

SEQ ID NO: 2184739 - protein, 18 aa, Cryptosporidium hominis
YSTLSYESGVSLNWIESV

SEQ ID NO: 2184740 - protein, 20 aa, Cryptosporidium hominis
YSTQNSQDWMSIVSEKSILR

SEQ ID NO: 2184741 - protein, 17 aa, Cryptosporidium hominis
YSVALSFISSQATCCEI

SEQ ID NO: 2184742 - protein, 17 aa, Cryptosporidium hominis
YSVETFLLLIALKVRYP

SEQ ID NO: 2184743 - protein, 18 aa, Cryptosporidium hominis
YSVFPTKNKIGIETKNDL

SEQ ID NO: 2184744 - protein, 17 aa, Cryptosporidium hominis
YSVIEHYFKVEANSKSQ

SEQ ID NO: 2184745 - protein, 18 aa, Cryptosporidium hominis
YSVPSYREENIFHYEPTG

SEQ ID NO: 2184746 - protein, 25 aa, Cryptosporidium hominis
YSVRTRSKFKLQYLFGQNIDSISHP

SEQ ID NO: 2184747 - protein, 18 aa, Cryptosporidium hominis
YSWHFPELAKIITDTEKF

SEQ ID NO: 2184748 - protein, 18 aa, Cryptosporidium hominis
YSWSDCGESIEIYISLQD

SEQ ID NO: 2184749 - protein, 19 aa, Cryptosporidium hominis
YSYKNLTSISARRTKAEPE

SEQ ID NO: 2184750 - protein, 18 aa, Cryptosporidium hominis
YTCLEVYRYFKAIKSITL

SEQ ID NO: 2184751 - protein, 18 aa, Cryptosporidium hominis
YTDGSVYTGEWFDGKEHG

SEQ ID NO: 2184752 - protein, 30 aa, Cryptosporidium hominis
YTDLRIGTRLNEGPGLTCSSKFIAFANDGG

SEQ ID NO: 2184753 - protein, 21 aa, Cryptosporidium hominis
YTELFLKLSINPILSNSGSTP

SEQ ID NO: 2184754 - protein, 17 aa, Cryptosporidium hominis
YTEMVRFYKTFTPSTLR

SEQ ID NO: 2184755 - protein, 24 aa, Cryptosporidium hominis
YTESKGRCLYARKCFNPGDIIFAE

SEQ ID NO: 2184756 - protein, 26 aa, Cryptosporidium hominis
YTFMENFKSLPLFSSINGIFEFDILK

SEQ ID NO: 2184757 - protein, 19 aa, Cryptosporidium hominis
YTHKGHLDLLALTNQDLIQ

SEQ ID NO: 2184758 - protein, 18 aa, Cryptosporidium hominis
YTHNLKFLNRESTGGQIK

SEQ ID NO: 2184759 - protein, 24 aa, Cryptosporidium hominis
YTKEADWSYIKYCSVLNSKLYSNK

SEQ ID NO: 2184760 - protein, 17 aa, Cryptosporidium hominis
YTKTCFEKNEAHCLKPS

SEQ ID NO: 2184761 - protein, 17 aa, Cryptosporidium hominis
YTLFSHINGFKELRFIP

SEQ ID NO: 2184762 - protein, 26 aa, Cryptosporidium hominis
YTLLKRVILVSIALRIGENCEFNQLR

SEQ ID NO: 2184763 - protein, 26 aa, Cryptosporidium hominis
YTLLLCLSGDCIISFNEKITKDNCNN

SEQ ID NO: 2184764 - protein, 28 aa, Cryptosporidium hominis
YTMVTDLIFSWLELRDGSENLVFSTENH

SEQ ID NO: 2184765 - protein, 23 aa, Cryptosporidium hominis
YTPKELGGLGMLSMGHILIPQSD

SEQ ID NO: 2184766 - protein, 24 aa, Cryptosporidium hominis
YTPLRQFFFFDAFEQLDLISNETH

SEQ ID NO: 2184767 - protein, 24 aa, Cryptosporidium hominis
YTQELKRIAGICSNNLKNSKKSDK

SEQ ID NO: 2184768 - protein, 27 aa, Cryptosporidium hominis
YTRKPGCSRMKLDIIGYGESENYGTQL

SEQ ID NO: 2184769 - protein, 17 aa, Cryptosporidium hominis
YTVSLRDSSPFFRNNYE

SEQ ID NO: 2184770 - protein, 24 aa, Cryptosporidium hominis
YVASFKCTLLLLPNGSKRISGLQF

SEQ ID NO: 2184771 - protein, 25 aa, Cryptosporidium hominis
YVCRADPMLCSAAFLSYPGLVRHIK

SEQ ID NO: 2184772 - protein, 18 aa, Cryptosporidium hominis
YVDKNACNEYIDRKIDTS

SEQ ID NO: 2184773 - protein, 17 aa, Cryptosporidium hominis
YVDQFFSIINWDFVESN

SEQ ID NO: 2184774 - protein, 26 aa, Cryptosporidium hominis
YVEKLVEIPFHPGMMYDENMLNQSIP

SEQ ID NO: 2184775 - protein, 24 aa, Cryptosporidium hominis
YVEKQICCNACYMKYDRNRPRYRN

SEQ ID NO: 2184776 - protein, 23 aa, Cryptosporidium hominis
YVELYLDWFLNKSIESQFRAFYN

SEQ ID NO: 2184777 - protein, 25 aa, Cryptosporidium hominis
YVERELYHYPLLLAPIISSMSNLNI

SEQ ID NO: 2184778 - protein, 19 aa, Cryptosporidium hominis
YVFHNWFGNTLFSFDPLDG

SEQ ID NO: 2184779 - protein, 18 aa, Cryptosporidium hominis
YVFIRLGDILQLAEKYYE

SEQ ID NO: 2184780 - protein, 17 aa, Cryptosporidium hominis
YVFKDSSNVPEWLSDLA

SEQ ID NO: 2184781 - protein, 25 aa, Cryptosporidium hominis
YVGRPKYKRCMAGALEGDIFVGSKC

SEQ ID NO: 2184782 - protein, 23 aa, Cryptosporidium hominis
YVHEGAVLLGIWNDNTVFLRFEA

SEQ ID NO: 2184783 - protein, 19 aa, Cryptosporidium hominis
YVHPLKVHLSNVFSHPKYR

SEQ ID NO: 2184784 - protein, 18 aa, Cryptosporidium hominis
YVIHPLISNLGMEKNQIA

SEQ ID NO: 2184785 - protein, 19 aa, Cryptosporidium hominis
YVIVLSLELLFCDPYEAKM

SEQ ID NO: 2184786 - protein, 19 aa, Cryptosporidium hominis
YVKSYSESYADCITGVTVY

SEQ ID NO: 2184787 - protein, 23 aa, Cryptosporidium hominis
YVLEALSKYFAYEICVGQNGIIW

SEQ ID NO: 2184788 - protein, 28 aa, Cryptosporidium hominis
YVLEINMSCSIIWSILYCEEIVCKPRVV

SEQ ID NO: 2184789 - protein, 22 aa, Cryptosporidium hominis
YVLVAWNRRYMWVYCHDIKSFT

SEQ ID NO: 2184790 - protein, 24 aa, Cryptosporidium hominis
YVNCKPLYLDVERIVSTVLVKNPY

SEQ ID NO: 2184791 - protein, 18 aa, Cryptosporidium hominis
YVNECISIIIPLIQGYDE

SEQ ID NO: 2184792 - protein, 17 aa, Cryptosporidium hominis
YVNSIIFRMRRICNHTL

SEQ ID NO: 2184793 - protein, 23 aa, Cryptosporidium hominis
YVPAFSGKFAFLPQPPLDGSSST

SEQ ID NO: 2184794 - protein, 21 aa, Cryptosporidium hominis
YVPECVGGRLPIMVDPTDPIY

SEQ ID NO: 2184795 - protein, 18 aa, Cryptosporidium hominis
YVPIIPMILVNGTDGIGT

SEQ ID NO: 2184796 - protein, 25 aa, Cryptosporidium hominis
YVQGMNFLVGCILWHSNSEEQAFEL

SEQ ID NO: 2184797 - protein, 26 aa, Cryptosporidium hominis
YVRGVKCGHGIYTWPNGDRFEGEYKD

SEQ ID NO: 2184798 - protein, 24 aa, Cryptosporidium hominis
YVTGAKGSFLRRVEDETGTFIFID

SEQ ID NO: 2184799 - protein, 22 aa, Cryptosporidium hominis
YVTLMPCISCTKNIIQCEIERV

SEQ ID NO: 2184800 - protein, 18 aa, Cryptosporidium hominis
YVTYKGVYALSINVPSKE

SEQ ID NO: 2184801 - protein, 17 aa, Cryptosporidium hominis
YVYGIKQVRIFSNTMRS

SEQ ID NO: 2184802 - protein, 20 aa, Cryptosporidium hominis
YWDGSGHRRSVHVPRNTTIG

SEQ ID NO: 2184803 - protein, 28 aa, Cryptosporidium hominis
YWERIFQLIPCPYLCLSATIGNPLAFYN

SEQ ID NO: 2184804 - protein, 25 aa, Cryptosporidium hominis
YWKDKESRVYARFTWATRKYSKSFY

SEQ ID NO: 2184805 - protein, 29 aa, Cryptosporidium hominis
YWKFEQSLCILLRLSTCLNPYSDIRESIS

SEQ ID NO: 2184806 - protein, 17 aa, Cryptosporidium hominis
YWLDPYKPIKLTREVKD

SEQ ID NO: 2184807 - protein, 19 aa, Cryptosporidium hominis
YWLNLIMKEEMGGISDGKD

SEQ ID NO: 2184808 - protein, 19 aa, Cryptosporidium hominis
YWQLIKRLLNLFVDESESE

SEQ ID NO: 2184809 - protein, 27 aa, Cryptosporidium hominis
YWTKRGPIKFCIVCGENIQINSDFFDR

SEQ ID NO: 2184810 - protein, 19 aa, Cryptosporidium hominis
YWTPFYFKETENFVKSIRN

SEQ ID NO: 2184811 - protein, 21 aa, Cryptosporidium hominis
YWYPYELDIPIKGYFTISPES

SEQ ID NO: 2184812 - protein, 17 aa, Cryptosporidium hominis
YYCNSGLIDNNKDWQLG

SEQ ID NO: 2184813 - protein, 17 aa, Cryptosporidium hominis
YYDSPRKITFFISLLRT

SEQ ID NO: 2184814 - protein, 21 aa, Cryptosporidium hominis
YYDTWCYLSILTGPNHHFTVA

SEQ ID NO: 2184815 - protein, 17 aa, Cryptosporidium hominis
YYELDILEIRKLRFKDF

SEQ ID NO: 2184816 - protein, 24 aa, Cryptosporidium hominis
YYFFAKKRQIVFLTRRGKVGEVRI

SEQ ID NO: 2184817 - protein, 24 aa, Cryptosporidium hominis
YYGELRFSTRIFKNALVFVLGEKE

SEQ ID NO: 2184818 - protein, 25 aa, Cryptosporidium hominis
YYGKIPRYLAILALNLKGHSFVSLN

SEQ ID NO: 2184819 - protein, 17 aa, Cryptosporidium hominis
YYHPLIVELVYKSILIC

SEQ ID NO: 2184820 - protein, 26 aa, Cryptosporidium hominis
YYKASEMERSVIIPRSKFVSHSSNPP

SEQ ID NO: 2184821 - protein, 17 aa, Cryptosporidium hominis
YYKLRNIVGNKFPRKSS

SEQ ID NO: 2184822 - protein, 23 aa, Cryptosporidium hominis
YYLELCGEYALYIDSNWDQIDIL

SEQ ID NO: 2184823 - protein, 17 aa, Cryptosporidium hominis
YYNSRILSLCKRSRDSL

SEQ ID NO: 2184824 - protein, 19 aa, Cryptosporidium hominis
YYQIISCRSKLFTIPQSFV

SEQ ID NO: 2184825 - protein, 19 aa, Cryptosporidium hominis
YYRKKKNMSLYAFGGTQGS

SEQ ID NO: 2184826 - protein, 29 aa, Cryptosporidium hominis
YYSRKRPILCITVGLGFDSFIVVRNTFTE

SEQ ID NO: 2184827 - protein, 21 aa, Cryptosporidium hominis
YYYCLSRMRLYSSILGVMTPP

SEQ ID NO: 2184828 - protein, 18 aa, Cryptosporidium hominis
YYYPYFDKSINEFNPLYN

SEQ ID NO: 2184829 - protein, 18 aa, Cryptosporidium hominis
YYYYKNKIKIGGNNYNEY

SEQ ID NO: 2184830 - protein, 20 aa, Cryptosporidium hominis
TLHLVLRLRGGMQIFVKTLT

SEQ ID NO: 2184831 - protein, 19 aa, Cryptosporidium hominis
AAEISRPLSLQAYADVLTH

SEQ ID NO: 2184832 - protein, 21 aa, Cryptosporidium hominis
AAELRSQYILRRIKENNCIKN

SEQ ID NO: 2184833 - protein, 18 aa, Cryptosporidium hominis
AAMEICKTASTLFDTTDG

SEQ ID NO: 2184834 - protein, 18 aa, Cryptosporidium hominis
ACETCTKTGFIMVFGEIT

SEQ ID NO: 2184835 - protein, 18 aa, Cryptosporidium hominis
ACKGIGKFHAKWIPVSVA

SEQ ID NO: 2184836 - protein, 19 aa, Cryptosporidium hominis
ACPICKKKVLFSTSYCEKC

SEQ ID NO: 2184837 - protein, 24 aa, Cryptosporidium hominis
ADAQEFKPTFGITGSNVIPNSGIY

SEQ ID NO: 2184838 - protein, 20 aa, Cryptosporidium hominis
ADIWSLGAILYRITYKRHLF

SEQ ID NO: 2184839 - protein, 22 aa, Cryptosporidium hominis
ADLSLWCSLKITLLGELPLSSK

SEQ ID NO: 2184840 - protein, 19 aa, Cryptosporidium hominis
ADRGWSDFFSLKTLLDPKT

SEQ ID NO: 2184841 - protein, 19 aa, Cryptosporidium hominis
ADSFIPVFYQFVTIYMQET

SEQ ID NO: 2184842 - protein, 20 aa, Cryptosporidium hominis
AEQFLVFLIKLIIKLREDED

SEQ ID NO: 2184843 - protein, 21 aa, Cryptosporidium hominis
AFKARTSLLLGQGIIEEPEDT

SEQ ID NO: 2184844 - protein, 22 aa, Cryptosporidium hominis
AFKRELIELFKIEVEILNGIQE

SEQ ID NO: 2184845 - protein, 18 aa, Cryptosporidium hominis
AFSLIRWIAIADCIALHI

SEQ ID NO: 2184846 - protein, 18 aa, Cryptosporidium hominis
AGGLCSIDGAFYAASADQ

SEQ ID NO: 2184847 - protein, 24 aa, Cryptosporidium hominis
AGILKRSLPLVFSRYMSSKCEGKK

SEQ ID NO: 2184848 - protein, 25 aa, Cryptosporidium hominis
AGISRLKLVFSYYDWGWKGYLDEFD

SEQ ID NO: 2184849 - protein, 22 aa, Cryptosporidium hominis
AGLKKHRLVFCEKPESIPNMAR

SEQ ID NO: 2184850 - protein, 17 aa, Cryptosporidium hominis
AGLLFYKKKYHEVVTPS

SEQ ID NO: 2184851 - protein, 18 aa, Cryptosporidium hominis
AHLLGFFKRLCKLLYYGI

SEQ ID NO: 2184852 - protein, 24 aa, Cryptosporidium hominis
AHPWKYRYAAIMAIAQTIEYLPED

SEQ ID NO: 2184853 - protein, 24 aa, Cryptosporidium hominis
AIDEAHCVCQWGFDFRPDYIQLCK

SEQ ID NO: 2184854 - protein, 17 aa, Cryptosporidium hominis
AIEWTFEDVQAMFEKEE

SEQ ID NO: 2184855 - protein, 21 aa, Cryptosporidium hominis
AILPKVEWILCFPVNQCSINT

SEQ ID NO: 2184856 - protein, 20 aa, Cryptosporidium hominis
AILPWFRLGSRPILSDESDE

SEQ ID NO: 2184857 - protein, 43 aa, Cryptosporidium hominis
AILYRKRKLHVLGIIRLIGELFIRKMFPMRSLNELVFDLVMIQ

SEQ ID NO: 2184858 - protein, 20 aa, Cryptosporidium hominis
AIPPPHMYAPNMARPGPYAQ

SEQ ID NO: 2184859 - protein, 18 aa, Cryptosporidium hominis
AISSFLLGRNSLYSPTSV

SEQ ID NO: 2184860 - protein, 18 aa, Cryptosporidium hominis
AKCPTEWRVRGITWHAER

SEQ ID NO: 2184861 - protein, 23 aa, Cryptosporidium hominis
AKKFKCPICFSNVLLNELVSLRY

SEQ ID NO: 2184862 - protein, 23 aa, Cryptosporidium hominis
AKLVCFYCDLLLKNSYSEIGNDF

SEQ ID NO: 2184863 - protein, 24 aa, Cryptosporidium hominis
AKRSFKISKIYLIFYSCNKTVLNI

SEQ ID NO: 2184864 - protein, 21 aa, Cryptosporidium hominis
AKTLMYCFGEYGALEAEKHIR

SEQ ID NO: 2184865 - protein, 19 aa, Cryptosporidium hominis
ALAKQCYRGMMGVQGREFL

SEQ ID NO: 2184866 - protein, 26 aa, Cryptosporidium hominis
ALCRHWMRGYCWLEADCKFAHGEAEL

SEQ ID NO: 2184867 - protein, 20 aa, Cryptosporidium hominis
ALLASCCGKGQLLLTLVYGN

SEQ ID NO: 2184868 - protein, 24 aa, Cryptosporidium hominis
ALPKRPIMYFAKWKHLSFADNTWE

SEQ ID NO: 2184869 - protein, 17 aa, Cryptosporidium hominis
ALTGWRGRLLVGINKTL

SEQ ID NO: 2184870 - protein, 20 aa, Cryptosporidium hominis
ALTIRCLNIRHTISLEAIIG

SEQ ID NO: 2184871 - protein, 23 aa, Cryptosporidium hominis
AMRLKEWYGWHFPELGKIISDRD

SEQ ID NO: 2184872 - protein, 20 aa, Cryptosporidium hominis
AMSCIFEIDLLFKQLNLRNA

SEQ ID NO: 2184873 - protein, 24 aa, Cryptosporidium hominis
ANCSPRLKINIIWPTTLKNYTMYS

SEQ ID NO: 2184874 - protein, 17 aa, Cryptosporidium hominis
APIEWHWTFHTPEDLTF

SEQ ID NO: 2184875 - protein, 19 aa, Cryptosporidium hominis
APWPMGVTMVGIHERAGRT

SEQ ID NO: 2184876 - protein, 20 aa, Cryptosporidium hominis
AQAIYHPWFEKIQLSPGIMI

SEQ ID NO: 2184877 - protein, 19 aa, Cryptosporidium hominis
AQHFKFNLMRILKRIKQTE

SEQ ID NO: 2184878 - protein, 20 aa, Cryptosporidium hominis
AQKYFLKKVRGIAPSTLTMD

SEQ ID NO: 2184879 - protein, 19 aa, Cryptosporidium hominis
ARAAAPCVLFFDELDSIGT

SEQ ID NO: 2184880 - protein, 19 aa, Cryptosporidium hominis
ARCSGRKLLRFNYAKKLQF

SEQ ID NO: 2184881 - protein, 18 aa, Cryptosporidium hominis
ARFAKWRAVLTIDQAKGK

SEQ ID NO: 2184882 - protein, 21 aa, Cryptosporidium hominis
ARFQVCQHIACYDCVRLALMI

SEQ ID NO: 2184883 - protein, 17 aa, Cryptosporidium hominis
ARILCAFELVKIGDMMG

SEQ ID NO: 2184884 - protein, 19 aa, Cryptosporidium hominis
ARLAFPLLIQRFKDLREEA

SEQ ID NO: 2184885 - protein, 17 aa, Cryptosporidium hominis
ARLKMFLGQVMVESAPK

SEQ ID NO: 2184886 - protein, 17 aa, Cryptosporidium hominis
ARRLFRKPVNTLLPGTY

SEQ ID NO: 2184887 - protein, 26 aa, Cryptosporidium hominis
ARRYFPRSISCPGILLRNGLIVTDRY

SEQ ID NO: 2184888 - protein, 17 aa, Cryptosporidium hominis
ARVFFIHRIKRQLLLFS

SEQ ID NO: 2184889 - protein, 19 aa, Cryptosporidium hominis
ASCCITLEWSVCGRFLLAS

SEQ ID NO: 2184890 - protein, 20 aa, Cryptosporidium hominis
ASFKCTLLLLPNGSKRISGL

SEQ ID NO: 2184891 - protein, 25 aa, Cryptosporidium hominis
ASIMGARCVVVWIGIRDCLSQESLF

SEQ ID NO: 2184892 - protein, 18 aa, Cryptosporidium hominis
ATELFTFKCSLYQRELKL

SEQ ID NO: 2184893 - protein, 18 aa, Cryptosporidium hominis
ATKISYNGKQRWRVVTVN

SEQ ID NO: 2184894 - protein, 17 aa, Cryptosporidium hominis
ATLPWLFELNMDRLFPT

SEQ ID NO: 2184895 - protein, 18 aa, Cryptosporidium hominis
ATSAKIMPEDTIFKQDWT

SEQ ID NO: 2184896 - protein, 24 aa, Cryptosporidium hominis
AVINCSDWPTSVSFHPIQKNIIFI

SEQ ID NO: 2184897 - protein, 19 aa, Cryptosporidium hominis
AVRICTLLKVWRISTQTDI

SEQ ID NO: 2184898 - protein, 19 aa, Cryptosporidium hominis
AYLARLGHRVIQKAHGAPI

SEQ ID NO: 2184899 - protein, 23 aa, Cryptosporidium hominis
AYMPPECWKIFWRLEENKIQFPL

SEQ ID NO: 2184900 - protein, 22 aa, Cryptosporidium hominis
AYPEMLEILLSCQSEDLRPNNG

SEQ ID NO: 2184901 - protein, 19 aa, Cryptosporidium hominis
AYRLCFLACHIEVVNAIAS

SEQ ID NO: 2184902 - protein, 17 aa, Cryptosporidium hominis
AYVCPKCGLIISSISKR

SEQ ID NO: 2184903 - protein, 17 aa, Cryptosporidium hominis
CADICWLKGSKVLVNGT

SEQ ID NO: 2184904 - protein, 19 aa, Cryptosporidium hominis
CAHIICIDCYKLISKKSSS

SEQ ID NO: 2184905 - protein, 21 aa, Cryptosporidium hominis
CAPEKSGIMTPEFPGSHDSNY

SEQ ID NO: 2184906 - protein, 17 aa, Cryptosporidium hominis
CCFSVPFFQGSPIYKAC

SEQ ID NO: 2184907 - protein, 22 aa, Cryptosporidium hominis
CCITCLKKSFNIIFGINKKFDY

SEQ ID NO: 2184908 - protein, 17 aa, Cryptosporidium hominis
CCLSWNMYQVAYFIKCI

SEQ ID NO: 2184909 - protein, 18 aa, Cryptosporidium hominis
CDIGRGAIFFSIARGKVA

SEQ ID NO: 2184910 - protein, 18 aa, Cryptosporidium hominis
CFLCGELGHTLKDCKKPR

SEQ ID NO: 2184911 - protein, 19 aa, Cryptosporidium hominis
CFNEIRFRRKLNFLKDSVR

SEQ ID NO: 2184912 - protein, 22 aa, Cryptosporidium hominis
CFRFSFLGLRSNEQWLGELFSL

SEQ ID NO: 2184913 - protein, 20 aa, Cryptosporidium hominis
CFSCSYCFEGYGMTELLAAS

SEQ ID NO: 2184914 - protein, 22 aa, Cryptosporidium hominis
CFSLKVPPVFCNNGNLLLIPKG

SEQ ID NO: 2184915 - protein, 18 aa, Cryptosporidium hominis
CGDVPYGKRIHVLPFDDC

SEQ ID NO: 2184916 - protein, 23 aa, Cryptosporidium hominis
CGHIYCWPCIIKLMNIILENDEY

SEQ ID NO: 2184917 - protein, 17 aa, Cryptosporidium hominis
CGIPSYLILQFFDKNNM

SEQ ID NO: 2184918 - protein, 18 aa, Cryptosporidium hominis
CGKLCLLDKLLSRLREKG

SEQ ID NO: 2184919 - protein, 20 aa, Cryptosporidium hominis
CGKPCIYSYYILRAGVVCGV

SEQ ID NO: 2184920 - protein, 20 aa, Cryptosporidium hominis
CGLWNAAVRLHLEFIGEIPM

SEQ ID NO: 2184921 - protein, 17 aa, Cryptosporidium hominis
CGVEEYLFILVLKLPSI

SEQ ID NO: 2184922 - protein, 19 aa, Cryptosporidium hominis
CHNYWKFPDINVFVNNDSH

SEQ ID NO: 2184923 - protein, 19 aa, Cryptosporidium hominis
CHRAHWGIGYVWFKREEYY

SEQ ID NO: 2184924 - protein, 19 aa, Cryptosporidium hominis
CICIYYKYISGVFYISQHC

SEQ ID NO: 2184925 - protein, 19 aa, Cryptosporidium hominis
CICLDPKPGHFVLDLCSAP

SEQ ID NO: 2184926 - protein, 21 aa, Cryptosporidium hominis
CIECKEELFSFEGFRYQCKQV

SEQ ID NO: 2184927 - protein, 21 aa, Cryptosporidium hominis
CKCNACGYIGALDNNHKITTY

SEQ ID NO: 2184928 - protein, 24 aa, Cryptosporidium hominis
CKCRYQICLWCFYHVRDQLDNKCP

SEQ ID NO: 2184929 - protein, 19 aa, Cryptosporidium hominis
CKGILFAIQVCKAIMEGNY

SEQ ID NO: 2184930 - protein, 19 aa, Cryptosporidium hominis
CKHLFSWIEYEMALLGNSI

SEQ ID NO: 2184931 - protein, 18 aa, Cryptosporidium hominis
CKHVRWIIQIPRLYNIFY

SEQ ID NO: 2184932 - protein, 24 aa, Cryptosporidium hominis
CKKCQVKFHFECCISDNIMNLNNL

SEQ ID NO: 2184933 - protein, 19 aa, Cryptosporidium hominis
CKREFDHINAFNVIPGELS

SEQ ID NO: 2184934 - protein, 21 aa, Cryptosporidium hominis
CKSKRPASVLMISFNSESSVQ

SEQ ID NO: 2184935 - protein, 20 aa, Cryptosporidium hominis
CLKCIKRKSLQYLFMKSKQK

SEQ ID NO: 2184936 - protein, 19 aa, Cryptosporidium hominis
CLLGLYYAMLLKWFDYETF

SEQ ID NO: 2184937 - protein, 23 aa, Cryptosporidium hominis
CLRSMRVSVRWLRLASSMHLNLY

SEQ ID NO: 2184938 - protein, 19 aa, Cryptosporidium hominis
CMQLYRQALNFALHGLKYE

SEQ ID NO: 2184939 - protein, 24 aa, Cryptosporidium hominis
CNHILCWKCIINVDEIFYLDSNTS

SEQ ID NO: 2184940 - protein, 17 aa, Cryptosporidium hominis
CNICGSVKHLARNCDQQ

SEQ ID NO: 2184941 - protein, 22 aa, Cryptosporidium hominis
CNPKCLICSQVLVKIKIVSFDK

SEQ ID NO: 2184942 - protein, 19 aa, Cryptosporidium hominis
CNVPKWIAQQVWFKCSFLS

SEQ ID NO: 2184943 - protein, 18 aa, Cryptosporidium hominis
CNYIKYSTQWYLWAKRRN

SEQ ID NO: 2184944 - protein, 17 aa, Cryptosporidium hominis
CPCCRKPDSCFCGIEKD

SEQ ID NO: 2184945 - protein, 20 aa, Cryptosporidium hominis
CPVCHGFVKYIADFEYGETD

SEQ ID NO: 2184946 - protein, 20 aa, Cryptosporidium hominis
CPVWIPPWWTAFRIGGWNWQ

SEQ ID NO: 2184947 - protein, 26 aa, Cryptosporidium hominis
CPYGPGCFFIHPTVPCRYGLACYNSL

SEQ ID NO: 2184948 - protein, 18 aa, Cryptosporidium hominis
CQQLPCSALEFLTGEYEL

SEQ ID NO: 2184949 - protein, 21 aa, Cryptosporidium hominis
CRGGRGGGYVGMFVDGKGNGR

SEQ ID NO: 2184950 - protein, 19 aa, Cryptosporidium hominis
CRMWYDMTQFFGFLGEDII

SEQ ID NO: 2184951 - protein, 20 aa, Cryptosporidium hominis
CRRCNSMAGTFCYMAPEILK

SEQ ID NO: 2184952 - protein, 23 aa, Cryptosporidium hominis
CSFKDLNVYFGWETPLVIPIITE

SEQ ID NO: 2184953 - protein, 18 aa, Cryptosporidium hominis
CSHSFHFGCMLLKYTSLM

SEQ ID NO: 2184954 - protein, 25 aa, Cryptosporidium hominis
CSIEWKNRFFFGFALREHYGPIPLN

SEQ ID NO: 2184955 - protein, 17 aa, Cryptosporidium hominis
CSIWKIERLIGGGSFGD

SEQ ID NO: 2184956 - protein, 17 aa, Cryptosporidium hominis
CSLIRVGGKKVYKSNKN

SEQ ID NO: 2184957 - protein, 18 aa, Cryptosporidium hominis
CSSIPGFFQNKLGWFNCV

SEQ ID NO: 2184958 - protein, 27 aa, Cryptosporidium hominis
CSWSSNPFLCRKCCKKSSVQPSITYDI

SEQ ID NO: 2184959 - protein, 18 aa, Cryptosporidium hominis
CTEFPGNFIFFLAAAVSD

SEQ ID NO: 2184960 - protein, 18 aa, Cryptosporidium hominis
CTRFRGFVFDIVHSDIPT

SEQ ID NO: 2184961 - protein, 30 aa, Cryptosporidium hominis
CTRSWRDAKAWRYSLLVARKSKMADNSYEE

SEQ ID NO: 2184962 - protein, 18 aa, Cryptosporidium hominis
CTSEFCLACELVHLTFML

SEQ ID NO: 2184963 - protein, 17 aa, Cryptosporidium hominis
CVFDHWELINGDPLEKG

SEQ ID NO: 2184964 - protein, 17 aa, Cryptosporidium hominis
CVKKCPYSAITIINLPK

SEQ ID NO: 2184965 - protein, 19 aa, Cryptosporidium hominis
CVSIIPSVRSIYKFKGQVH

SEQ ID NO: 2184966 - protein, 19 aa, Cryptosporidium hominis
CWCPWDFGLQFACAISDGS

SEQ ID NO: 2184967 - protein, 20 aa, Cryptosporidium hominis
CWDAEVLTSYGWIECAGHAD

SEQ ID NO: 2184968 - protein, 18 aa, Cryptosporidium hominis
CYSCESWSTLDLILNKTK

SEQ ID NO: 2184969 - protein, 20 aa, Cryptosporidium hominis
CYWVRIKLSYLFKEGEELPA

SEQ ID NO: 2184970 - protein, 24 aa, Cryptosporidium hominis
DADILCTMPWQFVIIDEAHRLKNR

SEQ ID NO: 2184971 - protein, 17 aa, Cryptosporidium hominis
DALDWIKKTFLYIRIIR

SEQ ID NO: 2184972 - protein, 22 aa, Cryptosporidium hominis
DAYKLKSSFGWEHVKGSSKLFF

SEQ ID NO: 2184973 - protein, 23 aa, Cryptosporidium hominis
DCFSDKLFSEWVFKLNGKKELYQ

SEQ ID NO: 2184974 - protein, 17 aa, Cryptosporidium hominis
DDKFCICVQSIIGEIFE

SEQ ID NO: 2184975 - protein, 19 aa, Cryptosporidium hominis
DDPKLCWRCHKRDATPHMR

SEQ ID NO: 2184976 - protein, 18 aa, Cryptosporidium hominis
DDTIKIWNMKGFGCVRTM

SEQ ID NO: 2184977 - protein, 19 aa, Cryptosporidium hominis
DDYFPRYSIIPNKECIDKW

SEQ ID NO: 2184978 - protein, 17 aa, Cryptosporidium hominis
DEEFIYLLLDFKISMIP

SEQ ID NO: 2184979 - protein, 20 aa, Cryptosporidium hominis
DEEHNRFVLALKKFGRNWTL

SEQ ID NO: 2184980 - protein, 20 aa, Cryptosporidium hominis
DEELLRWIAEAEYLGVSRET

SEQ ID NO: 2184981 - protein, 23 aa, Cryptosporidium hominis
DEIIAKVSSCFFCQQGQNSQIED

SEQ ID NO: 2184982 - protein, 24 aa, Cryptosporidium hominis
DELEMRLVLYLLKYFAPIWDTKVR

SEQ ID NO: 2184983 - protein, 20 aa, Cryptosporidium hominis
DELSSLTVIICWIEECLQNF

SEQ ID NO: 2184984 - protein, 20 aa, Cryptosporidium hominis
DEVPLRLGYTGVKNRSSADL

SEQ ID NO: 2184985 - protein, 20 aa, Cryptosporidium hominis
DEYFEAFPLAISETLEINQL

SEQ ID NO: 2184986 - protein, 24 aa, Cryptosporidium hominis
DFAKEIIKSIGLKPIYFDCIKNLL

SEQ ID NO: 2184987 - protein, 20 aa, Cryptosporidium hominis
DFDVPFSLKFGAFDDLVKLV

SEQ ID NO: 2184988 - protein, 18 aa, Cryptosporidium hominis
DFEKLRISYNLPIMNIND

SEQ ID NO: 2184989 - protein, 24 aa, Cryptosporidium hominis
DFPSFPYKYGMAITSLLADGQSNS

SEQ ID NO: 2184990 - protein, 19 aa, Cryptosporidium hominis
DFRNIPMLVSNLFGTTNLK

SEQ ID NO: 2184991 - protein, 18 aa, Cryptosporidium hominis
DFSELIVLKELPKLETLS

SEQ ID NO: 2184992 - protein, 18 aa, Cryptosporidium hominis
DFYYKYKYTLGFKRILRL

SEQ ID NO: 2184993 - protein, 19 aa, Cryptosporidium hominis
DGESMYLWLGRAIPTTFIQ

SEQ ID NO: 2184994 - protein, 20 aa, Cryptosporidium hominis
DGIRLNGKIDLLRGIQIAQL

SEQ ID NO: 2184995 - protein, 23 aa, Cryptosporidium hominis
DGKNSFKVLFSWLNEELKLPSIE

SEQ ID NO: 2184996 - protein, 20 aa, Cryptosporidium hominis
DGNCSRGFFLADIQNISEQF

SEQ ID NO: 2184997 - protein, 20 aa, Cryptosporidium hominis
DGPWRACLCRLGYDPRKDPE

SEQ ID NO: 2184998 - protein, 24 aa, Cryptosporidium hominis
DHFMFKICLLFSIQIVPISNDHTE

SEQ ID NO: 2184999 - protein, 19 aa, Cryptosporidium hominis
DIIDWKGCNPLILISSFFC

SEQ ID NO: 2185000 - protein, 19 aa, Cryptosporidium hominis
DIMQFYLFYCPKCIHLKQS

SEQ ID NO: 2185001 - protein, 21 aa, Cryptosporidium hominis
DIQYIWRRNCPYLYDTMLSYT

SEQ ID NO: 2185002 - protein, 22 aa, Cryptosporidium hominis
DITEVFSVLGIEAVRRALLREL

SEQ ID NO: 2185003 - protein, 23 aa, Cryptosporidium hominis
DITFPSTFCFPSLSDGRSFTAEI

SEQ ID NO: 2185004 - protein, 18 aa, Cryptosporidium hominis
DKRFPLNFLSYLEDVSVE

SEQ ID NO: 2185005 - protein, 18 aa, Cryptosporidium hominis
DKRLRSWIFGDLENIGYN

SEQ ID NO: 2185006 - protein, 26 aa, Cryptosporidium hominis
DLCNNWYHWYCLGLHKDNIPSENEPF

SEQ ID NO: 2185007 - protein, 23 aa, Cryptosporidium hominis
DLCNRRKTNISWDIEFKVTETYV

SEQ ID NO: 2185008 - protein, 23 aa, Cryptosporidium hominis
DLDYKAIFTWRRFNQIKYVLDTR

SEQ ID NO: 2185009 - protein, 21 aa, Cryptosporidium hominis
DLLKRYQCCIDLHQNALIIGD

SEQ ID NO: 2185010 - protein, 20 aa, Cryptosporidium hominis
DLLLSYILHRLFDTPFTDED

SEQ ID NO: 2185011 - protein, 22 aa, Cryptosporidium hominis
DLLPTSVCPLIIIGEITSDEQK

SEQ ID NO: 2185012 - protein, 23 aa, Cryptosporidium hominis
DLRIPCGLFKTFALISSHSIFVQ

SEQ ID NO: 2185013 - protein, 23 aa, Cryptosporidium hominis
DLTRTGFIIFWGGRELDSFNIGN

SEQ ID NO: 2185014 - protein, 19 aa, Cryptosporidium hominis
DLTSFSWNFTRRAKRRTVQ

SEQ ID NO: 2185015 - protein, 18 aa, Cryptosporidium hominis
DLVCCLWGSPGVYGVVTT

SEQ ID NO: 2185016 - protein, 25 aa, Cryptosporidium hominis
DNCKYRHCLPVGYVIKEQESDDGGD

SEQ ID NO: 2185017 - protein, 20 aa, Cryptosporidium hominis
DNELLRLLVLLNRIQLLNDV

SEQ ID NO: 2185018 - protein, 17 aa, Cryptosporidium hominis
DNIRFGLDYNNIGSISS

SEQ ID NO: 2185019 - protein, 19 aa, Cryptosporidium hominis
DNLYHWNKQMNVIKNVSSS

SEQ ID NO: 2185020 - protein, 27 aa, Cryptosporidium hominis
DNLYRALRFGGLLVRIPPYNQKSYEHF

SEQ ID NO: 2185021 - protein, 20 aa, Cryptosporidium hominis
DPFVGYGFLPYIVKMVWEKV

SEQ ID NO: 2185022 - protein, 24 aa, Cryptosporidium hominis
DPIKSDFCMLQFSRFISHYFEFPD

SEQ ID NO: 2185023 - protein, 23 aa, Cryptosporidium hominis
DPILLRIPLLFSDIYSNPADVAP

SEQ ID NO: 2185024 - protein, 24 aa, Cryptosporidium hominis
DPKVKFKALRLIKHLCENGNPTFK

SEQ ID NO: 2185025 - protein, 20 aa, Cryptosporidium hominis
DPLLRLGAGLPHNSSGTPCI

SEQ ID NO: 2185026 - protein, 23 aa, Cryptosporidium hominis
DPNRLRVAFRIIFLDEQGDIEPG

SEQ ID NO: 2185027 - protein, 21 aa, Cryptosporidium hominis
DPRILPELLVRIGQSNPEILQ

SEQ ID NO: 2185028 - protein, 23 aa, Cryptosporidium hominis
DQILKWNWYYRMEQLYYDWQGYF

SEQ ID NO: 2185029 - protein, 18 aa, Cryptosporidium hominis
DQLFKFLIRKNHRRTTLK

SEQ ID NO: 2185030 - protein, 24 aa, Cryptosporidium hominis
DQLIKWRLELIPSILNIFQSPLSK

SEQ ID NO: 2185031 - protein, 22 aa, Cryptosporidium hominis
DRFSRWSVLLGFSLPNLVEESE

SEQ ID NO: 2185032 - protein, 17 aa, Cryptosporidium hominis
DRILLILNQMERLNEII

SEQ ID NO: 2185033 - protein, 17 aa, Cryptosporidium hominis
DRLGAVCDFSYTSYSRG

SEQ ID NO: 2185034 - protein, 21 aa, Cryptosporidium hominis
DRMIIGGGMAFTFKKVMDNME

SEQ ID NO: 2185035 - protein, 18 aa, Cryptosporidium hominis
DRPGSCFFGRFSVPTHAQ

SEQ ID NO: 2185036 - protein, 19 aa, Cryptosporidium hominis
DRRELCSGYDLFLSDDRII

SEQ ID NO: 2185037 - protein, 17 aa, Cryptosporidium hominis
DRSDRLALRNAKKQQIE

SEQ ID NO: 2185038 - protein, 22 aa, Cryptosporidium hominis
DSFIPIIIPIFIKWKSKQFNSK

SEQ ID NO: 2185039 - protein, 18 aa, Cryptosporidium hominis
DSFRFERGLSLFLEIPKE

SEQ ID NO: 2185040 - protein, 17 aa, Cryptosporidium hominis
DSGQRWCMLMGLCPVTN

SEQ ID NO: 2185041 - protein, 19 aa, Cryptosporidium hominis
DSIAWGCCEILKNFDHSRW

SEQ ID NO: 2185042 - protein, 25 aa, Cryptosporidium hominis
DSIHWMIIIALRFIALSSLQLGNYA

SEQ ID NO: 2185043 - protein, 30 aa, Cryptosporidium hominis
DSTRGSSIARCFKKGLGGSILSSCMGVNDT

SEQ ID NO: 2185044 - protein, 18 aa, Cryptosporidium hominis
DTYLLFDLCKEFDLRFIV

SEQ ID NO: 2185045 - protein, 20 aa, Cryptosporidium hominis
DVCIWKLVTEWSVEERMVFG

SEQ ID NO: 2185046 - protein, 25 aa, Cryptosporidium hominis
DVDFQRFCLGLGFDINSQNQVICDS

SEQ ID NO: 2185047 - protein, 18 aa, Cryptosporidium hominis
DVIFAFDEIVSFGYRESI

SEQ ID NO: 2185048 - protein, 19 aa, Cryptosporidium hominis
DVIHFILKFVVDIDRQIQD

SEQ ID NO: 2185049 - protein, 24 aa, Cryptosporidium hominis
DVVGSPQCGPYCSTYPKGYFAFWL

SEQ ID NO: 2185050 - protein, 19 aa, Cryptosporidium hominis
DWTLICTRIENGLKLGDQL

SEQ ID NO: 2185051 - protein, 19 aa, Cryptosporidium hominis
DYASWEMIKDLAISELKDI

SEQ ID NO: 2185052 - protein, 22 aa, Cryptosporidium hominis
DYNLCFIIKILIYLISNVKDGL

SEQ ID NO: 2185053 - protein, 20 aa, Cryptosporidium hominis
DYRFKTLYGHLAEYDTVSSN

SEQ ID NO: 2185054 - protein, 20 aa, Cryptosporidium hominis
DYYQFRWFHSWKKLLRNSSG

SEQ ID NO: 2185055 - protein, 19 aa, Cryptosporidium hominis
EAISACLFFFGFPKQAEKL

SEQ ID NO: 2185056 - protein, 17 aa, Cryptosporidium hominis
EALKRFINSVGYSENVD

SEQ ID NO: 2185057 - protein, 19 aa, Cryptosporidium hominis
EALPYIPLLLPIGITVMAV

SEQ ID NO: 2185058 - protein, 21 aa, Cryptosporidium hominis
EARGYFSFTMCMENIYKELFM

SEQ ID NO: 2185059 - protein, 19 aa, Cryptosporidium hominis
ECVICKRDKFGVATGLGTE

SEQ ID NO: 2185060 - protein, 24 aa, Cryptosporidium hominis
EDISLLPGWILRNLSLMREIDKKS

SEQ ID NO: 2185061 - protein, 17 aa, Cryptosporidium hominis
EDLIEWKAMIKEFYSND

SEQ ID NO: 2185062 - protein, 24 aa, Cryptosporidium hominis
EDLQAIFRRCYKNSLWRKKEVETN

SEQ ID NO: 2185063 - protein, 23 aa, Cryptosporidium hominis
EDTIFKQDWTLFVIISTGIPEYE

SEQ ID NO: 2185064 - protein, 21 aa, Cryptosporidium hominis
EDYYRRINVQPAIVDTPMSPR

SEQ ID NO: 2185065 - protein, 17 aa, Cryptosporidium hominis
EEAKLITACKVYTNELE

SEQ ID NO: 2185066 - protein, 24 aa, Cryptosporidium hominis
EEDRVNCPFYWKIGACRHGDQCSR

SEQ ID NO: 2185067 - protein, 22 aa, Cryptosporidium hominis
EEEKEVWNIFSFSPVEDKSVYD

SEQ ID NO: 2185068 - protein, 22 aa, Cryptosporidium hominis
EEFYYKNIESIPRCYDELIDMS

SEQ ID NO: 2185069 - protein, 17 aa, Cryptosporidium hominis
EEINFYFNQVFRELIPN

SEQ ID NO: 2185070 - protein, 19 aa, Cryptosporidium hominis
EEKAIWCFKLSIHFNPMNV

SEQ ID NO: 2185071 - protein, 26 aa, Cryptosporidium hominis
EENIRYFLYWRRMRMQLKREERRQLN

SEQ ID NO: 2185072 - protein, 17 aa, Cryptosporidium hominis
EENWWAILIKIGVPNLP

SEQ ID NO: 2185073 - protein, 23 aa, Cryptosporidium hominis
EEYKLEWWLGIIEKLCDKNKSLL

SEQ ID NO: 2185074 - protein, 21 aa, Cryptosporidium hominis
EFCPKVPWLFQLMEYCNSGSL

SEQ ID NO: 2185075 - protein, 20 aa, Cryptosporidium hominis
EFDLRFIVIHDRYIPPSGKQ

SEQ ID NO: 2185076 - protein, 22 aa, Cryptosporidium hominis
EFEWLYCILKYLAFFNSKFGFY

SEQ ID NO: 2185077 - protein, 21 aa, Cryptosporidium hominis
EFFFCLECIRSSKLIDTSWML

SEQ ID NO: 2185078 - protein, 23 aa, Cryptosporidium hominis
EFRRRYLEEFLRRIFNRGYLISS

SEQ ID NO: 2185079 - protein, 18 aa, Cryptosporidium hominis
EGFLSKGGGFWGALNRNS

SEQ ID NO: 2185080 - protein, 19 aa, Cryptosporidium hominis
EGLELLFLVGFREKQAEDQ

SEQ ID NO: 2185081 - protein, 25 aa, Cryptosporidium hominis
EGLKMVAKEKLSFWMDLPCNMDRKK

SEQ ID NO: 2185082 - protein, 23 aa, Cryptosporidium hominis
EGLPRKIAAFILQRHGNQIPYDR

SEQ ID NO: 2185083 - protein, 19 aa, Cryptosporidium hominis
EGNNGFCFLQFSSPLTSYR

SEQ ID NO: 2185084 - protein, 17 aa, Cryptosporidium hominis
EGPVIWSQYRRFLSHQN

SEQ ID NO: 2185085 - protein, 24 aa, Cryptosporidium hominis
EGVSKKLGSFIAERTDLFKVENNM

SEQ ID NO: 2185086 - protein, 25 aa, Cryptosporidium hominis
EHIQAIELLKYFWGLSLSPKDNDER

SEQ ID NO: 2185087 - protein, 19 aa, Cryptosporidium hominis
EHVKRFSIIYDQGIGMNGI

SEQ ID NO: 2185088 - protein, 23 aa, Cryptosporidium hominis
EICHYIFTFRIYKDFNEIESGKN

SEQ ID NO: 2185089 - protein, 22 aa, Cryptosporidium hominis
EIDLRVGSSFTRFLTLRYSRLF

SEQ ID NO: 2185090 - protein, 19 aa, Cryptosporidium hominis
EIFLRNSILQIFRNFTDLI

SEQ ID NO: 2185091 - protein, 26 aa, Cryptosporidium hominis
EIIFKVQCLWPVFLLPLVSGELFFTI

SEQ ID NO: 2185092 - protein, 17 aa, Cryptosporidium hominis
EILHEWSPSINLLTTVD

SEQ ID NO: 2185093 - protein, 25 aa, Cryptosporidium hominis
EIPHFKLFRKGNCSNGIREVQFSKR

SEQ ID NO: 2185094 - protein, 19 aa, Cryptosporidium hominis
EIRKTEVLDNWSFGSNEEF

SEQ ID NO: 2185095 - protein, 19 aa, Cryptosporidium hominis
EIRPVPCTVYISGFQEKNY

SEQ ID NO: 2185096 - protein, 19 aa, Cryptosporidium hominis
EIVNCCPKDVFALGGNTSK

SEQ ID NO: 2185097 - protein, 17 aa, Cryptosporidium hominis
EIYKLPDGFSWFDCNLW

SEQ ID NO: 2185098 - protein, 21 aa, Cryptosporidium hominis
EKKRFTIYGALVFENDVRNLL

SEQ ID NO: 2185099 - protein, 24 aa, Cryptosporidium hominis
EKKRIFEGLTFFISREVPLLPLAF

SEQ ID NO: 2185100 - protein, 20 aa, Cryptosporidium hominis
EKKVPVAFGLFKLQMGATII

SEQ ID NO: 2185101 - protein, 17 aa, Cryptosporidium hominis
EKMFLLIKLISKIYYYD

SEQ ID NO: 2185102 - protein, 17 aa, Cryptosporidium hominis
EKQEQFYILAILLGCDY

SEQ ID NO: 2185103 - protein, 18 aa, Cryptosporidium hominis
EKQILIWNGIPINKLSGK

SEQ ID NO: 2185104 - protein, 19 aa, Cryptosporidium hominis
EKSGSFFSAFSMKDQAKSK

SEQ ID NO: 2185105 - protein, 22 aa, Cryptosporidium hominis
EKSQMIVDQWFGRLRELQNTSI

SEQ ID NO: 2185106 - protein, 19 aa, Cryptosporidium hominis
EKVVWDYLHFLYRQNTGVL

SEQ ID NO: 2185107 - protein, 19 aa, Cryptosporidium hominis
EKWFRRGRKLFVRKFVQQL

SEQ ID NO: 2185108 - protein, 20 aa, Cryptosporidium hominis
EKYLIMSIGFAFKRKITRNR

SEQ ID NO: 2185109 - protein, 17 aa, Cryptosporidium hominis
EKYWLPENMNLYIDSAL

SEQ ID NO: 2185110 - protein, 22 aa, Cryptosporidium hominis
ELCGLLLSSFCGILDDFGLETQ

SEQ ID NO: 2185111 - protein, 24 aa, Cryptosporidium hominis
ELEILDRISFIWGYNNDNMYKINI

SEQ ID NO: 2185112 - protein, 22 aa, Cryptosporidium hominis
ELEPERFQSLMIVQSLNDKIVP

SEQ ID NO: 2185113 - protein, 21 aa, Cryptosporidium hominis
ELFKTAGRVVKVFLAKNKNNS

SEQ ID NO: 2185114 - protein, 23 aa, Cryptosporidium hominis
ELFRRNIDICLPKDSKFSSIIDF

SEQ ID NO: 2185115 - protein, 19 aa, Cryptosporidium hominis
ELHILFKRWDIRALNASNI

SEQ ID NO: 2185116 - protein, 24 aa, Cryptosporidium hominis
ELIGEVIIEIMLYFGKYYQNDEEI

SEQ ID NO: 2185117 - protein, 17 aa, Cryptosporidium hominis
ELIKRSALFAGHDHLDQ

SEQ ID NO: 2185118 - protein, 22 aa, Cryptosporidium hominis
ELILYKRSWDWLARTRLDEACR

SEQ ID NO: 2185119 - protein, 24 aa, Cryptosporidium hominis
ELKLKILICFRENYFINNYSKKWK

SEQ ID NO: 2185120 - protein, 19 aa, Cryptosporidium hominis
ELKPSHFIPLLKSYIEDTN

SEQ ID NO: 2185121 - protein, 24 aa, Cryptosporidium hominis
ELPCKRWPELLPYLIRLVQNNSDN

SEQ ID NO: 2185122 - protein, 24 aa, Cryptosporidium hominis
ELPIKDLFFFPSRLLETAAFRPPK

SEQ ID NO: 2185123 - protein, 19 aa, Cryptosporidium hominis
ELRLRLCSQLAALLNPIIL

SEQ ID NO: 2185124 - protein, 18 aa, Cryptosporidium hominis
ELSIPVMVIPVEMKKLNC

SEQ ID NO: 2185125 - protein, 19 aa, Cryptosporidium hominis
ELWSLLNFLYPEIFSSSEE

SEQ ID NO: 2185126 - protein, 19 aa, Cryptosporidium hominis
ELYHYPLLLAPIISSMSNL

SEQ ID NO: 2185127 - protein, 17 aa, Cryptosporidium hominis
EMTEILFTRGLIKVLFA

SEQ ID NO: 2185128 - protein, 24 aa, Cryptosporidium hominis
ENEFKFVLLILNWAASVLMVTKAF

SEQ ID NO: 2185129 - protein, 22 aa, Cryptosporidium hominis
ENEPFHCLYCLERKHKGKRGRK

SEQ ID NO: 2185130 - protein, 25 aa, Cryptosporidium hominis
ENEVFSLYCVFAFKKIEDSNINLDE

SEQ ID NO: 2185131 - protein, 21 aa, Cryptosporidium hominis
ENFPRILAIFIDIYGTSMSND

SEQ ID NO: 2185132 - protein, 20 aa, Cryptosporidium hominis
ENGLKIVLCIGESLSERETG

SEQ ID NO: 2185133 - protein, 17 aa, Cryptosporidium hominis
ENISACIDYDCMERNNK

SEQ ID NO: 2185134 - protein, 18 aa, Cryptosporidium hominis
ENKCRVVVCSDLLARGID

SEQ ID NO: 2185135 - protein, 23 aa, Cryptosporidium hominis
ENNCFPCPIFKTGWMETNSKGDL

SEQ ID NO: 2185136 - protein, 24 aa, Cryptosporidium hominis
ENPELFANILIEWSKKGYQSEKDI

SEQ ID NO: 2185137 - protein, 20 aa, Cryptosporidium hominis
ENPRKVCLMDAVLKEGELEE

SEQ ID NO: 2185138 - protein, 24 aa, Cryptosporidium hominis
ENRIAFDFIIDEVFLRGTIYDYMR

SEQ ID NO: 2185139 - protein, 23 aa, Cryptosporidium hominis
ENRNRLKLLLSWLEERVQEGYQD

SEQ ID NO: 2185140 - protein, 25 aa, Cryptosporidium hominis
EPEWLNFYAPHIFKLNINDSNKEDL

SEQ ID NO: 2185141 - protein, 19 aa, Cryptosporidium hominis
EPFGPWLVTPLFLGAKGGG

SEQ ID NO: 2185142 - protein, 22 aa, Cryptosporidium hominis
EPPKYAVSLVMDLSKVPNIDQM

SEQ ID NO: 2185143 - protein, 21 aa, Cryptosporidium hominis
EPSWRIWIFFLRGIIPILERW

SEQ ID NO: 2185144 - protein, 23 aa, Cryptosporidium hominis
EQSCIRYRISWFEFLIGKRDRSY

SEQ ID NO: 2185145 - protein, 23 aa, Cryptosporidium hominis
ERKRAKEYLAWLIAQRTSTVSVD

SEQ ID NO: 2185146 - protein, 18 aa, Cryptosporidium hominis
ERLRLGGVLELLDEEALI

SEQ ID NO: 2185147 - protein, 18 aa, Cryptosporidium hominis
ERRCFRVIGGVMVERTVK

SEQ ID NO: 2185148 - protein, 17 aa, Cryptosporidium hominis
ERSKPKCSVAFCETVEF

SEQ ID NO: 2185149 - protein, 18 aa, Cryptosporidium hominis
ERTLKCFIKKLIIENFKS

SEQ ID NO: 2185150 - protein, 21 aa, Cryptosporidium hominis
ESAFKRLAFKRFKSVPLYIEW

SEQ ID NO: 2185151 - protein, 20 aa, Cryptosporidium hominis
ESFLPDFLDLIIWGHEHECI

SEQ ID NO: 2185152 - protein, 18 aa, Cryptosporidium hominis
ESGKRFALKKVLQDPRYK

SEQ ID NO: 2185153 - protein, 35 aa, Cryptosporidium hominis
ESGKRKFRFSSFCPKLLNCLFPWIRSEQYFEDHDQ

SEQ ID NO: 2185154 - protein, 25 aa, Cryptosporidium hominis
ESIKFIKIKVAFLINQGYPEKSPPE

SEQ ID NO: 2185155 - protein, 20 aa, Cryptosporidium hominis
ESKSDILECFIKWKNDHYYT

SEQ ID NO: 2185156 - protein, 21 aa, Cryptosporidium hominis
ESLHWEWPAGLLPASRGVRSR

SEQ ID NO: 2185157 - protein, 19 aa, Cryptosporidium hominis
ESPFVYALVDWIKEKVGNF

SEQ ID NO: 2185158 - protein, 24 aa, Cryptosporidium hominis
ESSFLRKYWWLIAIGFITYSVLTT

SEQ ID NO: 2185159 - protein, 24 aa, Cryptosporidium hominis
ESSILELISFFGFKYDEKSQKLLD

SEQ ID NO: 2185160 - protein, 19 aa, Cryptosporidium hominis
ESSILIWDCNKYIIKDNTK

SEQ ID NO: 2185161 - protein, 19 aa, Cryptosporidium hominis
ESSMSFAPVRFGSMSISDT

SEQ ID NO: 2185162 - protein, 23 aa, Cryptosporidium hominis
ESSQRWIAQWSDSISGRRITHGF

SEQ ID NO: 2185163 - protein, 17 aa, Cryptosporidium hominis
ESVERLQALGFPRNAVI

SEQ ID NO: 2185164 - protein, 18 aa, Cryptosporidium hominis
ESYIGRVCLFDIIENLQV

SEQ ID NO: 2185165 - protein, 23 aa, Cryptosporidium hominis
ETDFKLSIPILIELIKKDNLDEI

SEQ ID NO: 2185166 - protein, 17 aa, Cryptosporidium hominis
ETIPIFGNMGFDQINQS

SEQ ID NO: 2185167 - protein, 17 aa, Cryptosporidium hominis
ETIPIRFVRQIRVFNLA

SEQ ID NO: 2185168 - protein, 19 aa, Cryptosporidium hominis
ETISVFGIIHKPKIILLNI

SEQ ID NO: 2185169 - protein, 25 aa, Cryptosporidium hominis
ETLRAIPWVFAWTQIRSHLPVWLGL

SEQ ID NO: 2185170 - protein, 24 aa, Cryptosporidium hominis
EVFKPMVYETIVFPPGYFEYKKQL

SEQ ID NO: 2185171 - protein, 17 aa, Cryptosporidium hominis
EVIELFIDRNGFLFQYI

SEQ ID NO: 2185172 - protein, 19 aa, Cryptosporidium hominis
EVIELISFTIYRQANGPAA

SEQ ID NO: 2185173 - protein, 19 aa, Cryptosporidium hominis
EVLEPYEILIIPKRDNTVT

SEQ ID NO: 2185174 - protein, 20 aa, Cryptosporidium hominis
EVPALLAIACELFVRDLTSF

SEQ ID NO: 2185175 - protein, 20 aa, Cryptosporidium hominis
EVQDLDSLLLIYSCIGDIQG

SEQ ID NO: 2185176 - protein, 20 aa, Cryptosporidium hominis
EVYCVPGTKSYIVFGDAKLE

SEQ ID NO: 2185177 - protein, 18 aa, Cryptosporidium hominis
EWAEFGLIVIFCNRQTDV

SEQ ID NO: 2185178 - protein, 22 aa, Cryptosporidium hominis
EWKKLRWSNKLNLVINIDEYNK

SEQ ID NO: 2185179 - protein, 21 aa, Cryptosporidium hominis
EYVPRIAWIRVRRNMNTWQYE

SEQ ID NO: 2185180 - protein, 21 aa, Cryptosporidium hominis
EYVVGSLFYRREMKQVKEEIC

SEQ ID NO: 2185181 - protein, 28 aa, Cryptosporidium hominis
EYYMAELLWRIGTVLGHSSFVNIPLVPL

SEQ ID NO: 2185182 - protein, 17 aa, Cryptosporidium hominis
FACCLRIEIFMDNDIIL

SEQ ID NO: 2185183 - protein, 21 aa, Cryptosporidium hominis
FACGYPGCHASFKRRSHLERH

SEQ ID NO: 2185184 - protein, 23 aa, Cryptosporidium hominis
FAHLRLALLPSDFLVYSHRHDLV

SEQ ID NO: 2185185 - protein, 20 aa, Cryptosporidium hominis
FCCCYSKNCLCDFSVRYKSH

SEQ ID NO: 2185186 - protein, 19 aa, Cryptosporidium hominis
FCRRRLAVVLVQLKFCPNL

SEQ ID NO: 2185187 - protein, 17 aa, Cryptosporidium hominis
FDCLRRVPAYDKLITER

SEQ ID NO: 2185188 - protein, 22 aa, Cryptosporidium hominis
FDCSRCTISFSIKRNICERLSL

SEQ ID NO: 2185189 - protein, 21 aa, Cryptosporidium hominis
FDFRFKAIIGHLTLKFISVFF

SEQ ID NO: 2185190 - protein, 20 aa, Cryptosporidium hominis
FDGHGGSVISEWVSRHIESI

SEQ ID NO: 2185191 - protein, 17 aa, Cryptosporidium hominis
FDIPPVRVCIQILSAHQ

SEQ ID NO: 2185192 - protein, 18 aa, Cryptosporidium hominis
FDKSHYWFTPDFTLLSNG

SEQ ID NO: 2185193 - protein, 17 aa, Cryptosporidium hominis
FDLCKEFDLRFIVIHDR

SEQ ID NO: 2185194 - protein, 18 aa, Cryptosporidium hominis
FDSFRCILDVISKDNNSK

SEQ ID NO: 2185195 - protein, 20 aa, Cryptosporidium hominis
FDYALSIHCEFGRPRHRDSS

SEQ ID NO: 2185196 - protein, 22 aa, Cryptosporidium hominis
FEEMKYFFGRGGIIKIDPTTLS

SEQ ID NO: 2185197 - protein, 17 aa, Cryptosporidium hominis
FEFITFLNYCRALRFED

SEQ ID NO: 2185198 - protein, 18 aa, Cryptosporidium hominis
FEFLKEFYGVLDFGSVLK

SEQ ID NO: 2185199 - protein, 19 aa, Cryptosporidium hominis
FEGSWKLGGFENAIFLSDT

SEQ ID NO: 2185200 - protein, 17 aa, Cryptosporidium hominis
FEKVVVRGARGLSFQIV

SEQ ID NO: 2185201 - protein, 22 aa, Cryptosporidium hominis
FENELWKANVINVLKRFDQSWV

SEQ ID NO: 2185202 - protein, 17 aa, Cryptosporidium hominis
FEQSLCILLRLSTCLNP

SEQ ID NO: 2185203 - protein, 22 aa, Cryptosporidium hominis
FEVTECGWGEFDIMAKVYFVDS

SEQ ID NO: 2185204 - protein, 18 aa, Cryptosporidium hominis
FFFKRVVINPAFYDPNVF

SEQ ID NO: 2185205 - protein, 17 aa, Cryptosporidium hominis
FFIFSSFNHRGNELMLT

SEQ ID NO: 2185206 - protein, 19 aa, Cryptosporidium hominis
FFIQEIFLSLGILIGNIEV

SEQ ID NO: 2185207 - protein, 22 aa, Cryptosporidium hominis
FFPNIRTPVVITRCGHHFCLNC

SEQ ID NO: 2185208 - protein, 18 aa, Cryptosporidium hominis
FFRERYIMFASRLFSQIV

SEQ ID NO: 2185209 - protein, 19 aa, Cryptosporidium hominis
FGDLCCITFTPSGEHIFAT

SEQ ID NO: 2185210 - protein, 23 aa, Cryptosporidium hominis
FGDLRPSWSLYYLLKKIICKEMS

SEQ ID NO: 2185211 - protein, 18 aa, Cryptosporidium hominis
FGGAMAYRGGEFGRHPPY

SEQ ID NO: 2185212 - protein, 21 aa, Cryptosporidium hominis
FGIPRKSSLNSSFSDQMNTNI

SEQ ID NO: 2185213 - protein, 25 aa, Cryptosporidium hominis
FGITPWMPFWFRFTPINAKTVSNPL

SEQ ID NO: 2185214 - protein, 22 aa, Cryptosporidium hominis
FGRIGRLVLRACMERNDITVVA

SEQ ID NO: 2185215 - protein, 19 aa, Cryptosporidium hominis
FGYYKLRPGVINMLRTLSK

SEQ ID NO: 2185216 - protein, 17 aa, Cryptosporidium hominis
FHPKIPFVCKIEMKSET

SEQ ID NO: 2185217 - protein, 19 aa, Cryptosporidium hominis
FHYMKRFVIGLSIDKISSR

SEQ ID NO: 2185218 - protein, 19 aa, Cryptosporidium hominis
FIDRGWRDCFECFKHENRY

SEQ ID NO: 2185219 - protein, 18 aa, Cryptosporidium hominis
FIEFWRLYEEMLKHSGVY

SEQ ID NO: 2185220 - protein, 18 aa, Cryptosporidium hominis
FIELCKFNKNNIVGTENL

SEQ ID NO: 2185221 - protein, 24 aa, Cryptosporidium hominis
FIIKSSQCPIIFSCRMAIVNNSKK

SEQ ID NO: 2185222 - protein, 19 aa, Cryptosporidium hominis
FIKCKLINISYAFPSDTEH

SEQ ID NO: 2185223 - protein, 19 aa, Cryptosporidium hominis
FILEFCAGGNLFHSLQDAI

SEQ ID NO: 2185224 - protein, 17 aa, Cryptosporidium hominis
FIPQFKCCIDCNPTTIK

SEQ ID NO: 2185225 - protein, 19 aa, Cryptosporidium hominis
FIQNNVRFFFTRNIHCHAK

SEQ ID NO: 2185226 - protein, 19 aa, Cryptosporidium hominis
FIRNLKLCRLNLELEELVS

SEQ ID NO: 2185227 - protein, 18 aa, Cryptosporidium hominis
FKACRVFKDAITPISNMD

SEQ ID NO: 2185228 - protein, 18 aa, Cryptosporidium hominis
FKAGIPMLFHFINLNDKE

SEQ ID NO: 2185229 - protein, 25 aa, Cryptosporidium hominis
FKDPKFKIAWYFAMRDTLIVDDLDI

SEQ ID NO: 2185230 - protein, 17 aa, Cryptosporidium hominis
FKDVVDFASYIIKMGSI

SEQ ID NO: 2185231 - protein, 19 aa, Cryptosporidium hominis
FKENFGFEIYIKEKEYKLK

SEQ ID NO: 2185232 - protein, 19 aa, Cryptosporidium hominis
FKIAIALAENCQLPVFITL

SEQ ID NO: 2185233 - protein, 19 aa, Cryptosporidium hominis
FKIFLRYFIYPAYLDLYSY

SEQ ID NO: 2185234 - protein, 22 aa, Cryptosporidium hominis
FKIRCSRYLYTLVMKDLEKAKK

SEQ ID NO: 2185235 - protein, 21 aa, Cryptosporidium hominis
FKKEETALISFEFLGLAAMNL

SEQ ID NO: 2185236 - protein, 17 aa, Cryptosporidium hominis
FKMSVICPLCKVDVRGS

SEQ ID NO: 2185237 - protein, 22 aa, Cryptosporidium hominis
FKNEVCSKCSKNAECYVHSIFE

SEQ ID NO: 2185238 - protein, 19 aa, Cryptosporidium hominis
FKRLCKLLYYGILPVIVFD

SEQ ID NO: 2185239 - protein, 23 aa, Cryptosporidium hominis
FKRPDIKCSICGDKGHITKDCKQ

SEQ ID NO: 2185240 - protein, 25 aa, Cryptosporidium hominis
FKRSVWLKSHFIRKRIIDNINDFNL

SEQ ID NO: 2185241 - protein, 18 aa, Cryptosporidium hominis
FLDLPILELIGIDPAVLG

SEQ ID NO: 2185242 - protein, 18 aa, Cryptosporidium hominis
FLFGKSFRPPEAYETGSL

SEQ ID NO: 2185243 - protein, 19 aa, Cryptosporidium hominis
FLHELKLKLIEIFRINSEK

SEQ ID NO: 2185244 - protein, 18 aa, Cryptosporidium hominis
FLIGEGIPSYILDLPNEV

SEQ ID NO: 2185245 - protein, 24 aa, Cryptosporidium hominis
FLIYTCMIGICVLDIKIGKRVLII

SEQ ID NO: 2185246 - protein, 19 aa, Cryptosporidium hominis
FLKRLKGIGRHQVKINIYN

SEQ ID NO: 2185247 - protein, 20 aa, Cryptosporidium hominis
FLLNLLIKFGILRSDASDLH

SEQ ID NO: 2185248 - protein, 31 aa, Cryptosporidium hominis
FLLTEIRPRWYFIRNDCLIFIDSELPLKQSV

SEQ ID NO: 2185249 - protein, 22 aa, Cryptosporidium hominis
FLNKLCETRHLFQQGKGAIPDW

SEQ ID NO: 2185250 - protein, 19 aa, Cryptosporidium hominis
FLPIFPPRLDYCDKFISSQ

SEQ ID NO: 2185251 - protein, 18 aa, Cryptosporidium hominis
FLQLLLCIPYWNGNIPPP

SEQ ID NO: 2185252 - protein, 22 aa, Cryptosporidium hominis
FLSFVFKLPFYLKMDINLTPVT

SEQ ID NO: 2185253 - protein, 20 aa, Cryptosporidium hominis
FLTLRYSRLFPIPERTLSYG

SEQ ID NO: 2185254 - protein, 27 aa, Cryptosporidium hominis
FLVEDIPLPKVCVFQIEAKLELLLLYR

SEQ ID NO: 2185255 - protein, 19 aa, Cryptosporidium hominis
FLVPLSLSFMSNWAENKNK

SEQ ID NO: 2185256 - protein, 20 aa, Cryptosporidium hominis
FMIKELIKLLIMLNNISEKY

SEQ ID NO: 2185257 - protein, 24 aa, Cryptosporidium hominis
FMNIQELFLFLSLFYHNYQREWIL

SEQ ID NO: 2185258 - protein, 20 aa, Cryptosporidium hominis
FMQLFCGLFFQLSYFITFAQ

SEQ ID NO: 2185259 - protein, 24 aa, Cryptosporidium hominis
FNEFCQLFLWPLFHNVLNPEELSN

SEQ ID NO: 2185260 - protein, 18 aa, Cryptosporidium hominis
FNGPSYFCSYSFASVFSR

SEQ ID NO: 2185261 - protein, 17 aa, Cryptosporidium hominis
FNICHCHDWLAAPVLTS

SEQ ID NO: 2185262 - protein, 20 aa, Cryptosporidium hominis
FNPRSGIRWLCFILGEYGKL

SEQ ID NO: 2185263 - protein, 18 aa, Cryptosporidium hominis
FNRKEYMNALNLSLGQKL

SEQ ID NO: 2185264 - protein, 19 aa, Cryptosporidium hominis
FNVPYEWDKKSLVGLFCRF

SEQ ID NO: 2185265 - protein, 18 aa, Cryptosporidium hominis
FNYWMLAKKFEFEKIVTR

SEQ ID NO: 2185266 - protein, 17 aa, Cryptosporidium hominis
FPCGKWPDLLPFLFRLI

SEQ ID NO: 2185267 - protein, 21 aa, Cryptosporidium hominis
FPENIHIIFDYSLPLTFSDDL

SEQ ID NO: 2185268 - protein, 19 aa, Cryptosporidium hominis
FPHFEFLLDYMILFSPCGQ

SEQ ID NO: 2185269 - protein, 18 aa, Cryptosporidium hominis
FPHIRLGPSVSQVLTTLT

SEQ ID NO: 2185270 - protein, 24 aa, Cryptosporidium hominis
FPIDANCILSAWQYQEVSLYYIFN

SEQ ID NO: 2185271 - protein, 20 aa, Cryptosporidium hominis
FPIELCIISLVIVVKDLVPG

SEQ ID NO: 2185272 - protein, 22 aa, Cryptosporidium hominis
FPLPPRYAKILLLTTAYIRKNL

SEQ ID NO: 2185273 - protein, 21 aa, Cryptosporidium hominis
FPNCKRFYCPFIHDSETNLIN

SEQ ID NO: 2185274 - protein, 23 aa, Cryptosporidium hominis
FPPDAWHLCCWLLRKNSNERASP

SEQ ID NO: 2185275 - protein, 17 aa, Cryptosporidium hominis
FPPFQVKITQRFRRNRN

SEQ ID NO: 2185276 - protein, 21 aa, Cryptosporidium hominis
FPSFEIFRCLPVREELLRSIL

SEQ ID NO: 2185277 - protein, 19 aa, Cryptosporidium hominis
FPTEFMKLMVIDEADEMID

SEQ ID NO: 2185278 - protein, 21 aa, Cryptosporidium hominis
FPVMMSRFIATFARTDKRNSC

SEQ ID NO: 2185279 - protein, 19 aa, Cryptosporidium hominis
FQKGEWRAVYGPSKNRQQK

SEQ ID NO: 2185280 - protein, 19 aa, Cryptosporidium hominis
FRATKFCKRCGAGNSIVVY

SEQ ID NO: 2185281 - protein, 19 aa, Cryptosporidium hominis
FRCSGCPYKGMPAFKPGEK

SEQ ID NO: 2185282 - protein, 19 aa, Cryptosporidium hominis
FRDGILLVNLLKQWSSLYG

SEQ ID NO: 2185283 - protein, 19 aa, Cryptosporidium hominis
FRFKVRVGNTYAWMDPLND

SEQ ID NO: 2185284 - protein, 18 aa, Cryptosporidium hominis
FRIILCSSILKIIDSYTF

SEQ ID NO: 2185285 - protein, 17 aa, Cryptosporidium hominis
FRISQILKLKGFDLTET

SEQ ID NO: 2185286 - protein, 17 aa, Cryptosporidium hominis
FRKEIHGTWFITLKTED

SEQ ID NO: 2185287 - protein, 18 aa, Cryptosporidium hominis
FRKRDWYSLIAVFLTGAE

SEQ ID NO: 2185288 - protein, 18 aa, Cryptosporidium hominis
FRLACKHALYYSIRSTLT

SEQ ID NO: 2185289 - protein, 21 aa, Cryptosporidium hominis
FRNIYRLILFISEIKLSKNYN

SEQ ID NO: 2185290 - protein, 23 aa, Cryptosporidium hominis
FRNKEVIDLWGPHEVILFECGVC

SEQ ID NO: 2185291 - protein, 20 aa, Cryptosporidium hominis
FRSLYKFAFGDIAYAKKIGE

SEQ ID NO: 2185292 - protein, 17 aa, Cryptosporidium hominis
FSEVFKLGSCISQSLKV

SEQ ID NO: 2185293 - protein, 17 aa, Cryptosporidium hominis
FSIESGYRWDGVIRGNG

SEQ ID NO: 2185294 - protein, 18 aa, Cryptosporidium hominis
FSKIFSIKKLHLGHVASS

SEQ ID NO: 2185295 - protein, 17 aa, Cryptosporidium hominis
FSKYGLKYSQLRNATIH

SEQ ID NO: 2185296 - protein, 19 aa, Cryptosporidium hominis
FSLNYGWRPICNVPTPIQE

SEQ ID NO: 2185297 - protein, 19 aa, Cryptosporidium hominis
FSPKSQWKFICRFRSCFNK

SEQ ID NO: 2185298 - protein, 29 aa, Cryptosporidium hominis
FSSCVACGRFFCHLCILYIRSSNPCSPIA

SEQ ID NO: 2185299 - protein, 18 aa, Cryptosporidium hominis
FSSFFAYECSSAFEQQAS

SEQ ID NO: 2185300 - protein, 22 aa, Cryptosporidium hominis
FSSKELKRVFSIEFGVLSPELI

SEQ ID NO: 2185301 - protein, 24 aa, Cryptosporidium hominis
FTDHGWRMAVEFILFGSIPNMPYY

SEQ ID NO: 2185302 - protein, 17 aa, Cryptosporidium hominis
FTFPLLEEFSMIQDQIQ

SEQ ID NO: 2185303 - protein, 22 aa, Cryptosporidium hominis
FTLVRLKLWIVEEILYDEQILD

SEQ ID NO: 2185304 - protein, 23 aa, Cryptosporidium hominis
FTSKLAIVPLIFGIQGSNKSSVI

SEQ ID NO: 2185305 - protein, 18 aa, Cryptosporidium hominis
FVCRGCRIGKVLLNNSSE

SEQ ID NO: 2185306 - protein, 19 aa, Cryptosporidium hominis
FVEGMGIPPSVSRTGTSKG

SEQ ID NO: 2185307 - protein, 26 aa, Cryptosporidium hominis
FVHLLIWNYIKCCISFYQLDDQEQKN

SEQ ID NO: 2185308 - protein, 25 aa, Cryptosporidium hominis
FVIPSKRIIIEWPLYLLKNLKALDF

SEQ ID NO: 2185309 - protein, 17 aa, Cryptosporidium hominis
FVKYAFKEQGLFAIKSL

SEQ ID NO: 2185310 - protein, 23 aa, Cryptosporidium hominis
FVNYRAAAALGVWDLCRGTGKGL

SEQ ID NO: 2185311 - protein, 18 aa, Cryptosporidium hominis
FVQPRFADYASYYFPDGT

SEQ ID NO: 2185312 - protein, 19 aa, Cryptosporidium hominis
FWHPINKVWIGVWLDSITH

SEQ ID NO: 2185313 - protein, 18 aa, Cryptosporidium hominis
FWRCRAEASSKEQGKVLI

SEQ ID NO: 2185314 - protein, 17 aa, Cryptosporidium hominis
FWRFCYNACNSLFTKLQ

SEQ ID NO: 2185315 - protein, 19 aa, Cryptosporidium hominis
FYFHWKRIIGACNFKDLHA

SEQ ID NO: 2185316 - protein, 18 aa, Cryptosporidium hominis
FYFNQVFRELIPNGDAKL

SEQ ID NO: 2185317 - protein, 23 aa, Cryptosporidium hominis
FYLCGLCPHELFENTKLYMGPCK

SEQ ID NO: 2185318 - protein, 17 aa, Cryptosporidium hominis
FYLGPSLDCEGIIIYGY

SEQ ID NO: 2185319 - protein, 25 aa, Cryptosporidium hominis
FYLHSRCLITIPFLQWELINDQVYT

SEQ ID NO: 2185320 - protein, 19 aa, Cryptosporidium hominis
FYLRGSCRFGDNCRDYHPN

SEQ ID NO: 2185321 - protein, 31 aa, Cryptosporidium hominis
FYPIFPLVCFPDFVRSGANMEHLMVMDMSYS

SEQ ID NO: 2185322 - protein, 18 aa, Cryptosporidium hominis
GAGAFEFRAYNTLKETRK

SEQ ID NO: 2185323 - protein, 21 aa, Cryptosporidium hominis
GALRSPLPWDLGRHSKSTIQV

SEQ ID NO: 2185324 - protein, 22 aa, Cryptosporidium hominis
GASFYRFIFNSVFFSKSNLNEK

SEQ ID NO: 2185325 - protein, 18 aa, Cryptosporidium hominis
GCAFITFEQEEGAKSAIQ

SEQ ID NO: 2185326 - protein, 19 aa, Cryptosporidium hominis
GCTAAVCVRIFNEAHIAWV

SEQ ID NO: 2185327 - protein, 21 aa, Cryptosporidium hominis
GDLILEFDICFPKSLTPEQKK

SEQ ID NO: 2185328 - protein, 17 aa, Cryptosporidium hominis
GDLIPWTLCNHLARDDF

SEQ ID NO: 2185329 - protein, 21 aa, Cryptosporidium hominis
GDNATHSWTCFLRSPDNEDIS

SEQ ID NO: 2185330 - protein, 18 aa, Cryptosporidium hominis
GDRLGCFNLSLKGHGHAV

SEQ ID NO: 2185331 - protein, 20 aa, Cryptosporidium hominis
GDVRLWICIGDCYLAKNEVA

SEQ ID NO: 2185332 - protein, 21 aa, Cryptosporidium hominis
GEEFWAWIMIWMRLNSLGVLD

SEQ ID NO: 2185333 - protein, 22 aa, Cryptosporidium hominis
GELYALKCVRVFTKNHDHSNAH

SEQ ID NO: 2185334 - protein, 17 aa, Cryptosporidium hominis
GESYPFFPPGIKPAPID

SEQ ID NO: 2185335 - protein, 20 aa, Cryptosporidium hominis
GEVGCTYHALGWISGDVNVV

SEQ ID NO: 2185336 - protein, 18 aa, Cryptosporidium hominis
GFCHFSLNVNLEMDAGNE

SEQ ID NO: 2185337 - protein, 26 aa, Cryptosporidium hominis
GFELLKKCSRSGCLLRKDTDIENKSL

SEQ ID NO: 2185338 - protein, 18 aa, Cryptosporidium hominis
GFGGIWKKSLTELSGGQR

SEQ ID NO: 2185339 - protein, 19 aa, Cryptosporidium hominis
GFHLKPLLFRISKLVNSSE

SEQ ID NO: 2185340 - protein, 20 aa, Cryptosporidium hominis
GFIPFILCGDLSPIDNIDPS

SEQ ID NO: 2185341 - protein, 22 aa, Cryptosporidium hominis
GFKLWTRREFNLLLRCLETNGV

SEQ ID NO: 2185342 - protein, 18 aa, Cryptosporidium hominis
GFLKGIVIDSSFCSLRQL

SEQ ID NO: 2185343 - protein, 18 aa, Cryptosporidium hominis
GFLPEIYDSINITLYRMR

SEQ ID NO: 2185344 - protein, 18 aa, Cryptosporidium hominis
GFMFSMVVSYTWNNVYLL

SEQ ID NO: 2185345 - protein, 17 aa, Cryptosporidium hominis
GFRGEALSSISFVSQLS

SEQ ID NO: 2185346 - protein, 17 aa, Cryptosporidium hominis
GGHPFGGAMAYRGGEFG

SEQ ID NO: 2185347 - protein, 19 aa, Cryptosporidium hominis
GGKKEWRVVFWTHESTKPS

SEQ ID NO: 2185348 - protein, 17 aa, Cryptosporidium hominis
GGMGMMDKCYFTGKSDL

SEQ ID NO: 2185349 - protein, 17 aa, Cryptosporidium hominis
GGMGRGGFRGGYSRGGM

SEQ ID NO: 2185350 - protein, 17 aa, Cryptosporidium hominis
GGNRRWNFGASKEKGRY

SEQ ID NO: 2185351 - protein, 19 aa, Cryptosporidium hominis
GGSVPLMLQRIVLATQLQS

SEQ ID NO: 2185352 - protein, 18 aa, Cryptosporidium hominis
GGVPICLILQYPLECLRR

SEQ ID NO: 2185353 - protein, 17 aa, Cryptosporidium hominis
GHEGPVWQVCWAHPTFG

SEQ ID NO: 2185354 - protein, 17 aa, Cryptosporidium hominis
GHFRPILTHSFQMEYCL

SEQ ID NO: 2185355 - protein, 21 aa, Cryptosporidium hominis
GHLLFDFLELFGIVFNYSSTG

SEQ ID NO: 2185356 - protein, 23 aa, Cryptosporidium hominis
GHPFVKCRLCFLVKKDHCICMDL

SEQ ID NO: 2185357 - protein, 18 aa, Cryptosporidium hominis
GHTLRLLSFPSLLEKGLS

SEQ ID NO: 2185358 - protein, 23 aa, Cryptosporidium hominis
GIDISRLKAIEWRVKLINEKKLR

SEQ ID NO: 2185359 - protein, 23 aa, Cryptosporidium hominis
GIDPRLSEYYLIYADVLLEKEEN

SEQ ID NO: 2185360 - protein, 21 aa, Cryptosporidium hominis
GIEHLLRLLIILPKLIGDHIS

SEQ ID NO: 2185361 - protein, 18 aa, Cryptosporidium hominis
GIGVWSAEMAMIFCMNRK

SEQ ID NO: 2185362 - protein, 18 aa, Cryptosporidium hominis
GIIGRFFIFSSFNHRGNE

SEQ ID NO: 2185363 - protein, 28 aa, Cryptosporidium hominis
GILKDISTEFEIKFELGLINGSWLGGDI

SEQ ID NO: 2185364 - protein, 18 aa, Cryptosporidium hominis
GIMTPEFPGSHDSNYSFS

SEQ ID NO: 2185365 - protein, 25 aa, Cryptosporidium hominis
GIPLLCLRGSMPIWYYRKKKNMSLY

SEQ ID NO: 2185366 - protein, 21 aa, Cryptosporidium hominis
GIPVDHVFGFWDWVGGRFSVC

SEQ ID NO: 2185367 - protein, 23 aa, Cryptosporidium hominis
GKEFKELRRQLGWEKNTEKNFKN

SEQ ID NO: 2185368 - protein, 21 aa, Cryptosporidium hominis
GKEIKFILSMMLFHQTFLNFI

SEQ ID NO: 2185369 - protein, 17 aa, Cryptosporidium hominis
GKESLAVMYSRLYDYFT

SEQ ID NO: 2185370 - protein, 19 aa, Cryptosporidium hominis
GKICLPKEFYNMMIDKNNP

SEQ ID NO: 2185371 - protein, 20 aa, Cryptosporidium hominis
GKIPQGAHLLGFFKRLCKLL

SEQ ID NO: 2185372 - protein, 17 aa, Cryptosporidium hominis
GKIPRYLAILALNLKGH

SEQ ID NO: 2185373 - protein, 17 aa, Cryptosporidium hominis
GKKEWKNICVASIKELE

SEQ ID NO: 2185374 - protein, 25 aa, Cryptosporidium hominis
GKLHYKYFGPRSWTVMGLKEALRKA

SEQ ID NO: 2185375 - protein, 20 aa, Cryptosporidium hominis
GKLKPWKGILLYGPPGTGKT

SEQ ID NO: 2185376 - protein, 17 aa, Cryptosporidium hominis
GKRQGCWRRRKDGKRKH

SEQ ID NO: 2185377 - protein, 18 aa, Cryptosporidium hominis
GKYKWAWTIGDYRLVSDM

SEQ ID NO: 2185378 - protein, 17 aa, Cryptosporidium hominis
GKYMACCLMYRGDVVPK

SEQ ID NO: 2185379 - protein, 20 aa, Cryptosporidium hominis
GLEFKVGFGGIWKKSLTELS

SEQ ID NO: 2185380 - protein, 22 aa, Cryptosporidium hominis
GLFRPEMLRPLGFPSDIVVIAW

SEQ ID NO: 2185381 - protein, 17 aa, Cryptosporidium hominis
GLLIIGLCPWGWEYISG

SEQ ID NO: 2185382 - protein, 19 aa, Cryptosporidium hominis
GLMRPEGFPVYTTQWPSAF

SEQ ID NO: 2185383 - protein, 24 aa, Cryptosporidium hominis
GLNALLRWLFRYVPDLSLSIRNLY

SEQ ID NO: 2185384 - protein, 17 aa, Cryptosporidium hominis
GLYDLKSPIVFKPKLET

SEQ ID NO: 2185385 - protein, 23 aa, Cryptosporidium hominis
GMGADILHALGFNRTSNSDDSDT

SEQ ID NO: 2185386 - protein, 17 aa, Cryptosporidium hominis
GMLSCRPYSSSISTITS

SEQ ID NO: 2185387 - protein, 20 aa, Cryptosporidium hominis
GMSCLRSVLSMHDLVNNVSE

SEQ ID NO: 2185388 - protein, 19 aa, Cryptosporidium hominis
GNFIKLRFSQSLKVEISVK

SEQ ID NO: 2185389 - protein, 20 aa, Cryptosporidium hominis
GNFWPIEKFVSVFEPIERAK

SEQ ID NO: 2185390 - protein, 18 aa, Cryptosporidium hominis
GNIVAPIQIEWPKTPPAS

SEQ ID NO: 2185391 - protein, 23 aa, Cryptosporidium hominis
GNLRFLRYCKILWVMIGIDDFSM

SEQ ID NO: 2185392 - protein, 26 aa, Cryptosporidium hominis
GNLRPSSMPIFILRPIIKQLDEYRKI

SEQ ID NO: 2185393 - protein, 23 aa, Cryptosporidium hominis
GNVLKCLICIGGGNINKTFDYIK

SEQ ID NO: 2185394 - protein, 19 aa, Cryptosporidium hominis
GPIKFCIVCGENIQINSDF

SEQ ID NO: 2185395 - protein, 18 aa, Cryptosporidium hominis
GPITRGALKFIFKAPSPD

SEQ ID NO: 2185396 - protein, 20 aa, Cryptosporidium hominis
GPWEGYFLWDIIRGKILNYR

SEQ ID NO: 2185397 - protein, 18 aa, Cryptosporidium hominis
GQDLVKFVFEFENMDLHI

SEQ ID NO: 2185398 - protein, 23 aa, Cryptosporidium hominis
GQLEFKAILFIPRRAPFDLFETR

SEQ ID NO: 2185399 - protein, 22 aa, Cryptosporidium hominis
GRCNCGYPIFIINGEVVAGSSG

SEQ ID NO: 2185400 - protein, 19 aa, Cryptosporidium hominis
GRFSMAIACYREVQDLDSL

SEQ ID NO: 2185401 - protein, 19 aa, Cryptosporidium hominis
GRFTFLLLRALERYSPVWE

SEQ ID NO: 2185402 - protein, 19 aa, Cryptosporidium hominis
GRIIIKWMLEEGVRKIAIL

SEQ ID NO: 2185403 - protein, 18 aa, Cryptosporidium hominis
GRKSFILRINFLLPTGIS

SEQ ID NO: 2185404 - protein, 23 aa, Cryptosporidium hominis
GRNRLDILLSQWVSYFSGRQSID

SEQ ID NO: 2185405 - protein, 20 aa, Cryptosporidium hominis
GRSICNPCLQFSRVHDVSLF

SEQ ID NO: 2185406 - protein, 18 aa, Cryptosporidium hominis
GSAYPFWDLKIINVISSS

SEQ ID NO: 2185407 - protein, 18 aa, Cryptosporidium hominis
GSCNFQWILSNVYDAYTG

SEQ ID NO: 2185408 - protein, 19 aa, Cryptosporidium hominis
GSDILFFWVARMVMLSFAC

SEQ ID NO: 2185409 - protein, 17 aa, Cryptosporidium hominis
GSFGVVFKGRIRSGIWS

SEQ ID NO: 2185410 - protein, 21 aa, Cryptosporidium hominis
GSIGARGADIWMGGGGSSMGI

SEQ ID NO: 2185411 - protein, 18 aa, Cryptosporidium hominis
GSIGKLIFRRDGNMDLYL

SEQ ID NO: 2185412 - protein, 17 aa, Cryptosporidium hominis
GSINLKIVENVFADGPL

SEQ ID NO: 2185413 - protein, 18 aa, Cryptosporidium hominis
GSIRIVILGVLYRISNIL

SEQ ID NO: 2185414 - protein, 20 aa, Cryptosporidium hominis
GSNPKLISMMGVRNEGSIRN

SEQ ID NO: 2185415 - protein, 22 aa, Cryptosporidium hominis
GSRMKYWWSKYIRRQKKKKEES

SEQ ID NO: 2185416 - protein, 23 aa, Cryptosporidium hominis
GTDRRLDCWLTWESLRVIPNEYL

SEQ ID NO: 2185417 - protein, 20 aa, Cryptosporidium hominis
GTEVAPLFSKFVPNEDTSDS

SEQ ID NO: 2185418 - protein, 21 aa, Cryptosporidium hominis
GTHYEFKFLDGLFVFDPSIKG

SEQ ID NO: 2185419 - protein, 24 aa, Cryptosporidium hominis
GTIDFPEFLSLMARKMKDTDTEDE

SEQ ID NO: 2185420 - protein, 23 aa, Cryptosporidium hominis
GTNLLTFKFDYIFSSVSTQHEVF

SEQ ID NO: 2185421 - protein, 21 aa, Cryptosporidium hominis
GTPSWFPPLYVEALKHLKDLI

SEQ ID NO: 2185422 - protein, 24 aa, Cryptosporidium hominis
GVGPSQITSFCWITNQIFLVGFSN

SEQ ID NO: 2185423 - protein, 19 aa, Cryptosporidium hominis
GVIHPRILVNVKRVMTGII

SEQ ID NO: 2185424 - protein, 18 aa, Cryptosporidium hominis
GVWPFGRIGLLNQSQDSS

SEQ ID NO: 2185425 - protein, 19 aa, Cryptosporidium hominis
GWIPENMKLFLAIKSPFKG

SEQ ID NO: 2185426 - protein, 18 aa, Cryptosporidium hominis
GYCFIEFLGKLEAISALE

SEQ ID NO: 2185427 - protein, 19 aa, Cryptosporidium hominis
GYDYCLLYFELLRDGLINA

SEQ ID NO: 2185428 - protein, 18 aa, Cryptosporidium hominis
GYFPEIRAFVALDLSSSF

SEQ ID NO: 2185429 - protein, 22 aa, Cryptosporidium hominis
GYLYCWPWPGTISGRSEIKINP

SEQ ID NO: 2185430 - protein, 19 aa, Cryptosporidium hominis
GYNKCELFNSWAYKLLHRQ

SEQ ID NO: 2185431 - protein, 18 aa, Cryptosporidium hominis
GYQALPWVRYITQNGNYE

SEQ ID NO: 2185432 - protein, 17 aa, Cryptosporidium hominis
GYQYDFIFDWSFLQPEK

SEQ ID NO: 2185433 - protein, 17 aa, Cryptosporidium hominis
GYSCPKCKSIVCYLPTK

SEQ ID NO: 2185434 - protein, 17 aa, Cryptosporidium hominis
GYTGDGFTCHDIDECKV

SEQ ID NO: 2185435 - protein, 22 aa, Cryptosporidium hominis
HAHGRIAYKHGYPPSLGSGPGS

SEQ ID NO: 2185436 - protein, 17 aa, Cryptosporidium hominis
HAILRIKIESHINSNDV

SEQ ID NO: 2185437 - protein, 18 aa, Cryptosporidium hominis
HCNKCIKFGLSLDQIQIH

SEQ ID NO: 2185438 - protein, 25 aa, Cryptosporidium hominis
HCSECPTTFCIDCFPPEYARHQVLD

SEQ ID NO: 2185439 - protein, 18 aa, Cryptosporidium hominis
HCSLPNPIIYKWPSNSVC

SEQ ID NO: 2185440 - protein, 17 aa, Cryptosporidium hominis
HDFRFKVYHKFLDLLPE

SEQ ID NO: 2185441 - protein, 20 aa, Cryptosporidium hominis
HECPICRSLLKEELWLSKSD

SEQ ID NO: 2185442 - protein, 17 aa, Cryptosporidium hominis
HEICSPKIFLDASVNTE

SEQ ID NO: 2185443 - protein, 19 aa, Cryptosporidium hominis
HGIGMGMGNRIIPGISPGV

SEQ ID NO: 2185444 - protein, 19 aa, Cryptosporidium hominis
HGILFKRLGIIVVDELHLL

SEQ ID NO: 2185445 - protein, 17 aa, Cryptosporidium hominis
HGLRMGAVIKRFYIDSI

SEQ ID NO: 2185446 - protein, 18 aa, Cryptosporidium hominis
HKEMIKFSGISLQGRESL

SEQ ID NO: 2185447 - protein, 17 aa, Cryptosporidium hominis
HKPELGRNFTIKRYSSN

SEQ ID NO: 2185448 - protein, 22 aa, Cryptosporidium hominis
HKPRLLVKLLLEQGEGLTVVFV

SEQ ID NO: 2185449 - protein, 18 aa, Cryptosporidium hominis
HKQRATILTAIFGELYAI

SEQ ID NO: 2185450 - protein, 24 aa, Cryptosporidium hominis
HKVPEYRVLLIIPDEFYLTIADVE

SEQ ID NO: 2185451 - protein, 24 aa, Cryptosporidium hominis
HLCREILRLTKLVVDCHVQYRLGN

SEQ ID NO: 2185452 - protein, 17 aa, Cryptosporidium hominis
HLKRYQIGKVYRRDEPQ

SEQ ID NO: 2185453 - protein, 19 aa, Cryptosporidium hominis
HLKWQIPSFIIGGNPRLQG

SEQ ID NO: 2185454 - protein, 18 aa, Cryptosporidium hominis
HLLALLWRCYKICEERGY

SEQ ID NO: 2185455 - protein, 18 aa, Cryptosporidium hominis
HMRGFPYCRIDGNTSGDD

SEQ ID NO: 2185456 - protein, 17 aa, Cryptosporidium hominis
HMRVIRELLGFDIEELN

SEQ ID NO: 2185457 - protein, 26 aa, Cryptosporidium hominis
HMVKARLAVCMTFRLAIETFNQYYSY

SEQ ID NO: 2185458 - protein, 24 aa, Cryptosporidium hominis
HNIYWPRRCPFYLSNQSTIRYIPV

SEQ ID NO: 2185459 - protein, 17 aa, Cryptosporidium hominis
HNLEFKTSFPYVSNGGV

SEQ ID NO: 2185460 - protein, 17 aa, Cryptosporidium hominis
HPFEFITFLNYCRALRF

SEQ ID NO: 2185461 - protein, 17 aa, Cryptosporidium hominis
HPGCTRTAHPLCLKLYG

SEQ ID NO: 2185462 - protein, 17 aa, Cryptosporidium hominis
HPIASLLSVLSMNKGIQ

SEQ ID NO: 2185463 - protein, 17 aa, Cryptosporidium hominis
HPSFPFMYGNFPNNGSQ

SEQ ID NO: 2185464 - protein, 19 aa, Cryptosporidium hominis
HPWFEKIQLSPGIMISCNN

SEQ ID NO: 2185465 - protein, 19 aa, Cryptosporidium hominis
HQYCHLCFSRFMSLRPFLL

SEQ ID NO: 2185466 - protein, 17 aa, Cryptosporidium hominis
HRIPMGLLLGGRDALEN

SEQ ID NO: 2185467 - protein, 18 aa, Cryptosporidium hominis
HRRIEWFLHWYIESASSI

SEQ ID NO: 2185468 - protein, 20 aa, Cryptosporidium hominis
HSHSKYRGLHLISNQSDSDS

SEQ ID NO: 2185469 - protein, 20 aa, Cryptosporidium hominis
HSRICLFCKGFKRPIQHISK

SEQ ID NO: 2185470 - protein, 24 aa, Cryptosporidium hominis
HSVWPRILFIQSIIIGRFKFLDDY

SEQ ID NO: 2185471 - protein, 19 aa, Cryptosporidium hominis
HVLSFPMSYIFFSTYGRKF

SEQ ID NO: 2185472 - protein, 19 aa, Cryptosporidium hominis
HYERCGLSFYAIKSRGEAW

SEQ ID NO: 2185473 - protein, 23 aa, Cryptosporidium hominis
HYFEFPDLITIIYRFPFYINPMK

SEQ ID NO: 2185474 - protein, 23 aa, Cryptosporidium hominis
HYSRIPVKIKHYIVSDKDNSKEG

SEQ ID NO: 2185475 - protein, 20 aa, Cryptosporidium hominis
IAALRDIRNLFPIYRNPLYA

SEQ ID NO: 2185476 - protein, 24 aa, Cryptosporidium hominis
IACYDCVRLALMIQQRYNVKAHCP

SEQ ID NO: 2185477 - protein, 17 aa, Cryptosporidium hominis
IACYREVQDLDSLLLIY

SEQ ID NO: 2185478 - protein, 23 aa, Cryptosporidium hominis
IADRMTLSWSWKEMIDEDFLPIT

SEQ ID NO: 2185479 - protein, 18 aa, Cryptosporidium hominis
IAEFLIYYRFREVIRDKD

SEQ ID NO: 2185480 - protein, 17 aa, Cryptosporidium hominis
IALLCGWSGRKAGKDAN

SEQ ID NO: 2185481 - protein, 20 aa, Cryptosporidium hominis
IARRFGVEMVFFHGRGGSIG

SEQ ID NO: 2185482 - protein, 24 aa, Cryptosporidium hominis
IAVCRVCKSPCRIITLPYIFRYLS

SEQ ID NO: 2185483 - protein, 18 aa, Cryptosporidium hominis
ICEKLKLHGLVVIGGDDS

SEQ ID NO: 2185484 - protein, 17 aa, Cryptosporidium hominis
ICELLRSPRFCRSTSII

SEQ ID NO: 2185485 - protein, 19 aa, Cryptosporidium hominis
ICFNCLSLTLPSIIETTMG

SEQ ID NO: 2185486 - protein, 20 aa, Cryptosporidium hominis
ICGFLDRTIRVWFRTDQQLF

SEQ ID NO: 2185487 - protein, 18 aa, Cryptosporidium hominis
ICGVYCLDVGFLTDASKF

SEQ ID NO: 2185488 - protein, 24 aa, Cryptosporidium hominis
ICHRGKILVCNACYLRVSKENKIR

SEQ ID NO: 2185489 - protein, 20 aa, Cryptosporidium hominis
ICINFRLPVILTNFMAPTKK

SEQ ID NO: 2185490 - protein, 22 aa, Cryptosporidium hominis
ICLNLKLPIWVSSMAKQFYNAY

SEQ ID NO: 2185491 - protein, 25 aa, Cryptosporidium hominis
ICSIPVFEIRLVWKDKILSNNALLS

SEQ ID NO: 2185492 - protein, 19 aa, Cryptosporidium hominis
ICSTLSPGLNLEFETEIKS

SEQ ID NO: 2185493 - protein, 18 aa, Cryptosporidium hominis
ICVLDCSVFGRFNAIIPE

SEQ ID NO: 2185494 - protein, 19 aa, Cryptosporidium hominis
ICYIYKYRRESILKENLFK

SEQ ID NO: 2185495 - protein, 17 aa, Cryptosporidium hominis
IDCVSWPVILDLLLTKM

SEQ ID NO: 2185496 - protein, 20 aa, Cryptosporidium hominis
IDDPANWSWRQKSFLLEELG

SEQ ID NO: 2185497 - protein, 17 aa, Cryptosporidium hominis
IDETFCLALEHGLPPTG

SEQ ID NO: 2185498 - protein, 23 aa, Cryptosporidium hominis
IDHSYCYKIAWSYEKGRDDYKVM

SEQ ID NO: 2185499 - protein, 19 aa, Cryptosporidium hominis
IDIQFVWNIVLCRKYKYLS

SEQ ID NO: 2185500 - protein, 24 aa, Cryptosporidium hominis
IDKSYLDLMVWWRKNYMEFFSSIR

SEQ ID NO: 2185501 - protein, 24 aa, Cryptosporidium hominis
IDNPLCKICDPFFIGYSDLLNLQV

SEQ ID NO: 2185502 - protein, 18 aa, Cryptosporidium hominis
IDPRCHRAHWGIGYVWFK

SEQ ID NO: 2185503 - protein, 17 aa, Cryptosporidium hominis
IDSFFGYCIFEFLERVL

SEQ ID NO: 2185504 - protein, 17 aa, Cryptosporidium hominis
IDWWRIVLDEAQMTEGY

SEQ ID NO: 2185505 - protein, 24 aa, Cryptosporidium hominis
IDYKSHGIGVFLPEGRTIDPNAND

SEQ ID NO: 2185506 - protein, 25 aa, Cryptosporidium hominis
IEAKLELLLLYRGCSSKRPHTKRGR

SEQ ID NO: 2185507 - protein, 19 aa, Cryptosporidium hominis
IEFLIRFLLNMKRELESGK

SEQ ID NO: 2185508 - protein, 18 aa, Cryptosporidium hominis
IEGDIPYRVFIKGKMYPG

SEQ ID NO: 2185509 - protein, 23 aa, Cryptosporidium hominis
IEINGCKASHIYKSLIQQNMSHM

SEQ ID NO: 2185510 - protein, 18 aa, Cryptosporidium hominis
IEKKEEWGLYDDLIYKFL

SEQ ID NO: 2185511 - protein, 18 aa, Cryptosporidium hominis
IEKVWKPKVEEINSKCED

SEQ ID NO: 2185512 - protein, 22 aa, Cryptosporidium hominis
IELLKLLTWYLSWNKILEYPSA

SEQ ID NO: 2185513 - protein, 17 aa, Cryptosporidium hominis
IELLRAFLRLSKEDIIL

SEQ ID NO: 2185514 - protein, 22 aa, Cryptosporidium hominis
IENDCSLCLRQIGISNNIPGVV

SEQ ID NO: 2185515 - protein, 17 aa, Cryptosporidium hominis
IEWKGPFPLHNSIIQHV

SEQ ID NO: 2185516 - protein, 22 aa, Cryptosporidium hominis
IEYWFNRCCLYLSNNDIDNAMT

SEQ ID NO: 2185517 - protein, 22 aa, Cryptosporidium hominis
IFDLPGSIIIKLDLGKFGGNKP

SEQ ID NO: 2185518 - protein, 20 aa, Cryptosporidium hominis
IFHANCLLPWLNQHNSCPVC

SEQ ID NO: 2185519 - protein, 19 aa, Cryptosporidium hominis
IFIHGWKLAFLTVSPMSKL

SEQ ID NO: 2185520 - protein, 17 aa, Cryptosporidium hominis
IFLRQGYTHLVDWWSVG

SEQ ID NO: 2185521 - protein, 18 aa, Cryptosporidium hominis
IFLTKNCRYTEDIDNKLS

SEQ ID NO: 2185522 - protein, 18 aa, Cryptosporidium hominis
IFQRKYWPVFIGTIPICD

SEQ ID NO: 2185523 - protein, 17 aa, Cryptosporidium hominis
IFTSFRFYVYILIELKK

SEQ ID NO: 2185524 - protein, 17 aa, Cryptosporidium hominis
IFTSLKLIERDFKLIQE

SEQ ID NO: 2185525 - protein, 17 aa, Cryptosporidium hominis
IGCCHIKYIMPFPKDLK

SEQ ID NO: 2185526 - protein, 17 aa, Cryptosporidium hominis
IGITIGIKIAHLINNYV

SEQ ID NO: 2185527 - protein, 21 aa, Cryptosporidium hominis
IGKVCSIEFYLYNPLSFPIVC

SEQ ID NO: 2185528 - protein, 18 aa, Cryptosporidium hominis
IGLCPWGWEYISGGKVNS

SEQ ID NO: 2185529 - protein, 31 aa, Cryptosporidium hominis
IGRNEWYIYCLKIIDALVCFDRKGVKYGIPF

SEQ ID NO: 2185530 - protein, 19 aa, Cryptosporidium hominis
IGTCCPIVFHISPSEEKDR

SEQ ID NO: 2185531 - protein, 17 aa, Cryptosporidium hominis
IGYKICDRLGAGSASVV

SEQ ID NO: 2185532 - protein, 17 aa, Cryptosporidium hominis
IHARKAWLNGINPSKNR

SEQ ID NO: 2185533 - protein, 18 aa, Cryptosporidium hominis
IHGVFTWSFCKAISDIAT

SEQ ID NO: 2185534 - protein, 24 aa, Cryptosporidium hominis
IHIGSKLIWKIGFDSYYSIYLNVY

SEQ ID NO: 2185535 - protein, 20 aa, Cryptosporidium hominis
IHLKREWHRLWLVRSFLAFA

SEQ ID NO: 2185536 - protein, 23 aa, Cryptosporidium hominis
IHPLQCILLIIGILRRSLENPNH

SEQ ID NO: 2185537 - protein, 17 aa, Cryptosporidium hominis
IHWLFLSICTFEERKCF

SEQ ID NO: 2185538 - protein, 18 aa, Cryptosporidium hominis
IIDNWRKSVGFIFNDSYK

SEQ ID NO: 2185539 - protein, 17 aa, Cryptosporidium hominis
IIHYCILRLLKIRKSID

SEQ ID NO: 2185540 - protein, 24 aa, Cryptosporidium hominis
IIILKEIWIGMGIKNLLLINILRN

SEQ ID NO: 2185541 - protein, 21 aa, Cryptosporidium hominis
IIPKYKFCCCYSKNCLCDFSV

SEQ ID NO: 2185542 - protein, 17 aa, Cryptosporidium hominis
IIPNCLRQGEFKNVWNI

SEQ ID NO: 2185543 - protein, 18 aa, Cryptosporidium hominis
IIPPRLAIEANILIHQKK

SEQ ID NO: 2185544 - protein, 22 aa, Cryptosporidium hominis
IIPVGGDILCFLPGQQEIEETQ

SEQ ID NO: 2185545 - protein, 25 aa, Cryptosporidium hominis
IIRIPIYPNRCVFLSSIGGGLSSSS

SEQ ID NO: 2185546 - protein, 18 aa, Cryptosporidium hominis
IISGLSFAYPNSSNESFI

SEQ ID NO: 2185547 - protein, 25 aa, Cryptosporidium hominis
IISPVEWKPDVSFLRYGFISPISSN

SEQ ID NO: 2185548 - protein, 19 aa, Cryptosporidium hominis
IKCPICLDSDLLVPKISNC

SEQ ID NO: 2185549 - protein, 26 aa, Cryptosporidium hominis
IKDSFPLPGIYYFRFKVRVGNTYAWM

SEQ ID NO: 2185550 - protein, 18 aa, Cryptosporidium hominis
IKEEIDLMINRIKEIDEI

SEQ ID NO: 2185551 - protein, 21 aa, Cryptosporidium hominis
IKFKIPWKYPKIIHEHVIQQL

SEQ ID NO: 2185552 - protein, 19 aa, Cryptosporidium hominis
IKFKTCRQLFNKAGEILTG

SEQ ID NO: 2185553 - protein, 17 aa, Cryptosporidium hominis
IKFVGFLIRQFKGETEL

SEQ ID NO: 2185554 - protein, 17 aa, Cryptosporidium hominis
IKGLKFLHNDGKLLHGN

SEQ ID NO: 2185555 - protein, 22 aa, Cryptosporidium hominis
IKKAYHKLAIKWHPDKNMGNDR

SEQ ID NO: 2185556 - protein, 18 aa, Cryptosporidium hominis
IKKIRCVSFWVKEWGILF

SEQ ID NO: 2185557 - protein, 18 aa, Cryptosporidium hominis
IKLIDWGSCLSIDQASNT

SEQ ID NO: 2185558 - protein, 18 aa, Cryptosporidium hominis
IKLLTNFVNLVFGITLFL

SEQ ID NO: 2185559 - protein, 20 aa, Cryptosporidium hominis
IKLRCMSRVFSISVMNCEKY

SEQ ID NO: 2185560 - protein, 23 aa, Cryptosporidium hominis
IKNEIIWGFPIVPNITFIKGESN

SEQ ID NO: 2185561 - protein, 22 aa, Cryptosporidium hominis
IKNRPFKNCPICHTKWSRNPES

SEQ ID NO: 2185562 - protein, 19 aa, Cryptosporidium hominis
IKPLMKISCAEYFGISVFL

SEQ ID NO: 2185563 - protein, 17 aa, Cryptosporidium hominis
IKRRNRYGITRGRKHLA

SEQ ID NO: 2185564 - protein, 26 aa, Cryptosporidium hominis
ILCEICRVCGFVIVFAVESEYNEDVI

SEQ ID NO: 2185565 - protein, 19 aa, Cryptosporidium hominis
ILCKAFWKILRSYEISASI

SEQ ID NO: 2185566 - protein, 17 aa, Cryptosporidium hominis
ILCRYIWSFFIPTWNRI

SEQ ID NO: 2185567 - protein, 19 aa, Cryptosporidium hominis
ILEEKLCLIHENIARDIIF

SEQ ID NO: 2185568 - protein, 21 aa, Cryptosporidium hominis
ILEKFHPIWIRKIIDERRNLV

SEQ ID NO: 2185569 - protein, 23 aa, Cryptosporidium hominis
ILFERCFQEYLLLCCDPTESAAN

SEQ ID NO: 2185570 - protein, 23 aa, Cryptosporidium hominis
ILFYEFRLPIIYHIIYLLEILRI

SEQ ID NO: 2185571 - protein, 24 aa, Cryptosporidium hominis
ILFYPRMFCLSSWNLQQQETDQSL

SEQ ID NO: 2185572 - protein, 18 aa, Cryptosporidium hominis
ILHRGCCKIADFGLSKQS

SEQ ID NO: 2185573 - protein, 17 aa, Cryptosporidium hominis
ILIDRAVPVPMELQIIQ

SEQ ID NO: 2185574 - protein, 23 aa, Cryptosporidium hominis
ILKKDEWVCVLPLSVKSQEWADS

SEQ ID NO: 2185575 - protein, 18 aa, Cryptosporidium hominis
ILLEKGLHEILKFNPNIE

SEQ ID NO: 2185576 - protein, 23 aa, Cryptosporidium hominis
ILLERWNPFLLYKFEQEYFKNGA

SEQ ID NO: 2185577 - protein, 18 aa, Cryptosporidium hominis
ILLFELFIQFGLIDKITI

SEQ ID NO: 2185578 - protein, 19 aa, Cryptosporidium hominis
ILNLQCMWRHYNLKIQLKA

SEQ ID NO: 2185579 - protein, 20 aa, Cryptosporidium hominis
ILRKEMKNLLLLSKKEAYQF

SEQ ID NO: 2185580 - protein, 22 aa, Cryptosporidium hominis
ILSMLRFKPAPVYILDEIDSAL

SEQ ID NO: 2185581 - protein, 17 aa, Cryptosporidium hominis
ILSPSFKMIFHDDGVTT

SEQ ID NO: 2185582 - protein, 20 aa, Cryptosporidium hominis
ILSRFDLIFLLKDEKNVERD

SEQ ID NO: 2185583 - protein, 18 aa, Cryptosporidium hominis
ILSSICGGEGLKMVAKEK

SEQ ID NO: 2185584 - protein, 17 aa, Cryptosporidium hominis
ILSVFGFEELYRMNILE

SEQ ID NO: 2185585 - protein, 18 aa, Cryptosporidium hominis
ILYSFKFSPLKNIIIENQ

SEQ ID NO: 2185586 - protein, 17 aa, Cryptosporidium hominis
IMIKLLREWILNANRGE

SEQ ID NO: 2185587 - protein, 23 aa, Cryptosporidium hominis
INERINNLWLPRKNKTTQFDKDK

SEQ ID NO: 2185588 - protein, 18 aa, Cryptosporidium hominis
INITEGFPSVGFQFETYL

SEQ ID NO: 2185589 - protein, 24 aa, Cryptosporidium hominis
INKNNGSCPFCFFKGNNKGQKSSI

SEQ ID NO: 2185590 - protein, 18 aa, Cryptosporidium hominis
INLSLYWDESSSYLFDNT

SEQ ID NO: 2185591 - protein, 24 aa, Cryptosporidium hominis
INNSKLCICLNCNQTGHVNCGRQA

SEQ ID NO: 2185592 - protein, 18 aa, Cryptosporidium hominis
INNWKIKIELGIEEEKKT

SEQ ID NO: 2185593 - protein, 21 aa, Cryptosporidium hominis
INSCLSWKTFGYFNLISCYSV

SEQ ID NO: 2185594 - protein, 18 aa, Cryptosporidium hominis
INVLEKFACCLRIEIFMD

SEQ ID NO: 2185595 - protein, 23 aa, Cryptosporidium hominis
IPCGHTFCRYCITHNRLLGKKCP

SEQ ID NO: 2185596 - protein, 18 aa, Cryptosporidium hominis
IPCVLDFLKQRYLVNQIY

SEQ ID NO: 2185597 - protein, 17 aa, Cryptosporidium hominis
IPELFWDKDFILNLNAG

SEQ ID NO: 2185598 - protein, 17 aa, Cryptosporidium hominis
IPFDFVFSTINETGTGI

SEQ ID NO: 2185599 - protein, 17 aa, Cryptosporidium hominis
IPFGWCEFFVKLFETNS

SEQ ID NO: 2185600 - protein, 17 aa, Cryptosporidium hominis
IPFKYKWSYFIGLLQNL

SEQ ID NO: 2185601 - protein, 17 aa, Cryptosporidium hominis
IPGYLFGMISTRLTVDD

SEQ ID NO: 2185602 - protein, 19 aa, Cryptosporidium hominis
IPIEFCNWIIDSFLSKYQT

SEQ ID NO: 2185603 - protein, 17 aa, Cryptosporidium hominis
IPIFIKWKSKQFNSKLI

SEQ ID NO: 2185604 - protein, 18 aa, Cryptosporidium hominis
IPIGLKLRDMIGIAETGS

SEQ ID NO: 2185605 - protein, 21 aa, Cryptosporidium hominis
IPKERSCIFLDSINEQDSSVN

SEQ ID NO: 2185606 - protein, 17 aa, Cryptosporidium hominis
IPLPRWDRVALVRHFDT

SEQ ID NO: 2185607 - protein, 26 aa, Cryptosporidium hominis
IPNLSKRLECMILRSSFEQLYLESLK

SEQ ID NO: 2185608 - protein, 17 aa, Cryptosporidium hominis
IPNYILLLFGRNIENEL

SEQ ID NO: 2185609 - protein, 17 aa, Cryptosporidium hominis
IPPEYISGISIEIPPRF

SEQ ID NO: 2185610 - protein, 25 aa, Cryptosporidium hominis
IPPKGELRGGAWVVVDSNINPEFIE

SEQ ID NO: 2185611 - protein, 26 aa, Cryptosporidium hominis
IPTCISWSMDGTRLFIGYMNGNVIMC

SEQ ID NO: 2185612 - protein, 18 aa, Cryptosporidium hominis
IPVPDWMRPLLFTKSPNE

SEQ ID NO: 2185613 - protein, 23 aa, Cryptosporidium hominis
IPVSCLRPGLRWIQLFDANFIDI

SEQ ID NO: 2185614 - protein, 17 aa, Cryptosporidium hominis
IPYWLVPVFEFLKLPAS

SEQ ID NO: 2185615 - protein, 17 aa, Cryptosporidium hominis
IQEKLRLKMEGWTIHGS

SEQ ID NO: 2185616 - protein, 17 aa, Cryptosporidium hominis
IQFKCIFCKILVQMIIY

SEQ ID NO: 2185617 - protein, 17 aa, Cryptosporidium hominis
IQGLIGRYNSMCMDDQI

SEQ ID NO: 2185618 - protein, 17 aa, Cryptosporidium hominis
IQKGASITPRFSLEESL

SEQ ID NO: 2185619 - protein, 18 aa, Cryptosporidium hominis
IQKPYFLLFKLPRSLSLV

SEQ ID NO: 2185620 - protein, 17 aa, Cryptosporidium hominis
IQKSIFLALNFIDHNLY

SEQ ID NO: 2185621 - protein, 21 aa, Cryptosporidium hominis
IQKSIPWISNNNINMNINTGN

SEQ ID NO: 2185622 - protein, 18 aa, Cryptosporidium hominis
IQKSSFPHGSFRPSSSNI

SEQ ID NO: 2185623 - protein, 17 aa, Cryptosporidium hominis
IQLPSNIPIIFDHKEYK

SEQ ID NO: 2185624 - protein, 17 aa, Cryptosporidium hominis
IQRIPWRELKEIHHDAQ

SEQ ID NO: 2185625 - protein, 18 aa, Cryptosporidium hominis
IQSIIRYHFENIINKDNN

SEQ ID NO: 2185626 - protein, 35 aa, Cryptosporidium hominis
IQYAKDFEFFFGVPYRPYIRLSRYRFGKNMKYPRD

SEQ ID NO: 2185627 - protein, 19 aa, Cryptosporidium hominis
IRAQCVLAMKAFEEEYQSC

SEQ ID NO: 2185628 - protein, 22 aa, Cryptosporidium hominis
IRCSIKFFSLYRHIKRKNACIQ

SEQ ID NO: 2185629 - protein, 18 aa, Cryptosporidium hominis
IRDTRFNYILGIVLYSVR

SEQ ID NO: 2185630 - protein, 18 aa, Cryptosporidium hominis
IRGLLNLCGTSGKIEPNF

SEQ ID NO: 2185631 - protein, 17 aa, Cryptosporidium hominis
IRKRLDSYFSIVVRNIR

SEQ ID NO: 2185632 - protein, 23 aa, Cryptosporidium hominis
IRKTEIFWKFFLENLKGDMMNKT

SEQ ID NO: 2185633 - protein, 17 aa, Cryptosporidium hominis
IRMAINLFHDYFYCQIK

SEQ ID NO: 2185634 - protein, 19 aa, Cryptosporidium hominis
IRMKKRLVGTFGYLAPEVL

SEQ ID NO: 2185635 - protein, 19 aa, Cryptosporidium hominis
IRNLFPIYRNPLYAGFGNR

SEQ ID NO: 2185636 - protein, 18 aa, Cryptosporidium hominis
IRSTAWIPKGEYIPEDII

SEQ ID NO: 2185637 - protein, 18 aa, Cryptosporidium hominis
IRWPLLWNNSMRCKMNFL

SEQ ID NO: 2185638 - protein, 23 aa, Cryptosporidium hominis
ISCCNARLIPQIPRCDLTKHEDE

SEQ ID NO: 2185639 - protein, 25 aa, Cryptosporidium hominis
ISECDLYLFSTCNATSAKIMPEDTI

SEQ ID NO: 2185640 - protein, 25 aa, Cryptosporidium hominis
ISECDLYLFSTCNATSTKFMPDGTI

SEQ ID NO: 2185641 - protein, 27 aa, Cryptosporidium hominis
ISELRYIVLICIRWRLQNSSELSSNVS

SEQ ID NO: 2185642 - protein, 18 aa, Cryptosporidium hominis
ISFKEAFLSEKWNLNSNL

SEQ ID NO: 2185643 - protein, 17 aa, Cryptosporidium hominis
ISGISIEIPPRFDLTKL

SEQ ID NO: 2185644 - protein, 18 aa, Cryptosporidium hominis
ISICLRELFSYFANTRWK

SEQ ID NO: 2185645 - protein, 18 aa, Cryptosporidium hominis
ISKVPVIMFSPSIINFRR

SEQ ID NO: 2185646 - protein, 25 aa, Cryptosporidium hominis
ISLIKRLRYISSLKLGIFREILFRV

SEQ ID NO: 2185647 - protein, 23 aa, Cryptosporidium hominis
ISLWKTIFPWIWNNLEYQQRNEL

SEQ ID NO: 2185648 - protein, 18 aa, Cryptosporidium hominis
ISPLRSGLMINEESEEKF

SEQ ID NO: 2185649 - protein, 19 aa, Cryptosporidium hominis
ISPNFISFIEFWRLYEEML

SEQ ID NO: 2185650 - protein, 17 aa, Cryptosporidium hominis
ISQKLFPGWLSPDMLKC

SEQ ID NO: 2185651 - protein, 22 aa, Cryptosporidium hominis
ISRLRFPLYMAHIEKLLGETCK

SEQ ID NO: 2185652 - protein, 27 aa, Cryptosporidium hominis
ISRYFLEVMKAIILSGGYGSRLRPLTL

SEQ ID NO: 2185653 - protein, 21 aa, Cryptosporidium hominis
ISSSVKDLIKWMMTKDPESRC

SEQ ID NO: 2185654 - protein, 19 aa, Cryptosporidium hominis
ISTIGYWSIIDGFSSSLIK

SEQ ID NO: 2185655 - protein, 18 aa, Cryptosporidium hominis
ISVEIERDWFQIYNVDME

SEQ ID NO: 2185656 - protein, 20 aa, Cryptosporidium hominis
ISVEVCIRSDINLIQNEGDS

SEQ ID NO: 2185657 - protein, 17 aa, Cryptosporidium hominis
ITCKREIKCWIYKNQIK

SEQ ID NO: 2185658 - protein, 23 aa, Cryptosporidium hominis
ITFLYKFISGICPKSYGMNVAQL

SEQ ID NO: 2185659 - protein, 21 aa, Cryptosporidium hominis
ITNRLGTWLLRIQLNNKLVTD

SEQ ID NO: 2185660 - protein, 18 aa, Cryptosporidium hominis
ITRLYGLKPIRTLTLGTT

SEQ ID NO: 2185661 - protein, 18 aa, Cryptosporidium hominis
IVEGLKLDKGYISPYFIT

SEQ ID NO: 2185662 - protein, 24 aa, Cryptosporidium hominis
IVFSCKYLPFKFFKVRNLDLFLDL

SEQ ID NO: 2185663 - protein, 22 aa, Cryptosporidium hominis
IVFSGLCSRCLVQVSYGIGIAR

SEQ ID NO: 2185664 - protein, 24 aa, Cryptosporidium hominis
IVGGCGTVGVGARQGGGIGDLQQL

SEQ ID NO: 2185665 - protein, 17 aa, Cryptosporidium hominis
IVKRSGRPGITLIDKKF

SEQ ID NO: 2185666 - protein, 17 aa, Cryptosporidium hominis
IVLCIGESLSERETGKT

SEQ ID NO: 2185667 - protein, 17 aa, Cryptosporidium hominis
IWAKLILERLIRIDNSE

SEQ ID NO: 2185668 - protein, 18 aa, Cryptosporidium hominis
IWLIREIYLSLTPQILKL

SEQ ID NO: 2185669 - protein, 17 aa, Cryptosporidium hominis
IYCSLDIDKRFQLADWR

SEQ ID NO: 2185670 - protein, 17 aa, Cryptosporidium hominis
IYFDCIKNLLKHIESKS

SEQ ID NO: 2185671 - protein, 18 aa, Cryptosporidium hominis
IYFDICINGIILLDDEFK

SEQ ID NO: 2185672 - protein, 18 aa, Cryptosporidium hominis
IYGGLSLYKRNKKRITGI

SEQ ID NO: 2185673 - protein, 18 aa, Cryptosporidium hominis
IYGKCLLVPELCSKGDEP

SEQ ID NO: 2185674 - protein, 17 aa, Cryptosporidium hominis
IYKGYGIKNETDGSVTE

SEQ ID NO: 2185675 - protein, 18 aa, Cryptosporidium hominis
IYKILCLILSMLETNQNT

SEQ ID NO: 2185676 - protein, 17 aa, Cryptosporidium hominis
IYLETISVFGIIHKPKI

SEQ ID NO: 2185677 - protein, 18 aa, Cryptosporidium hominis
IYNFLRDRLRAVWQDLTV

SEQ ID NO: 2185678 - protein, 20 aa, Cryptosporidium hominis
KAGGCGINLIGANRLVMFDP

SEQ ID NO: 2185679 - protein, 24 aa, Cryptosporidium hominis
KAHCPFCQIELDWNRVKPFIVLFK

SEQ ID NO: 2185680 - protein, 20 aa, Cryptosporidium hominis
KAICCLTKLFQCCPDRLRAN

SEQ ID NO: 2185681 - protein, 25 aa, Cryptosporidium hominis
KAICMKFAIKLCIACGIASKESIDH

SEQ ID NO: 2185682 - protein, 23 aa, Cryptosporidium hominis
KAKLTGDVKFRWYVNENCANLGL

SEQ ID NO: 2185683 - protein, 19 aa, Cryptosporidium hominis
KALRLPVLYLLQFKNNLTN

SEQ ID NO: 2185684 - protein, 20 aa, Cryptosporidium hominis
KALYRRGLARLGFGMYEESK

SEQ ID NO: 2185685 - protein, 18 aa, Cryptosporidium hominis
KAPWKSRYLFEIFRNRQL

SEQ ID NO: 2185686 - protein, 23 aa, Cryptosporidium hominis
KARSKLWWFCRMAEHCGLVGREG

SEQ ID NO: 2185687 - protein, 19 aa, Cryptosporidium hominis
KASVLPGVWHEHLGNISIQ

SEQ ID NO: 2185688 - protein, 17 aa, Cryptosporidium hominis
KAYTGPEIDVWSCGVIL

SEQ ID NO: 2185689 - protein, 17 aa, Cryptosporidium hominis
KCKSIVCYLPTKCPVCL

SEQ ID NO: 2185690 - protein, 17 aa, Cryptosporidium hominis
KCNPSWFINTVIPIPPP

SEQ ID NO: 2185691 - protein, 22 aa, Cryptosporidium hominis
KCSNVNFPRRFRCFKCGEYRDE

SEQ ID NO: 2185692 - protein, 21 aa, Cryptosporidium hominis
KCYTLPIKGFGELVQREQQQR

SEQ ID NO: 2185693 - protein, 17 aa, Cryptosporidium hominis
KDAITLVARRAEIMASL

SEQ ID NO: 2185694 - protein, 19 aa, Cryptosporidium hominis
KDEGFNWCGNTVSRITNNE

SEQ ID NO: 2185695 - protein, 18 aa, Cryptosporidium hominis
KDFRRIASFMEYKTIKDC

SEQ ID NO: 2185696 - protein, 18 aa, Cryptosporidium hominis
KDFRYICEFDYFSRDAKL

SEQ ID NO: 2185697 - protein, 22 aa, Cryptosporidium hominis
KDGMCKYGPHACNYRIVKEVVF

SEQ ID NO: 2185698 - protein, 17 aa, Cryptosporidium hominis
KDIFDRLNCEPLKIEAY

SEQ ID NO: 2185699 - protein, 25 aa, Cryptosporidium hominis
KDIVCSGLIPKFFSRISLLNDPKAI

SEQ ID NO: 2185700 - protein, 21 aa, Cryptosporidium hominis
KDKESRVYARFTWATRKYSKS

SEQ ID NO: 2185701 - protein, 20 aa, Cryptosporidium hominis
KDLVLRYSQFINFPIYIYNP

SEQ ID NO: 2185702 - protein, 19 aa, Cryptosporidium hominis
KDPTLIIALHLKDTGNCIP

SEQ ID NO: 2185703 - protein, 21 aa, Cryptosporidium hominis
KDPVQRLLILLAHVYLTKPMT

SEQ ID NO: 2185704 - protein, 17 aa, Cryptosporidium hominis
KDRCTGLIANLHRMGIN

SEQ ID NO: 2185705 - protein, 20 aa, Cryptosporidium hominis
KDVLKHVIDFNIGRKTNILS

SEQ ID NO: 2185706 - protein, 19 aa, Cryptosporidium hominis
KEALKHPFFKGMDFTKIRL

SEQ ID NO: 2185707 - protein, 18 aa, Cryptosporidium hominis
KEDLKILVTKGVANISPK

SEQ ID NO: 2185708 - protein, 21 aa, Cryptosporidium hominis
KEFKMNLCLISLNRMDFELNM

SEQ ID NO: 2185709 - protein, 18 aa, Cryptosporidium hominis
KEFQGRCNYIKYSTQWYL

SEQ ID NO: 2185710 - protein, 21 aa, Cryptosporidium hominis
KEGILGRGSISWLNLKPKIPY

SEQ ID NO: 2185711 - protein, 21 aa, Cryptosporidium hominis
KEIRRIAKMLVWLQENNPKTS

SEQ ID NO: 2185712 - protein, 25 aa, Cryptosporidium hominis
KELMWKCLVCSQVFESRNKLFAHVK

SEQ ID NO: 2185713 - protein, 23 aa, Cryptosporidium hominis
KEMGSRLGGLVGYSIRFEDCTSE

SEQ ID NO: 2185714 - protein, 24 aa, Cryptosporidium hominis
KEMRRLCSILTFLFDSKNSGCLEF

SEQ ID NO: 2185715 - protein, 22 aa, Cryptosporidium hominis
KENEFIPCFALDFTKNSVPSSL

SEQ ID NO: 2185716 - protein, 20 aa, Cryptosporidium hominis
KERNLRLVSIDDWEEAPDVD

SEQ ID NO: 2185717 - protein, 17 aa, Cryptosporidium hominis
KERVAICGEKGVYIWSF

SEQ ID NO: 2185718 - protein, 19 aa, Cryptosporidium hominis
KEVFKCFLCGELGHTLKDC

SEQ ID NO: 2185719 - protein, 19 aa, Cryptosporidium hominis
KEWRLCTGIELILTAKVPI

SEQ ID NO: 2185720 - protein, 20 aa, Cryptosporidium hominis
KEYLFKAFLIILSLEDNVDA

SEQ ID NO: 2185721 - protein, 19 aa, Cryptosporidium hominis
KEYLYLMALVDDSKFIDVD

SEQ ID NO: 2185722 - protein, 20 aa, Cryptosporidium hominis
KEYWRFLVGYNYELLISLLH

SEQ ID NO: 2185723 - protein, 17 aa, Cryptosporidium hominis
KFCVKRLGFSITYNKRR

SEQ ID NO: 2185724 - protein, 32 aa, Cryptosporidium hominis
KFKHLEFFNTLLIRLEKFLSWIAKNNIQEYGV

SEQ ID NO: 2185725 - protein, 18 aa, Cryptosporidium hominis
KFKWSFLHTEKFWLENVM

SEQ ID NO: 2185726 - protein, 26 aa, Cryptosporidium hominis
KFMPDGTIFKQGWTLFVMINTGVPDY

SEQ ID NO: 2185727 - protein, 19 aa, Cryptosporidium hominis
KFPHSIWIQALRFLASSRF

SEQ ID NO: 2185728 - protein, 22 aa, Cryptosporidium hominis
KFPRKSSKFVLSFKKSSDDIVR

SEQ ID NO: 2185729 - protein, 17 aa, Cryptosporidium hominis
KFPSGLVEIVFYDEQED

SEQ ID NO: 2185730 - protein, 18 aa, Cryptosporidium hominis
KFQLSLNNLEIWFHRDNK

SEQ ID NO: 2185731 - protein, 18 aa, Cryptosporidium hominis
KFRRHLICPNHIIVEEIK

SEQ ID NO: 2185732 - protein, 18 aa, Cryptosporidium hominis
KFSDMYFCHFYKTNIELE

SEQ ID NO: 2185733 - protein, 17 aa, Cryptosporidium hominis
KFSFVFFYNQLVNIEGI

SEQ ID NO: 2185734 - protein, 23 aa, Cryptosporidium hominis
KFYCNLVPYMIKNLWRRLENASY

SEQ ID NO: 2185735 - protein, 20 aa, Cryptosporidium hominis
KGEHPVQCMIFSGPFTTDKE

SEQ ID NO: 2185736 - protein, 20 aa, Cryptosporidium hominis
KGFSSLHWASLKGHSQVVEE

SEQ ID NO: 2185737 - protein, 25 aa, Cryptosporidium hominis
KGKCCAFWKKWCCCCLSDKGPTKSG

SEQ ID NO: 2185738 - protein, 24 aa, Cryptosporidium hominis
KGLEWKVVFIPKFVDKVFPLYRES

SEQ ID NO: 2185739 - protein, 19 aa, Cryptosporidium hominis
KGNCGIKFKSRRDSIENML

SEQ ID NO: 2185740 - protein, 25 aa, Cryptosporidium hominis
KGNYLKFGFNVPRTDLLPISISFFD

SEQ ID NO: 2185741 - protein, 21 aa, Cryptosporidium hominis
KGSFKYAWVLDKLKAERERGI

SEQ ID NO: 2185742 - protein, 19 aa, Cryptosporidium hominis
KGSVIRFISTIFHHYLIPY

SEQ ID NO: 2185743 - protein, 18 aa, Cryptosporidium hominis
KHILSFNKKWEKPSKYHK

SEQ ID NO: 2185744 - protein, 19 aa, Cryptosporidium hominis
KHWLRKKCNNYLVMIRCSI

SEQ ID NO: 2185745 - protein, 18 aa, Cryptosporidium hominis
KIAKMIARIAMIRRKRKV

SEQ ID NO: 2185746 - protein, 25 aa, Cryptosporidium hominis
KIAMIKRLWIKLCEILIKYGVNLTI

SEQ ID NO: 2185747 - protein, 21 aa, Cryptosporidium hominis
KICNRPCTMFRWKLHNSKKYN

SEQ ID NO: 2185748 - protein, 19 aa, Cryptosporidium hominis
KIDRFEPFSSLIKQLATQP

SEQ ID NO: 2185749 - protein, 24 aa, Cryptosporidium hominis
KIENGWRFKYIFPIGHSPSVSSFV

SEQ ID NO: 2185750 - protein, 21 aa, Cryptosporidium hominis
KILKSRCSIPFIANGGISNYE

SEQ ID NO: 2185751 - protein, 18 aa, Cryptosporidium hominis
KIPMFWLQVKLIEILELF

SEQ ID NO: 2185752 - protein, 22 aa, Cryptosporidium hominis
KIQEHWLWKKNVPFIYDYLFIT

SEQ ID NO: 2185753 - protein, 20 aa, Cryptosporidium hominis
KISVIFWRKIWINIYKIVHG

SEQ ID NO: 2185754 - protein, 22 aa, Cryptosporidium hominis
KITEISRAWVLEAEASKQILDN

SEQ ID NO: 2185755 - protein, 23 aa, Cryptosporidium hominis
KIYFDFSNNFIKSNFLNNIEKFI

SEQ ID NO: 2185756 - protein, 26 aa, Cryptosporidium hominis
KIYKRDWQQVCLDWIYCDLCNNWYHW

SEQ ID NO: 2185757 - protein, 20 aa, Cryptosporidium hominis
KKCRNGVHCCFCHFQHKERK

SEQ ID NO: 2185758 - protein, 19 aa, Cryptosporidium hominis
KKEDLEFVSPFYLKAARKD

SEQ ID NO: 2185759 - protein, 18 aa, Cryptosporidium hominis
KKFEELREALQHGLAPIS

SEQ ID NO: 2185760 - protein, 20 aa, Cryptosporidium hominis
KKFVPRCCFFGGKAAPGYAT

SEQ ID NO: 2185761 - protein, 21 aa, Cryptosporidium hominis
KKGLICFSCGSILRSSFGSKI

SEQ ID NO: 2185762 - protein, 25 aa, Cryptosporidium hominis
KKGSSRISLQWGCLAEEYPKFDVSV

SEQ ID NO: 2185763 - protein, 25 aa, Cryptosporidium hominis
KKIRPATGIPRSFLRAINFDEEGRL

SEQ ID NO: 2185764 - protein, 21 aa, Cryptosporidium hominis
KKISRFLICLVITDRPMECFK

SEQ ID NO: 2185765 - protein, 19 aa, Cryptosporidium hominis
KKIVIEIEIGRCIIDLKVA

SEQ ID NO: 2185766 - protein, 24 aa, Cryptosporidium hominis
KKLLNIRMLYPFTIRCNGCEVYHY

SEQ ID NO: 2185767 - protein, 20 aa, Cryptosporidium hominis
KKLLVFLIWKIVNNPEINYK

SEQ ID NO: 2185768 - protein, 20 aa, Cryptosporidium hominis
KKLRCCTKEGLTLEETAEEK

SEQ ID NO: 2185769 - protein, 20 aa, Cryptosporidium hominis
KKLRGCPHVIQLIDSEIALS

SEQ ID NO: 2185770 - protein, 24 aa, Cryptosporidium hominis
KKQYGWFWVCPEGGDNCKYRHCLP

SEQ ID NO: 2185771 - protein, 19 aa, Cryptosporidium hominis
KKRIEDFKNGVSIDSSGPT

SEQ ID NO: 2185772 - protein, 19 aa, Cryptosporidium hominis
KKSKKCCIFHKKRNFGESS

SEQ ID NO: 2185773 - protein, 17 aa, Cryptosporidium hominis
KKVFCKSKKPIGSLKDF

SEQ ID NO: 2185774 - protein, 22 aa, Cryptosporidium hominis
KLARRAAGIIVRMVKQGKIAGR

SEQ ID NO: 2185775 - protein, 19 aa, Cryptosporidium hominis
KLDLIMYSAIGWARHGEIN

SEQ ID NO: 2185776 - protein, 17 aa, Cryptosporidium hominis
KLFGFKGVKVIQFLDST

SEQ ID NO: 2185777 - protein, 17 aa, Cryptosporidium hominis
KLIERLKILLLYLKQEI

SEQ ID NO: 2185778 - protein, 23 aa, Cryptosporidium hominis
KLINKRGRKSLSYNGSSINEQNS

SEQ ID NO: 2185779 - protein, 18 aa, Cryptosporidium hominis
KLKAEQFLVFLIKLIIKL

SEQ ID NO: 2185780 - protein, 23 aa, Cryptosporidium hominis
KLKKRTPLSWVWNNQIYDQKSES

SEQ ID NO: 2185781 - protein, 19 aa, Cryptosporidium hominis
KLKLKVILIDGTWSQAKSI

SEQ ID NO: 2185782 - protein, 19 aa, Cryptosporidium hominis
KLLCFCLEFFLKYLQVAGR

SEQ ID NO: 2185783 - protein, 22 aa, Cryptosporidium hominis
KLLEPYCRLFSYSQTENFFGTQ

SEQ ID NO: 2185784 - protein, 17 aa, Cryptosporidium hominis
KLLFKLIIKSVIKNDPE

SEQ ID NO: 2185785 - protein, 19 aa, Cryptosporidium hominis
KLLFSFIELCKFNKNNIVG

SEQ ID NO: 2185786 - protein, 17 aa, Cryptosporidium hominis
KLLGSYFIKANKMPIAI

SEQ ID NO: 2185787 - protein, 25 aa, Cryptosporidium hominis
KLLILKRRCINYFSFGEESRVGITF

SEQ ID NO: 2185788 - protein, 24 aa, Cryptosporidium hominis
KLLSECGTILRWSRQEDPTTKKLS

SEQ ID NO: 2185789 - protein, 19 aa, Cryptosporidium hominis
KLPLGDLGRKMLLKKLREI

SEQ ID NO: 2185790 - protein, 22 aa, Cryptosporidium hominis
KLPWQKVCIDIATSVSFLQKPP

SEQ ID NO: 2185791 - protein, 23 aa, Cryptosporidium hominis
KLREYSAIFGRSWNRIILDEAHR

SEQ ID NO: 2185792 - protein, 18 aa, Cryptosporidium hominis
KLRLFKENFGFEIYIKEK

SEQ ID NO: 2185793 - protein, 18 aa, Cryptosporidium hominis
KLRLLYRDHVTTFVDTRI

SEQ ID NO: 2185794 - protein, 18 aa, Cryptosporidium hominis
KLSCFDWFECESSIVSMK

SEQ ID NO: 2185795 - protein, 26 aa, Cryptosporidium hominis
KLSKKSLKEGFQWLISMEENTGNENY

SEQ ID NO: 2185796 - protein, 18 aa, Cryptosporidium hominis
KLSLGIHCSFRFVNIVRY

SEQ ID NO: 2185797 - protein, 19 aa, Cryptosporidium hominis
KLVCLKRLMGSLSDDQYLR

SEQ ID NO: 2185798 - protein, 20 aa, Cryptosporidium hominis
KLWLLCWPSPISLCSIDERF

SEQ ID NO: 2185799 - protein, 21 aa, Cryptosporidium hominis
KLYPNWKWSQRWHGIREKFYL

SEQ ID NO: 2185800 - protein, 19 aa, Cryptosporidium hominis
KLYRISVEIERDWFQIYNV

SEQ ID NO: 2185801 - protein, 24 aa, Cryptosporidium hominis
KMIKRIGLKLGVEIGGPILIFKNE

SEQ ID NO: 2185802 - protein, 18 aa, Cryptosporidium hominis
KMRGFAMVEFENDEQIQN

SEQ ID NO: 2185803 - protein, 17 aa, Cryptosporidium hominis
KMYYPHYICVGISDRKS

SEQ ID NO: 2185804 - protein, 17 aa, Cryptosporidium hominis
KNCFDIISFLNIVYDLS

SEQ ID NO: 2185805 - protein, 21 aa, Cryptosporidium hominis
KNEIIGGLGLESSVISMNNGF

SEQ ID NO: 2185806 - protein, 19 aa, Cryptosporidium hominis
KNFPIYTLLALRTISSEFK

SEQ ID NO: 2185807 - protein, 18 aa, Cryptosporidium hominis
KNFRPSINTLQEWLSITW

SEQ ID NO: 2185808 - protein, 19 aa, Cryptosporidium hominis
KNIRSSYMLSRSISPTLTP

SEQ ID NO: 2185809 - protein, 18 aa, Cryptosporidium hominis
KNLLSIYCSLDIDKRFQL

SEQ ID NO: 2185810 - protein, 23 aa, Cryptosporidium hominis
KNLMGMRGPQRFSIHKSFGENRL

SEQ ID NO: 2185811 - protein, 17 aa, Cryptosporidium hominis
KNLRCLLLGGNKIKDFS

SEQ ID NO: 2185812 - protein, 19 aa, Cryptosporidium hominis
KNNCELLIFTSFRFYVYIL

SEQ ID NO: 2185813 - protein, 23 aa, Cryptosporidium hominis
KNNRYLLKIARFEEAFITIIPTL

SEQ ID NO: 2185814 - protein, 19 aa, Cryptosporidium hominis
KNPFRWRGMLKDLYGVSEE

SEQ ID NO: 2185815 - protein, 17 aa, Cryptosporidium hominis
KNWFCFQCLSLTLRILP

SEQ ID NO: 2185816 - protein, 22 aa, Cryptosporidium hominis
KNWSCEVWFYVPFEITFHPYCL

SEQ ID NO: 2185817 - protein, 24 aa, Cryptosporidium hominis
KPEVVGLLEWLASIVIYRQNRYME

SEQ ID NO: 2185818 - protein, 18 aa, Cryptosporidium hominis
KPFPGLISKVSVPWKRVK

SEQ ID NO: 2185819 - protein, 18 aa, Cryptosporidium hominis
KPGNIILHRGCCKIADFG

SEQ ID NO: 2185820 - protein, 17 aa, Cryptosporidium hominis
KPLFPVKPLLSISSPDF

SEQ ID NO: 2185821 - protein, 20 aa, Cryptosporidium hominis
KPMICDFILFSILFDDISLI

SEQ ID NO: 2185822 - protein, 20 aa, Cryptosporidium hominis
KPQGWRVVYYTGKDREFEYF

SEQ ID NO: 2185823 - protein, 18 aa, Cryptosporidium hominis
KPRDEIFTSLKLIERDFK

SEQ ID NO: 2185824 - protein, 20 aa, Cryptosporidium hominis
KPSVLWCYKKELGFSSHKKV

SEQ ID NO: 2185825 - protein, 17 aa, Cryptosporidium hominis
KPWIKKLLHKWGTGTME

SEQ ID NO: 2185826 - protein, 18 aa, Cryptosporidium hominis
KQILLWLNDNEISLFDND

SEQ ID NO: 2185827 - protein, 21 aa, Cryptosporidium hominis
KQKIDVCFYIGFVPFYSKVIL

SEQ ID NO: 2185828 - protein, 18 aa, Cryptosporidium hominis
KQKLKFILKHAISKSTSN

SEQ ID NO: 2185829 - protein, 19 aa, Cryptosporidium hominis
KQRARLAAMVSRRRVTLQH

SEQ ID NO: 2185830 - protein, 19 aa, Cryptosporidium hominis
KQRYSVPWCYENFLQSRAL

SEQ ID NO: 2185831 - protein, 21 aa, Cryptosporidium hominis
KRAKNFLSLCETIGNEKVTQS

SEQ ID NO: 2185832 - protein, 21 aa, Cryptosporidium hominis
KRFFECIKLILKKEATRIVKI

SEQ ID NO: 2185833 - protein, 19 aa, Cryptosporidium hominis
KRFKSVPLYIEWAPVNLFV

SEQ ID NO: 2185834 - protein, 19 aa, Cryptosporidium hominis
KRFLSLLKRPSFASIDLNL

SEQ ID NO: 2185835 - protein, 18 aa, Cryptosporidium hominis
KRFVLLVGHQRITIIDTW

SEQ ID NO: 2185836 - protein, 19 aa, Cryptosporidium hominis
KRGIRCFAWVCNNEKEMNI

SEQ ID NO: 2185837 - protein, 17 aa, Cryptosporidium hominis
KRIGFPVMIKASSGGGG

SEQ ID NO: 2185838 - protein, 20 aa, Cryptosporidium hominis
KRIQFKIQVCKIGAGKFPIL

SEQ ID NO: 2185839 - protein, 22 aa, Cryptosporidium hominis
KRLAEEWRLRYLYSNPNGPNGQ

SEQ ID NO: 2185840 - protein, 21 aa, Cryptosporidium hominis
KRLDSYFSIVVRNIRDSVPKI

SEQ ID NO: 2185841 - protein, 19 aa, Cryptosporidium hominis
KRLPDWAKRFHRILKVISQ

SEQ ID NO: 2185842 - protein, 24 aa, Cryptosporidium hominis
KRMIGEILKWYFGMSHVSLNDITP

SEQ ID NO: 2185843 - protein, 21 aa, Cryptosporidium hominis
KRPILCITVGLGFDSFIVVRN

SEQ ID NO: 2185844 - protein, 17 aa, Cryptosporidium hominis
KRSLDSFAFPITSEKGK

SEQ ID NO: 2185845 - protein, 17 aa, Cryptosporidium hominis
KRWKISLYLSYAKWESL

SEQ ID NO: 2185846 - protein, 20 aa, Cryptosporidium hominis
KRWLPCFKVITYFGTPKERQ

SEQ ID NO: 2185847 - protein, 17 aa, Cryptosporidium hominis
KSAFKRCIEDEIMITTI

SEQ ID NO: 2185848 - protein, 19 aa, Cryptosporidium hominis
KSASVSIISPVEWKPDVSF

SEQ ID NO: 2185849 - protein, 17 aa, Cryptosporidium hominis
KSCTGRQTLLFSATLTN

SEQ ID NO: 2185850 - protein, 18 aa, Cryptosporidium hominis
KSKCIWKSVRMINIPKEA

SEQ ID NO: 2185851 - protein, 18 aa, Cryptosporidium hominis
KSKMIWSEIGHIVHSNRK

SEQ ID NO: 2185852 - protein, 20 aa, Cryptosporidium hominis
KSLLFIPSHPPFDMFDTYMG

SEQ ID NO: 2185853 - protein, 19 aa, Cryptosporidium hominis
KSPAWLRFIDICLNEIFQK

SEQ ID NO: 2185854 - protein, 17 aa, Cryptosporidium hominis
KSPGGIFFRLIRNQISH

SEQ ID NO: 2185855 - protein, 20 aa, Cryptosporidium hominis
KSQCCINTLGGFECKDSKDG

SEQ ID NO: 2185856 - protein, 28 aa, Cryptosporidium hominis
KSQRFLLIFIRISLLDFKRIILEIMEEI

SEQ ID NO: 2185857 - protein, 20 aa, Cryptosporidium hominis
KSSNWKEICHYIFTFRIYKD

SEQ ID NO: 2185858 - protein, 20 aa, Cryptosporidium hominis
KSVIFPKNWFNGIKSTENPL

SEQ ID NO: 2185859 - protein, 24 aa, Cryptosporidium hominis
KSWESRLAKQVKLFNKASSDVLEV

SEQ ID NO: 2185860 - protein, 17 aa, Cryptosporidium hominis
KSWKEWFIPKHSIWCLF

SEQ ID NO: 2185861 - protein, 17 aa, Cryptosporidium hominis
KSYNLWSNRAWLLEFIV

SEQ ID NO: 2185862 - protein, 25 aa, Cryptosporidium hominis
KTFKEYIIRQLGIRWERIKKQNIET

SEQ ID NO: 2185863 - protein, 18 aa, Cryptosporidium hominis
KTHILKRSKSIGVSKVKR

SEQ ID NO: 2185864 - protein, 18 aa, Cryptosporidium hominis
KTKFSGRWGSLISSMALK

SEQ ID NO: 2185865 - protein, 20 aa, Cryptosporidium hominis
KTLFKYSSWVGGDRDGNPYV

SEQ ID NO: 2185866 - protein, 25 aa, Cryptosporidium hominis
KTLKCCFEWFKTFKIMESDGVVCDD

SEQ ID NO: 2185867 - protein, 21 aa, Cryptosporidium hominis
KTLPIRLSDEFLMSFISNEGH

SEQ ID NO: 2185868 - protein, 19 aa, Cryptosporidium hominis
KTNSCKHLFSWIEYEMALL

SEQ ID NO: 2185869 - protein, 25 aa, Cryptosporidium hominis
KTPPASPVEFEWLLHLVLHSALSQL

SEQ ID NO: 2185870 - protein, 18 aa, Cryptosporidium hominis
KTTTRFASGNVDGVTTRT

SEQ ID NO: 2185871 - protein, 19 aa, Cryptosporidium hominis
KVFDFRPGILIKQLNLKSP

SEQ ID NO: 2185872 - protein, 18 aa, Cryptosporidium hominis
KVHNCLWSYVAKCTVFQP

SEQ ID NO: 2185873 - protein, 24 aa, Cryptosporidium hominis
KVLLKRRKIVYITAGFNGCTSVKT

SEQ ID NO: 2185874 - protein, 17 aa, Cryptosporidium hominis
KVTSMGLLYGRKEKEQE

SEQ ID NO: 2185875 - protein, 20 aa, Cryptosporidium hominis
KVVIDCFRLISPHSVIAGQE

SEQ ID NO: 2185876 - protein, 17 aa, Cryptosporidium hominis
KWFDIVFCLNSETHVLF

SEQ ID NO: 2185877 - protein, 21 aa, Cryptosporidium hominis
KWKSFVMVLKCCFSLLQRGNQ

SEQ ID NO: 2185878 - protein, 22 aa, Cryptosporidium hominis
KWNSDWIKRCMKIGNYISNKYY

SEQ ID NO: 2185879 - protein, 18 aa, Cryptosporidium hominis
KWPDLLPFLFRLISNLQN

SEQ ID NO: 2185880 - protein, 17 aa, Cryptosporidium hominis
KWPFIFFKSRIEFLETV

SEQ ID NO: 2185881 - protein, 21 aa, Cryptosporidium hominis
KWRIIRCIIRQIPLWIRYNQL

SEQ ID NO: 2185882 - protein, 18 aa, Cryptosporidium hominis
KWRLQKISWKYCILDEAH

SEQ ID NO: 2185883 - protein, 19 aa, Cryptosporidium hominis
KYAGEIIIVRFERSQIFPE

SEQ ID NO: 2185884 - protein, 18 aa, Cryptosporidium hominis
KYFTCFYGSNNIENSSLV

SEQ ID NO: 2185885 - protein, 19 aa, Cryptosporidium hominis
KYGRFCGFFNNGIFHSFHY

SEQ ID NO: 2185886 - protein, 20 aa, Cryptosporidium hominis
KYLCYKYKFMLVPSILILVI

SEQ ID NO: 2185887 - protein, 21 aa, Cryptosporidium hominis
KYWLKYSIEIIRQIRWILGNS

SEQ ID NO: 2185888 - protein, 18 aa, Cryptosporidium hominis
LADKRFVLLVGHQRITII

SEQ ID NO: 2185889 - protein, 18 aa, Cryptosporidium hominis
LAMESLKLAMKWDEDRFG

SEQ ID NO: 2185890 - protein, 18 aa, Cryptosporidium hominis
LAPLLSLVLVCKDTHEKE

SEQ ID NO: 2185891 - protein, 24 aa, Cryptosporidium hominis
LARMKKLYVCLGRHSIYLLKRNLR

SEQ ID NO: 2185892 - protein, 17 aa, Cryptosporidium hominis
LCIACGIASKESIDHLK

SEQ ID NO: 2185893 - protein, 18 aa, Cryptosporidium hominis
LCRCAICYDPGKAQFNET

SEQ ID NO: 2185894 - protein, 20 aa, Cryptosporidium hominis
LCRRSLREGCDFGPLRCQYS

SEQ ID NO: 2185895 - protein, 18 aa, Cryptosporidium hominis
LCSCPGFISVCNNKKKIH

SEQ ID NO: 2185896 - protein, 18 aa, Cryptosporidium hominis
LCSGYDLFLSDDRIIEKM

SEQ ID NO: 2185897 - protein, 23 aa, Cryptosporidium hominis
LCSKGNIYLPAWARIYNDRTKLE

SEQ ID NO: 2185898 - protein, 17 aa, Cryptosporidium hominis
LCSQVIFPTPLVSTEKV

SEQ ID NO: 2185899 - protein, 18 aa, Cryptosporidium hominis
LCWRCHKRDATPHMRSCE

SEQ ID NO: 2185900 - protein, 22 aa, Cryptosporidium hominis
LDDGSGLILIDWLVDNTGTKYK

SEQ ID NO: 2185901 - protein, 25 aa, Cryptosporidium hominis
LDELRWVQLHVRPEFGFILSPTAPK

SEQ ID NO: 2185902 - protein, 17 aa, Cryptosporidium hominis
LDKELVGIIGMENSISL

SEQ ID NO: 2185903 - protein, 17 aa, Cryptosporidium hominis
LDLRGSVPIQIHQPPQI

SEQ ID NO: 2185904 - protein, 17 aa, Cryptosporidium hominis
LDLSCWLPQNLTAICNP

SEQ ID NO: 2185905 - protein, 22 aa, Cryptosporidium hominis
LDLWNLGCLIYWSYQVSSNLNP

SEQ ID NO: 2185906 - protein, 18 aa, Cryptosporidium hominis
LDNPFRWVLFPIKYSRLW

SEQ ID NO: 2185907 - protein, 23 aa, Cryptosporidium hominis
LDPRIVMRILFNFRKLHPVSYKT

SEQ ID NO: 2185908 - protein, 22 aa, Cryptosporidium hominis
LDSIGALLFDWIRRIPKSQILE

SEQ ID NO: 2185909 - protein, 25 aa, Cryptosporidium hominis
LDVYWKGDITFRISIFHPTELEQIA

SEQ ID NO: 2185910 - protein, 17 aa, Cryptosporidium hominis
LEAESGTQISIRGKGTT

SEQ ID NO: 2185911 - protein, 19 aa, Cryptosporidium hominis
LEDAWPCAELIGYYLDKKN

SEQ ID NO: 2185912 - protein, 19 aa, Cryptosporidium hominis
LEDGDCCWIHGFVVDVEID

SEQ ID NO: 2185913 - protein, 18 aa, Cryptosporidium hominis
LEFRCSSCEIYLRRMHGL

SEQ ID NO: 2185914 - protein, 26 aa, Cryptosporidium hominis
LEGIRCPFCIIGFLVPSPIFKKSEVV

SEQ ID NO: 2185915 - protein, 17 aa, Cryptosporidium hominis
LEKRKTYVIGVVPDPGI

SEQ ID NO: 2185916 - protein, 21 aa, Cryptosporidium hominis
LELDYLLGWWLGAREAEFVRM

SEQ ID NO: 2185917 - protein, 21 aa, Cryptosporidium hominis
LELFSNLIIYSGFYLPPNSNI

SEQ ID NO: 2185918 - protein, 21 aa, Cryptosporidium hominis
LELKLRIGWISVSYGDGWLDS

SEQ ID NO: 2185919 - protein, 17 aa, Cryptosporidium hominis
LEMGCALYFIKSKQNFN

SEQ ID NO: 2185920 - protein, 24 aa, Cryptosporidium hominis
LENFLKEWDKICVIVSHSRDLLNQ

SEQ ID NO: 2185921 - protein, 20 aa, Cryptosporidium hominis
LEPAIKFCFGHTIICEDENI

SEQ ID NO: 2185922 - protein, 19 aa, Cryptosporidium hominis
LEPVYLRRLIRLMSNKLYE

SEQ ID NO: 2185923 - protein, 17 aa, Cryptosporidium hominis
LESIFELLSDIHLQVLK

SEQ ID NO: 2185924 - protein, 24 aa, Cryptosporidium hominis
LESSDRTQLMWAMITDYCEMIKNT

SEQ ID NO: 2185925 - protein, 18 aa, Cryptosporidium hominis
LETFKGLQVRPWPKAIQE

SEQ ID NO: 2185926 - protein, 22 aa, Cryptosporidium hominis
LETICLLFALKIRYPRQIHLIR

SEQ ID NO: 2185927 - protein, 21 aa, Cryptosporidium hominis
LEVIDCIYLICSMLLEVPYLA

SEQ ID NO: 2185928 - protein, 19 aa, Cryptosporidium hominis
LEVPLKFVLDVAFSDFSNY

SEQ ID NO: 2185929 - protein, 18 aa, Cryptosporidium hominis
LEYLAGSCNFQWILSNVY

SEQ ID NO: 2185930 - protein, 21 aa, Cryptosporidium hominis
LEYRFNHIIGHGISIGDNNYS

SEQ ID NO: 2185931 - protein, 17 aa, Cryptosporidium hominis
LFDAWMLYINFEKDRML

SEQ ID NO: 2185932 - protein, 17 aa, Cryptosporidium hominis
LFHPDCIQQLLFCFHNN

SEQ ID NO: 2185933 - protein, 18 aa, Cryptosporidium hominis
LFILKIIKDFSIGNKWDG

SEQ ID NO: 2185934 - protein, 17 aa, Cryptosporidium hominis
LFLKLLHRFSQFKFRSI

SEQ ID NO: 2185935 - protein, 18 aa, Cryptosporidium hominis
LFMRCLYSSLLLLYDYSS

SEQ ID NO: 2185936 - protein, 23 aa, Cryptosporidium hominis
LFSSCIGCSIIPTKIREEKKFFS

SEQ ID NO: 2185937 - protein, 19 aa, Cryptosporidium hominis
LGDLFKLLVHIIGKPIVEP

SEQ ID NO: 2185938 - protein, 17 aa, Cryptosporidium hominis
LGEHGIIVWMSRDPIGI

SEQ ID NO: 2185939 - protein, 20 aa, Cryptosporidium hominis
LGETCKYIFMEVIKHGRIST

SEQ ID NO: 2185940 - protein, 25 aa, Cryptosporidium hominis
LGFPEYWKRITVMRCMAPVISLSWS

SEQ ID NO: 2185941 - protein, 17 aa, Cryptosporidium hominis
LGHLSCRVCGVEYTSRI

SEQ ID NO: 2185942 - protein, 22 aa, Cryptosporidium hominis
LGIHCSFRFVNIVRYFRYFRKC

SEQ ID NO: 2185943 - protein, 17 aa, Cryptosporidium hominis
LGIKCFITISGSGLKFI

SEQ ID NO: 2185944 - protein, 24 aa, Cryptosporidium hominis
LGKGWKIFLARSVDLGRWAIIQKL

SEQ ID NO: 2185945 - protein, 24 aa, Cryptosporidium hominis
LGKWRECKDYVFSLSIWDYNQEDL

SEQ ID NO: 2185946 - protein, 18 aa, Cryptosporidium hominis
LGLCKPCVFVNKTNKKCR

SEQ ID NO: 2185947 - protein, 25 aa, Cryptosporidium hominis
LGLMLKGPLFMRSCKDTIDERSQGY

SEQ ID NO: 2185948 - protein, 17 aa, Cryptosporidium hominis
LGSEFERVFSIAVEIAT

SEQ ID NO: 2185949 - protein, 20 aa, Cryptosporidium hominis
LGSFSSILGYIPYNILLASE

SEQ ID NO: 2185950 - protein, 19 aa, Cryptosporidium hominis
LHFAYRWALVDLFDTSELF

SEQ ID NO: 2185951 - protein, 24 aa, Cryptosporidium hominis
LHFFELRLARYLSYCVDGGLLGAK

SEQ ID NO: 2185952 - protein, 18 aa, Cryptosporidium hominis
LHRCWKDIFVENIISPES

SEQ ID NO: 2185953 - protein, 18 aa, Cryptosporidium hominis
LIAIPLYASMSFDEQKKA

SEQ ID NO: 2185954 - protein, 17 aa, Cryptosporidium hominis
LICSLVCEPSQRIKSAK

SEQ ID NO: 2185955 - protein, 19 aa, Cryptosporidium hominis
LIDSWRVGPSMLIGRRNLA

SEQ ID NO: 2185956 - protein, 17 aa, Cryptosporidium hominis
LIELCFELKHSLATKYI

SEQ ID NO: 2185957 - protein, 24 aa, Cryptosporidium hominis
LIGDELRAVLGLSASAIRGVKVSK

SEQ ID NO: 2185958 - protein, 18 aa, Cryptosporidium hominis
LIGLDYLHRICGVIHTDI

SEQ ID NO: 2185959 - protein, 20 aa, Cryptosporidium hominis
LILKKPRLRDIKQLQYTVEP

SEQ ID NO: 2185960 - protein, 23 aa, Cryptosporidium hominis
LIQRTRWPIICICNDRMSEKVRN

SEQ ID NO: 2185961 - protein, 18 aa, Cryptosporidium hominis
LIRKCFEVFVSIGGSVSK

SEQ ID NO: 2185962 - protein, 23 aa, Cryptosporidium hominis
LIRMRYPRCEGSTMRYFFVDTRS

SEQ ID NO: 2185963 - protein, 17 aa, Cryptosporidium hominis
LIRQLFKDFVRIITQGR

SEQ ID NO: 2185964 - protein, 18 aa, Cryptosporidium hominis
LISFEFLGLAAMNLSSLD

SEQ ID NO: 2185965 - protein, 17 aa, Cryptosporidium hominis
LISMMGVRNEGSIRNNL

SEQ ID NO: 2185966 - protein, 20 aa, Cryptosporidium hominis
LITMCLRPNPDLRASSKEVF

SEQ ID NO: 2185967 - protein, 22 aa, Cryptosporidium hominis
LIYSLIEWRSVFGLVCSFKSFI

SEQ ID NO: 2185968 - protein, 17 aa, Cryptosporidium hominis
LKAPRRPSLLVQQRNYS

SEQ ID NO: 2185969 - protein, 19 aa, Cryptosporidium hominis
LKARCSILAAANPTFGSYD

SEQ ID NO: 2185970 - protein, 18 aa, Cryptosporidium hominis
LKEERWSVCESGLDYITN

SEQ ID NO: 2185971 - protein, 17 aa, Cryptosporidium hominis
LKELWSLIDFVYPGKLG

SEQ ID NO: 2185972 - protein, 19 aa, Cryptosporidium hominis
LKFISVFFKPGWRESNFQE

SEQ ID NO: 2185973 - protein, 19 aa, Cryptosporidium hominis
LKHRSIVLGEQMKAYTLGH

SEQ ID NO: 2185974 - protein, 19 aa, Cryptosporidium hominis
LKHTLRLASRVSISNNAKV

SEQ ID NO: 2185975 - protein, 17 aa, Cryptosporidium hominis
LKIGITIGIKIAHLINN

SEQ ID NO: 2185976 - protein, 20 aa, Cryptosporidium hominis
LKKRRKKVSINRHIKNPLDA

SEQ ID NO: 2185977 - protein, 21 aa, Cryptosporidium hominis
LKLSFGYGWNLLHIFSYLEHI

SEQ ID NO: 2185978 - protein, 19 aa, Cryptosporidium hominis
LKMMFDWNFEFNWYEDFTD

SEQ ID NO: 2185979 - protein, 24 aa, Cryptosporidium hominis
LKMVRGRCLGFYGVKGFLQGKHIT

SEQ ID NO: 2185980 - protein, 19 aa, Cryptosporidium hominis
LKNHMFGYGKFDWTDHRCY

SEQ ID NO: 2185981 - protein, 17 aa, Cryptosporidium hominis
LKNNPEWLVLDQYREIG

SEQ ID NO: 2185982 - protein, 18 aa, Cryptosporidium hominis
LKNQIPILLASVGISTQD

SEQ ID NO: 2185983 - protein, 17 aa, Cryptosporidium hominis
LKPLYLLYRHLKDSTYQ

SEQ ID NO: 2185984 - protein, 19 aa, Cryptosporidium hominis
LKPSWYIRVVILFFSTREA

SEQ ID NO: 2185985 - protein, 20 aa, Cryptosporidium hominis
LKRPRFATFDSFGSEYAVLM

SEQ ID NO: 2185986 - protein, 19 aa, Cryptosporidium hominis
LKRSLGLIMLRGENIVTFV

SEQ ID NO: 2185987 - protein, 25 aa, Cryptosporidium hominis
LKSCLGSVRIPHHWNSKRRYLQGKK

SEQ ID NO: 2185988 - protein, 21 aa, Cryptosporidium hominis
LKSIEKGDCSIIWIKDDGEQL

SEQ ID NO: 2185989 - protein, 18 aa, Cryptosporidium hominis
LKTNLWLERSWIIHFSGS

SEQ ID NO: 2185990 - protein, 17 aa, Cryptosporidium hominis
LKVCGNELCEFLVNVVE

SEQ ID NO: 2185991 - protein, 20 aa, Cryptosporidium hominis
LKYHAGIVLLELERYEEALT

SEQ ID NO: 2185992 - protein, 17 aa, Cryptosporidium hominis
LLDEIIILFSQSLNIEF

SEQ ID NO: 2185993 - protein, 17 aa, Cryptosporidium hominis
LLDFYGWLCDRCEFEKK

SEQ ID NO: 2185994 - protein, 17 aa, Cryptosporidium hominis
LLDVSPWFNYGFTEKTF

SEQ ID NO: 2185995 - protein, 18 aa, Cryptosporidium hominis
LLEQKILFLKLVIQGVIG

SEQ ID NO: 2185996 - protein, 17 aa, Cryptosporidium hominis
LLFCFHNNFPILWHPQV

SEQ ID NO: 2185997 - protein, 18 aa, Cryptosporidium hominis
LLFLSVLMGPKWERELKR

SEQ ID NO: 2185998 - protein, 20 aa, Cryptosporidium hominis
LLGFNCTIFAYGQTGTGKTY

SEQ ID NO: 2185999 - protein, 17 aa, Cryptosporidium hominis
LLHPERFVQLGIDPPKG

SEQ ID NO: 2186000 - protein, 17 aa, Cryptosporidium hominis
LLINSPLHRRSHLKHFR

SEQ ID NO: 2186001 - protein, 17 aa, Cryptosporidium hominis
LLKFCFIVWPSLNNTKT

SEQ ID NO: 2186002 - protein, 19 aa, Cryptosporidium hominis
LLLCLSGDCIISFNEKITK

SEQ ID NO: 2186003 - protein, 17 aa, Cryptosporidium hominis
LLNCHVGDWQPVDSDRV

SEQ ID NO: 2186004 - protein, 18 aa, Cryptosporidium hominis
LLNFLSFVQDLFKNYCSP

SEQ ID NO: 2186005 - protein, 21 aa, Cryptosporidium hominis
LLRKVCTDINLSLNYPIQSFE

SEQ ID NO: 2186006 - protein, 18 aa, Cryptosporidium hominis
LLSFPSLLEKGLSKLFSI

SEQ ID NO: 2186007 - protein, 18 aa, Cryptosporidium hominis
LLSPRVFIHDHIVLDKDL

SEQ ID NO: 2186008 - protein, 17 aa, Cryptosporidium hominis
LLTGVVKLFCHKVEYLD

SEQ ID NO: 2186009 - protein, 23 aa, Cryptosporidium hominis
LLTKWMGCPPLPFKLDDKETDNL

SEQ ID NO: 2186010 - protein, 19 aa, Cryptosporidium hominis
LLVFLKMRWLSNNVCSIEC

SEQ ID NO: 2186011 - protein, 17 aa, Cryptosporidium hominis
LLVYRYLIENGFVHTAF

SEQ ID NO: 2186012 - protein, 20 aa, Cryptosporidium hominis
LLWRCYKICEERGYYDLVSS

SEQ ID NO: 2186013 - protein, 24 aa, Cryptosporidium hominis
LMSRYRCYTEWKLLYRCNRHPNIL

SEQ ID NO: 2186014 - protein, 17 aa, Cryptosporidium hominis
LMTELGCGYECEDSQIT

SEQ ID NO: 2186015 - protein, 23 aa, Cryptosporidium hominis
LNCKKCGFLLSEYCENWVTAPLP

SEQ ID NO: 2186016 - protein, 17 aa, Cryptosporidium hominis
LNDACKIFELLFFSDNT

SEQ ID NO: 2186017 - protein, 19 aa, Cryptosporidium hominis
LNDFLRYFVDIFIEESVSV

SEQ ID NO: 2186018 - protein, 20 aa, Cryptosporidium hominis
LNIISEFLVLRGFRHQRLDG

SEQ ID NO: 2186019 - protein, 21 aa, Cryptosporidium hominis
LNIKSGFPILGTQILCNNIEK

SEQ ID NO: 2186020 - protein, 21 aa, Cryptosporidium hominis
LNIYISWSSYRLMESEKNNSD

SEQ ID NO: 2186021 - protein, 19 aa, Cryptosporidium hominis
LNKFCLRNNMSFLLHLLVF

SEQ ID NO: 2186022 - protein, 23 aa, Cryptosporidium hominis
LNKIPIRFPWILEELPIAQSFKN

SEQ ID NO: 2186023 - protein, 19 aa, Cryptosporidium hominis
LNNLLSFKGNLLRIGKPKV

SEQ ID NO: 2186024 - protein, 18 aa, Cryptosporidium hominis
LNSDFGDSPLCFISLIDC

SEQ ID NO: 2186025 - protein, 18 aa, Cryptosporidium hominis
LNSHEFYKSITLDYLNKN

SEQ ID NO: 2186026 - protein, 18 aa, Cryptosporidium hominis
LNVLKSVGFVIVKLKPSQ

SEQ ID NO: 2186027 - protein, 19 aa, Cryptosporidium hominis
LNVREIYGGLSLYKRNKKR

SEQ ID NO: 2186028 - protein, 19 aa, Cryptosporidium hominis
LNWKGRELVALSVLQAYLG

SEQ ID NO: 2186029 - protein, 18 aa, Cryptosporidium hominis
LNYKLLIRKIRWVSEQES

SEQ ID NO: 2186030 - protein, 18 aa, Cryptosporidium hominis
LNYLQGVYSFNGIFNGRP

SEQ ID NO: 2186031 - protein, 18 aa, Cryptosporidium hominis
LPDGFSWFDCNLWDIESQ

SEQ ID NO: 2186032 - protein, 19 aa, Cryptosporidium hominis
LPEEVPIKWTGRLQRTAAQ

SEQ ID NO: 2186033 - protein, 17 aa, Cryptosporidium hominis
LPGNDPLCWIWIDLDGT

SEQ ID NO: 2186034 - protein, 23 aa, Cryptosporidium hominis
LPIATTCGFRLSLPRYSSIEILR

SEQ ID NO: 2186035 - protein, 20 aa, Cryptosporidium hominis
LPLESCFGVSPLIEIFNAEV

SEQ ID NO: 2186036 - protein, 18 aa, Cryptosporidium hominis
LPLLCFSEVFKLGSCISQ

SEQ ID NO: 2186037 - protein, 19 aa, Cryptosporidium hominis
LPLNFCIPPLFGSCNPPFY

SEQ ID NO: 2186038 - protein, 17 aa, Cryptosporidium hominis
LPLWHLFSSLCWQGYHN

SEQ ID NO: 2186039 - protein, 22 aa, Cryptosporidium hominis
LPNCVFPKSFYSWLLNENNNKY

SEQ ID NO: 2186040 - protein, 22 aa, Cryptosporidium hominis
LPPKRELYVYIGLSKLQKKIYS

SEQ ID NO: 2186041 - protein, 19 aa, Cryptosporidium hominis
LPSNIPIIFDHKEYKDQES

SEQ ID NO: 2186042 - protein, 18 aa, Cryptosporidium hominis
LPSYFPAMYVPRAYVNNI

SEQ ID NO: 2186043 - protein, 20 aa, Cryptosporidium hominis
LPYRQFICGLALLIHLAIPW

SEQ ID NO: 2186044 - protein, 18 aa, Cryptosporidium hominis
LPYYLFIHFSRFSKANLN

SEQ ID NO: 2186045 - protein, 20 aa, Cryptosporidium hominis
LQCELCKSPLPSSASIKGSR

SEQ ID NO: 2186046 - protein, 24 aa, Cryptosporidium hominis
LQFLWIRFYGFRVIFRKFNDLLLT

SEQ ID NO: 2186047 - protein, 18 aa, Cryptosporidium hominis
LQIKEWALAAAYLTQQQQ

SEQ ID NO: 2186048 - protein, 18 aa, Cryptosporidium hominis
LQPDFGRSIFGIQYNKNN

SEQ ID NO: 2186049 - protein, 17 aa, Cryptosporidium hominis
LQSFCFMWMLPEHALLN

SEQ ID NO: 2186050 - protein, 17 aa, Cryptosporidium hominis
LQSKRVISQFGIFNIIN

SEQ ID NO: 2186051 - protein, 19 aa, Cryptosporidium hominis
LQVSLADFRRLCILKGVYP

SEQ ID NO: 2186052 - protein, 18 aa, Cryptosporidium hominis
LRAVPCLYRLTTTSISSK

SEQ ID NO: 2186053 - protein, 19 aa, Cryptosporidium hominis
LRCANLFLAKNILFTRVKI

SEQ ID NO: 2186054 - protein, 18 aa, Cryptosporidium hominis
LRCNICLNLQETLNLLDH

SEQ ID NO: 2186055 - protein, 19 aa, Cryptosporidium hominis
LRDEVKFWRCRAEASSKEQ

SEQ ID NO: 2186056 - protein, 19 aa, Cryptosporidium hominis
LRDSLGIKAQEIEKLQTEK

SEQ ID NO: 2186057 - protein, 19 aa, Cryptosporidium hominis
LREFKKWLPDANVVLYHGN

SEQ ID NO: 2186058 - protein, 18 aa, Cryptosporidium hominis
LREQLFMMGFELQDQNIE

SEQ ID NO: 2186059 - protein, 19 aa, Cryptosporidium hominis
LRFIFELIQLSTFGVSERA

SEQ ID NO: 2186060 - protein, 17 aa, Cryptosporidium hominis
LRFLRKLIADFIGFQKF

SEQ ID NO: 2186061 - protein, 17 aa, Cryptosporidium hominis
LRFSWLAPCHLVQIECI

SEQ ID NO: 2186062 - protein, 17 aa, Cryptosporidium hominis
LRGSVPIQIHQPPQIPL

SEQ ID NO: 2186063 - protein, 20 aa, Cryptosporidium hominis
LRIMLKFRRHLICPNHIIVE

SEQ ID NO: 2186064 - protein, 18 aa, Cryptosporidium hominis
LRITSKWELRRICRSIGA

SEQ ID NO: 2186065 - protein, 19 aa, Cryptosporidium hominis
LRKCDVWNLGVLLHCLLVG

SEQ ID NO: 2186066 - protein, 26 aa, Cryptosporidium hominis
LRKRFARKCLRRCILVTDLVSWMKNR

SEQ ID NO: 2186067 - protein, 26 aa, Cryptosporidium hominis
LRKYLPKLNCLFNFALNLGRKPDLMY

SEQ ID NO: 2186068 - protein, 20 aa, Cryptosporidium hominis
LRLACIHPQLGIMGIHNKNK

SEQ ID NO: 2186069 - protein, 33 aa, Cryptosporidium hominis
LRLNYESEYLFRLLWHFSHCCIYHGSLLNSSTL

SEQ ID NO: 2186070 - protein, 17 aa, Cryptosporidium hominis
LRMGLKLLGKWEMSDPY

SEQ ID NO: 2186071 - protein, 17 aa, Cryptosporidium hominis
LRMGRELVKYSSGLRSS

SEQ ID NO: 2186072 - protein, 20 aa, Cryptosporidium hominis
LRMIQKIDQFRVGSIDQSSD

SEQ ID NO: 2186073 - protein, 20 aa, Cryptosporidium hominis
LRNLFGLYCHVVFSLCKFVS

SEQ ID NO: 2186074 - protein, 18 aa, Cryptosporidium hominis
LRNPLSFFFGHLNVTDDL

SEQ ID NO: 2186075 - protein, 17 aa, Cryptosporidium hominis
LRPALNIGKRAKSTVNL

SEQ ID NO: 2186076 - protein, 18 aa, Cryptosporidium hominis
LRPLPDLRFTRLCELTKR

SEQ ID NO: 2186077 - protein, 19 aa, Cryptosporidium hominis
LRQILKLILKIGNFLNHGT

SEQ ID NO: 2186078 - protein, 19 aa, Cryptosporidium hominis
LRRHQRLFASQIMKSILNG

SEQ ID NO: 2186079 - protein, 21 aa, Cryptosporidium hominis
LRSILMADLIGFHFFPYAKQF

SEQ ID NO: 2186080 - protein, 18 aa, Cryptosporidium hominis
LRTVYKYKSIKSGMHSNM

SEQ ID NO: 2186081 - protein, 19 aa, Cryptosporidium hominis
LRVGIKSEHPIASLLSVLS

SEQ ID NO: 2186082 - protein, 17 aa, Cryptosporidium hominis
LRWRSAMELVQMISSIS

SEQ ID NO: 2186083 - protein, 19 aa, Cryptosporidium hominis
LSALSFLIPIDFFCQLKLN

SEQ ID NO: 2186084 - protein, 18 aa, Cryptosporidium hominis
LSATEFDVCHSLLQKIKT

SEQ ID NO: 2186085 - protein, 20 aa, Cryptosporidium hominis
LSDRGICCIDEFDKMDDSSR

SEQ ID NO: 2186086 - protein, 22 aa, Cryptosporidium hominis
LSELRYGISMWSGCTAAVCVRI

SEQ ID NO: 2186087 - protein, 19 aa, Cryptosporidium hominis
LSGDCLTCLYSVGQEEPLV

SEQ ID NO: 2186088 - protein, 17 aa, Cryptosporidium hominis
LSHPIRLYCRFVDKLYI

SEQ ID NO: 2186089 - protein, 21 aa, Cryptosporidium hominis
LSIIYRRLFSYFIQSIIRYHF

SEQ ID NO: 2186090 - protein, 17 aa, Cryptosporidium hominis
LSKNWSCEVWFYVPFEI

SEQ ID NO: 2186091 - protein, 17 aa, Cryptosporidium hominis
LSKRISVLSKFGAPVVR

SEQ ID NO: 2186092 - protein, 23 aa, Cryptosporidium hominis
LSKYLMRCLCSFCSKTTLIKLVN

SEQ ID NO: 2186093 - protein, 20 aa, Cryptosporidium hominis
LSQALARLRFSNIVERADFE

SEQ ID NO: 2186094 - protein, 18 aa, Cryptosporidium hominis
LSSFLLLLVLERSKISIL

SEQ ID NO: 2186095 - protein, 20 aa, Cryptosporidium hominis
LSSRAVFILVEMIGQNFQTK

SEQ ID NO: 2186096 - protein, 21 aa, Cryptosporidium hominis
LSSRLPLPFPIPIQQQPQLQM

SEQ ID NO: 2186097 - protein, 18 aa, Cryptosporidium hominis
LSTRAGGIGINLATADVV

SEQ ID NO: 2186098 - protein, 17 aa, Cryptosporidium hominis
LSTTLAVSSLGVEDTAN

SEQ ID NO: 2186099 - protein, 19 aa, Cryptosporidium hominis
LSWEEFKYILVHFSPNFPI

SEQ ID NO: 2186100 - protein, 22 aa, Cryptosporidium hominis
LSYTRIRFASVQQLFKISYVCD

SEQ ID NO: 2186101 - protein, 17 aa, Cryptosporidium hominis
LTKGMLGYVSKHTLNNF

SEQ ID NO: 2186102 - protein, 17 aa, Cryptosporidium hominis
LTLSIDISRDFSSNEEE

SEQ ID NO: 2186103 - protein, 18 aa, Cryptosporidium hominis
LTNPELFKRVGIKTPKGV

SEQ ID NO: 2186104 - protein, 18 aa, Cryptosporidium hominis
LTQFKWINTQGMLQIIKN

SEQ ID NO: 2186105 - protein, 17 aa, Cryptosporidium hominis
LTSAISIYGHHHSNHQP

SEQ ID NO: 2186106 - protein, 25 aa, Cryptosporidium hominis
LVCFDRKGVKYGIPFLRPVDPNMDG

SEQ ID NO: 2186107 - protein, 18 aa, Cryptosporidium hominis
LVCPELYQQIGIDPPTGV

SEQ ID NO: 2186108 - protein, 23 aa, Cryptosporidium hominis
LVDCKRILREIAILSRLNHDHIV

SEQ ID NO: 2186109 - protein, 19 aa, Cryptosporidium hominis
LVNKFCRLFSGMPFELPPL

SEQ ID NO: 2186110 - protein, 20 aa, Cryptosporidium hominis
LVNLLKQWSSLYGYNNTEGD

SEQ ID NO: 2186111 - protein, 18 aa, Cryptosporidium hominis
LVPDSGLIELLPFYSFHI

SEQ ID NO: 2186112 - protein, 18 aa, Cryptosporidium hominis
LVRLMKRRLIFVSISLLD

SEQ ID NO: 2186113 - protein, 17 aa, Cryptosporidium hominis
LVSNIFLYRSCISDSHR

SEQ ID NO: 2186114 - protein, 23 aa, Cryptosporidium hominis
LVSNRVSYSFGFRGPSQTIDTAC

SEQ ID NO: 2186115 - protein, 18 aa, Cryptosporidium hominis
LVTEWSVEERMVFGREQK

SEQ ID NO: 2186116 - protein, 23 aa, Cryptosporidium hominis
LVYKRLYDCLGPVMFPIAPLKGI

SEQ ID NO: 2186117 - protein, 18 aa, Cryptosporidium hominis
LWPLLNYIEPIKFASIEA

SEQ ID NO: 2186118 - protein, 20 aa, Cryptosporidium hominis
LWSLLNFLLPQVFHSVEDFQ

SEQ ID NO: 2186119 - protein, 18 aa, Cryptosporidium hominis
LWSLLNFLMPNLFSSSED

SEQ ID NO: 2186120 - protein, 17 aa, Cryptosporidium hominis
LWSYVAKCTVFQPHDIE

SEQ ID NO: 2186121 - protein, 17 aa, Cryptosporidium hominis
LWVCNPNKLRVCEFLIR

SEQ ID NO: 2186122 - protein, 17 aa, Cryptosporidium hominis
LYHFCIENNLPPTEETF

SEQ ID NO: 2186123 - protein, 20 aa, Cryptosporidium hominis
LYLDHWLFWLSLTNENNNSS

SEQ ID NO: 2186124 - protein, 18 aa, Cryptosporidium hominis
LYLFGGFDGIQCFNDLWV

SEQ ID NO: 2186125 - protein, 19 aa, Cryptosporidium hominis
LYLKACKFVSVSQTNNKVI

SEQ ID NO: 2186126 - protein, 18 aa, Cryptosporidium hominis
LYLYLCRLLSGAISLRSQ

SEQ ID NO: 2186127 - protein, 19 aa, Cryptosporidium hominis
LYVTLGICKKLNKLFNCKY

SEQ ID NO: 2186128 - protein, 18 aa, Cryptosporidium hominis
MASCGYFAATFCPQQNYS

SEQ ID NO: 2186129 - protein, 18 aa, Cryptosporidium hominis
MCGTSIQWGPWIEQGMAA

SEQ ID NO: 2186130 - protein, 18 aa, Cryptosporidium hominis
MCGTSIQWGPWIEQGMAM

SEQ ID NO: 2186131 - protein, 18 aa, Cryptosporidium hominis
MCPQRIALELSEDRVAAL

SEQ ID NO: 2186132 - protein, 17 aa, Cryptosporidium hominis
MDFCMSGMMVINSLNNT

SEQ ID NO: 2186133 - protein, 21 aa, Cryptosporidium hominis
MEASRLKLIFAGRILNDSQTV

SEQ ID NO: 2186134 - protein, 20 aa, Cryptosporidium hominis
MEIKEAFELFDGDSIGYIDI

SEQ ID NO: 2186135 - protein, 19 aa, Cryptosporidium hominis
MGAVIKRFYIDSIYTQDNL

SEQ ID NO: 2186136 - protein, 21 aa, Cryptosporidium hominis
MGFPDMFNRSGSPNFQGLDPA

SEQ ID NO: 2186137 - protein, 20 aa, Cryptosporidium hominis
MGGLIGFELLKRIKFEQLKD

SEQ ID NO: 2186138 - protein, 18 aa, Cryptosporidium hominis
MIEHCLKESGAEFKVKNY

SEQ ID NO: 2186139 - protein, 19 aa, Cryptosporidium hominis
MIGLLKLVFDKATTQHHFI

SEQ ID NO: 2186140 - protein, 25 aa, Cryptosporidium hominis
MKCKNVKPGECFFGLSPPYVGDDQL

SEQ ID NO: 2186141 - protein, 19 aa, Cryptosporidium hominis
MKSQFCKLVDNFVEETSKA

SEQ ID NO: 2186142 - protein, 18 aa, Cryptosporidium hominis
MLAKKFEFEKIVTRWTSN

SEQ ID NO: 2186143 - protein, 17 aa, Cryptosporidium hominis
MLEFCLSIFSFELREFD

SEQ ID NO: 2186144 - protein, 21 aa, Cryptosporidium hominis
MLKGEMMIPMTPWYKSFKGKI

SEQ ID NO: 2186145 - protein, 19 aa, Cryptosporidium hominis
MLLLLKLVDNILIRIILLT

SEQ ID NO: 2186146 - protein, 18 aa, Cryptosporidium hominis
MLQRRWKVVIWDLSIENL

SEQ ID NO: 2186147 - protein, 19 aa, Cryptosporidium hominis
MLRERIIVLSTNIEDKSSP

SEQ ID NO: 2186148 - protein, 17 aa, Cryptosporidium hominis
MLTFYAIEICFKKIDSK

SEQ ID NO: 2186149 - protein, 17 aa, Cryptosporidium hominis
MLVLGELLISWDKETII

SEQ ID NO: 2186150 - protein, 17 aa, Cryptosporidium hominis
MLVSNLFGTTNLKKQIL

SEQ ID NO: 2186151 - protein, 17 aa, Cryptosporidium hominis
MMDKCYFTGKSDLLNWL

SEQ ID NO: 2186152 - protein, 22 aa, Cryptosporidium hominis
MMKQRVGWMYGYYREDSTYPMG

SEQ ID NO: 2186153 - protein, 25 aa, Cryptosporidium hominis
MNFTIGIGLSRLGLYLMNSKLQSLI

SEQ ID NO: 2186154 - protein, 24 aa, Cryptosporidium hominis
MNGTCGGFVPCFPGTYLNMHYDPH

SEQ ID NO: 2186155 - protein, 18 aa, Cryptosporidium hominis
MNIEMIKGYCLVDAYRHY

SEQ ID NO: 2186156 - protein, 17 aa, Cryptosporidium hominis
MNMLKFEIDKFLADNPL

SEQ ID NO: 2186157 - protein, 23 aa, Cryptosporidium hominis
MNVCKSNVVSIPYSGGLTKGNYL

SEQ ID NO: 2186158 - protein, 23 aa, Cryptosporidium hominis
MPIWMIKRFVDLFNVSRTTYCYV

SEQ ID NO: 2186159 - protein, 18 aa, Cryptosporidium hominis
MQLIYSLLCKSEFQSLTQ

SEQ ID NO: 2186160 - protein, 22 aa, Cryptosporidium hominis
MQMWRRRWEPCLPHILRSPLSI

SEQ ID NO: 2186161 - protein, 17 aa, Cryptosporidium hominis
MQPNWPPPWLVRMQKYG

SEQ ID NO: 2186162 - protein, 22 aa, Cryptosporidium hominis
MRNEFSYFYPLDCRVSGKDLIF

SEQ ID NO: 2186163 - protein, 17 aa, Cryptosporidium hominis
MRSLNELVFDLVMIQEN

SEQ ID NO: 2186164 - protein, 24 aa, Cryptosporidium hominis
MSILSIILERLFNSPFEELQKLHS

SEQ ID NO: 2186165 - protein, 21 aa, Cryptosporidium hominis
MSPRTAKWVRELTPVLEPYNF

SEQ ID NO: 2186166 - protein, 21 aa, Cryptosporidium hominis
MTERFAYEVLLFWQNSAGSSD

SEQ ID NO: 2186167 - protein, 19 aa, Cryptosporidium hominis
MTSCPDLKGAVPLRGEIQN

SEQ ID NO: 2186168 - protein, 18 aa, Cryptosporidium hominis
MVVSYTWNNVYLLGRYIK

SEQ ID NO: 2186169 - protein, 23 aa, Cryptosporidium hominis
MVYRMGLILEETWDKSLEGSRAR

SEQ ID NO: 2186170 - protein, 17 aa, Cryptosporidium hominis
MYWKPLMEWDLKCFVKI

SEQ ID NO: 2186171 - protein, 20 aa, Cryptosporidium hominis
MYYKCLVEWSCLTLDILPDK

SEQ ID NO: 2186172 - protein, 20 aa, Cryptosporidium hominis
NALLRLNNLLSFKGNLLRIG

SEQ ID NO: 2186173 - protein, 19 aa, Cryptosporidium hominis
NALPKLVCKTVKIEENNPE

SEQ ID NO: 2186174 - protein, 19 aa, Cryptosporidium hominis
NCIVRPCFKKIKGKYGSVP

SEQ ID NO: 2186175 - protein, 25 aa, Cryptosporidium hominis
NCLILVKLQLCFSLLYFVNGNFQEC

SEQ ID NO: 2186176 - protein, 18 aa, Cryptosporidium hominis
NCNCTSCLKQVGRMGITS

SEQ ID NO: 2186177 - protein, 21 aa, Cryptosporidium hominis
NCNRYYCPFSHGIEQIRAPEK

SEQ ID NO: 2186178 - protein, 23 aa, Cryptosporidium hominis
NDCNKMSLLFSWYTYVPNNELDT

SEQ ID NO: 2186179 - protein, 20 aa, Cryptosporidium hominis
NDHVCCFMKYYQIIYERLKK

SEQ ID NO: 2186180 - protein, 17 aa, Cryptosporidium hominis
NDIGTCCPIVFHISPSE

SEQ ID NO: 2186181 - protein, 26 aa, Cryptosporidium hominis
NDKEIFKNCILCRDYSSPICKECSKH

SEQ ID NO: 2186182 - protein, 17 aa, Cryptosporidium hominis
NDKFMLIAYKWSNKESL

SEQ ID NO: 2186183 - protein, 23 aa, Cryptosporidium hominis
NDLKGNMFKLGYDKIVSTISSAL

SEQ ID NO: 2186184 - protein, 20 aa, Cryptosporidium hominis
NDLKLLIGFLIKYPLNCLRS

SEQ ID NO: 2186185 - protein, 21 aa, Cryptosporidium hominis
NDLSIPLYRHWNLMDSVYHSE

SEQ ID NO: 2186186 - protein, 23 aa, Cryptosporidium hominis
NEFELPGLVNIYFVSNDHQNILS

SEQ ID NO: 2186187 - protein, 27 aa, Cryptosporidium hominis
NEIFNWLLEYDVPLFIANDLINSELNM

SEQ ID NO: 2186188 - protein, 17 aa, Cryptosporidium hominis
NEILPLIAQRIVFSNII

SEQ ID NO: 2186189 - protein, 20 aa, Cryptosporidium hominis
NEILRLSTTLAVSSLGVEDT

SEQ ID NO: 2186190 - protein, 21 aa, Cryptosporidium hominis
NEIMSRLGFYDSVKGAELAGH

SEQ ID NO: 2186191 - protein, 23 aa, Cryptosporidium hominis
NEMSFRLIFKWFKETFKSLKLKS

SEQ ID NO: 2186192 - protein, 22 aa, Cryptosporidium hominis
NEVLPSWILEKFFVDGGFNVIS

SEQ ID NO: 2186193 - protein, 20 aa, Cryptosporidium hominis
NEWKKAFYLILGFDEEKMIS

SEQ ID NO: 2186194 - protein, 20 aa, Cryptosporidium hominis
NFANSVWDYVKPVSLDELER

SEQ ID NO: 2186195 - protein, 19 aa, Cryptosporidium hominis
NFCTFEFMLSPTLIGVPNT

SEQ ID NO: 2186196 - protein, 24 aa, Cryptosporidium hominis
NFHCWRHRSFVLCCLRYISVIISW

SEQ ID NO: 2186197 - protein, 19 aa, Cryptosporidium hominis
NFIKRKWFDIVFCLNSETH

SEQ ID NO: 2186198 - protein, 20 aa, Cryptosporidium hominis
NFLMDILEAFDCHTDFPPTI

SEQ ID NO: 2186199 - protein, 21 aa, Cryptosporidium hominis
NFTSCWKLPTFLFYSDKKGNL

SEQ ID NO: 2186200 - protein, 24 aa, Cryptosporidium hominis
NGDIKCILWPFSLLFIHKNELSDD

SEQ ID NO: 2186201 - protein, 17 aa, Cryptosporidium hominis
NGFLSIPFLPDLTSPAR

SEQ ID NO: 2186202 - protein, 18 aa, Cryptosporidium hominis
NGKEIYLYFGPQVDSKVI

SEQ ID NO: 2186203 - protein, 20 aa, Cryptosporidium hominis
NGNFKYNILKGFQIYIIGYS

SEQ ID NO: 2186204 - protein, 21 aa, Cryptosporidium hominis
NGSQCLCNFCGHTFDIPMDYL

SEQ ID NO: 2186205 - protein, 19 aa, Cryptosporidium hominis
NGYRFNICHCHDWLAAPVL

SEQ ID NO: 2186206 - protein, 17 aa, Cryptosporidium hominis
NHFWNYIFYCRWVLQVT

SEQ ID NO: 2186207 - protein, 24 aa, Cryptosporidium hominis
NIDILDLFPIFSWLENPNNFNHPM

SEQ ID NO: 2186208 - protein, 23 aa, Cryptosporidium hominis
NIIRCSFGTNKYCNSFIRNSVCN

SEQ ID NO: 2186209 - protein, 18 aa, Cryptosporidium hominis
NILGWRIEIIYVEGGLTV

SEQ ID NO: 2186210 - protein, 20 aa, Cryptosporidium hominis
NILSCYKLACIVQHNHISAI

SEQ ID NO: 2186211 - protein, 23 aa, Cryptosporidium hominis
NIRKELFDNLSFPISLSDGIVGK

SEQ ID NO: 2186212 - protein, 22 aa, Cryptosporidium hominis
NIRLSTGVSEIFGFFETSEDKQ

SEQ ID NO: 2186213 - protein, 25 aa, Cryptosporidium hominis
NISLSRRILICLSYFIITESYREIN

SEQ ID NO: 2186214 - protein, 18 aa, Cryptosporidium hominis
NISSRFLLIKVLHRGNFG

SEQ ID NO: 2186215 - protein, 20 aa, Cryptosporidium hominis
NIWQSICCLMNILNSSEDKF

SEQ ID NO: 2186216 - protein, 19 aa, Cryptosporidium hominis
NKCKTRYGAILNFLIANSS

SEQ ID NO: 2186217 - protein, 17 aa, Cryptosporidium hominis
NKFTFPLLEEFSMIQDQ

SEQ ID NO: 2186218 - protein, 18 aa, Cryptosporidium hominis
NKGTKFTICMIGGGSNGK

SEQ ID NO: 2186219 - protein, 24 aa, Cryptosporidium hominis
NKILNWRSGVEWDLDEVLQIRTIF

SEQ ID NO: 2186220 - protein, 20 aa, Cryptosporidium hominis
NKKRITGIIKRTSIEIEKPL

SEQ ID NO: 2186221 - protein, 24 aa, Cryptosporidium hominis
NKLGWFNCVENFFSVCNDEQIVED

SEQ ID NO: 2186222 - protein, 23 aa, Cryptosporidium hominis
NKLKSHKIFAVFLRYLQKKGIKY

SEQ ID NO: 2186223 - protein, 18 aa, Cryptosporidium hominis
NKLLERWIHKLAKKCINI

SEQ ID NO: 2186224 - protein, 18 aa, Cryptosporidium hominis
NKLSINIIHEFYLNLEID

SEQ ID NO: 2186225 - protein, 17 aa, Cryptosporidium hominis
NKMDFPFDMPSNYSSKY

SEQ ID NO: 2186226 - protein, 24 aa, Cryptosporidium hominis
NKQAKEFNIEFGLEKNTGIKQSNN

SEQ ID NO: 2186227 - protein, 21 aa, Cryptosporidium hominis
NKQRWKWVALLPFIDQKVLLE

SEQ ID NO: 2186228 - protein, 18 aa, Cryptosporidium hominis
NKRLSWQQILALGKSTEK

SEQ ID NO: 2186229 - protein, 19 aa, Cryptosporidium hominis
NKRMTFLIDYCKLHPDDDI

SEQ ID NO: 2186230 - protein, 21 aa, Cryptosporidium hominis
NKSFKLSICNANELIIECKHA

SEQ ID NO: 2186231 - protein, 20 aa, Cryptosporidium hominis
NKSNFRWVWPAHVFVTHTGT

SEQ ID NO: 2186232 - protein, 17 aa, Cryptosporidium hominis
NKWYLPNNMCLFIVGDI

SEQ ID NO: 2186233 - protein, 18 aa, Cryptosporidium hominis
NLDYAKWVIEKGADVNAK

SEQ ID NO: 2186234 - protein, 21 aa, Cryptosporidium hominis
NLEAFECTECSKFYKAINNNR

SEQ ID NO: 2186235 - protein, 25 aa, Cryptosporidium hominis
NLINFICPFCRFFVIDPYNKIIKPL

SEQ ID NO: 2186236 - protein, 25 aa, Cryptosporidium hominis
NLLECCGKLAKLRSYIIWNSIAVIK

SEQ ID NO: 2186237 - protein, 21 aa, Cryptosporidium hominis
NLLRRKGCLTDKSFTKYYAER

SEQ ID NO: 2186238 - protein, 21 aa, Cryptosporidium hominis
NLPESIWLSGFLDQVNLKDVM

SEQ ID NO: 2186239 - protein, 17 aa, Cryptosporidium hominis
NLPRSWYFLGEKIDEIY

SEQ ID NO: 2186240 - protein, 20 aa, Cryptosporidium hominis
NLQSSFGFVEGMGIPPSVSR

SEQ ID NO: 2186241 - protein, 18 aa, Cryptosporidium hominis
NLRCTAKFLIGVSNDCLR

SEQ ID NO: 2186242 - protein, 23 aa, Cryptosporidium hominis
NMFCSCCTCPMQQQFPSCQCGTN

SEQ ID NO: 2186243 - protein, 19 aa, Cryptosporidium hominis
NMMYRQKLSLIISGFISKL

SEQ ID NO: 2186244 - protein, 19 aa, Cryptosporidium hominis
NMRSKCLLIAIGQMLEDYY

SEQ ID NO: 2186245 - protein, 18 aa, Cryptosporidium hominis
NNAIKYIVCEQIKKNKLK

SEQ ID NO: 2186246 - protein, 17 aa, Cryptosporidium hominis
NNCRSLFLSHCFGQKGK

SEQ ID NO: 2186247 - protein, 20 aa, Cryptosporidium hominis
NNFELLLCHPFNLSLNKYNA

SEQ ID NO: 2186248 - protein, 21 aa, Cryptosporidium hominis
NNGNKWKGWGIKSGESTNADL

SEQ ID NO: 2186249 - protein, 17 aa, Cryptosporidium hominis
NNGPLCFTIPEFSNNPT

SEQ ID NO: 2186250 - protein, 17 aa, Cryptosporidium hominis
NNGYSWRKNKPITDNNV

SEQ ID NO: 2186251 - protein, 23 aa, Cryptosporidium hominis
NNHIGRLLTLFGISLNHQLQFLD

SEQ ID NO: 2186252 - protein, 18 aa, Cryptosporidium hominis
NNILPCIIEYTELNKLGD

SEQ ID NO: 2186253 - protein, 20 aa, Cryptosporidium hominis
NNKIEMLKILAANFGATQED

SEQ ID NO: 2186254 - protein, 24 aa, Cryptosporidium hominis
NNKLPFDFSDPWKMKLINKRGRKS

SEQ ID NO: 2186255 - protein, 22 aa, Cryptosporidium hominis
NNLCLGGGLLPVGGTGGGTPVQ

SEQ ID NO: 2186256 - protein, 24 aa, Cryptosporidium hominis
NNLFKWYLKYGMRDSVSQLVGQLT

SEQ ID NO: 2186257 - protein, 19 aa, Cryptosporidium hominis
NNLKSKWALDKRSGNIIER

SEQ ID NO: 2186258 - protein, 22 aa, Cryptosporidium hominis
NNQHCLPCGRFISPEYLVPGTP

SEQ ID NO: 2186259 - protein, 25 aa, Cryptosporidium hominis
NNRIEDVKIKLPMRNGNNEGVAIVE

SEQ ID NO: 2186260 - protein, 20 aa, Cryptosporidium hominis
NNSRILLCAITWMREVSSGN

SEQ ID NO: 2186261 - protein, 24 aa, Cryptosporidium hominis
NPDDGLFLCRFCNEKLKSVDSASF

SEQ ID NO: 2186262 - protein, 18 aa, Cryptosporidium hominis
NPIIYKWPSNSVCIEDYK

SEQ ID NO: 2186263 - protein, 25 aa, Cryptosporidium hominis
NPKVKWISFHGCYDFAYLVKILSSQ

SEQ ID NO: 2186264 - protein, 21 aa, Cryptosporidium hominis
NPRRVCICIKWNSSHHLEDNE

SEQ ID NO: 2186265 - protein, 24 aa, Cryptosporidium hominis
NQFIKEWMDSIIIPPRLAIEANIL

SEQ ID NO: 2186266 - protein, 17 aa, Cryptosporidium hominis
NQLEWVRRYSPQVYEAM

SEQ ID NO: 2186267 - protein, 21 aa, Cryptosporidium hominis
NRCGHLFCRDCIDRNLSSRNR

SEQ ID NO: 2186268 - protein, 17 aa, Cryptosporidium hominis
NRFSIESGYRWDGVIRG

SEQ ID NO: 2186269 - protein, 22 aa, Cryptosporidium hominis
  misc_feature (22)..(22): Xaa can be any naturally occurring amino acid
NRVGVEVSKTFNIWQLTNIKEX

SEQ ID NO: 2186270 - protein, 17 aa, Cryptosporidium hominis
NRVQYILNRVHKLTNLE

SEQ ID NO: 2186271 - protein, 23 aa, Cryptosporidium hominis
NSAIFGLCWCNNDSFLLSGCLDR

SEQ ID NO: 2186272 - protein, 25 aa, Cryptosporidium hominis
NSANPQLWCKISFIDLAGSERASAT

SEQ ID NO: 2186273 - protein, 26 aa, Cryptosporidium hominis
NSDGFCSFGKIYLGYNIHKILLSIID

SEQ ID NO: 2186274 - protein, 17 aa, Cryptosporidium hominis
NSIFRFPAEIEFNVYDQ

SEQ ID NO: 2186275 - protein, 21 aa, Cryptosporidium hominis
NSKMSIIICLLKNSKIAIYDI

SEQ ID NO: 2186276 - protein, 23 aa, Cryptosporidium hominis
NSLKNPLLFWFKGLFRQNEPTHI

SEQ ID NO: 2186277 - protein, 18 aa, Cryptosporidium hominis
NSMLRPALNIGKRAKSTV

SEQ ID NO: 2186278 - protein, 22 aa, Cryptosporidium hominis
NSNIRKGYAVNFIAVGPESEIQ

SEQ ID NO: 2186279 - protein, 17 aa, Cryptosporidium hominis
NSQEIRGLLNLCGTSGK

SEQ ID NO: 2186280 - protein, 23 aa, Cryptosporidium hominis
NTEKASVVNLDFPKKKKTKKDFE

SEQ ID NO: 2186281 - protein, 24 aa, Cryptosporidium hominis
NTIECAICLMTLQDLLNCKNKGEE

SEQ ID NO: 2186282 - protein, 24 aa, Cryptosporidium hominis
NTIKIKCYLIWSIKFEIIKKKKRL

SEQ ID NO: 2186283 - protein, 23 aa, Cryptosporidium hominis
NTLLYEGYEKCSLYNNCLSNKLE

SEQ ID NO: 2186284 - protein, 23 aa, Cryptosporidium hominis
NTPKIPTPMPRTKCSGDQGKKPI

SEQ ID NO: 2186285 - protein, 22 aa, Cryptosporidium hominis
NTRNKFLWCIEILHQFYYLNLD

SEQ ID NO: 2186286 - protein, 24 aa, Cryptosporidium hominis
NTRWKCPLCYQIIRPSMLKLDSFV

SEQ ID NO: 2186287 - protein, 19 aa, Cryptosporidium hominis
NTSRFPLRFTNVNQNFELC

SEQ ID NO: 2186288 - protein, 20 aa, Cryptosporidium hominis
NVIFRIEPISGFYYETGGLH

SEQ ID NO: 2186289 - protein, 23 aa, Cryptosporidium hominis
NVILRLVPRLDVPALIRKSQNSQ

SEQ ID NO: 2186290 - protein, 23 aa, Cryptosporidium hominis
NVYWPRRCPFYLSDRSALRYLPD

SEQ ID NO: 2186291 - protein, 21 aa, Cryptosporidium hominis
NWLKGRVSICLGRNLENNIEE

SEQ ID NO: 2186292 - protein, 19 aa, Cryptosporidium hominis
NYCLWRGWQYMRLDGSTNK

SEQ ID NO: 2186293 - protein, 23 aa, Cryptosporidium hominis
NYIPEWFRIGLRILTVSNALELR

SEQ ID NO: 2186294 - protein, 19 aa, Cryptosporidium hominis
NYIRDLLCILSRDIWSLLL

SEQ ID NO: 2186295 - protein, 20 aa, Cryptosporidium hominis
NYKKCTLWDLGFSHQINPLS

SEQ ID NO: 2186296 - protein, 21 aa, Cryptosporidium hominis
NYLGGAFIRYWKRASTHIFGF

SEQ ID NO: 2186297 - protein, 23 aa, Cryptosporidium hominis
NYSFKYRRGGIVVAPEICIPKQH

SEQ ID NO: 2186298 - protein, 19 aa, Cryptosporidium hominis
PAGLLRLEMIFMYYDKGNK

SEQ ID NO: 2186299 - protein, 19 aa, Cryptosporidium hominis
PAHARGALGVMPMPMELPP

SEQ ID NO: 2186300 - protein, 17 aa, Cryptosporidium hominis
PALKFAQHTGAHAMVGR

SEQ ID NO: 2186301 - protein, 18 aa, Cryptosporidium hominis
PARNCWEFQWPTEEKEQV

SEQ ID NO: 2186302 - protein, 26 aa, Cryptosporidium hominis
PCFLLAVKCSIDLTLPIYVYKRNLES

SEQ ID NO: 2186303 - protein, 19 aa, Cryptosporidium hominis
PCIEFRFLSIPEMDYDAKS

SEQ ID NO: 2186304 - protein, 17 aa, Cryptosporidium hominis
PCIFRDLYFYKHSEEST

SEQ ID NO: 2186305 - protein, 25 aa, Cryptosporidium hominis
PCLKCCIYPCRAFFLTGRCISQKRR

SEQ ID NO: 2186306 - protein, 18 aa, Cryptosporidium hominis
PDEYAVECLCQLIMTTGY

SEQ ID NO: 2186307 - protein, 17 aa, Cryptosporidium hominis
PDFLPIFPPRLDYCDKF

SEQ ID NO: 2186308 - protein, 17 aa, Cryptosporidium hominis
PDGDFRLGSSIELSFTT

SEQ ID NO: 2186309 - protein, 19 aa, Cryptosporidium hominis
PDLKGAVPLRGEIQNFNNI

SEQ ID NO: 2186310 - protein, 18 aa, Cryptosporidium hominis
PDNYKGILIWKSTNFIRH

SEQ ID NO: 2186311 - protein, 21 aa, Cryptosporidium hominis
PEFWSYRILTSMSIKIKDAND

SEQ ID NO: 2186312 - protein, 21 aa, Cryptosporidium hominis
PEHYIRFPVHKEFVSGIRLED

SEQ ID NO: 2186313 - protein, 20 aa, Cryptosporidium hominis
PEIDVWSCGVILYALLCGSL

SEQ ID NO: 2186314 - protein, 20 aa, Cryptosporidium hominis
PEIIWQYYIELMINEKNIEF

SEQ ID NO: 2186315 - protein, 19 aa, Cryptosporidium hominis
PELFPGLVYRYHPDNSPTK

SEQ ID NO: 2186316 - protein, 17 aa, Cryptosporidium hominis
PELGRNFTIKRYSSNDR

SEQ ID NO: 2186317 - protein, 20 aa, Cryptosporidium hominis
PELKFPLGYVLTEKEQNRVK

SEQ ID NO: 2186318 - protein, 24 aa, Cryptosporidium hominis
PETHGWWLYCCHNGWLTIKRSVLI

SEQ ID NO: 2186319 - protein, 18 aa, Cryptosporidium hominis
PEWRIHFRQILGGTEPFR

SEQ ID NO: 2186320 - protein, 21 aa, Cryptosporidium hominis
PFDMKSIRSLQTFSNQHSISH

SEQ ID NO: 2186321 - protein, 18 aa, Cryptosporidium hominis
PFGWQLDMRLVFYNALKY

SEQ ID NO: 2186322 - protein, 23 aa, Cryptosporidium hominis
PFLICEFCSGGTLFNLLHGDSKK

SEQ ID NO: 2186323 - protein, 18 aa, Cryptosporidium hominis
PFPSLCKFFEILFEKGNL

SEQ ID NO: 2186324 - protein, 20 aa, Cryptosporidium hominis
PFRRLCLKFGADVTVSEMVL

SEQ ID NO: 2186325 - protein, 17 aa, Cryptosporidium hominis
PFVCGSVDTLERIKILQ

SEQ ID NO: 2186326 - protein, 20 aa, Cryptosporidium hominis
PGAYHKWKFNAFLEIQKKLD

SEQ ID NO: 2186327 - protein, 20 aa, Cryptosporidium hominis
PGDFKRLFIGGSVRLKYSYA

SEQ ID NO: 2186328 - protein, 20 aa, Cryptosporidium hominis
PGGYAWTICVIYFFQKIGIL

SEQ ID NO: 2186329 - protein, 24 aa, Cryptosporidium hominis
PGINKVRYWAMCFIGSERSTEPEF

SEQ ID NO: 2186330 - protein, 18 aa, Cryptosporidium hominis
PGVCSRIACLIPHPVSPG

SEQ ID NO: 2186331 - protein, 17 aa, Cryptosporidium hominis
PGYVMRYPRSFKEQETF

SEQ ID NO: 2186332 - protein, 23 aa, Cryptosporidium hominis
PIFKEFTFFLSLRRSLLELRKKI

SEQ ID NO: 2186333 - protein, 20 aa, Cryptosporidium hominis
PIKFKIVFIAPMKSLVSEIT

SEQ ID NO: 2186334 - protein, 21 aa, Cryptosporidium hominis
PIKHPEIFESLGIAQPKGVLL

SEQ ID NO: 2186335 - protein, 18 aa, Cryptosporidium hominis
PITRYLIMFGYVIRTQKK

SEQ ID NO: 2186336 - protein, 22 aa, Cryptosporidium hominis
PKCDAWSAGVLLHLLLMGAVPF

SEQ ID NO: 2186337 - protein, 18 aa, Cryptosporidium hominis
PKDSRLVIYGKFKDNPLV

SEQ ID NO: 2186338 - protein, 19 aa, Cryptosporidium hominis
PKILRFIRVGNQLRRSITV

SEQ ID NO: 2186339 - protein, 19 aa, Cryptosporidium hominis
PKKEYRGIPELELSDKSED

SEQ ID NO: 2186340 - protein, 21 aa, Cryptosporidium hominis
PKKKLDCSVHWMYKSERGWMP

SEQ ID NO: 2186341 - protein, 20 aa, Cryptosporidium hominis
PKLLACSDLGISMHYSSSGL

SEQ ID NO: 2186342 - protein, 18 aa, Cryptosporidium hominis
PKLYTGMHKYRFDKDGNG

SEQ ID NO: 2186343 - protein, 19 aa, Cryptosporidium hominis
PKNRQCVLVSATMPTALAS

SEQ ID NO: 2186344 - protein, 18 aa, Cryptosporidium hominis
PKPCYLFAVVAGVLGRLE

SEQ ID NO: 2186345 - protein, 20 aa, Cryptosporidium hominis
PKPSKSIGCLEYVPESNNKN

SEQ ID NO: 2186346 - protein, 18 aa, Cryptosporidium hominis
PKQSLRLLLFINEQEKQS

SEQ ID NO: 2186347 - protein, 29 aa, Cryptosporidium hominis
PKSGCKGVSWSNRQMAWLAFWKEDNQRRS

SEQ ID NO: 2186348 - protein, 17 aa, Cryptosporidium hominis
PLCHYCRRSCKRLNYSR

SEQ ID NO: 2186349 - protein, 18 aa, Cryptosporidium hominis
PLFKNIFIIGRRGWIQNS

SEQ ID NO: 2186350 - protein, 21 aa, Cryptosporidium hominis
PLHRRSHLKHFRFSESDEEGE

SEQ ID NO: 2186351 - protein, 17 aa, Cryptosporidium hominis
PLLCWAADIPSAKAFNF

SEQ ID NO: 2186352 - protein, 19 aa, Cryptosporidium hominis
PLLHKLCVIAGRIRDILTL

SEQ ID NO: 2186353 - protein, 17 aa, Cryptosporidium hominis
PLLRIVSRGKLYTLADF

SEQ ID NO: 2186354 - protein, 20 aa, Cryptosporidium hominis
PLPCDMCRKSCAFDRGEEAR

SEQ ID NO: 2186355 - protein, 21 aa, Cryptosporidium hominis
PLPERHEIVLFKSMEDANNTT

SEQ ID NO: 2186356 - protein, 24 aa, Cryptosporidium hominis
PNFNRLRLQFIFFYYDSNRDGLLS

SEQ ID NO: 2186357 - protein, 20 aa, Cryptosporidium hominis
PNIDVLPWIGSVGVGGVVTW

SEQ ID NO: 2186358 - protein, 24 aa, Cryptosporidium hominis
PNIEFLRFGFLFSKDILAPFEMAI

SEQ ID NO: 2186359 - protein, 18 aa, Cryptosporidium hominis
PNKLRVCEFLIRWHEQRG

SEQ ID NO: 2186360 - protein, 19 aa, Cryptosporidium hominis
PNKMCPAGFELIDDDQCSQ

SEQ ID NO: 2186361 - protein, 22 aa, Cryptosporidium hominis
PNPHSLMPLRSCFSSRNGLWVA

SEQ ID NO: 2186362 - protein, 18 aa, Cryptosporidium hominis
PNPMCFHRTVTPIQRRRK

SEQ ID NO: 2186363 - protein, 18 aa, Cryptosporidium hominis
PNSMSFIWQNLVQQGSNP

SEQ ID NO: 2186364 - protein, 24 aa, Cryptosporidium hominis
PNVKKWGFKCCKNLKRSSVCSTYN

SEQ ID NO: 2186365 - protein, 22 aa, Cryptosporidium hominis
PNWPPPWLVRMQKYGPPPSYPY

SEQ ID NO: 2186366 - protein, 17 aa, Cryptosporidium hominis
PNYSRFIQEISPKFQDG

SEQ ID NO: 2186367 - protein, 19 aa, Cryptosporidium hominis
PPELLALVVRHIYSQDQQI

SEQ ID NO: 2186368 - protein, 17 aa, Cryptosporidium hominis
PPHLSIVILLKFITTVI

SEQ ID NO: 2186369 - protein, 17 aa, Cryptosporidium hominis
PPMYLLITHKGRNCKGN

SEQ ID NO: 2186370 - protein, 23 aa, Cryptosporidium hominis
PPRIKYNLCRWICRAYIFQAIRL

SEQ ID NO: 2186371 - protein, 19 aa, Cryptosporidium hominis
PPSSPTCFSFKASVPVNIL

SEQ ID NO: 2186372 - protein, 19 aa, Cryptosporidium hominis
PQCGPYCSTYPKGYFAFWL

SEQ ID NO: 2186373 - protein, 20 aa, Cryptosporidium hominis
PQFKCCIDCNPTTIKLNKKM

SEQ ID NO: 2186374 - protein, 24 aa, Cryptosporidium hominis
PQFKSGYKGVSWNSRMEAWLAFFV

SEQ ID NO: 2186375 - protein, 18 aa, Cryptosporidium hominis
PQINLAISRGIFFELDIS

SEQ ID NO: 2186376 - protein, 17 aa, Cryptosporidium hominis
PQLIFLRWIRLLFSREF

SEQ ID NO: 2186377 - protein, 21 aa, Cryptosporidium hominis
PRGKIPYEYLVKYHHQSYSQC

SEQ ID NO: 2186378 - protein, 18 aa, Cryptosporidium hominis
PRKDWAFDEAILYPPHPR

SEQ ID NO: 2186379 - protein, 21 aa, Cryptosporidium hominis
PRPYLVWLLHDFNFLLYDTAN

SEQ ID NO: 2186380 - protein, 23 aa, Cryptosporidium hominis
PRSVPCGSFIWWDRRVWEYNFVH

SEQ ID NO: 2186381 - protein, 19 aa, Cryptosporidium hominis
PRTVKVCAGGEYSENKDSE

SEQ ID NO: 2186382 - protein, 25 aa, Cryptosporidium hominis
PRVFYKPKFGWRFFPPNVPDFSRLL

SEQ ID NO: 2186383 - protein, 17 aa, Cryptosporidium hominis
PRVPLLFIQKNLFRLGW

SEQ ID NO: 2186384 - protein, 23 aa, Cryptosporidium hominis
PRVSSFPGTLSWDSRDSYKIRDL

SEQ ID NO: 2186385 - protein, 22 aa, Cryptosporidium hominis
PSCRSLRTSIRINRSSTLSHLG

SEQ ID NO: 2186386 - protein, 17 aa, Cryptosporidium hominis
PSLSLGIFEDWRSIHNQ

SEQ ID NO: 2186387 - protein, 18 aa, Cryptosporidium hominis
PSPLNEIVKILNMHQLTL

SEQ ID NO: 2186388 - protein, 19 aa, Cryptosporidium hominis
PSQCFKLDLIMYSAIGWAR

SEQ ID NO: 2186389 - protein, 18 aa, Cryptosporidium hominis
PSREVLFFTSGFKNVQTQ

SEQ ID NO: 2186390 - protein, 20 aa, Cryptosporidium hominis
PSRIFFKWKIYYCHSKEDAY

SEQ ID NO: 2186391 - protein, 24 aa, Cryptosporidium hominis
PSSPNLWLLYGFIYRKAFPDRVNE

SEQ ID NO: 2186392 - protein, 18 aa, Cryptosporidium hominis
PSTLRAIFKLSIQADQEA

SEQ ID NO: 2186393 - protein, 18 aa, Cryptosporidium hominis
PTDFYQLFLISSDSFAKN

SEQ ID NO: 2186394 - protein, 20 aa, Cryptosporidium hominis
PTEFIYFWKKCCRKINEKLG

SEQ ID NO: 2186395 - protein, 21 aa, Cryptosporidium hominis
PTIKCPRDFEIIFPTYPTEDT

SEQ ID NO: 2186396 - protein, 24 aa, Cryptosporidium hominis
PTKVDVFCLGWMLLFTLTKYQPFE

SEQ ID NO: 2186397 - protein, 19 aa, Cryptosporidium hominis
PVGFLFKKFEELREALQHG

SEQ ID NO: 2186398 - protein, 22 aa, Cryptosporidium hominis
PVLSEAFLLDWITSDVLQSTID

SEQ ID NO: 2186399 - protein, 17 aa, Cryptosporidium hominis
PVRRWTQDYKEWLESTL

SEQ ID NO: 2186400 - protein, 18 aa, Cryptosporidium hominis
PVWQVCWAHPTFGSVLAS

SEQ ID NO: 2186401 - protein, 18 aa, Cryptosporidium hominis
PWGKGRPGWHIECSVMAS

SEQ ID NO: 2186402 - protein, 17 aa, Cryptosporidium hominis
PWYKGCNKLILLGIPSS

SEQ ID NO: 2186403 - protein, 28 aa, Cryptosporidium hominis
PYDRQFWSYAYKTGRLHPAEEQVQRQLN

SEQ ID NO: 2186404 - protein, 24 aa, Cryptosporidium hominis
PYFEEWKFLYKRLCYIEKEVDSML

SEQ ID NO: 2186405 - protein, 18 aa, Cryptosporidium hominis
PYIFELHSGGLFPAPILI

SEQ ID NO: 2186406 - protein, 22 aa, Cryptosporidium hominis
PYTFRPESILSYFKDIYEEYDY

SEQ ID NO: 2186407 - protein, 19 aa, Cryptosporidium hominis
PYTSIPCVLDFLKQRYLVN

SEQ ID NO: 2186408 - protein, 22 aa, Cryptosporidium hominis
QAIKMAYSVGLTYEAGLGERKL

SEQ ID NO: 2186409 - protein, 18 aa, Cryptosporidium hominis
QALGFPRNAVIEAYLICE

SEQ ID NO: 2186410 - protein, 20 aa, Cryptosporidium hominis
QCADGQCGETCMHRAVNVDG

SEQ ID NO: 2186411 - protein, 22 aa, Cryptosporidium hominis
QCELCKKWRKLPLGMNPNTLPE

SEQ ID NO: 2186412 - protein, 17 aa, Cryptosporidium hominis
QCGETCMHRAVNVDGTQ

SEQ ID NO: 2186413 - protein, 17 aa, Cryptosporidium hominis
QCGKVFHFDCLRNCNLI

SEQ ID NO: 2186414 - protein, 17 aa, Cryptosporidium hominis
QCIKEWFKMSVICPLCK

SEQ ID NO: 2186415 - protein, 19 aa, Cryptosporidium hominis
QCILPLPIIHQGPMINGSS

SEQ ID NO: 2186416 - protein, 19 aa, Cryptosporidium hominis
QDDKINWSLNIGHSGEIYL

SEQ ID NO: 2186417 - protein, 20 aa, Cryptosporidium hominis
QDGVEFKGIFSLDQPELKLP

SEQ ID NO: 2186418 - protein, 17 aa, Cryptosporidium hominis
QDLSYFIHGKWASIKKL

SEQ ID NO: 2186419 - protein, 18 aa, Cryptosporidium hominis
QDVFKEWNIPPSISNWKN

SEQ ID NO: 2186420 - protein, 22 aa, Cryptosporidium hominis
QDYRFLPKQTFRIEDNNFYSNL

SEQ ID NO: 2186421 - protein, 19 aa, Cryptosporidium hominis
QEFYLRIYGTGLLNEIQNL

SEQ ID NO: 2186422 - protein, 17 aa, Cryptosporidium hominis
QESCIFCIIQTHIEELE

SEQ ID NO: 2186423 - protein, 22 aa, Cryptosporidium hominis
QFRFIVDLLRRFHVLDNYCGCT

SEQ ID NO: 2186424 - protein, 18 aa, Cryptosporidium hominis
QFYILAILLGCDYTVGVN

SEQ ID NO: 2186425 - protein, 20 aa, Cryptosporidium hominis
QGCMEICITPPLSSELITSN

SEQ ID NO: 2186426 - protein, 19 aa, Cryptosporidium hominis
QGLSSIFYPIFPLVCFPDF

SEQ ID NO: 2186427 - protein, 17 aa, Cryptosporidium hominis
QHNSAIFGLCWCNNDSF

SEQ ID NO: 2186428 - protein, 19 aa, Cryptosporidium hominis
QIACLRQRLLGISKNHAIS

SEQ ID NO: 2186429 - protein, 17 aa, Cryptosporidium hominis
QILKYKFDYYFDVSPRQ

SEQ ID NO: 2186430 - protein, 26 aa, Cryptosporidium hominis
QILVAAILCRWWHALPDWPPPDTDYQ

SEQ ID NO: 2186431 - protein, 20 aa, Cryptosporidium hominis
QIQLPPIFYILSKRILIQEA

SEQ ID NO: 2186432 - protein, 21 aa, Cryptosporidium hominis
QIRSICLMDTFSLVRSISNLR

SEQ ID NO: 2186433 - protein, 18 aa, Cryptosporidium hominis
QKLCSYNFHDQEEYKLEW

SEQ ID NO: 2186434 - protein, 18 aa, Cryptosporidium hominis
QKLFPGWLSPDMLKCNSE

SEQ ID NO: 2186435 - protein, 21 aa, Cryptosporidium hominis
QKLHPCEICAAFLSETDNDQR

SEQ ID NO: 2186436 - protein, 24 aa, Cryptosporidium hominis
QKLIWKRFRIGMMHDAQEFLRYFL

SEQ ID NO: 2186437 - protein, 18 aa, Cryptosporidium hominis
QKLLDILSIRPNQYGERI

SEQ ID NO: 2186438 - protein, 21 aa, Cryptosporidium hominis
QKLPKLRGFLSMNSLAHLGRQ

SEQ ID NO: 2186439 - protein, 18 aa, Cryptosporidium hominis
QKLSLIISGFISKLSDKR

SEQ ID NO: 2186440 - protein, 17 aa, Cryptosporidium hominis
QKRFVICPLDVVVVQGK

SEQ ID NO: 2186441 - protein, 19 aa, Cryptosporidium hominis
QKVDFLFGKSFRPPEAYET

SEQ ID NO: 2186442 - protein, 17 aa, Cryptosporidium hominis
QLACPRLSTDWGAYYKK

SEQ ID NO: 2186443 - protein, 25 aa, Cryptosporidium hominis
QLLFRDCFRVGLQLLDLSGADFNQI

SEQ ID NO: 2186444 - protein, 18 aa, Cryptosporidium hominis
QLRCAGMLESIRIRRSGY

SEQ ID NO: 2186445 - protein, 18 aa, Cryptosporidium hominis
QLVYGCGKLCLLDKLLSR

SEQ ID NO: 2186446 - protein, 17 aa, Cryptosporidium hominis
QNEELRDSLGIKAQEIE

SEQ ID NO: 2186447 - protein, 18 aa, Cryptosporidium hominis
QPCLELLTFILIDIIMDN

SEQ ID NO: 2186448 - protein, 20 aa, Cryptosporidium hominis
QPFIPFALSFLMNVGDSYGI

SEQ ID NO: 2186449 - protein, 17 aa, Cryptosporidium hominis
QPLLMRVYEDFFSMRGA

SEQ ID NO: 2186450 - protein, 25 aa, Cryptosporidium hominis
QPLRFPLPIFEFFCENMAKKCKGIE

SEQ ID NO: 2186451 - protein, 18 aa, Cryptosporidium hominis
QQEWSLRKPLEMRVQTDN

SEQ ID NO: 2186452 - protein, 22 aa, Cryptosporidium hominis
QQLIKSCNIMRDHMLRKQNNSV

SEQ ID NO: 2186453 - protein, 17 aa, Cryptosporidium hominis
QRFPWLEVLIRSMDMSI

SEQ ID NO: 2186454 - protein, 24 aa, Cryptosporidium hominis
QRFRTGKIWILICTDLMARGVDFK

SEQ ID NO: 2186455 - protein, 20 aa, Cryptosporidium hominis
QRLKDALGMQPNWPPPWLVR

SEQ ID NO: 2186456 - protein, 24 aa, Cryptosporidium hominis
QRSLARLWFDYVFSVKCLSPSASP

SEQ ID NO: 2186457 - protein, 22 aa, Cryptosporidium hominis
QRWFYELFHDFPFFSISPYTKT

SEQ ID NO: 2186458 - protein, 17 aa, Cryptosporidium hominis
QSLQLNLAMIYVKIQEW

SEQ ID NO: 2186459 - protein, 21 aa, Cryptosporidium hominis
QTGPKLQEWLGLRDWKNNQSK

SEQ ID NO: 2186460 - protein, 18 aa, Cryptosporidium hominis
QVSYLIFIHGWKLAFLTV

SEQ ID NO: 2186461 - protein, 17 aa, Cryptosporidium hominis
QVYILGWLIHLRILNRI

SEQ ID NO: 2186462 - protein, 33 aa, Cryptosporidium hominis
QYKSGYKGVSWNKRMQSWLAFWTEGQRRRSKTF

SEQ ID NO: 2186463 - protein, 22 aa, Cryptosporidium hominis
QYWKTKLCLMFSKGACKNGDNC

SEQ ID NO: 2186464 - protein, 25 aa, Cryptosporidium hominis
RAGRVRPGKCFRLYTKLSFITEMEV

SEQ ID NO: 2186465 - protein, 20 aa, Cryptosporidium hominis
RAIFHFVRCIPFINTSFREP

SEQ ID NO: 2186466 - protein, 19 aa, Cryptosporidium hominis
RALSHCLLELTGINNDLKK

SEQ ID NO: 2186467 - protein, 21 aa, Cryptosporidium hominis
RANVFLRWNLAPTKQQIAEFL

SEQ ID NO: 2186468 - protein, 17 aa, Cryptosporidium hominis
RAPEVILDLGWDMSSDM

SEQ ID NO: 2186469 - protein, 17 aa, Cryptosporidium hominis
RASAPCIVFFDELDSLC

SEQ ID NO: 2186470 - protein, 19 aa, Cryptosporidium hominis
RATFFDVLEIFLLTIYKFR

SEQ ID NO: 2186471 - protein, 24 aa, Cryptosporidium hominis
RCGNEVWLTLPLFFPSATLHNVTH

SEQ ID NO: 2186472 - protein, 18 aa, Cryptosporidium hominis
RCKPDYYQFFFGYLDYEK

SEQ ID NO: 2186473 - protein, 17 aa, Cryptosporidium hominis
RDCPICRNSVLGVVNIE

SEQ ID NO: 2186474 - protein, 23 aa, Cryptosporidium hominis
RDFKRILLLIGDYAIHRFQDYGL

SEQ ID NO: 2186475 - protein, 17 aa, Cryptosporidium hominis
RDFSVYIVNMFDTGQAA

SEQ ID NO: 2186476 - protein, 18 aa, Cryptosporidium hominis
RDGKCLPLQIGMNNNLNC

SEQ ID NO: 2186477 - protein, 22 aa, Cryptosporidium hominis
RDHLKALVLRYAKENGKDTFSE

SEQ ID NO: 2186478 - protein, 17 aa, Cryptosporidium hominis
RDLFPVMMSRFIATFAR

SEQ ID NO: 2186479 - protein, 25 aa, Cryptosporidium hominis
RDPDLRCCSYLAYPESDESVYGDSE

SEQ ID NO: 2186480 - protein, 17 aa, Cryptosporidium hominis
REFKIAIALAENCQLPV

SEQ ID NO: 2186481 - protein, 20 aa, Cryptosporidium hominis
REIIKRLGILNGSNNFEVND

SEQ ID NO: 2186482 - protein, 17 aa, Cryptosporidium hominis
REILRYILIGANSLSSD

SEQ ID NO: 2186483 - protein, 17 aa, Cryptosporidium hominis
REIYKGYGIKNETDGSV

SEQ ID NO: 2186484 - protein, 17 aa, Cryptosporidium hominis
REKCSYLLFILTPSENS

SEQ ID NO: 2186485 - protein, 18 aa, Cryptosporidium hominis
RELLALCLKKIKGLNTVR

SEQ ID NO: 2186486 - protein, 18 aa, Cryptosporidium hominis
RFEICLGTILNCIQVFGL

SEQ ID NO: 2186487 - protein, 18 aa, Cryptosporidium hominis
RFFFTRNIHCHAKYITID

SEQ ID NO: 2186488 - protein, 21 aa, Cryptosporidium hominis
RFKSQDIMNVFALSPNGKLVS

SEQ ID NO: 2186489 - protein, 18 aa, Cryptosporidium hominis
RFLLPKLLQFRPNIIFIS

SEQ ID NO: 2186490 - protein, 22 aa, Cryptosporidium hominis
RFLYLRLLDRLIIGNATYLQLA

SEQ ID NO: 2186491 - protein, 19 aa, Cryptosporidium hominis
RFTWYCSHCNFSIDNEILE

SEQ ID NO: 2186492 - protein, 18 aa, Cryptosporidium hominis
RFYDEYFEAFPLAISETL

SEQ ID NO: 2186493 - protein, 20 aa, Cryptosporidium hominis
RGCVAVKLVGNWDSHISPNK

SEQ ID NO: 2186494 - protein, 17 aa, Cryptosporidium hominis
RGEIKFVGFLIRQFKGE

SEQ ID NO: 2186495 - protein, 20 aa, Cryptosporidium hominis
RGGAVPPVLRPGAIPPGPPG

SEQ ID NO: 2186496 - protein, 17 aa, Cryptosporidium hominis
RGGLKYIWNDNCKVNWH

SEQ ID NO: 2186497 - protein, 17 aa, Cryptosporidium hominis
RGGRIWFDRHLLFQDNF

SEQ ID NO: 2186498 - protein, 19 aa, Cryptosporidium hominis
RHDCFRRRLAEFIIYPPPV

SEQ ID NO: 2186499 - protein, 17 aa, Cryptosporidium hominis
RHQRCCIMFYPPGNELI

SEQ ID NO: 2186500 - protein, 18 aa, Cryptosporidium hominis
RIAYEIAEVCYIRRKALL

SEQ ID NO: 2186501 - protein, 20 aa, Cryptosporidium hominis
RIDEFWIKYIQMELILKNYI

SEQ ID NO: 2186502 - protein, 19 aa, Cryptosporidium hominis
RIEKLALITGFGNWIPFGW

SEQ ID NO: 2186503 - protein, 23 aa, Cryptosporidium hominis
RIEPEERIRMGIFDDSLVESDVK

SEQ ID NO: 2186504 - protein, 17 aa, Cryptosporidium hominis
RIFGRLYLFGGFDGIQC

SEQ ID NO: 2186505 - protein, 19 aa, Cryptosporidium hominis
RIGFAWVRSIIGTFFNDTY

SEQ ID NO: 2186506 - protein, 17 aa, Cryptosporidium hominis
RIIKDICNYLLFNEEMS

SEQ ID NO: 2186507 - protein, 18 aa, Cryptosporidium hominis
RIKHKFEIATLFIQYFLQ

SEQ ID NO: 2186508 - protein, 20 aa, Cryptosporidium hominis
RINPYLPAVVEWQYNTIIRE

SEQ ID NO: 2186509 - protein, 19 aa, Cryptosporidium hominis
RIRVCPQLPNLVSTWSELG

SEQ ID NO: 2186510 - protein, 18 aa, Cryptosporidium hominis
RISCGLLTGVVKLFCHKV

SEQ ID NO: 2186511 - protein, 17 aa, Cryptosporidium hominis
RISGLGIGVHWEEISTK

SEQ ID NO: 2186512 - protein, 17 aa, Cryptosporidium hominis
RKDWPFDEAILYPPHPR

SEQ ID NO: 2186513 - protein, 25 aa, Cryptosporidium hominis
RKFSCKRWGKGKAYSHAMNFLASLT

SEQ ID NO: 2186514 - protein, 19 aa, Cryptosporidium hominis
RKIMSMFLLEFEVSNSKDY

SEQ ID NO: 2186515 - protein, 17 aa, Cryptosporidium hominis
RKKLGIGDFQQISKAEN

SEQ ID NO: 2186516 - protein, 20 aa, Cryptosporidium hominis
RKKLHKVPGVPLIYLNNQVP

SEQ ID NO: 2186517 - protein, 17 aa, Cryptosporidium hominis
RKLETFKGLQVRPWPKA

SEQ ID NO: 2186518 - protein, 17 aa, Cryptosporidium hominis
RKLYAILSICFNINLLN

SEQ ID NO: 2186519 - protein, 20 aa, Cryptosporidium hominis
RKMLYNFANSVWDYVKPVSL

SEQ ID NO: 2186520 - protein, 19 aa, Cryptosporidium hominis
RKNACIQICKALRRYVCIK

SEQ ID NO: 2186521 - protein, 22 aa, Cryptosporidium hominis
RKPGCSRMKLDIIGYGESENYG

SEQ ID NO: 2186522 - protein, 17 aa, Cryptosporidium hominis
RKRIPCMFKIIPCNEHS

SEQ ID NO: 2186523 - protein, 19 aa, Cryptosporidium hominis
RKRKVAIKVIRDVQRYTSA

SEQ ID NO: 2186524 - protein, 20 aa, Cryptosporidium hominis
RKSLYWDTVFNWSTSDDDEG

SEQ ID NO: 2186525 - protein, 22 aa, Cryptosporidium hominis
RKWRTLWCWTHIYVHYKRAQIY

SEQ ID NO: 2186526 - protein, 17 aa, Cryptosporidium hominis
RKYWPVFIGTIPICDLE

SEQ ID NO: 2186527 - protein, 19 aa, Cryptosporidium hominis
RLALMGLDWDNITADDIYV

SEQ ID NO: 2186528 - protein, 22 aa, Cryptosporidium hominis
RLCLYHCKRLDISVHVCDNTVN

SEQ ID NO: 2186529 - protein, 18 aa, Cryptosporidium hominis
RLGAPIYNITSFRKEKVY

SEQ ID NO: 2186530 - protein, 17 aa, Cryptosporidium hominis
RLHSVLRPFLLRRLKKD

SEQ ID NO: 2186531 - protein, 17 aa, Cryptosporidium hominis
RLKEIQAEFDWMILVFL

SEQ ID NO: 2186532 - protein, 19 aa, Cryptosporidium hominis
RLKPEFIKDLLLIQINSFW

SEQ ID NO: 2186533 - protein, 18 aa, Cryptosporidium hominis
RLLFTLVRLKLWIVEEIL

SEQ ID NO: 2186534 - protein, 18 aa, Cryptosporidium hominis
RLLICLLENSIFTDFDYI

SEQ ID NO: 2186535 - protein, 22 aa, Cryptosporidium hominis
RLLQLLGEWAEFGLIVIFCNRQ

SEQ ID NO: 2186536 - protein, 17 aa, Cryptosporidium hominis
RLLYKGKVVKIIDYEKE

SEQ ID NO: 2186537 - protein, 18 aa, Cryptosporidium hominis
RLRFSNIVERADFEEATR

SEQ ID NO: 2186538 - protein, 21 aa, Cryptosporidium hominis
RLRLVFSVNYPNIWEAKKELG

SEQ ID NO: 2186539 - protein, 22 aa, Cryptosporidium hominis
RLSFPSKEVFTFLFGDFNTLAI

SEQ ID NO: 2186540 - protein, 18 aa, Cryptosporidium hominis
RLWWKRIFKGGIETDISK

SEQ ID NO: 2186541 - protein, 19 aa, Cryptosporidium hominis
RLYEEMLKHSGVYNFLHNF

SEQ ID NO: 2186542 - protein, 18 aa, Cryptosporidium hominis
RLYLWNGLYWIRILDQSK

SEQ ID NO: 2186543 - protein, 23 aa, Cryptosporidium hominis
RMARIGWDLGILFNHYSMRKEME

SEQ ID NO: 2186544 - protein, 19 aa, Cryptosporidium hominis
RNDYKFGFMMQFFPNEKDD

SEQ ID NO: 2186545 - protein, 22 aa, Cryptosporidium hominis
RNEEIKTYWSIRVAYDTLTQER

SEQ ID NO: 2186546 - protein, 23 aa, Cryptosporidium hominis
RNKLPLCFLVLFKLETEYEILFK

SEQ ID NO: 2186547 - protein, 17 aa, Cryptosporidium hominis
RNLELFSNLIIYSGFYL

SEQ ID NO: 2186548 - protein, 17 aa, Cryptosporidium hominis
RNNLFLKRDEIIIRKIS

SEQ ID NO: 2186549 - protein, 21 aa, Cryptosporidium hominis
RNPYEYAYRPNLCPNVVFQNE

SEQ ID NO: 2186550 - protein, 17 aa, Cryptosporidium hominis
RPEEITRLYGLKPIRTL

SEQ ID NO: 2186551 - protein, 24 aa, Cryptosporidium hominis
RPEKAPDVCYSWWIFSLLYFLGRA

SEQ ID NO: 2186552 - protein, 20 aa, Cryptosporidium hominis
RPERIVKIAERFGVQGDVAL

SEQ ID NO: 2186553 - protein, 19 aa, Cryptosporidium hominis
RPFLPRLLICLLENSIFTD

SEQ ID NO: 2186554 - protein, 20 aa, Cryptosporidium hominis
RPGLYCLPRSCIKGGGNLLG

SEQ ID NO: 2186555 - protein, 19 aa, Cryptosporidium hominis
RPGVREFLNTIAPYYIMGI

SEQ ID NO: 2186556 - protein, 19 aa, Cryptosporidium hominis
RPLINWKFSDGCIVSITDF

SEQ ID NO: 2186557 - protein, 20 aa, Cryptosporidium hominis
RPTGLCGAALLISARYHGIP

SEQ ID NO: 2186558 - protein, 26 aa, Cryptosporidium hominis
RPTYKQVIWCCFGLLSGELELSLFED

SEQ ID NO: 2186559 - protein, 20 aa, Cryptosporidium hominis
RPVFGNIIDKDCCIYESDKY

SEQ ID NO: 2186560 - protein, 17 aa, Cryptosporidium hominis
RPWSRLLDVSPWFNYGF

SEQ ID NO: 2186561 - protein, 20 aa, Cryptosporidium hominis
RQIARLLVLISFFRYLPNPL

SEQ ID NO: 2186562 - protein, 19 aa, Cryptosporidium hominis
RQIIRYCFGGTPLYSESPK

SEQ ID NO: 2186563 - protein, 19 aa, Cryptosporidium hominis
RRFRCFKCGEYRDEIGDKI

SEQ ID NO: 2186564 - protein, 17 aa, Cryptosporidium hominis
RRIKPLIFGGGQERGMR

SEQ ID NO: 2186565 - protein, 17 aa, Cryptosporidium hominis
RRKAILPKVEWILCFPV

SEQ ID NO: 2186566 - protein, 21 aa, Cryptosporidium hominis
RRLASFPAIRAKIFEYFLSNA

SEQ ID NO: 2186567 - protein, 24 aa, Cryptosporidium hominis
RRLFKDLFFREGYQYDFIFDWSFL

SEQ ID NO: 2186568 - protein, 17 aa, Cryptosporidium hominis
RRNGTLLIYVWAFEQKK

SEQ ID NO: 2186569 - protein, 25 aa, Cryptosporidium hominis
RRSNWFLKHVCSFISQKLNEINKSN

SEQ ID NO: 2186570 - protein, 18 aa, Cryptosporidium hominis
RRVCKIVDKVKCRRKLDE

SEQ ID NO: 2186571 - protein, 24 aa, Cryptosporidium hominis
RRVLREMPHLIGFEDRLHFYYHYI

SEQ ID NO: 2186572 - protein, 19 aa, Cryptosporidium hominis
RRWEFVIEWRNVFLKSEQY

SEQ ID NO: 2186573 - protein, 21 aa, Cryptosporidium hominis
RRYDIKGSWIGRSTPLILQED

SEQ ID NO: 2186574 - protein, 19 aa, Cryptosporidium hominis
RSAFVWIIGEVYEFVQGTK

SEQ ID NO: 2186575 - protein, 20 aa, Cryptosporidium hominis
RSALFKALILYSLKNKEYMN

SEQ ID NO: 2186576 - protein, 18 aa, Cryptosporidium hominis
RSDVKFRFVIDVANSQDQ

SEQ ID NO: 2186577 - protein, 24 aa, Cryptosporidium hominis
RSEILENCIVCFTGFLKADEKPIV

SEQ ID NO: 2186578 - protein, 17 aa, Cryptosporidium hominis
RSEYRLTPVRSLAIFLE

SEQ ID NO: 2186579 - protein, 17 aa, Cryptosporidium hominis
RSIDDPANWSWRQKSFL

SEQ ID NO: 2186580 - protein, 19 aa, Cryptosporidium hominis
RSNLMSRLFAKFHKKQPSS

SEQ ID NO: 2186581 - protein, 17 aa, Cryptosporidium hominis
RSPRFCRSTSIIYCLSR

SEQ ID NO: 2186582 - protein, 20 aa, Cryptosporidium hominis
RSRLLLKERIFSMNPFGVNI

SEQ ID NO: 2186583 - protein, 18 aa, Cryptosporidium hominis
RSRVIYCHVCCQYKPRST

SEQ ID NO: 2186584 - protein, 18 aa, Cryptosporidium hominis
RSTGWLKVIDTMFPELSN

SEQ ID NO: 2186585 - protein, 19 aa, Cryptosporidium hominis
RSTRARFQVCQHIACYDCV

SEQ ID NO: 2186586 - protein, 17 aa, Cryptosporidium hominis
RSVHILMGKTFSRDNNI

SEQ ID NO: 2186587 - protein, 19 aa, Cryptosporidium hominis
RTMCVHMGLLLGVGAHMQE

SEQ ID NO: 2186588 - protein, 24 aa, Cryptosporidium hominis
RTQKWLLRNVKLEDFKYLIRVDQL

SEQ ID NO: 2186589 - protein, 19 aa, Cryptosporidium hominis
RTSEIPNFVSFVGCSLSTT

SEQ ID NO: 2186590 - protein, 19 aa, Cryptosporidium hominis
RTSMKDCFTEFAVSEYRLA

SEQ ID NO: 2186591 - protein, 18 aa, Cryptosporidium hominis
RVCEFLIRWHEQRGDKIL

SEQ ID NO: 2186592 - protein, 17 aa, Cryptosporidium hominis
RVCGYLYDYLCEDEISE

SEQ ID NO: 2186593 - protein, 20 aa, Cryptosporidium hominis
RVLCCCPRIVGISRLVSTLI

SEQ ID NO: 2186594 - protein, 20 aa, Cryptosporidium hominis
RVPECLESVFGIGSCEPSAM

SEQ ID NO: 2186595 - protein, 22 aa, Cryptosporidium hominis
RVQPRAGRIVTFFIADMHEGEP

SEQ ID NO: 2186596 - protein, 21 aa, Cryptosporidium hominis
RVSFIKSICLLKMYGKKLPIY

SEQ ID NO: 2186597 - protein, 19 aa, Cryptosporidium hominis
RVSGRHWGIIELDSEFSCK

SEQ ID NO: 2186598 - protein, 17 aa, Cryptosporidium hominis
RVSNILPLKSRHFYKDI

SEQ ID NO: 2186599 - protein, 19 aa, Cryptosporidium hominis
RVSRGWKISNWYGNFYFSG

SEQ ID NO: 2186600 - protein, 19 aa, Cryptosporidium hominis
RVTKSFNPRHYGGLEQALQ

SEQ ID NO: 2186601 - protein, 21 aa, Cryptosporidium hominis
RVYTGYWLKNHMFGYGKFDWT

SEQ ID NO: 2186602 - protein, 18 aa, Cryptosporidium hominis
RWAFRSLYKFAFGDIAYA

SEQ ID NO: 2186603 - protein, 19 aa, Cryptosporidium hominis
RWFHSWKKLLRNSSGYFFP

SEQ ID NO: 2186604 - protein, 21 aa, Cryptosporidium hominis
RWPAIKTWIYVCNQIKVDPRS

SEQ ID NO: 2186605 - protein, 23 aa, Cryptosporidium hominis
RWRKFFPCLKKNINYDVNTINNT

SEQ ID NO: 2186606 - protein, 25 aa, Cryptosporidium hominis
RWVLFPIKYSRLWSLYKKYEVSFWT

SEQ ID NO: 2186607 - protein, 18 aa, Cryptosporidium hominis
RYFVDIFIEESVSVQLQI

SEQ ID NO: 2186608 - protein, 24 aa, Cryptosporidium hominis
RYGVHWLLCAFSIKGGAILADEMG

SEQ ID NO: 2186609 - protein, 17 aa, Cryptosporidium hominis
RYISLKFLAKFVLNKNI

SEQ ID NO: 2186610 - protein, 19 aa, Cryptosporidium hominis
RYKAMCFSPAFKLKFSHNA

SEQ ID NO: 2186611 - protein, 24 aa, Cryptosporidium hominis
RYMPELDEFISFWCKYREHVEKNG

SEQ ID NO: 2186612 - protein, 18 aa, Cryptosporidium hominis
RYNTWFRYNLPFYLEPQY

SEQ ID NO: 2186613 - protein, 20 aa, Cryptosporidium hominis
RYRLSISLYKLFGCGDVFSD

SEQ ID NO: 2186614 - protein, 18 aa, Cryptosporidium hominis
SAPIPIKIVPKIIPKPAI

SEQ ID NO: 2186615 - protein, 21 aa, Cryptosporidium hominis
SCDAWAIGICLYEFLCGCLPF

SEQ ID NO: 2186616 - protein, 21 aa, Cryptosporidium hominis
SCGASACRDCVKNYLEQNKAV

SEQ ID NO: 2186617 - protein, 17 aa, Cryptosporidium hominis
SCLKRNWRIEFWSNFMA

SEQ ID NO: 2186618 - protein, 20 aa, Cryptosporidium hominis
SCLYCGSVLNTIRYISFYCS

SEQ ID NO: 2186619 - protein, 18 aa, Cryptosporidium hominis
SCNYMLICETCIIIDGHG

SEQ ID NO: 2186620 - protein, 20 aa, Cryptosporidium hominis
SCSAQAFGDLCNRRKTNISW

SEQ ID NO: 2186621 - protein, 19 aa, Cryptosporidium hominis
SCTLYVCRLSLKTKEDDLR

SEQ ID NO: 2186622 - protein, 18 aa, Cryptosporidium hominis
SCTMWRVRVKELIKDIIQ

SEQ ID NO: 2186623 - protein, 20 aa, Cryptosporidium hominis
SCWCISRFTPWLALQQGQPI

SEQ ID NO: 2186624 - protein, 19 aa, Cryptosporidium hominis
SDENFTFWLSLTSDKDQSC

SEQ ID NO: 2186625 - protein, 17 aa, Cryptosporidium hominis
SDFDFEWNNSLSVINKE

SEQ ID NO: 2186626 - protein, 18 aa, Cryptosporidium hominis
SDFEWLRSTLVIQFPGVF

SEQ ID NO: 2186627 - protein, 25 aa, Cryptosporidium hominis
SDFIPHKWVRLAMCEGYDINCTDFD

SEQ ID NO: 2186628 - protein, 17 aa, Cryptosporidium hominis
SDFPRTVKVCAGGEYSE

SEQ ID NO: 2186629 - protein, 18 aa, Cryptosporidium hominis
SDGALIWCHHPNDTVYCE

SEQ ID NO: 2186630 - protein, 23 aa, Cryptosporidium hominis
SDHLPCAVWLPWIPQLIAGIDRI

SEQ ID NO: 2186631 - protein, 21 aa, Cryptosporidium hominis
SDKKLICVIPRYSIIPKETLA

SEQ ID NO: 2186632 - protein, 18 aa, Cryptosporidium hominis
SDLCRRYHRAGLWDSSCP

SEQ ID NO: 2186633 - protein, 19 aa, Cryptosporidium hominis
SDLWIRYHVISSIARNGHP

SEQ ID NO: 2186634 - protein, 20 aa, Cryptosporidium hominis
SDRNCMQCFALLHAHAQTNA

SEQ ID NO: 2186635 - protein, 22 aa, Cryptosporidium hominis
SDSLRFPVPIKKLLFALELVQH

SEQ ID NO: 2186636 - protein, 23 aa, Cryptosporidium hominis
SDSRCLRDTWGLRQHRDGRWDWI

SEQ ID NO: 2186637 - protein, 22 aa, Cryptosporidium hominis
SDVISVLLFRFGALKNTNILNQ

SEQ ID NO: 2186638 - protein, 25 aa, Cryptosporidium hominis
SDYLQRFPTLTGFNRAGLSGNERII

SEQ ID NO: 2186639 - protein, 18 aa, Cryptosporidium hominis
SEACPRLVELLGHPSPLV

SEQ ID NO: 2186640 - protein, 17 aa, Cryptosporidium hominis
SEAFQLYSTYGFPMDLT

SEQ ID NO: 2186641 - protein, 23 aa, Cryptosporidium hominis
SECDLYLFSTCNATSAKIMPEDT

SEQ ID NO: 2186642 - protein, 20 aa, Cryptosporidium hominis
SEFILSLMIERIVQKIEHIV

SEQ ID NO: 2186643 - protein, 21 aa, Cryptosporidium hominis
SEIIQRWVVICSKLIEQSSLL

SEQ ID NO: 2186644 - protein, 18 aa, Cryptosporidium hominis
SEIIWKYHLNEEILFLTV

SEQ ID NO: 2186645 - protein, 18 aa, Cryptosporidium hominis
SEIRCLFDGFLSSDLYEL

SEQ ID NO: 2186646 - protein, 19 aa, Cryptosporidium hominis
SEIRQCYRLQFKGSDGKWY

SEQ ID NO: 2186647 - protein, 18 aa, Cryptosporidium hominis
SEKGFPFLNFQYNNIEET

SEQ ID NO: 2186648 - protein, 19 aa, Cryptosporidium hominis
SEKKCCIRPLIAPYDNQTT

SEQ ID NO: 2186649 - protein, 19 aa, Cryptosporidium hominis
SELIARYAILSKLILDSGI

SEQ ID NO: 2186650 - protein, 19 aa, Cryptosporidium hominis
SELWKIRFGIEVDIIQLFK

SEQ ID NO: 2186651 - protein, 18 aa, Cryptosporidium hominis
SEMNLLFPGEEEGDWKEL

SEQ ID NO: 2186652 - protein, 21 aa, Cryptosporidium hominis
SEMTFAFKVLKSFRGKLRLGV

SEQ ID NO: 2186653 - protein, 29 aa, Cryptosporidium hominis
SEMYADLCQILKWRSPVLVNKDGKSTIAF

SEQ ID NO: 2186654 - protein, 18 aa, Cryptosporidium hominis
SESLARMELSEWVKKSHV

SEQ ID NO: 2186655 - protein, 21 aa, Cryptosporidium hominis
SESSFKFGRIIDSTLSTPSTA

SEQ ID NO: 2186656 - protein, 20 aa, Cryptosporidium hominis
SEVYIELSVGSWTYWVIPNF

SEQ ID NO: 2186657 - protein, 25 aa, Cryptosporidium hominis
SEYICKLCGFPLLNPVLIKCAGSCG

SEQ ID NO: 2186658 - protein, 18 aa, Cryptosporidium hominis
SFFNGCGVVKRVSIPRYS

SEQ ID NO: 2186659 - protein, 17 aa, Cryptosporidium hominis
SFIGKVCSIEFYLYNPL

SEQ ID NO: 2186660 - protein, 17 aa, Cryptosporidium hominis
SFLDIIYSFAIKDEDIM

SEQ ID NO: 2186661 - protein, 18 aa, Cryptosporidium hominis
SFLYWLVNNCLKFETRKI

SEQ ID NO: 2186662 - protein, 19 aa, Cryptosporidium hominis
SFPIYCMELLGSKGSQSII

SEQ ID NO: 2186663 - protein, 31 aa, Cryptosporidium hominis
SFPTKSFSIGIGWSRLGLFVLNEYGDGLIQL

SEQ ID NO: 2186664 - protein, 20 aa, Cryptosporidium hominis
SGEIYLNIESWKGSNKGTKF

SEQ ID NO: 2186665 - protein, 17 aa, Cryptosporidium hominis
SGFEHIPAVLTHAAVLC

SEQ ID NO: 2186666 - protein, 17 aa, Cryptosporidium hominis
SGFKQKLLDILSIRPNQ

SEQ ID NO: 2186667 - protein, 18 aa, Cryptosporidium hominis
SGFYLGIRLVERLVTRLF

SEQ ID NO: 2186668 - protein, 20 aa, Cryptosporidium hominis
SGILCLKDAITLVARRAEIM

SEQ ID NO: 2186669 - protein, 19 aa, Cryptosporidium hominis
SGITHGWVAVWRLRESLES

SEQ ID NO: 2186670 - protein, 18 aa, Cryptosporidium hominis
SGLHGWAFTIEKFARIYA

SEQ ID NO: 2186671 - protein, 22 aa, Cryptosporidium hominis
SGNLKRIIKIVLFTLKSSNYEW

SEQ ID NO: 2186672 - protein, 24 aa, Cryptosporidium hominis
SGTVSRIGSPMIIKGNEMNYSQMT

SEQ ID NO: 2186673 - protein, 25 aa, Cryptosporidium hominis
SGVSFNFKSFCFMKFVTSIVGDSSS

SEQ ID NO: 2186674 - protein, 23 aa, Cryptosporidium hominis
SHGCLMCLTCSGVHRGLGVHISF

SEQ ID NO: 2186675 - protein, 19 aa, Cryptosporidium hominis
SHSKGVCSKALLLFQQSYQ

SEQ ID NO: 2186676 - protein, 17 aa, Cryptosporidium hominis
SIDGWKVLVDVERGRTV

SEQ ID NO: 2186677 - protein, 20 aa, Cryptosporidium hominis
SIHYRWSRGPSRAVCTFHPS

SEQ ID NO: 2186678 - protein, 19 aa, Cryptosporidium hominis
SIIFEFGKKLGMNSLSFKL

SEQ ID NO: 2186679 - protein, 17 aa, Cryptosporidium hominis
SIISLLSPVSWLQMDEI

SEQ ID NO: 2186680 - protein, 18 aa, Cryptosporidium hominis
SINTRIVPFISNYYSLLG

SEQ ID NO: 2186681 - protein, 18 aa, Cryptosporidium hominis
SIPFSWSQPILKLKILEE

SEQ ID NO: 2186682 - protein, 18 aa, Cryptosporidium hominis
SITPRFSLEESLNYRRSS

SEQ ID NO: 2186683 - protein, 19 aa, Cryptosporidium hominis
SIVRWSCRLLNISNFRNIP

SEQ ID NO: 2186684 - protein, 25 aa, Cryptosporidium hominis
SKEMIKWLGCLPIESMIDVYGTIVV

SEQ ID NO: 2186685 - protein, 25 aa, Cryptosporidium hominis
SKGHWNELIEVLKYIKIPANLQIIL

SEQ ID NO: 2186686 - protein, 17 aa, Cryptosporidium hominis
SKLICYNKWCVSGTPIV

SEQ ID NO: 2186687 - protein, 20 aa, Cryptosporidium hominis
SKLSRLSFRGDKESKGLDKI

SEQ ID NO: 2186688 - protein, 20 aa, Cryptosporidium hominis
SKMLISFPFFLKYYLSVLTT

SEQ ID NO: 2186689 - protein, 21 aa, Cryptosporidium hominis
SKPKCSVAFCETVEFRTVYVT

SEQ ID NO: 2186690 - protein, 19 aa, Cryptosporidium hominis
SKSAFSVAIRFRPAVCSEI

SEQ ID NO: 2186691 - protein, 24 aa, Cryptosporidium hominis
SKSMCLKCVESLYGILNISLKQSR

SEQ ID NO: 2186692 - protein, 23 aa, Cryptosporidium hominis
SKTCYRLCWPASKYVKLFSSAKI

SEQ ID NO: 2186693 - protein, 18 aa, Cryptosporidium hominis
SKTILCRYIWSFFIPTWN

SEQ ID NO: 2186694 - protein, 23 aa, Cryptosporidium hominis
SKVFPYPICFVSKSLPTPPKDYN

SEQ ID NO: 2186695 - protein, 17 aa, Cryptosporidium hominis
SKVSIFGLDQDEMKSDI

SEQ ID NO: 2186696 - protein, 17 aa, Cryptosporidium hominis
SKWIRDEYRFNNPMFLI

SEQ ID NO: 2186697 - protein, 21 aa, Cryptosporidium hominis
SKYSLSYNWFIYWNDNFPKST

SEQ ID NO: 2186698 - protein, 17 aa, Cryptosporidium hominis
SLCPIKLIGMVFVLSPS

SEQ ID NO: 2186699 - protein, 17 aa, Cryptosporidium hominis
SLDSFAFPITSEKGKKQ

SEQ ID NO: 2186700 - protein, 17 aa, Cryptosporidium hominis
SLFKVGGVFRRCGYLSN

SEQ ID NO: 2186701 - protein, 24 aa, Cryptosporidium hominis
SLGFKLFVDKCCDYYRYIRRKSWL

SEQ ID NO: 2186702 - protein, 20 aa, Cryptosporidium hominis
SLKLRLIFRFILKSMEVSNA

SEQ ID NO: 2186703 - protein, 18 aa, Cryptosporidium hominis
SLKNCLRNLLLSQITSDE

SEQ ID NO: 2186704 - protein, 17 aa, Cryptosporidium hominis
SLLKLSFGYGWNLLHIF

SEQ ID NO: 2186705 - protein, 23 aa, Cryptosporidium hominis
SLLRISSPFLWHFFQNGGNVHDL

SEQ ID NO: 2186706 - protein, 23 aa, Cryptosporidium hominis
SLNALKALPGWGARQKLERFGLR

SEQ ID NO: 2186707 - protein, 19 aa, Cryptosporidium hominis
SLQRFCAGLNFILQGKVII

SEQ ID NO: 2186708 - protein, 17 aa, Cryptosporidium hominis
SLQSFLIKYLDPIAIIS

SEQ ID NO: 2186709 - protein, 20 aa, Cryptosporidium hominis
SLRLWLGEDLEIWIFDFHRP

SEQ ID NO: 2186710 - protein, 19 aa, Cryptosporidium hominis
SLTCPICARLFRYAVLTPC

SEQ ID NO: 2186711 - protein, 27 aa, Cryptosporidium hominis
SLWFDALRHLLKWTLQWDPSNRPNVNQ

SEQ ID NO: 2186712 - protein, 23 aa, Cryptosporidium hominis
SMLEKRIGPVFSRNINGEKSDGT

SEQ ID NO: 2186713 - protein, 17 aa, Cryptosporidium hominis
SMRFKKSYPILASLITN

SEQ ID NO: 2186714 - protein, 22 aa, Cryptosporidium hominis
SNDGYYWMGYNFMKDNDPVFTL

SEQ ID NO: 2186715 - protein, 17 aa, Cryptosporidium hominis
SNEGFAIAINRNNDEAI

SEQ ID NO: 2186716 - protein, 18 aa, Cryptosporidium hominis
SNELWKLDIAYFSFQKFG

SEQ ID NO: 2186717 - protein, 21 aa, Cryptosporidium hominis
SNGIYPWVWCDLVTDQDTATP

SEQ ID NO: 2186718 - protein, 23 aa, Cryptosporidium hominis
SNIFCPYPFRFGDSSEYGTMIVA

SEQ ID NO: 2186719 - protein, 23 aa, Cryptosporidium hominis
SNIKSCPVHTAFSYRYQDENFDI

SEQ ID NO: 2186720 - protein, 17 aa, Cryptosporidium hominis
SNLLCKIPNGFTFEQAA

SEQ ID NO: 2186721 - protein, 19 aa, Cryptosporidium hominis
SNLLRWTQRYGYQGTDEFS

SEQ ID NO: 2186722 - protein, 19 aa, Cryptosporidium hominis
SNNVFMFPIPIWKSPTQKK

SEQ ID NO: 2186723 - protein, 18 aa, Cryptosporidium hominis
SNSLVGLYAEWVDKNTIW

SEQ ID NO: 2186724 - protein, 22 aa, Cryptosporidium hominis
SNYTPRLAFRGSVAPNSYYTVN

SEQ ID NO: 2186725 - protein, 17 aa, Cryptosporidium hominis
SPFGGVLNDGFWNHSHN

SEQ ID NO: 2186726 - protein, 18 aa, Cryptosporidium hominis
SPNNCWRMYCSECIMHNF

SEQ ID NO: 2186727 - protein, 19 aa, Cryptosporidium hominis
SQEKIKFECCFTDHIFSKM

SEQ ID NO: 2186728 - protein, 17 aa, Cryptosporidium hominis
SQFLRLVKKLLINYKKT

SEQ ID NO: 2186729 - protein, 18 aa, Cryptosporidium hominis
SQFRRLGCSLDWSREFFT

SEQ ID NO: 2186730 - protein, 19 aa, Cryptosporidium hominis
SQKLPSFGFENRFQDNIKG

SEQ ID NO: 2186731 - protein, 21 aa, Cryptosporidium hominis
SQNFPLCIFKSNIISSKNHPL

SEQ ID NO: 2186732 - protein, 18 aa, Cryptosporidium hominis
SQQIIWFWECLKEFDQNR

SEQ ID NO: 2186733 - protein, 19 aa, Cryptosporidium hominis
SREWKASKLIFLPSSDKHL

SEQ ID NO: 2186734 - protein, 19 aa, Cryptosporidium hominis
SRKAYFIGYMVHKLCLGAL

SEQ ID NO: 2186735 - protein, 24 aa, Cryptosporidium hominis
SRKILARVRELWLSNIVEGLPRKI

SEQ ID NO: 2186736 - protein, 18 aa, Cryptosporidium hominis
SRLRIAIVEADRCKPKNC

SEQ ID NO: 2186737 - protein, 21 aa, Cryptosporidium hominis
SRNSIKIIALISIKFKETASN

SEQ ID NO: 2186738 - protein, 21 aa, Cryptosporidium hominis
SRPFEYLRLTSLGVIGALVKV

SEQ ID NO: 2186739 - protein, 21 aa, Cryptosporidium hominis
SRSNLRLPPKVPGISSNNAFK

SEQ ID NO: 2186740 - protein, 18 aa, Cryptosporidium hominis
SRTIIICNCSPDKVNYYE

SEQ ID NO: 2186741 - protein, 21 aa, Cryptosporidium hominis
SRTSLALPEFLVEDIPLPKVC

SEQ ID NO: 2186742 - protein, 24 aa, Cryptosporidium hominis
SRVLHPKRRFKLFRSILKFGDPYR

SEQ ID NO: 2186743 - protein, 19 aa, Cryptosporidium hominis
SSCEIYLRRMHGLENELQI

SEQ ID NO: 2186744 - protein, 20 aa, Cryptosporidium hominis
SSDESLFCFIWKNILLIWNT

SEQ ID NO: 2186745 - protein, 23 aa, Cryptosporidium hominis
SSEFKGVIFAGGSGRMLGPLAKN

SEQ ID NO: 2186746 - protein, 17 aa, Cryptosporidium hominis
SSFSILNILLSRWSGIP

SEQ ID NO: 2186747 - protein, 18 aa, Cryptosporidium hominis
SSGGCWIALGGSNGFITL

SEQ ID NO: 2186748 - protein, 17 aa, Cryptosporidium hominis
SSIKVGKLFLVDLAGSE

SEQ ID NO: 2186749 - protein, 23 aa, Cryptosporidium hominis
SSIPFHLVCHVFESMKASLQKNE

SEQ ID NO: 2186750 - protein, 27 aa, Cryptosporidium hominis
SSKYCLLKNKYLFLGIEFLNETLEKII

SEQ ID NO: 2186751 - protein, 27 aa, Cryptosporidium hominis
SSKYKWLFRWLPYYYKFGMGYQISKVI

SEQ ID NO: 2186752 - protein, 22 aa, Cryptosporidium hominis
SSLHKLKGFFLILVQTELGDIY

SEQ ID NO: 2186753 - protein, 22 aa, Cryptosporidium hominis
SSQATCCEICLPPLTEKGLDES

SEQ ID NO: 2186754 - protein, 22 aa, Cryptosporidium hominis
SSSEFKASLYIEYGQLKVGQSY

SEQ ID NO: 2186755 - protein, 21 aa, Cryptosporidium hominis
SSYTLPIIWLLKSMNLSDGIS

SEQ ID NO: 2186756 - protein, 24 aa, Cryptosporidium hominis
STCTSLRVSSCFKRMELIVWNYND

SEQ ID NO: 2186757 - protein, 22 aa, Cryptosporidium hominis
STGLPIDPMVGLPFDPKSGNLV

SEQ ID NO: 2186758 - protein, 18 aa, Cryptosporidium hominis
STGNHFKPINGFVFDKTS

SEQ ID NO: 2186759 - protein, 19 aa, Cryptosporidium hominis
STNLLKSWFSKAFKQGISL

SEQ ID NO: 2186760 - protein, 19 aa, Cryptosporidium hominis
STNMLKMYLKQRIMKISEF

SEQ ID NO: 2186761 - protein, 20 aa, Cryptosporidium hominis
STSLPLPIPLIAKNNQFQGT

SEQ ID NO: 2186762 - protein, 21 aa, Cryptosporidium hominis
STSPCYYYLPTGYERIGNCFN

SEQ ID NO: 2186763 - protein, 18 aa, Cryptosporidium hominis
STWSRIFSPLSFGFDKRE

SEQ ID NO: 2186764 - protein, 19 aa, Cryptosporidium hominis
SVCAINCWGLFASNLISFQ

SEQ ID NO: 2186765 - protein, 19 aa, Cryptosporidium hominis
SVDSLDHWMMLFLQPLGIT

SEQ ID NO: 2186766 - protein, 18 aa, Cryptosporidium hominis
SVEKYSCFEHNSNIDRLS

SEQ ID NO: 2186767 - protein, 17 aa, Cryptosporidium hominis
SVFKLKWKFATMPDKNK

SEQ ID NO: 2186768 - protein, 18 aa, Cryptosporidium hominis
SVHLTKDRIEFMLEHPKF

SEQ ID NO: 2186769 - protein, 19 aa, Cryptosporidium hominis
SVIFRRFLEDLARNSHLGG

SEQ ID NO: 2186770 - protein, 19 aa, Cryptosporidium hominis
SVILGFRYANFMLLIDSVD

SEQ ID NO: 2186771 - protein, 19 aa, Cryptosporidium hominis
SVRRKNCIKNYLVSSDTEI

SEQ ID NO: 2186772 - protein, 25 aa, Cryptosporidium hominis
SVVDPRTGRQLKVWDVAKSFSDSIS

SEQ ID NO: 2186773 - protein, 27 aa, Cryptosporidium hominis
SWGHKLRWVKIFKCEMHYFLSPKESNI

SEQ ID NO: 2186774 - protein, 22 aa, Cryptosporidium hominis
SWKYRLQRHSILLNDTRRKLFN

SEQ ID NO: 2186775 - protein, 25 aa, Cryptosporidium hominis
SWNSRMEAWLAFFVENGVRKSKTFS

SEQ ID NO: 2186776 - protein, 19 aa, Cryptosporidium hominis
SWPEFSKLLAHLVESPHYS

SEQ ID NO: 2186777 - protein, 19 aa, Cryptosporidium hominis
SWRCWKANLPWKVHGMPPA

SEQ ID NO: 2186778 - protein, 20 aa, Cryptosporidium hominis
SYQAYECWLCVREFANVLIH

SEQ ID NO: 2186779 - protein, 18 aa, Cryptosporidium hominis
SYRFPNNGPLCFTIPEFS

SEQ ID NO: 2186780 - protein, 17 aa, Cryptosporidium hominis
SYVCDVFDYALSIHCEF

SEQ ID NO: 2186781 - protein, 22 aa, Cryptosporidium hominis
TALQRWDFRICGVYCLDVGFLT

SEQ ID NO: 2186782 - protein, 23 aa, Cryptosporidium hominis
TANLMPRCIGMWKEYFTSDGKPY

SEQ ID NO: 2186783 - protein, 22 aa, Cryptosporidium hominis
TARIPINTGYNFKIIPQNDSSS

SEQ ID NO: 2186784 - protein, 23 aa, Cryptosporidium hominis
TASYRLLPEFGFPNGPISGSDAL

SEQ ID NO: 2186785 - protein, 17 aa, Cryptosporidium hominis
TCLKFLPNLGIIISGDI

SEQ ID NO: 2186786 - protein, 22 aa, Cryptosporidium hominis
TCPLCRVPCSVFTLCDLVNITI

SEQ ID NO: 2186787 - protein, 18 aa, Cryptosporidium hominis
TDALIEIQKWLGLDQNEE

SEQ ID NO: 2186788 - protein, 18 aa, Cryptosporidium hominis
TDIPFIWMNVVQRYQIVN

SEQ ID NO: 2186789 - protein, 19 aa, Cryptosporidium hominis
TDIPIVFKLIGRFINGIFP

SEQ ID NO: 2186790 - protein, 18 aa, Cryptosporidium hominis
TDLIFSWLELRDGSENLV

SEQ ID NO: 2186791 - protein, 17 aa, Cryptosporidium hominis
TDQRIQGLIGRYNSMCM

SEQ ID NO: 2186792 - protein, 20 aa, Cryptosporidium hominis
TECIRLLVAFILNSLSMNEL

SEQ ID NO: 2186793 - protein, 23 aa, Cryptosporidium hominis
TEELCGISLEWSELKSLMKSKDS

SEQ ID NO: 2186794 - protein, 19 aa, Cryptosporidium hominis
TEGNWLFSLFCSINNKLIE

SEQ ID NO: 2186795 - protein, 17 aa, Cryptosporidium hominis
TEIDYNWFLSPHNRILI

SEQ ID NO: 2186796 - protein, 21 aa, Cryptosporidium hominis
TELLLIEWMEAFFAHLRLALL

SEQ ID NO: 2186797 - protein, 23 aa, Cryptosporidium hominis
TENEARWLFSQIFNAVINLHNKN

SEQ ID NO: 2186798 - protein, 17 aa, Cryptosporidium hominis
TERWDKERVAICGEKGV

SEQ ID NO: 2186799 - protein, 21 aa, Cryptosporidium hominis
TETVFDSGMKIQKTVNKTSTE

SEQ ID NO: 2186800 - protein, 23 aa, Cryptosporidium hominis
TEVLKRLTILGVLDDAIFDIPNA

SEQ ID NO: 2186801 - protein, 20 aa, Cryptosporidium hominis
TEYLCGSYVKVPIINPSTNS

SEQ ID NO: 2186802 - protein, 19 aa, Cryptosporidium hominis
TFELLLRKCIIEWEKQIDY

SEQ ID NO: 2186803 - protein, 23 aa, Cryptosporidium hominis
TFIKEAFCAPSFAPPKSDIFSIN

SEQ ID NO: 2186804 - protein, 20 aa, Cryptosporidium hominis
TFPPICLARRYFPRSISCPG

SEQ ID NO: 2186805 - protein, 17 aa, Cryptosporidium hominis
TGIAIICRFCGSIIENE

SEQ ID NO: 2186806 - protein, 17 aa, Cryptosporidium hominis
TGPFFSIFYQLAHGLIL

SEQ ID NO: 2186807 - protein, 18 aa, Cryptosporidium hominis
THSKIRVGPEYQAVLPDL

SEQ ID NO: 2186808 - protein, 23 aa, Cryptosporidium hominis
TIDYKIWLAKCIDLSQMDEDDKK

SEQ ID NO: 2186809 - protein, 18 aa, Cryptosporidium hominis
TIEITLAAAIGCRQNVVA

SEQ ID NO: 2186810 - protein, 24 aa, Cryptosporidium hominis
TIEYRDGMKLSLGVDGRKLLLKRI

SEQ ID NO: 2186811 - protein, 26 aa, Cryptosporidium hominis
TIGEWYRQANIMKRCNSYSCENFSVT

SEQ ID NO: 2186812 - protein, 23 aa, Cryptosporidium hominis
TIPKLKYYWVYMLTLDFPNLTFI

SEQ ID NO: 2186813 - protein, 17 aa, Cryptosporidium hominis
TIPSVILSPSFKMIFHD

SEQ ID NO: 2186814 - protein, 25 aa, Cryptosporidium hominis
TISKFKIPIELFPLNKNQIIIDIDL

SEQ ID NO: 2186815 - protein, 24 aa, Cryptosporidium hominis
TIVKRFSVSWMYKSGFLHIPIHSI

SEQ ID NO: 2186816 - protein, 24 aa, Cryptosporidium hominis
TIYMAYYTICHFFHSDFEGRSKGL

SEQ ID NO: 2186817 - protein, 18 aa, Cryptosporidium hominis
TKCPVCLIYLISPNHLAK

SEQ ID NO: 2186818 - protein, 20 aa, Cryptosporidium hominis
TKCQETMKGTGYETSIQGQD

SEQ ID NO: 2186819 - protein, 23 aa, Cryptosporidium hominis
TKKKSKVCGINWTCDGNKLVYSA

SEQ ID NO: 2186820 - protein, 20 aa, Cryptosporidium hominis
TKLFILELMAKINKQLNDSG

SEQ ID NO: 2186821 - protein, 18 aa, Cryptosporidium hominis
TKLKPCYLCYSSSTISNQ

SEQ ID NO: 2186822 - protein, 17 aa, Cryptosporidium hominis
TKLKSFCILLDYDSVII

SEQ ID NO: 2186823 - protein, 22 aa, Cryptosporidium hominis
TKPIEVFLIFSLNAIKSVIADL

SEQ ID NO: 2186824 - protein, 17 aa, Cryptosporidium hominis
TKRLGIKLLKLLKLLLE

SEQ ID NO: 2186825 - protein, 24 aa, Cryptosporidium hominis
TLAFCRRWLDQLGFNKHALALKSL

SEQ ID NO: 2186826 - protein, 24 aa, Cryptosporidium hominis
TLFGKGIYCFNHFVIARGKMNKIT

SEQ ID NO: 2186827 - protein, 17 aa, Cryptosporidium hominis
TLLPCCLVIANSKDSNI

SEQ ID NO: 2186828 - protein, 19 aa, Cryptosporidium hominis
TLQEFKWNHEIVYYSFQTI

SEQ ID NO: 2186829 - protein, 22 aa, Cryptosporidium hominis
TLSLSCLKWLLLSDSDNNISID

SEQ ID NO: 2186830 - protein, 19 aa, Cryptosporidium hominis
TLVNLWLTAYFEKRIKKKQ

SEQ ID NO: 2186831 - protein, 17 aa, Cryptosporidium hominis
TMWNFRKSYIVSEQSNT

SEQ ID NO: 2186832 - protein, 19 aa, Cryptosporidium hominis
TNELFKVWSPYIVSPYVLS

SEQ ID NO: 2186833 - protein, 24 aa, Cryptosporidium hominis
TNGFSKWQVCRSFLATLMLSNNRE

SEQ ID NO: 2186834 - protein, 23 aa, Cryptosporidium hominis
TNILSIKLGWPVIRCPHYIDFLP

SEQ ID NO: 2186835 - protein, 18 aa, Cryptosporidium hominis
TNIYLKWSRLVYEELENQ

SEQ ID NO: 2186836 - protein, 17 aa, Cryptosporidium hominis
TNLEIVQDILLLSIIRG

SEQ ID NO: 2186837 - protein, 19 aa, Cryptosporidium hominis
TNPDLKCTLWRSSQPKSAF

SEQ ID NO: 2186838 - protein, 17 aa, Cryptosporidium hominis
TNRLALMGLDWDNITAD

SEQ ID NO: 2186839 - protein, 18 aa, Cryptosporidium hominis
TQDYKEWLESTLLPAPNA

SEQ ID NO: 2186840 - protein, 23 aa, Cryptosporidium hominis
TQVEFLTGMLIFRPYNIKEKNSP

SEQ ID NO: 2186841 - protein, 20 aa, Cryptosporidium hominis
TRFASGNVDGVTTRTETFVT

SEQ ID NO: 2186842 - protein, 17 aa, Cryptosporidium hominis
TRFDCLKELLLVCKNSS

SEQ ID NO: 2186843 - protein, 18 aa, Cryptosporidium hominis
TRIPRVDCSIGIHDRNKK

SEQ ID NO: 2186844 - protein, 18 aa, Cryptosporidium hominis
TRIYRWYLFYKHIILPLR

SEQ ID NO: 2186845 - protein, 17 aa, Cryptosporidium hominis
TRLNCLIQDVFDLRKHK

SEQ ID NO: 2186846 - protein, 22 aa, Cryptosporidium hominis
TRLQEMWDRVVAGESIINGGKI

SEQ ID NO: 2186847 - protein, 20 aa, Cryptosporidium hominis
TRLSLITAFHGAWFCKEATI

SEQ ID NO: 2186848 - protein, 22 aa, Cryptosporidium hominis
TRLTEIFSEYGLNGCDIKKKYN

SEQ ID NO: 2186849 - protein, 17 aa, Cryptosporidium hominis
TRRRLRQLVKSGLSKGF

SEQ ID NO: 2186850 - protein, 23 aa, Cryptosporidium hominis
TRYRLAMYFYEFLKSIKMLTEKG

SEQ ID NO: 2186851 - protein, 18 aa, Cryptosporidium hominis
TSKFCFCKQPVLDNMIRC

SEQ ID NO: 2186852 - protein, 17 aa, Cryptosporidium hominis
TSLWSCIYKSLRYNMNR

SEQ ID NO: 2186853 - protein, 24 aa, Cryptosporidium hominis
TSPDYPVRCAFSLLNEYLKTYIDS

SEQ ID NO: 2186854 - protein, 17 aa, Cryptosporidium hominis
TSTKFMPDGTIFKQGWT

SEQ ID NO: 2186855 - protein, 17 aa, Cryptosporidium hominis
TTFDHFFLIKSCDFASE

SEQ ID NO: 2186856 - protein, 17 aa, Cryptosporidium hominis
TTPELPCYCFVIEASSM

SEQ ID NO: 2186857 - protein, 18 aa, Cryptosporidium hominis
TTPIPLLSPRVFIHDHIV

SEQ ID NO: 2186858 - protein, 18 aa, Cryptosporidium hominis
TTSCSLIWEGVRPSRIFF

SEQ ID NO: 2186859 - protein, 18 aa, Cryptosporidium hominis
TTSICSYGNYFILIDFKE

SEQ ID NO: 2186860 - protein, 17 aa, Cryptosporidium hominis
TVFKRLLLYDSKAVRKC

SEQ ID NO: 2186861 - protein, 21 aa, Cryptosporidium hominis
TVLRFPISISMYSLLLFASDS

SEQ ID NO: 2186862 - protein, 25 aa, Cryptosporidium hominis
TVVSKPGWGAVRWADLSISDASNSW

SEQ ID NO: 2186863 - protein, 19 aa, Cryptosporidium hominis
TWRICYAPEPGKRVTKSFN

SEQ ID NO: 2186864 - protein, 18 aa, Cryptosporidium hominis
TYCCTSCNYMLICETCII

SEQ ID NO: 2186865 - protein, 24 aa, Cryptosporidium hominis
TYFLRGLLYRIWKYNRNGKVINNS

SEQ ID NO: 2186866 - protein, 24 aa, Cryptosporidium hominis
VAAEGLKCGWGFPTGCSLNHCAAH

SEQ ID NO: 2186867 - protein, 19 aa, Cryptosporidium hominis
VACFRYRIEDCMRILTKGN

SEQ ID NO: 2186868 - protein, 17 aa, Cryptosporidium hominis
VAIRFRPAVCSEINEIE

SEQ ID NO: 2186869 - protein, 17 aa, Cryptosporidium hominis
VAVLDRCVWCIRCYSEG

SEQ ID NO: 2186870 - protein, 22 aa, Cryptosporidium hominis
VCENFTLCKSCCRNTNHEHPLE

SEQ ID NO: 2186871 - protein, 18 aa, Cryptosporidium hominis
VCGNELCEFLVNVVEPLK

SEQ ID NO: 2186872 - protein, 17 aa, Cryptosporidium hominis
VCIKIILNNVDWKCVTQ

SEQ ID NO: 2186873 - protein, 19 aa, Cryptosporidium hominis
VCIRFCRRIHQLYSNELSK

SEQ ID NO: 2186874 - protein, 19 aa, Cryptosporidium hominis
VDAALDFRNVSIIATFIKE

SEQ ID NO: 2186875 - protein, 24 aa, Cryptosporidium hominis
VDDELRQALLLSIQDFSGNDSTNN

SEQ ID NO: 2186876 - protein, 17 aa, Cryptosporidium hominis
VDLRWPAIKTWIYVCNQ

SEQ ID NO: 2186877 - protein, 19 aa, Cryptosporidium hominis
VECLCQLIMTTGYYLDSNE

SEQ ID NO: 2186878 - protein, 18 aa, Cryptosporidium hominis
VEECKKRHQSIIHQLVHI

SEQ ID NO: 2186879 - protein, 18 aa, Cryptosporidium hominis
VEHIWKSTCFIKLQSKLD

SEQ ID NO: 2186880 - protein, 19 aa, Cryptosporidium hominis
VELLFRYIFHFERNEIRIR

SEQ ID NO: 2186881 - protein, 19 aa, Cryptosporidium hominis
VEVNPRIAPGVGVNPPTVA

SEQ ID NO: 2186882 - protein, 24 aa, Cryptosporidium hominis
VFCPCRSCLFKGKAHDKLMGHFKI

SEQ ID NO: 2186883 - protein, 18 aa, Cryptosporidium hominis
VFELMALGHKHRAVASTN

SEQ ID NO: 2186884 - protein, 18 aa, Cryptosporidium hominis
VFGRKGDCSIRLKDQSIS

SEQ ID NO: 2186885 - protein, 22 aa, Cryptosporidium hominis
VFGVLRPNAKWRPGRGNSSKSQ

SEQ ID NO: 2186886 - protein, 20 aa, Cryptosporidium hominis
VFWRWLTPRILAIVGDKGIY

SEQ ID NO: 2186887 - protein, 17 aa, Cryptosporidium hominis
VGAGYDWSADIWSLGCT

SEQ ID NO: 2186888 - protein, 18 aa, Cryptosporidium hominis
VGHAFAFAFLQQVVVEPS

SEQ ID NO: 2186889 - protein, 19 aa, Cryptosporidium hominis
VGLIWKYRFYLFKFKAGIP

SEQ ID NO: 2186890 - protein, 21 aa, Cryptosporidium hominis
VGRGRIGGIPVGFILVETRVT

SEQ ID NO: 2186891 - protein, 17 aa, Cryptosporidium hominis
VGVFYLEQFINLQIEYW

SEQ ID NO: 2186892 - protein, 17 aa, Cryptosporidium hominis
VHFSKLYINIIVYQNSF

SEQ ID NO: 2186893 - protein, 17 aa, Cryptosporidium hominis
VICLLEISSIGYANSKS

SEQ ID NO: 2186894 - protein, 19 aa, Cryptosporidium hominis
VIEFFKYPIPFFSKKNISK

SEQ ID NO: 2186895 - protein, 20 aa, Cryptosporidium hominis
VIFCGPPIYPSIYLDCIQSI

SEQ ID NO: 2186896 - protein, 18 aa, Cryptosporidium hominis
VIKKRWAKELSFYENEVN

SEQ ID NO: 2186897 - protein, 17 aa, Cryptosporidium hominis
VIVGAGYDWSADIWSLG

SEQ ID NO: 2186898 - protein, 18 aa, Cryptosporidium hominis
VKDKLNGIVHSFKNGTDY

SEQ ID NO: 2186899 - protein, 19 aa, Cryptosporidium hominis
VKEKVFIVGRLIRYVSKAL

SEQ ID NO: 2186900 - protein, 18 aa, Cryptosporidium hominis
VKFFPRYLIYYPQITSQP

SEQ ID NO: 2186901 - protein, 17 aa, Cryptosporidium hominis
VKFYLDPIMDFDINLYN

SEQ ID NO: 2186902 - protein, 17 aa, Cryptosporidium hominis
VKICPWLAISNFVDEFV

SEQ ID NO: 2186903 - protein, 17 aa, Cryptosporidium hominis
VKIPVCDPLAWGETLGC

SEQ ID NO: 2186904 - protein, 19 aa, Cryptosporidium hominis
VKKLLGFLGMPCIDAPSEA

SEQ ID NO: 2186905 - protein, 19 aa, Cryptosporidium hominis
VKLGIKLYPNWKWSQRWHG

SEQ ID NO: 2186906 - protein, 23 aa, Cryptosporidium hominis
VKNQEIDCGFDFAPVDEYSNIGI

SEQ ID NO: 2186907 - protein, 19 aa, Cryptosporidium hominis
VKPKHFWKLIEPTVVSPAH

SEQ ID NO: 2186908 - protein, 18 aa, Cryptosporidium hominis
VKQWKKGHFFKLFEDSES

SEQ ID NO: 2186909 - protein, 21 aa, Cryptosporidium hominis
VKRIPDGILLFFGSYSLMDQA

SEQ ID NO: 2186910 - protein, 17 aa, Cryptosporidium hominis
VLESFTFELFCSIRQHF

SEQ ID NO: 2186911 - protein, 18 aa, Cryptosporidium hominis
VLEYFKAKLLNIANANER

SEQ ID NO: 2186912 - protein, 22 aa, Cryptosporidium hominis
VLFPRLLTLFFHYPEDQNSKIS

SEQ ID NO: 2186913 - protein, 22 aa, Cryptosporidium hominis
VLKGEIKDLLLLDVTPLSLGIE

SEQ ID NO: 2186914 - protein, 18 aa, Cryptosporidium hominis
VLLMFPFIEFYLQTYSKK

SEQ ID NO: 2186915 - protein, 19 aa, Cryptosporidium hominis
VLMGPKWERELKRYTQLSI

SEQ ID NO: 2186916 - protein, 23 aa, Cryptosporidium hominis
VLRYYCPFCNGACNCERCLRNQQ

SEQ ID NO: 2186917 - protein, 20 aa, Cryptosporidium hominis
VLSDKGCAFITFEQEEGAKS

SEQ ID NO: 2186918 - protein, 22 aa, Cryptosporidium hominis
VLSKFGAPVVRRADGEETIEYR

SEQ ID NO: 2186919 - protein, 25 aa, Cryptosporidium hominis
VMHYWKEIPLPFSFTSIINRIRNNY

SEQ ID NO: 2186920 - protein, 17 aa, Cryptosporidium hominis
VMKHVINPFNFLNDNIN

SEQ ID NO: 2186921 - protein, 23 aa, Cryptosporidium hominis
VMKIQCLIKRYWILAHLDRLFWV

SEQ ID NO: 2186922 - protein, 17 aa, Cryptosporidium hominis
VNFSYKRIQGILATSIL

SEQ ID NO: 2186923 - protein, 17 aa, Cryptosporidium hominis
VNLLRCRNDIFLQKKNQ

SEQ ID NO: 2186924 - protein, 19 aa, Cryptosporidium hominis
VNNCLKFETRKIVIVTHSN

SEQ ID NO: 2186925 - protein, 18 aa, Cryptosporidium hominis
VNNFRFGNSIWKTNKDSK

SEQ ID NO: 2186926 - protein, 20 aa, Cryptosporidium hominis
VNSDEMFLELGIHYPMPLPK

SEQ ID NO: 2186927 - protein, 17 aa, Cryptosporidium hominis
VPCRYGLACYNSLCNYS

SEQ ID NO: 2186928 - protein, 18 aa, Cryptosporidium hominis
VPHGLTIVKARTISRQTD

SEQ ID NO: 2186929 - protein, 20 aa, Cryptosporidium hominis
VPIRIRFLINDVIDSRKNNW

SEQ ID NO: 2186930 - protein, 28 aa, Cryptosporidium hominis
VPKSGIRLRLEWDRRRYCFKFTVYQIEE

SEQ ID NO: 2186931 - protein, 19 aa, Cryptosporidium hominis
VPLTFSLRGKKMFLRAKGI

SEQ ID NO: 2186932 - protein, 18 aa, Cryptosporidium hominis
VPPAQYILDTSIYSSATP

SEQ ID NO: 2186933 - protein, 22 aa, Cryptosporidium hominis
VPRPRFPYLVLVPLEGDFSSKI

SEQ ID NO: 2186934 - protein, 26 aa, Cryptosporidium hominis
VPSFLSFKPKFMYSIPFECNENKYSR

SEQ ID NO: 2186935 - protein, 17 aa, Cryptosporidium hominis
VPTGSFLIRAFYSNNGV

SEQ ID NO: 2186936 - protein, 21 aa, Cryptosporidium hominis
VQLRTDCWVYYSPKNAQQNKE

SEQ ID NO: 2186937 - protein, 17 aa, Cryptosporidium hominis
VQTPILYLFDAFIRNEE

SEQ ID NO: 2186938 - protein, 21 aa, Cryptosporidium hominis
VQYRIPLLNCHVGDWQPVDSD

SEQ ID NO: 2186939 - protein, 19 aa, Cryptosporidium hominis
VRDSLGYQKKRLIPVDQDE

SEQ ID NO: 2186940 - protein, 21 aa, Cryptosporidium hominis
VRDWCGSCLLDLIRRCQRLAS

SEQ ID NO: 2186941 - protein, 19 aa, Cryptosporidium hominis
VRGTLRFVVKLVPNQQNPN

SEQ ID NO: 2186942 - protein, 19 aa, Cryptosporidium hominis
VRKLSRLMIPYVQKGVLDL

SEQ ID NO: 2186943 - protein, 27 aa, Cryptosporidium hominis
VRNEILCGLNFCTLCYGKYSGISNQKV

SEQ ID NO: 2186944 - protein, 17 aa, Cryptosporidium hominis
VRRRIDLGSSLILQNYS

SEQ ID NO: 2186945 - protein, 19 aa, Cryptosporidium hominis
VRVSLKFYFKCEFERRLFN

SEQ ID NO: 2186946 - protein, 18 aa, Cryptosporidium hominis
VSCLKETVLILFKSNKLE

SEQ ID NO: 2186947 - protein, 17 aa, Cryptosporidium hominis
VSDMIWQVQVCKTYMGR

SEQ ID NO: 2186948 - protein, 20 aa, Cryptosporidium hominis
VSDPFCYPTPIALSSASNHI

SEQ ID NO: 2186949 - protein, 18 aa, Cryptosporidium hominis
VSEWSRYIVKCILEGSSM

SEQ ID NO: 2186950 - protein, 25 aa, Cryptosporidium hominis
VSFGKSRRNTIRWNPSGKWFAYGGF

SEQ ID NO: 2186951 - protein, 20 aa, Cryptosporidium hominis
VSGMQGWRVSMEDAHIALPR

SEQ ID NO: 2186952 - protein, 24 aa, Cryptosporidium hominis
VSGYAGKVLFGWDFPAGFTPSLSC

SEQ ID NO: 2186953 - protein, 18 aa, Cryptosporidium hominis
VSIGCQWHPVFPSRIASC

SEQ ID NO: 2186954 - protein, 22 aa, Cryptosporidium hominis
VSIRRMAYCIGVALSRLHELGI

SEQ ID NO: 2186955 - protein, 18 aa, Cryptosporidium hominis
VSRLGRCYLWLENKDLVT

SEQ ID NO: 2186956 - protein, 22 aa, Cryptosporidium hominis
VSSLCNCVTYFSGSTRSTGPNF

SEQ ID NO: 2186957 - protein, 18 aa, Cryptosporidium hominis
VTCCTFFKLFKLHLNSQV

SEQ ID NO: 2186958 - protein, 28 aa, Cryptosporidium hominis
VTCFSPRMLPDWQLNWLRDVTRSLSSVP

SEQ ID NO: 2186959 - protein, 19 aa, Cryptosporidium hominis
VTFEFLRRFYIATNVQIQI

SEQ ID NO: 2186960 - protein, 39 aa, Cryptosporidium hominis
VTGKNYTVCYIKNLNQFGGGFKYLSPLGYKPNYSRFIQE

SEQ ID NO: 2186961 - protein, 20 aa, Cryptosporidium hominis
VTNLCYSRELILNGIGNLFP

SEQ ID NO: 2186962 - protein, 19 aa, Cryptosporidium hominis
VVGSPQCGPYCSTYPKGYF

SEQ ID NO: 2186963 - protein, 19 aa, Cryptosporidium hominis
VVKKLCKKYDLFLASQVLL

SEQ ID NO: 2186964 - protein, 19 aa, Cryptosporidium hominis
VVMFWEIVKKLDLKLQKKL

SEQ ID NO: 2186965 - protein, 20 aa, Cryptosporidium hominis
VWHVLSGRLLRCFSTPTMTL

SEQ ID NO: 2186966 - protein, 18 aa, Cryptosporidium hominis
WACCKCSNVNFPRRFRCF

SEQ ID NO: 2186967 - protein, 23 aa, Cryptosporidium hominis
WCEVCNLGFNDSHSWIRHLNSQS

SEQ ID NO: 2186968 - protein, 20 aa, Cryptosporidium hominis
WCNNDSFLLSGCLDRQITVL

SEQ ID NO: 2186969 - protein, 17 aa, Cryptosporidium hominis
WDCLGRSALLHGFINVA

SEQ ID NO: 2186970 - protein, 21 aa, Cryptosporidium hominis
WDKKSLVGLFCRFGNILSAHL

SEQ ID NO: 2186971 - protein, 17 aa, Cryptosporidium hominis
WDLRMGRELVKYSSGLR

SEQ ID NO: 2186972 - protein, 17 aa, Cryptosporidium hominis
WFCIKYLEYYGSGRKHE

SEQ ID NO: 2186973 - protein, 20 aa, Cryptosporidium hominis
WGVNFPAHFAIIKGTEYFDA

SEQ ID NO: 2186974 - protein, 18 aa, Cryptosporidium hominis
WHFLSLFIQFIFRTIYSF

SEQ ID NO: 2186975 - protein, 17 aa, Cryptosporidium hominis
WHFLSLGAIFLKYSKKN

SEQ ID NO: 2186976 - protein, 24 aa, Cryptosporidium hominis
WICPWHECCLCFRRATQAGGLLIH

SEQ ID NO: 2186977 - protein, 19 aa, Cryptosporidium hominis
WIGSVGVGGVVTWNKQNNF

SEQ ID NO: 2186978 - protein, 18 aa, Cryptosporidium hominis
WILDSACEIIRIPLPENP

SEQ ID NO: 2186979 - protein, 19 aa, Cryptosporidium hominis
WIRDEYRFNNPMFLIPKKV

SEQ ID NO: 2186980 - protein, 23 aa, Cryptosporidium hominis
WISKRLAPHYIPKSSLDFLPLDI

SEQ ID NO: 2186981 - protein, 17 aa, Cryptosporidium hominis
WISNNNINMNINTGNDL

SEQ ID NO: 2186982 - protein, 17 aa, Cryptosporidium hominis
WKANLPWKVHGMPPAVE

SEQ ID NO: 2186983 - protein, 17 aa, Cryptosporidium hominis
WKCKFCNVIEYCQVCPL

SEQ ID NO: 2186984 - protein, 19 aa, Cryptosporidium hominis
WKIKIELGIEEEKKTKTRI

SEQ ID NO: 2186985 - protein, 17 aa, Cryptosporidium hominis
WKISLYLSYAKWESLQN

SEQ ID NO: 2186986 - protein, 19 aa, Cryptosporidium hominis
WKKCCRKINEKLGINLQPI

SEQ ID NO: 2186987 - protein, 18 aa, Cryptosporidium hominis
WKPISLNAICELLSSKDF

SEQ ID NO: 2186988 - protein, 19 aa, Cryptosporidium hominis
WKPLMEWDLKCFVKILKQC

SEQ ID NO: 2186989 - protein, 17 aa, Cryptosporidium hominis
WLCDRCEFEKKFLGTQY

SEQ ID NO: 2186990 - protein, 18 aa, Cryptosporidium hominis
WLDKYVCCDSIEILHVNL

SEQ ID NO: 2186991 - protein, 17 aa, Cryptosporidium hominis
WLFFSIRILDGYDTFCS

SEQ ID NO: 2186992 - protein, 21 aa, Cryptosporidium hominis
WLPKRLGGGLGKVRGQEKPES

SEQ ID NO: 2186993 - protein, 22 aa, Cryptosporidium hominis
WNIRTGKCLKRLSAHINAKSVS

SEQ ID NO: 2186994 - protein, 18 aa, Cryptosporidium hominis
WNKLKFFLVNGYKDLYPA

SEQ ID NO: 2186995 - protein, 17 aa, Cryptosporidium hominis
WNMYDWELLMRDIQYPA

SEQ ID NO: 2186996 - protein, 18 aa, Cryptosporidium hominis
WNSFELILRPELKKLNFN

SEQ ID NO: 2186997 - protein, 17 aa, Cryptosporidium hominis
WNYIFKCSRDFSLSQFH

SEQ ID NO: 2186998 - protein, 21 aa, Cryptosporidium hominis
WPEIPEYNLSFGIHTQSAIKI

SEQ ID NO: 2186999 - protein, 17 aa, Cryptosporidium hominis
WPLCPYGPGCFFIHPTV

SEQ ID NO: 2187000 - protein, 17 aa, Cryptosporidium hominis
WPLSSLKSLCEYVGISV

SEQ ID NO: 2187001 - protein, 18 aa, Cryptosporidium hominis
WPSPISLCSIDERFRQTV

SEQ ID NO: 2187002 - protein, 17 aa, Cryptosporidium hominis
WQIAAMCGLEERFINLH

SEQ ID NO: 2187003 - protein, 17 aa, Cryptosporidium hominis
WQLCFCKPIISVTLFAR

SEQ ID NO: 2187004 - protein, 18 aa, Cryptosporidium hominis
WRFWFCPDSNMLETGEDL

SEQ ID NO: 2187005 - protein, 20 aa, Cryptosporidium hominis
WSAEMAMIFCMNRKNVFSFS

SEQ ID NO: 2187006 - protein, 20 aa, Cryptosporidium hominis
WSCGVILYALLCGSLPFDDE

SEQ ID NO: 2187007 - protein, 24 aa, Cryptosporidium hominis
WSIGVLCYVCLCGGLPFHDNRAFD

SEQ ID NO: 2187008 - protein, 27 aa, Cryptosporidium hominis
WSNKFVYPREMLFLGYSICSAYNDCTD

SEQ ID NO: 2187009 - protein, 18 aa, Cryptosporidium hominis
WSQRWHGIREKFYLWVTN

SEQ ID NO: 2187010 - protein, 17 aa, Cryptosporidium hominis
WSRYPLKISKFEEENVK

SEQ ID NO: 2187011 - protein, 17 aa, Cryptosporidium hominis
WSSPFVYNSRNCRLYII

SEQ ID NO: 2187012 - protein, 18 aa, Cryptosporidium hominis
WSTACSFVNTGDVIEIFG

SEQ ID NO: 2187013 - protein, 17 aa, Cryptosporidium hominis
WSTKCCCTSRVKFSDTD

SEQ ID NO: 2187014 - protein, 19 aa, Cryptosporidium hominis
WTHLGWCILVYPNGDIKAI

SEQ ID NO: 2187015 - protein, 18 aa, Cryptosporidium hominis
WTKDCLEIYSGPQKCDPK

SEQ ID NO: 2187016 - protein, 19 aa, Cryptosporidium hominis
WTQRYGYQGTDEFSIRMFN

SEQ ID NO: 2187017 - protein, 20 aa, Cryptosporidium hominis
WVHLVCAIWHLPLVTCEDWK

SEQ ID NO: 2187018 - protein, 21 aa, Cryptosporidium hominis
WWKKPRGWKVTYFKQGQKLSQ

SEQ ID NO: 2187019 - protein, 18 aa, Cryptosporidium hominis
WYHKTCLELLNSESEREN

SEQ ID NO: 2187020 - protein, 23 aa, Cryptosporidium hominis
WYIKGIVTKGIWPFLSATNKVKR

SEQ ID NO: 2187021 - protein, 20 aa, Cryptosporidium hominis
WYTWCKRPDFNLIHREVLGD

SEQ ID NO: 2187022 - protein, 17 aa, Cryptosporidium hominis
YAKYFAVIRRYKISRAI

SEQ ID NO: 2187023 - protein, 21 aa, Cryptosporidium hominis
YARSLDTHWLKYLLDSGLTMI

SEQ ID NO: 2187024 - protein, 17 aa, Cryptosporidium hominis
YAYRLLRHPNICSYIGV

SEQ ID NO: 2187025 - protein, 21 aa, Cryptosporidium hominis
YCKSCGLPTDYCEYGQCTKNK

SEQ ID NO: 2187026 - protein, 20 aa, Cryptosporidium hominis
YCLRYPCLINYLFKLYSRIV

SEQ ID NO: 2187027 - protein, 25 aa, Cryptosporidium hominis
YCRRSCKRLNYSRCPSKLKPLNLGI

SEQ ID NO: 2187028 - protein, 25 aa, Cryptosporidium hominis
YCSTYPKGYFAFWLTYDEDNDLYEI

SEQ ID NO: 2187029 - protein, 26 aa, Cryptosporidium hominis
YCSTYPKGYFAFWLTYDSKYNYFIIS

SEQ ID NO: 2187030 - protein, 25 aa, Cryptosporidium hominis
YCSTYPKGYFAFWLTYNSVTNKYII

SEQ ID NO: 2187031 - protein, 24 aa, Cryptosporidium hominis
YDCTFKLRCSRGIAVSKIYAPWTA

SEQ ID NO: 2187032 - protein, 21 aa, Cryptosporidium hominis
YDCYKALYFLLIAKRLIGESI

SEQ ID NO: 2187033 - protein, 19 aa, Cryptosporidium hominis
YDLIFKDILLRDMNRMDAM

SEQ ID NO: 2187034 - protein, 19 aa, Cryptosporidium hominis
YDPRFPTVRGIVRRGLSPS

SEQ ID NO: 2187035 - protein, 18 aa, Cryptosporidium hominis
YECFEKWASLLISKYNII

SEQ ID NO: 2187036 - protein, 23 aa, Cryptosporidium hominis
YEDCMNCLYLLLPFTLTHGTSQN

SEQ ID NO: 2187037 - protein, 18 aa, Cryptosporidium hominis
YEFLKHILCRSCSNCASY

SEQ ID NO: 2187038 - protein, 17 aa, Cryptosporidium hominis
YEKCLLEQKILFLKLVI

SEQ ID NO: 2187039 - protein, 18 aa, Cryptosporidium hominis
YELCTRFITTLSITKSVK

SEQ ID NO: 2187040 - protein, 18 aa, Cryptosporidium hominis
YEMALRFYQVNIIGNFGN

SEQ ID NO: 2187041 - protein, 19 aa, Cryptosporidium hominis
YEPVSVCCIEFWNTIADLE

SEQ ID NO: 2187042 - protein, 21 aa, Cryptosporidium hominis
YEVIFRLVFHLKYINYLLNNI

SEQ ID NO: 2187043 - protein, 18 aa, Cryptosporidium hominis
YEYLFKTARIQGMIDTCG

SEQ ID NO: 2187044 - protein, 17 aa, Cryptosporidium hominis
YFAATFCPQQNYSSHKV

SEQ ID NO: 2187045 - protein, 18 aa, Cryptosporidium hominis
YFCSYSFASVFSRMGPSS

SEQ ID NO: 2187046 - protein, 17 aa, Cryptosporidium hominis
YFKCCLEKWSLTNIHAS

SEQ ID NO: 2187047 - protein, 21 aa, Cryptosporidium hominis
YGENSYPFFPPGVQPAPIDGD

SEQ ID NO: 2187048 - protein, 18 aa, Cryptosporidium hominis
YGKNYAFYPPGIKPAPII

SEQ ID NO: 2187049 - protein, 17 aa, Cryptosporidium hominis
YGLLKLMGINGIIGTTT

SEQ ID NO: 2187050 - protein, 19 aa, Cryptosporidium hominis
YGVEKSYEMALRFYQVNII

SEQ ID NO: 2187051 - protein, 26 aa, Cryptosporidium hominis
YGVLCCICKSCGAFLLKGEEKRQHLA

SEQ ID NO: 2187052 - protein, 21 aa, Cryptosporidium hominis
YGVRFGVSGMQGWRVSMEDAH

SEQ ID NO: 2187053 - protein, 17 aa, Cryptosporidium hominis
YHALGWISGDVNVVAID

SEQ ID NO: 2187054 - protein, 19 aa, Cryptosporidium hominis
YICLWDLQPDFGRSIFGIQ

SEQ ID NO: 2187055 - protein, 18 aa, Cryptosporidium hominis
YIEYCFKSSVVPAKKVIT

SEQ ID NO: 2187056 - protein, 17 aa, Cryptosporidium hominis
YIKPIFKAERTTLILRD

SEQ ID NO: 2187057 - protein, 24 aa, Cryptosporidium hominis
YIQNYRVGLKILKKRAALNNEEKM

SEQ ID NO: 2187058 - protein, 17 aa, Cryptosporidium hominis
YIVKCILEGSSMRKEDH

SEQ ID NO: 2187059 - protein, 19 aa, Cryptosporidium hominis
YKDSICWATIKAVKEVYEP

SEQ ID NO: 2187060 - protein, 25 aa, Cryptosporidium hominis
YKKKRFRFNFGIIILHFILANIKNG

SEQ ID NO: 2187061 - protein, 23 aa, Cryptosporidium hominis
YKKNLIWDGPRWDLAHFDPTMSA

SEQ ID NO: 2187062 - protein, 17 aa, Cryptosporidium hominis
YKLDEEHGWYVGDNSVW

SEQ ID NO: 2187063 - protein, 25 aa, Cryptosporidium hominis
YKRIPLKNIWFIFKRIYSMKPNSVE

SEQ ID NO: 2187064 - protein, 17 aa, Cryptosporidium hominis
YKSIPIVGSIRYKKQKI

SEQ ID NO: 2187065 - protein, 17 aa, Cryptosporidium hominis
YKYLPPRIQTVLVSATL

SEQ ID NO: 2187066 - protein, 20 aa, Cryptosporidium hominis
YKYPRSCIGSRRFSRYNFEI

SEQ ID NO: 2187067 - protein, 19 aa, Cryptosporidium hominis
YKYTLGFKRILRLVYYFKG

SEQ ID NO: 2187068 - protein, 19 aa, Cryptosporidium hominis
YLFNPCWTFTLSSKTDIFD

SEQ ID NO: 2187069 - protein, 17 aa, Cryptosporidium hominis
YLGIPIWRFYGRCTQCG

SEQ ID NO: 2187070 - protein, 21 aa, Cryptosporidium hominis
YLKKWSPVIGRGWQSRYFALL

SEQ ID NO: 2187071 - protein, 18 aa, Cryptosporidium hominis
YLSSFILELCIDDILTSL

SEQ ID NO: 2187072 - protein, 17 aa, Cryptosporidium hominis
YLYRLIIVIAEISLVLC

SEQ ID NO: 2187073 - protein, 22 aa, Cryptosporidium hominis
YMIFCGLKILYLLLNTTDISFF

SEQ ID NO: 2187074 - protein, 17 aa, Cryptosporidium hominis
YMKRSLDSFAFPITSEK

SEQ ID NO: 2187075 - protein, 17 aa, Cryptosporidium hominis
YMNILKLFGAINRLERD

SEQ ID NO: 2187076 - protein, 17 aa, Cryptosporidium hominis
YMSMSGFIPQFIQASKY

SEQ ID NO: 2187077 - protein, 18 aa, Cryptosporidium hominis
YNDLKILRFHDGISGKTY

SEQ ID NO: 2187078 - protein, 20 aa, Cryptosporidium hominis
YNGKQRWRVVTVNGELIDSS

SEQ ID NO: 2187079 - protein, 17 aa, Cryptosporidium hominis
YNILKGFQIYIIGYSKT

SEQ ID NO: 2187080 - protein, 20 aa, Cryptosporidium hominis
YNLWSNRAWLLEFIVNLKNA

SEQ ID NO: 2187081 - protein, 23 aa, Cryptosporidium hominis
YNNRVFKEWKEIIIPLLPLILTY

SEQ ID NO: 2187082 - protein, 18 aa, Cryptosporidium hominis
YNRIELIMFKNEIKQLLN

SEQ ID NO: 2187083 - protein, 19 aa, Cryptosporidium hominis
YPIVLIIGWCEKIDMLIKL

SEQ ID NO: 2187084 - protein, 23 aa, Cryptosporidium hominis
YPLECLRRSAAVFYFTSEPKSRG

SEQ ID NO: 2187085 - protein, 22 aa, Cryptosporidium hominis
YPMNSLRVGLFMTLKISTVNLF

SEQ ID NO: 2187086 - protein, 17 aa, Cryptosporidium hominis
YQDREMYLQHELELKEN

SEQ ID NO: 2187087 - protein, 18 aa, Cryptosporidium hominis
YQIVNSWNKLKFFLVNGY

SEQ ID NO: 2187088 - protein, 17 aa, Cryptosporidium hominis
YQKLRTPFWIWLSVNDE

SEQ ID NO: 2187089 - protein, 21 aa, Cryptosporidium hominis
YQPLVYWRVYKGLSPSISFPS

SEQ ID NO: 2187090 - protein, 22 aa, Cryptosporidium hominis
YRAEILDILSYCRLIIDETADD

SEQ ID NO: 2187091 - protein, 18 aa, Cryptosporidium hominis
YRDIKGLHLVLSPKSTLG

SEQ ID NO: 2187092 - protein, 20 aa, Cryptosporidium hominis
YRHIKRKNACIQICKALRRY

SEQ ID NO: 2187093 - protein, 17 aa, Cryptosporidium hominis
YRHSWVFPPDFPCFDAI

SEQ ID NO: 2187094 - protein, 19 aa, Cryptosporidium hominis
YRKGACTNCGSMTHQARDC

SEQ ID NO: 2187095 - protein, 19 aa, Cryptosporidium hominis
YRNPISFNYQCYNSLVYPI

SEQ ID NO: 2187096 - protein, 20 aa, Cryptosporidium hominis
YRTSSPYAFSPLEEERANKL

SEQ ID NO: 2187097 - protein, 17 aa, Cryptosporidium hominis
YRWSNNEIFVFKVQDTS

SEQ ID NO: 2187098 - protein, 19 aa, Cryptosporidium hominis
YRYKYRIMRQVRMCKDIKH

SEQ ID NO: 2187099 - protein, 18 aa, Cryptosporidium hominis
YRYLMVYNYLHIIGSIYR

SEQ ID NO: 2187100 - protein, 18 aa, Cryptosporidium hominis
YRYQCLRCFQMFGRQTKI

SEQ ID NO: 2187101 - protein, 18 aa, Cryptosporidium hominis
YSCLKRGGKVLIPVFAIG

SEQ ID NO: 2187102 - protein, 19 aa, Cryptosporidium hominis
YSDTGKMRGFAMVEFENDE

SEQ ID NO: 2187103 - protein, 22 aa, Cryptosporidium hominis
YSEKFGLWSFELYKNSNACITK

SEQ ID NO: 2187104 - protein, 17 aa, Cryptosporidium hominis
YSFLCGFVNLMRFKEDR

SEQ ID NO: 2187105 - protein, 17 aa, Cryptosporidium hominis
YSLRPSEVASMFPQQHI

SEQ ID NO: 2187106 - protein, 19 aa, Cryptosporidium hominis
YSRCCISPMAAFLGGIAAQ

SEQ ID NO: 2187107 - protein, 22 aa, Cryptosporidium hominis
YSVDGADAFEFLNILKASKPSD

SEQ ID NO: 2187108 - protein, 19 aa, Cryptosporidium hominis
YTIDLCLFLGLKMTTLTSK

SEQ ID NO: 2187109 - protein, 20 aa, Cryptosporidium hominis
YTNFFWKIRENLLKNSRLIR

SEQ ID NO: 2187110 - protein, 17 aa, Cryptosporidium hominis
YTNMTFPTIEVWCPGLN

SEQ ID NO: 2187111 - protein, 17 aa, Cryptosporidium hominis
YTSRFFIDSGLFKKIGG

SEQ ID NO: 2187112 - protein, 24 aa, Cryptosporidium hominis
YVDMMPKVLFCRGHLVEMILSCNI

SEQ ID NO: 2187113 - protein, 18 aa, Cryptosporidium hominis
YVPDLSLSIRNLYIRYED

SEQ ID NO: 2187114 - protein, 20 aa, Cryptosporidium hominis
YVRDILKFILNEESISNEKL

SEQ ID NO: 2187115 - protein, 21 aa, Cryptosporidium hominis
YWRRMQIRFPIFFGGSMTEKA

SEQ ID NO: 2187116 - protein, 26 aa, Cryptosporidium hominis
YYDRFSLRLPIIMLFESLLKVDLHRE

SEQ ID NO: 2187117 - protein, 18 aa, Cryptosporidium hominis
YYEGFKLPLGDLGRKMLL

SEQ ID NO: 2187118 - protein, 18 aa, Cryptosporidium hominis
YYLFLTWNNCILGYIPIN

SEQ ID NO: 2187119 - protein, 19 aa, Cryptosporidium hominis
YYLSAGIALRFISNIKNLY

SEQ ID NO: 2187120 - protein, 23 aa, Cryptosporidium hominis
YYNKELKSWVVRGEEHLVEQKQN

SEQ ID NO: 2187121 - protein, 21 aa, Cryptosporidium hominis
DAPVAPLKKDAPAAPAAPPAK

SEQ ID NO: 2187122 - protein, 20 aa, Cryptosporidium hominis
DAPVAPLKKDAPAASVAPPA

SEQ ID NO: 2187123 - protein, 26 aa, Cryptosporidium hominis
IQKESTLHLVLRLRGGMQIFVKTLTG

SEQ ID NO: 2187124 - protein, 34 aa, Cryptosporidium hominis
KEKEDPIAKLKAKVPVKPSPLLKSKSEKEKEKEE

SEQ ID NO: 2187125 - protein, 18 aa, Cryptosporidium hominis
LNKNLKHFVMFSSVASLL

SEQ ID NO: 2187126 - protein, 29 aa, Cryptosporidium hominis
AAAAITANLMPRCIGMWKEYFTSDGKPYY

SEQ ID NO: 2187127 - protein, 24 aa, Cryptosporidium hominis
AAAMQQWALFQNSFPQNGGMLPSA

SEQ ID NO: 2187128 - protein, 46 aa, Cryptosporidium hominis
AAANPYNYAYLNYAGYTANFPYMVGNTAAFGFPHYSTKPNGHHHPT

SEQ ID NO: 2187129 - protein, 29 aa, Cryptosporidium hominis
AAASSDAIIYIWSFKHRKLINKLVGHKGA

SEQ ID NO: 2187130 - protein, 26 aa, Cryptosporidium hominis
AAAVYSRYFFDSQPAKLFLTDVSSLS

SEQ ID NO: 2187131 - protein, 20 aa, Cryptosporidium hominis
AAEFIIFNTLVKVSIERNIS

SEQ ID NO: 2187132 - protein, 25 aa, Cryptosporidium hominis
AAFDCRGINLTKWNPSFGYNVISNS

SEQ ID NO: 2187133 - protein, 26 aa, Cryptosporidium hominis
AAHQMGLPFHLAALSSIAGGIPIDPS

SEQ ID NO: 2187134 - protein, 21 aa, Cryptosporidium hominis
AAHVFSDIYSVWICGFRSVEP

SEQ ID NO: 2187135 - protein, 26 aa, Cryptosporidium hominis
AAIPLPIVKKFLGNHLFIFSSTINGY

SEQ ID NO: 2187136 - protein, 19 aa, Cryptosporidium hominis
AALLNYYYANKYEGKLLLR

SEQ ID NO: 2187137 - protein, 27 aa, Cryptosporidium hominis
AALRDIRNLFPIYRNPLYAGFGNRDTD

SEQ ID NO: 2187138 - protein, 19 aa, Cryptosporidium hominis
AAMIGIPMFGARLNAQLFI

SEQ ID NO: 2187139 - protein, 29 aa, Cryptosporidium hominis
AAMIVLTDWFNGKIPYYNFPPQDNSHQNQ

SEQ ID NO: 2187140 - protein, 30 aa, Cryptosporidium hominis
AAPIREMPIPFFTASLPLIGQLAANAFPMI

SEQ ID NO: 2187141 - protein, 29 aa, Cryptosporidium hominis
AAPRVFYKPKFGWRFFPPNVPDFSRLLVL

SEQ ID NO: 2187142 - protein, 27 aa, Cryptosporidium hominis
AAPSYSGLPAPVLPPHHAPPLIATHQL

SEQ ID NO: 2187143 - protein, 20 aa, Cryptosporidium hominis
AAPTNLTDALMASPIVLGEG

SEQ ID NO: 2187144 - protein, 17 aa, Cryptosporidium hominis
AAPTVGILCKEGVILGA

SEQ ID NO: 2187145 - protein, 32 aa, Cryptosporidium hominis
AAQLYKFPVTKTLNLAYKKPILPGQTIVIISR

SEQ ID NO: 2187146 - protein, 17 aa, Cryptosporidium hominis
AARRALLEVIRGELLLV

SEQ ID NO: 2187147 - protein, 23 aa, Cryptosporidium hominis
AASMIFYNSFLQVLETHVKLIIQ

SEQ ID NO: 2187148 - protein, 32 aa, Cryptosporidium hominis
AATITFICPTKDSELIWLDSIHNHTKKKPLKY

SEQ ID NO: 2187149 - protein, 24 aa, Cryptosporidium hominis
AATKSFYYALYFARSNFSNEMERN

SEQ ID NO: 2187150 - protein, 20 aa, Cryptosporidium hominis
AAYKTAFWNGIDWTASSFAE

SEQ ID NO: 2187151 - protein, 28 aa, Cryptosporidium hominis
ACAPAIFNYQIPYFQPYSLRSYEISTLN

SEQ ID NO: 2187152 - protein, 18 aa, Cryptosporidium hominis
ACDYLLSKDTTHIILVSE

SEQ ID NO: 2187153 - protein, 22 aa, Cryptosporidium hominis
ACKKFVSFVKLLVNVLKAKNTF

SEQ ID NO: 2187154 - protein, 32 aa, Cryptosporidium hominis
ACNNLAPHNLRILRWTIFKSNRLPIGKYVCVI

SEQ ID NO: 2187155 - protein, 23 aa, Cryptosporidium hominis
ACNRALLKGWPIGMEALNGNWDL

SEQ ID NO: 2187156 - protein, 25 aa, Cryptosporidium hominis
ACNSGGPFLFIRIDGKTPGNKREEY

SEQ ID NO: 2187157 - protein, 17 aa, Cryptosporidium hominis
ACREKAYLYLKYLVQQK

SEQ ID NO: 2187158 - protein, 31 aa, Cryptosporidium hominis
ACRHIFPLQHVFIRKVKVLSKPSFDVSRLME

SEQ ID NO: 2187159 - protein, 24 aa, Cryptosporidium hominis
ADALQRFCSFILPMLDEKGTHTGE

SEQ ID NO: 2187160 - protein, 28 aa, Cryptosporidium hominis
ADDSRFDPIKYSDSLPYALPLAGTKAQT

SEQ ID NO: 2187161 - protein, 19 aa, Cryptosporidium hominis
ADDTPLCAQYFLGFCKYGP

SEQ ID NO: 2187162 - protein, 26 aa, Cryptosporidium hominis
ADDVGTIIIIEIYPKGEANDPLNITY

SEQ ID NO: 2187163 - protein, 35 aa, Cryptosporidium hominis
ADEFIHIWEITREAEWKLKILSRLLGHEKEVNCIR

SEQ ID NO: 2187164 - protein, 21 aa, Cryptosporidium hominis
ADFGLLIFVLSAIHPKHHQDV

SEQ ID NO: 2187165 - protein, 23 aa, Cryptosporidium hominis
ADGSTVLIKKRGLLGSLKEENVK

SEQ ID NO: 2187166 - protein, 21 aa, Cryptosporidium hominis
ADIITFKRFGFSDNAWFDMED

SEQ ID NO: 2187167 - protein, 20 aa, Cryptosporidium hominis
ADIKAICTEAGLLALRERRM

SEQ ID NO: 2187168 - protein, 23 aa, Cryptosporidium hominis
ADLINYILGVLEHLTRKIEQECT

SEQ ID NO: 2187169 - protein, 21 aa, Cryptosporidium hominis
ADLLNELAAMHYEWALDNYAK

SEQ ID NO: 2187170 - protein, 23 aa, Cryptosporidium hominis
ADLSQLIREATLKALDKLRTNDS

SEQ ID NO: 2187171 - protein, 25 aa, Cryptosporidium hominis
ADNARQILVFELKSLQKLFIEDKKE

SEQ ID NO: 2187172 - protein, 25 aa, Cryptosporidium hominis
ADRGWSDFFSLKTLLDPKTGFIDSE

SEQ ID NO: 2187173 - protein, 22 aa, Cryptosporidium hominis
ADSRNFLTKKLLARAQSQIDNP

SEQ ID NO: 2187174 - protein, 19 aa, Cryptosporidium hominis
ADWSYIKYCSVLNSKLYSN

SEQ ID NO: 2187175 - protein, 28 aa, Cryptosporidium hominis
AEANLRKNAMAMPPLNLKSINDLEGSSE

SEQ ID NO: 2187176 - protein, 20 aa, Cryptosporidium hominis
AEDPFSVFGLVLVPSRELSY

SEQ ID NO: 2187177 - protein, 26 aa, Cryptosporidium hominis
AEDRTQLYYFVKWLSCPYDQCTWESY

SEQ ID NO: 2187178 - protein, 25 aa, Cryptosporidium hominis
AEELLARLDPLGYFPEIRAFVALDL

SEQ ID NO: 2187179 - protein, 28 aa, Cryptosporidium hominis
AEGEIEFKSLLFIPSHPPFDMFDTYMGK

SEQ ID NO: 2187180 - protein, 26 aa, Cryptosporidium hominis
AEGHRVLIFSQFIQTLTLLEELVEHH

SEQ ID NO: 2187181 - protein, 22 aa, Cryptosporidium hominis
AEGILENPWLFQGFKTPEAINN

SEQ ID NO: 2187182 - protein, 18 aa, Cryptosporidium hominis
AEIITILHPYLRSDFREI

SEQ ID NO: 2187183 - protein, 27 aa, Cryptosporidium hominis
AEIPPKYILNFPIKNPLFITSNIKSDL

SEQ ID NO: 2187184 - protein, 23 aa, Cryptosporidium hominis
AEIRRECLKSYFFGTPEFPLKPH

SEQ ID NO: 2187185 - protein, 34 aa, Cryptosporidium hominis
AEKAAIRFLLINSPLHRRSHLKHFRFSESDEEGE

SEQ ID NO: 2187186 - protein, 20 aa, Cryptosporidium hominis
AEMPADSGYPAYLGARLASF

SEQ ID NO: 2187187 - protein, 25 aa, Cryptosporidium hominis
AEMRKYKSLQTKRRLSKRISVLSKF

SEQ ID NO: 2187188 - protein, 22 aa, Cryptosporidium hominis
AENALNHRWLRTSFAKQGIQTS

SEQ ID NO: 2187189 - protein, 26 aa, Cryptosporidium hominis
AENCQLPVFITLRAPGSPLIISIGQR

SEQ ID NO: 2187190 - protein, 24 aa, Cryptosporidium hominis
AENIISPLQLLTHPFRNKEVIDLW

SEQ ID NO: 2187191 - protein, 23 aa, Cryptosporidium hominis
AENLTLERLLYEYLINNGDVIVW

SEQ ID NO: 2187192 - protein, 27 aa, Cryptosporidium hominis
AESATTSFFRRLDWSPKGEMLVVPTGQ

SEQ ID NO: 2187193 - protein, 27 aa, Cryptosporidium hominis
AESNQRKIIEFKGIKIQRAINSANKIK

SEQ ID NO: 2187194 - protein, 26 aa, Cryptosporidium hominis
AESNYSPYYFILSTIYLLDDFQETHS

SEQ ID NO: 2187195 - protein, 26 aa, Cryptosporidium hominis
AESSIIYYLGHLALAKQCYRGMMGVQ

SEQ ID NO: 2187196 - protein, 24 aa, Cryptosporidium hominis
AESTKPFGGRFGATGFGSRGGRGG

SEQ ID NO: 2187197 - protein, 30 aa, Cryptosporidium hominis
AESVLSSQFLLSKLPFPNYGTFLGKETAEY

SEQ ID NO: 2187198 - protein, 24 aa, Cryptosporidium hominis
AETSIPGQWFKAIPSSLNPFQMIC

SEQ ID NO: 2187199 - protein, 21 aa, Cryptosporidium hominis
AETVLTGGSLFEPSEKKEDDN

SEQ ID NO: 2187200 - protein, 24 aa, Cryptosporidium hominis
AEWNPMNPSLIWRKNKENDDASTI

SEQ ID NO: 2187201 - protein, 34 aa, Cryptosporidium hominis
AEWVDKNTIWDVRKGPFKTVFVSESIKDLDYTSD

SEQ ID NO: 2187202 - protein, 18 aa, Cryptosporidium hominis
AEYESRKKDIFSRGVVSG

SEQ ID NO: 2187203 - protein, 18 aa, Cryptosporidium hominis
AEYILPALISLFNDVQKS

SEQ ID NO: 2187204 - protein, 20 aa, Cryptosporidium hominis
AEYNPLIKFLQEKNIRIKNL

SEQ ID NO: 2187205 - protein, 18 aa, Cryptosporidium hominis
AEYNSTIGHILMVMNAKE

SEQ ID NO: 2187206 - protein, 24 aa, Cryptosporidium hominis
AFAYQIMFEFDPIKWCSKGIATGM

SEQ ID NO: 2187207 - protein, 24 aa, Cryptosporidium hominis
AFGIKSPWRIVRSRFYVTSASHIQ

SEQ ID NO: 2187208 - protein, 26 aa, Cryptosporidium hominis
AFITKLQNILIYWTNLIHEYETEKKE

SEQ ID NO: 2187209 - protein, 17 aa, Cryptosporidium hominis
AFITYYDELSATKAIKN

SEQ ID NO: 2187210 - protein, 19 aa, Cryptosporidium hominis
AFKGDPDRILLILNQMERL

SEQ ID NO: 2187211 - protein, 33 aa, Cryptosporidium hominis
AFKRLAFKRFKSVPLYIEWAPVNLFVSETETQK

SEQ ID NO: 2187212 - protein, 26 aa, Cryptosporidium hominis
AFLDNCIFGLVYIKRSNPIIPSLQSN

SEQ ID NO: 2187213 - protein, 28 aa, Cryptosporidium hominis
AFNKEEILFVYIFSLLTGTCLCGENQIS

SEQ ID NO: 2187214 - protein, 25 aa, Cryptosporidium hominis
AFNNFENFEWAFASPPWGGYSYNGF

SEQ ID NO: 2187215 - protein, 27 aa, Cryptosporidium hominis
AFNQIRKTEIFWKFFLENLKGDMMNKT

SEQ ID NO: 2187216 - protein, 26 aa, Cryptosporidium hominis
AFPHCDAYMLSWSYRKTRIIVEILSH

SEQ ID NO: 2187217 - protein, 27 aa, Cryptosporidium hominis
AFPSGRIILDYIISKFPNTLGTAIKKA

SEQ ID NO: 2187218 - protein, 26 aa, Cryptosporidium hominis
AFQRRKLLAFITWRLTTNRSSHQISD

SEQ ID NO: 2187219 - protein, 25 aa, Cryptosporidium hominis
AFTYNEIMVVILFSPELDLNSIDNN

SEQ ID NO: 2187220 - protein, 17 aa, Cryptosporidium hominis
AFVSVRHTLAKYCDRQA

SEQ ID NO: 2187221 - protein, 33 aa, Cryptosporidium hominis
AFVSYIRAYKEYQLPFIFPFKSLSIGEIAASFA

SEQ ID NO: 2187222 - protein, 19 aa, Cryptosporidium hominis
AGDGLYEGLDWLARNLEKA

SEQ ID NO: 2187223 - protein, 25 aa, Cryptosporidium hominis
AGESKLFATILWLSNFVNAHSHNIN

SEQ ID NO: 2187224 - protein, 28 aa, Cryptosporidium hominis
AGETKIWQYIHLTHRIYLIDCPGIVPPE

SEQ ID NO: 2187225 - protein, 21 aa, Cryptosporidium hominis
AGFITFTCKILGVKKSYSYNM

SEQ ID NO: 2187226 - protein, 25 aa, Cryptosporidium hominis
AGGLHPGFQPVLHHLQQQLQLQQIQ

SEQ ID NO: 2187227 - protein, 22 aa, Cryptosporidium hominis
AGGNLPPPIYYSHNLNPTNSIV

SEQ ID NO: 2187228 - protein, 32 aa, Cryptosporidium hominis
AGGSTMFPGLGDRLLFELRKALPKDVKIRINA

SEQ ID NO: 2187229 - protein, 26 aa, Cryptosporidium hominis
AGGSVEPYFPGLFAQALSTTNVSDIV

SEQ ID NO: 2187230 - protein, 27 aa, Cryptosporidium hominis
AGINWSQYLVFKRLNIKIIYYCTSNYS

SEQ ID NO: 2187231 - protein, 29 aa, Cryptosporidium hominis
AGKETLYIEFLMNLLTLPIKSNFGQRSQL

SEQ ID NO: 2187232 - protein, 24 aa, Cryptosporidium hominis
AGKPYSVALSFISSQATCCEICLP

SEQ ID NO: 2187233 - protein, 25 aa, Cryptosporidium hominis
AGMAFSMFLKPSRGWNAPPLKQQTI

SEQ ID NO: 2187234 - protein, 17 aa, Cryptosporidium hominis
AGQIWFPDSAYKTAQAI

SEQ ID NO: 2187235 - protein, 29 aa, Cryptosporidium hominis
AGQQILAYYLFIVLKFIIPINEIKKLINN

SEQ ID NO: 2187236 - protein, 26 aa, Cryptosporidium hominis
AGRKVCEMFKLSFLKSLLLTNIGVIL

SEQ ID NO: 2187237 - protein, 24 aa, Cryptosporidium hominis
AGSKARNFLQRFVRSLFLQTGYGS

SEQ ID NO: 2187238 - protein, 24 aa, Cryptosporidium hominis
AGVDLLFRLLQYCPKKRITALEAL

SEQ ID NO: 2187239 - protein, 31 aa, Cryptosporidium hominis
AGVLKGEIKDLLLLDVTPLSLGIETLGGVFT

SEQ ID NO: 2187240 - protein, 19 aa, Cryptosporidium hominis
AGYGLFRVTNSKLLSMDTD

SEQ ID NO: 2187241 - protein, 20 aa, Cryptosporidium hominis
AGYGYPFPGFQQYAPAPRFT

SEQ ID NO: 2187242 - protein, 28 aa, Cryptosporidium hominis
AGYPVRFPHFEFLLDYMILFSPCGQLSI

SEQ ID NO: 2187243 - protein, 17 aa, Cryptosporidium hominis
AHELALYSGLNLLVPGS

SEQ ID NO: 2187244 - protein, 18 aa, Cryptosporidium hominis
AHGEPYNYKRALCRHWMR

SEQ ID NO: 2187245 - protein, 32 aa, Cryptosporidium hominis
AHISRQYELIFDQITLIWPQKSSFLRHDPQQI

SEQ ID NO: 2187246 - protein, 40 aa, Cryptosporidium hominis
AHLSYLPMAHIFERLIVMNAYYLGIPIGIFSGSVTRLMSD

SEQ ID NO: 2187247 - protein, 22 aa, Cryptosporidium hominis
AHNDMIRCILPLENKLFSYPNH

SEQ ID NO: 2187248 - protein, 17 aa, Cryptosporidium hominis
AHQLILDGYQWSHNKNV

SEQ ID NO: 2187249 - protein, 25 aa, Cryptosporidium hominis
AHSEWVRDVAWRPSVDLLAETIASC

SEQ ID NO: 2187250 - protein, 35 aa, Cryptosporidium hominis
AHSFDFPIYTYVSSYFGVIFIITRGGILYIVEPTS

SEQ ID NO: 2187251 - protein, 17 aa, Cryptosporidium hominis
AHVLLAMNPYRNIPNLY

SEQ ID NO: 2187252 - protein, 17 aa, Cryptosporidium hominis
AIAKIFLAISEFEYIYN

SEQ ID NO: 2187253 - protein, 20 aa, Cryptosporidium hominis
AIDHGLYSHAFQIYKKFSFN

SEQ ID NO: 2187254 - protein, 19 aa, Cryptosporidium hominis
AIEAFANALRQIPTILLDN

SEQ ID NO: 2187255 - protein, 25 aa, Cryptosporidium hominis
AIEAYIFVGPIYYQKLKHMVLDKMH

SEQ ID NO: 2187256 - protein, 21 aa, Cryptosporidium hominis
AIEPSIAPPIPPIPTISSISS

SEQ ID NO: 2187257 - protein, 21 aa, Cryptosporidium hominis
AIERKYDISLFQRLQMSGQQV

SEQ ID NO: 2187258 - protein, 18 aa, Cryptosporidium hominis
AIFDLDDTLIPTDWIRDT

SEQ ID NO: 2187259 - protein, 36 aa, Cryptosporidium hominis
AIFHQNTISAFWHFLSLFIQFIFRTIYSFDENGVEN

SEQ ID NO: 2187260 - protein, 19 aa, Cryptosporidium hominis
AIGDLLKTTFGPKGMDKIL

SEQ ID NO: 2187261 - protein, 22 aa, Cryptosporidium hominis
AIGQPLLMRVYEDFFSMRGAKV

SEQ ID NO: 2187262 - protein, 19 aa, Cryptosporidium hominis
AIGVVNRVLPRKGVEVRLL

SEQ ID NO: 2187263 - protein, 23 aa, Cryptosporidium hominis
AIHTPLLLYKSGIGPLESLQNMN

SEQ ID NO: 2187264 - protein, 28 aa, Cryptosporidium hominis
AIHVMKMYWKPLMEWDLKCFVKILKQCP

SEQ ID NO: 2187265 - protein, 22 aa, Cryptosporidium hominis
AIHYFFFLELKIKRMYYKLLIR

SEQ ID NO: 2187266 - protein, 33 aa, Cryptosporidium hominis
AIIDKGTHYEFKFLDGLFVFDPSIKGKNESNSD

SEQ ID NO: 2187267 - protein, 26 aa, Cryptosporidium hominis
AIIGHLTLKFISVFFKPGWRESNFQE

SEQ ID NO: 2187268 - protein, 25 aa, Cryptosporidium hominis
AIKNLRKLYISDGEHFKKVAEKIKN

SEQ ID NO: 2187269 - protein, 31 aa, Cryptosporidium hominis
AILCGEEFWAWIMIWMRLNSLGVLDWQRNYN

SEQ ID NO: 2187270 - protein, 25 aa, Cryptosporidium hominis
AILFRPKMIIAGASGYPRMINFKRF

SEQ ID NO: 2187271 - protein, 27 aa, Cryptosporidium hominis
AILHNIKLILLFSKVTLLSGYLRSHKL

SEQ ID NO: 2187272 - protein, 32 aa, Cryptosporidium hominis
AILKNWLRKNIVVVRYLYLFEQFMNKDESSYT

SEQ ID NO: 2187273 - protein, 23 aa, Cryptosporidium hominis
AILPNYLDPVWQLNFDPIKHYTQ

SEQ ID NO: 2187274 - protein, 20 aa, Cryptosporidium hominis
AILVGVLAACGIEKIVSAKE

SEQ ID NO: 2187275 - protein, 19 aa, Cryptosporidium hominis
AILWEISQPSPFNPVEMDK

SEQ ID NO: 2187276 - protein, 21 aa, Cryptosporidium hominis
AILYKSPSLAFFLSSSCLTES

SEQ ID NO: 2187277 - protein, 25 aa, Cryptosporidium hominis
AINSKLKSMILKKAPPKMMSRADFV

SEQ ID NO: 2187278 - protein, 20 aa, Cryptosporidium hominis
AIPSHLRLDSLSLSCISTGL

SEQ ID NO: 2187279 - protein, 18 aa, Cryptosporidium hominis
AIQHIPYQIPVNVPYQQM

SEQ ID NO: 2187280 - protein, 38 aa, Cryptosporidium hominis
AIQHVTFRDLLALPKRPIMYFAKWKHLSFADNTWEHEV

SEQ ID NO: 2187281 - protein, 21 aa, Cryptosporidium hominis
AIRAKIFEYFLSNACITTVTT

SEQ ID NO: 2187282 - protein, 27 aa, Cryptosporidium hominis
AIRANPFLFSQYGLAPFTGLESNKSEE

SEQ ID NO: 2187283 - protein, 18 aa, Cryptosporidium hominis
AIRLVSLKCGLCARIDFS

SEQ ID NO: 2187284 - protein, 25 aa, Cryptosporidium hominis
AIRQYLKYYGIPISVSMDTLLRRSD

SEQ ID NO: 2187285 - protein, 20 aa, Cryptosporidium hominis
AISADWLILATDVDALFTKN

SEQ ID NO: 2187286 - protein, 22 aa, Cryptosporidium hominis
AISGFYYVRPFCSTKPLRVYCD

SEQ ID NO: 2187287 - protein, 26 aa, Cryptosporidium hominis
AISHSRFKVFSWNVLAEIYASQEAFP

SEQ ID NO: 2187288 - protein, 18 aa, Cryptosporidium hominis
AISPRVLPIPVKPIMFDI

SEQ ID NO: 2187289 - protein, 18 aa, Cryptosporidium hominis
AISYNRTNYGLLGILNVI

SEQ ID NO: 2187290 - protein, 27 aa, Cryptosporidium hominis
AIVDANFVLSMPRFLAAATGLDALTHA

SEQ ID NO: 2187291 - protein, 21 aa, Cryptosporidium hominis
AIVEEFNGFRLKLGSSSSIEW

SEQ ID NO: 2187292 - protein, 36 aa, Cryptosporidium hominis
AIVNKAPLTFIKELFRRNIDICLPKDSKFSSIIDFA

SEQ ID NO: 2187293 - protein, 17 aa, Cryptosporidium hominis
AIWDLERSLKIFSYQEN

SEQ ID NO: 2187294 - protein, 22 aa, Cryptosporidium hominis
AIYMDTIIVPALPRSLKTEDNL

SEQ ID NO: 2187295 - protein, 29 aa, Cryptosporidium hominis
AIYPEAVRMLLLFIYGHTTSLRGANPYLI

SEQ ID NO: 2187296 - protein, 36 aa, Cryptosporidium hominis
AKAIKIQRVWRYYYLRQIMIHYIRIATPARKIQSVW

SEQ ID NO: 2187297 - protein, 22 aa, Cryptosporidium hominis
AKCKFFSNYLPTCKKRNFNSDQ

SEQ ID NO: 2187298 - protein, 25 aa, Cryptosporidium hominis
AKDLIRKMLTFHPSLRITATQCLEH

SEQ ID NO: 2187299 - protein, 27 aa, Cryptosporidium hominis
AKDTRLELFPMLPKIFEALSIRLETPF

SEQ ID NO: 2187300 - protein, 26 aa, Cryptosporidium hominis
AKEIIKSIGLKPIYFDCIKNLLKHIE

SEQ ID NO: 2187301 - protein, 24 aa, Cryptosporidium hominis
AKELPLYCEFSPRSPLNFKDIFPN

SEQ ID NO: 2187302 - protein, 21 aa, Cryptosporidium hominis
AKELYKGFRNGLRSNCNIQNH

SEQ ID NO: 2187303 - protein, 23 aa, Cryptosporidium hominis
AKERLFISVPLNVGKPSPFIQDA

SEQ ID NO: 2187304 - protein, 28 aa, Cryptosporidium hominis
AKESILVPIYGLLVPFHVRLLKNVVCTQ

SEQ ID NO: 2187305 - protein, 32 aa, Cryptosporidium hominis
AKETPPPAEESSWFSGWFGTSAPEEPPKEEEK

SEQ ID NO: 2187306 - protein, 20 aa, Cryptosporidium hominis
AKFHLYMPELVYVQSIDTVL

SEQ ID NO: 2187307 - protein, 22 aa, Cryptosporidium hominis
AKHGNMPNLLLSGPPGTGKTTS

SEQ ID NO: 2187308 - protein, 27 aa, Cryptosporidium hominis
AKHLLINDQLPLVRFIDKSLKIGQKVT

SEQ ID NO: 2187309 - protein, 21 aa, Cryptosporidium hominis
AKIALLTCPFEPPKPKTKHKI

SEQ ID NO: 2187310 - protein, 17 aa, Cryptosporidium hominis
AKIFLAISEFEYIYNFK

SEQ ID NO: 2187311 - protein, 19 aa, Cryptosporidium hominis
AKILLLTTAYIRKNLINDD

SEQ ID NO: 2187312 - protein, 24 aa, Cryptosporidium hominis
AKIQRELGILNERLKRVSESLQRK

SEQ ID NO: 2187313 - protein, 24 aa, Cryptosporidium hominis
AKLDLFRMRFLGRNIKISYYCEHE

SEQ ID NO: 2187314 - protein, 25 aa, Cryptosporidium hominis
AKLGRGLLLDVIRQISAFGLSFMRL

SEQ ID NO: 2187315 - protein, 28 aa, Cryptosporidium hominis
AKLSSMHFYGWKKGLKTGIYYLRTQSAT

SEQ ID NO: 2187316 - protein, 20 aa, Cryptosporidium hominis
AKLVCFYCDLLLKNSYSEIG

SEQ ID NO: 2187317 - protein, 17 aa, Cryptosporidium hominis
AKMIILPTRESIIFPRK

SEQ ID NO: 2187318 - protein, 25 aa, Cryptosporidium hominis
AKNLDINLILFKNLQEKVSKKDKEI

SEQ ID NO: 2187319 - protein, 30 aa, Cryptosporidium hominis
AKNVLYDMMIWYFITYSPGEWSLKPFVVHK

SEQ ID NO: 2187320 - protein, 17 aa, Cryptosporidium hominis
AKQIPNIRAIFGETYPD

SEQ ID NO: 2187321 - protein, 26 aa, Cryptosporidium hominis
AKQYLSAGQYYYSKSRALWKITPGVN

SEQ ID NO: 2187322 - protein, 25 aa, Cryptosporidium hominis
AKSIVRELNLKPLFNKNNENRIDRH

SEQ ID NO: 2187323 - protein, 24 aa, Cryptosporidium hominis
AKSKLIFLIIYLNNLISYLNCERF

SEQ ID NO: 2187324 - protein, 17 aa, Cryptosporidium hominis
AKTPFLCTAIIVNNAEL

SEQ ID NO: 2187325 - protein, 25 aa, Cryptosporidium hominis
AKTYNGFSHFLYYSALHLTNTIMME

SEQ ID NO: 2187326 - protein, 26 aa, Cryptosporidium hominis
AKVKKKFDELFGSTRYSKALELITKL

SEQ ID NO: 2187327 - protein, 18 aa, Cryptosporidium hominis
AKYFCLTCEHNCFCEVCA

SEQ ID NO: 2187328 - protein, 19 aa, Cryptosporidium hominis
ALACSFSIIFDYDNLPQTA

SEQ ID NO: 2187329 - protein, 22 aa, Cryptosporidium hominis
ALATMNRFVLKGRPIRVGRPTN

SEQ ID NO: 2187330 - protein, 17 aa, Cryptosporidium hominis
ALCLKKIKGLNTVRLVD

SEQ ID NO: 2187331 - protein, 32 aa, Cryptosporidium hominis
ALDDLGSIRIDLWLELANFISTTTNCPHLLST

SEQ ID NO: 2187332 - protein, 19 aa, Cryptosporidium hominis
ALDITHSMVMFGSTSKVIG

SEQ ID NO: 2187333 - protein, 24 aa, Cryptosporidium hominis
ALDTNGLVWVWGQNNLKQLTGIPE

SEQ ID NO: 2187334 - protein, 25 aa, Cryptosporidium hominis
ALEHGLPPTGGWGLGIDRLIMFLAD

SEQ ID NO: 2187335 - protein, 25 aa, Cryptosporidium hominis
ALERGFLDMLGLGDKQIWSGSNYGG

SEQ ID NO: 2187336 - protein, 18 aa, Cryptosporidium hominis
ALGAYVFIADNCKELLDV

SEQ ID NO: 2187337 - protein, 20 aa, Cryptosporidium hominis
ALHGLPKFLINKARYIQAYF

SEQ ID NO: 2187338 - protein, 31 aa, Cryptosporidium hominis
ALHYASACGWLPTMKLLLKYNCDINRRDHKN

SEQ ID NO: 2187339 - protein, 28 aa, Cryptosporidium hominis
ALISYYIQHGILFKRLGIIVVDELHLLG

SEQ ID NO: 2187340 - protein, 26 aa, Cryptosporidium hominis
ALKEYFTEDILLKLVSMKLLEDLGEY

SEQ ID NO: 2187341 - protein, 25 aa, Cryptosporidium hominis
ALKHLKDLIPPSRLQNRPAATASST

SEQ ID NO: 2187342 - protein, 21 aa, Cryptosporidium hominis
ALKKNLLLIGSHRANALELVE

SEQ ID NO: 2187343 - protein, 26 aa, Cryptosporidium hominis
ALLRLNNLLSFKGNLLRIGKPKVSEN

SEQ ID NO: 2187344 - protein, 17 aa, Cryptosporidium hominis
ALMGLDWDNITADDIYV

SEQ ID NO: 2187345 - protein, 20 aa, Cryptosporidium hominis
ALMKLRNARQRKIKGMRLTP

SEQ ID NO: 2187346 - protein, 18 aa, Cryptosporidium hominis
ALNLIKFGGNIIISLKTA

SEQ ID NO: 2187347 - protein, 27 aa, Cryptosporidium hominis
ALNNINLCLNFILNPPEKSKLPEYLNG

SEQ ID NO: 2187348 - protein, 23 aa, Cryptosporidium hominis
ALQTPGLFDAKLINFTGSTNSSS

SEQ ID NO: 2187349 - protein, 23 aa, Cryptosporidium hominis
ALQTYRVVRKLACKTNLVVCALT

SEQ ID NO: 2187350 - protein, 20 aa, Cryptosporidium hominis
ALRALIISIFTKCKQLGYNQ

SEQ ID NO: 2187351 - protein, 17 aa, Cryptosporidium hominis
ALRWIMMDRIRESSYKL

SEQ ID NO: 2187352 - protein, 24 aa, Cryptosporidium hominis
ALSGTWDGKLILWLSLERSKKNSN

SEQ ID NO: 2187353 - protein, 23 aa, Cryptosporidium hominis
ALSKFSAYTFQQLRDAILDLDKK

SEQ ID NO: 2187354 - protein, 18 aa, Cryptosporidium hominis
ALSLSHSLGRFKLKFSPE

SEQ ID NO: 2187355 - protein, 19 aa, Cryptosporidium hominis
ALTRRSLGYAYVNYNSVAD

SEQ ID NO: 2187356 - protein, 19 aa, Cryptosporidium hominis
ALYAGRNLHQLPPGIAGYV

SEQ ID NO: 2187357 - protein, 25 aa, Cryptosporidium hominis
AMCFSPAFKLKFSHNAFVSLGSLLE

SEQ ID NO: 2187358 - protein, 21 aa, Cryptosporidium hominis
AMDGYKWWFEQNLVTVWSAPN

SEQ ID NO: 2187359 - protein, 20 aa, Cryptosporidium hominis
AMDRYGLLSDLQLGHSMRLR

SEQ ID NO: 2187360 - protein, 24 aa, Cryptosporidium hominis
AMGKLIKLRVLIVGLRGLGVEIAK

SEQ ID NO: 2187361 - protein, 18 aa, Cryptosporidium hominis
AMIMVILNGYESIYGPIV

SEQ ID NO: 2187362 - protein, 17 aa, Cryptosporidium hominis
AMLFKKIAEALKELCHD

SEQ ID NO: 2187363 - protein, 28 aa, Cryptosporidium hominis
AMLNDLKLLIGFLIKYPLNCLRSAESDS

SEQ ID NO: 2187364 - protein, 33 aa, Cryptosporidium hominis
AMQQQIQPIIHHPIIQHPISPEIQTLIQSPMIA

SEQ ID NO: 2187365 - protein, 19 aa, Cryptosporidium hominis
AMYESNSQPFIYYDIKSDQ

SEQ ID NO: 2187366 - protein, 20 aa, Cryptosporidium hominis
AMYSPILAGGYGIAGTTTGC

SEQ ID NO: 2187367 - protein, 20 aa, Cryptosporidium hominis
ANEIQKILSIPVFVNPDLCE

SEQ ID NO: 2187368 - protein, 18 aa, Cryptosporidium hominis
ANELNLKCRIGEGGYGKV

SEQ ID NO: 2187369 - protein, 25 aa, Cryptosporidium hominis
ANETGAFFFLINGPEVMSKMAGEAE

SEQ ID NO: 2187370 - protein, 29 aa, Cryptosporidium hominis
ANEYGNIYGIIFLFKFTEKFKGNHFSQPI

SEQ ID NO: 2187371 - protein, 18 aa, Cryptosporidium hominis
ANHRFEQELYRQKLQEEK

SEQ ID NO: 2187372 - protein, 34 aa, Cryptosporidium hominis
ANHSINALCFSPCNYWLCAATDKCIRIWELEHKL

SEQ ID NO: 2187373 - protein, 24 aa, Cryptosporidium hominis
ANIHHIPVMIVSESYKLCEKNYFE

SEQ ID NO: 2187374 - protein, 21 aa, Cryptosporidium hominis
ANIHILSLFEIIRELKLSECN

SEQ ID NO: 2187375 - protein, 24 aa, Cryptosporidium hominis
ANIHSLRSSFYRKLSDRLSLASEL

SEQ ID NO: 2187376 - protein, 25 aa, Cryptosporidium hominis
ANIIDDLPLYCQIPANIHILSLFEI

SEQ ID NO: 2187377 - protein, 24 aa, Cryptosporidium hominis
ANIPEMVPFVIYYCTNLGETDLLL

SEQ ID NO: 2187378 - protein, 39 aa, Cryptosporidium hominis
ANKFEGRPLYVVPLPLHGELHIALDNITPHWSRGGIITE

SEQ ID NO: 2187379 - protein, 22 aa, Cryptosporidium hominis
ANKQRELAEKKAQLAKAVKNPA

SEQ ID NO: 2187380 - protein, 18 aa, Cryptosporidium hominis
ANLFFPNFRIVSIKDNSS

SEQ ID NO: 2187381 - protein, 20 aa, Cryptosporidium hominis
ANLNIKWPPSLPNYTQKNLL

SEQ ID NO: 2187382 - protein, 23 aa, Cryptosporidium hominis
ANRVILYDPWWNPMTDVQAKERC

SEQ ID NO: 2187383 - protein, 23 aa, Cryptosporidium hominis
ANSELLKHIFIEGSPDHIPNSVD

SEQ ID NO: 2187384 - protein, 23 aa, Cryptosporidium hominis
ANSLYIGILDIYGFEKLEINSFE

SEQ ID NO: 2187385 - protein, 20 aa, Cryptosporidium hominis
ANTFYKFKLISPDTIKVLDN

SEQ ID NO: 2187386 - protein, 24 aa, Cryptosporidium hominis
ANTKLYQLITYLRKHGFKHIFEDN

SEQ ID NO: 2187387 - protein, 24 aa, Cryptosporidium hominis
ANYILLPEVIVCPSSIHDFNSNKS

SEQ ID NO: 2187388 - protein, 17 aa, Cryptosporidium hominis
APEIHRGEPYSLCVDLW

SEQ ID NO: 2187389 - protein, 20 aa, Cryptosporidium hominis
APGAHPPRPAIPPPHMYAPN

SEQ ID NO: 2187390 - protein, 18 aa, Cryptosporidium hominis
APHEILMFLQNDQSKISF

SEQ ID NO: 2187391 - protein, 20 aa, Cryptosporidium hominis
APKITWRRLLILKVVKIFQE

SEQ ID NO: 2187392 - protein, 24 aa, Cryptosporidium hominis
APKSQIPLYMTLNDAKFGNEEVAT

SEQ ID NO: 2187393 - protein, 18 aa, Cryptosporidium hominis
APKVLIFCETKRGADILT

SEQ ID NO: 2187394 - protein, 29 aa, Cryptosporidium hominis
APLNKTGWFLDYDLNPLNGFIALGTNSTS

SEQ ID NO: 2187395 - protein, 28 aa, Cryptosporidium hominis
APLNSLRVYQFLSYDERISGLGIGVHWE

SEQ ID NO: 2187396 - protein, 17 aa, Cryptosporidium hominis
APRHLLQSRTNHFPEEG

SEQ ID NO: 2187397 - protein, 24 aa, Cryptosporidium hominis
APSATFFLRIMLPEPKKLENNKNV

SEQ ID NO: 2187398 - protein, 26 aa, Cryptosporidium hominis
AQDKYIELAIGNAPWPMGVTMVGIHE

SEQ ID NO: 2187399 - protein, 31 aa, Cryptosporidium hominis
AQHAALIQGGLLPGLGIPITQPGVPGVPGVP

SEQ ID NO: 2187400 - protein, 20 aa, Cryptosporidium hominis
AQHFLVKAGISVIRRVRKSD

SEQ ID NO: 2187401 - protein, 18 aa, Cryptosporidium hominis
AQHSLLQKELLKAAVDMV

SEQ ID NO: 2187402 - protein, 24 aa, Cryptosporidium hominis
AQKCKEFGIHALHIKLRAVGGVKS

SEQ ID NO: 2187403 - protein, 19 aa, Cryptosporidium hominis
AQKTIFREILYTSLSSHPQ

SEQ ID NO: 2187404 - protein, 26 aa, Cryptosporidium hominis
AQLQDKKYHSFVQNTLADYQASAFDA

SEQ ID NO: 2187405 - protein, 29 aa, Cryptosporidium hominis
AQMSFINAPIIFWGLWQAISLVLPQSTRD

SEQ ID NO: 2187406 - protein, 19 aa, Cryptosporidium hominis
AQPFKNCKGILFAIQVCKA

SEQ ID NO: 2187407 - protein, 17 aa, Cryptosporidium hominis
AQPTIFLTPIFNKTMIT

SEQ ID NO: 2187408 - protein, 26 aa, Cryptosporidium hominis
AQTCVWLQYLFDSGKLVKPVIISCPA

SEQ ID NO: 2187409 - protein, 18 aa, Cryptosporidium hominis
ARCYILSARGLLPPSGDL

SEQ ID NO: 2187410 - protein, 22 aa, Cryptosporidium hominis
AREARRFTPGLTLTKICGSRWE

SEQ ID NO: 2187411 - protein, 32 aa, Cryptosporidium hominis
ARENDIGSIWLIREIYLSLTPQILKLSMSVDG

SEQ ID NO: 2187412 - protein, 21 aa, Cryptosporidium hominis
ARFEELCADYFRATLAPVEKV

SEQ ID NO: 2187413 - protein, 19 aa, Cryptosporidium hominis
ARFILKQVVVALIYMHQKE

SEQ ID NO: 2187414 - protein, 17 aa, Cryptosporidium hominis
ARFTLYDDNQELNQTIL

SEQ ID NO: 2187415 - protein, 33 aa, Cryptosporidium hominis
ARFVEALKSFRSLNPLLLFSGDVFNPSIMSVTT

SEQ ID NO: 2187416 - protein, 32 aa, Cryptosporidium hominis
ARGDTHYLLYIYDIMKNLLLLHRHKNTEPPVL

SEQ ID NO: 2187417 - protein, 31 aa, Cryptosporidium hominis
ARIVALNAHLFLKNNGYFIISIKASCVDSTA

SEQ ID NO: 2187418 - protein, 27 aa, Cryptosporidium hominis
ARKDFVHAFIVWFDIIFGCGHKPVTFT

SEQ ID NO: 2187419 - protein, 17 aa, Cryptosporidium hominis
ARKHLIMGLKGLTIRGE

SEQ ID NO: 2187420 - protein, 29 aa, Cryptosporidium hominis
ARKKLDGRLFCFLCTFKYKKLKHEEVKKT

SEQ ID NO: 2187421 - protein, 21 aa, Cryptosporidium hominis
ARKVLPTFPGIWVEAAKLEER

SEQ ID NO: 2187422 - protein, 22 aa, Cryptosporidium hominis
ARLLRDLFPVMMSRFIATFART

SEQ ID NO: 2187423 - protein, 19 aa, Cryptosporidium hominis
ARLNAQLFILSFDNSFNEL

SEQ ID NO: 2187424 - protein, 18 aa, Cryptosporidium hominis
ARLTGRVALIKIGGYSDT

SEQ ID NO: 2187425 - protein, 18 aa, Cryptosporidium hominis
ARLYFRIQDPIQLSSSGQ

SEQ ID NO: 2187426 - protein, 18 aa, Cryptosporidium hominis
ARNGHPLRKFGTGSIETL

SEQ ID NO: 2187427 - protein, 29 aa, Cryptosporidium hominis
ARNNRGTRYLNYKLLIRKIRWVSEQESQE

SEQ ID NO: 2187428 - protein, 28 aa, Cryptosporidium hominis
ARNNSPVCVPPIYNSFWNPSEFNAISKN

SEQ ID NO: 2187429 - protein, 27 aa, Cryptosporidium hominis
ARNTFNEDFRFCRMSKLYKYALRTKMS

SEQ ID NO: 2187430 - protein, 27 aa, Cryptosporidium hominis
ARPGPYAQGRYAPSGALPYSVPGAVPT

SEQ ID NO: 2187431 - protein, 21 aa, Cryptosporidium hominis
ARPNWICLGNYHISIHTNNAS

SEQ ID NO: 2187432 - protein, 63 aa, Cryptosporidium hominis
ARQNKKVVNLPREAPFIAKVTNLDYSLQLKDIQDFFKNNRIEDVKIKLPMRNGNNEGVAIVEF

SEQ ID NO: 2187433 - protein, 23 aa, Cryptosporidium hominis
ARRKGIILTTPPPLSPSKGIYDR

SEQ ID NO: 2187434 - protein, 22 aa, Cryptosporidium hominis
ARRLEQWLRQPLIDEKQIISRQ

SEQ ID NO: 2187435 - protein, 25 aa, Cryptosporidium hominis
ARRNITWPMLFQISNPTKNKFTHSG

SEQ ID NO: 2187436 - protein, 19 aa, Cryptosporidium hominis
ARSLGIPRIFIAANSGARM

SEQ ID NO: 2187437 - protein, 30 aa, Cryptosporidium hominis
ARSNYNFEKPFLWLARRLTNQPALQLVGQH

SEQ ID NO: 2187438 - protein, 21 aa, Cryptosporidium hominis
ARSTGWLKVIDTMFPELSNAL

SEQ ID NO: 2187439 - protein, 17 aa, Cryptosporidium hominis
ARSTLKRILLEGDGRHF

SEQ ID NO: 2187440 - protein, 30 aa, Cryptosporidium hominis
ARTQQQFEETLPLILDTMLQITIMDIEDTV

SEQ ID NO: 2187441 - protein, 23 aa, Cryptosporidium hominis
ARVKSLIGPNILLKVVLEIGEIN

SEQ ID NO: 2187442 - protein, 21 aa, Cryptosporidium hominis
ARVMVFLDSFDPYGSLCLERS

SEQ ID NO: 2187443 - protein, 23 aa, Cryptosporidium hominis
ARVYCENLCFLSKLFLDHKTLYN

SEQ ID NO: 2187444 - protein, 44 aa, Cryptosporidium hominis
ASAARYIFTKLSKWTRYIFPEADDPLLTYLYDDGQQIEPLYYVP

SEQ ID NO: 2187445 - protein, 27 aa, Cryptosporidium hominis
ASCLNPAKTLMYCFGEYGALEAEKHIR

SEQ ID NO: 2187446 - protein, 24 aa, Cryptosporidium hominis
ASDSKLRISIQRLLAGMTFELNSE

SEQ ID NO: 2187447 - protein, 32 aa, Cryptosporidium hominis
ASEQLIQDLLKYYPDFFYPTIHSLCRKYGSPR

SEQ ID NO: 2187448 - protein, 30 aa, Cryptosporidium hominis
ASESEFWHFLSLGAIFLKYSKKNSIAVELF

SEQ ID NO: 2187449 - protein, 24 aa, Cryptosporidium hominis
ASFDGKIRIWKSSDLKLLKTLSGP

SEQ ID NO: 2187450 - protein, 27 aa, Cryptosporidium hominis
ASFDKTIRLWDGHSGKFIAVLRGHVGP

SEQ ID NO: 2187451 - protein, 40 aa, Cryptosporidium hominis
ASFEDILVEVPIYIKYPVLSEAFLLDWITSDVLQSTIDYS

SEQ ID NO: 2187452 - protein, 21 aa, Cryptosporidium hominis
ASGYSFYYMKYNKLPDELDVA

SEQ ID NO: 2187453 - protein, 20 aa, Cryptosporidium hominis
ASHHFHPGYPGAPFPQTGPT

SEQ ID NO: 2187454 - protein, 24 aa, Cryptosporidium hominis
ASIANALRRILLVEIPTVAIETVQ

SEQ ID NO: 2187455 - protein, 26 aa, Cryptosporidium hominis
ASIIQPFFETMNIFILQFSSCCKEIR

SEQ ID NO: 2187456 - protein, 26 aa, Cryptosporidium hominis
ASIQNPILCFLISSLLPSLSTPIHWL

SEQ ID NO: 2187457 - protein, 21 aa, Cryptosporidium hominis
ASISYLISLKDKKLFKLLDEI

SEQ ID NO: 2187458 - protein, 24 aa, Cryptosporidium hominis
ASKDFTLKIWNITTGTIINTLSSH

SEQ ID NO: 2187459 - protein, 19 aa, Cryptosporidium hominis
ASKIASILQSLRPNSGSAT

SEQ ID NO: 2187460 - protein, 21 aa, Cryptosporidium hominis
ASKMLRGEIWFHNIGIEEICD

SEQ ID NO: 2187461 - protein, 25 aa, Cryptosporidium hominis
ASKVNPKIFIIPNALNQDECDEIIS

SEQ ID NO: 2187462 - protein, 22 aa, Cryptosporidium hominis
ASLLKILPRINPVYTIMSLGRY

SEQ ID NO: 2187463 - protein, 24 aa, Cryptosporidium hominis
ASMPKYWHFIRLMGRQPSNEVLEC

SEQ ID NO: 2187464 - protein, 33 aa, Cryptosporidium hominis
ASPSKKMHISPSRPIGLPPPLPYNTINNRESGN

SEQ ID NO: 2187465 - protein, 30 aa, Cryptosporidium hominis
ASQAVLLQKLNIKPFSYGLKVNNIYDHGSV

SEQ ID NO: 2187466 - protein, 38 aa, Cryptosporidium hominis
ASQLLQQFDWIFKINKLPLWLHPYEILVIGSHGGFIEY

SEQ ID NO: 2187467 - protein, 27 aa, Cryptosporidium hominis
ASQSLQIPVFLKYLPSIVLDSELHPHL

SEQ ID NO: 2187468 - protein, 24 aa, Cryptosporidium hominis
ASRWLKYTFLVTRVKKSPIVYGFK

SEQ ID NO: 2187469 - protein, 31 aa, Cryptosporidium hominis
ASSEIFFLISDFKVLLDRFLHSFNLMELQQY

SEQ ID NO: 2187470 - protein, 22 aa, Cryptosporidium hominis
ASSFTLLYTFESSENYVIGVAW

SEQ ID NO: 2187471 - protein, 24 aa, Cryptosporidium hominis
ASSMGLDMLLMPPTVEMEQNDSNH

SEQ ID NO: 2187472 - protein, 23 aa, Cryptosporidium hominis
ASSNEEWLLYELITRHFLSSCSE

SEQ ID NO: 2187473 - protein, 29 aa, Cryptosporidium hominis
ASSPLDPNSFIPKVPIPSSFFSNISQNKI

SEQ ID NO: 2187474 - protein, 24 aa, Cryptosporidium hominis
ASTDFSLQTALFFACRDGNVKTAE

SEQ ID NO: 2187475 - protein, 29 aa, Cryptosporidium hominis
ASTGNHFKPINGFVFDKTSKDLKEVSELH

SEQ ID NO: 2187476 - protein, 25 aa, Cryptosporidium hominis
ASTLYPSFGYLYPEGTEQIRKAWND

SEQ ID NO: 2187477 - protein, 20 aa, Cryptosporidium hominis
ASTNLWLNLSDGFIGCGRRL

SEQ ID NO: 2187478 - protein, 30 aa, Cryptosporidium hominis
ASTPSILGVLLKYFDVSWPSHIFESLLKSD

SEQ ID NO: 2187479 - protein, 49 aa, Cryptosporidium hominis
ASTQDFPLMIYGVNLVRPIRKLSGFKLGFHLKPLLFRISKLVNSSEISV

SEQ ID NO: 2187480 - protein, 26 aa, Cryptosporidium hominis
ASTSEIRKSYRKLALKWHPDKNPDNR

SEQ ID NO: 2187481 - protein, 30 aa, Cryptosporidium hominis
ASVIVSYLRKMQITATLIFTLNQIGLDNNI

SEQ ID NO: 2187482 - protein, 21 aa, Cryptosporidium hominis
ASVLWSLRSILINNVNKYHKE

SEQ ID NO: 2187483 - protein, 18 aa, Cryptosporidium hominis
ASYGLLSAIFKKLADDIS

SEQ ID NO: 2187484 - protein, 28 aa, Cryptosporidium hominis
ASYKERFPMWSLPNIINLLKSEKYAHEI

SEQ ID NO: 2187485 - protein, 26 aa, Cryptosporidium hominis
ATCDLEFCVELFWLLISEISIQEYPK

SEQ ID NO: 2187486 - protein, 19 aa, Cryptosporidium hominis
ATCLLIKELKEPIRDRKKV

SEQ ID NO: 2187487 - protein, 26 aa, Cryptosporidium hominis
ATESNSLYIWIFSHENIKSNELNQKT

SEQ ID NO: 2187488 - protein, 27 aa, Cryptosporidium hominis
ATETLKVAILLFLTEFKRKIVALNYPK

SEQ ID NO: 2187489 - protein, 20 aa, Cryptosporidium hominis
ATFFSTHPVYRNLSPELVGT

SEQ ID NO: 2187490 - protein, 23 aa, Cryptosporidium hominis
ATKNLILKYPTKHKNILSFLATN

SEQ ID NO: 2187491 - protein, 18 aa, Cryptosporidium hominis
ATLALMDLAFRKNKNERV

SEQ ID NO: 2187492 - protein, 34 aa, Cryptosporidium hominis
ATLISHWIEVFNKWYYPIRIILFHGKGESERRTL

SEQ ID NO: 2187493 - protein, 22 aa, Cryptosporidium hominis
ATNLPILRDSILNENTPALKTE

SEQ ID NO: 2187494 - protein, 24 aa, Cryptosporidium hominis
ATPGRLFHHIIEAGLSLIAVKIII

SEQ ID NO: 2187495 - protein, 19 aa, Cryptosporidium hominis
ATQAILSIILNRLDIDIGS

SEQ ID NO: 2187496 - protein, 24 aa, Cryptosporidium hominis
ATQDFLLGMYVLTGRDIFLTRDQF

SEQ ID NO: 2187497 - protein, 18 aa, Cryptosporidium hominis
ATQPHYLANLPSFSKITY

SEQ ID NO: 2187498 - protein, 24 aa, Cryptosporidium hominis
ATRCKIILGCRDLMFPPLNLQDRE

SEQ ID NO: 2187499 - protein, 20 aa, Cryptosporidium hominis
ATRLQEMWDRVVAGESIING

SEQ ID NO: 2187500 - protein, 30 aa, Cryptosporidium hominis
ATSCIYINPKWSKGYYRCSQVYHMIGDVAN

SEQ ID NO: 2187501 - protein, 26 aa, Cryptosporidium hominis
ATSISKLFVKPIKLEFEKVYCPFLLM

SEQ ID NO: 2187502 - protein, 23 aa, Cryptosporidium hominis
ATTISFYGLTLTGTTTEILLPKD

SEQ ID NO: 2187503 - protein, 29 aa, Cryptosporidium hominis
AVADLILKKVLSVDLSLPPTVTHLAKIGK

SEQ ID NO: 2187504 - protein, 24 aa, Cryptosporidium hominis
AVAQKKYIYIYDREGIEIHCIRDH

SEQ ID NO: 2187505 - protein, 26 aa, Cryptosporidium hominis
AVAVFVPYAIFMAYVRKIQGRIIAEL

SEQ ID NO: 2187506 - protein, 24 aa, Cryptosporidium hominis
AVCGWNIKFPTFSLSTQNSMVGNV

SEQ ID NO: 2187507 - protein, 17 aa, Cryptosporidium hominis
AVDMWSIGCIFAELLTG

SEQ ID NO: 2187508 - protein, 24 aa, Cryptosporidium hominis
AVELQLLFPLVRVNFELGVIMVIA

SEQ ID NO: 2187509 - protein, 22 aa, Cryptosporidium hominis
AVFLVLDWILNERLDVPYISLH

SEQ ID NO: 2187510 - protein, 35 aa, Cryptosporidium hominis
AVKKLVVNFRKEIHGTWFITLKTEDLTTKVALWLR

SEQ ID NO: 2187511 - protein, 29 aa, Cryptosporidium hominis
AVKNYGIPKFFISVLVELEAFLDEKFRDK

SEQ ID NO: 2187512 - protein, 32 aa, Cryptosporidium hominis
AVKYLKQYFDPKNMFILLSIPENKALIEDERL

SEQ ID NO: 2187513 - protein, 18 aa, Cryptosporidium hominis
AVLGAYKKAIKRHPKMVE

SEQ ID NO: 2187514 - protein, 18 aa, Cryptosporidium hominis
AVMKYGLNNWSRVASLLI

SEQ ID NO: 2187515 - protein, 18 aa, Cryptosporidium hominis
AVNLQGTTGLPIHCFSKV

SEQ ID NO: 2187516 - protein, 17 aa, Cryptosporidium hominis
AVPALNNRWFGGNQVFC

SEQ ID NO: 2187517 - protein, 20 aa, Cryptosporidium hominis
AVPLLLDARHDGPVKVTSVA

SEQ ID NO: 2187518 - protein, 21 aa, Cryptosporidium hominis
AVQNSPFLEKLRKLDYEVIYM

SEQ ID NO: 2187519 - protein, 28 aa, Cryptosporidium hominis
AVSFLKKFNVPLLILGGGGYTLRNVPKC

SEQ ID NO: 2187520 - protein, 19 aa, Cryptosporidium hominis
AVVDFRPPMIKNANTVRNG

SEQ ID NO: 2187521 - protein, 26 aa, Cryptosporidium hominis
AVVPCGLLYPIVFIGNIPPNVPYEYL

SEQ ID NO: 2187522 - protein, 21 aa, Cryptosporidium hominis
AWFDLDLGNTPYKLLRYSESA

SEQ ID NO: 2187523 - protein, 23 aa, Cryptosporidium hominis
  misc_feature (2)..(2): Xaa can be any naturally occurring amino acid
AXRIFRAIFNLAIKRRWSTLARR

SEQ ID NO: 2187524 - protein, 17 aa, Cryptosporidium hominis
AYCRYTYSNLGISKIAI

SEQ ID NO: 2187525 - protein, 23 aa, Cryptosporidium hominis
AYDNIFYCNFRKKKEKCTEDFRD

SEQ ID NO: 2187526 - protein, 22 aa, Cryptosporidium hominis
AYEYAKQLWLKARNKSKLNKCQ

SEQ ID NO: 2187527 - protein, 36 aa, Cryptosporidium hominis
AYIGLYNQIVRHYSNMPWPIGLCQCSLYCVAIDVSR

SEQ ID NO: 2187528 - protein, 18 aa, Cryptosporidium hominis
AYKMYYKCLVEWSCLTLD

SEQ ID NO: 2187529 - protein, 23 aa, Cryptosporidium hominis
AYLEKKFILAIEILEEIVVKAPG

SEQ ID NO: 2187530 - protein, 17 aa, Cryptosporidium hominis
AYNHRIDHWSRCNDPLE

SEQ ID NO: 2187531 - protein, 18 aa, Cryptosporidium hominis
AYPDILIERIRHLETQNI

SEQ ID NO: 2187532 - protein, 19 aa, Cryptosporidium hominis
AYRYTHNLKFLNRESTGGQ

SEQ ID NO: 2187533 - protein, 24 aa, Cryptosporidium hominis
AYSVEAFLTAGTFYAKSILSDPPS

SEQ ID NO: 2187534 - protein, 19 aa, Cryptosporidium hominis
AYYSKIYTLPMFSISMDKG

SEQ ID NO: 2187535 - protein, 25 aa, Cryptosporidium hominis
CADELYNSLLYLRLQCEDEDILKKQ

SEQ ID NO: 2187536 - protein, 17 aa, Cryptosporidium hominis
CAHIHWTEIFLNECCKP

SEQ ID NO: 2187537 - protein, 19 aa, Cryptosporidium hominis
CAITLFNSPLPNVISTFNS

SEQ ID NO: 2187538 - protein, 25 aa, Cryptosporidium hominis
CAQLQKLLYDLPRIKQKELKRLKLV

SEQ ID NO: 2187539 - protein, 21 aa, Cryptosporidium hominis
CAQYFLGFCKYGPKCKRRHEP

SEQ ID NO: 2187540 - protein, 17 aa, Cryptosporidium hominis
CCCYSKNCLCDFSVRYK

SEQ ID NO: 2187541 - protein, 19 aa, Cryptosporidium hominis
CCFAGMPADFRVILKKSRK

SEQ ID NO: 2187542 - protein, 23 aa, Cryptosporidium hominis
CCFSVPFFQGSPIYKACRRLDIG

SEQ ID NO: 2187543 - protein, 17 aa, Cryptosporidium hominis
CCLVYPNESHRNLRYRK

SEQ ID NO: 2187544 - protein, 20 aa, Cryptosporidium hominis
CCTAVTWQYAPPEIVGCTDP

SEQ ID NO: 2187545 - protein, 29 aa, Cryptosporidium hominis
CDEIGHLFFEIFPFLSGIENMILKQIIMQ

SEQ ID NO: 2187546 - protein, 17 aa, Cryptosporidium hominis
CDHENCIQLFHPICAWL

SEQ ID NO: 2187547 - protein, 17 aa, Cryptosporidium hominis
CDIGKIKKPALPLKKEI

SEQ ID NO: 2187548 - protein, 19 aa, Cryptosporidium hominis
CDLHLKWAPFVTSSECLAY

SEQ ID NO: 2187549 - protein, 30 aa, Cryptosporidium hominis
CDNMVDKWLMLYILLKMNVIPRKCLIFVSE

SEQ ID NO: 2187550 - protein, 25 aa, Cryptosporidium hominis
CDPIDLIVKFLDNPSKYKDSICWAT

SEQ ID NO: 2187551 - protein, 25 aa, Cryptosporidium hominis
CDTRSIFLAILMNISQIYSFSRQIY

SEQ ID NO: 2187552 - protein, 25 aa, Cryptosporidium hominis
CDVCYSWWVFASLKIVKNIIINRNM

SEQ ID NO: 2187553 - protein, 29 aa, Cryptosporidium hominis
CDVWSAGVILYILLSGTPPFYGKNEYDIL

SEQ ID NO: 2187554 - protein, 24 aa, Cryptosporidium hominis
CEDRDPYLAYIAYRKAWGQCDDEI

SEQ ID NO: 2187555 - protein, 22 aa, Cryptosporidium hominis
CEDRHITKKQFFFNFNNQTPST

SEQ ID NO: 2187556 - protein, 24 aa, Cryptosporidium hominis
CEEMLEFLTKKLEFYRGLEAEILA

SEQ ID NO: 2187557 - protein, 27 aa, Cryptosporidium hominis
CEEPFSIFKRHECWCRPLEQIGSNTEG

SEQ ID NO: 2187558 - protein, 20 aa, Cryptosporidium hominis
CEERGYYDLVSSLSVHLINQ

SEQ ID NO: 2187559 - protein, 28 aa, Cryptosporidium hominis
CEEYLKTKLLFKLIIKSVIKNDPEPLIT

SEQ ID NO: 2187560 - protein, 18 aa, Cryptosporidium hominis
CEFVILNDKFEKENIEFD

SEQ ID NO: 2187561 - protein, 18 aa, Cryptosporidium hominis
CEHCSIGGYPYYCNCYKM

SEQ ID NO: 2187562 - protein, 18 aa, Cryptosporidium hominis
CEIIPFSSQLTCISDNLV

SEQ ID NO: 2187563 - protein, 25 aa, Cryptosporidium hominis
CEIKKARISLIEWAFNDIQSDLTRL

SEQ ID NO: 2187564 - protein, 23 aa, Cryptosporidium hominis
CEISVGYRPYAIRTFLDEWGMDS

SEQ ID NO: 2187565 - protein, 20 aa, Cryptosporidium hominis
CEIYLRRMHGLENELQILTN

SEQ ID NO: 2187566 - protein, 25 aa, Cryptosporidium hominis
CEKDIYIKPIFKAERTTLILRDLEN

SEQ ID NO: 2187567 - protein, 17 aa, Cryptosporidium hominis
CEKLAYNTPLMDFLKDL

SEQ ID NO: 2187568 - protein, 24 aa, Cryptosporidium hominis
CELLPGYEDIPFPDGLRGSYYDNP

SEQ ID NO: 2187569 - protein, 30 aa, Cryptosporidium hominis
CEMNKIKDCPLFLSFSYGRALQASVLKAWK

SEQ ID NO: 2187570 - protein, 19 aa, Cryptosporidium hominis
CENCAISQIALYDHNIRQY

SEQ ID NO: 2187571 - protein, 17 aa, Cryptosporidium hominis
CENIINTIKRNLDLFSE

SEQ ID NO: 2187572 - protein, 23 aa, Cryptosporidium hominis
CERLGIPCELISKILTECKIRHT

SEQ ID NO: 2187573 - protein, 20 aa, Cryptosporidium hominis
CERNLILKKLSVLNLRKQNV

SEQ ID NO: 2187574 - protein, 18 aa, Cryptosporidium hominis
CESDTLRVYTISSGDIFR

SEQ ID NO: 2187575 - protein, 35 aa, Cryptosporidium hominis
CESGNQCIYGVWFHFLCLKIINEPQKTWYCPGCTR

SEQ ID NO: 2187576 - protein, 24 aa, Cryptosporidium hominis
CESNRLWIRLQNHGTPKDKLRRER

SEQ ID NO: 2187577 - protein, 28 aa, Cryptosporidium hominis
CESYFTTLYSVSLFNLIAILKQNIPIES

SEQ ID NO: 2187578 - protein, 27 aa, Cryptosporidium hominis
CFEYMRIKYSFIIPDKEYLVDYKGLAQ

SEQ ID NO: 2187579 - protein, 23 aa, Cryptosporidium hominis
CFRRRLAEFIIYPPPVMDHRRKA

SEQ ID NO: 2187580 - protein, 31 aa, Cryptosporidium hominis
CFSKNHFSIFSLFNKHKLQLISSLSNFSNRN

SEQ ID NO: 2187581 - protein, 17 aa, Cryptosporidium hominis
CFWKKNPYKYRMTLPFL

SEQ ID NO: 2187582 - protein, 17 aa, Cryptosporidium hominis
CFYSHCTAWQRRNPTKY

SEQ ID NO: 2187583 - protein, 22 aa, Cryptosporidium hominis
CGGEQSGWFWDGELNVCLKLRT

SEQ ID NO: 2187584 - protein, 23 aa, Cryptosporidium hominis
CGHIYCWPCIIKLMNIILENDEY

SEQ ID NO: 2187585 - protein, 29 aa, Cryptosporidium hominis
CGKLAKLRSYIIWNSIAVIKVLKKRRKKV

SEQ ID NO: 2187586 - protein, 25 aa, Cryptosporidium hominis
CGKQDRLLPALPQSSNSRMMRMIQQ

SEQ ID NO: 2187587 - protein, 24 aa, Cryptosporidium hominis
CGKTVYEKFWQLPLDPEFQEMVKS

SEQ ID NO: 2187588 - protein, 21 aa, Cryptosporidium hominis
CGLIYYTDLPLNKQQLGTIGI

SEQ ID NO: 2187589 - protein, 17 aa, Cryptosporidium hominis
CGLKPIIKCTGKIIIKM

SEQ ID NO: 2187590 - protein, 23 aa, Cryptosporidium hominis
CGNPKNLWSSCHSNRTRHLGEDE

SEQ ID NO: 2187591 - protein, 24 aa, Cryptosporidium hominis
CGPIKAIYLGLNHQTMQPCGFCFV

SEQ ID NO: 2187592 - protein, 24 aa, Cryptosporidium hominis
CHCHDWLAAPVLTSLRRIGNNNRT

SEQ ID NO: 2187593 - protein, 19 aa, Cryptosporidium hominis
CHINGLSIRYIPSLKRMRF

SEQ ID NO: 2187594 - protein, 27 aa, Cryptosporidium hominis
CHLCFSRFMSLRPFLLKAVQRKWKCHL

SEQ ID NO: 2187595 - protein, 18 aa, Cryptosporidium hominis
CHNPKWNSYFEFDCLSNL

SEQ ID NO: 2187596 - protein, 24 aa, Cryptosporidium hominis
CHSCRDLLLIDNRLKYCISKIPNE

SEQ ID NO: 2187597 - protein, 27 aa, Cryptosporidium hominis
CHSLTRIFGRLYLFGGFDGIQCFNDLW

SEQ ID NO: 2187598 - protein, 23 aa, Cryptosporidium hominis
CIDIKLLQDLLWSGVPRGSPPEL

SEQ ID NO: 2187599 - protein, 31 aa, Cryptosporidium hominis
CIEDLIQSDLIPYAALFARCYYPSKLEEIVI

SEQ ID NO: 2187600 - protein, 20 aa, Cryptosporidium hominis
CIFEFFLEVFGIKILQEQRY

SEQ ID NO: 2187601 - protein, 19 aa, Cryptosporidium hominis
CIGNVFLIKTIPITIYNEF

SEQ ID NO: 2187602 - protein, 18 aa, Cryptosporidium hominis
CIHRIRFYKDSNLDQNYD

SEQ ID NO: 2187603 - protein, 43 aa, Cryptosporidium hominis
CIHYLRGLSWVLGYYYHGVPSWDWYYPYHYAPYVMDIVELLSD

SEQ ID NO: 2187604 - protein, 19 aa, Cryptosporidium hominis
CIKNSWPGMFRGIFGAHYL

SEQ ID NO: 2187605 - protein, 18 aa, Cryptosporidium hominis
CIKPISFRSSPYSASSNL

SEQ ID NO: 2187606 - protein, 19 aa, Cryptosporidium hominis
CILFNKFNLRFLVYNSAGG

SEQ ID NO: 2187607 - protein, 18 aa, Cryptosporidium hominis
CIMWYGQVSAIDGCPVIR

SEQ ID NO: 2187608 - protein, 17 aa, Cryptosporidium hominis
CINNYINSKFYSSHSTN

SEQ ID NO: 2187609 - protein, 31 aa, Cryptosporidium hominis
CINYETNYNLWIKCLDIYSSCLWQLSRSIDL

SEQ ID NO: 2187610 - protein, 29 aa, Cryptosporidium hominis
CIQNIDSLILYILKMYCIKTISCTFGQEF

SEQ ID NO: 2187611 - protein, 25 aa, Cryptosporidium hominis
CIQNLHALFRLFLTPPKTSSSSHDQ

SEQ ID NO: 2187612 - protein, 34 aa, Cryptosporidium hominis
CIRDHVMSPYKLDFLPYHFLLCSIGEFGELRYQD

SEQ ID NO: 2187613 - protein, 23 aa, Cryptosporidium hominis
CISNVPFLFEKISSLKKKLVNLE

SEQ ID NO: 2187614 - protein, 25 aa, Cryptosporidium hominis
CISTPPPFTGLPQNNPFFSSNGINE

SEQ ID NO: 2187615 - protein, 34 aa, Cryptosporidium hominis
CIVQDEISIPFSWSQPILKLKILEENDFKADIIG

SEQ ID NO: 2187616 - protein, 32 aa, Cryptosporidium hominis
CIVQHNHISAIKKFLYIWTKCSNLKSEMINGS

SEQ ID NO: 2187617 - protein, 26 aa, Cryptosporidium hominis
CKGTRNINIPIWRQGTMLPRVCNTTP

SEQ ID NO: 2187618 - protein, 31 aa, Cryptosporidium hominis
CKGVQHPMRGLFLRYFLIQTCKDVLPDTGSI

SEQ ID NO: 2187619 - protein, 23 aa, Cryptosporidium hominis
CKHLKQSLLLQNSGRHRFKHPPT

SEQ ID NO: 2187620 - protein, 29 aa, Cryptosporidium hominis
CKICNRPCTMFRWKLHNSKKYNQTTICYS

SEQ ID NO: 2187621 - protein, 24 aa, Cryptosporidium hominis
CKKGKLFLESFSLLPKISGENKET

SEQ ID NO: 2187622 - protein, 26 aa, Cryptosporidium hominis
CKKRLLTLRKSLVPPVTRSALEVVNL

SEQ ID NO: 2187623 - protein, 21 aa, Cryptosporidium hominis
CKLLTGTDLILIKSVEEKYIE

SEQ ID NO: 2187624 - protein, 19 aa, Cryptosporidium hominis
CKNDFLRQKLYGIHMRKVC

SEQ ID NO: 2187625 - protein, 22 aa, Cryptosporidium hominis
CKQKNCFAFLKLESLVSEFLKK

SEQ ID NO: 2187626 - protein, 23 aa, Cryptosporidium hominis
CKRDGVKMILSNQIRLLEEKQRN

SEQ ID NO: 2187627 - protein, 19 aa, Cryptosporidium hominis
CKRLLGLDHYFKPGGLIGI

SEQ ID NO: 2187628 - protein, 18 aa, Cryptosporidium hominis
CKRRNFLKILQNTKFFQS

SEQ ID NO: 2187629 - protein, 18 aa, Cryptosporidium hominis
CKTWVSMTPREFYNPVID

SEQ ID NO: 2187630 - protein, 17 aa, Cryptosporidium hominis
CKVIKYKRNSKPSNKIL

SEQ ID NO: 2187631 - protein, 26 aa, Cryptosporidium hominis
CLACELVHLTFMLYSCKFNLKNGKGR

SEQ ID NO: 2187632 - protein, 31 aa, Cryptosporidium hominis
CLEFTEEQFRWHWINILKCTTIEEFSPYQVI

SEQ ID NO: 2187633 - protein, 27 aa, Cryptosporidium hominis
CLERLLTFSIISILWILSANYCNLFKW

SEQ ID NO: 2187634 - protein, 18 aa, Cryptosporidium hominis
CLGAFVDPCTLSCSHSFC

SEQ ID NO: 2187635 - protein, 18 aa, Cryptosporidium hominis
CLGFIHPETHLAFDDPIN

SEQ ID NO: 2187636 - protein, 27 aa, Cryptosporidium hominis
CLGGQLKFSCLTLPPKGLNASSEDIIV

SEQ ID NO: 2187637 - protein, 17 aa, Cryptosporidium hominis
CLGIYNFRRNAKDLRIL

SEQ ID NO: 2187638 - protein, 26 aa, Cryptosporidium hominis
CLGLDKVPPRTWICPWHECCLCFRRA

SEQ ID NO: 2187639 - protein, 33 aa, Cryptosporidium hominis
CLICLDEFKDQQEILWLPCTHCFCRNCITSWFE

SEQ ID NO: 2187640 - protein, 19 aa, Cryptosporidium hominis
CLIFSGFRRIDIVDYDYVE

SEQ ID NO: 2187641 - protein, 22 aa, Cryptosporidium hominis
CLITIPFLQWELINDQVYTNLF

SEQ ID NO: 2187642 - protein, 18 aa, Cryptosporidium hominis
CLKLEMRLEKILELVTEQ

SEQ ID NO: 2187643 - protein, 20 aa, Cryptosporidium hominis
CLLDLIRRCQRLASQNSETG

SEQ ID NO: 2187644 - protein, 21 aa, Cryptosporidium hominis
CLLHVSLLLKQKIQAFVCIGT

SEQ ID NO: 2187645 - protein, 32 aa, Cryptosporidium hominis
CLLPGFHPITAWLLPPSYFEKGQLKKSAWFLN

SEQ ID NO: 2187646 - protein, 19 aa, Cryptosporidium hominis
CLMAELKEKMVLFRNRLNK

SEQ ID NO: 2187647 - protein, 18 aa, Cryptosporidium hominis
CLNRFIQQLIKSCNIMRD

SEQ ID NO: 2187648 - protein, 18 aa, Cryptosporidium hominis
CLPIGIRDEFLDLCTKEI

SEQ ID NO: 2187649 - protein, 23 aa, Cryptosporidium hominis
CLPTNAIRTVKVCPLPSAGSSMK

SEQ ID NO: 2187650 - protein, 22 aa, Cryptosporidium hominis
CLQKMNILEFVPSKKLSKEMTK

SEQ ID NO: 2187651 - protein, 18 aa, Cryptosporidium hominis
CLQKYEFHVRNLLCSLLR

SEQ ID NO: 2187652 - protein, 18 aa, Cryptosporidium hominis
CLQPFMKVQTGPLLKQHW

SEQ ID NO: 2187653 - protein, 26 aa, Cryptosporidium hominis
CLQSLQCEYIYLACKFKNDSTIFFGG

SEQ ID NO: 2187654 - protein, 18 aa, Cryptosporidium hominis
CMSQYGYKFPVTKSLLPT

SEQ ID NO: 2187655 - protein, 17 aa, Cryptosporidium hominis
CMTLLKKGDGAVFDVPL

SEQ ID NO: 2187656 - protein, 42 aa, Cryptosporidium hominis
CNAYKPLLKLISSWERFCNYTLLKRVILVSIALRIGENCEFN

SEQ ID NO: 2187657 - protein, 23 aa, Cryptosporidium hominis
CNELLYPILGRSLISTIYCEKTM

SEQ ID NO: 2187658 - protein, 39 aa, Cryptosporidium hominis
CNESKSLCCALSGTFRYLTTILLCDRLIMTGTFTEYDPS

SEQ ID NO: 2187659 - protein, 21 aa, Cryptosporidium hominis
CNGSKLTIQPSLLSNRNATTA

SEQ ID NO: 2187660 - protein, 24 aa, Cryptosporidium hominis
CNKELEAIFFDWKEFKILNKSTKN

SEQ ID NO: 2187661 - protein, 29 aa, Cryptosporidium hominis
CNKKVGIYGFNCRCGFNFCSTHRYADAHD

SEQ ID NO: 2187662 - protein, 23 aa, Cryptosporidium hominis
CNKYLSNIKFLPKNTLKRVEFLS

SEQ ID NO: 2187663 - protein, 28 aa, Cryptosporidium hominis
CNLIHATSLHTWIMLARVQALMNGEEKL

SEQ ID NO: 2187664 - protein, 29 aa, Cryptosporidium hominis
CNMKDIFYFYQLFDGQLVYLEPFYVKVLQ

SEQ ID NO: 2187665 - protein, 24 aa, Cryptosporidium hominis
CNNFKTLIFKQLISTSIYACDCYK

SEQ ID NO: 2187666 - protein, 32 aa, Cryptosporidium hominis
CNNYLVMIRCSIKFFSLYRHIKRKNACIQICK

SEQ ID NO: 2187667 - protein, 17 aa, Cryptosporidium hominis
CNSDIICNFPLREMLDL

SEQ ID NO: 2187668 - protein, 36 aa, Cryptosporidium hominis
CNSLETLLIHKDKLSEFLPALLLRLKEQGKHIKFYS

SEQ ID NO: 2187669 - protein, 26 aa, Cryptosporidium hominis
CNSLLLLRSGFLFASHEFGNHTNYQI

SEQ ID NO: 2187670 - protein, 17 aa, Cryptosporidium hominis
CNVIDLISPFHGITTRN

SEQ ID NO: 2187671 - protein, 20 aa, Cryptosporidium hominis
CNVILPWQKVTLESNDENDQ

SEQ ID NO: 2187672 - protein, 22 aa, Cryptosporidium hominis
CNYTNVYIFKLLDENYLGNGEF

SEQ ID NO: 2187673 - protein, 24 aa, Cryptosporidium hominis
CPAKDIFWSKTLSKRPIFSHNKNT

SEQ ID NO: 2187674 - protein, 17 aa, Cryptosporidium hominis
CPDLTLIDLPGITRVPL

SEQ ID NO: 2187675 - protein, 31 aa, Cryptosporidium hominis
CPEEYLDAGYPLGSLLWVSTLDIESHIKKWR

SEQ ID NO: 2187676 - protein, 35 aa, Cryptosporidium hominis
CPGQIELFTHLPVMRILVTALQRWDFRICGVYCLD

SEQ ID NO: 2187677 - protein, 29 aa, Cryptosporidium hominis
CPIKDLDFPILLHRKLINISLRKLNNINN

SEQ ID NO: 2187678 - protein, 23 aa, Cryptosporidium hominis
CPINHRVATIMLYLSSPPPDGRI

SEQ ID NO: 2187679 - protein, 24 aa, Cryptosporidium hominis
CPKTCENFLKLCKLKFYNNCEFYK

SEQ ID NO: 2187680 - protein, 26 aa, Cryptosporidium hominis
CPLTFGKVVIPKLNFAFKGGDKSLED

SEQ ID NO: 2187681 - protein, 17 aa, Cryptosporidium hominis
CPPLLQADIDLQSGIIL

SEQ ID NO: 2187682 - protein, 20 aa, Cryptosporidium hominis
CPQLLKWKPPHLNTADFAAI

SEQ ID NO: 2187683 - protein, 22 aa, Cryptosporidium hominis
CPRDFEIIFPTYPTEDTIKSNF

SEQ ID NO: 2187684 - protein, 18 aa, Cryptosporidium hominis
CPSFQRKGSLRPSPNTQV

SEQ ID NO: 2187685 - protein, 21 aa, Cryptosporidium hominis
CPVCRQLIGYNFRINMTIHNV

SEQ ID NO: 2187686 - protein, 25 aa, Cryptosporidium hominis
CQFIGELIILFTSNGYYDTFSSNLS

SEQ ID NO: 2187687 - protein, 22 aa, Cryptosporidium hominis
CQGSWLYYENPVAHFTKYKQNN

SEQ ID NO: 2187688 - protein, 17 aa, Cryptosporidium hominis
CQKMLAKYIFKEYPRFL

SEQ ID NO: 2187689 - protein, 17 aa, Cryptosporidium hominis
CQLNKGVFKVLHVSDSI

SEQ ID NO: 2187690 - protein, 24 aa, Cryptosporidium hominis
CQRMSRLPPELLALVVRHIYSQDQ

SEQ ID NO: 2187691 - protein, 28 aa, Cryptosporidium hominis
CQSFNWNVYMRQLYYNSKYPSFFKDVVA

SEQ ID NO: 2187692 - protein, 17 aa, Cryptosporidium hominis
CRDALTRRSLGYAYVNY

SEQ ID NO: 2187693 - protein, 23 aa, Cryptosporidium hominis
CREFSIKYILKLLQTIEKPTENT

SEQ ID NO: 2187694 - protein, 21 aa, Cryptosporidium hominis
CRIVFSYTELIYYLIVVCKAK

SEQ ID NO: 2187695 - protein, 18 aa, Cryptosporidium hominis
CRRSMESAYLLYLKTRTP

SEQ ID NO: 2187696 - protein, 25 aa, Cryptosporidium hominis
CSDYKIRLFLIQTGKCYKIFDENIS

SEQ ID NO: 2187697 - protein, 25 aa, Cryptosporidium hominis
CSEANFSFVLKLFISIVGSCVDMLE

SEQ ID NO: 2187698 - protein, 24 aa, Cryptosporidium hominis
CSGGELFDRIISQGSFDEIYAANL

SEQ ID NO: 2187699 - protein, 22 aa, Cryptosporidium hominis
CSGVHRGLGVHISFIRSITMDS

SEQ ID NO: 2187700 - protein, 23 aa, Cryptosporidium hominis
CSKDQLILHTLRALRSSLSSEQE

SEQ ID NO: 2187701 - protein, 28 aa, Cryptosporidium hominis
CSLSTTIKYLAFLGLLDDLLQLKNALNV

SEQ ID NO: 2187702 - protein, 18 aa, Cryptosporidium hominis
CSLYPYTSIIWKELSRIS

SEQ ID NO: 2187703 - protein, 24 aa, Cryptosporidium hominis
CSNECFVLAIIYVGRIIKFNKNFT

SEQ ID NO: 2187704 - protein, 27 aa, Cryptosporidium hominis
CSNPNFTMDNLLLYVRFIQGNICLNAS

SEQ ID NO: 2187705 - protein, 25 aa, Cryptosporidium hominis
CSPRLKINIIWPTTLKNYTMYSNMQ

SEQ ID NO: 2187706 - protein, 17 aa, Cryptosporidium hominis
CSSAAGSNFFHSYRKIK

SEQ ID NO: 2187707 - protein, 27 aa, Cryptosporidium hominis
CSSNKVIYIIKICNFSFQLIGRFVHSK

SEQ ID NO: 2187708 - protein, 18 aa, Cryptosporidium hominis
CSSPNNIIIIFSGRERHL

SEQ ID NO: 2187709 - protein, 31 aa, Cryptosporidium hominis
CSSRREALPYIPLLLPIGITVMAVDLSGSGL

SEQ ID NO: 2187710 - protein, 18 aa, Cryptosporidium hominis
CSVFTLCDLVNITIDETL

SEQ ID NO: 2187711 - protein, 20 aa, Cryptosporidium hominis
CSYDDFFQLVNNGILNGTVN

SEQ ID NO: 2187712 - protein, 24 aa, Cryptosporidium hominis
CSYGNYFILIDFKEKQQDFVKGNF

SEQ ID NO: 2187713 - protein, 19 aa, Cryptosporidium hominis
CSYIQVFRYLKSNIFEKLK

SEQ ID NO: 2187714 - protein, 19 aa, Cryptosporidium hominis
CSYPLPLVICPQVFDYRES

SEQ ID NO: 2187715 - protein, 27 aa, Cryptosporidium hominis
CTDLDDSFHNYLMKGLLGENVEGGSGS

SEQ ID NO: 2187716 - protein, 22 aa, Cryptosporidium hominis
CTDLGFFFASFTNRFSIFPPTA

SEQ ID NO: 2187717 - protein, 20 aa, Cryptosporidium hominis
CTFVWLCMKLGTSKFNINSY

SEQ ID NO: 2187718 - protein, 22 aa, Cryptosporidium hominis
CTISPSVTFFQQTYATLNTPSY

SEQ ID NO: 2187719 - protein, 18 aa, Cryptosporidium hominis
CTPGKMQDFLKKRSFPTE

SEQ ID NO: 2187720 - protein, 27 aa, Cryptosporidium hominis
CTQPTIISSLLRPSAPPTAPVCSSYKS

SEQ ID NO: 2187721 - protein, 22 aa, Cryptosporidium hominis
CTSRDCPIFYRRTKVRKDVNSI

SEQ ID NO: 2187722 - protein, 20 aa, Cryptosporidium hominis
CVAVLPYCQALCKFPAHVQQ

SEQ ID NO: 2187723 - protein, 19 aa, Cryptosporidium hominis
CVEAFTDYPPLGRFAVRDM

SEQ ID NO: 2187724 - protein, 21 aa, Cryptosporidium hominis
CVEYVHQRLLTNIYTVFSQNM

SEQ ID NO: 2187725 - protein, 19 aa, Cryptosporidium hominis
CVGTPFLYPNYGTCDLPQS

SEQ ID NO: 2187726 - protein, 17 aa, Cryptosporidium hominis
CVHVFQKEYFSTISADS

SEQ ID NO: 2187727 - protein, 27 aa, Cryptosporidium hominis
CVIDGNSYYYENFVRSLSFGDYSPYES

SEQ ID NO: 2187728 - protein, 21 aa, Cryptosporidium hominis
CVIKTVHPWFKSTATVECYNS

SEQ ID NO: 2187729 - protein, 23 aa, Cryptosporidium hominis
CVKRIPDGILLFFGSYSLMDQAV

SEQ ID NO: 2187730 - protein, 31 aa, Cryptosporidium hominis
CVNGSIIHPFYQPMVLIATLFQKSSQKQGKT

SEQ ID NO: 2187731 - protein, 28 aa, Cryptosporidium hominis
CVVSDIMEPFLPCPLSELCVPVAQGLEF

SEQ ID NO: 2187732 - protein, 19 aa, Cryptosporidium hominis
CWCISRFTPWLALQQGQPI

SEQ ID NO: 2187733 - protein, 23 aa, Cryptosporidium hominis
CWNWFNRVFEYLPVGAIIEDRIL

SEQ ID NO: 2187734 - protein, 17 aa, Cryptosporidium hominis
CYHEKVHLFLNLADIIY

SEQ ID NO: 2187735 - protein, 27 aa, Cryptosporidium hominis
CYIYKYRRESILKENLFKYIPTSVKMR

SEQ ID NO: 2187736 - protein, 17 aa, Cryptosporidium hominis
CYIYSIIFGEKIFEMIP

SEQ ID NO: 2187737 - protein, 27 aa, Cryptosporidium hominis
CYLNSIIHMLRSIPSFLQILRNSNLSS

SEQ ID NO: 2187738 - protein, 23 aa, Cryptosporidium hominis
CYNSLVYPILGTKIIFEDDVFKH

SEQ ID NO: 2187739 - protein, 32 aa, Cryptosporidium hominis
CYSKAWVNKTVISAWWVYPDQVSKNAPSGEYL

SEQ ID NO: 2187740 - protein, 17 aa, Cryptosporidium hominis
CYSLAVEGYGLLKLMGI

SEQ ID NO: 2187741 - protein, 25 aa, Cryptosporidium hominis
CYSSNLFKLIQSLLSRDPILRPDPL

SEQ ID NO: 2187742 - protein, 27 aa, Cryptosporidium hominis
CYTFSGNLLIFILPRVEKIPRLMKAYS

SEQ ID NO: 2187743 - protein, 17 aa, Cryptosporidium hominis
DACKVPCHLISSNAGFD

SEQ ID NO: 2187744 - protein, 23 aa, Cryptosporidium hominis
DADHYLFRKLKVLKTFVKLDHFD

SEQ ID NO: 2187745 - protein, 27 aa, Cryptosporidium hominis
DADILCTMPWQFVIIDEAHRLKNRGAK

SEQ ID NO: 2187746 - protein, 19 aa, Cryptosporidium hominis
DADKLSFLSDLYACMSIGQ

SEQ ID NO: 2187747 - protein, 19 aa, Cryptosporidium hominis
DAEFPLPISYLVDVNTKAL

SEQ ID NO: 2187748 - protein, 28 aa, Cryptosporidium hominis
DAEIGMQNFQRLLAKKAFDTIEEDEQQH

SEQ ID NO: 2187749 - protein, 25 aa, Cryptosporidium hominis
DAEYTCHDYFNKDNFLPSLINSNFV

SEQ ID NO: 2187750 - protein, 25 aa, Cryptosporidium hominis
DAGRPFYPHKFKISMSLPAYALKYG

SEQ ID NO: 2187751 - protein, 25 aa, Cryptosporidium hominis
DAISHVWQPTLWYISERKTINKFAQ

SEQ ID NO: 2187752 - protein, 23 aa, Cryptosporidium hominis
DAIVIPMHCNQTSHWWLIVICHP

SEQ ID NO: 2187753 - protein, 25 aa, Cryptosporidium hominis
DALAVARNILLDPALLPGGGGTEMA

SEQ ID NO: 2187754 - protein, 30 aa, Cryptosporidium hominis
DALDWIKKTFLYIRIIRNPSLYGLDIDEII

SEQ ID NO: 2187755 - protein, 17 aa, Cryptosporidium hominis
DALGIRLYNFHPGSTVG

SEQ ID NO: 2187756 - protein, 35 aa, Cryptosporidium hominis
DALNHPWITRFADDILFLSPRNYFYSNDGFMKTGI

SEQ ID NO: 2187757 - protein, 25 aa, Cryptosporidium hominis
DALRVIFSIVYFEISFLLCDSKSSI

SEQ ID NO: 2187758 - protein, 17 aa, Cryptosporidium hominis
DAMYNRDINYIRDLLCI

SEQ ID NO: 2187759 - protein, 23 aa, Cryptosporidium hominis
DANALSTILLQMKSYKPDCIIGM

SEQ ID NO: 2187760 - protein, 39 aa, Cryptosporidium hominis
DANQINGFGIYHWNDGRVYTGYWLKNHMFGYGKFDWTDH

SEQ ID NO: 2187761 - protein, 30 aa, Cryptosporidium hominis
DAPSCVELGGLYWLDPYKPIKLTREVKDKD

SEQ ID NO: 2187762 - protein, 22 aa, Cryptosporidium hominis
DAPSHLGMRFIGGRYVPKTVAS

SEQ ID NO: 2187763 - protein, 20 aa, Cryptosporidium hominis
DAPVAPLKKDAPAAPAAPPM

SEQ ID NO: 2187764 - protein, 20 aa, Cryptosporidium hominis
DAPVAPLKKDAPAAPTALPA

SEQ ID NO: 2187765 - protein, 26 aa, Cryptosporidium hominis
DAQEKLFVFTFEDTLPYNLSNQATSQ

SEQ ID NO: 2187766 - protein, 36 aa, Cryptosporidium hominis
DAQGLDKIMKLPWEKIPRYLYMSSGVDLFFIHLNNE

SEQ ID NO: 2187767 - protein, 17 aa, Cryptosporidium hominis
DAQLSYLSRIKYIDAVI

SEQ ID NO: 2187768 - protein, 31 aa, Cryptosporidium hominis
DARNELYFVTIFYGLQFALNRIFQGIISKNI

SEQ ID NO: 2187769 - protein, 23 aa, Cryptosporidium hominis
DASIWLKQFLMGLKDKEGKIPQG

SEQ ID NO: 2187770 - protein, 25 aa, Cryptosporidium hominis
DASKQLLIEKLPPLLTIQLKRFSYV

SEQ ID NO: 2187771 - protein, 19 aa, Cryptosporidium hominis
DASLNLTLKHKYGLIGRNG

SEQ ID NO: 2187772 - protein, 22 aa, Cryptosporidium hominis
DATIWLFRCLLSIDSPSFHQLM

SEQ ID NO: 2187773 - protein, 35 aa, Cryptosporidium hominis
DATSFFQSCIIQNGLLGLIQALPHIFIEGPHTIID

SEQ ID NO: 2187774 - protein, 21 aa, Cryptosporidium hominis
DAVLEKLPYKNGEDKVIVICA

SEQ ID NO: 2187775 - protein, 26 aa, Cryptosporidium hominis
DAVSKALYSLVFDYILHLVNTQISRA

SEQ ID NO: 2187776 - protein, 35 aa, Cryptosporidium hominis
DAWEIYYSITLIQLSFREIFIIFSQNNKNIEYKYL

SEQ ID NO: 2187777 - protein, 29 aa, Cryptosporidium hominis
DAWSAGVLLHLLLMGAVPFPGINDADTIS

SEQ ID NO: 2187778 - protein, 24 aa, Cryptosporidium hominis
DAYGRLTYWFIPPSSSKEGIQMWK

SEQ ID NO: 2187779 - protein, 29 aa, Cryptosporidium hominis
DCAQIITSLFIKKLFKKNKIIPMIKFEKK

SEQ ID NO: 2187780 - protein, 26 aa, Cryptosporidium hominis
DCCTIKPHWLVDFAPNLFQFADQDQL

SEQ ID NO: 2187781 - protein, 22 aa, Cryptosporidium hominis
DCDFPGKMVPNKNLLRLSRNHA

SEQ ID NO: 2187782 - protein, 26 aa, Cryptosporidium hominis
DCESRNPTWLSLSFAVFICLNCSSDH

SEQ ID NO: 2187783 - protein, 22 aa, Cryptosporidium hominis
DCEYPVITIRILGFLGKNIPKT

SEQ ID NO: 2187784 - protein, 40 aa, Cryptosporidium hominis
DCFEPISLLLQKIDHEILLKLYKIPIFNNVSEFLTNVSIS

SEQ ID NO: 2187785 - protein, 34 aa, Cryptosporidium hominis
DCIQQLLFCFHNNFPILWHPQVIAIIKSNIIPNN

SEQ ID NO: 2187786 - protein, 17 aa, Cryptosporidium hominis
DCKASFAVFSSSPLLLN

SEQ ID NO: 2187787 - protein, 18 aa, Cryptosporidium hominis
DCLLWALDRETFNHIVKG

SEQ ID NO: 2187788 - protein, 24 aa, Cryptosporidium hominis
DCNEFCFLQLFNLPGNILTLYIES

SEQ ID NO: 2187789 - protein, 24 aa, Cryptosporidium hominis
DCNTYYCHLIHGLAERRESKVYLL

SEQ ID NO: 2187790 - protein, 38 aa, Cryptosporidium hominis
DCPINLFRQILVLTSERFALFQYSPLKLLQAAPIVDFE

SEQ ID NO: 2187791 - protein, 19 aa, Cryptosporidium hominis
DCQELLLHPFFSSINGTEG

SEQ ID NO: 2187792 - protein, 26 aa, Cryptosporidium hominis
DCQPFKQIFKMIALSSTYSLPSFSEG

SEQ ID NO: 2187793 - protein, 22 aa, Cryptosporidium hominis
DCSYWERVLSKLCRLYELRNGE

SEQ ID NO: 2187794 - protein, 19 aa, Cryptosporidium hominis
DCTFDYKTFEREQLRKTNQ

SEQ ID NO: 2187795 - protein, 28 aa, Cryptosporidium hominis
DCVTGSYLPIPLFPDIIVVSSGTKLRVM

SEQ ID NO: 2187796 - protein, 24 aa, Cryptosporidium hominis
DDCYARFFTNLPVNLLEDAIHLYF

SEQ ID NO: 2187797 - protein, 26 aa, Cryptosporidium hominis
DDDEFVKLNWSGWFYDHYTINVFPIN

SEQ ID NO: 2187798 - protein, 23 aa, Cryptosporidium hominis
DDDIKEMWKSLISKKGMNLEDII

SEQ ID NO: 2187799 - protein, 25 aa, Cryptosporidium hominis
DDDLRTITFKFPSGLVEIVFYDEQE

SEQ ID NO: 2187800 - protein, 25 aa, Cryptosporidium hominis
DDDPELIIFVRFSSPCTIHSINIIG

SEQ ID NO: 2187801 - protein, 21 aa, Cryptosporidium hominis
DDEANHMLSQRGLPSIRWVGG

SEQ ID NO: 2187802 - protein, 17 aa, Cryptosporidium hominis
DDEFVDLLIRIRNSFDN

SEQ ID NO: 2187803 - protein, 20 aa, Cryptosporidium hominis
DDEKLIYYYPSNDSIIIKRQ

SEQ ID NO: 2187804 - protein, 17 aa, Cryptosporidium hominis
DDEYTPYVFLQFSPYQQ

SEQ ID NO: 2187805 - protein, 17 aa, Cryptosporidium hominis
DDFLKEFALPKVRVFDN

SEQ ID NO: 2187806 - protein, 33 aa, Cryptosporidium hominis
DDFLSSINGVCWCPWDFGLQFACAISDGSVAVC

SEQ ID NO: 2187807 - protein, 25 aa, Cryptosporidium hominis
DDFSIKLICNFGYRPNCITWNEVNK

SEQ ID NO: 2187808 - protein, 17 aa, Cryptosporidium hominis
DDGKPVSYLLFARSSIS

SEQ ID NO: 2187809 - protein, 23 aa, Cryptosporidium hominis
DDGMIRLWNTFTGSLLASVRKHT

SEQ ID NO: 2187810 - protein, 31 aa, Cryptosporidium hominis
DDGQQIEPLYYVPIIPMILVNGTDGIGTGWS

SEQ ID NO: 2187811 - protein, 24 aa, Cryptosporidium hominis
DDHGKPIWGLLPPIEDDDSNNSKN

SEQ ID NO: 2187812 - protein, 26 aa, Cryptosporidium hominis
DDIDFNRYLNLNFYFNQIQNDELDTY

SEQ ID NO: 2187813 - protein, 25 aa, Cryptosporidium hominis
DDIFGFIKLLFSFIELCKFNKNNIV

SEQ ID NO: 2187814 - protein, 19 aa, Cryptosporidium hominis
DDIKFIWKSMKEQIRLFKT

SEQ ID NO: 2187815 - protein, 24 aa, Cryptosporidium hominis
DDIKLQMTGIVPTISLDQSNKVNI

SEQ ID NO: 2187816 - protein, 20 aa, Cryptosporidium hominis
DDIRKYWEFFETSGKNKSEN

SEQ ID NO: 2187817 - protein, 23 aa, Cryptosporidium hominis
DDITVIVAFVAYSDRLSTRMSNI

SEQ ID NO: 2187818 - protein, 31 aa, Cryptosporidium hominis
DDKALNQHISLKKLAPYRVDKKRKYSPPVNT

SEQ ID NO: 2187819 - protein, 32 aa, Cryptosporidium hominis
DDKALVDKPLLKKVMQLWLSAGDTLLEMIVTH

SEQ ID NO: 2187820 - protein, 17 aa, Cryptosporidium hominis
DDLEVLCQISVNCTVVG

SEQ ID NO: 2187821 - protein, 22 aa, Cryptosporidium hominis
DDLILPIRSNKFNENSRFLFQV

SEQ ID NO: 2187822 - protein, 26 aa, Cryptosporidium hominis
DDLKRKYIPAILDWGMVKIFDKSKQI

SEQ ID NO: 2187823 - protein, 21 aa, Cryptosporidium hominis
DDLLHFDFMDPPPPETLIRAL

SEQ ID NO: 2187824 - protein, 23 aa, Cryptosporidium hominis
DDLLPLLIFCIIQSNPTKIKAHV

SEQ ID NO: 2187825 - protein, 32 aa, Cryptosporidium hominis
DDLNKINWLYKSLSPVYFYDLNLLNTCIEHLT

SEQ ID NO: 2187826 - protein, 26 aa, Cryptosporidium hominis
DDLRSFPVLLSVLRLQTLRPEEIIIV

SEQ ID NO: 2187827 - protein, 20 aa, Cryptosporidium hominis
DDLSELVLKVLPNKLINGIS

SEQ ID NO: 2187828 - protein, 20 aa, Cryptosporidium hominis
DDMLPILSILPKSCTGRQTL

SEQ ID NO: 2187829 - protein, 29 aa, Cryptosporidium hominis
DDQVRRKYKLLQHSALDGGCDWLTCTCNL

SEQ ID NO: 2187830 - protein, 26 aa, Cryptosporidium hominis
DDQYKKEILSLLLESRPAIVESAEST

SEQ ID NO: 2187831 - protein, 25 aa, Cryptosporidium hominis
DDRIPKKTFNFVPISEIRGYSKGQS

SEQ ID NO: 2187832 - protein, 17 aa, Cryptosporidium hominis
DDRLYIGTFYRNFEKIS

SEQ ID NO: 2187833 - protein, 26 aa, Cryptosporidium hominis
DDRVLYCIKIHYLIQRNLGICMTSEY

SEQ ID NO: 2187834 - protein, 19 aa, Cryptosporidium hominis
DDSLTMLSAMAYVSSFADE

SEQ ID NO: 2187835 - protein, 30 aa, Cryptosporidium hominis
DDTQKWNVILGRRLILNRRVGLGCLTRGPS

SEQ ID NO: 2187836 - protein, 22 aa, Cryptosporidium hominis
DDTRTVIFLTRLLSRSNTINGI

SEQ ID NO: 2187837 - protein, 52 aa, Cryptosporidium hominis
DDTTFFIRPKSVRIIFIVIISKEFFCFSSNGFPWWRGIISFFKEYLTSNKQS

SEQ ID NO: 2187838 - protein, 17 aa, Cryptosporidium hominis
DDVSSLLMDRIPPNLPI

SEQ ID NO: 2187839 - protein, 30 aa, Cryptosporidium hominis
DDWTKFEELLNYLFYRGLDIDPIDSSVIIT

SEQ ID NO: 2187840 - protein, 25 aa, Cryptosporidium hominis
DDYIKLYFAGLITLINNILLQMIPQ

SEQ ID NO: 2187841 - protein, 23 aa, Cryptosporidium hominis
DDYPLIDLLIALPRPKVFEKVLQ

SEQ ID NO: 2187842 - protein, 22 aa, Cryptosporidium hominis
DEAAELVARIFTELRAKCMNQS

SEQ ID NO: 2187843 - protein, 24 aa, Cryptosporidium hominis
DEADRLFEMGLASQIEKILESIPK

SEQ ID NO: 2187844 - protein, 19 aa, Cryptosporidium hominis
DECMQMIKKYLLLDNNDKD

SEQ ID NO: 2187845 - protein, 24 aa, Cryptosporidium hominis
DECSPPCSLPAPPGSDPFTISGFG

SEQ ID NO: 2187846 - protein, 17 aa, Cryptosporidium hominis
DEDFTLQVLLDSNPIII

SEQ ID NO: 2187847 - protein, 26 aa, Cryptosporidium hominis
DEDFTYLNRFYKINSFIIQIQGRKTN

SEQ ID NO: 2187848 - protein, 28 aa, Cryptosporidium hominis
DEDLENNVLGLPSWFIEDENKHNKPELP

SEQ ID NO: 2187849 - protein, 31 aa, Cryptosporidium hominis
DEDRAALLELLFKSTIPISGLYNSKPKNIYL

SEQ ID NO: 2187850 - protein, 18 aa, Cryptosporidium hominis
DEDTVAGFLLTGIGARDP

SEQ ID NO: 2187851 - protein, 25 aa, Cryptosporidium hominis
DEDVDLLRRYIPPPVYRCLSSGYNV

SEQ ID NO: 2187852 - protein, 25 aa, Cryptosporidium hominis
DEEAKKIWLKYLPEDRILSCGSKEN

SEQ ID NO: 2187853 - protein, 26 aa, Cryptosporidium hominis
DEEDWQIWYLLSWCSLVSEDVSGAIE

SEQ ID NO: 2187854 - protein, 30 aa, Cryptosporidium hominis
DEEETPPPLPPPLSPPSPPSPPLPEELPPP

SEQ ID NO: 2187855 - protein, 30 aa, Cryptosporidium hominis
DEEFYQHLKELLVVASLYENYRNFQNQCNE

SEQ ID NO: 2187856 - protein, 23 aa, Cryptosporidium hominis
DEEIPVLSRWFPKDSPPASQLIK

SEQ ID NO: 2187857 - protein, 27 aa, Cryptosporidium hominis
DEERDIDILFFLDYRTPHYSLSPQLEE

SEQ ID NO: 2187858 - protein, 32 aa, Cryptosporidium hominis
DEERLRGILLDHFLIQISQIRIVRDPKGKPKG

SEQ ID NO: 2187859 - protein, 29 aa, Cryptosporidium hominis
DEETLLLLQEVLKYHYSGGEGTFINLGTP

SEQ ID NO: 2187860 - protein, 26 aa, Cryptosporidium hominis
DEGGLLFCVTFKMISFRPYVGEVIEG

SEQ ID NO: 2187861 - protein, 23 aa, Cryptosporidium hominis
DEIKGMLFANYKNIDFAQQKVSP

SEQ ID NO: 2187862 - protein, 29 aa, Cryptosporidium hominis
DEIPKLNYIHYILAIIQRINEIDFKLLEY

SEQ ID NO: 2187863 - protein, 26 aa, Cryptosporidium hominis
DEIPRFFKDIGYPITINKTTIIAPGA

SEQ ID NO: 2187864 - protein, 33 aa, Cryptosporidium hominis
DEIPRSILYYETPQYCYSLLRCLHRVLCCCPRI

SEQ ID NO: 2187865 - protein, 19 aa, Cryptosporidium hominis
DEISHLRYRNALEIERSNH

SEQ ID NO: 2187866 - protein, 34 aa, Cryptosporidium hominis
DEITSYLPIVLALRRWQLSFCSKLHGVSFGSFYR

SEQ ID NO: 2187867 - protein, 23 aa, Cryptosporidium hominis
DEITTRIKDEIRKGLVDCSTDTE

SEQ ID NO: 2187868 - protein, 25 aa, Cryptosporidium hominis
DEKEAFPDDKLLPIYSRVVIQRIPW

SEQ ID NO: 2187869 - protein, 41 aa, Cryptosporidium hominis
DEKIKPFDMLIPFVNESGQIKFVTRRRLRQLVKSGLSKGFS

SEQ ID NO: 2187870 - protein, 20 aa, Cryptosporidium hominis
DEKKPFFFKSKYDNFDYKRY

SEQ ID NO: 2187871 - protein, 23 aa, Cryptosporidium hominis
DEKRDRWRGFRPEDYKPIIEQFE

SEQ ID NO: 2187872 - protein, 23 aa, Cryptosporidium hominis
DELDLPCLVLGTVYGMKLNRGYN

SEQ ID NO: 2187873 - protein, 27 aa, Cryptosporidium hominis
DELDYYLVTCKPGYFLKGLHVFSNTSE

SEQ ID NO: 2187874 - protein, 27 aa, Cryptosporidium hominis
DELFPSWEYGLSLPLPVPFNHPDLLLN

SEQ ID NO: 2187875 - protein, 17 aa, Cryptosporidium hominis
DELIPSCDIISFFDIFL

SEQ ID NO: 2187876 - protein, 30 aa, Cryptosporidium hominis
DELKSQSGLITRLSLFKNIHPLYESSDPSL

SEQ ID NO: 2187877 - protein, 25 aa, Cryptosporidium hominis
DELMIKAISGIHKYFLNKAFEHESE

SEQ ID NO: 2187878 - protein, 23 aa, Cryptosporidium hominis
DELQLEVSKVWKGIESPFSPKKI

SEQ ID NO: 2187879 - protein, 24 aa, Cryptosporidium hominis
DELRMRENIDFRLKPPLESIHMCD

SEQ ID NO: 2187880 - protein, 38 aa, Cryptosporidium hominis
DELRNSIIRLVPKEQLNSVFFLVSSLISKSINFRDFHV

SEQ ID NO: 2187881 - protein, 17 aa, Cryptosporidium hominis
DELRRVKSELDFCKGHD

SEQ ID NO: 2187882 - protein, 26 aa, Cryptosporidium hominis
DELYNYFMRHLTEKILINFKGKNSIS

SEQ ID NO: 2187883 - protein, 23 aa, Cryptosporidium hominis
DENEIIEWKVLKKALRKEIVLKG

SEQ ID NO: 2187884 - protein, 25 aa, Cryptosporidium hominis
DENEKFLRNYILNQEWKESNNQKRI

SEQ ID NO: 2187885 - protein, 25 aa, Cryptosporidium hominis
DENIAKMITFNPGILARTVTLNGDI

SEQ ID NO: 2187886 - protein, 25 aa, Cryptosporidium hominis
DENIVIIIDLFYLKSMKIWKIDHEL

SEQ ID NO: 2187887 - protein, 35 aa, Cryptosporidium hominis
DENNTIHVNLPPKYPFKYLMLISFDENKNTSPVFF

SEQ ID NO: 2187888 - protein, 22 aa, Cryptosporidium hominis
DENRLRIRKLYEKKLHDRKLRI

SEQ ID NO: 2187889 - protein, 26 aa, Cryptosporidium hominis
DENTGLPFYLPLLDYAGKEEMKAYFK

SEQ ID NO: 2187890 - protein, 26 aa, Cryptosporidium hominis
DEPQFKTVLVLTLNKPLIGKTFKQEA

SEQ ID NO: 2187891 - protein, 30 aa, Cryptosporidium hominis
DEQEKSFIFELLYIKRKLSLVLDLDNTLIH

SEQ ID NO: 2187892 - protein, 26 aa, Cryptosporidium hominis
DEQRYTHLLPLTQWNKSYVGGSELLL

SEQ ID NO: 2187893 - protein, 23 aa, Cryptosporidium hominis
DERENFTVYLQMPEGLLVFSQSI

SEQ ID NO: 2187894 - protein, 26 aa, Cryptosporidium hominis
DERTQIWGFAALRFLIRSSLNACNEF

SEQ ID NO: 2187895 - protein, 17 aa, Cryptosporidium hominis
DESIYSEQIFTLSTALG

SEQ ID NO: 2187896 - protein, 26 aa, Cryptosporidium hominis
DESKTKIKYLEEKFAMIIKDKEEEFE

SEQ ID NO: 2187897 - protein, 26 aa, Cryptosporidium hominis
DESLRERIQILEKVRANLLRIISIKS

SEQ ID NO: 2187898 - protein, 25 aa, Cryptosporidium hominis
DESRKFFLIGYEQFLLTAAPIISRL

SEQ ID NO: 2187899 - protein, 26 aa, Cryptosporidium hominis
DETIILKFVVLSIWLVELNSFVSFSQ

SEQ ID NO: 2187900 - protein, 24 aa, Cryptosporidium hominis
DETKLTLHGLLQYYVKLGESEKNR

SEQ ID NO: 2187901 - protein, 18 aa, Cryptosporidium hominis
DETLMCSFQILKPVEKKK

SEQ ID NO: 2187902 - protein, 25 aa, Cryptosporidium hominis
DETSRFLIYTCMIGICVLDIKIGKR

SEQ ID NO: 2187903 - protein, 30 aa, Cryptosporidium hominis
DETYGLPIDTLTGYPLDPVSLIPFNPETGE

SEQ ID NO: 2187904 - protein, 23 aa, Cryptosporidium hominis
DEVFNFLIDNFQIETTFIFVNDQ

SEQ ID NO: 2187905 - protein, 31 aa, Cryptosporidium hominis
DEYAVECLCQLIMTTGYYLDSNEKSQMIVDQ

SEQ ID NO: 2187906 - protein, 17 aa, Cryptosporidium hominis
DEYLFINQNLCGLKPII

SEQ ID NO: 2187907 - protein, 20 aa, Cryptosporidium hominis
DEYTPFLERGIHAGTSVIPS

SEQ ID NO: 2187908 - protein, 21 aa, Cryptosporidium hominis
DFAIQFLSFHIKDCHFVKEME

SEQ ID NO: 2187909 - protein, 18 aa, Cryptosporidium hominis
DFAPFNQNLSVDGSFLLG

SEQ ID NO: 2187910 - protein, 23 aa, Cryptosporidium hominis
DFAPLSHIFPGCIVSITATELAE

SEQ ID NO: 2187911 - protein, 24 aa, Cryptosporidium hominis
DFASRMFIRLWKTSALTGKNIRHV

SEQ ID NO: 2187912 - protein, 18 aa, Cryptosporidium hominis
DFDCLFGKGFLLEIPEIV

SEQ ID NO: 2187913 - protein, 17 aa, Cryptosporidium hominis
DFDIGIFDSCLCTCNSG

SEQ ID NO: 2187914 - protein, 21 aa, Cryptosporidium hominis
DFDSYISFVIFIINYGNYFRN

SEQ ID NO: 2187915 - protein, 26 aa, Cryptosporidium hominis
DFEEEWFEGFLKSRKFPLLTPFGCKN

SEQ ID NO: 2187916 - protein, 18 aa, Cryptosporidium hominis
DFELQIPGLLFIDTPGHE

SEQ ID NO: 2187917 - protein, 19 aa, Cryptosporidium hominis
DFELSYTRYTQGVELLCWV

SEQ ID NO: 2187918 - protein, 25 aa, Cryptosporidium hominis
DFEPFKPINTSLYLCDNKFHVDALK

SEQ ID NO: 2187919 - protein, 23 aa, Cryptosporidium hominis
DFEVIISPLLRRPCSNYGKELES

SEQ ID NO: 2187920 - protein, 23 aa, Cryptosporidium hominis
DFGSLLLRRLINQFRISYSKGDK

SEQ ID NO: 2187921 - protein, 21 aa, Cryptosporidium hominis
DFGVAKFLRQGYTQARTLVGT

SEQ ID NO: 2187922 - protein, 31 aa, Cryptosporidium hominis
DFHPEILIRDFPFIHHLGINVPKKHLQMLRS

SEQ ID NO: 2187923 - protein, 26 aa, Cryptosporidium hominis
DFHSITPSLSYLIQKNFENPTNGCHT

SEQ ID NO: 2187924 - protein, 17 aa, Cryptosporidium hominis
DFIIRESGALQSMQWKH

SEQ ID NO: 2187925 - protein, 22 aa, Cryptosporidium hominis
DFIKAFLLGFELQDAIALLRLD

SEQ ID NO: 2187926 - protein, 30 aa, Cryptosporidium hominis
DFILKEYFTDYFSIYKLFISTRENLYSQRE

SEQ ID NO: 2187927 - protein, 30 aa, Cryptosporidium hominis
DFIQEYLPLFAFFMKLSIRVHFDMISHPNN

SEQ ID NO: 2187928 - protein, 17 aa, Cryptosporidium hominis
DFIQKVPTKIYWGELNP

SEQ ID NO: 2187929 - protein, 20 aa, Cryptosporidium hominis
DFKIINIYVPPFQIIDTVEI

SEQ ID NO: 2187930 - protein, 18 aa, Cryptosporidium hominis
DFKNLVIIGPRKVEKLYN

SEQ ID NO: 2187931 - protein, 30 aa, Cryptosporidium hominis
DFKTAQANPLLLLTPRYKPTLRSETFNEFN

SEQ ID NO: 2187932 - protein, 20 aa, Cryptosporidium hominis
DFKYPLPRCVLKPRLGGSLK

SEQ ID NO: 2187933 - protein, 24 aa, Cryptosporidium hominis
DFLKLRNEALLNQGLWYSSLSEED

SEQ ID NO: 2187934 - protein, 19 aa, Cryptosporidium hominis
DFLRGYLERLKRSDFLNLS

SEQ ID NO: 2187935 - protein, 40 aa, Cryptosporidium hominis
DFMEREEKWWESIYNYYSQIYIPGYLFGMISTRLTVDDCQ

SEQ ID NO: 2187936 - protein, 25 aa, Cryptosporidium hominis
DFNDTQMLALLRPSLEETFEFFSQD

SEQ ID NO: 2187937 - protein, 35 aa, Cryptosporidium hominis
DFPKTTMKFSLRRNRLLLWRSIKCQIWKTQYIEYC

SEQ ID NO: 2187938 - protein, 18 aa, Cryptosporidium hominis
DFRDNSLILLLAGSLRNR

SEQ ID NO: 2187939 - protein, 22 aa, Cryptosporidium hominis
DFSAPLLNYLNDGLSSDSWGSF

SEQ ID NO: 2187940 - protein, 33 aa, Cryptosporidium hominis
DFSIYIYDSGFKQKLLDILSIRPNQYGERITSI

SEQ ID NO: 2187941 - protein, 24 aa, Cryptosporidium hominis
DFTFKKDLLLIKRRIILFKIEQGS

SEQ ID NO: 2187942 - protein, 38 aa, Cryptosporidium hominis
DFTKIFETLIPEIFLYILKLWLLCWPSPISLCSIDERF

SEQ ID NO: 2187943 - protein, 28 aa, Cryptosporidium hominis
DFTSMITYLCRSCFLPEIFSTNSKLSNF

SEQ ID NO: 2187944 - protein, 29 aa, Cryptosporidium hominis
DFTSRILEPILIPLSVNLRHFITSSFTDN

SEQ ID NO: 2187945 - protein, 19 aa, Cryptosporidium hominis
DFVAWFMYTQTDLQIHPIK

SEQ ID NO: 2187946 - protein, 25 aa, Cryptosporidium hominis
DFVCQILELLGLILYEHQKKLTENT

SEQ ID NO: 2187947 - protein, 34 aa, Cryptosporidium hominis
DFVDRGYYSVETFLLLIALKVRYPDRIMLIRGNH

SEQ ID NO: 2187948 - protein, 21 aa, Cryptosporidium hominis
DFVIEIFKKCAENYPLSGGVP

SEQ ID NO: 2187949 - protein, 19 aa, Cryptosporidium hominis
DFVLLSGFGFSAAVPVDTH

SEQ ID NO: 2187950 - protein, 17 aa, Cryptosporidium hominis
DFYGWLCDRCEFEKKFL

SEQ ID NO: 2187951 - protein, 23 aa, Cryptosporidium hominis
DFYPLLLDPLKGLTGLNSIINID

SEQ ID NO: 2187952 - protein, 25 aa, Cryptosporidium hominis
DFYSLHRRIAGFFIICSRLGAAINS

SEQ ID NO: 2187953 - protein, 25 aa, Cryptosporidium hominis
DGADPLMILPIYSQLPSDLQAKIFK

SEQ ID NO: 2187954 - protein, 32 aa, Cryptosporidium hominis
DGATGQPFIPFALSFLMNVGDSYGISFFTTSI

SEQ ID NO: 2187955 - protein, 24 aa, Cryptosporidium hominis
DGDKPLATLIITVAPKPGNSMLPA

SEQ ID NO: 2187956 - protein, 23 aa, Cryptosporidium hominis
DGDMLSIYLFSYSEQIRIAQFEI

SEQ ID NO: 2187957 - protein, 23 aa, Cryptosporidium hominis
DGDSWRLYDLITRHFFATISNDI

SEQ ID NO: 2187958 - protein, 26 aa, Cryptosporidium hominis
DGEELPQRFVLTPIVEKFLKRRPQMK

SEQ ID NO: 2187959 - protein, 21 aa, Cryptosporidium hominis
DGEILFTSPSYRMSPNNTIRR

SEQ ID NO: 2187960 - protein, 24 aa, Cryptosporidium hominis
DGESMYLWLGRAIPTTFIQQVFGV

SEQ ID NO: 2187961 - protein, 17 aa, Cryptosporidium hominis
DGEWLILGSQDGSIRQW

SEQ ID NO: 2187962 - protein, 17 aa, Cryptosporidium hominis
DGFWLAVGVGNLLIVFE

SEQ ID NO: 2187963 - protein, 25 aa, Cryptosporidium hominis
DGGTSTYMTLLKKLLEAQLTIEGGN

SEQ ID NO: 2187964 - protein, 20 aa, Cryptosporidium hominis
DGHYTIHWSNTSDLSSYLYG

SEQ ID NO: 2187965 - protein, 31 aa, Cryptosporidium hominis
DGINCTLPVNTLMPLVKWRPSSHFQNNQIEL

SEQ ID NO: 2187966 - protein, 25 aa, Cryptosporidium hominis
DGINSLLYEFWIKKFYSITNVEISR

SEQ ID NO: 2187967 - protein, 23 aa, Cryptosporidium hominis
DGIVFYEPKIRVPIYLTSSAINK

SEQ ID NO: 2187968 - protein, 17 aa, Cryptosporidium hominis
DGKKIMRRILSKDRLKP

SEQ ID NO: 2187969 - protein, 24 aa, Cryptosporidium hominis
DGKVSFVEFIIGLARLAVGSNPEE

SEQ ID NO: 2187970 - protein, 34 aa, Cryptosporidium hominis
DGLREYLVEKIWPRQPKLRLLYRDHVTTFVDTRI

SEQ ID NO: 2187971 - protein, 17 aa, Cryptosporidium hominis
DGNLFKEFFELPNGCVC

SEQ ID NO: 2187972 - protein, 30 aa, Cryptosporidium hominis
DGQINLPLCGLLIYFISSLIHRSPIFNLSE

SEQ ID NO: 2187973 - protein, 36 aa, Cryptosporidium hominis
DGQKRLCHIRGKMRKKVWVNPGDIVLVSLRDFQDSK

SEQ ID NO: 2187974 - protein, 23 aa, Cryptosporidium hominis
DGQLAPFCPIIDDENAFFSKNKI

SEQ ID NO: 2187975 - protein, 17 aa, Cryptosporidium hominis
DGQLFITSGWDGNIKIW

SEQ ID NO: 2187976 - protein, 26 aa, Cryptosporidium hominis
DGQYEYYVVRAWVRNARRIQIKAIDY

SEQ ID NO: 2187977 - protein, 33 aa, Cryptosporidium hominis
DGRVNPMRFRHGVGIWELFIPHLGPGEKYGYEI

SEQ ID NO: 2187978 - protein, 19 aa, Cryptosporidium hominis
DGTIRYWNLAGSRRCEYMI

SEQ ID NO: 2187979 - protein, 24 aa, Cryptosporidium hominis
DGTNKGYCFIEFLGKLEAISALEQ

SEQ ID NO: 2187980 - protein, 27 aa, Cryptosporidium hominis
DGTVLLKFCFIVWPSLNNTKTEIDALS

SEQ ID NO: 2187981 - protein, 22 aa, Cryptosporidium hominis
DGTYIYEKFLPTFGTDIKVYTV

SEQ ID NO: 2187982 - protein, 22 aa, Cryptosporidium hominis
DGVFSHEFILNYIKLKRDEVVL

SEQ ID NO: 2187983 - protein, 22 aa, Cryptosporidium hominis
DGYEPYIKYLQALSLSWSSCQA

SEQ ID NO: 2187984 - protein, 20 aa, Cryptosporidium hominis
DGYVLFFKICDDMKIELSSY

SEQ ID NO: 2187985 - protein, 27 aa, Cryptosporidium hominis
DHDKRPIWVFPDGLIIIETFHQSSKAA

SEQ ID NO: 2187986 - protein, 23 aa, Cryptosporidium hominis
DHEPSWLIYPLKNYGIRVQDNSD

SEQ ID NO: 2187987 - protein, 17 aa, Cryptosporidium hominis
DHEYLFQLNNFLNIECI

SEQ ID NO: 2187988 - protein, 20 aa, Cryptosporidium hominis
DHFNGKIHVGYLKIRKQAKD

SEQ ID NO: 2187989 - protein, 22 aa, Cryptosporidium hominis
DHFNVKWDILQTLDLSYYQFKY

SEQ ID NO: 2187990 - protein, 28 aa, Cryptosporidium hominis
DHHIFRLRIIQKFDWPLPLLFTKKNMEH

SEQ ID NO: 2187991 - protein, 25 aa, Cryptosporidium hominis
DHHNKTYILPCLYPGIYSTNIPCLA

SEQ ID NO: 2187992 - protein, 21 aa, Cryptosporidium hominis
DHKFTPGFLFVSMDVSRALVR

SEQ ID NO: 2187993 - protein, 23 aa, Cryptosporidium hominis
DHLEGIVHYQISPSLPGMKHANN

SEQ ID NO: 2187994 - protein, 20 aa, Cryptosporidium hominis
DHLHFFKFIGRIIGKCIYDG

SEQ ID NO: 2187995 - protein, 21 aa, Cryptosporidium hominis
DHLLPWYHYKNTISNLRVIVL

SEQ ID NO: 2187996 - protein, 21 aa, Cryptosporidium hominis
DHLVDFFLGKVLRSSNSLFYI

SEQ ID NO: 2187997 - protein, 20 aa, Cryptosporidium hominis
DHPLFLKYKGFQSELVDLVE

SEQ ID NO: 2187998 - protein, 24 aa, Cryptosporidium hominis
DHSDPLHTFLSISALSLIFNSDSE

SEQ ID NO: 2187999 - protein, 22 aa, Cryptosporidium hominis
DHSIPVILPKRLEGKIKDVLEN

SEQ ID NO: 2188000 - protein, 23 aa, Cryptosporidium hominis
DHSVSILLNTLRAIDDRVRWMST

SEQ ID NO: 2188001 - protein, 23 aa, Cryptosporidium hominis
DHSYVDIYITVRNIPVKSIEDIE

SEQ ID NO: 2188002 - protein, 25 aa, Cryptosporidium hominis
DHVDFETPFTRKHAYMRNELVFCNK

SEQ ID NO: 2188003 - protein, 18 aa, Cryptosporidium hominis
DHVPFNISLLRTGQDKQN

SEQ ID NO: 2188004 - protein, 24 aa, Cryptosporidium hominis
DHYKLKALDFRMVDFIKAAINPDT

SEQ ID NO: 2188005 - protein, 31 aa, Cryptosporidium hominis
DIAALTIRCLNIRHTISLEAIIGGGVSWIPK

SEQ ID NO: 2188006 - protein, 27 aa, Cryptosporidium hominis
DIAKHHGFPGIFFNGAVLIGPNGIDDI

SEQ ID NO: 2188007 - protein, 32 aa, Cryptosporidium hominis
DIARSLKRPPAYPTKFFGCELGALSKWEDKEE

SEQ ID NO: 2188008 - protein, 26 aa, Cryptosporidium hominis
DIASRNVFILDPILGNGFGVFSAIKY

SEQ ID NO: 2188009 - protein, 23 aa, Cryptosporidium hominis
DIAYNYYIDLFKYNLAINEIKKE

SEQ ID NO: 2188010 - protein, 26 aa, Cryptosporidium hominis
DICFDLNMTLFLAWSPKEAGHILETL

SEQ ID NO: 2188011 - protein, 26 aa, Cryptosporidium hominis
DICPIDRLFTLKPVDKFPLTIDEILG

SEQ ID NO: 2188012 - protein, 23 aa, Cryptosporidium hominis
DICRFKLTWPLQKSLEIADEEMK

SEQ ID NO: 2188013 - protein, 19 aa, Cryptosporidium hominis
DIDDQLEISIYYKLKNSSN

SEQ ID NO: 2188014 - protein, 26 aa, Cryptosporidium hominis
DIDILKGIYIYGFSNWTMMSMDENLS

SEQ ID NO: 2188015 - protein, 17 aa, Cryptosporidium hominis
DIDKIIRFSICSSSLQM

SEQ ID NO: 2188016 - protein, 28 aa, Cryptosporidium hominis
DIDMLNNQLEWVRRYSPQVYEAMLENTY

SEQ ID NO: 2188017 - protein, 18 aa, Cryptosporidium hominis
DIDQSLIGIIIFSLTNNI

SEQ ID NO: 2188018 - protein, 23 aa, Cryptosporidium hominis
DIDYESFNLLKQFAKNIIKNNPS

SEQ ID NO: 2188019 - protein, 26 aa, Cryptosporidium hominis
DIDYQVLHDAFFIYSTKPHLTQFGDL

SEQ ID NO: 2188020 - protein, 24 aa, Cryptosporidium hominis
DIECFTFLNRTLESSLAPIVIFGT

SEQ ID NO: 2188021 - protein, 20 aa, Cryptosporidium hominis
DIEGKILKQLDYNDGNENEI

SEQ ID NO: 2188022 - protein, 17 aa, Cryptosporidium hominis
DIFQDYLKPFLSRYTFH

SEQ ID NO: 2188023 - protein, 30 aa, Cryptosporidium hominis
DIFSNAFFVSLAIDLPLISKLSLLETNYEN

SEQ ID NO: 2188024 - protein, 25 aa, Cryptosporidium hominis
DIGKCALLMRNVAFQVVFDIMCILS

SEQ ID NO: 2188025 - protein, 18 aa, Cryptosporidium hominis
DIGQLMIEYIAVWGIINE

SEQ ID NO: 2188026 - protein, 17 aa, Cryptosporidium hominis
DIHGMAVVLILGSYRNE

SEQ ID NO: 2188027 - protein, 26 aa, Cryptosporidium hominis
DIHGQYYDLLRLFEYGGFPPDTNYLF

SEQ ID NO: 2188028 - protein, 25 aa, Cryptosporidium hominis
DIHGQYYDLMRLFHNYKAPISEELE

SEQ ID NO: 2188029 - protein, 23 aa, Cryptosporidium hominis
DIHTLTNLIKFKTNLYHLREERE

SEQ ID NO: 2188030 - protein, 17 aa, Cryptosporidium hominis
DIIEDEIRYIYLNQILS

SEQ ID NO: 2188031 - protein, 26 aa, Cryptosporidium hominis
DIIISEWMGYLLLYESMLDTVLFCRD

SEQ ID NO: 2188032 - protein, 19 aa, Cryptosporidium hominis
DIKIPKILLSTASKFNDDL

SEQ ID NO: 2188033 - protein, 19 aa, Cryptosporidium hominis
DIKPDNFLIGRGKKLNVVY

SEQ ID NO: 2188034 - protein, 18 aa, Cryptosporidium hominis
DIKPDNILLYPNPSFCEE

SEQ ID NO: 2188035 - protein, 23 aa, Cryptosporidium hominis
DIKRKEIMDSLFACQVGDNGNNS

SEQ ID NO: 2188036 - protein, 18 aa, Cryptosporidium hominis
DIKRWIYHSIEFTCNSIP

SEQ ID NO: 2188037 - protein, 24 aa, Cryptosporidium hominis
DIKTKNILTLLAYGLHIQTDSSVW

SEQ ID NO: 2188038 - protein, 20 aa, Cryptosporidium hominis
DIKVIIRQLLSSLEYCHLNN

SEQ ID NO: 2188039 - protein, 18 aa, Cryptosporidium hominis
DIKYLLYSYIRAETTRYV

SEQ ID NO: 2188040 - protein, 39 aa, Cryptosporidium hominis
DILAMLELPSEFIPPALELYPLPFPKIGGVKSPKLALET

SEQ ID NO: 2188041 - protein, 32 aa, Cryptosporidium hominis
DILEESAALFYSRWFDFELLRSANLKEVIISI

SEQ ID NO: 2188042 - protein, 21 aa, Cryptosporidium hominis
DILLLSSYKWVATNPSLLLDK

SEQ ID NO: 2188043 - protein, 20 aa, Cryptosporidium hominis
DILSDWRNSTLLKSHSDMVI

SEQ ID NO: 2188044 - protein, 18 aa, Cryptosporidium hominis
DILSWFGLSNKSAKILFL

SEQ ID NO: 2188045 - protein, 18 aa, Cryptosporidium hominis
DILVRIARLFGFNTRFQT

SEQ ID NO: 2188046 - protein, 18 aa, Cryptosporidium hominis
DILYKSMTFYLQEHPELL

SEQ ID NO: 2188047 - protein, 19 aa, Cryptosporidium hominis
DIMNVFALSPNGKLVSFVN

SEQ ID NO: 2188048 - protein, 20 aa, Cryptosporidium hominis
DIMSKYKCFLHELKLKLIEI

SEQ ID NO: 2188049 - protein, 23 aa, Cryptosporidium hominis
DINCKLLNLLTILNEVELSNMWV

SEQ ID NO: 2188050 - protein, 20 aa, Cryptosporidium hominis
DINRLWIRNLGRDCRLALFN

SEQ ID NO: 2188051 - protein, 24 aa, Cryptosporidium hominis
DIPDIKGIPVEELIILSSSGILPN

SEQ ID NO: 2188052 - protein, 19 aa, Cryptosporidium hominis
DIPILDKLQRIILSESPRL

SEQ ID NO: 2188053 - protein, 26 aa, Cryptosporidium hominis
DIPIYKINISPWGGLSLPIIQRIIRL

SEQ ID NO: 2188054 - protein, 25 aa, Cryptosporidium hominis
DIPPHVQIPKYYEGIKISLGEAGRE

SEQ ID NO: 2188055 - protein, 26 aa, Cryptosporidium hominis
DIPPNTMINPLLLSLKPDESPYMIET

SEQ ID NO: 2188056 - protein, 19 aa, Cryptosporidium hominis
DIPSYISYLDITKFFNSDF

SEQ ID NO: 2188057 - protein, 17 aa, Cryptosporidium hominis
DIPVFLPSSEPSPIEFS

SEQ ID NO: 2188058 - protein, 23 aa, Cryptosporidium hominis
DIQQIFSNCYLYNKPDSSVSILC

SEQ ID NO: 2188059 - protein, 23 aa, Cryptosporidium hominis
DIQRTMLELLNQLDGFEARGDVK

SEQ ID NO: 2188060 - protein, 21 aa, Cryptosporidium hominis
DIRLNILNRYSPFSRIVNLGD

SEQ ID NO: 2188061 - protein, 24 aa, Cryptosporidium hominis
DISFWDTYRFEGNSQWIPIKNNNK

SEQ ID NO: 2188062 - protein, 22 aa, Cryptosporidium hominis
DISGFFYSIINKIITLDPNDSH

SEQ ID NO: 2188063 - protein, 20 aa, Cryptosporidium hominis
DISIILNYLNNFNLITSFFE

SEQ ID NO: 2188064 - protein, 28 aa, Cryptosporidium hominis
DISIPIIKFVPILLRREVYSKWLEVILN

SEQ ID NO: 2188065 - protein, 21 aa, Cryptosporidium hominis
DISLIVIKSFLALRRKNLSEK

SEQ ID NO: 2188066 - protein, 18 aa, Cryptosporidium hominis
DISMLTCFLIILVNVINY

SEQ ID NO: 2188067 - protein, 20 aa, Cryptosporidium hominis
DISRAIGILNWKPTVDIKTG

SEQ ID NO: 2188068 - protein, 34 aa, Cryptosporidium hominis
DISSKIIRHRALIGIQAEIILKDGSTTDCKVSFS

SEQ ID NO: 2188069 - protein, 45 aa, Cryptosporidium hominis
DISYINKWEDLIQILVYEVVSRFVYGIGIPKQKIINFSKTQRRRN

SEQ ID NO: 2188070 - protein, 17 aa, Cryptosporidium hominis
DIVLGILELLKYHARVM

SEQ ID NO: 2188071 - protein, 25 aa, Cryptosporidium hominis
DIVSNIYRRGLIEIPPANDAYYGRR

SEQ ID NO: 2188072 - protein, 18 aa, Cryptosporidium hominis
DIWELYNLILSGDSVRSV

SEQ ID NO: 2188073 - protein, 19 aa, Cryptosporidium hominis
DIWGLLPKSIRSSLLQETQ

SEQ ID NO: 2188074 - protein, 22 aa, Cryptosporidium hominis
DIWSFGCVLYELTCLKPPFSGD

SEQ ID NO: 2188075 - protein, 17 aa, Cryptosporidium hominis
DIYKLETFFSGSETQFK

SEQ ID NO: 2188076 - protein, 19 aa, Cryptosporidium hominis
DIYLQFNALILQIVQTYID

SEQ ID NO: 2188077 - protein, 20 aa, Cryptosporidium hominis
DIYRRVDFLIKAFKKRDLNN

SEQ ID NO: 2188078 - protein, 30 aa, Cryptosporidium hominis
DIYVQGKLLKALFDKLYGEWALLSRQTQED

SEQ ID NO: 2188079 - protein, 24 aa, Cryptosporidium hominis
DKAVKVWHVLSGRLLRCFSTPTMT

SEQ ID NO: 2188080 - protein, 18 aa, Cryptosporidium hominis
DKCIGNRIYVVMKGDKEF

SEQ ID NO: 2188081 - protein, 21 aa, Cryptosporidium hominis
DKEGKFIERESKLVEKENKLI

SEQ ID NO: 2188082 - protein, 23 aa, Cryptosporidium hominis
DKEPILFKRIYLWREEAKIQVSK

SEQ ID NO: 2188083 - protein, 24 aa, Cryptosporidium hominis
DKGRYICISYGQPNYRLNYLKSMK

SEQ ID NO: 2188084 - protein, 23 aa, Cryptosporidium hominis
DKGTIYYVKPYIRNMTQLLNEIN

SEQ ID NO: 2188085 - protein, 28 aa, Cryptosporidium hominis
DKICTKMLKYLPFGKLPFEPMTSPHQKV

SEQ ID NO: 2188086 - protein, 22 aa, Cryptosporidium hominis
DKIRLYMMSLSRYGKSPFIYPV

SEQ ID NO: 2188087 - protein, 20 aa, Cryptosporidium hominis
DKKALTWGLGLQGRLGHGDT

SEQ ID NO: 2188088 - protein, 29 aa, Cryptosporidium hominis
DKKNFKLVKPPFSIIHLKAISRIYGDNGP

SEQ ID NO: 2188089 - protein, 24 aa, Cryptosporidium hominis
DKKNWSPLVPLIPSILETLQNLIS

SEQ ID NO: 2188090 - protein, 25 aa, Cryptosporidium hominis
DKKSPLDFALWKKAKPEEPCWDSPW

SEQ ID NO: 2188091 - protein, 40 aa, Cryptosporidium hominis
DKLFGNFLSSLYRISRIKLISFTWRKIVLNAKFSSFKTLP

SEQ ID NO: 2188092 - protein, 23 aa, Cryptosporidium hominis
DKLGTRPIIKCRELALMGVKEVF

SEQ ID NO: 2188093 - protein, 50 aa, Cryptosporidium hominis
DKLLKAHSIGPPFLVRLMRYNLLENKFPNFFDFGVNLTLPASFQVSEYRL

SEQ ID NO: 2188094 - protein, 25 aa, Cryptosporidium hominis
DKLLKILLAYFTGFLPWIHIEEHVL

SEQ ID NO: 2188095 - protein, 18 aa, Cryptosporidium hominis
DKLLPNQILFIDDDIRNC

SEQ ID NO: 2188096 - protein, 18 aa, Cryptosporidium hominis
DKLPPMHDWQFYDKKRIM

SEQ ID NO: 2188097 - protein, 20 aa, Cryptosporidium hominis
DKMFSCFKATPLNKISVVIL

SEQ ID NO: 2188098 - protein, 36 aa, Cryptosporidium hominis
DKNDDYFMMNFLHDKYKEVYMWLDKPFNESEFSNFT

SEQ ID NO: 2188099 - protein, 30 aa, Cryptosporidium hominis
DKNEVINSPWLFFSIRILDGYDTFCSDFIA

SEQ ID NO: 2188100 - protein, 22 aa, Cryptosporidium hominis
DKNGCWMLSFFLGEYNLRKQVL

SEQ ID NO: 2188101 - protein, 20 aa, Cryptosporidium hominis
DKPQPGSLSSGGYGPSVIVR

SEQ ID NO: 2188102 - protein, 33 aa, Cryptosporidium hominis
DKQCDMWSLGVILYILLCGYPPFHGSNDSIILH

SEQ ID NO: 2188103 - protein, 27 aa, Cryptosporidium hominis
DKQIFCTQYLPHLLTSIKAHGDSSTNI

SEQ ID NO: 2188104 - protein, 25 aa, Cryptosporidium hominis
DKQKRLELAILGMNPLDYEGGIRNP

SEQ ID NO: 2188105 - protein, 23 aa, Cryptosporidium hominis
DKRDILLNVFYKNQLIHLIRQNI

SEQ ID NO: 2188106 - protein, 19 aa, Cryptosporidium hominis
DKRILIKKCVPICQRLFYS

SEQ ID NO: 2188107 - protein, 25 aa, Cryptosporidium hominis
DKRQRLLRVLTISIPVTTSITTAFR

SEQ ID NO: 2188108 - protein, 25 aa, Cryptosporidium hominis
DKRTGMPKGFAYLEFCEPEAVETAL

SEQ ID NO: 2188109 - protein, 21 aa, Cryptosporidium hominis
DKSILTIYVIPDTATVKKPKQ

SEQ ID NO: 2188110 - protein, 23 aa, Cryptosporidium hominis
DKSKLTMLVGGLTAMAFGIYGAK

SEQ ID NO: 2188111 - protein, 28 aa, Cryptosporidium hominis
DKSKNILCKAFWKILRSYEISASISLIE

SEQ ID NO: 2188112 - protein, 18 aa, Cryptosporidium hominis
DKSNLIFIGTLLDSNKLF

SEQ ID NO: 2188113 - protein, 23 aa, Cryptosporidium hominis
DKSTNYLIYDKLIKDAVKSCLSG

SEQ ID NO: 2188114 - protein, 24 aa, Cryptosporidium hominis
DKTGFLINITLWGELAEVSDEKFL

SEQ ID NO: 2188115 - protein, 27 aa, Cryptosporidium hominis
DKTGNCRVIYWKDLYKSGVISQLMFSY

SEQ ID NO: 2188116 - protein, 27 aa, Cryptosporidium hominis
DKVLTTSFLRKYIHYCKYVRNTPKLTD

SEQ ID NO: 2188117 - protein, 21 aa, Cryptosporidium hominis
DKYANLFDRNIGSKGFGGILD

SEQ ID NO: 2188118 - protein, 20 aa, Cryptosporidium hominis
DKYIKLLEIASRYLNPLHFA

SEQ ID NO: 2188119 - protein, 29 aa, Cryptosporidium hominis
DKYKDLFTELIFNLLVNFDFEASQKILNS

SEQ ID NO: 2188120 - protein, 21 aa, Cryptosporidium hominis
DKYKFFGLDLINGTVRDNVQA

SEQ ID NO: 2188121 - protein, 25 aa, Cryptosporidium hominis
DKYLSEIPHFKLFRKGNCSNGIREV

SEQ ID NO: 2188122 - protein, 26 aa, Cryptosporidium hominis
DLAMNPVDYILLLRLISTTDDTKILN

SEQ ID NO: 2188123 - protein, 17 aa, Cryptosporidium hominis
DLAQHFLVKAGISVIRR

SEQ ID NO: 2188124 - protein, 23 aa, Cryptosporidium hominis
DLATLTGANYKLFEGRYASVLGN

SEQ ID NO: 2188125 - protein, 20 aa, Cryptosporidium hominis
DLCRFRTKPCRRSKQMGCDF

SEQ ID NO: 2188126 - protein, 20 aa, Cryptosporidium hominis
DLCSKCFYIVRKSPDGIEEF

SEQ ID NO: 2188127 - protein, 23 aa, Cryptosporidium hominis
DLCSYSEYRIYPGRGRKFVARDG

SEQ ID NO: 2188128 - protein, 25 aa, Cryptosporidium hominis
DLDGVLQRLLLLKKKKYACIQIVDF

SEQ ID NO: 2188129 - protein, 22 aa, Cryptosporidium hominis
DLDSIFPGDLLQRSFKKRISSL

SEQ ID NO: 2188130 - protein, 25 aa, Cryptosporidium hominis
DLEIGYLYDHIFSPVGGVHWMPRNG

SEQ ID NO: 2188131 - protein, 22 aa, Cryptosporidium hominis
DLEIWIFDFHRPAIDELMLSIG

SEQ ID NO: 2188132 - protein, 24 aa, Cryptosporidium hominis
DLEQDISYYKIWRDELDAENIFFS

SEQ ID NO: 2188133 - protein, 19 aa, Cryptosporidium hominis
DLETSLLNHLLIKKPDDHE

SEQ ID NO: 2188134 - protein, 24 aa, Cryptosporidium hominis
DLEVEELLKFPLQKKYFGGGGSMS

SEQ ID NO: 2188135 - protein, 17 aa, Cryptosporidium hominis
DLFFLASKLSDSLLLYS

SEQ ID NO: 2188136 - protein, 19 aa, Cryptosporidium hominis
DLFIWGSTGFTGNLICDLL

SEQ ID NO: 2188137 - protein, 18 aa, Cryptosporidium hominis
DLFKPCMDVIWEFNKHVM

SEQ ID NO: 2188138 - protein, 21 aa, Cryptosporidium hominis
DLFYGKYILDPKETFELEISK

SEQ ID NO: 2188139 - protein, 28 aa, Cryptosporidium hominis
DLGDKSLWWLKYTLNKRPILGPTTMDNE

SEQ ID NO: 2188140 - protein, 21 aa, Cryptosporidium hominis
DLGILNLPNKYSKEFSEIFQM

SEQ ID NO: 2188141 - protein, 18 aa, Cryptosporidium hominis
DLGKLLDICLEKILKRTN

SEQ ID NO: 2188142 - protein, 31 aa, Cryptosporidium hominis
DLGNDIIPFEYHWEKPLFNSKLFEIDHEFIE

SEQ ID NO: 2188143 - protein, 33 aa, Cryptosporidium hominis
DLGVQFLISTILLPEILFFDSLLSMPIYQYIKE

SEQ ID NO: 2188144 - protein, 19 aa, Cryptosporidium hominis
DLHSQIFSNFGLSGSGFGN

SEQ ID NO: 2188145 - protein, 29 aa, Cryptosporidium hominis
DLHVGLHSAPRGILLFGPPGTGKTMLAKW

SEQ ID NO: 2188146 - protein, 45 aa, Cryptosporidium hominis
DLICQYDDLLVPIEKEEKTYFLRGLLYRIWKYNRNGKVINNSNQI

SEQ ID NO: 2188147 - protein, 22 aa, Cryptosporidium hominis
DLIIEKLYTLYSKLTGQIIRGQ

SEQ ID NO: 2188148 - protein, 22 aa, Cryptosporidium hominis
DLIKIFCWMTTQNGPNNPLSVI

SEQ ID NO: 2188149 - protein, 22 aa, Cryptosporidium hominis
DLILEFDICFPKSLTPEQKKLI

SEQ ID NO: 2188150 - protein, 21 aa, Cryptosporidium hominis
DLIYFDICINGIILLDDEFKE

SEQ ID NO: 2188151 - protein, 22 aa, Cryptosporidium hominis
DLIYIDSYCHLVPTFSLGQFEV

SEQ ID NO: 2188152 - protein, 27 aa, Cryptosporidium hominis
DLKGRIHDRYILFINDSKVIQMAWRRK

SEQ ID NO: 2188153 - protein, 21 aa, Cryptosporidium hominis
DLKILLFELFIQFGLIDKITI

SEQ ID NO: 2188154 - protein, 17 aa, Cryptosporidium hominis
DLKILRFHDGISGKTYK

SEQ ID NO: 2188155 - protein, 17 aa, Cryptosporidium hominis
DLKKDQGYLLYNAKQYL

SEQ ID NO: 2188156 - protein, 19 aa, Cryptosporidium hominis
DLKLQKKLLFFVTGSDRVP

SEQ ID NO: 2188157 - protein, 24 aa, Cryptosporidium hominis
DLKVSVYLYLNQFMDNIMGELGGG

SEQ ID NO: 2188158 - protein, 31 aa, Cryptosporidium hominis
DLLDSALLRPGRLDRIIYIGLPDSKARKKIL

SEQ ID NO: 2188159 - protein, 17 aa, Cryptosporidium hominis
DLLIRIRNSFDNCNETS

SEQ ID NO: 2188160 - protein, 32 aa, Cryptosporidium hominis
DLLKFFQARPPLPYVPYPNRRPHKPYQGLADL

SEQ ID NO: 2188161 - protein, 20 aa, Cryptosporidium hominis
DLLKNLLCHPSKRFDGEQIK

SEQ ID NO: 2188162 - protein, 19 aa, Cryptosporidium hominis
DLLNWLNSYFNLNVSRIED

SEQ ID NO: 2188163 - protein, 22 aa, Cryptosporidium hominis
DLLQGFAAVELCNRGWLYYPDS

SEQ ID NO: 2188164 - protein, 17 aa, Cryptosporidium hominis
DLMSLYLKFAHGLDYYS

SEQ ID NO: 2188165 - protein, 17 aa, Cryptosporidium hominis
DLNIWCLALRQKVPDMK

SEQ ID NO: 2188166 - protein, 17 aa, Cryptosporidium hominis
DLNLFIPSLQLFSNILN

SEQ ID NO: 2188167 - protein, 18 aa, Cryptosporidium hominis
DLNLMWQSSIYSLKTKSS

SEQ ID NO: 2188168 - protein, 26 aa, Cryptosporidium hominis
DLNLPQELFSELLYSALKQVFDEITN

SEQ ID NO: 2188169 - protein, 26 aa, Cryptosporidium hominis
DLNNLLVMVVKSYDCIRPKRSSIGDF

SEQ ID NO: 2188170 - protein, 17 aa, Cryptosporidium hominis
DLPEFYLVLSNISKRQN

SEQ ID NO: 2188171 - protein, 21 aa, Cryptosporidium hominis
DLPEPVDFSMLSKLVLESSLD

SEQ ID NO: 2188172 - protein, 34 aa, Cryptosporidium hominis
DLQKSKIEWWKKPRGWKVTYFKQGQKLSQIFRVS

SEQ ID NO: 2188173 - protein, 25 aa, Cryptosporidium hominis
DLQSREFLDLNLDYSFESNNVSMEN

SEQ ID NO: 2188174 - protein, 20 aa, Cryptosporidium hominis
DLQVIWLHNYYMIYFNELHI

SEQ ID NO: 2188175 - protein, 25 aa, Cryptosporidium hominis
DLRIPCGLFKTFALISSHSIFVQSR

SEQ ID NO: 2188176 - protein, 17 aa, Cryptosporidium hominis
DLRLFIKNIKNTIYEKI

SEQ ID NO: 2188177 - protein, 37 aa, Cryptosporidium hominis
DLRLNSLYGSIYYFKLGIIKDLPPPIQPPEKIPGYDV

SEQ ID NO: 2188178 - protein, 21 aa, Cryptosporidium hominis
DLRLRKKLLENSLNKIKAVPV

SEQ ID NO: 2188179 - protein, 30 aa, Cryptosporidium hominis
DLRNWLEQSKIPLLVFPYGSTSTGFADQFS

SEQ ID NO: 2188180 - protein, 23 aa, Cryptosporidium hominis
DLRPFWFQDWGERAISYYSSQID

SEQ ID NO: 2188181 - protein, 23 aa, Cryptosporidium hominis
DLRSIIISILPNIKTFNKSIINK

SEQ ID NO: 2188182 - protein, 25 aa, Cryptosporidium hominis
DLRTPVNLKKTKLCPFWLSSACSIG

SEQ ID NO: 2188183 - protein, 25 aa, Cryptosporidium hominis
DLSKKRIYFFLGLGPNISNNILKSE

SEQ ID NO: 2188184 - protein, 22 aa, Cryptosporidium hominis
DLSNLVIAYEPIWAIGTGVVAT

SEQ ID NO: 2188185 - protein, 22 aa, Cryptosporidium hominis
DLSPKNLLKRSSTLLKATKSLT

SEQ ID NO: 2188186 - protein, 27 aa, Cryptosporidium hominis
DLSSLLELHAAFLAFTLTLYPDNTNYV

SEQ ID NO: 2188187 - protein, 24 aa, Cryptosporidium hominis
DLTNEKILRRWDANGLPISCLGLS

SEQ ID NO: 2188188 - protein, 17 aa, Cryptosporidium hominis
DLTWIRLSAIPGSPSMS

SEQ ID NO: 2188189 - protein, 25 aa, Cryptosporidium hominis
DLVEAYSLCLIPNKSYLRGMKNESE

SEQ ID NO: 2188190 - protein, 32 aa, Cryptosporidium hominis
DLVKNIFNCEILKKYPLPLIYQRNLICEIVKI

SEQ ID NO: 2188191 - protein, 30 aa, Cryptosporidium hominis
DLVLRAGALPPILQLIALEIGPLDNSEQMM

SEQ ID NO: 2188192 - protein, 24 aa, Cryptosporidium hominis
DLVMDPLHFLFKDFGDPQVETEDK

SEQ ID NO: 2188193 - protein, 30 aa, Cryptosporidium hominis
DLVYFIGMIFSKILLQIFNIKLVNFDRIIS

SEQ ID NO: 2188194 - protein, 19 aa, Cryptosporidium hominis
DLWALDCELLVDWGDGVLT

SEQ ID NO: 2188195 - protein, 27 aa, Cryptosporidium hominis
DLWSIGIILYILMTGIPPLRIDLMCDY

SEQ ID NO: 2188196 - protein, 18 aa, Cryptosporidium hominis
DLWSQYFDILTKLCSKDD

SEQ ID NO: 2188197 - protein, 36 aa, Cryptosporidium hominis
DLYEDEVGLIWKYRFYLFKFKAGIPMLFHFINLNDK

SEQ ID NO: 2188198 - protein, 19 aa, Cryptosporidium hominis
DLYRPLLFTNIVTSICREI

SEQ ID NO: 2188199 - protein, 17 aa, Cryptosporidium hominis
DLYSHLIPVYEIDPLEK

SEQ ID NO: 2188200 - protein, 19 aa, Cryptosporidium hominis
DMCMETIKKPFKYHCLSGG

SEQ ID NO: 2188201 - protein, 18 aa, Cryptosporidium hominis
DMDALISPFYNINIQNKQ

SEQ ID NO: 2188202 - protein, 20 aa, Cryptosporidium hominis
DMKFSPFYNNFLATSSDDRS

SEQ ID NO: 2188203 - protein, 26 aa, Cryptosporidium hominis
DMLSDMASILMTLYFSKKDSEDLAYE

SEQ ID NO: 2188204 - protein, 18 aa, Cryptosporidium hominis
DMLYTQLDTLIQAFAGIC

SEQ ID NO: 2188205 - protein, 31 aa, Cryptosporidium hominis
DMNSKETFTLPPLWHVAALCTLTMLEEEDKA

SEQ ID NO: 2188206 - protein, 26 aa, Cryptosporidium hominis
DMPKELKNCFILTLNVSLEYENSEVT

SEQ ID NO: 2188207 - protein, 17 aa, Cryptosporidium hominis
DMRGIRFNLLDVTLHAD

SEQ ID NO: 2188208 - protein, 27 aa, Cryptosporidium hominis
DMRNNYAWLHDLLTKNWGKLSKPRNSE

SEQ ID NO: 2188209 - protein, 20 aa, Cryptosporidium hominis
DMVKLLSRSVPFHQAVRILG

SEQ ID NO: 2188210 - protein, 23 aa, Cryptosporidium hominis
DMVKLNDYFTFPEKLDLSSFVNH

SEQ ID NO: 2188211 - protein, 18 aa, Cryptosporidium hominis
DMVTKVFASLMQCTASNI

SEQ ID NO: 2188212 - protein, 22 aa, Cryptosporidium hominis
DMVWRIFRYFGTPTEESWPEIG

SEQ ID NO: 2188213 - protein, 20 aa, Cryptosporidium hominis
DMYIYDPDFPNFSRLKIEAW

SEQ ID NO: 2188214 - protein, 25 aa, Cryptosporidium hominis
DNAFSIIVLPIPTCPLASPSERLRC

SEQ ID NO: 2188215 - protein, 25 aa, Cryptosporidium hominis
DNAIRIFRYNGDLLKRVNFDTLYSA

SEQ ID NO: 2188216 - protein, 19 aa, Cryptosporidium hominis
DNCIILPDTTIAPNTLIPP

SEQ ID NO: 2188217 - protein, 23 aa, Cryptosporidium hominis
DNCKYRHCLPVGYVIKEQESDDG

SEQ ID NO: 2188218 - protein, 23 aa, Cryptosporidium hominis
DNCNELIKCADIDGFLVGGASLK

SEQ ID NO: 2188219 - protein, 18 aa, Cryptosporidium hominis
DNDILKRAKNFLSLCETI

SEQ ID NO: 2188220 - protein, 24 aa, Cryptosporidium hominis
DNEAFLPTIDLLMALKATYGNELT

SEQ ID NO: 2188221 - protein, 22 aa, Cryptosporidium hominis
DNENFKLAYPFYSNIFNIENRT

SEQ ID NO: 2188222 - protein, 24 aa, Cryptosporidium hominis
DNERDLPDVVKLLDREYKDVIPFT

SEQ ID NO: 2188223 - protein, 28 aa, Cryptosporidium hominis
DNFHLRIRVHPFHVLRINKMLSCAGADR

SEQ ID NO: 2188224 - protein, 25 aa, Cryptosporidium hominis
DNFKLLTVFGKGDGNFRVFKFDNEE

SEQ ID NO: 2188225 - protein, 27 aa, Cryptosporidium hominis
DNGGEEVLLLLRYFDISNPRINEPSLK

SEQ ID NO: 2188226 - protein, 25 aa, Cryptosporidium hominis
DNGPEILELLKRTPYSCIPVILNRL

SEQ ID NO: 2188227 - protein, 25 aa, Cryptosporidium hominis
DNHFYYMLMEYMPGGDLMRHLIDLH

SEQ ID NO: 2188228 - protein, 27 aa, Cryptosporidium hominis
DNIAFHAVFKLVFSSKNPGLVEDEPLV

SEQ ID NO: 2188229 - protein, 24 aa, Cryptosporidium hominis
DNIEVFPVLLEKGSTRLAIYGIGN

SEQ ID NO: 2188230 - protein, 23 aa, Cryptosporidium hominis
DNIFTFPHVLPYDKSILTLSGPA

SEQ ID NO: 2188231 - protein, 19 aa, Cryptosporidium hominis
DNILLYPNPSFCEEGWNND

SEQ ID NO: 2188232 - protein, 20 aa, Cryptosporidium hominis
DNINILLDLVLLNNKDKRVY

SEQ ID NO: 2188233 - protein, 35 aa, Cryptosporidium hominis
DNITTIQLFKINPFKYLIDIQIYDGPLITNAFQAF

SEQ ID NO: 2188234 - protein, 24 aa, Cryptosporidium hominis
DNKHGYGIQKWPDGAVFEGNFVNG

SEQ ID NO: 2188235 - protein, 26 aa, Cryptosporidium hominis
DNKLLGQFEMMGIPPAPRGVPQIEVT

SEQ ID NO: 2188236 - protein, 24 aa, Cryptosporidium hominis
DNLSNGYILPKDMDALISPFYNIN

SEQ ID NO: 2188237 - protein, 30 aa, Cryptosporidium hominis
DNMLFTVHILNRILYIFNKSNYFSIQSFTE

SEQ ID NO: 2188238 - protein, 18 aa, Cryptosporidium hominis
DNMNPFITLKWSCSNAKS

SEQ ID NO: 2188239 - protein, 25 aa, Cryptosporidium hominis
DNNDKLRLILLYISHYIGINNDDLN

SEQ ID NO: 2188240 - protein, 24 aa, Cryptosporidium hominis
DNNLPFRFACESIPLFPILTHFCV

SEQ ID NO: 2188241 - protein, 23 aa, Cryptosporidium hominis
DNNNQLDRKISDIYTNHMDNNSD

SEQ ID NO: 2188242 - protein, 24 aa, Cryptosporidium hominis
DNNYIWVNAPRHPGALIRRPVRPE

SEQ ID NO: 2188243 - protein, 19 aa, Cryptosporidium hominis
DNSLRKWVPNKPELVLKCD

SEQ ID NO: 2188244 - protein, 26 aa, Cryptosporidium hominis
DNSNLLINIVWTLASAFNSLWVGGVE

SEQ ID NO: 2188245 - protein, 35 aa, Cryptosporidium hominis
DNSPVLVGSYLPFLPSLFIVSSSKPLLRIVNVDVG

SEQ ID NO: 2188246 - protein, 21 aa, Cryptosporidium hominis
DNSVLPFASCFRCGKSGHIVA

SEQ ID NO: 2188247 - protein, 26 aa, Cryptosporidium hominis
DNTKNFIPYRDSKLTRILQNSLGGNS

SEQ ID NO: 2188248 - protein, 19 aa, Cryptosporidium hominis
DNTVLVLYADTLKQFLVLY

SEQ ID NO: 2188249 - protein, 40 aa, Cryptosporidium hominis
DNTYGCRQSLLHGLFNGCIQMLAGKKIVVLGYGEVGKGCA

SEQ ID NO: 2188250 - protein, 23 aa, Cryptosporidium hominis
DNVSMDISGYVSDLSLKNVTTGT

SEQ ID NO: 2188251 - protein, 41 aa, Cryptosporidium hominis
DNVTSILESLWISLLKSRIVSRDTFNLWLSKNDLLGEDSKL

SEQ ID NO: 2188252 - protein, 21 aa, Cryptosporidium hominis
DNWNYIKSTYKFRTPSYLFSR

SEQ ID NO: 2188253 - protein, 38 aa, Cryptosporidium hominis
DNYASSSTLIPLFRVPRPRFPYLVLVPLEGDFSSKIGQ

SEQ ID NO: 2188254 - protein, 17 aa, Cryptosporidium hominis
DNYSLLNGFFNFPNNRD

SEQ ID NO: 2188255 - protein, 25 aa, Cryptosporidium hominis
DPAKHIIQGLWRKLTGKASRKRNRL

SEQ ID NO: 2188256 - protein, 20 aa, Cryptosporidium hominis
DPCYDPSTIWVPSSNSREAK

SEQ ID NO: 2188257 - protein, 23 aa, Cryptosporidium hominis
DPDRILLILNQMERLNEIISMRL

SEQ ID NO: 2188258 - protein, 26 aa, Cryptosporidium hominis
DPDRMSIFKRPLIQNPVILAPKTHHM

SEQ ID NO: 2188259 - protein, 23 aa, Cryptosporidium hominis
DPEAKIYQIFPKKTFLNDIMESV

SEQ ID NO: 2188260 - protein, 22 aa, Cryptosporidium hominis
DPELVEVDFYVNGGKLKSSFSI

SEQ ID NO: 2188261 - protein, 36 aa, Cryptosporidium hominis
DPEMYKFVLPQDLNTPYYLKLRPGVREFLNTIAPYY

SEQ ID NO: 2188262 - protein, 23 aa, Cryptosporidium hominis
DPESFWSQMARKELRWLRDFTKV

SEQ ID NO: 2188263 - protein, 28 aa, Cryptosporidium hominis
DPFSDGIIFSVRPPKKSWRPIHNLSGGE

SEQ ID NO: 2188264 - protein, 22 aa, Cryptosporidium hominis
DPKEEIIKAFKLFDDDETGKIT

SEQ ID NO: 2188265 - protein, 17 aa, Cryptosporidium hominis
DPKSYNLWSNRAWLLEF

SEQ ID NO: 2188266 - protein, 24 aa, Cryptosporidium hominis
DPKVRIKYLRYIQRLEQRGVEGID

SEQ ID NO: 2188267 - protein, 21 aa, Cryptosporidium hominis
DPLDSKYLSRSMLEITRDVCY

SEQ ID NO: 2188268 - protein, 20 aa, Cryptosporidium hominis
DPLLCPCQCRGSIKFVHLEC

SEQ ID NO: 2188269 - protein, 19 aa, Cryptosporidium hominis
DPLLRKKLHKVPGVPLIYL

SEQ ID NO: 2188270 - protein, 27 aa, Cryptosporidium hominis
DPNDLSPIVINFPHPIQLQNISIPYEV

SEQ ID NO: 2188271 - protein, 27 aa, Cryptosporidium hominis
DPNGEFKVFRIPLGGTLIEGSYAISGS

SEQ ID NO: 2188272 - protein, 33 aa, Cryptosporidium hominis
DPNHTLAFQNLLYILNYFIPLDNPKLIGNIRNN

SEQ ID NO: 2188273 - protein, 25 aa, Cryptosporidium hominis
DPNKKSYWQLIKRLLNLFVDESESE

SEQ ID NO: 2188274 - protein, 20 aa, Cryptosporidium hominis
DPNNWLLAQGTLYPDIIESG

SEQ ID NO: 2188275 - protein, 18 aa, Cryptosporidium hominis
DPNPNTRWSIKKALFHPD

SEQ ID NO: 2188276 - protein, 18 aa, Cryptosporidium hominis
DPNSINALVLPYGSEKET

SEQ ID NO: 2188277 - protein, 24 aa, Cryptosporidium hominis
DPNSPELIILPIYSSLPSEQQAKI

SEQ ID NO: 2188278 - protein, 23 aa, Cryptosporidium hominis
DPNTKSYFCLYFAKGACVNGSKC

SEQ ID NO: 2188279 - protein, 24 aa, Cryptosporidium hominis
DPNYSLFYYICDTGRYKLASFEPE

SEQ ID NO: 2188280 - protein, 18 aa, Cryptosporidium hominis
DPQRCIMWYGQVSAIDGC

SEQ ID NO: 2188281 - protein, 24 aa, Cryptosporidium hominis
DPQSLLIKLPSFYNSTRLVHFSKL

SEQ ID NO: 2188282 - protein, 19 aa, Cryptosporidium hominis
DPRLMKIIELPIDLRKWSY

SEQ ID NO: 2188283 - protein, 19 aa, Cryptosporidium hominis
DPRSLVLTLQELSTDYHKE

SEQ ID NO: 2188284 - protein, 22 aa, Cryptosporidium hominis
DPSLKGFFQSLIQRGEKKGSLS

SEQ ID NO: 2188285 - protein, 23 aa, Cryptosporidium hominis
DPSNTRLFFIGFGVIQGEDGKKF

SEQ ID NO: 2188286 - protein, 27 aa, Cryptosporidium hominis
DPSPLLSQFLDPNFVYCSDLEPINVDK

SEQ ID NO: 2188287 - protein, 23 aa, Cryptosporidium hominis
DPSTLTIFLKSVIILIHKVISIQ

SEQ ID NO: 2188288 - protein, 17 aa, Cryptosporidium hominis
DPSYLGFKSSIRGEIYP

SEQ ID NO: 2188289 - protein, 21 aa, Cryptosporidium hominis
DPTLIIALHLKDTGNCIPLKF

SEQ ID NO: 2188290 - protein, 19 aa, Cryptosporidium hominis
DPVLFKLVHESRPLSKIQL

SEQ ID NO: 2188291 - protein, 19 aa, Cryptosporidium hominis
DPWSPVPNSIFLYRDANGN

SEQ ID NO: 2188292 - protein, 30 aa, Cryptosporidium hominis
DQALLIRNLPNIIWDSNKLVWRALADEELL

SEQ ID NO: 2188293 - protein, 25 aa, Cryptosporidium hominis
DQDYIIILDVLLPNCSIPENCRKFD

SEQ ID NO: 2188294 - protein, 24 aa, Cryptosporidium hominis
DQEHVMYVWFDALTNYITGLKWAD

SEQ ID NO: 2188295 - protein, 24 aa, Cryptosporidium hominis
DQESPFVYALVDWIKEKVGNFRIE

SEQ ID NO: 2188296 - protein, 24 aa, Cryptosporidium hominis
DQGIELHILFKRWDIRALNASNIM

SEQ ID NO: 2188297 - protein, 39 aa, Cryptosporidium hominis
DQHNLFKSFHWLLNHLCAVFLDDTIWFRDRNMIYDEMND

SEQ ID NO: 2188298 - protein, 23 aa, Cryptosporidium hominis
DQIGRKIFRFPTIKLYKKREKAN

SEQ ID NO: 2188299 - protein, 21 aa, Cryptosporidium hominis
DQIKFTPPTLLDFWTKPILNI

SEQ ID NO: 2188300 - protein, 19 aa, Cryptosporidium hominis
DQILLIQVTLWAIGEYSQH

SEQ ID NO: 2188301 - protein, 22 aa, Cryptosporidium hominis
DQIMEMAPLIRLCLYHCKRLDI

SEQ ID NO: 2188302 - protein, 27 aa, Cryptosporidium hominis
DQIMEVYSTQKLLLKNYLTYSKRSETS

SEQ ID NO: 2188303 - protein, 18 aa, Cryptosporidium hominis
DQKFDLALGLGILELCIS

SEQ ID NO: 2188304 - protein, 25 aa, Cryptosporidium hominis
DQKIHPQVIIAGYRMALEEARKALS

SEQ ID NO: 2188305 - protein, 23 aa, Cryptosporidium hominis
DQKKVYYLGFIDFFSTWSTIKKF

SEQ ID NO: 2188306 - protein, 21 aa, Cryptosporidium hominis
DQLISLFSAILLMGNFELGEH

SEQ ID NO: 2188307 - protein, 29 aa, Cryptosporidium hominis
DQPILTDYVATRWYRAPEILLGSTKYTKG

SEQ ID NO: 2188308 - protein, 25 aa, Cryptosporidium hominis
DQRKGIWDTFLGFIGLLKEDQKDSV

SEQ ID NO: 2188309 - protein, 29 aa, Cryptosporidium hominis
DQSILPNIPFSLCISYLRQERSQICNKLH

SEQ ID NO: 2188310 - protein, 32 aa, Cryptosporidium hominis
DQSMDIFSKLELLRNYLLKVKKNESDFLEYSK

SEQ ID NO: 2188311 - protein, 24 aa, Cryptosporidium hominis
DQTNQILYKVPYSTNLNINNGNKW

SEQ ID NO: 2188312 - protein, 26 aa, Cryptosporidium hominis
DQVKSIQIVAKLDSIPTPTAQQKAGL

SEQ ID NO: 2188313 - protein, 25 aa, Cryptosporidium hominis
DQWNQAGSLYWARKIIIKAIELGFL

SEQ ID NO: 2188314 - protein, 18 aa, Cryptosporidium hominis
DQYINFETLKKLVDTRRL

SEQ ID NO: 2188315 - protein, 23 aa, Cryptosporidium hominis
DQYRWSVANLIKKQSISTQFIVT

SEQ ID NO: 2188316 - protein, 24 aa, Cryptosporidium hominis
DQYSEFICDLLLTKLGHDKELKLD

SEQ ID NO: 2188317 - protein, 22 aa, Cryptosporidium hominis
DRDDAHISLLLKTGLVHISTDQ

SEQ ID NO: 2188318 - protein, 37 aa, Cryptosporidium hominis
DRDHKQILVAAILCRWWHALPDWPPPDTDYQALLKER

SEQ ID NO: 2188319 - protein, 24 aa, Cryptosporidium hominis
DREFSKIFSIKKLHLGHVASSFGI

SEQ ID NO: 2188320 - protein, 18 aa, Cryptosporidium hominis
DREFVILDYDFLNNHLLI

SEQ ID NO: 2188321 - protein, 23 aa, Cryptosporidium hominis
DRELIFELFMEFKTHIEVFTSHD

SEQ ID NO: 2188322 - protein, 25 aa, Cryptosporidium hominis
DRFVTGILQVPLLRNLIVINETSLE

SEQ ID NO: 2188323 - protein, 35 aa, Cryptosporidium hominis
DRHEEFLRVLLSRLQKNLFLLAHLSNQPKAPNHLT

SEQ ID NO: 2188324 - protein, 21 aa, Cryptosporidium hominis
DRHLGPALIPKLLPSLLISES

SEQ ID NO: 2188325 - protein, 25 aa, Cryptosporidium hominis
DRIEQYNWVINALGLRPVEIYEFSR

SEQ ID NO: 2188326 - protein, 20 aa, Cryptosporidium hominis
DRIIELLKSLQYKSVGKWFS

SEQ ID NO: 2188327 - protein, 20 aa, Cryptosporidium hominis
DRIPIPITVRQLEAITRIAE

SEQ ID NO: 2188328 - protein, 22 aa, Cryptosporidium hominis
DRKRTVFIGGLPKFCTEDELRR

SEQ ID NO: 2188329 - protein, 18 aa, Cryptosporidium hominis
DRLFPSFKREVIDRKPYI

SEQ ID NO: 2188330 - protein, 23 aa, Cryptosporidium hominis
DRLKNEFCRFIDFKYHASTIGNT

SEQ ID NO: 2188331 - protein, 19 aa, Cryptosporidium hominis
DRLLREERLLIAEMIKQIA

SEQ ID NO: 2188332 - protein, 43 aa, Cryptosporidium hominis
DRLLRSYSYKKALEIALKMSWPHFISLLKLLSSRGALHLIARE

SEQ ID NO: 2188333 - protein, 39 aa, Cryptosporidium hominis
DRLPNKWDSMILWNDLFVWRNFVFSIIMNLISRSDHLTS

SEQ ID NO: 2188334 - protein, 25 aa, Cryptosporidium hominis
DRMRQLVFTSLLQSFCRPQWCNNLL

SEQ ID NO: 2188335 - protein, 21 aa, Cryptosporidium hominis
DRQRWSRRRNLSKIISGKNVN

SEQ ID NO: 2188336 - protein, 23 aa, Cryptosporidium hominis
DRRNVIVVLFLIREYPLAFKTSN

SEQ ID NO: 2188337 - protein, 30 aa, Cryptosporidium hominis
DRSELESIVRWSCRLLNISNFRNIPIQIGQ

SEQ ID NO: 2188338 - protein, 29 aa, Cryptosporidium hominis
DRSGKGKFSAYFLLIRKQIQQGSSKCGLY

SEQ ID NO: 2188339 - protein, 18 aa, Cryptosporidium hominis
DRSIKTWKLPNNGEFFDV

SEQ ID NO: 2188340 - protein, 25 aa, Cryptosporidium hominis
DRVLRQPFGHLLLIGPPGCGKTLLA

SEQ ID NO: 2188341 - protein, 17 aa, Cryptosporidium hominis
DSCTFVWLCMKLGTSKF

SEQ ID NO: 2188342 - protein, 24 aa, Cryptosporidium hominis
DSDFKKLFRTPVYLSELHVKTLLY

SEQ ID NO: 2188343 - protein, 28 aa, Cryptosporidium hominis
DSDVLDTWFSSGLIPFSPLGWPDEVNQK

SEQ ID NO: 2188344 - protein, 17 aa, Cryptosporidium hominis
DSEFSCDLVSTSEYYYY

SEQ ID NO: 2188345 - protein, 24 aa, Cryptosporidium hominis
DSEHLGYAGIWPSNGKDAKIVPMG

SEQ ID NO: 2188346 - protein, 18 aa, Cryptosporidium hominis
DSEKILCMSILDKVSLYR

SEQ ID NO: 2188347 - protein, 22 aa, Cryptosporidium hominis
DSELPPFLKVEKLMFERHEREN

SEQ ID NO: 2188348 - protein, 32 aa, Cryptosporidium hominis
DSENSELLPIPTAPYIIGLFLTKTISCDNILD

SEQ ID NO: 2188349 - protein, 19 aa, Cryptosporidium hominis
DSEWFMKILRHDPNVYRIA

SEQ ID NO: 2188350 - protein, 20 aa, Cryptosporidium hominis
DSFCKLTPNSGSNKIWVWTV

SEQ ID NO: 2188351 - protein, 21 aa, Cryptosporidium hominis
DSFGIILRKLGFIDQAILCYE

SEQ ID NO: 2188352 - protein, 18 aa, Cryptosporidium hominis
DSFPLPGIYYFRFKVRVG

SEQ ID NO: 2188353 - protein, 22 aa, Cryptosporidium hominis
DSFSMPSYIRIPSNNFPNSNNR

SEQ ID NO: 2188354 - protein, 24 aa, Cryptosporidium hominis
DSFVNNFIFGIQKMVDLSLSIFVK

SEQ ID NO: 2188355 - protein, 26 aa, Cryptosporidium hominis
DSGDYLILQFPNWFWRSASEEYIVRW

SEQ ID NO: 2188356 - protein, 22 aa, Cryptosporidium hominis
DSGQIIPIPPNPVNQIVGRSCS

SEQ ID NO: 2188357 - protein, 17 aa, Cryptosporidium hominis
DSICFVLGITNLSQIRI

SEQ ID NO: 2188358 - protein, 21 aa, Cryptosporidium hominis
DSICNPFLLRTIETPKLIGKI

SEQ ID NO: 2188359 - protein, 21 aa, Cryptosporidium hominis
DSILIYDIFSHNLKLNGNSPL

SEQ ID NO: 2188360 - protein, 17 aa, Cryptosporidium hominis
DSILYKCSEGYLLSESS

SEQ ID NO: 2188361 - protein, 26 aa, Cryptosporidium hominis
DSIPIEYLDLIKRWLNEMEIVYYEGR

SEQ ID NO: 2188362 - protein, 36 aa, Cryptosporidium hominis
DSKGLINFTIKKSDFRNIPMLVSNLFGTTNLKKQIL

SEQ ID NO: 2188363 - protein, 27 aa, Cryptosporidium hominis
DSKMEFLINNDMFSSAGTLLSSLLSVN

SEQ ID NO: 2188364 - protein, 28 aa, Cryptosporidium hominis
DSKRVKLFHHLLQKLLLRRTKDLVIKLP

SEQ ID NO: 2188365 - protein, 26 aa, Cryptosporidium hominis
DSLFAELHFIIWKMDINEIQAPIDDY

SEQ ID NO: 2188366 - protein, 26 aa, Cryptosporidium hominis
DSLPVKFFALFEFLKCITFEPAYISN

SEQ ID NO: 2188367 - protein, 23 aa, Cryptosporidium hominis
DSLQLLEIIPPNSPPEETDPLAQ

SEQ ID NO: 2188368 - protein, 26 aa, Cryptosporidium hominis
DSLTCPICARLFRYAVLTPCCGETYC

SEQ ID NO: 2188369 - protein, 20 aa, Cryptosporidium hominis
DSLYNLITMCLRPNPDLRAS

SEQ ID NO: 2188370 - protein, 26 aa, Cryptosporidium hominis
DSNDAKSLFVLNPDGSGILKDISTEF

SEQ ID NO: 2188371 - protein, 33 aa, Cryptosporidium hominis
DSNEKSQMIVDQWFGRLRELQNTSISTRLNCLI

SEQ ID NO: 2188372 - protein, 21 aa, Cryptosporidium hominis
DSNGIYPWVWCDLVTDQDTAT

SEQ ID NO: 2188373 - protein, 21 aa, Cryptosporidium hominis
DSNICLRLVQLSKEEIRLFEK

SEQ ID NO: 2188374 - protein, 27 aa, Cryptosporidium hominis
DSNKKHYLLTIYELYVFRTVVCSSHLQ

SEQ ID NO: 2188375 - protein, 32 aa, Cryptosporidium hominis
DSNNRSEFLLWMNGLNDLVCNLSLIGGSKKID

SEQ ID NO: 2188376 - protein, 26 aa, Cryptosporidium hominis
DSNRIMATLVLTILLKIAQENNLDKL

SEQ ID NO: 2188377 - protein, 34 aa, Cryptosporidium hominis
DSPILKSTILLQLKLTLSLINFLRKLGLFCLSSQ

SEQ ID NO: 2188378 - protein, 20 aa, Cryptosporidium hominis
DSPPHLILPSVSTPLHIPPP

SEQ ID NO: 2188379 - protein, 26 aa, Cryptosporidium hominis
DSPRKITFFISLLRTTAIAFSSGYSD

SEQ ID NO: 2188380 - protein, 21 aa, Cryptosporidium hominis
DSQIIIFDLNIVLSNPDGLAY

SEQ ID NO: 2188381 - protein, 25 aa, Cryptosporidium hominis
DSQITYFENLKLYLRSYYTMKECHT

SEQ ID NO: 2188382 - protein, 19 aa, Cryptosporidium hominis
DSQWKQFYSARMRTNAFNS

SEQ ID NO: 2188383 - protein, 17 aa, Cryptosporidium hominis
DSREELIPSLDFNDLSM

SEQ ID NO: 2188384 - protein, 21 aa, Cryptosporidium hominis
DSREILINTLAFALKDFNLKE

SEQ ID NO: 2188385 - protein, 20 aa, Cryptosporidium hominis
DSRNPLFSIKIEFNQQTQSS

SEQ ID NO: 2188386 - protein, 24 aa, Cryptosporidium hominis
DSRSRRILDFTIKGSGLGGSSSIE

SEQ ID NO: 2188387 - protein, 18 aa, Cryptosporidium hominis
DSRTKFWSVSPQLNIPRS

SEQ ID NO: 2188388 - protein, 21 aa, Cryptosporidium hominis
DSRVRLFNLSDLSTFVKFKGH

SEQ ID NO: 2188389 - protein, 24 aa, Cryptosporidium hominis
DSSCPTLYMCLYLDDVSSLLMDRI

SEQ ID NO: 2188390 - protein, 26 aa, Cryptosporidium hominis
DSSIQRPWVLQRLPKEQLAFDNANSK

SEQ ID NO: 2188391 - protein, 25 aa, Cryptosporidium hominis
DSSKILQFHRFVRVPEYITTAHNGP

SEQ ID NO: 2188392 - protein, 17 aa, Cryptosporidium hominis
DSSNIIGIAHKNSLFNL

SEQ ID NO: 2188393 - protein, 28 aa, Cryptosporidium hominis
DSSNKLLFQYFTTVFKFHTLNQFESTEF

SEQ ID NO: 2188394 - protein, 31 aa, Cryptosporidium hominis
DSSPSFVQSVYDLILVPLESTLNRFKDYIRL

SEQ ID NO: 2188395 - protein, 20 aa, Cryptosporidium hominis
DSSRFRTFIAQHFGVNASDV

SEQ ID NO: 2188396 - protein, 36 aa, Cryptosporidium hominis
DSSSIIQLLTRFESFRTKWARLILNHNQEALYQFDL

SEQ ID NO: 2188397 - protein, 30 aa, Cryptosporidium hominis
DSSTNIIIIQRILEKLLINFSQCTPSVFPL

SEQ ID NO: 2188398 - protein, 24 aa, Cryptosporidium hominis
DSTFYFEIIINIFGPLYEESIKDK

SEQ ID NO: 2188399 - protein, 25 aa, Cryptosporidium hominis
DSVGIYMPMIPETIYTMLACARIGA

SEQ ID NO: 2188400 - protein, 22 aa, Cryptosporidium hominis
DSVIMAYRRALDDLGSIRIDLW

SEQ ID NO: 2188401 - protein, 26 aa, Cryptosporidium hominis
DSVPKIIGHFLVRQIMDKLQFQLYNE

SEQ ID NO: 2188402 - protein, 22 aa, Cryptosporidium hominis
DSVSILHLKANYLNLEGGNELE

SEQ ID NO: 2188403 - protein, 25 aa, Cryptosporidium hominis
DSWCEKFLQIIFKKLFNPHETLIIR

SEQ ID NO: 2188404 - protein, 25 aa, Cryptosporidium hominis
DSWRKIETIFRTLSIDYSKLIDEEG

SEQ ID NO: 2188405 - protein, 22 aa, Cryptosporidium hominis
DSYNLSMYFDPKSNIVFVNGDI

SEQ ID NO: 2188406 - protein, 24 aa, Cryptosporidium hominis
DSYNVDIEGLPPLIVEYSSLNAKA

SEQ ID NO: 2188407 - protein, 23 aa, Cryptosporidium hominis
DTAKYLRNLDLNSAFYDPKSRSM

SEQ ID NO: 2188408 - protein, 18 aa, Cryptosporidium hominis
DTAYFKSVLSKNISMIPK

SEQ ID NO: 2188409 - protein, 32 aa, Cryptosporidium hominis
DTCRINVQYAFPPGSDLLPRPWSKYSVGSSQY

SEQ ID NO: 2188410 - protein, 26 aa, Cryptosporidium hominis
DTEFVHGFIVWFDIEFPAHNSNTTIL

SEQ ID NO: 2188411 - protein, 23 aa, Cryptosporidium hominis
DTEKNTCLPLFPSSLYTSNITCN

SEQ ID NO: 2188412 - protein, 25 aa, Cryptosporidium hominis
DTFGILFGMVNIPIVFAIDGAGIPV

SEQ ID NO: 2188413 - protein, 20 aa, Cryptosporidium hominis
DTGLAPPSQWDLAADRQNMQ

SEQ ID NO: 2188414 - protein, 21 aa, Cryptosporidium hominis
DTHDFIIYPHKIELRVRLVPC

SEQ ID NO: 2188415 - protein, 17 aa, Cryptosporidium hominis
DTIVRYIGDKEPLVVSS

SEQ ID NO: 2188416 - protein, 18 aa, Cryptosporidium hominis
DTKDSVIMAYRRALDDLG

SEQ ID NO: 2188417 - protein, 25 aa, Cryptosporidium hominis
DTLDPALLRPGRLDRKVEFGLPDLE

SEQ ID NO: 2188418 - protein, 27 aa, Cryptosporidium hominis
DTLFSEKLIYYVIIKKIFSSSIHLLRL

SEQ ID NO: 2188419 - protein, 20 aa, Cryptosporidium hominis
DTLLCIIQRVSLLWENKDFE

SEQ ID NO: 2188420 - protein, 24 aa, Cryptosporidium hominis
DTLNDQFWRIFGISLTTSSRSERV

SEQ ID NO: 2188421 - protein, 25 aa, Cryptosporidium hominis
DTLVELLIVVMFQNSNINSASGITG

SEQ ID NO: 2188422 - protein, 17 aa, Cryptosporidium hominis
DTLWTIRKKIITVIYHL

SEQ ID NO: 2188423 - protein, 18 aa, Cryptosporidium hominis
DTNLFSMPIQISSSQKIA

SEQ ID NO: 2188424 - protein, 23 aa, Cryptosporidium hominis
DTNQFAIWELNQASTSPVSPSSN

SEQ ID NO: 2188425 - protein, 42 aa, Cryptosporidium hominis
DTQKSIRGIYQWFRKYFKTYYLPNEYWIYKLHNFETKTNNAF

SEQ ID NO: 2188426 - protein, 24 aa, Cryptosporidium hominis
DTQVWAYKAFAQALEIIPKTLAQN

SEQ ID NO: 2188427 - protein, 28 aa, Cryptosporidium hominis
DTSEDWLKLMKKIFDFQKIQNLLNRKDF

SEQ ID NO: 2188428 - protein, 21 aa, Cryptosporidium hominis
DTSHQIYPLLFMSLSQDTATS

SEQ ID NO: 2188429 - protein, 23 aa, Cryptosporidium hominis
DTSKWKIIYPSYLNSNNTKSSGR

SEQ ID NO: 2188430 - protein, 19 aa, Cryptosporidium hominis
DTYLDQYLWYESDNRKLFP

SEQ ID NO: 2188431 - protein, 20 aa, Cryptosporidium hominis
DTYNCINLRLWKATPSREFD

SEQ ID NO: 2188432 - protein, 24 aa, Cryptosporidium hominis
DVDELFAKLIPFGYNCLTLHSGQD

SEQ ID NO: 2188433 - protein, 22 aa, Cryptosporidium hominis
DVDFQRFCLGLGFDINSQNQVI

SEQ ID NO: 2188434 - protein, 26 aa, Cryptosporidium hominis
DVDKLSLVQLVKLLQKVFSIQFQIRR

SEQ ID NO: 2188435 - protein, 23 aa, Cryptosporidium hominis
DVDVFWSMLARKLSCFDWFECES

SEQ ID NO: 2188436 - protein, 24 aa, Cryptosporidium hominis
DVEIQVKFIAPPQYLVTAVSYGKA

SEQ ID NO: 2188437 - protein, 32 aa, Cryptosporidium hominis
DVENFLKHFKLDIFPLPFLNIEVAEQYCAMRC

SEQ ID NO: 2188438 - protein, 20 aa, Cryptosporidium hominis
DVEVVCPAPVIVPYVQPEIK

SEQ ID NO: 2188439 - protein, 18 aa, Cryptosporidium hominis
DVFDAMFRHIFRGINTHC

SEQ ID NO: 2188440 - protein, 25 aa, Cryptosporidium hominis
DVFQRPWYISTIARDNRIKSWQNDR

SEQ ID NO: 2188441 - protein, 19 aa, Cryptosporidium hominis
DVGLTWKNAYYIAEPKVKR

SEQ ID NO: 2188442 - protein, 21 aa, Cryptosporidium hominis
DVIIGHFEKVIRPYTRKKNQK

SEQ ID NO: 2188443 - protein, 20 aa, Cryptosporidium hominis
DVIVWTLPFLVRSCENSINI

SEQ ID NO: 2188444 - protein, 21 aa, Cryptosporidium hominis
DVKELPSILLFTCQSLKPYKV

SEQ ID NO: 2188445 - protein, 23 aa, Cryptosporidium hominis
DVKPAVIKPKIATAAPVINIKKP

SEQ ID NO: 2188446 - protein, 23 aa, Cryptosporidium hominis
DVKVLIWKIYKIQKNESLEYIFV

SEQ ID NO: 2188447 - protein, 24 aa, Cryptosporidium hominis
DVLDPALLRPGRLDRKVEIPLPNE

SEQ ID NO: 2188448 - protein, 28 aa, Cryptosporidium hominis
DVLEPVYLRRLIRLMSNKLYELEMNRWN

SEQ ID NO: 2188449 - protein, 21 aa, Cryptosporidium hominis
DVLGFPEYWKRITVMRCMAPV

SEQ ID NO: 2188450 - protein, 30 aa, Cryptosporidium hominis
DVLIFTREYELILLRAYLLNSDSEKILCMS

SEQ ID NO: 2188451 - protein, 24 aa, Cryptosporidium hominis
DVLLSFSMTSLCAQIPFVRPKMVN

SEQ ID NO: 2188452 - protein, 30 aa, Cryptosporidium hominis
DVNKLLSFNQFIDLVIPRGSGELVHMIKKN

SEQ ID NO: 2188453 - protein, 32 aa, Cryptosporidium hominis
DVPALLVLSNYLWDPCSLLFDSIRGSGLAYSG

SEQ ID NO: 2188454 - protein, 24 aa, Cryptosporidium hominis
DVPDLLKQHLLPPKPIKIRHRLAL

SEQ ID NO: 2188455 - protein, 22 aa, Cryptosporidium hominis
DVREWAFATFPGLETNLEAIFA

SEQ ID NO: 2188456 - protein, 17 aa, Cryptosporidium hominis
DVRIIPINKSTNAKILP

SEQ ID NO: 2188457 - protein, 32 aa, Cryptosporidium hominis
DVSKNEILELPSHPFFIAAQYHPEFTSRPMSP

SEQ ID NO: 2188458 - protein, 17 aa, Cryptosporidium hominis
DVSYNSSLIPISKDEKT

SEQ ID NO: 2188459 - protein, 24 aa, Cryptosporidium hominis
DVTKYRQIFPWISETEITKIWGSI

SEQ ID NO: 2188460 - protein, 32 aa, Cryptosporidium hominis
DVVSWEKYLHSYLLLIYFFEINQDVNSPNIHK

SEQ ID NO: 2188461 - protein, 23 aa, Cryptosporidium hominis
DVVSYFDVFPQKYSISNLENTDQ

SEQ ID NO: 2188462 - protein, 25 aa, Cryptosporidium hominis
DVYCCSWLRKNIFKKYLYEASQTNC

SEQ ID NO: 2188463 - protein, 26 aa, Cryptosporidium hominis
DWCTDACLLRYLRGYNLKVIKSFEAL

SEQ ID NO: 2188464 - protein, 33 aa, Cryptosporidium hominis
DWDNIMSRTLTINQFFPNIRTPVVITRCGHHFC

SEQ ID NO: 2188465 - protein, 18 aa, Cryptosporidium hominis
DWGTQFGMLIEYLKEEYP

SEQ ID NO: 2188466 - protein, 18 aa, Cryptosporidium hominis
DWILLQCPGQIQSILWYF

SEQ ID NO: 2188467 - protein, 18 aa, Cryptosporidium hominis
DWIQLKGIFFRNPFILSS

SEQ ID NO: 2188468 - protein, 30 aa, Cryptosporidium hominis
DWRKTYTTPRTLLGILRLSQALARLRFSNI

SEQ ID NO: 2188469 - protein, 31 aa, Cryptosporidium hominis
DWSADIWSLGCTIFELLTGDLLFTPKATEDF

SEQ ID NO: 2188470 - protein, 17 aa, Cryptosporidium hominis
DWSDWWKDAYNNVANKL

SEQ ID NO: 2188471 - protein, 21 aa, Cryptosporidium hominis
DYDPRIIIFTSISLALKLEEF

SEQ ID NO: 2188472 - protein, 30 aa, Cryptosporidium hominis
DYELTQINIKYCFPFIVIYDASNTGDQNSK

SEQ ID NO: 2188473 - protein, 20 aa, Cryptosporidium hominis
DYENHKLCYLIDSTIRFKVS

SEQ ID NO: 2188474 - protein, 19 aa, Cryptosporidium hominis
DYFSRKRSPKLLITTNNRA

SEQ ID NO: 2188475 - protein, 20 aa, Cryptosporidium hominis
DYFTDEDFEIIFGYSKFIHN

SEQ ID NO: 2188476 - protein, 25 aa, Cryptosporidium hominis
DYHSLNIVALFLIELGYKPSEVIQF

SEQ ID NO: 2188477 - protein, 28 aa, Cryptosporidium hominis
DYIDRLYAMVKPRRLIYMAIDGVAPRAK

SEQ ID NO: 2188478 - protein, 20 aa, Cryptosporidium hominis
DYIKGQLPTFYSLKIRINNT

SEQ ID NO: 2188479 - protein, 27 aa, Cryptosporidium hominis
DYITQVEFLTGMLIFRPYNIKEKNSPN

SEQ ID NO: 2188480 - protein, 38 aa, Cryptosporidium hominis
DYIVASSTLMRPFYSTDDFLVFVKRNDKVPLSLVVYNT

SEQ ID NO: 2188481 - protein, 20 aa, Cryptosporidium hominis
DYIVFFVTNYQIVCNFKFYT

SEQ ID NO: 2188482 - protein, 33 aa, Cryptosporidium hominis
DYIVQNIVSFFLPNMLNFLRIVTSPNNKQFFRL

SEQ ID NO: 2188483 - protein, 19 aa, Cryptosporidium hominis
DYKDDFRIILINGAYFSKY

SEQ ID NO: 2188484 - protein, 33 aa, Cryptosporidium hominis
DYKGIIYCKVGHSNIFCPYPFRFGDSSEYGTMI

SEQ ID NO: 2188485 - protein, 19 aa, Cryptosporidium hominis
DYKKIHRKSTNNVTWDESA

SEQ ID NO: 2188486 - protein, 17 aa, Cryptosporidium hominis
DYKLQYIGLIDPQNYPK

SEQ ID NO: 2188487 - protein, 18 aa, Cryptosporidium hominis
DYKTFEREQLRKTNQAVI

SEQ ID NO: 2188488 - protein, 17 aa, Cryptosporidium hominis
DYLIRVFKELHTRFFQN

SEQ ID NO: 2188489 - protein, 25 aa, Cryptosporidium hominis
DYLKSHLHKNFSLAFNQLKYDETIQ

SEQ ID NO: 2188490 - protein, 21 aa, Cryptosporidium hominis
DYLLCNGCNRAFHWYCVNRPE

SEQ ID NO: 2188491 - protein, 23 aa, Cryptosporidium hominis
DYLSDLVCCLWGSPGVYGVVTTP

SEQ ID NO: 2188492 - protein, 36 aa, Cryptosporidium hominis
DYMAAMAAVYSGWYSPYGYTMPFMGSYTPIMPSIIP

SEQ ID NO: 2188493 - protein, 24 aa, Cryptosporidium hominis
DYMFNRIFIIINSIELKYYSSEKQ

SEQ ID NO: 2188494 - protein, 33 aa, Cryptosporidium hominis
DYMNRILIINLIFAIYRSLFYKWAYVNFQEFKD

SEQ ID NO: 2188495 - protein, 18 aa, Cryptosporidium hominis
DYNIWRTWGRSDKSGWSK

SEQ ID NO: 2188496 - protein, 21 aa, Cryptosporidium hominis
DYPPKYYPPLHFSIYKPKVTK

SEQ ID NO: 2188497 - protein, 35 aa, Cryptosporidium hominis
DYPQRLRFYLDDGSGLILIDWLVDNTGTKYKQDLV

SEQ ID NO: 2188498 - protein, 17 aa, Cryptosporidium hominis
DYQFVRNQNDGFLRDDG

SEQ ID NO: 2188499 - protein, 24 aa, Cryptosporidium hominis
DYQYQYKYYLAKLSRYEALEHSIT

SEQ ID NO: 2188500 - protein, 34 aa, Cryptosporidium hominis
DYSGFRIVVRPLPPLPFTICDWPLPIQSNERGEI

SEQ ID NO: 2188501 - protein, 27 aa, Cryptosporidium hominis
DYSKQFELAFMRLMKTRYSKAKVLANT

SEQ ID NO: 2188502 - protein, 18 aa, Cryptosporidium hominis
DYSKTCPSFQRKGSLRPS

SEQ ID NO: 2188503 - protein, 20 aa, Cryptosporidium hominis
DYSLIMKKTILVIGVGGVGS

SEQ ID NO: 2188504 - protein, 26 aa, Cryptosporidium hominis
DYSLSTYLSWLYLNKTQKIFCQGRLL

SEQ ID NO: 2188505 - protein, 24 aa, Cryptosporidium hominis
DYTKSYPLSYRSKALDILISLIYY

SEQ ID NO: 2188506 - protein, 28 aa, Cryptosporidium hominis
DYTNHKHLLLLILLIERNLSSGADLGCG

SEQ ID NO: 2188507 - protein, 25 aa, Cryptosporidium hominis
DYTRKKNILLILDRDFHKSLRNEPG

SEQ ID NO: 2188508 - protein, 24 aa, Cryptosporidium hominis
EAAALQLPDWSLPNPQRPSDHLPL

SEQ ID NO: 2188509 - protein, 26 aa, Cryptosporidium hominis
EAALSIYLEDFARTLGSREQLAIAEF

SEQ ID NO: 2188510 - protein, 38 aa, Cryptosporidium hominis
EAAWKLTESLIRKGFERLFPPLLYKLQQEYIQENAKHE

SEQ ID NO: 2188511 - protein, 22 aa, Cryptosporidium hominis
EACAIRIQTAFRKYIKRRYFNV

SEQ ID NO: 2188512 - protein, 23 aa, Cryptosporidium hominis
EACPRLVELLGHPSPLVQTPALR

SEQ ID NO: 2188513 - protein, 26 aa, Cryptosporidium hominis
EADKGNYLIIPYFTPELEKLSEEKNR

SEQ ID NO: 2188514 - protein, 27 aa, Cryptosporidium hominis
EADLWSLGVLFYVMLGGAFPFDERKGN

SEQ ID NO: 2188515 - protein, 23 aa, Cryptosporidium hominis
EAEARILQYIYPTESKDLVNISY

SEQ ID NO: 2188516 - protein, 32 aa, Cryptosporidium hominis
EAEGSKFLDPFLFWEGRVKLFPPELLSALAEC

SEQ ID NO: 2188517 - protein, 22 aa, Cryptosporidium hominis
EAEIPYRDLGFYGVPGRAGVSN

SEQ ID NO: 2188518 - protein, 25 aa, Cryptosporidium hominis
EAEKLKLMKLLPKDDFNINHLDVME

SEQ ID NO: 2188519 - protein, 23 aa, Cryptosporidium hominis
EAGREILRCYINQRGIRGKFMSS

SEQ ID NO: 2188520 - protein, 24 aa, Cryptosporidium hominis
EAGTKRIILIFLDSFTDVLEKINP

SEQ ID NO: 2188521 - protein, 24 aa, Cryptosporidium hominis
EAHKSHMVCFALVAMDVGFDNPMF

SEQ ID NO: 2188522 - protein, 18 aa, Cryptosporidium hominis
EAIIWSIDTLWEKKLIAS

SEQ ID NO: 2188523 - protein, 28 aa, Cryptosporidium hominis
EAIRDTRFNYILGIVLYSVRTRSKFKLQ

SEQ ID NO: 2188524 - protein, 23 aa, Cryptosporidium hominis
EAISSFLLGRNSLYSPTSVLSLL

SEQ ID NO: 2188525 - protein, 25 aa, Cryptosporidium hominis
EAKDGFIFAQSMYIGLVLNNSNSNN

SEQ ID NO: 2188526 - protein, 23 aa, Cryptosporidium hominis
EAKKDFRYICEFDYFSRDAKLQS

SEQ ID NO: 2188527 - protein, 30 aa, Cryptosporidium hominis
EAKRLLWDEITKDTLPPSWLRKINKEPMNS

SEQ ID NO: 2188528 - protein, 18 aa, Cryptosporidium hominis
EAKYFTKTKFRCCSRQTN

SEQ ID NO: 2188529 - protein, 24 aa, Cryptosporidium hominis
EALDLLDKLLQFNPNKRISANDAL

SEQ ID NO: 2188530 - protein, 36 aa, Cryptosporidium hominis
EALEKWSSSLFSKLLPRHLMIINEINYRFLNDVRAV

SEQ ID NO: 2188531 - protein, 22 aa, Cryptosporidium hominis
EALFQMDLFTHYDKHAIAALCE

SEQ ID NO: 2188532 - protein, 21 aa, Cryptosporidium hominis
EALGYVLMYFNRGTLPWQGLK

SEQ ID NO: 2188533 - protein, 25 aa, Cryptosporidium hominis
EALIQSICMIFFQSSPESKYRVIQY

SEQ ID NO: 2188534 - protein, 19 aa, Cryptosporidium hominis
EALLAKYMGKKKLIAETGA

SEQ ID NO: 2188535 - protein, 27 aa, Cryptosporidium hominis
EALNGELIILLKNIVFENIKIPLISGE

SEQ ID NO: 2188536 - protein, 23 aa, Cryptosporidium hominis
EALYDICFRTLKLTNPSYGDLNH

SEQ ID NO: 2188537 - protein, 37 aa, Cryptosporidium hominis
EALYNSGIDLFPKKPIRLYYCKSLDFLWDWNSRIFMD

SEQ ID NO: 2188538 - protein, 24 aa, Cryptosporidium hominis
EANLRKYLALPADVSYRASLNEKL

SEQ ID NO: 2188539 - protein, 22 aa, Cryptosporidium hominis
EANRPLFDIVTQYFSSFDNVLS

SEQ ID NO: 2188540 - protein, 27 aa, Cryptosporidium hominis
EANSEVLFLQQIIAPFVLRRSKQDVLS

SEQ ID NO: 2188541 - protein, 32 aa, Cryptosporidium hominis
EAPPAPPAEESSWFSGWFGTSAPEEPPKEDPA

SEQ ID NO: 2188542 - protein, 27 aa, Cryptosporidium hominis
EAQKVFTQHWIMYELDTMLFEAYKESQ

SEQ ID NO: 2188543 - protein, 24 aa, Cryptosporidium hominis
EASRLKLIFAGRILNDSQTVQDVG

SEQ ID NO: 2188544 - protein, 35 aa, Cryptosporidium hominis
EASVAMIRGTRRFLFDFSVTLKCDYTLDNNENEKY

SEQ ID NO: 2188545 - protein, 26 aa, Cryptosporidium hominis
EATLLWGKCSFLLDSDYWKDINSIED

SEQ ID NO: 2188546 - protein, 28 aa, Cryptosporidium hominis
EATPILFSRIVLSLKNKLSLLTLSTLVT

SEQ ID NO: 2188547 - protein, 25 aa, Cryptosporidium hominis
EAVDIYSNWIDKCYEVNSMEQSTSS

SEQ ID NO: 2188548 - protein, 34 aa, Cryptosporidium hominis
EAVYKKYPRYFFNDPWPEIDVSKPIPYVKQKQPS

SEQ ID NO: 2188549 - protein, 18 aa, Cryptosporidium hominis
ECFDLLFQANADLNLKEN

SEQ ID NO: 2188550 - protein, 18 aa, Cryptosporidium hominis
ECFVNIARKLLEKKLKNG

SEQ ID NO: 2188551 - protein, 25 aa, Cryptosporidium hominis
ECGSFLPMNKLFKKGDLLTTLVGLE

SEQ ID NO: 2188552 - protein, 26 aa, Cryptosporidium hominis
ECGSIERVSVLSDKGCAFITFEQEEG

SEQ ID NO: 2188553 - protein, 23 aa, Cryptosporidium hominis
ECGWGEFDIMAKVYFVDSTEKPV

SEQ ID NO: 2188554 - protein, 19 aa, Cryptosporidium hominis
ECIKTLHSLPLTQTNKKYL

SEQ ID NO: 2188555 - protein, 26 aa, Cryptosporidium hominis
ECINNFFTPLIQIIHYWGGDVIKFSG

SEQ ID NO: 2188556 - protein, 22 aa, Cryptosporidium hominis
ECIRLLVAFILNSLSMNELKCK

SEQ ID NO: 2188557 - protein, 32 aa, Cryptosporidium hominis
ECKRFLQHLKSKHLLISTFLAAARASLNSGSP

SEQ ID NO: 2188558 - protein, 24 aa, Cryptosporidium hominis
ECKSYINWLLTYDPANRPNIFEAF

SEQ ID NO: 2188559 - protein, 19 aa, Cryptosporidium hominis
ECKYPIIALKYVNDIYHLC

SEQ ID NO: 2188560 - protein, 18 aa, Cryptosporidium hominis
ECLYLNFDSPWSSSKPAQ

SEQ ID NO: 2188561 - protein, 32 aa, Cryptosporidium hominis
ECMILRSSFEQLYLESLKWIEEKIRGLELILN

SEQ ID NO: 2188562 - protein, 18 aa, Cryptosporidium hominis
ECNPGVEKPWKLPTGPLA

SEQ ID NO: 2188563 - protein, 23 aa, Cryptosporidium hominis
ECSRYHIIALFEDYLDVISPITA

SEQ ID NO: 2188564 - protein, 31 aa, Cryptosporidium hominis
EDAKKIFYTEAPRLGIIPKVMTFDGEKILKN

SEQ ID NO: 2188565 - protein, 23 aa, Cryptosporidium hominis
EDAKRYIRIFSKRTGIDLQTRFP

SEQ ID NO: 2188566 - protein, 31 aa, Cryptosporidium hominis
EDAKYGLCIPTLYSVLLLTICHVHKLKDFEE

SEQ ID NO: 2188567 - protein, 19 aa, Cryptosporidium hominis
EDALTILLRKMGVKDCQPF

SEQ ID NO: 2188568 - protein, 28 aa, Cryptosporidium hominis
EDARTPQKYRMLVPMVDVIFSDVAQPDQ

SEQ ID NO: 2188569 - protein, 22 aa, Cryptosporidium hominis
EDAWPCAELIGYYLDKKNPGNS

SEQ ID NO: 2188570 - protein, 30 aa, Cryptosporidium hominis
EDCIRMAINLFHDYFYCQIKQLLTNFPPDH

SEQ ID NO: 2188571 - protein, 23 aa, Cryptosporidium hominis
EDDEYWMVVFSGNKQLISKHVDL

SEQ ID NO: 2188572 - protein, 25 aa, Cryptosporidium hominis
EDDKKLYRIFVYYSGPNSERLSYRQ

SEQ ID NO: 2188573 - protein, 26 aa, Cryptosporidium hominis
EDDLIQDLQWLIGPKLYEANWMELQD

SEQ ID NO: 2188574 - protein, 27 aa, Cryptosporidium hominis
EDEKLASLLYLLRNTIPSHERAIIFCA

SEQ ID NO: 2188575 - protein, 17 aa, Cryptosporidium hominis
EDELEINSLLHNEFEEI

SEQ ID NO: 2188576 - protein, 26 aa, Cryptosporidium hominis
EDELIEAFKVFDRDGNGFISAAELRH

SEQ ID NO: 2188577 - protein, 28 aa, Cryptosporidium hominis
EDENRYPYRRMIISNIYTLLGELASQAQ

SEQ ID NO: 2188578 - protein, 19 aa, Cryptosporidium hominis
EDEYGYGRHSRLLNIDFGD

SEQ ID NO: 2188579 - protein, 21 aa, Cryptosporidium hominis
EDFEIIFGYSKFIHNKIIKQL

SEQ ID NO: 2188580 - protein, 26 aa, Cryptosporidium hominis
EDFFCSHSPFPVIWFSNYNDIQSFDI

SEQ ID NO: 2188581 - protein, 17 aa, Cryptosporidium hominis
EDFFSMRGAKVAQLLMT

SEQ ID NO: 2188582 - protein, 23 aa, Cryptosporidium hominis
EDGDLFIWNLKEVKSKSYVNING

SEQ ID NO: 2188583 - protein, 28 aa, Cryptosporidium hominis
EDGLDVLRWLDRKLIRLVSRFADYQKDD

SEQ ID NO: 2188584 - protein, 23 aa, Cryptosporidium hominis
EDGRIIFWKIFNLPMNQTVNVST

SEQ ID NO: 2188585 - protein, 35 aa, Cryptosporidium hominis
EDGTQRYILILNEDEIILVNKLLDDIAPHISHNTN

SEQ ID NO: 2188586 - protein, 25 aa, Cryptosporidium hominis
EDHCKFPLTFLLNINSKSPKQGTII

SEQ ID NO: 2188587 - protein, 26 aa, Cryptosporidium hominis
EDHKPRLLVKLLLEQGEGLTVVFVEM

SEQ ID NO: 2188588 - protein, 25 aa, Cryptosporidium hominis
EDISVYDWFYLDSKQQFKYFHKKGN

SEQ ID NO: 2188589 - protein, 25 aa, Cryptosporidium hominis
EDIYPSIGHFALLGSSNSQLLGVMN

SEQ ID NO: 2188590 - protein, 17 aa, Cryptosporidium hominis
EDKFNTLKLGESLLPLG

SEQ ID NO: 2188591 - protein, 21 aa, Cryptosporidium hominis
EDKILKWECLAAIPISYTTNE

SEQ ID NO: 2188592 - protein, 24 aa, Cryptosporidium hominis
EDKILLSDIVFCKTWVSMTPREFY

SEQ ID NO: 2188593 - protein, 30 aa, Cryptosporidium hominis
EDLDPKSQLFQALSRLSLELSNTNLALDQC

SEQ ID NO: 2188594 - protein, 19 aa, Cryptosporidium hominis
EDLFHRSIFLFICTNCTCS

SEQ ID NO: 2188595 - protein, 26 aa, Cryptosporidium hominis
EDLINYIRTNYIPEKMMILGVGNIDH

SEQ ID NO: 2188596 - protein, 23 aa, Cryptosporidium hominis
EDLQVSFGIMPLLLSEYFNLNFT

SEQ ID NO: 2188597 - protein, 20 aa, Cryptosporidium hominis
EDLYNLIELLRRRQLIGSQA

SEQ ID NO: 2188598 - protein, 24 aa, Cryptosporidium hominis
EDMEKIWHHTFYNELRVAPEEHPV

SEQ ID NO: 2188599 - protein, 17 aa, Cryptosporidium hominis
EDMLLETGEYFYSELER

SEQ ID NO: 2188600 - protein, 26 aa, Cryptosporidium hominis
EDNKTPLHYASFRPNLDYAKWVIEKG

SEQ ID NO: 2188601 - protein, 23 aa, Cryptosporidium hominis
EDQSLKSVYYSKSSKYRDSIDKD

SEQ ID NO: 2188602 - protein, 24 aa, Cryptosporidium hominis
EDQVNKIVIHPFSKHLFSASSDET

SEQ ID NO: 2188603 - protein, 27 aa, Cryptosporidium hominis
EDRPDYTYLRKLFRDLMQREGYVDDGD

SEQ ID NO: 2188604 - protein, 24 aa, Cryptosporidium hominis
EDRRPFKCILDVGLTRTTSGNRVF

SEQ ID NO: 2188605 - protein, 22 aa, Cryptosporidium hominis
EDRVNCPFYWKIGACRHGDQCS

SEQ ID NO: 2188606 - protein, 25 aa, Cryptosporidium hominis
EDSDKFVFLLSTRAGGLGINLTSAD

SEQ ID NO: 2188607 - protein, 31 aa, Cryptosporidium hominis
EDSIAKLKAKVPVKPSPLLKSKSEKEKEKEE

SEQ ID NO: 2188608 - protein, 24 aa, Cryptosporidium hominis
EDTGDYRIFRVSGEFSRALQQARV

SEQ ID NO: 2188609 - protein, 20 aa, Cryptosporidium hominis
EDVKKLLGFLGMPCIDAPSE

SEQ ID NO: 2188610 - protein, 29 aa, Cryptosporidium hominis
EDVLSPIIAILTWIYLTRAFCTLSSIPKC

SEQ ID NO: 2188611 - protein, 24 aa, Cryptosporidium hominis
EDVRKKVCIFLSDLLAVYKNNVSL

SEQ ID NO: 2188612 - protein, 29 aa, Cryptosporidium hominis
EDWNNIAVMMFFIYADRWNMKPLSHMYLA

SEQ ID NO: 2188613 - protein, 30 aa, Cryptosporidium hominis
EECDVIALLALPKICCILFLVNPGVCSDMI

SEQ ID NO: 2188614 - protein, 26 aa, Cryptosporidium hominis
EECKKYVFKIKYILANKYNLSVEFND

SEQ ID NO: 2188615 - protein, 25 aa, Cryptosporidium hominis
EECTILLLDRSFDTAPLYIHDYHYQ

SEQ ID NO: 2188616 - protein, 32 aa, Cryptosporidium hominis
EEDEEEFWKHRAKLYRFVNGEWKERGVGNAKL

SEQ ID NO: 2188617 - protein, 24 aa, Cryptosporidium hominis
EEDELLYQLVQRLGPSSWSETARL

SEQ ID NO: 2188618 - protein, 18 aa, Cryptosporidium hominis
EEDLYFDENMADISFQVN

SEQ ID NO: 2188619 - protein, 26 aa, Cryptosporidium hominis
EEEDAFEFWVALSTGLFQCYGSVLTA

SEQ ID NO: 2188620 - protein, 25 aa, Cryptosporidium hominis
EEEFRKLTLIRQETIMKDFIGDISR

SEQ ID NO: 2188621 - protein, 18 aa, Cryptosporidium hominis
EEEIMLLCNLAASCLNKW

SEQ ID NO: 2188622 - protein, 32 aa, Cryptosporidium hominis
EEEKLLHLAKLFPCQWRTIAPLVGRTAHQCLE

SEQ ID NO: 2188623 - protein, 20 aa, Cryptosporidium hominis
EEFPDRILQTFSVFPSPKVS

SEQ ID NO: 2188624 - protein, 24 aa, Cryptosporidium hominis
EEFYESQVHFTGTLMGACIYTKKE

SEQ ID NO: 2188625 - protein, 23 aa, Cryptosporidium hominis
EEFYLMMRFRWDGMDHYRMDKFT

SEQ ID NO: 2188626 - protein, 23 aa, Cryptosporidium hominis
EEIEKWLICRKMKFPRSVCSKNH

SEQ ID NO: 2188627 - protein, 25 aa, Cryptosporidium hominis
EEIFFLKFSDLISELLIIGSKFVDS

SEQ ID NO: 2188628 - protein, 19 aa, Cryptosporidium hominis
EEIIIERIIYLKGNSNYTF

SEQ ID NO: 2188629 - protein, 25 aa, Cryptosporidium hominis
EEILGAFNLLNWLKGRVSICLGRNL

SEQ ID NO: 2188630 - protein, 25 aa, Cryptosporidium hominis
EEIPQQCPIGFVFVESVRKCIKKES

SEQ ID NO: 2188631 - protein, 17 aa, Cryptosporidium hominis
EEIPSLCELQDKHYRNK

SEQ ID NO: 2188632 - protein, 25 aa, Cryptosporidium hominis
EEIPTLYTRRYIGYSLSMICLEFGE

SEQ ID NO: 2188633 - protein, 17 aa, Cryptosporidium hominis
EEIPVLIGGRRIKASYS

SEQ ID NO: 2188634 - protein, 24 aa, Cryptosporidium hominis
EEISNHMRILLLDPKWKQQKDQLV

SEQ ID NO: 2188635 - protein, 24 aa, Cryptosporidium hominis
EEISVLTSLLPNQGQMHKIAQYCH

SEQ ID NO: 2188636 - protein, 24 aa, Cryptosporidium hominis
EEKIMRRVPLVKKIYNWSISETNN

SEQ ID NO: 2188637 - protein, 34 aa, Cryptosporidium hominis
EEKIRGLELILNHQRLPLLFKAVVDSRNILNSKL

SEQ ID NO: 2188638 - protein, 23 aa, Cryptosporidium hominis
EEKKPQLFSITRSLGDSDGRVVG

SEQ ID NO: 2188639 - protein, 23 aa, Cryptosporidium hominis
EEKLHLMALQPIIQEYIYDNLRT

SEQ ID NO: 2188640 - protein, 28 aa, Cryptosporidium hominis
EEKNLSKNLIFLIFKGSTCYELLTAEKN

SEQ ID NO: 2188641 - protein, 20 aa, Cryptosporidium hominis
EEKPIWLQQIQQEHIQAIEL

SEQ ID NO: 2188642 - protein, 25 aa, Cryptosporidium hominis
EEKRARIRLMRRQTARQKWAKMALR

SEQ ID NO: 2188643 - protein, 23 aa, Cryptosporidium hominis
EELAIIWIRQILEGILYLNNLDK

SEQ ID NO: 2188644 - protein, 17 aa, Cryptosporidium hominis
EELIFPENYTWCFDIEQ

SEQ ID NO: 2188645 - protein, 19 aa, Cryptosporidium hominis
EELIPEFLGFVRGVVDSED

SEQ ID NO: 2188646 - protein, 23 aa, Cryptosporidium hominis
EELIPYGVFVWASGASPNSLTKQ

SEQ ID NO: 2188647 - protein, 24 aa, Cryptosporidium hominis
EELKTFLIQNLPKKVKKYNLGVGD

SEQ ID NO: 2188648 - protein, 23 aa, Cryptosporidium hominis
EELLNDMLLKYKDKIQIISFNKQ

SEQ ID NO: 2188649 - protein, 17 aa, Cryptosporidium hominis
EELQLTKQQMEQLRKVY

SEQ ID NO: 2188650 - protein, 25 aa, Cryptosporidium hominis
EELSEKLIWPLHRKYGHALDALKEA

SEQ ID NO: 2188651 - protein, 18 aa, Cryptosporidium hominis
EELTLVGTLIPFEYILNY

SEQ ID NO: 2188652 - protein, 25 aa, Cryptosporidium hominis
EEMERWNIWIAYINMEIAYGKNELL

SEQ ID NO: 2188653 - protein, 31 aa, Cryptosporidium hominis
EEMKAYFKESIWIPNALIPLVRQRNKDKEEA

SEQ ID NO: 2188654 - protein, 26 aa, Cryptosporidium hominis
EEMSQICHLFYKFKVYMNDLVNSFTS

SEQ ID NO: 2188655 - protein, 25 aa, Cryptosporidium hominis
EENLLSLLEWGGIKLPLKSETVKSI

SEQ ID NO: 2188656 - protein, 26 aa, Cryptosporidium hominis
EENNFELLLCHPFNLSLNKYNAINKL

SEQ ID NO: 2188657 - protein, 28 aa, Cryptosporidium hominis
EENSSLFLENILIPKVRLKKLIENGSLL

SEQ ID NO: 2188658 - protein, 25 aa, Cryptosporidium hominis
EEPNNLLPYIQLVSIGRKEKLFVFG

SEQ ID NO: 2188659 - protein, 24 aa, Cryptosporidium hominis
EEQLSDFILPKIKSVLFVDVDLVA

SEQ ID NO: 2188660 - protein, 32 aa, Cryptosporidium hominis
EEREGALFYILNKIFTKRVIVFFQTKKEAHRC

SEQ ID NO: 2188661 - protein, 32 aa, Cryptosporidium hominis
EERLFVISRLHSILRPFLLRRVKSDVLQDLPE

SEQ ID NO: 2188662 - protein, 24 aa, Cryptosporidium hominis
EERLRLVFSVNYPNIWEAKKELGI

SEQ ID NO: 2188663 - protein, 22 aa, Cryptosporidium hominis
EERPFAILDARPKLNAFANKAT

SEQ ID NO: 2188664 - protein, 17 aa, Cryptosporidium hominis
EESLPIQTSIGLYFESI

SEQ ID NO: 2188665 - protein, 30 aa, Cryptosporidium hominis
EESPHWKLPLFGDPLFAILKDLKLKDVGIY

SEQ ID NO: 2188666 - protein, 24 aa, Cryptosporidium hominis
EESQKVEWIFLKEKSLVLYVGINS

SEQ ID NO: 2188667 - protein, 27 aa, Cryptosporidium hominis
EESSIPIFQCFAWERGKFSMGGTQTFP

SEQ ID NO: 2188668 - protein, 27 aa, Cryptosporidium hominis
EETAKFYIAELLLALDYLNNIQGHIHR

SEQ ID NO: 2188669 - protein, 22 aa, Cryptosporidium hominis
EETCMADLIYLIKANLDGVISD

SEQ ID NO: 2188670 - protein, 29 aa, Cryptosporidium hominis
EETKSQRFLLIFIRISLLDFKRIILEIME

SEQ ID NO: 2188671 - protein, 25 aa, Cryptosporidium hominis
EEVCRSLISILIQLGKPSRITDAIS

SEQ ID NO: 2188672 - protein, 30 aa, Cryptosporidium hominis
EEVFKALDFLFFIYGQLGFTFDLFLSTMPK

SEQ ID NO: 2188673 - protein, 22 aa, Cryptosporidium hominis
EEVPVILLRKLTKNETILSLEF

SEQ ID NO: 2188674 - protein, 31 aa, Cryptosporidium hominis
EEVTKLIRYGRRALMHLGDTSKLFGLDLEAL

SEQ ID NO: 2188675 - protein, 23 aa, Cryptosporidium hominis
EEWELFMEYLKQDLPSTFRVVGV

SEQ ID NO: 2188676 - protein, 22 aa, Cryptosporidium hominis
EEWKPISLNAICELLSSKDFKD

SEQ ID NO: 2188677 - protein, 37 aa, Cryptosporidium hominis
EEYKNLTKIIIYFIQSYAALRYKFADKAVIENSFDEI

SEQ ID NO: 2188678 - protein, 17 aa, Cryptosporidium hominis
EEYLELPIAYISRLTDC

SEQ ID NO: 2188679 - protein, 28 aa, Cryptosporidium hominis
EFACSKWMEFFVKNLKYLETPQYLRKTL

SEQ ID NO: 2188680 - protein, 23 aa, Cryptosporidium hominis
EFAEALLVIPKTLAINSAKDATD

SEQ ID NO: 2188681 - protein, 27 aa, Cryptosporidium hominis
EFCIDSLEIRFIPDDIVDFQFEPISES

SEQ ID NO: 2188682 - protein, 26 aa, Cryptosporidium hominis
EFCKYRKMFWDIIWSDILSGKISPIT

SEQ ID NO: 2188683 - protein, 26 aa, Cryptosporidium hominis
EFCTRSWRDAKAWRYSLLVARKSKMA

SEQ ID NO: 2188684 - protein, 22 aa, Cryptosporidium hominis
EFDELLPYSKIAKILKLVTDKK

SEQ ID NO: 2188685 - protein, 28 aa, Cryptosporidium hominis
EFDGNYLKFELPPVLVKSLRTPSWGIPW

SEQ ID NO: 2188686 - protein, 21 aa, Cryptosporidium hominis
EFDKFMSQLKSMGIIEKIDGS

SEQ ID NO: 2188687 - protein, 25 aa, Cryptosporidium hominis
EFEDINSLLFRHSPPQMNGDELANL

SEQ ID NO: 2188688 - protein, 23 aa, Cryptosporidium hominis
EFEKVFKIIKLMKIKKFLNKSEC

SEQ ID NO: 2188689 - protein, 18 aa, Cryptosporidium hominis
EFELLKTYYHPLIVELVY

SEQ ID NO: 2188690 - protein, 20 aa, Cryptosporidium hominis
EFELPGLVNIYFVSNDHQNI

SEQ ID NO: 2188691 - protein, 30 aa, Cryptosporidium hominis
EFERFGAIRDVYLPLDYRSRRPRGFGFVEY

SEQ ID NO: 2188692 - protein, 25 aa, Cryptosporidium hominis
EFERLSFICLKPEPSSISSISKEMR

SEQ ID NO: 2188693 - protein, 18 aa, Cryptosporidium hominis
EFEYFKEMLMARLELTCN

SEQ ID NO: 2188694 - protein, 18 aa, Cryptosporidium hominis
EFFAKRQLVTLFSAPNYC

SEQ ID NO: 2188695 - protein, 19 aa, Cryptosporidium hominis
EFFEESVLLIKSGLENPVH

SEQ ID NO: 2188696 - protein, 17 aa, Cryptosporidium hominis
EFFLKYLQVAGRVENWN

SEQ ID NO: 2188697 - protein, 17 aa, Cryptosporidium hominis
EFFPGFIGLSNFGNNDS

SEQ ID NO: 2188698 - protein, 19 aa, Cryptosporidium hominis
EFGFRPGEWGKPPLDDHGK

SEQ ID NO: 2188699 - protein, 28 aa, Cryptosporidium hominis
EFGLPDNYVLVYLICTRAGGLGINLVSA

SEQ ID NO: 2188700 - protein, 17 aa, Cryptosporidium hominis
EFGYSKRGIIGCTQPRR

SEQ ID NO: 2188701 - protein, 20 aa, Cryptosporidium hominis
EFIEKIVSPIASLHGHEKRV

SEQ ID NO: 2188702 - protein, 19 aa, Cryptosporidium hominis
EFIKFWSYENLYCKHSVVE

SEQ ID NO: 2188703 - protein, 24 aa, Cryptosporidium hominis
EFIKITFQQLLKESLDLIRISAPL

SEQ ID NO: 2188704 - protein, 26 aa, Cryptosporidium hominis
EFIMDLYYSFWNHLISRFTNTNNQIM

SEQ ID NO: 2188705 - protein, 17 aa, Cryptosporidium hominis
EFISRYKAKSDLPMIIS

SEQ ID NO: 2188706 - protein, 23 aa, Cryptosporidium hominis
EFKMNLCLISLNRMDFELNMECE

SEQ ID NO: 2188707 - protein, 26 aa, Cryptosporidium hominis
EFKNLDIEFIIRVLAVYKSYNLAQNV

SEQ ID NO: 2188708 - protein, 23 aa, Cryptosporidium hominis
EFKNLPIGDIIWVARPKLEDNDE

SEQ ID NO: 2188709 - protein, 17 aa, Cryptosporidium hominis
EFKYLRSNVKNHSRITT

SEQ ID NO: 2188710 - protein, 25 aa, Cryptosporidium hominis
EFLDELLILDYIVAKLNKLLESTKI

SEQ ID NO: 2188711 - protein, 18 aa, Cryptosporidium hominis
EFLHELIDRIPSLIAPHS

SEQ ID NO: 2188712 - protein, 22 aa, Cryptosporidium hominis
EFLQTLRYGLLRENLFLELRGI

SEQ ID NO: 2188713 - protein, 23 aa, Cryptosporidium hominis
EFLRLDFTVMNLNNSLLKSQILY

SEQ ID NO: 2188714 - protein, 17 aa, Cryptosporidium hominis
EFLRNISNYLKPGGFFI

SEQ ID NO: 2188715 - protein, 34 aa, Cryptosporidium hominis
EFLSRQRALDRANVFLRWNLAPTKQQIAEFLEMA

SEQ ID NO: 2188716 - protein, 23 aa, Cryptosporidium hominis
EFMDSPIFIIWCANHIRSRLGNE

SEQ ID NO: 2188717 - protein, 25 aa, Cryptosporidium hominis
EFMEMHYKLILKRPILLFWREYFEL

SEQ ID NO: 2188718 - protein, 19 aa, Cryptosporidium hominis
EFPDLLRPKARYSEKVVKT

SEQ ID NO: 2188719 - protein, 33 aa, Cryptosporidium hominis
EFQGRCNYIKYSTQWYLWAKRRNAETYSQNHLE

SEQ ID NO: 2188720 - protein, 25 aa, Cryptosporidium hominis
EFQINTFLRKLGFFVSSRLNEKLYK

SEQ ID NO: 2188721 - protein, 18 aa, Cryptosporidium hominis
EFRDLKTSSKNWFCFQCL

SEQ ID NO: 2188722 - protein, 24 aa, Cryptosporidium hominis
EFRENLKKCLNILELLSMDIEEQA

SEQ ID NO: 2188723 - protein, 22 aa, Cryptosporidium hominis
EFRFRRGYLKSKNPRKMVTQWC

SEQ ID NO: 2188724 - protein, 20 aa, Cryptosporidium hominis
EFRVVPLTNGLLKLPSINFG

SEQ ID NO: 2188725 - protein, 23 aa, Cryptosporidium hominis
EFSERFGIDTLFEKSFEDLNEPK

SEQ ID NO: 2188726 - protein, 25 aa, Cryptosporidium hominis
EFSRLGFGFDIGLGLGPGPGPGPDH

SEQ ID NO: 2188727 - protein, 26 aa, Cryptosporidium hominis
EFSVIFRRAFASRVIPPKLLKELGIQ

SEQ ID NO: 2188728 - protein, 20 aa, Cryptosporidium hominis
EFSYFYPLDCRVSGKDLIFN

SEQ ID NO: 2188729 - protein, 23 aa, Cryptosporidium hominis
EFTCPGMLHSPRAQLLFSKQTEE

SEQ ID NO: 2188730 - protein, 25 aa, Cryptosporidium hominis
EFVGSEFGRIFFSNWIKSIEEDSKK

SEQ ID NO: 2188731 - protein, 28 aa, Cryptosporidium hominis
EFVIMTANLILPLLIIQSHSIQNIIIGG

SEQ ID NO: 2188732 - protein, 19 aa, Cryptosporidium hominis
EFVLWPRHYKDWESISFLV

SEQ ID NO: 2188733 - protein, 32 aa, Cryptosporidium hominis
EFYDNEYGLTPLKIKYPYLTGTYTQLNYNNIP

SEQ ID NO: 2188734 - protein, 25 aa, Cryptosporidium hominis
EFYKKLKLKVILIDGTWSQAKSINK

SEQ ID NO: 2188735 - protein, 18 aa, Cryptosporidium hominis
EFYVHFRGLNRRLDRWVK

SEQ ID NO: 2188736 - protein, 17 aa, Cryptosporidium hominis
EGAFEVLARIQIKKLLR

SEQ ID NO: 2188737 - protein, 23 aa, Cryptosporidium hominis
EGAKSAIQWNQTEYKGRMLRINM

SEQ ID NO: 2188738 - protein, 20 aa, Cryptosporidium hominis
EGCDFGPLRCQYSHNVYWPR

SEQ ID NO: 2188739 - protein, 31 aa, Cryptosporidium hominis
EGDDYSLVDPLPLFEGFEWYISRETIGHYLS

SEQ ID NO: 2188740 - protein, 25 aa, Cryptosporidium hominis
EGDRRKEGMSINRSLLALSQVISQL

SEQ ID NO: 2188741 - protein, 17 aa, Cryptosporidium hominis
EGDWLIVPEFKEIVSRT

SEQ ID NO: 2188742 - protein, 25 aa, Cryptosporidium hominis
EGEALTALILNKLQLNLKVCAVKAP

SEQ ID NO: 2188743 - protein, 21 aa, Cryptosporidium hominis
EGEKCFVVMIANISPSSKAFE

SEQ ID NO: 2188744 - protein, 33 aa, Cryptosporidium hominis
EGEKYKLGSQKLPFFSDLKPPKLSVEKLLTFDD

SEQ ID NO: 2188745 - protein, 19 aa, Cryptosporidium hominis
EGFELLIKLAAESNLMEKI

SEQ ID NO: 2188746 - protein, 17 aa, Cryptosporidium hominis
EGFISFTVDIGPLSINP

SEQ ID NO: 2188747 - protein, 26 aa, Cryptosporidium hominis
EGFNQDSFIYMRGNSIPGVVCGMNSI

SEQ ID NO: 2188748 - protein, 24 aa, Cryptosporidium hominis
EGFRLACKHALYYSIRSTLTIFSD

SEQ ID NO: 2188749 - protein, 23 aa, Cryptosporidium hominis
EGGDLKVWKFFIGYEQINIEDDK

SEQ ID NO: 2188750 - protein, 26 aa, Cryptosporidium hominis
EGGELYNIWYGKYQFDYDKRGKVASK

SEQ ID NO: 2188751 - protein, 30 aa, Cryptosporidium hominis
EGIFDPVYLHPWFLTLFVSTLPLKTVVIIW

SEQ ID NO: 2188752 - protein, 20 aa, Cryptosporidium hominis
EGKINFLPGIAGRKDKRYWN

SEQ ID NO: 2188753 - protein, 25 aa, Cryptosporidium hominis
EGKSYLSKILLIYSLMDIDVGYVQG

SEQ ID NO: 2188754 - protein, 22 aa, Cryptosporidium hominis
EGKVGEWRDGSRLRWIKSSLEN

SEQ ID NO: 2188755 - protein, 25 aa, Cryptosporidium hominis
EGLASPIGFSPLASPTYRKNVPQTR

SEQ ID NO: 2188756 - protein, 25 aa, Cryptosporidium hominis
EGLIEFIPEMKILIQELNEILDKLK

SEQ ID NO: 2188757 - protein, 26 aa, Cryptosporidium hominis
EGLKNLPPIFLANIEVSPRPDKEPCI

SEQ ID NO: 2188758 - protein, 18 aa, Cryptosporidium hominis
EGLLKLPYSLIHIPLNRK

SEQ ID NO: 2188759 - protein, 23 aa, Cryptosporidium hominis
EGLNLHLKTLRTFKSFILENEED

SEQ ID NO: 2188760 - protein, 23 aa, Cryptosporidium hominis
EGNFLNFDGIRRSGMGMIDVGRF

SEQ ID NO: 2188761 - protein, 25 aa, Cryptosporidium hominis
EGNIEMLKLEFYRISSRLSDSLKEK

SEQ ID NO: 2188762 - protein, 24 aa, Cryptosporidium hominis
EGNNGFCFLQFSSPLTSYRALKWE

SEQ ID NO: 2188763 - protein, 25 aa, Cryptosporidium hominis
EGNNIFLNIWTPLHLNQIMDRKTLE

SEQ ID NO: 2188764 - protein, 26 aa, Cryptosporidium hominis
EGNRIYLPCIYILNKIDQITIEELDV

SEQ ID NO: 2188765 - protein, 25 aa, Cryptosporidium hominis
EGSCNYLEDYLIKKLKRNDPKVKFK

SEQ ID NO: 2188766 - protein, 24 aa, Cryptosporidium hominis
EGSDTIFPLISEPLKTFVTVNPAT

SEQ ID NO: 2188767 - protein, 18 aa, Cryptosporidium hominis
EGVEWYPERQSWKVVGHT

SEQ ID NO: 2188768 - protein, 25 aa, Cryptosporidium hominis
EGVEYLRRYLDLPASVFPATHTKKT

SEQ ID NO: 2188769 - protein, 23 aa, Cryptosporidium hominis
EGVPDLIYLIAQLTQNYMGLHCL

SEQ ID NO: 2188770 - protein, 27 aa, Cryptosporidium hominis
EGVRPSRIFFKWKIYYCHSKEDAYRFF

SEQ ID NO: 2188771 - protein, 24 aa, Cryptosporidium hominis
EHADRVVVYLYLDKDLSIQFGSYM

SEQ ID NO: 2188772 - protein, 23 aa, Cryptosporidium hominis
EHDFIMATYLADRVILFTGTPGV

SEQ ID NO: 2188773 - protein, 28 aa, Cryptosporidium hominis
EHDKFLLNWKRYCKTIPLRGVILINKEF

SEQ ID NO: 2188774 - protein, 27 aa, Cryptosporidium hominis
EHLDISWCPMLTSKTLKYLALRYSRNN

SEQ ID NO: 2188775 - protein, 26 aa, Cryptosporidium hominis
EHNGYVFLILEYVDTNLFNILHRKKK

SEQ ID NO: 2188776 - protein, 27 aa, Cryptosporidium hominis
EHNYHAWSLVNWLIYELIPTIISTDDS

SEQ ID NO: 2188777 - protein, 24 aa, Cryptosporidium hominis
EHPKFTEYLCGSYVKVPIINPSTN

SEQ ID NO: 2188778 - protein, 25 aa, Cryptosporidium hominis
EHSKSLNISYPFLDDIIIRPKSTAR

SEQ ID NO: 2188779 - protein, 25 aa, Cryptosporidium hominis
EHSSYVPYRDSKLTRLLQDSLGGRT

SEQ ID NO: 2188780 - protein, 30 aa, Cryptosporidium hominis
EHVENIIRRLFKVFLQDFKLSSMYKTISNS

SEQ ID NO: 2188781 - protein, 17 aa, Cryptosporidium hominis
EIAIWDLERSLKIFSYQ

SEQ ID NO: 2188782 - protein, 25 aa, Cryptosporidium hominis
EICVGQNGIIWFSASNIKEMLLIMS

SEQ ID NO: 2188783 - protein, 27 aa, Cryptosporidium hominis
EIDKKTQRCLGFAHILFEKAIEGHDAI

SEQ ID NO: 2188784 - protein, 17 aa, Cryptosporidium hominis
EIDKLIGEKVFFSSALQ

SEQ ID NO: 2188785 - protein, 19 aa, Cryptosporidium hominis
EIDLLDFYVKSWKDDPYYL

SEQ ID NO: 2188786 - protein, 21 aa, Cryptosporidium hominis
EIDNELYIQNDCIYGDGDGDG

SEQ ID NO: 2188787 - protein, 26 aa, Cryptosporidium hominis
EIDPLKKVVLLFNKADFLTLELRKQW

SEQ ID NO: 2188788 - protein, 19 aa, Cryptosporidium hominis
EIDQLFDNLSYRMQRRHTQ

SEQ ID NO: 2188789 - protein, 31 aa, Cryptosporidium hominis
EIDRLFLNAGQFFKYIERCSPIKPISLNCII

SEQ ID NO: 2188790 - protein, 27 aa, Cryptosporidium hominis
EIDRLPNCVFPKSFYSWLLNENNNKYF

SEQ ID NO: 2188791 - protein, 23 aa, Cryptosporidium hominis
EIDTLFYIFRLLGTANESNWPGV

SEQ ID NO: 2188792 - protein, 23 aa, Cryptosporidium hominis
EIEDFVKILGGKLTSAVSGRTSY

SEQ ID NO: 2188793 - protein, 19 aa, Cryptosporidium hominis
EIEFRYYAFSNLDTIWVPD

SEQ ID NO: 2188794 - protein, 25 aa, Cryptosporidium hominis
EIEHFQWYVGQYLTSRYRILDIIGE

SEQ ID NO: 2188795 - protein, 23 aa, Cryptosporidium hominis
EIEKIKVDILRKLNFNPSTGVQT

SEQ ID NO: 2188796 - protein, 25 aa, Cryptosporidium hominis
EIEKLDEMILFPPVKVVEIRDNIFQ

SEQ ID NO: 2188797 - protein, 19 aa, Cryptosporidium hominis
EIELEIIPWSLLFGDSLSN

SEQ ID NO: 2188798 - protein, 22 aa, Cryptosporidium hominis
EIELFRKYFPDNMDLDSIFPGD

SEQ ID NO: 2188799 - protein, 28 aa, Cryptosporidium hominis
EIERIQKLLCFCLEFFLKYLQVAGRVEN

SEQ ID NO: 2188800 - protein, 31 aa, Cryptosporidium hominis
EIESLPFNIQLDCLYLFSPDYDGSPPLYVIE

SEQ ID NO: 2188801 - protein, 26 aa, Cryptosporidium hominis
EIESSNIFLPLIKGKCSRAARRQQKL

SEQ ID NO: 2188802 - protein, 17 aa, Cryptosporidium hominis
EIEVYLKKLLGTKLEMQ

SEQ ID NO: 2188803 - protein, 19 aa, Cryptosporidium hominis
EIEYLRYFPDDYIDAAVRQ

SEQ ID NO: 2188804 - protein, 25 aa, Cryptosporidium hominis
EIEYSPWIMYRIYFSNQVKNSRLIQ

SEQ ID NO: 2188805 - protein, 29 aa, Cryptosporidium hominis
EIFGIEHLLRLLIILPKLIGDHISFGEYN

SEQ ID NO: 2188806 - protein, 20 aa, Cryptosporidium hominis
EIFITPNSGWGGKGLLGCDI

SEQ ID NO: 2188807 - protein, 20 aa, Cryptosporidium hominis
EIFLREKYGIIFESRPIIVA

SEQ ID NO: 2188808 - protein, 17 aa, Cryptosporidium hominis
EIFRFRQEMQLLSILDH

SEQ ID NO: 2188809 - protein, 25 aa, Cryptosporidium hominis
EIGFLILDLGSFIMSIRDFSKYKSS

SEQ ID NO: 2188810 - protein, 25 aa, Cryptosporidium hominis
EIGKNNKMIVLDLPVICRKVFCGSN

SEQ ID NO: 2188811 - protein, 45 aa, Cryptosporidium hominis
EIGRNEWYIYCLKIIDALVCFDRKGVKYGIPFLRPVDPNMDGASD

SEQ ID NO: 2188812 - protein, 27 aa, Cryptosporidium hominis
EIGTFTYSCFLPPFIPPTFTGKLISFN

SEQ ID NO: 2188813 - protein, 20 aa, Cryptosporidium hominis
EIGVFANLTNRYCLLAHGSS

SEQ ID NO: 2188814 - protein, 21 aa, Cryptosporidium hominis
EIHEYLLLKGVNAVAIHGGLT

SEQ ID NO: 2188815 - protein, 21 aa, Cryptosporidium hominis
EIHSNKLIPPSSYYDSIESSP

SEQ ID NO: 2188816 - protein, 25 aa, Cryptosporidium hominis
EIIASNGLFILKIIKDFSIGNKWDG

SEQ ID NO: 2188817 - protein, 33 aa, Cryptosporidium hominis
EIICKHFLSAVEKKQYGWFWVCPEGGDNCKYRH

SEQ ID NO: 2188818 - protein, 24 aa, Cryptosporidium hominis
EIIDLILCQIQFRATLLWIHRISV

SEQ ID NO: 2188819 - protein, 30 aa, Cryptosporidium hominis
EIIFKVQCLWPVFLLPLVSGELFFTINENY

SEQ ID NO: 2188820 - protein, 17 aa, Cryptosporidium hominis
EIIGVSPDAGAAEIKKE

SEQ ID NO: 2188821 - protein, 18 aa, Cryptosporidium hominis
EIIKMLMDVYFDDFISWN

SEQ ID NO: 2188822 - protein, 23 aa, Cryptosporidium hominis
EIIRRDIYHAPLLYYREDDSISD

SEQ ID NO: 2188823 - protein, 18 aa, Cryptosporidium hominis
EIITIYIKNIRKEIFKLQ

SEQ ID NO: 2188824 - protein, 24 aa, Cryptosporidium hominis
EIIVTGIYRTFRDQKLNIKSGFPI

SEQ ID NO: 2188825 - protein, 22 aa, Cryptosporidium hominis
EIKDYVNPLLSECSCINIFAFG

SEQ ID NO: 2188826 - protein, 26 aa, Cryptosporidium hominis
EIKFVGFLIRQFKGETELFFAQKMDL

SEQ ID NO: 2188827 - protein, 26 aa, Cryptosporidium hominis
EIKGDLYFRCLLALEYSKSKDLSVDC

SEQ ID NO: 2188828 - protein, 23 aa, Cryptosporidium hominis
EIKIKGFLGSIFLAIKSLSKKIL

SEQ ID NO: 2188829 - protein, 22 aa, Cryptosporidium hominis
EIKKAYSLFIDVKRSTQYLIDY

SEQ ID NO: 2188830 - protein, 18 aa, Cryptosporidium hominis
EIKNIVNLLKRFLSIIED

SEQ ID NO: 2188831 - protein, 43 aa, Cryptosporidium hominis
EIKNQLLDFTLENQKFKKLIKQTIIPLIPNAEYNSTIGHILMV

SEQ ID NO: 2188832 - protein, 24 aa, Cryptosporidium hominis
EIKQKLQIWLGFSQISLNIRQACI

SEQ ID NO: 2188833 - protein, 23 aa, Cryptosporidium hominis
EIKRMEHILNMRILEGEKNTSFG

SEQ ID NO: 2188834 - protein, 28 aa, Cryptosporidium hominis
EIKRSLIYETLNRKINLKSELELLYLDF

SEQ ID NO: 2188835 - protein, 18 aa, Cryptosporidium hominis
EIKYSLIKIYRELKVKGT

SEQ ID NO: 2188836 - protein, 19 aa, Cryptosporidium hominis
EILARLSQCRVINSKTIKL

SEQ ID NO: 2188837 - protein, 22 aa, Cryptosporidium hominis
EILDFYSPLLINTIIIHKSKSL

SEQ ID NO: 2188838 - protein, 20 aa, Cryptosporidium hominis
EILDRISFIWGYNNDNMYKI

SEQ ID NO: 2188839 - protein, 20 aa, Cryptosporidium hominis
EILGPINTYFFSIKMNNGVK

SEQ ID NO: 2188840 - protein, 17 aa, Cryptosporidium hominis
EILMFLQNDQSKISFPR

SEQ ID NO: 2188841 - protein, 22 aa, Cryptosporidium hominis
EILMSDLCRRYHRAGLWDSSCP

SEQ ID NO: 2188842 - protein, 25 aa, Cryptosporidium hominis
EILNLIKPFYENFLMTLFNKNRNKK

SEQ ID NO: 2188843 - protein, 29 aa, Cryptosporidium hominis
EILNTIRFSAIEILAWTQSLLSEIFIKET

SEQ ID NO: 2188844 - protein, 23 aa, Cryptosporidium hominis
EILQIIYIMTKLCKSQLYSYSWY

SEQ ID NO: 2188845 - protein, 22 aa, Cryptosporidium hominis
EIMGSFDIILGSDLVYNSDMEV

SEQ ID NO: 2188846 - protein, 18 aa, Cryptosporidium hominis
EIMSFSGLIDFSSIFVPY

SEQ ID NO: 2188847 - protein, 29 aa, Cryptosporidium hominis
EINDSKIVFFPLLARLLGIEIEDLRTNIV

SEQ ID NO: 2188848 - protein, 23 aa, Cryptosporidium hominis
EINELNILLESKREKLRQMDAKS

SEQ ID NO: 2188849 - protein, 26 aa, Cryptosporidium hominis
EINKKIIRTRLFTDKWWTKKNGEKWG

SEQ ID NO: 2188850 - protein, 26 aa, Cryptosporidium hominis
EINLLVYRYLIENGFVHTAFSFNSEA

SEQ ID NO: 2188851 - protein, 22 aa, Cryptosporidium hominis
EINPPEVLTFKGPLTEKIDNYA

SEQ ID NO: 2188852 - protein, 23 aa, Cryptosporidium hominis
EINSMLFWGKYGNNKDFKKIQNS

SEQ ID NO: 2188853 - protein, 17 aa, Cryptosporidium hominis
EIPFIYLKDLTSKWRNA

SEQ ID NO: 2188854 - protein, 31 aa, Cryptosporidium hominis
EIPNTHFSLPPPKSLLRLFEKMKLVDSKYVE

SEQ ID NO: 2188855 - protein, 23 aa, Cryptosporidium hominis
EIPSSLPITLLDDKNYKLIMSSL

SEQ ID NO: 2188856 - protein, 23 aa, Cryptosporidium hominis
EIPVIKPDIFFMNGHPGDSICVE

SEQ ID NO: 2188857 - protein, 19 aa, Cryptosporidium hominis
EIQEILKNKSMDLPIIRLR

SEQ ID NO: 2188858 - protein, 22 aa, Cryptosporidium hominis
EIQGFIVTKFDPLLSIVKELND

SEQ ID NO: 2188859 - protein, 18 aa, Cryptosporidium hominis
EIQRIRGIELAEKEERAK

SEQ ID NO: 2188860 - protein, 34 aa, Cryptosporidium hominis
EIQYAKDFEFFFGVPYRPYIRLSRYRFGKNMKYP

SEQ ID NO: 2188861 - protein, 29 aa, Cryptosporidium hominis
EIRDTCTYFPLRKLLIKSLLEKGEITHHQ

SEQ ID NO: 2188862 - protein, 19 aa, Cryptosporidium hominis
EIRFRRKLNFLKDSVRDNR

SEQ ID NO: 2188863 - protein, 23 aa, Cryptosporidium hominis
EIRNNACQLTKWATQALLSSCDI

SEQ ID NO: 2188864 - protein, 27 aa, Cryptosporidium hominis
EIRSDCFVLGWYQLIRLDDFQDYGVVS

SEQ ID NO: 2188865 - protein, 21 aa, Cryptosporidium hominis
EIRSTAWIPKGEYIPEDIIMG

SEQ ID NO: 2188866 - protein, 27 aa, Cryptosporidium hominis
EISAPIPIKIVPKIIPKPAITKEQPTN

SEQ ID NO: 2188867 - protein, 26 aa, Cryptosporidium hominis
EISFVTQIKLIYKKIGWLINSKSSKI

SEQ ID NO: 2188868 - protein, 36 aa, Cryptosporidium hominis
EISKSLLPIHLDIVKLSQIPPILGLQLEVSMGQLTN

SEQ ID NO: 2188869 - protein, 32 aa, Cryptosporidium hominis
EISLPSHGNHLPLLPPSRFPFQSEARRTINRL

SEQ ID NO: 2188870 - protein, 25 aa, Cryptosporidium hominis
EISNEKLLLIKIEPFFGPTQILNWD

SEQ ID NO: 2188871 - protein, 18 aa, Cryptosporidium hominis
EISNLPQYLGKVNNENFE

SEQ ID NO: 2188872 - protein, 32 aa, Cryptosporidium hominis
EISQNLSYITISYFPSSFSGLTTLPVSAKFAS

SEQ ID NO: 2188873 - protein, 22 aa, Cryptosporidium hominis
EISRIQGILKNFARESDKMDVK

SEQ ID NO: 2188874 - protein, 18 aa, Cryptosporidium hominis
EITDLFSFFIIESTVINN

SEQ ID NO: 2188875 - protein, 33 aa, Cryptosporidium hominis
EITISPTFLSVIPLIFRQFIDISYMYDKFKTIH

SEQ ID NO: 2188876 - protein, 19 aa, Cryptosporidium hominis
EITLLRINGLFYIMDSNGL

SEQ ID NO: 2188877 - protein, 27 aa, Cryptosporidium hominis
EITNDLKGNMFKLGYDKIVSTISSALI

SEQ ID NO: 2188878 - protein, 27 aa, Cryptosporidium hominis
EITSELFAIQWFLTLFTYDIADTEYAI

SEQ ID NO: 2188879 - protein, 26 aa, Cryptosporidium hominis
EIVCPTFELLLRKCIIEWEKQIDYII

SEQ ID NO: 2188880 - protein, 20 aa, Cryptosporidium hominis
EIVHLSLPFEMANEAFFRDY

SEQ ID NO: 2188881 - protein, 17 aa, Cryptosporidium hominis
EIVLTLFCDLENMGISS

SEQ ID NO: 2188882 - protein, 19 aa, Cryptosporidium hominis
EIVSIIPNCDFYKRNGFNI

SEQ ID NO: 2188883 - protein, 23 aa, Cryptosporidium hominis
EIVTILHPVTYLNKVLVVTSKGC

SEQ ID NO: 2188884 - protein, 19 aa, Cryptosporidium hominis
EIVYALIPNVGLLEKNLKI

SEQ ID NO: 2188885 - protein, 18 aa, Cryptosporidium hominis
EIYIWDINTGRCRERIVD

SEQ ID NO: 2188886 - protein, 17 aa, Cryptosporidium hominis
EIYLNQDAERRARQLIQ

SEQ ID NO: 2188887 - protein, 25 aa, Cryptosporidium hominis
EIYMKVLRDLVKLASLQTAFFSLDE

SEQ ID NO: 2188888 - protein, 21 aa, Cryptosporidium hominis
EKAFFLSLSNHLHILESRKNS

SEQ ID NO: 2188889 - protein, 18 aa, Cryptosporidium hominis
EKAIKYLDARRKGIILTT

SEQ ID NO: 2188890 - protein, 24 aa, Cryptosporidium hominis
EKAKYLLVSIPPYGTKEIIFFLGS

SEQ ID NO: 2188891 - protein, 25 aa, Cryptosporidium hominis
EKARNFFGRFGITGSLALEPLYVLS

SEQ ID NO: 2188892 - protein, 30 aa, Cryptosporidium hominis
EKCKHKIFRNKLILAPLTTVGNLPFRRLCL

SEQ ID NO: 2188893 - protein, 24 aa, Cryptosporidium hominis
EKCQHFYYLIKKNVPLIESVNIKN

SEQ ID NO: 2188894 - protein, 22 aa, Cryptosporidium hominis
EKDIFLLRAVLVLLSLNKTQFA

SEQ ID NO: 2188895 - protein, 27 aa, Cryptosporidium hominis
EKDKWMDAIILWTLKSRKYRSKAEDSK

SEQ ID NO: 2188896 - protein, 21 aa, Cryptosporidium hominis
EKEFYIHESVFLFAREELQRI

SEQ ID NO: 2188897 - protein, 18 aa, Cryptosporidium hominis
EKEISVEYLLKLIDDKKK

SEQ ID NO: 2188898 - protein, 26 aa, Cryptosporidium hominis
EKELELHDIMSWIPEVKYNEDKYQTV

SEQ ID NO: 2188899 - protein, 21 aa, Cryptosporidium hominis
EKELHIIWDHIIRQGGTIDML

SEQ ID NO: 2188900 - protein, 31 aa, Cryptosporidium hominis
EKELIKTRGLYLDLVKKYKAIYKQYETDMIT

SEQ ID NO: 2188901 - protein, 27 aa, Cryptosporidium hominis
EKFALLIVDSIIALFRTEFSGRGELAE

SEQ ID NO: 2188902 - protein, 21 aa, Cryptosporidium hominis
EKFDKVMGYFRKYAGLEEGLS

SEQ ID NO: 2188903 - protein, 23 aa, Cryptosporidium hominis
EKFFGSMEFGEVESLTLVLACKL

SEQ ID NO: 2188904 - protein, 21 aa, Cryptosporidium hominis
EKFIRNKLVMALEGIDSRISQ

SEQ ID NO: 2188905 - protein, 20 aa, Cryptosporidium hominis
EKFKMMDCYFITGTSFEEIL

SEQ ID NO: 2188906 - protein, 19 aa, Cryptosporidium hominis
EKFNILPHYNISKLSKSEC

SEQ ID NO: 2188907 - protein, 18 aa, Cryptosporidium hominis
EKFPNIAVWSKESPVASL

SEQ ID NO: 2188908 - protein, 29 aa, Cryptosporidium hominis
EKFSQISKIWPLSFLKPRFTPEVLSDQVQ

SEQ ID NO: 2188909 - protein, 29 aa, Cryptosporidium hominis
EKFSRYRGLFFSLIANMFVLCEDDKSAQI

SEQ ID NO: 2188910 - protein, 19 aa, Cryptosporidium hominis
EKFWLVDSKGLITNSRDLN

SEQ ID NO: 2188911 - protein, 19 aa, Cryptosporidium hominis
EKFYFDRILCDVPCSSDGT

SEQ ID NO: 2188912 - protein, 23 aa, Cryptosporidium hominis
EKGSSMKVILATDGFLKFSDEAS

SEQ ID NO: 2188913 - protein, 17 aa, Cryptosporidium hominis
EKHPLGMHIIANSSNKG

SEQ ID NO: 2188914 - protein, 22 aa, Cryptosporidium hominis
EKIFYAIFKVEDLYKILLCFIY

SEQ ID NO: 2188915 - protein, 18 aa, Cryptosporidium hominis
EKIINLKRLLFNSVGRPG

SEQ ID NO: 2188916 - protein, 21 aa, Cryptosporidium hominis
EKILQLIRHLIATGAQWQDIW

SEQ ID NO: 2188917 - protein, 20 aa, Cryptosporidium hominis
EKILSIVCNICKQTFMCTAN

SEQ ID NO: 2188918 - protein, 28 aa, Cryptosporidium hominis
EKINSLIDLFHRIYRIMYQDLRNEVERN

SEQ ID NO: 2188919 - protein, 35 aa, Cryptosporidium hominis
EKIRQMYLFLNHRVRLVYLHYILSNVHFFNIDSVD

SEQ ID NO: 2188920 - protein, 26 aa, Cryptosporidium hominis
EKIVQKIMINLLDALKFIHKNGIIHR

SEQ ID NO: 2188921 - protein, 21 aa, Cryptosporidium hominis
EKKEELLIGGLSVCKHIFCFV

SEQ ID NO: 2188922 - protein, 26 aa, Cryptosporidium hominis
EKKFDEAIVKLYWAMTNRMNLLNITE

SEQ ID NO: 2188923 - protein, 25 aa, Cryptosporidium hominis
EKKKLLILGQRQLATMELSVVSSFG

SEQ ID NO: 2188924 - protein, 31 aa, Cryptosporidium hominis
EKKNRKLVQKLGLKPLPDFEKVVVRGARGLS

SEQ ID NO: 2188925 - protein, 21 aa, Cryptosporidium hominis
EKKPCIIYNYPKDIKSFYMKL

SEQ ID NO: 2188926 - protein, 24 aa, Cryptosporidium hominis
EKKSIELVPKKWQGKGYLGCNIAF

SEQ ID NO: 2188927 - protein, 25 aa, Cryptosporidium hominis
EKKSRDEYLLLKNKDILLLDKCKEA

SEQ ID NO: 2188928 - protein, 25 aa, Cryptosporidium hominis
EKKVKFYLDPIMDFDINLYNQTNLV

SEQ ID NO: 2188929 - protein, 24 aa, Cryptosporidium hominis
EKKVPVAFGLFKLQMGATIIDDLV

SEQ ID NO: 2188930 - protein, 17 aa, Cryptosporidium hominis
EKLFGRSSIFNIPGIGI

SEQ ID NO: 2188931 - protein, 34 aa, Cryptosporidium hominis
EKLGAFLFPESVVFWRWLTPRILAIVGDKGIYHW

SEQ ID NO: 2188932 - protein, 18 aa, Cryptosporidium hominis
EKLGKVLKKNNVSIDIIS

SEQ ID NO: 2188933 - protein, 25 aa, Cryptosporidium hominis
EKLKPILPKLTGKKEYFVCRNKPRK

SEQ ID NO: 2188934 - protein, 20 aa, Cryptosporidium hominis
EKLLDLLVRCENKIQTRIKI

SEQ ID NO: 2188935 - protein, 24 aa, Cryptosporidium hominis
EKLLFDLQNLEKEWWIDCLIEIGL

SEQ ID NO: 2188936 - protein, 18 aa, Cryptosporidium hominis
EKLLIWVEFWAQVKCMII

SEQ ID NO: 2188937 - protein, 33 aa, Cryptosporidium hominis
EKLLQNDKLLINQLQFRLHKLTKNPKFVCRTYS

SEQ ID NO: 2188938 - protein, 19 aa, Cryptosporidium hominis
EKLNKLKSALSELGDFNKK

SEQ ID NO: 2188939 - protein, 18 aa, Cryptosporidium hominis
EKLPASTITLYPDLIGKV

SEQ ID NO: 2188940 - protein, 21 aa, Cryptosporidium hominis
EKLREHFGKYGTIKNLSVMVD

SEQ ID NO: 2188941 - protein, 25 aa, Cryptosporidium hominis
EKLSSTNWPTWLGLSPLAENVISAQ

SEQ ID NO: 2188942 - protein, 28 aa, Cryptosporidium hominis
EKLTYQNFLDWFKQIYNNSNLFMLAIQS

SEQ ID NO: 2188943 - protein, 28 aa, Cryptosporidium hominis
EKMDISNDLTFRYLLDTLQESYHNFKFI

SEQ ID NO: 2188944 - protein, 23 aa, Cryptosporidium hominis
EKNDQLPVILFGFSRRKVEQLAT

SEQ ID NO: 2188945 - protein, 29 aa, Cryptosporidium hominis
EKNKPMICDFILFSILFDDISLIEFNEGE

SEQ ID NO: 2188946 - protein, 23 aa, Cryptosporidium hominis
EKNLSHDLLLDEYSIHEKCFTDN

SEQ ID NO: 2188947 - protein, 22 aa, Cryptosporidium hominis
EKNQRFPAKYKGQKKDTLSFSY

SEQ ID NO: 2188948 - protein, 23 aa, Cryptosporidium hominis
EKNSLILLLTSYCNWDEQIADVS

SEQ ID NO: 2188949 - protein, 30 aa, Cryptosporidium hominis
EKNTDPPIWKYWSLPNIEFHGLWDVLHYEN

SEQ ID NO: 2188950 - protein, 20 aa, Cryptosporidium hominis
EKPLLLLLDGINQKFHTDKA

SEQ ID NO: 2188951 - protein, 27 aa, Cryptosporidium hominis
EKQEQFYILAILLGCDYTVGVNGIGPV

SEQ ID NO: 2188952 - protein, 24 aa, Cryptosporidium hominis
EKQEYVIHPLISNLGMEKNQIAQE

SEQ ID NO: 2188953 - protein, 19 aa, Cryptosporidium hominis
EKQKHCVSFLAWSSDFTVY

SEQ ID NO: 2188954 - protein, 23 aa, Cryptosporidium hominis
EKQVVRWLTQALLGLAHLHNKRI

SEQ ID NO: 2188955 - protein, 24 aa, Cryptosporidium hominis
EKRFLRRIRNVLPGINTPIYEKYG

SEQ ID NO: 2188956 - protein, 24 aa, Cryptosporidium hominis
EKRIKSISLTLSIPPLTKPTDFPR

SEQ ID NO: 2188957 - protein, 24 aa, Cryptosporidium hominis
EKRQKAAWLAYVDNNLPILKNENP

SEQ ID NO: 2188958 - protein, 19 aa, Cryptosporidium hominis
EKRRLLPYHMHLSLEVIDC

SEQ ID NO: 2188959 - protein, 23 aa, Cryptosporidium hominis
EKRTQMELKLLSTCLHDMALRYH

SEQ ID NO: 2188960 - protein, 28 aa, Cryptosporidium hominis
EKSGSRMKYWWSKYIRRQKKKKEESKEK

SEQ ID NO: 2188961 - protein, 18 aa, Cryptosporidium hominis
EKSISEIVLTLFCDLENM

SEQ ID NO: 2188962 - protein, 17 aa, Cryptosporidium hominis
EKSLFSMGLISTMNPYH

SEQ ID NO: 2188963 - protein, 37 aa, Cryptosporidium hominis
EKSLMIQTLWSNLINNFTFKFIPRLLSKPYSLEETNE

SEQ ID NO: 2188964 - protein, 29 aa, Cryptosporidium hominis
EKSNSPFHFIWDSIIFNKTKKILGGNVKA

SEQ ID NO: 2188965 - protein, 30 aa, Cryptosporidium hominis
EKSRNLPKSIKWHFIGHLQSNKVKTLLSID

SEQ ID NO: 2188966 - protein, 25 aa, Cryptosporidium hominis
EKTFKEYIIRQLGIRWERIKKQNIE

SEQ ID NO: 2188967 - protein, 22 aa, Cryptosporidium hominis
EKTLTVLVQCSYVILDEADRMI

SEQ ID NO: 2188968 - protein, 29 aa, Cryptosporidium hominis
EKVELLNSFPSCSLAIIKSLTKGDEIDEE

SEQ ID NO: 2188969 - protein, 24 aa, Cryptosporidium hominis
EKVIPHIKTFLKYKIFDNAIKIIW

SEQ ID NO: 2188970 - protein, 22 aa, Cryptosporidium hominis
EKVKYIQIWLHNLIPIGISRVK

SEQ ID NO: 2188971 - protein, 21 aa, Cryptosporidium hominis
EKVLVLIKDLPFTLLQHNTQV

SEQ ID NO: 2188972 - protein, 66 aa, Cryptosporidium hominis
EKYDSEELAILYRKRKLHVLGIIRLIGELFIRKMFPMRSLNELVFDLVMIQENPDEYAVECLCQLI

SEQ ID NO: 2188973 - protein, 23 aa, Cryptosporidium hominis
EKYEQLVMLPGIGPKMANLILQI

SEQ ID NO: 2188974 - protein, 17 aa, Cryptosporidium hominis
EKYLFLVQKNEYLISRL

SEQ ID NO: 2188975 - protein, 36 aa, Cryptosporidium hominis
EKYLKRMCFAGFSEIFISWIHVKAMRCFVEAVLRYG

SEQ ID NO: 2188976 - protein, 19 aa, Cryptosporidium hominis
EKYSKFFPVSIIGEAESGG

SEQ ID NO: 2188977 - protein, 26 aa, Cryptosporidium hominis
ELAQLQALELTWKYPIENSSNFPNDK

SEQ ID NO: 2188978 - protein, 18 aa, Cryptosporidium hominis
ELAQYRQQFRRTVDGRLC

SEQ ID NO: 2188979 - protein, 21 aa, Cryptosporidium hominis
ELARTLTIKLLDTISLKDEMS

SEQ ID NO: 2188980 - protein, 19 aa, Cryptosporidium hominis
ELAYYLLDSMYISDIIINS

SEQ ID NO: 2188981 - protein, 26 aa, Cryptosporidium hominis
ELCKVYFPTQLRLIDNYASSSTLIPL

SEQ ID NO: 2188982 - protein, 24 aa, Cryptosporidium hominis
ELDIDYHYFSFPTSLQIFNNASEE

SEQ ID NO: 2188983 - protein, 19 aa, Cryptosporidium hominis
ELDIPIKGYFTISPESKEP

SEQ ID NO: 2188984 - protein, 26 aa, Cryptosporidium hominis
ELEAFQHFIQLIQSVLYFQDKGVVHR

SEQ ID NO: 2188985 - protein, 18 aa, Cryptosporidium hominis
ELEKALGLPLDSLKPKKN

SEQ ID NO: 2188986 - protein, 25 aa, Cryptosporidium hominis
ELEKLIELVRLNVGLIFCIDEPSEV

SEQ ID NO: 2188987 - protein, 21 aa, Cryptosporidium hominis
ELENPYILISQGKISSLKSIL

SEQ ID NO: 2188988 - protein, 17 aa, Cryptosporidium hominis
ELERSFDYIVGIDGVPL

SEQ ID NO: 2188989 - protein, 29 aa, Cryptosporidium hominis
ELESELIRQSLLNLIRHFQLVQSKENNSQ

SEQ ID NO: 2188990 - protein, 18 aa, Cryptosporidium hominis
ELETEYVKLIPNSEIVFA

SEQ ID NO: 2188991 - protein, 25 aa, Cryptosporidium hominis
ELETQLYMRIAPELYLKQLIVGGLD

SEQ ID NO: 2188992 - protein, 19 aa, Cryptosporidium hominis
ELFFYLAKDNVTSTPILLL

SEQ ID NO: 2188993 - protein, 18 aa, Cryptosporidium hominis
ELFGMMDDLIIRRGFDLF

SEQ ID NO: 2188994 - protein, 32 aa, Cryptosporidium hominis
ELFIDRNGFLFQYILDYLRTGTIVAIPNKDHI

SEQ ID NO: 2188995 - protein, 20 aa, Cryptosporidium hominis
ELFKLLIEYTKSSNLKTIVR

SEQ ID NO: 2188996 - protein, 18 aa, Cryptosporidium hominis
ELFLKLSINPILSNSGST

SEQ ID NO: 2188997 - protein, 27 aa, Cryptosporidium hominis
ELFTVFKRLLLYDSKAVRKCAVKVIIG

SEQ ID NO: 2188998 - protein, 24 aa, Cryptosporidium hominis
ELGKGWKIFLARSVDLGRWAIIQK

SEQ ID NO: 2188999 - protein, 48 aa, Cryptosporidium hominis
ELGMTNFELSTKTPCFLLAVKCSIDLTLPIYVYKRNLESNYCSLRVAK

SEQ ID NO: 2189000 - protein, 17 aa, Cryptosporidium hominis
ELHKELFPIVYDKQFYE

SEQ ID NO: 2189001 - protein, 24 aa, Cryptosporidium hominis
ELHMFGLVTSHWRSSRKYILHGNK

SEQ ID NO: 2189002 - protein, 26 aa, Cryptosporidium hominis
ELIDDLFIKFFYIKPSILSNIICRAL

SEQ ID NO: 2189003 - protein, 17 aa, Cryptosporidium hominis
ELIEMVSSIKLWVQLNI

SEQ ID NO: 2189004 - protein, 20 aa, Cryptosporidium hominis
ELIFKKLEKLYLKGEELLLG

SEQ ID NO: 2189005 - protein, 18 aa, Cryptosporidium hominis
ELILFDVLNCIYNSLSII

SEQ ID NO: 2189006 - protein, 25 aa, Cryptosporidium hominis
ELILPCVYSMIKARYYWNQYNKNYY

SEQ ID NO: 2189007 - protein, 17 aa, Cryptosporidium hominis
ELINLSLSSSEYPERRI

SEQ ID NO: 2189008 - protein, 24 aa, Cryptosporidium hominis
ELINNLFKWYLKYGMRDSVSQLVG

SEQ ID NO: 2189009 - protein, 28 aa, Cryptosporidium hominis
ELINYLNTEFWVWLLDVFIRRRENSHIS

SEQ ID NO: 2189010 - protein, 18 aa, Cryptosporidium hominis
ELIRFITDNIARQGLISS

SEQ ID NO: 2189011 - protein, 19 aa, Cryptosporidium hominis
ELISNRDQLKLFAAKLAVF

SEQ ID NO: 2189012 - protein, 19 aa, Cryptosporidium hominis
ELKAALRALGFDVKKKDIE

SEQ ID NO: 2189013 - protein, 26 aa, Cryptosporidium hominis
ELKDLNHFIILFQYDDHKGMRGLYSF

SEQ ID NO: 2189014 - protein, 32 aa, Cryptosporidium hominis
ELKDYQRYGVHWLLCAFSIKGGAILADEMGLG

SEQ ID NO: 2189015 - protein, 28 aa, Cryptosporidium hominis
ELKEPNIYLLERIVYFIPNELVYKTFNE

SEQ ID NO: 2189016 - protein, 18 aa, Cryptosporidium hominis
ELKFPLGYVLTEKEQNRV

SEQ ID NO: 2189017 - protein, 18 aa, Cryptosporidium hominis
ELKGIKKRKRSRMVYDPI

SEQ ID NO: 2189018 - protein, 17 aa, Cryptosporidium hominis
ELKGWSSFFNIENCVEI

SEQ ID NO: 2189019 - protein, 17 aa, Cryptosporidium hominis
ELKILCFKGSRYERRSL

SEQ ID NO: 2189020 - protein, 22 aa, Cryptosporidium hominis
ELKLQILEIYNSKLDERTYRKR

SEQ ID NO: 2189021 - protein, 25 aa, Cryptosporidium hominis
ELKNEISSLLPLLNCSNPKTIILVS

SEQ ID NO: 2189022 - protein, 18 aa, Cryptosporidium hominis
ELKQASWAITQKAYKPGN

SEQ ID NO: 2189023 - protein, 18 aa, Cryptosporidium hominis
ELKSNIRKKYFKSSNLKG

SEQ ID NO: 2189024 - protein, 17 aa, Cryptosporidium hominis
ELKTFRALNPVEMVNRS

SEQ ID NO: 2189025 - protein, 24 aa, Cryptosporidium hominis
ELLASELFDVPRDSGVAYLQIGTS

SEQ ID NO: 2189026 - protein, 17 aa, Cryptosporidium hominis
ELLCAIRTLFQMTIEIS

SEQ ID NO: 2189027 - protein, 23 aa, Cryptosporidium hominis
ELLDLLTTLGEHLALPPINRKVV

SEQ ID NO: 2189028 - protein, 17 aa, Cryptosporidium hominis
ELLFRRYLEKNDRYIHA

SEQ ID NO: 2189029 - protein, 17 aa, Cryptosporidium hominis
ELLGPSLEDLFNLCHRR

SEQ ID NO: 2189030 - protein, 26 aa, Cryptosporidium hominis
ELLKPFPTGISWYCKKRRFYTSNGLD

SEQ ID NO: 2189031 - protein, 19 aa, Cryptosporidium hominis
ELLLLLCTIENKCRHKLGK

SEQ ID NO: 2189032 - protein, 19 aa, Cryptosporidium hominis
ELLLSYITPLLSKAKMEGS

SEQ ID NO: 2189033 - protein, 18 aa, Cryptosporidium hominis
ELLNSKSITFRQFICKMR

SEQ ID NO: 2189034 - protein, 20 aa, Cryptosporidium hominis
ELLQQVCILVSYLSIGNLRD

SEQ ID NO: 2189035 - protein, 17 aa, Cryptosporidium hominis
ELLRFRPGVFDGAISIS

SEQ ID NO: 2189036 - protein, 19 aa, Cryptosporidium hominis
ELLRLLVLLNRIQLLNDVR

SEQ ID NO: 2189037 - protein, 21 aa, Cryptosporidium hominis
ELLYKYEVIFRLVFHLKYINY

SEQ ID NO: 2189038 - protein, 30 aa, Cryptosporidium hominis
ELMRELDILLILEFLVDLRLSYESCGIYDS

SEQ ID NO: 2189039 - protein, 25 aa, Cryptosporidium hominis
ELNDSQMLMIVPSEFSFGSNHCNRK

SEQ ID NO: 2189040 - protein, 18 aa, Cryptosporidium hominis
ELNKFTLYNTSGAKFMKI

SEQ ID NO: 2189041 - protein, 23 aa, Cryptosporidium hominis
ELNKLIKSILNPDRKMRPSFELI

SEQ ID NO: 2189042 - protein, 36 aa, Cryptosporidium hominis
ELNLFERIQILISKNLYDWALILAKNGNVSNSIYSQ

SEQ ID NO: 2189043 - protein, 29 aa, Cryptosporidium hominis
ELNNYEIIPFELPIDFITSIYNSGTISSG

SEQ ID NO: 2189044 - protein, 27 aa, Cryptosporidium hominis
ELNPLLKIEFLIRFLLNMKRELESGKQ

SEQ ID NO: 2189045 - protein, 25 aa, Cryptosporidium hominis
ELNSIQAVILPKLGYKSPSPWELHC

SEQ ID NO: 2189046 - protein, 18 aa, Cryptosporidium hominis
ELNSRISTLDLKLQESSR

SEQ ID NO: 2189047 - protein, 30 aa, Cryptosporidium hominis
ELNSSINEDYYRRINVQPAIVDTPMSPRTA

SEQ ID NO: 2189048 - protein, 21 aa, Cryptosporidium hominis
ELNVPILLGNAYHLGSRPGDE

SEQ ID NO: 2189049 - protein, 23 aa, Cryptosporidium hominis
ELNWYHFLTIYIVKIKNSLYQET

SEQ ID NO: 2189050 - protein, 17 aa, Cryptosporidium hominis
ELNYCLVYGFRAIQSIS

SEQ ID NO: 2189051 - protein, 23 aa, Cryptosporidium hominis
ELPCHIFMGVIYYQRLRHMVADK

SEQ ID NO: 2189052 - protein, 19 aa, Cryptosporidium hominis
ELPFLNTFSPRIVKNSPRY

SEQ ID NO: 2189053 - protein, 33 aa, Cryptosporidium hominis
ELPILITTERFLFFRRYLLKGATKVIFCGPPIY

SEQ ID NO: 2189054 - protein, 24 aa, Cryptosporidium hominis
ELPKALLRARRKIIWIGPSAESME

SEQ ID NO: 2189055 - protein, 23 aa, Cryptosporidium hominis
ELPLNICHFTTLPSTQIWAYENI

SEQ ID NO: 2189056 - protein, 22 aa, Cryptosporidium hominis
ELQQDLLLRNYDILWDVDLGGS

SEQ ID NO: 2189057 - protein, 22 aa, Cryptosporidium hominis
ELQRVALILALGKKADIYLIDE

SEQ ID NO: 2189058 - protein, 23 aa, Cryptosporidium hominis
ELQSIGQLPSKKSMQYIRSNMDE

SEQ ID NO: 2189059 - protein, 26 aa, Cryptosporidium hominis
ELRESLVFTLPGSKFHRLKHLTIFIE

SEQ ID NO: 2189060 - protein, 20 aa, Cryptosporidium hominis
ELRKKYLLDTNPNAFYQMKQ

SEQ ID NO: 2189061 - protein, 17 aa, Cryptosporidium hominis
ELRLKQQYFFVCATIQD

SEQ ID NO: 2189062 - protein, 28 aa, Cryptosporidium hominis
ELRMVNTRAPIFKDPTLIIALHLKDTGN

SEQ ID NO: 2189063 - protein, 17 aa, Cryptosporidium hominis
ELRVMCYIEQKINGHFT

SEQ ID NO: 2189064 - protein, 30 aa, Cryptosporidium hominis
ELSDFLKYEFISLIKDILFFSKYLGIDDEH

SEQ ID NO: 2189065 - protein, 18 aa, Cryptosporidium hominis
ELSEKLNYIIQYDQNMEL

SEQ ID NO: 2189066 - protein, 29 aa, Cryptosporidium hominis
ELSKALRLPVLYLLQFKNNLTNFLYDIIY

SEQ ID NO: 2189067 - protein, 24 aa, Cryptosporidium hominis
ELSKLQLFWHPNVSLRTDLVDLHV

SEQ ID NO: 2189068 - protein, 24 aa, Cryptosporidium hominis
ELSNEFEGIYNFRYEEPGANQQIM

SEQ ID NO: 2189069 - protein, 25 aa, Cryptosporidium hominis
ELSQILFRHMEMIMELIQNEILLGY

SEQ ID NO: 2189070 - protein, 19 aa, Cryptosporidium hominis
ELSRFRTRICERKALHGVC

SEQ ID NO: 2189071 - protein, 28 aa, Cryptosporidium hominis
ELSRQIAFPDSLLSRFDLIFIVKDSRNS

SEQ ID NO: 2189072 - protein, 19 aa, Cryptosporidium hominis
ELTIFPLLLFELRVELRRK

SEQ ID NO: 2189073 - protein, 37 aa, Cryptosporidium hominis
ELTLEHIVICRMMFILFPVTDAQHPILTPVIICLEQW

SEQ ID NO: 2189074 - protein, 17 aa, Cryptosporidium hominis
ELTRRLYQNYLKLNHFQ

SEQ ID NO: 2189075 - protein, 20 aa, Cryptosporidium hominis
ELVLCQKFIVRSHFQIGNIY

SEQ ID NO: 2189076 - protein, 21 aa, Cryptosporidium hominis
ELVPGVLFIDEVHMLDIECFT

SEQ ID NO: 2189077 - protein, 20 aa, Cryptosporidium hominis
ELYCNQKRPPPPPPGVSRHY

SEQ ID NO: 2189078 - protein, 31 aa, Cryptosporidium hominis
ELYGPFLAVHLFDPLFYEGFLEEVPLELKSK

SEQ ID NO: 2189079 - protein, 19 aa, Cryptosporidium hominis
ELYLDWFLNKSIESQFRAF

SEQ ID NO: 2189080 - protein, 20 aa, Cryptosporidium hominis
ELYNIKAFLSATRQLINSYL

SEQ ID NO: 2189081 - protein, 24 aa, Cryptosporidium hominis
ELYTKKIPFVIRRYLPNGNYEDWK

SEQ ID NO: 2189082 - protein, 35 aa, Cryptosporidium hominis
EMDHFSLFCPLLHRSAFRLALLVVGISHSVLGKSK

SEQ ID NO: 2189083 - protein, 24 aa, Cryptosporidium hominis
EMDNLIKEIKWYPKGLAFQITKSR

SEQ ID NO: 2189084 - protein, 31 aa, Cryptosporidium hominis
EMEILDIHGIKFKIPWKYPKIIHEHVIQQLE

SEQ ID NO: 2189085 - protein, 24 aa, Cryptosporidium hominis
EMFQISIKLWTIGTFTFNQLLASV

SEQ ID NO: 2189086 - protein, 25 aa, Cryptosporidium hominis
EMIDLKLAEFHNSRSSLIRWSKVSS

SEQ ID NO: 2189087 - protein, 39 aa, Cryptosporidium hominis
EMIELPLRHPGLFKALGVKPPRGVLLYGPPGSGKTLIAK

SEQ ID NO: 2189088 - protein, 18 aa, Cryptosporidium hominis
EMIFICFPDPHFKKRNWR

SEQ ID NO: 2189089 - protein, 25 aa, Cryptosporidium hominis
EMINNIERIWILGRLIIIIRNRREE

SEQ ID NO: 2189090 - protein, 19 aa, Cryptosporidium hominis
EMIYLYENSIVIFIIKEIG

SEQ ID NO: 2189091 - protein, 30 aa, Cryptosporidium hominis
EMKKLNAKILFLSSLTQISWLLNLRGSDVH

SEQ ID NO: 2189092 - protein, 30 aa, Cryptosporidium hominis
EMKNITLIINCLFALGYKKIALVKMDNNAL

SEQ ID NO: 2189093 - protein, 29 aa, Cryptosporidium hominis
EMKQKEELLYTILHLHKQINSIGSSLGCG

SEQ ID NO: 2189094 - protein, 19 aa, Cryptosporidium hominis
EMKRSIYIGNVDYGTKLTE

SEQ ID NO: 2189095 - protein, 17 aa, Cryptosporidium hominis
EMKTVTQNPLRIAMFSW

SEQ ID NO: 2189096 - protein, 25 aa, Cryptosporidium hominis
EMLLKKLYHMGVIPTYKSLEAINEL

SEQ ID NO: 2189097 - protein, 26 aa, Cryptosporidium hominis
EMPQYRYQIRLIAQSIIRGGSRGQEV

SEQ ID NO: 2189098 - protein, 25 aa, Cryptosporidium hominis
EMRCRDLFPALWVPDLFMERVEKDQ

SEQ ID NO: 2189099 - protein, 29 aa, Cryptosporidium hominis
EMRQEIDMLNIPIWLYKESGSLTVNGPFS

SEQ ID NO: 2189100 - protein, 31 aa, Cryptosporidium hominis
EMSFNQNTFPYLNHTILSKPNATTQLSMLNP

SEQ ID NO: 2189101 - protein, 22 aa, Cryptosporidium hominis
EMSLRLLLNTIITTAAKYQKSI

SEQ ID NO: 2189102 - protein, 21 aa, Cryptosporidium hominis
EMSRVFPPTRQGYPWSKWAAE

SEQ ID NO: 2189103 - protein, 39 aa, Cryptosporidium hominis
EMVIVSRTQKWLLRNVKLEDFKYLIRVDQLREENILRNS

SEQ ID NO: 2189104 - protein, 29 aa, Cryptosporidium hominis
EMVSHSLPVLCRLLYFSDLEVMTDACWAL

SEQ ID NO: 2189105 - protein, 29 aa, Cryptosporidium hominis
EMVSRRDFLIKKILPWEIELEIIPWSLLF

SEQ ID NO: 2189106 - protein, 18 aa, Cryptosporidium hominis
EMWLNITGNLLLNPSIRF

SEQ ID NO: 2189107 - protein, 34 aa, Cryptosporidium hominis
EMYENWPFVKSFFDLVSMILLKADVHIFELYNRI

SEQ ID NO: 2189108 - protein, 23 aa, Cryptosporidium hominis
EMYGKFMKSILLPLKTCEKTCRR

SEQ ID NO: 2189109 - protein, 17 aa, Cryptosporidium hominis
EMYSLLETIGELRVLGV

SEQ ID NO: 2189110 - protein, 22 aa, Cryptosporidium hominis
ENALLIMKNFLNNIILNNKNGL

SEQ ID NO: 2189111 - protein, 26 aa, Cryptosporidium hominis
ENATKPIEVFLIFSLNAIKSVIADLS

SEQ ID NO: 2189112 - protein, 18 aa, Cryptosporidium hominis
ENDFRLFCGDLGNDVTEE

SEQ ID NO: 2189113 - protein, 19 aa, Cryptosporidium hominis
ENDIPLIMLCGLGSSGKTS

SEQ ID NO: 2189114 - protein, 17 aa, Cryptosporidium hominis
ENDLFLILATDGITDFF

SEQ ID NO: 2189115 - protein, 17 aa, Cryptosporidium hominis
ENDLIFDQFESLNPLEQ

SEQ ID NO: 2189116 - protein, 23 aa, Cryptosporidium hominis
ENDRIFAIYEYGGISLLTFIEEK

SEQ ID NO: 2189117 - protein, 28 aa, Cryptosporidium hominis
ENDSFIPIIIPIFIKWKSKQFNSKLILT

SEQ ID NO: 2189118 - protein, 22 aa, Cryptosporidium hominis
ENEFIPCFALDFTKNSVPSSLI

SEQ ID NO: 2189119 - protein, 26 aa, Cryptosporidium hominis
ENEFKFVLLILNWAASVLMVTKAFEV

SEQ ID NO: 2189120 - protein, 26 aa, Cryptosporidium hominis
ENENTLAALQRNWIALQQNNGNVGGT

SEQ ID NO: 2189121 - protein, 22 aa, Cryptosporidium hominis
ENEYLNLQKKYIADLKMIGEKI

SEQ ID NO: 2189122 - protein, 22 aa, Cryptosporidium hominis
ENEYWMVVEFPKNSSLYRKHNC

SEQ ID NO: 2189123 - protein, 18 aa, Cryptosporidium hominis
ENFFLLRGNHECASINRI

SEQ ID NO: 2189124 - protein, 36 aa, Cryptosporidium hominis
ENFNIHLIMLSPYFKPPQFLLGKGMFEIYLSIEWEA

SEQ ID NO: 2189125 - protein, 27 aa, Cryptosporidium hominis
ENFPEREFFFDLFYNEKAQLYEGIGCN

SEQ ID NO: 2189126 - protein, 30 aa, Cryptosporidium hominis
ENFQNSLHLSLYLWDPLDGEYHPPHLGGGG

SEQ ID NO: 2189127 - protein, 35 aa, Cryptosporidium hominis
ENGKILVFVNSISYVYRLAPLLSLVLVCKDTHEKE

SEQ ID NO: 2189128 - protein, 24 aa, Cryptosporidium hominis
ENGMYRQKLHPCEICAAFLSETDN

SEQ ID NO: 2189129 - protein, 25 aa, Cryptosporidium hominis
ENGWRFKYIFPIGHSPSVSSFVQIK

SEQ ID NO: 2189130 - protein, 24 aa, Cryptosporidium hominis
ENGYICLWDLQPDFGRSIFGIQYN

SEQ ID NO: 2189131 - protein, 21 aa, Cryptosporidium hominis
ENHDSWLMYKSGGSLFTVSKE

SEQ ID NO: 2189132 - protein, 22 aa, Cryptosporidium hominis
ENIAFIHVCYLPYVGNQLKKKP

SEQ ID NO: 2189133 - protein, 25 aa, Cryptosporidium hominis
ENIEALGPFVPLLVKILNTISMAGY

SEQ ID NO: 2189134 - protein, 25 aa, Cryptosporidium hominis
ENIERRKLLYACRNCEYFSYADPTN

SEQ ID NO: 2189135 - protein, 21 aa, Cryptosporidium hominis
ENIIISIENLYLLLDIDDDEI

SEQ ID NO: 2189136 - protein, 20 aa, Cryptosporidium hominis
ENIIPLISKLGSKVGYSIPS

SEQ ID NO: 2189137 - protein, 20 aa, Cryptosporidium hominis
ENIKEIILLTQEIAGIYEHL

SEQ ID NO: 2189138 - protein, 23 aa, Cryptosporidium hominis
ENIKIQLIAIPLYASMSFDEQKK

SEQ ID NO: 2189139 - protein, 32 aa, Cryptosporidium hominis
ENILDIPRLKWMILLRIIPVDFFSLSIHDCYK

SEQ ID NO: 2189140 - protein, 25 aa, Cryptosporidium hominis
ENILKRFFECIKLILKKEATRIVKI

SEQ ID NO: 2189141 - protein, 24 aa, Cryptosporidium hominis
ENILMQLHDIVPLKWEYLDDNNVI

SEQ ID NO: 2189142 - protein, 32 aa, Cryptosporidium hominis
ENINLPPSLMSRFDLIYLILDKQSEESDKRLA

SEQ ID NO: 2189143 - protein, 19 aa, Cryptosporidium hominis
ENINWWSCVIKGDQEIDTT

SEQ ID NO: 2189144 - protein, 28 aa, Cryptosporidium hominis
ENIRSSSFILFHSLLDKYFKDLAPLVYT

SEQ ID NO: 2189145 - protein, 25 aa, Cryptosporidium hominis
ENISKIRFSINFFTAIGLGALTHKL

SEQ ID NO: 2189146 - protein, 24 aa, Cryptosporidium hominis
ENITLFESLFRLGFTNITASCSRI

SEQ ID NO: 2189147 - protein, 17 aa, Cryptosporidium hominis
ENIVNLMSKLYSSLSNL

SEQ ID NO: 2189148 - protein, 22 aa, Cryptosporidium hominis
ENIYFLLQVSPIVQVHTLRANV

SEQ ID NO: 2189149 - protein, 24 aa, Cryptosporidium hominis
ENIYLLTELIPGGELYDALQRIGL

SEQ ID NO: 2189150 - protein, 23 aa, Cryptosporidium hominis
ENKALINHKSLFSSYGGGLGGGD

SEQ ID NO: 2189151 - protein, 25 aa, Cryptosporidium hominis
ENKEKCLIFCHHTMLLDIIEEYIKI

SEQ ID NO: 2189152 - protein, 25 aa, Cryptosporidium hominis
ENKGNVLERVLIFSRSAFGRQKARD

SEQ ID NO: 2189153 - protein, 21 aa, Cryptosporidium hominis
ENKIDFDPLEVEPIMHSKVKK

SEQ ID NO: 2189154 - protein, 27 aa, Cryptosporidium hominis
ENKKIQKSLLFRLFKSEIHIYEKKMIS

SEQ ID NO: 2189155 - protein, 17 aa, Cryptosporidium hominis
ENKMKFRRLVKTNLNGI

SEQ ID NO: 2189156 - protein, 27 aa, Cryptosporidium hominis
ENKNKDCLPLFFSSNTPIRKGYEVKEI

SEQ ID NO: 2189157 - protein, 24 aa, Cryptosporidium hominis
ENKPIRLITDKLSYPVWRTSEPIR

SEQ ID NO: 2189158 - protein, 25 aa, Cryptosporidium hominis
ENLAERLLLYYIPFEEQDGYLLFYN

SEQ ID NO: 2189159 - protein, 17 aa, Cryptosporidium hominis
ENLFKYIPTSVKMRNWE

SEQ ID NO: 2189160 - protein, 19 aa, Cryptosporidium hominis
ENLKYIPLNNIGISNSSNN

SEQ ID NO: 2189161 - protein, 20 aa, Cryptosporidium hominis
ENLLFWIQQLQNQWKVDEAV

SEQ ID NO: 2189162 - protein, 35 aa, Cryptosporidium hominis
ENLLINGLEIFSIDLILIAILRLQIYCSRCNEVND

SEQ ID NO: 2189163 - protein, 25 aa, Cryptosporidium hominis
ENLNKRGWNISRDSMILFLCSKCKA

SEQ ID NO: 2189164 - protein, 30 aa, Cryptosporidium hominis
ENLRKLSEKFKYIVSVIVLQRSPAGFHLFT

SEQ ID NO: 2189165 - protein, 23 aa, Cryptosporidium hominis
ENLSDEFILVSLKIYNSEGNELF

SEQ ID NO: 2189166 - protein, 24 aa, Cryptosporidium hominis
ENMIFLRMGLKLLGKWEMSDPYTR

SEQ ID NO: 2189167 - protein, 21 aa, Cryptosporidium hominis
ENMKPPPLIILPVYSSQPSEI

SEQ ID NO: 2189168 - protein, 17 aa, Cryptosporidium hominis
ENNIIPIQWGDKHFEHV

SEQ ID NO: 2189169 - protein, 23 aa, Cryptosporidium hominis
ENNITIMYGLETILFEKFEYEVK

SEQ ID NO: 2189170 - protein, 25 aa, Cryptosporidium hominis
ENNITNEEFLNREWKTMQKYIYEHF

SEQ ID NO: 2189171 - protein, 26 aa, Cryptosporidium hominis
ENNPRGFVCGLFNPSIPTDGVALVHQ

SEQ ID NO: 2189172 - protein, 24 aa, Cryptosporidium hominis
ENNQISLSLLTFLRYEYLNYCINK

SEQ ID NO: 2189173 - protein, 23 aa, Cryptosporidium hominis
ENNRKMKLFQFEQTKLLESQKNE

SEQ ID NO: 2189174 - protein, 20 aa, Cryptosporidium hominis
ENNSRVLKVWFEDSEFIFDS

SEQ ID NO: 2189175 - protein, 24 aa, Cryptosporidium hominis
ENNYNSWKLFLKRDSPAGRKVCEM

SEQ ID NO: 2189176 - protein, 24 aa, Cryptosporidium hominis
ENQDRPRLLPYLNRMLRELKKPYD

SEQ ID NO: 2189177 - protein, 17 aa, Cryptosporidium hominis
ENQIIQENFGLISSLRG

SEQ ID NO: 2189178 - protein, 27 aa, Cryptosporidium hominis
ENQKLKQDLFLMKRINNRTKDHAKIKC

SEQ ID NO: 2189179 - protein, 24 aa, Cryptosporidium hominis
ENQKSLELFIKKLKEDEIDSCLGE

SEQ ID NO: 2189180 - protein, 24 aa, Cryptosporidium hominis
ENQLPSNLENMLDMAMVSSSLIDG

SEQ ID NO: 2189181 - protein, 23 aa, Cryptosporidium hominis
ENSKDRRLFQWRSIINEMINSKY

SEQ ID NO: 2189182 - protein, 22 aa, Cryptosporidium hominis
ENSLLIKRRTIGKNPFLIRASS

SEQ ID NO: 2189183 - protein, 29 aa, Cryptosporidium hominis
ENSRNLLLYYQKFLLLNKKVMNFWGFETN

SEQ ID NO: 2189184 - protein, 25 aa, Cryptosporidium hominis
ENTDYIRKIYLWPSYCEYKTNLTQQ

SEQ ID NO: 2189185 - protein, 28 aa, Cryptosporidium hominis
ENTFIASSPVLTISFDPYCQYKYIGTSY

SEQ ID NO: 2189186 - protein, 26 aa, Cryptosporidium hominis
ENTKISIYLVLLLSSYDIYIQEIRAL

SEQ ID NO: 2189187 - protein, 31 aa, Cryptosporidium hominis
ENTLNIDHFMFKICLLFSIQIVPISNDHTER

SEQ ID NO: 2189188 - protein, 24 aa, Cryptosporidium hominis
ENVDWKIIAQERTILYEKAKQHLA

SEQ ID NO: 2189189 - protein, 23 aa, Cryptosporidium hominis
ENVKLLFSFPFKTNSAKVLSTWP

SEQ ID NO: 2189190 - protein, 17 aa, Cryptosporidium hominis
ENVSWILDGFHTMLKSR

SEQ ID NO: 2189191 - protein, 21 aa, Cryptosporidium hominis
ENYFRSPYTYKFYIDPKSKEE

SEQ ID NO: 2189192 - protein, 25 aa, Cryptosporidium hominis
ENYHRFPSQILLKRINLLKTYIKTS

SEQ ID NO: 2189193 - protein, 25 aa, Cryptosporidium hominis
EPAFDVVRMFNFPKSFQIALEQAEK

SEQ ID NO: 2189194 - protein, 27 aa, Cryptosporidium hominis
EPAFYRQHFSIFFPQILNIAKNIQLST

SEQ ID NO: 2189195 - protein, 22 aa, Cryptosporidium hominis
EPFIDRVLKLNGQLSPFLRAKI

SEQ ID NO: 2189196 - protein, 17 aa, Cryptosporidium hominis
EPFPDYMLKKAYNSSKS

SEQ ID NO: 2189197 - protein, 25 aa, Cryptosporidium hominis
EPGKLLADWFNIIDLSILTDKLHRG

SEQ ID NO: 2189198 - protein, 40 aa, Cryptosporidium hominis
EPKFHEQTWFYWLENIQDWCISRQLWWGHRIPAYKIISSK

SEQ ID NO: 2189199 - protein, 17 aa, Cryptosporidium hominis
EPKLGISLFDVNSGLIS

SEQ ID NO: 2189200 - protein, 21 aa, Cryptosporidium hominis
EPKMNEKFVFESSPVLSSVAD

SEQ ID NO: 2189201 - protein, 17 aa, Cryptosporidium hominis
EPKRKLLTPFKNESISD

SEQ ID NO: 2189202 - protein, 20 aa, Cryptosporidium hominis
EPLNPLICPCDCKGSMQFVH

SEQ ID NO: 2189203 - protein, 31 aa, Cryptosporidium hominis
EPMIHSVFQNILWRDWLIRYAPLVGNNGNFV

SEQ ID NO: 2189204 - protein, 32 aa, Cryptosporidium hominis
EPNDQSIWQYYFWLMGDFLPKILFKNEQFKVI

SEQ ID NO: 2189205 - protein, 29 aa, Cryptosporidium hominis
EPNLQRRVAILLKLPAFKLAVEQSIKHRD

SEQ ID NO: 2189206 - protein, 24 aa, Cryptosporidium hominis
EPNNSLKLEISWSDRFALSGFCGE

SEQ ID NO: 2189207 - protein, 25 aa, Cryptosporidium hominis
EPPFSHFFNLRIFNGYFSDERSKKT

SEQ ID NO: 2189208 - protein, 33 aa, Cryptosporidium hominis
EPQNTIQRIVWPDYFRVLWNFISSVDLVRKTKL

SEQ ID NO: 2189209 - protein, 27 aa, Cryptosporidium hominis
EPQSLLFLSVLMGPKWERELKRYTQLS

SEQ ID NO: 2189210 - protein, 17 aa, Cryptosporidium hominis
EPRRSSVADVSYNSSLI

SEQ ID NO: 2189211 - protein, 22 aa, Cryptosporidium hominis
EPSVIFRRFLEDLARNSHLGGE

SEQ ID NO: 2189212 - protein, 20 aa, Cryptosporidium hominis
EPTHPIRLGLALNFSVFHYE

SEQ ID NO: 2189213 - protein, 25 aa, Cryptosporidium hominis
EPTIPTLKRYGFANYILIFCQDESY

SEQ ID NO: 2189214 - protein, 20 aa, Cryptosporidium hominis
EPVGFLFKKFEELREALQHG

SEQ ID NO: 2189215 - protein, 27 aa, Cryptosporidium hominis
EQEEPLSFLMLSYGITSTHWQNFIPEE

SEQ ID NO: 2189216 - protein, 25 aa, Cryptosporidium hominis
EQEKPRLIIHKIVLENFKSYGGSKV

SEQ ID NO: 2189217 - protein, 24 aa, Cryptosporidium hominis
EQFGELVIIPLYSSLPPYKQQKIF

SEQ ID NO: 2189218 - protein, 20 aa, Cryptosporidium hominis
EQFLPYKQKLDKALSDLKLL

SEQ ID NO: 2189219 - protein, 24 aa, Cryptosporidium hominis
EQFTSMFRRKAFLHWYTGEGMDEM

SEQ ID NO: 2189220 - protein, 24 aa, Cryptosporidium hominis
EQGASGFYFFVISTGSFGVEINGN

SEQ ID NO: 2189221 - protein, 18 aa, Cryptosporidium hominis
EQGVFLLNSLLSVEEGKP

SEQ ID NO: 2189222 - protein, 27 aa, Cryptosporidium hominis
EQHRQLLLPYPEGIQWDLETLSWRCNI

SEQ ID NO: 2189223 - protein, 29 aa, Cryptosporidium hominis
EQIDDDFFSNILVLTPSSSSSRKPRKSLN

SEQ ID NO: 2189224 - protein, 28 aa, Cryptosporidium hominis
EQIGTFYCPGINKVRYWAMCFIGSERST

SEQ ID NO: 2189225 - protein, 21 aa, Cryptosporidium hominis
EQIKNLIISAIQKLKSGGNLH

SEQ ID NO: 2189226 - protein, 20 aa, Cryptosporidium hominis
EQILFVLNRGFTYAHDSVIN

SEQ ID NO: 2189227 - protein, 21 aa, Cryptosporidium hominis
EQIPREFLLQVANKGPSRTLS

SEQ ID NO: 2189228 - protein, 24 aa, Cryptosporidium hominis
EQKEFMIDKRFIIQIIQKHNEDGS

SEQ ID NO: 2189229 - protein, 33 aa, Cryptosporidium hominis
EQKVLSYLEFLDLPILELIGIDPAVLGGVNTNA

SEQ ID NO: 2189230 - protein, 26 aa, Cryptosporidium hominis
EQMRTYKWFRPPFGRLTKQQYELVVS

SEQ ID NO: 2189231 - protein, 24 aa, Cryptosporidium hominis
EQNAVLVSLLDVSVRKLEILRKEN

SEQ ID NO: 2189232 - protein, 22 aa, Cryptosporidium hominis
EQNDDFMMLYNKYLEDIKENYD

SEQ ID NO: 2189233 - protein, 18 aa, Cryptosporidium hominis
EQNIFNKNYRLFYNKNLP

SEQ ID NO: 2189234 - protein, 26 aa, Cryptosporidium hominis
EQNKESFFWIRDRCLRYTPVNVEKYS

SEQ ID NO: 2189235 - protein, 29 aa, Cryptosporidium hominis
EQNKRTILLAIEMRKIITPILEEFDAEKS

SEQ ID NO: 2189236 - protein, 23 aa, Cryptosporidium hominis
EQNLTRKLALIKNSFKTSVIQLK

SEQ ID NO: 2189237 - protein, 24 aa, Cryptosporidium hominis
EQPSLIPFWDEGTGLFYLAGKGDT

SEQ ID NO: 2189238 - protein, 25 aa, Cryptosporidium hominis
EQPVVLIQYIFPTNTLTLEKRDRLI

SEQ ID NO: 2189239 - protein, 23 aa, Cryptosporidium hominis
EQRKLKYNILKESLIKEASGSIN

SEQ ID NO: 2189240 - protein, 17 aa, Cryptosporidium hominis
EQRKPPFMKLYTIRQGD

SEQ ID NO: 2189241 - protein, 17 aa, Cryptosporidium hominis
EQTKEMVIVSRTQKWLL

SEQ ID NO: 2189242 - protein, 28 aa, Cryptosporidium hominis
EQTKYRVPSFLSFKPKFMYSIPFECNEN

SEQ ID NO: 2189243 - protein, 24 aa, Cryptosporidium hominis
EQTPESWLKYEGYIPKLTGDHDDQ

SEQ ID NO: 2189244 - protein, 28 aa, Cryptosporidium hominis
EQVIEYFKSIKMSDLRPLIWVCDLHHRV

SEQ ID NO: 2189245 - protein, 25 aa, Cryptosporidium hominis
EQVLATKYLSRYKSFYGRLHSPSNN

SEQ ID NO: 2189246 - protein, 22 aa, Cryptosporidium hominis
EQWQLLRLYGVLNSPQLVLIYP

SEQ ID NO: 2189247 - protein, 19 aa, Cryptosporidium hominis
EQYPNCIIILTILVVRNTM

SEQ ID NO: 2189248 - protein, 20 aa, Cryptosporidium hominis
ERAIIFCATKHHVDYIVKIL

SEQ ID NO: 2189249 - protein, 33 aa, Cryptosporidium hominis
ERCPFSHCLSWHRRNPYEYAYRPNLCPNVVFQN

SEQ ID NO: 2189250 - protein, 35 aa, Cryptosporidium hominis
ERCSFKDLNVYFGWETPLVIPIITEPDCCYQSSYS

SEQ ID NO: 2189251 - protein, 26 aa, Cryptosporidium hominis
ERDLNFTWGCLPLRAIDHPDQLVPLP

SEQ ID NO: 2189252 - protein, 23 aa, Cryptosporidium hominis
EREAQTVGFLERKLRQVELEHKT

SEQ ID NO: 2189253 - protein, 23 aa, Cryptosporidium hominis
EREKLLSSSLLLEQQLLNLETAK

SEQ ID NO: 2189254 - protein, 32 aa, Cryptosporidium hominis
ERIAPNYYNLVKRPMWLQLMINKCKKREYKSR

SEQ ID NO: 2189255 - protein, 29 aa, Cryptosporidium hominis
ERIIKPIAEKFPYLIYPMNADELNINSMN

SEQ ID NO: 2189256 - protein, 27 aa, Cryptosporidium hominis
ERIKRANFYYNKLLSYVKYYAVDEASE

SEQ ID NO: 2189257 - protein, 34 aa, Cryptosporidium hominis
ERISAFQALQHPWLRSWDTPNIPLCGIGMINKIV

SEQ ID NO: 2189258 - protein, 18 aa, Cryptosporidium hominis
ERISPIKMLPINITEGFP

SEQ ID NO: 2189259 - protein, 28 aa, Cryptosporidium hominis
ERKELRILRKEMKNLLLLSKKEAYQFSK

SEQ ID NO: 2189260 - protein, 25 aa, Cryptosporidium hominis
ERKIYELETFYWNQTTDIGNMLRGW

SEQ ID NO: 2189261 - protein, 18 aa, Cryptosporidium hominis
ERKKLFGKMINTKKSNPL

SEQ ID NO: 2189262 - protein, 26 aa, Cryptosporidium hominis
ERLPKNISPKWFIWSKDDIAYQRLVD

SEQ ID NO: 2189263 - protein, 27 aa, Cryptosporidium hominis
ERLQALGFPRNAVIEAYLICEKNEELA

SEQ ID NO: 2189264 - protein, 27 aa, Cryptosporidium hominis
ERLQNNYWLFHILGVNLNAPNLSLNDI

SEQ ID NO: 2189265 - protein, 25 aa, Cryptosporidium hominis
ERMGKLLKNAFFPKFNKLEEFDSLS

SEQ ID NO: 2189266 - protein, 18 aa, Cryptosporidium hominis
ERNERREGVSSKKGDIFT

SEQ ID NO: 2189267 - protein, 22 aa, Cryptosporidium hominis
ERNLIENLFSFSKRKKFDIQIN

SEQ ID NO: 2189268 - protein, 24 aa, Cryptosporidium hominis
ERNSLLISLFDTLDEYWSTCATLH

SEQ ID NO: 2189269 - protein, 18 aa, Cryptosporidium hominis
ERPGYVRMDLSIGSYMAI

SEQ ID NO: 2189270 - protein, 25 aa, Cryptosporidium hominis
ERQLDYQRSILLKYWLSLEEKLASK

SEQ ID NO: 2189271 - protein, 25 aa, Cryptosporidium hominis
ERQLQLERKPLLDELIRIEERDKQL

SEQ ID NO: 2189272 - protein, 25 aa, Cryptosporidium hominis
ERRESKVYLLPYTQNVQVPNFPGVV

SEQ ID NO: 2189273 - protein, 21 aa, Cryptosporidium hominis
ERRLIIEVIKSLLMLCERKRG

SEQ ID NO: 2189274 - protein, 25 aa, Cryptosporidium hominis
ERRMSPPCRVFLSDNFKSSKLSPEN

SEQ ID NO: 2189275 - protein, 25 aa, Cryptosporidium hominis
ERRNCAKVYPPSDKMFSCFKATPLN

SEQ ID NO: 2189276 - protein, 21 aa, Cryptosporidium hominis
ERSEFYIDCISPYLSKGIGSI

SEQ ID NO: 2189277 - protein, 19 aa, Cryptosporidium hominis
ERSILYYNNEIKKLIFENK

SEQ ID NO: 2189278 - protein, 35 aa, Cryptosporidium hominis
ERSLHIKLYDIKKSLNYLALQLMLGKEHQISNRGR

SEQ ID NO: 2189279 - protein, 18 aa, Cryptosporidium hominis
ERSNLVGNSAYYNYMTSQ

SEQ ID NO: 2189280 - protein, 19 aa, Cryptosporidium hominis
ERSSFLIELYKLYSNFIAG

SEQ ID NO: 2189281 - protein, 20 aa, Cryptosporidium hominis
ERYFQLVSFNGEKITFCIVD

SEQ ID NO: 2189282 - protein, 25 aa, Cryptosporidium hominis
ERYIKGRYQRHLDKIKATKSRMEQE

SEQ ID NO: 2189283 - protein, 24 aa, Cryptosporidium hominis
ESADLSLWCSLKITLLGELPLSSK

SEQ ID NO: 2189284 - protein, 17 aa, Cryptosporidium hominis
ESAKISFVVLPKKIREV

SEQ ID NO: 2189285 - protein, 24 aa, Cryptosporidium hominis
ESAPGHFETLYPPPTLFSRDDVRN

SEQ ID NO: 2189286 - protein, 23 aa, Cryptosporidium hominis
ESAQRVFLMAVQRSFTIGRNNMH

SEQ ID NO: 2189287 - protein, 21 aa, Cryptosporidium hominis
ESCCRDLILVLLQRDENAGLN

SEQ ID NO: 2189288 - protein, 18 aa, Cryptosporidium hominis
ESCELLKFTDYQQTFRVY

SEQ ID NO: 2189289 - protein, 23 aa, Cryptosporidium hominis
ESCTIIETNPYFSPKKKPNADTN

SEQ ID NO: 2189290 - protein, 32 aa, Cryptosporidium hominis
ESDELEMRLVLYLLKYFAPIWDTKVRNQPCSL

SEQ ID NO: 2189291 - protein, 18 aa, Cryptosporidium hominis
ESDPQLAQLFASAQIRIE

SEQ ID NO: 2189292 - protein, 21 aa, Cryptosporidium hominis
ESDRNLVENLFLNGIIQIVVA

SEQ ID NO: 2189293 - protein, 25 aa, Cryptosporidium hominis
ESDWDHSWGCPGDFSDLPVLNQDHS

SEQ ID NO: 2189294 - protein, 25 aa, Cryptosporidium hominis
ESENRKILDLLKETKKRYLNDVKAL

SEQ ID NO: 2189295 - protein, 25 aa, Cryptosporidium hominis
ESESTRILMIYWSLHSEELLTNDSC

SEQ ID NO: 2189296 - protein, 22 aa, Cryptosporidium hominis
ESFEFGIWDALKASTYITIDKI

SEQ ID NO: 2189297 - protein, 19 aa, Cryptosporidium hominis
ESFILYYINLVSSLIRYTQ

SEQ ID NO: 2189298 - protein, 19 aa, Cryptosporidium hominis
ESFLFLREKMIEDQKIWKE

SEQ ID NO: 2189299 - protein, 24 aa, Cryptosporidium hominis
ESFTKFIHLLVSDLNYLLEEGLSM

SEQ ID NO: 2189300 - protein, 18 aa, Cryptosporidium hominis
ESGGILVVILPPSIINYG

SEQ ID NO: 2189301 - protein, 28 aa, Cryptosporidium hominis
ESGKFINLPSLYNSIKIHPSLDQAFLDV

SEQ ID NO: 2189302 - protein, 40 aa, Cryptosporidium hominis
ESGKRKFRFSSFCPKLLNCLFPWIRSEQYFEDHDQPIFYI

SEQ ID NO: 2189303 - protein, 25 aa, Cryptosporidium hominis
ESHELPIFMSIIDFGRSLDIGEIYK

SEQ ID NO: 2189304 - protein, 18 aa, Cryptosporidium hominis
ESIKKKYFGEIKAFKFIL

SEQ ID NO: 2189305 - protein, 20 aa, Cryptosporidium hominis
ESIKLAQELSLRLEISEPNS

SEQ ID NO: 2189306 - protein, 23 aa, Cryptosporidium hominis
ESILEILGYFDIRILKDSLISLF

SEQ ID NO: 2189307 - protein, 18 aa, Cryptosporidium hominis
ESIPLFPILTHFCVLTCD

SEQ ID NO: 2189308 - protein, 30 aa, Cryptosporidium hominis
ESISISLWKTIFPWIWNNLEYQQRNELTLD

SEQ ID NO: 2189309 - protein, 30 aa, Cryptosporidium hominis
ESIVSSMLTYYKFPFKNKLNRPFSGFCYRA

SEQ ID NO: 2189310 - protein, 17 aa, Cryptosporidium hominis
ESKCILYYSYKDVSRLQ

SEQ ID NO: 2189311 - protein, 24 aa, Cryptosporidium hominis
ESKKLVSWFGSKYIKNLPSTDFSL

SEQ ID NO: 2189312 - protein, 30 aa, Cryptosporidium hominis
ESKKRILRNLELFSNLIIYSGFYLPPNSNI

SEQ ID NO: 2189313 - protein, 17 aa, Cryptosporidium hominis
ESKLILNWLEDGVFDAL

SEQ ID NO: 2189314 - protein, 19 aa, Cryptosporidium hominis
ESKLKYKLHIMKTSLQGLV

SEQ ID NO: 2189315 - protein, 18 aa, Cryptosporidium hominis
ESKLLIENKYWAQHIIHS

SEQ ID NO: 2189316 - protein, 19 aa, Cryptosporidium hominis
ESKLTRLLQEYLGGGADPP

SEQ ID NO: 2189317 - protein, 24 aa, Cryptosporidium hominis
ESKRKRKSLYWDTVFNWSTSDDDE

SEQ ID NO: 2189318 - protein, 27 aa, Cryptosporidium hominis
ESKRSWYHIRWFEIQKLLLIENIKSNF

SEQ ID NO: 2189319 - protein, 22 aa, Cryptosporidium hominis
ESLDMILLVTINGNIKIFQIHG

SEQ ID NO: 2189320 - protein, 19 aa, Cryptosporidium hominis
ESLDPALIRPGRIDRKIEL

SEQ ID NO: 2189321 - protein, 25 aa, Cryptosporidium hominis
ESLTGFRRLIYSLIEWRSVFGLVCS

SEQ ID NO: 2189322 - protein, 17 aa, Cryptosporidium hominis
ESMLDTVLFCRDKWLNE

SEQ ID NO: 2189323 - protein, 25 aa, Cryptosporidium hominis
ESMLSLLERFYSIKISKLPGNVKNL

SEQ ID NO: 2189324 - protein, 32 aa, Cryptosporidium hominis
ESNGISKEKILKGFFSCYLQKQTHLRNNGCIL

SEQ ID NO: 2189325 - protein, 24 aa, Cryptosporidium hominis
ESNNPQFDFLKPGHALFGYFADLV

SEQ ID NO: 2189326 - protein, 22 aa, Cryptosporidium hominis
ESNPMMTSIADVGYNSKPEMNL

SEQ ID NO: 2189327 - protein, 23 aa, Cryptosporidium hominis
ESNQKFILRWIDTQLKEWEKLLK

SEQ ID NO: 2189328 - protein, 24 aa, Cryptosporidium hominis
ESNYLIFEMGSYYSRIRAIKDGVI

SEQ ID NO: 2189329 - protein, 18 aa, Cryptosporidium hominis
ESQEFRFGEGTFTGGLTD

SEQ ID NO: 2189330 - protein, 23 aa, Cryptosporidium hominis
ESQINLNEWKKEALRLTFDSSIT

SEQ ID NO: 2189331 - protein, 25 aa, Cryptosporidium hominis
ESQQEELVLSGIKWLTSVVNEIDEL

SEQ ID NO: 2189332 - protein, 24 aa, Cryptosporidium hominis
ESRAWIHILVYITQFYDCIMSFLR

SEQ ID NO: 2189333 - protein, 33 aa, Cryptosporidium hominis
ESRCTAAQAIYHPWFEKIQLSPGIMISCNNNNN

SEQ ID NO: 2189334 - protein, 20 aa, Cryptosporidium hominis
ESRLIWDQRPFLTGSIDDDT

SEQ ID NO: 2189335 - protein, 19 aa, Cryptosporidium hominis
ESRPIIVALLVDGFSIIKP

SEQ ID NO: 2189336 - protein, 29 aa, Cryptosporidium hominis
ESRQKEFEEFWFELDKRQKNISTREKELD

SEQ ID NO: 2189337 - protein, 24 aa, Cryptosporidium hominis
ESRSAFVWIIGEVYEFVQGTKPST

SEQ ID NO: 2189338 - protein, 20 aa, Cryptosporidium hominis
ESRVLLIKNGLKSINHSLID

SEQ ID NO: 2189339 - protein, 28 aa, Cryptosporidium hominis
ESSEWGNGNFWPIEKFVSVFEPIERAKM

SEQ ID NO: 2189340 - protein, 27 aa, Cryptosporidium hominis
ESSNNCIWNDLLYNQVFDHVDFETPFT

SEQ ID NO: 2189341 - protein, 21 aa, Cryptosporidium hominis
ESTELLIYKEKKVKFYLDPIM

SEQ ID NO: 2189342 - protein, 19 aa, Cryptosporidium hominis
ESTFRHPIGPEWNTTAIHN

SEQ ID NO: 2189343 - protein, 24 aa, Cryptosporidium hominis
ESTLPFDVGPIKRLLFQDKAPGKS

SEQ ID NO: 2189344 - protein, 27 aa, Cryptosporidium hominis
ESTQDYISLAFWNVIRKSVIFPKNWFN

SEQ ID NO: 2189345 - protein, 17 aa, Cryptosporidium hominis
ESVLFRHEVLYVLGQMG

SEQ ID NO: 2189346 - protein, 17 aa, Cryptosporidium hominis
ESVLLIKSGLENPVHMS

SEQ ID NO: 2189347 - protein, 24 aa, Cryptosporidium hominis
ESVRTIIKLLPYINEDGLYMLAVN

SEQ ID NO: 2189348 - protein, 24 aa, Cryptosporidium hominis
ESVTLIVALKVRYRNRVFLIRGNH

SEQ ID NO: 2189349 - protein, 22 aa, Cryptosporidium hominis
ETALISFEFLGLAAMNLSSLDK

SEQ ID NO: 2189350 - protein, 20 aa, Cryptosporidium hominis
ETARNYAKEKGILSFETSAK

SEQ ID NO: 2189351 - protein, 18 aa, Cryptosporidium hominis
ETAYQYTKSNYWAFVSVR

SEQ ID NO: 2189352 - protein, 17 aa, Cryptosporidium hominis
ETCYLAAHSLRLKREKR

SEQ ID NO: 2189353 - protein, 35 aa, Cryptosporidium hominis
ETDKKFYPCKCRYQICLWCFYHVRDQLDNKCPACR

SEQ ID NO: 2189354 - protein, 21 aa, Cryptosporidium hominis
ETDKKIPIVIPTCSEWFDMDS

SEQ ID NO: 2189355 - protein, 31 aa, Cryptosporidium hominis
ETDKRLKIYFPLPPLDKYYDSCAPAYIANII

SEQ ID NO: 2189356 - protein, 28 aa, Cryptosporidium hominis
ETDPKECLIIFTYFTFEICHTTFPSVYH

SEQ ID NO: 2189357 - protein, 30 aa, Cryptosporidium hominis
ETDSYLIYSPEVKLLDLQPTSYIGANNLKT

SEQ ID NO: 2189358 - protein, 20 aa, Cryptosporidium hominis
ETEVFAFDGDKWKCPVCRGE

SEQ ID NO: 2189359 - protein, 23 aa, Cryptosporidium hominis
ETGKRFLNLGLLQIHRGINYNDN

SEQ ID NO: 2189360 - protein, 23 aa, Cryptosporidium hominis
ETHKLSFEFLYRTCYRLTINNYG

SEQ ID NO: 2189361 - protein, 19 aa, Cryptosporidium hominis
ETILFNIISNPGDLRYRSI

SEQ ID NO: 2189362 - protein, 18 aa, Cryptosporidium hominis
ETILITGINKKFVLEDIK

SEQ ID NO: 2189363 - protein, 19 aa, Cryptosporidium hominis
ETIMELYNADLTKFSQGYL

SEQ ID NO: 2189364 - protein, 18 aa, Cryptosporidium hominis
ETIPRIDWKPNPLCWDNL

SEQ ID NO: 2189365 - protein, 19 aa, Cryptosporidium hominis
ETIQNFLDELTVQYDERIY

SEQ ID NO: 2189366 - protein, 23 aa, Cryptosporidium hominis
ETKETFVIISADDKVRTILKGQS

SEQ ID NO: 2189367 - protein, 18 aa, Cryptosporidium hominis
ETKGFVSRLLGLGDISGL

SEQ ID NO: 2189368 - protein, 27 aa, Cryptosporidium hominis
ETKKDEPVPWWLANVDKPNLVEVDNEG

SEQ ID NO: 2189369 - protein, 26 aa, Cryptosporidium hominis
ETKKISRFLICLVITDRPMECFKKRC

SEQ ID NO: 2189370 - protein, 28 aa, Cryptosporidium hominis
ETLAFLKTIQLINILIFPIVPNESISIN

SEQ ID NO: 2189371 - protein, 19 aa, Cryptosporidium hominis
ETLLLNILRGDFNRLRRCI

SEQ ID NO: 2189372 - protein, 23 aa, Cryptosporidium hominis
ETLNDFLRYFVDIFIEESVSVQL

SEQ ID NO: 2189373 - protein, 18 aa, Cryptosporidium hominis
ETLPSVVLSFIVDKCNEQ

SEQ ID NO: 2189374 - protein, 28 aa, Cryptosporidium hominis
ETMRDSYGKLVFLLMDAQKESIRELLQF

SEQ ID NO: 2189375 - protein, 21 aa, Cryptosporidium hominis
ETNEILAKYVNDLASEYCHRN

SEQ ID NO: 2189376 - protein, 17 aa, Cryptosporidium hominis
ETNFQGFDPTEWCNLGS

SEQ ID NO: 2189377 - protein, 24 aa, Cryptosporidium hominis
ETNNIGKIFFGKPIRDFSSFSNVI

SEQ ID NO: 2189378 - protein, 42 aa, Cryptosporidium hominis
ETNRLRHVTKFYSYLLSKDAIPWNLLFIVKLSEKDTASSSRI

SEQ ID NO: 2189379 - protein, 30 aa, Cryptosporidium hominis
ETNTDFEPLLPYLVYYFNYNTRIICIQFEK

SEQ ID NO: 2189380 - protein, 18 aa, Cryptosporidium hominis
ETRMFLVLKDYFGHSKKV

SEQ ID NO: 2189381 - protein, 17 aa, Cryptosporidium hominis
ETSHIPSCLFEQDNTNN

SEQ ID NO: 2189382 - protein, 19 aa, Cryptosporidium hominis
ETSMKFLTEACLRGALDNL

SEQ ID NO: 2189383 - protein, 28 aa, Cryptosporidium hominis
ETVEKLLSLEQWGTLIQTMNQMNPELQN

SEQ ID NO: 2189384 - protein, 31 aa, Cryptosporidium hominis
ETVINMILESKGIPGIFRGQSIHPVENMMIG

SEQ ID NO: 2189385 - protein, 28 aa, Cryptosporidium hominis
ETVYTPVAPLFIPNYPVVPGGVGSPGVI

SEQ ID NO: 2189386 - protein, 35 aa, Cryptosporidium hominis
ETYDEFIFYEPTERFYEKLISGPIQPMAQHRLQPY

SEQ ID NO: 2189387 - protein, 24 aa, Cryptosporidium hominis
ETYNSTYSELEKCKFDLSTEQNNN

SEQ ID NO: 2189388 - protein, 33 aa, Cryptosporidium hominis
EVCADPMRFGQVAQFFAFFPFQTAEMALENMKE

SEQ ID NO: 2189389 - protein, 26 aa, Cryptosporidium hominis
EVDDELRQALLLSIQDFSGNDSTNNT

SEQ ID NO: 2189390 - protein, 28 aa, Cryptosporidium hominis
EVDIEIRLLIFKFIEKLLKMGIDVFESN

SEQ ID NO: 2189391 - protein, 24 aa, Cryptosporidium hominis
EVDNYIYYNLNDEGIIKNLNDAKK

SEQ ID NO: 2189392 - protein, 24 aa, Cryptosporidium hominis
EVDTLILSKKSLIPPKKDFSTPPI

SEQ ID NO: 2189393 - protein, 23 aa, Cryptosporidium hominis
EVEIPIHSEVYIRYGILSSSECL

SEQ ID NO: 2189394 - protein, 19 aa, Cryptosporidium hominis
EVETPMLNMIYGGAAARPF

SEQ ID NO: 2189395 - protein, 19 aa, Cryptosporidium hominis
EVFCYVKRPISDFDLTELR

SEQ ID NO: 2189396 - protein, 31 aa, Cryptosporidium hominis
EVFKPMVYETIVFPPGYFEYKKQLEELRKKY

SEQ ID NO: 2189397 - protein, 29 aa, Cryptosporidium hominis
EVFTLISHITWGLWSIARTPGYQPNSVEF

SEQ ID NO: 2189398 - protein, 23 aa, Cryptosporidium hominis
EVGYKIMKNLIWKEPESSEDFPS

SEQ ID NO: 2189399 - protein, 27 aa, Cryptosporidium hominis
EVHQIHVDLRWPAIKTWIYVCNQIKVD

SEQ ID NO: 2189400 - protein, 19 aa, Cryptosporidium hominis
EVILKIQSFLRPCDLEEIS

SEQ ID NO: 2189401 - protein, 27 aa, Cryptosporidium hominis
EVINLLEYILNFLSFSTQELISRYNKK

SEQ ID NO: 2189402 - protein, 23 aa, Cryptosporidium hominis
EVKALKEEWKKALASCNKKGSKK

SEQ ID NO: 2189403 - protein, 23 aa, Cryptosporidium hominis
EVKDQIWVLISGGDKNKTISFSE

SEQ ID NO: 2189404 - protein, 24 aa, Cryptosporidium hominis
EVKEKVFIVGRLIRYVSKALNISS

SEQ ID NO: 2189405 - protein, 19 aa, Cryptosporidium hominis
EVKIYLDEIAVLRSQILQM

SEQ ID NO: 2189406 - protein, 22 aa, Cryptosporidium hominis
  misc_feature (22)..(22): Xaa can be any naturally occurring amino acid
EVKSLIIFNYLFIIKLLKKIIX

SEQ ID NO: 2189407 - protein, 24 aa, Cryptosporidium hominis
EVLARIQIKKLLRPSLTCVEQVYD

SEQ ID NO: 2189408 - protein, 19 aa, Cryptosporidium hominis
EVLLGFNCTIFAYGQTGTG

SEQ ID NO: 2189409 - protein, 26 aa, Cryptosporidium hominis
EVMKNLLMLVLSYILERSINKIILKV

SEQ ID NO: 2189410 - protein, 24 aa, Cryptosporidium hominis
EVPATLTIFDIAGLVPGAHKGEGL

SEQ ID NO: 2189411 - protein, 26 aa, Cryptosporidium hominis
EVPIAFYSAIPVPILIDRAVPVPMEL

SEQ ID NO: 2189412 - protein, 26 aa, Cryptosporidium hominis
EVPQVTCYIILIINGQICPDEMIAIA

SEQ ID NO: 2189413 - protein, 24 aa, Cryptosporidium hominis
EVPTSYFPVMGFLSERRRLDEMPE

SEQ ID NO: 2189414 - protein, 27 aa, Cryptosporidium hominis
EVQGELQVLNLLSLVKIEQPESDETLT

SEQ ID NO: 2189415 - protein, 26 aa, Cryptosporidium hominis
EVQNSSFIPTWAWPASLRNNEDLKLI

SEQ ID NO: 2189416 - protein, 19 aa, Cryptosporidium hominis
EVQRTMLELLNQLDGFSSD

SEQ ID NO: 2189417 - protein, 19 aa, Cryptosporidium hominis
EVREVFLRILAIGSLSRIV

SEQ ID NO: 2189418 - protein, 24 aa, Cryptosporidium hominis
EVRRSNWFLKHVCSFISQKLNEIN

SEQ ID NO: 2189419 - protein, 22 aa, Cryptosporidium hominis
EVSELHILRLKQIETAQRLKET

SEQ ID NO: 2189420 - protein, 24 aa, Cryptosporidium hominis
EVSELLLVGNPFIKKRALLASVHI

SEQ ID NO: 2189421 - protein, 23 aa, Cryptosporidium hominis
EVSNRLIKLFSKLGGETLVSTRR

SEQ ID NO: 2189422 - protein, 19 aa, Cryptosporidium hominis
EVTGCTFCEIKKARISLIE

SEQ ID NO: 2189423 - protein, 26 aa, Cryptosporidium hominis
EVTQSWDLLNKNKPIWMRKPEEVTFE

SEQ ID NO: 2189424 - protein, 25 aa, Cryptosporidium hominis
EVYNEKLFDLLAPQSNLNNSSNDFN

SEQ ID NO: 2189425 - protein, 19 aa, Cryptosporidium hominis
EVYVTEPCFTPSPNPLANG

SEQ ID NO: 2189426 - protein, 30 aa, Cryptosporidium hominis
EWDKKSLVGLFCRFGNILSAHLMVDKTSGR

SEQ ID NO: 2189427 - protein, 25 aa, Cryptosporidium hominis
EWGIKYDFWLIEHINQYEYVVPWES

SEQ ID NO: 2189428 - protein, 49 aa, Cryptosporidium hominis
EWKCRWRGLHFKVYTLRFPNSFFGYPIQIFTKYIYKHLGIFLIGVYSPD

SEQ ID NO: 2189429 - protein, 21 aa, Cryptosporidium hominis
EWKIIFEKLDLIANSGVNVVL

SEQ ID NO: 2189430 - protein, 19 aa, Cryptosporidium hominis
EWLNLYNISKLPHVSVVDP

SEQ ID NO: 2189431 - protein, 20 aa, Cryptosporidium hominis
EWLNVVQSPPFIYSLVSACK

SEQ ID NO: 2189432 - protein, 27 aa, Cryptosporidium hominis
EWNAKLECLILMFIKLIKLQLNEIREE

SEQ ID NO: 2189433 - protein, 27 aa, Cryptosporidium hominis
EWNYSLEWHPFFRPNGNFKYNILKGFQ

SEQ ID NO: 2189434 - protein, 30 aa, Cryptosporidium hominis
EWRAKPKNNSLVRLITIPTSSDQSKVNIKD

SEQ ID NO: 2189435 - protein, 27 aa, Cryptosporidium hominis
EWRNELLSFPHIFNQVFLSLNRFNDYI

SEQ ID NO: 2189436 - protein, 21 aa, Cryptosporidium hominis
EWRRYHQMNMLWSSVITPIVS

SEQ ID NO: 2189437 - protein, 33 aa, Cryptosporidium hominis
EWSEGFLQYLQSILPPADFLFAWLKHCHYREEV

SEQ ID NO: 2189438 - protein, 21 aa, Cryptosporidium hominis
EWSKMLEMRIFYTQSVLRHFV

SEQ ID NO: 2189439 - protein, 31 aa, Cryptosporidium hominis
EWSLLRMLEVWLDHLFHPILSEESFLTEIVH

SEQ ID NO: 2189440 - protein, 18 aa, Cryptosporidium hominis
EWVKFRNSARNDSLKLYH

SEQ ID NO: 2189441 - protein, 23 aa, Cryptosporidium hominis
EWYKTQQLLPPLSRLCAPIPGLE

SEQ ID NO: 2189442 - protein, 17 aa, Cryptosporidium hominis
EYAVILSNIYKFKEIRI

SEQ ID NO: 2189443 - protein, 19 aa, Cryptosporidium hominis
EYCKFCIPHGSYLINLGNP

SEQ ID NO: 2189444 - protein, 23 aa, Cryptosporidium hominis
EYCTRIIQLLKKNFPIKMGQVLI

SEQ ID NO: 2189445 - protein, 18 aa, Cryptosporidium hominis
EYEYELATNPVLENLDEE

SEQ ID NO: 2189446 - protein, 28 aa, Cryptosporidium hominis
EYFDNAPIIYIPGRRFPVNIYYTKSPEA

SEQ ID NO: 2189447 - protein, 25 aa, Cryptosporidium hominis
EYFEDFLKFIGFHLSIRKDQKVILA

SEQ ID NO: 2189448 - protein, 21 aa, Cryptosporidium hominis
EYFLSHIIKNLNLKTPIILTP

SEQ ID NO: 2189449 - protein, 20 aa, Cryptosporidium hominis
EYGILNSHKRFRKIESSQES

SEQ ID NO: 2189450 - protein, 23 aa, Cryptosporidium hominis
EYGRRPFGVGLLLAGFDESGPHL

SEQ ID NO: 2189451 - protein, 19 aa, Cryptosporidium hominis
EYHSNMKISYITLKSNYRQ

SEQ ID NO: 2189452 - protein, 18 aa, Cryptosporidium hominis
EYINNPRFKYLTALGIVY

SEQ ID NO: 2189453 - protein, 26 aa, Cryptosporidium hominis
EYIQVFKLFCLVFSRLDMNQITLIKM

SEQ ID NO: 2189454 - protein, 21 aa, Cryptosporidium hominis
EYIRKAITAGFFLQSARINKG

SEQ ID NO: 2189455 - protein, 21 aa, Cryptosporidium hominis
EYKIAFPHFYNSLPKFVSTSV

SEQ ID NO: 2189456 - protein, 18 aa, Cryptosporidium hominis
EYKIKWMGYSHLHNTWES

SEQ ID NO: 2189457 - protein, 30 aa, Cryptosporidium hominis
EYKVKQRSALFKALILYSLKNKEYMNGESA

SEQ ID NO: 2189458 - protein, 20 aa, Cryptosporidium hominis
EYLFQLNNFLNIECIYKSKL

SEQ ID NO: 2189459 - protein, 27 aa, Cryptosporidium hominis
EYLHDCYRRQPVLPGLIICGDFNSTPD

SEQ ID NO: 2189460 - protein, 22 aa, Cryptosporidium hominis
EYLKIHRLIPFDDLISLCLGVS

SEQ ID NO: 2189461 - protein, 19 aa, Cryptosporidium hominis
EYMDSSCLNGFLTQGLNSI

SEQ ID NO: 2189462 - protein, 28 aa, Cryptosporidium hominis
EYNNIIPLFNFPLITQLKILLTKNYKSN

SEQ ID NO: 2189463 - protein, 17 aa, Cryptosporidium hominis
EYNPFTPFVISEKTPRL

SEQ ID NO: 2189464 - protein, 22 aa, Cryptosporidium hominis
EYNSIFPLEKIASHLNISLKFL

SEQ ID NO: 2189465 - protein, 43 aa, Cryptosporidium hominis
EYQNKHILFVLNKVDLIPKWVASKWISFYGSIRPTIAFHSSIT

SEQ ID NO: 2189466 - protein, 27 aa, Cryptosporidium hominis
EYSDNSWNPLLLLTAKHLLINDQLPLV

SEQ ID NO: 2189467 - protein, 29 aa, Cryptosporidium hominis
EYSECLVIVLGYDFLFEKSPILFYQNEEL

SEQ ID NO: 2189468 - protein, 20 aa, Cryptosporidium hominis
EYSLELFYNNPVMLQSFITK

SEQ ID NO: 2189469 - protein, 17 aa, Cryptosporidium hominis
EYSLNLEKLLQNDKLLI

SEQ ID NO: 2189470 - protein, 26 aa, Cryptosporidium hominis
EYSPHWSPILVGFIHSALQKLPQNRI

SEQ ID NO: 2189471 - protein, 20 aa, Cryptosporidium hominis
EYSPPILEPIKSISWHNSDV

SEQ ID NO: 2189472 - protein, 27 aa, Cryptosporidium hominis
EYSRNLHLKLLGFLGKRFPPHVTLERN

SEQ ID NO: 2189473 - protein, 24 aa, Cryptosporidium hominis
EYSSPIIPKILYIESQPLEYRYRK

SEQ ID NO: 2189474 - protein, 17 aa, Cryptosporidium hominis
EYVDGYVLFFKICDDMK

SEQ ID NO: 2189475 - protein, 18 aa, Cryptosporidium hominis
EYVKRVFSLFDINNTGKV

SEQ ID NO: 2189476 - protein, 24 aa, Cryptosporidium hominis
EYVPRIAWIRVRRNMNTWQYEDEK

SEQ ID NO: 2189477 - protein, 20 aa, Cryptosporidium hominis
EYYNKINLGLISHDPLTAPK

SEQ ID NO: 2189478 - protein, 30 aa, Cryptosporidium hominis
FADFKLAAEAFWKMGALPPTFSGFGPQVPQ

SEQ ID NO: 2189479 - protein, 23 aa, Cryptosporidium hominis
FAEALDVFPRLLAENSGLNSTDL

SEQ ID NO: 2189480 - protein, 27 aa, Cryptosporidium hominis
FAGASIIKHIVLKRIKYGFSQLSKNAI

SEQ ID NO: 2189481 - protein, 17 aa, Cryptosporidium hominis
FAIIKLPEISGGELKIS

SEQ ID NO: 2189482 - protein, 28 aa, Cryptosporidium hominis
FAKDSLELSLLLNFRSLSTKLQTEILHA

SEQ ID NO: 2189483 - protein, 24 aa, Cryptosporidium hominis
FAKESLSIFYSYDLSSNSCSVPTV

SEQ ID NO: 2189484 - protein, 19 aa, Cryptosporidium hominis
FALLEMVGILYRRFPNIKE

SEQ ID NO: 2189485 - protein, 22 aa, Cryptosporidium hominis
FANALRQIPTILLDNGGYDSAE

SEQ ID NO: 2189486 - protein, 17 aa, Cryptosporidium hominis
FAQEYLSPVAFSLLLDP

SEQ ID NO: 2189487 - protein, 18 aa, Cryptosporidium hominis
FAQKMDLGGSVPLMLQRI

SEQ ID NO: 2189488 - protein, 27 aa, Cryptosporidium hominis
FARLNMTYLVLSKRKLLLLVNEKHVAG

SEQ ID NO: 2189489 - protein, 25 aa, Cryptosporidium hominis
FASIDLNLILPYLLDLNGIDIQYKD

SEQ ID NO: 2189490 - protein, 30 aa, Cryptosporidium hominis
FASNIGNALFPMFWSSFLASQQFNNTHSFI

SEQ ID NO: 2189491 - protein, 30 aa, Cryptosporidium hominis
FATSKEYLDYFFPLFLLECQQSIQRAKQIE

SEQ ID NO: 2189492 - protein, 18 aa, Cryptosporidium hominis
FCIICNYVNKITPALQSR

SEQ ID NO: 2189493 - protein, 18 aa, Cryptosporidium hominis
FCIKQLCNSSWIVQLRVG

SEQ ID NO: 2189494 - protein, 25 aa, Cryptosporidium hominis
FCKKFNIPLLILGGGGYTIRNVART

SEQ ID NO: 2189495 - protein, 17 aa, Cryptosporidium hominis
FCLTILSSGKLINTLSN

SEQ ID NO: 2189496 - protein, 24 aa, Cryptosporidium hominis
FCNKAKLISCCNARLIPQIPRCDL

SEQ ID NO: 2189497 - protein, 29 aa, Cryptosporidium hominis
FCNLTPIQNYLYRRFLRSSACKKLLDSDS

SEQ ID NO: 2189498 - protein, 32 aa, Cryptosporidium hominis
FCNNNCLIIMKWIDSLLYITQKIRFSIQFIVD

SEQ ID NO: 2189499 - protein, 17 aa, Cryptosporidium hominis
FCPSIKAVKFLGNGQER

SEQ ID NO: 2189500 - protein, 24 aa, Cryptosporidium hominis
FCRGHLVEMILSCNISGYLEFQGI

SEQ ID NO: 2189501 - protein, 19 aa, Cryptosporidium hominis
FCRGVPDPKIRIYDVGRKK

SEQ ID NO: 2189502 - protein, 36 aa, Cryptosporidium hominis
FCSDSMELWFSTIELLMLLQNWKKARTFLDLARSKN

SEQ ID NO: 2189503 - protein, 17 aa, Cryptosporidium hominis
FCSLILGEYREIPTGLN

SEQ ID NO: 2189504 - protein, 19 aa, Cryptosporidium hominis
FDAPPLPDFPLAQDLCIRL

SEQ ID NO: 2189505 - protein, 26 aa, Cryptosporidium hominis
FDCEYRLYKYFFPLNHERTKISKFPK

SEQ ID NO: 2189506 - protein, 18 aa, Cryptosporidium hominis
FDDESVLSLIYFKTKTEL

SEQ ID NO: 2189507 - protein, 25 aa, Cryptosporidium hominis
FDDGNLFDACLMATLSGLKHYRYNE

SEQ ID NO: 2189508 - protein, 20 aa, Cryptosporidium hominis
FDDLFNSLFKRKSGKHMASE

SEQ ID NO: 2189509 - protein, 30 aa, Cryptosporidium hominis
FDEEIILDPYLLLRFIKLSFEELKAGILAK

SEQ ID NO: 2189510 - protein, 31 aa, Cryptosporidium hominis
FDEKDELTFTPWTNYFGTAQRNIINLSPNTY

SEQ ID NO: 2189511 - protein, 22 aa, Cryptosporidium hominis
FDELNADLFRKTIEPVKKVLED

SEQ ID NO: 2189512 - protein, 34 aa, Cryptosporidium hominis
FDGFDKSVFALKQLKLLILTTMAFAKNGVFQSMG

SEQ ID NO: 2189513 - protein, 23 aa, Cryptosporidium hominis
FDGGLNSHIYRRAPVGVPQNLGY

SEQ ID NO: 2189514 - protein, 21 aa, Cryptosporidium hominis
FDGRNFLQHYQLFEIGFNVYP

SEQ ID NO: 2189515 - protein, 33 aa, Cryptosporidium hominis
FDHINAFNVIPGELSIPVMVIPVEMKKLNCNEM

SEQ ID NO: 2189516 - protein, 18 aa, Cryptosporidium hominis
FDHWYKIQLLNSKAYDCT

SEQ ID NO: 2189517 - protein, 25 aa, Cryptosporidium hominis
FDKLTNHRFVNIPNIFILYNEIHMS

SEQ ID NO: 2189518 - protein, 28 aa, Cryptosporidium hominis
FDKTKNDLPLFIRLLQDGSTEAVLSSGC

SEQ ID NO: 2189519 - protein, 19 aa, Cryptosporidium hominis
FDKYGVRFGVSGMQGWRVS

SEQ ID NO: 2189520 - protein, 19 aa, Cryptosporidium hominis
FDLFNFYISDGINNKIIVC

SEQ ID NO: 2189521 - protein, 24 aa, Cryptosporidium hominis
FDNIILQSILRHSIVNNNILSAGH

SEQ ID NO: 2189522 - protein, 17 aa, Cryptosporidium hominis
FDNKLRWTTIPFDASKL

SEQ ID NO: 2189523 - protein, 27 aa, Cryptosporidium hominis
FDNLSEAIARLLPYHTFYVDEIKSNRV

SEQ ID NO: 2189524 - protein, 32 aa, Cryptosporidium hominis
FDPCVWLDDPLPISHPVILGISKILSDTLPHL

SEQ ID NO: 2189525 - protein, 25 aa, Cryptosporidium hominis
FDQNYTVAIIYPLNGAQPIRCPTNF

SEQ ID NO: 2189526 - protein, 24 aa, Cryptosporidium hominis
FDRIELIISIFSLLLEIINRGILP

SEQ ID NO: 2189527 - protein, 17 aa, Cryptosporidium hominis
FDSFTLLSILNSSIKRF

SEQ ID NO: 2189528 - protein, 36 aa, Cryptosporidium hominis
FDSRLSKLYRSMYIQNYRVGLKILKKRAALNNEEKM

SEQ ID NO: 2189529 - protein, 17 aa, Cryptosporidium hominis
FDTLQFLEYIGNSMKFP

SEQ ID NO: 2189530 - protein, 24 aa, Cryptosporidium hominis
FDTNPPLIMQILSNNEPDKSDDKV

SEQ ID NO: 2189531 - protein, 25 aa, Cryptosporidium hominis
FDTSKIFKSYKLPFIKVKINNCNYV

SEQ ID NO: 2189532 - protein, 25 aa, Cryptosporidium hominis
FDTSKSKWMVVLKLSPELISISLNH

SEQ ID NO: 2189533 - protein, 23 aa, Cryptosporidium hominis
FEASAFFPNLFGTLSTSKFSIAT

SEQ ID NO: 2189534 - protein, 20 aa, Cryptosporidium hominis
FEAYIDILRDQMMGMGELEH

SEQ ID NO: 2189535 - protein, 30 aa, Cryptosporidium hominis
FEDESFVNYLKYLLYWCEFPYVKYISYPHC

SEQ ID NO: 2189536 - protein, 26 aa, Cryptosporidium hominis
FEEFCQILVYLMTSQNLFGVGAFYGT

SEQ ID NO: 2189537 - protein, 28 aa, Cryptosporidium hominis
FEEFDSCLNMKYFPPKKIDWNGLLGNNK

SEQ ID NO: 2189538 - protein, 17 aa, Cryptosporidium hominis
FEEIIDEKLFETKEAEE

SEQ ID NO: 2189539 - protein, 18 aa, Cryptosporidium hominis
FEEIYYGVSDRVIGECRA

SEQ ID NO: 2189540 - protein, 18 aa, Cryptosporidium hominis
FEELYETKKISRFLICLV

SEQ ID NO: 2189541 - protein, 29 aa, Cryptosporidium hominis
FEFENMDLHILSFLSYNITLSLRSLCSIK

SEQ ID NO: 2189542 - protein, 18 aa, Cryptosporidium hominis
FEFQIISSIIYEWENLFG

SEQ ID NO: 2189543 - protein, 24 aa, Cryptosporidium hominis
FEGHKRSLSFPKFLGGIELDINQD

SEQ ID NO: 2189544 - protein, 26 aa, Cryptosporidium hominis
FEGSVRDLFLMKIRDSFMDVQFTSEV

SEQ ID NO: 2189545 - protein, 19 aa, Cryptosporidium hominis
FEHLAAAVHLFPEKETHPT

SEQ ID NO: 2189546 - protein, 22 aa, Cryptosporidium hominis
FEIDKFLADNPLFYTVVDNIQC

SEQ ID NO: 2189547 - protein, 22 aa, Cryptosporidium hominis
FEIISRLYQLQSILLVTSSNGF

SEQ ID NO: 2189548 - protein, 27 aa, Cryptosporidium hominis
FEITNPLFFPLDESIPIVLALPVTACL

SEQ ID NO: 2189549 - protein, 27 aa, Cryptosporidium hominis
FELCSLSLFMQILSYNPIDLNLILLKS

SEQ ID NO: 2189550 - protein, 18 aa, Cryptosporidium hominis
FELLKWSSNISLFDYCED

SEQ ID NO: 2189551 - protein, 18 aa, Cryptosporidium hominis
FELLLNMNIRRTFSLDHN

SEQ ID NO: 2189552 - protein, 19 aa, Cryptosporidium hominis
FELRAYLVGQIARIISVFG

SEQ ID NO: 2189553 - protein, 20 aa, Cryptosporidium hominis
FELSIYPIGPVRDGCLDYFF

SEQ ID NO: 2189554 - protein, 23 aa, Cryptosporidium hominis
FEMAIKEKWRLQKISWKYCILDE

SEQ ID NO: 2189555 - protein, 27 aa, Cryptosporidium hominis
FEMANEAFFRDYILRHLNNYFDLSNRQ

SEQ ID NO: 2189556 - protein, 28 aa, Cryptosporidium hominis
FEMMIQEIWITKWNQELLQDLALGGREL

SEQ ID NO: 2189557 - protein, 25 aa, Cryptosporidium hominis
FEMPNIQLIFSFLYNPSSFNFINKG

SEQ ID NO: 2189558 - protein, 26 aa, Cryptosporidium hominis
FENNQEIIFSRRILSSGASRYLIDKN

SEQ ID NO: 2189559 - protein, 18 aa, Cryptosporidium hominis
FENPSLPLTFVLTSITKP

SEQ ID NO: 2189560 - protein, 24 aa, Cryptosporidium hominis
FENSPFPYINTKSGAFFLNNSSFQ

SEQ ID NO: 2189561 - protein, 25 aa, Cryptosporidium hominis
FEPEQRAQMLRKLDSLLISTLKCTA

SEQ ID NO: 2189562 - protein, 17 aa, Cryptosporidium hominis
FEQLKGLFLMKPIDEAV

SEQ ID NO: 2189563 - protein, 17 aa, Cryptosporidium hominis
FEQQGIWEGIYYVVGSN

SEQ ID NO: 2189564 - protein, 34 aa, Cryptosporidium hominis
FEQSPSLTIFSPDTLDARLLKTGLTPVNNKELSS

SEQ ID NO: 2189565 - protein, 19 aa, Cryptosporidium hominis
FERISGRFTEPKILRFIRV

SEQ ID NO: 2189566 - protein, 21 aa, Cryptosporidium hominis
FERIVHMVITYLGGKIGFYSG

SEQ ID NO: 2189567 - protein, 30 aa, Cryptosporidium hominis
FERRCKPDYYQFFFGYLDYEKEKKDKISGL

SEQ ID NO: 2189568 - protein, 30 aa, Cryptosporidium hominis
FERTVRSRLRLFKKMRDRLVNTRDSLALIL

SEQ ID NO: 2189569 - protein, 24 aa, Cryptosporidium hominis
FESSLRLLKDVLLVQPNKLDSSNG

SEQ ID NO: 2189570 - protein, 25 aa, Cryptosporidium hominis
FESYDIDYLLAFINKNSKEFLASAR

SEQ ID NO: 2189571 - protein, 25 aa, Cryptosporidium hominis
FETENTFFRLFELSELWDMINLESF

SEQ ID NO: 2189572 - protein, 26 aa, Cryptosporidium hominis
FETLIKELNLILLKTNDRKQIVDSLS

SEQ ID NO: 2189573 - protein, 21 aa, Cryptosporidium hominis
FETYHKFYLTEMKHIIGILED

SEQ ID NO: 2189574 - protein, 20 aa, Cryptosporidium hominis
FEVISRLIKTLLSPNSNRIG

SEQ ID NO: 2189575 - protein, 18 aa, Cryptosporidium hominis
FEVSRPIQRESSMSFAPV

SEQ ID NO: 2189576 - protein, 24 aa, Cryptosporidium hominis
FEVTKPLLRFIANKLGVQFSSKFK

SEQ ID NO: 2189577 - protein, 22 aa, Cryptosporidium hominis
FEYIIPIFVIYRIFEVHSEDCK

SEQ ID NO: 2189578 - protein, 20 aa, Cryptosporidium hominis
FFDFILKSHVSDPKLSLSHE

SEQ ID NO: 2189579 - protein, 17 aa, Cryptosporidium hominis
FFEILHLRRPFGLRSNS

SEQ ID NO: 2189580 - protein, 20 aa, Cryptosporidium hominis
FFELLRLETTIFPFLESNKA

SEQ ID NO: 2189581 - protein, 19 aa, Cryptosporidium hominis
FFEVYRVPALFVSTQAVLS

SEQ ID NO: 2189582 - protein, 18 aa, Cryptosporidium hominis
FFFKSKYDNFDYKRYRSY

SEQ ID NO: 2189583 - protein, 20 aa, Cryptosporidium hominis
FFLASKLSDSLLLYSKNNNF

SEQ ID NO: 2189584 - protein, 28 aa, Cryptosporidium hominis
FFLHENRYYLSLEYFPQTLLQYLEKSPK

SEQ ID NO: 2189585 - protein, 26 aa, Cryptosporidium hominis
FFLKKVPIFVSFSYLNDSIWVCDPNY

SEQ ID NO: 2189586 - protein, 17 aa, Cryptosporidium hominis
FFPLENNFLCLKEYMVN

SEQ ID NO: 2189587 - protein, 20 aa, Cryptosporidium hominis
FFPNEFQLPMPIEEAKRRLR

SEQ ID NO: 2189588 - protein, 17 aa, Cryptosporidium hominis
FFPNFRIVSIKDNSSGD

SEQ ID NO: 2189589 - protein, 17 aa, Cryptosporidium hominis
FFQLRRLSIVFDNPDCV

SEQ ID NO: 2189590 - protein, 17 aa, Cryptosporidium hominis
FFQTVFEIARRYKMLNP

SEQ ID NO: 2189591 - protein, 26 aa, Cryptosporidium hominis
FFRLKKEIMELPPSLWYVVLPQLLSR

SEQ ID NO: 2189592 - protein, 18 aa, Cryptosporidium hominis
FFRSILSKYFNHIKSNQS

SEQ ID NO: 2189593 - protein, 26 aa, Cryptosporidium hominis
FFSDLWSTGMAYKIVIITNAGLRTVE

SEQ ID NO: 2189594 - protein, 22 aa, Cryptosporidium hominis
FFSGLIKLPFLSSEPEYINFPI

SEQ ID NO: 2189595 - protein, 28 aa, Cryptosporidium hominis
FFSNLKSYLNFISIYNQISKQGSINYTL

SEQ ID NO: 2189596 - protein, 23 aa, Cryptosporidium hominis
FFSRSNLELIYRAESPFGLEIPN

SEQ ID NO: 2189597 - protein, 25 aa, Cryptosporidium hominis
FFVRKGEVILRILENYYPPIFESNL

SEQ ID NO: 2189598 - protein, 27 aa, Cryptosporidium hominis
FFVTCPPISPFIRSYYGTALMLQHEKI

SEQ ID NO: 2189599 - protein, 31 aa, Cryptosporidium hominis
FGAHYLHEDLYTKPFPGYYFTGDGVLRDQDG

SEQ ID NO: 2189600 - protein, 18 aa, Cryptosporidium hominis
FGCDVPYNNYLINRGQQL

SEQ ID NO: 2189601 - protein, 23 aa, Cryptosporidium hominis
FGCPLKVYIKNSGKFEYIYTFRI

SEQ ID NO: 2189602 - protein, 33 aa, Cryptosporidium hominis
FGDFIESYPLKRTTIPYLDGIWTWIDCNPKNVE

SEQ ID NO: 2189603 - protein, 20 aa, Cryptosporidium hominis
FGDFSTPYSSWFEGLGSCYS

SEQ ID NO: 2189604 - protein, 24 aa, Cryptosporidium hominis
FGDLINCFVTHFDFNRVKIFSQRR

SEQ ID NO: 2189605 - protein, 36 aa, Cryptosporidium hominis
FGDLTRKCYISKSVLLYYFFEKWMNEKFVGEYKYLR

SEQ ID NO: 2189606 - protein, 18 aa, Cryptosporidium hominis
FGDNNLSLPFIWEKKFEQ

SEQ ID NO: 2189607 - protein, 23 aa, Cryptosporidium hominis
FGDSSIRILPIASGYLLSDYIGI

SEQ ID NO: 2189608 - protein, 29 aa, Cryptosporidium hominis
FGDYTDTLINYLNIWRDVKQSRNIKSYSN

SEQ ID NO: 2189609 - protein, 30 aa, Cryptosporidium hominis
FGETVNWRWILINYCLPLSLKRLNIKNLSN

SEQ ID NO: 2189610 - protein, 18 aa, Cryptosporidium hominis
FGFPNIVRFSWSTASEII

SEQ ID NO: 2189611 - protein, 31 aa, Cryptosporidium hominis
FGGDNLDFLKPLLPTLLQLLVLNLSSPNIGI

SEQ ID NO: 2189612 - protein, 18 aa, Cryptosporidium hominis
FGGFLVLCHANNSSQILS

SEQ ID NO: 2189613 - protein, 30 aa, Cryptosporidium hominis
FGGGVDGTGWLWMAPDGRVLSVLSGHGDSI

SEQ ID NO: 2189614 - protein, 31 aa, Cryptosporidium hominis
FGGIHGQLIDLLYFFEQFSWPHFHRGDILSM

SEQ ID NO: 2189615 - protein, 25 aa, Cryptosporidium hominis
FGGLESIIIPPVLDLSANKAHYSSE

SEQ ID NO: 2189616 - protein, 32 aa, Cryptosporidium hominis
FGGLPAMIIKKLLVNGPLPMDRLYHLVIKDKE

SEQ ID NO: 2189617 - protein, 17 aa, Cryptosporidium hominis
FGIFMRFINDKHNGKII

SEQ ID NO: 2189618 - protein, 28 aa, Cryptosporidium hominis
FGIKILKILFLILINYNIFPGVNGKSAY

SEQ ID NO: 2189619 - protein, 23 aa, Cryptosporidium hominis
FGINFTGLLVVGAPIVQLTSGIT

SEQ ID NO: 2189620 - protein, 21 aa, Cryptosporidium hominis
FGISRFLNFGFTTTPQLHFMV

SEQ ID NO: 2189621 - protein, 32 aa, Cryptosporidium hominis
FGITSELLKFWSKLGFLPVYIRQQVSEVTGEH

SEQ ID NO: 2189622 - protein, 23 aa, Cryptosporidium hominis
FGKRTLFHVLRQYASLLSDKKHV

SEQ ID NO: 2189623 - protein, 27 aa, Cryptosporidium hominis
FGKSRRNTIRWNPSGKWFAYGGFGNLA

SEQ ID NO: 2189624 - protein, 18 aa, Cryptosporidium hominis
FGLWELYIHNKSVVPVIR

SEQ ID NO: 2189625 - protein, 19 aa, Cryptosporidium hominis
FGMEGIFIVKSDPSTIMLD

SEQ ID NO: 2189626 - protein, 19 aa, Cryptosporidium hominis
FGMSCGVLTPIIPAATRRM

SEQ ID NO: 2189627 - protein, 25 aa, Cryptosporidium hominis
FGNYVLHIGILLQGKIEISPELKSL

SEQ ID NO: 2189628 - protein, 33 aa, Cryptosporidium hominis
FGPSPPLGFEPKRLHWSVIPPNKIVGTIWEDIH

SEQ ID NO: 2189629 - protein, 55 aa, Cryptosporidium hominis
FGSLSQSRTLVRIITIALCSSLMVIRDISVLLKYPLLSIQGKLPVNIDLICQYDD

SEQ ID NO: 2189630 - protein, 29 aa, Cryptosporidium hominis
FGTLAFCRRWLDQLGFNKHALALKSLVDS

SEQ ID NO: 2189631 - protein, 26 aa, Cryptosporidium hominis
FGTSHDIEELSKWFSKMVGKFETFGL

SEQ ID NO: 2189632 - protein, 24 aa, Cryptosporidium hominis
FGTSTILRFLARGSPYTNLYGRTD

SEQ ID NO: 2189633 - protein, 29 aa, Cryptosporidium hominis
FGTTNLKKQILLWLNDNEISLFDNDSTIS

SEQ ID NO: 2189634 - protein, 25 aa, Cryptosporidium hominis
FGTVLIPDALLSHLPDMKILISEIN

SEQ ID NO: 2189635 - protein, 19 aa, Cryptosporidium hominis
FGVGGGQFNPFSGSIGKPL

SEQ ID NO: 2189636 - protein, 17 aa, Cryptosporidium hominis
FGVGLSPLNGLSGLSSP

SEQ ID NO: 2189637 - protein, 20 aa, Cryptosporidium hominis
FHKEILLSKSRGIRHIVFEM

SEQ ID NO: 2189638 - protein, 32 aa, Cryptosporidium hominis
FHKWIGWIESKLRFLVRKLETFKGLQVRPWPK

SEQ ID NO: 2189639 - protein, 31 aa, Cryptosporidium hominis
FHLSNQFTPLSLLDIPLVWRDKSFGHKNNHI

SEQ ID NO: 2189640 - protein, 17 aa, Cryptosporidium hominis
FHNIMKLFYSEKYSQMI

SEQ ID NO: 2189641 - protein, 20 aa, Cryptosporidium hominis
FHNKRWLLFSTCVEGFIIIY

SEQ ID NO: 2189642 - protein, 18 aa, Cryptosporidium hominis
FHNKYYSSNNMFLTLVSN

SEQ ID NO: 2189643 - protein, 17 aa, Cryptosporidium hominis
FHRINIRLEVPGQYLRI

SEQ ID NO: 2189644 - protein, 17 aa, Cryptosporidium hominis
FHRLKHLTIFIEENQDL

SEQ ID NO: 2189645 - protein, 23 aa, Cryptosporidium hominis
FHSSFSKIIWKKVKTKLPTESEI

SEQ ID NO: 2189646 - protein, 29 aa, Cryptosporidium hominis
FHVIKTSCPIMIKLLREWILNANRGEFDH

SEQ ID NO: 2189647 - protein, 19 aa, Cryptosporidium hominis
FHYKLTFSKIPLLLKMLTY

SEQ ID NO: 2189648 - protein, 17 aa, Cryptosporidium hominis
FIAVNRNGQIRIFMNIP

SEQ ID NO: 2189649 - protein, 22 aa, Cryptosporidium hominis
FIAVPRLFTRIYKGKVLQEVRK

SEQ ID NO: 2189650 - protein, 20 aa, Cryptosporidium hominis
FICCTIAPCKSIQGGDPIPN

SEQ ID NO: 2189651 - protein, 22 aa, Cryptosporidium hominis
FICEIPVNIKTLFMKIVKESAE

SEQ ID NO: 2189652 - protein, 24 aa, Cryptosporidium hominis
FIDCFRLFTNGNIDWILVSGNCSY

SEQ ID NO: 2189653 - protein, 18 aa, Cryptosporidium hominis
FIDDSKILTYRSGSFIQA

SEQ ID NO: 2189654 - protein, 24 aa, Cryptosporidium hominis
FIDIDLLWLDIHLLSILKGDSYNF

SEQ ID NO: 2189655 - protein, 24 aa, Cryptosporidium hominis
FIDPQQLLPMSRFLPKTSAQKTTK

SEQ ID NO: 2189656 - protein, 28 aa, Cryptosporidium hominis
FIEFRRRYLEEFLRRIFNRGYLISSNLV

SEQ ID NO: 2189657 - protein, 25 aa, Cryptosporidium hominis
FIEINDQFFKILNSQEIRGLLNLCG

SEQ ID NO: 2189658 - protein, 26 aa, Cryptosporidium hominis
FIELVKALFPTLYDLKFILKQLSSLS

SEQ ID NO: 2189659 - protein, 27 aa, Cryptosporidium hominis
FIENYIVNMFNFLFYSEITLLANNQEM

SEQ ID NO: 2189660 - protein, 25 aa, Cryptosporidium hominis
FIEQEIKLLLFKLSTIINSNLFNQK

SEQ ID NO: 2189661 - protein, 19 aa, Cryptosporidium hominis
FIEVYFQIDGEYYLAKEPK

SEQ ID NO: 2189662 - protein, 18 aa, Cryptosporidium hominis
FIFQVSKCNYYRGLLSRE

SEQ ID NO: 2189663 - protein, 18 aa, Cryptosporidium hominis
FIGCGRRLYGVGGGCFDG

SEQ ID NO: 2189664 - protein, 27 aa, Cryptosporidium hominis
FIGKVCSIEFYLYNPLSFPIVCESLQL

SEQ ID NO: 2189665 - protein, 25 aa, Cryptosporidium hominis
FIGSHLVEYLLSKGYYVLALDNFFS

SEQ ID NO: 2189666 - protein, 17 aa, Cryptosporidium hominis
FIHPYMMNDFVDHKDFN

SEQ ID NO: 2189667 - protein, 18 aa, Cryptosporidium hominis
FIIEKLLKMYGVNYPIWN

SEQ ID NO: 2189668 - protein, 18 aa, Cryptosporidium hominis
FIIKLVRTFKDSENIYLL

SEQ ID NO: 2189669 - protein, 18 aa, Cryptosporidium hominis
FIILETILCRINCKILDI

SEQ ID NO: 2189670 - protein, 18 aa, Cryptosporidium hominis
FIINNASFIYIYLSSISL

SEQ ID NO: 2189671 - protein, 29 aa, Cryptosporidium hominis
FIKEWMDSIIIPPRLAIEANILIHQKKYK

SEQ ID NO: 2189672 - protein, 18 aa, Cryptosporidium hominis
FILDKFDICPIDRLFTLK

SEQ ID NO: 2189673 - protein, 19 aa, Cryptosporidium hominis
FILKLYFESKNFPKRVIWY

SEQ ID NO: 2189674 - protein, 28 aa, Cryptosporidium hominis
FIMDGTDPIAFLSYYTKSDLKVSRGEKS

SEQ ID NO: 2189675 - protein, 21 aa, Cryptosporidium hominis
FINAGIYILSKRILDLIKPNQ

SEQ ID NO: 2189676 - protein, 25 aa, Cryptosporidium hominis
FINDSKVIQMAWRRKQNYSFECEEL

SEQ ID NO: 2189677 - protein, 26 aa, Cryptosporidium hominis
FINLMEGDLFAYRLRILFKQSNISIY

SEQ ID NO: 2189678 - protein, 25 aa, Cryptosporidium hominis
FINRNLNIITFKSPVHTIIIPFKAV

SEQ ID NO: 2189679 - protein, 18 aa, Cryptosporidium hominis
FINYFGLQRFGTSEIPTY

SEQ ID NO: 2189680 - protein, 17 aa, Cryptosporidium hominis
FIPCYDVIPPKFINAIV

SEQ ID NO: 2189681 - protein, 28 aa, Cryptosporidium hominis
FIPKHSIWCLFYFFYQRYPKYTVISTVQ

SEQ ID NO: 2189682 - protein, 27 aa, Cryptosporidium hominis
FIPSINPFMMPIFPSLIQNNTNINAEW

SEQ ID NO: 2189683 - protein, 17 aa, Cryptosporidium hominis
FIRIGLDRLASVEFNSP

SEQ ID NO: 2189684 - protein, 31 aa, Cryptosporidium hominis
FISFSPIYSEAFVPALPSYAPPHGILAPLWT

SEQ ID NO: 2189685 - protein, 21 aa, Cryptosporidium hominis
FISHILPNRKPVSPTLTGLQG

SEQ ID NO: 2189686 - protein, 17 aa, Cryptosporidium hominis
FISIFSIMFTLFSGNDL

SEQ ID NO: 2189687 - protein, 19 aa, Cryptosporidium hominis
FITACHIWRRNEIRQLKSF

SEQ ID NO: 2189688 - protein, 18 aa, Cryptosporidium hominis
FITADARGPKHLQIKLSR

SEQ ID NO: 2189689 - protein, 20 aa, Cryptosporidium hominis
FITDIDLFDNTFFGLSSTEA

SEQ ID NO: 2189690 - protein, 20 aa, Cryptosporidium hominis
FIVLACDGIWDVVDNQLCVD

SEQ ID NO: 2189691 - protein, 29 aa, Cryptosporidium hominis
FIWKSNNVFMFPIPIWKSPTQKKNINGRN

SEQ ID NO: 2189692 - protein, 17 aa, Cryptosporidium hominis
FIYKLKCVFLCHPSLSS

SEQ ID NO: 2189693 - protein, 18 aa, Cryptosporidium hominis
FIYTKYYLDKEISRDLYE

SEQ ID NO: 2189694 - protein, 23 aa, Cryptosporidium hominis
FKADIIGVCSISIDMSSIGIPSQ

SEQ ID NO: 2189695 - protein, 45 aa, Cryptosporidium hominis
FKANLINFICPFCRFFVIDPYNKIIKPLFFTTFYSYTAIHNIHPK

SEQ ID NO: 2189696 - protein, 24 aa, Cryptosporidium hominis
FKAQLLFVELLEQRPLITSGYECI

SEQ ID NO: 2189697 - protein, 17 aa, Cryptosporidium hominis
FKASMHDKFFLGGNCGA

SEQ ID NO: 2189698 - protein, 38 aa, Cryptosporidium hominis
FKDINPVHGCLVPCLKCCIYPCRAFFLTGRCISQKRRV

SEQ ID NO: 2189699 - protein, 28 aa, Cryptosporidium hominis
FKDIYEEYDYFIKTLKTDGLFTDDSQSI

SEQ ID NO: 2189700 - protein, 27 aa, Cryptosporidium hominis
FKDKNRKITIKSILKLFVQNNVIKNSE

SEQ ID NO: 2189701 - protein, 26 aa, Cryptosporidium hominis
FKDLDYKAIFTWRRFNQIKYVLDTRS

SEQ ID NO: 2189702 - protein, 27 aa, Cryptosporidium hominis
FKDLNNWMINLYDRILFSKKESFQTEN

SEQ ID NO: 2189703 - protein, 22 aa, Cryptosporidium hominis
FKEKRLLYKEDYWLDCLNNYLD

SEQ ID NO: 2189704 - protein, 26 aa, Cryptosporidium hominis
FKEMLSITVLLHYLCIGNDSPLMKEL

SEQ ID NO: 2189705 - protein, 17 aa, Cryptosporidium hominis
FKENFGFEIYIKEKEYK

SEQ ID NO: 2189706 - protein, 29 aa, Cryptosporidium hominis
FKEWKEIIIPLLPLILTYYYDSIDEKKSI

SEQ ID NO: 2189707 - protein, 27 aa, Cryptosporidium hominis
FKGFQKRFFKLNLTDNALLYWREEPTF

SEQ ID NO: 2189708 - protein, 23 aa, Cryptosporidium hominis
FKGILKVDLFGDGIIRLLAIKTR

SEQ ID NO: 2189709 - protein, 40 aa, Cryptosporidium hominis
FKIAECIKPALAKSPAWLRFIDICLNEIFQKIDLKDLKTL

SEQ ID NO: 2189710 - protein, 27 aa, Cryptosporidium hominis
FKIGSLESELLIIRQQLAFQKQLNSKE

SEQ ID NO: 2189711 - protein, 18 aa, Cryptosporidium hominis
FKIKFEHILIDMESNKDR

SEQ ID NO: 2189712 - protein, 17 aa, Cryptosporidium hominis
FKISRYFLEVMKAIILS

SEQ ID NO: 2189713 - protein, 17 aa, Cryptosporidium hominis
FKKDVLCLAYLFDHFNL

SEQ ID NO: 2189714 - protein, 24 aa, Cryptosporidium hominis
FKKKGFKSWLEYHKKFWLESFHAF

SEQ ID NO: 2189715 - protein, 28 aa, Cryptosporidium hominis
FKKLDLNDIYYSLAKMIILPTRESIIFP

SEQ ID NO: 2189716 - protein, 19 aa, Cryptosporidium hominis
FKKLSSDADYLLKRTADTF

SEQ ID NO: 2189717 - protein, 28 aa, Cryptosporidium hominis
FKLLKQVRDIWKFQDLYRATGPLQFEGP

SEQ ID NO: 2189718 - protein, 19 aa, Cryptosporidium hominis
FKLLLIGDSGVGKSCLLLR

SEQ ID NO: 2189719 - protein, 18 aa, Cryptosporidium hominis
FKLTTQIYYNLSNDFYIN

SEQ ID NO: 2189720 - protein, 17 aa, Cryptosporidium hominis
FKMVECYIRGNNIKLIR

SEQ ID NO: 2189721 - protein, 20 aa, Cryptosporidium hominis
FKNIIVDFPSKFKSVGENNS

SEQ ID NO: 2189722 - protein, 17 aa, Cryptosporidium hominis
FKNLSLFDMVYILCEDN

SEQ ID NO: 2189723 - protein, 25 aa, Cryptosporidium hominis
FKNSIKFIPPLPYETIRSIKLLEMN

SEQ ID NO: 2189724 - protein, 23 aa, Cryptosporidium hominis
FKPFAITFFNYKVKYSWIAVHGI

SEQ ID NO: 2189725 - protein, 30 aa, Cryptosporidium hominis
FKSFNEFCQLFLWPLFHNVLNPEELSNAPF

SEQ ID NO: 2189726 - protein, 20 aa, Cryptosporidium hominis
FKSHLYYSRFLLEQLVNSNW

SEQ ID NO: 2189727 - protein, 22 aa, Cryptosporidium hominis
FKSIIYNIPQIGSGSRSLISVP

SEQ ID NO: 2189728 - protein, 17 aa, Cryptosporidium hominis
FKSIKEKDPLNNKCIDC

SEQ ID NO: 2189729 - protein, 20 aa, Cryptosporidium hominis
FKSKGWFDPIGVKLSVFSQC

SEQ ID NO: 2189730 - protein, 17 aa, Cryptosporidium hominis
FKVFLYVTNNLSIDQKG

SEQ ID NO: 2189731 - protein, 18 aa, Cryptosporidium hominis
FKYSLYSVTGFLPDIGLV

SEQ ID NO: 2189732 - protein, 21 aa, Cryptosporidium hominis
FLARPEFPKWLGKNSTTNKNK

SEQ ID NO: 2189733 - protein, 19 aa, Cryptosporidium hominis
FLDDGSLFSFDYFFYDTKS

SEQ ID NO: 2189734 - protein, 23 aa, Cryptosporidium hominis
FLDRTIRVWFRTDQQLFLEEERE

SEQ ID NO: 2189735 - protein, 21 aa, Cryptosporidium hominis
FLEDGLYDRNSLNASRKVTEK

SEQ ID NO: 2189736 - protein, 19 aa, Cryptosporidium hominis
FLEFIDISNSILQWLKEYL

SEQ ID NO: 2189737 - protein, 20 aa, Cryptosporidium hominis
FLEFNRLPEFLPNKTGNDLK

SEQ ID NO: 2189738 - protein, 18 aa, Cryptosporidium hominis
FLEKVRVIWKHDNEFKHE

SEQ ID NO: 2189739 - protein, 28 aa, Cryptosporidium hominis
FLELGIHYPMPLPKPWDELLLEDVCLTR

SEQ ID NO: 2189740 - protein, 17 aa, Cryptosporidium hominis
FLFGNIYERIYECCVVN

SEQ ID NO: 2189741 - protein, 19 aa, Cryptosporidium hominis
FLFPFSLVGSSGTAVSGRT

SEQ ID NO: 2189742 - protein, 26 aa, Cryptosporidium hominis
FLGERAIEFVSELWEYISKFAGNPIK

SEQ ID NO: 2189743 - protein, 19 aa, Cryptosporidium hominis
FLHFSYFSSTNALSLKAGA

SEQ ID NO: 2189744 - protein, 19 aa, Cryptosporidium hominis
FLHGFDPNFSLYSVSDDHT

SEQ ID NO: 2189745 - protein, 17 aa, Cryptosporidium hominis
FLIDGDRISACYVLVVV

SEQ ID NO: 2189746 - protein, 17 aa, Cryptosporidium hominis
FLIELYKLYSNFIAGEV

SEQ ID NO: 2189747 - protein, 17 aa, Cryptosporidium hominis
FLINFGKKFVKFELKEF

SEQ ID NO: 2189748 - protein, 18 aa, Cryptosporidium hominis
FLIQPQLENEPLLGKGFN

SEQ ID NO: 2189749 - protein, 23 aa, Cryptosporidium hominis
FLISTFNYLVDEIKLLESILEES

SEQ ID NO: 2189750 - protein, 24 aa, Cryptosporidium hominis
FLKEFYGVLDFGSVLKVNILALDS

SEQ ID NO: 2189751 - protein, 17 aa, Cryptosporidium hominis
FLKILQNTKFFQSTEMD

SEQ ID NO: 2189752 - protein, 17 aa, Cryptosporidium hominis
FLLHQIRKMVALAIEIF

SEQ ID NO: 2189753 - protein, 24 aa, Cryptosporidium hominis
FLMSLQCPIAKLRKPLNPFPNIPE

SEQ ID NO: 2189754 - protein, 17 aa, Cryptosporidium hominis
FLNILRSNNAKFKIVNK

SEQ ID NO: 2189755 - protein, 33 aa, Cryptosporidium hominis
FLNNEIPVQIILYKDFPFSPPDITFPSTFCFPS

SEQ ID NO: 2189756 - protein, 32 aa, Cryptosporidium hominis
FLNQKCASLFHQKIRPVKLKWSVGWRRMNKKL

SEQ ID NO: 2189757 - protein, 18 aa, Cryptosporidium hominis
FLNQLYNYQLFLTSAKVC

SEQ ID NO: 2189758 - protein, 18 aa, Cryptosporidium hominis
FLNQVFQTLIFLNREKQG

SEQ ID NO: 2189759 - protein, 25 aa, Cryptosporidium hominis
FLPKLDRVLLDAPCTGLGIIARDPS

SEQ ID NO: 2189760 - protein, 23 aa, Cryptosporidium hominis
FLPNPSPFNLSLISPGSSSISIH

SEQ ID NO: 2189761 - protein, 18 aa, Cryptosporidium hominis
FLQQLHTPGIDILNVNGA

SEQ ID NO: 2189762 - protein, 29 aa, Cryptosporidium hominis
FLRDKPARVLFSHPLILEILHIDCSKGNA

SEQ ID NO: 2189763 - protein, 18 aa, Cryptosporidium hominis
FLRKKFTPEELLNNDFDA

SEQ ID NO: 2189764 - protein, 21 aa, Cryptosporidium hominis
FLRRVFDPVFGFPNIVRFSWS

SEQ ID NO: 2189765 - protein, 17 aa, Cryptosporidium hominis
FLSCNLHKIITPSGTAY

SEQ ID NO: 2189766 - protein, 17 aa, Cryptosporidium hominis
FLSEFIMDYPISPEFFN

SEQ ID NO: 2189767 - protein, 26 aa, Cryptosporidium hominis
FLSFRNSMMYLVHHYCIIYYEISDPN

SEQ ID NO: 2189768 - protein, 25 aa, Cryptosporidium hominis
FLSKGYIDTLFTNKFKIWYQRDEGS

SEQ ID NO: 2189769 - protein, 37 aa, Cryptosporidium hominis
FLSKSKHFLISPNFISFIEFWRLYEEMLKHSGVYNFL

SEQ ID NO: 2189770 - protein, 32 aa, Cryptosporidium hominis
FLSSGADWTIKLWMPNPLASSFTLLYTFESSE

SEQ ID NO: 2189771 - protein, 18 aa, Cryptosporidium hominis
FLVADISEIALLISFDRY

SEQ ID NO: 2189772 - protein, 26 aa, Cryptosporidium hominis
FLVNIEFKALVFKPKIGELLICRISH

SEQ ID NO: 2189773 - protein, 18 aa, Cryptosporidium hominis
FLVYELIMAAVISEEIYN

SEQ ID NO: 2189774 - protein, 19 aa, Cryptosporidium hominis
FLYNPNGPISLLSFNILIE

SEQ ID NO: 2189775 - protein, 20 aa, Cryptosporidium hominis
FMDKSCVAVLPYCQALCKFP

SEQ ID NO: 2189776 - protein, 20 aa, Cryptosporidium hominis
FMDPPPPETLIRALELLYSL

SEQ ID NO: 2189777 - protein, 19 aa, Cryptosporidium hominis
FMDPPPTTTLLIALETLFE

SEQ ID NO: 2189778 - protein, 25 aa, Cryptosporidium hominis
FMDVEYMAYLLKYDSVHGNFNGTVE

SEQ ID NO: 2189779 - protein, 25 aa, Cryptosporidium hominis
FMGSYTPIMPSIIPNPNVLGNQFQN

SEQ ID NO: 2189780 - protein, 17 aa, Cryptosporidium hominis
FMLIFNRIKALESPIFK

SEQ ID NO: 2189781 - protein, 18 aa, Cryptosporidium hominis
FMLLFTEDYCNFKGGFQK

SEQ ID NO: 2189782 - protein, 19 aa, Cryptosporidium hominis
FMNNFILLWDNLCSEISIV

SEQ ID NO: 2189783 - protein, 17 aa, Cryptosporidium hominis
FMPDVVRRKLARKSALK

SEQ ID NO: 2189784 - protein, 18 aa, Cryptosporidium hominis
FMQNWDHILDVFKVMNKL

SEQ ID NO: 2189785 - protein, 22 aa, Cryptosporidium hominis
FMVTLQERFYSWLSSPNSLLYD

SEQ ID NO: 2189786 - protein, 18 aa, Cryptosporidium hominis
FNAIIYHLFECTLSMIKD

SEQ ID NO: 2189787 - protein, 23 aa, Cryptosporidium hominis
FNDGIRAFGLRIPKFPVPKITLD

SEQ ID NO: 2189788 - protein, 30 aa, Cryptosporidium hominis
FNDQKRAYNLKFWKILLSKDKTQFELVSNY

SEQ ID NO: 2189789 - protein, 29 aa, Cryptosporidium hominis
FNDRILTKKILLNQIGIMIPKLKNRQNTT

SEQ ID NO: 2189790 - protein, 24 aa, Cryptosporidium hominis
FNDSMDLGFLSKRFGEKETNQNKP

SEQ ID NO: 2189791 - protein, 22 aa, Cryptosporidium hominis
FNDSWVLYSLLWTSSIKHDACN

SEQ ID NO: 2189792 - protein, 20 aa, Cryptosporidium hominis
FNDWKFLFSNTLGLNVVLIT

SEQ ID NO: 2189793 - protein, 25 aa, Cryptosporidium hominis
FNFNYQRPIIYQNTNSRLFPVQNIG

SEQ ID NO: 2189794 - protein, 17 aa, Cryptosporidium hominis
FNFRINVQWHSVYVDGW

SEQ ID NO: 2189795 - protein, 27 aa, Cryptosporidium hominis
FNGNCKLLLEYIPFSEPEDINYYVSMI

SEQ ID NO: 2189796 - protein, 23 aa, Cryptosporidium hominis
FNHMAAFSLTWPEVIQLCEMAFS

SEQ ID NO: 2189797 - protein, 24 aa, Cryptosporidium hominis
FNHTSYALLRKKAIKKFPVNYGSS

SEQ ID NO: 2189798 - protein, 17 aa, Cryptosporidium hominis
FNIINQSVSFLNSNLWN

SEQ ID NO: 2189799 - protein, 17 aa, Cryptosporidium hominis
FNIISNPGDLRYRSIKS

SEQ ID NO: 2189800 - protein, 22 aa, Cryptosporidium hominis
FNKECRTIFVGDLYINRSKSNY

SEQ ID NO: 2189801 - protein, 17 aa, Cryptosporidium hominis
FNKPLESLNGIWKRDES

SEQ ID NO: 2189802 - protein, 17 aa, Cryptosporidium hominis
FNKSLKKRLIYPSEMNQ

SEQ ID NO: 2189803 - protein, 19 aa, Cryptosporidium hominis
FNLLQDDLSALIWTDIRHF

SEQ ID NO: 2189804 - protein, 26 aa, Cryptosporidium hominis
FNLNENFWYGYFFTNKDKAVLSILFN

SEQ ID NO: 2189805 - protein, 18 aa, Cryptosporidium hominis
FNNFPHHIPHHSHIPPPI

SEQ ID NO: 2189806 - protein, 18 aa, Cryptosporidium hominis
FNNLTIFCRNKDKMENVF

SEQ ID NO: 2189807 - protein, 17 aa, Cryptosporidium hominis
FNNNFNFRINVQWHSVY

SEQ ID NO: 2189808 - protein, 19 aa, Cryptosporidium hominis
FNQFDYRKEFDACLDTLVI

SEQ ID NO: 2189809 - protein, 18 aa, Cryptosporidium hominis
FNQKGIISDILFPPEVPQ

SEQ ID NO: 2189810 - protein, 22 aa, Cryptosporidium hominis
FNQQIINLVKLLIIRSIISNNS

SEQ ID NO: 2189811 - protein, 21 aa, Cryptosporidium hominis
FNRCRVLILCPFKGVAKKLVD

SEQ ID NO: 2189812 - protein, 25 aa, Cryptosporidium hominis
FNTFTTILSGLCSCPGFISVCNNKK

SEQ ID NO: 2189813 - protein, 25 aa, Cryptosporidium hominis
FNTLQKEFMLQNLTEWYREIVKQYK

SEQ ID NO: 2189814 - protein, 19 aa, Cryptosporidium hominis
FPAILIYDNYSLLNGFFNF

SEQ ID NO: 2189815 - protein, 21 aa, Cryptosporidium hominis
FPAVIFLDKILISLPIESICD

SEQ ID NO: 2189816 - protein, 27 aa, Cryptosporidium hominis
FPDCYNNTKSFLYALDKVCLARISFSS

SEQ ID NO: 2189817 - protein, 29 aa, Cryptosporidium hominis
FPENRTLIYRILTLMIPYFSNITSNLISN

SEQ ID NO: 2189818 - protein, 18 aa, Cryptosporidium hominis
FPGLIKTLRIIISGKRSK

SEQ ID NO: 2189819 - protein, 18 aa, Cryptosporidium hominis
FPGNTCIKNILLYPSFSL

SEQ ID NO: 2189820 - protein, 20 aa, Cryptosporidium hominis
FPIYNEFVFLMSNLLRKTNF

SEQ ID NO: 2189821 - protein, 26 aa, Cryptosporidium hominis
FPLTIDEILGLFNLLPTIASNRLTKS

SEQ ID NO: 2189822 - protein, 21 aa, Cryptosporidium hominis
FPPILLVQKTLPHIYLRGEIL

SEQ ID NO: 2189823 - protein, 17 aa, Cryptosporidium hominis
FPPIYRFNCGFNSYLHY

SEQ ID NO: 2189824 - protein, 28 aa, Cryptosporidium hominis
FPPTIQRICELLLFPDCYNNTKSFLYAL

SEQ ID NO: 2189825 - protein, 24 aa, Cryptosporidium hominis
FPQDIGHCHIYISNNGLGICCITS

SEQ ID NO: 2189826 - protein, 18 aa, Cryptosporidium hominis
FPSCWPLEYQNLNNIPLF

SEQ ID NO: 2189827 - protein, 17 aa, Cryptosporidium hominis
FPSFKREVIDRKPYIFK

SEQ ID NO: 2189828 - protein, 18 aa, Cryptosporidium hominis
FPSGVRVTPPTAPGIGVH

SEQ ID NO: 2189829 - protein, 32 aa, Cryptosporidium hominis
FPSPSFPLPLSPLPSPPPLSPPLLSPLSSFPL

SEQ ID NO: 2189830 - protein, 29 aa, Cryptosporidium hominis
FPTDRSFIHILIGVIFTIFEKEVGIKILI

SEQ ID NO: 2189831 - protein, 17 aa, Cryptosporidium hominis
FPVLDFHHWYENFQNSL

SEQ ID NO: 2189832 - protein, 20 aa, Cryptosporidium hominis
FPVQSGYFYDYYNALPQMQL

SEQ ID NO: 2189833 - protein, 26 aa, Cryptosporidium hominis
FQASPAYFIIPNYNYAFQSLYPSQSG

SEQ ID NO: 2189834 - protein, 20 aa, Cryptosporidium hominis
FQCYGSVLTAIPDPSGKRIL

SEQ ID NO: 2189835 - protein, 32 aa, Cryptosporidium hominis
FQEKMIENGVFVRVFVLLTDFMDTLMIGDISR

SEQ ID NO: 2189836 - protein, 26 aa, Cryptosporidium hominis
FQGNHGFMPPMYPYGSSYAPYVPGAK

SEQ ID NO: 2189837 - protein, 34 aa, Cryptosporidium hominis
FQGTISFLILHWDDLFFELFEKKLSKLSSYFKHQ

SEQ ID NO: 2189838 - protein, 25 aa, Cryptosporidium hominis
FQIAQLPSLPEIKAILKWADNISQD

SEQ ID NO: 2189839 - protein, 28 aa, Cryptosporidium hominis
FQILHRRIEWFLHWYIESASSIDQEDRW

SEQ ID NO: 2189840 - protein, 27 aa, Cryptosporidium hominis
FQINRIFFEEFPIYRKEYQYPSDYKQK

SEQ ID NO: 2189841 - protein, 23 aa, Cryptosporidium hominis
FQKNGFLYIHTPIITAADCEGAG

SEQ ID NO: 2189842 - protein, 18 aa, Cryptosporidium hominis
FQLNLLILSGEFLRNHLM

SEQ ID NO: 2189843 - protein, 18 aa, Cryptosporidium hominis
FQLSKMRIYEKPDENIEW

SEQ ID NO: 2189844 - protein, 20 aa, Cryptosporidium hominis
FQNQIPNYPGGRYPPYQRML

SEQ ID NO: 2189845 - protein, 34 aa, Cryptosporidium hominis
FQPRTLRDYQIYGLNWMISRFKKNVNILLADEMG

SEQ ID NO: 2189846 - protein, 32 aa, Cryptosporidium hominis
FQQYGFTVKIPLRVFLLKFSEIYIPRIHKKGI

SEQ ID NO: 2189847 - protein, 32 aa, Cryptosporidium hominis
FQRASEMTLVSATCFWIALKYEAAYVQGENLK

SEQ ID NO: 2189848 - protein, 19 aa, Cryptosporidium hominis
FQRSDGTIILILTPTRELC

SEQ ID NO: 2189849 - protein, 24 aa, Cryptosporidium hominis
FQSCTFHLSCRIFDTFLIETHVQY

SEQ ID NO: 2189850 - protein, 33 aa, Cryptosporidium hominis
FQSPIKRDLLLAIRKYLYSIPIFTEACISKSSL

SEQ ID NO: 2189851 - protein, 22 aa, Cryptosporidium hominis
FQTKRDFLLKNILQLYEISVHN

SEQ ID NO: 2189852 - protein, 22 aa, Cryptosporidium hominis
FQTLIMHMIYGTELGAIKGHFG

SEQ ID NO: 2189853 - protein, 53 aa, Cryptosporidium hominis
FQTSIETLMSLYTWLKSHLLNPKSPFFDLDYGKFYYTRALELLSNIEYIVRVS

SEQ ID NO: 2189854 - protein, 34 aa, Cryptosporidium hominis
FQWLTNNHWVFLWTQILKKVLVIALSYIQDSSYI

SEQ ID NO: 2189855 - protein, 18 aa, Cryptosporidium hominis
FRCRYPEAFLNKLIELRR

SEQ ID NO: 2189856 - protein, 27 aa, Cryptosporidium hominis
FRDRMRFKVINLFKKWASRFSNSNCKV

SEQ ID NO: 2189857 - protein, 19 aa, Cryptosporidium hominis
FRIDSDFCSYKLLNSVRSE

SEQ ID NO: 2189858 - protein, 22 aa, Cryptosporidium hominis
FRKYNHVKICPWLAISNFVDEF

SEQ ID NO: 2189859 - protein, 38 aa, Cryptosporidium hominis
FRLEPLLYPNLVSLPDPVLLPYWRNLSKRTYHQWDKEM

SEQ ID NO: 2189860 - protein, 18 aa, Cryptosporidium hominis
FRNFESELVTYCILTYIF

SEQ ID NO: 2189861 - protein, 17 aa, Cryptosporidium hominis
FRQILSRSIFQQLNVSF

SEQ ID NO: 2189862 - protein, 19 aa, Cryptosporidium hominis
FRRQIQKSIFLALNFIDHN

SEQ ID NO: 2189863 - protein, 21 aa, Cryptosporidium hominis
FRSDLCSEKIYKIFQASNWKN

SEQ ID NO: 2189864 - protein, 19 aa, Cryptosporidium hominis
FRSEDNYYLVSLFGVHKHN

SEQ ID NO: 2189865 - protein, 17 aa, Cryptosporidium hominis
FSAILSKIKNGVKLTSD

SEQ ID NO: 2189866 - protein, 24 aa, Cryptosporidium hominis
FSASNIKEMLLIMSALKVIPNCTK

SEQ ID NO: 2189867 - protein, 17 aa, Cryptosporidium hominis
FSDRRKLFTVKGGGCFV

SEQ ID NO: 2189868 - protein, 31 aa, Cryptosporidium hominis
FSDSSERLIPPRMSPLLRSQRQRLKQILQEE

SEQ ID NO: 2189869 - protein, 24 aa, Cryptosporidium hominis
FSEGLQPVFFQRSNSNSGFIATNL

SEQ ID NO: 2189870 - protein, 23 aa, Cryptosporidium hominis
FSEHSIYLKNWLEHFHLNDTHSY

SEQ ID NO: 2189871 - protein, 22 aa, Cryptosporidium hominis
FSEINLVYLDWAIKSSMISPEN

SEQ ID NO: 2189872 - protein, 25 aa, Cryptosporidium hominis
FSEKLTLIFYPFTYKIKYKQTLKHV

SEQ ID NO: 2189873 - protein, 24 aa, Cryptosporidium hominis
FSEKNLMIMAKGKRLYNCKTKNWE

SEQ ID NO: 2189874 - protein, 17 aa, Cryptosporidium hominis
FSELNWYHFLTIYIVKI

SEQ ID NO: 2189875 - protein, 25 aa, Cryptosporidium hominis
FSGDIPAIVCTYFNKIYLNNNYMGD

SEQ ID NO: 2189876 - protein, 18 aa, Cryptosporidium hominis
FSGDSLLSLAWKISFQEI

SEQ ID NO: 2189877 - protein, 24 aa, Cryptosporidium hominis
FSGKIPQIGFWYIRHRHDKLDHNV

SEQ ID NO: 2189878 - protein, 28 aa, Cryptosporidium hominis
FSHDKMIFDWRNVGLIELIYFDSDEFIK

SEQ ID NO: 2189879 - protein, 18 aa, Cryptosporidium hominis
FSHTRGIPWPKVKDFVSS

SEQ ID NO: 2189880 - protein, 23 aa, Cryptosporidium hominis
FSIHFQDLLEIYSKYFIQKTRPR

SEQ ID NO: 2189881 - protein, 17 aa, Cryptosporidium hominis
FSIIYDQGIGMNGIQTN

SEQ ID NO: 2189882 - protein, 27 aa, Cryptosporidium hominis
FSIKDILIRLLVFTFTLGTYKDIFNDQ

SEQ ID NO: 2189883 - protein, 25 aa, Cryptosporidium hominis
FSINYLHIVLRLLQPVKIEKVSELD

SEQ ID NO: 2189884 - protein, 23 aa, Cryptosporidium hominis
FSKAMLFFSKRDITCLKCIKRKS

SEQ ID NO: 2189885 - protein, 25 aa, Cryptosporidium hominis
FSKAQNGNNLFSANKGVLNVKLDKV

SEQ ID NO: 2189886 - protein, 33 aa, Cryptosporidium hominis
FSKLKDLVLRYSQFINFPIYIYNPEGVNKSEKD

SEQ ID NO: 2189887 - protein, 33 aa, Cryptosporidium hominis
FSLITSRDLPYTIDLCLFLGLKMTTLTSKQTTD

SEQ ID NO: 2189888 - protein, 23 aa, Cryptosporidium hominis
FSLKKMNLKLIIYLSNIFEYRNN

SEQ ID NO: 2189889 - protein, 21 aa, Cryptosporidium hominis
FSLNLDFSNLAFKPRNSYIYR

SEQ ID NO: 2189890 - protein, 26 aa, Cryptosporidium hominis
FSLTPEFYIPIFKKLKVSTVIRLNKK

SEQ ID NO: 2189891 - protein, 19 aa, Cryptosporidium hominis
FSLYDDWLKTISPFTAFSR

SEQ ID NO: 2189892 - protein, 30 aa, Cryptosporidium hominis
FSNGQIPMELPPPTILKPVELWTGKQVFNM

SEQ ID NO: 2189893 - protein, 17 aa, Cryptosporidium hominis
FSNKYFLFNNINTQNTL

SEQ ID NO: 2189894 - protein, 25 aa, Cryptosporidium hominis
FSNLRRDHLKALVLRYAKENGKDTF

SEQ ID NO: 2189895 - protein, 20 aa, Cryptosporidium hominis
FSNNFLNPLLMTKCLNVNPP

SEQ ID NO: 2189896 - protein, 25 aa, Cryptosporidium hominis
FSNSQYPFNYFTPYSKYGTLEEFKD

SEQ ID NO: 2189897 - protein, 25 aa, Cryptosporidium hominis
FSPDGRLILVKTNLGKIFTISSFRG

SEQ ID NO: 2189898 - protein, 25 aa, Cryptosporidium hominis
FSQDNLFFIIELINTSFAPCEAPDR

SEQ ID NO: 2189899 - protein, 18 aa, Cryptosporidium hominis
FSQVFNLMPSGNGGFMIF

SEQ ID NO: 2189900 - protein, 21 aa, Cryptosporidium hominis
FSRWSVLLGFSLPNLVEESEE

SEQ ID NO: 2189901 - protein, 25 aa, Cryptosporidium hominis
FSSFEIRFLLTFKGIDKIKSIIQTT

SEQ ID NO: 2189902 - protein, 31 aa, Cryptosporidium hominis
FSSKMITYCWIKYNNLYLVLLSRKNSNAIMM

SEQ ID NO: 2189903 - protein, 18 aa, Cryptosporidium hominis
FSSLLFPGSKVSAGTLYC

SEQ ID NO: 2189904 - protein, 36 aa, Cryptosporidium hominis
FSSMILNRDIWNDSLIIEFIQEHFIFWQRSSNTPEG

SEQ ID NO: 2189905 - protein, 24 aa, Cryptosporidium hominis
FSSNYARKWPGIILSPRAKKKVSM

SEQ ID NO: 2189906 - protein, 20 aa, Cryptosporidium hominis
FSSRINRMIKLGLSIDEEDI

SEQ ID NO: 2189907 - protein, 20 aa, Cryptosporidium hominis
FSSSLYYPFTNKVNRFSGQL

SEQ ID NO: 2189908 - protein, 19 aa, Cryptosporidium hominis
FSTELLLKVQRHSFLQLPS

SEQ ID NO: 2189909 - protein, 26 aa, Cryptosporidium hominis
FSTLRPLLIVIKLFLRQRGLDETYLG

SEQ ID NO: 2189910 - protein, 30 aa, Cryptosporidium hominis
FSVDKLKLDLFKIGLFLLQGKTKKAVQYIN

SEQ ID NO: 2189911 - protein, 25 aa, Cryptosporidium hominis
FSVKLITYLLVPQVSLRNFTQYEYW

SEQ ID NO: 2189912 - protein, 19 aa, Cryptosporidium hominis
FSVSIGTRIFLFFNNNTIT

SEQ ID NO: 2189913 - protein, 26 aa, Cryptosporidium hominis
FSVSSVLFPRLLTLFFHYPEDQNSKI

SEQ ID NO: 2189914 - protein, 18 aa, Cryptosporidium hominis
FSVTKYVPIKLTSFLIKR

SEQ ID NO: 2189915 - protein, 30 aa, Cryptosporidium hominis
FSWSQSRLEWVQTPILYLFDAFIRNEEQFK

SEQ ID NO: 2189916 - protein, 19 aa, Cryptosporidium hominis
FSYFKQIISLFGINNLYIS

SEQ ID NO: 2189917 - protein, 34 aa, Cryptosporidium hominis
FSYIHFQDYFLQIYKFLLAKRLLQYHLSLEKNEL

SEQ ID NO: 2189918 - protein, 19 aa, Cryptosporidium hominis
FSYLGRPIPNLRHQEMPCI

SEQ ID NO: 2189919 - protein, 27 aa, Cryptosporidium hominis
FSYSELLSYRLLINVINPKILLKIRNL

SEQ ID NO: 2189920 - protein, 24 aa, Cryptosporidium hominis
FTAFSRLVLILRSMHINPERTKVI

SEQ ID NO: 2189921 - protein, 24 aa, Cryptosporidium hominis
FTAMEFYMAYADYYDLMDLTEELI

SEQ ID NO: 2189922 - protein, 17 aa, Cryptosporidium hominis
FTCFYGSNNIENSSLVN

SEQ ID NO: 2189923 - protein, 19 aa, Cryptosporidium hominis
FTEHVKRFSIIYDQGIGMN

SEQ ID NO: 2189924 - protein, 20 aa, Cryptosporidium hominis
FTEIIVELLVYFYSSRSNKS

SEQ ID NO: 2189925 - protein, 18 aa, Cryptosporidium hominis
FTEIPKQPSIYPLELERN

SEQ ID NO: 2189926 - protein, 17 aa, Cryptosporidium hominis
FTFWVTYSKIKSSYTIT

SEQ ID NO: 2189927 - protein, 22 aa, Cryptosporidium hominis
FTGNLICDLLVRTYKPGTTNLN

SEQ ID NO: 2189928 - protein, 25 aa, Cryptosporidium hominis
FTGPLRPYPISIKRKVPSHILRPDY

SEQ ID NO: 2189929 - protein, 24 aa, Cryptosporidium hominis
FTHVQQVYYHFQKGEWRAVYGPSK

SEQ ID NO: 2189930 - protein, 26 aa, Cryptosporidium hominis
FTIGTYWHRIINVKKLLETGFIGIPR

SEQ ID NO: 2189931 - protein, 17 aa, Cryptosporidium hominis
FTLLSILNSSIKRFKTD

SEQ ID NO: 2189932 - protein, 30 aa, Cryptosporidium hominis
FTRDDCHLIMKVTIPLVRALTGFTCPVTTL

SEQ ID NO: 2189933 - protein, 17 aa, Cryptosporidium hominis
FTRVFELGAFHAGIEIY

SEQ ID NO: 2189934 - protein, 27 aa, Cryptosporidium hominis
FTSCWKLPTFLFYSDKKGNLLNYLFNK

SEQ ID NO: 2189935 - protein, 25 aa, Cryptosporidium hominis
FTSFTIWDTIFSIKGAKRPTSERYY

SEQ ID NO: 2189936 - protein, 24 aa, Cryptosporidium hominis
FTSRFSFFSSCEIELILESMLAEN

SEQ ID NO: 2189937 - protein, 34 aa, Cryptosporidium hominis
FTTDDLRHIFKTFGVILSCQLIPSIEKPGTHRGY

SEQ ID NO: 2189938 - protein, 24 aa, Cryptosporidium hominis
FTTGATTTTTFKKTATTGTQKQGE

SEQ ID NO: 2189939 - protein, 22 aa, Cryptosporidium hominis
FTTILYVSFRLIDEFYPILICK

SEQ ID NO: 2189940 - protein, 24 aa, Cryptosporidium hominis
FTTLPGIPEDVGRPWCDIEKPYKV

SEQ ID NO: 2189941 - protein, 26 aa, Cryptosporidium hominis
FTTTPQLHFMVAFANGLIIDRVPIVI

SEQ ID NO: 2189942 - protein, 22 aa, Cryptosporidium hominis
FTYIPDLEVILQRLTDSSIQND

SEQ ID NO: 2189943 - protein, 35 aa, Cryptosporidium hominis
FVAGLSEKEVLLMFPFIEFYLQTYSKKYNLSKTLG

SEQ ID NO: 2189944 - protein, 18 aa, Cryptosporidium hominis
FVDEFGLPESSLLHLEPK

SEQ ID NO: 2189945 - protein, 27 aa, Cryptosporidium hominis
FVDVLENLLLQLFSDKIQKIKLRNWDE

SEQ ID NO: 2189946 - protein, 17 aa, Cryptosporidium hominis
FVDWCPTGFKCGINYQP

SEQ ID NO: 2189947 - protein, 24 aa, Cryptosporidium hominis
FVFNLHNILIDKYSFVTKFCDFTL

SEQ ID NO: 2189948 - protein, 17 aa, Cryptosporidium hominis
FVILNRLREYTASFCTR

SEQ ID NO: 2189949 - protein, 32 aa, Cryptosporidium hominis
FVKDGEFVIKDWTYFLPILLSSSVSDIEISII

SEQ ID NO: 2189950 - protein, 20 aa, Cryptosporidium hominis
FVKRLVLMKKWIDESKILTI

SEQ ID NO: 2189951 - protein, 27 aa, Cryptosporidium hominis
FVKVQKFFQYYSKKNILLIKQGRGGVL

SEQ ID NO: 2189952 - protein, 19 aa, Cryptosporidium hominis
FVLKSKRISSSGSLLIAVC

SEQ ID NO: 2189953 - protein, 18 aa, Cryptosporidium hominis
FVLPIKQAELRNAAKVQT

SEQ ID NO: 2189954 - protein, 18 aa, Cryptosporidium hominis
FVLSFKKSSDDIVRKTMN

SEQ ID NO: 2189955 - protein, 18 aa, Cryptosporidium hominis
FVLTCDVIGPLDLLGLAN

SEQ ID NO: 2189956 - protein, 17 aa, Cryptosporidium hominis
FVLVLNKADIMSESSDS

SEQ ID NO: 2189957 - protein, 17 aa, Cryptosporidium hominis
FVMKHVINPFNFLNDNI

SEQ ID NO: 2189958 - protein, 18 aa, Cryptosporidium hominis
FVMLDGCATPLQLDKLLG

SEQ ID NO: 2189959 - protein, 18 aa, Cryptosporidium hominis
FVQILRRISISRVITDGG

SEQ ID NO: 2189960 - protein, 19 aa, Cryptosporidium hominis
FVYLFQKSQPSKYTWIAEI

SEQ ID NO: 2189961 - protein, 27 aa, Cryptosporidium hominis
FWEVAKVNQFVFMELLFSKNSARGLGL

SEQ ID NO: 2189962 - protein, 18 aa, Cryptosporidium hominis
FWLAVGVGNLLIVFEIST

SEQ ID NO: 2189963 - protein, 21 aa, Cryptosporidium hominis
FWRSLEFIRTDKYLYKMKPDI

SEQ ID NO: 2189964 - protein, 25 aa, Cryptosporidium hominis
FWSASKILEIAGINRKWITGQIGNS

SEQ ID NO: 2189965 - protein, 20 aa, Cryptosporidium hominis
FYAQCLKIFSSSYGPESIYG

SEQ ID NO: 2189966 - protein, 18 aa, Cryptosporidium hominis
FYCVSAVASMLQIVTEEL

SEQ ID NO: 2189967 - protein, 19 aa, Cryptosporidium hominis
FYDLVETKILQRDPKEEII

SEQ ID NO: 2189968 - protein, 23 aa, Cryptosporidium hominis
FYEFVKKRLNILESSKFDFIQDP

SEQ ID NO: 2189969 - protein, 19 aa, Cryptosporidium hominis
FYEKIGISDLKFKPAFNPY

SEQ ID NO: 2189970 - protein, 19 aa, Cryptosporidium hominis
FYESLYNENPYSIIALKYC

SEQ ID NO: 2189971 - protein, 18 aa, Cryptosporidium hominis
FYKRALLMDSRSSQTWVL

SEQ ID NO: 2189972 - protein, 21 aa, Cryptosporidium hominis
FYLHSRCLITIPFLQWELIND

SEQ ID NO: 2189973 - protein, 17 aa, Cryptosporidium hominis
FYLPNWFSSSKISKESY

SEQ ID NO: 2189974 - protein, 17 aa, Cryptosporidium hominis
FYLRGSCRFGDNCRDYH

SEQ ID NO: 2189975 - protein, 28 aa, Cryptosporidium hominis
FYLSNQSTIRYIPVLCPDIIIKEDESSI

SEQ ID NO: 2189976 - protein, 20 aa, Cryptosporidium hominis
FYMMVRAKASLHLVAHRGAS

SEQ ID NO: 2189977 - protein, 17 aa, Cryptosporidium hominis
FYMRKQFPQLKPTLFGS

SEQ ID NO: 2189978 - protein, 17 aa, Cryptosporidium hominis
FYNHFKTLFDVLDDQDV

SEQ ID NO: 2189979 - protein, 18 aa, Cryptosporidium hominis
FYNIIPKYIYGINQYISK

SEQ ID NO: 2189980 - protein, 19 aa, Cryptosporidium hominis
FYQSLELPYRVISIVSGAL

SEQ ID NO: 2189981 - protein, 29 aa, Cryptosporidium hominis
FYSNDPDYILSLPGILQKKARDLNNFQYG

SEQ ID NO: 2189982 - protein, 18 aa, Cryptosporidium hominis
FYSTGFPLNKAISYAKLK

SEQ ID NO: 2189983 - protein, 27 aa, Cryptosporidium hominis
FYTDRICRIVLEHALNLLPYDFKEIKT

SEQ ID NO: 2189984 - protein, 25 aa, Cryptosporidium hominis
FYTELPILLLRFQPTTLRISTLGIL

SEQ ID NO: 2189985 - protein, 20 aa, Cryptosporidium hominis
FYTIRTLKRTIPSAMAGVMF

SEQ ID NO: 2189986 - protein, 20 aa, Cryptosporidium hominis
GAAALGRLIQRTRWPIICIC

SEQ ID NO: 2189987 - protein, 47 aa, Cryptosporidium hominis
GACNFKDLHAYRLIFRCLGNLRPSSMPIFILRPIIKQLDEYRKISEP

SEQ ID NO: 2189988 - protein, 30 aa, Cryptosporidium hominis
GAELDVIEILPLTEWLVNTYQNYGAQLEFV

SEQ ID NO: 2189989 - protein, 18 aa, Cryptosporidium hominis
GAFFYYTTDGRFLIKTVG

SEQ ID NO: 2189990 - protein, 17 aa, Cryptosporidium hominis
GAFITDIDLFDNTFFGL

SEQ ID NO: 2189991 - protein, 21 aa, Cryptosporidium hominis
GAGNAILSYWFIKECGKPQNK

SEQ ID NO: 2189992 - protein, 23 aa, Cryptosporidium hominis
GAGYFFVSIVRFTKGKFDILATV

SEQ ID NO: 2189993 - protein, 22 aa, Cryptosporidium hominis
GAIELLIVWENLETKRMVVKNP

SEQ ID NO: 2189994 - protein, 29 aa, Cryptosporidium hominis
GAISPYEAIRLLKDPKLYSSPHNISKALA

SEQ ID NO: 2189995 - protein, 24 aa, Cryptosporidium hominis
GAKTPRWASINLGILICIDCSGVH

SEQ ID NO: 2189996 - protein, 26 aa, Cryptosporidium hominis
GALGGAAMMSIFSSPKSFVCTLSSTR

SEQ ID NO: 2189997 - protein, 18 aa, Cryptosporidium hominis
GAMEIYLNQDAERRARQL

SEQ ID NO: 2189998 - protein, 31 aa, Cryptosporidium hominis
GAMSPGPYEWLYNPLLMNLYGNYSAASQAAA

SEQ ID NO: 2189999 - protein, 27 aa, Cryptosporidium hominis
GAPVDQMLIPPFPQVSGIPMFEDGTPD

SEQ ID NO: 2190000 - protein, 19 aa, Cryptosporidium hominis
GARGADIWMGGGGSSMGIG

SEQ ID NO: 2190001 - protein, 19 aa, Cryptosporidium hominis
GARYRLGVLEIPECFLSKY

SEQ ID NO: 2190002 - protein, 32 aa, Cryptosporidium hominis
GAVEFEWLYCILKYLAFFNSKFGFYNENLALL

SEQ ID NO: 2190003 - protein, 21 aa, Cryptosporidium hominis
GAVRKSGVPGVYWSQKPQGWR

SEQ ID NO: 2190004 - protein, 37 aa, Cryptosporidium hominis
GAYSNGKLHYKYFGPRSWTVMGLKEALRKAFKARTSL

SEQ ID NO: 2190005 - protein, 27 aa, Cryptosporidium hominis
GCAFVKYAFKEQGLFAIKSLHGALTLA

SEQ ID NO: 2190006 - protein, 26 aa, Cryptosporidium hominis
GCAPAFVAWVPLWFAASPRACTLGSA

SEQ ID NO: 2190007 - protein, 25 aa, Cryptosporidium hominis
GCDEKNQILTLHRKLGFALDVNQQL

SEQ ID NO: 2190008 - protein, 24 aa, Cryptosporidium hominis
GCDNMTFMIVQLGPNIRKKSSDCM

SEQ ID NO: 2190009 - protein, 18 aa, Cryptosporidium hominis
GCFERSEFYIDCISPYLS

SEQ ID NO: 2190010 - protein, 18 aa, Cryptosporidium hominis
GCHISCSKHIFGGLFGKS

SEQ ID NO: 2190011 - protein, 21 aa, Cryptosporidium hominis
GCILILNPCNGKLFMKVIHTS

SEQ ID NO: 2190012 - protein, 17 aa, Cryptosporidium hominis
GCLLALTCWNKSVKFYD

SEQ ID NO: 2190013 - protein, 20 aa, Cryptosporidium hominis
GCLLSSRYVSRLVPLDIICS

SEQ ID NO: 2190014 - protein, 24 aa, Cryptosporidium hominis
GCLYLKQRGIFHLNLKPTNILIEE

SEQ ID NO: 2190015 - protein, 20 aa, Cryptosporidium hominis
GCSFFGCNIPFDACSYQMCN

SEQ ID NO: 2190016 - protein, 20 aa, Cryptosporidium hominis
GCSKAPHAPPLVNRTRNIYI

SEQ ID NO: 2190017 - protein, 24 aa, Cryptosporidium hominis
GDAFGELALLYNCPRAASVVAKTD

SEQ ID NO: 2190018 - protein, 25 aa, Cryptosporidium hominis
GDAFHYICYIPFGKNVYELDGLTTG

SEQ ID NO: 2190019 - protein, 19 aa, Cryptosporidium hominis
GDDFVFHPKIPFVCKIEMK

SEQ ID NO: 2190020 - protein, 36 aa, Cryptosporidium hominis
GDEEYLYHSKRQLILKLRWYGAKTLDYYSSRADYVI

SEQ ID NO: 2190021 - protein, 35 aa, Cryptosporidium hominis
GDEIPKLSFINFWKQRFYRIWQRSLEGGIKFAATP

SEQ ID NO: 2190022 - protein, 26 aa, Cryptosporidium hominis
GDEKNSLFGFLKHTITPGGTRLLKRW

SEQ ID NO: 2190023 - protein, 26 aa, Cryptosporidium hominis
GDETLRFWQIFPTGRPKGPKNLAALS

SEQ ID NO: 2190024 - protein, 34 aa, Cryptosporidium hominis
GDFSDMIVVPDFEKVWIDPFFDRKTLHVACFVLF

SEQ ID NO: 2190025 - protein, 24 aa, Cryptosporidium hominis
GDGFLDFEDFYRVFQYCHSSTQND

SEQ ID NO: 2190026 - protein, 24 aa, Cryptosporidium hominis
GDGKSYWQHTSPYKFSSSQGVIDW

SEQ ID NO: 2190027 - protein, 25 aa, Cryptosporidium hominis
GDGTLLWLSHLFQTSVPPVISIAMG

SEQ ID NO: 2190028 - protein, 20 aa, Cryptosporidium hominis
GDHFNLLINEQFKKVIEASQ

SEQ ID NO: 2190029 - protein, 17 aa, Cryptosporidium hominis
GDHLEPIRYIYPKGYAP

SEQ ID NO: 2190030 - protein, 17 aa, Cryptosporidium hominis
GDHSYPIPVPVPVITPR

SEQ ID NO: 2190031 - protein, 28 aa, Cryptosporidium hominis
GDIEDAYRLIFRSFVELSLNNISQEQRI

SEQ ID NO: 2190032 - protein, 20 aa, Cryptosporidium hominis
GDIIFAESPLLVVTPELAPE

SEQ ID NO: 2190033 - protein, 19 aa, Cryptosporidium hominis
GDILVFYFAGHGVQVDVLT

SEQ ID NO: 2190034 - protein, 33 aa, Cryptosporidium hominis
GDIRGIYIKPYSNLVLLYNMYKLQWEIYERLGD

SEQ ID NO: 2190035 - protein, 23 aa, Cryptosporidium hominis
GDISWVIPNKFIAFSGPSGTSVD

SEQ ID NO: 2190036 - protein, 17 aa, Cryptosporidium hominis
GDLARDILPYFIEYIKP

SEQ ID NO: 2190037 - protein, 20 aa, Cryptosporidium hominis
GDLLIYKRPLNRSQALNNIN

SEQ ID NO: 2190038 - protein, 25 aa, Cryptosporidium hominis
GDLTQYPIFPWTIVSFNSVLNSRHD

SEQ ID NO: 2190039 - protein, 17 aa, Cryptosporidium hominis
GDLTYMSYLVTPFPPNE

SEQ ID NO: 2190040 - protein, 20 aa, Cryptosporidium hominis
GDMIFGYKNTKYFDTEIQSM

SEQ ID NO: 2190041 - protein, 28 aa, Cryptosporidium hominis
GDNSRYQICNLYYILSNIHSKKPSVLWC

SEQ ID NO: 2190042 - protein, 24 aa, Cryptosporidium hominis
GDSQLFNIHLSRQLFPQLKFEDIP

SEQ ID NO: 2190043 - protein, 25 aa, Cryptosporidium hominis
GDTDYMMFLGCKTHRAASIVLRGAN

SEQ ID NO: 2190044 - protein, 24 aa, Cryptosporidium hominis
GDTFYLVMDLVEGGELFYKIVEHG

SEQ ID NO: 2190045 - protein, 30 aa, Cryptosporidium hominis
GDVMRDKARHFLWKAMVTGVPYSQAKLMKE

SEQ ID NO: 2190046 - protein, 22 aa, Cryptosporidium hominis
GDYNVMILDLLGPSLEDLFTIC

SEQ ID NO: 2190047 - protein, 21 aa, Cryptosporidium hominis
GDYTWLTQQLISIANLCCNGR

SEQ ID NO: 2190048 - protein, 25 aa, Cryptosporidium hominis
GEATAKLYILIEIQRMASVIGNPKV

SEQ ID NO: 2190049 - protein, 24 aa, Cryptosporidium hominis
GECFVLSLAYKFDPCVWLDDPLPI

SEQ ID NO: 2190050 - protein, 31 aa, Cryptosporidium hominis
GECLTLFQPWNLLYASWKHGLSLNRLVSLIE

SEQ ID NO: 2190051 - protein, 24 aa, Cryptosporidium hominis
GECPSKLIKFPLNGLKKLNHSDTP

SEQ ID NO: 2190052 - protein, 26 aa, Cryptosporidium hominis
GEDCPVFDGLWEFCQLSAGGSLGGAQ

SEQ ID NO: 2190053 - protein, 22 aa, Cryptosporidium hominis
GEDFIPYAISVLQLFQQASITQ

SEQ ID NO: 2190054 - protein, 24 aa, Cryptosporidium hominis
GEDQVKIWRRSFDVPPPVLEKSDP

SEQ ID NO: 2190055 - protein, 24 aa, Cryptosporidium hominis
GEEAVLVLWRQTFSSDSYLIHTRN

SEQ ID NO: 2190056 - protein, 25 aa, Cryptosporidium hominis
GEEEKILMKYFRKYQALSADKRREE

SEQ ID NO: 2190057 - protein, 17 aa, Cryptosporidium hominis
GEFGIKEPKIKWVNDIY

SEQ ID NO: 2190058 - protein, 22 aa, Cryptosporidium hominis
GEGVNFIRRGLIDSAIESRSQK

SEQ ID NO: 2190059 - protein, 25 aa, Cryptosporidium hominis
GEIIKRCDMFFRLVKYEFNEFQAIE

SEQ ID NO: 2190060 - protein, 17 aa, Cryptosporidium hominis
GEIILRIYDRKNRLNIY

SEQ ID NO: 2190061 - protein, 34 aa, Cryptosporidium hominis
GEILGVSLLFMHNYWQYQGLLLSIRRSIIDGILE

SEQ ID NO: 2190062 - protein, 23 aa, Cryptosporidium hominis
GEILIFSFQLLDLGEKLELNLKK

SEQ ID NO: 2190063 - protein, 20 aa, Cryptosporidium hominis
GEILRNKYSKLHKVRPSKNC

SEQ ID NO: 2190064 - protein, 25 aa, Cryptosporidium hominis
GEIQGVYFDKIRKLWRANWKENGRV

SEQ ID NO: 2190065 - protein, 24 aa, Cryptosporidium hominis
GEISLFEIILRIHELYKYGEIKYL

SEQ ID NO: 2190066 - protein, 30 aa, Cryptosporidium hominis
GEIYPPDDNFILLIIDLIRELVQEWKDDTS

SEQ ID NO: 2190067 - protein, 31 aa, Cryptosporidium hominis
GEKTMAALALLFAMQSYHPSPFFVLDEVDAA

SEQ ID NO: 2190068 - protein, 28 aa, Cryptosporidium hominis
GELLDRPFVHLLIWNYIKCCISFYQLDD

SEQ ID NO: 2190069 - protein, 19 aa, Cryptosporidium hominis
GELLRIKGPSIQIPHSGQS

SEQ ID NO: 2190070 - protein, 24 aa, Cryptosporidium hominis
GELNMYLKPVFGIFHGFSGTKFWR

SEQ ID NO: 2190071 - protein, 25 aa, Cryptosporidium hominis
GELVKTDYLKLIKALSTDENIKLNR

SEQ ID NO: 2190072 - protein, 23 aa, Cryptosporidium hominis
GENCMMDWHIKKSVFENIFPIQV

SEQ ID NO: 2190073 - protein, 21 aa, Cryptosporidium hominis
GEQLLSLPRSLLDEICREINV

SEQ ID NO: 2190074 - protein, 30 aa, Cryptosporidium hominis
GERLIIQSSRFSFFVNRNQFLNVRSQVSHI

SEQ ID NO: 2190075 - protein, 25 aa, Cryptosporidium hominis
GESFVFLPVQLIPQLLQKTGKPATQ

SEQ ID NO: 2190076 - protein, 19 aa, Cryptosporidium hominis
GESIAKWISSLRSCVSKSA

SEQ ID NO: 2190077 - protein, 26 aa, Cryptosporidium hominis
GESNKKLLVFLKMRWLSNNVCSIECL

SEQ ID NO: 2190078 - protein, 29 aa, Cryptosporidium hominis
GETEEFVHFLFREGFLVKGSRMESYDFHS

SEQ ID NO: 2190079 - protein, 21 aa, Cryptosporidium hominis
GETELFFAQKMDLGGSVPLML

SEQ ID NO: 2190080 - protein, 26 aa, Cryptosporidium hominis
GETENIIKALFMISEYSSPSIIFIDE

SEQ ID NO: 2190081 - protein, 25 aa, Cryptosporidium hominis
GETTKLHFSKFFSLGQLQCVDPETR

SEQ ID NO: 2190082 - protein, 17 aa, Cryptosporidium hominis
GEWFCPRCIRGRRRRTN

SEQ ID NO: 2190083 - protein, 20 aa, Cryptosporidium hominis
GEWSEPYPFNLMFRTKIGPK

SEQ ID NO: 2190084 - protein, 26 aa, Cryptosporidium hominis
GEYKYLRIPIPMLIEQHRQLLLPYPE

SEQ ID NO: 2190085 - protein, 24 aa, Cryptosporidium hominis
GEYNLRNYVLLELLSKYLDSNCYL

SEQ ID NO: 2190086 - protein, 24 aa, Cryptosporidium hominis
GEYSYCVMLYNAFLFNNSNMCLVF

SEQ ID NO: 2190087 - protein, 21 aa, Cryptosporidium hominis
GFDILSNHEGLLRKLLAFKEV

SEQ ID NO: 2190088 - protein, 27 aa, Cryptosporidium hominis
GFEDRLHFYYHYIAELRFNHYQPELFH

SEQ ID NO: 2190089 - protein, 24 aa, Cryptosporidium hominis
GFEEFDVIFPADIARILVGVTSFR

SEQ ID NO: 2190090 - protein, 20 aa, Cryptosporidium hominis
GFENLLIRMASYTIGLRQYA

SEQ ID NO: 2190091 - protein, 20 aa, Cryptosporidium hominis
GFEYACSIALKKLEEISLKN

SEQ ID NO: 2190092 - protein, 20 aa, Cryptosporidium hominis
GFFGHLINKIIIYNIKNNNN

SEQ ID NO: 2190093 - protein, 19 aa, Cryptosporidium hominis
GFFKDDFFKYLFDSDNQKN

SEQ ID NO: 2190094 - protein, 17 aa, Cryptosporidium hominis
GFFKGMGAGLVAAVALP

SEQ ID NO: 2190095 - protein, 18 aa, Cryptosporidium hominis
GFFLIPEDGVWSYNSMVV

SEQ ID NO: 2190096 - protein, 27 aa, Cryptosporidium hominis
GFGASESLIWSLSIHFRSITLQDPATV

SEQ ID NO: 2190097 - protein, 26 aa, Cryptosporidium hominis
GFGNWIPFGWCEFFVKLFETNSKHYL

SEQ ID NO: 2190098 - protein, 24 aa, Cryptosporidium hominis
GFGQRRRLFGSVRPLSNIGQCAAL

SEQ ID NO: 2190099 - protein, 17 aa, Cryptosporidium hominis
GFHLFRSDRRGGGNCFS

SEQ ID NO: 2190100 - protein, 33 aa, Cryptosporidium hominis
GFILFKGLENSFKPRIYLRFKSLRDPSSTGFER

SEQ ID NO: 2190101 - protein, 19 aa, Cryptosporidium hominis
GFISGHLMLRYNKGGMSSS

SEQ ID NO: 2190102 - protein, 17 aa, Cryptosporidium hominis
GFLRDDGNFDNYYEYEQ

SEQ ID NO: 2190103 - protein, 23 aa, Cryptosporidium hominis
GFPSDIVVIAWGLSLERPTMISY

SEQ ID NO: 2190104 - protein, 24 aa, Cryptosporidium hominis
GFQLEEIFYGCLTSIFAGSLPSST

SEQ ID NO: 2190105 - protein, 35 aa, Cryptosporidium hominis
GFRFSEFHVSRIIQQILLAIRYLHLKRVVHKNLKP

SEQ ID NO: 2190106 - protein, 19 aa, Cryptosporidium hominis
GFRGGYSRGGMMSGGHGPN

SEQ ID NO: 2190107 - protein, 18 aa, Cryptosporidium hominis
GFRLKLGSSSSIEWNPSG

SEQ ID NO: 2190108 - protein, 25 aa, Cryptosporidium hominis
GFSALKRMYHTVQEPMWDAAMYNPN

SEQ ID NO: 2190109 - protein, 19 aa, Cryptosporidium hominis
GFSSLHWASLKGHSQVVEE

SEQ ID NO: 2190110 - protein, 20 aa, Cryptosporidium hominis
GFTCLYITIKIERVVNFNFK

SEQ ID NO: 2190111 - protein, 20 aa, Cryptosporidium hominis
GFVLPMIERLGCSHSQIVGI

SEQ ID NO: 2190112 - protein, 18 aa, Cryptosporidium hominis
GGALIFSLVTNHPNFLTC

SEQ ID NO: 2190113 - protein, 27 aa, Cryptosporidium hominis
GGDRLENWLIKNLCISVFQFSEHSIYL

SEQ ID NO: 2190114 - protein, 20 aa, Cryptosporidium hominis
GGEILNHKIIKSKGSEAKAI

SEQ ID NO: 2190115 - protein, 32 aa, Cryptosporidium hominis
GGELDFPYAGIKIKPKKGLAVVWPNIDSQGKL

SEQ ID NO: 2190116 - protein, 22 aa, Cryptosporidium hominis
GGEYIYREMLINNISIGEYTLR

SEQ ID NO: 2190117 - protein, 25 aa, Cryptosporidium hominis
GGGFKYLSPLGYKPNYSRFIQEISP

SEQ ID NO: 2190118 - protein, 26 aa, Cryptosporidium hominis
GGHGRFTFLLLRALERYSPVWEDLGY

SEQ ID NO: 2190119 - protein, 40 aa, Cryptosporidium hominis
GGIETLRAIPWVFAWTQIRSHLPVWLGLSAALEEMKKQNK

SEQ ID NO: 2190120 - protein, 23 aa, Cryptosporidium hominis
GGIIPNLPKNLNPAVIRRLQNAD

SEQ ID NO: 2190121 - protein, 23 aa, Cryptosporidium hominis
GGLDQFDYLPYNCKLHSNLENSH

SEQ ID NO: 2190122 - protein, 19 aa, Cryptosporidium hominis
GGLFFFEFLYRNTRIYIKR

SEQ ID NO: 2190123 - protein, 25 aa, Cryptosporidium hominis
GGLRKSPWMRPPGEWLRLCDNCLLP

SEQ ID NO: 2190124 - protein, 17 aa, Cryptosporidium hominis
GGLRSCMGYLGSASIEE

SEQ ID NO: 2190125 - protein, 31 aa, Cryptosporidium hominis
GGLSFLVQVVVIHVFPICYKEMIETLQDDNR

SEQ ID NO: 2190126 - protein, 23 aa, Cryptosporidium hominis
GGNGIIYKIYYDSIPTLNSCISK

SEQ ID NO: 2190127 - protein, 24 aa, Cryptosporidium hominis
GGNRKIIKIPYLANITDFSTIQNA

SEQ ID NO: 2190128 - protein, 17 aa, Cryptosporidium hominis
GGNTRLTEIFSEYGLNG

SEQ ID NO: 2190129 - protein, 20 aa, Cryptosporidium hominis
GGPPLSSLPLFVRVKFNANE

SEQ ID NO: 2190130 - protein, 22 aa, Cryptosporidium hominis
GGRHNYNLRKLLKSENYRELQK

SEQ ID NO: 2190131 - protein, 28 aa, Cryptosporidium hominis
GGRLCQCEYILNEILEAVSYKLETYEKH

SEQ ID NO: 2190132 - protein, 25 aa, Cryptosporidium hominis
GGRNCSPLLTLIFVRVCNSICNANN

SEQ ID NO: 2190133 - protein, 26 aa, Cryptosporidium hominis
GGSNGFITLIYLPCATISKIERLYET

SEQ ID NO: 2190134 - protein, 23 aa, Cryptosporidium hominis
GGSNPNIYFTPNSLIHGSCKEGN

SEQ ID NO: 2190135 - protein, 26 aa, Cryptosporidium hominis
GGSYKLELFLPEHYPMEPPKVRFLTK

SEQ ID NO: 2190136 - protein, 23 aa, Cryptosporidium hominis
GGTTVIRKALNLSIHRLNNSISN

SEQ ID NO: 2190137 - protein, 25 aa, Cryptosporidium hominis
GGVCFRPYFEQRFAEIAFLAVTSTE

SEQ ID NO: 2190138 - protein, 24 aa, Cryptosporidium hominis
GGVRPFGISLLVAGFDSTRGPQLF

SEQ ID NO: 2190139 - protein, 30 aa, Cryptosporidium hominis
GGVYWERIFQLIPCPYLCLSATIGNPLAFY

SEQ ID NO: 2190140 - protein, 28 aa, Cryptosporidium hominis
GGYAWTICVIYFFQKIGILPVIDANEFF

SEQ ID NO: 2190141 - protein, 23 aa, Cryptosporidium hominis
GGYSMLLRKGIGIGYISLFSFDE

SEQ ID NO: 2190142 - protein, 22 aa, Cryptosporidium hominis
GGYVGMIYDDTMNGGGMSGLGI

SEQ ID NO: 2190143 - protein, 35 aa, Cryptosporidium hominis
GHASRIFEEFFGTNNIFDIFSSFGEFPGFNESSRS

SEQ ID NO: 2190144 - protein, 24 aa, Cryptosporidium hominis
GHEFIDISLLPGVNLITGGNGSGK

SEQ ID NO: 2190145 - protein, 24 aa, Cryptosporidium hominis
GHELNFILFLMCIHRLGAFQKNDL

SEQ ID NO: 2190146 - protein, 25 aa, Cryptosporidium hominis
GHGPNMRGYYGNPYKSYRGGGGGVG

SEQ ID NO: 2190147 - protein, 17 aa, Cryptosporidium hominis
GHHIDWRALEFEVCRIR

SEQ ID NO: 2190148 - protein, 18 aa, Cryptosporidium hominis
GHIHPLIGNNDLMSSLEN

SEQ ID NO: 2190149 - protein, 18 aa, Cryptosporidium hominis
GHKIPIIKCGPLLETERS

SEQ ID NO: 2190150 - protein, 23 aa, Cryptosporidium hominis
GHLKLLDFGLCKFSPLIEGDKNS

SEQ ID NO: 2190151 - protein, 31 aa, Cryptosporidium hominis
GHLNVTDDLQLYLYLCRLLSGAISLRSQNIQ

SEQ ID NO: 2190152 - protein, 33 aa, Cryptosporidium hominis
GHLSAIIWLTRFFDINLIPREISQLIWYQHIQP

SEQ ID NO: 2190153 - protein, 25 aa, Cryptosporidium hominis
GHMHLSRCALLPTPDYRILNLGGIP

SEQ ID NO: 2190154 - protein, 18 aa, Cryptosporidium hominis
GHNFALTPNLITLENVQR

SEQ ID NO: 2190155 - protein, 25 aa, Cryptosporidium hominis
GHNFITEIDPLLSLTKLKSLNISKN

SEQ ID NO: 2190156 - protein, 18 aa, Cryptosporidium hominis
GHNKSFIQELYLKKKNEL

SEQ ID NO: 2190157 - protein, 29 aa, Cryptosporidium hominis
GHPCKCLFINWHKLSIWMPFYRVHSHIDS

SEQ ID NO: 2190158 - protein, 24 aa, Cryptosporidium hominis
GHPLPTHYAIIQELLHKLQYIFRE

SEQ ID NO: 2190159 - protein, 19 aa, Cryptosporidium hominis
GHSFPIYCMELLGSKGSQS

SEQ ID NO: 2190160 - protein, 22 aa, Cryptosporidium hominis
GHSFVLSSVRKGILPLIVEELI

SEQ ID NO: 2190161 - protein, 24 aa, Cryptosporidium hominis
GHVEIFKRKVFLGQWQSAYIILTK

SEQ ID NO: 2190162 - protein, 26 aa, Cryptosporidium hominis
GIADNLTYFSKISSYLILWLDCDREG

SEQ ID NO: 2190163 - protein, 17 aa, Cryptosporidium hominis
GIARQVVAFKGDPDRIL

SEQ ID NO: 2190164 - protein, 24 aa, Cryptosporidium hominis
GIAVSKIYAPWTAGGPTPDLSAFQ

SEQ ID NO: 2190165 - protein, 25 aa, Cryptosporidium hominis
GICDTFNSFIWEPAVNKLSAYSSAT

SEQ ID NO: 2190166 - protein, 22 aa, Cryptosporidium hominis
GICLHSLLYILPPSVPTENYLI

SEQ ID NO: 2190167 - protein, 26 aa, Cryptosporidium hominis
GIDDDSFLSLFKPIISKCIEVYRPGA

SEQ ID NO: 2190168 - protein, 21 aa, Cryptosporidium hominis
GIDFRNYLHILQKNKIYGLYK

SEQ ID NO: 2190169 - protein, 32 aa, Cryptosporidium hominis
GIEKKEEWGLYDDLIYKFLFRKHDDSHLNTNK

SEQ ID NO: 2190170 - protein, 27 aa, Cryptosporidium hominis
GIELLKLLTWYLSWNKILEYPSASFSI

SEQ ID NO: 2190171 - protein, 24 aa, Cryptosporidium hominis
GIELPLLNITNLSDLLLLPIDVNR

SEQ ID NO: 2190172 - protein, 26 aa, Cryptosporidium hominis
GIESIRLELLPFLAKNQHVPGSELWG

SEQ ID NO: 2190173 - protein, 17 aa, Cryptosporidium hominis
GIEVWWSFEGSVSSLPN

SEQ ID NO: 2190174 - protein, 21 aa, Cryptosporidium hominis
GIFNIGKYIDSLYNQSRDSIN

SEQ ID NO: 2190175 - protein, 19 aa, Cryptosporidium hominis
GIFQAFISWERIEIFKVSP

SEQ ID NO: 2190176 - protein, 17 aa, Cryptosporidium hominis
GIFVLFNFKLKLNKEIG

SEQ ID NO: 2190177 - protein, 27 aa, Cryptosporidium hominis
GIGAFYIRSKPRRRIKPLIFGGGQERG

SEQ ID NO: 2190178 - protein, 18 aa, Cryptosporidium hominis
GIGKFHAKWIPVSVATFT

SEQ ID NO: 2190179 - protein, 27 aa, Cryptosporidium hominis
GIGRFQNFLYCIMGEISIELIINQVCE

SEQ ID NO: 2190180 - protein, 25 aa, Cryptosporidium hominis
GIIFMSKFYYLIKQQLFSSIDTSLF

SEQ ID NO: 2190181 - protein, 28 aa, Cryptosporidium hominis
GIIFTPVHLPYVPGTCPQLLKWKPPHLN

SEQ ID NO: 2190182 - protein, 17 aa, Cryptosporidium hominis
GIIISRILDNFCKCVDE

SEQ ID NO: 2190183 - protein, 22 aa, Cryptosporidium hominis
GIIKLKSRLLNYLQEPLYDYLD

SEQ ID NO: 2190184 - protein, 20 aa, Cryptosporidium hominis
GIILKNVISFPNNPFYRIIS

SEQ ID NO: 2190185 - protein, 18 aa, Cryptosporidium hominis
GIISSFKSWTHSLITHSS

SEQ ID NO: 2190186 - protein, 27 aa, Cryptosporidium hominis
GIKHPRGELKLWPTSYDRVISQNSSKR

SEQ ID NO: 2190187 - protein, 17 aa, Cryptosporidium hominis
GIKIQRAINSANKIKNL

SEQ ID NO: 2190188 - protein, 19 aa, Cryptosporidium hominis
GIKNFPFAPSMKIDRLGAV

SEQ ID NO: 2190189 - protein, 19 aa, Cryptosporidium hominis
GIKTIFKVLFSLEFRESPQ

SEQ ID NO: 2190190 - protein, 34 aa, Cryptosporidium hominis
GILDSTTLLELYYFDYDRFVISRPILDGKEDAWI

SEQ ID NO: 2190191 - protein, 18 aa, Cryptosporidium hominis
GILEALYLSIAQKAEHFE

SEQ ID NO: 2190192 - protein, 17 aa, Cryptosporidium hominis
GILFTPICPHTLSFRPV

SEQ ID NO: 2190193 - protein, 17 aa, Cryptosporidium hominis
GILGVLMKYYPNVYWER

SEQ ID NO: 2190194 - protein, 20 aa, Cryptosporidium hominis
GILIWKSTNFIRHCDIILTA

SEQ ID NO: 2190195 - protein, 19 aa, Cryptosporidium hominis
GILNDFFPNRLADYCYELS

SEQ ID NO: 2190196 - protein, 20 aa, Cryptosporidium hominis
GILSMKIVEFGFQGTNVLRM

SEQ ID NO: 2190197 - protein, 29 aa, Cryptosporidium hominis
GINELNPGFPLILPNQLYQVNNALGAVRA

SEQ ID NO: 2190198 - protein, 21 aa, Cryptosporidium hominis
GIPIFEKFMQFLERPKVDSYL

SEQ ID NO: 2190199 - protein, 23 aa, Cryptosporidium hominis
GIPISHLVLCKAIFPERYEDCMN

SEQ ID NO: 2190200 - protein, 31 aa, Cryptosporidium hominis
GIPQIYGEKWSIIVIIGILQILKPCKDIDLE

SEQ ID NO: 2190201 - protein, 18 aa, Cryptosporidium hominis
GIPRSFLRAINFDEEGRL

SEQ ID NO: 2190202 - protein, 27 aa, Cryptosporidium hominis
GIPVDLLDRLLIIRTIPYNIEEMIRIV

SEQ ID NO: 2190203 - protein, 22 aa, Cryptosporidium hominis
GIQPISVPILRMNTIDSRKNVF

SEQ ID NO: 2190204 - protein, 28 aa, Cryptosporidium hominis
GIQRSLARLWFDYVFSVKCLSPSASPYL

SEQ ID NO: 2190205 - protein, 26 aa, Cryptosporidium hominis
GIRCPFCIIGFLVPSPIFKKSEVVES

SEQ ID NO: 2190206 - protein, 27 aa, Cryptosporidium hominis
GIRLRLEWDRRRYCFKFTVYQIEEVRD

SEQ ID NO: 2190207 - protein, 19 aa, Cryptosporidium hominis
GISDLKFKPAFNPYTEPSM

SEQ ID NO: 2190208 - protein, 38 aa, Cryptosporidium hominis
GISKLVLSPCKNLLMGLTCYGWIYIWNIEQLGNNTNND

SEQ ID NO: 2190209 - protein, 37 aa, Cryptosporidium hominis
GISRLKLVFSYYDWGWKGYLDEFDWKRLRSDILNLTY

SEQ ID NO: 2190210 - protein, 20 aa, Cryptosporidium hominis
GISSIIPYSVLPIKSICSTD

SEQ ID NO: 2190211 - protein, 21 aa, Cryptosporidium hominis
GISTDILVDILLVKQLKVGNN

SEQ ID NO: 2190212 - protein, 27 aa, Cryptosporidium hominis
GISTEDVLKIVYYPMTPFKILPATRCT

SEQ ID NO: 2190213 - protein, 24 aa, Cryptosporidium hominis
GITAIDLGIKVGGISPPHGIQIGG

SEQ ID NO: 2190214 - protein, 25 aa, Cryptosporidium hominis
GITGKIFMDVLFQLVNAFDLDDREI

SEQ ID NO: 2190215 - protein, 23 aa, Cryptosporidium hominis
GITRLILEILAVLFEFDQNISVN

SEQ ID NO: 2190216 - protein, 29 aa, Cryptosporidium hominis
GIVKEMRIYYYDTIPVCNSLLLLRSGFLF

SEQ ID NO: 2190217 - protein, 31 aa, Cryptosporidium hominis
GIWLDTHSIPLLWRLAMFRIEDIPLFISNSD

SEQ ID NO: 2190218 - protein, 17 aa, Cryptosporidium hominis
GIYAPRLESINFPVFGA

SEQ ID NO: 2190219 - protein, 20 aa, Cryptosporidium hominis
GIYDILTLDEFLKFSVSGFD

SEQ ID NO: 2190220 - protein, 17 aa, Cryptosporidium hominis
GIYIPHSPNRFPGFTKG

SEQ ID NO: 2190221 - protein, 30 aa, Cryptosporidium hominis
GIYSGLYYAALLITSAWWSPGIDTYRIAAS

SEQ ID NO: 2190222 - protein, 24 aa, Cryptosporidium hominis
GKCGPYQFILISELIEHILHESNI

SEQ ID NO: 2190223 - protein, 17 aa, Cryptosporidium hominis
GKCLWIDTEGTFRPERI

SEQ ID NO: 2190224 - protein, 26 aa, Cryptosporidium hominis
GKDDKIHSMLFGRLTLEQKKAVFTNH

SEQ ID NO: 2190225 - protein, 23 aa, Cryptosporidium hominis
GKDGWLIEPQEWIEFAKMALGFD

SEQ ID NO: 2190226 - protein, 27 aa, Cryptosporidium hominis
GKDLHESWICLVTLIFQMKDLIEERIK

SEQ ID NO: 2190227 - protein, 29 aa, Cryptosporidium hominis
GKEIKFILSMMLFHQTFLNFISIENNVDS

SEQ ID NO: 2190228 - protein, 30 aa, Cryptosporidium hominis
GKEKLGFLNRDILLTDYRLIFLKDAEYSTQ

SEQ ID NO: 2190229 - protein, 27 aa, Cryptosporidium hominis
GKESIALMYYLLAREVNFLRGKTDKWD

SEQ ID NO: 2190230 - protein, 24 aa, Cryptosporidium hominis
GKEVFAYFCRCGGLIFLEKKHIEE

SEQ ID NO: 2190231 - protein, 24 aa, Cryptosporidium hominis
GKFGTAIMFCNMSDYPFLSSIEKA

SEQ ID NO: 2190232 - protein, 24 aa, Cryptosporidium hominis
GKFHTKNFLVRLKRAGFEKSIHNL

SEQ ID NO: 2190233 - protein, 20 aa, Cryptosporidium hominis
GKFLASIFRVSIGHLLDTLK

SEQ ID NO: 2190234 - protein, 25 aa, Cryptosporidium hominis
GKFSGRFICIEGMYTFLDISRMIKH

SEQ ID NO: 2190235 - protein, 18 aa, Cryptosporidium hominis
GKICIELLGRLNKCGVIS

SEQ ID NO: 2190236 - protein, 25 aa, Cryptosporidium hominis
GKIQQLLYYRIKDASLGPTITWESD

SEQ ID NO: 2190237 - protein, 19 aa, Cryptosporidium hominis
GKKHGIVLLPEGLIEFIPE

SEQ ID NO: 2190238 - protein, 24 aa, Cryptosporidium hominis
GKKKAPPKASFSPGSRFPQVENIN

SEQ ID NO: 2190239 - protein, 24 aa, Cryptosporidium hominis
GKKSKLNFCTWPSPQLSTAVVEPY

SEQ ID NO: 2190240 - protein, 22 aa, Cryptosporidium hominis
GKKYLISFFNSIGGSFISDCQI

SEQ ID NO: 2190241 - protein, 34 aa, Cryptosporidium hominis
GKLDNLFRDVIKRNQLYAFRLLQYQARIELKGKI

SEQ ID NO: 2190242 - protein, 20 aa, Cryptosporidium hominis
GKMIFHRFHKRKWKMYIDSS

SEQ ID NO: 2190243 - protein, 23 aa, Cryptosporidium hominis
GKMVLMGKLLPKLKAEGHRVLIF

SEQ ID NO: 2190244 - protein, 22 aa, Cryptosporidium hominis
GKNSFKVLFSWLNEELKLPSIE

SEQ ID NO: 2190245 - protein, 32 aa, Cryptosporidium hominis
GKPKGFGFVLFNDRKFVISSVKMLNGAQFKDS

SEQ ID NO: 2190246 - protein, 24 aa, Cryptosporidium hominis
GKRIPFGFRDRSLPHFLKYDYGPE

SEQ ID NO: 2190247 - protein, 27 aa, Cryptosporidium hominis
GKSNVIDAMLFVFGKRAKHMRLNKVSE

SEQ ID NO: 2190248 - protein, 49 aa, Cryptosporidium hominis
GKSQIKPIGNLRFLRYCKILWVMIGIDDFSMNDIYRPTPDRIYSFLCGF

SEQ ID NO: 2190249 - protein, 27 aa, Cryptosporidium hominis
GKSSSSYIYFLLYNTIIYLEETILDLE

SEQ ID NO: 2190250 - protein, 32 aa, Cryptosporidium hominis
GKSYLSMCIAGELGLPFFKLSGPNIINGVSGT

SEQ ID NO: 2190251 - protein, 26 aa, Cryptosporidium hominis
GKTIQTISLLAYLACYMKNWGPHLIV

SEQ ID NO: 2190252 - protein, 23 aa, Cryptosporidium hominis
GKTLSFLVPAIQRSLLNDIGRTT

SEQ ID NO: 2190253 - protein, 25 aa, Cryptosporidium hominis
GKTWDPFIIIRARDMVKLLSRSVPF

SEQ ID NO: 2190254 - protein, 22 aa, Cryptosporidium hominis
GKVGVIVFVGRNKNLRLLTSTG

SEQ ID NO: 2190255 - protein, 31 aa, Cryptosporidium hominis
GKVVLGDYGMLRLIPSYLSYSQARDLGLSIS

SEQ ID NO: 2190256 - protein, 28 aa, Cryptosporidium hominis
GKWEVEYFQVFHFITLKKSLNCLLNLSK

SEQ ID NO: 2190257 - protein, 26 aa, Cryptosporidium hominis
GKYQDNLEFLQWMKGLFDESGAIDRD

SEQ ID NO: 2190258 - protein, 20 aa, Cryptosporidium hominis
GLATVDFPRLLFSDGAANGK

SEQ ID NO: 2190259 - protein, 22 aa, Cryptosporidium hominis
GLDAWREEFLIQATPKDPNSFP

SEQ ID NO: 2190260 - protein, 25 aa, Cryptosporidium hominis
GLDKETILILIKLLELGVQPETLSE

SEQ ID NO: 2190261 - protein, 26 aa, Cryptosporidium hominis
GLEAVQILMKYLYRNDLIVAPIDTNV

SEQ ID NO: 2190262 - protein, 28 aa, Cryptosporidium hominis
GLEDILPPLKLIIMSATLRVTDFSENPK

SEQ ID NO: 2190263 - protein, 25 aa, Cryptosporidium hominis
GLEFKVGFGGIWKKSLTELSGGQRS

SEQ ID NO: 2190264 - protein, 22 aa, Cryptosporidium hominis
GLEGLLTYKYTLRGQGQTITQF

SEQ ID NO: 2190265 - protein, 25 aa, Cryptosporidium hominis
GLERIDIPIILGKIEKPRNSLFVAD

SEQ ID NO: 2190266 - protein, 28 aa, Cryptosporidium hominis
GLEYQLRVRKLIQSILWKIIKFAHKSNI

SEQ ID NO: 2190267 - protein, 25 aa, Cryptosporidium hominis
GLFGPGSLVWIPCPKEVWRPGVVSR

SEQ ID NO: 2190268 - protein, 23 aa, Cryptosporidium hominis
GLGFVVAFFLLQLTPEDTVRLAL

SEQ ID NO: 2190269 - protein, 17 aa, Cryptosporidium hominis
GLGIDRLIMFLADKNNI

SEQ ID NO: 2190270 - protein, 18 aa, Cryptosporidium hominis
GLGKYTVYLVSGVTPDGH

SEQ ID NO: 2190271 - protein, 27 aa, Cryptosporidium hominis
GLGMGGIMDVGYNQKLFYYQGQYQQQS

SEQ ID NO: 2190272 - protein, 30 aa, Cryptosporidium hominis
GLGSIIIQPLIAKILRKLPRQAAWSFVSML

SEQ ID NO: 2190273 - protein, 34 aa, Cryptosporidium hominis
GLGVWSFFNIHSSWIPFLCQIRIPPSPLLKQELT

SEQ ID NO: 2190274 - protein, 26 aa, Cryptosporidium hominis
GLHFQKSPLHPVPAAPQLLQCQQLLQ

SEQ ID NO: 2190275 - protein, 17 aa, Cryptosporidium hominis
GLILPKPNQFVSTDFSI

SEQ ID NO: 2190276 - protein, 18 aa, Cryptosporidium hominis
GLINRYYSRKRPILCITV

SEQ ID NO: 2190277 - protein, 18 aa, Cryptosporidium hominis
GLISAARLLVHLYESNTL

SEQ ID NO: 2190278 - protein, 18 aa, Cryptosporidium hominis
GLISIILSHPYDIPFWLP

SEQ ID NO: 2190279 - protein, 23 aa, Cryptosporidium hominis
GLKKHRLVFCEKPESIPNMARQL

SEQ ID NO: 2190280 - protein, 18 aa, Cryptosporidium hominis
GLKMKRKYKKYIRKIIKE

SEQ ID NO: 2190281 - protein, 21 aa, Cryptosporidium hominis
GLKPDFLFGRCEVPIDDLCRE

SEQ ID NO: 2190282 - protein, 28 aa, Cryptosporidium hominis
GLKTSFFCSQVCFKENWAIHKLKHQLGG

SEQ ID NO: 2190283 - protein, 19 aa, Cryptosporidium hominis
GLLCDLLWSDPEKDVRGWG

SEQ ID NO: 2190284 - protein, 24 aa, Cryptosporidium hominis
GLLCDPREYYFNPMTMTGASGANR

SEQ ID NO: 2190285 - protein, 17 aa, Cryptosporidium hominis
GLLEWLASIVIYRQNRY

SEQ ID NO: 2190286 - protein, 33 aa, Cryptosporidium hominis
GLNDFLSKIPFPILLVYIGLNAGLFRGSEFGMD

SEQ ID NO: 2190287 - protein, 26 aa, Cryptosporidium hominis
GLNGISINFILPHQLSLIQQIQDYYD

SEQ ID NO: 2190288 - protein, 17 aa, Cryptosporidium hominis
GLNIMKNSKEQIGGIIP

SEQ ID NO: 2190289 - protein, 26 aa, Cryptosporidium hominis
GLNKTLPIRLSDEFLMSFISNEGHRV

SEQ ID NO: 2190290 - protein, 28 aa, Cryptosporidium hominis
GLNLLSNFRAFHKYNRFMKVALTVIAQQ

SEQ ID NO: 2190291 - protein, 31 aa, Cryptosporidium hominis
GLNLQVANYVFLLDPWWNPAAELQAFQRAHR

SEQ ID NO: 2190292 - protein, 18 aa, Cryptosporidium hominis
GLNPMDLLRGIKLGVEHV

SEQ ID NO: 2190293 - protein, 17 aa, Cryptosporidium hominis
GLPDYSLRNIKLGQISF

SEQ ID NO: 2190294 - protein, 23 aa, Cryptosporidium hominis
GLPSLKQLIVFKSLSDFLEGKAL

SEQ ID NO: 2190295 - protein, 27 aa, Cryptosporidium hominis
GLQDPRANLFWDPAVMTAASSVSPFYT

SEQ ID NO: 2190296 - protein, 17 aa, Cryptosporidium hominis
GLQFPVGRIQRMLKHRI

SEQ ID NO: 2190297 - protein, 20 aa, Cryptosporidium hominis
GLQGFLMFNAVGGGTGAGLG

SEQ ID NO: 2190298 - protein, 28 aa, Cryptosporidium hominis
GLQVKEISNLLLLFKKLQENVDASIQFK

SEQ ID NO: 2190299 - protein, 26 aa, Cryptosporidium hominis
GLRTVELFYLKYCLPKLGDILKKYNV

SEQ ID NO: 2190300 - protein, 24 aa, Cryptosporidium hominis
GLRVIIVCHGGVIKSFRALLESER

SEQ ID NO: 2190301 - protein, 23 aa, Cryptosporidium hominis
GLSHKLNYLISIMFEKLYHGTEV

SEQ ID NO: 2190302 - protein, 26 aa, Cryptosporidium hominis
GLSILYNIILKFKRLTESKLKVFVNA

SEQ ID NO: 2190303 - protein, 20 aa, Cryptosporidium hominis
GLSIRYIPSLKRMRFEYDCI

SEQ ID NO: 2190304 - protein, 27 aa, Cryptosporidium hominis
GLSVCKHIFCFVCIKQWSDVATQCPLC

SEQ ID NO: 2190305 - protein, 41 aa, Cryptosporidium hominis
GLTKGNYLKFGFNVPRTDLLPISISFFDSNDAKSLFVLNPD

SEQ ID NO: 2190306 - protein, 25 aa, Cryptosporidium hominis
GLTSSWRLWSLTEKKWNNLDLSLEC

SEQ ID NO: 2190307 - protein, 25 aa, Cryptosporidium hominis
GLVKNKLPHYGFTDILVAFETNLNW

SEQ ID NO: 2190308 - protein, 20 aa, Cryptosporidium hominis
GLYELLYASVSFTTATLYPR

SEQ ID NO: 2190309 - protein, 23 aa, Cryptosporidium hominis
GMAEYLAITLLRDKYKPDMSFDE

SEQ ID NO: 2190310 - protein, 18 aa, Cryptosporidium hominis
GMCGTSIQWGPWIEQGMA

SEQ ID NO: 2190311 - protein, 24 aa, Cryptosporidium hominis
GMECFKFIMNDSRFNDIPLILETP

SEQ ID NO: 2190312 - protein, 22 aa, Cryptosporidium hominis
GMFIYYEDTRLFWFNMASLESN

SEQ ID NO: 2190313 - protein, 19 aa, Cryptosporidium hominis
GMGFDYIWNTSICSSLQDI

SEQ ID NO: 2190314 - protein, 34 aa, Cryptosporidium hominis
GMGFIPRGNIVAPIQIEWPKTPPASPVEFEWLLH

SEQ ID NO: 2190315 - protein, 19 aa, Cryptosporidium hominis
GMGPISRKIPKGPFKILDA

SEQ ID NO: 2190316 - protein, 18 aa, Cryptosporidium hominis
GMIIGKEENIVFGRLSDM

SEQ ID NO: 2190317 - protein, 18 aa, Cryptosporidium hominis
GMIPRALNLIFDNIDRNC

SEQ ID NO: 2190318 - protein, 23 aa, Cryptosporidium hominis
GMKNCAMPILPTMNEGVIGEIPN

SEQ ID NO: 2190319 - protein, 30 aa, Cryptosporidium hominis
GMLPIIKEMTEILFTRGLIKVLFATETISM

SEQ ID NO: 2190320 - protein, 24 aa, Cryptosporidium hominis
GMNFLVGCILWHSNSEEQAFELLV

SEQ ID NO: 2190321 - protein, 21 aa, Cryptosporidium hominis
GMNGLKFSYYSKIKFVLVVEK

SEQ ID NO: 2190322 - protein, 22 aa, Cryptosporidium hominis
GMTACYCCAPPLVNFESNFSED

SEQ ID NO: 2190323 - protein, 19 aa, Cryptosporidium hominis
GMTKSKMMNSLLLGNGVNN

SEQ ID NO: 2190324 - protein, 24 aa, Cryptosporidium hominis
GMVNKLFVIKLKIIKILQSAQNRN

SEQ ID NO: 2190325 - protein, 19 aa, Cryptosporidium hominis
GMYLLDARQYLLDVIAKKR

SEQ ID NO: 2190326 - protein, 17 aa, Cryptosporidium hominis
GNAYTICSLQKGTIEHA

SEQ ID NO: 2190327 - protein, 24 aa, Cryptosporidium hominis
GNCKLFNELALIWCILKTFAISTK

SEQ ID NO: 2190328 - protein, 23 aa, Cryptosporidium hominis
GNDLRQILNELQLLSLSNINVRF

SEQ ID NO: 2190329 - protein, 26 aa, Cryptosporidium hominis
GNEEETSLKKNSVEVDVEEDDFDGLP

SEQ ID NO: 2190330 - protein, 30 aa, Cryptosporidium hominis
GNENEIFNWLLEYDVPLFIANDLINSELNM

SEQ ID NO: 2190331 - protein, 23 aa, Cryptosporidium hominis
GNFKNFFEIIPTNPKLDEKLHVK

SEQ ID NO: 2190332 - protein, 22 aa, Cryptosporidium hominis
GNFQPFTHFFGYQGRSAMPSQF

SEQ ID NO: 2190333 - protein, 33 aa, Cryptosporidium hominis
GNGESNFLSFVFKLPFYLKMDINLTPVTIVLNE

SEQ ID NO: 2190334 - protein, 18 aa, Cryptosporidium hominis
GNGFFRRCRSRSSKQTRK

SEQ ID NO: 2190335 - protein, 21 aa, Cryptosporidium hominis
GNGKVVRIEVWFGTPRHQSAI

SEQ ID NO: 2190336 - protein, 25 aa, Cryptosporidium hominis
GNGNRMVWITDESILNAAQKLAGDS

SEQ ID NO: 2190337 - protein, 25 aa, Cryptosporidium hominis
GNHEYNLILNNFYKDYELGILEEFN

SEQ ID NO: 2190338 - protein, 30 aa, Cryptosporidium hominis
GNHSSVWGSYYDPNVKKWGFKCCKNLKRSS

SEQ ID NO: 2190339 - protein, 30 aa, Cryptosporidium hominis
GNILIPINVPTRIWLLWSNEVVLQLFNEKE

SEQ ID NO: 2190340 - protein, 22 aa, Cryptosporidium hominis
GNIVPRLFLLITAGACYIRSLE

SEQ ID NO: 2190341 - protein, 24 aa, Cryptosporidium hominis
GNKDYHHNFNSIYYATTVNEDNFS

SEQ ID NO: 2190342 - protein, 25 aa, Cryptosporidium hominis
GNKIKRPEGVSKKLGSFIAERTDLF

SEQ ID NO: 2190343 - protein, 33 aa, Cryptosporidium hominis
GNKKIYESILKLYETYIISYQESLWFSKKQNSV

SEQ ID NO: 2190344 - protein, 21 aa, Cryptosporidium hominis
GNKLISTIHNLLYELESRGEH

SEQ ID NO: 2190345 - protein, 17 aa, Cryptosporidium hominis
GNKPFSGVSLYINSPTE

SEQ ID NO: 2190346 - protein, 28 aa, Cryptosporidium hominis
GNKSQQFLILFLFICTFREFSGLSFSEG

SEQ ID NO: 2190347 - protein, 28 aa, Cryptosporidium hominis
GNLFETYLKPYFLEAYRPVKKGDAFLVR

SEQ ID NO: 2190348 - protein, 37 aa, Cryptosporidium hominis
GNLFPEVKFILNTMLQDGIFLVNLYNGPQYYYQDRYG

SEQ ID NO: 2190349 - protein, 17 aa, Cryptosporidium hominis
GNLLNYLFNKYPCLEFQ

SEQ ID NO: 2190350 - protein, 38 aa, Cryptosporidium hominis
GNLPLEVVLSQFLYQRTLYPCFPVQHPINPKLLQKLAL

SEQ ID NO: 2190351 - protein, 30 aa, Cryptosporidium hominis
GNLPYSCTEEEIRGLFEECGSIERVSVLSD

SEQ ID NO: 2190352 - protein, 27 aa, Cryptosporidium hominis
GNLYIKSGWIPENMKLFLAIKSPFKGV

SEQ ID NO: 2190353 - protein, 24 aa, Cryptosporidium hominis
GNLYKYPAIIKTIPDFLESSIQMP

SEQ ID NO: 2190354 - protein, 30 aa, Cryptosporidium hominis
GNMGIRLCYSSLWRKLPQQIPVRELAMSRY

SEQ ID NO: 2190355 - protein, 17 aa, Cryptosporidium hominis
GNNMIKYYVLDKSRKKT

SEQ ID NO: 2190356 - protein, 23 aa, Cryptosporidium hominis
GNNQFGLNLKFKDKSHLKQNLLL

SEQ ID NO: 2190357 - protein, 27 aa, Cryptosporidium hominis
GNNTLVGPGLFLLLSRNILSTIQDQDE

SEQ ID NO: 2190358 - protein, 18 aa, Cryptosporidium hominis
GNNVGIPGMCRNNPMNVG

SEQ ID NO: 2190359 - protein, 17 aa, Cryptosporidium hominis
GNNYIHTFIQDYNYRKS

SEQ ID NO: 2190360 - protein, 22 aa, Cryptosporidium hominis
GNNYPFILGDEQIEKITYGQQN

SEQ ID NO: 2190361 - protein, 19 aa, Cryptosporidium hominis
GNPFIILREQEQKQRLKGI

SEQ ID NO: 2190362 - protein, 26 aa, Cryptosporidium hominis
GNPQYINKLILFIDSYTQELKRIAGI

SEQ ID NO: 2190363 - protein, 26 aa, Cryptosporidium hominis
GNRIIKPFQIRFILVLLQGNILEHGF

SEQ ID NO: 2190364 - protein, 25 aa, Cryptosporidium hominis
GNRRCILNRLQAWNGAPLSGAGHPD

SEQ ID NO: 2190365 - protein, 32 aa, Cryptosporidium hominis
GNRSSISLLLPICNAYYIGQLLALYEHRTAVE

SEQ ID NO: 2190366 - protein, 26 aa, Cryptosporidium hominis
GNSGLFRPEMLRPLGFPSDIVVIAWG

SEQ ID NO: 2190367 - protein, 26 aa, Cryptosporidium hominis
GNSKVQIISLFYLLGSDLIPVNQVKN

SEQ ID NO: 2190368 - protein, 22 aa, Cryptosporidium hominis
GNSLRALLYLLEGMTPEQILEV

SEQ ID NO: 2190369 - protein, 20 aa, Cryptosporidium hominis
GNSNLLNAVSIFDSKMGGEK

SEQ ID NO: 2190370 - protein, 26 aa, Cryptosporidium hominis
GNSNMLTGYPILYQNNHHNHPAGDLL

SEQ ID NO: 2190371 - protein, 42 aa, Cryptosporidium hominis
GNSTPIWVHKLEKLLLNAQILWKCQYLIKSLNTYNSCLLALA

SEQ ID NO: 2190372 - protein, 27 aa, Cryptosporidium hominis
GNTIKIKCYLIWSIKFEIIKKKKRLRE

SEQ ID NO: 2190373 - protein, 17 aa, Cryptosporidium hominis
GNTPKYGLLFQSTYIGK

SEQ ID NO: 2190374 - protein, 35 aa, Cryptosporidium hominis
GNTRKFLNGLLPLINNLIISLSNKLYILGQFTKLM

SEQ ID NO: 2190375 - protein, 19 aa, Cryptosporidium hominis
GNVFLWCLENERRQLPSRN

SEQ ID NO: 2190376 - protein, 18 aa, Cryptosporidium hominis
GNVNNICPCDRAIDSCAA

SEQ ID NO: 2190377 - protein, 32 aa, Cryptosporidium hominis
GNVSSVKPIMITSLWSCIYKSLRYNMNRYNAC

SEQ ID NO: 2190378 - protein, 22 aa, Cryptosporidium hominis
GNVSYIDAVLHKNDSNSGGVTT

SEQ ID NO: 2190379 - protein, 19 aa, Cryptosporidium hominis
GNWLFSLFCSINNKLIEFN

SEQ ID NO: 2190380 - protein, 24 aa, Cryptosporidium hominis
GPDSNLFDPVKQYEKLLKKTISLN

SEQ ID NO: 2190381 - protein, 25 aa, Cryptosporidium hominis
GPFSTRHMSSLWKSYTFTHETLFTM

SEQ ID NO: 2190382 - protein, 19 aa, Cryptosporidium hominis
GPGNRRKYYPGEEIPILSI

SEQ ID NO: 2190383 - protein, 40 aa, Cryptosporidium hominis
GPGVGFWEPSWRIWIFFLRGIIPILERWIGNLLSRQFTGR

SEQ ID NO: 2190384 - protein, 17 aa, Cryptosporidium hominis
GPHFKSFDSFLSERNFV

SEQ ID NO: 2190385 - protein, 25 aa, Cryptosporidium hominis
GPIFDEELLRWIAEAEYLGVSRETA

SEQ ID NO: 2190386 - protein, 19 aa, Cryptosporidium hominis
GPIPCIEFRFLSIPEMDYD

SEQ ID NO: 2190387 - protein, 23 aa, Cryptosporidium hominis
GPKAMLKMLLDPLGGIVLTNDGN

SEQ ID NO: 2190388 - protein, 25 aa, Cryptosporidium hominis
GPKDIMYEIIHRLYKRDKQQIFAEP

SEQ ID NO: 2190389 - protein, 23 aa, Cryptosporidium hominis
GPKLQEWLGLRDWKNNQSKKQNV

SEQ ID NO: 2190390 - protein, 37 aa, Cryptosporidium hominis
GPLEKKNSWSWGHKLRWVKIFKCEMHYFLSPKESNIK

SEQ ID NO: 2190391 - protein, 27 aa, Cryptosporidium hominis
GPSLDCEGIIIYGYYEDGDLAPRFIYF

SEQ ID NO: 2190392 - protein, 18 aa, Cryptosporidium hominis
GPTHPYGYVIQPPNMINP

SEQ ID NO: 2190393 - protein, 29 aa, Cryptosporidium hominis
GPTRSQLQQLFFFSAPSLLPYVDEIVESF

SEQ ID NO: 2190394 - protein, 19 aa, Cryptosporidium hominis
GPTTGSIFGSSPFGGSISG

SEQ ID NO: 2190395 - protein, 23 aa, Cryptosporidium hominis
GPYNSIVMMSWIVKGYFGENSKL

SEQ ID NO: 2190396 - protein, 22 aa, Cryptosporidium hominis
GQAKVVLKVSFKELLESERRAK

SEQ ID NO: 2190397 - protein, 22 aa, Cryptosporidium hominis
GQFFDLLELFRIGGMPPDVNYL

SEQ ID NO: 2190398 - protein, 18 aa, Cryptosporidium hominis
GQFMIKINHRQLLDGILE

SEQ ID NO: 2190399 - protein, 17 aa, Cryptosporidium hominis
GQIAPPIHHATAPGPQS

SEQ ID NO: 2190400 - protein, 19 aa, Cryptosporidium hominis
GQIIISFTQLLPVPKAHFV

SEQ ID NO: 2190401 - protein, 25 aa, Cryptosporidium hominis
GQKALNLVKLRRLFTSKSIELPFFV

SEQ ID NO: 2190402 - protein, 27 aa, Cryptosporidium hominis
GQKDSRIWGLWAVLDFLNNSRKQSETF

SEQ ID NO: 2190403 - protein, 25 aa, Cryptosporidium hominis
GQKKDTLSFSYSPKTLVNPTNQDKS

SEQ ID NO: 2190404 - protein, 25 aa, Cryptosporidium hominis
GQKKNCYIYRLFSTGTIEEKIYQRQ

SEQ ID NO: 2190405 - protein, 19 aa, Cryptosporidium hominis
GQKSIIFEFGKKLGMNSLS

SEQ ID NO: 2190406 - protein, 26 aa, Cryptosporidium hominis
GQKVLDIWFPYIVQSLLQAFKRENSD

SEQ ID NO: 2190407 - protein, 31 aa, Cryptosporidium hominis
GQLDNFEEKLSWLPNIEILDMPEKVDLTLPC

SEQ ID NO: 2190408 - protein, 27 aa, Cryptosporidium hominis
GQLLNCWLPHYKPINKIKLIQGNSILV

SEQ ID NO: 2190409 - protein, 18 aa, Cryptosporidium hominis
GQLLVKYQHGIDKEIAKW

SEQ ID NO: 2190410 - protein, 23 aa, Cryptosporidium hominis
GQMMRFDMRESFPLLTTKKVAIR

SEQ ID NO: 2190411 - protein, 17 aa, Cryptosporidium hominis
GQNIESQEFRFGEGTFT

SEQ ID NO: 2190412 - protein, 23 aa, Cryptosporidium hominis
GQNVMFSNYMWVSKRKILGCVVK

SEQ ID NO: 2190413 - protein, 21 aa, Cryptosporidium hominis
GQQIVEVFSPVIDDLKIKYEH

SEQ ID NO: 2190414 - protein, 24 aa, Cryptosporidium hominis
GQRCDHIFLPPTHLSKKLAQYEPY

SEQ ID NO: 2190415 - protein, 25 aa, Cryptosporidium hominis
GQRQSPLNLFPFNFGVGNSTNNRND

SEQ ID NO: 2190416 - protein, 18 aa, Cryptosporidium hominis
GQSPQAFFYLDKTIFNEK

SEQ ID NO: 2190417 - protein, 23 aa, Cryptosporidium hominis
GQSTDRFLVALIFPNEQALRKWS

SEQ ID NO: 2190418 - protein, 23 aa, Cryptosporidium hominis
GQTKLGRFKFSKNKKKSKKHNIE

SEQ ID NO: 2190419 - protein, 25 aa, Cryptosporidium hominis
GQVSALHELLRPHLLRRVKEDVMKE

SEQ ID NO: 2190420 - protein, 17 aa, Cryptosporidium hominis
GQYQNIVRMHSLDIERL

SEQ ID NO: 2190421 - protein, 18 aa, Cryptosporidium hominis
GRAALVVFPFVSLVSEKR

SEQ ID NO: 2190422 - protein, 29 aa, Cryptosporidium hominis
GRCGNEVWLTLPLFFPSATLHNVTHQRRD

SEQ ID NO: 2190423 - protein, 26 aa, Cryptosporidium hominis
GRCNCGYPIFIINGEVVAGSSGFGCN

SEQ ID NO: 2190424 - protein, 19 aa, Cryptosporidium hominis
GRDFVGGGGISRGGGNRDG

SEQ ID NO: 2190425 - protein, 24 aa, Cryptosporidium hominis
GREIGSCICCHLIYEDEMNVYRAD

SEQ ID NO: 2190426 - protein, 30 aa, Cryptosporidium hominis
GRFTSVISKILLLRGLSLRSLLNYNTREFL

SEQ ID NO: 2190427 - protein, 19 aa, Cryptosporidium hominis
GRGFVTLCRRLCGAIFETA

SEQ ID NO: 2190428 - protein, 20 aa, Cryptosporidium hominis
GRHRFKHPPTKSPPGYWDLD

SEQ ID NO: 2190429 - protein, 18 aa, Cryptosporidium hominis
GRIAWMDHIPVSIGWTLE

SEQ ID NO: 2190430 - protein, 24 aa, Cryptosporidium hominis
GRIFDLRIIRFIKINDIHALTGSI

SEQ ID NO: 2190431 - protein, 17 aa, Cryptosporidium hominis
GRISCIILEKLSVTLIQ

SEQ ID NO: 2190432 - protein, 34 aa, Cryptosporidium hominis
GRIYTSLRCPLFYMALMKLLFDEYPMITETDEEL

SEQ ID NO: 2190433 - protein, 26 aa, Cryptosporidium hominis
GRKSFILRINFLLPTGISLEQLPSTL

SEQ ID NO: 2190434 - protein, 22 aa, Cryptosporidium hominis
GRLFTQLQWISKHYSTPVILIE

SEQ ID NO: 2190435 - protein, 21 aa, Cryptosporidium hominis
GRLRAPLLRNRVVKAAEAANP

SEQ ID NO: 2190436 - protein, 21 aa, Cryptosporidium hominis
GRLYSEVYCLPDGTFAVLKDA

SEQ ID NO: 2190437 - protein, 17 aa, Cryptosporidium hominis
GRNYYIDFVIDDVIFRC

SEQ ID NO: 2190438 - protein, 17 aa, Cryptosporidium hominis
GRPIPNLRHQEMPCIPR

SEQ ID NO: 2190439 - protein, 29 aa, Cryptosporidium hominis
GRPSHALLICKRICHFDSRLSKLYRSMYI

SEQ ID NO: 2190440 - protein, 30 aa, Cryptosporidium hominis
GRRECSSIPGFFQNKLGWFNCVENFFSVCN

SEQ ID NO: 2190441 - protein, 20 aa, Cryptosporidium hominis
GRSALMKLLDDMRVPVEKGD

SEQ ID NO: 2190442 - protein, 25 aa, Cryptosporidium hominis
GRSEGAWLYRWEYIPESIDNLFMEN

SEQ ID NO: 2190443 - protein, 23 aa, Cryptosporidium hominis
GRSRGFGFVTFKDPKTVEIVQNI

SEQ ID NO: 2190444 - protein, 30 aa, Cryptosporidium hominis
GRSTSILLCDWLFTILDYLDKKKSNSFYEK

SEQ ID NO: 2190445 - protein, 37 aa, Cryptosporidium hominis
GRSYDFQVSYLIFIHGWKLAFLTVSPMSKLFEIPSNE

SEQ ID NO: 2190446 - protein, 22 aa, Cryptosporidium hominis
GRTCNCMINENILIYYNEKGMQ

SEQ ID NO: 2190447 - protein, 25 aa, Cryptosporidium hominis
GRTGYAITFFTLKDIPKIKSIAKVI

SEQ ID NO: 2190448 - protein, 22 aa, Cryptosporidium hominis
GRTRQWLESLSTLFDGVYTQRS

SEQ ID NO: 2190449 - protein, 25 aa, Cryptosporidium hominis
GRVLLRTEFIVPVAPLDYVEYSTDS

SEQ ID NO: 2190450 - protein, 24 aa, Cryptosporidium hominis
GRYSSPIFFPIYNSLLDTKCDNFA

SEQ ID NO: 2190451 - protein, 33 aa, Cryptosporidium hominis
GSAGLLFCVLGDGFAYLLSIPLLNNMILNRFNI

SEQ ID NO: 2190452 - protein, 17 aa, Cryptosporidium hominis
GSATFPFFGIEPAILDP

SEQ ID NO: 2190453 - protein, 26 aa, Cryptosporidium hominis
GSCLKRNWRIEFWSNFMANCINFCPI

SEQ ID NO: 2190454 - protein, 26 aa, Cryptosporidium hominis
GSDCLCWRCYFNQRPFFEEMDYSRIP

SEQ ID NO: 2190455 - protein, 24 aa, Cryptosporidium hominis
GSDLLLLDVTPLTLGIETVGGVMT

SEQ ID NO: 2190456 - protein, 18 aa, Cryptosporidium hominis
GSDPFRYYLAREGRFGND

SEQ ID NO: 2190457 - protein, 32 aa, Cryptosporidium hominis
GSDVNIQILYNRSLVQLGLSAFRLGQISEAQQ

SEQ ID NO: 2190458 - protein, 23 aa, Cryptosporidium hominis
GSEKLIFLLSTRAGGIGINLATA

SEQ ID NO: 2190459 - protein, 19 aa, Cryptosporidium hominis
GSEVPALLAIACELFVRDL

SEQ ID NO: 2190460 - protein, 26 aa, Cryptosporidium hominis
GSFENLSRPYAPLRDITGSIFGGLVR

SEQ ID NO: 2190461 - protein, 22 aa, Cryptosporidium hominis
GSFNRRLIIILNKIYNETLNKI

SEQ ID NO: 2190462 - protein, 23 aa, Cryptosporidium hominis
GSFSTFIVFKYIEASVHLGQIQE

SEQ ID NO: 2190463 - protein, 30 aa, Cryptosporidium hominis
GSFSVEVILVLFTLKIMYPYHVHLARGNHE

SEQ ID NO: 2190464 - protein, 25 aa, Cryptosporidium hominis
GSGDTFFFRQLQCELCKSPLPSSAS

SEQ ID NO: 2190465 - protein, 32 aa, Cryptosporidium hominis
GSGEGRMCWLYLKNDWKEIKEFAWIQICDKYN

SEQ ID NO: 2190466 - protein, 23 aa, Cryptosporidium hominis
GSGKILINPFQITYSKLNNICSN

SEQ ID NO: 2190467 - protein, 29 aa, Cryptosporidium hominis
GSGKTAAFLFPIVMKMLNDGPPPTPQQSS

SEQ ID NO: 2190468 - protein, 30 aa, Cryptosporidium hominis
GSGKTAAFLLPALERLLRSPYVRNSRVSSL

SEQ ID NO: 2190469 - protein, 26 aa, Cryptosporidium hominis
GSGKTLAYILPLIRHVLVQSNNNYPF

SEQ ID NO: 2190470 - protein, 24 aa, Cryptosporidium hominis
GSGKTLCYILPILGRLKNDKVYCA

SEQ ID NO: 2190471 - protein, 18 aa, Cryptosporidium hominis
GSGRYKFGGGYAEEDRRR

SEQ ID NO: 2190472 - protein, 32 aa, Cryptosporidium hominis
GSGSKKGCIVILANLFRLIIHHNPSDLIDAVY

SEQ ID NO: 2190473 - protein, 26 aa, Cryptosporidium hominis
GSHECPICRSLLKEELWLSKSDQLVD

SEQ ID NO: 2190474 - protein, 41 aa, Cryptosporidium hominis
GSINMPELSLPYKLWIDAKSRDWILEWQTKNGRWSVRKFSC

SEQ ID NO: 2190475 - protein, 23 aa, Cryptosporidium hominis
GSISNLYYYLLKKVWNFKENSNN

SEQ ID NO: 2190476 - protein, 23 aa, Cryptosporidium hominis
GSITLLELSSLKIKSKFLEQSSP

SEQ ID NO: 2190477 - protein, 25 aa, Cryptosporidium hominis
GSKEGLFFYILLENNAKKSSECMGR

SEQ ID NO: 2190478 - protein, 28 aa, Cryptosporidium hominis
GSKKELFKFMLKNIGPRPIWTNSGAIGD

SEQ ID NO: 2190479 - protein, 17 aa, Cryptosporidium hominis
GSKKILSVLLRKLDGFD

SEQ ID NO: 2190480 - protein, 22 aa, Cryptosporidium hominis
GSKLFLKGFDHLILVTAYETDN

SEQ ID NO: 2190481 - protein, 24 aa, Cryptosporidium hominis
GSKSKANWWPFHGSTAGLVCGGAA

SEQ ID NO: 2190482 - protein, 19 aa, Cryptosporidium hominis
GSLAMRRSGSLTPTVIKCF

SEQ ID NO: 2190483 - protein, 25 aa, Cryptosporidium hominis
GSLKLYSKILKLLPGTFKIALCVGL

SEQ ID NO: 2190484 - protein, 20 aa, Cryptosporidium hominis
GSLTFFENSLNSGGCIFPNG

SEQ ID NO: 2190485 - protein, 24 aa, Cryptosporidium hominis
GSMERVCLFLNLANDPTIERILTP

SEQ ID NO: 2190486 - protein, 23 aa, Cryptosporidium hominis
GSMPMPMPMPMPTPMPMPMPTNS

SEQ ID NO: 2190487 - protein, 27 aa, Cryptosporidium hominis
GSMSQLFILCKFDFDLFSKIIASIKII

SEQ ID NO: 2190488 - protein, 21 aa, Cryptosporidium hominis
GSNFIGINSIKMGGGSNLGGD

SEQ ID NO: 2190489 - protein, 23 aa, Cryptosporidium hominis
GSNLQLFFFDSNVSPGSCFWLPA

SEQ ID NO: 2190490 - protein, 27 aa, Cryptosporidium hominis
GSNSDFGLILLQNGMLWNWDRRQAQTE

SEQ ID NO: 2190491 - protein, 24 aa, Cryptosporidium hominis
GSNTRQLLQRILFTWTRENPELGY

SEQ ID NO: 2190492 - protein, 22 aa, Cryptosporidium hominis
GSPYSFVSQFPYLKVSKFDENS

SEQ ID NO: 2190493 - protein, 21 aa, Cryptosporidium hominis
GSQFFITTVPCPWLDGKHVVF

SEQ ID NO: 2190494 - protein, 42 aa, Cryptosporidium hominis
GSQGGLVNPFLMMQRMSAANPMLLAFNPQLAAAAAAATAATS

SEQ ID NO: 2190495 - protein, 26 aa, Cryptosporidium hominis
GSRIKYRNDLFNLLCDAIGLSQDERS

SEQ ID NO: 2190496 - protein, 23 aa, Cryptosporidium hominis
GSRNIVLQLRKGGIQSLQISDDG

SEQ ID NO: 2190497 - protein, 25 aa, Cryptosporidium hominis
GSRNIYVIDFGLAKRFRDPKTLQHI

SEQ ID NO: 2190498 - protein, 25 aa, Cryptosporidium hominis
GSRQSIFKMLYLKINKNLIEKEKMR

SEQ ID NO: 2190499 - protein, 30 aa, Cryptosporidium hominis
GSSGKRAPPPKAPPPLKPPPKRGATSQGFG

SEQ ID NO: 2190500 - protein, 28 aa, Cryptosporidium hominis
GSSIKFFMKRYWLDIKLFGKMLYENKRE

SEQ ID NO: 2190501 - protein, 17 aa, Cryptosporidium hominis
GSSLLGEELNWKSFSDG

SEQ ID NO: 2190502 - protein, 24 aa, Cryptosporidium hominis
GSTDDVLIPRLLEGPLEDIQITKV

SEQ ID NO: 2190503 - protein, 22 aa, Cryptosporidium hominis
GSTIHFLIQPYSGLQQKVEERI

SEQ ID NO: 2190504 - protein, 17 aa, Cryptosporidium hominis
GSTIVLIFQAPENFKFD

SEQ ID NO: 2190505 - protein, 17 aa, Cryptosporidium hominis
GSTLTPWRNGKRSLSTN

SEQ ID NO: 2190506 - protein, 22 aa, Cryptosporidium hominis
GSTTCLLCFLDGNQLWVSNVGD

SEQ ID NO: 2190507 - protein, 23 aa, Cryptosporidium hominis
GSVKFNYLSIPWEDLEDSRGISS

SEQ ID NO: 2190508 - protein, 24 aa, Cryptosporidium hominis
GSVPLMLQRIVLATQLQSLNALKK

SEQ ID NO: 2190509 - protein, 29 aa, Cryptosporidium hominis
GSYAYGLKQGFGKFSWHDGSKYIGNFDAN

SEQ ID NO: 2190510 - protein, 24 aa, Cryptosporidium hominis
GTANTPSLGLGLSSGIPAQTLGAT

SEQ ID NO: 2190511 - protein, 17 aa, Cryptosporidium hominis
GTAVFNFRRNEVRSFLL

SEQ ID NO: 2190512 - protein, 22 aa, Cryptosporidium hominis
GTCLQDRLAWFLNGKLNVCDNC

SEQ ID NO: 2190513 - protein, 23 aa, Cryptosporidium hominis
GTCNYICLFPDIISGPSVEWRNN

SEQ ID NO: 2190514 - protein, 24 aa, Cryptosporidium hominis
GTDSGLHFLWSPTGNYLAHCSDKG

SEQ ID NO: 2190515 - protein, 21 aa, Cryptosporidium hominis
GTELFHVPKFALAARSKYFQN

SEQ ID NO: 2190516 - protein, 26 aa, Cryptosporidium hominis
GTEMGIGIPPILSTLNAPLSNLPPNV

SEQ ID NO: 2190517 - protein, 33 aa, Cryptosporidium hominis
GTGALTPQLGAPGGTPYLLRSKSRETLSSAEAN

SEQ ID NO: 2190518 - protein, 34 aa, Cryptosporidium hominis
GTGKALLFLLPEEIAFLQYLRKMNIPLNEYVFGK

SEQ ID NO: 2190519 - protein, 24 aa, Cryptosporidium hominis
GTGKTAAFVIPLLEKINTKKNIIQ

SEQ ID NO: 2190520 - protein, 29 aa, Cryptosporidium hominis
GTGKTLAFVLPVIERLLKKGKFDPNKHGR

SEQ ID NO: 2190521 - protein, 17 aa, Cryptosporidium hominis
GTHKFYYDRSFINLVLS

SEQ ID NO: 2190522 - protein, 23 aa, Cryptosporidium hominis
GTIDFPEFLSLMARKMKDTDTED

SEQ ID NO: 2190523 - protein, 21 aa, Cryptosporidium hominis
GTIEHANLDLFLSTSAEIELS

SEQ ID NO: 2190524 - protein, 22 aa, Cryptosporidium hominis
GTIPIYIWDDVNWIPYGNLMER

SEQ ID NO: 2190525 - protein, 18 aa, Cryptosporidium hominis
GTIVYLRKAFPNLEHLCL

SEQ ID NO: 2190526 - protein, 31 aa, Cryptosporidium hominis
GTIYKLNIPKIKSLIKYKVLYEYIGHRVGQL

SEQ ID NO: 2190527 - protein, 31 aa, Cryptosporidium hominis
GTKCPMCVRQRILRAFLLEEQKVVKSVIAEK

SEQ ID NO: 2190528 - protein, 17 aa, Cryptosporidium hominis
GTLIKLVYTLSLENDEL

SEQ ID NO: 2190529 - protein, 24 aa, Cryptosporidium hominis
GTLKELFEEQPLWLRPVIESKISP

SEQ ID NO: 2190530 - protein, 26 aa, Cryptosporidium hominis
GTLPNLSIRNKILKLISNIPLGEEDV

SEQ ID NO: 2190531 - protein, 29 aa, Cryptosporidium hominis
GTLSPLDLYPKLLGFIPVVSQSLTMTLDR

SEQ ID NO: 2190532 - protein, 17 aa, Cryptosporidium hominis
GTLSRFPSEKKCCIRPL

SEQ ID NO: 2190533 - protein, 24 aa, Cryptosporidium hominis
GTPNGPFLYPLSVRGRKPFSLLTD

SEQ ID NO: 2190534 - protein, 42 aa, Cryptosporidium hominis
GTPRTLLCTLKTTPRPYLVWLLHDFNFLLYDTANNMILNSID

SEQ ID NO: 2190535 - protein, 26 aa, Cryptosporidium hominis
GTQNELIVIVYPKANLHELGIKCFIT

SEQ ID NO: 2190536 - protein, 17 aa, Cryptosporidium hominis
GTRIFLFFNNNTITFDE

SEQ ID NO: 2190537 - protein, 25 aa, Cryptosporidium hominis
GTSYFNIPLLHLWCADHIRFRKGNQ

SEQ ID NO: 2190538 - protein, 24 aa, Cryptosporidium hominis
GTTQTSQWRFLNLGELYSSNKDEH

SEQ ID NO: 2190539 - protein, 19 aa, Cryptosporidium hominis
GTVIFIGRGTLSNSRKEFQ

SEQ ID NO: 2190540 - protein, 24 aa, Cryptosporidium hominis
GTYKIAYLPFNKKGLIMLDGLAKA

SEQ ID NO: 2190541 - protein, 17 aa, Cryptosporidium hominis
GVANMFLISSQKTTKLF

SEQ ID NO: 2190542 - protein, 20 aa, Cryptosporidium hominis
GVCASKLACACLMLAHKIEG

SEQ ID NO: 2190543 - protein, 18 aa, Cryptosporidium hominis
GVCYLLLEKNNCPKFTLE

SEQ ID NO: 2190544 - protein, 27 aa, Cryptosporidium hominis
GVDKNKPLLRIVSRGKLYTLADFVNTH

SEQ ID NO: 2190545 - protein, 34 aa, Cryptosporidium hominis
GVDVVIFSSKLFPIDLIPLLSGATTISFYGLTLT

SEQ ID NO: 2190546 - protein, 24 aa, Cryptosporidium hominis
GVENSDFFLKRPPKVSITNSGGID

SEQ ID NO: 2190547 - protein, 19 aa, Cryptosporidium hominis
GVFKSINLKENLHFNNCVS

SEQ ID NO: 2190548 - protein, 31 aa, Cryptosporidium hominis
GVHGAPMQFGVPPQMYFIPGNPNVAATAMPH

SEQ ID NO: 2190549 - protein, 28 aa, Cryptosporidium hominis
GVHISFIRSITMDSWTPKQMKAMELGGN

SEQ ID NO: 2190550 - protein, 24 aa, Cryptosporidium hominis
GVISTIHLSPFDGQLFITSGWDGN

SEQ ID NO: 2190551 - protein, 24 aa, Cryptosporidium hominis
GVKKNLFFIGATNRPEILDEALLR

SEQ ID NO: 2190552 - protein, 25 aa, Cryptosporidium hominis
GVKREEMVPILRPPSKKLTQDVFKE

SEQ ID NO: 2190553 - protein, 30 aa, Cryptosporidium hominis
GVLDVLSQWLSPFKDGTLPNLSIRNKILKL

SEQ ID NO: 2190554 - protein, 17 aa, Cryptosporidium hominis
GVMAHILLCGVPPFAGN

SEQ ID NO: 2190555 - protein, 24 aa, Cryptosporidium hominis
GVMGFFSRPLPRLPVRGVRVRGVP

SEQ ID NO: 2190556 - protein, 20 aa, Cryptosporidium hominis
GVMVVELIIIAKCCGLTGEL

SEQ ID NO: 2190557 - protein, 25 aa, Cryptosporidium hominis
GVNGLFFVSYFLFGDDRLILSETIH

SEQ ID NO: 2190558 - protein, 35 aa, Cryptosporidium hominis
GVNIGLFLHIPFPSFEIFRCLPVREELLRSILMAD

SEQ ID NO: 2190559 - protein, 19 aa, Cryptosporidium hominis
GVNLLLRQLGPLSGGSFQE

SEQ ID NO: 2190560 - protein, 22 aa, Cryptosporidium hominis
GVPRRRLYDITNVLEAVGLFTK

SEQ ID NO: 2190561 - protein, 23 aa, Cryptosporidium hominis
GVSFNFKSFCFMKFVTSIVGDSS

SEQ ID NO: 2190562 - protein, 27 aa, Cryptosporidium hominis
GVSGLLKLILVLKNRIAPKILHFQKLN

SEQ ID NO: 2190563 - protein, 25 aa, Cryptosporidium hominis
GVSKKYLEGFARTFDPMRSLFRENR

SEQ ID NO: 2190564 - protein, 46 aa, Cryptosporidium hominis
GVSRHYPVSPIFKNGYQLFDYQLAGLNWLLQLWSEGRNGILADEMG

SEQ ID NO: 2190565 - protein, 22 aa, Cryptosporidium hominis
GVTILDVFSRVMKSFHLSILEK

SEQ ID NO: 2190566 - protein, 17 aa, Cryptosporidium hominis
GVTYRIINQIKPKPYLK

SEQ ID NO: 2190567 - protein, 35 aa, Cryptosporidium hominis
GVVCDDVFDILIPSNLILFIQELSPMFFADYSLTE

SEQ ID NO: 2190568 - protein, 17 aa, Cryptosporidium hominis
GVVYQLVGGLRSCMGYL

SEQ ID NO: 2190569 - protein, 17 aa, Cryptosporidium hominis
GVYIKHRSFLKAEFIPI

SEQ ID NO: 2190570 - protein, 24 aa, Cryptosporidium hominis
GWFSNDLFNIKGLVFNKYGKPIYK

SEQ ID NO: 2190571 - protein, 27 aa, Cryptosporidium hominis
GWISSSQFKFVDLWKRIFISERCIIVK

SEQ ID NO: 2190572 - protein, 20 aa, Cryptosporidium hominis
GWVRDKILRFIYLNSAKNKD

SEQ ID NO: 2190573 - protein, 20 aa, Cryptosporidium hominis
GYDFNGVILEIQFANTHSRT

SEQ ID NO: 2190574 - protein, 25 aa, Cryptosporidium hominis
GYERIVYIVANLIENYWLKSSNGFE

SEQ ID NO: 2190575 - protein, 27 aa, Cryptosporidium hominis
GYFPEKSFFEDLFQYGLVSFPDMEVME

SEQ ID NO: 2190576 - protein, 18 aa, Cryptosporidium hominis
GYGFVQYEFVEHAVSALS

SEQ ID NO: 2190577 - protein, 17 aa, Cryptosporidium hominis
GYGIRYTYGIFEQKIVQ

SEQ ID NO: 2190578 - protein, 18 aa, Cryptosporidium hominis
GYHPAPITNYPYSFGPIK

SEQ ID NO: 2190579 - protein, 23 aa, Cryptosporidium hominis
GYHRKDFISYVGKLSPWTKIALI

SEQ ID NO: 2190580 - protein, 26 aa, Cryptosporidium hominis
GYHSIECICLIMALKIRYKDKVTILR

SEQ ID NO: 2190581 - protein, 25 aa, Cryptosporidium hominis
GYIRELPIIGFYKGIMLRGIIDSLQ

SEQ ID NO: 2190582 - protein, 22 aa, Cryptosporidium hominis
GYISREHCIFYYSSIRNREYEG

SEQ ID NO: 2190583 - protein, 26 aa, Cryptosporidium hominis
GYKLDEEALLLLPPEHFRKAPPRCVS

SEQ ID NO: 2190584 - protein, 24 aa, Cryptosporidium hominis
GYNIKSLFKKLASTLPNLDYIQEG

SEQ ID NO: 2190585 - protein, 18 aa, Cryptosporidium hominis
GYPFVLLNGYLHSTLTNY

SEQ ID NO: 2190586 - protein, 18 aa, Cryptosporidium hominis
GYQVGMPGRPLLFQGAEI

SEQ ID NO: 2190587 - protein, 20 aa, Cryptosporidium hominis
GYRGSPMILTQFIENIDLNN

SEQ ID NO: 2190588 - protein, 27 aa, Cryptosporidium hominis
GYRKKKLLNIRMLYPFTIRCNGCEVYH

SEQ ID NO: 2190589 - protein, 18 aa, Cryptosporidium hominis
GYSDLITRLTCEAITSIM

SEQ ID NO: 2190590 - protein, 22 aa, Cryptosporidium hominis
GYSIFGISRPFTSNLLKVTMED

SEQ ID NO: 2190591 - protein, 26 aa, Cryptosporidium hominis
GYSSNFIWDLVRSIPIESLNRLYVSW

SEQ ID NO: 2190592 - protein, 31 aa, Cryptosporidium hominis
GYVISGIERLLFFQVLQLFHQIDLNNKDNFL

SEQ ID NO: 2190593 - protein, 21 aa, Cryptosporidium hominis
GYWNNVYGFNYQYVKPCIMEE

SEQ ID NO: 2190594 - protein, 22 aa, Cryptosporidium hominis
GYYWMGYNFMKDNDPVFTLLFN

SEQ ID NO: 2190595 - protein, 18 aa, Cryptosporidium hominis
HACIQINYIPPASNITQC

SEQ ID NO: 2190596 - protein, 27 aa, Cryptosporidium hominis
HAESCLENIYISVDKLEKFSELCKVEN

SEQ ID NO: 2190597 - protein, 22 aa, Cryptosporidium hominis
HAGSKFMPLDLRKKLTRAKRRA

SEQ ID NO: 2190598 - protein, 25 aa, Cryptosporidium hominis
HAHFQPFVEPILPICGPYLTEEQQI

SEQ ID NO: 2190599 - protein, 24 aa, Cryptosporidium hominis
HAHGRIAYKHGYPPSLGSGPGSGT

SEQ ID NO: 2190600 - protein, 34 aa, Cryptosporidium hominis
HAIRLRLHLWGRFYDEYFEAFPLAISETLEINQL

SEQ ID NO: 2190601 - protein, 24 aa, Cryptosporidium hominis
HAKEDILLQMLKHVRSKSAASFIG

SEQ ID NO: 2190602 - protein, 23 aa, Cryptosporidium hominis
HAKFTWRDISFALNKVKPRIPHS

SEQ ID NO: 2190603 - protein, 32 aa, Cryptosporidium hominis
HAKWSPVCTASYRLLPEFGFPNGPISGSDALK

SEQ ID NO: 2190604 - protein, 23 aa, Cryptosporidium hominis
HAPPPFMDPWNMQGHPYPAYAPD

SEQ ID NO: 2190605 - protein, 35 aa, Cryptosporidium hominis
HAQYACNNSIRNFYRSLFIPKAIGLDWKIISSMQK

SEQ ID NO: 2190606 - protein, 26 aa, Cryptosporidium hominis
HARDNVNIPPPPYNAIGLNFPCNEGL

SEQ ID NO: 2190607 - protein, 26 aa, Cryptosporidium hominis
HASKTFIDPYTLLPEQPWDVMKEDGD

SEQ ID NO: 2190608 - protein, 17 aa, Cryptosporidium hominis
HAYIHQTSNTMIGGLER

SEQ ID NO: 2190609 - protein, 19 aa, Cryptosporidium hominis
HCFYIHPSEACKSWPLCPY

SEQ ID NO: 2190610 - protein, 18 aa, Cryptosporidium hominis
HCLANYSFKYRRGGIVVA

SEQ ID NO: 2190611 - protein, 36 aa, Cryptosporidium hominis
HCLDEIINEAFPPVFPLFTLPPLPPKRNGPGWNSHS

SEQ ID NO: 2190612 - protein, 19 aa, Cryptosporidium hominis
HCLNSILQGPYFDEAFLSK

SEQ ID NO: 2190613 - protein, 17 aa, Cryptosporidium hominis
HCMDIAKVLRVLYEDPN

SEQ ID NO: 2190614 - protein, 18 aa, Cryptosporidium hominis
HCMGEALLAKYMGKKKLI

SEQ ID NO: 2190615 - protein, 17 aa, Cryptosporidium hominis
HCNSAFQWATKEGILCE

SEQ ID NO: 2190616 - protein, 25 aa, Cryptosporidium hominis
HCNSTDLIFLYLEKLIENLENILGD

SEQ ID NO: 2190617 - protein, 20 aa, Cryptosporidium hominis
HCNYYPIYGSSTPPSHLGPN

SEQ ID NO: 2190618 - protein, 35 aa, Cryptosporidium hominis
HCPFCQIELDWNRVKPFIVLFKPKSEANIEEDTNK

SEQ ID NO: 2190619 - protein, 26 aa, Cryptosporidium hominis
HCTEFPGNFIFFLAAAVSDFYIPENL

SEQ ID NO: 2190620 - protein, 28 aa, Cryptosporidium hominis
HDACDGKLYRLVRSSFPFNLSSGPPNWG

SEQ ID NO: 2190621 - protein, 18 aa, Cryptosporidium hominis
HDAPISNIFWCDEQKFVV

SEQ ID NO: 2190622 - protein, 22 aa, Cryptosporidium hominis
HDFFTQYWQVIGILAKQESRQI

SEQ ID NO: 2190623 - protein, 31 aa, Cryptosporidium hominis
HDHVISFSFLDGKIWFRHYQIAPTTERDHNN

SEQ ID NO: 2190624 - protein, 17 aa, Cryptosporidium hominis
HDKYVIPILMVIQECFT

SEQ ID NO: 2190625 - protein, 28 aa, Cryptosporidium hominis
HDLKEAQSLLRFPPEWRSLNNEEVLGHS

SEQ ID NO: 2190626 - protein, 18 aa, Cryptosporidium hominis
HDLLLGLENPLKKIIIDI

SEQ ID NO: 2190627 - protein, 24 aa, Cryptosporidium hominis
HDLNQGMGFADLFYNFLNSEVEES

SEQ ID NO: 2190628 - protein, 23 aa, Cryptosporidium hominis
HDNIIIEYIIILFRSNRHDQALN

SEQ ID NO: 2190629 - protein, 21 aa, Cryptosporidium hominis
HDPRYMYTGYASGYSSNIYAT

SEQ ID NO: 2190630 - protein, 24 aa, Cryptosporidium hominis
HDQNIPICSAFGSPFDSSLIISSS

SEQ ID NO: 2190631 - protein, 33 aa, Cryptosporidium hominis
HDSDPLMSRYRCYTEWKLLYRCNRHPNILNLIG

SEQ ID NO: 2190632 - protein, 24 aa, Cryptosporidium hominis
HDSLIKFISMTIILLTKKLEGAIP

SEQ ID NO: 2190633 - protein, 20 aa, Cryptosporidium hominis
HDVIAYVPSKIPKLSIRIPD

SEQ ID NO: 2190634 - protein, 20 aa, Cryptosporidium hominis
HECLGLCKITENCTYWSFQG

SEQ ID NO: 2190635 - protein, 22 aa, Cryptosporidium hominis
HEDHFLGIFNLLKLKNSINIQQ

SEQ ID NO: 2190636 - protein, 17 aa, Cryptosporidium hominis
HEDLGILNLPNKYSKEF

SEQ ID NO: 2190637 - protein, 36 aa, Cryptosporidium hominis
HEEPFMQLFCGLFFQLSYFITFAQILSDKSFLNHSK

SEQ ID NO: 2190638 - protein, 17 aa, Cryptosporidium hominis
HEFIMYILEIIHDGTIK

SEQ ID NO: 2190639 - protein, 26 aa, Cryptosporidium hominis
HEFYKSITLDYLNKNLRNLMLKVFRK

SEQ ID NO: 2190640 - protein, 19 aa, Cryptosporidium hominis
HEGLLRKLLAFKEVNLDFI

SEQ ID NO: 2190641 - protein, 25 aa, Cryptosporidium hominis
HEISKFPCRYLNTVGFCRNLKDCRF

SEQ ID NO: 2190642 - protein, 21 aa, Cryptosporidium hominis
HEKANFEIWKTDGIYRNENDR

SEQ ID NO: 2190643 - protein, 23 aa, Cryptosporidium hominis
HEKLLTWSLSGFSVLIYGFGSKR

SEQ ID NO: 2190644 - protein, 24 aa, Cryptosporidium hominis
HELEGWALSWNKIKESYLASGSDD

SEQ ID NO: 2190645 - protein, 23 aa, Cryptosporidium hominis
HELLAKFNFVQPVNLTGVSFKLL

SEQ ID NO: 2190646 - protein, 25 aa, Cryptosporidium hominis
HELQIHNLQLLSVLMRILHYTRENK

SEQ ID NO: 2190647 - protein, 24 aa, Cryptosporidium hominis
HELTDMFDYLPLGALVEHHMFCDH

SEQ ID NO: 2190648 - protein, 27 aa, Cryptosporidium hominis
HENILQLYAWFEDKSRIWLVIEIAPGG

SEQ ID NO: 2190649 - protein, 34 aa, Cryptosporidium hominis
HEQRGDKILVFSDSLFALINIAVALKKPFVCGSV

SEQ ID NO: 2190650 - protein, 26 aa, Cryptosporidium hominis
HERNIICLTFRGQPKRWVFCPCRSCL

SEQ ID NO: 2190651 - protein, 29 aa, Cryptosporidium hominis
HESSKMKKIIFSIFKIVITDLDKKALIDG

SEQ ID NO: 2190652 - protein, 22 aa, Cryptosporidium hominis
HEVFVWSGHNFALTPNLITLEN

SEQ ID NO: 2190653 - protein, 17 aa, Cryptosporidium hominis
HEWLNYKINTHSKGDLT

SEQ ID NO: 2190654 - protein, 20 aa, Cryptosporidium hominis
HEYLFRKGYLEPIVMKKGYC

SEQ ID NO: 2190655 - protein, 25 aa, Cryptosporidium hominis
HFANLALKAILRLGDNMNLDYIQII

SEQ ID NO: 2190656 - protein, 37 aa, Cryptosporidium hominis
HFCNKYDILTLRITSKWELRRICRSIGAVAMVRLGVP

SEQ ID NO: 2190657 - protein, 19 aa, Cryptosporidium hominis
HFFKFIVDGEWRYSPEYPI

SEQ ID NO: 2190658 - protein, 17 aa, Cryptosporidium hominis
HFFNPDVPALLVLSNYL

SEQ ID NO: 2190659 - protein, 29 aa, Cryptosporidium hominis
HFLAAHIPLYLYPFLNTVTKSRPFEYLRL

SEQ ID NO: 2190660 - protein, 18 aa, Cryptosporidium hominis
HFLTNFCGKFILSNFIYA

SEQ ID NO: 2190661 - protein, 19 aa, Cryptosporidium hominis
HFQDLILKGFSNAASLLSQ

SEQ ID NO: 2190662 - protein, 20 aa, Cryptosporidium hominis
HFVQGVGTLLPTYASLSSEQ

SEQ ID NO: 2190663 - protein, 18 aa, Cryptosporidium hominis
HFWDWKTTKNFRSFNAHE

SEQ ID NO: 2190664 - protein, 19 aa, Cryptosporidium hominis
HFYNTTFGIGPSLMDFRIN

SEQ ID NO: 2190665 - protein, 19 aa, Cryptosporidium hominis
HGALTLADVNRPIEVRFAS

SEQ ID NO: 2190666 - protein, 28 aa, Cryptosporidium hominis
HGCNVFINRQLIYNYPDQLFKEAGIVAI

SEQ ID NO: 2190667 - protein, 17 aa, Cryptosporidium hominis
HGCVGTPFLYPNYGTCD

SEQ ID NO: 2190668 - protein, 24 aa, Cryptosporidium hominis
HGDCELADFKKKFITSCIAEQFSE

SEQ ID NO: 2190669 - protein, 25 aa, Cryptosporidium hominis
HGESLNPSIFLLKSGFLYPNEVLVH

SEQ ID NO: 2190670 - protein, 17 aa, Cryptosporidium hominis
HGFLPQEKRLENFSKFK

SEQ ID NO: 2190671 - protein, 17 aa, Cryptosporidium hominis
HGIIKTGMKSRRVAETT

SEQ ID NO: 2190672 - protein, 19 aa, Cryptosporidium hominis
HGITWCYRSARFKVRYRRS

SEQ ID NO: 2190673 - protein, 18 aa, Cryptosporidium hominis
HGIYVKDLSEYFVTSPEE

SEQ ID NO: 2190674 - protein, 34 aa, Cryptosporidium hominis
HGLKVRNNFFSPAIAFRLLGLRNKLVKKPKVFEN

SEQ ID NO: 2190675 - protein, 17 aa, Cryptosporidium hominis
HGQKGILSMLWPQENMP

SEQ ID NO: 2190676 - protein, 17 aa, Cryptosporidium hominis
HGRVDTPIFMPVATHGS

SEQ ID NO: 2190677 - protein, 24 aa, Cryptosporidium hominis
HGSLIFWNYITINWIRMSPSFLRK

SEQ ID NO: 2190678 - protein, 21 aa, Cryptosporidium hominis
HGTHHHSLIGDELRAVLGLSA

SEQ ID NO: 2190679 - protein, 25 aa, Cryptosporidium hominis
HGYISKTAFLQKADWKLHEKELEIK

SEQ ID NO: 2190680 - protein, 28 aa, Cryptosporidium hominis
HHFELDITQLLILLIRNNSKLSIKEVSS

SEQ ID NO: 2190681 - protein, 21 aa, Cryptosporidium hominis
HHHPTPVFNQYSQGPNPSQHG

SEQ ID NO: 2190682 - protein, 20 aa, Cryptosporidium hominis
HHILTNFLYNPNGPISLLSF

SEQ ID NO: 2190683 - protein, 24 aa, Cryptosporidium hominis
HHIRSKIKRRLIVEWAKELCLGGY

SEQ ID NO: 2190684 - protein, 17 aa, Cryptosporidium hominis
HHKIIIKSIKKYSYMLN

SEQ ID NO: 2190685 - protein, 18 aa, Cryptosporidium hominis
HHPPPFYTSQQNKNVNKN

SEQ ID NO: 2190686 - protein, 18 aa, Cryptosporidium hominis
HHPSLDWVSSLRITDKLA

SEQ ID NO: 2190687 - protein, 23 aa, Cryptosporidium hominis
HHSILDVALLSDSIIFLTKKTNK

SEQ ID NO: 2190688 - protein, 19 aa, Cryptosporidium hominis
HHSYWVVSQWHILAEREFE

SEQ ID NO: 2190689 - protein, 48 aa, Cryptosporidium hominis
HHTFFEMLGSWSFGDYFKEEAIEWAFKLLTQVYGIPKDRLYATYFGGD

SEQ ID NO: 2190690 - protein, 17 aa, Cryptosporidium hominis
HIAIMEYLKRNQLDFNK

SEQ ID NO: 2190691 - protein, 17 aa, Cryptosporidium hominis
HICDLVKPSLYLDGEKD

SEQ ID NO: 2190692 - protein, 18 aa, Cryptosporidium hominis
HIDILSILIALKEFLNSK

SEQ ID NO: 2190693 - protein, 23 aa, Cryptosporidium hominis
HIEKPQLLNIGTGKLPNLMVDGS

SEQ ID NO: 2190694 - protein, 19 aa, Cryptosporidium hominis
HIFSFDWFIKTRSSNDIYR

SEQ ID NO: 2190695 - protein, 18 aa, Cryptosporidium hominis
HIHYAPYVPRRAESATNK

SEQ ID NO: 2190696 - protein, 18 aa, Cryptosporidium hominis
HIIDGPIIGLEWKCTGTN

SEQ ID NO: 2190697 - protein, 29 aa, Cryptosporidium hominis
HIIRGLLIEADFYLLESLCSILSNKLLEQ

SEQ ID NO: 2190698 - protein, 17 aa, Cryptosporidium hominis
HIISMFKNILSCYKLAC

SEQ ID NO: 2190699 - protein, 28 aa, Cryptosporidium hominis
HIKESLVDYWIELTLTQAKSMNNNLESN

SEQ ID NO: 2190700 - protein, 24 aa, Cryptosporidium hominis
HIKHYGMLLGSFILRKNDPEKQFE

SEQ ID NO: 2190701 - protein, 19 aa, Cryptosporidium hominis
HIKNGYRFTNYNMNTQLSN

SEQ ID NO: 2190702 - protein, 29 aa, Cryptosporidium hominis
HINDRLLWCNEWLPETPLEKFDGNAIAKI

SEQ ID NO: 2190703 - protein, 24 aa, Cryptosporidium hominis
HINEKVVVPKLFNSTPDLYHADKN

SEQ ID NO: 2190704 - protein, 17 aa, Cryptosporidium hominis
HINLIDPSMSALNNFQV

SEQ ID NO: 2190705 - protein, 25 aa, Cryptosporidium hominis
HINVLKLTFRILTQCYRMLSRGLIP

SEQ ID NO: 2190706 - protein, 22 aa, Cryptosporidium hominis
HIPLLKSTILLSFTKLYCNSDH

SEQ ID NO: 2190707 - protein, 18 aa, Cryptosporidium hominis
HIRYLPLLNETNSIEDYI

SEQ ID NO: 2190708 - protein, 25 aa, Cryptosporidium hominis
HITGFEGILLKRIKKRDIMFVQTIK

SEQ ID NO: 2190709 - protein, 17 aa, Cryptosporidium hominis
HIVELNDTFQKRWDETQ

SEQ ID NO: 2190710 - protein, 40 aa, Cryptosporidium hominis
HIVQFYYDYFLMDSPYRRSYILLLQAPPFNRLISYSKQKG

SEQ ID NO: 2190711 - protein, 18 aa, Cryptosporidium hominis
HIWKSTCFIKLQSKLDDG

SEQ ID NO: 2190712 - protein, 29 aa, Cryptosporidium hominis
HIYDSLALTKFLYYLYKAGRDKTLFNGKV

SEQ ID NO: 2190713 - protein, 18 aa, Cryptosporidium hominis
HKCSNVLFRFKPMHHYNI

SEQ ID NO: 2190714 - protein, 26 aa, Cryptosporidium hominis
HKDQNWSLIVNGRILELFRKIKATNL

SEQ ID NO: 2190715 - protein, 30 aa, Cryptosporidium hominis
HKDRILLHETIFWKRRHGLRISSGLLKDIF

SEQ ID NO: 2190716 - protein, 28 aa, Cryptosporidium hominis
HKEIAEMNNILFQAKERYQLTLNENNEK

SEQ ID NO: 2190717 - protein, 29 aa, Cryptosporidium hominis
HKEKEILKTILPYLNNWKDKRLEIRKEEL

SEQ ID NO: 2190718 - protein, 25 aa, Cryptosporidium hominis
HKETKKIRFLLRQEKTLKIVANHYV

SEQ ID NO: 2190719 - protein, 26 aa, Cryptosporidium hominis
HKFQRARIYYKNKSLFKLMGNCNDHN

SEQ ID NO: 2190720 - protein, 32 aa, Cryptosporidium hominis
HKIAMIKRLWIKLCEILIKYGVNLTISDSNSE

SEQ ID NO: 2190721 - protein, 23 aa, Cryptosporidium hominis
HKRNLVKWFQIALNSLTCTDLGF

SEQ ID NO: 2190722 - protein, 18 aa, Cryptosporidium hominis
HKSGILSMKIVEFGFQGT

SEQ ID NO: 2190723 - protein, 21 aa, Cryptosporidium hominis
HKSTFQFLQKTLSNILSVFSD

SEQ ID NO: 2190724 - protein, 18 aa, Cryptosporidium hominis
HKSYDFLDDMRQKEFNQI

SEQ ID NO: 2190725 - protein, 25 aa, Cryptosporidium hominis
HKVPEYRVLLIIPDEFYLTIADVEF

SEQ ID NO: 2190726 - protein, 30 aa, Cryptosporidium hominis
HKYSPTEIKIQPSIFSFDISLDTKKSNLDN

SEQ ID NO: 2190727 - protein, 20 aa, Cryptosporidium hominis
HLEPIRYIYPKGYAPSTSNF

SEQ ID NO: 2190728 - protein, 20 aa, Cryptosporidium hominis
HLGQFLRALQKIADTFGVAV

SEQ ID NO: 2190729 - protein, 21 aa, Cryptosporidium hominis
HLIFRNYLRCLLKAGFPHIVL

SEQ ID NO: 2190730 - protein, 22 aa, Cryptosporidium hominis
HLKIPLKFIYIGYNISQILSDR

SEQ ID NO: 2190731 - protein, 24 aa, Cryptosporidium hominis
HLKKSRVKLLPISNTCYTIIREKT

SEQ ID NO: 2190732 - protein, 23 aa, Cryptosporidium hominis
HLNNEIVQLVKWLELTNSEHMLR

SEQ ID NO: 2190733 - protein, 35 aa, Cryptosporidium hominis
HLNVDIKIRFFPLRTLTLYLLYKRSLEVDTKFVTK

SEQ ID NO: 2190734 - protein, 27 aa, Cryptosporidium hominis
HLPDLKHPFSLLYSYKRLNELNIEVSN

SEQ ID NO: 2190735 - protein, 23 aa, Cryptosporidium hominis
HLPKLECLMLNGNRFKEISFINH

SEQ ID NO: 2190736 - protein, 20 aa, Cryptosporidium hominis
HLQALPTRSEMLYKSSILNK

SEQ ID NO: 2190737 - protein, 17 aa, Cryptosporidium hominis
HLQIVHPLQNEYPEFFQ

SEQ ID NO: 2190738 - protein, 18 aa, Cryptosporidium hominis
HLQSPLKFVSGLGPRKAK

SEQ ID NO: 2190739 - protein, 17 aa, Cryptosporidium hominis
HLQVTLNTLLYKYKETR

SEQ ID NO: 2190740 - protein, 27 aa, Cryptosporidium hominis
HLRFLEKVKKIFGGVLIIGIYDDSTTQ

SEQ ID NO: 2190741 - protein, 25 aa, Cryptosporidium hominis
HLRKNPDFYAFLKGCLELDPLKRLT

SEQ ID NO: 2190742 - protein, 18 aa, Cryptosporidium hominis
HLRRHMMLVHSSIEEKAS

SEQ ID NO: 2190743 - protein, 31 aa, Cryptosporidium hominis
HLRSLLIEYYGIPKLFPIYIFTSKYTDHKHS

SEQ ID NO: 2190744 - protein, 19 aa, Cryptosporidium hominis
HLSRLLIVLFSVYHNFEKN

SEQ ID NO: 2190745 - protein, 18 aa, Cryptosporidium hominis
HLTFEQLGTLYRLSMQIL

SEQ ID NO: 2190746 - protein, 18 aa, Cryptosporidium hominis
HLTLLYAFESFREVLYKD

SEQ ID NO: 2190747 - protein, 25 aa, Cryptosporidium hominis
HMFEMADRLVGIYKTFDITKSVSII

SEQ ID NO: 2190748 - protein, 31 aa, Cryptosporidium hominis
HMSNKILELKGLRFAFFKDDLDILDTCIMMA

SEQ ID NO: 2190749 - protein, 18 aa, Cryptosporidium hominis
HNCETQMLFLSETDPNYV

SEQ ID NO: 2190750 - protein, 29 aa, Cryptosporidium hominis
HNDGRDKIFPLPYNGDNFAPGLLLKAHGI

SEQ ID NO: 2190751 - protein, 17 aa, Cryptosporidium hominis
HNFMRWNRNILTDSGGF

SEQ ID NO: 2190752 - protein, 32 aa, Cryptosporidium hominis
HNGNYYDKYGRFCGFFNNGIFHSFHYHYQQYL

SEQ ID NO: 2190753 - protein, 22 aa, Cryptosporidium hominis
HNGPNWNNNIPYNGFEYGSGLG

SEQ ID NO: 2190754 - protein, 20 aa, Cryptosporidium hominis
HNHDLTLIKDFVFNSYCLIH

SEQ ID NO: 2190755 - protein, 28 aa, Cryptosporidium hominis
HNHTKKKPLKYWRQILDGIIVRHRRITR

SEQ ID NO: 2190756 - protein, 17 aa, Cryptosporidium hominis
HNIAMGNVIKWLKKQIC

SEQ ID NO: 2190757 - protein, 27 aa, Cryptosporidium hominis
HNIRNFRLPVYFVPSSSDYFYVSESNT

SEQ ID NO: 2190758 - protein, 29 aa, Cryptosporidium hominis
HNKFPLKAIKDILRPINGDFYHPINLLGY

SEQ ID NO: 2190759 - protein, 24 aa, Cryptosporidium hominis
HNNKPFLRGGDFTRRRARGETPMQ

SEQ ID NO: 2190760 - protein, 28 aa, Cryptosporidium hominis
HNPQDFDILFDYIIFITQYLELDSVLQE

SEQ ID NO: 2190761 - protein, 28 aa, Cryptosporidium hominis
HNQDTILQVLKFTGFYKIIANRMQFDEN

SEQ ID NO: 2190762 - protein, 18 aa, Cryptosporidium hominis
HNQYWKTKLCLMFSKGAC

SEQ ID NO: 2190763 - protein, 21 aa, Cryptosporidium hominis
HNRFLILQGEVELIAQMKPKS

SEQ ID NO: 2190764 - protein, 17 aa, Cryptosporidium hominis
HNSEHIFYCIQYVNRFG

SEQ ID NO: 2190765 - protein, 25 aa, Cryptosporidium hominis
HNSNQIGILLTPDRNFSRSENIISP

SEQ ID NO: 2190766 - protein, 36 aa, Cryptosporidium hominis
HNSRSSLIRWSKVSSTIYLFGTTQVQLRISRGNLLA

SEQ ID NO: 2190767 - protein, 31 aa, Cryptosporidium hominis
HNSSGTPCIPPFWHANPALLASAASLIGSGD

SEQ ID NO: 2190768 - protein, 19 aa, Cryptosporidium hominis
HNTIWYYWDNEIHKEYVQR

SEQ ID NO: 2190769 - protein, 17 aa, Cryptosporidium hominis
HPDFDPCSFRNIAPEHK

SEQ ID NO: 2190770 - protein, 27 aa, Cryptosporidium hominis
HPELKYFNSYLYFPSSIVPAPIDGNEA

SEQ ID NO: 2190771 - protein, 23 aa, Cryptosporidium hominis
HPELSLFGVFDGHGGSVISEWVS

SEQ ID NO: 2190772 - protein, 29 aa, Cryptosporidium hominis
HPESPPSSYLLYLHVNKEPVRLGFEASQA

SEQ ID NO: 2190773 - protein, 25 aa, Cryptosporidium hominis
HPETWVPFFVPQKKLGNSTPIWVHK

SEQ ID NO: 2190774 - protein, 17 aa, Cryptosporidium hominis
HPFEFITFLNYCRALRF

SEQ ID NO: 2190775 - protein, 17 aa, Cryptosporidium hominis
HPHIFIHGNPQFHYHHQ

SEQ ID NO: 2190776 - protein, 17 aa, Cryptosporidium hominis
HPHNKWSIPSRYQVRHL

SEQ ID NO: 2190777 - protein, 24 aa, Cryptosporidium hominis
HPIASLLSVLSMNKGIQSIHNRMS

SEQ ID NO: 2190778 - protein, 26 aa, Cryptosporidium hominis
HPILTPVIICLEQWAHRWSQVGKSLL

SEQ ID NO: 2190779 - protein, 22 aa, Cryptosporidium hominis
HPIQKNIIFIGSLDASVQILRL

SEQ ID NO: 2190780 - protein, 18 aa, Cryptosporidium hominis
HPIYADVGGFLISESTGN

SEQ ID NO: 2190781 - protein, 24 aa, Cryptosporidium hominis
HPNIMKLFEILEDSSSFYIVGELY

SEQ ID NO: 2190782 - protein, 20 aa, Cryptosporidium hominis
HPNSVDFELLYNVLLSLKNG

SEQ ID NO: 2190783 - protein, 23 aa, Cryptosporidium hominis
HPTFPEYFIVAYGTKFSQNSSFE

SEQ ID NO: 2190784 - protein, 20 aa, Cryptosporidium hominis
HPYVIFGTGIFKKSSIETDI

SEQ ID NO: 2190785 - protein, 25 aa, Cryptosporidium hominis
HQERKCIPIALLIEQITKKKLHVTK

SEQ ID NO: 2190786 - protein, 17 aa, Cryptosporidium hominis
HQFYRSLAHSGEMVGTI

SEQ ID NO: 2190787 - protein, 31 aa, Cryptosporidium hominis
HQKSKKLVLPPIPYFRRPAISRSRINYSNVR

SEQ ID NO: 2190788 - protein, 18 aa, Cryptosporidium hominis
HQLGIYNSIRFVGKKSGD

SEQ ID NO: 2190789 - protein, 18 aa, Cryptosporidium hominis
HQLSELRRRHSNELQRFE

SEQ ID NO: 2190790 - protein, 27 aa, Cryptosporidium hominis
HQLWREDIILIIRKFAEIVYEIVTGNF

SEQ ID NO: 2190791 - protein, 22 aa, Cryptosporidium hominis
HQNPMIVHPIQMPPHGHGAQLQ

SEQ ID NO: 2190792 - protein, 24 aa, Cryptosporidium hominis
HQNYYGYGYNPYYSSGYMSGMGTV

SEQ ID NO: 2190793 - protein, 23 aa, Cryptosporidium hominis
HQRSINTVFSKNIELLRLAIKRS

SEQ ID NO: 2190794 - protein, 27 aa, Cryptosporidium hominis
HRDLKPENFLFLTDSPDSPLKLIDFGL

SEQ ID NO: 2190795 - protein, 18 aa, Cryptosporidium hominis
HRGILHRDLKPSNILLHI

SEQ ID NO: 2190796 - protein, 17 aa, Cryptosporidium hominis
HRGYGFIEFGTADQAKL

SEQ ID NO: 2190797 - protein, 18 aa, Cryptosporidium hominis
HRIISVLQDIFNLLPDLR

SEQ ID NO: 2190798 - protein, 25 aa, Cryptosporidium hominis
HRITARLAMVYLNSSQFVKGLDYIE

SEQ ID NO: 2190799 - protein, 27 aa, Cryptosporidium hominis
HRLKLQSFCFMWMLPEHALLNSIIESG

SEQ ID NO: 2190800 - protein, 20 aa, Cryptosporidium hominis
HRLQPYFHKTDKSAFEKTLA

SEQ ID NO: 2190801 - protein, 26 aa, Cryptosporidium hominis
HRMVVWRHYFVVFGGFHDTIRETRYF

SEQ ID NO: 2190802 - protein, 20 aa, Cryptosporidium hominis
HRNLAYIYKQRIPKKHQFEM

SEQ ID NO: 2190803 - protein, 27 aa, Cryptosporidium hominis
HRQINDILINLIKKKNKFESHNFIYHI

SEQ ID NO: 2190804 - protein, 34 aa, Cryptosporidium hominis
HRQKNIMGPVFMKVLLFMFVVDPPYHLDPRARSS

SEQ ID NO: 2190805 - protein, 24 aa, Cryptosporidium hominis
HRSRFIEEYLLYGTSETFKFGQNT

SEQ ID NO: 2190806 - protein, 38 aa, Cryptosporidium hominis
HRVEELISYLYHMSLYKYIQVYTLKINPSQTPLVIGTL

SEQ ID NO: 2190807 - protein, 23 aa, Cryptosporidium hominis
HSEFISGFKIIASQLKEIYQMIT

SEQ ID NO: 2190808 - protein, 23 aa, Cryptosporidium hominis
HSERLKRQLFTTQLDIMNKENPI

SEQ ID NO: 2190809 - protein, 23 aa, Cryptosporidium hominis
HSFGDFLELPIYSSSLLSIQSFQ

SEQ ID NO: 2190810 - protein, 21 aa, Cryptosporidium hominis
HSGVYNFLHNFDGILNGMVYL

SEQ ID NO: 2190811 - protein, 17 aa, Cryptosporidium hominis
HSHPGFGCWFSGTDVST

SEQ ID NO: 2190812 - protein, 23 aa, Cryptosporidium hominis
HSHPLNIWFKPDSTFNSPHSLIN

SEQ ID NO: 2190813 - protein, 27 aa, Cryptosporidium hominis
HSIAQHFKFNLMRILKRIKQTEEVQVY

SEQ ID NO: 2190814 - protein, 17 aa, Cryptosporidium hominis
HSIAWSKYLFDIVFGVR

SEQ ID NO: 2190815 - protein, 26 aa, Cryptosporidium hominis
HSKVKKEKMYKDAKTGYLIVEDDVDF

SEQ ID NO: 2190816 - protein, 33 aa, Cryptosporidium hominis
HSKYSHIHIFLIKNLLIQLFKVGPRALPFDPLN

SEQ ID NO: 2190817 - protein, 28 aa, Cryptosporidium hominis
HSLETICLLFALKIRYPRQIHLIRGNHE

SEQ ID NO: 2190818 - protein, 25 aa, Cryptosporidium hominis
HSLMPLRSCFSSRNGLWVASAAEDC

SEQ ID NO: 2190819 - protein, 25 aa, Cryptosporidium hominis
HSLPNFIAKIILPLFTSKNEKDFLK

SEQ ID NO: 2190820 - protein, 25 aa, Cryptosporidium hominis
HSLSAIYIAIDGTLDWVFCPSTDKD

SEQ ID NO: 2190821 - protein, 17 aa, Cryptosporidium hominis
HSNINWHTARLARKIIT

SEQ ID NO: 2190822 - protein, 25 aa, Cryptosporidium hominis
HSNKYGHLILFVGLTTGVILSCKVD

SEQ ID NO: 2190823 - protein, 28 aa, Cryptosporidium hominis
HSNTLSRHFFQFLWDVFSNNIKENTSIV

SEQ ID NO: 2190824 - protein, 19 aa, Cryptosporidium hominis
HSPKKPVIIFVASRRQTRI

SEQ ID NO: 2190825 - protein, 19 aa, Cryptosporidium hominis
HSRDFSFYGENFFHTVERG

SEQ ID NO: 2190826 - protein, 26 aa, Cryptosporidium hominis
HSRQNKFQVLLFSATVPPWVKNILTE

SEQ ID NO: 2190827 - protein, 26 aa, Cryptosporidium hominis
HSSDLIRMVTIPLIKKMIPQVGEISL

SEQ ID NO: 2190828 - protein, 31 aa, Cryptosporidium hominis
HSSKYPPPNNFDFYNLHKYNPRIQSFCDDLL

SEQ ID NO: 2190829 - protein, 25 aa, Cryptosporidium hominis
HSVKNLHPYILIIICMLRERYQKAV

SEQ ID NO: 2190830 - protein, 19 aa, Cryptosporidium hominis
HSVSAFPLDLTLYSEYKST

SEQ ID NO: 2190831 - protein, 20 aa, Cryptosporidium hominis
HSYPYMFSSSWYSPEDQEKK

SEQ ID NO: 2190832 - protein, 29 aa, Cryptosporidium hominis
HTAILLVTGKLYMFGGGAFGKLGFGSTDD

SEQ ID NO: 2190833 - protein, 17 aa, Cryptosporidium hominis
HTDILFGLVKDVSRFRN

SEQ ID NO: 2190834 - protein, 27 aa, Cryptosporidium hominis
HTDLKLENILFTDNNYIWVNAPRHPGA

SEQ ID NO: 2190835 - protein, 21 aa, Cryptosporidium hominis
HTFDIPMDYLRLLQSQIKTQS

SEQ ID NO: 2190836 - protein, 24 aa, Cryptosporidium hominis
HTGGKLPFWLSPRQAIVLSISEKT

SEQ ID NO: 2190837 - protein, 17 aa, Cryptosporidium hominis
HTIIWQGDKKQLCGTGK

SEQ ID NO: 2190838 - protein, 20 aa, Cryptosporidium hominis
HTNFPMLPRVFSSNLCSLLP

SEQ ID NO: 2190839 - protein, 24 aa, Cryptosporidium hominis
HTNIFNRPYFNIDNISFEPKKEET

SEQ ID NO: 2190840 - protein, 19 aa, Cryptosporidium hominis
HTNIFPNFLSKILKIEDYQ

SEQ ID NO: 2190841 - protein, 25 aa, Cryptosporidium hominis
HTQIKYPEYFIKPNNKYVNELGGSN

SEQ ID NO: 2190842 - protein, 18 aa, Cryptosporidium hominis
HTRLLDGKKYIPGSVGGG

SEQ ID NO: 2190843 - protein, 20 aa, Cryptosporidium hominis
HTVLLRREDIVLVGATIGGG

SEQ ID NO: 2190844 - protein, 22 aa, Cryptosporidium hominis
HVCCFMKYYQIIYERLKKAKST

SEQ ID NO: 2190845 - protein, 22 aa, Cryptosporidium hominis
HVEAPVFKYGGYKNSSLIINNN

SEQ ID NO: 2190846 - protein, 17 aa, Cryptosporidium hominis
HVELLNKVILILKDIEI

SEQ ID NO: 2190847 - protein, 19 aa, Cryptosporidium hominis
HVFHKQCIDAWLSKCDSNK

SEQ ID NO: 2190848 - protein, 20 aa, Cryptosporidium hominis
HVIHQFWEVAKVNQFVFMEL

SEQ ID NO: 2190849 - protein, 23 aa, Cryptosporidium hominis
HVKALLLLCRGLDKFEIKTLKTV

SEQ ID NO: 2190850 - protein, 24 aa, Cryptosporidium hominis
HVKNRKVYILASLEPSKELSGGTF

SEQ ID NO: 2190851 - protein, 40 aa, Cryptosporidium hominis
HVKREDGNYPPICSVYGVPAKYLDPLTNKYYSSLEAFKMI

SEQ ID NO: 2190852 - protein, 20 aa, Cryptosporidium hominis
HVLVQEYICFGIMDSSLIRK

SEQ ID NO: 2190853 - protein, 25 aa, Cryptosporidium hominis
HVQRYIQAINDYFAREGLLGVCESR

SEQ ID NO: 2190854 - protein, 20 aa, Cryptosporidium hominis
HVRPEFGFILSPTAPKTQKQ

SEQ ID NO: 2190855 - protein, 17 aa, Cryptosporidium hominis
HVTLERNLTKFLDERPI

SEQ ID NO: 2190856 - protein, 17 aa, Cryptosporidium hominis
HVVLSQVFLLNQNLMRS

SEQ ID NO: 2190857 - protein, 18 aa, Cryptosporidium hominis
HVYVCAAFLLHWEKELRN

SEQ ID NO: 2190858 - protein, 24 aa, Cryptosporidium hominis
HYDENILNSMKVIELKDVCSKLQL

SEQ ID NO: 2190859 - protein, 19 aa, Cryptosporidium hominis
HYFESLPYVTDLEGVIDYD

SEQ ID NO: 2190860 - protein, 18 aa, Cryptosporidium hominis
HYKEIVHLSLPFEMANEA

SEQ ID NO: 2190861 - protein, 24 aa, Cryptosporidium hominis
HYNETQLRLFRQEQLLLLAENERL

SEQ ID NO: 2190862 - protein, 33 aa, Cryptosporidium hominis
HYPERLHRAFIIQPGWFFKAVWGLISPCIPGNT

SEQ ID NO: 2190863 - protein, 20 aa, Cryptosporidium hominis
HYSHVFWNRVSERIAPNYYN

SEQ ID NO: 2190864 - protein, 26 aa, Cryptosporidium hominis
IAACVLINILISYDPILQFPSHQNIL

SEQ ID NO: 2190865 - protein, 23 aa, Cryptosporidium hominis
IAAGILKRSLPLVFSRYMSSKCE

SEQ ID NO: 2190866 - protein, 19 aa, Cryptosporidium hominis
IAAKLSLVPVRRGYWGNKI

SEQ ID NO: 2190867 - protein, 25 aa, Cryptosporidium hominis
IADCQIYMTIFVDSASLRDNINQSF

SEQ ID NO: 2190868 - protein, 25 aa, Cryptosporidium hominis
IADHLNLPPIKLHCSLLAEDAIKHA

SEQ ID NO: 2190869 - protein, 22 aa, Cryptosporidium hominis
IADNLIMEYLGPIDSIRAANDP

SEQ ID NO: 2190870 - protein, 22 aa, Cryptosporidium hominis
IAEFLIYYRFREVIRDKDDYDD

SEQ ID NO: 2190871 - protein, 20 aa, Cryptosporidium hominis
IAEVCYIRRKALLLNSKVNT

SEQ ID NO: 2190872 - protein, 17 aa, Cryptosporidium hominis
IAFITKRPDLFGTIEEA

SEQ ID NO: 2190873 - protein, 31 aa, Cryptosporidium hominis
IAGTTTGCFNPLLRQMYLGWQGNNSALTGQG

SEQ ID NO: 2190874 - protein, 17 aa, Cryptosporidium hominis
IAIMAFKLVPSKTNLIL

SEQ ID NO: 2190875 - protein, 20 aa, Cryptosporidium hominis
IAISPFQGVSYKFEFRSSDD

SEQ ID NO: 2190876 - protein, 25 aa, Cryptosporidium hominis
IAKDHITLLYRLFAQLDRLEDIMDF

SEQ ID NO: 2190877 - protein, 21 aa, Cryptosporidium hominis
IAKHWYQKFNKQVFHNRLPEE

SEQ ID NO: 2190878 - protein, 17 aa, Cryptosporidium hominis
IAKLDPSLGTKLAFEQH

SEQ ID NO: 2190879 - protein, 29 aa, Cryptosporidium hominis
IAKLISGIFKVFPYLFHQGANYSQEIYEK

SEQ ID NO: 2190880 - protein, 24 aa, Cryptosporidium hominis
IAKLLFIHMLGYPSQFGQVECLKL

SEQ ID NO: 2190881 - protein, 22 aa, Cryptosporidium hominis
IAKVIRILRRLLKGASIININC

SEQ ID NO: 2190882 - protein, 27 aa, Cryptosporidium hominis
IALEYLDYCILYPPPNVGIIRTHLYRI

SEQ ID NO: 2190883 - protein, 19 aa, Cryptosporidium hominis
IALRVMLLEDEYFLGLEPI

SEQ ID NO: 2190884 - protein, 25 aa, Cryptosporidium hominis
IAMGGGSHPSFPFMYGNFPNNGSQQ

SEQ ID NO: 2190885 - protein, 24 aa, Cryptosporidium hominis
IAMGPFVVDTWYYSPYPKEVQNVD

SEQ ID NO: 2190886 - protein, 24 aa, Cryptosporidium hominis
IAMYMHNFTLYGSVRPFGCSILLG

SEQ ID NO: 2190887 - protein, 25 aa, Cryptosporidium hominis
IANAILLPHIISYNASNRPTKQSIL

SEQ ID NO: 2190888 - protein, 24 aa, Cryptosporidium hominis
IAPEIFGMLDVKKGLLLQLIGGVT

SEQ ID NO: 2190889 - protein, 19 aa, Cryptosporidium hominis
IAPLYYRSKKQKMVKGFFL

SEQ ID NO: 2190890 - protein, 21 aa, Cryptosporidium hominis
IAPRLYAILEHCEDHFNDVNS

SEQ ID NO: 2190891 - protein, 28 aa, Cryptosporidium hominis
IAQANQRFLLLYTFLKKNRDKKVMVFFS

SEQ ID NO: 2190892 - protein, 18 aa, Cryptosporidium hominis
IARAIGFDLTPGIRRKTG

SEQ ID NO: 2190893 - protein, 17 aa, Cryptosporidium hominis
IASILEGMFPIGSSTAP

SEQ ID NO: 2190894 - protein, 18 aa, Cryptosporidium hominis
IASSSFYLPNWFSSSKIS

SEQ ID NO: 2190895 - protein, 18 aa, Cryptosporidium hominis
IATFIPCYDVIPPKFINA

SEQ ID NO: 2190896 - protein, 27 aa, Cryptosporidium hominis
IATHQLPPHPGIHAPPPFMDPWNMQGH

SEQ ID NO: 2190897 - protein, 24 aa, Cryptosporidium hominis
IATKYLIKRFIQNNVRFFFTRNIH

SEQ ID NO: 2190898 - protein, 18 aa, Cryptosporidium hominis
IAVHGIHTKQLLLKYIRN

SEQ ID NO: 2190899 - protein, 19 aa, Cryptosporidium hominis
IAVIPTFAPFTCIKDFKYC

SEQ ID NO: 2190900 - protein, 18 aa, Cryptosporidium hominis
ICAAFLMRELGISSLQAL

SEQ ID NO: 2190901 - protein, 28 aa, Cryptosporidium hominis
ICDEIENFFIQFPIFPSNMSQYRQRWLE

SEQ ID NO: 2190902 - protein, 20 aa, Cryptosporidium hominis
ICEIVALSSLLYSGGNILAI

SEQ ID NO: 2190903 - protein, 18 aa, Cryptosporidium hominis
ICELYLKIDPDFQRWNLN

SEQ ID NO: 2190904 - protein, 27 aa, Cryptosporidium hominis
ICESRSHRRLYIKNLPFSANTESVIEV

SEQ ID NO: 2190905 - protein, 18 aa, Cryptosporidium hominis
ICEVPEKILEDGDCCWIH

SEQ ID NO: 2190906 - protein, 32 aa, Cryptosporidium hominis
ICIDPQDLTRTGFIIFWGGRELDSFNIGNNIT

SEQ ID NO: 2190907 - protein, 18 aa, Cryptosporidium hominis
ICILLATNVPGTLDKAVI

SEQ ID NO: 2190908 - protein, 20 aa, Cryptosporidium hominis
ICIRLISGLKFLEFDDIETG

SEQ ID NO: 2190909 - protein, 20 aa, Cryptosporidium hominis
ICITPPLSSELITSNNFYFP

SEQ ID NO: 2190910 - protein, 32 aa, Cryptosporidium hominis
ICMRNSVLAHYLIYNYLPIMDTNVPLIPFEML

SEQ ID NO: 2190911 - protein, 31 aa, Cryptosporidium hominis
ICNSAYKQLIFLFKQIIYSISPIKVNKLCFY

SEQ ID NO: 2190912 - protein, 19 aa, Cryptosporidium hominis
ICQALYQIVLKDKSMMVKS

SEQ ID NO: 2190913 - protein, 24 aa, Cryptosporidium hominis
ICQLKPVIHHITSLDLINAVITNN

SEQ ID NO: 2190914 - protein, 18 aa, Cryptosporidium hominis
ICQLLPNGSIRIVDRRKN

SEQ ID NO: 2190915 - protein, 24 aa, Cryptosporidium hominis
ICRNNIQLILKYLLENYIVVICNL

SEQ ID NO: 2190916 - protein, 18 aa, Cryptosporidium hominis
ICRSWENYIHPRAKDFWK

SEQ ID NO: 2190917 - protein, 26 aa, Cryptosporidium hominis
ICSGGLLIIGLCPWGWEYISGGKVNS

SEQ ID NO: 2190918 - protein, 28 aa, Cryptosporidium hominis
ICSIPVFEIRLVWKDKILSNNALLSSYG

SEQ ID NO: 2190919 - protein, 25 aa, Cryptosporidium hominis
IDCPSELFSTLLLNPDLESLSVQKI

SEQ ID NO: 2190920 - protein, 18 aa, Cryptosporidium hominis
IDCSYRCPYPDCGRFYSS

SEQ ID NO: 2190921 - protein, 25 aa, Cryptosporidium hominis
IDCVSWPVILDLLLTKMNESSMNEL

SEQ ID NO: 2190922 - protein, 26 aa, Cryptosporidium hominis
IDDLFASVRYFQPPFLISPAEEAQTG

SEQ ID NO: 2190923 - protein, 21 aa, Cryptosporidium hominis
IDDSFVLPWIIERKTGSDMCS

SEQ ID NO: 2190924 - protein, 28 aa, Cryptosporidium hominis
IDEETVISIFIQLLDALNYCHTRSNRVL

SEQ ID NO: 2190925 - protein, 19 aa, Cryptosporidium hominis
IDEFSTWLDKYVCCDSIEI

SEQ ID NO: 2190926 - protein, 23 aa, Cryptosporidium hominis
IDELYSLIKHVYFLLDTVQEEAK

SEQ ID NO: 2190927 - protein, 30 aa, Cryptosporidium hominis
IDEMHWIASTILLLKMKFNYSWSEFAILAR

SEQ ID NO: 2190928 - protein, 26 aa, Cryptosporidium hominis
IDFFRERYIMFASRLFSQIVKEIEGL

SEQ ID NO: 2190929 - protein, 26 aa, Cryptosporidium hominis
IDFKAFSLTLLEKLSKIPGSRWFLQP

SEQ ID NO: 2190930 - protein, 19 aa, Cryptosporidium hominis
IDFSSIFVPYMSTAKRVGQ

SEQ ID NO: 2190931 - protein, 17 aa, Cryptosporidium hominis
IDFTLSIGRLNTDPLMN

SEQ ID NO: 2190932 - protein, 18 aa, Cryptosporidium hominis
IDGEFFRGWSSPCSTYDS

SEQ ID NO: 2190933 - protein, 27 aa, Cryptosporidium hominis
IDGSKRVVIKLSKYVLDCEFRLKKTLL

SEQ ID NO: 2190934 - protein, 24 aa, Cryptosporidium hominis
IDHNQIILFELFKQVYEDILCLIS

SEQ ID NO: 2190935 - protein, 41 aa, Cryptosporidium hominis
IDHPDQLVPLPIGYFKHDFRFKVYHKFLDLLPECRNNDISK

SEQ ID NO: 2190936 - protein, 19 aa, Cryptosporidium hominis
IDIDGAFFGTSFPHIFLQV

SEQ ID NO: 2190937 - protein, 26 aa, Cryptosporidium hominis
IDIHELFRRYCPDPLYLIADVTADDF

SEQ ID NO: 2190938 - protein, 18 aa, Cryptosporidium hominis
IDILSKKFNRAIGKADYL

SEQ ID NO: 2190939 - protein, 26 aa, Cryptosporidium hominis
IDISKSFIPPPLFSCTDQKPYIPDFH

SEQ ID NO: 2190940 - protein, 25 aa, Cryptosporidium hominis
IDIYGYPISWFLWGSSGSGKSTLVR

SEQ ID NO: 2190941 - protein, 17 aa, Cryptosporidium hominis
IDKLYSLRPPDLKKKKF

SEQ ID NO: 2190942 - protein, 23 aa, Cryptosporidium hominis
IDKPYYFIKFDRVIQRCKSEYKD

SEQ ID NO: 2190943 - protein, 24 aa, Cryptosporidium hominis
IDKSIKIWDIRKANNPLKTINNLP

SEQ ID NO: 2190944 - protein, 27 aa, Cryptosporidium hominis
IDKSYLDLMVWWRKNYMEFFSSIRNIQ

SEQ ID NO: 2190945 - protein, 24 aa, Cryptosporidium hominis
IDLEERLLLWSTPLQQSQDWESQG

SEQ ID NO: 2190946 - protein, 24 aa, Cryptosporidium hominis
IDLGLLQYLTILEYEKWLDPEIYE

SEQ ID NO: 2190947 - protein, 26 aa, Cryptosporidium hominis
IDLITDNYLYLNAPILPLESLLNNEF

SEQ ID NO: 2190948 - protein, 17 aa, Cryptosporidium hominis
IDLLPPDSPNFEDIYIV

SEQ ID NO: 2190949 - protein, 26 aa, Cryptosporidium hominis
IDLNTFTTLVKKLNLGWSSGQIRHAM

SEQ ID NO: 2190950 - protein, 19 aa, Cryptosporidium hominis
IDLYNYKYYFINYDKDTGN

SEQ ID NO: 2190951 - protein, 29 aa, Cryptosporidium hominis
IDMLATDWFLTLFSYSIPLNIIGKFWDDF

SEQ ID NO: 2190952 - protein, 19 aa, Cryptosporidium hominis
IDMLFEILIEIQGLRKEIQ

SEQ ID NO: 2190953 - protein, 21 aa, Cryptosporidium hominis
IDMWSVGCIFAELLNMLKENV

SEQ ID NO: 2190954 - protein, 22 aa, Cryptosporidium hominis
IDNIFFIEKSIHNRYISLKSKI

SEQ ID NO: 2190955 - protein, 25 aa, Cryptosporidium hominis
IDNIRSYFLYHIDTPRFKQIEETSI

SEQ ID NO: 2190956 - protein, 25 aa, Cryptosporidium hominis
IDNKDQVLLTLKLPERLKVVNKTNV

SEQ ID NO: 2190957 - protein, 25 aa, Cryptosporidium hominis
IDNKTLFDTFSLFGNIMSCKIATDV

SEQ ID NO: 2190958 - protein, 25 aa, Cryptosporidium hominis
IDNSYDIHFALSSYLLGVNYTNFRN

SEQ ID NO: 2190959 - protein, 29 aa, Cryptosporidium hominis
IDNYAVGMNLLLFLTGRFICRQKGLDVTE

SEQ ID NO: 2190960 - protein, 28 aa, Cryptosporidium hominis
IDPAMMRPGRLDRVIYVPLPNEMGRLDI

SEQ ID NO: 2190961 - protein, 23 aa, Cryptosporidium hominis
IDPMALFSWITYNLKKKIDKYLR

SEQ ID NO: 2190962 - protein, 25 aa, Cryptosporidium hominis
IDPRLSEYYLIYADVLLEKEENSTN

SEQ ID NO: 2190963 - protein, 24 aa, Cryptosporidium hominis
IDPVAPVHALLIPKKRSGLTRLSK

SEQ ID NO: 2190964 - protein, 23 aa, Cryptosporidium hominis
IDQYICNFGQWTISPELFNELLI

SEQ ID NO: 2190965 - protein, 24 aa, Cryptosporidium hominis
IDRFKMYQFFKKLRDFETGGFKIQ

SEQ ID NO: 2190966 - protein, 23 aa, Cryptosporidium hominis
IDRQRIIAIVNFSSGFFPVSIDR

SEQ ID NO: 2190967 - protein, 31 aa, Cryptosporidium hominis
IDSAIVTLVSYYLFIWRDSIARLLDVSPSYV

SEQ ID NO: 2190968 - protein, 18 aa, Cryptosporidium hominis
IDSFFGYCIFEFLERVLN

SEQ ID NO: 2190969 - protein, 24 aa, Cryptosporidium hominis
IDSGIPMEFFPLAISIAESSHFYG

SEQ ID NO: 2190970 - protein, 29 aa, Cryptosporidium hominis
IDSLLNMNRGFIPFILCGDLSPIDNIDPS

SEQ ID NO: 2190971 - protein, 23 aa, Cryptosporidium hominis
IDTIIPFHNLYYLKSKISKDSET

SEQ ID NO: 2190972 - protein, 25 aa, Cryptosporidium hominis
IDTVSDLIFPPKRKSRFPISAYPRA

SEQ ID NO: 2190973 - protein, 28 aa, Cryptosporidium hominis
IDVCFYIGFVPFYSKVILRLLHQQLASL

SEQ ID NO: 2190974 - protein, 23 aa, Cryptosporidium hominis
IDVIWRKIFTQEFVKITLDDVYV

SEQ ID NO: 2190975 - protein, 17 aa, Cryptosporidium hominis
IDVKRSTQYLIDYQQEY

SEQ ID NO: 2190976 - protein, 23 aa, Cryptosporidium hominis
IDVQNAMITFFHQTVYDPIEGNM

SEQ ID NO: 2190977 - protein, 21 aa, Cryptosporidium hominis
IDWISGDGFLENIKDSHFVDY

SEQ ID NO: 2190978 - protein, 24 aa, Cryptosporidium hominis
IDWKGHTLVVKRYASLYFVACIDK

SEQ ID NO: 2190979 - protein, 20 aa, Cryptosporidium hominis
IDWKPNPLCWDNLRKAFCSG

SEQ ID NO: 2190980 - protein, 20 aa, Cryptosporidium hominis
IDYKPPFFPKIRSSLQLSTF

SEQ ID NO: 2190981 - protein, 21 aa, Cryptosporidium hominis
IDYMVSYFRKYDLRGNGKISR

SEQ ID NO: 2190982 - protein, 28 aa, Cryptosporidium hominis
IDYQKLRTPFWIWLSVNDEWNYSLEWHP

SEQ ID NO: 2190983 - protein, 20 aa, Cryptosporidium hominis
IDYRLLSEICSEFKIFLVAD

SEQ ID NO: 2190984 - protein, 24 aa, Cryptosporidium hominis
IDYSLNACQVLLLAPTRELAQQIQ

SEQ ID NO: 2190985 - protein, 17 aa, Cryptosporidium hominis
IEALAYYELSEEDLLFF

SEQ ID NO: 2190986 - protein, 17 aa, Cryptosporidium hominis
IECLAYAPKKALLSVKG

SEQ ID NO: 2190987 - protein, 24 aa, Cryptosporidium hominis
IECNRPLFIPDFKSINITNEYCQF

SEQ ID NO: 2190988 - protein, 31 aa, Cryptosporidium hominis
IEDDKSLSLELILDSEIRKTEVLDNWSFGSN

SEQ ID NO: 2190989 - protein, 28 aa, Cryptosporidium hominis
IEDGEKYFNYWMLAKKFEFEKIVTRWTS

SEQ ID NO: 2190990 - protein, 17 aa, Cryptosporidium hominis
IEDIGWFGTLKSYNKSM

SEQ ID NO: 2190991 - protein, 24 aa, Cryptosporidium hominis
IEEAKLLLSLKLKYVKMLLSSSIN

SEQ ID NO: 2190992 - protein, 24 aa, Cryptosporidium hominis
IEECLILDFQLPRGDEILLAETPS

SEQ ID NO: 2190993 - protein, 25 aa, Cryptosporidium hominis
IEEENIILILNMPGWITGVGLEISS

SEQ ID NO: 2190994 - protein, 25 aa, Cryptosporidium hominis
IEEFSPYQVILAPFETNNLNLVAME

SEQ ID NO: 2190995 - protein, 25 aa, Cryptosporidium hominis
IEELIEFLPKERQILLYSATFPVTV

SEQ ID NO: 2190996 - protein, 17 aa, Cryptosporidium hominis
IEENLIAFITKRPDLFG

SEQ ID NO: 2190997 - protein, 32 aa, Cryptosporidium hominis
IEEVDHFFTFMEQLLYNEIVGSAGLFDKVLEG

SEQ ID NO: 2190998 - protein, 22 aa, Cryptosporidium hominis
IEEYRWKFYQSDPGNWNNLHLE

SEQ ID NO: 2190999 - protein, 18 aa, Cryptosporidium hominis
IEFKPYNYIAVFPDILLK

SEQ ID NO: 2191000 - protein, 18 aa, Cryptosporidium hominis
IEFLESENTLRAFNRMST

SEQ ID NO: 2191001 - protein, 21 aa, Cryptosporidium hominis
IEFLKKKLYTLKNQQLIVSSE

SEQ ID NO: 2191002 - protein, 37 aa, Cryptosporidium hominis
IEGFHQFFPGLNMGGEYIGGLLPGALAAAGVNIGGGI

SEQ ID NO: 2191003 - protein, 23 aa, Cryptosporidium hominis
IEHHYITILLTWKVKEETKTMDY

SEQ ID NO: 2191004 - protein, 20 aa, Cryptosporidium hominis
IEHILLRICSRNIDLLRSSS

SEQ ID NO: 2191005 - protein, 25 aa, Cryptosporidium hominis
IEHLHSLVFDAFHLLSTGKSQLNDG

SEQ ID NO: 2191006 - protein, 26 aa, Cryptosporidium hominis
IEIGNILSHHYLFYPKNIQVMDLKEN

SEQ ID NO: 2191007 - protein, 27 aa, Cryptosporidium hominis
IEIIGGCSRIPWVQRAIGAAFNDKELC

SEQ ID NO: 2191008 - protein, 31 aa, Cryptosporidium hominis
IEIIRIVLEGSYYISILLSPFITLACKEVFN

SEQ ID NO: 2191009 - protein, 18 aa, Cryptosporidium hominis
IEIKGQKKGLFRAKKKSL

SEQ ID NO: 2191010 - protein, 24 aa, Cryptosporidium hominis
IEILKYSPLSQAVSALFIAKECLG

SEQ ID NO: 2191011 - protein, 18 aa, Cryptosporidium hominis
IEILLDNGHLLNKVVKGK

SEQ ID NO: 2191012 - protein, 19 aa, Cryptosporidium hominis
IEINSLHQNPLLSASQQSP

SEQ ID NO: 2191013 - protein, 17 aa, Cryptosporidium hominis
IEIPKFNDSMDLGFLSK

SEQ ID NO: 2191014 - protein, 22 aa, Cryptosporidium hominis
IEIRNIHIKSEKGFPFLNFQYN

SEQ ID NO: 2191015 - protein, 33 aa, Cryptosporidium hominis
IEITPIPIEKMLDKYTRMIYDYNSGLLLDSNDE

SEQ ID NO: 2191016 - protein, 25 aa, Cryptosporidium hominis
IEKAELQHKILGYEKIRAFKCISTP

SEQ ID NO: 2191017 - protein, 24 aa, Cryptosporidium hominis
IEKETVFPGINRYDPGNLRPSFSP

SEQ ID NO: 2191018 - protein, 29 aa, Cryptosporidium hominis
IEKFQTTQVPLFLLSTKAAGQGLNLTVAS

SEQ ID NO: 2191019 - protein, 18 aa, Cryptosporidium hominis
IEKFWLDCELETSVELSG

SEQ ID NO: 2191020 - protein, 19 aa, Cryptosporidium hominis
IEKIFRLKSTLSTSNMTLF

SEQ ID NO: 2191021 - protein, 19 aa, Cryptosporidium hominis
IEKILKAAAFMQQLKGIIR

SEQ ID NO: 2191022 - protein, 29 aa, Cryptosporidium hominis
IEKISRHLIMNFGYTDLLLRFTTPNGTLD

SEQ ID NO: 2191023 - protein, 21 aa, Cryptosporidium hominis
IEKLNLLYRMASIDTANNLLK

SEQ ID NO: 2191024 - protein, 27 aa, Cryptosporidium hominis
IEKMVRCPAQLYFIKRRIENIKENIEN

SEQ ID NO: 2191025 - protein, 33 aa, Cryptosporidium hominis
IEKRKVSLQKGLSLQMNPTMTALTYQLDEKAPE

SEQ ID NO: 2191026 - protein, 27 aa, Cryptosporidium hominis
IELGKPMFHIGFITTVLKLLRCVCYAC

SEQ ID NO: 2191027 - protein, 17 aa, Cryptosporidium hominis
IELKIQDINDLKERIKN

SEQ ID NO: 2191028 - protein, 22 aa, Cryptosporidium hominis
IELPIRIDIAEFTKLLLHVQKS

SEQ ID NO: 2191029 - protein, 17 aa, Cryptosporidium hominis
IELVEAQALLSRRTSNK

SEQ ID NO: 2191030 - protein, 25 aa, Cryptosporidium hominis
IEMFKDSLFFIIFDEADRLLEDCFI

SEQ ID NO: 2191031 - protein, 18 aa, Cryptosporidium hominis
IEMLTFYAIEICFKKIDS

SEQ ID NO: 2191032 - protein, 25 aa, Cryptosporidium hominis
IEMTKPNDFSFLLNSDINDGNDFLH

SEQ ID NO: 2191033 - protein, 21 aa, Cryptosporidium hominis
IEMVSSIKLWVQLNIPQIQDG

SEQ ID NO: 2191034 - protein, 29 aa, Cryptosporidium hominis
IENDFPIRKLQYSPLGSYLLVLTVFEQGK

SEQ ID NO: 2191035 - protein, 32 aa, Cryptosporidium hominis
IENDVFYLDDGAGYITFNSSKLDFSEMEKRSK

SEQ ID NO: 2191036 - protein, 19 aa, Cryptosporidium hominis
IENEKIPLHILAKVSKSHS

SEQ ID NO: 2191037 - protein, 26 aa, Cryptosporidium hominis
IENNIKYIFDGPLSFDTIMALKKKKS

SEQ ID NO: 2191038 - protein, 28 aa, Cryptosporidium hominis
IENRFPAILRRFYLDFFSFCCKDDFGEV

SEQ ID NO: 2191039 - protein, 32 aa, Cryptosporidium hominis
IENRQIIRTLIQRWVRLISKDRPPSLETIDKV

SEQ ID NO: 2191040 - protein, 18 aa, Cryptosporidium hominis
IENSKIIHVIKTLKTDLS

SEQ ID NO: 2191041 - protein, 26 aa, Cryptosporidium hominis
IEPKRIQDLPLMLRGLELLSRSDPCI

SEQ ID NO: 2191042 - protein, 20 aa, Cryptosporidium hominis
IEQEFKFISKLKLHDSFGPK

SEQ ID NO: 2191043 - protein, 22 aa, Cryptosporidium hominis
IEQFYWERLPRFVGFEELPWRE

SEQ ID NO: 2191044 - protein, 43 aa, Cryptosporidium hominis
IEQGKIQSKLPATHQLYNLDFSLYSKIGNWYLPNLGKDYVNKP

SEQ ID NO: 2191045 - protein, 30 aa, Cryptosporidium hominis
IEQLKSYLKEKLYFQFLESSLEYISTDGLK

SEQ ID NO: 2191046 - protein, 21 aa, Cryptosporidium hominis
IEQYSLRSLFFLKKSNSDFGF

SEQ ID NO: 2191047 - protein, 19 aa, Cryptosporidium hominis
IERALGEGAVFNPFFNINS

SEQ ID NO: 2191048 - protein, 18 aa, Cryptosporidium hominis
IERDRIIELLKSLQYKSV

SEQ ID NO: 2191049 - protein, 21 aa, Cryptosporidium hominis
IEREEFFRLKKIQEKKKEWAE

SEQ ID NO: 2191050 - protein, 18 aa, Cryptosporidium hominis
IERNNCVFVFNFSEKYYN

SEQ ID NO: 2191051 - protein, 26 aa, Cryptosporidium hominis
IERQKLHFFELRLARYLSYCVDGGLL

SEQ ID NO: 2191052 - protein, 18 aa, Cryptosporidium hominis
IERVKFLRKKFTPEELLN

SEQ ID NO: 2191053 - protein, 20 aa, Cryptosporidium hominis
IESARRLGVLSKIKIGRNTH

SEQ ID NO: 2191054 - protein, 27 aa, Cryptosporidium hominis
IESDVIKFFIVSYFNIVRKNVADSVPK

SEQ ID NO: 2191055 - protein, 25 aa, Cryptosporidium hominis
IESGKKPFFLKQKDINISIQHDKYK

SEQ ID NO: 2191056 - protein, 25 aa, Cryptosporidium hominis
IESKDFQHRFVFFPSSTIHTKSLNQ

SEQ ID NO: 2191057 - protein, 29 aa, Cryptosporidium hominis
IESQQKLPTYYKFPFIPNNSFSNCYKSFN

SEQ ID NO: 2191058 - protein, 28 aa, Cryptosporidium hominis
IESVCNVVLLPYNYLLDSITRQNLKIDL

SEQ ID NO: 2191059 - protein, 21 aa, Cryptosporidium hominis
IETDFKLSIPILIELIKKDNL

SEQ ID NO: 2191060 - protein, 21 aa, Cryptosporidium hominis
IETLLIFSLSDEKWSLLPNIS

SEQ ID NO: 2191061 - protein, 27 aa, Cryptosporidium hominis
IEVGKKVIISPLNLELLDNGSNYSKTQ

SEQ ID NO: 2191062 - protein, 27 aa, Cryptosporidium hominis
IEVILGIPEYVSLMPYYTSLCYPIQDH

SEQ ID NO: 2191063 - protein, 22 aa, Cryptosporidium hominis
IEYDFCKMVSKKSKLDDSDSKY

SEQ ID NO: 2191064 - protein, 32 aa, Cryptosporidium hominis
IEYIYSKISDVKLILENPKYIKSQLEKHKVSK

SEQ ID NO: 2191065 - protein, 29 aa, Cryptosporidium hominis
IEYTNINMYWIYYRIFHGIPFELFEICQI

SEQ ID NO: 2191066 - protein, 17 aa, Cryptosporidium hominis
IFCKILVQMIIYSQQLF

SEQ ID NO: 2191067 - protein, 17 aa, Cryptosporidium hominis
IFCLRDCQPFAKFACLR

SEQ ID NO: 2191068 - protein, 31 aa, Cryptosporidium hominis
IFDKNACIALNDSFVKLISWYDNESGYSNRL

SEQ ID NO: 2191069 - protein, 21 aa, Cryptosporidium hominis
IFDLDYVTMFPIILRELLKDL

SEQ ID NO: 2191070 - protein, 19 aa, Cryptosporidium hominis
IFDLPGSIIIKLDLGKFGG

SEQ ID NO: 2191071 - protein, 32 aa, Cryptosporidium hominis
IFDSINIHPNPNKLSWKLVRNNKYGKIISDQK

SEQ ID NO: 2191072 - protein, 23 aa, Cryptosporidium hominis
IFEDPIFSCKLNISFSKLRQMVW

SEQ ID NO: 2191073 - protein, 23 aa, Cryptosporidium hominis
IFEKDILVLFPSFSDTHMILEIQ

SEQ ID NO: 2191074 - protein, 17 aa, Cryptosporidium hominis
IFELVKNIKNSKNDKCS

SEQ ID NO: 2191075 - protein, 27 aa, Cryptosporidium hominis
IFESLDLAWELLRTFPEDMLKKIKHDL

SEQ ID NO: 2191076 - protein, 18 aa, Cryptosporidium hominis
IFEWSQLNFLTSGASPPI

SEQ ID NO: 2191077 - protein, 17 aa, Cryptosporidium hominis
IFGKPDKCEVAKNKLSN

SEQ ID NO: 2191078 - protein, 29 aa, Cryptosporidium hominis
IFGSFIMTNFRIILAPLFQKNINNKALTI

SEQ ID NO: 2191079 - protein, 17 aa, Cryptosporidium hominis
IFGVPGDYALSFLNVVM

SEQ ID NO: 2191080 - protein, 26 aa, Cryptosporidium hominis
IFHDNTVTWLAYYRDSINNQFKYIFL

SEQ ID NO: 2191081 - protein, 19 aa, Cryptosporidium hominis
IFIQWLDCVYQCYNQFPTE

SEQ ID NO: 2191082 - protein, 24 aa, Cryptosporidium hominis
IFKQDWTLFVIISTGIPEYEDNSN

SEQ ID NO: 2191083 - protein, 18 aa, Cryptosporidium hominis
IFLKSALELLHPFEYDNM

SEQ ID NO: 2191084 - protein, 21 aa, Cryptosporidium hominis
IFLRNSILQIFRNFTDLIGSN

SEQ ID NO: 2191085 - protein, 33 aa, Cryptosporidium hominis
IFPNQHMLSKIPLKLAYFNISKFWEEAEKAVKV

SEQ ID NO: 2191086 - protein, 26 aa, Cryptosporidium hominis
IFQENLELFLRNCELNREVGWREVEN

SEQ ID NO: 2191087 - protein, 19 aa, Cryptosporidium hominis
IFQFIHKIAIILVTCAPEL

SEQ ID NO: 2191088 - protein, 18 aa, Cryptosporidium hominis
IFQNIAHLVIDEADLLFA

SEQ ID NO: 2191089 - protein, 20 aa, Cryptosporidium hominis
IFQNLKVPFNKSIEYSLNLE

SEQ ID NO: 2191090 - protein, 17 aa, Cryptosporidium hominis
IFRGHRKMLCGLPNQNI

SEQ ID NO: 2191091 - protein, 17 aa, Cryptosporidium hominis
IFSHYISHYFKAVASEH

SEQ ID NO: 2191092 - protein, 19 aa, Cryptosporidium hominis
IFSIEYSLTKLWESKGIVP

SEQ ID NO: 2191093 - protein, 17 aa, Cryptosporidium hominis
IFSPLNPIQFKISRYFL

SEQ ID NO: 2191094 - protein, 17 aa, Cryptosporidium hominis
IFTLYHNNFKKNIGDYC

SEQ ID NO: 2191095 - protein, 18 aa, Cryptosporidium hominis
IFTPKLIESLAGLPIKEI

SEQ ID NO: 2191096 - protein, 17 aa, Cryptosporidium hominis
IFYCIQYVNRFGEYHEP

SEQ ID NO: 2191097 - protein, 18 aa, Cryptosporidium hominis
IGAYFTLVLDSDSQLFVW

SEQ ID NO: 2191098 - protein, 17 aa, Cryptosporidium hominis
IGAYLARLGHRVIQKAH

SEQ ID NO: 2191099 - protein, 24 aa, Cryptosporidium hominis
IGCCNTDWHFLQAKFGFENFTSYT

SEQ ID NO: 2191100 - protein, 19 aa, Cryptosporidium hominis
IGCQWHPVFPSRIASCGWD

SEQ ID NO: 2191101 - protein, 17 aa, Cryptosporidium hominis
IGDEYFCFLTESKTPKA

SEQ ID NO: 2191102 - protein, 17 aa, Cryptosporidium hominis
IGDYPLCSEWISLGSQN

SEQ ID NO: 2191103 - protein, 17 aa, Cryptosporidium hominis
IGEGIPSYILDLPNEVM

SEQ ID NO: 2191104 - protein, 24 aa, Cryptosporidium hominis
IGELNFNELFIKFSLNILTEVYKK

SEQ ID NO: 2191105 - protein, 24 aa, Cryptosporidium hominis
IGESWPFDQYQATGLLPVDYAYWL

SEQ ID NO: 2191106 - protein, 19 aa, Cryptosporidium hominis
IGEVIIEIMLYFGKYYQND

SEQ ID NO: 2191107 - protein, 33 aa, Cryptosporidium hominis
IGFNLYPSLAKFPLFIQDTLKVLTLPYSSTFIG

SEQ ID NO: 2191108 - protein, 22 aa, Cryptosporidium hominis
IGGPSSIFEMRLSPSMNELKNE

SEQ ID NO: 2191109 - protein, 34 aa, Cryptosporidium hominis
IGGVPQWEMLMLEYHILKILNWDLSINYHEFKKT

SEQ ID NO: 2191110 - protein, 23 aa, Cryptosporidium hominis
IGGYYYQYNMGEKVYKINDNNNN

SEQ ID NO: 2191111 - protein, 18 aa, Cryptosporidium hominis
IGHAKAALLNYYYANKYE

SEQ ID NO: 2191112 - protein, 24 aa, Cryptosporidium hominis
IGHDYIDINLLNKDVKLIPELFWD

SEQ ID NO: 2191113 - protein, 22 aa, Cryptosporidium hominis
IGITLFDRFIRLNNKHGLINCD

SEQ ID NO: 2191114 - protein, 17 aa, Cryptosporidium hominis
IGIWNIRTGKCLKRLSA

SEQ ID NO: 2191115 - protein, 25 aa, Cryptosporidium hominis
IGKFPFKVTPFFFFKKNNLGIHNIF

SEQ ID NO: 2191116 - protein, 18 aa, Cryptosporidium hominis
IGKIFCCHARTRFIDSIK

SEQ ID NO: 2191117 - protein, 18 aa, Cryptosporidium hominis
IGKKYRKLSLLIHPDKTS

SEQ ID NO: 2191118 - protein, 34 aa, Cryptosporidium hominis
IGKRLTFPSFFPIKQFFFCFFIEESLEANIKEIE

SEQ ID NO: 2191119 - protein, 18 aa, Cryptosporidium hominis
IGKSLIPYKKNSFHNNEV

SEQ ID NO: 2191120 - protein, 23 aa, Cryptosporidium hominis
IGKVIIKIPTPFKYLELDMENHK

SEQ ID NO: 2191121 - protein, 18 aa, Cryptosporidium hominis
IGKYTFLENIRSSSFILF

SEQ ID NO: 2191122 - protein, 25 aa, Cryptosporidium hominis
IGLDFSLIKILPYINGINTSFEISR

SEQ ID NO: 2191123 - protein, 19 aa, Cryptosporidium hominis
IGLERVIMLFLNLGNIRKS

SEQ ID NO: 2191124 - protein, 25 aa, Cryptosporidium hominis
IGLHKIFQVLRRIIVFYSSFNEVFE

SEQ ID NO: 2191125 - protein, 17 aa, Cryptosporidium hominis
IGLIDEVLKMRDEWNYE

SEQ ID NO: 2191126 - protein, 23 aa, Cryptosporidium hominis
IGLKTIWVGGVCDPGAFFTASKQ

SEQ ID NO: 2191127 - protein, 18 aa, Cryptosporidium hominis
IGLLSRIVIFRREEYIRK

SEQ ID NO: 2191128 - protein, 22 aa, Cryptosporidium hominis
IGLSRLGLYLMNSKLQSLIQIQ

SEQ ID NO: 2191129 - protein, 20 aa, Cryptosporidium hominis
IGMGGGHCMDIAKVLRVLYE

SEQ ID NO: 2191130 - protein, 26 aa, Cryptosporidium hominis
IGMGMGNRIIPGISPGVIHPKSTVGG

SEQ ID NO: 2191131 - protein, 19 aa, Cryptosporidium hominis
IGNLQLVRQLIASSKFNAN

SEQ ID NO: 2191132 - protein, 17 aa, Cryptosporidium hominis
IGPFHKSFTAIVGPNGS

SEQ ID NO: 2191133 - protein, 25 aa, Cryptosporidium hominis
IGPNWGEYFAIQIFNQLIVCSVGEE

SEQ ID NO: 2191134 - protein, 17 aa, Cryptosporidium hominis
IGQLINFDKISQSLKNP

SEQ ID NO: 2191135 - protein, 31 aa, Cryptosporidium hominis
IGQNRPKWWQLCFCKPIISVTLFARIISDEI

SEQ ID NO: 2191136 - protein, 28 aa, Cryptosporidium hominis
IGQVLEIIFNFLVLFKATPVIPELVGEF

SEQ ID NO: 2191137 - protein, 27 aa, Cryptosporidium hominis
IGSGWHYYHQILNQYKPCQSMIQFKYY

SEQ ID NO: 2191138 - protein, 25 aa, Cryptosporidium hominis
IGSMLPWFVNLSLKLNAHVLAYDYR

SEQ ID NO: 2191139 - protein, 26 aa, Cryptosporidium hominis
IGSSRWKYPIVDMSELLVIGWEALKK

SEQ ID NO: 2191140 - protein, 28 aa, Cryptosporidium hominis
IGSTENYLKLWLYGFLQRKESCRNALRQ

SEQ ID NO: 2191141 - protein, 18 aa, Cryptosporidium hominis
IGTPGRIIALIRQKKLVT

SEQ ID NO: 2191142 - protein, 18 aa, Cryptosporidium hominis
IGVDRFSNKYFLFNNINT

SEQ ID NO: 2191143 - protein, 20 aa, Cryptosporidium hominis
IGVFIDFVPAHFCKDAWGLV

SEQ ID NO: 2191144 - protein, 17 aa, Cryptosporidium hominis
IGVHRKFQFRPATIHIG

SEQ ID NO: 2191145 - protein, 19 aa, Cryptosporidium hominis
IGYDPRFAERIIKVVERPK

SEQ ID NO: 2191146 - protein, 23 aa, Cryptosporidium hominis
IGYSFCRLLVRKTHNLFGFKFLN

SEQ ID NO: 2191147 - protein, 27 aa, Cryptosporidium hominis
IHASGFRDFFLKPELIRAIGDAGFEHP

SEQ ID NO: 2191148 - protein, 32 aa, Cryptosporidium hominis
IHCSFRFVNIVRYFRYFRKCFGIISNLIKDEN

SEQ ID NO: 2191149 - protein, 21 aa, Cryptosporidium hominis
IHEDKIHGIYVKDLSEYFVTS

SEQ ID NO: 2191150 - protein, 26 aa, Cryptosporidium hominis
IHEGIIDLYILRYGIKDRLIPDLSPI

SEQ ID NO: 2191151 - protein, 31 aa, Cryptosporidium hominis
IHEYKRQLLNLFYIIHRYLTLKHISPEERKK

SEQ ID NO: 2191152 - protein, 19 aa, Cryptosporidium hominis
IHFRRKYAPQFISPRNISS

SEQ ID NO: 2191153 - protein, 17 aa, Cryptosporidium hominis
IHGILFNIPDSLILEYF

SEQ ID NO: 2191154 - protein, 19 aa, Cryptosporidium hominis
IHGPRFRLCNNNPPRILIC

SEQ ID NO: 2191155 - protein, 26 aa, Cryptosporidium hominis
IHGQFFDLLNIFDINGLPSVNNGYLF

SEQ ID NO: 2191156 - protein, 17 aa, Cryptosporidium hominis
IHILLQAQELNIPTIFA

SEQ ID NO: 2191157 - protein, 17 aa, Cryptosporidium hominis
IHKDLINEFKHALVWGT

SEQ ID NO: 2191158 - protein, 33 aa, Cryptosporidium hominis
IHKESNIVKFFPRYLIYYPQITSQPLNFPIPMD

SEQ ID NO: 2191159 - protein, 23 aa, Cryptosporidium hominis
IHKIFMKIQLYYIHLKFVILVFI

SEQ ID NO: 2191160 - protein, 17 aa, Cryptosporidium hominis
IHMISFTIAPYSDQNKP

SEQ ID NO: 2191161 - protein, 23 aa, Cryptosporidium hominis
IHPKTRFYSLSSGKLLLVQNFRI

SEQ ID NO: 2191162 - protein, 18 aa, Cryptosporidium hominis
IHQMTSFPSFRNYEQNFQ

SEQ ID NO: 2191163 - protein, 20 aa, Cryptosporidium hominis
IHQNINAYPQIYSNINHLQY

SEQ ID NO: 2191164 - protein, 22 aa, Cryptosporidium hominis
IHQQQLMLLNAIQQQHIKQQQQ

SEQ ID NO: 2191165 - protein, 32 aa, Cryptosporidium hominis
IHQTSGVDLLLSYILHRLFDTPFTDEDGKILK

SEQ ID NO: 2191166 - protein, 17 aa, Cryptosporidium hominis
IHRLYSSANSRISSVSS

SEQ ID NO: 2191167 - protein, 18 aa, Cryptosporidium hominis
IHRRNAILPITKQNLLKL

SEQ ID NO: 2191168 - protein, 25 aa, Cryptosporidium hominis
IHSGGNFFGGYIHANRIKVPGENGI

SEQ ID NO: 2191169 - protein, 27 aa, Cryptosporidium hominis
IHSIIRSIYIRIFNWVVSHINRFTSCK

SEQ ID NO: 2191170 - protein, 36 aa, Cryptosporidium hominis
IHSRKIKTYPWTELAKKLILCTKRKKKDGKLFSSGF

SEQ ID NO: 2191171 - protein, 30 aa, Cryptosporidium hominis
IHSYKNFNFRIMILPKVKLTSGGSLEGHIS

SEQ ID NO: 2191172 - protein, 22 aa, Cryptosporidium hominis
IHVAQMKIGNSFFPFSITVLEE

SEQ ID NO: 2191173 - protein, 24 aa, Cryptosporidium hominis
IHVVYYWFEFVITNMLAWNRVEQW

SEQ ID NO: 2191174 - protein, 28 aa, Cryptosporidium hominis
IHYKKKRLVILLRIYSIKQAKAIKIQRV

SEQ ID NO: 2191175 - protein, 17 aa, Cryptosporidium hominis
IIALTTMTKAFRFIEIS

SEQ ID NO: 2191176 - protein, 18 aa, Cryptosporidium hominis
IIARDMIRRAIALDMEKI

SEQ ID NO: 2191177 - protein, 26 aa, Cryptosporidium hominis
IICRRDLYLLLYYTNELYLYIQSIIY

SEQ ID NO: 2191178 - protein, 25 aa, Cryptosporidium hominis
IIDFERLIMVQLGSSGGIIVDSNTG

SEQ ID NO: 2191179 - protein, 36 aa, Cryptosporidium hominis
IIDIMTLLHKKIVIFQFISFLVIDEGDRLFDMGFAP

SEQ ID NO: 2191180 - protein, 23 aa, Cryptosporidium hominis
IIDPNLCEKIDPIKAIITSSDSY

SEQ ID NO: 2191181 - protein, 25 aa, Cryptosporidium hominis
IIDSLIPFLVPILDNNPINKSFINQ

SEQ ID NO: 2191182 - protein, 24 aa, Cryptosporidium hominis
IIDSTMFLLCIDIKNGEILLNNIN

SEQ ID NO: 2191183 - protein, 23 aa, Cryptosporidium hominis
IIEFIFSCLKTIYPLNSKLLEAI

SEQ ID NO: 2191184 - protein, 27 aa, Cryptosporidium hominis
IIELCRPFINFSFFKKTPVPLSSAILS

SEQ ID NO: 2191185 - protein, 18 aa, Cryptosporidium hominis
IIEYGAGNAILSYWFIKE

SEQ ID NO: 2191186 - protein, 32 aa, Cryptosporidium hominis
IIFKQSQFRHDLVFTLLRQTLQYYENVKNSYL

SEQ ID NO: 2191187 - protein, 20 aa, Cryptosporidium hominis
IIGNVYFHDELDDINLERKN

SEQ ID NO: 2191188 - protein, 19 aa, Cryptosporidium hominis
IIGPCLGSIYQNNLVSGTE

SEQ ID NO: 2191189 - protein, 28 aa, Cryptosporidium hominis
IIGTGKLRYYVFNWKIPQISPSNVGIIL

SEQ ID NO: 2191190 - protein, 17 aa, Cryptosporidium hominis
IIGTLSRFPSEKKCCIR

SEQ ID NO: 2191191 - protein, 17 aa, Cryptosporidium hominis
IIGVLDSAIWSVASHPK

SEQ ID NO: 2191192 - protein, 19 aa, Cryptosporidium hominis
IIHQLVHISCMIEEYGEKN

SEQ ID NO: 2191193 - protein, 17 aa, Cryptosporidium hominis
IIHVIKTLKTDLSQKNK

SEQ ID NO: 2191194 - protein, 17 aa, Cryptosporidium hominis
IIILFRSNRHDQALNYI

SEQ ID NO: 2191195 - protein, 17 aa, Cryptosporidium hominis
IIIRPKGDTKLLFANAN

SEQ ID NO: 2191196 - protein, 19 aa, Cryptosporidium hominis
IIKEHFILPIGINGKIAIV

SEQ ID NO: 2191197 - protein, 18 aa, Cryptosporidium hominis
IIKETLCYIAKDPAAENE

SEQ ID NO: 2191198 - protein, 20 aa, Cryptosporidium hominis
IIKFLKIKNEFQNKIISNIC

SEQ ID NO: 2191199 - protein, 19 aa, Cryptosporidium hominis
IIKFPKLRVLLDPEGIPCN

SEQ ID NO: 2191200 - protein, 26 aa, Cryptosporidium hominis
IIKGIQSIFLGMPFKFEDNSQISDIT

SEQ ID NO: 2191201 - protein, 18 aa, Cryptosporidium hominis
IIKKIFSSSIHLLRLSFS

SEQ ID NO: 2191202 - protein, 20 aa, Cryptosporidium hominis
IIKLINSFISFIAPRKKLKL

SEQ ID NO: 2191203 - protein, 18 aa, Cryptosporidium hominis
IIKLTRLQRMGTIWCNSI

SEQ ID NO: 2191204 - protein, 30 aa, Cryptosporidium hominis
IILNDWIVGKIPYFIPPPQSSSEFAIQEST

SEQ ID NO: 2191205 - protein, 18 aa, Cryptosporidium hominis
IILRDLELPEGCRSIRSL

SEQ ID NO: 2191206 - protein, 19 aa, Cryptosporidium hominis
IILTVKWPYQEPEIIFYHP

SEQ ID NO: 2191207 - protein, 26 aa, Cryptosporidium hominis
IIMGEIDIFLALKLYLVQRESSMGLL

SEQ ID NO: 2191208 - protein, 19 aa, Cryptosporidium hominis
IINKCATLFSIYLASLSCS

SEQ ID NO: 2191209 - protein, 24 aa, Cryptosporidium hominis
IINLCNIIFNRLPELILEQMERST

SEQ ID NO: 2191210 - protein, 26 aa, Cryptosporidium hominis
IINNNSLIFQKLKYKLIKSKYSGDNN

SEQ ID NO: 2191211 - protein, 19 aa, Cryptosporidium hominis
IINPCYLILDCGYQCCFSV

SEQ ID NO: 2191212 - protein, 18 aa, Cryptosporidium hominis
IINQLQYHDRIYMGMSPT

SEQ ID NO: 2191213 - protein, 18 aa, Cryptosporidium hominis
IIPGIFLGGSTIANDLKK

SEQ ID NO: 2191214 - protein, 24 aa, Cryptosporidium hominis
IIQNSSLLLSGYLSGTPAQSNSRK

SEQ ID NO: 2191215 - protein, 34 aa, Cryptosporidium hominis
IIRDIEEFVIRPLKLPDIYKAVGVNSPCGVLLQG

SEQ ID NO: 2191216 - protein, 23 aa, Cryptosporidium hominis
IIRIEVVGILIYAILAVPMSSKY

SEQ ID NO: 2191217 - protein, 25 aa, Cryptosporidium hominis
IIRNYLKLKYLVLRIIFNTNKTRLE

SEQ ID NO: 2191218 - protein, 18 aa, Cryptosporidium hominis
IIRPYPPLNDIPGSFSSQ

SEQ ID NO: 2191219 - protein, 19 aa, Cryptosporidium hominis
IIRVKRILSYQLTSLYENS

SEQ ID NO: 2191220 - protein, 30 aa, Cryptosporidium hominis
IISCYSTIVFPPCPILLFSLHDINSNYQNK

SEQ ID NO: 2191221 - protein, 26 aa, Cryptosporidium hominis
IISHTVDWVCYYLSAGIALRFISNIK

SEQ ID NO: 2191222 - protein, 18 aa, Cryptosporidium hominis
IISKIRTLEYYEIPKVER

SEQ ID NO: 2191223 - protein, 26 aa, Cryptosporidium hominis
IISNHYYDIFVSFPPIFEASSHLHIF

SEQ ID NO: 2191224 - protein, 32 aa, Cryptosporidium hominis
IISPRVPLLFIQKNLFRLGWFEPNLSLINIPF

SEQ ID NO: 2191225 - protein, 20 aa, Cryptosporidium hominis
IISRILDNFCKCVDEFYSSI

SEQ ID NO: 2191226 - protein, 17 aa, Cryptosporidium hominis
IISYNYHLFKLISPKLA

SEQ ID NO: 2191227 - protein, 19 aa, Cryptosporidium hominis
IITCDSPTSFYLYSQPNIS

SEQ ID NO: 2191228 - protein, 17 aa, Cryptosporidium hominis
IITGFSAVFLLSTSIDP

SEQ ID NO: 2191229 - protein, 39 aa, Cryptosporidium hominis
IITGTDIPIVFKLIGRFINGIFPIISKNQPIKYSNNQYT

SEQ ID NO: 2191230 - protein, 17 aa, Cryptosporidium hominis
IITSMKNKLTKMILSED

SEQ ID NO: 2191231 - protein, 17 aa, Cryptosporidium hominis
IITSRILLTDLLSEKLD

SEQ ID NO: 2191232 - protein, 26 aa, Cryptosporidium hominis
IIVDILCEFADFFVDLASNVAARTGK

SEQ ID NO: 2191233 - protein, 23 aa, Cryptosporidium hominis
IIVKSIKFIPNSTKVWMVAANRE

SEQ ID NO: 2191234 - protein, 17 aa, Cryptosporidium hominis
IIVKTLCALLAKNDVDR

SEQ ID NO: 2191235 - protein, 23 aa, Cryptosporidium hominis
IIVSEWMGFYLLHEGMLDSVIFA

SEQ ID NO: 2191236 - protein, 20 aa, Cryptosporidium hominis
IKAEMKFWDKYNPVLDNTFE

SEQ ID NO: 2191237 - protein, 28 aa, Cryptosporidium hominis
IKAETTPLLLRVDGLVGLLARIRRDEIE

SEQ ID NO: 2191238 - protein, 25 aa, Cryptosporidium hominis
IKDHIHVILIILTNILYLNHNIMKI

SEQ ID NO: 2191239 - protein, 30 aa, Cryptosporidium hominis
IKDLALIGYDPYYLSKAMKILIQKGDLIER

SEQ ID NO: 2191240 - protein, 25 aa, Cryptosporidium hominis
IKDPFPICRKAAIQALLSTIHFYSP

SEQ ID NO: 2191241 - protein, 23 aa, Cryptosporidium hominis
IKDQSILLYLSRYVEYKTNNNPK

SEQ ID NO: 2191242 - protein, 22 aa, Cryptosporidium hominis
IKDWKLSRVWSKELIEYTWLSK

SEQ ID NO: 2191243 - protein, 18 aa, Cryptosporidium hominis
IKECCEILNLKISNLNND

SEQ ID NO: 2191244 - protein, 19 aa, Cryptosporidium hominis
IKEDSGVFDINNITKSSSM

SEQ ID NO: 2191245 - protein, 19 aa, Cryptosporidium hominis
IKEKKKLIIQEDFVKGIID

SEQ ID NO: 2191246 - protein, 18 aa, Cryptosporidium hominis
IKEKNVLLRIPRGTKDGT

SEQ ID NO: 2191247 - protein, 21 aa, Cryptosporidium hominis
IKELIFLQDLDLKLLKELFNA

SEQ ID NO: 2191248 - protein, 21 aa, Cryptosporidium hominis
IKERKVFIHKGGKFIYNYNSR

SEQ ID NO: 2191249 - protein, 20 aa, Cryptosporidium hominis
IKESDLLIQSSPLFDSDENV

SEQ ID NO: 2191250 - protein, 23 aa, Cryptosporidium hominis
IKESRLFPVGFKKEFCTFLEKPQ

SEQ ID NO: 2191251 - protein, 24 aa, Cryptosporidium hominis
IKETDIGLLLFQYSDDWPTRIDGS

SEQ ID NO: 2191252 - protein, 29 aa, Cryptosporidium hominis
IKETSKLPRHSPIPLLKKACSIRKIKIYF

SEQ ID NO: 2191253 - protein, 21 aa, Cryptosporidium hominis
IKEVFNQLRQIANSFSLHDNI

SEQ ID NO: 2191254 - protein, 19 aa, Cryptosporidium hominis
IKEVKVAMRALGFDPKKEE

SEQ ID NO: 2191255 - protein, 25 aa, Cryptosporidium hominis
IKEVNPYYYTILQDKQELLPLSEFD

SEQ ID NO: 2191256 - protein, 17 aa, Cryptosporidium hominis
IKFFGKPLKIQLKAGED

SEQ ID NO: 2191257 - protein, 23 aa, Cryptosporidium hominis
IKFIQYYSYWVPFHTISENRDSS

SEQ ID NO: 2191258 - protein, 21 aa, Cryptosporidium hominis
IKFKIRDICIWSILYERIKRT

SEQ ID NO: 2191259 - protein, 18 aa, Cryptosporidium hominis
IKFLVDFLHFVSTKSSIN

SEQ ID NO: 2191260 - protein, 19 aa, Cryptosporidium hominis
IKGIPRIPRRRSRSPSLEE

SEQ ID NO: 2191261 - protein, 17 aa, Cryptosporidium hominis
IKHAFFGYVFKINELVN

SEQ ID NO: 2191262 - protein, 26 aa, Cryptosporidium hominis
IKIDNIFCVTFTSSLFSLICLKLDGH

SEQ ID NO: 2191263 - protein, 19 aa, Cryptosporidium hominis
IKIHPSLDQAFLDVLARKT

SEQ ID NO: 2191264 - protein, 20 aa, Cryptosporidium hominis
IKIVLGYFDSDYYVVHRLIA

SEQ ID NO: 2191265 - protein, 25 aa, Cryptosporidium hominis
IKKAYHKLAIKWHPDKNMGNDRQMC

SEQ ID NO: 2191266 - protein, 29 aa, Cryptosporidium hominis
IKKFKHWFTYLGITNYILKVIKRLPPDII

SEQ ID NO: 2191267 - protein, 18 aa, Cryptosporidium hominis
IKKLLLKTKDQKLYSIGR

SEQ ID NO: 2191268 - protein, 17 aa, Cryptosporidium hominis
IKKNFYFIFNGKFDRET

SEQ ID NO: 2191269 - protein, 20 aa, Cryptosporidium hominis
IKKNKLEVLKLRAAESNQRK

SEQ ID NO: 2191270 - protein, 22 aa, Cryptosporidium hominis
IKKYLCCFLFHYIAEFQGVWVC

SEQ ID NO: 2191271 - protein, 31 aa, Cryptosporidium hominis
IKLDSQPPIINPLLQSPLLSIGSQPSIIHPN

SEQ ID NO: 2191272 - protein, 18 aa, Cryptosporidium hominis
IKLEFRVVPLTNGLLKLP

SEQ ID NO: 2191273 - protein, 18 aa, Cryptosporidium hominis
IKLFLIPGIDENTPLEPK

SEQ ID NO: 2191274 - protein, 27 aa, Cryptosporidium hominis
IKLKAEQFLVFLIKLIIKLREDEDQHM

SEQ ID NO: 2191275 - protein, 21 aa, Cryptosporidium hominis
IKLSIKLALLTKKKIKRKIQI

SEQ ID NO: 2191276 - protein, 17 aa, Cryptosporidium hominis
IKLTLQAFIKVFELSYF

SEQ ID NO: 2191277 - protein, 24 aa, Cryptosporidium hominis
IKNEIIWGFPIVPNITFIKGESNN

SEQ ID NO: 2191278 - protein, 18 aa, Cryptosporidium hominis
IKNELILFRLRFNSSNNQ

SEQ ID NO: 2191279 - protein, 30 aa, Cryptosporidium hominis
IKNFILNNKLNLFIILSNYIYITEDHQNEE

SEQ ID NO: 2191280 - protein, 19 aa, Cryptosporidium hominis
IKNGLPWCVSLTWSNDGKT

SEQ ID NO: 2191281 - protein, 20 aa, Cryptosporidium hominis
IKNINTLYYILSNNIISKLL

SEQ ID NO: 2191282 - protein, 18 aa, Cryptosporidium hominis
IKNLLFSTFNSKMSIIIC

SEQ ID NO: 2191283 - protein, 19 aa, Cryptosporidium hominis
IKNLLLINILRNKELIISY

SEQ ID NO: 2191284 - protein, 30 aa, Cryptosporidium hominis
IKNNKNYHLLPFKSLFRLGINENILQLLKC

SEQ ID NO: 2191285 - protein, 43 aa, Cryptosporidium hominis
IKNQQALLIYKYWRMRRHKLGKPLLRHFWPITSPHDSSPYACF

SEQ ID NO: 2191286 - protein, 23 aa, Cryptosporidium hominis
IKNYSHIYNTNYTNPFLSVSTND

SEQ ID NO: 2191287 - protein, 25 aa, Cryptosporidium hominis
IKPIRSLAKHPIHYSFLSAGADCIK

SEQ ID NO: 2191288 - protein, 19 aa, Cryptosporidium hominis
IKQFIKMKFILGTESEEFI

SEQ ID NO: 2191289 - protein, 17 aa, Cryptosporidium hominis
IKRYKRRSFHHKTSKKT

SEQ ID NO: 2191290 - protein, 17 aa, Cryptosporidium hominis
IKRYLELYCRTWGHERK

SEQ ID NO: 2191291 - protein, 18 aa, Cryptosporidium hominis
IKSFYNKYLDYYNEKLFN

SEQ ID NO: 2191292 - protein, 32 aa, Cryptosporidium hominis
IKSICLLKMYGKKLPIYLFDGSQLLIKIEPIF

SEQ ID NO: 2191293 - protein, 23 aa, Cryptosporidium hominis
IKSKIVYNYYKLRNIVGNKFPRK

SEQ ID NO: 2191294 - protein, 24 aa, Cryptosporidium hominis
IKSLKLIIVHLNHILLNVIKQKIV

SEQ ID NO: 2191295 - protein, 28 aa, Cryptosporidium hominis
IKSNFTFPPICLARRYFPRSISCPGILL

SEQ ID NO: 2191296 - protein, 24 aa, Cryptosporidium hominis
IKSQVKMDWLFDLDAFNIHKITHE

SEQ ID NO: 2191297 - protein, 27 aa, Cryptosporidium hominis
IKSSELIARYAILSKLILDSGIEESEE

SEQ ID NO: 2191298 - protein, 25 aa, Cryptosporidium hominis
IKSWFEYFEFLTTSELRTLLINQKK

SEQ ID NO: 2191299 - protein, 23 aa, Cryptosporidium hominis
IKTLRYILRPKLLTKPIVEPNNN

SEQ ID NO: 2191300 - protein, 24 aa, Cryptosporidium hominis
IKTPEIVYYNNTSNLRVLAKKGLL

SEQ ID NO: 2191301 - protein, 21 aa, Cryptosporidium hominis
IKTVLPFLDPNYSLFYYICDT

SEQ ID NO: 2191302 - protein, 21 aa, Cryptosporidium hominis
IKVETDFYYGFPLIENHPDNT

SEQ ID NO: 2191303 - protein, 25 aa, Cryptosporidium hominis
IKVMQWEKLLLLPHPCRKISPEALD

SEQ ID NO: 2191304 - protein, 20 aa, Cryptosporidium hominis
IKWEKLEPQSLLFLSVLMGP

SEQ ID NO: 2191305 - protein, 24 aa, Cryptosporidium hominis
IKYNELFEYIFTNYKKEQFNNIIS

SEQ ID NO: 2191306 - protein, 17 aa, Cryptosporidium hominis
ILAIYVSILFTSQDFKL

SEQ ID NO: 2191307 - protein, 17 aa, Cryptosporidium hominis
ILALERLKEVYSVKSRL

SEQ ID NO: 2191308 - protein, 20 aa, Cryptosporidium hominis
ILCMSILDKVSLYRENLRKS

SEQ ID NO: 2191309 - protein, 35 aa, Cryptosporidium hominis
ILDEALLRPGRLDQLIYIPLPDLPARVSVLQAILR

SEQ ID NO: 2191310 - protein, 18 aa, Cryptosporidium hominis
ILDEYIRLFDNLMVLAMD

SEQ ID NO: 2191311 - protein, 27 aa, Cryptosporidium hominis
ILDFHSVNFIKRKWFDIVFCLNSETHV

SEQ ID NO: 2191312 - protein, 35 aa, Cryptosporidium hominis
ILDGKVFHIVATPYNIYLFDTLCNLVSFQKITNKE

SEQ ID NO: 2191313 - protein, 23 aa, Cryptosporidium hominis
ILDIGCGYGGLLVWLSENFKDKL

SEQ ID NO: 2191314 - protein, 17 aa, Cryptosporidium hominis
ILDILNSKNLNREEKRT

SEQ ID NO: 2191315 - protein, 25 aa, Cryptosporidium hominis
ILDQSKIHPAILRLGMRMKDRKIVG

SEQ ID NO: 2191316 - protein, 18 aa, Cryptosporidium hominis
ILDRYINQVKIRNSAKSK

SEQ ID NO: 2191317 - protein, 18 aa, Cryptosporidium hominis
ILDYLKWMSSESHVIVVL

SEQ ID NO: 2191318 - protein, 18 aa, Cryptosporidium hominis
ILEEKLLLEFFERLEVIQ

SEQ ID NO: 2191319 - protein, 25 aa, Cryptosporidium hominis
ILEHNPDLWGAKRYTLKPPQVVRVG

SEQ ID NO: 2191320 - protein, 25 aa, Cryptosporidium hominis
ILELDSYLFSYGVKLPLEKDSNLIW

SEQ ID NO: 2191321 - protein, 29 aa, Cryptosporidium hominis
ILENGIGFFPLKSSYIWVITTKKTVSEKI

SEQ ID NO: 2191322 - protein, 18 aa, Cryptosporidium hominis
ILENHPNALVRFLCNLII

SEQ ID NO: 2191323 - protein, 24 aa, Cryptosporidium hominis
ILENKLYWNIYIDATILSFGGNMV

SEQ ID NO: 2191324 - protein, 17 aa, Cryptosporidium hominis
ILEPIKSISWHNSDVND

SEQ ID NO: 2191325 - protein, 18 aa, Cryptosporidium hominis
ILESSKFDFIQDPSPIRK

SEQ ID NO: 2191326 - protein, 17 aa, Cryptosporidium hominis
ILFKHTNPENLYENVLV

SEQ ID NO: 2191327 - protein, 27 aa, Cryptosporidium hominis
ILGAEKALFRALKTKKSTPKYGLIYHA

SEQ ID NO: 2191328 - protein, 17 aa, Cryptosporidium hominis
ILGILNKYKERQLDYQR

SEQ ID NO: 2191329 - protein, 26 aa, Cryptosporidium hominis
ILGKELPGLYPVGVGAINALPNTNSY

SEQ ID NO: 2191330 - protein, 30 aa, Cryptosporidium hominis
ILGRGSISWLNLKPKIPYFNVRKALILLQD

SEQ ID NO: 2191331 - protein, 26 aa, Cryptosporidium hominis
ILHILNKIVLIFPQSIYFNIRSSYLE

SEQ ID NO: 2191332 - protein, 18 aa, Cryptosporidium hominis
ILHNKLMNYVKVYKINTL

SEQ ID NO: 2191333 - protein, 33 aa, Cryptosporidium hominis
ILIDIGSKLSFLRYYVRHYFSLCDDYDFSSACK

SEQ ID NO: 2191334 - protein, 17 aa, Cryptosporidium hominis
ILILNIYSIITRNIFKY

SEQ ID NO: 2191335 - protein, 18 aa, Cryptosporidium hominis
ILKDAWSPALTLRTVMLS

SEQ ID NO: 2191336 - protein, 33 aa, Cryptosporidium hominis
ILKGFGTIIPLGRMRMLFNYQKIEYLICGESKI

SEQ ID NO: 2191337 - protein, 19 aa, Cryptosporidium hominis
ILKIDEIIMAKPAGGPKPR

SEQ ID NO: 2191338 - protein, 19 aa, Cryptosporidium hominis
ILKKLMEIEPKFNYDPPGT

SEQ ID NO: 2191339 - protein, 30 aa, Cryptosporidium hominis
ILKNNVILTRSWVCKLYILSGITGKDLSIC

SEQ ID NO: 2191340 - protein, 28 aa, Cryptosporidium hominis
ILKQKHKRWRKFFPCLKKNINYDVNTIN

SEQ ID NO: 2191341 - protein, 18 aa, Cryptosporidium hominis
ILKWLSYVPECVGGRLPI

SEQ ID NO: 2191342 - protein, 27 aa, Cryptosporidium hominis
ILLDTKFKKILNYYKTWSFSINEDYIK

SEQ ID NO: 2191343 - protein, 20 aa, Cryptosporidium hominis
ILLKQISLMNGFKYSFTGAL

SEQ ID NO: 2191344 - protein, 18 aa, Cryptosporidium hominis
ILLMSQYSRIKGIQFHEF

SEQ ID NO: 2191345 - protein, 27 aa, Cryptosporidium hominis
ILLSYPKLFEKNLLLIIQLINENLNNS

SEQ ID NO: 2191346 - protein, 28 aa, Cryptosporidium hominis
ILMADLIGFHFFPYAKQFLSSCKRLLGL

SEQ ID NO: 2191347 - protein, 17 aa, Cryptosporidium hominis
ILMALRRNINSPKKCKL

SEQ ID NO: 2191348 - protein, 20 aa, Cryptosporidium hominis
ILMPFGFTMMHHYLGYEGRC

SEQ ID NO: 2191349 - protein, 19 aa, Cryptosporidium hominis
ILNFETWKYAKSRSKSIGI

SEQ ID NO: 2191350 - protein, 21 aa, Cryptosporidium hominis
ILNGVLYKYILNPYKLNIEEI

SEQ ID NO: 2191351 - protein, 27 aa, Cryptosporidium hominis
ILNHHDFFILHLRKCVIGILDNWIKNR

SEQ ID NO: 2191352 - protein, 22 aa, Cryptosporidium hominis
ILNLIEVISLPKLAYKSDIAKN

SEQ ID NO: 2191353 - protein, 18 aa, Cryptosporidium hominis
ILNNLILPFLINEKYYFF

SEQ ID NO: 2191354 - protein, 26 aa, Cryptosporidium hominis
ILNPGRLILFNSFYLTGKSLPMFANI

SEQ ID NO: 2191355 - protein, 18 aa, Cryptosporidium hominis
ILNQMKWIYKLFHNKEED

SEQ ID NO: 2191356 - protein, 19 aa, Cryptosporidium hominis
ILNQWIGKTKGFIIDENRD

SEQ ID NO: 2191357 - protein, 24 aa, Cryptosporidium hominis
ILNSLITIERLSLKLASRISQVSI

SEQ ID NO: 2191358 - protein, 28 aa, Cryptosporidium hominis
ILNSPCQSPIFLILKPEVPKASEEINQP

SEQ ID NO: 2191359 - protein, 19 aa, Cryptosporidium hominis
ILPEQSLWEYVWGDVPVSY

SEQ ID NO: 2191360 - protein, 18 aa, Cryptosporidium hominis
ILPFLINEKYYFFQIQYI

SEQ ID NO: 2191361 - protein, 24 aa, Cryptosporidium hominis
ILPTGEYDLILAFDSPICKSSETT

SEQ ID NO: 2191362 - protein, 19 aa, Cryptosporidium hominis
ILPTRESIIFPRKNDLLLK

SEQ ID NO: 2191363 - protein, 23 aa, Cryptosporidium hominis
ILPVSIHQFFKEKSLLICTPIYD

SEQ ID NO: 2191364 - protein, 18 aa, Cryptosporidium hominis
ILQLISLYDYKGVPIDIV

SEQ ID NO: 2191365 - protein, 18 aa, Cryptosporidium hominis
ILQNKIMNLFRAATKHVY

SEQ ID NO: 2191366 - protein, 26 aa, Cryptosporidium hominis
ILQQGYNFNAYPIAKTPSVLSFSNYF

SEQ ID NO: 2191367 - protein, 25 aa, Cryptosporidium hominis
ILQQKTKYWNSYSKNLELISQYGSK

SEQ ID NO: 2191368 - protein, 18 aa, Cryptosporidium hominis
ILQSLRPNSGSATSNSVV

SEQ ID NO: 2191369 - protein, 31 aa, Cryptosporidium hominis
ILQSMKLPCAAIIQPFPLLNDFENPVPIVNS

SEQ ID NO: 2191370 - protein, 17 aa, Cryptosporidium hominis
ILQTLDLSYYQFKYIER

SEQ ID NO: 2191371 - protein, 17 aa, Cryptosporidium hominis
ILRCLIFSGFRRIDIVD

SEQ ID NO: 2191372 - protein, 19 aa, Cryptosporidium hominis
ILRERIEYFGRFKLDILDS

SEQ ID NO: 2191373 - protein, 17 aa, Cryptosporidium hominis
ILRFIYLNSAKNKDSCV

SEQ ID NO: 2191374 - protein, 17 aa, Cryptosporidium hominis
ILRLLHQQLASLKVTPE

SEQ ID NO: 2191375 - protein, 17 aa, Cryptosporidium hominis
ILRYILIGANSLSSDEA

SEQ ID NO: 2191376 - protein, 19 aa, Cryptosporidium hominis
ILSETLKLTFLFVREDEKL

SEQ ID NO: 2191377 - protein, 27 aa, Cryptosporidium hominis
ILSHPYDIPFWLPETITFLANYSGSRD

SEQ ID NO: 2191378 - protein, 25 aa, Cryptosporidium hominis
ILSIQGPALLYSLISNECLAHLEEM

SEQ ID NO: 2191379 - protein, 17 aa, Cryptosporidium hominis
ILSLGCKLNIDNLSKPD

SEQ ID NO: 2191380 - protein, 17 aa, Cryptosporidium hominis
ILSLGFGFEYLPLKCSD

SEQ ID NO: 2191381 - protein, 17 aa, Cryptosporidium hominis
ILSYFKDIYEEYDYFIK

SEQ ID NO: 2191382 - protein, 21 aa, Cryptosporidium hominis
ILSYKMEGDWLIVPEFKEIVS

SEQ ID NO: 2191383 - protein, 31 aa, Cryptosporidium hominis
ILTDDSILLEMFMFAPFTLPLIYGKECFEEY

SEQ ID NO: 2191384 - protein, 24 aa, Cryptosporidium hominis
ILTGDWYIQWYLNNYKDDIKDNEI

SEQ ID NO: 2191385 - protein, 19 aa, Cryptosporidium hominis
ILTNDLFYGKYILDPKETF

SEQ ID NO: 2191386 - protein, 17 aa, Cryptosporidium hominis
ILTWIRNGFFDGKGDLL

SEQ ID NO: 2191387 - protein, 26 aa, Cryptosporidium hominis
ILVDSSNLYMEPILVHKYSVNDYIKE

SEQ ID NO: 2191388 - protein, 23 aa, Cryptosporidium hominis
ILVNNILKYFLGFGENSNFLGYH

SEQ ID NO: 2191389 - protein, 29 aa, Cryptosporidium hominis
ILVQNNNYQLLLSQLMQYLYGGNNNNSNN

SEQ ID NO: 2191390 - protein, 18 aa, Cryptosporidium hominis
ILVREYQTCLSSYPDTRQ

SEQ ID NO: 2191391 - protein, 17 aa, Cryptosporidium hominis
ILVYLRMKYPDTKLEEF

SEQ ID NO: 2191392 - protein, 17 aa, Cryptosporidium hominis
ILYIVEPTSNTLLYCNK

SEQ ID NO: 2191393 - protein, 20 aa, Cryptosporidium hominis
IMAYLNPHLLILDEPTNHLD

SEQ ID NO: 2191394 - protein, 26 aa, Cryptosporidium hominis
IMDFKTKYIFPFSFESVLDAILYKAY

SEQ ID NO: 2191395 - protein, 25 aa, Cryptosporidium hominis
IMDINSLLDLQLSVAYKLHGIYIAF

SEQ ID NO: 2191396 - protein, 24 aa, Cryptosporidium hominis
IMDYPKIKILGSQFLNPTKLLVSI

SEQ ID NO: 2191397 - protein, 28 aa, Cryptosporidium hominis
IMEDSSNLPLYSLGSFRDANYYPNVTVS

SEQ ID NO: 2191398 - protein, 26 aa, Cryptosporidium hominis
IMGHRVKILPYSTFRLNLSVTSPYNA

SEQ ID NO: 2191399 - protein, 17 aa, Cryptosporidium hominis
IMGICTNATREYADVIR

SEQ ID NO: 2191400 - protein, 19 aa, Cryptosporidium hominis
IMIFSQLVKDCIFGRIFDL

SEQ ID NO: 2191401 - protein, 25 aa, Cryptosporidium hominis
IMKSAKQCKSRWYEWLDPRVKKTEW

SEQ ID NO: 2191402 - protein, 23 aa, Cryptosporidium hominis
IMKSISIIIYTLKNSPWLTINEI

SEQ ID NO: 2191403 - protein, 18 aa, Cryptosporidium hominis
IMNLTGGSLMGNVLMMSG

SEQ ID NO: 2191404 - protein, 18 aa, Cryptosporidium hominis
IMNYNLELDLRSVGIRAF

SEQ ID NO: 2191405 - protein, 17 aa, Cryptosporidium hominis
IMSIWNTKNDNFIEIEY

SEQ ID NO: 2191406 - protein, 41 aa, Cryptosporidium hominis
IMTTSAMTLQPLHPPPPPPPPPPPPPPPHTLPHLSQSQNSI

SEQ ID NO: 2191407 - protein, 24 aa, Cryptosporidium hominis
IMVSDFIAKELLTYALKAANNVPS

SEQ ID NO: 2191408 - protein, 17 aa, Cryptosporidium hominis
IMVSTNMRKGTYISILN

SEQ ID NO: 2191409 - protein, 17 aa, Cryptosporidium hominis
IMYFMVNAAKEAIQREL

SEQ ID NO: 2191410 - protein, 17 aa, Cryptosporidium hominis
IMYILSSGSFCNEKGKL

SEQ ID NO: 2191411 - protein, 24 aa, Cryptosporidium hominis
INADSWLVSWNLLGIADGVSSVES

SEQ ID NO: 2191412 - protein, 29 aa, Cryptosporidium hominis
INANKPIRLLNFPLPFKLPPKRYSNSDHP

SEQ ID NO: 2191413 - protein, 25 aa, Cryptosporidium hominis
INCFSVILGFRYANFMLLIDSVDER

SEQ ID NO: 2191414 - protein, 22 aa, Cryptosporidium hominis
INDHLYYQPINFNDTIVRYIGD

SEQ ID NO: 2191415 - protein, 25 aa, Cryptosporidium hominis
INDKMLSFIQWKFPTRVLNNSNQII

SEQ ID NO: 2191416 - protein, 27 aa, Cryptosporidium hominis
INDLLPPFLVVFLLPLSPVGDIELLDI

SEQ ID NO: 2191417 - protein, 28 aa, Cryptosporidium hominis
INDTLYKKYIGYLSSILYIKSNKGNAES

SEQ ID NO: 2191418 - protein, 20 aa, Cryptosporidium hominis
INECNYLKEKLRSLSQVLNT

SEQ ID NO: 2191419 - protein, 18 aa, Cryptosporidium hominis
INEHQIILAIVYQNAYSA

SEQ ID NO: 2191420 - protein, 24 aa, Cryptosporidium hominis
INEIKILQFLAKINPTYYYIAKLH

SEQ ID NO: 2191421 - protein, 26 aa, Cryptosporidium hominis
INELLKDDILFNLYLELIKEAKVDLV

SEQ ID NO: 2191422 - protein, 25 aa, Cryptosporidium hominis
INESNYILKIILTSFNPIELTTKLG

SEQ ID NO: 2191423 - protein, 24 aa, Cryptosporidium hominis
INFEKLRILICKLKKSLYSDTLSK

SEQ ID NO: 2191424 - protein, 26 aa, Cryptosporidium hominis
INFGELKHELLIKLVNCQKLVLEEKY

SEQ ID NO: 2191425 - protein, 24 aa, Cryptosporidium hominis
INFIDKFVPLIKRHSNKKFKFSKN

SEQ ID NO: 2191426 - protein, 19 aa, Cryptosporidium hominis
INFNDTIVRYIGDKEPLVV

SEQ ID NO: 2191427 - protein, 26 aa, Cryptosporidium hominis
INFQADIKTLPPKLRKLRDYRLNDID

SEQ ID NO: 2191428 - protein, 25 aa, Cryptosporidium hominis
INFVNKFGLILITGEMKNITLIINC

SEQ ID NO: 2191429 - protein, 18 aa, Cryptosporidium hominis
INHHDIPKFGMITARFLK

SEQ ID NO: 2191430 - protein, 20 aa, Cryptosporidium hominis
INILELEELIFKKLEKLYLK

SEQ ID NO: 2191431 - protein, 36 aa, Cryptosporidium hominis
INIPTQCQILITLPFMLELLLMSTAYQQWVSKIKFV

SEQ ID NO: 2191432 - protein, 19 aa, Cryptosporidium hominis
INISIINSFPKLKKTELKK

SEQ ID NO: 2191433 - protein, 32 aa, Cryptosporidium hominis
INISKTILCRYIWSFFIPTWNRIFITSSKESK

SEQ ID NO: 2191434 - protein, 22 aa, Cryptosporidium hominis
INKDRFISKLFVRGDSVILILK

SEQ ID NO: 2191435 - protein, 32 aa, Cryptosporidium hominis
INKFEAHNFSLFLYSFLALDPRMRPGAQTLLD

SEQ ID NO: 2191436 - protein, 17 aa, Cryptosporidium hominis
INKIVFSLFNYDDSEFL

SEQ ID NO: 2191437 - protein, 25 aa, Cryptosporidium hominis
INKRFSMDLIYSYAGRLLVAVNPFK

SEQ ID NO: 2191438 - protein, 27 aa, Cryptosporidium hominis
INKVLEYFISCYLLEICLYDIEILKYS

SEQ ID NO: 2191439 - protein, 17 aa, Cryptosporidium hominis
INLSFFDIFEDNFVRYS

SEQ ID NO: 2191440 - protein, 28 aa, Cryptosporidium hominis
INLSYTPRKLLTLPSPQLFTGLETLMSS

SEQ ID NO: 2191441 - protein, 18 aa, Cryptosporidium hominis
INLYTGHVYSNWPTARTP

SEQ ID NO: 2191442 - protein, 23 aa, Cryptosporidium hominis
INMGAPSFIPEYPTAYYSNPEVM

SEQ ID NO: 2191443 - protein, 25 aa, Cryptosporidium hominis
INMRQVRLLEVYNIRILESVVIRVH

SEQ ID NO: 2191444 - protein, 50 aa, Cryptosporidium hominis
INNLFSKYGLKYSQLRNATIHELCRMAYVCGLWEEAVKLHFQHIRKKAHE

SEQ ID NO: 2191445 - protein, 22 aa, Cryptosporidium hominis
INNQFKYIFLSASSGFKGMSDY

SEQ ID NO: 2191446 - protein, 28 aa, Cryptosporidium hominis
INNTASEKLTKGMLGYVSKHTLNNFKNP

SEQ ID NO: 2191447 - protein, 18 aa, Cryptosporidium hominis
INNTKNHYSYYLGSNSNS

SEQ ID NO: 2191448 - protein, 31 aa, Cryptosporidium hominis
INNYYIFQNVPLELFMFIFDFNASATNNQTN

SEQ ID NO: 2191449 - protein, 17 aa, Cryptosporidium hominis
INPILDPIVAQSLLRKM

SEQ ID NO: 2191450 - protein, 18 aa, Cryptosporidium hominis
INPSISLSNCDVPWPLTG

SEQ ID NO: 2191451 - protein, 26 aa, Cryptosporidium hominis
INQELTPPVLLFSYAIHTGKINYISV

SEQ ID NO: 2191452 - protein, 23 aa, Cryptosporidium hominis
INQSILSIILRDPGTKTISINRK

SEQ ID NO: 2191453 - protein, 25 aa, Cryptosporidium hominis
INRFLSHIKFFTAKISSIFSRFLSS

SEQ ID NO: 2191454 - protein, 21 aa, Cryptosporidium hominis
INRLITICAFINLSFEIFIDD

SEQ ID NO: 2191455 - protein, 24 aa, Cryptosporidium hominis
INRTIKELWNITYKGHDIDYIAIR

SEQ ID NO: 2191456 - protein, 21 aa, Cryptosporidium hominis
INSIFDYIQENMKQMTPSHGC

SEQ ID NO: 2191457 - protein, 20 aa, Cryptosporidium hominis
INSLFEIFKLFLTTYFHNRK

SEQ ID NO: 2191458 - protein, 17 aa, Cryptosporidium hominis
INSLIKKAQKISSKKRV

SEQ ID NO: 2191459 - protein, 35 aa, Cryptosporidium hominis
INSNQRIRFLASSYTLPIIWLLKSMNLSDGISIND

SEQ ID NO: 2191460 - protein, 36 aa, Cryptosporidium hominis
INSPCILTFIRRPVFDPLTCLLGCPYGEVGTSYFSC

SEQ ID NO: 2191461 - protein, 23 aa, Cryptosporidium hominis
INSRTYLFKFGGEEKKFLLVESG

SEQ ID NO: 2191462 - protein, 19 aa, Cryptosporidium hominis
INSTLKHKTNLDPKSLLFN

SEQ ID NO: 2191463 - protein, 26 aa, Cryptosporidium hominis
INSVYEFLVDWRFWFCPDSNMLETGE

SEQ ID NO: 2191464 - protein, 17 aa, Cryptosporidium hominis
INTLPIRQNPKPCLVMW

SEQ ID NO: 2191465 - protein, 29 aa, Cryptosporidium hominis
INTPHGIPYWLVPVFEFLKLPASSTLSSL

SEQ ID NO: 2191466 - protein, 38 aa, Cryptosporidium hominis
INTRNKFLWCIEILHQFYYLNLDLLRMEKKRIEKSVKN

SEQ ID NO: 2191467 - protein, 21 aa, Cryptosporidium hominis
INVIIVKIIIILKEIWIGMGI

SEQ ID NO: 2191468 - protein, 29 aa, Cryptosporidium hominis
INYCARKLKWWLDAFQPIVSPIFPNMDTK

SEQ ID NO: 2191469 - protein, 22 aa, Cryptosporidium hominis
INYCREFIHPRLSLDAAAILEN

SEQ ID NO: 2191470 - protein, 17 aa, Cryptosporidium hominis
INYLTMPSTKQIPYSYS

SEQ ID NO: 2191471 - protein, 24 aa, Cryptosporidium hominis
INYMQIVYEILESLLKPCIEHHNM

SEQ ID NO: 2191472 - protein, 18 aa, Cryptosporidium hominis
INYPVYSSFIFFNNINHQ

SEQ ID NO: 2191473 - protein, 17 aa, Cryptosporidium hominis
IPALSHLWRASLNILLL

SEQ ID NO: 2191474 - protein, 24 aa, Cryptosporidium hominis
IPASPLVTILAFVPAIETFGFETD

SEQ ID NO: 2191475 - protein, 23 aa, Cryptosporidium hominis
IPDCSICREYLTRNLTVITVCGH

SEQ ID NO: 2191476 - protein, 19 aa, Cryptosporidium hominis
IPDNYKGILIWKSTNFIRH

SEQ ID NO: 2191477 - protein, 22 aa, Cryptosporidium hominis
IPEDLYFLIKRAVSIRKHLEKF

SEQ ID NO: 2191478 - protein, 25 aa, Cryptosporidium hominis
IPEHKAYCFNAWPLEYRRVKLYEVN

SEQ ID NO: 2191479 - protein, 18 aa, Cryptosporidium hominis
IPEKPIVKGKPPGPPPPL

SEQ ID NO: 2191480 - protein, 17 aa, Cryptosporidium hominis
IPELLKELVYKEIENSN

SEQ ID NO: 2191481 - protein, 25 aa, Cryptosporidium hominis
IPEMYAPILRAKPWCYDPDYVPWYD

SEQ ID NO: 2191482 - protein, 18 aa, Cryptosporidium hominis
IPEYELYRRILHHVRIRL

SEQ ID NO: 2191483 - protein, 27 aa, Cryptosporidium hominis
IPHQMVLPSMMQMPNVAPPPLPIYQQP

SEQ ID NO: 2191484 - protein, 17 aa, Cryptosporidium hominis
IPIIKCGPLLETERSFE

SEQ ID NO: 2191485 - protein, 17 aa, Cryptosporidium hominis
IPIPFCLDNKATTVRLA

SEQ ID NO: 2191486 - protein, 17 aa, Cryptosporidium hominis
IPISMVYSRNLLGGAGL

SEQ ID NO: 2191487 - protein, 19 aa, Cryptosporidium hominis
IPKFGMITARFLKTSGIPK

SEQ ID NO: 2191488 - protein, 24 aa, Cryptosporidium hominis
IPKYQVLIIALKIQCLIKYNKLEE

SEQ ID NO: 2191489 - protein, 25 aa, Cryptosporidium hominis
IPLNLLQTMINGMFPAIDLTKIRIR

SEQ ID NO: 2191490 - protein, 39 aa, Cryptosporidium hominis
IPLPKVCVFQIEAKLELLLLYRGCSSKRPHTKRGRSTAN

SEQ ID NO: 2191491 - protein, 19 aa, Cryptosporidium hominis
IPLQRFILYILVCNATQLI

SEQ ID NO: 2191492 - protein, 24 aa, Cryptosporidium hominis
IPNYKTILIGMLPNLIYLDFQKIN

SEQ ID NO: 2191493 - protein, 18 aa, Cryptosporidium hominis
IPPVGALDPNVLASLGLN

SEQ ID NO: 2191494 - protein, 17 aa, Cryptosporidium hominis
IPQAVFLGQPGTTNNNK

SEQ ID NO: 2191495 - protein, 29 aa, Cryptosporidium hominis
IPQEYFDGVYKSIFIRIAEYKVKQRSALF

SEQ ID NO: 2191496 - protein, 23 aa, Cryptosporidium hominis
IPREDFMIWENKLRTLKWQTNPS

SEQ ID NO: 2191497 - protein, 18 aa, Cryptosporidium hominis
IPREISLNCFLKVANELR

SEQ ID NO: 2191498 - protein, 33 aa, Cryptosporidium hominis
IPSCDIISFFDIFLLSLFRSKIPQLIRHLGWDE

SEQ ID NO: 2191499 - protein, 18 aa, Cryptosporidium hominis
IPSLCELQDKHYRNKNLS

SEQ ID NO: 2191500 - protein, 29 aa, Cryptosporidium hominis
IPSSILIYYGKLKNSLLLVLFDKEQERNL

SEQ ID NO: 2191501 - protein, 22 aa, Cryptosporidium hominis
IPSYILDLPNEVMRTPFGSMIL

SEQ ID NO: 2191502 - protein, 26 aa, Cryptosporidium hominis
IPTPSTVASLLPSLTSPLSTSQHQNL

SEQ ID NO: 2191503 - protein, 26 aa, Cryptosporidium hominis
IPTSCLYLLSIWDKIESIPSTRKTAW

SEQ ID NO: 2191504 - protein, 37 aa, Cryptosporidium hominis
IPTYKIGISLLKNEWKKAFYLILGFDEEKMISYSAEK

SEQ ID NO: 2191505 - protein, 23 aa, Cryptosporidium hominis
IPVPNRISFYGFVARIGPNLCDE

SEQ ID NO: 2191506 - protein, 33 aa, Cryptosporidium hominis
IQAVFRGWLVRKKFCKLFMLKRCILALKRKSLI

SEQ ID NO: 2191507 - protein, 28 aa, Cryptosporidium hominis
IQCEIVKTFKNLTLSPCLCKSQESPNNP

SEQ ID NO: 2191508 - protein, 20 aa, Cryptosporidium hominis
IQDALLRDIIGPKFARHLNQ

SEQ ID NO: 2191509 - protein, 26 aa, Cryptosporidium hominis
IQDNTHLRKVCNWPAIEFSKQTSPPT

SEQ ID NO: 2191510 - protein, 25 aa, Cryptosporidium hominis
IQEENWSAMFYLGGLMDNLSSKQVM

SEQ ID NO: 2191511 - protein, 22 aa, Cryptosporidium hominis
IQEFFDGIFKFYKKQFSGEELE

SEQ ID NO: 2191512 - protein, 24 aa, Cryptosporidium hominis
IQEHDDFLFRLLDLSQNDSSRLKY

SEQ ID NO: 2191513 - protein, 17 aa, Cryptosporidium hominis
IQFQTLYNHPSGRKRLR

SEQ ID NO: 2191514 - protein, 26 aa, Cryptosporidium hominis
IQGDIPYCDTILYLDNPKPKKYDTTF

SEQ ID NO: 2191515 - protein, 24 aa, Cryptosporidium hominis
IQGFSLIYITLLSNKKIYAFYPDS

SEQ ID NO: 2191516 - protein, 24 aa, Cryptosporidium hominis
IQGKTLLNFISSIVGEIFTTEEIS

SEQ ID NO: 2191517 - protein, 19 aa, Cryptosporidium hominis
IQGLQRLIDKLKEVKLGSS

SEQ ID NO: 2191518 - protein, 26 aa, Cryptosporidium hominis
IQGRNRLDILLSQWVSYFSGRQSIDI

SEQ ID NO: 2191519 - protein, 37 aa, Cryptosporidium hominis
IQGTLSSLQLYRTTYRPPLPLLLTHLKARCKPTTQYN

SEQ ID NO: 2191520 - protein, 18 aa, Cryptosporidium hominis
IQGYKFKIKYPLLGKAEN

SEQ ID NO: 2191521 - protein, 19 aa, Cryptosporidium hominis
IQHKIFKDLTLISNLNSED

SEQ ID NO: 2191522 - protein, 24 aa, Cryptosporidium hominis
IQHSHFFEKIRIKLWKSEYVMKIQ

SEQ ID NO: 2191523 - protein, 19 aa, Cryptosporidium hominis
IQILYRLGQFEECERLYSI

SEQ ID NO: 2191524 - protein, 29 aa, Cryptosporidium hominis
IQISNDVFLFFEMWPSKLLPNAGNTTESY

SEQ ID NO: 2191525 - protein, 28 aa, Cryptosporidium hominis
IQKLIQQFINLFSFFIGERLECKQTGSV

SEQ ID NO: 2191526 - protein, 25 aa, Cryptosporidium hominis
IQLKAGEDALLPLTLRPIVEGSTRN

SEQ ID NO: 2191527 - protein, 23 aa, Cryptosporidium hominis
IQMNDLFVLLKGKDKRIASTCSN

SEQ ID NO: 2191528 - protein, 38 aa, Cryptosporidium hominis
IQMPNYEWLANWMKIILSAICMPLITLFPQKVNCDVND

SEQ ID NO: 2191529 - protein, 17 aa, Cryptosporidium hominis
IQNALPVSKFDLSRSQN

SEQ ID NO: 2191530 - protein, 26 aa, Cryptosporidium hominis
IQNQRRINRDFLLNSHATINNYNLEH

SEQ ID NO: 2191531 - protein, 17 aa, Cryptosporidium hominis
IQPFLVLKVHRDSIVND

SEQ ID NO: 2191532 - protein, 17 aa, Cryptosporidium hominis
IQPYFDLETTKDILDEM

SEQ ID NO: 2191533 - protein, 25 aa, Cryptosporidium hominis
IQQHIHKWRILQQRSYIAIGKFKQT

SEQ ID NO: 2191534 - protein, 19 aa, Cryptosporidium hominis
IQQLFAKSIVRELNLKPLF

SEQ ID NO: 2191535 - protein, 19 aa, Cryptosporidium hominis
IQREILRYILIGANSLSSD

SEQ ID NO: 2191536 - protein, 20 aa, Cryptosporidium hominis
IQRITLVYQVIPFNGIKNIL

SEQ ID NO: 2191537 - protein, 21 aa, Cryptosporidium hominis
IQRTLMELLNQLDGFDELGAV

SEQ ID NO: 2191538 - protein, 35 aa, Cryptosporidium hominis
IQSLDSDIFYVYYQLSFDFFIYSTEKKLKRINFLD

SEQ ID NO: 2191539 - protein, 18 aa, Cryptosporidium hominis
IQTIICILTLLTCRVQNS

SEQ ID NO: 2191540 - protein, 29 aa, Cryptosporidium hominis
IQVISLFGKYTWSWISPRLLHGVSSTPTT

SEQ ID NO: 2191541 - protein, 24 aa, Cryptosporidium hominis
IQVMEYKFLELLSIDFQQTPEEII

SEQ ID NO: 2191542 - protein, 18 aa, Cryptosporidium hominis
IQVPLIYVSLENIVSKWY

SEQ ID NO: 2191543 - protein, 25 aa, Cryptosporidium hominis
IQVTPKWVYDVVLDFTIIKPTSKRN

SEQ ID NO: 2191544 - protein, 27 aa, Cryptosporidium hominis
IRATQKHMLPLSYKWIGLSRSNHKLLN

SEQ ID NO: 2191545 - protein, 18 aa, Cryptosporidium hominis
IRAVRIIERPKDGRSLGI

SEQ ID NO: 2191546 - protein, 23 aa, Cryptosporidium hominis
IREEIRTLMRYQEFLRLDFTVMN

SEQ ID NO: 2191547 - protein, 20 aa, Cryptosporidium hominis
IREIPVPSIVDLIGIVRHFS

SEQ ID NO: 2191548 - protein, 30 aa, Cryptosporidium hominis
IREKDGLWAVLAWLSILAHKNPDPTKPLVS

SEQ ID NO: 2191549 - protein, 36 aa, Cryptosporidium hominis
IREKHSKLLEDFYSNPFYPIFVNEYNKRLFMDHEES

SEQ ID NO: 2191550 - protein, 23 aa, Cryptosporidium hominis
IRELLQFRCYKPVLTVYEFLKSK

SEQ ID NO: 2191551 - protein, 28 aa, Cryptosporidium hominis
IRELLRKSFSIILPYKPIKDLSERFDNN

SEQ ID NO: 2191552 - protein, 20 aa, Cryptosporidium hominis
IRELQPMETLSWLKNHGLNK

SEQ ID NO: 2191553 - protein, 17 aa, Cryptosporidium hominis
IREMIELPLRHPGLFKA

SEQ ID NO: 2191554 - protein, 22 aa, Cryptosporidium hominis
IRESLKLIPRKSKIEFEQNRNP

SEQ ID NO: 2191555 - protein, 24 aa, Cryptosporidium hominis
IRESQLLQWNYMLVIGENEARDKK

SEQ ID NO: 2191556 - protein, 19 aa, Cryptosporidium hominis
IRFCILPDMLKNAPMFKLA

SEQ ID NO: 2191557 - protein, 31 aa, Cryptosporidium hominis
IRFISTIFHHYLIPYLRINSKIIIENVNKYL

SEQ ID NO: 2191558 - protein, 32 aa, Cryptosporidium hominis
IRFRKGNQAIWRNLIPRIWSIFIEEPLDINNL

SEQ ID NO: 2191559 - protein, 30 aa, Cryptosporidium hominis
IRGKKNFLPPLKLEMGCALYFIKSKQNFNQ

SEQ ID NO: 2191560 - protein, 20 aa, Cryptosporidium hominis
IRGRIRRINGHRTSSLSDIK

SEQ ID NO: 2191561 - protein, 24 aa, Cryptosporidium hominis
IRIKDLLNHFPPQGDILGISKDEI

SEQ ID NO: 2191562 - protein, 20 aa, Cryptosporidium hominis
IRISHIVYKEGIKGYSISER

SEQ ID NO: 2191563 - protein, 27 aa, Cryptosporidium hominis
IRITNEYLMLYSFPFGGFSSCFQFNFD

SEQ ID NO: 2191564 - protein, 19 aa, Cryptosporidium hominis
IRKDDGCLILPISKRRVGL

SEQ ID NO: 2191565 - protein, 17 aa, Cryptosporidium hominis
IRKLCRCAICYDPGKAQ

SEQ ID NO: 2191566 - protein, 18 aa, Cryptosporidium hominis
IRKPPIMMVSGHSAGITD

SEQ ID NO: 2191567 - protein, 22 aa, Cryptosporidium hominis
IRKRIVKLPPSGGKIQRFICIP

SEQ ID NO: 2191568 - protein, 20 aa, Cryptosporidium hominis
IRKTKLIDLIFPIIHGIERK

SEQ ID NO: 2191569 - protein, 17 aa, Cryptosporidium hominis
IRLIASRDYYLDALNFG

SEQ ID NO: 2191570 - protein, 24 aa, Cryptosporidium hominis
IRLNDLIIALRRAFDNGTVTFSRH

SEQ ID NO: 2191571 - protein, 18 aa, Cryptosporidium hominis
IRMQLEQFQKLHLINENV

SEQ ID NO: 2191572 - protein, 25 aa, Cryptosporidium hominis
IRNKLPLCFLVLFKLETEYEILFKK

SEQ ID NO: 2191573 - protein, 21 aa, Cryptosporidium hominis
IRNNWIYRNDIYLETISVFGI

SEQ ID NO: 2191574 - protein, 21 aa, Cryptosporidium hominis
IRPFMPYLDPLVRRVISMSME

SEQ ID NO: 2191575 - protein, 19 aa, Cryptosporidium hominis
IRPLWRHYYSNTDGLIFVI

SEQ ID NO: 2191576 - protein, 19 aa, Cryptosporidium hominis
IRPLWRHYYTNTDGIIFVV

SEQ ID NO: 2191577 - protein, 20 aa, Cryptosporidium hominis
IRQISAFGLSFMRLDIRQEA

SEQ ID NO: 2191578 - protein, 23 aa, Cryptosporidium hominis
IRRRFERRIYIPLPDEESRVLLI

SEQ ID NO: 2191579 - protein, 19 aa, Cryptosporidium hominis
IRRRIVLEGYLDFSNSVTS

SEQ ID NO: 2191580 - protein, 19 aa, Cryptosporidium hominis
IRSISCWCISRFTPWLALQ

SEQ ID NO: 2191581 - protein, 23 aa, Cryptosporidium hominis
IRTDIPIAILFRALGVLSDKDIL

SEQ ID NO: 2191582 - protein, 18 aa, Cryptosporidium hominis
IRTFLPDIRREINARIRT

SEQ ID NO: 2191583 - protein, 19 aa, Cryptosporidium hominis
IRTGDICQLLPNGSIRIVD

SEQ ID NO: 2191584 - protein, 26 aa, Cryptosporidium hominis
IRTVTKIRGEWLLEISPKYYNLEDFP

SEQ ID NO: 2191585 - protein, 18 aa, Cryptosporidium hominis
IRVKKLDSLILDAALKKL

SEQ ID NO: 2191586 - protein, 18 aa, Cryptosporidium hominis
IRVYVIKDKDDLTMKDNI

SEQ ID NO: 2191587 - protein, 19 aa, Cryptosporidium hominis
IRYDLLDIGLAICSPQLLK

SEQ ID NO: 2191588 - protein, 25 aa, Cryptosporidium hominis
IRYESGIKGKFWRCSTEAHNRMYEV

SEQ ID NO: 2191589 - protein, 26 aa, Cryptosporidium hominis
IRYWKRASTHIFGFRFDLIRVFADKM

SEQ ID NO: 2191590 - protein, 24 aa, Cryptosporidium hominis
ISAINHLWLNDYCSRWFISTETDS

SEQ ID NO: 2191591 - protein, 25 aa, Cryptosporidium hominis
ISCKNALLHPWFDDIDRSKYVMWDS

SEQ ID NO: 2191592 - protein, 26 aa, Cryptosporidium hominis
ISDESFSISFPIYKASLIATDNESKN

SEQ ID NO: 2191593 - protein, 25 aa, Cryptosporidium hominis
ISDESYSFQLTFKSSAFKFTGAVVS

SEQ ID NO: 2191594 - protein, 22 aa, Cryptosporidium hominis
ISDNGIPLIALWLHSENVGVRE

SEQ ID NO: 2191595 - protein, 36 aa, Cryptosporidium hominis
ISDNYSRRFILRLFRQFWGFLDYMDLSLIENLNIKN

SEQ ID NO: 2191596 - protein, 24 aa, Cryptosporidium hominis
ISEIALLISFDRYGKEKNNPYRYC

SEQ ID NO: 2191597 - protein, 23 aa, Cryptosporidium hominis
ISELQGKIMLAEKARELLLTRYK

SEQ ID NO: 2191598 - protein, 25 aa, Cryptosporidium hominis
ISELSNMLIFLMPEVFNSDLLEDAY

SEQ ID NO: 2191599 - protein, 25 aa, Cryptosporidium hominis
ISEMTFAFKVLKSFRGKLRLGVCCT

SEQ ID NO: 2191600 - protein, 23 aa, Cryptosporidium hominis
ISEPSIVPLYTLAQTQSPTMSNI

SEQ ID NO: 2191601 - protein, 31 aa, Cryptosporidium hominis
ISESSKYKWLFRWLPYYYKFGMGYQISKVIS

SEQ ID NO: 2191602 - protein, 17 aa, Cryptosporidium hominis
ISETFLNGPANLSLFDV

SEQ ID NO: 2191603 - protein, 27 aa, Cryptosporidium hominis
ISETYTYIRHTFSWMNNQFGMKLIAPQ

SEQ ID NO: 2191604 - protein, 17 aa, Cryptosporidium hominis
ISFCRQCERFQKPPWVS

SEQ ID NO: 2191605 - protein, 18 aa, Cryptosporidium hominis
ISFNGILDSTTLLELYYF

SEQ ID NO: 2191606 - protein, 26 aa, Cryptosporidium hominis
ISFRKEILALSIKKSYYRLKYTREFS

SEQ ID NO: 2191607 - protein, 35 aa, Cryptosporidium hominis
ISFTETNKRFIMRKMPLLCWAADIPSAKAFNFDDY

SEQ ID NO: 2191608 - protein, 31 aa, Cryptosporidium hominis
ISGEIIYLDGAWRPPFITSGSVRRLSIQKSS

SEQ ID NO: 2191609 - protein, 31 aa, Cryptosporidium hominis
ISGSIWSKLIQIPILHRLIEKELFPSFRIEV

SEQ ID NO: 2191610 - protein, 31 aa, Cryptosporidium hominis
ISIKKMYISPFLIYNFWTDPTLWTIQTNENY

SEQ ID NO: 2191611 - protein, 18 aa, Cryptosporidium hominis
ISILGFLKSTFKVEGPHI

SEQ ID NO: 2191612 - protein, 20 aa, Cryptosporidium hominis
ISIQLSYFYSETLNFKGMIE

SEQ ID NO: 2191613 - protein, 23 aa, Cryptosporidium hominis
ISISRRFILFSYVEGIRMYIQAL

SEQ ID NO: 2191614 - protein, 25 aa, Cryptosporidium hominis
ISISSFPLPPRYAKILLLTTAYIRK

SEQ ID NO: 2191615 - protein, 23 aa, Cryptosporidium hominis
ISKDFIGCISSQAGVICTSNKRR

SEQ ID NO: 2191616 - protein, 17 aa, Cryptosporidium hominis
ISKGTLNIPFKFTTLIE

SEQ ID NO: 2191617 - protein, 20 aa, Cryptosporidium hominis
ISKKLTWLLRHGDPAKTGLN

SEQ ID NO: 2191618 - protein, 26 aa, Cryptosporidium hominis
ISKNSYPSPLNYWGFPKSCCTSVNEI

SEQ ID NO: 2191619 - protein, 19 aa, Cryptosporidium hominis
ISKRATRLQEMWDRVVAGE

SEQ ID NO: 2191620 - protein, 22 aa, Cryptosporidium hominis
ISLANFYYLYSLKDKSAETEIL

SEQ ID NO: 2191621 - protein, 19 aa, Cryptosporidium hominis
ISLELILKSLRRSPLTLEK

SEQ ID NO: 2191622 - protein, 17 aa, Cryptosporidium hominis
ISLFKNNNVFLDPSLIY

SEQ ID NO: 2191623 - protein, 27 aa, Cryptosporidium hominis
ISLLLPQKPCRCILLSNILAVEELLIP

SEQ ID NO: 2191624 - protein, 23 aa, Cryptosporidium hominis
ISLQFQDLKLLPQFKGLSVGEKV

SEQ ID NO: 2191625 - protein, 23 aa, Cryptosporidium hominis
ISLRRLMKISQVLRKNRISRGAI

SEQ ID NO: 2191626 - protein, 34 aa, Cryptosporidium hominis
ISLTDFHLKYLNFVRLLLNRKKYRIILLDEPTIE

SEQ ID NO: 2191627 - protein, 18 aa, Cryptosporidium hominis
ISMKDVVLLNFLSDYMNE

SEQ ID NO: 2191628 - protein, 19 aa, Cryptosporidium hominis
ISMMNLIRHLEYVVGSLFY

SEQ ID NO: 2191629 - protein, 35 aa, Cryptosporidium hominis
ISMNIFPAIMTLINGYELLIFPKKSTLIDLKRTFE

SEQ ID NO: 2191630 - protein, 26 aa, Cryptosporidium hominis
ISNFDSILLAWDFFKDIKEEVFGVER

SEQ ID NO: 2191631 - protein, 31 aa, Cryptosporidium hominis
ISNFPEIQKLILEFLFSFKTSKKLSLVNKEG

SEQ ID NO: 2191632 - protein, 32 aa, Cryptosporidium hominis
ISNFREYIGNPLAFIYLFYNKLSGGNIETYFT

SEQ ID NO: 2191633 - protein, 24 aa, Cryptosporidium hominis
ISNFRRFQGLSRLKKIALTLIAQN

SEQ ID NO: 2191634 - protein, 27 aa, Cryptosporidium hominis
ISNGSNKYPYFYSKRKKVFKDNSEIIY

SEQ ID NO: 2191635 - protein, 17 aa, Cryptosporidium hominis
ISNIFWCDEQKFVVTGS

SEQ ID NO: 2191636 - protein, 22 aa, Cryptosporidium hominis
ISNIFWGLWGICKSDIRSNNSS

SEQ ID NO: 2191637 - protein, 17 aa, Cryptosporidium hominis
ISNNYLVTIYGSQLCYH

SEQ ID NO: 2191638 - protein, 25 aa, Cryptosporidium hominis
ISNRNILWDSILLEKLKSLVNQEIN

SEQ ID NO: 2191639 - protein, 17 aa, Cryptosporidium hominis
ISPIIRTNFEQIGTFYC

SEQ ID NO: 2191640 - protein, 21 aa, Cryptosporidium hominis
ISPISLYHAIIGKTDYVVKII

SEQ ID NO: 2191641 - protein, 24 aa, Cryptosporidium hominis
ISPNKYFCFTPLLTQIVSNRLPRE

SEQ ID NO: 2191642 - protein, 20 aa, Cryptosporidium hominis
ISQIFLRYLGVPFIKENDFN

SEQ ID NO: 2191643 - protein, 20 aa, Cryptosporidium hominis
ISQLIWYQHIQPLSTEIVRI

SEQ ID NO: 2191644 - protein, 26 aa, Cryptosporidium hominis
ISQTMALLNVNPLGLQPFVQAQTPQQ

SEQ ID NO: 2191645 - protein, 23 aa, Cryptosporidium hominis
ISQYCPTIFWNIVRIFHGEIDLG

SEQ ID NO: 2191646 - protein, 25 aa, Cryptosporidium hominis
ISREDYMLPTFSLLNIQPYNSTYCS

SEQ ID NO: 2191647 - protein, 26 aa, Cryptosporidium hominis
ISRFEKRGYRIAAMKLTIATPAILEE

SEQ ID NO: 2191648 - protein, 19 aa, Cryptosporidium hominis
ISRHLGISKLGTPNSRCSI

SEQ ID NO: 2191649 - protein, 17 aa, Cryptosporidium hominis
ISRYFSAKRYGVEKSYE

SEQ ID NO: 2191650 - protein, 27 aa, Cryptosporidium hominis
ISSAPRLPFIIKRPQINLAISRGIFFE

SEQ ID NO: 2191651 - protein, 26 aa, Cryptosporidium hominis
ISSFGYPSYPLPPIHNIAPSCNKCLL

SEQ ID NO: 2191652 - protein, 18 aa, Cryptosporidium hominis
ISSFVFLIDTVYNIIPGT

SEQ ID NO: 2191653 - protein, 30 aa, Cryptosporidium hominis
ISSKIIPVPDWMRPLLFTKSPNEALVGKIS

SEQ ID NO: 2191654 - protein, 20 aa, Cryptosporidium hominis
ISSLALLKMLKHGRAGVPME

SEQ ID NO: 2191655 - protein, 25 aa, Cryptosporidium hominis
ISSLEIPIFLQLLNFCVYSVMDSID

SEQ ID NO: 2191656 - protein, 38 aa, Cryptosporidium hominis
ISTEFEIKFELGLINGSWLGGDIFILNREHALEAVNYS

SEQ ID NO: 2191657 - protein, 22 aa, Cryptosporidium hominis
ISTHGLFRATFEDKILLSDIVF

SEQ ID NO: 2191658 - protein, 18 aa, Cryptosporidium hominis
ISTIFDRIASNCSNLAIV

SEQ ID NO: 2191659 - protein, 18 aa, Cryptosporidium hominis
ISTILIFIIFEAESNIQN

SEQ ID NO: 2191660 - protein, 21 aa, Cryptosporidium hominis
ISTIYCKLNPLFEKALDHYKN

SEQ ID NO: 2191661 - protein, 24 aa, Cryptosporidium hominis
ISTLNVINYLIPNKEFRLKVSSVV

SEQ ID NO: 2191662 - protein, 30 aa, Cryptosporidium hominis
ISTRLNCLIQDVFDLRKHKWVKKVHKQKAK

SEQ ID NO: 2191663 - protein, 18 aa, Cryptosporidium hominis
ISVFDRNTLCWADVEYTA

SEQ ID NO: 2191664 - protein, 17 aa, Cryptosporidium hominis
ISVLLEGIARQVVAFKG

SEQ ID NO: 2191665 - protein, 24 aa, Cryptosporidium hominis
ISVPGLLKTIPKYGNNFNKESFNN

SEQ ID NO: 2191666 - protein, 24 aa, Cryptosporidium hominis
ISVPNELLYQPIFSGGYDGYIRSW

SEQ ID NO: 2191667 - protein, 31 aa, Cryptosporidium hominis
ISYETAYALTYILKFGYEPYKLFQVPNIITS

SEQ ID NO: 2191668 - protein, 19 aa, Cryptosporidium hominis
ISYFSKLLELCEEIFHVSP

SEQ ID NO: 2191669 - protein, 24 aa, Cryptosporidium hominis
ITALLQEIISIYPLLSPPNLSNQA

SEQ ID NO: 2191670 - protein, 25 aa, Cryptosporidium hominis
ITCARFSSFLRNNSGRLHWLRVMYH

SEQ ID NO: 2191671 - protein, 25 aa, Cryptosporidium hominis
ITDFKRILIDLKFTGKLIQDLSICE

SEQ ID NO: 2191672 - protein, 24 aa, Cryptosporidium hominis
ITDHIEDLLPKYLNFIKGVVDSDD

SEQ ID NO: 2191673 - protein, 19 aa, Cryptosporidium hominis
ITDKYLWARIFSEANRKFS

SEQ ID NO: 2191674 - protein, 18 aa, Cryptosporidium hominis
ITDSHWMFSPNNDSWTVV

SEQ ID NO: 2191675 - protein, 21 aa, Cryptosporidium hominis
ITELLNIPPIPIKSLKYPEII

SEQ ID NO: 2191676 - protein, 25 aa, Cryptosporidium hominis
ITEMNSLLFLKINLGFNPQTLIDQV

SEQ ID NO: 2191677 - protein, 25 aa, Cryptosporidium hominis
ITESLYNFISAFHFNQADFPDSNEF

SEQ ID NO: 2191678 - protein, 27 aa, Cryptosporidium hominis
ITETYISRTLYLCKLPYDMTEDSVREL

SEQ ID NO: 2191679 - protein, 30 aa, Cryptosporidium hominis
ITGHPNFMTGSLIHNFPLFQNQDTSLTANN

SEQ ID NO: 2191680 - protein, 22 aa, Cryptosporidium hominis
ITGPHLIVVPLSTVGNWAREAR

SEQ ID NO: 2191681 - protein, 17 aa, Cryptosporidium hominis
ITHLKIQILYRLGQFEE

SEQ ID NO: 2191682 - protein, 21 aa, Cryptosporidium hominis
ITIDIALWQFETPKYHYTVID

SEQ ID NO: 2191683 - protein, 36 aa, Cryptosporidium hominis
ITIFEFVQIYFENFLKQWYLSFTNVLLRMLDDTLWT

SEQ ID NO: 2191684 - protein, 17 aa, Cryptosporidium hominis
ITKYKGSLTTKEAEINN

SEQ ID NO: 2191685 - protein, 17 aa, Cryptosporidium hominis
ITLELYSTPKYARYIRN

SEQ ID NO: 2191686 - protein, 26 aa, Cryptosporidium hominis
ITLIDKKFNWVPFSRAPPSEVESLPQ

SEQ ID NO: 2191687 - protein, 29 aa, Cryptosporidium hominis
ITLQDPATVIFKAPNWYKIIKSTNEISPS

SEQ ID NO: 2191688 - protein, 30 aa, Cryptosporidium hominis
ITNDLLSTLEYFNWYLNLSGDIEPFPDCST

SEQ ID NO: 2191689 - protein, 25 aa, Cryptosporidium hominis
ITNLRRIIIYHSLFLTKPSNSRPPS

SEQ ID NO: 2191690 - protein, 21 aa, Cryptosporidium hominis
ITNRLGTWLLRIQLNNKLVTD

SEQ ID NO: 2191691 - protein, 18 aa, Cryptosporidium hominis
ITPLRQPFETFVTGNDGT

SEQ ID NO: 2191692 - protein, 23 aa, Cryptosporidium hominis
ITQKFMEPRLLIVTDPRVDSQAV

SEQ ID NO: 2191693 - protein, 27 aa, Cryptosporidium hominis
ITQNKFLSMLIFFPNIESQISIFLASV

SEQ ID NO: 2191694 - protein, 20 aa, Cryptosporidium hominis
ITRLAQQEKWLESFRPKREE

SEQ ID NO: 2191695 - protein, 21 aa, Cryptosporidium hominis
ITRNRLSRIPGKIVRIPTGLV

SEQ ID NO: 2191696 - protein, 19 aa, Cryptosporidium hominis
ITRYLIMFGYVIRTQKKYE

SEQ ID NO: 2191697 - protein, 21 aa, Cryptosporidium hominis
ITSEIGCCFAGMPADFRVILK

SEQ ID NO: 2191698 - protein, 18 aa, Cryptosporidium hominis
ITSLGFKPKYDYIFNGNK

SEQ ID NO: 2191699 - protein, 25 aa, Cryptosporidium hominis
ITSQPLNFPIPMDTQFLISSFGYPS

SEQ ID NO: 2191700 - protein, 26 aa, Cryptosporidium hominis
ITSVYGWDLCYEVILLDFHDLMIEGG

SEQ ID NO: 2191701 - protein, 25 aa, Cryptosporidium hominis
ITTEIQSFVPVILGENQKLDTSEME

SEQ ID NO: 2191702 - protein, 27 aa, Cryptosporidium hominis
ITTTCSYPILLTPRLYIVCVSLLSELS

SEQ ID NO: 2191703 - protein, 29 aa, Cryptosporidium hominis
ITVRGNTIRYFILPDSLPLDALLIDDTPK

SEQ ID NO: 2191704 - protein, 19 aa, Cryptosporidium hominis
ITYIRTITNLLPPNGVWIN

SEQ ID NO: 2191705 - protein, 17 aa, Cryptosporidium hominis
IVASYWIANLVRNENIF

SEQ ID NO: 2191706 - protein, 21 aa, Cryptosporidium hominis
IVDIWDIRNLEKISSLEYLTK

SEQ ID NO: 2191707 - protein, 19 aa, Cryptosporidium hominis
IVDQLFKGINGTVLAYGQT

SEQ ID NO: 2191708 - protein, 19 aa, Cryptosporidium hominis
IVEILSLPFQSMPLSIMVE

SEQ ID NO: 2191709 - protein, 24 aa, Cryptosporidium hominis
IVEISLYHALSFYNAIYSEDFGYI

SEQ ID NO: 2191710 - protein, 33 aa, Cryptosporidium hominis
IVENLVILEELKFFRFFDFFISFSNKDPTKKEY

SEQ ID NO: 2191711 - protein, 19 aa, Cryptosporidium hominis
IVERLLLRGYKVRATTRSK

SEQ ID NO: 2191712 - protein, 17 aa, Cryptosporidium hominis
IVEVEMWKRKLKTQEVQ

SEQ ID NO: 2191713 - protein, 22 aa, Cryptosporidium hominis
IVFIHDICILSDFFKKPTSENN

SEQ ID NO: 2191714 - protein, 17 aa, Cryptosporidium hominis
IVFLISMASRKYTLGSC

SEQ ID NO: 2191715 - protein, 27 aa, Cryptosporidium hominis
IVGAIIDTFGPISSPFYVLSKQSNVSN

SEQ ID NO: 2191716 - protein, 17 aa, Cryptosporidium hominis
IVGEYFVHIWKAAGMDM

SEQ ID NO: 2191717 - protein, 25 aa, Cryptosporidium hominis
IVIAPLKLFGLTNFLHRISNWYNYR

SEQ ID NO: 2191718 - protein, 21 aa, Cryptosporidium hominis
IVIRNLELISYFSSCKLQPLH

SEQ ID NO: 2191719 - protein, 19 aa, Cryptosporidium hominis
IVISLKDRLFSQADTLIGV

SEQ ID NO: 2191720 - protein, 23 aa, Cryptosporidium hominis
IVKGIILWGLPFYVQEKSILNHV

SEQ ID NO: 2191721 - protein, 25 aa, Cryptosporidium hominis
IVKIGMPSIVFSLGLLISNIFGGKD

SEQ ID NO: 2191722 - protein, 27 aa, Cryptosporidium hominis
IVKNRDLINYLYQDIKFLKETNNLLSN

SEQ ID NO: 2191723 - protein, 17 aa, Cryptosporidium hominis
IVKRIWQYVEMKGLQNS

SEQ ID NO: 2191724 - protein, 26 aa, Cryptosporidium hominis
IVKSDPSTIMLDLGSVLCLEDKTIVG

SEQ ID NO: 2191725 - protein, 34 aa, Cryptosporidium hominis
IVLDSIPLFFQQRDGPWFPTLRLLHKYPDMMPTM

SEQ ID NO: 2191726 - protein, 17 aa, Cryptosporidium hominis
IVLFTTLNRTVLCYIYS

SEQ ID NO: 2191727 - protein, 40 aa, Cryptosporidium hominis
IVLIRKRRQLMNLISTRIYRWYLFYKHIILPLRRQVEYRM

SEQ ID NO: 2191728 - protein, 35 aa, Cryptosporidium hominis
IVLNLMRILLSKFHKKYLIASLYPDLLTSSEDNEY

SEQ ID NO: 2191729 - protein, 20 aa, Cryptosporidium hominis
IVLSERRRILASNRNSNRRG

SEQ ID NO: 2191730 - protein, 19 aa, Cryptosporidium hominis
IVNIRYLHGYNIKNGFKFM

SEQ ID NO: 2191731 - protein, 18 aa, Cryptosporidium hominis
IVNLGDDLFFLASKLSDS

SEQ ID NO: 2191732 - protein, 18 aa, Cryptosporidium hominis
IVNLWISLLPIKYDTDEA

SEQ ID NO: 2191733 - protein, 23 aa, Cryptosporidium hominis
IVQIKGCFYSLTPGGIIMQNIVM

SEQ ID NO: 2191734 - protein, 23 aa, Cryptosporidium hominis
IVQRYICRICIPRVNRMPALQNR

SEQ ID NO: 2191735 - protein, 28 aa, Cryptosporidium hominis
IVQSYNESFKFQPLSRIESKRSISVPVH

SEQ ID NO: 2191736 - protein, 17 aa, Cryptosporidium hominis
IVQSYPAFFETEMKLFY

SEQ ID NO: 2191737 - protein, 18 aa, Cryptosporidium hominis
IVQTLLRLEILETRKHFP

SEQ ID NO: 2191738 - protein, 37 aa, Cryptosporidium hominis
IVQWKNARVFFIHRIKRQLLLFSLRSEISQKLGISLT

SEQ ID NO: 2191739 - protein, 20 aa, Cryptosporidium hominis
IVSFDKWNLMEFVKGIICQH

SEQ ID NO: 2191740 - protein, 22 aa, Cryptosporidium hominis
IVSICCLILRIISCTWSNNFSS

SEQ ID NO: 2191741 - protein, 19 aa, Cryptosporidium hominis
IVSKCTLLYFSMPSNQLNE

SEQ ID NO: 2191742 - protein, 20 aa, Cryptosporidium hominis
IVSKEKFGCIIGIQFASKIT

SEQ ID NO: 2191743 - protein, 28 aa, Cryptosporidium hominis
IVSKLGWGHFSTVWLAIDTLSTPTTYFA

SEQ ID NO: 2191744 - protein, 17 aa, Cryptosporidium hominis
IVSYLLDIDRFSTVLDL

SEQ ID NO: 2191745 - protein, 24 aa, Cryptosporidium hominis
IVTEKWTSPLIPYIIKDFSCPNCF

SEQ ID NO: 2191746 - protein, 25 aa, Cryptosporidium hominis
IVTNFIQNWAPLLYNHDFWSKCYVL

SEQ ID NO: 2191747 - protein, 26 aa, Cryptosporidium hominis
IVTNGNFLFYSLFEALKVNLNVDQNQ

SEQ ID NO: 2191748 - protein, 17 aa, Cryptosporidium hominis
IVVMLVGNKLDLVEKDP

SEQ ID NO: 2191749 - protein, 18 aa, Cryptosporidium hominis
IVVNQVMFPIDLPSGNDQ

SEQ ID NO: 2191750 - protein, 17 aa, Cryptosporidium hominis
IWEFTLLCNLNDGSFYV

SEQ ID NO: 2191751 - protein, 18 aa, Cryptosporidium hominis
IWEGIYYVVGSNLTQYLS

SEQ ID NO: 2191752 - protein, 19 aa, Cryptosporidium hominis
IWKHKKYMKSLQSISNREK

SEQ ID NO: 2191753 - protein, 19 aa, Cryptosporidium hominis
IWNHTFYWSCLRSPSETNK

SEQ ID NO: 2191754 - protein, 19 aa, Cryptosporidium hominis
IWRLAYISVMGYEIDFGWL

SEQ ID NO: 2191755 - protein, 25 aa, Cryptosporidium hominis
IWSVGCIFIELLIGRPIFSGDSEVS

SEQ ID NO: 2191756 - protein, 24 aa, Cryptosporidium hominis
IYDGQHLDAWFTRSFYKNMLGQPI

SEQ ID NO: 2191757 - protein, 19 aa, Cryptosporidium hominis
IYDKVKLIHKFIIQECKIN

SEQ ID NO: 2191758 - protein, 18 aa, Cryptosporidium hominis
IYDPIYDYKIKKLNMIGN

SEQ ID NO: 2191759 - protein, 27 aa, Cryptosporidium hominis
IYDSKFKYLILNFSSLYMKKLVQPYYS

SEQ ID NO: 2191760 - protein, 22 aa, Cryptosporidium hominis
IYEGCEIPVLVSTFKDTFLNKK

SEQ ID NO: 2191761 - protein, 17 aa, Cryptosporidium hominis
IYEGMWYKDQAIGLYIL

SEQ ID NO: 2191762 - protein, 21 aa, Cryptosporidium hominis
IYEKAFHIIVSYFPYEYEDDH

SEQ ID NO: 2191763 - protein, 21 aa, Cryptosporidium hominis
IYGNSIPIRVLAERIAMYMHN

SEQ ID NO: 2191764 - protein, 33 aa, Cryptosporidium hominis
IYGPIVHSVWPRILFIQSIIIGRFKFLDDYKHE

SEQ ID NO: 2191765 - protein, 17 aa, Cryptosporidium hominis
IYKGFVHAVLDVDYNPM

SEQ ID NO: 2191766 - protein, 20 aa, Cryptosporidium hominis
IYKRCILNSAFLHSTIPSLP

SEQ ID NO: 2191767 - protein, 21 aa, Cryptosporidium hominis
IYNALVFPIYAERDNWSCVPT

SEQ ID NO: 2191768 - protein, 31 aa, Cryptosporidium hominis
IYNGFNYVYRSFILKLVIKLNNYFLSFIDGN

SEQ ID NO: 2191769 - protein, 18 aa, Cryptosporidium hominis
IYNKILTHSPKKPVIIFV

SEQ ID NO: 2191770 - protein, 17 aa, Cryptosporidium hominis
IYNLEHILISLSICLLK

SEQ ID NO: 2191771 - protein, 26 aa, Cryptosporidium hominis
IYNNYNYGYPIYFLKGLYKENVLDFN

SEQ ID NO: 2191772 - protein, 19 aa, Cryptosporidium hominis
IYRIGNIHPNLRGLSSMII

SEQ ID NO: 2191773 - protein, 28 aa, Cryptosporidium hominis
IYRLPDERYISLKFLAKFVLNKNIQTEV

SEQ ID NO: 2191774 - protein, 18 aa, Cryptosporidium hominis
IYRRAPVGVPQNLGYRLV

SEQ ID NO: 2191775 - protein, 22 aa, Cryptosporidium hominis
IYSIKNCKLINSLFKSILGCKS

SEQ ID NO: 2191776 - protein, 18 aa, Cryptosporidium hominis
IYYELDILEIRKLRFKDF

SEQ ID NO: 2191777 - protein, 26 aa, Cryptosporidium hominis
IYYGYFSMQYPIIWEDFKNHLNSNNS

SEQ ID NO: 2191778 - protein, 34 aa, Cryptosporidium hominis
IYYLFGCRLIIIMELIELPKRQWYHVSGSSLDIK

SEQ ID NO: 2191779 - protein, 18 aa, Cryptosporidium hominis
KAALKKTPILPMKKEIEI

SEQ ID NO: 2191780 - protein, 17 aa, Cryptosporidium hominis
KACRRLDIGGYHLDLAL

SEQ ID NO: 2191781 - protein, 18 aa, Cryptosporidium hominis
KADKYYELFYKSEQYWDL

SEQ ID NO: 2191782 - protein, 22 aa, Cryptosporidium hominis
KAFERNLLFSGFIKVKKLKGDG

SEQ ID NO: 2191783 - protein, 19 aa, Cryptosporidium hominis
KAFTPIRVLIYPLTIGTRN

SEQ ID NO: 2191784 - protein, 20 aa, Cryptosporidium hominis
KAIEIAYKYGFQNFNLNVGC

SEQ ID NO: 2191785 - protein, 23 aa, Cryptosporidium hominis
KAIIEKIPKFWADTISRHPVFQD

SEQ ID NO: 2191786 - protein, 17 aa, Cryptosporidium hominis
KAIKKIASMLGGGSFTA

SEQ ID NO: 2191787 - protein, 25 aa, Cryptosporidium hominis
KAKAPLGVINFKIAEWNLQISDSDE

SEQ ID NO: 2191788 - protein, 29 aa, Cryptosporidium hominis
KAKFGLDIFADALLAIPKTLAENAGLDQQ

SEQ ID NO: 2191789 - protein, 26 aa, Cryptosporidium hominis
KAKMVFHGRFFAGRKLNVSFIKDEEF

SEQ ID NO: 2191790 - protein, 26 aa, Cryptosporidium hominis
KAKNNKLYLYLGDELSQILFRHMEMI

SEQ ID NO: 2191791 - protein, 24 aa, Cryptosporidium hominis
KALDLNHCMALIGSPAKIFGENNY

SEQ ID NO: 2191792 - protein, 25 aa, Cryptosporidium hominis
KALENIYYIFERLVKYLKDFNDENS

SEQ ID NO: 2191793 - protein, 23 aa, Cryptosporidium hominis
KALSKLWKSLFQHKNMYLTQLFD

SEQ ID NO: 2191794 - protein, 25 aa, Cryptosporidium hominis
KALSNFHFHHNFSMFGEVIQDNGQR

SEQ ID NO: 2191795 - protein, 21 aa, Cryptosporidium hominis
KALSNSRYWSLDSITSKCPQS

SEQ ID NO: 2191796 - protein, 20 aa, Cryptosporidium hominis
KALYNKAFYVWHENFLKNSD

SEQ ID NO: 2191797 - protein, 17 aa, Cryptosporidium hominis
KAMWSAFVSVRHTLAKY

SEQ ID NO: 2191798 - protein, 25 aa, Cryptosporidium hominis
KANNRLELVLFQLYCNENMGGKYFD

SEQ ID NO: 2191799 - protein, 20 aa, Cryptosporidium hominis
KANTLSLVGIINFCTTIKLK

SEQ ID NO: 2191800 - protein, 23 aa, Cryptosporidium hominis
KANYYFDHVFDDKSTNYLIYDKL

SEQ ID NO: 2191801 - protein, 32 aa, Cryptosporidium hominis
KAPDAVLNAPLPSVSWIPKKEFNVTLYGHGVD

SEQ ID NO: 2191802 - protein, 29 aa, Cryptosporidium hominis
KAPDVCYSWWIFSLLYFLGRANYIDKNLL

SEQ ID NO: 2191803 - protein, 21 aa, Cryptosporidium hominis
KAPNHLTVNDLLRPVFSCDYS

SEQ ID NO: 2191804 - protein, 26 aa, Cryptosporidium hominis
KAPPVYKIDIFPLSPKAFDICLNPVA

SEQ ID NO: 2191805 - protein, 26 aa, Cryptosporidium hominis
KAPTPHLAAMWVSEIDMLIQKSKNNW

SEQ ID NO: 2191806 - protein, 31 aa, Cryptosporidium hominis
KAQDGLLYPLNRSFIFITKPVILIRFDDILN

SEQ ID NO: 2191807 - protein, 18 aa, Cryptosporidium hominis
KAQFFKEPACSLVVAVHS

SEQ ID NO: 2191808 - protein, 25 aa, Cryptosporidium hominis
KAQGDVLTHFPLFLNKPFTSNENNK

SEQ ID NO: 2191809 - protein, 23 aa, Cryptosporidium hominis
KARELLLTRYKSDEIQFMLQNEK

SEQ ID NO: 2191810 - protein, 26 aa, Cryptosporidium hominis
KARGRCKVAYLDRKAFKRVLGPIEDI

SEQ ID NO: 2191811 - protein, 23 aa, Cryptosporidium hominis
KARILHAVAQWRERFKTIDDFHV

SEQ ID NO: 2191812 - protein, 25 aa, Cryptosporidium hominis
KARIRNQYTISWLKMGIFALNDIKK

SEQ ID NO: 2191813 - protein, 23 aa, Cryptosporidium hominis
KARKKILNIYLKSKNYIQIDDCN

SEQ ID NO: 2191814 - protein, 23 aa, Cryptosporidium hominis
KARLRKGITILGGTPGRILDHID

SEQ ID NO: 2191815 - protein, 20 aa, Cryptosporidium hominis
KASIKFQLKKVLCLGVAIGN

SEQ ID NO: 2191816 - protein, 27 aa, Cryptosporidium hominis
KAVPWSNIKEIFTTKSELRMVNTRAPI

SEQ ID NO: 2191817 - protein, 22 aa, Cryptosporidium hominis
KAYVYCLLGFYDSAMSVCLKEL

SEQ ID NO: 2191818 - protein, 22 aa, Cryptosporidium hominis
KCCAFWKKWCCCCLSDKGPTKS

SEQ ID NO: 2191819 - protein, 24 aa, Cryptosporidium hominis
KCCDYYRYIRRKSWLISNVLLLMV

SEQ ID NO: 2191820 - protein, 33 aa, Cryptosporidium hominis
KCDELDILLERWNPFLLYKFEQEYFKNGAVLMD

SEQ ID NO: 2191821 - protein, 18 aa, Cryptosporidium hominis
KCDFKLISFYKAVKGNIV

SEQ ID NO: 2191822 - protein, 21 aa, Cryptosporidium hominis
KCEDYLFKIGSLESELLIIRQ

SEQ ID NO: 2191823 - protein, 29 aa, Cryptosporidium hominis
KCELFNSWAYKLLHRQSIIAYLQGNISKN

SEQ ID NO: 2191824 - protein, 18 aa, Cryptosporidium hominis
KCFEYQYVCLLARHLEDD

SEQ ID NO: 2191825 - protein, 27 aa, Cryptosporidium hominis
KCFNMHMLIRFLAKNLSLYKYIKSSYA

SEQ ID NO: 2191826 - protein, 24 aa, Cryptosporidium hominis
KCFNNTQWFKATRFIFEINGNDDD

SEQ ID NO: 2191827 - protein, 20 aa, Cryptosporidium hominis
KCFNPGDIIFAESPLLVVTP

SEQ ID NO: 2191828 - protein, 25 aa, Cryptosporidium hominis
KCILKMEQTFLPTSFKPIISFAIVP

SEQ ID NO: 2191829 - protein, 19 aa, Cryptosporidium hominis
KCKFITPQNRFSIESGYRW

SEQ ID NO: 2191830 - protein, 25 aa, Cryptosporidium hominis
KCKHLTPQWYIDTYIKLFCLAGNII

SEQ ID NO: 2191831 - protein, 26 aa, Cryptosporidium hominis
KCKMHKILIFTQFQLILDELENYCLW

SEQ ID NO: 2191832 - protein, 29 aa, Cryptosporidium hominis
KCLDACVHYISYTLKYLLDNPEENALNIS

SEQ ID NO: 2191833 - protein, 23 aa, Cryptosporidium hominis
KCLKFLNEILLSSKNIFWNVPGQ

SEQ ID NO: 2191834 - protein, 27 aa, Cryptosporidium hominis
KCNSLDLVFFELIKSLFRVLNLNNKHS

SEQ ID NO: 2191835 - protein, 17 aa, Cryptosporidium hominis
KCNYYRGLLSREFPNIF

SEQ ID NO: 2191836 - protein, 27 aa, Cryptosporidium hominis
KCQINYMQKILYSLKYKKHALLESPTG

SEQ ID NO: 2191837 - protein, 28 aa, Cryptosporidium hominis
KCSDKSILWKIFVKRRLRRLDLAHLTSV

SEQ ID NO: 2191838 - protein, 17 aa, Cryptosporidium hominis
KCTLWRSSQPKSAFKRC

SEQ ID NO: 2191839 - protein, 30 aa, Cryptosporidium hominis
KCTPPAFKSSPPLLFILICSSNTDSIEEQK

SEQ ID NO: 2191840 - protein, 28 aa, Cryptosporidium hominis
KCVIKTLHQILRPFMLRRLKADVERDLP

SEQ ID NO: 2191841 - protein, 22 aa, Cryptosporidium hominis
KCYRYRIFSLPPRAGASSSENA

SEQ ID NO: 2191842 - protein, 20 aa, Cryptosporidium hominis
KDAFILICSDGVWEFISSQE

SEQ ID NO: 2191843 - protein, 27 aa, Cryptosporidium hominis
KDDDSQNKLPPWKRKPISLDNDILKRA

SEQ ID NO: 2191844 - protein, 18 aa, Cryptosporidium hominis
KDDLVVNFIVSKELLERN

SEQ ID NO: 2191845 - protein, 25 aa, Cryptosporidium hominis
KDEHCYNIFILKGIGWRKLSNYENE

SEQ ID NO: 2191846 - protein, 24 aa, Cryptosporidium hominis
KDEHFMCNWIQWDPTGRYVTTAFQ

SEQ ID NO: 2191847 - protein, 24 aa, Cryptosporidium hominis
KDESEPIDILSDEIILFSNNESAI

SEQ ID NO: 2191848 - protein, 19 aa, Cryptosporidium hominis
KDFALLKDEKEMLKNKYTE

SEQ ID NO: 2191849 - protein, 27 aa, Cryptosporidium hominis
KDFIKNLFFVYYCKSPLVMNSSLCSFL

SEQ ID NO: 2191850 - protein, 20 aa, Cryptosporidium hominis
KDFIMNVYHPKLLLSIVSNV

SEQ ID NO: 2191851 - protein, 34 aa, Cryptosporidium hominis
KDFKPLMLEVFIRKAPWQILVKNLNYLIGNVRSG

SEQ ID NO: 2191852 - protein, 21 aa, Cryptosporidium hominis
KDFRNQLLSLRRNLAAEFGIS

SEQ ID NO: 2191853 - protein, 31 aa, Cryptosporidium hominis
KDFSELIVLKELPKLETLSLLLNPIAEKNSE

SEQ ID NO: 2191854 - protein, 26 aa, Cryptosporidium hominis
KDFVFNSYCLIHLKECINLLTNEINS

SEQ ID NO: 2191855 - protein, 23 aa, Cryptosporidium hominis
KDGKGILRFAMGHSIQGVWKDGV

SEQ ID NO: 2191856 - protein, 18 aa, Cryptosporidium hominis
KDHIPFRNSKLTMVLKNS

SEQ ID NO: 2191857 - protein, 33 aa, Cryptosporidium hominis
KDIARKLLEHELHSLRQWKKGMKQWDSEFSASS

SEQ ID NO: 2191858 - protein, 19 aa, Cryptosporidium hominis
KDICVVYYHYLLESNGSFA

SEQ ID NO: 2191859 - protein, 17 aa, Cryptosporidium hominis
KDIFELVKNIKNSKNDK

SEQ ID NO: 2191860 - protein, 19 aa, Cryptosporidium hominis
KDIGLAYCKVLLVGVGGIG

SEQ ID NO: 2191861 - protein, 19 aa, Cryptosporidium hominis
KDIIIIINTENKLLSCKIP

SEQ ID NO: 2191862 - protein, 21 aa, Cryptosporidium hominis
KDIIMNLKRMLKGEMMIPMTP

SEQ ID NO: 2191863 - protein, 24 aa, Cryptosporidium hominis
KDIKTVLNLIDPYISVNSFNRPNI

SEQ ID NO: 2191864 - protein, 17 aa, Cryptosporidium hominis
KDILLSLSFMVMNQLVS

SEQ ID NO: 2191865 - protein, 26 aa, Cryptosporidium hominis
KDITDLSYVFIRLGDILQLAEKYYEA

SEQ ID NO: 2191866 - protein, 23 aa, Cryptosporidium hominis
KDKDLEVLVVSQFTLFGNVKNGS

SEQ ID NO: 2191867 - protein, 18 aa, Cryptosporidium hominis
KDKLFQLSKMRIYEKPDE

SEQ ID NO: 2191868 - protein, 20 aa, Cryptosporidium hominis
KDLIAKWKKQGYEYLCCINC

SEQ ID NO: 2191869 - protein, 25 aa, Cryptosporidium hominis
KDLPQGYIRFKTSISSPLSQDDFFS

SEQ ID NO: 2191870 - protein, 26 aa, Cryptosporidium hominis
KDLQGIMTCFNLLKTYINNVHSHPYE

SEQ ID NO: 2191871 - protein, 17 aa, Cryptosporidium hominis
KDLRKLFANLNIPLIKI

SEQ ID NO: 2191872 - protein, 18 aa, Cryptosporidium hominis
KDMLGYTRQSLIGGIDAF

SEQ ID NO: 2191873 - protein, 21 aa, Cryptosporidium hominis
KDNAFYLGQETALQLLFTLED

SEQ ID NO: 2191874 - protein, 25 aa, Cryptosporidium hominis
KDNNQNFQLIPRITLKSLIEEISRN

SEQ ID NO: 2191875 - protein, 25 aa, Cryptosporidium hominis
KDNPLVSLIGEVPLELSSFANSYRL

SEQ ID NO: 2191876 - protein, 17 aa, Cryptosporidium hominis
KDNVVGGGALVLDDCRK

SEQ ID NO: 2191877 - protein, 30 aa, Cryptosporidium hominis
KDPFEIEYFWKVFNPDIHFKPTLGYAVVPV

SEQ ID NO: 2191878 - protein, 23 aa, Cryptosporidium hominis
KDPIKWYSIFQNNFKFWSSFLTA

SEQ ID NO: 2191879 - protein, 25 aa, Cryptosporidium hominis
KDPSTLYELYHDSGYLAWVGNRSEV

SEQ ID NO: 2191880 - protein, 29 aa, Cryptosporidium hominis
KDRLVQSLHLLALLWRCYKICEERGYYDL

SEQ ID NO: 2191881 - protein, 24 aa, Cryptosporidium hominis
KDSEAELVIPRLSLTEKRRSISKK

SEQ ID NO: 2191882 - protein, 26 aa, Cryptosporidium hominis
KDSEIVVCFIMQLPYYIKVQAGETVD

SEQ ID NO: 2191883 - protein, 21 aa, Cryptosporidium hominis
KDSFFKIFCQKIQSLIRLVSK

SEQ ID NO: 2191884 - protein, 22 aa, Cryptosporidium hominis
KDSIWTKIDILNKKKLCYDCQK

SEQ ID NO: 2191885 - protein, 25 aa, Cryptosporidium hominis
KDSKNLCYALNNIILRDLELPEGCR

SEQ ID NO: 2191886 - protein, 21 aa, Cryptosporidium hominis
KDSKYLFERALNLVRNHFEGK

SEQ ID NO: 2191887 - protein, 26 aa, Cryptosporidium hominis
KDSNEEFLVIPPEKIPDTFVCSQAIK

SEQ ID NO: 2191888 - protein, 25 aa, Cryptosporidium hominis
KDSQYLPQYIPKVSSAKWPSSALLG

SEQ ID NO: 2191889 - protein, 27 aa, Cryptosporidium hominis
KDTVRPPTAPTFFPSNKLNLDNNSNLA

SEQ ID NO: 2191890 - protein, 20 aa, Cryptosporidium hominis
KDVFFYLSDDSHYVPRALLF

SEQ ID NO: 2191891 - protein, 23 aa, Cryptosporidium hominis
KDVILGLHKLVNVHKGAALLSTF

SEQ ID NO: 2191892 - protein, 20 aa, Cryptosporidium hominis
KDWFNPITCLKLHRLQDSVD

SEQ ID NO: 2191893 - protein, 35 aa, Cryptosporidium hominis
KDWGPVYIIKKVESLLDKLLLWKNVGIINDEGNKS

SEQ ID NO: 2191894 - protein, 24 aa, Cryptosporidium hominis
KDWRRRWFVLTRNYLASFKDQRSL

SEQ ID NO: 2191895 - protein, 20 aa, Cryptosporidium hominis
KDYFREVALIKSYFLHNSRV

SEQ ID NO: 2191896 - protein, 31 aa, Cryptosporidium hominis
KDYKPLKKTKKLIIPLDKYPDYNFMGLIIGP

SEQ ID NO: 2191897 - protein, 22 aa, Cryptosporidium hominis
KEAFSLIRWIAIADCIALHITG

SEQ ID NO: 2191898 - protein, 18 aa, Cryptosporidium hominis
KEALIQDIKFRLSPQQLK

SEQ ID NO: 2191899 - protein, 25 aa, Cryptosporidium hominis
KEALKHPFFKGMDFTKIRLQKPPIV

SEQ ID NO: 2191900 - protein, 40 aa, Cryptosporidium hominis
KEAVILPAKFPELFQGKLKPWKGILLYGPPGTGKTFLAKA

SEQ ID NO: 2191901 - protein, 25 aa, Cryptosporidium hominis
KEDDDKFCICVQSIIGEIFELRTQL

SEQ ID NO: 2191902 - protein, 26 aa, Cryptosporidium hominis
KEDICRAYMRLALEWYPDGNRSDTEL

SEQ ID NO: 2191903 - protein, 32 aa, Cryptosporidium hominis
KEDVEYEGIFWHPINKVWIGVWLDSITHETCT

SEQ ID NO: 2191904 - protein, 31 aa, Cryptosporidium hominis
KEEDWKHVSFLAIDLIRKLLTYNPAERITAR

SEQ ID NO: 2191905 - protein, 20 aa, Cryptosporidium hominis
KEEIMELLKKEKTDLENLLR

SEQ ID NO: 2191906 - protein, 18 aa, Cryptosporidium hominis
KEELYFLRKGAFSRFQDN

SEQ ID NO: 2191907 - protein, 30 aa, Cryptosporidium hominis
KEEMLKFKGVFKGLSFILLAGNALSQTTQQ

SEQ ID NO: 2191908 - protein, 29 aa, Cryptosporidium hominis
KEENILKYYKSILMSLPNSPKNIVSSKID

SEQ ID NO: 2191909 - protein, 22 aa, Cryptosporidium hominis
KEFEFKFKNIRPGKLSQRLKDA

SEQ ID NO: 2191910 - protein, 27 aa, Cryptosporidium hominis
KEFETPSLVFFKKSLKWYLESFHSVHL

SEQ ID NO: 2191911 - protein, 18 aa, Cryptosporidium hominis
KEFFDNYKGEESFDFVPI

SEQ ID NO: 2191912 - protein, 22 aa, Cryptosporidium hominis
KEFIPIRLEMYEKRKNYLLSKL

SEQ ID NO: 2191913 - protein, 19 aa, Cryptosporidium hominis
KEFKKVPGALWVQESMLFK

SEQ ID NO: 2191914 - protein, 27 aa, Cryptosporidium hominis
KEFKTIPGVILILRTSDDIPPNTMINP

SEQ ID NO: 2191915 - protein, 22 aa, Cryptosporidium hominis
KEFPVLLSNCNFFIISGPNDIG

SEQ ID NO: 2191916 - protein, 24 aa, Cryptosporidium hominis
KEGNIFLYNRIALDSPRVLFSSLL

SEQ ID NO: 2191917 - protein, 19 aa, Cryptosporidium hominis
KEGVGYNSSLTLKLKKTLK

SEQ ID NO: 2191918 - protein, 31 aa, Cryptosporidium hominis
KEHEIEPQLIFLRWIRLLFSREFSDLNNSII

SEQ ID NO: 2191919 - protein, 19 aa, Cryptosporidium hominis
KEHGLVLNAFEKVDPERRC

SEQ ID NO: 2191920 - protein, 24 aa, Cryptosporidium hominis
KEIAKGLHFLMDSINDYMDGRFCD

SEQ ID NO: 2191921 - protein, 20 aa, Cryptosporidium hominis
KEICTLYPFTDAKQIVMAFL

SEQ ID NO: 2191922 - protein, 31 aa, Cryptosporidium hominis
KEINIKLFGQFIKTPAFYPVSKVLLDEKTIN

SEQ ID NO: 2191923 - protein, 28 aa, Cryptosporidium hominis
KEIQKLDIPIVIKLLHNKLIDLSDTDTN

SEQ ID NO: 2191924 - protein, 21 aa, Cryptosporidium hominis
KEIQRVLDRLPPPTHIVPSQL

SEQ ID NO: 2191925 - protein, 24 aa, Cryptosporidium hominis
KEISEIRWFSFTSLPNWHANQSLR

SEQ ID NO: 2191926 - protein, 18 aa, Cryptosporidium hominis
KEIVLYAHYLNLKYFSTE

SEQ ID NO: 2191927 - protein, 20 aa, Cryptosporidium hominis
KEIYKLPDGFSWFDCNLWDI

SEQ ID NO: 2191928 - protein, 18 aa, Cryptosporidium hominis
KEKAPTASIPPAPALAPT

SEQ ID NO: 2191929 - protein, 23 aa, Cryptosporidium hominis
KEKFIHIHRPFLFSSKMVHTDFK

SEQ ID NO: 2191930 - protein, 18 aa, Cryptosporidium hominis
KEKPFLVYELIMAAVISE

SEQ ID NO: 2191931 - protein, 35 aa, Cryptosporidium hominis
KEKSQKVVFPCILKIIPQYIFNARDPIICGVYVEE

SEQ ID NO: 2191932 - protein, 18 aa, Cryptosporidium hominis
KEKTLLKTFEEINFYFNQ

SEQ ID NO: 2191933 - protein, 26 aa, Cryptosporidium hominis
KEKVSLLHYNLACILTLPCYQRKGYG

SEQ ID NO: 2191934 - protein, 19 aa, Cryptosporidium hominis
KEKYYQYSSPCNGGFYIHS

SEQ ID NO: 2191935 - protein, 33 aa, Cryptosporidium hominis
KELEERGILSRFGYTYLPKFKLGEDEQPIGIYG

SEQ ID NO: 2191936 - protein, 19 aa, Cryptosporidium hominis
KELHWLIDIKVVCLSYDGN

SEQ ID NO: 2191937 - protein, 22 aa, Cryptosporidium hominis
KELNPYYVLQGDSFSSSKICNI

SEQ ID NO: 2191938 - protein, 26 aa, Cryptosporidium hominis
KELTHPSFHWTLHKLKPVLQGLVLPS

SEQ ID NO: 2191939 - protein, 24 aa, Cryptosporidium hominis
KELWSLIDFVYPGKLGTLPVFEQQ

SEQ ID NO: 2191940 - protein, 27 aa, Cryptosporidium hominis
KEMSEKPFFVNFLNDKVKIDNIRFGLD

SEQ ID NO: 2191941 - protein, 22 aa, Cryptosporidium hominis
KENFVACLYTCYEFLRPDTVME

SEQ ID NO: 2191942 - protein, 25 aa, Cryptosporidium hominis
KENKLKQMNFLVGKVFKSLQDSSTE

SEQ ID NO: 2191943 - protein, 19 aa, Cryptosporidium hominis
KENKTCLDKKIRENCILQS

SEQ ID NO: 2191944 - protein, 17 aa, Cryptosporidium hominis
KENVLQPLLVNLSSVKL

SEQ ID NO: 2191945 - protein, 20 aa, Cryptosporidium hominis
KEQSFPWHLEIPFPSEEEDL

SEQ ID NO: 2191946 - protein, 25 aa, Cryptosporidium hominis
KERIELRRQKFGACGPSTEAEKRLA

SEQ ID NO: 2191947 - protein, 20 aa, Cryptosporidium hominis
KERKHWRYNLLDTRILGKKH

SEQ ID NO: 2191948 - protein, 22 aa, Cryptosporidium hominis
KERMFYFNKLRAIEILYEELNE

SEQ ID NO: 2191949 - protein, 24 aa, Cryptosporidium hominis
KERQGEAIHWLKENGKYPQEEYVQ

SEQ ID NO: 2191950 - protein, 21 aa, Cryptosporidium hominis
KERQLLVIWLMDSSSCLKRLD

SEQ ID NO: 2191951 - protein, 26 aa, Cryptosporidium hominis
KERRKVIIAAILEEAKRRKLAEKNKE

SEQ ID NO: 2191952 - protein, 31 aa, Cryptosporidium hominis
KERTLKCFIKKLIIENFKSYNGRHIIGPFSE

SEQ ID NO: 2191953 - protein, 17 aa, Cryptosporidium hominis
KERYHNGNYYDKYGRFC

SEQ ID NO: 2191954 - protein, 24 aa, Cryptosporidium hominis
KESEEFFIPLISMLLHPKFDESRI

SEQ ID NO: 2191955 - protein, 21 aa, Cryptosporidium hominis
KESLDLIRISAPLFLEKESGL

SEQ ID NO: 2191956 - protein, 17 aa, Cryptosporidium hominis
KESLSKLYQDFSKFVVF

SEQ ID NO: 2191957 - protein, 38 aa, Cryptosporidium hominis
KESNIINRQGLSSIFYPIFPLVCFPDFVRSGANMEHLM

SEQ ID NO: 2191958 - protein, 24 aa, Cryptosporidium hominis
KESQMISYEEYMKKMAPKRLEVPK

SEQ ID NO: 2191959 - protein, 26 aa, Cryptosporidium hominis
KESRWLPTVLIGLINRYYSRKRPILC

SEQ ID NO: 2191960 - protein, 27 aa, Cryptosporidium hominis
KESTLHLVLRLRGGVIEPSLANLARQY

SEQ ID NO: 2191961 - protein, 29 aa, Cryptosporidium hominis
KETIRIYQVILPPKLLFKLPKHHVLKSLP

SEQ ID NO: 2191962 - protein, 24 aa, Cryptosporidium hominis
KEVDIRMLEISKTLLRFFDYEYDL

SEQ ID NO: 2191963 - protein, 22 aa, Cryptosporidium hominis
KEVFKCFLCGELGHTLKDCKKP

SEQ ID NO: 2191964 - protein, 26 aa, Cryptosporidium hominis
KEVKVLLLSLLKVDPLLRPSIFDIEQ

SEQ ID NO: 2191965 - protein, 23 aa, Cryptosporidium hominis
KEVPIRIRFLINDVIDSRKNNWK

SEQ ID NO: 2191966 - protein, 24 aa, Cryptosporidium hominis
KEVSIWAPRIRAVKYHGSQKERRQ

SEQ ID NO: 2191967 - protein, 19 aa, Cryptosporidium hominis
KEVYDDIPVVKYVPKFDVE

SEQ ID NO: 2191968 - protein, 17 aa, Cryptosporidium hominis
KEWLIDTGSVCAGGLCS

SEQ ID NO: 2191969 - protein, 21 aa, Cryptosporidium hominis
KEYEIILLLLKDLISYFSKLL

SEQ ID NO: 2191970 - protein, 23 aa, Cryptosporidium hominis
KEYLYLMALVDDSKFIDVDKAEE

SEQ ID NO: 2191971 - protein, 29 aa, Cryptosporidium hominis
KEYMKSLELLWLSHIFELSLSKTGSQSFY

SEQ ID NO: 2191972 - protein, 30 aa, Cryptosporidium hominis
KEYPSSPNLWLLYGFIYRKAFPDRVNETLK

SEQ ID NO: 2191973 - protein, 17 aa, Cryptosporidium hominis
KEYRLRALALHPDKNQN

SEQ ID NO: 2191974 - protein, 31 aa, Cryptosporidium hominis
KFCLRNNMSFLLHLLVFSCLIINLCFGSEST

SEQ ID NO: 2191975 - protein, 23 aa, Cryptosporidium hominis
KFDAHWLIVRINESAPIQPKPFF

SEQ ID NO: 2191976 - protein, 18 aa, Cryptosporidium hominis
KFDGAMFRGRQIKVSTKR

SEQ ID NO: 2191977 - protein, 28 aa, Cryptosporidium hominis
KFDLFQYNIYLVLWIQLHVRKEFSLQFK

SEQ ID NO: 2191978 - protein, 34 aa, Cryptosporidium hominis
KFEIATLFIQYFLQDVLNILIPFKPDVTMKIFKG

SEQ ID NO: 2191979 - protein, 19 aa, Cryptosporidium hominis
KFEIMTDSLLLLQRLEESR

SEQ ID NO: 2191980 - protein, 20 aa, Cryptosporidium hominis
KFENKLKNKLYLPLYSKFVD

SEQ ID NO: 2191981 - protein, 19 aa, Cryptosporidium hominis
KFEPHIFSLARRALVSWAE

SEQ ID NO: 2191982 - protein, 17 aa, Cryptosporidium hominis
KFFEKINKILLVPYKVI

SEQ ID NO: 2191983 - protein, 26 aa, Cryptosporidium hominis
KFFQTPRIWLFGYNKEGYPLSTEEMV

SEQ ID NO: 2191984 - protein, 25 aa, Cryptosporidium hominis
KFGETLYVKIVFSKLTQLPKGVAFV

SEQ ID NO: 2191985 - protein, 23 aa, Cryptosporidium hominis
KFGLGKWRIILATSKLTNRDEVG

SEQ ID NO: 2191986 - protein, 18 aa, Cryptosporidium hominis
KFGVKYETNQSGKTQIKI

SEQ ID NO: 2191987 - protein, 19 aa, Cryptosporidium hominis
KFGWIAYHEYLFTKERLHK

SEQ ID NO: 2191988 - protein, 18 aa, Cryptosporidium hominis
KFGYFHMFSSQYEEGYKR

SEQ ID NO: 2191989 - protein, 18 aa, Cryptosporidium hominis
KFHFNIPTLLVSTPGRFI

SEQ ID NO: 2191990 - protein, 19 aa, Cryptosporidium hominis
KFIINWIKKIEIEIGIKID

SEQ ID NO: 2191991 - protein, 19 aa, Cryptosporidium hominis
KFITRIWHPNISSQTGAIC

SEQ ID NO: 2191992 - protein, 18 aa, Cryptosporidium hominis
KFIVKNLQILTGKEIKFI

SEQ ID NO: 2191993 - protein, 19 aa, Cryptosporidium hominis
KFKEKLNLKIRKKKDSTHE

SEQ ID NO: 2191994 - protein, 30 aa, Cryptosporidium hominis
KFKHLEFFNTLLIRLEKFLSWIAKNNIQEY

SEQ ID NO: 2191995 - protein, 22 aa, Cryptosporidium hominis
KFLKILEISFRRDPMNFRPRIN

SEQ ID NO: 2191996 - protein, 18 aa, Cryptosporidium hominis
KFLLVESGIRFHTTQWKR

SEQ ID NO: 2191997 - protein, 19 aa, Cryptosporidium hominis
KFLNLLKRYYKEIYDDFSE

SEQ ID NO: 2191998 - protein, 30 aa, Cryptosporidium hominis
KFMPDGTIFKQGWTLFVMINTGVPDYDPNN

SEQ ID NO: 2191999 - protein, 18 aa, Cryptosporidium hominis
KFNEGCIIFIDEIDTLAS

SEQ ID NO: 2192000 - protein, 31 aa, Cryptosporidium hominis
KFNENSRFLFQVPPPPPLVYSSSGQPVSSLG

SEQ ID NO: 2192001 - protein, 18 aa, Cryptosporidium hominis
KFNFISEKFPPNYQSKKI

SEQ ID NO: 2192002 - protein, 18 aa, Cryptosporidium hominis
KFNIMADLIRLLSKPRLF

SEQ ID NO: 2192003 - protein, 18 aa, Cryptosporidium hominis
KFNKIDTWWVSETGIMDF

SEQ ID NO: 2192004 - protein, 18 aa, Cryptosporidium hominis
KFNRLPICIWRTISDFEE

SEQ ID NO: 2192005 - protein, 20 aa, Cryptosporidium hominis
KFNTDFGPLIFNVWDTAGQE

SEQ ID NO: 2192006 - protein, 20 aa, Cryptosporidium hominis
KFPRQIIRYCFGGTPLYSES

SEQ ID NO: 2192007 - protein, 18 aa, Cryptosporidium hominis
KFQRFDITKFIKSALSSY

SEQ ID NO: 2192008 - protein, 19 aa, Cryptosporidium hominis
KFRETIGKLFDLSYEEVFI

SEQ ID NO: 2192009 - protein, 21 aa, Cryptosporidium hominis
KFRKISFYCYGPPNFLGTGRA

SEQ ID NO: 2192010 - protein, 22 aa, Cryptosporidium hominis
KFSDMYFCHFYKTNIELEKLDK

SEQ ID NO: 2192011 - protein, 25 aa, Cryptosporidium hominis
KFSGIILAGNILRLTPASKGNQFST

SEQ ID NO: 2192012 - protein, 19 aa, Cryptosporidium hominis
KFSILRYFNPVGCHPSSLI

SEQ ID NO: 2192013 - protein, 31 aa, Cryptosporidium hominis
KFSLEVISILFSLKIMFPDKIFLLRGNHEDA

SEQ ID NO: 2192014 - protein, 20 aa, Cryptosporidium hominis
KFSNLLPAWTELHGKKIILT

SEQ ID NO: 2192015 - protein, 28 aa, Cryptosporidium hominis
KFSQSHTLFYRFLKFIETHLWTTVIDIS

SEQ ID NO: 2192016 - protein, 17 aa, Cryptosporidium hominis
KFTLYNTSGAKFMKITQ

SEQ ID NO: 2192017 - protein, 26 aa, Cryptosporidium hominis
KFTPYKNLFVIWDYMIKRSYQELGMD

SEQ ID NO: 2192018 - protein, 24 aa, Cryptosporidium hominis
KFVNKDLPICIWLNGEKTVGWNLD

SEQ ID NO: 2192019 - protein, 24 aa, Cryptosporidium hominis
KFVPPLAHNLLKLKKNRIYTNSSD

SEQ ID NO: 2192020 - protein, 31 aa, Cryptosporidium hominis
KFVYIYQNQFNYHFYYFRILTVESELDLNRD

SEQ ID NO: 2192021 - protein, 23 aa, Cryptosporidium hominis
KFYLCGLCPHELFENTKLYMGPC

SEQ ID NO: 2192022 - protein, 28 aa, Cryptosporidium hominis
KFYQLEGLNWMFQLYKHNINGILADEMG

SEQ ID NO: 2192023 - protein, 25 aa, Cryptosporidium hominis
KFYSQINSVLSFEIDLINKHDLEDG

SEQ ID NO: 2192024 - protein, 25 aa, Cryptosporidium hominis
KGATKVIFCGPPIYPSIYLDCIQSI

SEQ ID NO: 2192025 - protein, 28 aa, Cryptosporidium hominis
KGDPTHWLWDRIIFSNTRQILGGKLKAI

SEQ ID NO: 2192026 - protein, 22 aa, Cryptosporidium hominis
KGEFRIVSIYLSSGSILAEIFT

SEQ ID NO: 2192027 - protein, 30 aa, Cryptosporidium hominis
KGELLISLYRRLYILRPFIEKINNEILRIP

SEQ ID NO: 2192028 - protein, 25 aa, Cryptosporidium hominis
KGERNFHIFYQLCSAAKHIISQGSS

SEQ ID NO: 2192029 - protein, 25 aa, Cryptosporidium hominis
KGEVLFASIIGDNILFLPKLSERVV

SEQ ID NO: 2192030 - protein, 25 aa, Cryptosporidium hominis
KGFAPFLDVYWKGDITFRISIFHPT

SEQ ID NO: 2192031 - protein, 17 aa, Cryptosporidium hominis
KGFSWLESNPCQFDINQ

SEQ ID NO: 2192032 - protein, 24 aa, Cryptosporidium hominis
KGGACLELLMNPQKLMECLVVIKS

SEQ ID NO: 2192033 - protein, 24 aa, Cryptosporidium hominis
KGGKYYITLNYSTILAFKVGEEFD

SEQ ID NO: 2192034 - protein, 30 aa, Cryptosporidium hominis; identical to SEQ ID NO: 2174643

SEQ ID NO: 2192035 - protein, 29 aa, Cryptosporidium hominis
KGHIPNQYFIFTSPSLLYASFGLYSAPFK

SEQ ID NO: 2192036 - protein, 23 aa, Cryptosporidium hominis
KGIFFRNPFILSSAKQYKYLNRQ

SEQ ID NO: 2192037 - protein, 29 aa, Cryptosporidium hominis
KGIIFAKDLRDGYWDYGRSKIIFTRRNKS

SEQ ID NO: 2192038 - protein, 17 aa, Cryptosporidium hominis
KGIIQIWSIPFQNPENE

SEQ ID NO: 2192039 - protein, 20 aa, Cryptosporidium hominis
KGILQFDMWGVTPDSGLCDW

SEQ ID NO: 2192040 - protein, 20 aa, Cryptosporidium hominis
KGILSMLWPQENMPFSESGM

SEQ ID NO: 2192041 - protein, 23 aa, Cryptosporidium hominis
KGIQFHISYFFLNKENPEIYLRE

SEQ ID NO: 2192042 - protein, 20 aa, Cryptosporidium hominis
KGIRLLNIDPIEALFVGVIT

SEQ ID NO: 2192043 - protein, 22 aa, Cryptosporidium hominis
KGKIAFNRQVLFITPHSEIVPH

SEQ ID NO: 2192044 - protein, 24 aa, Cryptosporidium hominis
KGKNFKPERFIWSSVSDSTALWGF

SEQ ID NO: 2192045 - protein, 20 aa, Cryptosporidium hominis
KGKRVVMLKALPSGLVVVTG

SEQ ID NO: 2192046 - protein, 25 aa, Cryptosporidium hominis
KGLEWKVVFIPKFVDKVFPLYRESE

SEQ ID NO: 2192047 - protein, 25 aa, Cryptosporidium hominis
KGLQNWIYRLFSTYRSNGTSKEDIE

SEQ ID NO: 2192048 - protein, 20 aa, Cryptosporidium hominis
KGLQSEYPMYVSLAVSVGRL

SEQ ID NO: 2192049 - protein, 21 aa, Cryptosporidium hominis
KGLVLFIGKLIADTWLKSKVL

SEQ ID NO: 2192050 - protein, 26 aa, Cryptosporidium hominis
KGLYDKLFDYIILNLNENIKPPSGFK

SEQ ID NO: 2192051 - protein, 34 aa, Cryptosporidium hominis
KGLYEKCQKKLEAYFILIKTRIENMWNEKINVFS

SEQ ID NO: 2192052 - protein, 21 aa, Cryptosporidium hominis
KGNIHYFLKEYHKALHAYQEG

SEQ ID NO: 2192053 - protein, 23 aa, Cryptosporidium hominis
KGNIYLPAWARIYNDRTKLEPTE

SEQ ID NO: 2192054 - protein, 24 aa, Cryptosporidium hominis
KGNLIFSPKIFLPCNPDKGYKLLA

SEQ ID NO: 2192055 - protein, 22 aa, Cryptosporidium hominis
KGNLNDLFYFEPSLYQYRCVPN

SEQ ID NO: 2192056 - protein, 23 aa, Cryptosporidium hominis
KGPFHHRAPSKILFRAVRGMIPH

SEQ ID NO: 2192057 - protein, 17 aa, Cryptosporidium hominis
KGQLKKSAWFLNGMPTN

SEQ ID NO: 2192058 - protein, 25 aa, Cryptosporidium hominis
KGRDIHSLSYWYIPNSVKHQYYVNY

SEQ ID NO: 2192059 - protein, 20 aa, Cryptosporidium hominis
KGRFHILDIYPLSIQQRSIK

SEQ ID NO: 2192060 - protein, 18 aa, Cryptosporidium hominis
KGRFYAFGRVFSGTVATG

SEQ ID NO: 2192061 - protein, 21 aa, Cryptosporidium hominis
KGRIPILSWTNPDLKCTLWRS

SEQ ID NO: 2192062 - protein, 30 aa, Cryptosporidium hominis
KGRKAIAVLYKLLFLLCKLNFINFSIDDSK

SEQ ID NO: 2192063 - protein, 23 aa, Cryptosporidium hominis
KGRKIRYVPIPKLENFMASSPSL

SEQ ID NO: 2192064 - protein, 23 aa, Cryptosporidium hominis
KGRKRRLLFPSTVTKKQIKRSFP

SEQ ID NO: 2192065 - protein, 25 aa, Cryptosporidium hominis
KGRNPDLFPCVILNSIYTLNMLRTV

SEQ ID NO: 2192066 - protein, 20 aa, Cryptosporidium hominis
KGSFKYAWVLDKLKAERERG

SEQ ID NO: 2192067 - protein, 18 aa, Cryptosporidium hominis
KGSFLRRVEDETGTFIFI

SEQ ID NO: 2192068 - protein, 25 aa, Cryptosporidium hominis
KGSFNSHPWIWLKSIFEICKDTKQV

SEQ ID NO: 2192069 - protein, 22 aa, Cryptosporidium hominis
KGSVFELIDYLDSKYSIALEMI

SEQ ID NO: 2192070 - protein, 21 aa, Cryptosporidium hominis
KGVAMPWLYQNFDASGYSFYY

SEQ ID NO: 2192071 - protein, 19 aa, Cryptosporidium hominis
KGVCYVEFYSVESVLKALK

SEQ ID NO: 2192072 - protein, 25 aa, Cryptosporidium hominis
KGVNIVFEFFPYDLKRYLSMFPDKV

SEQ ID NO: 2192073 - protein, 31 aa, Cryptosporidium hominis
KGVSWSNRQMAWLAFWKEDNQRRSKTFSARK

SEQ ID NO: 2192074 - protein, 17 aa, Cryptosporidium hominis
KGWKRIPKERSCIFLDS

SEQ ID NO: 2192075 - protein, 20 aa, Cryptosporidium hominis
KGWQLILKRKHIIHNSKVNS

SEQ ID NO: 2192076 - protein, 20 aa, Cryptosporidium hominis
KGWTSKLFYGWRKELNSEKN

SEQ ID NO: 2192077 - protein, 25 aa, Cryptosporidium hominis
KGYGKLLVDLSYKLSLKEGKWGHPE

SEQ ID NO: 2192078 - protein, 17 aa, Cryptosporidium hominis
KHAIAAIGQPLLMRVYE

SEQ ID NO: 2192079 - protein, 17 aa, Cryptosporidium hominis
KHAIFQPVENDLIVILH

SEQ ID NO: 2192080 - protein, 21 aa, Cryptosporidium hominis
KHAYMRNELVFCNKPILEIDH

SEQ ID NO: 2192081 - protein, 25 aa, Cryptosporidium hominis
KHELKNYFVIIERIAGIFSETNHLN

SEQ ID NO: 2192082 - protein, 18 aa, Cryptosporidium hominis
KHFPGLIRCLPQLLIHVD

SEQ ID NO: 2192083 - protein, 22 aa, Cryptosporidium hominis
KHIEVLLRKYIMEYVACSMCKS

SEQ ID NO: 2192084 - protein, 21 aa, Cryptosporidium hominis
KHILSFNKKWEKPSKYHKIPQ

SEQ ID NO: 2192085 - protein, 17 aa, Cryptosporidium hominis
KHIPFDINLNRFDTFET

SEQ ID NO: 2192086 - protein, 20 aa, Cryptosporidium hominis
KHLFSWIEYEMALLGNSIHG

SEQ ID NO: 2192087 - protein, 19 aa, Cryptosporidium hominis
KHLIILILVKFVKMNVKSA

SEQ ID NO: 2192088 - protein, 25 aa, Cryptosporidium hominis
KHLILYFNLIIFSIKSDKSLSNNNN

SEQ ID NO: 2192089 - protein, 17 aa, Cryptosporidium hominis
KHLIMGLKGLTIRGEIR

SEQ ID NO: 2192090 - protein, 20 aa, Cryptosporidium hominis
KHLLNKWRKVAEYPELYISE

SEQ ID NO: 2192091 - protein, 24 aa, Cryptosporidium hominis
KHLNNFLFSKFNDGIRAFGLRIPK

SEQ ID NO: 2192092 - protein, 34 aa, Cryptosporidium hominis
KHLSKIDFSVFEEGFYRRYKSFFHDRQADEIDLT

SEQ ID NO: 2192093 - protein, 27 aa, Cryptosporidium hominis
KHNCLDATMPFFIQSLRDMTNRIDVLE

SEQ ID NO: 2192094 - protein, 26 aa, Cryptosporidium hominis
KHNGKIIIPFINNSLLFMNTSMDTGH

SEQ ID NO: 2192095 - protein, 32 aa, Cryptosporidium hominis
KHNKNEFITYIKLLLRVSFIKSICLLKMYGKK

SEQ ID NO: 2192096 - protein, 22 aa, Cryptosporidium hominis
KHPNCEFIQPQWVFDSMNESIR

SEQ ID NO: 2192097 - protein, 18 aa, Cryptosporidium hominis
KHQLEMIFICFPDPHFKK

SEQ ID NO: 2192098 - protein, 22 aa, Cryptosporidium hominis
KHSFILIKNELYTYLRGKSKIF

SEQ ID NO: 2192099 - protein, 28 aa, Cryptosporidium hominis
KHSLSVFKLKFLYFAENITLFESLFRLG

SEQ ID NO: 2192100 - protein, 22 aa, Cryptosporidium hominis
KHYEDFNTLFLQFEEFSTNKEV

SEQ ID NO: 2192101 - protein, 24 aa, Cryptosporidium hominis
KIACIDFPLKQYRMQMGIRVELED

SEQ ID NO: 2192102 - protein, 24 aa, Cryptosporidium hominis
KIADFFVTEFYSRLKKDPSTLYEL

SEQ ID NO: 2192103 - protein, 18 aa, Cryptosporidium hominis
KIAKIPHYDENILNSMKV

SEQ ID NO: 2192104 - protein, 22 aa, Cryptosporidium hominis
KIANLPNIIRFQSMTVLLDSCC

SEQ ID NO: 2192105 - protein, 25 aa, Cryptosporidium hominis
KIANNLFNQAFIMSIWNTKNDNFIE

SEQ ID NO: 2192106 - protein, 30 aa, Cryptosporidium hominis
KIASNSRIVLFYWTGIKWICTRNDSSNTIL

SEQ ID NO: 2192107 - protein, 33 aa, Cryptosporidium hominis
KIATYSTPWFVYYRPFLKFFLQNASKLGSICVF

SEQ ID NO: 2192108 - protein, 23 aa, Cryptosporidium hominis
KICNFKLRSLLLCDNWITRSKSR

SEQ ID NO: 2192109 - protein, 20 aa, Cryptosporidium hominis
KIDDILNQISKIRQLLNEQE

SEQ ID NO: 2192110 - protein, 27 aa, Cryptosporidium hominis
KIDIEETLLIMRPFEPTLLMKPQDVSE

SEQ ID NO: 2192111 - protein, 24 aa, Cryptosporidium hominis
KIDIKKFEFSIGKETIRFDKIIEF

SEQ ID NO: 2192112 - protein, 17 aa, Cryptosporidium hominis
KIDLPCPIPPIMKSKKS

SEQ ID NO: 2192113 - protein, 19 aa, Cryptosporidium hominis
KIDMLIKLTFSLKPSNFIV

SEQ ID NO: 2192114 - protein, 26 aa, Cryptosporidium hominis
KIEGELKIPPLPDSLYNLITMCLRPN

SEQ ID NO: 2192115 - protein, 21 aa, Cryptosporidium hominis
KIEHIEWVLSIRTEPKNFISE

SEQ ID NO: 2192116 - protein, 39 aa, Cryptosporidium hominis
KIEIFKKWKHFIPKSYYWILIIVWYRIMHDYSRMIDCYN

SEQ ID NO: 2192117 - protein, 30 aa, Cryptosporidium hominis
KIELFKNSFINLSLPLFVITEPLPAPKTIS

SEQ ID NO: 2192118 - protein, 19 aa, Cryptosporidium hominis
KIEVRSRVILTDGLELKNE

SEQ ID NO: 2192119 - protein, 23 aa, Cryptosporidium hominis
KIEYRVWNPFRSKLGATIIGGVA

SEQ ID NO: 2192120 - protein, 19 aa, Cryptosporidium hominis
KIFQLFRLRQINNGVFLPL

SEQ ID NO: 2192121 - protein, 22 aa, Cryptosporidium hominis
KIGARLLLPNENEYILSADKTC

SEQ ID NO: 2192122 - protein, 17 aa, Cryptosporidium hominis
KIGLWDFCQCDVARCSG

SEQ ID NO: 2192123 - protein, 27 aa, Cryptosporidium hominis
KIGMEILKMIYLNWVPEEKILMMNVWS

SEQ ID NO: 2192124 - protein, 28 aa, Cryptosporidium hominis
KIGTGDDILILLIGNGVANMFLISSQKT

SEQ ID NO: 2192125 - protein, 30 aa, Cryptosporidium hominis
KIGTMVYRMGLILEETWDKSLEGSRARYEQ

SEQ ID NO: 2192126 - protein, 25 aa, Cryptosporidium hominis
KIIADYILNQIFLMLGYSSYKFSIN

SEQ ID NO: 2192127 - protein, 18 aa, Cryptosporidium hominis
KIIFTRRNKSGQTTIIEN

SEQ ID NO: 2192128 - protein, 20 aa, Cryptosporidium hominis
KIIGFVPSHWSPTAIKLFPL

SEQ ID NO: 2192129 - protein, 20 aa, Cryptosporidium hominis
KIIIKSIKKYSYMLNDKVNV

SEQ ID NO: 2192130 - protein, 20 aa, Cryptosporidium hominis
KIIKRFILHSQKTAFVVEHD

SEQ ID NO: 2192131 - protein, 18 aa, Cryptosporidium hominis
KIILNIFCNLTPIQNYLY

SEQ ID NO: 2192132 - protein, 25 aa, Cryptosporidium hominis
KIINENIYILKLRSLSILEEVINLA

SEQ ID NO: 2192133 - protein, 36 aa, Cryptosporidium hominis
KIINNETLAYFLSRTYDFLISIGINPDGIRFRQHLS

SEQ ID NO: 2192134 - protein, 17 aa, Cryptosporidium hominis
KIIRCSSGLSPKAFITQ

SEQ ID NO: 2192135 - protein, 23 aa, Cryptosporidium hominis
KIIVVFMINIEYFPREDKKLGLV

SEQ ID NO: 2192136 - protein, 24 aa, Cryptosporidium hominis
KIKIGALNLYVWCSIPLSELNYIP

SEQ ID NO: 2192137 - protein, 31 aa, Cryptosporidium hominis
KIKIRRYIGLIYQITILKIHLSRLLGKVRNK

SEQ ID NO: 2192138 - protein, 29 aa, Cryptosporidium hominis
KIKLKLEDIQVLDLWKLSILIGGGISQIG

SEQ ID NO: 2192139 - protein, 23 aa, Cryptosporidium hominis
KIKPGIIVLVNNCDWEILGGENY

SEQ ID NO: 2192140 - protein, 38 aa, Cryptosporidium hominis
KIKSKILVYKRYEDYIRLLPFFKERKYIPLFSNTELDS

SEQ ID NO: 2192141 - protein, 18 aa, Cryptosporidium hominis
KIKTFLNKYLEILKKLNQ

SEQ ID NO: 2192142 - protein, 24 aa, Cryptosporidium hominis
KIKWHPTIPMVLLSCSYDNTIIAW

SEQ ID NO: 2192143 - protein, 20 aa, Cryptosporidium hominis
KILFRAVRGMIPHKTPRGAA

SEQ ID NO: 2192144 - protein, 34 aa, Cryptosporidium hominis
KILGFDPVKCNPSWFINTVIPIPPPTVRPYVQFG

SEQ ID NO: 2192145 - protein, 19 aa, Cryptosporidium hominis
KILHHHLLFLCKEGGFKCD

SEQ ID NO: 2192146 - protein, 20 aa, Cryptosporidium hominis
KILIICLELIYGIEKSFIVS

SEQ ID NO: 2192147 - protein, 19 aa, Cryptosporidium hominis
KILILFRHDSFGVVELCWT

SEQ ID NO: 2192148 - protein, 17 aa, Cryptosporidium hominis
KILKAWMDGCECFSRAA

SEQ ID NO: 2192149 - protein, 18 aa, Cryptosporidium hominis
KILLEILSNSPDGISKDG

SEQ ID NO: 2192150 - protein, 27 aa, Cryptosporidium hominis
KILNIYKRTCLLLRKILGFGGKNSTII

SEQ ID NO: 2192151 - protein, 20 aa, Cryptosporidium hominis
KILNLIAQLLKKRNYLNLKP

SEQ ID NO: 2192152 - protein, 19 aa, Cryptosporidium hominis
KILNLRIVKDFQGESRGYA

SEQ ID NO: 2192153 - protein, 29 aa, Cryptosporidium hominis
KILSIPIHTPIAEFLYISPREMLTRLKNC

SEQ ID NO: 2192154 - protein, 17 aa, Cryptosporidium hominis
KILTYRSGSFIQANSQG

SEQ ID NO: 2192155 - protein, 25 aa, Cryptosporidium hominis
KILYTKRLFSLKYNLPKLLERIIGS

SEQ ID NO: 2192156 - protein, 29 aa, Cryptosporidium hominis
KINISLSRRILICLSYFIITESYREININ

SEQ ID NO: 2192157 - protein, 26 aa, Cryptosporidium hominis
KINLKSELELLYLDFIKKQLQETRIP

SEQ ID NO: 2192158 - protein, 21 aa, Cryptosporidium hominis
KINSLLDEYYSLHFEDVLDNG

SEQ ID NO: 2192159 - protein, 20 aa, Cryptosporidium hominis
KINSYHYLNGKKNTIANILS

SEQ ID NO: 2192160 - protein, 28 aa, Cryptosporidium hominis
KINYAYLFEKIMFAHELALYSGLNLLVP

SEQ ID NO: 2192161 - protein, 26 aa, Cryptosporidium hominis
KIPLEYSNLLCSLPYEYNQITQMIDN

SEQ ID NO: 2192162 - protein, 17 aa, Cryptosporidium hominis
KIPLLWVPGTSAGIFKA

SEQ ID NO: 2192163 - protein, 42 aa, Cryptosporidium hominis
KIPQGAHLLGFFKRLCKLLYYGILPVIVFDGTPPDIKKRTLE

SEQ ID NO: 2192164 - protein, 17 aa, Cryptosporidium hominis
KIPQLLDFSLRLLNERL

SEQ ID NO: 2192165 - protein, 37 aa, Cryptosporidium hominis
KIPSSIYQHLLRCANLFLAKNILFTRVKIAEKVEAGT

SEQ ID NO: 2192166 - protein, 23 aa, Cryptosporidium hominis
KIQAIFCCKLIEGFGMSECIGTL

SEQ ID NO: 2192167 - protein, 36 aa, Cryptosporidium hominis
KIQCLIKRYWILAHLDRLFWVADVLQPRLHSALTRL

SEQ ID NO: 2192168 - protein, 44 aa, Cryptosporidium hominis
KIQEHWLWKKNVPFIYDYLFITPLRWPTLTFSIPPIRFNSEDMK

SEQ ID NO: 2192169 - protein, 19 aa, Cryptosporidium hominis
KIQIEQILLYINTGAKYNS

SEQ ID NO: 2192170 - protein, 21 aa, Cryptosporidium hominis
KIQLLFRDCFRVGLQLLDLSG

SEQ ID NO: 2192171 - protein, 18 aa, Cryptosporidium hominis
KIQNILKEKYEEIELIIK

SEQ ID NO: 2192172 - protein, 26 aa, Cryptosporidium hominis
KIQPQVKPYIIPTKTQSKINSNLSIH

SEQ ID NO: 2192173 - protein, 17 aa, Cryptosporidium hominis
KIQTRIGAVIKPLVYSK

SEQ ID NO: 2192174 - protein, 25 aa, Cryptosporidium hominis
KIQVQNSILLLNNNNVKYLGGNVES

SEQ ID NO: 2192175 - protein, 20 aa, Cryptosporidium hominis
KIRFSIQFIVDIYYGYFSMQ

SEQ ID NO: 2192176 - protein, 25 aa, Cryptosporidium hominis
KIRLQMVDAFWRIQTQPSKRNLVET

SEQ ID NO: 2192177 - protein, 44 aa, Cryptosporidium hominis
KIRPFISSIYCDPFYELLWLGWTNGFLSSFRFPHCSRYTAFPVG

SEQ ID NO: 2192178 - protein, 17 aa, Cryptosporidium hominis
KISEKLEDISTKVNQLL

SEQ ID NO: 2192179 - protein, 20 aa, Cryptosporidium hominis
KISHYSRIPVKIKHYIVSDK

SEQ ID NO: 2192180 - protein, 34 aa, Cryptosporidium hominis
KISKFILEHLSNKDWFISSKVIYLDVLIPLFETE

SEQ ID NO: 2192181 - protein, 25 aa, Cryptosporidium hominis
KISKHYLLPLILLYSDLKESEAERF

SEQ ID NO: 2192182 - protein, 24 aa, Cryptosporidium hominis
KISKLESYLSLCEDLYLGGISKTQ

SEQ ID NO: 2192183 - protein, 24 aa, Cryptosporidium hominis
KISKLLIEGKIKEAISSSYGNDEL

SEQ ID NO: 2192184 - protein, 23 aa, Cryptosporidium hominis
KISKLQYWDLKSVLIHKYCINKF

SEQ ID NO: 2192185 - protein, 17 aa, Cryptosporidium hominis
KISLQILSKISISPILI

SEQ ID NO: 2192186 - protein, 22 aa, Cryptosporidium hominis
KISNWYGNFYFSGVDLLLAPNC

SEQ ID NO: 2192187 - protein, 23 aa, Cryptosporidium hominis
KISTQLLDIMPKLKKQLSEEGVM

SEQ ID NO: 2192188 - protein, 21 aa, Cryptosporidium hominis
KISVKPHLILKRLFGTQANAC

SEQ ID NO: 2192189 - protein, 24 aa, Cryptosporidium hominis
KITYTLLNCLAYHLRYATKVIIGS

SEQ ID NO: 2192190 - protein, 30 aa, Cryptosporidium hominis
KIVAEYAKHVYLHHLKAYRSFNNGNTSGNS

SEQ ID NO: 2192191 - protein, 20 aa, Cryptosporidium hominis
KIVFSLFNYDDSEFLVFLID

SEQ ID NO: 2192192 - protein, 17 aa, Cryptosporidium hominis
KIVITDLDKKALIDGLI

SEQ ID NO: 2192193 - protein, 22 aa, Cryptosporidium hominis
KIVQVLPAYRLSRAIDTLFPKF

SEQ ID NO: 2192194 - protein, 24 aa, Cryptosporidium hominis
KIVWSPIMFTIMQPSLNMQNLDSD

SEQ ID NO: 2192195 - protein, 22 aa, Cryptosporidium hominis
KIWSSDSKCIYIYHGHKNAVRD

SEQ ID NO: 2192196 - protein, 26 aa, Cryptosporidium hominis
KIYDLGALRSPLPWDLGRHSKSTIQV

SEQ ID NO: 2192197 - protein, 21 aa, Cryptosporidium hominis
KIYIDIRSYLIRLNRPSEQVP

SEQ ID NO: 2192198 - protein, 25 aa, Cryptosporidium hominis
KIYNVKVIILWKNRGIFYPTLGDQV

SEQ ID NO: 2192199 - protein, 17 aa, Cryptosporidium hominis
KIYQEYDDFLLSNNDDH

SEQ ID NO: 2192200 - protein, 28 aa, Cryptosporidium hominis
KKACEKGFFSVLGLLLRDIDISIGESAS

SEQ ID NO: 2192201 - protein, 24 aa, Cryptosporidium hominis
KKAKPNLLDLLERAQYTPLTKTIH

SEQ ID NO: 2192202 - protein, 24 aa, Cryptosporidium hominis
KKCKLIFKRLINKVNIVRETSSKS

SEQ ID NO: 2192203 - protein, 19 aa, Cryptosporidium hominis
KKCRFMIHILAINYKGKHK

SEQ ID NO: 2192204 - protein, 22 aa, Cryptosporidium hominis
KKDAPVAPLKKDAPAAPAVPPM

SEQ ID NO: 2192205 - protein, 17 aa, Cryptosporidium hominis
KKDECHCCFWKKNPYKY

SEQ ID NO: 2192206 - protein, 32 aa, Cryptosporidium hominis
KKDLDKFVLDCDLREYFVGESIKFRDGKIVTD

SEQ ID NO: 2192207 - protein, 18 aa, Cryptosporidium hominis
KKDQNIFTPQPNLKDRVL

SEQ ID NO: 2192208 - protein, 33 aa, Cryptosporidium hominis
KKEELETNLRYYQDREMYLQHELELKENELNKL

SEQ ID NO: 2192209 - protein, 25 aa, Cryptosporidium hominis
KKEFKVIIRFLYTSYLDETDLQTLC

SEQ ID NO: 2192210 - protein, 24 aa, Cryptosporidium hominis
KKEGRFLFKPFAEIARAVGIPAHS

SEQ ID NO: 2192211 - protein, 25 aa, Cryptosporidium hominis
KKELQIISFKFIRSLSKIWGYSIME

SEQ ID NO: 2192212 - protein, 33 aa, Cryptosporidium hominis
KKERFDCPWFFSTLLTIILFKDKYKNSLETNEI

SEQ ID NO: 2192213 - protein, 18 aa, Cryptosporidium hominis
KKEYFLLDLAKSDGLKSD

SEQ ID NO: 2192214 - protein, 24 aa, Cryptosporidium hominis
KKFDEALGFYLKALGILELEQSLK

SEQ ID NO: 2192215 - protein, 27 aa, Cryptosporidium hominis
KKFNEKYQFPFSRLPPIIDFSFAESRH

SEQ ID NO: 2192216 - protein, 20 aa, Cryptosporidium hominis
KKFNRAIGKADYLLEQLSNS

SEQ ID NO: 2192217 - protein, 33 aa, Cryptosporidium hominis
KKFSKRKMLYNFANSVWDYVKPVSLDELERKQS

SEQ ID NO: 2192218 - protein, 24 aa, Cryptosporidium hominis
KKGDPETCPAFLFVTPEKLKHSKT

SEQ ID NO: 2192219 - protein, 21 aa, Cryptosporidium hominis
KKGHFFKLFEDSESPPICTIM

SEQ ID NO: 2192220 - protein, 22 aa, Cryptosporidium hominis
KKGYILIEWVNRIRILLRMRND

SEQ ID NO: 2192221 - protein, 24 aa, Cryptosporidium hominis
KKHSRYLGCSIIRKNLAKVRKQIK

SEQ ID NO: 2192222 - protein, 23 aa, Cryptosporidium hominis
KKIALTVIARYCPDKWIENLRNV

SEQ ID NO: 2192223 - protein, 20 aa, Cryptosporidium hominis
KKIDLFNYDIILLPINVNNV

SEQ ID NO: 2192224 - protein, 22 aa, Cryptosporidium hominis
KKIGPLFLNFEIPMFNLSNIQV

SEQ ID NO: 2192225 - protein, 22 aa, Cryptosporidium hominis
KKIKFLNKCLQIAPIYPEKCNK

SEQ ID NO: 2192226 - protein, 18 aa, Cryptosporidium hominis
KKIMRRILSKDRLKPSIY

SEQ ID NO: 2192227 - protein, 30 aa, Cryptosporidium hominis
KKIRCVSFWVKEWGILFVGSTVFSQMVVFT

SEQ ID NO: 2192228 - protein, 34 aa, Cryptosporidium hominis
KKKFDNLYFKFYSNLPFRNFYSSVYFINIAELYK

SEQ ID NO: 2192229 - protein, 29 aa, Cryptosporidium hominis
KKKIQKSIDFIYWLLKKKTDFYCSESETE

SEQ ID NO: 2192230 - protein, 26 aa, Cryptosporidium hominis
KKKKLIITNYFIINTLFNMTEIKKIR

SEQ ID NO: 2192231 - protein, 31 aa, Cryptosporidium hominis
KKKLEDSLLDIYSFISWYIYDYNNEITQKTE

SEQ ID NO: 2192232 - protein, 31 aa, Cryptosporidium hominis
KKKLQERLLTLQYYFSLWRQESRKERNFKES

SEQ ID NO: 2192233 - protein, 19 aa, Cryptosporidium hominis
KKKMELLYSTKICELYLKI

SEQ ID NO: 2192234 - protein, 25 aa, Cryptosporidium hominis
KKKNEYLWPIYRINHLRSRFIYTKY

SEQ ID NO: 2192235 - protein, 29 aa, Cryptosporidium hominis
KKKYNSQIAAYYRGMLKDLCEGNTPGPKP

SEQ ID NO: 2192236 - protein, 22 aa, Cryptosporidium hominis
KKLCLKLLNLPYHPNVMKIYQV

SEQ ID NO: 2192237 - protein, 20 aa, Cryptosporidium hominis
KKLCSQVIFPTPLVSTEKVV

SEQ ID NO: 2192238 - protein, 26 aa, Cryptosporidium hominis
KKLEDELLIHLFSTKLDIVDLIEIAA

SEQ ID NO: 2192239 - protein, 17 aa, Cryptosporidium hominis
KKLFLTNNKIKTIQGLN

SEQ ID NO: 2192240 - protein, 22 aa, Cryptosporidium hominis
KKLGKGAYGIVWKSIDRRTGEV

SEQ ID NO: 2192241 - protein, 23 aa, Cryptosporidium hominis
KKLGLVINSLLHLTLKNNVGSNP

SEQ ID NO: 2192242 - protein, 17 aa, Cryptosporidium hominis
KKLLRNSSGYFFPHKNS

SEQ ID NO: 2192243 - protein, 28 aa, Cryptosporidium hominis
KKLTVGGYNKVSGFFDSISCETLDPERS

SEQ ID NO: 2192244 - protein, 21 aa, Cryptosporidium hominis
KKMIQELIYEKISLNSEVNSL

SEQ ID NO: 2192245 - protein, 23 aa, Cryptosporidium hominis
KKMKDIFRNPLLFVKNLNGQPES

SEQ ID NO: 2192246 - protein, 26 aa, Cryptosporidium hominis
KKMLNEICELLRSPRFCRSTSIIYCL

SEQ ID NO: 2192247 - protein, 18 aa, Cryptosporidium hominis
KKMVLHRPIFVDIKPEIK

SEQ ID NO: 2192248 - protein, 23 aa, Cryptosporidium hominis
KKMYQSISMITWSLISESFIQGH

SEQ ID NO: 2192249 - protein, 24 aa, Cryptosporidium hominis
KKNELLFNSAFFDDDVISEFWTDE

SEQ ID NO: 2192250 - protein, 23 aa, Cryptosporidium hominis
KKNKIIPMIKFEKKKNMISLTKK

SEQ ID NO: 2192251 - protein, 17 aa, Cryptosporidium hominis
KKNLVTLLRFTCSFDED

SEQ ID NO: 2192252 - protein, 32 aa, Cryptosporidium hominis
KKNMEHYYNLFDFYWLFFRTYNGLERIWREAF

SEQ ID NO: 2192253 - protein, 29 aa, Cryptosporidium hominis
KKNPYKYRMTLPFLQQKPRFNLWASIKES

SEQ ID NO: 2192254 - protein, 24 aa, Cryptosporidium hominis
KKNRRWKEKWFRRGRKLFVRKFVQ

SEQ ID NO: 2192255 - protein, 29 aa, Cryptosporidium hominis
KKNTDIFLIAPYLNLPKYLISLLKNRERS

SEQ ID NO: 2192256 - protein, 26 aa, Cryptosporidium hominis
KKNVNNIFMWYSYFRGNIYLENTSRI

SEQ ID NO: 2192257 - protein, 24 aa, Cryptosporidium hominis
KKPKIPSWFHPSISNLLSKCFERK

SEQ ID NO: 2192258 - protein, 18 aa, Cryptosporidium hominis
KKPSIHLHWLAVEGKFVF

SEQ ID NO: 2192259 - protein, 27 aa, Cryptosporidium hominis
KKQAQQQALLAALFKGTENIKKVSAED

SEQ ID NO: 2192260 - protein, 23 aa, Cryptosporidium hominis
KKQYTPPLAENFPKGLPSIVQDP

SEQ ID NO: 2192261 - protein, 24 aa, Cryptosporidium hominis
KKRDYYIQMVPLLVEIFSGNELDG

SEQ ID NO: 2192262 - protein, 18 aa, Cryptosporidium hominis
KKRGFSDFSLKSLNSIGK

SEQ ID NO: 2192263 - protein, 23 aa, Cryptosporidium hominis
KKRLAIKELLRRYASKDYSEQCN

SEQ ID NO: 2192264 - protein, 24 aa, Cryptosporidium hominis
KKRPFYIPVIVGLIGKDSCKEIRQ

SEQ ID NO: 2192265 - protein, 21 aa, Cryptosporidium hominis
KKSAWFLNGMPTNLFNTCFSI

SEQ ID NO: 2192266 - protein, 25 aa, Cryptosporidium hominis
KKSENVVCHFFRPSTLRCEIFDRHL

SEQ ID NO: 2192267 - protein, 24 aa, Cryptosporidium hominis
KKSFLPPLFISRPLNLYSYSGINI

SEQ ID NO: 2192268 - protein, 24 aa, Cryptosporidium hominis
KKSKYNYIGPWRKDQKEKVITENI

SEQ ID NO: 2192269 - protein, 21 aa, Cryptosporidium hominis
KKSLNFGAKKLVDKLRGEREN

SEQ ID NO: 2192270 - protein, 23 aa, Cryptosporidium hominis
KKSWLEDFYRFCQTLNPTSAEVM

SEQ ID NO: 2192271 - protein, 18 aa, Cryptosporidium hominis
KKSWRPIHNLSGGEKTLS

SEQ ID NO: 2192272 - protein, 19 aa, Cryptosporidium hominis
KKSYYRLKYTREFSEKILT

SEQ ID NO: 2192273 - protein, 31 aa, Cryptosporidium hominis
KKTALLSIPKRDFKRILLLIGDYAIHRFQDY

SEQ ID NO: 2192274 - protein, 17 aa, Cryptosporidium hominis
KKTEYHLGRLKAQLAKL

SEQ ID NO: 2192275 - protein, 20 aa, Cryptosporidium hominis
KKVKLAVLKYYKVDGDKVVK

SEQ ID NO: 2192276 - protein, 17 aa, Cryptosporidium hominis
KKWISQKRFGIVTSSFL

SEQ ID NO: 2192277 - protein, 21 aa, Cryptosporidium hominis
KKYCPNAFVICITNPLDVMVS

SEQ ID NO: 2192278 - protein, 23 aa, Cryptosporidium hominis
KKYDLEAWFPGYNSYRELVSCSN

SEQ ID NO: 2192279 - protein, 32 aa, Cryptosporidium hominis
KKYDLFLASQVLLPQIPRLLGPGLNKAGKFPT

SEQ ID NO: 2192280 - protein, 33 aa, Cryptosporidium hominis
KKYFNDYQWDFLSKFYRVYISDQYKFVSNIPVS

SEQ ID NO: 2192281 - protein, 26 aa, Cryptosporidium hominis
KKYKLRSYISILRYITMMIESCASIE

SEQ ID NO: 2192282 - protein, 17 aa, Cryptosporidium hominis
KKYLKIDSLIWKIMDRI

SEQ ID NO: 2192283 - protein, 20 aa, Cryptosporidium hominis
KKYLRFPLCEKIIKSHKYVK

SEQ ID NO: 2192284 - protein, 21 aa, Cryptosporidium hominis
KLAYNTPLMDFLKDLNQQNST

SEQ ID NO: 2192285 - protein, 19 aa, Cryptosporidium hominis
KLCGQIIIKFPKLRVLLDP

SEQ ID NO: 2192286 - protein, 25 aa, Cryptosporidium hominis
KLCKSQLYSYSWYCYNHLITTLDQF

SEQ ID NO: 2192287 - protein, 19 aa, Cryptosporidium hominis
KLCNQLPPTGLISSLNEDS

SEQ ID NO: 2192288 - protein, 30 aa, Cryptosporidium hominis
KLCSAYNSVIIFFFLYHCAFKNESSFEFIP

SEQ ID NO: 2192289 - protein, 21 aa, Cryptosporidium hominis
KLDDGHVFFANSRGGYESQRS

SEQ ID NO: 2192290 - protein, 23 aa, Cryptosporidium hominis
KLDFAGFVSLVNSGNEIKKFTVE

SEQ ID NO: 2192291 - protein, 21 aa, Cryptosporidium hominis
KLDILSLCFVIQSVPNCPSQT

SEQ ID NO: 2192292 - protein, 29 aa, Cryptosporidium hominis
KLDKAVSMIQPLLDPFHPLHEEYKRDGLQ

SEQ ID NO: 2192293 - protein, 32 aa, Cryptosporidium hominis
KLDSEWLNIRTFKSYVLLNLPKDRPSEYGDKG

SEQ ID NO: 2192294 - protein, 25 aa, Cryptosporidium hominis
KLDSIGALLFDWIRRIPKSQILELK

SEQ ID NO: 2192295 - protein, 26 aa, Cryptosporidium hominis
KLDSIYNSKLKLLLGLYKLEINNIED

SEQ ID NO: 2192296 - protein, 21 aa, Cryptosporidium hominis
KLDYVLGLTISKFLERRLQTR

SEQ ID NO: 2192297 - protein, 23 aa, Cryptosporidium hominis
KLDYYDMKLDFYNRLISGFEYDL

SEQ ID NO: 2192298 - protein, 19 aa, Cryptosporidium hominis
KLEDISTKVNQLLTGYISK

SEQ ID NO: 2192299 - protein, 25 aa, Cryptosporidium hominis
KLEEKKREFMLASEKLEGYERENQR

SEQ ID NO: 2192300 - protein, 28 aa, Cryptosporidium hominis
KLEFEKVYCPFLLMNKKRYAGVLFKNPQ

SEQ ID NO: 2192301 - protein, 25 aa, Cryptosporidium hominis
KLEGSKMLIYEILRDVFVEDENLVG

SEQ ID NO: 2192302 - protein, 22 aa, Cryptosporidium hominis
KLEGWSVFQLPKYMPESKKNCY

SEQ ID NO: 2192303 - protein, 20 aa, Cryptosporidium hominis
KLENDLILKADEIKLSKEDL

SEQ ID NO: 2192304 - protein, 24 aa, Cryptosporidium hominis
KLETFIFDSFAFTNIPVHCINVSR

SEQ ID NO: 2192305 - protein, 26 aa, Cryptosporidium hominis
KLEVASLFTSRRPVLSCFACGRTSGI

SEQ ID NO: 2192306 - protein, 28 aa, Cryptosporidium hominis
KLGKLSNNFLEKIKFIYPSLEIVKVSDL

SEQ ID NO: 2192307 - protein, 17 aa, Cryptosporidium hominis
KLGLILPKPNQFVSTDF

SEQ ID NO: 2192308 - protein, 26 aa, Cryptosporidium hominis
KLGYYCWFGGKCSCGYWQTPSFQIHK

SEQ ID NO: 2192309 - protein, 25 aa, Cryptosporidium hominis
KLHGIYIAFRHNSAICRVIQQHIHK

SEQ ID NO: 2192310 - protein, 17 aa, Cryptosporidium hominis
KLHIVELNDTFQKRWDE

SEQ ID NO: 2192311 - protein, 19 aa, Cryptosporidium hominis
KLIDFGLAARFKPGKMMRT

SEQ ID NO: 2192312 - protein, 18 aa, Cryptosporidium hominis
KLILNWLEDGVFDALEKQ

SEQ ID NO: 2192313 - protein, 21 aa, Cryptosporidium hominis
KLIMEYRGNFPKRLLNQGVFT

SEQ ID NO: 2192314 - protein, 26 aa, Cryptosporidium hominis
KLINEGWSVELIFKGLAEFIIMSDKI

SEQ ID NO: 2192315 - protein, 34 aa, Cryptosporidium hominis
KLINGYYMIFCGLKILYLLLNTTDISFFLPLVRH

SEQ ID NO: 2192316 - protein, 19 aa, Cryptosporidium hominis
KLISKFQYLRFTISVILLG

SEQ ID NO: 2192317 - protein, 33 aa, Cryptosporidium hominis
KLISLTELYRYLMVYNYLHIIGSIYRHAKNFER

SEQ ID NO: 2192318 - protein, 28 aa, Cryptosporidium hominis
KLISLYEKIIFIKPIFYSRLTKTLIIYQ

SEQ ID NO: 2192319 - protein, 17 aa, Cryptosporidium hominis
KLKCPVVMIGQRSILPR

SEQ ID NO: 2192320 - protein, 24 aa, Cryptosporidium hominis
KLKGKISRILAAKLSLCIRVDALN

SEQ ID NO: 2192321 - protein, 17 aa, Cryptosporidium hominis
KLKIEYLKTLGKPSIKI

SEQ ID NO: 2192322 - protein, 21 aa, Cryptosporidium hominis
KLKKEGILNIGLKPAPKMETL

SEQ ID NO: 2192323 - protein, 23 aa, Cryptosporidium hominis
KLKKYLGEYFIKKQEELASNHAT

SEQ ID NO: 2192324 - protein, 17 aa, Cryptosporidium hominis
KLKPCYLCYSSSTISNQ

SEQ ID NO: 2192325 - protein, 19 aa, Cryptosporidium hominis
KLKQFWSEYPEKLNKKIEF

SEQ ID NO: 2192326 - protein, 27 aa, Cryptosporidium hominis
KLKQQLQLHTLLISELRKYHTEIEDLK

SEQ ID NO: 2192327 - protein, 20 aa, Cryptosporidium hominis
KLKTFLLNPQQTMTGLNKVP

SEQ ID NO: 2192328 - protein, 26 aa, Cryptosporidium hominis
KLLCNDWNLIRPVKSIHVKNRKVYIL

SEQ ID NO: 2192329 - protein, 20 aa, Cryptosporidium hominis
KLLDPAYVTSLYKVRKHIGA

SEQ ID NO: 2192330 - protein, 26 aa, Cryptosporidium hominis
KLLESTKIKVFKIFRVTKNFDARIDC

SEQ ID NO: 2192331 - protein, 27 aa, Cryptosporidium hominis
KLLESYFILNFILCKSYYLLNIVGNYH

SEQ ID NO: 2192332 - protein, 17 aa, Cryptosporidium hominis
KLLGCDFCTYSYHPKCI

SEQ ID NO: 2192333 - protein, 20 aa, Cryptosporidium hominis
KLLHSTLSSLKIVSKILGDL

SEQ ID NO: 2192334 - protein, 24 aa, Cryptosporidium hominis
KLLKDKFHFIFSIETTGCIPPVEL

SEQ ID NO: 2192335 - protein, 20 aa, Cryptosporidium hominis
KLLKKTISLNKLQKSIMESQ

SEQ ID NO: 2192336 - protein, 27 aa, Cryptosporidium hominis
KLLLTSIPQFRDVILMSFECPHCGFKN

SEQ ID NO: 2192337 - protein, 19 aa, Cryptosporidium hominis
KLLRESFLEIWRNSIKLNT

SEQ ID NO: 2192338 - protein, 22 aa, Cryptosporidium hominis
KLLSSFLVELLFQTSVKVINLI

SEQ ID NO: 2192339 - protein, 21 aa, Cryptosporidium hominis
KLLVSRLISKLAPNYKILVSC

SEQ ID NO: 2192340 - protein, 18 aa, Cryptosporidium hominis
KLMSFSGIPFSTLQAILF

SEQ ID NO: 2192341 - protein, 30 aa, Cryptosporidium hominis
KLNDPYRPLFSNYLFMEYINGVPLDNLLYY

SEQ ID NO: 2192342 - protein, 23 aa, Cryptosporidium hominis
KLNEEFPKFFWKRKSNFSFISEI

SEQ ID NO: 2192343 - protein, 18 aa, Cryptosporidium hominis
KLNELRSFGGKWPFIFFK

SEQ ID NO: 2192344 - protein, 25 aa, Cryptosporidium hominis
KLNFTFTDIYPSIPTRLIFSVQNYQ

SEQ ID NO: 2192345 - protein, 23 aa, Cryptosporidium hominis
KLNKQIFEVIYYAALDASCELAE

SEQ ID NO: 2192346 - protein, 20 aa, Cryptosporidium hominis
KLNLGWSSGQIRHAMIFLSG

SEQ ID NO: 2192347 - protein, 18 aa, Cryptosporidium hominis
KLNNYFLSFIDGNDLQDV

SEQ ID NO: 2192348 - protein, 24 aa, Cryptosporidium hominis
KLNNYGRYLLSCDSSLNLEFMNSN

SEQ ID NO: 2192349 - protein, 21 aa, Cryptosporidium hominis
KLNREFILGILNKYKERQLDY

SEQ ID NO: 2192350 - protein, 18 aa, Cryptosporidium hominis
KLNRPFSGFCYRALSTIY

SEQ ID NO: 2192351 - protein, 23 aa, Cryptosporidium hominis
KLPDIFLIITGKGPNKNLWLEKA

SEQ ID NO: 2192352 - protein, 21 aa, Cryptosporidium hominis
KLPFDFSDPWKMKLINKRGRK

SEQ ID NO: 2192353 - protein, 18 aa, Cryptosporidium hominis
KLPFEPMTSPHQKVFILL

SEQ ID NO: 2192354 - protein, 17 aa, Cryptosporidium hominis
KLQLEYLDENNSIYFKE

SEQ ID NO: 2192355 - protein, 20 aa, Cryptosporidium hominis
KLQMTMPIITLIASETKYCG

SEQ ID NO: 2192356 - protein, 30 aa, Cryptosporidium hominis
KLQREKLLMRLYMKLVIKQLVEPAFDVVRM

SEQ ID NO: 2192357 - protein, 20 aa, Cryptosporidium hominis
KLQSAWIHYKKKRLVILLRI

SEQ ID NO: 2192358 - protein, 22 aa, Cryptosporidium hominis
KLQSELIFEMTLFDTHVKEIKE

SEQ ID NO: 2192359 - protein, 23 aa, Cryptosporidium hominis
KLQSLRPLIYGTAGFRMNYEENP

SEQ ID NO: 2192360 - protein, 19 aa, Cryptosporidium hominis
KLQYIGLIDPQNYPKKEVY

SEQ ID NO: 2192361 - protein, 20 aa, Cryptosporidium hominis
KLSKIPGSRWFLQPVDPELD

SEQ ID NO: 2192362 - protein, 18 aa, Cryptosporidium hominis
KLSLGVDGRKLLLKRIRE

SEQ ID NO: 2192363 - protein, 18 aa, Cryptosporidium hominis
KLSMSVDGEWLILGSQDG

SEQ ID NO: 2192364 - protein, 25 aa, Cryptosporidium hominis
KLSRDSLFLHFMEKPNLSSNFGTNY

SEQ ID NO: 2192365 - protein, 29 aa, Cryptosporidium hominis
KLSSLFLELPSYFPAMYVPRAYVNNIKVI

SEQ ID NO: 2192366 - protein, 23 aa, Cryptosporidium hominis
KLTEINWPETHGWWLYCCHNGWL

SEQ ID NO: 2192367 - protein, 20 aa, Cryptosporidium hominis
KLTFNIWRKSNKDRVWYEWL

SEQ ID NO: 2192368 - protein, 18 aa, Cryptosporidium hominis
KLTLMIDYQHDICKDFKE

SEQ ID NO: 2192369 - protein, 19 aa, Cryptosporidium hominis
KLVLGMKSIVLGSGVESLT

SEQ ID NO: 2192370 - protein, 28 aa, Cryptosporidium hominis
KLVNKFCRLFSGMPFELPPLPYDKKALL

SEQ ID NO: 2192371 - protein, 24 aa, Cryptosporidium hominis
KLVNKIIPCFIDGRHFVSINKIRS

SEQ ID NO: 2192372 - protein, 26 aa, Cryptosporidium hominis
KLVPTTSMLYFILNPSLIGVMVLHDI

SEQ ID NO: 2192373 - protein, 19 aa, Cryptosporidium hominis
KLVRGKPLYVGLHERKEQR

SEQ ID NO: 2192374 - protein, 19 aa, Cryptosporidium hominis
KLVTNPQIHRLRFALYKCS

SEQ ID NO: 2192375 - protein, 17 aa, Cryptosporidium hominis
KLWDYLYGTEIDSINLE

SEQ ID NO: 2192376 - protein, 20 aa, Cryptosporidium hominis
KLYLSILLHSVDISNPLMNT

SEQ ID NO: 2192377 - protein, 23 aa, Cryptosporidium hominis
KLYPNWKWSQRWHGIREKFYLWV

SEQ ID NO: 2192378 - protein, 18 aa, Cryptosporidium hominis
KLYTLKNQQLIVSSENYE

SEQ ID NO: 2192379 - protein, 25 aa, Cryptosporidium hominis
KLYVASCYYFGDISTFLPIGAKSIQ

SEQ ID NO: 2192380 - protein, 25 aa, Cryptosporidium hominis
KMAIKNLVFGMIREVYRAHGAVEID

SEQ ID NO: 2192381 - protein, 22 aa, Cryptosporidium hominis
KMCLIHSIRLLDPIRRLKVVNI

SEQ ID NO: 2192382 - protein, 17 aa, Cryptosporidium hominis
KMDCIYFVTNEKRNLER

SEQ ID NO: 2192383 - protein, 18 aa, Cryptosporidium hominis
KMEYKVNLKDRKGEIKEL

SEQ ID NO: 2192384 - protein, 17 aa, Cryptosporidium hominis
KMKYYQWISNNSSAKHI

SEQ ID NO: 2192385 - protein, 27 aa, Cryptosporidium hominis
KMLAKYIFKEYPRFLTQYFKIRKEWKE

SEQ ID NO: 2192386 - protein, 31 aa, Cryptosporidium hominis
KMLDGKVINLPIPRRPMILVGPNCKTKKAPN

SEQ ID NO: 2192387 - protein, 19 aa, Cryptosporidium hominis
KMLFESVAVLPLIDQWVKG

SEQ ID NO: 2192388 - protein, 18 aa, Cryptosporidium hominis
KMLMNKFSLILNNYKLQE

SEQ ID NO: 2192389 - protein, 28 aa, Cryptosporidium hominis
KMLSKLNFCTFEFMLSPTLIGVPNTRVR

SEQ ID NO: 2192390 - protein, 18 aa, Cryptosporidium hominis
KMLVQRHANQIRVCQSYK

SEQ ID NO: 2192391 - protein, 17 aa, Cryptosporidium hominis
KMMINSILFTDMFQHKY

SEQ ID NO: 2192392 - protein, 21 aa, Cryptosporidium hominis
KMMQRLWGDNFFNPETKKFTK

SEQ ID NO: 2192393 - protein, 24 aa, Cryptosporidium hominis
KMNKILCEQLILNQLLQQVEWSEG

SEQ ID NO: 2192394 - protein, 23 aa, Cryptosporidium hominis
KMNYRALLRIKKIVELRKLDQAQ

SEQ ID NO: 2192395 - protein, 20 aa, Cryptosporidium hominis
KMRGFAMVEFENDEQIQNAL

SEQ ID NO: 2192396 - protein, 23 aa, Cryptosporidium hominis
KMRNWEARILSYLSPHPNIVQCL

SEQ ID NO: 2192397 - protein, 30 aa, Cryptosporidium hominis
KMRSSSTSLPLPIPLIAKNNQFQGTSGLLK

SEQ ID NO: 2192398 - protein, 27 aa, Cryptosporidium hominis
KMTKHQILAIQYFVPYVIKHSYKLEDD

SEQ ID NO: 2192399 - protein, 18 aa, Cryptosporidium hominis
KMVFLKDKIFSLTNLSNN

SEQ ID NO: 2192400 - protein, 17 aa, Cryptosporidium hominis
KMVLELCKGGDLYQYVL

SEQ ID NO: 2192401 - protein, 18 aa, Cryptosporidium hominis
KMYPNTHLIVGVASDEET

SEQ ID NO: 2192402 - protein, 24 aa, Cryptosporidium hominis
KNAPFHRLVACISPIPPPSVLSSS

SEQ ID NO: 2192403 - protein, 20 aa, Cryptosporidium hominis
KNAQIFIAVNRNGQIRIFMN

SEQ ID NO: 2192404 - protein, 19 aa, Cryptosporidium hominis
KNCPEKQILWLKAAQNQSA

SEQ ID NO: 2192405 - protein, 17 aa, Cryptosporidium hominis
KNDHIFSFDWFIKTRSS

SEQ ID NO: 2192406 - protein, 24 aa, Cryptosporidium hominis
KNDSRNMYLLIHGSGKEAESAVLS

SEQ ID NO: 2192407 - protein, 23 aa, Cryptosporidium hominis
KNDVRIYLDFEWLTILRSVKANI

SEQ ID NO: 2192408 - protein, 25 aa, Cryptosporidium hominis
KNEENLTLDLLLFEETQNYEERYLI

SEQ ID NO: 2192409 - protein, 28 aa, Cryptosporidium hominis
KNEIRIYNPLLFKNYPQLILSSIHRSLT

SEQ ID NO: 2192410 - protein, 21 aa, Cryptosporidium hominis
KNEPKNLPPIPFIENPIERKP

SEQ ID NO: 2192411 - protein, 25 aa, Cryptosporidium hominis
KNFETSVMFAPPLAMPEIKVKSPKR

SEQ ID NO: 2192412 - protein, 19 aa, Cryptosporidium hominis
KNFGRWYLSNNTKTRSFPN

SEQ ID NO: 2192413 - protein, 18 aa, Cryptosporidium hominis
KNFKKGVLKCLLLKIIRP

SEQ ID NO: 2192414 - protein, 21 aa, Cryptosporidium hominis
KNFLRLMCLLDRSTPHTTTSP

SEQ ID NO: 2192415 - protein, 20 aa, Cryptosporidium hominis
KNGILIKPLISQGESFISGN

SEQ ID NO: 2192416 - protein, 17 aa, Cryptosporidium hominis
KNGLFEILSRCDPENST

SEQ ID NO: 2192417 - protein, 23 aa, Cryptosporidium hominis
KNGMQIIKLSLILSELDINMDQF

SEQ ID NO: 2192418 - protein, 27 aa, Cryptosporidium hominis
KNHFPNSQFIIVSLKEGMFNKADVLFK

SEQ ID NO: 2192419 - protein, 21 aa, Cryptosporidium hominis
KNHINISRIPFWIKQDVDTEN

SEQ ID NO: 2192420 - protein, 27 aa, Cryptosporidium hominis
KNHPPHLSIVILLKFITTVIPSIELDN

SEQ ID NO: 2192421 - protein, 27 aa, Cryptosporidium hominis
KNIESISAIFFLRNLKRLSLVNNPITK

SEQ ID NO: 2192422 - protein, 23 aa, Cryptosporidium hominis
KNIIIHPIVLLSIVDHYNRIAKG

SEQ ID NO: 2192423 - protein, 20 aa, Cryptosporidium hominis
KNILLNDEIWELNRIIKSNN

SEQ ID NO: 2192424 - protein, 20 aa, Cryptosporidium hominis
KNILSCYKLACIVQHNHISA

SEQ ID NO: 2192425 - protein, 26 aa, Cryptosporidium hominis
KNIPYHDILALIRFGMVNNGLNKHSF

SEQ ID NO: 2192426 - protein, 19 aa, Cryptosporidium hominis
KNIQNPLIAPKSSLKLDPT

SEQ ID NO: 2192427 - protein, 26 aa, Cryptosporidium hominis
KNISSSVKDLIKWMMTKDPESRCTAA

SEQ ID NO: 2192428 - protein, 19 aa, Cryptosporidium hominis
KNKLYLPLYSKFVDENSFI

SEQ ID NO: 2192429 - protein, 23 aa, Cryptosporidium hominis
KNKNVIFRIEPISGFYYETGGLH

SEQ ID NO: 2192430 - protein, 22 aa, Cryptosporidium hominis
KNKSILHPSISGVGFVGPEPRF

SEQ ID NO: 2192431 - protein, 20 aa, Cryptosporidium hominis
KNLDLLKKGLILPGMKEAEG

SEQ ID NO: 2192432 - protein, 27 aa, Cryptosporidium hominis
KNLFSYTFMENFKSLPLFSSINGIFEF

SEQ ID NO: 2192433 - protein, 32 aa, Cryptosporidium hominis
KNLKMPNYFSSKLFIRNLPKVSINNLSSKPIY

SEQ ID NO: 2192434 - protein, 29 aa, Cryptosporidium hominis
KNLLEQKMLLNLHKPTWSEPLRCEKEENF

SEQ ID NO: 2192435 - protein, 23 aa, Cryptosporidium hominis
KNLLRLSRNHAYLYVKKNNKGKD

SEQ ID NO: 2192436 - protein, 19 aa, Cryptosporidium hominis
KNLNQFGGGFKYLSPLGYK

SEQ ID NO: 2192437 - protein, 23 aa, Cryptosporidium hominis
KNLRQRIVCFVGSPLEDDLTEKQ

SEQ ID NO: 2192438 - protein, 23 aa, Cryptosporidium hominis
KNLTIFVRDIYSFGFLHSILFNN

SEQ ID NO: 2192439 - protein, 26 aa, Cryptosporidium hominis
KNLVSKLTKVLFKHIRTFLPDIRREI

SEQ ID NO: 2192440 - protein, 21 aa, Cryptosporidium hominis
KNMKALILSSFNNAFCSESEF

SEQ ID NO: 2192441 - protein, 23 aa, Cryptosporidium hominis
KNMKNLLKNILHYEIQSRRSAQN

SEQ ID NO: 2192442 - protein, 25 aa, Cryptosporidium hominis
KNNFKLKVVFIYDLKFQFGNHTNSS

SEQ ID NO: 2192443 - protein, 24 aa, Cryptosporidium hominis
KNNNRLQFLSWDVNLRDHVDVGWY

SEQ ID NO: 2192444 - protein, 24 aa, Cryptosporidium hominis
KNNRVKLPGYLDLPGRLSKNLDKG

SEQ ID NO: 2192445 - protein, 27 aa, Cryptosporidium hominis
KNNTFKTTPIPLLSPRVFIHDHIVLDK

SEQ ID NO: 2192446 - protein, 18 aa, Cryptosporidium hominis
KNPIGGVGGIRRVEATKE

SEQ ID NO: 2192447 - protein, 26 aa, Cryptosporidium hominis
KNPIKNIMVYLWIGSKTTYFNQAKQI

SEQ ID NO: 2192448 - protein, 17 aa, Cryptosporidium hominis
KNPKFVCRTYSSEIPQL

SEQ ID NO: 2192449 - protein, 27 aa, Cryptosporidium hominis
KNQIAQEFSFILGDELYNTGLYSHNSE

SEQ ID NO: 2192450 - protein, 21 aa, Cryptosporidium hominis
KNRCRSFFSFVANWSDDDVSK

SEQ ID NO: 2192451 - protein, 23 aa, Cryptosporidium hominis
KNRIFAIIKGFSFIMRYSKGRQS

SEQ ID NO: 2192452 - protein, 22 aa, Cryptosporidium hominis
KNRNKYLLSVKVNDFINKLITI

SEQ ID NO: 2192453 - protein, 19 aa, Cryptosporidium hominis
KNRQWIEYYYSLDDEIQRL

SEQ ID NO: 2192454 - protein, 21 aa, Cryptosporidium hominis
KNRVLYLERLLEQSDKDLSAL

SEQ ID NO: 2192455 - protein, 21 aa, Cryptosporidium hominis
KNRYVILPKDFEKGWKIHVKK

SEQ ID NO: 2192456 - protein, 28 aa, Cryptosporidium hominis
KNSKNVKALYRRGLARLGFGMYEESKED

SEQ ID NO: 2192457 - protein, 17 aa, Cryptosporidium hominis
KNSLFILETFKLPEDTT

SEQ ID NO: 2192458 - protein, 26 aa, Cryptosporidium hominis
KNSLKLMLGLMLKGPLFMRSCKDTID

SEQ ID NO: 2192459 - protein, 31 aa, Cryptosporidium hominis
KNSNAIMMITFLYKLIEILKDYFKVLEEESI

SEQ ID NO: 2192460 - protein, 32 aa, Cryptosporidium hominis
KNSPNFNRLRLQFIFFYYDSNRDGLLSIDELA

SEQ ID NO: 2192461 - protein, 20 aa, Cryptosporidium hominis
KNTFMYNTRSKAMSMRQVGA

SEQ ID NO: 2192462 - protein, 21 aa, Cryptosporidium hominis
KNTLDLYKIMTKSKELGTWNK

SEQ ID NO: 2192463 - protein, 28 aa, Cryptosporidium hominis
KNTQSMEHVLIQSLRMIQKIDQFRVGSI

SEQ ID NO: 2192464 - protein, 21 aa, Cryptosporidium hominis
KNTRFVIICNYISKIIEPLAS

SEQ ID NO: 2192465 - protein, 17 aa, Cryptosporidium hominis
KNVKCTIWLSFTSNMIS

SEQ ID NO: 2192466 - protein, 31 aa, Cryptosporidium hominis
KNVLDLQFKQDLSYFIHGKWASIKKLVDDFF

SEQ ID NO: 2192467 - protein, 21 aa, Cryptosporidium hominis
KNVNPLIFFNEYMGYYLSKKH

SEQ ID NO: 2192468 - protein, 27 aa, Cryptosporidium hominis
KNVSNKLLIKNLPFQATKSDIMSLFNS

SEQ ID NO: 2192469 - protein, 20 aa, Cryptosporidium hominis
KNVSSIFLLDLSLSLSTFSR

SEQ ID NO: 2192470 - protein, 30 aa, Cryptosporidium hominis
KNVTIRKPIILGTYAFMLSIAEQKKRGDNA

SEQ ID NO: 2192471 - protein, 24 aa, Cryptosporidium hominis
KNYKRWIKTWYNQPGRKQSRRIAR

SEQ ID NO: 2192472 - protein, 19 aa, Cryptosporidium hominis
KNYLLSKLNYEKCLLEQKI

SEQ ID NO: 2192473 - protein, 23 aa, Cryptosporidium hominis
KNYRDNHINFWKSKVLLNLISNQ

SEQ ID NO: 2192474 - protein, 36 aa, Cryptosporidium hominis
KNYSLVYKRLYDCLGPVMFPIAPLKGIKHPRGELKL

SEQ ID NO: 2192475 - protein, 22 aa, Cryptosporidium hominis
KPAIRRLARRGGVKRISALIYE

SEQ ID NO: 2192476 - protein, 17 aa, Cryptosporidium hominis
KPCYLCYSSSTISNQMI

SEQ ID NO: 2192477 - protein, 25 aa, Cryptosporidium hominis
KPDDCLWSIIDGKTIQIVLEKQENI

SEQ ID NO: 2192478 - protein, 25 aa, Cryptosporidium hominis
KPDLMYSHSLWTNSFYVAFIELRRE

SEQ ID NO: 2192479 - protein, 19 aa, Cryptosporidium hominis
KPDMLMNLMRLGAASIMAS

SEQ ID NO: 2192480 - protein, 18 aa, Cryptosporidium hominis
KPDQLYEESIIDFLKKNG

SEQ ID NO: 2192481 - protein, 19 aa, Cryptosporidium hominis
KPEEPIILIKIPDGKSKAS

SEQ ID NO: 2192482 - protein, 18 aa, Cryptosporidium hominis
KPEFINRRLSLFKTLYEK

SEQ ID NO: 2192483 - protein, 22 aa, Cryptosporidium hominis
KPEFKNFLYKPSVQKVNAIGNN

SEQ ID NO: 2192484 - protein, 19 aa, Cryptosporidium hominis
KPEYYYFPPELLTDARDFL

SEQ ID NO: 2192485 - protein, 24 aa, Cryptosporidium hominis
KPFINAPESLPIFPPNPIEIDENT

SEQ ID NO: 2192486 - protein, 22 aa, Cryptosporidium hominis
KPGDKVIFTGTLIVAPDVPSLM

SEQ ID NO: 2192487 - protein, 19 aa, Cryptosporidium hominis
KPGECFFGLSPPYVGDDQL

SEQ ID NO: 2192488 - protein, 25 aa, Cryptosporidium hominis
KPIDPTTGLPFNPPTGHLINPTNNN

SEQ ID NO: 2192489 - protein, 23 aa, Cryptosporidium hominis
KPIFVHISLLPFTEQISLSVNNK

SEQ ID NO: 2192490 - protein, 19 aa, Cryptosporidium hominis
KPIIDKFSGIILAGNILRL

SEQ ID NO: 2192491 - protein, 18 aa, Cryptosporidium hominis
KPIKIRHRLALKGDWIDN

SEQ ID NO: 2192492 - protein, 18 aa, Cryptosporidium hominis
KPILNSFKMLINTIYDFL

SEQ ID NO: 2192493 - protein, 26 aa, Cryptosporidium hominis
KPINEQLITGIKFIDSLIPIGLGQRE

SEQ ID NO: 2192494 - protein, 19 aa, Cryptosporidium hominis
KPIVARCYILSARGLLPPS

SEQ ID NO: 2192495 - protein, 22 aa, Cryptosporidium hominis
KPIVHTFLHLLSIAKTYKDDVK

SEQ ID NO: 2192496 - protein, 27 aa, Cryptosporidium hominis
KPIVKGKPPGPPPPLKSKSALSLKSSG

SEQ ID NO: 2192497 - protein, 18 aa, Cryptosporidium hominis
KPKDILLLSYLKCINKKS

SEQ ID NO: 2192498 - protein, 28 aa, Cryptosporidium hominis
KPKIRDYFTCMLFITLKLQDIFTKKNSE

SEQ ID NO: 2192499 - protein, 26 aa, Cryptosporidium hominis
KPKKPKRMFSGKYKDPSLFLKSAQKE

SEQ ID NO: 2192500 - protein, 25 aa, Cryptosporidium hominis
KPKPLQMLFHFALKQKEKSNSPFHF

SEQ ID NO: 2192501 - protein, 40 aa, Cryptosporidium hominis
KPLKSKMPFVIDVFVLYCIERYTGKFLPFKGISWKTIIES

SEQ ID NO: 2192502 - protein, 20 aa, Cryptosporidium hominis
KPNFVQFYAVPHPPVPAMKY

SEQ ID NO: 2192503 - protein, 32 aa, Cryptosporidium hominis
KPNGRSWDIFVNVPKKFANVTTLGFENGKKLQ

SEQ ID NO: 2192504 - protein, 22 aa, Cryptosporidium hominis
KPNSIIAYWPPNEALKIPTAIE

SEQ ID NO: 2192505 - protein, 26 aa, Cryptosporidium hominis
KPNWSFHFKGIYFFRNISKSNPCGSN

SEQ ID NO: 2192506 - protein, 19 aa, Cryptosporidium hominis
KPPPPVYNPLHWEMKSRSN

SEQ ID NO: 2192507 - protein, 18 aa, Cryptosporidium hominis
KPRFNLWASIKESITKDI

SEQ ID NO: 2192508 - protein, 20 aa, Cryptosporidium hominis
KPRHVPDFVLISPEDVDRLL

SEQ ID NO: 2192509 - protein, 23 aa, Cryptosporidium hominis
KPRPINWWFNHSVRHITVKFNCE

SEQ ID NO: 2192510 - protein, 29 aa, Cryptosporidium hominis
KPSLSLELIKLFIYIWGLDKSFSMDESKQ

SEQ ID NO: 2192511 - protein, 18 aa, Cryptosporidium hominis
KPVIISCPASLLDNWTKE

SEQ ID NO: 2192512 - protein, 20 aa, Cryptosporidium hominis
KPVSYLLFARSSISKSPIRL

SEQ ID NO: 2192513 - protein, 19 aa, Cryptosporidium hominis
KPYFEDVIAPSIMSGKSVL

SEQ ID NO: 2192514 - protein, 27 aa, Cryptosporidium hominis
KPYQLEGLNWLINLYEGGLNGILADEM

SEQ ID NO: 2192515 - protein, 28 aa, Cryptosporidium hominis
KQDCESFEFFFSFIYGLIVHSDKVKIPV

SEQ ID NO: 2192516 - protein, 25 aa, Cryptosporidium hominis
KQDCPAFIYYWNGSTCYIYDDNIAI

SEQ ID NO: 2192517 - protein, 26 aa, Cryptosporidium hominis
KQEALRTYLFTYGHLYSSYSVNNLIE

SEQ ID NO: 2192518 - protein, 24 aa, Cryptosporidium hominis
KQEGAWIFDKPVDEKAWNCSDYYK

SEQ ID NO: 2192519 - protein, 25 aa, Cryptosporidium hominis
KQEIIEVVFSYWDGSGHRRSVHVPR

SEQ ID NO: 2192520 - protein, 27 aa, Cryptosporidium hominis
KQELIYDLLFGNNQRKLPKGGIGNFED

SEQ ID NO: 2192521 - protein, 25 aa, Cryptosporidium hominis
KQFNKLYRINNKLNKKFREINNKIS

SEQ ID NO: 2192522 - protein, 20 aa, Cryptosporidium hominis
KQFPPLKILQFSVGQRHTLV

SEQ ID NO: 2192523 - protein, 34 aa, Cryptosporidium hominis
KQFQAISHTAQLLRKLYHFCIENNLPPTEETFKK

SEQ ID NO: 2192524 - protein, 17 aa, Cryptosporidium hominis
KQFYSARMRTNAFNSRH

SEQ ID NO: 2192525 - protein, 23 aa, Cryptosporidium hominis
KQHKERLVLLEFQGSLSISKLNT

SEQ ID NO: 2192526 - protein, 20 aa, Cryptosporidium hominis
KQHSYSEDLFPDCFAGIPSC

SEQ ID NO: 2192527 - protein, 22 aa, Cryptosporidium hominis
KQIFLQFHRDTLLPKRWPIGEK

SEQ ID NO: 2192528 - protein, 21 aa, Cryptosporidium hominis
KQILKYKFDYYFDVSPRQISK

SEQ ID NO: 2192529 - protein, 18 aa, Cryptosporidium hominis
KQKIFEYEFNDNKLDVEA

SEQ ID NO: 2192530 - protein, 25 aa, Cryptosporidium hominis
KQKRFYYSYFLPNNHMMSVPQIALL

SEQ ID NO: 2192531 - protein, 20 aa, Cryptosporidium hominis
KQKVYLIDQSDCKELNKDEM

SEQ ID NO: 2192532 - protein, 19 aa, Cryptosporidium hominis
KQLFYIPEKQYSTPDLWLT

SEQ ID NO: 2192533 - protein, 24 aa, Cryptosporidium hominis
KQLGYIIFANIIPISSTRLLVVGV

SEQ ID NO: 2192534 - protein, 25 aa, Cryptosporidium hominis
KQLKMRSPTIFSLSFDRPNLKYEVR

SEQ ID NO: 2192535 - protein, 28 aa, Cryptosporidium hominis
KQLSFFLSGFHELIPARLIAIFDDKELE

SEQ ID NO: 2192536 - protein, 26 aa, Cryptosporidium hominis
KQLSFSNFKIFLKLPNRLQVQDVLSV

SEQ ID NO: 2192537 - protein, 19 aa, Cryptosporidium hominis
KQNLLLSKRIKNVNLKVGV

SEQ ID NO: 2192538 - protein, 23 aa, Cryptosporidium hominis
KQNPSNLLGVRDANIEGGSIGAR

SEQ ID NO: 2192539 - protein, 21 aa, Cryptosporidium hominis
KQRLLKIKNILKNISKKRYEE

SEQ ID NO: 2192540 - protein, 30 aa, Cryptosporidium hominis
KQTITISDIILYFITQLLPNQKIIQHKIFK

SEQ ID NO: 2192541 - protein, 19 aa, Cryptosporidium hominis
KQWKVRRLIATLEAARGNG

SEQ ID NO: 2192542 - protein, 18 aa, Cryptosporidium hominis
KRCIYDALCVVRNLIRDS

SEQ ID NO: 2192543 - protein, 18 aa, Cryptosporidium hominis
KRDCVNVTLFFNKVLQSR

SEQ ID NO: 2192544 - protein, 23 aa, Cryptosporidium hominis
KRDKNLWTRGLYMLQNTDRSELE

SEQ ID NO: 2192545 - protein, 24 aa, Cryptosporidium hominis
KRDNIIQRFRTGKIWILICTDLMA

SEQ ID NO: 2192546 - protein, 26 aa, Cryptosporidium hominis
KREFSVFFKHILFSTSIEHLNLSRNK

SEQ ID NO: 2192547 - protein, 17 aa, Cryptosporidium hominis
KREILIMKRLDHPNIIK

SEQ ID NO: 2192548 - protein, 18 aa, Cryptosporidium hominis
KREIVQDITLYDLDLANA

SEQ ID NO: 2192549 - protein, 25 aa, Cryptosporidium hominis
KREKTRWEKFAELKGIKKRKRSRMV

SEQ ID NO: 2192550 - protein, 27 aa, Cryptosporidium hominis
KREQSLIILGLITTYLFFSIPKSRIRI

SEQ ID NO: 2192551 - protein, 28 aa, Cryptosporidium hominis
KRFEVACYKNKILNWRSGVEWDLDEVLQ

SEQ ID NO: 2192552 - protein, 33 aa, Cryptosporidium hominis
KRFKELHEFGTMYRLLLSGTPLHNNLEELWSLL

SEQ ID NO: 2192553 - protein, 26 aa, Cryptosporidium hominis
KRFRFNFGIIILHFILANIKNGVFEK

SEQ ID NO: 2192554 - protein, 25 aa, Cryptosporidium hominis
KRGDYFGELALLRNTPRAATVKARG

SEQ ID NO: 2192555 - protein, 17 aa, Cryptosporidium hominis
KRHLVVGSIQILTRRVL

SEQ ID NO: 2192556 - protein, 30 aa, Cryptosporidium hominis
KRICSIEWKNRFFFGFALREHYGPIPLNAL

SEQ ID NO: 2192557 - protein, 23 aa, Cryptosporidium hominis
KRIESLQKNYKVRILLCLVDIPP

SEQ ID NO: 2192558 - protein, 21 aa, Cryptosporidium hominis
KRIEVFSLKLKRGGFRKVNKT

SEQ ID NO: 2192559 - protein, 29 aa, Cryptosporidium hominis
KRIFEGLTFFISREVPLLPLAFVIKSFGG

SEQ ID NO: 2192560 - protein, 20 aa, Cryptosporidium hominis
KRIFPELFIIMSTFPPNIPE

SEQ ID NO: 2192561 - protein, 22 aa, Cryptosporidium hominis
KRIKCILDTLMKMMVYEMSYVR

SEQ ID NO: 2192562 - protein, 22 aa, Cryptosporidium hominis
KRIPSILEKFFDKSITKKINHK

SEQ ID NO: 2192563 - protein, 18 aa, Cryptosporidium hominis
KRIVMEMIPLIYSKADMV

SEQ ID NO: 2192564 - protein, 24 aa, Cryptosporidium hominis
KRKGKFKVYPPLGTILTVGEDQTN

SEQ ID NO: 2192565 - protein, 24 aa, Cryptosporidium hominis
KRKMHYREFITAKSKLPKANDSDS

SEQ ID NO: 2192566 - protein, 21 aa, Cryptosporidium hominis
KRKQKGPPQYARLPAVVPNAK

SEQ ID NO: 2192567 - protein, 24 aa, Cryptosporidium hominis
KRLAQLGRFLTFGYTQGLYGVRVD

SEQ ID NO: 2192568 - protein, 28 aa, Cryptosporidium hominis
KRLQVSLADFRRLCILKGVYPREPKKKL

SEQ ID NO: 2192569 - protein, 25 aa, Cryptosporidium hominis
KRLSKFYEPLLKFVKDEFPGEFLKV

SEQ ID NO: 2192570 - protein, 26 aa, Cryptosporidium hominis
KRLSTPPFLKLHLKPMPSDPTHSSYY

SEQ ID NO: 2192571 - protein, 24 aa, Cryptosporidium hominis
KRMIGEILKWYFGMSHVSLNDITP

SEQ ID NO: 2192572 - protein, 34 aa, Cryptosporidium hominis
KRMLKGEMMIPMTPWYKSFKGKIFPIKQKSKKNS

SEQ ID NO: 2192573 - protein, 29 aa, Cryptosporidium hominis
KRNLLQKGFKLWTRREFNLLLRCLETNGV

SEQ ID NO: 2192574 - protein, 25 aa, Cryptosporidium hominis
KRPTDKPLRLPLQDVYKIGGVGTVP

SEQ ID NO: 2192575 - protein, 25 aa, Cryptosporidium hominis
KRQIEEHILLSFKYPDVLDKIVNGT

SEQ ID NO: 2192576 - protein, 39 aa, Cryptosporidium hominis
KRRAFNWLVREIENYKSLYLQFLCVTLASNIRPGNNSLL

SEQ ID NO: 2192577 - protein, 22 aa, Cryptosporidium hominis
KRRDSVVKWIGRLSMNSSSEEK

SEQ ID NO: 2192578 - protein, 23 aa, Cryptosporidium hominis
KRRDTICIVLVDPDLEEGKIRMN

SEQ ID NO: 2192579 - protein, 23 aa, Cryptosporidium hominis
KRREKLWYLMESYLPTDIESIQR

SEQ ID NO: 2192580 - protein, 30 aa, Cryptosporidium hominis
KRRFQPNQFLKFSNLVLVPGKPRKWKRVQR

SEQ ID NO: 2192581 - protein, 27 aa, Cryptosporidium hominis
KRSFKISKIYLIFYSCNKTVLNIEEQL

SEQ ID NO: 2192582 - protein, 18 aa, Cryptosporidium hominis
KRSFSKENSTILIETNEI

SEQ ID NO: 2192583 - protein, 26 aa, Cryptosporidium hominis
KRSGLLVCKFADSEDLNLTWPGGQTK

SEQ ID NO: 2192584 - protein, 26 aa, Cryptosporidium hominis
KRSVENLLRLLSYHGVMACVGAPPAG

SEQ ID NO: 2192585 - protein, 25 aa, Cryptosporidium hominis
KRSWSSLIRMLYTDYLMSNPKDYPV

SEQ ID NO: 2192586 - protein, 20 aa, Cryptosporidium hominis
KRTFLRHRITARLAMVYLNS

SEQ ID NO: 2192587 - protein, 18 aa, Cryptosporidium hominis
KRTIQFVDWCPTGFKCGI

SEQ ID NO: 2192588 - protein, 24 aa, Cryptosporidium hominis
KRVVLIKYDLYILSILKSLNNENN

SEQ ID NO: 2192589 - protein, 17 aa, Cryptosporidium hominis
KRWVFCPCRSCLFKGKA

SEQ ID NO: 2192590 - protein, 17 aa, Cryptosporidium hominis
KRYEGLGFKLESDKISK

SEQ ID NO: 2192591 - protein, 20 aa, Cryptosporidium hominis
KRYLTYISNILPQRLYCSFC

SEQ ID NO: 2192592 - protein, 25 aa, Cryptosporidium hominis
KRYTETILDWIYFEKPDSYKEICML

SEQ ID NO: 2192593 - protein, 20 aa, Cryptosporidium hominis
KSALSELGDFNKKLLEENTR

SEQ ID NO: 2192594 - protein, 26 aa, Cryptosporidium hominis
KSCEDDISLFLEGKPFVLSNINYNEL

SEQ ID NO: 2192595 - protein, 18 aa, Cryptosporidium hominis
KSCEPFVDWLLDGSNDES

SEQ ID NO: 2192596 - protein, 33 aa, Cryptosporidium hominis
KSCICWLKQHRKQPMNFLPLNSIKLDKRGNSTV

SEQ ID NO: 2192597 - protein, 33 aa, Cryptosporidium hominis
KSCNILIKSSKWYKYPWRFTFSDFTNKKMISKS

SEQ ID NO: 2192598 - protein, 33 aa, Cryptosporidium hominis
KSCPVWIPPWWTAFRIGGWNWQYSLEVELSWFS

SEQ ID NO: 2192599 - protein, 24 aa, Cryptosporidium hominis
KSDENFTFWLSLTSDKDQSCQKYN

SEQ ID NO: 2192600 - protein, 19 aa, Cryptosporidium hominis
KSDILECFIKWKNDHYYTK

SEQ ID NO: 2192601 - protein, 27 aa, Cryptosporidium hominis
KSDKGVFNYFELVEKYTTRNSYNRRGN

SEQ ID NO: 2192602 - protein, 22 aa, Cryptosporidium hominis
KSDLPMIISHCPGWICYSEKSL

SEQ ID NO: 2192603 - protein, 24 aa, Cryptosporidium hominis
KSEIHLRCLLLSNMFTEQSIKESM

SEQ ID NO: 2192604 - protein, 42 aa, Cryptosporidium hominis
KSEIPKLDFVVDHLFLWGSPLPAMLVMMFPEYLRSGLTLPKG

SEQ ID NO: 2192605 - protein, 17 aa, Cryptosporidium hominis
KSEKFLKALNSNLLRII

SEQ ID NO: 2192606 - protein, 20 aa, Cryptosporidium hominis
KSEKLLPLKIVQNKYNKHKK

SEQ ID NO: 2192607 - protein, 25 aa, Cryptosporidium hominis
KSELDYIFGILSRESFSSGFSALQN

SEQ ID NO: 2192608 - protein, 27 aa, Cryptosporidium hominis
KSENTLRKLLNWWKTEGFFKRSKHLED

SEQ ID NO: 2192609 - protein, 31 aa, Cryptosporidium hominis
KSEQRLLVDFQEFPVMLVDLLNRSKGNGCSD

SEQ ID NO: 2192610 - protein, 31 aa, Cryptosporidium hominis
KSESGFEPFGPWLVTPLFLGAKGGGGSQGHS

SEQ ID NO: 2192611 - protein, 20 aa, Cryptosporidium hominis
KSETDIETRQKEREIDNELY

SEQ ID NO: 2192612 - protein, 18 aa, Cryptosporidium hominis
KSFDSFLSERNFVTDDLP

SEQ ID NO: 2192613 - protein, 33 aa, Cryptosporidium hominis
KSFDYTILFQSISRLFLLPRPGTSLVNLVIALE

SEQ ID NO: 2192614 - protein, 32 aa, Cryptosporidium hominis
KSFKGNYIAPFGLFGHLKIYDFALSTIEVGLL

SEQ ID NO: 2192615 - protein, 31 aa, Cryptosporidium hominis
KSFLPPVMLENLPWLHHIDIFGIASTIHCLI

SEQ ID NO: 2192616 - protein, 33 aa, Cryptosporidium hominis
KSFNPRHYGGLEQALQAAIEYLREQKAKLSLYR

SEQ ID NO: 2192617 - protein, 25 aa, Cryptosporidium hominis
KSFRNIFLGNKWLSPPELFSRMFNS

SEQ ID NO: 2192618 - protein, 28 aa, Cryptosporidium hominis
KSFSNCLFDYIPKLVLLLRSHETLSLIL

SEQ ID NO: 2192619 - protein, 17 aa, Cryptosporidium hominis
KSGAFFYYTTDGRFLIK

SEQ ID NO: 2192620 - protein, 21 aa, Cryptosporidium hominis
KSGMLKRRIFPEDVTLNIAED

SEQ ID NO: 2192621 - protein, 25 aa, Cryptosporidium hominis
KSGSAYPFWDLKIINVISSSERKRR

SEQ ID NO: 2192622 - protein, 37 aa, Cryptosporidium hominis
KSGYKGVSWNKRMQSWLAFWTEGQRRRSKTFNSKIYG

SEQ ID NO: 2192623 - protein, 17 aa, Cryptosporidium hominis
KSHKLYLEKLHKLTLAP

SEQ ID NO: 2192624 - protein, 25 aa, Cryptosporidium hominis
KSHLTLLKEIVFAYSYPRLDINVSK

SEQ ID NO: 2192625 - protein, 25 aa, Cryptosporidium hominis
KSIAKLLDLILDNSDEFLAEDTAGR

SEQ ID NO: 2192626 - protein, 31 aa, Cryptosporidium hominis
KSIDLPLPRINCGMFLRGNIIYIYGGLFESG

SEQ ID NO: 2192627 - protein, 25 aa, Cryptosporidium hominis
KSIELPFFVPSCVSLPFGTLNKLLN

SEQ ID NO: 2192628 - protein, 26 aa, Cryptosporidium hominis
KSIGDSFFPEIWNFYCNYFKCCLEKW

SEQ ID NO: 2192629 - protein, 31 aa, Cryptosporidium hominis
KSIILSGHNLFLPYIFELHSGGLFPAPILIN

SEQ ID NO: 2192630 - protein, 27 aa, Cryptosporidium hominis
KSIKFYKNLLLNRIKWDQPIETTTSCS

SEQ ID NO: 2192631 - protein, 29 aa, Cryptosporidium hominis
KSILEYLDLFPCFVLAIFKSLVLLDQVEL

SEQ ID NO: 2192632 - protein, 24 aa, Cryptosporidium hominis
KSILQDRFPVPKFVLCHAGGSQAR

SEQ ID NO: 2192633 - protein, 25 aa, Cryptosporidium hominis
KSINARIELYKQYLAQWLKNAEDNG

SEQ ID NO: 2192634 - protein, 28 aa, Cryptosporidium hominis
KSINFRDFHVRLIAILRSSQLVEILENM

SEQ ID NO: 2192635 - protein, 19 aa, Cryptosporidium hominis
KSIRTMFFDTFSGPIVRGS

SEQ ID NO: 2192636 - protein, 26 aa, Cryptosporidium hominis
KSISSPNIFSPLRSPSFLNKNYSQEG

SEQ ID NO: 2192637 - protein, 24 aa, Cryptosporidium hominis
KSKDFFLNLLQNKNLIYFKTELTK

SEQ ID NO: 2192638 - protein, 26 aa, Cryptosporidium hominis
KSKEQFLFSFFDIKRFDYSKFTLETS

SEQ ID NO: 2192639 - protein, 21 aa, Cryptosporidium hominis
KSKEYFWIKWANFEEKYGNFE

SEQ ID NO: 2192640 - protein, 24 aa, Cryptosporidium hominis
KSKIHKIFFIVMENIFHTPVEIHR

SEQ ID NO: 2192641 - protein, 24 aa, Cryptosporidium hominis
KSKKNRLFYISKICSKKIDKVIPE

SEQ ID NO: 2192642 - protein, 23 aa, Cryptosporidium hominis
KSKLLKDFSSLKLDFDKLKEQHN

SEQ ID NO: 2192643 - protein, 21 aa, Cryptosporidium hominis
KSLEKLMIPSILKVGKEPVIQ

SEQ ID NO: 2192644 - protein, 18 aa, Cryptosporidium hominis
KSLFKVGGVFRRCGYLSN

SEQ ID NO: 2192645 - protein, 17 aa, Cryptosporidium hominis
KSLGITEPILTQVDLVC

SEQ ID NO: 2192646 - protein, 20 aa, Cryptosporidium hominis
KSLIHANSYAFKNIYKLDDF

SEQ ID NO: 2192647 - protein, 22 aa, Cryptosporidium hominis
KSLISILRGLLDTRNKFFNGKA

SEQ ID NO: 2192648 - protein, 20 aa, Cryptosporidium hominis
KSLKLFRIDSDFCSYKLLNS

SEQ ID NO: 2192649 - protein, 23 aa, Cryptosporidium hominis
KSLKSGATLLFRDYGRYDMAQLR

SEQ ID NO: 2192650 - protein, 25 aa, Cryptosporidium hominis
KSLNDFLQDLLNFIGYHIESESILE

SEQ ID NO: 2192651 - protein, 20 aa, Cryptosporidium hominis
KSLYLIEKFVLNSKILSLND

SEQ ID NO: 2192652 - protein, 24 aa, Cryptosporidium hominis
KSMEIKGIPYQSALEKFWLVDSKG

SEQ ID NO: 2192653 - protein, 32 aa, Cryptosporidium hominis
KSNGPIISLRAYYPERFASSKPKYIPGNDSFK

SEQ ID NO: 2192654 - protein, 31 aa, Cryptosporidium hominis
KSNHKDYHLPSSSYLYLLATAATEIFEKQEV

SEQ ID NO: 2192655 - protein, 22 aa, Cryptosporidium hominis
KSNKFILNALKYDGKKSKILVD

SEQ ID NO: 2192656 - protein, 28 aa, Cryptosporidium hominis
KSNNFIIIELPRYFTSNPLFFKNSANKQ

SEQ ID NO: 2192657 - protein, 30 aa, Cryptosporidium hominis
KSNSKISFLLNRPLIMSIQDFIATYKSNSF

SEQ ID NO: 2192658 - protein, 23 aa, Cryptosporidium hominis
KSNTLSAIKWNFSRFLIDKNGKV

SEQ ID NO: 2192659 - protein, 21 aa, Cryptosporidium hominis
KSNTWNIFIDSSINRNIVCEM

SEQ ID NO: 2192660 - protein, 26 aa, Cryptosporidium hominis
KSNYYATAFLRYLPGINAKNIKVLTS

SEQ ID NO: 2192661 - protein, 26 aa, Cryptosporidium hominis
KSNYYLGYHFLTTLVTFWTGGSKFRQ

SEQ ID NO: 2192662 - protein, 28 aa, Cryptosporidium hominis
KSPCRIITLPYIFRYLSNELAAMNIVIR

SEQ ID NO: 2192663 - protein, 30 aa, Cryptosporidium hominis
KSQGLYWEDEFILPPTQFPFIKEEKESLEN

SEQ ID NO: 2192664 - protein, 20 aa, Cryptosporidium hominis
KSQHIHFELQKQFMSDSLNN

SEQ ID NO: 2192665 - protein, 21 aa, Cryptosporidium hominis
KSQKNLLINPFLLINNRNQLN

SEQ ID NO: 2192666 - protein, 25 aa, Cryptosporidium hominis
KSQLPLIRWVMLEILPILHKLNSIP

SEQ ID NO: 2192667 - protein, 32 aa, Cryptosporidium hominis
KSRNMDPAPYWWYNELRKYGSVPHSGFGLGFE

SEQ ID NO: 2192668 - protein, 19 aa, Cryptosporidium hominis
KSRTPLNSFVFPQASNVQV

SEQ ID NO: 2192669 - protein, 28 aa, Cryptosporidium hominis
KSRTSLALPEFLVEDIPLPKVCVFQIEA

SEQ ID NO: 2192670 - protein, 22 aa, Cryptosporidium hominis
KSRVAIAIMAYLNPHLLILDEP

SEQ ID NO: 2192671 - protein, 18 aa, Cryptosporidium hominis
KSSFELLLNMNIRRTFSL

SEQ ID NO: 2192672 - protein, 19 aa, Cryptosporidium hominis
KSSFMLLPHRETSLLVSIP

SEQ ID NO: 2192673 - protein, 26 aa, Cryptosporidium hominis
KSSIIDIDSLLYWIVQRQSGIEGGFQ

SEQ ID NO: 2192674 - protein, 35 aa, Cryptosporidium hominis
KSSSTLNLTLAWTKAFIYLILVSSMTVLASVPRFA

SEQ ID NO: 2192675 - protein, 23 aa, Cryptosporidium hominis
KSTEFFIHIDTKDPGFSKNLGGI

SEQ ID NO: 2192676 - protein, 24 aa, Cryptosporidium hominis
KSTKNYILILKSLVDRLQLFIGSM

SEQ ID NO: 2192677 - protein, 22 aa, Cryptosporidium hominis
KSTQLLLALQNQTPLIGLQNTP

SEQ ID NO: 2192678 - protein, 24 aa, Cryptosporidium hominis
KSTYLIDEFMYLVSELGFLTKSFI

SEQ ID NO: 2192679 - protein, 24 aa, Cryptosporidium hominis
KSVCAINCWGLFASNLISFQNLMN

SEQ ID NO: 2192680 - protein, 17 aa, Cryptosporidium hominis
KSVHLLALKFDNFDLAG

SEQ ID NO: 2192681 - protein, 28 aa, Cryptosporidium hominis
KSVMDKLTTLKIWYTKNGLKWCRNNETC

SEQ ID NO: 2192682 - protein, 20 aa, Cryptosporidium hominis
KSVSFLPQQILETNLTDLQF

SEQ ID NO: 2192683 - protein, 28 aa, Cryptosporidium hominis
KSVSSKDFRLKRLFYASKSQLKNISYEN

SEQ ID NO: 2192684 - protein, 17 aa, Cryptosporidium hominis
KSYFFGTPEFPLKPHTI

SEQ ID NO: 2192685 - protein, 26 aa, Cryptosporidium hominis
KSYLSELNLFRLILELIQTDLVKDLR

SEQ ID NO: 2192686 - protein, 27 aa, Cryptosporidium hominis
KSYNLWSNRAWLLEFIVNLKNADKILL

SEQ ID NO: 2192687 - protein, 28 aa, Cryptosporidium hominis
KSYYKQMVRIYSVFAPLGLEIIGLPSRE

SEQ ID NO: 2192688 - protein, 35 aa, Cryptosporidium hominis
KTDKLEELIFDWIKLRCWNFTDSDLRWIDGCKYIG

SEQ ID NO: 2192689 - protein, 19 aa, Cryptosporidium hominis
KTEDFMDLTWIRLSAIPGS

SEQ ID NO: 2192690 - protein, 34 aa, Cryptosporidium hominis
KTEHAINSLKNPLLFWFKGLFRQNEPTHIRPAFP

SEQ ID NO: 2192691 - protein, 20 aa, Cryptosporidium hominis
KTFLQELLGGIDGQRRVLRM

SEQ ID NO: 2192692 - protein, 30 aa, Cryptosporidium hominis
KTFSLDNLLRIVWISPQLISIKWCKANKIN

SEQ ID NO: 2192693 - protein, 22 aa, Cryptosporidium hominis
KTGLDSLIRRKILQGIKDKLKT

SEQ ID NO: 2192694 - protein, 23 aa, Cryptosporidium hominis
KTGQLIIWEWQSESYILKQQGHS

SEQ ID NO: 2192695 - protein, 24 aa, Cryptosporidium hominis
KTGSFIIPILQRLLDDQVPMYAVI

SEQ ID NO: 2192696 - protein, 25 aa, Cryptosporidium hominis
KTIGGVFCYLLKQLVAEDQITIQEW

SEQ ID NO: 2192697 - protein, 21 aa, Cryptosporidium hominis
KTILPILNSTTLETMWDCLGR

SEQ ID NO: 2192698 - protein, 25 aa, Cryptosporidium hominis
KTIQSYYYFIYSLIFRESYPFNENE

SEQ ID NO: 2192699 - protein, 25 aa, Cryptosporidium hominis
KTIQTLTFLACLKALGITGPHLIVV

SEQ ID NO: 2192700 - protein, 19 aa, Cryptosporidium hominis
KTIRDELLARFDQLGYSKY

SEQ ID NO: 2192701 - protein, 17 aa, Cryptosporidium hominis
KTIYKYFSPKERSIKGI

SEQ ID NO: 2192702 - protein, 17 aa, Cryptosporidium hominis
KTIYLFVNNTIPKAGSL

SEQ ID NO: 2192703 - protein, 27 aa, Cryptosporidium hominis
KTKIGRELYLLYSSLFNIVVNRIKCNL

SEQ ID NO: 2192704 - protein, 27 aa, Cryptosporidium hominis
KTKSDFMPFLFFTNGHVWKMAFSPPSY

SEQ ID NO: 2192705 - protein, 18 aa, Cryptosporidium hominis
KTLFCGWSSPLWSQADSG

SEQ ID NO: 2192706 - protein, 23 aa, Cryptosporidium hominis
KTLHVACFVLFHTGEPSPGCVRS

SEQ ID NO: 2192707 - protein, 25 aa, Cryptosporidium hominis
KTLLQYITEIIWRDKPELLSLAEPL

SEQ ID NO: 2192708 - protein, 21 aa, Cryptosporidium hominis
KTLQFIIRVPKEYPFKPPKVK

SEQ ID NO: 2192709 - protein, 30 aa, Cryptosporidium hominis
KTLSSLALVFALHQFRPSPLYFMDEVDAAL

SEQ ID NO: 2192710 - protein, 24 aa, Cryptosporidium hominis
KTNCRNAFSDFPRTVKVCAGGEYS

SEQ ID NO: 2192711 - protein, 36 aa, Cryptosporidium hominis
KTNILSIKLGWPVIRCPHYIDFLPVLKNCILRTNIQ

SEQ ID NO: 2192712 - protein, 33 aa, Cryptosporidium hominis
KTNKLQISYLGDSGIIILRRTPETFRMGIVYRS

SEQ ID NO: 2192713 - protein, 17 aa, Cryptosporidium hominis
KTNLIVFILDGDPEKHS

SEQ ID NO: 2192714 - protein, 28 aa, Cryptosporidium hominis
KTNNNILMRFILFAYDLGLLYIDESIIE

SEQ ID NO: 2192715 - protein, 33 aa, Cryptosporidium hominis
KTPAEVRAICRDWWIFSLKYYRNIKYKDNKHNS

SEQ ID NO: 2192716 - protein, 24 aa, Cryptosporidium hominis
KTPDYRMNMLNAPDYRTPNYIQQQ

SEQ ID NO: 2192717 - protein, 22 aa, Cryptosporidium hominis
KTPFRRSIPFMGSSQDSVGYPA

SEQ ID NO: 2192718 - protein, 24 aa, Cryptosporidium hominis
KTPKGVLLYGPPGTGKTLLARAMA

SEQ ID NO: 2192719 - protein, 25 aa, Cryptosporidium hominis
KTPQMHLHVLKRLTLLPPESKFTKP

SEQ ID NO: 2192720 - protein, 25 aa, Cryptosporidium hominis
KTQDLVKTLLPAPKALNIDEDDPSI

SEQ ID NO: 2192721 - protein, 19 aa, Cryptosporidium hominis
KTQIKITETYQTDGTYTSK

SEQ ID NO: 2192722 - protein, 23 aa, Cryptosporidium hominis
KTQPVLDLIFDLFSLLDDDSRLK

SEQ ID NO: 2192723 - protein, 26 aa, Cryptosporidium hominis
KTQVYDIYKYLPPRIQTVLVSATLPD

SEQ ID NO: 2192724 - protein, 19 aa, Cryptosporidium hominis
KTRELLFSNLAQIKYPSIQ

SEQ ID NO: 2192725 - protein, 17 aa, Cryptosporidium hominis
KTRIYVPLSIETKDDNA

SEQ ID NO: 2192726 - protein, 21 aa, Cryptosporidium hominis
KTRYRLSISLYKLFGCGDVFS

SEQ ID NO: 2192727 - protein, 28 aa, Cryptosporidium hominis
KTSDGYVLRLFCIAFTRRMADQVKSTCY

SEQ ID NO: 2192728 - protein, 21 aa, Cryptosporidium hominis
KTSLFLTSLLPFRENGHSHIT

SEQ ID NO: 2192729 - protein, 27 aa, Cryptosporidium hominis
KTSLPIIFIRYIQYTLCLSPYALLCLW

SEQ ID NO: 2192730 - protein, 24 aa, Cryptosporidium hominis
KTSRNRSQYYRNENYYDQGYDNDY

SEQ ID NO: 2192731 - protein, 42 aa, Cryptosporidium hominis
KTSSKNWFCFQCLSLTLRILPSLIYRIPNLTPGLIDSIQNLY

SEQ ID NO: 2192732 - protein, 27 aa, Cryptosporidium hominis
KTSSRQTVFLPVIGLVPENELKPGDLV

SEQ ID NO: 2192733 - protein, 17 aa, Cryptosporidium hominis
KTTPSLKLIDKLPGMVT

SEQ ID NO: 2192734 - protein, 21 aa, Cryptosporidium hominis
KTVRYLIRQIDYTRRIRWVGC

SEQ ID NO: 2192735 - protein, 23 aa, Cryptosporidium hominis
KTVSGTIYLWPPDSRIVVSDVDG

SEQ ID NO: 2192736 - protein, 19 aa, Cryptosporidium hominis
KTVWISNSLMYIILSKIEA

SEQ ID NO: 2192737 - protein, 28 aa, Cryptosporidium hominis
KVADKIQLIKNLLLKVDRMIIGGGMAFT

SEQ ID NO: 2192738 - protein, 24 aa, Cryptosporidium hominis
KVDDWIKFMPTTYSKGILYGNKYI

SEQ ID NO: 2192739 - protein, 25 aa, Cryptosporidium hominis
KVDIWAIGCIFFEILHLRRPFGLRS

SEQ ID NO: 2192740 - protein, 30 aa, Cryptosporidium hominis
KVEDLYKILLCFIYTDFLIWDPFSDSQNTD

SEQ ID NO: 2192741 - protein, 32 aa, Cryptosporidium hominis
KVEIYHNYEIIYKYRYQCLRCFQMFGRQTKIN

SEQ ID NO: 2192742 - protein, 25 aa, Cryptosporidium hominis
KVFDFRPGILIKQLNLKSPIFKKTS

SEQ ID NO: 2192743 - protein, 19 aa, Cryptosporidium hominis
KVFPKVWIFSSNDVDSLCT

SEQ ID NO: 2192744 - protein, 26 aa, Cryptosporidium hominis
KVFSSKLIFHWLTHHILTNFLYNPNG

SEQ ID NO: 2192745 - protein, 17 aa, Cryptosporidium hominis
KVFVVAATNRPDIIDPA

SEQ ID NO: 2192746 - protein, 21 aa, Cryptosporidium hominis
KVICDLNAFYKLKLHEKENKT

SEQ ID NO: 2192747 - protein, 45 aa, Cryptosporidium hominis
KVIKKEFSVWGPVDYIRVIPSKNIAFVRYFLRSSAEFAKAAMENQ

SEQ ID NO: 2192748 - protein, 24 aa, Cryptosporidium hominis
KVIRPEQWHPWKSFGKLMDEAILE

SEQ ID NO: 2192749 - protein, 17 aa, Cryptosporidium hominis
KVIYLDVLIPLFETENT

SEQ ID NO: 2192750 - protein, 25 aa, Cryptosporidium hominis
KVKFKALRLIKHLCENGNPTFKMLV

SEQ ID NO: 2192751 - protein, 17 aa, Cryptosporidium hominis
KVKKDMIVITLKKANNS

SEQ ID NO: 2192752 - protein, 25 aa, Cryptosporidium hominis
KVKWPNFIEYLLDKILTVFQIVVLE

SEQ ID NO: 2192753 - protein, 25 aa, Cryptosporidium hominis
KVLEKIKIILKVDSNLNEIFICGDK

SEQ ID NO: 2192754 - protein, 26 aa, Cryptosporidium hominis
KVLGEELFFKIQLSKILVVGAGGIGC

SEQ ID NO: 2192755 - protein, 26 aa, Cryptosporidium hominis
KVLHRIELIMNTLESILCRCEKVEAK

SEQ ID NO: 2192756 - protein, 19 aa, Cryptosporidium hominis
KVLLAQAYILEGKVLYLNK

SEQ ID NO: 2192757 - protein, 17 aa, Cryptosporidium hominis
KVLLPDLPVPLSYNKSS

SEQ ID NO: 2192758 - protein, 17 aa, Cryptosporidium hominis
KVMHLCRQKELNISQLY

SEQ ID NO: 2192759 - protein, 20 aa, Cryptosporidium hominis
KVNEFFLHSKELRNPLSFFF

SEQ ID NO: 2192760 - protein, 26 aa, Cryptosporidium hominis
KVNVSILWIYIDKASPESFIFAQYLK

SEQ ID NO: 2192761 - protein, 24 aa, Cryptosporidium hominis
KVQECDTIILETQKIIRPTVRNKA

SEQ ID NO: 2192762 - protein, 19 aa, Cryptosporidium hominis
KVQFVPGVLMFITSGKDNA

SEQ ID NO: 2192763 - protein, 28 aa, Cryptosporidium hominis
KVQHLSHEKLLLQRGIEFLKKKLYTLKN

SEQ ID NO: 2192764 - protein, 26 aa, Cryptosporidium hominis
KVQKFLTQPFFMSEAFTGKPGVFVNL

SEQ ID NO: 2192765 - protein, 30 aa, Cryptosporidium hominis
KVQSDSYLGIPIWRFYGRCTQCGNEIVFRT

SEQ ID NO: 2192766 - protein, 27 aa, Cryptosporidium hominis
KVRANLLRIISIKSEAYYRLLNKADNV

SEQ ID NO: 2192767 - protein, 21 aa, Cryptosporidium hominis
KVSASMFVGDLATGLKGMTNN

SEQ ID NO: 2192768 - protein, 20 aa, Cryptosporidium hominis
KVSFNFQIPDLRKFRKGLPE

SEQ ID NO: 2192769 - protein, 22 aa, Cryptosporidium hominis
KVSLKLFIHLLLFTIKYSSIFI

SEQ ID NO: 2192770 - protein, 24 aa, Cryptosporidium hominis
KVSTKRKNIPGYNRGRGMGPGGGF

SEQ ID NO: 2192771 - protein, 17 aa, Cryptosporidium hominis
KVVLQRLVLIREFIDIC

SEQ ID NO: 2192772 - protein, 23 aa, Cryptosporidium hominis
KVVSSFSFFPPKLSGLVLRDRDG

SEQ ID NO: 2192773 - protein, 17 aa, Cryptosporidium hominis
KVYEQIPRYLRVNTTIE

SEQ ID NO: 2192774 - protein, 31 aa, Cryptosporidium hominis
KVYESLTMSKLLHFLGFKKTRISNDVDFLVH

SEQ ID NO: 2192775 - protein, 18 aa, Cryptosporidium hominis
KWCSKVSSIKFLSQNLIE

SEQ ID NO: 2192776 - protein, 21 aa, Cryptosporidium hominis
KWDVMVDVFFWRDPEEYENSA

SEQ ID NO: 2192777 - protein, 19 aa, Cryptosporidium hominis
KWNHSRFHWADLTSVHPLL

SEQ ID NO: 2192778 - protein, 19 aa, Cryptosporidium hominis
KWPPSLPNYTQKNLLRTFF

SEQ ID NO: 2192779 - protein, 18 aa, Cryptosporidium hominis
KWSVGWRRMNKKLTNQGA

SEQ ID NO: 2192780 - protein, 19 aa, Cryptosporidium hominis
KWTPNILMTGGVDNKVVVW

SEQ ID NO: 2192781 - protein, 18 aa, Cryptosporidium hominis
KWVIYPMYDFAHGQSDSI

SEQ ID NO: 2192782 - protein, 18 aa, Cryptosporidium hominis
KWVPNKPELVLKCDKASY

SEQ ID NO: 2192783 - protein, 30 aa, Cryptosporidium hominis
KYADIPERLYLLYGSRWKSLKERKISKQEL

SEQ ID NO: 2192784 - protein, 26 aa, Cryptosporidium hominis
KYCTSISATWRMYKAKKEYKQIRKAS

SEQ ID NO: 2192785 - protein, 18 aa, Cryptosporidium hominis
KYDDFGRLSKRAFKFQRK

SEQ ID NO: 2192786 - protein, 30 aa, Cryptosporidium hominis
KYDIEKIIFLITPLHLLINYFKNIGNYCIR

SEQ ID NO: 2192787 - protein, 17 aa, Cryptosporidium hominis
KYEFISRYKAKSDLPMI

SEQ ID NO: 2192788 - protein, 18 aa, Cryptosporidium hominis
KYFDIVENILICKRRLKK

SEQ ID NO: 2192789 - protein, 19 aa, Cryptosporidium hominis
KYGIIFESRPIIVALLVDG

SEQ ID NO: 2192790 - protein, 20 aa, Cryptosporidium hominis
KYGLTLLSQDLLNFLISDIN

SEQ ID NO: 2192791 - protein, 25 aa, Cryptosporidium hominis
KYGQCRRSYLLGYFGEKFNREKSSS

SEQ ID NO: 2192792 - protein, 17 aa, Cryptosporidium hominis
KYGSVPHSGFGLGFERL

SEQ ID NO: 2192793 - protein, 31 aa, Cryptosporidium hominis
KYIDVDLFKKFRKAVYISSEWLKVFKINHFN

SEQ ID NO: 2192794 - protein, 43 aa, Cryptosporidium hominis
KYINPLQCDITSNGFMLIMVLLYQMGWIDTAILCQMYYVPKTL

SEQ ID NO: 2192795 - protein, 25 aa, Cryptosporidium hominis
KYIRESIELFWKNLKFHTSNYILKY

SEQ ID NO: 2192796 - protein, 23 aa, Cryptosporidium hominis
KYKDSICWATIKAVKEVYEPQVK

SEQ ID NO: 2192797 - protein, 17 aa, Cryptosporidium hominis
KYKLRGMDWYKYLNVSN

SEQ ID NO: 2192798 - protein, 23 aa, Cryptosporidium hominis
KYKNHYIFVSIDRLDQLSGLQLK

SEQ ID NO: 2192799 - protein, 27 aa, Cryptosporidium hominis
KYLEKLSYLKIWVPSAHRPPKHQTAII

SEQ ID NO: 2192800 - protein, 28 aa, Cryptosporidium hominis
KYLPKLNCLFNFALNLGRKPDLMYSHSL

SEQ ID NO: 2192801 - protein, 21 aa, Cryptosporidium hominis
KYLSLAFKKYSDHLPCAVWLP

SEQ ID NO: 2192802 - protein, 23 aa, Cryptosporidium hominis
KYLVKYIILHFIEKVSLGSDDQF

SEQ ID NO: 2192803 - protein, 31 aa, Cryptosporidium hominis
KYMDENHIWKIFFDIIFGLQHLHHRGILHRD

SEQ ID NO: 2192804 - protein, 18 aa, Cryptosporidium hominis
KYNLWIVGNSRYLLGNPE

SEQ ID NO: 2192805 - protein, 30 aa, Cryptosporidium hominis
KYNNNHIINNYFNYLWQVGDEFSEIHCFPL

SEQ ID NO: 2192806 - protein, 26 aa, Cryptosporidium hominis
KYPDYNFMGLIIGPRGYNHRRLEAES

SEQ ID NO: 2192807 - protein, 17 aa, Cryptosporidium hominis
KYRETFPDLAPLMWHSF

SEQ ID NO: 2192808 - protein, 18 aa, Cryptosporidium hominis
KYRIILLDEPTIEAQIEL

SEQ ID NO: 2192809 - protein, 17 aa, Cryptosporidium hominis
KYRLFESCQLILYDVLK

SEQ ID NO: 2192810 - protein, 32 aa, Cryptosporidium hominis
KYRMKYAILTFPCNVPKWIAQQVWFKCSFLSN

SEQ ID NO: 2192811 - protein, 23 aa, Cryptosporidium hominis
KYRPLEVVNFNPPIDAIRHGFGE

SEQ ID NO: 2192812 - protein, 34 aa, Cryptosporidium hominis
KYSMNKWFMKLHEKPFWEVFPLSQIVVLSPDSSE

SEQ ID NO: 2192813 - protein, 24 aa, Cryptosporidium hominis
KYSNIIRLKYLNILLSSNMSKRQL

SEQ ID NO: 2192814 - protein, 25 aa, Cryptosporidium hominis
KYSSPELYLPLSNTPLTFIKEPGDL

SEQ ID NO: 2192815 - protein, 22 aa, Cryptosporidium hominis
KYTQINSLLIPNGGYESTSDPT

SEQ ID NO: 2192816 - protein, 22 aa, Cryptosporidium hominis
KYVKFCISFCIYGQGIIDWNNP

SEQ ID NO: 2192817 - protein, 21 aa, Cryptosporidium hominis
KYVLDCEFRLKKTLLHECCHV

SEQ ID NO: 2192818 - protein, 23 aa, Cryptosporidium hominis
KYVPCDVHLFLIGIRLRNQNDTN

SEQ ID NO: 2192819 - protein, 25 aa, Cryptosporidium hominis
KYVSPITPILGDYLYRAVASEKQKL

SEQ ID NO: 2192820 - protein, 30 aa, Cryptosporidium hominis
KYWLKYSIEIIRQIRWILGNSSIHSNTPLP

SEQ ID NO: 2192821 - protein, 20 aa, Cryptosporidium hominis
KYYINVLKNLDSLTNIIFCI

SEQ ID NO: 2192822 - protein, 31 aa, Cryptosporidium hominis
LAAFDFEKELDLLYGILSTCFEFVSEGEDFT

SEQ ID NO: 2192823 - protein, 24 aa, Cryptosporidium hominis
LAANAFPMIKGISSLAPKKPKPTN

SEQ ID NO: 2192824 - protein, 28 aa, Cryptosporidium hominis
LACGVEEYLFILVLKLPSICFAEDSEAS

SEQ ID NO: 2192825 - protein, 27 aa, Cryptosporidium hominis
LACYNSIVFGVLRPNAKWRPGRGNSSK

SEQ ID NO: 2192826 - protein, 17 aa, Cryptosporidium hominis
LADVNRPIEVRFASKNH

SEQ ID NO: 2192827 - protein, 24 aa, Cryptosporidium hominis
LAEEWRLRYLYSNPNGPNGQQNGA

SEQ ID NO: 2192828 - protein, 18 aa, Cryptosporidium hominis
LAELQCVLCFIFHVERIS

SEQ ID NO: 2192829 - protein, 19 aa, Cryptosporidium hominis
LAEMDFGPSPPLGFEPKRL

SEQ ID NO: 2192830 - protein, 17 aa, Cryptosporidium hominis
LAEMWKNLPELERSPWE

SEQ ID NO: 2192831 - protein, 22 aa, Cryptosporidium hominis
LAGGRMQIKPFLDAMKVKKKNK

SEQ ID NO: 2192832 - protein, 20 aa, Cryptosporidium hominis
LAHVEYFVEPPIGICLHSLL

SEQ ID NO: 2192833 - protein, 26 aa, Cryptosporidium hominis
LAIPNDWWMCYVHGDDLEKILCHNSG

SEQ ID NO: 2192834 - protein, 22 aa, Cryptosporidium hominis
LAIQGTFYYVHRHDRLCASKFK

SEQ ID NO: 2192835 - protein, 31 aa, Cryptosporidium hominis
LAISPRQFSTGSVGWYYGGKVPLPVGDDLEV

SEQ ID NO: 2192836 - protein, 25 aa, Cryptosporidium hominis
LAKDFLHNYIFLTVGRVGATSGSIV

SEQ ID NO: 2192837 - protein, 17 aa, Cryptosporidium hominis
LAKLRKETSLLYKNEYV

SEQ ID NO: 2192838 - protein, 22 aa, Cryptosporidium hominis
LAKVCYLLKNKGNLNVLIVACD

SEQ ID NO: 2192839 - protein, 17 aa, Cryptosporidium hominis
LAMIEYPSLLLSEDEIK

SEQ ID NO: 2192840 - protein, 21 aa, Cryptosporidium hominis
LAMSFPMLSKENFELIKQAQQ

SEQ ID NO: 2192841 - protein, 19 aa, Cryptosporidium hominis
LAMSIYLKHPLLISDVKLA

SEQ ID NO: 2192842 - protein, 27 aa, Cryptosporidium hominis
LANDPTIERILTPKLALTTAEYLAYEK

SEQ ID NO: 2192843 - protein, 21 aa, Cryptosporidium hominis
LANIITLVRNQISTPTQVCST

SEQ ID NO: 2192844 - protein, 23 aa, Cryptosporidium hominis
LANMPYYNVPLYFNNQPSNQYHP

SEQ ID NO: 2192845 - protein, 33 aa, Cryptosporidium hominis
LANQEILSWKYRLQRHSILLNDTRRKLFNELQD

SEQ ID NO: 2192846 - protein, 25 aa, Cryptosporidium hominis
LAPLKVGMILRSYSNFVTLSRFQLF

SEQ ID NO: 2192847 - protein, 20 aa, Cryptosporidium hominis
LAQILAPYLVKYLKSSTISK

SEQ ID NO: 2192848 - protein, 17 aa, Cryptosporidium hominis
LAQTYPGLISFGNQILK

SEQ ID NO: 2192849 - protein, 21 aa, Cryptosporidium hominis
LARIDLLLVPVYIPCDHQIND

SEQ ID NO: 2192850 - protein, 18 aa, Cryptosporidium hominis
LARLDTRWDKVGNNEILR

SEQ ID NO: 2192851 - protein, 17 aa, Cryptosporidium hominis
LARLEYWQYINSYLHEI

SEQ ID NO: 2192852 - protein, 34 aa, Cryptosporidium hominis
LARMKKLYVCLGRHSIYLLKRNLRKVITGGKLKY

SEQ ID NO: 2192853 - protein, 19 aa, Cryptosporidium hominis
LASIHYRWSRGPSRAVCTF

SEQ ID NO: 2192854 - protein, 30 aa, Cryptosporidium hominis
LASLNGFIISQLIFNPLRLKMIKEKYQEDL

SEQ ID NO: 2192855 - protein, 28 aa, Cryptosporidium hominis
LASTRDLLLDFLFLPASICNVPPTGVES

SEQ ID NO: 2192856 - protein, 17 aa, Cryptosporidium hominis
LASVPRFANLNTPANAV

SEQ ID NO: 2192857 - protein, 20 aa, Cryptosporidium hominis
LATEFGAIRAVRIIERPKDG

SEQ ID NO: 2192858 - protein, 25 aa, Cryptosporidium hominis
LATQKIIEMLYKMPIKSLYSDCLML

SEQ ID NO: 2192859 - protein, 21 aa, Cryptosporidium hominis
LATRQSHLGQFLRALQKIADT

SEQ ID NO: 2192860 - protein, 23 aa, Cryptosporidium hominis
LAVMYSRLYDYFTDEDFEIIFGY

SEQ ID NO: 2192861 - protein, 23 aa, Cryptosporidium hominis
LAYAIPICHNLLNISNRSANKVY

SEQ ID NO: 2192862 - protein, 18 aa, Cryptosporidium hominis
LCDRCDRGYHTYCLDPPL

SEQ ID NO: 2192863 - protein, 27 aa, Cryptosporidium hominis
LCEDHFCEFQLKLKLKSAFNGKEFEHE

SEQ ID NO: 2192864 - protein, 20 aa, Cryptosporidium hominis
LCEICRVCGFVIVFAVESEY

SEQ ID NO: 2192865 - protein, 30 aa, Cryptosporidium hominis
LCEIYISIPCGYILDYFYLGVSAGDLLQES

SEQ ID NO: 2192866 - protein, 24 aa, Cryptosporidium hominis
LCEKKFLDLDFPYIHKRAVLVKQG

SEQ ID NO: 2192867 - protein, 19 aa, Cryptosporidium hominis
LCEYPIGGDFLDDQIARHL

SEQ ID NO: 2192868 - protein, 17 aa, Cryptosporidium hominis
LCGYALHELGNIRSSLF

SEQ ID NO: 2192869 - protein, 28 aa, Cryptosporidium hominis
LCIEKVKFILYRNLMRRIRNWCRKNLKG

SEQ ID NO: 2192870 - protein, 18 aa, Cryptosporidium hominis
LCKGGDLYQYVLANGAME

SEQ ID NO: 2192871 - protein, 18 aa, Cryptosporidium hominis
LCKITENCTYWSFQGISG

SEQ ID NO: 2192872 - protein, 30 aa, Cryptosporidium hominis
LCKMVEFSLLWMALVINKFPNFIKVSLGDD

SEQ ID NO: 2192873 - protein, 18 aa, Cryptosporidium hominis
LCLAYLFDHFNLKDEAEY

SEQ ID NO: 2192874 - protein, 24 aa, Cryptosporidium hominis
LCLCENNNLYYWFLNNECGFDSNL

SEQ ID NO: 2192875 - protein, 25 aa, Cryptosporidium hominis
LCQILCNYAARRGYTPLFIDLDPRG

SEQ ID NO: 2192876 - protein, 25 aa, Cryptosporidium hominis
LCRERGIPLIMVPDSKELGEMAGLC

SEQ ID NO: 2192877 - protein, 20 aa, Cryptosporidium hominis
LCVRLKDNVVGGGALVLDDC

SEQ ID NO: 2192878 - protein, 19 aa, Cryptosporidium hominis
LCYDPIKRILYSISWDQIL

SEQ ID NO: 2192879 - protein, 20 aa, Cryptosporidium hominis
LDALPTMRSMYPGKLEISTG

SEQ ID NO: 2192880 - protein, 21 aa, Cryptosporidium hominis
LDAMVYYFKEKSGIPANKVCG

SEQ ID NO: 2192881 - protein, 17 aa, Cryptosporidium hominis
LDAMYEQVYDFKTKYIL

SEQ ID NO: 2192882 - protein, 25 aa, Cryptosporidium hominis
LDATTLTIMRRLPREVDPMVYNMLH

SEQ ID NO: 2192883 - protein, 20 aa, Cryptosporidium hominis
LDCDLLMESWDRIFRDVVFP

SEQ ID NO: 2192884 - protein, 23 aa, Cryptosporidium hominis
LDDDLLHPSIASSSPLGKVFQST

SEQ ID NO: 2192885 - protein, 24 aa, Cryptosporidium hominis
LDDDNVFWMKIEDEYFGKIDDRMK

SEQ ID NO: 2192886 - protein, 24 aa, Cryptosporidium hominis
LDDEFIHLLFQFSEIIILDNSSSK

SEQ ID NO: 2192887 - protein, 26 aa, Cryptosporidium hominis
LDDERLLLYPDLLKDISDFLSTQYLN

SEQ ID NO: 2192888 - protein, 25 aa, Cryptosporidium hominis
LDDESLSSALPWFTSRRKSQKLVKK

SEQ ID NO: 2192889 - protein, 22 aa, Cryptosporidium hominis
LDDGLFYSFRISMGIFDSLISK

SEQ ID NO: 2192890 - protein, 25 aa, Cryptosporidium hominis
LDEKIISKWRFYRLESKSLQGIKDN

SEQ ID NO: 2192891 - protein, 26 aa, Cryptosporidium hominis
LDELSDLLLTDFPSRNWHLAKSDILK

SEQ ID NO: 2192892 - protein, 26 aa, Cryptosporidium hominis
LDEPQKLSLILKYGPILINKIQKQTT

SEQ ID NO: 2192893 - protein, 19 aa, Cryptosporidium hominis
LDERLLRIEQLEMNYQNVN

SEQ ID NO: 2192894 - protein, 26 aa, Cryptosporidium hominis
LDETDLQTLCNVLLIADSYNLSALSD

SEQ ID NO: 2192895 - protein, 19 aa, Cryptosporidium hominis
LDEVLQIRTIFANVSKGQV

SEQ ID NO: 2192896 - protein, 17 aa, Cryptosporidium hominis
LDFKQWLIIESVRNCRI

SEQ ID NO: 2192897 - protein, 21 aa, Cryptosporidium hominis
LDFNKVYEIYFKSLDQAFEHI

SEQ ID NO: 2192898 - protein, 40 aa, Cryptosporidium hominis
LDFRNRLYMLKPLKFDLPNKWRFFYLNITNYEIVNQNQNK

SEQ ID NO: 2192899 - protein, 17 aa, Cryptosporidium hominis
LDGFPRTIPQAEGLAKI

SEQ ID NO: 2192900 - protein, 29 aa, Cryptosporidium hominis
LDGLIEKIWQYLDLIRIYTKPKGQIPDYA

SEQ ID NO: 2192901 - protein, 33 aa, Cryptosporidium hominis
LDHDSLKYWCKLFKVNLLFPPCKSDNIRRVGNN

SEQ ID NO: 2192902 - protein, 17 aa, Cryptosporidium hominis
LDHHWNSGVLISSGVGG

SEQ ID NO: 2192903 - protein, 29 aa, Cryptosporidium hominis
LDHIYGSDHCPILLILKTGEFESLYNNEK

SEQ ID NO: 2192904 - protein, 22 aa, Cryptosporidium hominis
LDIIDDYLRWSGYPYCRIDGST

SEQ ID NO: 2192905 - protein, 24 aa, Cryptosporidium hominis
LDIIRFPFRNIASSSIKSLKPAFL

SEQ ID NO: 2192906 - protein, 20 aa, Cryptosporidium hominis
LDKRIKLWDYLYGTEIDSIN

SEQ ID NO: 2192907 - protein, 21 aa, Cryptosporidium hominis
LDKRYSMEGNLLTFSGQRQQV

SEQ ID NO: 2192908 - protein, 28 aa, Cryptosporidium hominis
LDKSYMLQRRWKVVIWDLSIENLCDEEA

SEQ ID NO: 2192909 - protein, 24 aa, Cryptosporidium hominis
LDLDNKIIMVPITSLNGLSSISVP

SEQ ID NO: 2192910 - protein, 20 aa, Cryptosporidium hominis
LDLDPKFTKAWSRKGNIHYF

SEQ ID NO: 2192911 - protein, 17 aa, Cryptosporidium hominis
LDLGFIPVKSIKGEDDE

SEQ ID NO: 2192912 - protein, 18 aa, Cryptosporidium hominis
LDLGWDMSSDMWGFGCIL

SEQ ID NO: 2192913 - protein, 17 aa, Cryptosporidium hominis
LDLLISNLDMMKNPNQF

SEQ ID NO: 2192914 - protein, 17 aa, Cryptosporidium hominis
LDLYKDNKLLINRKYKL

SEQ ID NO: 2192915 - protein, 18 aa, Cryptosporidium hominis
LDMSLPIERTNQTSTTSV

SEQ ID NO: 2192916 - protein, 20 aa, Cryptosporidium hominis
LDNCLIIYLPNNAISEVFSD

SEQ ID NO: 2192917 - protein, 24 aa, Cryptosporidium hominis
LDNDLDLDLYLKKPKILNKKEELG

SEQ ID NO: 2192918 - protein, 26 aa, Cryptosporidium hominis
LDNIHHYIIISFIDRSLVLTIGEHVE

SEQ ID NO: 2192919 - protein, 27 aa, Cryptosporidium hominis
LDNIQKKFSLLMVLGRPSRELDTGIYR

SEQ ID NO: 2192920 - protein, 23 aa, Cryptosporidium hominis
LDNKIHLWDLRKSAILDSLELST

SEQ ID NO: 2192921 - protein, 23 aa, Cryptosporidium hominis
LDNYYLSTWSIKPIKYLNTKIIL

SEQ ID NO: 2192922 - protein, 17 aa, Cryptosporidium hominis
LDPIVAQSLLRKMMIDS

SEQ ID NO: 2192923 - protein, 20 aa, Cryptosporidium hominis
LDPLKRLTALQLQDLKWLNF

SEQ ID NO: 2192924 - protein, 27 aa, Cryptosporidium hominis
LDPTEFDFFYFRISQILKLKGFDLTET

SEQ ID NO: 2192925 - protein, 26 aa, Cryptosporidium hominis
LDPVKTLRILAIRLWDKRIMLKGDLG

SEQ ID NO: 2192926 - protein, 28 aa, Cryptosporidium hominis
LDQNIDMNDILWGGGKLKSSLKDDIQRL

SEQ ID NO: 2192927 - protein, 29 aa, Cryptosporidium hominis
LDQSNFCNDIWLMDLKYIESLANGNLNSN

SEQ ID NO: 2192928 - protein, 18 aa, Cryptosporidium hominis
LDRNGFLWVLIKTNIEND

SEQ ID NO: 2192929 - protein, 28 aa, Cryptosporidium hominis
LDSDFVTRKAILLRFSWLAPCHLVQIEC

SEQ ID NO: 2192930 - protein, 28 aa, Cryptosporidium hominis
LDSEFSCKTLLNNGLYLGGTEISIEKWK

SEQ ID NO: 2192931 - protein, 32 aa, Cryptosporidium hominis
LDSGRMKVLLFRFPDYFGSESLRFFDSEDLLP

SEQ ID NO: 2192932 - protein, 32 aa, Cryptosporidium hominis
LDSRIYHNLIINFNILLKHSVHFIISVANSFP

SEQ ID NO: 2192933 - protein, 25 aa, Cryptosporidium hominis
LDSRLARRHVLIKELPPISANDDEL

SEQ ID NO: 2192934 - protein, 24 aa, Cryptosporidium hominis
LDSRYFPSKFGGKPAWLNPQNLPQ

SEQ ID NO: 2192935 - protein, 26 aa, Cryptosporidium hominis
LDSSLKFIPNIRIQLGKYFPLSKDSL

SEQ ID NO: 2192936 - protein, 32 aa, Cryptosporidium hominis
LDSSSFGITPWMPFWFRFTPINAKTVSNPLLY

SEQ ID NO: 2192937 - protein, 28 aa, Cryptosporidium hominis
LDSTVLLYLLLEWLFSNLEHLGSNIFKR

SEQ ID NO: 2192938 - protein, 21 aa, Cryptosporidium hominis
LDSVLLYMHSLGIPDIVDFPF

SEQ ID NO: 2192939 - protein, 24 aa, Cryptosporidium hominis
LDTFKNFVVCWLDRLIEAQDKDVE

SEQ ID NO: 2192940 - protein, 24 aa, Cryptosporidium hominis
LDTRSFSIKWWPLNEKFYKHEKLG

SEQ ID NO: 2192941 - protein, 23 aa, Cryptosporidium hominis
LDTSALLPFSFGKQQWGDYGGYH

SEQ ID NO: 2192942 - protein, 25 aa, Cryptosporidium hominis
LDTSKRMFLLNLFILEESKYMRTLV

SEQ ID NO: 2192943 - protein, 21 aa, Cryptosporidium hominis
LDTSLALDLLISNLDMMKNPN

SEQ ID NO: 2192944 - protein, 20 aa, Cryptosporidium hominis
LDTVLFCRDKWLNEDGLIFP

SEQ ID NO: 2192945 - protein, 28 aa, Cryptosporidium hominis
LDVAQFDWVWFDWPHSKIPFSRSELRVI

SEQ ID NO: 2192946 - protein, 18 aa, Cryptosporidium hominis
LDVGFLRAAATCMDIPLD

SEQ ID NO: 2192947 - protein, 17 aa, Cryptosporidium hominis
LDVLVISSSLEKAFLMD

SEQ ID NO: 2192948 - protein, 45 aa, Cryptosporidium hominis
LDVPYISLHKMHLIQPPLNDFLLGKIVFLDSIYYKLKLSIESFQQ

SEQ ID NO: 2192949 - protein, 23 aa, Cryptosporidium hominis
LDVTPSLILKPNSPIILQAFGEN

SEQ ID NO: 2192950 - protein, 21 aa, Cryptosporidium hominis
LEAAPPKITLPELHILNKRIE

SEQ ID NO: 2192951 - protein, 20 aa, Cryptosporidium hominis
LEAFFSSLFEFFLKHLLFCQ

SEQ ID NO: 2192952 - protein, 24 aa, Cryptosporidium hominis
LEAIGYVLMYFCRNGTLPWQGIRA

SEQ ID NO: 2192953 - protein, 20 aa, Cryptosporidium hominis
LEDIKYRYNSLKQDLFSLES

SEQ ID NO: 2192954 - protein, 19 aa, Cryptosporidium hominis
LEDLFNLCHRRFTMKTILM

SEQ ID NO: 2192955 - protein, 17 aa, Cryptosporidium hominis
LEDLSLFDPFPSTQGRS

SEQ ID NO: 2192956 - protein, 33 aa, Cryptosporidium hominis
LEDLWNKISLISEPFFPLSFSGNLNRYVTEDND

SEQ ID NO: 2192957 - protein, 22 aa, Cryptosporidium hominis
LEDMRIIQRNLVYVVGLSYSIA

SEQ ID NO: 2192958 - protein, 26 aa, Cryptosporidium hominis
LEDNSWILRYLVLRLEKEHLKIKNIL

SEQ ID NO: 2192959 - protein, 24 aa, Cryptosporidium hominis
LEDPGFIYILKDRLVLQNHLGSVC

SEQ ID NO: 2192960 - protein, 24 aa, Cryptosporidium hominis
LEDSSLILLLQENYIPFIGNCADI

SEQ ID NO: 2192961 - protein, 19 aa, Cryptosporidium hominis
LEEAMILHKLRHPNIVSLV

SEQ ID NO: 2192962 - protein, 25 aa, Cryptosporidium hominis
LEEEVTRLRYLVDSQTKRISALEMR

SEQ ID NO: 2192963 - protein, 27 aa, Cryptosporidium hominis
LEEHSHTILIFIFNLNKIKNSQKKKFL

SEQ ID NO: 2192964 - protein, 35 aa, Cryptosporidium hominis
LEEIFAKYGKIESIKMFNSYFRKGQAWITFSNAVS

SEQ ID NO: 2192965 - protein, 23 aa, Cryptosporidium hominis
LEEIHGFLDQLLSKLGLVAEYSL

SEQ ID NO: 2192966 - protein, 25 aa, Cryptosporidium hominis
LEEKPVMDYIYKLGMFRFSKILRNE

SEQ ID NO: 2192967 - protein, 17 aa, Cryptosporidium hominis
LEELIIGEPYSPTDSRW

SEQ ID NO: 2192968 - protein, 23 aa, Cryptosporidium hominis
LEELIMIEGRLKNSILDLNKLVF

SEQ ID NO: 2192969 - protein, 17 aa, Cryptosporidium hominis
LEELKIIRRENNSLIKS

SEQ ID NO: 2192970 - protein, 24 aa, Cryptosporidium hominis
LEERRICEKIPLFSTSPITNNVNN

SEQ ID NO: 2192971 - protein, 19 aa, Cryptosporidium hominis
LEESRAILWEISQPSPFNP

SEQ ID NO: 2192972 - protein, 18 aa, Cryptosporidium hominis
LEFLLSNNKKENFVACLY

SEQ ID NO: 2192973 - protein, 17 aa, Cryptosporidium hominis
LEGDLAPILVQLVIRDS

SEQ ID NO: 2192974 - protein, 23 aa, Cryptosporidium hominis
LEGEVQVSLPSNWLSRRASSLTS

SEQ ID NO: 2192975 - protein, 22 aa, Cryptosporidium hominis
LEGIGILKKMGRNAFMCSASVP

SEQ ID NO: 2192976 - protein, 17 aa, Cryptosporidium hominis
LEGKGLPFTIKLDDPSG

SEQ ID NO: 2192977 - protein, 20 aa, Cryptosporidium hominis
LEGLTKLKPCYLCYSSSTIS

SEQ ID NO: 2192978 - protein, 25 aa, Cryptosporidium hominis
LEHKLPVAEFAPPAPIKNGLPWCVS

SEQ ID NO: 2192979 - protein, 19 aa, Cryptosporidium hominis
LEHSVYFSSPLTKKVSMQY

SEQ ID NO: 2192980 - protein, 20 aa, Cryptosporidium hominis
LEICLYDIEILKYSPLSQAV

SEQ ID NO: 2192981 - protein, 19 aa, Cryptosporidium hominis
LEIITLILMNPRKEYYYYL

SEQ ID NO: 2192982 - protein, 17 aa, Cryptosporidium hominis
LEIKLMKESLERLILNK

SEQ ID NO: 2192983 - protein, 22 aa, Cryptosporidium hominis
LEKAFLMDIYSRTFVASDSSLF

SEQ ID NO: 2192984 - protein, 35 aa, Cryptosporidium hominis
LEKDDYNLLIYNSDKYWSSRLYDLYRRMKGESSQR

SEQ ID NO: 2192985 - protein, 24 aa, Cryptosporidium hominis
LEKHIQLPSIVSFRDLCMEAFGEE

SEQ ID NO: 2192986 - protein, 31 aa, Cryptosporidium hominis
LEKKELNTSIRLWWKRIFKGGIETDISKFNR

SEQ ID NO: 2192987 - protein, 25 aa, Cryptosporidium hominis
LEKKKFKWSFLHTEKFWLENVMNFE

SEQ ID NO: 2192988 - protein, 20 aa, Cryptosporidium hominis
LEKLFPRRNFTNDELDVIIL

SEQ ID NO: 2192989 - protein, 34 aa, Cryptosporidium hominis
LEKLMNYICEIVKLYWTPFYFKETENFVKSIRNV

SEQ ID NO: 2192990 - protein, 18 aa, Cryptosporidium hominis
LEKNLLNKRLFSNKIKIF

SEQ ID NO: 2192991 - protein, 25 aa, Cryptosporidium hominis
LEKNLRRIILSRVWIEMINNIERIW

SEQ ID NO: 2192992 - protein, 32 aa, Cryptosporidium hominis
LEKREDAFQALKILSNAFIKLSSRYDQLKEKS

SEQ ID NO: 2192993 - protein, 19 aa, Cryptosporidium hominis
LEKSELIGEINYLRKMLNE

SEQ ID NO: 2192994 - protein, 19 aa, Cryptosporidium hominis
LELEMAFIGPGSDFQFSII

SEQ ID NO: 2192995 - protein, 18 aa, Cryptosporidium hominis
LELILSFYGLDNQNIQGK

SEQ ID NO: 2192996 - protein, 17 aa, Cryptosporidium hominis
LELISSKASVLDGNYRY

SEQ ID NO: 2192997 - protein, 18 aa, Cryptosporidium hominis
LELKPSHFIPLLKSYIED

SEQ ID NO: 2192998 - protein, 32 aa, Cryptosporidium hominis
LELKVGSELILYKRSWDWLARTRLDEACRKKI

SEQ ID NO: 2192999 - protein, 20 aa, Cryptosporidium hominis
LELLESDAVIYKLVGSVMVK

SEQ ID NO: 2193000 - protein, 27 aa, Cryptosporidium hominis
LELNLKKIVTFGLPFVPFSIRAENDSG

SEQ ID NO: 2193001 - protein, 19 aa, Cryptosporidium hominis
LELPIAYISRLTDCHHLLA

SEQ ID NO: 2193002 - protein, 18 aa, Cryptosporidium hominis
LELPYMGELLKFGDSGLK

SEQ ID NO: 2193003 - protein, 27 aa, Cryptosporidium hominis
LELQQMRILQKFDEYLLTLSDSEKGLE

SEQ ID NO: 2193004 - protein, 18 aa, Cryptosporidium hominis
LEMYEKRKNYLLSKLNYE

SEQ ID NO: 2193005 - protein, 20 aa, Cryptosporidium hominis
LENCWRKDLLSHFLLKLCFI

SEQ ID NO: 2193006 - protein, 26 aa, Cryptosporidium hominis
LENELKVTSMGLLYGRKEKEQEREIA

SEQ ID NO: 2193007 - protein, 25 aa, Cryptosporidium hominis
LENIGKLHRKIIGSELFQSSQNTQL

SEQ ID NO: 2193008 - protein, 27 aa, Cryptosporidium hominis
LENIYKIFEYKMNIEIPKFNDSMDLGF

SEQ ID NO: 2193009 - protein, 21 aa, Cryptosporidium hominis
LENLENCYLVISPNISNMLSL

SEQ ID NO: 2193010 - protein, 29 aa, Cryptosporidium hominis
LENTFDFNGILLKASFLGKTDIIKSCLDN

SEQ ID NO: 2193011 - protein, 19 aa, Cryptosporidium hominis
LEPMMAITYLLNYILHRDD

SEQ ID NO: 2193012 - protein, 36 aa, Cryptosporidium hominis
LEPSETCIGLHFAYRWALVDLFDTSELFKLVGNRNK

SEQ ID NO: 2193013 - protein, 24 aa, Cryptosporidium hominis
LEQDRTLVYWAKKPSFRDEQPRGS

SEQ ID NO: 2193014 - protein, 19 aa, Cryptosporidium hominis
LEQFQHTHLYGRHLIIEVA

SEQ ID NO: 2193015 - protein, 24 aa, Cryptosporidium hominis
LEQLNISRTMLASMGSPSDSRHSY

SEQ ID NO: 2193016 - protein, 28 aa, Cryptosporidium hominis
LEQNKSIPPYFRPFDKPNNYINEINCSS

SEQ ID NO: 2193017 - protein, 19 aa, Cryptosporidium hominis
LERAVRLSKNWSCEVWFYV

SEQ ID NO: 2193018 - protein, 25 aa, Cryptosporidium hominis
LERCKSAFFCKLLHEFYQIDKHPDN

SEQ ID NO: 2193019 - protein, 25 aa, Cryptosporidium hominis
LERDPREEILKAFKLFDDDNTGKIS

SEQ ID NO: 2193020 - protein, 23 aa, Cryptosporidium hominis
LEREVYAYRLLRHPNICSYIGVC

SEQ ID NO: 2193021 - protein, 17 aa, Cryptosporidium hominis
LERFDDLEFYLGPSLDC

SEQ ID NO: 2193022 - protein, 29 aa, Cryptosporidium hominis
LERFSIGYFTLSLSCLKWLLLSDSDNNIS

SEQ ID NO: 2193023 - protein, 26 aa, Cryptosporidium hominis
LERLRTYPGPIPWNYGAFPQTWEDPN

SEQ ID NO: 2193024 - protein, 25 aa, Cryptosporidium hominis
LERQKWVPTLPYSLSSNCIKIKEIE

SEQ ID NO: 2193025 - protein, 25 aa, Cryptosporidium hominis
LERRGLIELIVHPLCIDDPAPWRGS

SEQ ID NO: 2193026 - protein, 21 aa, Cryptosporidium hominis
LERSLINAKTKYTKLLMQCNS

SEQ ID NO: 2193027 - protein, 18 aa, Cryptosporidium hominis
LERYTFKNNFTKTLGIFN

SEQ ID NO: 2193028 - protein, 22 aa, Cryptosporidium hominis
LESINFPVFGAIKLTMSSRGAI

SEQ ID NO: 2193029 - protein, 33 aa, Cryptosporidium hominis
LESINSEFFQLEKPYLIVPPQITIFHLQNYIMD

SEQ ID NO: 2193030 - protein, 23 aa, Cryptosporidium hominis
LESLIRELELRSQILSIQGPALL

SEQ ID NO: 2193031 - protein, 26 aa, Cryptosporidium hominis
LESMQSYLKLPNGKKFPIPIRFDKKG

SEQ ID NO: 2193032 - protein, 21 aa, Cryptosporidium hominis
LESRELLALCLKKIKGLNTVR

SEQ ID NO: 2193033 - protein, 27 aa, Cryptosporidium hominis
LESRRFIHIPFPPLNYKHDTKLLILAL

SEQ ID NO: 2193034 - protein, 20 aa, Cryptosporidium hominis
LETFKGLQVRPWPKAIQEQD

SEQ ID NO: 2193035 - protein, 21 aa, Cryptosporidium hominis
LETGFWNEMPSKMKIESPKSQ

SEQ ID NO: 2193036 - protein, 19 aa, Cryptosporidium hominis
LEVFFPYDNVYPEQLEYMK

SEQ ID NO: 2193037 - protein, 25 aa, Cryptosporidium hominis
LEVSDPFCYPTPIALSSASNHIEKN

SEQ ID NO: 2193038 - protein, 17 aa, Cryptosporidium hominis
LEVVKLLIQFLGISSNG

SEQ ID NO: 2193039 - protein, 17 aa, Cryptosporidium hominis
LEVYGKILNLRIVKDFQ

SEQ ID NO: 2193040 - protein, 17 aa, Cryptosporidium hominis
LEYLKEVGRCHFVMLDG

SEQ ID NO: 2193041 - protein, 21 aa, Cryptosporidium hominis
LEYQNLNNIPLFRNRFFENFE

SEQ ID NO: 2193042 - protein, 18 aa, Cryptosporidium hominis
LFDVYRRCLFVENIDNEN

SEQ ID NO: 2193043 - protein, 18 aa, Cryptosporidium hominis
LFEEAIKSLWNKCPKYFV

SEQ ID NO: 2193044 - protein, 17 aa, Cryptosporidium hominis
LFEHLRIPDIEDNLPTS

SEQ ID NO: 2193045 - protein, 28 aa, Cryptosporidium hominis
LFEHVYNPYYYKVLKGLTVLPAVISKKI

SEQ ID NO: 2193046 - protein, 17 aa, Cryptosporidium hominis
LFEIDIIDWRMLFSPIH

SEQ ID NO: 2193047 - protein, 26 aa, Cryptosporidium hominis
LFEIGFNVYPIGMPPLIHSNSQVYSK

SEQ ID NO: 2193048 - protein, 20 aa, Cryptosporidium hominis
LFEREQILNNFYLSIGEPVE

SEQ ID NO: 2193049 - protein, 23 aa, Cryptosporidium hominis
LFESFEDYNSIYLIMELCTGGEL

SEQ ID NO: 2193050 - protein, 19 aa, Cryptosporidium hominis
LFGKLLMELYEIESFIKTS

SEQ ID NO: 2193051 - protein, 17 aa, Cryptosporidium hominis
LFGKWSYDDVNVSDLSL

SEQ ID NO: 2193052 - protein, 24 aa, Cryptosporidium hominis
LFGNNLLHLLTPYSESRLSFQEKQ

SEQ ID NO: 2193053 - protein, 17 aa, Cryptosporidium hominis
LFIDILEKYMYYLEQGN

SEQ ID NO: 2193054 - protein, 21 aa, Cryptosporidium hominis
LFIECELWRLHPAEKYQVPIV

SEQ ID NO: 2193055 - protein, 26 aa, Cryptosporidium hominis
LFIEIENVLLFWLNLIFSSSDIDYKP

SEQ ID NO: 2193056 - protein, 20 aa, Cryptosporidium hominis
LFIHGSLYHLALMKRREFPE

SEQ ID NO: 2193057 - protein, 20 aa, Cryptosporidium hominis
LFKDSFFIKQSISSNCYTFI

SEQ ID NO: 2193058 - protein, 17 aa, Cryptosporidium hominis
LFKFPRVSPIINDEKNK

SEQ ID NO: 2193059 - protein, 20 aa, Cryptosporidium hominis
LFKILFERCFQEYLLLCCDP

SEQ ID NO: 2193060 - protein, 23 aa, Cryptosporidium hominis
LFKPCTEFLPRLHQNLGPDYDEK

SEQ ID NO: 2193061 - protein, 27 aa, Cryptosporidium hominis
LFKVNKKTLDLLLPNPNKNFGRDISNI

SEQ ID NO: 2193062 - protein, 18 aa, Cryptosporidium hominis
LFLECYLNHSFSGSQICL

SEQ ID NO: 2193063 - protein, 17 aa, Cryptosporidium hominis
LFLKFIYCVLRVKIEWI

SEQ ID NO: 2193064 - protein, 21 aa, Cryptosporidium hominis
LFLTYTQMVVNTWLLEHGFTV

SEQ ID NO: 2193065 - protein, 23 aa, Cryptosporidium hominis
LFNDNIRSTFGDRLYFSNYDDEL

SEQ ID NO: 2193066 - protein, 18 aa, Cryptosporidium hominis
LFNNLFMEIILLFKHHYT

SEQ ID NO: 2193067 - protein, 17 aa, Cryptosporidium hominis
LFPDCFAGIPSCTSDDW

SEQ ID NO: 2193068 - protein, 18 aa, Cryptosporidium hominis
LFPIVYDKQFYEGIASGI

SEQ ID NO: 2193069 - protein, 17 aa, Cryptosporidium hominis
LFPTFNDNDIRFYIYQI

SEQ ID NO: 2193070 - protein, 25 aa, Cryptosporidium hominis
LFQGHYISYVFKKEFNGWFKFDDDI

SEQ ID NO: 2193071 - protein, 21 aa, Cryptosporidium hominis
LFRHEVLYVLGQMGLKSPLTR

SEQ ID NO: 2193072 - protein, 19 aa, Cryptosporidium hominis
LFSCDLNANIFLWNNSQVE

SEQ ID NO: 2193073 - protein, 26 aa, Cryptosporidium hominis
LFSMRCREWYSWHFPELAKIITDTEK

SEQ ID NO: 2193074 - protein, 25 aa, Cryptosporidium hominis
LFSQGLIRVLITTATLAWGVNLPAR

SEQ ID NO: 2193075 - protein, 19 aa, Cryptosporidium hominis
LFVGEMLCLVRFAGDFSIY

SEQ ID NO: 2193076 - protein, 33 aa, Cryptosporidium hominis
LGACSERQLIPKKVWLIVRDLPSKSYALQQNDM

SEQ ID NO: 2193077 - protein, 23 aa, Cryptosporidium hominis
LGCCIYEILAGRPPFYARSYDEL

SEQ ID NO: 2193078 - protein, 20 aa, Cryptosporidium hominis
LGCDFCTYSYHPKCIETEVF

SEQ ID NO: 2193079 - protein, 23 aa, Cryptosporidium hominis
LGCKRLILVGDPKQLPATVLSRR

SEQ ID NO: 2193080 - protein, 24 aa, Cryptosporidium hominis
LGDLFKLLVHIIGKPIVEPQTMSR

SEQ ID NO: 2193081 - protein, 21 aa, Cryptosporidium hominis
LGEENKFYYNKELKSWVVRGE

SEQ ID NO: 2193082 - protein, 17 aa, Cryptosporidium hominis
LGEGSYFRAYRGRKLFS

SEQ ID NO: 2193083 - protein, 18 aa, Cryptosporidium hominis
LGFNDSHSWIRHLNSQSH

SEQ ID NO: 2193084 - protein, 19 aa, Cryptosporidium hominis
LGFSITYNKRRAWFSVRSR

SEQ ID NO: 2193085 - protein, 34 aa, Cryptosporidium hominis
LGGGADPPYSPYCLRCIMLCTISPSVTFFQQTYA

SEQ ID NO: 2193086 - protein, 25 aa, Cryptosporidium hominis
LGGIHTKYIWRLAYTTLNPSSRSRS

SEQ ID NO: 2193087 - protein, 27 aa, Cryptosporidium hominis
LGGLIKSFLPEFWPAYEPSSSLELFSI

SEQ ID NO: 2193088 - protein, 27 aa, Cryptosporidium hominis
LGGYTASFYGLRWIESLRTLRCEKLGK

SEQ ID NO: 2193089 - protein, 19 aa, Cryptosporidium hominis
LGHHYWYINPPNDEVIFKL

SEQ ID NO: 2193090 - protein, 20 aa, Cryptosporidium hominis
LGHLASYWQFFKINTLYEND

SEQ ID NO: 2193091 - protein, 33 aa, Cryptosporidium hominis
LGIHLKREWHRLWLVRSFLAFAWESYLEDLMIE

SEQ ID NO: 2193092 - protein, 20 aa, Cryptosporidium hominis
LGILTWYARMDPRVVHVVVL

SEQ ID NO: 2193093 - protein, 17 aa, Cryptosporidium hominis
LGINNIRFNEKTDVEIT

SEQ ID NO: 2193094 - protein, 27 aa, Cryptosporidium hominis
LGISPSSAKLFIWNITSMELIHQENIQ

SEQ ID NO: 2193095 - protein, 27 aa, Cryptosporidium hominis
LGKCEGFLDILLSPPRFTRGILNRHCY

SEQ ID NO: 2193096 - protein, 17 aa, Cryptosporidium hominis
LGKMGGIEYGVVRNFLL

SEQ ID NO: 2193097 - protein, 41 aa, Cryptosporidium hominis
LGKTMQTMSFVWHLVYKEKLRGPFLVVAPLSTLDHWKRTFE

SEQ ID NO: 2193098 - protein, 19 aa, Cryptosporidium hominis
LGKVFIRCNNVLYISRAEE

SEQ ID NO: 2193099 - protein, 18 aa, Cryptosporidium hominis
LGKYTGLGIHAFVGGLSL

SEQ ID NO: 2193100 - protein, 22 aa, Cryptosporidium hominis
LGLPNALWNTDIYLRERDRGVL

SEQ ID NO: 2193101 - protein, 24 aa, Cryptosporidium hominis
LGLSWNSLICERLILKREKDLKAD

SEQ ID NO: 2193102 - protein, 24 aa, Cryptosporidium hominis
LGNGFGVFSAIKYLLSKGVLQRKI

SEQ ID NO: 2193103 - protein, 26 aa, Cryptosporidium hominis
LGNNDLFSRFLFSGSGPNLESWLSLQ

SEQ ID NO: 2193104 - protein, 29 aa, Cryptosporidium hominis
LGPDGRPMPYWLYKLNGLGIEFKCEICGN

SEQ ID NO: 2193105 - protein, 22 aa, Cryptosporidium hominis
LGPTAFEWILGEIEHQFYRSLA

SEQ ID NO: 2193106 - protein, 17 aa, Cryptosporidium hominis
LGQGNLLVLMIATPSRS

SEQ ID NO: 2193107 - protein, 35 aa, Cryptosporidium hominis
LGQKQLSLDRRYFPNIFFYCTHLEIPLMQNNNVKD

SEQ ID NO: 2193108 - protein, 19 aa, Cryptosporidium hominis
LGRLKKLIPVCYISNILKT

SEQ ID NO: 2193109 - protein, 21 aa, Cryptosporidium hominis
LGRSAGLGLFSDRHFRKNDII

SEQ ID NO: 2193110 - protein, 28 aa, Cryptosporidium hominis
LGSFSSILGYIPYNILLASENIQNEKEL

SEQ ID NO: 2193111 - protein, 24 aa, Cryptosporidium hominis
LGSLEALLVFLKSSNIPVVALNIG

SEQ ID NO: 2193112 - protein, 18 aa, Cryptosporidium hominis
LGSPFNIASYAILTMMLA

SEQ ID NO: 2193113 - protein, 24 aa, Cryptosporidium hominis
LGTPILCTIIPFNSYCDPISVVKV

SEQ ID NO: 2193114 - protein, 22 aa, Cryptosporidium hominis
LGVLNPIPQFGVGLSPLNGLSG

SEQ ID NO: 2193115 - protein, 18 aa, Cryptosporidium hominis
LGVQVKIMLPYDPEGKTG

SEQ ID NO: 2193116 - protein, 23 aa, Cryptosporidium hominis
LGYQKKRLIPVDQDELFVNVNAS

SEQ ID NO: 2193117 - protein, 19 aa, Cryptosporidium hominis
LHECCHVAQFLLDSCIKPP

SEQ ID NO: 2193118 - protein, 18 aa, Cryptosporidium hominis
LHEGMLDSVIFARDKWLN

SEQ ID NO: 2193119 - protein, 24 aa, Cryptosporidium hominis
LHEISVLIELTLGHLRYLLTDVPP

SEQ ID NO: 2193120 - protein, 18 aa, Cryptosporidium hominis
LHELGNIRSSLFAYRTAL

SEQ ID NO: 2193121 - protein, 23 aa, Cryptosporidium hominis
LHFPCASILNFKFFNSIFELYEE

SEQ ID NO: 2193122 - protein, 24 aa, Cryptosporidium hominis
LHGKKIILTIPSRILYRINCLIVD

SEQ ID NO: 2193123 - protein, 27 aa, Cryptosporidium hominis
LHGNISPLTIYLNFEGSWKLGGFENAI

SEQ ID NO: 2193124 - protein, 28 aa, Cryptosporidium hominis
LHGSDYDIIWLQRDFSVYIVNMFDTGQA

SEQ ID NO: 2193125 - protein, 27 aa, Cryptosporidium hominis
LHGYNIKNGFKFMSWNDLSASEKINQD

SEQ ID NO: 2193126 - protein, 17 aa, Cryptosporidium hominis
LHHHMMVFDGFDKSVFA

SEQ ID NO: 2193127 - protein, 18 aa, Cryptosporidium hominis
LHIKPGVDINVISTPTGP

SEQ ID NO: 2193128 - protein, 19 aa, Cryptosporidium hominis
LHILQKNKIYGLYKFSTID

SEQ ID NO: 2193129 - protein, 30 aa, Cryptosporidium hominis
LHKWRIIRCIIRQIPLWIRYNQLCVRVCPF

SEQ ID NO: 2193130 - protein, 21 aa, Cryptosporidium hominis
LHNFDGILNGMVYLRDRIIDE

SEQ ID NO: 2193131 - protein, 26 aa, Cryptosporidium hominis
LHNGLLVLSKYPILNARFTCFSDVTL

SEQ ID NO: 2193132 - protein, 25 aa, Cryptosporidium hominis
LHNHPHLQQLHALQNLAPIQGMPHM

SEQ ID NO: 2193133 - protein, 20 aa, Cryptosporidium hominis
LHNLVIVITIRMALDYSLSV

SEQ ID NO: 2193134 - protein, 32 aa, Cryptosporidium hominis
LHNNLEELWSLLHFLNPLRFQNYQEFRLRYPD

SEQ ID NO: 2193135 - protein, 24 aa, Cryptosporidium hominis
LHNSLKLCTLIKSNYDFILSFTCI

SEQ ID NO: 2193136 - protein, 17 aa, Cryptosporidium hominis
LHPLIIQELLGIDDELR

SEQ ID NO: 2193137 - protein, 17 aa, Cryptosporidium hominis
LHQLYNGRIPAAPMSTR

SEQ ID NO: 2193138 - protein, 18 aa, Cryptosporidium hominis
LHQSLRNLELWFISDPEI

SEQ ID NO: 2193139 - protein, 20 aa, Cryptosporidium hominis
LHRLDAPWIHLLKVQVQRDK

SEQ ID NO: 2193140 - protein, 26 aa, Cryptosporidium hominis
LHRPVPLKHYLYIYEKCFQIMDENNK

SEQ ID NO: 2193141 - protein, 19 aa, Cryptosporidium hominis
LHSGGLLHRDMKPSNILLN

SEQ ID NO: 2193142 - protein, 20 aa, Cryptosporidium hominis
LHSHNTFPVTFPTPVNRSIS

SEQ ID NO: 2193143 - protein, 19 aa, Cryptosporidium hominis
LHSLPLTQTNKKYLVKYII

SEQ ID NO: 2193144 - protein, 36 aa, Cryptosporidium hominis
LIAMELFPCGKWPDLLPFLFRLISNLQNYTGATSAP

SEQ ID NO: 2193145 - protein, 19 aa, Cryptosporidium hominis
LICNGPYLNPPMISLLIRA

SEQ ID NO: 2193146 - protein, 17 aa, Cryptosporidium hominis
LICPCDCKGSMQFVHLQ

SEQ ID NO: 2193147 - protein, 18 aa, Cryptosporidium hominis
LICPICEGFFRGATTIRE

SEQ ID NO: 2193148 - protein, 22 aa, Cryptosporidium hominis
LICQYCIGMRLELARIDLLNNC

SEQ ID NO: 2193149 - protein, 26 aa, Cryptosporidium hominis
LICVIPRYSIIPKETLAFLKTIQLIN

SEQ ID NO: 2193150 - protein, 26 aa, Cryptosporidium hominis
LIDEMNSFIWILFGHDPCNKELEAIF

SEQ ID NO: 2193151 - protein, 27 aa, Cryptosporidium hominis
LIDEVLKMRDEWNYELPKIEHDHLIAH

SEQ ID NO: 2193152 - protein, 32 aa, Cryptosporidium hominis
LIDKYLKKNFIYMLLPMIIKKAFLAYNSLKEI

SEQ ID NO: 2193153 - protein, 19 aa, Cryptosporidium hominis
LIDNRVYHGIFHSISKKEG

SEQ ID NO: 2193154 - protein, 19 aa, Cryptosporidium hominis
LIDQPYVAIAYFGGLVAIH

SEQ ID NO: 2193155 - protein, 35 aa, Cryptosporidium hominis
LIDRGKVNLKLIKFLILDEADRMLDMGFAPQIREI

SEQ ID NO: 2193156 - protein, 19 aa, Cryptosporidium hominis
LIDSMPFDRFVCVFKTLDE

SEQ ID NO: 2193157 - protein, 19 aa, Cryptosporidium hominis
LIEGYSVPFPYDAYKCQIN

SEQ ID NO: 2193158 - protein, 26 aa, Cryptosporidium hominis
LIEHLRPTFWFSGHHHCFFDASIEFE

SEQ ID NO: 2193159 - protein, 19 aa, Cryptosporidium hominis
LIEKSFILHGLEYQLRVRK

SEQ ID NO: 2193160 - protein, 17 aa, Cryptosporidium hominis
LIERFQKQGIKFISSLG

SEQ ID NO: 2193161 - protein, 19 aa, Cryptosporidium hominis
LIEVRRAISWLFSESLSNA

SEQ ID NO: 2193162 - protein, 24 aa, Cryptosporidium hominis
LIEWKAMIKEFYSNDPDYILSLPG

SEQ ID NO: 2193163 - protein, 22 aa, Cryptosporidium hominis
LIFTSFRFYVYILIELKKIKNS

SEQ ID NO: 2193164 - protein, 19 aa, Cryptosporidium hominis
LIGEKVFFSSALQNSLSSK

SEQ ID NO: 2193165 - protein, 20 aa, Cryptosporidium hominis
LIGIFDDFSIKLICNFGYRP

SEQ ID NO: 2193166 - protein, 25 aa, Cryptosporidium hominis
LIGTPLMPPNAYYSKIYTLPMFSIS

SEQ ID NO: 2193167 - protein, 28 aa, Cryptosporidium hominis
LIGVVVNSGVWPFGRIGLLNQSQDSSNS

SEQ ID NO: 2193168 - protein, 29 aa, Cryptosporidium hominis
LIIDEHLLNIWISLLRKCIDTFIKFIPNT

SEQ ID NO: 2193169 - protein, 18 aa, Cryptosporidium hominis
LIIDIFPYELCINELFIN

SEQ ID NO: 2193170 - protein, 18 aa, Cryptosporidium hominis
LIIDSNTGALVPLNEKKK

SEQ ID NO: 2193171 - protein, 17 aa, Cryptosporidium hominis
LIIFGPNGAGKTTILRC

SEQ ID NO: 2193172 - protein, 17 aa, Cryptosporidium hominis
LIILSKGLGIFNIVYKY

SEQ ID NO: 2193173 - protein, 18 aa, Cryptosporidium hominis
LIINSKNWFKECLDQREA

SEQ ID NO: 2193174 - protein, 25 aa, Cryptosporidium hominis
LIKILKKFCVLVSGNWVYKSELMYN

SEQ ID NO: 2193175 - protein, 19 aa, Cryptosporidium hominis
LIKKGLIIEPLRELYKDEV

SEQ ID NO: 2193176 - protein, 22 aa, Cryptosporidium hominis
LIKSIVILLTNQLVQKGILHSQ

SEQ ID NO: 2193177 - protein, 25 aa, Cryptosporidium hominis
LILDELENYCLWRGWQYMRLDGSTN

SEQ ID NO: 2193178 - protein, 24 aa, Cryptosporidium hominis
LILEKFHPIWIRKIIDERRNLVLK

SEQ ID NO: 2193179 - protein, 18 aa, Cryptosporidium hominis
LILENLFMYLEDHSKILS

SEQ ID NO: 2193180 - protein, 17 aa, Cryptosporidium hominis
LILEQYKIRKELGLLFN

SEQ ID NO: 2193181 - protein, 26 aa, Cryptosporidium hominis
LILHCEQLSSIIPPLRSRCLCIRVPL

SEQ ID NO: 2193182 - protein, 20 aa, Cryptosporidium hominis
LILITEFYPQRGILETISQL

SEQ ID NO: 2193183 - protein, 19 aa, Cryptosporidium hominis
LILKAYSFGYLGIAFNNTL

SEQ ID NO: 2193184 - protein, 19 aa, Cryptosporidium hominis
LILKRRCINYFSFGEESRV

SEQ ID NO: 2193185 - protein, 20 aa, Cryptosporidium hominis
LILMTKTIIYFLNKTLLNTE

SEQ ID NO: 2193186 - protein, 17 aa, Cryptosporidium hominis
LILPLNIVSLVEIPSEK

SEQ ID NO: 2193187 - protein, 32 aa, Cryptosporidium hominis
LILPSVSTPLHIPPPPPPPPPKIKQSSSILGV

SEQ ID NO: 2193188 - protein, 17 aa, Cryptosporidium hominis
LILSQVIIDQFFESILR

SEQ ID NO: 2193189 - protein, 17 aa, Cryptosporidium hominis
LILYEECLNWSRKIKTA

SEQ ID NO: 2193190 - protein, 18 aa, Cryptosporidium hominis
LIMECSWLSLYNSMVCYG

SEQ ID NO: 2193191 - protein, 18 aa, Cryptosporidium hominis
LIMGLKGLTIRGEIRTNV

SEQ ID NO: 2193192 - protein, 17 aa, Cryptosporidium hominis
LIMLCGLGSSGKTSIIK

SEQ ID NO: 2193193 - protein, 21 aa, Cryptosporidium hominis
LIMRHPFPGPGLSINVICYDG

SEQ ID NO: 2193194 - protein, 22 aa, Cryptosporidium hominis
LINEETYFEEIYYGVSDRVIGE

SEQ ID NO: 2193195 - protein, 27 aa, Cryptosporidium hominis
LINKPHLYSQISNTPFISCYKFVANKT

SEQ ID NO: 2193196 - protein, 29 aa, Cryptosporidium hominis
LINMFDHDKWPLNKWAPSPFRVQHASPYK

SEQ ID NO: 2193197 - protein, 18 aa, Cryptosporidium hominis
LINNIYMDLFIPSNIDTI

SEQ ID NO: 2193198 - protein, 20 aa, Cryptosporidium hominis
LINNNPLTIATTASSGIITA

SEQ ID NO: 2193199 - protein, 20 aa, Cryptosporidium hominis
LINNRLFQLCTFKLTSESNQ

SEQ ID NO: 2193200 - protein, 32 aa, Cryptosporidium hominis
LINNYVEALIPMFKILPKRFSSKPKQARLAFP

SEQ ID NO: 2193201 - protein, 25 aa, Cryptosporidium hominis
LINSDLLSLLILKMSQKYKIFNNEQ

SEQ ID NO: 2193202 - protein, 17 aa, Cryptosporidium hominis
LINSTHLSKLIKLHTVH

SEQ ID NO: 2193203 - protein, 19 aa, Cryptosporidium hominis
LINYFNYQHFYVLYSRFVE

SEQ ID NO: 2193204 - protein, 21 aa, Cryptosporidium hominis
LIPGQPVRRIVEAKEPLYGVY

SEQ ID NO: 2193205 - protein, 19 aa, Cryptosporidium hominis
LIQFLPFECIKCRKKFCIE

SEQ ID NO: 2193206 - protein, 34 aa, Cryptosporidium hominis
LIQQNMSHMSILSIILERLFNSPFEELQKLHSPN

SEQ ID NO: 2193207 - protein, 23 aa, Cryptosporidium hominis
LIQREIIQLLRRLLSTETSSQQL

SEQ ID NO: 2193208 - protein, 23 aa, Cryptosporidium hominis
LIQTYLNIFLKIHSTTILENESE

SEQ ID NO: 2193209 - protein, 21 aa, Cryptosporidium hominis
LIREAVNILKLTRKSKKNLSS

SEQ ID NO: 2193210 - protein, 17 aa, Cryptosporidium hominis
LIRLCRSVNRLTKHRNK

SEQ ID NO: 2193211 - protein, 26 aa, Cryptosporidium hominis
LIRNNKLIMIDYLDNFKPPDLLIHVA

SEQ ID NO: 2193212 - protein, 17 aa, Cryptosporidium hominis
LIRVVDSLSLEEFNFSN

SEQ ID NO: 2193213 - protein, 17 aa, Cryptosporidium hominis
LIRYFAYIGFFMINSIE

SEQ ID NO: 2193214 - protein, 34 aa, Cryptosporidium hominis
LISHGLFQDMIMKRLFMHRSPLPSLEESAIFPCE

SEQ ID NO: 2193215 - protein, 21 aa, Cryptosporidium hominis
LISKPLIVNRIKPFTKHRGIL

SEQ ID NO: 2193216 - protein, 17 aa, Cryptosporidium hominis
LISLSTGSPIELLQAVY

SEQ ID NO: 2193217 - protein, 18 aa, Cryptosporidium hominis
LISLYKFVKSTKSKSKLE

SEQ ID NO: 2193218 - protein, 18 aa, Cryptosporidium hominis
LISTVCQLNKGVFKVLHV

SEQ ID NO: 2193219 - protein, 18 aa, Cryptosporidium hominis
LITEPFLNPSSLQHSLFE

SEQ ID NO: 2193220 - protein, 34 aa, Cryptosporidium hominis
LITVSKFYTYLNNLLIISPKRRLGIWRKVFGEKG

SEQ ID NO: 2193221 - protein, 25 aa, Cryptosporidium hominis
LIVLSNYVIYLRIRKYLLQQNAIFA

SEQ ID NO: 2193222 - protein, 19 aa, Cryptosporidium hominis
LIVPDLNKFGRSEQLFFSI

SEQ ID NO: 2193223 - protein, 31 aa, Cryptosporidium hominis
LIVQTIGIWSYLPVNLIPTTTLPPKFIVVPM

SEQ ID NO: 2193224 - protein, 19 aa, Cryptosporidium hominis
LIVVLDNKLLYRSKSKFLI

SEQ ID NO: 2193225 - protein, 17 aa, Cryptosporidium hominis
LIWAGLDPDRPLIDQLV

SEQ ID NO: 2193226 - protein, 20 aa, Cryptosporidium hominis
LIWPRELLYKYEVIFRLVFH

SEQ ID NO: 2193227 - protein, 25 aa, Cryptosporidium hominis
LIYDRHYNINYLKLEFGPEIKEIIS

SEQ ID NO: 2193228 - protein, 26 aa, Cryptosporidium hominis
LIYIHDPEDFRFWKQKPESFMKQLSE

SEQ ID NO: 2193229 - protein, 18 aa, Cryptosporidium hominis
LIYKSYFLRQKMLLLTTG

SEQ ID NO: 2193230 - protein, 25 aa, Cryptosporidium hominis
LKAIEWRVKLINEKKLRDNVVEYVN

SEQ ID NO: 2193231 - protein, 19 aa, Cryptosporidium hominis
LKALLKEKIAISDQSVHYI

SEQ ID NO: 2193232 - protein, 22 aa, Cryptosporidium hominis
LKAPIVASLPLRKKDETPEDRR

SEQ ID NO: 2193233 - protein, 26 aa, Cryptosporidium hominis
LKCAPKLYFIIPRIGYLLSLIDTIQD

SEQ ID NO: 2193234 - protein, 18 aa, Cryptosporidium hominis
LKCFVKILKQCPRISICL

SEQ ID NO: 2193235 - protein, 26 aa, Cryptosporidium hominis
LKCIKRKSLQYLFMKSKQKAQQAYEK

SEQ ID NO: 2193236 - protein, 35 aa, Cryptosporidium hominis
LKCMYKVLKMELLKNPFRWRGMLKDLYGVSEETTT

SEQ ID NO: 2193237 - protein, 24 aa, Cryptosporidium hominis
LKCPILMVLHIWKAYVYFNYQENN

SEQ ID NO: 2193238 - protein, 22 aa, Cryptosporidium hominis
LKDFLLAAKQFNLLRPDYAICG

SEQ ID NO: 2193239 - protein, 25 aa, Cryptosporidium hominis
LKDIQIPNITIFISGRALLSDASLN

SEQ ID NO: 2193240 - protein, 25 aa, Cryptosporidium hominis
LKDKYKVFSMNNAKHRIFSRKKAGS

SEQ ID NO: 2193241 - protein, 22 aa, Cryptosporidium hominis
LKDQYLCTNGIAYLSHEPCISC

SEQ ID NO: 2193242 - protein, 35 aa, Cryptosporidium hominis
LKDRPIDDYIILPLQLPPISELYFFHLESLGEIYI

SEQ ID NO: 2193243 - protein, 24 aa, Cryptosporidium hominis
LKDTGNCIPLKFDSKKSKEDFLNF

SEQ ID NO: 2193244 - protein, 18 aa, Cryptosporidium hominis
LKDVPISLGRKSWVRLYI

SEQ ID NO: 2193245 - protein, 44 aa, Cryptosporidium hominis
LKEDYKILIGKYLPFFTARDNYMNLFFSNTIFTEVFPYLSCFFA

SEQ ID NO: 2193246 - protein, 26 aa, Cryptosporidium hominis
LKEERQQLIQLLTALSSNNNFYIDNN

SEQ ID NO: 2193247 - protein, 23 aa, Cryptosporidium hominis
LKEEWLNYLVKLDNYEKEILIGQ

SEQ ID NO: 2193248 - protein, 18 aa, Cryptosporidium hominis
LKEKSLVLYVGINSPGNL

SEQ ID NO: 2193249 - protein, 25 aa, Cryptosporidium hominis
LKEMETIKILYEEKLSLVRRTNKNE

SEQ ID NO: 2193250 - protein, 27 aa, Cryptosporidium hominis
LKEQFKIHKEFIIPISWSSDGLRLSKI

SEQ ID NO: 2193251 - protein, 37 aa, Cryptosporidium hominis
LKERILLPVTWIPPEYRWLHFLHLALIVHLISSEIFV

SEQ ID NO: 2193252 - protein, 24 aa, Cryptosporidium hominis
LKESGNCIPLFFNNSQDKERFVAT

SEQ ID NO: 2193253 - protein, 27 aa, Cryptosporidium hominis
LKETILHELIHAYLFLTSNDRDRNFHG

SEQ ID NO: 2193254 - protein, 18 aa, Cryptosporidium hominis
LKEWMMRLDPELLSLQEK

SEQ ID NO: 2193255 - protein, 18 aa, Cryptosporidium hominis
LKFDNLSIDIKPAYTLSM

SEQ ID NO: 2193256 - protein, 26 aa, Cryptosporidium hominis
LKFVDITCPYLPTKNSRRLILEQLKI

SEQ ID NO: 2193257 - protein, 18 aa, Cryptosporidium hominis
LKFVGVSSFLGTGMKSFL

SEQ ID NO: 2193258 - protein, 19 aa, Cryptosporidium hominis
LKGSLLGRKVIDFSSLNGE

SEQ ID NO: 2193259 - protein, 29 aa, Cryptosporidium hominis
LKGVSKERLKILLDLYPTPDEIQLLNSIK

SEQ ID NO: 2193260 - protein, 17 aa, Cryptosporidium hominis
LKHFVLNRMVLFVAYVL

SEQ ID NO: 2193261 - protein, 22 aa, Cryptosporidium hominis
LKIIGVFLRTLLIYKKKLINYL

SEQ ID NO: 2193262 - protein, 28 aa, Cryptosporidium hominis
LKITKAQKKIPLWARSMNWIPKMKEQRN

SEQ ID NO: 2193263 - protein, 30 aa, Cryptosporidium hominis
LKKALPASIILQNAWRTLKPRLFISKLRLM

SEQ ID NO: 2193264 - protein, 20 aa, Cryptosporidium hominis
LKKCVLALIYIFKSGSQTCS

SEQ ID NO: 2193265 - protein, 38 aa, Cryptosporidium hominis
LKKEHFDKLLFFKMGKFYELFYIDAYICQKHCDLRWTS

SEQ ID NO: 2193266 - protein, 25 aa, Cryptosporidium hominis
LKKENIFNFPILIQEYNFDNLIIDN

SEQ ID NO: 2193267 - protein, 25 aa, Cryptosporidium hominis
LKKINLSLFILPVSLLSLLESEEDA

SEQ ID NO: 2193268 - protein, 26 aa, Cryptosporidium hominis
LKKIQSYLVLSKFWNSHIFLNFETNM

SEQ ID NO: 2193269 - protein, 28 aa, Cryptosporidium hominis
LKKNSKPLSIYWIQDSKLILDDLINDLN

SEQ ID NO: 2193270 - protein, 18 aa, Cryptosporidium hominis
LKKTLLHECCHVAQFLLD

SEQ ID NO: 2193271 - protein, 19 aa, Cryptosporidium hominis
LKLGESLLPLGFHLRDLHG

SEQ ID NO: 2193272 - protein, 23 aa, Cryptosporidium hominis
LKLLKELFNAVLYLFNPCWTFTL

SEQ ID NO: 2193273 - protein, 23 aa, Cryptosporidium hominis
LKLRRRGRRRRPGKLNISKQLTK

SEQ ID NO: 2193274 - protein, 32 aa, Cryptosporidium hominis
LKLTWKLHYSSLKLRLIFRFILKSMEVSNARK

SEQ ID NO: 2193275 - protein, 41 aa, Cryptosporidium hominis
LKNKPRDEIFTSLKLIERDFKLIQELFTEHVKRFSIIYDQG

SEQ ID NO: 2193276 - protein, 25 aa, Cryptosporidium hominis
LKNLSIVWTIWKPIKYCAVENIIPR

SEQ ID NO: 2193277 - protein, 17 aa, Cryptosporidium hominis
LKNLYFDFRENYQILND

SEQ ID NO: 2193278 - protein, 28 aa, Cryptosporidium hominis
LKNPSLDFCLGFGALLPNFINNSIFKAS

SEQ ID NO: 2193279 - protein, 27 aa, Cryptosporidium hominis
LKNRDEIMFIKRKVNLISQIYPINIDY

SEQ ID NO: 2193280 - protein, 25 aa, Cryptosporidium hominis
LKNRRKAILPKVEWILCFPVNQCSI

SEQ ID NO: 2193281 - protein, 21 aa, Cryptosporidium hominis
LKPQRKYTTLGTLSSLVGYNK

SEQ ID NO: 2193282 - protein, 19 aa, Cryptosporidium hominis
LKQKIDFLKGIINKKNQCL

SEQ ID NO: 2193283 - protein, 26 aa, Cryptosporidium hominis
LKQPCLELLTFILIDIIMDNEIHFNI

SEQ ID NO: 2193284 - protein, 22 aa, Cryptosporidium hominis
LKQQYFFVCATIQDILRRFKKS

SEQ ID NO: 2193285 - protein, 27 aa, Cryptosporidium hominis
LKQSQYFMWEIFIGFTDPNPNTRWSIK

SEQ ID NO: 2193286 - protein, 23 aa, Cryptosporidium hominis
LKQSYKSFFISKGVMNKIPPSVT

SEQ ID NO: 2193287 - protein, 38 aa, Cryptosporidium hominis
LKRIDEIDKFLLSFGLRKVGMHIIFLFEIDPKVHYKIK

SEQ ID NO: 2193288 - protein, 24 aa, Cryptosporidium hominis
LKSGFSVIFFHRKGSHIPFTIDCP

SEQ ID NO: 2193289 - protein, 27 aa, Cryptosporidium hominis
LKSILPILEFCISSRSPLLIIAEEIEG

SEQ ID NO: 2193290 - protein, 38 aa, Cryptosporidium hominis
LKSLLYKEFPTNIRWTYYSFYPLILSSYLQAYNNLKTE

SEQ ID NO: 2193291 - protein, 23 aa, Cryptosporidium hominis
LKSPIPRQFLSEVNKRFPTLPFS

SEQ ID NO: 2193292 - protein, 24 aa, Cryptosporidium hominis
LKSSEFMDFFSRASRLIERALGEG

SEQ ID NO: 2193293 - protein, 20 aa, Cryptosporidium hominis
LKTMLGLKEFGFELKLAIST

SEQ ID NO: 2193294 - protein, 18 aa, Cryptosporidium hominis
LKTNLWLERSWIIHFSGS

SEQ ID NO: 2193295 - protein, 22 aa, Cryptosporidium hominis
LKTNYIPNDILLNGGSSPAPCS

SEQ ID NO: 2193296 - protein, 22 aa, Cryptosporidium hominis
LKTPPKRPFLRKGEGKSLVISN

SEQ ID NO: 2193297 - protein, 23 aa, Cryptosporidium hominis
LKVGSIIFVRIKKYNFSDNGDFI

SEQ ID NO: 2193298 - protein, 37 aa, Cryptosporidium hominis
LKVIGTHPFIKLLTNFVNLVFGITLFLNNKKPNEQIE

SEQ ID NO: 2193299 - protein, 23 aa, Cryptosporidium hominis
LKVKAFEPILLLGKQIFSGVDIR

SEQ ID NO: 2193300 - protein, 27 aa, Cryptosporidium hominis
LKVNESKPFILFFKQHPTEASLTTTQC

SEQ ID NO: 2193301 - protein, 17 aa, Cryptosporidium hominis
LKYPLQFFDWSPEEDNL

SEQ ID NO: 2193302 - protein, 27 aa, Cryptosporidium hominis
LKYQDFIKFPTQIFWISCKSIKCFMQP

SEQ ID NO: 2193303 - protein, 22 aa, Cryptosporidium hominis
LLAFEICQSIIPRLAYEIAEEI

SEQ ID NO: 2193304 - protein, 34 aa, Cryptosporidium hominis
LLAIACELFVRDLTSFSWNFTRRAKRRTVQVQDI

SEQ ID NO: 2193305 - protein, 17 aa, Cryptosporidium hominis
LLATRFNKEVPNFQSNN

SEQ ID NO: 2193306 - protein, 17 aa, Cryptosporidium hominis
LLCRETMMQVIRRTITN

SEQ ID NO: 2193307 - protein, 18 aa, Cryptosporidium hominis
LLDQLKQLELLRFNNIQD

SEQ ID NO: 2193308 - protein, 19 aa, Cryptosporidium hominis
LLDSETRMFLVLKDYFGHS

SEQ ID NO: 2193309 - protein, 46 aa, Cryptosporidium hominis
LLEDAIHLYFQIQAAYWWYEDMWYDKYSHVLPKLSLRVFGQFVAED

SEQ ID NO: 2193310 - protein, 18 aa, Cryptosporidium hominis
LLEEGFGASYKKIYQFVI

SEQ ID NO: 2193311 - protein, 25 aa, Cryptosporidium hominis
LLELFDSLILIKTLMNKKILKKLGT

SEQ ID NO: 2193312 - protein, 19 aa, Cryptosporidium hominis
LLELIKYLDKSYMLQRRWK

SEQ ID NO: 2193313 - protein, 30 aa, Cryptosporidium hominis
LLEMKRLNELILPPRWDPLDGRLDHEFDHA

SEQ ID NO: 2193314 - protein, 22 aa, Cryptosporidium hominis
LLEMNSYTELFLKLSINPILSN

SEQ ID NO: 2193315 - protein, 21 aa, Cryptosporidium hominis
LLERRQKPFFYPTFIKEQVEN

SEQ ID NO: 2193316 - protein, 30 aa, Cryptosporidium hominis
LLETGSDILFFWVARMVMLSFACTDKLPFK

SEQ ID NO: 2193317 - protein, 25 aa, Cryptosporidium hominis
LLEVTNYHFLIWISSREISIYYVNR

SEQ ID NO: 2193318 - protein, 19 aa, Cryptosporidium hominis
LLEYRICGVKLYQNPPYTS

SEQ ID NO: 2193319 - protein, 17 aa, Cryptosporidium hominis
LLFFIHEKVMKDPSYLG

SEQ ID NO: 2193320 - protein, 28 aa, Cryptosporidium hominis
LLFPCSHSFHFGCMLLKYTSLMNHDEIN

SEQ ID NO: 2193321 - protein, 18 aa, Cryptosporidium hominis
LLFRWDKKSLPPDLHRLD

SEQ ID NO: 2193322 - protein, 25 aa, Cryptosporidium hominis
LLHASPLLFNLFELKLNLLTEEGTE

SEQ ID NO: 2193323 - protein, 18 aa, Cryptosporidium hominis
LLHDTPSGSIGKLIFRRD

SEQ ID NO: 2193324 - protein, 18 aa, Cryptosporidium hominis
LLIHLTREKLNELESYVF

SEQ ID NO: 2193325 - protein, 18 aa, Cryptosporidium hominis
LLIKTLIDPIRSLPIHIL

SEQ ID NO: 2193326 - protein, 35 aa, Cryptosporidium hominis
LLIQYSPILAFLDPKRFLSLLKRPSFASIDLNLIL

SEQ ID NO: 2193327 - protein, 18 aa, Cryptosporidium hominis
LLIVLFSVYHNFEKNTLL

SEQ ID NO: 2193328 - protein, 19 aa, Cryptosporidium hominis
LLIYTKLFKLKLDSDLRIL

SEQ ID NO: 2193329 - protein, 24 aa, Cryptosporidium hominis
LLKFVNFKLYQLNNLTYPPTINTP

SEQ ID NO: 2193330 - protein, 19 aa, Cryptosporidium hominis
LLKIFRLVDEKALAQESLE

SEQ ID NO: 2193331 - protein, 26 aa, Cryptosporidium hominis
LLKKTPVLQYLYYLKQIGIAVSPVSN

SEQ ID NO: 2193332 - protein, 18 aa, Cryptosporidium hominis
LLKNLRNLQTLYLERNPI

SEQ ID NO: 2193333 - protein, 25 aa, Cryptosporidium hominis
LLKNNVKVIWFNPISQIFKDTFLFR

SEQ ID NO: 2193334 - protein, 17 aa, Cryptosporidium hominis
LLKQIKERQIRNCLYNW

SEQ ID NO: 2193335 - protein, 17 aa, Cryptosporidium hominis
LLKRVNFDTLYSAYWSP

SEQ ID NO: 2193336 - protein, 34 aa, Cryptosporidium hominis
LLKSVAYITNFLLQLFRFLTLFDSSPPELKDFTF

SEQ ID NO: 2193337 - protein, 27 aa, Cryptosporidium hominis
LLKYIHIRTFEVLYKPWGIVRGSSKKF

SEQ ID NO: 2193338 - protein, 22 aa, Cryptosporidium hominis
LLLEQKKNLLLFQKSRGGDQQL

SEQ ID NO: 2193339 - protein, 17 aa, Cryptosporidium hominis
LLLGIYGLKFETVRLLL

SEQ ID NO: 2193340 - protein, 20 aa, Cryptosporidium hominis
LLLHTFIEDPLRPETKRLKD

SEQ ID NO: 2193341 - protein, 18 aa, Cryptosporidium hominis
LLLIPEWQDILDGLEILL

SEQ ID NO: 2193342 - protein, 22 aa, Cryptosporidium hominis
LLLKQLRVRVLLIKARIFALNN

SEQ ID NO: 2193343 - protein, 17 aa, Cryptosporidium hominis
LLLKRIRETRSSRENEI

SEQ ID NO: 2193344 - protein, 20 aa, Cryptosporidium hominis
LLLMFTEEVNLLKKLRGCPH

SEQ ID NO: 2193345 - protein, 20 aa, Cryptosporidium hominis
LLLPFFERRIGSELDCSFLG

SEQ ID NO: 2193346 - protein, 19 aa, Cryptosporidium hominis
LLLSKKEAYQFSKNNIKFG

SEQ ID NO: 2193347 - protein, 17 aa, Cryptosporidium hominis
LLLTPLSIKWNDSNTRS

SEQ ID NO: 2193348 - protein, 22 aa, Cryptosporidium hominis
LLLVNYKEFVSIFLDIPNWERL

SEQ ID NO: 2193349 - protein, 17 aa, Cryptosporidium hominis
LLMKSPLVKNALRRLNK

SEQ ID NO: 2193350 - protein, 21 aa, Cryptosporidium hominis
LLMQYSSFLVPSTITYWEIPS

SEQ ID NO: 2193351 - protein, 18 aa, Cryptosporidium hominis
LLNALNGFFPAFEDVRSA

SEQ ID NO: 2193352 - protein, 19 aa, Cryptosporidium hominis
LLNDLQERKEYSEKCLLAN

SEQ ID NO: 2193353 - protein, 26 aa, Cryptosporidium hominis
LLNEHYPRKLIKTFSVFPMLNNESSD

SEQ ID NO: 2193354 - protein, 26 aa, Cryptosporidium hominis
LLNESSMDYIWKNYLSSGEVGIFNTS

SEQ ID NO: 2193355 - protein, 18 aa, Cryptosporidium hominis
LLNFDFMDPPPTTTLLIA

SEQ ID NO: 2193356 - protein, 29 aa, Cryptosporidium hominis
LLNKDVKLIPELFWDKDFILNLNAGATQK

SEQ ID NO: 2193357 - protein, 25 aa, Cryptosporidium hominis
LLNPSILGWGLFSYSSLFNHSCDPN

SEQ ID NO: 2193358 - protein, 24 aa, Cryptosporidium hominis
LLNSQLTFLKLLIKGEAPLVLIEK

SEQ ID NO: 2193359 - protein, 17 aa, Cryptosporidium hominis
LLNYLQEPLYDYLDDTR

SEQ ID NO: 2193360 - protein, 20 aa, Cryptosporidium hominis
LLNYLVGVSLIMNLPNAMRN

SEQ ID NO: 2193361 - protein, 19 aa, Cryptosporidium hominis
LLPCCLVIANSKDSNISCI

SEQ ID NO: 2193362 - protein, 18 aa, Cryptosporidium hominis
LLPKPPLSNYYASYLSKV

SEQ ID NO: 2193363 - protein, 18 aa, Cryptosporidium hominis
LLPSWKIVILDEAEMMTA

SEQ ID NO: 2193364 - protein, 17 aa, Cryptosporidium hominis
LLQEYLGGGADPPYSPY

SEQ ID NO: 2193365 - protein, 18 aa, Cryptosporidium hominis
LLRIQKGASITPRFSLEE

SEQ ID NO: 2193366 - protein, 26 aa, Cryptosporidium hominis
LLRLEMIFMYYDKGNKGYWNMYDWEL

SEQ ID NO: 2193367 - protein, 19 aa, Cryptosporidium hominis
LLRNVVLYTLYDAYNNNYV

SEQ ID NO: 2193368 - protein, 40 aa, Cryptosporidium hominis
LLRRTKDLVIKLPDKIIRDIWLPLSPSGWQWYKRLLDVGN

SEQ ID NO: 2193369 - protein, 27 aa, Cryptosporidium hominis
LLRSRKCPFIIALNKIDRLYGWIEQNW

SEQ ID NO: 2193370 - protein, 18 aa, Cryptosporidium hominis
LLRVLPTRYARFNSTLSF

SEQ ID NO: 2193371 - protein, 21 aa, Cryptosporidium hominis
LLSAVWPHIESFNTFLSVGLK

SEQ ID NO: 2193372 - protein, 18 aa, Cryptosporidium hominis
LLSILDKFIETFTLLHGE

SEQ ID NO: 2193373 - protein, 18 aa, Cryptosporidium hominis
LLSIQKLMLNKWNRANIG

SEQ ID NO: 2193374 - protein, 18 aa, Cryptosporidium hominis
LLSKLMVYNSKKATFDDE

SEQ ID NO: 2193375 - protein, 19 aa, Cryptosporidium hominis
LLSLAWKISFQEIEPLPSC

SEQ ID NO: 2193376 - protein, 19 aa, Cryptosporidium hominis
LLSQHICLLSEKLALTDAS

SEQ ID NO: 2193377 - protein, 28 aa, Cryptosporidium hominis
LLSSLKVYPLFARGWITWAQYTDRLLYI

SEQ ID NO: 2193378 - protein, 18 aa, Cryptosporidium hominis
LLTKLILLVQRCQNYVRK

SEQ ID NO: 2193379 - protein, 30 aa, Cryptosporidium hominis
LLTRYQAQFYIGSIILALEYLHERSIVYRD

SEQ ID NO: 2193380 - protein, 18 aa, Cryptosporidium hominis
LLVAINPFKDVGLVGNDV

SEQ ID NO: 2193381 - protein, 21 aa, Cryptosporidium hominis
LLVSYLLNCSKIKNLGITKEE

SEQ ID NO: 2193382 - protein, 38 aa, Cryptosporidium hominis
LLYDNQVITNYLLQDGFLYPNTLLYEGYEKCSLYNNCL

SEQ ID NO: 2193383 - protein, 29 aa, Cryptosporidium hominis
LLYENIMTHILEWPSLSVQWMCESSISDV

SEQ ID NO: 2193384 - protein, 18 aa, Cryptosporidium hominis
LLYLDKNIENGLVERLKI

SEQ ID NO: 2193385 - protein, 17 aa, Cryptosporidium hominis
LLYRLSQDLPEDTKFWI

SEQ ID NO: 2193386 - protein, 21 aa, Cryptosporidium hominis
LLYVPFSYFNSQSVAFQVVFE

SEQ ID NO: 2193387 - protein, 20 aa, Cryptosporidium hominis
LMCCSPPQINSMPINQAPPS

SEQ ID NO: 2193388 - protein, 43 aa, Cryptosporidium hominis
LMCMEELLQFHLPHHLEALCVFLHHVGPFLDSERWKHYEDFNT

SEQ ID NO: 2193389 - protein, 26 aa, Cryptosporidium hominis
LMDIEFVYYFFIRLKNKQMINNPLIK

SEQ ID NO: 2193390 - protein, 17 aa, Cryptosporidium hominis
LMDMGLDLGFEGEMGLP

SEQ ID NO: 2193391 - protein, 18 aa, Cryptosporidium hominis
LMEKLENLELLVSRKESL

SEQ ID NO: 2193392 - protein, 17 aa, Cryptosporidium hominis
LMGKGFFEQLKGLFLMK

SEQ ID NO: 2193393 - protein, 25 aa, Cryptosporidium hominis
LMHDEKVFGWQFCSLILGEYREIPT

SEQ ID NO: 2193394 - protein, 41 aa, Cryptosporidium hominis
LMIVLQGVHFLLRRWISKRLAPHYIPKSSLDFLPLDILESE

SEQ ID NO: 2193395 - protein, 18 aa, Cryptosporidium hominis
LMKTMLKHNTQASSDRMI

SEQ ID NO: 2193396 - protein, 17 aa, Cryptosporidium hominis
LMLHGLSLTNETKENFY

SEQ ID NO: 2193397 - protein, 17 aa, Cryptosporidium hominis
LMLLNGFIKLVELESTI

SEQ ID NO: 2193398 - protein, 29 aa, Cryptosporidium hominis
LMNKDFVLEFIKPKKFIYKSYPGVVHTIT

SEQ ID NO: 2193399 - protein, 17 aa, Cryptosporidium hominis
LMNPDAFNRIPMIYEKK

SEQ ID NO: 2193400 - protein, 24 aa, Cryptosporidium hominis
LMNQELQMYLNRKNKRLSSTILND

SEQ ID NO: 2193401 - protein, 23 aa, Cryptosporidium hominis
LMPEVDYLLIGHGLDLERVKRRE

SEQ ID NO: 2193402 - protein, 17 aa, Cryptosporidium hominis
LMPFNLFELQNGGSQAP

SEQ ID NO: 2193403 - protein, 26 aa, Cryptosporidium hominis
LMYKQDYCLLILRRALSSTNRRVSSI

SEQ ID NO: 2193404 - protein, 17 aa, Cryptosporidium hominis
LNCDLITIQRKLSGLFK

SEQ ID NO: 2193405 - protein, 30 aa, Cryptosporidium hominis
LNCYQSLPQYILIKGILSEYSYFLNIFYKL

SEQ ID NO: 2193406 - protein, 17 aa, Cryptosporidium hominis
LNDLLSALNPKYFRFSI

SEQ ID NO: 2193407 - protein, 21 aa, Cryptosporidium hominis
LNDYYDYFAPDFKLHIPPLNL

SEQ ID NO: 2193408 - protein, 33 aa, Cryptosporidium hominis
LNEDGKINRSKIVPYITREMSIAQLQDKKYHSF

SEQ ID NO: 2193409 - protein, 25 aa, Cryptosporidium hominis
LNEDNFQYRYILGKILLDKNPGIRT

SEQ ID NO: 2193410 - protein, 24 aa, Cryptosporidium hominis
LNEEKIMIQSQYYKEKSKFDCDFQ

SEQ ID NO: 2193411 - protein, 28 aa, Cryptosporidium hominis
LNEFLEQIRPQIPLIEAASPGAAPVLLS

SEQ ID NO: 2193412 - protein, 22 aa, Cryptosporidium hominis
LNEHVRIQLLLSTSYNISSSCR

SEQ ID NO: 2193413 - protein, 21 aa, Cryptosporidium hominis
LNELLPIWKISINSQAKNESQ

SEQ ID NO: 2193414 - protein, 28 aa, Cryptosporidium hominis
LNEMKRKLLSFKPRVTFKKGTYFKPRGR

SEQ ID NO: 2193415 - protein, 24 aa, Cryptosporidium hominis
LNEQVIRRFFEFTDPSFENDSLES

SEQ ID NO: 2193416 - protein, 25 aa, Cryptosporidium hominis
LNERLIVKATLIIAPGSIVDQWYDE

SEQ ID NO: 2193417 - protein, 19 aa, Cryptosporidium hominis
LNFILNLQCMWRHYNLKIQ

SEQ ID NO: 2193418 - protein, 17 aa, Cryptosporidium hominis
LNGLLNLRYRDGSLLSS

SEQ ID NO: 2193419 - protein, 23 aa, Cryptosporidium hominis
LNGNLFHVIIRDLEILDTNIQKE

SEQ ID NO: 2193420 - protein, 29 aa, Cryptosporidium hominis
LNGQLSPFLRAKILERIKLTLQAFIKVFE

SEQ ID NO: 2193421 - protein, 18 aa, Cryptosporidium hominis
LNGVRKIIWQPGDSICLA

SEQ ID NO: 2193422 - protein, 20 aa, Cryptosporidium hominis
LNHILIDDWILLQCPGQIQS

SEQ ID NO: 2193423 - protein, 22 aa, Cryptosporidium hominis
LNIELERFFGYSKNLKVLVLSN

SEQ ID NO: 2193424 - protein, 28 aa, Cryptosporidium hominis
LNIENKLCQRFPWLEVLIRSMDMSILNP

SEQ ID NO: 2193425 - protein, 35 aa, Cryptosporidium hominis
LNIFKSMYNLCDAKFWGFNSFIFLVSNHTIIAIDV

SEQ ID NO: 2193426 - protein, 39 aa, Cryptosporidium hominis
LNIIGKFWDDFFQQGWVPLYKLILYRLQRIESNILYSND

SEQ ID NO: 2193427 - protein, 18 aa, Cryptosporidium hominis
LNIILRQNDFLTKLGSGK

SEQ ID NO: 2193428 - protein, 31 aa, Cryptosporidium hominis
LNIKDYFGHIVIDLLFFQAKKFASIMGARCV

SEQ ID NO: 2193429 - protein, 19 aa, Cryptosporidium hominis
LNILGILGVLMKYYPNVYW

SEQ ID NO: 2193430 - protein, 25 aa, Cryptosporidium hominis
LNINNNYSFFLSKDLRIIKSPNGNG

SEQ ID NO: 2193431 - protein, 26 aa, Cryptosporidium hominis
LNIQDKLHFDFILSASNLYSNMVRLP

SEQ ID NO: 2193432 - protein, 26 aa, Cryptosporidium hominis
LNIRNIPFLTNLLYELIKTRNLILDE

SEQ ID NO: 2193433 - protein, 20 aa, Cryptosporidium hominis
LNISLKFLENAQIQWMNEKE

SEQ ID NO: 2193434 - protein, 25 aa, Cryptosporidium hominis
LNKDSIGNYFLFSKDILQSDKDDDE

SEQ ID NO: 2193435 - protein, 22 aa, Cryptosporidium hominis
LNKDYYIPLKSLLDKLNTIKNT

SEQ ID NO: 2193436 - protein, 25 aa, Cryptosporidium hominis
LNKFRTTQVLTPSSPIKITASPLQQ

SEQ ID NO: 2193437 - protein, 26 aa, Cryptosporidium hominis
LNKNLRNLMLKVFRKDMFSDYCQKCK

SEQ ID NO: 2193438 - protein, 24 aa, Cryptosporidium hominis
LNKRQDYILDFTKKLELSGMNLDI

SEQ ID NO: 2193439 - protein, 20 aa, Cryptosporidium hominis
LNKSILNIILRQNDFLTKLG

SEQ ID NO: 2193440 - protein, 17 aa, Cryptosporidium hominis
LNKYPFCLTILSSGKLI

SEQ ID NO: 2193441 - protein, 17 aa, Cryptosporidium hominis
LNLEEFYYKNIESIPRC

SEQ ID NO: 2193442 - protein, 24 aa, Cryptosporidium hominis
LNLEGDLLRGIFAYGFEKPSAIQQ

SEQ ID NO: 2193443 - protein, 22 aa, Cryptosporidium hominis
LNLIGQFGVGFYASYLVSDRVT

SEQ ID NO: 2193444 - protein, 18 aa, Cryptosporidium hominis
LNLRYRDGSLLSSLPDIG

SEQ ID NO: 2193445 - protein, 25 aa, Cryptosporidium hominis
LNLSPDLLKGIYNKGFNRPSKIQAA

SEQ ID NO: 2193446 - protein, 21 aa, Cryptosporidium hominis
LNLVALCISTPPPFTGLPQNN

SEQ ID NO: 2193447 - protein, 24 aa, Cryptosporidium hominis
LNMDLESLFYYFSNNSIYLKCKQF

SEQ ID NO: 2193448 - protein, 19 aa, Cryptosporidium hominis
LNMITECISNVPFLFEKIS

SEQ ID NO: 2193449 - protein, 20 aa, Cryptosporidium hominis
LNNAKWDLVNKYYINVLKNL

SEQ ID NO: 2193450 - protein, 36 aa, Cryptosporidium hominis
LNNESEWEIFWQELLIYLFFKPILNKNSIELRDLPA

SEQ ID NO: 2193451 - protein, 18 aa, Cryptosporidium hominis
LNNIGLGPTLIIDCDYDD

SEQ ID NO: 2193452 - protein, 24 aa, Cryptosporidium hominis
LNNLVRNYLTLGLMISYNTGNNNG

SEQ ID NO: 2193453 - protein, 18 aa, Cryptosporidium hominis
LNNRWFGGNQVFCSLYNT

SEQ ID NO: 2193454 - protein, 26 aa, Cryptosporidium hominis
LNNYSNLPFPPFQVKITQRFRRNRNN

SEQ ID NO: 2193455 - protein, 17 aa, Cryptosporidium hominis
LNPDDGLFLCRFCNEKL

SEQ ID NO: 2193456 - protein, 24 aa, Cryptosporidium hominis
LNPFQMICIALNKPCIEFYDLRSG

SEQ ID NO: 2193457 - protein, 17 aa, Cryptosporidium hominis
LNPKSDILQAERRLNEL

SEQ ID NO: 2193458 - protein, 28 aa, Cryptosporidium hominis
LNPLSQPPFRVNLSANLFFPNFRIVSIK

SEQ ID NO: 2193459 - protein, 20 aa, Cryptosporidium hominis
LNQAIKMAYSVGLTYEAGLG

SEQ ID NO: 2193460 - protein, 22 aa, Cryptosporidium hominis
LNQDLLVHWKNKSQLSHGEIIG

SEQ ID NO: 2193461 - protein, 24 aa, Cryptosporidium hominis
LNQIHCQYIFLCHGQIQNSSDRNV

SEQ ID NO: 2193462 - protein, 26 aa, Cryptosporidium hominis
LNQIPNRRFTLWWSPTINRANVYIGF

SEQ ID NO: 2193463 - protein, 26 aa, Cryptosporidium hominis
LNQKRIIISILKIFEGIQGYLEREGS

SEQ ID NO: 2193464 - protein, 18 aa, Cryptosporidium hominis
LNQNFQITKKHNLSLLIT

SEQ ID NO: 2193465 - protein, 24 aa, Cryptosporidium hominis
LNQQNLWGNRWADIARHLPGRTTH

SEQ ID NO: 2193466 - protein, 20 aa, Cryptosporidium hominis
LNQRQFILHKQFTPPQTPNN

SEQ ID NO: 2193467 - protein, 24 aa, Cryptosporidium hominis
LNREELYFELIPEKKQFYTRKQNA

SEQ ID NO: 2193468 - protein, 22 aa, Cryptosporidium hominis
LNRHFFICCEQPKVLFWSYNSG

SEQ ID NO: 2193469 - protein, 26 aa, Cryptosporidium hominis
LNRNRGLFEIIIFNPPYVPSSNKDLN

SEQ ID NO: 2193470 - protein, 21 aa, Cryptosporidium hominis
LNRYKTICEIGEGAFGVVFKC

SEQ ID NO: 2193471 - protein, 21 aa, Cryptosporidium hominis
LNSEFNAFKLIRKRLNHSIYN

SEQ ID NO: 2193472 - protein, 33 aa, Cryptosporidium hominis
LNSEKLKFVTLIENKLLRGIKDFLANQKSCEEH

SEQ ID NO: 2193473 - protein, 23 aa, Cryptosporidium hominis
LNSESFFEILNWSIDTLGSGKIG

SEQ ID NO: 2193474 - protein, 21 aa, Cryptosporidium hominis
LNSIPSLNPFYTQTINLNNYS

SEQ ID NO: 2193475 - protein, 23 aa, Cryptosporidium hominis
LNSKGILDLFPYNFQNQAFSSLE

SEQ ID NO: 2193476 - protein, 30 aa, Cryptosporidium hominis
LNSKLQYEILIQLRDAWINALRSNAVDTKD

SEQ ID NO: 2193477 - protein, 21 aa, Cryptosporidium hominis
LNSLKIVLNLNISEGGIEQSY

SEQ ID NO: 2193478 - protein, 32 aa, Cryptosporidium hominis
LNSYKSFLNMDRVMPWMLNIDSFNLPNSNQQP

SEQ ID NO: 2193479 - protein, 18 aa, Cryptosporidium hominis
LNTQFKRYLTECGQLVIN

SEQ ID NO: 2193480 - protein, 31 aa, Cryptosporidium hominis
LNVKECLALFPIKKFKRFLRLQGFQSQDQYK

SEQ ID NO: 2193481 - protein, 25 aa, Cryptosporidium hominis
LNVKNFKPELLGYKSVEDWVSSQPK

SEQ ID NO: 2193482 - protein, 24 aa, Cryptosporidium hominis
LNVPKLIAFQRPEHYIRFPVHKEF

SEQ ID NO: 2193483 - protein, 29 aa, Cryptosporidium hominis
LNVQKPTLQPIQFPNMQAGVPNLCGIQGQ

SEQ ID NO: 2193484 - protein, 17 aa, Cryptosporidium hominis
LNYFRVTNIYIPGTELN

SEQ ID NO: 2193485 - protein, 25 aa, Cryptosporidium hominis
LNYGDIIHWLFLSICTFEERKCFSL

SEQ ID NO: 2193486 - protein, 25 aa, Cryptosporidium hominis
LNYIIGLINLVIKYISVIRNVFCNT

SEQ ID NO: 2193487 - protein, 28 aa, Cryptosporidium hominis
LNYSNLLYDLFYFHVDVTIRIFYRENEN

SEQ ID NO: 2193488 - protein, 21 aa, Cryptosporidium hominis
LPDGPVFLSPDRLFPSFKREV

SEQ ID NO: 2193489 - protein, 20 aa, Cryptosporidium hominis
LPDRTVAIGSFSRIKYKKFY

SEQ ID NO: 2193490 - protein, 20 aa, Cryptosporidium hominis
LPEDLLFYVLSMLVTPVVYE

SEQ ID NO: 2193491 - protein, 27 aa, Cryptosporidium hominis
LPEESLIHKFPRLKMLFESVAVLPLID

SEQ ID NO: 2193492 - protein, 23 aa, Cryptosporidium hominis
LPEEWVCTMNTWDKLYSSCDAAE

SEQ ID NO: 2193493 - protein, 25 aa, Cryptosporidium hominis
LPEIREVQDLILETKKLIGEETPDY

SEQ ID NO: 2193494 - protein, 24 aa, Cryptosporidium hominis
LPEPILKYYIGLKILSYPSILEKV

SEQ ID NO: 2193495 - protein, 18 aa, Cryptosporidium hominis
LPERHEIVLFKSMEDANN

SEQ ID NO: 2193496 - protein, 29 aa, Cryptosporidium hominis
LPESDIIKLCTMYPYLNPRYFLNKNAKKG

SEQ ID NO: 2193497 - protein, 18 aa, Cryptosporidium hominis
LPFDYRSPVIMACMGTGI

SEQ ID NO: 2193498 - protein, 19 aa, Cryptosporidium hominis
LPFVLKVVLSESLDMILLV

SEQ ID NO: 2193499 - protein, 25 aa, Cryptosporidium hominis
LPGLPTSIKWSYDGSLLAVSCMDKV

SEQ ID NO: 2193500 - protein, 19 aa, Cryptosporidium hominis
LPHFSQLFHKLILCQTFCA

SEQ ID NO: 2193501 - protein, 19 aa, Cryptosporidium hominis
LPIIQSRLGILTWYARMDP

SEQ ID NO: 2193502 - protein, 24 aa, Cryptosporidium hominis
LPKFQIEVGFWKAASTLKYDVIKS

SEQ ID NO: 2193503 - protein, 17 aa, Cryptosporidium hominis
LPKYFYSSALYISELSL

SEQ ID NO: 2193504 - protein, 17 aa, Cryptosporidium hominis
LPLPIHHYLKKKNIIKP

SEQ ID NO: 2193505 - protein, 25 aa, Cryptosporidium hominis
LPLPTFPNKGVSKIWLPTEYEMSIT

SEQ ID NO: 2193506 - protein, 18 aa, Cryptosporidium hominis
LPNIFPSISHRPLPVNVC

SEQ ID NO: 2193507 - protein, 26 aa, Cryptosporidium hominis
LPNNKGNLLDVLFGSSAKMAKNLEKK

SEQ ID NO: 2193508 - protein, 19 aa, Cryptosporidium hominis
LPNRTLSRVPRIYSLAEGD

SEQ ID NO: 2193509 - protein, 33 aa, Cryptosporidium hominis
LPPDVDMKIAPLSRVAIYTWHGCILQIRGLVQQ

SEQ ID NO: 2193510 - protein, 22 aa, Cryptosporidium hominis
LPPIGGFSLPPFKYWEYFQADP

SEQ ID NO: 2193511 - protein, 20 aa, Cryptosporidium hominis
LPPKFIVVPMNPLSHYFYEQ

SEQ ID NO: 2193512 - protein, 30 aa, Cryptosporidium hominis
LPPKSPGLIPRFTIDMWDSSITSGPIGHAS

SEQ ID NO: 2193513 - protein, 23 aa, Cryptosporidium hominis
LPQLRALPPDKLDDFRKLYAMWN

SEQ ID NO: 2193514 - protein, 19 aa, Cryptosporidium hominis
LPRFVGFEELPWREYWCYP

SEQ ID NO: 2193515 - protein, 17 aa, Cryptosporidium hominis
LPRKQHSYSEDLFPDCF

SEQ ID NO: 2193516 - protein, 18 aa, Cryptosporidium hominis
LPSDLQAKIFKPSPYRKV

SEQ ID NO: 2193517 - protein, 26 aa, Cryptosporidium hominis
LPTIQTSFYIITWSPSNSVLKIRMRQ

SEQ ID NO: 2193518 - protein, 27 aa, Cryptosporidium hominis
LPTLIQSLNFIIQLKNKIFLNSEFSKC

SEQ ID NO: 2193519 - protein, 17 aa, Cryptosporidium hominis
LPTLRTAGLPKIYTAYQ

SEQ ID NO: 2193520 - protein, 18 aa, Cryptosporidium hominis
LPTPPKDYNLRKTGIDLN

SEQ ID NO: 2193521 - protein, 26 aa, Cryptosporidium hominis
LPTSRDPKLWLVKVDRAGLEKDICIA

SEQ ID NO: 2193522 - protein, 19 aa, Cryptosporidium hominis
LPVESIVELAFEILQEKLN

SEQ ID NO: 2193523 - protein, 25 aa, Cryptosporidium hominis
LPVREELLRSILMADLIGFHFFPYA

SEQ ID NO: 2193524 - protein, 19 aa, Cryptosporidium hominis
LPYMGILSNSSNKGTLKQV

SEQ ID NO: 2193525 - protein, 17 aa, Cryptosporidium hominis
LPYPEKIYLKVRTSQFF

SEQ ID NO: 2193526 - protein, 32 aa, Cryptosporidium hominis
LQCPGQIQSILWYFRYVVRDFIQFLSQKLLES

SEQ ID NO: 2193527 - protein, 23 aa, Cryptosporidium hominis
LQDDFLLTFPGGIPKGSTKNAKS

SEQ ID NO: 2193528 - protein, 24 aa, Cryptosporidium hominis
LQDDFYLNLVDWSSTNLLAVGLSS

SEQ ID NO: 2193529 - protein, 25 aa, Cryptosporidium hominis
LQDIRGNIRVFCRVRPPTISEQDFC

SEQ ID NO: 2193530 - protein, 17 aa, Cryptosporidium hominis
LQDLKSSLLLIYTKLFK

SEQ ID NO: 2193531 - protein, 32 aa, Cryptosporidium hominis
LQDSEIKEIRRIAKMLVWLQENNPKTSASAET

SEQ ID NO: 2193532 - protein, 26 aa, Cryptosporidium hominis
LQELFDAWMLYINFEKDRMLSIDYSS

SEQ ID NO: 2193533 - protein, 22 aa, Cryptosporidium hominis
LQELRAKQFAILEQEGMLSHIK

SEQ ID NO: 2193534 - protein, 32 aa, Cryptosporidium hominis
LQESMDMFFFSAYIFELFYMVFYSDEDELINN

SEQ ID NO: 2193535 - protein, 25 aa, Cryptosporidium hominis
LQETIFTFINVLEAYIDTPWTSVLK

SEQ ID NO: 2193536 - protein, 42 aa, Cryptosporidium hominis
LQFSRFISHYFEFPDLITIIYRFPFYINPMKLSHGKEIKFIL

SEQ ID NO: 2193537 - protein, 21 aa, Cryptosporidium hominis
LQGFHAIIIHLIRENIKQINE

SEQ ID NO: 2193538 - protein, 31 aa, Cryptosporidium hominis
LQGIKKKSFGVFDKLISLAQNRSIARPISKD

SEQ ID NO: 2193539 - protein, 27 aa, Cryptosporidium hominis
LQGNVTNLILYCLKHIFTQLAQSSPES

SEQ ID NO: 2193540 - protein, 18 aa, Cryptosporidium hominis
LQGPYFDEAFLSKIAYEI

SEQ ID NO: 2193541 - protein, 24 aa, Cryptosporidium hominis
LQIGDIFGFLKERGLYKPNSVPMT

SEQ ID NO: 2193542 - protein, 17 aa, Cryptosporidium hominis
LQILELIGVVVNSGVWP

SEQ ID NO: 2193543 - protein, 23 aa, Cryptosporidium hominis
LQKRILELFVERRALMDENKSLN

SEQ ID NO: 2193544 - protein, 20 aa, Cryptosporidium hominis
LQKVFSIQFQIRRRIKELEI

SEQ ID NO: 2193545 - protein, 18 aa, Cryptosporidium hominis
LQKVMILHTYILDDPFED

SEQ ID NO: 2193546 - protein, 24 aa, Cryptosporidium hominis
LQLGEIPVIRYLANSPLCRNIAFA

SEQ ID NO: 2193547 - protein, 23 aa, Cryptosporidium hominis
LQLKLKAFDNFLQNYPYIKEEQP

SEQ ID NO: 2193548 - protein, 23 aa, Cryptosporidium hominis
LQLKVLRPFNQESKLILNWLEDG

SEQ ID NO: 2193549 - protein, 18 aa, Cryptosporidium hominis
LQLSDYFRLLIDRSIEIR

SEQ ID NO: 2193550 - protein, 19 aa, Cryptosporidium hominis
LQLTSSIFNVFRTYAGKQD

SEQ ID NO: 2193551 - protein, 20 aa, Cryptosporidium hominis
LQNFGLLMGTGLGMPSLGAT

SEQ ID NO: 2193552 - protein, 28 aa, Cryptosporidium hominis
LQNNLMELWSLLHFLMPHIFTSHHDFKT

SEQ ID NO: 2193553 - protein, 17 aa, Cryptosporidium hominis
LQNSLGGNSLTALIVTC

SEQ ID NO: 2193554 - protein, 25 aa, Cryptosporidium hominis
LQNTKQFLFKNLLNLVIDEADRILE

SEQ ID NO: 2193555 - protein, 25 aa, Cryptosporidium hominis
LQNYKNLRCLLLGGNKIKDFSELIV

SEQ ID NO: 2193556 - protein, 17 aa, Cryptosporidium hominis
LQPVNQISKPFLQNTNT

SEQ ID NO: 2193557 - protein, 20 aa, Cryptosporidium hominis
LQPYPNGIKWINETHSWKVV

SEQ ID NO: 2193558 - protein, 18 aa, Cryptosporidium hominis
LQPYSGAYKRTKGKRWST

SEQ ID NO: 2193559 - protein, 25 aa, Cryptosporidium hominis
LQQDVAEWLGTYFTCVWIQISKQRD

SEQ ID NO: 2193560 - protein, 27 aa, Cryptosporidium hominis
LQQEALWISRKFLQTYPELFKEELLRR

SEQ ID NO: 2193561 - protein, 19 aa, Cryptosporidium hominis
LQQPHHLIDGRLVFVHQAI

SEQ ID NO: 2193562 - protein, 23 aa, Cryptosporidium hominis
LQQPVFHVGYFKHLYGVLCCICK

SEQ ID NO: 2193563 - protein, 20 aa, Cryptosporidium hominis
LQQQFLANTIPFNFQSRQQL

SEQ ID NO: 2193564 - protein, 19 aa, Cryptosporidium hominis
LQQQKPVLGILPAIDEECF

SEQ ID NO: 2193565 - protein, 19 aa, Cryptosporidium hominis
LQQVLWENAQWEPIEFSKL

SEQ ID NO: 2193566 - protein, 20 aa, Cryptosporidium hominis
LQSDLLEESLKLLIKHVIAQ

SEQ ID NO: 2193567 - protein, 24 aa, Cryptosporidium hominis
LQSGSLNIYISWSSYRLMESEKNN

SEQ ID NO: 2193568 - protein, 36 aa, Cryptosporidium hominis
LQSSNSEYYLFLTWNNCILGYIPINTNKINKVTLEA

SEQ ID NO: 2193569 - protein, 19 aa, Cryptosporidium hominis
LQSVDPIRKFYWKWRADNL

SEQ ID NO: 2193570 - protein, 34 aa, Cryptosporidium hominis
LQTPVKVLGQVFMKLLRLLRLHVPNIDPSMFMER

SEQ ID NO: 2193571 - protein, 17 aa, Cryptosporidium hominis
LQVLLNSAQRKLAERNN

SEQ ID NO: 2193572 - protein, 19 aa, Cryptosporidium hominis
LQVRFRIPNPHSLMPLRSC

SEQ ID NO: 2193573 - protein, 19 aa, Cryptosporidium hominis
LQWKYLDETISKMKNTLAT

SEQ ID NO: 2193574 - protein, 17 aa, Cryptosporidium hominis
LQWLKEYLNNFSQTSIC

SEQ ID NO: 2193575 - protein, 36 aa, Cryptosporidium hominis
LQYSQKIWISLFLVGSVHFPYLPKLRFNASMSTPFS

SEQ ID NO: 2193576 - protein, 19 aa, Cryptosporidium hominis
LRDEIFSSLLFPGSKVSAG

SEQ ID NO: 2193577 - protein, 22 aa, Cryptosporidium hominis
LRDILRSYPQLSSNVIPILMEV

SEQ ID NO: 2193578 - protein, 18 aa, Cryptosporidium hominis
LRDLYRQRDDLRLALEQE

SEQ ID NO: 2193579 - protein, 25 aa, Cryptosporidium hominis
LRECIPLAILLRNRLKFALTYTEAK

SEQ ID NO: 2193580 - protein, 19 aa, Cryptosporidium hominis
LREFASILKEWRLCTGIEL

SEQ ID NO: 2193581 - protein, 30 aa, Cryptosporidium hominis
LREKCKILKPKLLLVPSDVLTLFIDYRLLS

SEQ ID NO: 2193582 - protein, 30 aa, Cryptosporidium hominis
LREPSLNMFQILLDILFLDINNSQIKFVED

SEQ ID NO: 2193583 - protein, 18 aa, Cryptosporidium hominis
LREQKAKLSLYRPNGNSN

SEQ ID NO: 2193584 - protein, 21 aa, Cryptosporidium hominis
LREQLFMMGFELQDQNIEKDQ

SEQ ID NO: 2193585 - protein, 24 aa, Cryptosporidium hominis
LRGAILDFVGFIMNWSEVENYKDS

SEQ ID NO: 2193586 - protein, 24 aa, Cryptosporidium hominis
LRIHANFLEQFTSNLFKYIESSKH

SEQ ID NO: 2193587 - protein, 24 aa, Cryptosporidium hominis
LRIKRMAYPVALVLSPTRELAIQT

SEQ ID NO: 2193588 - protein, 17 aa, Cryptosporidium hominis
LRISPKLILDEYKFYSF

SEQ ID NO: 2193589 - protein, 24 aa, Cryptosporidium hominis
LRKKDIFDIFSKIPGNPLFKKNEE

SEQ ID NO: 2193590 - protein, 24 aa, Cryptosporidium hominis
LRKLRPPIVTLLTTSPPEVQYVVL

SEQ ID NO: 2193591 - protein, 33 aa, Cryptosporidium hominis
LRKMCVNLVPFPRLHFFMIGFAPLTSRGSQQYR

SEQ ID NO: 2193592 - protein, 17 aa, Cryptosporidium hominis
LRKMDCIYFVTNEKRNL

SEQ ID NO: 2193593 - protein, 19 aa, Cryptosporidium hominis
LRKMYEKNLPSLNEEKIMI

SEQ ID NO: 2193594 - protein, 27 aa, Cryptosporidium hominis
LRKNPDIWTIWRPEKALSLHKKQVSLL

SEQ ID NO: 2193595 - protein, 29 aa, Cryptosporidium hominis
LRKNPNLFAKWSISFSLGLHRLQRNILLR

SEQ ID NO: 2193596 - protein, 20 aa, Cryptosporidium hominis
LRKVIWNSILGLERFDTFSV

SEQ ID NO: 2193597 - protein, 23 aa, Cryptosporidium hominis
LRLESFEFWPLYLRNEKGINILR

SEQ ID NO: 2193598 - protein, 27 aa, Cryptosporidium hominis
LRLLCNLRFIKLIQPLIESILENLQHR

SEQ ID NO: 2193599 - protein, 17 aa, Cryptosporidium hominis
LRLRKWVKRVSTPLLLN

SEQ ID NO: 2193600 - protein, 20 aa, Cryptosporidium hominis
LRMIGYWNWLCGDDLCSICS

SEQ ID NO: 2193601 - protein, 22 aa, Cryptosporidium hominis
LRNEEIKTYWSIRVAYDTLTQE

SEQ ID NO: 2193602 - protein, 17 aa, Cryptosporidium hominis
LRNKPRNLLRHQTQNIW

SEQ ID NO: 2193603 - protein, 25 aa, Cryptosporidium hominis
LRNLLELLYLSDASEFFFCLECIRS

SEQ ID NO: 2193604 - protein, 17 aa, Cryptosporidium hominis
LRNLQNLPFESICAGDQ

SEQ ID NO: 2193605 - protein, 33 aa, Cryptosporidium hominis
LRNSIRFCDQIIFFFKKNWGIFYKKVNKIILNI

SEQ ID NO: 2193606 - protein, 18 aa, Cryptosporidium hominis
LRQEKLNRLKIAEKELNT

SEQ ID NO: 2193607 - protein, 18 aa, Cryptosporidium hominis
LRQERFGMISEADKIKNR

SEQ ID NO: 2193608 - protein, 30 aa, Cryptosporidium hominis
LRQGYTHLVDWWSVGILMYECLYGGVPFND

SEQ ID NO: 2193609 - protein, 18 aa, Cryptosporidium hominis
LRQWIKKKMPGISEKEIN

SEQ ID NO: 2193610 - protein, 17 aa, Cryptosporidium hominis
LRRAEHQSGVPGVYWQE

SEQ ID NO: 2193611 - protein, 26 aa, Cryptosporidium hominis
LRRKYRLYWIAILRNAPEGLEGLYDR

SEQ ID NO: 2193612 - protein, 20 aa, Cryptosporidium hominis
LRRLDRTLLLIEENFEQVSK

SEQ ID NO: 2193613 - protein, 26 aa, Cryptosporidium hominis
LRSAAIRFGMRYISSGKELSFGGKAR

SEQ ID NO: 2193614 - protein, 28 aa, Cryptosporidium hominis
LRSFGGKWPFIFFKSRIEFLETVTQSLS

SEQ ID NO: 2193615 - protein, 17 aa, Cryptosporidium hominis
LRTARNHGYSPYRKIQE

SEQ ID NO: 2193616 - protein, 23 aa, Cryptosporidium hominis
LRVRHRLCNSKGYWPRIKIEIPE

SEQ ID NO: 2193617 - protein, 19 aa, Cryptosporidium hominis
LRVTRAGQIWFPDSAYKTA

SEQ ID NO: 2193618 - protein, 33 aa, Cryptosporidium hominis
LSAEIHSWRLTSYCPLLVQFFGAFIKPNKSVVC

SEQ ID NO: 2193619 - protein, 26 aa, Cryptosporidium hominis
LSALSFLIPIDFFCQLKLNRIQVLKV

SEQ ID NO: 2193620 - protein, 18 aa, Cryptosporidium hominis
LSCTCNCNIGTNYFDQKV

SEQ ID NO: 2193621 - protein, 26 aa, Cryptosporidium hominis
LSDINLFQLINSYSRIFPKGLFINEL

SEQ ID NO: 2193622 - protein, 23 aa, Cryptosporidium hominis
LSDKFNVFFIKSIINTACICPNF

SEQ ID NO: 2193623 - protein, 18 aa, Cryptosporidium hominis
LSDLCVPPTLLYKENSLD

SEQ ID NO: 2193624 - protein, 19 aa, Cryptosporidium hominis
LSDLYACMSIGQSIIFVNT

SEQ ID NO: 2193625 - protein, 26 aa, Cryptosporidium hominis
LSDLYRVPIHIFEKIRNSKLNASLLE

SEQ ID NO: 2193626 - protein, 20 aa, Cryptosporidium hominis
LSDRMIVEFFLSAYSIPSNT

SEQ ID NO: 2193627 - protein, 20 aa, Cryptosporidium hominis
LSDVVLNLPLTPYSEQFLPY

SEQ ID NO: 2193628 - protein, 31 aa, Cryptosporidium hominis
LSDYRGKYVVLFFYPLNFTFVCPSEILAFNQ

SEQ ID NO: 2193629 - protein, 21 aa, Cryptosporidium hominis
LSEECYWVRIKLSYLFKEGEE

SEQ ID NO: 2193630 - protein, 21 aa, Cryptosporidium hominis
LSEIMPMYKKDFEKGVRAEEY

SEQ ID NO: 2193631 - protein, 26 aa, Cryptosporidium hominis
LSEKIQRFNLLLEKINKMEQMNISFK

SEQ ID NO: 2193632 - protein, 34 aa, Cryptosporidium hominis
LSEKYEYLIEIFQGLEIVLRLLERRQKPFFYPTF

SEQ ID NO: 2193633 - protein, 25 aa, Cryptosporidium hominis
LSELNYIPEWFRIGLRILTVSNALE

SEQ ID NO: 2193634 - protein, 26 aa, Cryptosporidium hominis
LSELRYGISMWSGCTAAVCVRIFNEA

SEQ ID NO: 2193635 - protein, 18 aa, Cryptosporidium hominis
LSEPLLKYRSVKELKETI

SEQ ID NO: 2193636 - protein, 28 aa, Cryptosporidium hominis
LSERKRAKEYLAWLIAQRTSTVSVDTRA

SEQ ID NO: 2193637 - protein, 26 aa, Cryptosporidium hominis
LSEVNKRFPTLPFSLNMISDEKVARL

SEQ ID NO: 2193638 - protein, 19 aa, Cryptosporidium hominis
LSEYIFLTKGRFHILDIYP

SEQ ID NO: 2193639 - protein, 19 aa, Cryptosporidium hominis
LSFPIVCESLQLWGHLRLY

SEQ ID NO: 2193640 - protein, 28 aa, Cryptosporidium hominis
LSFQGKIRNMLFKLLIHPVHELVNNLKT

SEQ ID NO: 2193641 - protein, 19 aa, Cryptosporidium hominis
LSFSPWLTVKALKGIFQAF

SEQ ID NO: 2193642 - protein, 17 aa, Cryptosporidium hominis
LSGEGFAIVKKPTSYGK

SEQ ID NO: 2193643 - protein, 17 aa, Cryptosporidium hominis
LSGFGFSAAVPVDTHIL

SEQ ID NO: 2193644 - protein, 38 aa, Cryptosporidium hominis
LSGGQKTLVALAFLFALHRADPAPMYLLDEVDAALDDQ

SEQ ID NO: 2193645 - protein, 23 aa, Cryptosporidium hominis
LSGGSVFEFKLTSGIPSAVPTQI

SEQ ID NO: 2193646 - protein, 25 aa, Cryptosporidium hominis
LSGGWRMRVALARAIYANPDILLLD

SEQ ID NO: 2193647 - protein, 24 aa, Cryptosporidium hominis
LSGTVYIWVITTGQLLNCWLPHYK

SEQ ID NO: 2193648 - protein, 19 aa, Cryptosporidium hominis
LSHLWRASLNILLLLARCS

SEQ ID NO: 2193649 - protein, 27 aa, Cryptosporidium hominis
LSHPIRLYCRFVDKLYIIIKLSKQEIK

SEQ ID NO: 2193650 - protein, 26 aa, Cryptosporidium hominis
LSIIAKLSHVFTLFSTAMRCIDDVIL

SEQ ID NO: 2193651 - protein, 18 aa, Cryptosporidium hominis
LSILTFITSFFPKYYPNL

SEQ ID NO: 2193652 - protein, 18 aa, Cryptosporidium hominis
LSIPPLTKPTDFPRELIH

SEQ ID NO: 2193653 - protein, 35 aa, Cryptosporidium hominis
LSIQSDLVPDLWLKLLPILLYSLDIWLSDLIRKLS

SEQ ID NO: 2193654 - protein, 17 aa, Cryptosporidium hominis
LSIWQRIHLLYDPDRNQ

SEQ ID NO: 2193655 - protein, 28 aa, Cryptosporidium hominis
LSKDLNALYLRRSGKKLILPLNIVSLVE

SEQ ID NO: 2193656 - protein, 29 aa, Cryptosporidium hominis
LSKDSIPESFLPDFLDLIIWGHEHECIVN

SEQ ID NO: 2193657 - protein, 19 aa, Cryptosporidium hominis
LSKIEFYSNWKNIINHQDA

SEQ ID NO: 2193658 - protein, 28 aa, Cryptosporidium hominis
LSKNWSCEVWFYVPFEITFHPYCLISNS

SEQ ID NO: 2193659 - protein, 27 aa, Cryptosporidium hominis
LSKPIEDYCMFPLDSVYRLSTTNTNGI

SEQ ID NO: 2193660 - protein, 22 aa, Cryptosporidium hominis
LSKSFNVALLNDSTSLLSDIED

SEQ ID NO: 2193661 - protein, 28 aa, Cryptosporidium hominis
LSKYSLSYNWFIYWNDNFPKSTGISNDI

SEQ ID NO: 2193662 - protein, 17 aa, Cryptosporidium hominis
LSLCWMNEHTIYTGGST

SEQ ID NO: 2193663 - protein, 26 aa, Cryptosporidium hominis
LSLFCSTNCYYLYLDLSISLSETHPH

SEQ ID NO: 2193664 - protein, 23 aa, Cryptosporidium hominis
LSLGSFTHVLGLCKPCVFVNKTN

SEQ ID NO: 2193665 - protein, 31 aa, Cryptosporidium hominis
LSLIHQTPVALFEYLEQYPLLLNNLGMAARI

SEQ ID NO: 2193666 - protein, 32 aa, Cryptosporidium hominis
LSLKDLTESLYPLIKFQALYAGRNLHQLPPGI

SEQ ID NO: 2193667 - protein, 23 aa, Cryptosporidium hominis
LSLKRRCKLNIPPCSRVPEPDYE

SEQ ID NO: 2193668 - protein, 26 aa, Cryptosporidium hominis
LSLNRYYLPGYFKTAPFNYVRDAKVF

SEQ ID NO: 2193669 - protein, 20 aa, Cryptosporidium hominis
LSLPKTIFAHGFVTAPDGKK

SEQ ID NO: 2193670 - protein, 22 aa, Cryptosporidium hominis
LSLSLFNYIEISPLVSYYGENL

SEQ ID NO: 2193671 - protein, 26 aa, Cryptosporidium hominis
LSLSSPIIDINPPVSALNTSSSRISS

SEQ ID NO: 2193672 - protein, 24 aa, Cryptosporidium hominis
LSLSSSLSVPFPKPSRSSKANSVD

SEQ ID NO: 2193673 - protein, 31 aa, Cryptosporidium hominis
LSLVNTRYRMRLYRMFIVNCPKFINVVSNAL

SEQ ID NO: 2193674 - protein, 25 aa, Cryptosporidium hominis
LSMANTLRRIILAEIPTLAIDLVTM

SEQ ID NO: 2193675 - protein, 18 aa, Cryptosporidium hominis
LSNFYFCCLYFHRLDSMA

SEQ ID NO: 2193676 - protein, 22 aa, Cryptosporidium hominis
LSNIIIFANILVELIIFEEQGL

SEQ ID NO: 2193677 - protein, 23 aa, Cryptosporidium hominis
LSNITNHFILRRANTLLAKVLPP

SEQ ID NO: 2193678 - protein, 24 aa, Cryptosporidium hominis
LSNKKPLVIIFFVSIDVYDKITSL

SEQ ID NO: 2193679 - protein, 57 aa, Cryptosporidium hominis
LSNLKSLPATLPWLFELNMDRLFPTMHLLWIHSSLFSIPSIIILRNAKQFIFNGADL

SEQ ID NO: 2193680 - protein, 27 aa, Cryptosporidium hominis
LSNNLQIFILGLLAYNGSHFKVNWNNY

SEQ ID NO: 2193681 - protein, 22 aa, Cryptosporidium hominis
LSNTIFPLKPWEKRDYIEVLHP

SEQ ID NO: 2193682 - protein, 22 aa, Cryptosporidium hominis
LSNTKRYVQLIYIAADNCLPVP

SEQ ID NO: 2193683 - protein, 18 aa, Cryptosporidium hominis
LSPYALLCLWHPHSKSCS

SEQ ID NO: 2193684 - protein, 21 aa, Cryptosporidium hominis
LSQQDVFQLLIRQMELVQAKL

SEQ ID NO: 2193685 - protein, 22 aa, Cryptosporidium hominis
LSRILVYDSPFQPEFWSYRILT

SEQ ID NO: 2193686 - protein, 20 aa, Cryptosporidium hominis
LSRIVIFRREEYIRKTKQGL

SEQ ID NO: 2193687 - protein, 19 aa, Cryptosporidium hominis
LSRTTRLLEAGIKPVFVFD

SEQ ID NO: 2193688 - protein, 30 aa, Cryptosporidium hominis
LSSAHYYGKIPRYLAILALNLKGHSFVSLN

SEQ ID NO: 2193689 - protein, 26 aa, Cryptosporidium hominis
LSSDSWGSFLPYSKITDYCFENSPDN

SEQ ID NO: 2193690 - protein, 24 aa, Cryptosporidium hominis
LSSFFGNAPIFNIPGRTFPVEIEY

SEQ ID NO: 2193691 - protein, 17 aa, Cryptosporidium hominis
LSSFLLLLVLERSKISI

SEQ ID NO: 2193692 - protein, 27 aa, Cryptosporidium hominis
LSSGKLYLIFDFFPIGPTMAPDTGARC

SEQ ID NO: 2193693 - protein, 17 aa, Cryptosporidium hominis
LSSKSISSKSAISSLPK

SEQ ID NO: 2193694 - protein, 19 aa, Cryptosporidium hominis
LSSLRHRSWFIQSTCATAG

SEQ ID NO: 2193695 - protein, 23 aa, Cryptosporidium hominis
LSSNFIEWIISQSNLHMDKFLIF

SEQ ID NO: 2193696 - protein, 25 aa, Cryptosporidium hominis
LSSRLGRCIPANPIALVGLLSNFGQ

SEQ ID NO: 2193697 - protein, 25 aa, Cryptosporidium hominis
LSSSFFFKRVVINPAFYDPNVFQVE

SEQ ID NO: 2193698 - protein, 20 aa, Cryptosporidium hominis
LSTFLIYIQDIGEHIQRFQQ

SEQ ID NO: 2193699 - protein, 23 aa, Cryptosporidium hominis
LSTLFTFMLEWITISKTVWISNS

SEQ ID NO: 2193700 - protein, 17 aa, Cryptosporidium hominis
LSTLRELELKGFRVTYL

SEQ ID NO: 2193701 - protein, 25 aa, Cryptosporidium hominis
LSTSILLLLCLLFEKDESERNNLSI

SEQ ID NO: 2193702 - protein, 22 aa, Cryptosporidium hominis
LSVASTYWSLVSRLAGILGSID

SEQ ID NO: 2193703 - protein, 18 aa, Cryptosporidium hominis
LSVRGHPIYADVGGFLIS

SEQ ID NO: 2193704 - protein, 17 aa, Cryptosporidium hominis
LSVRYFLNLIIVDEEDR

SEQ ID NO: 2193705 - protein, 21 aa, Cryptosporidium hominis
LSWVPRGYAKEIPIKNAHYTM

SEQ ID NO: 2193706 - protein, 24 aa, Cryptosporidium hominis
LSYDRVLYYGLPGDFYLPPNDGLD

SEQ ID NO: 2193707 - protein, 20 aa, Cryptosporidium hominis
LSYRPRVHFKKGTRFFTQDY

SEQ ID NO: 2193708 - protein, 18 aa, Cryptosporidium hominis
LTAINWLTRDAEAGDILV

SEQ ID NO: 2193709 - protein, 18 aa, Cryptosporidium hominis
LTAIPDPSGKRILAEGML

SEQ ID NO: 2193710 - protein, 21 aa, Cryptosporidium hominis
LTALQHCKLGFILELSDLIEK

SEQ ID NO: 2193711 - protein, 17 aa, Cryptosporidium hominis
LTCWNKSVKFYDPQIPY

SEQ ID NO: 2193712 - protein, 18 aa, Cryptosporidium hominis
LTDALMASPIVLGEGTSS

SEQ ID NO: 2193713 - protein, 47 aa, Cryptosporidium hominis
LTDHGLSYTRIRFASVQQLFKISYVCDVFDYALSIHCEFGRPRHRDS

SEQ ID NO: 2193714 - protein, 26 aa, Cryptosporidium hominis
LTDLKEILLFLENSLVALNEQLTNYK

SEQ ID NO: 2193715 - protein, 28 aa, Cryptosporidium hominis
LTDSASATKYWYFMKMIGDKTSNVALEV

SEQ ID NO: 2193716 - protein, 22 aa, Cryptosporidium hominis
LTDYVVTRWYRAPEIILCVNRY

SEQ ID NO: 2193717 - protein, 33 aa, Cryptosporidium hominis
LTEEEFWNRIIQSPLFFDILGQKNTLVNNSDTL

SEQ ID NO: 2193718 - protein, 19 aa, Cryptosporidium hominis
LTENIYSQLILKFVDFDSL

SEQ ID NO: 2193719 - protein, 20 aa, Cryptosporidium hominis
LTEWSIEPLSSWISVAEIPL

SEQ ID NO: 2193720 - protein, 35 aa, Cryptosporidium hominis
LTEYCNLHFIFKKLLSEGLEYWKTLFNKAFCLQKM

SEQ ID NO: 2193721 - protein, 17 aa, Cryptosporidium hominis
LTFYAIEICFKKIDSKL

SEQ ID NO: 2193722 - protein, 34 aa, Cryptosporidium hominis
LTGLNSIINIDLYELLILSSSQRLLLLSKHAPIL

SEQ ID NO: 2193723 - protein, 21 aa, Cryptosporidium hominis
LTGTIAQYLLSRVPLPTSRVD

SEQ ID NO: 2193724 - protein, 25 aa, Cryptosporidium hominis
LTHTIRAFTKPIPVTPGQVKLNSAD

SEQ ID NO: 2193725 - protein, 25 aa, Cryptosporidium hominis
LTIMSEFLVVMNRWKKLAKYTIEND

SEQ ID NO: 2193726 - protein, 24 aa, Cryptosporidium hominis
LTISARAMLKFVKGLTPTQLGINW

SEQ ID NO: 2193727 - protein, 20 aa, Cryptosporidium hominis
LTISYILDLYQPTFKRKSIV

SEQ ID NO: 2193728 - protein, 26 aa, Cryptosporidium hominis
LTIVTERKILLFDLLNINRKSEWMSI

SEQ ID NO: 2193729 - protein, 18 aa, Cryptosporidium hominis
LTIYEWSNKFVYPREMLF

SEQ ID NO: 2193730 - protein, 22 aa, Cryptosporidium hominis
LTKLITRLQYLKTSSQELLIEN

SEQ ID NO: 2193731 - protein, 20 aa, Cryptosporidium hominis
LTLAINFLVSLLKKNWHNIK

SEQ ID NO: 2193732 - protein, 28 aa, Cryptosporidium hominis
LTLEIYNQLLFLYKFRLSNSYGTNMNIK

SEQ ID NO: 2193733 - protein, 20 aa, Cryptosporidium hominis
LTLISKWLEMPQYRYQIRLI

SEQ ID NO: 2193734 - protein, 19 aa, Cryptosporidium hominis
LTMEYIKGFNILNKMLLKE

SEQ ID NO: 2193735 - protein, 19 aa, Cryptosporidium hominis
LTMWYRAPEILLGIDKYSP

SEQ ID NO: 2193736 - protein, 31 aa, Cryptosporidium hominis
LTNNRYVDICRNPEWPFIKQTSKVFSKNEQA

SEQ ID NO: 2193737 - protein, 25 aa, Cryptosporidium hominis
LTNWNKFTFPLLEEFSMIQDQIQLV

SEQ ID NO: 2193738 - protein, 20 aa, Cryptosporidium hominis
LTPQILKLSMSVDGEWLILG

SEQ ID NO: 2193739 - protein, 21 aa, Cryptosporidium hominis
LTPVPLRELIASIILCSRGTL

SEQ ID NO: 2193740 - protein, 24 aa, Cryptosporidium hominis
LTQKKSYKFAVLSPFNISHRLYNL

SEQ ID NO: 2193741 - protein, 18 aa, Cryptosporidium hominis
LTQYQLFTIVSELRNFHL

SEQ ID NO: 2193742 - protein, 20 aa, Cryptosporidium hominis
LTRALLLGEVELFNSSLWSL

SEQ ID NO: 2193743 - protein, 26 aa, Cryptosporidium hominis
LTREELVIPKFFKSYDSIQYSLACLN

SEQ ID NO: 2193744 - protein, 18 aa, Cryptosporidium hominis
LTRFTAGIIIVLSSVFDK

SEQ ID NO: 2193745 - protein, 25 aa, Cryptosporidium hominis
LTRGQRKRRLVLERVKRKQDLTSYL

SEQ ID NO: 2193746 - protein, 31 aa, Cryptosporidium hominis
LTRICEQRQLWNEVVYLYLQYQEFDQAVLTV

SEQ ID NO: 2193747 - protein, 26 aa, Cryptosporidium hominis
LTRNLTVITVCGHVFHKQCIDAWLSK

SEQ ID NO: 2193748 - protein, 25 aa, Cryptosporidium hominis
LTSNRVRLLFRKGMKCYRPRRTGEM

SEQ ID NO: 2193749 - protein, 22 aa, Cryptosporidium hominis
LTSPIPITPFRRPEFQLNSTPK

SEQ ID NO: 2193750 - protein, 30 aa, Cryptosporidium hominis
LTSRHDVLLSPLFINFLEFPNSENLPPIMK

SEQ ID NO: 2193751 - protein, 24 aa, Cryptosporidium hominis
LTSRIVRFLLSGYSPILALTFTRK

SEQ ID NO: 2193752 - protein, 32 aa, Cryptosporidium hominis
LTSTILAPPAFSKKIIKFFKMNQRNSLNYPSF

SEQ ID NO: 2193753 - protein, 24 aa, Cryptosporidium hominis
LTSYKKISLPKIDLSKIGAQELIP

SEQ ID NO: 2193754 - protein, 32 aa, Cryptosporidium hominis
LTTKLGGPWEGYFLWDIIRGKILNYRDNINQK

SEQ ID NO: 2193755 - protein, 20 aa, Cryptosporidium hominis
LTTSLIPYNRWFDSTNEDKK

SEQ ID NO: 2193756 - protein, 18 aa, Cryptosporidium hominis
LTVLQHHSYWVVSQWHIL

SEQ ID NO: 2193757 - protein, 22 aa, Cryptosporidium hominis
LTVSRILEYFQGKKADLVLCDG

SEQ ID NO: 2193758 - protein, 28 aa, Cryptosporidium hominis
LTVVETLLALEFFFPMDSGDLPYEVKRM

SEQ ID NO: 2193759 - protein, 28 aa, Cryptosporidium hominis
LTYDEGNQLIFPPGYKIPALSKSKKEDP

SEQ ID NO: 2193760 - protein, 23 aa, Cryptosporidium hominis
LTYLDRWQLYDNIRFWAEVIDKL

SEQ ID NO: 2193761 - protein, 25 aa, Cryptosporidium hominis
LVAGDGRFFLPEAIQIISEIAAAHK

SEQ ID NO: 2193762 - protein, 18 aa, Cryptosporidium hominis
LVAPPPPPPPPSSQGITS

SEQ ID NO: 2193763 - protein, 20 aa, Cryptosporidium hominis
LVCTFFTILGSYSKGFIVIV

SEQ ID NO: 2193764 - protein, 30 aa, Cryptosporidium hominis
LVDDKGVLLLIIFGLPPVYHLDDPLRAVFA

SEQ ID NO: 2193765 - protein, 17 aa, Cryptosporidium hominis
LVDILLVKQLKVGNNQT

SEQ ID NO: 2193766 - protein, 22 aa, Cryptosporidium hominis
LVDLNGPLFKLLKQVRDIWKFQ

SEQ ID NO: 2193767 - protein, 17 aa, Cryptosporidium hominis
LVDLRRAARRALLEVIR

SEQ ID NO: 2193768 - protein, 24 aa, Cryptosporidium hominis
LVEEGIIESLPLKVFDMRGSDENG

SEQ ID NO: 2193769 - protein, 27 aa, Cryptosporidium hominis
LVENKVLCYFMILNRPLIKPENSQNTK

SEQ ID NO: 2193770 - protein, 17 aa, Cryptosporidium hominis
LVENLPLSLNALKALPG

SEQ ID NO: 2193771 - protein, 25 aa, Cryptosporidium hominis
LVEQKQNLPPPPPKRPTTTDSGTRT

SEQ ID NO: 2193772 - protein, 26 aa, Cryptosporidium hominis
LVEYERLQYLYLSLKTIIENNASTKA

SEQ ID NO: 2193773 - protein, 19 aa, Cryptosporidium hominis
LVGDFSLDMRLYCLVRRSE

SEQ ID NO: 2193774 - protein, 25 aa, Cryptosporidium hominis
LVGFDQLTNIVLQNCSEKIYNKDLN

SEQ ID NO: 2193775 - protein, 22 aa, Cryptosporidium hominis
LVGKWISFLYNKEILNVEYEFL

SEQ ID NO: 2193776 - protein, 19 aa, Cryptosporidium hominis
LVGNSAYYNYMTSQEELYI

SEQ ID NO: 2193777 - protein, 18 aa, Cryptosporidium hominis
LVGTLIPFEYILNYEKEK

SEQ ID NO: 2193778 - protein, 17 aa, Cryptosporidium hominis
LVIFNILYYGFSPEYCQ

SEQ ID NO: 2193779 - protein, 18 aa, Cryptosporidium hominis
LVKPWNGNRFMFPRGKMD

SEQ ID NO: 2193780 - protein, 19 aa, Cryptosporidium hominis
LVKTLLDTSVPKSGIRLRL

SEQ ID NO: 2193781 - protein, 18 aa, Cryptosporidium hominis
LVLALKYKKKHLNNKCEE

SEQ ID NO: 2193782 - protein, 17 aa, Cryptosporidium hominis
LVLEACAIRIQTAFRKY

SEQ ID NO: 2193783 - protein, 25 aa, Cryptosporidium hominis
LVLLSNNDLYFVKLPEYSEFKETID

SEQ ID NO: 2193784 - protein, 19 aa, Cryptosporidium hominis
LVLMGFPDMFNRSGSPNFQ

SEQ ID NO: 2193785 - protein, 24 aa, Cryptosporidium hominis
LVMDLRYLMSPWSAIKLQENKHNK

SEQ ID NO: 2193786 - protein, 28 aa, Cryptosporidium hominis
LVMSDWLLCELVWEQVLLELGVKTKIEK

SEQ ID NO: 2193787 - protein, 32 aa, Cryptosporidium hominis
LVNKDGKSTIAFSKALLARCEQEFKNMPRNMT

SEQ ID NO: 2193788 - protein, 17 aa, Cryptosporidium hominis
LVNNTCKYEIIAENEYW

SEQ ID NO: 2193789 - protein, 32 aa, Cryptosporidium hominis
LVNSRRFDVPFRNMLLWGKPGTGKTMFARKLA

SEQ ID NO: 2193790 - protein, 25 aa, Cryptosporidium hominis
LVNTGTILRHRIWHQLYASWGSSIN

SEQ ID NO: 2193791 - protein, 34 aa, Cryptosporidium hominis
LVPDSGLIELLPFYSFHILSRTPVSKIPSSIYQH

SEQ ID NO: 2193792 - protein, 29 aa, Cryptosporidium hominis
LVPELQHLSVPYWNLFPDIIDDVLNDTNK

SEQ ID NO: 2193793 - protein, 18 aa, Cryptosporidium hominis
LVPNILVWLFSRKLLIRH

SEQ ID NO: 2193794 - protein, 27 aa, Cryptosporidium hominis
LVPYTSIPCVLDFLKQRYLVNQIYTTA

SEQ ID NO: 2193795 - protein, 22 aa, Cryptosporidium hominis
LVQSLRPDLGLQSNLFTLCIHA

SEQ ID NO: 2193796 - protein, 24 aa, Cryptosporidium hominis
LVQSNISLFAYIKLETASNNPNEI

SEQ ID NO: 2193797 - protein, 22 aa, Cryptosporidium hominis
LVRAMIIIPTRELALQVYKQTT

SEQ ID NO: 2193798 - protein, 18 aa, Cryptosporidium hominis
LVRFGNSGKLRQGGEHLK

SEQ ID NO: 2193799 - protein, 29 aa, Cryptosporidium hominis
LVRKTHNLFGFKFLNIGINQINLARAARF

SEQ ID NO: 2193800 - protein, 18 aa, Cryptosporidium hominis
LVRNMDIKILLAESSPIL

SEQ ID NO: 2193801 - protein, 24 aa, Cryptosporidium hominis
LVRPEHILKKSLDFVYNNYIKYSS

SEQ ID NO: 2193802 - protein, 23 aa, Cryptosporidium hominis
LVRYSRHYELPTISTIIKSSNPE

SEQ ID NO: 2193803 - protein, 25 aa, Cryptosporidium hominis
LVSCKCCGLTVHWSCYGLGEKMESI

SEQ ID NO: 2193804 - protein, 26 aa, Cryptosporidium hominis
LVSEDLYFFTHFYSAITFLEKLDGRQ

SEQ ID NO: 2193805 - protein, 24 aa, Cryptosporidium hominis
LVSIPTYHFGFLGICINPPLALEN

SEQ ID NO: 2193806 - protein, 37 aa, Cryptosporidium hominis
LVSKIRRVLIYRSEWKRPPMYLLITHKGRNCKGNYPL

SEQ ID NO: 2193807 - protein, 17 aa, Cryptosporidium hominis
LVSLYLKHDIEVLFLTE

SEQ ID NO: 2193808 - protein, 28 aa, Cryptosporidium hominis
LVSNDFLSQLLSFFNMRAIAIVGNNEAA

SEQ ID NO: 2193809 - protein, 45 aa, Cryptosporidium hominis
LVTEKGMEYLDSKNTLLLMYIGYLCYYMMLKTSPDINIKEHPILL

SEQ ID NO: 2193810 - protein, 17 aa, Cryptosporidium hominis
LVVIDPLLNLLSFNTSG

SEQ ID NO: 2193811 - protein, 17 aa, Cryptosporidium hominis
LVVILPPSIINYGGNGK

SEQ ID NO: 2193812 - protein, 17 aa, Cryptosporidium hominis
LVVLLQYSIYPKRTNLE

SEQ ID NO: 2193813 - protein, 18 aa, Cryptosporidium hominis
LVVNFIVSKELLERNYKL

SEQ ID NO: 2193814 - protein, 26 aa, Cryptosporidium hominis
LVVTRYELLSFWYTISSLYSFQGKPM

SEQ ID NO: 2193815 - protein, 18 aa, Cryptosporidium hominis
LVVVPLSTLPNWQKEFEI

SEQ ID NO: 2193816 - protein, 30 aa, Cryptosporidium hominis
LVWDLSNLIRIWWHFIPIPHCEIPCPVPKP

SEQ ID NO: 2193817 - protein, 24 aa, Cryptosporidium hominis
LVYEPFFQDFGPLNLRCIYKYCKK

SEQ ID NO: 2193818 - protein, 19 aa, Cryptosporidium hominis
LVYRYHPDNSPTKAVLLLF

SEQ ID NO: 2193819 - protein, 19 aa, Cryptosporidium hominis
LVYYEALFNKLENDVVLRC

SEQ ID NO: 2193820 - protein, 33 aa, Cryptosporidium hominis
LWEVSDPIILNTFEKELFAFLTGETPRENSSPA

SEQ ID NO: 2193821 - protein, 20 aa, Cryptosporidium hominis
LWKGIYYDNRNKGWKLCLDG

SEQ ID NO: 2193822 - protein, 23 aa, Cryptosporidium hominis
LWKSPDWMICLRDGISKGIKNKN

SEQ ID NO: 2193823 - protein, 25 aa, Cryptosporidium hominis
LWPSYLQDMPWTMIKFASIARKSHR

SEQ ID NO: 2193824 - protein, 18 aa, Cryptosporidium hominis
LWSHIFQREALKKSIEAN

SEQ ID NO: 2193825 - protein, 25 aa, Cryptosporidium hominis
LWVCNPNKLRVCEFLIRWHEQRGDK

SEQ ID NO: 2193826 - protein, 19 aa, Cryptosporidium hominis
LWVEVFEPKFNKWISVDIH

SEQ ID NO: 2193827 - protein, 23 aa, Cryptosporidium hominis
LYATRLIFPPRLRNNIVTDFVIE

SEQ ID NO: 2193828 - protein, 19 aa, Cryptosporidium hominis
LYCLNILFRIYKLEFTENW

SEQ ID NO: 2193829 - protein, 24 aa, Cryptosporidium hominis
LYDFFQRAHLFDYSWKHLAEEQRR

SEQ ID NO: 2193830 - protein, 20 aa, Cryptosporidium hominis
LYELLNASWRIVTIASILVP

SEQ ID NO: 2193831 - protein, 21 aa, Cryptosporidium hominis
LYELVKLFPEKMDISNDLTFR

SEQ ID NO: 2193832 - protein, 27 aa, Cryptosporidium hominis
LYEYNKLQWCTLALTRIAQYSALGIRH

SEQ ID NO: 2193833 - protein, 25 aa, Cryptosporidium hominis
LYFEEQERYFIAALSTLESWLSFDQ

SEQ ID NO: 2193834 - protein, 20 aa, Cryptosporidium hominis
LYFQEIYDFQLSLDRFEIKE

SEQ ID NO: 2193835 - protein, 17 aa, Cryptosporidium hominis
LYGMDPQIGLTTFNSNM

SEQ ID NO: 2193836 - protein, 38 aa, Cryptosporidium hominis
LYGSYSKLCDLWSAGVILYILLCGYPPFHGKDNVEILR

SEQ ID NO: 2193837 - protein, 17 aa, Cryptosporidium hominis
LYICKLSFSLFFKKKKK

SEQ ID NO: 2193838 - protein, 20 aa, Cryptosporidium hominis
LYISGLGYNPKQNTLIIFIN

SEQ ID NO: 2193839 - protein, 33 aa, Cryptosporidium hominis
LYKEIKNWRFHKIPMFWLQVKLIEILELFPEVI

SEQ ID NO: 2193840 - protein, 18 aa, Cryptosporidium hominis
LYKYPRSCIGSRRFSRYN

SEQ ID NO: 2193841 - protein, 21 aa, Cryptosporidium hominis
LYKYQGYVGAHLIVAGSDSTG

SEQ ID NO: 2193842 - protein, 24 aa, Cryptosporidium hominis
LYLQIYNVFSFSKPILLITISFLE

SEQ ID NO: 2193843 - protein, 19 aa, Cryptosporidium hominis
LYNDPYLYNRKIYTRFPLN

SEQ ID NO: 2193844 - protein, 18 aa, Cryptosporidium hominis
LYNSMVCYGPKSPIYYYC

SEQ ID NO: 2193845 - protein, 30 aa, Cryptosporidium hominis
LYNSPLETFYQFIWRPHPPSLLSQEKFDEI

SEQ ID NO: 2193846 - protein, 17 aa, Cryptosporidium hominis
LYPNGSCVHTHCLSNEY

SEQ ID NO: 2193847 - protein, 19 aa, Cryptosporidium hominis
LYQNFDASGYSFYYMKYNK

SEQ ID NO: 2193848 - protein, 26 aa, Cryptosporidium hominis
LYQTQKQFQIILGKRNVEFSNVKDEL

SEQ ID NO: 2193849 - protein, 36 aa, Cryptosporidium hominis
LYREDVWGTYRSYDPIYWWVDFVLQSNNPCISTYSD

SEQ ID NO: 2193850 - protein, 21 aa, Cryptosporidium hominis
LYRINCLIVDDLLEFWDKVID

SEQ ID NO: 2193851 - protein, 24 aa, Cryptosporidium hominis
LYRMGYLCIIISTRTLALGVNMPC

SEQ ID NO: 2193852 - protein, 28 aa, Cryptosporidium hominis
LYSGKSIMVRLIGLDYIDQLRDLRVEWL

SEQ ID NO: 2193853 - protein, 26 aa, Cryptosporidium hominis
LYSISNFDMISIIRIPIYPNRCVFLS

SEQ ID NO: 2193854 - protein, 18 aa, Cryptosporidium hominis
LYVIFESISKATFFFIKQ

SEQ ID NO: 2193855 - protein, 22 aa, Cryptosporidium hominis
LYVLGQMGLKSPLTRLYEILAD

SEQ ID NO: 2193856 - protein, 18 aa, Cryptosporidium hominis
MAAWFFEIQGIPAATISG

SEQ ID NO: 2193857 - protein, 17 aa, Cryptosporidium hominis
MAHILLCGVPPFAGNTD

SEQ ID NO: 2193858 - protein, 28 aa, Cryptosporidium hominis
MAKIGWSRFDSFFRKIPMGAKKDIILKT

SEQ ID NO: 2193859 - protein, 19 aa, Cryptosporidium hominis
MAKRRQLMSVFRTYIDILH

SEQ ID NO: 2193860 - protein, 27 aa, Cryptosporidium hominis
MAKSRNWTKFPILLKYDDLLIMEKSIF

SEQ ID NO: 2193861 - protein, 17 aa, Cryptosporidium hominis
MALELNPNWFALLVSIV

SEQ ID NO: 2193862 - protein, 24 aa, Cryptosporidium hominis
MALLELEIKTLAYILSREIKTSFQ

SEQ ID NO: 2193863 - protein, 36 aa, Cryptosporidium hominis
MALSHYAMGFLLKKGYLAIQPPYFMKRDLMGKAAEL

SEQ ID NO: 2193864 - protein, 18 aa, Cryptosporidium hominis
MALTLMSHFDFNASDIIF

SEQ ID NO: 2193865 - protein, 20 aa, Cryptosporidium hominis
MAMLWNVDTLRRARPTPLDE

SEQ ID NO: 2193866 - protein, 23 aa, Cryptosporidium hominis
MANYYLQQQVAYATAANLAISSN

SEQ ID NO: 2193867 - protein, 22 aa, Cryptosporidium hominis
MASFVSLHRPLLSEYDFRSDIK

SEQ ID NO: 2193868 - protein, 20 aa, Cryptosporidium hominis
MASPFMFQQGINQSFNNGMM

SEQ ID NO: 2193869 - protein, 25 aa, Cryptosporidium hominis
MAVLETGLFKAPIYHHPRRQRNLQA

SEQ ID NO: 2193870 - protein, 20 aa, Cryptosporidium hominis
MAVVLILGSYRNEEFIRIGY

SEQ ID NO: 2193871 - protein, 17 aa, Cryptosporidium hominis
MCANRRPIVQRYICRIC

SEQ ID NO: 2193872 - protein, 19 aa, Cryptosporidium hominis
MDESIFGSDLLDLDYTCGN

SEQ ID NO: 2193873 - protein, 29 aa, Cryptosporidium hominis
MDGIRLNGKIDLLRGIQIAQLALKHRLNK

SEQ ID NO: 2193874 - protein, 33 aa, Cryptosporidium hominis
MDIETALLEIDPHPAISKLPLSDTRLLGIDTDD

SEQ ID NO: 2193875 - protein, 25 aa, Cryptosporidium hominis
MDIHRTLHNFPTPIPGRHLTLHIGV

SEQ ID NO: 2193876 - protein, 24 aa, Cryptosporidium hominis
MDKVLCHPWFNLAKNTPIINHHIY

SEQ ID NO: 2193877 - protein, 19 aa, Cryptosporidium hominis
MDLEDVFQRPWYISTIARD

SEQ ID NO: 2193878 - protein, 19 aa, Cryptosporidium hominis
MDLFFSDVLALKKIINAHR

SEQ ID NO: 2193879 - protein, 18 aa, Cryptosporidium hominis
MDLSNICHVLLSLDFDRK

SEQ ID NO: 2193880 - protein, 23 aa, Cryptosporidium hominis
MDSLITMLRLACIHPQLGIMGIH

SEQ ID NO: 2193881 - protein, 25 aa, Cryptosporidium hominis
MDYYSRLRYVFPNNEYYLNSHFNTE

SEQ ID NO: 2193882 - protein, 17 aa, Cryptosporidium hominis
MECAPVDGEYQLVSGFP

SEQ ID NO: 2193883 - protein, 25 aa, Cryptosporidium hominis
MEDISLLPGWILRNLSLMREIDKKS

SEQ ID NO: 2193884 - protein, 25 aa, Cryptosporidium hominis
MEDNNHILLMKWSRMHKTKRDRDEN

SEQ ID NO: 2193885 - protein, 17 aa, Cryptosporidium hominis
MEEPYCRILFSDNIEEI

SEQ ID NO: 2193886 - protein, 34 aa, Cryptosporidium hominis
MEIDNIRFIYQAIDNIYLILMTPINSNIIEDMDT

SEQ ID NO: 2193887 - protein, 18 aa, Cryptosporidium hominis
MEIKLMISSHKEDIDKMN

SEQ ID NO: 2193888 - protein, 23 aa, Cryptosporidium hominis
MEKIDLTLLNRLLRLITDHNIAD

SEQ ID NO: 2193889 - protein, 18 aa, Cryptosporidium hominis
MERAFKMFDKDGSGKIST

SEQ ID NO: 2193890 - protein, 17 aa, Cryptosporidium hominis
MERISINLPKFQKHQFE

SEQ ID NO: 2193891 - protein, 30 aa, Cryptosporidium hominis
MERLAVEGKFICKEYGKQKVYLIDQSDCKE

SEQ ID NO: 2193892 - protein, 27 aa, Cryptosporidium hominis
MERLNEIISMRLSYNQDLISLQSTLDI

SEQ ID NO: 2193893 - protein, 20 aa, Cryptosporidium hominis
MESAYLLYLKTRTPSSKESL

SEQ ID NO: 2193894 - protein, 28 aa, Cryptosporidium hominis
MESKVPLMHRVLGFPLSFNHANPKTIAE

SEQ ID NO: 2193895 - protein, 24 aa, Cryptosporidium hominis
METLSWLKNHGLNKMALIISQERE

SEQ ID NO: 2193896 - protein, 21 aa, Cryptosporidium hominis
MEVRKTLMGSILLSGGTSLTT

SEQ ID NO: 2193897 - protein, 29 aa, Cryptosporidium hominis
MEYSLTVIVPILEELLGKSVIFAKDCVGK

SEQ ID NO: 2193898 - protein, 18 aa, Cryptosporidium hominis
MFHACVYKTKIISAAPPS

SEQ ID NO: 2193899 - protein, 17 aa, Cryptosporidium hominis
MFMKNYYQLLSLERQNT

SEQ ID NO: 2193900 - protein, 17 aa, Cryptosporidium hominis
MFNFRQTPSLTLGCGSW

SEQ ID NO: 2193901 - protein, 17 aa, Cryptosporidium hominis
MFPDLFSSKYNQKSSRS

SEQ ID NO: 2193902 - protein, 30 aa, Cryptosporidium hominis
MFSLFENAYLGLVLVLVLELAFKLKLGVVS

SEQ ID NO: 2193903 - protein, 20 aa, Cryptosporidium hominis
MFSYETFVLGCILTGCDYVK

SEQ ID NO: 2193904 - protein, 24 aa, Cryptosporidium hominis
MGADILHALGFNRTSNSDDSDTAD

SEQ ID NO: 2193905 - protein, 21 aa, Cryptosporidium hominis
MGCDFGITRCQYSHNIYWPRR

SEQ ID NO: 2193906 - protein, 26 aa, Cryptosporidium hominis
MGDDGFHAIFPLLTQVKSLGKLDLGM

SEQ ID NO: 2193907 - protein, 17 aa, Cryptosporidium hominis
MGELLRFRPGVFDGAIS

SEQ ID NO: 2193908 - protein, 17 aa, Cryptosporidium hominis
MGFLHISTDYRNVFTSN

SEQ ID NO: 2193909 - protein, 22 aa, Cryptosporidium hominis
MGGCFLNFRRLILANVNFTYFC

SEQ ID NO: 2193910 - protein, 20 aa, Cryptosporidium hominis
MGGELNCIFRKIKFDIPTEC

SEQ ID NO: 2193911 - protein, 20 aa, Cryptosporidium hominis
MGGIEYGVVRNFLLEKSRVI

SEQ ID NO: 2193912 - protein, 17 aa, Cryptosporidium hominis
MGKGSFKYAWVLDKLKA

SEQ ID NO: 2193913 - protein, 23 aa, Cryptosporidium hominis
MGKMYGIILIPEGLIEFIPEMKI

SEQ ID NO: 2193914 - protein, 19 aa, Cryptosporidium hominis
MGLGMTPPGSILSTIYDEN

SEQ ID NO: 2193915 - protein, 18 aa, Cryptosporidium hominis
MGNVIKWLKKQICKINPS

SEQ ID NO: 2193916 - protein, 17 aa, Cryptosporidium hominis
MGPLIGPFDYFYSTHRP

SEQ ID NO: 2193917 - protein, 25 aa, Cryptosporidium hominis
MGQNYQYYYPVNNQGYYNYGQYYYD

SEQ ID NO: 2193918 - protein, 27 aa, Cryptosporidium hominis
MGTHFTLMGSIFPNQLPPGIQNHVPTT

SEQ ID NO: 2193919 - protein, 19 aa, Cryptosporidium hominis
MGVLGLNKTLPIRLSDEFL

SEQ ID NO: 2193920 - protein, 19 aa, Cryptosporidium hominis
MGYSRNISSLRRPDERRKL

SEQ ID NO: 2193921 - protein, 17 aa, Cryptosporidium hominis
MHDWQFYDKKRIMELHK

SEQ ID NO: 2193922 - protein, 24 aa, Cryptosporidium hominis
MHGKLPTLKISLIQIFRAHLWQKI

SEQ ID NO: 2193923 - protein, 17 aa, Cryptosporidium hominis
MHGYMKCLFSRPIQQNE

SEQ ID NO: 2193924 - protein, 17 aa, Cryptosporidium hominis
MHLKLVRGKPLYVGLHE

SEQ ID NO: 2193925 - protein, 20 aa, Cryptosporidium hominis
MHLNLYQIASFLCREDLEIP

SEQ ID NO: 2193926 - protein, 26 aa, Cryptosporidium hominis
MHQNHLCIVFEWLHGSLKNCIHHFSK

SEQ ID NO: 2193927 - protein, 24 aa, Cryptosporidium hominis
MHSCREFMYYSDIYDLQNFIKVFY

SEQ ID NO: 2193928 - protein, 19 aa, Cryptosporidium hominis
MHWQSVYKAIKYYLNSLRS

SEQ ID NO: 2193929 - protein, 18 aa, Cryptosporidium hominis
MIAKIQLLYNNSSTYFKN

SEQ ID NO: 2193930 - protein, 26 aa, Cryptosporidium hominis
MIDNQAQILPYNKPLKNLVNTIAGIC

SEQ ID NO: 2193931 - protein, 20 aa, Cryptosporidium hominis
MIEKMTPFYTPGILSYLAAC

SEQ ID NO: 2193932 - protein, 31 aa, Cryptosporidium hominis
MIEKYRLISIYRFYYACFLKDLCNPMMTFEL

SEQ ID NO: 2193933 - protein, 18 aa, Cryptosporidium hominis
MIESWVIKLLQRHPSHYG

SEQ ID NO: 2193934 - protein, 18 aa, Cryptosporidium hominis
MIEYIAVWGIINEDDHLL

SEQ ID NO: 2193935 - protein, 19 aa, Cryptosporidium hominis
MIFYRPKVLSTSILLLLCL

SEQ ID NO: 2193936 - protein, 26 aa, Cryptosporidium hominis
MIGRGALLKPWIFTEIKENRNWDISA

SEQ ID NO: 2193937 - protein, 24 aa, Cryptosporidium hominis
MIHIRAQPLLRYGDGPICLVLAPT

SEQ ID NO: 2193938 - protein, 28 aa, Cryptosporidium hominis
MIHRRRHSLSYKPNIKKGVRRTDKSRIP

SEQ ID NO: 2193939 - protein, 17 aa, Cryptosporidium hominis
MILMSELSKRRIRSVNK

SEQ ID NO: 2193940 - protein, 18 aa, Cryptosporidium hominis
MILSFLPCLRITNAYKYA

SEQ ID NO: 2193941 - protein, 20 aa, Cryptosporidium hominis
MINFKRFRDICDKVKAYLMV

SEQ ID NO: 2193942 - protein, 17 aa, Cryptosporidium hominis
MINHSIFSLKKHVFLLL

SEQ ID NO: 2193943 - protein, 23 aa, Cryptosporidium hominis
MINKIVVWPWHQQRMRVTKSRAS

SEQ ID NO: 2193944 - protein, 19 aa, Cryptosporidium hominis
MINQSLLTLGRVINALVEH

SEQ ID NO: 2193945 - protein, 34 aa, Cryptosporidium hominis
MIQITQEYLKPGGKLLIFTPFMTTELLQIHQDLS

SEQ ID NO: 2193946 - protein, 19 aa, Cryptosporidium hominis
MIQNLRKVIWNSILGLERF

SEQ ID NO: 2193947 - protein, 25 aa, Cryptosporidium hominis
MIQNPSKVFYLYEPFSKKITRETYS

SEQ ID NO: 2193948 - protein, 28 aa, Cryptosporidium hominis
MIRGADINKLYLDLIQKSQQNVQVFKTC

SEQ ID NO: 2193949 - protein, 18 aa, Cryptosporidium hominis
MIRRAIALDMEKIPKTYK

SEQ ID NO: 2193950 - protein, 18 aa, Cryptosporidium hominis
MISNNFLQQLHTPGIDIL

SEQ ID NO: 2193951 - protein, 21 aa, Cryptosporidium hominis
MITNIFFHYRAYDLSAGIMIA

SEQ ID NO: 2193952 - protein, 24 aa, Cryptosporidium hominis
MITTQRKLWSILINTKISAQEQEE

SEQ ID NO: 2193953 - protein, 38 aa, Cryptosporidium hominis
MKDNISLNKLKSHKIFAVFLRYLQKKGIKYPRNNYGND

SEQ ID NO: 2193954 - protein, 26 aa, Cryptosporidium hominis
MKEIFTSKLAIVPLIFGIQGSNKSSV

SEQ ID NO: 2193955 - protein, 17 aa, Cryptosporidium hominis
MKGLLGENVEGGSGSNN

SEQ ID NO: 2193956 - protein, 30 aa, Cryptosporidium hominis
MKIPSHAIKIFPITFLPSIKILEIGLSDKR

SEQ ID NO: 2193957 - protein, 23 aa, Cryptosporidium hominis
MKKYLIVHWDLSKDSGFEVLKNL

SEQ ID NO: 2193958 - protein, 26 aa, Cryptosporidium hominis
MKNHKRWIMSLPISGKIFLDKGAIKS

SEQ ID NO: 2193959 - protein, 21 aa, Cryptosporidium hominis
MKNLEQLTWAFGLLEENSDSI

SEQ ID NO: 2193960 - protein, 19 aa, Cryptosporidium hominis
MKPPENVLFVCKLNPVTQD

SEQ ID NO: 2193961 - protein, 24 aa, Cryptosporidium hominis
MKQDFVPYLPHLLPGIFNILETRE

SEQ ID NO: 2193962 - protein, 21 aa, Cryptosporidium hominis
MKRSFSLEFLSQALGDDTPEK

SEQ ID NO: 2193963 - protein, 19 aa, Cryptosporidium hominis
MKRYFLNILRSNNAKFKIV

SEQ ID NO: 2193964 - protein, 19 aa, Cryptosporidium hominis
MKSPLVKNALRRLNKSDIL

SEQ ID NO: 2193965 - protein, 22 aa, Cryptosporidium hominis
MKYFVSAGCIAVRRVEKVDLRR

SEQ ID NO: 2193966 - protein, 19 aa, Cryptosporidium hominis
MLAFELITFLLRSGGNFEE

SEQ ID NO: 2193967 - protein, 18 aa, Cryptosporidium hominis
MLDLFLKERYNAVIHFAG

SEQ ID NO: 2193968 - protein, 17 aa, Cryptosporidium hominis
MLELLNQLDGFESTQNI

SEQ ID NO: 2193969 - protein, 17 aa, Cryptosporidium hominis
MLELLNQLDGFSSDDRV

SEQ ID NO: 2193970 - protein, 18 aa, Cryptosporidium hominis
MLEMLKRVGRSELVVGWY

SEQ ID NO: 2193971 - protein, 19 aa, Cryptosporidium hominis
MLISSPLLCYGSMKMNSDI

SEQ ID NO: 2193972 - protein, 17 aa, Cryptosporidium hominis
MLKNIWNLSQEKANTNP

SEQ ID NO: 2193973 - protein, 18 aa, Cryptosporidium hominis
MLKRCILALKRKSLIRLG

SEQ ID NO: 2193974 - protein, 20 aa, Cryptosporidium hominis
MLKRSCSTPLLYSMNNAYPN

SEQ ID NO: 2193975 - protein, 17 aa, Cryptosporidium hominis
MLLFIDEAEAFLSKGRE

SEQ ID NO: 2193976 - protein, 31 aa, Cryptosporidium hominis
MLLSDAPTHRIFVLLPPFDPNTKSIPPILVA

SEQ ID NO: 2193977 - protein, 19 aa, Cryptosporidium hominis
MLMDVYFDDFISWNNLNSQ

SEQ ID NO: 2193978 - protein, 25 aa, Cryptosporidium hominis
MLNDKVNVFFHYLDGFFGAIGAYLS

SEQ ID NO: 2193979 - protein, 29 aa, Cryptosporidium hominis
MLNWEMEFKRWLPCFKVITYFGTPKERQK

SEQ ID NO: 2193980 - protein, 21 aa, Cryptosporidium hominis
MLQIGRNFSLPSWVQLRNIRD

SEQ ID NO: 2193981 - protein, 18 aa, Cryptosporidium hominis
MLSAMAYVSSFADEIVRQ

SEQ ID NO: 2193982 - protein, 20 aa, Cryptosporidium hominis
MLSIYERHQIFINLKVNNIL

SEQ ID NO: 2193983 - protein, 32 aa, Cryptosporidium hominis
MLYSCSVMYRCKLPFILIFNKIDVTDHLLCTK

SEQ ID NO: 2193984 - protein, 17 aa, Cryptosporidium hominis
MLYTFDMRKLNIARFIY

SEQ ID NO: 2193985 - protein, 19 aa, Cryptosporidium hominis
MMDLMIIPLKIVGKLIERF

SEQ ID NO: 2193986 - protein, 20 aa, Cryptosporidium hominis
MMLYLMVRDRWEALVYNRNS

SEQ ID NO: 2193987 - protein, 17 aa, Cryptosporidium hominis
MMNLPLQQRQELERIEK

SEQ ID NO: 2193988 - protein, 20 aa, Cryptosporidium hominis
MNALIMKIQKHEFDLSGKFQ

SEQ ID NO: 2193989 - protein, 20 aa, Cryptosporidium hominis
MNEIARFCPSIKAVKFLGNG

SEQ ID NO: 2193990 - protein, 17 aa, Cryptosporidium hominis
MNGGSIAIPLIENIIQS

SEQ ID NO: 2193991 - protein, 36 aa, Cryptosporidium hominis
MNGTCGGFVPCFPGTYLNMHYDPHFGNFPGNNYNRS

SEQ ID NO: 2193992 - protein, 17 aa, Cryptosporidium hominis
MNIFSPYSQDKFKRTRE

SEQ ID NO: 2193993 - protein, 19 aa, Cryptosporidium hominis
MNIPLRLVDMIRKRIFSQV

SEQ ID NO: 2193994 - protein, 40 aa, Cryptosporidium hominis
MNKENPIFSPLMIRNINALRIYWDYYSRGILQESVKIRNG

SEQ ID NO: 2193995 - protein, 18 aa, Cryptosporidium hominis
MNKPWIILTFAFNSREFT

SEQ ID NO: 2193996 - protein, 25 aa, Cryptosporidium hominis
MNLDNLWQLCIFKNQSIGLILSNHK

SEQ ID NO: 2193997 - protein, 18 aa, Cryptosporidium hominis
MNNQLKDGFIRNLLMNHN

SEQ ID NO: 2193998 - protein, 24 aa, Cryptosporidium hominis
MNNYELGTIVLRRLCISESSEIKA

SEQ ID NO: 2193999 - protein, 30 aa, Cryptosporidium hominis
MNPGLFQTPLFINPFYNSTSCPSCYFSWLR

SEQ ID NO: 2194000 - protein, 19 aa, Cryptosporidium hominis
MNPQLFIAETSIPGQWFKA

SEQ ID NO: 2194001 - protein, 23 aa, Cryptosporidium hominis
MNPTSSINFYNSMTGGVGGGHGI

SEQ ID NO: 2194002 - protein, 20 aa, Cryptosporidium hominis
MNQYLQQQLVFQQTLQEQMR

SEQ ID NO: 2194003 - protein, 30 aa, Cryptosporidium hominis
MNTALYNDPALLQLYFTNLFQGNHGFMPPM

SEQ ID NO: 2194004 - protein, 20 aa, Cryptosporidium hominis
MNVYFQTQLLKKGLQNVVVS

SEQ ID NO: 2194005 - protein, 27 aa, Cryptosporidium hominis
MNWSNMQIVFQSYLRQLQTITLLEEYS

SEQ ID NO: 2194006 - protein, 33 aa, Cryptosporidium hominis
MNYSSKYCLLKNKYLFLGIEFLNETLEKIISSR

SEQ ID NO: 2194007 - protein, 36 aa, Cryptosporidium hominis
MPESKFLGPLMPWEYYEPWDPILRPTLDLGGVMAIY

SEQ ID NO: 2194008 - protein, 19 aa, Cryptosporidium hominis
MPIWYYRKKKNMSLYAFGG

SEQ ID NO: 2194009 - protein, 20 aa, Cryptosporidium hominis
MPKLLGSYFIKANKMPIAIK

SEQ ID NO: 2194010 - protein, 23 aa, Cryptosporidium hominis
MPLLAHLKVYTRQSDLRHILIHM

SEQ ID NO: 2194011 - protein, 24 aa, Cryptosporidium hominis
MPLNSFIEIFGFYIESIESLKLFT

SEQ ID NO: 2194012 - protein, 28 aa, Cryptosporidium hominis
MPNVAPPPLPIYQQPPGYPLSNGPAPYQ

SEQ ID NO: 2194013 - protein, 17 aa, Cryptosporidium hominis
MPSGSVIPPFLRGSQGA

SEQ ID NO: 2194014 - protein, 25 aa, Cryptosporidium hominis
MQALILALHKEKFAMALELNPNWFA

SEQ ID NO: 2194015 - protein, 21 aa, Cryptosporidium hominis
MQDFLKKRSFPTEFMKLMVID

SEQ ID NO: 2194016 - protein, 24 aa, Cryptosporidium hominis
MQPCGFCFVQYYNHADALTAVTFL

SEQ ID NO: 2194017 - protein, 19 aa, Cryptosporidium hominis
MQQDPAISSSIDCAMFSGF

SEQ ID NO: 2194018 - protein, 18 aa, Cryptosporidium hominis
MQQQFPSCQCGTNYFNTQ

SEQ ID NO: 2194019 - protein, 17 aa, Cryptosporidium hominis
MQSIIRPEMKLIDMCNI

SEQ ID NO: 2194020 - protein, 25 aa, Cryptosporidium hominis
MQTDTIHPAFIQLLKLKTNSELKDE

SEQ ID NO: 2194021 - protein, 25 aa, Cryptosporidium hominis
MRAGISLLEYLLSQGFLDEDTIMEG

SEQ ID NO: 2194022 - protein, 19 aa, Cryptosporidium hominis
MRCLRHKKLKALIVAPDIE

SEQ ID NO: 2194023 - protein, 19 aa, Cryptosporidium hominis
MRDRFYQQMRLLVASIKIS

SEQ ID NO: 2194024 - protein, 34 aa, Cryptosporidium hominis
MREDPVLMQIIPPYRSFIPSILMNLIIIDKKDIN

SEQ ID NO: 2194025 - protein, 28 aa, Cryptosporidium hominis
MRFFLIKFFPILLFSTRINNGLFIRNYE

SEQ ID NO: 2194026 - protein, 24 aa, Cryptosporidium hominis
MRKLNIARFIYKGFVHAVLDVDYN

SEQ ID NO: 2194027 - protein, 23 aa, Cryptosporidium hominis
MRLKEWYGWHFPELGKIISDRDV

SEQ ID NO: 2194028 - protein, 26 aa, Cryptosporidium hominis
MRLRDPKCTGLLFRSGRLMITGARLE

SEQ ID NO: 2194029 - protein, 28 aa, Cryptosporidium hominis
MRQEAVSMLPVLFLDVKPNHYVLDLCSA

SEQ ID NO: 2194030 - protein, 18 aa, Cryptosporidium hominis
MRRILSKDRLKPSIYLTK

SEQ ID NO: 2194031 - protein, 23 aa, Cryptosporidium hominis
MRYPLLSMQGLFQPLAKIVESNT

SEQ ID NO: 2194032 - protein, 24 aa, Cryptosporidium hominis
MSCSNLNIYYPIQTTQRKSNETDS

SEQ ID NO: 2194033 - protein, 27 aa, Cryptosporidium hominis
MSELQLQLVGIMDMFMATSPASFTVHG

SEQ ID NO: 2194034 - protein, 27 aa, Cryptosporidium hominis
MSGMGTVHPQYYVVPSPLGVSGINNTT

SEQ ID NO: 2194035 - protein, 18 aa, Cryptosporidium hominis
MSHLYIYKYNEDGLKFKN

SEQ ID NO: 2194036 - protein, 17 aa, Cryptosporidium hominis
MSILRPKYPTHVVTKQG

SEQ ID NO: 2194037 - protein, 19 aa, Cryptosporidium hominis
MSLFDFCKTIEKFTFHTET

SEQ ID NO: 2194038 - protein, 17 aa, Cryptosporidium hominis
MSLIKNYSRYNKNSKKS

SEQ ID NO: 2194039 - protein, 31 aa, Cryptosporidium hominis
MSMPKLSFLKLPIFSLNKIYNLRLFSQINSF

SEQ ID NO: 2194040 - protein, 33 aa, Cryptosporidium hominis
MSNPKDYPVILLERPFFPIELSNYIKQILLENY

SEQ ID NO: 2194041 - protein, 19 aa, Cryptosporidium hominis
MSPNNTIRRKFIVGITETA

SEQ ID NO: 2194042 - protein, 24 aa, Cryptosporidium hominis
MSQPNGIIQLPKGLKISMIKCESD

SEQ ID NO: 2194043 - protein, 28 aa, Cryptosporidium hominis
MSQYSALETMRKLYYATQEYMEKWPSSD

SEQ ID NO: 2194044 - protein, 35 aa, Cryptosporidium hominis
MSSCNLNVITLRKLYAILSICFNINLLNIDIQNVY

SEQ ID NO: 2194045 - protein, 28 aa, Cryptosporidium hominis
MSSDMWGFGCILMELYTGVLLFKTHEHM

SEQ ID NO: 2194046 - protein, 25 aa, Cryptosporidium hominis
MSSFPGSYSIWKKLCLKLLNLPYHP

SEQ ID NO: 2194047 - protein, 23 aa, Cryptosporidium hominis
MSTRQWLMNLYRIPQIQENNKNS

SEQ ID NO: 2194048 - protein, 18 aa, Cryptosporidium hominis
MSYIFFSTYGRKFADKIS

SEQ ID NO: 2194049 - protein, 24 aa, Cryptosporidium hominis
MSYLVMRHFCTCHSYIDKVVLQKK

SEQ ID NO: 2194050 - protein, 23 aa, Cryptosporidium hominis
MTAPCIPILAAKKLTIEGLNWPR

SEQ ID NO: 2194051 - protein, 18 aa, Cryptosporidium hominis
MTDGILLREFLSEPDLKN

SEQ ID NO: 2194052 - protein, 19 aa, Cryptosporidium hominis
MTGKFWDIVTRILKSLTGH

SEQ ID NO: 2194053 - protein, 28 aa, Cryptosporidium hominis
MTGTAMMLRLYRYYKQTKLLEKQVIQLS

SEQ ID NO: 2194054 - protein, 17 aa, Cryptosporidium hominis
MTIDGIFDSLLTRDVHA

SEQ ID NO: 2194055 - protein, 27 aa, Cryptosporidium hominis
MTKDNHLLGKFHLDGIPPAPRGVPQIE

SEQ ID NO: 2194056 - protein, 27 aa, Cryptosporidium hominis
MTPREFYNPVIDLPTWRRMRTQAELRR

SEQ ID NO: 2194057 - protein, 17 aa, Cryptosporidium hominis
MTQKILERDPREEILKA

SEQ ID NO: 2194058 - protein, 26 aa, Cryptosporidium hominis
MTRMDRLLNFLSFVQDLFKNYCSPEI

SEQ ID NO: 2194059 - protein, 28 aa, Cryptosporidium hominis
MTSKQVWGPINLFYPDVKSTFTYIPDLE

SEQ ID NO: 2194060 - protein, 19 aa, Cryptosporidium hominis
MTVGKLLELISSKASVLDG

SEQ ID NO: 2194061 - protein, 24 aa, Cryptosporidium hominis
MTVNQNFIISLNKALLLYNESGFK

SEQ ID NO: 2194062 - protein, 17 aa, Cryptosporidium hominis
MTVRRFLTATGHAISLF

SEQ ID NO: 2194063 - protein, 26 aa, Cryptosporidium hominis
MVAKEKLSFWMDLPCNMDRKKAKTGI

SEQ ID NO: 2194064 - protein, 33 aa, Cryptosporidium hominis
MVDIFSLLHLNRGFNYLWTSLEYWSIVCRGRRN

SEQ ID NO: 2194065 - protein, 17 aa, Cryptosporidium hominis
MVDKVVTPLLIAVGGKD

SEQ ID NO: 2194066 - protein, 24 aa, Cryptosporidium hominis
MVDKYISFLRRQAARPVISYTFKQ

SEQ ID NO: 2194067 - protein, 28 aa, Cryptosporidium hominis
MVEMNHFPNLLYFLNKQAGKKVALSLIN

SEQ ID NO: 2194068 - protein, 41 aa, Cryptosporidium hominis
MVIELKGYIRILLKLIDIKASQVGLLLLNKVQRKSFKKLST

SEQ ID NO: 2194069 - protein, 29 aa, Cryptosporidium hominis
MVNPNIEFLRFGFLFSKDILAPFEMAISQ

SEQ ID NO: 2194070 - protein, 22 aa, Cryptosporidium hominis
MVRRRLTLYRYNEFREFSIQVI

SEQ ID NO: 2194071 - protein, 40 aa, Cryptosporidium hominis
MVSEKGYDYCLLYFELLRDGLINAHLWRDTTIEELDLAIT

SEQ ID NO: 2194072 - protein, 25 aa, Cryptosporidium hominis
MVSNYLNIYYGNMLKHQFFGDNSEG

SEQ ID NO: 2194073 - protein, 17 aa, Cryptosporidium hominis
MVSPLQSFRTPRLENQN

SEQ ID NO: 2194074 - protein, 21 aa, Cryptosporidium hominis
MVTINIFKFRIIIAKDLDDAM

SEQ ID NO: 2194075 - protein, 25 aa, Cryptosporidium hominis
MVTSVFTPRKLFGIVITGLGFNMST

SEQ ID NO: 2194076 - protein, 20 aa, Cryptosporidium hominis
MVYRIFYSWKLKMIELRSLK

SEQ ID NO: 2194077 - protein, 19 aa, Cryptosporidium hominis
MWYKDQAIGLYILQANFMI

SEQ ID NO: 2194078 - protein, 18 aa, Cryptosporidium hominis
MYALSKFIWERIKNIFNY

SEQ ID NO: 2194079 - protein, 22 aa, Cryptosporidium hominis
MYEQFQNMLNMGSPSALLSMIP

SEQ ID NO: 2194080 - protein, 24 aa, Cryptosporidium hominis
MYLKQRIMKISEFPDFSIANSRTN

SEQ ID NO: 2194081 - protein, 36 aa, Cryptosporidium hominis
MYNQNNRIIGAWLLEGITLILYKNGVLKALHNYLGR

SEQ ID NO: 2194082 - protein, 30 aa, Cryptosporidium hominis
MYQKYTHLSRILTNTFYGRYISDLGCYLQP

SEQ ID NO: 2194083 - protein, 23 aa, Cryptosporidium hominis
MYQRLLTKFYTFLFGRKHHFLEF

SEQ ID NO: 2194084 - protein, 35 aa, Cryptosporidium hominis
MYTERLLSRSSLRRMLNRPSTLFRLPIIERREMNN

SEQ ID NO: 2194085 - protein, 30 aa, Cryptosporidium hominis
MYVREVLDKLYFYPHFRGVKPSSSLKLKEL

SEQ ID NO: 2194086 - protein, 20 aa, Cryptosporidium hominis
NAAFNIQKNLQSSFGFVEGM

SEQ ID NO: 2194087 - protein, 19 aa, Cryptosporidium hominis
NAAVRLHLEFIGEIPMTAS

SEQ ID NO: 2194088 - protein, 25 aa, Cryptosporidium hominis
NACRGVIIAGLPFPSIADARVCLKK

SEQ ID NO: 2194089 - protein, 20 aa, Cryptosporidium hominis
NADGLYFDNHSHYHVPTNYS

SEQ ID NO: 2194090 - protein, 34 aa, Cryptosporidium hominis
NADLTKFSQGYLKNLFLLSLDKNKDKINFEDGLT

SEQ ID NO: 2194091 - protein, 18 aa, Cryptosporidium hominis
NAFHLCREILRLTKLVVD

SEQ ID NO: 2194092 - protein, 31 aa, Cryptosporidium hominis
NAGALLFIKRDLTVVPKILLPSASKDPRMIL

SEQ ID NO: 2194093 - protein, 19 aa, Cryptosporidium hominis
NAGLMIYFVGFDGVDHADI

SEQ ID NO: 2194094 - protein, 24 aa, Cryptosporidium hominis
NAIKRTLKYPYIKKISTTKKYLTN

SEQ ID NO: 2194095 - protein, 21 aa, Cryptosporidium hominis
NAILPITKQNLLKLTKDGGFQ

SEQ ID NO: 2194096 - protein, 22 aa, Cryptosporidium hominis
NAKDAISSMPTLAAAVATTNKP

SEQ ID NO: 2194097 - protein, 24 aa, Cryptosporidium hominis
NALNPLDASLLTLFSLIQAQRHDE

SEQ ID NO: 2194098 - protein, 24 aa, Cryptosporidium hominis
NANQNFLKLILSPDLYYDQIELNN

SEQ ID NO: 2194099 - protein, 25 aa, Cryptosporidium hominis
NANRYQPPFLRTTSSSAFERGSNLQ

SEQ ID NO: 2194100 - protein, 26 aa, Cryptosporidium hominis
NAPSEFLVFCRVFQNGLRFPPDFPED

SEQ ID NO: 2194101 - protein, 23 aa, Cryptosporidium hominis
NAQKLLNKVPNISILTFDDDGGS

SEQ ID NO: 2194102 - protein, 29 aa, Cryptosporidium hominis
NARKIMEDFYSYSIFLFKQFERTNGRKKS

SEQ ID NO: 2194103 - protein, 24 aa, Cryptosporidium hominis
NARVHNRLKYKKALKRLKGTQRSM

SEQ ID NO: 2194104 - protein, 27 aa, Cryptosporidium hominis
NASERDIRLAFLRLVRKFHPDKNISEL

SEQ ID NO: 2194105 - protein, 18 aa, Cryptosporidium hominis
NASLLYAAALSSSTASTH

SEQ ID NO: 2194106 - protein, 17 aa, Cryptosporidium hominis
NASLSFINLVKTGGVPG

SEQ ID NO: 2194107 - protein, 25 aa, Cryptosporidium hominis
NASMEKSEYYNSRILSLCKRSRDSL

SEQ ID NO: 2194108 - protein, 25 aa, Cryptosporidium hominis
NASSIKQVFACRPDLVELGMTNFEL

SEQ ID NO: 2194109 - protein, 43 aa, Cryptosporidium hominis
NASTRSQIFTERPFFQRLTDSIYRRLIIGSSNQIKLVGLISAA

SEQ ID NO: 2194110 - protein, 17 aa, Cryptosporidium hominis
NASWFPNIDLTICTLEK

SEQ ID NO: 2194111 - protein, 17 aa, Cryptosporidium hominis
NATGHFGSGWIWVVIDP

SEQ ID NO: 2194112 - protein, 25 aa, Cryptosporidium hominis
NATNVNLFATPPPNRKGRYSVASSY

SEQ ID NO: 2194113 - protein, 42 aa, Cryptosporidium hominis
NAVISYLMGIYLRPDKYSILLSRVLWLLPHDSPDGKYLSLAF

SEQ ID NO: 2194114 - protein, 23 aa, Cryptosporidium hominis
NAVLYLFNPCWTFTLSSKTDIFD

SEQ ID NO: 2194115 - protein, 20 aa, Cryptosporidium hominis
NAYPWYQFGVCPINTAEIIE

SEQ ID NO: 2194116 - protein, 19 aa, Cryptosporidium hominis
NCCNNFTISWLNSCSNEES

SEQ ID NO: 2194117 - protein, 17 aa, Cryptosporidium hominis
NCHYMANDFTKKENKRS

SEQ ID NO: 2194118 - protein, 28 aa, Cryptosporidium hominis
NCIKQFRLVFGPLFLPRQFIKYPTESEI

SEQ ID NO: 2194119 - protein, 23 aa, Cryptosporidium hominis
NCINYLSFDLSLARGLDYYTGVI

SEQ ID NO: 2194120 - protein, 20 aa, Cryptosporidium hominis
NCIQLFHPICAWLNGVQIEV

SEQ ID NO: 2194121 - protein, 24 aa, Cryptosporidium hominis
NCLPNYLPFPIFVQIIQARKKKLP

SEQ ID NO: 2194122 - protein, 39 aa, Cryptosporidium hominis
NCLSSVGGGLPLDLSCWLPQNLTAICNPGFQSSSSSTCA

SEQ ID NO: 2194123 - protein, 34 aa, Cryptosporidium hominis
NCMNNEDNMVLYPGTKLLLSLQQGGLSKIQVQNS

SEQ ID NO: 2194124 - protein, 30 aa, Cryptosporidium hominis
NCQDYYQDFLKLIHLYTRGVLTVVETLLAL

SEQ ID NO: 2194125 - protein, 18 aa, Cryptosporidium hominis
NCRFYCKELRHPLIEAQG

SEQ ID NO: 2194126 - protein, 32 aa, Cryptosporidium hominis
NCRTSSMLDVWNLLLKPLGLSLQVVNMGGDCT

SEQ ID NO: 2194127 - protein, 19 aa, Cryptosporidium hominis
NCSDYYKIITKPMDFSLIR

SEQ ID NO: 2194128 - protein, 32 aa, Cryptosporidium hominis
NCSSKNILYFNYLRISSILVEVTYRGSVSLNN

SEQ ID NO: 2194129 - protein, 22 aa, Cryptosporidium hominis
NCVKHEKFISDFKMLSKIANNL

SEQ ID NO: 2194130 - protein, 24 aa, Cryptosporidium hominis
NCWFSLGCVALRLEKWEIAQQAFS

SEQ ID NO: 2194131 - protein, 26 aa, Cryptosporidium hominis
NDACKIFELLFFSDNTTHPFFSETSK

SEQ ID NO: 2194132 - protein, 22 aa, Cryptosporidium hominis
NDAFFFSQALRPTPLEKTIIGV

SEQ ID NO: 2194133 - protein, 25 aa, Cryptosporidium hominis
NDAQEIMLVFLQLLGSGLKGDDPLK

SEQ ID NO: 2194134 - protein, 26 aa, Cryptosporidium hominis
NDCNKMSLLFSWYTYVPNNELDTSAL

SEQ ID NO: 2194135 - protein, 24 aa, Cryptosporidium hominis
NDCSLCLRQIGISNNIPGVVLQCC

SEQ ID NO: 2194136 - protein, 23 aa, Cryptosporidium hominis
NDDDVILLLKLVKVPSSVELINF

SEQ ID NO: 2194137 - protein, 24 aa, Cryptosporidium hominis
NDDDYYFMDLPTSNNNKLSMFKKS

SEQ ID NO: 2194138 - protein, 23 aa, Cryptosporidium hominis
NDDMGYMRNLIPIGGSNSSPLHS

SEQ ID NO: 2194139 - protein, 24 aa, Cryptosporidium hominis
NDDSNLIISAQKKLLNTSPEATKE

SEQ ID NO: 2194140 - protein, 23 aa, Cryptosporidium hominis
NDESLLGSYYRLKSYKKLTSNKK

SEQ ID NO: 2194141 - protein, 18 aa, Cryptosporidium hominis
NDFYPVFKSHFFGKANLT

SEQ ID NO: 2194142 - protein, 23 aa, Cryptosporidium hominis
NDGIYDKVFGFNIPVRPDVKELL

SEQ ID NO: 2194143 - protein, 22 aa, Cryptosporidium hominis
NDGRLRFRANFNLPKKYAGEKI

SEQ ID NO: 2194144 - protein, 24 aa, Cryptosporidium hominis
NDHDVFLYYNKRPIDKMIEYLTTF

SEQ ID NO: 2194145 - protein, 25 aa, Cryptosporidium hominis
NDIEINLWFCIKYLEYYGSGRKHER

SEQ ID NO: 2194146 - protein, 23 aa, Cryptosporidium hominis
NDIRFYIYQILKALDFCHSQGIM

SEQ ID NO: 2194147 - protein, 30 aa, Cryptosporidium hominis
NDISIFISSLYYYLTPLISEGIYWKFKNKL

SEQ ID NO: 2194148 - protein, 23 aa, Cryptosporidium hominis
NDKELELLFQKIKKFMREKYGEY

SEQ ID NO: 2194149 - protein, 30 aa, Cryptosporidium hominis
NDKKDGDGKFTWPDGRAYIGQWKNGKQHGI

SEQ ID NO: 2194150 - protein, 24 aa, Cryptosporidium hominis
NDKMHTLLKFLIKSLVELKNDGEK

SEQ ID NO: 2194151 - protein, 24 aa, Cryptosporidium hominis
NDKNLLINQYIKNQRKKFISESIY

SEQ ID NO: 2194152 - protein, 17 aa, Cryptosporidium hominis
NDKRYEGVLHSIDVDKS

SEQ ID NO: 2194153 - protein, 19 aa, Cryptosporidium hominis
NDLIPRWLHDWLSELLTCM

SEQ ID NO: 2194154 - protein, 27 aa, Cryptosporidium hominis
NDLRVHPDFRLLYQSSAPFQETNNLGE

SEQ ID NO: 2194155 - protein, 31 aa, Cryptosporidium hominis
NDLSPHKIWLYLDHWLFWLSLTNENNNSSNQ

SEQ ID NO: 2194156 - protein, 23 aa, Cryptosporidium hominis
NDLTLFLLRKEQLSLFAENENLM

SEQ ID NO: 2194157 - protein, 19 aa, Cryptosporidium hominis
NDLYLLTYENCKDKYHVSL

SEQ ID NO: 2194158 - protein, 25 aa, Cryptosporidium hominis
NDNFFDYEILLPTKSQLEDYSILSL

SEQ ID NO: 2194159 - protein, 17 aa, Cryptosporidium hominis
NDNIVLSERRRILASNR

SEQ ID NO: 2194160 - protein, 26 aa, Cryptosporidium hominis
NDNNNKELMWKCLVCSQVFESRNKLF

SEQ ID NO: 2194161 - protein, 26 aa, Cryptosporidium hominis
NDPDSARFMILIRNAMEDLQHQVETE

SEQ ID NO: 2194162 - protein, 24 aa, Cryptosporidium hominis
NDPEGLHILVRYNEPRELEIVEAI

SEQ ID NO: 2194163 - protein, 35 aa, Cryptosporidium hominis
NDPMYDLLLLNEMSFRLIFKWFKETFKSLKLKSTY

SEQ ID NO: 2194164 - protein, 31 aa, Cryptosporidium hominis
NDQGELEVLEPYEILIIPKRDNTVTIRDVSH

SEQ ID NO: 2194165 - protein, 25 aa, Cryptosporidium hominis
NDQLYNIIKIIKAVMFLGNITFIEN

SEQ ID NO: 2194166 - protein, 24 aa, Cryptosporidium hominis
NDRNFYIVDFICEIPVNIKTLFMK

SEQ ID NO: 2194167 - protein, 35 aa, Cryptosporidium hominis
NDSELRATFFDVLEIFLLTIYKFREKLSSSSDIFS

SEQ ID NO: 2194168 - protein, 17 aa, Cryptosporidium hominis
NDSFLFNPIPFVEDLRN

SEQ ID NO: 2194169 - protein, 23 aa, Cryptosporidium hominis
NDSGFFQIIPATSNLPELSIPVT

SEQ ID NO: 2194170 - protein, 25 aa, Cryptosporidium hominis
NDSIFYFIVPIINLLSRDPSLITDF

SEQ ID NO: 2194171 - protein, 23 aa, Cryptosporidium hominis
NDSVVIGIFFSTLGRQGSFAIVE

SEQ ID NO: 2194172 - protein, 22 aa, Cryptosporidium hominis
NDTLSFIPDERLNHLIMPMNKS

SEQ ID NO: 2194173 - protein, 23 aa, Cryptosporidium hominis
NDTLSRLEKNKFVFGRKGDCSIR

SEQ ID NO: 2194174 - protein, 24 aa, Cryptosporidium hominis
NDVRAVLGDGPWISKMSIYEEGWD

SEQ ID NO: 2194175 - protein, 31 aa, Cryptosporidium hominis
NDVVSSKLWGKFKSIPYFVVLEICKESFKEI

SEQ ID NO: 2194176 - protein, 20 aa, Cryptosporidium hominis
NEARWLFSQIFNAVINLHNK

SEQ ID NO: 2194177 - protein, 27 aa, Cryptosporidium hominis
NECATWINEFIIPSILLPYIENRTHSI

SEQ ID NO: 2194178 - protein, 17 aa, Cryptosporidium hominis
NEDFPEYYHDLFPQFND

SEQ ID NO: 2194179 - protein, 19 aa, Cryptosporidium hominis
NEDLPFNKMQFIWSSELDE

SEQ ID NO: 2194180 - protein, 33 aa, Cryptosporidium hominis
NEDSAFNGFIPLKPIGWRKRSFSKENSTILIET

SEQ ID NO: 2194181 - protein, 26 aa, Cryptosporidium hominis
NEEDSFEWQLKYKNKMKGNMIFMASL

SEQ ID NO: 2194182 - protein, 25 aa, Cryptosporidium hominis
NEEITKVLLPYYIDVNFDGISQFES

SEQ ID NO: 2194183 - protein, 23 aa, Cryptosporidium hominis
NEELLDLYGFYKQATVGDAPEKS

SEQ ID NO: 2194184 - protein, 24 aa, Cryptosporidium hominis
NEEPLFNIFLVKLFNNHNSEEAIL

SEQ ID NO: 2194185 - protein, 27 aa, Cryptosporidium hominis
NEFKSFVSSFGFISFLANLRNENERIF

SEQ ID NO: 2194186 - protein, 28 aa, Cryptosporidium hominis
NEFSKPNKLILYLFEFLTCILEPIKQDG

SEQ ID NO: 2194187 - protein, 23 aa, Cryptosporidium hominis
NEGFLIPDLPGTSRTRNFRSNHR

SEQ ID NO: 2194188 - protein, 25 aa, Cryptosporidium hominis
NEHFKEVFPISFRTNIPLLCESFVD

SEQ ID NO: 2194189 - protein, 27 aa, Cryptosporidium hominis
NEHIQYFMYQILRGLSYLHKVNIIHRD

SEQ ID NO: 2194190 - protein, 24 aa, Cryptosporidium hominis
NEICDGNYLLSEYILLCICSRQKL

SEQ ID NO: 2194191 - protein, 26 aa, Cryptosporidium hominis
NEILILYPNGILLSLLKRFYNRYWGK

SEQ ID NO: 2194192 - protein, 28 aa, Cryptosporidium hominis
NEILSYYSPKYSILAIISRGRCFAFYSQ

SEQ ID NO: 2194193 - protein, 24 aa, Cryptosporidium hominis
NEISLEMYSKELDIISLSKGIVEN

SEQ ID NO: 2194194 - protein, 17 aa, Cryptosporidium hominis
NEKDIFELVKNIKNSKN

SEQ ID NO: 2194195 - protein, 27 aa, Cryptosporidium hominis
NEKEKYYLPCQLLITSLGFKPKYDYIF

SEQ ID NO: 2194196 - protein, 24 aa, Cryptosporidium hominis
NEKFRKLLIFTSAGKPIYSYGITD

SEQ ID NO: 2194197 - protein, 22 aa, Cryptosporidium hominis
NEKLFDVLKKKLTILDNGTLNL

SEQ ID NO: 2194198 - protein, 22 aa, Cryptosporidium hominis
NEKLFSVNYLNNAYNCTYNLGK

SEQ ID NO: 2194199 - protein, 18 aa, Cryptosporidium hominis
NEKLYVKIRNENVSLKIL

SEQ ID NO: 2194200 - protein, 29 aa, Cryptosporidium hominis
NEKRDTLQIPICKFPLIKKIIVALDNSQN

SEQ ID NO: 2194201 - protein, 25 aa, Cryptosporidium hominis
NEKSHILYMLLLRSKIGKASLALKE

SEQ ID NO: 2194202 - protein, 25 aa, Cryptosporidium hominis
NEKTLFPLLYVLGTGSAIPSPYRNV

SEQ ID NO: 2194203 - protein, 33 aa, Cryptosporidium hominis
NELFKVWSPYIVSPYVLSLYLKSFTSPQFHCST

SEQ ID NO: 2194204 - protein, 25 aa, Cryptosporidium hominis
NELHNWFIIHRDLAPANIFINSKGI

SEQ ID NO: 2194205 - protein, 23 aa, Cryptosporidium hominis
NELINFIINWNKYSKYIPMPQIN

SEQ ID NO: 2194206 - protein, 21 aa, Cryptosporidium hominis
NELLHQYYSYIQDLQHRFEEM

SEQ ID NO: 2194207 - protein, 46 aa, Cryptosporidium hominis
NELMLTQFVRPIPAPSGIITPRAIFHFVRCIPFINTSFREPPKRTR

SEQ ID NO: 2194208 - protein, 18 aa, Cryptosporidium hominis
NELNNGYSGVLINTSGSL

SEQ ID NO: 2194209 - protein, 18 aa, Cryptosporidium hominis
NELSDWQFISYHPSWRDD

SEQ ID NO: 2194210 - protein, 23 aa, Cryptosporidium hominis
NELVWWRMTRKQRYLPGRTVTLE

SEQ ID NO: 2194211 - protein, 21 aa, Cryptosporidium hominis
NELYLNHKYMLIGHENTFVGR

SEQ ID NO: 2194212 - protein, 24 aa, Cryptosporidium hominis
NENDRSFIFGNRKMSNMKKMQIDY

SEQ ID NO: 2194213 - protein, 25 aa, Cryptosporidium hominis
NENHKAYLLFYYRSDFNKYDLLKDS

SEQ ID NO: 2194214 - protein, 21 aa, Cryptosporidium hominis
NENKRFLTFDTAPRRGEFSKN

SEQ ID NO: 2194215 - protein, 21 aa, Cryptosporidium hominis
NENPYSIIALKYCVENGILMG

SEQ ID NO: 2194216 - protein, 24 aa, Cryptosporidium hominis
NENYKLINNLKLNKLSRSKNYYST

SEQ ID NO: 2194217 - protein, 25 aa, Cryptosporidium hominis
NEQDLLYFNMITGELSFNILPSGGG

SEQ ID NO: 2194218 - protein, 31 aa, Cryptosporidium hominis
NEQTNIDILDLFPIFSWLENPNNFNHPMHSK

SEQ ID NO: 2194219 - protein, 35 aa, Cryptosporidium hominis
NEQVNFVPFSTAAPLFYFGLPEETLMGGGYTGTGN

SEQ ID NO: 2194220 - protein, 23 aa, Cryptosporidium hominis
NERLHENLNGLQELLVKSKQELL

SEQ ID NO: 2194221 - protein, 25 aa, Cryptosporidium hominis
NERPSIYYDPSLLPRNSINGNNIPS

SEQ ID NO: 2194222 - protein, 23 aa, Cryptosporidium hominis
NERQFDIIVLRPSNDYIYSLRNV

SEQ ID NO: 2194223 - protein, 29 aa, Cryptosporidium hominis
NERRRHDFLPFVLTLLRHASKKGLLMKKL

SEQ ID NO: 2194224 - protein, 21 aa, Cryptosporidium hominis
NESIGWWIISVNEYGYLRETT

SEQ ID NO: 2194225 - protein, 22 aa, Cryptosporidium hominis
NESKILPCFGIIDLPGTAQIQD

SEQ ID NO: 2194226 - protein, 24 aa, Cryptosporidium hominis
NESKKPLDWLASKVLIQLHSLSIL

SEQ ID NO: 2194227 - protein, 23 aa, Cryptosporidium hominis
NESKSIGLTSLLQKNIKLNDSTS

SEQ ID NO: 2194228 - protein, 18 aa, Cryptosporidium hominis
NESRNLNINLLDENIENP

SEQ ID NO: 2194229 - protein, 21 aa, Cryptosporidium hominis
NESSQFRTVKGSSGGGRGNES

SEQ ID NO: 2194230 - protein, 17 aa, Cryptosporidium hominis
NETGIINFYNPFKTDFL

SEQ ID NO: 2194231 - protein, 23 aa, Cryptosporidium hominis
NETGIIRGYFPKVKIVVPRTLKS

SEQ ID NO: 2194232 - protein, 27 aa, Cryptosporidium hominis
NEVCSFNLLQPLSLNISYSGSNDKSQG

SEQ ID NO: 2194233 - protein, 25 aa, Cryptosporidium hominis
NEVERPFIPGIPPVRYEYSEIKEPN

SEQ ID NO: 2194234 - protein, 23 aa, Cryptosporidium hominis
NEVKNIMPYLIDNTINRLELKLR

SEQ ID NO: 2194235 - protein, 26 aa, Cryptosporidium hominis
NEVLPSWILEKFFVDGGFNVISRLGE

SEQ ID NO: 2194236 - protein, 17 aa, Cryptosporidium hominis
NEWINVNMLLLSAYHDR

SEQ ID NO: 2194237 - protein, 17 aa, Cryptosporidium hominis
NEYIKLIEKKNPQWEET

SEQ ID NO: 2194238 - protein, 22 aa, Cryptosporidium hominis
NFAAIPNAFLSQPGISGLGAPN

SEQ ID NO: 2194239 - protein, 19 aa, Cryptosporidium hominis
NFCGKFILSNFIYAHQHIE

SEQ ID NO: 2194240 - protein, 21 aa, Cryptosporidium hominis
NFCPHIPFPPWSGNTTNQNKE

SEQ ID NO: 2194241 - protein, 18 aa, Cryptosporidium hominis
NFDALFQPQKHPARDSHD

SEQ ID NO: 2194242 - protein, 23 aa, Cryptosporidium hominis
NFDCHKFLTSQKAVFLHPNSSIN

SEQ ID NO: 2194243 - protein, 39 aa, Cryptosporidium hominis
NFDDLPFVIPSKRIIIEWPLYLLKNLKALDFENNDFSKY

SEQ ID NO: 2194244 - protein, 20 aa, Cryptosporidium hominis
NFDMIFVTKDYSKPVKRVDS

SEQ ID NO: 2194245 - protein, 23 aa, Cryptosporidium hominis
NFDSFYYNYHMLTGFPTLTPRFG

SEQ ID NO: 2194246 - protein, 19 aa, Cryptosporidium hominis
NFDSPVFSVRYKDPSIELS

SEQ ID NO: 2194247 - protein, 27 aa, Cryptosporidium hominis
NFEAAKLAYIKLIYLKKRGDYDTYCQG

SEQ ID NO: 2194248 - protein, 25 aa, Cryptosporidium hominis
NFEDIKNLKLQLPTNYFGIDNKDQV

SEQ ID NO: 2194249 - protein, 23 aa, Cryptosporidium hominis
NFEDLKLVLFNLSGKIIKDEDLI

SEQ ID NO: 2194250 - protein, 22 aa, Cryptosporidium hominis
NFELKTEPYINLSKEQLYKIIY

SEQ ID NO: 2194251 - protein, 34 aa, Cryptosporidium hominis
NFEPLSISNTLIASLPGLGFGLTPFLGMPNSQYA

SEQ ID NO: 2194252 - protein, 30 aa, Cryptosporidium hominis
NFERKNLFKIFLRYFIYPAYLDLYSYGNII

SEQ ID NO: 2194253 - protein, 19 aa, Cryptosporidium hominis
NFFDPLFQFSKKESNPTIQ

SEQ ID NO: 2194254 - protein, 17 aa, Cryptosporidium hominis
NFFSAILSKIKNGVKLT

SEQ ID NO: 2194255 - protein, 25 aa, Cryptosporidium hominis
NFHKFALFFIYKSNNSLKLLQLTPT

SEQ ID NO: 2194256 - protein, 29 aa, Cryptosporidium hominis
NFHSKDPIATYIYTLYRDLYNKSEINSRR

SEQ ID NO: 2194257 - protein, 32 aa, Cryptosporidium hominis
NFILRNMDQFIFFGLPFFFPPVLGIKPNENIT

SEQ ID NO: 2194258 - protein, 18 aa, Cryptosporidium hominis
NFINSFLNTCNHKHWSQF

SEQ ID NO: 2194259 - protein, 19 aa, Cryptosporidium hominis
NFKIYWTPCSQPSNIDHYD

SEQ ID NO: 2194260 - protein, 22 aa, Cryptosporidium hominis
NFKPILVLGTTNIPWEIDSGIR

SEQ ID NO: 2194261 - protein, 28 aa, Cryptosporidium hominis
NFKPRSMKMIFTRWLSFEKEFGSLQTQK

SEQ ID NO: 2194262 - protein, 17 aa, Cryptosporidium hominis
NFKQWELPKFKKPQPPP

SEQ ID NO: 2194263 - protein, 20 aa, Cryptosporidium hominis
NFKSLPKIKYKFIKSCSIGK

SEQ ID NO: 2194264 - protein, 20 aa, Cryptosporidium hominis
NFLKIREFFVGKQYSVSCRN

SEQ ID NO: 2194265 - protein, 37 aa, Cryptosporidium hominis
NFLNQTFHQIAFQNQFNFLNHLGYLNHLAGLTITGVG

SEQ ID NO: 2194266 - protein, 27 aa, Cryptosporidium hominis
NFMKDNDPVFTLLFNETYLTIKDWKGK

SEQ ID NO: 2194267 - protein, 18 aa, Cryptosporidium hominis
NFNIIPLEKMNYQEILNN

SEQ ID NO: 2194268 - protein, 18 aa, Cryptosporidium hominis
NFNTLNLPNQPNLSSKPA

SEQ ID NO: 2194269 - protein, 20 aa, Cryptosporidium hominis
NFNTLPLNKVRRWISSKTEQ

SEQ ID NO: 2194270 - protein, 31 aa, Cryptosporidium hominis
NFPIKLNSCKIFYLNLPKLRSIRLKCKSILD

SEQ ID NO: 2194271 - protein, 20 aa, Cryptosporidium hominis
NFQFGLLYLTKLIFHIKKNS

SEQ ID NO: 2194272 - protein, 23 aa, Cryptosporidium hominis
NFQGLDPAMWQMVTTIAAICSTA

SEQ ID NO: 2194273 - protein, 35 aa, Cryptosporidium hominis
NFSNKPYKRIPLKNIWFIFKRIYSMKPNSVEIIYG

SEQ ID NO: 2194274 - protein, 31 aa, Cryptosporidium hominis
NFSQINCISDLKLRILWIKETIHCFEPFTDT

SEQ ID NO: 2194275 - protein, 35 aa, Cryptosporidium hominis
NFSQLNRIFCYFKNLPYLISFPLSQCKFEKYLACS

SEQ ID NO: 2194276 - protein, 20 aa, Cryptosporidium hominis
NFSYVPPPLTSIYNYNNNNI

SEQ ID NO: 2194277 - protein, 41 aa, Cryptosporidium hominis
NFTITLLNVHRIIVTALILATKFFDDIYYSNAFYAKISGVG

SEQ ID NO: 2194278 - protein, 26 aa, Cryptosporidium hominis
NFTTFVGMIYLFFLDIFRVEKDLNLE

SEQ ID NO: 2194279 - protein, 29 aa, Cryptosporidium hominis
NFVTGFIIKFRLPIDPHILSYYLKEVILN

SEQ ID NO: 2194280 - protein, 19 aa, Cryptosporidium hominis
NFYLRFNGNCKLLLEYIPF

SEQ ID NO: 2194281 - protein, 22 aa, Cryptosporidium hominis
NGAKYIIPILNLNFTEKRNSEL

SEQ ID NO: 2194282 - protein, 20 aa, Cryptosporidium hominis
NGAPVKGDRRRGRGRGRGRG

SEQ ID NO: 2194283 - protein, 24 aa, Cryptosporidium hominis
NGCKVILFGSLYRVIHESAKIEVD

SEQ ID NO: 2194284 - protein, 34 aa, Cryptosporidium hominis
NGDKFEGYYKDDIKWGHGIYRWSNGEVFEGEYVR

SEQ ID NO: 2194285 - protein, 24 aa, Cryptosporidium hominis
NGDMRLRFKDWSDLHNYLLVSMKQ

SEQ ID NO: 2194286 - protein, 22 aa, Cryptosporidium hominis
NGDYLSFDFKSNNRICKSYFQL

SEQ ID NO: 2194287 - protein, 27 aa, Cryptosporidium hominis
NGEFEYMNILKLFGAINRLERDSNIIF

SEQ ID NO: 2194288 - protein, 25 aa, Cryptosporidium hominis
NGEPTCPLCRVPCSVFTLCDLVNIT

SEQ ID NO: 2194289 - protein, 18 aa, Cryptosporidium hominis
NGEPWFYKLVDSVSNIMG

SEQ ID NO: 2194290 - protein, 26 aa, Cryptosporidium hominis
NGEVNLWNLDFIDSIDPILTLYSDVG

SEQ ID NO: 2194291 - protein, 28 aa, Cryptosporidium hominis
NGFDDFQIIDLTFLFQNISFCDISKYHA

SEQ ID NO: 2194292 - protein, 26 aa, Cryptosporidium hominis
NGFDLKYNGFYILYAKSNKPDSQWKQ

SEQ ID NO: 2194293 - protein, 34 aa, Cryptosporidium hominis
NGFMFSMVVSYTWNNVYLLGRYIKFSRRISQSKW

SEQ ID NO: 2194294 - protein, 18 aa, Cryptosporidium hominis
NGFNSLFVILNRLREYTA

SEQ ID NO: 2194295 - protein, 22 aa, Cryptosporidium hominis
NGFTPFELLNSTWNDFLKLRNE

SEQ ID NO: 2194296 - protein, 29 aa, Cryptosporidium hominis
NGGGSQRSFIVGELKPRINQALKAELDTE

SEQ ID NO: 2194297 - protein, 19 aa, Cryptosporidium hominis
NGGIYIITSRILLTDLLSE

SEQ ID NO: 2194298 - protein, 21 aa, Cryptosporidium hominis
NGGNPVILPSPLTTASTAPTA

SEQ ID NO: 2194299 - protein, 25 aa, Cryptosporidium hominis
NGGRQFLRNFTPPGTPSYSIQKVPG

SEQ ID NO: 2194300 - protein, 19 aa, Cryptosporidium hominis
NGHINHRFSNRPRFVSMQD

SEQ ID NO: 2194301 - protein, 31 aa, Cryptosporidium hominis
NGHLIKRLFKIPFWPDGFRFIKNRKYFIKDG

SEQ ID NO: 2194302 - protein, 23 aa, Cryptosporidium hominis
NGIAHFLEHLIFKGTYNRSRKEI

SEQ ID NO: 2194303 - protein, 22 aa, Cryptosporidium hominis
NGIEFKLAISAILLDFEDEVGS

SEQ ID NO: 2194304 - protein, 29 aa, Cryptosporidium hominis
NGIENFLDVIFGFLLRKTDFFTAMNQGEE

SEQ ID NO: 2194305 - protein, 23 aa, Cryptosporidium hominis
NGIILDVHFPLAVYKKLLGYKVD

SEQ ID NO: 2194306 - protein, 20 aa, Cryptosporidium hominis
NGINMLAKYVAPHVYGYSQL

SEQ ID NO: 2194307 - protein, 20 aa, Cryptosporidium hominis
NGKEIYLYFGPQVDSKVISE

SEQ ID NO: 2194308 - protein, 29 aa, Cryptosporidium hominis
NGKIYKRWVFPFTYYLTYENEFNLLENEP

SEQ ID NO: 2194309 - protein, 24 aa, Cryptosporidium hominis
NGKKFPIPIRFDKKGIPKDCKGED

SEQ ID NO: 2194310 - protein, 25 aa, Cryptosporidium hominis
NGLAHFLEHMLFLGSARHPNPSDFD

SEQ ID NO: 2194311 - protein, 17 aa, Cryptosporidium hominis
NGLFYIMDSNGLAMIEY

SEQ ID NO: 2194312 - protein, 19 aa, Cryptosporidium hominis
NGLIVPLVNLLNTAEFDVK

SEQ ID NO: 2194313 - protein, 17 aa, Cryptosporidium hominis
NGLKKCVLALIYIFKSG

SEQ ID NO: 2194314 - protein, 22 aa, Cryptosporidium hominis
NGLNDSLLRKISNLNFDEMSLI

SEQ ID NO: 2194315 - protein, 24 aa, Cryptosporidium hominis
NGLSTEIILSKFKFISVRDLQQLH

SEQ ID NO: 2194316 - protein, 19 aa, Cryptosporidium hominis
NGLTPSSIAALWAKAMSKT

SEQ ID NO: 2194317 - protein, 27 aa, Cryptosporidium hominis
NGLYCKHVRWIIQIPRLYNIFYKDGCV

SEQ ID NO: 2194318 - protein, 29 aa, Cryptosporidium hominis
NGMTMEEPILLFLTYQFAETLLAFNEMKI

SEQ ID NO: 2194319 - protein, 27 aa, Cryptosporidium hominis
NGNHELLGIYYLYNKKMVAHKPYLVDY

SEQ ID NO: 2194320 - protein, 22 aa, Cryptosporidium hominis
NGNLIYPLHRNLVMSDWLLCEL

SEQ ID NO: 2194321 - protein, 23 aa, Cryptosporidium hominis
NGNTSFMFFSSLSNIVNPGIEIS

SEQ ID NO: 2194322 - protein, 29 aa, Cryptosporidium hominis
NGNVPWIISTLLEQKIWMHDSSGKQIQTI

SEQ ID NO: 2194323 - protein, 18 aa, Cryptosporidium hominis
NGNYYVGGFKNGLTDGPG

SEQ ID NO: 2194324 - protein, 32 aa, Cryptosporidium hominis
NGPISLLSFNILIEKLSPFFSKYTECSQIMYS

SEQ ID NO: 2194325 - protein, 25 aa, Cryptosporidium hominis
NGQTPKLIFLMFTPENAKVKDRMVF

SEQ ID NO: 2194326 - protein, 24 aa, Cryptosporidium hominis
NGRTNIVFLMQGLDLKLLRPGDLP

SEQ ID NO: 2194327 - protein, 19 aa, Cryptosporidium hominis
NGRVYYFPRDHVCDFKYCN

SEQ ID NO: 2194328 - protein, 25 aa, Cryptosporidium hominis
NGRYDILAILLAYNSSYLRSLEILE

SEQ ID NO: 2194329 - protein, 22 aa, Cryptosporidium hominis
NGSQFFITTASCPWLDGVHTIF

SEQ ID NO: 2194330 - protein, 23 aa, Cryptosporidium hominis
NGSSITIILSTKKFKYLIVTTQE

SEQ ID NO: 2194331 - protein, 17 aa, Cryptosporidium hominis
NGTFLNGKRLNKSVPTQ

SEQ ID NO: 2194332 - protein, 28 aa, Cryptosporidium hominis
NGTHNTLGFLFYRKFVVLINLITHEQCS

SEQ ID NO: 2194333 - protein, 23 aa, Cryptosporidium hominis
NGTLLHHTLFDYSKTLKMFEQVT

SEQ ID NO: 2194334 - protein, 40 aa, Cryptosporidium hominis
NGTNIILRFLMIPNGDIKCILWPFSLLFIHKNELSDDVNS

SEQ ID NO: 2194335 - protein, 24 aa, Cryptosporidium hominis
NGTYRKILVVPDYINYVGLNISEK

SEQ ID NO: 2194336 - protein, 23 aa, Cryptosporidium hominis
NGVLYLLYQACRIFKQLGVEYVT

SEQ ID NO: 2194337 - protein, 27 aa, Cryptosporidium hominis
NGYPNHVLCCRIFILVIQKVSERERKK

SEQ ID NO: 2194338 - protein, 27 aa, Cryptosporidium hominis
NGYRYVPIKMLDIAGLIPGAHLGNGLG

SEQ ID NO: 2194339 - protein, 17 aa, Cryptosporidium hominis
NHEIVYYSFQTIHKYLS

SEQ ID NO: 2194340 - protein, 27 aa, Cryptosporidium hominis
NHEYANMPWFVLFKSNPQLLEAKYDFN

SEQ ID NO: 2194341 - protein, 24 aa, Cryptosporidium hominis
NHFKDYSLVLWKKLIKKCKNDNKL

SEQ ID NO: 2194342 - protein, 30 aa, Cryptosporidium hominis
NHGYKFPHSIWIQALRFLASSRFHVQTALE

SEQ ID NO: 2194343 - protein, 21 aa, Cryptosporidium hominis
NHILCWKCIINVDEIFYLDSN

SEQ ID NO: 2194344 - protein, 17 aa, Cryptosporidium hominis
NHKERLGHLSCRVCGVE

SEQ ID NO: 2194345 - protein, 43 aa, Cryptosporidium hominis
NHKPFLSPGIIDSFLPYILDETLLSCFLVCPHWLLTITEFINE

SEQ ID NO: 2194346 - protein, 20 aa, Cryptosporidium hominis
NHLILLFENYLSNGSCELLN

SEQ ID NO: 2194347 - protein, 18 aa, Cryptosporidium hominis
NHPNDIYILVKRSIDDPA

SEQ ID NO: 2194348 - protein, 17 aa, Cryptosporidium hominis
NHPNYIIGYFKLEKMEK

SEQ ID NO: 2194349 - protein, 26 aa, Cryptosporidium hominis
NHQVFDLLVLSLLPYNYTYNLEYGNA

SEQ ID NO: 2194350 - protein, 26 aa, Cryptosporidium hominis
NHSEDLLWEDYYVLYRLMVCINCVKE

SEQ ID NO: 2194351 - protein, 27 aa, Cryptosporidium hominis
NHSFLSLYLLFLIYNKIHVSNQLILTD

SEQ ID NO: 2194352 - protein, 25 aa, Cryptosporidium hominis
NHTTPLNVYGPIPGAPNGGIIAPII

SEQ ID NO: 2194353 - protein, 18 aa, Cryptosporidium hominis
NHYGVKGIYMGVPTIIGK

SEQ ID NO: 2194354 - protein, 25 aa, Cryptosporidium hominis
NIAAILFCEGVVLDALDWSIEFPKP

SEQ ID NO: 2194355 - protein, 25 aa, Cryptosporidium hominis
NIAKVLEDWPYWNKSILSELKHNKL

SEQ ID NO: 2194356 - protein, 19 aa, Cryptosporidium hominis
NIAQGRLNYLLSDNGEPTC

SEQ ID NO: 2194357 - protein, 37 aa, Cryptosporidium hominis
NICILINLGAMVNILHSLRLWLGEDLEIWIFDFHRPA

SEQ ID NO: 2194358 - protein, 25 aa, Cryptosporidium hominis
NICTQSYVPIKKVLEKIKIILKVDS

SEQ ID NO: 2194359 - protein, 29 aa, Cryptosporidium hominis
NIDDETLDTIPWFCSYNKLQVLSNSEYEV

SEQ ID NO: 2194360 - protein, 23 aa, Cryptosporidium hominis
NIDFPIKKKNEFFSKLQINDLFN

SEQ ID NO: 2194361 - protein, 25 aa, Cryptosporidium hominis
NIDIYNYRFIPTINKDYYSHSFAAV

SEQ ID NO: 2194362 - protein, 30 aa, Cryptosporidium hominis
NIDMGERVLYLTRNLWIEKSDFWFDENQEI

SEQ ID NO: 2194363 - protein, 26 aa, Cryptosporidium hominis
NIEENINLLILYDFLLILNDKNETMN

SEQ ID NO: 2194364 - protein, 18 aa, Cryptosporidium hominis
NIEFHGLWDVLHYENNLK

SEQ ID NO: 2194365 - protein, 26 aa, Cryptosporidium hominis
NIEKKYLLYILEDFVPAFIETIDLNT

SEQ ID NO: 2194366 - protein, 23 aa, Cryptosporidium hominis
NIEKPHVLILLGPFIDVRNESIK

SEQ ID NO: 2194367 - protein, 19 aa, Cryptosporidium hominis
NIELLKIEKRIQQLSVEDR

SEQ ID NO: 2194368 - protein, 36 aa, Cryptosporidium hominis
NIELNWRDELISKVRQFILYLSPKPKIQSSKSSYMT

SEQ ID NO: 2194369 - protein, 18 aa, Cryptosporidium hominis
NIENIFREFFNLANKLQN

SEQ ID NO: 2194370 - protein, 18 aa, Cryptosporidium hominis
NIEQEIETILVEKKKIDE

SEQ ID NO: 2194371 - protein, 22 aa, Cryptosporidium hominis
NIERRDLKLGTLLFGVIDHVSE

SEQ ID NO: 2194372 - protein, 24 aa, Cryptosporidium hominis
NIERSWEVILFSKIIGIIKTLFLV

SEQ ID NO: 2194373 - protein, 17 aa, Cryptosporidium hominis
NIFAYFCENPFAAASIG

SEQ ID NO: 2194374 - protein, 25 aa, Cryptosporidium hominis
NIFIKSHILSLYLYYNQEYDTQKSI

SEQ ID NO: 2194375 - protein, 29 aa, Cryptosporidium hominis
NIFKKLSAAFFRFILLKFASSNEEPFVQI

SEQ ID NO: 2194376 - protein, 20 aa, Cryptosporidium hominis
NIFKRAFVSILKKHDKFHNG

SEQ ID NO: 2194377 - protein, 20 aa, Cryptosporidium hominis
NIFQQTAISDLKYFSDLILE

SEQ ID NO: 2194378 - protein, 26 aa, Cryptosporidium hominis
NIGDSFLEYRFKIASLLWDNHISCEI

SEQ ID NO: 2194379 - protein, 17 aa, Cryptosporidium hominis
NIGINQINLARAARFNS

SEQ ID NO: 2194380 - protein, 24 aa, Cryptosporidium hominis
NIGSFVDLLLTLRKLQETAISSLL

SEQ ID NO: 2194381 - protein, 27 aa, Cryptosporidium hominis
NIGSNERFKIIYWLSLHSNRLKFQSCT

SEQ ID NO: 2194382 - protein, 23 aa, Cryptosporidium hominis
NIGTLFQTSLFSYLQTIYNTDRN

SEQ ID NO: 2194383 - protein, 17 aa, Cryptosporidium hominis
NIHFWEFELLKTYYHPL

SEQ ID NO: 2194384 - protein, 20 aa, Cryptosporidium hominis
NIHIIFDYSLPLTFSDDLIN

SEQ ID NO: 2194385 - protein, 17 aa, Cryptosporidium hominis
NIIADFTNFPDFTLLAC

SEQ ID NO: 2194386 - protein, 19 aa, Cryptosporidium hominis
NIICMALLSSKLAIERVFS

SEQ ID NO: 2194387 - protein, 19 aa, Cryptosporidium hominis
NIIEDKLYLFGGWNGFQAL

SEQ ID NO: 2194388 - protein, 19 aa, Cryptosporidium hominis
NIIISWFNFAIEELSMELI

SEQ ID NO: 2194389 - protein, 24 aa, Cryptosporidium hominis
NIIKDYLLLMRHQLYQLNNELGIF

SEQ ID NO: 2194390 - protein, 19 aa, Cryptosporidium hominis
NIIKPFPIQMQSIPILMSG

SEQ ID NO: 2194391 - protein, 17 aa, Cryptosporidium hominis
NIIKRLLCRVPEVRMGC

SEQ ID NO: 2194392 - protein, 19 aa, Cryptosporidium hominis
NIILGGPGFFKDDFFKYLF

SEQ ID NO: 2194393 - protein, 17 aa, Cryptosporidium hominis
NIILIYISAPNQDEATL

SEQ ID NO: 2194394 - protein, 22 aa, Cryptosporidium hominis
NIISEFLVLRGFRHQRLDGTMG

SEQ ID NO: 2194395 - protein, 19 aa, Cryptosporidium hominis
NIKEYLLGRLEILKENKYD

SEQ ID NO: 2194396 - protein, 20 aa, Cryptosporidium hominis
NIKFGNMKIINLIKRISSDL

SEQ ID NO: 2194397 - protein, 30 aa, Cryptosporidium hominis
NIKKKYKKNLIWDGPRWDLAHFDPTMSARE

SEQ ID NO: 2194398 - protein, 41 aa, Cryptosporidium hominis
NIKLKFDKLKEIKMKRLSLKRRLYLKGYFDITDFDDIEQIY

SEQ ID NO: 2194399 - protein, 17 aa, Cryptosporidium hominis
NIKLVNFDRIISLIIDL

SEQ ID NO: 2194400 - protein, 23 aa, Cryptosporidium hominis
NIKNNPLGYPKKVYYFIYGFFHR

SEQ ID NO: 2194401 - protein, 25 aa, Cryptosporidium hominis
NIKRSLHFIYHRYKRYVAYNEMLNS

SEQ ID NO: 2194402 - protein, 36 aa, Cryptosporidium hominis
NIKVKSFFLKLIIYIDWLIYLINHSNKSFGGARAIQ

SEQ ID NO: 2194403 - protein, 17 aa, Cryptosporidium hominis
NIKYSYILPIRSVGVQG

SEQ ID NO: 2194404 - protein, 22 aa, Cryptosporidium hominis
NILFATLLRSLGHHCRLTLFIP

SEQ ID NO: 2194405 - protein, 20 aa, Cryptosporidium hominis
NILFRIYKLEFTENWDLILF

SEQ ID NO: 2194406 - protein, 20 aa, Cryptosporidium hominis
NILGIIDLLPPDSPNFEDIY

SEQ ID NO: 2194407 - protein, 26 aa, Cryptosporidium hominis
NILKKDEWVCVLPLSVKSQEWADSDS

SEQ ID NO: 2194408 - protein, 50 aa, Cryptosporidium hominis
NILNILSDRYYRLLYSQLLYRPIYISKNKKLLVFLIWKIVNNPEINYKVS

SEQ ID NO: 2194409 - protein, 24 aa, Cryptosporidium hominis
NILNYLIDGVWRQQQYRLDMIEKH

SEQ ID NO: 2194410 - protein, 17 aa, Cryptosporidium hominis
NILQQSSPFIYNMSLSP

SEQ ID NO: 2194411 - protein, 17 aa, Cryptosporidium hominis
NILTRFPSSWKKYKWEK

SEQ ID NO: 2194412 - protein, 19 aa, Cryptosporidium hominis
NILVKARNFLVFQGDVEDV

SEQ ID NO: 2194413 - protein, 19 aa, Cryptosporidium hominis
NIMNPKKLFNVKFGTLTED

SEQ ID NO: 2194414 - protein, 20 aa, Cryptosporidium hominis
NIMRQIFSALHYLHNQGICH

SEQ ID NO: 2194415 - protein, 23 aa, Cryptosporidium hominis
NINEPIFRFRSKTPPPLKEPNLP

SEQ ID NO: 2194416 - protein, 29 aa, Cryptosporidium hominis
NINERVDIFRFILIEFTMIQQEMYLRQMM

SEQ ID NO: 2194417 - protein, 21 aa, Cryptosporidium hominis
NINILNNNIYSLLGISKLECL

SEQ ID NO: 2194418 - protein, 24 aa, Cryptosporidium hominis
NINKEAMLFKPVPMNLISKFTETT

SEQ ID NO: 2194419 - protein, 26 aa, Cryptosporidium hominis
NINLINKLLLKLNFNSFYIGKIPASV

SEQ ID NO: 2194420 - protein, 18 aa, Cryptosporidium hominis
NINLIYLSTNFRSTKSII

SEQ ID NO: 2194421 - protein, 25 aa, Cryptosporidium hominis
NINNRLILTIGSKGIFRLWKVIIKH

SEQ ID NO: 2194422 - protein, 27 aa, Cryptosporidium hominis
NINPGSIFFDLWNSSLFISCTNTPLVH

SEQ ID NO: 2194423 - protein, 29 aa, Cryptosporidium hominis
NINQDICLNLKLPIWVSSMAKQFYNAYNQ

SEQ ID NO: 2194424 - protein, 25 aa, Cryptosporidium hominis
NINQEPAKCLLIGSPFKLPCSKGCH

SEQ ID NO: 2194425 - protein, 27 aa, Cryptosporidium hominis
NINQFVSQLQNLLPPIVPGHNSGNIQN

SEQ ID NO: 2194426 - protein, 32 aa, Cryptosporidium hominis
NINQISNYWLLLVLAYEQLFGNLKIQGGGALA

SEQ ID NO: 2194427 - protein, 41 aa, Cryptosporidium hominis
NINRFFELLQRRYRTMLLARGFWRIWSSCYSPLFKRKTNCG

SEQ ID NO: 2194428 - protein, 19 aa, Cryptosporidium hominis
NIPHLLFYGPSGGGKKVRI

SEQ ID NO: 2194429 - protein, 18 aa, Cryptosporidium hominis
NIPIKGLFSVPINLRQEY

SEQ ID NO: 2194430 - protein, 21 aa, Cryptosporidium hominis
NIPKKLLFLHMGQEHIAEAKW

SEQ ID NO: 2194431 - protein, 20 aa, Cryptosporidium hominis
NIPLCGIGMINKIVVWPWHQ

SEQ ID NO: 2194432 - protein, 22 aa, Cryptosporidium hominis
NIPQGLTWIKVVNDRIFAGDIS

SEQ ID NO: 2194433 - protein, 33 aa, Cryptosporidium hominis
NIQDFGKEFVPILRLYLFKNSWFVEVIKDINRQ

SEQ ID NO: 2194434 - protein, 25 aa, Cryptosporidium hominis
NIQEDWLLDLVPIIDTPELGTLAGE

SEQ ID NO: 2194435 - protein, 28 aa, Cryptosporidium hominis
NIQEIFQSNIYILNFINSFLNTCNHKHW

SEQ ID NO: 2194436 - protein, 23 aa, Cryptosporidium hominis
NIQKNFLVAKFIHAVLTVLKQNP

SEQ ID NO: 2194437 - protein, 17 aa, Cryptosporidium hominis
NIQRFKKSQGIFMIIRY

SEQ ID NO: 2194438 - protein, 25 aa, Cryptosporidium hominis
NIQSRRFFLGYNFDSIFDTEIMFSV

SEQ ID NO: 2194439 - protein, 18 aa, Cryptosporidium hominis
NIRFGLDYNNIGSISSML

SEQ ID NO: 2194440 - protein, 24 aa, Cryptosporidium hominis
NIRKSIVMLAFIIKLFGLKNMQIT

SEQ ID NO: 2194441 - protein, 19 aa, Cryptosporidium hominis
NIRRAHCLANYSFKYRRGG

SEQ ID NO: 2194442 - protein, 20 aa, Cryptosporidium hominis
NISCMIGVICLLEISSIGYA

SEQ ID NO: 2194443 - protein, 26 aa, Cryptosporidium hominis
NISEQFLLALSFLRKMKLTHTDLKLE

SEQ ID NO: 2194444 - protein, 22 aa, Cryptosporidium hominis
NISKEMLWYKPISINHIVTHMI

SEQ ID NO: 2194445 - protein, 23 aa, Cryptosporidium hominis
NISKYERFLLKEIFQSCIESILV

SEQ ID NO: 2194446 - protein, 21 aa, Cryptosporidium hominis
NISLALWDRVYRASCGELIYC

SEQ ID NO: 2194447 - protein, 27 aa, Cryptosporidium hominis
NISMDLPKYIWENFQSIKKLNVFNNKT

SEQ ID NO: 2194448 - protein, 37 aa, Cryptosporidium hominis
NISSMNWYVYQSPPILKVIPDKKLTLLKAGFVPNAQL

SEQ ID NO: 2194449 - protein, 31 aa, Cryptosporidium hominis
NISSNDFLQKAKVIWLYKNGDKYDKGTIYYV

SEQ ID NO: 2194450 - protein, 25 aa, Cryptosporidium hominis
NISSRFLLIKVLHRGNFGQVYVGLD

SEQ ID NO: 2194451 - protein, 19 aa, Cryptosporidium hominis
NISVPLTIDELEEKIMQEN

SEQ ID NO: 2194452 - protein, 21 aa, Cryptosporidium hominis
NITHLFYKTLVYISAISGINS

SEQ ID NO: 2194453 - protein, 18 aa, Cryptosporidium hominis
NITKCKIEFPRQPTLSNE

SEQ ID NO: 2194454 - protein, 26 aa, Cryptosporidium hominis
NITKNMSIILLPGEKLLLFSKECGIS

SEQ ID NO: 2194455 - protein, 19 aa, Cryptosporidium hominis
NITLDDCWCFNILKKDEWV

SEQ ID NO: 2194456 - protein, 22 aa, Cryptosporidium hominis
NITMVYTMVTDLIFSWLELRDG

SEQ ID NO: 2194457 - protein, 25 aa, Cryptosporidium hominis
NITQTIPNSIYYYPTPNINQEKEEK

SEQ ID NO: 2194458 - protein, 27 aa, Cryptosporidium hominis
NIVDRLLFAIPFFFKSDVFTNPFVNPI

SEQ ID NO: 2194459 - protein, 17 aa, Cryptosporidium hominis
NIVKFLIGEGIPSYILD

SEQ ID NO: 2194460 - protein, 19 aa, Cryptosporidium hominis
NIVLLTPSLAPIASFRQFL

SEQ ID NO: 2194461 - protein, 18 aa, Cryptosporidium hominis
NIVLMNKPWIILTFAFNS

SEQ ID NO: 2194462 - protein, 29 aa, Cryptosporidium hominis
NIVNAFYEYYMAELLWRIGTVLGHSSFVN

SEQ ID NO: 2194463 - protein, 19 aa, Cryptosporidium hominis
NIVQQFLPSIVQLRKYELE

SEQ ID NO: 2194464 - protein, 17 aa, Cryptosporidium hominis
NIVRMHSLDIERLQNMN

SEQ ID NO: 2194465 - protein, 28 aa, Cryptosporidium hominis
NIVSSFPPPPPYFRLFDHEDKVTKIKPP

SEQ ID NO: 2194466 - protein, 23 aa, Cryptosporidium hominis
NIYEKMLEFISYLDSALNAYFPK

SEQ ID NO: 2194467 - protein, 19 aa, Cryptosporidium hominis
NIYLKKFLQLEDLKWDINQ

SEQ ID NO: 2194468 - protein, 17 aa, Cryptosporidium hominis
NIYNSLSTRIRTIILNP

SEQ ID NO: 2194469 - protein, 18 aa, Cryptosporidium hominis
NIYYNVDGFVDNTITNST

SEQ ID NO: 2194470 - protein, 18 aa, Cryptosporidium hominis
NIYYSRSLIPWRVPKSQS

SEQ ID NO: 2194471 - protein, 23 aa, Cryptosporidium hominis
NKAKFLGLVLFKNKDIQGNEIPE

SEQ ID NO: 2194472 - protein, 23 aa, Cryptosporidium hominis
NKASLSLPPIYMKSCSLDAIVDL

SEQ ID NO: 2194473 - protein, 25 aa, Cryptosporidium hominis
NKAVDLLGLIPIYPVKNIKTFTNNL

SEQ ID NO: 2194474 - protein, 18 aa, Cryptosporidium hominis
NKCKLNESFYLLIENENN

SEQ ID NO: 2194475 - protein, 25 aa, Cryptosporidium hominis
NKCRSMQLLIYRYHLMVAESCLDSL

SEQ ID NO: 2194476 - protein, 30 aa, Cryptosporidium hominis
NKDFDKPGALPHLFRSFRATKFCKRCGAGN

SEQ ID NO: 2194477 - protein, 27 aa, Cryptosporidium hominis
NKDGIWVHLVCAIWHLPLVTCEDWKNL

SEQ ID NO: 2194478 - protein, 19 aa, Cryptosporidium hominis
NKDKNFNRFKQFGNGNIYG

SEQ ID NO: 2194479 - protein, 18 aa, Cryptosporidium hominis
NKDLVVIDPLLNLLSFNT

SEQ ID NO: 2194480 - protein, 24 aa, Cryptosporidium hominis
NKDWQLGYMVIEDFSIYIYDSGFK

SEQ ID NO: 2194481 - protein, 23 aa, Cryptosporidium hominis
NKEEDLQWSDWNSFVAAETTITN

SEQ ID NO: 2194482 - protein, 26 aa, Cryptosporidium hominis
NKEESLNLVAMINSIFDYIQENMKQM

SEQ ID NO: 2194483 - protein, 25 aa, Cryptosporidium hominis
NKEEWKFWMVGLLVSHALAQREKLV

SEQ ID NO: 2194484 - protein, 23 aa, Cryptosporidium hominis
NKEIPLVKYIISNSLKLSNKIAN

SEQ ID NO: 2194485 - protein, 20 aa, Cryptosporidium hominis
NKFMSFGVASLRSMNSNALS

SEQ ID NO: 2194486 - protein, 28 aa, Cryptosporidium hominis
NKFRLGITSLQYIARLTPNKVWVKPGGE

SEQ ID NO: 2194487 - protein, 28 aa, Cryptosporidium hominis
NKFYDALSLFGTDLMLVKSVFPEFTDKQ

SEQ ID NO: 2194488 - protein, 27 aa, Cryptosporidium hominis
NKGIVDDPIILTIYGTQCPDLTLIDLP

SEQ ID NO: 2194489 - protein, 26 aa, Cryptosporidium hominis
NKGKEMALIMPFSIKINKIKADLQET

SEQ ID NO: 2194490 - protein, 30 aa, Cryptosporidium hominis
NKGNELKLFDYLLSMPLWSLTKEKMELLEA

SEQ ID NO: 2194491 - protein, 27 aa, Cryptosporidium hominis
NKGTALVFQFKYCEPYFGAWQAKELSN

SEQ ID NO: 2194492 - protein, 27 aa, Cryptosporidium hominis
NKGYWNMYDWELLMRDIQYPAKNGEKL

SEQ ID NO: 2194493 - protein, 26 aa, Cryptosporidium hominis
NKHGRRPLVLVLLPTRELAQQVSNEF

SEQ ID NO: 2194494 - protein, 32 aa, Cryptosporidium hominis
NKHPNWLISLLGPTFVYLTPNLFYKSFFGNNN

SEQ ID NO: 2194495 - protein, 19 aa, Cryptosporidium hominis
NKIELYWKFNQDRLKDTLK

SEQ ID NO: 2194496 - protein, 32 aa, Cryptosporidium hominis
NKIFDTLDLIKCSDFIIALFGFNDEFQAFDEI

SEQ ID NO: 2194497 - protein, 24 aa, Cryptosporidium hominis
NKIGRLVIELFQDIVPKTSENFRQ

SEQ ID NO: 2194498 - protein, 21 aa, Cryptosporidium hominis
NKILTYTMNLMLEKLRTCDSR

SEQ ID NO: 2194499 - protein, 21 aa, Cryptosporidium hominis
NKIYLLRQSLLEEADSIRREK

SEQ ID NO: 2194500 - protein, 31 aa, Cryptosporidium hominis
NKKAIERLFIIIRNLRKYLPKLNCLFNFALN

SEQ ID NO: 2194501 - protein, 25 aa, Cryptosporidium hominis
NKKFSFIQLRMYGSIKLRIIYKENK

SEQ ID NO: 2194502 - protein, 32 aa, Cryptosporidium hominis
NKKICYHKTTFWKPVLHMIPQKMFEIQDSIEF

SEQ ID NO: 2194503 - protein, 18 aa, Cryptosporidium hominis
NKLKLHIVELNDTFQKRW

SEQ ID NO: 2194504 - protein, 22 aa, Cryptosporidium hominis
NKLKSIKRLLKVWCMEMCPEEY

SEQ ID NO: 2194505 - protein, 20 aa, Cryptosporidium hominis
NKLKSLEEILIRNGEKSISE

SEQ ID NO: 2194506 - protein, 35 aa, Cryptosporidium hominis
NKLPVALNPNLPYLQHSMIAFANRIPYQTTPEVQT

SEQ ID NO: 2194507 - protein, 31 aa, Cryptosporidium hominis
NKLTECGCVFVFYVADWFALLNNKMGGDLEK

SEQ ID NO: 2194508 - protein, 19 aa, Cryptosporidium hominis
NKLVAILDLDNTLLHAYNS

SEQ ID NO: 2194509 - protein, 28 aa, Cryptosporidium hominis
NKLVDSCYSFWFTGLLFCIEEILRIRTS

SEQ ID NO: 2194510 - protein, 22 aa, Cryptosporidium hominis
NKLVKNILIKEISGIEGNIEML

SEQ ID NO: 2194511 - protein, 24 aa, Cryptosporidium hominis
NKLYKVILAYLELCGFEQVMINSE

SEQ ID NO: 2194512 - protein, 17 aa, Cryptosporidium hominis
NKMFAMNELFQKLLNTN

SEQ ID NO: 2194513 - protein, 24 aa, Cryptosporidium hominis
NKMGPFGWFDGKYTIPGWRTMQMA

SEQ ID NO: 2194514 - protein, 25 aa, Cryptosporidium hominis
NKMKMWPSFDHIFKAARRDNKWYLR

SEQ ID NO: 2194515 - protein, 21 aa, Cryptosporidium hominis
NKMLILAVNRFGPGNWSLIKN

SEQ ID NO: 2194516 - protein, 17 aa, Cryptosporidium hominis
NKNIIWKGISSINHILC

SEQ ID NO: 2194517 - protein, 18 aa, Cryptosporidium hominis
NKNLCYDIKWNYFGNILA

SEQ ID NO: 2194518 - protein, 23 aa, Cryptosporidium hominis
NKNLQNLLLLTSIKIDVRRLDDY

SEQ ID NO: 2194519 - protein, 17 aa, Cryptosporidium hominis
NKNLWLEKASKTEMKHV

SEQ ID NO: 2194520 - protein, 25 aa, Cryptosporidium hominis
NKNNGSCPFCFFKGNNKGQKSSISI

SEQ ID NO: 2194521 - protein, 23 aa, Cryptosporidium hominis
NKNYPYLIFAYTGQGCQYINMCK

SEQ ID NO: 2194522 - protein, 25 aa, Cryptosporidium hominis
NKPKKVDILSYYSSLNLKGQTKCPT

SEQ ID NO: 2194523 - protein, 21 aa, Cryptosporidium hominis
NKQIFIIGGIIDRNKYKNISK

SEQ ID NO: 2194524 - protein, 27 aa, Cryptosporidium hominis
NKQKPSLGLIWSNSINWRIFLSKSRSP

SEQ ID NO: 2194525 - protein, 31 aa, Cryptosporidium hominis
NKQLKLERSIWWLTDVILTEPSLIVLDSCSS

SEQ ID NO: 2194526 - protein, 18 aa, Cryptosporidium hominis
NKQRFFPTAAIPRFDNFD

SEQ ID NO: 2194527 - protein, 24 aa, Cryptosporidium hominis
NKREYFQSILRFLENFKLSNQIQT

SEQ ID NO: 2194528 - protein, 19 aa, Cryptosporidium hominis
NKRLLSELMAIITVGRKGN

SEQ ID NO: 2194529 - protein, 30 aa, Cryptosporidium hominis
NKTCNSLYKLIFDPTSPRNYFKNNLGSGAI

SEQ ID NO: 2194530 - protein, 23 aa, Cryptosporidium hominis
NKTIKIFNVVPLSYKKSVLDIDY

SEQ ID NO: 2194531 - protein, 24 aa, Cryptosporidium hominis
NKTLRVYSLGKKRLLRKSEYRNIP

SEQ ID NO: 2194532 - protein, 21 aa, Cryptosporidium hominis
NKTMYISSGTYFYSNAETSRW

SEQ ID NO: 2194533 - protein, 26 aa, Cryptosporidium hominis
NKTNIYFPFHFLHIQIVSGLRNLIIS

SEQ ID NO: 2194534 - protein, 24 aa, Cryptosporidium hominis
NKVGAQLIFQWIKNPNIGDQEIYG

SEQ ID NO: 2194535 - protein, 29 aa, Cryptosporidium hominis
NKVIIDTSDLLAISFRISPEKKCDEKIGV

SEQ ID NO: 2194536 - protein, 19 aa, Cryptosporidium hominis
NKVWLVAPKSSPGILLNKG

SEQ ID NO: 2194537 - protein, 27 aa, Cryptosporidium hominis
NKWYLRSQPLRAVNKILFEEQKLINIS

SEQ ID NO: 2194538 - protein, 17 aa, Cryptosporidium hominis
NKYFLFNNINTQNTLYK

SEQ ID NO: 2194539 - protein, 20 aa, Cryptosporidium hominis
NKYIDFLPSHGISGKLLIYD

SEQ ID NO: 2194540 - protein, 25 aa, Cryptosporidium hominis
NKYKVIIVSILYQEDLKLNYLQGVY

SEQ ID NO: 2194541 - protein, 17 aa, Cryptosporidium hominis
NKYLDYYNEKLFNVIKE

SEQ ID NO: 2194542 - protein, 19 aa, Cryptosporidium hominis
NKYTLLGRGLNNLPKHSST

SEQ ID NO: 2194543 - protein, 20 aa, Cryptosporidium hominis
NLAGLFSLQLYFASSYSRVK

SEQ ID NO: 2194544 - protein, 24 aa, Cryptosporidium hominis
NLAKLHGLQLFKPIESLINLASEI

SEQ ID NO: 2194545 - protein, 20 aa, Cryptosporidium hominis
NLAVVSYINNANRRLSVAEN

SEQ ID NO: 2194546 - protein, 17 aa, Cryptosporidium hominis
NLCLLYRNVSSPLIHFE

SEQ ID NO: 2194547 - protein, 18 aa, Cryptosporidium hominis
NLCYSRELILNGIGNLFP

SEQ ID NO: 2194548 - protein, 27 aa, Cryptosporidium hominis
NLDHYSLPFYYFELLFEATCKRVLVEK

SEQ ID NO: 2194549 - protein, 30 aa, Cryptosporidium hominis
NLDINKLQEIIQKSIPWISNNNINMNINTG

SEQ ID NO: 2194550 - protein, 22 aa, Cryptosporidium hominis
NLDLYSLPPDMLKTERFSNISN

SEQ ID NO: 2194551 - protein, 18 aa, Cryptosporidium hominis
NLDPNNPVLLLQSYFKYS

SEQ ID NO: 2194552 - protein, 25 aa, Cryptosporidium hominis
NLEIESLKKLLIERNQLEMQKEYNR

SEQ ID NO: 2194553 - protein, 18 aa, Cryptosporidium hominis
NLEIKWNAYRKRTQRLET

SEQ ID NO: 2194554 - protein, 27 aa, Cryptosporidium hominis
NLEKLKIDRFEPFSSLIKQLATQPCIR

SEQ ID NO: 2194555 - protein, 18 aa, Cryptosporidium hominis
NLELLDNGSNYSKTQSFN

SEQ ID NO: 2194556 - protein, 24 aa, Cryptosporidium hominis
NLELTEHAGIIPRAVQLIFERLES

SEQ ID NO: 2194557 - protein, 21 aa, Cryptosporidium hominis
NLERFLPIYNEIIDSIANLRL

SEQ ID NO: 2194558 - protein, 24 aa, Cryptosporidium hominis
NLFGLYCHVVFSLCKFVSVIINTI

SEQ ID NO: 2194559 - protein, 26 aa, Cryptosporidium hominis
NLFLPELINMMGPLLSGTLFPYNNNT

SEQ ID NO: 2194560 - protein, 26 aa, Cryptosporidium hominis
NLFQKLRVFRIHRLRIAQFGPLEEPE

SEQ ID NO: 2194561 - protein, 22 aa, Cryptosporidium hominis
NLFSVSLFSFYNYKFIFDLTAT

SEQ ID NO: 2194562 - protein, 18 aa, Cryptosporidium hominis
NLGGYYYIYQRTEFIDDS

SEQ ID NO: 2194563 - protein, 17 aa, Cryptosporidium hominis
NLGSTIVLIFQAPENFK

SEQ ID NO: 2194564 - protein, 24 aa, Cryptosporidium hominis
NLHKNFNQHFSGCSTNIIGEIRDS

SEQ ID NO: 2194565 - protein, 30 aa, Cryptosporidium hominis
NLIENWKHIFSIDFPYMQTLGGGLGRLLVH

SEQ ID NO: 2194566 - protein, 18 aa, Cryptosporidium hominis
NLIPGLNSCFRSFLSQCP

SEQ ID NO: 2194567 - protein, 18 aa, Cryptosporidium hominis
NLIVFILDGDPEKHSQEF

SEQ ID NO: 2194568 - protein, 20 aa, Cryptosporidium hominis
NLKDLIYRPEQEGGPVDISQ

SEQ ID NO: 2194569 - protein, 20 aa, Cryptosporidium hominis
NLKFLIFFKINNDINPCKED

SEQ ID NO: 2194570 - protein, 18 aa, Cryptosporidium hominis
NLKILQTISEIYPGLVEK

SEQ ID NO: 2194571 - protein, 29 aa, Cryptosporidium hominis
NLKITCFKLWRFFIYYRKTRNSRFEKITN

SEQ ID NO: 2194572 - protein, 35 aa, Cryptosporidium hominis
NLKKKMIELILIKKFKDFYILIMKNYGIKMNHINN

SEQ ID NO: 2194573 - protein, 24 aa, Cryptosporidium hominis
NLKLDKFIESFSVTLVFIASTLIN

SEQ ID NO: 2194574 - protein, 28 aa, Cryptosporidium hominis
NLKSSEWIFFFFKHLLSENPCIFRDLYF

SEQ ID NO: 2194575 - protein, 17 aa, Cryptosporidium hominis
NLKYLETPQYLRKTLFK

SEQ ID NO: 2194576 - protein, 34 aa, Cryptosporidium hominis
NLKYRDIIDWKGCNPLILISSFFCNGKKLCDVRS

SEQ ID NO: 2194577 - protein, 20 aa, Cryptosporidium hominis
NLLFSLAGFSVRILPTCRIG

SEQ ID NO: 2194578 - protein, 26 aa, Cryptosporidium hominis
NLLGFGDNCFYIVNNGPFSQSNHTSK

SEQ ID NO: 2194579 - protein, 23 aa, Cryptosporidium hominis
NLLGIQLRCQILEAILELMKNQS

SEQ ID NO: 2194580 - protein, 24 aa, Cryptosporidium hominis
NLLGKFELSGIPPAPRGVPQIEVT

SEQ ID NO: 2194581 - protein, 23 aa, Cryptosporidium hominis
NLLKENDILFKFPRVSPIINDEK

SEQ ID NO: 2194582 - protein, 25 aa, Cryptosporidium hominis
NLLKVIYRIFLFNNLLNNTNLGITK

SEQ ID NO: 2194583 - protein, 17 aa, Cryptosporidium hominis
NLLLIPKGRDNEIYVYD

SEQ ID NO: 2194584 - protein, 17 aa, Cryptosporidium hominis
NLLLRKEKMLDGKVINL

SEQ ID NO: 2194585 - protein, 20 aa, Cryptosporidium hominis
NLLNKRLFSNKIKIFGNKPT

SEQ ID NO: 2194586 - protein, 25 aa, Cryptosporidium hominis
NLLNNWIDLCYLYLLDLEDNPKLRA

SEQ ID NO: 2194587 - protein, 32 aa, Cryptosporidium hominis
NLLNRESDYLQRFPTLTGFNRAGLSGNERIIV

SEQ ID NO: 2194588 - protein, 19 aa, Cryptosporidium hominis
NLLSDLWIRYHVISSIARN

SEQ ID NO: 2194589 - protein, 21 aa, Cryptosporidium hominis
NLLTEMPILYLIVSNTGVSQI

SEQ ID NO: 2194590 - protein, 25 aa, Cryptosporidium hominis
NLLTKWMGCPPLPFKLDDKETDNLE

SEQ ID NO: 2194591 - protein, 26 aa, Cryptosporidium hominis
NLLTTVDSIIKFLKSYSTHIAVVGPS

SEQ ID NO: 2194592 - protein, 21 aa, Cryptosporidium hominis
NLMLSPHLFVAFCRARMLSPD

SEQ ID NO: 2194593 - protein, 27 aa, Cryptosporidium hominis
NLNGMWYIKGIVTKGIWPFLSATNKVK

SEQ ID NO: 2194594 - protein, 31 aa, Cryptosporidium hominis
NLNIKLVKIWEFIVPNLIFTLSRIRLYKEIK

SEQ ID NO: 2194595 - protein, 21 aa, Cryptosporidium hominis
NLNINILPTIALIKNSKLIHK

SEQ ID NO: 2194596 - protein, 25 aa, Cryptosporidium hominis
NLNLKLLNEPLQDDFLLTFPGGIPK

SEQ ID NO: 2194597 - protein, 35 aa, Cryptosporidium hominis
NLNLKTPIILTPFEYQVFLGITKWSTRYLNTPDLQ

SEQ ID NO: 2194598 - protein, 20 aa, Cryptosporidium hominis
NLNMDYCISNGYGPNMNTNN

SEQ ID NO: 2194599 - protein, 26 aa, Cryptosporidium hominis
NLNNERYISSSLILTNGTSQGKFALS

SEQ ID NO: 2194600 - protein, 18 aa, Cryptosporidium hominis
NLNNKSCIITWDPVKTKL

SEQ ID NO: 2194601 - protein, 23 aa, Cryptosporidium hominis
NLNQMLYIYDANCLPKWFITSQG

SEQ ID NO: 2194602 - protein, 20 aa, Cryptosporidium hominis
NLNSRLLLKVQLPESINQLY

SEQ ID NO: 2194603 - protein, 24 aa, Cryptosporidium hominis
NLNTNKYKYLIFKERYHNGNYYDK

SEQ ID NO: 2194604 - protein, 18 aa, Cryptosporidium hominis
NLPICYIYKYRRESILKE

SEQ ID NO: 2194605 - protein, 25 aa, Cryptosporidium hominis
NLPLSLNALKALPGWGARQKLERFG

SEQ ID NO: 2194606 - protein, 32 aa, Cryptosporidium hominis
NLPNPKFSQWLNPPYFRIGPQFEPDPMSYNWG

SEQ ID NO: 2194607 - protein, 31 aa, Cryptosporidium hominis
NLPNSFLERIFLRYNQLFEIFLCQVNNSDSS

SEQ ID NO: 2194608 - protein, 18 aa, Cryptosporidium hominis
NLPPPPPITGFPSNMIYF

SEQ ID NO: 2194609 - protein, 20 aa, Cryptosporidium hominis
NLPRSWYFLGEKIDEIYVSV

SEQ ID NO: 2194610 - protein, 22 aa, Cryptosporidium hominis
NLQEKISNHLIGLSIAKSNNSF

SEQ ID NO: 2194611 - protein, 17 aa, Cryptosporidium hominis
NLQLHAHLFQQDPIYRN

SEQ ID NO: 2194612 - protein, 17 aa, Cryptosporidium hominis
NLQLMLNSIWSDLSKEN

SEQ ID NO: 2194613 - protein, 29 aa, Cryptosporidium hominis
NLQQLLRVAHQCGLWNAAVRLHLEFIGEI

SEQ ID NO: 2194614 - protein, 22 aa, Cryptosporidium hominis
NLQQPHFYSILKGETFLVRMDS

SEQ ID NO: 2194615 - protein, 37 aa, Cryptosporidium hominis
NLQSIRTWRGWKPLKKLKKFFKPRYSYGLPDMNGPNF

SEQ ID NO: 2194616 - protein, 23 aa, Cryptosporidium hominis
NLQTLRQISWFYVILDEGHKIRN

SEQ ID NO: 2194617 - protein, 24 aa, Cryptosporidium hominis
NLRDPILYRILKQSHPHTGDKWVI

SEQ ID NO: 2194618 - protein, 20 aa, Cryptosporidium hominis
NLRLKYMQIYIMGGYAKKHF

SEQ ID NO: 2194619 - protein, 18 aa, Cryptosporidium hominis
NLRMKALELFKGKNQAKN

SEQ ID NO: 2194620 - protein, 27 aa, Cryptosporidium hominis
NLRNIKINLILIIKYSKVLLSISSDKR

SEQ ID NO: 2194621 - protein, 21 aa, Cryptosporidium hominis
NLRRIFKNAINSRPCILVFDD

SEQ ID NO: 2194622 - protein, 17 aa, Cryptosporidium hominis
NLRVTWKKNLYPSSSTR

SEQ ID NO: 2194623 - protein, 22 aa, Cryptosporidium hominis
NLSGNLPSINWAISNNFREKMK

SEQ ID NO: 2194624 - protein, 22 aa, Cryptosporidium hominis
NLSHLFSLLRLHNIMEYYPKSV

SEQ ID NO: 2194625 - protein, 20 aa, Cryptosporidium hominis
NLSIYKHLFKQSNKANFDRL

SEQ ID NO: 2194626 - protein, 20 aa, Cryptosporidium hominis
NLSKRLECMILRSSFEQLYL

SEQ ID NO: 2194627 - protein, 40 aa, Cryptosporidium hominis
NLSLNGIHYPIDDRLYLWNGLYWIRILDQSKSETLKTSFE

SEQ ID NO: 2194628 - protein, 21 aa, Cryptosporidium hominis
NLSLSTILDICDVRIVDELPP

SEQ ID NO: 2194629 - protein, 29 aa, Cryptosporidium hominis
NLSPKGLTKILFKNFISYYSNEYISKLWQ

SEQ ID NO: 2194630 - protein, 31 aa, Cryptosporidium hominis
NLSRFEPLIKTIIYHLLCQLNIGNNSLISYN

SEQ ID NO: 2194631 - protein, 26 aa, Cryptosporidium hominis
NLSSRLPLPFPIPIQQQPQLQMVNQD

SEQ ID NO: 2194632 - protein, 17 aa, Cryptosporidium hominis
NLTDYLSYGIINLDKPA

SEQ ID NO: 2194633 - protein, 18 aa, Cryptosporidium hominis
NLTIIGTLSRFPSEKKCC

SEQ ID NO: 2194634 - protein, 25 aa, Cryptosporidium hominis
NLTILKPCYLLLWNYNIRNCNNTTK

SEQ ID NO: 2194635 - protein, 18 aa, Cryptosporidium hominis
NLTLKHKYGLIGRNGIGK

SEQ ID NO: 2194636 - protein, 17 aa, Cryptosporidium hominis
NLTTRNLSISTTTIRVV

SEQ ID NO: 2194637 - protein, 25 aa, Cryptosporidium hominis
NLVEKKVLRKVPVSGVYELSGSRIP

SEQ ID NO: 2194638 - protein, 18 aa, Cryptosporidium hominis
NLVFNIFSIVLQIDKRIQ

SEQ ID NO: 2194639 - protein, 33 aa, Cryptosporidium hominis
NLVHKKHIMLAKFIRYILRPDPNLRPTPEMALR

SEQ ID NO: 2194640 - protein, 21 aa, Cryptosporidium hominis
NLVSSFIPIPLNTRGLRRETM

SEQ ID NO: 2194641 - protein, 17 aa, Cryptosporidium hominis
NLVVSFLLSCDYADIIS

SEQ ID NO: 2194642 - protein, 26 aa, Cryptosporidium hominis
NLVYGIPLLCLRGSMPIWYYRKKKNM

SEQ ID NO: 2194643 - protein, 25 aa, Cryptosporidium hominis
NLWILFQRRHSVLFKYFGSLENEIC

SEQ ID NO: 2194644 - protein, 23 aa, Cryptosporidium hominis
NLYDLKSIWKIGNLVPYVTSNIN

SEQ ID NO: 2194645 - protein, 20 aa, Cryptosporidium hominis
NLYIDSALDYRLFEKLLASE

SEQ ID NO: 2194646 - protein, 17 aa, Cryptosporidium hominis
NLYPLNPLSSLSYDRVL

SEQ ID NO: 2194647 - protein, 30 aa, Cryptosporidium hominis
NMAIEFFTLEREIYIAKLLLHLEEQRDAMR

SEQ ID NO: 2194648 - protein, 18 aa, Cryptosporidium hominis
NMARDAFKFINNNNKLPF

SEQ ID NO: 2194649 - protein, 28 aa, Cryptosporidium hominis
NMASNPLNFYFENIYEKSLKTLSNALAF

SEQ ID NO: 2194650 - protein, 24 aa, Cryptosporidium hominis
NMDDRICMHCWISKSTLYCSTCMC

SEQ ID NO: 2194651 - protein, 19 aa, Cryptosporidium hominis
NMDLQLSELRYGISMWSGC

SEQ ID NO: 2194652 - protein, 21 aa, Cryptosporidium hominis
NMDPESILRLIDDYDYEFEED

SEQ ID NO: 2194653 - protein, 28 aa, Cryptosporidium hominis
NMDRQKWLQTSGLYIPLLNEVIEQILHE

SEQ ID NO: 2194654 - protein, 30 aa, Cryptosporidium hominis
NMEHLMVMDMSYSLELFTSPISSEFDILGQ

SEQ ID NO: 2194655 - protein, 17 aa, Cryptosporidium hominis
NMEWRAKPKNNSLVRLI

SEQ ID NO: 2194656 - protein, 25 aa, Cryptosporidium hominis
NMFPISILHTIYSIKNCKLINSLFK

SEQ ID NO: 2194657 - protein, 17 aa, Cryptosporidium hominis
NMKDILSDWRNSTLLKS

SEQ ID NO: 2194658 - protein, 18 aa, Cryptosporidium hominis
NMLKFEIDKFLADNPLFY

SEQ ID NO: 2194659 - protein, 23 aa, Cryptosporidium hominis
NMLPIDGVRFHKSDFRMGIFESF

SEQ ID NO: 2194660 - protein, 18 aa, Cryptosporidium hominis
NMLTKIFNKSLKKRLIYP

SEQ ID NO: 2194661 - protein, 33 aa, Cryptosporidium hominis
NMNLPDSLLSRFDLQFLLLDIPDKEKDLKLARH

SEQ ID NO: 2194662 - protein, 18 aa, Cryptosporidium hominis
NMNMNPPHLPPPPNMQMQ

SEQ ID NO: 2194663 - protein, 24 aa, Cryptosporidium hominis
NMNNLNQFPLIKPPYHHHLYEVYH

SEQ ID NO: 2194664 - protein, 26 aa, Cryptosporidium hominis
NMNPNRLFSIIRAYVLTLYIRHSSQI

SEQ ID NO: 2194665 - protein, 21 aa, Cryptosporidium hominis
NMPIPNFVPKAVPSFIAKQIG

SEQ ID NO: 2194666 - protein, 29 aa, Cryptosporidium hominis
NMSQYRQRWLEVQYMLILYEECLNWSRKI

SEQ ID NO: 2194667 - protein, 28 aa, Cryptosporidium hominis
NMSRYQIFLDLFELILEILEGMKARESV

SEQ ID NO: 2194668 - protein, 27 aa, Cryptosporidium hominis
NMTERFAYEVLLFWQNSAGSSDFKSAT

SEQ ID NO: 2194669 - protein, 28 aa, Cryptosporidium hominis
NMTMQFFNFRIVKRRHYSSSSNLLKSFN

SEQ ID NO: 2194670 - protein, 17 aa, Cryptosporidium hominis
NMVKLIRIPLPESRLRD

SEQ ID NO: 2194671 - protein, 19 aa, Cryptosporidium hominis
NMYVWNHRTWFIRKYNSVE

SEQ ID NO: 2194672 - protein, 23 aa, Cryptosporidium hominis
NNAFIQLFNQGYIFRKTRLVSWC

SEQ ID NO: 2194673 - protein, 26 aa, Cryptosporidium hominis
NNDDFYKNIIFLLRLIALYSEKSEQK

SEQ ID NO: 2194674 - protein, 22 aa, Cryptosporidium hominis
NNDIKLMMQNNPLLEEYNESDR

SEQ ID NO: 2194675 - protein, 24 aa, Cryptosporidium hominis
NNEDLKLISLFYTAETNVPLSPSQ

SEQ ID NO: 2194676 - protein, 24 aa, Cryptosporidium hominis
NNEDQYIIYIYSNRIAIQDLNNYI

SEQ ID NO: 2194677 - protein, 24 aa, Cryptosporidium hominis
NNEEEMIGLLKLVFDKATTQHHFI

SEQ ID NO: 2194678 - protein, 19 aa, Cryptosporidium hominis
NNEIQIEWIDLNNEPKDNK

SEQ ID NO: 2194679 - protein, 27 aa, Cryptosporidium hominis
NNENDQFLRLLQLLGEWAEFGLIVIFC

SEQ ID NO: 2194680 - protein, 21 aa, Cryptosporidium hominis
NNESFKCDILKIGPLAFAPNS

SEQ ID NO: 2194681 - protein, 28 aa, Cryptosporidium hominis
NNEYLSIGIIQMLYILNKQWERSINNEN

SEQ ID NO: 2194682 - protein, 17 aa, Cryptosporidium hominis
NNFNFRINVQWHSVYVD

SEQ ID NO: 2194683 - protein, 23 aa, Cryptosporidium hominis
NNGPLFVDLLNKLLCIDPDERLS

SEQ ID NO: 2194684 - protein, 25 aa, Cryptosporidium hominis
NNGSYMQMFNFVEAALIIQNSTSLY

SEQ ID NO: 2194685 - protein, 25 aa, Cryptosporidium hominis
NNHDDILNPLWLSNGVSSTPIISAS

SEQ ID NO: 2194686 - protein, 26 aa, Cryptosporidium hominis
NNHHFLNIFAPNRNHINLIDPSMSAL

SEQ ID NO: 2194687 - protein, 24 aa, Cryptosporidium hominis
NNHKYIIYALIFHKGKTTNSGHYY

SEQ ID NO: 2194688 - protein, 23 aa, Cryptosporidium hominis
NNHLKVLFCTSLHMMDSEIKADR

SEQ ID NO: 2194689 - protein, 18 aa, Cryptosporidium hominis
NNHPMFKKMLYPTNNEHS

SEQ ID NO: 2194690 - protein, 21 aa, Cryptosporidium hominis
NNIALFLPRNTNIPEFSALLS

SEQ ID NO: 2194691 - protein, 19 aa, Cryptosporidium hominis
NNICRVIVLDWLIGVHRKF

SEQ ID NO: 2194692 - protein, 24 aa, Cryptosporidium hominis
NNIFAKVFIYFSNHQLRIGDLNKA

SEQ ID NO: 2194693 - protein, 18 aa, Cryptosporidium hominis
NNIFSYFKQIISLFGINN

SEQ ID NO: 2194694 - protein, 21 aa, Cryptosporidium hominis
NNIGFGFVFPFQPTSREEISD

SEQ ID NO: 2194695 - protein, 21 aa, Cryptosporidium hominis
NNIIFQILNPNENLPNIAGPI

SEQ ID NO: 2194696 - protein, 18 aa, Cryptosporidium hominis
NNINQNIMLLDPSLSYLS

SEQ ID NO: 2194697 - protein, 26 aa, Cryptosporidium hominis
NNISKKLKVLPLKTPNIISNDSETSC

SEQ ID NO: 2194698 - protein, 17 aa, Cryptosporidium hominis
NNIYSLLGISKLECLTE

SEQ ID NO: 2194699 - protein, 31 aa, Cryptosporidium hominis
NNKDNFLIFNNIFYVFPVPFDMKSIRSLQTF

SEQ ID NO: 2194700 - protein, 17 aa, Cryptosporidium hominis
NNKEMVLSSINDSFNQL

SEQ ID NO: 2194701 - protein, 25 aa, Cryptosporidium hominis
NNKIILRHIIISLITIYRCGFASSI

SEQ ID NO: 2194702 - protein, 24 aa, Cryptosporidium hominis
NNKIQKLLWGCLNFTPCQRLTLAQ

SEQ ID NO: 2194703 - protein, 26 aa, Cryptosporidium hominis
NNKSTSLEIIPLLKPLLTGYMDDQIP

SEQ ID NO: 2194704 - protein, 23 aa, Cryptosporidium hominis
NNKTEYPTVPYPFSIDSDDGHLR

SEQ ID NO: 2194705 - protein, 31 aa, Cryptosporidium hominis
NNLCNQLTIHPNIDVLPWIGSVGVGGVVTWN

SEQ ID NO: 2194706 - protein, 38 aa, Cryptosporidium hominis
NNLDELELENLCLIRQLFKDFVRIITQGRIETLEKGIG

SEQ ID NO: 2194707 - protein, 18 aa, Cryptosporidium hominis
NNLDGLCIGSRNIRVNAV

SEQ ID NO: 2194708 - protein, 22 aa, Cryptosporidium hominis
NNLIPFNVKLEYWKRVLSDGCQ

SEQ ID NO: 2194709 - protein, 27 aa, Cryptosporidium hominis
NNLLLSYLDTFLFPGSSIFNLDLFNSI

SEQ ID NO: 2194710 - protein, 25 aa, Cryptosporidium hominis
NNLREGFIPLIYKGVQLISYSYLLN

SEQ ID NO: 2194711 - protein, 23 aa, Cryptosporidium hominis
NNLRELFEKFTYRYLSRAGIMVE

SEQ ID NO: 2194712 - protein, 20 aa, Cryptosporidium hominis
NNLSLPFIWEKKFEQEKKSS

SEQ ID NO: 2194713 - protein, 18 aa, Cryptosporidium hominis
NNLTNFLYDIIYSRELHS

SEQ ID NO: 2194714 - protein, 17 aa, Cryptosporidium hominis
NNLYNTCFWSLVSINKL

SEQ ID NO: 2194715 - protein, 24 aa, Cryptosporidium hominis
NNNATTQILGSKLPGVHPTTAALA

SEQ ID NO: 2194716 - protein, 22 aa, Cryptosporidium hominis
NNNCRSLFLSHCFGQKGKFQEA

SEQ ID NO: 2194717 - protein, 27 aa, Cryptosporidium hominis
NNNEVYTTLFIKKIPRNIWSKQWEMHE

SEQ ID NO: 2194718 - protein, 17 aa, Cryptosporidium hominis
NNNFREYLTSFQAPNQN

SEQ ID NO: 2194719 - protein, 20 aa, Cryptosporidium hominis
NNNIFGMLSCRPYSSSISTI

SEQ ID NO: 2194720 - protein, 25 aa, Cryptosporidium hominis
NNNILLQCIFLLNLKDEFISKVKNY

SEQ ID NO: 2194721 - protein, 22 aa, Cryptosporidium hominis
NNNIPYCIIIGESEALKKTVQF

SEQ ID NO: 2194722 - protein, 28 aa, Cryptosporidium hominis
NNNLDFSYLNIRWRRKMGEKLIDIQGKD

SEQ ID NO: 2194723 - protein, 21 aa, Cryptosporidium hominis
NNNLQLYSWLDMKLSQYESKQ

SEQ ID NO: 2194724 - protein, 31 aa, Cryptosporidium hominis
NNNNNMASSIPYLLPLLMGSGSNNDQNITLL

SEQ ID NO: 2194725 - protein, 37 aa, Cryptosporidium hominis
NNNNNNMLLLLKLVDNILIRIILLTIENIIDINNEDD

SEQ ID NO: 2194726 - protein, 24 aa, Cryptosporidium hominis
NNNPWIFEFIAIITKRITNCILTY

SEQ ID NO: 2194727 - protein, 25 aa, Cryptosporidium hominis
NNNSCRLLTYFLNLFNPVIGDAISD

SEQ ID NO: 2194728 - protein, 20 aa, Cryptosporidium hominis
NNNSFISFPSITMSSFSSVN

SEQ ID NO: 2194729 - protein, 28 aa, Cryptosporidium hominis
NNNTINSVKLPVPPSYKGVGTRKNPIGG

SEQ ID NO: 2194730 - protein, 24 aa, Cryptosporidium hominis
NNNTSDFGIPRKSSLNSSFSDQMN

SEQ ID NO: 2194731 - protein, 18 aa, Cryptosporidium hominis
NNNYLSLGIPVISPIIRT

SEQ ID NO: 2194732 - protein, 24 aa, Cryptosporidium hominis
NNPEMMRMMLNPQMIQSVLNSNNM

SEQ ID NO: 2194733 - protein, 30 aa, Cryptosporidium hominis
NNPQLVRNILHSNPMFAQLSANNPMLDQML

SEQ ID NO: 2194734 - protein, 20 aa, Cryptosporidium hominis
NNPRFKYLTALGIVYLRLTE

SEQ ID NO: 2194735 - protein, 22 aa, Cryptosporidium hominis
NNPSFKLLMNHIEKWEVDNTYA

SEQ ID NO: 2194736 - protein, 21 aa, Cryptosporidium hominis
NNPVLLLQSYFKYSKKRRDEM

SEQ ID NO: 2194737 - protein, 24 aa, Cryptosporidium hominis
NNQDEILILGFNMTHLTLIDNQSS

SEQ ID NO: 2194738 - protein, 23 aa, Cryptosporidium hominis
NNQLITTFEWSHEINQIFVALNN

SEQ ID NO: 2194739 - protein, 27 aa, Cryptosporidium hominis
NNRICKSYFQLCQRLKEYLKNMSPYFK

SEQ ID NO: 2194740 - protein, 26 aa, Cryptosporidium hominis
NNRINIVHDLLLLRTLTSIIQNSKDR

SEQ ID NO: 2194741 - protein, 22 aa, Cryptosporidium hominis
NNRIYIILKESLDLLYSYLGFN

SEQ ID NO: 2194742 - protein, 17 aa, Cryptosporidium hominis
NNRTLFAVFLQPIVIDS

SEQ ID NO: 2194743 - protein, 26 aa, Cryptosporidium hominis
NNSANPQLWCKISFIDLAGSERASAT

SEQ ID NO: 2194744 - protein, 24 aa, Cryptosporidium hominis
NNSIDLLFNFNRLNRWLLKRIIAS

SEQ ID NO: 2194745 - protein, 22 aa, Cryptosporidium hominis
NNSKNTKGFAFITYSKREEAQN

SEQ ID NO: 2194746 - protein, 25 aa, Cryptosporidium hominis
NNSNSIFCYSVDLVYSLFSLLQNEV

SEQ ID NO: 2194747 - protein, 37 aa, Cryptosporidium hominis
NNSNSIIIKSLRYFQDQLFKFLIRKNHRRTTLKVPIY

SEQ ID NO: 2194748 - protein, 26 aa, Cryptosporidium hominis
NNSNWLIIGAVKHELFFYLAKDNVTS

SEQ ID NO: 2194749 - protein, 28 aa, Cryptosporidium hominis
NNSPQTLPYIYLFERFMNYLIEAGTKRI

SEQ ID NO: 2194750 - protein, 28 aa, Cryptosporidium hominis
NNSPSLNMLNSIDFNYLSPLQVLNDSTL

SEQ ID NO: 2194751 - protein, 31 aa, Cryptosporidium hominis
NNSSRQIQPLRFPLPIFEFFCENMAKKCKGI

SEQ ID NO: 2194752 - protein, 19 aa, Cryptosporidium hominis
NNSVLLSAVLQVIASIQKL

SEQ ID NO: 2194753 - protein, 22 aa, Cryptosporidium hominis
NNTAGQIFLKHGSELQLIPRDR

SEQ ID NO: 2194754 - protein, 18 aa, Cryptosporidium hominis
NNTEGDLLIYKRPLNRSQ

SEQ ID NO: 2194755 - protein, 21 aa, Cryptosporidium hominis
NNTQFIQWICHSANIIEQRIS

SEQ ID NO: 2194756 - protein, 25 aa, Cryptosporidium hominis
NNTSNLRVLAKKGLLERVEEKVNDV

SEQ ID NO: 2194757 - protein, 24 aa, Cryptosporidium hominis
NNTTLLDRLIFVREDREDESSRYG

SEQ ID NO: 2194758 - protein, 25 aa, Cryptosporidium hominis
NNVSPPVFIFVIDTCLIEAELTELR

SEQ ID NO: 2194759 - protein, 21 aa, Cryptosporidium hominis
NNYKHNWTLPLKDFTSSKKKE

SEQ ID NO: 2194760 - protein, 24 aa, Cryptosporidium hominis
NPCLVHILPSILKRTISKGNPEFS

SEQ ID NO: 2194761 - protein, 30 aa, Cryptosporidium hominis
NPDFKKLNSLLLPRPPPPPPLASIHIHDED

SEQ ID NO: 2194762 - protein, 21 aa, Cryptosporidium hominis
NPEFTYYIPNLNFNPNFETDF

SEQ ID NO: 2194763 - protein, 29 aa, Cryptosporidium hominis
NPEHLTAPLPVMYPYHRGIGRAIGVPNHT

SEQ ID NO: 2194764 - protein, 25 aa, Cryptosporidium hominis
NPEIMFLTLLRNLYKYAFLDGQNDL

SEQ ID NO: 2194765 - protein, 33 aa, Cryptosporidium hominis
NPELRPWSRLLDVSPWFNYGFTEKTFKEYIIRQ

SEQ ID NO: 2194766 - protein, 26 aa, Cryptosporidium hominis
NPFGWQLDMRLVFYNALKYHKEGNTV

SEQ ID NO: 2194767 - protein, 20 aa, Cryptosporidium hominis
NPHFDGVFHYYDFVNNQNII

SEQ ID NO: 2194768 - protein, 19 aa, Cryptosporidium hominis
NPIPSVAIPSNVSSAIGVA

SEQ ID NO: 2194769 - protein, 20 aa, Cryptosporidium hominis
NPIQRPDLHVGLHSAPRGIL

SEQ ID NO: 2194770 - protein, 27 aa, Cryptosporidium hominis
NPIYDPKYIYVPYKKEFMPLKDLSEPH

SEQ ID NO: 2194771 - protein, 28 aa, Cryptosporidium hominis
NPKDFLLGSKLFMEFLKSNSITGHLCND

SEQ ID NO: 2194772 - protein, 26 aa, Cryptosporidium hominis
NPKQNTLIIFINGRLVKNNAIKQAIE

SEQ ID NO: 2194773 - protein, 26 aa, Cryptosporidium hominis
NPKSLDLWNLGCLIYWSYQVSSNLNP

SEQ ID NO: 2194774 - protein, 27 aa, Cryptosporidium hominis
NPLCKICDPFFIGYSDLLNLQVSTKTI

SEQ ID NO: 2194775 - protein, 32 aa, Cryptosporidium hominis
NPLGLTHYSHPYNFPKASFLPPNTEPSSNIIL

SEQ ID NO: 2194776 - protein, 24 aa, Cryptosporidium hominis
NPLHSLVICHPDLHLIEQRFFEIY

SEQ ID NO: 2194777 - protein, 23 aa, Cryptosporidium hominis
NPLNKYQYLLLKHLEIPSVKFEI

SEQ ID NO: 2194778 - protein, 30 aa, Cryptosporidium hominis
NPLYNYGKNYAFYPPGIKPAPIIGNYHTTP

SEQ ID NO: 2194779 - protein, 21 aa, Cryptosporidium hominis
NPNDHYYSPKLCPEICFVKSN

SEQ ID NO: 2194780 - protein, 26 aa, Cryptosporidium hominis
NPNENPILCVWFAQKKGNYGFIEFRT

SEQ ID NO: 2194781 - protein, 28 aa, Cryptosporidium hominis
NPNKAPLGKLIPSPLMITIGIGNTELTE

SEQ ID NO: 2194782 - protein, 26 aa, Cryptosporidium hominis
NPNPSKCYTLPIKGFGELVQREQQQR

SEQ ID NO: 2194783 - protein, 27 aa, Cryptosporidium hominis
NPNVKIVHTLWLWACDGQWQRVSEDLF

SEQ ID NO: 2194784 - protein, 25 aa, Cryptosporidium hominis
NPPALALRWLMNLYSLTNSYVKLSV

SEQ ID NO: 2194785 - protein, 19 aa, Cryptosporidium hominis
NPPIDAIRHGFGENGMRYI

SEQ ID NO: 2194786 - protein, 24 aa, Cryptosporidium hominis
NPPYSYWGFYLYSNIRVLNQLLYS

SEQ ID NO: 2194787 - protein, 25 aa, Cryptosporidium hominis
NPPYTSHRLLQIPSALRGINADIIA

SEQ ID NO: 2194788 - protein, 21 aa, Cryptosporidium hominis
NPRVPYILKGKGPPIFGKDTF

SEQ ID NO: 2194789 - protein, 18 aa, Cryptosporidium hominis
NPSAWRWYHSVVGEERCS

SEQ ID NO: 2194790 - protein, 23 aa, Cryptosporidium hominis
NPSKYVILALHNYFWDQKSNKGI

SEQ ID NO: 2194791 - protein, 22 aa, Cryptosporidium hominis
NPSSLIYPKNEVTPNAPASALD

SEQ ID NO: 2194792 - protein, 27 aa, Cryptosporidium hominis
NPSTLATYPYLIQQLYDADILSEKVIL

SEQ ID NO: 2194793 - protein, 19 aa, Cryptosporidium hominis
NPSVYIFIRSRESNGDGIM

SEQ ID NO: 2194794 - protein, 28 aa, Cryptosporidium hominis
NPVLKNMIFFLYDSFLSEIFQLDGLSEN

SEQ ID NO: 2194795 - protein, 21 aa, Cryptosporidium hominis
NPYLNGVWIKNGLSFVVSQKY

SEQ ID NO: 2194796 - protein, 18 aa, Cryptosporidium hominis
NQASPISLTPLAPLGVLN

SEQ ID NO: 2194797 - protein, 32 aa, Cryptosporidium hominis
NQCRNLRYFDFIHKELVLFSRYDTTRSIPNLL

SEQ ID NO: 2194798 - protein, 31 aa, Cryptosporidium hominis
NQDSSSLLLLFPSILFITIQKHKNSSSINND

SEQ ID NO: 2194799 - protein, 25 aa, Cryptosporidium hominis
NQEIHQLLIIDNILVSACWGGKIVF

SEQ ID NO: 2194800 - protein, 29 aa, Cryptosporidium hominis
NQEIPVYPIKNITSYLHRWRIVGRVVSKS

SEQ ID NO: 2194801 - protein, 18 aa, Cryptosporidium hominis
NQEKLSAIPLNKKVATDK

SEQ ID NO: 2194802 - protein, 38 aa, Cryptosporidium hominis
NQFETRLRQYRAILNKLTIEKFDKLYEQILSVGINNEE

SEQ ID NO: 2194803 - protein, 18 aa, Cryptosporidium hominis
NQHDGQLAPFCPIIDDEN

SEQ ID NO: 2194804 - protein, 27 aa, Cryptosporidium hominis
NQIGFENFLLTVLQLRITIWATKNSTI

SEQ ID NO: 2194805 - protein, 24 aa, Cryptosporidium hominis
NQIIPLISSYFIFDNLSIDITEKQ

SEQ ID NO: 2194806 - protein, 21 aa, Cryptosporidium hominis
NQIIQCVSLLSWLSNIIISPS

SEQ ID NO: 2194807 - protein, 23 aa, Cryptosporidium hominis
NQISNLIGFNPFEGGDSLEKRED

SEQ ID NO: 2194808 - protein, 25 aa, Cryptosporidium hominis
NQKENYIFNFKNIHYFHSNKQGEFI

SEQ ID NO: 2194809 - protein, 26 aa, Cryptosporidium hominis
NQKGGNIILPLALIDKCIGNRIYVVM

SEQ ID NO: 2194810 - protein, 27 aa, Cryptosporidium hominis
NQKNDEYIFILCPTPSDLEEEYIDQEG

SEQ ID NO: 2194811 - protein, 25 aa, Cryptosporidium hominis
NQKSRPEIFCPEGYLLKDVKRDSSI

SEQ ID NO: 2194812 - protein, 21 aa, Cryptosporidium hominis
NQKVRNIIFPNFDIFNKYSDF

SEQ ID NO: 2194813 - protein, 25 aa, Cryptosporidium hominis
NQLLTHPFIDTCIVSRYVMQQIPKS

SEQ ID NO: 2194814 - protein, 23 aa, Cryptosporidium hominis
NQLNYISLFINNLTFTILKMMMF

SEQ ID NO: 2194815 - protein, 28 aa, Cryptosporidium hominis
NQLRRSITVTPLVEDLQRVLNGGAANLG

SEQ ID NO: 2194816 - protein, 25 aa, Cryptosporidium hominis
NQLSKGYSGLISLPLKLRFHCENLE

SEQ ID NO: 2194817 - protein, 20 aa, Cryptosporidium hominis
NQMAMAMYSPILAGGYGIAG

SEQ ID NO: 2194818 - protein, 26 aa, Cryptosporidium hominis
NQMLKLKLELFHKEMIKFSGISLQGR

SEQ ID NO: 2194819 - protein, 20 aa, Cryptosporidium hominis
NQNIMLLDPSLSYLSSKNNS

SEQ ID NO: 2194820 - protein, 50 aa, Cryptosporidium hominis
NQNSLVDLYYWYKDEEFIYLLLDFKISMIPKLHDILLILANSISSTVVMN

SEQ ID NO: 2194821 - protein, 18 aa, Cryptosporidium hominis
NQPLFFRTLENESLDSLH

SEQ ID NO: 2194822 - protein, 27 aa, Cryptosporidium hominis
NQQEPDKVKFIPLSSLKKLQSLKSPNI

SEQ ID NO: 2194823 - protein, 26 aa, Cryptosporidium hominis
NQQFSIRWDGFLLAPESGRYYFSIEA

SEQ ID NO: 2194824 - protein, 22 aa, Cryptosporidium hominis
NQRSILSAYKQYNNLRLKILSN

SEQ ID NO: 2194825 - protein, 21 aa, Cryptosporidium hominis
NQSIPPIPPQSQPPFMMGGPG

SEQ ID NO: 2194826 - protein, 22 aa, Cryptosporidium hominis
NQSNFLPIDLYVSTSTSVCKVG

SEQ ID NO: 2194827 - protein, 28 aa, Cryptosporidium hominis
NQSQKILFKLFNYWNLNIDFKQSSFFQG

SEQ ID NO: 2194828 - protein, 20 aa, Cryptosporidium hominis
NQSYSRELIMDHSEGIDWIS

SEQ ID NO: 2194829 - protein, 32 aa, Cryptosporidium hominis
NQTIDPYGFLLDTLYLYYPRNESKNPVHMLDP

SEQ ID NO: 2194830 - protein, 26 aa, Cryptosporidium hominis
NQYHKRLFRLFLLASYLKRGDKLVNL

SEQ ID NO: 2194831 - protein, 24 aa, Cryptosporidium hominis
NQYSLVLAIINKSSFMLLPHRETS

SEQ ID NO: 2194832 - protein, 27 aa, Cryptosporidium hominis
NRCIQQLKILFWRHPGDPLLGKELARC

SEQ ID NO: 2194833 - protein, 25 aa, Cryptosporidium hominis
NRDDPGALILKLLHNGRNIETASVV

SEQ ID NO: 2194834 - protein, 32 aa, Cryptosporidium hominis
NRDINYIRDLLCILSRDIWSLLLSCHQNFGQM

SEQ ID NO: 2194835 - protein, 27 aa, Cryptosporidium hominis
NRDQLKLFAAKLAVFGSAPYSYDSAPF

SEQ ID NO: 2194836 - protein, 26 aa, Cryptosporidium hominis
NRDSSPDFTIVRRMNPTKSDESNPKN

SEQ ID NO: 2194837 - protein, 26 aa, Cryptosporidium hominis
NREAFRPITIQDFNLSLKLVKPSYSS

SEQ ID NO: 2194838 - protein, 20 aa, Cryptosporidium hominis
NREEWYLTEHACNAFGICLA

SEQ ID NO: 2194839 - protein, 18 aa, Cryptosporidium hominis
NREILKQTKIGVVMTAVK

SEQ ID NO: 2194840 - protein, 18 aa, Cryptosporidium hominis
NRENIVNGLYKLYKDYGP

SEQ ID NO: 2194841 - protein, 20 aa, Cryptosporidium hominis
NRENLYFNSLKKCVIFDTDW

SEQ ID NO: 2194842 - protein, 23 aa, Cryptosporidium hominis
NREVRMLLEKLPASTITLYPDLI

SEQ ID NO: 2194843 - protein, 18 aa, Cryptosporidium hominis
NREWKTMQKYIYEHFKNQ

SEQ ID NO: 2194844 - protein, 36 aa, Cryptosporidium hominis
NREYLIMELFHGGTIRQLLRFKYKNGLPINSVRNLM

SEQ ID NO: 2194845 - protein, 18 aa, Cryptosporidium hominis
NRFNWKGWVDFHISSIKL

SEQ ID NO: 2194846 - protein, 21 aa, Cryptosporidium hominis
NRGKIPFFNHNNGHDFTASFH

SEQ ID NO: 2194847 - protein, 23 aa, Cryptosporidium hominis
NRGTTTLGFIYQGGVILAVDSRA

SEQ ID NO: 2194848 - protein, 23 aa, Cryptosporidium hominis
NRHKFISFILEYTQTILGSSSNE

SEQ ID NO: 2194849 - protein, 17 aa, Cryptosporidium hominis
NRHNDLSVWFQFMESIE

SEQ ID NO: 2194850 - protein, 22 aa, Cryptosporidium hominis
NRKLDYLRWKEREYKRLKREHF

SEQ ID NO: 2194851 - protein, 17 aa, Cryptosporidium hominis
NRKLLFENWKDELLELF

SEQ ID NO: 2194852 - protein, 22 aa, Cryptosporidium hominis
NRLDDRFITNFQILENVAKSTD

SEQ ID NO: 2194853 - protein, 17 aa, Cryptosporidium hominis
NRLFLNSNHQNYSIQYQ

SEQ ID NO: 2194854 - protein, 17 aa, Cryptosporidium hominis
NRNCNLLKGPFESKIDS

SEQ ID NO: 2194855 - protein, 24 aa, Cryptosporidium hominis
NRNKGWKLCLDGYAEKFFGSMEFG

SEQ ID NO: 2194856 - protein, 19 aa, Cryptosporidium hominis
NRNRLKLLLSWLEERVQEG

SEQ ID NO: 2194857 - protein, 27 aa, Cryptosporidium hominis
NRPKLLIHNIIFGKLWIEIVGISTIIN

SEQ ID NO: 2194858 - protein, 17 aa, Cryptosporidium hominis
NRQLIIALTTMTKAFRF

SEQ ID NO: 2194859 - protein, 18 aa, Cryptosporidium hominis
NRQLLMEISKLRKTNQLL

SEQ ID NO: 2194860 - protein, 27 aa, Cryptosporidium hominis
NRVGELYSLVRFIGFHPYAYNFCNKGD

SEQ ID NO: 2194861 - protein, 17 aa, Cryptosporidium hominis
NRVQYILNRVHKLTNLE

SEQ ID NO: 2194862 - protein, 21 aa, Cryptosporidium hominis
NRYEGYWENDRRHGKGIFYCA

SEQ ID NO: 2194863 - protein, 25 aa, Cryptosporidium hominis
NSAFKLIPIDFLKMDFNNHPINLIN

SEQ ID NO: 2194864 - protein, 23 aa, Cryptosporidium hominis
NSAIFGLCWCNNDSFLLSGCLDR

SEQ ID NO: 2194865 - protein, 25 aa, Cryptosporidium hominis
NSAVRLFHVSNMIIKLLLGSAKETY

SEQ ID NO: 2194866 - protein, 26 aa, Cryptosporidium hominis
NSCDIYLKLILLTRHFPNIKLIWSCN

SEQ ID NO: 2194867 - protein, 24 aa, Cryptosporidium hominis
NSCGTRMRFLLQVYAPQDDREDLF

SEQ ID NO: 2194868 - protein, 23 aa, Cryptosporidium hominis
NSDDFCFLLSTKAGGLGINLTTA

SEQ ID NO: 2194869 - protein, 25 aa, Cryptosporidium hominis
NSDEVELVLSFPLIGSSRSIDTLKN

SEQ ID NO: 2194870 - protein, 30 aa, Cryptosporidium hominis
NSDSPWINKLYYYWEDNHFYYMLMEYMPGG

SEQ ID NO: 2194871 - protein, 19 aa, Cryptosporidium hominis
NSDWIKRCMKIGNYISNKY

SEQ ID NO: 2194872 - protein, 23 aa, Cryptosporidium hominis
NSDYLYIWDVRKPNNILFKLDRE

SEQ ID NO: 2194873 - protein, 30 aa, Cryptosporidium hominis
NSEATKEYLAWLDPQFFFSGTPAITKRQYR

SEQ ID NO: 2194874 - protein, 19 aa, Cryptosporidium hominis
NSEFWLNYTALNSDSWKEI

SEQ ID NO: 2194875 - protein, 31 aa, Cryptosporidium hominis
NSEIKREYSTSPCYYYLPTGYERIGNCFNEI

SEQ ID NO: 2194876 - protein, 26 aa, Cryptosporidium hominis
NSELFIFDIISSNLLDWVKFKSPAIC

SEQ ID NO: 2194877 - protein, 19 aa, Cryptosporidium hominis
NSFFGINRTAERIKIPSDG

SEQ ID NO: 2194878 - protein, 17 aa, Cryptosporidium hominis
NSFGPRNKRINTRSNPY

SEQ ID NO: 2194879 - protein, 22 aa, Cryptosporidium hominis
NSFKLHRLPVPRPGQVLGLVGT

SEQ ID NO: 2194880 - protein, 18 aa, Cryptosporidium hominis
NSGFIEVYFQIDGEYYLA

SEQ ID NO: 2194881 - protein, 27 aa, Cryptosporidium hominis
NSGRMESILNFLKLRCKEIGLDLRGNE

SEQ ID NO: 2194882 - protein, 26 aa, Cryptosporidium hominis
NSGTKFLLLIPVLMNLINVLIKHSTG

SEQ ID NO: 2194883 - protein, 23 aa, Cryptosporidium hominis
NSHFRMLCRIISKKTELWTEMVV

SEQ ID NO: 2194884 - protein, 25 aa, Cryptosporidium hominis
NSHLNIRHYFISCDSQWPHLNREES

SEQ ID NO: 2194885 - protein, 28 aa, Cryptosporidium hominis
NSHQYFLSCFLFYPNIIHCMVRIILSLN

SEQ ID NO: 2194886 - protein, 24 aa, Cryptosporidium hominis
NSIAVELFEKLLNNLKLLCPEMNG

SEQ ID NO: 2194887 - protein, 17 aa, Cryptosporidium hominis
NSIEYWFNRCCLYLSNN

SEQ ID NO: 2194888 - protein, 26 aa, Cryptosporidium hominis
NSIFIENCVGCIFLVNGVISSIEIVN

SEQ ID NO: 2194889 - protein, 25 aa, Cryptosporidium hominis
NSIIKMIKPISWYETYFSKFGRCNM

SEQ ID NO: 2194890 - protein, 20 aa, Cryptosporidium hominis
NSIILILSRITEFRDLCLSY

SEQ ID NO: 2194891 - protein, 69 aa, Cryptosporidium hominis
NSIRDSLISDRELLIKLAPPHYESYLKNTILDKSKPFSLGFTVLIGQCICSFLQEFKKKASLIVKQENK

SEQ ID NO: 2194892 - protein, 31 aa, Cryptosporidium hominis
NSISSLLRISSPFLWHFFQNGGNVHDLPNPI

SEQ ID NO: 2194893 - protein, 30 aa, Cryptosporidium hominis
NSISTIGYWSIIDGFSSSLIKHAPIKENGH

SEQ ID NO: 2194894 - protein, 17 aa, Cryptosporidium hominis
NSKFKNIIVDFPSKFKS

SEQ ID NO: 2194895 - protein, 23 aa, Cryptosporidium hominis
NSKHIYEIYSLHKSIQVYNPTTN

SEQ ID NO: 2194896 - protein, 20 aa, Cryptosporidium hominis
NSKLGFYRPIFNSTSGLYNN

SEQ ID NO: 2194897 - protein, 24 aa, Cryptosporidium hominis
NSKMSIIICLLKNSKIAIYDIINQ

SEQ ID NO: 2194898 - protein, 31 aa, Cryptosporidium hominis
NSKRTILYHKALYLAIQQHLLMYSSELQALL

SEQ ID NO: 2194899 - protein, 22 aa, Cryptosporidium hominis
NSKSGPRIPRTTRHDPELIEHE

SEQ ID NO: 2194900 - protein, 18 aa, Cryptosporidium hominis
NSKVFDWTGKFLASFEFF

SEQ ID NO: 2194901 - protein, 18 aa, Cryptosporidium hominis
NSKVNSLDWSRCGRFLLT

SEQ ID NO: 2194902 - protein, 25 aa, Cryptosporidium hominis
NSKYSLTYFFPLISCLDINEGKKQK

SEQ ID NO: 2194903 - protein, 22 aa, Cryptosporidium hominis
NSLKNFRMQTITILSSMYEVIN

SEQ ID NO: 2194904 - protein, 27 aa, Cryptosporidium hominis
NSLKYNIMLIINYLLNIGFIKPKDILL

SEQ ID NO: 2194905 - protein, 33 aa, Cryptosporidium hominis
NSLLKSQILYFMNFVYELLLRAFEIVRKEQSGE

SEQ ID NO: 2194906 - protein, 21 aa, Cryptosporidium hominis
NSLLKVYPYNFFPSNSIPNDS

SEQ ID NO: 2194907 - protein, 35 aa, Cryptosporidium hominis
NSLPTSLFRIPITAPFRKLIRYFRDVAAIHEGIID

SEQ ID NO: 2194908 - protein, 17 aa, Cryptosporidium hominis
NSLTLFNIINQSVSFLN

SEQ ID NO: 2194909 - protein, 23 aa, Cryptosporidium hominis
NSLYKHWLRKKCNNYLVMIRCSI

SEQ ID NO: 2194910 - protein, 18 aa, Cryptosporidium hominis
NSMKLIWEKIIKVWMSVY

SEQ ID NO: 2194911 - protein, 24 aa, Cryptosporidium hominis
NSMKSLILLSFSQPLKTLFSSCFN

SEQ ID NO: 2194912 - protein, 32 aa, Cryptosporidium hominis
NSMTRLQMLKIWKGLYYSMWLSDKVLIQREIA

SEQ ID NO: 2194913 - protein, 35 aa, Cryptosporidium hominis
NSNDFINLLVPFYLPSFVNLEIMFRIIKTKIKTRD

SEQ ID NO: 2194914 - protein, 23 aa, Cryptosporidium hominis
NSNDVCVGILNFVDLAGSESIKR

SEQ ID NO: 2194915 - protein, 26 aa, Cryptosporidium hominis
NSNELWKLDIAYFSFQKFGMDKSCKD

SEQ ID NO: 2194916 - protein, 25 aa, Cryptosporidium hominis
NSNENFFMCLKWPESLSVTPEAEDV

SEQ ID NO: 2194917 - protein, 25 aa, Cryptosporidium hominis
NSNFINIYLIIFQVLLHLCNSEITP

SEQ ID NO: 2194918 - protein, 23 aa, Cryptosporidium hominis
NSNFLGYHMIDDYFPRYSIIPNK

SEQ ID NO: 2194919 - protein, 25 aa, Cryptosporidium hominis
NSNFSYVFIVFYSISDDLNHSNDEI

SEQ ID NO: 2194920 - protein, 18 aa, Cryptosporidium hominis
NSNILFPPLTASVGREIS

SEQ ID NO: 2194921 - protein, 24 aa, Cryptosporidium hominis
NSNNQFNIIKIIDMPIFGYFQNYY

SEQ ID NO: 2194922 - protein, 24 aa, Cryptosporidium hominis
NSNTPFPIMLSVGKIMEQMELLHQ

SEQ ID NO: 2194923 - protein, 24 aa, Cryptosporidium hominis
NSNVDPILFCTPHNFGAGYFTVPN

SEQ ID NO: 2194924 - protein, 26 aa, Cryptosporidium hominis
NSNYADYYRNPYLPVHAGGVPSQQIY

SEQ ID NO: 2194925 - protein, 24 aa, Cryptosporidium hominis
NSPNPPLSSLQKFFALLISSRPIA

SEQ ID NO: 2194926 - protein, 28 aa, Cryptosporidium hominis
NSPRHIRMLFLLHKWDAPMNYSPETSLQ

SEQ ID NO: 2194927 - protein, 18 aa, Cryptosporidium hominis
NSQFITLIISLSNTPEFV

SEQ ID NO: 2194928 - protein, 20 aa, Cryptosporidium hominis
NSQGILKNPYMLLSSIVGTG

SEQ ID NO: 2194929 - protein, 25 aa, Cryptosporidium hominis
NSQHLLRDVITLDIEVLRKSKLGRL

SEQ ID NO: 2194930 - protein, 24 aa, Cryptosporidium hominis
NSQSQYILAIFGVARNRRAAELRV

SEQ ID NO: 2194931 - protein, 22 aa, Cryptosporidium hominis
NSQVFPSLDLSIEEYRWKFYQS

SEQ ID NO: 2194932 - protein, 25 aa, Cryptosporidium hominis
NSRFKPLKIVKFYQILRNFMKNEIK

SEQ ID NO: 2194933 - protein, 28 aa, Cryptosporidium hominis
NSRKVIPPTLILIDHSLETLKKYTFLLK

SEQ ID NO: 2194934 - protein, 25 aa, Cryptosporidium hominis
NSRPLKLIWIVPKTELQKMFTPQIL

SEQ ID NO: 2194935 - protein, 25 aa, Cryptosporidium hominis
NSRRLILEQLKIATSILPLKRFEAM

SEQ ID NO: 2194936 - protein, 18 aa, Cryptosporidium hominis
NSRSITYTVPSLRVKLRR

SEQ ID NO: 2194937 - protein, 24 aa, Cryptosporidium hominis
NSSDFQYFQQLIIKGFLASRKHVD

SEQ ID NO: 2194938 - protein, 18 aa, Cryptosporidium hominis
NSSKWPRLSYKDSPLKKT

SEQ ID NO: 2194939 - protein, 23 aa, Cryptosporidium hominis
NSSLEAFIVCRYFKFDDQDSTNV

SEQ ID NO: 2194940 - protein, 22 aa, Cryptosporidium hominis
NSSLTINRYLSIFFKVLNNNET

SEQ ID NO: 2194941 - protein, 26 aa, Cryptosporidium hominis
NSSLWNSFELILRPELKKLNFNIENI

SEQ ID NO: 2194942 - protein, 24 aa, Cryptosporidium hominis
NSSNWKEWNSYSKLLPLAVVELDV

SEQ ID NO: 2194943 - protein, 33 aa, Cryptosporidium hominis
NSSRRYPKRLRTAPLKWYLGERLEYHRDEKNEL

SEQ ID NO: 2194944 - protein, 26 aa, Cryptosporidium hominis
NSSYLYRLIIVIAEISLVLCKSGEVD

SEQ ID NO: 2194945 - protein, 35 aa, Cryptosporidium hominis
NSSYMSMSGFIPQFIQASKYFTCFYGSNNIENSSL

SEQ ID NO: 2194946 - protein, 24 aa, Cryptosporidium hominis
NSTSSILFSVWNQLFRGNSRIESD

SEQ ID NO: 2194947 - protein, 23 aa, Cryptosporidium hominis
NSTYIKFWEVTTGQIYILKNRFI

SEQ ID NO: 2194948 - protein, 33 aa, Cryptosporidium hominis
NSVCIEDYKLYMSRLPLLCFSEVFKLGSCISQS

SEQ ID NO: 2194949 - protein, 25 aa, Cryptosporidium hominis
NSVHTNFWLRLKSKEKRIISRNAMK

SEQ ID NO: 2194950 - protein, 18 aa, Cryptosporidium hominis
NSVNSNGRRNFKGSPGKI

SEQ ID NO: 2194951 - protein, 22 aa, Cryptosporidium hominis
NSWGDMWNWSTKVKSWGEKWEN

SEQ ID NO: 2194952 - protein, 20 aa, Cryptosporidium hominis
NSWVGLLRPNGIFSRFDCCN

SEQ ID NO: 2194953 - protein, 22 aa, Cryptosporidium hominis
NSYIEPFLIVSTLLESSVSIKQ

SEQ ID NO: 2194954 - protein, 30 aa, Cryptosporidium hominis
NSYIPSELWNIIFKLIIVLTPKSSKGYYYD

SEQ ID NO: 2194955 - protein, 29 aa, Cryptosporidium hominis
NSYIYLTTSYFFPPSFLRRAIQTAINNNV

SEQ ID NO: 2194956 - protein, 33 aa, Cryptosporidium hominis
NSYQGVQPPVCPVSLLPPIPHPPPGRHTMFWDS

SEQ ID NO: 2194957 - protein, 26 aa, Cryptosporidium hominis
NTAFEFWNNSFLLHDNPDILSINCNY

SEQ ID NO: 2194958 - protein, 28 aa, Cryptosporidium hominis
NTCIKNILLYPSFSLLNLSPAIMDIKFK

SEQ ID NO: 2194959 - protein, 20 aa, Cryptosporidium hominis
NTCLIRDYLLKGLNKIEING

SEQ ID NO: 2194960 - protein, 17 aa, Cryptosporidium hominis
NTCYTIIREKTEDFFPG

SEQ ID NO: 2194961 - protein, 17 aa, Cryptosporidium hominis
NTDIYLRERDRGVLANK

SEQ ID NO: 2194962 - protein, 32 aa, Cryptosporidium hominis
NTDPSSLLPNYDFGRFAWNGYFDRNKNLLNNS

SEQ ID NO: 2194963 - protein, 34 aa, Cryptosporidium hominis
NTENKLLSCKIPLHYILTLFIRSRIRRIREKLGN

SEQ ID NO: 2194964 - protein, 27 aa, Cryptosporidium hominis
NTEYSIPFDIRFSKLRKGFSSQNGRGT

SEQ ID NO: 2194965 - protein, 21 aa, Cryptosporidium hominis
NTFITFEDLFRRNIYNSIESF

SEQ ID NO: 2194966 - protein, 17 aa, Cryptosporidium hominis
NTGMIIGKEENIVFGRL

SEQ ID NO: 2194967 - protein, 20 aa, Cryptosporidium hominis
NTIDYKIWLAKCIDLSQMDE

SEQ ID NO: 2194968 - protein, 20 aa, Cryptosporidium hominis
NTIIHLNSSYFKYYDIFDSQ

SEQ ID NO: 2194969 - protein, 26 aa, Cryptosporidium hominis
NTINIKLNIIRKLIPRVNLLQLEEEH

SEQ ID NO: 2194970 - protein, 26 aa, Cryptosporidium hominis
NTIRKLEMIPFNVHHFPLSISIGYIN

SEQ ID NO: 2194971 - protein, 28 aa, Cryptosporidium hominis
NTISITNRVLPPIPSLPNAAISNRDLTY

SEQ ID NO: 2194972 - protein, 22 aa, Cryptosporidium hominis
NTKAIPPLSLNPLIQKFTGFNS

SEQ ID NO: 2194973 - protein, 17 aa, Cryptosporidium hominis
NTKFIQYINNFPRGGYK

SEQ ID NO: 2194974 - protein, 22 aa, Cryptosporidium hominis
NTLDLLWNNFLIFENSAFPKNS

SEQ ID NO: 2194975 - protein, 23 aa, Cryptosporidium hominis
NTLDPEILVRIYSLLIDSKEEIQ

SEQ ID NO: 2194976 - protein, 23 aa, Cryptosporidium hominis
NTLFQFCHAFYLSIIREIFCVLT

SEQ ID NO: 2194977 - protein, 21 aa, Cryptosporidium hominis
NTLNIYFATCSYDFNIKIWCF

SEQ ID NO: 2194978 - protein, 26 aa, Cryptosporidium hominis
NTLNREICLFYLPLNLPCMYSVPFIE

SEQ ID NO: 2194979 - protein, 19 aa, Cryptosporidium hominis
NTMFLWDPLGENGRKPIHR

SEQ ID NO: 2194980 - protein, 29 aa, Cryptosporidium hominis
NTNLSISYLSLSIPIFKPLQRNISKYSNV

SEQ ID NO: 2194981 - protein, 29 aa, Cryptosporidium hominis
NTNNKIIIPKPFPGLISKVSVPWKRVKTS

SEQ ID NO: 2194982 - protein, 23 aa, Cryptosporidium hominis
NTNPLQVVVLTKSNLYITSAEIF

SEQ ID NO: 2194983 - protein, 34 aa, Cryptosporidium hominis
NTNRIMLCTDGWYIVKILTNITLIKSLIQNMPRN

SEQ ID NO: 2194984 - protein, 22 aa, Cryptosporidium hominis
NTNSLILSITYSDSLVSLTNEQ

SEQ ID NO: 2194985 - protein, 24 aa, Cryptosporidium hominis
NTNSRLFPVQNIGIATFPGRTRNG

SEQ ID NO: 2194986 - protein, 29 aa, Cryptosporidium hominis
NTNTQLFNSSAFPPLTSALIKQIPSSKDS

SEQ ID NO: 2194987 - protein, 25 aa, Cryptosporidium hominis
NTNVTLWCPSGIVPRPRRIWSILAS

SEQ ID NO: 2194988 - protein, 32 aa, Cryptosporidium hominis
NTNYRKISVIFWRKIWINIYKIVHGKLELAQI

SEQ ID NO: 2194989 - protein, 25 aa, Cryptosporidium hominis
NTPKVIEIPFPLLVSKFSYEEEQYS

SEQ ID NO: 2194990 - protein, 26 aa, Cryptosporidium hominis
NTPSRFIRYIFNRLILESSAVRAASI

SEQ ID NO: 2194991 - protein, 24 aa, Cryptosporidium hominis
NTPYKVFNFRKSISTLKFLCDSNP

SEQ ID NO: 2194992 - protein, 24 aa, Cryptosporidium hominis
NTRCILGMMSMENTAILSVRTEYA

SEQ ID NO: 2194993 - protein, 19 aa, Cryptosporidium hominis
NTRELLRNISFSNSGGLKG

SEQ ID NO: 2194994 - protein, 23 aa, Cryptosporidium hominis
NTRILTPFNIRNGINSIKSYKEV

SEQ ID NO: 2194995 - protein, 26 aa, Cryptosporidium hominis
NTRKLLPGMYVTISGVFLPVVKEGFQ

SEQ ID NO: 2194996 - protein, 32 aa, Cryptosporidium hominis
NTTFERRFLYLRLLDRLIIGNATYLQLAYQNN

SEQ ID NO: 2194997 - protein, 25 aa, Cryptosporidium hominis
NTTVCSIWKIERLIGGGSFGDIYLA

SEQ ID NO: 2194998 - protein, 21 aa, Cryptosporidium hominis
NTVFLYLKKYVPSSLSFDKLL

SEQ ID NO: 2194999 - protein, 25 aa, Cryptosporidium hominis
NTVRLVDASFIWTEPHSRRLKVKCT

SEQ ID NO: 2195000 - protein, 29 aa, Cryptosporidium hominis
NTWPQHIAAMTWLCELLDYEQAVFPHLNY

SEQ ID NO: 2195001 - protein, 19 aa, Cryptosporidium hominis
NTYLPVQSKFRLTYQMILQ

SEQ ID NO: 2195002 - protein, 25 aa, Cryptosporidium hominis
NTYRSGNLPILYNENNMLRCESNML

SEQ ID NO: 2195003 - protein, 26 aa, Cryptosporidium hominis
NVCELDLIFNFHKAYFILDEIILAGE

SEQ ID NO: 2195004 - protein, 19 aa, Cryptosporidium hominis
NVCIKLLDLLINDLIDSLE

SEQ ID NO: 2195005 - protein, 17 aa, Cryptosporidium hominis
NVCSLRQWIKKKMPGIS

SEQ ID NO: 2195006 - protein, 25 aa, Cryptosporidium hominis
NVDEAFHRILSEIYTLRSERQLTAN

SEQ ID NO: 2195007 - protein, 31 aa, Cryptosporidium hominis
NVEAIAIRRLLNILLDFIAKLDPSLGTKLAF

SEQ ID NO: 2195008 - protein, 23 aa, Cryptosporidium hominis
NVEFRLYGRLFTLPEPENQGKDW

SEQ ID NO: 2195009 - protein, 25 aa, Cryptosporidium hominis
NVERKLSIQLLRFPEVFDGILNDFF

SEQ ID NO: 2195010 - protein, 19 aa, Cryptosporidium hominis
NVFDRLLDPKLYTGMHKYR

SEQ ID NO: 2195011 - protein, 25 aa, Cryptosporidium hominis
NVFSEKDRWFSLSSVTSPVDIEALG

SEQ ID NO: 2195012 - protein, 26 aa, Cryptosporidium hominis
NVGGIPFLLNLRHFYQFNFITQRHRR

SEQ ID NO: 2195013 - protein, 28 aa, Cryptosporidium hominis
NVGPDEFTLIPLPYPDFSMIAKTRGITK

SEQ ID NO: 2195014 - protein, 17 aa, Cryptosporidium hominis
NVHHFINNELTQNSLGR

SEQ ID NO: 2195015 - protein, 29 aa, Cryptosporidium hominis
NVHKGLYISWHPKTRRFVVALKSCESGKT

SEQ ID NO: 2195016 - protein, 32 aa, Cryptosporidium hominis
NVHVLPFPSLCKFFEILFEKGNLFLFQFGLSI

SEQ ID NO: 2195017 - protein, 17 aa, Cryptosporidium hominis
NVHYHKNYKRWIKTWYN

SEQ ID NO: 2195018 - protein, 24 aa, Cryptosporidium hominis
NVIAHPWLKISSNKASKYFTPIMA

SEQ ID NO: 2195019 - protein, 29 aa, Cryptosporidium hominis
NVIFFLDTVSSLRWFLLDKKVSFSSLRQD

SEQ ID NO: 2195020 - protein, 18 aa, Cryptosporidium hominis
NVIGIFALSPNNVSHLPP

SEQ ID NO: 2195021 - protein, 20 aa, Cryptosporidium hominis
NVIKGKYVINPIISTEKETT

SEQ ID NO: 2195022 - protein, 24 aa, Cryptosporidium hominis
NVIREDFEYILKSTSILLNELEST

SEQ ID NO: 2195023 - protein, 21 aa, Cryptosporidium hominis
NVKKWEGITIKYKGPLKEFRG

SEQ ID NO: 2195024 - protein, 20 aa, Cryptosporidium hominis
NVLFRFKPMHHYNIYQLSSE

SEQ ID NO: 2195025 - protein, 17 aa, Cryptosporidium hominis
NVLLFPCSHSFHFGCML

SEQ ID NO: 2195026 - protein, 17 aa, Cryptosporidium hominis
NVLNLLHANTRSFICIE

SEQ ID NO: 2195027 - protein, 25 aa, Cryptosporidium hominis
NVLRNQFTMRYSFNNDQLYSYSGGG

SEQ ID NO: 2195028 - protein, 23 aa, Cryptosporidium hominis
NVLTWLSRPVLSDLIISLANCTQ

SEQ ID NO: 2195029 - protein, 23 aa, Cryptosporidium hominis
NVMATCMKFLTNTVLIIGGFLTQ

SEQ ID NO: 2195030 - protein, 19 aa, Cryptosporidium hominis
NVMFDCGVLPYLVKCMSSE

SEQ ID NO: 2195031 - protein, 22 aa, Cryptosporidium hominis
NVMKTLTLLKSHYLPSSATRGQ

SEQ ID NO: 2195032 - protein, 20 aa, Cryptosporidium hominis
NVNFEIPDPLTVPFISCGDL

SEQ ID NO: 2195033 - protein, 18 aa, Cryptosporidium hominis
NVNKYLMLHGLSLTNETK

SEQ ID NO: 2195034 - protein, 17 aa, Cryptosporidium hominis
NVNLNHRIHSGGNFFGG

SEQ ID NO: 2195035 - protein, 29 aa, Cryptosporidium hominis
NVNLQFKHYFSIFWSKTMRPHLKFDHDKS

SEQ ID NO: 2195036 - protein, 25 aa, Cryptosporidium hominis
NVNSNLLLPGFAGLGNFGNIPNFGN

SEQ ID NO: 2195037 - protein, 28 aa, Cryptosporidium hominis
NVPTKHLYLYLSELLKLNGLGGEIPRIV

SEQ ID NO: 2195038 - protein, 23 aa, Cryptosporidium hominis
NVQDKIYWTYKIKGLAMGKKFQE

SEQ ID NO: 2195039 - protein, 28 aa, Cryptosporidium hominis
NVQSQMFPRQMPISRVGVMGKPPGLGTQ

SEQ ID NO: 2195040 - protein, 22 aa, Cryptosporidium hominis
NVRRVFAWHPLTKSYSPCLCLK

SEQ ID NO: 2195041 - protein, 23 aa, Cryptosporidium hominis
NVSIIIMLINSFLIDFYESQRFS

SEQ ID NO: 2195042 - protein, 17 aa, Cryptosporidium hominis
NVSNRIIILSSILPFER

SEQ ID NO: 2195043 - protein, 26 aa, Cryptosporidium hominis
NVSQINMPYFTKLLLVSAYVASKVSK

SEQ ID NO: 2195044 - protein, 31 aa, Cryptosporidium hominis
NVTLFLGVVMSPLYCLVTELVPNGSLFDLLH

SEQ ID NO: 2195045 - protein, 27 aa, Cryptosporidium hominis
NVTNYLKGIDIFLRIPEYIRPKKDGAV

SEQ ID NO: 2195046 - protein, 19 aa, Cryptosporidium hominis
NVVLPKLEDGMNYILRELD

SEQ ID NO: 2195047 - protein, 17 aa, Cryptosporidium hominis
NVYKYLVYILTMGVVEE

SEQ ID NO: 2195048 - protein, 20 aa, Cryptosporidium hominis
NWENSIIIGSLKHATRALYQ

SEQ ID NO: 2195049 - protein, 24 aa, Cryptosporidium hominis
NWERTVLKYFIFGGAIRVKINIKS

SEQ ID NO: 2195050 - protein, 18 aa, Cryptosporidium hominis
NWFALLVSIVIGSNIHLA

SEQ ID NO: 2195051 - protein, 22 aa, Cryptosporidium hominis
NWGPHLIVVPTSVMLNWEMEFK

SEQ ID NO: 2195052 - protein, 26 aa, Cryptosporidium hominis
NWGVSTYFSFLLPLSHHYYKNEKNKE

SEQ ID NO: 2195053 - protein, 19 aa, Cryptosporidium hominis
NWKEIIDLFRFSDKYGIKS

SEQ ID NO: 2195054 - protein, 23 aa, Cryptosporidium hominis
NWPKVDCLISFYSTGFPLNKAIS

SEQ ID NO: 2195055 - protein, 29 aa, Cryptosporidium hominis
NWSFGSNEEFNLLSIFKDDNANIKNNEQL

SEQ ID NO: 2195056 - protein, 17 aa, Cryptosporidium hominis
NWSIRKYLDPFFEHNQD

SEQ ID NO: 2195057 - protein, 17 aa, Cryptosporidium hominis
NWTEIETPWEWERDFTI

SEQ ID NO: 2195058 - protein, 25 aa, Cryptosporidium hominis
NWVEDLIDLLRRLLEKSPSKRISAQ

SEQ ID NO: 2195059 - protein, 25 aa, Cryptosporidium hominis
NWVKSVCPWDLSLSSNTWKHIHRPT

SEQ ID NO: 2195060 - protein, 27 aa, Cryptosporidium hominis
NWYSINNEILLFLLSSLLQKGMSMNKS

SEQ ID NO: 2195061 - protein, 19 aa, Cryptosporidium hominis
NYAIWKGAQLFSALRDYQE

SEQ ID NO: 2195062 - protein, 32 aa, Cryptosporidium hominis
NYDDSEFLVFLIDIYIQGVLLFLLEHVESTYS

SEQ ID NO: 2195063 - protein, 19 aa, Cryptosporidium hominis
NYELLISLLHSAPSLKRKS

SEQ ID NO: 2195064 - protein, 25 aa, Cryptosporidium hominis
NYENELLFLKYYREKIIPTMNVYDL

SEQ ID NO: 2195065 - protein, 39 aa, Cryptosporidium hominis
NYFQGYYHLMNIYNFIIKKYINWFLIPAADIFGFGNSIK

SEQ ID NO: 2195066 - protein, 25 aa, Cryptosporidium hominis
NYGDLFIKVNIKPNTKLKWIKDNIH

SEQ ID NO: 2195067 - protein, 24 aa, Cryptosporidium hominis
NYHEQMYLMFKKINTKEKIVGWYS

SEQ ID NO: 2195068 - protein, 28 aa, Cryptosporidium hominis
NYIAVFPDILLKRNWKINPLLSINIRNQ

SEQ ID NO: 2195069 - protein, 32 aa, Cryptosporidium hominis
NYIFGSNTFRIWPTRILLYPVSKSQVPNDHKN

SEQ ID NO: 2195070 - protein, 20 aa, Cryptosporidium hominis
NYIIILLGRRHVKAGFSKKM

SEQ ID NO: 2195071 - protein, 18 aa, Cryptosporidium hominis
NYINIWSIELTSENFYEE

SEQ ID NO: 2195072 - protein, 18 aa, Cryptosporidium hominis
NYINTGMIIGKEENIVFG

SEQ ID NO: 2195073 - protein, 18 aa, Cryptosporidium hominis
NYIWIDKHIKNVIACKHE

SEQ ID NO: 2195074 - protein, 18 aa, Cryptosporidium hominis
NYKCTAGIRPNCEVLVFI

SEQ ID NO: 2195075 - protein, 28 aa, Cryptosporidium hominis
NYKHKRKFPFLYYYGRQPSINNDYGHIR

SEQ ID NO: 2195076 - protein, 20 aa, Cryptosporidium hominis
NYKPVWILSLLHLSSTEHFS

SEQ ID NO: 2195077 - protein, 22 aa, Cryptosporidium hominis
NYKVNFKQITLPVSNFTNEIER

SEQ ID NO: 2195078 - protein, 17 aa, Cryptosporidium hominis
NYLKSRFCGYTFQCSIS

SEQ ID NO: 2195079 - protein, 33 aa, Cryptosporidium hominis
NYLSQLNVAVLQQERLRMWAKDNAKYTSSISNT

SEQ ID NO: 2195080 - protein, 27 aa, Cryptosporidium hominis
NYNKIQVLMIINDMIQILLLNINHFNN

SEQ ID NO: 2195081 - protein, 19 aa, Cryptosporidium hominis
NYNPSSFKFTSLIDTNSEE

SEQ ID NO: 2195082 - protein, 33 aa, Cryptosporidium hominis
NYNSFIRWKREEPFRVYDMWYDAVKERKDGRNS

SEQ ID NO: 2195083 - protein, 19 aa, Cryptosporidium hominis
NYQEFRLRYPDIENPNVIG

SEQ ID NO: 2195084 - protein, 27 aa, Cryptosporidium hominis
NYQIKYYYYHSMTWPQLLDIATDSNDS

SEQ ID NO: 2195085 - protein, 17 aa, Cryptosporidium hominis
NYQYLLNQCLSFVMSSL

SEQ ID NO: 2195086 - protein, 17 aa, Cryptosporidium hominis
NYSITSLAIHYIEKYLK

SEQ ID NO: 2195087 - protein, 26 aa, Cryptosporidium hominis
NYSKLQLCAVPYMLYQVNLASVTNKD

SEQ ID NO: 2195088 - protein, 25 aa, Cryptosporidium hominis
NYSKSLLCNLWFRSIKIIQEIQNYN

SEQ ID NO: 2195089 - protein, 26 aa, Cryptosporidium hominis
NYTPSKLLYIYISRIKYHSILSKEFL

SEQ ID NO: 2195090 - protein, 18 aa, Cryptosporidium hominis
NYWKFPDINVFVNNDSHL

SEQ ID NO: 2195091 - protein, 27 aa, Cryptosporidium hominis
NYYAVPPAQYILDTSIYSSATPYVAVP

SEQ ID NO: 2195092 - protein, 21 aa, Cryptosporidium hominis
NYYETLSTIDFARRAKKIQNK

SEQ ID NO: 2195093 - protein, 19 aa, Cryptosporidium hominis
NYYKMSIQEWKDFLASIEP

SEQ ID NO: 2195094 - protein, 20 aa, Cryptosporidium hominis
NYYLVSLFGVHKHNSKKNLT

SEQ ID NO: 2195095 - protein, 21 aa, Cryptosporidium hominis
NYYMNWFVCFCKKSLTLVNNK

SEQ ID NO: 2195096 - protein, 32 aa, Cryptosporidium hominis
NYYPPIFESNLIAIPLFMPCNGRAAWGKEHGK

SEQ ID NO: 2195097 - protein, 18 aa, Cryptosporidium hominis
NYYRRLESLVFDIFLVRS

SEQ ID NO: 2195098 - protein, 22 aa, Cryptosporidium hominis
NYYSLPDFKSMNPTSSINFYNS

SEQ ID NO: 2195099 - protein, 27 aa, Cryptosporidium hominis
PACYLVSRFYRAPEIILGCISYGQPID

SEQ ID NO: 2195100 - protein, 23 aa, Cryptosporidium hominis
PADLSLLFSAPIKYRSTDTLEGF

SEQ ID NO: 2195101 - protein, 31 aa, Cryptosporidium hominis
PADVAPFDSKLIRLIWEGLNICVPINNKKKQ

SEQ ID NO: 2195102 - protein, 28 aa, Cryptosporidium hominis
PAFFETEMKLFYCKYNDPAYIKIEKLNL

SEQ ID NO: 2195103 - protein, 31 aa, Cryptosporidium hominis
PAHARGALGVMPMPMELPPQPPVSHPEDNSQ

SEQ ID NO: 2195104 - protein, 17 aa, Cryptosporidium hominis
PAIDLTKIRIRSCKRVV

SEQ ID NO: 2195105 - protein, 19 aa, Cryptosporidium hominis
PALIRPGRIDRKIELPNPD

SEQ ID NO: 2195106 - protein, 19 aa, Cryptosporidium hominis
PAMMGVCASKLACACLMLA

SEQ ID NO: 2195107 - protein, 30 aa, Cryptosporidium hominis
PANGRYDFIWIQWALQYLSDDEFVDLLIRI

SEQ ID NO: 2195108 - protein, 23 aa, Cryptosporidium hominis
PAPARQGVIAPCNVVVPAGATGL

SEQ ID NO: 2195109 - protein, 26 aa, Cryptosporidium hominis
PAPSSEELPLPPPPPPSLEEPLSTPS

SEQ ID NO: 2195110 - protein, 30 aa, Cryptosporidium hominis
PASSTVFEMIVFRGSDITDLAVCQPAAATN

SEQ ID NO: 2195111 - protein, 17 aa, Cryptosporidium hominis
PAVVRAIPRVNKRYAKP

SEQ ID NO: 2195112 - protein, 18 aa, Cryptosporidium hominis
PAYIKIEKLNLLYRMASI

SEQ ID NO: 2195113 - protein, 21 aa, Cryptosporidium hominis
PCALTLSMYFIKTCGRACNVN

SEQ ID NO: 2195114 - protein, 20 aa, Cryptosporidium hominis
PCIKYLMQFLHDFVAHWSIE

SEQ ID NO: 2195115 - protein, 18 aa, Cryptosporidium hominis
PCMILRRKIQKTVKKIAL

SEQ ID NO: 2195116 - protein, 25 aa, Cryptosporidium hominis
PCNGDFMFHYIYKYEKSLSLTGSFG

SEQ ID NO: 2195117 - protein, 20 aa, Cryptosporidium hominis
PCVTIEWYPGGRRLVVGTVG

SEQ ID NO: 2195118 - protein, 17 aa, Cryptosporidium hominis
PCYDVIPPKFINAIVTE

SEQ ID NO: 2195119 - protein, 26 aa, Cryptosporidium hominis
PDEFKNPSSFLKIYGDPLCGKQPSNG

SEQ ID NO: 2195120 - protein, 23 aa, Cryptosporidium hominis
PDERWRPIFGVESILVSVISMLG

SEQ ID NO: 2195121 - protein, 18 aa, Cryptosporidium hominis
PDFEKVVVRGARGLSFQI

SEQ ID NO: 2195122 - protein, 25 aa, Cryptosporidium hominis
PDFTHITCLCSDKSLKLFRIDSDFC

SEQ ID NO: 2195123 - protein, 20 aa, Cryptosporidium hominis
PDGLPIIYHGHTLTSKVYFE

SEQ ID NO: 2195124 - protein, 30 aa, Cryptosporidium hominis
PDINIKEHPILLRLVTLRTMMEKLKPIDVK

SEQ ID NO: 2195125 - protein, 30 aa, Cryptosporidium hominis
PDLILVVFYRYILLMRRLQSIYLLEPAGSR

SEQ ID NO: 2195126 - protein, 17 aa, Cryptosporidium hominis
PDMLDDAALRRLSKRVL

SEQ ID NO: 2195127 - protein, 26 aa, Cryptosporidium hominis
PDNSPTKAVLLLFVSGKVIVTGCKNY

SEQ ID NO: 2195128 - protein, 27 aa, Cryptosporidium hominis
PDTKDYLMCVFLPNYNVSNAQIIIPAS

SEQ ID NO: 2195129 - protein, 26 aa, Cryptosporidium hominis
PDVRDRALIYWRLLSTNPEETRKVVL

SEQ ID NO: 2195130 - protein, 17 aa, Cryptosporidium hominis
PDVVRRKLARKSALKSV

SEQ ID NO: 2195131 - protein, 25 aa, Cryptosporidium hominis
PDYEIKLLINDKYDGPFKLEMKNNP

SEQ ID NO: 2195132 - protein, 20 aa, Cryptosporidium hominis
PEDCGWLEPIRLKVHAMEVQ

SEQ ID NO: 2195133 - protein, 17 aa, Cryptosporidium hominis
PEDIHGIIKTGMKSRRV

SEQ ID NO: 2195134 - protein, 29 aa, Cryptosporidium hominis
PEDKYGESYPFFPPGIKPAPIDGDENNTP

SEQ ID NO: 2195135 - protein, 17 aa, Cryptosporidium hominis
PEDLTFLRKVRSGLING

SEQ ID NO: 2195136 - protein, 23 aa, Cryptosporidium hominis
PEDQQMFVLGEKLRSLLFNSFNL

SEQ ID NO: 2195137 - protein, 24 aa, Cryptosporidium hominis
PEDTKFWILCDYDCFGLSIAATYI

SEQ ID NO: 2195138 - protein, 26 aa, Cryptosporidium hominis
PEEITRLYGLKPIRTLTLGTTKKSQK

SEQ ID NO: 2195139 - protein, 25 aa, Cryptosporidium hominis
PEEKILYWCAQLAAGLYYLHNECRI

SEQ ID NO: 2195140 - protein, 33 aa, Cryptosporidium hominis
PEEKIVSHLLFTYYLESILLLYGKQISSVYCNQ

SEQ ID NO: 2195141 - protein, 25 aa, Cryptosporidium hominis
PEEWPLLKMINFLKNSLVSSIHNQT

SEQ ID NO: 2195142 - protein, 20 aa, Cryptosporidium hominis
PEFSALLSILGFYAIEIEAI

SEQ ID NO: 2195143 - protein, 31 aa, Cryptosporidium hominis
PEFTSRPMSPNPLFYGLILASIGKIKHNEAL

SEQ ID NO: 2195144 - protein, 40 aa, Cryptosporidium hominis
PEGSKRFFDLVKFKDPKFKIAWYFAMRDTLIVDDLDIATK

SEQ ID NO: 2195145 - protein, 21 aa, Cryptosporidium hominis
PEIKDLPPVKVTVGPDGRETN

SEQ ID NO: 2195146 - protein, 28 aa, Cryptosporidium hominis
PEIKRGVMLLLPGMLTFIMHKDAEQSVY

SEQ ID NO: 2195147 - protein, 18 aa, Cryptosporidium hominis
PEIYDSINITLYRMRRLL

SEQ ID NO: 2195148 - protein, 19 aa, Cryptosporidium hominis
PEKALKLGLILPKPNQFVS

SEQ ID NO: 2195149 - protein, 27 aa, Cryptosporidium hominis
PEKTGPYAVFMCYKLYSLFDPEDKGYI

SEQ ID NO: 2195150 - protein, 27 aa, Cryptosporidium hominis
PEKVDLTLPCEFVGEIYSIIDDGAIFG

SEQ ID NO: 2195151 - protein, 22 aa, Cryptosporidium hominis
PEKYLIALQRYYHLFEEQEIVE

SEQ ID NO: 2195152 - protein, 25 aa, Cryptosporidium hominis
PELDTFVCIPLLDKLSSKLVNDINR

SEQ ID NO: 2195153 - protein, 19 aa, Cryptosporidium hominis
PELEDMILFQNWSMNKFQD

SEQ ID NO: 2195154 - protein, 26 aa, Cryptosporidium hominis
PELFNELLILIHNILIEKFSNSAIDM

SEQ ID NO: 2195155 - protein, 20 aa, Cryptosporidium hominis
PELFPGLVYRYHPDNSPTKA

SEQ ID NO: 2195156 - protein, 33 aa, Cryptosporidium hominis
PELHARMQPQKLPKLRGFLSMNSLAHLGRQSFG

SEQ ID NO: 2195157 - protein, 27 aa, Cryptosporidium hominis
PELIHEYQLTIFSLYAAVSLGITVDSI

SEQ ID NO: 2195158 - protein, 21 aa, Cryptosporidium hominis
PELSFKLFNIHDMSFSRKKFE

SEQ ID NO: 2195159 - protein, 31 aa, Cryptosporidium hominis
PEMCLKGHLNWVLTLAWSPDSTLLASAGMDN

SEQ ID NO: 2195160 - protein, 27 aa, Cryptosporidium hominis
PENKNRLIFAVLPFGTGNDWAKSFGWS

SEQ ID NO: 2195161 - protein, 18 aa, Cryptosporidium hominis
PENLLGFDLKDLAARGAL

SEQ ID NO: 2195162 - protein, 23 aa, Cryptosporidium hominis
PENQYIPINNYKVIKILGKGAYG

SEQ ID NO: 2195163 - protein, 25 aa, Cryptosporidium hominis
PENVFRPFEYNITKLYSLISEKMKN

SEQ ID NO: 2195164 - protein, 26 aa, Cryptosporidium hominis
PEPQVNINPLILWISSEDGEKRVIEV

SEQ ID NO: 2195165 - protein, 30 aa, Cryptosporidium hominis
PERYEDCMNCLYLLLPFTLTHGTSQNVSWL

SEQ ID NO: 2195166 - protein, 30 aa, Cryptosporidium hominis
PESPIFKFVPLMQYWRHYWFDNTERTQPFP

SEQ ID NO: 2195167 - protein, 22 aa, Cryptosporidium hominis
PETLIRALELLYSLGALDDKGE

SEQ ID NO: 2195168 - protein, 17 aa, Cryptosporidium hominis
PETLMRTISYIASIYEG

SEQ ID NO: 2195169 - protein, 24 aa, Cryptosporidium hominis
PETSPLAALLRAKAPPLPLHMKSG

SEQ ID NO: 2195170 - protein, 20 aa, Cryptosporidium hominis
PEVVTLWYRCPELLFGSTKY

SEQ ID NO: 2195171 - protein, 25 aa, Cryptosporidium hominis
PEWRIHFRQILGGTEPFRITHEMSK

SEQ ID NO: 2195172 - protein, 18 aa, Cryptosporidium hominis
PEYCFRRRNFKGEGELEN

SEQ ID NO: 2195173 - protein, 19 aa, Cryptosporidium hominis
PEYLAGHYMIQSASSLIPV

SEQ ID NO: 2195174 - protein, 27 aa, Cryptosporidium hominis
PFEYGNGYGYLYTRLKWILDNNETSGQ

SEQ ID NO: 2195175 - protein, 33 aa, Cryptosporidium hominis
PFGIQPTPFEDFRIFDIYLLGQDYVGILVDLPC

SEQ ID NO: 2195176 - protein, 20 aa, Cryptosporidium hominis
PFGLFEPQLKEYFSQFGKIL

SEQ ID NO: 2195177 - protein, 17 aa, Cryptosporidium hominis
PFIHYRNIGFNKDLKQD

SEQ ID NO: 2195178 - protein, 28 aa, Cryptosporidium hominis
PFLKEINHILRDWAVFVLQADPDSGSNL

SEQ ID NO: 2195179 - protein, 19 aa, Cryptosporidium hominis
PFLPGLIEKMTGPVLCMVF

SEQ ID NO: 2195180 - protein, 19 aa, Cryptosporidium hominis
PFNISLLRTGQDKQNFYFT

SEQ ID NO: 2195181 - protein, 22 aa, Cryptosporidium hominis
PFQPEFWSYRILTSMSIKIKDA

SEQ ID NO: 2195182 - protein, 22 aa, Cryptosporidium hominis
PFSIFVMEYLPHSCMKWNSETQ

SEQ ID NO: 2195183 - protein, 17 aa, Cryptosporidium hominis
PFSITVLEESHVDFLFG

SEQ ID NO: 2195184 - protein, 20 aa, Cryptosporidium hominis
PFSYHALLDFLFGVQKTYVD

SEQ ID NO: 2195185 - protein, 17 aa, Cryptosporidium hominis
PFTFKLCIYFDFKTQIA

SEQ ID NO: 2195186 - protein, 17 aa, Cryptosporidium hominis
PGEFVLLALLDQFEERL

SEQ ID NO: 2195187 - protein, 32 aa, Cryptosporidium hominis
PGFPSPDMFEYLILPHLRKIQAPVMECLDKVT

SEQ ID NO: 2195188 - protein, 22 aa, Cryptosporidium hominis
PGFYAIITEYLTNGNLFELLYE

SEQ ID NO: 2195189 - protein, 26 aa, Cryptosporidium hominis
PGGTRLLKRWITYPLVNTDRINERLD

SEQ ID NO: 2195190 - protein, 24 aa, Cryptosporidium hominis
PGHALFGYFADLVEAYSLCLIPNK

SEQ ID NO: 2195191 - protein, 26 aa, Cryptosporidium hominis
PGISPFPLITAWFKGVGKPSDSWCIH

SEQ ID NO: 2195192 - protein, 20 aa, Cryptosporidium hominis
PGIYYFRFKVRVGNTYAWMD

SEQ ID NO: 2195193 - protein, 18 aa, Cryptosporidium hominis
PGLPPLHRFVQSSGIIRS

SEQ ID NO: 2195194 - protein, 24 aa, Cryptosporidium hominis
PGLVNGVGNWRILYEPIGGGGRSG

SEQ ID NO: 2195195 - protein, 22 aa, Cryptosporidium hominis
PGMELRIIWQRSSYTIQQYLRS

SEQ ID NO: 2195196 - protein, 24 aa, Cryptosporidium hominis
PGNDPLCWIWIDLDGTINNMNSLE

SEQ ID NO: 2195197 - protein, 26 aa, Cryptosporidium hominis
PGNMPLSILRYLSSIVPSIQLTNFRD

SEQ ID NO: 2195198 - protein, 27 aa, Cryptosporidium hominis
PGNWNNLHLETLRLLTQQYNSFIEQGK

SEQ ID NO: 2195199 - protein, 18 aa, Cryptosporidium hominis
PGNYFDFNTLADAKLNYI

SEQ ID NO: 2195200 - protein, 25 aa, Cryptosporidium hominis
PGPSPAFCRIAIPNYIQSIYKNGVD

SEQ ID NO: 2195201 - protein, 23 aa, Cryptosporidium hominis
PGQFPLINPSIGGLPIPPPGVPP

SEQ ID NO: 2195202 - protein, 31 aa, Cryptosporidium hominis
PGQKRFEIKKWNAVALWSWDIVVDNCAICRN

SEQ ID NO: 2195203 - protein, 25 aa, Cryptosporidium hominis
PGQRKVLFATFKKKLNNELKVAQLA

SEQ ID NO: 2195204 - protein, 24 aa, Cryptosporidium hominis
PGRILDMLLNTLSIQLELLEIIIL

SEQ ID NO: 2195205 - protein, 23 aa, Cryptosporidium hominis
PGSDFQFSIIPEKQINLLNERVE

SEQ ID NO: 2195206 - protein, 26 aa, Cryptosporidium hominis
PGSKRAFCQFIMEPICQLFSSIMNGD

SEQ ID NO: 2195207 - protein, 24 aa, Cryptosporidium hominis
PGSNISDLLRNLRFLVLDEADRLL

SEQ ID NO: 2195208 - protein, 27 aa, Cryptosporidium hominis
PGTIDRIRRWFGLYKAVENKDVAKVNM

SEQ ID NO: 2195209 - protein, 27 aa, Cryptosporidium hominis
PGTKDIIPFKIWRPPKVPLAAGQKYLP

SEQ ID NO: 2195210 - protein, 17 aa, Cryptosporidium hominis
PGVIPQMIPLANSYAAF

SEQ ID NO: 2195211 - protein, 17 aa, Cryptosporidium hominis
PGVREFLNTIAPYYIMG

SEQ ID NO: 2195212 - protein, 24 aa, Cryptosporidium hominis
PHFFNLEFKPKCVLPLLIGDFTLY

SEQ ID NO: 2195213 - protein, 20 aa, Cryptosporidium hominis
PHGSFLCEIKTQIGLPPLKI

SEQ ID NO: 2195214 - protein, 29 aa, Cryptosporidium hominis
PHHMRISEWLPYRQGVIVPGPKFFKGNIL

SEQ ID NO: 2195215 - protein, 17 aa, Cryptosporidium hominis
PHIEKSLMGKALIGKKG

SEQ ID NO: 2195216 - protein, 19 aa, Cryptosporidium hominis
PHIFLQVYPEYISTSCPEP

SEQ ID NO: 2195217 - protein, 24 aa, Cryptosporidium hominis
PHNFGAGYFTVPNAYPAPNVEIKL

SEQ ID NO: 2195218 - protein, 23 aa, Cryptosporidium hominis
PHTLSFRPVILPGSTELLIHVPE

SEQ ID NO: 2195219 - protein, 29 aa, Cryptosporidium hominis
PHVYGYSQLKKGILLLLVGGVEKRTKDNI

SEQ ID NO: 2195220 - protein, 17 aa, Cryptosporidium hominis
PIASYKLTPDMAIVDAN

SEQ ID NO: 2195221 - protein, 18 aa, Cryptosporidium hominis
PICQYPVGTYFLHDDSWW

SEQ ID NO: 2195222 - protein, 26 aa, Cryptosporidium hominis
PICTPKRSYLPLITHISSPLSNPSTA

SEQ ID NO: 2195223 - protein, 24 aa, Cryptosporidium hominis
PIDDFELLLFIDQKGKKSIFCPRC

SEQ ID NO: 2195224 - protein, 24 aa, Cryptosporidium hominis
PIDTPSHIIGVFIKAMRKIQKINS

SEQ ID NO: 2195225 - protein, 21 aa, Cryptosporidium hominis
PIDVFLPIFVNHDHLLLEMAW

SEQ ID NO: 2195226 - protein, 23 aa, Cryptosporidium hominis
PIELDCNTPLPAPPSPRYTTIKV

SEQ ID NO: 2195227 - protein, 23 aa, Cryptosporidium hominis
PIELKGIELLRNPFYNKGLSFTM

SEQ ID NO: 2195228 - protein, 19 aa, Cryptosporidium hominis
PIFVQTLLERVPYQDLDIL

SEQ ID NO: 2195229 - protein, 27 aa, Cryptosporidium hominis
PIGIPGNMFILNPYLEVGEIKTIIEVE

SEQ ID NO: 2195230 - protein, 19 aa, Cryptosporidium hominis
PIIALKYVNDIYHLCSPPD

SEQ ID NO: 2195231 - protein, 22 aa, Cryptosporidium hominis
PIICMEWSKWTPNILMTGGVDN

SEQ ID NO: 2195232 - protein, 40 aa, Cryptosporidium hominis
PIIEGWLHKWTNMVNTWKPRYFRLYPGILCYMKGSKIRKI

SEQ ID NO: 2195233 - protein, 31 aa, Cryptosporidium hominis
PIISASLYFSFKLYCRNISFNDLLKATGISK

SEQ ID NO: 2195234 - protein, 19 aa, Cryptosporidium hominis
PIITLQHIVKERYPCFVDA

SEQ ID NO: 2195235 - protein, 24 aa, Cryptosporidium hominis
PIKKKFSKIFENKLSTLFANTKKF

SEQ ID NO: 2195236 - protein, 25 aa, Cryptosporidium hominis
PIKVRIIMSILYISDSLRESCKQEF

SEQ ID NO: 2195237 - protein, 23 aa, Cryptosporidium hominis
PIKYKQPECFTSALRHSKPALTW

SEQ ID NO: 2195238 - protein, 17 aa, Cryptosporidium hominis
PILIERFQKQGIKFISS

SEQ ID NO: 2195239 - protein, 18 aa, Cryptosporidium hominis
PILIIATRQDIIGALAPG

SEQ ID NO: 2195240 - protein, 19 aa, Cryptosporidium hominis
PILKKSDFCDFKKVSLLPL

SEQ ID NO: 2195241 - protein, 18 aa, Cryptosporidium hominis
PILLNILMDGIGAYNSMI

SEQ ID NO: 2195242 - protein, 17 aa, Cryptosporidium hominis
PILNSYEAFVLLGNLSN

SEQ ID NO: 2195243 - protein, 18 aa, Cryptosporidium hominis
PIMDQLMCRVGASDAQIL

SEQ ID NO: 2195244 - protein, 20 aa, Cryptosporidium hominis
PINEFFILNKSFPENIHIIF

SEQ ID NO: 2195245 - protein, 26 aa, Cryptosporidium hominis
PINENYFILDLLAQAGTYIKEFVNGD

SEQ ID NO: 2195246 - protein, 21 aa, Cryptosporidium hominis
PINPKLLQKLALSGELPHIII

SEQ ID NO: 2195247 - protein, 22 aa, Cryptosporidium hominis
PINSSLMDVQLSFEGVLTELEK

SEQ ID NO: 2195248 - protein, 18 aa, Cryptosporidium hominis
PIPGRHLTLHIGVGYGRT

SEQ ID NO: 2195249 - protein, 19 aa, Cryptosporidium hominis
PIPLNALSSSLLPRRRTII

SEQ ID NO: 2195250 - protein, 17 aa, Cryptosporidium hominis
PIPPASPQRTPPASLPP

SEQ ID NO: 2195251 - protein, 24 aa, Cryptosporidium hominis
PIPPESPLPIPPSLSRTRSASSLL

SEQ ID NO: 2195252 - protein, 23 aa, Cryptosporidium hominis
PIQGMPHMQSFPHIGAQMQRAGG

SEQ ID NO: 2195253 - protein, 19 aa, Cryptosporidium hominis
PIQHISKDTLYLYKTTKCT

SEQ ID NO: 2195254 - protein, 27 aa, Cryptosporidium hominis
PIRNIPDLMTMLDLSDIPPHVQIPKYY

SEQ ID NO: 2195255 - protein, 33 aa, Cryptosporidium hominis
PISAFQIIIRKYIIPLILMIYQPNNFEKCEDVV

SEQ ID NO: 2195256 - protein, 19 aa, Cryptosporidium hominis
PISCEFPESLLPINGVPII

SEQ ID NO: 2195257 - protein, 23 aa, Cryptosporidium hominis
PISKRLISFTEHILRKSKLDGGE

SEQ ID NO: 2195258 - protein, 41 aa, Cryptosporidium hominis
PISLEELYIIQSIIPISIFSLLLTRFPVPAASTFSFSLICN

SEQ ID NO: 2195259 - protein, 26 aa, Cryptosporidium hominis
PISLPQPPFQPYIFKNSRNYQSFNSF

SEQ ID NO: 2195260 - protein, 20 aa, Cryptosporidium hominis
PISNWEWVKFRNSARNDSLK

SEQ ID NO: 2195261 - protein, 20 aa, Cryptosporidium hominis
PISYFLYNDATEVYRKAHIE

SEQ ID NO: 2195262 - protein, 17 aa, Cryptosporidium hominis
PITINKTTIIAPGAPNT

SEQ ID NO: 2195263 - protein, 18 aa, Cryptosporidium hominis
PITIVYLSSLLHPYLNIW

SEQ ID NO: 2195264 - protein, 19 aa, Cryptosporidium hominis
PITLNNIIQFLRDKEFVDP

SEQ ID NO: 2195265 - protein, 26 aa, Cryptosporidium hominis
PITRDTQFLQIIQHKMPKRSNKQLGS

SEQ ID NO: 2195266 - protein, 32 aa, Cryptosporidium hominis
PIVEKKLMINYSFSSLIFFPNICITMSSNVPG

SEQ ID NO: 2195267 - protein, 18 aa, Cryptosporidium hominis
PIVLLNNAYWEPKVKEWV

SEQ ID NO: 2195268 - protein, 19 aa, Cryptosporidium hominis
PIYSRVVIQRIPWRELKEI

SEQ ID NO: 2195269 - protein, 19 aa, Cryptosporidium hominis
PKAMLPGCPVKPLGGGEFS

SEQ ID NO: 2195270 - protein, 18 aa, Cryptosporidium hominis
PKDLEIDLLDFYVKSWKD

SEQ ID NO: 2195271 - protein, 24 aa, Cryptosporidium hominis
PKDNPLIFILLTNIVGWDTVDDES

SEQ ID NO: 2195272 - protein, 24 aa, Cryptosporidium hominis
PKDPNSFPFVVLGNKLDLDQKSRK

SEQ ID NO: 2195273 - protein, 25 aa, Cryptosporidium hominis
PKDSRLVIYGKFKDNPLVSLIGEVP

SEQ ID NO: 2195274 - protein, 17 aa, Cryptosporidium hominis
PKELGQGNLLVLMIATP

SEQ ID NO: 2195275 - protein, 31 aa, Cryptosporidium hominis
PKFVKASIVIFFYTVFDCFIIPKSADALSSF

SEQ ID NO: 2195276 - protein, 33 aa, Cryptosporidium hominis
PKGNTAVYLLYAYARICAIFRKVEFIQSDDNMV

SEQ ID NO: 2195277 - protein, 20 aa, Cryptosporidium hominis
  misc_feature (20)..(20): Xaa can be any naturally occurring amino acid
PKGYFAFWVTYDPEIHVYIX

SEQ ID NO: 2195278 - protein, 30 aa, Cryptosporidium hominis
PKIEAIYKDIPIPIPVKRTIEKPVPIGLYD

SEQ ID NO: 2195279 - protein, 29 aa, Cryptosporidium hominis
PKIHEFIEKIYSWNKIRLNKFQEQGVLES

SEQ ID NO: 2195280 - protein, 19 aa, Cryptosporidium hominis
PKIRLMSVKAIFSENFLSI

SEQ ID NO: 2195281 - protein, 30 aa, Cryptosporidium hominis
PKISLKQLLLLLEKIILLIELARIEGTNQI

SEQ ID NO: 2195282 - protein, 25 aa, Cryptosporidium hominis
PKKVYYFIYGFFHRIYEKIYHYRHP

SEQ ID NO: 2195283 - protein, 26 aa, Cryptosporidium hominis
PKLKAVIPLFGLLDLAFEIRKYCYTN

SEQ ID NO: 2195284 - protein, 19 aa, Cryptosporidium hominis
PKMPREYIVRLIFDRNHYS

SEQ ID NO: 2195285 - protein, 29 aa, Cryptosporidium hominis
PKNEDSVLFLKSKFDYLLCNGCNRAFHWY

SEQ ID NO: 2195286 - protein, 32 aa, Cryptosporidium hominis
PKQFKDWRAHDIGIGFLLYGESACFALARMIE

SEQ ID NO: 2195287 - protein, 23 aa, Cryptosporidium hominis
PKQIFDFMINVENKPLYDSTCAE

SEQ ID NO: 2195288 - protein, 21 aa, Cryptosporidium hominis
PKSFTIEPKWDPLLEQQSQQS

SEQ ID NO: 2195289 - protein, 25 aa, Cryptosporidium hominis
PKSLNSPISYIPITKSPTSFTNTSY

SEQ ID NO: 2195290 - protein, 25 aa, Cryptosporidium hominis
PKSNEFLLCKGIIPPELTLNSGIDG

SEQ ID NO: 2195291 - protein, 24 aa, Cryptosporidium hominis
PKTLHLKLVLLGDASVGKSCLVVR

SEQ ID NO: 2195292 - protein, 27 aa, Cryptosporidium hominis
PKVDSYLSDKLLFFLSGLISHSNDGAY

SEQ ID NO: 2195293 - protein, 18 aa, Cryptosporidium hominis
PKVKFITRIWHPNISSQT

SEQ ID NO: 2195294 - protein, 25 aa, Cryptosporidium hominis
PKWIIFTDIIQTKKTYIRIISAINH

SEQ ID NO: 2195295 - protein, 26 aa, Cryptosporidium hominis
PKYPPMLHNWFFKKFSTKSSYIWLKS

SEQ ID NO: 2195296 - protein, 21 aa, Cryptosporidium hominis
PLAITLFHWQNSLALERIVGT

SEQ ID NO: 2195297 - protein, 24 aa, Cryptosporidium hominis
PLCTKHYCPFAHGLDELRNPETIE

SEQ ID NO: 2195298 - protein, 20 aa, Cryptosporidium hominis
PLCWDNLRKAFCSGYFHNSA

SEQ ID NO: 2195299 - protein, 26 aa, Cryptosporidium hominis
PLCYTGSFFHRIIPQFMIQGGDFTRG

SEQ ID NO: 2195300 - protein, 18 aa, Cryptosporidium hominis
PLDAYSLLNSHEFYKSIT

SEQ ID NO: 2195301 - protein, 19 aa, Cryptosporidium hominis
PLDNLWLNQNFQITKKHNL

SEQ ID NO: 2195302 - protein, 23 aa, Cryptosporidium hominis
PLEFLKMIKAMVNKDVFEVCDKI

SEQ ID NO: 2195303 - protein, 17 aa, Cryptosporidium hominis
PLEGVMVVELIIIAKCC

SEQ ID NO: 2195304 - protein, 19 aa, Cryptosporidium hominis
PLEILLHLPLVCEDKNTPY

SEQ ID NO: 2195305 - protein, 29 aa, Cryptosporidium hominis
PLELMFCHFFHTKYVYDLLSKLCTLSCSR

SEQ ID NO: 2195306 - protein, 19 aa, Cryptosporidium hominis
PLELPIIHFLCDHSFHRYC

SEQ ID NO: 2195307 - protein, 19 aa, Cryptosporidium hominis
PLENKFVIALPPPNVTGRL

SEQ ID NO: 2195308 - protein, 19 aa, Cryptosporidium hominis
PLETRISWLSKWLRISKSG

SEQ ID NO: 2195309 - protein, 20 aa, Cryptosporidium hominis
PLEYGGMGFDYIWNTSICSS

SEQ ID NO: 2195310 - protein, 25 aa, Cryptosporidium hominis
PLEYPKLCNRTYKNELDSFSGIGIV

SEQ ID NO: 2195311 - protein, 24 aa, Cryptosporidium hominis
PLFENYGICHLGLNCKFGLSHFNE

SEQ ID NO: 2195312 - protein, 17 aa, Cryptosporidium hominis
PLHIIGYNPVISGYDQN

SEQ ID NO: 2195313 - protein, 24 aa, Cryptosporidium hominis
PLIDQRSFFLGKILGRMISSILSG

SEQ ID NO: 2195314 - protein, 18 aa, Cryptosporidium hominis
PLITKRVIPQTNKIVYQP

SEQ ID NO: 2195315 - protein, 20 aa, Cryptosporidium hominis
PLLKIKTVIDILGDLLKKIQ

SEQ ID NO: 2195316 - protein, 23 aa, Cryptosporidium hominis
PLMMSYLKTRFTLTSGMFPHKLK

SEQ ID NO: 2195317 - protein, 26 aa, Cryptosporidium hominis
PLMSLQKVHFLALPPFNAALSPLAQK

SEQ ID NO: 2195318 - protein, 18 aa, Cryptosporidium hominis
PLMWHSFGCITALLQEII

SEQ ID NO: 2195319 - protein, 20 aa, Cryptosporidium hominis
PLNFLSYLEDVSVEPCLKYV

SEQ ID NO: 2195320 - protein, 18 aa, Cryptosporidium hominis
PLNKISVVILGQDPYHQP

SEQ ID NO: 2195321 - protein, 38 aa, Cryptosporidium hominis
PLNKRIIIKKFFKLIERLKILLLYLKQEIIGKSSSSYI

SEQ ID NO: 2195322 - protein, 17 aa, Cryptosporidium hominis
PLNLPCMYSVPFIEQEH

SEQ ID NO: 2195323 - protein, 26 aa, Cryptosporidium hominis
PLPDPDPFLRPIKNNGKQRFYLTASE

SEQ ID NO: 2195324 - protein, 24 aa, Cryptosporidium hominis
PLPGRPRCIWTLKNGIDPSLSGSQ

SEQ ID NO: 2195325 - protein, 19 aa, Cryptosporidium hominis
PLPTLVRNVFSLAALANGY

SEQ ID NO: 2195326 - protein, 30 aa, Cryptosporidium hominis
PLQNSLKELFTLLNFLYPDILQDSEIFEKI

SEQ ID NO: 2195327 - protein, 27 aa, Cryptosporidium hominis
PLRAVFAGLRILDSIRFMGLSSSIGIG

SEQ ID NO: 2195328 - protein, 30 aa, Cryptosporidium hominis
PLRSSEFFMINILGLNRFKIRAQCVLAMKA

SEQ ID NO: 2195329 - protein, 29 aa, Cryptosporidium hominis
PLTKQKEYLIKWKVPGQPVQPTWEPEENL

SEQ ID NO: 2195330 - protein, 19 aa, Cryptosporidium hominis
PLTPYSEQFLPYKQKLDKA

SEQ ID NO: 2195331 - protein, 19 aa, Cryptosporidium hominis
PLTSYVSTRWYRAPELLVK

SEQ ID NO: 2195332 - protein, 24 aa, Cryptosporidium hominis
PLVCPELYQQIGIDPPTGVLLYGP

SEQ ID NO: 2195333 - protein, 19 aa, Cryptosporidium hominis
PLVLKKKETILITGINKKF

SEQ ID NO: 2195334 - protein, 27 aa, Cryptosporidium hominis
PLVLQAGFRRFYICPIVSNCPRISSAT

SEQ ID NO: 2195335 - protein, 34 aa, Cryptosporidium hominis
PLYCPLAIGYFWIDKFMWQMYRFPGSNLQTISPI

SEQ ID NO: 2195336 - protein, 25 aa, Cryptosporidium hominis
PLYSERVFHISLFYIKKSDLYLGNA

SEQ ID NO: 2195337 - protein, 19 aa, Cryptosporidium hominis
PMCGRIIPHKFFSNSFKQS

SEQ ID NO: 2195338 - protein, 21 aa, Cryptosporidium hominis
PMGKLSLYITLGGIDPSKVLP

SEQ ID NO: 2195339 - protein, 18 aa, Cryptosporidium hominis
PMILTQFIENIDLNNESE

SEQ ID NO: 2195340 - protein, 17 aa, Cryptosporidium hominis
PMKKDLPPAPPMKKDAP

SEQ ID NO: 2195341 - protein, 26 aa, Cryptosporidium hominis
PMKKEIEISILLKKNIKIPPKKDGLV

SEQ ID NO: 2195342 - protein, 29 aa, Cryptosporidium hominis
PMKLLKGGSLLPYQIIGVEWMLSLYNNKL

SEQ ID NO: 2195343 - protein, 26 aa, Cryptosporidium hominis
PMKYVDYYIETLPRPNIDFNQTHKML

SEQ ID NO: 2195344 - protein, 21 aa, Cryptosporidium hominis
PMLYDKLSRSIAPSIWENDDV

SEQ ID NO: 2195345 - protein, 17 aa, Cryptosporidium hominis
PMQVFINALNKKYNPEK

SEQ ID NO: 2195346 - protein, 17 aa, Cryptosporidium hominis
PMRAKFDQISFSAHSDF

SEQ ID NO: 2195347 - protein, 26 aa, Cryptosporidium hominis
PMTSPHQKVFILLQANIFSIPVTVVD

SEQ ID NO: 2195348 - protein, 26 aa, Cryptosporidium hominis
PNAKCRLRLLKYERIKDYLMMEQEFI

SEQ ID NO: 2195349 - protein, 28 aa, Cryptosporidium hominis
PNALVRFLCNLIISQIFKFPTVFRTNIK

SEQ ID NO: 2195350 - protein, 23 aa, Cryptosporidium hominis
PNCKRFYCPFIHDSETNLINFNE

SEQ ID NO: 2195351 - protein, 23 aa, Cryptosporidium hominis
PNEFLYLNIPIYDTPFEDISKYF

SEQ ID NO: 2195352 - protein, 23 aa, Cryptosporidium hominis
PNEHIRHYLNLDFNWENESKMAE

SEQ ID NO: 2195353 - protein, 25 aa, Cryptosporidium hominis
PNEMRDYWLKFKDKISKIILDSRKI

SEQ ID NO: 2195354 - protein, 24 aa, Cryptosporidium hominis
PNENLELFPFHQESLKLESLLSNQ

SEQ ID NO: 2195355 - protein, 25 aa, Cryptosporidium hominis
PNGGIIAPIIVVPGATIPGGVATSP

SEQ ID NO: 2195356 - protein, 22 aa, Cryptosporidium hominis
PNGLFCFDFKLRINPNSSESDR

SEQ ID NO: 2195357 - protein, 28 aa, Cryptosporidium hominis
PNGNFKYNILKGFQIYIIGYSKTIGGFN

SEQ ID NO: 2195358 - protein, 29 aa, Cryptosporidium hominis
PNGNKQRWKWVALLPFIDQKVLLETVIPL

SEQ ID NO: 2195359 - protein, 39 aa, Cryptosporidium hominis
PNHYFLINTFVKLNLWWELMVYILRWSFELGPSKSRSLL

SEQ ID NO: 2195360 - protein, 24 aa, Cryptosporidium hominis
PNIELTMYDLLYNSSKKLKNKIES

SEQ ID NO: 2195361 - protein, 24 aa, Cryptosporidium hominis
PNIIKLFEVFEDTNYLYFVMEICT

SEQ ID NO: 2195362 - protein, 27 aa, Cryptosporidium hominis
PNILNKDYLLMFLYFGEDSFYEKGIKF

SEQ ID NO: 2195363 - protein, 21 aa, Cryptosporidium hominis
PNIQDINAFKLTKIIGKLDEL

SEQ ID NO: 2195364 - protein, 31 aa, Cryptosporidium hominis
PNKEREYYKWDYIILLTTRYISPDSNTIIYQ

SEQ ID NO: 2195365 - protein, 29 aa, Cryptosporidium hominis
PNKPGKIIKTRLLLKAPLSPYELDWCTDA

SEQ ID NO: 2195366 - protein, 18 aa, Cryptosporidium hominis
PNKRNILTAINWLTRDAE

SEQ ID NO: 2195367 - protein, 24 aa, Cryptosporidium hominis
PNKSNFRWVWPAHVFVTHTGTIIF

SEQ ID NO: 2195368 - protein, 21 aa, Cryptosporidium hominis
PNKVRFFIMDGTDPIAFLSYY

SEQ ID NO: 2195369 - protein, 27 aa, Cryptosporidium hominis
PNLDSLMDFIFFIWGADDEFWDKNKLR

SEQ ID NO: 2195370 - protein, 18 aa, Cryptosporidium hominis
PNLKVYFFSALNEINKRE

SEQ ID NO: 2195371 - protein, 19 aa, Cryptosporidium hominis
PNLLRDTHLLFLNRFSIVF

SEQ ID NO: 2195372 - protein, 26 aa, Cryptosporidium hominis
PNLVTSYYYPYFDKSINEFNPLYNYG

SEQ ID NO: 2195373 - protein, 20 aa, Cryptosporidium hominis
PNNFHHHSMGIYSSITNMDY

SEQ ID NO: 2195374 - protein, 21 aa, Cryptosporidium hominis
PNNIIIIFSGRERHLLDEWFG

SEQ ID NO: 2195375 - protein, 18 aa, Cryptosporidium hominis
PNNLTPIDWARLNKEAFL

SEQ ID NO: 2195376 - protein, 29 aa, Cryptosporidium hominis
PNNPLSVIEFFKYPIPFFSKKNISKNEFS

SEQ ID NO: 2195377 - protein, 24 aa, Cryptosporidium hominis
PNNQLTLDLLKLSSVPIAAPSANR

SEQ ID NO: 2195378 - protein, 24 aa, Cryptosporidium hominis
PNPKYQYLFVGAEPYNTIGIRIPN

SEQ ID NO: 2195379 - protein, 26 aa, Cryptosporidium hominis
PNQETRISEFLSKHLSFISKLSEDKQ

SEQ ID NO: 2195380 - protein, 31 aa, Cryptosporidium hominis
PNQMNSLMNPHYLNSVPLLAQIRIECIQDLP

SEQ ID NO: 2195381 - protein, 25 aa, Cryptosporidium hominis
PNQPHKYFENILSPNKFTKKEANNT

SEQ ID NO: 2195382 - protein, 28 aa, Cryptosporidium hominis
PNRGSIWMVFEYLPYDLSGYIEGLKLEG

SEQ ID NO: 2195383 - protein, 20 aa, Cryptosporidium hominis
PNRYVSQPPIYYYDQQPSQV

SEQ ID NO: 2195384 - protein, 25 aa, Cryptosporidium hominis
PNSEKLVFLLSTRAGGLGINLATAD

SEQ ID NO: 2195385 - protein, 19 aa, Cryptosporidium hominis
PNSGWGGKGLLGCDIAAGP

SEQ ID NO: 2195386 - protein, 17 aa, Cryptosporidium hominis
PNSNLLLPFETASSYVI

SEQ ID NO: 2195387 - protein, 23 aa, Cryptosporidium hominis
PNTHEVVTLWYRAPELLLGQRCY

SEQ ID NO: 2195388 - protein, 23 aa, Cryptosporidium hominis
PNTKNVMLCTPLHFSASNGFDEI

SEQ ID NO: 2195389 - protein, 22 aa, Cryptosporidium hominis
PNTRWSIKKALFHPDCIQQLLF

SEQ ID NO: 2195390 - protein, 21 aa, Cryptosporidium hominis
PNTYPDIGLVPYTSIPCVLDF

SEQ ID NO: 2195391 - protein, 21 aa, Cryptosporidium hominis
PNWDEYFMKIAKLASQRSNCV

SEQ ID NO: 2195392 - protein, 27 aa, Cryptosporidium hominis
PNWQKEFEIWSPELKILCFKGSRYERR

SEQ ID NO: 2195393 - protein, 22 aa, Cryptosporidium hominis
PNYGTNAPIVRAYKATIQTINS

SEQ ID NO: 2195394 - protein, 27 aa, Cryptosporidium hominis
PNYKILVSCFKQFPSSYLLINSNFKAN

SEQ ID NO: 2195395 - protein, 17 aa, Cryptosporidium hominis
PPAVFSKVTHPVNIKWI

SEQ ID NO: 2195396 - protein, 21 aa, Cryptosporidium hominis
PPCCDPSLLEPVKLPFGESNE

SEQ ID NO: 2195397 - protein, 23 aa, Cryptosporidium hominis
PPCGRAITLFDHNGMAVATTTST

SEQ ID NO: 2195398 - protein, 17 aa, Cryptosporidium hominis
PPDLLIHVAKCDFLSLT

SEQ ID NO: 2195399 - protein, 22 aa, Cryptosporidium hominis
PPECWKIFWRLEENKIQFPLEE

SEQ ID NO: 2195400 - protein, 23 aa, Cryptosporidium hominis
PPEDYIFEEFINIALEETQILDD

SEQ ID NO: 2195401 - protein, 17 aa, Cryptosporidium hominis
PPFMKLYTIRQGDPLEN

SEQ ID NO: 2195402 - protein, 19 aa, Cryptosporidium hominis
PPHGQIFMKWGKVASKVFP

SEQ ID NO: 2195403 - protein, 17 aa, Cryptosporidium hominis
PPIGICLHSLLYILPPS

SEQ ID NO: 2195404 - protein, 19 aa, Cryptosporidium hominis
PPILNRLIERMLSLKIITE

SEQ ID NO: 2195405 - protein, 19 aa, Cryptosporidium hominis
PPIPNVISLILRISSSKIG

SEQ ID NO: 2195406 - protein, 19 aa, Cryptosporidium hominis
PPKGVILYGPPGTGKTLLA

SEQ ID NO: 2195407 - protein, 26 aa, Cryptosporidium hominis
PPKKEILLYVPLTNMQRRLYKDLLSK

SEQ ID NO: 2195408 - protein, 25 aa, Cryptosporidium hominis
PPKRELYVYIGLSKLQKKIYSELLT

SEQ ID NO: 2195409 - protein, 18 aa, Cryptosporidium hominis
PPLPLHMKSGMKSKSCPF

SEQ ID NO: 2195410 - protein, 19 aa, Cryptosporidium hominis
PPLSPLPPPAFLSLFFARA

SEQ ID NO: 2195411 - protein, 21 aa, Cryptosporidium hominis
PPNHFFSFKNLSNESAKISFV

SEQ ID NO: 2195412 - protein, 17 aa, Cryptosporidium hominis
PPPAKPLGGKPATKIPP

SEQ ID NO: 2195413 - protein, 20 aa, Cryptosporidium hominis
PPPKIGILEPVETSEGLISP

SEQ ID NO: 2195414 - protein, 32 aa, Cryptosporidium hominis
PPPPITGFPSNMIYFPPPPPPHLNPPIPGHPN

SEQ ID NO: 2195415 - protein, 17 aa, Cryptosporidium hominis
PPPPPPGVSRHYPVSPI

SEQ ID NO: 2195416 - protein, 23 aa, Cryptosporidium hominis
PPPPPPPPPPPPPPPPVLRHSVT

SEQ ID NO: 2195417 - protein, 19 aa, Cryptosporidium hominis
PPQKPMKKPLPIPKDFPKS

SEQ ID NO: 2195418 - protein, 27 aa, Cryptosporidium hominis
PPQNSDWLYIRAASILRHLYVRPNVGV

SEQ ID NO: 2195419 - protein, 24 aa, Cryptosporidium hominis
PPSNKPLLMYLSGAKGQLINIAQM

SEQ ID NO: 2195420 - protein, 21 aa, Cryptosporidium hominis
PPVFHHENILWMNFKLPTQNC

SEQ ID NO: 2195421 - protein, 19 aa, Cryptosporidium hominis
PQAFFYLDKTIFNEKSKHL

SEQ ID NO: 2195422 - protein, 23 aa, Cryptosporidium hominis
PQAGAIIRFKSKETIYCSCEFLD

SEQ ID NO: 2195423 - protein, 28 aa, Cryptosporidium hominis
PQCCWIWSTYVFLKIIKSFTFCLENINN

SEQ ID NO: 2195424 - protein, 26 aa, Cryptosporidium hominis
PQCGPFCSTYTNGFFTFWVTYSKIKS

SEQ ID NO: 2195425 - protein, 35 aa, Cryptosporidium hominis
PQCGPYCSTYPKGYFAFWLTYDSKYNYFIISVNSN

SEQ ID NO: 2195426 - protein, 31 aa, Cryptosporidium hominis
PQHAQINPMIFQNPILMNALQSGGTNPMSVP

SEQ ID NO: 2195427 - protein, 17 aa, Cryptosporidium hominis
PQHSIAWSKYLFDIVFG

SEQ ID NO: 2195428 - protein, 18 aa, Cryptosporidium hominis
PQIQILPPSIKTLIVNPK

SEQ ID NO: 2195429 - protein, 25 aa, Cryptosporidium hominis
PQKIINEPYLYVSPFEEVIKDLVDL

SEQ ID NO: 2195430 - protein, 18 aa, Cryptosporidium hominis
PQLGSFFTPRPWKGGNQS

SEQ ID NO: 2195431 - protein, 26 aa, Cryptosporidium hominis
PQLSTILNYLLFIKFNKYPTCESDTD

SEQ ID NO: 2195432 - protein, 21 aa, Cryptosporidium hominis
PQNILIIKRPKSPNSTILAVE

SEQ ID NO: 2195433 - protein, 18 aa, Cryptosporidium hominis
PQSFSRLAAVKGSLQRLG

SEQ ID NO: 2195434 - protein, 25 aa, Cryptosporidium hominis
PQSLKRRFYMQIQFIKYMEKHIGAL

SEQ ID NO: 2195435 - protein, 18 aa, Cryptosporidium hominis
PQSMLTWEDTQFQGQANI

SEQ ID NO: 2195436 - protein, 26 aa, Cryptosporidium hominis
PQSTSDNWLREFKKWLPDANVVLYHG

SEQ ID NO: 2195437 - protein, 26 aa, Cryptosporidium hominis
PQVRTSFLEVINWLREWACSRSYGLG

SEQ ID NO: 2195438 - protein, 23 aa, Cryptosporidium hominis
PRAPIEWHWTFHTPEDLTFLRKV

SEQ ID NO: 2195439 - protein, 25 aa, Cryptosporidium hominis
PRDLSPNQIEFLRKIDLRKQNRFSH

SEQ ID NO: 2195440 - protein, 18 aa, Cryptosporidium hominis
PREDLLVKDYSFDLYRIK

SEQ ID NO: 2195441 - protein, 26 aa, Cryptosporidium hominis
PREKCSYLLFILTPSENSKDLTTLEM

SEQ ID NO: 2195442 - protein, 17 aa, Cryptosporidium hominis
PRELIHCRSLRDILYNL

SEQ ID NO: 2195443 - protein, 17 aa, Cryptosporidium hominis
PRESIVIQFSKVIKALL

SEQ ID NO: 2195444 - protein, 18 aa, Cryptosporidium hominis
PRGKIPYEYLVKYHHQSY

SEQ ID NO: 2195445 - protein, 25 aa, Cryptosporidium hominis
PRIIYCKLPDDIASRNVFILDPILG

SEQ ID NO: 2195446 - protein, 19 aa, Cryptosporidium hominis
PRILHAFIQLNKLGNYLSP

SEQ ID NO: 2195447 - protein, 29 aa, Cryptosporidium hominis
PRKDWAFDEAILYPPHPRTGLPKSPKIKT

SEQ ID NO: 2195448 - protein, 26 aa, Cryptosporidium hominis
PRKDWPFDEAILYPPHPRIGSPVTKV

SEQ ID NO: 2195449 - protein, 33 aa, Cryptosporidium hominis
PRKLSKATRSRLLLKERIFSMNPFGVNINGRIE

SEQ ID NO: 2195450 - protein, 25 aa, Cryptosporidium hominis
PRLHSALTRLYWKNMLKSIKCIQSW

SEQ ID NO: 2195451 - protein, 18 aa, Cryptosporidium hominis
PRPAIPPPHMYAPNMARP

SEQ ID NO: 2195452 - protein, 29 aa, Cryptosporidium hominis
PRRSKDLPLSYDEARFIREIWQDTRAQYE

SEQ ID NO: 2195453 - protein, 21 aa, Cryptosporidium hominis
PRSDEELAFLFAFDTDEYNRF

SEQ ID NO: 2195454 - protein, 26 aa, Cryptosporidium hominis
PRSGIRWLCFILGEYGKLISSKVSIV

SEQ ID NO: 2195455 - protein, 20 aa, Cryptosporidium hominis
PRSGSLGFLPRKRCSRSRGK

SEQ ID NO: 2195456 - protein, 20 aa, Cryptosporidium hominis
PRSIFKLETAVQRSSIHTSN

SEQ ID NO: 2195457 - protein, 23 aa, Cryptosporidium hominis
PRSLYIRIVNLTDFDLTLQLPAA

SEQ ID NO: 2195458 - protein, 25 aa, Cryptosporidium hominis
PRTPQFRATYILPTSPHFSDSDEFY

SEQ ID NO: 2195459 - protein, 21 aa, Cryptosporidium hominis
PRVLPIPVKPIMFDIASDFIL

SEQ ID NO: 2195460 - protein, 19 aa, Cryptosporidium hominis
PSCLFEQDNTNNLDFNRIK

SEQ ID NO: 2195461 - protein, 19 aa, Cryptosporidium hominis
PSCRSLRTSIRINRSSTLS

SEQ ID NO: 2195462 - protein, 19 aa, Cryptosporidium hominis
PSCTLYVCRLSLKTKEDDL

SEQ ID NO: 2195463 - protein, 18 aa, Cryptosporidium hominis
PSDILCVHVFQKEYFSTI

SEQ ID NO: 2195464 - protein, 44 aa, Cryptosporidium hominis
PSEACKSWPLCPYGPGCFFIHPTVPCRYGLACYNSLCNYSHPNG

SEQ ID NO: 2195465 - protein, 29 aa, Cryptosporidium hominis
PSEYICKLCGFPLLNPVLIKCAGSCGASA

SEQ ID NO: 2195466 - protein, 33 aa, Cryptosporidium hominis
PSEYIPYARSLDTHWLKYLLDSGLTMISDDSNH

SEQ ID NO: 2195467 - protein, 23 aa, Cryptosporidium hominis
PSFTALHYIIANLSLTNPNLNLN

SEQ ID NO: 2195468 - protein, 22 aa, Cryptosporidium hominis
PSGDFMMCKVCGFKSAVLGKTG

SEQ ID NO: 2195469 - protein, 29 aa, Cryptosporidium hominis
PSHSALYVTLKFPLPNIVQQFLPSIVQLR

SEQ ID NO: 2195470 - protein, 18 aa, Cryptosporidium hominis
PSHYQNVRKKWWSSWGSN

SEQ ID NO: 2195471 - protein, 17 aa, Cryptosporidium hominis
PSIIGCGDIINFQDYQQ

SEQ ID NO: 2195472 - protein, 25 aa, Cryptosporidium hominis
PSIIHPNIMPRISPIIGPCLGSIYQ

SEQ ID NO: 2195473 - protein, 32 aa, Cryptosporidium hominis
PSILDDILIDVPQFKEIVLTEFITDAISKYDS

SEQ ID NO: 2195474 - protein, 24 aa, Cryptosporidium hominis
PSIRQKTMMQANANKRLLLSKAKN

SEQ ID NO: 2195475 - protein, 23 aa, Cryptosporidium hominis
PSISMIRKLLYKRGYLKVGKRGS

SEQ ID NO: 2195476 - protein, 25 aa, Cryptosporidium hominis
PSKIQAAALPLILNSPMNLIAQAHN

SEQ ID NO: 2195477 - protein, 18 aa, Cryptosporidium hominis
PSKLGYGARGCPPVIPKN

SEQ ID NO: 2195478 - protein, 21 aa, Cryptosporidium hominis
PSKRWYERIAVISPYNEQVKI

SEQ ID NO: 2195479 - protein, 19 aa, Cryptosporidium hominis
PSLCLNNCGFYGNPTTNNL

SEQ ID NO: 2195480 - protein, 26 aa, Cryptosporidium hominis
PSLERIRTLVLPKLYTYINYSLINQL

SEQ ID NO: 2195481 - protein, 28 aa, Cryptosporidium hominis
PSLIELPVPYMVPKPFVVPVHVPVLEFR

SEQ ID NO: 2195482 - protein, 21 aa, Cryptosporidium hominis
PSLLCVLGKHLLIANLASEAA

SEQ ID NO: 2195483 - protein, 21 aa, Cryptosporidium hominis
PSLPPPSLPPPPPQYSSYKSS

SEQ ID NO: 2195484 - protein, 37 aa, Cryptosporidium hominis
PSLTLNSGLPPISLPPRAIPPINLSQSLMTPTTSASS

SEQ ID NO: 2195485 - protein, 19 aa, Cryptosporidium hominis
PSMIMPISRAYRAQLERHN

SEQ ID NO: 2195486 - protein, 31 aa, Cryptosporidium hominis
PSMQKQLLGERLFPIIAQFQPELAGKITGMM

SEQ ID NO: 2195487 - protein, 24 aa, Cryptosporidium hominis
PSNILLHITFDKFLEQPICQALLS

SEQ ID NO: 2195488 - protein, 23 aa, Cryptosporidium hominis
PSNILVNLSCDLKICDFGLARGN

SEQ ID NO: 2195489 - protein, 17 aa, Cryptosporidium hominis
PSNLAVVSYINNANRRL

SEQ ID NO: 2195490 - protein, 24 aa, Cryptosporidium hominis
PSNSLQLFSFILNDIISSLVENAL

SEQ ID NO: 2195491 - protein, 30 aa, Cryptosporidium hominis
PSPGKFIYDIGFYTLINQLIDFFKEDISKE

SEQ ID NO: 2195492 - protein, 40 aa, Cryptosporidium hominis
PSPSPLLLPLPSPSPLPFPSLPPSLLSFPSPPPPPFSPSS

SEQ ID NO: 2195493 - protein, 19 aa, Cryptosporidium hominis
PSQGILSLGFGFEYLPLKC

SEQ ID NO: 2195494 - protein, 24 aa, Cryptosporidium hominis
PSQNWPSNWVWLNTRYSVTLINQK

SEQ ID NO: 2195495 - protein, 19 aa, Cryptosporidium hominis
PSRKNSFFGINRTAERIKI

SEQ ID NO: 2195496 - protein, 35 aa, Cryptosporidium hominis
PSRYLVPLFMRCLYSSLLLLYDYSSYLLSFTELNN

SEQ ID NO: 2195497 - protein, 26 aa, Cryptosporidium hominis
PSSIIEMHLGLLPKTDYIKSNSLIKS

SEQ ID NO: 2195498 - protein, 31 aa, Cryptosporidium hominis
PSSKGLRLSGYLDLIYFKATTPLLDSKMDTK

SEQ ID NO: 2195499 - protein, 25 aa, Cryptosporidium hominis
PSSNSPLLINTLIPASNGIPKRSGF

SEQ ID NO: 2195500 - protein, 23 aa, Cryptosporidium hominis
PSSRETYFFSKQSNLILPDNKTN

SEQ ID NO: 2195501 - protein, 31 aa, Cryptosporidium hominis
PSTYEDDDYVWWQCDGCLKEILPNKKKFDCK

SEQ ID NO: 2195502 - protein, 26 aa, Cryptosporidium hominis
PSVYLRDYMYLKLNNGIKVILISDAI

SEQ ID NO: 2195503 - protein, 19 aa, Cryptosporidium hominis
PTCPDVIPTYPFFDRDPFA

SEQ ID NO: 2195504 - protein, 34 aa, Cryptosporidium hominis
PTDHYSMPLILLLFPKNIVLIKLMSSFSISDLNN

SEQ ID NO: 2195505 - protein, 25 aa, Cryptosporidium hominis
PTENYLIFKCKVLPDWIANNTNLNI

SEQ ID NO: 2195506 - protein, 30 aa, Cryptosporidium hominis
PTESFNFERIMYLKKLLLVWDTSGHIAFIN

SEQ ID NO: 2195507 - protein, 20 aa, Cryptosporidium hominis
PTHEICSPKIFLDASVNTEI

SEQ ID NO: 2195508 - protein, 23 aa, Cryptosporidium hominis
PTHPYGIFGPGNPVSAAAAAAAA

SEQ ID NO: 2195509 - protein, 20 aa, Cryptosporidium hominis
PTIFLTPIFNKTMITQIVSS

SEQ ID NO: 2195510 - protein, 17 aa, Cryptosporidium hominis
PTILFINAGMNQFKSIF

SEQ ID NO: 2195511 - protein, 17 aa, Cryptosporidium hominis
PTILLDNGGYDSAEIVT

SEQ ID NO: 2195512 - protein, 24 aa, Cryptosporidium hominis
PTIRNWLGSGLYLNKSHKGRIYEI

SEQ ID NO: 2195513 - protein, 20 aa, Cryptosporidium hominis
PTKGLRYQLPMRGHTGYLSF

SEQ ID NO: 2195514 - protein, 30 aa, Cryptosporidium hominis
PTKSFSIGIGWSRLGLFVLNEYGDGLIQLK

SEQ ID NO: 2195515 - protein, 33 aa, Cryptosporidium hominis
PTKVDVFCLGWMLLFTLTKYQPFETCRLITDNL

SEQ ID NO: 2195516 - protein, 18 aa, Cryptosporidium hominis
PTLGFNIKTLLHGKYRLN

SEQ ID NO: 2195517 - protein, 25 aa, Cryptosporidium hominis
PTLLDVVDIIFCNCGYMFKVIVVSD

SEQ ID NO: 2195518 - protein, 23 aa, Cryptosporidium hominis
PTLYNTLYISCYMCTFNPLKADE

SEQ ID NO: 2195519 - protein, 27 aa, Cryptosporidium hominis
PTMMEQFILDPIWNIYQNIFINFNEEK

SEQ ID NO: 2195520 - protein, 25 aa, Cryptosporidium hominis
PTNHLDILAVTWLENFLKEWDKICV

SEQ ID NO: 2195521 - protein, 33 aa, Cryptosporidium hominis
PTPDRIYSFLCGFVNLMRFKEDRWMTYKNEFYE

SEQ ID NO: 2195522 - protein, 32 aa, Cryptosporidium hominis
PTPTPTTAPPPPAPPLPPPSFSPSTVSSQFKL

SEQ ID NO: 2195523 - protein, 20 aa, Cryptosporidium hominis
PTQQVPAIPATIQAGIVSNK

SEQ ID NO: 2195524 - protein, 18 aa, Cryptosporidium hominis
PTVKYLRDNFSIKAFPQM

SEQ ID NO: 2195525 - protein, 26 aa, Cryptosporidium hominis
PTVYEPLLVDLLTQAMLKLLEPTVIV

SEQ ID NO: 2195526 - protein, 32 aa, Cryptosporidium hominis
PTYKNPFVKGHLFVIINIIFPDKLDSKTQDLV

SEQ ID NO: 2195527 - protein, 18 aa, Cryptosporidium hominis
PTYKQVIWCCFGLLSGEL

SEQ ID NO: 2195528 - protein, 32 aa, Cryptosporidium hominis
PVARFSSVQQFWWLWHNIPQPSELLKGKRMIR

SEQ ID NO: 2195529 - protein, 19 aa, Cryptosporidium hominis
PVDERWISILDLSARPQNL

SEQ ID NO: 2195530 - protein, 24 aa, Cryptosporidium hominis
PVDFCVMVILIRRAVEKSKGRLSV

SEQ ID NO: 2195531 - protein, 25 aa, Cryptosporidium hominis
PVDHVFGFWDWVGGRFSVCSAVGLV

SEQ ID NO: 2195532 - protein, 24 aa, Cryptosporidium hominis
PVDLHMIEILPMKHGLTSETRLVR

SEQ ID NO: 2195533 - protein, 17 aa, Cryptosporidium hominis
PVEIEYLRYFPDDYIDA

SEQ ID NO: 2195534 - protein, 27 aa, Cryptosporidium hominis
PVENDLIVILHLHLKHSIWLGKKKTQD

SEQ ID NO: 2195535 - protein, 28 aa, Cryptosporidium hominis
PVEWKPDVSFLRYGFISPISSNYPISFS

SEQ ID NO: 2195536 - protein, 21 aa, Cryptosporidium hominis
PVFEQQFVLPIKQAELRNAAK

SEQ ID NO: 2195537 - protein, 20 aa, Cryptosporidium hominis
PVGRIQRMLKHRIPGDCRVG

SEQ ID NO: 2195538 - protein, 31 aa, Cryptosporidium hominis
PVHKQYVVYQLIKVIKYLHSGGLLHRDMKPS

SEQ ID NO: 2195539 - protein, 26 aa, Cryptosporidium hominis
PVIMFSPSIINFRRFTFSRMELEPER

SEQ ID NO: 2195540 - protein, 23 aa, Cryptosporidium hominis
PVKKGDAFLVRGGFRPIEFKVVG

SEQ ID NO: 2195541 - protein, 21 aa, Cryptosporidium hominis
PVNHFWNYIFYCRWVLQVTIG

SEQ ID NO: 2195542 - protein, 19 aa, Cryptosporidium hominis
PVQSKFRLTYQMILQLSCR

SEQ ID NO: 2195543 - protein, 17 aa, Cryptosporidium hominis
PVQTMYPPQAYLQNGVY

SEQ ID NO: 2195544 - protein, 28 aa, Cryptosporidium hominis
PVRNQDILMMLPFVDNLVKLGVPGNLLL

SEQ ID NO: 2195545 - protein, 17 aa, Cryptosporidium hominis
PVSLIPFNPETGELFDP

SEQ ID NO: 2195546 - protein, 18 aa, Cryptosporidium hominis
PVTSFSLNLDFSNLAFKP

SEQ ID NO: 2195547 - protein, 20 aa, Cryptosporidium hominis
PVTTSITTAFRYASIEPIIN

SEQ ID NO: 2195548 - protein, 31 aa, Cryptosporidium hominis
PVVENPHYFTLIRFLGLISNTSMAIEWTFED

SEQ ID NO: 2195549 - protein, 24 aa, Cryptosporidium hominis
PVWQVCWAHPTFGSVLASCSYDKK

SEQ ID NO: 2195550 - protein, 19 aa, Cryptosporidium hominis
PWCYDPDYVPWYDSEMKNL

SEQ ID NO: 2195551 - protein, 18 aa, Cryptosporidium hominis
PYCSTYPKGYFAFWVTYD

SEQ ID NO: 2195552 - protein, 21 aa, Cryptosporidium hominis
PYFNNIPLVLKKKETILITGI

SEQ ID NO: 2195553 - protein, 19 aa, Cryptosporidium hominis
PYFNVRKALILLQDAGFIT

SEQ ID NO: 2195554 - protein, 17 aa, Cryptosporidium hominis
PYHLSLNLMLISNLTRY

SEQ ID NO: 2195555 - protein, 20 aa, Cryptosporidium hominis
PYLNKEILDILNSKNLNREE

SEQ ID NO: 2195556 - protein, 20 aa, Cryptosporidium hominis
PYNRPIYSDFMKRTGVLLRK

SEQ ID NO: 2195557 - protein, 31 aa, Cryptosporidium hominis
PYNYKRALCRHWMRGYCWLEADCKFAHGEAE

SEQ ID NO: 2195558 - protein, 33 aa, Cryptosporidium hominis
PYPNGNLIHIGSKLIWKIGFDSYYSIYLNVYDQ

SEQ ID NO: 2195559 - protein, 20 aa, Cryptosporidium hominis
PYQYTLSKILQSRLSFLKEN

SEQ ID NO: 2195560 - protein, 20 aa, Cryptosporidium hominis
PYVMTSLGPIPLPDNVRNQI

SEQ ID NO: 2195561 - protein, 19 aa, Cryptosporidium hominis
PYYGYVRRSINRKPGPADS

SEQ ID NO: 2195562 - protein, 19 aa, Cryptosporidium hominis
QACILLQFNDFISLSLLEL

SEQ ID NO: 2195563 - protein, 24 aa, Cryptosporidium hominis
QADFYYSYIVLFKYLNHCLEKYNN

SEQ ID NO: 2195564 - protein, 23 aa, Cryptosporidium hominis
QAEFDWMILVFLSEEQLPSQDQE

SEQ ID NO: 2195565 - protein, 25 aa, Cryptosporidium hominis
QAEKKLAQAALLYMASKLTTLDETK

SEQ ID NO: 2195566 - protein, 21 aa, Cryptosporidium hominis
QAELRRELNIPLAIKADSEYV

SEQ ID NO: 2195567 - protein, 20 aa, Cryptosporidium hominis
QAESLIRRLLTKSPKQRITS

SEQ ID NO: 2195568 - protein, 17 aa, Cryptosporidium hominis
QAIFRIQSEVCRLLREF

SEQ ID NO: 2195569 - protein, 19 aa, Cryptosporidium hominis
QAISLIFSLYSLFANFEGK

SEQ ID NO: 2195570 - protein, 21 aa, Cryptosporidium hominis
QAKDFLLQLLNKNPSERISAF

SEQ ID NO: 2195571 - protein, 24 aa, Cryptosporidium hominis
QAKNLKNYFMYYGQTGIYSSCFEI

SEQ ID NO: 2195572 - protein, 18 aa, Cryptosporidium hominis
QAKTLPPILRYIDQEGEG

SEQ ID NO: 2195573 - protein, 23 aa, Cryptosporidium hominis
QALRRLMEVYSESTRFALACNQS

SEQ ID NO: 2195574 - protein, 17 aa, Cryptosporidium hominis
QAMHLFTHRKNKGLGLE

SEQ ID NO: 2195575 - protein, 26 aa, Cryptosporidium hominis
QANLNNFRFIFSLATFSVSAPYIQRI

SEQ ID NO: 2195576 - protein, 33 aa, Cryptosporidium hominis
QANPMLNSFLSNPFMNPFGLQVPPMLGQNANLI

SEQ ID NO: 2195577 - protein, 24 aa, Cryptosporidium hominis
QANQLLCSLLERDPCRLNSSGLYS

SEQ ID NO: 2195578 - protein, 26 aa, Cryptosporidium hominis
QAQELNIPTIFALNRHRIGRAMGKHM

SEQ ID NO: 2195579 - protein, 32 aa, Cryptosporidium hominis
QATENLVDTVLKLAKLSILRIESEGGGGGGTG

SEQ ID NO: 2195580 - protein, 31 aa, Cryptosporidium hominis
QATGLLPVDYAYWLTPYNTSIGPTAFVMMQA

SEQ ID NO: 2195581 - protein, 23 aa, Cryptosporidium hominis
QAVDHPYLIVYGKFNHKKDLEYK

SEQ ID NO: 2195582 - protein, 25 aa, Cryptosporidium hominis
QAWDAILTCFFLDTAKNIITYIRTI

SEQ ID NO: 2195583 - protein, 17 aa, Cryptosporidium hominis
QAYFNGFFDLMKDDFGT

SEQ ID NO: 2195584 - protein, 26 aa, Cryptosporidium hominis
QCAALEFAPFILSCPSGYTQSEGKCV

SEQ ID NO: 2195585 - protein, 19 aa, Cryptosporidium hominis
QCATTLRCFCGVGCYKQGF

SEQ ID NO: 2195586 - protein, 23 aa, Cryptosporidium hominis
QCDPLIHIIRRNEKGRWMRLMYE

SEQ ID NO: 2195587 - protein, 26 aa, Cryptosporidium hominis
QCFKNAPLKYIPICEGVLKEVYLELV

SEQ ID NO: 2195588 - protein, 17 aa, Cryptosporidium hominis
QCHLPLELPIIHFLCDH

SEQ ID NO: 2195589 - protein, 20 aa, Cryptosporidium hominis
QCKNVDLFMLKVLENEEKSF

SEQ ID NO: 2195590 - protein, 26 aa, Cryptosporidium hominis
QCLENYPFLNMLGQQPLNNVISGDRI

SEQ ID NO: 2195591 - protein, 17 aa, Cryptosporidium hominis
QCLFFEFLSGKINITMN

SEQ ID NO: 2195592 - protein, 18 aa, Cryptosporidium hominis
QCMWRHYNLKIQLKAEEY

SEQ ID NO: 2195593 - protein, 25 aa, Cryptosporidium hominis
QCSKTEILVLQRITSLLTQNKNRLR

SEQ ID NO: 2195594 - protein, 27 aa, Cryptosporidium hominis
QCTPSVFPLVLTLMEPFKDATTCPKFI

SEQ ID NO: 2195595 - protein, 17 aa, Cryptosporidium hominis
QCWYVCRADPMLCSAAF

SEQ ID NO: 2195596 - protein, 21 aa, Cryptosporidium hominis
QDCIIAFLRKYKEWYNDVVVI

SEQ ID NO: 2195597 - protein, 34 aa, Cryptosporidium hominis
QDDLSALIWTDIRHFAFILFKKNLNVLSTSSGLN

SEQ ID NO: 2195598 - protein, 22 aa, Cryptosporidium hominis
QDEVKYIVRFLQGRLRIGIQQT

SEQ ID NO: 2195599 - protein, 25 aa, Cryptosporidium hominis
QDEVLAHRLGLIPMLIDPNTIEFRN

SEQ ID NO: 2195600 - protein, 26 aa, Cryptosporidium hominis
QDEVPSLDLTPLKELVTKYTQHPLST

SEQ ID NO: 2195601 - protein, 26 aa, Cryptosporidium hominis
QDFRKSIWFPIVDIPLRYEKVSSIIQ

SEQ ID NO: 2195602 - protein, 22 aa, Cryptosporidium hominis
QDFVLIGIFVKKGSITILTSNE

SEQ ID NO: 2195603 - protein, 28 aa, Cryptosporidium hominis
QDIAFDDFPSFPYKYGMAITSLLADGQS

SEQ ID NO: 2195604 - protein, 32 aa, Cryptosporidium hominis
QDKDPFVGYGFLPYIVKMVWEKVRAALEGDLD

SEQ ID NO: 2195605 - protein, 24 aa, Cryptosporidium hominis
QDKKLKSMIWSNGIYMIGPLEVNL

SEQ ID NO: 2195606 - protein, 23 aa, Cryptosporidium hominis
QDKTNLIFGLYNKPNINLIETKL

SEQ ID NO: 2195607 - protein, 19 aa, Cryptosporidium hominis
QDLDLKLLKELFNAVLYLF

SEQ ID NO: 2195608 - protein, 24 aa, Cryptosporidium hominis
QDNILALGCIFHQAGNFRYALELY

SEQ ID NO: 2195609 - protein, 24 aa, Cryptosporidium hominis
QDPLLDVSIPYNSLAPYALTCYQL

SEQ ID NO: 2195610 - protein, 17 aa, Cryptosporidium hominis
QDSFLEEGFILEKKIGV

SEQ ID NO: 2195611 - protein, 22 aa, Cryptosporidium hominis
QDVLSLLSYLVPNSGGDVNCSS

SEQ ID NO: 2195612 - protein, 25 aa, Cryptosporidium hominis
QDYKKYIFDGYFFFAKQGFENKATQ

SEQ ID NO: 2195613 - protein, 25 aa, Cryptosporidium hominis
QDYRYSIIFYQAIPNYSRLTSCYIQ

SEQ ID NO: 2195614 - protein, 25 aa, Cryptosporidium hominis
QECVAYFIQLPIEEPFMRNINPSKN

SEQ ID NO: 2195615 - protein, 29 aa, Cryptosporidium hominis
QEDGTPTALLFIIDNKYMSLFLPENFSYS

SEQ ID NO: 2195616 - protein, 28 aa, Cryptosporidium hominis
QEEFKFWPIEVLSLPNIFKGLIKRKKLV

SEQ ID NO: 2195617 - protein, 22 aa, Cryptosporidium hominis
QEESCIKPIFSSKMITYCWIKY

SEQ ID NO: 2195618 - protein, 25 aa, Cryptosporidium hominis
QEESNLSSLFLKRTSVLKTEKKSEP

SEQ ID NO: 2195619 - protein, 25 aa, Cryptosporidium hominis
QEEYKLEWWLGIIEKLCDKNKSLLI

SEQ ID NO: 2195620 - protein, 24 aa, Cryptosporidium hominis
QEFPKEPMVLLIQSMVRLEELKTH

SEQ ID NO: 2195621 - protein, 31 aa, Cryptosporidium hominis
QEGFVSTFIDYWYRILRFLHKSLETIYMAYY

SEQ ID NO: 2195622 - protein, 20 aa, Cryptosporidium hominis
QEGILALRRVKRRNMERLTL

SEQ ID NO: 2195623 - protein, 33 aa, Cryptosporidium hominis
QEGKNPSSLYSISLLLIIGLALKGNGENETLGS

SEQ ID NO: 2195624 - protein, 29 aa, Cryptosporidium hominis
QEHIQAIELLKYFWGLSLSPKDNDERRKT

SEQ ID NO: 2195625 - protein, 26 aa, Cryptosporidium hominis
QEHPELLNSLLMLTLKPKKSSEMIPK

SEQ ID NO: 2195626 - protein, 18 aa, Cryptosporidium hominis
QEILKTTPIFVSIRIHTE

SEQ ID NO: 2195627 - protein, 24 aa, Cryptosporidium hominis
QEITMYLQKLLSDKGYIATTRDDL

SEQ ID NO: 2195628 - protein, 34 aa, Cryptosporidium hominis
QEKAKYQALILSSQKLLEIIYFEIHFSESNTRNY

SEQ ID NO: 2195629 - protein, 28 aa, Cryptosporidium hominis
QELCILLEIYWRRMQIRFPIFFGGSMTE

SEQ ID NO: 2195630 - protein, 18 aa, Cryptosporidium hominis
QEMDLIYDYSLNIRRAHC

SEQ ID NO: 2195631 - protein, 20 aa, Cryptosporidium hominis
QEMNKICLPALENLLFNSKD

SEQ ID NO: 2195632 - protein, 25 aa, Cryptosporidium hominis
QENKWIPFYKCLTKSFWQNVAKLDP

SEQ ID NO: 2195633 - protein, 27 aa, Cryptosporidium hominis
QEQKHLKLPLKLIKDLFIQVFGTPRYH

SEQ ID NO: 2195634 - protein, 25 aa, Cryptosporidium hominis
QEREHALRLFRSGQRPILVATDVAA

SEQ ID NO: 2195635 - protein, 18 aa, Cryptosporidium hominis
QESFYLLKDSLGTDFDKL

SEQ ID NO: 2195636 - protein, 22 aa, Cryptosporidium hominis
QESYHNFKFISSSNKKTFDMIS

SEQ ID NO: 2195637 - protein, 18 aa, Cryptosporidium hominis
QETRNISVPLTIDELEEK

SEQ ID NO: 2195638 - protein, 33 aa, Cryptosporidium hominis
QEVIEKLWNLIKAKFLQICRKPVYSRGIQSILK

SEQ ID NO: 2195639 - protein, 24 aa, Cryptosporidium hominis
QEVLKNWFIKLPLEYLEQAVSTLQ

SEQ ID NO: 2195640 - protein, 18 aa, Cryptosporidium hominis
QEWKDFLASIEPKDKRYK

SEQ ID NO: 2195641 - protein, 17 aa, Cryptosporidium hominis
QEYLGGGADPPYSPYCL

SEQ ID NO: 2195642 - protein, 20 aa, Cryptosporidium hominis
QEYLSPVAFSLLLDPVSEVR

SEQ ID NO: 2195643 - protein, 18 aa, Cryptosporidium hominis
QFCNECCKFIFTTLHQCP

SEQ ID NO: 2195644 - protein, 24 aa, Cryptosporidium hominis
QFCSFILRKDIFLNSSYSLDCCNF

SEQ ID NO: 2195645 - protein, 24 aa, Cryptosporidium hominis
QFEERLLFYISVYGFEELGFKCIY

SEQ ID NO: 2195646 - protein, 17 aa, Cryptosporidium hominis
QFESTEFCRLLLSPNST

SEQ ID NO: 2195647 - protein, 17 aa, Cryptosporidium hominis
QFEYNLCEIKRVISIAE

SEQ ID NO: 2195648 - protein, 26 aa, Cryptosporidium hominis
QFFNSKLKFPAIRKLPMAPKALRSTF

SEQ ID NO: 2195649 - protein, 30 aa, Cryptosporidium hominis
QFGGLRPFGVSFLFAGYDKNYGYQLYQSDP

SEQ ID NO: 2195650 - protein, 18 aa, Cryptosporidium hominis
QFGTWVFQLVESSKNDYS

SEQ ID NO: 2195651 - protein, 29 aa, Cryptosporidium hominis
QFHYDCYKALYFLLIAKRLIGESIERILF

SEQ ID NO: 2195652 - protein, 21 aa, Cryptosporidium hominis
QFIVTTFRPQILQIADKYFQV

SEQ ID NO: 2195653 - protein, 24 aa, Cryptosporidium hominis
QFKAVTSLLWPFKLSSPNGGFVRK

SEQ ID NO: 2195654 - protein, 32 aa, Cryptosporidium hominis
QFKHSTIPITKKKLCWYFISGKCSKSDCQYSH

SEQ ID NO: 2195655 - protein, 22 aa, Cryptosporidium hominis
QFNGRRIFARLALNRTEIANIE

SEQ ID NO: 2195656 - protein, 19 aa, Cryptosporidium hominis
QFNQTYFDFWSCGKLLYLM

SEQ ID NO: 2195657 - protein, 19 aa, Cryptosporidium hominis
QFNWDSLRSISRKEREHYL

SEQ ID NO: 2195658 - protein, 18 aa, Cryptosporidium hominis
QFPAFFAVFTREFENAVV

SEQ ID NO: 2195659 - protein, 29 aa, Cryptosporidium hominis
QFPTEFQFHPNLLIIIADHLNNSLFGNFH

SEQ ID NO: 2195660 - protein, 19 aa, Cryptosporidium hominis
QFRFNYSKEFLRWALCVPG

SEQ ID NO: 2195661 - protein, 34 aa, Cryptosporidium hominis
QFRQKGIFLHIMSHPWLLAINNLTNIDIELGKGW

SEQ ID NO: 2195662 - protein, 18 aa, Cryptosporidium hominis
QFSFRWMNCLLTREFPTK

SEQ ID NO: 2195663 - protein, 31 aa, Cryptosporidium hominis
QFSSFVCQYYLLIVDLLLLGLTRANQIAGSP

SEQ ID NO: 2195664 - protein, 35 aa, Cryptosporidium hominis
QFYEIPLNIEILGWTNLLHFVEAFPDVWTVENVGP

SEQ ID NO: 2195665 - protein, 29 aa, Cryptosporidium hominis
QGATTMIHGITPFYYGISGLSEVQPVNLQ

SEQ ID NO: 2195666 - protein, 21 aa, Cryptosporidium hominis
QGAVWGVAWHPLGHLVVSSGQ

SEQ ID NO: 2195667 - protein, 27 aa, Cryptosporidium hominis
QGDKNSALLVLRRKKLVTQEREKLLSS

SEQ ID NO: 2195668 - protein, 20 aa, Cryptosporidium hominis
QGDYLLSIKTTSDGKFVAFP

SEQ ID NO: 2195669 - protein, 17 aa, Cryptosporidium hominis
QGFAQLRRFYEVRGMSP

SEQ ID NO: 2195670 - protein, 19 aa, Cryptosporidium hominis
QGFDPTEWCNLGSGINTMV

SEQ ID NO: 2195671 - protein, 22 aa, Cryptosporidium hominis
QGGIYLLFSIKDDPKFFSQLVL

SEQ ID NO: 2195672 - protein, 20 aa, Cryptosporidium hominis
QGHPFVKCRLCFLVKKDHCI

SEQ ID NO: 2195673 - protein, 20 aa, Cryptosporidium hominis
QGIFMIIRYYLNMNQDSQSE

SEQ ID NO: 2195674 - protein, 26 aa, Cryptosporidium hominis
QGKITIEQWLLSSLKQSERYILYAEA

SEQ ID NO: 2195675 - protein, 37 aa, Cryptosporidium hominis
QGKKSNLLQFLWIRFYGFRVIFRKFNDLLLTSVPKNV

SEQ ID NO: 2195676 - protein, 26 aa, Cryptosporidium hominis
QGKNMETVGTCLFFADTEPTNKDPSD

SEQ ID NO: 2195677 - protein, 19 aa, Cryptosporidium hominis
QGKPWIWGLSFSGIDHHNV

SEQ ID NO: 2195678 - protein, 17 aa, Cryptosporidium hominis
QGLIGRYNSMCMDDQIL

SEQ ID NO: 2195679 - protein, 17 aa, Cryptosporidium hominis
QGNLFWIDSNIAYYSPK

SEQ ID NO: 2195680 - protein, 21 aa, Cryptosporidium hominis
QGNLLVLMIATPSRSSIKWEK

SEQ ID NO: 2195681 - protein, 23 aa, Cryptosporidium hominis
QGNLVLRYLYRHLGFGLQIEPKY

SEQ ID NO: 2195682 - protein, 23 aa, Cryptosporidium hominis
QGNNDIIWVHRNNFRFLLEKSCE

SEQ ID NO: 2195683 - protein, 24 aa, Cryptosporidium hominis
QGNTPLLTGQRILDALFPSVQGGT

SEQ ID NO: 2195684 - protein, 26 aa, Cryptosporidium hominis
QGNVAYWLYMPAISHIIDCNGKLIFG

SEQ ID NO: 2195685 - protein, 24 aa, Cryptosporidium hominis
QGQEHFVQHLLKNNLPQGGCSQTG

SEQ ID NO: 2195686 - protein, 24 aa, Cryptosporidium hominis
QGQNKLIVSIIGPVPISGNINYTN

SEQ ID NO: 2195687 - protein, 19 aa, Cryptosporidium hominis
QGSAIVFLISMASRKYTLG

SEQ ID NO: 2195688 - protein, 29 aa, Cryptosporidium hominis
QGSRDYLGGFRRSCLFELLSLSVSRGYIV

SEQ ID NO: 2195689 - protein, 22 aa, Cryptosporidium hominis
QGTSWRTVWPNSNLMSNGGIGD

SEQ ID NO: 2195690 - protein, 19 aa, Cryptosporidium hominis
QGVFRACCPSGASTGIYEA

SEQ ID NO: 2195691 - protein, 25 aa, Cryptosporidium hominis
QGYKYIDIYNFLRDRLRAVWQDLTV

SEQ ID NO: 2195692 - protein, 31 aa, Cryptosporidium hominis
QHDFESTILSRFDLIFLLKDEKNVERDKLIA

SEQ ID NO: 2195693 - protein, 18 aa, Cryptosporidium hominis
QHDSKILIFGKPDKCEVA

SEQ ID NO: 2195694 - protein, 42 aa, Cryptosporidium hominis
QHEIMVPLGPLAFSPGYIINTNKVLMLLGSDLYAERTTFESQ

SEQ ID NO: 2195695 - protein, 28 aa, Cryptosporidium hominis
QHFSTNPKLWMFYLSAKAESIKDITSHF

SEQ ID NO: 2195696 - protein, 20 aa, Cryptosporidium hominis
QHHFIPMYVELCDKLRDHLK

SEQ ID NO: 2195697 - protein, 20 aa, Cryptosporidium hominis
QHIMVALDMLMRIYNNREFP

SEQ ID NO: 2195698 - protein, 21 aa, Cryptosporidium hominis
QHNGTWFLTIFPAGVNCDGDM

SEQ ID NO: 2195699 - protein, 31 aa, Cryptosporidium hominis
QHNSGIGTKLLNSFIPWMGTCGTQPSAGQNT

SEQ ID NO: 2195700 - protein, 18 aa, Cryptosporidium hominis
QHSLFEIIFEQFGFNKAI

SEQ ID NO: 2195701 - protein, 40 aa, Cryptosporidium hominis
QHTGGKLRLFTEFPFEKIYRDIYQTLYSIFFVQNVAYDCT

SEQ ID NO: 2195702 - protein, 18 aa, Cryptosporidium hominis
QHVLRNYDILWSPSSASV

SEQ ID NO: 2195703 - protein, 23 aa, Cryptosporidium hominis
QIAEIPLDLTDEYLAKWLDGKNA

SEQ ID NO: 2195704 - protein, 25 aa, Cryptosporidium hominis
QIALNRLSCIFQPRKFQCNFESDII

SEQ ID NO: 2195705 - protein, 35 aa, Cryptosporidium hominis
QICISLIHQLNFNGTITFIWIMLGLCSSLSNQELI

SEQ ID NO: 2195706 - protein, 18 aa, Cryptosporidium hominis
QICLIFNVECNDVYFGVP

SEQ ID NO: 2195707 - protein, 20 aa, Cryptosporidium hominis
QICPVCHGFVKYIADFEYGE

SEQ ID NO: 2195708 - protein, 25 aa, Cryptosporidium hominis
QIEDRYLINYTYQYGYGSWDQILSA

SEQ ID NO: 2195709 - protein, 19 aa, Cryptosporidium hominis
QIEDYILRTARNHGYSPYR

SEQ ID NO: 2195710 - protein, 25 aa, Cryptosporidium hominis
QIENSKFFFLGIKVDKDKLDTLLKS

SEQ ID NO: 2195711 - protein, 21 aa, Cryptosporidium hominis
QIEREDIVAFLLFNADEILVD

SEQ ID NO: 2195712 - protein, 29 aa, Cryptosporidium hominis
QIESFTRVLIGFIRLHKLVFPIGTNATAI

SEQ ID NO: 2195713 - protein, 19 aa, Cryptosporidium hominis
QIFNSINYLMQIVGDGNMN

SEQ ID NO: 2195714 - protein, 18 aa, Cryptosporidium hominis
QIGGIIPAVGFNSSNANA

SEQ ID NO: 2195715 - protein, 18 aa, Cryptosporidium hominis
QIGKKELLAWGSSLLGEE

SEQ ID NO: 2195716 - protein, 23 aa, Cryptosporidium hominis
QIGKSIEFDLIISKSIQSNIRFQ

SEQ ID NO: 2195717 - protein, 24 aa, Cryptosporidium hominis
QIGVFPILLTHFYTKIFNNMKNGI

SEQ ID NO: 2195718 - protein, 17 aa, Cryptosporidium hominis
QIGYRVRYHNSYVGWVA

SEQ ID NO: 2195719 - protein, 18 aa, Cryptosporidium hominis
QIIAFKMEFHKLSGSKLA

SEQ ID NO: 2195720 - protein, 17 aa, Cryptosporidium hominis
QIIKFRPFKENCSSIGS

SEQ ID NO: 2195721 - protein, 30 aa, Cryptosporidium hominis
QIILDLMERVLFLWAIRNPASGYVQGINDL

SEQ ID NO: 2195722 - protein, 22 aa, Cryptosporidium hominis
QIISRVLGFLQDQFPRVRYACC

SEQ ID NO: 2195723 - protein, 22 aa, Cryptosporidium hominis
QIITQIYWSFKKITLKVLISYM

SEQ ID NO: 2195724 - protein, 24 aa, Cryptosporidium hominis
QIKELCSDFESFPELLVVSKYQSE

SEQ ID NO: 2195725 - protein, 39 aa, Cryptosporidium hominis
QIKKNNRYLLKIARFEEAFITIIPTLKGYYRSCGNDVNI

SEQ ID NO: 2195726 - protein, 25 aa, Cryptosporidium hominis
QIKSKGLQKLRWYCQLCEKQCRDEN

SEQ ID NO: 2195727 - protein, 20 aa, Cryptosporidium hominis
QILEKLLDVLVISSSLEKAF

SEQ ID NO: 2195728 - protein, 17 aa, Cryptosporidium hominis
QILFDGRLPKENPFNKL

SEQ ID NO: 2195729 - protein, 32 aa, Cryptosporidium hominis
QILSNSLELVKSMHIPVFPPYQSKNDINFNKT

SEQ ID NO: 2195730 - protein, 28 aa, Cryptosporidium hominis
QINFNGDFLLNLLIKFGILRSDASDLHS

SEQ ID NO: 2195731 - protein, 25 aa, Cryptosporidium hominis
QINNDQIILPNRNINITLNSASVLP

SEQ ID NO: 2195732 - protein, 19 aa, Cryptosporidium hominis
QINPIFKKKSQIFQHRGNI

SEQ ID NO: 2195733 - protein, 26 aa, Cryptosporidium hominis
QINPQAQYLPLNPTIGQLTNYIQSWK

SEQ ID NO: 2195734 - protein, 21 aa, Cryptosporidium hominis
QINSFIDLKWILDSTISAKLK

SEQ ID NO: 2195735 - protein, 26 aa, Cryptosporidium hominis
QIPNEKLFEWFIKKESINSKKVTMIN

SEQ ID NO: 2195736 - protein, 18 aa, Cryptosporidium hominis
QIQENHMRLGAWQSSINQ

SEQ ID NO: 2195737 - protein, 20 aa, Cryptosporidium hominis
QIQILNLDLQYLKEENSRLK

SEQ ID NO: 2195738 - protein, 20 aa, Cryptosporidium hominis
QIQKILIFGIPTVIKELICS

SEQ ID NO: 2195739 - protein, 24 aa, Cryptosporidium hominis
QIRKRLFEIIKMENIPYVDSGIDT

SEQ ID NO: 2195740 - protein, 17 aa, Cryptosporidium hominis
QIRMLRERIIVLSTNIE

SEQ ID NO: 2195741 - protein, 30 aa, Cryptosporidium hominis
QIRNSNKLRLILKAFLLLGNYVNHGINFST

SEQ ID NO: 2195742 - protein, 17 aa, Cryptosporidium hominis
QISLYFLNQIDSSHLTL

SEQ ID NO: 2195743 - protein, 31 aa, Cryptosporidium hominis
QISMLKSLRRYYVSPLLKKIALTVIARYCPD

SEQ ID NO: 2195744 - protein, 18 aa, Cryptosporidium hominis
QIVPKRSNLSLSSPIIDI

SEQ ID NO: 2195745 - protein, 34 aa, Cryptosporidium hominis
QIVVTDFYLIVNAKYRLIIWKRTFLPQFQNRNQR

SEQ ID NO: 2195746 - protein, 26 aa, Cryptosporidium hominis
QIWYNRLMWVLKHEIIISILSLSQID

SEQ ID NO: 2195747 - protein, 26 aa, Cryptosporidium hominis
QIYNNFLKIIVPYNPYIYEVIKNVIF

SEQ ID NO: 2195748 - protein, 26 aa, Cryptosporidium hominis
QKAYDFLLETLLLKVISEYSSNKALL

SEQ ID NO: 2195749 - protein, 20 aa, Cryptosporidium hominis
QKDLISRLIRLLIMFNNKKN

SEQ ID NO: 2195750 - protein, 26 aa, Cryptosporidium hominis
QKDNFKAGLLFYKKKYHEVVTPSLLK

SEQ ID NO: 2195751 - protein, 28 aa, Cryptosporidium hominis
QKDTILWDLLTLLIYLDSMNPQIWDRRA

SEQ ID NO: 2195752 - protein, 22 aa, Cryptosporidium hominis
QKDVIDLYRKVINGIITGFEIA

SEQ ID NO: 2195753 - protein, 26 aa, Cryptosporidium hominis
QKEDILDFIDIYSLSSYFMGLTKIEG

SEQ ID NO: 2195754 - protein, 28 aa, Cryptosporidium hominis
QKEKMFLLIKLISKIYYYDTQLKEKLQE

SEQ ID NO: 2195755 - protein, 26 aa, Cryptosporidium hominis
QKFQFYPKYILIGHEAIIWSIDTLWE

SEQ ID NO: 2195756 - protein, 18 aa, Cryptosporidium hominis
QKGFGGFGGILRYKVDFQ

SEQ ID NO: 2195757 - protein, 23 aa, Cryptosporidium hominis
QKGGLLFNPKFIHKVPATEMEAL

SEQ ID NO: 2195758 - protein, 27 aa, Cryptosporidium hominis
QKIAQFEILCLSILLLNIYMQSNWTGP

SEQ ID NO: 2195759 - protein, 20 aa, Cryptosporidium hominis
QKIFELINWISEKDPTHEDC

SEQ ID NO: 2195760 - protein, 34 aa, Cryptosporidium hominis
QKIIVKRNVARVRPFILCAILRDLSFNEDIYRSF

SEQ ID NO: 2195761 - protein, 35 aa, Cryptosporidium hominis
QKIKDIPHRFFLNQVKLLQIKYSYKNLTSISARRT

SEQ ID NO: 2195762 - protein, 23 aa, Cryptosporidium hominis
QKKESRYPIFTEERARLLKLDKT

SEQ ID NO: 2195763 - protein, 25 aa, Cryptosporidium hominis
QKLAPKAFCWLLCDSCNQLLMLLNG

SEQ ID NO: 2195764 - protein, 29 aa, Cryptosporidium hominis
QKLDLRAKQKFEYNRRFSREKAGNFRFQN

SEQ ID NO: 2195765 - protein, 20 aa, Cryptosporidium hominis
QKMFTPQILISTISLPKEER

SEQ ID NO: 2195766 - protein, 40 aa, Cryptosporidium hominis
QKNESILLDNPFRWVLFPIKYSRLWSLYKKYEVSFWTAEV

SEQ ID NO: 2195767 - protein, 25 aa, Cryptosporidium hominis
QKNTPFFELSWIPGLAEDKTGQVKL

SEQ ID NO: 2195768 - protein, 20 aa, Cryptosporidium hominis
QKNWFIWRDKQNRSFKDCRD

SEQ ID NO: 2195769 - protein, 20 aa, Cryptosporidium hominis
QKQITPWQAYLEKRKQKRKE

SEQ ID NO: 2195770 - protein, 22 aa, Cryptosporidium hominis
QKQYSCPLCMTSTYYKNDIKMY

SEQ ID NO: 2195771 - protein, 22 aa, Cryptosporidium hominis
QKRAAMVWLDKKRYKYFETIHD

SEQ ID NO: 2195772 - protein, 29 aa, Cryptosporidium hominis
QKRLPDWAKRFHRILKVISQQEAFSPFVS

SEQ ID NO: 2195773 - protein, 31 aa, Cryptosporidium hominis
QKRNLKFEVGFLPAPLSLISSASTLGNYEFK

SEQ ID NO: 2195774 - protein, 18 aa, Cryptosporidium hominis
QKSFSVNKYGFYEAKRLA

SEQ ID NO: 2195775 - protein, 18 aa, Cryptosporidium hominis
QKSIIEQKLFVAVLTPSN

SEQ ID NO: 2195776 - protein, 31 aa, Cryptosporidium hominis
QKSLEDWYKAHYYDYYFKAYKTNGLDDATSS

SEQ ID NO: 2195777 - protein, 32 aa, Cryptosporidium hominis
QKSPYYDRFSLRLPIIMLFESLLKVDLHRERL

SEQ ID NO: 2195778 - protein, 27 aa, Cryptosporidium hominis
QKTLKCCFEWFKTFKIMESDGVVCDDV

SEQ ID NO: 2195779 - protein, 26 aa, Cryptosporidium hominis
QKTNIKTVLLFLIDFVKRLYNQHIGE

SEQ ID NO: 2195780 - protein, 22 aa, Cryptosporidium hominis
QKVYRQVPYYKDVEVPFVVPRY

SEQ ID NO: 2195781 - protein, 17 aa, Cryptosporidium hominis
QKYLVDMAAYRTTSGSP

SEQ ID NO: 2195782 - protein, 17 aa, Cryptosporidium hominis
QKYRIRVEMFHSSHLRY

SEQ ID NO: 2195783 - protein, 23 aa, Cryptosporidium hominis
QKYRLMRSIGVENVIYLLEDLNS

SEQ ID NO: 2195784 - protein, 19 aa, Cryptosporidium hominis
QLALYNQMAMAMYSPILAG

SEQ ID NO: 2195785 - protein, 18 aa, Cryptosporidium hominis
QLAQLFASAQIRIEDINN

SEQ ID NO: 2195786 - protein, 32 aa, Cryptosporidium hominis
QLCHELVHHYIPLLPNFLVDSALSFIKSTIND

SEQ ID NO: 2195787 - protein, 19 aa, Cryptosporidium hominis
QLDSNLSIAYLKLQDYPNA

SEQ ID NO: 2195788 - protein, 31 aa, Cryptosporidium hominis
QLEDMGPTKLYRYLDLLPYDKRLNIKKSSIH

SEQ ID NO: 2195789 - protein, 19 aa, Cryptosporidium hominis
QLEFNQVIIFVKSVSRAQA

SEQ ID NO: 2195790 - protein, 26 aa, Cryptosporidium hominis
QLEKQYKQELLRRSDLEELKRTIKDQ

SEQ ID NO: 2195791 - protein, 25 aa, Cryptosporidium hominis
QLEKRYAALFALRNILTGIIDSNQR

SEQ ID NO: 2195792 - protein, 23 aa, Cryptosporidium hominis
QLENDFLLLDGILNYGIAIHNSK

SEQ ID NO: 2195793 - protein, 30 aa, Cryptosporidium hominis
QLEQSRLLLCFLTKQILLKGLDLLGVETLE

SEQ ID NO: 2195794 - protein, 17 aa, Cryptosporidium hominis
QLFCGFFLSRIVCHNCQ

SEQ ID NO: 2195795 - protein, 18 aa, Cryptosporidium hominis
QLFGFLGGLDGLFKSTYK

SEQ ID NO: 2195796 - protein, 21 aa, Cryptosporidium hominis
QLFKPTIFITVPRVLNRIHDK

SEQ ID NO: 2195797 - protein, 29 aa, Cryptosporidium hominis
QLGPAYRLTVIKIVPWITQLDAIPINRSG

SEQ ID NO: 2195798 - protein, 25 aa, Cryptosporidium hominis
QLGTLYRLSMQILPILLENNSYYLF

SEQ ID NO: 2195799 - protein, 20 aa, Cryptosporidium hominis
QLHAHLFQQDPIYRNPNQLL

SEQ ID NO: 2195800 - protein, 18 aa, Cryptosporidium hominis
QLIIEKILKKNGSMNWKK

SEQ ID NO: 2195801 - protein, 31 aa, Cryptosporidium hominis
QLILPDSLKLTLIYVSSLFKHPSLMPLNTVL

SEQ ID NO: 2195802 - protein, 21 aa, Cryptosporidium hominis
QLKEYFSQFGKILRIKLSRSK

SEQ ID NO: 2195803 - protein, 19 aa, Cryptosporidium hominis
QLKPLVRIQAQLRRVLDIE

SEQ ID NO: 2195804 - protein, 28 aa, Cryptosporidium hominis
QLKRNILECLIPVKFRLGFIPNISLLKK

SEQ ID NO: 2195805 - protein, 27 aa, Cryptosporidium hominis
QLLEAVYLRYKLRREFRKNQLKPLVRI

SEQ ID NO: 2195806 - protein, 24 aa, Cryptosporidium hominis
QLLEDEYFIVYEKNKQIGQELEEE

SEQ ID NO: 2195807 - protein, 27 aa, Cryptosporidium hominis
QLLKDENFIIFQNYIKLIPITNKIIYN

SEQ ID NO: 2195808 - protein, 17 aa, Cryptosporidium hominis
QLLKYYKNQVKSDYILS

SEQ ID NO: 2195809 - protein, 19 aa, Cryptosporidium hominis
QLLLTLVYGNDWVPMAIIE

SEQ ID NO: 2195810 - protein, 21 aa, Cryptosporidium hominis
QLLQYSRFILSKKISLCIKSL

SEQ ID NO: 2195811 - protein, 23 aa, Cryptosporidium hominis
QLMPSIPGVYFDRRQIGYRVRYH

SEQ ID NO: 2195812 - protein, 18 aa, Cryptosporidium hominis
QLMQAYPQNRFVSKKKCR

SEQ ID NO: 2195813 - protein, 20 aa, Cryptosporidium hominis
QLMSNHRLMALLKSIAIVGT

SEQ ID NO: 2195814 - protein, 28 aa, Cryptosporidium hominis
QLNEIGPRFILRLYKIELGTLEMKNLSI

SEQ ID NO: 2195815 - protein, 25 aa, Cryptosporidium hominis
QLNEKVINTTFFNSNPTLIGNSVEK

SEQ ID NO: 2195816 - protein, 17 aa, Cryptosporidium hominis
QLNLIEAILYKLGEFYQ

SEQ ID NO: 2195817 - protein, 24 aa, Cryptosporidium hominis
QLNVNNSHFLIMQGRITKVINMKP

SEQ ID NO: 2195818 - protein, 18 aa, Cryptosporidium hominis
QLPTFYSLKIRINNTNPN

SEQ ID NO: 2195819 - protein, 17 aa, Cryptosporidium hominis
QLPYLVANIVESLDFSD

SEQ ID NO: 2195820 - protein, 21 aa, Cryptosporidium hominis
QLQFVPQRYLRRGIFSSVDLS

SEQ ID NO: 2195821 - protein, 18 aa, Cryptosporidium hominis
QLRELGEPICYFGEDQYR

SEQ ID NO: 2195822 - protein, 17 aa, Cryptosporidium hominis
QLRQFTGLEGTDFNLKE

SEQ ID NO: 2195823 - protein, 17 aa, Cryptosporidium hominis
QLSAVVVLAAAKAAEAA

SEQ ID NO: 2195824 - protein, 25 aa, Cryptosporidium hominis
QLSKLNLMDDWIRSISFTETNKRFI

SEQ ID NO: 2195825 - protein, 24 aa, Cryptosporidium hominis
QLSYQAYSPFIPSINPFMMPIFPS

SEQ ID NO: 2195826 - protein, 24 aa, Cryptosporidium hominis
QLTALINVPHWLKPASNKQEFLLE

SEQ ID NO: 2195827 - protein, 19 aa, Cryptosporidium hominis
QLTALTNLVNKFEKNKMIK

SEQ ID NO: 2195828 - protein, 22 aa, Cryptosporidium hominis
QLTPQLAAFLGNPNLIPTKDTG

SEQ ID NO: 2195829 - protein, 27 aa, Cryptosporidium hominis
QLTQLPVILGIPLKQIDFLDLLSQINK

SEQ ID NO: 2195830 - protein, 31 aa, Cryptosporidium hominis
QLVQGMTVSQLYYLIGHMQKLVVQNPETARS

SEQ ID NO: 2195831 - protein, 20 aa, Cryptosporidium hominis
QLVRQLIASSKFNANATNEK

SEQ ID NO: 2195832 - protein, 20 aa, Cryptosporidium hominis
QLVYMGIIGLLLDVLKQNDL

SEQ ID NO: 2195833 - protein, 18 aa, Cryptosporidium hominis
QLYHPLMYKTKECSLYPN

SEQ ID NO: 2195834 - protein, 21 aa, Cryptosporidium hominis
QLYSIITKYLLPDIHFAGKTI

SEQ ID NO: 2195835 - protein, 17 aa, Cryptosporidium hominis
QLYSTYGFPMDLTELMA

SEQ ID NO: 2195836 - protein, 40 aa, Cryptosporidium hominis
QMCDRFIRDIPRGFFYAYFLNPLILLASDPIRNVRSTWLR

SEQ ID NO: 2195837 - protein, 24 aa, Cryptosporidium hominis
QMDSNFFLIGITSLDIFPTNNHEY

SEQ ID NO: 2195838 - protein, 23 aa, Cryptosporidium hominis
QMEWYLCHSFLKNIESIPNKISE

SEQ ID NO: 2195839 - protein, 33 aa, Cryptosporidium hominis
QMIHGLVRFVTLYNQFQFWTQVRRFRPIERPGS

SEQ ID NO: 2195840 - protein, 27 aa, Cryptosporidium hominis
QMIKLCSSFRRMLKLYVASCYYFGDIS

SEQ ID NO: 2195841 - protein, 18 aa, Cryptosporidium hominis
QMLICGIPSYLILQFFDK

SEQ ID NO: 2195842 - protein, 28 aa, Cryptosporidium hominis
QMNISFKEAFLSEKWNLNSNLNSGTRGL

SEQ ID NO: 2195843 - protein, 40 aa, Cryptosporidium hominis
QMNLQRQLWDPLPMSPGNPLMMTYLQNQWILTPTIQTQEM

SEQ ID NO: 2195844 - protein, 18 aa, Cryptosporidium hominis
QMNMLWSSVITPIVSPEH

SEQ ID NO: 2195845 - protein, 18 aa, Cryptosporidium hominis
QMNMNMFGRYYGMTIPQG

SEQ ID NO: 2195846 - protein, 19 aa, Cryptosporidium hominis
QMQRAGGLHPGFQPVLHHL

SEQ ID NO: 2195847 - protein, 18 aa, Cryptosporidium hominis
QMRLLFEPQRLTIHDVYS

SEQ ID NO: 2195848 - protein, 23 aa, Cryptosporidium hominis
QMSGRDLFVYDPSLFVDDEDAAG

SEQ ID NO: 2195849 - protein, 20 aa, Cryptosporidium hominis
QMVVNTWLLEHGFTVGCQDI

SEQ ID NO: 2195850 - protein, 24 aa, Cryptosporidium hominis
QNCDILPYYIEYYRFQNVAFQRVV

SEQ ID NO: 2195851 - protein, 29 aa, Cryptosporidium hominis
QNDIVNLRRQLESYIKKYEIAKTDYQNLR

SEQ ID NO: 2195852 - protein, 22 aa, Cryptosporidium hominis
QNDVIVMLLACRKLEKQIEEQQ

SEQ ID NO: 2195853 - protein, 21 aa, Cryptosporidium hominis
QNFIQAKYLNWFDQESFRSLD

SEQ ID NO: 2195854 - protein, 24 aa, Cryptosporidium hominis
QNFRLNIEDAPPVDYIARFTAQQQ

SEQ ID NO: 2195855 - protein, 27 aa, Cryptosporidium hominis
QNGILDKIIILHKLAIEIELTKIVYLY

SEQ ID NO: 2195856 - protein, 20 aa, Cryptosporidium hominis
QNHLHFENRLKDLVLRISSD

SEQ ID NO: 2195857 - protein, 35 aa, Cryptosporidium hominis
QNIHSIKPCFYLFITDWIQTILTPILAINNITYNS

SEQ ID NO: 2195858 - protein, 23 aa, Cryptosporidium hominis
QNKCYWLVGFKEERWKKLIPVQV

SEQ ID NO: 2195859 - protein, 25 aa, Cryptosporidium hominis
QNLIKIIKFVIILKSYQKLDLHLKR

SEQ ID NO: 2195860 - protein, 24 aa, Cryptosporidium hominis
QNLNSIILNMFELLCNLITERNDC

SEQ ID NO: 2195861 - protein, 52 aa, Cryptosporidium hominis
QNMQIPVPMPMQMPIPAHLPTPMPMPMPVPMPMPMQMPMPMPMVAPGPIQIP

SEQ ID NO: 2195862 - protein, 17 aa, Cryptosporidium hominis
QNMVFDETSRFLIYTCM

SEQ ID NO: 2195863 - protein, 21 aa, Cryptosporidium hominis
QNNDWINHLGLVSELRNYQKD

SEQ ID NO: 2195864 - protein, 29 aa, Cryptosporidium hominis
QNNIPIFNNYKFVISPNIKVPSISEISWL

SEQ ID NO: 2195865 - protein, 27 aa, Cryptosporidium hominis
QNNLRELWSLLNFLMPNLFSSSEDFES

SEQ ID NO: 2195866 - protein, 27 aa, Cryptosporidium hominis
QNNQIELPFSFSYWPLDAGNGYTNVTI

SEQ ID NO: 2195867 - protein, 29 aa, Cryptosporidium hominis
QNNTEELWPLLNYIEPIKFASIEAFTQEF

SEQ ID NO: 2195868 - protein, 23 aa, Cryptosporidium hominis
QNQFISQLMANPLFQPQAIASQS

SEQ ID NO: 2195869 - protein, 17 aa, Cryptosporidium hominis
QNQLLISSLSITSKIMR

SEQ ID NO: 2195870 - protein, 24 aa, Cryptosporidium hominis
QNQLPRKLLRIATRPFHKIFSISV

SEQ ID NO: 2195871 - protein, 25 aa, Cryptosporidium hominis
QNQQKFNFIIPNINKMDTILLNNQL

SEQ ID NO: 2195872 - protein, 23 aa, Cryptosporidium hominis
QNRNPYLDFFGNKKVCLLGDEEY

SEQ ID NO: 2195873 - protein, 25 aa, Cryptosporidium hominis
QNRRGFIRLWKPLEKIIGYMEKNLP

SEQ ID NO: 2195874 - protein, 24 aa, Cryptosporidium hominis
QNSDKIFYSFFDLSIIESQQKLPT

SEQ ID NO: 2195875 - protein, 29 aa, Cryptosporidium hominis
QNSDLIIDFPLFIKLVEYRIIKGTSQILR

SEQ ID NO: 2195876 - protein, 24 aa, Cryptosporidium hominis
QNSELYINFVFSTKIPPHLEHVNG

SEQ ID NO: 2195877 - protein, 27 aa, Cryptosporidium hominis
QNSLRELWSLLNFLYPEIFSSSEEFEA

SEQ ID NO: 2195878 - protein, 25 aa, Cryptosporidium hominis
QNSRSNQFCFIPNGLEIVGYNSTEL

SEQ ID NO: 2195879 - protein, 23 aa, Cryptosporidium hominis
QNSVRKPRKFSQDGGFRGKKQSW

SEQ ID NO: 2195880 - protein, 52 aa, Cryptosporidium hominis
QNTCPACDKIYKRDWQQVCLDWIYCDLCNNWYHWYCLGLHKDNIPSENEPFH

SEQ ID NO: 2195881 - protein, 22 aa, Cryptosporidium hominis
QNVDILYICEFCLSFFAHSDEY

SEQ ID NO: 2195882 - protein, 18 aa, Cryptosporidium hominis
QNYLNPKSDILQAERRLN

SEQ ID NO: 2195883 - protein, 47 aa, Cryptosporidium hominis
QPAIVDTPMSPRTAKWVRELTPVLEPYNFNLNEISDLIHRCHYDANQ

SEQ ID NO: 2195884 - protein, 25 aa, Cryptosporidium hominis
QPDKDLIIKWPKYDKLFIGNWIDTD

SEQ ID NO: 2195885 - protein, 24 aa, Cryptosporidium hominis
QPEIETLLLALQPCCVNLSKVFLG

SEQ ID NO: 2195886 - protein, 24 aa, Cryptosporidium hominis
QPEKQIYRPKWASSGFAERMRAAR

SEQ ID NO: 2195887 - protein, 20 aa, Cryptosporidium hominis
QPHDIEKIYLSWKGINPPET

SEQ ID NO: 2195888 - protein, 36 aa, Cryptosporidium hominis
QPHSPNPMGLQPFPMHSILLPTLLQAQIQAQMRQPS

SEQ ID NO: 2195889 - protein, 28 aa, Cryptosporidium hominis
QPIDTSNWPLLLKNYSKLNVRTGHYTPL

SEQ ID NO: 2195890 - protein, 22 aa, Cryptosporidium hominis
QPKGFFHELFKRQTKSEAEEDK

SEQ ID NO: 2195891 - protein, 23 aa, Cryptosporidium hominis
QPKGVLLYGPPGTGKTLLARAVA

SEQ ID NO: 2195892 - protein, 26 aa, Cryptosporidium hominis
QPKHFVNPRILLLNLELELKAEKDNA

SEQ ID NO: 2195893 - protein, 17 aa, Cryptosporidium hominis
QPKRWVFCPCRSCLFKG

SEQ ID NO: 2195894 - protein, 18 aa, Cryptosporidium hominis
QPLSNYLSLIKSDVSRIF

SEQ ID NO: 2195895 - protein, 17 aa, Cryptosporidium hominis
QPRILVKNLILNIEIDE

SEQ ID NO: 2195896 - protein, 22 aa, Cryptosporidium hominis
QPSPFGGVLNDGFWNHSHNSVA

SEQ ID NO: 2195897 - protein, 18 aa, Cryptosporidium hominis
QPTFKRKSIVNSPKVFAC

SEQ ID NO: 2195898 - protein, 31 aa, Cryptosporidium hominis
QQAGQDFNGAQVYFGAVQTPSQTTYGKFGVK

SEQ ID NO: 2195899 - protein, 27 aa, Cryptosporidium hominis
QQALKHPWLVDSFKYNPIGPIYKQILC

SEQ ID NO: 2195900 - protein, 25 aa, Cryptosporidium hominis
QQDTLEYFTFLQEKLSDDLKKYYNH

SEQ ID NO: 2195901 - protein, 32 aa, Cryptosporidium hominis
QQFGEIFLTKWELQTILTEKFFTYTRKDLLQT

SEQ ID NO: 2195902 - protein, 34 aa, Cryptosporidium hominis
QQFNFSAHPYYLPNFLDIFSWSLPFVSEKVTEML

SEQ ID NO: 2195903 - protein, 24 aa, Cryptosporidium hominis
QQFSDELVFYNFLEQSRKLSCDIK

SEQ ID NO: 2195904 - protein, 29 aa, Cryptosporidium hominis
QQFSFALSCLYNRLNFVRNVLPDCTYTLA

SEQ ID NO: 2195905 - protein, 25 aa, Cryptosporidium hominis
QQGLDLLLQLLQYSPESRLTARQAL

SEQ ID NO: 2195906 - protein, 23 aa, Cryptosporidium hominis
QQGRFYFQGIIYCSILTGTVSLV

SEQ ID NO: 2195907 - protein, 30 aa, Cryptosporidium hominis
QQITEDFLALIDPYILFLGGIDHQDSMNSQ

SEQ ID NO: 2195908 - protein, 18 aa, Cryptosporidium hominis
QQIYIIMEYCDEGDLGNI

SEQ ID NO: 2195909 - protein, 17 aa, Cryptosporidium hominis
QQKFLCNLKLQQRSKKN

SEQ ID NO: 2195910 - protein, 26 aa, Cryptosporidium hominis
QQLLFTQQQYEYSLQLQYQYQLQQQL

SEQ ID NO: 2195911 - protein, 19 aa, Cryptosporidium hominis
QQMYQHLQMLAFAQQQQML

SEQ ID NO: 2195912 - protein, 18 aa, Cryptosporidium hominis
QQNIDSILYKCSEGYLLS

SEQ ID NO: 2195913 - protein, 25 aa, Cryptosporidium hominis
QQNITSIIRLYLRFKNLISDRYGNI

SEQ ID NO: 2195914 - protein, 19 aa, Cryptosporidium hominis
QQPLYKEWLAAKEVLLNSL

SEQ ID NO: 2195915 - protein, 27 aa, Cryptosporidium hominis
QQQNNKLVITPKLKFGLGGTNLISGSI

SEQ ID NO: 2195916 - protein, 31 aa, Cryptosporidium hominis
QQQQMLQRQLQIKEWALAAAYLTQQQQQQQQ

SEQ ID NO: 2195917 - protein, 21 aa, Cryptosporidium hominis
QQRIYLLEPKLDDSIKHLQEN

SEQ ID NO: 2195918 - protein, 24 aa, Cryptosporidium hominis
QQSGFILNFNFAPNPFFEGTNIKK

SEQ ID NO: 2195919 - protein, 23 aa, Cryptosporidium hominis
QQSLIRHLALIVDNFRGRFLYNN

SEQ ID NO: 2195920 - protein, 20 aa, Cryptosporidium hominis
QQTFNKTFKPFLNSAGKSRG

SEQ ID NO: 2195921 - protein, 24 aa, Cryptosporidium hominis
QQTKKHLIFWEVDLGLNYVSRKSS

SEQ ID NO: 2195922 - protein, 21 aa, Cryptosporidium hominis
QRCCIMFYPPGNELIRQDGLS

SEQ ID NO: 2195923 - protein, 39 aa, Cryptosporidium hominis
QRERSFLEKYPSDPLYLATILNYTILKYDLLGNPEGAMK

SEQ ID NO: 2195924 - protein, 28 aa, Cryptosporidium hominis
QRFAPIDQKLLCKYIRYARKYCKPQIRS

SEQ ID NO: 2195925 - protein, 23 aa, Cryptosporidium hominis
QRFSQFWIVNNIINSLFSTNNAH

SEQ ID NO: 2195926 - protein, 20 aa, Cryptosporidium hominis
QRGLPSIRWVGGVEIELLAI

SEQ ID NO: 2195927 - protein, 25 aa, Cryptosporidium hominis
QRIEFRIPDSSACPHLAFSAILCAG

SEQ ID NO: 2195928 - protein, 21 aa, Cryptosporidium hominis
QRISSSLYYRDLNDGTGHGGG

SEQ ID NO: 2195929 - protein, 27 aa, Cryptosporidium hominis
QRKQSSNFQILWPSLQDWIYSSDKNIL

SEQ ID NO: 2195930 - protein, 22 aa, Cryptosporidium hominis
QRLSMQNVFKRFYSPGNSSSNT

SEQ ID NO: 2195931 - protein, 27 aa, Cryptosporidium hominis
QRNRLLQQQLEAMFKLVNDLSIKLDES

SEQ ID NO: 2195932 - protein, 30 aa, Cryptosporidium hominis
QRPPRIKYNLCRWICRAYIFQAIRLPVVES

SEQ ID NO: 2195933 - protein, 24 aa, Cryptosporidium hominis
QRQYELIIRDLRRRIMFLERDIES

SEQ ID NO: 2195934 - protein, 20 aa, Cryptosporidium hominis
QRRFACIQPLKVIIINWDEC

SEQ ID NO: 2195935 - protein, 19 aa, Cryptosporidium hominis
QRVFLRNSFEKLKEVDYPT

SEQ ID NO: 2195936 - protein, 26 aa, Cryptosporidium hominis
QRVFSTVFMRYFIEKAQTYTPLVPKE

SEQ ID NO: 2195937 - protein, 22 aa, Cryptosporidium hominis
QRVMDHFIKIIKSKTGKDVKSD

SEQ ID NO: 2195938 - protein, 18 aa, Cryptosporidium hominis
QRWYITEQNKMGPFGWFD

SEQ ID NO: 2195939 - protein, 29 aa, Cryptosporidium hominis
QRYNRTFMYRYYFNNIIFSLKTVTNNKTD

SEQ ID NO: 2195940 - protein, 18 aa, Cryptosporidium hominis
QSALFGLYKEFYGELEDI

SEQ ID NO: 2195941 - protein, 23 aa, Cryptosporidium hominis
QSDIFDQRLASKILKIVDVSYGG

SEQ ID NO: 2195942 - protein, 26 aa, Cryptosporidium hominis
QSDLRHILIHMLSHQLALDTTQINMA

SEQ ID NO: 2195943 - protein, 23 aa, Cryptosporidium hominis
QSDTRIYHWIRLSSLRLESQMIL

SEQ ID NO: 2195944 - protein, 25 aa, Cryptosporidium hominis
QSEKSDFIIIRFYGEAYGSMSYKEY

SEQ ID NO: 2195945 - protein, 23 aa, Cryptosporidium hominis
QSEYKMEISREGDLLKLIQEEIS

SEQ ID NO: 2195946 - protein, 25 aa, Cryptosporidium hominis
QSFLFTKQFTTHLGLLSIFSYILGV

SEQ ID NO: 2195947 - protein, 35 aa, Cryptosporidium hominis
QSGHPGVTWCSERRTWRICYAPEPGKRVTKSFNPR

SEQ ID NO: 2195948 - protein, 19 aa, Cryptosporidium hominis
QSIGVYDMALGSDVNIQIL

SEQ ID NO: 2195949 - protein, 19 aa, Cryptosporidium hominis
QSIMKCDLDIRKDLYANIV

SEQ ID NO: 2195950 - protein, 23 aa, Cryptosporidium hominis
QSISISFVILLKLGRRLNILTYK

SEQ ID NO: 2195951 - protein, 28 aa, Cryptosporidium hominis
QSISSFPWNYIFKCSRDFSLSQFHSELE

SEQ ID NO: 2195952 - protein, 30 aa, Cryptosporidium hominis
QSKTDSFFQLLPYLLKLTKFQIIRNEFSLN

SEQ ID NO: 2195953 - protein, 20 aa, Cryptosporidium hominis
QSKYSWHILVTNVDGKLIFD

SEQ ID NO: 2195954 - protein, 29 aa, Cryptosporidium hominis
QSLETICLLFAYKIKYPENFFLLRGNHEC

SEQ ID NO: 2195955 - protein, 20 aa, Cryptosporidium hominis
QSLIKDLVIPSLDPLSTLNN

SEQ ID NO: 2195956 - protein, 48 aa, Cryptosporidium hominis; identical to SEQ ID NO: 2179892

SEQ ID NO: 2195957 - protein, 19 aa, Cryptosporidium hominis
QSLLRLNPLERISASQALE

SEQ ID NO: 2195958 - protein, 26 aa, Cryptosporidium hominis
QSLLSDPQFRLVLEQLKQNPATLTQV

SEQ ID NO: 2195959 - protein, 26 aa, Cryptosporidium hominis
QSLQLNLAMIYVKIQEWSKAIQVTGQ

SEQ ID NO: 2195960 - protein, 21 aa, Cryptosporidium hominis
QSLYNFMYPLGVEAQLWSASQ

SEQ ID NO: 2195961 - protein, 22 aa, Cryptosporidium hominis
QSMIQFKYYCNSGLIDNNKDWQ

SEQ ID NO: 2195962 - protein, 22 aa, Cryptosporidium hominis
QSMNGVPFPAPSIPQNLNVPSS

SEQ ID NO: 2195963 - protein, 33 aa, Cryptosporidium hominis
QSNMQMWRRRWEPCLPHILRSPLSIKEVSAFEG

SEQ ID NO: 2195964 - protein, 23 aa, Cryptosporidium hominis
QSNNYKIIPNHKIFSSPSSSSSS

SEQ ID NO: 2195965 - protein, 27 aa, Cryptosporidium hominis
QSNSSKIFTYWYPYELDIPIKGYFTIS

SEQ ID NO: 2195966 - protein, 18 aa, Cryptosporidium hominis
QSPSTYKLSRPSSSNFSN

SEQ ID NO: 2195967 - protein, 23 aa, Cryptosporidium hominis
QSPYDLIRRRYLGELKKTLVSDS

SEQ ID NO: 2195968 - protein, 32 aa, Cryptosporidium hominis
QSQILSFLSISYISEKLFPFMSGQLANTSSGV

SEQ ID NO: 2195969 - protein, 17 aa, Cryptosporidium hominis
QSRCFMATYIPFSQSRK

SEQ ID NO: 2195970 - protein, 18 aa, Cryptosporidium hominis
QSRESIFPSMFPPEDPKI

SEQ ID NO: 2195971 - protein, 24 aa, Cryptosporidium hominis
QSRKKNMLLPKGFEIGGGIASCKL

SEQ ID NO: 2195972 - protein, 25 aa, Cryptosporidium hominis
QSSINNMILIFRQIEKRNLYNSLYK

SEQ ID NO: 2195973 - protein, 24 aa, Cryptosporidium hominis
QSSIPFHLVCHVFESMKASLQKNE

SEQ ID NO: 2195974 - protein, 25 aa, Cryptosporidium hominis
QSTGIRKNLYTSTPGLNIMKNSKEQ

SEQ ID NO: 2195975 - protein, 28 aa, Cryptosporidium hominis
QSTPNINLLPWEILSKALPLDLGIDFNS

SEQ ID NO: 2195976 - protein, 23 aa, Cryptosporidium hominis
QSTYFSRYYIRKLLQEFNVNVLY

SEQ ID NO: 2195977 - protein, 21 aa, Cryptosporidium hominis
QSVHYIRYDGEILKKHYEQLR

SEQ ID NO: 2195978 - protein, 27 aa, Cryptosporidium hominis
QSVPKLFWLSIYYLVNSMKFISREHQR

SEQ ID NO: 2195979 - protein, 17 aa, Cryptosporidium hominis
QTAFKLLGLEVGASTKE

SEQ ID NO: 2195980 - protein, 25 aa, Cryptosporidium hominis
QTAYRIWIRSQFLRRDTPKVPFSPY

SEQ ID NO: 2195981 - protein, 26 aa, Cryptosporidium hominis
QTELFDILLEIYNIIPTWGSFKENFY

SEQ ID NO: 2195982 - protein, 24 aa, Cryptosporidium hominis
QTENEFLVPLSLSFMSNWAENKNK

SEQ ID NO: 2195983 - protein, 32 aa, Cryptosporidium hominis
QTFVSFIKYLRESLHWEWPAGLLPASRGVRSR

SEQ ID NO: 2195984 - protein, 26 aa, Cryptosporidium hominis
QTGFDSFKMPISDFIQFGKIFESWDT

SEQ ID NO: 2195985 - protein, 17 aa, Cryptosporidium hominis
QTIEYIYSKISDVKLIL

SEQ ID NO: 2195986 - protein, 17 aa, Cryptosporidium hominis
QTIISLFDHSIYLLENC

SEQ ID NO: 2195987 - protein, 20 aa, Cryptosporidium hominis
QTIQLKPLSTMKSISGLFFE

SEQ ID NO: 2195988 - protein, 18 aa, Cryptosporidium hominis
QTITQLKTRIRRLAMINS

SEQ ID NO: 2195989 - protein, 22 aa, Cryptosporidium hominis
QTKATFLKLAGPQLVQMFIGDG

SEQ ID NO: 2195990 - protein, 28 aa, Cryptosporidium hominis
QTKVHSNFYFLFNNYLNFLENQPLKNDL

SEQ ID NO: 2195991 - protein, 20 aa, Cryptosporidium hominis
QTLHLRFSDIEQGKLDILSI

SEQ ID NO: 2195992 - protein, 24 aa, Cryptosporidium hominis
QTLIRRLSNLIEKCLIIDPKKRIS

SEQ ID NO: 2195993 - protein, 17 aa, Cryptosporidium hominis
QTLLWSATWPKEVQKLA

SEQ ID NO: 2195994 - protein, 22 aa, Cryptosporidium hominis
QTLSRYWTHISLIGECFNILKK

SEQ ID NO: 2195995 - protein, 18 aa, Cryptosporidium hominis
QTLTLLEELVEHHGWGYE

SEQ ID NO: 2195996 - protein, 17 aa, Cryptosporidium hominis
QTLVAPPPPPPPPSSQG

SEQ ID NO: 2195997 - protein, 27 aa, Cryptosporidium hominis
QTMINKAILPWFRLGSRPILSDESDEY

SEQ ID NO: 2195998 - protein, 21 aa, Cryptosporidium hominis
QTMRIPLPKNFVMDLNKLEKE

SEQ ID NO: 2195999 - protein, 24 aa, Cryptosporidium hominis
QTNSIIRYMRRWNYLSLVMLPPNN

SEQ ID NO: 2196000 - protein, 33 aa, Cryptosporidium hominis
QTPNPFPYQPHHQLPMPPVPPQNMQIPVPMPMQ

SEQ ID NO: 2196001 - protein, 25 aa, Cryptosporidium hominis
QTQICRRAYIPNYSKDEVKDLIGCN

SEQ ID NO: 2196002 - protein, 29 aa, Cryptosporidium hominis
QTQPQAFPNFFQLQHLFQQQLLQQQQQLQ

SEQ ID NO: 2196003 - protein, 25 aa, Cryptosporidium hominis
QTSHWWLIVICHPHKIFNLMNSSSP

SEQ ID NO: 2196004 - protein, 25 aa, Cryptosporidium hominis
QTTLYPVYMSFPYNQGRNINVPYTV

SEQ ID NO: 2196005 - protein, 20 aa, Cryptosporidium hominis
QTTYGKFGVKYETNQSGKTQ

SEQ ID NO: 2196006 - protein, 21 aa, Cryptosporidium hominis
QTVFVSLPRSESVFDASYSLN

SEQ ID NO: 2196007 - protein, 24 aa, Cryptosporidium hominis
QTVLDYYQHWLKVSPPHEITVLYS

SEQ ID NO: 2196008 - protein, 34 aa, Cryptosporidium hominis
QTVSPQPTLALTPLGLIPILPKVVGSHQFQGLNP

SEQ ID NO: 2196009 - protein, 25 aa, Cryptosporidium hominis
QTYVNRILAFLYADDESFLELQKKP

SEQ ID NO: 2196010 - protein, 25 aa, Cryptosporidium hominis
QVAGLEWMVKLYKRGLNGILADEMG

SEQ ID NO: 2196011 - protein, 26 aa, Cryptosporidium hominis
QVAWELFYIGRGDALRWIMMDRIRES

SEQ ID NO: 2196012 - protein, 18 aa, Cryptosporidium hominis
QVCVFAPNLLLGCVMTYP

SEQ ID NO: 2196013 - protein, 24 aa, Cryptosporidium hominis
QVDGDAAIIYPDGGKYTGEVVNGI

SEQ ID NO: 2196014 - protein, 18 aa, Cryptosporidium hominis
QVDQLFQYRYPNIPKVSN

SEQ ID NO: 2196015 - protein, 30 aa, Cryptosporidium hominis
QVEGINDHLILPITWKQISSIFNGILKELH

SEQ ID NO: 2196016 - protein, 28 aa, Cryptosporidium hominis
QVELYTHNYILREILLVLAKDLDIRLTA

SEQ ID NO: 2196017 - protein, 23 aa, Cryptosporidium hominis
QVEVFFWTKIKDPRLQAPEGSFM

SEQ ID NO: 2196018 - protein, 26 aa, Cryptosporidium hominis
QVEYKDTKLLLLNQDYEILKKDFALL

SEQ ID NO: 2196019 - protein, 25 aa, Cryptosporidium hominis
QVFKSIACRHILLLSGTPVQNNTEE

SEQ ID NO: 2196020 - protein, 17 aa, Cryptosporidium hominis
QVFLLNQNLMRSCLEIL

SEQ ID NO: 2196021 - protein, 24 aa, Cryptosporidium hominis
QVHKLNRLYDKLSNLCLAIPELNN

SEQ ID NO: 2196022 - protein, 26 aa, Cryptosporidium hominis
QVIINGLRIKILKLILNILLDISEFQ

SEQ ID NO: 2196023 - protein, 26 aa, Cryptosporidium hominis
QVIKIFSLDLYFIWDKEKFACSSFGE

SEQ ID NO: 2196024 - protein, 18 aa, Cryptosporidium hominis
QVIPLIFEKDILVLFPSF

SEQ ID NO: 2196025 - protein, 22 aa, Cryptosporidium hominis
QVIQSAWRTLKAQALLVEKLAF

SEQ ID NO: 2196026 - protein, 19 aa, Cryptosporidium hominis
QVIWCCFGLLSGELELSLF

SEQ ID NO: 2196027 - protein, 25 aa, Cryptosporidium hominis
QVKEEICIPPTFYGNTYLSLSSVER

SEQ ID NO: 2196028 - protein, 25 aa, Cryptosporidium hominis
QVKNEWFPGIFPMVPGHEIIGIVEE

SEQ ID NO: 2196029 - protein, 18 aa, Cryptosporidium hominis
QVLETHVKLIIQDRIYDW

SEQ ID NO: 2196030 - protein, 30 aa, Cryptosporidium hominis
QVLIEIGPRFVLEPILILDGTFSGQVLYRN

SEQ ID NO: 2196031 - protein, 19 aa, Cryptosporidium hominis
QVLWLIRASGRVGLVSLDI

SEQ ID NO: 2196032 - protein, 17 aa, Cryptosporidium hominis
QVMQPFLDIKRWIINIS

SEQ ID NO: 2196033 - protein, 17 aa, Cryptosporidium hominis
QVNNPNLVLFVGEALVG

SEQ ID NO: 2196034 - protein, 20 aa, Cryptosporidium hominis
QVNYTIFNKHLVATESWNCD

SEQ ID NO: 2196035 - protein, 17 aa, Cryptosporidium hominis
QVPILCLGLTFDGDRII

SEQ ID NO: 2196036 - protein, 20 aa, Cryptosporidium hominis
QVQELICSYAALVLSDGGVP

SEQ ID NO: 2196037 - protein, 17 aa, Cryptosporidium hominis
QVRKYMQSIIRPEMKLI

SEQ ID NO: 2196038 - protein, 21 aa, Cryptosporidium hominis
QVSYGIGIARPLSLYINTFGT

SEQ ID NO: 2196039 - protein, 25 aa, Cryptosporidium hominis
QVTGFSVGYPFKTDQWREQQQSISF

SEQ ID NO: 2196040 - protein, 23 aa, Cryptosporidium hominis
QVTRSFNHLPVDIKLCGNGKVVR

SEQ ID NO: 2196041 - protein, 36 aa, Cryptosporidium hominis
QVVFDIMCILSDTSQVFYVIRVLVKVRDWCGSCLLD

SEQ ID NO: 2196042 - protein, 21 aa, Cryptosporidium hominis
QVVFEYIFTIFNEKLSLSGAE

SEQ ID NO: 2196043 - protein, 27 aa, Cryptosporidium hominis
QVVQRRDHISWFKVPPSIYFNRGCLEE

SEQ ID NO: 2196044 - protein, 20 aa, Cryptosporidium hominis
QVWRESYTEMVRFYKTFTPS

SEQ ID NO: 2196045 - protein, 17 aa, Cryptosporidium hominis
QVYGRLKNDLKLIQIFE

SEQ ID NO: 2196046 - protein, 17 aa, Cryptosporidium hominis
QWIEFPPEKIYANSIVE

SEQ ID NO: 2196047 - protein, 19 aa, Cryptosporidium hominis
QWYKRLLDVGNVHGDVSFR

SEQ ID NO: 2196048 - protein, 25 aa, Cryptosporidium hominis
QYCEKYLSELFIKMNNMEWRAKPKN

SEQ ID NO: 2196049 - protein, 19 aa, Cryptosporidium hominis
QYCRIPPIAIQCLAAYTPK

SEQ ID NO: 2196050 - protein, 18 aa, Cryptosporidium hominis
QYDLEIITIVHILFKSRL

SEQ ID NO: 2196051 - protein, 31 aa, Cryptosporidium hominis
QYGFANTCFNLFSLLSLLKDSLISITSPNTV

SEQ ID NO: 2196052 - protein, 39 aa, Cryptosporidium hominis
QYGQVHIPLISPMPHQFWYNHLVPQCNFGHIVPPPPDYF

SEQ ID NO: 2196053 - protein, 19 aa, Cryptosporidium hominis
QYKLALALNNLHLKGLCHL

SEQ ID NO: 2196054 - protein, 17 aa, Cryptosporidium hominis
QYLIDYQQEYLFSEIED

SEQ ID NO: 2196055 - protein, 18 aa, Cryptosporidium hominis
QYLLNQCLSFVMSSLENI

SEQ ID NO: 2196056 - protein, 28 aa, Cryptosporidium hominis
QYLTSCYYDIFFPPPITNQPSMSSIQIG

SEQ ID NO: 2196057 - protein, 30 aa, Cryptosporidium hominis
QYLYVTELLLIFDSLYWKDIISRLVELRSN

SEQ ID NO: 2196058 - protein, 20 aa, Cryptosporidium hominis
QYMEKKAQFFKEPACSLVVA

SEQ ID NO: 2196059 - protein, 24 aa, Cryptosporidium hominis
QYNELWKAIIRPPRDRYSIRDLGP

SEQ ID NO: 2196060 - protein, 31 aa, Cryptosporidium hominis
QYRQFGHALILICILIKKYSNIIRLKYLNIL

SEQ ID NO: 2196061 - protein, 17 aa, Cryptosporidium hominis
QYSVDMVTKVFASLMQC

SEQ ID NO: 2196062 - protein, 24 aa, Cryptosporidium hominis
RAACYMQLLEYPSALIDVQKALDL

SEQ ID NO: 2196063 - protein, 28 aa, Cryptosporidium hominis
RACKDYAFQISPYPIILSLEMHASDKQR

SEQ ID NO: 2196064 - protein, 28 aa, Cryptosporidium hominis
RADARNSVFKLKWKFATMPDKNKIKIAM

SEQ ID NO: 2196065 - protein, 29 aa, Cryptosporidium hominis
RAEHFITIMKKLILYLQEYIRVYSTRIEG

SEQ ID NO: 2196066 - protein, 39 aa, Cryptosporidium hominis
RAEHQSGVPGVYWQESSQRWIAQWSDSISGRRITHGFSA

SEQ ID NO: 2196067 - protein, 24 aa, Cryptosporidium hominis
RAEILDILSYCRLIIDETADDCFL

SEQ ID NO: 2196068 - protein, 20 aa, Cryptosporidium hominis
RAEIREFIQLMKDAANKDEI

SEQ ID NO: 2196069 - protein, 28 aa, Cryptosporidium hominis
RAEKGSSNLPPLPRTEDYWPKINKDTTQ

SEQ ID NO: 2196070 - protein, 33 aa, Cryptosporidium hominis
RAFLRLSKEDIILLYIILFINNKVNMKNKKLVS

SEQ ID NO: 2196071 - protein, 20 aa, Cryptosporidium hominis
RAGTGGNGFFRRCRSRSSKQ

SEQ ID NO: 2196072 - protein, 25 aa, Cryptosporidium hominis
RAHLKYIGFPIVRDILYSDKVLPGI

SEQ ID NO: 2196073 - protein, 17 aa, Cryptosporidium hominis
RAHWGIGYVWFKREEYY

SEQ ID NO: 2196074 - protein, 24 aa, Cryptosporidium hominis
RAIDTLFPKFWEENTFGALLPDIS

SEQ ID NO: 2196075 - protein, 25 aa, Cryptosporidium hominis
RAIETGVEILRRTLNKRENEIRASL

SEQ ID NO: 2196076 - protein, 28 aa, Cryptosporidium hominis
RAINERINNLWLPRKNKTTQFDKDKIRK

SEQ ID NO: 2196077 - protein, 21 aa, Cryptosporidium hominis
RAISMCAYFNHWISYKFSTKN

SEQ ID NO: 2196078 - protein, 22 aa, Cryptosporidium hominis
RAKVHKIFTSKLKMIQHEKLKN

SEQ ID NO: 2196079 - protein, 26 aa, Cryptosporidium hominis
RALDADSFIPVFYQFVTIYMQETSAH

SEQ ID NO: 2196080 - protein, 18 aa, Cryptosporidium hominis
RALVLKNNLRVLLVQDEN

SEQ ID NO: 2196081 - protein, 17 aa, Cryptosporidium hominis
RAMAMLWNVDTLRRARP

SEQ ID NO: 2196082 - protein, 17 aa, Cryptosporidium hominis
RAPCVTIEWYPGGRRLV

SEQ ID NO: 2196083 - protein, 28 aa, Cryptosporidium hominis
RAPVVAWQDIPIFKPFTFFSVNSEEEQG

SEQ ID NO: 2196084 - protein, 17 aa, Cryptosporidium hominis
RAQRAKSMKFRDGYMIA

SEQ ID NO: 2196085 - protein, 19 aa, Cryptosporidium hominis
RAQRIIPGIFLGGSTIAND

SEQ ID NO: 2196086 - protein, 18 aa, Cryptosporidium hominis
RARLDQNMYMVEGMGVNG

SEQ ID NO: 2196087 - protein, 19 aa, Cryptosporidium hominis
RARNYFKQVLGVNFSPKTK

SEQ ID NO: 2196088 - protein, 31 aa, Cryptosporidium hominis
RASGPSYNLKLPPMDFIINEKSLCNDFRRAN

SEQ ID NO: 2196089 - protein, 24 aa, Cryptosporidium hominis
RASKHMYNFLKEIVSIIPNCDFYK

SEQ ID NO: 2196090 - protein, 17 aa, Cryptosporidium hominis
RASRLIERALGEGAVFN

SEQ ID NO: 2196091 - protein, 20 aa, Cryptosporidium hominis
RAVEYLTSGLPIPENPVAPN

SEQ ID NO: 2196092 - protein, 32 aa, Cryptosporidium hominis
RAVKSLLNKITVEKFTVIAEKLAVCIDEIKNV

SEQ ID NO: 2196093 - protein, 30 aa, Cryptosporidium hominis
RAVVIDTLRKLVVLVWTFLQETSFGSSPGM

SEQ ID NO: 2196094 - protein, 24 aa, Cryptosporidium hominis
RAYAQAFEIIPYTLAENAGLNPIE

SEQ ID NO: 2196095 - protein, 17 aa, Cryptosporidium hominis
RAYFEMYYDFEVSKKLK

SEQ ID NO: 2196096 - protein, 38 aa, Cryptosporidium hominis
RAYTCLEVYRYFKAIKSITLLQQWWRVTSTLKKHIDSG

SEQ ID NO: 2196097 - protein, 26 aa, Cryptosporidium hominis
RCEFEKKFLGTQYLIAFNPGSISCAL

SEQ ID NO: 2196098 - protein, 17 aa, Cryptosporidium hominis
RCGLTPKFKDVPTLIKA

SEQ ID NO: 2196099 - protein, 17 aa, Cryptosporidium hominis
RCGYLSNSSFNSNLVTS

SEQ ID NO: 2196100 - protein, 23 aa, Cryptosporidium hominis
RCIDDVILLSKSLSPIFNHFITK

SEQ ID NO: 2196101 - protein, 17 aa, Cryptosporidium hominis
RCIVEVEMWKRKLKTQE

SEQ ID NO: 2196102 - protein, 26 aa, Cryptosporidium hominis
RCKGSLGFVLLRQTFYRLQLVADANN

SEQ ID NO: 2196103 - protein, 24 aa, Cryptosporidium hominis
RCLHRVLCCCPRIVGISRLVSTLI

SEQ ID NO: 2196104 - protein, 18 aa, Cryptosporidium hominis
RCLLPEKYIYGLSDRMIV

SEQ ID NO: 2196105 - protein, 29 aa, Cryptosporidium hominis
RCQYSHNVYWPRRCPFYLSDRSALRYLPD

SEQ ID NO: 2196106 - protein, 24 aa, Cryptosporidium hominis
RCSNDDMLLWSRLMEDFIAIHKNK

SEQ ID NO: 2196107 - protein, 17 aa, Cryptosporidium hominis
RCSRYLYTLVMKDLEKA

SEQ ID NO: 2196108 - protein, 22 aa, Cryptosporidium hominis
RCYYLSLEFLLGRAMQNALVNL

SEQ ID NO: 2196109 - protein, 19 aa, Cryptosporidium hominis
RDAEAGDILVFYFAGHGVQ

SEQ ID NO: 2196110 - protein, 24 aa, Cryptosporidium hominis
RDDENLLNYCFLISKPFKNNSIGF

SEQ ID NO: 2196111 - protein, 17 aa, Cryptosporidium hominis
RDDFNFDKGYQLNKNQF

SEQ ID NO: 2196112 - protein, 33 aa, Cryptosporidium hominis
RDDFYYRLFTKHDIFKYIFLIMGQLKVPRNRGE

SEQ ID NO: 2196113 - protein, 22 aa, Cryptosporidium hominis
RDDPKLCWRCHKRDATPHMRSC

SEQ ID NO: 2196114 - protein, 25 aa, Cryptosporidium hominis
RDDWVRKLSRLMIPYVQKGVLDLGE

SEQ ID NO: 2196115 - protein, 23 aa, Cryptosporidium hominis
RDELISKIGLLNLNINRLNKALE

SEQ ID NO: 2196116 - protein, 24 aa, Cryptosporidium hominis
RDENLIFKIVLLLLDELEKSSTQQ

SEQ ID NO: 2196117 - protein, 22 aa, Cryptosporidium hominis
RDERKMFRLESSAESWVVKQKE

SEQ ID NO: 2196118 - protein, 34 aa, Cryptosporidium hominis
RDFESSIIHPLQCILLIIGILRRSLENPNHSDLK

SEQ ID NO: 2196119 - protein, 28 aa, Cryptosporidium hominis
RDFNMEELPLIILANWRGFSGGQKDMFD

SEQ ID NO: 2196120 - protein, 24 aa, Cryptosporidium hominis
RDGILLVNLLKQWSSLYGYNNTEG

SEQ ID NO: 2196121 - protein, 19 aa, Cryptosporidium hominis
RDGSRLRWIKSSLENGELV

SEQ ID NO: 2196122 - protein, 20 aa, Cryptosporidium hominis
RDIIYIKRRPGSESSFHVEG

SEQ ID NO: 2196123 - protein, 22 aa, Cryptosporidium hominis
RDIKSLNIFLSLPIKSNADVPI

SEQ ID NO: 2196124 - protein, 18 aa, Cryptosporidium hominis
RDILYNLVKIQCAYKYTR

SEQ ID NO: 2196125 - protein, 22 aa, Cryptosporidium hominis
RDKLCSLIRKYQTLIEAHCNVK

SEQ ID NO: 2196126 - protein, 19 aa, Cryptosporidium hominis
RDKLWHKIGNILQPDVPIS

SEQ ID NO: 2196127 - protein, 24 aa, Cryptosporidium hominis
RDLAYRLCFLACHIEVVNAIASAD

SEQ ID NO: 2196128 - protein, 17 aa, Cryptosporidium hominis
RDLKPENFLFLHSKSNI

SEQ ID NO: 2196129 - protein, 23 aa, Cryptosporidium hominis
RDNLNYYPIDVPLLICHCVHDIL

SEQ ID NO: 2196130 - protein, 25 aa, Cryptosporidium hominis
RDPRRSLLIRSLRFDTPTSLVRREF

SEQ ID NO: 2196131 - protein, 17 aa, Cryptosporidium hominis
RDSILNENTPALKTEDS

SEQ ID NO: 2196132 - protein, 24 aa, Cryptosporidium hominis
RDSIYLLGWVVEAIQALILIADDI

SEQ ID NO: 2196133 - protein, 24 aa, Cryptosporidium hominis
RDSQINILFFMPHCDRCVFGMIIN

SEQ ID NO: 2196134 - protein, 17 aa, Cryptosporidium hominis
RDTLLPKRWPIGEKSSI

SEQ ID NO: 2196135 - protein, 25 aa, Cryptosporidium hominis
RDVADYDFIMKEKFFIIPRTSRESN

SEQ ID NO: 2196136 - protein, 29 aa, Cryptosporidium hominis
RDVSSLWIRYMSYYLDLEDLDKARMVAER

SEQ ID NO: 2196137 - protein, 18 aa, Cryptosporidium hominis
RDVYLVFDYMETDLHAVI

SEQ ID NO: 2196138 - protein, 24 aa, Cryptosporidium hominis
RDYNLQLKTIKWNLSDLKNPELNS

SEQ ID NO: 2196139 - protein, 22 aa, Cryptosporidium hominis
REAILLLPRNTILCPWVHIEGI

SEQ ID NO: 2196140 - protein, 17 aa, Cryptosporidium hominis
REAILSSIFSKVLETFN

SEQ ID NO: 2196141 - protein, 20 aa, Cryptosporidium hominis
RECKDYVFSLSIWDYNQEDL

SEQ ID NO: 2196142 - protein, 27 aa, Cryptosporidium hominis
RECSDDYICKLYLLLKNVGIKITESFL

SEQ ID NO: 2196143 - protein, 18 aa, Cryptosporidium hominis
REELIPSLDFNDLSMIER

SEQ ID NO: 2196144 - protein, 17 aa, Cryptosporidium hominis
REELLKANDLYENYRKL

SEQ ID NO: 2196145 - protein, 25 aa, Cryptosporidium hominis
REEQILKHLFTFYSKVLLLDLDELE

SEQ ID NO: 2196146 - protein, 19 aa, Cryptosporidium hominis
REFFYSFLADCNEFCFLQL

SEQ ID NO: 2196147 - protein, 21 aa, Cryptosporidium hominis
REFPLGDVLTGSTLSNLVESM

SEQ ID NO: 2196148 - protein, 35 aa, Cryptosporidium hominis
REHRENLFDTFFWKLLIYSYFKLNSTLSPISSLIK

SEQ ID NO: 2196149 - protein, 17 aa, Cryptosporidium hominis
REHYGPIPLNALSSSLL

SEQ ID NO: 2196150 - protein, 24 aa, Cryptosporidium hominis
REIDQLDCKLLLLDSNVKTIDKNS

SEQ ID NO: 2196151 - protein, 25 aa, Cryptosporidium hominis
REIEIDPIVTCPPRFVLNLQTQVCE

SEQ ID NO: 2196152 - protein, 20 aa, Cryptosporidium hominis
REILDVVRYIPKIPTIHIIA

SEQ ID NO: 2196153 - protein, 23 aa, Cryptosporidium hominis
REKAYLYLKYLVQQKHGPVTIDV

SEQ ID NO: 2196154 - protein, 20 aa, Cryptosporidium hominis
REKDALLKIFRLVDEKALAQ

SEQ ID NO: 2196155 - protein, 20 aa, Cryptosporidium hominis
REKHYCHFLNGTLCAIQRTM

SEQ ID NO: 2196156 - protein, 23 aa, Cryptosporidium hominis
REKYMITFPYPYMNGRLHLGHAF

SEQ ID NO: 2196157 - protein, 27 aa, Cryptosporidium hominis
RELFRKNYIPITQFEKVLLSVTSCVEG

SEQ ID NO: 2196158 - protein, 24 aa, Cryptosporidium hominis
RELFSPYCSIVSLYLWEISNGDYK

SEQ ID NO: 2196159 - protein, 22 aa, Cryptosporidium hominis
RELNRNQLFWQESQVGLAPAAN

SEQ ID NO: 2196160 - protein, 28 aa, Cryptosporidium hominis
RELTKQQFITWFVINQQNGPSIADSEVT

SEQ ID NO: 2196161 - protein, 28 aa, Cryptosporidium hominis
RENNRELLLFDLAINMYQKYTHLSRILT

SEQ ID NO: 2196162 - protein, 17 aa, Cryptosporidium hominis
RENYYSLRPSEVASMFP

SEQ ID NO: 2196163 - protein, 18 aa, Cryptosporidium hominis
REPSPPPIYDKNGSRINT

SEQ ID NO: 2196164 - protein, 23 aa, Cryptosporidium hominis
REQNPLPFQRWSPNGPDVPRPTY

SEQ ID NO: 2196165 - protein, 19 aa, Cryptosporidium hominis
RERGITIDIALWQFETPKY

SEQ ID NO: 2196166 - protein, 26 aa, Cryptosporidium hominis
RESHCSLPNPIIYKWPSNSVCIEDYK

SEQ ID NO: 2196167 - protein, 23 aa, Cryptosporidium hominis
RESPQSINWFWNILDLNETGYID

SEQ ID NO: 2196168 - protein, 18 aa, Cryptosporidium hominis
RESSMSFAPVRFGSMSIS

SEQ ID NO: 2196169 - protein, 29 aa, Cryptosporidium hominis
RESWNRAMSMNLINLKWLLVRSSESIRNK

SEQ ID NO: 2196170 - protein, 25 aa, Cryptosporidium hominis
RETDNLKLYYLYESFENKKGTQNEL

SEQ ID NO: 2196171 - protein, 47 aa, Cryptosporidium hominis
RETLKFTTNNYLKWDPSHLITDLRGIHIPLSLAGKYFGLLRNERTKG

SEQ ID NO: 2196172 - protein, 19 aa, Cryptosporidium hominis
REVLELKLRIGWISVSYGD

SEQ ID NO: 2196173 - protein, 28 aa, Cryptosporidium hominis
REVLLSFDDFFLFKSSSDSKIEKINYSD

SEQ ID NO: 2196174 - protein, 28 aa, Cryptosporidium hominis
REVQDLDSLLLIYSCIGDIQGLKYVAKM

SEQ ID NO: 2196175 - protein, 22 aa, Cryptosporidium hominis
REVRLSIFPEKYPEKRKISEEI

SEQ ID NO: 2196176 - protein, 18 aa, Cryptosporidium hominis
REWKASKLIFLPSSDKHL

SEQ ID NO: 2196177 - protein, 24 aa, Cryptosporidium hominis
REYNKLYQKYTALLSEYTASKKNE

SEQ ID NO: 2196178 - protein, 22 aa, Cryptosporidium hominis
REYPIVLIIGWCEKIDMLIKLT

SEQ ID NO: 2196179 - protein, 19 aa, Cryptosporidium hominis
RFAFYKGELPILITTERFL

SEQ ID NO: 2196180 - protein, 19 aa, Cryptosporidium hominis
RFDKPLLSSLLGHSKQISK

SEQ ID NO: 2196181 - protein, 45 aa, Cryptosporidium hominis
RFEDRPDYAYLRRLFKDLFFREGYQYDFIFDWSFLQPEKDRRRTG

SEQ ID NO: 2196182 - protein, 18 aa, Cryptosporidium hominis
RFFSEKKIVWSPIMFTIM

SEQ ID NO: 2196183 - protein, 19 aa, Cryptosporidium hominis
RFHKRKWKMYIDSSKTKIF

SEQ ID NO: 2196184 - protein, 22 aa, Cryptosporidium hominis
RFHSDVLKSRLLTPAVVVNQLK

SEQ ID NO: 2196185 - protein, 19 aa, Cryptosporidium hominis
RFKIFQPDLEEIFKIADIP

SEQ ID NO: 2196186 - protein, 17 aa, Cryptosporidium hominis
RFKIRAQCVLAMKAFEE

SEQ ID NO: 2196187 - protein, 19 aa, Cryptosporidium hominis
RFKKSQGIFMIIRYYLNMN

SEQ ID NO: 2196188 - protein, 17 aa, Cryptosporidium hominis
RFLFEGERLRPEMTAED

SEQ ID NO: 2196189 - protein, 18 aa, Cryptosporidium hominis
RFLSIIEDERQSILLLLG

SEQ ID NO: 2196190 - protein, 17 aa, Cryptosporidium hominis
RFLSKMFHPNIYPDGRI

SEQ ID NO: 2196191 - protein, 18 aa, Cryptosporidium hominis
RFLTQYFKIRKEWKEYNR

SEQ ID NO: 2196192 - protein, 20 aa, Cryptosporidium hominis
RFNDIQTVYKYYGVEAARHC

SEQ ID NO: 2196193 - protein, 19 aa, Cryptosporidium hominis
RFNEALRIYLVVKYNQMSV

SEQ ID NO: 2196194 - protein, 25 aa, Cryptosporidium hominis
RFNQNQSIFLFILTSRVGGVGLNIT

SEQ ID NO: 2196195 - protein, 24 aa, Cryptosporidium hominis
RFPEKSCRFLLDLLQNAESNCDMK

SEQ ID NO: 2196196 - protein, 17 aa, Cryptosporidium hominis
RFPPHVTLERNLTKFLD

SEQ ID NO: 2196197 - protein, 18 aa, Cryptosporidium hominis
RFPTRVNSPRYYNEKKEV

SEQ ID NO: 2196198 - protein, 18 aa, Cryptosporidium hominis
RFPVEIIKDEFESLINPE

SEQ ID NO: 2196199 - protein, 26 aa, Cryptosporidium hominis
RFQRSTELLIRKLPFQRLVREIAQDF

SEQ ID NO: 2196200 - protein, 36 aa, Cryptosporidium hominis
RFQVCQHIACYDCVRLALMIQQRYNVKAHCPFCQIE

SEQ ID NO: 2196201 - protein, 18 aa, Cryptosporidium hominis
RFRCPEALFQPGLLGKEA

SEQ ID NO: 2196202 - protein, 27 aa, Cryptosporidium hominis
RFRGLSKLFKLPKSRSKILIRTLQTCI

SEQ ID NO: 2196203 - protein, 17 aa, Cryptosporidium hominis
RFRLCNNNPPRILICNP

SEQ ID NO: 2196204 - protein, 17 aa, Cryptosporidium hominis
RFRTITSSYYRGAHGII

SEQ ID NO: 2196205 - protein, 21 aa, Cryptosporidium hominis
RFSFDRMLDPKGNTAVYLLYA

SEQ ID NO: 2196206 - protein, 20 aa, Cryptosporidium hominis
RFSTRIFKNALVFVLGEKEN

SEQ ID NO: 2196207 - protein, 17 aa, Cryptosporidium hominis
RFSWLAPCHLVQIECIN

SEQ ID NO: 2196208 - protein, 27 aa, Cryptosporidium hominis
RFTEPKILRFIRVGNQLRRSITVTPLV

SEQ ID NO: 2196209 - protein, 18 aa, Cryptosporidium hominis
RFTMKTILMIADQMLQRV

SEQ ID NO: 2196210 - protein, 26 aa, Cryptosporidium hominis
RFYRQTIHYLSYTPLNKIPYKEKPFL

SEQ ID NO: 2196211 - protein, 17 aa, Cryptosporidium hominis
RGDIEGKILKQLDYNDG

SEQ ID NO: 2196212 - protein, 17 aa, Cryptosporidium hominis
RGDILSMKYVFLGDYVD

SEQ ID NO: 2196213 - protein, 26 aa, Cryptosporidium hominis
RGEHLLEIVVSILSKIFNMYLEKANQ

SEQ ID NO: 2196214 - protein, 32 aa, Cryptosporidium hominis
RGEILKLIQVCLLTIWSQYKGLGAFPVTDGFR

SEQ ID NO: 2196215 - protein, 25 aa, Cryptosporidium hominis
RGELYLTLDELRWVQLHVRPEFGFI

SEQ ID NO: 2196216 - protein, 25 aa, Cryptosporidium hominis
RGGAYNIIHGVFTWSFCKAISDIAT

SEQ ID NO: 2196217 - protein, 29 aa, Cryptosporidium hominis
RGGGAGGNRRWNFGASKEKGRYKQSGNES

SEQ ID NO: 2196218 - protein, 18 aa, Cryptosporidium hominis
RGGILYIVEPTSNTLLYC

SEQ ID NO: 2196219 - protein, 24 aa, Cryptosporidium hominis
RGGRIWFDRHLLFQDNFEPHFTDP

SEQ ID NO: 2196220 - protein, 20 aa, Cryptosporidium hominis
RGHTGLNHLLFTSVGVLNDK

SEQ ID NO: 2196221 - protein, 18 aa, Cryptosporidium hominis
RGIFSIKVKGLSAFWDDE

SEQ ID NO: 2196222 - protein, 18 aa, Cryptosporidium hominis
RGIKLFRTEWGIKYDFWL

SEQ ID NO: 2196223 - protein, 25 aa, Cryptosporidium hominis
RGILNKFIPDVWIYFDKPKKDSLQN

SEQ ID NO: 2196224 - protein, 17 aa, Cryptosporidium hominis
RGIRFNLLDVTLHADAI

SEQ ID NO: 2196225 - protein, 34 aa, Cryptosporidium hominis
RGKHSLQKLLLTFSFEGGIWRVLLGLLREEFNKK

SEQ ID NO: 2196226 - protein, 19 aa, Cryptosporidium hominis
RGKLFDNLFTFIIYETCIE

SEQ ID NO: 2196227 - protein, 19 aa, Cryptosporidium hominis
RGLRPSGDLIPWTLCNHLA

SEQ ID NO: 2196228 - protein, 18 aa, Cryptosporidium hominis
RGLWPNEARLRNLTYSSP

SEQ ID NO: 2196229 - protein, 18 aa, Cryptosporidium hominis
RGLYMSHEHWVLPLSHDE

SEQ ID NO: 2196230 - protein, 20 aa, Cryptosporidium hominis
RGNQIAFRLYMKSTKILPRS

SEQ ID NO: 2196231 - protein, 18 aa, Cryptosporidium hominis
RGPKHLQIKLSRAKYEEL

SEQ ID NO: 2196232 - protein, 22 aa, Cryptosporidium hominis
RGPPLIPPPMMPPGQFPLINPS

SEQ ID NO: 2196233 - protein, 26 aa, Cryptosporidium hominis
RGPSRCPITLWFDQYNMKVVLEDFDT

SEQ ID NO: 2196234 - protein, 24 aa, Cryptosporidium hominis
RGQQLRHKYFGQQKLYGFPSNMSN

SEQ ID NO: 2196235 - protein, 21 aa, Cryptosporidium hominis
RGRPCRIMWCLRDPASRRNND

SEQ ID NO: 2196236 - protein, 17 aa, Cryptosporidium hominis
RGRQIKVSTKRKNIPGY

SEQ ID NO: 2196237 - protein, 18 aa, Cryptosporidium hominis
RGRYKQRYNNKRSRNGIT

SEQ ID NO: 2196238 - protein, 17 aa, Cryptosporidium hominis
RGSDRRGLSSGAVGTIG

SEQ ID NO: 2196239 - protein, 28 aa, Cryptosporidium hominis
RGSNRYKLLYGKTIKWLGSNTPLHIAAF

SEQ ID NO: 2196240 - protein, 17 aa, Cryptosporidium hominis
RGTLRFVVKLVPNQQNP

SEQ ID NO: 2196241 - protein, 31 aa, Cryptosporidium hominis
RGVDIPMIKYVINFDFPLSPKLFVHRTGRTA

SEQ ID NO: 2196242 - protein, 23 aa, Cryptosporidium hominis
RGVELYCIHPSGSCYKYCAMAVG

SEQ ID NO: 2196243 - protein, 25 aa, Cryptosporidium hominis
RGVNSYLFAQPAWKNVSSAAQHFVQ

SEQ ID NO: 2196244 - protein, 24 aa, Cryptosporidium hominis
RGVPQDFRWKIWNSLLQISSLDDE

SEQ ID NO: 2196245 - protein, 22 aa, Cryptosporidium hominis
RGYAFVTFKTIESALLACKNPV

SEQ ID NO: 2196246 - protein, 31 aa, Cryptosporidium hominis
RGYHNKVLLKRRKIVYITAGFNGCTSVKTCP

SEQ ID NO: 2196247 - protein, 18 aa, Cryptosporidium hominis
RGYHTYCLDPPLDSVPSG

SEQ ID NO: 2196248 - protein, 25 aa, Cryptosporidium hominis
RGYILEVMLTKVRLLSKLQGEGRTI

SEQ ID NO: 2196249 - protein, 20 aa, Cryptosporidium hominis
RGYVLRRILRRAIRYGSQYL

SEQ ID NO: 2196250 - protein, 18 aa, Cryptosporidium hominis
RHEIASFGSLNSVIWGSD

SEQ ID NO: 2196251 - protein, 27 aa, Cryptosporidium hominis
RHEKSLGICINFILNKSNLTDEQFDEI

SEQ ID NO: 2196252 - protein, 17 aa, Cryptosporidium hominis
RHISTLFPGFNCPEAID

SEQ ID NO: 2196253 - protein, 25 aa, Cryptosporidium hominis
RHIYRKWIDWKPDPSIYIQYSKFEE

SEQ ID NO: 2196254 - protein, 34 aa, Cryptosporidium hominis
RHKKSLNILLQSFPQLILPPNGSLVPLLRLAPMV

SEQ ID NO: 2196255 - protein, 23 aa, Cryptosporidium hominis
RHKSEPLFEKLKFISVFTNDGNI

SEQ ID NO: 2196256 - protein, 23 aa, Cryptosporidium hominis
RHLAEFWMIEPEMAFADLSDNMK

SEQ ID NO: 2196257 - protein, 23 aa, Cryptosporidium hominis
RHPGALIRRPVRPEIRLIDFGAA

SEQ ID NO: 2196258 - protein, 25 aa, Cryptosporidium hominis
RHPNICSYIGVCLEPGFYAIITEYL

SEQ ID NO: 2196259 - protein, 22 aa, Cryptosporidium hominis
RHPQLIYETKVLKLLQGGVGIA

SEQ ID NO: 2196260 - protein, 18 aa, Cryptosporidium hominis
RHPQPILPFHMVQTTAPT

SEQ ID NO: 2196261 - protein, 32 aa, Cryptosporidium hominis
RHRIGRAMGKHMRMSVLGLLSIRGVEKQFQAI

SEQ ID NO: 2196262 - protein, 24 aa, Cryptosporidium hominis
RHSELAFKPLVLSAVENRRATAPD

SEQ ID NO: 2196263 - protein, 19 aa, Cryptosporidium hominis
RHVLRNISTQVLRTKKPIF

SEQ ID NO: 2196264 - protein, 18 aa, Cryptosporidium hominis
RIAMFSWESLYTHSVGGV

SEQ ID NO: 2196265 - protein, 25 aa, Cryptosporidium hominis
RIATRPFHKIFSISVIKFLRTCLGT

SEQ ID NO: 2196266 - protein, 27 aa, Cryptosporidium hominis
RIDADYTDLLWSFLVSIRDENLIFKIV

SEQ ID NO: 2196267 - protein, 17 aa, Cryptosporidium hominis
RIDILDPILGKISKVDF

SEQ ID NO: 2196268 - protein, 28 aa, Cryptosporidium hominis
RIEDNPMKLLELSNWISVLLEGIARQVV

SEQ ID NO: 2196269 - protein, 27 aa, Cryptosporidium hominis
RIEGDIPYRVFIKGKMYPGLAMSRAIG

SEQ ID NO: 2196270 - protein, 25 aa, Cryptosporidium hominis
RIEKSSNEILPWSKGIISIDGLASK

SEQ ID NO: 2196271 - protein, 22 aa, Cryptosporidium hominis
RIENLLFHYMKRFVIGLSIDKI

SEQ ID NO: 2196272 - protein, 26 aa, Cryptosporidium hominis
RIENRGRAHERSEFKYLRSNVKNHSR

SEQ ID NO: 2196273 - protein, 25 aa, Cryptosporidium hominis
RIERQRLELPGPGTPVTFETFMEWK

SEQ ID NO: 2196274 - protein, 18 aa, Cryptosporidium hominis
RIEYFGRFKLDILDSNHL

SEQ ID NO: 2196275 - protein, 17 aa, Cryptosporidium hominis
RIFFKSITYSSDPYKVL

SEQ ID NO: 2196276 - protein, 18 aa, Cryptosporidium hominis
RIFLELLGARRFQVNVTW

SEQ ID NO: 2196277 - protein, 18 aa, Cryptosporidium hominis
RIFLFFNNNTITFDEALE

SEQ ID NO: 2196278 - protein, 21 aa, Cryptosporidium hominis
RIFNRGYLISSNLVRTWLNRS

SEQ ID NO: 2196279 - protein, 31 aa, Cryptosporidium hominis
RIGPSSFRINPYLPAVVEWQYNTIIREIDQE

SEQ ID NO: 2196280 - protein, 20 aa, Cryptosporidium hominis
RIGVFDLLEGKINFLPGIAG

SEQ ID NO: 2196281 - protein, 19 aa, Cryptosporidium hominis
RIHSSLIGSLSWTVPTDKD

SEQ ID NO: 2196282 - protein, 18 aa, Cryptosporidium hominis
RIIALIRQKKLVTEGIAH

SEQ ID NO: 2196283 - protein, 17 aa, Cryptosporidium hominis
RIIHPQCMCLCPTRELA

SEQ ID NO: 2196284 - protein, 28 aa, Cryptosporidium hominis
RIISTVIEAVRQFGFKIDIEYIKEFINN

SEQ ID NO: 2196285 - protein, 37 aa, Cryptosporidium hominis
RIIYTGDVSFLLKLHAYLEFWGLINFQADIKTLPPKL

SEQ ID NO: 2196286 - protein, 18 aa, Cryptosporidium hominis
RIKRIRGISWYTGSASAQ

SEQ ID NO: 2196287 - protein, 19 aa, Cryptosporidium hominis
RILATWEFGMITGNISFKN

SEQ ID NO: 2196288 - protein, 31 aa, Cryptosporidium hominis
RILDIGCGNGLFLIDLIRNINFSSAVGIDYI

SEQ ID NO: 2196289 - protein, 20 aa, Cryptosporidium hominis
RILDPELRFFHSKRIFYRNN

SEQ ID NO: 2196290 - protein, 21 aa, Cryptosporidium hominis
RILINEWKKLRWSNKLNLVIN

SEQ ID NO: 2196291 - protein, 20 aa, Cryptosporidium hominis
RILNKWQPLIFSGDIIFQDK

SEQ ID NO: 2196292 - protein, 20 aa, Cryptosporidium hominis
RILQILSFISQKCWKYLFGH

SEQ ID NO: 2196293 - protein, 17 aa, Cryptosporidium hominis
RILYRINCLIVDDLLEF

SEQ ID NO: 2196294 - protein, 21 aa, Cryptosporidium hominis
RINELILNKYIYSSSNFESNS

SEQ ID NO: 2196295 - protein, 35 aa, Cryptosporidium hominis
RINENLLNYFINLPESIWLSGFLDQVNLKDVMLNT

SEQ ID NO: 2196296 - protein, 25 aa, Cryptosporidium hominis
RINEYEIWLVTEYIRTGDLFKLIHG

SEQ ID NO: 2196297 - protein, 22 aa, Cryptosporidium hominis
RINHLRSRFIYTKYYLDKEISR

SEQ ID NO: 2196298 - protein, 24 aa, Cryptosporidium hominis
RIPSVFRIVYILPEYAKALLKSYK

SEQ ID NO: 2196299 - protein, 18 aa, Cryptosporidium hominis
RIQELRDLLLKLIDLEIV

SEQ ID NO: 2196300 - protein, 25 aa, Cryptosporidium hominis
RIRDRNMVRFIQWGPAAIQVALSKY

SEQ ID NO: 2196301 - protein, 20 aa, Cryptosporidium hominis
RIRGACLLEYKFIIGKETEP

SEQ ID NO: 2196302 - protein, 25 aa, Cryptosporidium hominis
RIRGGAVPPVLRPGAIPPGPPGVHG

SEQ ID NO: 2196303 - protein, 30 aa, Cryptosporidium hominis
RIRPNTQLQWLFIDKWPHLVVLTIPGIEIK

SEQ ID NO: 2196304 - protein, 20 aa, Cryptosporidium hominis
RIRSNQWITNTFVRSFTMPT

SEQ ID NO: 2196305 - protein, 24 aa, Cryptosporidium hominis
RISDDWRWLALKSEKRLNNMKKMN

SEQ ID NO: 2196306 - protein, 17 aa, Cryptosporidium hominis
RISPTIKTLGCLNKSNK

SEQ ID NO: 2196307 - protein, 34 aa, Cryptosporidium hominis
RISSLLTSLVNKIVFLLVLKHDTWYVHQEARDGL

SEQ ID NO: 2196308 - protein, 24 aa, Cryptosporidium hominis
RITIYITLQVVFILENLKSHFSSN

SEQ ID NO: 2196309 - protein, 24 aa, Cryptosporidium hominis
RITKNFGFLSNELARTLTIKLLDT

SEQ ID NO: 2196310 - protein, 24 aa, Cryptosporidium hominis
RITTLCVIPNYILLLFGRNIENEL

SEQ ID NO: 2196311 - protein, 28 aa, Cryptosporidium hominis
RIVISGLRCPIPIYIKKHIFVMSYIGDG

SEQ ID NO: 2196312 - protein, 26 aa, Cryptosporidium hominis
RIVKEVVFENIFFKNKKYSHLESFKI

SEQ ID NO: 2196313 - protein, 35 aa, Cryptosporidium hominis
RIVKLTFGFGDNTFYLIFEFFVAGNIILTDCNYKI

SEQ ID NO: 2196314 - protein, 29 aa, Cryptosporidium hominis
RIYHGNLFIVRNLLYLKYELINLSRQNNG

SEQ ID NO: 2196315 - protein, 23 aa, Cryptosporidium hominis
RIYHRLKKHLLTFSKSSYQQNSK

SEQ ID NO: 2196316 - protein, 17 aa, Cryptosporidium hominis
RIYLIDCPGIVPPENAS

SEQ ID NO: 2196317 - protein, 19 aa, Cryptosporidium hominis
RIYPKYPLDVTWRHDLFVK

SEQ ID NO: 2196318 - protein, 32 aa, Cryptosporidium hominis
RIYRQNFRLLVFTTRLFLLFIQEMCGGIVEEN

SEQ ID NO: 2196319 - protein, 34 aa, Cryptosporidium hominis
RKASFSIQSRWRSFQIRKSFLAILGSRTQAARVI

SEQ ID NO: 2196320 - protein, 26 aa, Cryptosporidium hominis
RKATPFLCLLVKLLQIRPSTEIVLEY

SEQ ID NO: 2196321 - protein, 25 aa, Cryptosporidium hominis
RKATRLVDQLLIKTSNDFSNLEGAA

SEQ ID NO: 2196322 - protein, 27 aa, Cryptosporidium hominis
RKCPVDYLRLLLKNIIFIGGSSINSLL

SEQ ID NO: 2196323 - protein, 18 aa, Cryptosporidium hominis
RKEFQGRPTPIYYAKNLT

SEQ ID NO: 2196324 - protein, 24 aa, Cryptosporidium hominis
RKEGPIWILLIRTSKGRYESKIQC

SEQ ID NO: 2196325 - protein, 23 aa, Cryptosporidium hominis
RKEKLFVFGNDWPTRDGTGVRDY

SEQ ID NO: 2196326 - protein, 24 aa, Cryptosporidium hominis
RKEKSAKWQVPIPKIKALNEDEMF

SEQ ID NO: 2196327 - protein, 23 aa, Cryptosporidium hominis
RKEPNLGFKSLISSGIKVNVAEL

SEQ ID NO: 2196328 - protein, 43 aa, Cryptosporidium hominis
RKESDIIVIKTLVVALYRNDLVKKLVIYISKNLNPKPEKYLED

SEQ ID NO: 2196329 - protein, 22 aa, Cryptosporidium hominis
RKETSLLYKNEYVKDFLENYHL

SEQ ID NO: 2196330 - protein, 19 aa, Cryptosporidium hominis
RKEYRRELLDNSLRKFEMD

SEQ ID NO: 2196331 - protein, 18 aa, Cryptosporidium hominis
RKGQRRLNKLSGKFPFIN

SEQ ID NO: 2196332 - protein, 22 aa, Cryptosporidium hominis
RKHSRICLFCKGFKRPIQHISK

SEQ ID NO: 2196333 - protein, 23 aa, Cryptosporidium hominis
RKIAPPETLKFLEKVRVIWKHDN

SEQ ID NO: 2196334 - protein, 30 aa, Cryptosporidium hominis
RKILARVRELWLSNIVEGLPRKIAAFILQR

SEQ ID NO: 2196335 - protein, 24 aa, Cryptosporidium hominis
RKKFISESIYIRPDIYHINQENKK

SEQ ID NO: 2196336 - protein, 24 aa, Cryptosporidium hominis
RKKIHNWLCFSTALWYRCYAEHHR

SEQ ID NO: 2196337 - protein, 22 aa, Cryptosporidium hominis
RKKIHTLIKEFVPFITSRTVEN

SEQ ID NO: 2196338 - protein, 25 aa, Cryptosporidium hominis
RKKLPIINIPKLTRGFPVMGEQSVT

SEQ ID NO: 2196339 - protein, 26 aa, Cryptosporidium hominis
RKKNFESNFIFDLWSFLNGGGGNGNT

SEQ ID NO: 2196340 - protein, 19 aa, Cryptosporidium hominis
RKKVNLRGTIYSIPKPKRG

SEQ ID NO: 2196341 - protein, 26 aa, Cryptosporidium hominis
RKKVWPAVIVRQRKAFRRPEGTFLYF

SEQ ID NO: 2196342 - protein, 18 aa, Cryptosporidium hominis
RKLVILYGNLSFPSKMIG

SEQ ID NO: 2196343 - protein, 20 aa, Cryptosporidium hominis
RKMWQVSESVSKFLFSAKSK

SEQ ID NO: 2196344 - protein, 29 aa, Cryptosporidium hominis
RKNHTFTLCQLILKKPRLRDIKQLQYTVE

SEQ ID NO: 2196345 - protein, 25 aa, Cryptosporidium hominis
RKPPKLERYIRPTGLRFKKAHVTHP

SEQ ID NO: 2196346 - protein, 22 aa, Cryptosporidium hominis
RKPYIFKIAALRDIRNLFPIYR

SEQ ID NO: 2196347 - protein, 26 aa, Cryptosporidium hominis
RKQSDILRFLMRVRSWEYRQLPAVMR

SEQ ID NO: 2196348 - protein, 22 aa, Cryptosporidium hominis
RKRPILCITVGLGFDSFIVVRN

SEQ ID NO: 2196349 - protein, 38 aa, Cryptosporidium hominis
RKRYSDFEWLRSTLVIQFPGVFIPPIPKKKKVGRFEKD

SEQ ID NO: 2196350 - protein, 23 aa, Cryptosporidium hominis
RKSDWIRIIHRLGVFGLTPSWSS

SEQ ID NO: 2196351 - protein, 18 aa, Cryptosporidium hominis
RKSIERGRSKERVKRNYE

SEQ ID NO: 2196352 - protein, 24 aa, Cryptosporidium hominis
RKSLDRTFYLFFEDSKIPLSKVLG

SEQ ID NO: 2196353 - protein, 22 aa, Cryptosporidium hominis
RKSLEEVVIFPNQNLWLQEEKT

SEQ ID NO: 2196354 - protein, 21 aa, Cryptosporidium hominis
RKSRLILNRHPLVLTINGCIG

SEQ ID NO: 2196355 - protein, 19 aa, Cryptosporidium hominis
RKSSFLNASKWLEDIKQNS

SEQ ID NO: 2196356 - protein, 17 aa, Cryptosporidium hominis
RKSSKFVLSFKKSSDDI

SEQ ID NO: 2196357 - protein, 54 aa, Cryptosporidium hominis
RKSTFLTRDKFLQLLLCIPYWNGNIPPPAILRPQPLWTGKQIITVLLAFTTDLG

SEQ ID NO: 2196358 - protein, 28 aa, Cryptosporidium hominis
RKSWVRLYIEIIGIMYIMFNECHLIHGD

SEQ ID NO: 2196359 - protein, 26 aa, Cryptosporidium hominis
RKTQDLAFQIFQGLKIIHEKGLVHAD

SEQ ID NO: 2196360 - protein, 18 aa, Cryptosporidium hominis
RKVILDNLILMTKTIIYF

SEQ ID NO: 2196361 - protein, 22 aa, Cryptosporidium hominis
RKVLYHKDLLPIEKEYLEYKSI

SEQ ID NO: 2196362 - protein, 18 aa, Cryptosporidium hominis
RKVVFIQTLYLNDVNHIL

SEQ ID NO: 2196363 - protein, 19 aa, Cryptosporidium hominis
RKVVSDLLICPICEGFFRG

SEQ ID NO: 2196364 - protein, 25 aa, Cryptosporidium hominis
RKWRTLWCWTHIYVHYKRAQIYTRN

SEQ ID NO: 2196365 - protein, 27 aa, Cryptosporidium hominis
RKYLCYKYKFMLVPSILILVIKNEITF

SEQ ID NO: 2196366 - protein, 19 aa, Cryptosporidium hominis
RKYQVEKSLYYFAVVECDC

SEQ ID NO: 2196367 - protein, 26 aa, Cryptosporidium hominis
RKYSAKLEMLFRKNFIRNLHEVEEIF

SEQ ID NO: 2196368 - protein, 20 aa, Cryptosporidium hominis
RKYVKDGLVPDLPKFYSSEL

SEQ ID NO: 2196369 - protein, 19 aa, Cryptosporidium hominis
RKYYPGEEIPILSIMGDGN

SEQ ID NO: 2196370 - protein, 32 aa, Cryptosporidium hominis
RLCNNNPPRILICNPLKYLILERDSQIIIFDL

SEQ ID NO: 2196371 - protein, 18 aa, Cryptosporidium hominis
RLDLLDEALLRPGRFEVQ

SEQ ID NO: 2196372 - protein, 17 aa, Cryptosporidium hominis
RLDSYFSIVVRNIRDSV

SEQ ID NO: 2196373 - protein, 30 aa, Cryptosporidium hominis
RLEPLQSLRTPCRPHRLVRRRGRGGRIWFD

SEQ ID NO: 2196374 - protein, 21 aa, Cryptosporidium hominis
RLFDMGFAPQLLSIISIIRPD

SEQ ID NO: 2196375 - protein, 18 aa, Cryptosporidium hominis
RLFQIAIGKGTRAYQNFL

SEQ ID NO: 2196376 - protein, 34 aa, Cryptosporidium hominis
RLGNEDIWRNIFGLIWVIFYTKPFKPKDFVWKNI

SEQ ID NO: 2196377 - protein, 20 aa, Cryptosporidium hominis
RLHNEVCKLLTGTDLILIKS

SEQ ID NO: 2196378 - protein, 18 aa, Cryptosporidium hominis
RLIINPKVLLLDCTLEYK

SEQ ID NO: 2196379 - protein, 20 aa, Cryptosporidium hominis
RLIKTLLSPNSNRIGYKTFL

SEQ ID NO: 2196380 - protein, 23 aa, Cryptosporidium hominis
RLKEYLKNMSPYFKDNLEVDIGL

SEQ ID NO: 2196381 - protein, 23 aa, Cryptosporidium hominis
RLKEYQIVGVSWLLALHQNSYNG

SEQ ID NO: 2196382 - protein, 28 aa, Cryptosporidium hominis
RLKNCFDIISFLNIVYDLSPMLTQRDAN

SEQ ID NO: 2196383 - protein, 25 aa, Cryptosporidium hominis
RLKNDLKLIQIFERETKSMGTLEII

SEQ ID NO: 2196384 - protein, 26 aa, Cryptosporidium hominis
RLKPEFIKDLLLIQINSFWSSSSRYK

SEQ ID NO: 2196385 - protein, 19 aa, Cryptosporidium hominis
RLKSILFINWRRYSKKQRI

SEQ ID NO: 2196386 - protein, 17 aa, Cryptosporidium hominis
RLLDWVIFTCNENLRPA

SEQ ID NO: 2196387 - protein, 20 aa, Cryptosporidium hominis
RLLEAGIKPVFVFDGAPPEM

SEQ ID NO: 2196388 - protein, 21 aa, Cryptosporidium hominis
RLLEETMLILYRFTGTELQDM

SEQ ID NO: 2196389 - protein, 18 aa, Cryptosporidium hominis
RLLTFINRSIEGSGILRI

SEQ ID NO: 2196390 - protein, 20 aa, Cryptosporidium hominis
RLMDKFIQMYVLCPNCELPE

SEQ ID NO: 2196391 - protein, 21 aa, Cryptosporidium hominis
RLNELLQSEIFSRKSMEQRLI

SEQ ID NO: 2196392 - protein, 31 aa, Cryptosporidium hominis
RLNNRLRANGFLSIPFLPDLTSPARSLILNR

SEQ ID NO: 2196393 - protein, 23 aa, Cryptosporidium hominis
RLNSFLLNHLPRLNWINVDISTL

SEQ ID NO: 2196394 - protein, 32 aa, Cryptosporidium hominis
RLNSHQYKLQIFKFLNLKIPIKCDDQIYLYLG

SEQ ID NO: 2196395 - protein, 26 aa, Cryptosporidium hominis
RLNTGALIVLYWVLGDNYLAWIMEDI

SEQ ID NO: 2196396 - protein, 39 aa, Cryptosporidium hominis
RLQPKVLSLTRRLWQKGIRSEYRLTPVRSLAIFLEKLKK

SEQ ID NO: 2196397 - protein, 31 aa, Cryptosporidium hominis
RLQQPLEFWRRITYLTYFNNCKFGILGTKDE

SEQ ID NO: 2196398 - protein, 21 aa, Cryptosporidium hominis
RLQSIYLLEPAGSRGVWGLDD

SEQ ID NO: 2196399 - protein, 26 aa, Cryptosporidium hominis
RLRTDLIDYIWTIEDFPLLRTLAMQR

SEQ ID NO: 2196400 - protein, 18 aa, Cryptosporidium hominis
RLSWQQILALGKSTEKIV

SEQ ID NO: 2196401 - protein, 19 aa, Cryptosporidium hominis
RLTEIFSEYGLNGCDIKKK

SEQ ID NO: 2196402 - protein, 31 aa, Cryptosporidium hominis
RLTLQYSQILLRLYFELLRQGGSSEESILSL

SEQ ID NO: 2196403 - protein, 25 aa, Cryptosporidium hominis
RLTNTILKIVIIPAINQGVPNPLPE

SEQ ID NO: 2196404 - protein, 20 aa, Cryptosporidium hominis
RLTNYRFSFDRMLDPKGNTA

SEQ ID NO: 2196405 - protein, 23 aa, Cryptosporidium hominis
RLVEKSFFSKFFKLKVKSDISRY

SEQ ID NO: 2196406 - protein, 23 aa, Cryptosporidium hominis
RLVFHLKYINYLLNNIWILHQTS

SEQ ID NO: 2196407 - protein, 25 aa, Cryptosporidium hominis
RLVNILVDALKWTISAREAILLLPR

SEQ ID NO: 2196408 - protein, 18 aa, Cryptosporidium hominis
RLVVQLLEISYKLLNEWN

SEQ ID NO: 2196409 - protein, 17 aa, Cryptosporidium hominis
RLYEELYNKFQTCKNDI

SEQ ID NO: 2196410 - protein, 19 aa, Cryptosporidium hominis
RLYIGTFYRNFEKISELSL

SEQ ID NO: 2196411 - protein, 18 aa, Cryptosporidium hominis
RLYRLKENLKRLKIDKNA

SEQ ID NO: 2196412 - protein, 19 aa, Cryptosporidium hominis
RMAREFLDLQWATQFKEYG

SEQ ID NO: 2196413 - protein, 17 aa, Cryptosporidium hominis
RMASYTIGLRQYATSNF

SEQ ID NO: 2196414 - protein, 25 aa, Cryptosporidium hominis
RMDHKFDLMYSKRAFVHWYVGEGME

SEQ ID NO: 2196415 - protein, 25 aa, Cryptosporidium hominis
RMDKFTFLQRTMLAESLNLLSKKNF

SEQ ID NO: 2196416 - protein, 20 aa, Cryptosporidium hominis
RMILRDYWSGKLLYCHTPPS

SEQ ID NO: 2196417 - protein, 19 aa, Cryptosporidium hominis
RMISRLKQIAIGKSLPEYK

SEQ ID NO: 2196418 - protein, 18 aa, Cryptosporidium hominis
RMLDMGFAPQIREIVEDS

SEQ ID NO: 2196419 - protein, 18 aa, Cryptosporidium hominis
RMLKHRIPGDCRVGSTAS

SEQ ID NO: 2196420 - protein, 18 aa, Cryptosporidium hominis
RMLNIISEFLVLRGFRHQ

SEQ ID NO: 2196421 - protein, 19 aa, Cryptosporidium hominis
RMLSRGLIPGEKLLGELFG

SEQ ID NO: 2196422 - protein, 31 aa, Cryptosporidium hominis
RMLTNRVVTLWYRPPELLLGAQFYDTPVDMW

SEQ ID NO: 2196423 - protein, 27 aa, Cryptosporidium hominis
RMNEYYLYNKWLIWCKKAYDRIEWVHD

SEQ ID NO: 2196424 - protein, 18 aa, Cryptosporidium hominis
RMQIINLRNKISMTDLDE

SEQ ID NO: 2196425 - protein, 23 aa, Cryptosporidium hominis
RMRQPGCLLKYLIINELEVKKAF

SEQ ID NO: 2196426 - protein, 25 aa, Cryptosporidium hominis
RMVLFVAYVLEFWRKSRNSEKIPFK

SEQ ID NO: 2196427 - protein, 23 aa, Cryptosporidium hominis
RMVRDVFRLARENSPAIVFIDEV

SEQ ID NO: 2196428 - protein, 17 aa, Cryptosporidium hominis
RNARQRKIKGMRLTPSE

SEQ ID NO: 2196429 - protein, 17 aa, Cryptosporidium hominis
RNAVNLQGTTGLPIHCF

SEQ ID NO: 2196430 - protein, 18 aa, Cryptosporidium hominis
RNDHFPSEKLYKPSINNS

SEQ ID NO: 2196431 - protein, 23 aa, Cryptosporidium hominis
RNDLCVIMTGIPYIDKKNFLRLM

SEQ ID NO: 2196432 - protein, 24 aa, Cryptosporidium hominis
RNECINVLPRFDVLYSRKNNPFIC

SEQ ID NO: 2196433 - protein, 17 aa, Cryptosporidium hominis
RNEFSYFYPLDCRVSGK

SEQ ID NO: 2196434 - protein, 22 aa, Cryptosporidium hominis
RNEIRIMNLLRHPNIVQYMGGN

SEQ ID NO: 2196435 - protein, 28 aa, Cryptosporidium hominis
RNEKGINILRPFLPRLLICLLENSIFTD

SEQ ID NO: 2196436 - protein, 29 aa, Cryptosporidium hominis
RNELVQVGLFDLLDQFFSDLWSTGMAYKI

SEQ ID NO: 2196437 - protein, 27 aa, Cryptosporidium hominis
RNEVRSFLLGAAYHWLRRYHIDGLRID

SEQ ID NO: 2196438 - protein, 17 aa, Cryptosporidium hominis
RNFIRTVTKIRGEWLLE

SEQ ID NO: 2196439 - protein, 22 aa, Cryptosporidium hominis
RNFWKRPNYVNKYRNIDSLYDY

SEQ ID NO: 2196440 - protein, 19 aa, Cryptosporidium hominis
RNHDVILVKKVFRKNQNNL

SEQ ID NO: 2196441 - protein, 21 aa, Cryptosporidium hominis
RNHGYSPYRKIQESELINMIS

SEQ ID NO: 2196442 - protein, 21 aa, Cryptosporidium hominis
RNHHYFPIRNDPPNPFIHHQI

SEQ ID NO: 2196443 - protein, 19 aa, Cryptosporidium hominis
RNHLQKVQEWCSLGIRTLE

SEQ ID NO: 2196444 - protein, 19 aa, Cryptosporidium hominis
RNHPPYYGYVRRSINRKPG

SEQ ID NO: 2196445 - protein, 26 aa, Cryptosporidium hominis
RNHSNYRHSWVFPPDFPCFDAIHAMK

SEQ ID NO: 2196446 - protein, 24 aa, Cryptosporidium hominis
RNHVFPYGELLLPNPQVSKLINAV

SEQ ID NO: 2196447 - protein, 22 aa, Cryptosporidium hominis
RNIAKMSGPEWKCPFGSEIFTG

SEQ ID NO: 2196448 - protein, 25 aa, Cryptosporidium hominis
RNIRKVPFPILILHGTNDQVIHISN

SEQ ID NO: 2196449 - protein, 17 aa, Cryptosporidium hominis
RNKIIEIYRETPRQYLT

SEQ ID NO: 2196450 - protein, 43 aa, Cryptosporidium hominis
RNKKFEFVLKIFPVSIDVFLSNRLIWDLFGECTLENLFDINKE

SEQ ID NO: 2196451 - protein, 27 aa, Cryptosporidium hominis
RNKLGCDILYSFKFSPLKNIIIENQQK

SEQ ID NO: 2196452 - protein, 18 aa, Cryptosporidium hominis
RNKQLLLHTFIEDPLRPE

SEQ ID NO: 2196453 - protein, 22 aa, Cryptosporidium hominis
RNKTIAFDVKWPIIANISDLIS

SEQ ID NO: 2196454 - protein, 19 aa, Cryptosporidium hominis
RNLEFLPNINRLSNEPIDI

SEQ ID NO: 2196455 - protein, 27 aa, Cryptosporidium hominis
RNLGFSYRRTFSEFIYQFKYCDMSAAN

SEQ ID NO: 2196456 - protein, 30 aa, Cryptosporidium hominis
RNLLRRLHSVLRPFLLRRLKKDVEKEMPSK

SEQ ID NO: 2196457 - protein, 24 aa, Cryptosporidium hominis
RNLNEYYNGRQLLGFIGDICEKEN

SEQ ID NO: 2196458 - protein, 21 aa, Cryptosporidium hominis
RNLRFEEYGLFWKTIPEKNGN

SEQ ID NO: 2196459 - protein, 27 aa, Cryptosporidium hominis
RNLRGWIEVLKRIPLYNPSNPGGIIPN

SEQ ID NO: 2196460 - protein, 25 aa, Cryptosporidium hominis
RNLVYVVGLSYSIAKREILSCENSF

SEQ ID NO: 2196461 - protein, 28 aa, Cryptosporidium hominis
RNNDRIYLNKLNSLFFLKRLIGEKNVHN

SEQ ID NO: 2196462 - protein, 23 aa, Cryptosporidium hominis
RNNRNVISLALNWISLSGEHNKK

SEQ ID NO: 2196463 - protein, 23 aa, Cryptosporidium hominis
RNQIDSYEYLFFGSDPGNKSNST

SEQ ID NO: 2196464 - protein, 27 aa, Cryptosporidium hominis
RNQLTKLDFPLFRAGTTSIECGMSLME

SEQ ID NO: 2196465 - protein, 17 aa, Cryptosporidium hominis
RNSKLTMVLKNSLGGNS

SEQ ID NO: 2196466 - protein, 24 aa, Cryptosporidium hominis
RNSWMHIFSFDSAIPRSNQRETIG

SEQ ID NO: 2196467 - protein, 17 aa, Cryptosporidium hominis
RNTFDQNTLQKILMSCK

SEQ ID NO: 2196468 - protein, 29 aa, Cryptosporidium hominis
RNTHNFSWVSVYFQMLIGSTPLLIRGCHN

SEQ ID NO: 2196469 - protein, 32 aa, Cryptosporidium hominis
RNTIWTYSEIRMFIEKYLMYPKDFRRIASFME

SEQ ID NO: 2196470 - protein, 18 aa, Cryptosporidium hominis
RNTLHPRSDLVMMSTLTE

SEQ ID NO: 2196471 - protein, 19 aa, Cryptosporidium hominis
RNTTVPKTPKFATQMRSES

SEQ ID NO: 2196472 - protein, 20 aa, Cryptosporidium hominis
RNTWLSLCLSNKGSLYNFSL

SEQ ID NO: 2196473 - protein, 22 aa, Cryptosporidium hominis
RNVQSIAKFLKKASFQSIVISL

SEQ ID NO: 2196474 - protein, 24 aa, Cryptosporidium hominis
RNWNDAFILQLFKSKNPNGFIKGI

SEQ ID NO: 2196475 - protein, 51 aa, Cryptosporidium hominis
RNYNIPIEKVVWDYLHFLYRQNTGVLGYLAPYIDESFNIGKFHCLVTEFCK

SEQ ID NO: 2196476 - protein, 24 aa, Cryptosporidium hominis
RPDKEPCIRIIKRIKQRISEVNGL

SEQ ID NO: 2196477 - protein, 24 aa, Cryptosporidium hominis
RPEKVLWMRRQRVLRRLLRKYRES

SEQ ID NO: 2196478 - protein, 29 aa, Cryptosporidium hominis
RPETYVPLEIKTSIFAAYFAAEPVVIHFS

SEQ ID NO: 2196479 - protein, 19 aa, Cryptosporidium hominis
RPFEYLRLTSLGVIGALVK

SEQ ID NO: 2196480 - protein, 29 aa, Cryptosporidium hominis
RPLPVNVCYIKLTFNWPGARLVRDLWALD

SEQ ID NO: 2196481 - protein, 25 aa, Cryptosporidium hominis
RPNKGFRLFLATELPKKILNPSHKD

SEQ ID NO: 2196482 - protein, 30 aa, Cryptosporidium hominis
RPRYRNGKKVPPPLPPYLYSQNQCITASKP

SEQ ID NO: 2196483 - protein, 17 aa, Cryptosporidium hominis
RPSSFLVSNGGLWDSSP

SEQ ID NO: 2196484 - protein, 17 aa, Cryptosporidium hominis
RPVLSCFACGRTSGIVV

SEQ ID NO: 2196485 - protein, 22 aa, Cryptosporidium hominis
RPVPLREHIIIKGKAYIKPGKD

SEQ ID NO: 2196486 - protein, 33 aa, Cryptosporidium hominis
RQAARPVISYTFKQLRHSLLPKHFKSHKRNSTY

SEQ ID NO: 2196487 - protein, 17 aa, Cryptosporidium hominis
RQCYRLQFKGSDGKWYF

SEQ ID NO: 2196488 - protein, 22 aa, Cryptosporidium hominis
RQEQIRLLKKAAEISRPLSLQA

SEQ ID NO: 2196489 - protein, 23 aa, Cryptosporidium hominis
RQERSQICNKLHSVWKGYKTRSI

SEQ ID NO: 2196490 - protein, 29 aa, Cryptosporidium hominis
RQGEYVASFKCTLLLLPNGSKRISGLQFT

SEQ ID NO: 2196491 - protein, 22 aa, Cryptosporidium hominis
RQGSKFEYKLSKSTTKIENNTA

SEQ ID NO: 2196492 - protein, 29 aa, Cryptosporidium hominis
RQIARLLVLISFFRYLPNPLPKIESNIED

SEQ ID NO: 2196493 - protein, 33 aa, Cryptosporidium hominis
RQKGNFIHFVKDRLYLMIKIIKVDNIITFENLE

SEQ ID NO: 2196494 - protein, 24 aa, Cryptosporidium hominis
RQKILNLSLKLQNGFKLLLELVQY

SEQ ID NO: 2196495 - protein, 34 aa, Cryptosporidium hominis
RQKQLIIQRSLVKLSLREKPVYRILACYNSIVFG

SEQ ID NO: 2196496 - protein, 24 aa, Cryptosporidium hominis
RQKRSPYLIGKFISLNFVSDSSKE

SEQ ID NO: 2196497 - protein, 24 aa, Cryptosporidium hominis
RQKSYRCICYISTPIYIHEYHEIS

SEQ ID NO: 2196498 - protein, 27 aa, Cryptosporidium hominis
RQLGTATYLIDFLALRVGGEKDTDEEA

SEQ ID NO: 2196499 - protein, 28 aa, Cryptosporidium hominis
RQLNTRFRLLLTGTPLQNSLRELWSLLN

SEQ ID NO: 2196500 - protein, 18 aa, Cryptosporidium hominis
RQLRYEVNNLRKKLLETY

SEQ ID NO: 2196501 - protein, 25 aa, Cryptosporidium hominis
RQLTGHVVTRWYRAPELILLQENYT

SEQ ID NO: 2196502 - protein, 17 aa, Cryptosporidium hominis
RQLVKSGLSKGFSEGVP

SEQ ID NO: 2196503 - protein, 23 aa, Cryptosporidium hominis
RQMARFPLDPPLSKVLLTANKLD

SEQ ID NO: 2196504 - protein, 17 aa, Cryptosporidium hominis
RQNFQINRIFFEEFPIY

SEQ ID NO: 2196505 - protein, 24 aa, Cryptosporidium hominis
RQPNENLWDMPCSEMTSMTLGDIR

SEQ ID NO: 2196506 - protein, 21 aa, Cryptosporidium hominis
RQRQRIRPLSQRSAASNGVSG

SEQ ID NO: 2196507 - protein, 23 aa, Cryptosporidium hominis
RQSIRRMCQIATYLDNSGYNDEI

SEQ ID NO: 2196508 - protein, 26 aa, Cryptosporidium hominis
RQSNKRDIFSKWKNLLLKINPKADCN

SEQ ID NO: 2196509 - protein, 20 aa, Cryptosporidium hominis
RQTLIMNGYSFYSVISSSKT

SEQ ID NO: 2196510 - protein, 24 aa, Cryptosporidium hominis
RQTQSICMLFHTMKLIEYKKQRFA

SEQ ID NO: 2196511 - protein, 31 aa, Cryptosporidium hominis
RQTSNLKHQFILDPKLFRPLYESDNPDKCDR

SEQ ID NO: 2196512 - protein, 26 aa, Cryptosporidium hominis
RQVYILGWLIHLRILNRIVDNIFIKS

SEQ ID NO: 2196513 - protein, 40 aa, Cryptosporidium hominis
RQVYKDELSSLTVIICWIEECLQNFVYPIQRKQSEYKMEI

SEQ ID NO: 2196514 - protein, 22 aa, Cryptosporidium hominis
RRAYIAFVRSYMSYDREFSKIF

SEQ ID NO: 2196515 - protein, 24 aa, Cryptosporidium hominis
RRDFRDGFFNSEISRRVTNIQNYQ

SEQ ID NO: 2196516 - protein, 20 aa, Cryptosporidium hominis
RRDSSLLWLSYDPSNERQNE

SEQ ID NO: 2196517 - protein, 26 aa, Cryptosporidium hominis
RREELDLYLLVLRVVSKKADIVISFN

SEQ ID NO: 2196518 - protein, 17 aa, Cryptosporidium hominis
RREFERFGAIRDVYLPL

SEQ ID NO: 2196519 - protein, 22 aa, Cryptosporidium hominis
RREKSGPLIVLKVGTSTLTNSR

SEQ ID NO: 2196520 - protein, 32 aa, Cryptosporidium hominis
RRGRLVSIVELLFRYIFHFERNEIRIRLSLPR

SEQ ID NO: 2196521 - protein, 19 aa, Cryptosporidium hominis
RRIHKQLLPQMKYALVWGQ

SEQ ID NO: 2196522 - protein, 20 aa, Cryptosporidium hominis
RRIKTILESIKKFNLSNSDS

SEQ ID NO: 2196523 - protein, 27 aa, Cryptosporidium hominis
RRKRTESFALYIYKVLKQVHPETGISK

SEQ ID NO: 2196524 - protein, 22 aa, Cryptosporidium hominis
RRKRWKISLYLSYAKWESLQNN

SEQ ID NO: 2196525 - protein, 26 aa, Cryptosporidium hominis
RRLFRKPVNTLLPGTYLPLNDDSGSD

SEQ ID NO: 2196526 - protein, 27 aa, Cryptosporidium hominis
RRLLYSPLIDLLRLIEVWSKYRLELQK

SEQ ID NO: 2196527 - protein, 22 aa, Cryptosporidium hominis
RRLVSLLSCLQKTAPRVLIFSE

SEQ ID NO: 2196528 - protein, 22 aa, Cryptosporidium hominis
RRNLSYLLSRCSSYYGYYTNYM

SEQ ID NO: 2196529 - protein, 29 aa, Cryptosporidium hominis
RRPCPLCLEDLFYSIKTVSILNCGHTIHE

SEQ ID NO: 2196530 - protein, 22 aa, Cryptosporidium hominis
RRQERIYTLPFTRGINLNKYPN

SEQ ID NO: 2196531 - protein, 33 aa, Cryptosporidium hominis
RRRADELIYFSPQDLVLIIFDPEFKSEEFDDNL

SEQ ID NO: 2196532 - protein, 25 aa, Cryptosporidium hominis
RRRFKDCFNIWRGLSLRLRNQKKKI

SEQ ID NO: 2196533 - protein, 32 aa, Cryptosporidium hominis
RRSELMHSFLKFFIQEIFLSLGILIGNIEVEY

SEQ ID NO: 2196534 - protein, 24 aa, Cryptosporidium hominis
RRSNRKFEFIKCKLINISYAFPSD

SEQ ID NO: 2196535 - protein, 19 aa, Cryptosporidium hominis
RRTIRPTLDQFMKLTHTIK

SEQ ID NO: 2196536 - protein, 18 aa, Cryptosporidium hominis
RRVFGSIYNLFIVLEQIY

SEQ ID NO: 2196537 - protein, 22 aa, Cryptosporidium hominis
RRVIPLTHDFGCDNPKGCNSQF

SEQ ID NO: 2196538 - protein, 22 aa, Cryptosporidium hominis
RRVLHSAFFSGKSSVFCSSIKV

SEQ ID NO: 2196539 - protein, 20 aa, Cryptosporidium hominis
RRWMISGRFQDILPKESLTM

SEQ ID NO: 2196540 - protein, 25 aa, Cryptosporidium hominis
RRYADIIVHRLLSASIGLEPLCEVM

SEQ ID NO: 2196541 - protein, 24 aa, Cryptosporidium hominis
RRYGLFTLVKFNISGTYYAVLSQR

SEQ ID NO: 2196542 - protein, 25 aa, Cryptosporidium hominis
RSALGMFYHVLDPVMPFIELQEACE

SEQ ID NO: 2196543 - protein, 19 aa, Cryptosporidium hominis
RSALKHFNLSNRFQDFNFG

SEQ ID NO: 2196544 - protein, 25 aa, Cryptosporidium hominis
RSASSLLIPPTSPPPPIPPASPQRT

SEQ ID NO: 2196545 - protein, 26 aa, Cryptosporidium hominis
RSCELEFISLPPPEYSYNILNFNDQG

SEQ ID NO: 2196546 - protein, 29 aa, Cryptosporidium hominis
RSCHYSYFNKLIINPIKRYGFSGEGSEAL

SEQ ID NO: 2196547 - protein, 20 aa, Cryptosporidium hominis
RSCMGYLGSASIEELWKKSS

SEQ ID NO: 2196548 - protein, 26 aa, Cryptosporidium hominis
RSDLQKAIPYFLKAVELYNKNGRFSQ

SEQ ID NO: 2196549 - protein, 22 aa, Cryptosporidium hominis
RSDYYISYFIDFSDLEKKLINL

SEQ ID NO: 2196550 - protein, 18 aa, Cryptosporidium hominis
RSEMLYKSSILNKDNDNL

SEQ ID NO: 2196551 - protein, 19 aa, Cryptosporidium hominis
RSENYGLETPKGLSSKRAS

SEQ ID NO: 2196552 - protein, 18 aa, Cryptosporidium hominis
RSFCYVTDMVYGLYKLMK

SEQ ID NO: 2196553 - protein, 18 aa, Cryptosporidium hominis
RSFIKHILKQNSEVDLLD

SEQ ID NO: 2196554 - protein, 17 aa, Cryptosporidium hominis
RSFLKYILSNDYRLEFF

SEQ ID NO: 2196555 - protein, 18 aa, Cryptosporidium hominis
RSFLSLYISIEIPHALMG

SEQ ID NO: 2196556 - protein, 19 aa, Cryptosporidium hominis
RSFSLFRRRFSNEVGNTHN

SEQ ID NO: 2196557 - protein, 17 aa, Cryptosporidium hominis
RSFTMPTSCKKFISTIN

SEQ ID NO: 2196558 - protein, 24 aa, Cryptosporidium hominis
RSHAILQIEIRSRIFSVTKESTLQ

SEQ ID NO: 2196559 - protein, 28 aa, Cryptosporidium hominis
RSIEYELLRLIFSKRLPRYIIQTNTNIL

SEQ ID NO: 2196560 - protein, 19 aa, Cryptosporidium hominis
RSIFLFICTNCTCSVQAFR

SEQ ID NO: 2196561 - protein, 23 aa, Cryptosporidium hominis
RSIKANILALYPLLEQVIDDILP

SEQ ID NO: 2196562 - protein, 24 aa, Cryptosporidium hominis
RSIKYIPCFCFPDRNYKIASLKTF

SEQ ID NO: 2196563 - protein, 32 aa, Cryptosporidium hominis
RSIPMNLISIYIYQLFRAVGFIHSLGICHRDI

SEQ ID NO: 2196564 - protein, 21 aa, Cryptosporidium hominis
RSIPNLLDGLKPGQRKVLFAT

SEQ ID NO: 2196565 - protein, 21 aa, Cryptosporidium hominis
RSIPTKMPMHLFSGKRGMGKT

SEQ ID NO: 2196566 - protein, 21 aa, Cryptosporidium hominis
RSITFLYKFISGICPKSYGMN

SEQ ID NO: 2196567 - protein, 27 aa, Cryptosporidium hominis
RSKALDILISLIYYTTDYRDYFSNWKD

SEQ ID NO: 2196568 - protein, 22 aa, Cryptosporidium hominis
RSKIIKLLKFHTSKSGDSTVFL

SEQ ID NO: 2196569 - protein, 17 aa, Cryptosporidium hominis
RSKTFNSKIYGFDVARS

SEQ ID NO: 2196570 - protein, 25 aa, Cryptosporidium hominis
RSKVWTCPFSLQRNPFPPHYAEHIS

SEQ ID NO: 2196571 - protein, 18 aa, Cryptosporidium hominis
RSKYWIEALRAYVNQSKG

SEQ ID NO: 2196572 - protein, 25 aa, Cryptosporidium hominis
RSLAIFLEKLKKDTLVELLIVVMFQ

SEQ ID NO: 2196573 - protein, 27 aa, Cryptosporidium hominis
RSLALTSFEPYLSTPFYMGIKVKDMLN

SEQ ID NO: 2196574 - protein, 23 aa, Cryptosporidium hominis
RSLEKKISLLERGEGINLFHSSV

SEQ ID NO: 2196575 - protein, 18 aa, Cryptosporidium hominis
RSLLALANCINSLALSSS

SEQ ID NO: 2196576 - protein, 17 aa, Cryptosporidium hominis
RSLLSKNWFNPFGMFAG

SEQ ID NO: 2196577 - protein, 17 aa, Cryptosporidium hominis
RSLLYSLGSEKFVRVHN

SEQ ID NO: 2196578 - protein, 21 aa, Cryptosporidium hominis
RSLQLIDIRTVGRQALLNYNK

SEQ ID NO: 2196579 - protein, 32 aa, Cryptosporidium hominis
RSLSHKLRLISQKLFPGWLSPDMLKCNSELPP

SEQ ID NO: 2196580 - protein, 23 aa, Cryptosporidium hominis
RSLSNWEIIYNPRSLPFQENNFD

SEQ ID NO: 2196581 - protein, 20 aa, Cryptosporidium hominis
RSMRVSVRWLRLASSMHLNL

SEQ ID NO: 2196582 - protein, 23 aa, Cryptosporidium hominis
RSNLCFELKSLFIAPTREICIQI

SEQ ID NO: 2196583 - protein, 19 aa, Cryptosporidium hominis
RSNLMSRLFAKFHKKQPSS

SEQ ID NO: 2196584 - protein, 31 aa, Cryptosporidium hominis
RSPSYFNTGFIPNQLVLNASLLNELRQEPSG

SEQ ID NO: 2196585 - protein, 18 aa, Cryptosporidium hominis
RSRVIYCHVCCQYKPRST

SEQ ID NO: 2196586 - protein, 24 aa, Cryptosporidium hominis
RSSIEFYRDVLQHPDFNEIDSIKS

SEQ ID NO: 2196587 - protein, 18 aa, Cryptosporidium hominis
RSSLCTFFDFCNCFGPRV

SEQ ID NO: 2196588 - protein, 25 aa, Cryptosporidium hominis
RSSLQPGVVCILLAGPYKGKRVVML

SEQ ID NO: 2196589 - protein, 18 aa, Cryptosporidium hominis
RSSQSDCLVPWDSTITWK

SEQ ID NO: 2196590 - protein, 23 aa, Cryptosporidium hominis
RSSVRTFIRFCPSKKTIIEDSKE

SEQ ID NO: 2196591 - protein, 20 aa, Cryptosporidium hominis
RSTNLLKSWFSKAFKQGISL

SEQ ID NO: 2196592 - protein, 26 aa, Cryptosporidium hominis
RSVDLGRWAIIQKLSFFFNKFRVVDE

SEQ ID NO: 2196593 - protein, 26 aa, Cryptosporidium hominis
RSVTDAMHYFFKLHPSIITNSPSSPR

SEQ ID NO: 2196594 - protein, 28 aa, Cryptosporidium hominis
RSVVQQDPRILPELLVRIGQSNPEILQL

SEQ ID NO: 2196595 - protein, 24 aa, Cryptosporidium hominis
RSYTHEVVTLWYRAPDVLMGSKKY

SEQ ID NO: 2196596 - protein, 18 aa, Cryptosporidium hominis
RTCLVANTSNMPVAAREA

SEQ ID NO: 2196597 - protein, 19 aa, Cryptosporidium hominis
RTEFNYSPLPYLPPHSTRP

SEQ ID NO: 2196598 - protein, 17 aa, Cryptosporidium hominis
RTFIAQHFGVNASDVSA

SEQ ID NO: 2196599 - protein, 25 aa, Cryptosporidium hominis
RTGKMWKPRILLQQKSKRSIRAPED

SEQ ID NO: 2196600 - protein, 20 aa, Cryptosporidium hominis
RTGVLLRKLKYANGRIEWRV

SEQ ID NO: 2196601 - protein, 17 aa, Cryptosporidium hominis
RTHDYIIDPFNLFNEIQ

SEQ ID NO: 2196602 - protein, 23 aa, Cryptosporidium hominis
RTHLRNMVILPEMVGSVAGVYNG

SEQ ID NO: 2196603 - protein, 31 aa, Cryptosporidium hominis
RTIPKLKYYWVYMLTLDFPNLTFILNGGVTS

SEQ ID NO: 2196604 - protein, 19 aa, Cryptosporidium hominis
RTLFAVFLQPIVIDSIGKL

SEQ ID NO: 2196605 - protein, 20 aa, Cryptosporidium hominis
RTLKPRLFISKLRLMSVRIQ

SEQ ID NO: 2196606 - protein, 17 aa, Cryptosporidium hominis
RTLLLIEENFEQVSKRL

SEQ ID NO: 2196607 - protein, 17 aa, Cryptosporidium hominis
RTNVLNLLHANTRSFIC

SEQ ID NO: 2196608 - protein, 19 aa, Cryptosporidium hominis
RTPFGSMILPMLQKAQKSQ

SEQ ID NO: 2196609 - protein, 23 aa, Cryptosporidium hominis
RTPHGFSQFFFFSSSKVTCELLV

SEQ ID NO: 2196610 - protein, 18 aa, Cryptosporidium hominis
RTPTVDDWYVFDKQLSEI

SEQ ID NO: 2196611 - protein, 20 aa, Cryptosporidium hominis
RTQIAAGEYTAIAIGPGPSE

SEQ ID NO: 2196612 - protein, 24 aa, Cryptosporidium hominis
RTQRKLVLHVISFKRISNFSSIFC

SEQ ID NO: 2196613 - protein, 18 aa, Cryptosporidium hominis
RTRALARITLISHSLWPG

SEQ ID NO: 2196614 - protein, 25 aa, Cryptosporidium hominis
RTRCMRIWTLLRNSVPNALKNKILS

SEQ ID NO: 2196615 - protein, 18 aa, Cryptosporidium hominis
RTRLSNWIISFSCLDDDI

SEQ ID NO: 2196616 - protein, 20 aa, Cryptosporidium hominis
RTRSKFKLQYLFGQNIDSIS

SEQ ID NO: 2196617 - protein, 30 aa, Cryptosporidium hominis
RTRSTNPYRILLSKLYTFLGRRTNSSFNET

SEQ ID NO: 2196618 - protein, 17 aa, Cryptosporidium hominis
RTSLIQNYHFTCTCRLC

SEQ ID NO: 2196619 - protein, 18 aa, Cryptosporidium hominis
RTSPYLSGRKRNIEAAWK

SEQ ID NO: 2196620 - protein, 18 aa, Cryptosporidium hominis
RTSRYKAWKSNRQLSEYI

SEQ ID NO: 2196621 - protein, 28 aa, Cryptosporidium hominis
RTTISIPQRYNYIRNRNSSLMKEISIKK

SEQ ID NO: 2196622 - protein, 24 aa, Cryptosporidium hominis
RTYSKVCIKIILNNVDWKCVTQFL

SEQ ID NO: 2196623 - protein, 20 aa, Cryptosporidium hominis
RVAGIVKFVDLIEQEIAIFY

SEQ ID NO: 2196624 - protein, 20 aa, Cryptosporidium hominis
RVCTNICWIIHQIAESSQFV

SEQ ID NO: 2196625 - protein, 28 aa, Cryptosporidium hominis
RVEHKRTFLYLEQLILKHGAHEKVSNIV

SEQ ID NO: 2196626 - protein, 19 aa, Cryptosporidium hominis
RVEIPLGCLFTPLKESSKL

SEQ ID NO: 2196627 - protein, 29 aa, Cryptosporidium hominis
RVELPCKRWPELLPYLIRLVQNNSDNKMS

SEQ ID NO: 2196628 - protein, 35 aa, Cryptosporidium hominis
RVERKKYIKIIKKWKWIEFMITGQKPILNSGTIIH

SEQ ID NO: 2196629 - protein, 19 aa, Cryptosporidium hominis
RVFIPSKLGYGARGCPPVI

SEQ ID NO: 2196630 - protein, 36 aa, Cryptosporidium hominis
RVFNRMGTISYNISPFLQMSFETSMKFLTEACLRGA

SEQ ID NO: 2196631 - protein, 30 aa, Cryptosporidium hominis
RVGSIIVISNLMWWINDIHVRELATEFGAI

SEQ ID NO: 2196632 - protein, 24 aa, Cryptosporidium hominis
RVGTLYYIAPEILLGKGYDDKCDI

SEQ ID NO: 2196633 - protein, 19 aa, Cryptosporidium hominis
RVGWDYCLWIDIPEFSCMY

SEQ ID NO: 2196634 - protein, 17 aa, Cryptosporidium hominis
RVHFKKGTRFFTQDYSY

SEQ ID NO: 2196635 - protein, 18 aa, Cryptosporidium hominis
RVILTDGLELKNEISSLL

SEQ ID NO: 2196636 - protein, 20 aa, Cryptosporidium hominis
RVIQGLIRRSYGNSGAVCAK

SEQ ID NO: 2196637 - protein, 18 aa, Cryptosporidium hominis
RVIVFFQTKKEAHRCAIL

SEQ ID NO: 2196638 - protein, 20 aa, Cryptosporidium hominis
RVIVKRIVLVGNLFKVRKSK

SEQ ID NO: 2196639 - protein, 25 aa, Cryptosporidium hominis
RVKAILLLWKILYLHFTNSDSIEDN

SEQ ID NO: 2196640 - protein, 17 aa, Cryptosporidium hominis
RVKPYFEDVIAPSIMSG

SEQ ID NO: 2196641 - protein, 31 aa, Cryptosporidium hominis
RVLHPKRRFKLFRSILKFGDPYRRLDDIIID

SEQ ID NO: 2196642 - protein, 19 aa, Cryptosporidium hominis
RVLIFSQMVRMLNIISEFL

SEQ ID NO: 2196643 - protein, 22 aa, Cryptosporidium hominis
RVLIFTQGVRTLKLLSALLEKD

SEQ ID NO: 2196644 - protein, 30 aa, Cryptosporidium hominis
RVLLNRQEWLIPFWPLLMAVGSIYDSNVLR

SEQ ID NO: 2196645 - protein, 17 aa, Cryptosporidium hominis
RVMCYIEQKINGHFTKD

SEQ ID NO: 2196646 - protein, 31 aa, Cryptosporidium hominis
RVMYAAALTASPRLLEPMFLVEISAPQEVVG

SEQ ID NO: 2196647 - protein, 26 aa, Cryptosporidium hominis
RVPKGPMVLFCYFLGKLYMQQDRFVL

SEQ ID NO: 2196648 - protein, 32 aa, Cryptosporidium hominis
RVPPNALVGFLQKALLYIYLEYHTSDETGEEI

SEQ ID NO: 2196649 - protein, 28 aa, Cryptosporidium hominis
RVQFDELPPELLLSRPFNPLSIDEASNQ

SEQ ID NO: 2196650 - protein, 18 aa, Cryptosporidium hominis
RVQSSLINWLLSSNEFLQ

SEQ ID NO: 2196651 - protein, 25 aa, Cryptosporidium hominis
RVRIGKFILDTWYFSPLPDEYQNVD

SEQ ID NO: 2196652 - protein, 24 aa, Cryptosporidium hominis
RVRPGKCFRLYTKLSFITEMEVSN

SEQ ID NO: 2196653 - protein, 17 aa, Cryptosporidium hominis
RVRYHNSYVGWVALSRH

SEQ ID NO: 2196654 - protein, 20 aa, Cryptosporidium hominis
RVRYLGFTCLYITIKIERVV

SEQ ID NO: 2196655 - protein, 19 aa, Cryptosporidium hominis
RVTKDEAMQWFQSKYDGII

SEQ ID NO: 2196656 - protein, 18 aa, Cryptosporidium hominis
RVTRIIRLLTFINRSIEG

SEQ ID NO: 2196657 - protein, 24 aa, Cryptosporidium hominis
RVVLIVHEMPHFFSEKINIFNETI

SEQ ID NO: 2196658 - protein, 30 aa, Cryptosporidium hominis
RVVTIRVACRLLIISILLSSLENLANKEHS

SEQ ID NO: 2196659 - protein, 17 aa, Cryptosporidium hominis
RVYAMDLKYPALVVAAA

SEQ ID NO: 2196660 - protein, 27 aa, Cryptosporidium hominis
RWENMREIIKEYLKFDDKILVVGNGTS

SEQ ID NO: 2196661 - protein, 17 aa, Cryptosporidium hominis
RWFGYIKDYDGGTLMEC

SEQ ID NO: 2196662 - protein, 25 aa, Cryptosporidium hominis
RWMRLMYELHEIILKYIEIEKLFEE

SEQ ID NO: 2196663 - protein, 17 aa, Cryptosporidium hominis
RWYLSNNTKTRSFPNMH

SEQ ID NO: 2196664 - protein, 21 aa, Cryptosporidium hominis
RYEAPPLIIDSNTGALVPLNE

SEQ ID NO: 2196665 - protein, 24 aa, Cryptosporidium hominis
RYERYLRVYIIEYTIRRMNEYYLY

SEQ ID NO: 2196666 - protein, 19 aa, Cryptosporidium hominis
RYFPPDFDPKKLEESKKLL

SEQ ID NO: 2196667 - protein, 25 aa, Cryptosporidium hominis
RYFPRSISCPGILLRNGLIVTDRYI

SEQ ID NO: 2196668 - protein, 24 aa, Cryptosporidium hominis
RYGAILNFLIANSSAIPILVQNKN

SEQ ID NO: 2196669 - protein, 17 aa, Cryptosporidium hominis
RYISDLGCYLQPATTEN

SEQ ID NO: 2196670 - protein, 20 aa, Cryptosporidium hominis
RYMNFTRLRDNYGIARHNIG

SEQ ID NO: 2196671 - protein, 18 aa, Cryptosporidium hominis
RYPDLKLIPKVGIGKNLK

SEQ ID NO: 2196672 - protein, 27 aa, Cryptosporidium hominis
RYQRSTELLIRKLPFQRLVREIAQDFK

SEQ ID NO: 2196673 - protein, 22 aa, Cryptosporidium hominis
RYSELIRLKNKLLEELSNVENE

SEQ ID NO: 2196674 - protein, 26 aa, Cryptosporidium hominis
RYSLHDPFILWVLRNGILANIGDLNI

SEQ ID NO: 2196675 - protein, 17 aa, Cryptosporidium hominis
RYSLHLLTVSQVLANRK

SEQ ID NO: 2196676 - protein, 20 aa, Cryptosporidium hominis
RYVPCLYVHNKIDNLNLSEI

SEQ ID NO: 2196677 - protein, 25 aa, Cryptosporidium hominis
RYYYDTWCYLSILTGPNHHFTVAAK

SEQ ID NO: 2196678 - protein, 20 aa, Cryptosporidium hominis
SAAGSNFFHSYRKIKQIEEE

SEQ ID NO: 2196679 - protein, 23 aa, Cryptosporidium hominis
SAAQHFVQWLLESDPKKRPTAEN

SEQ ID NO: 2196680 - protein, 18 aa, Cryptosporidium hominis
SACTNECGWGIQTRGRRI

SEQ ID NO: 2196681 - protein, 26 aa, Cryptosporidium hominis
SACWGGKIVFWKFDQASGTFIISAQI

SEQ ID NO: 2196682 - protein, 51 aa, Cryptosporidium hominis
SAEEIFNLDFIKYKTIKLSPKLDLYFLMYEYQKILSYNRYLESLLKGDQIF

SEQ ID NO: 2196683 - protein, 20 aa, Cryptosporidium hominis
SAEFDLKRLLKAFKKNFSCN

SEQ ID NO: 2196684 - protein, 26 aa, Cryptosporidium hominis
SAEVRAQIRLIFREYQNKKKIQIVRS

SEQ ID NO: 2196685 - protein, 18 aa, Cryptosporidium hominis
SAGGSTLTPWRNGKRSLS

SEQ ID NO: 2196686 - protein, 26 aa, Cryptosporidium hominis
SAGTVIFAELYWVPGTMLQAEDRCHR

SEQ ID NO: 2196687 - protein, 22 aa, Cryptosporidium hominis
SAGVMMYVLLCGYPPFSAPTDS

SEQ ID NO: 2196688 - protein, 17 aa, Cryptosporidium hominis
SAISFLRLYEKWSNTRS

SEQ ID NO: 2196689 - protein, 24 aa, Cryptosporidium hominis
SAKAGLQFPVGRVARYLKKGRYAK

SEQ ID NO: 2196690 - protein, 29 aa, Cryptosporidium hominis
SAKIFSRDILKLRKQMERLSLARSQLMGA

SEQ ID NO: 2196691 - protein, 21 aa, Cryptosporidium hominis
SALASPWMQSILNDPEIFRVM

SEQ ID NO: 2196692 - protein, 24 aa, Cryptosporidium hominis
SALLRAINTIRPLKVYPGINLWEN

SEQ ID NO: 2196693 - protein, 26 aa, Cryptosporidium hominis
SALLWASRNLGKLYSQSPPPGKTLTP

SEQ ID NO: 2196694 - protein, 17 aa, Cryptosporidium hominis
SALRRIIEVSSKNTRFV

SEQ ID NO: 2196695 - protein, 30 aa, Cryptosporidium hominis
SALYCYAIALDWNPVLWKSFQKLVGLSCQY

SEQ ID NO: 2196696 - protein, 31 aa, Cryptosporidium hominis
SAMLLYTILERHKLPLSIYPSGSYSTIKDSE

SEQ ID NO: 2196697 - protein, 30 aa, Cryptosporidium hominis
SAMNINLNPLIWKKFSGLPLSLKDLVDADC

SEQ ID NO: 2196698 - protein, 25 aa, Cryptosporidium hominis
SANKVYLISFLLAVAYQISGEKNKA

SEQ ID NO: 2196699 - protein, 22 aa, Cryptosporidium hominis
SAPIQMAFFIISACELSDKKTA

SEQ ID NO: 2196700 - protein, 18 aa, Cryptosporidium hominis
SAPKNLTKRNVANSGGSA

SEQ ID NO: 2196701 - protein, 22 aa, Cryptosporidium hominis
SAPTLFRHHFSFKDIGIGGLDD

SEQ ID NO: 2196702 - protein, 26 aa, Cryptosporidium hominis
SAQDLTGGLVRSFSKAQNGNNLFSAN

SEQ ID NO: 2196703 - protein, 26 aa, Cryptosporidium hominis
SAQWDTQSYLPMSYYAGAYDPNGMAY

SEQ ID NO: 2196704 - protein, 24 aa, Cryptosporidium hominis
SARFHTVPMVFLEKNKVDQRSKTR

SEQ ID NO: 2196705 - protein, 26 aa, Cryptosporidium hominis
SARKNIPSIDIIKRLAGRLKNKDSDT

SEQ ID NO: 2196706 - protein, 23 aa, Cryptosporidium hominis
SASDHYFPFKLYSRLDRSGQLEL

SEQ ID NO: 2196707 - protein, 36 aa, Cryptosporidium hominis
SASESKMLISFPFFLKYYLSVLTTIRQKHFSSVKIN

SEQ ID NO: 2196708 - protein, 23 aa, Cryptosporidium hominis
SASKLPCFSLFTNKEYFIQDIRD

SEQ ID NO: 2196709 - protein, 32 aa, Cryptosporidium hominis
SASNSVPVPVGIPPPGCIPIVGGCGTVGVGAR

SEQ ID NO: 2196710 - protein, 40 aa, Cryptosporidium hominis
SASPIPLVSSLQLILQPRPPKPLPPQRRVLRLRSRTPTSL

SEQ ID NO: 2196711 - protein, 25 aa, Cryptosporidium hominis
SAVKLDIPLLNQYISQDLIAEVGSC

SEQ ID NO: 2196712 - protein, 21 aa, Cryptosporidium hominis
SAWCYRHFIFTNLKKMNALKE

SEQ ID NO: 2196713 - protein, 45 aa, Cryptosporidium hominis
SAYSDYINRILGLYDLFCKFNILLQYFQYKALRYLQIHDIPNMTN

SEQ ID NO: 2196714 - protein, 30 aa, Cryptosporidium hominis
SCAEAISACLFFFGFPKQAEKLLGIFKGGH

SEQ ID NO: 2196715 - protein, 25 aa, Cryptosporidium hominis
SCDPSLSFEFILSKLLLKVKAGSEY

SEQ ID NO: 2196716 - protein, 17 aa, Cryptosporidium hominis
SCDSSVLCSLVLTVSDL

SEQ ID NO: 2196717 - protein, 18 aa, Cryptosporidium hominis
SCEFLDLESLYETERDQA

SEQ ID NO: 2196718 - protein, 23 aa, Cryptosporidium hominis
SCELQPIVILRDKMGKLWDDDDE

SEQ ID NO: 2196719 - protein, 25 aa, Cryptosporidium hominis
SCGAAKYLLQLLSSPKKVIRKEACW

SEQ ID NO: 2196720 - protein, 25 aa, Cryptosporidium hominis
SCGINDLCWINPTLTPNIFSTVNHQ

SEQ ID NO: 2196721 - protein, 24 aa, Cryptosporidium hominis
SCGKLLYLMLTGKYLEIDFFECFD

SEQ ID NO: 2196722 - protein, 25 aa, Cryptosporidium hominis
SCGKPCIYSYYILRAGVVCGVSVAV

SEQ ID NO: 2196723 - protein, 28 aa, Cryptosporidium hominis
SCGKSQLLRFVMSIAPLAISTTGRGCSG

SEQ ID NO: 2196724 - protein, 20 aa, Cryptosporidium hominis
SCGYNIYHFLKSGSIKVFVN

SEQ ID NO: 2196725 - protein, 24 aa, Cryptosporidium hominis
SCIARTILFFNSKPLNPCSPDCQI

SEQ ID NO: 2196726 - protein, 19 aa, Cryptosporidium hominis
SCIITWDPVKTKLLLNLDL

SEQ ID NO: 2196727 - protein, 24 aa, Cryptosporidium hominis
SCILKKLQFLVDAGVVFIGHALPS

SEQ ID NO: 2196728 - protein, 19 aa, Cryptosporidium hominis
SCIPYRESKLTRLLQEYLG

SEQ ID NO: 2196729 - protein, 26 aa, Cryptosporidium hominis
SCIRYRISWFEFLIGKRDRSYSEICN

SEQ ID NO: 2196730 - protein, 19 aa, Cryptosporidium hominis
SCLLFKYYCLRYPCLINYL

SEQ ID NO: 2196731 - protein, 21 aa, Cryptosporidium hominis
SCLQKTAPRVLIFSENKKDVD

SEQ ID NO: 2196732 - protein, 31 aa, Cryptosporidium hominis
SCLRPGLRWIQLFDANFIDIQCCGILANISI

SEQ ID NO: 2196733 - protein, 27 aa, Cryptosporidium hominis
SCNDLDLWLRYNAYLRKSRLEFTNSRL

SEQ ID NO: 2196734 - protein, 19 aa, Cryptosporidium hominis
SCNLKFKCIGIAPLEVLSD

SEQ ID NO: 2196735 - protein, 28 aa, Cryptosporidium hominis
SCNLLNDFHLLLYLAKLFDEATAISICE

SEQ ID NO: 2196736 - protein, 20 aa, Cryptosporidium hominis
SCNQLLMLLNGFIKLVELES

SEQ ID NO: 2196737 - protein, 23 aa, Cryptosporidium hominis
SCQICLNYYFPSKAIKQMESNSN

SEQ ID NO: 2196738 - protein, 36 aa, Cryptosporidium hominis
SCRSKLFTIPQSFVRAFSILIEPILGLFQEHNSEAN

SEQ ID NO: 2196739 - protein, 25 aa, Cryptosporidium hominis
SCSSPSLPLFLLFDESYTSHAFYEW

SEQ ID NO: 2196740 - protein, 27 aa, Cryptosporidium hominis
SCTFGQEFYLRIYGTGLLNEIQNLTTS

SEQ ID NO: 2196741 - protein, 25 aa, Cryptosporidium hominis
SDAIRRKLFVRNLGFETNEDSLSEV

SEQ ID NO: 2196742 - protein, 26 aa, Cryptosporidium hominis
SDASHDFFLKRLKGIGRHQVKINIYN

SEQ ID NO: 2196743 - protein, 30 aa, Cryptosporidium hominis
SDDALNPHIPQFIAKAPWYINQQESSLEHQ

SEQ ID NO: 2196744 - protein, 24 aa, Cryptosporidium hominis
SDDDIQMLIFKIDQIRSALKHFNL

SEQ ID NO: 2196745 - protein, 37 aa, Cryptosporidium hominis
SDDESIKSFFNGCGVVKRVSIPRYSDTGKMRGFAMVE

SEQ ID NO: 2196746 - protein, 25 aa, Cryptosporidium hominis
SDDGTIIMWIFSNLSIYNQTNLYTY

SEQ ID NO: 2196747 - protein, 25 aa, Cryptosporidium hominis
SDDKKMFVWDVGIPIVVKHIADPLM

SEQ ID NO: 2196748 - protein, 25 aa, Cryptosporidium hominis
SDEGVLGGLFSTRRPRDAMAGFSSG

SEQ ID NO: 2196749 - protein, 30 aa, Cryptosporidium hominis
SDEIHLHSVIYFPCILLDEIDKKGKKQWIL

SEQ ID NO: 2196750 - protein, 23 aa, Cryptosporidium hominis
SDEKLNLRIYDDIAGKRGLNVDR

SEQ ID NO: 2196751 - protein, 24 aa, Cryptosporidium hominis
SDEKNWRAVFRLGIQQIVSICNTK

SEQ ID NO: 2196752 - protein, 17 aa, Cryptosporidium hominis
SDELEFIRWHPRGPCIF

SEQ ID NO: 2196753 - protein, 26 aa, Cryptosporidium hominis
SDFCDFKKVSLLPLLFGETTCNQQLT

SEQ ID NO: 2196754 - protein, 22 aa, Cryptosporidium hominis
SDFKDIILSNYYYHGNCATADS

SEQ ID NO: 2196755 - protein, 24 aa, Cryptosporidium hominis
SDFNCLICFRILQRTMVVKDCLHR

SEQ ID NO: 2196756 - protein, 24 aa, Cryptosporidium hominis
SDFTCLEFWDFLSNTLQKSSDKSH

SEQ ID NO: 2196757 - protein, 21 aa, Cryptosporidium hominis
SDGCKLYLYFDDNVGYTVITN

SEQ ID NO: 2196758 - protein, 18 aa, Cryptosporidium hominis
SDGEIAIWDLERSLKIFS

SEQ ID NO: 2196759 - protein, 39 aa, Cryptosporidium hominis
SDGFCSFGKIYLGYNIHKILLSIIDLYDLILDEESKVFQ

SEQ ID NO: 2196760 - protein, 24 aa, Cryptosporidium hominis
SDGSGLFELMPNNQLRLARGGNLC

SEQ ID NO: 2196761 - protein, 25 aa, Cryptosporidium hominis
SDGVQKFFFKILRRKVHSKHPVKHW

SEQ ID NO: 2196762 - protein, 31 aa, Cryptosporidium hominis
SDHGRIPLARRLLMQLLKKANKQTPILIIAT

SEQ ID NO: 2196763 - protein, 17 aa, Cryptosporidium hominis
SDHLRRHMMLVHSSIEE

SEQ ID NO: 2196764 - protein, 24 aa, Cryptosporidium hominis
SDHLTLLNIFIQWKRHGSNLRWSE

SEQ ID NO: 2196765 - protein, 36 aa, Cryptosporidium hominis
SDIEISIILDKLPKVIRFLIKTIRKFQFITGKCVSV

SEQ ID NO: 2196766 - protein, 25 aa, Cryptosporidium hominis
SDIGAGFFQIVIAKLKGVVAENVEA

SEQ ID NO: 2196767 - protein, 22 aa, Cryptosporidium hominis
SDIPFLSYFLLSSNAKMRVNSI

SEQ ID NO: 2196768 - protein, 22 aa, Cryptosporidium hominis
SDIPRKYVLLCLVDSIVRKCRS

SEQ ID NO: 2196769 - protein, 27 aa, Cryptosporidium hominis
SDKEEILIGPLMQLTTMDQFVLTFALN

SEQ ID NO: 2196770 - protein, 27 aa, Cryptosporidium hominis
SDKEPLKPLYLLYRHLKDSTYQAKNHS

SEQ ID NO: 2196771 - protein, 24 aa, Cryptosporidium hominis
SDKISFYHRQTLINILRFETFENE

SEQ ID NO: 2196772 - protein, 38 aa, Cryptosporidium hominis
SDKISKFYCNLVPYMIKNLWRRLENASYQRVDWSSRQF

SEQ ID NO: 2196773 - protein, 29 aa, Cryptosporidium hominis
SDKTVKDLIWLLYDTSLLTSGFSLEDPTQ

SEQ ID NO: 2196774 - protein, 27 aa, Cryptosporidium hominis
SDKVLELWPHYVYSLVSSLGASHAGSR

SEQ ID NO: 2196775 - protein, 25 aa, Cryptosporidium hominis
SDLAKDLLYKLLSYSFYQSESLTMD

SEQ ID NO: 2196776 - protein, 28 aa, Cryptosporidium hominis
SDLAKEYWRFLVGYNYELLISLLHSAPS

SEQ ID NO: 2196777 - protein, 34 aa, Cryptosporidium hominis
SDLEVIKQLRNCNLLYFNKEVVFNCIVDIEQSKL

SEQ ID NO: 2196778 - protein, 30 aa, Cryptosporidium hominis
SDLGRVSYISYWGYILLELLMDGSQDVILW

SEQ ID NO: 2196779 - protein, 18 aa, Cryptosporidium hominis
SDLHRKYTFLQSNNAINN

SEQ ID NO: 2196780 - protein, 25 aa, Cryptosporidium hominis
SDLQFVFAQIPLSVSKPLIAIREGL

SEQ ID NO: 2196781 - protein, 25 aa, Cryptosporidium hominis
SDLSLPINNIGRMMKLSIPGSAKIS

SEQ ID NO: 2196782 - protein, 19 aa, Cryptosporidium hominis
SDLSLYTLGIALSVCKILG

SEQ ID NO: 2196783 - protein, 22 aa, Cryptosporidium hominis
SDLSYLICLISSNYKYENIVFC

SEQ ID NO: 2196784 - protein, 19 aa, Cryptosporidium hominis
SDLYESTFRHPIGPEWNTT

SEQ ID NO: 2196785 - protein, 24 aa, Cryptosporidium hominis
SDPLCRMWYDMTQFFGFLGEDIID

SEQ ID NO: 2196786 - protein, 19 aa, Cryptosporidium hominis
SDPNLFSIVSILGQKFIEE

SEQ ID NO: 2196787 - protein, 23 aa, Cryptosporidium hominis
SDREEYILKKRWTEDTVFRNQNR

SEQ ID NO: 2196788 - protein, 27 aa, Cryptosporidium hominis
SDRSSSNILFPWIYNSDFSIFESEFSF

SEQ ID NO: 2196789 - protein, 20 aa, Cryptosporidium hominis
SDSFLEKWNLTKKCNRTKAR

SEQ ID NO: 2196790 - protein, 23 aa, Cryptosporidium hominis
SDSILLLFTIFQVFQGEKSKWNK

SEQ ID NO: 2196791 - protein, 24 aa, Cryptosporidium hominis
SDSLWLDICKNELYKLIRVKSPKD

SEQ ID NO: 2196792 - protein, 20 aa, Cryptosporidium hominis
SDTFDPFWDITLALPEVSDD

SEQ ID NO: 2196793 - protein, 19 aa, Cryptosporidium hominis
SDTGKMRGFAMVEFENDEQ

SEQ ID NO: 2196794 - protein, 26 aa, Cryptosporidium hominis
SDVCSPPIKLPWSIIFHTLDPTEFDF

SEQ ID NO: 2196795 - protein, 19 aa, Cryptosporidium hominis
SDVFQYNKLVSNSMNYTIS

SEQ ID NO: 2196796 - protein, 22 aa, Cryptosporidium hominis
SDVPGVKFFSFIISGNKPSSVN

SEQ ID NO: 2196797 - protein, 25 aa, Cryptosporidium hominis
SDWDSPFIDLSNSLFISNCANYKLS

SEQ ID NO: 2196798 - protein, 18 aa, Cryptosporidium hominis
SDWIVLNMLGKFQTTIKE

SEQ ID NO: 2196799 - protein, 24 aa, Cryptosporidium hominis
SDWNSLFCILSHLPKLECLMLNGN

SEQ ID NO: 2196800 - protein, 24 aa, Cryptosporidium hominis
SDYHIAVMLLYKKTVIKASEEEMA

SEQ ID NO: 2196801 - protein, 20 aa, Cryptosporidium hominis
SDYIIESLQPVYPYFARESK

SEQ ID NO: 2196802 - protein, 32 aa, Cryptosporidium hominis
SDYSINCRDSIAPNLPGAFLSVVMQNLSSVNF

SEQ ID NO: 2196803 - protein, 26 aa, Cryptosporidium hominis
SEADQRAYILWLKGKDLTYRGKMDEA

SEQ ID NO: 2196804 - protein, 32 aa, Cryptosporidium hominis; identical to SEQ ID NO: 2181067

SEQ ID NO: 2196805 - protein, 22 aa, Cryptosporidium hominis
SECLNYPFGYVNSVLEGSPAFQ

SEQ ID NO: 2196806 - protein, 18 aa, Cryptosporidium hominis
SECNPKFLEIHRGNTNHK

SEQ ID NO: 2196807 - protein, 17 aa, Cryptosporidium hominis
SECSCINIFAFGSSGTG

SEQ ID NO: 2196808 - protein, 30 aa, Cryptosporidium hominis
SEDDSIHWMIIIALRFIALSSLQLGNYAQC

SEQ ID NO: 2196809 - protein, 24 aa, Cryptosporidium hominis
SEDKGCWWFIGARNGYIEAKPGSK

SEQ ID NO: 2196810 - protein, 28 aa, Cryptosporidium hominis
SEDKQMPNWMITTPYLNMKDILSDWRNS

SEQ ID NO: 2196811 - protein, 36 aa, Cryptosporidium hominis
SEDLNSVKYYEGFKLPLGDLGRKMLLKKLREIHTQN

SEQ ID NO: 2196812 - protein, 24 aa, Cryptosporidium hominis
SEEADNYWNLYKEALNRIDELESS

SEQ ID NO: 2196813 - protein, 25 aa, Cryptosporidium hominis
SEEGLYNWIRELVIRYLADERTDNE

SEQ ID NO: 2196814 - protein, 25 aa, Cryptosporidium hominis
SEEKKVLEIILRETLDGDSLTRATS

SEQ ID NO: 2196815 - protein, 18 aa, Cryptosporidium hominis
SEELPLPPAPSSEELPLP

SEQ ID NO: 2196816 - protein, 30 aa, Cryptosporidium hominis
SEERQIEYNLFLKLLHRFSQFKFRSIGATE

SEQ ID NO: 2196817 - protein, 18 aa, Cryptosporidium hominis
SEFLGRFSELQYLSLNAT

SEQ ID NO: 2196818 - protein, 19 aa, Cryptosporidium hominis
SEGENIIKFLKIKNEFQNK

SEQ ID NO: 2196819 - protein, 17 aa, Cryptosporidium hominis
SEIALRVMLLEDEYFLG

SEQ ID NO: 2196820 - protein, 29 aa, Cryptosporidium hominis
SEIDSLPPYLLVQLVRFEWKKSSEIARTE

SEQ ID NO: 2196821 - protein, 26 aa, Cryptosporidium hominis
SEIETKYSLLKEKYLFLVQKNEYLIS

SEQ ID NO: 2196822 - protein, 20 aa, Cryptosporidium hominis
SEIFGFFETSEDKQMPNWMI

SEQ ID NO: 2196823 - protein, 26 aa, Cryptosporidium hominis
SEIHVNHMWWVPLLKKIIKEDEEIAA

SEQ ID NO: 2196824 - protein, 29 aa, Cryptosporidium hominis
SEIQLKLCIMELYDFLYNKNNSLIKENQD

SEQ ID NO: 2196825 - protein, 23 aa, Cryptosporidium hominis
SEIRCLFDGFLSSDLYELRTENN

SEQ ID NO: 2196826 - protein, 23 aa, Cryptosporidium hominis
SEIRRRLHFSRQKSDIMIDGTRI

SEQ ID NO: 2196827 - protein, 26 aa, Cryptosporidium hominis
SEIVSSFFEVYFAYHEYYFKQLVNLI

SEQ ID NO: 2196828 - protein, 25 aa, Cryptosporidium hominis
SEKANLLFDLFGYDDANRLSVAFHS

SEQ ID NO: 2196829 - protein, 31 aa, Cryptosporidium hominis
SEKEKINSWLEKQILIWNGIPINKLSGKNRV

SEQ ID NO: 2196830 - protein, 19 aa, Cryptosporidium hominis
SEKFGLWSFELYKNSNACI

SEQ ID NO: 2196831 - protein, 25 aa, Cryptosporidium hominis
SEKGYKSWWALKSEIFNLIQMTKQS

SEQ ID NO: 2196832 - protein, 24 aa, Cryptosporidium hominis
SEKHRVELLYKLEKLRKIQDEYFR

SEQ ID NO: 2196833 - protein, 29 aa, Cryptosporidium hominis
SEKKNIFQFIINYLKLMSSHLLFMAETDP

SEQ ID NO: 2196834 - protein, 31 aa, Cryptosporidium hominis
SEKNESIKFIKIKVAFLINQGYPEKSPPEIN

SEQ ID NO: 2196835 - protein, 29 aa, Cryptosporidium hominis
SEKSFMKKLKFILFQQQRENKRLKKIKSK

SEQ ID NO: 2196836 - protein, 20 aa, Cryptosporidium hominis
SEKSLLGIIAFSISKSFKSL

SEQ ID NO: 2196837 - protein, 35 aa, Cryptosporidium hominis
SEKTENESLWFDALRHLLKWTLQWDPSNRPNVNQL

SEQ ID NO: 2196838 - protein, 17 aa, Cryptosporidium hominis
SELDVLEPVYLRRLIRL

SEQ ID NO: 2196839 - protein, 24 aa, Cryptosporidium hominis
SELKSFCRTLLERRLRDGEIQIFP

SEQ ID NO: 2196840 - protein, 27 aa, Cryptosporidium hominis
SEMKKKLVVKLRKKLMEFHNKLLNKEN

SEQ ID NO: 2196841 - protein, 19 aa, Cryptosporidium hominis
SEMNLLFPGEEEGDWKELA

SEQ ID NO: 2196842 - protein, 28 aa, Cryptosporidium hominis
SEMNTLLHLIVPIYLKYLRHKNINGNSK

SEQ ID NO: 2196843 - protein, 24 aa, Cryptosporidium hominis
SEMSKIFHILTLDLNSEEFLKLSD

SEQ ID NO: 2196844 - protein, 30 aa, Cryptosporidium hominis
SEMYADLCQILKWRSPVLVNKDGKSTIAFS

SEQ ID NO: 2196845 - protein, 25 aa, Cryptosporidium hominis
SENEPFHCLYCLERKHKGKRGRKRK

SEQ ID NO: 2196846 - protein, 21 aa, Cryptosporidium hominis
SENFLIRNTLHPRSDLVMMST

SEQ ID NO: 2196847 - protein, 35 aa, Cryptosporidium hominis
SENGWVHWYCGLREHYFFIVIPNEYTRDAFNLYGL

SEQ ID NO: 2196848 - protein, 24 aa, Cryptosporidium hominis
SENMSRRRFSISYVQNLPNKSIEN

SEQ ID NO: 2196849 - protein, 37 aa, Cryptosporidium hominis
SENNNTNFMMPFQNNILKLIDHLSINIGKISFEGLKN

SEQ ID NO: 2196850 - protein, 17 aa, Cryptosporidium hominis
SENNYLHIWSPGEAMFL

SEQ ID NO: 2196851 - protein, 31 aa, Cryptosporidium hominis
SENRHFAIFVDPFPKPCYLFAVVAGVLGRLE

SEQ ID NO: 2196852 - protein, 21 aa, Cryptosporidium hominis
SENSGFIFARALNEYDPKTVK

SEQ ID NO: 2196853 - protein, 23 aa, Cryptosporidium hominis
SENSRLLGIKKVELDEARSLLAS

SEQ ID NO: 2196854 - protein, 20 aa, Cryptosporidium hominis
SENVDKLCLAELELKIKENE

SEQ ID NO: 2196855 - protein, 24 aa, Cryptosporidium hominis
SEPIPPVYIPIFWTSIHRNKVELD

SEQ ID NO: 2196856 - protein, 17 aa, Cryptosporidium hominis
SEPTQQVPAIPATIQAG

SEQ ID NO: 2196857 - protein, 24 aa, Cryptosporidium hominis
SEQAKQLIRRLLTVDPSQRMTLSE

SEQ ID NO: 2196858 - protein, 18 aa, Cryptosporidium hominis
SEQESCVKVLLNYGADLK

SEQ ID NO: 2196859 - protein, 23 aa, Cryptosporidium hominis
SEQLKLKQKECLDYSSKIQQIEL

SEQ ID NO: 2196860 - protein, 31 aa, Cryptosporidium hominis
SEQQQQIPVRYLVPPPPPPPSKTSGPLQIFQ

SEQ ID NO: 2196861 - protein, 31 aa, Cryptosporidium hominis
SEQTIELELDYLLGWWLGAREAEFVRMSEAW

SEQ ID NO: 2196862 - protein, 30 aa, Cryptosporidium hominis
SEQYINARKLVERLLLKIYQEYDDFLLSNN

SEQ ID NO: 2196863 - protein, 29 aa, Cryptosporidium hominis
SESLRIEMYKKFLKNQALLALKLGKYNDS

SEQ ID NO: 2196864 - protein, 26 aa, Cryptosporidium hominis
SESNNKSISILWPTLDKWASLSEESF

SEQ ID NO: 2196865 - protein, 26 aa, Cryptosporidium hominis
SESRKAYFIGYMVHKLCLGALGRVPE

SEQ ID NO: 2196866 - protein, 23 aa, Cryptosporidium hominis
SESYTSFILARSLNPIKYTNEND

SEQ ID NO: 2196867 - protein, 32 aa, Cryptosporidium hominis
SETFAGFITDQGYLYCWPWPGTISGRSEIKIN

SEQ ID NO: 2196868 - protein, 21 aa, Cryptosporidium hominis
SEVLSILRYLSNFDTFSTSLD

SEQ ID NO: 2196869 - protein, 25 aa, Cryptosporidium hominis
SEVQPVNLQYLGGGPHLGPHPHIFI

SEQ ID NO: 2196870 - protein, 29 aa, Cryptosporidium hominis
SEVSISLIKRLRYISSLKLGIFREILFRV

SEQ ID NO: 2196871 - protein, 27 aa, Cryptosporidium hominis
SEVYLEQFTFFRFQLRDYPAITKVVCK

SEQ ID NO: 2196872 - protein, 24 aa, Cryptosporidium hominis
SEYNLMITVFSESIIYCCVDKIMD

SEQ ID NO: 2196873 - protein, 24 aa, Cryptosporidium hominis
SEYTPLYIYKSFGSSVRSVSISGT

SEQ ID NO: 2196874 - protein, 20 aa, Cryptosporidium hominis
SFAFAPILKINVHSSVLATS

SEQ ID NO: 2196875 - protein, 18 aa, Cryptosporidium hominis
SFAPVRFGSMSISDTLAL

SEQ ID NO: 2196876 - protein, 34 aa, Cryptosporidium hominis
SFARRSISLFFGYHYFVLLSFMPGSGLLDETFKL

SEQ ID NO: 2196877 - protein, 19 aa, Cryptosporidium hominis
SFCITAKGRMYIGGGESVG

SEQ ID NO: 2196878 - protein, 18 aa, Cryptosporidium hominis
SFDDIINYFKQFTKKISE

SEQ ID NO: 2196879 - protein, 26 aa, Cryptosporidium hominis
SFDKSHYWFTPDFTLLSNGGGVIDHC

SEQ ID NO: 2196880 - protein, 20 aa, Cryptosporidium hominis
SFDLTLIQLIKHIIVVPADN

SEQ ID NO: 2196881 - protein, 25 aa, Cryptosporidium hominis
SFDRSRLLTRFVIKLILELNDKNKS

SEQ ID NO: 2196882 - protein, 18 aa, Cryptosporidium hominis
SFEAFHIFKLFVANPNKS

SEQ ID NO: 2196883 - protein, 19 aa, Cryptosporidium hominis
SFEGLKNVIKGKYVINPII

SEQ ID NO: 2196884 - protein, 29 aa, Cryptosporidium hominis
SFEHALDLFSAFFICPLFDTKYVDREVNA

SEQ ID NO: 2196885 - protein, 26 aa, Cryptosporidium hominis
SFELEAPKFELSFSDLSIRGEASISV

SEQ ID NO: 2196886 - protein, 18 aa, Cryptosporidium hominis
SFELFKNYITICSIKYKS

SEQ ID NO: 2196887 - protein, 24 aa, Cryptosporidium hominis
SFFLSYIGYFIYSENKDPFSECKK

SEQ ID NO: 2196888 - protein, 26 aa, Cryptosporidium hominis
SFGIGRIIYCLLEHSFKIREDLSEVQ

SEQ ID NO: 2196889 - protein, 25 aa, Cryptosporidium hominis
SFGKYGKILNMRILPNNNDTCSAFI

SEQ ID NO: 2196890 - protein, 30 aa, Cryptosporidium hominis
SFGSYFEKPPPLAVLPYKGFIQTGIPQIHL

SEQ ID NO: 2196891 - protein, 17 aa, Cryptosporidium hominis
SFGVFDKLISLAQNRSI

SEQ ID NO: 2196892 - protein, 21 aa, Cryptosporidium hominis
SFICNDKVKAVPWSNIKEIFT

SEQ ID NO: 2196893 - protein, 19 aa, Cryptosporidium hominis
SFIHILMEFKGYSGVFNSD

SEQ ID NO: 2196894 - protein, 17 aa, Cryptosporidium hominis
SFIKQAILFCCDEIGHL

SEQ ID NO: 2196895 - protein, 19 aa, Cryptosporidium hominis
SFILHGLEYQLRVRKLIQS

SEQ ID NO: 2196896 - protein, 20 aa, Cryptosporidium hominis
SFISGILWLNPSDTFMDIKR

SEQ ID NO: 2196897 - protein, 18 aa, Cryptosporidium hominis
SFITVNSILHMGGPGGTQ

SEQ ID NO: 2196898 - protein, 28 aa, Cryptosporidium hominis
SFIYPSLSRVLFLIFNYSNIILKHGIVQ

SEQ ID NO: 2196899 - protein, 19 aa, Cryptosporidium hominis
SFKENFYFHWKRIIGACNF

SEQ ID NO: 2196900 - protein, 19 aa, Cryptosporidium hominis
SFKSIFSTLLPNSSAELVP

SEQ ID NO: 2196901 - protein, 24 aa, Cryptosporidium hominis
SFLDASRQLILPKLFQISQGEHLI

SEQ ID NO: 2196902 - protein, 21 aa, Cryptosporidium hominis
SFLEIFKRANYKCILKMEQTF

SEQ ID NO: 2196903 - protein, 17 aa, Cryptosporidium hominis
SFLIKRMTRKMYTDITA

SEQ ID NO: 2196904 - protein, 22 aa, Cryptosporidium hominis
SFLNIMCNIIMNDKLRSICKVE

SEQ ID NO: 2196905 - protein, 28 aa, Cryptosporidium hominis
SFLSIRIIHYCILRLLKIRKSIDAIYQT

SEQ ID NO: 2196906 - protein, 19 aa, Cryptosporidium hominis
SFLVKGVAFKKTFSYAGFE

SEQ ID NO: 2196907 - protein, 19 aa, Cryptosporidium hominis
SFMILDYIAFLSENKQDEN

SEQ ID NO: 2196908 - protein, 18 aa, Cryptosporidium hominis
SFMRLVSSLYQHPSIICQ

SEQ ID NO: 2196909 - protein, 21 aa, Cryptosporidium hominis
SFPDVSFLKLTSKIFFFFEHY

SEQ ID NO: 2196910 - protein, 20 aa, Cryptosporidium hominis
SFPLGLACNVSNRRYDLNPR

SEQ ID NO: 2196911 - protein, 26 aa, Cryptosporidium hominis
SFSSRTNLIYTYSSNWFASLVNSKSA

SEQ ID NO: 2196912 - protein, 30 aa, Cryptosporidium hominis
SFTKELFLKYTFLRFMPRSFSIKKISLAPC

SEQ ID NO: 2196913 - protein, 31 aa, Cryptosporidium hominis
SFTNLDSISGIKTFLLGKIGHGNIGSKLNTS

SEQ ID NO: 2196914 - protein, 18 aa, Cryptosporidium hominis
SFVNKLIERYYSTSKSKL

SEQ ID NO: 2196915 - protein, 18 aa, Cryptosporidium hominis
SFVVLPKKIREVGNEPAF

SEQ ID NO: 2196916 - protein, 23 aa, Cryptosporidium hominis
SFYITQLSILTEQLNMQKQLLLS

SEQ ID NO: 2196917 - protein, 17 aa, Cryptosporidium hominis
SFYSCGYDKQILFWDAE

SEQ ID NO: 2196918 - protein, 19 aa, Cryptosporidium hominis
SFYSFIYSTCNTIPFKESE

SEQ ID NO: 2196919 - protein, 17 aa, Cryptosporidium hominis
SGAKHLIILILVKFVKM

SEQ ID NO: 2196920 - protein, 21 aa, Cryptosporidium hominis
SGAPLPLFMLELFSLSREERA

SEQ ID NO: 2196921 - protein, 23 aa, Cryptosporidium hominis
SGAYGCVVSFYDKSRGSYIAVKK

SEQ ID NO: 2196922 - protein, 17 aa, Cryptosporidium hominis
SGAYKRTKGKRWSTEQT

SEQ ID NO: 2196923 - protein, 24 aa, Cryptosporidium hominis
SGCTALHIALLNAYPEMLEILLSC

SEQ ID NO: 2196924 - protein, 18 aa, Cryptosporidium hominis
SGDLIPWTLCNHLARDDF

SEQ ID NO: 2196925 - protein, 20 aa, Cryptosporidium hominis
SGECFPVFKGIASKLNNLFS

SEQ ID NO: 2196926 - protein, 24 aa, Cryptosporidium hominis
SGEKSFMIFCIPISWLDSTDDYIK

SEQ ID NO: 2196927 - protein, 25 aa, Cryptosporidium hominis
SGFKKSIILSYLVSSGYLDLNEGVE

SEQ ID NO: 2196928 - protein, 17 aa, Cryptosporidium hominis
SGFLAFCTEKRALKSGG

SEQ ID NO: 2196929 - protein, 24 aa, Cryptosporidium hominis
SGGAFRIWDIRTGRSILSQLAHSK

SEQ ID NO: 2196930 - protein, 32 aa, Cryptosporidium hominis
SGGARLNYVFHNWFGNTLFSFDPLDGLSDTEI

SEQ ID NO: 2196931 - protein, 28 aa, Cryptosporidium hominis
SGGLEFWDPWIMTLPRRNIQDNELNPIK

SEQ ID NO: 2196932 - protein, 36 aa, Cryptosporidium hominis
SGGQRSLLALSLILSMLRFKPAPVYILDEIDSALDL

SEQ ID NO: 2196933 - protein, 18 aa, Cryptosporidium hominis
SGICSGINPSKWGGSVLP

SEQ ID NO: 2196934 - protein, 25 aa, Cryptosporidium hominis
SGINSLLKEKYKWECRIVELGGPNY

SEQ ID NO: 2196935 - protein, 17 aa, Cryptosporidium hominis
SGIPIASFPGIESILST

SEQ ID NO: 2196936 - protein, 26 aa, Cryptosporidium hominis
SGIWHETLPIFIYTTQGHIKYAIPNI

SEQ ID NO: 2196937 - protein, 25 aa, Cryptosporidium hominis
SGKAIPNPILVQKMSRCLGVNLPKP

SEQ ID NO: 2196938 - protein, 27 aa, Cryptosporidium hominis
SGKLLIYDDWLYFGPLSVQELYRMKLS

SEQ ID NO: 2196939 - protein, 31 aa, Cryptosporidium hominis
SGKLLLVQNFRIICPLFTSCGHLLIGAYRAH

SEQ ID NO: 2196940 - protein, 19 aa, Cryptosporidium hominis
SGKLVKPVIISCPASLLDN

SEQ ID NO: 2196941 - protein, 22 aa, Cryptosporidium hominis
SGKPAGLYGGNLVPFGLSGGAL

SEQ ID NO: 2196942 - protein, 23 aa, Cryptosporidium hominis
SGKSIVESILLPLSTTSCGTSAE

SEQ ID NO: 2196943 - protein, 23 aa, Cryptosporidium hominis
SGKTFICYYAMEQVLRFDNESVV

SEQ ID NO: 2196944 - protein, 23 aa, Cryptosporidium hominis
SGKTLAFLIPAANLLYNVEFLPR

SEQ ID NO: 2196945 - protein, 23 aa, Cryptosporidium hominis
SGLAWPMYYKFDEKEIKEQNFEL

SEQ ID NO: 2196946 - protein, 27 aa, Cryptosporidium hominis
SGLDEKIRVIKYLWETKRDFNIHEVFD

SEQ ID NO: 2196947 - protein, 24 aa, Cryptosporidium hominis
SGLHGWAFTIEKFARIYAKKFGVE

SEQ ID NO: 2196948 - protein, 27 aa, Cryptosporidium hominis
SGLIKKRITIIPLDKIMDPSISEKTLN

SEQ ID NO: 2196949 - protein, 25 aa, Cryptosporidium hominis
SGLREIFVYLAKNKLIDVIVTSAGG

SEQ ID NO: 2196950 - protein, 28 aa, Cryptosporidium hominis
SGLYDLISEAFCFLPLAHVINDKVFVVH

SEQ ID NO: 2196951 - protein, 20 aa, Cryptosporidium hominis
SGMHINISLWKNEKNIFFDP

SEQ ID NO: 2196952 - protein, 18 aa, Cryptosporidium hominis
SGMIVDQGLLHQNASQRN

SEQ ID NO: 2196953 - protein, 23 aa, Cryptosporidium hominis
SGNENVLGFIPFETAKKLAKNQF

SEQ ID NO: 2196954 - protein, 25 aa, Cryptosporidium hominis
SGNLFYISLITGQLLRWDPDEVTTN

SEQ ID NO: 2196955 - protein, 28 aa, Cryptosporidium hominis
SGNLKRIIKIVLFTLKSSNYEWIFISSH

SEQ ID NO: 2196956 - protein, 24 aa, Cryptosporidium hominis
SGNNGNMYGLYQYNAKKPEIPIDI

SEQ ID NO: 2196957 - protein, 23 aa, Cryptosporidium hominis
SGNPRIIGLIGSPPPREIWSGAN

SEQ ID NO: 2196958 - protein, 22 aa, Cryptosporidium hominis
SGNSSMFLPGRAQNTAGQAGQV

SEQ ID NO: 2196959 - protein, 25 aa, Cryptosporidium hominis
SGPYRNFAFLFRNPSYKGKIIEIIA

SEQ ID NO: 2196960 - protein, 27 aa, Cryptosporidium hominis
SGRGYKFLKMILKSNYYLGYHFLTTLV

SEQ ID NO: 2196961 - protein, 25 aa, Cryptosporidium hominis
SGRIVDYLRSMYLLFNVDDGNILKH

SEQ ID NO: 2196962 - protein, 19 aa, Cryptosporidium hominis
SGRKLLRFNYAKKLQFSSN

SEQ ID NO: 2196963 - protein, 29 aa, Cryptosporidium hominis
SGRLHWLRVMYHYLDTVDARKIREVNKGD

SEQ ID NO: 2196964 - protein, 19 aa, Cryptosporidium hominis
SGSIISRFIPRFILSLSSC

SEQ ID NO: 2196965 - protein, 26 aa, Cryptosporidium hominis
SGSILAEIFTFEFLKEFYGVLDFGSV

SEQ ID NO: 2196966 - protein, 20 aa, Cryptosporidium hominis
SGSNNLYFPKLISASKDFTL

SEQ ID NO: 2196967 - protein, 23 aa, Cryptosporidium hominis
SGSSDFCIRLWKNEASQPLGPRS

SEQ ID NO: 2196968 - protein, 23 aa, Cryptosporidium hominis
SGSWNDFLSFLYSKGHSVDWKIE

SEQ ID NO: 2196969 - protein, 17 aa, Cryptosporidium hominis
SGSYLYKYPRSCIGSRR

SEQ ID NO: 2196970 - protein, 25 aa, Cryptosporidium hominis
SGTTATVILHLPLENRIIAAHVGDS

SEQ ID NO: 2196971 - protein, 24 aa, Cryptosporidium hominis
SGVGKSCLLLRFADDTYTDSYIST

SEQ ID NO: 2196972 - protein, 18 aa, Cryptosporidium hominis
SGVILYEETLFQSTASGE

SEQ ID NO: 2196973 - protein, 24 aa, Cryptosporidium hominis
SGVSRGFGFVSFLSPDEATKAITE

SEQ ID NO: 2196974 - protein, 27 aa, Cryptosporidium hominis
SGYAGKVLFGWDFPAGFTPSLSCKGFH

SEQ ID NO: 2196975 - protein, 47 aa, Cryptosporidium hominis
SGYITSIEWIFHTKLLVFTIYRILDTFVFPFSIPNLKQPCLELLTFI

SEQ ID NO: 2196976 - protein, 18 aa, Cryptosporidium hominis
SHAMNFLASLTSCGIIKD

SEQ ID NO: 2196977 - protein, 18 aa, Cryptosporidium hominis
SHCFGIFMRFINDKHNGK

SEQ ID NO: 2196978 - protein, 29 aa, Cryptosporidium hominis
SHDPYKRLLVFFKWLFNSLNRGSRAVFQF

SEQ ID NO: 2196979 - protein, 18 aa, Cryptosporidium hominis
SHFFNIRIVMFQICREIA

SEQ ID NO: 2196980 - protein, 34 aa, Cryptosporidium hominis
SHGDLRFRVLLGDRKFYSMPLYLEITLDPDNNYK

SEQ ID NO: 2196981 - protein, 26 aa, Cryptosporidium hominis
SHGVPMIHIPMLYDSFTSFRFEHDAT

SEQ ID NO: 2196982 - protein, 18 aa, Cryptosporidium hominis
SHIERFTRILLYSPKLNE

SEQ ID NO: 2196983 - protein, 21 aa, Cryptosporidium hominis
SHIRGLGLNDALDARYSSDGM

SEQ ID NO: 2196984 - protein, 35 aa, Cryptosporidium hominis
SHISKWIRDEYRFNNPMFLIPKKVKKNFKNEVCSK

SEQ ID NO: 2196985 - protein, 26 aa, Cryptosporidium hominis
SHKKNPLLAVGFTNGLFSLIQPETGK

SEQ ID NO: 2196986 - protein, 26 aa, Cryptosporidium hominis
SHKLIEYHILRLFEKVIDFNSFSRCV

SEQ ID NO: 2196987 - protein, 19 aa, Cryptosporidium hominis
SHKYRIPFHYLIKHPINAL

SEQ ID NO: 2196988 - protein, 23 aa, Cryptosporidium hominis
SHLQDNALLIAMYKLGVQSYNDV

SEQ ID NO: 2196989 - protein, 24 aa, Cryptosporidium hominis
SHMHEIHMQKFPHPSIISNHQLDS

SEQ ID NO: 2196990 - protein, 26 aa, Cryptosporidium hominis
SHNGSLVSTPIRKSKRQIIYNFANSI

SEQ ID NO: 2196991 - protein, 24 aa, Cryptosporidium hominis
SHPAIPPYHMLPQPQPGVIPQMIP

SEQ ID NO: 2196992 - protein, 23 aa, Cryptosporidium hominis
SHPFKLHIHDLIKDVWHSSILCK

SEQ ID NO: 2196993 - protein, 25 aa, Cryptosporidium hominis
SHRKLTWIYWYGECVLDYKLPTPNG

SEQ ID NO: 2196994 - protein, 18 aa, Cryptosporidium hominis
SHRQTLIAEGILPIIADS

SEQ ID NO: 2196995 - protein, 20 aa, Cryptosporidium hominis
SHSLGRFKLKFSPEKIDTMI

SEQ ID NO: 2196996 - protein, 18 aa, Cryptosporidium hominis
SHSSIPRYSLKNKLVIVF

SEQ ID NO: 2196997 - protein, 17 aa, Cryptosporidium hominis
SHVYYPRAYMYNNIKHN

SEQ ID NO: 2196998 - protein, 18 aa, Cryptosporidium hominis
SHWSILLKHQSSQFNVDV

SEQ ID NO: 2196999 - protein, 18 aa, Cryptosporidium hominis
SHWSPTAIKLFPLASPVG

SEQ ID NO: 2197000 - protein, 30 aa, Cryptosporidium hominis
SIAESLLYLTLHELFIFRTLQTDPNPANFL

SEQ ID NO: 2197001 - protein, 19 aa, Cryptosporidium hominis
SIAGIKFFGKPLKIQLKAG

SEQ ID NO: 2197002 - protein, 18 aa, Cryptosporidium hominis
SIAIPLIENIIQSKDEKL

SEQ ID NO: 2197003 - protein, 25 aa, Cryptosporidium hominis
SIAKYSYHILICIINIIEDKSFQLD

SEQ ID NO: 2197004 - protein, 24 aa, Cryptosporidium hominis
SIALQPCIAIKEKSFRLPIFELTY

SEQ ID NO: 2197005 - protein, 20 aa, Cryptosporidium hominis
SIANFKLNIPLTSISTYNTN

SEQ ID NO: 2197006 - protein, 26 aa, Cryptosporidium hominis
SIAPAYHRMNFLLQVSQQYALVSNEL

SEQ ID NO: 2197007 - protein, 20 aa, Cryptosporidium hominis
SICILHDILNYYNKYNTCYL

SEQ ID NO: 2197008 - protein, 22 aa, Cryptosporidium hominis
SICLMDTFSLVRSISNLRLIGS

SEQ ID NO: 2197009 - protein, 23 aa, Cryptosporidium hominis
SICRNIFLFYQSNKYYMNFTQLN

SEQ ID NO: 2197010 - protein, 19 aa, Cryptosporidium hominis
SIDIISFGEILVNRERLQA

SEQ ID NO: 2197011 - protein, 20 aa, Cryptosporidium hominis
SIDLLKKMLVFNPNKRITVD

SEQ ID NO: 2197012 - protein, 26 aa, Cryptosporidium hominis
SIDLWSIGCVFGELILGKPLFSGETS

SEQ ID NO: 2197013 - protein, 25 aa, Cryptosporidium hominis
SIDNYILIILGTWMNGSKLSCIYYN

SEQ ID NO: 2197014 - protein, 23 aa, Cryptosporidium hominis
SIEADCGARLFLGGRAIIVDRMP

SEQ ID NO: 2197015 - protein, 24 aa, Cryptosporidium hominis
SIEIPPRFDLTKLPWLNQIPNANF

SEQ ID NO: 2197016 - protein, 24 aa, Cryptosporidium hominis
SIEKDWEEFFKHKSPRMRKICQWK

SEQ ID NO: 2197017 - protein, 30 aa, Cryptosporidium hominis
SIENQKIFLSILFFTVYHLLSNGKYDNAKF

SEQ ID NO: 2197018 - protein, 22 aa, Cryptosporidium hominis
SIERILFLILNNGFLALQHNKL

SEQ ID NO: 2197019 - protein, 20 aa, Cryptosporidium hominis
SIESGYRWDGVIRGNGFEEN

SEQ ID NO: 2197020 - protein, 27 aa, Cryptosporidium hominis
SIESINEFILLNWTPGEQKLLEEAICY

SEQ ID NO: 2197021 - protein, 24 aa, Cryptosporidium hominis
SIFQRKYWPVFIGTIPICDLEPSN

SEQ ID NO: 2197022 - protein, 27 aa, Cryptosporidium hominis
SIFSLKKHVFLLLKLKIDKKNKIIQLF

SEQ ID NO: 2197023 - protein, 20 aa, Cryptosporidium hominis
SIFTLIYEMEAKVGLDESRI

SEQ ID NO: 2197024 - protein, 20 aa, Cryptosporidium hominis
SIGCLLLELCSLEKVFRKYS

SEQ ID NO: 2197025 - protein, 24 aa, Cryptosporidium hominis
SIGKPFLPVGIHPVPYFGTSENTP

SEQ ID NO: 2197026 - protein, 19 aa, Cryptosporidium hominis
SIGNTDLRLNQVNNEIVFG

SEQ ID NO: 2197027 - protein, 27 aa, Cryptosporidium hominis
SIGQLRLQFIFLYYDTDRNGLLNLNEL

SEQ ID NO: 2197028 - protein, 24 aa, Cryptosporidium hominis
SIGRPKFGGILKSQKGDMLCDYDD

SEQ ID NO: 2197029 - protein, 17 aa, Cryptosporidium hominis
SIHFRSITLQDPATVIF

SEQ ID NO: 2197030 - protein, 17 aa, Cryptosporidium hominis
SIHLHWLAVEGKFVFNS

SEQ ID NO: 2197031 - protein, 31 aa, Cryptosporidium hominis
SIHTSTVEYLSSFILELCIDDILTSLDTSIH

SEQ ID NO: 2197032 - protein, 24 aa, Cryptosporidium hominis
SIIARFHRILRPFMLRRVKSEVEI

SEQ ID NO: 2197033 - protein, 28 aa, Cryptosporidium hominis
SIIEIWIDWKIFPLEYIEGLSSSLCFDK

SEQ ID NO: 2197034 - protein, 29 aa, Cryptosporidium hominis
SIIIVEGIFILFHPKIRHLINMSIFVDTD

SEQ ID NO: 2197035 - protein, 20 aa, Cryptosporidium hominis
SIIKTQFYNALPEKSRDLLC

SEQ ID NO: 2197036 - protein, 36 aa, Cryptosporidium hominis
SIIMQESKLLREPIILLIDPKRMQIINLRNKISMTD

SEQ ID NO: 2197037 - protein, 20 aa, Cryptosporidium hominis
SIIPLLSISVDFYVRVFVKV

SEQ ID NO: 2197038 - protein, 19 aa, Cryptosporidium hominis
SIISLLSPVSWLQMDEIKI

SEQ ID NO: 2197039 - protein, 19 aa, Cryptosporidium hominis
SIISRYWLNHSIACSGERI

SEQ ID NO: 2197040 - protein, 26 aa, Cryptosporidium hominis
SIIVENLVFFFIITKDHKNAKLIYSW

SEQ ID NO: 2197041 - protein, 26 aa, Cryptosporidium hominis
SIKKFIDSLLKLSFGYGWNLLHIFSY

SEQ ID NO: 2197042 - protein, 25 aa, Cryptosporidium hominis
SIKNEILFRILSTKLAQFYTTNGGD

SEQ ID NO: 2197043 - protein, 34 aa, Cryptosporidium hominis
SIKRLYQGSINFIKLKLLIYIEEPEILLANTCGP

SEQ ID NO: 2197044 - protein, 27 aa, Cryptosporidium hominis
SIKRYGIPALMNYSYRYTNKALSSDTE

SEQ ID NO: 2197045 - protein, 20 aa, Cryptosporidium hominis
SIKVIFNPTSLFGQIFEWSQ

SEQ ID NO: 2197046 - protein, 18 aa, Cryptosporidium hominis
SILDRRIIQSLTNNNYLV

SEQ ID NO: 2197047 - protein, 24 aa, Cryptosporidium hominis
SILELYHFCIRDRFYSSLSYGQLK

SEQ ID NO: 2197048 - protein, 18 aa, Cryptosporidium hominis
SILENFLMDILEAFDCHT

SEQ ID NO: 2197049 - protein, 22 aa, Cryptosporidium hominis
SILFTDMFQHKYLRDLVLNFNK

SEQ ID NO: 2197050 - protein, 17 aa, Cryptosporidium hominis
SILGFGSTSLVYSAVWR

SEQ ID NO: 2197051 - protein, 22 aa, Cryptosporidium hominis
SILIIDVQPLLHASPLLFNLFE

SEQ ID NO: 2197052 - protein, 28 aa, Cryptosporidium hominis
SILKCSQLDLLKFLKYSNDKLSKYNIGV

SEQ ID NO: 2197053 - protein, 25 aa, Cryptosporidium hominis
SILKGLSELGFLNPTPIQAACLVPA

SEQ ID NO: 2197054 - protein, 34 aa, Cryptosporidium hominis
SILKGYLIHLTQDISWIYNKMDMSRFYLSITPDE

SEQ ID NO: 2197055 - protein, 25 aa, Cryptosporidium hominis
SILKRKKHIFIITKTSSVFQSSIDE

SEQ ID NO: 2197056 - protein, 19 aa, Cryptosporidium hominis
SILKSYRRIVQSNEQMING

SEQ ID NO: 2197057 - protein, 34 aa, Cryptosporidium hominis
SILLDNPQFCYALLHSQFILGMVNEPFVPLNQEQ

SEQ ID NO: 2197058 - protein, 19 aa, Cryptosporidium hominis
SILLDPANYKPVWILSLLH

SEQ ID NO: 2197059 - protein, 27 aa, Cryptosporidium hominis
SILSIWPIKSRLPVWKVWREMNNLLIN

SEQ ID NO: 2197060 - protein, 27 aa, Cryptosporidium hominis
SILTFVWLTYWHLKSLLNIAPSFWRFC

SEQ ID NO: 2197061 - protein, 26 aa, Cryptosporidium hominis
SIMNSMDSFRFFYINKSNYAIRRSNR

SEQ ID NO: 2197062 - protein, 34 aa, Cryptosporidium hominis
SINDKLEIFFIDFDLMPLLLEENYISALSVKSGG

SEQ ID NO: 2197063 - protein, 23 aa, Cryptosporidium hominis
SINITIGDDFFQSPMLDPCNISK

SEQ ID NO: 2197064 - protein, 24 aa, Cryptosporidium hominis
SINITLYRMRRLLGVRAHDGSKAQ

SEQ ID NO: 2197065 - protein, 23 aa, Cryptosporidium hominis
SINKIRSHIRKCSRVRDIAYELN

SEQ ID NO: 2197066 - protein, 26 aa, Cryptosporidium hominis
SINLNLNVKFGYLKHSILNGKQGEVI

SEQ ID NO: 2197067 - protein, 22 aa, Cryptosporidium hominis
SIPGRMFPVELIYNIKPEKDYL

SEQ ID NO: 2197068 - protein, 26 aa, Cryptosporidium hominis
SIPKDGIVRLLTRRKIQLREGEILKH

SEQ ID NO: 2197069 - protein, 20 aa, Cryptosporidium hominis
SIPNNWKFQATVARKQLRQF

SEQ ID NO: 2197070 - protein, 17 aa, Cryptosporidium hominis
SIPSEYIPYARSLDTHW

SEQ ID NO: 2197071 - protein, 18 aa, Cryptosporidium hominis
SIPTLLHDTPSGSIGKLI

SEQ ID NO: 2197072 - protein, 23 aa, Cryptosporidium hominis
SIQDSPINAASTTVKMLSSKSIS

SEQ ID NO: 2197073 - protein, 25 aa, Cryptosporidium hominis
SIQIQKIRLILPPRGIDIQLNTVIN

SEQ ID NO: 2197074 - protein, 19 aa, Cryptosporidium hominis
SIQLELLEIIILDEADRLL

SEQ ID NO: 2197075 - protein, 24 aa, Cryptosporidium hominis
SIQQRLEDVFSGKLDQLSIACKSL

SEQ ID NO: 2197076 - protein, 26 aa, Cryptosporidium hominis
SIRDLFSLPAKYLKYKCKFEEILSSG

SEQ ID NO: 2197077 - protein, 20 aa, Cryptosporidium hominis
SIRIVILGVLYRISNILNIL

SEQ ID NO: 2197078 - protein, 20 aa, Cryptosporidium hominis
SIRPPPVQTMYPPQAYLQNG

SEQ ID NO: 2197079 - protein, 26 aa, Cryptosporidium hominis
SIRSTRIATILLFIKEILLSFSESVS

SEQ ID NO: 2197080 - protein, 19 aa, Cryptosporidium hominis
SIRYTLLKNISKYERFLLK

SEQ ID NO: 2197081 - protein, 23 aa, Cryptosporidium hominis
SISCIDTWQNPLWYDSYSNGFCK

SEQ ID NO: 2197082 - protein, 19 aa, Cryptosporidium hominis
SISDLALACPLHCPELSIS

SEQ ID NO: 2197083 - protein, 23 aa, Cryptosporidium hominis
SISILKDNLLMTELFLTCGSDVQ

SEQ ID NO: 2197084 - protein, 22 aa, Cryptosporidium hominis
SISIQSINCEIIIFSSNNFLIN

SEQ ID NO: 2197085 - protein, 23 aa, Cryptosporidium hominis
SISLSNCDVPWPLTGGDQFLHFN

SEQ ID NO: 2197086 - protein, 25 aa, Cryptosporidium hominis
SISSKSAISSLPKSKAKSAVKSAPA

SEQ ID NO: 2197087 - protein, 24 aa, Cryptosporidium hominis
SISSLKFHPTLPYLISSCCDTFDQ

SEQ ID NO: 2197088 - protein, 22 aa, Cryptosporidium hominis
SISSSLIYKKLIQAQIEHSNTL

SEQ ID NO: 2197089 - protein, 19 aa, Cryptosporidium hominis
SISTNVPIFVLQKDDPNKK

SEQ ID NO: 2197090 - protein, 26 aa, Cryptosporidium hominis
SISVLRSIWTEMVLALKNVHDLRIVH

SEQ ID NO: 2197091 - protein, 32 aa, Cryptosporidium hominis
SISVSLIIAKALQFNFLPTVRSIEKETETSVR

SEQ ID NO: 2197092 - protein, 18 aa, Cryptosporidium hominis
SISVWEFVSRDIGWACIC

SEQ ID NO: 2197093 - protein, 36 aa, Cryptosporidium hominis
SITDQLIKWRLELIPSILNIFQSPLSKLLIEINKYM

SEQ ID NO: 2197094 - protein, 26 aa, Cryptosporidium hominis
SITELWSLLNFLLPQVFHSVEDFQVW

SEQ ID NO: 2197095 - protein, 25 aa, Cryptosporidium hominis
SITIFDTITFHSWLKILSIEQYSLR

SEQ ID NO: 2197096 - protein, 30 aa, Cryptosporidium hominis
SIVEQWIRDKYEFKLYTPDNMIPPSLQIDS

SEQ ID NO: 2197097 - protein, 19 aa, Cryptosporidium hominis
SIVFVLMEFIIKKIVELKA

SEQ ID NO: 2197098 - protein, 22 aa, Cryptosporidium hominis
SIVISLLTFCYGYFPDQVILFI

SEQ ID NO: 2197099 - protein, 24 aa, Cryptosporidium hominis
SIVPQQQFPYYHHLTESSNLNNQF

SEQ ID NO: 2197100 - protein, 18 aa, Cryptosporidium hominis
SIWSYVFKLCGIVKFEMT

SEQ ID NO: 2197101 - protein, 23 aa, Cryptosporidium hominis
SIYQKSYILDYLFLSNQISQTND

SEQ ID NO: 2197102 - protein, 26 aa, Cryptosporidium hominis
SKAAAQLKAAILARASSKKNISADNS

SEQ ID NO: 2197103 - protein, 24 aa, Cryptosporidium hominis
SKAKKYYLCLWAGFYSTIPQTLPQ

SEQ ID NO: 2197104 - protein, 32 aa, Cryptosporidium hominis
SKAMIPVCNKPMIWYPLSNLIQHRIRDICIFC

SEQ ID NO: 2197105 - protein, 28 aa, Cryptosporidium hominis
SKAYYRRGIAYFNLLKYSLARKDFMMVL

SEQ ID NO: 2197106 - protein, 17 aa, Cryptosporidium hominis
SKCEFVILNDKFEKENI

SEQ ID NO: 2197107 - protein, 22 aa, Cryptosporidium hominis
SKCLDLLYQSKLIRYNIINDEV

SEQ ID NO: 2197108 - protein, 34 aa, Cryptosporidium hominis
SKDARPSRFPPDAWHLCCWLLRKNSNERASPIQA

SEQ ID NO: 2197109 - protein, 30 aa, Cryptosporidium hominis
SKDCITEIPLDRWPFDLYYDPDPDNRSKSY

SEQ ID NO: 2197110 - protein, 37 aa, Cryptosporidium hominis
SKDDLIECILASSTIPFLSVPWPTFKCRGKPCVDGYF

SEQ ID NO: 2197111 - protein, 24 aa, Cryptosporidium hominis
SKDLKLIKIQQARERYLLRKQNKN

SEQ ID NO: 2197112 - protein, 44 aa, Cryptosporidium hominis
SKDSLIWESYPNLIEFIIIIDKVFQPLKELLWNKKNTFLMDSET

SEQ ID NO: 2197113 - protein, 18 aa, Cryptosporidium hominis
SKDYYLLQSKRLLEETNQ

SEQ ID NO: 2197114 - protein, 28 aa, Cryptosporidium hominis
SKEDLVTRLFIFTADQKSKLSKISQNDQ

SEQ ID NO: 2197115 - protein, 24 aa, Cryptosporidium hominis
SKEELTYHARQLLQQLRDSLGVKK

SEQ ID NO: 2197116 - protein, 25 aa, Cryptosporidium hominis
SKEFLRWALCVPGQKKNWLVGVRVN

SEQ ID NO: 2197117 - protein, 17 aa, Cryptosporidium hominis
SKEKLGAFLFPESVVFW

SEQ ID NO: 2197118 - protein, 26 aa, Cryptosporidium hominis
SKFHTKALIFFINKDFKRSLFYIEKI

SEQ ID NO: 2197119 - protein, 21 aa, Cryptosporidium hominis
SKFLNVIFKKESGILYVTRNN

SEQ ID NO: 2197120 - protein, 20 aa, Cryptosporidium hominis
SKGEWIVLPFDHITGVELQN

SEQ ID NO: 2197121 - protein, 27 aa, Cryptosporidium hominis
SKGFRQKGVPMLSRYLRPIKVGDYVDI

SEQ ID NO: 2197122 - protein, 21 aa, Cryptosporidium hominis
SKGIIVYNWNKQYSILLESDI

SEQ ID NO: 2197123 - protein, 22 aa, Cryptosporidium hominis
SKGLILNRMQFPGSVGFICYSH

SEQ ID NO: 2197124 - protein, 17 aa, Cryptosporidium hominis
SKGLPIISPSTLRNILN

SEQ ID NO: 2197125 - protein, 22 aa, Cryptosporidium hominis
SKGQLFFVGKNLLKNLGTRAIS

SEQ ID NO: 2197126 - protein, 27 aa, Cryptosporidium hominis
SKGQSLDLLGILLKAGPITTITVKSTG

SEQ ID NO: 2197127 - protein, 24 aa, Cryptosporidium hominis
SKGVLQRKIIVLSLIVAHNAIHRI

SEQ ID NO: 2197128 - protein, 24 aa, Cryptosporidium hominis
SKGVPLRLQFPLNDKYEHGNMQFY

SEQ ID NO: 2197129 - protein, 23 aa, Cryptosporidium hominis
SKHAKLYHEKYKDLFMQMNQSLE

SEQ ID NO: 2197130 - protein, 17 aa, Cryptosporidium hominis
SKIAKILKLVTDKKFTK

SEQ ID NO: 2197131 - protein, 21 aa, Cryptosporidium hominis
SKIPCINLKILTKDVLKHVID

SEQ ID NO: 2197132 - protein, 25 aa, Cryptosporidium hominis
SKIPKLLEEFQNRLLFKAKQRQNES

SEQ ID NO: 2197133 - protein, 24 aa, Cryptosporidium hominis
SKIPLKMIICGVSQRLKQGLYKTL

SEQ ID NO: 2197134 - protein, 28 aa, Cryptosporidium hominis
SKIRVGPEYQAVLPDLIVPEKKTQDKKD

SEQ ID NO: 2197135 - protein, 17 aa, Cryptosporidium hominis
SKISFPGHLIELVNEEK

SEQ ID NO: 2197136 - protein, 24 aa, Cryptosporidium hominis
SKKDKIFYNSFYKVKNFKGNEKQK

SEQ ID NO: 2197137 - protein, 28 aa, Cryptosporidium hominis
SKKERSTWSRIFSPLSFGFDKRELSYSG

SEQ ID NO: 2197138 - protein, 26 aa, Cryptosporidium hominis
SKKGHLLVPTLLPLPTTDLLKLDYSE

SEQ ID NO: 2197139 - protein, 25 aa, Cryptosporidium hominis
SKKHPFRLIFARYYDSHILDMYEFN

SEQ ID NO: 2197140 - protein, 32 aa, Cryptosporidium hominis
SKKNYKSFLLSYPKLFRIFGKDDNHSIQWIGS

SEQ ID NO: 2197141 - protein, 24 aa, Cryptosporidium hominis
SKKQKMVKGFFLFGDGIVEYRSIE

SEQ ID NO: 2197142 - protein, 25 aa, Cryptosporidium hominis
SKKSFYKRFLYDSLPLESCFGVSPL

SEQ ID NO: 2197143 - protein, 17 aa, Cryptosporidium hominis
SKKYVPCMILRRKIQKT

SEQ ID NO: 2197144 - protein, 18 aa, Cryptosporidium hominis
SKLALFSDFYKLASLHED

SEQ ID NO: 2197145 - protein, 23 aa, Cryptosporidium hominis
SKLDEALTYRIESAITAEREINQ

SEQ ID NO: 2197146 - protein, 26 aa, Cryptosporidium hominis
SKLDETKLLPLLYRRQLSQIIEEHYK

SEQ ID NO: 2197147 - protein, 19 aa, Cryptosporidium hominis
SKLLLNDPVSFFVCMEQTF

SEQ ID NO: 2197148 - protein, 17 aa, Cryptosporidium hominis
SKLMMKNSKFKNIIVDF

SEQ ID NO: 2197149 - protein, 23 aa, Cryptosporidium hominis
SKLPPHVFAIAKRAFDNIMSVSR

SEQ ID NO: 2197150 - protein, 28 aa, Cryptosporidium hominis
SKLQKFVKMLHLLANFELFLNGCFNSPY

SEQ ID NO: 2197151 - protein, 32 aa, Cryptosporidium hominis
SKMPPEIQKPYFLLFKLPRSLSLVALEPKSPL

SEQ ID NO: 2197152 - protein, 25 aa, Cryptosporidium hominis
SKNCLDILSDPLLPIATRNVEQVDD

SEQ ID NO: 2197153 - protein, 29 aa, Cryptosporidium hominis
SKNEDSISLLFIPILLKADLKKTRVNPEK

SEQ ID NO: 2197154 - protein, 23 aa, Cryptosporidium hominis
SKNKFFQMIIQNLVSHLNFDDLD

SEQ ID NO: 2197155 - protein, 28 aa, Cryptosporidium hominis
SKNKLESISFLKYCWNLTDINLSNNNLT

SEQ ID NO: 2197156 - protein, 23 aa, Cryptosporidium hominis
SKNKYINYRDSKITRILSDSLGG

SEQ ID NO: 2197157 - protein, 18 aa, Cryptosporidium hominis
SKNLLMKSPLVKNALRRL

SEQ ID NO: 2197158 - protein, 20 aa, Cryptosporidium hominis
SKNNWGVGFLESFERKKVCQ

SEQ ID NO: 2197159 - protein, 23 aa, Cryptosporidium hominis
SKNQTKILLKQNADYIQSSEKRL

SEQ ID NO: 2197160 - protein, 25 aa, Cryptosporidium hominis
SKPKNIYLSSMRWNIVTNGNFLFYS

SEQ ID NO: 2197161 - protein, 29 aa, Cryptosporidium hominis
SKPNLSGKLYLLSRLLFHIRSNTKDRVVL

SEQ ID NO: 2197162 - protein, 25 aa, Cryptosporidium hominis
SKPQDARVPTLLKSTYISTSDSSSN

SEQ ID NO: 2197163 - protein, 20 aa, Cryptosporidium hominis
SKQESKLILSEFRDDSMSFK

SEQ ID NO: 2197164 - protein, 25 aa, Cryptosporidium hominis
SKQKIKFGIFGGYLYSIVVGRKPNS

SEQ ID NO: 2197165 - protein, 28 aa, Cryptosporidium hominis
SKQSKSIMWYILVPYEYGIPIITETQRQ

SEQ ID NO: 2197166 - protein, 27 aa, Cryptosporidium hominis
SKQVYRKLKFFTEFKLWKIFKDEYSNI

SEQ ID NO: 2197167 - protein, 33 aa, Cryptosporidium hominis
SKRARPLEMLILPNVALMLSTLRFRLYEVMENL

SEQ ID NO: 2197168 - protein, 30 aa, Cryptosporidium hominis
SKRITIYEDFVSKHYKKWIDRLTIIEDVVS

SEQ ID NO: 2197169 - protein, 27 aa, Cryptosporidium hominis
SKRKVHRSLWIPPKSYEHAYVNDLNGT

SEQ ID NO: 2197170 - protein, 22 aa, Cryptosporidium hominis
SKSFVIFGLPCIGSDKYERFLK

SEQ ID NO: 2197171 - protein, 19 aa, Cryptosporidium hominis
SKSIFIPKSVIKPNAHSSA

SEQ ID NO: 2197172 - protein, 25 aa, Cryptosporidium hominis
SKSISRISVFPWSGKNCFYIYTDNS

SEQ ID NO: 2197173 - protein, 21 aa, Cryptosporidium hominis
SKSITFRQFICKMRKSFKQLI

SEQ ID NO: 2197174 - protein, 28 aa, Cryptosporidium hominis
SKSKKRRIIMRLSKLKKGLRGEVEIGGQ

SEQ ID NO: 2197175 - protein, 35 aa, Cryptosporidium hominis
SKSPLPHPLNHLLYRCYKLLTFWNVIVKDWNSVNY

SEQ ID NO: 2197176 - protein, 29 aa, Cryptosporidium hominis
SKSRRNLATIFYLKKLKKLGLSMSYFIKS

SEQ ID NO: 2197177 - protein, 19 aa, Cryptosporidium hominis
SKSYLPYCSIVRDILKVSL

SEQ ID NO: 2197178 - protein, 20 aa, Cryptosporidium hominis
SKTFQFIRNYLELHLNRLEQ

SEQ ID NO: 2197179 - protein, 32 aa, Cryptosporidium hominis
SKTITQPRIIFRQKGIYKVLLNSPLNPEISKT

SEQ ID NO: 2197180 - protein, 31 aa, Cryptosporidium hominis
SKTPENIITAIKLLAIVRDIKRQIKLIKNQH

SEQ ID NO: 2197181 - protein, 25 aa, Cryptosporidium hominis
SKTPRKIQNYLFSATLTLPNHLHPR

SEQ ID NO: 2197182 - protein, 27 aa, Cryptosporidium hominis
SKTRRELLSNWLFYCQCERCNNPTDLS

SEQ ID NO: 2197183 - protein, 24 aa, Cryptosporidium hominis
SKTSSLYWIIYYSCSISSKWQINE

SEQ ID NO: 2197184 - protein, 25 aa, Cryptosporidium hominis
SKVILESFQLLLKDFDQRIAKYELF

SEQ ID NO: 2197185 - protein, 24 aa, Cryptosporidium hominis
SKVKSIVLFLRANLGINVAKNFKE

SEQ ID NO: 2197186 - protein, 18 aa, Cryptosporidium hominis
SKYFAYEICVGQNGIIWF

SEQ ID NO: 2197187 - protein, 25 aa, Cryptosporidium hominis
SKYGKFIRFKGIFKAKNSIESDHSN

SEQ ID NO: 2197188 - protein, 18 aa, Cryptosporidium hominis
SKYKFLNNVLIKYSDRLS

SEQ ID NO: 2197189 - protein, 22 aa, Cryptosporidium hominis
SKYKKFLAIKDPSKQIYGPKML

SEQ ID NO: 2197190 - protein, 20 aa, Cryptosporidium hominis
SKYNKSIISPKKLINSDENN

SEQ ID NO: 2197191 - protein, 24 aa, Cryptosporidium hominis
SKYSIALEMIAGGRLYNLVVENHE

SEQ ID NO: 2197192 - protein, 17 aa, Cryptosporidium hominis
SLAFFLSSSCLTESTFQ

SEQ ID NO: 2197193 - protein, 23 aa, Cryptosporidium hominis
SLAVFAPEILQKVGLTFPTQQAI

SEQ ID NO: 2197194 - protein, 21 aa, Cryptosporidium hominis
SLCFQLPGLLKYNNPASVTVV

SEQ ID NO: 2197195 - protein, 29 aa, Cryptosporidium hominis
SLCPIKLIGMVFVLSPSPLLQSCTDELLL

SEQ ID NO: 2197196 - protein, 31 aa, Cryptosporidium hominis
SLCVDLWSVGIILFEMLFGGPPLSDPGQNSL

SEQ ID NO: 2197197 - protein, 31 aa, Cryptosporidium hominis
SLDDSCLFSIRQFLHLVPRLFDGKSYDEIDD

SEQ ID NO: 2197198 - protein, 26 aa, Cryptosporidium hominis
SLDHMKWMRGIWNLITFKIFGNSSSK

SEQ ID NO: 2197199 - protein, 29 aa, Cryptosporidium hominis
SLDNISKAALLLPFAIQKELKLFNNCSTS

SEQ ID NO: 2197200 - protein, 26 aa, Cryptosporidium hominis
SLDPNAIFIHYGHTAPITSISWNPNE

SEQ ID NO: 2197201 - protein, 20 aa, Cryptosporidium hominis
SLDPYLGYLGPAISLSYEYE

SEQ ID NO: 2197202 - protein, 25 aa, Cryptosporidium hominis
SLDQNIFNDKFLNTPIIECSDFFQV

SEQ ID NO: 2197203 - protein, 17 aa, Cryptosporidium hominis
SLDWSRCGRFLLTASND

SEQ ID NO: 2197204 - protein, 27 aa, Cryptosporidium hominis
SLEDKIPFPFIQFKDILSKYPTLQNIF

SEQ ID NO: 2197205 - protein, 22 aa, Cryptosporidium hominis
SLEEIVLNGVLYMQEYFKRIDN

SEQ ID NO: 2197206 - protein, 21 aa, Cryptosporidium hominis
SLEFSALIKEATHRTLPAEVK

SEQ ID NO: 2197207 - protein, 25 aa, Cryptosporidium hominis
SLEKKPNGIFPLLDSECLMPQGSDS

SEQ ID NO: 2197208 - protein, 22 aa, Cryptosporidium hominis
SLEPFFMWQISILGNCHTPTLS

SEQ ID NO: 2197209 - protein, 20 aa, Cryptosporidium hominis
SLETLKKYTFLLKNTKETDD

SEQ ID NO: 2197210 - protein, 31 aa, Cryptosporidium hominis
SLEVIDCIYLICSMLLEVPYLAYHKSLIMQN

SEQ ID NO: 2197211 - protein, 26 aa, Cryptosporidium hominis
SLEYMRFSTLFLNKLLIGPIQVKCND

SEQ ID NO: 2197212 - protein, 22 aa, Cryptosporidium hominis
SLFELSFLISEELLRICFYSKA

SEQ ID NO: 2197213 - protein, 24 aa, Cryptosporidium hominis
SLFNDVLVTLFFSKNKFNPYGGKY

SEQ ID NO: 2197214 - protein, 25 aa, Cryptosporidium hominis
SLFSFDYFFYDTKSQKILFFACTTK

SEQ ID NO: 2197215 - protein, 27 aa, Cryptosporidium hominis
SLFSGTQNGIFFIKKNNGGSGVNSHHH

SEQ ID NO: 2197216 - protein, 19 aa, Cryptosporidium hominis
SLFSKFLPDLISALPGIDE

SEQ ID NO: 2197217 - protein, 35 aa, Cryptosporidium hominis
SLFSNKYMGNIFSSFSPFIKGINKFTLRPKERSPE

SEQ ID NO: 2197218 - protein, 27 aa, Cryptosporidium hominis
SLFYYNDQLIWFQKNKLFSFSLVDYQQ

SEQ ID NO: 2197219 - protein, 17 aa, Cryptosporidium hominis
SLGIPVISPIIRTNFEQ

SEQ ID NO: 2197220 - protein, 18 aa, Cryptosporidium hominis
SLGKRILLSNGRLLSHLP

SEQ ID NO: 2197221 - protein, 33 aa, Cryptosporidium hominis
SLGLHRLQRNILLRALSILKPKEGLLVYSTCSF

SEQ ID NO: 2197222 - protein, 25 aa, Cryptosporidium hominis
SLGVQAIRFIPKTGHLLLSAGLDSQ

SEQ ID NO: 2197223 - protein, 25 aa, Cryptosporidium hominis
SLHKKQVSLLSRAFKLLKNGGKLVY

SEQ ID NO: 2197224 - protein, 27 aa, Cryptosporidium hominis
SLICKCMARIYLILLKKGIINAHQERV

SEQ ID NO: 2197225 - protein, 25 aa, Cryptosporidium hominis
SLIEWRSVFGLVCSFKSFIESDNFQ

SEQ ID NO: 2197226 - protein, 20 aa, Cryptosporidium hominis
SLIFINIPSFASGNDIWRYC

SEQ ID NO: 2197227 - protein, 20 aa, Cryptosporidium hominis
SLIGSLSWTVPTDKDDIILK

SEQ ID NO: 2197228 - protein, 20 aa, Cryptosporidium hominis
SLIHILWNEIGPEKTGLFLT

SEQ ID NO: 2197229 - protein, 23 aa, Cryptosporidium hominis
SLIKAKNFSLLILKTIALDQDHA

SEQ ID NO: 2197230 - protein, 28 aa, Cryptosporidium hominis
SLIKRICTRLRIKNLPNPSIEESLNHVC

SEQ ID NO: 2197231 - protein, 32 aa, Cryptosporidium hominis
SLIKYNAKEYLFKAFLIILSLEDNVDAQIKWE

SEQ ID NO: 2197232 - protein, 17 aa, Cryptosporidium hominis
SLILLLAGSLRNRVTSI

SEQ ID NO: 2197233 - protein, 24 aa, Cryptosporidium hominis
SLIREKNIWLNSDKMKYLSNIREL

SEQ ID NO: 2197234 - protein, 27 aa, Cryptosporidium hominis
SLISDVISVLLFRFGALKNTNILNQIN

SEQ ID NO: 2197235 - protein, 25 aa, Cryptosporidium hominis
SLITRIYGLHALRFKKPLLQPFNTI

SEQ ID NO: 2197236 - protein, 17 aa, Cryptosporidium hominis
SLIVLINRLGVFKEKSK

SEQ ID NO: 2197237 - protein, 27 aa, Cryptosporidium hominis
SLKAIKRLLPTVGKYIIKLTRLQRMGT

SEQ ID NO: 2197238 - protein, 27 aa, Cryptosporidium hominis
SLKEILLRRSFESKNPLRLVVMSATLE

SEQ ID NO: 2197239 - protein, 27 aa, Cryptosporidium hominis
SLKHPRILFRIYGKHVGKFYDSKVELD

SEQ ID NO: 2197240 - protein, 17 aa, Cryptosporidium hominis
SLKKITPISVIPLKKTE

SEQ ID NO: 2197241 - protein, 19 aa, Cryptosporidium hominis
SLKLIDKLPGMVTKNSPSS

SEQ ID NO: 2197242 - protein, 23 aa, Cryptosporidium hominis
SLKNKLVIVFVIGSITFPEIRCV

SEQ ID NO: 2197243 - protein, 21 aa, Cryptosporidium hominis
SLKNLHFLPLDSYKSYYKEIC

SEQ ID NO: 2197244 - protein, 24 aa, Cryptosporidium hominis
SLKQTVFLNMSPFSAYILAPSNLV

SEQ ID NO: 2197245 - protein, 17 aa, Cryptosporidium hominis
SLKYDYNNSWMFEKGPR

SEQ ID NO: 2197246 - protein, 17 aa, Cryptosporidium hominis
SLKYRLFESCQLILYDV

SEQ ID NO: 2197247 - protein, 24 aa, Cryptosporidium hominis
SLLARFRDFQRQSKLKKLALTCVA

SEQ ID NO: 2197248 - protein, 18 aa, Cryptosporidium hominis
SLLAYLREYRDIKGLHLV

SEQ ID NO: 2197249 - protein, 28 aa, Cryptosporidium hominis
SLLESVPPIPVYIPPSNPSIPPPIHQSV

SEQ ID NO: 2197250 - protein, 18 aa, Cryptosporidium hominis
SLLGEDIFSKVSSLIFVI

SEQ ID NO: 2197251 - protein, 18 aa, Cryptosporidium hominis
SLLLQRLLADEPRVCTNI

SEQ ID NO: 2197252 - protein, 24 aa, Cryptosporidium hominis
SLLNIAPSFWRFCYNACNSLFTKL

SEQ ID NO: 2197253 - protein, 18 aa, Cryptosporidium hominis
SLLPINGVPIINYIIEML

SEQ ID NO: 2197254 - protein, 17 aa, Cryptosporidium hominis
SLLRHLLIQGVVNSEYI

SEQ ID NO: 2197255 - protein, 20 aa, Cryptosporidium hominis
SLLSASLRKRGKVNNMVSGL

SEQ ID NO: 2197256 - protein, 29 aa, Cryptosporidium hominis
SLLSCDNPPILPATLLLHLSTKLRCWHIA

SEQ ID NO: 2197257 - protein, 24 aa, Cryptosporidium hominis
SLLSIWVHLIPLEFIKTNLMQTIW

SEQ ID NO: 2197258 - protein, 18 aa, Cryptosporidium hominis
SLMELYNFLFDYSSMMYC

SEQ ID NO: 2197259 - protein, 23 aa, Cryptosporidium hominis
SLMNNTNLHYPSISSSVMGGSVH

SEQ ID NO: 2197260 - protein, 22 aa, Cryptosporidium hominis
SLNDLAYSGMPNIPISGLSNQG

SEQ ID NO: 2197261 - protein, 21 aa, Cryptosporidium hominis
SLNFCAKYSYYILLKQSIVNQ

SEQ ID NO: 2197262 - protein, 31 aa, Cryptosporidium hominis
SLNIISKYNYAVGSFFSFVYSHYDNMVNGEI

SEQ ID NO: 2197263 - protein, 18 aa, Cryptosporidium hominis
SLNLDDLYLFITASKSKK

SEQ ID NO: 2197264 - protein, 21 aa, Cryptosporidium hominis
SLNLMKYYEYMDKIPGKRPFG

SEQ ID NO: 2197265 - protein, 17 aa, Cryptosporidium hominis
SLNNLRELFEKFTYRYL

SEQ ID NO: 2197266 - protein, 31 aa, Cryptosporidium hominis
SLNNPYFEEWKFLYKRLCYIEKEVDSMLLKL

SEQ ID NO: 2197267 - protein, 26 aa, Cryptosporidium hominis
SLNPLEQRALLLKWITEILKTSEASS

SEQ ID NO: 2197268 - protein, 17 aa, Cryptosporidium hominis
SLNPTLLDVVDIIFCNC

SEQ ID NO: 2197269 - protein, 27 aa, Cryptosporidium hominis
SLNQLLMNIPVYSKKMVFLKDKIFSLT

SEQ ID NO: 2197270 - protein, 18 aa, Cryptosporidium hominis
SLNTNITPLMQLKEKLKE

SEQ ID NO: 2197271 - protein, 18 aa, Cryptosporidium hominis
SLPHFLKYDYGPESRGFV

SEQ ID NO: 2197272 - protein, 19 aa, Cryptosporidium hominis
SLPIVNFIAISILLARRSA

SEQ ID NO: 2197273 - protein, 20 aa, Cryptosporidium hominis
SLPLLYAEKLLIWVEFWAQV

SEQ ID NO: 2197274 - protein, 19 aa, Cryptosporidium hominis
SLPPFKYWEYFQADPSQNE

SEQ ID NO: 2197275 - protein, 31 aa, Cryptosporidium hominis
SLPPISSLHTPLAWSFYLVSGNMLPIDGVRF

SEQ ID NO: 2197276 - protein, 19 aa, Cryptosporidium hominis
SLQGITLLKTSNSDGFCSF

SEQ ID NO: 2197277 - protein, 36 aa, Cryptosporidium hominis
SLQIMTDLNKIPIRFPWILEELPIAQSFKNQFLLFN

SEQ ID NO: 2197278 - protein, 21 aa, Cryptosporidium hominis
SLRHHVIHILLQAQELNIPTI

SEQ ID NO: 2197279 - protein, 23 aa, Cryptosporidium hominis
SLRKNSNVVCLCCRKKGHQMSDC

SEQ ID NO: 2197280 - protein, 25 aa, Cryptosporidium hominis
SLRKYRPDFLVPQPSRIPIESIYNP

SEQ ID NO: 2197281 - protein, 28 aa, Cryptosporidium hominis
SLRLESQMILFYPRMFCLSSWNLQQQET

SEQ ID NO: 2197282 - protein, 24 aa, Cryptosporidium hominis
SLRNNWKFVVSLKGPLHYGTLEVV

SEQ ID NO: 2197283 - protein, 21 aa, Cryptosporidium hominis
SLRPFPDNLDWCDSTFSFVVA

SEQ ID NO: 2197284 - protein, 25 aa, Cryptosporidium hominis
SLRYDLTVPLARYIATSGLDHLKRY

SEQ ID NO: 2197285 - protein, 21 aa, Cryptosporidium hominis
SLSFKLVYIHKILQSRILEIL

SEQ ID NO: 2197286 - protein, 21 aa, Cryptosporidium hominis
SLSFWKVIYDLNSKSKIKSIE

SEQ ID NO: 2197287 - protein, 17 aa, Cryptosporidium hominis
SLSIYLSHLAIHEPAMM

SEQ ID NO: 2197288 - protein, 17 aa, Cryptosporidium hominis
SLSKISISDLLMLKEKK

SEQ ID NO: 2197289 - protein, 26 aa, Cryptosporidium hominis
SLSKSLKTGLIRFPVEIIKDEFESLI

SEQ ID NO: 2197290 - protein, 23 aa, Cryptosporidium hominis
SLSNPMVYPNTYSSNILSSHNKV

SEQ ID NO: 2197291 - protein, 26 aa, Cryptosporidium hominis
SLSNVFPCVIIPLKVQKIFSILSNHT

SEQ ID NO: 2197292 - protein, 18 aa, Cryptosporidium hominis
SLSRNRFAFYKGELPILI

SEQ ID NO: 2197293 - protein, 24 aa, Cryptosporidium hominis
SLSTIIYILYLWDELNIEKESKKK

SEQ ID NO: 2197294 - protein, 22 aa, Cryptosporidium hominis
SLTGSFGFGWLSKGMMNIKCQE

SEQ ID NO: 2197295 - protein, 23 aa, Cryptosporidium hominis
SLTPNIRSLYNLKIISNLVNLEE

SEQ ID NO: 2197296 - protein, 21 aa, Cryptosporidium hominis
SLVEFVRYILSSRSSSFPKLS

SEQ ID NO: 2197297 - protein, 25 aa, Cryptosporidium hominis
SLVKKNLIRPFKAPLVKVNMDICKS

SEQ ID NO: 2197298 - protein, 24 aa, Cryptosporidium hominis
SLVPLLITKWKSFPIDHPCLVASM

SEQ ID NO: 2197299 - protein, 19 aa, Cryptosporidium hominis
SLVPVKFHYKPRLNPNRRE

SEQ ID NO: 2197300 - protein, 19 aa, Cryptosporidium hominis
SLVTICVNKLRTIRNSITC

SEQ ID NO: 2197301 - protein, 19 aa, Cryptosporidium hominis
SLYGILNISLKQSRIIYEI

SEQ ID NO: 2197302 - protein, 20 aa, Cryptosporidium hominis
SLYMKKLVQPYYSKIFKSIH

SEQ ID NO: 2197303 - protein, 29 aa, Cryptosporidium hominis
SLYNNYRHSIFGNFRWNNKRRRLGSYIAS

SEQ ID NO: 2197304 - protein, 27 aa, Cryptosporidium hominis
SLYSNDHWWYIFKKKFNMSTKGGISEE

SEQ ID NO: 2197305 - protein, 36 aa, Cryptosporidium hominis
SLYVDVKHIFTFCYKLWDYLNLYPTPVIECFNQCAY

SEQ ID NO: 2197306 - protein, 19 aa, Cryptosporidium hominis
SMCLLIKYNCETLVDLELE

SEQ ID NO: 2197307 - protein, 22 aa, Cryptosporidium hominis
SMCMQLYRQALNFALHGLKYEP

SEQ ID NO: 2197308 - protein, 37 aa, Cryptosporidium hominis
SMDQLRQRLLQCGLDDVAIIPLPRWDRVALVRHFDTS

SEQ ID NO: 2197309 - protein, 19 aa, Cryptosporidium hominis
SMFAQEGILALRRVKRRNM

SEQ ID NO: 2197310 - protein, 19 aa, Cryptosporidium hominis
SMFKDNINLIYLSTNFRST

SEQ ID NO: 2197311 - protein, 21 aa, Cryptosporidium hominis
SMFKIVYKCIFFVAIRNKVGL

SEQ ID NO: 2197312 - protein, 17 aa, Cryptosporidium hominis
SMGLISTMNPYHVRSRS

SEQ ID NO: 2197313 - protein, 18 aa, Cryptosporidium hominis
SMHNQYYIPSNNSEVYNH

SEQ ID NO: 2197314 - protein, 17 aa, Cryptosporidium hominis
SMIAMFINDLRIDRGYC

SEQ ID NO: 2197315 - protein, 17 aa, Cryptosporidium hominis
SMIPKRLQYFMATGNVK

SEQ ID NO: 2197316 - protein, 24 aa, Cryptosporidium hominis
SMKEMEIMKDRLGLWKESLEGLNE

SEQ ID NO: 2197317 - protein, 19 aa, Cryptosporidium hominis
SMKISPRSAIIPSSNQSNK

SEQ ID NO: 2197318 - protein, 19 aa, Cryptosporidium hominis
SMKKYLQLLNTDPISLKNK

SEQ ID NO: 2197319 - protein, 17 aa, Cryptosporidium hominis
SMNFKVPRVAYLSDRVQ

SEQ ID NO: 2197320 - protein, 25 aa, Cryptosporidium hominis
SMNKLLLVSMWKESRRFMFKKLEDE

SEQ ID NO: 2197321 - protein, 25 aa, Cryptosporidium hominis
SMNNLSNYFISEGVLDVLSQWLSPF

SEQ ID NO: 2197322 - protein, 28 aa, Cryptosporidium hominis
SMQDYESLIKMYNKWKKPLEILSNDDDF

SEQ ID NO: 2197323 - protein, 23 aa, Cryptosporidium hominis
SMRCKMNFLYLKVSTFEEYDVEL

SEQ ID NO: 2197324 - protein, 34 aa, Cryptosporidium hominis
SMRFKKSYPILASLITNIDWWRIVLDEAQMTEGY

SEQ ID NO: 2197325 - protein, 26 aa, Cryptosporidium hominis
SMRGRRRYRRTLLRNYEQPLGQNSHG

SEQ ID NO: 2197326 - protein, 23 aa, Cryptosporidium hominis
SMRRIIHSSYLKSPLILGVEPKN

SEQ ID NO: 2197327 - protein, 36 aa, Cryptosporidium hominis
SMSILQRNSILYSFNKFPDLKIILISLKAGGEGLNL

SEQ ID NO: 2197328 - protein, 20 aa, Cryptosporidium hominis
SMSRPFGVAMLIAGADSDGS

SEQ ID NO: 2197329 - protein, 23 aa, Cryptosporidium hominis
SMSRRFEWLLDKNFTNKIDLEAY

SEQ ID NO: 2197330 - protein, 18 aa, Cryptosporidium hominis
SMVEEFMLLANVSVARQI

SEQ ID NO: 2197331 - protein, 19 aa, Cryptosporidium hominis
SMVYFRLSTFFASSTYRNS

SEQ ID NO: 2197332 - protein, 24 aa, Cryptosporidium hominis
SMYENRFFYCTIKTNLFSSTFETI

SEQ ID NO: 2197333 - protein, 18 aa, Cryptosporidium hominis
SMYPSQIHTLVRKGSFVT

SEQ ID NO: 2197334 - protein, 27 aa, Cryptosporidium hominis
SNAINDIFFLKMLSLSLIFELSSVFGD

SEQ ID NO: 2197335 - protein, 18 aa, Cryptosporidium hominis
SNCNYIINCNKKATNGSK

SEQ ID NO: 2197336 - protein, 23 aa, Cryptosporidium hominis
SNDEILLLNNQEPFEIHGCGHKL

SEQ ID NO: 2197337 - protein, 25 aa, Cryptosporidium hominis
SNDGYKALLPEYVSRRGYIKDKNSN

SEQ ID NO: 2197338 - protein, 26 aa, Cryptosporidium hominis
SNDLNPYLQQTLNKLPVALNPNLPYL

SEQ ID NO: 2197339 - protein, 25 aa, Cryptosporidium hominis
SNDLTFGFWLTYVLPASSSSNENSN

SEQ ID NO: 2197340 - protein, 26 aa, Cryptosporidium hominis
SNDRNPLCTLTMKSIDLNPPCLSEDN

SEQ ID NO: 2197341 - protein, 30 aa, Cryptosporidium hominis
SNDSKVFPYPICFVSKSLPTPPKDYNLRKT

SEQ ID NO: 2197342 - protein, 23 aa, Cryptosporidium hominis
SNEALIDRLIENTTLYPCFDEVL

SEQ ID NO: 2197343 - protein, 25 aa, Cryptosporidium hominis
SNEFWIPICLPTISTVSYVYCYIQC

SEQ ID NO: 2197344 - protein, 25 aa, Cryptosporidium hominis
SNEPHGHLIGFIKFIPLIGKEVITT

SEQ ID NO: 2197345 - protein, 33 aa, Cryptosporidium hominis
SNERNNLWELFSSNFLLFKFYPSGNEIEEELKS

SEQ ID NO: 2197346 - protein, 27 aa, Cryptosporidium hominis
SNFDWRSSYLPHIYSATLGLKNGFIDP

SEQ ID NO: 2197347 - protein, 32 aa, Cryptosporidium hominis
SNFEINPVDVIRTFLVLRKNSEHSHGHFVMSP

SEQ ID NO: 2197348 - protein, 34 aa, Cryptosporidium hominis
SNFSPLITHPLLFRFQLLIWSLKLKQFLNHDGLH

SEQ ID NO: 2197349 - protein, 24 aa, Cryptosporidium hominis
SNGFKPKVWLWNSFFYTKLTCDQS

SEQ ID NO: 2197350 - protein, 32 aa, Cryptosporidium hominis
SNGIQLCFLPDKFSIHLAPSQGLLLDRVFYNS

SEQ ID NO: 2197351 - protein, 29 aa, Cryptosporidium hominis
SNGLKLYRRTCPIGVILVIFEARPEVAIQ

SEQ ID NO: 2197352 - protein, 20 aa, Cryptosporidium hominis
SNGLLSLLLQRLLADEPRVC

SEQ ID NO: 2197353 - protein, 29 aa, Cryptosporidium hominis
SNGMQIIDTWPYAFPRYKYDIDDQLEISI

SEQ ID NO: 2197354 - protein, 19 aa, Cryptosporidium hominis
SNGRRNFKGSPGKISRSRG

SEQ ID NO: 2197355 - protein, 25 aa, Cryptosporidium hominis
SNGSSFIPLLSRSSLVDFYVLNVER

SEQ ID NO: 2197356 - protein, 31 aa, Cryptosporidium hominis
SNGSYLLVVTQREPFYTPRNKLRLGGNIHEG

SEQ ID NO: 2197357 - protein, 30 aa, Cryptosporidium hominis
SNGTYLLTLDYFIPLIETLNEILPLIAQRI

SEQ ID NO: 2197358 - protein, 32 aa, Cryptosporidium hominis
SNGYQILSLRKVGINLPPYVPFSLGSVVIPES

SEQ ID NO: 2197359 - protein, 25 aa, Cryptosporidium hominis
SNHCPKLVPIACNNLFRATSFLEVK

SEQ ID NO: 2197360 - protein, 22 aa, Cryptosporidium hominis
SNHPLFCRRGVEVTVISQGEFF

SEQ ID NO: 2197361 - protein, 31 aa, Cryptosporidium hominis
SNHVFFTPIHYLIGGSPLILGALWDVTDQDI

SEQ ID NO: 2197362 - protein, 31 aa, Cryptosporidium hominis
SNIEKDPILLRIPLLFSDIYSNPADVAPFDS

SEQ ID NO: 2197363 - protein, 19 aa, Cryptosporidium hominis
SNIFLCHELKYPYKIKRSI

SEQ ID NO: 2197364 - protein, 37 aa, Cryptosporidium hominis
SNIKFNLLQDEKLVILFKLIHEFLNFYEINNTCRMLE

SEQ ID NO: 2197365 - protein, 22 aa, Cryptosporidium hominis
SNIPSIISKLEGLQIEFDSLNN

SEQ ID NO: 2197366 - protein, 24 aa, Cryptosporidium hominis
SNISGCLFCQRLQHCCICDFSRRT

SEQ ID NO: 2197367 - protein, 25 aa, Cryptosporidium hominis
SNISIPLEYGQIIDYMILGEFGYGI

SEQ ID NO: 2197368 - protein, 26 aa, Cryptosporidium hominis
SNIVLQTIMILIKNRAPKGRKLLILA

SEQ ID NO: 2197369 - protein, 24 aa, Cryptosporidium hominis
SNIYKAELGLNLHQLYNGRIPAAP

SEQ ID NO: 2197370 - protein, 21 aa, Cryptosporidium hominis
SNKDLLVCKKLPNITQFQSKY

SEQ ID NO: 2197371 - protein, 21 aa, Cryptosporidium hominis
SNKFNIFLNNFLPYIDEATLS

SEQ ID NO: 2197372 - protein, 26 aa, Cryptosporidium hominis
SNKFVYPREMLFLGYSICSAYNDCTD

SEQ ID NO: 2197373 - protein, 24 aa, Cryptosporidium hominis
SNKIFEFPYHIAKKKIPYLKYLND

SEQ ID NO: 2197374 - protein, 20 aa, Cryptosporidium hominis
SNKIILDKIQLVLASLKIKN

SEQ ID NO: 2197375 - protein, 19 aa, Cryptosporidium hominis
SNKIWVWTVQDFSEEQKLE

SEQ ID NO: 2197376 - protein, 23 aa, Cryptosporidium hominis
SNKLLSITFLNENTIIAGSSDGI

SEQ ID NO: 2197377 - protein, 19 aa, Cryptosporidium hominis
SNKLRFPSIYTELISSKVE

SEQ ID NO: 2197378 - protein, 20 aa, Cryptosporidium hominis
SNKWFQLMNKFSKYGEITRG

SEQ ID NO: 2197379 - protein, 25 aa, Cryptosporidium hominis
SNLAQIKYPSIQRILRRICKRAIIE

SEQ ID NO: 2197380 - protein, 30 aa, Cryptosporidium hominis
SNLCLNYFVRYPFSKGLLKKPKEINERFIN

SEQ ID NO: 2197381 - protein, 28 aa, Cryptosporidium hominis
SNLDQLIKYPLLDSFNPKPGFFQKLIHS

SEQ ID NO: 2197382 - protein, 24 aa, Cryptosporidium hominis
SNLFKNIHPLLLDGLVLENKLSIN

SEQ ID NO: 2197383 - protein, 26 aa, Cryptosporidium hominis
SNLGLLNFLPLFFTNFESLKKGILEG

SEQ ID NO: 2197384 - protein, 38 aa, Cryptosporidium hominis
SNLNIRQIISKNIYPIEVLLKLYKPLNVPRSIFKLETA

SEQ ID NO: 2197385 - protein, 26 aa, Cryptosporidium hominis
SNLRLPPKVPGISSNNAFKFNISQPA

SEQ ID NO: 2197386 - protein, 35 aa, Cryptosporidium hominis
SNLRRKLHVPNSYIEIPLRGLSKLQLLTLEQLSGI

SEQ ID NO: 2197387 - protein, 19 aa, Cryptosporidium hominis
SNMNNVVICLLIVNNLLPC

SEQ ID NO: 2197388 - protein, 23 aa, Cryptosporidium hominis
SNMNSILNIRIIPPKNLQTEKST

SEQ ID NO: 2197389 - protein, 23 aa, Cryptosporidium hominis
SNMWVPYISYSKCFYNFSRVSKL

SEQ ID NO: 2197390 - protein, 20 aa, Cryptosporidium hominis
SNNAGRLLMSIIGAGQQNNN

SEQ ID NO: 2197391 - protein, 33 aa, Cryptosporidium hominis
SNNAPIFGNILPLNFCIPPLFGSCNPPFYGIGM

SEQ ID NO: 2197392 - protein, 24 aa, Cryptosporidium hominis
SNNDYEFVSTSSKLKFLALPAGVL

SEQ ID NO: 2197393 - protein, 23 aa, Cryptosporidium hominis
SNNFLNNIQIPPIPNITSSTDFN

SEQ ID NO: 2197394 - protein, 34 aa, Cryptosporidium hominis
SNNGIGLSIIYRRLFSYFIQSIIRYHFENIINKD

SEQ ID NO: 2197395 - protein, 31 aa, Cryptosporidium hominis
SNNIIINAILFIPELYIIKTITKMTGGVCLC

SEQ ID NO: 2197396 - protein, 26 aa, Cryptosporidium hominis
SNNKKYYEYYIAGKKVEDFITSKISD

SEQ ID NO: 2197397 - protein, 29 aa, Cryptosporidium hominis
SNNMHITCSWSSNPFLCRKCCKKSSVQPS

SEQ ID NO: 2197398 - protein, 24 aa, Cryptosporidium hominis
SNNNKLSMFKKSGNNYPFILGDEQ

SEQ ID NO: 2197399 - protein, 20 aa, Cryptosporidium hominis
SNNPNYFRSILLLIGNDISS

SEQ ID NO: 2197400 - protein, 26 aa, Cryptosporidium hominis
SNNQDLRRLVYLAIKSLKVNESEAFV

SEQ ID NO: 2197401 - protein, 18 aa, Cryptosporidium hominis
SNNSIFWHLFDLGIGSDE

SEQ ID NO: 2197402 - protein, 26 aa, Cryptosporidium hominis
SNNTVQDYRFLPKQTFRIEDNNFYSN

SEQ ID NO: 2197403 - protein, 27 aa, Cryptosporidium hominis
SNPEEPFLLISSVLPNIFPSISHRPLP

SEQ ID NO: 2197404 - protein, 23 aa, Cryptosporidium hominis
SNPIIVHFDFFKSYWKSQEIHIT

SEQ ID NO: 2197405 - protein, 23 aa, Cryptosporidium hominis
SNPIKIIFIGRDLKNLLNIIIKE

SEQ ID NO: 2197406 - protein, 26 aa, Cryptosporidium hominis
SNPKYEELMEWLIKEQNFNEARVISY

SEQ ID NO: 2197407 - protein, 17 aa, Cryptosporidium hominis
SNPLKLREIISSVLDQA

SEQ ID NO: 2197408 - protein, 19 aa, Cryptosporidium hominis
SNPLVQGSIYYLAPEIYTN

SEQ ID NO: 2197409 - protein, 25 aa, Cryptosporidium hominis
SNPRVDILRFVHDKYVIPILMVIQE

SEQ ID NO: 2197410 - protein, 22 aa, Cryptosporidium hominis
SNPVRVLMRYFKEKLALGDDDL

SEQ ID NO: 2197411 - protein, 20 aa, Cryptosporidium hominis
SNQALYFIGGILSHAKAIMA

SEQ ID NO: 2197412 - protein, 31 aa, Cryptosporidium hominis
SNQEWVMHYWKEIPLPFSFTSIINRIRNNYY

SEQ ID NO: 2197413 - protein, 24 aa, Cryptosporidium hominis
SNQRIWLISLLERKQVKKGSKFIN

SEQ ID NO: 2197414 - protein, 24 aa, Cryptosporidium hominis
SNQSTLLDSLKFGGGLEPPQVSQY

SEQ ID NO: 2197415 - protein, 26 aa, Cryptosporidium hominis
SNREEFLCYYIIYVTLQNMKADLIRV

SEQ ID NO: 2197416 - protein, 17 aa, Cryptosporidium hominis
SNRKIIKLIPYETDKRL

SEQ ID NO: 2197417 - protein, 25 aa, Cryptosporidium hominis
SNSCNLYPISYYYPNFFGDITTSIR

SEQ ID NO: 2197418 - protein, 27 aa, Cryptosporidium hominis
SNSDIYRPLFKNIFIIGRRGWIQNSFK

SEQ ID NO: 2197419 - protein, 25 aa, Cryptosporidium hominis
SNSDYDQFLLTHYSDILKNYNKSEA

SEQ ID NO: 2197420 - protein, 25 aa, Cryptosporidium hominis
SNSHFPWQQFQNTGIGPLIQSQLQV

SEQ ID NO: 2197421 - protein, 42 aa, Cryptosporidium hominis
SNSITQKYVIPLIMSYPIAGIVFFNTNMGIKWFNAKNPIIND

SEQ ID NO: 2197422 - protein, 25 aa, Cryptosporidium hominis
SNSITYLNKTFKKALLFGDKENITK

SEQ ID NO: 2197423 - protein, 21 aa, Cryptosporidium hominis
SNSLPYFIQAERIISKTLESR

SEQ ID NO: 2197424 - protein, 27 aa, Cryptosporidium hominis
SNSNFEKKIVWSAKYFGGNIHIQLNHQ

SEQ ID NO: 2197425 - protein, 19 aa, Cryptosporidium hominis
SNSPFILPQSHSKSVDLNS

SEQ ID NO: 2197426 - protein, 20 aa, Cryptosporidium hominis
SNSRIVLSFGFDNLIYSGYM

SEQ ID NO: 2197427 - protein, 21 aa, Cryptosporidium hominis
SNTEKIKLNKQLPYLVANIVE

SEQ ID NO: 2197428 - protein, 21 aa, Cryptosporidium hominis
SNTLLYCNKVCQDSVFLGSPS

SEQ ID NO: 2197429 - protein, 22 aa, Cryptosporidium hominis
SNTVLIFAGELLRNAAKLLNDN

SEQ ID NO: 2197430 - protein, 23 aa, Cryptosporidium hominis
SNVKPQLLEIKKLFHPSNNMTDS

SEQ ID NO: 2197431 - protein, 24 aa, Cryptosporidium hominis
SNVLGGKIKFTLSGAAPLDEHTQR

SEQ ID NO: 2197432 - protein, 30 aa, Cryptosporidium hominis
SNVMPNLDYFLFLLPTPKILIIGDSSPSYS

SEQ ID NO: 2197433 - protein, 24 aa, Cryptosporidium hominis
SNVNVLDFDVPFSLKFGAFDDLVK

SEQ ID NO: 2197434 - protein, 25 aa, Cryptosporidium hominis
SNVSPGSCFWLPAGARLYNKLMDFI

SEQ ID NO: 2197435 - protein, 36 aa, Cryptosporidium hominis
SNVYLSDYEILKEGIYLNVVRLPKDLAKPLLEAANS

SEQ ID NO: 2197436 - protein, 27 aa, Cryptosporidium hominis
SNWCVLDYILYLFHNLEVYVGSNNDMI

SEQ ID NO: 2197437 - protein, 35 aa, Cryptosporidium hominis
SNWQRLRWSIRMIPQKLPLDLIIALECVLQLHSTP

SEQ ID NO: 2197438 - protein, 21 aa, Cryptosporidium hominis
SNWSFGYYKLRPGVINMLRTL

SEQ ID NO: 2197439 - protein, 21 aa, Cryptosporidium hominis
SNYDIDLFKPIFDQIYQVISS

SEQ ID NO: 2197440 - protein, 20 aa, Cryptosporidium hominis
SNYFFKLPILKTNTNIDIKF

SEQ ID NO: 2197441 - protein, 25 aa, Cryptosporidium hominis
SNYILIPESMYRSVESWLLSNAYNQ

SEQ ID NO: 2197442 - protein, 19 aa, Cryptosporidium hominis
SNYRIPRETIVQRNNLDHN

SEQ ID NO: 2197443 - protein, 18 aa, Cryptosporidium hominis
SNYYFIHQNFSKAQLYVI

SEQ ID NO: 2197444 - protein, 23 aa, Cryptosporidium hominis
SNYYYPCRSIFKKKLLDIHVSQL

SEQ ID NO: 2197445 - protein, 26 aa, Cryptosporidium hominis
SPDLKKSPLFLFLHGGPHSVTTTNYN

SEQ ID NO: 2197446 - protein, 18 aa, Cryptosporidium hominis
SPDLVIHPSILKGLSELG

SEQ ID NO: 2197447 - protein, 25 aa, Cryptosporidium hominis
SPDSKVFYFKMKGDYHRYISEFSTG

SEQ ID NO: 2197448 - protein, 23 aa, Cryptosporidium hominis
SPDVRYNNYMGNSLLVDDQRDQC

SEQ ID NO: 2197449 - protein, 20 aa, Cryptosporidium hominis
SPECLIFAQRFLKPSGTMIP

SEQ ID NO: 2197450 - protein, 27 aa, Cryptosporidium hominis
SPEEAIFALKLSKLQWKYLDETISKMK

SEQ ID NO: 2197451 - protein, 34 aa, Cryptosporidium hominis
SPEHMDMVWINDYHLLLLCQYLTRRVKGVNIGLF

SEQ ID NO: 2197452 - protein, 29 aa, Cryptosporidium hominis
SPEIDEKFLFYLFSNFGKILSLKIVGNDQ

SEQ ID NO: 2197453 - protein, 26 aa, Cryptosporidium hominis
SPEIVLICIFLLTHLFFNDGVSERMV

SEQ ID NO: 2197454 - protein, 21 aa, Cryptosporidium hominis
SPEKFSILIHITIPSGYPKEN

SEQ ID NO: 2197455 - protein, 20 aa, Cryptosporidium hominis
SPESFIFAQYLKLIIENRLN

SEQ ID NO: 2197456 - protein, 29 aa, Cryptosporidium hominis
SPESNVTLILYSREILLFPYQNLNENSKP

SEQ ID NO: 2197457 - protein, 30 aa, Cryptosporidium hominis
SPESRFQLLEDILFQYALSRSRYESCMNLG

SEQ ID NO: 2197458 - protein, 19 aa, Cryptosporidium hominis
SPFGRINRLCLSPSKTIAI

SEQ ID NO: 2197459 - protein, 29 aa, Cryptosporidium hominis
SPHGIPIDLLDRCLIIPTVPYSEEDVKKI

SEQ ID NO: 2197460 - protein, 22 aa, Cryptosporidium hominis
SPHIQSYDWILFSPDSNNNNAD

SEQ ID NO: 2197461 - protein, 24 aa, Cryptosporidium hominis
SPHYSVRLPIAASMSLILATALSC

SEQ ID NO: 2197462 - protein, 20 aa, Cryptosporidium hominis
SPISLTPLAPLGVLNPIPQF

SEQ ID NO: 2197463 - protein, 20 aa, Cryptosporidium hominis
SPISYAKLWEKTINQHLFIS

SEQ ID NO: 2197464 - protein, 20 aa, Cryptosporidium hominis
SPIVFKPKLETFFGGKNKIV

SEQ ID NO: 2197465 - protein, 29 aa, Cryptosporidium hominis
SPIYENIFPKFAPIDILSIPLDSVLLYMH

SEQ ID NO: 2197466 - protein, 22 aa, Cryptosporidium hominis
SPIYYYCLSRMRLYSSILGVMT

SEQ ID NO: 2197467 - protein, 22 aa, Cryptosporidium hominis
SPKFPSYLDFAQRYSDTRINKF

SEQ ID NO: 2197468 - protein, 19 aa, Cryptosporidium hominis
SPKLKFGYFHMFSSQYEEG

SEQ ID NO: 2197469 - protein, 25 aa, Cryptosporidium hominis
SPLPESRYMSMKLWYYEDRVPNDYE

SEQ ID NO: 2197470 - protein, 19 aa, Cryptosporidium hominis
SPLPYLPPHSTRPKETIRI

SEQ ID NO: 2197471 - protein, 25 aa, Cryptosporidium hominis
SPLSPKFITYGKMVFIDLAGSERGA

SEQ ID NO: 2197472 - protein, 20 aa, Cryptosporidium hominis
SPLYIGFMKKSRPEWFVLQT

SEQ ID NO: 2197473 - protein, 25 aa, Cryptosporidium hominis
SPMLAPTFFSLHPCFVSEPINFYSI

SEQ ID NO: 2197474 - protein, 25 aa, Cryptosporidium hominis
SPNLAFGSVPITGPIFDEELLRWIA

SEQ ID NO: 2197475 - protein, 29 aa, Cryptosporidium hominis
SPNNKQFFRLERHLIWVESIIRVHGNTFL

SEQ ID NO: 2197476 - protein, 24 aa, Cryptosporidium hominis
SPNQDDFFILKTENWGLFGVFDGH

SEQ ID NO: 2197477 - protein, 24 aa, Cryptosporidium hominis
SPPHGIQIGGVIDYKSHGIGVFLP

SEQ ID NO: 2197478 - protein, 27 aa, Cryptosporidium hominis
SPPSPPLPEELPPPPPSEELPPPPPSP

SEQ ID NO: 2197479 - protein, 35 aa, Cryptosporidium hominis
SPQCGPYCSTYPKGYFAFWLTYNSVTNKYIISVEN

SEQ ID NO: 2197480 - protein, 19 aa, Cryptosporidium hominis
SPQRTPPASLPPIPPSSSR

SEQ ID NO: 2197481 - protein, 34 aa, Cryptosporidium hominis
SPQWGPYCSTYPKGYFAFWLTYDEDNDLYEISIN

SEQ ID NO: 2197482 - protein, 31 aa, Cryptosporidium hominis
SPRESNMYWCDIMQFYLFYCPKCIHLKQSNV

SEQ ID NO: 2197483 - protein, 25 aa, Cryptosporidium hominis
SPRTDWRVSNILPLKSRHFYKDITN

SEQ ID NO: 2197484 - protein, 23 aa, Cryptosporidium hominis
SPSSPLMDYTPTSPIYAASSPTY

SEQ ID NO: 2197485 - protein, 29 aa, Cryptosporidium hominis
SPTETNFFNLVTLLKSLIFSKIRLMKNKI

SEQ ID NO: 2197486 - protein, 27 aa, Cryptosporidium hominis
SPTYQPLVYWRVYKGLSPSISFPSDEI

SEQ ID NO: 2197487 - protein, 26 aa, Cryptosporidium hominis
SPVHTIIIPFKAVSLYRSKLSNSYKI

SEQ ID NO: 2197488 - protein, 20 aa, Cryptosporidium hominis
SPVVSFPYSISSPSSSSSSS

SEQ ID NO: 2197489 - protein, 19 aa, Cryptosporidium hominis
SPYLRAPRMYSISDLALAC

SEQ ID NO: 2197490 - protein, 25 aa, Cryptosporidium hominis
SQADSWNMYAIPISSLMTLNIEGDK

SEQ ID NO: 2197491 - protein, 24 aa, Cryptosporidium hominis
SQASGFILNAPFQPSNDLLKELIS

SEQ ID NO: 2197492 - protein, 24 aa, Cryptosporidium hominis
SQCFKLDLIMYSAIGWARHGEINQ

SEQ ID NO: 2197493 - protein, 21 aa, Cryptosporidium hominis
SQCLPDVLFSHYGSQQLQRYP

SEQ ID NO: 2197494 - protein, 26 aa, Cryptosporidium hominis
SQDNYIKIWDLRRFDKPLLSSLLGHS

SEQ ID NO: 2197495 - protein, 24 aa, Cryptosporidium hominis
SQDRKYQCILLSATLNKEVDSLKK

SEQ ID NO: 2197496 - protein, 21 aa, Cryptosporidium hominis
SQELKNWFFSQSNLHESVVSL

SEQ ID NO: 2197497 - protein, 32 aa, Cryptosporidium hominis
SQENNMYIKNLNPMQLKYLQKTQKILSYELSS

SEQ ID NO: 2197498 - protein, 26 aa, Cryptosporidium hominis
SQESQLIEFLFLDFLDYIHIDKGLIK

SEQ ID NO: 2197499 - protein, 28 aa, Cryptosporidium hominis
SQEVRIPNQFLWRTYNKKIVDRTHCIEN

SEQ ID NO: 2197500 - protein, 18 aa, Cryptosporidium hominis
SQFIRLNNRLRANGFLSI

SEQ ID NO: 2197501 - protein, 17 aa, Cryptosporidium hominis
SQFKLKLEAPKLGKKSK

SEQ ID NO: 2197502 - protein, 20 aa, Cryptosporidium hominis
SQFNSIMYILSSGSFCNEKG

SEQ ID NO: 2197503 - protein, 22 aa, Cryptosporidium hominis
SQHFIREYSVLSESPNLAENIA

SEQ ID NO: 2197504 - protein, 27 aa, Cryptosporidium hominis
SQIMGIKPLFPVKPLLSISSPDFEQIW

SEQ ID NO: 2197505 - protein, 23 aa, Cryptosporidium hominis
SQIRRVKFQPTLSPIAQSPLSEN

SEQ ID NO: 2197506 - protein, 22 aa, Cryptosporidium hominis
SQKKVQFGTKNLIIIDENKQDL

SEQ ID NO: 2197507 - protein, 24 aa, Cryptosporidium hominis
SQKYIKLCDYLIHIPLYGNGTASL

SEQ ID NO: 2197508 - protein, 20 aa, Cryptosporidium hominis
SQLFHKLILCQTFCAGQQIL

SEQ ID NO: 2197509 - protein, 19 aa, Cryptosporidium hominis
SQLLDINPVNFFSSSRNKL

SEQ ID NO: 2197510 - protein, 17 aa, Cryptosporidium hominis
SQLLRLMGKYKPETRAE

SEQ ID NO: 2197511 - protein, 35 aa, Cryptosporidium hominis
SQLNNLHERIYPSPLNEIVKILNMHQLTLQSIESE

SEQ ID NO: 2197512 - protein, 19 aa, Cryptosporidium hominis
SQLNNLSWFLEISSQRNSS

SEQ ID NO: 2197513 - protein, 20 aa, Cryptosporidium hominis
SQLRMKFLQLWNIYSNKNLI

SEQ ID NO: 2197514 - protein, 25 aa, Cryptosporidium hominis
SQLSRKYLIQRIKKYFSLQANVELG

SEQ ID NO: 2197515 - protein, 32 aa, Cryptosporidium hominis
SQNEAFLNIKPRVKPLMYCYEKEIVLYAHYLN

SEQ ID NO: 2197516 - protein, 21 aa, Cryptosporidium hominis
SQNFPLCIFKSNIISSKNHPL

SEQ ID NO: 2197517 - protein, 24 aa, Cryptosporidium hominis
SQNNIFEIIKLFDFKRKTKVFTDY

SEQ ID NO: 2197518 - protein, 20 aa, Cryptosporidium hominis
SQNPFVCKYSLEPAVKYPGY

SEQ ID NO: 2197519 - protein, 22 aa, Cryptosporidium hominis
SQNRIYIGSVPYSFTTDDLRHI

SEQ ID NO: 2197520 - protein, 23 aa, Cryptosporidium hominis
SQQIYGRYGRHDPRYMYTGYASG

SEQ ID NO: 2197521 - protein, 35 aa, Cryptosporidium hominis
SQQVEIILVPPYSSFIKFCVKRLGFSITYNKRRAW

SEQ ID NO: 2197522 - protein, 23 aa, Cryptosporidium hominis
SQRDVFVMMPTGGGKSLCFQLPG

SEQ ID NO: 2197523 - protein, 47 aa, Cryptosporidium hominis
SQRLKDALGMQPNWPPPWLVRMQKYGPPPSYPYLRVPGVNSQIPNGC

SEQ ID NO: 2197524 - protein, 23 aa, Cryptosporidium hominis
SQRLKQGLYKTLAESWLGVEISS

SEQ ID NO: 2197525 - protein, 22 aa, Cryptosporidium hominis
SQRPLINWKFSDGCIVSITDFS

SEQ ID NO: 2197526 - protein, 26 aa, Cryptosporidium hominis
SQSGSKSLFFFTPHKYRKSVGIIVPR

SEQ ID NO: 2197527 - protein, 25 aa, Cryptosporidium hominis
SQSGTFPKFFGVNYPLEENESMAVL

SEQ ID NO: 2197528 - protein, 26 aa, Cryptosporidium hominis
SQSIVRPNIFYPGEYRAFGLAYIAFG

SEQ ID NO: 2197529 - protein, 22 aa, Cryptosporidium hominis
SQSNFLVRTVFHKALKQKESII

SEQ ID NO: 2197530 - protein, 25 aa, Cryptosporidium hominis
SQSRNHCQIPYSLSTYGNSCGVSSI

SEQ ID NO: 2197531 - protein, 27 aa, Cryptosporidium hominis
SQVDCDFLRQIDWYMMIVDEAHQLKNR

SEQ ID NO: 2197532 - protein, 32 aa, Cryptosporidium hominis
SQVGQIRKFFRQNLQILLFSATYHEEVRLFAE

SEQ ID NO: 2197533 - protein, 24 aa, Cryptosporidium hominis
SQYKIVLRFLSYLDHLLNFMSHTI

SEQ ID NO: 2197534 - protein, 19 aa, Cryptosporidium hominis
SRAALYRIVLKDSLACQLM

SEQ ID NO: 2197535 - protein, 19 aa, Cryptosporidium hominis
SRAFGNWDMYSGMKLQGLS

SEQ ID NO: 2197536 - protein, 26 aa, Cryptosporidium hominis
SRAPPEHLIPLVYILNDFAQKCKSQA

SEQ ID NO: 2197537 - protein, 22 aa, Cryptosporidium hominis
SRCTRFRFSPLPIEDIRNRISE

SEQ ID NO: 2197538 - protein, 35 aa, Cryptosporidium hominis
SRDEEVCHHIFHANCLLPWLNQHNSCPVCRFELPT

SEQ ID NO: 2197539 - protein, 26 aa, Cryptosporidium hominis
SRDRNEFDYFFYPKKFPDNSRVIYIK

SEQ ID NO: 2197540 - protein, 17 aa, Cryptosporidium hominis
SRDRSIKWAPRFKLNKV

SEQ ID NO: 2197541 - protein, 25 aa, Cryptosporidium hominis
SREMLPFKYLIPVGESPYSKMRVTQ

SEQ ID NO: 2197542 - protein, 27 aa, Cryptosporidium hominis
SRETAILIATKRRALNLNKSGGSLVVD

SEQ ID NO: 2197543 - protein, 34 aa, Cryptosporidium hominis
SRFDLDKIYTFTGPILIAVNPYRTLEGFYSMEMI

SEQ ID NO: 2197544 - protein, 24 aa, Cryptosporidium hominis
SRFHPLISMIQLLSKFTHQMEWYL

SEQ ID NO: 2197545 - protein, 17 aa, Cryptosporidium hominis
SRFPKLSDQILDRSQEI

SEQ ID NO: 2197546 - protein, 22 aa, Cryptosporidium hominis
SRGFAFMDFFESGDALAAHMLN

SEQ ID NO: 2197547 - protein, 22 aa, Cryptosporidium hominis
SRGIERLFPIQAQSFESIYGKK

SEQ ID NO: 2197548 - protein, 23 aa, Cryptosporidium hominis
SRHPLCHYCRRSCKRLNYSRCPS

SEQ ID NO: 2197549 - protein, 25 aa, Cryptosporidium hominis
SRHPQLLYESKLYKILAGGIGVPTV

SEQ ID NO: 2197550 - protein, 28 aa, Cryptosporidium hominis
SRIDGLELIFIFSKLLQVVATCIPYCPI

SEQ ID NO: 2197551 - protein, 22 aa, Cryptosporidium hominis
SRIDQLEFMLNDLISEVESSSP

SEQ ID NO: 2197552 - protein, 26 aa, Cryptosporidium hominis
SRIFCYQMINWIILGKLVDPFEEFIV

SEQ ID NO: 2197553 - protein, 19 aa, Cryptosporidium hominis
SRIKYLERLPILEEVRKDP

SEQ ID NO: 2197554 - protein, 24 aa, Cryptosporidium hominis
SRINRFLELIPSETIFLIQEMSNY

SEQ ID NO: 2197555 - protein, 18 aa, Cryptosporidium hominis
SRIPVKIKHYIVSDKDNS

SEQ ID NO: 2197556 - protein, 17 aa, Cryptosporidium hominis
SRIWLVIEIAPGGELYE

SEQ ID NO: 2197557 - protein, 19 aa, Cryptosporidium hominis
SRKFWGISESRYISTIKSN

SEQ ID NO: 2197558 - protein, 29 aa, Cryptosporidium hominis
SRKPPRSLWFDYAPFKFETALLQVFNIIK

SEQ ID NO: 2197559 - protein, 28 aa, Cryptosporidium hominis
SRLDILNKGFLLLYYTDPYTATMAAWFF

SEQ ID NO: 2197560 - protein, 17 aa, Cryptosporidium hominis
SRLFAKFHKKQPSSSET

SEQ ID NO: 2197561 - protein, 37 aa, Cryptosporidium hominis
SRLKNTPLLIIPFKDTEYYFFAKKRQIVFLTRRGKVG

SEQ ID NO: 2197562 - protein, 23 aa, Cryptosporidium hominis
SRLRFPLYMAHIEKLLGETCKYI

SEQ ID NO: 2197563 - protein, 25 aa, Cryptosporidium hominis
SRLSSLVRCAILGGADFIVTCTGKV

SEQ ID NO: 2197564 - protein, 17 aa, Cryptosporidium hominis
SRLTFTSALSYLRRLNT

SEQ ID NO: 2197565 - protein, 26 aa, Cryptosporidium hominis
SRLWQERFFILRSDGALIWCHHPNDT

SEQ ID NO: 2197566 - protein, 21 aa, Cryptosporidium hominis
SRNDWFSKVHKSKPEKCTSSE

SEQ ID NO: 2197567 - protein, 31 aa, Cryptosporidium hominis
SRNEWQNLLIKWLTYVFKFSERNGISMYESW

SEQ ID NO: 2197568 - protein, 20 aa, Cryptosporidium hominis
SRNNSLPYMGILSNSSNKGT

SEQ ID NO: 2197569 - protein, 24 aa, Cryptosporidium hominis
SRNSIKIIALISIKFKETASNCFQ

SEQ ID NO: 2197570 - protein, 28 aa, Cryptosporidium hominis
SRNSIQSILNLKAPRRPSLLVQQRNYSE

SEQ ID NO: 2197571 - protein, 27 aa, Cryptosporidium hominis
SRREGLKTILTFLSKRGYPNQINPKTL

SEQ ID NO: 2197572 - protein, 20 aa, Cryptosporidium hominis
SRRLWDLEETLSFTNLDSIS

SEQ ID NO: 2197573 - protein, 23 aa, Cryptosporidium hominis
SRRQYEYLMPEFLLKHVNINNDD

SEQ ID NO: 2197574 - protein, 23 aa, Cryptosporidium hominis
SRRVDKHWRLIGFGDIISGDTVR

SEQ ID NO: 2197575 - protein, 20 aa, Cryptosporidium hominis
SRSIGTGLKRRKCWEMLVDE

SEQ ID NO: 2197576 - protein, 29 aa, Cryptosporidium hominis
SRSNDIVELFLIPQWWMNCKPFAEKACKA

SEQ ID NO: 2197577 - protein, 21 aa, Cryptosporidium hominis
SRTINKGCQIGLFGSNPCSYR

SEQ ID NO: 2197578 - protein, 17 aa, Cryptosporidium hominis
SRTKLLDQLKQLELLRF

SEQ ID NO: 2197579 - protein, 21 aa, Cryptosporidium hominis
SRTQLFPLNPIHTENKMAASS

SEQ ID NO: 2197580 - protein, 22 aa, Cryptosporidium hominis
SRVFSVDSACRYVFIKRISKLE

SEQ ID NO: 2197581 - protein, 18 aa, Cryptosporidium hominis
SRVIPPKLLKELGIQHVK

SEQ ID NO: 2197582 - protein, 23 aa, Cryptosporidium hominis
SRVKLLNFLQKITLISLAEFVNS

SEQ ID NO: 2197583 - protein, 20 aa, Cryptosporidium hominis
SRVYKPLISALFSLSRVASE

SEQ ID NO: 2197584 - protein, 26 aa, Cryptosporidium hominis
SRYGSKIFLYLLTRLQGFTQIKECLS

SEQ ID NO: 2197585 - protein, 28 aa, Cryptosporidium hominis
SSADPVHITMPPRLGLPSQTPLNMKDQY

SEQ ID NO: 2197586 - protein, 21 aa, Cryptosporidium hominis
SSAFYLEKYLSLVNEVYGSGD

SEQ ID NO: 2197587 - protein, 25 aa, Cryptosporidium hominis
SSAIIKFLWTVRTTNFIQYFIENLI

SEQ ID NO: 2197588 - protein, 22 aa, Cryptosporidium hominis
SSAKIWEYLPENIREQLLLDRE

SEQ ID NO: 2197589 - protein, 35 aa, Cryptosporidium hominis
SSAKQGYFLVRELVMLFILLRPTIHKERLDSDPLF

SEQ ID NO: 2197590 - protein, 32 aa, Cryptosporidium hominis
SSAPMSTPLPAIPQPPIPFQNNSSISGGIQYH

SEQ ID NO: 2197591 - protein, 27 aa, Cryptosporidium hominis
SSAVQDLLLLDVAPLSLGLETAGGVMT

SEQ ID NO: 2197592 - protein, 18 aa, Cryptosporidium hominis
SSCKLQPLHTSLVLRRAM

SEQ ID NO: 2197593 - protein, 28 aa, Cryptosporidium hominis
SSCVACGRFFCHLCILYIRSSNPCSPIA

SEQ ID NO: 2197594 - protein, 24 aa, Cryptosporidium hominis
SSDDLSIGLSPKRSKCMLNDDLEL

SEQ ID NO: 2197595 - protein, 27 aa, Cryptosporidium hominis
SSDEIFDSIYIPYRLVKSNSLEEISTY

SEQ ID NO: 2197596 - protein, 32 aa, Cryptosporidium hominis
SSDERILPVLEFCLFGVIFTQSLEDAKKIFYT

SEQ ID NO: 2197597 - protein, 25 aa, Cryptosporidium hominis
SSDKLIKFWDINSGILKLTLTGHVA

SEQ ID NO: 2197598 - protein, 20 aa, Cryptosporidium hominis
SSDRPRWYPLLSAAHYGIMV

SEQ ID NO: 2197599 - protein, 30 aa, Cryptosporidium hominis
SSEDKFINYLIGFYFKHLQYLYNPDVRQYI

SEQ ID NO: 2197600 - protein, 25 aa, Cryptosporidium hominis
SSEEFKGMIDIRPHIFSMQSNQCPA

SEQ ID NO: 2197601 - protein, 24 aa, Cryptosporidium hominis
SSEFDILGQTLQHFGSLSQSRTLV

SEQ ID NO: 2197602 - protein, 24 aa, Cryptosporidium hominis
SSEFSIYPQFMYHLRRSHFLQTFN

SEQ ID NO: 2197603 - protein, 17 aa, Cryptosporidium hominis
SSEIIEFLESENTLRAF

SEQ ID NO: 2197604 - protein, 30 aa, Cryptosporidium hominis
SSESDRMVILSLIFMPILEREVDRHINNGD

SEQ ID NO: 2197605 - protein, 24 aa, Cryptosporidium hominis
SSFAVLFPKYREKYLRDIWPDIRN

SEQ ID NO: 2197606 - protein, 27 aa, Cryptosporidium hominis
SSFIKCAQKLIWKRFRIGMMHDAQEFL

SEQ ID NO: 2197607 - protein, 26 aa, Cryptosporidium hominis
SSFTNNYKALFPYPKKRFYRVDVLEA

SEQ ID NO: 2197608 - protein, 22 aa, Cryptosporidium hominis
SSFVTIPIPRILQGLEVFNLTG

SEQ ID NO: 2197609 - protein, 17 aa, Cryptosporidium hominis
SSFYLPNWFSSSKISKE

SEQ ID NO: 2197610 - protein, 17 aa, Cryptosporidium hominis
SSGIFVLFNFKLKLNKE

SEQ ID NO: 2197611 - protein, 24 aa, Cryptosporidium hominis
SSGLKLLSEMKLLPPEKALKDLGM

SEQ ID NO: 2197612 - protein, 24 aa, Cryptosporidium hominis
SSGMKFFPVPMKKFGTLYSREGVG

SEQ ID NO: 2197613 - protein, 26 aa, Cryptosporidium hominis
SSGNTPKIPTPMPRTKCSGDQGKKPI

SEQ ID NO: 2197614 - protein, 24 aa, Cryptosporidium hominis
SSGQIRHAMIFLSGERSLSSMYVS

SEQ ID NO: 2197615 - protein, 21 aa, Cryptosporidium hominis
SSGRFQASNLLLIIESEQAIK

SEQ ID NO: 2197616 - protein, 29 aa, Cryptosporidium hominis
SSGRKFLSKYYRGPWKLWKNKPREILSPK

SEQ ID NO: 2197617 - protein, 23 aa, Cryptosporidium hominis
SSGVWYFEITVLEPRVISKFLGH

SEQ ID NO: 2197618 - protein, 18 aa, Cryptosporidium hominis
SSGYFFPHKNSMSQFLPN

SEQ ID NO: 2197619 - protein, 24 aa, Cryptosporidium hominis
SSHGGELIFVIRPAPSMGGEGGIM

SEQ ID NO: 2197620 - protein, 18 aa, Cryptosporidium hominis
SSIAMRPILKRYQSIVLT

SEQ ID NO: 2197621 - protein, 25 aa, Cryptosporidium hominis
SSIDKKTWNLLYISGNSAVNAFIDN

SEQ ID NO: 2197622 - protein, 24 aa, Cryptosporidium hominis
SSIEILRSRLLYAINNCVAIDLDA

SEQ ID NO: 2197623 - protein, 35 aa, Cryptosporidium hominis
SSIENITVTGLLKFINKWYLPNNMCLFIVGDIPAS

SEQ ID NO: 2197624 - protein, 21 aa, Cryptosporidium hominis
SSIGPGLLLLVGIRTDDVDSN

SEQ ID NO: 2197625 - protein, 18 aa, Cryptosporidium hominis
SSIILARCDGTISIINQT

SEQ ID NO: 2197626 - protein, 18 aa, Cryptosporidium hominis
SSIIRYPNYFNNQGFCEH

SEQ ID NO: 2197627 - protein, 26 aa, Cryptosporidium hominis
SSIKPILNFSQCGLPLPIHHYLKKKN

SEQ ID NO: 2197628 - protein, 18 aa, Cryptosporidium hominis
SSIRGEIYPPDDNFILLI

SEQ ID NO: 2197629 - protein, 21 aa, Cryptosporidium hominis
SSISFFNSKLRRYIRNKKLDD

SEQ ID NO: 2197630 - protein, 30 aa, Cryptosporidium hominis
SSISKEMRRLCSILTFLFDSKNSGCLEFTE

SEQ ID NO: 2197631 - protein, 28 aa, Cryptosporidium hominis
SSKANELLDYILMSIIKDNGHNGNVFEQ

SEQ ID NO: 2197632 - protein, 22 aa, Cryptosporidium hominis
SSKDILFSLISLPSIQSLSSKF

SEQ ID NO: 2197633 - protein, 21 aa, Cryptosporidium hominis
SSKDLFSLNLMKYYEYMDKIP

SEQ ID NO: 2197634 - protein, 30 aa, Cryptosporidium hominis
SSKDQFNDPYFGRAFIFFYNVESAIKAKLD

SEQ ID NO: 2197635 - protein, 28 aa, Cryptosporidium hominis
SSKIKLKKRMLYFTLTTGKMKLPSSEQS

SEQ ID NO: 2197636 - protein, 30 aa, Cryptosporidium hominis
SSKMTPWSLALFKSLPRFIRREILSLDVDS

SEQ ID NO: 2197637 - protein, 28 aa, Cryptosporidium hominis
SSKPKQARLAFPLLIQRFKDLREEAIAQ

SEQ ID NO: 2197638 - protein, 34 aa, Cryptosporidium hominis
SSKTCYRLCWPASKYVKLFSSAKIKFEVISRLIK

SEQ ID NO: 2197639 - protein, 28 aa, Cryptosporidium hominis
SSKTQYYLYISFKNCIVAKLKINSNSFN

SEQ ID NO: 2197640 - protein, 23 aa, Cryptosporidium hominis
SSKVFAPFPKYDIKKRVYWDDVT

SEQ ID NO: 2197641 - protein, 25 aa, Cryptosporidium hominis
SSLCGHEYIKKGLLLGILGGAEHNL

SEQ ID NO: 2197642 - protein, 22 aa, Cryptosporidium hominis
SSLDFLPLDILESEFSQFYEIP

SEQ ID NO: 2197643 - protein, 21 aa, Cryptosporidium hominis
SSLDWNTWFCKSVDIAIMQSV

SEQ ID NO: 2197644 - protein, 18 aa, Cryptosporidium hominis
SSLFEFFLKHLLFCQQKK

SEQ ID NO: 2197645 - protein, 25 aa, Cryptosporidium hominis
SSLHKLKGFFLILVQTELGDIYRIN

SEQ ID NO: 2197646 - protein, 22 aa, Cryptosporidium hominis
SSLLHPYLNIWSNIRSFFNILI

SEQ ID NO: 2197647 - protein, 23 aa, Cryptosporidium hominis
SSLNSMVNLFTSLRFYHYSVEVR

SEQ ID NO: 2197648 - protein, 19 aa, Cryptosporidium hominis
SSLPYLVRYQLESSTINNV

SEQ ID NO: 2197649 - protein, 29 aa, Cryptosporidium hominis
SSLQLVAHSLYWLLKFTNSTNVPIYSIGS

SEQ ID NO: 2197650 - protein, 18 aa, Cryptosporidium hominis
SSMMNFTFFDQAKKILQS

SEQ ID NO: 2197651 - protein, 28 aa, Cryptosporidium hominis
SSMTERELRYFFLKEIQRFSPDLVIPDS

SEQ ID NO: 2197652 - protein, 24 aa, Cryptosporidium hominis
SSNHLTLFDILLDNDEYKIRYENL

SEQ ID NO: 2197653 - protein, 27 aa, Cryptosporidium hominis
SSNHTLLFSGTYFAKTPFLCTAIIVNN

SEQ ID NO: 2197654 - protein, 27 aa, Cryptosporidium hominis
SSNIDWNKRISSRLFQIAIGKGTRAYQ

SEQ ID NO: 2197655 - protein, 27 aa, Cryptosporidium hominis
SSNIPKLSPIFKVNLSSGVTPLLLPAQ

SEQ ID NO: 2197656 - protein, 24 aa, Cryptosporidium hominis
SSNITLFDHLFSKLEIKDALSTGE

SEQ ID NO: 2197657 - protein, 31 aa, Cryptosporidium hominis
SSNKLDFKGFLSNLLVPLFSSSHYSYLDQLF

SEQ ID NO: 2197658 - protein, 17 aa, Cryptosporidium hominis
SSNLFGFERIHKFKVIP

SEQ ID NO: 2197659 - protein, 32 aa, Cryptosporidium hominis
SSNLLAFICRNIMTNWLPLSKSIFERVINYIP

SEQ ID NO: 2197660 - protein, 24 aa, Cryptosporidium hominis
SSNLLDYLESIFEWIRVCGVSIES

SEQ ID NO: 2197661 - protein, 19 aa, Cryptosporidium hominis
SSNLRIIYGGSVTPDNCNE

SEQ ID NO: 2197662 - protein, 19 aa, Cryptosporidium hominis
SSNLYPKVNLGIPIGVVLS

SEQ ID NO: 2197663 - protein, 31 aa, Cryptosporidium hominis
SSNNKLLFVNKFVWIRSIPMGRFIICPESLE

SEQ ID NO: 2197664 - protein, 26 aa, Cryptosporidium hominis
SSNNLFDLKFIQRGIEYNNSLLDLEL

SEQ ID NO: 2197665 - protein, 25 aa, Cryptosporidium hominis
SSNNNTFFTPCNVPNPNRFSNKPKN

SEQ ID NO: 2197666 - protein, 26 aa, Cryptosporidium hominis
SSNPQRLMDFYYQLKSMNKLKSIKRL

SEQ ID NO: 2197667 - protein, 33 aa, Cryptosporidium hominis
SSNQILHFYCIKFLWKFLPLTSTKDFLEQYSGR

SEQ ID NO: 2197668 - protein, 42 aa, Cryptosporidium hominis
SSNQQILPTLTNNSPIMYPESPMVLMPLLTDIKNELNELKRS

SEQ ID NO: 2197669 - protein, 22 aa, Cryptosporidium hominis
SSNSILRFMKFYTNLNSDLNEG

SEQ ID NO: 2197670 - protein, 26 aa, Cryptosporidium hominis
SSNSLFYIEKKLQQALYGAVFLAFEL

SEQ ID NO: 2197671 - protein, 19 aa, Cryptosporidium hominis
SSNTLFLDEADLGHFTSND

SEQ ID NO: 2197672 - protein, 22 aa, Cryptosporidium hominis
SSPDFEQIWKEVKWDTKRVNNT

SEQ ID NO: 2197673 - protein, 18 aa, Cryptosporidium hominis
SSPIWKLEYNLKIPILID

SEQ ID NO: 2197674 - protein, 24 aa, Cryptosporidium hominis
SSPKHLQELLANNILLIGGSTKFR

SEQ ID NO: 2197675 - protein, 28 aa, Cryptosporidium hominis
SSPLQSPPLLVLTPSTPIPIVPTTISQQ

SEQ ID NO: 2197676 - protein, 28 aa, Cryptosporidium hominis
SSPNIGFTYQLLLFQKALSLVKFGIPTR

SEQ ID NO: 2197677 - protein, 26 aa, Cryptosporidium hominis
SSPPSLPLFPPLPPSLRLYACRVPRL

SEQ ID NO: 2197678 - protein, 17 aa, Cryptosporidium hominis
SSQCPIIFSCRMAIVNN

SEQ ID NO: 2197679 - protein, 27 aa, Cryptosporidium hominis
SSQIYPPEKMVYESTPVVGLTVDARFG

SEQ ID NO: 2197680 - protein, 29 aa, Cryptosporidium hominis
SSRAYSELVPILILAYDLSTFLRSQKENN

SEQ ID NO: 2197681 - protein, 20 aa, Cryptosporidium hominis
SSREIYQKARRPRHLVKKDK

SEQ ID NO: 2197682 - protein, 22 aa, Cryptosporidium hominis
SSRIFIKILFQELSYNMGIKNL

SEQ ID NO: 2197683 - protein, 19 aa, Cryptosporidium hominis
SSRIIIKNLPSYLSEKRLK

SEQ ID NO: 2197684 - protein, 23 aa, Cryptosporidium hominis
SSRSKILNWFRDQKPIWDEEDYF

SEQ ID NO: 2197685 - protein, 24 aa, Cryptosporidium hominis
SSSATVYLPKPTPLLETDPLGASN

SEQ ID NO: 2197686 - protein, 26 aa, Cryptosporidium hominis
SSSIDCAMFSGFISRQLDSAPLSEQL

SEQ ID NO: 2197687 - protein, 29 aa, Cryptosporidium hominis
SSSIKRTLKFLWAISKGLPIISPSTLRNI

SEQ ID NO: 2197688 - protein, 21 aa, Cryptosporidium hominis
SSSINLILMLSLIECTNFEKY

SEQ ID NO: 2197689 - protein, 24 aa, Cryptosporidium hominis
SSSIVIGYLMWKYNKSFNDASEYV

SEQ ID NO: 2197690 - protein, 32 aa, Cryptosporidium hominis
SSSKEGLNALLRWLFRYVPDLSLSIRNLYIRY

SEQ ID NO: 2197691 - protein, 26 aa, Cryptosporidium hominis
SSSKSINIKIPYRETSHIPSCLFEQD

SEQ ID NO: 2197692 - protein, 29 aa, Cryptosporidium hominis
SSSLQMDLINKTLNFWFNNRKSRRECLTE

SEQ ID NO: 2197693 - protein, 17 aa, Cryptosporidium hominis
SSSNIFNFAPPQKPRQV

SEQ ID NO: 2197694 - protein, 24 aa, Cryptosporidium hominis
SSSNLLVDILCEVADFSVDLALRL

SEQ ID NO: 2197695 - protein, 23 aa, Cryptosporidium hominis
SSSNLYNLDPLSPEYQRLIEEQV

SEQ ID NO: 2197696 - protein, 27 aa, Cryptosporidium hominis
SSSNPTNFALPMYMRSPNPESIPMPCG

SEQ ID NO: 2197697 - protein, 24 aa, Cryptosporidium hominis
SSSNYNPLIPWSYGAQIVALNYQA

SEQ ID NO: 2197698 - protein, 20 aa, Cryptosporidium hominis
SSSRGLFNISLNELSENTTN

SEQ ID NO: 2197699 - protein, 28 aa, Cryptosporidium hominis
SSSSFIGPSPLWFENSIFRFPAEIEFNV

SEQ ID NO: 2197700 - protein, 27 aa, Cryptosporidium hominis
SSSTSGVVGPWRRSLHGGQTVDSLETV

SEQ ID NO: 2197701 - protein, 26 aa, Cryptosporidium hominis
SSSVTASLLLMRKVQTLTSSVEELDA

SEQ ID NO: 2197702 - protein, 39 aa, Cryptosporidium hominis
SSSWFVSDPWIWLDLIETSFLPLITFDFEFPYNLETRRA

SEQ ID NO: 2197703 - protein, 24 aa, Cryptosporidium hominis
SSSWKYMEYLFLKQAGKSTSAVTW

SEQ ID NO: 2197704 - protein, 28 aa, Cryptosporidium hominis
SSSYLVRLMKRRLIFVSISLLDLLDDEN

SEQ ID NO: 2197705 - protein, 22 aa, Cryptosporidium hominis
SSTALFDYPTLRSIIQHLTDSL

SEQ ID NO: 2197706 - protein, 28 aa, Cryptosporidium hominis
SSTIRIKLYFLLAFLHSVILERKRYTPL

SEQ ID NO: 2197707 - protein, 25 aa, Cryptosporidium hominis
SSTNGSFISDPWMSTSGGYSPSNGF

SEQ ID NO: 2197708 - protein, 24 aa, Cryptosporidium hominis
SSTRSFIRLSKRNIWREISRDSYS

SEQ ID NO: 2197709 - protein, 25 aa, Cryptosporidium hominis
SSTSLRYICQLLTPAHIIASTFGRD

SEQ ID NO: 2197710 - protein, 17 aa, Cryptosporidium hominis
SSTVQILGAEKALFRAL

SEQ ID NO: 2197711 - protein, 22 aa, Cryptosporidium hominis
SSTYFKNIFLIIHSIDSISIRQ

SEQ ID NO: 2197712 - protein, 22 aa, Cryptosporidium hominis
SSVSLVFLNIETFGGGVKLWKN

SEQ ID NO: 2197713 - protein, 34 aa, Cryptosporidium hominis
SSVTPPLMLSRTGSRLRLLLDRSRFILSTKGDIN

SEQ ID NO: 2197714 - protein, 19 aa, Cryptosporidium hominis
SSYFNRMLNMLLNAGAEID

SEQ ID NO: 2197715 - protein, 20 aa, Cryptosporidium hominis
SSYIYKLWAVVCHSGNTLSC

SEQ ID NO: 2197716 - protein, 20 aa, Cryptosporidium hominis
SSYLFLNKLIIQKCCDKLVS

SEQ ID NO: 2197717 - protein, 25 aa, Cryptosporidium hominis
SSYNFSPPPIPVTNSPIQSGDPKDI

SEQ ID NO: 2197718 - protein, 24 aa, Cryptosporidium hominis
SSYYKYLIDYLNSSKLLITSESPI

SEQ ID NO: 2197719 - protein, 18 aa, Cryptosporidium hominis
STCVTLCERLMDIRNMSE

SEQ ID NO: 2197720 - protein, 19 aa, Cryptosporidium hominis
STDIDICINWILTNIDSIN

SEQ ID NO: 2197721 - protein, 22 aa, Cryptosporidium hominis
STDTRFVIYPNLLFEKELCDLS

SEQ ID NO: 2197722 - protein, 30 aa, Cryptosporidium hominis
STEKPVEIKHFLRLYPPGTTDVRSVKFPSD

SEQ ID NO: 2197723 - protein, 27 aa, Cryptosporidium hominis
STENQFYHFRDLWRLNLKNYSWQEVKT

SEQ ID NO: 2197724 - protein, 19 aa, Cryptosporidium hominis
STEQILEPLILMYNALEDY

SEQ ID NO: 2197725 - protein, 18 aa, Cryptosporidium hominis
STFHLPYSFKEVPEPKIR

SEQ ID NO: 2197726 - protein, 28 aa, Cryptosporidium hominis
STFNEDILIFSFPSSYIKWNVSFMCFIT

SEQ ID NO: 2197727 - protein, 24 aa, Cryptosporidium hominis
STGLPIDPMVGLPFDPKSGNLVHP

SEQ ID NO: 2197728 - protein, 30 aa, Cryptosporidium hominis
STGNYNIFTIPNLPLILSTIWSRYSGFITD

SEQ ID NO: 2197729 - protein, 24 aa, Cryptosporidium hominis
STIENLKLLSPKSHLFCLVHKMDK

SEQ ID NO: 2197730 - protein, 23 aa, Cryptosporidium hominis
STIQCLALSYYFIEWLHEYMRNE

SEQ ID NO: 2197731 - protein, 36 aa, Cryptosporidium hominis
STIRLKYGIISLKARSKLWWFCRMAEHCGLVGREGN

SEQ ID NO: 2197732 - protein, 23 aa, Cryptosporidium hominis
STISSYLASFLRVKCVISTDTIR

SEQ ID NO: 2197733 - protein, 29 aa, Cryptosporidium hominis
STITQLYDLLFNVYFQPKDIFMKKREHHH

SEQ ID NO: 2197734 - protein, 25 aa, Cryptosporidium hominis
STITTYERNLWTAWLQDNKSNQNNS

SEQ ID NO: 2197735 - protein, 26 aa, Cryptosporidium hominis
STIYKWLRAYWFDDASLISPIRLCTT

SEQ ID NO: 2197736 - protein, 24 aa, Cryptosporidium hominis
STKKKIHWLANLPSVLTKCILREY

SEQ ID NO: 2197737 - protein, 24 aa, Cryptosporidium hominis
STLHRVHWALIDRLIFHTIVQQVV

SEQ ID NO: 2197738 - protein, 18 aa, Cryptosporidium hominis
STLIPPLNLKNVPEDLRK

SEQ ID NO: 2197739 - protein, 17 aa, Cryptosporidium hominis
STLIYVGLYNDSLDMEI

SEQ ID NO: 2197740 - protein, 33 aa, Cryptosporidium hominis
STMNIDLIKWRLIPNFEQIHFKNLKFLIVGSGT

SEQ ID NO: 2197741 - protein, 29 aa, Cryptosporidium hominis
STMPELWKNPFYWTEIFSINSLYFKSSFL

SEQ ID NO: 2197742 - protein, 24 aa, Cryptosporidium hominis
STNDLTEIVYFLDIIHNVETVLSH

SEQ ID NO: 2197743 - protein, 28 aa, Cryptosporidium hominis
STNKSHFNTLLLSPTRSINFLNESSPDT

SEQ ID NO: 2197744 - protein, 26 aa, Cryptosporidium hominis
STQMFSPPQIIMFCEPFEIAKEKAKS

SEQ ID NO: 2197745 - protein, 34 aa, Cryptosporidium hominis
STQVVEFYFALLQSIRWPSKLLIKGGPNVKNSIK

SEQ ID NO: 2197746 - protein, 26 aa, Cryptosporidium hominis
STRDVLVLFYTPWCGHCKTFDPIYNE

SEQ ID NO: 2197747 - protein, 25 aa, Cryptosporidium hominis
STRIPKIQALIKEFFDGKEPNRGIN

SEQ ID NO: 2197748 - protein, 20 aa, Cryptosporidium hominis
STRIPKVQALIQEFFNGKEP

SEQ ID NO: 2197749 - protein, 26 aa, Cryptosporidium hominis
STRQHRIFVPIDPKIPKIIIHTKLSS

SEQ ID NO: 2197750 - protein, 17 aa, Cryptosporidium hominis
STRRKGAGLGSLIAAEV

SEQ ID NO: 2197751 - protein, 18 aa, Cryptosporidium hominis
STRSFTPLDPNLNSRLLL

SEQ ID NO: 2197752 - protein, 26 aa, Cryptosporidium hominis
STSARFVQLGFFGALRFGSNRIDIYS

SEQ ID NO: 2197753 - protein, 26 aa, Cryptosporidium hominis
STSKYVHSFLLLYLASRFNSPEEIML

SEQ ID NO: 2197754 - protein, 25 aa, Cryptosporidium hominis
STSPPPHINYPYSPNSYHQSSPYYS

SEQ ID NO: 2197755 - protein, 30 aa, Cryptosporidium hominis
STSQLISKLPYYLFIHFSRFSKANLNLEKN

SEQ ID NO: 2197756 - protein, 31 aa, Cryptosporidium hominis
STSSGQFIPYFGQPLLFPNNNQNLLNLVALC

SEQ ID NO: 2197757 - protein, 19 aa, Cryptosporidium hominis
STSVIGYMPLRGDFDVEYD

SEQ ID NO: 2197758 - protein, 31 aa, Cryptosporidium hominis
STSVPPPAPPAPPAPPAPPAPSAPPAPPSPP

SEQ ID NO: 2197759 - protein, 22 aa, Cryptosporidium hominis
STTGFIFGSSPFGSSVSGSGSS

SEQ ID NO: 2197760 - protein, 26 aa, Cryptosporidium hominis
STTGYPLLEFYKSNYFFSLYEDIDYQ

SEQ ID NO: 2197761 - protein, 26 aa, Cryptosporidium hominis
STTNGILLFWSPFPFNVRSNPRRRSY

SEQ ID NO: 2197762 - protein, 34 aa, Cryptosporidium hominis
STTQMSLNILKEFNYFGIKFYDNSLIYVFGGCNG

SEQ ID NO: 2197763 - protein, 29 aa, Cryptosporidium hominis
STTTVSSPLLPPIAFPTKVIDTNQQNNLT

SEQ ID NO: 2197764 - protein, 19 aa, Cryptosporidium hominis
STVIVIMRHGVRKPKLKLK

SEQ ID NO: 2197765 - protein, 24 aa, Cryptosporidium hominis
STVLQYHLITLINNDLPGLPQSRT

SEQ ID NO: 2197766 - protein, 21 aa, Cryptosporidium hominis
STVTFLVSFIERLDGESLKAL

SEQ ID NO: 2197767 - protein, 17 aa, Cryptosporidium hominis
STYDCRGGLKYIWNDNC

SEQ ID NO: 2197768 - protein, 19 aa, Cryptosporidium hominis
STYHFEYFMKSLESNMDVL

SEQ ID NO: 2197769 - protein, 25 aa, Cryptosporidium hominis
STYIKPLCKGILDSKIHPISMGKYS

SEQ ID NO: 2197770 - protein, 22 aa, Cryptosporidium hominis
STYIRQIAICSLLAQIGCFVPA

SEQ ID NO: 2197771 - protein, 21 aa, Cryptosporidium hominis
STYLIFQGEIILRIYDRKNRL

SEQ ID NO: 2197772 - protein, 22 aa, Cryptosporidium hominis
STYTHFMRDFYKRSCFSSLGNM

SEQ ID NO: 2197773 - protein, 28 aa, Cryptosporidium hominis
SVAENTHLGFIWLQANNIPFQKPTPSSS

SEQ ID NO: 2197774 - protein, 23 aa, Cryptosporidium hominis
SVAFHSMYYSHTPQYPAAIQIGS

SEQ ID NO: 2197775 - protein, 18 aa, Cryptosporidium hominis
SVAYICSRFYRAPELMLG

SEQ ID NO: 2197776 - protein, 18 aa, Cryptosporidium hominis
SVCFGFGGFLVLCHANNS

SEQ ID NO: 2197777 - protein, 17 aa, Cryptosporidium hominis
SVCINREILKQTKIGVV

SEQ ID NO: 2197778 - protein, 28 aa, Cryptosporidium hominis
SVCKVLGSLILMPNLFASKLNKLNNHFI

SEQ ID NO: 2197779 - protein, 36 aa, Cryptosporidium hominis
SVCPKNTRKLLWTHLGWCILVYPNGDIKAIKPDKNI

SEQ ID NO: 2197780 - protein, 24 aa, Cryptosporidium hominis
SVDFDIFCFIWNKYVNYSKTESQL

SEQ ID NO: 2197781 - protein, 17 aa, Cryptosporidium hominis
SVDMVTKVFASLMQCTA

SEQ ID NO: 2197782 - protein, 25 aa, Cryptosporidium hominis
SVDNIRWPLLWNNSMRCKMNFLYLK

SEQ ID NO: 2197783 - protein, 28 aa, Cryptosporidium hominis
SVDSLDHWMMLFLQPLGITCDSLSLNNC

SEQ ID NO: 2197784 - protein, 31 aa, Cryptosporidium hominis
SVEGQLEFKAILFIPRRAPFDLFETRKKRNN

SEQ ID NO: 2197785 - protein, 23 aa, Cryptosporidium hominis
SVEIHDLSWYLTSSKTVLPDNTT

SEQ ID NO: 2197786 - protein, 30 aa, Cryptosporidium hominis
SVEVDVEEDDFDGLPSEEEELDDIDDEEDD

SEQ ID NO: 2197787 - protein, 21 aa, Cryptosporidium hominis
SVGISILPTFFGAQSLQNILN

SEQ ID NO: 2197788 - protein, 31 aa, Cryptosporidium hominis
SVHDKRVIEWLYNLLECCGKLAKLRSYIIWN

SEQ ID NO: 2197789 - protein, 27 aa, Cryptosporidium hominis
SVHFEGFGTFYMPPPTREFSTEIDYNW

SEQ ID NO: 2197790 - protein, 29 aa, Cryptosporidium hominis
SVIDSSFILTIPMFVASITGMRALLHGLE

SEQ ID NO: 2197791 - protein, 31 aa, Cryptosporidium hominis
SVIFGMIPDFNIFKVLQAPLKNYLFWCYSQS

SEQ ID NO: 2197792 - protein, 32 aa, Cryptosporidium hominis
SVIKKGFLNTISYWSFLRAPPSPKKNVKKWEG

SEQ ID NO: 2197793 - protein, 25 aa, Cryptosporidium hominis
SVIPEDVLIAFELLSYAMFGEVIEK

SEQ ID NO: 2197794 - protein, 21 aa, Cryptosporidium hominis
SVISDLLKNKIDLSLLVVSKS

SEQ ID NO: 2197795 - protein, 19 aa, Cryptosporidium hominis
SVIYSYIYSLFANISLGDK

SEQ ID NO: 2197796 - protein, 25 aa, Cryptosporidium hominis
SVKFSQYFSMFKKKMLKSFNSINEL

SEQ ID NO: 2197797 - protein, 26 aa, Cryptosporidium hominis
SVKSLPLLERLKLAYLKVVIPKCKYD

SEQ ID NO: 2197798 - protein, 17 aa, Cryptosporidium hominis
SVLFEREQILNNFYLSI

SEQ ID NO: 2197799 - protein, 21 aa, Cryptosporidium hominis
SVLKILLKLKMINNAFKILDS

SEQ ID NO: 2197800 - protein, 24 aa, Cryptosporidium hominis
SVLKLKEIISNICSIPVFEIRLVW

SEQ ID NO: 2197801 - protein, 21 aa, Cryptosporidium hominis
SVLQAILRKSPLSKNVPISFI

SEQ ID NO: 2197802 - protein, 21 aa, Cryptosporidium hominis
SVMNNFAALGVIFNCEVPQSH

SEQ ID NO: 2197803 - protein, 19 aa, Cryptosporidium hominis
SVNLKKILKEYSLKGLMEF

SEQ ID NO: 2197804 - protein, 19 aa, Cryptosporidium hominis
SVPFKIGTPKKLRRSSRLK

SEQ ID NO: 2197805 - protein, 24 aa, Cryptosporidium hominis
SVPIGLTCFYVELNPLLKIEFLIR

SEQ ID NO: 2197806 - protein, 17 aa, Cryptosporidium hominis
SVPLFDPISKYVKYLSQ

SEQ ID NO: 2197807 - protein, 22 aa, Cryptosporidium hominis
SVPVDPLIKRTLEFENTQRKVY

SEQ ID NO: 2197808 - protein, 25 aa, Cryptosporidium hominis
SVRAMPTFKFFLNGKEVKSVVGANF

SEQ ID NO: 2197809 - protein, 25 aa, Cryptosporidium hominis
SVRCPKMFLEDLYPPALESANKYSN

SEQ ID NO: 2197810 - protein, 33 aa, Cryptosporidium hominis
SVRFENGLVLMTKRFIQYLYEQGESRIIDLAAA

SEQ ID NO: 2197811 - protein, 24 aa, Cryptosporidium hominis
SVRKYVMNTLGLAGIHFTKKSKYD

SEQ ID NO: 2197812 - protein, 33 aa, Cryptosporidium hominis
SVRRKFKDFYNRYKILYPSFESHDFTGAKNYSL

SEQ ID NO: 2197813 - protein, 24 aa, Cryptosporidium hominis
SVSGKYKWAWTIGDYRLVSDMIWQ

SEQ ID NO: 2197814 - protein, 31 aa, Cryptosporidium hominis
SVSGNIKSYSKVTFTAPETTTAGAASVTSST

SEQ ID NO: 2197815 - protein, 25 aa, Cryptosporidium hominis
SVSHGCLMCLTCSGVHRGLGVHISF

SEQ ID NO: 2197816 - protein, 21 aa, Cryptosporidium hominis
SVSINFNLRVTWKKNLYPSSS

SEQ ID NO: 2197817 - protein, 21 aa, Cryptosporidium hominis
SVSLCAIHRNSKIYYFILSPQ

SEQ ID NO: 2197818 - protein, 23 aa, Cryptosporidium hominis
SVSLEAFLRFKDTKSALVEATAL

SEQ ID NO: 2197819 - protein, 30 aa, Cryptosporidium hominis
SVSNSQLQLLLIFILKIYGAMNVSELLNLC

SEQ ID NO: 2197820 - protein, 24 aa, Cryptosporidium hominis
SVSSEGVIIFWKPSSKKESRGKKV

SEQ ID NO: 2197821 - protein, 23 aa, Cryptosporidium hominis
SVSVSMPPVIPNLGSHYGDVSPE

SEQ ID NO: 2197822 - protein, 20 aa, Cryptosporidium hominis
SVTAPWLFSVQSGTPISSLQ

SEQ ID NO: 2197823 - protein, 37 aa, Cryptosporidium hominis
SVTSKINLINFAMSCIFEIDLLFKQLNLRNASSYNSS

SEQ ID NO: 2197824 - protein, 26 aa, Cryptosporidium hominis
SVTSLTAHRLVLAAALLTYKLMYDVQ

SEQ ID NO: 2197825 - protein, 17 aa, Cryptosporidium hominis
SVVFNHLDDRCFVAWNK

SEQ ID NO: 2197826 - protein, 21 aa, Cryptosporidium hominis
SVVVFFDLWIDDGNVLTTSPL

SEQ ID NO: 2197827 - protein, 18 aa, Cryptosporidium hominis
SVYERVILEYLIMRKLNH

SEQ ID NO: 2197828 - protein, 18 aa, Cryptosporidium hominis
SWLHNLLCLDSTNPPLFS

SEQ ID NO: 2197829 - protein, 22 aa, Cryptosporidium hominis
SWMKNRFIVLIRKRRQLMNLIS

SEQ ID NO: 2197830 - protein, 25 aa, Cryptosporidium hominis
SWMNNQFGMKLIAPQAPAYITPNSG

SEQ ID NO: 2197831 - protein, 27 aa, Cryptosporidium hominis
SWSVGILIYELYMGNVPFIPNNSSGGG

SEQ ID NO: 2197832 - protein, 18 aa, Cryptosporidium hominis
SYAPPHGILAPLWTDFTT

SEQ ID NO: 2197833 - protein, 19 aa, Cryptosporidium hominis
SYCPYCIKAINSLKSAGYS

SEQ ID NO: 2197834 - protein, 19 aa, Cryptosporidium hominis
SYDALYEKMVWLHPSNQSI

SEQ ID NO: 2197835 - protein, 27 aa, Cryptosporidium hominis
SYDKVIKKPIKLLKYKNSNSKLGIKNN

SEQ ID NO: 2197836 - protein, 23 aa, Cryptosporidium hominis
SYEEINYHPLMYKTKICEQFQRG

SEQ ID NO: 2197837 - protein, 23 aa, Cryptosporidium hominis
SYEMALRFYQVNIIGNFGNESKS

SEQ ID NO: 2197838 - protein, 24 aa, Cryptosporidium hominis
SYFHCKVCCMCYPLSIKETHKCIE

SEQ ID NO: 2197839 - protein, 17 aa, Cryptosporidium hominis
SYFRAYRGRKLFSFNKD

SEQ ID NO: 2197840 - protein, 26 aa, Cryptosporidium hominis
SYFYKEENLLLLLTVKDILSLDSLLS

SEQ ID NO: 2197841 - protein, 18 aa, Cryptosporidium hominis
SYFYSREEFYVYQAIFNY

SEQ ID NO: 2197842 - protein, 17 aa, Cryptosporidium hominis
SYHWSQCLGLDKVPPRT

SEQ ID NO: 2197843 - protein, 19 aa, Cryptosporidium hominis
SYIKNLLMKIVPVRNLDLK

SEQ ID NO: 2197844 - protein, 21 aa, Cryptosporidium hominis
SYILKRLHRGILYYKQKNNYI

SEQ ID NO: 2197845 - protein, 25 aa, Cryptosporidium hominis
SYKIKDFPALPKFLINFRDDLFALN

SEQ ID NO: 2197846 - protein, 37 aa, Cryptosporidium hominis
SYKNFNLKLQLILKPSWYIRVVILFFSTREAFHGRPL

SEQ ID NO: 2197847 - protein, 21 aa, Cryptosporidium hominis
SYKRTFMLKKLIGSGANASVF

SEQ ID NO: 2197848 - protein, 21 aa, Cryptosporidium hominis
SYLEKLLLNGFIKEKKKIQSN

SEQ ID NO: 2197849 - protein, 30 aa, Cryptosporidium hominis
SYLFDNTHSKIILFVGNYKNGTNNGDKISV

SEQ ID NO: 2197850 - protein, 18 aa, Cryptosporidium hominis
SYLIHKVLNILQSNTVPL

SEQ ID NO: 2197851 - protein, 18 aa, Cryptosporidium hominis
SYLPTPSTSTFPLTSSHS

SEQ ID NO: 2197852 - protein, 20 aa, Cryptosporidium hominis
SYLQTYPMNYWASNGNIWCN

SEQ ID NO: 2197853 - protein, 23 aa, Cryptosporidium hominis
SYLSLPALIAPVKCSILPISSNA

SEQ ID NO: 2197854 - protein, 24 aa, Cryptosporidium hominis
SYLVYAPLCNGITTLIFEGVPTYP

SEQ ID NO: 2197855 - protein, 20 aa, Cryptosporidium hominis
SYNFYLEKLWNWCILVISDI

SEQ ID NO: 2197856 - protein, 25 aa, Cryptosporidium hominis
SYNHGDRNWNNTRYLNRYRDRHENY

SEQ ID NO: 2197857 - protein, 17 aa, Cryptosporidium hominis
SYNIWYLNSQNRLPVSI

SEQ ID NO: 2197858 - protein, 24 aa, Cryptosporidium hominis
SYNNSLFFTAFTIPSNEGSSIDLR

SEQ ID NO: 2197859 - protein, 25 aa, Cryptosporidium hominis
SYNSQDFKFPFIFSKEIRSSKNVGY

SEQ ID NO: 2197860 - protein, 19 aa, Cryptosporidium hominis
SYPIRGELLIRGTTIFKGY

SEQ ID NO: 2197861 - protein, 25 aa, Cryptosporidium hominis
SYRFDLEMMSLLDSLKYPELNKLIY

SEQ ID NO: 2197862 - protein, 24 aa, Cryptosporidium hominis
SYSELYVYCDPAYKLRPFCDFQTM

SEQ ID NO: 2197863 - protein, 20 aa, Cryptosporidium hominis
SYSFGNNCPLLLEGSYNGNN

SEQ ID NO: 2197864 - protein, 37 aa, Cryptosporidium hominis
SYSKSNIPVLAPPPVAEYMPVTTPIIMARQPMNALNY

SEQ ID NO: 2197865 - protein, 17 aa, Cryptosporidium hominis
SYSLPKHSNKLLSITFL

SEQ ID NO: 2197866 - protein, 27 aa, Cryptosporidium hominis
SYSSRSHLIFMLQLQQKNVFDSSIKVG

SEQ ID NO: 2197867 - protein, 27 aa, Cryptosporidium hominis
SYTEIKEIIIWIYDLYINSMACFDNGL

SEQ ID NO: 2197868 - protein, 18 aa, Cryptosporidium hominis
SYTFTHETLFTMTSKQVW

SEQ ID NO: 2197869 - protein, 26 aa, Cryptosporidium hominis
SYTLEWPTLTIDWLPNSYKSADGSYS

SEQ ID NO: 2197870 - protein, 23 aa, Cryptosporidium hominis
SYTVKKLYLSLLSRNDQILLIQV

SEQ ID NO: 2197871 - protein, 20 aa, Cryptosporidium hominis
SYVHIPPNHFFSFKNLSNES

SEQ ID NO: 2197872 - protein, 17 aa, Cryptosporidium hominis
SYYILLKQSIVNQYILQ

SEQ ID NO: 2197873 - protein, 18 aa, Cryptosporidium hominis
SYYKEICTLYPFTDAKQI

SEQ ID NO: 2197874 - protein, 18 aa, Cryptosporidium hominis
SYYSKIKFVLVVEKDTIF

SEQ ID NO: 2197875 - protein, 19 aa, Cryptosporidium hominis
TAAMLGLPNALWNTDIYLR

SEQ ID NO: 2197876 - protein, 38 aa, Cryptosporidium hominis
TAANLMQYYMFIPFKYKWSYFIGLLQNLGQYTGIIFCN

SEQ ID NO: 2197877 - protein, 25 aa, Cryptosporidium hominis
TADDIYVVLSSFLFSSTSINPGQSN

SEQ ID NO: 2197878 - protein, 29 aa, Cryptosporidium hominis
TADIWSLGAILYRITYKRHLFQQPISNTS

SEQ ID NO: 2197879 - protein, 24 aa, Cryptosporidium hominis
TADSGHYVAWRYCPNDREYIIKFD

SEQ ID NO: 2197880 - protein, 25 aa, Cryptosporidium hominis
TAFLMSNMVSVPINLLQPGRNINLQ

SEQ ID NO: 2197881 - protein, 22 aa, Cryptosporidium hominis
TAFPDVRIIPLTNEDEFIVLAC

SEQ ID NO: 2197882 - protein, 28 aa, Cryptosporidium hominis
TAGQERYRSLAPMYYRGAAAAIVVYDIT

SEQ ID NO: 2197883 - protein, 26 aa, Cryptosporidium hominis
TAHQQGLPLSIYRLPNTYIASDTGYT

SEQ ID NO: 2197884 - protein, 20 aa, Cryptosporidium hominis
TAIDFLLNNELYIENWSRVV

SEQ ID NO: 2197885 - protein, 20 aa, Cryptosporidium hominis
TAIENFFIDLIKEAEDDIKF

SEQ ID NO: 2197886 - protein, 19 aa, Cryptosporidium hominis
TAILCQMYYVPKTLQEFKW

SEQ ID NO: 2197887 - protein, 30 aa, Cryptosporidium hominis
TAKECARILYPTLLRLGYTVSQSRVGKVCV

SEQ ID NO: 2197888 - protein, 17 aa, Cryptosporidium hominis
TAKRLFEFLQNPSYIQD

SEQ ID NO: 2197889 - protein, 26 aa, Cryptosporidium hominis
TAKSQLLQYIHKITPRGYYISGKGSS

SEQ ID NO: 2197890 - protein, 24 aa, Cryptosporidium hominis
TALAMLCMDPYYRTIQGFLSLIEK

SEQ ID NO: 2197891 - protein, 25 aa, Cryptosporidium hominis
TANNLTKFIYLFGQIPSEIINSELY

SEQ ID NO: 2197892 - protein, 28 aa, Cryptosporidium hominis
TAPLYIHDYHYQALAYDLLKIPVSISNP

SEQ ID NO: 2197893 - protein, 21 aa, Cryptosporidium hominis
TARQKWAKMALRFGGNELQKN

SEQ ID NO: 2197894 - protein, 27 aa, Cryptosporidium hominis
TASCLVHLLEFPPFVLSLDEIEVVSFE

SEQ ID NO: 2197895 - protein, 25 aa, Cryptosporidium hominis
TASDGIVPTWLLQDDSNFANKTSIS

SEQ ID NO: 2197896 - protein, 18 aa, Cryptosporidium hominis
TATFVIAALQKIDYSLNA

SEQ ID NO: 2197897 - protein, 23 aa, Cryptosporidium hominis
TATLYPRLYPLHHSLILSESNSE

SEQ ID NO: 2197898 - protein, 26 aa, Cryptosporidium hominis
TATQFRFIVDLLRRFHVLDNYCGCTG

SEQ ID NO: 2197899 - protein, 23 aa, Cryptosporidium hominis
TAVMALRRAKYKFPGRQKVVVSD

SEQ ID NO: 2197900 - protein, 23 aa, Cryptosporidium hominis
TAYRTQLLLGLAPQNATWMLLDR

SEQ ID NO: 2197901 - protein, 23 aa, Cryptosporidium hominis
TAYSIKLFLERFGMSCGVLTPII

SEQ ID NO: 2197902 - protein, 18 aa, Cryptosporidium hominis
TCCTFFKLFKLHLNSQVD

SEQ ID NO: 2197903 - protein, 24 aa, Cryptosporidium hominis
TCEMLYYSKPFDKLFFSEGTYNSH

SEQ ID NO: 2197904 - protein, 18 aa, Cryptosporidium hominis
TCFIKLQSKLDDGGYFTC

SEQ ID NO: 2197905 - protein, 17 aa, Cryptosporidium hominis
TCFLIILVNVINYNQFH

SEQ ID NO: 2197906 - protein, 29 aa, Cryptosporidium hominis
TCFSLFVRWNLGIDDVLYPNIPKLNPSSI

SEQ ID NO: 2197907 - protein, 26 aa, Cryptosporidium hominis
TCFSPRMLPDWQLNWLRDVTRSLSSV

SEQ ID NO: 2197908 - protein, 20 aa, Cryptosporidium hominis
TCLKFLPNLGIIISGDISGG

SEQ ID NO: 2197909 - protein, 31 aa, Cryptosporidium hominis
TCNRDFVAVITSLRYLRIWRNSGISVSVTKL

SEQ ID NO: 2197910 - protein, 26 aa, Cryptosporidium hominis
TCPVCLDYYMLPVTIPCGHTFCRYCI

SEQ ID NO: 2197911 - protein, 23 aa, Cryptosporidium hominis
TCSDIVFFIAKFIQHYPRLDEGL

SEQ ID NO: 2197912 - protein, 18 aa, Cryptosporidium hominis
TCSEWFDMDSVHPIELEM

SEQ ID NO: 2197913 - protein, 26 aa, Cryptosporidium hominis
TCTEKLIILSSYLAFLVFKVSKKNQT

SEQ ID NO: 2197914 - protein, 21 aa, Cryptosporidium hominis
TCVVLGIYHWLTNDKYKALRF

SEQ ID NO: 2197915 - protein, 24 aa, Cryptosporidium hominis
TCYETWYKIIQHFSDKYPSSLEPI

SEQ ID NO: 2197916 - protein, 25 aa, Cryptosporidium hominis
TDAKQIVMAFLYTKIRIFKELSKQI

SEQ ID NO: 2197917 - protein, 30 aa, Cryptosporidium hominis
TDCTYLIHHLILIPFTYGSKFPPPIPNIGS

SEQ ID NO: 2197918 - protein, 25 aa, Cryptosporidium hominis
TDDLPKAYSLLLEKHLKLKSEFDEK

SEQ ID NO: 2197919 - protein, 23 aa, Cryptosporidium hominis
TDELAISSLLSNAKFTLSVIKIG

SEQ ID NO: 2197920 - protein, 24 aa, Cryptosporidium hominis
TDERLRLGGVLELLDEEALIREAA

SEQ ID NO: 2197921 - protein, 36 aa, Cryptosporidium hominis
TDETIRVLREVKPYVFYGFPNLNLLKTLVFKKGAFT

SEQ ID NO: 2197922 - protein, 29 aa, Cryptosporidium hominis
TDEYLAKWLDGKNALIIRKLVNGDKDMQT

SEQ ID NO: 2197923 - protein, 17 aa, Cryptosporidium hominis
TDFGVYPWYELGMNEYR

SEQ ID NO: 2197924 - protein, 25 aa, Cryptosporidium hominis
TDILGQYETIPLIWTSSKNLSQLIN

SEQ ID NO: 2197925 - protein, 25 aa, Cryptosporidium hominis
TDINPYYDAFVKWQFRTLKVSFKST

SEQ ID NO: 2197926 - protein, 22 aa, Cryptosporidium hominis
TDISFFLPLVRHIFSNLQVVYC

SEQ ID NO: 2197927 - protein, 42 aa, Cryptosporidium hominis
TDKRGIALTRRFLLEFLSFFHRYIPIGILEQPIHTQNFNWRT

SEQ ID NO: 2197928 - protein, 31 aa, Cryptosporidium hominis
TDKSKCILFLDYLILRTKKLSYIVDSLIQDR

SEQ ID NO: 2197929 - protein, 24 aa, Cryptosporidium hominis
TDKSLFLYYEPGAGKNELIKPNGR

SEQ ID NO: 2197930 - protein, 33 aa, Cryptosporidium hominis
TDKSRIPKFRNPWDVYGELQPRRSKDLPLSYDE

SEQ ID NO: 2197931 - protein, 24 aa, Cryptosporidium hominis
TDLKSGLLDYYGTLFIPSEQDLSS

SEQ ID NO: 2197932 - protein, 24 aa, Cryptosporidium hominis
TDLKSHIMLLTDIPSYISYLDITK

SEQ ID NO: 2197933 - protein, 29 aa, Cryptosporidium hominis
TDLTKELILKPISLLKSCYPKVIVMTQTA

SEQ ID NO: 2197934 - protein, 29 aa, Cryptosporidium hominis
TDLTRYVRYPRYILLQRQKSTLMRRLKVP

SEQ ID NO: 2197935 - protein, 27 aa, Cryptosporidium hominis
TDLVDLHVYLFKSSIFKILEIASGSQK

SEQ ID NO: 2197936 - protein, 17 aa, Cryptosporidium hominis
TDLVLALKYKKKHLNNK

SEQ ID NO: 2197937 - protein, 23 aa, Cryptosporidium hominis
TDNLYAIDLRFPNSKKLPIPIMK

SEQ ID NO: 2197938 - protein, 21 aa, Cryptosporidium hominis
TDPFYRCPIWDRLKNYKQQKR

SEQ ID NO: 2197939 - protein, 23 aa, Cryptosporidium hominis
TDPIYWTEYFPPLTKKDLKNFGT

SEQ ID NO: 2197940 - protein, 18 aa, Cryptosporidium hominis
TDQDYLIHTFSFSKGKSS

SEQ ID NO: 2197941 - protein, 39 aa, Cryptosporidium hominis
TDQEKLFCDQIQLPPIFYILSKRILIQEAKYHLSLNSKT

SEQ ID NO: 2197942 - protein, 20 aa, Cryptosporidium hominis
TDQFLQVHILITIGDLRTVI

SEQ ID NO: 2197943 - protein, 27 aa, Cryptosporidium hominis
TDQGLSLYLSFWCFSAAAALSSLVSAG

SEQ ID NO: 2197944 - protein, 25 aa, Cryptosporidium hominis
TDSALSLFLLRLRNLEFLEIIDCNS

SEQ ID NO: 2197945 - protein, 44 aa, Cryptosporidium hominis
TDSEIPFILVPLSSLYMENFSPYVLLLQIDILYNLLTQQIDSNY

SEQ ID NO: 2197946 - protein, 26 aa, Cryptosporidium hominis
TDSNAPLLPYLRRLFNTLNREICLFY

SEQ ID NO: 2197947 - protein, 33 aa, Cryptosporidium hominis
TDSNIEIYFKLLESLIFCIPFGNSLNSGIERQS

SEQ ID NO: 2197948 - protein, 29 aa, Cryptosporidium hominis
TDSQSSFRRFMNFDWFTSMFSSRRRGTSQ

SEQ ID NO: 2197949 - protein, 20 aa, Cryptosporidium hominis
TDVTPRLDYSPQGGGGLISK

SEQ ID NO: 2197950 - protein, 20 aa, Cryptosporidium hominis
TDWLANYLSKLSPRTRFDCL

SEQ ID NO: 2197951 - protein, 26 aa, Cryptosporidium hominis
TDYSSRLPLWHLFSSLCWQGYHNQQE

SEQ ID NO: 2197952 - protein, 34 aa, Cryptosporidium hominis
TEDDTYLLFDLCKEFDLRFIVIHDRYIPPSGKQR

SEQ ID NO: 2197953 - protein, 25 aa, Cryptosporidium hominis
TEDEIRELFSPYGQINEIFIMREPH

SEQ ID NO: 2197954 - protein, 26 aa, Cryptosporidium hominis
TEDLTTKVALWLRDQKLRDNNSSLLR

SEQ ID NO: 2197955 - protein, 17 aa, Cryptosporidium hominis
TEEILANAFKKYASFEK

SEQ ID NO: 2197956 - protein, 18 aa, Cryptosporidium hominis
TEEYNKHINWLESEISRV

SEQ ID NO: 2197957 - protein, 23 aa, Cryptosporidium hominis
TEFDVCHSLLQKIKTRDEDLSST

SEQ ID NO: 2197958 - protein, 34 aa, Cryptosporidium hominis
TEFQTNLVPYPRIHFMLSSYAPIISAEKAFHEQL

SEQ ID NO: 2197959 - protein, 47 aa, Cryptosporidium hominis
TEGSSVLVEPFKSKFLKMFVKKPLEDSTPSVMKFFSVSYPNESTVTV

SEQ ID NO: 2197960 - protein, 25 aa, Cryptosporidium hominis
TEGYGYYFVRLMGRSASHITLECGL

SEQ ID NO: 2197961 - protein, 24 aa, Cryptosporidium hominis
TEHFKKYASLMLLLSDILRCMKRQ

SEQ ID NO: 2197962 - protein, 23 aa, Cryptosporidium hominis
TEIDDLLLASKFAELENYKSASI

SEQ ID NO: 2197963 - protein, 26 aa, Cryptosporidium hominis
TEIIQLIVRGFLLSGVTIWSYESPQQ

SEQ ID NO: 2197964 - protein, 28 aa, Cryptosporidium hominis
TEINRNILLILLGNLLLIARNIGLDGEI

SEQ ID NO: 2197965 - protein, 31 aa, Cryptosporidium hominis
TEKHEFFYSQWIEQIGYLSSLTKGFTRSIRE

SEQ ID NO: 2197966 - protein, 26 aa, Cryptosporidium hominis
TEKQLFRKLFLLEESLWNSQSYLSLG

SEQ ID NO: 2197967 - protein, 29 aa, Cryptosporidium hominis
TEKQLKLLLDFLDYTVFLYGDFSAGSCPK

SEQ ID NO: 2197968 - protein, 24 aa, Cryptosporidium hominis
TEKTAFIRSCTRYLTIDTNGTVNN

SEQ ID NO: 2197969 - protein, 27 aa, Cryptosporidium hominis
TEKVLGCLYKLYLNGNLYCFAIDEAHC

SEQ ID NO: 2197970 - protein, 26 aa, Cryptosporidium hominis
TELKRRIRRIPGVPIMYVTNHKYSIE

SEQ ID NO: 2197971 - protein, 36 aa, Cryptosporidium hominis
TELLLIEWMEAFFAHLRLALLPSDFLVYSHRHDLVC

SEQ ID NO: 2197972 - protein, 17 aa, Cryptosporidium hominis
TELLLKSGALLAEAMDS

SEQ ID NO: 2197973 - protein, 24 aa, Cryptosporidium hominis
TEMLQYIIHPIIIPVLEDYHACIS

SEQ ID NO: 2197974 - protein, 18 aa, Cryptosporidium hominis
TENFQWLTNNHWVFLWTQ

SEQ ID NO: 2197975 - protein, 25 aa, Cryptosporidium hominis
TENFYPFRFYPMNELDQKFPNIHAI

SEQ ID NO: 2197976 - protein, 26 aa, Cryptosporidium hominis
TENRIAFDFIIDEVFLRGTIYDYMRQ

SEQ ID NO: 2197977 - protein, 25 aa, Cryptosporidium hominis
TEQFWEYLERVFYPVDERWISILDL

SEQ ID NO: 2197978 - protein, 24 aa, Cryptosporidium hominis
TERELGIFELAVNNIFELLEQSEH

SEQ ID NO: 2197979 - protein, 25 aa, Cryptosporidium hominis
TERFERCLDLYLCPRAMKMRMNVDP

SEQ ID NO: 2197980 - protein, 20 aa, Cryptosporidium hominis
TERIYKQILIFLKEGNKDLT

SEQ ID NO: 2197981 - protein, 17 aa, Cryptosporidium hominis
TETPEMCLKGHLNWVLT

SEQ ID NO: 2197982 - protein, 25 aa, Cryptosporidium hominis
TETQRQFACLLWGIKNEYGLVTTEK

SEQ ID NO: 2197983 - protein, 17 aa, Cryptosporidium hominis
TETRRVFIPSKLGYGAR

SEQ ID NO: 2197984 - protein, 23 aa, Cryptosporidium hominis
TEVVKFLKFVNKGNLAMALDIEK

SEQ ID NO: 2197985 - protein, 23 aa, Cryptosporidium hominis
TEWEKIGWLTASRLLLEIDSQSN

SEQ ID NO: 2197986 - protein, 23 aa, Cryptosporidium hominis
TEYDSLLEMILNIGNITNKTFQE

SEQ ID NO: 2197987 - protein, 18 aa, Cryptosporidium hominis
TEYHLGRLKAQLAKLKTE

SEQ ID NO: 2197988 - protein, 23 aa, Cryptosporidium hominis
TFCYGYFPDQVILFILKNINREE

SEQ ID NO: 2197989 - protein, 25 aa, Cryptosporidium hominis
TFDDPDYEYLRLLEPELNKSASSWK

SEQ ID NO: 2197990 - protein, 20 aa, Cryptosporidium hominis
TFDGIEFFPGFIGLSNFGNN

SEQ ID NO: 2197991 - protein, 18 aa, Cryptosporidium hominis
TFDPYNTLFIARLNYDTT

SEQ ID NO: 2197992 - protein, 26 aa, Cryptosporidium hominis
TFDTYRKRNVLLNRALYGLAGSMFTV

SEQ ID NO: 2197993 - protein, 17 aa, Cryptosporidium hominis
TFERIIKPIAEKFPYLI

SEQ ID NO: 2197994 - protein, 18 aa, Cryptosporidium hominis
TFERSLSPVNRTLETTTS

SEQ ID NO: 2197995 - protein, 17 aa, Cryptosporidium hominis
TFFIKSKSRNCKFPRYG

SEQ ID NO: 2197996 - protein, 18 aa, Cryptosporidium hominis
TFFQQTYATLNTPSYGNN

SEQ ID NO: 2197997 - protein, 29 aa, Cryptosporidium hominis
TFGLKMMFDWNFEFNWYEDFTDVIPIASG

SEQ ID NO: 2197998 - protein, 20 aa, Cryptosporidium hominis
TFKLCIYFDFKTQIAYYSAF

SEQ ID NO: 2197999 - protein, 21 aa, Cryptosporidium hominis
TFKNYLVLVSSPLNISSEYYS

SEQ ID NO: 2198000 - protein, 24 aa, Cryptosporidium hominis
TFKQGWTLFTLISTGIPIRDPNNI

SEQ ID NO: 2198001 - protein, 20 aa, Cryptosporidium hominis
TFLNGPANLSLFDVNTPIFD

SEQ ID NO: 2198002 - protein, 30 aa, Cryptosporidium hominis
TFLNKSSHLLPVGSLGPYSFQPYKEQPHGD

SEQ ID NO: 2198003 - protein, 20 aa, Cryptosporidium hominis
TFLWSLTEIENDCSLCLRQI

SEQ ID NO: 2198004 - protein, 26 aa, Cryptosporidium hominis
TFNEDWTLFVILSTGVPVYGDNSNNI

SEQ ID NO: 2198005 - protein, 33 aa, Cryptosporidium hominis
TFNSKIYGFDVARSEAIAFLKAKQSELQSIGQL

SEQ ID NO: 2198006 - protein, 23 aa, Cryptosporidium hominis
TFSYSLDVWSVGVIMYSVITGRH

SEQ ID NO: 2198007 - protein, 26 aa, Cryptosporidium hominis
TFTSEPFNIMNLNTLKYSGLAARRSI

SEQ ID NO: 2198008 - protein, 18 aa, Cryptosporidium hominis
TFVRSFTMPTSCKKFIST

SEQ ID NO: 2198009 - protein, 18 aa, Cryptosporidium hominis
TFYNDLYVFEVNNKRWYE

SEQ ID NO: 2198010 - protein, 20 aa, Cryptosporidium hominis
TGDVKFRWYVNENCANLGLD

SEQ ID NO: 2198011 - protein, 25 aa, Cryptosporidium hominis
TGFKRGIFIFTGNDLEFKYLNNMLN

SEQ ID NO: 2198012 - protein, 28 aa, Cryptosporidium hominis
TGFLLTEILPIKLFRSMITFLNTRNFSK

SEQ ID NO: 2198013 - protein, 26 aa, Cryptosporidium hominis
TGFLRSLWLISRFDWEKKPLIVDFDF

SEQ ID NO: 2198014 - protein, 19 aa, Cryptosporidium hominis
TGGSLMGNVLMMSGNGTNG

SEQ ID NO: 2198015 - protein, 20 aa, Cryptosporidium hominis
TGHFGSGWIWVVIDPINNQK

SEQ ID NO: 2198016 - protein, 18 aa, Cryptosporidium hominis
TGHRAFVSILKLINELPP

SEQ ID NO: 2198017 - protein, 27 aa, Cryptosporidium hominis
TGHTLRLLSFPSLLEKGLSKLFSIKQN

SEQ ID NO: 2198018 - protein, 17 aa, Cryptosporidium hominis
TGHVYSNWPTARTPLKY

SEQ ID NO: 2198019 - protein, 22 aa, Cryptosporidium hominis
TGIIGRFFIFSSFNHRGNELML

SEQ ID NO: 2198020 - protein, 21 aa, Cryptosporidium hominis
TGIINFYNPFKTDFLSSQYWI

SEQ ID NO: 2198021 - protein, 25 aa, Cryptosporidium hominis
TGIIQWVCNLTIEIGFLILDLGSFI

SEQ ID NO: 2198022 - protein, 18 aa, Cryptosporidium hominis
TGIKYPIASYKLTPDMAI

SEQ ID NO: 2198023 - protein, 18 aa, Cryptosporidium hominis
TGIQIWISTLSFQIWTST

SEQ ID NO: 2198024 - protein, 22 aa, Cryptosporidium hominis
TGKKNLEPSLGLSWNSLICERL

SEQ ID NO: 2198025 - protein, 26 aa, Cryptosporidium hominis
TGKTIAFVLFIFNKLLDSLDNCLERS

SEQ ID NO: 2198026 - protein, 23 aa, Cryptosporidium hominis
TGKTLCLLASTLAFQKHFLISHG

SEQ ID NO: 2198027 - protein, 23 aa, Cryptosporidium hominis
TGLCLVYGTDDSLLRYCFIEAEN

SEQ ID NO: 2198028 - protein, 18 aa, Cryptosporidium hominis
TGLDTIKYLLSQAKLLLN

SEQ ID NO: 2198029 - protein, 19 aa, Cryptosporidium hominis
TGLIANLHRMGINNSIVVN

SEQ ID NO: 2198030 - protein, 26 aa, Cryptosporidium hominis
TGLIEKCLKLFLHPTITPVELSARFN

SEQ ID NO: 2198031 - protein, 20 aa, Cryptosporidium hominis
TGLLLLYRFDDESVLSLIYF

SEQ ID NO: 2198032 - protein, 24 aa, Cryptosporidium hominis
TGLQRLDNFPLLENLKVLEIQDNH

SEQ ID NO: 2198033 - protein, 18 aa, Cryptosporidium hominis
TGMPASGALLPHIPSLGN

SEQ ID NO: 2198034 - protein, 24 aa, Cryptosporidium hominis
TGNRKIKRLFWNYNDENCCNNFTI

SEQ ID NO: 2198035 - protein, 17 aa, Cryptosporidium hominis
TGNSKLALLKFGKILNN

SEQ ID NO: 2198036 - protein, 23 aa, Cryptosporidium hominis
TGQIYNFPSLEELINTKKTENTS

SEQ ID NO: 2198037 - protein, 28 aa, Cryptosporidium hominis
TGSGKTIAFLIPLISYVGNKPILDYKTS

SEQ ID NO: 2198038 - protein, 40 aa, Cryptosporidium hominis
TGSGLLFEFRLSWSNHLIYTHWMERFFGYLNKYHIKIAGE

SEQ ID NO: 2198039 - protein, 24 aa, Cryptosporidium hominis
TGSNMIIWKLELTKLNGVRKIIWQ

SEQ ID NO: 2198040 - protein, 19 aa, Cryptosporidium hominis
TGVNLSHLILSKNSIKQLE

SEQ ID NO: 2198041 - protein, 27 aa, Cryptosporidium hominis
TGYILSNIPLVIYKVLGNTINKSSNND

SEQ ID NO: 2198042 - protein, 33 aa, Cryptosporidium hominis
TGYKSIKSFVLLAYFLNVFGVKDAMDVIISIQG

SEQ ID NO: 2198043 - protein, 18 aa, Cryptosporidium hominis
THFTFKDKLLARVSTNNN

SEQ ID NO: 2198044 - protein, 20 aa, Cryptosporidium hominis
THGFIVVHILSCKADSLIYS

SEQ ID NO: 2198045 - protein, 27 aa, Cryptosporidium hominis
THGYSLNQVILWKWPSMQKIATLTGHT

SEQ ID NO: 2198046 - protein, 28 aa, Cryptosporidium hominis
THIKYIRMSLSLLLKLRLKCIRKQTFTP

SEQ ID NO: 2198047 - protein, 30 aa, Cryptosporidium hominis
THIYSFDAAMPIWMIKRFVDLFNVSRTTYC

SEQ ID NO: 2198048 - protein, 24 aa, Cryptosporidium hominis
THKIKRRWELDTPFIHYRNIGFNK

SEQ ID NO: 2198049 - protein, 19 aa, Cryptosporidium hominis
THLLFLNRFSIVFDQLHAI

SEQ ID NO: 2198050 - protein, 21 aa, Cryptosporidium hominis
THMNPLMMKIYSAEGGMPGGM

SEQ ID NO: 2198051 - protein, 24 aa, Cryptosporidium hominis
THPNLVVIPERYADRKLSVYGSEM

SEQ ID NO: 2198052 - protein, 24 aa, Cryptosporidium hominis
THPQDVLHYAFIKANQRLQEHVLE

SEQ ID NO: 2198053 - protein, 25 aa, Cryptosporidium hominis
THSDSWFIDMKPFLNQGLPIWERVS

SEQ ID NO: 2198054 - protein, 24 aa, Cryptosporidium hominis
THSHSKYRGLHLISNQSDSDSSDP

SEQ ID NO: 2198055 - protein, 18 aa, Cryptosporidium hominis
THVFFDISIGGTPTGRVV

SEQ ID NO: 2198056 - protein, 22 aa, Cryptosporidium hominis
THVKLIIQDRIYDWKTPDSRKI

SEQ ID NO: 2198057 - protein, 17 aa, Cryptosporidium hominis
THWGAQWDVNYIEKIYN

SEQ ID NO: 2198058 - protein, 17 aa, Cryptosporidium hominis
TIAPNTLIPPFTEWGGT

SEQ ID NO: 2198059 - protein, 17 aa, Cryptosporidium hominis
TIDGLLGMVKYCEEQYK

SEQ ID NO: 2198060 - protein, 42 aa, Cryptosporidium hominis
TIDLPTCLNSDNLYRALRFGGLLVRIPPYNQKSYEHFNLLSP

SEQ ID NO: 2198061 - protein, 21 aa, Cryptosporidium hominis
TIEDFPLLRTLAMQRALPNHD

SEQ ID NO: 2198062 - protein, 23 aa, Cryptosporidium hominis
TIENLFCIGALDSTTAASCLGKF

SEQ ID NO: 2198063 - protein, 23 aa, Cryptosporidium hominis
TIEYRDGMKLSLGVDGRKLLLKR

SEQ ID NO: 2198064 - protein, 27 aa, Cryptosporidium hominis
TIGNPLAFYNWLQRIGKLPSSKVHFVT

SEQ ID NO: 2198065 - protein, 30 aa, Cryptosporidium hominis
TIGRIVTFHPTIIFPLLGLPPQQSVEHSNG

SEQ ID NO: 2198066 - protein, 22 aa, Cryptosporidium hominis
TIHGIFLDLPSPWIAIKHADQV

SEQ ID NO: 2198067 - protein, 27 aa, Cryptosporidium hominis
TIHKLVSFYVRDILKFILNEESISNEK

SEQ ID NO: 2198068 - protein, 19 aa, Cryptosporidium hominis
TIILILTPTRELCIQTIET

SEQ ID NO: 2198069 - protein, 23 aa, Cryptosporidium hominis
TIKTLYFDLIPRWITQKNKYRRI

SEQ ID NO: 2198070 - protein, 29 aa, Cryptosporidium hominis
TILNEGLGASFYRFIFNSVFFSKSNLNEK

SEQ ID NO: 2198071 - protein, 17 aa, Cryptosporidium hominis
TINASWFPNIDLTICTL

SEQ ID NO: 2198072 - protein, 25 aa, Cryptosporidium hominis
TINDYYLISIFGQIPETISLQFQDL

SEQ ID NO: 2198073 - protein, 17 aa, Cryptosporidium hominis
TINFALVALIKASIRLK

SEQ ID NO: 2198074 - protein, 19 aa, Cryptosporidium hominis
TINLPMINALILEKFAVKS

SEQ ID NO: 2198075 - protein, 18 aa, Cryptosporidium hominis
TINMLTLEWGLDNSVGVD

SEQ ID NO: 2198076 - protein, 33 aa, Cryptosporidium hominis
TINSCLSWKTFGYFNLISCYSVLVNSGTCESKE

SEQ ID NO: 2198077 - protein, 24 aa, Cryptosporidium hominis
TINTQIVLYGCKKGKLIRVYVIKD

SEQ ID NO: 2198078 - protein, 26 aa, Cryptosporidium hominis
TINVKYQIVLSWIYKFLNDFGRLPVN

SEQ ID NO: 2198079 - protein, 23 aa, Cryptosporidium hominis
TIPNLTVALRYLQGRPVVAYDSL

SEQ ID NO: 2198080 - protein, 23 aa, Cryptosporidium hominis
TIQLDFQLPIRFNLQYRTDENIS

SEQ ID NO: 2198081 - protein, 22 aa, Cryptosporidium hominis
TIRGHCKLFGKLKIVLLEGRYF

SEQ ID NO: 2198082 - protein, 21 aa, Cryptosporidium hominis
TIRSYWRNYFESTDGIIWVVD

SEQ ID NO: 2198083 - protein, 24 aa, Cryptosporidium hominis
TISEFLKYYIAGLSSNKFKENRFE

SEQ ID NO: 2198084 - protein, 19 aa, Cryptosporidium hominis
TISKLKSLRFATEAAITLL

SEQ ID NO: 2198085 - protein, 27 aa, Cryptosporidium hominis
TISKRQQFIFWWYITSNNAHYNFEFVS

SEQ ID NO: 2198086 - protein, 17 aa, Cryptosporidium hominis
TISPFWKSERYSIDYSL

SEQ ID NO: 2198087 - protein, 22 aa, Cryptosporidium hominis
TISQIPIYQLLDSKFFSSTSQL

SEQ ID NO: 2198088 - protein, 27 aa, Cryptosporidium hominis
TISQKYALRYLSYFTKASPLSTTVNIS

SEQ ID NO: 2198089 - protein, 24 aa, Cryptosporidium hominis
TISSSSFLYWLVNNCLKFETRKIV

SEQ ID NO: 2198090 - protein, 29 aa, Cryptosporidium hominis
TITNLLPPNGVWINLGPLLYHYSGLNNVI

SEQ ID NO: 2198091 - protein, 19 aa, Cryptosporidium hominis
TITSSPRLLCPEDYILQYS

SEQ ID NO: 2198092 - protein, 46 aa, Cryptosporidium hominis
TIVGFVQPRFADYASYYFPDGTPSWFPPLYVEALKHLKDLIPPSRL

SEQ ID NO: 2198093 - protein, 18 aa, Cryptosporidium hominis
TIVLIFQAPENFKFDVDR

SEQ ID NO: 2198094 - protein, 27 aa, Cryptosporidium hominis
TIVLSFVTYIPIDHLILASGNEIFQQK

SEQ ID NO: 2198095 - protein, 17 aa, Cryptosporidium hominis
TIVQINDLFYNMPSRQR

SEQ ID NO: 2198096 - protein, 20 aa, Cryptosporidium hominis
TIVRFRSQIPVDAKLIQGVP

SEQ ID NO: 2198097 - protein, 17 aa, Cryptosporidium hominis
TIWLSFTSNMISSGLRE

SEQ ID NO: 2198098 - protein, 33 aa, Cryptosporidium hominis
TIYRGKFIMEYIKLSILYLRILSKSIALRVVSA

SEQ ID NO: 2198099 - protein, 19 aa, Cryptosporidium hominis
TIYSSIMNALYPLISINRT

SEQ ID NO: 2198100 - protein, 31 aa, Cryptosporidium hominis
TKAFQQVKLIQHFQYLLATNPDLVCYGLKST

SEQ ID NO: 2198101 - protein, 22 aa, Cryptosporidium hominis
TKAFRFIEISVLTSSLGFESNF

SEQ ID NO: 2198102 - protein, 20 aa, Cryptosporidium hominis
TKCCSKCIFEGEKETLQCYD

SEQ ID NO: 2198103 - protein, 43 aa, Cryptosporidium hominis
TKDDSLRLLKLQRWFYELFHDFPFFSISPYTKTLKYLSNSSEN

SEQ ID NO: 2198104 - protein, 25 aa, Cryptosporidium hominis
TKDERDLHSFLKPISRFQTEEEQEK

SEQ ID NO: 2198105 - protein, 39 aa, Cryptosporidium hominis
TKDLKFLVSIHNLFFFKNIILETSSKFFTLFFGDFISPD

SEQ ID NO: 2198106 - protein, 23 aa, Cryptosporidium hominis
TKDPLETFIFHREPILSVDWHHQ

SEQ ID NO: 2198107 - protein, 35 aa, Cryptosporidium hominis
TKDVNPMFPKWCKSRLFAWPVDKWLEIIRKTFNRD

SEQ ID NO: 2198108 - protein, 20 aa, Cryptosporidium hominis
TKECSLYPNCNRYYCPFSHG

SEQ ID NO: 2198109 - protein, 25 aa, Cryptosporidium hominis
TKEEQMYHVLVYKTQLCREYPLCTK

SEQ ID NO: 2198110 - protein, 18 aa, Cryptosporidium hominis
TKEFLRRVFDPVFGFPNI

SEQ ID NO: 2198111 - protein, 23 aa, Cryptosporidium hominis
TKEMEQLLALDDFKKLIGLLERA

SEQ ID NO: 2198112 - protein, 27 aa, Cryptosporidium hominis
TKEMQYQICLLLKALGIPWIDSPGEAE

SEQ ID NO: 2198113 - protein, 26 aa, Cryptosporidium hominis
TKENCKYVCYLSIKYSLINAINSIQN

SEQ ID NO: 2198114 - protein, 26 aa, Cryptosporidium hominis
TKERTFYLDHIFPMDTNQSYVYKTAA

SEQ ID NO: 2198115 - protein, 32 aa, Cryptosporidium hominis
TKGIDMWSLGCILGEILCGKPIFPGSSTMNQL

SEQ ID NO: 2198116 - protein, 32 aa, Cryptosporidium hominis
TKISDSLRFPVPIKKLLFALELVQHKFKNSST

SEQ ID NO: 2198117 - protein, 24 aa, Cryptosporidium hominis
TKISPPCWLFSHENIRTYNQWNVF

SEQ ID NO: 2198118 - protein, 31 aa, Cryptosporidium hominis
TKIYCLIQRKMWNQALFLIKSLEKDEIELPF

SEQ ID NO: 2198119 - protein, 24 aa, Cryptosporidium hominis
TKKKGLLGLFNDKLSKSAPELGSQ

SEQ ID NO: 2198120 - protein, 35 aa, Cryptosporidium hominis
TKKNSLFEYKNFPIYTLLALRTISSEFKNLDTSFS

SEQ ID NO: 2198121 - protein, 24 aa, Cryptosporidium hominis
TKKPPKFIPFVNKESERKQLNEQV

SEQ ID NO: 2198122 - protein, 25 aa, Cryptosporidium hominis
TKLTELQDLFKSCGSINRITIMNDK

SEQ ID NO: 2198123 - protein, 19 aa, Cryptosporidium hominis
TKLVIRKYSLIGPNVILTC

SEQ ID NO: 2198124 - protein, 27 aa, Cryptosporidium hominis
TKNRKRNIDYSLLSRKGPVSSPDKSFE

SEQ ID NO: 2198125 - protein, 25 aa, Cryptosporidium hominis
TKRILLSIYPFYDCQMVKRLVIKYL

SEQ ID NO: 2198126 - protein, 24 aa, Cryptosporidium hominis
TKRLGIKLLKLLKLLLEFTKEYGY

SEQ ID NO: 2198127 - protein, 28 aa, Cryptosporidium hominis
TKRLLTECFVPYLASFLELEKESLLKKV

SEQ ID NO: 2198128 - protein, 24 aa, Cryptosporidium hominis
TKRTKLMKLLKKLILKEKNKDLRR

SEQ ID NO: 2198129 - protein, 23 aa, Cryptosporidium hominis
TKSFYLNNILAWNLMHFKIRQII

SEQ ID NO: 2198130 - protein, 17 aa, Cryptosporidium hominis
TKSRPFEYLRLTSLGVI

SEQ ID NO: 2198131 - protein, 30 aa, Cryptosporidium hominis
TKTIENISKLKPIFAKLAPPNIVKGIQGGG

SEQ ID NO: 2198132 - protein, 20 aa, Cryptosporidium hominis
TKTLIIYQYPSQLLSLSGYQ

SEQ ID NO: 2198133 - protein, 23 aa, Cryptosporidium hominis
TKTSTYPILRILSDRIHRVESKI

SEQ ID NO: 2198134 - protein, 24 aa, Cryptosporidium hominis
TKVNQLLTGYISKENDESSVSSQD

SEQ ID NO: 2198135 - protein, 19 aa, Cryptosporidium hominis
TKVWTRFRGLRNTLNGFPG

SEQ ID NO: 2198136 - protein, 17 aa, Cryptosporidium hominis
TLCCKLAYFKTIDDFEE

SEQ ID NO: 2198137 - protein, 21 aa, Cryptosporidium hominis
TLCHVPMCRLCRPSHTHADEK

SEQ ID NO: 2198138 - protein, 18 aa, Cryptosporidium hominis
TLCIPFSGAIRDILRQFH

SEQ ID NO: 2198139 - protein, 18 aa, Cryptosporidium hominis
TLCNITSFLYKQLNNRLL

SEQ ID NO: 2198140 - protein, 20 aa, Cryptosporidium hominis
TLDEWPENDFRLFCGDLGND

SEQ ID NO: 2198141 - protein, 41 aa, Cryptosporidium hominis
TLDFTQPFFMLLSFIPKLSYDILLAHVPGCTSEFCLACELV

SEQ ID NO: 2198142 - protein, 29 aa, Cryptosporidium hominis
TLDNWFCELKRWCPSLRVVKLHGDRQLRD

SEQ ID NO: 2198143 - protein, 30 aa, Cryptosporidium hominis
TLDPALLRPGRLDRKIEFPLPDRRQRRLIF

SEQ ID NO: 2198144 - protein, 24 aa, Cryptosporidium hominis
TLDSMFLLVAMFLRSSTKSVEIEV

SEQ ID NO: 2198145 - protein, 26 aa, Cryptosporidium hominis
TLEDEELWPLSSLKSLCEYVGISVKG

SEQ ID NO: 2198146 - protein, 24 aa, Cryptosporidium hominis
TLEGMRIWLRCNMGHKLIYAMKDI

SEQ ID NO: 2198147 - protein, 32 aa, Cryptosporidium hominis
TLEHQTWMNSNPDLWLSWLLMSRNNSKEDDTS

SEQ ID NO: 2198148 - protein, 24 aa, Cryptosporidium hominis
TLEKAYRICFNLYFQEIYDFQLSL

SEQ ID NO: 2198149 - protein, 18 aa, Cryptosporidium hominis
TLEQTLFTDPPWGKIGRA

SEQ ID NO: 2198150 - protein, 28 aa, Cryptosporidium hominis
TLFEEEEFVYFLSRIPNLSKRLECMILR

SEQ ID NO: 2198151 - protein, 31 aa, Cryptosporidium hominis
TLFESDLYLPILGQLYPLLSKAKSISVIQTF

SEQ ID NO: 2198152 - protein, 17 aa, Cryptosporidium hominis
TLGCHISCSKHIFGGLF

SEQ ID NO: 2198153 - protein, 25 aa, Cryptosporidium hominis
TLGDHLKVMFPKDRTLPWDTNGRYN

SEQ ID NO: 2198154 - protein, 20 aa, Cryptosporidium hominis
TLGLQIITSMKNKLTKMILS

SEQ ID NO: 2198155 - protein, 23 aa, Cryptosporidium hominis
TLIRLGELVTLRESNDRLRRELI

SEQ ID NO: 2198156 - protein, 19 aa, Cryptosporidium hominis
TLKDVRYFENGPNGAPGPA

SEQ ID NO: 2198157 - protein, 19 aa, Cryptosporidium hominis
TLKFHLYILNPRNTLEGLR

SEQ ID NO: 2198158 - protein, 26 aa, Cryptosporidium hominis
TLKQVAVRICTLLKVWRISTQTDIAD

SEQ ID NO: 2198159 - protein, 20 aa, Cryptosporidium hominis
TLKRILLEGDGRHFTGKVSE

SEQ ID NO: 2198160 - protein, 32 aa, Cryptosporidium hominis
TLKSESNFKVIYKILCLILSMLETNQNTKKSL

SEQ ID NO: 2198161 - protein, 22 aa, Cryptosporidium hominis
TLLGVPMSITVLPPIQIQKSEQ

SEQ ID NO: 2198162 - protein, 30 aa, Cryptosporidium hominis
TLLKTFEEINFYFNQVFRELIPNGDAKLIL

SEQ ID NO: 2198163 - protein, 23 aa, Cryptosporidium hominis
TLLNLESIPVPLAYQQIKKLEWD

SEQ ID NO: 2198164 - protein, 21 aa, Cryptosporidium hominis
TLLSNEWYLNYVKTVDGGIVE

SEQ ID NO: 2198165 - protein, 34 aa, Cryptosporidium hominis
TLNESFLVSISELRYIVLICIRWRLQNSSELSSN

SEQ ID NO: 2198166 - protein, 29 aa, Cryptosporidium hominis
TLNFRKRDWYSLIAVFLTGAEWQLQSFPF

SEQ ID NO: 2198167 - protein, 22 aa, Cryptosporidium hominis
TLNGLHVWSFNEAIFTSENDLV

SEQ ID NO: 2198168 - protein, 19 aa, Cryptosporidium hominis
TLNIPFKFTTLIEASGNSK

SEQ ID NO: 2198169 - protein, 20 aa, Cryptosporidium hominis
TLNLQLKFKETMRTKQLPTN

SEQ ID NO: 2198170 - protein, 28 aa, Cryptosporidium hominis
TLNQNLLVTYLFKLFQRNQIKVAIHFYE

SEQ ID NO: 2198171 - protein, 18 aa, Cryptosporidium hominis
TLNQSHLQFLFNLNNSSM

SEQ ID NO: 2198172 - protein, 32 aa, Cryptosporidium hominis
TLNSPTRALYLEVLQFIISQYDPRIKISKPDD

SEQ ID NO: 2198173 - protein, 17 aa, Cryptosporidium hominis
TLNVTFSELEPCNLETL

SEQ ID NO: 2198174 - protein, 18 aa, Cryptosporidium hominis
TLPEFEELKFDPGEIPLI

SEQ ID NO: 2198175 - protein, 29 aa, Cryptosporidium hominis
TLPIRQNPKPCLVMWEPIIDCPSDLSSGL

SEQ ID NO: 2198176 - protein, 25 aa, Cryptosporidium hominis
TLQNIFHLMPLYNQKINKRILMLQK

SEQ ID NO: 2198177 - protein, 25 aa, Cryptosporidium hominis
TLQSITILWTLLNQGFDGKPSVRKA

SEQ ID NO: 2198178 - protein, 28 aa, Cryptosporidium hominis
TLQVLLDSNPIIIVNKITGVIKLNSFNC

SEQ ID NO: 2198179 - protein, 17 aa, Cryptosporidium hominis
TLQVYLYSIEDGSFYVH

SEQ ID NO: 2198180 - protein, 33 aa, Cryptosporidium hominis
TLRDILNNPVIKLLVQLRTDCWVYYSPKNAQQN

SEQ ID NO: 2198181 - protein, 22 aa, Cryptosporidium hominis
TLRELELKGFRVTYLKVNNKGL

SEQ ID NO: 2198182 - protein, 24 aa, Cryptosporidium hominis
TLRKLDCALLGLTPPVPSALSCGN

SEQ ID NO: 2198183 - protein, 20 aa, Cryptosporidium hominis
TLSAVRRKGYPPQSLWDFCD

SEQ ID NO: 2198184 - protein, 25 aa, Cryptosporidium hominis
TLSNSRIFLNKFIKLLISSPMMNEL

SEQ ID NO: 2198185 - protein, 26 aa, Cryptosporidium hominis
TLSPNGVFWLARRLFRKPVNTLLPGT

SEQ ID NO: 2198186 - protein, 19 aa, Cryptosporidium hominis
TLSPPLIRFSELGRSRVHS

SEQ ID NO: 2198187 - protein, 42 aa, Cryptosporidium hominis
TLSRQHFRTVLYLILPKLTSVQLDWLYALAPKDLFGNVKYEQ

SEQ ID NO: 2198188 - protein, 23 aa, Cryptosporidium hominis
TLSSLVVPLFKKSGDVKSYVSEL

SEQ ID NO: 2198189 - protein, 23 aa, Cryptosporidium hominis
TLSTALGLDINFDSLINKNPMQV

SEQ ID NO: 2198190 - protein, 23 aa, Cryptosporidium hominis
TLTREVVTLWYRAPELLLGNKNY

SEQ ID NO: 2198191 - protein, 23 aa, Cryptosporidium hominis
TLVEDVFFLLHKTINRCISIGNI

SEQ ID NO: 2198192 - protein, 27 aa, Cryptosporidium hominis
TLVIHGHLVFLLPLMVSDANIVIPNLI

SEQ ID NO: 2198193 - protein, 24 aa, Cryptosporidium hominis
TLVPTPRCHFLVTSYTPITISQNI

SEQ ID NO: 2198194 - protein, 17 aa, Cryptosporidium hominis
TLWSIVIKTAYRKRRSK

SEQ ID NO: 2198195 - protein, 17 aa, Cryptosporidium hominis
TLWTVLVYLNTIPEEGG

SEQ ID NO: 2198196 - protein, 23 aa, Cryptosporidium hominis
TLYNSVHLFLFYVLTECDDKGYH

SEQ ID NO: 2198197 - protein, 19 aa, Cryptosporidium hominis
TLYSTISLQIKRINKYLLN

SEQ ID NO: 2198198 - protein, 22 aa, Cryptosporidium hominis
TMDFHVLVDILFREMVIMRDSG

SEQ ID NO: 2198199 - protein, 31 aa, Cryptosporidium hominis
TMHTFTDYNYGINLPSLRKPISLISRSPRNS

SEQ ID NO: 2198200 - protein, 27 aa, Cryptosporidium hominis
TMIDDIPDKFFPFPVQKQGATLLNYKD

SEQ ID NO: 2198201 - protein, 26 aa, Cryptosporidium hominis
TMKAQKLWFLILQAQIETGTPFICYK

SEQ ID NO: 2198202 - protein, 28 aa, Cryptosporidium hominis
TMLEFQQNLIRYFHGINSLVNIIESKKD

SEQ ID NO: 2198203 - protein, 18 aa, Cryptosporidium hominis
TMLSLPPFSKTERKKLPI

SEQ ID NO: 2198204 - protein, 21 aa, Cryptosporidium hominis
TMLYEIFNSVAVVSSVRICRD

SEQ ID NO: 2198205 - protein, 23 aa, Cryptosporidium hominis
TMPAPVTDIKFSPSGKLLAYSLS

SEQ ID NO: 2198206 - protein, 20 aa, Cryptosporidium hominis
TMQQIFIIWSIIQKTEIIED

SEQ ID NO: 2198207 - protein, 17 aa, Cryptosporidium hominis
TMRCAIKLYRQKQTLES

SEQ ID NO: 2198208 - protein, 26 aa, Cryptosporidium hominis
TMVSKKYIYFFFSNATPNSIFCFIEK

SEQ ID NO: 2198209 - protein, 26 aa, Cryptosporidium hominis
TNADSEWFSILLFHQNRKKGNFGGTL

SEQ ID NO: 2198210 - protein, 19 aa, Cryptosporidium hominis
TNASLRTHFSPYGEIVDSV

SEQ ID NO: 2198211 - protein, 26 aa, Cryptosporidium hominis
TNDKKRKFRRPFQRSPTNGAQKSSIG

SEQ ID NO: 2198212 - protein, 25 aa, Cryptosporidium hominis
TNDQSWIYYIRIVGESSGYQRKAVQ

SEQ ID NO: 2198213 - protein, 17 aa, Cryptosporidium hominis
TNDSRVRLFNLSDLSTF

SEQ ID NO: 2198214 - protein, 25 aa, Cryptosporidium hominis
TNELHKFSKYWLKKLGIPKEVPPSA

SEQ ID NO: 2198215 - protein, 24 aa, Cryptosporidium hominis
TNELYLYIQSIIYQLIKKGIWKKK

SEQ ID NO: 2198216 - protein, 26 aa, Cryptosporidium hominis
TNEQFVCIRFCRRIHQLYSNELSKPI

SEQ ID NO: 2198217 - protein, 25 aa, Cryptosporidium hominis
TNERQTMLFQILSGIILLGNIVFKN

SEQ ID NO: 2198218 - protein, 37 aa, Cryptosporidium hominis
TNFPQFQDFYYFIPHKVPTHKIYLAMNFFFPFENKKM

SEQ ID NO: 2198219 - protein, 18 aa, Cryptosporidium hominis
TNFRIKLLNLNFVDVLRP

SEQ ID NO: 2198220 - protein, 28 aa, Cryptosporidium hominis
TNGIITDWYDMEALWTYCFSEMKTSSED

SEQ ID NO: 2198221 - protein, 25 aa, Cryptosporidium hominis
TNGLKPYLGVLRYSLHDPFILWVLR

SEQ ID NO: 2198222 - protein, 26 aa, Cryptosporidium hominis
TNGTSQGKFALSPLNGTEVAPLFSKF

SEQ ID NO: 2198223 - protein, 22 aa, Cryptosporidium hominis
TNHNIIPLPMSSYGQFRKSRRD

SEQ ID NO: 2198224 - protein, 22 aa, Cryptosporidium hominis
TNIFERIWIFNFDLESEADEYI

SEQ ID NO: 2198225 - protein, 20 aa, Cryptosporidium hominis
TNIHPMGMPLPTMAGGPPPH

SEQ ID NO: 2198226 - protein, 29 aa, Cryptosporidium hominis
TNIIIPSNKLFNISYLLEFTKSSLNQTNI

SEQ ID NO: 2198227 - protein, 22 aa, Cryptosporidium hominis
TNIKKFILNELSYNSIYNVDEP

SEQ ID NO: 2198228 - protein, 25 aa, Cryptosporidium hominis
TNIPSYNPIVMIKALLVLKSIIKDE

SEQ ID NO: 2198229 - protein, 36 aa, Cryptosporidium hominis
TNKDNIQYIKPQMPPMFPAGYYHNVHYIGDESLGAI

SEQ ID NO: 2198230 - protein, 23 aa, Cryptosporidium hominis
TNKLPLFMEATLDGINKAINVNN

SEQ ID NO: 2198231 - protein, 26 aa, Cryptosporidium hominis
TNKNKKLLIIKKALEFIPNSIKLWKE

SEQ ID NO: 2198232 - protein, 33 aa, Cryptosporidium hominis
TNKSLDINYGYIKPIRYLNDGLPVYRLEDINLG

SEQ ID NO: 2198233 - protein, 29 aa, Cryptosporidium hominis
TNLEIVQDILLLSIIRGPLSSDFLSCTYQ

SEQ ID NO: 2198234 - protein, 32 aa, Cryptosporidium hominis
TNLISCYNINNVYPYILLISKDEEKEFKMNLC

SEQ ID NO: 2198235 - protein, 18 aa, Cryptosporidium hominis
TNLNLFRSNIKSCPVHTA

SEQ ID NO: 2198236 - protein, 28 aa, Cryptosporidium hominis
TNLNSKLIRLEDFPCIIFSQNCFPTSNN

SEQ ID NO: 2198237 - protein, 17 aa, Cryptosporidium hominis
TNLPIRYTNVPGSIIPN

SEQ ID NO: 2198238 - protein, 29 aa, Cryptosporidium hominis
TNMFTLSKWILIPFTKYAPWHRIEESRSE

SEQ ID NO: 2198239 - protein, 39 aa, Cryptosporidium hominis
TNMNKLDAYYKLLVLSYSKMFLAFISLKNDCELEDVHFH

SEQ ID NO: 2198240 - protein, 26 aa, Cryptosporidium hominis
TNNCKMVLLVLPATLISHWIEVFNKW

SEQ ID NO: 2198241 - protein, 22 aa, Cryptosporidium hominis
TNNFVMPVPSFNVLNGGKHAGN

SEQ ID NO: 2198242 - protein, 19 aa, Cryptosporidium hominis
TNNLFSTLSILITKDSKIK

SEQ ID NO: 2198243 - protein, 26 aa, Cryptosporidium hominis
TNNLLKYILMLLTQIIEKKLFKFEIS

SEQ ID NO: 2198244 - protein, 18 aa, Cryptosporidium hominis
TNNNIVFEVFARAILNGQ

SEQ ID NO: 2198245 - protein, 38 aa, Cryptosporidium hominis
TNNPISWFEFFIPISNPILLKKFDKLTFNIWRKSNKDR

SEQ ID NO: 2198246 - protein, 23 aa, Cryptosporidium hominis
TNNPYIQPIRYHVERIKDKDSPE

SEQ ID NO: 2198247 - protein, 25 aa, Cryptosporidium hominis
TNNRETILLPCRHACLCKICSNTLF

SEQ ID NO: 2198248 - protein, 23 aa, Cryptosporidium hominis
TNNVFRFKVIIAKNLEEAMITGL

SEQ ID NO: 2198249 - protein, 17 aa, Cryptosporidium hominis
TNQIWYSSPLRKPDYFE

SEQ ID NO: 2198250 - protein, 25 aa, Cryptosporidium hominis
TNRDGLIDWKEFCTFIVDYFNTSRE

SEQ ID NO: 2198251 - protein, 19 aa, Cryptosporidium hominis
TNRFSIFPPTAYAGRIRIV

SEQ ID NO: 2198252 - protein, 19 aa, Cryptosporidium hominis
TNRNLFNSNPQLIESKSRT

SEQ ID NO: 2198253 - protein, 24 aa, Cryptosporidium hominis
TNRRLIMYQPQDTEIWLPSYNRIE

SEQ ID NO: 2198254 - protein, 32 aa, Cryptosporidium hominis
TNSENQWIPLRISCGLLTGVVKLFCHKVEYLD

SEQ ID NO: 2198255 - protein, 22 aa, Cryptosporidium hominis
TNSGDLILWGYGGCGQLGFGNL

SEQ ID NO: 2198256 - protein, 24 aa, Cryptosporidium hominis
TNSIRILLDYFINSNDLIASINVI

SEQ ID NO: 2198257 - protein, 29 aa, Cryptosporidium hominis
TNSLLSISIRHKFLRLLEICDILNITSLD

SEQ ID NO: 2198258 - protein, 23 aa, Cryptosporidium hominis
TNSMLEVLLKMKNKFITENSKNQ

SEQ ID NO: 2198259 - protein, 23 aa, Cryptosporidium hominis
TNSSQFFITTIPCPWLDGRHVVF

SEQ ID NO: 2198260 - protein, 24 aa, Cryptosporidium hominis
TNSVPPPVFAAYYEGGDNENNNLF

SEQ ID NO: 2198261 - protein, 28 aa, Cryptosporidium hominis
TNTHIRKLLSECGTILRWSRQEDPTTKK

SEQ ID NO: 2198262 - protein, 29 aa, Cryptosporidium hominis
TNTNSNFQNMPIPYPPKAPLSDCNNSESE

SEQ ID NO: 2198263 - protein, 24 aa, Cryptosporidium hominis
TNVKLKVYLTLPFMGSNTIIEKNQ

SEQ ID NO: 2198264 - protein, 18 aa, Cryptosporidium hominis
TNYDIEFFRILNLTCTND

SEQ ID NO: 2198265 - protein, 19 aa, Cryptosporidium hominis
TNYMVLHRSLYEKYSFLRL

SEQ ID NO: 2198266 - protein, 17 aa, Cryptosporidium hominis
TNYRELSGLFSLPDLLL

SEQ ID NO: 2198267 - protein, 25 aa, Cryptosporidium hominis
TPATRRLFEFFLCKVGVGCSVVKND

SEQ ID NO: 2198268 - protein, 25 aa, Cryptosporidium hominis
TPFHSVCIPPIPIRAYLIRLAQNFG

SEQ ID NO: 2198269 - protein, 30 aa, Cryptosporidium hominis
TPFINIGNVPLLPWKTLCTDIVESWRLTKS

SEQ ID NO: 2198270 - protein, 18 aa, Cryptosporidium hominis
TPFVISEKTPRLTFEEGC

SEQ ID NO: 2198271 - protein, 22 aa, Cryptosporidium hominis
TPGITQLEWKLIEFFKRHNYRI

SEQ ID NO: 2198272 - protein, 17 aa, Cryptosporidium hominis
TPIFMPVATHGSIKGLS

SEQ ID NO: 2198273 - protein, 23 aa, Cryptosporidium hominis
TPIKLTYELLQFQKEGLAWLCNQ

SEQ ID NO: 2198274 - protein, 18 aa, Cryptosporidium hominis
TPIQSQVIPLLFSGVDLL

SEQ ID NO: 2198275 - protein, 28 aa, Cryptosporidium hominis
TPKELKLKLIDFLDKKLNWTEIETPWEW

SEQ ID NO: 2198276 - protein, 22 aa, Cryptosporidium hominis
TPKYGLLFQSTYIGKASQKNKG

SEQ ID NO: 2198277 - protein, 24 aa, Cryptosporidium hominis
TPLKNQWINIVTPLVEHMGLHVRM

SEQ ID NO: 2198278 - protein, 19 aa, Cryptosporidium hominis
TPLPKVFSISSLNTKHLIT

SEQ ID NO: 2198279 - protein, 23 aa, Cryptosporidium hominis
TPMGGFPRYGVVNQDFLMLKGCT

SEQ ID NO: 2198280 - protein, 32 aa, Cryptosporidium hominis
TPPASPVEFEWLLHLVLHSALSQLGPMVSHGV

SEQ ID NO: 2198281 - protein, 27 aa, Cryptosporidium hominis
TPPNVFREMIKWCKLKLNIPILEGTSK

SEQ ID NO: 2198282 - protein, 24 aa, Cryptosporidium hominis
TPQWRYISVCSVESKLRVCNACWM

SEQ ID NO: 2198283 - protein, 22 aa, Cryptosporidium hominis
TPRCLQKFQPLSNYLSLIKSDV

SEQ ID NO: 2198284 - protein, 23 aa, Cryptosporidium hominis
TPRTPECKARILCAFELVKIGDM

SEQ ID NO: 2198285 - protein, 22 aa, Cryptosporidium hominis
TPRYLWEKIKLSNNFLVAISQI

SEQ ID NO: 2198286 - protein, 21 aa, Cryptosporidium hominis
TPSHIMPLNVALANLLEDYSI

SEQ ID NO: 2198287 - protein, 25 aa, Cryptosporidium hominis
TPSKEYLVSNIFLYRSCISDSHRVE

SEQ ID NO: 2198288 - protein, 20 aa, Cryptosporidium hominis
TPTCRRVMYAAALTASPRLL

SEQ ID NO: 2198289 - protein, 22 aa, Cryptosporidium hominis
TPTVIKCFFHSYRDGISRLQCK

SEQ ID NO: 2198290 - protein, 28 aa, Cryptosporidium hominis
TQAALMAANPFFMFGAAAAAAAAAVGSS

SEQ ID NO: 2198291 - protein, 32 aa, Cryptosporidium hominis
TQASNLLKILSPSWILCIDIAAILLTNTDNKM

SEQ ID NO: 2198292 - protein, 24 aa, Cryptosporidium hominis
TQDGTCYILLKPFKNDKSLIENME

SEQ ID NO: 2198293 - protein, 26 aa, Cryptosporidium hominis
TQDKFQNFVLEEIAHIKNDIAKESQN

SEQ ID NO: 2198294 - protein, 32 aa, Cryptosporidium hominis
TQDVFKEWNIPPSISNWKNPMGYTVPLDKRVQ

SEQ ID NO: 2198295 - protein, 21 aa, Cryptosporidium hominis
TQDYRLRTVYKYKSIKSGMHS

SEQ ID NO: 2198296 - protein, 27 aa, Cryptosporidium hominis
TQEVFISKIFGYLLALGLSDGRVILYD

SEQ ID NO: 2198297 - protein, 31 aa, Cryptosporidium hominis
TQFVHIICSLYTPGIYRLACGQVYGAANYLG

SEQ ID NO: 2198298 - protein, 24 aa, Cryptosporidium hominis
TQIPIPIRDFTSSPRMIIIRSFDV

SEQ ID NO: 2198299 - protein, 25 aa, Cryptosporidium hominis
TQIPQYLFEAGYYKNGIIACTQPRR

SEQ ID NO: 2198300 - protein, 19 aa, Cryptosporidium hominis
TQIWAYENIDFLINTEKLS

SEQ ID NO: 2198301 - protein, 19 aa, Cryptosporidium hominis
TQKKIMLKPIFRLANHNIL

SEQ ID NO: 2198302 - protein, 26 aa, Cryptosporidium hominis
TQLIYGDGFPILKMMERALTLLSMRV

SEQ ID NO: 2198303 - protein, 34 aa, Cryptosporidium hominis
TQLKKSAWEYFDSLHSKLINLAGFHNPDECSICK

SEQ ID NO: 2198304 - protein, 30 aa, Cryptosporidium hominis
TQNYSTIKIPFNIPILGLPSITQWMNIIEN

SEQ ID NO: 2198305 - protein, 23 aa, Cryptosporidium hominis
TQPKRWMIMFSRAQSSSYRDSKD

SEQ ID NO: 2198306 - protein, 22 aa, Cryptosporidium hominis
TQQLYIQEILPKLLNVVLSCED

SEQ ID NO: 2198307 - protein, 23 aa, Cryptosporidium hominis
TQQPQVYFQTKNIPMFSEAMSSG

SEQ ID NO: 2198308 - protein, 25 aa, Cryptosporidium hominis
TQSCLHYIVESFLKPFKKSATRAIE

SEQ ID NO: 2198309 - protein, 21 aa, Cryptosporidium hominis
TQSIWQVSNLLKETVKDRVFG

SEQ ID NO: 2198310 - protein, 23 aa, Cryptosporidium hominis
TQTDLQIHPIKLPEPALETYTFD

SEQ ID NO: 2198311 - protein, 25 aa, Cryptosporidium hominis
TQVWGSYYDLEAKKWGFRCCKQTCR

SEQ ID NO: 2198312 - protein, 25 aa, Cryptosporidium hominis
TQWEVPPEFLSFRPNFSREVVGPPG

SEQ ID NO: 2198313 - protein, 28 aa, Cryptosporidium hominis
TRCQYSHNIYWPRRCPFYLSNQSTIRYI

SEQ ID NO: 2198314 - protein, 18 aa, Cryptosporidium hominis
TRDFFWPYTTVASGNYLS

SEQ ID NO: 2198315 - protein, 27 aa, Cryptosporidium hominis
TRDPTTAMKWFPLVKYNGFTGVGSVDN

SEQ ID NO: 2198316 - protein, 17 aa, Cryptosporidium hominis
TREHALLAFTLGVRQMI

SEQ ID NO: 2198317 - protein, 24 aa, Cryptosporidium hominis
TREKGLRKIFLKMAKYGMDNTSIL

SEQ ID NO: 2198318 - protein, 29 aa, Cryptosporidium hominis
TRELNSLEIHFLRLVRFQLFVTEHEYEIY

SEQ ID NO: 2198319 - protein, 23 aa, Cryptosporidium hominis
TRFHFGCHCGNPIVLNHFCQGNV

SEQ ID NO: 2198320 - protein, 19 aa, Cryptosporidium hominis
TRFSLVKRFNQNQSIFLFI

SEQ ID NO: 2198321 - protein, 18 aa, Cryptosporidium hominis
TRFVSYGNFIKWGSRADL

SEQ ID NO: 2198322 - protein, 21 aa, Cryptosporidium hominis
TRGALKFIFKAPSPDFTKIPP

SEQ ID NO: 2198323 - protein, 23 aa, Cryptosporidium hominis
TRGDEFNAFLILEKTQESDYSKN

SEQ ID NO: 2198324 - protein, 25 aa, Cryptosporidium hominis
TRGINMKRIFKLTQSKLRLRGKGSG

SEQ ID NO: 2198325 - protein, 29 aa, Cryptosporidium hominis
TRGRIWCPKGFNVIFPPKALEKYEFGEEI

SEQ ID NO: 2198326 - protein, 20 aa, Cryptosporidium hominis
TRIEGPLTFVKHIEASCYIQ

SEQ ID NO: 2198327 - protein, 23 aa, Cryptosporidium hominis
TRIEKYQHFISAIDPIFTELSNS

SEQ ID NO: 2198328 - protein, 21 aa, Cryptosporidium hominis
TRILRFIFELIQLSTFGVSER

SEQ ID NO: 2198329 - protein, 25 aa, Cryptosporidium hominis
TRKIPIQFHIINRYLKNWYNESEST

SEQ ID NO: 2198330 - protein, 24 aa, Cryptosporidium hominis
TRKRYRFDIVITTPSILNSQVDCD

SEQ ID NO: 2198331 - protein, 20 aa, Cryptosporidium hominis
TRKVPPSWTLKILGSIIQGD

SEQ ID NO: 2198332 - protein, 17 aa, Cryptosporidium hominis
TRLRRAEHQSGVPGVYW

SEQ ID NO: 2198333 - protein, 28 aa, Cryptosporidium hominis
TRQQIKNFFIVLFHNMDLQLSELRYGIS

SEQ ID NO: 2198334 - protein, 26 aa, Cryptosporidium hominis
TRQRSILEYVIVLSLELLFCDPYEAK

SEQ ID NO: 2198335 - protein, 21 aa, Cryptosporidium hominis
TRQTMLFSATLSRSVTDLALL

SEQ ID NO: 2198336 - protein, 30 aa, Cryptosporidium hominis
TRRDKFGIRNLLPAFGHIRDYFNVNKNGSN

SEQ ID NO: 2198337 - protein, 25 aa, Cryptosporidium hominis
TRRFRRLYFGNLPINLGLTESSFQQ

SEQ ID NO: 2198338 - protein, 17 aa, Cryptosporidium hominis
TRTLWTVLVYLNTIPEE

SEQ ID NO: 2198339 - protein, 24 aa, Cryptosporidium hominis
TRTRKWIRSLRPAGVNLKDFEPSL

SEQ ID NO: 2198340 - protein, 23 aa, Cryptosporidium hominis
TRTSRLSYSSTPISSLMAANDAE

SEQ ID NO: 2198341 - protein, 25 aa, Cryptosporidium hominis
TRVIYKILTDKFWPGPLTVISKKRR

SEQ ID NO: 2198342 - protein, 25 aa, Cryptosporidium hominis
TRWKCPLCYQIIRPSMLKLDSFVKM

SEQ ID NO: 2198343 - protein, 20 aa, Cryptosporidium hominis
TRWNMDPTLNLFLEKGLEII

SEQ ID NO: 2198344 - protein, 25 aa, Cryptosporidium hominis
TRYRLAMYFYEFLKSIKMLTEKGNG

SEQ ID NO: 2198345 - protein, 25 aa, Cryptosporidium hominis
TRYSQVFLKEIRKRLDSYFSIVVRN

SEQ ID NO: 2198346 - protein, 24 aa, Cryptosporidium hominis
TSAVDFVFWSDRLIRLVVENALGH

SEQ ID NO: 2198347 - protein, 26 aa, Cryptosporidium hominis
TSAYKSNRIYIFSKRLPLLDNGDVNL

SEQ ID NO: 2198348 - protein, 21 aa, Cryptosporidium hominis
TSCPEPYYPKIFGFRVSDKLS

SEQ ID NO: 2198349 - protein, 20 aa, Cryptosporidium hominis
TSCSLIWEGVRPSRIFFKWK

SEQ ID NO: 2198350 - protein, 19 aa, Cryptosporidium hominis
TSDHVFLGPKLDDGHVFFA

SEQ ID NO: 2198351 - protein, 24 aa, Cryptosporidium hominis
TSESKASLRKFLESTIMDSGEDSI

SEQ ID NO: 2198352 - protein, 29 aa, Cryptosporidium hominis
TSFISSICIPYFQALLKFDPEIVQECIQN

SEQ ID NO: 2198353 - protein, 18 aa, Cryptosporidium hominis
TSFPHIFLQVYPEYISTS

SEQ ID NO: 2198354 - protein, 26 aa, Cryptosporidium hominis
TSGTFLRLKPFSYPVRVLPGMVLKVG

SEQ ID NO: 2198355 - protein, 23 aa, Cryptosporidium hominis
TSHGAFLFCIDTLGNSYSGSSTH

SEQ ID NO: 2198356 - protein, 26 aa, Cryptosporidium hominis
TSHIYKACVIVWLLSFNEETVPILVS

SEQ ID NO: 2198357 - protein, 26 aa, Cryptosporidium hominis
TSHRVYEISILLLIGKKVKEKNFVSA

SEQ ID NO: 2198358 - protein, 19 aa, Cryptosporidium hominis
TSIQHYMQSPLSYTSNRIP

SEQ ID NO: 2198359 - protein, 19 aa, Cryptosporidium hominis
TSITLLRDGPGGANLFIYG

SEQ ID NO: 2198360 - protein, 27 aa, Cryptosporidium hominis
TSKGEIYRWGLYDLKSPIVFKPKLETF

SEQ ID NO: 2198361 - protein, 17 aa, Cryptosporidium hominis
TSKLICYNKWCVSGTPI

SEQ ID NO: 2198362 - protein, 23 aa, Cryptosporidium hominis
TSKPKLIHFKDKNIFKLESCPNK

SEQ ID NO: 2198363 - protein, 32 aa, Cryptosporidium hominis
TSKSSPRVKPPLKPKPKFLAPPKNPKVSHLSP

SEQ ID NO: 2198364 - protein, 26 aa, Cryptosporidium hominis
TSLKTGYLYVYRFSNGMPIICKDTEY

SEQ ID NO: 2198365 - protein, 17 aa, Cryptosporidium hominis
TSLMIVLQGVHFLLRRW

SEQ ID NO: 2198366 - protein, 45 aa, Cryptosporidium hominis
TSMQSPNIMFLIVLDSSLPWTLNDDLVIWIQQIQECWAKSLELSN

SEQ ID NO: 2198367 - protein, 23 aa, Cryptosporidium hominis
TSNQFILVAKDPMPRWLTSACEV

SEQ ID NO: 2198368 - protein, 21 aa, Cryptosporidium hominis
TSNYILKYLNLYLSIAGKEEM

SEQ ID NO: 2198369 - protein, 27 aa, Cryptosporidium hominis
TSPANLGGLLGFPNFMANLSAPKVSGF

SEQ ID NO: 2198370 - protein, 24 aa, Cryptosporidium hominis
TSPDYPVRCAFSLLNEYLKTYIDS

SEQ ID NO: 2198371 - protein, 22 aa, Cryptosporidium hominis
TSPQPLAFICNVNIVDLSSSET

SEQ ID NO: 2198372 - protein, 17 aa, Cryptosporidium hominis
TSPRNLEFLPNINRLSN

SEQ ID NO: 2198373 - protein, 34 aa, Cryptosporidium hominis
TSQACYFDTTDNTMTFVYQAPTKTETTTTMTETF

SEQ ID NO: 2198374 - protein, 24 aa, Cryptosporidium hominis
TSQDQFIGLIFPKLGQPLMNFTQN

SEQ ID NO: 2198375 - protein, 24 aa, Cryptosporidium hominis
TSQLNNVLSLPIPKDLITYSSDTR

SEQ ID NO: 2198376 - protein, 37 aa, Cryptosporidium hominis
TSQNGFIRLWDLRFAQQPFLYMNSNLTDWEFVQETNS

SEQ ID NO: 2198377 - protein, 24 aa, Cryptosporidium hominis
TSQPLFVSCGWDKIVKVWSHEFKP

SEQ ID NO: 2198378 - protein, 27 aa, Cryptosporidium hominis
TSQRELFKQYVVPIVDEVLLGFNCTIF

SEQ ID NO: 2198379 - protein, 19 aa, Cryptosporidium hominis
TSRFFIDSGLFKKIGGKNK

SEQ ID NO: 2198380 - protein, 25 aa, Cryptosporidium hominis
TSRMLQITINYFKKKLPKNQQKNLD

SEQ ID NO: 2198381 - protein, 20 aa, Cryptosporidium hominis
TSRNIISHPYYIQKQPNTSK

SEQ ID NO: 2198382 - protein, 24 aa, Cryptosporidium hominis
TSRYTFYMPVFFGLTLSEIQVSSA

SEQ ID NO: 2198383 - protein, 29 aa, Cryptosporidium hominis
TSSFQDKILRLLLPLFDTGSRDKYDQENI

SEQ ID NO: 2198384 - protein, 20 aa, Cryptosporidium hominis
TSSKIYYISKHGIPVSLIHW

SEQ ID NO: 2198385 - protein, 24 aa, Cryptosporidium hominis
TSSSNLLALNPKTGILNNIIVNGA

SEQ ID NO: 2198386 - protein, 26 aa, Cryptosporidium hominis
TSSSVYFEWSCTDCPLYMPKMCNCGT

SEQ ID NO: 2198387 - protein, 34 aa, Cryptosporidium hominis
TSTLDVSLFYDKRLRSWIFGDLENIGYNTEESIY

SEQ ID NO: 2198388 - protein, 34 aa, Cryptosporidium hominis
TSTLIPLDPRIVMRILFNFRKLHPVSYKTRIIKD

SEQ ID NO: 2198389 - protein, 28 aa, Cryptosporidium hominis
TSTQPFFRLDWKVLYDNIKEMPILERHS

SEQ ID NO: 2198390 - protein, 27 aa, Cryptosporidium hominis
TSTRPDLYHYIYICTVVNKNVPEIGNS

SEQ ID NO: 2198391 - protein, 24 aa, Cryptosporidium hominis
TSVELAQLIMIRYLLEIEDKHSDH

SEQ ID NO: 2198392 - protein, 22 aa, Cryptosporidium hominis
TSVIIACKDVWILNPENSKTLE

SEQ ID NO: 2198393 - protein, 20 aa, Cryptosporidium hominis
TSVLAPKLGPLGMSPKKVGD

SEQ ID NO: 2198394 - protein, 21 aa, Cryptosporidium hominis
TSVVLLAAELLRRGTSLVSNG

SEQ ID NO: 2198395 - protein, 18 aa, Cryptosporidium hominis
TSYTDLVLALKYKKKHLN

SEQ ID NO: 2198396 - protein, 28 aa, Cryptosporidium hominis
TTCPKFILKSFYTVTKFLLCQNDRSIRY

SEQ ID NO: 2198397 - protein, 17 aa, Cryptosporidium hominis
TTDLACPMSLEEEVKMH

SEQ ID NO: 2198398 - protein, 23 aa, Cryptosporidium hominis
TTEKSYKGTVTRETYSVDGKQTS

SEQ ID NO: 2198399 - protein, 22 aa, Cryptosporidium hominis
TTEWQVFDTDKWCKIPISDPPS

SEQ ID NO: 2198400 - protein, 19 aa, Cryptosporidium hominis
TTFKWHPKKPALKSFISNL

SEQ ID NO: 2198401 - protein, 23 aa, Cryptosporidium hominis
TTFTTLPLVAVPTPRKASEKEKL

SEQ ID NO: 2198402 - protein, 19 aa, Cryptosporidium hominis
TTGLPIHCFSKVATPQPPA

SEQ ID NO: 2198403 - protein, 20 aa, Cryptosporidium hominis
TTIFFFITLMFNSGSKLPQL

SEQ ID NO: 2198404 - protein, 23 aa, Cryptosporidium hominis
TTIPIIYSKQHKERLVLLEFQGS

SEQ ID NO: 2198405 - protein, 30 aa, Cryptosporidium hominis
TTKDITANLKRYLIKLFPTEITQEHYKKDK

SEQ ID NO: 2198406 - protein, 29 aa, Cryptosporidium hominis
TTKEIVDFYYCIWKRTSRYKAWKSNRQLS

SEQ ID NO: 2198407 - protein, 21 aa, Cryptosporidium hominis
TTKFDGSLFGGGAKFARQGTN

SEQ ID NO: 2198408 - protein, 29 aa, Cryptosporidium hominis
TTKKVAIRSIFEELIWFIKGDTNGNHLIE

SEQ ID NO: 2198409 - protein, 33 aa, Cryptosporidium hominis
TTKTESSFLRKYWWLIAIGFITYSVLTTDQSLT

SEQ ID NO: 2198410 - protein, 31 aa, Cryptosporidium hominis
TTLEKKKILQSHYLYSIIVGFEKSISYWKLQ

SEQ ID NO: 2198411 - protein, 27 aa, Cryptosporidium hominis
TTLGHLLFDFLELFGIVFNYSSTGIRL

SEQ ID NO: 2198412 - protein, 18 aa, Cryptosporidium hominis
TTLKYLIRVVDSLSLEEF

SEQ ID NO: 2198413 - protein, 23 aa, Cryptosporidium hominis
TTLQSMIVIIPILLKEDTEKSCS

SEQ ID NO: 2198414 - protein, 19 aa, Cryptosporidium hominis
TTMDQFVLTFALNCVVSHQ

SEQ ID NO: 2198415 - protein, 25 aa, Cryptosporidium hominis
TTNELELLLDKLKFLLDLQLNRHNE

SEQ ID NO: 2198416 - protein, 26 aa, Cryptosporidium hominis
TTPHRPPTCLFLLILPIPPLLRSRPS

SEQ ID NO: 2198417 - protein, 17 aa, Cryptosporidium hominis
TTPTPDMISMNPTPIIS

SEQ ID NO: 2198418 - protein, 17 aa, Cryptosporidium hominis
TTQFFNSKLKFPAIRKL

SEQ ID NO: 2198419 - protein, 20 aa, Cryptosporidium hominis
TTRNLSISTTTIRVVSVDSD

SEQ ID NO: 2198420 - protein, 24 aa, Cryptosporidium hominis
TTRSGRFVSLKYGYDDILMSDDDA

SEQ ID NO: 2198421 - protein, 21 aa, Cryptosporidium hominis
TTRVIRRNSPYLRAPRMYSIS

SEQ ID NO: 2198422 - protein, 41 aa, Cryptosporidium hominis
TTSKIFRNKIKRFLLPKLLQFRPNIIFISAGFDGHVIDIVG

SEQ ID NO: 2198423 - protein, 24 aa, Cryptosporidium hominis
TTTIDSFLRLSSMDSTICTTIQND

SEQ ID NO: 2198424 - protein, 27 aa, Cryptosporidium hominis
TTTRGTNLLTFKFDYIFSSVSTQHEVF

SEQ ID NO: 2198425 - protein, 21 aa, Cryptosporidium hominis
TTVDQVFQDCSKMTTTTTVPS

SEQ ID NO: 2198426 - protein, 26 aa, Cryptosporidium hominis
TTVQTKLYLRIYSQPQEFWSDVQQIF

SEQ ID NO: 2198427 - protein, 23 aa, Cryptosporidium hominis
TTYPGSHIYSLFASSGFGIDNFQ

SEQ ID NO: 2198428 - protein, 25 aa, Cryptosporidium hominis
TVAISNHIYIFKKKSIFWNCVETIA

SEQ ID NO: 2198429 - protein, 17 aa, Cryptosporidium hominis
TVARKQLRQFTGLEGTD

SEQ ID NO: 2198430 - protein, 26 aa, Cryptosporidium hominis
TVAYGTGFNLLPKPTPGVKASPHTTV

SEQ ID NO: 2198431 - protein, 23 aa, Cryptosporidium hominis
TVDDWYVFDKQLSEIQYRNSVKR

SEQ ID NO: 2198432 - protein, 21 aa, Cryptosporidium hominis
TVENWLPKRLGGGLGKVRGQE

SEQ ID NO: 2198433 - protein, 18 aa, Cryptosporidium hominis
TVEYVLINNMPDLLYLDK

SEQ ID NO: 2198434 - protein, 30 aa, Cryptosporidium hominis; identical to SEQ ID NO: 2183082

SEQ ID NO: 2198435 - protein, 25 aa, Cryptosporidium hominis
TVGFEIPYFTISGLTIRYLKITEKS

SEQ ID NO: 2198436 - protein, 41 aa, Cryptosporidium hominis
TVGIKMQLIYSLLCKSEFQSLTQLIFHLLSEKPVGLVNKTD

SEQ ID NO: 2198437 - protein, 24 aa, Cryptosporidium hominis
TVGNLPFRRLCLKFGADVTVSEMV

SEQ ID NO: 2198438 - protein, 34 aa, Cryptosporidium hominis
TVHPRDNPWYKGCNKLILLGIPSSLRPHDLKEII

SEQ ID NO: 2198439 - protein, 24 aa, Cryptosporidium hominis
TVHRESFFNFFKSLNVPSDEELAK

SEQ ID NO: 2198440 - protein, 19 aa, Cryptosporidium hominis
TVIGRFNPKFNAITGLNGS

SEQ ID NO: 2198441 - protein, 27 aa, Cryptosporidium hominis
TVKEVQLKFYRILLNILTRCKIQNNQI

SEQ ID NO: 2198442 - protein, 24 aa, Cryptosporidium hominis
TVKLNIEYPPYWYCLKIPKKEENE

SEQ ID NO: 2198443 - protein, 20 aa, Cryptosporidium hominis
TVLARAIFKSGCEKVDAGLN

SEQ ID NO: 2198444 - protein, 30 aa, Cryptosporidium hominis
TVLEESHVDFLFGLDLLKRYQCCIDLHQNA

SEQ ID NO: 2198445 - protein, 18 aa, Cryptosporidium hominis
TVLNFWAMLPSVVTTCHV

SEQ ID NO: 2198446 - protein, 25 aa, Cryptosporidium hominis
TVLRFPISISMYSLLLFASDSLQLN

SEQ ID NO: 2198447 - protein, 21 aa, Cryptosporidium hominis
TVLSKRKLTWIVNNGLVEGWY

SEQ ID NO: 2198448 - protein, 22 aa, Cryptosporidium hominis
TVNDPFERALLLISLKSSMTRD

SEQ ID NO: 2198449 - protein, 17 aa, Cryptosporidium hominis
TVNIIKRLLCRVPEVRM

SEQ ID NO: 2198450 - protein, 18 aa, Cryptosporidium hominis
TVNLLKIPQLLDFSLRLL

SEQ ID NO: 2198451 - protein, 30 aa, Cryptosporidium hominis
TVNSLLSYPIKISGLFWGIGSMKLLFNNLQ

SEQ ID NO: 2198452 - protein, 17 aa, Cryptosporidium hominis
TVPIYEGYALPHAIMRL

SEQ ID NO: 2198453 - protein, 19 aa, Cryptosporidium hominis
TVREIRKLVYPHLDKFQRQ

SEQ ID NO: 2198454 - protein, 24 aa, Cryptosporidium hominis
TVRGIVRRGLSPSALLQFVTEQGP

SEQ ID NO: 2198455 - protein, 25 aa, Cryptosporidium hominis
TVSSLCNCVTYFSGSTRSTGPNFHY

SEQ ID NO: 2198456 - protein, 23 aa, Cryptosporidium hominis
TVTFEFLRRFYIATNVQIQIMDN

SEQ ID NO: 2198457 - protein, 20 aa, Cryptosporidium hominis
TVTQNPLRIAMFSWESLYTH

SEQ ID NO: 2198458 - protein, 25 aa, Cryptosporidium hominis
TVVSKPGWGAVRWADLSISDASNSW

SEQ ID NO: 2198459 - protein, 26 aa, Cryptosporidium hominis
TVYNGPLKLEHLLPSGLTKRDLEILR

SEQ ID NO: 2198460 - protein, 24 aa, Cryptosporidium hominis
TWDRYEMRIYKRVIDLYSSSDVVK

SEQ ID NO: 2198461 - protein, 18 aa, Cryptosporidium hominis
TWFHGNLYIKSGWIPENM

SEQ ID NO: 2198462 - protein, 21 aa, Cryptosporidium hominis
TWPPYRWSNNEIFVFKVQDTS

SEQ ID NO: 2198463 - protein, 20 aa, Cryptosporidium hominis
TYCLDPPLDSVPSGEWFCPR

SEQ ID NO: 2198464 - protein, 27 aa, Cryptosporidium hominis
TYCRIEFLQHRILKKAFKVFNKEICMD

SEQ ID NO: 2198465 - protein, 30 aa, Cryptosporidium hominis
TYDMPVIDSNLIFTILFGSDSLEKYVGKLK

SEQ ID NO: 2198466 - protein, 27 aa, Cryptosporidium hominis
TYGGGIWHTWFDRGLGIAGKVVDNACN

SEQ ID NO: 2198467 - protein, 30 aa, Cryptosporidium hominis
TYHFNHHTILLRMIILFLMSGNEEDLQTRS

SEQ ID NO: 2198468 - protein, 19 aa, Cryptosporidium hominis
TYIGQLFCGFFLSRIVCHN

SEQ ID NO: 2198469 - protein, 42 aa, Cryptosporidium hominis
TYKEIRYNTWFRYNLPFYLEPQYYHLLSYKLSPRNIKKLVDN

SEQ ID NO: 2198470 - protein, 17 aa, Cryptosporidium hominis
TYKFRTPSYLFSRIKMN

SEQ ID NO: 2198471 - protein, 34 aa, Cryptosporidium hominis
TYNHEIKCLKNELVYPILILLDEPMLCEFICGAK

SEQ ID NO: 2198472 - protein, 23 aa, Cryptosporidium hominis
TYNNIANWKYSKLPKTFGFPNVP

SEQ ID NO: 2198473 - protein, 20 aa, Cryptosporidium hominis
TYRIINQIKPKPYLKRKSKS

SEQ ID NO: 2198474 - protein, 26 aa, Cryptosporidium hominis
TYSITFLCEPRYYREIDQLDCKLLLL

SEQ ID NO: 2198475 - protein, 26 aa, Cryptosporidium hominis
TYSYLRNEYIFDDIIFTLYHNNFKKN

SEQ ID NO: 2198476 - protein, 31 aa, Cryptosporidium hominis
TYVQKFTLETLFYIFYNMPQDLLQGFAAVEL

SEQ ID NO: 2198477 - protein, 20 aa, Cryptosporidium hominis
TYYHPLIVELVYKSILICED

SEQ ID NO: 2198478 - protein, 21 aa, Cryptosporidium hominis
VADKLLQFVDCNESMISSKGN

SEQ ID NO: 2198479 - protein, 32 aa, Cryptosporidium hominis
VAEQYCAMRCDLLILLSTRKKLQRLNSFRHAW

SEQ ID NO: 2198480 - protein, 21 aa, Cryptosporidium hominis
VAEYAFRFIVERFRFKGIRLV

SEQ ID NO: 2198481 - protein, 24 aa, Cryptosporidium hominis
VAIDCPVKCFVGEWSSWSKCPNDD

SEQ ID NO: 2198482 - protein, 17 aa, Cryptosporidium hominis
VAIWFINHLSKSNANIR

SEQ ID NO: 2198483 - protein, 31 aa, Cryptosporidium hominis
VALDVSEPCQLVFSLRYLNNFAKATPLSSSV

SEQ ID NO: 2198484 - protein, 17 aa, Cryptosporidium hominis
VAMRALGFDPKKEELKK

SEQ ID NO: 2198485 - protein, 24 aa, Cryptosporidium hominis
VANKLLLNTIRLRVAKKVKDKVRK

SEQ ID NO: 2198486 - protein, 22 aa, Cryptosporidium hominis
VANPLQFNIPSYMLNRQKDVKD

SEQ ID NO: 2198487 - protein, 25 aa, Cryptosporidium hominis
VAQGKKLVLILSKIDLVPGDVVKEW

SEQ ID NO: 2198488 - protein, 25 aa, Cryptosporidium hominis
VARMNKMRLMGLLNNNNTPMTQMTP

SEQ ID NO: 2198489 - protein, 23 aa, Cryptosporidium hominis
VARNLIGWGIRNFKFIDHSKVSL

SEQ ID NO: 2198490 - protein, 35 aa, Cryptosporidium hominis
VARTYDMQIITYDQTPIPIPNLPRGRRLQSLENLE

SEQ ID NO: 2198491 - protein, 27 aa, Cryptosporidium hominis
VARYIEESLLLSPWNITQEYGQVMRHQ

SEQ ID NO: 2198492 - protein, 18 aa, Cryptosporidium hominis
VASPQNYVNQILTASLDH

SEQ ID NO: 2198493 - protein, 17 aa, Cryptosporidium hominis
VAVILPDETGDTPYLIV

SEQ ID NO: 2198494 - protein, 23 aa, Cryptosporidium hominis
VAWNRRYMWVYCHDIKSFTEMHS

SEQ ID NO: 2198495 - protein, 27 aa, Cryptosporidium hominis
VCCVDAIMNINISLSILLRLNIKSVQE

SEQ ID NO: 2198496 - protein, 28 aa, Cryptosporidium hominis
VCDLNDPLLLEFLFYIVGYTSLKEENIR

SEQ ID NO: 2198497 - protein, 29 aa, Cryptosporidium hominis
VCEIDIPGFRRCLIMAFVCNFCGIKTNEL

SEQ ID NO: 2198498 - protein, 17 aa, Cryptosporidium hominis
VCFIDTEGTFRPERIVK

SEQ ID NO: 2198499 - protein, 26 aa, Cryptosporidium hominis
VCGDTIELFLDFPIDLQKLVLKELHS

SEQ ID NO: 2198500 - protein, 18 aa, Cryptosporidium hominis
VCIIFGPDPIDNKLKLVI

SEQ ID NO: 2198501 - protein, 17 aa, Cryptosporidium hominis
VCIIMRRCYIPPTLDSY

SEQ ID NO: 2198502 - protein, 17 aa, Cryptosporidium hominis
VCKSNVVSIPYSGGLTK

SEQ ID NO: 2198503 - protein, 17 aa, Cryptosporidium hominis
VCKYSLEPAVKYPGYKL

SEQ ID NO: 2198504 - protein, 18 aa, Cryptosporidium hominis
VCLPIHLQNFKISSVVWT

SEQ ID NO: 2198505 - protein, 20 aa, Cryptosporidium hominis
VCLTTFDFIIRESGALQSMQ

SEQ ID NO: 2198506 - protein, 30 aa, Cryptosporidium hominis
VCMEQTFVKPLLYYSPKMKFIAKLAASAQW

SEQ ID NO: 2198507 - protein, 21 aa, Cryptosporidium hominis
VCPFYNSIIVRSILDTAFSVS

SEQ ID NO: 2198508 - protein, 26 aa, Cryptosporidium hominis
VCPNCNQVFKTIVPPELVYSGGIQQM

SEQ ID NO: 2198509 - protein, 18 aa, Cryptosporidium hominis
VCQSCVSDLNFGLSLYAR

SEQ ID NO: 2198510 - protein, 29 aa, Cryptosporidium hominis
VCRADPMLCSAAFLSYPGLVRHIKSKHWS

SEQ ID NO: 2198511 - protein, 18 aa, Cryptosporidium hominis
VCRQVWRESYTEMVRFYK

SEQ ID NO: 2198512 - protein, 18 aa, Cryptosporidium hominis
VCRVKVFHKPICPEGSLD

SEQ ID NO: 2198513 - protein, 26 aa, Cryptosporidium hominis
VCVFFTSHLFLDVFFKFLVSDKSSKD

SEQ ID NO: 2198514 - protein, 19 aa, Cryptosporidium hominis
VCYGPKSPIYYYCLSRMRL

SEQ ID NO: 2198515 - protein, 24 aa, Cryptosporidium hominis
VDASIQFKRSVWLKSHFIRKRIID

SEQ ID NO: 2198516 - protein, 18 aa, Cryptosporidium hominis
VDAVILFKEGIQPMWEDP

SEQ ID NO: 2198517 - protein, 36 aa, Cryptosporidium hominis
VDDDIQYIWRRNCPYLYDTMLSYTLEWPTLTIDWLP

SEQ ID NO: 2198518 - protein, 24 aa, Cryptosporidium hominis
VDELKILHGFFPQISSSVDSIVML

SEQ ID NO: 2198519 - protein, 28 aa, Cryptosporidium hominis
VDEQIIIKISFIEPVSITKFGIQALDIE

SEQ ID NO: 2198520 - protein, 17 aa, Cryptosporidium hominis
VDFLIKAFKKRDLNNIN

SEQ ID NO: 2198521 - protein, 19 aa, Cryptosporidium hominis
VDFLQFSFRWMNCLLTREF

SEQ ID NO: 2198522 - protein, 25 aa, Cryptosporidium hominis
VDGEFLIAYHPLYFDVSHSRKIKVL

SEQ ID NO: 2198523 - protein, 26 aa, Cryptosporidium hominis
VDGKLFSNLFGLVIIFYKYEIVGSEH

SEQ ID NO: 2198524 - protein, 26 aa, Cryptosporidium hominis
VDGQKRYILRYLIYDCICIERDDSVK

SEQ ID NO: 2198525 - protein, 24 aa, Cryptosporidium hominis
VDKNIISQIFFLDGIFDTILSELK

SEQ ID NO: 2198526 - protein, 20 aa, Cryptosporidium hominis
VDLFDVIFGGGRRAGSRGGG

SEQ ID NO: 2198527 - protein, 26 aa, Cryptosporidium hominis
VDLSQIPASLLKKLSFIPTSEVQVIK

SEQ ID NO: 2198528 - protein, 27 aa, Cryptosporidium hominis
VDNQNYFFFLEELYRQINIRSGISRLQ

SEQ ID NO: 2198529 - protein, 24 aa, Cryptosporidium hominis
VDPEMIKLLPTIDPLRKLYYSEKF

SEQ ID NO: 2198530 - protein, 28 aa, Cryptosporidium hominis
VDPERFKYRLAFQEYLNLLLHVLKNACK

SEQ ID NO: 2198531 - protein, 27 aa, Cryptosporidium hominis
VDPKMLQFHLLLAIRSVVANLGVQINR

SEQ ID NO: 2198532 - protein, 24 aa, Cryptosporidium hominis
VDQVYRVYLYYNSIYKFFSSDVFI

SEQ ID NO: 2198533 - protein, 34 aa, Cryptosporidium hominis
VDRALYNRQIYPPINVLPSLSRLMKSGIGTGLTR

SEQ ID NO: 2198534 - protein, 24 aa, Cryptosporidium hominis
VDRKRKELALLLKNNSNSIRNYKD

SEQ ID NO: 2198535 - protein, 27 aa, Cryptosporidium hominis
VDRTKYKIQIPLPPKIDPSVAMMTVED

SEQ ID NO: 2198536 - protein, 26 aa, Cryptosporidium hominis
VDSALDATYFLDPEFEIKPKFESELE

SEQ ID NO: 2198537 - protein, 23 aa, Cryptosporidium hominis
VDSDPQLMIYPRQGRNLESRYIG

SEQ ID NO: 2198538 - protein, 39 aa, Cryptosporidium hominis
VDSGILFYEFRLPIIYHIIYLLEILRICIRIPTEGNWLF

SEQ ID NO: 2198539 - protein, 32 aa, Cryptosporidium hominis
VDSIPKHIPDFLPIFPPRLDYCDKFISSQCSN

SEQ ID NO: 2198540 - protein, 24 aa, Cryptosporidium hominis
VDSLIQDRSILLKALEKDKQDLRL

SEQ ID NO: 2198541 - protein, 17 aa, Cryptosporidium hominis
VDSSLLAFGIRSDKPRN

SEQ ID NO: 2198542 - protein, 18 aa, Cryptosporidium hominis
VDVLQQIHTLWNLGEICN

SEQ ID NO: 2198543 - protein, 29 aa, Cryptosporidium hominis
VDVWSMGCIFLEILCKRTPLQHVLDKVDE

SEQ ID NO: 2198544 - protein, 17 aa, Cryptosporidium hominis
VEAANFDYKFGIKSFVL

SEQ ID NO: 2198545 - protein, 25 aa, Cryptosporidium hominis
VEALTGFKFIITHLDGRKLLVKSNP

SEQ ID NO: 2198546 - protein, 32 aa, Cryptosporidium hominis
VEASGKMVLLHKLLPKLFSQGSRVLLFSQMTR

SEQ ID NO: 2198547 - protein, 25 aa, Cryptosporidium hominis
VEASYLLMMYLGISCKLKYFYNIEE

SEQ ID NO: 2198548 - protein, 25 aa, Cryptosporidium hominis
VECDVTFYRFSFFKSPVVQNAIDQT

SEQ ID NO: 2198549 - protein, 28 aa, Cryptosporidium hominis
VEEMKRALEEIPNLPFLGKSIRVEEDIG

SEQ ID NO: 2198550 - protein, 19 aa, Cryptosporidium hominis
VEEYFWGDFPIFDYEHDRV

SEQ ID NO: 2198551 - protein, 21 aa, Cryptosporidium hominis
VEFKELFSTFLKSYIAKDGDS

SEQ ID NO: 2198552 - protein, 25 aa, Cryptosporidium hominis
VEFLKKILERYPFLSNSRSSEGSYA

SEQ ID NO: 2198553 - protein, 24 aa, Cryptosporidium hominis
VEFQSFMRLISEILDFYSPLLINT

SEQ ID NO: 2198554 - protein, 18 aa, Cryptosporidium hominis
VEFSPFYSCLLVSASQDK

SEQ ID NO: 2198555 - protein, 17 aa, Cryptosporidium hominis
VEFYSVESVLKALKLSG

SEQ ID NO: 2198556 - protein, 22 aa, Cryptosporidium hominis
VEGESLMMKLYSLALSSGSACT

SEQ ID NO: 2198557 - protein, 28 aa, Cryptosporidium hominis
VEGLKLDKGYISPYFITNQKYQKVELEN

SEQ ID NO: 2198558 - protein, 45 aa, Cryptosporidium hominis
VEGLPRKIAAFILQRHGNQIPYDRQFWSYAYKTGRLHPAEEQVQR

SEQ ID NO: 2198559 - protein, 20 aa, Cryptosporidium hominis
VEGSVKVPIAIYLEPWHVDV

SEQ ID NO: 2198560 - protein, 22 aa, Cryptosporidium hominis
VEIDISDHLKLRKLRKVDGEKS

SEQ ID NO: 2198561 - protein, 26 aa, Cryptosporidium hominis
VEIMKLKHIIILQNKVELIKEAQAQE

SEQ ID NO: 2198562 - protein, 19 aa, Cryptosporidium hominis
VEINLPFITADARGPKHLQ

SEQ ID NO: 2198563 - protein, 27 aa, Cryptosporidium hominis
VEIPKTDPYLFWADIYEISGLGLPSEV

SEQ ID NO: 2198564 - protein, 26 aa, Cryptosporidium hominis
VEKIKNIYLVLLKTPNIRDWPINVLE

SEQ ID NO: 2198565 - protein, 18 aa, Cryptosporidium hominis
VEKPWKLPTGPLARPDRE

SEQ ID NO: 2198566 - protein, 26 aa, Cryptosporidium hominis
VELCNRGWLYYPDSLQWYSKVQNEEK

SEQ ID NO: 2198567 - protein, 27 aa, Cryptosporidium hominis
VELFNSSLWSLFPNNKFILTLSNLLSH

SEQ ID NO: 2198568 - protein, 20 aa, Cryptosporidium hominis
VELLNEHQFLTAKPVVYLVN

SEQ ID NO: 2198569 - protein, 24 aa, Cryptosporidium hominis
VELSTLIPLKLGCKRLILVGDPKQ

SEQ ID NO: 2198570 - protein, 25 aa, Cryptosporidium hominis
VENAALVDGLFGRIWEFPKCENVRE

SEQ ID NO: 2198571 - protein, 23 aa, Cryptosporidium hominis
VENLFLNGIIQIVVATSTLAWGV

SEQ ID NO: 2198572 - protein, 30 aa, Cryptosporidium hominis
VENLLDISPPYYIHSVLAGIPKILSDRFLA

SEQ ID NO: 2198573 - protein, 26 aa, Cryptosporidium hominis
VENPSPTLMPCASLIFINIPSFASGN

SEQ ID NO: 2198574 - protein, 26 aa, Cryptosporidium hominis
VENSEIIKYSCGALAIDCPFMGKFVD

SEQ ID NO: 2198575 - protein, 19 aa, Cryptosporidium hominis
VERAVQQRIYLLEPKLDDS

SEQ ID NO: 2198576 - protein, 18 aa, Cryptosporidium hominis
VERHRITHFYAAPTAIRT

SEQ ID NO: 2198577 - protein, 17 aa, Cryptosporidium hominis
VERPIVFALSNPTNKAE

SEQ ID NO: 2198578 - protein, 31 aa, Cryptosporidium hominis
VESIDLTLVVWLRKMYCKYNQPYLTCLDCLE

SEQ ID NO: 2198579 - protein, 20 aa, Cryptosporidium hominis
VESKIKRYEGLGFKLESDKI

SEQ ID NO: 2198580 - protein, 18 aa, Cryptosporidium hominis
VESLYLKACKFVSVSQTN

SEQ ID NO: 2198581 - protein, 26 aa, Cryptosporidium hominis
VESMRFRSLPIHPKFASKKKVGAALE

SEQ ID NO: 2198582 - protein, 19 aa, Cryptosporidium hominis
VESSFWNFDALFQPQKHPA

SEQ ID NO: 2198583 - protein, 18 aa, Cryptosporidium hominis
VESWKLNNILSGSGSKGF

SEQ ID NO: 2198584 - protein, 27 aa, Cryptosporidium hominis
VEYIDIPIEKIILKPNPQIIEKIVQVP

SEQ ID NO: 2198585 - protein, 32 aa, Cryptosporidium hominis
VEYRYKVMYQLADSIRFLHSLSPKIVHKDLKS

SEQ ID NO: 2198586 - protein, 32 aa, Cryptosporidium hominis
VFDHYFDVPSVVKALIIPPKGYDGRVSKEYIT

SEQ ID NO: 2198587 - protein, 20 aa, Cryptosporidium hominis
VFDKLRALTADRQKALEPLR

SEQ ID NO: 2198588 - protein, 26 aa, Cryptosporidium hominis
VFEAELMDHIPIINTLIGGTRLVGRC

SEQ ID NO: 2198589 - protein, 18 aa, Cryptosporidium hominis
VFEILLSDDYYLKFFKAC

SEQ ID NO: 2198590 - protein, 17 aa, Cryptosporidium hominis
VFELFTEIAPLTSENFR

SEQ ID NO: 2198591 - protein, 30 aa, Cryptosporidium hominis
VFEQFQNELIGYLYLIINPSIITSDGNNFK

SEQ ID NO: 2198592 - protein, 24 aa, Cryptosporidium hominis
VFESNPMMTSIADVGYNSKPEMNL

SEQ ID NO: 2198593 - protein, 21 aa, Cryptosporidium hominis
VFEYSFFPQCPNGIIGGIIHY

SEQ ID NO: 2198594 - protein, 18 aa, Cryptosporidium hominis
VFFKDFNFDRLLGRSYVA

SEQ ID NO: 2198595 - protein, 21 aa, Cryptosporidium hominis
VFGYPPYFDIFSKKSPIEFQL

SEQ ID NO: 2198596 - protein, 26 aa, Cryptosporidium hominis
VFIPKNLCISLLGGISSLLLCKKITN

SEQ ID NO: 2198597 - protein, 17 aa, Cryptosporidium hominis
VFKELHTRFFQNPETAC

SEQ ID NO: 2198598 - protein, 17 aa, Cryptosporidium hominis
VFKIAPLYYRSKKQKMV

SEQ ID NO: 2198599 - protein, 18 aa, Cryptosporidium hominis
VFKLCEYYNKINLGLISH

SEQ ID NO: 2198600 - protein, 25 aa, Cryptosporidium hominis
VFKLRSRAIKYIRNYFDRLGFLEVE

SEQ ID NO: 2198601 - protein, 44 aa, Cryptosporidium hominis
VFKNEGFFDIAREIKLRKLSYSHFIPLHQLWKQYIKGLIESNSV

SEQ ID NO: 2198602 - protein, 25 aa, Cryptosporidium hominis
VFKSSPLLTSILVKCPTSCNPENGG

SEQ ID NO: 2198603 - protein, 23 aa, Cryptosporidium hominis
VFKTKGNEWIYKARKEIFESVDT

SEQ ID NO: 2198604 - protein, 30 aa, Cryptosporidium hominis
VFMINKRLLFTLVRLKLWIVEEILYDEQIL

SEQ ID NO: 2198605 - protein, 22 aa, Cryptosporidium hominis
VFNQPWIPIMRISFKDNNEKYN

SEQ ID NO: 2198606 - protein, 29 aa, Cryptosporidium hominis
VFNQVFLSWFKHFLTPWLKFGTAFDHFSE

SEQ ID NO: 2198607 - protein, 18 aa, Cryptosporidium hominis
VFQRYNITLSLCGHLLYG

SEQ ID NO: 2198608 - protein, 23 aa, Cryptosporidium hominis
VFQSFGVLPIAMESFKNSGKKSK

SEQ ID NO: 2198609 - protein, 20 aa, Cryptosporidium hominis
VFQTLIFLNREKQGILLCKQ

SEQ ID NO: 2198610 - protein, 25 aa, Cryptosporidium hominis
VFRRDQIFWERRPGLYCLPRSCIKG

SEQ ID NO: 2198611 - protein, 17 aa, Cryptosporidium hominis
VFRSLYPMKAAEIGRNE

SEQ ID NO: 2198612 - protein, 29 aa, Cryptosporidium hominis
VFSCKYLPFKFFKVRNLDLFLDLNIDKTE

SEQ ID NO: 2198613 - protein, 25 aa, Cryptosporidium hominis
VFSSRDWVFYYNNHPMFKKMLYPTN

SEQ ID NO: 2198614 - protein, 28 aa, Cryptosporidium hominis
VFVGETRYFFLVLKWNGLQQIVGASGLF

SEQ ID NO: 2198615 - protein, 17 aa, Cryptosporidium hominis
VFVPLRRDNPITYGTYF

SEQ ID NO: 2198616 - protein, 20 aa, Cryptosporidium hominis
VFVTNPILPPPPPTSTIVKP

SEQ ID NO: 2198617 - protein, 19 aa, Cryptosporidium hominis
VFYEEIFKELSKYGEILEL

SEQ ID NO: 2198618 - protein, 23 aa, Cryptosporidium hominis
VGANPRFPLLNEIKQLYIDAYSG

SEQ ID NO: 2198619 - protein, 24 aa, Cryptosporidium hominis
VGDFGLCQQLFSDKGFINGSGNLV

SEQ ID NO: 2198620 - protein, 31 aa, Cryptosporidium hominis
VGEELPIKDLFFFPSRLLETAAFRPPKNVTW

SEQ ID NO: 2198621 - protein, 21 aa, Cryptosporidium hominis
VGEFSILKYVKSETLVNLWLT

SEQ ID NO: 2198622 - protein, 33 aa, Cryptosporidium hominis
VGFNQFLRCDSVLYLLVYPQKPLCKTRTIEMIN

SEQ ID NO: 2198623 - protein, 26 aa, Cryptosporidium hominis
VGHQLKLEVFLVFKSGLDPNSELFEK

SEQ ID NO: 2198624 - protein, 17 aa, Cryptosporidium hominis
VGIINFCTTIKLKHLHF

SEQ ID NO: 2198625 - protein, 27 aa, Cryptosporidium hominis
VGIIRTHLYRIFHTIFSLPGAHIFRDE

SEQ ID NO: 2198626 - protein, 17 aa, Cryptosporidium hominis
VGILCKEGVILGADKAI

SEQ ID NO: 2198627 - protein, 33 aa, Cryptosporidium hominis
VGISRLVSTLINLIDVILPLYDLNGTLCSRSKN

SEQ ID NO: 2198628 - protein, 17 aa, Cryptosporidium hominis
VGKARWRPGFPSQIAFC

SEQ ID NO: 2198629 - protein, 32 aa, Cryptosporidium hominis
VGKDITWFHSVIWPAMLLSVGLSLPKTIFAHG

SEQ ID NO: 2198630 - protein, 41 aa, Cryptosporidium hominis
VGKSFVQNFLLTEIRPRWYFIRNDCLIFIDSELPLKQSVQN

SEQ ID NO: 2198631 - protein, 20 aa, Cryptosporidium hominis
VGKSSLKWNGGGTGSNNGGI

SEQ ID NO: 2198632 - protein, 29 aa, Cryptosporidium hominis
VGKYTPLRQFFFFDAFEQLDLISNETHTK

SEQ ID NO: 2198633 - protein, 18 aa, Cryptosporidium hominis
VGLFTKPRHNIYKLNMDM

SEQ ID NO: 2198634 - protein, 20 aa, Cryptosporidium hominis
VGLINGKWHWYTWCKRPDFN

SEQ ID NO: 2198635 - protein, 22 aa, Cryptosporidium hominis
VGLRPFMGFIPEYELYRRILHH

SEQ ID NO: 2198636 - protein, 18 aa, Cryptosporidium hominis
VGLYAEWVDKNTIWDVRK

SEQ ID NO: 2198637 - protein, 28 aa, Cryptosporidium hominis
VGPPGANIFIFNVPYEWDKKSLVGLFCR

SEQ ID NO: 2198638 - protein, 20 aa, Cryptosporidium hominis
VGQIPMINPIQNVIPSQMPS

SEQ ID NO: 2198639 - protein, 26 aa, Cryptosporidium hominis
VGQIPNYVKLLPELLCQAGDGLDKVT

SEQ ID NO: 2198640 - protein, 23 aa, Cryptosporidium hominis
VGREYRLNFSVGTKLKKLSFYNN

SEQ ID NO: 2198641 - protein, 17 aa, Cryptosporidium hominis
VGSDRYWGKAYNGPLMD

SEQ ID NO: 2198642 - protein, 25 aa, Cryptosporidium hominis
VGSSFTRFLTLRYSRLFPIPERTLS

SEQ ID NO: 2198643 - protein, 29 aa, Cryptosporidium hominis
VGTISKFKIPIELFPLNKNQIIIDIDLVQ

SEQ ID NO: 2198644 - protein, 18 aa, Cryptosporidium hominis
VGTLLPTYASLSSEQLRM

SEQ ID NO: 2198645 - protein, 19 aa, Cryptosporidium hominis
VGTPFIPPAVFSKVTHPVN

SEQ ID NO: 2198646 - protein, 27 aa, Cryptosporidium hominis
VGTSYFSCLYPFRDISDIKPFGWEELC

SEQ ID NO: 2198647 - protein, 25 aa, Cryptosporidium hominis
VGTYFLHDDSWWYQPYDGSAPFCPN

SEQ ID NO: 2198648 - protein, 18 aa, Cryptosporidium hominis
VGVGKNLIWAGLDPDRPL

SEQ ID NO: 2198649 - protein, 18 aa, Cryptosporidium hominis
VGVSPTNTSRPSKYSPGC

SEQ ID NO: 2198650 - protein, 21 aa, Cryptosporidium hominis
VGYFSFNHIIPNVPTFDDHQR

SEQ ID NO: 2198651 - protein, 25 aa, Cryptosporidium hominis
VGYVQIPYNAFLSRSFESSGHDKIK

SEQ ID NO: 2198652 - protein, 25 aa, Cryptosporidium hominis
VHCFNGYYNNCIFHRVIKGFMIQTG

SEQ ID NO: 2198653 - protein, 22 aa, Cryptosporidium hominis
VHDWAYVRLLQHKVEESRLIWD

SEQ ID NO: 2198654 - protein, 23 aa, Cryptosporidium hominis
VHEGAVLLGIWNDNTVFLRFEAT

SEQ ID NO: 2198655 - protein, 18 aa, Cryptosporidium hominis
VHHDVIIGDYPLCSEWIS

SEQ ID NO: 2198656 - protein, 21 aa, Cryptosporidium hominis
VHIFELYNRILAPPNLQKIGD

SEQ ID NO: 2198657 - protein, 25 aa, Cryptosporidium hominis
VHIKDVPIYIKYNSISSTCTSTAPS

SEQ ID NO: 2198658 - protein, 33 aa, Cryptosporidium hominis
VHIYEVYEDRLNLYFILEFCAGGNLFHSLQDAI

SEQ ID NO: 2198659 - protein, 24 aa, Cryptosporidium hominis
VHKGAALLSTFSSDPTFKKNCDYN

SEQ ID NO: 2198660 - protein, 19 aa, Cryptosporidium hominis
VHLECLRHWINGRLNLANE

SEQ ID NO: 2198661 - protein, 17 aa, Cryptosporidium hominis
VHLLALKFDNFDLAGDC

SEQ ID NO: 2198662 - protein, 25 aa, Cryptosporidium hominis
VHMLDVECFSFLNKALEEETSPILI

SEQ ID NO: 2198663 - protein, 23 aa, Cryptosporidium hominis
VHPTTAALALAYSLSVAASAKRN

SEQ ID NO: 2198664 - protein, 28 aa, Cryptosporidium hominis
VHQFIQMADFYFIPPPGFRDKKTIHEEI

SEQ ID NO: 2198665 - protein, 27 aa, Cryptosporidium hominis
VHQKRHPIKSRLLSWRSKDYTEKEKES

SEQ ID NO: 2198666 - protein, 30 aa, Cryptosporidium hominis
VHRDLKPENFLFLNKNYNAPLKIIDFGLAA

SEQ ID NO: 2198667 - protein, 26 aa, Cryptosporidium hominis
VHSGHYYAYIRPKPDSDWFRFDDEKV

SEQ ID NO: 2198668 - protein, 33 aa, Cryptosporidium hominis
VHSHSSIRVVFPDKYILQLQFRPNHTTYDLIQS

SEQ ID NO: 2198669 - protein, 17 aa, Cryptosporidium hominis
VHSILSNTKRYVQLIYI

SEQ ID NO: 2198670 - protein, 29 aa, Cryptosporidium hominis
VHSKHPVKHWLYDSLSFKKISNVLGGKIK

SEQ ID NO: 2198671 - protein, 21 aa, Cryptosporidium hominis
VHSLSFSLSQRYLISSGGDGI

SEQ ID NO: 2198672 - protein, 31 aa, Cryptosporidium hominis
VHVLRVRLSPAFINFLLPKAVDEVKEELYFL

SEQ ID NO: 2198673 - protein, 24 aa, Cryptosporidium hominis
VIAAKKFLQSFLKLPEEALREDFD

SEQ ID NO: 2198674 - protein, 20 aa, Cryptosporidium hominis
VIAALQKIDYSLNACQVLLL

SEQ ID NO: 2198675 - protein, 35 aa, Cryptosporidium hominis
VIANTFYLFNVWVNDFYRILKWDPFEFSEFNSSVF

SEQ ID NO: 2198676 - protein, 20 aa, Cryptosporidium hominis
VIATILLHVLSRTFSGGACF

SEQ ID NO: 2198677 - protein, 27 aa, Cryptosporidium hominis
VICKEMVHTLYIFDTSQKLFKPINRSK

SEQ ID NO: 2198678 - protein, 18 aa, Cryptosporidium hominis
VICLLIVNNLLPCITPPD

SEQ ID NO: 2198679 - protein, 23 aa, Cryptosporidium hominis
VICLQLPLENIFFKQGSFVSRPM

SEQ ID NO: 2198680 - protein, 27 aa, Cryptosporidium hominis
VIDATPFRQFYLQRYGVELGRRKNADE

SEQ ID NO: 2198681 - protein, 22 aa, Cryptosporidium hominis
VIDFVLRNYLVFRNLNTFFQPK

SEQ ID NO: 2198682 - protein, 34 aa, Cryptosporidium hominis
VIDGKPPYYPIKAFYPVITSIIAFGKPPSTQALK

SEQ ID NO: 2198683 - protein, 30 aa, Cryptosporidium hominis
VIDYKSHGIGVFLPEGRTIDPNANDGLLFG

SEQ ID NO: 2198684 - protein, 18 aa, Cryptosporidium hominis
VIDYLIGHPLGYSTNDIG

SEQ ID NO: 2198685 - protein, 28 aa, Cryptosporidium hominis
VIEIKHAIRIIPISRILLSFDICANIPT

SEQ ID NO: 2198686 - protein, 22 aa, Cryptosporidium hominis
VIEIWNLVFMQYYREVDSTLTP

SEQ ID NO: 2198687 - protein, 17 aa, Cryptosporidium hominis
VIELISFTIYRQANGPA

SEQ ID NO: 2198688 - protein, 24 aa, Cryptosporidium hominis
VIELLQMEAAMFQHKYRHNLEHPR

SEQ ID NO: 2198689 - protein, 20 aa, Cryptosporidium hominis
VIENIQFFEPKLTFFSSVTG

SEQ ID NO: 2198690 - protein, 17 aa, Cryptosporidium hominis
VIEPIYIAQWSTMWTMM

SEQ ID NO: 2198691 - protein, 18 aa, Cryptosporidium hominis
VIFIINYGNYFRNPHIRC

SEQ ID NO: 2198692 - protein, 18 aa, Cryptosporidium hominis
VIFKLYRESSLTGELTLL

SEQ ID NO: 2198693 - protein, 29 aa, Cryptosporidium hominis
VIGIVQDSLLGIFLLTRKSTFLTRDKFLQ

SEQ ID NO: 2198694 - protein, 24 aa, Cryptosporidium hominis
VIIDQFFESILRFGAIPFANADRI

SEQ ID NO: 2198695 - protein, 19 aa, Cryptosporidium hominis
VIIWDYLLANGLQSLISIA

SEQ ID NO: 2198696 - protein, 19 aa, Cryptosporidium hominis
VIKEKMDINWNKASSGGEV

SEQ ID NO: 2198697 - protein, 18 aa, Cryptosporidium hominis
VIKPQLNPLSQPPFRVNL

SEQ ID NO: 2198698 - protein, 27 aa, Cryptosporidium hominis
VIKRMIRIWNIKKDYLKWTKDCLEIYS

SEQ ID NO: 2198699 - protein, 27 aa, Cryptosporidium hominis
VIKSLKFSFVFFYNQLVNIEGISRSHI

SEQ ID NO: 2198700 - protein, 23 aa, Cryptosporidium hominis
VIKSWESRLAKQVKLFNKASSDV

SEQ ID NO: 2198701 - protein, 17 aa, Cryptosporidium hominis
VILNRLVNIANSQEKLI

SEQ ID NO: 2198702 - protein, 24 aa, Cryptosporidium hominis
VILRLVPRLDVPALIRKSQNSQDV

SEQ ID NO: 2198703 - protein, 29 aa, Cryptosporidium hominis
VINDSVQKLLHFQDILGKGSKIESDYSRK

SEQ ID NO: 2198704 - protein, 30 aa, Cryptosporidium hominis
VINGNSTEFAVFILVLIGSEVELKLIDNRV

SEQ ID NO: 2198705 - protein, 25 aa, Cryptosporidium hominis
VINKEQFSHLLAEYAEIIDLKDQNI

SEQ ID NO: 2198706 - protein, 30 aa, Cryptosporidium hominis
VINQMESLDWWWWLNIKDNFEGLLTQNMSW

SEQ ID NO: 2198707 - protein, 18 aa, Cryptosporidium hominis
VINSLHTIIWQGDKKQLC

SEQ ID NO: 2198708 - protein, 24 aa, Cryptosporidium hominis
VINSLIEDFIPNSLNLLKKGGCFV

SEQ ID NO: 2198709 - protein, 18 aa, Cryptosporidium hominis
VIPLNDPTILFINAGMNQ

SEQ ID NO: 2198710 - protein, 19 aa, Cryptosporidium hominis
VIPSSYFYTGNPRQPLKLS

SEQ ID NO: 2198711 - protein, 25 aa, Cryptosporidium hominis
VIQNELSWYDFLKDFGGDSLFPNIN

SEQ ID NO: 2198712 - protein, 33 aa, Cryptosporidium hominis
VIREIGCCHIKYIMPFPKDLKPKIFKGTSNFQF

SEQ ID NO: 2198713 - protein, 17 aa, Cryptosporidium hominis
VIRIVDNNLLYEPQKIA

SEQ ID NO: 2198714 - protein, 29 aa, Cryptosporidium hominis
VIRNVFCNTFYLPVFLSTDSILLDIERSI

SEQ ID NO: 2198715 - protein, 17 aa, Cryptosporidium hominis
VISTLLRKFPDAKLITP

SEQ ID NO: 2198716 - protein, 27 aa, Cryptosporidium hominis
VITDHKQFVLLNLYVPLLRSKAEEKEE

SEQ ID NO: 2198717 - protein, 19 aa, Cryptosporidium hominis
VITEKSVHLLALKFDNFDL

SEQ ID NO: 2198718 - protein, 22 aa, Cryptosporidium hominis
VITRCGHHFCLNCAGNLVQRKQ

SEQ ID NO: 2198719 - protein, 27 aa, Cryptosporidium hominis
VIVNGLEYFFIYKYESRIIGDCEANAW

SEQ ID NO: 2198720 - protein, 18 aa, Cryptosporidium hominis
VIVRLNSGVDYKGLLACL

SEQ ID NO: 2198721 - protein, 31 aa, Cryptosporidium hominis
VIVTSYEMLLKERTWFLRRNFHSVIIDEAHR

SEQ ID NO: 2198722 - protein, 26 aa, Cryptosporidium hominis
VIYDNDLTLLFVRTLRLLLSSCHEKK

SEQ ID NO: 2198723 - protein, 18 aa, Cryptosporidium hominis
VIYLFYCENNYCSMNWAT

SEQ ID NO: 2198724 - protein, 30 aa, Cryptosporidium hominis
VIYSYLCISSYLIHFLKDVSPLPFNDNSET

SEQ ID NO: 2198725 - protein, 25 aa, Cryptosporidium hominis
VKASSFNYFFFNSPNLEIVDLSNCY

SEQ ID NO: 2198726 - protein, 26 aa, Cryptosporidium hominis
VKCHDIQVENIKYGELVVLIESDDDY

SEQ ID NO: 2198727 - protein, 24 aa, Cryptosporidium hominis
VKDILLNKVTYLPTGLNLLGMAAS

SEQ ID NO: 2198728 - protein, 24 aa, Cryptosporidium hominis
VKDLRGLELLISKLTFRGNLEALK

SEQ ID NO: 2198729 - protein, 25 aa, Cryptosporidium hominis
VKDYSIFYNIFKTKKIDLLVSCVDN

SEQ ID NO: 2198730 - protein, 29 aa, Cryptosporidium hominis
VKEEALSPIQLFLRPFMQCCAPRSRSGKK

SEQ ID NO: 2198731 - protein, 21 aa, Cryptosporidium hominis
VKELLILKKEQVHKLSDLLLN

SEQ ID NO: 2198732 - protein, 17 aa, Cryptosporidium hominis
VKEYLFSFIEEFYLMMR

SEQ ID NO: 2198733 - protein, 27 aa, Cryptosporidium hominis
VKFSIEGFWSLITLIPKMVLNNLNTKD

SEQ ID NO: 2198734 - protein, 24 aa, Cryptosporidium hominis
VKGKLIHPNFLKVFEDLYELLNAS

SEQ ID NO: 2198735 - protein, 17 aa, Cryptosporidium hominis
VKGPELLTLWFGESEAN

SEQ ID NO: 2198736 - protein, 24 aa, Cryptosporidium hominis
VKHDFQYLHNYKLLQQVFGKVNQP

SEQ ID NO: 2198737 - protein, 31 aa, Cryptosporidium hominis
VKHIPKSWTEDLLYKIFGVYGKISSLVLQSD

SEQ ID NO: 2198738 - protein, 24 aa, Cryptosporidium hominis
VKIGNNCIISLKSSLPPNLEICND

SEQ ID NO: 2198739 - protein, 33 aa, Cryptosporidium hominis
VKIIGPIALHIFPKSEFYYNEKILSILDEIIGG

SEQ ID NO: 2198740 - protein, 30 aa, Cryptosporidium hominis
VKIMSGLINLLLLFEKNQRFKKMTFITSLK

SEQ ID NO: 2198741 - protein, 21 aa, Cryptosporidium hominis
VKIVGVYKPISRRENNALTGI

SEQ ID NO: 2198742 - protein, 20 aa, Cryptosporidium hominis
VKKEYICKPWIKKLLHKWGT

SEQ ID NO: 2198743 - protein, 17 aa, Cryptosporidium hominis
VKKIFQFIHKIAIILVT

SEQ ID NO: 2198744 - protein, 27 aa, Cryptosporidium hominis
VKKVVFSLHPSFLNPNRVVEKCPFEVT

SEQ ID NO: 2198745 - protein, 18 aa, Cryptosporidium hominis
VKLILFCNNKGGVDNNGQ

SEQ ID NO: 2198746 - protein, 26 aa, Cryptosporidium hominis
VKLKYGIQLILGLNGYVWISLPFEHS

SEQ ID NO: 2198747 - protein, 17 aa, Cryptosporidium hominis
VKLLNKRCSLQATPYRG

SEQ ID NO: 2198748 - protein, 20 aa, Cryptosporidium hominis
VKLQLCFSLLYFVNGNFQEC

SEQ ID NO: 2198749 - protein, 26 aa, Cryptosporidium hominis
VKLRENQLFIIDLSRFKTKSSLDENG

SEQ ID NO: 2198750 - protein, 28 aa, Cryptosporidium hominis
VKLRNFPDIDIFCFFGCSEYFLSHIIKN

SEQ ID NO: 2198751 - protein, 45 aa, Cryptosporidium hominis
VKNEIWTIQQLSFVFLRTKKLIPATQLPLLAKRLTTYARNSPEIG

SEQ ID NO: 2198752 - protein, 25 aa, Cryptosporidium hominis
VKNFEKFMIKELIKLLIMLNNISEK

SEQ ID NO: 2198753 - protein, 30 aa, Cryptosporidium hominis
VKNQRKIWSDILAIRIFIQNALKLCNQLPP

SEQ ID NO: 2198754 - protein, 18 aa, Cryptosporidium hominis
VKNSPLLERFRIDDELII

SEQ ID NO: 2198755 - protein, 24 aa, Cryptosporidium hominis
VKNYLFGGFLAIPNDWWMCYVHGD

SEQ ID NO: 2198756 - protein, 21 aa, Cryptosporidium hominis
VKNYYCFYPKIWQSQDLYSSI

SEQ ID NO: 2198757 - protein, 19 aa, Cryptosporidium hominis
VKPIMFDIASDFILSPDLS

SEQ ID NO: 2198758 - protein, 18 aa, Cryptosporidium hominis
VKRFSVSWMYKSGFLHIP

SEQ ID NO: 2198759 - protein, 23 aa, Cryptosporidium hominis
VKRRFRTAKRLLIKNTLELSRNT

SEQ ID NO: 2198760 - protein, 29 aa, Cryptosporidium hominis
VKSLRTPSWGIPWTLQTDIDILKGIYIYG

SEQ ID NO: 2198761 - protein, 24 aa, Cryptosporidium hominis
VKTPNQFLMIPKKILTQSINNRVY

SEQ ID NO: 2198762 - protein, 31 aa, Cryptosporidium hominis
VKVDLDYYQFRWFHSWKKLLRNSSGYFFPHK

SEQ ID NO: 2198763 - protein, 28 aa, Cryptosporidium hominis
VKVESKLFLDKLWLWHSGKYVNKFKTSN

SEQ ID NO: 2198764 - protein, 26 aa, Cryptosporidium hominis
VKVLTFPIIVWPKKILYISYSELEMF

SEQ ID NO: 2198765 - protein, 19 aa, Cryptosporidium hominis
VKVYRLITARTYEAEMFER

SEQ ID NO: 2198766 - protein, 24 aa, Cryptosporidium hominis
VKWVDEIISPCPWVIDEKFVEKHK

SEQ ID NO: 2198767 - protein, 18 aa, Cryptosporidium hominis
VKYNETCNWYTTFDSILP

SEQ ID NO: 2198768 - protein, 21 aa, Cryptosporidium hominis
VLAHGKWLIKAPYPVFYPSTP

SEQ ID NO: 2198769 - protein, 25 aa, Cryptosporidium hominis
VLDALDWSIEFPKPSDYIKRYCLVF

SEQ ID NO: 2198770 - protein, 19 aa, Cryptosporidium hominis
VLDDFFLKLEQFPVKHIKS

SEQ ID NO: 2198771 - protein, 31 aa, Cryptosporidium hominis
VLDPRSVPCGSFIWWDRRVWEYNFVHMARRL

SEQ ID NO: 2198772 - protein, 24 aa, Cryptosporidium hominis
VLEEDKFLEYAFGTNYSEMLVTFD

SEQ ID NO: 2198773 - protein, 30 aa, Cryptosporidium hominis
VLEKILEIEPLALNFIISGRGYKFLKMILK

SEQ ID NO: 2198774 - protein, 25 aa, Cryptosporidium hominis
VLELRNLYIPLDTFDHLILMFSLSN

SEQ ID NO: 2198775 - protein, 17 aa, Cryptosporidium hominis
VLEQEVPLKFLFPTDRV

SEQ ID NO: 2198776 - protein, 26 aa, Cryptosporidium hominis
VLEVDKAIITYTTKLYSIRADQQEIR

SEQ ID NO: 2198777 - protein, 19 aa, Cryptosporidium hominis
VLFCGLINGTIRAFHKPTG

SEQ ID NO: 2198778 - protein, 18 aa, Cryptosporidium hominis
VLFESAAGYLLCIIDNWE

SEQ ID NO: 2198779 - protein, 21 aa, Cryptosporidium hominis
VLFVIENFFFFKNGIAKQSLS

SEQ ID NO: 2198780 - protein, 19 aa, Cryptosporidium hominis
VLGAEKALFRALKSKGNTP

SEQ ID NO: 2198781 - protein, 20 aa, Cryptosporidium hominis
VLGHPGFLPEIYDSINITLY

SEQ ID NO: 2198782 - protein, 42 aa, Cryptosporidium hominis
VLHRSLYEKYSFLRLNYESEYLFRLLWHFSHCCIYHGSLLNS

SEQ ID NO: 2198783 - protein, 17 aa, Cryptosporidium hominis
VLIEDFINKLEAIELLN

SEQ ID NO: 2198784 - protein, 17 aa, Cryptosporidium hominis
VLIFKPNRLIKLSIKLA

SEQ ID NO: 2198785 - protein, 17 aa, Cryptosporidium hominis
VLIPKRIHTILVSVQHD

SEQ ID NO: 2198786 - protein, 27 aa, Cryptosporidium hominis
VLIPLYYGGWVAPNIFYLGSSGVIRVG

SEQ ID NO: 2198787 - protein, 18 aa, Cryptosporidium hominis
VLLALLDQFEERLLFYIS

SEQ ID NO: 2198788 - protein, 43 aa, Cryptosporidium hominis
VLLCLVDSIVRKCRSGSIFFPYFLPYIAPYFAEAYTTKTSPQI

SEQ ID NO: 2198789 - protein, 26 aa, Cryptosporidium hominis
VLLPEIPKIMLNPDSYFKLANMPYYN

SEQ ID NO: 2198790 - protein, 25 aa, Cryptosporidium hominis
VLLQSLLVERGLSLLPSLPPKTLFT

SEQ ID NO: 2198791 - protein, 17 aa, Cryptosporidium hominis
VLLRKLDGFDTLNSKTL

SEQ ID NO: 2198792 - protein, 18 aa, Cryptosporidium hominis
VLNNLINIIKKRGNNNSS

SEQ ID NO: 2198793 - protein, 17 aa, Cryptosporidium hominis
VLNSWNKIGRMQNEFFE

SEQ ID NO: 2198794 - protein, 22 aa, Cryptosporidium hominis
VLNYQYILDPKVAQASLLGGGT

SEQ ID NO: 2198795 - protein, 26 aa, Cryptosporidium hominis
VLPLGRRIHWKPLTEEMAQKTIFREI

SEQ ID NO: 2198796 - protein, 21 aa, Cryptosporidium hominis
VLPNIPTVLLPKKSKSKQGNS

SEQ ID NO: 2198797 - protein, 20 aa, Cryptosporidium hominis
VLQGYLNFWKRSNGLPVPVD

SEQ ID NO: 2198798 - protein, 29 aa, Cryptosporidium hominis
VLQRSPAGFHLFTTCYWDQANDGSVTHRW

SEQ ID NO: 2198799 - protein, 22 aa, Cryptosporidium hominis
VLRAMNPHPNPSPPKGKWLTTP

SEQ ID NO: 2198800 - protein, 18 aa, Cryptosporidium hominis
VLRSLIWSMNKRNEELST

SEQ ID NO: 2198801 - protein, 17 aa, Cryptosporidium hominis
VLRYYCPFCNGACNCER

SEQ ID NO: 2198802 - protein, 18 aa, Cryptosporidium hominis
VLSCPYPVNINIKSTFNY

SEQ ID NO: 2198803 - protein, 18 aa, Cryptosporidium hominis
VLSFFDFFSENISDDNID

SEQ ID NO: 2198804 - protein, 18 aa, Cryptosporidium hominis
VLSLIYFKTKTELFELIS

SEQ ID NO: 2198805 - protein, 24 aa, Cryptosporidium hominis
VLSTFLEFYHSLLKFVNFKLYQLN

SEQ ID NO: 2198806 - protein, 18 aa, Cryptosporidium hominis
VLSTWPPYRWSNNEIFVF

SEQ ID NO: 2198807 - protein, 27 aa, Cryptosporidium hominis
VLVHEYLPFQLMYWNRYGKFYSVINNS

SEQ ID NO: 2198808 - protein, 31 aa, Cryptosporidium hominis
VLVNNDDLCIILKPPFWYCPIEGTGMDEDEQ

SEQ ID NO: 2198809 - protein, 24 aa, Cryptosporidium hominis
VLYNFINYFNQWSSFLKASQYIYN

SEQ ID NO: 2198810 - protein, 33 aa, Cryptosporidium hominis
VMARRVLGTSLPLITRRLVFKSGGDIFGRIRSN

SEQ ID NO: 2198811 - protein, 28 aa, Cryptosporidium hominis
VMKKFEYKMRLVYSHFPINSNILNNGSL

SEQ ID NO: 2198812 - protein, 24 aa, Cryptosporidium hominis
VMKNPQWFKLYIHYEPDSYKEIDG

SEQ ID NO: 2198813 - protein, 18 aa, Cryptosporidium hominis
VMNLLPIIISVIKGRLTA

SEQ ID NO: 2198814 - protein, 19 aa, Cryptosporidium hominis
VMPGYPFASLAGVPCVIPP

SEQ ID NO: 2198815 - protein, 28 aa, Cryptosporidium hominis
VMQGVELVLLRLGISFYFSLCQIMDHPF

SEQ ID NO: 2198816 - protein, 24 aa, Cryptosporidium hominis
VMTKPKYSWRNEFSRLSKLYGANV

SEQ ID NO: 2198817 - protein, 17 aa, Cryptosporidium hominis
VNCGLPVEAWIETKLEN

SEQ ID NO: 2198818 - protein, 24 aa, Cryptosporidium hominis
VNDILYKSFQPLYIHKQNSSIIYS

SEQ ID NO: 2198819 - protein, 21 aa, Cryptosporidium hominis
VNECISIIIPLIQGYDELDTC

SEQ ID NO: 2198820 - protein, 26 aa, Cryptosporidium hominis
VNEGKVYFFTVKSSPLFYYNDFSCSS

SEQ ID NO: 2198821 - protein, 33 aa, Cryptosporidium hominis
VNESIREFFMRTKTYWLNLIMKEEMGGISDGKD

SEQ ID NO: 2198822 - protein, 29 aa, Cryptosporidium hominis
VNESNIFLNNKIEMLKILAANFGATQEDI

SEQ ID NO: 2198823 - protein, 25 aa, Cryptosporidium hominis
VNFKPSFIFVPPTPNNRADSPRILE

SEQ ID NO: 2198824 - protein, 27 aa, Cryptosporidium hominis
VNFSDELCRCLIIVSLPFPQKTEMLFN

SEQ ID NO: 2198825 - protein, 19 aa, Cryptosporidium hominis
VNFYFAALRILHQLKRKTP

SEQ ID NO: 2198826 - protein, 19 aa, Cryptosporidium hominis
VNGLYKLYKDYGPLYYCTV

SEQ ID NO: 2198827 - protein, 23 aa, Cryptosporidium hominis
VNHSFPLYFLPSKNEDSISLLFI

SEQ ID NO: 2198828 - protein, 31 aa, Cryptosporidium hominis
VNKDRFIDFKNTLLDLIHWNVVPIINENDSV

SEQ ID NO: 2198829 - protein, 24 aa, Cryptosporidium hominis
VNKDSYLILDKLPPEYDSRVKAME

SEQ ID NO: 2198830 - protein, 18 aa, Cryptosporidium hominis
VNKKKLPKYFYSSALYIS

SEQ ID NO: 2198831 - protein, 34 aa, Cryptosporidium hominis
VNKNNSILCVLPRTPIDRLCLSPIPNVKSDIYEE

SEQ ID NO: 2198832 - protein, 22 aa, Cryptosporidium hominis
VNKYRLCIRNIPTKIKSSELND

SEQ ID NO: 2198833 - protein, 26 aa, Cryptosporidium hominis
VNNDVWSLIYTYYRKITLDISQIGIS

SEQ ID NO: 2198834 - protein, 26 aa, Cryptosporidium hominis
VNNKQYIPLKNFADQNILVLPNLQNS

SEQ ID NO: 2198835 - protein, 24 aa, Cryptosporidium hominis
VNNLIEMFQLPREKIHSLLSKMML

SEQ ID NO: 2198836 - protein, 18 aa, Cryptosporidium hominis
VNNLLPCITPPDSPILKS

SEQ ID NO: 2198837 - protein, 22 aa, Cryptosporidium hominis
VNNQFLLNQAIGLGVGVGIGVE

SEQ ID NO: 2198838 - protein, 20 aa, Cryptosporidium hominis
VNRTRNIYIVTPLNYDGNKV

SEQ ID NO: 2198839 - protein, 25 aa, Cryptosporidium hominis
VNSEKKILKQLSYINQYKLSSGHSI

SEQ ID NO: 2198840 - protein, 24 aa, Cryptosporidium hominis
VNSNPVLTIFPPHSPNFNFTNHVN

SEQ ID NO: 2198841 - protein, 19 aa, Cryptosporidium hominis
VNTLHHPPPFYTSQQNKNV

SEQ ID NO: 2198842 - protein, 30 aa, Cryptosporidium hominis
VNTSNLRWAFRSLYKFAFGDIAYAKKIGED

SEQ ID NO: 2198843 - protein, 25 aa, Cryptosporidium hominis
VNVLKLILQFLLESGLLESYSTLSY

SEQ ID NO: 2198844 - protein, 26 aa, Cryptosporidium hominis
VNVLLQLYITGSRWITQKLTLLSDLH

SEQ ID NO: 2198845 - protein, 18 aa, Cryptosporidium hominis
VNVLPTLFTLKKENLENI

SEQ ID NO: 2198846 - protein, 23 aa, Cryptosporidium hominis
VNVWRYCTEIFDYLSLASLIEDR

SEQ ID NO: 2198847 - protein, 25 aa, Cryptosporidium hominis
VNYKQPCFVYIPPKGELRGGAWVVV

SEQ ID NO: 2198848 - protein, 18 aa, Cryptosporidium hominis
VNYLMFRQPMIPGVSCWN

SEQ ID NO: 2198849 - protein, 17 aa, Cryptosporidium hominis
VPAMPPVKKDAPAAPPM

SEQ ID NO: 2198850 - protein, 28 aa, Cryptosporidium hominis
VPAQPQNMPPIIPPTPQGVAQQLSQMMG

SEQ ID NO: 2198851 - protein, 17 aa, Cryptosporidium hominis
VPEAPLDNLWLNQNFQI

SEQ ID NO: 2198852 - protein, 25 aa, Cryptosporidium hominis
VPFNHPDLLLNSKPKIFPVFGKRPI

SEQ ID NO: 2198853 - protein, 19 aa, Cryptosporidium hominis
VPGALWVQESMLFKIFNDE

SEQ ID NO: 2198854 - protein, 25 aa, Cryptosporidium hominis
VPHGKEWLVMLNSDDWKYGGAMFGP

SEQ ID NO: 2198855 - protein, 35 aa, Cryptosporidium hominis
VPHLVKDYVPAFSGKFAFLPQPPLDGSSSTGDYSE

SEQ ID NO: 2198856 - protein, 50 aa, Cryptosporidium hominis
VPHNIFMDEIPIFKEFTFFLSLRRSLLELRKKIWRLYSIIETKSSVIKLW

SEQ ID NO: 2198857 - protein, 17 aa, Cryptosporidium hominis
VPIAYPPRIVPVPKPYI

SEQ ID NO: 2198858 - protein, 25 aa, Cryptosporidium hominis
VPIINYIIEMLLKNGVTEIYLLAYS

SEQ ID NO: 2198859 - protein, 29 aa, Cryptosporidium hominis
VPISNLSLNYLIFILKTLCSKRIFDLKST

SEQ ID NO: 2198860 - protein, 27 aa, Cryptosporidium hominis
VPLIPFEMLKWMEFLIRMTRELVPSSL

SEQ ID NO: 2198861 - protein, 21 aa, Cryptosporidium hominis
VPLKFLFPTDRVANISFEAFI

SEQ ID NO: 2198862 - protein, 25 aa, Cryptosporidium hominis
VPMSKRYLKYLTKKYLKKQQIRDFL

SEQ ID NO: 2198863 - protein, 24 aa, Cryptosporidium hominis
VPNAQLYFKLELPPNHTLKGNYIK

SEQ ID NO: 2198864 - protein, 26 aa, Cryptosporidium hominis
VPNLSMTMIFMESPPLSTLRTKKNEN

SEQ ID NO: 2198865 - protein, 25 aa, Cryptosporidium hominis
VPQNQPTMQPPPGRQVFGYAVVPNI

SEQ ID NO: 2198866 - protein, 24 aa, Cryptosporidium hominis
VPQVNDYLYFFPNAYICSGLDDIF

SEQ ID NO: 2198867 - protein, 35 aa, Cryptosporidium hominis
VPRIKKLRAQYWFEKFYWFISSDGYLIIGGHDASQ

SEQ ID NO: 2198868 - protein, 28 aa, Cryptosporidium hominis
VPRNTTIGEFLEKCRIKLKSEFKEFSRL

SEQ ID NO: 2198869 - protein, 26 aa, Cryptosporidium hominis
VPTDPESPAFWFAEASYLRDEKEKIN

SEQ ID NO: 2198870 - protein, 19 aa, Cryptosporidium hominis
VPYGKRIHVLPFDDCLEGI

SEQ ID NO: 2198871 - protein, 26 aa, Cryptosporidium hominis
VPYGVFHPKFILLVFEHLVQPKKNFV

SEQ ID NO: 2198872 - protein, 17 aa, Cryptosporidium hominis
VPYPYTSSDLYESTFRH

SEQ ID NO: 2198873 - protein, 21 aa, Cryptosporidium hominis
VQDSIIRLSNKWPEYIKLGDS

SEQ ID NO: 2198874 - protein, 19 aa, Cryptosporidium hominis
VQDYILYPSSCCGYIINSS

SEQ ID NO: 2198875 - protein, 23 aa, Cryptosporidium hominis
VQEAYLEICNYISDILEVRLNSD

SEQ ID NO: 2198876 - protein, 29 aa, Cryptosporidium hominis
VQELRPLPDLRFTRLCELTKRGDICRDVN

SEQ ID NO: 2198877 - protein, 17 aa, Cryptosporidium hominis
VQGREFLIMGRNFTLSD

SEQ ID NO: 2198878 - protein, 24 aa, Cryptosporidium hominis
VQIAQLLLMLKSKLSSLTNPEAGN

SEQ ID NO: 2198879 - protein, 20 aa, Cryptosporidium hominis
VQINDLFYNMPSRQRAMGSA

SEQ ID NO: 2198880 - protein, 27 aa, Cryptosporidium hominis
VQIRSHAQKYFLKKVRGIAPSTLTMDS

SEQ ID NO: 2198881 - protein, 28 aa, Cryptosporidium hominis
VQISYRWFCIHLLPKYYLIIQFSITNKS

SEQ ID NO: 2198882 - protein, 17 aa, Cryptosporidium hominis
VQIVTPRPLVIDDDDHS

SEQ ID NO: 2198883 - protein, 25 aa, Cryptosporidium hominis
VQKEIPLNAFLYPESKNAIFPQKNR

SEQ ID NO: 2198884 - protein, 17 aa, Cryptosporidium hominis
VQKFSIPTVLNGRDLMA

SEQ ID NO: 2198885 - protein, 18 aa, Cryptosporidium hominis
VQLPSCRSLRTSIRINRS

SEQ ID NO: 2198886 - protein, 29 aa, Cryptosporidium hominis
VQQRSAILFTILLIKSLTILSPSSIIEMH

SEQ ID NO: 2198887 - protein, 22 aa, Cryptosporidium hominis
VQQVYDLPWPIGQRENIMFCFG

SEQ ID NO: 2198888 - protein, 26 aa, Cryptosporidium hominis
VQRIRTPLRYRSSLLGALSNRTNSSC

SEQ ID NO: 2198889 - protein, 24 aa, Cryptosporidium hominis
VQRRRLYDITNVLEGIGILKKMGR

SEQ ID NO: 2198890 - protein, 33 aa, Cryptosporidium hominis
VQSLKPNVILLLDSFFHIVVWYGEMIHQWKEQG

SEQ ID NO: 2198891 - protein, 33 aa, Cryptosporidium hominis
VQTQHYKFHVLLTSYEILLADADILCTMPWQFV

SEQ ID NO: 2198892 - protein, 21 aa, Cryptosporidium hominis
VQVYIRSLYQQLKSEMICHIE

SEQ ID NO: 2198893 - protein, 23 aa, Cryptosporidium hominis
VQWIYNMITGRMPLTVDLQTGWV

SEQ ID NO: 2198894 - protein, 24 aa, Cryptosporidium hominis
VQYHPPINWVLLESDLISGRINNQ

SEQ ID NO: 2198895 - protein, 24 aa, Cryptosporidium hominis
VQYQLNPIFQKTLSKFLYEGDIFN

SEQ ID NO: 2198896 - protein, 21 aa, Cryptosporidium hominis
VQYRIPLLNCHVGDWQPVDSD

SEQ ID NO: 2198897 - protein, 24 aa, Cryptosporidium hominis
VRAQFEAVAKFKRGLKHKDKSDSG

SEQ ID NO: 2198898 - protein, 27 aa, Cryptosporidium hominis
VRDGCLDYFFFFKTPMDLITVSNLLLD

SEQ ID NO: 2198899 - protein, 26 aa, Cryptosporidium hominis
VRDLFYRQMSLPLSGLPDLLDEYRIW

SEQ ID NO: 2198900 - protein, 20 aa, Cryptosporidium hominis
VRELGYCSDWIVLNMLGKFQ

SEQ ID NO: 2198901 - protein, 20 aa, Cryptosporidium hominis
VRETILSAMLFFAEMDRNIT

SEQ ID NO: 2198902 - protein, 47 aa, Cryptosporidium hominis
VRITDIPFIWMNVVQRYQIVNSWNKLKFFLVNGYKDLYPAFLRQADA

SEQ ID NO: 2198903 - protein, 23 aa, Cryptosporidium hominis
VRKLSIETLLRYSNDFDIIVAES

SEQ ID NO: 2198904 - protein, 31 aa, Cryptosporidium hominis
VRLVQSYLNIWISLFWNSLINKSKKKKVSNK

SEQ ID NO: 2198905 - protein, 18 aa, Cryptosporidium hominis
VRMEVSLTIIEPFELDEE

SEQ ID NO: 2198906 - protein, 17 aa, Cryptosporidium hominis
VRQRYVVAMKMLSLNNS

SEQ ID NO: 2198907 - protein, 22 aa, Cryptosporidium hominis
VRSGSIAYASFGKVCIWGGIDE

SEQ ID NO: 2198908 - protein, 17 aa, Cryptosporidium hominis
VRVAGGWVRDKILRFIY

SEQ ID NO: 2198909 - protein, 17 aa, Cryptosporidium hominis
VRYSKIIRCSSGLSPKA

SEQ ID NO: 2198910 - protein, 25 aa, Cryptosporidium hominis
VSAIEPEWLNFYAPHIFKLNINDSN

SEQ ID NO: 2198911 - protein, 18 aa, Cryptosporidium hominis
VSAVPFDYYPYSPRYKYP

SEQ ID NO: 2198912 - protein, 24 aa, Cryptosporidium hominis
VSCRDFEHKITLIQKSRDELEMEY

SEQ ID NO: 2198913 - protein, 18 aa, Cryptosporidium hominis
VSDLNFGLSLYARDDYIK

SEQ ID NO: 2198914 - protein, 26 aa, Cryptosporidium hominis
VSDNYLALYLVLTDTGTIVPISERRN

SEQ ID NO: 2198915 - protein, 19 aa, Cryptosporidium hominis
VSDWRMTAIPFNCLMKIVP

SEQ ID NO: 2198916 - protein, 20 aa, Cryptosporidium hominis
VSEFIPEIIDFISTIISRGF

SEQ ID NO: 2198917 - protein, 24 aa, Cryptosporidium hominis
VSEILYGNFISLSLSRINGAIIQI

SEQ ID NO: 2198918 - protein, 32 aa, Cryptosporidium hominis
VSELIRCLRRNGTLLIYVWAFEQKKGTVGSRD

SEQ ID NO: 2198919 - protein, 18 aa, Cryptosporidium hominis
VSFGSFYRRVSNKGPSIL

SEQ ID NO: 2198920 - protein, 27 aa, Cryptosporidium hominis
VSFVRRDRVVFLGSPPELPERVNPDPG

SEQ ID NO: 2198921 - protein, 21 aa, Cryptosporidium hominis
VSGDIFLLSPKFFNTLDRTES

SEQ ID NO: 2198922 - protein, 18 aa, Cryptosporidium hominis
VSGKLRAQRAKSMKFRDG

SEQ ID NO: 2198923 - protein, 23 aa, Cryptosporidium hominis
VSGKLVRWLIQNGGQGEKGQAYV

SEQ ID NO: 2198924 - protein, 25 aa, Cryptosporidium hominis
VSGKTVILIPLRLLEEFMSLEEQRS

SEQ ID NO: 2198925 - protein, 25 aa, Cryptosporidium hominis
VSIDQIKIPFLLKNNMREYQVAGLE

SEQ ID NO: 2198926 - protein, 27 aa, Cryptosporidium hominis
VSIERDLIFVFQLMEYFNNPEFYTKLT

SEQ ID NO: 2198927 - protein, 23 aa, Cryptosporidium hominis
VSIKYLKHFLPNATNMMPSSCIA

SEQ ID NO: 2198928 - protein, 20 aa, Cryptosporidium hominis
VSIPFFDGSWQPSSFYDKIK

SEQ ID NO: 2198929 - protein, 28 aa, Cryptosporidium hominis
VSIRLDFDQLLPIIILGNDRLYLEELKA

SEQ ID NO: 2198930 - protein, 17 aa, Cryptosporidium hominis
VSISTYPQFIPSVKHSL

SEQ ID NO: 2198931 - protein, 20 aa, Cryptosporidium hominis
VSIWMILEHFVGVSPTLFLN

SEQ ID NO: 2198932 - protein, 19 aa, Cryptosporidium hominis
VSKIWLPTEYEMSITPNWS

SEQ ID NO: 2198933 - protein, 28 aa, Cryptosporidium hominis
VSKPSWDGGRLVKLLQGHGLNIENYEKE

SEQ ID NO: 2198934 - protein, 26 aa, Cryptosporidium hominis
VSLKKDIDIYFISLSKDANMYREIEY

SEQ ID NO: 2198935 - protein, 21 aa, Cryptosporidium hominis
VSLKRSIVYDSSLGCCVPLYT

SEQ ID NO: 2198936 - protein, 28 aa, Cryptosporidium hominis
VSLMFNYGMREMFVSGLPGLRVKCLILN

SEQ ID NO: 2198937 - protein, 33 aa, Cryptosporidium hominis
VSLPSKQEILLPRAYPLPAKREKTRWEKFAELK

SEQ ID NO: 2198938 - protein, 18 aa, Cryptosporidium hominis
VSLRMKVMHLCRQKELNI

SEQ ID NO: 2198939 - protein, 25 aa, Cryptosporidium hominis
VSLSCKGYCFSAAPWSQIAAEASLP

SEQ ID NO: 2198940 - protein, 26 aa, Cryptosporidium hominis
VSMDSLPEIIISNKLQKLILSMDDQI

SEQ ID NO: 2198941 - protein, 24 aa, Cryptosporidium hominis
VSMIGQFGVGFYSAYLVADKVTVI

SEQ ID NO: 2198942 - protein, 17 aa, Cryptosporidium hominis
VSMLPCICLDPKPGHFV

SEQ ID NO: 2198943 - protein, 26 aa, Cryptosporidium hominis
VSMSGRFLMVKLAADPFPFETKRSDA

SEQ ID NO: 2198944 - protein, 31 aa, Cryptosporidium hominis
VSNDHQNILSIYFFQSYLALRDLENQNICSG

SEQ ID NO: 2198945 - protein, 17 aa, Cryptosporidium hominis
VSNFILSSLLNQELPIY

SEQ ID NO: 2198946 - protein, 22 aa, Cryptosporidium hominis
VSNIWKVYQRHPRDSGFQLQKV

SEQ ID NO: 2198947 - protein, 26 aa, Cryptosporidium hominis
VSNNALFLELMKNPFPKFFNVGLNVS

SEQ ID NO: 2198948 - protein, 25 aa, Cryptosporidium hominis
VSNPDPHLKWQIPSFIIGGNPRLQG

SEQ ID NO: 2198949 - protein, 33 aa, Cryptosporidium hominis
VSNTPKMESSILELISFFGFKYDEKSQKLLDNF

SEQ ID NO: 2198950 - protein, 23 aa, Cryptosporidium hominis
VSNVFRCYLLELYSLKLEKYLDK

SEQ ID NO: 2198951 - protein, 24 aa, Cryptosporidium hominis
VSQCILPLPIIHQGPMINGSSRTS

SEQ ID NO: 2198952 - protein, 34 aa, Cryptosporidium hominis
VSQDFDEFMRFSVLLTVLFGLKDPIDPKVFKLRI

SEQ ID NO: 2198953 - protein, 25 aa, Cryptosporidium hominis
VSQHIHEWIDLIFGFKQRGPQAYSS

SEQ ID NO: 2198954 - protein, 24 aa, Cryptosporidium hominis
VSRDLLFHLYCLFSENIQNGDLNN

SEQ ID NO: 2198955 - protein, 19 aa, Cryptosporidium hominis
VSRFKNVNLLAMHFPSSFT

SEQ ID NO: 2198956 - protein, 27 aa, Cryptosporidium hominis
VSRKIVRGLLMVWKAKLDQVSAEAWIT

SEQ ID NO: 2198957 - protein, 19 aa, Cryptosporidium hominis
VSRLLIVKNSPLLERFRID

SEQ ID NO: 2198958 - protein, 25 aa, Cryptosporidium hominis
VSSATKLFILELMAKINKQLNDSGS

SEQ ID NO: 2198959 - protein, 33 aa, Cryptosporidium hominis
VSSDESLFCFIWKNILLIWNTQYPDKIIRFRHS

SEQ ID NO: 2198960 - protein, 23 aa, Cryptosporidium hominis
VSSGFSINWVLDADWSFLNNHKL

SEQ ID NO: 2198961 - protein, 22 aa, Cryptosporidium hominis
VSSIGRIFKPFNPLLGETFEFS

SEQ ID NO: 2198962 - protein, 28 aa, Cryptosporidium hominis
VSSNQYFGPFEAPPLHIIGYNPVISGYD

SEQ ID NO: 2198963 - protein, 30 aa, Cryptosporidium hominis
VSSRSHAIFQLSIFLERKKLFNVSANNNPH

SEQ ID NO: 2198964 - protein, 20 aa, Cryptosporidium hominis
VSTEPIPSMISLGGLNGNLT

SEQ ID NO: 2198965 - protein, 21 aa, Cryptosporidium hominis
VSTNMRKGTYISILNIIRGET

SEQ ID NO: 2198966 - protein, 34 aa, Cryptosporidium hominis
VSTSSIFTPLSTKTRFLPILPTSPRKEIYENLKS

SEQ ID NO: 2198967 - protein, 26 aa, Cryptosporidium hominis
VSVSTPTKLLLWYGQNRIIDLFVKND

SEQ ID NO: 2198968 - protein, 20 aa, Cryptosporidium hominis
VSWMYKSGFLHIPIHSITQI

SEQ ID NO: 2198969 - protein, 29 aa, Cryptosporidium hominis
VSWNSRMEAWLAFFVENGVRKSKTFSSRK

SEQ ID NO: 2198970 - protein, 27 aa, Cryptosporidium hominis
VTAHKSCFIHYFIYNDINNRISNFLKG

SEQ ID NO: 2198971 - protein, 25 aa, Cryptosporidium hominis
VTATYNFWLYELCDVYLELVKSRFK

SEQ ID NO: 2198972 - protein, 22 aa, Cryptosporidium hominis
VTCRDWFQLTLKEGLTVYRDQE

SEQ ID NO: 2198973 - protein, 20 aa, Cryptosporidium hominis
VTDILFKIIDSIIKEPRKGK

SEQ ID NO: 2198974 - protein, 28 aa, Cryptosporidium hominis
VTDYNNMILSNMLLLNGALSGSSPSNIN

SEQ ID NO: 2198975 - protein, 25 aa, Cryptosporidium hominis
VTEESFFVDNFRWQCIVLDEAHRIK

SEQ ID NO: 2198976 - protein, 21 aa, Cryptosporidium hominis
VTEIYLLAYSHKDLLIDHIEG

SEQ ID NO: 2198977 - protein, 18 aa, Cryptosporidium hominis
VTFAIIDFERLIMVQLGS

SEQ ID NO: 2198978 - protein, 21 aa, Cryptosporidium hominis
VTFDIIRRVLEDYFGYDVYLV

SEQ ID NO: 2198979 - protein, 27 aa, Cryptosporidium hominis
VTFDKSIINIIAYKKILHSLESVKLQI

SEQ ID NO: 2198980 - protein, 25 aa, Cryptosporidium hominis
VTFRNIYRLILFISEIKLSKNYNYF

SEQ ID NO: 2198981 - protein, 17 aa, Cryptosporidium hominis
VTGFLGSGKTTLLRHII

SEQ ID NO: 2198982 - protein, 26 aa, Cryptosporidium hominis
VTGFVGRILLVKLIEEFKNMQIVCLV

SEQ ID NO: 2198983 - protein, 33 aa, Cryptosporidium hominis
VTGLPAPPTLATPPGLATPPSAPVLPGINGFHA

SEQ ID NO: 2198984 - protein, 23 aa, Cryptosporidium hominis
VTGSHLLNGWNTSGSSPSKDGST

SEQ ID NO: 2198985 - protein, 25 aa, Cryptosporidium hominis
VTGSWHHVRILLTGSRIQIWVGTEA

SEQ ID NO: 2198986 - protein, 20 aa, Cryptosporidium hominis
VTHLLPRIDEFWIKYIQMEL

SEQ ID NO: 2198987 - protein, 23 aa, Cryptosporidium hominis
VTHSPILVKIKFLDSAEISSLST

SEQ ID NO: 2198988 - protein, 19 aa, Cryptosporidium hominis
VTITPKFAASPPKPASGAA

SEQ ID NO: 2198989 - protein, 27 aa, Cryptosporidium hominis
VTKAHPNPFLPIKKVQKRSGFSGCIMN

SEQ ID NO: 2198990 - protein, 27 aa, Cryptosporidium hominis
VTKEFEKLILLYYVIGQREYMEKLGKI

SEQ ID NO: 2198991 - protein, 22 aa, Cryptosporidium hominis
VTKKQPLIVLDSSKFNWDSTDD

SEQ ID NO: 2198992 - protein, 25 aa, Cryptosporidium hominis
VTKLKDIFIEWKYPAIDFNIDLSEN

SEQ ID NO: 2198993 - protein, 25 aa, Cryptosporidium hominis
VTKVIFRIFKYQLYSQIYSHPSYFE

SEQ ID NO: 2198994 - protein, 19 aa, Cryptosporidium hominis
VTLSYLKSSSFLKHYLISE

SEQ ID NO: 2198995 - protein, 30 aa, Cryptosporidium hominis
VTNGFSKWQVCRSFLATLMLSNNREIDILQ

SEQ ID NO: 2198996 - protein, 17 aa, Cryptosporidium hominis
VTPFEKNLEFWRQLWRT

SEQ ID NO: 2198997 - protein, 28 aa, Cryptosporidium hominis
VTSSILMEYFLQFGVILDAVVMYDNVSG

SEQ ID NO: 2198998 - protein, 26 aa, Cryptosporidium hominis
VTTATIGIVQVFWGLDKKLAQRKHFP

SEQ ID NO: 2198999 - protein, 17 aa, Cryptosporidium hominis
VTTCHVPLLLNFQQYIE

SEQ ID NO: 2199000 - protein, 27 aa, Cryptosporidium hominis
VTTTNYNFFLVFLVSIGYTVLAPNYTG

SEQ ID NO: 2199001 - protein, 24 aa, Cryptosporidium hominis
VTTVGALCFQYISNLPRKFSSDVE

SEQ ID NO: 2199002 - protein, 20 aa, Cryptosporidium hominis
VTVYNYFTGRRLSNVTVSRV

SEQ ID NO: 2199003 - protein, 25 aa, Cryptosporidium hominis
VTYKNDLYRLLARYLVERQDLDLWN

SEQ ID NO: 2199004 - protein, 24 aa, Cryptosporidium hominis
VVAPIFVQILHLKSKSMIDIQQEE

SEQ ID NO: 2199005 - protein, 17 aa, Cryptosporidium hominis
VVATNIFKRAFVSILKK

SEQ ID NO: 2199006 - protein, 23 aa, Cryptosporidium hominis
VVAYRHFCNKLWNACKFAFGNIE

SEQ ID NO: 2199007 - protein, 25 aa, Cryptosporidium hominis
VVERPKDPLELPKFKNRILGGVKRE

SEQ ID NO: 2199008 - protein, 31 aa, Cryptosporidium hominis
VVEYVKLFRNKISSILLLNNISRDFRTDIDI

SEQ ID NO: 2199009 - protein, 21 aa, Cryptosporidium hominis
VVFERWDCNIILKEMGKEMAT

SEQ ID NO: 2199010 - protein, 18 aa, Cryptosporidium hominis
VVFKTRVTFQIVPRTRTQ

SEQ ID NO: 2199011 - protein, 24 aa, Cryptosporidium hominis
VVGHCLYMEKIVAPFLVVVPQSTS

SEQ ID NO: 2199012 - protein, 35 aa, Cryptosporidium hominis
VVGHTGISWCVRRKTWRVWFITSGGTRATRSFNPK

SEQ ID NO: 2199013 - protein, 24 aa, Cryptosporidium hominis
VVKALHLHHVLLEGSLLKPNMVTP

SEQ ID NO: 2199014 - protein, 23 aa, Cryptosporidium hominis
VVKSRLKHILNVKKIFVGMGEGN

SEQ ID NO: 2199015 - protein, 17 aa, Cryptosporidium hominis
VVLILKSLGINDLVHFD

SEQ ID NO: 2199016 - protein, 19 aa, Cryptosporidium hominis
VVNSLMSHLYIYKYNEDGL

SEQ ID NO: 2199017 - protein, 18 aa, Cryptosporidium hominis
VVPKDYKPLKKTKKLIIP

SEQ ID NO: 2199018 - protein, 34 aa, Cryptosporidium hominis
VVRGARGLSFQIVNPEVYCVPGTKSYIVFGDAKL

SEQ ID NO: 2199019 - protein, 27 aa, Cryptosporidium hominis
VVSENPFIKGILPLTLSDFPKTTMKFS

SEQ ID NO: 2199020 - protein, 17 aa, Cryptosporidium hominis
VVSNEVLPSWILEKFFV

SEQ ID NO: 2199021 - protein, 25 aa, Cryptosporidium hominis
VVWEEVLILLDPKVQLVLLSATIPN

SEQ ID NO: 2199022 - protein, 17 aa, Cryptosporidium hominis
VVYLSANGDFFKDPKRI

SEQ ID NO: 2199023 - protein, 22 aa, Cryptosporidium hominis
VWEGVAFHLPPGSLLQEAGRFL

SEQ ID NO: 2199024 - protein, 17 aa, Cryptosporidium hominis
VWERDIPPILNRLIERM

SEQ ID NO: 2199025 - protein, 17 aa, Cryptosporidium hominis
VWLLKDKITGKKYAGKL

SEQ ID NO: 2199026 - protein, 19 aa, Cryptosporidium hominis
VWLNTRYSVTLINQKDYRK

SEQ ID NO: 2199027 - protein, 17 aa, Cryptosporidium hominis
VWLYNKLTNLASQNISQ

SEQ ID NO: 2199028 - protein, 25 aa, Cryptosporidium hominis
VWREIFNLCFAFLQINYSKGTKFNV

SEQ ID NO: 2199029 - protein, 20 aa, Cryptosporidium hominis
VWSKELIEYTWLSKLSEGYK

SEQ ID NO: 2199030 - protein, 18 aa, Cryptosporidium hominis
VWTLGCLLHTLVFGYPPY

SEQ ID NO: 2199031 - protein, 19 aa, Cryptosporidium hominis
VYCKFYFQEILEDHVPGYR

SEQ ID NO: 2199032 - protein, 28 aa, Cryptosporidium hominis
VYDGLKSSLLFGFNLDLIKLHALTPRTN

SEQ ID NO: 2199033 - protein, 45 aa, Cryptosporidium hominis
VYGEILIRRLSTLSFRSRILCLCQSFFKLEAPGILRKLLQIISRM

SEQ ID NO: 2199034 - protein, 22 aa, Cryptosporidium hominis
VYIKRGNSLYFWDKLKYNNQSL

SEQ ID NO: 2199035 - protein, 19 aa, Cryptosporidium hominis
VYKAIKYYLNSLRSKQRRL

SEQ ID NO: 2199036 - protein, 18 aa, Cryptosporidium hominis
VYLEYTSRFFIDSGLFKK

SEQ ID NO: 2199037 - protein, 36 aa, Cryptosporidium hominis
VYLKLEIYEFKIIGIGILLLLRQKLDLKEFYTCIGL

SEQ ID NO: 2199038 - protein, 18 aa, Cryptosporidium hominis
VYLPHTNFPMLPRVFSSN

SEQ ID NO: 2199039 - protein, 27 aa, Cryptosporidium hominis
VYNIGVGDWFLIPDNTNYNFSNTSDHS

SEQ ID NO: 2199040 - protein, 26 aa, Cryptosporidium hominis
VYPEIRFIIFMNDREYFRSSNTGKLV

SEQ ID NO: 2199041 - protein, 17 aa, Cryptosporidium hominis
VYRILACYNSIVFGVLR

SEQ ID NO: 2199042 - protein, 24 aa, Cryptosporidium hominis
VYSEKISILILYQLLVCVDYLHEH

SEQ ID NO: 2199043 - protein, 21 aa, Cryptosporidium hominis
VYSKWLEVILNYFVCNEFSTD

SEQ ID NO: 2199044 - protein, 24 aa, Cryptosporidium hominis
VYTLIGEWLTKYKSGKLPKAFSII

SEQ ID NO: 2199045 - protein, 17 aa, Cryptosporidium hominis
VYTLPDGLTLHDEHTNK

SEQ ID NO: 2199046 - protein, 24 aa, Cryptosporidium hominis
VYVDGWPHIILTSIPGIGIKLGDE

SEQ ID NO: 2199047 - protein, 20 aa, Cryptosporidium hominis
VYVGNLPWKAKWHDLKDHMR

SEQ ID NO: 2199048 - protein, 33 aa, Cryptosporidium hominis
VYVTIRFKFPKVVKKRFTYYLDSSLRTLSSQTV

SEQ ID NO: 2199049 - protein, 20 aa, Cryptosporidium hominis
VYVYDNKKYWLKYSIEIIRQ

SEQ ID NO: 2199050 - protein, 17 aa, Cryptosporidium hominis
VYYLELCGEYALYIDSN

SEQ ID NO: 2199051 - protein, 26 aa, Cryptosporidium hominis
WAIACCLLEIFGGPIPFYEYSSNEEV

SEQ ID NO: 2199052 - protein, 22 aa, Cryptosporidium hominis
WAIGICLYEFLCGCLPFGNDAV

SEQ ID NO: 2199053 - protein, 27 aa, Cryptosporidium hominis
WALGVTIWCWFYGTLPFQGNSILELFD

SEQ ID NO: 2199054 - protein, 26 aa, Cryptosporidium hominis
WAQCELCKKWRKLPLGMNPNTLPEEW

SEQ ID NO: 2199055 - protein, 27 aa, Cryptosporidium hominis
WCEYPKSLLGCTWYYNPNRSNLKDIRN

SEQ ID NO: 2199056 - protein, 18 aa, Cryptosporidium hominis
WCGSCLLDLIRRCQRLAS

SEQ ID NO: 2199057 - protein, 39 aa, Cryptosporidium hominis
WCRMVVRRLLVYFIEADRIFLNYLYRKPQGQGYKYIDIY

SEQ ID NO: 2199058 - protein, 18 aa, Cryptosporidium hominis
WDAIWCESKIYLPNFERA

SEQ ID NO: 2199059 - protein, 19 aa, Cryptosporidium hominis
WDKGPDLIFPRYGHAITKL

SEQ ID NO: 2199060 - protein, 34 aa, Cryptosporidium hominis
WDKTNILDLVRQFIKIRFPFVLVLNKADIMSESS

SEQ ID NO: 2199061 - protein, 17 aa, Cryptosporidium hominis
WDLDEVLQIRTIFANVS

SEQ ID NO: 2199062 - protein, 24 aa, Cryptosporidium hominis
WEALKILKSRCSIPFIANGGISNY

SEQ ID NO: 2199063 - protein, 17 aa, Cryptosporidium hominis
WEFKEILLYCGEASSCG

SEQ ID NO: 2199064 - protein, 31 aa, Cryptosporidium hominis
WEHVKGSSKLFFLDKLLMQLHRENCKYIPNY

SEQ ID NO: 2199065 - protein, 26 aa, Cryptosporidium hominis
WEKNFTRYFNLLLSSLNQHGCVGTPF

SEQ ID NO: 2199066 - protein, 30 aa, Cryptosporidium hominis
WEKPSKYHKIPQFINYKLPSAEIKVDGNIV

SEQ ID NO: 2199067 - protein, 26 aa, Cryptosporidium hominis
WENETSLLSYYYYGSLQLTSSIFNVF

SEQ ID NO: 2199068 - protein, 20 aa, Cryptosporidium hominis
WENLLTLSLLLEIFIASKFQ

SEQ ID NO: 2199069 - protein, 17 aa, Cryptosporidium hominis
WEYNFVHMARRLSTNDE

SEQ ID NO: 2199070 - protein, 17 aa, Cryptosporidium hominis
WFDSTKGFGFITPDDGS

SEQ ID NO: 2199071 - protein, 18 aa, Cryptosporidium hominis
WFVGLNVHVLPFPSLCKF

SEQ ID NO: 2199072 - protein, 27 aa, Cryptosporidium hominis
WFYDHYTINVFPINNIKFNTLQGLLSQ

SEQ ID NO: 2199073 - protein, 17 aa, Cryptosporidium hominis
WGIFYKKVNKIILNIKN

SEQ ID NO: 2199074 - protein, 17 aa, Cryptosporidium hominis
WGKLGLVRLYTKKKGEF

SEQ ID NO: 2199075 - protein, 26 aa, Cryptosporidium hominis
WGKSKWKDFIFWDKTKNSWVGLLRPN

SEQ ID NO: 2199076 - protein, 25 aa, Cryptosporidium hominis
WGLDDYQFLPFLFGSAQLINSNELF

SEQ ID NO: 2199077 - protein, 27 aa, Cryptosporidium hominis
WGSAKVLMIIQFWQTSLTFTDRIVNNR

SEQ ID NO: 2199078 - protein, 20 aa, Cryptosporidium hominis
WHECCLCFRRATQAGGLLIH

SEQ ID NO: 2199079 - protein, 20 aa, Cryptosporidium hominis
WHLQYLYEDLPTQLTTPINN

SEQ ID NO: 2199080 - protein, 26 aa, Cryptosporidium hominis
WHSILCICIYYKYISGVFYISQHCNL

SEQ ID NO: 2199081 - protein, 18 aa, Cryptosporidium hominis
WIAVCYLFSKYKKKDNCL

SEQ ID NO: 2199082 - protein, 17 aa, Cryptosporidium hominis
WIAVERFFRSVTKSLAP

SEQ ID NO: 2199083 - protein, 17 aa, Cryptosporidium hominis
WILDFEKIKLNEFKERS

SEQ ID NO: 2199084 - protein, 17 aa, Cryptosporidium hominis
WILNERLDVPYISLHKM

SEQ ID NO: 2199085 - protein, 25 aa, Cryptosporidium hominis
WITNQIFLVGFSNGLIRILQVTKQC

SEQ ID NO: 2199086 - protein, 29 aa, Cryptosporidium hominis
WKDKESRVYARFTWATRKYSKSFYVGPNK

SEQ ID NO: 2199087 - protein, 23 aa, Cryptosporidium hominis
WKEICHYIFTFRIYKDFNEIESG

SEQ ID NO: 2199088 - protein, 19 aa, Cryptosporidium hominis
WKKAFHFCNEALKLDPDYP

SEQ ID NO: 2199089 - protein, 18 aa, Cryptosporidium hominis
WKKLIPVQVLSKTGNKIF

SEQ ID NO: 2199090 - protein, 31 aa, Cryptosporidium hominis
WKPGNLQRFLHLFIINQLFSENLVQLKNGVS

SEQ ID NO: 2199091 - protein, 18 aa, Cryptosporidium hominis
WKRIPKERSCIFLDSINE

SEQ ID NO: 2199092 - protein, 26 aa, Cryptosporidium hominis
WKRSGVNLLFGLQITFNVPDEVTVIA

SEQ ID NO: 2199093 - protein, 23 aa, Cryptosporidium hominis
WKSIGIYEKMFFGRYSDGGHFGP

SEQ ID NO: 2199094 - protein, 17 aa, Cryptosporidium hominis
WLCNRYPLIVKELKDAI

SEQ ID NO: 2199095 - protein, 23 aa, Cryptosporidium hominis
WLESRLEIPSEWFLHTGREYNTI

SEQ ID NO: 2199096 - protein, 37 aa, Cryptosporidium hominis
WLESSTLKIIIPLMKYMEPVYLRWRKWNKKYKRLMDG

SEQ ID NO: 2199097 - protein, 19 aa, Cryptosporidium hominis
WLIKAPYPVFYPSTPLQKR

SEQ ID NO: 2199098 - protein, 18 aa, Cryptosporidium hominis
WLKKQICKINPSLPPNEI

SEQ ID NO: 2199099 - protein, 24 aa, Cryptosporidium hominis
WLNQIEELYKPLEYPKLCNRTYKN

SEQ ID NO: 2199100 - protein, 17 aa, Cryptosporidium hominis
WLQQIQQEHIQAIELLK

SEQ ID NO: 2199101 - protein, 18 aa, Cryptosporidium hominis
WLSPPELFSRMFNSLNSE

SEQ ID NO: 2199102 - protein, 19 aa, Cryptosporidium hominis
WLTYLRREHPTLAFKSALN

SEQ ID NO: 2199103 - protein, 28 aa, Cryptosporidium hominis
WMSQDQLLQLLLFRPNSTESKYSVSIPS

SEQ ID NO: 2199104 - protein, 26 aa, Cryptosporidium hominis
WMSVYQPISFLNMKKIGLPLSNVYMS

SEQ ID NO: 2199105 - protein, 24 aa, Cryptosporidium hominis
WNELIEVLKYIKIPANLQIILFEH

SEQ ID NO: 2199106 - protein, 24 aa, Cryptosporidium hominis
WNKQEFVGPLPFQNKVAIGNRSCL

SEQ ID NO: 2199107 - protein, 23 aa, Cryptosporidium hominis
WNKSWSVPYDLLFDVYISLLDSS

SEQ ID NO: 2199108 - protein, 25 aa, Cryptosporidium hominis
WNMKPLSHMYLANSLIEKIKDSKNL

SEQ ID NO: 2199109 - protein, 29 aa, Cryptosporidium hominis
WNNIRRTHFFWDQKSNKILIICLELIYGI

SEQ ID NO: 2199110 - protein, 27 aa, Cryptosporidium hominis
WNQTEYKGRMLRINMSADKPQPGSLSS

SEQ ID NO: 2199111 - protein, 17 aa, Cryptosporidium hominis
WNRLFGKKEMRILMVGL

SEQ ID NO: 2199112 - protein, 22 aa, Cryptosporidium hominis
WNSKDFLKVMFLQSMLGEYGTN

SEQ ID NO: 2199113 - protein, 26 aa, Cryptosporidium hominis
WPDEVVPLLMRRLADIEYRLSRGASE

SEQ ID NO: 2199114 - protein, 18 aa, Cryptosporidium hominis
WPGKVKYPDFLNPKVREI

SEQ ID NO: 2199115 - protein, 20 aa, Cryptosporidium hominis
WPGMFRGIFGAHYLHEDLYT

SEQ ID NO: 2199116 - protein, 18 aa, Cryptosporidium hominis
WPHLVVLTIPGIEIKQGD

SEQ ID NO: 2199117 - protein, 27 aa, Cryptosporidium hominis
WPKADCILILRNMPFDIPINGFNSLFV

SEQ ID NO: 2199118 - protein, 17 aa, Cryptosporidium hominis
WPPPDTDYQALLKERNL

SEQ ID NO: 2199119 - protein, 20 aa, Cryptosporidium hominis
WPYQEPEIIFYHPPSSFSIL

SEQ ID NO: 2199120 - protein, 17 aa, Cryptosporidium hominis
WQLPLDPEFQEMVKSEI

SEQ ID NO: 2199121 - protein, 20 aa, Cryptosporidium hominis
WRASLNILLLLARCSNLVLI

SEQ ID NO: 2199122 - protein, 19 aa, Cryptosporidium hominis
WRATTLDELVEDCAFNIIR

SEQ ID NO: 2199123 - protein, 25 aa, Cryptosporidium hominis
WRHQLLCHCIPFNRFCYNLCNSGIL

SEQ ID NO: 2199124 - protein, 27 aa, Cryptosporidium hominis
WRHRSFVLCCLRYISVIISWDTFLEEM

SEQ ID NO: 2199125 - protein, 28 aa, Cryptosporidium hominis
WRIRQIFRQFQILRNNPFWWTHQKHDGK

SEQ ID NO: 2199126 - protein, 19 aa, Cryptosporidium hominis
WRKWNKKYKRLMDGLCIFM

SEQ ID NO: 2199127 - protein, 24 aa, Cryptosporidium hominis
WRNISELRGWWIKVGQFLSTRGDL

SEQ ID NO: 2199128 - protein, 19 aa, Cryptosporidium hominis
WRREEDMWIGFLDDLPDEF

SEQ ID NO: 2199129 - protein, 24 aa, Cryptosporidium hominis
WSCGVILYALLCGSLPFDDENVGN

SEQ ID NO: 2199130 - protein, 25 aa, Cryptosporidium hominis
WSDGTYSLLINDELVYDCVIGPDKA

SEQ ID NO: 2199131 - protein, 18 aa, Cryptosporidium hominis
WSERWSERSGYKEAWKKG

SEQ ID NO: 2199132 - protein, 26 aa, Cryptosporidium hominis
WSFESQILPCPQLCKYIDYSLKNCKP

SEQ ID NO: 2199133 - protein, 21 aa, Cryptosporidium hominis
WSHDFNQLNFPNIKEMCGSIN

SEQ ID NO: 2199134 - protein, 31 aa, Cryptosporidium hominis
WSKCYVLFCRNIIIIFLVNFTLRSELDEENC

SEQ ID NO: 2199135 - protein, 20 aa, Cryptosporidium hominis
WSKFVGLMKNSLNISILNRP

SEQ ID NO: 2199136 - protein, 21 aa, Cryptosporidium hominis
WSKLKKRTPLSWVWNNQIYDQ

SEQ ID NO: 2199137 - protein, 27 aa, Cryptosporidium hominis
WSLCNDKFMLIAYKWSNKESLKEIMEF

SEQ ID NO: 2199138 - protein, 18 aa, Cryptosporidium hominis
WSLGCVLAGLIFKRDPFF

SEQ ID NO: 2199139 - protein, 24 aa, Cryptosporidium hominis
WSNIRSFFNILINKVFLADLSNIK

SEQ ID NO: 2199140 - protein, 31 aa, Cryptosporidium hominis
WSNSTKINLSLYWDESSSYLFDNTHSKIILF

SEQ ID NO: 2199141 - protein, 18 aa, Cryptosporidium hominis
WSPALTLRTVMLSIQALL

SEQ ID NO: 2199142 - protein, 21 aa, Cryptosporidium hominis
WSPLGSYFVLGGSGGNLTFCQ

SEQ ID NO: 2199143 - protein, 25 aa, Cryptosporidium hominis
WSVGCILGELVLQQPLFCSETEAGV

SEQ ID NO: 2199144 - protein, 27 aa, Cryptosporidium hominis
WTDEEHNRFVLALKKFGRNWTLVQQEV

SEQ ID NO: 2199145 - protein, 17 aa, Cryptosporidium hominis
WTDFSVQWSPMGSYLVT

SEQ ID NO: 2199146 - protein, 29 aa, Cryptosporidium hominis
WTEAQRYDLIFKDILLRDMNRMDAMYNRD

SEQ ID NO: 2199147 - protein, 18 aa, Cryptosporidium hominis
WTEIYNGAKLFYLSGIHN

SEQ ID NO: 2199148 - protein, 19 aa, Cryptosporidium hominis
WTFHTPEDLTFLRKVRSGL

SEQ ID NO: 2199149 - protein, 33 aa, Cryptosporidium hominis
WTPSKMIHFLGEKLIMMNLSIIGATKIIYQFSV

SEQ ID NO: 2199150 - protein, 18 aa, Cryptosporidium hominis
WTTRIEKILKAAAFMQQL

SEQ ID NO: 2199151 - protein, 18 aa, Cryptosporidium hominis
WTVPTDKDDIILKSAKEN

SEQ ID NO: 2199152 - protein, 25 aa, Cryptosporidium hominis
WVGDSRVVIYKFTKPIYKGLDSLDK

SEQ ID NO: 2199153 - protein, 20 aa, Cryptosporidium hominis
WVHDFRLKSILFINWRRYSK

SEQ ID NO: 2199154 - protein, 25 aa, Cryptosporidium hominis
WVIISGFPRHLISLIRPKLEYEIGP

SEQ ID NO: 2199155 - protein, 17 aa, Cryptosporidium hominis
WVNCSHISKFIGFNGFT

SEQ ID NO: 2199156 - protein, 18 aa, Cryptosporidium hominis
WVVYLSFMEDYENFMEIK

SEQ ID NO: 2199157 - protein, 17 aa, Cryptosporidium hominis
WWGHRIPAYKIISSKLN

SEQ ID NO: 2199158 - protein, 28 aa, Cryptosporidium hominis
WYDSSFSIPKLLPIKVPPVSKLIESGLI

SEQ ID NO: 2199159 - protein, 23 aa, Cryptosporidium hominis
YADNFATGYFRKQGFRKEVSMPK

SEQ ID NO: 2199160 - protein, 18 aa, Cryptosporidium hominis
YANKYEGKLLLRFDDTNP

SEQ ID NO: 2199161 - protein, 28 aa, Cryptosporidium hominis
YANPGPIQYFNLFKNLFNRTLFESEYVY

SEQ ID NO: 2199162 - protein, 30 aa, Cryptosporidium hominis
YARQQTVQLLRALILLTQSLSPLPESRYMS

SEQ ID NO: 2199163 - protein, 25 aa, Cryptosporidium hominis
YASDYFDQLYEWAKKLILAGKAYVD

SEQ ID NO: 2199164 - protein, 26 aa, Cryptosporidium hominis
YCAASLTTFYRPKRLKIAILDHIPCD

SEQ ID NO: 2199165 - protein, 20 aa, Cryptosporidium hominis
YCDRSFLKRNLKIHLRYFCG

SEQ ID NO: 2199166 - protein, 32 aa, Cryptosporidium hominis
YCGMHTELSLYEELLKYLFSKRDLNEETFESI

SEQ ID NO: 2199167 - protein, 17 aa, Cryptosporidium hominis
YCHMRGFPYCRIDGNTS

SEQ ID NO: 2199168 - protein, 34 aa, Cryptosporidium hominis
YCIDMFEYIAYLLQKLYDIILSESYTYFKSSEKF

SEQ ID NO: 2199169 - protein, 23 aa, Cryptosporidium hominis
YCINNLLTFISILGEIKKLTNNS

SEQ ID NO: 2199170 - protein, 18 aa, Cryptosporidium hominis
YCLLQSNIFLCHELKYPY

SEQ ID NO: 2199171 - protein, 17 aa, Cryptosporidium hominis
YCLRFIEFKNTSFRWGE

SEQ ID NO: 2199172 - protein, 24 aa, Cryptosporidium hominis
YCLRYPCLINYLFKLYSRIVDEIN

SEQ ID NO: 2199173 - protein, 19 aa, Cryptosporidium hominis
YCNEFAFLKHCRLPFPFDD

SEQ ID NO: 2199174 - protein, 22 aa, Cryptosporidium hominis
YCPIKLISFVLALSSDILWVHD

SEQ ID NO: 2199175 - protein, 25 aa, Cryptosporidium hominis
YCPNAFVICITNPLDAMVYYFKEKS

SEQ ID NO: 2199176 - protein, 18 aa, Cryptosporidium hominis
YCQNIQRFKKSQGIFMII

SEQ ID NO: 2199177 - protein, 37 aa, Cryptosporidium hominis
YCRYFKLCKKAPWKSRYLFEIFRNRQLIIALTTMTKA

SEQ ID NO: 2199178 - protein, 17 aa, Cryptosporidium hominis
YCSLCGLSGRMHTRRSC

SEQ ID NO: 2199179 - protein, 17 aa, Cryptosporidium hominis
YCTNLGETDLLLKLFEE

SEQ ID NO: 2199180 - protein, 19 aa, Cryptosporidium hominis
YCTVSQKNWFIWRDKQNRS

SEQ ID NO: 2199181 - protein, 25 aa, Cryptosporidium hominis
YCVKRQILSIAPTLAQQLLLVDEVI

SEQ ID NO: 2199182 - protein, 30 aa, Cryptosporidium hominis
YCYGQVQLAYPFLPLPIILLKEEDTFLVQL

SEQ ID NO: 2199183 - protein, 24 aa, Cryptosporidium hominis
YDCQMVKRLVIKYLDLPEGTSIRD

SEQ ID NO: 2199184 - protein, 28 aa, Cryptosporidium hominis
YDDPEFMKFYSLKLPMKLANEFSRFVNN

SEQ ID NO: 2199185 - protein, 30 aa, Cryptosporidium hominis
YDECFVKGTLILPNRLRYLQKRKVGIKLQG

SEQ ID NO: 2199186 - protein, 26 aa, Cryptosporidium hominis
YDEEIDLFKKVYYLSDLRELGSIDID

SEQ ID NO: 2199187 - protein, 25 aa, Cryptosporidium hominis
YDFIGKFKCILCPKKIIINESDLDK

SEQ ID NO: 2199188 - protein, 30 aa, Cryptosporidium hominis
YDFNQVTFIPAYLLTLYSYGKETGIVVDIG

SEQ ID NO: 2199189 - protein, 17 aa, Cryptosporidium hominis
YDGGYVTGSWHHVRILL

SEQ ID NO: 2199190 - protein, 25 aa, Cryptosporidium hominis
YDIFESIVLVYRYRLSHLISTAYHL

SEQ ID NO: 2199191 - protein, 19 aa, Cryptosporidium hominis
YDIKWNYFGNILATTNKDR

SEQ ID NO: 2199192 - protein, 17 aa, Cryptosporidium hominis
YDIPILSYLKNITSEWT

SEQ ID NO: 2199193 - protein, 18 aa, Cryptosporidium hominis
YDKFKVIIYNVLEKLPLN

SEQ ID NO: 2199194 - protein, 18 aa, Cryptosporidium hominis
YDKKRALLKKTKKGQPVL

SEQ ID NO: 2199195 - protein, 22 aa, Cryptosporidium hominis
YDKQILFWDAEYGKTKWKILND

SEQ ID NO: 2199196 - protein, 17 aa, Cryptosporidium hominis
YDKVGHWSGFTSIGKAT

SEQ ID NO: 2199197 - protein, 26 aa, Cryptosporidium hominis
YDLINTKAIYLTFLSSCKFFNDIITL

SEQ ID NO: 2199198 - protein, 20 aa, Cryptosporidium hominis
YDNTIIAWAPSSQLLGHDEV

SEQ ID NO: 2199199 - protein, 26 aa, Cryptosporidium hominis
YDPKYVNSIIFRMRRICNHTLLHQGH

SEQ ID NO: 2199200 - protein, 24 aa, Cryptosporidium hominis
YDQDDIYGWLKRCGKFKATQRTKG

SEQ ID NO: 2199201 - protein, 25 aa, Cryptosporidium hominis
YDQRRKWILNLIKPLGYNRDIQGLT

SEQ ID NO: 2199202 - protein, 17 aa, Cryptosporidium hominis
YDRHLDYLIRVFKELHT

SEQ ID NO: 2199203 - protein, 26 aa, Cryptosporidium hominis
YDRNKVIIQKSLFINELREKVPLKNN

SEQ ID NO: 2199204 - protein, 21 aa, Cryptosporidium hominis
YDTYCQGIIPEYLTNLFSSNE

SEQ ID NO: 2199205 - protein, 24 aa, Cryptosporidium hominis
YEDDEFGIFDFVSAKSPPANDPFK

SEQ ID NO: 2199206 - protein, 17 aa, Cryptosporidium hominis
YEDLGILKRVNAKLPPK

SEQ ID NO: 2199207 - protein, 17 aa, Cryptosporidium hominis
YEEFERWIMSITHPEDH

SEQ ID NO: 2199208 - protein, 21 aa, Cryptosporidium hominis
YEFIEEKLFRIASTLLSCEIA

SEQ ID NO: 2199209 - protein, 18 aa, Cryptosporidium hominis
YEGVLHSIDVDKSTITLK

SEQ ID NO: 2199210 - protein, 17 aa, Cryptosporidium hominis
YEIAEVCYIRRKALLLN

SEQ ID NO: 2199211 - protein, 19 aa, Cryptosporidium hominis
YEILKKDFALLKDEKEMLK

SEQ ID NO: 2199212 - protein, 20 aa, Cryptosporidium hominis
YEISRAFLSKYLGHPLEGVM

SEQ ID NO: 2199213 - protein, 17 aa, Cryptosporidium hominis
YEIYFKSLDQAFEHIIG

SEQ ID NO: 2199214 - protein, 29 aa, Cryptosporidium hominis
YEKCLLEQKILFLKLVIQGVIGLSNKSKE

SEQ ID NO: 2199215 - protein, 27 aa, Cryptosporidium hominis
YEKIVKLITFIITRFNELLFSDEVFEV

SEQ ID NO: 2199216 - protein, 18 aa, Cryptosporidium hominis
YEKSILLIAIKFTETLKI

SEQ ID NO: 2199217 - protein, 18 aa, Cryptosporidium hominis
YELFVSFEKMKLWTKSVL

SEQ ID NO: 2199218 - protein, 29 aa, Cryptosporidium hominis
YEMGIFIRDKLIPYSLYWFTGEAVDEDDE

SEQ ID NO: 2199219 - protein, 31 aa, Cryptosporidium hominis
YENYGSQYLGKIDTFLGIGGKYAKFQAKTRN

SEQ ID NO: 2199220 - protein, 18 aa, Cryptosporidium hominis
YEQAVFPHLNYSKDGEFG

SEQ ID NO: 2199221 - protein, 18 aa, Cryptosporidium hominis
YERFIGQPILVWGDSQLF

SEQ ID NO: 2199222 - protein, 22 aa, Cryptosporidium hominis
YERLKFVLNWYNKNCINTIELP

SEQ ID NO: 2199223 - protein, 30 aa, Cryptosporidium hominis
YESLIDSFRFERGLSLFLEIPKETIKYIYS

SEQ ID NO: 2199224 - protein, 23 aa, Cryptosporidium hominis
YETSMLHFAYIINTKIRLQMVDA

SEQ ID NO: 2199225 - protein, 18 aa, Cryptosporidium hominis
YEWHFMPENITNIEKITV

SEQ ID NO: 2199226 - protein, 17 aa, Cryptosporidium hominis
YEWLDPRVKKTEWSRAE

SEQ ID NO: 2199227 - protein, 17 aa, Cryptosporidium hominis
YEYWALSLESFTSLKST

SEQ ID NO: 2199228 - protein, 26 aa, Cryptosporidium hominis
YFADVEPRLSVLYKLLVKISSTHNQV

SEQ ID NO: 2199229 - protein, 21 aa, Cryptosporidium hominis
YFDWLVFRINNPMTNGLMNNN

SEQ ID NO: 2199230 - protein, 18 aa, Cryptosporidium hominis
YFETLLTMARKKIIKIIT

SEQ ID NO: 2199231 - protein, 17 aa, Cryptosporidium hominis
YFFPHKNSMSQFLPNKK

SEQ ID NO: 2199232 - protein, 26 aa, Cryptosporidium hominis
YFGEIKAFKFILMEIGFESIIADMKM

SEQ ID NO: 2199233 - protein, 37 aa, Cryptosporidium hominis
YFIEEPFIRNIPSTLLSTLELKRLRYFTIKSIPTSIS

SEQ ID NO: 2199234 - protein, 17 aa, Cryptosporidium hominis
YFIINGMEKVLVGQERM

SEQ ID NO: 2199235 - protein, 19 aa, Cryptosporidium hominis
YFIIPTDHYSMPLILLLFP

SEQ ID NO: 2199236 - protein, 18 aa, Cryptosporidium hominis
YFISVFPVNKVIGPDFNN

SEQ ID NO: 2199237 - protein, 18 aa, Cryptosporidium hominis
YFKNIRAGKIAIYNSDDE

SEQ ID NO: 2199238 - protein, 17 aa, Cryptosporidium hominis
YFLEVVKLLIQFLGISS

SEQ ID NO: 2199239 - protein, 22 aa, Cryptosporidium hominis
YFQDVNMCLLRSAIFEGINELL

SEQ ID NO: 2199240 - protein, 20 aa, Cryptosporidium hominis
YFQKIMYPISDNYSFIEING

SEQ ID NO: 2199241 - protein, 19 aa, Cryptosporidium hominis
YFREIFSSLLLKPFNKTEE

SEQ ID NO: 2199242 - protein, 18 aa, Cryptosporidium hominis
YFRLLIDRSIEIRNWRRG

SEQ ID NO: 2199243 - protein, 20 aa, Cryptosporidium hominis
YFSHIFIYNFDEKTISLVKY

SEQ ID NO: 2199244 - protein, 19 aa, Cryptosporidium hominis
YFSIVRLKIKYMEIDIIRL

SEQ ID NO: 2199245 - protein, 25 aa, Cryptosporidium hominis
YFSSKCLLARGIPDWDFISNDDKIS

SEQ ID NO: 2199246 - protein, 17 aa, Cryptosporidium hominis
YFTCVWIQISKQRDSLF

SEQ ID NO: 2199247 - protein, 30 aa, Cryptosporidium hominis
YFTEDEVLFIFFQILLGVKYLHDNNIVHCD

SEQ ID NO: 2199248 - protein, 19 aa, Cryptosporidium hominis
YFTTYSQNTLYLLVNYQDI

SEQ ID NO: 2199249 - protein, 17 aa, Cryptosporidium hominis
YFVEEKVRLFTGLNFDH

SEQ ID NO: 2199250 - protein, 45 aa, Cryptosporidium hominis
YGAEKAMRKAFFPKLLTWLSLPQTLQRYFLAPWIVWSMDKDDSCQ

SEQ ID NO: 2199251 - protein, 24 aa, Cryptosporidium hominis
YGDFESFNKLPYFRESINNQKRPC

SEQ ID NO: 2199252 - protein, 31 aa, Cryptosporidium hominis
YGDGEYLDPYKIQLLPNGRVYYFPRDHVCDF

SEQ ID NO: 2199253 - protein, 26 aa, Cryptosporidium hominis
YGEIKPTFFIGEKKLHITLGLVRAET

SEQ ID NO: 2199254 - protein, 17 aa, Cryptosporidium hominis
YGELRFSTRIFKNALVF

SEQ ID NO: 2199255 - protein, 25 aa, Cryptosporidium hominis
YGENSYPFFPPGVQPAPIDGDENNT

SEQ ID NO: 2199256 - protein, 25 aa, Cryptosporidium hominis
YGFVFPIMIRLKILHHHLLFLCKEG

SEQ ID NO: 2199257 - protein, 21 aa, Cryptosporidium hominis
YGGQLVQMNRKTFTIYCIISE

SEQ ID NO: 2199258 - protein, 17 aa, Cryptosporidium hominis
YGIDFKVAQPGDMKELG

SEQ ID NO: 2199259 - protein, 28 aa, Cryptosporidium hominis
YGIKTNILIRWIIHISKQLLHPIMNENE

SEQ ID NO: 2199260 - protein, 17 aa, Cryptosporidium hominis
YGIVWKSIDRRTGEVVA

SEQ ID NO: 2199261 - protein, 20 aa, Cryptosporidium hominis
YGKFDWTDHRCYEGQYINDK

SEQ ID NO: 2199262 - protein, 23 aa, Cryptosporidium hominis
YGKNRFMKLYYKFQVEEAAIKKY

SEQ ID NO: 2199263 - protein, 23 aa, Cryptosporidium hominis
YGKSPFIYPVYGLGGLPEGFSRL

SEQ ID NO: 2199264 - protein, 20 aa, Cryptosporidium hominis
YGPGPLEFKGKDGWLIEPQE

SEQ ID NO: 2199265 - protein, 19 aa, Cryptosporidium hominis
YGPKIDIMLWDALKRQHQC

SEQ ID NO: 2199266 - protein, 28 aa, Cryptosporidium hominis
YGPVRDVYLPLDYYTRRPRGFGFVEYMD

SEQ ID NO: 2199267 - protein, 25 aa, Cryptosporidium hominis
YGQPNYRLNYLKSMKEWEVTTIPIK

SEQ ID NO: 2199268 - protein, 24 aa, Cryptosporidium hominis
YGQTKFMIELMMKDIYTASKNTKF

SEQ ID NO: 2199269 - protein, 23 aa, Cryptosporidium hominis
YGRLLIDLLRFICNELQIYKIIC

SEQ ID NO: 2199270 - protein, 21 aa, Cryptosporidium hominis
YGSFRYNILISTPGDILCAKG

SEQ ID NO: 2199271 - protein, 17 aa, Cryptosporidium hominis
YGSPLTAFLKALEFREN

SEQ ID NO: 2199272 - protein, 22 aa, Cryptosporidium hominis
YGSSCPFVKSVLGRIFVNPTGN

SEQ ID NO: 2199273 - protein, 21 aa, Cryptosporidium hominis
YGSVRPFGCSILLGGLDQDRG

SEQ ID NO: 2199274 - protein, 32 aa, Cryptosporidium hominis
YGTPNVWRYFTDLFDYLPLSALIDNKIFCPHA

SEQ ID NO: 2199275 - protein, 20 aa, Cryptosporidium hominis
YGVFYAWARLKEQEIRNLTW

SEQ ID NO: 2199276 - protein, 18 aa, Cryptosporidium hominis
YGVIPFNCKIESRTFSKI

SEQ ID NO: 2199277 - protein, 31 aa, Cryptosporidium hominis
YGYKFPVTKSLLPTIYPYLSIQFIAQVENSK

SEQ ID NO: 2199278 - protein, 18 aa, Cryptosporidium hominis
YHAIIGKTDYVVKIICLK

SEQ ID NO: 2199279 - protein, 23 aa, Cryptosporidium hominis
YHELKVAMRALGFEVKKAQVLEI

SEQ ID NO: 2199280 - protein, 23 aa, Cryptosporidium hominis
YHEVPLTRRLNVVYIPSTTAVLV

SEQ ID NO: 2199281 - protein, 21 aa, Cryptosporidium hominis
YHKAPLFLFSSTINSYFGFNS

SEQ ID NO: 2199282 - protein, 17 aa, Cryptosporidium hominis
YHLNEEILFLTVHFMDN

SEQ ID NO: 2199283 - protein, 26 aa, Cryptosporidium hominis
YHTRSGFLSSLSRRLWDLEETLSFTN

SEQ ID NO: 2199284 - protein, 18 aa, Cryptosporidium hominis
YIDILPPRNHSSLLLNLL

SEQ ID NO: 2199285 - protein, 23 aa, Cryptosporidium hominis
YIDSFESLPWKGQTMFSNFRELQ

SEQ ID NO: 2199286 - protein, 18 aa, Cryptosporidium hominis
YIEFVAAVISPKLSCRKD

SEQ ID NO: 2199287 - protein, 19 aa, Cryptosporidium hominis
YIFLLKYKHNNNLDNETSL

SEQ ID NO: 2199288 - protein, 24 aa, Cryptosporidium hominis
YIGKFKFIYVVKLKNQRNAALKQL

SEQ ID NO: 2199289 - protein, 18 aa, Cryptosporidium hominis
YIGLNQLLQPVQHPHLNP

SEQ ID NO: 2199290 - protein, 30 aa, Cryptosporidium hominis
YIHRECIDDLFQGLFYIIIGQQVSQKAQVS

SEQ ID NO: 2199291 - protein, 17 aa, Cryptosporidium hominis
YIIDILTLHSEGSIYLD

SEQ ID NO: 2199292 - protein, 17 aa, Cryptosporidium hominis
YIIMEYCDEGDLGNILK

SEQ ID NO: 2199293 - protein, 17 aa, Cryptosporidium hominis
YIIPKIQNLIIPQSPTL

SEQ ID NO: 2199294 - protein, 17 aa, Cryptosporidium hominis
YIISLLKSKCGAGFTSK

SEQ ID NO: 2199295 - protein, 17 aa, Cryptosporidium hominis
YIKGFNILNKMLLKENR

SEQ ID NO: 2199296 - protein, 17 aa, Cryptosporidium hominis
YIKGQCAIIMFDVTSRI

SEQ ID NO: 2199297 - protein, 19 aa, Cryptosporidium hominis
YIKHRSFLKAEFIPINKYS

SEQ ID NO: 2199298 - protein, 19 aa, Cryptosporidium hominis
YILGHVYMAPDSKSLQIMI

SEQ ID NO: 2199299 - protein, 36 aa, Cryptosporidium hominis
YILNSHLIFGDLRPSWSLYYLLKKIICKEMSGYYVQ

SEQ ID NO: 2199300 - protein, 17 aa, Cryptosporidium hominis
YILPIRSVGVQGDFRTY

SEQ ID NO: 2199301 - protein, 19 aa, Cryptosporidium hominis
YILQGPYLALSVDAYVKLI

SEQ ID NO: 2199302 - protein, 18 aa, Cryptosporidium hominis
YILVGTPGRIFHLFENLK

SEQ ID NO: 2199303 - protein, 26 aa, Cryptosporidium hominis
YINLSKEQLYKIIYQKHDELQQMKLQ

SEQ ID NO: 2199304 - protein, 20 aa, Cryptosporidium hominis
YINRDMFPDLFSSKYNQKSS

SEQ ID NO: 2199305 - protein, 24 aa, Cryptosporidium hominis
YINTKICMNYLWNGGINSSRFIKK

SEQ ID NO: 2199306 - protein, 18 aa, Cryptosporidium hominis
YIPGNDSFKFRDESKLLK

SEQ ID NO: 2199307 - protein, 21 aa, Cryptosporidium hominis
YIPIYIHYYCSQKILGKLSME

SEQ ID NO: 2199308 - protein, 17 aa, Cryptosporidium hominis
YIPLLNEVIEQILHESI

SEQ ID NO: 2199309 - protein, 27 aa, Cryptosporidium hominis
YIQDVKYIHPLGYSPSFNKYTQINSLL

SEQ ID NO: 2199310 - protein, 31 aa, Cryptosporidium hominis
YIQRINSWWNDIWLIRMRYPRCEGSTMRYFF

SEQ ID NO: 2199311 - protein, 20 aa, Cryptosporidium hominis
YIQSRFRISPTIKTLGCLNK

SEQ ID NO: 2199312 - protein, 29 aa, Cryptosporidium hominis
YIRHSSQIIPGWYLNKFPSAKNSLSFVYV

SEQ ID NO: 2199313 - protein, 17 aa, Cryptosporidium hominis
YIRSWDLRKKGFFSQVL

SEQ ID NO: 2199314 - protein, 24 aa, Cryptosporidium hominis
YISNKYYEHKLPSGFQRPSWSSQQ

SEQ ID NO: 2199315 - protein, 17 aa, Cryptosporidium hominis
YISTSCPEPYYPKIFGF

SEQ ID NO: 2199316 - protein, 20 aa, Cryptosporidium hominis
YITCMDIVALLFHVTSKSSS

SEQ ID NO: 2199317 - protein, 19 aa, Cryptosporidium hominis
YITLFIPDNYKGILIWKST

SEQ ID NO: 2199318 - protein, 25 aa, Cryptosporidium hominis
YIVNWLMFAPHNDSIWNYIISFFSK

SEQ ID NO: 2199319 - protein, 28 aa, Cryptosporidium hominis
YIYGEENIRYFLYWRRMRMQLKREERRQ

SEQ ID NO: 2199320 - protein, 21 aa, Cryptosporidium hominis
YIYKLHVWASNYYFIHQNFSK

SEQ ID NO: 2199321 - protein, 17 aa, Cryptosporidium hominis
YIYSIKGGNLLINNEKD

SEQ ID NO: 2199322 - protein, 29 aa, Cryptosporidium hominis
YKCFLHELKLKLIEIFRINSEKFKIQYKL

SEQ ID NO: 2199323 - protein, 26 aa, Cryptosporidium hominis
YKCLVEWSCLTLDILPDKLGDNRTQF

SEQ ID NO: 2199324 - protein, 21 aa, Cryptosporidium hominis
YKDFVEIMTQKILERDPREEI

SEQ ID NO: 2199325 - protein, 26 aa, Cryptosporidium hominis
YKDSTLIMQLLRDNLTLWTADLGASG

SEQ ID NO: 2199326 - protein, 18 aa, Cryptosporidium hominis
YKEDNKVWLVAPKSSPGI

SEQ ID NO: 2199327 - protein, 29 aa, Cryptosporidium hominis
YKEFRNLLTQLLILPELRDLFDEYKDPDT

SEQ ID NO: 2199328 - protein, 28 aa, Cryptosporidium hominis
YKGEESFDFVPIKENLDDFSIGNTDLRL

SEQ ID NO: 2199329 - protein, 28 aa, Cryptosporidium hominis
YKIGDLVYSLWKGQLWKAIILDTSLKIH

SEQ ID NO: 2199330 - protein, 26 aa, Cryptosporidium hominis
YKIITKPMDFSLIRKKLRNGEYELCR

SEQ ID NO: 2199331 - protein, 19 aa, Cryptosporidium hominis
YKIMGFNKPLESLNGIWKR

SEQ ID NO: 2199332 - protein, 17 aa, Cryptosporidium hominis
YKIMTKSKELGTWNKVK

SEQ ID NO: 2199333 - protein, 23 aa, Cryptosporidium hominis
YKKMNKFLKFSPLTYAPIQKEMI

SEQ ID NO: 2199334 - protein, 20 aa, Cryptosporidium hominis
YKKQNLISLEKFNLSSKKAT

SEQ ID NO: 2199335 - protein, 25 aa, Cryptosporidium hominis
YKNCHPLIIFKYKDKLLSYRPRVHF

SEQ ID NO: 2199336 - protein, 20 aa, Cryptosporidium hominis
YKNELDFFYSRQFLSGQFFV

SEQ ID NO: 2199337 - protein, 30 aa, Cryptosporidium hominis
YKNKMKGNMIFMASLVRKKVIASTVVLMCM

SEQ ID NO: 2199338 - protein, 26 aa, Cryptosporidium hominis
YKNNISDIISSALFRDVFLIENSEDV

SEQ ID NO: 2199339 - protein, 24 aa, Cryptosporidium hominis
YKQRSHLIDYLNNRLYNVAPNLQS

SEQ ID NO: 2199340 - protein, 22 aa, Cryptosporidium hominis
YKRPPSIGTPILTPPSAKTAVH

SEQ ID NO: 2199341 - protein, 23 aa, Cryptosporidium hominis
YKRTHEGIFLINLAKTWEKIQIA

SEQ ID NO: 2199342 - protein, 17 aa, Cryptosporidium hominis
YKSLLEEIQYMESTLIL

SEQ ID NO: 2199343 - protein, 21 aa, Cryptosporidium hominis
YKSMTFYLQEHPELLNSLLML

SEQ ID NO: 2199344 - protein, 24 aa, Cryptosporidium hominis
YKTGSILFAPFFNKIKRLFKKNVN

SEQ ID NO: 2199345 - protein, 43 aa, Cryptosporidium hominis
YKTIKDCIDFYYKYKYTLGFKRILRLVYYFKGSHNKNQINMNH

SEQ ID NO: 2199346 - protein, 29 aa, Cryptosporidium hominis
YLETISVFGIIHKPKIILLNINNIISESN

SEQ ID NO: 2199347 - protein, 18 aa, Cryptosporidium hominis
YLETPQYLRKTLFKFDND

SEQ ID NO: 2199348 - protein, 17 aa, Cryptosporidium hominis
YLFLVQKNEYLISRLEY

SEQ ID NO: 2199349 - protein, 17 aa, Cryptosporidium hominis
YLFVNNTIPKAGSLMQE

SEQ ID NO: 2199350 - protein, 20 aa, Cryptosporidium hominis
YLGTWWRTEFNYSPLPYLPP

SEQ ID NO: 2199351 - protein, 17 aa, Cryptosporidium hominis
YLGVSRETAILIATKRR

SEQ ID NO: 2199352 - protein, 18 aa, Cryptosporidium hominis
YLHQIGRLVWEGVAFHLP

SEQ ID NO: 2199353 - protein, 19 aa, Cryptosporidium hominis
YLIHTFSFSKGKSSYIDKN

SEQ ID NO: 2199354 - protein, 18 aa, Cryptosporidium hominis
YLIIAGNIIRLLDTAKET

SEQ ID NO: 2199355 - protein, 27 aa, Cryptosporidium hominis
YLIKIKRPICAIPNLAIHLTTSEERSS

SEQ ID NO: 2199356 - protein, 17 aa, Cryptosporidium hominis
YLITQFIQSNPPALALR

SEQ ID NO: 2199357 - protein, 27 aa, Cryptosporidium hominis
YLKAMLRKYMNAGCKINKILNGEKITS

SEQ ID NO: 2199358 - protein, 18 aa, Cryptosporidium hominis
YLLPDLAPKVTSSLQLEE

SEQ ID NO: 2199359 - protein, 19 aa, Cryptosporidium hominis
YLMVDIAHYSGLVVAGKYP

SEQ ID NO: 2199360 - protein, 17 aa, Cryptosporidium hominis
YLNDVKALYIQLKEKSD

SEQ ID NO: 2199361 - protein, 21 aa, Cryptosporidium hominis
YLNNIIYRRRFKDCFNIWRGL

SEQ ID NO: 2199362 - protein, 17 aa, Cryptosporidium hominis
YLNPLHFASVFPTLIHI

SEQ ID NO: 2199363 - protein, 25 aa, Cryptosporidium hominis
YLNPNAQEFIPRGWVNPTNEPFINH

SEQ ID NO: 2199364 - protein, 19 aa, Cryptosporidium hominis
YLNPPMISLLIRAFSNTRD

SEQ ID NO: 2199365 - protein, 20 aa, Cryptosporidium hominis
YLREKYGILSIIEEKKKDIL

SEQ ID NO: 2199366 - protein, 28 aa, Cryptosporidium hominis
YLSELHVKTLLYNLLVGLKYIHSAGIYH

SEQ ID NO: 2199367 - protein, 22 aa, Cryptosporidium hominis
YLSFIHEIGLIELEILFNSVYE

SEQ ID NO: 2199368 - protein, 34 aa, Cryptosporidium hominis
YLSGALLIVAFSNSFLYCLDPHIKVLPSFSDKNF

SEQ ID NO: 2199369 - protein, 18 aa, Cryptosporidium hominis
YLSIIREIFCVLTDTLHT

SEQ ID NO: 2199370 - protein, 20 aa, Cryptosporidium hominis
YLSISLIRFSEYVDGYVLFF

SEQ ID NO: 2199371 - protein, 30 aa, Cryptosporidium hominis
YLTHFDLYLYILFKHLFKRKIKEFKSTTKD

SEQ ID NO: 2199372 - protein, 25 aa, Cryptosporidium hominis
YLTSPVDTIKWSPLGSYFVLGGSGG

SEQ ID NO: 2199373 - protein, 18 aa, Cryptosporidium hominis
YLVDYTDLITLALNLLGN

SEQ ID NO: 2199374 - protein, 17 aa, Cryptosporidium hominis
YLYFGPQVDSKVISEIF

SEQ ID NO: 2199375 - protein, 20 aa, Cryptosporidium hominis
YMEKINLFAERNPQLGLNNV

SEQ ID NO: 2199376 - protein, 18 aa, Cryptosporidium hominis
YMHNNLVSLFSTLVPTPR

SEQ ID NO: 2199377 - protein, 17 aa, Cryptosporidium hominis
YMIGPLEVNLLTKWMGC

SEQ ID NO: 2199378 - protein, 28 aa, Cryptosporidium hominis
YMNSLLQSLYHIGRFRKAVYTIPLNPNR

SEQ ID NO: 2199379 - protein, 24 aa, Cryptosporidium hominis
YMPELDEFISFWCKYREHVEKNGD

SEQ ID NO: 2199380 - protein, 18 aa, Cryptosporidium hominis
YMQTLGGGLGRLLVHMKL

SEQ ID NO: 2199381 - protein, 18 aa, Cryptosporidium hominis
YMQYSIILSIYINNTYNS

SEQ ID NO: 2199382 - protein, 17 aa, Cryptosporidium hominis
YMTYIKAYLARIKETME

SEQ ID NO: 2199383 - protein, 19 aa, Cryptosporidium hominis
YNAMNIVDFVLLNIECILE

SEQ ID NO: 2199384 - protein, 18 aa, Cryptosporidium hominis
YNCPLTILSFKDMFNTTM

SEQ ID NO: 2199385 - protein, 20 aa, Cryptosporidium hominis
YNDIEGMILMSELSKRRIRS

SEQ ID NO: 2199386 - protein, 25 aa, Cryptosporidium hominis
YNDNNIFWMDLGIDLGLNNGFNINN

SEQ ID NO: 2199387 - protein, 30 aa, Cryptosporidium hominis
YNDWPKLLSAHIPLTTLWSRIRLALTRITK

SEQ ID NO: 2199388 - protein, 18 aa, Cryptosporidium hominis
YNENLLRRKGCLTDKSFT

SEQ ID NO: 2199389 - protein, 26 aa, Cryptosporidium hominis
YNFRHRRSIETILFRGKKLENYPLVE

SEQ ID NO: 2199390 - protein, 25 aa, Cryptosporidium hominis
YNINDEYILFLWSKHMILYNFDPKF

SEQ ID NO: 2199391 - protein, 17 aa, Cryptosporidium hominis
YNKLCGLITKLVSGIRK

SEQ ID NO: 2199392 - protein, 18 aa, Cryptosporidium hominis
YNKLPYDNSIQNLNYIQQ

SEQ ID NO: 2199393 - protein, 31 aa, Cryptosporidium hominis
YNKQIFELIQREIIYLFYRDMRNHPQQIPEF

SEQ ID NO: 2199394 - protein, 17 aa, Cryptosporidium hominis
YNKRRAWFSVRSRGVLE

SEQ ID NO: 2199395 - protein, 18 aa, Cryptosporidium hominis
YNMSDFYLRLDGTTPILE

SEQ ID NO: 2199396 - protein, 17 aa, Cryptosporidium hominis
YNNIYSYSPFLYSNNTL

SEQ ID NO: 2199397 - protein, 36 aa, Cryptosporidium hominis
YNNKKIFFLNPVQSQLFHILFYSDENIFLGAPTGSG

SEQ ID NO: 2199398 - protein, 17 aa, Cryptosporidium hominis
YNPIDLNLILLKSITRK

SEQ ID NO: 2199399 - protein, 27 aa, Cryptosporidium hominis
YNQGNLLFQNFQSNYSQFSYGAPNNPY

SEQ ID NO: 2199400 - protein, 17 aa, Cryptosporidium hominis
YNQVFDHVDFETPFTRK

SEQ ID NO: 2199401 - protein, 18 aa, Cryptosporidium hominis
YNRFLSRFGSKQRPVSSK

SEQ ID NO: 2199402 - protein, 19 aa, Cryptosporidium hominis
YNRTNYGLLGILNVIRMTD

SEQ ID NO: 2199403 - protein, 24 aa, Cryptosporidium hominis
YNSCMSFSFYKYLLKGALSEEQAF

SEQ ID NO: 2199404 - protein, 27 aa, Cryptosporidium hominis
YNSKIILKILVFVNFSSSNYDGIHTES

SEQ ID NO: 2199405 - protein, 31 aa, Cryptosporidium hominis
YNSKIWCEKISLPKFPHIMPPPPKNINNLKN

SEQ ID NO: 2199406 - protein, 25 aa, Cryptosporidium hominis
YNSLAKFLLLTHFSQRYFSMPKVEM

SEQ ID NO: 2199407 - protein, 18 aa, Cryptosporidium hominis
YNSLWAELQWDGEKFDKV

SEQ ID NO: 2199408 - protein, 24 aa, Cryptosporidium hominis
YNSPKYRFVVRLTNTKVICQIIYA

SEQ ID NO: 2199409 - protein, 18 aa, Cryptosporidium hominis
YNSSLTLKLKKTLKKKDS

SEQ ID NO: 2199410 - protein, 27 aa, Cryptosporidium hominis
YNSTSCPSCYFSWLRLINSKNGDDNNS

SEQ ID NO: 2199411 - protein, 20 aa, Cryptosporidium hominis
YNSVLTLKRLALNADCVVVL

SEQ ID NO: 2199412 - protein, 30 aa, Cryptosporidium hominis
YNTEYPIIFSSPFHLPFVKEILQIFENSKV

SEQ ID NO: 2199413 - protein, 39 aa, Cryptosporidium hominis
YNTQKFPYNPENFKTFVQILLRLFHDSPAIIVGDCLIRE

SEQ ID NO: 2199414 - protein, 24 aa, Cryptosporidium hominis
YNVRVVRPMIYCREKDLANFALKA

SEQ ID NO: 2199415 - protein, 17 aa, Cryptosporidium hominis
YNYMTSQEELYISKQKS

SEQ ID NO: 2199416 - protein, 23 aa, Cryptosporidium hominis
YNYSLSYKELIPNFNKLSITDDV

SEQ ID NO: 2199417 - protein, 18 aa, Cryptosporidium hominis
YPCIVKNLNYYPLEKEEN

SEQ ID NO: 2199418 - protein, 27 aa, Cryptosporidium hominis
YPEKYLIMSIGFAFKRKITRNRSTGAE

SEQ ID NO: 2199419 - protein, 19 aa, Cryptosporidium hominis
YPIPVPVPVITPRTRDLTR

SEQ ID NO: 2199420 - protein, 19 aa, Cryptosporidium hominis
YPNDVSFQGFPQFLAQFCT

SEQ ID NO: 2199421 - protein, 23 aa, Cryptosporidium hominis
YPNIGREWYIKRWNDIKSIKFQK

SEQ ID NO: 2199422 - protein, 17 aa, Cryptosporidium hominis
YPPPIKILKLCLSSLKV

SEQ ID NO: 2199423 - protein, 22 aa, Cryptosporidium hominis
YPPYQRMLPPQTQSQSIRPPPV

SEQ ID NO: 2199424 - protein, 17 aa, Cryptosporidium hominis
YPQFIPSVKHSLPENSS

SEQ ID NO: 2199425 - protein, 19 aa, Cryptosporidium hominis
YPSCLAGLSLLFQLNIRIL

SEQ ID NO: 2199426 - protein, 28 aa, Cryptosporidium hominis
YPVDDWKVHFLSIIKKNLSRIAMNLIEK

SEQ ID NO: 2199427 - protein, 18 aa, Cryptosporidium hominis
YQADFNIYIYQLNEKSEE

SEQ ID NO: 2199428 - protein, 23 aa, Cryptosporidium hominis
YQALMSILKLWRDKKEHRVLIFT

SEQ ID NO: 2199429 - protein, 18 aa, Cryptosporidium hominis
YQDLDILETFKPGNLLIS

SEQ ID NO: 2199430 - protein, 18 aa, Cryptosporidium hominis
YQEQALRMMFSNGRARSG

SEQ ID NO: 2199431 - protein, 23 aa, Cryptosporidium hominis
YQFKYIERYLHDVFFNYDQSHKK

SEQ ID NO: 2199432 - protein, 20 aa, Cryptosporidium hominis
YQIELIILVGFVVKTFKSIW

SEQ ID NO: 2199433 - protein, 27 aa, Cryptosporidium hominis
YQILTRIAMDTSLRYSLHLLTVSQVLA

SEQ ID NO: 2199434 - protein, 24 aa, Cryptosporidium hominis
YQLIPSIVRILSYAKNMFLDVAIV

SEQ ID NO: 2199435 - protein, 17 aa, Cryptosporidium hominis
YQLSEYIGVFRDSKGNA

SEQ ID NO: 2199436 - protein, 17 aa, Cryptosporidium hominis
YQNIVRMHSLDIERLQN

SEQ ID NO: 2199437 - protein, 17 aa, Cryptosporidium hominis
YQPRFTSIFSKIIIQLS

SEQ ID NO: 2199438 - protein, 28 aa, Cryptosporidium hominis
YQRCNSAPFLTWSIFLIEFLSNRSTDNK

SEQ ID NO: 2199439 - protein, 25 aa, Cryptosporidium hominis
YQRYPKPWYKALKKIYNGFNYVYRS

SEQ ID NO: 2199440 - protein, 18 aa, Cryptosporidium hominis
YRALWSHIFQREALKKSI

SEQ ID NO: 2199441 - protein, 17 aa, Cryptosporidium hominis
YRCPYPDCGRFYSSKSN

SEQ ID NO: 2199442 - protein, 19 aa, Cryptosporidium hominis
YRCVLTPHHRTGTKYKVYP

SEQ ID NO: 2199443 - protein, 31 aa, Cryptosporidium hominis
YRDESYLRRIISPLELLLTDLPRIVVKDSCV

SEQ ID NO: 2199444 - protein, 19 aa, Cryptosporidium hominis
YREFLNRFREYPAHSSFTQ

SEQ ID NO: 2199445 - protein, 28 aa, Cryptosporidium hominis
YRELSGLFSLPDLLLKDELLCRGLKCEH

SEQ ID NO: 2199446 - protein, 41 aa, Cryptosporidium hominis
YRESINLLPKNSYSLYIHSLQSLFFNIVASERIKKFGRNPV

SEQ ID NO: 2199447 - protein, 18 aa, Cryptosporidium hominis
YRHSLIQLDINKHQLKLL

SEQ ID NO: 2199448 - protein, 24 aa, Cryptosporidium hominis
YRKMLEFCLSIFSFELREFDWSDE

SEQ ID NO: 2199449 - protein, 21 aa, Cryptosporidium hominis
YRKRFVIERNLLDIKLQQQKE

SEQ ID NO: 2199450 - protein, 23 aa, Cryptosporidium hominis
YRLDDFLRNKLIAGHFFNVLVNT

SEQ ID NO: 2199451 - protein, 30 aa, Cryptosporidium hominis
YRLQFKGSDGKWYFAPKIKIEEFEEKFPNI

SEQ ID NO: 2199452 - protein, 26 aa, Cryptosporidium hominis
YRMGPQKWEYSLIPSLKSLIQDNNNL

SEQ ID NO: 2199453 - protein, 21 aa, Cryptosporidium hominis
YRMNPLFYQPSIVPGPGMSEC

SEQ ID NO: 2199454 - protein, 19 aa, Cryptosporidium hominis
YRMPYIMGIKVVDSIIIES

SEQ ID NO: 2199455 - protein, 29 aa, Cryptosporidium hominis
YRNDQFIDYYLFFSHIFTNLDKIYNKTEM

SEQ ID NO: 2199456 - protein, 28 aa, Cryptosporidium hominis
YRNNISLHLIKPLMKISCAEYFGISVFL

SEQ ID NO: 2199457 - protein, 20 aa, Cryptosporidium hominis
YRQEKTIFESVPNTKGIRID

SEQ ID NO: 2199458 - protein, 18 aa, Cryptosporidium hominis
YRQPKPISFPVGTTPIIA

SEQ ID NO: 2199459 - protein, 33 aa, Cryptosporidium hominis
YRSKIETIVIYPYQIDFISFIQTNLLTGTERRI

SEQ ID NO: 2199460 - protein, 25 aa, Cryptosporidium hominis
YRSTAWYPKFLFDKKFIEENIEEAS

SEQ ID NO: 2199461 - protein, 21 aa, Cryptosporidium hominis
YRSVESWLLSNAYNQWDKLSI

SEQ ID NO: 2199462 - protein, 18 aa, Cryptosporidium hominis
YRYNSLKQDLFSLESSKR

SEQ ID NO: 2199463 - protein, 18 aa, Cryptosporidium hominis
YSALFKDAIFSFLQKIRS

SEQ ID NO: 2199464 - protein, 28 aa, Cryptosporidium hominis
YSALLVIYNILFDWYMIDLRSIERELDM

SEQ ID NO: 2199465 - protein, 27 aa, Cryptosporidium hominis
YSDCLMLRQMKNMFFLLCKQDSSWENV

SEQ ID NO: 2199466 - protein, 29 aa, Cryptosporidium hominis
YSDHLPCAVWLPWIPQLIAGIDRIEGSAI

SEQ ID NO: 2199467 - protein, 23 aa, Cryptosporidium hominis
YSDKLLKLLLSVDLSKIIKKGSL

SEQ ID NO: 2199468 - protein, 23 aa, Cryptosporidium hominis
YSDTRRVFYKQSIITKVSPNHEP

SEQ ID NO: 2199469 - protein, 28 aa, Cryptosporidium hominis
YSEFSAYFKYLISPISPLLLSSFENNLK

SEQ ID NO: 2199470 - protein, 23 aa, Cryptosporidium hominis
YSELYLLPLVLKVLEIGSYEVNH

SEQ ID NO: 2199471 - protein, 17 aa, Cryptosporidium hominis
YSEQFLPYKQKLDKALS

SEQ ID NO: 2199472 - protein, 17 aa, Cryptosporidium hominis
YSERYYISLMRNSKIKL

SEQ ID NO: 2199473 - protein, 21 aa, Cryptosporidium hominis
YSFEKTSLVPGKLFCLVENFI

SEQ ID NO: 2199474 - protein, 31 aa, Cryptosporidium hominis
YSFKKDILSIFWKFYLDGKFTMVSKKYIYFF

SEQ ID NO: 2199475 - protein, 31 aa, Cryptosporidium hominis
YSFQGKPMLKPLNWLLFEFKNHDLIGKNESI

SEQ ID NO: 2199476 - protein, 19 aa, Cryptosporidium hominis
YSFTYDSPMPLNTLVNKLV

SEQ ID NO: 2199477 - protein, 27 aa, Cryptosporidium hominis
YSHIEIPQLALFLNLSSERVYSKVIEM

SEQ ID NO: 2199478 - protein, 24 aa, Cryptosporidium hominis
YSIGAILWEMINGQPPFGGLGNLQ

SEQ ID NO: 2199479 - protein, 17 aa, Cryptosporidium hominis
YSKIIRCSSGLSPKAFI

SEQ ID NO: 2199480 - protein, 31 aa, Cryptosporidium hominis
YSKKWKFGTYWNLIYRNILNRRISIRNEVVE

SEQ ID NO: 2199481 - protein, 20 aa, Cryptosporidium hominis
YSLFFQPYKDFERDQFLLGL

SEQ ID NO: 2199482 - protein, 19 aa, Cryptosporidium hominis
YSLIKIYRELKVKGTSPKL

SEQ ID NO: 2199483 - protein, 17 aa, Cryptosporidium hominis
YSLIKLRNDVYKCLNYS

SEQ ID NO: 2199484 - protein, 28 aa, Cryptosporidium hominis
YSLKVAYQGIFLLNGLFSQLITNKLQLG

SEQ ID NO: 2199485 - protein, 19 aa, Cryptosporidium hominis
YSLTKLWESKGIVPSAVMG

SEQ ID NO: 2199486 - protein, 34 aa, Cryptosporidium hominis
YSNFVTLSRFQLFDKDINLFKLVGFVRNVEHDDY

SEQ ID NO: 2199487 - protein, 24 aa, Cryptosporidium hominis
YSNLSNFYSIFSRITEMKNKEMAS

SEQ ID NO: 2199488 - protein, 20 aa, Cryptosporidium hominis
YSNNICTLRDLANSLKRKIT

SEQ ID NO: 2199489 - protein, 26 aa, Cryptosporidium hominis
YSNNTLLNKQLLFSSSLSPSSYLNTQ

SEQ ID NO: 2199490 - protein, 22 aa, Cryptosporidium hominis
YSNRAHVYLLLKRYVDCVDDCR

SEQ ID NO: 2199491 - protein, 34 aa, Cryptosporidium hominis
YSNSRPIRLLYYNDLHYDSLFYRKEHQTPIINKD

SEQ ID NO: 2199492 - protein, 28 aa, Cryptosporidium hominis
YSPCNPFVAYPYGIPARGPTPGSQPKKT

SEQ ID NO: 2199493 - protein, 19 aa, Cryptosporidium hominis
YSPIVFVRSIIRTKLSPCK

SEQ ID NO: 2199494 - protein, 18 aa, Cryptosporidium hominis
YSPRKLVGHLAPVRCLSL

SEQ ID NO: 2199495 - protein, 23 aa, Cryptosporidium hominis
YSPTSVLSLLNLNGATGCTILQD

SEQ ID NO: 2199496 - protein, 20 aa, Cryptosporidium hominis
YSQGFAYLKCFVPHKPPGRA

SEQ ID NO: 2199497 - protein, 28 aa, Cryptosporidium hominis
YSQMTKNNPIILQFPMVRSSSQSPGGAL

SEQ ID NO: 2199498 - protein, 26 aa, Cryptosporidium hominis
YSREEFYVYQAIFNYSISLIASLDSF

SEQ ID NO: 2199499 - protein, 17 aa, Cryptosporidium hominis
YSRLFPIPERTLSYGTC

SEQ ID NO: 2199500 - protein, 39 aa, Cryptosporidium hominis
YSRLNLGYIPMLAQIFSSLHYLLTQLGIDGFRFTVPDLS

SEQ ID NO: 2199501 - protein, 22 aa, Cryptosporidium hominis
YSRLPLAKIPIMLRSEYCWTHN

SEQ ID NO: 2199502 - protein, 20 aa, Cryptosporidium hominis
YSRVRKIKFKRIGLDSSKKG

SEQ ID NO: 2199503 - protein, 17 aa, Cryptosporidium hominis
YSSFVLNKQTHACILHA

SEQ ID NO: 2199504 - protein, 23 aa, Cryptosporidium hominis
YSSKRQECILKSVKLRASIAPIE

SEQ ID NO: 2199505 - protein, 26 aa, Cryptosporidium hominis
YSSMIPQILINLKALILDLELKRNQL

SEQ ID NO: 2199506 - protein, 28 aa, Cryptosporidium hominis
YSSNEFCPKVPWLFQLMEYCNSGSLDTL

SEQ ID NO: 2199507 - protein, 29 aa, Cryptosporidium hominis
YSSNPCFTPYFIPYTPYGVYSNLYALQNN

SEQ ID NO: 2199508 - protein, 23 aa, Cryptosporidium hominis
YSSNQYFPPGWKNTLLLLLSNCI

SEQ ID NO: 2199509 - protein, 21 aa, Cryptosporidium hominis
YSSNRLAVYGPYQPINLELLD

SEQ ID NO: 2199510 - protein, 29 aa, Cryptosporidium hominis
YSSSLRNLRPFFRIPPPPPNHRAGSNRLY

SEQ ID NO: 2199511 - protein, 17 aa, Cryptosporidium hominis
YSTRIEGPLTFVKHIEA

SEQ ID NO: 2199512 - protein, 19 aa, Cryptosporidium hominis
YSVPFPYDAYKCQINYMQK

SEQ ID NO: 2199513 - protein, 17 aa, Cryptosporidium hominis
YSVPWCYENFLQSRALK

SEQ ID NO: 2199514 - protein, 29 aa, Cryptosporidium hominis
YSYSLSKPIFIKVPIIISNYFLQESSQIL

SEQ ID NO: 2199515 - protein, 24 aa, Cryptosporidium hominis
YTARYEIQIPPDNQFQIARRIIGT

SEQ ID NO: 2199516 - protein, 26 aa, Cryptosporidium hominis
YTDGLCIQAMRLIFDHLPNSVINADA

SEQ ID NO: 2199517 - protein, 28 aa, Cryptosporidium hominis
YTEMVRFYKTFTPSTLRAIFKLSIQADQ

SEQ ID NO: 2199518 - protein, 25 aa, Cryptosporidium hominis
YTGLVRTIILLLEGFRLACKHALYY

SEQ ID NO: 2199519 - protein, 27 aa, Cryptosporidium hominis
YTLNSLAQHIPLLNSFLKPLATSIMAN

SEQ ID NO: 2199520 - protein, 18 aa, Cryptosporidium hominis
YTNMPSSNSPLLINTLIP

SEQ ID NO: 2199521 - protein, 47 aa, Cryptosporidium hominis
YTPLSSMKFMNIQELFLFLSLFYHNYQREWILPLLNNLKNLEIVFFT

SEQ ID NO: 2199522 - protein, 26 aa, Cryptosporidium hominis
YTQLSIKYFPYSGEYIRLTPPVFKIE

SEQ ID NO: 2199523 - protein, 18 aa, Cryptosporidium hominis
YTQWLEHSVYFSSPLTKK

SEQ ID NO: 2199524 - protein, 24 aa, Cryptosporidium hominis
YTRDAFNLYGLRQYFPKNYDSLIE

SEQ ID NO: 2199525 - protein, 29 aa, Cryptosporidium hominis
YTRKKNQKGKWRVKLRNGIAQIANQEIPF

SEQ ID NO: 2199526 - protein, 24 aa, Cryptosporidium hominis
YTRRIYPHLNNMDGFFVAKLKKIS

SEQ ID NO: 2199527 - protein, 20 aa, Cryptosporidium hominis
YTRRPRGFGFVEYMDPRDAQ

SEQ ID NO: 2199528 - protein, 18 aa, Cryptosporidium hominis
YTSEALFNIFNQINLYHT

SEQ ID NO: 2199529 - protein, 18 aa, Cryptosporidium hominis
YTVTPNPSVVRYIEQRSA

SEQ ID NO: 2199530 - protein, 19 aa, Cryptosporidium hominis
YTWKEAKQLISKLKSSTKL

SEQ ID NO: 2199531 - protein, 27 aa, Cryptosporidium hominis
YVDSKYILNIFEILLLYHKNPELDNSN

SEQ ID NO: 2199532 - protein, 27 aa, Cryptosporidium hominis
YVERELYHYPLLLAPIISSMSNLNIKN

SEQ ID NO: 2199533 - protein, 18 aa, Cryptosporidium hominis
YVEYLNTYSFPKIKKENI

SEQ ID NO: 2199534 - protein, 17 aa, Cryptosporidium hominis
YVFYTDERLRLGGVLEL

SEQ ID NO: 2199535 - protein, 17 aa, Cryptosporidium hominis
YVGVKRSINKRAPPIIT

SEQ ID NO: 2199536 - protein, 19 aa, Cryptosporidium hominis
YVIGVAWHPVHPGIFAAID

SEQ ID NO: 2199537 - protein, 29 aa, Cryptosporidium hominis
YVIVQDKFRIPALISLLLSRTGSGKRTVL

SEQ ID NO: 2199538 - protein, 17 aa, Cryptosporidium hominis
YVKIMRIGQGAFGDVWL

SEQ ID NO: 2199539 - protein, 19 aa, Cryptosporidium hominis
YVKLIPNSEIVFAKSYDKE

SEQ ID NO: 2199540 - protein, 30 aa, Cryptosporidium hominis
YVKSETLVNLWLTAYFEKRIKKKQLMSINI

SEQ ID NO: 2199541 - protein, 34 aa, Cryptosporidium hominis
YVLNQLTFKLNPISSLFLLQFQMGIIMESYLKDI

SEQ ID NO: 2199542 - protein, 21 aa, Cryptosporidium hominis
YVPIKLTSFLIKRMTRKMYTD

SEQ ID NO: 2199543 - protein, 18 aa, Cryptosporidium hominis
YVPKFDVEVVCPAPVIVP

SEQ ID NO: 2199544 - protein, 24 aa, Cryptosporidium hominis
YVQYSQYMPTIYKYSIISQVMMQS

SEQ ID NO: 2199545 - protein, 30 aa, Cryptosporidium hominis
YVSNQILNQFPWLIPSYFNSNSGGFCEYII

SEQ ID NO: 2199546 - protein, 18 aa, Cryptosporidium hominis
YVSWLDGNIPGVTKLIVN

SEQ ID NO: 2199547 - protein, 23 aa, Cryptosporidium hominis
YVVKIICLKVITAKPYLSCPENT

SEQ ID NO: 2199548 - protein, 17 aa, Cryptosporidium hominis
YVYGRLMVEAKLVTKPG

SEQ ID NO: 2199549 - protein, 18 aa, Cryptosporidium hominis
YWCYDNFLQVKSLKKARD

SEQ ID NO: 2199550 - protein, 20 aa, Cryptosporidium hominis
YWDVIIIGTGLIECIVASGL

SEQ ID NO: 2199551 - protein, 17 aa, Cryptosporidium hominis
YWEFFETSGKNKSENHL

SEQ ID NO: 2199552 - protein, 27 aa, Cryptosporidium hominis
YWKFEQSLCILLRLSTCLNPYSDIRES

SEQ ID NO: 2199553 - protein, 28 aa, Cryptosporidium hominis
YWKSRDLGFFILWKIIEDFEPVISYDDY

SEQ ID NO: 2199554 - protein, 18 aa, Cryptosporidium hominis
YWKTKLCLMFSKGACKNG

SEQ ID NO: 2199555 - protein, 18 aa, Cryptosporidium hominis
YWLPENMNLYIDSALDYR

SEQ ID NO: 2199556 - protein, 26 aa, Cryptosporidium hominis
YWSRTGPFFSIFYQLAHGLILDNNNP

SEQ ID NO: 2199557 - protein, 26 aa, Cryptosporidium hominis
YYDYNLCFIIKILIYLISNVKDGLDL

SEQ ID NO: 2199558 - protein, 30 aa, Cryptosporidium hominis
YYECETRKYYFFFIPDLSEYTIEITLAAAI

SEQ ID NO: 2199559 - protein, 22 aa, Cryptosporidium hominis
YYEWVKRLRTFPRSLYIRIVNL

SEQ ID NO: 2199560 - protein, 18 aa, Cryptosporidium hominis
YYEYTFDHIFPPNADQET

SEQ ID NO: 2199561 - protein, 25 aa, Cryptosporidium hominis
YYMETPIGNPLKLDSRTRCMRIWTL

SEQ ID NO: 2199562 - protein, 17 aa, Cryptosporidium hominis
YYPFTNKVNRFSGQLDY

SEQ ID NO: 2199563 - protein, 29 aa, Cryptosporidium hominis
YYPLEKEENWWAILIKIGVPNLPKENSDD

SEQ ID NO: 2199564 - protein, 22 aa, Cryptosporidium hominis
YYPMNSLRVGLFMTLKISTVNL

SEQ ID NO: 2199565 - protein, 21 aa, Cryptosporidium hominis
YYPRAYMYNNIKHNLPDYSLI

SEQ ID NO: 2199566 - protein, 17 aa, Cryptosporidium hominis
YYQWLLIQYWNYSINRV

SEQ ID NO: 2199567 - protein, 18 aa, Cryptosporidium hominis
YYSIAIRYRKNLLEQKML

SEQ ID NO: 2199568 - protein, 19 aa, Cryptosporidium hominis
YYSLGNNLIIKPFNLNVNP

SEQ ID NO: 2199569 - protein, 25 aa, Cryptosporidium hominis
YYSSWNYWNFEFTPEKPILQKMGIE

SEQ ID NO: 2199570 - protein, 24 aa, Cryptosporidium hominis
PIAKLKAKVPVKPSPLLKSKSEKE

SEQ ID NO: 2199571 - protein, 17 aa, Cryptosporidium hominis
AAQLKAAILARASSKKN

SEQ ID NO: 2199572 - protein, 19 aa, Cryptosporidium hominis
AARYIFTKLSKWTRYIFPE

SEQ ID NO: 2199573 - protein, 25 aa, Cryptosporidium hominis
ADWTIKLWMPNPLASSFTLLYTFES

SEQ ID NO: 2199574 - protein, 20 aa, Cryptosporidium hominis
AEESSWFSGWFGTSAPEEPP

SEQ ID NO: 2199575 - protein, 21 aa, Cryptosporidium hominis
AEESSWFSGWFGTSAPEEPPK

SEQ ID NO: 2199576 - protein, 17 aa, Cryptosporidium hominis
AEYAKHVYLHHLKAYRS

SEQ ID NO: 2199577 - protein, 27 aa, Cryptosporidium hominis
AFLFPESVVFWRWLTPRILAIVGDKGI

SEQ ID NO: 2199578 - protein, 21 aa, Cryptosporidium hominis
AFYEYYMAELLWRIGTVLGHS

SEQ ID NO: 2199579 - protein, 17 aa, Cryptosporidium hominis
AHPNPFLPIKKVQKRSG

SEQ ID NO: 2199580 - protein, 26 aa, Cryptosporidium hominis
AILKNWLRKNIVVVRYLYLFEQFMNK

SEQ ID NO: 2199581 - protein, 27 aa, Cryptosporidium hominis
AINSLKNPLLFWFKGLFRQNEPTHIRP

SEQ ID NO: 2199582 - protein, 22 aa, Cryptosporidium hominis
AKVLMIIQFWQTSLTFTDRIVN

SEQ ID NO: 2199583 - protein, 18 aa, Cryptosporidium hominis
ALDILISLIYYTTDYRDY

SEQ ID NO: 2199584 - protein, 19 aa, Cryptosporidium hominis
ALELYPLPFPKIGGVKSPK

SEQ ID NO: 2199585 - protein, 20 aa, Cryptosporidium hominis
ALLICKRICHFDSRLSKLYR

SEQ ID NO: 2199586 - protein, 24 aa, Cryptosporidium hominis
ALSHYAMGFLLKKGYLAIQPPYFM

SEQ ID NO: 2199587 - protein, 18 aa, Cryptosporidium hominis
ALTYILKFGYEPYKLFQV

SEQ ID NO: 2199588 - protein, 21 aa, Cryptosporidium hominis
AMGKHMRMSVLGLLSIRGVEK

SEQ ID NO: 2199589 - protein, 19 aa, Cryptosporidium hominis
AMRCDLLILLSTRKKLQRL

SEQ ID NO: 2199590 - protein, 25 aa, Cryptosporidium hominis
AMRKAFFPKLLTWLSLPQTLQRYFL

SEQ ID NO: 2199591 - protein, 25 aa, Cryptosporidium hominis
AMSPGPYEWLYNPLLMNLYGNYSAA

SEQ ID NO: 2199592 - protein, 25 aa, Cryptosporidium hominis
ANLMQYYMFIPFKYKWSYFIGLLQN

SEQ ID NO: 2199593 - protein, 22 aa, Cryptosporidium hominis
ANPFLFSQYGLAPFTGLESNKS

SEQ ID NO: 2199594 - protein, 22 aa, Cryptosporidium hominis
ANQRFLLLYTFLKKNRDKKVMV

SEQ ID NO: 2199595 - protein, 22 aa, Cryptosporidium hominis
ANYVFLLDPWWNPAAELQAFQR

SEQ ID NO: 2199596 - protein, 19 aa, Cryptosporidium hominis
APPEHLIPLVYILNDFAQK

SEQ ID NO: 2199597 - protein, 17 aa, Cryptosporidium hominis
ARRHVLIKELPPISAND

SEQ ID NO: 2199598 - protein, 31 aa, Cryptosporidium hominis
ASESKMLISFPFFLKYYLSVLTTIRQKHFSS

SEQ ID NO: 2199599 - protein, 18 aa, Cryptosporidium hominis
ASSIPYLLPLLMGSGSNN

SEQ ID NO: 2199600 - protein, 25 aa, Cryptosporidium hominis
ATYSTPWFVYYRPFLKFFLQNASKL

SEQ ID NO: 2199601 - protein, 18 aa, Cryptosporidium hominis
AVLYKLLFLLCKLNFINF

SEQ ID NO: 2199602 - protein, 19 aa, Cryptosporidium hominis
AYFIIPNYNYAFQSLYPSQ

SEQ ID NO: 2199603 - protein, 24 aa, Cryptosporidium hominis
AYITNFLLQLFRFLTLFDSSPPEL

SEQ ID NO: 2199604 - protein, 19 aa, Cryptosporidium hominis
AYRLTVIKIVPWITQLDAI

SEQ ID NO: 2199605 - protein, 24 aa, Cryptosporidium hominis
CARKLKWWLDAFQPIVSPIFPNMD

SEQ ID NO: 2199606 - protein, 23 aa, Cryptosporidium hominis
CDKIYKRDWQQVCLDWIYCDLCN

SEQ ID NO: 2199607 - protein, 18 aa, Cryptosporidium hominis
CDVTFYRFSFFKSPVVQN

SEQ ID NO: 2199608 - protein, 26 aa, Cryptosporidium hominis
CETRKYYFFFIPDLSEYTIEITLAAA

SEQ ID NO: 2199609 - protein, 23 aa, Cryptosporidium hominis
CIKPALAKSPAWLRFIDICLNEI

SEQ ID NO: 2199610 - protein, 21 aa, Cryptosporidium hominis
CILKIIPQYIFNARDPIICGV

SEQ ID NO: 2199611 - protein, 22 aa, Cryptosporidium hominis
CKFNILLQYFQYKALRYLQIHD

SEQ ID NO: 2199612 - protein, 21 aa, Cryptosporidium hominis
CKILKPKLLLVPSDVLTLFID

SEQ ID NO: 2199613 - protein, 17 aa, Cryptosporidium hominis
CKPDYYQFFFGYLDYEK

SEQ ID NO: 2199614 - protein, 30 aa, Cryptosporidium hominis
CLDWIYCDLCNNWYHWYCLGLHKDNIPSEN

SEQ ID NO: 2199615 - protein, 21 aa, Cryptosporidium hominis
CLIIMKWIDSLLYITQKIRFS

SEQ ID NO: 2199616 - protein, 23 aa, Cryptosporidium hominis
CLLEQKILFLKLVIQGVIGLSNK

SEQ ID NO: 2199617 - protein, 21 aa, Cryptosporidium hominis
CLLGLYYAMLLKWFDYETFDI

SEQ ID NO: 2199618 - protein, 17 aa, Cryptosporidium hominis
CNDIWLMDLKYIESLAN

SEQ ID NO: 2199619 - protein, 19 aa, Cryptosporidium hominis
CNRGWLYYPDSLQWYSKVQ

SEQ ID NO: 2199620 - protein, 19 aa, Cryptosporidium hominis
CNVFINRQLIYNYPDQLFK

SEQ ID NO: 2199621 - protein, 32 aa, Cryptosporidium hominis
CPKNTRKLLWTHLGWCILVYPNGDIKAIKPDK

SEQ ID NO: 2199622 - protein, 24 aa, Cryptosporidium hominis
CQYSHNIYWPRRCPFYLSNQSTIR

SEQ ID NO: 2199623 - protein, 24 aa, Cryptosporidium hominis
CQYYLLIVDLLLLGLTRANQIAGS

SEQ ID NO: 2199624 - protein, 23 aa, Cryptosporidium hominis
CRDSIAPNLPGAFLSVVMQNLSS

SEQ ID NO: 2199625 - protein, 23 aa, Cryptosporidium hominis
CRIEFLQHRILKKAFKVFNKEIC

SEQ ID NO: 2199626 - protein, 17 aa, Cryptosporidium hominis
CRRDLYLLLYYTNELYL

SEQ ID NO: 2199627 - protein, 27 aa, Cryptosporidium hominis
CSFKDLNVYFGWETPLVIPIITEPDCC

SEQ ID NO: 2199628 - protein, 21 aa, Cryptosporidium hominis
CSKWMEFFVKNLKYLETPQYL

SEQ ID NO: 2199629 - protein, 23 aa, Cryptosporidium hominis
CTYLIHHLILIPFTYGSKFPPPI

SEQ ID NO: 2199630 - protein, 17 aa, Cryptosporidium hominis
CVIIPLKVQKIFSILSN

SEQ ID NO: 2199631 - protein, 18 aa, Cryptosporidium hominis
CWPASKYVKLFSSAKIKF

SEQ ID NO: 2199632 - protein, 18 aa, Cryptosporidium hominis
CYISKSVLLYYFFEKWMN

SEQ ID NO: 2199633 - protein, 18 aa, Cryptosporidium hominis
DALRHLLKWTLQWDPSNR

SEQ ID NO: 2199634 - protein, 24 aa, Cryptosporidium hominis
DCESFEFFFSFIYGLIVHSDKVKI

SEQ ID NO: 2199635 - protein, 26 aa, Cryptosporidium hominis
DCIDFYYKYKYTLGFKRILRLVYYFK

SEQ ID NO: 2199636 - protein, 17 aa, Cryptosporidium hominis
DCQIYMTIFVDSASLRD

SEQ ID NO: 2199637 - protein, 24 aa, Cryptosporidium hominis
DDLQLYLYLCRLLSGAISLRSQNI

SEQ ID NO: 2199638 - protein, 25 aa, Cryptosporidium hominis
DEEFIYLLLDFKISMIPKLHDILLI

SEQ ID NO: 2199639 - protein, 24 aa, Cryptosporidium hominis
DEEHNRFVLALKKFGRNWTLVQQE

SEQ ID NO: 2199640 - protein, 21 aa, Cryptosporidium hominis
DEFMRFSVLLTVLFGLKDPID

SEQ ID NO: 2199641 - protein, 22 aa, Cryptosporidium hominis
DEKIRVIKYLWETKRDFNIHEV

SEQ ID NO: 2199642 - protein, 24 aa, Cryptosporidium hominis
DELEMRLVLYLLKYFAPIWDTKVR

SEQ ID NO: 2199643 - protein, 21 aa, Cryptosporidium hominis
DETLDTIPWFCSYNKLQVLSN

SEQ ID NO: 2199644 - protein, 26 aa, Cryptosporidium hominis
DEYRFNNPMFLIPKKVKKNFKNEVCS

SEQ ID NO: 2199645 - protein, 17 aa, Cryptosporidium hominis
DFHLLLYLAKLFDEATA

SEQ ID NO: 2199646 - protein, 18 aa, Cryptosporidium hominis
DFLALIDPYILFLGGIDH

SEQ ID NO: 2199647 - protein, 19 aa, Cryptosporidium hominis
DFPILLHRKLINISLRKLN

SEQ ID NO: 2199648 - protein, 17 aa, Cryptosporidium hominis
DFTIVRRMNPTKSDESN

SEQ ID NO: 2199649 - protein, 17 aa, Cryptosporidium hominis
DFVTRKAILLRFSWLAP

SEQ ID NO: 2199650 - protein, 22 aa, Cryptosporidium hominis
DGEKYFNYWMLAKKFEFEKIVT

SEQ ID NO: 2199651 - protein, 22 aa, Cryptosporidium hominis
DHDKWPLNKWAPSPFRVQHASP

SEQ ID NO: 2199652 - protein, 23 aa, Cryptosporidium hominis
DHFMFKICLLFSIQIVPISNDHT

SEQ ID NO: 2199653 - protein, 25 aa, Cryptosporidium hominis
DIGSIWLIREIYLSLTPQILKLSMS

SEQ ID NO: 2199654 - protein, 17 aa, Cryptosporidium hominis
DILFFWVARMVMLSFAC

SEQ ID NO: 2199655 - protein, 23 aa, Cryptosporidium hominis
DILPPLKLIIMSATLRVTDFSEN

SEQ ID NO: 2199656 - protein, 23 aa, Cryptosporidium hominis
DIPERLYLLYGSRWKSLKERKIS

SEQ ID NO: 2199657 - protein, 20 aa, Cryptosporidium hominis
DIPFIWMNVVQRYQIVNSWN

SEQ ID NO: 2199658 - protein, 21 aa, Cryptosporidium hominis
DIPHRFFLNQVKLLQIKYSYK

SEQ ID NO: 2199659 - protein, 26 aa, Cryptosporidium hominis
DIPRGFFYAYFLNPLILLASDPIRNV

SEQ ID NO: 2199660 - protein, 19 aa, Cryptosporidium hominis
DKIFPLPYNGDNFAPGLLL

SEQ ID NO: 2199661 - protein, 20 aa, Cryptosporidium hominis
DKILRLLLPLFDTGSRDKYD

SEQ ID NO: 2199662 - protein, 20 aa, Cryptosporidium hominis
DKYSILLSRVLWLLPHDSPD

SEQ ID NO: 2199663 - protein, 19 aa, Cryptosporidium hominis
DLHVYLFKSSIFKILEIAS

SEQ ID NO: 2199664 - protein, 24 aa, Cryptosporidium hominis
DLIIDFPLFIKLVEYRIIKGTSQI

SEQ ID NO: 2199665 - protein, 22 aa, Cryptosporidium hominis
DLLKFFQARPPLPYVPYPNRRP

SEQ ID NO: 2199666 - protein, 18 aa, Cryptosporidium hominis
DLPNKWRFFYLNITNYEI

SEQ ID NO: 2199667 - protein, 19 aa, Cryptosporidium hominis
DLSCWLPQNLTAICNPGFQ

SEQ ID NO: 2199668 - protein, 28 aa, Cryptosporidium hominis
DLVPDLWLKLLPILLYSLDIWLSDLIRK

SEQ ID NO: 2199669 - protein, 23 aa, Cryptosporidium hominis
DLYKILLCFIYTDFLIWDPFSDS

SEQ ID NO: 2199670 - protein, 23 aa, Cryptosporidium hominis
DNKTPLHYASFRPNLDYAKWVIE

SEQ ID NO: 2199671 - protein, 24 aa, Cryptosporidium hominis
DNTFYLIFEFFVAGNIILTDCNYK

SEQ ID NO: 2199672 - protein, 17 aa, Cryptosporidium hominis
DNYIKIWDLRRFDKPLL

SEQ ID NO: 2199673 - protein, 18 aa, Cryptosporidium hominis
DPNSFIPKVPIPSSFFSN

SEQ ID NO: 2199674 - protein, 20 aa, Cryptosporidium hominis
DPREEILKAFKLFDDDNTGK

SEQ ID NO: 2199675 - protein, 26 aa, Cryptosporidium hominis
DQSIWQYYFWLMGDFLPKILFKNEQF

SEQ ID NO: 2199676 - protein, 24 aa, Cryptosporidium hominis
DRLFPTMHLLWIHSSLFSIPSIII

SEQ ID NO: 2199677 - protein, 21 aa, Cryptosporidium hominis
DRPFVHLLIWNYIKCCISFYQ

SEQ ID NO: 2199678 - protein, 22 aa, Cryptosporidium hominis
DRTQLYYFVKWLSCPYDQCTWE

SEQ ID NO: 2199679 - protein, 21 aa, Cryptosporidium hominis
DSCYSFWFTGLLFCIEEILRI

SEQ ID NO: 2199680 - protein, 20 aa, Cryptosporidium hominis
DSEWFSILLFHQNRKKGNFG

SEQ ID NO: 2199681 - protein, 23 aa, Cryptosporidium hominis
DSFFQLLPYLLKLTKFQIIRNEF

SEQ ID NO: 2199682 - protein, 17 aa, Cryptosporidium hominis
DSFLSLFKPIISKCIEV

SEQ ID NO: 2199683 - protein, 19 aa, Cryptosporidium hominis
DSLELSLLLNFRSLSTKLQ

SEQ ID NO: 2199684 - protein, 24 aa, Cryptosporidium hominis
DSVQKLLHFQDILGKGSKIESDYS

SEQ ID NO: 2199685 - protein, 23 aa, Cryptosporidium hominis
DTCTYFPLRKLLIKSLLEKGEIT

SEQ ID NO: 2199686 - protein, 24 aa, Cryptosporidium hominis
DVCYSWWIFSLLYFLGRANYIDKN

SEQ ID NO: 2199687 - protein, 26 aa, Cryptosporidium hominis
DVEYEGIFWHPINKVWIGVWLDSITH

SEQ ID NO: 2199688 - protein, 30 aa, Cryptosporidium hominis
DVKHIFTFCYKLWDYLNLYPTPVIECFNQC

SEQ ID NO: 2199689 - protein, 20 aa, Cryptosporidium hominis
DVLEIFLLTIYKFREKLSSS

SEQ ID NO: 2199690 - protein, 20 aa, Cryptosporidium hominis
DYFGHIVIDLLFFQAKKFAS

SEQ ID NO: 2199691 - protein, 19 aa, Cryptosporidium hominis
DYFMMNFLHDKYKEVYMWL

SEQ ID NO: 2199692 - protein, 26 aa, Cryptosporidium hominis
DYRGKYVVLFFYPLNFTFVCPSEILA

SEQ ID NO: 2199693 - protein, 22 aa, Cryptosporidium hominis
DYTNFFWKIRENLLKNSRLIRN

SEQ ID NO: 2199694 - protein, 19 aa, Cryptosporidium hominis
DYYQFRWFHSWKKLLRNSS

SEQ ID NO: 2199695 - protein, 24 aa, Cryptosporidium hominis
ECSSIPGFFQNKLGWFNCVENFFS

SEQ ID NO: 2199696 - protein, 19 aa, Cryptosporidium hominis
EDCMNCLYLLLPFTLTHGT

SEQ ID NO: 2199697 - protein, 24 aa, Cryptosporidium hominis
EDDKSLSLELILDSEIRKTEVLDN

SEQ ID NO: 2199698 - protein, 25 aa, Cryptosporidium hominis
EDDSIHWMIIIALRFIALSSLQLGN

SEQ ID NO: 2199699 - protein, 23 aa, Cryptosporidium hominis
EDRAALLELLFKSTIPISGLYNS

SEQ ID NO: 2199700 - protein, 23 aa, Cryptosporidium hominis
EDRLHFYYHYIAELRFNHYQPEL

SEQ ID NO: 2199701 - protein, 21 aa, Cryptosporidium hominis
EDRLNLYFILEFCAGGNLFHS

SEQ ID NO: 2199702 - protein, 25 aa, Cryptosporidium hominis
EDSLLDIYSFISWYIYDYNNEITQK

SEQ ID NO: 2199703 - protein, 23 aa, Cryptosporidium hominis
EEDAFEFWVALSTGLFQCYGSVL

SEQ ID NO: 2199704 - protein, 17 aa, Cryptosporidium hominis
EEEEFVYFLSRIPNLSK

SEQ ID NO: 2199705 - protein, 24 aa, Cryptosporidium hominis
EEFWAWIMIWMRLNSLGVLDWQRN

SEQ ID NO: 2199706 - protein, 17 aa, Cryptosporidium hominis
EEILFVYIFSLLTGTCL

SEQ ID NO: 2199707 - protein, 21 aa, Cryptosporidium hominis
EELKFFRFFDFFISFSNKDPT

SEQ ID NO: 2199708 - protein, 22 aa, Cryptosporidium hominis
EELWPLLNYIEPIKFASIEAFT

SEQ ID NO: 2199709 - protein, 21 aa, Cryptosporidium hominis
EETLLIMRPFEPTLLMKPQDV

SEQ ID NO: 2199710 - protein, 21 aa, Cryptosporidium hominis
EEVCHHIFHANCLLPWLNQHN

SEQ ID NO: 2199711 - protein, 20 aa, Cryptosporidium hominis
EEVLLLLRYFDISNPRINEP

SEQ ID NO: 2199712 - protein, 18 aa, Cryptosporidium hominis
EFCPKVPWLFQLMEYCNS

SEQ ID NO: 2199713 - protein, 19 aa, Cryptosporidium hominis
EFLLWMNGLNDLVCNLSLI

SEQ ID NO: 2199714 - protein, 18 aa, Cryptosporidium hominis
EFLTGMLIFRPYNIKEKN

SEQ ID NO: 2199715 - protein, 22 aa, Cryptosporidium hominis
EFLVFLIDIYIQGVLLFLLEHV

SEQ ID NO: 2199716 - protein, 18 aa, Cryptosporidium hominis
EFNSKMIFTLFLPQKVIF

SEQ ID NO: 2199717 - protein, 17 aa, Cryptosporidium hominis
EFPTNIRWTYYSFYPLI

SEQ ID NO: 2199718 - protein, 22 aa, Cryptosporidium hominis
EFRNLLTQLLILPELRDLFDEY

SEQ ID NO: 2199719 - protein, 20 aa, Cryptosporidium hominis
EFSLLWMALVINKFPNFIKV

SEQ ID NO: 2199720 - protein, 24 aa, Cryptosporidium hominis
EFYFALLQSIRWPSKLLIKGGPNV

SEQ ID NO: 2199721 - protein, 24 aa, Cryptosporidium hominis
EGSKRFFDLVKFKDPKFKIAWYFA

SEQ ID NO: 2199722 - protein, 24 aa, Cryptosporidium hominis
EHIQYFMYQILRGLSYLHKVNIIH

SEQ ID NO: 2199723 - protein, 19 aa, Cryptosporidium hominis
EHLLRLLIILPKLIGDHIS

SEQ ID NO: 2199724 - protein, 19 aa, Cryptosporidium hominis
EHQSGVPGVYWQESSQRWI

SEQ ID NO: 2199725 - protein, 18 aa, Cryptosporidium hominis
EHWLWKKNVPFIYDYLFI

SEQ ID NO: 2199726 - protein, 25 aa, Cryptosporidium hominis
EIDEKFLFYLFSNFGKILSLKIVGN

SEQ ID NO: 2199727 - protein, 23 aa, Cryptosporidium hominis
EIKEIRRIAKMLVWLQENNPKTS

SEQ ID NO: 2199728 - protein, 21 aa, Cryptosporidium hominis
EINLLVYRYLIENGFVHTAFS

SEQ ID NO: 2199729 - protein, 19 aa, Cryptosporidium hominis
EIQKLILEFLFSFKTSKKL

SEQ ID NO: 2199730 - protein, 18 aa, Cryptosporidium hominis
EITRLYGLKPIRTLTLGT

SEQ ID NO: 2199731 - protein, 25 aa, Cryptosporidium hominis
EKHSKLLEDFYSNPFYPIFVNEYNK

SEQ ID NO: 2199732 - protein, 24 aa, Cryptosporidium hominis
EKIVSHLLFTYYLESILLLYGKQI

SEQ ID NO: 2199733 - protein, 22 aa, Cryptosporidium hominis
EKKNSWSWGHKLRWVKIFKCEM

SEQ ID NO: 2199734 - protein, 17 aa, Cryptosporidium hominis
EKLSYLKIWVPSAHRPP

SEQ ID NO: 2199735 - protein, 18 aa, Cryptosporidium hominis
EKYSFLRLNYESEYLFRL

SEQ ID NO: 2199736 - protein, 22 aa, Cryptosporidium hominis
EKYYLPCQLLITSLGFKPKYDY

SEQ ID NO: 2199737 - protein, 18 aa, Cryptosporidium hominis
ELELDYLLGWWLGAREAE

SEQ ID NO: 2199738 - protein, 29 aa, Cryptosporidium hominis
ELFPCGKWPDLLPFLFRLISNLQNYTGAT

SEQ ID NO: 2199739 - protein, 19 aa, Cryptosporidium hominis
ELGGLYWLDPYKPIKLTRE

SEQ ID NO: 2199740 - protein, 26 aa, Cryptosporidium hominis
ELIKTRGLYLDLVKKYKAIYKQYETD

SEQ ID NO: 2199741 - protein, 17 aa, Cryptosporidium hominis
ELKLWPTSYDRVISQNS

SEQ ID NO: 2199742 - protein, 19 aa, Cryptosporidium hominis
ELLKFWSKLGFLPVYIRQQ

SEQ ID NO: 2199743 - protein, 33 aa, Cryptosporidium hominis
ELNWRDELISKVRQFILYLSPKPKIQSSKSSYM

SEQ ID NO: 2199744 - protein, 24 aa, Cryptosporidium hominis
ELPIKDLFFFPSRLLETAAFRPPK

SEQ ID NO: 2199745 - protein, 21 aa, Cryptosporidium hominis
ELPPELLLSRPFNPLSIDEAS

SEQ ID NO: 2199746 - protein, 23 aa, Cryptosporidium hominis
EMQYQICLLLKALGIPWIDSPGE

SEQ ID NO: 2199747 - protein, 23 aa, Cryptosporidium hominis
ENEIFNWLLEYDVPLFIANDLIN

SEQ ID NO: 2199748 - protein, 26 aa, Cryptosporidium hominis
ENNNTNFMMPFQNNILKLIDHLSINI

SEQ ID NO: 2199749 - protein, 23 aa, Cryptosporidium hominis
ENRYPYRRMIISNIYTLLGELAS

SEQ ID NO: 2199750 - protein, 23 aa, Cryptosporidium hominis
EQFYILAILLGCDYTVGVNGIGP

SEQ ID NO: 2199751 - protein, 24 aa, Cryptosporidium hominis
EQSRLLLCFLTKQILLKGLDLLGV

SEQ ID NO: 2199752 - protein, 23 aa, Cryptosporidium hominis
EQTWFYWLENIQDWCISRQLWWG

SEQ ID NO: 2199753 - protein, 24 aa, Cryptosporidium hominis
ERILPVLEFCLFGVIFTQSLEDAK

SEQ ID NO: 2199754 - protein, 23 aa, Cryptosporidium hominis
ERVDIFRFILIEFTMIQQEMYLR

SEQ ID NO: 2199755 - protein, 29 aa, Cryptosporidium hominis
ESEWEIFWQELLIYLFFKPILNKNSIELR

SEQ ID NO: 2199756 - protein, 23 aa, Cryptosporidium hominis
ESIALMYYLLAREVNFLRGKTDK

SEQ ID NO: 2199757 - protein, 18 aa, Cryptosporidium hominis
ESIYNYYSQIYIPGYLFG

SEQ ID NO: 2199758 - protein, 23 aa, Cryptosporidium hominis
ESNFKVIYKILCLILSMLETNQN

SEQ ID NO: 2199759 - protein, 19 aa, Cryptosporidium hominis
ESRVYARFTWATRKYSKSF

SEQ ID NO: 2199760 - protein, 26 aa, Cryptosporidium hominis
ESSKYKWLFRWLPYYYKFGMGYQISK

SEQ ID NO: 2199761 - protein, 19 aa, Cryptosporidium hominis
ETAYALTYILKFGYEPYKL

SEQ ID NO: 2199762 - protein, 22 aa, Cryptosporidium hominis
ETNKRFIMRKMPLLCWAADIPS

SEQ ID NO: 2199763 - protein, 21 aa, Cryptosporidium hominis
ETPPPLPPPLSPPSPPSPPLP

SEQ ID NO: 2199764 - protein, 17 aa, Cryptosporidium hominis
EVFLVFKSGLDPNSELF

SEQ ID NO: 2199765 - protein, 25 aa, Cryptosporidium hominis
EVRAICRDWWIFSLKYYRNIKYKDN

SEQ ID NO: 2199766 - protein, 18 aa, Cryptosporidium hominis
EWIFFFFKHLLSENPCIF

SEQ ID NO: 2199767 - protein, 17 aa, Cryptosporidium hominis
EWKKAFYLILGFDEEKM

SEQ ID NO: 2199768 - protein, 25 aa, Cryptosporidium hominis
EYIGNPLAFIYLFYNKLSGGNIETY

SEQ ID NO: 2199769 - protein, 22 aa, Cryptosporidium hominis
EYLDYFFPLFLLECQQSIQRAK

SEQ ID NO: 2199770 - protein, 17 aa, Cryptosporidium hominis
FCPLLHRSAFRLALLVV

SEQ ID NO: 2199771 - protein, 20 aa, Cryptosporidium hominis
FCSFGKIYLGYNIHKILLSI

SEQ ID NO: 2199772 - protein, 18 aa, Cryptosporidium hominis
FDLKYNGFYILYAKSNKP

SEQ ID NO: 2199773 - protein, 25 aa, Cryptosporidium hominis
FDTTDNTMTFVYQAPTKTETTTTMT

SEQ ID NO: 2199774 - protein, 17 aa, Cryptosporidium hominis
FDYAPFKFETALLQVFN

SEQ ID NO: 2199775 - protein, 23 aa, Cryptosporidium hominis
FEEAFITIIPTLKGYYRSCGNDV

SEQ ID NO: 2199776 - protein, 24 aa, Cryptosporidium hominis
FEPFGPWLVTPLFLGAKGGGGSQG

SEQ ID NO: 2199777 - protein, 24 aa, Cryptosporidium hominis
FEPKRLHWSVIPPNKIVGTIWEDI

SEQ ID NO: 2199778 - protein, 21 aa, Cryptosporidium hominis
FEQSLCILLRLSTCLNPYSDI

SEQ ID NO: 2199779 - protein, 24 aa, Cryptosporidium hominis
FEYKNFPIYTLLALRTISSEFKNL

SEQ ID NO: 2199780 - protein, 17 aa, Cryptosporidium hominis
FFDLFYNEKAQLYEGIG

SEQ ID NO: 2199781 - protein, 17 aa, Cryptosporidium hominis
FFKYIERCSPIKPISLN

SEQ ID NO: 2199782 - protein, 18 aa, Cryptosporidium hominis
FFRLERHLIWVESIIRVH

SEQ ID NO: 2199783 - protein, 19 aa, Cryptosporidium hominis
FFWIRDRCLRYTPVNVEKY

SEQ ID NO: 2199784 - protein, 17 aa, Cryptosporidium hominis
FGFLLRKTDFFTAMNQG

SEQ ID NO: 2199785 - protein, 25 aa, Cryptosporidium hominis
FGITPWMPFWFRFTPINAKTVSNPL

SEQ ID NO: 2199786 - protein, 24 aa, Cryptosporidium hominis
FGKEFVPILRLYLFKNSWFVEVIK

SEQ ID NO: 2199787 - protein, 17 aa, Cryptosporidium hominis
FGNFRWNNKRRRLGSYI

SEQ ID NO: 2199788 - protein, 29 aa, Cryptosporidium hominis
FHKWIGWIESKLRFLVRKLETFKGLQVRP

SEQ ID NO: 2199789 - protein, 17 aa, Cryptosporidium hominis
FHVLLTSYEILLADADI

SEQ ID NO: 2199790 - protein, 18 aa, Cryptosporidium hominis
FICRNIMTNWLPLSKSIF

SEQ ID NO: 2199791 - protein, 18 aa, Cryptosporidium hominis
FIFELLYIKRKLSLVLDL

SEQ ID NO: 2199792 - protein, 18 aa, Cryptosporidium hominis
FIIKFRLPIDPHILSYYL

SEQ ID NO: 2199793 - protein, 22 aa, Cryptosporidium hominis
FIKNLFFVYYCKSPLVMNSSLC

SEQ ID NO: 2199794 - protein, 17 aa, Cryptosporidium hominis
FILVLKLPSICFAEDSE

SEQ ID NO: 2199795 - protein, 19 aa, Cryptosporidium hominis
FIPFALSFLMNVGDSYGIS

SEQ ID NO: 2199796 - protein, 18 aa, Cryptosporidium hominis
FIPYFGQPLLFPNNNQNL

SEQ ID NO: 2199797 - protein, 25 aa, Cryptosporidium hominis
FISTIFHHYLIPYLRINSKIIIENV

SEQ ID NO: 2199798 - protein, 25 aa, Cryptosporidium hominis
FITDQGYLYCWPWPGTISGRSEIKI

SEQ ID NO: 2199799 - protein, 24 aa, Cryptosporidium hominis
FKKLNSLLLPRPPPPPPLASIHIH

SEQ ID NO: 2199800 - protein, 24 aa, Cryptosporidium hominis
FLASSYTLPIIWLLKSMNLSDGIS

SEQ ID NO: 2199801 - protein, 17 aa, Cryptosporidium hominis
FLDLPILELIGIDPAVL

SEQ ID NO: 2199802 - protein, 18 aa, Cryptosporidium hominis
FLDVIFGFLLRKTDFFTA

SEQ ID NO: 2199803 - protein, 17 aa, Cryptosporidium hominis
FLENILIPKVRLKKLIE

SEQ ID NO: 2199804 - protein, 28 aa, Cryptosporidium hominis
FLLTEIRPRWYFIRNDCLIFIDSELPLK

SEQ ID NO: 2199805 - protein, 22 aa, Cryptosporidium hominis
FLRCDSVLYLLVYPQKPLCKTR

SEQ ID NO: 2199806 - protein, 18 aa, Cryptosporidium hominis
FLSFVFKLPFYLKMDINL

SEQ ID NO: 2199807 - protein, 18 aa, Cryptosporidium hominis
FLSIPFLPDLTSPARSLI

SEQ ID NO: 2199808 - protein, 18 aa, Cryptosporidium hominis
FLSLFKPIISKCIEVYRP

SEQ ID NO: 2199809 - protein, 19 aa, Cryptosporidium hominis
FMKVLLFMFVVDPPYHLDP

SEQ ID NO: 2199810 - protein, 18 aa, Cryptosporidium hominis
FMYRYYFNNIIFSLKTVT

SEQ ID NO: 2199811 - protein, 18 aa, Cryptosporidium hominis
FNILIEKLSPFFSKYTEC

SEQ ID NO: 2199812 - protein, 17 aa, Cryptosporidium hominis
FPCILKIIPQYIFNARD

SEQ ID NO: 2199813 - protein, 18 aa, Cryptosporidium hominis
FPIRKLQYSPLGSYLLVL

SEQ ID NO: 2199814 - protein, 26 aa, Cryptosporidium hominis
FPSPDMFEYLILPHLRKIQAPVMECL

SEQ ID NO: 2199815 - protein, 25 aa, Cryptosporidium hominis
FQQGWVPLYKLILYRLQRIESNILY

SEQ ID NO: 2199816 - protein, 25 aa, Cryptosporidium hominis
FQVSYLIFIHGWKLAFLTVSPMSKL

SEQ ID NO: 2199817 - protein, 20 aa, Cryptosporidium hominis
FRDKFRLLPGWAQLVLFSSS

SEQ ID NO: 2199818 - protein, 19 aa, Cryptosporidium hominis
FRFKVYHKFLDLLPECRNN

SEQ ID NO: 2199819 - protein, 19 aa, Cryptosporidium hominis
FRKEIHGTWFITLKTEDLT

SEQ ID NO: 2199820 - protein, 23 aa, Cryptosporidium hominis
FRLPIIYHIIYLLEILRICIRIP

SEQ ID NO: 2199821 - protein, 18 aa, Cryptosporidium hominis
FRNKISSILLLNNISRDF

SEQ ID NO: 2199822 - protein, 20 aa, Cryptosporidium hominis
FTLSKWILIPFTKYAPWHRI

SEQ ID NO: 2199823 - protein, 17 aa, Cryptosporidium hominis
FVGMIYLFFLDIFRVEK

SEQ ID NO: 2199824 - protein, 21 aa, Cryptosporidium hominis
FVLPQDLNTPYYLKLRPGVRE

SEQ ID NO: 2199825 - protein, 19 aa, Cryptosporidium hominis
FVNYLKYLLYWCEFPYVKY

SEQ ID NO: 2199826 - protein, 18 aa, Cryptosporidium hominis
FWYGYFFTNKDKAVLSIL

SEQ ID NO: 2199827 - protein, 20 aa, Cryptosporidium hominis
FYLFITDWIQTILTPILAIN

SEQ ID NO: 2199828 - protein, 20 aa, Cryptosporidium hominis
FYSQWIEQIGYLSSLTKGFT

SEQ ID NO: 2199829 - protein, 26 aa, Cryptosporidium hominis
GCCHIKYIMPFPKDLKPKIFKGTSNF

SEQ ID NO: 2199830 - protein, 20 aa, Cryptosporidium hominis
GCVFVFYVADWFALLNNKMG

SEQ ID NO: 2199831 - protein, 24 aa, Cryptosporidium hominis
GDTHYLLYIYDIMKNLLLLHRHKN

SEQ ID NO: 2199832 - protein, 23 aa, Cryptosporidium hominis
GEMMIPMTPWYKSFKGKIFPIKQ

SEQ ID NO: 2199833 - protein, 17 aa, Cryptosporidium hominis
GESNFLSFVFKLPFYLK

SEQ ID NO: 2199834 - protein, 25 aa, Cryptosporidium hominis
GEYLDPYKIQLLPNGRVYYFPRDHV

SEQ ID NO: 2199835 - protein, 23 aa, Cryptosporidium hominis
GFANTCFNLFSLLSLLKDSLISI

SEQ ID NO: 2199836 - protein, 18 aa, Cryptosporidium hominis
GFHLFTTCYWDQANDGSV

SEQ ID NO: 2199837 - protein, 21 aa, Cryptosporidium hominis
GFLNRDILLTDYRLIFLKDAE

SEQ ID NO: 2199838 - protein, 23 aa, Cryptosporidium hominis
GFNQDSFIYMRGNSIPGVVCGMN

SEQ ID NO: 2199839 - protein, 24 aa, Cryptosporidium hominis
GFVSTFIDYWYRILRFLHKSLETI

SEQ ID NO: 2199840 - protein, 29 aa, Cryptosporidium hominis
GFWEPSWRIWIFFLRGIIPILERWIGNLL

SEQ ID NO: 2199841 - protein, 24 aa, Cryptosporidium hominis
GGQKTLVALAFLFALHRADPAPMY

SEQ ID NO: 2199842 - protein, 23 aa, Cryptosporidium hominis
GGSQRSFIVGELKPRINQALKAE

SEQ ID NO: 2199843 - protein, 18 aa, Cryptosporidium hominis
GHLIGFIKFIPLIGKEVI

SEQ ID NO: 2199844 - protein, 20 aa, Cryptosporidium hominis
GIFILFHPKIRHLINMSIFV

SEQ ID NO: 2199845 - protein, 17 aa, Cryptosporidium hominis
GIFKVFPYLFHQGANYS

SEQ ID NO: 2199846 - protein, 25 aa, Cryptosporidium hominis
GIKILKILFLILINYNIFPGVNGKS

SEQ ID NO: 2199847 - protein, 24 aa, Cryptosporidium hominis
GIKWSTIIKIWRLILDRLVDCKNL

SEQ ID NO: 2199848 - protein, 20 aa, Cryptosporidium hominis
GIRNLLPAFGHIRDYFNVNK

SEQ ID NO: 2199849 - protein, 18 aa, Cryptosporidium hominis
GKLYLLSRLLFHIRSNTK

SEQ ID NO: 2199850 - protein, 20 aa, Cryptosporidium hominis
GKNYAFYPPGIKPAPIIGNY

SEQ ID NO: 2199851 - protein, 21 aa, Cryptosporidium hominis
GKSTIAFSKALLARCEQEFKN

SEQ ID NO: 2199852 - protein, 25 aa, Cryptosporidium hominis
GLYWEDEFILPPTQFPFIKEEKESL

SEQ ID NO: 2199853 - protein, 17 aa, Cryptosporidium hominis
GMIYLFFLDIFRVEKDL

SEQ ID NO: 2199854 - protein, 25 aa, Cryptosporidium hominis
GNEVWLTLPLFFPSATLHNVTHQRR

SEQ ID NO: 2199855 - protein, 22 aa, Cryptosporidium hominis
GNHLPLLPPSRFPFQSEARRTI

SEQ ID NO: 2199856 - protein, 18 aa, Cryptosporidium hominis
GNLQRFLHLFIINQLFSE

SEQ ID NO: 2199857 - protein, 22 aa, Cryptosporidium hominis
GNYLKFELPPVLVKSLRTPSWG

SEQ ID NO: 2199858 - protein, 17 aa, Cryptosporidium hominis
GPFEAPPLHIIGYNPVI

SEQ ID NO: 2199859 - protein, 21 aa, Cryptosporidium hominis
GQLIDLLYFFEQFSWPHFHRG

SEQ ID NO: 2199860 - protein, 23 aa, Cryptosporidium hominis
GQLRLQFIFLYYDTDRNGLLNLN

SEQ ID NO: 2199861 - protein, 23 aa, Cryptosporidium hominis
GQSLDLLGILLKAGPITTITVKS

SEQ ID NO: 2199862 - protein, 22 aa, Cryptosporidium hominis
GRNEWYIYCLKIIDALVCFDRK

SEQ ID NO: 2199863 - protein, 20 aa, Cryptosporidium hominis
GSELILYKRSWDWLARTRLD

SEQ ID NO: 2199864 - protein, 24 aa, Cryptosporidium hominis
GTPCIPPFWHANPALLASAASLIG

SEQ ID NO: 2199865 - protein, 22 aa, Cryptosporidium hominis
GTPSWFPPLYVEALKHLKDLIP

SEQ ID NO: 2199866 - protein, 18 aa, Cryptosporidium hominis
GVMPMPMELPPQPPVSHP

SEQ ID NO: 2199867 - protein, 24 aa, Cryptosporidium hominis
GVPSWDWYYPYHYAPYVMDIVELL

SEQ ID NO: 2199868 - protein, 18 aa, Cryptosporidium hominis
GVQPPVCPVSLLPPIPHP

SEQ ID NO: 2199869 - protein, 18 aa, Cryptosporidium hominis
GWLPTMKLLLKYNCDINR

SEQ ID NO: 2199870 - protein, 21 aa, Cryptosporidium hominis
HAIKIFPITFLPSIKILEIGL

SEQ ID NO: 2199871 - protein, 25 aa, Cryptosporidium hominis
HDSLKYWCKLFKVNLLFPPCKSDNI

SEQ ID NO: 2199872 - protein, 30 aa, Cryptosporidium hominis
HEVDLIKPLWTMPLLLRIFLNNINLDNNPQ

SEQ ID NO: 2199873 - protein, 32 aa, Cryptosporidium hominis
HFDKLLFFKMGKFYELFYIDAYICQKHCDLRW

SEQ ID NO: 2199874 - protein, 27 aa, Cryptosporidium hominis
HFIPKSYYWILIIVWYRIMHDYSRMID

SEQ ID NO: 2199875 - protein, 18 aa, Cryptosporidium hominis
HFKPINGFVFDKTSKDLK

SEQ ID NO: 2199876 - protein, 18 aa, Cryptosporidium hominis
HFLSLFIQFIFRTIYSFD

SEQ ID NO: 2199877 - protein, 18 aa, Cryptosporidium hominis
HFNTLLLSPTRSINFLNE

SEQ ID NO: 2199878 - protein, 24 aa, Cryptosporidium hominis
HFYCIKFLWKFLPLTSTKDFLEQY

SEQ ID NO: 2199879 - protein, 22 aa, Cryptosporidium hominis
HHYIPLLPNFLVDSALSFIKST

SEQ ID NO: 2199880 - protein, 18 aa, Cryptosporidium hominis
HIEIPQLALFLNLSSERV

SEQ ID NO: 2199881 - protein, 18 aa, Cryptosporidium hominis
HIPQFIAKAPWYINQQES

SEQ ID NO: 2199882 - protein, 22 aa, Cryptosporidium hominis
HIRKLLSECGTILRWSRQEDPT

SEQ ID NO: 2199883 - protein, 19 aa, Cryptosporidium hominis
HIVICRMMFILFPVTDAQH

SEQ ID NO: 2199884 - protein, 17 aa, Cryptosporidium hominis
HLAKLFPCQWRTIAPLV

SEQ ID NO: 2199885 - protein, 25 aa, Cryptosporidium hominis
HLIKRLFKIPFWPDGFRFIKNRKYF

SEQ ID NO: 2199886 - protein, 27 aa, Cryptosporidium hominis
HLKREWHRLWLVRSFLAFAWESYLEDL

SEQ ID NO: 2199887 - protein, 20 aa, Cryptosporidium hominis
HLKYLNFVRLLLNRKKYRII

SEQ ID NO: 2199888 - protein, 17 aa, Cryptosporidium hominis
HLLLYLAKLFDEATAIS

SEQ ID NO: 2199889 - protein, 22 aa, Cryptosporidium hominis
HLPCAVWLPWIPQLIAGIDRIE

SEQ ID NO: 2199890 - protein, 24 aa, Cryptosporidium hominis
HNFSLFLYSFLALDPRMRPGAQTL

SEQ ID NO: 2199891 - protein, 24 aa, Cryptosporidium hominis
HPLLFRFQLLIWSLKLKQFLNHDG

SEQ ID NO: 2199892 - protein, 18 aa, Cryptosporidium hominis
HQLKLEVFLVFKSGLDPN

SEQ ID NO: 2199893 - protein, 25 aa, Cryptosporidium hominis
HSKRQLILKLRWYGAKTLDYYSSRA

SEQ ID NO: 2199894 - protein, 17 aa, Cryptosporidium hominis
HSMLFGRLTLEQKKAVF

SEQ ID NO: 2199895 - protein, 19 aa, Cryptosporidium hominis
HSWRLTSYCPLLVQFFGAF

SEQ ID NO: 2199896 - protein, 17 aa, Cryptosporidium hominis
HTVDWVCYYLSAGIALR

SEQ ID NO: 2199897 - protein, 19 aa, Cryptosporidium hominis
HVNLPPKYPFKYLMLISFD

SEQ ID NO: 2199898 - protein, 25 aa, Cryptosporidium hominis
HYSMPLILLLFPKNIVLIKLMSSFS

SEQ ID NO: 2199899 - protein, 20 aa, Cryptosporidium hominis
HYYNLFDFYWLFFRTYNGLE

SEQ ID NO: 2199900 - protein, 23 aa, Cryptosporidium hominis
IAKLKAKVPVKPSPLLKSKSEKE

SEQ ID NO: 2199901 - protein, 25 aa, Cryptosporidium hominis
IASNSRIVLFYWTGIKWICTRNDSS

SEQ ID NO: 2199902 - protein, 17 aa, Cryptosporidium hominis
ICIRLISGLKFLEFDDI

SEQ ID NO: 2199903 - protein, 24 aa, Cryptosporidium hominis
IDDRLYLWNGLYWIRILDQSKSET

SEQ ID NO: 2199904 - protein, 23 aa, Cryptosporidium hominis
IDNIRFIYQAIDNIYLILMTPIN

SEQ ID NO: 2199905 - protein, 22 aa, Cryptosporidium hominis
IDSLILYILKMYCIKTISCTFG

SEQ ID NO: 2199906 - protein, 17 aa, Cryptosporidium hominis
IDSNLIFTILFGSDSLE

SEQ ID NO: 2199907 - protein, 20 aa, Cryptosporidium hominis
IDTLRKLVVLVWTFLQETSF

SEQ ID NO: 2199908 - protein, 19 aa, Cryptosporidium hominis
IEAKLELLLLYRGCSSKRP

SEQ ID NO: 2199909 - protein, 19 aa, Cryptosporidium hominis
IEFKSLLFIPSHPPFDMFD

SEQ ID NO: 2199910 - protein, 24 aa, Cryptosporidium hominis
IEIKHAIRIIPISRILLSFDICAN

SEQ ID NO: 2199911 - protein, 31 aa, Cryptosporidium hominis
IEKEEKTYFLRGLLYRIWKYNRNGKVINNSN

SEQ ID NO: 2199912 - protein, 18 aa, Cryptosporidium hominis
IENITVTGLLKFINKWYL

SEQ ID NO: 2199913 - protein, 17 aa, Cryptosporidium hominis
IEQIGYLSSLTKGFTRS

SEQ ID NO: 2199914 - protein, 18 aa, Cryptosporidium hominis
IERLLFFQVLQLFHQIDL

SEQ ID NO: 2199915 - protein, 20 aa, Cryptosporidium hominis
IEYYGIPKLFPIYIFTSKYT

SEQ ID NO: 2199916 - protein, 23 aa, Cryptosporidium hominis
IFESNLIAIPLFMPCNGRAAWGK

SEQ ID NO: 2199917 - protein, 28 aa, Cryptosporidium hominis
IFETLIPEIFLYILKLWLLCWPSPISLC

SEQ ID NO: 2199918 - protein, 19 aa, Cryptosporidium hominis
IFFGLPFFFPPVLGIKPNE

SEQ ID NO: 2199919 - protein, 19 aa, Cryptosporidium hominis
IFLIKNLLIQLFKVGPRAL

SEQ ID NO: 2199920 - protein, 17 aa, Cryptosporidium hominis
IFLILKPEVPKASEEIN

SEQ ID NO: 2199921 - protein, 18 aa, Cryptosporidium hominis
IFMASLVRKKVIASTVVL

SEQ ID NO: 2199922 - protein, 21 aa, Cryptosporidium hominis
IFQFIINYLKLMSSHLLFMAE

SEQ ID NO: 2199923 - protein, 21 aa, Cryptosporidium hominis
IFRNKIKRFLLPKLLQFRPNI

SEQ ID NO: 2199924 - protein, 18 aa, Cryptosporidium hominis
IFSLLLTRFPVPAASTFS

SEQ ID NO: 2199925 - protein, 19 aa, Cryptosporidium hominis
IFTKLSKWTRYIFPEADDP

SEQ ID NO: 2199926 - protein, 23 aa, Cryptosporidium hominis
IGHLFFEIFPFLSGIENMILKQI

SEQ ID NO: 2199927 - protein, 22 aa, Cryptosporidium hominis
IGMQNFQRLLAKKAFDTIEEDE

SEQ ID NO: 2199928 - protein, 19 aa, Cryptosporidium hominis
IHIGSKLIWKIGFDSYYSI

SEQ ID NO: 2199929 - protein, 25 aa, Cryptosporidium hominis
IHSVFQNILWRDWLIRYAPLVGNNG

SEQ ID NO: 2199930 - protein, 19 aa, Cryptosporidium hominis
IIFSVRPPKKSWRPIHNLS

SEQ ID NO: 2199931 - protein, 23 aa, Cryptosporidium hominis
IIHPFYQPMVLIATLFQKSSQKQ

SEQ ID NO: 2199932 - protein, 23 aa, Cryptosporidium hominis
IILDPYLLLRFIKLSFEELKAGI

SEQ ID NO: 2199933 - protein, 28 aa, Cryptosporidium hominis
IINEAFPPVFPLFTLPPLPPKRNGPGWN

SEQ ID NO: 2199934 - protein, 17 aa, Cryptosporidium hominis
IISPLNLELLDNGSNYS

SEQ ID NO: 2199935 - protein, 23 aa, Cryptosporidium hominis
IKKTFLYIRIIRNPSLYGLDIDE

SEQ ID NO: 2199936 - protein, 18 aa, Cryptosporidium hominis
IKLPDKIIRDIWLPLSPS

SEQ ID NO: 2199937 - protein, 17 aa, Cryptosporidium hominis
IKNLNPMQLKYLQKTQK

SEQ ID NO: 2199938 - protein, 27 aa, Cryptosporidium hominis
IKPIGNLRFLRYCKILWVMIGIDDFSM

SEQ ID NO: 2199939 - protein, 20 aa, Cryptosporidium hominis
IKRTLKFLWAISKGLPIISP

SEQ ID NO: 2199940 - protein, 19 aa, Cryptosporidium hominis
ILASLITNIDWWRIVLDEA

SEQ ID NO: 2199941 - protein, 21 aa, Cryptosporidium hominis
ILDLVRQFIKIRFPFVLVLNK

SEQ ID NO: 2199942 - protein, 27 aa, Cryptosporidium hominis
ILLDNPFRWVLFPIKYSRLWSLYKKYE

SEQ ID NO: 2199943 - protein, 19 aa, Cryptosporidium hominis
ILMEYFLQFGVILDAVVMY

SEQ ID NO: 2199944 - protein, 18 aa, Cryptosporidium hominis
ILPLQLPPISELYFFHLE

SEQ ID NO: 2199945 - protein, 17 aa, Cryptosporidium hominis
ILQFPNWFWRSASEEYI

SEQ ID NO: 2199946 - protein, 19 aa, Cryptosporidium hominis
ILSPSWILCIDIAAILLTN

SEQ ID NO: 2199947 - protein, 29 aa, Cryptosporidium hominis
ILVAAILCRWWHALPDWPPPDTDYQALLK

SEQ ID NO: 2199948 - protein, 22 aa, Cryptosporidium hominis
IMLAKFIRYILRPDPNLRPTPE

SEQ ID NO: 2199949 - protein, 26 aa, Cryptosporidium hominis
IMLCTDGWYIVKILTNITLIKSLIQN

SEQ ID NO: 2199950 - protein, 17 aa, Cryptosporidium hominis
IMQLLRDNLTLWTADLG

SEQ ID NO: 2199951 - protein, 25 aa, Cryptosporidium hominis
IMYPESPMVLMPLLTDIKNELNELK

SEQ ID NO: 2199952 - protein, 18 aa, Cryptosporidium hominis
INALRIYWDYYSRGILQE

SEQ ID NO: 2199953 - protein, 18 aa, Cryptosporidium hominis
INAPIIFWGLWQAISLVL

SEQ ID NO: 2199954 - protein, 21 aa, Cryptosporidium hominis
INARKLVERLLLKIYQEYDDF

SEQ ID NO: 2199955 - protein, 21 aa, Cryptosporidium hominis
INEFILLNWTPGEQKLLEEAI

SEQ ID NO: 2199956 - protein, 24 aa, Cryptosporidium hominis
INIKEHPILLRLVTLRTMMEKLKP

SEQ ID NO: 2199957 - protein, 29 aa, Cryptosporidium hominis
INRQGLSSIFYPIFPLVCFPDFVRSGANM

SEQ ID NO: 2199958 - protein, 23 aa, Cryptosporidium hominis
INSPWLFFSIRILDGYDTFCSDF

SEQ ID NO: 2199959 - protein, 17 aa, Cryptosporidium hominis
IPFEYHWEKPLFNSKLF

SEQ ID NO: 2199960 - protein, 26 aa, Cryptosporidium hominis
IPIEKVVWDYLHFLYRQNTGVLGYLA

SEQ ID NO: 2199961 - protein, 26 aa, Cryptosporidium hominis
IPIVFKLIGRFINGIFPIISKNQPIK

SEQ ID NO: 2199962 - protein, 18 aa, Cryptosporidium hominis
IPLRISCGLLTGVVKLFC

SEQ ID NO: 2199963 - protein, 18 aa, Cryptosporidium hominis
IPNDWWMCYVHGDDLEKI

SEQ ID NO: 2199964 - protein, 17 aa, Cryptosporidium hominis
IPNQYFIFTSPSLLYAS

SEQ ID NO: 2199965 - protein, 25 aa, Cryptosporidium hominis
IPRLKWMILLRIIPVDFFSLSIHDC

SEQ ID NO: 2199966 - protein, 20 aa, Cryptosporidium hominis
IPWVFAWTQIRSHLPVWLGL

SEQ ID NO: 2199967 - protein, 20 aa, Cryptosporidium hominis
IQDLLKYYPDFFYPTIHSLC

SEQ ID NO: 2199968 - protein, 22 aa, Cryptosporidium hominis
IQPLRFPLPIFEFFCENMAKKC

SEQ ID NO: 2199969 - protein, 22 aa, Cryptosporidium hominis
IRDYFTCMLFITLKLQDIFTKK

SEQ ID NO: 2199970 - protein, 19 aa, Cryptosporidium hominis
IRGIYQWFRKYFKTYYLPN

SEQ ID NO: 2199971 - protein, 17 aa, Cryptosporidium hominis
IRKTEIFWKFFLENLKG

SEQ ID NO: 2199972 - protein, 23 aa, Cryptosporidium hominis
ISDSLRFPVPIKKLLFALELVQH

SEQ ID NO: 2199973 - protein, 23 aa, Cryptosporidium hominis
ISEQFLLALSFLRKMKLTHTDLK

SEQ ID NO: 2199974 - protein, 22 aa, Cryptosporidium hominis
ISLWKTIFPWIWNNLEYQQRNE

SEQ ID NO: 2199975 - protein, 17 aa, Cryptosporidium hominis
ISPMPHQFWYNHLVPQC

SEQ ID NO: 2199976 - protein, 22 aa, Cryptosporidium hominis
ISPYEAIRLLKDPKLYSSPHNI

SEQ ID NO: 2199977 - protein, 25 aa, Cryptosporidium hominis
ISTRIYRWYLFYKHIILPLRRQVEY

SEQ ID NO: 2199978 - protein, 17 aa, Cryptosporidium hominis
ISVFPWSGKNCFYIYTD

SEQ ID NO: 2199979 - protein, 19 aa, Cryptosporidium hominis
ITANLMPRCIGMWKEYFTS

SEQ ID NO: 2199980 - protein, 25 aa, Cryptosporidium hominis
ITDLRGIHIPLSLAGKYFGLLRNER

SEQ ID NO: 2199981 - protein, 28 aa, Cryptosporidium hominis
ITSNGFMLIMVLLYQMGWIDTAILCQMY

SEQ ID NO: 2199982 - protein, 22 aa, Cryptosporidium hominis
IVDTPMSPRTAKWVRELTPVLE

SEQ ID NO: 2199983 - protein, 18 aa, Cryptosporidium hominis
IVEGIFILFHPKIRHLIN

SEQ ID NO: 2199984 - protein, 18 aa, Cryptosporidium hominis
IVKLITFIITRFNELLFS

SEQ ID NO: 2199985 - protein, 18 aa, Cryptosporidium hominis
IVLALRRWQLSFCSKLHG

SEQ ID NO: 2199986 - protein, 18 aa, Cryptosporidium hominis
IVQKIMINLLDALKFIHK

SEQ ID NO: 2199987 - protein, 24 aa, Cryptosporidium hominis
IWESYPNLIEFIIIIDKVFQPLKE

SEQ ID NO: 2199988 - protein, 17 aa, Cryptosporidium hominis
IWKIFFDIIFGLQHLHH

SEQ ID NO: 2199989 - protein, 19 aa, Cryptosporidium hominis
IWLYLDHWLFWLSLTNENN

SEQ ID NO: 2199990 - protein, 23 aa, Cryptosporidium hominis
IYDPKYIYVPYKKEFMPLKDLSE

SEQ ID NO: 2199991 - protein, 24 aa, Cryptosporidium hominis
IYSFLCGFVNLMRFKEDRWMTYKN

SEQ ID NO: 2199992 - protein, 20 aa, Cryptosporidium hominis
IYYLFGCRLIIIMELIELPK

SEQ ID NO: 2199993 - protein, 25 aa, Cryptosporidium hominis
KAIERLFIIIRNLRKYLPKLNCLFN

SEQ ID NO: 2199994 - protein, 25 aa, Cryptosporidium hominis
KALEIALKMSWPHFISLLKLLSSRG

SEQ ID NO: 2199995 - protein, 23 aa, Cryptosporidium hominis
KATRSRLLLKERIFSMNPFGVNI

SEQ ID NO: 2199996 - protein, 18 aa, Cryptosporidium hominis
KCILWPFSLLFIHKNELS

SEQ ID NO: 2199997 - protein, 18 aa, Cryptosporidium hominis
KDFYNRYKILYPSFESHD

SEQ ID NO: 2199998 - protein, 23 aa, Cryptosporidium hominis
KECARILYPTLLRLGYTVSQSRV

SEQ ID NO: 2199999 - protein, 19 aa, Cryptosporidium hominis
KEFMLQNLTEWYREIVKQY

SEQ ID NO: 2200000 - protein, 18 aa, Cryptosporidium hominis
KEGLFFYILLENNAKKSS

SEQ ID NO: 2200001 - protein, 26 aa, Cryptosporidium hominis
KEGLNALLRWLFRYVPDLSLSIRNLY

SEQ ID NO: 2200002 - protein, 24 aa, Cryptosporidium hominis
KEIVDFYYCIWKRTSRYKAWKSNR

SEQ ID NO: 2200003 - protein, 20 aa, Cryptosporidium hominis
KELDLLYGILSTCFEFVSEG

SEQ ID NO: 2200004 - protein, 23 aa, Cryptosporidium hominis
KELKLKLIDFLDKKLNWTEIETP

SEQ ID NO: 2200005 - protein, 22 aa, Cryptosporidium hominis
KEYLFKAFLIILSLEDNVDAQI

SEQ ID NO: 2200006 - protein, 21 aa, Cryptosporidium hominis
KEYLYLMALVDDSKFIDVDKA

SEQ ID NO: 2200007 - protein, 26 aa, Cryptosporidium hominis
KFKDPKFKIAWYFAMRDTLIVDDLDI

SEQ ID NO: 2200008 - protein, 20 aa, Cryptosporidium hominis
KFYCNLVPYMIKNLWRRLEN

SEQ ID NO: 2200009 - protein, 17 aa, Cryptosporidium hominis
KFYPCKCRYQICLWCFY

SEQ ID NO: 2200010 - protein, 18 aa, Cryptosporidium hominis
KFYTYLNNLLIISPKRRL

SEQ ID NO: 2200011 - protein, 21 aa, Cryptosporidium hominis
KGCIVILANLFRLIIHHNPSD

SEQ ID NO: 2200012 - protein, 17 aa, Cryptosporidium hominis
KGHLFVIINIIFPDKLD

SEQ ID NO: 2200013 - protein, 17 aa, Cryptosporidium hominis
KGSSNLPPLPRTEDYWP

SEQ ID NO: 2200014 - protein, 18 aa, Cryptosporidium hominis
KGTLILPNRLRYLQKRKV

SEQ ID NO: 2200015 - protein, 20 aa, Cryptosporidium hominis
KGVFNYFELVEKYTTRNSYN

SEQ ID NO: 2200016 - protein, 22 aa, Cryptosporidium hominis
KHIPDFLPIFPPRLDYCDKFIS

SEQ ID NO: 2200017 - protein, 21 aa, Cryptosporidium hominis
KHKIFRNKLILAPLTTVGNLP

SEQ ID NO: 2200018 - protein, 22 aa, Cryptosporidium hominis
KHLILYFNLIIFSIKSDKSLSN

SEQ ID NO: 2200019 - protein, 18 aa, Cryptosporidium hominis
KHPRGELKLWPTSYDRVI

SEQ ID NO: 2200020 - protein, 18 aa, Cryptosporidium hominis
KHRAKLYRFVNGEWKERG

SEQ ID NO: 2200021 - protein, 18 aa, Cryptosporidium hominis
KHVYLHHLKAYRSFNNGN

SEQ ID NO: 2200022 - protein, 20 aa, Cryptosporidium hominis
KIDHEILLKLYKIPIFNNVS

SEQ ID NO: 2200023 - protein, 17 aa, Cryptosporidium hominis
KILLLYLKQEIIGKSSS

SEQ ID NO: 2200024 - protein, 20 aa, Cryptosporidium hominis
KIPLHYILTLFIRSRIRRIR

SEQ ID NO: 2200025 - protein, 24 aa, Cryptosporidium hominis
KIQKSIDFIYWLLKKKTDFYCSES

SEQ ID NO: 2200026 - protein, 18 aa, Cryptosporidium hominis
KIWDLRRFDKPLLSSLLG

SEQ ID NO: 2200027 - protein, 21 aa, Cryptosporidium hominis
KIWSDILAIRIFIQNALKLCN

SEQ ID NO: 2200028 - protein, 18 aa, Cryptosporidium hominis
KIYLGYNIHKILLSIIDL

SEQ ID NO: 2200029 - protein, 17 aa, Cryptosporidium hominis
KKKSIYDICLLLSRLIS

SEQ ID NO: 2200030 - protein, 18 aa, Cryptosporidium hominis
KKLKFILFQQQRENKRLK

SEQ ID NO: 2200031 - protein, 30 aa, Cryptosporidium hominis
KKNVPFIYDYLFITPLRWPTLTFSIPPIRF

SEQ ID NO: 2200032 - protein, 20 aa, Cryptosporidium hominis
KKTQRCLGFAHILFEKAIEG

SEQ ID NO: 2200033 - protein, 24 aa, Cryptosporidium hominis
KLAKLRSYIIWNSIAVIKVLKKRR

SEQ ID NO: 2200034 - protein, 19 aa, Cryptosporidium hominis
KLCIMELYDFLYNKNNSLI

SEQ ID NO: 2200035 - protein, 24 aa, Cryptosporidium hominis
KLDGRLFCFLCTFKYKKLKHEEVK

SEQ ID NO: 2200036 - protein, 17 aa, Cryptosporidium hominis
KLEVFLVFKSGLDPNSE

SEQ ID NO: 2200037 - protein, 29 aa, Cryptosporidium hominis
KLFCDQIQLPPIFYILSKRILIQEAKYHL

SEQ ID NO: 2200038 - protein, 23 aa, Cryptosporidium hominis
KLHEKPFWEVFPLSQIVVLSPDS

SEQ ID NO: 2200039 - protein, 17 aa, Cryptosporidium hominis
KLILQFLLESGLLESYS

SEQ ID NO: 2200040 - protein, 18 aa, Cryptosporidium hominis
KLIQHFQYLLATNPDLVC

SEQ ID NO: 2200041 - protein, 28 aa, Cryptosporidium hominis
KLKSHKIFAVFLRYLQKKGIKYPRNNYG

SEQ ID NO: 2200042 - protein, 17 aa, Cryptosporidium hominis
KLLESLIFCIPFGNSLN

SEQ ID NO: 2200043 - protein, 21 aa, Cryptosporidium hominis
KLQSFCFMWMLPEHALLNSII

SEQ ID NO: 2200044 - protein, 18 aa, Cryptosporidium hominis
KLVFSYYDWGWKGYLDEF

SEQ ID NO: 2200045 - protein, 19 aa, Cryptosporidium hominis
KLVVNFRKEIHGTWFITLK

SEQ ID NO: 2200046 - protein, 20 aa, Cryptosporidium hominis
KMIELILIKKFKDFYILIMK

SEQ ID NO: 2200047 - protein, 21 aa, Cryptosporidium hominis
KNDLPLFIRLLQDGSTEAVLS

SEQ ID NO: 2200048 - protein, 23 aa, Cryptosporidium hominis
KNITLIINCLFALGYKKIALVKM

SEQ ID NO: 2200049 - protein, 20 aa, Cryptosporidium hominis
KNIWFIFKRIYSMKPNSVEI

SEQ ID NO: 2200050 - protein, 18 aa, Cryptosporidium hominis
KNLKENYLFILKIIKMLK

SEQ ID NO: 2200051 - protein, 25 aa, Cryptosporidium hominis
KNLSKNLIFLIFKGSTCYELLTAEK

SEQ ID NO: 2200052 - protein, 21 aa, Cryptosporidium hominis
KNMIFFLYDSFLSEIFQLDGL

SEQ ID NO: 2200053 - protein, 18 aa, Cryptosporidium hominis
KNNSILCVLPRTPIDRLC

SEQ ID NO: 2200054 - protein, 23 aa, Cryptosporidium hominis
KNVKALYRRGLARLGFGMYEESK

SEQ ID NO: 2200055 - protein, 22 aa, Cryptosporidium hominis
KPMICDFILFSILFDDISLIEF

SEQ ID NO: 2200056 - protein, 21 aa, Cryptosporidium hominis
KPNVILLLDSFFHIVVWYGEM

SEQ ID NO: 2200057 - protein, 24 aa, Cryptosporidium hominis
KQHRKQPMNFLPLNSIKLDKRGNS

SEQ ID NO: 2200058 - protein, 20 aa, Cryptosporidium hominis
KQLIFLFKQIIYSISPIKVN

SEQ ID NO: 2200059 - protein, 21 aa, Cryptosporidium hominis
KQMPNWMITTPYLNMKDILSD

SEQ ID NO: 2200060 - protein, 18 aa, Cryptosporidium hominis
KQSSNFQILWPSLQDWIY

SEQ ID NO: 2200061 - protein, 24 aa, Cryptosporidium hominis
KRARPLEMLILPNVALMLSTLRFR

SEQ ID NO: 2200062 - protein, 23 aa, Cryptosporidium hominis
KRLSLKRRLYLKGYFDITDFDDI

SEQ ID NO: 2200063 - protein, 25 aa, Cryptosporidium hominis
KRLTFPSFFPIKQFFFCFFIEESLE

SEQ ID NO: 2200064 - protein, 19 aa, Cryptosporidium hominis
KRMEILTKIFTILKNQKNI

SEQ ID NO: 2200065 - protein, 17 aa, Cryptosporidium hominis
KSAWEYFDSLHSKLINL

SEQ ID NO: 2200066 - protein, 22 aa, Cryptosporidium hominis
KSCPVWIPPWWTAFRIGGWNWQ

SEQ ID NO: 2200067 - protein, 24 aa, Cryptosporidium hominis
KSIKSFVLLAYFLNVFGVKDAMDV

SEQ ID NO: 2200068 - protein, 18 aa, Cryptosporidium hominis
KSIMWYILVPYEYGIPII

SEQ ID NO: 2200069 - protein, 26 aa, Cryptosporidium hominis
KSKKLVLPPIPYFRRPAISRSRINYS

SEQ ID NO: 2200070 - protein, 17 aa, Cryptosporidium hominis
KSLNYLALQLMLGKEHQ

SEQ ID NO: 2200071 - protein, 27 aa, Cryptosporidium hominis
KSNLLQFLWIRFYGFRVIFRKFNDLLL

SEQ ID NO: 2200072 - protein, 23 aa, Cryptosporidium hominis
KSQILYFMNFVYELLLRAFEIVR

SEQ ID NO: 2200073 - protein, 24 aa, Cryptosporidium hominis
KSQQFLILFLFICTFREFSGLSFS

SEQ ID NO: 2200074 - protein, 19 aa, Cryptosporidium hominis
KSVLLYYFFEKWMNEKFVG

SEQ ID NO: 2200075 - protein, 24 aa, Cryptosporidium hominis
KTAAFLLPALERLLRSPYVRNSRV

SEQ ID NO: 2200076 - protein, 19 aa, Cryptosporidium hominis
KTLRILAIRLWDKRIMLKG

SEQ ID NO: 2200077 - protein, 24 aa, Cryptosporidium hominis
KTVKDLIWLLYDTSLLTSGFSLED

SEQ ID NO: 2200078 - protein, 21 aa, Cryptosporidium hominis
KVFPYPICFVSKSLPTPPKDY

SEQ ID NO: 2200079 - protein, 24 aa, Cryptosporidium hominis
KVGIYGFNCRCGFNFCSTHRYADA

SEQ ID NO: 2200080 - protein, 21 aa, Cryptosporidium hominis
KVHRSLWIPPKSYEHAYVNDL

SEQ ID NO: 2200081 - protein, 24 aa, Cryptosporidium hominis
KVHSNFYFLFNNYLNFLENQPLKN

SEQ ID NO: 2200082 - protein, 25 aa, Cryptosporidium hominis
KVLGQVFMKLLRLLRLHVPNIDPSM

SEQ ID NO: 2200083 - protein, 19 aa, Cryptosporidium hominis
KVLLFRFPDYFGSESLRFF

SEQ ID NO: 2200084 - protein, 18 aa, Cryptosporidium hominis
KYIEHCLYLLQLYAKKKS

SEQ ID NO: 2200085 - protein, 18 aa, Cryptosporidium hominis
KYIFDGPLSFDTIMALKK

SEQ ID NO: 2200086 - protein, 22 aa, Cryptosporidium hominis
KYIRMSLSLLLKLRLKCIRKQT

SEQ ID NO: 2200087 - protein, 17 aa, Cryptosporidium hominis
KYQALILSSQKLLEIIY

SEQ ID NO: 2200088 - protein, 24 aa, Cryptosporidium hominis
KYSLSYNWFIYWNDNFPKSTGISN

SEQ ID NO: 2200089 - protein, 17 aa, Cryptosporidium hominis
KYYWVYMLTLDFPNLTF

SEQ ID NO: 2200090 - protein, 19 aa, Cryptosporidium hominis
KYYYYHSMTWPQLLDIATD

SEQ ID NO: 2200091 - protein, 22 aa, Cryptosporidium hominis
LAGLNWLLQLWSEGRNGILADE

SEQ ID NO: 2200092 - protein, 46 aa, Cryptosporidium hominis
LAILYRKRKLHVLGIIRLIGELFIRKMFPMRSLNELVFDLVMIQEN

SEQ ID NO: 2200093 - protein, 17 aa, Cryptosporidium hominis
LAIRIFIQNALKLCNQL

SEQ ID NO: 2200094 - protein, 18 aa, Cryptosporidium hominis
LASQVLLPQIPRLLGPGL

SEQ ID NO: 2200095 - protein, 21 aa, Cryptosporidium hominis
LCNDKFMLIAYKWSNKESLKE

SEQ ID NO: 2200096 - protein, 18 aa, Cryptosporidium hominis
LCNLIISQIFKFPTVFRT

SEQ ID NO: 2200097 - protein, 18 aa, Cryptosporidium hominis
LCVLPRTPIDRLCLSPIP

SEQ ID NO: 2200098 - protein, 24 aa, Cryptosporidium hominis
LDAYYKLLVLSYSKMFLAFISLKN

SEQ ID NO: 2200099 - protein, 27 aa, Cryptosporidium hominis
LDFTQPFFMLLSFIPKLSYDILLAHVP

SEQ ID NO: 2200100 - protein, 17 aa, Cryptosporidium hominis
LDLFKIGLFLLQGKTKK

SEQ ID NO: 2200101 - protein, 19 aa, Cryptosporidium hominis
LDLFLNLANWFGLHSGIPF

SEQ ID NO: 2200102 - protein, 25 aa, Cryptosporidium hominis
LDSQPPIINPLLQSPLLSIGSQPSI

SEQ ID NO: 2200103 - protein, 19 aa, Cryptosporidium hominis
LDSTTLLELYYFDYDRFVI

SEQ ID NO: 2200104 - protein, 17 aa, Cryptosporidium hominis
LEDILFQYALSRSRYES

SEQ ID NO: 2200105 - protein, 25 aa, Cryptosporidium hominis
LEFEKVYCPFLLMNKKRYAGVLFKN

SEQ ID NO: 2200106 - protein, 24 aa, Cryptosporidium hominis
LEFWDPWIMTLPRRNIQDNELNPI

SEQ ID NO: 2200107 - protein, 17 aa, Cryptosporidium hominis
LERWNPFLLYKFEQEYF

SEQ ID NO: 2200108 - protein, 21 aa, Cryptosporidium hominis
LETLFYIFYNMPQDLLQGFAA

SEQ ID NO: 2200109 - protein, 17 aa, Cryptosporidium hominis
LEYIPFSEPEDINYYVS

SEQ ID NO: 2200110 - protein, 18 aa, Cryptosporidium hominis
LFAIPFFFKSDVFTNPFV

SEQ ID NO: 2200111 - protein, 18 aa, Cryptosporidium hominis
LFCRNIIIIFLVNFTLRS

SEQ ID NO: 2200112 - protein, 18 aa, Cryptosporidium hominis
LFFYILLENNAKKSSECM

SEQ ID NO: 2200113 - protein, 17 aa, Cryptosporidium hominis
LFRIPITAPFRKLIRYF

SEQ ID NO: 2200114 - protein, 18 aa, Cryptosporidium hominis
LFRPKMIIAGASGYPRMI

SEQ ID NO: 2200115 - protein, 17 aa, Cryptosporidium hominis
LGIYYLYNKKMVAHKPY

SEQ ID NO: 2200116 - protein, 23 aa, Cryptosporidium hominis
LGKPMFHIGFITTVLKLLRCVCY

SEQ ID NO: 2200117 - protein, 23 aa, Cryptosporidium hominis
LGRKQMNILFIHYLVFTLKNLNL

SEQ ID NO: 2200118 - protein, 25 aa, Cryptosporidium hominis
LGSFSSILGYIPYNILLASENIQNE

SEQ ID NO: 2200119 - protein, 20 aa, Cryptosporidium hominis
LHEFGTMYRLLLSGTPLHNN

SEQ ID NO: 2200120 - protein, 21 aa, Cryptosporidium hominis
LHESWICLVTLIFQMKDLIEE

SEQ ID NO: 2200121 - protein, 18 aa, Cryptosporidium hominis
LHLLVFSCLIINLCFGSE

SEQ ID NO: 2200122 - protein, 21 aa, Cryptosporidium hominis
LHRRIEWFLHWYIESASSIDQ

SEQ ID NO: 2200123 - protein, 19 aa, Cryptosporidium hominis
LHRSAFRLALLVVGISHSV

SEQ ID NO: 2200124 - protein, 22 aa, Cryptosporidium hominis
LHWLRVMYHYLDTVDARKIREV

SEQ ID NO: 2200125 - protein, 19 aa, Cryptosporidium hominis
LIERLKILLLYLKQEIIGK

SEQ ID NO: 2200126 - protein, 24 aa, Cryptosporidium hominis
LIIAKALQFNFLPTVRSIEKETET

SEQ ID NO: 2200127 - protein, 22 aa, Cryptosporidium hominis
LIKKRITIIPLDKIMDPSISEK

SEQ ID NO: 2200128 - protein, 23 aa, Cryptosporidium hominis
LIPLDPRIVMRILFNFRKLHPVS

SEQ ID NO: 2200129 - protein, 18 aa, Cryptosporidium hominis
LIPLFRVPRPRFPYLVLV

SEQ ID NO: 2200130 - protein, 18 aa, Cryptosporidium hominis
LIQSLNFIIQLKNKIFLN

SEQ ID NO: 2200131 - protein, 27 aa, Cryptosporidium hominis
LIRKGFERLFPPLLYKLQQEYIQENAK

SEQ ID NO: 2200132 - protein, 18 aa, Cryptosporidium hominis
LISLIYYTTDYRDYFSNW

SEQ ID NO: 2200133 - protein, 25 aa, Cryptosporidium hominis
LISTILLPEILFFDSLLSMPIYQYI

SEQ ID NO: 2200134 - protein, 18 aa, Cryptosporidium hominis
LIVRGFLLSGVTIWSYES

SEQ ID NO: 2200135 - protein, 17 aa, Cryptosporidium hominis
LIWVIFYTKPFKPKDFV

SEQ ID NO: 2200136 - protein, 23 aa, Cryptosporidium hominis
LKARSKLWWFCRMAEHCGLVGRE

SEQ ID NO: 2200137 - protein, 19 aa, Cryptosporidium hominis
LKELFTLLNFLYPDILQDS

SEQ ID NO: 2200138 - protein, 21 aa, Cryptosporidium hominis
LKLFDYLLSMPLWSLTKEKME

SEQ ID NO: 2200139 - protein, 18 aa, Cryptosporidium hominis
LKQIIMQMIILFKNLVSV

SEQ ID NO: 2200140 - protein, 23 aa, Cryptosporidium hominis
LKTGYLYVYRFSNGMPIICKDTE

SEQ ID NO: 2200141 - protein, 27 aa, Cryptosporidium hominis
LKTTPRPYLVWLLHDFNFLLYDTANNM

SEQ ID NO: 2200142 - protein, 27 aa, Cryptosporidium hominis
LLALPKRPIMYFAKWKHLSFADNTWEH

SEQ ID NO: 2200143 - protein, 19 aa, Cryptosporidium hominis
LLCDWLFTILDYLDKKKSN

SEQ ID NO: 2200144 - protein, 19 aa, Cryptosporidium hominis
LLDKFLRFCVKFHIEWLYK

SEQ ID NO: 2200145 - protein, 24 aa, Cryptosporidium hominis
LLDNPQFCYALLHSQFILGMVNEP

SEQ ID NO: 2200146 - protein, 25 aa, Cryptosporidium hominis
LLEFLSFFHRYIPIGILEQPIHTQN

SEQ ID NO: 2200147 - protein, 18 aa, Cryptosporidium hominis
LLEGITLILYKNGVLKAL

SEQ ID NO: 2200148 - protein, 20 aa, Cryptosporidium hominis
LLFEFRLSWSNHLIYTHWME

SEQ ID NO: 2200149 - protein, 19 aa, Cryptosporidium hominis
LLFVNKFVWIRSIPMGRFI

SEQ ID NO: 2200150 - protein, 22 aa, Cryptosporidium hominis
LLHKKIVIFQFISFLVIDEGDR

SEQ ID NO: 2200151 - protein, 19 aa, Cryptosporidium hominis
LLIIGLCPWGWEYISGGKV

SEQ ID NO: 2200152 - protein, 22 aa, Cryptosporidium hominis
LLISLYRRLYILRPFIEKINNE

SEQ ID NO: 2200153 - protein, 22 aa, Cryptosporidium hominis
LLKLLTWYLSWNKILEYPSASF

SEQ ID NO: 2200154 - protein, 30 aa, Cryptosporidium hominis
LLKLQRWFYELFHDFPFFSISPYTKTLKYL

SEQ ID NO: 2200155 - protein, 18 aa, Cryptosporidium hominis
LLLLLEKIILLIELARIE

SEQ ID NO: 2200156 - protein, 19 aa, Cryptosporidium hominis
LLLLYRGCSSKRPHTKRGR

SEQ ID NO: 2200157 - protein, 19 aa, Cryptosporidium hominis
LLNCWLPHYKPINKIKLIQ

SEQ ID NO: 2200158 - protein, 19 aa, Cryptosporidium hominis
LLNLFYIIHRYLTLKHISP

SEQ ID NO: 2200159 - protein, 24 aa, Cryptosporidium hominis
LLQQFDWIFKINKLPLWLHPYEIL

SEQ ID NO: 2200160 - protein, 19 aa, Cryptosporidium hominis
LLRKSFSIILPYKPIKDLS

SEQ ID NO: 2200161 - protein, 18 aa, Cryptosporidium hominis
LLTLQYYFSLWRQESRKE

SEQ ID NO: 2200162 - protein, 17 aa, Cryptosporidium hominis
LLVLRRKKLVTQEREKL

SEQ ID NO: 2200163 - protein, 17 aa, Cryptosporidium hominis
LLVPFYLPSFVNLEIMF

SEQ ID NO: 2200164 - protein, 18 aa, Cryptosporidium hominis
LNAGQFFKYIERCSPIKP

SEQ ID NO: 2200165 - protein, 18 aa, Cryptosporidium hominis
LNFIIQLKNKIFLNSEFS

SEQ ID NO: 2200166 - protein, 17 aa, Cryptosporidium hominis
LNFTWGCLPLRAIDHPD

SEQ ID NO: 2200167 - protein, 23 aa, Cryptosporidium hominis
LNKIPIRFPWILEELPIAQSFKN

SEQ ID NO: 2200168 - protein, 24 aa, Cryptosporidium hominis
LNRQEWLIPFWPLLMAVGSIYDSN

SEQ ID NO: 2200169 - protein, 22 aa, Cryptosporidium hominis
LNSCKIFYLNLPKLRSIRLKCK

SEQ ID NO: 2200170 - protein, 27 aa, Cryptosporidium hominis
LNSDNLYRALRFGGLLVRIPPYNQKSY

SEQ ID NO: 2200171 - protein, 25 aa, Cryptosporidium hominis
LNSGLPPISLPPRAIPPINLSQSLM

SEQ ID NO: 2200172 - protein, 19 aa, Cryptosporidium hominis
LNTISYWSFLRAPPSPKKN

SEQ ID NO: 2200173 - protein, 23 aa, Cryptosporidium hominis
LNTSIRLWWKRIFKGGIETDISK

SEQ ID NO: 2200174 - protein, 17 aa, Cryptosporidium hominis
LPLWLHPYEILVIGSHG

SEQ ID NO: 2200175 - protein, 17 aa, Cryptosporidium hominis
LPPLPRTEDYWPKINKD

SEQ ID NO: 2200176 - protein, 19 aa, Cryptosporidium hominis
LPVTWIPPEYRWLHFLHLA

SEQ ID NO: 2200177 - protein, 20 aa, Cryptosporidium hominis
LQEIIQKSIPWISNNNINMN

SEQ ID NO: 2200178 - protein, 23 aa, Cryptosporidium hominis
LQFKHYFSIFWSKTMRPHLKFDH

SEQ ID NO: 2200179 - protein, 17 aa, Cryptosporidium hominis
LQLKLTLSLINFLRKLG

SEQ ID NO: 2200180 - protein, 23 aa, Cryptosporidium hominis
LQSFPQLILPPNGSLVPLLRLAP

SEQ ID NO: 2200181 - protein, 21 aa, Cryptosporidium hominis
LQSPPLLVLTPSTPIPIVPTT

SEQ ID NO: 2200182 - protein, 17 aa, Cryptosporidium hominis
LQYSQILLRLYFELLRQ

SEQ ID NO: 2200183 - protein, 18 aa, Cryptosporidium hominis
LREHYFFIVIPNEYTRDA

SEQ ID NO: 2200184 - protein, 17 aa, Cryptosporidium hominis
LRFVMSIAPLAISTTGR

SEQ ID NO: 2200185 - protein, 24 aa, Cryptosporidium hominis
LRLSGYLDLIYFKATTPLLDSKMD

SEQ ID NO: 2200186 - protein, 22 aa, Cryptosporidium hominis
LRRNRLLLWRSIKCQIWKTQYI

SEQ ID NO: 2200187 - protein, 24 aa, Cryptosporidium hominis
LSKIPFPILLVYIGLNAGLFRGSE

SEQ ID NO: 2200188 - protein, 18 aa, Cryptosporidium hominis
LSLPYKLWIDAKSRDWIL

SEQ ID NO: 2200189 - protein, 19 aa, Cryptosporidium hominis
LSLYLSFWCFSAAAALSSL

SEQ ID NO: 2200190 - protein, 24 aa, Cryptosporidium hominis
LSNLIRIWWHFIPIPHCEIPCPVP

SEQ ID NO: 2200191 - protein, 20 aa, Cryptosporidium hominis
LSPIQLFLRPFMQCCAPRSR

SEQ ID NO: 2200192 - protein, 19 aa, Cryptosporidium hominis
LSRFDLQFLLLDIPDKEKD

SEQ ID NO: 2200193 - protein, 18 aa, Cryptosporidium hominis
LTMSKLLHFLGFKKTRIS

SEQ ID NO: 2200194 - protein, 18 aa, Cryptosporidium hominis
LTQPFFMSEAFTGKPGVF

SEQ ID NO: 2200195 - protein, 19 aa, Cryptosporidium hominis
LVDGLFGRIWEFPKCENVR

SEQ ID NO: 2200196 - protein, 19 aa, Cryptosporidium hominis
LVDYWIELTLTQAKSMNNN

SEQ ID NO: 2200197 - protein, 19 aa, Cryptosporidium hominis
LVGFLQKALLYIYLEYHTS

SEQ ID NO: 2200198 - protein, 25 aa, Cryptosporidium hominis
LVRELVMLFILLRPTIHKERLDSDP

SEQ ID NO: 2200199 - protein, 23 aa, Cryptosporidium hominis
LVSKLTKVLFKHIRTFLPDIRRE

SEQ ID NO: 2200200 - protein, 19 aa, Cryptosporidium hominis
LVVWLRKMYCKYNQPYLTC

SEQ ID NO: 2200201 - protein, 18 aa, Cryptosporidium hominis
LWCIEILHQFYYLNLDLL

SEQ ID NO: 2200202 - protein, 20 aa, Cryptosporidium hominis
LWELFSSNFLLFKFYPSGNE

SEQ ID NO: 2200203 - protein, 19 aa, Cryptosporidium hominis
LWRFFIYYRKTRNSRFEKI

SEQ ID NO: 2200204 - protein, 17 aa, Cryptosporidium hominis
LYFQIQAAYWWYEDMWY

SEQ ID NO: 2200205 - protein, 20 aa, Cryptosporidium hominis
LYGSIYYFKLGIIKDLPPPI

SEQ ID NO: 2200206 - protein, 20 aa, Cryptosporidium hominis
LYIIQSIIPISIFSLLLTRF

SEQ ID NO: 2200207 - protein, 25 aa, Cryptosporidium hominis
LYQGSINFIKLKLLIYIEEPEILLA

SEQ ID NO: 2200208 - protein, 20 aa, Cryptosporidium hominis
LYVVPLPLHGELHIALDNIT

SEQ ID NO: 2200209 - protein, 20 aa, Cryptosporidium hominis
LYYAALLITSAWWSPGIDTY

SEQ ID NO: 2200210 - protein, 22 aa, Cryptosporidium hominis
MEDISLLPGWILRNLSLMREID

SEQ ID NO: 2200211 - protein, 25 aa, Cryptosporidium hominis
MEQTFVKPLLYYSPKMKFIAKLAAS

SEQ ID NO: 2200212 - protein, 17 aa, Cryptosporidium hominis
MERVLFLWAIRNPASGY

SEQ ID NO: 2200213 - protein, 22 aa, Cryptosporidium hominis
MGCIFLEILCKRTPLQHVLDKV

SEQ ID NO: 2200214 - protein, 23 aa, Cryptosporidium hominis
MINKAILPWFRLGSRPILSDESD

SEQ ID NO: 2200215 - protein, 17 aa, Cryptosporidium hominis
MINLLDALKFIHKNGII

SEQ ID NO: 2200216 - protein, 19 aa, Cryptosporidium hominis
MIRCSIKFFSLYRHIKRKN

SEQ ID NO: 2200217 - protein, 23 aa, Cryptosporidium hominis
MLDVWNLLLKPLGLSLQVVNMGG

SEQ ID NO: 2200218 - protein, 17 aa, Cryptosporidium hominis
MLIAYKWSNKESLKEIM

SEQ ID NO: 2200219 - protein, 25 aa, Cryptosporidium hominis
MLKSLRRYYVSPLLKKIALTVIARY

SEQ ID NO: 2200220 - protein, 18 aa, Cryptosporidium hominis
MLLLLKLVDNILIRIILL

SEQ ID NO: 2200221 - protein, 17 aa, Cryptosporidium hominis
MLPLSYKWIGLSRSNHK

SEQ ID NO: 2200222 - protein, 22 aa, Cryptosporidium hominis
MNYICEIVKLYWTPFYFKETEN

SEQ ID NO: 2200223 - protein, 23 aa, Cryptosporidium hominis
MPLYKRVFPKWFPITWFEDNNIR

SEQ ID NO: 2200224 - protein, 24 aa, Cryptosporidium hominis
MQIIDTWPYAFPRYKYDIDDQLEI

SEQ ID NO: 2200225 - protein, 24 aa, Cryptosporidium hominis
MQTMSFVWHLVYKEKLRGPFLVVA

SEQ ID NO: 2200226 - protein, 21 aa, Cryptosporidium hominis
MRFFLIKFFPILLFSTRINNG

SEQ ID NO: 2200227 - protein, 23 aa, Cryptosporidium hominis
MRFVCILWRKILPYRQFICGLAL

SEQ ID NO: 2200228 - protein, 20 aa, Cryptosporidium hominis
MSFRLIFKWFKETFKSLKLK

SEQ ID NO: 2200229 - protein, 19 aa, Cryptosporidium hominis
MSGLINLLLLFEKNQRFKK

SEQ ID NO: 2200230 - protein, 17 aa, Cryptosporidium hominis
MVLLHKLLPKLFSQGSR

SEQ ID NO: 2200231 - protein, 17 aa, Cryptosporidium hominis
MVRLIGLDYIDQLRDLR

SEQ ID NO: 2200232 - protein, 20 aa, Cryptosporidium hominis
MWRRRWEPCLPHILRSPLSI

SEQ ID NO: 2200233 - protein, 23 aa, Cryptosporidium hominis
MWSLGVILYILLCGYPPFHGSND

SEQ ID NO: 2200234 - protein, 18 aa, Cryptosporidium hominis
MWYILVPYEYGIPIITET

SEQ ID NO: 2200235 - protein, 25 aa, Cryptosporidium hominis
MYADLCQILKWRSPVLVNKDGKSTI

SEQ ID NO: 2200236 - protein, 24 aa, Cryptosporidium hominis
NANKPIRLLNFPLPFKLPPKRYSN

SEQ ID NO: 2200237 - protein, 17 aa, Cryptosporidium hominis
NCTLPVNTLMPLVKWRP

SEQ ID NO: 2200238 - protein, 23 aa, Cryptosporidium hominis
NDIVELFLIPQWWMNCKPFAEKA

SEQ ID NO: 2200239 - protein, 24 aa, Cryptosporidium hominis
NDKLEIFFIDFDLMPLLLEENYIS

SEQ ID NO: 2200240 - protein, 23 aa, Cryptosporidium hominis
NDPLLLEFLFYIVGYTSLKEENI

SEQ ID NO: 2200241 - protein, 19 aa, Cryptosporidium hominis
NEAFFRDYILRHLNNYFDL

SEQ ID NO: 2200242 - protein, 19 aa, Cryptosporidium hominis
NEGWSVELIFKGLAEFIIM

SEQ ID NO: 2200243 - protein, 21 aa, Cryptosporidium hominis
NEKYQFPFSRLPPIIDFSFAE

SEQ ID NO: 2200244 - protein, 21 aa, Cryptosporidium hominis
NENFFMCLKWPESLSVTPEAE

SEQ ID NO: 2200245 - protein, 23 aa, Cryptosporidium hominis
NENLLNYFINLPESIWLSGFLDQ

SEQ ID NO: 2200246 - protein, 25 aa, Cryptosporidium hominis
NENSRFLFQVPPPPPLVYSSSGQPV

SEQ ID NO: 2200247 - protein, 18 aa, Cryptosporidium hominis
NENYFILDLLAQAGTYIK

SEQ ID NO: 2200248 - protein, 17 aa, Cryptosporidium hominis
NERFKIIYWLSLHSNRL

SEQ ID NO: 2200249 - protein, 20 aa, Cryptosporidium hominis
NESLWFDALRHLLKWTLQWD

SEQ ID NO: 2200250 - protein, 25 aa, Cryptosporidium hominis
NEWQNLLIKWLTYVFKFSERNGISM

SEQ ID NO: 2200251 - protein, 19 aa, Cryptosporidium hominis
NFEEKLSWLPNIEILDMPE

SEQ ID NO: 2200252 - protein, 20 aa, Cryptosporidium hominis
NFIIKKYINWFLIPAADIFG

SEQ ID NO: 2200253 - protein, 25 aa, Cryptosporidium hominis
NFKDLHAYRLIFRCLGNLRPSSMPI

SEQ ID NO: 2200254 - protein, 19 aa, Cryptosporidium hominis
NFLKQWYLSFTNVLLRMLD

SEQ ID NO: 2200255 - protein, 27 aa, Cryptosporidium hominis
NFNRLRLQFIFFYYDSNRDGLLSIDEL

SEQ ID NO: 2200256 - protein, 22 aa, Cryptosporidium hominis
NGFLFQYILDYLRTGTIVAIPN

SEQ ID NO: 2200257 - protein, 25 aa, Cryptosporidium hominis
NIDILDLFPIFSWLENPNNFNHPMH

SEQ ID NO: 2200258 - protein, 23 aa, Cryptosporidium hominis
NIDWNKRISSRLFQIAIGKGTRA

SEQ ID NO: 2200259 - protein, 20 aa, Cryptosporidium hominis
NIESISAIFFLRNLKRLSLV

SEQ ID NO: 2200260 - protein, 19 aa, Cryptosporidium hominis
NIHKILLSIIDLYDLILDE

SEQ ID NO: 2200261 - protein, 19 aa, Cryptosporidium hominis
NIITAIKLLAIVRDIKRQI

SEQ ID NO: 2200262 - protein, 20 aa, Cryptosporidium hominis
NILQLYAWFEDKSRIWLVIE

SEQ ID NO: 2200263 - protein, 19 aa, Cryptosporidium hominis
NILYFNYLRISSILVEVTY

SEQ ID NO: 2200264 - protein, 23 aa, Cryptosporidium hominis
NIQELFLFLSLFYHNYQREWILP

SEQ ID NO: 2200265 - protein, 20 aa, Cryptosporidium hominis
NIRWTYYSFYPLILSSYLQA

SEQ ID NO: 2200266 - protein, 24 aa, Cryptosporidium hominis
NKDVKLIPELFWDKDFILNLNAGA

SEQ ID NO: 2200267 - protein, 24 aa, Cryptosporidium hominis
NKIKDCPLFLSFSYGRALQASVLK

SEQ ID NO: 2200268 - protein, 23 aa, Cryptosporidium hominis
NKNRLIFAVLPFGTGNDWAKSFG

SEQ ID NO: 2200269 - protein, 21 aa, Cryptosporidium hominis
NKQRWKWVALLPFIDQKVLLE

SEQ ID NO: 2200270 - protein, 25 aa, Cryptosporidium hominis
NLEELWSLLHFLNPLRFQNYQEFRL

SEQ ID NO: 2200271 - protein, 18 aa, Cryptosporidium hominis
NLFIILSNYIYITEDHQN

SEQ ID NO: 2200272 - protein, 20 aa, Cryptosporidium hominis
NLFKIFLRYFIYPAYLDLYS

SEQ ID NO: 2200273 - protein, 21 aa, Cryptosporidium hominis
NLLELLYLSDASEFFFCLECI

SEQ ID NO: 2200274 - protein, 20 aa, Cryptosporidium hominis
NLPLCGLLIYFISSLIHRSP

SEQ ID NO: 2200275 - protein, 19 aa, Cryptosporidium hominis
NLPREAPFIAKVTNLDYSL

SEQ ID NO: 2200276 - protein, 24 aa, Cryptosporidium hominis
NLRPSSMPIFILRPIIKQLDEYRK

SEQ ID NO: 2200277 - protein, 29 aa, Cryptosporidium hominis
NLTKIIIYFIQSYAALRYKFADKAVIENS

SEQ ID NO: 2200278 - protein, 26 aa, Cryptosporidium hominis
NLVPYPRIHFMLSSYAPIISAEKAFH

SEQ ID NO: 2200279 - protein, 18 aa, Cryptosporidium hominis
NMFQILLDILFLDINNSQ

SEQ ID NO: 2200280 - protein, 20 aa, Cryptosporidium hominis
NMSFLLHLLVFSCLIINLCF

SEQ ID NO: 2200281 - protein, 27 aa, Cryptosporidium hominis
NMSHMSILSIILERLFNSPFEELQKLH

SEQ ID NO: 2200282 - protein, 26 aa, Cryptosporidium hominis
NMVDKWLMLYILLKMNVIPRKCLIFV

SEQ ID NO: 2200283 - protein, 18 aa, Cryptosporidium hominis
NNMILSNMLLLNGALSGS

SEQ ID NO: 2200284 - protein, 21 aa, Cryptosporidium hominis
NNNYQLLLSQLMQYLYGGNNN

SEQ ID NO: 2200285 - protein, 23 aa, Cryptosporidium hominis
NNPPRILICNPLKYLILERDSQI

SEQ ID NO: 2200286 - protein, 20 aa, Cryptosporidium hominis
NNVFMFPIPIWKSPTQKKNI

SEQ ID NO: 2200287 - protein, 19 aa, Cryptosporidium hominis
NPFLLYKFEQEYFKNGAVL

SEQ ID NO: 2200288 - protein, 23 aa, Cryptosporidium hominis
NPGPIQYFNLFKNLFNRTLFESE

SEQ ID NO: 2200289 - protein, 28 aa, Cryptosporidium hominis
NPMGLQPFPMHSILLPTLLQAQIQAQMR

SEQ ID NO: 2200290 - protein, 27 aa, Cryptosporidium hominis
NPSSLYSISLLLIIGLALKGNGENETL

SEQ ID NO: 2200291 - protein, 25 aa, Cryptosporidium hominis
NQISNYWLLLVLAYEQLFGNLKIQG

SEQ ID NO: 2200292 - protein, 22 aa, Cryptosporidium hominis
NRGTRYLNYKLLIRKIRWVSEQ

SEQ ID NO: 2200293 - protein, 18 aa, Cryptosporidium hominis
NRIYIFSKRLPLLDNGDV

SEQ ID NO: 2200294 - protein, 18 aa, Cryptosporidium hominis
NRVKPFIVLFKPKSEANI

SEQ ID NO: 2200295 - protein, 22 aa, Cryptosporidium hominis
NSKPLSIYWIQDSKLILDDLIN

SEQ ID NO: 2200296 - protein, 23 aa, Cryptosporidium hominis
NSTEFAVFILVLIGSEVELKLID

SEQ ID NO: 2200297 - protein, 20 aa, Cryptosporidium hominis
NTHLGFIWLQANNIPFQKPT

SEQ ID NO: 2200298 - protein, 20 aa, Cryptosporidium hominis
NTLLHLIVPIYLKYLRHKNI

SEQ ID NO: 2200299 - protein, 24 aa, Cryptosporidium hominis
NVAPPPLPIYQQPPGYPLSNGPAP

SEQ ID NO: 2200300 - protein, 18 aa, Cryptosporidium hominis
NVLKLILQFLLESGLLES

SEQ ID NO: 2200301 - protein, 28 aa, Cryptosporidium hominis
NVMPNLDYFLFLLPTPKILIIGDSSPSY

SEQ ID NO: 2200302 - protein, 19 aa, Cryptosporidium hominis
NVVLLPYNYLLDSITRQNL

SEQ ID NO: 2200303 - protein, 18 aa, Cryptosporidium hominis
NWLYKSLSPVYFYDLNLL

SEQ ID NO: 2200304 - protein, 18 aa, Cryptosporidium hominis
NWRFHKIPMFWLQVKLIE

SEQ ID NO: 2200305 - protein, 18 aa, Cryptosporidium hominis
NWSCEVWFYVPFEITFHP

SEQ ID NO: 2200306 - protein, 19 aa, Cryptosporidium hominis
NYHLLPFKSLFRLGINENI

SEQ ID NO: 2200307 - protein, 19 aa, Cryptosporidium hominis
NYIKYSTQWYLWAKRRNAE

SEQ ID NO: 2200308 - protein, 22 aa, Cryptosporidium hominis
NYKSFLLSYPKLFRIFGKDDNH

SEQ ID NO: 2200309 - protein, 19 aa, Cryptosporidium hominis
NYLKFGFNVPRTDLLPISI

SEQ ID NO: 2200310 - protein, 20 aa, Cryptosporidium hominis
NYRHSIFGNFRWNNKRRRLG

SEQ ID NO: 2200311 - protein, 28 aa, Cryptosporidium hominis
PASPVEFEWLLHLVLHSALSQLGPMVSH

SEQ ID NO: 2200312 - protein, 21 aa, Cryptosporidium hominis
PCKRWPELLPYLIRLVQNNSD

SEQ ID NO: 2200313 - protein, 23 aa, Cryptosporidium hominis
PDDNFILLIIDLIRELVQEWKDD

SEQ ID NO: 2200314 - protein, 22 aa, Cryptosporidium hominis
PDEFTLIPLPYPDFSMIAKTRG

SEQ ID NO: 2200315 - protein, 26 aa, Cryptosporidium hominis
PDGRPMPYWLYKLNGLGIEFKCEICG

SEQ ID NO: 2200316 - protein, 26 aa, Cryptosporidium hominis
PDSGLIELLPFYSFHILSRTPVSKIP

SEQ ID NO: 2200317 - protein, 25 aa, Cryptosporidium hominis
PENFKTFVQILLRLFHDSPAIIVGD

SEQ ID NO: 2200318 - protein, 17 aa, Cryptosporidium hominis
PEREFFFDLFYNEKAQL

SEQ ID NO: 2200319 - protein, 20 aa, Cryptosporidium hominis
PFCRFFVIDPYNKIIKPLFF

SEQ ID NO: 2200320 - protein, 19 aa, Cryptosporidium hominis
PFEYQVFLGITKWSTRYLN

SEQ ID NO: 2200321 - protein, 17 aa, Cryptosporidium hominis
PFLPIKKVQKRSGFSGC

SEQ ID NO: 2200322 - protein, 19 aa, Cryptosporidium hominis
PFLPSLFIVSSSKPLLRIV

SEQ ID NO: 2200323 - protein, 20 aa, Cryptosporidium hominis
PFLSVPWPTFKCRGKPCVDG

SEQ ID NO: 2200324 - protein, 21 aa, Cryptosporidium hominis
PFMQLFCGLFFQLSYFITFAQ

SEQ ID NO: 2200325 - protein, 19 aa, Cryptosporidium hominis
PFPRLHFFMIGFAPLTSRG

SEQ ID NO: 2200326 - protein, 19 aa, Cryptosporidium hominis
PFVIDVFVLYCIERYTGKF

SEQ ID NO: 2200327 - protein, 18 aa, Cryptosporidium hominis
PGALPHLFRSFRATKFCK

SEQ ID NO: 2200328 - protein, 17 aa, Cryptosporidium hominis
PIELFPLNKNQIIIDID

SEQ ID NO: 2200329 - protein, 22 aa, Cryptosporidium hominis
PIFYQFFCFQRYPILILRPLFS

SEQ ID NO: 2200330 - protein, 17 aa, Cryptosporidium hominis
PIGWRKRSFSKENSTIL

SEQ ID NO: 2200331 - protein, 19 aa, Cryptosporidium hominis
PIIHHPIIQHPISPEIQTL

SEQ ID NO: 2200332 - protein, 24 aa, Cryptosporidium hominis
PIISLRAYYPERFASSKPKYIPGN

SEQ ID NO: 2200333 - protein, 21 aa, Cryptosporidium hominis
PKFSQWLNPPYFRIGPQFEPD

SEQ ID NO: 2200334 - protein, 22 aa, Cryptosporidium hominis
PKGPMVLFCYFLGKLYMQQDRF

SEQ ID NO: 2200335 - protein, 22 aa, Cryptosporidium hominis
PKGYFAFWLTYNSVTNKYIISV

SEQ ID NO: 2200336 - protein, 24 aa, Cryptosporidium hominis
PKHSIWCLFYFFYQRYPKYTVIST

SEQ ID NO: 2200337 - protein, 25 aa, Cryptosporidium hominis
PKLDFVVDHLFLWGSPLPAMLVMMF

SEQ ID NO: 2200338 - protein, 25 aa, Cryptosporidium hominis
PKMESSILELISFFGFKYDEKSQKL

SEQ ID NO: 2200339 - protein, 17 aa, Cryptosporidium hominis
PLARRLLMQLLKKANKQ

SEQ ID NO: 2200340 - protein, 23 aa, Cryptosporidium hominis
PLETFYQFIWRPHPPSLLSQEKF

SEQ ID NO: 2200341 - protein, 21 aa, Cryptosporidium hominis
PLEVVLSQFLYQRTLYPCFPV

SEQ ID NO: 2200342 - protein, 17 aa, Cryptosporidium hominis
PLLPWKTLCTDIVESWR

SEQ ID NO: 2200343 - protein, 20 aa, Cryptosporidium hominis
PLMHRVLGFPLSFNHANPKT

SEQ ID NO: 2200344 - protein, 23 aa, Cryptosporidium hominis
PMIKYVINFDFPLSPKLFVHRTG

SEQ ID NO: 2200345 - protein, 20 aa, Cryptosporidium hominis
PMLKPLNWLLFEFKNHDLIG

SEQ ID NO: 2200346 - protein, 17 aa, Cryptosporidium hominis
PMPLPKPWDELLLEDVC

SEQ ID NO: 2200347 - protein, 24 aa, Cryptosporidium hominis
PNIEFLRFGFLFSKDILAPFEMAI

SEQ ID NO: 2200348 - protein, 22 aa, Cryptosporidium hominis
PNINLLPWEILSKALPLDLGID

SEQ ID NO: 2200349 - protein, 23 aa, Cryptosporidium hominis
PNTQLQWLFIDKWPHLVVLTIPG

SEQ ID NO: 2200350 - protein, 20 aa, Cryptosporidium hominis
PPAILRPQPLWTGKQIITVL

SEQ ID NO: 2200351 - protein, 27 aa, Cryptosporidium hominis
PPEIQKPYFLLFKLPRSLSLVALEPKS

SEQ ID NO: 2200352 - protein, 18 aa, Cryptosporidium hominis
PQKLPKLRGFLSMNSLAH

SEQ ID NO: 2200353 - protein, 24 aa, Cryptosporidium hominis
PSKQEILLPRAYPLPAKREKTRWE

SEQ ID NO: 2200354 - protein, 25 aa, Cryptosporidium hominis
PSKRIIIEWPLYLLKNLKALDFENN

SEQ ID NO: 2200355 - protein, 25 aa, Cryptosporidium hominis
PSSPNLWLLYGFIYRKAFPDRVNET

SEQ ID NO: 2200356 - protein, 22 aa, Cryptosporidium hominis
PSSYLLYLHVNKEPVRLGFEAS

SEQ ID NO: 2200357 - protein, 19 aa, Cryptosporidium hominis
PTHWLWDRIIFSNTRQILG

SEQ ID NO: 2200358 - protein, 19 aa, Cryptosporidium hominis
PTKLYRYLDLLPYDKRLNI

SEQ ID NO: 2200359 - protein, 20 aa, Cryptosporidium hominis
PTLALTPLGLIPILPKVVGS

SEQ ID NO: 2200360 - protein, 23 aa, Cryptosporidium hominis
PVDQMLIPPFPQVSGIPMFEDGT

SEQ ID NO: 2200361 - protein, 19 aa, Cryptosporidium hominis
PVDVIRTFLVLRKNSEHSH

SEQ ID NO: 2200362 - protein, 17 aa, Cryptosporidium hominis
PVFLKYLPSIVLDSELH

SEQ ID NO: 2200363 - protein, 21 aa, Cryptosporidium hominis
PVLMQIIPPYRSFIPSILMNL

SEQ ID NO: 2200364 - protein, 23 aa, Cryptosporidium hominis
PVRDVYLPLDYYTRRPRGFGFVE

SEQ ID NO: 2200365 - protein, 22 aa, Cryptosporidium hominis
PWFFSTLLTIILFKDKYKNSLE

SEQ ID NO: 2200366 - protein, 21 aa, Cryptosporidium hominis
PWINKLYYYWEDNHFYYMLME

SEQ ID NO: 2200367 - protein, 20 aa, Cryptosporidium hominis
PWNYIFKCSRDFSLSQFHSE

SEQ ID NO: 2200368 - protein, 23 aa, Cryptosporidium hominis
PYGFLLDTLYLYYPRNESKNPVH

SEQ ID NO: 2200369 - protein, 24 aa, Cryptosporidium hominis
PYKLDFLPYHFLLCSIGEFGELRY

SEQ ID NO: 2200370 - protein, 23 aa, Cryptosporidium hominis
PYNYAYLNYAGYTANFPYMVGNT

SEQ ID NO: 2200371 - protein, 22 aa, Cryptosporidium hominis
QAIELLKYFWGLSLSPKDNDER

SEQ ID NO: 2200372 - protein, 19 aa, Cryptosporidium hominis
QALQHPWLRSWDTPNIPLC

SEQ ID NO: 2200373 - protein, 24 aa, Cryptosporidium hominis
QDLTRTGFIIFWGGRELDSFNIGN

SEQ ID NO: 2200374 - protein, 22 aa, Cryptosporidium hominis
QEIDMLNIPIWLYKESGSLTVN

SEQ ID NO: 2200375 - protein, 21 aa, Cryptosporidium hominis
QFDWVWFDWPHSKIPFSRSEL

SEQ ID NO: 2200376 - protein, 34 aa, Cryptosporidium hominis
QGAHLLGFFKRLCKLLYYGILPVIVFDGTPPDIK

SEQ ID NO: 2200377 - protein, 21 aa, Cryptosporidium hominis
QGYFFPNISYVNIYWIPYSFF

SEQ ID NO: 2200378 - protein, 21 aa, Cryptosporidium hominis
QGYLKNLFLLSLDKNKDKINF

SEQ ID NO: 2200379 - protein, 25 aa, Cryptosporidium hominis
QHFRTVLYLILPKLTSVQLDWLYAL

SEQ ID NO: 2200380 - protein, 21 aa, Cryptosporidium hominis
QHRIFVPIDPKIPKIIIHTKL

SEQ ID NO: 2200381 - protein, 23 aa, Cryptosporidium hominis
QIEPLYYVPIIPMILVNGTDGIG

SEQ ID NO: 2200382 - protein, 19 aa, Cryptosporidium hominis
QILLRLYFELLRQGGSSEE

SEQ ID NO: 2200383 - protein, 24 aa, Cryptosporidium hominis
QINDILINLIKKKNKFESHNFIYH

SEQ ID NO: 2200384 - protein, 18 aa, Cryptosporidium hominis
QINIKYCFPFIVIYDASN

SEQ ID NO: 2200385 - protein, 23 aa, Cryptosporidium hominis
QKEFEEFWFELDKRQKNISTREK

SEQ ID NO: 2200386 - protein, 24 aa, Cryptosporidium hominis
QKEKMFLLIKLISKIYYYDTQLKE

SEQ ID NO: 2200387 - protein, 25 aa, Cryptosporidium hominis
QKNDEYIFILCPTPSDLEEEYIDQE

SEQ ID NO: 2200388 - protein, 17 aa, Cryptosporidium hominis
QKRYILRYLIYDCICIE

SEQ ID NO: 2200389 - protein, 24 aa, Cryptosporidium hominis
QKTLKCCFEWFKTFKIMESDGVVC

SEQ ID NO: 2200390 - protein, 24 aa, Cryptosporidium hominis
QLEFKAILFIPRRAPFDLFETRKK

SEQ ID NO: 2200391 - protein, 18 aa, Cryptosporidium hominis
QLFDYQLAGLNWLLQLWS

SEQ ID NO: 2200392 - protein, 24 aa, Cryptosporidium hominis
QLGAPGGTPYLLRSKSRETLSSAE

SEQ ID NO: 2200393 - protein, 18 aa, Cryptosporidium hominis
QLIFLRWIRLLFSREFSD

SEQ ID NO: 2200394 - protein, 18 aa, Cryptosporidium hominis
QLIKWRLELIPSILNIFQ

SEQ ID NO: 2200395 - protein, 23 aa, Cryptosporidium hominis
QLRNCNLLYFNKEVVFNCIVDIE

SEQ ID NO: 2200396 - protein, 20 aa, Cryptosporidium hominis
QLWDPLPMSPGNPLMMTYLQ

SEQ ID NO: 2200397 - protein, 24 aa, Cryptosporidium hominis
QMESLDWWWWLNIKDNFEGLLTQN

SEQ ID NO: 2200398 - protein, 20 aa, Cryptosporidium hominis
QNELIGYLYLIINPSIITSD

SEQ ID NO: 2200399 - protein, 23 aa, Cryptosporidium hominis
QNGFIRLWDLRFAQQPFLYMNSN

SEQ ID NO: 2200400 - protein, 22 aa, Cryptosporidium hominis
QNNYWLFHILGVNLNAPNLSLN

SEQ ID NO: 2200401 - protein, 21 aa, Cryptosporidium hominis
QNQFNYHFYYFRILTVESELD

SEQ ID NO: 2200402 - protein, 23 aa, Cryptosporidium hominis
QNRPKWWQLCFCKPIISVTLFAR

SEQ ID NO: 2200403 - protein, 22 aa, Cryptosporidium hominis
QNSSFIPTWAWPASLRNNEDLK

SEQ ID NO: 2200404 - protein, 23 aa, Cryptosporidium hominis
QQEPDKVKFIPLSSLKKLQSLKS

SEQ ID NO: 2200405 - protein, 23 aa, Cryptosporidium hominis
QQIKNFFIVLFHNMDLQLSELRY

SEQ ID NO: 2200406 - protein, 23 aa, Cryptosporidium hominis
QQLLFCFHNNFPILWHPQVIAII

SEQ ID NO: 2200407 - protein, 26 aa, Cryptosporidium hominis
QQQQIPVRYLVPPPPPPPSKTSGPLQ

SEQ ID NO: 2200408 - protein, 24 aa, Cryptosporidium hominis
QREKLLMRLYMKLVIKQLVEPAFD

SEQ ID NO: 2200409 - protein, 22 aa, Cryptosporidium hominis
QRLRWSIRMIPQKLPLDLIIAL

SEQ ID NO: 2200410 - protein, 24 aa, Cryptosporidium hominis
QRSAILFTILLIKSLTILSPSSII

SEQ ID NO: 2200411 - protein, 19 aa, Cryptosporidium hominis
QRSALFKALILYSLKNKEY

SEQ ID NO: 2200412 - protein, 29 aa, Cryptosporidium hominis
QRSLLALSLILSMLRFKPAPVYILDEIDS

SEQ ID NO: 2200413 - protein, 21 aa, Cryptosporidium hominis
QSDLIPYAALFARCYYPSKLE

SEQ ID NO: 2200414 - protein, 23 aa, Cryptosporidium hominis
QSHTLFYRFLKFIETHLWTTVID

SEQ ID NO: 2200415 - protein, 23 aa, Cryptosporidium hominis
QSPNIMFLIVLDSSLPWTLNDDL

SEQ ID NO: 2200416 - protein, 20 aa, Cryptosporidium hominis
QSQLFHILFYSDENIFLGAP

SEQ ID NO: 2200417 - protein, 29 aa, Cryptosporidium hominis
QSSNSEYYLFLTWNNCILGYIPINTNKIN

SEQ ID NO: 2200418 - protein, 24 aa, Cryptosporidium hominis
QSYLNIWISLFWNSLINKSKKKKV

SEQ ID NO: 2200419 - protein, 22 aa, Cryptosporidium hominis
QVFLSWFKHFLTPWLKFGTAFD

SEQ ID NO: 2200420 - protein, 19 aa, Cryptosporidium hominis
QVFYVIRVLVKVRDWCGSC

SEQ ID NO: 2200421 - protein, 20 aa, Cryptosporidium hominis
QYEYYVVRAWVRNARRIQIK

SEQ ID NO: 2200422 - protein, 20 aa, Cryptosporidium hominis
RAFCQFIMEPICQLFSSIMN

SEQ ID NO: 2200423 - protein, 17 aa, Cryptosporidium hominis
RAHERSEFKYLRSNVKN

SEQ ID NO: 2200424 - protein, 29 aa, Cryptosporidium hominis
RCTAAQAIYHPWFEKIQLSPGIMISCNNN

SEQ ID NO: 2200425 - protein, 18 aa, Cryptosporidium hominis
RDLTSFSWNFTRRAKRRT

SEQ ID NO: 2200426 - protein, 21 aa, Cryptosporidium hominis
RDPRRSLLIRSLRFDTPTSLV

SEQ ID NO: 2200427 - protein, 21 aa, Cryptosporidium hominis
RDTLQIPICKFPLIKKIIVAL

SEQ ID NO: 2200428 - protein, 23 aa, Cryptosporidium hominis
REELDLYLLVLRVVSKKADIVIS

SEQ ID NO: 2200429 - protein, 23 aa, Cryptosporidium hominis
RELDILLILEFLVDLRLSYESCG

SEQ ID NO: 2200430 - protein, 27 aa, Cryptosporidium hominis
RENLFDTFFWKLLIYSYFKLNSTLSPI

SEQ ID NO: 2200431 - protein, 25 aa, Cryptosporidium hominis
RESDYLQRFPTLTGFNRAGLSGNER

SEQ ID NO: 2200432 - protein, 25 aa, Cryptosporidium hominis
REYSTSPCYYYLPTGYERIGNCFNE

SEQ ID NO: 2200433 - protein, 24 aa, Cryptosporidium hominis
REYYKWDYIILLTTRYISPDSNTI

SEQ ID NO: 2200434 - protein, 25 aa, Cryptosporidium hominis
RFPPDAWHLCCWLLRKNSNERASPI

SEQ ID NO: 2200435 - protein, 21 aa, Cryptosporidium hominis
RFSLRLPIIMLFESLLKVDLH

SEQ ID NO: 2200436 - protein, 28 aa, Cryptosporidium hominis
RFSSVQQFWWLWHNIPQPSELLKGKRMI

SEQ ID NO: 2200437 - protein, 17 aa, Cryptosporidium hominis
RGILLDHFLIQISQIRI

SEQ ID NO: 2200438 - protein, 18 aa, Cryptosporidium hominis
RHFIYFYMGQIAVLLFKS

SEQ ID NO: 2200439 - protein, 21 aa, Cryptosporidium hominis
RHIRMLFLLHKWDAPMNYSPE

SEQ ID NO: 2200440 - protein, 18 aa, Cryptosporidium hominis
RIFDIYLLGQDYVGILVD

SEQ ID NO: 2200441 - protein, 18 aa, Cryptosporidium hominis
RIFQLIPCPYLCLSATIG

SEQ ID NO: 2200442 - protein, 30 aa, Cryptosporidium hominis
RIKKLRAQYWFEKFYWFISSDGYLIIGGHD

SEQ ID NO: 2200443 - protein, 17 aa, Cryptosporidium hominis
RIKLISFTWRKIVLNAK

SEQ ID NO: 2200444 - protein, 17 aa, Cryptosporidium hominis
RILLKLIDIKASQVGLL

SEQ ID NO: 2200445 - protein, 17 aa, Cryptosporidium hominis
RIRRWFGLYKAVENKDV

SEQ ID NO: 2200446 - protein, 29 aa, Cryptosporidium hominis
RKCRSGSIFFPYFLPYIAPYFAEAYTTKT

SEQ ID NO: 2200447 - protein, 20 aa, Cryptosporidium hominis
RKFPFLYYYGRQPSINNDYG

SEQ ID NO: 2200448 - protein, 33 aa, Cryptosporidium hominis
RKFRFSSFCPKLLNCLFPWIRSEQYFEDHDQPI

SEQ ID NO: 2200449 - protein, 18 aa, Cryptosporidium hominis
RKHQVSITFIFKYFPNSI

SEQ ID NO: 2200450 - protein, 23 aa, Cryptosporidium hominis
RKYRLYWIAILRNAPEGLEGLYD

SEQ ID NO: 2200451 - protein, 17 aa, Cryptosporidium hominis
RLAFLRLVRKFHPDKNI

SEQ ID NO: 2200452 - protein, 17 aa, Cryptosporidium hominis
RLDILLSQWVSYFSGRQ

SEQ ID NO: 2200453 - protein, 25 aa, Cryptosporidium hominis
RLELIPSILNIFQSPLSKLLIEINK

SEQ ID NO: 2200454 - protein, 18 aa, Cryptosporidium hominis
RLIPPRMSPLLRSQRQRL

SEQ ID NO: 2200455 - protein, 25 aa, Cryptosporidium hominis
RLKNTPLLIIPFKDTEYYFFAKKRQ

SEQ ID NO: 2200456 - protein, 21 aa, Cryptosporidium hominis
RLNCLIQDVFDLRKHKWVKKV

SEQ ID NO: 2200457 - protein, 22 aa, Cryptosporidium hominis
RLNELILPPRWDPLDGRLDHEF

SEQ ID NO: 2200458 - protein, 19 aa, Cryptosporidium hominis
RLRANGFLSIPFLPDLTSP

SEQ ID NO: 2200459 - protein, 18 aa, Cryptosporidium hominis
RLSKFYEPLLKFVKDEFP

SEQ ID NO: 2200460 - protein, 24 aa, Cryptosporidium hominis
RLVQSLHLLALLWRCYKICEERGY

SEQ ID NO: 2200461 - protein, 19 aa, Cryptosporidium hominis
RLWIKLCEILIKYGVNLTI

SEQ ID NO: 2200462 - protein, 17 aa, Cryptosporidium hominis
RLWSLTEKKWNNLDLSL

SEQ ID NO: 2200463 - protein, 17 aa, Cryptosporidium hominis
RLYGLKPIRTLTLGTTK

SEQ ID NO: 2200464 - protein, 19 aa, Cryptosporidium hominis
RMCWLYLKNDWKEIKEFAW

SEQ ID NO: 2200465 - protein, 20 aa, Cryptosporidium hominis
RMMFILFPVTDAQHPILTPV

SEQ ID NO: 2200466 - protein, 19 aa, Cryptosporidium hominis
RNCSPLLTLIFVRVCNSIC

SEQ ID NO: 2200467 - protein, 22 aa, Cryptosporidium hominis
RNELYFVTIFYGLQFALNRIFQ

SEQ ID NO: 2200468 - protein, 20 aa, Cryptosporidium hominis
RNFRLPVYFVPSSSDYFYVS

SEQ ID NO: 2200469 - protein, 18 aa, Cryptosporidium hominis
RNINIPIWRQGTMLPRVC

SEQ ID NO: 2200470 - protein, 22 aa, Cryptosporidium hominis
RNLATIFYLKKLKKLGLSMSYF

SEQ ID NO: 2200471 - protein, 23 aa, Cryptosporidium hominis
RNSWMHIFSFDSAIPRSNQRETI

SEQ ID NO: 2200472 - protein, 29 aa, Cryptosporidium hominis
RQRALDRANVFLRWNLAPTKQQIAEFLEM

SEQ ID NO: 2200473 - protein, 21 aa, Cryptosporidium hominis
RRFDVPFRNMLLWGKPGTGKT

SEQ ID NO: 2200474 - protein, 17 aa, Cryptosporidium hominis
RRILICLSYFIITESYR

SEQ ID NO: 2200475 - protein, 18 aa, Cryptosporidium hominis
RRMLNRPSTLFRLPIIER

SEQ ID NO: 2200476 - protein, 17 aa, Cryptosporidium hominis
RRTWRICYAPEPGKRVT

SEQ ID NO: 2200477 - protein, 23 aa, Cryptosporidium hominis
RRYFPNIFFYCTHLEIPLMQNNN

SEQ ID NO: 2200478 - protein, 17 aa, Cryptosporidium hominis
RSHAIFQLSIFLERKKL

SEQ ID NO: 2200479 - protein, 23 aa, Cryptosporidium hominis
RSTNPYRILLSKLYTFLGRRTNS

SEQ ID NO: 2200480 - protein, 17 aa, Cryptosporidium hominis
RTKYKIQIPLPPKIDPS

SEQ ID NO: 2200481 - protein, 21 aa, Cryptosporidium hominis
RTLIYRILTLMIPYFSNITSN

SEQ ID NO: 2200482 - protein, 22 aa, Cryptosporidium hominis
RTQIWGFAALRFLIRSSLNACN

SEQ ID NO: 2200483 - protein, 18 aa, Cryptosporidium hominis
RVKPPLKPKPKFLAPPKN

SEQ ID NO: 2200484 - protein, 25 aa, Cryptosporidium hominis
RYLVPLFMRCLYSSLLLLYDYSSYL

SEQ ID NO: 2200485 - protein, 21 aa, Cryptosporidium hominis
RYRGLFFSLIANMFVLCEDDK

SEQ ID NO: 2200486 - protein, 18 aa, Cryptosporidium hominis
RYSSLPRHNIRTIPPPFF

SEQ ID NO: 2200487 - protein, 22 aa, Cryptosporidium hominis
SAANPMLLAFNPQLAAAAAAAT

SEQ ID NO: 2200488 - protein, 23 aa, Cryptosporidium hominis
SAGVILYILLCGYPPFHGKDNVE

SEQ ID NO: 2200489 - protein, 21 aa, Cryptosporidium hominis
SAGVILYILLSGTPPFYGKNE

SEQ ID NO: 2200490 - protein, 21 aa, Cryptosporidium hominis
SAGVLLHLLLMGAVPFPGIND

SEQ ID NO: 2200491 - protein, 18 aa, Cryptosporidium hominis
SAIFFLRNLKRLSLVNNP

SEQ ID NO: 2200492 - protein, 22 aa, Cryptosporidium hominis
SANPQLWCKISFIDLAGSERAS

SEQ ID NO: 2200493 - protein, 17 aa, Cryptosporidium hominis
SAYFKYLISPISPLLLS

SEQ ID NO: 2200494 - protein, 21 aa, Cryptosporidium hominis
SDAIIYIWSFKHRKLINKLVG

SEQ ID NO: 2200495 - protein, 18 aa, Cryptosporidium hominis
SDELCRCLIIVSLPFPQK

SEQ ID NO: 2200496 - protein, 19 aa, Cryptosporidium hominis
SDWLLCELVWEQVLLELGV

SEQ ID NO: 2200497 - protein, 20 aa, Cryptosporidium hominis
SDWLYIRAASILRHLYVRPN

SEQ ID NO: 2200498 - protein, 26 aa, Cryptosporidium hominis
SEACKSWPLCPYGPGCFFIHPTVPCR

SEQ ID NO: 2200499 - protein, 27 aa, Cryptosporidium hominis
SEKEVLLMFPFIEFYLQTYSKKYNLSK

SEQ ID NO: 2200500 - protein, 28 aa, Cryptosporidium hominis
SEKGYDYCLLYFELLRDGLINAHLWRDT

SEQ ID NO: 2200501 - protein, 18 aa, Cryptosporidium hominis
SERDIRLAFLRLVRKFHP

SEQ ID NO: 2200502 - protein, 25 aa, Cryptosporidium hominis
SERQLIPKKVWLIVRDLPSKSYALQ

SEQ ID NO: 2200503 - protein, 18 aa, Cryptosporidium hominis
SFEQLYLESLKWIEEKIR

SEQ ID NO: 2200504 - protein, 18 aa, Cryptosporidium hominis
SFFDIFLLSLFRSKIPQL

SEQ ID NO: 2200505 - protein, 22 aa, Cryptosporidium hominis
SFFLKLIIYIDWLIYLINHSNK

SEQ ID NO: 2200506 - protein, 24 aa, Cryptosporidium hominis
SFGGKWPFIFFKSRIEFLETVTQS

SEQ ID NO: 2200507 - protein, 21 aa, Cryptosporidium hominis
SFIPIIIPIFIKWKSKQFNSK

SEQ ID NO: 2200508 - protein, 23 aa, Cryptosporidium hominis
SFLERIFLRYNQLFEIFLCQVNN

SEQ ID NO: 2200509 - protein, 21 aa, Cryptosporidium hominis
SFLKFFIQEIFLSLGILIGNI

SEQ ID NO: 2200510 - protein, 26 aa, Cryptosporidium hominis
SFNEFCQLFLWPLFHNVLNPEELSNA

SEQ ID NO: 2200511 - protein, 17 aa, Cryptosporidium hominis
SFVFFYNQLVNIEGISR

SEQ ID NO: 2200512 - protein, 18 aa, Cryptosporidium hominis
SFYPLILSSYLQAYNNLK

SEQ ID NO: 2200513 - protein, 18 aa, Cryptosporidium hominis
SGGLLIIGLCPWGWEYIS

SEQ ID NO: 2200514 - protein, 23 aa, Cryptosporidium hominis
SGIRWLCFILGEYGKLISSKVSI

SEQ ID NO: 2200515 - protein, 23 aa, Cryptosporidium hominis
SGKLYLIFDFFPIGPTMAPDTGA

SEQ ID NO: 2200516 - protein, 20 aa, Cryptosporidium hominis
SGLLKLILVLKNRIAPKILH

SEQ ID NO: 2200517 - protein, 26 aa, Cryptosporidium hominis
SGVDLLLSYILHRLFDTPFTDEDGKI

SEQ ID NO: 2200518 - protein, 24 aa, Cryptosporidium hominis
SHQYKLQIFKFLNLKIPIKCDDQI

SEQ ID NO: 2200519 - protein, 21 aa, Cryptosporidium hominis
SHSLPVLCRLLYFSDLEVMTD

SEQ ID NO: 2200520 - protein, 26 aa, Cryptosporidium hominis
SIIHPLQCILLIIGILRRSLENPNHS

SEQ ID NO: 2200521 - protein, 19 aa, Cryptosporidium hominis
SIIRLVPKEQLNSVFFLVS

SEQ ID NO: 2200522 - protein, 23 aa, Cryptosporidium hominis
SIIVISNLMWWINDIHVRELATE

SEQ ID NO: 2200523 - protein, 20 aa, Cryptosporidium hominis
SIIYRRLFSYFIQSIIRYHF

SEQ ID NO: 2200524 - protein, 17 aa, Cryptosporidium hominis
SILNILLSRWSGIPIVS

SEQ ID NO: 2200525 - protein, 21 aa, Cryptosporidium hominis
SIQSRWRSFQIRKSFLAILGS

SEQ ID NO: 2200526 - protein, 17 aa, Cryptosporidium hominis
SIRTWRGWKPLKKLKKF

SEQ ID NO: 2200527 - protein, 20 aa, Cryptosporidium hominis
SISLLFIPILLKADLKKTRV

SEQ ID NO: 2200528 - protein, 23 aa, Cryptosporidium hominis
SKCILFLDYLILRTKKLSYIVDS

SEQ ID NO: 2200529 - protein, 17 aa, Cryptosporidium hominis
SKDFRLKRLFYASKSQL

SEQ ID NO: 2200530 - protein, 22 aa, Cryptosporidium hominis
SKFLDPFLFWEGRVKLFPPELL

SEQ ID NO: 2200531 - protein, 22 aa, Cryptosporidium hominis
SKIRRVLIYRSEWKRPPMYLLI

SEQ ID NO: 2200532 - protein, 22 aa, Cryptosporidium hominis
SKISFLLNRPLIMSIQDFIATY

SEQ ID NO: 2200533 - protein, 24 aa, Cryptosporidium hominis
SKKRRIIMRLSKLKKGLRGEVEIG

SEQ ID NO: 2200534 - protein, 24 aa, Cryptosporidium hominis
SKLLREPIILLIDPKRMQIINLRN

SEQ ID NO: 2200535 - protein, 20 aa, Cryptosporidium hominis
SKLNFCTFEFMLSPTLIGVP

SEQ ID NO: 2200536 - protein, 23 aa, Cryptosporidium hominis
SKMKKIIFSIFKIVITDLDKKAL

SEQ ID NO: 2200537 - protein, 29 aa, Cryptosporidium hominis
SKNTLLLMYIGYLCYYMMLKTSPDINIKE

SEQ ID NO: 2200538 - protein, 24 aa, Cryptosporidium hominis
SKPIEDYCMFPLDSVYRLSTTNTN

SEQ ID NO: 2200539 - protein, 22 aa, Cryptosporidium hominis
SKRQQFIFWWYITSNNAHYNFE

SEQ ID NO: 2200540 - protein, 25 aa, Cryptosporidium hominis
SKRVKLFHHLLQKLLLRRTKDLVIK

SEQ ID NO: 2200541 - protein, 19 aa, Cryptosporidium hominis
SLCCALSGTFRYLTTILLC

SEQ ID NO: 2200542 - protein, 17 aa, Cryptosporidium hominis
SLDLVFFELIKSLFRVL

SEQ ID NO: 2200543 - protein, 24 aa, Cryptosporidium hominis
SLDNLLRIVWISPQLISIKWCKAN

SEQ ID NO: 2200544 - protein, 18 aa, Cryptosporidium hominis
SLDTHWLKYLLDSGLTMI

SEQ ID NO: 2200545 - protein, 19 aa, Cryptosporidium hominis
SLEIHFLRLVRFQLFVTEH

SEQ ID NO: 2200546 - protein, 19 aa, Cryptosporidium hominis
SLFGFLKHTITPGGTRLLK

SEQ ID NO: 2200547 - protein, 21 aa, Cryptosporidium hominis
SLHLSLYLWDPLDGEYHPPHL

SEQ ID NO: 2200548 - protein, 17 aa, Cryptosporidium hominis
SLKIMFPDKIFLLRGNH

SEQ ID NO: 2200549 - protein, 18 aa, Cryptosporidium hominis
SLKVYPLFARGWITWAQY

SEQ ID NO: 2200550 - protein, 18 aa, Cryptosporidium hominis
SLLFMHNYWQYQGLLLSI

SEQ ID NO: 2200551 - protein, 20 aa, Cryptosporidium hominis
SLLLLFPSILFITIQKHKNS

SEQ ID NO: 2200552 - protein, 22 aa, Cryptosporidium hominis
SLMSRFDLIYLILDKQSEESDK

SEQ ID NO: 2200553 - protein, 21 aa, Cryptosporidium hominis
SLPATLPWLFELNMDRLFPTM

SEQ ID NO: 2200554 - protein, 18 aa, Cryptosporidium hominis
SLPLITRRLVFKSGGDIF

SEQ ID NO: 2200555 - protein, 24 aa, Cryptosporidium hominis
SLQKLLLTFSFEGGIWRVLLGLLR

SEQ ID NO: 2200556 - protein, 26 aa, Cryptosporidium hominis
SLRCPLFYMALMKLLFDEYPMITETD

SEQ ID NO: 2200557 - protein, 32 aa, Cryptosporidium hominis
SLSNSLYLFLFDYKTNYWRFLTPDLSISISQI

SEQ ID NO: 2200558 - protein, 20 aa, Cryptosporidium hominis
SLTLRILPSLIYRIPNLTPG

SEQ ID NO: 2200559 - protein, 19 aa, Cryptosporidium hominis
SLWWLKYTLNKRPILGPTT

SEQ ID NO: 2200560 - protein, 18 aa, Cryptosporidium hominis
SMITYLCRSCFLPEIFST

SEQ ID NO: 2200561 - protein, 20 aa, Cryptosporidium hominis
SMLTYYKFPFKNKLNRPFSG

SEQ ID NO: 2200562 - protein, 23 aa, Cryptosporidium hominis
SMSGRFLMVKLAADPFPFETKRS

SEQ ID NO: 2200563 - protein, 27 aa, Cryptosporidium hominis
SNDHQNILSIYFFQSYLALRDLENQNI

SEQ ID NO: 2200564 - protein, 24 aa, Cryptosporidium hominis
SNDVFLFFEMWPSKLLPNAGNTTE

SEQ ID NO: 2200565 - protein, 20 aa, Cryptosporidium hominis
SNKLRLILKAFLLLGNYVNH

SEQ ID NO: 2200566 - protein, 23 aa, Cryptosporidium hominis
SNKVIYIIKICNFSFQLIGRFVH

SEQ ID NO: 2200567 - protein, 21 aa, Cryptosporidium hominis
SNPLNFYFENIYEKSLKTLSN

SEQ ID NO: 2200568 - protein, 23 aa, Cryptosporidium hominis
SNQRKIIEFKGIKIQRAINSANK

SEQ ID NO: 2200569 - protein, 27 aa, Cryptosporidium hominis
SNSQLQLLLIFILKIYGAMNVSELLNL

SEQ ID NO: 2200570 - protein, 23 aa, Cryptosporidium hominis
SNTFRIWPTRILLYPVSKSQVPN

SEQ ID NO: 2200571 - protein, 17 aa, Cryptosporidium hominis
SPAFWFAEASYLRDEKE

SEQ ID NO: 2200572 - protein, 18 aa, Cryptosporidium hominis
SPCQSPIFLILKPEVPKA

SEQ ID NO: 2200573 - protein, 24 aa, Cryptosporidium hominis
SPIFKFVPLMQYWRHYWFDNTERT

SEQ ID NO: 2200574 - protein, 24 aa, Cryptosporidium hominis
SPNFISFIEFWRLYEEMLKHSGVY

SEQ ID NO: 2200575 - protein, 21 aa, Cryptosporidium hominis
SPTFLSVIPLIFRQFIDISYM

SEQ ID NO: 2200576 - protein, 24 aa, Cryptosporidium hominis
SQDQLLQLLLFRPNSTESKYSVSI

SEQ ID NO: 2200577 - protein, 21 aa, Cryptosporidium hominis
SQFRHDLVFTLLRQTLQYYEN

SEQ ID NO: 2200578 - protein, 25 aa, Cryptosporidium hominis
SQIMGIKPLFPVKPLLSISSPDFEQ

SEQ ID NO: 2200579 - protein, 20 aa, Cryptosporidium hominis
SQLFQALSRLSLELSNTNLA

SEQ ID NO: 2200580 - protein, 25 aa, Cryptosporidium hominis
SQNLSYITISYFPSSFSGLTTLPVS

SEQ ID NO: 2200581 - protein, 20 aa, Cryptosporidium hominis
SRFKVFSWNVLAEIYASQEA

SEQ ID NO: 2200582 - protein, 17 aa, Cryptosporidium hominis
SRFVYGIGIPKQKIINF

SEQ ID NO: 2200583 - protein, 18 aa, Cryptosporidium hominis
SRHLIMNFGYTDLLLRFT

SEQ ID NO: 2200584 - protein, 18 aa, Cryptosporidium hominis
SRKQYLRMLLRKKYLKLS

SEQ ID NO: 2200585 - protein, 19 aa, Cryptosporidium hominis
SRPIGLPPPLPYNTINNRE

SEQ ID NO: 2200586 - protein, 25 aa, Cryptosporidium hominis
SRTQKWLLRNVKLEDFKYLIRVDQL

SEQ ID NO: 2200587 - protein, 24 aa, Cryptosporidium hominis
SSDESLFCFIWKNILLIWNTQYPD

SEQ ID NO: 2200588 - protein, 21 aa, Cryptosporidium hominis
SSFRRFMNFDWFTSMFSSRRR

SEQ ID NO: 2200589 - protein, 29 aa, Cryptosporidium hominis
SSIYCDPFYELLWLGWTNGFLSSFRFPHC

SEQ ID NO: 2200590 - protein, 23 aa, Cryptosporidium hominis
SSKLFPIDLIPLLSGATTISFYG

SEQ ID NO: 2200591 - protein, 24 aa, Cryptosporidium hominis
SSKNWFCFQCLSLTLRILPSLIYR

SEQ ID NO: 2200592 - protein, 23 aa, Cryptosporidium hominis
SSKSINIKIPYRETSHIPSCLFE

SEQ ID NO: 2200593 - protein, 21 aa, Cryptosporidium hominis
SSNILFPWIYNSDFSIFESEF

SEQ ID NO: 2200594 - protein, 24 aa, Cryptosporidium hominis
SSSSYIYFLLYNTIIYLEETILDL

SEQ ID NO: 2200595 - protein, 31 aa, Cryptosporidium hominis
SSSTLNLTLAWTKAFIYLILVSSMTVLASVP

SEQ ID NO: 2200596 - protein, 24 aa, Cryptosporidium hominis
SSTSGVVGPWRRSLHGGQTVDSLE

SEQ ID NO: 2200597 - protein, 20 aa, Cryptosporidium hominis
SSVKPIMITSLWSCIYKSLR

SEQ ID NO: 2200598 - protein, 23 aa, Cryptosporidium hominis
SSVTASLLLMRKVQTLTSSVEEL

SEQ ID NO: 2200599 - protein, 24 aa, Cryptosporidium hominis
STAAPLFYFGLPEETLMGGGYTGT

SEQ ID NO: 2200600 - protein, 23 aa, Cryptosporidium hominis
STIELLMLLQNWKKARTFLDLAR

SEQ ID NO: 2200601 - protein, 19 aa, Cryptosporidium hominis
SVIFWRKIWINIYKIVHGK

SEQ ID NO: 2200602 - protein, 23 aa, Cryptosporidium hominis
SVKYYEGFKLPLGDLGRKMLLKK

SEQ ID NO: 2200603 - protein, 19 aa, Cryptosporidium hominis
SVWGSYYDPNVKKWGFKCC

SEQ ID NO: 2200604 - protein, 27 aa, Cryptosporidium hominis
SWCVRRKTWRVWFITSGGTRATRSFNP

SEQ ID NO: 2200605 - protein, 26 aa, Cryptosporidium hominis
SWEKYLHSYLLLIYFFEINQDVNSPN

SEQ ID NO: 2200606 - protein, 21 aa, Cryptosporidium hominis
SYLGIPIWRFYGRCTQCGNEI

SEQ ID NO: 2200607 - protein, 18 aa, Cryptosporidium hominis
SYLKIWVPSAHRPPKHQT

SEQ ID NO: 2200608 - protein, 24 aa, Cryptosporidium hominis
SYLVRLMKRRLIFVSISLLDLLDD

SEQ ID NO: 2200609 - protein, 20 aa, Cryptosporidium hominis
TASEKLTKGMLGYVSKHTLN

SEQ ID NO: 2200610 - protein, 17 aa, Cryptosporidium hominis
TAWLLPPSYFEKGQLKK

SEQ ID NO: 2200611 - protein, 18 aa, Cryptosporidium hominis
TCFKLWRFFIYYRKTRNS

SEQ ID NO: 2200612 - protein, 24 aa, Cryptosporidium hominis
TDDSILLEMFMFAPFTLPLIYGKE

SEQ ID NO: 2200613 - protein, 18 aa, Cryptosporidium hominis
TDIRHFAFILFKKNLNVL

SEQ ID NO: 2200614 - protein, 19 aa, Cryptosporidium hominis
TDLQTLCNVLLIADSYNLS

SEQ ID NO: 2200615 - protein, 24 aa, Cryptosporidium hominis
TDPPIWKYWSLPNIEFHGLWDVLH

SEQ ID NO: 2200616 - protein, 23 aa, Cryptosporidium hominis
TEAQRYDLIFKDILLRDMNRMDA

SEQ ID NO: 2200617 - protein, 17 aa, Cryptosporidium hominis
TEDVLKIVYYPMTPFKI

SEQ ID NO: 2200618 - protein, 24 aa, Cryptosporidium hominis
TEEEFWNRIIQSPLFFDILGQKNT

SEQ ID NO: 2200619 - protein, 21 aa, Cryptosporidium hominis
TELSLYEELLKYLFSKRDLNE

SEQ ID NO: 2200620 - protein, 22 aa, Cryptosporidium hominis
TERFLFFRRYLLKGATKVIFCG

SEQ ID NO: 2200621 - protein, 25 aa, Cryptosporidium hominis
TESSFLRKYWWLIAIGFITYSVLTT

SEQ ID NO: 2200622 - protein, 20 aa, Cryptosporidium hominis
TFHPTIIFPLLGLPPQQSVE

SEQ ID NO: 2200623 - protein, 18 aa, Cryptosporidium hominis
TFLPTTPHRPPTCLFLLI

SEQ ID NO: 2200624 - protein, 20 aa, Cryptosporidium hominis
TFTLPPLWHVAALCTLTMLE

SEQ ID NO: 2200625 - protein, 23 aa, Cryptosporidium hominis
TGKLRYYVFNWKIPQISPSNVGI

SEQ ID NO: 2200626 - protein, 19 aa, Cryptosporidium hominis
TGWFLDYDLNPLNGFIALG

SEQ ID NO: 2200627 - protein, 36 aa, Cryptosporidium hominis
TIALCSSLMVIRDISVLLKYPLLSIQGKLPVNIDLI

SEQ ID NO: 2200628 - protein, 19 aa, Cryptosporidium hominis
TICLLFALKIRYPRQIHLI

SEQ ID NO: 2200629 - protein, 17 aa, Cryptosporidium hominis
TIHVNLPPKYPFKYLML

SEQ ID NO: 2200630 - protein, 20 aa, Cryptosporidium hominis
TIISSLLRPSAPPTAPVCSS

SEQ ID NO: 2200631 - protein, 25 aa, Cryptosporidium hominis
TILCRYIWSFFIPTWNRIFITSSKE

SEQ ID NO: 2200632 - protein, 20 aa, Cryptosporidium hominis
TIQLFKINPFKYLIDIQIYD

SEQ ID NO: 2200633 - protein, 23 aa, Cryptosporidium hominis
TIRIKLYFLLAFLHSVILERKRY

SEQ ID NO: 2200634 - protein, 22 aa, Cryptosporidium hominis
TKAQKKIPLWARSMNWIPKMKE

SEQ ID NO: 2200635 - protein, 21 aa, Cryptosporidium hominis
TKISIYLVLLLSSYDIYIQEI

SEQ ID NO: 2200636 - protein, 18 aa, Cryptosporidium hominis
TKLLLWYGQNRIIDLFVK

SEQ ID NO: 2200637 - protein, 24 aa, Cryptosporidium hominis
TKSQRFLLIFIRISLLDFKRIILE

SEQ ID NO: 2200638 - protein, 17 aa, Cryptosporidium hominis
TLDLIKCSDFIIALFGF

SEQ ID NO: 2200639 - protein, 17 aa, Cryptosporidium hominis
TLGFKRILRLVYYFKGS

SEQ ID NO: 2200640 - protein, 26 aa, Cryptosporidium hominis
TLKIIIPLMKYMEPVYLRWRKWNKKY

SEQ ID NO: 2200641 - protein, 19 aa, Cryptosporidium hominis
TLLELYYFDYDRFVISRPI

SEQ ID NO: 2200642 - protein, 19 aa, Cryptosporidium hominis
TLPYIYLFERFMNYLIEAG

SEQ ID NO: 2200643 - protein, 18 aa, Cryptosporidium hominis
TLQKEFMLQNLTEWYREI

SEQ ID NO: 2200644 - protein, 21 aa, Cryptosporidium hominis
TLRFWQIFPTGRPKGPKNLAA

SEQ ID NO: 2200645 - protein, 18 aa, Cryptosporidium hominis
TLVRIITIALCSSLMVIR

SEQ ID NO: 2200646 - protein, 23 aa, Cryptosporidium hominis
TLVSYYLFIWRDSIARLLDVSPS

SEQ ID NO: 2200647 - protein, 24 aa, Cryptosporidium hominis
TMEEPILLFLTYQFAETLLAFNEM

SEQ ID NO: 2200648 - protein, 21 aa, Cryptosporidium hominis
TNFFNLVTLLKSLIFSKIRLM

SEQ ID NO: 2200649 - protein, 23 aa, Cryptosporidium hominis
TNHKHLLLLILLIERNLSSGADL

SEQ ID NO: 2200650 - protein, 24 aa, Cryptosporidium hominis
TNLKKQILLWLNDNEISLFDNDST

SEQ ID NO: 2200651 - protein, 23 aa, Cryptosporidium hominis
TNNHWVFLWTQILKKVLVIALSY

SEQ ID NO: 2200652 - protein, 25 aa, Cryptosporidium hominis
TNSNFQNMPIPYPPKAPLSDCNNSE

SEQ ID NO: 2200653 - protein, 19 aa, Cryptosporidium hominis
TPCFLLAVKCSIDLTLPIY

SEQ ID NO: 2200654 - protein, 17 aa, Cryptosporidium hominis
TPENIITAIKLLAIVRD

SEQ ID NO: 2200655 - protein, 20 aa, Cryptosporidium hominis
TPLLLRVDGLVGLLARIRRD

SEQ ID NO: 2200656 - protein, 22 aa, Cryptosporidium hominis
TPLRQFFFFDAFEQLDLISNET

SEQ ID NO: 2200657 - protein, 24 aa, Cryptosporidium hominis
TPSILGVLLKYFDVSWPSHIFESL

SEQ ID NO: 2200658 - protein, 18 aa, Cryptosporidium hominis
TPYFIPYTPYGVYSNLYA

SEQ ID NO: 2200659 - protein, 17 aa, Cryptosporidium hominis
TQHYKFHVLLTSYEILL

SEQ ID NO: 2200660 - protein, 18 aa, Cryptosporidium hominis
TQKHMLPLSYKWIGLSRS

SEQ ID NO: 2200661 - protein, 20 aa, Cryptosporidium hominis
TQSMEHVLIQSLRMIQKIDQ

SEQ ID NO: 2200662 - protein, 27 aa, Cryptosporidium hominis
TRDKFLQLLLCIPYWNGNIPPPAILRP

SEQ ID NO: 2200663 - protein, 20 aa, Cryptosporidium hominis
TRDLLLDFLFLPASICNVPP

SEQ ID NO: 2200664 - protein, 21 aa, Cryptosporidium hominis
TRRFRRLYFGNLPINLGLTES

SEQ ID NO: 2200665 - protein, 35 aa, Cryptosporidium hominis
TSAMTLQPLHPPPPPPPPPPPPPPPHTLPHLSQSQ

SEQ ID NO: 2200666 - protein, 18 aa, Cryptosporidium hominis
TSCPSCYFSWLRLINSKN

SEQ ID NO: 2200667 - protein, 24 aa, Cryptosporidium hominis
TSCWKLPTFLFYSDKKGNLLNYLF

SEQ ID NO: 2200668 - protein, 25 aa, Cryptosporidium hominis
TSIETLMSLYTWLKSHLLNPKSPFF

SEQ ID NO: 2200669 - protein, 23 aa, Cryptosporidium hominis
TSNLKHQFILDPKLFRPLYESDN

SEQ ID NO: 2200670 - protein, 22 aa, Cryptosporidium hominis
TSVQLDWLYALAPKDLFGNVKY

SEQ ID NO: 2200671 - protein, 25 aa, Cryptosporidium hominis
TTVSSPLLPPIAFPTKVIDTNQQNN

SEQ ID NO: 2200672 - protein, 19 aa, Cryptosporidium hominis
TVILIPLRLLEEFMSLEEQ

SEQ ID NO: 2200673 - protein, 24 aa, Cryptosporidium hominis
TVKIPLRVFLLKFSEIYIPRIHKK

SEQ ID NO: 2200674 - protein, 22 aa, Cryptosporidium hominis
TVLLKFCFIVWPSLNNTKTEID

SEQ ID NO: 2200675 - protein, 25 aa, Cryptosporidium hominis
TYPKGYFAFWLTYDSKYNYFIISVN

SEQ ID NO: 2200676 - protein, 19 aa, Cryptosporidium hominis
VAHSLYWLLKFTNSTNVPI

SEQ ID NO: 2200677 - protein, 17 aa, Cryptosporidium hominis
VALNAHLFLKNNGYFII

SEQ ID NO: 2200678 - protein, 21 aa, Cryptosporidium hominis
VCKHIFCFVCIKQWSDVATQC

SEQ ID NO: 2200679 - protein, 24 aa, Cryptosporidium hominis
VDGTGWLWMAPDGRVLSVLSGHGD

SEQ ID NO: 2200680 - protein, 27 aa, Cryptosporidium hominis
VDIKIRFFPLRTLTLYLLYKRSLEVDT

SEQ ID NO: 2200681 - protein, 25 aa, Cryptosporidium hominis
VDKNKPLLRIVSRGKLYTLADFVNT

SEQ ID NO: 2200682 - protein, 18 aa, Cryptosporidium hominis
VDLRWPAIKTWIYVCNQI

SEQ ID NO: 2200683 - protein, 17 aa, Cryptosporidium hominis
VDRLLFAIPFFFKSDVF

SEQ ID NO: 2200684 - protein, 25 aa, Cryptosporidium hominis
VDSLDHWMMLFLQPLGITCDSLSLN

SEQ ID NO: 2200685 - protein, 17 aa, Cryptosporidium hominis
VEEYLFILVLKLPSICF

SEQ ID NO: 2200686 - protein, 17 aa, Cryptosporidium hominis
VERLLLKIYQEYDDFLL

SEQ ID NO: 2200687 - protein, 21 aa, Cryptosporidium hominis
VFCLGWMLLFTLTKYQPFETC

SEQ ID NO: 2200688 - protein, 21 aa, Cryptosporidium hominis
VFFTPIHYLIGGSPLILGALW

SEQ ID NO: 2200689 - protein, 18 aa, Cryptosporidium hominis
VFIRKAPWQILVKNLNYL

SEQ ID NO: 2200690 - protein, 17 aa, Cryptosporidium hominis
VFLSNRLIWDLFGECTL

SEQ ID NO: 2200691 - protein, 18 aa, Cryptosporidium hominis
VFWRCLQPLFPYIMFKSK

SEQ ID NO: 2200692 - protein, 25 aa, Cryptosporidium hominis
VGETRYFFLVLKWNGLQQIVGASGL

SEQ ID NO: 2200693 - protein, 26 aa, Cryptosporidium hominis
VGLIWKYRFYLFKFKAGIPMLFHFIN

SEQ ID NO: 2200694 - protein, 23 aa, Cryptosporidium hominis
VHKGLYISWHPKTRRFVVALKSC

SEQ ID NO: 2200695 - protein, 18 aa, Cryptosporidium hominis
VHYISYTLKYLLDNPEEN

SEQ ID NO: 2200696 - protein, 17 aa, Cryptosporidium hominis
VIKRNQLYAFRLLQYQA

SEQ ID NO: 2200697 - protein, 18 aa, Cryptosporidium hominis
VILVLFTLKIMYPYHVHL

SEQ ID NO: 2200698 - protein, 20 aa, Cryptosporidium hominis
VISILFSLKIMFPDKIFLLR

SEQ ID NO: 2200699 - protein, 18 aa, Cryptosporidium hominis
VKCSIDLTLPIYVYKRNL

SEQ ID NO: 2200700 - protein, 17 aa, Cryptosporidium hominis
VLCYFMILNRPLIKPEN

SEQ ID NO: 2200701 - protein, 17 aa, Cryptosporidium hominis
VLDCDLREYFVGESIKF

SEQ ID NO: 2200702 - protein, 18 aa, Cryptosporidium hominis
VLLKRRKIVYITAGFNGC

SEQ ID NO: 2200703 - protein, 24 aa, Cryptosporidium hominis
VLQGVHFLLRRWISKRLAPHYIPK

SEQ ID NO: 2200704 - protein, 20 aa, Cryptosporidium hominis
VLTTSFLRKYIHYCKYVRNT

SEQ ID NO: 2200705 - protein, 17 aa, Cryptosporidium hominis
VNAKYRLIIWKRTFLPQ

SEQ ID NO: 2200706 - protein, 18 aa, Cryptosporidium hominis
VNLWLTAYFEKRIKKKQL

SEQ ID NO: 2200707 - protein, 27 aa, Cryptosporidium hominis
VNNDDLCIILKPPFWYCPIEGTGMDED

SEQ ID NO: 2200708 - protein, 18 aa, Cryptosporidium hominis
VNTLMPLVKWRPSSHFQN

SEQ ID NO: 2200709 - protein, 20 aa, Cryptosporidium hominis
VPDWMRPLLFTKSPNEALVG

SEQ ID NO: 2200710 - protein, 20 aa, Cryptosporidium hominis
VPYMIKNLWRRLENASYQRV

SEQ ID NO: 2200711 - protein, 21 aa, Cryptosporidium hominis
VQCLWPVFLLPLVSGELFFTI

SEQ ID NO: 2200712 - protein, 22 aa, Cryptosporidium hominis
VQHPMRGLFLRYFLIQTCKDVL

SEQ ID NO: 2200713 - protein, 18 aa, Cryptosporidium hominis
VRRDRVVFLGSPPELPER

SEQ ID NO: 2200714 - protein, 19 aa, Cryptosporidium hominis
VTGLLKFINKWYLPNNMCL

SEQ ID NO: 2200715 - protein, 19 aa, Cryptosporidium hominis
VTRKAILLRFSWLAPCHLV

SEQ ID NO: 2200716 - protein, 19 aa, Cryptosporidium hominis
VTWCSERRTWRICYAPEPG

SEQ ID NO: 2200717 - protein, 23 aa, Cryptosporidium hominis
VVAWQDIPIFKPFTFFSVNSEEE

SEQ ID NO: 2200718 - protein, 26 aa, Cryptosporidium hominis
VVENPHYFTLIRFLGLISNTSMAIEW

SEQ ID NO: 2200719 - protein, 24 aa, Cryptosporidium hominis
VWGTYRSYDPIYWWVDFVLQSNNP

SEQ ID NO: 2200720 - protein, 27 aa, Cryptosporidium hominis
VYKRYEDYIRLLPFFKERKYIPLFSNT

SEQ ID NO: 2200721 - protein, 21 aa, Cryptosporidium hominis
VYRMGLILEETWDKSLEGSRA

SEQ ID NO: 2200722 - protein, 17 aa, Cryptosporidium hominis
WCWFYGTLPFQGNSILE

SEQ ID NO: 2200723 - protein, 18 aa, Cryptosporidium hominis
WEGYFLWDIIRGKILNYR

SEQ ID NO: 2200724 - protein, 17 aa, Cryptosporidium hominis
WEIYYSITLIQLSFREI

SEQ ID NO: 2200725 - protein, 18 aa, Cryptosporidium hominis
WEYFDSLHSKLINLAGFH

SEQ ID NO: 2200726 - protein, 19 aa, Cryptosporidium hominis
WFHSVIWPAMLLSVGLSLP

SEQ ID NO: 2200727 - protein, 17 aa, Cryptosporidium hominis
WFHSWKKLLRNSSGYFF

SEQ ID NO: 2200728 - protein, 18 aa, Cryptosporidium hominis
WFRKYFKTYYLPNEYWIY

SEQ ID NO: 2200729 - protein, 17 aa, Cryptosporidium hominis
WFYVPFEITFHPYCLIS

SEQ ID NO: 2200730 - protein, 19 aa, Cryptosporidium hominis
WHFLSLGAIFLKYSKKNSI

SEQ ID NO: 2200731 - protein, 26 aa, Cryptosporidium hominis
WIEVFNKWYYPIRIILFHGKGESERR

SEQ ID NO: 2200732 - protein, 24 aa, Cryptosporidium hominis
WISKRLAPHYIPKSSLDFLPLDIL

SEQ ID NO: 2200733 - protein, 19 aa, Cryptosporidium hominis
WKTFGYFNLISCYSVLVNS

SEQ ID NO: 2200734 - protein, 17 aa, Cryptosporidium hominis
WLIVRDLPSKSYALQQN

SEQ ID NO: 2200735 - protein, 18 aa, Cryptosporidium hominis
WLKSHLLNPKSPFFDLDY

SEQ ID NO: 2200736 - protein, 18 aa, Cryptosporidium hominis
WLSIYYLVNSMKFISREH

SEQ ID NO: 2200737 - protein, 17 aa, Cryptosporidium hominis
WLYYPDSLQWYSKVQNE

SEQ ID NO: 2200738 - protein, 18 aa, Cryptosporidium hominis
WPHFISLLKLLSSRGALH

SEQ ID NO: 2200739 - protein, 21 aa, Cryptosporidium hominis
WRNIFGLIWVIFYTKPFKPKD

SEQ ID NO: 2200740 - protein, 25 aa, Cryptosporidium hominis
WSNRQMAWLAFWKEDNQRRSKTFSA

SEQ ID NO: 2200741 - protein, 21 aa, Cryptosporidium hominis
WSVGIILFEMLFGGPPLSDPG

SEQ ID NO: 2200742 - protein, 17 aa, Cryptosporidium hominis
WYKYPWRFTFSDFTNKK

SEQ ID NO: 2200743 - protein, 24 aa, Cryptosporidium hominis
YAVECLCQLIMTTGYYLDSNEKSQ

SEQ ID NO: 2200744 - protein, 18 aa, Cryptosporidium hominis
YDMMIWYFITYSPGEWSL

SEQ ID NO: 2200745 - protein, 18 aa, Cryptosporidium hominis
YENWPFVKSFFDLVSMIL

SEQ ID NO: 2200746 - protein, 17 aa, Cryptosporidium hominis
YEPLLKFVKDEFPGEFL

SEQ ID NO: 2200747 - protein, 19 aa, Cryptosporidium hominis
YFDWLVFRINNPMTNGLMN

SEQ ID NO: 2200748 - protein, 27 aa, Cryptosporidium hominis
YFEFPDLITIIYRFPFYINPMKLSHGK

SEQ ID NO: 2200749 - protein, 17 aa, Cryptosporidium hominis
YFIFTSPSLLYASFGLY

SEQ ID NO: 2200750 - protein, 23 aa, Cryptosporidium hominis
YFKESIWIPNALIPLVRQRNKDK

SEQ ID NO: 2200751 - protein, 18 aa, Cryptosporidium hominis
YFLWDIIRGKILNYRDNI

SEQ ID NO: 2200752 - protein, 18 aa, Cryptosporidium hominis
YFPLPPLDKYYDSCAPAY

SEQ ID NO: 2200753 - protein, 19 aa, Cryptosporidium hominis
YFQDQLFKFLIRKNHRRTT

SEQ ID NO: 2200754 - protein, 24 aa, Cryptosporidium hominis
YGESYPFFPPGIKPAPIDGDENNT

SEQ ID NO: 2200755 - protein, 24 aa, Cryptosporidium hominis
YGNIYGIIFLFKFTEKFKGNHFSQ

SEQ ID NO: 2200756 - protein, 19 aa, Cryptosporidium hominis
YHKIPQFINYKLPSAEIKV

SEQ ID NO: 2200757 - protein, 24 aa, Cryptosporidium hominis
YIRDLLCILSRDIWSLLLSCHQNF

SEQ ID NO: 2200758 - protein, 22 aa, Cryptosporidium hominis
YISPFLIYNFWTDPTLWTIQTN

SEQ ID NO: 2200759 - protein, 24 aa, Cryptosporidium hominis
YKEYQLPFIFPFKSLSIGEIAASF

SEQ ID NO: 2200760 - protein, 31 aa, Cryptosporidium hominis
YKGVSWNKRMQSWLAFWTEGQRRRSKTFNSK

SEQ ID NO: 2200761 - protein, 19 aa, Cryptosporidium hominis
YKIQIPLPPKIDPSVAMMT

SEQ ID NO: 2200762 - protein, 25 aa, Cryptosporidium hominis
YKNFNFRIMILPKVKLTSGGSLEGH

SEQ ID NO: 2200763 - protein, 21 aa, Cryptosporidium hominis
YKRIPLKNIWFIFKRIYSMKP

SEQ ID NO: 2200764 - protein, 19 aa, Cryptosporidium hominis
YLDDGSGLILIDWLVDNTG

SEQ ID NO: 2200765 - protein, 20 aa, Cryptosporidium hominis
YLDLFPCFVLAIFKSLVLLD

SEQ ID NO: 2200766 - protein, 27 aa, Cryptosporidium hominis
YLKKNFIYMLLPMIIKKAFLAYNSLKE

SEQ ID NO: 2200767 - protein, 17 aa, Cryptosporidium hominis
YLNIRWRRKMGEKLIDI

SEQ ID NO: 2200768 - protein, 21 aa, Cryptosporidium hominis
YLPLFAFFMKLSIRVHFDMIS

SEQ ID NO: 2200769 - protein, 19 aa, Cryptosporidium hominis
YMLQRRWKVVIWDLSIENL

SEQ ID NO: 2200770 - protein, 17 aa, Cryptosporidium hominis
YMMFLGCKTHRAASIVL

SEQ ID NO: 2200771 - protein, 24 aa, Cryptosporidium hominis
YNFEKPFLWLARRLTNQPALQLVG

SEQ ID NO: 2200772 - protein, 19 aa, Cryptosporidium hominis
YNIYLFDTLCNLVSFQKIT

SEQ ID NO: 2200773 - protein, 18 aa, Cryptosporidium hominis
YNLWIKCLDIYSSCLWQL

SEQ ID NO: 2200774 - protein, 22 aa, Cryptosporidium hominis
YNSVIIFFFLYHCAFKNESSFE

SEQ ID NO: 2200775 - protein, 25 aa, Cryptosporidium hominis
YNTWFRYNLPFYLEPQYYHLLSYKL

SEQ ID NO: 2200776 - protein, 25 aa, Cryptosporidium hominis
YNYKRALCRHWMRGYCWLEADCKFA

SEQ ID NO: 2200777 - protein, 20 aa, Cryptosporidium hominis
YPCKCRYQICLWCFYHVRDQ

SEQ ID NO: 2200778 - protein, 24 aa, Cryptosporidium hominis
YPKRLRTAPLKWYLGERLEYHRDE

SEQ ID NO: 2200779 - protein, 18 aa, Cryptosporidium hominis
YRSLAPMYYRGAAAAIVV

SEQ ID NO: 2200780 - protein, 22 aa, Cryptosporidium hominis
YSAKLEMLFRKNFIRNLHEVEE

SEQ ID NO: 2200781 - protein, 23 aa, Cryptosporidium hominis
YSNDHWWYIFKKKFNMSTKGGIS

SEQ ID NO: 2200782 - protein, 21 aa, Cryptosporidium hominis
YSQLLYRPIYISKNKKLLVFL

SEQ ID NO: 2200783 - protein, 29 aa, Cryptosporidium hominis
YSRRFILRLFRQFWGFLDYMDLSLIENLN

SEQ ID NO: 2200784 - protein, 19 aa, Cryptosporidium hominis
YVFHNWFGNTLFSFDPLDG

SEQ ID NO: 2200785 - protein, 26 aa, Cryptosporidium hominis
YVPAFSGKFAFLPQPPLDGSSSTGDY

SEQ ID NO: 2200786 - protein, 4 aa, Cryptosporidium hominis
CDDE

SEQ ID NO: 2200787 - protein, 15 aa, Cryptosporidium hominis
AAFPASRTKYPANTE

SEQ ID NO: 2200788 - protein, 11 aa, Cryptosporidium hominis
CGSDGKTYDNT

SEQ ID NO: 2200789 - protein, 4 aa, Cryptosporidium hominis
GVTY

SEQ ID NO: 2200790 - protein, 4 aa, Cryptosporidium hominis
KDNS

SEQ ID NO: 2200791 - protein, 5 aa, Cryptosporidium hominis
KSSSV

SEQ ID NO: 2200792 - protein, 8 aa, Cryptosporidium hominis
LEKENSGC

SEQ ID NO: 2200793 - protein, 5 aa, Cryptosporidium hominis
LPSTE

SEQ ID NO: 2200794 - protein, 4 aa, Cryptosporidium hominis
PESY

SEQ ID NO: 2200795 - protein, 5 aa, Cryptosporidium hominis
RGPDC

SEQ ID NO: 2200796 - protein, 6 aa, Cryptosporidium hominis
RGPNCK

SEQ ID NO: 2200797 - protein, 8 aa, Cryptosporidium hominis
SQPPTQTI

SEQ ID NO: 2200798 - protein, 5 aa, Cryptosporidium hominis
SSSTL

SEQ ID NO: 2200799 - protein, 16 aa, Cryptosporidium hominis
TEVKPEESTERPPLGP

SEQ ID NO: 2200800 - protein, 10 aa, Cryptosporidium hominis
VSTPTPTISA

SEQ ID NO: 2200801 - protein, 13 aa, Cryptosporidium hominis
AADGGEGSDFEKN

SEQ ID NO: 2200802 - protein, 7 aa, Cryptosporidium hominis
AAKEKYN

SEQ ID NO: 2200803 - protein, 10 aa, Cryptosporidium hominis
AAKETSTVYE

SEQ ID NO: 2200804 - protein, 12 aa, Cryptosporidium hominis
AAKSSTRKISDE

SEQ ID NO: 2200805 - protein, 33 aa, Cryptosporidium hominis
AALNSSPKKNGSGSGSSSIFGSGSDSGSTSSSI

SEQ ID NO: 2200806 - protein, 11 aa, Cryptosporidium hominis
AALQQKQKALA

SEQ ID NO: 2200807 - protein, 7 aa, Cryptosporidium hominis
AANDPDI

SEQ ID NO: 2200808 - protein, 10 aa, Cryptosporidium hominis
AANNGTHNKY

SEQ ID NO: 2200809 - protein, 11 aa, Cryptosporidium hominis
AANRGASSTGS

SEQ ID NO: 2200810 - protein, 12 aa, Cryptosporidium hominis
AAPGKSPLAGVP

SEQ ID NO: 2200811 - protein, 6 aa, Cryptosporidium hominis
AAQPPY

SEQ ID NO: 2200812 - protein, 6 aa, Cryptosporidium hominis
AASELE

SEQ ID NO: 2200813 - protein, 5 aa, Cryptosporidium hominis
AASIY

SEQ ID NO: 2200814 - protein, 7 aa, Cryptosporidium hominis
AASNPPK

SEQ ID NO: 2200815 - protein, 7 aa, Cryptosporidium hominis
AASYTGK

SEQ ID NO: 2200816 - protein, 11 aa, Cryptosporidium hominis
AATGTADVNNS

SEQ ID NO: 2200817 - protein, 9 aa, Cryptosporidium hominis
AATKENDVD

SEQ ID NO: 2200818 - protein, 8 aa, Cryptosporidium hominis
AAYGPASR

SEQ ID NO: 2200819 - protein, 15 aa, Cryptosporidium hominis
ADEGELESSYNKKSN

SEQ ID NO: 2200820 - protein, 6 aa, Cryptosporidium hominis
ADESLR

SEQ ID NO: 2200821 - protein, 7 aa, Cryptosporidium hominis
ADEYGNS

SEQ ID NO: 2200822 - protein, 18 aa, Cryptosporidium hominis
ADIDSFSDSEFSNSYPSV

SEQ ID NO: 2200823 - protein, 14 aa, Cryptosporidium hominis
ADLPRDNKFASKPA

SEQ ID NO: 2200824 - protein, 15 aa, Cryptosporidium hominis
ADLSDETSEVQNPEQ

SEQ ID NO: 2200825 - protein, 7 aa, Cryptosporidium hominis
ADNEDDL

SEQ ID NO: 2200826 - protein, 47 aa, Cryptosporidium hominis
ADNRNSNSTEEPGTKPTERPGVPRVEEKGEPEDESKKEEAQNSEGKF

SEQ ID NO: 2200827 - protein, 23 aa, Cryptosporidium hominis
ADPITSETGNENEGTEDSVTEDF

SEQ ID NO: 2200828 - protein, 8 aa, Cryptosporidium hominis
ADPSRTHP

SEQ ID NO: 2200829 - protein, 8 aa, Cryptosporidium hominis
ADSNSDGV

SEQ ID NO: 2200830 - protein, 44 aa, Cryptosporidium hominis
ADSRSGNKSGLRKRSGLTPQGTSKVSSDSSKKESNSAGEEGINS

SEQ ID NO: 2200831 - protein, 7 aa, Cryptosporidium hominis
ADTESQW

SEQ ID NO: 2200832 - protein, 5 aa, Cryptosporidium hominis
ADYEY

SEQ ID NO: 2200833 - protein, 4 aa, Cryptosporidium hominis
ADYR

SEQ ID NO: 2200834 - protein, 14 aa, Cryptosporidium hominis
AEAIENTPQQIIED

SEQ ID NO: 2200835 - protein, 15 aa, Cryptosporidium hominis
AEAPDGNSSDDLSEE

SEQ ID NO: 2200836 - protein, 18 aa, Cryptosporidium hominis
AEAPHSSDENEESNDGKT

SEQ ID NO: 2200837 - protein, 7 aa, Cryptosporidium hominis
AEDSTYN

SEQ ID NO: 2200838 - protein, 18 aa, Cryptosporidium hominis
AEEAKKEESDKLSSQIAE

SEQ ID NO: 2200839 - protein, 23 aa, Cryptosporidium hominis
AEEEEEPGIPGTNPEKRPSESPI

SEQ ID NO: 2200840 - protein, 6 aa, Cryptosporidium hominis
AEEIEG

SEQ ID NO: 2200841 - protein, 6 aa, Cryptosporidium hominis
AEEQKK

SEQ ID NO: 2200842 - protein, 5 aa, Cryptosporidium hominis
AEESG

SEQ ID NO: 2200843 - protein, 8 aa, Cryptosporidium hominis
AEHQDNSQ

SEQ ID NO: 2200844 - protein, 9 aa, Cryptosporidium hominis
AEIQNGING

SEQ ID NO: 2200845 - protein, 5 aa, Cryptosporidium hominis
AEKHV

SEQ ID NO: 2200846 - protein, 8 aa, Cryptosporidium hominis
AEKSRASI

SEQ ID NO: 2200847 - protein, 8 aa, Cryptosporidium hominis
AEKSRDSL

SEQ ID NO: 2200848 - protein, 8 aa, Cryptosporidium hominis
AENASELN

SEQ ID NO: 2200849 - protein, 7 aa, Cryptosporidium hominis
AEQAEDG

SEQ ID NO: 2200850 - protein, 6 aa, Cryptosporidium hominis
AESEEA

SEQ ID NO: 2200851 - protein, 5 aa, Cryptosporidium hominis
AESGD

SEQ ID NO: 2200852 - protein, 6 aa, Cryptosporidium hominis
AESGVT

SEQ ID NO: 2200853 - protein, 6 aa, Cryptosporidium hominis
AESLSD

SEQ ID NO: 2200854 - protein, 8 aa, Cryptosporidium hominis
AESSTEDY

SEQ ID NO: 2200855 - protein, 6 aa, Cryptosporidium hominis
AEVESG

SEQ ID NO: 2200856 - protein, 5 aa, Cryptosporidium hominis
AEYPT

SEQ ID NO: 2200857 - protein, 9 aa, Cryptosporidium hominis
AFDKVTPDE

SEQ ID NO: 2200858 - protein, 10 aa, Cryptosporidium hominis
AFDNSEDSFG

SEQ ID NO: 2200859 - protein, 5 aa, Cryptosporidium hominis
AFEEK

SEQ ID NO: 2200860 - protein, 20 aa, Cryptosporidium hominis
AFGEEGLKSEGFGGGGDGGF

SEQ ID NO: 2200861 - protein, 8 aa, Cryptosporidium hominis
AFPRQKEK

SEQ ID NO: 2200862 - protein, 4 aa, Cryptosporidium hominis
AFSI

SEQ ID NO: 2200863 - protein, 5 aa, Cryptosporidium hominis
AFSPL

SEQ ID NO: 2200864 - protein, 4 aa, Cryptosporidium hominis
AGCP

SEQ ID NO: 2200865 - protein, 6 aa, Cryptosporidium hominis
AGDEFS

SEQ ID NO: 2200866 - protein, 5 aa, Cryptosporidium hominis
AGETG

SEQ ID NO: 2200867 - protein, 4 aa, Cryptosporidium hominis
AGGN

SEQ ID NO: 2200868 - protein, 7 aa, Cryptosporidium hominis
AGGNLPS

SEQ ID NO: 2200869 - protein, 6 aa, Cryptosporidium hominis
AGKKRT

SEQ ID NO: 2200870 - protein, 5 aa, Cryptosporidium hominis
AGKPV

SEQ ID NO: 2200871 - protein, 16 aa, Cryptosporidium hominis
AGNRNEEVKSGQQNVP

SEQ ID NO: 2200872 - protein, 14 aa, Cryptosporidium hominis
AGQHKNTETAQSDT

SEQ ID NO: 2200873 - protein, 7 aa, Cryptosporidium hominis
AGRPSAD

SEQ ID NO: 2200874 - protein, 7 aa, Cryptosporidium hominis
AGSTGKF

SEQ ID NO: 2200875 - protein, 5 aa, Cryptosporidium hominis
AGYPV

SEQ ID NO: 2200876 - protein, 6 aa, Cryptosporidium hominis
AGYSTG

SEQ ID NO: 2200877 - protein, 13 aa, Cryptosporidium hominis
AIKGEEEEREGLN

SEQ ID NO: 2200878 - protein, 6 aa, Cryptosporidium hominis
AINQQN

SEQ ID NO: 2200879 - protein, 27 aa, Cryptosporidium hominis
AIPGTNKRIKKKDSLEIQNDDNPELKS

SEQ ID NO: 2200880 - protein, 4 aa, Cryptosporidium hominis
AISP

SEQ ID NO: 2200881 - protein, 12 aa, Cryptosporidium hominis
AISSNKRSYENG

SEQ ID NO: 2200882 - protein, 18 aa, Cryptosporidium hominis
AISSRSPVHAKKGSNKVH

SEQ ID NO: 2200883 - protein, 8 aa, Cryptosporidium hominis
AISTEESR

SEQ ID NO: 2200884 - protein, 5 aa, Cryptosporidium hominis
AITES

SEQ ID NO: 2200885 - protein, 4 aa, Cryptosporidium hominis
AKAK

SEQ ID NO: 2200886 - protein, 10 aa, Cryptosporidium hominis
AKCTGGECTP

SEQ ID NO: 2200887 - protein, 45 aa, Cryptosporidium hominis
AKDEQLNKRSPRTRNTAVSSSYSTKYPRPSQTADTLDDTKPHVPS

SEQ ID NO: 2200888 - protein, 7 aa, Cryptosporidium hominis
AKDGESN

SEQ ID NO: 2200889 - protein, 13 aa, Cryptosporidium hominis
AKENSVPESQAHP

SEQ ID NO: 2200890 - protein, 9 aa, Cryptosporidium hominis
AKEPEESAK

SEQ ID NO: 2200891 - protein, 22 aa, Cryptosporidium hominis
AKEVKNEAENVPKETQPEEKRR

SEQ ID NO: 2200892 - protein, 10 aa, Cryptosporidium hominis
AKGNPSPPQM

SEQ ID NO: 2200893 - protein, 8 aa, Cryptosporidium hominis
AKKENLDN

SEQ ID NO: 2200894 - protein, 5 aa, Cryptosporidium hominis
AKKGQ

SEQ ID NO: 2200895 - protein, 8 aa, Cryptosporidium hominis
AKKNINDA

SEQ ID NO: 2200896 - protein, 5 aa, Cryptosporidium hominis
AKKNV

SEQ ID NO: 2200897 - protein, 9 aa, Cryptosporidium hominis
AKNESVPNS

SEQ ID NO: 2200898 - protein, 5 aa, Cryptosporidium hominis
AKNGK

SEQ ID NO: 2200899 - protein, 6 aa, Cryptosporidium hominis
AKPSQY

SEQ ID NO: 2200900 - protein, 135 aa, Cryptosporidium hominis
AKQEKEKQKLQKLEDKKKKKALKEADKKSSSDKNKADDAELSKKQEKERQKRLREEEKEQKRLKKEKKKQKLPKDNEKQKLSKEEKQRQKELEKEEKQKQKQLQKEEKQRQKKLQKEEKQRQKQLQKEEKQKQKL

SEQ ID NO: 2200901 - protein, 7 aa, Cryptosporidium hominis
AKRTIEG

SEQ ID NO: 2200902 - protein, 6 aa, Cryptosporidium hominis
AKSDEE

SEQ ID NO: 2200903 - protein, 9 aa, Cryptosporidium hominis
AKSKSERDG

SEQ ID NO: 2200904 - protein, 8 aa, Cryptosporidium hominis
AKSSAKQC

SEQ ID NO: 2200905 - protein, 6 aa, Cryptosporidium hominis
AKTDIN

SEQ ID NO: 2200906 - protein, 12 aa, Cryptosporidium hominis
AKTIRNSSQSSY

SEQ ID NO: 2200907 - protein, 8 aa, Cryptosporidium hominis
AKYGEDDI

SEQ ID NO: 2200908 - protein, 4 aa, Cryptosporidium hominis
ALES

SEQ ID NO: 2200909 - protein, 13 aa, Cryptosporidium hominis
ALGKDTSATNCPN

SEQ ID NO: 2200910 - protein, 15 aa, Cryptosporidium hominis
ALPASRTGQPSETTH

SEQ ID NO: 2200911 - protein, 6 aa, Cryptosporidium hominis
ALQTEL

SEQ ID NO: 2200912 - protein, 5 aa, Cryptosporidium hominis
ALREE

SEQ ID NO: 2200913 - protein, 9 aa, Cryptosporidium hominis
ALRNARKEF

SEQ ID NO: 2200914 - protein, 8 aa, Cryptosporidium hominis
AMDSQNAR

SEQ ID NO: 2200915 - protein, 7 aa, Cryptosporidium hominis
AMGTLSK

SEQ ID NO: 2200916 - protein, 10 aa, Cryptosporidium hominis
ANAPSPNRNK

SEQ ID NO: 2200917 - protein, 4 aa, Cryptosporidium hominis
ANAT

SEQ ID NO: 2200918 - protein, 6 aa, Cryptosporidium hominis
ANDPYI

SEQ ID NO: 2200919 - protein, 6 aa, Cryptosporidium hominis
ANERPE

SEQ ID NO: 2200920 - protein, 5 aa, Cryptosporidium hominis
ANETL

SEQ ID NO: 2200921 - protein, 8 aa, Cryptosporidium hominis
ANGNQAVT

SEQ ID NO: 2200922 - protein, 7 aa, Cryptosporidium hominis
ANGRPSA

SEQ ID NO: 2200923 - protein, 18 aa, Cryptosporidium hominis
ANKESGEENLSGEHTTTT

SEQ ID NO: 2200924 - protein, 6 aa, Cryptosporidium hominis
ANNQNL

SEQ ID NO: 2200925 - protein, 21 aa, Cryptosporidium hominis
ANNTRYSYTSSSSKKSGPAPF

SEQ ID NO: 2200926 - protein, 17 aa, Cryptosporidium hominis
ANPIDQKEVSQDPTGSE

SEQ ID NO: 2200927 - protein, 6 aa, Cryptosporidium hominis
ANQPRY

SEQ ID NO: 2200928 - protein, 26 aa, Cryptosporidium hominis
ANRQDEDGRFEGASPSNTSGVKTRAN

SEQ ID NO: 2200929 - protein, 13 aa, Cryptosporidium hominis
ANSDSISDKIGRT

SEQ ID NO: 2200930 - protein, 8 aa, Cryptosporidium hominis
ANSERSCK

SEQ ID NO: 2200931 - protein, 18 aa, Cryptosporidium hominis
ANSINSRKQYDELSSSTP

SEQ ID NO: 2200932 - protein, 10 aa, Cryptosporidium hominis
ANSKSSNNEI

SEQ ID NO: 2200933 - protein, 5 aa, Cryptosporidium hominis
ANSPG

SEQ ID NO: 2200934 - protein, 9 aa, Cryptosporidium hominis
ANSQKSVTC

SEQ ID NO: 2200935 - protein, 9 aa, Cryptosporidium hominis
ANSVTGRSN

SEQ ID NO: 2200936 - protein, 5 aa, Cryptosporidium hominis
ANSYS

SEQ ID NO: 2200937 - protein, 8 aa, Cryptosporidium hominis
ANTGLSQN

SEQ ID NO: 2200938 - protein, 21 aa, Cryptosporidium hominis
ANWGNKGYAKIRRGKNIGGIE

SEQ ID NO: 2200939 - protein, 8 aa, Cryptosporidium hominis
ANYDDYPT

SEQ ID NO: 2200940 - protein, 5 aa, Cryptosporidium hominis
APAFS

SEQ ID NO: 2200941 - protein, 8 aa, Cryptosporidium hominis
APDSEGSV

SEQ ID NO: 2200942 - protein, 4 aa, Cryptosporidium hominis
APDW

SEQ ID NO: 2200943 - protein, 6 aa, Cryptosporidium hominis
APEEHV

SEQ ID NO: 2200944 - protein, 8 aa, Cryptosporidium hominis
APELTCSK

SEQ ID NO: 2200945 - protein, 14 aa, Cryptosporidium hominis
APESAELESTCPPN

SEQ ID NO: 2200946 - protein, 11 aa, Cryptosporidium hominis
APEYEKAAKAL

SEQ ID NO: 2200947 - protein, 62 aa, Cryptosporidium hominis
APFSEKSRSSKSVEDEMSNLSENSVSEKEKTALVPSENTISAGNQVSQEEQSSDEEVKDQVE

SEQ ID NO: 2200948 - protein, 8 aa, Cryptosporidium hominis
APGDDSDI

SEQ ID NO: 2200949 - protein, 5 aa, Cryptosporidium hominis
APGRP

SEQ ID NO: 2200950 - protein, 5 aa, Cryptosporidium hominis
APIDT

SEQ ID NO: 2200951 - protein, 6 aa, Cryptosporidium hominis
APISKP

SEQ ID NO: 2200952 - protein, 8 aa, Cryptosporidium hominis
APKPRQLT

SEQ ID NO: 2200953 - protein, 5 aa, Cryptosporidium hominis
APKQW

SEQ ID NO: 2200954 - protein, 8 aa, Cryptosporidium hominis
APNGDKYY

SEQ ID NO: 2200955 - protein, 7 aa, Cryptosporidium hominis
APPFAPP

SEQ ID NO: 2200956 - protein, 5 aa, Cryptosporidium hominis
APPGL

SEQ ID NO: 2200957 - protein, 6 aa, Cryptosporidium hominis
APPNRK

SEQ ID NO: 2200958 - protein, 11 aa, Cryptosporidium hominis
APQVKPNIPGV

SEQ ID NO: 2200959 - protein, 12 aa, Cryptosporidium hominis
APQVPIVTETKT

SEQ ID NO: 2200960 - protein, 24 aa, Cryptosporidium hominis
APSCKSPGCKGTNCDGSKCKGSEC

SEQ ID NO: 2200961 - protein, 4 aa, Cryptosporidium hominis
APSP

SEQ ID NO: 2200962 - protein, 6 aa, Cryptosporidium hominis
APSQEQ

SEQ ID NO: 2200963 - protein, 17 aa, Cryptosporidium hominis
APYDSARAEYSPDGPSV

SEQ ID NO: 2200964 - protein, 4 aa, Cryptosporidium hominis
APYT

SEQ ID NO: 2200965 - protein, 8 aa, Cryptosporidium hominis
AQAPYPSE

SEQ ID NO: 2200966 - protein, 8 aa, Cryptosporidium hominis
AQEGGAIE

SEQ ID NO: 2200967 - protein, 7 aa, Cryptosporidium hominis
AQEKPEM

SEQ ID NO: 2200968 - protein, 5 aa, Cryptosporidium hominis
AQFDE

SEQ ID NO: 2200969 - protein, 4 aa, Cryptosporidium hominis
AQGA

SEQ ID NO: 2200970 - protein, 12 aa, Cryptosporidium hominis
AQINRQPNSNFQ

SEQ ID NO: 2200971 - protein, 8 aa, Cryptosporidium hominis
AQKNNEEV

SEQ ID NO: 2200972 - protein, 11 aa, Cryptosporidium hominis
AQNKTFNNNSI

SEQ ID NO: 2200973 - protein, 13 aa, Cryptosporidium hominis
AQNQTSQSDEESE

SEQ ID NO: 2200974 - protein, 17 aa, Cryptosporidium hominis
AQQTSEEIAEKADSTLD

SEQ ID NO: 2200975 - protein, 13 aa, Cryptosporidium hominis
AQSNISAPFSTNG

SEQ ID NO: 2200976 - protein, 5 aa, Cryptosporidium hominis
AQSNQ

SEQ ID NO: 2200977 - protein, 8 aa, Cryptosporidium hominis
AQSQSYSL

SEQ ID NO: 2200978 - protein, 7 aa, Cryptosporidium hominis
AQSSLQE

SEQ ID NO: 2200979 - protein, 4 aa, Cryptosporidium hominis
AQVD

SEQ ID NO: 2200980 - protein, 8 aa, Cryptosporidium hominis
ARDSESLE

SEQ ID NO: 2200981 - protein, 12 aa, Cryptosporidium hominis
ARELGDEKKMDP

SEQ ID NO: 2200982 - protein, 5 aa, Cryptosporidium hominis
ARELK

SEQ ID NO: 2200983 - protein, 18 aa, Cryptosporidium hominis
ARGSDVEDPLESEVARTE

SEQ ID NO: 2200984 - protein, 13 aa, Cryptosporidium hominis
ARKNEKINESGDF

SEQ ID NO: 2200985 - protein, 4 aa, Cryptosporidium hominis
ARNA

SEQ ID NO: 2200986 - protein, 7 aa, Cryptosporidium hominis
ARNPTMD

SEQ ID NO: 2200987 - protein, 4 aa, Cryptosporidium hominis
ARQS

SEQ ID NO: 2200988 - protein, 4 aa, Cryptosporidium hominis
ARRR

SEQ ID NO: 2200989 - protein, 13 aa, Cryptosporidium hominis
ARSALERSAASEQ

SEQ ID NO: 2200990 - protein, 4 aa, Cryptosporidium hominis
ARSQ

SEQ ID NO: 2200991 - protein, 6 aa, Cryptosporidium hominis
ARSRAF

SEQ ID NO: 2200992 - protein, 5 aa, Cryptosporidium hominis
ARVRE

SEQ ID NO: 2200993 - protein, 6 aa, Cryptosporidium hominis
ASADQV

SEQ ID NO: 2200994 - protein, 7 aa, Cryptosporidium hominis
ASAPTSN

SEQ ID NO: 2200995 - protein, 9 aa, Cryptosporidium hominis
ASASINNRI

SEQ ID NO: 2200996 - protein, 4 aa, Cryptosporidium hominis
ASAV

SEQ ID NO: 2200997 - protein, 8 aa, Cryptosporidium hominis
ASDEDSLN

SEQ ID NO: 2200998 - protein, 7 aa, Cryptosporidium hominis
ASDGSSI

SEQ ID NO: 2200999 - protein, 10 aa, Cryptosporidium hominis
ASDPTENKKK

SEQ ID NO: 2201000 - protein, 5 aa, Cryptosporidium hominis
ASDQS

SEQ ID NO: 2201001 - protein, 50 aa, Cryptosporidium hominis
ASDSEESKGASSSRNSESEPEPVSVASSENESQMTKPDQGIEPTAEELST

SEQ ID NO: 2201002 - protein, 16 aa, Cryptosporidium hominis
ASDVTSSGSLKTSNNL

SEQ ID NO: 2201003 - protein, 12 aa, Cryptosporidium hominis
ASEEKQDEKDSI

SEQ ID NO: 2201004 - protein, 5 aa, Cryptosporidium hominis
ASEEN

SEQ ID NO: 2201005 - protein, 10 aa, Cryptosporidium hominis
ASEKRAHAAN

SEQ ID NO: 2201006 - protein, 4 aa, Cryptosporidium hominis
ASES

SEQ ID NO: 2201007 - protein, 8 aa, Cryptosporidium hominis
ASESPSKR

SEQ ID NO: 2201008 - protein, 6 aa, Cryptosporidium hominis
ASFSSP

SEQ ID NO: 2201009 - protein, 15 aa, Cryptosporidium hominis
ASGDDYFSNSPTARE

SEQ ID NO: 2201010 - protein, 7 aa, Cryptosporidium hominis
ASGDVES

SEQ ID NO: 2201011 - protein, 47 aa, Cryptosporidium hominis
ASGETNSETSSSSDQRPFTDSDFDSSVSSFDSSDYEFDTDSDSPMNA

SEQ ID NO: 2201012 - protein, 8 aa, Cryptosporidium hominis
ASGGNDGK

SEQ ID NO: 2201013 - protein, 12 aa, Cryptosporidium hominis
ASGQAKKKPIEN

SEQ ID NO: 2201014 - protein, 6 aa, Cryptosporidium hominis
ASHNDK

SEQ ID NO: 2201015 - protein, 8 aa, Cryptosporidium hominis
ASKAPEFY

SEQ ID NO: 2201016 - protein, 10 aa, Cryptosporidium hominis
ASKAPNSNVE

SEQ ID NO: 2201017 - protein, 5 aa, Cryptosporidium hominis
ASKIP

SEQ ID NO: 2201018 - protein, 11 aa, Cryptosporidium hominis
ASKSDQSVLEE

SEQ ID NO: 2201019 - protein, 8 aa, Cryptosporidium hominis
ASKSGQEI

SEQ ID NO: 2201020 - protein, 6 aa, Cryptosporidium hominis
ASKTGF

SEQ ID NO: 2201021 - protein, 5 aa, Cryptosporidium hominis
ASKVT

SEQ ID NO: 2201022 - protein, 13 aa, Cryptosporidium hominis
ASLGGSTVDNTGV

SEQ ID NO: 2201023 - protein, 6 aa, Cryptosporidium hominis
ASMKNT

SEQ ID NO: 2201024 - protein, 5 aa, Cryptosporidium hominis
ASNED

SEQ ID NO: 2201025 - protein, 30 aa, Cryptosporidium hominis
ASNPTESITEKIPESEETTNEGYSDAESFS

SEQ ID NO: 2201026 - protein, 14 aa, Cryptosporidium hominis
ASNSDNQSNTKNDI

SEQ ID NO: 2201027 - protein, 19 aa, Cryptosporidium hominis
ASNTSNKNKTNNSDSVSNV

SEQ ID NO: 2201028 - protein, 10 aa, Cryptosporidium hominis
ASPAPETNNE

SEQ ID NO: 2201029 - protein, 9 aa, Cryptosporidium hominis
ASPESTATT

SEQ ID NO: 2201030 - protein, 7 aa, Cryptosporidium hominis
ASPPPAS

SEQ ID NO: 2201031 - protein, 7 aa, Cryptosporidium hominis
ASPPTGG

SEQ ID NO: 2201032 - protein, 9 aa, Cryptosporidium hominis
ASPQNKDRM

SEQ ID NO: 2201033 - protein, 7 aa, Cryptosporidium hominis
ASQKEAI

SEQ ID NO: 2201034 - protein, 20 aa, Cryptosporidium hominis
ASQKEKRERRNQARNSKIVS

SEQ ID NO: 2201035 - protein, 6 aa, Cryptosporidium hominis
ASQPMK

SEQ ID NO: 2201036 - protein, 8 aa, Cryptosporidium hominis
ASQPRDDK

SEQ ID NO: 2201037 - protein, 4 aa, Cryptosporidium hominis
ASQY

SEQ ID NO: 2201038 - protein, 13 aa, Cryptosporidium hominis
ASRKSYTHGAQDT

SEQ ID NO: 2201039 - protein, 6 aa, Cryptosporidium hominis
ASRPGK

SEQ ID NO: 2201040 - protein, 11 aa, Cryptosporidium hominis
ASSCPEEGNRG

SEQ ID NO: 2201041 - protein, 14 aa, Cryptosporidium hominis
ASSEGLSGEKRHVS

SEQ ID NO: 2201042 - protein, 6 aa, Cryptosporidium hominis
ASSGDY

SEQ ID NO: 2201043 - protein, 14 aa, Cryptosporidium hominis
ASSKADFSNTASAR

SEQ ID NO: 2201044 - protein, 28 aa, Cryptosporidium hominis
ASSTEDNTETGSSMSGSGNFNDDFCKTK

SEQ ID NO: 2201045 - protein, 12 aa, Cryptosporidium hominis
ASSVQKKSESIP

SEQ ID NO: 2201046 - protein, 8 aa, Cryptosporidium hominis
ASTGSPVG

SEQ ID NO: 2201047 - protein, 5 aa, Cryptosporidium hominis
ASTQD

SEQ ID NO: 2201048 - protein, 5 aa, Cryptosporidium hominis
ASTRR

SEQ ID NO: 2201049 - protein, 6 aa, Cryptosporidium hominis
ASTSRY

SEQ ID NO: 2201050 - protein, 8 aa, Cryptosporidium hominis
ASTSVPGA

SEQ ID NO: 2201051 - protein, 7 aa, Cryptosporidium hominis
ATAPGTA

SEQ ID NO: 2201052 - protein, 8 aa, Cryptosporidium hominis
ATASDPLS

SEQ ID NO: 2201053 - protein, 13 aa, Cryptosporidium hominis
ATGPSTNNKELES

SEQ ID NO: 2201054 - protein, 12 aa, Cryptosporidium hominis
ATINRKENDFSQ

SEQ ID NO: 2201055 - protein, 19 aa, Cryptosporidium hominis
ATKENVGETQKGASPAVPQ

SEQ ID NO: 2201056 - protein, 10 aa, Cryptosporidium hominis
ATKYTGCEKG

SEQ ID NO: 2201057 - protein, 11 aa, Cryptosporidium hominis
ATNPLPELSPE

SEQ ID NO: 2201058 - protein, 6 aa, Cryptosporidium hominis
ATNPSI

SEQ ID NO: 2201059 - protein, 7 aa, Cryptosporidium hominis
ATNSTLG

SEQ ID NO: 2201060 - protein, 10 aa, Cryptosporidium hominis
ATPPENRPED

SEQ ID NO: 2201061 - protein, 6 aa, Cryptosporidium hominis
ATQEES

SEQ ID NO: 2201062 - protein, 23 aa, Cryptosporidium hominis
ATQQDIDESLKRERETSRILHIG

SEQ ID NO: 2201063 - protein, 4 aa, Cryptosporidium hominis
ATQW

SEQ ID NO: 2201064 - protein, 14 aa, Cryptosporidium hominis
ATRIESNATEPISN

SEQ ID NO: 2201065 - protein, 11 aa, Cryptosporidium hominis
ATSDENQVEDL

SEQ ID NO: 2201066 - protein, 16 aa, Cryptosporidium hominis
ATSDQKVEQKDPYRST

SEQ ID NO: 2201067 - protein, 6 aa, Cryptosporidium hominis
ATSGNF

SEQ ID NO: 2201068 - protein, 7 aa, Cryptosporidium hominis
ATSGSDQ

SEQ ID NO: 2201069 - protein, 4 aa, Cryptosporidium hominis
ATSN

SEQ ID NO: 2201070 - protein, 11 aa, Cryptosporidium hominis
ATSNGVSDFSS

SEQ ID NO: 2201071 - protein, 6 aa, Cryptosporidium hominis
ATSPKR

SEQ ID NO: 2201072 - protein, 24 aa, Cryptosporidium hominis
ATTLNQQAKQGQKLQNPVKASTPV

SEQ ID NO: 2201073 - protein, 7 aa, Cryptosporidium hominis
ATTPEGK

SEQ ID NO: 2201074 - protein, 7 aa, Cryptosporidium hominis
AVGDSVS

SEQ ID NO: 2201075 - protein, 5 aa, Cryptosporidium hominis
AVKPL

SEQ ID NO: 2201076 - protein, 4 aa, Cryptosporidium hominis
AVPE

SEQ ID NO: 2201077 - protein, 7 aa, Cryptosporidium hominis
AVPTHGG

SEQ ID NO: 2201078 - protein, 15 aa, Cryptosporidium hominis
AVPVPDPAVPTPVPA

SEQ ID NO: 2201079 - protein, 39 aa, Cryptosporidium hominis
AVPVPDPTVPTPAQTPDIEVGSQDQEGEAVTTPEYPGSL

SEQ ID NO: 2201080 - protein, 243 aa, Cryptosporidium hominis
AVQGPSKRNTQPKQNESGTTEAPSTGSPTPKEEQSEVQSPCGGSSQEGIPSPRLTSNSEAGVPESKSPTSSPNPTTKSPPNPTTKSPPNPTTKSPPKPAPKPTTKPAPKPTLPGVTTKPSSTARPSKPLGPAAGVRPLGSGVAPKPSGPSRSSKPLGPGAGVKPLGSGVTSKPSGPSRSSKPLGPGAGVKPLGSGVTPKPPASSRLSRPLGAGAAIGSPTKGATTASRVSATGLTKPTPSGLS

SEQ ID NO: 2201081 - protein, 8 aa, Cryptosporidium hominis
AVQQEQKL

SEQ ID NO: 2201082 - protein, 5 aa, Cryptosporidium hominis
AYGRI

SEQ ID NO: 2201083 - protein, 11 aa, Cryptosporidium hominis
AYTTSSGTSQS

SEQ ID NO: 2201084 - protein, 7 aa, Cryptosporidium hominis
CANNPGT

SEQ ID NO: 2201085 - protein, 10 aa, Cryptosporidium hominis
CAPPSNEAEY

SEQ ID NO: 2201086 - protein, 4 aa, Cryptosporidium hominis
CAQQ

SEQ ID NO: 2201087 - protein, 8 aa, Cryptosporidium hominis
CASVGSSE

SEQ ID NO: 2201088 - protein, 7 aa, Cryptosporidium hominis
CATTREK

SEQ ID NO: 2201089 - protein, 4 aa, Cryptosporidium hominis
CDDK

SEQ ID NO: 2201090 - protein, 5 aa, Cryptosporidium hominis
CDNEN

SEQ ID NO: 2201091 - protein, 4 aa, Cryptosporidium hominis
CDNS

SEQ ID NO: 2201092 - protein, 19 aa, Cryptosporidium hominis
CDPQEYSGEYPFSEPETRA

SEQ ID NO: 2201093 - protein, 11 aa, Cryptosporidium hominis
CDSSSDSDSAD

SEQ ID NO: 2201094 - protein, 5 aa, Cryptosporidium hominis
CEELT

SEQ ID NO: 2201095 - protein, 9 aa, Cryptosporidium hominis
CEKEGNKGL

SEQ ID NO: 2201096 - protein, 6 aa, Cryptosporidium hominis
CESEDQ

SEQ ID NO: 2201097 - protein, 5 aa, Cryptosporidium hominis
CETQE

SEQ ID NO: 2201098 - protein, 11 aa, Cryptosporidium hominis
CGEKGTNYTKD

SEQ ID NO: 2201099 - protein, 22 aa, Cryptosporidium hominis
CGGKNGNTGNPVKLASEAENSI

SEQ ID NO: 2201100 - protein, 11 aa, Cryptosporidium hominis
CGKCSSGSTCC

SEQ ID NO: 2201101 - protein, 9 aa, Cryptosporidium hominis
CGSDGKTYS

SEQ ID NO: 2201102 - protein, 8 aa, Cryptosporidium hominis
CGSNNEDV

SEQ ID NO: 2201103 - protein, 5 aa, Cryptosporidium hominis
CKEEK

SEQ ID NO: 2201104 - protein, 7 aa, Cryptosporidium hominis
CKEGSHS

SEQ ID NO: 2201105 - protein, 20 aa, Cryptosporidium hominis
CKKKKSKKKGLSLPPPPARS

SEQ ID NO: 2201106 - protein, 7 aa, Cryptosporidium hominis
CKKKREV

SEQ ID NO: 2201107 - protein, 11 aa, Cryptosporidium hominis
CKNTKKSLTEQ

SEQ ID NO: 2201108 - protein, 6 aa, Cryptosporidium hominis
CKPNEN

SEQ ID NO: 2201109 - protein, 12 aa, Cryptosporidium hominis
CKTELSKAKKSF

SEQ ID NO: 2201110 - protein, 5 aa, Cryptosporidium hominis
CKTKS

SEQ ID NO: 2201111 - protein, 8 aa, Cryptosporidium hominis
CKTPLKKN

SEQ ID NO: 2201112 - protein, 6 aa, Cryptosporidium hominis
CNETEN

SEQ ID NO: 2201113 - protein, 15 aa, Cryptosporidium hominis
CNKPAQPSAQPSQAP

SEQ ID NO: 2201114 - protein, 6 aa, Cryptosporidium hominis
CNTNPC

SEQ ID NO: 2201115 - protein, 10 aa, Cryptosporidium hominis
CNVNRSDVDE

SEQ ID NO: 2201116 - protein, 9 aa, Cryptosporidium hominis
CPGQESFPA

SEQ ID NO: 2201117 - protein, 24 aa, Cryptosporidium hominis
CPKADGDSIKREPRTGNVNNSSGK

SEQ ID NO: 2201118 - protein, 5 aa, Cryptosporidium hominis
CPNES

SEQ ID NO: 2201119 - protein, 4 aa, Cryptosporidium hominis
CPNG

SEQ ID NO: 2201120 - protein, 8 aa, Cryptosporidium hominis
CPNNPNSN

SEQ ID NO: 2201121 - protein, 5 aa, Cryptosporidium hominis
CPPGI

SEQ ID NO: 2201122 - protein, 13 aa, Cryptosporidium hominis
CPSGGCEKIESTP

SEQ ID NO: 2201123 - protein, 11 aa, Cryptosporidium hominis
CPSGYVTDQDG

SEQ ID NO: 2201124 - protein, 10 aa, Cryptosporidium hominis
CQDSGKDIKS

SEQ ID NO: 2201125 - protein, 7 aa, Cryptosporidium hominis
CQDSKKS

SEQ ID NO: 2201126 - protein, 10 aa, Cryptosporidium hominis
CQESESSNEK

SEQ ID NO: 2201127 - protein, 8 aa, Cryptosporidium hominis
CQIPGGNY

SEQ ID NO: 2201128 - protein, 6 aa, Cryptosporidium hominis
CRDPSL

SEQ ID NO: 2201129 - protein, 12 aa, Cryptosporidium hominis
CRQKTNRKEEKL

SEQ ID NO: 2201130 - protein, 66 aa, Cryptosporidium hominis
CSARRDSNSRKDSKSRKDSKSRRDSKSRTTSRSRSGSRSRSGSRSRSQSPKDSKEQITSTTTQHPL

SEQ ID NO: 2201131 - protein, 4 aa, Cryptosporidium hominis
CSDD

SEQ ID NO: 2201132 - protein, 4 aa, Cryptosporidium hominis
CSEP

SEQ ID NO: 2201133 - protein, 11 aa, Cryptosporidium hominis
CSESSEDVESE

SEQ ID NO: 2201134 - protein, 5 aa, Cryptosporidium hominis
CSETA

SEQ ID NO: 2201135 - protein, 5 aa, Cryptosporidium hominis
CSGRT

SEQ ID NO: 2201136 - protein, 16 aa, Cryptosporidium hominis
CSKSEEEEEVESLEGR

SEQ ID NO: 2201137 - protein, 9 aa, Cryptosporidium hominis
CSKSRYPVK

SEQ ID NO: 2201138 - protein, 4 aa, Cryptosporidium hominis
CSNG

SEQ ID NO: 2201139 - protein, 6 aa, Cryptosporidium hominis
CSNGDT

SEQ ID NO: 2201140 - protein, 14 aa, Cryptosporidium hominis
CSNQTVNIEGKNGE

SEQ ID NO: 2201141 - protein, 4 aa, Cryptosporidium hominis
CSPE

SEQ ID NO: 2201142 - protein, 5 aa, Cryptosporidium hominis
CSPPE

SEQ ID NO: 2201143 - protein, 14 aa, Cryptosporidium hominis
CSRVKGNDGSSYSM

SEQ ID NO: 2201144 - protein, 4 aa, Cryptosporidium hominis
CSSE

SEQ ID NO: 2201145 - protein, 34 aa, Cryptosporidium hominis
CSSKKEKKSKTKNKEKEVQNDETQRMDEQTPKTL

SEQ ID NO: 2201146 - protein, 5 aa, Cryptosporidium hominis
CSSQR

SEQ ID NO: 2201147 - protein, 5 aa, Cryptosporidium hominis
CTKHS

SEQ ID NO: 2201148 - protein, 18 aa, Cryptosporidium hominis
CTQTTQAPPQPECPPGTN

SEQ ID NO: 2201149 - protein, 31 aa, Cryptosporidium hominis
CTSEESQPNKKKREDLGTLDRPRGPKCKQDC

SEQ ID NO: 2201150 - protein, 8 aa, Cryptosporidium hominis
CTSSPSVS

SEQ ID NO: 2201151 - protein, 5 aa, Cryptosporidium hominis
CVEKT

SEQ ID NO: 2201152 - protein, 4 aa, Cryptosporidium hominis
DACE

SEQ ID NO: 2201153 - protein, 4 aa, Cryptosporidium hominis
DADV

SEQ ID NO: 2201154 - protein, 5 aa, Cryptosporidium hominis
DAETY

SEQ ID NO: 2201155 - protein, 7 aa, Cryptosporidium hominis
DAEYKGA

SEQ ID NO: 2201156 - protein, 10 aa, Cryptosporidium hominis
DAKCEKGSCK

SEQ ID NO: 2201157 - protein, 12 aa, Cryptosporidium hominis
DANEEDLAPEDS

SEQ ID NO: 2201158 - protein, 5 aa, Cryptosporidium hominis
DAPFG

SEQ ID NO: 2201159 - protein, 8 aa, Cryptosporidium hominis
DAPHSQKR

SEQ ID NO: 2201160 - protein, 26 aa, Cryptosporidium hominis
DASEAEARRREASDKAKLAAERATEH

SEQ ID NO: 2201161 - protein, 6 aa, Cryptosporidium hominis
DATENM

SEQ ID NO: 2201162 - protein, 9 aa, Cryptosporidium hominis
DATSESYVD

SEQ ID NO: 2201163 - protein, 7 aa, Cryptosporidium hominis
DCKTCSG

SEQ ID NO: 2201164 - protein, 7 aa, Cryptosporidium hominis
DCTSTNQ

SEQ ID NO: 2201165 - protein, 4 aa, Cryptosporidium hominis
DDAN

SEQ ID NO: 2201166 - protein, 7 aa, Cryptosporidium hominis
DDARTTI

SEQ ID NO: 2201167 - protein, 9 aa, Cryptosporidium hominis
DDCGNDGGD

SEQ ID NO: 2201168 - protein, 8 aa, Cryptosporidium hominis
DDDRNPSL

SEQ ID NO: 2201169 - protein, 33 aa, Cryptosporidium hominis
DDDYPSYNTGIAEGGVTRHQSQAARGFGGGIPG

SEQ ID NO: 2201170 - protein, 7 aa, Cryptosporidium hominis
DDEDPRD

SEQ ID NO: 2201171 - protein, 8 aa, Cryptosporidium hominis
DDEELTKH

SEQ ID NO: 2201172 - protein, 8 aa, Cryptosporidium hominis
DDETSNKK

SEQ ID NO: 2201173 - protein, 8 aa, Cryptosporidium hominis
DDGALGRL

SEQ ID NO: 2201174 - protein, 6 aa, Cryptosporidium hominis
DDGKSI

SEQ ID NO: 2201175 - protein, 13 aa, Cryptosporidium hominis
DDNNEDSNYSSNY

SEQ ID NO: 2201176 - protein, 18 aa, Cryptosporidium hominis
DDNSDKQYDFNKNDGNKH

SEQ ID NO: 2201177 - protein, 94 aa, Cryptosporidium hominis
DDPSSYPSDMPSDEPSHNPDDDEESCNDDDDDDNDDDEDELCDDEEEEEEKYQREKEKEKNEDKHDQVDSGRKRRRKRKVKKNKSKSRLRGSGK

SEQ ID NO: 2201178 - protein, 7 aa, Cryptosporidium hominis
DDPVNPE

SEQ ID NO: 2201179 - protein, 21 aa, Cryptosporidium hominis
DDQSSSRIKTTAGGLPSSSSL

SEQ ID NO: 2201180 - protein, 5 aa, Cryptosporidium hominis
DDRCN

SEQ ID NO: 2201181 - protein, 30 aa, Cryptosporidium hominis
DDSESSDSSCCSSDCSKSSDSEGEDSKSSC

SEQ ID NO: 2201182 - protein, 9 aa, Cryptosporidium hominis
DDSFTQKDL

SEQ ID NO: 2201183 - protein, 4 aa, Cryptosporidium hominis
DDSG

SEQ ID NO: 2201184 - protein, 23 aa, Cryptosporidium hominis
DDSSDEGDTNNPIDPPNANSSVS

SEQ ID NO: 2201185 - protein, 15 aa, Cryptosporidium hominis
DDSSDLGDRNDQNIP

SEQ ID NO: 2201186 - protein, 4 aa, Cryptosporidium hominis
DDTP

SEQ ID NO: 2201187 - protein, 7 aa, Cryptosporidium hominis
DDVHGSS

SEQ ID NO: 2201188 - protein, 7 aa, Cryptosporidium hominis
DDWENNL

SEQ ID NO: 2201189 - protein, 9 aa, Cryptosporidium hominis
DDYDEPSSY

SEQ ID NO: 2201190 - protein, 8 aa, Cryptosporidium hominis
DEANAKYK

SEQ ID NO: 2201191 - protein, 19 aa, Cryptosporidium hominis
DEARGDVNYSSRDKAATEN

SEQ ID NO: 2201192 - protein, 28 aa, Cryptosporidium hominis
DEASEGTIGLPSQKGDDTAEKSHEGDVS

SEQ ID NO: 2201193 - protein, 6 aa, Cryptosporidium hominis
DEDRFE

SEQ ID NO: 2201194 - protein, 5 aa, Cryptosporidium hominis
DEDYE

SEQ ID NO: 2201195 - protein, 9 aa, Cryptosporidium hominis
DEEAAKECD

SEQ ID NO: 2201196 - protein, 8 aa, Cryptosporidium hominis
DEEEDSEI

SEQ ID NO: 2201197 - protein, 6 aa, Cryptosporidium hominis
DEEPVS

SEQ ID NO: 2201198 - protein, 5 aa, Cryptosporidium hominis
DEFGQ

SEQ ID NO: 2201199 - protein, 4 aa, Cryptosporidium hominis
DEFQ

SEQ ID NO: 2201200 - protein, 45 aa, Cryptosporidium hominis
DEGKSSEGVALSDGSSGAGVYGPSVSSKYHKSSREAARKAVAPRE

SEQ ID NO: 2201201 - protein, 43 aa, Cryptosporidium hominis
DEGRGPRNIKEPFSTNAVSSSKAPYKRNPIQKTAFDNYTTRNE

SEQ ID NO: 2201202 - protein, 5 aa, Cryptosporidium hominis
DEIND

SEQ ID NO: 2201203 - protein, 19 aa, Cryptosporidium hominis
DEKQEGSASPTFPAPSEYS

SEQ ID NO: 2201204 - protein, 8 aa, Cryptosporidium hominis
DENKEDLP

SEQ ID NO: 2201205 - protein, 10 aa, Cryptosporidium hominis
DENKNSHSIN

SEQ ID NO: 2201206 - protein, 11 aa, Cryptosporidium hominis
DENLTSESTVS

SEQ ID NO: 2201207 - protein, 6 aa, Cryptosporidium hominis
DEQTDL

SEQ ID NO: 2201208 - protein, 70 aa, Cryptosporidium hominis
DESEEKTNDENKNTKSEEEIDKASSNDTTTTTSTTTSTSTASISDKDTESTTKEELGKESDNKEEEKGIK

SEQ ID NO: 2201209 - protein, 5 aa, Cryptosporidium hominis
DESKL

SEQ ID NO: 2201210 - protein, 8 aa, Cryptosporidium hominis
DESSEKCE

SEQ ID NO: 2201211 - protein, 8 aa, Cryptosporidium hominis
DESSGHTT

SEQ ID NO: 2201212 - protein, 13 aa, Cryptosporidium hominis
DESSSDPKSESMK

SEQ ID NO: 2201213 - protein, 15 aa, Cryptosporidium hominis
DETDRGERGLGSTGL

SEQ ID NO: 2201214 - protein, 4 aa, Cryptosporidium hominis
DETV

SEQ ID NO: 2201215 - protein, 10 aa, Cryptosporidium hominis
DEVSTVASEN

SEQ ID NO: 2201216 - protein, 10 aa, Cryptosporidium hominis
DFDSSDNKVT

SEQ ID NO: 2201217 - protein, 5 aa, Cryptosporidium hominis
DFETE

SEQ ID NO: 2201218 - protein, 7 aa, Cryptosporidium hominis
DFSGSSP

SEQ ID NO: 2201219 - protein, 4 aa, Cryptosporidium hominis
DFSQ

SEQ ID NO: 2201220 - protein, 6 aa, Cryptosporidium hominis
DFSSNG

SEQ ID NO: 2201221 - protein, 7 aa, Cryptosporidium hominis
DFSTPKV

SEQ ID NO: 2201222 - protein, 28 aa, Cryptosporidium hominis
DGDIEEGSSQTSTSTDQEGHSEKGDKRK

SEQ ID NO: 2201223 - protein, 4 aa, Cryptosporidium hominis
DGEM

SEQ ID NO: 2201224 - protein, 10 aa, Cryptosporidium hominis
DGGINTDSSL

SEQ ID NO: 2201225 - protein, 7 aa, Cryptosporidium hominis
DGGSKFK

SEQ ID NO: 2201226 - protein, 4 aa, Cryptosporidium hominis
DGIT

SEQ ID NO: 2201227 - protein, 8 aa, Cryptosporidium hominis
DGKMTDRT

SEQ ID NO: 2201228 - protein, 7 aa, Cryptosporidium hominis
DGNGSRV

SEQ ID NO: 2201229 - protein, 5 aa, Cryptosporidium hominis
DGNIP

SEQ ID NO: 2201230 - protein, 7 aa, Cryptosporidium hominis
DGNKITL

SEQ ID NO: 2201231 - protein, 13 aa, Cryptosporidium hominis
DGRGYAGSGDGEC

SEQ ID NO: 2201232 - protein, 14 aa, Cryptosporidium hominis
DGSEYESDPAAKAA

SEQ ID NO: 2201233 - protein, 5 aa, Cryptosporidium hominis
DGSTC

SEQ ID NO: 2201234 - protein, 4 aa, Cryptosporidium hominis
DGSY

SEQ ID NO: 2201235 - protein, 7 aa, Cryptosporidium hominis
DGSYSED

SEQ ID NO: 2201236 - protein, 17 aa, Cryptosporidium hominis
DGTTVVTSGRGSKKLGD

SEQ ID NO: 2201237 - protein, 22 aa, Cryptosporidium hominis
DGYSPTEAIKQKESLNSKTTIV

SEQ ID NO: 2201238 - protein, 20 aa, Cryptosporidium hominis
DHEEEKDEENKNEDSDIQEL

SEQ ID NO: 2201239 - protein, 12 aa, Cryptosporidium hominis
DHETFKDSNAKS

SEQ ID NO: 2201240 - protein, 13 aa, Cryptosporidium hominis
DHGSHGTHKPRRR

SEQ ID NO: 2201241 - protein, 19 aa, Cryptosporidium hominis
DHKQAEGNNQESQKASEKV

SEQ ID NO: 2201242 - protein, 9 aa, Cryptosporidium hominis
DHPNRGDSA

SEQ ID NO: 2201243 - protein, 4 aa, Cryptosporidium hominis
DHSN

SEQ ID NO: 2201244 - protein, 5 aa, Cryptosporidium hominis
DHVEA

SEQ ID NO: 2201245 - protein, 22 aa, Cryptosporidium hominis
DIEEARAASQGKTAEMRSQYKR

SEQ ID NO: 2201246 - protein, 11 aa, Cryptosporidium hominis
DIENDKKIDET

SEQ ID NO: 2201247 - protein, 6 aa, Cryptosporidium hominis
DIETYD

SEQ ID NO: 2201248 - protein, 22 aa, Cryptosporidium hominis
DIKDSPQGSENVNVEIVNGGVD

SEQ ID NO: 2201249 - protein, 26 aa, Cryptosporidium hominis
DINQRKGRSSSASSVDSKRSGNEKNG

SEQ ID NO: 2201250 - protein, 4 aa, Cryptosporidium hominis
DIPA

SEQ ID NO: 2201251 - protein, 49 aa, Cryptosporidium hominis
DIQSSAESDQKEEEIPSKEQKGKENDIEKETEGINSTGNDSNHLNQGQI

SEQ ID NO: 2201252 - protein, 7 aa, Cryptosporidium hominis
DISENSA

SEQ ID NO: 2201253 - protein, 12 aa, Cryptosporidium hominis
DISPTNQFSTPD

SEQ ID NO: 2201254 - protein, 6 aa, Cryptosporidium hominis
DISSSD

SEQ ID NO: 2201255 - protein, 6 aa, Cryptosporidium hominis
DITGGP

SEQ ID NO: 2201256 - protein, 7 aa, Cryptosporidium hominis
DKCPGYK

SEQ ID NO: 2201257 - protein, 13 aa, Cryptosporidium hominis
DKDEEGVDCGGPC

SEQ ID NO: 2201258 - protein, 9 aa, Cryptosporidium hominis
DKDQRENDK

SEQ ID NO: 2201259 - protein, 4 aa, Cryptosporidium hominis
DKDT

SEQ ID NO: 2201260 - protein, 6 aa, Cryptosporidium hominis
DKEESK

SEQ ID NO: 2201261 - protein, 8 aa, Cryptosporidium hominis
DKETSDNI

SEQ ID NO: 2201262 - protein, 15 aa, Cryptosporidium hominis
DKGDCNSKKNDSPLD

SEQ ID NO: 2201263 - protein, 4 aa, Cryptosporidium hominis
DKGI

SEQ ID NO: 2201264 - protein, 95 aa, Cryptosporidium hominis
DKGQEAGKSESTNRAQSDKDEEVESSVGSNLSETDEETSRYENSKSEESGSSGTDRYYETEDSTDNSQNTDDLQDQSTSESQDDSSEQSESSGEH

SEQ ID NO: 2201265 - protein, 7 aa, Cryptosporidium hominis
DKIQGSY

SEQ ID NO: 2201266 - protein, 18 aa, Cryptosporidium hominis
DKKEKKKEKEEKKRLEIE

SEQ ID NO: 2201267 - protein, 9 aa, Cryptosporidium hominis
DKKKGETVL

SEQ ID NO: 2201268 - protein, 9 aa, Cryptosporidium hominis
DKKPKPKKK

SEQ ID NO: 2201269 - protein, 8 aa, Cryptosporidium hominis
DKKRNTAY

SEQ ID NO: 2201270 - protein, 8 aa, Cryptosporidium hominis
DKKTLQSL

SEQ ID NO: 2201271 - protein, 12 aa, Cryptosporidium hominis
DKLADSEGLAPV

SEQ ID NO: 2201272 - protein, 6 aa, Cryptosporidium hominis
DKLDGS

SEQ ID NO: 2201273 - protein, 9 aa, Cryptosporidium hominis
DKLQGKNNL

SEQ ID NO: 2201274 - protein, 7 aa, Cryptosporidium hominis
DKNGNEV

SEQ ID NO: 2201275 - protein, 5 aa, Cryptosporidium hominis
DKNGS

SEQ ID NO: 2201276 - protein, 9 aa, Cryptosporidium hominis
DKPDPEVPP

SEQ ID NO: 2201277 - protein, 6 aa, Cryptosporidium hominis
DKQDQI

SEQ ID NO: 2201278 - protein, 8 aa, Cryptosporidium hominis
DKQKEVAD

SEQ ID NO: 2201279 - protein, 7 aa, Cryptosporidium hominis
DKQKKGI

SEQ ID NO: 2201280 - protein, 4 aa, Cryptosporidium hominis
DKRG

SEQ ID NO: 2201281 - protein, 8 aa, Cryptosporidium hominis
DKRGSSIF

SEQ ID NO: 2201282 - protein, 9 aa, Cryptosporidium hominis
DKSASNKIT

SEQ ID NO: 2201283 - protein, 7 aa, Cryptosporidium hominis
DKSFETQ

SEQ ID NO: 2201284 - protein, 6 aa, Cryptosporidium hominis
DKSSRK

SEQ ID NO: 2201285 - protein, 29 aa, Cryptosporidium hominis
DKSVGGFDEQGNNNDFPEIEDNQRDFSSV

SEQ ID NO: 2201286 - protein, 29 aa, Cryptosporidium hominis
DKSVSNKETKDVSINKSETISQVGKSEEI

SEQ ID NO: 2201287 - protein, 20 aa, Cryptosporidium hominis
DLDTTTEDGIYSKSSRTVER

SEQ ID NO: 2201288 - protein, 21 aa, Cryptosporidium hominis
DLEEKQRNSPGTDEDEARAFS

SEQ ID NO: 2201289 - protein, 55 aa, Cryptosporidium hominis
DLGSEKVPESKKPESKKPESKKPESRKPESKKPESKSSSCNCSSGRCAKSSCTGS

SEQ ID NO: 2201290 - protein, 7 aa, Cryptosporidium hominis
DLKGSKY

SEQ ID NO: 2201291 - protein, 4 aa, Cryptosporidium hominis
DLND

SEQ ID NO: 2201292 - protein, 45 aa, Cryptosporidium hominis
DLNEGSRSSIAKDVENEDSAKHKPSTVSNEENHYDASYESNLEEM

SEQ ID NO: 2201293 - protein, 6 aa, Cryptosporidium hominis
DLNTTR

SEQ ID NO: 2201294 - protein, 9 aa, Cryptosporidium hominis
DLPKPSYLE

SEQ ID NO: 2201295 - protein, 6 aa, Cryptosporidium hominis
DLPSES

SEQ ID NO: 2201296 - protein, 8 aa, Cryptosporidium hominis
DLQGDPNT

SEQ ID NO: 2201297 - protein, 9 aa, Cryptosporidium hominis
DLRKNPSTF

SEQ ID NO: 2201298 - protein, 16 aa, Cryptosporidium hominis
DLSEHSKDNSADSSIS

SEQ ID NO: 2201299 - protein, 5 aa, Cryptosporidium hominis
DLTDE

SEQ ID NO: 2201300 - protein, 27 aa, Cryptosporidium hominis
DLTEEKEKAIKEEKDKEKKGKIPKGEV

SEQ ID NO: 2201301 - protein, 18 aa, Cryptosporidium hominis
DLYNDESHALSSQLGQEQ

SEQ ID NO: 2201302 - protein, 12 aa, Cryptosporidium hominis
DMDTSGYEPLDA

SEQ ID NO: 2201303 - protein, 8 aa, Cryptosporidium hominis
DMNGPPDR

SEQ ID NO: 2201304 - protein, 20 aa, Cryptosporidium hominis
DMSKSQSQGDLSTSVGGIAP

SEQ ID NO: 2201305 - protein, 7 aa, Cryptosporidium hominis
DMSRSPY

SEQ ID NO: 2201306 - protein, 14 aa, Cryptosporidium hominis
DMSSDDDSELSSVE

SEQ ID NO: 2201307 - protein, 10 aa, Cryptosporidium hominis
DNASISSAST

SEQ ID NO: 2201308 - protein, 5 aa, Cryptosporidium hominis
DNAYG

SEQ ID NO: 2201309 - protein, 13 aa, Cryptosporidium hominis
DNDQDGLVDATQN

SEQ ID NO: 2201310 - protein, 8 aa, Cryptosporidium hominis
DNDVTQRK

SEQ ID NO: 2201311 - protein, 5 aa, Cryptosporidium hominis
DNEAP

SEQ ID NO: 2201312 - protein, 7 aa, Cryptosporidium hominis
DNETELV

SEQ ID NO: 2201313 - protein, 5 aa, Cryptosporidium hominis
DNFGE

SEQ ID NO: 2201314 - protein, 11 aa, Cryptosporidium hominis
DNGNCNEKKTK

SEQ ID NO: 2201315 - protein, 4 aa, Cryptosporidium hominis
DNGS

SEQ ID NO: 2201316 - protein, 4 aa, Cryptosporidium hominis
DNKT

SEQ ID NO: 2201317 - protein, 6 aa, Cryptosporidium hominis
DNNENI

SEQ ID NO: 2201318 - protein, 8 aa, Cryptosporidium hominis
DNNHKKAI

SEQ ID NO: 2201319 - protein, 18 aa, Cryptosporidium hominis
DNNSGDLLSNKNKDNESG

SEQ ID NO: 2201320 - protein, 6 aa, Cryptosporidium hominis
DNNSNC

SEQ ID NO: 2201321 - protein, 31 aa, Cryptosporidium hominis
DNNSSTSSESSEASSNNSSVPSSEQNRDQSE

SEQ ID NO: 2201322 - protein, 4 aa, Cryptosporidium hominis
DNNT

SEQ ID NO: 2201323 - protein, 9 aa, Cryptosporidium hominis
DNPDPSNYK

SEQ ID NO: 2201324 - protein, 7 aa, Cryptosporidium hominis
DNPPREK

SEQ ID NO: 2201325 - protein, 16 aa, Cryptosporidium hominis
DNPTQKYTTDKSIPPT

SEQ ID NO: 2201326 - protein, 6 aa, Cryptosporidium hominis
DNPYEE

SEQ ID NO: 2201327 - protein, 10 aa, Cryptosporidium hominis
DNRGSADSSM

SEQ ID NO: 2201328 - protein, 11 aa, Cryptosporidium hominis
DNSGIGSKENL

SEQ ID NO: 2201329 - protein, 9 aa, Cryptosporidium hominis
DNSKAREEK

SEQ ID NO: 2201330 - protein, 5 aa, Cryptosporidium hominis
DNSNS

SEQ ID NO: 2201331 - protein, 11 aa, Cryptosporidium hominis
DNSPENTKLKE

SEQ ID NO: 2201332 - protein, 4 aa, Cryptosporidium hominis
DNSS

SEQ ID NO: 2201333 - protein, 27 aa, Cryptosporidium hominis
DNTSNNDSTSNAQNESSEFTESTETTG

SEQ ID NO: 2201334 - protein, 5 aa, Cryptosporidium hominis
DNTSR

SEQ ID NO: 2201335 - protein, 9 aa, Cryptosporidium hominis
DNTWTENSQ

SEQ ID NO: 2201336 - protein, 8 aa, Cryptosporidium hominis
DPASTSFT

SEQ ID NO: 2201337 - protein, 4 aa, Cryptosporidium hominis
DPDY

SEQ ID NO: 2201338 - protein, 7 aa, Cryptosporidium hominis
DPENGKV

SEQ ID NO: 2201339 - protein, 47 aa, Cryptosporidium hominis
DPENPASESNSNIPITSTPSLKAKREAASDVNASNLRKSYRPEQSKS

SEQ ID NO: 2201340 - protein, 9 aa, Cryptosporidium hominis
DPEQETKER

SEQ ID NO: 2201341 - protein, 24 aa, Cryptosporidium hominis
DPETSEEAVNRNQSNTSDKYSSKC

SEQ ID NO: 2201342 - protein, 6 aa, Cryptosporidium hominis
DPFSGR

SEQ ID NO: 2201343 - protein, 7 aa, Cryptosporidium hominis
DPFTDEK

SEQ ID NO: 2201344 - protein, 9 aa, Cryptosporidium hominis
DPINENNDD

SEQ ID NO: 2201345 - protein, 18 aa, Cryptosporidium hominis
DPKKSNEEYYQNDANNQQ

SEQ ID NO: 2201346 - protein, 5 aa, Cryptosporidium hominis
DPMTN

SEQ ID NO: 2201347 - protein, 12 aa, Cryptosporidium hominis
DPNNKDTTGGNS

SEQ ID NO: 2201348 - protein, 14 aa, Cryptosporidium hominis
DPNTEYNDFDSPVR

SEQ ID NO: 2201349 - protein, 15 aa, Cryptosporidium hominis
DPPMSSSSSGSTNSL

SEQ ID NO: 2201350 - protein, 16 aa, Cryptosporidium hominis
DPPMSSSSSGSTSSSL

SEQ ID NO: 2201351 - protein, 5 aa, Cryptosporidium hominis
DPQIK

SEQ ID NO: 2201352 - protein, 15 aa, Cryptosporidium hominis
DPQNNRNQVDSNDNT

SEQ ID NO: 2201353 - protein, 87 aa, Cryptosporidium hominis
DPRGGAKQKVKTKTDTSKNDNRRNSRRRSRSPSPKPCTSSGAQTGSSSRSSSPRPCTSSGVQTGSSFRSHSPRPRVSSRSQAGSSLR

SEQ ID NO: 2201354 - protein, 4 aa, Cryptosporidium hominis
DPSD

SEQ ID NO: 2201355 - protein, 6 aa, Cryptosporidium hominis
DPSPTY

SEQ ID NO: 2201356 - protein, 9 aa, Cryptosporidium hominis
DPSSPIQYE

SEQ ID NO: 2201357 - protein, 4 aa, Cryptosporidium hominis
DPTC

SEQ ID NO: 2201358 - protein, 15 aa, Cryptosporidium hominis
DPTDGSYDPFSPSIN

SEQ ID NO: 2201359 - protein, 5 aa, Cryptosporidium hominis
DPVPD

SEQ ID NO: 2201360 - protein, 6 aa, Cryptosporidium hominis
DPYAAD

SEQ ID NO: 2201361 - protein, 6 aa, Cryptosporidium hominis
DQDYSN

SEQ ID NO: 2201362 - protein, 5 aa, Cryptosporidium hominis
DQGSE

SEQ ID NO: 2201363 - protein, 8 aa, Cryptosporidium hominis
DQISPGAA

SEQ ID NO: 2201364 - protein, 8 aa, Cryptosporidium hominis
DQNPPSSE

SEQ ID NO: 2201365 - protein, 4 aa, Cryptosporidium hominis
DQRI

SEQ ID NO: 2201366 - protein, 6 aa, Cryptosporidium hominis
DQSDMA

SEQ ID NO: 2201367 - protein, 6 aa, Cryptosporidium hominis
DQSQMD

SEQ ID NO: 2201368 - protein, 7 aa, Cryptosporidium hominis
DRAPQNL

SEQ ID NO: 2201369 - protein, 5 aa, Cryptosporidium hominis
DREFD

SEQ ID NO: 2201370 - protein, 18 aa, Cryptosporidium hominis
DREQNQSESSDSNSIGSN

SEQ ID NO: 2201371 - protein, 21 aa, Cryptosporidium hominis
DRFSQNANSLSDSNDQRVESK

SEQ ID NO: 2201372 - protein, 10 aa, Cryptosporidium hominis
DRGDNTGASI

SEQ ID NO: 2201373 - protein, 4 aa, Cryptosporidium hominis
DRGS

SEQ ID NO: 2201374 - protein, 8 aa, Cryptosporidium hominis
DRPDPEIY

SEQ ID NO: 2201375 - protein, 14 aa, Cryptosporidium hominis
DRPHESISENLGEQ

SEQ ID NO: 2201376 - protein, 4 aa, Cryptosporidium hominis
DRRR

SEQ ID NO: 2201377 - protein, 33 aa, Cryptosporidium hominis
DRTSKIPKSYDLSTNKGSSCPQDCSDTQQTSQK

SEQ ID NO: 2201378 - protein, 4 aa, Cryptosporidium hominis
DRVS

SEQ ID NO: 2201379 - protein, 20 aa, Cryptosporidium hominis
DRYGSSPDKPLKKVVWWMAD

SEQ ID NO: 2201380 - protein, 7 aa, Cryptosporidium hominis
DRYPPSI

SEQ ID NO: 2201381 - protein, 6 aa, Cryptosporidium hominis
DSDDIH

SEQ ID NO: 2201382 - protein, 17 aa, Cryptosporidium hominis
DSDFDKNSLSKAKLNPT

SEQ ID NO: 2201383 - protein, 14 aa, Cryptosporidium hominis
DSDKHDSMNTQPKE

SEQ ID NO: 2201384 - protein, 5 aa, Cryptosporidium hominis
DSDNP

SEQ ID NO: 2201385 - protein, 11 aa, Cryptosporidium hominis
DSDQQDSRSSM

SEQ ID NO: 2201386 - protein, 10 aa, Cryptosporidium hominis
DSDRKYKAAD

SEQ ID NO: 2201387 - protein, 21 aa, Cryptosporidium hominis
DSDSDEISEVNQTQKKQSLKD

SEQ ID NO: 2201388 - protein, 10 aa, Cryptosporidium hominis
DSEEFTDEEE

SEQ ID NO: 2201389 - protein, 9 aa, Cryptosporidium hominis
DSEGNPYVD

SEQ ID NO: 2201390 - protein, 4 aa, Cryptosporidium hominis
DSEL

SEQ ID NO: 2201391 - protein, 5 aa, Cryptosporidium hominis
DSESD

SEQ ID NO: 2201392 - protein, 7 aa, Cryptosporidium hominis
DSETNNS

SEQ ID NO: 2201393 - protein, 6 aa, Cryptosporidium hominis
DSEVEV

SEQ ID NO: 2201394 - protein, 4 aa, Cryptosporidium hominis
DSGD

SEQ ID NO: 2201395 - protein, 7 aa, Cryptosporidium hominis
DSGPFET

SEQ ID NO: 2201396 - protein, 13 aa, Cryptosporidium hominis
DSIKPTPSCPPEY

SEQ ID NO: 2201397 - protein, 6 aa, Cryptosporidium hominis
DSIQTQ

SEQ ID NO: 2201398 - protein, 9 aa, Cryptosporidium hominis
DSKGSEMVK

SEQ ID NO: 2201399 - protein, 11 aa, Cryptosporidium hominis
DSKNDGNEDSL

SEQ ID NO: 2201400 - protein, 7 aa, Cryptosporidium hominis
DSKYSNL

SEQ ID NO: 2201401 - protein, 9 aa, Cryptosporidium hominis
DSLNSSSEH

SEQ ID NO: 2201402 - protein, 13 aa, Cryptosporidium hominis
DSLSEKNDQKKSE

SEQ ID NO: 2201403 - protein, 12 aa, Cryptosporidium hominis
DSNATSNVSEDE

SEQ ID NO: 2201404 - protein, 11 aa, Cryptosporidium hominis
DSNGGAVSYDS

SEQ ID NO: 2201405 - protein, 12 aa, Cryptosporidium hominis
DSNLDSQNPIQD

SEQ ID NO: 2201406 - protein, 5 aa, Cryptosporidium hominis
DSNLT

SEQ ID NO: 2201407 - protein, 6 aa, Cryptosporidium hominis
DSNQEC

SEQ ID NO: 2201408 - protein, 12 aa, Cryptosporidium hominis
DSNRRKKMEENR

SEQ ID NO: 2201409 - protein, 14 aa, Cryptosporidium hominis
DSNTDSDVDANKTD

SEQ ID NO: 2201410 - protein, 6 aa, Cryptosporidium hominis
DSPEAE

SEQ ID NO: 2201411 - protein, 6 aa, Cryptosporidium hominis
DSPFRS

SEQ ID NO: 2201412 - protein, 6 aa, Cryptosporidium hominis
DSPRDP

SEQ ID NO: 2201413 - protein, 6 aa, Cryptosporidium hominis
DSPVSI

SEQ ID NO: 2201414 - protein, 8 aa, Cryptosporidium hominis
DSQPKLRS

SEQ ID NO: 2201415 - protein, 7 aa, Cryptosporidium hominis
DSRIPSF

SEQ ID NO: 2201416 - protein, 9 aa, Cryptosporidium hominis
DSSDSEREK

SEQ ID NO: 2201417 - protein, 11 aa, Cryptosporidium hominis
DSSDSGSKGHK

SEQ ID NO: 2201418 - protein, 15 aa, Cryptosporidium hominis
DSSEQNELPENDDVF

SEQ ID NO: 2201419 - protein, 10 aa, Cryptosporidium hominis
DSSESSSGML

SEQ ID NO: 2201420 - protein, 6 aa, Cryptosporidium hominis
DSSFTS

SEQ ID NO: 2201421 - protein, 26 aa, Cryptosporidium hominis
DSSGSDSDSDSDSDSDSNSDGEIRDA

SEQ ID NO: 2201422 - protein, 12 aa, Cryptosporidium hominis
DSSIIGQKEYDG

SEQ ID NO: 2201423 - protein, 7 aa, Cryptosporidium hominis
DSSKGDL

SEQ ID NO: 2201424 - protein, 5 aa, Cryptosporidium hominis
DSSKI

SEQ ID NO: 2201425 - protein, 7 aa, Cryptosporidium hominis
DSSQGKP

SEQ ID NO: 2201426 - protein, 9 aa, Cryptosporidium hominis
DSSQTDSNE

SEQ ID NO: 2201427 - protein, 7 aa, Cryptosporidium hominis
DSSQYYK

SEQ ID NO: 2201428 - protein, 8 aa, Cryptosporidium hominis
DSSSIDLN

SEQ ID NO: 2201429 - protein, 8 aa, Cryptosporidium hominis
DSSSPNIE

SEQ ID NO: 2201430 - protein, 12 aa, Cryptosporidium hominis
DSTGNLASSGRL

SEQ ID NO: 2201431 - protein, 10 aa, Cryptosporidium hominis
DSTKKPFEQI

SEQ ID NO: 2201432 - protein, 4 aa, Cryptosporidium hominis
DSTL

SEQ ID NO: 2201433 - protein, 19 aa, Cryptosporidium hominis
DSTNKKNPNSNLEDGQVGR

SEQ ID NO: 2201434 - protein, 9 aa, Cryptosporidium hominis
DSTSKRSAA

SEQ ID NO: 2201435 - protein, 35 aa, Cryptosporidium hominis
DSTTDTSKEDVGEAQTSASSYASQEVSSKAKEQVC

SEQ ID NO: 2201436 - protein, 6 aa, Cryptosporidium hominis
DSVDNA

SEQ ID NO: 2201437 - protein, 6 aa, Cryptosporidium hominis
DSVYES

SEQ ID NO: 2201438 - protein, 11 aa, Cryptosporidium hominis
DSYAENSTKEY

SEQ ID NO: 2201439 - protein, 14 aa, Cryptosporidium hominis
DSYPTSNSQFYPPP

SEQ ID NO: 2201440 - protein, 8 aa, Cryptosporidium hominis
DTEDEDSR

SEQ ID NO: 2201441 - protein, 4 aa, Cryptosporidium hominis
DTEL

SEQ ID NO: 2201442 - protein, 4 aa, Cryptosporidium hominis
DTEM

SEQ ID NO: 2201443 - protein, 5 aa, Cryptosporidium hominis
DTENE

SEQ ID NO: 2201444 - protein, 4 aa, Cryptosporidium hominis
DTGG

SEQ ID NO: 2201445 - protein, 10 aa, Cryptosporidium hominis
DTGISSGEWG

SEQ ID NO: 2201446 - protein, 15 aa, Cryptosporidium hominis
DTKSKQSELKPTDSP

SEQ ID NO: 2201447 - protein, 15 aa, Cryptosporidium hominis
DTPDLEEKSDEIDHK

SEQ ID NO: 2201448 - protein, 8 aa, Cryptosporidium hominis
DTSESKLP

SEQ ID NO: 2201449 - protein, 7 aa, Cryptosporidium hominis
DTSSRED

SEQ ID NO: 2201450 - protein, 7 aa, Cryptosporidium hominis
DTSTQEY

SEQ ID NO: 2201451 - protein, 7 aa, Cryptosporidium hominis
DTTNENL

SEQ ID NO: 2201452 - protein, 20 aa, Cryptosporidium hominis
DTTTDLSDTNQENPSENVPV

SEQ ID NO: 2201453 - protein, 4 aa, Cryptosporidium hominis
DVEG

SEQ ID NO: 2201454 - protein, 11 aa, Cryptosporidium hominis
DVGSESSIDLG

SEQ ID NO: 2201455 - protein, 8 aa, Cryptosporidium hominis
DVKPDDIN

SEQ ID NO: 2201456 - protein, 12 aa, Cryptosporidium hominis
DVPPEQDTGNNP

SEQ ID NO: 2201457 - protein, 29 aa, Cryptosporidium hominis
DVPQPPKVGTDDAEGDQANVKELSPTVGE

SEQ ID NO: 2201458 - protein, 32 aa, Cryptosporidium hominis
DVTNSRLSGKTSGNKGSNKTKESSKKSRKSSV

SEQ ID NO: 2201459 - protein, 12 aa, Cryptosporidium hominis
DWPSPDSNSPKN

SEQ ID NO: 2201460 - protein, 5 aa, Cryptosporidium hominis
DYDTG

SEQ ID NO: 2201461 - protein, 4 aa, Cryptosporidium hominis
DYGR

SEQ ID NO: 2201462 - protein, 5 aa, Cryptosporidium hominis
DYNNQ

SEQ ID NO: 2201463 - protein, 5 aa, Cryptosporidium hominis
DYPSQ

SEQ ID NO: 2201464 - protein, 7 aa, Cryptosporidium hominis
DYSGERG

SEQ ID NO: 2201465 - protein, 9 aa, Cryptosporidium hominis
DYSRPDPPQ

SEQ ID NO: 2201466 - protein, 12 aa, Cryptosporidium hominis
EAAGTGSPSAIG

SEQ ID NO: 2201467 - protein, 10 aa, Cryptosporidium hominis
EAAKARPHST

SEQ ID NO: 2201468 - protein, 11 aa, Cryptosporidium hominis
EADASNPLTRN

SEQ ID NO: 2201469 - protein, 8 aa, Cryptosporidium hominis
EADEKTIR

SEQ ID NO: 2201470 - protein, 5 aa, Cryptosporidium hominis
EAEIS

SEQ ID NO: 2201471 - protein, 8 aa, Cryptosporidium hominis
EAEKDVDE

SEQ ID NO: 2201472 - protein, 9 aa, Cryptosporidium hominis
EAIENEKKA

SEQ ID NO: 2201473 - protein, 7 aa, Cryptosporidium hominis
EAIRRPK

SEQ ID NO: 2201474 - protein, 9 aa, Cryptosporidium hominis
EAITTSNGT

SEQ ID NO: 2201475 - protein, 6 aa, Cryptosporidium hominis
EAKSNI

SEQ ID NO: 2201476 - protein, 12 aa, Cryptosporidium hominis
EANNRRKKNQSF

SEQ ID NO: 2201477 - protein, 17 aa, Cryptosporidium hominis
EAPGSFSIQTSGAQAFT

SEQ ID NO: 2201478 - protein, 5 aa, Cryptosporidium hominis
EAQES

SEQ ID NO: 2201479 - protein, 6 aa, Cryptosporidium hominis
EARKPG

SEQ ID NO: 2201480 - protein, 22 aa, Cryptosporidium hominis
EASEDNDQAEQKISPDSQIRDE

SEQ ID NO: 2201481 - protein, 33 aa, Cryptosporidium hominis
EASEGPIEPLGKDDLNGEESIRYNENDNNSIPN

SEQ ID NO: 2201482 - protein, 10 aa, Cryptosporidium hominis
EASKPANPPY

SEQ ID NO: 2201483 - protein, 37 aa, Cryptosporidium hominis
EASMPSNNQEKIKSDGEYSGSEHSEKSKTSQKEEVSG

SEQ ID NO: 2201484 - protein, 37 aa, Cryptosporidium hominis
EASNADEGSARGKDSTHKKRTSKKKHLQSSPHGPQPQ

SEQ ID NO: 2201485 - protein, 14 aa, Cryptosporidium hominis
EASSTQQKKEPKSV

SEQ ID NO: 2201486 - protein, 7 aa, Cryptosporidium hominis
EATEGKG

SEQ ID NO: 2201487 - protein, 9 aa, Cryptosporidium hominis
EAVPESKKL

SEQ ID NO: 2201488 - protein, 6 aa, Cryptosporidium hominis
EAYNSG

SEQ ID NO: 2201489 - protein, 14 aa, Cryptosporidium hominis
ECENEQNGNEIETK

SEQ ID NO: 2201490 - protein, 7 aa, Cryptosporidium hominis
ECMSGTP

SEQ ID NO: 2201491 - protein, 9 aa, Cryptosporidium hominis
ECQPTKEQT

SEQ ID NO: 2201492 - protein, 7 aa, Cryptosporidium hominis
ECQSGSP

SEQ ID NO: 2201493 - protein, 9 aa, Cryptosporidium hominis
ECSNGDSKC

SEQ ID NO: 2201494 - protein, 9 aa, Cryptosporidium hominis
EDCNNENCD

SEQ ID NO: 2201495 - protein, 7 aa, Cryptosporidium hominis
EDDTVPN

SEQ ID NO: 2201496 - protein, 16 aa, Cryptosporidium hominis
EDDVTPHTGRKGLTQE

SEQ ID NO: 2201497 - protein, 5 aa, Cryptosporidium hominis
EDEST

SEQ ID NO: 2201498 - protein, 6 aa, Cryptosporidium hominis
EDGERC

SEQ ID NO: 2201499 - protein, 4 aa, Cryptosporidium hominis
EDGG

SEQ ID NO: 2201500 - protein, 17 aa, Cryptosporidium hominis
EDGIKSEEENNKEAELE

SEQ ID NO: 2201501 - protein, 19 aa, Cryptosporidium hominis
EDIDSETQSEESEDENEDE

SEQ ID NO: 2201502 - protein, 10 aa, Cryptosporidium hominis
EDITSNEEEY

SEQ ID NO: 2201503 - protein, 5 aa, Cryptosporidium hominis
EDKME

SEQ ID NO: 2201504 - protein, 8 aa, Cryptosporidium hominis
EDPKVNSK

SEQ ID NO: 2201505 - protein, 7 aa, Cryptosporidium hominis
EDPRGQI

SEQ ID NO: 2201506 - protein, 8 aa, Cryptosporidium hominis
EDPTGAQY

SEQ ID NO: 2201507 - protein, 5 aa, Cryptosporidium hominis
EDRSL

SEQ ID NO: 2201508 - protein, 7 aa, Cryptosporidium hominis
EDSETSC

SEQ ID NO: 2201509 - protein, 11 aa, Cryptosporidium hominis
EDSSNKRNIGR

SEQ ID NO: 2201510 - protein, 4 aa, Cryptosporidium hominis
EDST

SEQ ID NO: 2201511 - protein, 22 aa, Cryptosporidium hominis
EDTDDSKEGSEASTADLEDRTT

SEQ ID NO: 2201512 - protein, 61 aa, Cryptosporidium hominis
EDTEYEVNKNEEDEPRMKEPDTQLDDTAPSPSRTSSYERSSITGENTGPTDMKTSTFDMSA

SEQ ID NO: 2201513 - protein, 5 aa, Cryptosporidium hominis
EDTKS

SEQ ID NO: 2201514 - protein, 6 aa, Cryptosporidium hominis
EDTPGH

SEQ ID NO: 2201515 - protein, 8 aa, Cryptosporidium hominis
EDTSTDEE

SEQ ID NO: 2201516 - protein, 6 aa, Cryptosporidium hominis
EDYIGS

SEQ ID NO: 2201517 - protein, 23 aa, Cryptosporidium hominis
EDYQTKDMDGESQSNENEQQTDL

SEQ ID NO: 2201518 - protein, 11 aa, Cryptosporidium hominis
EDYSPEKSIKQ

SEQ ID NO: 2201519 - protein, 10 aa, Cryptosporidium hominis
EDYTDGPIEE

SEQ ID NO: 2201520 - protein, 17 aa, Cryptosporidium hominis
EEAKLKQKKVEAERAEL

SEQ ID NO: 2201521 - protein, 4 aa, Cryptosporidium hominis
EECP

SEQ ID NO: 2201522 - protein, 12 aa, Cryptosporidium hominis
EEDDGVNDETEY

SEQ ID NO: 2201523 - protein, 11 aa, Cryptosporidium hominis
EEDRNKNLESV

SEQ ID NO: 2201524 - protein, 13 aa, Cryptosporidium hominis
EEEEEEEETERSL

SEQ ID NO: 2201525 - protein, 40 aa, Cryptosporidium hominis
EEEEVSKSISNTSENEEHSYSSENGEETRAYGKNSSAGVS

SEQ ID NO: 2201526 - protein, 11 aa, Cryptosporidium hominis
EEEGPSDEVSP

SEQ ID NO: 2201527 - protein, 10 aa, Cryptosporidium hominis
EEEKSLKREE

SEQ ID NO: 2201528 - protein, 4 aa, Cryptosporidium hominis
EEEL

SEQ ID NO: 2201529 - protein, 6 aa, Cryptosporidium hominis
EEEREE

SEQ ID NO: 2201530 - protein, 9 aa, Cryptosporidium hominis
EEESHSAAI

SEQ ID NO: 2201531 - protein, 5 aa, Cryptosporidium hominis
EEEYS

SEQ ID NO: 2201532 - protein, 32 aa, Cryptosporidium hominis
EEFKENQKKLEEKDPEEQGKAIDTPEKAEEDK

SEQ ID NO: 2201533 - protein, 6 aa, Cryptosporidium hominis
EEFSSN

SEQ ID NO: 2201534 - protein, 5 aa, Cryptosporidium hominis
EEFTT

SEQ ID NO: 2201535 - protein, 11 aa, Cryptosporidium hominis
EEGNETGGPTI

SEQ ID NO: 2201536 - protein, 22 aa, Cryptosporidium hominis
EEGTQIKTNNGHEYKVNSGSVG

SEQ ID NO: 2201537 - protein, 6 aa, Cryptosporidium hominis
EEHTDI

SEQ ID NO: 2201538 - protein, 5 aa, Cryptosporidium hominis
EEIGI

SEQ ID NO: 2201539 - protein, 7 aa, Cryptosporidium hominis
EEIPNEA

SEQ ID NO: 2201540 - protein, 12 aa, Cryptosporidium hominis
EEIQGYKKEQQA

SEQ ID NO: 2201541 - protein, 4 aa, Cryptosporidium hominis
EEIT

SEQ ID NO: 2201542 - protein, 11 aa, Cryptosporidium hominis
EEKGEKRSKLK

SEQ ID NO: 2201543 - protein, 9 aa, Cryptosporidium hominis
EEKKIRNEL

SEQ ID NO: 2201544 - protein, 9 aa, Cryptosporidium hominis
EEKSQEKYS

SEQ ID NO: 2201545 - protein, 17 aa, Cryptosporidium hominis
EELNADETNSSRSNGLG

SEQ ID NO: 2201546 - protein, 7 aa, Cryptosporidium hominis
EELTPAT

SEQ ID NO: 2201547 - protein, 4 aa, Cryptosporidium hominis
EEND

SEQ ID NO: 2201548 - protein, 14 aa, Cryptosporidium hominis
EENKNSDHSVGNGI

SEQ ID NO: 2201549 - protein, 6 aa, Cryptosporidium hominis
EENKSE

SEQ ID NO: 2201550 - protein, 4 aa, Cryptosporidium hominis
EENS

SEQ ID NO: 2201551 - protein, 8 aa, Cryptosporidium hominis
EEPRELKR

SEQ ID NO: 2201552 - protein, 8 aa, Cryptosporidium hominis
EEQKLSSI

SEQ ID NO: 2201553 - protein, 10 aa, Cryptosporidium hominis
EEQKSLQREE

SEQ ID NO: 2201554 - protein, 17 aa, Cryptosporidium hominis
EERKRVGAGLDREEVRR

SEQ ID NO: 2201555 - protein, 7 aa, Cryptosporidium hominis
EERLKQE

SEQ ID NO: 2201556 - protein, 5 aa, Cryptosporidium hominis
EESPD

SEQ ID NO: 2201557 - protein, 6 aa, Cryptosporidium hominis
EESPKE

SEQ ID NO: 2201558 - protein, 7 aa, Cryptosporidium hominis
EESRMTE

SEQ ID NO: 2201559 - protein, 5 aa, Cryptosporidium hominis
EESSM

SEQ ID NO: 2201560 - protein, 4 aa, Cryptosporidium hominis
EETL

SEQ ID NO: 2201561 - protein, 6 aa, Cryptosporidium hominis
EETRKR

SEQ ID NO: 2201562 - protein, 44 aa, Cryptosporidium hominis
EETTAGSGTGQCTGNGLKEPSNRDGCLGGRPSNSISPSLPRAPS

SEQ ID NO: 2201563 - protein, 4 aa, Cryptosporidium hominis
EEVD

SEQ ID NO: 2201564 - protein, 5 aa, Cryptosporidium hominis
EEVET

SEQ ID NO: 2201565 - protein, 7 aa, Cryptosporidium hominis
EEYKDND

SEQ ID NO: 2201566 - protein, 27 aa, Cryptosporidium hominis
EEYSEEEKSQSTEDELQSDHNSENNQD

SEQ ID NO: 2201567 - protein, 10 aa, Cryptosporidium hominis
EEYYGGREEN

SEQ ID NO: 2201568 - protein, 7 aa, Cryptosporidium hominis
EFKKSAS

SEQ ID NO: 2201569 - protein, 7 aa, Cryptosporidium hominis
EFPTQEQ

SEQ ID NO: 2201570 - protein, 7 aa, Cryptosporidium hominis
EFSPSSK

SEQ ID NO: 2201571 - protein, 9 aa, Cryptosporidium hominis
EFSRQHKRN

SEQ ID NO: 2201572 - protein, 7 aa, Cryptosporidium hominis
EFSTPSY

SEQ ID NO: 2201573 - protein, 30 aa, Cryptosporidium hominis
EGAGSSSKNSGIKAESIEPVNDEEEVDRDS

SEQ ID NO: 2201574 - protein, 4 aa, Cryptosporidium hominis
EGAN

SEQ ID NO: 2201575 - protein, 4 aa, Cryptosporidium hominis
EGCP

SEQ ID NO: 2201576 - protein, 5 aa, Cryptosporidium hominis
EGEFY

SEQ ID NO: 2201577 - protein, 12 aa, Cryptosporidium hominis
EGFKQGSSLKTE

SEQ ID NO: 2201578 - protein, 11 aa, Cryptosporidium hominis
EGFSKTNKKIS

SEQ ID NO: 2201579 - protein, 32 aa, Cryptosporidium hominis
EGGKDLESSSSSYLTKETSTTNSDDGELSQPN

SEQ ID NO: 2201580 - protein, 8 aa, Cryptosporidium hominis
EGITQERG

SEQ ID NO: 2201581 - protein, 12 aa, Cryptosporidium hominis
EGKEESAKAQLE

SEQ ID NO: 2201582 - protein, 9 aa, Cryptosporidium hominis
EGKISAPPV

SEQ ID NO: 2201583 - protein, 6 aa, Cryptosporidium hominis
EGKMTS

SEQ ID NO: 2201584 - protein, 10 aa, Cryptosporidium hominis
EGKSEQGFQP

SEQ ID NO: 2201585 - protein, 8 aa, Cryptosporidium hominis
EGKTNEPF

SEQ ID NO: 2201586 - protein, 5 aa, Cryptosporidium hominis
EGKTR

SEQ ID NO: 2201587 - protein, 4 aa, Cryptosporidium hominis
EGLP

SEQ ID NO: 2201588 - protein, 8 aa, Cryptosporidium hominis
EGLSRGEK

SEQ ID NO: 2201589 - protein, 7 aa, Cryptosporidium hominis
EGNPITS

SEQ ID NO: 2201590 - protein, 19 aa, Cryptosporidium hominis
EGPKNSYEGSTKNEIESEK

SEQ ID NO: 2201591 - protein, 11 aa, Cryptosporidium hominis
EGQVPNKYENY

SEQ ID NO: 2201592 - protein, 8 aa, Cryptosporidium hominis
EGRPELTP

SEQ ID NO: 2201593 - protein, 8 aa, Cryptosporidium hominis
EGSAGLRT

SEQ ID NO: 2201594 - protein, 4 aa, Cryptosporidium hominis
EGSI

SEQ ID NO: 2201595 - protein, 5 aa, Cryptosporidium hominis
EGSNT

SEQ ID NO: 2201596 - protein, 7 aa, Cryptosporidium hominis
EGSPLGP

SEQ ID NO: 2201597 - protein, 8 aa, Cryptosporidium hominis
EGSQSYSA

SEQ ID NO: 2201598 - protein, 4 aa, Cryptosporidium hominis
EGSV

SEQ ID NO: 2201599 - protein, 5 aa, Cryptosporidium hominis
EGTDY

SEQ ID NO: 2201600 - protein, 13 aa, Cryptosporidium hominis
EGTGQEKPKPEDE

SEQ ID NO: 2201601 - protein, 7 aa, Cryptosporidium hominis
EGTNDEC

SEQ ID NO: 2201602 - protein, 7 aa, Cryptosporidium hominis
EGTPDYS

SEQ ID NO: 2201603 - protein, 4 aa, Cryptosporidium hominis
EGTT

SEQ ID NO: 2201604 - protein, 14 aa, Cryptosporidium hominis
EGVSTGLAKQQNKR

SEQ ID NO: 2201605 - protein, 7 aa, Cryptosporidium hominis
EGYSEEK

SEQ ID NO: 2201606 - protein, 6 aa, Cryptosporidium hominis
EHDSSV

SEQ ID NO: 2201607 - protein, 13 aa, Cryptosporidium hominis
EHENKSEQESAQV

SEQ ID NO: 2201608 - protein, 6 aa, Cryptosporidium hominis
EHETNL

SEQ ID NO: 2201609 - protein, 11 aa, Cryptosporidium hominis
EHGSKSDGTIE

SEQ ID NO: 2201610 - protein, 97 aa, Cryptosporidium hominis
EHRTPSPSISPSSTPSPPPPPLPPRPSPSPPPLPPRPSPSPPPTPHSYTSPSSGTPSRTPMPKDEDLNPNPAVDKTKHRGSSKLPKPKSKKKPLTRR

SEQ ID NO: 2201611 - protein, 7 aa, Cryptosporidium hominis
EHSEENR

SEQ ID NO: 2201612 - protein, 9 aa, Cryptosporidium hominis
EHSRDNSDN

SEQ ID NO: 2201613 - protein, 13 aa, Cryptosporidium hominis
EIDKDLDKAARNL

SEQ ID NO: 2201614 - protein, 6 aa, Cryptosporidium hominis
EIDRES

SEQ ID NO: 2201615 - protein, 12 aa, Cryptosporidium hominis
EIGKGEPRKSEK

SEQ ID NO: 2201616 - protein, 6 aa, Cryptosporidium hominis
EINDSP

SEQ ID NO: 2201617 - protein, 9 aa, Cryptosporidium hominis
EINSNQPRA

SEQ ID NO: 2201618 - protein, 8 aa, Cryptosporidium hominis
EINSRKGV

SEQ ID NO: 2201619 - protein, 8 aa, Cryptosporidium hominis
EIPGGGSK

SEQ ID NO: 2201620 - protein, 4 aa, Cryptosporidium hominis
EIPP

SEQ ID NO: 2201621 - protein, 5 aa, Cryptosporidium hominis
EIPYE

SEQ ID NO: 2201622 - protein, 16 aa, Cryptosporidium hominis
EIQNTEERLREEYKEK

SEQ ID NO: 2201623 - protein, 10 aa, Cryptosporidium hominis
EITSSAKSVN

SEQ ID NO: 2201624 - protein, 7 aa, Cryptosporidium hominis
EKAIQQS

SEQ ID NO: 2201625 - protein, 15 aa, Cryptosporidium hominis
EKASMSSNSQGSSDS

SEQ ID NO: 2201626 - protein, 9 aa, Cryptosporidium hominis
EKDPKDISN

SEQ ID NO: 2201627 - protein, 9 aa, Cryptosporidium hominis
EKDTQVSHG

SEQ ID NO: 2201628 - protein, 10 aa, Cryptosporidium hominis
EKDYEATTNE

SEQ ID NO: 2201629 - protein, 11 aa, Cryptosporidium hominis
EKECSGESMDK

SEQ ID NO: 2201630 - protein, 14 aa, Cryptosporidium hominis
EKEGDRTTTKTQND

SEQ ID NO: 2201631 - protein, 10 aa, Cryptosporidium hominis
EKEKKQNYYT

SEQ ID NO: 2201632 - protein, 7 aa, Cryptosporidium hominis
EKELKER

SEQ ID NO: 2201633 - protein, 9 aa, Cryptosporidium hominis
EKENKLNEI

SEQ ID NO: 2201634 - protein, 17 aa, Cryptosporidium hominis
EKENSLSKNKKASNNID

SEQ ID NO: 2201635 - protein, 11 aa, Cryptosporidium hominis
EKEPSGGADEF

SEQ ID NO: 2201636 - protein, 15 aa, Cryptosporidium hominis
EKERLEKERLEKEKI

SEQ ID NO: 2201637 - protein, 5 aa, Cryptosporidium hominis
EKESN

SEQ ID NO: 2201638 - protein, 6 aa, Cryptosporidium hominis
EKESPV

SEQ ID NO: 2201639 - protein, 4 aa, Cryptosporidium hominis
EKET

SEQ ID NO: 2201640 - protein, 30 aa, Cryptosporidium hominis
EKFAEKSDEENEFDTDEFDADDNNPNDDVE

SEQ ID NO: 2201641 - protein, 12 aa, Cryptosporidium hominis
EKFSKGKYKKTL

SEQ ID NO: 2201642 - protein, 7 aa, Cryptosporidium hominis
EKGANRN

SEQ ID NO: 2201643 - protein, 6 aa, Cryptosporidium hominis
EKGGFA

SEQ ID NO: 2201644 - protein, 12 aa, Cryptosporidium hominis
EKGKHNKRSPQN

SEQ ID NO: 2201645 - protein, 17 aa, Cryptosporidium hominis
EKGYGPAASKSDGKKIK

SEQ ID NO: 2201646 - protein, 5 aa, Cryptosporidium hominis
EKHTD

SEQ ID NO: 2201647 - protein, 26 aa, Cryptosporidium hominis
EKINPCSQNKTIDNSYATKKTIKEEL

SEQ ID NO: 2201648 - protein, 4 aa, Cryptosporidium hominis
EKIS

SEQ ID NO: 2201649 - protein, 15 aa, Cryptosporidium hominis
EKITNRNSNFSENKR

SEQ ID NO: 2201650 - protein, 18 aa, Cryptosporidium hominis
EKKDYDAKKEEKEKLPLQ

SEQ ID NO: 2201651 - protein, 17 aa, Cryptosporidium hominis
EKKEKELKKQKEKERLK

SEQ ID NO: 2201652 - protein, 7 aa, Cryptosporidium hominis
EKKKQEG

SEQ ID NO: 2201653 - protein, 10 aa, Cryptosporidium hominis
EKKKTTTHAI

SEQ ID NO: 2201654 - protein, 7 aa, Cryptosporidium hominis
EKKNEDF

SEQ ID NO: 2201655 - protein, 7 aa, Cryptosporidium hominis
EKKRENI

SEQ ID NO: 2201656 - protein, 9 aa, Cryptosporidium hominis
EKKSGEKNF

SEQ ID NO: 2201657 - protein, 34 aa, Cryptosporidium hominis
EKKSGIQSSLKSSELSISTEEANMNESAPESDHY

SEQ ID NO: 2201658 - protein, 24 aa, Cryptosporidium hominis
EKKVDEDFTNKDSKLDERRSNNKV

SEQ ID NO: 2201659 - protein, 7 aa, Cryptosporidium hominis
EKKVGEI

SEQ ID NO: 2201660 - protein, 16 aa, Cryptosporidium hominis
EKLEEIGKKYSSGEML

SEQ ID NO: 2201661 - protein, 11 aa, Cryptosporidium hominis
EKLEQSSRGKY

SEQ ID NO: 2201662 - protein, 13 aa, Cryptosporidium hominis
EKNDEEGKPKVKV

SEQ ID NO: 2201663 - protein, 5 aa, Cryptosporidium hominis
EKNEE

SEQ ID NO: 2201664 - protein, 8 aa, Cryptosporidium hominis
EKNEEEKF

SEQ ID NO: 2201665 - protein, 17 aa, Cryptosporidium hominis
EKNEPIKVNNESETGLK

SEQ ID NO: 2201666 - protein, 11 aa, Cryptosporidium hominis
EKNIVASPAGI

SEQ ID NO: 2201667 - protein, 15 aa, Cryptosporidium hominis
EKNKPSSLEPLSEDD

SEQ ID NO: 2201668 - protein, 4 aa, Cryptosporidium hominis
EKNP

SEQ ID NO: 2201669 - protein, 6 aa, Cryptosporidium hominis
EKNRYG

SEQ ID NO: 2201670 - protein, 6 aa, Cryptosporidium hominis
EKNSEY

SEQ ID NO: 2201671 - protein, 8 aa, Cryptosporidium hominis
EKNSKHSE

SEQ ID NO: 2201672 - protein, 8 aa, Cryptosporidium hominis
EKNSNSKI

SEQ ID NO: 2201673 - protein, 5 aa, Cryptosporidium hominis
EKNTI

SEQ ID NO: 2201674 - protein, 12 aa, Cryptosporidium hominis
EKNVTEKQSEIR

SEQ ID NO: 2201675 - protein, 9 aa, Cryptosporidium hominis
EKPEKHGTY

SEQ ID NO: 2201676 - protein, 4 aa, Cryptosporidium hominis
EKPL

SEQ ID NO: 2201677 - protein, 8 aa, Cryptosporidium hominis
EKQRFSTH

SEQ ID NO: 2201678 - protein, 7 aa, Cryptosporidium hominis
EKRACED

SEQ ID NO: 2201679 - protein, 38 aa, Cryptosporidium hominis
EKRDQKRKRRSESEYSQYNSKLRSKSETVQITSEKHGH

SEQ ID NO: 2201680 - protein, 7 aa, Cryptosporidium hominis
EKREITP

SEQ ID NO: 2201681 - protein, 5 aa, Cryptosporidium hominis
EKRGI

SEQ ID NO: 2201682 - protein, 6 aa, Cryptosporidium hominis
EKRNSQ

SEQ ID NO: 2201683 - protein, 13 aa, Cryptosporidium hominis
EKSAEEKKTEMIE

SEQ ID NO: 2201684 - protein, 16 aa, Cryptosporidium hominis
EKSENKTMKENLSSIL

SEQ ID NO: 2201685 - protein, 26 aa, Cryptosporidium hominis
EKSEPPHQKCPEGTEYEESSSSCKVK

SEQ ID NO: 2201686 - protein, 11 aa, Cryptosporidium hominis
EKSKQLSDKER

SEQ ID NO: 2201687 - protein, 10 aa, Cryptosporidium hominis
EKSKSSADYE

SEQ ID NO: 2201688 - protein, 33 aa, Cryptosporidium hominis
EKSLEQPYVKSSDKSEMSKSKIQRPGSPESSKF

SEQ ID NO: 2201689 - protein, 8 aa, Cryptosporidium hominis
EKSLESSQ

SEQ ID NO: 2201690 - protein, 13 aa, Cryptosporidium hominis
EKSPSDPKGPLRR

SEQ ID NO: 2201691 - protein, 9 aa, Cryptosporidium hominis
EKTLDGNEN

SEQ ID NO: 2201692 - protein, 6 aa, Cryptosporidium hominis
EKVEPE

SEQ ID NO: 2201693 - protein, 14 aa, Cryptosporidium hominis
EKYNKKKSWRKKTR

SEQ ID NO: 2201694 - protein, 17 aa, Cryptosporidium hominis
ELANSSSYYTSTPTFED

SEQ ID NO: 2201695 - protein, 8 aa, Cryptosporidium hominis
ELDDANYN

SEQ ID NO: 2201696 - protein, 7 aa, Cryptosporidium hominis
ELDDRYS

SEQ ID NO: 2201697 - protein, 36 aa, Cryptosporidium hominis
ELDGGDESVSELPDISEEPSPLPEFEEPERIAPSKF

SEQ ID NO: 2201698 - protein, 6 aa, Cryptosporidium hominis
ELEAPR

SEQ ID NO: 2201699 - protein, 18 aa, Cryptosporidium hominis
ELEKEAEKEFGGSQANTL

SEQ ID NO: 2201700 - protein, 8 aa, Cryptosporidium hominis
ELEKNGKD

SEQ ID NO: 2201701 - protein, 10 aa, Cryptosporidium hominis
ELGDSGKSDK

SEQ ID NO: 2201702 - protein, 6 aa, Cryptosporidium hominis
ELKEEY

SEQ ID NO: 2201703 - protein, 5 aa, Cryptosporidium hominis
ELKEK

SEQ ID NO: 2201704 - protein, 26 aa, Cryptosporidium hominis
ELKTEDSIGKRNIRSHPNNAKNSKLP

SEQ ID NO: 2201705 - protein, 11 aa, Cryptosporidium hominis
ELNEANKAADL

SEQ ID NO: 2201706 - protein, 6 aa, Cryptosporidium hominis
ELPHET

SEQ ID NO: 2201707 - protein, 6 aa, Cryptosporidium hominis
ELPQDI

SEQ ID NO: 2201708 - protein, 9 aa, Cryptosporidium hominis
ELRKTEKPT

SEQ ID NO: 2201709 - protein, 12 aa, Cryptosporidium hominis
ELSEQGIGGELS

SEQ ID NO: 2201710 - protein, 8 aa, Cryptosporidium hominis
ELSESEKL

SEQ ID NO: 2201711 - protein, 10 aa, Cryptosporidium hominis
ELSGTASSTM

SEQ ID NO: 2201712 - protein, 11 aa, Cryptosporidium hominis
ELSNDNDNDIM

SEQ ID NO: 2201713 - protein, 5 aa, Cryptosporidium hominis
ELSNL

SEQ ID NO: 2201714 - protein, 6 aa, Cryptosporidium hominis
ELSPDD

SEQ ID NO: 2201715 - protein, 9 aa, Cryptosporidium hominis
ELSPEQEKE

SEQ ID NO: 2201716 - protein, 7 aa, Cryptosporidium hominis
ELSPSRV

SEQ ID NO: 2201717 - protein, 6 aa, Cryptosporidium hominis
ELTPQH

SEQ ID NO: 2201718 - protein, 13 aa, Cryptosporidium hominis
EMKNTQSTSGKTL

SEQ ID NO: 2201719 - protein, 6 aa, Cryptosporidium hominis
EMQTST

SEQ ID NO: 2201720 - protein, 7 aa, Cryptosporidium hominis
ENAASLT

SEQ ID NO: 2201721 - protein, 13 aa, Cryptosporidium hominis
ENAEGSDIKYEND

SEQ ID NO: 2201722 - protein, 7 aa, Cryptosporidium hominis
ENAGGLR

SEQ ID NO: 2201723 - protein, 12 aa, Cryptosporidium hominis
ENARNVPAPIGV

SEQ ID NO: 2201724 - protein, 9 aa, Cryptosporidium hominis
ENDLPKDEF

SEQ ID NO: 2201725 - protein, 14 aa, Cryptosporidium hominis
ENDSSYKYNKNPFT

SEQ ID NO: 2201726 - protein, 7 aa, Cryptosporidium hominis
ENDSYSD

SEQ ID NO: 2201727 - protein, 4 aa, Cryptosporidium hominis
ENEG

SEQ ID NO: 2201728 - protein, 6 aa, Cryptosporidium hominis
ENEHKL

SEQ ID NO: 2201729 - protein, 8 aa, Cryptosporidium hominis
ENENTLQK

SEQ ID NO: 2201730 - protein, 7 aa, Cryptosporidium hominis
ENERANN

SEQ ID NO: 2201731 - protein, 10 aa, Cryptosporidium hominis
ENEREQEAIE

SEQ ID NO: 2201732 - protein, 5 aa, Cryptosporidium hominis
ENESY

SEQ ID NO: 2201733 - protein, 7 aa, Cryptosporidium hominis
ENEYAPI

SEQ ID NO: 2201734 - protein, 6 aa, Cryptosporidium hominis
ENFDGD

SEQ ID NO: 2201735 - protein, 5 aa, Cryptosporidium hominis
ENGER

SEQ ID NO: 2201736 - protein, 4 aa, Cryptosporidium hominis
ENGN

SEQ ID NO: 2201737 - protein, 4 aa, Cryptosporidium hominis
ENGS

SEQ ID NO: 2201738 - protein, 6 aa, Cryptosporidium hominis
ENGTDE

SEQ ID NO: 2201739 - protein, 7 aa, Cryptosporidium hominis
ENHESER

SEQ ID NO: 2201740 - protein, 7 aa, Cryptosporidium hominis
ENHYSPA

SEQ ID NO: 2201741 - protein, 8 aa, Cryptosporidium hominis
ENINGSGN

SEQ ID NO: 2201742 - protein, 6 aa, Cryptosporidium hominis
ENIPQN

SEQ ID NO: 2201743 - protein, 5 aa, Cryptosporidium hominis
ENKDN

SEQ ID NO: 2201744 - protein, 8 aa, Cryptosporidium hominis
ENKEEGEV

SEQ ID NO: 2201745 - protein, 10 aa, Cryptosporidium hominis
ENKEKTQLKP

SEQ ID NO: 2201746 - protein, 20 aa, Cryptosporidium hominis
ENKFKEKKKKKSPNKVKEPE

SEQ ID NO: 2201747 - protein, 4 aa, Cryptosporidium hominis
ENKG

SEQ ID NO: 2201748 - protein, 18 aa, Cryptosporidium hominis
ENKKHGLKVDENDQSKLE

SEQ ID NO: 2201749 - protein, 8 aa, Cryptosporidium hominis
ENKNNTEL

SEQ ID NO: 2201750 - protein, 6 aa, Cryptosporidium hominis
ENLGQN

SEQ ID NO: 2201751 - protein, 5 aa, Cryptosporidium hominis
ENLNE

SEQ ID NO: 2201752 - protein, 7 aa, Cryptosporidium hominis
ENLSQQL

SEQ ID NO: 2201753 - protein, 9 aa, Cryptosporidium hominis
ENNANNGRI

SEQ ID NO: 2201754 - protein, 14 aa, Cryptosporidium hominis
ENNDENAPREQFTG

SEQ ID NO: 2201755 - protein, 5 aa, Cryptosporidium hominis
ENNDV

SEQ ID NO: 2201756 - protein, 6 aa, Cryptosporidium hominis
ENNKLG

SEQ ID NO: 2201757 - protein, 10 aa, Cryptosporidium hominis
ENNQEKNFQN

SEQ ID NO: 2201758 - protein, 4 aa, Cryptosporidium hominis
ENPA

SEQ ID NO: 2201759 - protein, 8 aa, Cryptosporidium hominis
ENPCENNR

SEQ ID NO: 2201760 - protein, 11 aa, Cryptosporidium hominis
ENPEARKNPKL

SEQ ID NO: 2201761 - protein, 4 aa, Cryptosporidium hominis
ENPK

SEQ ID NO: 2201762 - protein, 5 aa, Cryptosporidium hominis
ENPND

SEQ ID NO: 2201763 - protein, 11 aa, Cryptosporidium hominis
ENPPNKETQIE

SEQ ID NO: 2201764 - protein, 6 aa, Cryptosporidium hominis
ENPPQL

SEQ ID NO: 2201765 - protein, 10 aa, Cryptosporidium hominis
ENPSAKFEDG

SEQ ID NO: 2201766 - protein, 13 aa, Cryptosporidium hominis
ENPSLRRGNSGSI

SEQ ID NO: 2201767 - protein, 6 aa, Cryptosporidium hominis
ENQIDQ

SEQ ID NO: 2201768 - protein, 20 aa, Cryptosporidium hominis
ENQNAETPSLDQGETIETQT

SEQ ID NO: 2201769 - protein, 8 aa, Cryptosporidium hominis
ENQSEKPF

SEQ ID NO: 2201770 - protein, 7 aa, Cryptosporidium hominis
ENRDKTI

SEQ ID NO: 2201771 - protein, 9 aa, Cryptosporidium hominis
ENRLEEKEN

SEQ ID NO: 2201772 - protein, 9 aa, Cryptosporidium hominis
ENSDESDPM

SEQ ID NO: 2201773 - protein, 4 aa, Cryptosporidium hominis
ENSE

SEQ ID NO: 2201774 - protein, 55 aa, Cryptosporidium hominis
ENSNINKERKAPTSDNKLGNNDHVENGASKKSKRKKNRKDKDGNVNSKENICQTP

SEQ ID NO: 2201775 - protein, 19 aa, Cryptosporidium hominis
  misc_feature (17)..(17): Xaa can be any naturally occurring amino acid
ENSQDNQLLDIISKSSXCL

SEQ ID NO: 2201776 - protein, 7 aa, Cryptosporidium hominis
ENSSISD

SEQ ID NO: 2201777 - protein, 6 aa, Cryptosporidium hominis
ENTGIQ

SEQ ID NO: 2201778 - protein, 15 aa, Cryptosporidium hominis
ENTLKNEDTPILRLL

SEQ ID NO: 2201779 - protein, 11 aa, Cryptosporidium hominis
ENTQYSNGIPS

SEQ ID NO: 2201780 - protein, 7 aa, Cryptosporidium hominis
ENVTYKN

SEQ ID NO: 2201781 - protein, 9 aa, Cryptosporidium hominis
ENYEENQIP

SEQ ID NO: 2201782 - protein, 14 aa, Cryptosporidium hominis
ENYESSNLETSSRT

SEQ ID NO: 2201783 - protein, 7 aa, Cryptosporidium hominis
ENYSKTP

SEQ ID NO: 2201784 - protein, 20 aa, Cryptosporidium hominis
ENYTNKEKGNEIPKSNHPRN

SEQ ID NO: 2201785 - protein, 7 aa, Cryptosporidium hominis
EPALSQS

SEQ ID NO: 2201786 - protein, 4 aa, Cryptosporidium hominis
EPDN

SEQ ID NO: 2201787 - protein, 4 aa, Cryptosporidium hominis
EPDY

SEQ ID NO: 2201788 - protein, 23 aa, Cryptosporidium hominis
EPDYEANYPEEESRKSPNTKSAI

SEQ ID NO: 2201789 - protein, 10 aa, Cryptosporidium hominis
EPGKGEESIK

SEQ ID NO: 2201790 - protein, 4 aa, Cryptosporidium hominis
EPIN

SEQ ID NO: 2201791 - protein, 8 aa, Cryptosporidium hominis
EPKLRSEP

SEQ ID NO: 2201792 - protein, 8 aa, Cryptosporidium hominis
EPKTTNSM

SEQ ID NO: 2201793 - protein, 4 aa, Cryptosporidium hominis
EPNK

SEQ ID NO: 2201794 - protein, 4 aa, Cryptosporidium hominis
EPNQ

SEQ ID NO: 2201795 - protein, 8 aa, Cryptosporidium hominis
EPREGEKI

SEQ ID NO: 2201796 - protein, 8 aa, Cryptosporidium hominis
EPSRDPSL

SEQ ID NO: 2201797 - protein, 11 aa, Cryptosporidium hominis
EPSRDPSLSQT

SEQ ID NO: 2201798 - protein, 8 aa, Cryptosporidium hominis
EQADVKSE

SEQ ID NO: 2201799 - protein, 5 aa, Cryptosporidium hominis
EQDEE

SEQ ID NO: 2201800 - protein, 6 aa, Cryptosporidium hominis
EQGASG

SEQ ID NO: 2201801 - protein, 7 aa, Cryptosporidium hominis
EQGEEVP

SEQ ID NO: 2201802 - protein, 8 aa, Cryptosporidium hominis
EQIGQCGE

SEQ ID NO: 2201803 - protein, 6 aa, Cryptosporidium hominis
EQLPDN

SEQ ID NO: 2201804 - protein, 8 aa, Cryptosporidium hominis
EQNKASSL

SEQ ID NO: 2201805 - protein, 39 aa, Cryptosporidium hominis
EQQEGEEPVEENKKSKKDKKAKKDKKDKKSKKSKKDENG

SEQ ID NO: 2201806 - protein, 18 aa, Cryptosporidium hominis
EQQNYQQADDGDSSSQVN

SEQ ID NO: 2201807 - protein, 16 aa, Cryptosporidium hominis
EQRNIDQTKNVTNRSG

SEQ ID NO: 2201808 - protein, 4 aa, Cryptosporidium hominis
EQSE

SEQ ID NO: 2201809 - protein, 13 aa, Cryptosporidium hominis
EQSGSYREDPERM

SEQ ID NO: 2201810 - protein, 16 aa, Cryptosporidium hominis
EQSNRSDFPESGSISS

SEQ ID NO: 2201811 - protein, 11 aa, Cryptosporidium hominis
EQTNNGASKAT

SEQ ID NO: 2201812 - protein, 7 aa, Cryptosporidium hominis
ERDIVSE

SEQ ID NO: 2201813 - protein, 9 aa, Cryptosporidium hominis
ERDNANKAL

SEQ ID NO: 2201814 - protein, 13 aa, Cryptosporidium hominis
EREDRSKNDEPSL

SEQ ID NO: 2201815 - protein, 4 aa, Cryptosporidium hominis
EREQ

SEQ ID NO: 2201816 - protein, 12 aa, Cryptosporidium hominis
EREQEKIKEEKE

SEQ ID NO: 2201817 - protein, 30 aa, Cryptosporidium hominis
EREYNHDKKIKQAKEEQKRLEKKREQRMTR

SEQ ID NO: 2201818 - protein, 6 aa, Cryptosporidium hominis
ERIKNR

SEQ ID NO: 2201819 - protein, 47 aa, Cryptosporidium hominis
ERKENKERKLREKKVKEEKERLERERLSEANKNKEKKPRKKKTKPKK

SEQ ID NO: 2201820 - protein, 8 aa, Cryptosporidium hominis
ERKESNKG

SEQ ID NO: 2201821 - protein, 6 aa, Cryptosporidium hominis
ERNRLE

SEQ ID NO: 2201822 - protein, 35 aa, Cryptosporidium hominis
ERQEQSKGRPSLRSLQEKSNNPEKAISSDKKSEKG

SEQ ID NO: 2201823 - protein, 9 aa, Cryptosporidium hominis
ERQKSSISK

SEQ ID NO: 2201824 - protein, 5 aa, Cryptosporidium hominis
ERRSA

SEQ ID NO: 2201825 - protein, 8 aa, Cryptosporidium hominis
ERSPEDLP

SEQ ID NO: 2201826 - protein, 9 aa, Cryptosporidium hominis
ERSQGSSDI

SEQ ID NO: 2201827 - protein, 8 aa, Cryptosporidium hominis
ERSSVSEI

SEQ ID NO: 2201828 - protein, 11 aa, Cryptosporidium hominis
ERTDQTKTTQV

SEQ ID NO: 2201829 - protein, 9 aa, Cryptosporidium hominis
ERTQGSGLK

SEQ ID NO: 2201830 - protein, 6 aa, Cryptosporidium hominis
ERTTNY

SEQ ID NO: 2201831 - protein, 6 aa, Cryptosporidium hominis
ERTVGN

SEQ ID NO: 2201832 - protein, 8 aa, Cryptosporidium hominis
ESAPEGYE

SEQ ID NO: 2201833 - protein, 7 aa, Cryptosporidium hominis
ESAQSDF

SEQ ID NO: 2201834 - protein, 7 aa, Cryptosporidium hominis
ESCNNQQ

SEQ ID NO: 2201835 - protein, 4 aa, Cryptosporidium hominis
ESCP

SEQ ID NO: 2201836 - protein, 4 aa, Cryptosporidium hominis
ESDY

SEQ ID NO: 2201837 - protein, 7 aa, Cryptosporidium hominis
ESEEGLT

SEQ ID NO: 2201838 - protein, 15 aa, Cryptosporidium hominis
ESEEIPTGEDEFGEV

SEQ ID NO: 2201839 - protein, 7 aa, Cryptosporidium hominis
ESELKET

SEQ ID NO: 2201840 - protein, 14 aa, Cryptosporidium hominis
ESEQKNGSSTLSKN

SEQ ID NO: 2201841 - protein, 8 aa, Cryptosporidium hominis
ESGNGECI

SEQ ID NO: 2201842 - protein, 7 aa, Cryptosporidium hominis
ESGSLQE

SEQ ID NO: 2201843 - protein, 11 aa, Cryptosporidium hominis
ESGTQTEETGM

SEQ ID NO: 2201844 - protein, 17 aa, Cryptosporidium hominis
ESHSAEATKEADNKTLQ

SEQ ID NO: 2201845 - protein, 8 aa, Cryptosporidium hominis
ESIESIQT

SEQ ID NO: 2201846 - protein, 9 aa, Cryptosporidium hominis
ESIKNTTIN

SEQ ID NO: 2201847 - protein, 14 aa, Cryptosporidium hominis
ESIKTNSGKGKCEA

SEQ ID NO: 2201848 - protein, 6 aa, Cryptosporidium hominis
ESKKNC

SEQ ID NO: 2201849 - protein, 7 aa, Cryptosporidium hominis
ESKKSTT

SEQ ID NO: 2201850 - protein, 6 aa, Cryptosporidium hominis
ESKNIT

SEQ ID NO: 2201851 - protein, 14 aa, Cryptosporidium hominis
ESKQIEEKANSAYK

SEQ ID NO: 2201852 - protein, 4 aa, Cryptosporidium hominis
ESLE

SEQ ID NO: 2201853 - protein, 7 aa, Cryptosporidium hominis
ESNAESY

SEQ ID NO: 2201854 - protein, 7 aa, Cryptosporidium hominis
ESNDNPI

SEQ ID NO: 2201855 - protein, 16 aa, Cryptosporidium hominis
ESNKTCSNEEKYDPKR

SEQ ID NO: 2201856 - protein, 7 aa, Cryptosporidium hominis
ESNNENL

SEQ ID NO: 2201857 - protein, 11 aa, Cryptosporidium hominis
ESNNTRISDDG

SEQ ID NO: 2201858 - protein, 7 aa, Cryptosporidium hominis
ESNPKNP

SEQ ID NO: 2201859 - protein, 27 aa, Cryptosporidium hominis
ESNSKDEEYNKSISKANSKCKKLSKEV

SEQ ID NO: 2201860 - protein, 10 aa, Cryptosporidium hominis
ESNYEENGAS

SEQ ID NO: 2201861 - protein, 12 aa, Cryptosporidium hominis
ESPLKGDESTLS

SEQ ID NO: 2201862 - protein, 9 aa, Cryptosporidium hominis
ESPSDVTTL

SEQ ID NO: 2201863 - protein, 9 aa, Cryptosporidium hominis
ESPVNSPHP

SEQ ID NO: 2201864 - protein, 15 aa, Cryptosporidium hominis
ESQSTTSESRTGSRG

SEQ ID NO: 2201865 - protein, 8 aa, Cryptosporidium hominis
ESRDQNRA

SEQ ID NO: 2201866 - protein, 4 aa, Cryptosporidium hominis
ESRE

SEQ ID NO: 2201867 - protein, 27 aa, Cryptosporidium hominis
ESRKDLSKDDNRTEGGSDSNTNELSHS

SEQ ID NO: 2201868 - protein, 6 aa, Cryptosporidium hominis
ESSEEA

SEQ ID NO: 2201869 - protein, 8 aa, Cryptosporidium hominis
ESSESLSN

SEQ ID NO: 2201870 - protein, 5 aa, Cryptosporidium hominis
ESSIQ

SEQ ID NO: 2201871 - protein, 10 aa, Cryptosporidium hominis
ESSKPNSLIP

SEQ ID NO: 2201872 - protein, 24 aa, Cryptosporidium hominis
ESSSDQVNPQAEEVHGEDNTNEEL

SEQ ID NO: 2201873 - protein, 8 aa, Cryptosporidium hominis
ESSSPRTT

SEQ ID NO: 2201874 - protein, 10 aa, Cryptosporidium hominis
ESSTELSGGS

SEQ ID NO: 2201875 - protein, 10 aa, Cryptosporidium hominis
ESTDYSPPVS

SEQ ID NO: 2201876 - protein, 8 aa, Cryptosporidium hominis
ESTKKNNF

SEQ ID NO: 2201877 - protein, 6 aa, Cryptosporidium hominis
ESVFPA

SEQ ID NO: 2201878 - protein, 14 aa, Cryptosporidium hominis
ESVISNQDNKEENK

SEQ ID NO: 2201879 - protein, 9 aa, Cryptosporidium hominis
ESVKPVTKV

SEQ ID NO: 2201880 - protein, 4 aa, Cryptosporidium hominis
ESVR

SEQ ID NO: 2201881 - protein, 6 aa, Cryptosporidium hominis
ESVSPT

SEQ ID NO: 2201882 - protein, 6 aa, Cryptosporidium hominis
ESYDQL

SEQ ID NO: 2201883 - protein, 7 aa, Cryptosporidium hominis
ETANGAF

SEQ ID NO: 2201884 - protein, 19 aa, Cryptosporidium hominis
ETCPTRNQRTDQGDYEYEG

SEQ ID NO: 2201885 - protein, 5 aa, Cryptosporidium hominis
ETDQK

SEQ ID NO: 2201886 - protein, 10 aa, Cryptosporidium hominis
ETDQKYEKGH

SEQ ID NO: 2201887 - protein, 5 aa, Cryptosporidium hominis
ETDQL

SEQ ID NO: 2201888 - protein, 10 aa, Cryptosporidium hominis
ETDVNPRDGR

SEQ ID NO: 2201889 - protein, 13 aa, Cryptosporidium hominis
ETEEKGTNNVNDI

SEQ ID NO: 2201890 - protein, 4 aa, Cryptosporidium hominis
ETEK

SEQ ID NO: 2201891 - protein, 22 aa, Cryptosporidium hominis
ETEKQESDQKEEEEEEEKVANV

SEQ ID NO: 2201892 - protein, 4 aa, Cryptosporidium hominis
ETFQ

SEQ ID NO: 2201893 - protein, 10 aa, Cryptosporidium hominis
ETGCSSTCDS

SEQ ID NO: 2201894 - protein, 18 aa, Cryptosporidium hominis
ETGDNLNSGDSNPFGNSS

SEQ ID NO: 2201895 - protein, 10 aa, Cryptosporidium hominis
ETGGLDPVTE

SEQ ID NO: 2201896 - protein, 6 aa, Cryptosporidium hominis
ETGNTA

SEQ ID NO: 2201897 - protein, 13 aa, Cryptosporidium hominis
ETHKNDSKGTSEC

SEQ ID NO: 2201898 - protein, 9 aa, Cryptosporidium hominis
ETKKNEFNS

SEQ ID NO: 2201899 - protein, 5 aa, Cryptosporidium hominis
ETKLK

SEQ ID NO: 2201900 - protein, 6 aa, Cryptosporidium hominis
ETLTSS

SEQ ID NO: 2201901 - protein, 6 aa, Cryptosporidium hominis
ETNQSI

SEQ ID NO: 2201902 - protein, 8 aa, Cryptosporidium hominis
ETPERPQL

SEQ ID NO: 2201903 - protein, 4 aa, Cryptosporidium hominis
ETPK

SEQ ID NO: 2201904 - protein, 5 aa, Cryptosporidium hominis
ETPTD

SEQ ID NO: 2201905 - protein, 13 aa, Cryptosporidium hominis
ETPWTPSDDTSWG

SEQ ID NO: 2201906 - protein, 8 aa, Cryptosporidium hominis
ETQKQGAV

SEQ ID NO: 2201907 - protein, 12 aa, Cryptosporidium hominis
ETRSSNNQSGSH

SEQ ID NO: 2201908 - protein, 17 aa, Cryptosporidium hominis
ETSAAELPNSSNKPQVV

SEQ ID NO: 2201909 - protein, 5 aa, Cryptosporidium hominis
ETSNP

SEQ ID NO: 2201910 - protein, 11 aa, Cryptosporidium hominis
ETSPQSTNPFA

SEQ ID NO: 2201911 - protein, 13 aa, Cryptosporidium hominis
ETSTKEQASEIGE

SEQ ID NO: 2201912 - protein, 42 aa, Cryptosporidium hominis
ETSVPKYEKPSIRKGTVSPPPPPPLPLSEDAKVSDIQKENSQ

SEQ ID NO: 2201913 - protein, 12 aa, Cryptosporidium hominis
ETTRANDTNSHK

SEQ ID NO: 2201914 - protein, 4 aa, Cryptosporidium hominis
ETVS

SEQ ID NO: 2201915 - protein, 16 aa, Cryptosporidium hominis
ETVTPQQQASGLSRTG

SEQ ID NO: 2201916 - protein, 4 aa, Cryptosporidium hominis
ETYI

SEQ ID NO: 2201917 - protein, 12 aa, Cryptosporidium hominis
ETYSDNDQVPSG

SEQ ID NO: 2201918 - protein, 7 aa, Cryptosporidium hominis
ETYTNGP

SEQ ID NO: 2201919 - protein, 11 aa, Cryptosporidium hominis
ETYYDSTERYR

SEQ ID NO: 2201920 - protein, 5 aa, Cryptosporidium hominis
EVANK

SEQ ID NO: 2201921 - protein, 16 aa, Cryptosporidium hominis
EVASGTPIRNDEEMQD

SEQ ID NO: 2201922 - protein, 4 aa, Cryptosporidium hominis
EVDP

SEQ ID NO: 2201923 - protein, 13 aa, Cryptosporidium hominis
EVDSESSKSNITV

SEQ ID NO: 2201924 - protein, 8 aa, Cryptosporidium hominis
EVKPNNSV

SEQ ID NO: 2201925 - protein, 8 aa, Cryptosporidium hominis
EVNGTDSI

SEQ ID NO: 2201926 - protein, 18 aa, Cryptosporidium hominis
EVSDSGKIIAPKDATSVP

SEQ ID NO: 2201927 - protein, 5 aa, Cryptosporidium hominis
EVSEE

SEQ ID NO: 2201928 - protein, 8 aa, Cryptosporidium hominis
EWTKQEED

SEQ ID NO: 2201929 - protein, 8 aa, Cryptosporidium hominis
EYDQGKNL

SEQ ID NO: 2201930 - protein, 12 aa, Cryptosporidium hominis
EYEDNGQKKTIT

SEQ ID NO: 2201931 - protein, 11 aa, Cryptosporidium hominis
EYKNSTKNITA

SEQ ID NO: 2201932 - protein, 21 aa, Cryptosporidium hominis
EYNGGNASFPASRTQYPTDPN

SEQ ID NO: 2201933 - protein, 5 aa, Cryptosporidium hominis
EYNQE

SEQ ID NO: 2201934 - protein, 6 aa, Cryptosporidium hominis
EYNSTD

SEQ ID NO: 2201935 - protein, 4 aa, Cryptosporidium hominis
EYQT

SEQ ID NO: 2201936 - protein, 19 aa, Cryptosporidium hominis
EYSESRKGYYKDQEGKPVY

SEQ ID NO: 2201937 - protein, 4 aa, Cryptosporidium hominis
EYTP

SEQ ID NO: 2201938 - protein, 28 aa, Cryptosporidium hominis
EYYPEQSESEEKTRITETGHFSKQESPV

SEQ ID NO: 2201939 - protein, 14 aa, Cryptosporidium hominis
FAGSEEVQDSSNLS

SEQ ID NO: 2201940 - protein, 9 aa, Cryptosporidium hominis
FAKQDLKSG

SEQ ID NO: 2201941 - protein, 34 aa, Cryptosporidium hominis
FAQEKNDQTSSIQVKQSERINVEPAKETKIENEV

SEQ ID NO: 2201942 - protein, 4 aa, Cryptosporidium hominis
FAQP

SEQ ID NO: 2201943 - protein, 100 aa, Cryptosporidium hominis
FASPSGESTITNRDPENRINEPSSSVEESSISEPPVSESSQLQTVEGSSQSTQNEQLPSQEGPNTEDASHISAQTSSNDQSQLPSSSKKQGDKGRKTEIA

SEQ ID NO: 2201944 - protein, 6 aa, Cryptosporidium hominis
FCSETD

SEQ ID NO: 2201945 - protein, 8 aa, Cryptosporidium hominis
FDIPNSES

SEQ ID NO: 2201946 - protein, 7 aa, Cryptosporidium hominis
FDPNTSR

SEQ ID NO: 2201947 - protein, 4 aa, Cryptosporidium hominis
FDTS

SEQ ID NO: 2201948 - protein, 6 aa, Cryptosporidium hominis
FEDYDK

SEQ ID NO: 2201949 - protein, 9 aa, Cryptosporidium hominis
FEEDAASSF

SEQ ID NO: 2201950 - protein, 8 aa, Cryptosporidium hominis
FEEDPRDL

SEQ ID NO: 2201951 - protein, 7 aa, Cryptosporidium hominis
FEEQKEQ

SEQ ID NO: 2201952 - protein, 22 aa, Cryptosporidium hominis
FEESKTSERSSSIGKLNTADSS

SEQ ID NO: 2201953 - protein, 14 aa, Cryptosporidium hominis
FEGSGEQKLNQEPG

SEQ ID NO: 2201954 - protein, 20 aa, Cryptosporidium hominis
FEHSSESWSSITSARRKMKA

SEQ ID NO: 2201955 - protein, 15 aa, Cryptosporidium hominis
FENFKNSTSNETEVD

SEQ ID NO: 2201956 - protein, 6 aa, Cryptosporidium hominis
FERSGQ

SEQ ID NO: 2201957 - protein, 10 aa, Cryptosporidium hominis
FESDSYKENL

SEQ ID NO: 2201958 - protein, 5 aa, Cryptosporidium hominis
FESSI

SEQ ID NO: 2201959 - protein, 7 aa, Cryptosporidium hominis
FESTGEH

SEQ ID NO: 2201960 - protein, 18 aa, Cryptosporidium hominis
FETSNDKGSSEPLPDGAS

SEQ ID NO: 2201961 - protein, 9 aa, Cryptosporidium hominis
FETSTGSKR

SEQ ID NO: 2201962 - protein, 6 aa, Cryptosporidium hominis
FGENRV

SEQ ID NO: 2201963 - protein, 10 aa, Cryptosporidium hominis
FGEPGPSIRE

SEQ ID NO: 2201964 - protein, 50 aa, Cryptosporidium hominis
FGGSKKESEVTNKEESVSVPAEESQKEAVESSVKEESEKPEELPDNNKSR

SEQ ID NO: 2201965 - protein, 8 aa, Cryptosporidium hominis
FGGSKSKA

SEQ ID NO: 2201966 - protein, 8 aa, Cryptosporidium hominis
FGNSESKI

SEQ ID NO: 2201967 - protein, 81 aa, Cryptosporidium hominis
FGPPIPVPTTSTSTTSTSSTSTSTTTTTTTTTTTTTTTTTTTTTTTTTTTTTTTTTTTTTTEVAESGRIQNQSSSRRLMVR

SEQ ID NO: 2201968 - protein, 11 aa, Cryptosporidium hominis
FGQGDTSNGVD

SEQ ID NO: 2201969 - protein, 10 aa, Cryptosporidium hominis
FGREQTKGGV

SEQ ID NO: 2201970 - protein, 12 aa, Cryptosporidium hominis
FGSENEENPRKL

SEQ ID NO: 2201971 - protein, 4 aa, Cryptosporidium hominis
FGSH

SEQ ID NO: 2201972 - protein, 17 aa, Cryptosporidium hominis
FGTNSNTESNNPNDSND

SEQ ID NO: 2201973 - protein, 4 aa, Cryptosporidium hominis
FGVG

SEQ ID NO: 2201974 - protein, 10 aa, Cryptosporidium hominis
FKKDTSEFDS

SEQ ID NO: 2201975 - protein, 6 aa, Cryptosporidium hominis
FKKNYK

SEQ ID NO: 2201976 - protein, 10 aa, Cryptosporidium hominis
FKPPALDKDS

SEQ ID NO: 2201977 - protein, 9 aa, Cryptosporidium hominis
FKSNSSGIN

SEQ ID NO: 2201978 - protein, 7 aa, Cryptosporidium hominis
FKTGNSH

SEQ ID NO: 2201979 - protein, 7 aa, Cryptosporidium hominis
FLNPNTE

SEQ ID NO: 2201980 - protein, 6 aa, Cryptosporidium hominis
FNEPSH

SEQ ID NO: 2201981 - protein, 15 aa, Cryptosporidium hominis
FNNEYDEGKLFISSF

SEQ ID NO: 2201982 - protein, 7 aa, Cryptosporidium hominis
FNRDGTT

SEQ ID NO: 2201983 - protein, 12 aa, Cryptosporidium hominis
FNSNRDRNSSKE

SEQ ID NO: 2201984 - protein, 6 aa, Cryptosporidium hominis
FNSSSI

SEQ ID NO: 2201985 - protein, 4 aa, Cryptosporidium hominis
FNSV

SEQ ID NO: 2201986 - protein, 9 aa, Cryptosporidium hominis
FPATHTDHR

SEQ ID NO: 2201987 - protein, 20 aa, Cryptosporidium hominis
FPDTGPKVSDEESNTESQEI

SEQ ID NO: 2201988 - protein, 7 aa, Cryptosporidium hominis
FPEDPDK

SEQ ID NO: 2201989 - protein, 11 aa, Cryptosporidium hominis
FPEKANIPSDK

SEQ ID NO: 2201990 - protein, 8 aa, Cryptosporidium hominis
FPGSDESK

SEQ ID NO: 2201991 - protein, 8 aa, Cryptosporidium hominis
FPGTKSPL

SEQ ID NO: 2201992 - protein, 6 aa, Cryptosporidium hominis
FPKPGS

SEQ ID NO: 2201993 - protein, 9 aa, Cryptosporidium hominis
FPPNPKYNK

SEQ ID NO: 2201994 - protein, 45 aa, Cryptosporidium hominis
FPPPPSPEEMGSSSFTDPDSLPSLPPPPPPVPPKPRKSMLRKVFN

SEQ ID NO: 2201995 - protein, 20 aa, Cryptosporidium hominis
FPPSPPPTTPGVPSPTFPSQ

SEQ ID NO: 2201996 - protein, 9 aa, Cryptosporidium hominis
FPQSPSSIG

SEQ ID NO: 2201997 - protein, 6 aa, Cryptosporidium hominis
FPSDKR

SEQ ID NO: 2201998 - protein, 4 aa, Cryptosporidium hominis
FPSK

SEQ ID NO: 2201999 - protein, 6 aa, Cryptosporidium hominis
FPTSNN

SEQ ID NO: 2202000 - protein, 4 aa, Cryptosporidium hominis
FQDN

SEQ ID NO: 2202001 - protein, 8 aa, Cryptosporidium hominis
FQEQKAQV

SEQ ID NO: 2202002 - protein, 10 aa, Cryptosporidium hominis
FQGGDKRTYL

SEQ ID NO: 2202003 - protein, 6 aa, Cryptosporidium hominis
FQNERD

SEQ ID NO: 2202004 - protein, 8 aa, Cryptosporidium hominis
FQSPSGEF

SEQ ID NO: 2202005 - protein, 15 aa, Cryptosporidium hominis
FQSSTTTPATECSEC

SEQ ID NO: 2202006 - protein, 12 aa, Cryptosporidium hominis
FQTYGGRDNRTF

SEQ ID NO: 2202007 - protein, 12 aa, Cryptosporidium hominis
FRDPAQRSRPST

SEQ ID NO: 2202008 - protein, 10 aa, Cryptosporidium hominis
FSAPGAPTTT

SEQ ID NO: 2202009 - protein, 11 aa, Cryptosporidium hominis
FSDDEQTISDT

SEQ ID NO: 2202010 - protein, 13 aa, Cryptosporidium hominis
FSDNESQDSGSKP

SEQ ID NO: 2202011 - protein, 8 aa, Cryptosporidium hominis
FSDPSKEP

SEQ ID NO: 2202012 - protein, 9 aa, Cryptosporidium hominis
FSEGTPSFE

SEQ ID NO: 2202013 - protein, 18 aa, Cryptosporidium hominis
FSENDQLSKYEDNNKTNS

SEQ ID NO: 2202014 - protein, 4 aa, Cryptosporidium hominis
FSES

SEQ ID NO: 2202015 - protein, 10 aa, Cryptosporidium hominis
FSGTSDQDEC

SEQ ID NO: 2202016 - protein, 14 aa, Cryptosporidium hominis
FSKDDKSKETIEEK

SEQ ID NO: 2202017 - protein, 5 aa, Cryptosporidium hominis
FSKPE

SEQ ID NO: 2202018 - protein, 20 aa, Cryptosporidium hominis
FSKPESETNNKTDYNNENEY

SEQ ID NO: 2202019 - protein, 14 aa, Cryptosporidium hominis
FSKTPSELTTEGLE

SEQ ID NO: 2202020 - protein, 15 aa, Cryptosporidium hominis
FSPPNSDIEKQETYE

SEQ ID NO: 2202021 - protein, 19 aa, Cryptosporidium hominis
FSQKEGKNTHKKDQEQTPL

SEQ ID NO: 2202022 - protein, 11 aa, Cryptosporidium hominis
FSQTPAPEVPL

SEQ ID NO: 2202023 - protein, 18 aa, Cryptosporidium hominis
FTPTQKRGPFSAKAETTE

SEQ ID NO: 2202024 - protein, 16 aa, Cryptosporidium hominis
FTRPQSNHHSDHAGHG

SEQ ID NO: 2202025 - protein, 11 aa, Cryptosporidium hominis
FTSPKNGGACT

SEQ ID NO: 2202026 - protein, 14 aa, Cryptosporidium hominis
FTSPSNSGSSSQLN

SEQ ID NO: 2202027 - protein, 19 aa, Cryptosporidium hominis
FTTDTSDIQTSDASVDSEI

SEQ ID NO: 2202028 - protein, 11 aa, Cryptosporidium hominis
FTTPSNNDTID

SEQ ID NO: 2202029 - protein, 6 aa, Cryptosporidium hominis
FVPETN

SEQ ID NO: 2202030 - protein, 6 aa, Cryptosporidium hominis
FYPPGE

SEQ ID NO: 2202031 - protein, 7 aa, Cryptosporidium hominis
GAANTQC

SEQ ID NO: 2202032 - protein, 5 aa, Cryptosporidium hominis
GACPQ

SEQ ID NO: 2202033 - protein, 6 aa, Cryptosporidium hominis
GADETI

SEQ ID NO: 2202034 - protein, 5 aa, Cryptosporidium hominis
GADSS

SEQ ID NO: 2202035 - protein, 6 aa, Cryptosporidium hominis
GAITPT

SEQ ID NO: 2202036 - protein, 12 aa, Cryptosporidium hominis
GAKCKKQEERDD

SEQ ID NO: 2202037 - protein, 7 aa, Cryptosporidium hominis
GANRGAW

SEQ ID NO: 2202038 - protein, 34 aa, Cryptosporidium hominis
GAPSRRRESSPSGRDGSRRLRQDSIDSPTRGNQG

SEQ ID NO: 2202039 - protein, 63 aa, Cryptosporidium hominis
GARPKTKTIRPRARSRSSTRSSSRSRTRSRTRSRTRSRTRLRSKSRIRSSSRTRSKSRGRSPE

SEQ ID NO: 2202040 - protein, 71 aa, Cryptosporidium hominis
GARPKTSVGGPKPRSSSSSSSSSKSSARRRSKSRSRSRRSSRSRARSSRSRARSSRSRGRSRSRDKSSEVR

SEQ ID NO: 2202041 - protein, 9 aa, Cryptosporidium hominis
GARSKACQS

SEQ ID NO: 2202042 - protein, 13 aa, Cryptosporidium hominis
GASNQSKSDEDHL

SEQ ID NO: 2202043 - protein, 16 aa, Cryptosporidium hominis
GASSEEYKEPRPTNRS

SEQ ID NO: 2202044 - protein, 7 aa, Cryptosporidium hominis
GASSQED

SEQ ID NO: 2202045 - protein, 4 aa, Cryptosporidium hominis
GATG

SEQ ID NO: 2202046 - protein, 6 aa, Cryptosporidium hominis
GATGGL

SEQ ID NO: 2202047 - protein, 7 aa, Cryptosporidium hominis
GATKKDF

SEQ ID NO: 2202048 - protein, 5 aa, Cryptosporidium hominis
GAVGT

SEQ ID NO: 2202049 - protein, 13 aa, Cryptosporidium hominis
GAVPVKSKDLSDI

SEQ ID NO: 2202050 - protein, 11 aa, Cryptosporidium hominis
GDDTQTSPIPI

SEQ ID NO: 2202051 - protein, 10 aa, Cryptosporidium hominis
GDEKQKELPQ

SEQ ID NO: 2202052 - protein, 20 aa, Cryptosporidium hominis
GDFTNGNGTGGKSIYGDSFE

SEQ ID NO: 2202053 - protein, 7 aa, Cryptosporidium hominis
GDGENDL

SEQ ID NO: 2202054 - protein, 11 aa, Cryptosporidium hominis
GDGRTKGTGCQ

SEQ ID NO: 2202055 - protein, 5 aa, Cryptosporidium hominis
GDHES

SEQ ID NO: 2202056 - protein, 9 aa, Cryptosporidium hominis
GDIPPTNEE

SEQ ID NO: 2202057 - protein, 9 aa, Cryptosporidium hominis
GDKSEETDN

SEQ ID NO: 2202058 - protein, 4 aa, Cryptosporidium hominis
GDLP

SEQ ID NO: 2202059 - protein, 9 aa, Cryptosporidium hominis
GDLSDSSYS

SEQ ID NO: 2202060 - protein, 4 aa, Cryptosporidium hominis
GDPN

SEQ ID NO: 2202061 - protein, 15 aa, Cryptosporidium hominis
GDPPRKRKLPTDEDG

SEQ ID NO: 2202062 - protein, 7 aa, Cryptosporidium hominis
GDPSAIQ

SEQ ID NO: 2202063 - protein, 9 aa, Cryptosporidium hominis
GDSGPPPKV

SEQ ID NO: 2202064 - protein, 18 aa, Cryptosporidium hominis
GDVSEGPRSSSASSIQPD

SEQ ID NO: 2202065 - protein, 4 aa, Cryptosporidium hominis
GDYK

SEQ ID NO: 2202066 - protein, 4 aa, Cryptosporidium hominis
GEAN

SEQ ID NO: 2202067 - protein, 8 aa, Cryptosporidium hominis
GECKPGKC

SEQ ID NO: 2202068 - protein, 6 aa, Cryptosporidium hominis
GEDFGN

SEQ ID NO: 2202069 - protein, 5 aa, Cryptosporidium hominis
GEDGL

SEQ ID NO: 2202070 - protein, 8 aa, Cryptosporidium hominis
GEDHRSPH

SEQ ID NO: 2202071 - protein, 7 aa, Cryptosporidium hominis
GEEGAET

SEQ ID NO: 2202072 - protein, 11 aa, Cryptosporidium hominis
GEEKTFDNTKT

SEQ ID NO: 2202073 - protein, 29 aa, Cryptosporidium hominis
GEEPTDGDSATSQPSSEDTESEQNGSNGR

SEQ ID NO: 2202074 - protein, 8 aa, Cryptosporidium hominis
GEESEDLY

SEQ ID NO: 2202075 - protein, 19 aa, Cryptosporidium hominis
GEGKSQTSQKDSEKLYSEA

SEQ ID NO: 2202076 - protein, 22 aa, Cryptosporidium hominis
GEGRISSEEYPSGLDKNKQDEH

SEQ ID NO: 2202077 - protein, 5 aa, Cryptosporidium hominis
GEITE

SEQ ID NO: 2202078 - protein, 5 aa, Cryptosporidium hominis
GEKEL

SEQ ID NO: 2202079 - protein, 8 aa, Cryptosporidium hominis
GEKSVRNL

SEQ ID NO: 2202080 - protein, 12 aa, Cryptosporidium hominis
GELQSANKDTIK

SEQ ID NO: 2202081 - protein, 4 aa, Cryptosporidium hominis
GENQ

SEQ ID NO: 2202082 - protein, 7 aa, Cryptosporidium hominis
GENQNER

SEQ ID NO: 2202083 - protein, 11 aa, Cryptosporidium hominis
GENTNKNDMSE

SEQ ID NO: 2202084 - protein, 6 aa, Cryptosporidium hominis
GERSTF

SEQ ID NO: 2202085 - protein, 7 aa, Cryptosporidium hominis
GESDNGK

SEQ ID NO: 2202086 - protein, 33 aa, Cryptosporidium hominis
GESESPNNNRDKETEFNQKDDEPYTSGQDYSSG

SEQ ID NO: 2202087 - protein, 11 aa, Cryptosporidium hominis
GESSRESSESS

SEQ ID NO: 2202088 - protein, 5 aa, Cryptosporidium hominis
GETAK

SEQ ID NO: 2202089 - protein, 23 aa, Cryptosporidium hominis
GETFKESDNTYYSKIGKSPENIA

SEQ ID NO: 2202090 - protein, 7 aa, Cryptosporidium hominis
GETQPKP

SEQ ID NO: 2202091 - protein, 13 aa, Cryptosporidium hominis
GFEDSDPSSMDET

SEQ ID NO: 2202092 - protein, 8 aa, Cryptosporidium hominis
GFPSPDRD

SEQ ID NO: 2202093 - protein, 19 aa, Cryptosporidium hominis
GFPTGGYESTSNSKDNNGF

SEQ ID NO: 2202094 - protein, 7 aa, Cryptosporidium hominis
GFPTNDK

SEQ ID NO: 2202095 - protein, 6 aa, Cryptosporidium hominis
GFQDSN

SEQ ID NO: 2202096 - protein, 8 aa, Cryptosporidium hominis
GFRNSESI

SEQ ID NO: 2202097 - protein, 9 aa, Cryptosporidium hominis
GFSAREGSL

SEQ ID NO: 2202098 - protein, 12 aa, Cryptosporidium hominis
GFSNKKQKQKFH

SEQ ID NO: 2202099 - protein, 11 aa, Cryptosporidium hominis
GFSSSKPIQPI

SEQ ID NO: 2202100 - protein, 5 aa, Cryptosporidium hominis
GFSYP

SEQ ID NO: 2202101 - protein, 10 aa, Cryptosporidium hominis
GFTPGGSSRI

SEQ ID NO: 2202102 - protein, 11 aa, Cryptosporidium hominis
GGAANAYTSAD

SEQ ID NO: 2202103 - protein, 18 aa, Cryptosporidium hominis
GGDDEDQQQPIEIGPPTN

SEQ ID NO: 2202104 - protein, 10 aa, Cryptosporidium hominis
GGDLPPDNNY

SEQ ID NO: 2202105 - protein, 13 aa, Cryptosporidium hominis
GGEGDDIKGIETS

SEQ ID NO: 2202106 - protein, 6 aa, Cryptosporidium hominis
GGEGIN

SEQ ID NO: 2202107 - protein, 8 aa, Cryptosporidium hominis
GGEKSTSI

SEQ ID NO: 2202108 - protein, 7 aa, Cryptosporidium hominis
GGGASIN

SEQ ID NO: 2202109 - protein, 12 aa, Cryptosporidium hominis
GGISQNEPQNLR

SEQ ID NO: 2202110 - protein, 8 aa, Cryptosporidium hominis
GGKPIELK

SEQ ID NO: 2202111 - protein, 10 aa, Cryptosporidium hominis
GGKTTYSSQP

SEQ ID NO: 2202112 - protein, 8 aa, Cryptosporidium hominis
GGKVGGSV

SEQ ID NO: 2202113 - protein, 10 aa, Cryptosporidium hominis
GGKYKEKKRF

SEQ ID NO: 2202114 - protein, 6 aa, Cryptosporidium hominis
GGKYPA

SEQ ID NO: 2202115 - protein, 11 aa, Cryptosporidium hominis
GGNEDYSYNSQ

SEQ ID NO: 2202116 - protein, 5 aa, Cryptosporidium hominis
GGNGI

SEQ ID NO: 2202117 - protein, 7 aa, Cryptosporidium hominis
GGNPGSY

SEQ ID NO: 2202118 - protein, 33 aa, Cryptosporidium hominis
GGPFGFGGGGGGRRQGGNSRSHFESQGSSYNNL

SEQ ID NO: 2202119 - protein, 13 aa, Cryptosporidium hominis
GGPFGSMGGPMGP

SEQ ID NO: 2202120 - protein, 5 aa, Cryptosporidium hominis
GGQGT

SEQ ID NO: 2202121 - protein, 9 aa, Cryptosporidium hominis
GGQITSKTN

SEQ ID NO: 2202122 - protein, 11 aa, Cryptosporidium hominis
GGRPSIPETVP

SEQ ID NO: 2202123 - protein, 10 aa, Cryptosporidium hominis
GGRQYDEDKR

SEQ ID NO: 2202124 - protein, 18 aa, Cryptosporidium hominis
GGSCPTDINRTGGISKED

SEQ ID NO: 2202125 - protein, 9 aa, Cryptosporidium hominis
GGSGESSGY

SEQ ID NO: 2202126 - protein, 17 aa, Cryptosporidium hominis
GGSGGMAAAKEAAKYGK

SEQ ID NO: 2202127 - protein, 7 aa, Cryptosporidium hominis
GGSNRGA

SEQ ID NO: 2202128 - protein, 14 aa, Cryptosporidium hominis
GGTNNENLSPNMHS

SEQ ID NO: 2202129 - protein, 7 aa, Cryptosporidium hominis
GGTRGLN

SEQ ID NO: 2202130 - protein, 10 aa, Cryptosporidium hominis
GGTSKDGKSF

SEQ ID NO: 2202131 - protein, 5 aa, Cryptosporidium hominis
GGTTR

SEQ ID NO: 2202132 - protein, 8 aa, Cryptosporidium hominis
GGVPNSES

SEQ ID NO: 2202133 - protein, 14 aa, Cryptosporidium hominis
GGYESRKASNLEEQ

SEQ ID NO: 2202134 - protein, 7 aa, Cryptosporidium hominis
GGYNEDE

SEQ ID NO: 2202135 - protein, 4 aa, Cryptosporidium hominis
GGYT

SEQ ID NO: 2202136 - protein, 6 aa, Cryptosporidium hominis
GHCEKG

SEQ ID NO: 2202137 - protein, 8 aa, Cryptosporidium hominis
GHGGPLTH

SEQ ID NO: 2202138 - protein, 7 aa, Cryptosporidium hominis
GHGKRNG

SEQ ID NO: 2202139 - protein, 4 aa, Cryptosporidium hominis
GHGT

SEQ ID NO: 2202140 - protein, 9 aa, Cryptosporidium hominis
GHKASGASQ

SEQ ID NO: 2202141 - protein, 5 aa, Cryptosporidium hominis
GIADD

SEQ ID NO: 2202142 - protein, 4 aa, Cryptosporidium hominis
GIPN

SEQ ID NO: 2202143 - protein, 5 aa, Cryptosporidium hominis
GIPPS

SEQ ID NO: 2202144 - protein, 13 aa, Cryptosporidium hominis
GIPQGQENQTSHD

SEQ ID NO: 2202145 - protein, 6 aa, Cryptosporidium hominis
GIPSEK

SEQ ID NO: 2202146 - protein, 12 aa, Cryptosporidium hominis
GIQEKNETKEYY

SEQ ID NO: 2202147 - protein, 20 aa, Cryptosporidium hominis
GIQSRSIETSASKSKIRGSD

SEQ ID NO: 2202148 - protein, 16 aa, Cryptosporidium hominis
GISNDLSSLTSNSVSK

SEQ ID NO: 2202149 - protein, 4 aa, Cryptosporidium hominis
GITG

SEQ ID NO: 2202150 - protein, 8 aa, Cryptosporidium hominis
GITSTVGS

SEQ ID NO: 2202151 - protein, 6 aa, Cryptosporidium hominis
GITYPN

SEQ ID NO: 2202152 - protein, 12 aa, Cryptosporidium hominis
GIVEKSSSIDTK

SEQ ID NO: 2202153 - protein, 7 aa, Cryptosporidium hominis
GKDAENE

SEQ ID NO: 2202154 - protein, 11 aa, Cryptosporidium hominis
GKDESSNKEIT

SEQ ID NO: 2202155 - protein, 8 aa, Cryptosporidium hominis
GKEGSSDL

SEQ ID NO: 2202156 - protein, 15 aa, Cryptosporidium hominis
GKGEYQLPSAEKTYQ

SEQ ID NO: 2202157 - protein, 4 aa, Cryptosporidium hominis
GKGK

SEQ ID NO: 2202158 - protein, 13 aa, Cryptosporidium hominis
GKGNEKERLTSQS

SEQ ID NO: 2202159 - protein, 5 aa, Cryptosporidium hominis
GKIHD

SEQ ID NO: 2202160 - protein, 8 aa, Cryptosporidium hominis
GKIYERDG

SEQ ID NO: 2202161 - protein, 7 aa, Cryptosporidium hominis
GKKEKEM

SEQ ID NO: 2202162 - protein, 12 aa, Cryptosporidium hominis
GKKKPNPSEKKI

SEQ ID NO: 2202163 - protein, 11 aa, Cryptosporidium hominis
GKKKSKSTEIR

SEQ ID NO: 2202164 - protein, 7 aa, Cryptosporidium hominis
GKLGYSN

SEQ ID NO: 2202165 - protein, 7 aa, Cryptosporidium hominis
GKLNERQ

SEQ ID NO: 2202166 - protein, 6 aa, Cryptosporidium hominis
GKLNNE

SEQ ID NO: 2202167 - protein, 6 aa, Cryptosporidium hominis
GKMRNR

SEQ ID NO: 2202168 - protein, 6 aa, Cryptosporidium hominis
GKNDAL

SEQ ID NO: 2202169 - protein, 10 aa, Cryptosporidium hominis
GKNNNSPHEF

SEQ ID NO: 2202170 - protein, 11 aa, Cryptosporidium hominis
GKNTDKSSEVL

SEQ ID NO: 2202171 - protein, 16 aa, Cryptosporidium hominis
GKNTEMECTAQNSENF

SEQ ID NO: 2202172 - protein, 5 aa, Cryptosporidium hominis
GKPIP

SEQ ID NO: 2202173 - protein, 9 aa, Cryptosporidium hominis
GKPNCKKPD

SEQ ID NO: 2202174 - protein, 22 aa, Cryptosporidium hominis
GKQCTATKTASQQPSCPPGTTL

SEQ ID NO: 2202175 - protein, 12 aa, Cryptosporidium hominis
GKSEHKSIPRSV

SEQ ID NO: 2202176 - protein, 11 aa, Cryptosporidium hominis
GKSPAAQSSQY

SEQ ID NO: 2202177 - protein, 7 aa, Cryptosporidium hominis
GKSRDEF

SEQ ID NO: 2202178 - protein, 9 aa, Cryptosporidium hominis
GKSTEGISE

SEQ ID NO: 2202179 - protein, 4 aa, Cryptosporidium hominis
GKTL

SEQ ID NO: 2202180 - protein, 7 aa, Cryptosporidium hominis
GKTTARD

SEQ ID NO: 2202181 - protein, 20 aa, Cryptosporidium hominis
GKVTPKAHRSKIPVKDEQET

SEQ ID NO: 2202182 - protein, 11 aa, Cryptosporidium hominis
GKYDPRASQRY

SEQ ID NO: 2202183 - protein, 4 aa, Cryptosporidium hominis
GKYS

SEQ ID NO: 2202184 - protein, 6 aa, Cryptosporidium hominis
GKYSSK

SEQ ID NO: 2202185 - protein, 4 aa, Cryptosporidium hominis
GKYY

SEQ ID NO: 2202186 - protein, 11 aa, Cryptosporidium hominis
GLENNDENVEN

SEQ ID NO: 2202187 - protein, 5 aa, Cryptosporidium hominis
GLESD

SEQ ID NO: 2202188 - protein, 16 aa, Cryptosporidium hominis
GLESRAKPEHCEPGGR

SEQ ID NO: 2202189 - protein, 10 aa, Cryptosporidium hominis
GLGTAARKVH

SEQ ID NO: 2202190 - protein, 8 aa, Cryptosporidium hominis
GLNTPIDS

SEQ ID NO: 2202191 - protein, 7 aa, Cryptosporidium hominis
GLPTTNE

SEQ ID NO: 2202192 - protein, 11 aa, Cryptosporidium hominis
GLQLTSPSPRL

SEQ ID NO: 2202193 - protein, 6 aa, Cryptosporidium hominis
GLRDHP

SEQ ID NO: 2202194 - protein, 15 aa, Cryptosporidium hominis
GLRGGENAGFVPTPK

SEQ ID NO: 2202195 - protein, 4 aa, Cryptosporidium hominis
GLSD

SEQ ID NO: 2202196 - protein, 4 aa, Cryptosporidium hominis
GLSE

SEQ ID NO: 2202197 - protein, 4 aa, Cryptosporidium hominis
GLSK

SEQ ID NO: 2202198 - protein, 8 aa, Cryptosporidium hominis
GLSSQNST

SEQ ID NO: 2202199 - protein, 6 aa, Cryptosporidium hominis
GLSYQG

SEQ ID NO: 2202200 - protein, 12 aa, Cryptosporidium hominis
GLTEGSNKADIR

SEQ ID NO: 2202201 - protein, 5 aa, Cryptosporidium hominis
GLTQD

SEQ ID NO: 2202202 - protein, 28 aa, Cryptosporidium hominis
GMDPNDPISEPKTDPKGSTVPSQTPVQA

SEQ ID NO: 2202203 - protein, 6 aa, Cryptosporidium hominis
GMDSSS

SEQ ID NO: 2202204 - protein, 30 aa, Cryptosporidium hominis
GMSESDKAPFQKQADADKKRYEREKAQMAG

SEQ ID NO: 2202205 - protein, 7 aa, Cryptosporidium hominis
GMTPGDA

SEQ ID NO: 2202206 - protein, 25 aa, Cryptosporidium hominis
GMYPSPSEIEKYGQNTEVSDPKEEK

SEQ ID NO: 2202207 - protein, 20 aa, Cryptosporidium hominis
GNAHSRNPSAELTNRKLSEA

SEQ ID NO: 2202208 - protein, 14 aa, Cryptosporidium hominis
GNAYQSDLSDDSDI

SEQ ID NO: 2202209 - protein, 16 aa, Cryptosporidium hominis
GNCSAKDGDNETTKGE

SEQ ID NO: 2202210 - protein, 14 aa, Cryptosporidium hominis
GNDNSKVASIRPGR

SEQ ID NO: 2202211 - protein, 6 aa, Cryptosporidium hominis
GNDTPN

SEQ ID NO: 2202212 - protein, 5 aa, Cryptosporidium hominis
GNENI

SEQ ID NO: 2202213 - protein, 8 aa, Cryptosporidium hominis
GNENREKY

SEQ ID NO: 2202214 - protein, 13 aa, Cryptosporidium hominis
GNESDFKTERISS

SEQ ID NO: 2202215 - protein, 8 aa, Cryptosporidium hominis
GNESDLSS

SEQ ID NO: 2202216 - protein, 7 aa, Cryptosporidium hominis
GNETRDS

SEQ ID NO: 2202217 - protein, 23 aa, Cryptosporidium hominis
GNGDDDDEDDDIEEDEDNDQDFD

SEQ ID NO: 2202218 - protein, 9 aa, Cryptosporidium hominis
GNGEEVKDL

SEQ ID NO: 2202219 - protein, 19 aa, Cryptosporidium hominis
GNGESSKDEKFLSNGESDP

SEQ ID NO: 2202220 - protein, 5 aa, Cryptosporidium hominis
GNGGG

SEQ ID NO: 2202221 - protein, 13 aa, Cryptosporidium hominis
GNGGISKLERGTS

SEQ ID NO: 2202222 - protein, 309 aa, Cryptosporidium hominis
GNGGKKPKPVLSSSRSSSSCNSSSSRKGKADVDSGSKKTGKGSTGPGGACGTSRGPNKADKTRKLGTTGKGRDTASGPSGTGGRLGRTPNGSGGRGNAPSSTSRGPGNASRGPSSASRGPSGAPSSAPSSTPSSTPSSTPSGLGGKGGAPSSAPSSAPSSAPSSAPSSAPSGLSSTPSGLSNTPSGPSSTPSSTGSAPTGAGKVSTTGGSSSSPSAPSGTGSLGGIGGSATSSGAGGSGSGAGGSSGGRGGGGRRGGGGGGGGGGGRRRRGRGDGKEEGSEDKDTDDDESGNGEDSDTSSSSSGSRKEE

SEQ ID NO: 2202223 - protein, 6 aa, Cryptosporidium hominis
GNGRNV

SEQ ID NO: 2202224 - protein, 6 aa, Cryptosporidium hominis
GNIGDD

SEQ ID NO: 2202225 - protein, 14 aa, Cryptosporidium hominis
GNKKKQKCYSNPND

SEQ ID NO: 2202226 - protein, 8 aa, Cryptosporidium hominis
GNLTELNK

SEQ ID NO: 2202227 - protein, 11 aa, Cryptosporidium hominis
GNNKDDDSLRS

SEQ ID NO: 2202228 - protein, 4 aa, Cryptosporidium hominis
GNNS

SEQ ID NO: 2202229 - protein, 8 aa, Cryptosporidium hominis
GNPRFTGG

SEQ ID NO: 2202230 - protein, 8 aa, Cryptosporidium hominis
GNPTTGYS

SEQ ID NO: 2202231 - protein, 5 aa, Cryptosporidium hominis
GNPYP

SEQ ID NO: 2202232 - protein, 9 aa, Cryptosporidium hominis
GNQTNEDHY

SEQ ID NO: 2202233 - protein, 6 aa, Cryptosporidium hominis
GNSEGN

SEQ ID NO: 2202234 - protein, 6 aa, Cryptosporidium hominis
GNSIGQ

SEQ ID NO: 2202235 - protein, 17 aa, Cryptosporidium hominis
GNSNNNYTSTSRAIGTE

SEQ ID NO: 2202236 - protein, 6 aa, Cryptosporidium hominis
GNSYPS

SEQ ID NO: 2202237 - protein, 16 aa, Cryptosporidium hominis
GNTVQSDARNYDSAKR

SEQ ID NO: 2202238 - protein, 15 aa, Cryptosporidium hominis
GNYGEGRPHPTLGPT

SEQ ID NO: 2202239 - protein, 6 aa, Cryptosporidium hominis
GPAERL

SEQ ID NO: 2202240 - protein, 7 aa, Cryptosporidium hominis
GPDYTDN

SEQ ID NO: 2202241 - protein, 6 aa, Cryptosporidium hominis
GPECRT

SEQ ID NO: 2202242 - protein, 15 aa, Cryptosporidium hominis
GPFGTSGSGAGGGAV

SEQ ID NO: 2202243 - protein, 42 aa, Cryptosporidium hominis
GPIGGPLGSMGGQMGGPIGSSMGPMGGPLGSMGGQMGPMGPI

SEQ ID NO: 2202244 - protein, 11 aa, Cryptosporidium hominis
GPITKSGPMET

SEQ ID NO: 2202245 - protein, 8 aa, Cryptosporidium hominis
GPKAGEAM

SEQ ID NO: 2202246 - protein, 11 aa, Cryptosporidium hominis
GPKSKRNSKYQ

SEQ ID NO: 2202247 - protein, 7 aa, Cryptosporidium hominis
GPLETGE

SEQ ID NO: 2202248 - protein, 9 aa, Cryptosporidium hominis
GPNGTKNNA

SEQ ID NO: 2202249 - protein, 4 aa, Cryptosporidium hominis
GPNL

SEQ ID NO: 2202250 - protein, 8 aa, Cryptosporidium hominis
GPQHPPHD

SEQ ID NO: 2202251 - protein, 9 aa, Cryptosporidium hominis
GPSQTLNYT

SEQ ID NO: 2202252 - protein, 4 aa, Cryptosporidium hominis
GPTS

SEQ ID NO: 2202253 - protein, 5 aa, Cryptosporidium hominis
GPTVG

SEQ ID NO: 2202254 - protein, 4 aa, Cryptosporidium hominis
GPVI

SEQ ID NO: 2202255 - protein, 4 aa, Cryptosporidium hominis
GPYI

SEQ ID NO: 2202256 - protein, 6 aa, Cryptosporidium hominis
GPYKPF

SEQ ID NO: 2202257 - protein, 7 aa, Cryptosporidium hominis
GQCDPNC

SEQ ID NO: 2202258 - protein, 18 aa, Cryptosporidium hominis
GQNSPITGSSEHSPRGTF

SEQ ID NO: 2202259 - protein, 11 aa, Cryptosporidium hominis
GQREKKTTEDK

SEQ ID NO: 2202260 - protein, 11 aa, Cryptosporidium hominis
GQRNKTEMKDP

SEQ ID NO: 2202261 - protein, 4 aa, Cryptosporidium hominis
GQYQ

SEQ ID NO: 2202262 - protein, 8 aa, Cryptosporidium hominis
GRAPVDPL

SEQ ID NO: 2202263 - protein, 4 aa, Cryptosporidium hominis
GREP

SEQ ID NO: 2202264 - protein, 6 aa, Cryptosporidium hominis
GREQSF

SEQ ID NO: 2202265 - protein, 35 aa, Cryptosporidium hominis
GREYKENELNDEKQTKDNKKNNNENNKKLNSSYNP

SEQ ID NO: 2202266 - protein, 4 aa, Cryptosporidium hominis
GRGF

SEQ ID NO: 2202267 - protein, 8 aa, Cryptosporidium hominis
GRGPSSES

SEQ ID NO: 2202268 - protein, 4 aa, Cryptosporidium hominis
GRGT

SEQ ID NO: 2202269 - protein, 11 aa, Cryptosporidium hominis
GRNPRNPNSYN

SEQ ID NO: 2202270 - protein, 16 aa, Cryptosporidium hominis
GRNTDDSSEFSPPFSQ

SEQ ID NO: 2202271 - protein, 5 aa, Cryptosporidium hominis
GRPIR

SEQ ID NO: 2202272 - protein, 6 aa, Cryptosporidium hominis
GRQPDG

SEQ ID NO: 2202273 - protein, 21 aa, Cryptosporidium hominis
GRRAVSQGSINRGTLPSRKAY

SEQ ID NO: 2202274 - protein, 21 aa, Cryptosporidium hominis
GRRGGKGKWSNGIGGLPSPRI

SEQ ID NO: 2202275 - protein, 13 aa, Cryptosporidium hominis
GRSKTKKNNLTNL

SEQ ID NO: 2202276 - protein, 5 aa, Cryptosporidium hominis
GRSMT

SEQ ID NO: 2202277 - protein, 10 aa, Cryptosporidium hominis
GRSSEKGDRH

SEQ ID NO: 2202278 - protein, 11 aa, Cryptosporidium hominis
GRTVGSCSSDY

SEQ ID NO: 2202279 - protein, 46 aa, Cryptosporidium hominis
GSAGEKSSMFPSNEESTSASGEDLAGISSDSEVTSSLGSGIEGSNL

SEQ ID NO: 2202280 - protein, 12 aa, Cryptosporidium hominis
GSCHSGSCSSTK

SEQ ID NO: 2202281 - protein, 7 aa, Cryptosporidium hominis
GSDFSDS

SEQ ID NO: 2202282 - protein, 9 aa, Cryptosporidium hominis
GSDGKTYTN

SEQ ID NO: 2202283 - protein, 9 aa, Cryptosporidium hominis
GSDSPQSTR

SEQ ID NO: 2202284 - protein, 9 aa, Cryptosporidium hominis
GSDSQSGVF

SEQ ID NO: 2202285 - protein, 8 aa, Cryptosporidium hominis
GSECTPAK

SEQ ID NO: 2202286 - protein, 23 aa, Cryptosporidium hominis
GSESYPSQSQMEPSNSSSYANSA

SEQ ID NO: 2202287 - protein, 14 aa, Cryptosporidium hominis
GSETKFSVSTSECE

SEQ ID NO: 2202288 - protein, 9 aa, Cryptosporidium hominis
GSETNKTLG

SEQ ID NO: 2202289 - protein, 12 aa, Cryptosporidium hominis
GSETSLPASTAI

SEQ ID NO: 2202290 - protein, 8 aa, Cryptosporidium hominis
GSEVPPSG

SEQ ID NO: 2202291 - protein, 9 aa, Cryptosporidium hominis
GSFESKSVD

SEQ ID NO: 2202292 - protein, 4 aa, Cryptosporidium hominis
GSGA

SEQ ID NO: 2202293 - protein, 6 aa, Cryptosporidium hominis
GSGEDL

SEQ ID NO: 2202294 - protein, 6 aa, Cryptosporidium hominis
GSGGAS

SEQ ID NO: 2202295 - protein, 6 aa, Cryptosporidium hominis
GSGGNI

SEQ ID NO: 2202296 - protein, 7 aa, Cryptosporidium hominis
GSGLYQK

SEQ ID NO: 2202297 - protein, 14 aa, Cryptosporidium hominis
GSGRGDGERYRVPD

SEQ ID NO: 2202298 - protein, 5 aa, Cryptosporidium hominis
GSGSP

SEQ ID NO: 2202299 - protein, 8 aa, Cryptosporidium hominis
GSGSTVST

SEQ ID NO: 2202300 - protein, 10 aa, Cryptosporidium hominis
GSGTITGLGP

SEQ ID NO: 2202301 - protein, 17 aa, Cryptosporidium hominis
GSGVPNKNTQNLQPSLA

SEQ ID NO: 2202302 - protein, 52 aa, Cryptosporidium hominis
GSHSLSSNIPRSTPIPVPAESEPTASYQNDEEDHEYSDSEDSDYGQESSRDE

SEQ ID NO: 2202303 - protein, 5 aa, Cryptosporidium hominis
GSIPK

SEQ ID NO: 2202304 - protein, 6 aa, Cryptosporidium hominis
GSITET

SEQ ID NO: 2202305 - protein, 7 aa, Cryptosporidium hominis
GSKENSA

SEQ ID NO: 2202306 - protein, 5 aa, Cryptosporidium hominis
GSKHE

SEQ ID NO: 2202307 - protein, 7 aa, Cryptosporidium hominis
GSKKINV

SEQ ID NO: 2202308 - protein, 6 aa, Cryptosporidium hominis
GSKPGL

SEQ ID NO: 2202309 - protein, 7 aa, Cryptosporidium hominis
GSKSKNF

SEQ ID NO: 2202310 - protein, 17 aa, Cryptosporidium hominis
GSKYRGLPKAHQNERGN

SEQ ID NO: 2202311 - protein, 16 aa, Cryptosporidium hominis
GSNEEELKKRSSEIDQ

SEQ ID NO: 2202312 - protein, 9 aa, Cryptosporidium hominis
GSNESNSEY

SEQ ID NO: 2202313 - protein, 7 aa, Cryptosporidium hominis
GSNSEQL

SEQ ID NO: 2202314 - protein, 5 aa, Cryptosporidium hominis
GSNVN

SEQ ID NO: 2202315 - protein, 16 aa, Cryptosporidium hominis
GSPDSEYSAADAPKGY

SEQ ID NO: 2202316 - protein, 7 aa, Cryptosporidium hominis
GSPGTAM

SEQ ID NO: 2202317 - protein, 8 aa, Cryptosporidium hominis
GSPIEPST

SEQ ID NO: 2202318 - protein, 14 aa, Cryptosporidium hominis
GSPMGPMGSPMGPM

SEQ ID NO: 2202319 - protein, 4 aa, Cryptosporidium hominis
GSPN

SEQ ID NO: 2202320 - protein, 5 aa, Cryptosporidium hominis
GSQFD

SEQ ID NO: 2202321 - protein, 4 aa, Cryptosporidium hominis
GSQH

SEQ ID NO: 2202322 - protein, 6 aa, Cryptosporidium hominis
GSQSER

SEQ ID NO: 2202323 - protein, 9 aa, Cryptosporidium hominis
GSRPKLQSG

SEQ ID NO: 2202324 - protein, 7 aa, Cryptosporidium hominis
GSRTEFT

SEQ ID NO: 2202325 - protein, 6 aa, Cryptosporidium hominis
GSSARQ

SEQ ID NO: 2202326 - protein, 23 aa, Cryptosporidium hominis
GSSGSSNGKLRASRNNTSKEENS

SEQ ID NO: 2202327 - protein, 16 aa, Cryptosporidium hominis
GSSSTVSSHSPSRETL

SEQ ID NO: 2202328 - protein, 4 aa, Cryptosporidium hominis
GSST

SEQ ID NO: 2202329 - protein, 8 aa, Cryptosporidium hominis
GSTKNRMK

SEQ ID NO: 2202330 - protein, 14 aa, Cryptosporidium hominis
GSVEKQPISRNLPG

SEQ ID NO: 2202331 - protein, 13 aa, Cryptosporidium hominis
GSVSSKSVKMPST

SEQ ID NO: 2202332 - protein, 5 aa, Cryptosporidium hominis
GSYPS

SEQ ID NO: 2202333 - protein, 11 aa, Cryptosporidium hominis
GSYSGRTSKRI

SEQ ID NO: 2202334 - protein, 26 aa, Cryptosporidium hominis
GTCGALEGKAKSKVKSKKKGGGRKKL

SEQ ID NO: 2202335 - protein, 9 aa, Cryptosporidium hominis
GTDGTLSAV

SEQ ID NO: 2202336 - protein, 9 aa, Cryptosporidium hominis
GTEACNKGK

SEQ ID NO: 2202337 - protein, 10 aa, Cryptosporidium hominis
GTEDSTSDLS

SEQ ID NO: 2202338 - protein, 7 aa, Cryptosporidium hominis
GTELSHS

SEQ ID NO: 2202339 - protein, 43 aa, Cryptosporidium hominis
GTESESEIENETDDSQQPLNEADKSSDPRDSGSEIVPEQEEEN

SEQ ID NO: 2202340 - protein, 12 aa, Cryptosporidium hominis
GTLSSVKGREQL

SEQ ID NO: 2202341 - protein, 4 aa, Cryptosporidium hominis
GTNR

SEQ ID NO: 2202342 - protein, 8 aa, Cryptosporidium hominis
GTPIPTPN

SEQ ID NO: 2202343 - protein, 6 aa, Cryptosporidium hominis
GTPSFD

SEQ ID NO: 2202344 - protein, 4 aa, Cryptosporidium hominis
GTPT

SEQ ID NO: 2202345 - protein, 25 aa, Cryptosporidium hominis
GTQRTSLNSKVNSSNGSINSQASNL

SEQ ID NO: 2202346 - protein, 15 aa, Cryptosporidium hominis
GTRISGKTKEERRQN

SEQ ID NO: 2202347 - protein, 14 aa, Cryptosporidium hominis
GTRTPIPYDGKRTV

SEQ ID NO: 2202348 - protein, 9 aa, Cryptosporidium hominis
GTSFEGRPI

SEQ ID NO: 2202349 - protein, 8 aa, Cryptosporidium hominis
GTSGTDII

SEQ ID NO: 2202350 - protein, 9 aa, Cryptosporidium hominis
GTSLSGKVP

SEQ ID NO: 2202351 - protein, 8 aa, Cryptosporidium hominis
GTSTLSHS

SEQ ID NO: 2202352 - protein, 10 aa, Cryptosporidium hominis
GTTENKGPRE

SEQ ID NO: 2202353 - protein, 6 aa, Cryptosporidium hominis
GTTERI

SEQ ID NO: 2202354 - protein, 5 aa, Cryptosporidium hominis
GTVTP

SEQ ID NO: 2202355 - protein, 6 aa, Cryptosporidium hominis
GTYRST

SEQ ID NO: 2202356 - protein, 14 aa, Cryptosporidium hominis
GVAESSEEANEQEM

SEQ ID NO: 2202357 - protein, 7 aa, Cryptosporidium hominis
GVDGSEV

SEQ ID NO: 2202358 - protein, 15 aa, Cryptosporidium hominis
GVETGKKKRPKTTKY

SEQ ID NO: 2202359 - protein, 19 aa, Cryptosporidium hominis
GVETKSDKTLSIGDPEESI

SEQ ID NO: 2202360 - protein, 10 aa, Cryptosporidium hominis
GVKGKSKEKN

SEQ ID NO: 2202361 - protein, 25 aa, Cryptosporidium hominis
GVKNGGASTKSCKDFGGEDVCGSEQ

SEQ ID NO: 2202362 - protein, 10 aa, Cryptosporidium hominis
GVKPEDETIK

SEQ ID NO: 2202363 - protein, 11 aa, Cryptosporidium hominis
GVPGIPPALGS

SEQ ID NO: 2202364 - protein, 15 aa, Cryptosporidium hominis
GVQGTASSKEGLNSE

SEQ ID NO: 2202365 - protein, 9 aa, Cryptosporidium hominis
GVRPSTVTP

SEQ ID NO: 2202366 - protein, 18 aa, Cryptosporidium hominis
GVSDSRKDTGARASGPDF

SEQ ID NO: 2202367 - protein, 13 aa, Cryptosporidium hominis
GVSRTRSDDTSKI

SEQ ID NO: 2202368 - protein, 10 aa, Cryptosporidium hominis
GVSTTPSPDP

SEQ ID NO: 2202369 - protein, 7 aa, Cryptosporidium hominis
GYDGKPV

SEQ ID NO: 2202370 - protein, 6 aa, Cryptosporidium hominis
GYEETK

SEQ ID NO: 2202371 - protein, 9 aa, Cryptosporidium hominis
GYEKSKNAY

SEQ ID NO: 2202372 - protein, 6 aa, Cryptosporidium hominis
GYEQGT

SEQ ID NO: 2202373 - protein, 6 aa, Cryptosporidium hominis
GYGRTK

SEQ ID NO: 2202374 - protein, 10 aa, Cryptosporidium hominis
GYKITGANNQ

SEQ ID NO: 2202375 - protein, 7 aa, Cryptosporidium hominis
GYNPEGA

SEQ ID NO: 2202376 - protein, 12 aa, Cryptosporidium hominis
HAHHNNESNNQH

SEQ ID NO: 2202377 - protein, 7 aa, Cryptosporidium hominis
HAQRTRE

SEQ ID NO: 2202378 - protein, 8 aa, Cryptosporidium hominis
HARIPSSE

SEQ ID NO: 2202379 - protein, 10 aa, Cryptosporidium hominis
HCPENNQKRS

SEQ ID NO: 2202380 - protein, 13 aa, Cryptosporidium hominis
HCTGGSCSPAKVR

SEQ ID NO: 2202381 - protein, 16 aa, Cryptosporidium hominis
HDEKLQSEYSPKNQEE

SEQ ID NO: 2202382 - protein, 4 aa, Cryptosporidium hominis
HDHY

SEQ ID NO: 2202383 - protein, 14 aa, Cryptosporidium hominis
HDSLEEKLSSQEVV

SEQ ID NO: 2202384 - protein, 8 aa, Cryptosporidium hominis
HEATESPL

SEQ ID NO: 2202385 - protein, 9 aa, Cryptosporidium hominis
HEDPNKSSK

SEQ ID NO: 2202386 - protein, 10 aa, Cryptosporidium hominis
HEEDPNNIKD

SEQ ID NO: 2202387 - protein, 13 aa, Cryptosporidium hominis
HEGSESSEAEEIE

SEQ ID NO: 2202388 - protein, 8 aa, Cryptosporidium hominis
HEHENQSF

SEQ ID NO: 2202389 - protein, 31 aa, Cryptosporidium hominis
HEKALEKEKEMRHSGATTSSGLKPASPIQQG

SEQ ID NO: 2202390 - protein, 38 aa, Cryptosporidium hominis
HENEGNYKSKTSSVQKDEESFSDSTVATEGDEGSEEEQ

SEQ ID NO: 2202391 - protein, 20 aa, Cryptosporidium hominis
HENLTANSSISNGTKTSNIL

SEQ ID NO: 2202392 - protein, 48 aa, Cryptosporidium hominis
HENSDSKLSSGNSSGFECPKDEPGSNSRLARPAIKTGGASSRGGENTD

SEQ ID NO: 2202393 - protein, 5 aa, Cryptosporidium hominis
HEPEN

SEQ ID NO: 2202394 - protein, 5 aa, Cryptosporidium hominis
HESNS

SEQ ID NO: 2202395 - protein, 5 aa, Cryptosporidium hominis
HGHSH

SEQ ID NO: 2202396 - protein, 20 aa, Cryptosporidium hominis
HGKNDSLNLSEETNQSWDNM

SEQ ID NO: 2202397 - protein, 16 aa, Cryptosporidium hominis
HGNPSNILGSELFSID

SEQ ID NO: 2202398 - protein, 12 aa, Cryptosporidium hominis
HGPETKKTSLSR

SEQ ID NO: 2202399 - protein, 9 aa, Cryptosporidium hominis
HGSSKQRKE

SEQ ID NO: 2202400 - protein, 4 aa, Cryptosporidium hominis
HHQS

SEQ ID NO: 2202401 - protein, 6 aa, Cryptosporidium hominis
HKAKVG

SEQ ID NO: 2202402 - protein, 46 aa, Cryptosporidium hominis
HKASANRNSTGGNSLSRDKSLGDEKRTPSPNIPPPPSFPAPPPPFT

SEQ ID NO: 2202403 - protein, 19 aa, Cryptosporidium hominis
HKDGAGEDQVGESSTLEEN

SEQ ID NO: 2202404 - protein, 7 aa, Cryptosporidium hominis
HKEAPRP

SEQ ID NO: 2202405 - protein, 4 aa, Cryptosporidium hominis
HKKK

SEQ ID NO: 2202406 - protein, 7 aa, Cryptosporidium hominis
HKNSDYD

SEQ ID NO: 2202407 - protein, 17 aa, Cryptosporidium hominis
HKNTGSYLTRSTSSINL

SEQ ID NO: 2202408 - protein, 13 aa, Cryptosporidium hominis
HKPIPDHFKANDP

SEQ ID NO: 2202409 - protein, 12 aa, Cryptosporidium hominis
HKPTKDEKRTTV

SEQ ID NO: 2202410 - protein, 10 aa, Cryptosporidium hominis
HKTENDNVEG

SEQ ID NO: 2202411 - protein, 101 aa, Cryptosporidium hominis
HKTGANRNLNGGNSLSQDKSLGDKKRTPSPIIPPPPSFPAPPPPSFHAPPPPSIPSGTTSRTPIPKDGDLNPDPKMGKTNHQGSSQSSEPKSKRKPLTRKG

SEQ ID NO: 2202412 - protein, 36 aa, Cryptosporidium hominis
HKTGTSQSAIRRNSSSRAGGFGNEKRTPPSPPPSPF

SEQ ID NO: 2202413 - protein, 91 aa, Cryptosporidium hominis
HKTRARKNLNRKNSSDLDDEKEEEEEDEENMTSTGPFDQRPPSPPHPPPSSGSFAPPSPPHSPPPPPPPPPPPPPSSPPSPPPSPPTYTSL

SEQ ID NO: 2202414 - protein, 11 aa, Cryptosporidium hominis
HLEGSDSAEHI

SEQ ID NO: 2202415 - protein, 8 aa, Cryptosporidium hominis
HLKSSKYN

SEQ ID NO: 2202416 - protein, 5 aa, Cryptosporidium hominis
HLTDP

SEQ ID NO: 2202417 - protein, 34 aa, Cryptosporidium hominis
HNEGFDPNDIEDQQELKKEAGPFYNDDQTQGQIP

SEQ ID NO: 2202418 - protein, 6 aa, Cryptosporidium hominis
HNGDKK

SEQ ID NO: 2202419 - protein, 8 aa, Cryptosporidium hominis
HNGEVTDD

SEQ ID NO: 2202420 - protein, 5 aa, Cryptosporidium hominis
HNHSK

SEQ ID NO: 2202421 - protein, 10 aa, Cryptosporidium hominis
HNKRDLDPSH

SEQ ID NO: 2202422 - protein, 7 aa, Cryptosporidium hominis
HNPGSIQ

SEQ ID NO: 2202423 - protein, 12 aa, Cryptosporidium hominis
HNRKDSKNWRAR

SEQ ID NO: 2202424 - protein, 5 aa, Cryptosporidium hominis
HNTRT

SEQ ID NO: 2202425 - protein, 11 aa, Cryptosporidium hominis
HPDKNPGSKEK

SEQ ID NO: 2202426 - protein, 10 aa, Cryptosporidium hominis
HPDNGGSNYV

SEQ ID NO: 2202427 - protein, 6 aa, Cryptosporidium hominis
HPENTH

SEQ ID NO: 2202428 - protein, 4 aa, Cryptosporidium hominis
HPGL

SEQ ID NO: 2202429 - protein, 8 aa, Cryptosporidium hominis
HPNSNEYR

SEQ ID NO: 2202430 - protein, 14 aa, Cryptosporidium hominis
HPNSSHYTPPKPSI

SEQ ID NO: 2202431 - protein, 8 aa, Cryptosporidium hominis
HPPDPADV

SEQ ID NO: 2202432 - protein, 27 aa, Cryptosporidium hominis
HPPPVGPPPPIVPPPVGPPPPVGLPPP

SEQ ID NO: 2202433 - protein, 17 aa, Cryptosporidium hominis
HPPTPENLPDKASGRGF

SEQ ID NO: 2202434 - protein, 4 aa, Cryptosporidium hominis
HQSS

SEQ ID NO: 2202435 - protein, 12 aa, Cryptosporidium hominis
HQSTDLRNNENS

SEQ ID NO: 2202436 - protein, 6 aa, Cryptosporidium hominis
HQSVQK

SEQ ID NO: 2202437 - protein, 9 aa, Cryptosporidium hominis
HREKPEHLR

SEQ ID NO: 2202438 - protein, 4 aa, Cryptosporidium hominis
HRGR

SEQ ID NO: 2202439 - protein, 24 aa, Cryptosporidium hominis
HRGSHSATGAASAPSRYGPGFPPL

SEQ ID NO: 2202440 - protein, 38 aa, Cryptosporidium hominis
HRKGSYKRRKNKSNKNSTSSSRKSKGIPSPPKSPTSDV

SEQ ID NO: 2202441 - protein, 16 aa, Cryptosporidium hominis
HRTGDNRNSNGINSSY

SEQ ID NO: 2202442 - protein, 6 aa, Cryptosporidium hominis
HSAGAK

SEQ ID NO: 2202443 - protein, 6 aa, Cryptosporidium hominis
HSAPSA

SEQ ID NO: 2202444 - protein, 5 aa, Cryptosporidium hominis
HSEIA

SEQ ID NO: 2202445 - protein, 23 aa, Cryptosporidium hominis
HSHKHKQSNSHKDQNNKDEEAHI

SEQ ID NO: 2202446 - protein, 5 aa, Cryptosporidium hominis
HSKDG

SEQ ID NO: 2202447 - protein, 41 aa, Cryptosporidium hominis
HSNSPSQLLESSSSMSNIRGKQEQASCKNKDKEDEKSKKGL

SEQ ID NO: 2202448 - protein, 16 aa, Cryptosporidium hominis
HSPQTWPNRASPGENL

SEQ ID NO: 2202449 - protein, 9 aa, Cryptosporidium hominis
HSQRKTATA

SEQ ID NO: 2202450 - protein, 10 aa, Cryptosporidium hominis
HSRPCGGYSE

SEQ ID NO: 2202451 - protein, 8 aa, Cryptosporidium hominis
HSSNNNLS

SEQ ID NO: 2202452 - protein, 6 aa, Cryptosporidium hominis
HSSSFT

SEQ ID NO: 2202453 - protein, 10 aa, Cryptosporidium hominis
HSSTAKFGLP

SEQ ID NO: 2202454 - protein, 8 aa, Cryptosporidium hominis
HSSYPDDK

SEQ ID NO: 2202455 - protein, 84 aa, Cryptosporidium hominis
HTKVRRSGRIASSRQHSSSYSSFSPQTPSTSSSLQSEFSQSQTRLPSAHTTSRYHSRTHQSGRGVTSTRGRSTRMRHRRRRRTL

SEQ ID NO: 2202456 - protein, 4 aa, Cryptosporidium hominis
HTNE

SEQ ID NO: 2202457 - protein, 4 aa, Cryptosporidium hominis
HTQQ

SEQ ID NO: 2202458 - protein, 5 aa, Cryptosporidium hominis
HTSEE

SEQ ID NO: 2202459 - protein, 13 aa, Cryptosporidium hominis
HVGSTGIASPDRL

SEQ ID NO: 2202460 - protein, 14 aa, Cryptosporidium hominis
HYNDNNSSGKYSTV

SEQ ID NO: 2202461 - protein, 12 aa, Cryptosporidium hominis
HYRDKGASMDKS

SEQ ID NO: 2202462 - protein, 9 aa, Cryptosporidium hominis
HYSENKTQY

SEQ ID NO: 2202463 - protein, 9 aa, Cryptosporidium hominis
IAENYPNSN

SEQ ID NO: 2202464 - protein, 5 aa, Cryptosporidium hominis
IAPDL

SEQ ID NO: 2202465 - protein, 7 aa, Cryptosporidium hominis
IAPKDTM

SEQ ID NO: 2202466 - protein, 14 aa, Cryptosporidium hominis
IARNYSDSSLSETT

SEQ ID NO: 2202467 - protein, 9 aa, Cryptosporidium hominis
IASKPKYPL

SEQ ID NO: 2202468 - protein, 13 aa, Cryptosporidium hominis
ICKSRENSEKSWQ

SEQ ID NO: 2202469 - protein, 13 aa, Cryptosporidium hominis
ICTPNDNSNSGGA

SEQ ID NO: 2202470 - protein, 21 aa, Cryptosporidium hominis
IDEGEQTEAEDDIKVEKPENQ

SEQ ID NO: 2202471 - protein, 32 aa, Cryptosporidium hominis
IDEQDKTSKVTDSKPISADSTPKKDEDKNYID

SEQ ID NO: 2202472 - protein, 4 aa, Cryptosporidium hominis
IDET

SEQ ID NO: 2202473 - protein, 178 aa, Cryptosporidium hominis
IDGGASAGASGRAGGRAGGRASGGGSGGGNGGGSGGGSGGGSGGGSGRASGGGSAGGSGGGSGGVGALGGGKRGAGGVSRGASKGTVRGTSGGGSGGTVKGTSGGTSGGASGGAGGGASSGARARSPLGAKSTQRSRSRSRSRSRSRSSRSRTSRSRSRSRSRAGEGSNCPTSSSRSS

SEQ ID NO: 2202474 - protein, 9 aa, Cryptosporidium hominis
IDGSQNEVE

SEQ ID NO: 2202475 - protein, 9 aa, Cryptosporidium hominis
IDGTPDQSK

SEQ ID NO: 2202476 - protein, 5 aa, Cryptosporidium hominis
IDIDQ

SEQ ID NO: 2202477 - protein, 12 aa, Cryptosporidium hominis
IDKEKNSHSTEA

SEQ ID NO: 2202478 - protein, 11 aa, Cryptosporidium hominis
IDKHGSKLRNS

SEQ ID NO: 2202479 - protein, 6 aa, Cryptosporidium hominis
IDKQFD

SEQ ID NO: 2202480 - protein, 4 aa, Cryptosporidium hominis
IDNN

SEQ ID NO: 2202481 - protein, 6 aa, Cryptosporidium hominis
IDPDNL

SEQ ID NO: 2202482 - protein, 9 aa, Cryptosporidium hominis
IDPSSTPNL

SEQ ID NO: 2202483 - protein, 7 aa, Cryptosporidium hominis
IDQSNSL

SEQ ID NO: 2202484 - protein, 11 aa, Cryptosporidium hominis
IDRKRSKADSY

SEQ ID NO: 2202485 - protein, 10 aa, Cryptosporidium hominis
IDSGIGAAAP

SEQ ID NO: 2202486 - protein, 7 aa, Cryptosporidium hominis
IDSSRRH

SEQ ID NO: 2202487 - protein, 15 aa, Cryptosporidium hominis
IDTGGDPGATLSPSK

SEQ ID NO: 2202488 - protein, 12 aa, Cryptosporidium hominis
IDTTDDERSYTN

SEQ ID NO: 2202489 - protein, 6 aa, Cryptosporidium hominis
IEAPEQ

SEQ ID NO: 2202490 - protein, 20 aa, Cryptosporidium hominis
IEDEQTSNQVNNSPEFSGEK

SEQ ID NO: 2202491 - protein, 4 aa, Cryptosporidium hominis
IEDG

SEQ ID NO: 2202492 - protein, 119 aa, Cryptosporidium hominis
IEEEEEEAHTSKKHRRARRSQSDLETGHKDSQQEAGSSSDEDSSQREKCPKRRSKRGRSRTGVTSLDESTLGAVGGQSLDSSTLESKSSGSTSSLDSTSSSLLGNSESSARPDPDKVPV

SEQ ID NO: 2202493 - protein, 22 aa, Cryptosporidium hominis
IEEETKPKSKSKLRGNKSSNSM

SEQ ID NO: 2202494 - protein, 6 aa, Cryptosporidium hominis
IEENEY

SEQ ID NO: 2202495 - protein, 12 aa, Cryptosporidium hominis
IEESPSPIKQGE

SEQ ID NO: 2202496 - protein, 6 aa, Cryptosporidium hominis
IEGDDL

SEQ ID NO: 2202497 - protein, 12 aa, Cryptosporidium hominis
IEGGKTSYGNTP

SEQ ID NO: 2202498 - protein, 4 aa, Cryptosporidium hominis
IEGN

SEQ ID NO: 2202499 - protein, 9 aa, Cryptosporidium hominis
IEKEANIEA

SEQ ID NO: 2202500 - protein, 45 aa, Cryptosporidium hominis
IEKEEEVEEEEEEEKEEKKEKDKKRKNTKTLSRGGRAGKNDTAKT

SEQ ID NO: 2202501 - protein, 13 aa, Cryptosporidium hominis
IENNSGKGKHLSK

SEQ ID NO: 2202502 - protein, 12 aa, Cryptosporidium hominis
IENSNLPSNNEI

SEQ ID NO: 2202503 - protein, 6 aa, Cryptosporidium hominis
IEPQPR

SEQ ID NO: 2202504 - protein, 4 aa, Cryptosporidium hominis
IEPV

SEQ ID NO: 2202505 - protein, 10 aa, Cryptosporidium hominis
IEQESNKTFS

SEQ ID NO: 2202506 - protein, 15 aa, Cryptosporidium hominis
IESAFDKKSSENYNL

SEQ ID NO: 2202507 - protein, 4 aa, Cryptosporidium hominis
IESD

SEQ ID NO: 2202508 - protein, 8 aa, Cryptosporidium hominis
IESDDPEV

SEQ ID NO: 2202509 - protein, 82 aa, Cryptosporidium hominis
IESEGNIKVGNSAKDSGDDVNDESNSIIKGEEEKNNDQGLTTNNTESGNSTTTENTSDNNETVSQNITEADNNNNNNNNDSL

SEQ ID NO: 2202510 - protein, 10 aa, Cryptosporidium hominis
IESKEYSTTT

SEQ ID NO: 2202511 - protein, 11 aa, Cryptosporidium hominis
IESRISSSKSK

SEQ ID NO: 2202512 - protein, 10 aa, Cryptosporidium hominis
IESSGATFDE

SEQ ID NO: 2202513 - protein, 8 aa, Cryptosporidium hominis
IETDGTNE

SEQ ID NO: 2202514 - protein, 10 aa, Cryptosporidium hominis
IETGTSKTID

SEQ ID NO: 2202515 - protein, 10 aa, Cryptosporidium hominis
IETPESESQV

SEQ ID NO: 2202516 - protein, 17 aa, Cryptosporidium hominis
IGANSKKVDEFSDEYSS

SEQ ID NO: 2202517 - protein, 5 aa, Cryptosporidium hominis
IGAPQ

SEQ ID NO: 2202518 - protein, 12 aa, Cryptosporidium hominis
IGEEYDERNSPL

SEQ ID NO: 2202519 - protein, 9 aa, Cryptosporidium hominis
IGENEDASR

SEQ ID NO: 2202520 - protein, 4 aa, Cryptosporidium hominis
IGER

SEQ ID NO: 2202521 - protein, 4 aa, Cryptosporidium hominis
IGKE

SEQ ID NO: 2202522 - protein, 11 aa, Cryptosporidium hominis
IGKSKAVRGRG

SEQ ID NO: 2202523 - protein, 17 aa, Cryptosporidium hominis
IGNNDHSRTHSSFTTDS

SEQ ID NO: 2202524 - protein, 5 aa, Cryptosporidium hominis
IGNNP

SEQ ID NO: 2202525 - protein, 6 aa, Cryptosporidium hominis
IGNPQY

SEQ ID NO: 2202526 - protein, 5 aa, Cryptosporidium hominis
IGNSG

SEQ ID NO: 2202527 - protein, 5 aa, Cryptosporidium hominis
IGPTE

SEQ ID NO: 2202528 - protein, 26 aa, Cryptosporidium hominis
IGRNKNSILTSSGSQSNVDSGPLNDG

SEQ ID NO: 2202529 - protein, 10 aa, Cryptosporidium hominis
IGSDTQHTEP

SEQ ID NO: 2202530 - protein, 5 aa, Cryptosporidium hominis
IGSSC

SEQ ID NO: 2202531 - protein, 17 aa, Cryptosporidium hominis
IGTKGGRPIKGREVNPI

SEQ ID NO: 2202532 - protein, 8 aa, Cryptosporidium hominis
IGTTPYSP

SEQ ID NO: 2202533 - protein, 6 aa, Cryptosporidium hominis
IHSKYD

SEQ ID NO: 2202534 - protein, 29 aa, Cryptosporidium hominis
IIGSSDNKYKESPYSETSMSSRRGKRSQN

SEQ ID NO: 2202535 - protein, 26 aa, Cryptosporidium hominis
IKAKEEANKYKESIKKREMSRTEGSV

SEQ ID NO: 2202536 - protein, 8 aa, Cryptosporidium hominis
IKCSPGSP

SEQ ID NO: 2202537 - protein, 5 aa, Cryptosporidium hominis
IKDAP

SEQ ID NO: 2202538 - protein, 9 aa, Cryptosporidium hominis
IKDKRELSK

SEQ ID NO: 2202539 - protein, 5 aa, Cryptosporidium hominis
IKEEF

SEQ ID NO: 2202540 - protein, 7 aa, Cryptosporidium hominis
IKENEPI

SEQ ID NO: 2202541 - protein, 8 aa, Cryptosporidium hominis
IKENPPRY

SEQ ID NO: 2202542 - protein, 11 aa, Cryptosporidium hominis
IKKEDPPKDAL

SEQ ID NO: 2202543 - protein, 12 aa, Cryptosporidium hominis
IKKEKGKKKMTI

SEQ ID NO: 2202544 - protein, 10 aa, Cryptosporidium hominis
IKKFSQSQNN

SEQ ID NO: 2202545 - protein, 8 aa, Cryptosporidium hominis
IKKSKYNS

SEQ ID NO: 2202546 - protein, 13 aa, Cryptosporidium hominis
IKNNKCGKCFCSR

SEQ ID NO: 2202547 - protein, 10 aa, Cryptosporidium hominis
IKNNPEQKKD

SEQ ID NO: 2202548 - protein, 8 aa, Cryptosporidium hominis
IKNSSDQT

SEQ ID NO: 2202549 - protein, 10 aa, Cryptosporidium hominis
IKPGETTTLE

SEQ ID NO: 2202550 - protein, 5 aa, Cryptosporidium hominis
IKPGR

SEQ ID NO: 2202551 - protein, 7 aa, Cryptosporidium hominis
IKPSSSR

SEQ ID NO: 2202552 - protein, 9 aa, Cryptosporidium hominis
IKQNNDKIQ

SEQ ID NO: 2202553 - protein, 17 aa, Cryptosporidium hominis
IKSSNSNTLSLKEKGQP

SEQ ID NO: 2202554 - protein, 7 aa, Cryptosporidium hominis
IKTGKVT

SEQ ID NO: 2202555 - protein, 11 aa, Cryptosporidium hominis
IKTNSDQAIDN

SEQ ID NO: 2202556 - protein, 14 aa, Cryptosporidium hominis
IKYADKENNQIVSS

SEQ ID NO: 2202557 - protein, 17 aa, Cryptosporidium hominis
ILETSTQTKGRKSQNEI

SEQ ID NO: 2202558 - protein, 6 aa, Cryptosporidium hominis
INAAKG

SEQ ID NO: 2202559 - protein, 9 aa, Cryptosporidium hominis
INDGSNYHT

SEQ ID NO: 2202560 - protein, 23 aa, Cryptosporidium hominis
INDRENNKKQNRLGNKGRQIKNS

SEQ ID NO: 2202561 - protein, 5 aa, Cryptosporidium hominis
INESK

SEQ ID NO: 2202562 - protein, 12 aa, Cryptosporidium hominis
INETNIPNEETN

SEQ ID NO: 2202563 - protein, 7 aa, Cryptosporidium hominis
INGDAPK

SEQ ID NO: 2202564 - protein, 5 aa, Cryptosporidium hominis
INGER

SEQ ID NO: 2202565 - protein, 15 aa, Cryptosporidium hominis
INGSNLSESPVDTRA

SEQ ID NO: 2202566 - protein, 11 aa, Cryptosporidium hominis
INKKRSVRKQE

SEQ ID NO: 2202567 - protein, 20 aa, Cryptosporidium hominis
INKNEYSSKEYPTLNNDTDN

SEQ ID NO: 2202568 - protein, 4 aa, Cryptosporidium hominis
INND

SEQ ID NO: 2202569 - protein, 18 aa, Cryptosporidium hominis
INNENNDDEEARRLSQEE

SEQ ID NO: 2202570 - protein, 10 aa, Cryptosporidium hominis
INPGSGNING

SEQ ID NO: 2202571 - protein, 4 aa, Cryptosporidium hominis
INPS

SEQ ID NO: 2202572 - protein, 11 aa, Cryptosporidium hominis
INQETNERSNF

SEQ ID NO: 2202573 - protein, 5 aa, Cryptosporidium hominis
INSED

SEQ ID NO: 2202574 - protein, 7 aa, Cryptosporidium hominis
INSKDDK

SEQ ID NO: 2202575 - protein, 8 aa, Cryptosporidium hominis
INSKNSET

SEQ ID NO: 2202576 - protein, 6 aa, Cryptosporidium hominis
INSPKD

SEQ ID NO: 2202577 - protein, 5 aa, Cryptosporidium hominis
IPAGI

SEQ ID NO: 2202578 - protein, 18 aa, Cryptosporidium hominis
IPDHEDNQEFPSLEARDE

SEQ ID NO: 2202579 - protein, 28 aa, Cryptosporidium hominis
IPDPNSRKQNGKPDNQSGSGSSTDFGTS

SEQ ID NO: 2202580 - protein, 5 aa, Cryptosporidium hominis
IPDVG

SEQ ID NO: 2202581 - protein, 5 aa, Cryptosporidium hominis
IPEED

SEQ ID NO: 2202582 - protein, 29 aa, Cryptosporidium hominis
IPEETGPGDSPKYETPGSPYSPAQTPDQF

SEQ ID NO: 2202583 - protein, 13 aa, Cryptosporidium hominis
IPEGPPPTPPPGY

SEQ ID NO: 2202584 - protein, 17 aa, Cryptosporidium hominis
IPEIPGPPSRRGSGPIS

SEQ ID NO: 2202585 - protein, 11 aa, Cryptosporidium hominis
IPGADDNSAIE

SEQ ID NO: 2202586 - protein, 9 aa, Cryptosporidium hominis
IPGDPDALE

SEQ ID NO: 2202587 - protein, 9 aa, Cryptosporidium hominis
IPGKDSSQC

SEQ ID NO: 2202588 - protein, 6 aa, Cryptosporidium hominis
IPGVGT

SEQ ID NO: 2202589 - protein, 16 aa, Cryptosporidium hominis
IPKKQADVRPKRPTIA

SEQ ID NO: 2202590 - protein, 6 aa, Cryptosporidium hominis
IPKNEE

SEQ ID NO: 2202591 - protein, 5 aa, Cryptosporidium hominis
IPKSC

SEQ ID NO: 2202592 - protein, 22 aa, Cryptosporidium hominis
IPKTSSSNQFSNETNAGCKENF

SEQ ID NO: 2202593 - protein, 12 aa, Cryptosporidium hominis
IPNPTASSTTVD

SEQ ID NO: 2202594 - protein, 10 aa, Cryptosporidium hominis
IPPPAAGRGP

SEQ ID NO: 2202595 - protein, 15 aa, Cryptosporidium hominis
IPPPPPFPAPQAPVE

SEQ ID NO: 2202596 - protein, 6 aa, Cryptosporidium hominis
IPSKDE

SEQ ID NO: 2202597 - protein, 12 aa, Cryptosporidium hominis
IPTEVNNGTFGS

SEQ ID NO: 2202598 - protein, 12 aa, Cryptosporidium hominis
IPTYTQDPSPNF

SEQ ID NO: 2202599 - protein, 4 aa, Cryptosporidium hominis
IPYS

SEQ ID NO: 2202600 - protein, 21 aa, Cryptosporidium hominis
IQESSVDAKSSDSARDRSEFS

SEQ ID NO: 2202601 - protein, 14 aa, Cryptosporidium hominis
IQKDNAEVIKNDSG

SEQ ID NO: 2202602 - protein, 5 aa, Cryptosporidium hominis
IQMPN

SEQ ID NO: 2202603 - protein, 11 aa, Cryptosporidium hominis
IQNGAEGADTF

SEQ ID NO: 2202604 - protein, 10 aa, Cryptosporidium hominis
IQNKDSPDLK

SEQ ID NO: 2202605 - protein, 4 aa, Cryptosporidium hominis
IQNP

SEQ ID NO: 2202606 - protein, 11 aa, Cryptosporidium hominis
IQPENGCPEDY

SEQ ID NO: 2202607 - protein, 4 aa, Cryptosporidium hominis
IQPN

SEQ ID NO: 2202608 - protein, 12 aa, Cryptosporidium hominis
IQPPPEAKKGKN

SEQ ID NO: 2202609 - protein, 34 aa, Cryptosporidium hominis
IQPTTSRRNVKKSLEEKQDNKKKTVEKEKKNKKF

SEQ ID NO: 2202610 - protein, 7 aa, Cryptosporidium hominis
IQQDKSF

SEQ ID NO: 2202611 - protein, 5 aa, Cryptosporidium hominis
IQSNN

SEQ ID NO: 2202612 - protein, 16 aa, Cryptosporidium hominis
IQSQIQGQKQGQNHHN

SEQ ID NO: 2202613 - protein, 26 aa, Cryptosporidium hominis
IQSQSQSQGQSQSQIQSQDQGQLKGQ

SEQ ID NO: 2202614 - protein, 22 aa, Cryptosporidium hominis
IQSSKKKGKKPSRSDCEKAASE

SEQ ID NO: 2202615 - protein, 21 aa, Cryptosporidium hominis
IQYQSSEEKLSDLTSRSGSAV

SEQ ID NO: 2202616 - protein, 7 aa, Cryptosporidium hominis
IRARTRE

SEQ ID NO: 2202617 - protein, 4 aa, Cryptosporidium hominis
IREE

SEQ ID NO: 2202618 - protein, 5 aa, Cryptosporidium hominis
IRGGA

SEQ ID NO: 2202619 - protein, 92 aa, Cryptosporidium hominis
IRGGDQNKLESENPEETTTTTTTTPQPDSTSDEDTTTSTSTTTTTTTTTTTTSTTTTTKAPESGETKDTEETNENAEETATASPKPKSPTYK

SEQ ID NO: 2202620 - protein, 14 aa, Cryptosporidium hominis
IRGGPHQKNCPQDL

SEQ ID NO: 2202621 - protein, 4 aa, Cryptosporidium hominis
IRGN

SEQ ID NO: 2202622 - protein, 6 aa, Cryptosporidium hominis
IRGSNV

SEQ ID NO: 2202623 - protein, 21 aa, Cryptosporidium hominis
IRKNQRKTCNSGRSDEDGVDI

SEQ ID NO: 2202624 - protein, 22 aa, Cryptosporidium hominis
IRKPSPLDEQPLPSCEGVKSSK

SEQ ID NO: 2202625 - protein, 9 aa, Cryptosporidium hominis
IRRNELNRK

SEQ ID NO: 2202626 - protein, 13 aa, Cryptosporidium hominis
IRSSKSEGGGRGK

SEQ ID NO: 2202627 - protein, 12 aa, Cryptosporidium hominis
IRTKEEKGTVRK

SEQ ID NO: 2202628 - protein, 5 aa, Cryptosporidium hominis
ISDND

SEQ ID NO: 2202629 - protein, 14 aa, Cryptosporidium hominis
ISEGEDEDTSNVSD

SEQ ID NO: 2202630 - protein, 7 aa, Cryptosporidium hominis
ISEPRPV

SEQ ID NO: 2202631 - protein, 6 aa, Cryptosporidium hominis
ISEQRA

SEQ ID NO: 2202632 - protein, 6 aa, Cryptosporidium hominis
ISETVS

SEQ ID NO: 2202633 - protein, 4 aa, Cryptosporidium hominis
ISFS

SEQ ID NO: 2202634 - protein, 9 aa, Cryptosporidium hominis
ISGDNIDKI

SEQ ID NO: 2202635 - protein, 5 aa, Cryptosporidium hominis
ISGKQ

SEQ ID NO: 2202636 - protein, 9 aa, Cryptosporidium hominis
ISGNKGDVE

SEQ ID NO: 2202637 - protein, 36 aa, Cryptosporidium hominis
ISGPAGTPPTPTFPPAPTLPSTSKLPTPTISTPTIP

SEQ ID NO: 2202638 - protein, 34 aa, Cryptosporidium hominis
ISGPQDFSQENINNQDSSDNNSNTQDNEGTASSS

SEQ ID NO: 2202639 - protein, 12 aa, Cryptosporidium hominis
ISGSRKNEEDSL

SEQ ID NO: 2202640 - protein, 20 aa, Cryptosporidium hominis
ISKCSKKTSEPKPERSESDK

SEQ ID NO: 2202641 - protein, 12 aa, Cryptosporidium hominis
ISKETEPIDEGR

SEQ ID NO: 2202642 - protein, 11 aa, Cryptosporidium hominis
ISKGGYGPDGN

SEQ ID NO: 2202643 - protein, 16 aa, Cryptosporidium hominis
ISKQKSKNKMSSQSYE

SEQ ID NO: 2202644 - protein, 23 aa, Cryptosporidium hominis
ISNDEVPAQDDSSKTPSTETNKD

SEQ ID NO: 2202645 - protein, 4 aa, Cryptosporidium hominis
ISNE

SEQ ID NO: 2202646 - protein, 10 aa, Cryptosporidium hominis
ISNKDGSPKM

SEQ ID NO: 2202647 - protein, 28 aa, Cryptosporidium hominis
ISNPDSKDSKKSLKRLPRPLGGSQLTSV

SEQ ID NO: 2202648 - protein, 51 aa, Cryptosporidium hominis
ISNTINKASNAVGSSKKDKKKQKEPKEEEEKEKKKEKEKVKEKKKNTIEGG

SEQ ID NO: 2202649 - protein, 11 aa, Cryptosporidium hominis
ISPEEANYDGK

SEQ ID NO: 2202650 - protein, 7 aa, Cryptosporidium hominis
ISPPKNR

SEQ ID NO: 2202651 - protein, 6 aa, Cryptosporidium hominis
ISQPSL

SEQ ID NO: 2202652 - protein, 10 aa, Cryptosporidium hominis
ISQRRGGKIS

SEQ ID NO: 2202653 - protein, 4 aa, Cryptosporidium hominis
ISRK

SEQ ID NO: 2202654 - protein, 9 aa, Cryptosporidium hominis
ISRKDNKLK

SEQ ID NO: 2202655 - protein, 4 aa, Cryptosporidium hominis
ISSC

SEQ ID NO: 2202656 - protein, 5 aa, Cryptosporidium hominis
ISSEN

SEQ ID NO: 2202657 - protein, 9 aa, Cryptosporidium hominis
ISSETQFRE

SEQ ID NO: 2202658 - protein, 11 aa, Cryptosporidium hominis
ISSGDDNNSSI

SEQ ID NO: 2202659 - protein, 6 aa, Cryptosporidium hominis
ISSGGF

SEQ ID NO: 2202660 - protein, 5 aa, Cryptosporidium hominis
ISSGR

SEQ ID NO: 2202661 - protein, 8 aa, Cryptosporidium hominis
ISSNRSRL

SEQ ID NO: 2202662 - protein, 5 aa, Cryptosporidium hominis
ISSSD

SEQ ID NO: 2202663 - protein, 23 aa, Cryptosporidium hominis
ISTGARARYGGKYASVSSSQEAE

SEQ ID NO: 2202664 - protein, 5 aa, Cryptosporidium hominis
ISTIP

SEQ ID NO: 2202665 - protein, 5 aa, Cryptosporidium hominis
ISTQS

SEQ ID NO: 2202666 - protein, 4 aa, Cryptosporidium hominis
ISTV

SEQ ID NO: 2202667 - protein, 12 aa, Cryptosporidium hominis
ITEAGDKQNRNR

SEQ ID NO: 2202668 - protein, 11 aa, Cryptosporidium hominis
ITEKSESSEVL

SEQ ID NO: 2202669 - protein, 16 aa, Cryptosporidium hominis
ITENPSINCPSGTFQK

SEQ ID NO: 2202670 - protein, 22 aa, Cryptosporidium hominis
ITESGNKVGGKASESSSITASG

SEQ ID NO: 2202671 - protein, 5 aa, Cryptosporidium hominis
ITGPP

SEQ ID NO: 2202672 - protein, 12 aa, Cryptosporidium hominis
ITMESEKSNGLK

SEQ ID NO: 2202673 - protein, 10 aa, Cryptosporidium hominis
ITPKDKSKQL

SEQ ID NO: 2202674 - protein, 21 aa, Cryptosporidium hominis
ITPPKTSGHRHPAPAPPTVYP

SEQ ID NO: 2202675 - protein, 4 aa, Cryptosporidium hominis
ITQD

SEQ ID NO: 2202676 - protein, 6 aa, Cryptosporidium hominis
ITQQAN

SEQ ID NO: 2202677 - protein, 4 aa, Cryptosporidium hominis
ITSG

SEQ ID NO: 2202678 - protein, 19 aa, Cryptosporidium hominis
ITSSEVSPLSEASDSLSTE

SEQ ID NO: 2202679 - protein, 12 aa, Cryptosporidium hominis
ITSSNDENKNDK

SEQ ID NO: 2202680 - protein, 5 aa, Cryptosporidium hominis
ITSTE

SEQ ID NO: 2202681 - protein, 15 aa, Cryptosporidium hominis
ITSTESFNLPNITNL

SEQ ID NO: 2202682 - protein, 7 aa, Cryptosporidium hominis
ITTPGPK

SEQ ID NO: 2202683 - protein, 22 aa, Cryptosporidium hominis
ITTSTTKATHTLKSNNQSASEE

SEQ ID NO: 2202684 - protein, 9 aa, Cryptosporidium hominis
IVEKKQGES

SEQ ID NO: 2202685 - protein, 8 aa, Cryptosporidium hominis
IYDPSKST

SEQ ID NO: 2202686 - protein, 9 aa, Cryptosporidium hominis
KAAYSGSKR

SEQ ID NO: 2202687 - protein, 20 aa, Cryptosporidium hominis
KADAKKKEVDVSSSIPGSTD

SEQ ID NO: 2202688 - protein, 7 aa, Cryptosporidium hominis
KAEDELS

SEQ ID NO: 2202689 - protein, 29 aa, Cryptosporidium hominis
KAEEDSISDNSPKGTQNNGELNTNGFGNT

SEQ ID NO: 2202690 - protein, 11 aa, Cryptosporidium hominis
KAEGAEGGDLA

SEQ ID NO: 2202691 - protein, 21 aa, Cryptosporidium hominis
KAKEEKKSQRKKTKSKREFPT

SEQ ID NO: 2202692 - protein, 20 aa, Cryptosporidium hominis
KAKMAPSAPRNSSNQEKDGD

SEQ ID NO: 2202693 - protein, 7 aa, Cryptosporidium hominis
KAKTPRD

SEQ ID NO: 2202694 - protein, 6 aa, Cryptosporidium hominis
KALETP

SEQ ID NO: 2202695 - protein, 10 aa, Cryptosporidium hominis
KALGKEGYKV

SEQ ID NO: 2202696 - protein, 8 aa, Cryptosporidium hominis
KAMEPSKG

SEQ ID NO: 2202697 - protein, 7 aa, Cryptosporidium hominis
KANGPRS

SEQ ID NO: 2202698 - protein, 7 aa, Cryptosporidium hominis
KAQWNND

SEQ ID NO: 2202699 - protein, 13 aa, Cryptosporidium hominis
KASIPKNRPDGLP

SEQ ID NO: 2202700 - protein, 8 aa, Cryptosporidium hominis
KASKRASK

SEQ ID NO: 2202701 - protein, 6 aa, Cryptosporidium hominis
KASPNG

SEQ ID NO: 2202702 - protein, 8 aa, Cryptosporidium hominis
KATGGEKM

SEQ ID NO: 2202703 - protein, 10 aa, Cryptosporidium hominis
KATKTKTRKY

SEQ ID NO: 2202704 - protein, 5 aa, Cryptosporidium hominis
KATMK

SEQ ID NO: 2202705 - protein, 5 aa, Cryptosporidium hominis
KATSR

SEQ ID NO: 2202706 - protein, 9 aa, Cryptosporidium hominis
KAVEGSSEK

SEQ ID NO: 2202707 - protein, 11 aa, Cryptosporidium hominis
KCESDPKCPEG

SEQ ID NO: 2202708 - protein, 8 aa, Cryptosporidium hominis
KCNGNEYD

SEQ ID NO: 2202709 - protein, 34 aa, Cryptosporidium hominis
KCQPGSCTPGTCTTGSCNVGESQTGCEKGSCKGG

SEQ ID NO: 2202710 - protein, 11 aa, Cryptosporidium hominis
KCSDSLTEKPA

SEQ ID NO: 2202711 - protein, 10 aa, Cryptosporidium hominis
KCSKASSHIK

SEQ ID NO: 2202712 - protein, 7 aa, Cryptosporidium hominis
KCSKREL

SEQ ID NO: 2202713 - protein, 16 aa, Cryptosporidium hominis
KCTGSYQDLRDGTTDL

SEQ ID NO: 2202714 - protein, 12 aa, Cryptosporidium hominis
KCTSSKRQPCCS

SEQ ID NO: 2202715 - protein, 4 aa, Cryptosporidium hominis
KDAF

SEQ ID NO: 2202716 - protein, 26 aa, Cryptosporidium hominis
KDDTNNNKGNSIAKDTDNSEVSEKED

SEQ ID NO: 2202717 - protein, 7 aa, Cryptosporidium hominis
KDEESQT

SEQ ID NO: 2202718 - protein, 4 aa, Cryptosporidium hominis
KDFQ

SEQ ID NO: 2202719 - protein, 7 aa, Cryptosporidium hominis
KDGRDDG

SEQ ID NO: 2202720 - protein, 6 aa, Cryptosporidium hominis
KDGSWS

SEQ ID NO: 2202721 - protein, 6 aa, Cryptosporidium hominis
KDHIDE

SEQ ID NO: 2202722 - protein, 6 aa, Cryptosporidium hominis
KDINNG

SEQ ID NO: 2202723 - protein, 10 aa, Cryptosporidium hominis
KDKNSKFENN

SEQ ID NO: 2202724 - protein, 29 aa, Cryptosporidium hominis
KDKQSFRSQQGSTTKTEASHSEKPHTSEL

SEQ ID NO: 2202725 - protein, 6 aa, Cryptosporidium hominis
KDLDSE

SEQ ID NO: 2202726 - protein, 13 aa, Cryptosporidium hominis
KDLEPEPATQISG

SEQ ID NO: 2202727 - protein, 6 aa, Cryptosporidium hominis
KDLNEN

SEQ ID NO: 2202728 - protein, 5 aa, Cryptosporidium hominis
KDLTE

SEQ ID NO: 2202729 - protein, 4 aa, Cryptosporidium hominis
KDND

SEQ ID NO: 2202730 - protein, 8 aa, Cryptosporidium hominis
KDNFSGEK

SEQ ID NO: 2202731 - protein, 5 aa, Cryptosporidium hominis
KDNNS

SEQ ID NO: 2202732 - protein, 4 aa, Cryptosporidium hominis
KDPA

SEQ ID NO: 2202733 - protein, 10 aa, Cryptosporidium hominis
KDPKPTPPYY

SEQ ID NO: 2202734 - protein, 24 aa, Cryptosporidium hominis
KDQENIDYGDPDLYEKNDADKDSM

SEQ ID NO: 2202735 - protein, 4 aa, Cryptosporidium hominis
KDRA

SEQ ID NO: 2202736 - protein, 4 aa, Cryptosporidium hominis
KDRH

SEQ ID NO: 2202737 - protein, 7 aa, Cryptosporidium hominis
KDRKNRQ

SEQ ID NO: 2202738 - protein, 6 aa, Cryptosporidium hominis
KDSGGY

SEQ ID NO: 2202739 - protein, 28 aa, Cryptosporidium hominis
KDSGINQSNFSSSKSSSLGIANSQDSHQ

SEQ ID NO: 2202740 - protein, 7 aa, Cryptosporidium hominis
KDSGNPI

SEQ ID NO: 2202741 - protein, 10 aa, Cryptosporidium hominis
KDSKEIKKLR

SEQ ID NO: 2202742 - protein, 19 aa, Cryptosporidium hominis
KDSNTRPEKVSQYDRMENK

SEQ ID NO: 2202743 - protein, 6 aa, Cryptosporidium hominis
KDSSEL

SEQ ID NO: 2202744 - protein, 6 aa, Cryptosporidium hominis
KDSTLV

SEQ ID NO: 2202745 - protein, 4 aa, Cryptosporidium hominis
KDTM

SEQ ID NO: 2202746 - protein, 8 aa, Cryptosporidium hominis
KDTNEKIE

SEQ ID NO: 2202747 - protein, 5 aa, Cryptosporidium hominis
KDVES

SEQ ID NO: 2202748 - protein, 8 aa, Cryptosporidium hominis
KDYDLSKE

SEQ ID NO: 2202749 - protein, 17 aa, Cryptosporidium hominis
KEANEKLNEEVKTQAQK

SEQ ID NO: 2202750 - protein, 8 aa, Cryptosporidium hominis
KEATCKSD

SEQ ID NO: 2202751 - protein, 4 aa, Cryptosporidium hominis
KECP

SEQ ID NO: 2202752 - protein, 8 aa, Cryptosporidium hominis
KEDAEKSE

SEQ ID NO: 2202753 - protein, 5 aa, Cryptosporidium hominis
KEDDE

SEQ ID NO: 2202754 - protein, 6 aa, Cryptosporidium hominis
KEDKEP

SEQ ID NO: 2202755 - protein, 10 aa, Cryptosporidium hominis
KEDRDLEEEK

SEQ ID NO: 2202756 - protein, 5 aa, Cryptosporidium hominis
KEDVR

SEQ ID NO: 2202757 - protein, 9 aa, Cryptosporidium hominis
KEECSKGEC

SEQ ID NO: 2202758 - protein, 9 aa, Cryptosporidium hominis
KEEEKQRQK

SEQ ID NO: 2202759 - protein, 10 aa, Cryptosporidium hominis
KEEEKSLKRE

SEQ ID NO: 2202760 - protein, 11 aa, Cryptosporidium hominis
KEEEPGTQPIT

SEQ ID NO: 2202761 - protein, 7 aa, Cryptosporidium hominis
KEEGTDN

SEQ ID NO: 2202762 - protein, 6 aa, Cryptosporidium hominis
KEELER

SEQ ID NO: 2202763 - protein, 6 aa, Cryptosporidium hominis
KEENGR

SEQ ID NO: 2202764 - protein, 8 aa, Cryptosporidium hominis
KEETDSLV

SEQ ID NO: 2202765 - protein, 9 aa, Cryptosporidium hominis
KEFPDTREN

SEQ ID NO: 2202766 - protein, 6 aa, Cryptosporidium hominis
KEFPGF

SEQ ID NO: 2202767 - protein, 4 aa, Cryptosporidium hominis
KEGD

SEQ ID NO: 2202768 - protein, 8 aa, Cryptosporidium hominis
KEGDSKKI

SEQ ID NO: 2202769 - protein, 30 aa, Cryptosporidium hominis
KEGDSRASQLGESSQLTSGISEVSESSSGN

SEQ ID NO: 2202770 - protein, 13 aa, Cryptosporidium hominis
KEGESTFNDEEYR

SEQ ID NO: 2202771 - protein, 10 aa, Cryptosporidium hominis
KEGNNGANKD

SEQ ID NO: 2202772 - protein, 12 aa, Cryptosporidium hominis
KEGNSSHESYNN

SEQ ID NO: 2202773 - protein, 14 aa, Cryptosporidium hominis
KEGSEASIKSRDSV

SEQ ID NO: 2202774 - protein, 11 aa, Cryptosporidium hominis
KEIQERKIGNE

SEQ ID NO: 2202775 - protein, 6 aa, Cryptosporidium hominis
KEKAEE

SEQ ID NO: 2202776 - protein, 9 aa, Cryptosporidium hominis
KEKENDSNM

SEQ ID NO: 2202777 - protein, 9 aa, Cryptosporidium hominis
KEKLKKEKK

SEQ ID NO: 2202778 - protein, 11 aa, Cryptosporidium hominis
KEKPFESDTSS

SEQ ID NO: 2202779 - protein, 10 aa, Cryptosporidium hominis
KEKRRNNRIP

SEQ ID NO: 2202780 - protein, 7 aa, Cryptosporidium hominis
KEKTEQL

SEQ ID NO: 2202781 - protein, 5 aa, Cryptosporidium hominis
KELDS

SEQ ID NO: 2202782 - protein, 6 aa, Cryptosporidium hominis
KELKRK

SEQ ID NO: 2202783 - protein, 38 aa, Cryptosporidium hominis
KELREKIEGELKKTNSSNSKVKSLEEDLKKKERQNNSF

SEQ ID NO: 2202784 - protein, 4 aa, Cryptosporidium hominis
KELS

SEQ ID NO: 2202785 - protein, 7 aa, Cryptosporidium hominis
KELSNKE

SEQ ID NO: 2202786 - protein, 14 aa, Cryptosporidium hominis
KEMKQSKSDKRKKL

SEQ ID NO: 2202787 - protein, 8 aa, Cryptosporidium hominis
KENCESSK

SEQ ID NO: 2202788 - protein, 17 aa, Cryptosporidium hominis
KENDDDDDLLNNEPSIS

SEQ ID NO: 2202789 - protein, 8 aa, Cryptosporidium hominis
KENDDGPI

SEQ ID NO: 2202790 - protein, 6 aa, Cryptosporidium hominis
KENDKD

SEQ ID NO: 2202791 - protein, 12 aa, Cryptosporidium hominis
KENETNQPETEE

SEQ ID NO: 2202792 - protein, 6 aa, Cryptosporidium hominis
KENPGF

SEQ ID NO: 2202793 - protein, 5 aa, Cryptosporidium hominis
KEPNN

SEQ ID NO: 2202794 - protein, 7 aa, Cryptosporidium hominis
KEQKPAR

SEQ ID NO: 2202795 - protein, 52 aa, Cryptosporidium hominis
KEQKSSNVSSKRRKQGERKTKNDNRREREERERVEEREKERERERERQKRIE

SEQ ID NO: 2202796 - protein, 6 aa, Cryptosporidium hominis
KEQNKT

SEQ ID NO: 2202797 - protein, 30 aa, Cryptosporidium hominis
KEQPTKKIKDKISSQVKSADLSSKSRGAFK

SEQ ID NO: 2202798 - protein, 25 aa, Cryptosporidium hominis
KEQREKRLKEKREREEREKADREHS

SEQ ID NO: 2202799 - protein, 6 aa, Cryptosporidium hominis
KEQYRE

SEQ ID NO: 2202800 - protein, 5 aa, Cryptosporidium hominis
KESAR

SEQ ID NO: 2202801 - protein, 16 aa, Cryptosporidium hominis
KESCPGSCNLMKIVRC

SEQ ID NO: 2202802 - protein, 18 aa, Cryptosporidium hominis
KESDSNNSNSKKLFKQNS

SEQ ID NO: 2202803 - protein, 54 aa, Cryptosporidium hominis
KESKPNLEVPETQIPSSVPGSPTASETPIATGSPMTPESLTAPGTPVAAGSPMV

SEQ ID NO: 2202804 - protein, 19 aa, Cryptosporidium hominis
KESSENNNKGNQPKNGELN

SEQ ID NO: 2202805 - protein, 7 aa, Cryptosporidium hominis
KESTGTF

SEQ ID NO: 2202806 - protein, 10 aa, Cryptosporidium hominis
KESVGSKGPY

SEQ ID NO: 2202807 - protein, 4 aa, Cryptosporidium hominis
KETA

SEQ ID NO: 2202808 - protein, 8 aa, Cryptosporidium hominis
KETDKYEK

SEQ ID NO: 2202809 - protein, 6 aa, Cryptosporidium hominis
KETENI

SEQ ID NO: 2202810 - protein, 4 aa, Cryptosporidium hominis
KETK

SEQ ID NO: 2202811 - protein, 7 aa, Cryptosporidium hominis
KETLQQR

SEQ ID NO: 2202812 - protein, 8 aa, Cryptosporidium hominis
KETSEQFE

SEQ ID NO: 2202813 - protein, 7 aa, Cryptosporidium hominis
KEYSGNV

SEQ ID NO: 2202814 - protein, 18 aa, Cryptosporidium hominis
KEYVDGTQKMAENGKPTM

SEQ ID NO: 2202815 - protein, 8 aa, Cryptosporidium hominis
KFENEADS

SEQ ID NO: 2202816 - protein, 14 aa, Cryptosporidium hominis
KFGSNKRNSSRSVT

SEQ ID NO: 2202817 - protein, 7 aa, Cryptosporidium hominis
KFGSTDF

SEQ ID NO: 2202818 - protein, 8 aa, Cryptosporidium hominis
KFGTGNKE

SEQ ID NO: 2202819 - protein, 19 aa, Cryptosporidium hominis
KFKSSQENKWKNFTKKVNS

SEQ ID NO: 2202820 - protein, 20 aa, Cryptosporidium hominis
KFPGNKPPKGPGKPPVPTPR

SEQ ID NO: 2202821 - protein, 26 aa, Cryptosporidium hominis
KFRDKNGSNKLNLSSKESDKSTVNQK

SEQ ID NO: 2202822 - protein, 16 aa, Cryptosporidium hominis
KFTGSVDKYPSKYDPY

SEQ ID NO: 2202823 - protein, 4 aa, Cryptosporidium hominis
KFTS

SEQ ID NO: 2202824 - protein, 8 aa, Cryptosporidium hominis
KGACNRAQ

SEQ ID NO: 2202825 - protein, 4 aa, Cryptosporidium hominis
KGAE

SEQ ID NO: 2202826 - protein, 7 aa, Cryptosporidium hominis
KGAEGEL

SEQ ID NO: 2202827 - protein, 14 aa, Cryptosporidium hominis
KGALPTASSEVSES

SEQ ID NO: 2202828 - protein, 8 aa, Cryptosporidium hominis
KGAPGVIT

SEQ ID NO: 2202829 - protein, 6 aa, Cryptosporidium hominis
KGDEEK

SEQ ID NO: 2202830 - protein, 9 aa, Cryptosporidium hominis
KGDKTNTKF

SEQ ID NO: 2202831 - protein, 10 aa, Cryptosporidium hominis
KGDPKNPDLA

SEQ ID NO: 2202832 - protein, 7 aa, Cryptosporidium hominis
KGDQWDG

SEQ ID NO: 2202833 - protein, 5 aa, Cryptosporidium hominis
KGDSG

SEQ ID NO: 2202834 - protein, 5 aa, Cryptosporidium hominis
KGDTF

SEQ ID NO: 2202835 - protein, 9 aa, Cryptosporidium hominis
KGEIRPNTE

SEQ ID NO: 2202836 - protein, 25 aa, Cryptosporidium hominis
KGENDASSLATTYTDSTPFISPTSD

SEQ ID NO: 2202837 - protein, 12 aa, Cryptosporidium hominis
KGGISREDVSSE

SEQ ID NO: 2202838 - protein, 6 aa, Cryptosporidium hominis
KGGNDL

SEQ ID NO: 2202839 - protein, 15 aa, Cryptosporidium hominis
KGGNEISKKKSYGPT

SEQ ID NO: 2202840 - protein, 11 aa, Cryptosporidium hominis
KGGVGKSTISS

SEQ ID NO: 2202841 - protein, 4 aa, Cryptosporidium hominis
KGHQ

SEQ ID NO: 2202842 - protein, 6 aa, Cryptosporidium hominis
KGIPIP

SEQ ID NO: 2202843 - protein, 17 aa, Cryptosporidium hominis
KGISGGGELKGKRHTID

SEQ ID NO: 2202844 - protein, 6 aa, Cryptosporidium hominis
KGISTK

SEQ ID NO: 2202845 - protein, 4 aa, Cryptosporidium hominis
KGLA

SEQ ID NO: 2202846 - protein, 11 aa, Cryptosporidium hominis
KGMPIRNTNEY

SEQ ID NO: 2202847 - protein, 11 aa, Cryptosporidium hominis
KGNAPSTLTYS

SEQ ID NO: 2202848 - protein, 6 aa, Cryptosporidium hominis
KGPEIR

SEQ ID NO: 2202849 - protein, 8 aa, Cryptosporidium hominis
KGPKSKRL

SEQ ID NO: 2202850 - protein, 5 aa, Cryptosporidium hominis
KGPSA

SEQ ID NO: 2202851 - protein, 9 aa, Cryptosporidium hominis
KGPYKTPVA

SEQ ID NO: 2202852 - protein, 10 aa, Cryptosporidium hominis
KGQNSTREDL

SEQ ID NO: 2202853 - protein, 25 aa, Cryptosporidium hominis
KGQSQAKKQQKSSLIRENEEKDDMA

SEQ ID NO: 2202854 - protein, 6 aa, Cryptosporidium hominis
KGQYNT

SEQ ID NO: 2202855 - protein, 12 aa, Cryptosporidium hominis
KGREIAKKEWES

SEQ ID NO: 2202856 - protein, 4 aa, Cryptosporidium hominis
KGSK

SEQ ID NO: 2202857 - protein, 12 aa, Cryptosporidium hominis
KGSSGCSQSQIP

SEQ ID NO: 2202858 - protein, 6 aa, Cryptosporidium hominis
KGSYGE

SEQ ID NO: 2202859 - protein, 13 aa, Cryptosporidium hominis
KGTFRSDINDETR

SEQ ID NO: 2202860 - protein, 5 aa, Cryptosporidium hominis
KGTGS

SEQ ID NO: 2202861 - protein, 11 aa, Cryptosporidium hominis
KGTVGENEEKN

SEQ ID NO: 2202862 - protein, 12 aa, Cryptosporidium hominis
KGVPEEYKGSLP

SEQ ID NO: 2202863 - protein, 6 aa, Cryptosporidium hominis
KGWDKN

SEQ ID NO: 2202864 - protein, 8 aa, Cryptosporidium hominis
KGYTKSDI

SEQ ID NO: 2202865 - protein, 5 aa, Cryptosporidium hominis
KHENI

SEQ ID NO: 2202866 - protein, 11 aa, Cryptosporidium hominis
KHGKSIPDSAK

SEQ ID NO: 2202867 - protein, 13 aa, Cryptosporidium hominis
KHHGKNTRTANTH

SEQ ID NO: 2202868 - protein, 12 aa, Cryptosporidium hominis
KHPGQGYYPTDA

SEQ ID NO: 2202869 - protein, 9 aa, Cryptosporidium hominis
KHRKNDTVA

SEQ ID NO: 2202870 - protein, 11 aa, Cryptosporidium hominis
KHSKRQKELEE

SEQ ID NO: 2202871 - protein, 4 aa, Cryptosporidium hominis
KHTS

SEQ ID NO: 2202872 - protein, 10 aa, Cryptosporidium hominis
KIASKFGKDS

SEQ ID NO: 2202873 - protein, 8 aa, Cryptosporidium hominis
KIDERTEM

SEQ ID NO: 2202874 - protein, 4 aa, Cryptosporidium hominis
KIDS

SEQ ID NO: 2202875 - protein, 6 aa, Cryptosporidium hominis
KIDSHS

SEQ ID NO: 2202876 - protein, 5 aa, Cryptosporidium hominis
KIEDN

SEQ ID NO: 2202877 - protein, 8 aa, Cryptosporidium hominis
KIEHQEKK

SEQ ID NO: 2202878 - protein, 5 aa, Cryptosporidium hominis
KIEPR

SEQ ID NO: 2202879 - protein, 9 aa, Cryptosporidium hominis
KIESRHDKA

SEQ ID NO: 2202880 - protein, 17 aa, Cryptosporidium hominis
KIGPTSGDETEGFQPPE

SEQ ID NO: 2202881 - protein, 4 aa, Cryptosporidium hominis
KIGS

SEQ ID NO: 2202882 - protein, 55 aa, Cryptosporidium hominis
KIHESAKGKNRKSSESFASDYESERIESPTLKYDETSRSGEKEQSISSAPEDQQY

SEQ ID NO: 2202883 - protein, 4 aa, Cryptosporidium hominis
KIHN

SEQ ID NO: 2202884 - protein, 6 aa, Cryptosporidium hominis
KIIGGE

SEQ ID NO: 2202885 - protein, 15 aa, Cryptosporidium hominis
KIKELKQEIQILMNL

SEQ ID NO: 2202886 - protein, 13 aa, Cryptosporidium hominis
KIKSSNSLEDADD

SEQ ID NO: 2202887 - protein, 5 aa, Cryptosporidium hominis
KINPE

SEQ ID NO: 2202888 - protein, 18 aa, Cryptosporidium hominis
KIPPPGELPIRSGNGACD

SEQ ID NO: 2202889 - protein, 7 aa, Cryptosporidium hominis
KIQGSKN

SEQ ID NO: 2202890 - protein, 6 aa, Cryptosporidium hominis
KISDGV

SEQ ID NO: 2202891 - protein, 5 aa, Cryptosporidium hominis
KISDL

SEQ ID NO: 2202892 - protein, 11 aa, Cryptosporidium hominis
KISKKASEDAE

SEQ ID NO: 2202893 - protein, 11 aa, Cryptosporidium hominis
KISPSKGSVQR

SEQ ID NO: 2202894 - protein, 6 aa, Cryptosporidium hominis
KISSGF

SEQ ID NO: 2202895 - protein, 5 aa, Cryptosporidium hominis
KITGP

SEQ ID NO: 2202896 - protein, 14 aa, Cryptosporidium hominis
KITPKTCTKADSVP

SEQ ID NO: 2202897 - protein, 7 aa, Cryptosporidium hominis
KIYSGKN

SEQ ID NO: 2202898 - protein, 7 aa, Cryptosporidium hominis
KKCSPGL

SEQ ID NO: 2202899 - protein, 8 aa, Cryptosporidium hominis
KKDASTQE

SEQ ID NO: 2202900 - protein, 8 aa, Cryptosporidium hominis
KKDDTGNI

SEQ ID NO: 2202901 - protein, 14 aa, Cryptosporidium hominis
KKDETKKELGSSGI

SEQ ID NO: 2202902 - protein, 23 aa, Cryptosporidium hominis
KKDLPSIEEEELDSEKSRDLKQL

SEQ ID NO: 2202903 - protein, 9 aa, Cryptosporidium hominis
KKDSESQAK

SEQ ID NO: 2202904 - protein, 7 aa, Cryptosporidium hominis
KKEFETR

SEQ ID NO: 2202905 - protein, 8 aa, Cryptosporidium hominis
KKEKSLEL

SEQ ID NO: 2202906 - protein, 6 aa, Cryptosporidium hominis
KKEQKK

SEQ ID NO: 2202907 - protein, 8 aa, Cryptosporidium hominis
KKESDINN

SEQ ID NO: 2202908 - protein, 10 aa, Cryptosporidium hominis
KKFPDASQRE

SEQ ID NO: 2202909 - protein, 4 aa, Cryptosporidium hominis
KKGA

SEQ ID NO: 2202910 - protein, 5 aa, Cryptosporidium hominis
KKGEV

SEQ ID NO: 2202911 - protein, 6 aa, Cryptosporidium hominis
KKGFDS

SEQ ID NO: 2202912 - protein, 84 aa, Cryptosporidium hominis
KKGKKFESKKSKIKEIKQQGEDSQEYGQEHKQEHKQGHEQEHDQEHEQEHEQEHEQEHEQEHDQEYEQEQGQEHDQEYQDDYKD

SEQ ID NO: 2202913 - protein, 5 aa, Cryptosporidium hominis
KKGKN

SEQ ID NO: 2202914 - protein, 8 aa, Cryptosporidium hominis
KKGYKKKR

SEQ ID NO: 2202915 - protein, 32 aa, Cryptosporidium hominis
KKIENSSNMNSSGIDPSDSADLELSAESIGIS

SEQ ID NO: 2202916 - protein, 4 aa, Cryptosporidium hominis
KKIP

SEQ ID NO: 2202917 - protein, 9 aa, Cryptosporidium hominis
KKKDSDENI

SEQ ID NO: 2202918 - protein, 8 aa, Cryptosporidium hominis
KKKKENEF

SEQ ID NO: 2202919 - protein, 14 aa, Cryptosporidium hominis
KKKNATPDEVRSSI

SEQ ID NO: 2202920 - protein, 16 aa, Cryptosporidium hominis
KKKNKPDENQATQFKK

SEQ ID NO: 2202921 - protein, 12 aa, Cryptosporidium hominis
KKKQKEHENRKQ

SEQ ID NO: 2202922 - protein, 58 aa, Cryptosporidium hominis
KKKSPSLKSLDSTQKQDSEQESDRVTPRPRSSQGEARRRGNASESERRSLSSASRSVS

SEQ ID NO: 2202923 - protein, 8 aa, Cryptosporidium hominis
KKKYPEAY

SEQ ID NO: 2202924 - protein, 5 aa, Cryptosporidium hominis
KKLPK

SEQ ID NO: 2202925 - protein, 10 aa, Cryptosporidium hominis
KKLRKEEESK

SEQ ID NO: 2202926 - protein, 6 aa, Cryptosporidium hominis
KKLRNS

SEQ ID NO: 2202927 - protein, 11 aa, Cryptosporidium hominis
KKLSGTSKIQT

SEQ ID NO: 2202928 - protein, 6 aa, Cryptosporidium hominis
KKNLKK

SEQ ID NO: 2202929 - protein, 6 aa, Cryptosporidium hominis
KKNSEV

SEQ ID NO: 2202930 - protein, 9 aa, Cryptosporidium hominis
KKNTGQTID

SEQ ID NO: 2202931 - protein, 4 aa, Cryptosporidium hominis
KKPA

SEQ ID NO: 2202932 - protein, 4 aa, Cryptosporidium hominis
KKPI

SEQ ID NO: 2202933 - protein, 13 aa, Cryptosporidium hominis
KKPIKTEPTKERR

SEQ ID NO: 2202934 - protein, 7 aa, Cryptosporidium hominis
KKPSSVK

SEQ ID NO: 2202935 - protein, 7 aa, Cryptosporidium hominis
KKPVKGC

SEQ ID NO: 2202936 - protein, 6 aa, Cryptosporidium hominis
KKQEIS

SEQ ID NO: 2202937 - protein, 44 aa, Cryptosporidium hominis
KKQLKNEKKNKNKSKNEGSGETSIESPKEKKSSCFSKKKKQDYV

SEQ ID NO: 2202938 - protein, 8 aa, Cryptosporidium hominis
KKQQKYAT

SEQ ID NO: 2202939 - protein, 20 aa, Cryptosporidium hominis
KKRKDSKKNEDENEDEEAYE

SEQ ID NO: 2202940 - protein, 26 aa, Cryptosporidium hominis
KKRKRKVNTHARTKLKDESDRQRVST

SEQ ID NO: 2202941 - protein, 9 aa, Cryptosporidium hominis
KKRNGDIND

SEQ ID NO: 2202942 - protein, 48 aa, Cryptosporidium hominis
KKRNQLNEEEEPTNEGSRSEDQEIGTDEPENSVEPEKTDKKNASTEMD

SEQ ID NO: 2202943 - protein, 8 aa, Cryptosporidium hominis
KKSEKNGE

SEQ ID NO: 2202944 - protein, 8 aa, Cryptosporidium hominis
KKSGISKR

SEQ ID NO: 2202945 - protein, 7 aa, Cryptosporidium hominis
KKSNCSS

SEQ ID NO: 2202946 - protein, 8 aa, Cryptosporidium hominis
KKSNDEYI

SEQ ID NO: 2202947 - protein, 7 aa, Cryptosporidium hominis
KKSRKYD

SEQ ID NO: 2202948 - protein, 11 aa, Cryptosporidium hominis
KKSSKTSYNPD

SEQ ID NO: 2202949 - protein, 6 aa, Cryptosporidium hominis
KKSSLE

SEQ ID NO: 2202950 - protein, 6 aa, Cryptosporidium hominis
KKSVSN

SEQ ID NO: 2202951 - protein, 18 aa, Cryptosporidium hominis
KKTGQDSQSPEGDQNVRK

SEQ ID NO: 2202952 - protein, 6 aa, Cryptosporidium hominis
KKTGYT

SEQ ID NO: 2202953 - protein, 8 aa, Cryptosporidium hominis
KKTNPYEQ

SEQ ID NO: 2202954 - protein, 7 aa, Cryptosporidium hominis
KKTTDGL

SEQ ID NO: 2202955 - protein, 10 aa, Cryptosporidium hominis
KKYKNSSSTL

SEQ ID NO: 2202956 - protein, 13 aa, Cryptosporidium hominis
KKYQKQLSDENDE

SEQ ID NO: 2202957 - protein, 13 aa, Cryptosporidium hominis
KKYRGQSVNYPPS

SEQ ID NO: 2202958 - protein, 10 aa, Cryptosporidium hominis
KKYSQEFRDS

SEQ ID NO: 2202959 - protein, 6 aa, Cryptosporidium hominis
KLAESG

SEQ ID NO: 2202960 - protein, 16 aa, Cryptosporidium hominis
KLEESRAALDERSKEA

SEQ ID NO: 2202961 - protein, 4 aa, Cryptosporidium hominis
KLER

SEQ ID NO: 2202962 - protein, 7 aa, Cryptosporidium hominis
KLGGEKA

SEQ ID NO: 2202963 - protein, 11 aa, Cryptosporidium hominis
KLKPQQGSHDQ

SEQ ID NO: 2202964 - protein, 6 aa, Cryptosporidium hominis
KLNDDN

SEQ ID NO: 2202965 - protein, 5 aa, Cryptosporidium hominis
KLNDN

SEQ ID NO: 2202966 - protein, 43 aa, Cryptosporidium hominis
KLNKKSDNNKNSNKDEEDDDEDDDEDDDEDEEEPEDSEKYPNK

SEQ ID NO: 2202967 - protein, 4 aa, Cryptosporidium hominis
KLNT

SEQ ID NO: 2202968 - protein, 7 aa, Cryptosporidium hominis
KLPDNFS

SEQ ID NO: 2202969 - protein, 15 aa, Cryptosporidium hominis
KLPSTRDKSSPSGGY

SEQ ID NO: 2202970 - protein, 6 aa, Cryptosporidium hominis
KLQEEE

SEQ ID NO: 2202971 - protein, 13 aa, Cryptosporidium hominis
KLSASLQAPTDMN

SEQ ID NO: 2202972 - protein, 8 aa, Cryptosporidium hominis
KLSKNDVD

SEQ ID NO: 2202973 - protein, 7 aa, Cryptosporidium hominis
KLSQTQE

SEQ ID NO: 2202974 - protein, 39 aa, Cryptosporidium hominis
KLSSEPNSSINTPLSSSPPPAPPPPPPLPNQSPTNSPSF

SEQ ID NO: 2202975 - protein, 9 aa, Cryptosporidium hominis
KLSSGTAGE

SEQ ID NO: 2202976 - protein, 10 aa, Cryptosporidium hominis
KLSTDERQSI

SEQ ID NO: 2202977 - protein, 7 aa, Cryptosporidium hominis
KLTASEK

SEQ ID NO: 2202978 - protein, 11 aa, Cryptosporidium hominis
KLTPRDSQNQI

SEQ ID NO: 2202979 - protein, 12 aa, Cryptosporidium hominis
KLTSNSDNKYES

SEQ ID NO: 2202980 - protein, 12 aa, Cryptosporidium hominis
KLVGDDKTLSEL

SEQ ID NO: 2202981 - protein, 6 aa, Cryptosporidium hominis
KMDPQD

SEQ ID NO: 2202982 - protein, 5 aa, Cryptosporidium hominis
KMDSI

SEQ ID NO: 2202983 - protein, 12 aa, Cryptosporidium hominis
KMKQNKKAPIIP

SEQ ID NO: 2202984 - protein, 15 aa, Cryptosporidium hominis
KMNDKSKEDSKISDV

SEQ ID NO: 2202985 - protein, 5 aa, Cryptosporidium hominis
KMRKN

SEQ ID NO: 2202986 - protein, 8 aa, Cryptosporidium hominis
KNAFDGNN

SEQ ID NO: 2202987 - protein, 11 aa, Cryptosporidium hominis
KNAFDSKGNNH

SEQ ID NO: 2202988 - protein, 6 aa, Cryptosporidium hominis
KNDEAV

SEQ ID NO: 2202989 - protein, 5 aa, Cryptosporidium hominis
KNDIE

SEQ ID NO: 2202990 - protein, 6 aa, Cryptosporidium hominis
KNDPRI

SEQ ID NO: 2202991 - protein, 7 aa, Cryptosporidium hominis
KNDPSTV

SEQ ID NO: 2202992 - protein, 7 aa, Cryptosporidium hominis
KNDSTYI

SEQ ID NO: 2202993 - protein, 5 aa, Cryptosporidium hominis
KNDYR

SEQ ID NO: 2202994 - protein, 9 aa, Cryptosporidium hominis
KNEFNDNDD

SEQ ID NO: 2202995 - protein, 6 aa, Cryptosporidium hominis
KNEKRW

SEQ ID NO: 2202996 - protein, 7 aa, Cryptosporidium hominis
KNEPAKN

SEQ ID NO: 2202997 - protein, 6 aa, Cryptosporidium hominis
KNESII

SEQ ID NO: 2202998 - protein, 26 aa, Cryptosporidium hominis
KNGGKKDKVSKESDLSFEKNDYSAQV

SEQ ID NO: 2202999 - protein, 10 aa, Cryptosporidium hominis
KNGGTETVDQ

SEQ ID NO: 2203000 - protein, 6 aa, Cryptosporidium hominis
KNGMER

SEQ ID NO: 2203001 - protein, 6 aa, Cryptosporidium hominis
KNGNEK

SEQ ID NO: 2203002 - protein, 7 aa, Cryptosporidium hominis
KNGSGTQ

SEQ ID NO: 2203003 - protein, 8 aa, Cryptosporidium hominis
KNGTPPKI

SEQ ID NO: 2203004 - protein, 5 aa, Cryptosporidium hominis
KNHPK

SEQ ID NO: 2203005 - protein, 11 aa, Cryptosporidium hominis
KNHQKNREAVN

SEQ ID NO: 2203006 - protein, 7 aa, Cryptosporidium hominis
KNIKTQV

SEQ ID NO: 2203007 - protein, 7 aa, Cryptosporidium hominis
KNIPSNL

SEQ ID NO: 2203008 - protein, 6 aa, Cryptosporidium hominis
KNIPSR

SEQ ID NO: 2203009 - protein, 5 aa, Cryptosporidium hominis
KNIQK

SEQ ID NO: 2203010 - protein, 5 aa, Cryptosporidium hominis
KNIVE

SEQ ID NO: 2203011 - protein, 13 aa, Cryptosporidium hominis
KNKDRKGVITTSS

SEQ ID NO: 2203012 - protein, 10 aa, Cryptosporidium hominis
KNKDSTDNKM

SEQ ID NO: 2203013 - protein, 4 aa, Cryptosporidium hominis
KNKE

SEQ ID NO: 2203014 - protein, 16 aa, Cryptosporidium hominis
KNKENKDSKEDLNTDS

SEQ ID NO: 2203015 - protein, 9 aa, Cryptosporidium hominis
KNKKELESL

SEQ ID NO: 2203016 - protein, 9 aa, Cryptosporidium hominis
KNKQNNQGI

SEQ ID NO: 2203017 - protein, 7 aa, Cryptosporidium hominis
KNKRNLE

SEQ ID NO: 2203018 - protein, 32 aa, Cryptosporidium hominis
KNKSSKKKNQKRKSSLGSIATRPSSSRPGFIG

SEQ ID NO: 2203019 - protein, 4 aa, Cryptosporidium hominis
KNKT

SEQ ID NO: 2203020 - protein, 6 aa, Cryptosporidium hominis
KNLTKK

SEQ ID NO: 2203021 - protein, 7 aa, Cryptosporidium hominis
KNMDSAQ

SEQ ID NO: 2203022 - protein, 9 aa, Cryptosporidium hominis
KNNDSGLEC

SEQ ID NO: 2203023 - protein, 46 aa, Cryptosporidium hominis
KNNFGTNNVPPAPIPTSIPTPSQIPSSVPPVAPPPMPNSNNSSIIG

SEQ ID NO: 2203024 - protein, 6 aa, Cryptosporidium hominis
KNNGIT

SEQ ID NO: 2203025 - protein, 6 aa, Cryptosporidium hominis
KNNINL

SEQ ID NO: 2203026 - protein, 11 aa, Cryptosporidium hominis
KNNLSRSKELE

SEQ ID NO: 2203027 - protein, 5 aa, Cryptosporidium hominis
KNPKQ

SEQ ID NO: 2203028 - protein, 7 aa, Cryptosporidium hominis
KNPPITG

SEQ ID NO: 2203029 - protein, 12 aa, Cryptosporidium hominis
KNPPSNTQYKGG

SEQ ID NO: 2203030 - protein, 6 aa, Cryptosporidium hominis
KNQLEA

SEQ ID NO: 2203031 - protein, 10 aa, Cryptosporidium hominis
KNRENAMSDA

SEQ ID NO: 2203032 - protein, 7 aa, Cryptosporidium hominis
KNRNELK

SEQ ID NO: 2203033 - protein, 10 aa, Cryptosporidium hominis
KNRSDCAAAG

SEQ ID NO: 2203034 - protein, 17 aa, Cryptosporidium hominis
KNSCSDPAAGLAGKPLG

SEQ ID NO: 2203035 - protein, 7 aa, Cryptosporidium hominis
KNSKDEV

SEQ ID NO: 2203036 - protein, 12 aa, Cryptosporidium hominis
KNSKPKNFKQGN

SEQ ID NO: 2203037 - protein, 10 aa, Cryptosporidium hominis
KNSNNNDKTL

SEQ ID NO: 2203038 - protein, 26 aa, Cryptosporidium hominis
KNSPPPPPPPPPPPPPPPPPPPLPPS

SEQ ID NO: 2203039 - protein, 8 aa, Cryptosporidium hominis
KNSSYEDL

SEQ ID NO: 2203040 - protein, 5 aa, Cryptosporidium hominis
KNTDE

SEQ ID NO: 2203041 - protein, 13 aa, Cryptosporidium hominis
KNTDNKPRASYPI

SEQ ID NO: 2203042 - protein, 12 aa, Cryptosporidium hominis
KNTIQTKNSEIN

SEQ ID NO: 2203043 - protein, 7 aa, Cryptosporidium hominis
KNTKSNI

SEQ ID NO: 2203044 - protein, 9 aa, Cryptosporidium hominis
KNTKTKEQI

SEQ ID NO: 2203045 - protein, 4 aa, Cryptosporidium hominis
KNVQ

SEQ ID NO: 2203046 - protein, 8 aa, Cryptosporidium hominis
KNYPGQLQ

SEQ ID NO: 2203047 - protein, 5 aa, Cryptosporidium hominis
KPCEI

SEQ ID NO: 2203048 - protein, 13 aa, Cryptosporidium hominis
KPCPSDQKFEDPT

SEQ ID NO: 2203049 - protein, 4 aa, Cryptosporidium hominis
KPEA

SEQ ID NO: 2203050 - protein, 6 aa, Cryptosporidium hominis
KPEEVC

SEQ ID NO: 2203051 - protein, 8 aa, Cryptosporidium hominis
KPELGGNT

SEQ ID NO: 2203052 - protein, 6 aa, Cryptosporidium hominis
KPEVAR

SEQ ID NO: 2203053 - protein, 4 aa, Cryptosporidium hominis
KPEY

SEQ ID NO: 2203054 - protein, 7 aa, Cryptosporidium hominis
KPGENWE

SEQ ID NO: 2203055 - protein, 6 aa, Cryptosporidium hominis
KPGINE

SEQ ID NO: 2203056 - protein, 13 aa, Cryptosporidium hominis
KPGNGKRQHCQYC

SEQ ID NO: 2203057 - protein, 16 aa, Cryptosporidium hominis
KPGSSYSTPPVNPPVQ

SEQ ID NO: 2203058 - protein, 9 aa, Cryptosporidium hominis
KPGTKRTDV

SEQ ID NO: 2203059 - protein, 25 aa, Cryptosporidium hominis
KPHKVPREMNDDDREKVRNKNSNEV

SEQ ID NO: 2203060 - protein, 7 aa, Cryptosporidium hominis
KPIHRTA

SEQ ID NO: 2203061 - protein, 38 aa, Cryptosporidium hominis
KPITEEISAEENSQKVDVPKAEQDLKDESSVEPPIESP

SEQ ID NO: 2203062 - protein, 14 aa, Cryptosporidium hominis
KPKDFTGPRKAESV

SEQ ID NO: 2203063 - protein, 12 aa, Cryptosporidium hominis
KPKESYSKKSRL

SEQ ID NO: 2203064 - protein, 9 aa, Cryptosporidium hominis
KPLNPVGST

SEQ ID NO: 2203065 - protein, 4 aa, Cryptosporidium hominis
KPLS

SEQ ID NO: 2203066 - protein, 6 aa, Cryptosporidium hominis
KPNEEQ

SEQ ID NO: 2203067 - protein, 5 aa, Cryptosporidium hominis
KPPFF

SEQ ID NO: 2203068 - protein, 16 aa, Cryptosporidium hominis
KPPKPGQAGDREDYGN

SEQ ID NO: 2203069 - protein, 9 aa, Cryptosporidium hominis
KPPPETYTK

SEQ ID NO: 2203070 - protein, 5 aa, Cryptosporidium hominis
KPPTL

SEQ ID NO: 2203071 - protein, 11 aa, Cryptosporidium hominis
KPQARSQPNAF

SEQ ID NO: 2203072 - protein, 10 aa, Cryptosporidium hominis
KPQDAPATDI

SEQ ID NO: 2203073 - protein, 59 aa, Cryptosporidium hominis
KPRNRSNPDRISQEPKKKIRSNRSKGSRSSDASVAEGEPPKGSLEEKTLTKEELASSRL

SEQ ID NO: 2203074 - protein, 12 aa, Cryptosporidium hominis
KPRSKNKPLTKK

SEQ ID NO: 2203075 - protein, 5 aa, Cryptosporidium hominis
KPSNQ

SEQ ID NO: 2203076 - protein, 14 aa, Cryptosporidium hominis
KPTGQGKVTRSQCT

SEQ ID NO: 2203077 - protein, 10 aa, Cryptosporidium hominis
KPTNTEPEGK

SEQ ID NO: 2203078 - protein, 5 aa, Cryptosporidium hominis
KPVED

SEQ ID NO: 2203079 - protein, 6 aa, Cryptosporidium hominis
KPWGGF

SEQ ID NO: 2203080 - protein, 5 aa, Cryptosporidium hominis
KPYIN

SEQ ID NO: 2203081 - protein, 28 aa, Cryptosporidium hominis
KQAEEKKSGKAKKGYDTFAEKSSLEEPA

SEQ ID NO: 2203082 - protein, 10 aa, Cryptosporidium hominis
KQATSIPTAY

SEQ ID NO: 2203083 - protein, 12 aa, Cryptosporidium hominis
KQCPNGPTELET

SEQ ID NO: 2203084 - protein, 6 aa, Cryptosporidium hominis
KQDPAS

SEQ ID NO: 2203085 - protein, 9 aa, Cryptosporidium hominis
KQEEQAGTP

SEQ ID NO: 2203086 - protein, 5 aa, Cryptosporidium hominis
KQGEL

SEQ ID NO: 2203087 - protein, 5 aa, Cryptosporidium hominis
KQGIL

SEQ ID NO: 2203088 - protein, 7 aa, Cryptosporidium hominis
KQHDINE

SEQ ID NO: 2203089 - protein, 6 aa, Cryptosporidium hominis
KQIKTQ

SEQ ID NO: 2203090 - protein, 16 aa, Cryptosporidium hominis
KQKFQEKRKPQKSKHI

SEQ ID NO: 2203091 - protein, 8 aa, Cryptosporidium hominis
KQKGGSEK

SEQ ID NO: 2203092 - protein, 14 aa, Cryptosporidium hominis
KQKKQADSKKRKEM

SEQ ID NO: 2203093 - protein, 71 aa, Cryptosporidium hominis
KQKSNEVPTDTKDVEVKSHDTTDKNPSEKNNEEKSLSSENQTEPTKEENKDEKKESETETENHEQKSNEEL

SEQ ID NO: 2203094 - protein, 7 aa, Cryptosporidium hominis
KQKSTIS

SEQ ID NO: 2203095 - protein, 6 aa, Cryptosporidium hominis
KQLENG

SEQ ID NO: 2203096 - protein, 8 aa, Cryptosporidium hominis
KQLKEGLG

SEQ ID NO: 2203097 - protein, 4 aa, Cryptosporidium hominis
KQMG

SEQ ID NO: 2203098 - protein, 5 aa, Cryptosporidium hominis
KQPMS

SEQ ID NO: 2203099 - protein, 8 aa, Cryptosporidium hominis
KQRNKELK

SEQ ID NO: 2203100 - protein, 5 aa, Cryptosporidium hominis
KQRSD

SEQ ID NO: 2203101 - protein, 13 aa, Cryptosporidium hominis
KQSLEDTTFDTQS

SEQ ID NO: 2203102 - protein, 23 aa, Cryptosporidium hominis
KQSPSHDTASLPASRTGAPIDSN

SEQ ID NO: 2203103 - protein, 5 aa, Cryptosporidium hominis
KQSSA

SEQ ID NO: 2203104 - protein, 5 aa, Cryptosporidium hominis
KQSVR

SEQ ID NO: 2203105 - protein, 13 aa, Cryptosporidium hominis
KQTKEEKKATTNV

SEQ ID NO: 2203106 - protein, 4 aa, Cryptosporidium hominis
KQYY

SEQ ID NO: 2203107 - protein, 5 aa, Cryptosporidium hominis
KRCSK

SEQ ID NO: 2203108 - protein, 7 aa, Cryptosporidium hominis
KRDNKLD

SEQ ID NO: 2203109 - protein, 9 aa, Cryptosporidium hominis
KRDSSSKWS

SEQ ID NO: 2203110 - protein, 9 aa, Cryptosporidium hominis
KREKNNTSE

SEQ ID NO: 2203111 - protein, 11 aa, Cryptosporidium hominis
KRESNLEKKES

SEQ ID NO: 2203112 - protein, 12 aa, Cryptosporidium hominis
KRGINTKPTREF

SEQ ID NO: 2203113 - protein, 6 aa, Cryptosporidium hominis
KRGKKA

SEQ ID NO: 2203114 - protein, 9 aa, Cryptosporidium hominis
KRGPSREKC

SEQ ID NO: 2203115 - protein, 17 aa, Cryptosporidium hominis
KRGQDPRPTPSKQPKLL

SEQ ID NO: 2203116 - protein, 6 aa, Cryptosporidium hominis
KRGRFS

SEQ ID NO: 2203117 - protein, 13 aa, Cryptosporidium hominis
KRHESQKKYNNPK

SEQ ID NO: 2203118 - protein, 6 aa, Cryptosporidium hominis
KRIEEE

SEQ ID NO: 2203119 - protein, 21 aa, Cryptosporidium hominis
KRKEEEKRKKIEQKKIEEEEK

SEQ ID NO: 2203120 - protein, 25 aa, Cryptosporidium hominis
KRKIKNKAKKRYKMNKDRKSKKPNI

SEQ ID NO: 2203121 - protein, 10 aa, Cryptosporidium hominis
KRKPKTEREL

SEQ ID NO: 2203122 - protein, 6 aa, Cryptosporidium hominis
KRLTKG

SEQ ID NO: 2203123 - protein, 5 aa, Cryptosporidium hominis
KRNGI

SEQ ID NO: 2203124 - protein, 10 aa, Cryptosporidium hominis
KRNSCGDTGK

SEQ ID NO: 2203125 - protein, 5 aa, Cryptosporidium hominis
KRPRK

SEQ ID NO: 2203126 - protein, 12 aa, Cryptosporidium hominis
KRPTAYSSPAII

SEQ ID NO: 2203127 - protein, 4 aa, Cryptosporidium hominis
KRQE

SEQ ID NO: 2203128 - protein, 11 aa, Cryptosporidium hominis
KRREANENEKE

SEQ ID NO: 2203129 - protein, 18 aa, Cryptosporidium hominis
KRSGESFVSSGGCGGGKC

SEQ ID NO: 2203130 - protein, 6 aa, Cryptosporidium hominis
KRSIAG

SEQ ID NO: 2203131 - protein, 9 aa, Cryptosporidium hominis
KRSKLGENA

SEQ ID NO: 2203132 - protein, 6 aa, Cryptosporidium hominis
KRSQNS

SEQ ID NO: 2203133 - protein, 4 aa, Cryptosporidium hominis
KRSS

SEQ ID NO: 2203134 - protein, 7 aa, Cryptosporidium hominis
KRTDKER

SEQ ID NO: 2203135 - protein, 5 aa, Cryptosporidium hominis
KRTHP

SEQ ID NO: 2203136 - protein, 6 aa, Cryptosporidium hominis
KRTSEV

SEQ ID NO: 2203137 - protein, 4 aa, Cryptosporidium hominis
KRWG

SEQ ID NO: 2203138 - protein, 14 aa, Cryptosporidium hominis
KRYSGKSIRTNKKG

SEQ ID NO: 2203139 - protein, 7 aa, Cryptosporidium hominis
KSADAFS

SEQ ID NO: 2203140 - protein, 7 aa, Cryptosporidium hominis
KSAEENT

SEQ ID NO: 2203141 - protein, 4 aa, Cryptosporidium hominis
KSAF

SEQ ID NO: 2203142 - protein, 12 aa, Cryptosporidium hominis
KSAQISKGTTIE

SEQ ID NO: 2203143 - protein, 7 aa, Cryptosporidium hominis
KSARKSI

SEQ ID NO: 2203144 - protein, 15 aa, Cryptosporidium hominis
KSASDTEIKKAYRQK

SEQ ID NO: 2203145 - protein, 8 aa, Cryptosporidium hominis
KSCKDKSE

SEQ ID NO: 2203146 - protein, 5 aa, Cryptosporidium hominis
KSCPP

SEQ ID NO: 2203147 - protein, 15 aa, Cryptosporidium hominis
KSDIESGSESSNGFD

SEQ ID NO: 2203148 - protein, 6 aa, Cryptosporidium hominis
KSDKAA

SEQ ID NO: 2203149 - protein, 8 aa, Cryptosporidium hominis
KSDLNDSF

SEQ ID NO: 2203150 - protein, 7 aa, Cryptosporidium hominis
KSDVTRE

SEQ ID NO: 2203151 - protein, 7 aa, Cryptosporidium hominis
KSEDDSE

SEQ ID NO: 2203152 - protein, 9 aa, Cryptosporidium hominis
KSEEDCPEN

SEQ ID NO: 2203153 - protein, 9 aa, Cryptosporidium hominis
KSEEVEDSE

SEQ ID NO: 2203154 - protein, 6 aa, Cryptosporidium hominis
KSEFNK

SEQ ID NO: 2203155 - protein, 8 aa, Cryptosporidium hominis
KSEFPSSG

SEQ ID NO: 2203156 - protein, 6 aa, Cryptosporidium hominis
KSENDN

SEQ ID NO: 2203157 - protein, 5 aa, Cryptosporidium hominis
KSEPN

SEQ ID NO: 2203158 - protein, 18 aa, Cryptosporidium hominis
KSEPSANSDAETEPEKIK

SEQ ID NO: 2203159 - protein, 7 aa, Cryptosporidium hominis
KSEQKYE

SEQ ID NO: 2203160 - protein, 8 aa, Cryptosporidium hominis
KSGGDGSL

SEQ ID NO: 2203161 - protein, 5 aa, Cryptosporidium hominis
KSGGH

SEQ ID NO: 2203162 - protein, 50 aa, Cryptosporidium hominis
KSGNQDLNGNSESNGKKGSEGNSGALGAASTSSTPPPPPPPPSPPPPPTL

SEQ ID NO: 2203163 - protein, 6 aa, Cryptosporidium hominis
KSGSIF

SEQ ID NO: 2203164 - protein, 6 aa, Cryptosporidium hominis
KSHTSL

SEQ ID NO: 2203165 - protein, 6 aa, Cryptosporidium hominis
KSIDEL

SEQ ID NO: 2203166 - protein, 13 aa, Cryptosporidium hominis
KSIKDKDSGLREK

SEQ ID NO: 2203167 - protein, 7 aa, Cryptosporidium hominis
KSIKESS

SEQ ID NO: 2203168 - protein, 21 aa, Cryptosporidium hominis
KSIKQKSDTALAAKALSGHNQ

SEQ ID NO: 2203169 - protein, 9 aa, Cryptosporidium hominis
KSKDSSKDI

SEQ ID NO: 2203170 - protein, 9 aa, Cryptosporidium hominis
KSKEGEVGY

SEQ ID NO: 2203171 - protein, 216 aa, Cryptosporidium hominis
KSKFDNGGVKTASKAKTKTKSEPKPKTEATSKIAKTKAKTESKSTSKPVAKAKTTNSKTKAKTESKTESKTKPKTSSSSSKAKTESNTIKTTSKTKTKVDSKTKASTSKTKTKTEPKTKAKTEPKTKAKTEPKTKAKTEPKTKSKTEPKIEPKIKPKTSSSTKAKAEPKTTKAASKTKARTMTTPKTTKTKTTAKSKNDTSKSTTSCKKTTKCRTK

SEQ ID NO: 2203172 - protein, 7 aa, Cryptosporidium hominis
KSKGEKE

SEQ ID NO: 2203173 - protein, 10 aa, Cryptosporidium hominis
KSKKPAERKI

SEQ ID NO: 2203174 - protein, 6 aa, Cryptosporidium hominis
KSKNLN

SEQ ID NO: 2203175 - protein, 22 aa, Cryptosporidium hominis
KSKSSRCSARDDSYVSGTIPTS

SEQ ID NO: 2203176 - protein, 4 aa, Cryptosporidium hominis
KSLE

SEQ ID NO: 2203177 - protein, 5 aa, Cryptosporidium hominis
KSLEE

SEQ ID NO: 2203178 - protein, 13 aa, Cryptosporidium hominis
KSLPQKPCSQCPS

SEQ ID NO: 2203179 - protein, 9 aa, Cryptosporidium hominis
KSLRQSKTE

SEQ ID NO: 2203180 - protein, 9 aa, Cryptosporidium hominis
KSMKNSQQD

SEQ ID NO: 2203181 - protein, 6 aa, Cryptosporidium hominis
KSNDPR

SEQ ID NO: 2203182 - protein, 6 aa, Cryptosporidium hominis
KSNEID

SEQ ID NO: 2203183 - protein, 7 aa, Cryptosporidium hominis
KSNGYDK

SEQ ID NO: 2203184 - protein, 5 aa, Cryptosporidium hominis
KSNND

SEQ ID NO: 2203185 - protein, 6 aa, Cryptosporidium hominis
KSNREG

SEQ ID NO: 2203186 - protein, 6 aa, Cryptosporidium hominis
KSPEEF

SEQ ID NO: 2203187 - protein, 5 aa, Cryptosporidium hominis
KSPGD

SEQ ID NO: 2203188 - protein, 20 aa, Cryptosporidium hominis
KSPGGPPKPPERLSSLSGLL

SEQ ID NO: 2203189 - protein, 14 aa, Cryptosporidium hominis
KSPSTSSGSNEPLT

SEQ ID NO: 2203190 - protein, 9 aa, Cryptosporidium hominis
KSPTRATSI

SEQ ID NO: 2203191 - protein, 6 aa, Cryptosporidium hominis
KSPVSS

SEQ ID NO: 2203192 - protein, 8 aa, Cryptosporidium hominis
KSQAPSLG

SEQ ID NO: 2203193 - protein, 6 aa, Cryptosporidium hominis
KSQDFS

SEQ ID NO: 2203194 - protein, 6 aa, Cryptosporidium hominis
KSQRIN

SEQ ID NO: 2203195 - protein, 6 aa, Cryptosporidium hominis
KSQVDE

SEQ ID NO: 2203196 - protein, 7 aa, Cryptosporidium hominis
KSQYQKD

SEQ ID NO: 2203197 - protein, 25 aa, Cryptosporidium hominis
KSRARKNLNRRISSDLDDEEEENVE

SEQ ID NO: 2203198 - protein, 6 aa, Cryptosporidium hominis
KSRGSI

SEQ ID NO: 2203199 - protein, 4 aa, Cryptosporidium hominis
KSRK

SEQ ID NO: 2203200 - protein, 8 aa, Cryptosporidium hominis
KSRNDYFG

SEQ ID NO: 2203201 - protein, 8 aa, Cryptosporidium hominis
KSRNTLEV

SEQ ID NO: 2203202 - protein, 10 aa, Cryptosporidium hominis
KSRRDEEKDD

SEQ ID NO: 2203203 - protein, 43 aa, Cryptosporidium hominis
KSRRNKKQTISIEESDSTSDSEIESKNQDSVDKEKKKKRNKLR

SEQ ID NO: 2203204 - protein, 10 aa, Cryptosporidium hominis
KSSDKGIAKD

SEQ ID NO: 2203205 - protein, 16 aa, Cryptosporidium hominis
KSSENGCENNNNEENP

SEQ ID NO: 2203206 - protein, 6 aa, Cryptosporidium hominis
KSSEYD

SEQ ID NO: 2203207 - protein, 18 aa, Cryptosporidium hominis
KSSGLNTSQTNSGYYGNK

SEQ ID NO: 2203208 - protein, 8 aa, Cryptosporidium hominis
KSSLSEED

SEQ ID NO: 2203209 - protein, 6 aa, Cryptosporidium hominis
KSSQDL

SEQ ID NO: 2203210 - protein, 15 aa, Cryptosporidium hominis
KSSQEGSSIDESSSD

SEQ ID NO: 2203211 - protein, 8 aa, Cryptosporidium hominis
KSSSFSGY

SEQ ID NO: 2203212 - protein, 10 aa, Cryptosporidium hominis
KSSSIGERST

SEQ ID NO: 2203213 - protein, 19 aa, Cryptosporidium hominis
KSSSISNNNNNNNNNNNKL

SEQ ID NO: 2203214 - protein, 9 aa, Cryptosporidium hominis
KSSSTCISS

SEQ ID NO: 2203215 - protein, 56 aa, Cryptosporidium hominis
KSSTTTTTTTTIAPVSSEDKTEDDSEDEKDPDSEEQNDSSNEGPSGSENSEETKKT

SEQ ID NO: 2203216 - protein, 6 aa, Cryptosporidium hominis
KSSYTN

SEQ ID NO: 2203217 - protein, 20 aa, Cryptosporidium hominis
KSTASNSFGRVKPKTSYTQD

SEQ ID NO: 2203218 - protein, 16 aa, Cryptosporidium hominis
KSTDDDISKPEERSSR

SEQ ID NO: 2203219 - protein, 5 aa, Cryptosporidium hominis
KSTIE

SEQ ID NO: 2203220 - protein, 6 aa, Cryptosporidium hominis
KSVESL

SEQ ID NO: 2203221 - protein, 5 aa, Cryptosporidium hominis
KSVKE

SEQ ID NO: 2203222 - protein, 7 aa, Cryptosporidium hominis
KSVSEYR

SEQ ID NO: 2203223 - protein, 13 aa, Cryptosporidium hominis
KSVSSKSSTGFSD

SEQ ID NO: 2203224 - protein, 12 aa, Cryptosporidium hominis
KSYNLTVNVTIE

SEQ ID NO: 2203225 - protein, 13 aa, Cryptosporidium hominis
KSYSKTSKNLSEG

SEQ ID NO: 2203226 - protein, 6 aa, Cryptosporidium hominis
KSYTSS

SEQ ID NO: 2203227 - protein, 5 aa, Cryptosporidium hominis
KTAAI

SEQ ID NO: 2203228 - protein, 9 aa, Cryptosporidium hominis
KTAGHPRHE

SEQ ID NO: 2203229 - protein, 20 aa, Cryptosporidium hominis
KTALPEANPPQGKREVGVQV

SEQ ID NO: 2203230 - protein, 25 aa, Cryptosporidium hominis
KTASKNSITKTRSAETNAKKKSGFT

SEQ ID NO: 2203231 - protein, 6 aa, Cryptosporidium hominis
KTASNA

SEQ ID NO: 2203232 - protein, 7 aa, Cryptosporidium hominis
KTASNES

SEQ ID NO: 2203233 - protein, 19 aa, Cryptosporidium hominis
KTASSTGNPSIQGGGIGAN

SEQ ID NO: 2203234 - protein, 6 aa, Cryptosporidium hominis
KTDKNV

SEQ ID NO: 2203235 - protein, 6 aa, Cryptosporidium hominis
KTDQVN

SEQ ID NO: 2203236 - protein, 5 aa, Cryptosporidium hominis
KTFSD

SEQ ID NO: 2203237 - protein, 7 aa, Cryptosporidium hominis
KTFSGGR

SEQ ID NO: 2203238 - protein, 6 aa, Cryptosporidium hominis
KTGAIS

SEQ ID NO: 2203239 - protein, 8 aa, Cryptosporidium hominis
KTGLHDKP

SEQ ID NO: 2203240 - protein, 9 aa, Cryptosporidium hominis
KTGQEEDGL

SEQ ID NO: 2203241 - protein, 4 aa, Cryptosporidium hominis
KTHT

SEQ ID NO: 2203242 - protein, 5 aa, Cryptosporidium hominis
KTIQE

SEQ ID NO: 2203243 - protein, 5 aa, Cryptosporidium hominis
KTISL

SEQ ID NO: 2203244 - protein, 8 aa, Cryptosporidium hominis
KTKAKTTL

SEQ ID NO: 2203245 - protein, 6 aa, Cryptosporidium hominis
KTKKEL

SEQ ID NO: 2203246 - protein, 10 aa, Cryptosporidium hominis
KTKLGSSMGD

SEQ ID NO: 2203247 - protein, 8 aa, Cryptosporidium hominis
KTKNNDRY

SEQ ID NO: 2203248 - protein, 8 aa, Cryptosporidium hominis
KTKSDRVD

SEQ ID NO: 2203249 - protein, 7 aa, Cryptosporidium hominis
KTKSSQG

SEQ ID NO: 2203250 - protein, 5 aa, Cryptosporidium hominis
KTLDE

SEQ ID NO: 2203251 - protein, 7 aa, Cryptosporidium hominis
KTLNEKN

SEQ ID NO: 2203252 - protein, 19 aa, Cryptosporidium hominis
KTNEHDLSNKLTKKEERIE

SEQ ID NO: 2203253 - protein, 6 aa, Cryptosporidium hominis
KTNESL

SEQ ID NO: 2203254 - protein, 8 aa, Cryptosporidium hominis
KTNKRTNP

SEQ ID NO: 2203255 - protein, 13 aa, Cryptosporidium hominis
KTNWSSTSTVATA

SEQ ID NO: 2203256 - protein, 5 aa, Cryptosporidium hominis
KTPDV

SEQ ID NO: 2203257 - protein, 14 aa, Cryptosporidium hominis
KTPPTLKCPPGSVD

SEQ ID NO: 2203258 - protein, 9 aa, Cryptosporidium hominis
KTQGENNNY

SEQ ID NO: 2203259 - protein, 7 aa, Cryptosporidium hominis
KTRGDGL

SEQ ID NO: 2203260 - protein, 91 aa, Cryptosporidium hominis
KTRINGNLTGGNFSSRDKSLDEKRTPSPNIPSPPSFPAPPPPYISSGTPSRTPMPKNGDLTSDPKMSTLGHQGSSQSSEPKSKRKPLTRKG

SEQ ID NO: 2203261 - protein, 17 aa, Cryptosporidium hominis
KTSEEAGNRNQNNTGDR

SEQ ID NO: 2203262 - protein, 9 aa, Cryptosporidium hominis
KTSKTYTEA

SEQ ID NO: 2203263 - protein, 12 aa, Cryptosporidium hominis
KTTKEKKCSADQ

SEQ ID NO: 2203264 - protein, 9 aa, Cryptosporidium hominis
KTTNVSESS

SEQ ID NO: 2203265 - protein, 8 aa, Cryptosporidium hominis
KTTTLNDY

SEQ ID NO: 2203266 - protein, 4 aa, Cryptosporidium hominis
KVAT

SEQ ID NO: 2203267 - protein, 14 aa, Cryptosporidium hominis
KVETEEASSEKGIS

SEQ ID NO: 2203268 - protein, 7 aa, Cryptosporidium hominis
KVGTTGN

SEQ ID NO: 2203269 - protein, 7 aa, Cryptosporidium hominis
KVKNPDR

SEQ ID NO: 2203270 - protein, 6 aa, Cryptosporidium hominis
KVKQGR

SEQ ID NO: 2203271 - protein, 11 aa, Cryptosporidium hominis
KVLSSQGLSEY

SEQ ID NO: 2203272 - protein, 8 aa, Cryptosporidium hominis
KVMPTTPD

SEQ ID NO: 2203273 - protein, 17 aa, Cryptosporidium hominis
KVNEDSKQAKNRLGKEY

SEQ ID NO: 2203274 - protein, 16 aa, Cryptosporidium hominis
KVNKESPGLESKASAV

SEQ ID NO: 2203275 - protein, 4 aa, Cryptosporidium hominis
KVNQ

SEQ ID NO: 2203276 - protein, 7 aa, Cryptosporidium hominis
KVPEASE

SEQ ID NO: 2203277 - protein, 8 aa, Cryptosporidium hominis
KVPTRPLP

SEQ ID NO: 2203278 - protein, 6 aa, Cryptosporidium hominis
KVRSSN

SEQ ID NO: 2203279 - protein, 11 aa, Cryptosporidium hominis
KVSAENDLNDK

SEQ ID NO: 2203280 - protein, 8 aa, Cryptosporidium hominis
KVSGDLKE

SEQ ID NO: 2203281 - protein, 15 aa, Cryptosporidium hominis
KVSKKEAKKNKPKRA

SEQ ID NO: 2203282 - protein, 6 aa, Cryptosporidium hominis
KVSNKT

SEQ ID NO: 2203283 - protein, 4 aa, Cryptosporidium hominis
KVSQ

SEQ ID NO: 2203284 - protein, 6 aa, Cryptosporidium hominis
KVVRPG

SEQ ID NO: 2203285 - protein, 10 aa, Cryptosporidium hominis
KWSKSRELKK

SEQ ID NO: 2203286 - protein, 10 aa, Cryptosporidium hominis
KWYEKRDPIT

SEQ ID NO: 2203287 - protein, 4 aa, Cryptosporidium hominis
KYDL

SEQ ID NO: 2203288 - protein, 5 aa, Cryptosporidium hominis
KYEKR

SEQ ID NO: 2203289 - protein, 4 aa, Cryptosporidium hominis
KYET

SEQ ID NO: 2203290 - protein, 9 aa, Cryptosporidium hominis
KYETKGTES

SEQ ID NO: 2203291 - protein, 9 aa, Cryptosporidium hominis
KYGDNKLDT

SEQ ID NO: 2203292 - protein, 5 aa, Cryptosporidium hominis
KYGGY

SEQ ID NO: 2203293 - protein, 8 aa, Cryptosporidium hominis
KYHDSGKK

SEQ ID NO: 2203294 - protein, 36 aa, Cryptosporidium hominis
KYLNNSSKICKDKETNRTSTKGKKMTRERETNEKKI

SEQ ID NO: 2203295 - protein, 12 aa, Cryptosporidium hominis
KYLSSSNGLEGL

SEQ ID NO: 2203296 - protein, 7 aa, Cryptosporidium hominis
KYNGNTK

SEQ ID NO: 2203297 - protein, 7 aa, Cryptosporidium hominis
KYNGTIS

SEQ ID NO: 2203298 - protein, 7 aa, Cryptosporidium hominis
KYNKEND

SEQ ID NO: 2203299 - protein, 8 aa, Cryptosporidium hominis
KYPEIGQY

SEQ ID NO: 2203300 - protein, 17 aa, Cryptosporidium hominis
KYPGHQKDGVGSRFSET

SEQ ID NO: 2203301 - protein, 4 aa, Cryptosporidium hominis
KYPN

SEQ ID NO: 2203302 - protein, 10 aa, Cryptosporidium hominis
KYPPESRKKP

SEQ ID NO: 2203303 - protein, 9 aa, Cryptosporidium hominis
KYPSESSQI

SEQ ID NO: 2203304 - protein, 6 aa, Cryptosporidium hominis
KYPSVE

SEQ ID NO: 2203305 - protein, 12 aa, Cryptosporidium hominis
KYSADSHTYNAG

SEQ ID NO: 2203306 - protein, 8 aa, Cryptosporidium hominis
KYSEFDSK

SEQ ID NO: 2203307 - protein, 6 aa, Cryptosporidium hominis
KYSKEE

SEQ ID NO: 2203308 - protein, 4 aa, Cryptosporidium hominis
KYSP

SEQ ID NO: 2203309 - protein, 7 aa, Cryptosporidium hominis
KYSPELG

SEQ ID NO: 2203310 - protein, 61 aa, Cryptosporidium hominis
KYSQEDGSFVENKKGSKKESKAIDSTETAEEALQSNSESDVNKTNIKDDGEKTKESSEQLE

SEQ ID NO: 2203311 - protein, 13 aa, Cryptosporidium hominis
KYSRDYSSEELER

SEQ ID NO: 2203312 - protein, 5 aa, Cryptosporidium hominis
KYSRR

SEQ ID NO: 2203313 - protein, 10 aa, Cryptosporidium hominis
KYSSLSNKHY

SEQ ID NO: 2203314 - protein, 9 aa, Cryptosporidium hominis
KYYPDPPNI

SEQ ID NO: 2203315 - protein, 5 aa, Cryptosporidium hominis
LADKL

SEQ ID NO: 2203316 - protein, 17 aa, Cryptosporidium hominis
LADKTNQMYETSEQITT

SEQ ID NO: 2203317 - protein, 27 aa, Cryptosporidium hominis
LANKTSNESKKTEIESYASSNSTSNLG

SEQ ID NO: 2203318 - protein, 7 aa, Cryptosporidium hominis
LAPELSP

SEQ ID NO: 2203319 - protein, 16 aa, Cryptosporidium hominis
LAPRKSPNLGIESSEI

SEQ ID NO: 2203320 - protein, 4 aa, Cryptosporidium hominis
LASH

SEQ ID NO: 2203321 - protein, 6 aa, Cryptosporidium hominis
LASYKR

SEQ ID NO: 2203322 - protein, 14 aa, Cryptosporidium hominis
LCENPDSSSPLSKF

SEQ ID NO: 2203323 - protein, 12 aa, Cryptosporidium hominis
LCETTSNNERFN

SEQ ID NO: 2203324 - protein, 8 aa, Cryptosporidium hominis
LDDEVNES

SEQ ID NO: 2203325 - protein, 6 aa, Cryptosporidium hominis
LDEQYK

SEQ ID NO: 2203326 - protein, 11 aa, Cryptosporidium hominis
LDGGNVQAKTD

SEQ ID NO: 2203327 - protein, 59 aa, Cryptosporidium hominis
LDGSDGGKNPDRPLGRRGGMRGRNGGNRQDKSSSSSSNSGSSSSPDGPVSSGGGGKGGV

SEQ ID NO: 2203328 - protein, 20 aa, Cryptosporidium hominis
LDGSSSSQGYSGSRAGSGWT

SEQ ID NO: 2203329 - protein, 13 aa, Cryptosporidium hominis
LDHKTSANSQASL

SEQ ID NO: 2203330 - protein, 17 aa, Cryptosporidium hominis
LDKEKNNNKSSGSKDKD

SEQ ID NO: 2203331 - protein, 7 aa, Cryptosporidium hominis
LDKKTQK

SEQ ID NO: 2203332 - protein, 4 aa, Cryptosporidium hominis
LDLT

SEQ ID NO: 2203333 - protein, 7 aa, Cryptosporidium hominis
LDPDSDS

SEQ ID NO: 2203334 - protein, 16 aa, Cryptosporidium hominis
LDPTRSSKIGSKMPTN

SEQ ID NO: 2203335 - protein, 17 aa, Cryptosporidium hominis
LDREKSCTQIKKGTGLN

SEQ ID NO: 2203336 - protein, 17 aa, Cryptosporidium hominis
LDSKGNRLENKIPKPTL

SEQ ID NO: 2203337 - protein, 6 aa, Cryptosporidium hominis
LDSKKN

SEQ ID NO: 2203338 - protein, 5 aa, Cryptosporidium hominis
LDSPV

SEQ ID NO: 2203339 - protein, 8 aa, Cryptosporidium hominis
LDSQDSSV

SEQ ID NO: 2203340 - protein, 18 aa, Cryptosporidium hominis
LDSSDTLDESTPSSNSEL

SEQ ID NO: 2203341 - protein, 6 aa, Cryptosporidium hominis
LDSTGT

SEQ ID NO: 2203342 - protein, 17 aa, Cryptosporidium hominis
LDTNDGFEEVKDSSFQN

SEQ ID NO: 2203343 - protein, 13 aa, Cryptosporidium hominis
LDTRVKGGSKHST

SEQ ID NO: 2203344 - protein, 10 aa, Cryptosporidium hominis
LDWKGKESGI

SEQ ID NO: 2203345 - protein, 9 aa, Cryptosporidium hominis
LDYETGKKI

SEQ ID NO: 2203346 - protein, 7 aa, Cryptosporidium hominis
LEASEKL

SEQ ID NO: 2203347 - protein, 5 aa, Cryptosporidium hominis
LEDAN

SEQ ID NO: 2203348 - protein, 23 aa, Cryptosporidium hominis
LEDDELGKFSREKKIGVILELLI

SEQ ID NO: 2203349 - protein, 8 aa, Cryptosporidium hominis
LEDTGSPS

SEQ ID NO: 2203350 - protein, 7 aa, Cryptosporidium hominis
LEEKRKH

SEQ ID NO: 2203351 - protein, 7 aa, Cryptosporidium hominis
LEERERS

SEQ ID NO: 2203352 - protein, 6 aa, Cryptosporidium hominis
LEESDP

SEQ ID NO: 2203353 - protein, 10 aa, Cryptosporidium hominis
LEGGDSVSQH

SEQ ID NO: 2203354 - protein, 14 aa, Cryptosporidium hominis
LEGPENNHKKKNPV

SEQ ID NO: 2203355 - protein, 10 aa, Cryptosporidium hominis
LEKAKSSSNF

SEQ ID NO: 2203356 - protein, 8 aa, Cryptosporidium hominis
LEKERLEK

SEQ ID NO: 2203357 - protein, 6 aa, Cryptosporidium hominis
LEKETS

SEQ ID NO: 2203358 - protein, 11 aa, Cryptosporidium hominis
LEKSEENKELA

SEQ ID NO: 2203359 - protein, 6 aa, Cryptosporidium hominis
LENNNS

SEQ ID NO: 2203360 - protein, 14 aa, Cryptosporidium hominis
LENSASKAKGARKD

SEQ ID NO: 2203361 - protein, 20 aa, Cryptosporidium hominis
LENSENTSKTIETLRSTNKI

SEQ ID NO: 2203362 - protein, 7 aa, Cryptosporidium hominis
LENTVAT

SEQ ID NO: 2203363 - protein, 11 aa, Cryptosporidium hominis
LEPHPGKTSIS

SEQ ID NO: 2203364 - protein, 11 aa, Cryptosporidium hominis
LEPKHNSNSEL

SEQ ID NO: 2203365 - protein, 20 aa, Cryptosporidium hominis
LEPQPNISTIEKNSESNEEL

SEQ ID NO: 2203366 - protein, 39 aa, Cryptosporidium hominis
LEQNDDKKKNKGKKRKLDEKKSEDKGKNKKKKLAKNKKN

SEQ ID NO: 2203367 - protein, 35 aa, Cryptosporidium hominis
LEQNSDRVSSALSSVASSTSQTSSSSSPAKSRKHS

SEQ ID NO: 2203368 - protein, 36 aa, Cryptosporidium hominis
LEQTDEETNQGDGDDGEDDDEDDEDNGDDDGTQYDS

SEQ ID NO: 2203369 - protein, 4 aa, Cryptosporidium hominis
LERY

SEQ ID NO: 2203370 - protein, 4 aa, Cryptosporidium hominis
LESA

SEQ ID NO: 2203371 - protein, 10 aa, Cryptosporidium hominis
LESDQAIPDD

SEQ ID NO: 2203372 - protein, 11 aa, Cryptosporidium hominis
LESEIKGSIES

SEQ ID NO: 2203373 - protein, 6 aa, Cryptosporidium hominis
LESNGT

SEQ ID NO: 2203374 - protein, 4 aa, Cryptosporidium hominis
LESS

SEQ ID NO: 2203375 - protein, 14 aa, Cryptosporidium hominis
LETDDSQTESEFEN

SEQ ID NO: 2203376 - protein, 9 aa, Cryptosporidium hominis
LETENTNSR

SEQ ID NO: 2203377 - protein, 11 aa, Cryptosporidium hominis
LEYSQKNNIAN

SEQ ID NO: 2203378 - protein, 8 aa, Cryptosporidium hominis
LGANNSTG

SEQ ID NO: 2203379 - protein, 9 aa, Cryptosporidium hominis
LGCSQTDND

SEQ ID NO: 2203380 - protein, 24 aa, Cryptosporidium hominis
LGDEETESSTKSQAESGVSQENSA

SEQ ID NO: 2203381 - protein, 9 aa, Cryptosporidium hominis
LGDEQDLDQ

SEQ ID NO: 2203382 - protein, 12 aa, Cryptosporidium hominis
LGDKNRVNQNED

SEQ ID NO: 2203383 - protein, 10 aa, Cryptosporidium hominis
LGDNPKTGII

SEQ ID NO: 2203384 - protein, 17 aa, Cryptosporidium hominis
LGDNSGSNSTVSEPAHN

SEQ ID NO: 2203385 - protein, 19 aa, Cryptosporidium hominis
LGDPGTEAPGINSDFPDNS

SEQ ID NO: 2203386 - protein, 6 aa, Cryptosporidium hominis
LGEEEK

SEQ ID NO: 2203387 - protein, 8 aa, Cryptosporidium hominis
LGGEGDDI

SEQ ID NO: 2203388 - protein, 64 aa, Cryptosporidium hominis
LGGEGDDIKGIDTSASSLDLTKEKEKAIKEEMDRKKGDDTITKGEEIGKENVELEDDKKGSSES

SEQ ID NO: 2203389 - protein, 72 aa, Cryptosporidium hominis
LGGEGDDIKGIDTSASSLDLTKEKEKATKKEKTKKGIKISRKPKESKKGSKKGSKKGSKKGIKKGSKGSEDE

SEQ ID NO: 2203390 - protein, 9 aa, Cryptosporidium hominis
LGGGSPSLI

SEQ ID NO: 2203391 - protein, 7 aa, Cryptosporidium hominis
LGGSHAE

SEQ ID NO: 2203392 - protein, 6 aa, Cryptosporidium hominis
LGGSLV

SEQ ID NO: 2203393 - protein, 7 aa, Cryptosporidium hominis
LGKSDAT

SEQ ID NO: 2203394 - protein, 16 aa, Cryptosporidium hominis
LGLPPDHPVNAQNPTI

SEQ ID NO: 2203395 - protein, 35 aa, Cryptosporidium hominis
LGNNEEDEKNSEKEKLEKEKLEKEKLEKERLERER

SEQ ID NO: 2203396 - protein, 15 aa, Cryptosporidium hominis
LGPFDRKRGPNCKQE

SEQ ID NO: 2203397 - protein, 8 aa, Cryptosporidium hominis
LGRTSLKT

SEQ ID NO: 2203398 - protein, 10 aa, Cryptosporidium hominis
LGSDGSDFIS

SEQ ID NO: 2203399 - protein, 10 aa, Cryptosporidium hominis
LGSGDTIDSI

SEQ ID NO: 2203400 - protein, 12 aa, Cryptosporidium hominis
LGTDTTTPMPPT

SEQ ID NO: 2203401 - protein, 54 aa, Cryptosporidium hominis
LGTSPSSSSRFIGSSSGANPRANVGAASQDLRGSTSAGSSIFPRSSSSTQNLQS

SEQ ID NO: 2203402 - protein, 13 aa, Cryptosporidium hominis
LGVSDENNNLSYD

SEQ ID NO: 2203403 - protein, 8 aa, Cryptosporidium hominis
LHSKRSSK

SEQ ID NO: 2203404 - protein, 9 aa, Cryptosporidium hominis
LIPKPERKS

SEQ ID NO: 2203405 - protein, 14 aa, Cryptosporidium hominis
LISSDEESNLTDEQ

SEQ ID NO: 2203406 - protein, 6 aa, Cryptosporidium hominis
LKDEKT

SEQ ID NO: 2203407 - protein, 12 aa, Cryptosporidium hominis
LKDKNSKQNESA

SEQ ID NO: 2203408 - protein, 9 aa, Cryptosporidium hominis
LKDLKNNKN

SEQ ID NO: 2203409 - protein, 8 aa, Cryptosporidium hominis
LKDTPVNT

SEQ ID NO: 2203410 - protein, 16 aa, Cryptosporidium hominis
LKECPTGFKPTNDSAT

SEQ ID NO: 2203411 - protein, 6 aa, Cryptosporidium hominis
LKECSN

SEQ ID NO: 2203412 - protein, 17 aa, Cryptosporidium hominis
LKEENQDENNGSKTLPT

SEQ ID NO: 2203413 - protein, 8 aa, Cryptosporidium hominis
LKESGKMH

SEQ ID NO: 2203414 - protein, 10 aa, Cryptosporidium hominis
LKGDSGYSAS

SEQ ID NO: 2203415 - protein, 10 aa, Cryptosporidium hominis
LKGESTVTNE

SEQ ID NO: 2203416 - protein, 10 aa, Cryptosporidium hominis
LKGTNPESVT

SEQ ID NO: 2203417 - protein, 7 aa, Cryptosporidium hominis
LKKGSKQ

SEQ ID NO: 2203418 - protein, 7 aa, Cryptosporidium hominis
LKNTHQT

SEQ ID NO: 2203419 - protein, 11 aa, Cryptosporidium hominis
LKPKKSSLDSF

SEQ ID NO: 2203420 - protein, 4 aa, Cryptosporidium hominis
LKPS

SEQ ID NO: 2203421 - protein, 12 aa, Cryptosporidium hominis
LKPTGSSASSEI

SEQ ID NO: 2203422 - protein, 21 aa, Cryptosporidium hominis
LKPTKGMLSTESRLNSDLSSE

SEQ ID NO: 2203423 - protein, 6 aa, Cryptosporidium hominis
LKQTGK

SEQ ID NO: 2203424 - protein, 4 aa, Cryptosporidium hominis
LKRQ

SEQ ID NO: 2203425 - protein, 65 aa, Cryptosporidium hominis
LKSNPLGNGNYDQAYSDRNRSSSNKKVDPKRIGSSGGLGSNRAHYSYNSRDVNNGGISSQSRTVY

SEQ ID NO: 2203426 - protein, 7 aa, Cryptosporidium hominis
LKSRNTH

SEQ ID NO: 2203427 - protein, 5 aa, Cryptosporidium hominis
LKTEA

SEQ ID NO: 2203428 - protein, 49 aa, Cryptosporidium hominis
LKTPPYYSGSHENIANSTEIKKVSTSPEFEVPETKNYTNSKFKDKSQFQ

SEQ ID NO: 2203429 - protein, 5 aa, Cryptosporidium hominis
LKTSG

SEQ ID NO: 2203430 - protein, 12 aa, Cryptosporidium hominis
LKTSKSDRKAMN

SEQ ID NO: 2203431 - protein, 26 aa, Cryptosporidium hominis
LKTSPKRYQEKERIPSRLSPPREEPP

SEQ ID NO: 2203432 - protein, 10 aa, Cryptosporidium hominis
LLPPPEESNI

SEQ ID NO: 2203433 - protein, 4 aa, Cryptosporidium hominis
LLST

SEQ ID NO: 2203434 - protein, 10 aa, Cryptosporidium hominis
LLSTTNSAQK

SEQ ID NO: 2203435 - protein, 9 aa, Cryptosporidium hominis
LNDSNKEYS

SEQ ID NO: 2203436 - protein, 7 aa, Cryptosporidium hominis
LNDTTQK

SEQ ID NO: 2203437 - protein, 16 aa, Cryptosporidium hominis
LNGSKKGLVKEEPPFA

SEQ ID NO: 2203438 - protein, 14 aa, Cryptosporidium hominis
LNKYQNDTAAWPGF

SEQ ID NO: 2203439 - protein, 10 aa, Cryptosporidium hominis
LNNPKTRSVS

SEQ ID NO: 2203440 - protein, 11 aa, Cryptosporidium hominis
LNNQPRIEPPI

SEQ ID NO: 2203441 - protein, 7 aa, Cryptosporidium hominis
LNNSGPL

SEQ ID NO: 2203442 - protein, 7 aa, Cryptosporidium hominis
LNRKEEK

SEQ ID NO: 2203443 - protein, 9 aa, Cryptosporidium hominis
LNSATESRN

SEQ ID NO: 2203444 - protein, 6 aa, Cryptosporidium hominis
LNSEKL

SEQ ID NO: 2203445 - protein, 5 aa, Cryptosporidium hominis
LPATS

SEQ ID NO: 2203446 - protein, 8 aa, Cryptosporidium hominis
LPDQRKSR

SEQ ID NO: 2203447 - protein, 9 aa, Cryptosporidium hominis
LPDTEAKKV

SEQ ID NO: 2203448 - protein, 9 aa, Cryptosporidium hominis
LPGGGASCR

SEQ ID NO: 2203449 - protein, 6 aa, Cryptosporidium hominis
LPGGSK

SEQ ID NO: 2203450 - protein, 67 aa, Cryptosporidium hominis
LPGGSSGGASGGASGGASGGTSGGDSGGDSGGASGGDSGGASGGASGGDSGGDSGGSTATQSGYSQY

SEQ ID NO: 2203451 - protein, 4 aa, Cryptosporidium hominis
LPKD

SEQ ID NO: 2203452 - protein, 15 aa, Cryptosporidium hominis
LPKPNEGEDKERPKE

SEQ ID NO: 2203453 - protein, 7 aa, Cryptosporidium hominis
LPKRRPI

SEQ ID NO: 2203454 - protein, 7 aa, Cryptosporidium hominis
LPNEVPG

SEQ ID NO: 2203455 - protein, 4 aa, Cryptosporidium hominis
LPPD

SEQ ID NO: 2203456 - protein, 27 aa, Cryptosporidium hominis
LPPDSGSMSEESNSEDSEHYQPSDEKF

SEQ ID NO: 2203457 - protein, 9 aa, Cryptosporidium hominis
LPPEETKES

SEQ ID NO: 2203458 - protein, 12 aa, Cryptosporidium hominis
LPPGNESHNRAH

SEQ ID NO: 2203459 - protein, 15 aa, Cryptosporidium hominis
LPPNNGSLNINNQTG

SEQ ID NO: 2203460 - protein, 8 aa, Cryptosporidium hominis
LPPSSKRS

SEQ ID NO: 2203461 - protein, 13 aa, Cryptosporidium hominis
LPRENERERSATI

SEQ ID NO: 2203462 - protein, 4 aa, Cryptosporidium hominis
LPRK

SEQ ID NO: 2203463 - protein, 62 aa, Cryptosporidium hominis
LPRNSQDPKNKTGEGGNSKSATARVGSRPSTVGSSTTSGSGTKPKATIPRPSGQSTSSSSRI

SEQ ID NO: 2203464 - protein, 5 aa, Cryptosporidium hominis
LPRSN

SEQ ID NO: 2203465 - protein, 20 aa, Cryptosporidium hominis
LPSGSSSSSGTSRPDQKNQV

SEQ ID NO: 2203466 - protein, 5 aa, Cryptosporidium hominis
LPSNN

SEQ ID NO: 2203467 - protein, 92 aa, Cryptosporidium hominis
LPSPTASGSGLNNEGYQSDNEDDNEDENEDGDDSGSVTSSSSSSSSSSSSSSSSSSSSSSSSSSSSSSSSGSSSSGSSSSSPYANDREYDTR

SEQ ID NO: 2203468 - protein, 12 aa, Cryptosporidium hominis
LPSTDSNLRSGD

SEQ ID NO: 2203469 - protein, 4 aa, Cryptosporidium hominis
LPTE

SEQ ID NO: 2203470 - protein, 5 aa, Cryptosporidium hominis
LPTSH

SEQ ID NO: 2203471 - protein, 11 aa, Cryptosporidium hominis
LPVSRTDTLSE

SEQ ID NO: 2203472 - protein, 19 aa, Cryptosporidium hominis
LQDSDSDYLEGDEYQEDLN

SEQ ID NO: 2203473 - protein, 4 aa, Cryptosporidium hominis
LQDT

SEQ ID NO: 2203474 - protein, 6 aa, Cryptosporidium hominis
LQEANQ

SEQ ID NO: 2203475 - protein, 10 aa, Cryptosporidium hominis
LQEEKEDPLK

SEQ ID NO: 2203476 - protein, 12 aa, Cryptosporidium hominis
LQEEKIKRRREI

SEQ ID NO: 2203477 - protein, 17 aa, Cryptosporidium hominis
LQENADKEEKGNIQNKG

SEQ ID NO: 2203478 - protein, 14 aa, Cryptosporidium hominis
LQGNAHASSGGTVL

SEQ ID NO: 2203479 - protein, 10 aa, Cryptosporidium hominis
LQKGNTWSAK

SEQ ID NO: 2203480 - protein, 6 aa, Cryptosporidium hominis
LQKKDV

SEQ ID NO: 2203481 - protein, 7 aa, Cryptosporidium hominis
LQNEPNC

SEQ ID NO: 2203482 - protein, 4 aa, Cryptosporidium hominis
LQNP

SEQ ID NO: 2203483 - protein, 4 aa, Cryptosporidium hominis
LQPT

SEQ ID NO: 2203484 - protein, 10 aa, Cryptosporidium hominis
LQQGSRKESC

SEQ ID NO: 2203485 - protein, 42 aa, Cryptosporidium hominis
LQSKGKSRSRRSRSRSRDASPTAPRTGSVTEGDQSKDGELEA

SEQ ID NO: 2203486 - protein, 8 aa, Cryptosporidium hominis
LRASQRAA

SEQ ID NO: 2203487 - protein, 19 aa, Cryptosporidium hominis
LREEIRNTATGNGDAVPSI

SEQ ID NO: 2203488 - protein, 20 aa, Cryptosporidium hominis
LREQKRKKEFKKEKLENQEK

SEQ ID NO: 2203489 - protein, 19 aa, Cryptosporidium hominis
LRHGKSAQSICNDEDSERV

SEQ ID NO: 2203490 - protein, 6 aa, Cryptosporidium hominis
LRIPSD

SEQ ID NO: 2203491 - protein, 6 aa, Cryptosporidium hominis
LRNPYS

SEQ ID NO: 2203492 - protein, 5 aa, Cryptosporidium hominis
LRNSK

SEQ ID NO: 2203493 - protein, 38 aa, Cryptosporidium hominis
LRNSSGVSSSKSKSNSWNGLTSSNEFQEDHKPPEVPKR

SEQ ID NO: 2203494 - protein, 6 aa, Cryptosporidium hominis
LRNTPK

SEQ ID NO: 2203495 - protein, 4 aa, Cryptosporidium hominis
LRPA

SEQ ID NO: 2203496 - protein, 7 aa, Cryptosporidium hominis
LRPGRMQ

SEQ ID NO: 2203497 - protein, 6 aa, Cryptosporidium hominis
LRRNAS

SEQ ID NO: 2203498 - protein, 32 aa, Cryptosporidium hominis
LRSGSKKSTSKDLKNDNNNQIGKPNEVTHTNT

SEQ ID NO: 2203499 - protein, 11 aa, Cryptosporidium hominis
LRSSTPCKNEK

SEQ ID NO: 2203500 - protein, 10 aa, Cryptosporidium hominis
LSADGPLEED

SEQ ID NO: 2203501 - protein, 23 aa, Cryptosporidium hominis
LSAPISSKNPAIKPSKKEAATIS

SEQ ID NO: 2203502 - protein, 5 aa, Cryptosporidium hominis
LSDGT

SEQ ID NO: 2203503 - protein, 26 aa, Cryptosporidium hominis
LSDHGASFKSRNQKLTENSSDGFGIP

SEQ ID NO: 2203504 - protein, 5 aa, Cryptosporidium hominis
LSDLK

SEQ ID NO: 2203505 - protein, 5 aa, Cryptosporidium hominis
LSDPT

SEQ ID NO: 2203506 - protein, 10 aa, Cryptosporidium hominis
LSDSEEGYKN

SEQ ID NO: 2203507 - protein, 9 aa, Cryptosporidium hominis
LSEDATEEA

SEQ ID NO: 2203508 - protein, 9 aa, Cryptosporidium hominis
LSEEGSISP

SEQ ID NO: 2203509 - protein, 5 aa, Cryptosporidium hominis
LSEGE

SEQ ID NO: 2203510 - protein, 11 aa, Cryptosporidium hominis
LSERQKKSEGL

SEQ ID NO: 2203511 - protein, 24 aa, Cryptosporidium hominis
LSESGNVDKNFDTQIPEDAISPAV

SEQ ID NO: 2203512 - protein, 15 aa, Cryptosporidium hominis
LSESSKVSDIQKGGP

SEQ ID NO: 2203513 - protein, 11 aa, Cryptosporidium hominis
LSGDKKRLSVS

SEQ ID NO: 2203514 - protein, 7 aa, Cryptosporidium hominis
LSGDPKS

SEQ ID NO: 2203515 - protein, 5 aa, Cryptosporidium hominis
LSGGN

SEQ ID NO: 2203516 - protein, 7 aa, Cryptosporidium hominis
LSGIPTR

SEQ ID NO: 2203517 - protein, 7 aa, Cryptosporidium hominis
LSGSPRT

SEQ ID NO: 2203518 - protein, 23 aa, Cryptosporidium hominis
LSGSQCEQIKEAPPVSECPPGYT

SEQ ID NO: 2203519 - protein, 7 aa, Cryptosporidium hominis
LSKDARD

SEQ ID NO: 2203520 - protein, 7 aa, Cryptosporidium hominis
LSKDELS

SEQ ID NO: 2203521 - protein, 12 aa, Cryptosporidium hominis
LSNEDGKSCSSS

SEQ ID NO: 2203522 - protein, 10 aa, Cryptosporidium hominis
LSNEVKEESA

SEQ ID NO: 2203523 - protein, 8 aa, Cryptosporidium hominis
LSNSEKEN

SEQ ID NO: 2203524 - protein, 8 aa, Cryptosporidium hominis
LSNSNSDI

SEQ ID NO: 2203525 - protein, 12 aa, Cryptosporidium hominis
LSPETKNKIGEE

SEQ ID NO: 2203526 - protein, 7 aa, Cryptosporidium hominis
LSPGDDL

SEQ ID NO: 2203527 - protein, 4 aa, Cryptosporidium hominis
LSPP

SEQ ID NO: 2203528 - protein, 15 aa, Cryptosporidium hominis
LSQNETALKEAENMG

SEQ ID NO: 2203529 - protein, 21 aa, Cryptosporidium hominis
LSRLSKESNVLNTNKGEKSHG

SEQ ID NO: 2203530 - protein, 6 aa, Cryptosporidium hominis
LSRNYA

SEQ ID NO: 2203531 - protein, 10 aa, Cryptosporidium hominis
LSRRPRRAPQ

SEQ ID NO: 2203532 - protein, 6 aa, Cryptosporidium hominis
LSRRTQ

SEQ ID NO: 2203533 - protein, 8 aa, Cryptosporidium hominis
LSRSQKKR

SEQ ID NO: 2203534 - protein, 11 aa, Cryptosporidium hominis
LSSDSKTTEQG

SEQ ID NO: 2203535 - protein, 16 aa, Cryptosporidium hominis
LSSHGVPPSGPSSIHS

SEQ ID NO: 2203536 - protein, 4 aa, Cryptosporidium hominis
LSSK

SEQ ID NO: 2203537 - protein, 9 aa, Cryptosporidium hominis
LSSNSSKIL

SEQ ID NO: 2203538 - protein, 56 aa, Cryptosporidium hominis
LSSPNTSETGRDSSRDNSRNNSRSSSNSSYRSRSNNLGESRAASNDKNNRRESSLN

SEQ ID NO: 2203539 - protein, 62 aa, Cryptosporidium hominis
LSSSDFPNGEENHESTGDRQDETDGNGSSSSSSSSNDPEEDEADGSSSFGGAPLSSPRPQRR

SEQ ID NO: 2203540 - protein, 13 aa, Cryptosporidium hominis
LSSSGRHNSPSSF

SEQ ID NO: 2203541 - protein, 5 aa, Cryptosporidium hominis
LSTGD

SEQ ID NO: 2203542 - protein, 11 aa, Cryptosporidium hominis
LSTSPETTLES

SEQ ID NO: 2203543 - protein, 10 aa, Cryptosporidium hominis
LTEGSQVESL

SEQ ID NO: 2203544 - protein, 7 aa, Cryptosporidium hominis
LTEKESK

SEQ ID NO: 2203545 - protein, 18 aa, Cryptosporidium hominis
LTKPEKYAEPIDKRKEID

SEQ ID NO: 2203546 - protein, 13 aa, Cryptosporidium hominis
LTKSQKKKLEKER

SEQ ID NO: 2203547 - protein, 9 aa, Cryptosporidium hominis
LTNGASREE

SEQ ID NO: 2203548 - protein, 4 aa, Cryptosporidium hominis
LTNP

SEQ ID NO: 2203549 - protein, 8 aa, Cryptosporidium hominis
LTPFKRTP

SEQ ID NO: 2203550 - protein, 4 aa, Cryptosporidium hominis
LTPK

SEQ ID NO: 2203551 - protein, 7 aa, Cryptosporidium hominis
LTRSTSD

SEQ ID NO: 2203552 - protein, 5 aa, Cryptosporidium hominis
LTSPQ

SEQ ID NO: 2203553 - protein, 16 aa, Cryptosporidium hominis
LTSPRGSGAPCPKTRE

SEQ ID NO: 2203554 - protein, 4 aa, Cryptosporidium hominis
LTSR

SEQ ID NO: 2203555 - protein, 4 aa, Cryptosporidium hominis
LTSS

SEQ ID NO: 2203556 - protein, 10 aa, Cryptosporidium hominis
LTSSPPSLPR

SEQ ID NO: 2203557 - protein, 9 aa, Cryptosporidium hominis
LVSPTGGKL

SEQ ID NO: 2203558 - protein, 4 aa, Cryptosporidium hominis
LWSR

SEQ ID NO: 2203559 - protein, 9 aa, Cryptosporidium hominis
LYGSSQPLD

SEQ ID NO: 2203560 - protein, 7 aa, Cryptosporidium hominis
LYQDETS

SEQ ID NO: 2203561 - protein, 10 aa, Cryptosporidium hominis
LYSPGEGSLV

SEQ ID NO: 2203562 - protein, 12 aa, Cryptosporidium hominis
MAGNPFPAGLGP

SEQ ID NO: 2203563 - protein, 7 aa, Cryptosporidium hominis
MAPKTKM

SEQ ID NO: 2203564 - protein, 4 aa, Cryptosporidium hominis
MASD

SEQ ID NO: 2203565 - protein, 8 aa, Cryptosporidium hominis
MASSIGSN

SEQ ID NO: 2203566 - protein, 8 aa, Cryptosporidium hominis
MDEAQGKT

SEQ ID NO: 2203567 - protein, 12 aa, Cryptosporidium hominis
MDEDKKNEEDNS

SEQ ID NO: 2203568 - protein, 11 aa, Cryptosporidium hominis
MDEQQKKKAIE

SEQ ID NO: 2203569 - protein, 6 aa, Cryptosporidium hominis
MDGPTS

SEQ ID NO: 2203570 - protein, 12 aa, Cryptosporidium hominis
MDKPTSRLSSAD

SEQ ID NO: 2203571 - protein, 10 aa, Cryptosporidium hominis
MDNQRRSTLD

SEQ ID NO: 2203572 - protein, 9 aa, Cryptosporidium hominis
MEKEKGLSS

SEQ ID NO: 2203573 - protein, 4 aa, Cryptosporidium hominis
MGDP

SEQ ID NO: 2203574 - protein, 4 aa, Cryptosporidium hominis
MGPM

SEQ ID NO: 2203575 - protein, 26 aa, Cryptosporidium hominis
MGSGNRKSKSNIKQTSKSKSRSVSSV

SEQ ID NO: 2203576 - protein, 5 aa, Cryptosporidium hominis
MGTDI

SEQ ID NO: 2203577 - protein, 7 aa, Cryptosporidium hominis
MGTGDDH

SEQ ID NO: 2203578 - protein, 12 aa, Cryptosporidium hominis
MGTPWPEKGPYE

SEQ ID NO: 2203579 - protein, 14 aa, Cryptosporidium hominis
MHPSPPPPPPSSIH

SEQ ID NO: 2203580 - protein, 13 aa, Cryptosporidium hominis
MHSEATEQQKKEI

SEQ ID NO: 2203581 - protein, 10 aa, Cryptosporidium hominis
MKDKDGKEMS

SEQ ID NO: 2203582 - protein, 7 aa, Cryptosporidium hominis
MKIPKSS

SEQ ID NO: 2203583 - protein, 18 aa, Cryptosporidium hominis
MKKTEQNYLESKKAAERS

SEQ ID NO: 2203584 - protein, 5 aa, Cryptosporidium hominis
MKPAS

SEQ ID NO: 2203585 - protein, 10 aa, Cryptosporidium hominis
MKQDQSELSD

SEQ ID NO: 2203586 - protein, 8 aa, Cryptosporidium hominis
MKSDEKRI

SEQ ID NO: 2203587 - protein, 11 aa, Cryptosporidium hominis
MKSPPKSPDDF

SEQ ID NO: 2203588 - protein, 12 aa, Cryptosporidium hominis
MNDATNNKLKQR

SEQ ID NO: 2203589 - protein, 12 aa, Cryptosporidium hominis
MNDENSASCSQI

SEQ ID NO: 2203590 - protein, 442 aa, Cryptosporidium hominis
MNEGEDDSFPEEEENPELGDESNDDLEGQENIENHEGDKIENEDNGENTNAEEFGDEGKKDDLDTKQDELDEGDSRNGEDPGLNGEGEDENDDKDDTDGNDQDGNNEKDTPDGEDIGGTDQEDSDSGGEAKGTDYDEEEGKELDSDSGDGESGGGEDNDEVDDGESNSGDGDHGEDDGGDNDEGEDGESNSGDGGESGGGENNVERENEESISGDGGFGGDDGGDGGGDKDEEGGDLDSDSGDGGNDGGDKDKEVGDLDSDLEDGGDDVEGGGGGGEGDLDSGGGGGDYMGDSDKDSDLGDGAEVGGGGDEGEDGGLDSGGGGLDNFEGNTGDSYSESNDAFGTGGGDYRKDSDEDSDLGSGEGVGSFGTKGRGEGDDFDRDLDSNSMETGGISGNFGGGNTNQNDLEYSKGHTGSGSLGNNEFEGDPLSGSGDEGGFDDSY

SEQ ID NO: 2203591 - protein, 7 aa, Cryptosporidium hominis
MNENNET

SEQ ID NO: 2203592 - protein, 6 aa, Cryptosporidium hominis
MNEPSA

SEQ ID NO: 2203593 - protein, 12 aa, Cryptosporidium hominis
MNESKDQERGEF

SEQ ID NO: 2203594 - protein, 5 aa, Cryptosporidium hominis
MNKHD

SEQ ID NO: 2203595 - protein, 5 aa, Cryptosporidium hominis
MNLSE

SEQ ID NO: 2203596 - protein, 11 aa, Cryptosporidium hominis
MNNMKKQENYA

SEQ ID NO: 2203597 - protein, 18 aa, Cryptosporidium hominis
MPKYSSQEAATEEEPEDL

SEQ ID NO: 2203598 - protein, 8 aa, Cryptosporidium hominis
MPNTTSTG

SEQ ID NO: 2203599 - protein, 11 aa, Cryptosporidium hominis
MPPEQISPTVT

SEQ ID NO: 2203600 - protein, 9 aa, Cryptosporidium hominis
MPPMKRPQA

SEQ ID NO: 2203601 - protein, 6 aa, Cryptosporidium hominis
MPPQPQ

SEQ ID NO: 2203602 - protein, 6 aa, Cryptosporidium hominis
MPTDSS

SEQ ID NO: 2203603 - protein, 4 aa, Cryptosporidium hominis
MPTT

SEQ ID NO: 2203604 - protein, 19 aa, Cryptosporidium hominis
MRPPPRPSRPPPPVPQRPI

SEQ ID NO: 2203605 - protein, 6 aa, Cryptosporidium hominis
MRPPTY

SEQ ID NO: 2203606 - protein, 8 aa, Cryptosporidium hominis
MRSSDSSL

SEQ ID NO: 2203607 - protein, 19 aa, Cryptosporidium hominis
MRSTSNKISVKSPCNGTMH

SEQ ID NO: 2203608 - protein, 11 aa, Cryptosporidium hominis
MSKDSELSNAQ

SEQ ID NO: 2203609 - protein, 7 aa, Cryptosporidium hominis
MSNPGQQ

SEQ ID NO: 2203610 - protein, 9 aa, Cryptosporidium hominis
MSSKVYSPK

SEQ ID NO: 2203611 - protein, 52 aa, Cryptosporidium hominis
MSTPTSEFKSEDNLENKADSKDSLVSENKGEKNDIENPQDTQNKNDTSKTTI

SEQ ID NO: 2203612 - protein, 26 aa, Cryptosporidium hominis
MTESESEEENENLSNLPKSNKSRSKS

SEQ ID NO: 2203613 - protein, 7 aa, Cryptosporidium hominis
MTPPYPI

SEQ ID NO: 2203614 - protein, 8 aa, Cryptosporidium hominis
NAANGGEH

SEQ ID NO: 2203615 - protein, 7 aa, Cryptosporidium hominis
NAARAKL

SEQ ID NO: 2203616 - protein, 11 aa, Cryptosporidium hominis
NAEEAREPLGP

SEQ ID NO: 2203617 - protein, 9 aa, Cryptosporidium hominis
NAEGGDEGI

SEQ ID NO: 2203618 - protein, 7 aa, Cryptosporidium hominis
NAGEITQ

SEQ ID NO: 2203619 - protein, 7 aa, Cryptosporidium hominis
NAKKEDV

SEQ ID NO: 2203620 - protein, 17 aa, Cryptosporidium hominis
NALTTPKGEESEEDSVE

SEQ ID NO: 2203621 - protein, 4 aa, Cryptosporidium hominis
NANS

SEQ ID NO: 2203622 - protein, 8 aa, Cryptosporidium hominis
NAPNGKLK

SEQ ID NO: 2203623 - protein, 5 aa, Cryptosporidium hominis
NAQHG

SEQ ID NO: 2203624 - protein, 4 aa, Cryptosporidium hominis
NAQL

SEQ ID NO: 2203625 - protein, 9 aa, Cryptosporidium hominis
NARFSSKAN

SEQ ID NO: 2203626 - protein, 7 aa, Cryptosporidium hominis
NASKLNG

SEQ ID NO: 2203627 - protein, 11 aa, Cryptosporidium hominis
NASKNKGKRIE

SEQ ID NO: 2203628 - protein, 14 aa, Cryptosporidium hominis
NASLPASRTQYPID

SEQ ID NO: 2203629 - protein, 10 aa, Cryptosporidium hominis
NASNKKKCKE

SEQ ID NO: 2203630 - protein, 8 aa, Cryptosporidium hominis
NASTTANQ

SEQ ID NO: 2203631 - protein, 4 aa, Cryptosporidium hominis
NATD

SEQ ID NO: 2203632 - protein, 4 aa, Cryptosporidium hominis
NATP

SEQ ID NO: 2203633 - protein, 7 aa, Cryptosporidium hominis
NATPSQI

SEQ ID NO: 2203634 - protein, 10 aa, Cryptosporidium hominis
NCGTEKPVEN

SEQ ID NO: 2203635 - protein, 18 aa, Cryptosporidium hominis
NCKQDSKFDPGKTKFGEY

SEQ ID NO: 2203636 - protein, 27 aa, Cryptosporidium hominis
NDAPIEKASDSSILESSKSASSKNVPS

SEQ ID NO: 2203637 - protein, 15 aa, Cryptosporidium hominis
NDDQSGKNVDSLTEE

SEQ ID NO: 2203638 - protein, 18 aa, Cryptosporidium hominis
NDDSNPISAPYGEKEANR

SEQ ID NO: 2203639 - protein, 5 aa, Cryptosporidium hominis
NDEDT

SEQ ID NO: 2203640 - protein, 5 aa, Cryptosporidium hominis
NDEEG

SEQ ID NO: 2203641 - protein, 9 aa, Cryptosporidium hominis
NDENSNCKD

SEQ ID NO: 2203642 - protein, 15 aa, Cryptosporidium hominis
NDEPSKLDDQSQSYS

SEQ ID NO: 2203643 - protein, 4 aa, Cryptosporidium hominis
NDET

SEQ ID NO: 2203644 - protein, 13 aa, Cryptosporidium hominis
NDGQYNSAVENDK

SEQ ID NO: 2203645 - protein, 11 aa, Cryptosporidium hominis
NDKESTNINTI

SEQ ID NO: 2203646 - protein, 8 aa, Cryptosporidium hominis
NDLKKSSF

SEQ ID NO: 2203647 - protein, 7 aa, Cryptosporidium hominis
NDNGEND

SEQ ID NO: 2203648 - protein, 8 aa, Cryptosporidium hominis
NDNGPNRM

SEQ ID NO: 2203649 - protein, 6 aa, Cryptosporidium hominis
NDPAIN

SEQ ID NO: 2203650 - protein, 6 aa, Cryptosporidium hominis
NDPLTN

SEQ ID NO: 2203651 - protein, 6 aa, Cryptosporidium hominis
NDPQFG

SEQ ID NO: 2203652 - protein, 11 aa, Cryptosporidium hominis
NDPRKKMDAQK

SEQ ID NO: 2203653 - protein, 20 aa, Cryptosporidium hominis
NDQSYDSAANLTNSKNFSKS

SEQ ID NO: 2203654 - protein, 5 aa, Cryptosporidium hominis
NDREK

SEQ ID NO: 2203655 - protein, 9 aa, Cryptosporidium hominis
NDSDHRKEQ

SEQ ID NO: 2203656 - protein, 9 aa, Cryptosporidium hominis
NDSNNNKTK

SEQ ID NO: 2203657 - protein, 9 aa, Cryptosporidium hominis
NDSVGGKTI

SEQ ID NO: 2203658 - protein, 5 aa, Cryptosporidium hominis
NDTKL

SEQ ID NO: 2203659 - protein, 9 aa, Cryptosporidium hominis
NDYNKQVEE

SEQ ID NO: 2203660 - protein, 6 aa, Cryptosporidium hominis
NDYSDL

SEQ ID NO: 2203661 - protein, 10 aa, Cryptosporidium hominis
NEAKLSASYE

SEQ ID NO: 2203662 - protein, 7 aa, Cryptosporidium hominis
NEDINVS

SEQ ID NO: 2203663 - protein, 8 aa, Cryptosporidium hominis
NEDPKADI

SEQ ID NO: 2203664 - protein, 11 aa, Cryptosporidium hominis
NEDRNTNINQD

SEQ ID NO: 2203665 - protein, 9 aa, Cryptosporidium hominis
NEEPSTHSQ

SEQ ID NO: 2203666 - protein, 6 aa, Cryptosporidium hominis
NEESIR

SEQ ID NO: 2203667 - protein, 6 aa, Cryptosporidium hominis
NEESVD

SEQ ID NO: 2203668 - protein, 6 aa, Cryptosporidium hominis
NEIEKN

SEQ ID NO: 2203669 - protein, 9 aa, Cryptosporidium hominis
NEIEPQAKS

SEQ ID NO: 2203670 - protein, 35 aa, Cryptosporidium hominis
NEIQKQNQTFDKENLESKNTQNLQESKNPTSKLSQ

SEQ ID NO: 2203671 - protein, 4 aa, Cryptosporidium hominis
NEIS

SEQ ID NO: 2203672 - protein, 4 aa, Cryptosporidium hominis
NEKL

SEQ ID NO: 2203673 - protein, 9 aa, Cryptosporidium hominis
NEKMEQSNH

SEQ ID NO: 2203674 - protein, 7 aa, Cryptosporidium hominis
NEKQEDA

SEQ ID NO: 2203675 - protein, 7 aa, Cryptosporidium hominis
NEKSGNY

SEQ ID NO: 2203676 - protein, 13 aa, Cryptosporidium hominis
NEKYGCEKKNSDQ

SEQ ID NO: 2203677 - protein, 6 aa, Cryptosporidium hominis
NELETG

SEQ ID NO: 2203678 - protein, 16 aa, Cryptosporidium hominis
NELETRPSFDSNRESL

SEQ ID NO: 2203679 - protein, 10 aa, Cryptosporidium hominis
NEMDHKKGNI

SEQ ID NO: 2203680 - protein, 4 aa, Cryptosporidium hominis
NENE

SEQ ID NO: 2203681 - protein, 5 aa, Cryptosporidium hominis
NENGE

SEQ ID NO: 2203682 - protein, 4 aa, Cryptosporidium hominis
NENH

SEQ ID NO: 2203683 - protein, 8 aa, Cryptosporidium hominis
NENISESQ

SEQ ID NO: 2203684 - protein, 16 aa, Cryptosporidium hominis
NENKKPDNEVSSASDE

SEQ ID NO: 2203685 - protein, 4 aa, Cryptosporidium hominis
NENP

SEQ ID NO: 2203686 - protein, 4 aa, Cryptosporidium hominis
NENS

SEQ ID NO: 2203687 - protein, 5 aa, Cryptosporidium hominis
NENSD

SEQ ID NO: 2203688 - protein, 4 aa, Cryptosporidium hominis
NEPD

SEQ ID NO: 2203689 - protein, 7 aa, Cryptosporidium hominis
NEPESER

SEQ ID NO: 2203690 - protein, 10 aa, Cryptosporidium hominis
NEPNSTNNEH

SEQ ID NO: 2203691 - protein, 5 aa, Cryptosporidium hominis
NEQDT

SEQ ID NO: 2203692 - protein, 7 aa, Cryptosporidium hominis
NEQETTN

SEQ ID NO: 2203693 - protein, 21 aa, Cryptosporidium hominis
NERENSQAKEDIKDLKSTEVS

SEQ ID NO: 2203694 - protein, 19 aa, Cryptosporidium hominis
NETASFPASRTKYPADTEH

SEQ ID NO: 2203695 - protein, 8 aa, Cryptosporidium hominis
NETNRSSA

SEQ ID NO: 2203696 - protein, 8 aa, Cryptosporidium hominis
NETPGARA

SEQ ID NO: 2203697 - protein, 31 aa, Cryptosporidium hominis
NETPNKSSSSSDNNNSEGLSRGGGGRGGKKP

SEQ ID NO: 2203698 - protein, 13 aa, Cryptosporidium hominis
NEVASSGSPILPN

SEQ ID NO: 2203699 - protein, 8 aa, Cryptosporidium hominis
NEYATSNE

SEQ ID NO: 2203700 - protein, 7 aa, Cryptosporidium hominis
NEYDEDG

SEQ ID NO: 2203701 - protein, 21 aa, Cryptosporidium hominis
NEYNQDTNESNQINPVIYLFK

SEQ ID NO: 2203702 - protein, 9 aa, Cryptosporidium hominis
NEYNTGEIR

SEQ ID NO: 2203703 - protein, 13 aa, Cryptosporidium hominis
NFEINGKKNYSKK

SEQ ID NO: 2203704 - protein, 37 aa, Cryptosporidium hominis
NFEPSKKDTTVEESRSSLDKSLKEPEPLTEEESEGIA

SEQ ID NO: 2203705 - protein, 5 aa, Cryptosporidium hominis
NFGSD

SEQ ID NO: 2203706 - protein, 26 aa, Cryptosporidium hominis
NFRSAQELEENTSNSEEENQNSSKNF

SEQ ID NO: 2203707 - protein, 7 aa, Cryptosporidium hominis
NFTTEKS

SEQ ID NO: 2203708 - protein, 22 aa, Cryptosporidium hominis
NGCSDSGRPPQKPHLPDGFRLR

SEQ ID NO: 2203709 - protein, 6 aa, Cryptosporidium hominis
NGDPLD

SEQ ID NO: 2203710 - protein, 8 aa, Cryptosporidium hominis
NGDSPSIK

SEQ ID NO: 2203711 - protein, 9 aa, Cryptosporidium hominis
NGEFDPSNA

SEQ ID NO: 2203712 - protein, 9 aa, Cryptosporidium hominis
NGEISTTNH

SEQ ID NO: 2203713 - protein, 4 aa, Cryptosporidium hominis
NGEN

SEQ ID NO: 2203714 - protein, 8 aa, Cryptosporidium hominis
NGENKQIP

SEQ ID NO: 2203715 - protein, 6 aa, Cryptosporidium hominis
NGENSI

SEQ ID NO: 2203716 - protein, 6 aa, Cryptosporidium hominis
NGEQNK

SEQ ID NO: 2203717 - protein, 9 aa, Cryptosporidium hominis
NGEQNRRVK

SEQ ID NO: 2203718 - protein, 30 aa, Cryptosporidium hominis
NGEQPSEISRVDSEGSDFTQTSNFDEPQEE

SEQ ID NO: 2203719 - protein, 6 aa, Cryptosporidium hominis
NGFSSN

SEQ ID NO: 2203720 - protein, 16 aa, Cryptosporidium hominis
NGIPSHISTQKDQNLN

SEQ ID NO: 2203721 - protein, 5 aa, Cryptosporidium hominis
NGKNS

SEQ ID NO: 2203722 - protein, 14 aa, Cryptosporidium hominis
NGLENEDSAKQRQL

SEQ ID NO: 2203723 - protein, 4 aa, Cryptosporidium hominis
NGLV

SEQ ID NO: 2203724 - protein, 7 aa, Cryptosporidium hominis
NGMPGGI

SEQ ID NO: 2203725 - protein, 6 aa, Cryptosporidium hominis
NGNCEK

SEQ ID NO: 2203726 - protein, 8 aa, Cryptosporidium hominis
NGNDQKSC

SEQ ID NO: 2203727 - protein, 4 aa, Cryptosporidium hominis
NGNE

SEQ ID NO: 2203728 - protein, 10 aa, Cryptosporidium hominis
NGNEYHDGTK

SEQ ID NO: 2203729 - protein, 7 aa, Cryptosporidium hominis
NGNNAGM

SEQ ID NO: 2203730 - protein, 12 aa, Cryptosporidium hominis
NGNSGILGPGST

SEQ ID NO: 2203731 - protein, 10 aa, Cryptosporidium hominis
NGPQNDIPYE

SEQ ID NO: 2203732 - protein, 11 aa, Cryptosporidium hominis
NGPSSRNEQSF

SEQ ID NO: 2203733 - protein, 6 aa, Cryptosporidium hominis
NGPYID

SEQ ID NO: 2203734 - protein, 8 aa, Cryptosporidium hominis
NGQCEDEN

SEQ ID NO: 2203735 - protein, 9 aa, Cryptosporidium hominis
NGQGLSSTI

SEQ ID NO: 2203736 - protein, 9 aa, Cryptosporidium hominis
NGQYNTGST

SEQ ID NO: 2203737 - protein, 12 aa, Cryptosporidium hominis
NGRNGNTVSQAL

SEQ ID NO: 2203738 - protein, 6 aa, Cryptosporidium hominis
NGSKCT

SEQ ID NO: 2203739 - protein, 5 aa, Cryptosporidium hominis
NGSLI

SEQ ID NO: 2203740 - protein, 8 aa, Cryptosporidium hominis
NGSNRINQ

SEQ ID NO: 2203741 - protein, 7 aa, Cryptosporidium hominis
NGSNTLI

SEQ ID NO: 2203742 - protein, 10 aa, Cryptosporidium hominis
NGSTSDKKHL

SEQ ID NO: 2203743 - protein, 10 aa, Cryptosporidium hominis
NGTKRKRKSI

SEQ ID NO: 2203744 - protein, 9 aa, Cryptosporidium hominis
NGTQVNDGI

SEQ ID NO: 2203745 - protein, 6 aa, Cryptosporidium hominis
NGTRQT

SEQ ID NO: 2203746 - protein, 14 aa, Cryptosporidium hominis
NGTRTSLRSNCSLI

SEQ ID NO: 2203747 - protein, 5 aa, Cryptosporidium hominis
NGTSA

SEQ ID NO: 2203748 - protein, 7 aa, Cryptosporidium hominis
NGTSNEI

SEQ ID NO: 2203749 - protein, 14 aa, Cryptosporidium hominis
NGWNNGGEKLKDEQ

SEQ ID NO: 2203750 - protein, 6 aa, Cryptosporidium hominis
NGYTNK

SEQ ID NO: 2203751 - protein, 5 aa, Cryptosporidium hominis
NHGST

SEQ ID NO: 2203752 - protein, 13 aa, Cryptosporidium hominis
NHKSCTKLSSGDL

SEQ ID NO: 2203753 - protein, 7 aa, Cryptosporidium hominis
NHKSRTV

SEQ ID NO: 2203754 - protein, 18 aa, Cryptosporidium hominis
NHQYDHSQVSSTSNGVNG

SEQ ID NO: 2203755 - protein, 11 aa, Cryptosporidium hominis
NHRERPGPSNL

SEQ ID NO: 2203756 - protein, 11 aa, Cryptosporidium hominis
NIEGDSGLNEN

SEQ ID NO: 2203757 - protein, 14 aa, Cryptosporidium hominis
NIEGQEKVEQHKNY

SEQ ID NO: 2203758 - protein, 11 aa, Cryptosporidium hominis
NIEKPKEVKTK

SEQ ID NO: 2203759 - protein, 4 aa, Cryptosporidium hominis
NIEN

SEQ ID NO: 2203760 - protein, 35 aa, Cryptosporidium hominis
NIFPEDSVGNTEWNKYGDGRDRISRNARETNTKYP

SEQ ID NO: 2203761 - protein, 8 aa, Cryptosporidium hominis
NIKESDSE

SEQ ID NO: 2203762 - protein, 6 aa, Cryptosporidium hominis
NIKGSN

SEQ ID NO: 2203763 - protein, 9 aa, Cryptosporidium hominis
NIKSNKRDK

SEQ ID NO: 2203764 - protein, 24 aa, Cryptosporidium hominis
NINGNSKYAKISNNEEKDDESADS

SEQ ID NO: 2203765 - protein, 7 aa, Cryptosporidium hominis
NIPDQGF

SEQ ID NO: 2203766 - protein, 31 aa, Cryptosporidium hominis
NIPKPRPKIKSKPKKQDNETQSSSNSTSSQF

SEQ ID NO: 2203767 - protein, 4 aa, Cryptosporidium hominis
NIPN

SEQ ID NO: 2203768 - protein, 6 aa, Cryptosporidium hominis
NIQGTE

SEQ ID NO: 2203769 - protein, 4 aa, Cryptosporidium hominis
NIQN

SEQ ID NO: 2203770 - protein, 11 aa, Cryptosporidium hominis
NISEKSQTVKL

SEQ ID NO: 2203771 - protein, 4 aa, Cryptosporidium hominis
NISK

SEQ ID NO: 2203772 - protein, 13 aa, Cryptosporidium hominis
NKARHPNNKNITS

SEQ ID NO: 2203773 - protein, 5 aa, Cryptosporidium hominis
NKARQ

SEQ ID NO: 2203774 - protein, 8 aa, Cryptosporidium hominis
NKDAKKRI

SEQ ID NO: 2203775 - protein, 9 aa, Cryptosporidium hominis
NKDGKLSNE

SEQ ID NO: 2203776 - protein, 6 aa, Cryptosporidium hominis
NKDSSS

SEQ ID NO: 2203777 - protein, 32 aa, Cryptosporidium hominis
NKEDSVEDQENTESQKEEEKKDNGDGEQQDSI

SEQ ID NO: 2203778 - protein, 9 aa, Cryptosporidium hominis
NKEKSRVGR

SEQ ID NO: 2203779 - protein, 12 aa, Cryptosporidium hominis
NKELNDIQDTSE

SEQ ID NO: 2203780 - protein, 30 aa, Cryptosporidium hominis
NKELQGSKNGMGDQTENNQVSPGSRRNSVE

SEQ ID NO: 2203781 - protein, 14 aa, Cryptosporidium hominis
NKENFTESYLDFMD

SEQ ID NO: 2203782 - protein, 9 aa, Cryptosporidium hominis
NKEQDERMD

SEQ ID NO: 2203783 - protein, 5 aa, Cryptosporidium hominis
NKGNL

SEQ ID NO: 2203784 - protein, 13 aa, Cryptosporidium hominis
NKGNTESASSVDD

SEQ ID NO: 2203785 - protein, 7 aa, Cryptosporidium hominis
NKIKNDN

SEQ ID NO: 2203786 - protein, 8 aa, Cryptosporidium hominis
NKINSKHN

SEQ ID NO: 2203787 - protein, 7 aa, Cryptosporidium hominis
NKIQRPG

SEQ ID NO: 2203788 - protein, 10 aa, Cryptosporidium hominis
NKKAEENRRA

SEQ ID NO: 2203789 - protein, 8 aa, Cryptosporidium hominis
NKKKQDEF

SEQ ID NO: 2203790 - protein, 9 aa, Cryptosporidium hominis
NKKNKNDLT

SEQ ID NO: 2203791 - protein, 8 aa, Cryptosporidium hominis
NKKPKGKC

SEQ ID NO: 2203792 - protein, 18 aa, Cryptosporidium hominis
NKKSIVGSRVDSKHKRQP

SEQ ID NO: 2203793 - protein, 7 aa, Cryptosporidium hominis
NKKTRRL

SEQ ID NO: 2203794 - protein, 31 aa, Cryptosporidium hominis
NKNEASGSENLNEANLGETNIGNKNQNSSKY

SEQ ID NO: 2203795 - protein, 8 aa, Cryptosporidium hominis
NKNEYQST

SEQ ID NO: 2203796 - protein, 4 aa, Cryptosporidium hominis
NKNI

SEQ ID NO: 2203797 - protein, 112 aa, Cryptosporidium hominis
NKNKAKANGKHKRNRRHKAEKSASIEEEFADQANKRVRQPETDLEPEVGLGSDSKSGPGSGSGSGPRSGPGSGPGSEPGSEPGSGPRSGSVPGPGSEPKAEEGIRPSQGELS

SEQ ID NO: 2203798 - protein, 4 aa, Cryptosporidium hominis
NKNL

SEQ ID NO: 2203799 - protein, 7 aa, Cryptosporidium hominis
NKNNDWY

SEQ ID NO: 2203800 - protein, 12 aa, Cryptosporidium hominis
NKNTKLEKSRDE

SEQ ID NO: 2203801 - protein, 6 aa, Cryptosporidium hominis
NKPDTV

SEQ ID NO: 2203802 - protein, 5 aa, Cryptosporidium hominis
NKQLK

SEQ ID NO: 2203803 - protein, 8 aa, Cryptosporidium hominis
NKRNETKN

SEQ ID NO: 2203804 - protein, 7 aa, Cryptosporidium hominis
NKSDEFS

SEQ ID NO: 2203805 - protein, 7 aa, Cryptosporidium hominis
NKSELRS

SEQ ID NO: 2203806 - protein, 7 aa, Cryptosporidium hominis
NKSETCV

SEQ ID NO: 2203807 - protein, 13 aa, Cryptosporidium hominis
NKSGISQVTEDVN

SEQ ID NO: 2203808 - protein, 16 aa, Cryptosporidium hominis
NKSIKESTAGDRNEEE

SEQ ID NO: 2203809 - protein, 8 aa, Cryptosporidium hominis
NKSKIQEG

SEQ ID NO: 2203810 - protein, 4 aa, Cryptosporidium hominis
NKSL

SEQ ID NO: 2203811 - protein, 18 aa, Cryptosporidium hominis
NKSLQPTKKTNESNMSNL

SEQ ID NO: 2203812 - protein, 7 aa, Cryptosporidium hominis
NKSNAKL

SEQ ID NO: 2203813 - protein, 9 aa, Cryptosporidium hominis
NKSNSLGIN

SEQ ID NO: 2203814 - protein, 8 aa, Cryptosporidium hominis
NKSNVESL

SEQ ID NO: 2203815 - protein, 10 aa, Cryptosporidium hominis
NKSPDNKEDE

SEQ ID NO: 2203816 - protein, 5 aa, Cryptosporidium hominis
NKSPI

SEQ ID NO: 2203817 - protein, 7 aa, Cryptosporidium hominis
NKSSSEF

SEQ ID NO: 2203818 - protein, 5 aa, Cryptosporidium hominis
NKSTQ

SEQ ID NO: 2203819 - protein, 13 aa, Cryptosporidium hominis
NKTHTKAISQGIR

SEQ ID NO: 2203820 - protein, 8 aa, Cryptosporidium hominis
NKVGNSSP

SEQ ID NO: 2203821 - protein, 15 aa, Cryptosporidium hominis
NKYKPSLKNRSYRNK

SEQ ID NO: 2203822 - protein, 7 aa, Cryptosporidium hominis
NKYRTNL

SEQ ID NO: 2203823 - protein, 5 aa, Cryptosporidium hominis
NKYSD

SEQ ID NO: 2203824 - protein, 10 aa, Cryptosporidium hominis
NLDGVDTGKF

SEQ ID NO: 2203825 - protein, 4 aa, Cryptosporidium hominis
NLDR

SEQ ID NO: 2203826 - protein, 13 aa, Cryptosporidium hominis
NLEDTSGKAVSSK

SEQ ID NO: 2203827 - protein, 13 aa, Cryptosporidium hominis
NLESSASSSDISQ

SEQ ID NO: 2203828 - protein, 6 aa, Cryptosporidium hominis
NLETEL

SEQ ID NO: 2203829 - protein, 5 aa, Cryptosporidium hominis
NLGSS

SEQ ID NO: 2203830 - protein, 9 aa, Cryptosporidium hominis
NLPGGDRIS

SEQ ID NO: 2203831 - protein, 5 aa, Cryptosporidium hominis
NLPPE

SEQ ID NO: 2203832 - protein, 10 aa, Cryptosporidium hominis
NLPSNSSSSC

SEQ ID NO: 2203833 - protein, 10 aa, Cryptosporidium hominis
NLQAKSNMES

SEQ ID NO: 2203834 - protein, 6 aa, Cryptosporidium hominis
NLSSGN

SEQ ID NO: 2203835 - protein, 4 aa, Cryptosporidium hominis
NLTE

SEQ ID NO: 2203836 - protein, 5 aa, Cryptosporidium hominis
NLTEK

SEQ ID NO: 2203837 - protein, 9 aa, Cryptosporidium hominis
NLTNKDDKF

SEQ ID NO: 2203838 - protein, 6 aa, Cryptosporidium hominis
NMGDTV

SEQ ID NO: 2203839 - protein, 8 aa, Cryptosporidium hominis
NMRGPDGQ

SEQ ID NO: 2203840 - protein, 14 aa, Cryptosporidium hominis
NNAPQVNSSKTTAK

SEQ ID NO: 2203841 - protein, 12 aa, Cryptosporidium hominis
NNDAKSSEKSTC

SEQ ID NO: 2203842 - protein, 5 aa, Cryptosporidium hominis
NNDKD

SEQ ID NO: 2203843 - protein, 7 aa, Cryptosporidium hominis
NNDKQDF

SEQ ID NO: 2203844 - protein, 7 aa, Cryptosporidium hominis
NNDPVYS

SEQ ID NO: 2203845 - protein, 14 aa, Cryptosporidium hominis
NNEANSKAEDDYEK

SEQ ID NO: 2203846 - protein, 6 aa, Cryptosporidium hominis
NNEERK

SEQ ID NO: 2203847 - protein, 7 aa, Cryptosporidium hominis
NNENDLS

SEQ ID NO: 2203848 - protein, 18 aa, Cryptosporidium hominis
NNENHQYEDEDYVESPSV

SEQ ID NO: 2203849 - protein, 10 aa, Cryptosporidium hominis
NNESSSSLQS

SEQ ID NO: 2203850 - protein, 44 aa, Cryptosporidium hominis
NNFANSASIASDHEISDPNYDLQNNTNINHDNSSYVNNETMSNP

SEQ ID NO: 2203851 - protein, 12 aa, Cryptosporidium hominis
NNFQEDNKQHHS

SEQ ID NO: 2203852 - protein, 17 aa, Cryptosporidium hominis
NNGKDIQNIGTSSLNSR

SEQ ID NO: 2203853 - protein, 16 aa, Cryptosporidium hominis
NNGNITELDKNSTLET

SEQ ID NO: 2203854 - protein, 14 aa, Cryptosporidium hominis
NNKELNKGNDENIS

SEQ ID NO: 2203855 - protein, 6 aa, Cryptosporidium hominis
NNKNNP

SEQ ID NO: 2203856 - protein, 8 aa, Cryptosporidium hominis
NNKNQVRK

SEQ ID NO: 2203857 - protein, 7 aa, Cryptosporidium hominis
NNKRPKI

SEQ ID NO: 2203858 - protein, 11 aa, Cryptosporidium hominis
NNKSYNESIND

SEQ ID NO: 2203859 - protein, 15 aa, Cryptosporidium hominis
NNNDSDGKGNKSDKK

SEQ ID NO: 2203860 - protein, 5 aa, Cryptosporidium hominis
NNNFS

SEQ ID NO: 2203861 - protein, 6 aa, Cryptosporidium hominis
NNNGPK

SEQ ID NO: 2203862 - protein, 9 aa, Cryptosporidium hominis
NNNRGERHK

SEQ ID NO: 2203863 - protein, 5 aa, Cryptosporidium hominis
NNPIK

SEQ ID NO: 2203864 - protein, 11 aa, Cryptosporidium hominis
NNPISSDKNNA

SEQ ID NO: 2203865 - protein, 5 aa, Cryptosporidium hominis
NNPYS

SEQ ID NO: 2203866 - protein, 7 aa, Cryptosporidium hominis
NNRKITE

SEQ ID NO: 2203867 - protein, 5 aa, Cryptosporidium hominis
NNRSA

SEQ ID NO: 2203868 - protein, 12 aa, Cryptosporidium hominis
NNSAKNDVTHQK

SEQ ID NO: 2203869 - protein, 9 aa, Cryptosporidium hominis
NNSELEGAT

SEQ ID NO: 2203870 - protein, 4 aa, Cryptosporidium hominis
NNSF

SEQ ID NO: 2203871 - protein, 7 aa, Cryptosporidium hominis
NNSLSYS

SEQ ID NO: 2203872 - protein, 15 aa, Cryptosporidium hominis
NNSNEYSSEGSIETG

SEQ ID NO: 2203873 - protein, 7 aa, Cryptosporidium hominis
NNSNNYD

SEQ ID NO: 2203874 - protein, 10 aa, Cryptosporidium hominis
NNSSNGGGYN

SEQ ID NO: 2203875 - protein, 7 aa, Cryptosporidium hominis
NNSSNPF

SEQ ID NO: 2203876 - protein, 10 aa, Cryptosporidium hominis
NNSSPIESIP

SEQ ID NO: 2203877 - protein, 6 aa, Cryptosporidium hominis
NNSTHK

SEQ ID NO: 2203878 - protein, 20 aa, Cryptosporidium hominis
NNTENAASPASRTSQPTETK

SEQ ID NO: 2203879 - protein, 4 aa, Cryptosporidium hominis
NPAV

SEQ ID NO: 2203880 - protein, 4 aa, Cryptosporidium hominis
NPEL

SEQ ID NO: 2203881 - protein, 5 aa, Cryptosporidium hominis
NPENL

SEQ ID NO: 2203882 - protein, 5 aa, Cryptosporidium hominis
NPESL

SEQ ID NO: 2203883 - protein, 10 aa, Cryptosporidium hominis
NPGKTSASDT

SEQ ID NO: 2203884 - protein, 11 aa, Cryptosporidium hominis
NPGSGKPSPIG

SEQ ID NO: 2203885 - protein, 11 aa, Cryptosporidium hominis
NPGSSLSNGVI

SEQ ID NO: 2203886 - protein, 5 aa, Cryptosporidium hominis
NPIIP

SEQ ID NO: 2203887 - protein, 13 aa, Cryptosporidium hominis
NPKNPTSADYSAS

SEQ ID NO: 2203888 - protein, 5 aa, Cryptosporidium hominis
NPNNF

SEQ ID NO: 2203889 - protein, 6 aa, Cryptosporidium hominis
NPPQKQ

SEQ ID NO: 2203890 - protein, 9 aa, Cryptosporidium hominis
NPQEVQTNC

SEQ ID NO: 2203891 - protein, 6 aa, Cryptosporidium hominis
NPQQSV

SEQ ID NO: 2203892 - protein, 11 aa, Cryptosporidium hominis
NPRKEKDIDVP

SEQ ID NO: 2203893 - protein, 9 aa, Cryptosporidium hominis
NPSEESKNS

SEQ ID NO: 2203894 - protein, 14 aa, Cryptosporidium hominis
NPSPGSKNPYSESN

SEQ ID NO: 2203895 - protein, 6 aa, Cryptosporidium hominis
NPSPSS

SEQ ID NO: 2203896 - protein, 13 aa, Cryptosporidium hominis
NPSSEDEEEEEKI

SEQ ID NO: 2203897 - protein, 5 aa, Cryptosporidium hominis
NPSSS

SEQ ID NO: 2203898 - protein, 6 aa, Cryptosporidium hominis
NPYSEG

SEQ ID NO: 2203899 - protein, 4 aa, Cryptosporidium hominis
NPYT

SEQ ID NO: 2203900 - protein, 5 aa, Cryptosporidium hominis
NQGFS

SEQ ID NO: 2203901 - protein, 13 aa, Cryptosporidium hominis
NQGNYSQNSTIII

SEQ ID NO: 2203902 - protein, 7 aa, Cryptosporidium hominis
NQIPTAP

SEQ ID NO: 2203903 - protein, 7 aa, Cryptosporidium hominis
NQKNDHI

SEQ ID NO: 2203904 - protein, 7 aa, Cryptosporidium hominis
NQKNNKL

SEQ ID NO: 2203905 - protein, 6 aa, Cryptosporidium hominis
NQLSSL

SEQ ID NO: 2203906 - protein, 6 aa, Cryptosporidium hominis
NQMGPK

SEQ ID NO: 2203907 - protein, 6 aa, Cryptosporidium hominis
NQNQSI

SEQ ID NO: 2203908 - protein, 5 aa, Cryptosporidium hominis
NQPRM

SEQ ID NO: 2203909 - protein, 4 aa, Cryptosporidium hominis
NQPT

SEQ ID NO: 2203910 - protein, 11 aa, Cryptosporidium hominis
NQQTHSDYSSS

SEQ ID NO: 2203911 - protein, 4 aa, Cryptosporidium hominis
NQSL

SEQ ID NO: 2203912 - protein, 7 aa, Cryptosporidium hominis
NQSLDNN

SEQ ID NO: 2203913 - protein, 7 aa, Cryptosporidium hominis
NQSLDPE

SEQ ID NO: 2203914 - protein, 19 aa, Cryptosporidium hominis
NQSNSLANTYSKISAADST

SEQ ID NO: 2203915 - protein, 10 aa, Cryptosporidium hominis
NQSWEGESQE

SEQ ID NO: 2203916 - protein, 5 aa, Cryptosporidium hominis
NRDEV

SEQ ID NO: 2203917 - protein, 5 aa, Cryptosporidium hominis
NREDF

SEQ ID NO: 2203918 - protein, 9 aa, Cryptosporidium hominis
NRGGSLNSA

SEQ ID NO: 2203919 - protein, 9 aa, Cryptosporidium hominis
NRGPNTNGS

SEQ ID NO: 2203920 - protein, 19 aa, Cryptosporidium hominis
NRKLEKDQVTDESENEELG

SEQ ID NO: 2203921 - protein, 11 aa, Cryptosporidium hominis
NRNQDDQSNQL

SEQ ID NO: 2203922 - protein, 19 aa, Cryptosporidium hominis
NRPQAIQTTHSNNNRHHNG

SEQ ID NO: 2203923 - protein, 19 aa, Cryptosporidium hominis
NRQENQSNPHSKKAESIEN

SEQ ID NO: 2203924 - protein, 8 aa, Cryptosporidium hominis
NRSASSAF

SEQ ID NO: 2203925 - protein, 7 aa, Cryptosporidium hominis
NRSTSRI

SEQ ID NO: 2203926 - protein, 6 aa, Cryptosporidium hominis
NRTDPV

SEQ ID NO: 2203927 - protein, 5 aa, Cryptosporidium hominis
NRVNN

SEQ ID NO: 2203928 - protein, 5 aa, Cryptosporidium hominis
NSAGE

SEQ ID NO: 2203929 - protein, 14 aa, Cryptosporidium hominis
NSCNNKDCNYDGGD

SEQ ID NO: 2203930 - protein, 6 aa, Cryptosporidium hominis
NSDGSC

SEQ ID NO: 2203931 - protein, 44 aa, Cryptosporidium hominis
NSDISKNGGTEPIKEVASSNGTMNSTSITESSEENLGNKLSNPE

SEQ ID NO: 2203932 - protein, 63 aa, Cryptosporidium hominis
NSDMSENDEQKTDDSEGSQDYDDNDDDDDDDDDDDGDSDREDAAGINRSYSNKHISTSTSNLK

SEQ ID NO: 2203933 - protein, 22 aa, Cryptosporidium hominis
NSDTNLSSNTISRTITSTTTVN

SEQ ID NO: 2203934 - protein, 12 aa, Cryptosporidium hominis
NSEEDKKNPPKV

SEQ ID NO: 2203935 - protein, 11 aa, Cryptosporidium hominis
NSEKLSNHDLP

SEQ ID NO: 2203936 - protein, 6 aa, Cryptosporidium hominis
NSESNV

SEQ ID NO: 2203937 - protein, 14 aa, Cryptosporidium hominis
NSEWRSASNLSPEQ

SEQ ID NO: 2203938 - protein, 15 aa, Cryptosporidium hominis
NSFSTNDKIGRDNGL

SEQ ID NO: 2203939 - protein, 7 aa, Cryptosporidium hominis
NSFTNNE

SEQ ID NO: 2203940 - protein, 10 aa, Cryptosporidium hominis
NSGETEESAN

SEQ ID NO: 2203941 - protein, 20 aa, Cryptosporidium hominis
NSGGGGGYSRQSYNVNSRQE

SEQ ID NO: 2203942 - protein, 11 aa, Cryptosporidium hominis
NSGKATKGISK

SEQ ID NO: 2203943 - protein, 6 aa, Cryptosporidium hominis
NSGKET

SEQ ID NO: 2203944 - protein, 12 aa, Cryptosporidium hominis
NSGLGSSAKRLE

SEQ ID NO: 2203945 - protein, 4 aa, Cryptosporidium hominis
NSGT

SEQ ID NO: 2203946 - protein, 4 aa, Cryptosporidium hominis
NSIQ

SEQ ID NO: 2203947 - protein, 9 aa, Cryptosporidium hominis
NSISGSPNI

SEQ ID NO: 2203948 - protein, 6 aa, Cryptosporidium hominis
NSITRE

SEQ ID NO: 2203949 - protein, 4 aa, Cryptosporidium hominis
NSKK

SEQ ID NO: 2203950 - protein, 6 aa, Cryptosporidium hominis
NSKKEE

SEQ ID NO: 2203951 - protein, 7 aa, Cryptosporidium hominis
NSKLSTQ

SEQ ID NO: 2203952 - protein, 12 aa, Cryptosporidium hominis
NSKQVKERYNNK

SEQ ID NO: 2203953 - protein, 15 aa, Cryptosporidium hominis
NSKTEANSKTSQHID

SEQ ID NO: 2203954 - protein, 15 aa, Cryptosporidium hominis
NSLDDGKDIDSDNIA

SEQ ID NO: 2203955 - protein, 4 aa, Cryptosporidium hominis
NSLQ

SEQ ID NO: 2203956 - protein, 4 aa, Cryptosporidium hominis
NSNG

SEQ ID NO: 2203957 - protein, 4 aa, Cryptosporidium hominis
NSNN

SEQ ID NO: 2203958 - protein, 17 aa, Cryptosporidium hominis
NSNNFGKSNDINNGNNS

SEQ ID NO: 2203959 - protein, 8 aa, Cryptosporidium hominis
NSNNLSTQ

SEQ ID NO: 2203960 - protein, 6 aa, Cryptosporidium hominis
NSNPGV

SEQ ID NO: 2203961 - protein, 5 aa, Cryptosporidium hominis
NSNQY

SEQ ID NO: 2203962 - protein, 6 aa, Cryptosporidium hominis
NSNTQF

SEQ ID NO: 2203963 - protein, 6 aa, Cryptosporidium hominis
NSPARK

SEQ ID NO: 2203964 - protein, 6 aa, Cryptosporidium hominis
NSQISS

SEQ ID NO: 2203965 - protein, 8 aa, Cryptosporidium hominis
NSQPNNVN

SEQ ID NO: 2203966 - protein, 14 aa, Cryptosporidium hominis
NSRAASKTAAEAVT

SEQ ID NO: 2203967 - protein, 7 aa, Cryptosporidium hominis
NSRNGLS

SEQ ID NO: 2203968 - protein, 8 aa, Cryptosporidium hominis
NSRNKIPH

SEQ ID NO: 2203969 - protein, 6 aa, Cryptosporidium hominis
NSRREP

SEQ ID NO: 2203970 - protein, 4 aa, Cryptosporidium hominis
NSSD

SEQ ID NO: 2203971 - protein, 9 aa, Cryptosporidium hominis
NSSDFSDPM

SEQ ID NO: 2203972 - protein, 20 aa, Cryptosporidium hominis
NSSFSGNNSENSSKPPEKKN

SEQ ID NO: 2203973 - protein, 5 aa, Cryptosporidium hominis
NSSGN

SEQ ID NO: 2203974 - protein, 6 aa, Cryptosporidium hominis
NSSGNL

SEQ ID NO: 2203975 - protein, 4 aa, Cryptosporidium hominis
NSSI

SEQ ID NO: 2203976 - protein, 4 aa, Cryptosporidium hominis
NSSL

SEQ ID NO: 2203977 - protein, 20 aa, Cryptosporidium hominis
NSSPPYNNLPNNGELNKKNS

SEQ ID NO: 2203978 - protein, 39 aa, Cryptosporidium hominis
NSTKVEEGNSASGSNSTGNSTQSGSVSNGDKKSSTKTIY

SEQ ID NO: 2203979 - protein, 8 aa, Cryptosporidium hominis
NSTQVDKG

SEQ ID NO: 2203980 - protein, 4 aa, Cryptosporidium hominis
NSTT

SEQ ID NO: 2203981 - protein, 8 aa, Cryptosporidium hominis
NTANKAYE

SEQ ID NO: 2203982 - protein, 6 aa, Cryptosporidium hominis
NTAPVN

SEQ ID NO: 2203983 - protein, 6 aa, Cryptosporidium hominis
NTDTQS

SEQ ID NO: 2203984 - protein, 4 aa, Cryptosporidium hominis
NTEI

SEQ ID NO: 2203985 - protein, 15 aa, Cryptosporidium hominis
NTGEETRSKSPNQAL

SEQ ID NO: 2203986 - protein, 5 aa, Cryptosporidium hominis
NTISK

SEQ ID NO: 2203987 - protein, 7 aa, Cryptosporidium hominis
NTKDENG

SEQ ID NO: 2203988 - protein, 5 aa, Cryptosporidium hominis
NTKDI

SEQ ID NO: 2203989 - protein, 10 aa, Cryptosporidium hominis
NTLDRYGSSN

SEQ ID NO: 2203990 - protein, 19 aa, Cryptosporidium hominis
NTNDNVSEGGSDEGTSEEL

SEQ ID NO: 2203991 - protein, 13 aa, Cryptosporidium hominis
NTNNPDKQRRDAE

SEQ ID NO: 2203992 - protein, 5 aa, Cryptosporidium hominis
NTNSF

SEQ ID NO: 2203993 - protein, 8 aa, Cryptosporidium hominis
NTNSQSGF

SEQ ID NO: 2203994 - protein, 6 aa, Cryptosporidium hominis
NTPDTF

SEQ ID NO: 2203995 - protein, 6 aa, Cryptosporidium hominis
NTPIIN

SEQ ID NO: 2203996 - protein, 5 aa, Cryptosporidium hominis
NTRKS

SEQ ID NO: 2203997 - protein, 4 aa, Cryptosporidium hominis
NTSI

SEQ ID NO: 2203998 - protein, 10 aa, Cryptosporidium hominis
NTSPKPNPFT

SEQ ID NO: 2203999 - protein, 6 aa, Cryptosporidium hominis
NTSTQY

SEQ ID NO: 2204000 - protein, 6 aa, Cryptosporidium hominis
NTSTTL

SEQ ID NO: 2204001 - protein, 12 aa, Cryptosporidium hominis
NTTDENRDPYSL

SEQ ID NO: 2204002 - protein, 4 aa, Cryptosporidium hominis
NTTK

SEQ ID NO: 2204003 - protein, 4 aa, Cryptosporidium hominis
NTTN

SEQ ID NO: 2204004 - protein, 16 aa, Cryptosporidium hominis
NTTNTTNTSNTTNNNI

SEQ ID NO: 2204005 - protein, 5 aa, Cryptosporidium hominis
NTVEG

SEQ ID NO: 2204006 - protein, 12 aa, Cryptosporidium hominis
NTVTSKSKRTKL

SEQ ID NO: 2204007 - protein, 9 aa, Cryptosporidium hominis
NTYDSGDEF

SEQ ID NO: 2204008 - protein, 7 aa, Cryptosporidium hominis
NVDSTNY

SEQ ID NO: 2204009 - protein, 15 aa, Cryptosporidium hominis
NVEKETNHDNETPKI

SEQ ID NO: 2204010 - protein, 13 aa, Cryptosporidium hominis
NVESTKVSKTLGD

SEQ ID NO: 2204011 - protein, 10 aa, Cryptosporidium hominis
NVKEDSEKDL

SEQ ID NO: 2204012 - protein, 8 aa, Cryptosporidium hominis
NVKPGNEF

SEQ ID NO: 2204013 - protein, 14 aa, Cryptosporidium hominis
NVLAGSNVGELKPS

SEQ ID NO: 2204014 - protein, 14 aa, Cryptosporidium hominis
NVPAKTDSSQASFE

SEQ ID NO: 2204015 - protein, 10 aa, Cryptosporidium hominis
NVPDSGNHYA

SEQ ID NO: 2204016 - protein, 9 aa, Cryptosporidium hominis
NVPSHGKSI

SEQ ID NO: 2204017 - protein, 15 aa, Cryptosporidium hominis
NVQNSGSTSLDSVPS

SEQ ID NO: 2204018 - protein, 5 aa, Cryptosporidium hominis
NVQSK

SEQ ID NO: 2204019 - protein, 9 aa, Cryptosporidium hominis
NVRENASKQ

SEQ ID NO: 2204020 - protein, 21 aa, Cryptosporidium hominis
NVSDGNGNPMDGAPKKPPLPA

SEQ ID NO: 2204021 - protein, 8 aa, Cryptosporidium hominis
NVVGSNGD

SEQ ID NO: 2204022 - protein, 9 aa, Cryptosporidium hominis
NWDGETRTT

SEQ ID NO: 2204023 - protein, 9 aa, Cryptosporidium hominis
NYATPGSGM

SEQ ID NO: 2204024 - protein, 9 aa, Cryptosporidium hominis
NYDNYGKRS

SEQ ID NO: 2204025 - protein, 13 aa, Cryptosporidium hominis
NYGASQVEEYDEA

SEQ ID NO: 2204026 - protein, 6 aa, Cryptosporidium hominis
NYGGFS

SEQ ID NO: 2204027 - protein, 4 aa, Cryptosporidium hominis
NYGK

SEQ ID NO: 2204028 - protein, 9 aa, Cryptosporidium hominis
NYKNNEIDE

SEQ ID NO: 2204029 - protein, 4 aa, Cryptosporidium hominis
NYPE

SEQ ID NO: 2204030 - protein, 5 aa, Cryptosporidium hominis
NYSVE

SEQ ID NO: 2204031 - protein, 4 aa, Cryptosporidium hominis
NYTV

SEQ ID NO: 2204032 - protein, 5 aa, Cryptosporidium hominis
NYYGE

SEQ ID NO: 2204033 - protein, 7 aa, Cryptosporidium hominis
NYYTRNG

SEQ ID NO: 2204034 - protein, 9 aa, Cryptosporidium hominis
PAAASDEEY

SEQ ID NO: 2204035 - protein, 13 aa, Cryptosporidium hominis
PAGKKISSKNREQ

SEQ ID NO: 2204036 - protein, 4 aa, Cryptosporidium hominis
PAKS

SEQ ID NO: 2204037 - protein, 9 aa, Cryptosporidium hominis
PAKSEYNQE

SEQ ID NO: 2204038 - protein, 7 aa, Cryptosporidium hominis
PANEGSN

SEQ ID NO: 2204039 - protein, 6 aa, Cryptosporidium hominis
PAPAPY

SEQ ID NO: 2204040 - protein, 9 aa, Cryptosporidium hominis
PAPRSPRCS

SEQ ID NO: 2204041 - protein, 9 aa, Cryptosporidium hominis
PASTNFESR

SEQ ID NO: 2204042 - protein, 19 aa, Cryptosporidium hominis
PATHTSVEAPGLGSQQPGI

SEQ ID NO: 2204043 - protein, 11 aa, Cryptosporidium hominis
PATTPRKSKNL

SEQ ID NO: 2204044 - protein, 16 aa, Cryptosporidium hominis
PAVPVPAPAVPTPAQA

SEQ ID NO: 2204045 - protein, 7 aa, Cryptosporidium hominis
PCSNPDQ

SEQ ID NO: 2204046 - protein, 14 aa, Cryptosporidium hominis
PDEDPKKTKEISEN

SEQ ID NO: 2204047 - protein, 8 aa, Cryptosporidium hominis
PDESSGKN

SEQ ID NO: 2204048 - protein, 12 aa, Cryptosporidium hominis
PDGSQCAKTEHT

SEQ ID NO: 2204049 - protein, 15 aa, Cryptosporidium hominis
PDKNKENSSDARSEE

SEQ ID NO: 2204050 - protein, 10 aa, Cryptosporidium hominis
PDKSNFTNST

SEQ ID NO: 2204051 - protein, 10 aa, Cryptosporidium hominis
PDMTGASEAL

SEQ ID NO: 2204052 - protein, 9 aa, Cryptosporidium hominis
PDNQKEETK

SEQ ID NO: 2204053 - protein, 7 aa, Cryptosporidium hominis
PDPATEK

SEQ ID NO: 2204054 - protein, 26 aa, Cryptosporidium hominis
PDPDYGNSDFQTSVERSRELRKSSSD

SEQ ID NO: 2204055 - protein, 7 aa, Cryptosporidium hominis
PDPYSQN

SEQ ID NO: 2204056 - protein, 4 aa, Cryptosporidium hominis
PDQI

SEQ ID NO: 2204057 - protein, 4 aa, Cryptosporidium hominis
PDRR

SEQ ID NO: 2204058 - protein, 16 aa, Cryptosporidium hominis
PDSRCPDNTEKTSTGC

SEQ ID NO: 2204059 - protein, 34 aa, Cryptosporidium hominis
PDTNNKPKKKYVSPPPQISYAGTEEDEDDDYDEN

SEQ ID NO: 2204060 - protein, 8 aa, Cryptosporidium hominis
PDVGRETP

SEQ ID NO: 2204061 - protein, 13 aa, Cryptosporidium hominis
PEAHNLRDGSKTD

SEQ ID NO: 2204062 - protein, 4 aa, Cryptosporidium hominis
PEDE

SEQ ID NO: 2204063 - protein, 4 aa, Cryptosporidium hominis
PEDH

SEQ ID NO: 2204064 - protein, 30 aa, Cryptosporidium hominis
PEDKMEGKKSSCCSSSCSSSSEKGSDKELK

SEQ ID NO: 2204065 - protein, 7 aa, Cryptosporidium hominis
PEDLPKN

SEQ ID NO: 2204066 - protein, 7 aa, Cryptosporidium hominis
PEDVEDG

SEQ ID NO: 2204067 - protein, 5 aa, Cryptosporidium hominis
PEEGR

SEQ ID NO: 2204068 - protein, 8 aa, Cryptosporidium hominis
PEEKPDFT

SEQ ID NO: 2204069 - protein, 5 aa, Cryptosporidium hominis
PEESS

SEQ ID NO: 2204070 - protein, 5 aa, Cryptosporidium hominis
PEEYD

SEQ ID NO: 2204071 - protein, 6 aa, Cryptosporidium hominis
PEGGYP

SEQ ID NO: 2204072 - protein, 10 aa, Cryptosporidium hominis
PEGTAKESLK

SEQ ID NO: 2204073 - protein, 4 aa, Cryptosporidium hominis
PEIG

SEQ ID NO: 2204074 - protein, 4 aa, Cryptosporidium hominis
PEKD

SEQ ID NO: 2204075 - protein, 12 aa, Cryptosporidium hominis
PEKETKEEEKIR

SEQ ID NO: 2204076 - protein, 14 aa, Cryptosporidium hominis
PEKSEDGEKDSQSP

SEQ ID NO: 2204077 - protein, 11 aa, Cryptosporidium hominis
PEKTVEESKIT

SEQ ID NO: 2204078 - protein, 74 aa, Cryptosporidium hominis
PELPPSTSSRPSSVRQPSHSDKGVSYKTSKTGRKSSTRATSISRRTPSGASRRTTSSPGAKGHSVSQSPYPSLQ

SEQ ID NO: 2204079 - protein, 5 aa, Cryptosporidium hominis
PENAN

SEQ ID NO: 2204080 - protein, 5 aa, Cryptosporidium hominis
PENDS

SEQ ID NO: 2204081 - protein, 7 aa, Cryptosporidium hominis
PESDPTQ

SEQ ID NO: 2204082 - protein, 17 aa, Cryptosporidium hominis
PESKENHSNSGQKTRLS

SEQ ID NO: 2204083 - protein, 11 aa, Cryptosporidium hominis
PESTDKTEENE

SEQ ID NO: 2204084 - protein, 4 aa, Cryptosporidium hominis
PETG

SEQ ID NO: 2204085 - protein, 7 aa, Cryptosporidium hominis
PETNFSR

SEQ ID NO: 2204086 - protein, 7 aa, Cryptosporidium hominis
PETRRKY

SEQ ID NO: 2204087 - protein, 4 aa, Cryptosporidium hominis
PETV

SEQ ID NO: 2204088 - protein, 4 aa, Cryptosporidium hominis
PEVL

SEQ ID NO: 2204089 - protein, 14 aa, Cryptosporidium hominis
PEVSCPPGSTPHGH

SEQ ID NO: 2204090 - protein, 12 aa, Cryptosporidium hominis
PFENSSAQQCAE

SEQ ID NO: 2204091 - protein, 6 aa, Cryptosporidium hominis
PFGPQA

SEQ ID NO: 2204092 - protein, 44 aa, Cryptosporidium hominis
PFSAPESGAIPKVRSSEGTRAQQSSLHGATKKKSDYKNMGKASR

SEQ ID NO: 2204093 - protein, 12 aa, Cryptosporidium hominis
PFSDKSGTIGNI

SEQ ID NO: 2204094 - protein, 5 aa, Cryptosporidium hominis
PFSKS

SEQ ID NO: 2204095 - protein, 32 aa, Cryptosporidium hominis
PFSQGPPPHLPPSSNSYSNGEPKKSSSSESLV

SEQ ID NO: 2204096 - protein, 5 aa, Cryptosporidium hominis
PFSSD

SEQ ID NO: 2204097 - protein, 4 aa, Cryptosporidium hominis
PGAQ

SEQ ID NO: 2204098 - protein, 4 aa, Cryptosporidium hominis
PGEE

SEQ ID NO: 2204099 - protein, 9 aa, Cryptosporidium hominis
PGFRGGKND

SEQ ID NO: 2204100 - protein, 14 aa, Cryptosporidium hominis
PGGNRTDTSFQNDS

SEQ ID NO: 2204101 - protein, 5 aa, Cryptosporidium hominis
PGGTF

SEQ ID NO: 2204102 - protein, 22 aa, Cryptosporidium hominis
PGIPSSSGLPPPPPPPSTTSSI

SEQ ID NO: 2204103 - protein, 9 aa, Cryptosporidium hominis
PGLNKRHPN

SEQ ID NO: 2204104 - protein, 5 aa, Cryptosporidium hominis
PGQRD

SEQ ID NO: 2204105 - protein, 26 aa, Cryptosporidium hominis
PGRDPYKKRSGKPDQSPPPLPPRDPS

SEQ ID NO: 2204106 - protein, 9 aa, Cryptosporidium hominis
PGSELEEGE

SEQ ID NO: 2204107 - protein, 14 aa, Cryptosporidium hominis
PGSSIQESDPPDHS

SEQ ID NO: 2204108 - protein, 8 aa, Cryptosporidium hominis
PGTQQPDL

SEQ ID NO: 2204109 - protein, 8 aa, Cryptosporidium hominis
PGYTDSGD

SEQ ID NO: 2204110 - protein, 8 aa, Cryptosporidium hominis
PHEGLPPE

SEQ ID NO: 2204111 - protein, 5 aa, Cryptosporidium hominis
PHGCE

SEQ ID NO: 2204112 - protein, 8 aa, Cryptosporidium hominis
PHKSPTSD

SEQ ID NO: 2204113 - protein, 8 aa, Cryptosporidium hominis
PHPRYGKY

SEQ ID NO: 2204114 - protein, 6 aa, Cryptosporidium hominis
PHRPRA

SEQ ID NO: 2204115 - protein, 5 aa, Cryptosporidium hominis
PIASK

SEQ ID NO: 2204116 - protein, 16 aa, Cryptosporidium hominis
PIKEDDDDSNFDHNTA

SEQ ID NO: 2204117 - protein, 4 aa, Cryptosporidium hominis
PINP

SEQ ID NO: 2204118 - protein, 12 aa, Cryptosporidium hominis
PIPSIEKRQNYD

SEQ ID NO: 2204119 - protein, 44 aa, Cryptosporidium hominis
PIRPPSSPPPLSPTSPHPTPQPPPPPPLPSTSFPQPPPPPPPLP

SEQ ID NO: 2204120 - protein, 10 aa, Cryptosporidium hominis
PIRPQKRQDE

SEQ ID NO: 2204121 - protein, 13 aa, Cryptosporidium hominis
PIRTGKKSGKEIR

SEQ ID NO: 2204122 - protein, 4 aa, Cryptosporidium hominis
PITG

SEQ ID NO: 2204123 - protein, 23 aa, Cryptosporidium hominis
PITPSSKNQDEKIKNNSSRSEFK

SEQ ID NO: 2204124 - protein, 5 aa, Cryptosporidium hominis
PIYPE

SEQ ID NO: 2204125 - protein, 6 aa, Cryptosporidium hominis
PIYTPT

SEQ ID NO: 2204126 - protein, 10 aa, Cryptosporidium hominis
PKEPDCSSSI

SEQ ID NO: 2204127 - protein, 11 aa, Cryptosporidium hominis
PKFDQDQKNMA

SEQ ID NO: 2204128 - protein, 10 aa, Cryptosporidium hominis
PKGQTNNTNI

SEQ ID NO: 2204129 - protein, 7 aa, Cryptosporidium hominis
PKGSKYN

SEQ ID NO: 2204130 - protein, 8 aa, Cryptosporidium hominis
PKKEDVNI

SEQ ID NO: 2204131 - protein, 5 aa, Cryptosporidium hominis
PKKNG

SEQ ID NO: 2204132 - protein, 14 aa, Cryptosporidium hominis
PKKTCEGGIEPDSD

SEQ ID NO: 2204133 - protein, 15 aa, Cryptosporidium hominis
PKNKSREKKRGITPS

SEQ ID NO: 2204134 - protein, 13 aa, Cryptosporidium hominis
PKNPGCPCDKEPK

SEQ ID NO: 2204135 - protein, 5 aa, Cryptosporidium hominis
PKPQY

SEQ ID NO: 2204136 - protein, 6 aa, Cryptosporidium hominis
PKQLGQ

SEQ ID NO: 2204137 - protein, 10 aa, Cryptosporidium hominis
PKRPKKSYPK

SEQ ID NO: 2204138 - protein, 6 aa, Cryptosporidium hominis
PKRTGI

SEQ ID NO: 2204139 - protein, 11 aa, Cryptosporidium hominis
PKSSSIYTQPS

SEQ ID NO: 2204140 - protein, 5 aa, Cryptosporidium hominis
PKTAN

SEQ ID NO: 2204141 - protein, 41 aa, Cryptosporidium hominis
PKTQSTTPPPSPFPPPSPFPPPSPSPPPSPSPSPSPPPLPP

SEQ ID NO: 2204142 - protein, 5 aa, Cryptosporidium hominis
PKTRD

SEQ ID NO: 2204143 - protein, 5 aa, Cryptosporidium hominis
PKYKE

SEQ ID NO: 2204144 - protein, 7 aa, Cryptosporidium hominis
PLEGPEK

SEQ ID NO: 2204145 - protein, 12 aa, Cryptosporidium hominis
PLENDDSISGYK

SEQ ID NO: 2204146 - protein, 7 aa, Cryptosporidium hominis
PLEPLPS

SEQ ID NO: 2204147 - protein, 8 aa, Cryptosporidium hominis
PLGSSQAV

SEQ ID NO: 2204148 - protein, 26 aa, Cryptosporidium hominis
PLKGEESDEEKKTRRDPFKRSKSQLS

SEQ ID NO: 2204149 - protein, 4 aa, Cryptosporidium hominis
PLNP

SEQ ID NO: 2204150 - protein, 149 aa, Cryptosporidium hominis
PLPPTPKAPTLPTPTISTPTIPTPTIPTPTIPAPTIPPTPTPTISTPTIPTPTIPTPTIPAPTIPAPTIPPTPTPTPTISTPTLPPQTLPPALPPALPPTITPTPTPPTLPQTPGQTITSGYPSNLSQQHSTNTDMTTDEEEQQSDSDE

SEQ ID NO: 2204151 - protein, 4 aa, Cryptosporidium hominis
PLSI

SEQ ID NO: 2204152 - protein, 12 aa, Cryptosporidium hominis
PLSKSEKKELQK

SEQ ID NO: 2204153 - protein, 15 aa, Cryptosporidium hominis
PLSTQSQTQSEKDEL

SEQ ID NO: 2204154 - protein, 11 aa, Cryptosporidium hominis
PMSGDNKNINS

SEQ ID NO: 2204155 - protein, 8 aa, Cryptosporidium hominis
PMTGESYY

SEQ ID NO: 2204156 - protein, 10 aa, Cryptosporidium hominis
PNAPLTANSN

SEQ ID NO: 2204157 - protein, 22 aa, Cryptosporidium hominis
PNCKKPCSSLDSPVYGSDGKEY

SEQ ID NO: 2204158 - protein, 5 aa, Cryptosporidium hominis
PNCSA

SEQ ID NO: 2204159 - protein, 7 aa, Cryptosporidium hominis
PNESSEL

SEQ ID NO: 2204160 - protein, 4 aa, Cryptosporidium hominis
PNET

SEQ ID NO: 2204161 - protein, 5 aa, Cryptosporidium hominis
PNEYG

SEQ ID NO: 2204162 - protein, 18 aa, Cryptosporidium hominis
PNFPNDINADGTSPLSEN

SEQ ID NO: 2204163 - protein, 18 aa, Cryptosporidium hominis
PNFRSGSSTLTSKTAIVR

SEQ ID NO: 2204164 - protein, 9 aa, Cryptosporidium hominis
PNFSQSQKE

SEQ ID NO: 2204165 - protein, 48 aa, Cryptosporidium hominis
PNGDFSTNEFESDVDDSSAREPSPVVTPNRKLAEATSDIEDDDDEMPN

SEQ ID NO: 2204166 - protein, 8 aa, Cryptosporidium hominis
PNGKEGKN

SEQ ID NO: 2204167 - protein, 4 aa, Cryptosporidium hominis
PNGN

SEQ ID NO: 2204168 - protein, 4 aa, Cryptosporidium hominis
PNGQ

SEQ ID NO: 2204169 - protein, 8 aa, Cryptosporidium hominis
PNKDVSNN

SEQ ID NO: 2204170 - protein, 11 aa, Cryptosporidium hominis
PNLDSDNNFSS

SEQ ID NO: 2204171 - protein, 11 aa, Cryptosporidium hominis
PNNISNEDYTE

SEQ ID NO: 2204172 - protein, 10 aa, Cryptosporidium hominis
PNNPPKEFSC

SEQ ID NO: 2204173 - protein, 11 aa, Cryptosporidium hominis
PNPESKGRKDL

SEQ ID NO: 2204174 - protein, 6 aa, Cryptosporidium hominis
PNPGDL

SEQ ID NO: 2204175 - protein, 6 aa, Cryptosporidium hominis
PNPYDR

SEQ ID NO: 2204176 - protein, 4 aa, Cryptosporidium hominis
PNQI

SEQ ID NO: 2204177 - protein, 5 aa, Cryptosporidium hominis
PNQID

SEQ ID NO: 2204178 - protein, 5 aa, Cryptosporidium hominis
PNQSK

SEQ ID NO: 2204179 - protein, 10 aa, Cryptosporidium hominis
PNSDQENLSR

SEQ ID NO: 2204180 - protein, 18 aa, Cryptosporidium hominis
PNSISEDTCSTSTSGSQE

SEQ ID NO: 2204181 - protein, 15 aa, Cryptosporidium hominis
PNSLDQSGSNRRNNR

SEQ ID NO: 2204182 - protein, 4 aa, Cryptosporidium hominis
PNTP

SEQ ID NO: 2204183 - protein, 5 aa, Cryptosporidium hominis
PNYGS

SEQ ID NO: 2204184 - protein, 8 aa, Cryptosporidium hominis
PPCSNGKV

SEQ ID NO: 2204185 - protein, 16 aa, Cryptosporidium hominis
PPDNWDANDDSVYPKN

SEQ ID NO: 2204186 - protein, 13 aa, Cryptosporidium hominis
PPEPTGPQYEDGN

SEQ ID NO: 2204187 - protein, 4 aa, Cryptosporidium hominis
PPES

SEQ ID NO: 2204188 - protein, 9 aa, Cryptosporidium hominis
PPFKRPEGI

SEQ ID NO: 2204189 - protein, 4 aa, Cryptosporidium hominis
PPFV

SEQ ID NO: 2204190 - protein, 6 aa, Cryptosporidium hominis
PPIDPI

SEQ ID NO: 2204191 - protein, 11 aa, Cryptosporidium hominis
PPIPGTEPGIE

SEQ ID NO: 2204192 - protein, 8 aa, Cryptosporidium hominis
PPKMDDEE

SEQ ID NO: 2204193 - protein, 5 aa, Cryptosporidium hominis
PPNGE

SEQ ID NO: 2204194 - protein, 4 aa, Cryptosporidium hominis
PPNR

SEQ ID NO: 2204195 - protein, 24 aa, Cryptosporidium hominis
PPPPPLPLSGDSKVSDMQKEDPTL

SEQ ID NO: 2204196 - protein, 31 aa, Cryptosporidium hominis
PPPSFPAPPPPSIPSGTPSRTPIPKDGNLTL

SEQ ID NO: 2204197 - protein, 4 aa, Cryptosporidium hominis
PPQM

SEQ ID NO: 2204198 - protein, 10 aa, Cryptosporidium hominis
PPSEDQPQGM

SEQ ID NO: 2204199 - protein, 11 aa, Cryptosporidium hominis
PPSENLSSPKL

SEQ ID NO: 2204200 - protein, 5 aa, Cryptosporidium hominis
PPSVA

SEQ ID NO: 2204201 - protein, 4 aa, Cryptosporidium hominis
PPSY

SEQ ID NO: 2204202 - protein, 6 aa, Cryptosporidium hominis
PPSYRC

SEQ ID NO: 2204203 - protein, 9 aa, Cryptosporidium hominis
PPSYTLPKS

SEQ ID NO: 2204204 - protein, 14 aa, Cryptosporidium hominis
PPTDSNSETVPLPP

SEQ ID NO: 2204205 - protein, 4 aa, Cryptosporidium hominis
PPTH

SEQ ID NO: 2204206 - protein, 7 aa, Cryptosporidium hominis
PPTPPQV

SEQ ID NO: 2204207 - protein, 4 aa, Cryptosporidium hominis
PPTV

SEQ ID NO: 2204208 - protein, 11 aa, Cryptosporidium hominis
PPYPPYPGSQF

SEQ ID NO: 2204209 - protein, 6 aa, Cryptosporidium hominis
PPYQGA

SEQ ID NO: 2204210 - protein, 13 aa, Cryptosporidium hominis
PQGYRNANGIQTA

SEQ ID NO: 2204211 - protein, 7 aa, Cryptosporidium hominis
PQHPSDY

SEQ ID NO: 2204212 - protein, 11 aa, Cryptosporidium hominis
PQLHTADPRTV

SEQ ID NO: 2204213 - protein, 18 aa, Cryptosporidium hominis
PQNISKPINRSVEASTSQ

SEQ ID NO: 2204214 - protein, 8 aa, Cryptosporidium hominis
PQNSQEEE

SEQ ID NO: 2204215 - protein, 9 aa, Cryptosporidium hominis
PQPDTQTAT

SEQ ID NO: 2204216 - protein, 13 aa, Cryptosporidium hominis
PQSAQPPSVNPTN

SEQ ID NO: 2204217 - protein, 6 aa, Cryptosporidium hominis
PQSSDL

SEQ ID NO: 2204218 - protein, 8 aa, Cryptosporidium hominis
PQVSTPEE

SEQ ID NO: 2204219 - protein, 4 aa, Cryptosporidium hominis
PREL

SEQ ID NO: 2204220 - protein, 9 aa, Cryptosporidium hominis
PRETEVSEI

SEQ ID NO: 2204221 - protein, 8 aa, Cryptosporidium hominis
PRGSSSPP

SEQ ID NO: 2204222 - protein, 10 aa, Cryptosporidium hominis
PRIGPDPRDP

SEQ ID NO: 2204223 - protein, 20 aa, Cryptosporidium hominis
PRKSKKRSFYKASHLNQLLV

SEQ ID NO: 2204224 - protein, 15 aa, Cryptosporidium hominis
PRKSTPSERAQNLSK

SEQ ID NO: 2204225 - protein, 6 aa, Cryptosporidium hominis
PRNNGL

SEQ ID NO: 2204226 - protein, 15 aa, Cryptosporidium hominis
PRPATLAQKQNEIES

SEQ ID NO: 2204227 - protein, 10 aa, Cryptosporidium hominis
PRRSFSSEIP

SEQ ID NO: 2204228 - protein, 6 aa, Cryptosporidium hominis
PRSKWR

SEQ ID NO: 2204229 - protein, 6 aa, Cryptosporidium hominis
PRSTPG

SEQ ID NO: 2204230 - protein, 5 aa, Cryptosporidium hominis
PRSVP

SEQ ID NO: 2204231 - protein, 7 aa, Cryptosporidium hominis
PRTSTVD

SEQ ID NO: 2204232 - protein, 7 aa, Cryptosporidium hominis
PRTYESY

SEQ ID NO: 2204233 - protein, 10 aa, Cryptosporidium hominis
PRYIPSNEEM

SEQ ID NO: 2204234 - protein, 4 aa, Cryptosporidium hominis
PSAP

SEQ ID NO: 2204235 - protein, 4 aa, Cryptosporidium hominis
PSCR

SEQ ID NO: 2204236 - protein, 16 aa, Cryptosporidium hominis
PSDEQIPNKKSNSDLK

SEQ ID NO: 2204237 - protein, 4 aa, Cryptosporidium hominis
PSDK

SEQ ID NO: 2204238 - protein, 4 aa, Cryptosporidium hominis
PSEI

SEQ ID NO: 2204239 - protein, 5 aa, Cryptosporidium hominis
PSESG

SEQ ID NO: 2204240 - protein, 5 aa, Cryptosporidium hominis
PSETF

SEQ ID NO: 2204241 - protein, 8 aa, Cryptosporidium hominis
PSEVKSAM

SEQ ID NO: 2204242 - protein, 6 aa, Cryptosporidium hominis
PSFNPE

SEQ ID NO: 2204243 - protein, 4 aa, Cryptosporidium hominis
PSFT

SEQ ID NO: 2204244 - protein, 4 aa, Cryptosporidium hominis
PSGI

SEQ ID NO: 2204245 - protein, 8 aa, Cryptosporidium hominis
PSGSGKKT

SEQ ID NO: 2204246 - protein, 10 aa, Cryptosporidium hominis
PSGTSDGHGK

SEQ ID NO: 2204247 - protein, 6 aa, Cryptosporidium hominis
PSHSFD

SEQ ID NO: 2204248 - protein, 7 aa, Cryptosporidium hominis
PSILSST

SEQ ID NO: 2204249 - protein, 24 aa, Cryptosporidium hominis
PSKGLGSGAPRPGRSPKKDKFGNP

SEQ ID NO: 2204250 - protein, 4 aa, Cryptosporidium hominis
PSKI

SEQ ID NO: 2204251 - protein, 8 aa, Cryptosporidium hominis
PSKKPDYY

SEQ ID NO: 2204252 - protein, 7 aa, Cryptosporidium hominis
PSKSTKY

SEQ ID NO: 2204253 - protein, 7 aa, Cryptosporidium hominis
PSLDGKD

SEQ ID NO: 2204254 - protein, 11 aa, Cryptosporidium hominis
PSLKPEPSTKF

SEQ ID NO: 2204255 - protein, 13 aa, Cryptosporidium hominis
PSNFPKTGYRGCG

SEQ ID NO: 2204256 - protein, 23 aa, Cryptosporidium hominis
PSPISTTTTTTATTTTTTTTTTT

SEQ ID NO: 2204257 - protein, 4 aa, Cryptosporidium hominis
PSRD

SEQ ID NO: 2204258 - protein, 6 aa, Cryptosporidium hominis
PSSIPD

SEQ ID NO: 2204259 - protein, 5 aa, Cryptosporidium hominis
PSSNI

SEQ ID NO: 2204260 - protein, 8 aa, Cryptosporidium hominis
PSSTNSGF

SEQ ID NO: 2204261 - protein, 37 aa, Cryptosporidium hominis
PSSTSTTTTTTTTTTTTTTTTTTTTTTTTTTSTTTHG

SEQ ID NO: 2204262 - protein, 10 aa, Cryptosporidium hominis
PSTIPESGFT

SEQ ID NO: 2204263 - protein, 6 aa, Cryptosporidium hominis
PSTKPF

SEQ ID NO: 2204264 - protein, 8 aa, Cryptosporidium hominis
PSTQGTKW

SEQ ID NO: 2204265 - protein, 7 aa, Cryptosporidium hominis
PSTSFKE

SEQ ID NO: 2204266 - protein, 14 aa, Cryptosporidium hominis
PSVDSKRKKPTKIE

SEQ ID NO: 2204267 - protein, 12 aa, Cryptosporidium hominis
PSVLKEKASSAW

SEQ ID NO: 2204268 - protein, 5 aa, Cryptosporidium hominis
PSVTP

SEQ ID NO: 2204269 - protein, 6 aa, Cryptosporidium hominis
PSYPEQ

SEQ ID NO: 2204270 - protein, 12 aa, Cryptosporidium hominis
PSYQEKKISNLN

SEQ ID NO: 2204271 - protein, 17 aa, Cryptosporidium hominis
PTEAPSSYTVTSTDTSS

SEQ ID NO: 2204272 - protein, 7 aa, Cryptosporidium hominis
PTEITES

SEQ ID NO: 2204273 - protein, 4 aa, Cryptosporidium hominis
PTER

SEQ ID NO: 2204274 - protein, 13 aa, Cryptosporidium hominis
PTFAKEGSSINYK

SEQ ID NO: 2204275 - protein, 84 aa, Cryptosporidium hominis
PTFNNNDESSGNCSNNMESVPNPDPSNIPVPSSDPVVSSTSQQSGYSSSSRPIPIPARSGSNKGPSSPSSFPSPCSPSSSTSKL

SEQ ID NO: 2204276 - protein, 5 aa, Cryptosporidium hominis
PTGVP

SEQ ID NO: 2204277 - protein, 4 aa, Cryptosporidium hominis
PTKR

SEQ ID NO: 2204278 - protein, 10 aa, Cryptosporidium hominis
PTKSNNQMLN

SEQ ID NO: 2204279 - protein, 7 aa, Cryptosporidium hominis
PTKTTQI

SEQ ID NO: 2204280 - protein, 6 aa, Cryptosporidium hominis
PTKYYG

SEQ ID NO: 2204281 - protein, 4 aa, Cryptosporidium hominis
PTME

SEQ ID NO: 2204282 - protein, 16 aa, Cryptosporidium hominis
PTNTTDERDTSKKSST

SEQ ID NO: 2204283 - protein, 5 aa, Cryptosporidium hominis
PTPNA

SEQ ID NO: 2204284 - protein, 6 aa, Cryptosporidium hominis
PTQTYT

SEQ ID NO: 2204285 - protein, 9 aa, Cryptosporidium hominis
PTRYKEASK

SEQ ID NO: 2204286 - protein, 9 aa, Cryptosporidium hominis
PTSDNTRPI

SEQ ID NO: 2204287 - protein, 5 aa, Cryptosporidium hominis
PTSER

SEQ ID NO: 2204288 - protein, 17 aa, Cryptosporidium hominis
PTSMGGSSSSGSAASLD

SEQ ID NO: 2204289 - protein, 8 aa, Cryptosporidium hominis
PTSQDSTR

SEQ ID NO: 2204290 - protein, 27 aa, Cryptosporidium hominis
PTSSMEVETTKSEDKPTGTKSSRKEEK

SEQ ID NO: 2204291 - protein, 17 aa, Cryptosporidium hominis
PTSVPASVPTSAPGSYI

SEQ ID NO: 2204292 - protein, 13 aa, Cryptosporidium hominis
PTTAPKLVKPPSS

SEQ ID NO: 2204293 - protein, 17 aa, Cryptosporidium hominis
PVAPQQPSIRPSTQGTY

SEQ ID NO: 2204294 - protein, 5 aa, Cryptosporidium hominis
PVDIS

SEQ ID NO: 2204295 - protein, 6 aa, Cryptosporidium hominis
PVESTE

SEQ ID NO: 2204296 - protein, 9 aa, Cryptosporidium hominis
PVGSPNSQW

SEQ ID NO: 2204297 - protein, 4 aa, Cryptosporidium hominis
PVKA

SEQ ID NO: 2204298 - protein, 7 aa, Cryptosporidium hominis
PVTTPNS

SEQ ID NO: 2204299 - protein, 47 aa, Cryptosporidium hominis
PVTTPVATPIPAPRTTTTTTTTTTTTTTTTTTTTTTTTTSPTESPKF

SEQ ID NO: 2204300 - protein, 7 aa, Cryptosporidium hominis
PVYSPSG

SEQ ID NO: 2204301 - protein, 6 aa, Cryptosporidium hominis
PVYTPD

SEQ ID NO: 2204302 - protein, 6 aa, Cryptosporidium hominis
PYATPA

SEQ ID NO: 2204303 - protein, 6 aa, Cryptosporidium hominis
PYKNKT

SEQ ID NO: 2204304 - protein, 14 aa, Cryptosporidium hominis
PYPNGVQDLPKETK

SEQ ID NO: 2204305 - protein, 5 aa, Cryptosporidium hominis
PYPNP

SEQ ID NO: 2204306 - protein, 6 aa, Cryptosporidium hominis
PYPSTF

SEQ ID NO: 2204307 - protein, 8 aa, Cryptosporidium hominis
PYRGGESE

SEQ ID NO: 2204308 - protein, 11 aa, Cryptosporidium hominis
PYSPKSSYTGV

SEQ ID NO: 2204309 - protein, 8 aa, Cryptosporidium hominis
PYTDPYAG

SEQ ID NO: 2204310 - protein, 10 aa, Cryptosporidium hominis
PYTPGKNSSN

SEQ ID NO: 2204311 - protein, 4 aa, Cryptosporidium hominis
PYTT

SEQ ID NO: 2204312 - protein, 12 aa, Cryptosporidium hominis
QAHNYDSKSPHI

SEQ ID NO: 2204313 - protein, 5 aa, Cryptosporidium hominis
QAKNL

SEQ ID NO: 2204314 - protein, 13 aa, Cryptosporidium hominis
QALSSNKENREIK

SEQ ID NO: 2204315 - protein, 5 aa, Cryptosporidium hominis
QANIN

SEQ ID NO: 2204316 - protein, 14 aa, Cryptosporidium hominis
QANQPNVSEYNSEQ

SEQ ID NO: 2204317 - protein, 6 aa, Cryptosporidium hominis
QAQPIV

SEQ ID NO: 2204318 - protein, 8 aa, Cryptosporidium hominis
QATASSVG

SEQ ID NO: 2204319 - protein, 19 aa, Cryptosporidium hominis
QATSGPNSPFGRLPATSPK

SEQ ID NO: 2204320 - protein, 8 aa, Cryptosporidium hominis
QAVTEGDS

SEQ ID NO: 2204321 - protein, 6 aa, Cryptosporidium hominis
QCDNEG

SEQ ID NO: 2204322 - protein, 9 aa, Cryptosporidium hominis
QCPAGSIPR

SEQ ID NO: 2204323 - protein, 7 aa, Cryptosporidium hominis
QCPPGYE

SEQ ID NO: 2204324 - protein, 5 aa, Cryptosporidium hominis
QCQSI

SEQ ID NO: 2204325 - protein, 9 aa, Cryptosporidium hominis
QDCDTKQAI

SEQ ID NO: 2204326 - protein, 29 aa, Cryptosporidium hominis
QDEDDDEGKSDREQEKLDDLDPGSEEQKK

SEQ ID NO: 2204327 - protein, 6 aa, Cryptosporidium hominis
QDELPQ

SEQ ID NO: 2204328 - protein, 4 aa, Cryptosporidium hominis
QDFN

SEQ ID NO: 2204329 - protein, 5 aa, Cryptosporidium hominis
QDFSE

SEQ ID NO: 2204330 - protein, 7 aa, Cryptosporidium hominis
QDFSTDS

SEQ ID NO: 2204331 - protein, 16 aa, Cryptosporidium hominis
QDGSHTYDKSKLNELN

SEQ ID NO: 2204332 - protein, 9 aa, Cryptosporidium hominis
QDGTRSKEC

SEQ ID NO: 2204333 - protein, 17 aa, Cryptosporidium hominis
QDKETSLESKEKALSEL

SEQ ID NO: 2204334 - protein, 9 aa, Cryptosporidium hominis
QDLSNNGAD

SEQ ID NO: 2204335 - protein, 5 aa, Cryptosporidium hominis
QDNTI

SEQ ID NO: 2204336 - protein, 6 aa, Cryptosporidium hominis
QDPDNL

SEQ ID NO: 2204337 - protein, 4 aa, Cryptosporidium hominis
QDPN

SEQ ID NO: 2204338 - protein, 9 aa, Cryptosporidium hominis
QDPNEPSTI

SEQ ID NO: 2204339 - protein, 8 aa, Cryptosporidium hominis
QDQGSAEI

SEQ ID NO: 2204340 - protein, 45 aa, Cryptosporidium hominis
QDQGSSIPKNREDEKKRNKPSISTESSDQSNENSNKPEENYNGDG

SEQ ID NO: 2204341 - protein, 21 aa, Cryptosporidium hominis
QDRNSQNNRYYGTYNSQGGYY

SEQ ID NO: 2204342 - protein, 9 aa, Cryptosporidium hominis
QDSPNPTEI

SEQ ID NO: 2204343 - protein, 8 aa, Cryptosporidium hominis
QDSSELKN

SEQ ID NO: 2204344 - protein, 14 aa, Cryptosporidium hominis
QDTPRWESTSSGLS

SEQ ID NO: 2204345 - protein, 7 aa, Cryptosporidium hominis
QEEALEK

SEQ ID NO: 2204346 - protein, 16 aa, Cryptosporidium hominis
QEECQKKSKKISGNKL

SEQ ID NO: 2204347 - protein, 5 aa, Cryptosporidium hominis
QEGNN

SEQ ID NO: 2204348 - protein, 23 aa, Cryptosporidium hominis
QEHAAKPASRTGAPAPGAPAGNL

SEQ ID NO: 2204349 - protein, 8 aa, Cryptosporidium hominis
QEKTSSQP

SEQ ID NO: 2204350 - protein, 12 aa, Cryptosporidium hominis
QELSSKKKSFWR

SEQ ID NO: 2204351 - protein, 6 aa, Cryptosporidium hominis
QENKRA

SEQ ID NO: 2204352 - protein, 8 aa, Cryptosporidium hominis
QENSGLGP

SEQ ID NO: 2204353 - protein, 52 aa, Cryptosporidium hominis
QEQESGSEKEFEQESEGEPKQDTEKESEREFDESKETSSKIEESSKPLEKST

SEQ ID NO: 2204354 - protein, 52 aa, Cryptosporidium hominis
QEQKSSNTSTRRRKQDERKTKNETRREREERERVEERERERERERERQKRIE

SEQ ID NO: 2204355 - protein, 10 aa, Cryptosporidium hominis
QERMEGEKEE

SEQ ID NO: 2204356 - protein, 6 aa, Cryptosporidium hominis
QETFSE

SEQ ID NO: 2204357 - protein, 6 aa, Cryptosporidium hominis
QETPEG

SEQ ID NO: 2204358 - protein, 4 aa, Cryptosporidium hominis
QEWN

SEQ ID NO: 2204359 - protein, 21 aa, Cryptosporidium hominis
QEYPENRESKKSLLKKRSDEF

SEQ ID NO: 2204360 - protein, 16 aa, Cryptosporidium hominis
QFSSQVKPKAYTTSKG

SEQ ID NO: 2204361 - protein, 6 aa, Cryptosporidium hominis
QGCEGG

SEQ ID NO: 2204362 - protein, 4 aa, Cryptosporidium hominis
QGCG

SEQ ID NO: 2204363 - protein, 4 aa, Cryptosporidium hominis
QGGG

SEQ ID NO: 2204364 - protein, 4 aa, Cryptosporidium hominis
QGKN

SEQ ID NO: 2204365 - protein, 7 aa, Cryptosporidium hominis
QGMGSQE

SEQ ID NO: 2204366 - protein, 18 aa, Cryptosporidium hominis
QGPSDFAKPRGESSRSEV

SEQ ID NO: 2204367 - protein, 6 aa, Cryptosporidium hominis
QGPTFP

SEQ ID NO: 2204368 - protein, 8 aa, Cryptosporidium hominis
QGRCSSEQ

SEQ ID NO: 2204369 - protein, 13 aa, Cryptosporidium hominis
QGSQTKMSASVQN

SEQ ID NO: 2204370 - protein, 11 aa, Cryptosporidium hominis
QHANEPEHNSG

SEQ ID NO: 2204371 - protein, 7 aa, Cryptosporidium hominis
QHPNQQQ

SEQ ID NO: 2204372 - protein, 7 aa, Cryptosporidium hominis
QHSATLT

SEQ ID NO: 2204373 - protein, 9 aa, Cryptosporidium hominis
QHSTEGMDT

SEQ ID NO: 2204374 - protein, 5 aa, Cryptosporidium hominis
QIIGQ

SEQ ID NO: 2204375 - protein, 10 aa, Cryptosporidium hominis
QIPSPGGTPC

SEQ ID NO: 2204376 - protein, 7 aa, Cryptosporidium hominis
QIQNNKE

SEQ ID NO: 2204377 - protein, 15 aa, Cryptosporidium hominis
QISDPNQKNNSEQIN

SEQ ID NO: 2204378 - protein, 6 aa, Cryptosporidium hominis
QIYGSA

SEQ ID NO: 2204379 - protein, 11 aa, Cryptosporidium hominis
QKAKEAEEARQ

SEQ ID NO: 2204380 - protein, 5 aa, Cryptosporidium hominis
QKDRD

SEQ ID NO: 2204381 - protein, 7 aa, Cryptosporidium hominis
QKEADAL

SEQ ID NO: 2204382 - protein, 10 aa, Cryptosporidium hominis
QKEDNETMTG

SEQ ID NO: 2204383 - protein, 9 aa, Cryptosporidium hominis
QKEFNNDKQ

SEQ ID NO: 2204384 - protein, 4 aa, Cryptosporidium hominis
QKES

SEQ ID NO: 2204385 - protein, 5 aa, Cryptosporidium hominis
QKGIE

SEQ ID NO: 2204386 - protein, 17 aa, Cryptosporidium hominis
QKHNNNKLENKDFNNEN

SEQ ID NO: 2204387 - protein, 20 aa, Cryptosporidium hominis
QKKALENQSLKKKAQVQLSD

SEQ ID NO: 2204388 - protein, 8 aa, Cryptosporidium hominis
QKKKTENI

SEQ ID NO: 2204389 - protein, 13 aa, Cryptosporidium hominis
QKKYGTQITPSGQ

SEQ ID NO: 2204390 - protein, 12 aa, Cryptosporidium hominis
QKNDKLNNFDSS

SEQ ID NO: 2204391 - protein, 6 aa, Cryptosporidium hominis
QKNSKG

SEQ ID NO: 2204392 - protein, 4 aa, Cryptosporidium hominis
QKQT

SEQ ID NO: 2204393 - protein, 10 aa, Cryptosporidium hominis
QKRECGDTPC

SEQ ID NO: 2204394 - protein, 6 aa, Cryptosporidium hominis
QKRNEL

SEQ ID NO: 2204395 - protein, 9 aa, Cryptosporidium hominis
QKRSPLKKE

SEQ ID NO: 2204396 - protein, 8 aa, Cryptosporidium hominis
QKSATRQA

SEQ ID NO: 2204397 - protein, 4 aa, Cryptosporidium hominis
QKSI

SEQ ID NO: 2204398 - protein, 8 aa, Cryptosporidium hominis
QKSKLRKM

SEQ ID NO: 2204399 - protein, 13 aa, Cryptosporidium hominis
QKTGDGTNSGREV

SEQ ID NO: 2204400 - protein, 8 aa, Cryptosporidium hominis
QKYPGGYK

SEQ ID NO: 2204401 - protein, 5 aa, Cryptosporidium hominis
QLNKT

SEQ ID NO: 2204402 - protein, 9 aa, Cryptosporidium hominis
QLPDGSQKL

SEQ ID NO: 2204403 - protein, 9 aa, Cryptosporidium hominis
QLPPPPSQN

SEQ ID NO: 2204404 - protein, 11 aa, Cryptosporidium hominis
QLSNNSKITEN

SEQ ID NO: 2204405 - protein, 5 aa, Cryptosporidium hominis
QLSPS

SEQ ID NO: 2204406 - protein, 20 aa, Cryptosporidium hominis
QLSTESNTPSYIPSEPQKAN

SEQ ID NO: 2204407 - protein, 5 aa, Cryptosporidium hominis
QMQPG

SEQ ID NO: 2204408 - protein, 8 aa, Cryptosporidium hominis
QNGSPYGI

SEQ ID NO: 2204409 - protein, 15 aa, Cryptosporidium hominis
QNKDENLKRRRSRGV

SEQ ID NO: 2204410 - protein, 15 aa, Cryptosporidium hominis
QNKEDLKNNIETPTH

SEQ ID NO: 2204411 - protein, 8 aa, Cryptosporidium hominis
QNLDDGYQ

SEQ ID NO: 2204412 - protein, 9 aa, Cryptosporidium hominis
QNPDLNQDG

SEQ ID NO: 2204413 - protein, 5 aa, Cryptosporidium hominis
QNQCT

SEQ ID NO: 2204414 - protein, 7 aa, Cryptosporidium hominis
QNQNGAE

SEQ ID NO: 2204415 - protein, 7 aa, Cryptosporidium hominis
QNQNYGH

SEQ ID NO: 2204416 - protein, 6 aa, Cryptosporidium hominis
QNQPSI

SEQ ID NO: 2204417 - protein, 7 aa, Cryptosporidium hominis
QNQQENM

SEQ ID NO: 2204418 - protein, 7 aa, Cryptosporidium hominis
QNQYYSD

SEQ ID NO: 2204419 - protein, 4 aa, Cryptosporidium hominis
QNSG

SEQ ID NO: 2204420 - protein, 12 aa, Cryptosporidium hominis
QNSINKETSQIN

SEQ ID NO: 2204421 - protein, 10 aa, Cryptosporidium hominis
QNSTAYRTNL

SEQ ID NO: 2204422 - protein, 7 aa, Cryptosporidium hominis
QNSTGNN

SEQ ID NO: 2204423 - protein, 10 aa, Cryptosporidium hominis
QNTPPIAGRK

SEQ ID NO: 2204424 - protein, 5 aa, Cryptosporidium hominis
QNTSF

SEQ ID NO: 2204425 - protein, 6 aa, Cryptosporidium hominis
QNTTST

SEQ ID NO: 2204426 - protein, 10 aa, Cryptosporidium hominis
QNYSGARSKD

SEQ ID NO: 2204427 - protein, 8 aa, Cryptosporidium hominis
QPEGATAK

SEQ ID NO: 2204428 - protein, 8 aa, Cryptosporidium hominis
QPETEDAT

SEQ ID NO: 2204429 - protein, 6 aa, Cryptosporidium hominis
QPFSGR

SEQ ID NO: 2204430 - protein, 6 aa, Cryptosporidium hominis
QPGKKH

SEQ ID NO: 2204431 - protein, 13 aa, Cryptosporidium hominis
QPGPQGSPNTGLR

SEQ ID NO: 2204432 - protein, 21 aa, Cryptosporidium hominis
QPINIPPPNCPPNNSNITQGT

SEQ ID NO: 2204433 - protein, 25 aa, Cryptosporidium hominis
QPTRTIEPDHSGVYTTPNLKPSDLE

SEQ ID NO: 2204434 - protein, 7 aa, Cryptosporidium hominis
QQEELQK

SEQ ID NO: 2204435 - protein, 13 aa, Cryptosporidium hominis
QQFPTKPTATYGV

SEQ ID NO: 2204436 - protein, 6 aa, Cryptosporidium hominis
QQGPSW

SEQ ID NO: 2204437 - protein, 6 aa, Cryptosporidium hominis
QQHDPR

SEQ ID NO: 2204438 - protein, 10 aa, Cryptosporidium hominis
QQKCETYGSE

SEQ ID NO: 2204439 - protein, 74 aa, Cryptosporidium hominis
QQKKEASNNGSKDNVKPSNESEEQKKQQKLKEKQDKKKAKAEKELKENEEGDSSSCSSKKKSKKTKSTQTQGPE

SEQ ID NO: 2204440 - protein, 5 aa, Cryptosporidium hominis
QQMHG

SEQ ID NO: 2204441 - protein, 4 aa, Cryptosporidium hominis
QQPE

SEQ ID NO: 2204442 - protein, 7 aa, Cryptosporidium hominis
QQPRSYA

SEQ ID NO: 2204443 - protein, 13 aa, Cryptosporidium hominis
QQSNATLSGNATY

SEQ ID NO: 2204444 - protein, 12 aa, Cryptosporidium hominis
QQTDQLPETPES

SEQ ID NO: 2204445 - protein, 25 aa, Cryptosporidium hominis
QRKDRNASKQLGPKEPSSSSKYPVS

SEQ ID NO: 2204446 - protein, 4 aa, Cryptosporidium hominis
QRLS

SEQ ID NO: 2204447 - protein, 7 aa, Cryptosporidium hominis
QRPKEKK

SEQ ID NO: 2204448 - protein, 10 aa, Cryptosporidium hominis
QRQKAANRAL

SEQ ID NO: 2204449 - protein, 15 aa, Cryptosporidium hominis
QRQKEEFSEIEKTRR

SEQ ID NO: 2204450 - protein, 5 aa, Cryptosporidium hominis
QRSKI

SEQ ID NO: 2204451 - protein, 58 aa, Cryptosporidium hominis
QRSRSRSRSRSRSSSRSSSRSRSRSRSRSRSRSRSHSHSHSHSHSNIESRQHQHSGPR

SEQ ID NO: 2204452 - protein, 23 aa, Cryptosporidium hominis
QSALSGSGVSGSSPTTSSSAALG

SEQ ID NO: 2204453 - protein, 6 aa, Cryptosporidium hominis
QSATFR

SEQ ID NO: 2204454 - protein, 4 aa, Cryptosporidium hominis
QSDD

SEQ ID NO: 2204455 - protein, 4 aa, Cryptosporidium hominis
QSDE

SEQ ID NO: 2204456 - protein, 8 aa, Cryptosporidium hominis
QSEDGESI

SEQ ID NO: 2204457 - protein, 7 aa, Cryptosporidium hominis
QSEIEDL

SEQ ID NO: 2204458 - protein, 11 aa, Cryptosporidium hominis
QSGDEKLTGKA

SEQ ID NO: 2204459 - protein, 10 aa, Cryptosporidium hominis
QSHAGGSGRS

SEQ ID NO: 2204460 - protein, 4 aa, Cryptosporidium hominis
QSLE

SEQ ID NO: 2204461 - protein, 5 aa, Cryptosporidium hominis
QSNDP

SEQ ID NO: 2204462 - protein, 5 aa, Cryptosporidium hominis
QSNEE

SEQ ID NO: 2204463 - protein, 13 aa, Cryptosporidium hominis
QSNPKKFNPPQGS

SEQ ID NO: 2204464 - protein, 7 aa, Cryptosporidium hominis
QSPTKNI

SEQ ID NO: 2204465 - protein, 9 aa, Cryptosporidium hominis
QSQNSIATE

SEQ ID NO: 2204466 - protein, 21 aa, Cryptosporidium hominis
QSQNTALGDGIERSGPNFSTD

SEQ ID NO: 2204467 - protein, 9 aa, Cryptosporidium hominis
QSSFQNAKQ

SEQ ID NO: 2204468 - protein, 8 aa, Cryptosporidium hominis
QSSQRLPL

SEQ ID NO: 2204469 - protein, 9 aa, Cryptosporidium hominis
QSSSCFSGN

SEQ ID NO: 2204470 - protein, 11 aa, Cryptosporidium hominis
QSSTGGSSSIE

SEQ ID NO: 2204471 - protein, 6 aa, Cryptosporidium hominis
QSSVHA

SEQ ID NO: 2204472 - protein, 16 aa, Cryptosporidium hominis
QSSVSASSVFSPTSAP

SEQ ID NO: 2204473 - protein, 4 aa, Cryptosporidium hominis
QSTN

SEQ ID NO: 2204474 - protein, 34 aa, Cryptosporidium hominis
QSTVSGSTSMSDISNTEDQQTNVTVEEDQELNKE

SEQ ID NO: 2204475 - protein, 47 aa, Cryptosporidium hominis
QSVPTGGVAVSGGAAATSGGAAQDSAPAEKKKEEEEEEEGDLGFSLF

SEQ ID NO: 2204476 - protein, 16 aa, Cryptosporidium hominis
QSYESFDPRSPNGGVT

SEQ ID NO: 2204477 - protein, 13 aa, Cryptosporidium hominis
QSYKYENNTRNAL

SEQ ID NO: 2204478 - protein, 9 aa, Cryptosporidium hominis
QTAPSTYPT

SEQ ID NO: 2204479 - protein, 6 aa, Cryptosporidium hominis
QTEEVT

SEQ ID NO: 2204480 - protein, 11 aa, Cryptosporidium hominis
QTETSSLPASR

SEQ ID NO: 2204481 - protein, 8 aa, Cryptosporidium hominis
QTGYHSSG

SEQ ID NO: 2204482 - protein, 9 aa, Cryptosporidium hominis
QTKKLNKKG

SEQ ID NO: 2204483 - protein, 12 aa, Cryptosporidium hominis
QTNPDLPSSKEL

SEQ ID NO: 2204484 - protein, 19 aa, Cryptosporidium hominis
QTPIPQTQPEKSKSHPPQI

SEQ ID NO: 2204485 - protein, 5 aa, Cryptosporidium hominis
QTPMG

SEQ ID NO: 2204486 - protein, 33 aa, Cryptosporidium hominis
QTPPHSPPPLPSPPPPPPPSPSPSPPPPPTYPM

SEQ ID NO: 2204487 - protein, 10 aa, Cryptosporidium hominis
QTQGESEESF

SEQ ID NO: 2204488 - protein, 5 aa, Cryptosporidium hominis
QTSGL

SEQ ID NO: 2204489 - protein, 5 aa, Cryptosporidium hominis
QTSPN

SEQ ID NO: 2204490 - protein, 9 aa, Cryptosporidium hominis
QTSSNSGCS

SEQ ID NO: 2204491 - protein, 14 aa, Cryptosporidium hominis
QTSTTVPGDSDEAD

SEQ ID NO: 2204492 - protein, 6 aa, Cryptosporidium hominis
QTSYEK

SEQ ID NO: 2204493 - protein, 4 aa, Cryptosporidium hominis
QTYG

SEQ ID NO: 2204494 - protein, 25 aa, Cryptosporidium hominis
QVAPPSNRSSITTAPHSGATPPIPG

SEQ ID NO: 2204495 - protein, 11 aa, Cryptosporidium hominis
QVDEKKAKYQS

SEQ ID NO: 2204496 - protein, 16 aa, Cryptosporidium hominis
QVEGKDQTMEEETSKV

SEQ ID NO: 2204497 - protein, 10 aa, Cryptosporidium hominis
QVSQKKQYKY

SEQ ID NO: 2204498 - protein, 6 aa, Cryptosporidium hominis
QVTPTL

SEQ ID NO: 2204499 - protein, 4 aa, Cryptosporidium hominis
QVTY

SEQ ID NO: 2204500 - protein, 4 aa, Cryptosporidium hominis
QYES

SEQ ID NO: 2204501 - protein, 44 aa, Cryptosporidium hominis
QYNTNSMTSTNKRKKRKKRKKIKKKNKNKKERGISSTEEYEISS

SEQ ID NO: 2204502 - protein, 5 aa, Cryptosporidium hominis
QYPEL

SEQ ID NO: 2204503 - protein, 7 aa, Cryptosporidium hominis
QYPSSLP

SEQ ID NO: 2204504 - protein, 22 aa, Cryptosporidium hominis
QYTGAAGKNNIVSTDENTPQTR

SEQ ID NO: 2204505 - protein, 9 aa, Cryptosporidium hominis
QYTPANEGK

SEQ ID NO: 2204506 - protein, 11 aa, Cryptosporidium hominis
RADEEEAELEK

SEQ ID NO: 2204507 - protein, 5 aa, Cryptosporidium hominis
RADPD

SEQ ID NO: 2204508 - protein, 9 aa, Cryptosporidium hominis
RADPQTSLS

SEQ ID NO: 2204509 - protein, 11 aa, Cryptosporidium hominis
RAEEGDKEAER

SEQ ID NO: 2204510 - protein, 6 aa, Cryptosporidium hominis
RAGSQE

SEQ ID NO: 2204511 - protein, 9 aa, Cryptosporidium hominis
RAKEASSAT

SEQ ID NO: 2204512 - protein, 9 aa, Cryptosporidium hominis
RAKKEQKKY

SEQ ID NO: 2204513 - protein, 7 aa, Cryptosporidium hominis
RANENGL

SEQ ID NO: 2204514 - protein, 19 aa, Cryptosporidium hominis
RARTSGETVFEDENEVNTY

SEQ ID NO: 2204515 - protein, 7 aa, Cryptosporidium hominis
RASRQPS

SEQ ID NO: 2204516 - protein, 9 aa, Cryptosporidium hominis
RASSHESNL

SEQ ID NO: 2204517 - protein, 8 aa, Cryptosporidium hominis
RASSSDPF

SEQ ID NO: 2204518 - protein, 6 aa, Cryptosporidium hominis
RCKNPT

SEQ ID NO: 2204519 - protein, 5 aa, Cryptosporidium hominis
RDDDY

SEQ ID NO: 2204520 - protein, 5 aa, Cryptosporidium hominis
RDEEL

SEQ ID NO: 2204521 - protein, 8 aa, Cryptosporidium hominis
RDENDDYE

SEQ ID NO: 2204522 - protein, 14 aa, Cryptosporidium hominis
RDESSKGENNNESE

SEQ ID NO: 2204523 - protein, 4 aa, Cryptosporidium hominis
RDIH

SEQ ID NO: 2204524 - protein, 9 aa, Cryptosporidium hominis
RDKVTKDEI

SEQ ID NO: 2204525 - protein, 7 aa, Cryptosporidium hominis
RDLKAGD

SEQ ID NO: 2204526 - protein, 8 aa, Cryptosporidium hominis
RDPEKEGH

SEQ ID NO: 2204527 - protein, 6 aa, Cryptosporidium hominis
RDPGTL

SEQ ID NO: 2204528 - protein, 4 aa, Cryptosporidium hominis
RDPN

SEQ ID NO: 2204529 - protein, 7 aa, Cryptosporidium hominis
RDQTKDP

SEQ ID NO: 2204530 - protein, 5 aa, Cryptosporidium hominis
RDVMS

SEQ ID NO: 2204531 - protein, 8 aa, Cryptosporidium hominis
RDYESNSI

SEQ ID NO: 2204532 - protein, 8 aa, Cryptosporidium hominis
RDYSGTSI

SEQ ID NO: 2204533 - protein, 5 aa, Cryptosporidium hominis
REAEG

SEQ ID NO: 2204534 - protein, 7 aa, Cryptosporidium hominis
REDFDSK

SEQ ID NO: 2204535 - protein, 9 aa, Cryptosporidium hominis
REDIGPRAA

SEQ ID NO: 2204536 - protein, 13 aa, Cryptosporidium hominis
REKAESRRRSANI

SEQ ID NO: 2204537 - protein, 15 aa, Cryptosporidium hominis
REKDYKEKKDGKSEN

SEQ ID NO: 2204538 - protein, 11 aa, Cryptosporidium hominis
REKSRSATEPL

SEQ ID NO: 2204539 - protein, 4 aa, Cryptosporidium hominis
RENE

SEQ ID NO: 2204540 - protein, 13 aa, Cryptosporidium hominis
RENKKTYTITIDK

SEQ ID NO: 2204541 - protein, 4 aa, Cryptosporidium hominis
REPE

SEQ ID NO: 2204542 - protein, 7 aa, Cryptosporidium hominis
REPEIPT

SEQ ID NO: 2204543 - protein, 5 aa, Cryptosporidium hominis
RERAY

SEQ ID NO: 2204544 - protein, 19 aa, Cryptosporidium hominis
RERDENLRNSITNIRTNLN

SEQ ID NO: 2204545 - protein, 17 aa, Cryptosporidium hominis
RERDKLESDLAQKRREY

SEQ ID NO: 2204546 - protein, 23 aa, Cryptosporidium hominis
RERRESSYSSETSLSSKEEEITK

SEQ ID NO: 2204547 - protein, 10 aa, Cryptosporidium hominis
RERTKTRERI

SEQ ID NO: 2204548 - protein, 6 aa, Cryptosporidium hominis
RESKSP

SEQ ID NO: 2204549 - protein, 5 aa, Cryptosporidium hominis
RETNA

SEQ ID NO: 2204550 - protein, 10 aa, Cryptosporidium hominis
RFGKKKGKVE

SEQ ID NO: 2204551 - protein, 10 aa, Cryptosporidium hominis
RFNGNDENIT

SEQ ID NO: 2204552 - protein, 10 aa, Cryptosporidium hominis
RFSQESEDLI

SEQ ID NO: 2204553 - protein, 9 aa, Cryptosporidium hominis
RGAEEESED

SEQ ID NO: 2204554 - protein, 15 aa, Cryptosporidium hominis
RGDLSNDQLRSNNGR

SEQ ID NO: 2204555 - protein, 6 aa, Cryptosporidium hominis
RGEGDC

SEQ ID NO: 2204556 - protein, 5 aa, Cryptosporidium hominis
RGELA

SEQ ID NO: 2204557 - protein, 5 aa, Cryptosporidium hominis
RGGFA

SEQ ID NO: 2204558 - protein, 24 aa, Cryptosporidium hominis
RGGIAKKSRITSRNSGDDPAYTPK

SEQ ID NO: 2204559 - protein, 11 aa, Cryptosporidium hominis
RGGPREKHPKT

SEQ ID NO: 2204560 - protein, 36 aa, Cryptosporidium hominis
RGHKGNSPHPDSEGDEADGLGSFGGAPLSSPRPSRR

SEQ ID NO: 2204561 - protein, 12 aa, Cryptosporidium hominis
RGKKPDNYGSNP

SEQ ID NO: 2204562 - protein, 7 aa, Cryptosporidium hominis
RGLTGGS

SEQ ID NO: 2204563 - protein, 45 aa, Cryptosporidium hominis
RGNRGGHSHSDPESDGESTGPFGGLAPRPPSPLKTIPRKTKLRKR

SEQ ID NO: 2204564 - protein, 4 aa, Cryptosporidium hominis
RGPD

SEQ ID NO: 2204565 - protein, 12 aa, Cryptosporidium hominis
RGPGCKTPCTKE

SEQ ID NO: 2204566 - protein, 12 aa, Cryptosporidium hominis
RGPKTRPSEIKQ

SEQ ID NO: 2204567 - protein, 10 aa, Cryptosporidium hominis
RGYAGTGGKV

SEQ ID NO: 2204568 - protein, 4 aa, Cryptosporidium hominis
RHEY

SEQ ID NO: 2204569 - protein, 5 aa, Cryptosporidium hominis
RHNPN

SEQ ID NO: 2204570 - protein, 87 aa, Cryptosporidium hominis
RHSSSSSSLSSSSSTSSSSYSSSSSSSEDEDEETNKSKESKKKRHRGRKTGKKSRSRSKSRSRSRFRSRSKSRSRSPSLVFQFDEEL

SEQ ID NO: 2204571 - protein, 9 aa, Cryptosporidium hominis
RIKDDQSQL

SEQ ID NO: 2204572 - protein, 10 aa, Cryptosporidium hominis
RIKKETNAIQ

SEQ ID NO: 2204573 - protein, 9 aa, Cryptosporidium hominis
RIPQPTTSN

SEQ ID NO: 2204574 - protein, 59 aa, Cryptosporidium hominis
RIQKTENKEYSSSELSSDAEQGKGVASRKHGKKGADRKKSRSDKKQKPKTNGKKKRLGL

SEQ ID NO: 2204575 - protein, 8 aa, Cryptosporidium hominis
RKAADTNS

SEQ ID NO: 2204576 - protein, 8 aa, Cryptosporidium hominis
RKALGSYK

SEQ ID NO: 2204577 - protein, 10 aa, Cryptosporidium hominis
RKDENKVVPS

SEQ ID NO: 2204578 - protein, 9 aa, Cryptosporidium hominis
RKENEKTGK

SEQ ID NO: 2204579 - protein, 7 aa, Cryptosporidium hominis
RKEPRRM

SEQ ID NO: 2204580 - protein, 13 aa, Cryptosporidium hominis
RKKDEFNKTMKPY

SEQ ID NO: 2204581 - protein, 6 aa, Cryptosporidium hominis
RKKDGE

SEQ ID NO: 2204582 - protein, 15 aa, Cryptosporidium hominis
RKKSIKDSIQNSNQD

SEQ ID NO: 2204583 - protein, 7 aa, Cryptosporidium hominis
RKLGENL

SEQ ID NO: 2204584 - protein, 11 aa, Cryptosporidium hominis
RKLKGKKKKLL

SEQ ID NO: 2204585 - protein, 5 aa, Cryptosporidium hominis
RKNGV

SEQ ID NO: 2204586 - protein, 8 aa, Cryptosporidium hominis
RKPKQSQV

SEQ ID NO: 2204587 - protein, 7 aa, Cryptosporidium hominis
RKPTTTV

SEQ ID NO: 2204588 - protein, 8 aa, Cryptosporidium hominis
RKQRKEGK

SEQ ID NO: 2204589 - protein, 7 aa, Cryptosporidium hominis
RKRRGIP

SEQ ID NO: 2204590 - protein, 12 aa, Cryptosporidium hominis
RKSKKKGSIPDQ

SEQ ID NO: 2204591 - protein, 10 aa, Cryptosporidium hominis
RKSKSKSISN

SEQ ID NO: 2204592 - protein, 6 aa, Cryptosporidium hominis
RKSREA

SEQ ID NO: 2204593 - protein, 11 aa, Cryptosporidium hominis
RKSSFGETGTE

SEQ ID NO: 2204594 - protein, 9 aa, Cryptosporidium hominis
RKTDEVKLP

SEQ ID NO: 2204595 - protein, 11 aa, Cryptosporidium hominis
RKTPQTKGRGS

SEQ ID NO: 2204596 - protein, 6 aa, Cryptosporidium hominis
RLKQEQ

SEQ ID NO: 2204597 - protein, 4 aa, Cryptosporidium hominis
RLNR

SEQ ID NO: 2204598 - protein, 22 aa, Cryptosporidium hominis
RLPLSSGGYDTSSSSSDEERYD

SEQ ID NO: 2204599 - protein, 9 aa, Cryptosporidium hominis
RLPTTKRKL

SEQ ID NO: 2204600 - protein, 4 aa, Cryptosporidium hominis
RLQE

SEQ ID NO: 2204601 - protein, 7 aa, Cryptosporidium hominis
RLTGGYN

SEQ ID NO: 2204602 - protein, 4 aa, Cryptosporidium hominis
RNAK

SEQ ID NO: 2204603 - protein, 29 aa, Cryptosporidium hominis
RNANENFKKQPEKKVEKKHNKIDSVKTGN

SEQ ID NO: 2204604 - protein, 9 aa, Cryptosporidium hominis
RNANENQIK

SEQ ID NO: 2204605 - protein, 11 aa, Cryptosporidium hominis
RNASLPASRTQ

SEQ ID NO: 2204606 - protein, 19 aa, Cryptosporidium hominis
RNASLPASRTQFQTDPNHG

SEQ ID NO: 2204607 - protein, 20 aa, Cryptosporidium hominis
RNDENAAFPASRTQYPANPN

SEQ ID NO: 2204608 - protein, 9 aa, Cryptosporidium hominis
RNEDSANQL

SEQ ID NO: 2204609 - protein, 7 aa, Cryptosporidium hominis
RNEFENA

SEQ ID NO: 2204610 - protein, 5 aa, Cryptosporidium hominis
RNETG

SEQ ID NO: 2204611 - protein, 11 aa, Cryptosporidium hominis
RNFNSENGDNN

SEQ ID NO: 2204612 - protein, 5 aa, Cryptosporidium hominis
RNGFR

SEQ ID NO: 2204613 - protein, 6 aa, Cryptosporidium hominis
RNGRNE

SEQ ID NO: 2204614 - protein, 5 aa, Cryptosporidium hominis
RNISP

SEQ ID NO: 2204615 - protein, 9 aa, Cryptosporidium hominis
RNPGENVNP

SEQ ID NO: 2204616 - protein, 5 aa, Cryptosporidium hominis
RNPVL

SEQ ID NO: 2204617 - protein, 8 aa, Cryptosporidium hominis
RNQDGTPL

SEQ ID NO: 2204618 - protein, 5 aa, Cryptosporidium hominis
RNQRK

SEQ ID NO: 2204619 - protein, 8 aa, Cryptosporidium hominis
RNRDEEKW

SEQ ID NO: 2204620 - protein, 5 aa, Cryptosporidium hominis
RNSIS

SEQ ID NO: 2204621 - protein, 12 aa, Cryptosporidium hominis
RNSQYKNNEAIK

SEQ ID NO: 2204622 - protein, 9 aa, Cryptosporidium hominis
RNSSSNKRS

SEQ ID NO: 2204623 - protein, 8 aa, Cryptosporidium hominis
RNSSTHTR

SEQ ID NO: 2204624 - protein, 37 aa, Cryptosporidium hominis
RNSTPDGSLSTRKSSLGSAPDETQKKDPLLTQQNHSS

SEQ ID NO: 2204625 - protein, 8 aa, Cryptosporidium hominis
RNSVEQKQ

SEQ ID NO: 2204626 - protein, 6 aa, Cryptosporidium hominis
RNSYRE

SEQ ID NO: 2204627 - protein, 16 aa, Cryptosporidium hominis
RNTAGNAENSYQPPNA

SEQ ID NO: 2204628 - protein, 12 aa, Cryptosporidium hominis
RNTEGSSEKKNI

SEQ ID NO: 2204629 - protein, 7 aa, Cryptosporidium hominis
RNTTTDG

SEQ ID NO: 2204630 - protein, 9 aa, Cryptosporidium hominis
RPAATVSPN

SEQ ID NO: 2204631 - protein, 5 aa, Cryptosporidium hominis
RPAMT

SEQ ID NO: 2204632 - protein, 153 aa, Cryptosporidium hominis
RPATTTTTRSTTTTTRSTTTTTRPTTTTTRSTTTTRPTTTTTRSTTTTTRPTTTTTRSTTTTTRSTTTTTRSTTTTTRSTTTTTRPTTTTTRPTTTTTTTTTTTSRPTTTTTTTTTRPTTTTTTTTTTTRYATTSLRTSTTTVSSPISTGPSR

SEQ ID NO: 2204633 - protein, 5 aa, Cryptosporidium hominis
RPDEA

SEQ ID NO: 2204634 - protein, 16 aa, Cryptosporidium hominis
RPDNTKDEDNEEFETK

SEQ ID NO: 2204635 - protein, 4 aa, Cryptosporidium hominis
RPED

SEQ ID NO: 2204636 - protein, 6 aa, Cryptosporidium hominis
RPERKL

SEQ ID NO: 2204637 - protein, 7 aa, Cryptosporidium hominis
RPESDPD

SEQ ID NO: 2204638 - protein, 6 aa, Cryptosporidium hominis
RPIPIG

SEQ ID NO: 2204639 - protein, 4 aa, Cryptosporidium hominis
RPLG

SEQ ID NO: 2204640 - protein, 7 aa, Cryptosporidium hominis
RPLNSRE

SEQ ID NO: 2204641 - protein, 13 aa, Cryptosporidium hominis
RPNDQISTGSAEY

SEQ ID NO: 2204642 - protein, 6 aa, Cryptosporidium hominis
RQGEAP

SEQ ID NO: 2204643 - protein, 5 aa, Cryptosporidium hominis
RQGSQ

SEQ ID NO: 2204644 - protein, 10 aa, Cryptosporidium hominis
RQGSTPEGKA

SEQ ID NO: 2204645 - protein, 12 aa, Cryptosporidium hominis
RQIGTTLEPSAG

SEQ ID NO: 2204646 - protein, 4 aa, Cryptosporidium hominis
RQLE

SEQ ID NO: 2204647 - protein, 7 aa, Cryptosporidium hominis
RQNGGCR

SEQ ID NO: 2204648 - protein, 15 aa, Cryptosporidium hominis
RRAEITAANPSLRSQ

SEQ ID NO: 2204649 - protein, 10 aa, Cryptosporidium hominis
RRATQNEKEF

SEQ ID NO: 2204650 - protein, 7 aa, Cryptosporidium hominis
RREPAEV

SEQ ID NO: 2204651 - protein, 12 aa, Cryptosporidium hominis
RRERSKQYVSNR

SEQ ID NO: 2204652 - protein, 8 aa, Cryptosporidium hominis
RRGNDPKT

SEQ ID NO: 2204653 - protein, 6 aa, Cryptosporidium hominis
RRGSTC

SEQ ID NO: 2204654 - protein, 7 aa, Cryptosporidium hominis
RRKLKGA

SEQ ID NO: 2204655 - protein, 6 aa, Cryptosporidium hominis
RRNGDN

SEQ ID NO: 2204656 - protein, 5 aa, Cryptosporidium hominis
RRNPK

SEQ ID NO: 2204657 - protein, 17 aa, Cryptosporidium hominis
RRNRKTKYSSEKNLYNN

SEQ ID NO: 2204658 - protein, 4 aa, Cryptosporidium hominis
RRRS

SEQ ID NO: 2204659 - protein, 7 aa, Cryptosporidium hominis
RRSTSLN

SEQ ID NO: 2204660 - protein, 10 aa, Cryptosporidium hominis
RRTSGKELNE

SEQ ID NO: 2204661 - protein, 11 aa, Cryptosporidium hominis
RRYGDSTVPLT

SEQ ID NO: 2204662 - protein, 14 aa, Cryptosporidium hominis
RSCPNTSATISSYT

SEQ ID NO: 2204663 - protein, 5 aa, Cryptosporidium hominis
RSDEL

SEQ ID NO: 2204664 - protein, 8 aa, Cryptosporidium hominis
RSDQAKKK

SEQ ID NO: 2204665 - protein, 5 aa, Cryptosporidium hominis
RSEEA

SEQ ID NO: 2204666 - protein, 6 aa, Cryptosporidium hominis
RSEISE

SEQ ID NO: 2204667 - protein, 5 aa, Cryptosporidium hominis
RSESN

SEQ ID NO: 2204668 - protein, 7 aa, Cryptosporidium hominis
RSFGPNE

SEQ ID NO: 2204669 - protein, 5 aa, Cryptosporidium hominis
RSGDM

SEQ ID NO: 2204670 - protein, 4 aa, Cryptosporidium hominis
RSGL

SEQ ID NO: 2204671 - protein, 7 aa, Cryptosporidium hominis
RSGLRKK

SEQ ID NO: 2204672 - protein, 9 aa, Cryptosporidium hominis
RSGSVPGNT

SEQ ID NO: 2204673 - protein, 7 aa, Cryptosporidium hominis
RSKEPNE

SEQ ID NO: 2204674 - protein, 4 aa, Cryptosporidium hominis
RSKR

SEQ ID NO: 2204675 - protein, 17 aa, Cryptosporidium hominis
RSKTSSRNRLNEPGIDP

SEQ ID NO: 2204676 - protein, 8 aa, Cryptosporidium hominis
RSNGGDEF

SEQ ID NO: 2204677 - protein, 35 aa, Cryptosporidium hominis
RSNLDEPTSNDDDKLSSGDETRNINDSQNNGELEI

SEQ ID NO: 2204678 - protein, 8 aa, Cryptosporidium hominis
RSNPSKAL

SEQ ID NO: 2204679 - protein, 16 aa, Cryptosporidium hominis
RSRGSNEQQTDNEVTG

SEQ ID NO: 2204680 - protein, 4 aa, Cryptosporidium hominis
RSSC

SEQ ID NO: 2204681 - protein, 8 aa, Cryptosporidium hominis
RSSDSDSE

SEQ ID NO: 2204682 - protein, 8 aa, Cryptosporidium hominis
RSSEREDQ

SEQ ID NO: 2204683 - protein, 4 aa, Cryptosporidium hominis
RSSL

SEQ ID NO: 2204684 - protein, 7 aa, Cryptosporidium hominis
RSSLKEV

SEQ ID NO: 2204685 - protein, 7 aa, Cryptosporidium hominis
RSTAWNA

SEQ ID NO: 2204686 - protein, 5 aa, Cryptosporidium hominis
RSYET

SEQ ID NO: 2204687 - protein, 4 aa, Cryptosporidium hominis
RTAY

SEQ ID NO: 2204688 - protein, 9 aa, Cryptosporidium hominis
RTENNERVE

SEQ ID NO: 2204689 - protein, 4 aa, Cryptosporidium hominis
RTGL

SEQ ID NO: 2204690 - protein, 6 aa, Cryptosporidium hominis
RTLPRN

SEQ ID NO: 2204691 - protein, 4 aa, Cryptosporidium hominis
RTNL

SEQ ID NO: 2204692 - protein, 5 aa, Cryptosporidium hominis
RTNQG

SEQ ID NO: 2204693 - protein, 15 aa, Cryptosporidium hominis
RTPELYPKPNPPERY

SEQ ID NO: 2204694 - protein, 19 aa, Cryptosporidium hominis
RTPYIPPKAQKALEGSKGI

SEQ ID NO: 2204695 - protein, 13 aa, Cryptosporidium hominis
RTQREKLSNLSAS

SEQ ID NO: 2204696 - protein, 11 aa, Cryptosporidium hominis
RTQRGPSDWGY

SEQ ID NO: 2204697 - protein, 11 aa, Cryptosporidium hominis
RTQSSPQLDNS

SEQ ID NO: 2204698 - protein, 64 aa, Cryptosporidium hominis
RTRNSGSRRKQKSHKKNSIKNRNLSKYKSSSSSNTNKSKRHKTALSKHTANERRLSRANSAKNM

SEQ ID NO: 2204699 - protein, 12 aa, Cryptosporidium hominis
RTSATAGKVSPR

SEQ ID NO: 2204700 - protein, 10 aa, Cryptosporidium hominis
RTSENASKAF

SEQ ID NO: 2204701 - protein, 10 aa, Cryptosporidium hominis
RTSKDYQPFK

SEQ ID NO: 2204702 - protein, 11 aa, Cryptosporidium hominis
RTSNKKETTSS

SEQ ID NO: 2204703 - protein, 10 aa, Cryptosporidium hominis
RTSQTPSTVP

SEQ ID NO: 2204704 - protein, 6 aa, Cryptosporidium hominis
RTTNQP

SEQ ID NO: 2204705 - protein, 4 aa, Cryptosporidium hominis
RVEN

SEQ ID NO: 2204706 - protein, 4 aa, Cryptosporidium hominis
RVEP

SEQ ID NO: 2204707 - protein, 33 aa, Cryptosporidium hominis
RVSGTKKSSLGNKARDSESKMAGGSSGHSKRGA

SEQ ID NO: 2204708 - protein, 9 aa, Cryptosporidium hominis
RVTTKDRVP

SEQ ID NO: 2204709 - protein, 5 aa, Cryptosporidium hominis
RYGRH

SEQ ID NO: 2204710 - protein, 9 aa, Cryptosporidium hominis
RYLSESQKS

SEQ ID NO: 2204711 - protein, 17 aa, Cryptosporidium hominis
SAAFPASRTSFPADPKH

SEQ ID NO: 2204712 - protein, 4 aa, Cryptosporidium hominis
SAAI

SEQ ID NO: 2204713 - protein, 15 aa, Cryptosporidium hominis
SAATNEFNEETQKLK

SEQ ID NO: 2204714 - protein, 11 aa, Cryptosporidium hominis
SADDDDDDDDV

SEQ ID NO: 2204715 - protein, 10 aa, Cryptosporidium hominis
SADETTPNER

SEQ ID NO: 2204716 - protein, 41 aa, Cryptosporidium hominis
SAEESNIIGDDDGKSESEDEEEFGDNKNTRNIQSTKKEEKI

SEQ ID NO: 2204717 - protein, 6 aa, Cryptosporidium hominis
SAEKLS

SEQ ID NO: 2204718 - protein, 10 aa, Cryptosporidium hominis
SAELNDENSA

SEQ ID NO: 2204719 - protein, 6 aa, Cryptosporidium hominis
SAGDGR

SEQ ID NO: 2204720 - protein, 10 aa, Cryptosporidium hominis
SAGEIKDKIK

SEQ ID NO: 2204721 - protein, 6 aa, Cryptosporidium hominis
SAGESI

SEQ ID NO: 2204722 - protein, 4 aa, Cryptosporidium hominis
SAHD

SEQ ID NO: 2204723 - protein, 5 aa, Cryptosporidium hominis
SAHQK

SEQ ID NO: 2204724 - protein, 97 aa, Cryptosporidium hominis
SAIPPPPSFSPPPPPIPPPPPPIPSPPSPIPSSPSPIPSPPSSPPPPPPKPEYPPPSSPIPSPPSSPPPPPPKPEYPPPSSPIPTLPPSSPPTPPMP

SEQ ID NO: 2204725 - protein, 8 aa, Cryptosporidium hominis
SALGSKTI

SEQ ID NO: 2204726 - protein, 6 aa, Cryptosporidium hominis
SALNKK

SEQ ID NO: 2204727 - protein, 9 aa, Cryptosporidium hominis
SALSTKSNE

SEQ ID NO: 2204728 - protein, 9 aa, Cryptosporidium hominis
SANNQTEQS

SEQ ID NO: 2204729 - protein, 4 aa, Cryptosporidium hominis
SAPP

SEQ ID NO: 2204730 - protein, 21 aa, Cryptosporidium hominis
SAQDSFSAQKQISKDSASEKM

SEQ ID NO: 2204731 - protein, 6 aa, Cryptosporidium hominis
SAQEQF

SEQ ID NO: 2204732 - protein, 16 aa, Cryptosporidium hominis
SAQTGRLRSKNPSESS

SEQ ID NO: 2204733 - protein, 7 aa, Cryptosporidium hominis
SARTPQI

SEQ ID NO: 2204734 - protein, 5 aa, Cryptosporidium hominis
SARVP

SEQ ID NO: 2204735 - protein, 5 aa, Cryptosporidium hominis
SASEA

SEQ ID NO: 2204736 - protein, 18 aa, Cryptosporidium hominis
SASESSENGKIQGIDSPA

SEQ ID NO: 2204737 - protein, 13 aa, Cryptosporidium hominis
SASFPSAADPTIK

SEQ ID NO: 2204738 - protein, 5 aa, Cryptosporidium hominis
SASGF

SEQ ID NO: 2204739 - protein, 51 aa, Cryptosporidium hominis
SASNDSPRKASEVLESSTGLSTQNENKDAHLQETTSLDTELSNTAASFQSE

SEQ ID NO: 2204740 - protein, 19 aa, Cryptosporidium hominis
SASNQEVGSSINHAESRKL

SEQ ID NO: 2204741 - protein, 10 aa, Cryptosporidium hominis
SASPLAKGVD

SEQ ID NO: 2204742 - protein, 13 aa, Cryptosporidium hominis
SASSDLQNAPTVR

SEQ ID NO: 2204743 - protein, 9 aa, Cryptosporidium hominis
SATCGGKKC

SEQ ID NO: 2204744 - protein, 6 aa, Cryptosporidium hominis
SATLTG

SEQ ID NO: 2204745 - protein, 9 aa, Cryptosporidium hominis
SATPRDNSE

SEQ ID NO: 2204746 - protein, 27 aa, Cryptosporidium hominis
SAVGKTNHQDSPQLKPKSKRKPLTRKG

SEQ ID NO: 2204747 - protein, 37 aa, Cryptosporidium hominis
SAVGSTSGSGQLPPNERKRKLSSDERDSSSSGHRPSR

SEQ ID NO: 2204748 - protein, 12 aa, Cryptosporidium hominis
SAVTADPTSSTK

SEQ ID NO: 2204749 - protein, 23 aa, Cryptosporidium hominis
SAYPNDSSFEADHKYETSQFSQG

SEQ ID NO: 2204750 - protein, 24 aa, Cryptosporidium hominis
SCDSDSEDELNSSTNTSQEQGHSN

SEQ ID NO: 2204751 - protein, 27 aa, Cryptosporidium hominis
SCSSDDSCCSSSSNSGSLNIGDPTQPR

SEQ ID NO: 2204752 - protein, 21 aa, Cryptosporidium hominis
SCSSSNKKKKEKKQVNGNEMS

SEQ ID NO: 2204753 - protein, 33 aa, Cryptosporidium hominis
SCSSSNKKKSKNEKKDKKQKKGKDEKNKKEEKL

SEQ ID NO: 2204754 - protein, 5 aa, Cryptosporidium hominis
SDAEY

SEQ ID NO: 2204755 - protein, 6 aa, Cryptosporidium hominis
SDANYN

SEQ ID NO: 2204756 - protein, 8 aa, Cryptosporidium hominis
SDAPNYEE

SEQ ID NO: 2204757 - protein, 4 aa, Cryptosporidium hominis
SDAT

SEQ ID NO: 2204758 - protein, 43 aa, Cryptosporidium hominis
SDDDEEQDKGTGSRKSHKKHKAKRENKSQSETVSEREKKISKR

SEQ ID NO: 2204759 - protein, 27 aa, Cryptosporidium hominis
SDDPNFQRRNSISTDLSGVSDDSAQNN

SEQ ID NO: 2204760 - protein, 7 aa, Cryptosporidium hominis
SDDPSNS

SEQ ID NO: 2204761 - protein, 6 aa, Cryptosporidium hominis
SDDYSS

SEQ ID NO: 2204762 - protein, 8 aa, Cryptosporidium hominis
SDEAKEDL

SEQ ID NO: 2204763 - protein, 7 aa, Cryptosporidium hominis
SDEERNE

SEQ ID NO: 2204764 - protein, 6 aa, Cryptosporidium hominis
SDEFSS

SEQ ID NO: 2204765 - protein, 5 aa, Cryptosporidium hominis
SDEGM

SEQ ID NO: 2204766 - protein, 15 aa, Cryptosporidium hominis
SDESEQHKDLSPVGE

SEQ ID NO: 2204767 - protein, 9 aa, Cryptosporidium hominis
SDFADADAA

SEQ ID NO: 2204768 - protein, 39 aa, Cryptosporidium hominis
SDFSPSSSNESSEPEQNIDESQQEKEIVSEESKSAPAPV

SEQ ID NO: 2204769 - protein, 11 aa, Cryptosporidium hominis
SDGENNSVDGL

SEQ ID NO: 2204770 - protein, 13 aa, Cryptosporidium hominis
SDGKAYSKRTRPI

SEQ ID NO: 2204771 - protein, 5 aa, Cryptosporidium hominis
SDGKT

SEQ ID NO: 2204772 - protein, 8 aa, Cryptosporidium hominis
SDGKTYDN

SEQ ID NO: 2204773 - protein, 9 aa, Cryptosporidium hominis
SDGKTYSNI

SEQ ID NO: 2204774 - protein, 7 aa, Cryptosporidium hominis
SDGSVEE

SEQ ID NO: 2204775 - protein, 7 aa, Cryptosporidium hominis
SDHAGKP

SEQ ID NO: 2204776 - protein, 17 aa, Cryptosporidium hominis
SDIENQTDIETTDDETN

SEQ ID NO: 2204777 - protein, 14 aa, Cryptosporidium hominis
SDIQGESEDSLNEE

SEQ ID NO: 2204778 - protein, 9 aa, Cryptosporidium hominis
SDKDSDQTL

SEQ ID NO: 2204779 - protein, 9 aa, Cryptosporidium hominis
SDKLSSKEI

SEQ ID NO: 2204780 - protein, 7 aa, Cryptosporidium hominis
SDKNQKV

SEQ ID NO: 2204781 - protein, 9 aa, Cryptosporidium hominis
SDKSDDLRG

SEQ ID NO: 2204782 - protein, 11 aa, Cryptosporidium hominis
SDKSRKPVSPY

SEQ ID NO: 2204783 - protein, 11 aa, Cryptosporidium hominis
SDLNNSTQKAT

SEQ ID NO: 2204784 - protein, 5 aa, Cryptosporidium hominis
SDLPP

SEQ ID NO: 2204785 - protein, 9 aa, Cryptosporidium hominis
SDLPSSPEE

SEQ ID NO: 2204786 - protein, 6 aa, Cryptosporidium hominis
SDLSTT

SEQ ID NO: 2204787 - protein, 8 aa, Cryptosporidium hominis
SDMGKSIP

SEQ ID NO: 2204788 - protein, 7 aa, Cryptosporidium hominis
SDNKAVE

SEQ ID NO: 2204789 - protein, 7 aa, Cryptosporidium hominis
SDNPSYI

SEQ ID NO: 2204790 - protein, 6 aa, Cryptosporidium hominis
SDNRDF

SEQ ID NO: 2204791 - protein, 4 aa, Cryptosporidium hominis
SDNS

SEQ ID NO: 2204792 - protein, 18 aa, Cryptosporidium hominis
SDPASNQIGNTESHTEDL

SEQ ID NO: 2204793 - protein, 6 aa, Cryptosporidium hominis
SDPEDN

SEQ ID NO: 2204794 - protein, 6 aa, Cryptosporidium hominis
SDPEPK

SEQ ID NO: 2204795 - protein, 7 aa, Cryptosporidium hominis
SDPKYGG

SEQ ID NO: 2204796 - protein, 10 aa, Cryptosporidium hominis
SDPKYSNSPF

SEQ ID NO: 2204797 - protein, 9 aa, Cryptosporidium hominis
SDPNLNPKA

SEQ ID NO: 2204798 - protein, 6 aa, Cryptosporidium hominis
SDPSNA

SEQ ID NO: 2204799 - protein, 8 aa, Cryptosporidium hominis
SDPVVSSS

SEQ ID NO: 2204800 - protein, 7 aa, Cryptosporidium hominis
SDQNFNG

SEQ ID NO: 2204801 - protein, 5 aa, Cryptosporidium hominis
SDQNR

SEQ ID NO: 2204802 - protein, 16 aa, Cryptosporidium hominis
SDSGAVSNPTKQQNKF

SEQ ID NO: 2204803 - protein, 4 aa, Cryptosporidium hominis
SDSK

SEQ ID NO: 2204804 - protein, 8 aa, Cryptosporidium hominis
SDSKGSFN

SEQ ID NO: 2204805 - protein, 9 aa, Cryptosporidium hominis
SDSNGSAPT

SEQ ID NO: 2204806 - protein, 8 aa, Cryptosporidium hominis
SDSNKNKD

SEQ ID NO: 2204807 - protein, 7 aa, Cryptosporidium hominis
SDSSEFD

SEQ ID NO: 2204808 - protein, 45 aa, Cryptosporidium hominis
SDSSIEDYSSGQSHISESGRSSPADNNVESRANTDEYESSTEENL

SEQ ID NO: 2204809 - protein, 7 aa, Cryptosporidium hominis
SDSVPED

SEQ ID NO: 2204810 - protein, 4 aa, Cryptosporidium hominis
SDTA

SEQ ID NO: 2204811 - protein, 11 aa, Cryptosporidium hominis
SDTEKEQSVKE

SEQ ID NO: 2204812 - protein, 7 aa, Cryptosporidium hominis
SDTPGKI

SEQ ID NO: 2204813 - protein, 34 aa, Cryptosporidium hominis
SDTSTSASSDGINIDASKNSGYGAEQATSKNKQG

SEQ ID NO: 2204814 - protein, 10 aa, Cryptosporidium hominis
SDTVSTSYAP

SEQ ID NO: 2204815 - protein, 11 aa, Cryptosporidium hominis
SDVAGKEFETG

SEQ ID NO: 2204816 - protein, 22 aa, Cryptosporidium hominis
SEADNLQASGSASGSASGPALE

SEQ ID NO: 2204817 - protein, 8 aa, Cryptosporidium hominis
SEAEDAKE

SEQ ID NO: 2204818 - protein, 4 aa, Cryptosporidium hominis
SEAL

SEQ ID NO: 2204819 - protein, 9 aa, Cryptosporidium hominis
SEAPSRLKT

SEQ ID NO: 2204820 - protein, 10 aa, Cryptosporidium hominis
SEASNNSTDF

SEQ ID NO: 2204821 - protein, 4 aa, Cryptosporidium hominis
SEDS

SEQ ID NO: 2204822 - protein, 6 aa, Cryptosporidium hominis
SEDYDG

SEQ ID NO: 2204823 - protein, 9 aa, Cryptosporidium hominis
SEEDEDDYY

SEQ ID NO: 2204824 - protein, 12 aa, Cryptosporidium hominis
SEEELKSKDLQE

SEQ ID NO: 2204825 - protein, 6 aa, Cryptosporidium hominis
SEEFDS

SEQ ID NO: 2204826 - protein, 17 aa, Cryptosporidium hominis
SEENASFASGKDSKEVK

SEQ ID NO: 2204827 - protein, 14 aa, Cryptosporidium hominis
SEEPPSEEDNDGPV

SEQ ID NO: 2204828 - protein, 32 aa, Cryptosporidium hominis
SEESGRSSEYVGGEEQKTAVPEQSEVEESNRE

SEQ ID NO: 2204829 - protein, 4 aa, Cryptosporidium hominis
SEFQ

SEQ ID NO: 2204830 - protein, 9 aa, Cryptosporidium hominis
SEGEIDDGT

SEQ ID NO: 2204831 - protein, 5 aa, Cryptosporidium hominis
SEGKC

SEQ ID NO: 2204832 - protein, 7 aa, Cryptosporidium hominis
SEGKHEL

SEQ ID NO: 2204833 - protein, 8 aa, Cryptosporidium hominis
SEGNPEGQ

SEQ ID NO: 2204834 - protein, 9 aa, Cryptosporidium hominis
SEGPSEELD

SEQ ID NO: 2204835 - protein, 13 aa, Cryptosporidium hominis
SEGQSQYYSGLPN

SEQ ID NO: 2204836 - protein, 6 aa, Cryptosporidium hominis
SEGSGI

SEQ ID NO: 2204837 - protein, 6 aa, Cryptosporidium hominis
SEHSSH

SEQ ID NO: 2204838 - protein, 9 aa, Cryptosporidium hominis
SEIGENGGI

SEQ ID NO: 2204839 - protein, 10 aa, Cryptosporidium hominis
SEIPNNENSR

SEQ ID NO: 2204840 - protein, 27 aa, Cryptosporidium hominis
SEISESNQYDLENENISKRPEGATSIP

SEQ ID NO: 2204841 - protein, 17 aa, Cryptosporidium hominis
SEKRSLPSIRGTKTDTL

SEQ ID NO: 2204842 - protein, 4 aa, Cryptosporidium hominis
SEKS

SEQ ID NO: 2204843 - protein, 6 aa, Cryptosporidium hominis
SEKTVE

SEQ ID NO: 2204844 - protein, 17 aa, Cryptosporidium hominis
SELNDAQKQLIRQAILD

SEQ ID NO: 2204845 - protein, 10 aa, Cryptosporidium hominis
SELSQTEKEF

SEQ ID NO: 2204846 - protein, 8 aa, Cryptosporidium hominis
SENEASQL

SEQ ID NO: 2204847 - protein, 5 aa, Cryptosporidium hominis
SENEV

SEQ ID NO: 2204848 - protein, 36 aa, Cryptosporidium hominis
SENGKVCEPREEKSKVELSRQNSFSNQGNQKNNQLN

SEQ ID NO: 2204849 - protein, 15 aa, Cryptosporidium hominis
SENGLDNEQNNKFKS

SEQ ID NO: 2204850 - protein, 7 aa, Cryptosporidium hominis
SENGRPI

SEQ ID NO: 2204851 - protein, 8 aa, Cryptosporidium hominis
SENISKSM

SEQ ID NO: 2204852 - protein, 4 aa, Cryptosporidium hominis
SENS

SEQ ID NO: 2204853 - protein, 31 aa, Cryptosporidium hominis
SENSGIPESKNDNNNNNNNNNNNKQNNNIDS

SEQ ID NO: 2204854 - protein, 6 aa, Cryptosporidium hominis
SENSMV

SEQ ID NO: 2204855 - protein, 6 aa, Cryptosporidium hominis
SENTET

SEQ ID NO: 2204856 - protein, 5 aa, Cryptosporidium hominis
SEPAN

SEQ ID NO: 2204857 - protein, 12 aa, Cryptosporidium hominis
SEPIPAEQSGPV

SEQ ID NO: 2204858 - protein, 12 aa, Cryptosporidium hominis
SEPLSTAKHSSQ

SEQ ID NO: 2204859 - protein, 9 aa, Cryptosporidium hominis
SEQSRNEKP

SEQ ID NO: 2204860 - protein, 7 aa, Cryptosporidium hominis
SESDEKM

SEQ ID NO: 2204861 - protein, 6 aa, Cryptosporidium hominis
SESDGF

SEQ ID NO: 2204862 - protein, 5 aa, Cryptosporidium hominis
SESFN

SEQ ID NO: 2204863 - protein, 20 aa, Cryptosporidium hominis
SESIDEYQNNNASQEVESTG

SEQ ID NO: 2204864 - protein, 6 aa, Cryptosporidium hominis
SESKFE

SEQ ID NO: 2204865 - protein, 23 aa, Cryptosporidium hominis
SESPLEGGDTGSLGNSSKKEIVP

SEQ ID NO: 2204866 - protein, 7 aa, Cryptosporidium hominis
SESTSAA

SEQ ID NO: 2204867 - protein, 10 aa, Cryptosporidium hominis
SESTSSVDQL

SEQ ID NO: 2204868 - protein, 9 aa, Cryptosporidium hominis
SETKARDAK

SEQ ID NO: 2204869 - protein, 15 aa, Cryptosporidium hominis
SETLPKIDSNYTTDG

SEQ ID NO: 2204870 - protein, 9 aa, Cryptosporidium hominis
SETLQNGAS

SEQ ID NO: 2204871 - protein, 82 aa, Cryptosporidium hominis
SETQRSIRSPTTTTTTTTTTTTTTTTTTTTTTTTTTTTTTTTTTTTTTTTTTTTTTTTTTTTTTTTTTTTTTSTTTSTTTKS

SEQ ID NO: 2204872 - protein, 4 aa, Cryptosporidium hominis
SETR

SEQ ID NO: 2204873 - protein, 6 aa, Cryptosporidium hominis
SEYNEN

SEQ ID NO: 2204874 - protein, 6 aa, Cryptosporidium hominis
SFDSKY

SEQ ID NO: 2204875 - protein, 5 aa, Cryptosporidium hominis
SFEST

SEQ ID NO: 2204876 - protein, 5 aa, Cryptosporidium hominis
SFNSN

SEQ ID NO: 2204877 - protein, 12 aa, Cryptosporidium hominis
SFSAPNRECPAG

SEQ ID NO: 2204878 - protein, 9 aa, Cryptosporidium hominis
SFSDGGKSK

SEQ ID NO: 2204879 - protein, 14 aa, Cryptosporidium hominis
SFSGAAPATPPSGV

SEQ ID NO: 2204880 - protein, 9 aa, Cryptosporidium hominis
SFSGEESPL

SEQ ID NO: 2204881 - protein, 8 aa, Cryptosporidium hominis
SFSTSSPS

SEQ ID NO: 2204882 - protein, 14 aa, Cryptosporidium hominis
SFTPGPKTTSTESS

SEQ ID NO: 2204883 - protein, 10 aa, Cryptosporidium hominis
SFTSEQARAL

SEQ ID NO: 2204884 - protein, 13 aa, Cryptosporidium hominis
SFTSSSSSFSSSY

SEQ ID NO: 2204885 - protein, 9 aa, Cryptosporidium hominis
SGATSATDE

SEQ ID NO: 2204886 - protein, 10 aa, Cryptosporidium hominis
SGCETNESGY

SEQ ID NO: 2204887 - protein, 6 aa, Cryptosporidium hominis
SGDEDM

SEQ ID NO: 2204888 - protein, 9 aa, Cryptosporidium hominis
SGDKDDSEI

SEQ ID NO: 2204889 - protein, 16 aa, Cryptosporidium hominis
SGDTLNKENFSSPQAE

SEQ ID NO: 2204890 - protein, 9 aa, Cryptosporidium hominis
SGEAGQSDK

SEQ ID NO: 2204891 - protein, 6 aa, Cryptosporidium hominis
SGEFEK

SEQ ID NO: 2204892 - protein, 9 aa, Cryptosporidium hominis
SGEHGDNSD

SEQ ID NO: 2204893 - protein, 10 aa, Cryptosporidium hominis
SGEPENPTLP

SEQ ID NO: 2204894 - protein, 7 aa, Cryptosporidium hominis
SGFPGSS

SEQ ID NO: 2204895 - protein, 6 aa, Cryptosporidium hominis
SGGEAS

SEQ ID NO: 2204896 - protein, 10 aa, Cryptosporidium hominis
SGGIKDAAPL

SEQ ID NO: 2204897 - protein, 6 aa, Cryptosporidium hominis
SGGNTQ

SEQ ID NO: 2204898 - protein, 13 aa, Cryptosporidium hominis
SGGQATEEEQRRL

SEQ ID NO: 2204899 - protein, 7 aa, Cryptosporidium hominis
SGGSFET

SEQ ID NO: 2204900 - protein, 6 aa, Cryptosporidium hominis
SGHREH

SEQ ID NO: 2204901 - protein, 8 aa, Cryptosporidium hominis
SGKASRIK

SEQ ID NO: 2204902 - protein, 9 aa, Cryptosporidium hominis
SGKDEELCG

SEQ ID NO: 2204903 - protein, 10 aa, Cryptosporidium hominis
SGKEQPTASD

SEQ ID NO: 2204904 - protein, 12 aa, Cryptosporidium hominis
SGLGDMDDKGGS

SEQ ID NO: 2204905 - protein, 7 aa, Cryptosporidium hominis
SGLNSQE

SEQ ID NO: 2204906 - protein, 10 aa, Cryptosporidium hominis
SGLSSTNQGV

SEQ ID NO: 2204907 - protein, 11 aa, Cryptosporidium hominis
SGLSTSDPRVE

SEQ ID NO: 2204908 - protein, 31 aa, Cryptosporidium hominis
SGNAPTSDDDNESETRSQNTPTITTSSQSIE

SEQ ID NO: 2204909 - protein, 8 aa, Cryptosporidium hominis
SGNEPDLR

SEQ ID NO: 2204910 - protein, 8 aa, Cryptosporidium hominis
SGNSETII

SEQ ID NO: 2204911 - protein, 8 aa, Cryptosporidium hominis
SGPASWSK

SEQ ID NO: 2204912 - protein, 9 aa, Cryptosporidium hominis
SGPLSKSIS

SEQ ID NO: 2204913 - protein, 13 aa, Cryptosporidium hominis
SGPSSTSIGANSA

SEQ ID NO: 2204914 - protein, 6 aa, Cryptosporidium hominis
SGQDEM

SEQ ID NO: 2204915 - protein, 6 aa, Cryptosporidium hominis
SGQPPY

SEQ ID NO: 2204916 - protein, 17 aa, Cryptosporidium hominis
SGQRKSKSTSSARTKLR

SEQ ID NO: 2204917 - protein, 10 aa, Cryptosporidium hominis
SGQSNRYEST

SEQ ID NO: 2204918 - protein, 9 aa, Cryptosporidium hominis
SGRVAGPDK

SEQ ID NO: 2204919 - protein, 23 aa, Cryptosporidium hominis
SGSDNNQKQDQNDGNTERGASEA

SEQ ID NO: 2204920 - protein, 10 aa, Cryptosporidium hominis
SGSDSSQIAE

SEQ ID NO: 2204921 - protein, 7 aa, Cryptosporidium hominis
SGSFSKK

SEQ ID NO: 2204922 - protein, 21 aa, Cryptosporidium hominis
SGSGDPTGNGAYLSEKSPSIL

SEQ ID NO: 2204923 - protein, 9 aa, Cryptosporidium hominis
SGSKDKRYA

SEQ ID NO: 2204924 - protein, 9 aa, Cryptosporidium hominis
SGSKGKEIS

SEQ ID NO: 2204925 - protein, 22 aa, Cryptosporidium hominis
SGSLSDKMAQKNNKKNVSTKVS

SEQ ID NO: 2204926 - protein, 9 aa, Cryptosporidium hominis
SGSNKGPWQ

SEQ ID NO: 2204927 - protein, 13 aa, Cryptosporidium hominis
SGSNPIKGRNDSI

SEQ ID NO: 2204928 - protein, 8 aa, Cryptosporidium hominis
SGSQITPS

SEQ ID NO: 2204929 - protein, 151 aa, Cryptosporidium hominis
SGSSKPSAGGGLTKRSGSGTTKSSTGLGAGPKSSPLTRASQPKTKSGATRARSKSRSRSRSRDRFSGGRRSLESTEPGCSGETGDKGGSGEGRSSGGSSGGASGGASGGTSGGASGGGEGGSGESGAYGGSGSGSGDDKGDKGNQPGRGRY

SEQ ID NO: 2204930 - protein, 6 aa, Cryptosporidium hominis
SGSSQI

SEQ ID NO: 2204931 - protein, 6 aa, Cryptosporidium hominis
SGSSSD

SEQ ID NO: 2204932 - protein, 6 aa, Cryptosporidium hominis
SGSTNK

SEQ ID NO: 2204933 - protein, 4 aa, Cryptosporidium hominis
SGTE

SEQ ID NO: 2204934 - protein, 14 aa, Cryptosporidium hominis
SGTGFEDDSEISRV

SEQ ID NO: 2204935 - protein, 6 aa, Cryptosporidium hominis
SGTINQ

SEQ ID NO: 2204936 - protein, 46 aa, Cryptosporidium hominis
SGTPSHTLTQKDENLTSDPKMSTLGHQGSSKSSEPKSKRKPLTKKE

SEQ ID NO: 2204937 - protein, 4 aa, Cryptosporidium hominis
SGTS

SEQ ID NO: 2204938 - protein, 11 aa, Cryptosporidium hominis
SGTTVKDGEIE

SEQ ID NO: 2204939 - protein, 18 aa, Cryptosporidium hominis
SGVGSKEDIQISSPGIKN

SEQ ID NO: 2204940 - protein, 17 aa, Cryptosporidium hominis
SGYGQSKVQSSTGTFPI

SEQ ID NO: 2204941 - protein, 6 aa, Cryptosporidium hominis
SGYSRG

SEQ ID NO: 2204942 - protein, 9 aa, Cryptosporidium hominis
SHASQASGE

SEQ ID NO: 2204943 - protein, 5 aa, Cryptosporidium hominis
SHGNS

SEQ ID NO: 2204944 - protein, 16 aa, Cryptosporidium hominis
SHQNPSSKIQRTSEDI

SEQ ID NO: 2204945 - protein, 10 aa, Cryptosporidium hominis
SHRNPKREKG

SEQ ID NO: 2204946 - protein, 34 aa, Cryptosporidium hominis
SHSEEVPAPSNSTELVSSEDPVSDTQEQTSTNET

SEQ ID NO: 2204947 - protein, 7 aa, Cryptosporidium hominis
SHSHEKK

SEQ ID NO: 2204948 - protein, 8 aa, Cryptosporidium hominis
SHSSTTTY

SEQ ID NO: 2204949 - protein, 11 aa, Cryptosporidium hominis
SHYNNTSPGYP

SEQ ID NO: 2204950 - protein, 9 aa, Cryptosporidium hominis
SIADSTREF

SEQ ID NO: 2204951 - protein, 67 aa, Cryptosporidium hominis
SIAPGEDTPIPSSIESSLQTEQSLGKGERSTSNPLENSVSSAASFSTTENSKSEKGDSSVGSIFEGS

SEQ ID NO: 2204952 - protein, 13 aa, Cryptosporidium hominis
SIEASNSPGIDDV

SEQ ID NO: 2204953 - protein, 14 aa, Cryptosporidium hominis
SIENPSSISNEKFE

SEQ ID NO: 2204954 - protein, 28 aa, Cryptosporidium hominis
SIETGNKTAIQSKASRPPSISSSPKRLE

SEQ ID NO: 2204955 - protein, 25 aa, Cryptosporidium hominis
SIGGRSGNVNMQKKETKKSPTNNEI

SEQ ID NO: 2204956 - protein, 4 aa, Cryptosporidium hominis
SIGN

SEQ ID NO: 2204957 - protein, 7 aa, Cryptosporidium hominis
SIKEEQD

SEQ ID NO: 2204958 - protein, 43 aa, Cryptosporidium hominis
SIKETAEKMNKKIKESRERRNQSHRSRGFSSSSSLSSSSGSLF

SEQ ID NO: 2204959 - protein, 12 aa, Cryptosporidium hominis
SIKKGTKDIDRE

SEQ ID NO: 2204960 - protein, 17 aa, Cryptosporidium hominis
SINDSYRTQNDEIDSLQ

SEQ ID NO: 2204961 - protein, 6 aa, Cryptosporidium hominis
SINPAD

SEQ ID NO: 2204962 - protein, 6 aa, Cryptosporidium hominis
SINTSN

SEQ ID NO: 2204963 - protein, 25 aa, Cryptosporidium hominis
SIPDDESENEQVKSTKKTKKRKGPL

SEQ ID NO: 2204964 - protein, 25 aa, Cryptosporidium hominis
SIPEKSELDTDVSDEETNKDNDFSE

SEQ ID NO: 2204965 - protein, 6 aa, Cryptosporidium hominis
SIPNDH

SEQ ID NO: 2204966 - protein, 5 aa, Cryptosporidium hominis
SIPNP

SEQ ID NO: 2204967 - protein, 7 aa, Cryptosporidium hominis
SIPSVGS

SEQ ID NO: 2204968 - protein, 15 aa, Cryptosporidium hominis
SIPTHDEKGRPLPDD

SEQ ID NO: 2204969 - protein, 4 aa, Cryptosporidium hominis
SIQN

SEQ ID NO: 2204970 - protein, 14 aa, Cryptosporidium hominis
SIQQSGNLYNMLVK

SEQ ID NO: 2204971 - protein, 4 aa, Cryptosporidium hominis
SIRR

SEQ ID NO: 2204972 - protein, 10 aa, Cryptosporidium hominis
SISEDFSSEN

SEQ ID NO: 2204973 - protein, 13 aa, Cryptosporidium hominis
SISGSENSPAQDI

SEQ ID NO: 2204974 - protein, 28 aa, Cryptosporidium hominis
SISHSEKQLKYSQDHSKLPKNEIPKLNT

SEQ ID NO: 2204975 - protein, 12 aa, Cryptosporidium hominis
SISPDSKDEPSI

SEQ ID NO: 2204976 - protein, 6 aa, Cryptosporidium hominis
SISPTN

SEQ ID NO: 2204977 - protein, 9 aa, Cryptosporidium hominis
SISSNKDSN

SEQ ID NO: 2204978 - protein, 18 aa, Cryptosporidium hominis
SISTTSHREYNSRTGGYP

SEQ ID NO: 2204979 - protein, 5 aa, Cryptosporidium hominis
SKAGI

SEQ ID NO: 2204980 - protein, 6 aa, Cryptosporidium hominis
SKASPL

SEQ ID NO: 2204981 - protein, 17 aa, Cryptosporidium hominis
SKCKSTKPIKQIGGGQY

SEQ ID NO: 2204982 - protein, 4 aa, Cryptosporidium hominis
SKDL

SEQ ID NO: 2204983 - protein, 10 aa, Cryptosporidium hominis
SKDSSKDMSN

SEQ ID NO: 2204984 - protein, 6 aa, Cryptosporidium hominis
SKEATI

SEQ ID NO: 2204985 - protein, 7 aa, Cryptosporidium hominis
SKEDEVS

SEQ ID NO: 2204986 - protein, 8 aa, Cryptosporidium hominis
SKEIGSGC

SEQ ID NO: 2204987 - protein, 15 aa, Cryptosporidium hominis
SKELGSADSDNATYP

SEQ ID NO: 2204988 - protein, 6 aa, Cryptosporidium hominis
SKELTK

SEQ ID NO: 2204989 - protein, 8 aa, Cryptosporidium hominis
SKENECRN

SEQ ID NO: 2204990 - protein, 7 aa, Cryptosporidium hominis
SKEQKPI

SEQ ID NO: 2204991 - protein, 5 aa, Cryptosporidium hominis
SKERI

SEQ ID NO: 2204992 - protein, 8 aa, Cryptosporidium hominis
SKGEENEK

SEQ ID NO: 2204993 - protein, 6 aa, Cryptosporidium hominis
SKGEKA

SEQ ID NO: 2204994 - protein, 6 aa, Cryptosporidium hominis
SKGTGK

SEQ ID NO: 2204995 - protein, 8 aa, Cryptosporidium hominis
SKHNQGSR

SEQ ID NO: 2204996 - protein, 10 aa, Cryptosporidium hominis
SKHRTSDNGQ

SEQ ID NO: 2204997 - protein, 11 aa, Cryptosporidium hominis
SKHTSSNPIGT

SEQ ID NO: 2204998 - protein, 6 aa, Cryptosporidium hominis
SKHVTE

SEQ ID NO: 2204999 - protein, 9 aa, Cryptosporidium hominis
SKIENHPEV

SEQ ID NO: 2205000 - protein, 12 aa, Cryptosporidium hominis
SKIQTTNKESHK

SEQ ID NO: 2205001 - protein, 5 aa, Cryptosporidium hominis
SKITD

SEQ ID NO: 2205002 - protein, 10 aa, Cryptosporidium hominis
SKKENIDDIS

SEQ ID NO: 2205003 - protein, 14 aa, Cryptosporidium hominis
SKKKSGSSPQSGLL

SEQ ID NO: 2205004 - protein, 15 aa, Cryptosporidium hominis
SKKQSKKQKSNNKKS

SEQ ID NO: 2205005 - protein, 6 aa, Cryptosporidium hominis
SKKQTD

SEQ ID NO: 2205006 - protein, 5 aa, Cryptosporidium hominis
SKKRA

SEQ ID NO: 2205007 - protein, 18 aa, Cryptosporidium hominis
SKKRGCVSGRKDESYENS

SEQ ID NO: 2205008 - protein, 9 aa, Cryptosporidium hominis
SKKRPSGAS

SEQ ID NO: 2205009 - protein, 9 aa, Cryptosporidium hominis
SKKYKMSRD

SEQ ID NO: 2205010 - protein, 16 aa, Cryptosporidium hominis
SKLKKEGSDKENQTNS

SEQ ID NO: 2205011 - protein, 7 aa, Cryptosporidium hominis
SKLNDDL

SEQ ID NO: 2205012 - protein, 6 aa, Cryptosporidium hominis
SKLRER

SEQ ID NO: 2205013 - protein, 14 aa, Cryptosporidium hominis
SKMGENDHIPDENE

SEQ ID NO: 2205014 - protein, 10 aa, Cryptosporidium hominis
SKNDEPKYSS

SEQ ID NO: 2205015 - protein, 15 aa, Cryptosporidium hominis
SKNKSLNKLSKQKRR

SEQ ID NO: 2205016 - protein, 6 aa, Cryptosporidium hominis
SKNNGF

SEQ ID NO: 2205017 - protein, 6 aa, Cryptosporidium hominis
SKNPED

SEQ ID NO: 2205018 - protein, 7 aa, Cryptosporidium hominis
SKNSKDN

SEQ ID NO: 2205019 - protein, 8 aa, Cryptosporidium hominis
SKNVPNKA

SEQ ID NO: 2205020 - protein, 4 aa, Cryptosporidium hominis
SKPD

SEQ ID NO: 2205021 - protein, 8 aa, Cryptosporidium hominis
SKPDSSFQ

SEQ ID NO: 2205022 - protein, 7 aa, Cryptosporidium hominis
SKPDVNG

SEQ ID NO: 2205023 - protein, 9 aa, Cryptosporidium hominis
SKPKSSKSI

SEQ ID NO: 2205024 - protein, 284 aa, Cryptosporidium hominis
SKPNDEQAKEQSSSKSGESKPEESNPDKTKPKEPKPDENKPEESKSGEAKPRESNSDEAKPEESKSDESKPEETKPDETKPEEAKSEEAKPEESKPDENKPKESKPDETKPEETKPEETKHDEENSGKGNSTEPKSLESVESSKDDLKKEDKSEDNSAKESTEENSAKSSDSEADANKDFSSSEVAQEEDLASESTDNLNDQTGNSDGAENTSEEKSSEENDEKSMKTDTNDQSNSDVKNDEVKNEDSKNDASLSDASKDTSKESSNNSEIKANGDDKLEDNVE

SEQ ID NO: 2205025 - protein, 7 aa, Cryptosporidium hominis
SKPPFEA

SEQ ID NO: 2205026 - protein, 7 aa, Cryptosporidium hominis
SKPSEIV

SEQ ID NO: 2205027 - protein, 9 aa, Cryptosporidium hominis
SKPSSALAS

SEQ ID NO: 2205028 - protein, 12 aa, Cryptosporidium hominis
SKPTDAATEITG

SEQ ID NO: 2205029 - protein, 21 aa, Cryptosporidium hominis
SKQFSTGKTWERPSGAQGNNN

SEQ ID NO: 2205030 - protein, 5 aa, Cryptosporidium hominis
SKQIP

SEQ ID NO: 2205031 - protein, 8 aa, Cryptosporidium hominis
SKQSSGLS

SEQ ID NO: 2205032 - protein, 9 aa, Cryptosporidium hominis
SKRDSEGKI

SEQ ID NO: 2205033 - protein, 6 aa, Cryptosporidium hominis
SKRIES

SEQ ID NO: 2205034 - protein, 20 aa, Cryptosporidium hominis
SKRQFGPDPSVRPKTTKPQL

SEQ ID NO: 2205035 - protein, 8 aa, Cryptosporidium hominis
SKRSREYY

SEQ ID NO: 2205036 - protein, 8 aa, Cryptosporidium hominis
SKSCPKNC

SEQ ID NO: 2205037 - protein, 4 aa, Cryptosporidium hominis
SKSE

SEQ ID NO: 2205038 - protein, 6 aa, Cryptosporidium hominis
SKSEFE

SEQ ID NO: 2205039 - protein, 10 aa, Cryptosporidium hominis
SKSEKTLTTE

SEQ ID NO: 2205040 - protein, 8 aa, Cryptosporidium hominis
SKSGNSEQ

SEQ ID NO: 2205041 - protein, 6 aa, Cryptosporidium hominis
SKSINS

SEQ ID NO: 2205042 - protein, 7 aa, Cryptosporidium hominis
SKSLENK

SEQ ID NO: 2205043 - protein, 8 aa, Cryptosporidium hominis
SKSSSDNL

SEQ ID NO: 2205044 - protein, 6 aa, Cryptosporidium hominis
SKTFSS

SEQ ID NO: 2205045 - protein, 7 aa, Cryptosporidium hominis
SKTKNAN

SEQ ID NO: 2205046 - protein, 4 aa, Cryptosporidium hominis
SKTL

SEQ ID NO: 2205047 - protein, 6 aa, Cryptosporidium hominis
SKTNTE

SEQ ID NO: 2205048 - protein, 4 aa, Cryptosporidium hominis
SKTR

SEQ ID NO: 2205049 - protein, 5 aa, Cryptosporidium hominis
SKTVD

SEQ ID NO: 2205050 - protein, 7 aa, Cryptosporidium hominis
SKTYRQN

SEQ ID NO: 2205051 - protein, 5 aa, Cryptosporidium hominis
SKVNT

SEQ ID NO: 2205052 - protein, 5 aa, Cryptosporidium hominis
SKVPV

SEQ ID NO: 2205053 - protein, 5 aa, Cryptosporidium hominis
SKVQP

SEQ ID NO: 2205054 - protein, 10 aa, Cryptosporidium hominis
SKVSEGSISP

SEQ ID NO: 2205055 - protein, 5 aa, Cryptosporidium hominis
SKVSK

SEQ ID NO: 2205056 - protein, 6 aa, Cryptosporidium hominis
SKYNTV

SEQ ID NO: 2205057 - protein, 17 aa, Cryptosporidium hominis
SKYSKLEQRDVDGKIGS

SEQ ID NO: 2205058 - protein, 8 aa, Cryptosporidium hominis
SLAGVGSS

SEQ ID NO: 2205059 - protein, 4 aa, Cryptosporidium hominis
SLDE

SEQ ID NO: 2205060 - protein, 16 aa, Cryptosporidium hominis
SLDENNDEIKSEYNYG

SEQ ID NO: 2205061 - protein, 8 aa, Cryptosporidium hominis
SLDSNDTY

SEQ ID NO: 2205062 - protein, 10 aa, Cryptosporidium hominis
SLEESSSRVC

SEQ ID NO: 2205063 - protein, 4 aa, Cryptosporidium hominis
SLEN

SEQ ID NO: 2205064 - protein, 4 aa, Cryptosporidium hominis
SLES

SEQ ID NO: 2205065 - protein, 6 aa, Cryptosporidium hominis
SLESNS

SEQ ID NO: 2205066 - protein, 12 aa, Cryptosporidium hominis
SLESTNSRKWSG

SEQ ID NO: 2205067 - protein, 20 aa, Cryptosporidium hominis
SLETGSESEPVALPPQDTQM

SEQ ID NO: 2205068 - protein, 15 aa, Cryptosporidium hominis
SLGETETLSKKQQQI

SEQ ID NO: 2205069 - protein, 6 aa, Cryptosporidium hominis
SLGKES

SEQ ID NO: 2205070 - protein, 44 aa, Cryptosporidium hominis
SLGNTGSDSDGSGPDDDPPNFKPPPPPGKKGNVGSNPDGPPVPL

SEQ ID NO: 2205071 - protein, 6 aa, Cryptosporidium hominis
SLHEQK

SEQ ID NO: 2205072 - protein, 4 aa, Cryptosporidium hominis
SLIE

SEQ ID NO: 2205073 - protein, 10 aa, Cryptosporidium hominis
SLKEEISRKE

SEQ ID NO: 2205074 - protein, 8 aa, Cryptosporidium hominis
SLKPSSKH

SEQ ID NO: 2205075 - protein, 7 aa, Cryptosporidium hominis
SLLPRQT

SEQ ID NO: 2205076 - protein, 5 aa, Cryptosporidium hominis
SLNGS

SEQ ID NO: 2205077 - protein, 7 aa, Cryptosporidium hominis
SLNNGAS

SEQ ID NO: 2205078 - protein, 19 aa, Cryptosporidium hominis
SLNNVDNDDFETDSEKGID

SEQ ID NO: 2205079 - protein, 26 aa, Cryptosporidium hominis
SLNPPRKIRDNKNKVSNSNIKRDNSI

SEQ ID NO: 2205080 - protein, 9 aa, Cryptosporidium hominis
SLNQEGKDG

SEQ ID NO: 2205081 - protein, 11 aa, Cryptosporidium hominis
SLNSSLNSSSH

SEQ ID NO: 2205082 - protein, 17 aa, Cryptosporidium hominis
SLPEGLPNAPKTTSPEG

SEQ ID NO: 2205083 - protein, 12 aa, Cryptosporidium hominis
SLPPNEYNPYSN

SEQ ID NO: 2205084 - protein, 9 aa, Cryptosporidium hominis
SLQEGLPES

SEQ ID NO: 2205085 - protein, 4 aa, Cryptosporidium hominis
SLRY

SEQ ID NO: 2205086 - protein, 10 aa, Cryptosporidium hominis
SLSDNKESGY

SEQ ID NO: 2205087 - protein, 8 aa, Cryptosporidium hominis
SLSEEKQH

SEQ ID NO: 2205088 - protein, 6 aa, Cryptosporidium hominis
SLSNKQ

SEQ ID NO: 2205089 - protein, 15 aa, Cryptosporidium hominis
SLSNNDKNEAADEKI

SEQ ID NO: 2205090 - protein, 15 aa, Cryptosporidium hominis
SLSSGGADSKLALGT

SEQ ID NO: 2205091 - protein, 12 aa, Cryptosporidium hominis
SLSSLSDSNVQN

SEQ ID NO: 2205092 - protein, 20 aa, Cryptosporidium hominis
SLSSNQKNLEESVKTAEQDL

SEQ ID NO: 2205093 - protein, 4 aa, Cryptosporidium hominis
SLSY

SEQ ID NO: 2205094 - protein, 7 aa, Cryptosporidium hominis
SLTGSVG

SEQ ID NO: 2205095 - protein, 6 aa, Cryptosporidium hominis
SLTPSR

SEQ ID NO: 2205096 - protein, 8 aa, Cryptosporidium hominis
SLTQNSAA

SEQ ID NO: 2205097 - protein, 15 aa, Cryptosporidium hominis
SLVGNNDKGGGFGKE

SEQ ID NO: 2205098 - protein, 19 aa, Cryptosporidium hominis
SMDTRSEDLEEKKYKSPFE

SEQ ID NO: 2205099 - protein, 5 aa, Cryptosporidium hominis
SMIPR

SEQ ID NO: 2205100 - protein, 10 aa, Cryptosporidium hominis
SMSGDTNGQL

SEQ ID NO: 2205101 - protein, 5 aa, Cryptosporidium hominis
SMTEE

SEQ ID NO: 2205102 - protein, 5 aa, Cryptosporidium hominis
SNADA

SEQ ID NO: 2205103 - protein, 6 aa, Cryptosporidium hominis
SNDADK

SEQ ID NO: 2205104 - protein, 7 aa, Cryptosporidium hominis
SNDADKI

SEQ ID NO: 2205105 - protein, 10 aa, Cryptosporidium hominis
SNDGQSYKKR

SEQ ID NO: 2205106 - protein, 19 aa, Cryptosporidium hominis
SNDIDQNVQDEETKSFGSD

SEQ ID NO: 2205107 - protein, 17 aa, Cryptosporidium hominis
SNDPESAKEELKRSAEK

SEQ ID NO: 2205108 - protein, 11 aa, Cryptosporidium hominis
SNDYSINSSTL

SEQ ID NO: 2205109 - protein, 6 aa, Cryptosporidium hominis
SNEGFR

SEQ ID NO: 2205110 - protein, 5 aa, Cryptosporidium hominis
SNEII

SEQ ID NO: 2205111 - protein, 13 aa, Cryptosporidium hominis
SNEKQISEGPPQW

SEQ ID NO: 2205112 - protein, 20 aa, Cryptosporidium hominis
SNETASFPASRTSHPSDPNH

SEQ ID NO: 2205113 - protein, 12 aa, Cryptosporidium hominis
SNETCSGKANRA

SEQ ID NO: 2205114 - protein, 10 aa, Cryptosporidium hominis
SNFDNTSRGF

SEQ ID NO: 2205115 - protein, 7 aa, Cryptosporidium hominis
SNFNTND

SEQ ID NO: 2205116 - protein, 8 aa, Cryptosporidium hominis
SNFTSDQL

SEQ ID NO: 2205117 - protein, 23 aa, Cryptosporidium hominis
SNGEVDSSTSGGESSSDTGSQRL

SEQ ID NO: 2205118 - protein, 31 aa, Cryptosporidium hominis
SNGGTCTLQNGDRTCKTNNQNVISGNPDVAV

SEQ ID NO: 2205119 - protein, 6 aa, Cryptosporidium hominis
SNGRTA

SEQ ID NO: 2205120 - protein, 9 aa, Cryptosporidium hominis
SNGSSNNSL

SEQ ID NO: 2205121 - protein, 4 aa, Cryptosporidium hominis
SNID

SEQ ID NO: 2205122 - protein, 6 aa, Cryptosporidium hominis
SNIKLG

SEQ ID NO: 2205123 - protein, 11 aa, Cryptosporidium hominis
SNISPSKQESK

SEQ ID NO: 2205124 - protein, 47 aa, Cryptosporidium hominis
SNISTRKRKQGERKIKNENRREKEERERLEEKEREMEREREKRERMK

SEQ ID NO: 2205125 - protein, 34 aa, Cryptosporidium hominis
SNITPKRKTKPVSLSKPKKKKPAQDKPTELQSEE

SEQ ID NO: 2205126 - protein, 4 aa, Cryptosporidium hominis
SNIV

SEQ ID NO: 2205127 - protein, 17 aa, Cryptosporidium hominis
SNKDVENSTDKEKTDSI

SEQ ID NO: 2205128 - protein, 13 aa, Cryptosporidium hominis
SNKKTDNSKVNDE

SEQ ID NO: 2205129 - protein, 4 aa, Cryptosporidium hominis
SNKY

SEQ ID NO: 2205130 - protein, 10 aa, Cryptosporidium hominis
SNLEQKEHSE

SEQ ID NO: 2205131 - protein, 6 aa, Cryptosporidium hominis
SNLEST

SEQ ID NO: 2205132 - protein, 11 aa, Cryptosporidium hominis
SNLNNNPQLNG

SEQ ID NO: 2205133 - protein, 6 aa, Cryptosporidium hominis
SNLPKE

SEQ ID NO: 2205134 - protein, 6 aa, Cryptosporidium hominis
SNMPNY

SEQ ID NO: 2205135 - protein, 8 aa, Cryptosporidium hominis
SNNNGTGE

SEQ ID NO: 2205136 - protein, 12 aa, Cryptosporidium hominis
SNNTDNSTLSSS

SEQ ID NO: 2205137 - protein, 4 aa, Cryptosporidium hominis
SNPE

SEQ ID NO: 2205138 - protein, 5 aa, Cryptosporidium hominis
SNPES

SEQ ID NO: 2205139 - protein, 10 aa, Cryptosporidium hominis
SNPNRRIGDP

SEQ ID NO: 2205140 - protein, 15 aa, Cryptosporidium hominis
SNPPKQSATTTTTKT

SEQ ID NO: 2205141 - protein, 9 aa, Cryptosporidium hominis
SNPQANTNE

SEQ ID NO: 2205142 - protein, 7 aa, Cryptosporidium hominis
SNQEDGL

SEQ ID NO: 2205143 - protein, 41 aa, Cryptosporidium hominis
SNQVGPGSAPITDRNTPWGHANANGDVSTGDEYSCEEGTKL

SEQ ID NO: 2205144 - protein, 20 aa, Cryptosporidium hominis
SNRNGIQSQSTGYYIRSFKI

SEQ ID NO: 2205145 - protein, 9 aa, Cryptosporidium hominis
SNRPTRAEM

SEQ ID NO: 2205146 - protein, 6 aa, Cryptosporidium hominis
SNSETY

SEQ ID NO: 2205147 - protein, 12 aa, Cryptosporidium hominis
SNSGSKKEAYPY

SEQ ID NO: 2205148 - protein, 8 aa, Cryptosporidium hominis
SNSLKEPE

SEQ ID NO: 2205149 - protein, 6 aa, Cryptosporidium hominis
SNSLKS

SEQ ID NO: 2205150 - protein, 10 aa, Cryptosporidium hominis
SNSNAGGLRN

SEQ ID NO: 2205151 - protein, 30 aa, Cryptosporidium hominis
SNSNYESSDNKLQGSTHECNTNKASTSFDD

SEQ ID NO: 2205152 - protein, 5 aa, Cryptosporidium hominis
SNSPR

SEQ ID NO: 2205153 - protein, 4 aa, Cryptosporidium hominis
SNSS

SEQ ID NO: 2205154 - protein, 25 aa, Cryptosporidium hominis
SNSSLDNIKGQDDDELTSSEYLSEE

SEQ ID NO: 2205155 - protein, 9 aa, Cryptosporidium hominis
SNSSNANSF

SEQ ID NO: 2205156 - protein, 21 aa, Cryptosporidium hominis
SNSTNNNSSNNSFTTTTTTTV

SEQ ID NO: 2205157 - protein, 6 aa, Cryptosporidium hominis
SNTELN

SEQ ID NO: 2205158 - protein, 9 aa, Cryptosporidium hominis
SNTEQDEGF

SEQ ID NO: 2205159 - protein, 4 aa, Cryptosporidium hominis
SNTL

SEQ ID NO: 2205160 - protein, 12 aa, Cryptosporidium hominis
SNTQGGNSEGSQ

SEQ ID NO: 2205161 - protein, 7 aa, Cryptosporidium hominis
SNTSKTK

SEQ ID NO: 2205162 - protein, 10 aa, Cryptosporidium hominis
SNVNDTTTLE

SEQ ID NO: 2205163 - protein, 11 aa, Cryptosporidium hominis
SNVNSKDQFKR

SEQ ID NO: 2205164 - protein, 13 aa, Cryptosporidium hominis
SNYLPNPRECTTD

SEQ ID NO: 2205165 - protein, 5 aa, Cryptosporidium hominis
SPCDG

SEQ ID NO: 2205166 - protein, 14 aa, Cryptosporidium hominis
SPDLTSKESCTESQ

SEQ ID NO: 2205167 - protein, 6 aa, Cryptosporidium hominis
SPDSEI

SEQ ID NO: 2205168 - protein, 12 aa, Cryptosporidium hominis
SPEENSSPEEIQ

SEQ ID NO: 2205169 - protein, 4 aa, Cryptosporidium hominis
SPEL

SEQ ID NO: 2205170 - protein, 6 aa, Cryptosporidium hominis
SPEPRC

SEQ ID NO: 2205171 - protein, 4 aa, Cryptosporidium hominis
SPEY

SEQ ID NO: 2205172 - protein, 5 aa, Cryptosporidium hominis
SPFKN

SEQ ID NO: 2205173 - protein, 9 aa, Cryptosporidium hominis
SPFYPPPKK

SEQ ID NO: 2205174 - protein, 9 aa, Cryptosporidium hominis
SPGDPRYSN

SEQ ID NO: 2205175 - protein, 5 aa, Cryptosporidium hominis
SPGKT

SEQ ID NO: 2205176 - protein, 6 aa, Cryptosporidium hominis
SPGKTY

SEQ ID NO: 2205177 - protein, 5 aa, Cryptosporidium hominis
SPIGQ

SEQ ID NO: 2205178 - protein, 13 aa, Cryptosporidium hominis
SPIPEAPEGAEDK

SEQ ID NO: 2205179 - protein, 7 aa, Cryptosporidium hominis
SPIQTGA

SEQ ID NO: 2205180 - protein, 8 aa, Cryptosporidium hominis
SPISTNSE

SEQ ID NO: 2205181 - protein, 5 aa, Cryptosporidium hominis
SPITN

SEQ ID NO: 2205182 - protein, 9 aa, Cryptosporidium hominis
SPKNENSKY

SEQ ID NO: 2205183 - protein, 13 aa, Cryptosporidium hominis
SPLPHTKGQVPTY

SEQ ID NO: 2205184 - protein, 44 aa, Cryptosporidium hominis
SPLQNKNKISPTKVESKRKKSFKNNIEKGINSDFDSDFSSSDSD

SEQ ID NO: 2205185 - protein, 4 aa, Cryptosporidium hominis
SPNE

SEQ ID NO: 2205186 - protein, 16 aa, Cryptosporidium hominis
SPNPIPGKSPETPRNL

SEQ ID NO: 2205187 - protein, 7 aa, Cryptosporidium hominis
SPNREAY

SEQ ID NO: 2205188 - protein, 8 aa, Cryptosporidium hominis
SPNSSMPD

SEQ ID NO: 2205189 - protein, 15 aa, Cryptosporidium hominis
SPPASNEASAQQDTS

SEQ ID NO: 2205190 - protein, 4 aa, Cryptosporidium hominis
SPPN

SEQ ID NO: 2205191 - protein, 4 aa, Cryptosporidium hominis
SPPV

SEQ ID NO: 2205192 - protein, 7 aa, Cryptosporidium hominis
SPQGQTL

SEQ ID NO: 2205193 - protein, 67 aa, Cryptosporidium hominis
SPQKKASFSKDEEEESQEQTPKIPPIPKSDSKNLPKPSKDTNEEVSQTTDERIPSTPTAKMVPPKPA

SEQ ID NO: 2205194 - protein, 9 aa, Cryptosporidium hominis
SPQRSVSDP

SEQ ID NO: 2205195 - protein, 12 aa, Cryptosporidium hominis
SPRIRNSNLTSP

SEQ ID NO: 2205196 - protein, 4 aa, Cryptosporidium hominis
SPRK

SEQ ID NO: 2205197 - protein, 23 aa, Cryptosporidium hominis
SPRPIRPRKQIKGRNPSNIPGAS

SEQ ID NO: 2205198 - protein, 8 aa, Cryptosporidium hominis
SPRPTITD

SEQ ID NO: 2205199 - protein, 7 aa, Cryptosporidium hominis
SPSNAGD

SEQ ID NO: 2205200 - protein, 5 aa, Cryptosporidium hominis
SPSNI

SEQ ID NO: 2205201 - protein, 6 aa, Cryptosporidium hominis
SPSRIR

SEQ ID NO: 2205202 - protein, 5 aa, Cryptosporidium hominis
SPTDT

SEQ ID NO: 2205203 - protein, 15 aa, Cryptosporidium hominis
SPTFSQNSPIQAIPP

SEQ ID NO: 2205204 - protein, 4 aa, Cryptosporidium hominis
SPTL

SEQ ID NO: 2205205 - protein, 5 aa, Cryptosporidium hominis
SPTSY

SEQ ID NO: 2205206 - protein, 7 aa, Cryptosporidium hominis
SPTYPKC

SEQ ID NO: 2205207 - protein, 19 aa, Cryptosporidium hominis
SPVTQESGVTVRSTNYRQS

SEQ ID NO: 2205208 - protein, 6 aa, Cryptosporidium hominis
SQCEDS

SEQ ID NO: 2205209 - protein, 21 aa, Cryptosporidium hominis
SQEARKLEEDKTGVNKGSAEL

SEQ ID NO: 2205210 - protein, 6 aa, Cryptosporidium hominis
SQEFSQ

SEQ ID NO: 2205211 - protein, 9 aa, Cryptosporidium hominis
SQEGNKAYG

SEQ ID NO: 2205212 - protein, 8 aa, Cryptosporidium hominis
SQENPNPV

SEQ ID NO: 2205213 - protein, 4 aa, Cryptosporidium hominis
SQER

SEQ ID NO: 2205214 - protein, 9 aa, Cryptosporidium hominis
SQFQSTASG

SEQ ID NO: 2205215 - protein, 9 aa, Cryptosporidium hominis
SQGALGKNS

SEQ ID NO: 2205216 - protein, 5 aa, Cryptosporidium hominis
SQGEK

SEQ ID NO: 2205217 - protein, 9 aa, Cryptosporidium hominis
SQGTRSESG

SEQ ID NO: 2205218 - protein, 27 aa, Cryptosporidium hominis
SQIDGSEGQTDQSEYPNYNKEASISYS

SEQ ID NO: 2205219 - protein, 19 aa, Cryptosporidium hominis
SQIGGGDQITPSSKKGNKF

SEQ ID NO: 2205220 - protein, 7 aa, Cryptosporidium hominis
SQKAASP

SEQ ID NO: 2205221 - protein, 7 aa, Cryptosporidium hominis
SQKPIKN

SEQ ID NO: 2205222 - protein, 4 aa, Cryptosporidium hominis
SQLP

SEQ ID NO: 2205223 - protein, 8 aa, Cryptosporidium hominis
SQLQVKGT

SEQ ID NO: 2205224 - protein, 10 aa, Cryptosporidium hominis
SQNDKNGDGI

SEQ ID NO: 2205225 - protein, 5 aa, Cryptosporidium hominis
SQNEL

SEQ ID NO: 2205226 - protein, 6 aa, Cryptosporidium hominis
SQNGEY

SEQ ID NO: 2205227 - protein, 5 aa, Cryptosporidium hominis
SQNKI

SEQ ID NO: 2205228 - protein, 16 aa, Cryptosporidium hominis
SQNNNTVDTNPELSSS

SEQ ID NO: 2205229 - protein, 8 aa, Cryptosporidium hominis
SQNPSKLA

SEQ ID NO: 2205230 - protein, 12 aa, Cryptosporidium hominis
SQNRSGSPNSKV

SEQ ID NO: 2205231 - protein, 16 aa, Cryptosporidium hominis
SQNSPNSKDSHSNSFS

SEQ ID NO: 2205232 - protein, 6 aa, Cryptosporidium hominis
SQNSSK

SEQ ID NO: 2205233 - protein, 6 aa, Cryptosporidium hominis
SQNTNY

SEQ ID NO: 2205234 - protein, 8 aa, Cryptosporidium hominis
SQPEKECP

SEQ ID NO: 2205235 - protein, 10 aa, Cryptosporidium hominis
SQPENPEDAL

SEQ ID NO: 2205236 - protein, 7 aa, Cryptosporidium hominis
SQPPQPV

SEQ ID NO: 2205237 - protein, 7 aa, Cryptosporidium hominis
SQPVKPY

SEQ ID NO: 2205238 - protein, 6 aa, Cryptosporidium hominis
SQQAES

SEQ ID NO: 2205239 - protein, 9 aa, Cryptosporidium hominis
SQQVSTTIE

SEQ ID NO: 2205240 - protein, 36 aa, Cryptosporidium hominis
SQSIGERSNQSLRRKKSKKGRKDQKNNNIEDSPIEQ

SEQ ID NO: 2205241 - protein, 11 aa, Cryptosporidium hominis
SQSISREEFDR

SEQ ID NO: 2205242 - protein, 14 aa, Cryptosporidium hominis
SQSPTDIPSHSGPI

SEQ ID NO: 2205243 - protein, 9 aa, Cryptosporidium hominis
SQSSTPNCK

SEQ ID NO: 2205244 - protein, 5 aa, Cryptosporidium hominis
SQTEK

SEQ ID NO: 2205245 - protein, 11 aa, Cryptosporidium hominis
SQTGGSYEENY

SEQ ID NO: 2205246 - protein, 7 aa, Cryptosporidium hominis
SQTHNKM

SEQ ID NO: 2205247 - protein, 9 aa, Cryptosporidium hominis
SQVKPEKKY

SEQ ID NO: 2205248 - protein, 4 aa, Cryptosporidium hominis
SRAQ

SEQ ID NO: 2205249 - protein, 9 aa, Cryptosporidium hominis
SRDFEARRK

SEQ ID NO: 2205250 - protein, 14 aa, Cryptosporidium hominis
SRDVETKPGISASH

SEQ ID NO: 2205251 - protein, 8 aa, Cryptosporidium hominis
SREPAGLT

SEQ ID NO: 2205252 - protein, 6 aa, Cryptosporidium hominis
SREQNV

SEQ ID NO: 2205253 - protein, 6 aa, Cryptosporidium hominis
SRESTM

SEQ ID NO: 2205254 - protein, 22 aa, Cryptosporidium hominis
SRFSKTNSSSWSIGNPKFFINQ

SEQ ID NO: 2205255 - protein, 5 aa, Cryptosporidium hominis
SRGIP

SEQ ID NO: 2205256 - protein, 5 aa, Cryptosporidium hominis
SRIPG

SEQ ID NO: 2205257 - protein, 5 aa, Cryptosporidium hominis
SRKDI

SEQ ID NO: 2205258 - protein, 53 aa, Cryptosporidium hominis
SRKEKKRPKSGSKSRSKSRSRSRSQNSKEKQKFQNKKNVKKKSQNSPNSKQSF

SEQ ID NO: 2205259 - protein, 7 aa, Cryptosporidium hominis
SRKYEGP

SEQ ID NO: 2205260 - protein, 10 aa, Cryptosporidium hominis
SRLDSDQKIQ

SEQ ID NO: 2205261 - protein, 6 aa, Cryptosporidium hominis
SRLPEQ

SEQ ID NO: 2205262 - protein, 9 aa, Cryptosporidium hominis
SRLPTKTEF

SEQ ID NO: 2205263 - protein, 18 aa, Cryptosporidium hominis
SRLVSDDEDIETNKQKSM

SEQ ID NO: 2205264 - protein, 7 aa, Cryptosporidium hominis
SRNARSF

SEQ ID NO: 2205265 - protein, 10 aa, Cryptosporidium hominis
SRNKNGEIIS

SEQ ID NO: 2205266 - protein, 9 aa, Cryptosporidium hominis
SRNNNKESF

SEQ ID NO: 2205267 - protein, 16 aa, Cryptosporidium hominis
SRNNQGENSDQESKDE

SEQ ID NO: 2205268 - protein, 7 aa, Cryptosporidium hominis
SRNPNAI

SEQ ID NO: 2205269 - protein, 10 aa, Cryptosporidium hominis
SRNRNQSLNN

SEQ ID NO: 2205270 - protein, 7 aa, Cryptosporidium hominis
SRPARSV

SEQ ID NO: 2205271 - protein, 5 aa, Cryptosporidium hominis
SRPGQ

SEQ ID NO: 2205272 - protein, 7 aa, Cryptosporidium hominis
SRPKGSC

SEQ ID NO: 2205273 - protein, 5 aa, Cryptosporidium hominis
SRPNI

SEQ ID NO: 2205274 - protein, 9 aa, Cryptosporidium hominis
SRSADSTGL

SEQ ID NO: 2205275 - protein, 11 aa, Cryptosporidium hominis
SRSDKEGYSPN

SEQ ID NO: 2205276 - protein, 7 aa, Cryptosporidium hominis
SRSETPK

SEQ ID NO: 2205277 - protein, 7 aa, Cryptosporidium hominis
SRSGNIA

SEQ ID NO: 2205278 - protein, 248 aa, Cryptosporidium hominis
SRSGNTKEPKPEKESKSSCASSKSDKTKEPKPEKDSKSSCACSKSDKTKEPKPEKESKSSCACSKSDKTKEPKPEKDSKSSCACSKSDKTKEPKPEKDSNSSCACSKSDKTKEPKPEKETKSSCACSKSDKTKEPKPEKESKSSCACSKSDKTKEPKPEKDSKSSCACSKSDKTKEPKPEKESKSSCSCSKSDKTKEPKPEKDSKSSCACSKSNKTKEPRPEKESNSSCASCSSSKKSKKRSGKYDNS

SEQ ID NO: 2205279 - protein, 6 aa, Cryptosporidium hominis
SRVPPQ

SEQ ID NO: 2205280 - protein, 11 aa, Cryptosporidium hominis
SRVTNYKKANY

SEQ ID NO: 2205281 - protein, 12 aa, Cryptosporidium hominis
SRYDGERDLKDY

SEQ ID NO: 2205282 - protein, 4 aa, Cryptosporidium hominis
SSAN

SEQ ID NO: 2205283 - protein, 8 aa, Cryptosporidium hominis
SSANPMGK

SEQ ID NO: 2205284 - protein, 7 aa, Cryptosporidium hominis
SSAPTLR

SEQ ID NO: 2205285 - protein, 11 aa, Cryptosporidium hominis
SSATSSSGRGV

SEQ ID NO: 2205286 - protein, 8 aa, Cryptosporidium hominis
SSATTTTE

SEQ ID NO: 2205287 - protein, 6 aa, Cryptosporidium hominis
SSDCEK

SEQ ID NO: 2205288 - protein, 6 aa, Cryptosporidium hominis
SSDENL

SEQ ID NO: 2205289 - protein, 4 aa, Cryptosporidium hominis
SSDL

SEQ ID NO: 2205290 - protein, 4 aa, Cryptosporidium hominis
SSDP

SEQ ID NO: 2205291 - protein, 4 aa, Cryptosporidium hominis
SSDQ

SEQ ID NO: 2205292 - protein, 5 aa, Cryptosporidium hominis
SSDSI

SEQ ID NO: 2205293 - protein, 10 aa, Cryptosporidium hominis
SSDTKPKKMR

SEQ ID NO: 2205294 - protein, 8 aa, Cryptosporidium hominis
SSEASSSF

SEQ ID NO: 2205295 - protein, 14 aa, Cryptosporidium hominis
SSEERLSFDEVDNK

SEQ ID NO: 2205296 - protein, 6 aa, Cryptosporidium hominis
SSEISG

SEQ ID NO: 2205297 - protein, 6 aa, Cryptosporidium hominis
SSENFE

SEQ ID NO: 2205298 - protein, 50 aa, Cryptosporidium hominis
SSENIDTSDSDSDSDSNSTSDSNSSSNSNSSSNSSENGDQYENDLTETHK

SEQ ID NO: 2205299 - protein, 6 aa, Cryptosporidium hominis
SSEQAI

SEQ ID NO: 2205300 - protein, 9 aa, Cryptosporidium hominis
SSESGATGK

SEQ ID NO: 2205301 - protein, 35 aa, Cryptosporidium hominis
SSESKINGNKENSIGNKQNSNSTTKNKRSSCDHSK

SEQ ID NO: 2205302 - protein, 7 aa, Cryptosporidium hominis
SSETDLY

SEQ ID NO: 2205303 - protein, 5 aa, Cryptosporidium hominis
SSETV

SEQ ID NO: 2205304 - protein, 4 aa, Cryptosporidium hominis
SSFG

SEQ ID NO: 2205305 - protein, 13 aa, Cryptosporidium hominis
SSFKNKYPISERG

SEQ ID NO: 2205306 - protein, 6 aa, Cryptosporidium hominis
SSFKTT

SEQ ID NO: 2205307 - protein, 9 aa, Cryptosporidium hominis
SSFNGNENT

SEQ ID NO: 2205308 - protein, 7 aa, Cryptosporidium hominis
SSFSPGN

SEQ ID NO: 2205309 - protein, 8 aa, Cryptosporidium hominis
SSGGIGAT

SEQ ID NO: 2205310 - protein, 7 aa, Cryptosporidium hominis
SSGGSVE

SEQ ID NO: 2205311 - protein, 8 aa, Cryptosporidium hominis
SSGKDGKT

SEQ ID NO: 2205312 - protein, 43 aa, Cryptosporidium hominis
SSGNRKSNIGISSTGRITSKQTESKNKETNQDSIKSKSPNTEI

SEQ ID NO: 2205313 - protein, 6 aa, Cryptosporidium hominis
SSGPQN

SEQ ID NO: 2205314 - protein, 9 aa, Cryptosporidium hominis
SSGSCNNSS

SEQ ID NO: 2205315 - protein, 12 aa, Cryptosporidium hominis
SSGSTHKSKNNY

SEQ ID NO: 2205316 - protein, 12 aa, Cryptosporidium hominis
SSGVEKNISSKD

SEQ ID NO: 2205317 - protein, 4 aa, Cryptosporidium hominis
SSHS

SEQ ID NO: 2205318 - protein, 25 aa, Cryptosporidium hominis
SSIETSSSSANSEPEGEDKEKEIEK

SEQ ID NO: 2205319 - protein, 23 aa, Cryptosporidium hominis
SSIKDNQNKKGGSSLNLNPGPVF

SEQ ID NO: 2205320 - protein, 4 aa, Cryptosporidium hominis
SSIP

SEQ ID NO: 2205321 - protein, 9 aa, Cryptosporidium hominis
SSIPDECTS

SEQ ID NO: 2205322 - protein, 4 aa, Cryptosporidium hominis
SSIQ

SEQ ID NO: 2205323 - protein, 13 aa, Cryptosporidium hominis
SSISKDKDTSLPQ

SEQ ID NO: 2205324 - protein, 13 aa, Cryptosporidium hominis
SSISKNLAKNGYR

SEQ ID NO: 2205325 - protein, 7 aa, Cryptosporidium hominis
SSISKSP

SEQ ID NO: 2205326 - protein, 7 aa, Cryptosporidium hominis
SSITGTV

SEQ ID NO: 2205327 - protein, 11 aa, Cryptosporidium hominis
SSITSQEPEPV

SEQ ID NO: 2205328 - protein, 12 aa, Cryptosporidium hominis
SSIVSEAEISTL

SEQ ID NO: 2205329 - protein, 68 aa, Cryptosporidium hominis
SSKARTTGKGGSEGGERGERGGRGGRSGEGGSGGRGGRGGRGGRGGRGGSGSGDGGSGDEGRKAPKSY

SEQ ID NO: 2205330 - protein, 16 aa, Cryptosporidium hominis
SSKHTAGTHHYSTPSA

SEQ ID NO: 2205331 - protein, 9 aa, Cryptosporidium hominis
SSKINSSEH

SEQ ID NO: 2205332 - protein, 18 aa, Cryptosporidium hominis
SSKKSTEEDNDKTSDDLK

SEQ ID NO: 2205333 - protein, 4 aa, Cryptosporidium hominis
SSKM

SEQ ID NO: 2205334 - protein, 18 aa, Cryptosporidium hominis
SSKRKKTKKGENSQPPKL

SEQ ID NO: 2205335 - protein, 7 aa, Cryptosporidium hominis
SSKSMSS

SEQ ID NO: 2205336 - protein, 9 aa, Cryptosporidium hominis
SSKSTGGVP

SEQ ID NO: 2205337 - protein, 4 aa, Cryptosporidium hominis
SSLD

SEQ ID NO: 2205338 - protein, 9 aa, Cryptosporidium hominis
SSLEPKKFP

SEQ ID NO: 2205339 - protein, 12 aa, Cryptosporidium hominis
SSLGNGGKTAKC

SEQ ID NO: 2205340 - protein, 23 aa, Cryptosporidium hominis
SSLGSRPGIKGSYKQEGREEKKT

SEQ ID NO: 2205341 - protein, 13 aa, Cryptosporidium hominis
SSLLSEGTASLSK

SEQ ID NO: 2205342 - protein, 4 aa, Cryptosporidium hominis
SSLP

SEQ ID NO: 2205343 - protein, 21 aa, Cryptosporidium hominis
SSLPQQGSSFQPNSGGNMDSF

SEQ ID NO: 2205344 - protein, 9 aa, Cryptosporidium hominis
SSMDEAKKE

SEQ ID NO: 2205345 - protein, 8 aa, Cryptosporidium hominis
SSMSGTET

SEQ ID NO: 2205346 - protein, 6 aa, Cryptosporidium hominis
SSMTEE

SEQ ID NO: 2205347 - protein, 5 aa, Cryptosporidium hominis
SSNEN

SEQ ID NO: 2205348 - protein, 14 aa, Cryptosporidium hominis
SSNGRTPPKITKKR

SEQ ID NO: 2205349 - protein, 11 aa, Cryptosporidium hominis
SSNKEKSGFEL

SEQ ID NO: 2205350 - protein, 8 aa, Cryptosporidium hominis
SSNNGKVN

SEQ ID NO: 2205351 - protein, 10 aa, Cryptosporidium hominis
SSNNISNKAT

SEQ ID NO: 2205352 - protein, 9 aa, Cryptosporidium hominis
SSNNPYPSH

SEQ ID NO: 2205353 - protein, 5 aa, Cryptosporidium hominis
SSNNY

SEQ ID NO: 2205354 - protein, 4 aa, Cryptosporidium hominis
SSNQ

SEQ ID NO: 2205355 - protein, 9 aa, Cryptosporidium hominis
SSNQTKSVN

SEQ ID NO: 2205356 - protein, 9 aa, Cryptosporidium hominis
SSNSETNFG

SEQ ID NO: 2205357 - protein, 13 aa, Cryptosporidium hominis
SSNSQSKDSHGQT

SEQ ID NO: 2205358 - protein, 16 aa, Cryptosporidium hominis
SSNSQTDEQEDDGSLE

SEQ ID NO: 2205359 - protein, 6 aa, Cryptosporidium hominis
SSNTSL

SEQ ID NO: 2205360 - protein, 9 aa, Cryptosporidium hominis
SSNVDSEEF

SEQ ID NO: 2205361 - protein, 6 aa, Cryptosporidium hominis
SSNYSY

SEQ ID NO: 2205362 - protein, 6 aa, Cryptosporidium hominis
SSPDEI

SEQ ID NO: 2205363 - protein, 9 aa, Cryptosporidium hominis
SSPRETQIQ

SEQ ID NO: 2205364 - protein, 6 aa, Cryptosporidium hominis
SSPSTQ

SEQ ID NO: 2205365 - protein, 7 aa, Cryptosporidium hominis
SSQKYPS

SEQ ID NO: 2205366 - protein, 6 aa, Cryptosporidium hominis
SSQPNT

SEQ ID NO: 2205367 - protein, 7 aa, Cryptosporidium hominis
SSQTEAD

SEQ ID NO: 2205368 - protein, 6 aa, Cryptosporidium hominis
SSQTGF

SEQ ID NO: 2205369 - protein, 11 aa, Cryptosporidium hominis
SSRDLKNNGGI

SEQ ID NO: 2205370 - protein, 9 aa, Cryptosporidium hominis
SSRKITREE

SEQ ID NO: 2205371 - protein, 5 aa, Cryptosporidium hominis
SSSAE

SEQ ID NO: 2205372 - protein, 6 aa, Cryptosporidium hominis
SSSASI

SEQ ID NO: 2205373 - protein, 16 aa, Cryptosporidium hominis
SSSEYARSTIPKGAGY

SEQ ID NO: 2205374 - protein, 11 aa, Cryptosporidium hominis
SSSLPSTSNGM

SEQ ID NO: 2205375 - protein, 7 aa, Cryptosporidium hominis
SSSNPIN

SEQ ID NO: 2205376 - protein, 9 aa, Cryptosporidium hominis
SSSNSLQME

SEQ ID NO: 2205377 - protein, 9 aa, Cryptosporidium hominis
SSSPRKEIS

SEQ ID NO: 2205378 - protein, 11 aa, Cryptosporidium hominis
SSSPTEETEEM

SEQ ID NO: 2205379 - protein, 4 aa, Cryptosporidium hominis
SSSQ

SEQ ID NO: 2205380 - protein, 15 aa, Cryptosporidium hominis
SSSQIKNDLDSTEFA

SEQ ID NO: 2205381 - protein, 5 aa, Cryptosporidium hominis
SSSRN

SEQ ID NO: 2205382 - protein, 5 aa, Cryptosporidium hominis
SSSSK

SEQ ID NO: 2205383 - protein, 9 aa, Cryptosporidium hominis
SSSSNGTTA

SEQ ID NO: 2205384 - protein, 10 aa, Cryptosporidium hominis
SSSSSRHSSI

SEQ ID NO: 2205385 - protein, 7 aa, Cryptosporidium hominis
SSSTKLP

SEQ ID NO: 2205386 - protein, 7 aa, Cryptosporidium hominis
SSSVEQN

SEQ ID NO: 2205387 - protein, 6 aa, Cryptosporidium hominis
SSSVSV

SEQ ID NO: 2205388 - protein, 23 aa, Cryptosporidium hominis
SSSYYSKSSSMISPKTKNNCGNK

SEQ ID NO: 2205389 - protein, 7 aa, Cryptosporidium hominis
SSTCGGG

SEQ ID NO: 2205390 - protein, 52 aa, Cryptosporidium hominis
SSTDYRSSHLSGGHGEQSSHGERSKNRERSRNRERSRNRERSGNRESGRKMT

SEQ ID NO: 2205391 - protein, 14 aa, Cryptosporidium hominis
SSTHNRSSQKKERV

SEQ ID NO: 2205392 - protein, 6 aa, Cryptosporidium hominis
SSTNNC

SEQ ID NO: 2205393 - protein, 19 aa, Cryptosporidium hominis
SSTSVPASVPASASVSAPG

SEQ ID NO: 2205394 - protein, 52 aa, Cryptosporidium hominis
SSTTTTTTTTTTTTTTTTTTTTTTTTTTTTTTTTTTTIPPSMSDEEKSPFVS

SEQ ID NO: 2205395 - protein, 30 aa, Cryptosporidium hominis
SSVSSIDNEGVKESQHSENNEASTSPKLES

SEQ ID NO: 2205396 - protein, 7 aa, Cryptosporidium hominis
SSWDPSN

SEQ ID NO: 2205397 - protein, 27 aa, Cryptosporidium hominis
SSWEPKKSKENSHAEENRNKSNRQSDE

SEQ ID NO: 2205398 - protein, 8 aa, Cryptosporidium hominis
STAGSSVS

SEQ ID NO: 2205399 - protein, 11 aa, Cryptosporidium hominis
STAKPLSKSEL

SEQ ID NO: 2205400 - protein, 5 aa, Cryptosporidium hominis
STDDE

SEQ ID NO: 2205401 - protein, 22 aa, Cryptosporidium hominis
STDEGSNSKVSCSNRKSPCSQM

SEQ ID NO: 2205402 - protein, 11 aa, Cryptosporidium hominis
STDPKKSEMGT

SEQ ID NO: 2205403 - protein, 13 aa, Cryptosporidium hominis
STDPLESCPPGFE

SEQ ID NO: 2205404 - protein, 4 aa, Cryptosporidium hominis
STDT

SEQ ID NO: 2205405 - protein, 24 aa, Cryptosporidium hominis
STEIDNGNFGDSSGNDGRAPIPPM

SEQ ID NO: 2205406 - protein, 7 aa, Cryptosporidium hominis
STEQAQE

SEQ ID NO: 2205407 - protein, 22 aa, Cryptosporidium hominis
STEQDNRENNIPTKGDMNSTSN

SEQ ID NO: 2205408 - protein, 9 aa, Cryptosporidium hominis
STESDLVSS

SEQ ID NO: 2205409 - protein, 19 aa, Cryptosporidium hominis
STETAAFPASRTKYPANTE

SEQ ID NO: 2205410 - protein, 15 aa, Cryptosporidium hominis
STETAALPASRTHYP

SEQ ID NO: 2205411 - protein, 5 aa, Cryptosporidium hominis
STGSP

SEQ ID NO: 2205412 - protein, 5 aa, Cryptosporidium hominis
STGTI

SEQ ID NO: 2205413 - protein, 5 aa, Cryptosporidium hominis
STGTV

SEQ ID NO: 2205414 - protein, 8 aa, Cryptosporidium hominis
STIDSEKV

SEQ ID NO: 2205415 - protein, 8 aa, Cryptosporidium hominis
STIGRAQR

SEQ ID NO: 2205416 - protein, 10 aa, Cryptosporidium hominis
STINTGGKNV

SEQ ID NO: 2205417 - protein, 10 aa, Cryptosporidium hominis
STITAKRRKG

SEQ ID NO: 2205418 - protein, 13 aa, Cryptosporidium hominis
STKLSEDDEIHSV

SEQ ID NO: 2205419 - protein, 5 aa, Cryptosporidium hominis
STKLY

SEQ ID NO: 2205420 - protein, 8 aa, Cryptosporidium hominis
STKNETSQ

SEQ ID NO: 2205421 - protein, 10 aa, Cryptosporidium hominis
STKNSFASSK

SEQ ID NO: 2205422 - protein, 7 aa, Cryptosporidium hominis
STKNVNV

SEQ ID NO: 2205423 - protein, 4 aa, Cryptosporidium hominis
STLA

SEQ ID NO: 2205424 - protein, 9 aa, Cryptosporidium hominis
STLAENNEE

SEQ ID NO: 2205425 - protein, 9 aa, Cryptosporidium hominis
STLRKGTIT

SEQ ID NO: 2205426 - protein, 8 aa, Cryptosporidium hominis
STNAPESQ

SEQ ID NO: 2205427 - protein, 9 aa, Cryptosporidium hominis
STNGNIQGE

SEQ ID NO: 2205428 - protein, 6 aa, Cryptosporidium hominis
STNQTM

SEQ ID NO: 2205429 - protein, 5 aa, Cryptosporidium hominis
STPGE

SEQ ID NO: 2205430 - protein, 5 aa, Cryptosporidium hominis
STPLN

SEQ ID NO: 2205431 - protein, 5 aa, Cryptosporidium hominis
STPND

SEQ ID NO: 2205432 - protein, 21 aa, Cryptosporidium hominis
STPNIRRTPNSSNGDINDQNI

SEQ ID NO: 2205433 - protein, 7 aa, Cryptosporidium hominis
STPSNSG

SEQ ID NO: 2205434 - protein, 5 aa, Cryptosporidium hominis
STPSY

SEQ ID NO: 2205435 - protein, 9 aa, Cryptosporidium hominis
STQSASISD

SEQ ID NO: 2205436 - protein, 5 aa, Cryptosporidium hominis
STQTE

SEQ ID NO: 2205437 - protein, 5 aa, Cryptosporidium hominis
STSAT

SEQ ID NO: 2205438 - protein, 6 aa, Cryptosporidium hominis
STSLTE

SEQ ID NO: 2205439 - protein, 6 aa, Cryptosporidium hominis
STSRKN

SEQ ID NO: 2205440 - protein, 5 aa, Cryptosporidium hominis
STSRL

SEQ ID NO: 2205441 - protein, 7 aa, Cryptosporidium hominis
STSSSTL

SEQ ID NO: 2205442 - protein, 8 aa, Cryptosporidium hominis
STSSWKSC

SEQ ID NO: 2205443 - protein, 8 aa, Cryptosporidium hominis
STSTSERE

SEQ ID NO: 2205444 - protein, 4 aa, Cryptosporidium hominis
STTI

SEQ ID NO: 2205445 - protein, 13 aa, Cryptosporidium hominis
STTTKTTTTQPVK

SEQ ID NO: 2205446 - protein, 4 aa, Cryptosporidium hominis
STTV

SEQ ID NO: 2205447 - protein, 14 aa, Cryptosporidium hominis
STYEGGNASLPASR

SEQ ID NO: 2205448 - protein, 7 aa, Cryptosporidium hominis
STYIPND

SEQ ID NO: 2205449 - protein, 6 aa, Cryptosporidium hominis
SVATNE

SEQ ID NO: 2205450 - protein, 4 aa, Cryptosporidium hominis
SVDE

SEQ ID NO: 2205451 - protein, 8 aa, Cryptosporidium hominis
SVDKPIGD

SEQ ID NO: 2205452 - protein, 7 aa, Cryptosporidium hominis
SVEATKT

SEQ ID NO: 2205453 - protein, 7 aa, Cryptosporidium hominis
SVEDPNG

SEQ ID NO: 2205454 - protein, 8 aa, Cryptosporidium hominis
SVEGEKAA

SEQ ID NO: 2205455 - protein, 6 aa, Cryptosporidium hominis
SVEPID

SEQ ID NO: 2205456 - protein, 57 aa, Cryptosporidium hominis
SVGEETVTAEDKKAKKEKKQKKEKKQKETKAEKEARKQREKEEKLREKQQKEEEKRL

SEQ ID NO: 2205457 - protein, 9 aa, Cryptosporidium hominis
SVKNQNKLE

SEQ ID NO: 2205458 - protein, 9 aa, Cryptosporidium hominis
SVNKIDTSE

SEQ ID NO: 2205459 - protein, 11 aa, Cryptosporidium hominis
SVNSTDDSEKI

SEQ ID NO: 2205460 - protein, 6 aa, Cryptosporidium hominis
SVPKYG

SEQ ID NO: 2205461 - protein, 13 aa, Cryptosporidium hominis
SVREDLEKSATTI

SEQ ID NO: 2205462 - protein, 4 aa, Cryptosporidium hominis
SVRS

SEQ ID NO: 2205463 - protein, 4 aa, Cryptosporidium hominis
SVRT

SEQ ID NO: 2205464 - protein, 19 aa, Cryptosporidium hominis
SVSGSDSKSGSKKEEAAIS

SEQ ID NO: 2205465 - protein, 7 aa, Cryptosporidium hominis
SVSNKEN

SEQ ID NO: 2205466 - protein, 4 aa, Cryptosporidium hominis
SVSR

SEQ ID NO: 2205467 - protein, 17 aa, Cryptosporidium hominis
SVSSEKSINEQTHSSSL

SEQ ID NO: 2205468 - protein, 38 aa, Cryptosporidium hominis
SVSTEDDTGGATSQSRLGSSRRRAYEVPDSGPRRPTSD

SEQ ID NO: 2205469 - protein, 8 aa, Cryptosporidium hominis
SVSTMDSP

SEQ ID NO: 2205470 - protein, 7 aa, Cryptosporidium hominis
SVTDEQI

SEQ ID NO: 2205471 - protein, 9 aa, Cryptosporidium hominis
SVTSPTKFT

SEQ ID NO: 2205472 - protein, 8 aa, Cryptosporidium hominis
SWEDGGVK

SEQ ID NO: 2205473 - protein, 8 aa, Cryptosporidium hominis
SYDSNKNA

SEQ ID NO: 2205474 - protein, 6 aa, Cryptosporidium hominis
SYDSPP

SEQ ID NO: 2205475 - protein, 9 aa, Cryptosporidium hominis
SYGDGWNSG

SEQ ID NO: 2205476 - protein, 13 aa, Cryptosporidium hominis
SYKTNNKDIGATK

SEQ ID NO: 2205477 - protein, 11 aa, Cryptosporidium hominis
SYNRGEEPSKL

SEQ ID NO: 2205478 - protein, 13 aa, Cryptosporidium hominis
SYPSEVENGMETP

SEQ ID NO: 2205479 - protein, 6 aa, Cryptosporidium hominis
SYPTPF

SEQ ID NO: 2205480 - protein, 5 aa, Cryptosporidium hominis
SYQSK

SEQ ID NO: 2205481 - protein, 8 aa, Cryptosporidium hominis
SYSGTGTC

SEQ ID NO: 2205482 - protein, 6 aa, Cryptosporidium hominis
SYSKLS

SEQ ID NO: 2205483 - protein, 7 aa, Cryptosporidium hominis
SYSRTES

SEQ ID NO: 2205484 - protein, 9 aa, Cryptosporidium hominis
SYSSERVSE

SEQ ID NO: 2205485 - protein, 12 aa, Cryptosporidium hominis
SYSSSKDQSLYS

SEQ ID NO: 2205486 - protein, 6 aa, Cryptosporidium hominis
SYTPQN

SEQ ID NO: 2205487 - protein, 9 aa, Cryptosporidium hominis
SYTSPSKGI

SEQ ID NO: 2205488 - protein, 10 aa, Cryptosporidium hominis
SYVPDPHPEG

SEQ ID NO: 2205489 - protein, 4 aa, Cryptosporidium hominis
TAAK

SEQ ID NO: 2205490 - protein, 14 aa, Cryptosporidium hominis
TAAKLSESKLAKPR

SEQ ID NO: 2205491 - protein, 4 aa, Cryptosporidium hominis
TADT

SEQ ID NO: 2205492 - protein, 29 aa, Cryptosporidium hominis
TADTIQKSIQNENKDQRVKASGAEVGQEN

SEQ ID NO: 2205493 - protein, 11 aa, Cryptosporidium hominis
TAEYNENQPYK

SEQ ID NO: 2205494 - protein, 21 aa, Cryptosporidium hominis
TAGAERSNSDSKENGSGSGML

SEQ ID NO: 2205495 - protein, 6 aa, Cryptosporidium hominis
TAINGR

SEQ ID NO: 2205496 - protein, 5 aa, Cryptosporidium hominis
TAKPI

SEQ ID NO: 2205497 - protein, 7 aa, Cryptosporidium hominis
TANEVTD

SEQ ID NO: 2205498 - protein, 7 aa, Cryptosporidium hominis
TANNSSF

SEQ ID NO: 2205499 - protein, 12 aa, Cryptosporidium hominis
TANQLTELSSSE

SEQ ID NO: 2205500 - protein, 8 aa, Cryptosporidium hominis
TANTTLNI

SEQ ID NO: 2205501 - protein, 10 aa, Cryptosporidium hominis
TAPAKPPTFL

SEQ ID NO: 2205502 - protein, 5 aa, Cryptosporidium hominis
TAPPS

SEQ ID NO: 2205503 - protein, 8 aa, Cryptosporidium hominis
TAPSSNSD

SEQ ID NO: 2205504 - protein, 4 aa, Cryptosporidium hominis
TAPY

SEQ ID NO: 2205505 - protein, 6 aa, Cryptosporidium hominis
TAQGTY

SEQ ID NO: 2205506 - protein, 6 aa, Cryptosporidium hominis
TASNAV

SEQ ID NO: 2205507 - protein, 5 aa, Cryptosporidium hominis
TASYA

SEQ ID NO: 2205508 - protein, 6 aa, Cryptosporidium hominis
TATQQE

SEQ ID NO: 2205509 - protein, 32 aa, Cryptosporidium hominis
TATQQLNSTTSTTANANKQIQEASKKNNSQIV

SEQ ID NO: 2205510 - protein, 7 aa, Cryptosporidium hominis
TATTGKP

SEQ ID NO: 2205511 - protein, 9 aa, Cryptosporidium hominis
TCKPKAGTH

SEQ ID NO: 2205512 - protein, 4 aa, Cryptosporidium hominis
TCSI

SEQ ID NO: 2205513 - protein, 9 aa, Cryptosporidium hominis
TCSSSNCPD

SEQ ID NO: 2205514 - protein, 11 aa, Cryptosporidium hominis
TDDSDQTTSEI

SEQ ID NO: 2205515 - protein, 20 aa, Cryptosporidium hominis
TDEGTSNLNRKVAESQSHKY

SEQ ID NO: 2205516 - protein, 7 aa, Cryptosporidium hominis
TDEKGDN

SEQ ID NO: 2205517 - protein, 10 aa, Cryptosporidium hominis
TDGEVSAKVK

SEQ ID NO: 2205518 - protein, 5 aa, Cryptosporidium hominis
TDGRI

SEQ ID NO: 2205519 - protein, 5 aa, Cryptosporidium hominis
TDGSY

SEQ ID NO: 2205520 - protein, 21 aa, Cryptosporidium hominis
TDKTKEKKEREINSDIESPRT

SEQ ID NO: 2205521 - protein, 10 aa, Cryptosporidium hominis
TDNRLEDNTF

SEQ ID NO: 2205522 - protein, 14 aa, Cryptosporidium hominis
TDPPHYDGSSELSE

SEQ ID NO: 2205523 - protein, 6 aa, Cryptosporidium hominis
TDRGTL

SEQ ID NO: 2205524 - protein, 9 aa, Cryptosporidium hominis
TDRHGASEL

SEQ ID NO: 2205525 - protein, 16 aa, Cryptosporidium hominis
TDRSSEKQLRSRVTRE

SEQ ID NO: 2205526 - protein, 5 aa, Cryptosporidium hominis
TDSAK

SEQ ID NO: 2205527 - protein, 10 aa, Cryptosporidium hominis
TDSAKNGSIS

SEQ ID NO: 2205528 - protein, 9 aa, Cryptosporidium hominis
TDSKNNVRE

SEQ ID NO: 2205529 - protein, 6 aa, Cryptosporidium hominis
TDSSQI

SEQ ID NO: 2205530 - protein, 10 aa, Cryptosporidium hominis
TDSTDDAEFV

SEQ ID NO: 2205531 - protein, 8 aa, Cryptosporidium hominis
TDVSSGNH

SEQ ID NO: 2205532 - protein, 11 aa, Cryptosporidium hominis
TEAGQTSTSSV

SEQ ID NO: 2205533 - protein, 4 aa, Cryptosporidium hominis
TEAK

SEQ ID NO: 2205534 - protein, 9 aa, Cryptosporidium hominis
TEAKPNRIT

SEQ ID NO: 2205535 - protein, 5 aa, Cryptosporidium hominis
TEDEL

SEQ ID NO: 2205536 - protein, 5 aa, Cryptosporidium hominis
TEDGK

SEQ ID NO: 2205537 - protein, 9 aa, Cryptosporidium hominis
TEDSQSEIE

SEQ ID NO: 2205538 - protein, 6 aa, Cryptosporidium hominis
TEEENQ

SEQ ID NO: 2205539 - protein, 34 aa, Cryptosporidium hominis
TEENVESPDVTVGGRGLPGPLDRERGPNCKTPCT

SEQ ID NO: 2205540 - protein, 7 aa, Cryptosporidium hominis
TEESNKY

SEQ ID NO: 2205541 - protein, 27 aa, Cryptosporidium hominis
TEETDDEKIKGAGATDRTKTISNTGGK

SEQ ID NO: 2205542 - protein, 22 aa, Cryptosporidium hominis
TEETEESSSRMRERARTSAYNT

SEQ ID NO: 2205543 - protein, 12 aa, Cryptosporidium hominis
TEETSSEPNSGL

SEQ ID NO: 2205544 - protein, 4 aa, Cryptosporidium hominis
TEGW

SEQ ID NO: 2205545 - protein, 5 aa, Cryptosporidium hominis
TEHEV

SEQ ID NO: 2205546 - protein, 13 aa, Cryptosporidium hominis
TEINNKKKASELE

SEQ ID NO: 2205547 - protein, 6 aa, Cryptosporidium hominis
TENENY

SEQ ID NO: 2205548 - protein, 14 aa, Cryptosporidium hominis
TENFETSSLPASRV

SEQ ID NO: 2205549 - protein, 7 aa, Cryptosporidium hominis
TENLSSD

SEQ ID NO: 2205550 - protein, 30 aa, Cryptosporidium hominis
TENPIGTKRMSGRGADRSLLNSSEDSFSKC

SEQ ID NO: 2205551 - protein, 7 aa, Cryptosporidium hominis
TENPNSV

SEQ ID NO: 2205552 - protein, 9 aa, Cryptosporidium hominis
TENSHPGMK

SEQ ID NO: 2205553 - protein, 8 aa, Cryptosporidium hominis
TEPETQSE

SEQ ID NO: 2205554 - protein, 8 aa, Cryptosporidium hominis
TEPQRQPC

SEQ ID NO: 2205555 - protein, 12 aa, Cryptosporidium hominis
TESGAKSNEEIV

SEQ ID NO: 2205556 - protein, 5 aa, Cryptosporidium hominis
TESGY

SEQ ID NO: 2205557 - protein, 14 aa, Cryptosporidium hominis
TESKSGSSSPASRI

SEQ ID NO: 2205558 - protein, 4 aa, Cryptosporidium hominis
TESN

SEQ ID NO: 2205559 - protein, 17 aa, Cryptosporidium hominis
TESNECVANTKSKSENR

SEQ ID NO: 2205560 - protein, 8 aa, Cryptosporidium hominis
TESQNGKH

SEQ ID NO: 2205561 - protein, 5 aa, Cryptosporidium hominis
TESSE

SEQ ID NO: 2205562 - protein, 6 aa, Cryptosporidium hominis
TESTAV

SEQ ID NO: 2205563 - protein, 36 aa, Cryptosporidium hominis
TETSAIAGPNQVSQSAQIEPSKTASISVEPPSPPIS

SEQ ID NO: 2205564 - protein, 15 aa, Cryptosporidium hominis
TEVKPEEPIERPPLG

SEQ ID NO: 2205565 - protein, 31 aa, Cryptosporidium hominis
TEVTKKKRKYGKSFNHKNKKKSNKKKRTKLG

SEQ ID NO: 2205566 - protein, 5 aa, Cryptosporidium hominis
TEWEN

SEQ ID NO: 2205567 - protein, 5 aa, Cryptosporidium hominis
TEYPF

SEQ ID NO: 2205568 - protein, 17 aa, Cryptosporidium hominis
TFDGSSSRCARERSHKK

SEQ ID NO: 2205569 - protein, 8 aa, Cryptosporidium hominis
TFSPETSF

SEQ ID NO: 2205570 - protein, 10 aa, Cryptosporidium hominis
TFSQRQRKSL

SEQ ID NO: 2205571 - protein, 5 aa, Cryptosporidium hominis
TFTST

SEQ ID NO: 2205572 - protein, 13 aa, Cryptosporidium hominis
TGCSSCRASRSYQ

SEQ ID NO: 2205573 - protein, 8 aa, Cryptosporidium hominis
TGDDKADP

SEQ ID NO: 2205574 - protein, 6 aa, Cryptosporidium hominis
TGDYTT

SEQ ID NO: 2205575 - protein, 4 aa, Cryptosporidium hominis
TGEY

SEQ ID NO: 2205576 - protein, 8 aa, Cryptosporidium hominis
TGGEQQFS

SEQ ID NO: 2205577 - protein, 4 aa, Cryptosporidium hominis
TGGG

SEQ ID NO: 2205578 - protein, 9 aa, Cryptosporidium hominis
TGKAYTPAQ

SEQ ID NO: 2205579 - protein, 5 aa, Cryptosporidium hominis
TGKNC

SEQ ID NO: 2205580 - protein, 13 aa, Cryptosporidium hominis
TGKSGEAGTKGGV

SEQ ID NO: 2205581 - protein, 14 aa, Cryptosporidium hominis
TGKVEESKRIRDQL

SEQ ID NO: 2205582 - protein, 9 aa, Cryptosporidium hominis
TGNESPIKE

SEQ ID NO: 2205583 - protein, 14 aa, Cryptosporidium hominis
TGNSGGIIDDGNDY

SEQ ID NO: 2205584 - protein, 10 aa, Cryptosporidium hominis
TGNSSTEEIN

SEQ ID NO: 2205585 - protein, 4 aa, Cryptosporidium hominis
TGNT

SEQ ID NO: 2205586 - protein, 5 aa, Cryptosporidium hominis
TGPAV

SEQ ID NO: 2205587 - protein, 8 aa, Cryptosporidium hominis
TGPEENRL

SEQ ID NO: 2205588 - protein, 7 aa, Cryptosporidium hominis
TGPEQGD

SEQ ID NO: 2205589 - protein, 7 aa, Cryptosporidium hominis
TGQSIKR

SEQ ID NO: 2205590 - protein, 13 aa, Cryptosporidium hominis
TGRALESPTQDLS

SEQ ID NO: 2205591 - protein, 8 aa, Cryptosporidium hominis
TGRNPDVK

SEQ ID NO: 2205592 - protein, 10 aa, Cryptosporidium hominis
TGSEIPTETP

SEQ ID NO: 2205593 - protein, 16 aa, Cryptosporidium hominis
TGSEVRLSGSPKTTLG

SEQ ID NO: 2205594 - protein, 4 aa, Cryptosporidium hominis
TGSI

SEQ ID NO: 2205595 - protein, 12 aa, Cryptosporidium hominis
TGSSSSCPASRS

SEQ ID NO: 2205596 - protein, 7 aa, Cryptosporidium hominis
TGTGTSP

SEQ ID NO: 2205597 - protein, 5 aa, Cryptosporidium hominis
TGVNK

SEQ ID NO: 2205598 - protein, 11 aa, Cryptosporidium hominis
TGVPSRTGAGR

SEQ ID NO: 2205599 - protein, 13 aa, Cryptosporidium hominis
TGVRSGKLPAISK

SEQ ID NO: 2205600 - protein, 14 aa, Cryptosporidium hominis
THPIESGKGPFEKA

SEQ ID NO: 2205601 - protein, 10 aa, Cryptosporidium hominis
THQSLDGQGE

SEQ ID NO: 2205602 - protein, 4 aa, Cryptosporidium hominis
TIGN

SEQ ID NO: 2205603 - protein, 6 aa, Cryptosporidium hominis
TIGTGR

SEQ ID NO: 2205604 - protein, 8 aa, Cryptosporidium hominis
TINESYKS

SEQ ID NO: 2205605 - protein, 13 aa, Cryptosporidium hominis
TINKPENKNRPNS

SEQ ID NO: 2205606 - protein, 5 aa, Cryptosporidium hominis
TINQP

SEQ ID NO: 2205607 - protein, 5 aa, Cryptosporidium hominis
TINRG

SEQ ID NO: 2205608 - protein, 6 aa, Cryptosporidium hominis
TIPEEY

SEQ ID NO: 2205609 - protein, 5 aa, Cryptosporidium hominis
TIRDS

SEQ ID NO: 2205610 - protein, 5 aa, Cryptosporidium hominis
TISER

SEQ ID NO: 2205611 - protein, 6 aa, Cryptosporidium hominis
TISNEE

SEQ ID NO: 2205612 - protein, 12 aa, Cryptosporidium hominis
TISPPAESNSNS

SEQ ID NO: 2205613 - protein, 10 aa, Cryptosporidium hominis
TISSPSNPGL

SEQ ID NO: 2205614 - protein, 5 aa, Cryptosporidium hominis
TITQQ

SEQ ID NO: 2205615 - protein, 9 aa, Cryptosporidium hominis
TKDNDFNNS

SEQ ID NO: 2205616 - protein, 8 aa, Cryptosporidium hominis
TKECPPGF

SEQ ID NO: 2205617 - protein, 16 aa, Cryptosporidium hominis
TKEDTKKFGGSIQRES

SEQ ID NO: 2205618 - protein, 7 aa, Cryptosporidium hominis
TKEGKTH

SEQ ID NO: 2205619 - protein, 6 aa, Cryptosporidium hominis
TKEGNQ

SEQ ID NO: 2205620 - protein, 6 aa, Cryptosporidium hominis
TKGTAE

SEQ ID NO: 2205621 - protein, 7 aa, Cryptosporidium hominis
TKIPISS

SEQ ID NO: 2205622 - protein, 6 aa, Cryptosporidium hominis
TKITES

SEQ ID NO: 2205623 - protein, 8 aa, Cryptosporidium hominis
TKKEETLR

SEQ ID NO: 2205624 - protein, 27 aa, Cryptosporidium hominis
TKKINDSGIKKKPTKNTKIDKTFSELI

SEQ ID NO: 2205625 - protein, 15 aa, Cryptosporidium hominis
TKKKAKSLQPERTNT

SEQ ID NO: 2205626 - protein, 7 aa, Cryptosporidium hominis
TKKSSPL

SEQ ID NO: 2205627 - protein, 7 aa, Cryptosporidium hominis
TKKTSTR

SEQ ID NO: 2205628 - protein, 10 aa, Cryptosporidium hominis
TKKTTSTNTW

SEQ ID NO: 2205629 - protein, 5 aa, Cryptosporidium hominis
TKPLP

SEQ ID NO: 2205630 - protein, 5 aa, Cryptosporidium hominis
TKPST

SEQ ID NO: 2205631 - protein, 8 aa, Cryptosporidium hominis
TKQKENFD

SEQ ID NO: 2205632 - protein, 9 aa, Cryptosporidium hominis
TKQVNSDIN

SEQ ID NO: 2205633 - protein, 6 aa, Cryptosporidium hominis
TKREEY

SEQ ID NO: 2205634 - protein, 9 aa, Cryptosporidium hominis
TKRPGTNLR

SEQ ID NO: 2205635 - protein, 7 aa, Cryptosporidium hominis
TKRRVEN

SEQ ID NO: 2205636 - protein, 8 aa, Cryptosporidium hominis
TKSKGPEI

SEQ ID NO: 2205637 - protein, 8 aa, Cryptosporidium hominis
TKSQSPKI

SEQ ID NO: 2205638 - protein, 17 aa, Cryptosporidium hominis
TKSTPRSINTLSSGKDR

SEQ ID NO: 2205639 - protein, 20 aa, Cryptosporidium hominis
TKTKTPGTACSTKPTTSEMA

SEQ ID NO: 2205640 - protein, 8 aa, Cryptosporidium hominis
TKTNGKLE

SEQ ID NO: 2205641 - protein, 8 aa, Cryptosporidium hominis
TLDKNQQD

SEQ ID NO: 2205642 - protein, 24 aa, Cryptosporidium hominis
TLGHQGSSKSSEPKSKRKPLTKKE

SEQ ID NO: 2205643 - protein, 78 aa, Cryptosporidium hominis
TLPTPPPQTTDSTEATGGGGGGNGSGGGFPNTSTSVPTETTAGSGGSGGSGGGSGGGSGGGSGGGSGGSGGDGDQNQV

SEQ ID NO: 2205644 - protein, 10 aa, Cryptosporidium hominis
TLTQEQTKEA

SEQ ID NO: 2205645 - protein, 18 aa, Cryptosporidium hominis
TNAEATIYEEDASSKTNF

SEQ ID NO: 2205646 - protein, 7 aa, Cryptosporidium hominis
TNDRDSG

SEQ ID NO: 2205647 - protein, 6 aa, Cryptosporidium hominis
TNDVNG

SEQ ID NO: 2205648 - protein, 15 aa, Cryptosporidium hominis
TNEEPDGSVKNYPRD

SEQ ID NO: 2205649 - protein, 10 aa, Cryptosporidium hominis
TNFKGKDSLT

SEQ ID NO: 2205650 - protein, 10 aa, Cryptosporidium hominis
TNGAEAPIKE

SEQ ID NO: 2205651 - protein, 8 aa, Cryptosporidium hominis
TNGKTYEN

SEQ ID NO: 2205652 - protein, 13 aa, Cryptosporidium hominis
TNIGSGKKKRKTI

SEQ ID NO: 2205653 - protein, 8 aa, Cryptosporidium hominis
TNISEKES

SEQ ID NO: 2205654 - protein, 8 aa, Cryptosporidium hominis
TNKDEIQE

SEQ ID NO: 2205655 - protein, 17 aa, Cryptosporidium hominis
TNKDNNLESFNNGAPEY

SEQ ID NO: 2205656 - protein, 10 aa, Cryptosporidium hominis
TNKKDKGYSI

SEQ ID NO: 2205657 - protein, 12 aa, Cryptosporidium hominis
TNKKQRKQGQKR

SEQ ID NO: 2205658 - protein, 15 aa, Cryptosporidium hominis
TNKSREQLLKLFINK

SEQ ID NO: 2205659 - protein, 4 aa, Cryptosporidium hominis
TNLA

SEQ ID NO: 2205660 - protein, 13 aa, Cryptosporidium hominis
TNNEKAQANDEEI

SEQ ID NO: 2205661 - protein, 7 aa, Cryptosporidium hominis
TNNYPNF

SEQ ID NO: 2205662 - protein, 12 aa, Cryptosporidium hominis
TNNYTNKVNATI

SEQ ID NO: 2205663 - protein, 6 aa, Cryptosporidium hominis
TNPEIT

SEQ ID NO: 2205664 - protein, 8 aa, Cryptosporidium hominis
TNSDDSEM

SEQ ID NO: 2205665 - protein, 10 aa, Cryptosporidium hominis
TNSGNGPDCE

SEQ ID NO: 2205666 - protein, 16 aa, Cryptosporidium hominis
TNSNETQTKNSKIDPI

SEQ ID NO: 2205667 - protein, 6 aa, Cryptosporidium hominis
TNSPNY

SEQ ID NO: 2205668 - protein, 10 aa, Cryptosporidium hominis
TNSRSENDER

SEQ ID NO: 2205669 - protein, 5 aa, Cryptosporidium hominis
TNTGG

SEQ ID NO: 2205670 - protein, 4 aa, Cryptosporidium hominis
TNTP

SEQ ID NO: 2205671 - protein, 52 aa, Cryptosporidium hominis
TNTPGTSRRLDSQRSGSVSTDSVHRRTSTNSQRRSSNVASGTLSDEPTPPHP

SEQ ID NO: 2205672 - protein, 6 aa, Cryptosporidium hominis
TNTTEI

SEQ ID NO: 2205673 - protein, 30 aa, Cryptosporidium hominis
TNTTGSSNQDSTIDNGSFEGKKDKSKQEFS

SEQ ID NO: 2205674 - protein, 15 aa, Cryptosporidium hominis
TNTVTSHSDSRTFKN

SEQ ID NO: 2205675 - protein, 11 aa, Cryptosporidium hominis
TNYKTRGANNY

SEQ ID NO: 2205676 - protein, 8 aa, Cryptosporidium hominis
TNYNSGGY

SEQ ID NO: 2205677 - protein, 23 aa, Cryptosporidium hominis
TNYSDHNASFPASRTHYPADPNH

SEQ ID NO: 2205678 - protein, 6 aa, Cryptosporidium hominis
TPDTQN

SEQ ID NO: 2205679 - protein, 7 aa, Cryptosporidium hominis
TPEHPGL

SEQ ID NO: 2205680 - protein, 4 aa, Cryptosporidium hominis
TPHL

SEQ ID NO: 2205681 - protein, 16 aa, Cryptosporidium hominis
TPISVSSKKSCNTITP

SEQ ID NO: 2205682 - protein, 10 aa, Cryptosporidium hominis
TPKKPSLDAF

SEQ ID NO: 2205683 - protein, 8 aa, Cryptosporidium hominis
TPKTPTLG

SEQ ID NO: 2205684 - protein, 6 aa, Cryptosporidium hominis
TPNIPG

SEQ ID NO: 2205685 - protein, 10 aa, Cryptosporidium hominis
TPNKELNSQL

SEQ ID NO: 2205686 - protein, 8 aa, Cryptosporidium hominis
TPPGTSDE

SEQ ID NO: 2205687 - protein, 9 aa, Cryptosporidium hominis
TPPSSDEIE

SEQ ID NO: 2205688 - protein, 5 aa, Cryptosporidium hominis
TPPTG

SEQ ID NO: 2205689 - protein, 14 aa, Cryptosporidium hominis
TPQRDLPISKPTPL

SEQ ID NO: 2205690 - protein, 5 aa, Cryptosporidium hominis
TPSGG

SEQ ID NO: 2205691 - protein, 14 aa, Cryptosporidium hominis
TPSKFSNKNPELTE

SEQ ID NO: 2205692 - protein, 18 aa, Cryptosporidium hominis
TPTLSQTHKSYSTSSPKI

SEQ ID NO: 2205693 - protein, 5 aa, Cryptosporidium hominis
TPTPT

SEQ ID NO: 2205694 - protein, 4 aa, Cryptosporidium hominis
TPTS

SEQ ID NO: 2205695 - protein, 13 aa, Cryptosporidium hominis
TPVETRKVQNDPK

SEQ ID NO: 2205696 - protein, 4 aa, Cryptosporidium hominis
TPVY

SEQ ID NO: 2205697 - protein, 5 aa, Cryptosporidium hominis
TPYPI

SEQ ID NO: 2205698 - protein, 8 aa, Cryptosporidium hominis
TQADRTRS

SEQ ID NO: 2205699 - protein, 12 aa, Cryptosporidium hominis
TQANKTSISGNS

SEQ ID NO: 2205700 - protein, 4 aa, Cryptosporidium hominis
TQKK

SEQ ID NO: 2205701 - protein, 5 aa, Cryptosporidium hominis
TQLPP

SEQ ID NO: 2205702 - protein, 9 aa, Cryptosporidium hominis
TQNVSNSNT

SEQ ID NO: 2205703 - protein, 10 aa, Cryptosporidium hominis
TQQENGPDCA

SEQ ID NO: 2205704 - protein, 18 aa, Cryptosporidium hominis
TQQNENQEQGVNKESNSM

SEQ ID NO: 2205705 - protein, 10 aa, Cryptosporidium hominis
TQSNTTVDEN

SEQ ID NO: 2205706 - protein, 6 aa, Cryptosporidium hominis
TQSVKD

SEQ ID NO: 2205707 - protein, 6 aa, Cryptosporidium hominis
TQTSSI

SEQ ID NO: 2205708 - protein, 19 aa, Cryptosporidium hominis
TRATADKKHHEDKEKGKKV

SEQ ID NO: 2205709 - protein, 41 aa, Cryptosporidium hominis
TRDQAAYNKSIQSGTTPAPTPAPTPAPTPIPIPAPTPVPLP

SEQ ID NO: 2205710 - protein, 4 aa, Cryptosporidium hominis
TRDT

SEQ ID NO: 2205711 - protein, 4 aa, Cryptosporidium hominis
TREG

SEQ ID NO: 2205712 - protein, 20 aa, Cryptosporidium hominis
TRESIENKTYSPENKSVSKP

SEQ ID NO: 2205713 - protein, 18 aa, Cryptosporidium hominis
TRGIKTGHQNNDESRIST

SEQ ID NO: 2205714 - protein, 7 aa, Cryptosporidium hominis
TRIDKTH

SEQ ID NO: 2205715 - protein, 16 aa, Cryptosporidium hominis
TRKDAKPEDSKSSSIP

SEQ ID NO: 2205716 - protein, 6 aa, Cryptosporidium hominis
TRLDSP

SEQ ID NO: 2205717 - protein, 19 aa, Cryptosporidium hominis
TRNIRGTRGFGQGATGARL

SEQ ID NO: 2205718 - protein, 13 aa, Cryptosporidium hominis
TRNSNRRRRRESR

SEQ ID NO: 2205719 - protein, 8 aa, Cryptosporidium hominis
TRPSSPNV

SEQ ID NO: 2205720 - protein, 6 aa, Cryptosporidium hominis
TRSNSN

SEQ ID NO: 2205721 - protein, 6 aa, Cryptosporidium hominis
TRTDDF

SEQ ID NO: 2205722 - protein, 8 aa, Cryptosporidium hominis
TSASIGEN

SEQ ID NO: 2205723 - protein, 10 aa, Cryptosporidium hominis
TSDIEDNEFE

SEQ ID NO: 2205724 - protein, 7 aa, Cryptosporidium hominis
TSDNESR

SEQ ID NO: 2205725 - protein, 16 aa, Cryptosporidium hominis
TSDSNSSGNEQAPSDS

SEQ ID NO: 2205726 - protein, 8 aa, Cryptosporidium hominis
TSEAAQEK

SEQ ID NO: 2205727 - protein, 14 aa, Cryptosporidium hominis
TSEDADQSVSGELD

SEQ ID NO: 2205728 - protein, 9 aa, Cryptosporidium hominis
TSEIQNPGH

SEQ ID NO: 2205729 - protein, 8 aa, Cryptosporidium hominis
TSESRNKE

SEQ ID NO: 2205730 - protein, 21 aa, Cryptosporidium hominis
TSFNTPEPTITRESTGNCLNP

SEQ ID NO: 2205731 - protein, 6 aa, Cryptosporidium hominis
TSGESR

SEQ ID NO: 2205732 - protein, 4 aa, Cryptosporidium hominis
TSGH

SEQ ID NO: 2205733 - protein, 5 aa, Cryptosporidium hominis
TSGIS

SEQ ID NO: 2205734 - protein, 17 aa, Cryptosporidium hominis
TSHSNSANSIKREEHRK

SEQ ID NO: 2205735 - protein, 6 aa, Cryptosporidium hominis
TSIDSN

SEQ ID NO: 2205736 - protein, 5 aa, Cryptosporidium hominis
TSINP

SEQ ID NO: 2205737 - protein, 14 aa, Cryptosporidium hominis
TSISEVSRNKRPLT

SEQ ID NO: 2205738 - protein, 5 aa, Cryptosporidium hominis
TSITQ

SEQ ID NO: 2205739 - protein, 8 aa, Cryptosporidium hominis
TSKDSAEY

SEQ ID NO: 2205740 - protein, 20 aa, Cryptosporidium hominis
TSKNEENSELSDKDLSKNCN

SEQ ID NO: 2205741 - protein, 31 aa, Cryptosporidium hominis
TSKTLNENNNTPKEDHHRKSRRNRQSSAPKL

SEQ ID NO: 2205742 - protein, 7 aa, Cryptosporidium hominis
TSNLVGE

SEQ ID NO: 2205743 - protein, 139 aa, Cryptosporidium hominis
TSPASSIEPHVSSTNGSTVDSGESDKKAEKAKKNKKQKEKKEKKEKKAKKGKKAKKSEVKEEGAQDGVKEGGQEGPQEGPVEETEGKKGKKDKKAKKEKKAKKEKKAKKEKKVETQEGATATTAATAAEQEAAPVEQRT

SEQ ID NO: 2205744 - protein, 10 aa, Cryptosporidium hominis
TSPDISESQI

SEQ ID NO: 2205745 - protein, 6 aa, Cryptosporidium hominis
TSPHRD

SEQ ID NO: 2205746 - protein, 4 aa, Cryptosporidium hominis
TSPV

SEQ ID NO: 2205747 - protein, 5 aa, Cryptosporidium hominis
TSRSY

SEQ ID NO: 2205748 - protein, 11 aa, Cryptosporidium hominis
TSSAPTQPVCP

SEQ ID NO: 2205749 - protein, 8 aa, Cryptosporidium hominis
TSSGSFVG

SEQ ID NO: 2205750 - protein, 5 aa, Cryptosporidium hominis
TSSNE

SEQ ID NO: 2205751 - protein, 8 aa, Cryptosporidium hominis
TSSPEENI

SEQ ID NO: 2205752 - protein, 6 aa, Cryptosporidium hominis
TSSSFE

SEQ ID NO: 2205753 - protein, 25 aa, Cryptosporidium hominis
TSSSKKTTTTTAEVTGVGESIPPLG

SEQ ID NO: 2205754 - protein, 14 aa, Cryptosporidium hominis
TSSSLNSKSEDLRE

SEQ ID NO: 2205755 - protein, 7 aa, Cryptosporidium hominis
TSSSSCR

SEQ ID NO: 2205756 - protein, 7 aa, Cryptosporidium hominis
TSSVNEV

SEQ ID NO: 2205757 - protein, 9 aa, Cryptosporidium hominis
TSTKNNFPT

SEQ ID NO: 2205758 - protein, 15 aa, Cryptosporidium hominis
TSTLTSSNDLTAISS

SEQ ID NO: 2205759 - protein, 5 aa, Cryptosporidium hominis
TSTSA

SEQ ID NO: 2205760 - protein, 5 aa, Cryptosporidium hominis
TSVPE

SEQ ID NO: 2205761 - protein, 6 aa, Cryptosporidium hominis
TSVSRT

SEQ ID NO: 2205762 - protein, 10 aa, Cryptosporidium hominis
TTDSKSPELE

SEQ ID NO: 2205763 - protein, 13 aa, Cryptosporidium hominis
TTEGEKGKSRLES

SEQ ID NO: 2205764 - protein, 13 aa, Cryptosporidium hominis
TTESNSDSKTDFD

SEQ ID NO: 2205765 - protein, 4 aa, Cryptosporidium hominis
TTET

SEQ ID NO: 2205766 - protein, 10 aa, Cryptosporidium hominis
TTFQKDDNTK

SEQ ID NO: 2205767 - protein, 9 aa, Cryptosporidium hominis
TTGRQQKLG

SEQ ID NO: 2205768 - protein, 16 aa, Cryptosporidium hominis
TTGYTSENMQQAPATT

SEQ ID NO: 2205769 - protein, 8 aa, Cryptosporidium hominis
TTKENSSF

SEQ ID NO: 2205770 - protein, 14 aa, Cryptosporidium hominis
TTKQGTKSNTGSIL

SEQ ID NO: 2205771 - protein, 5 aa, Cryptosporidium hominis
TTLKD

SEQ ID NO: 2205772 - protein, 12 aa, Cryptosporidium hominis
TTLSKTPDTQIK

SEQ ID NO: 2205773 - protein, 13 aa, Cryptosporidium hominis
TTNKFNKETGLSI

SEQ ID NO: 2205774 - protein, 6 aa, Cryptosporidium hominis
TTNSEG

SEQ ID NO: 2205775 - protein, 7 aa, Cryptosporidium hominis
TTPDPLT

SEQ ID NO: 2205776 - protein, 8 aa, Cryptosporidium hominis
TTPGLVDS

SEQ ID NO: 2205777 - protein, 5 aa, Cryptosporidium hominis
TTPSV

SEQ ID NO: 2205778 - protein, 13 aa, Cryptosporidium hominis
TTQVETKAPLSES

SEQ ID NO: 2205779 - protein, 4 aa, Cryptosporidium hominis
TTSD

SEQ ID NO: 2205780 - protein, 20 aa, Cryptosporidium hominis
TTSQYEPLGSAEDSNSLRPP

SEQ ID NO: 2205781 - protein, 81 aa, Cryptosporidium hominis
TTSTTTTTTSTSTSTSTTTENTSTNFESDSSSESTSEYTSTSTSSTITSDIEPTSTSTSASTSASPTSTTTFATSTKSSRK

SEQ ID NO: 2205782 - protein, 49 aa, Cryptosporidium hominis
TTTATKTSTITTTTTTTTTTTTTTTTTTTTTTTITTTTTTTTTTTTTTT

SEQ ID NO: 2205783 - protein, 37 aa, Cryptosporidium hominis
TTTTTTPRPTRIPPPRPPLPKFTGNKDASRPAPSDSI

SEQ ID NO: 2205784 - protein, 26 aa, Cryptosporidium hominis
TVEQDSSSSPDESSSKEQSRTRSLGP

SEQ ID NO: 2205785 - protein, 10 aa, Cryptosporidium hominis
TVGNVSREKA

SEQ ID NO: 2205786 - protein, 17 aa, Cryptosporidium hominis
TVKHSEKSLDIEDEKQY

SEQ ID NO: 2205787 - protein, 7 aa, Cryptosporidium hominis
TVNSGAN

SEQ ID NO: 2205788 - protein, 83 aa, Cryptosporidium hominis
TVPPRTQEGNEHNEQSEESEEKHSCCSSSSCKSKKLSSNNGSSNGGSNGDSNSGGNGGSNGNEDDPQNPYAGYTGRLNSAFTT

SEQ ID NO: 2205789 - protein, 9 aa, Cryptosporidium hominis
TVSKKRSAR

SEQ ID NO: 2205790 - protein, 10 aa, Cryptosporidium hominis
TVSSNYNSNF

SEQ ID NO: 2205791 - protein, 7 aa, Cryptosporidium hominis
TVTECTN

SEQ ID NO: 2205792 - protein, 10 aa, Cryptosporidium hominis
TYEPNNTNSI

SEQ ID NO: 2205793 - protein, 4 aa, Cryptosporidium hominis
TYFQ

SEQ ID NO: 2205794 - protein, 20 aa, Cryptosporidium hominis
TYNEAKASIEESQSSGTPFS

SEQ ID NO: 2205795 - protein, 9 aa, Cryptosporidium hominis
VAKGGDANV

SEQ ID NO: 2205796 - protein, 6 aa, Cryptosporidium hominis
VANSEK

SEQ ID NO: 2205797 - protein, 5 aa, Cryptosporidium hominis
VAPTL

SEQ ID NO: 2205798 - protein, 21 aa, Cryptosporidium hominis
VAQGTRRSLGTASNHPHHSSG

SEQ ID NO: 2205799 - protein, 6 aa, Cryptosporidium hominis
VASKGG

SEQ ID NO: 2205800 - protein, 60 aa, Cryptosporidium hominis
VASPAEVSSIAGTPIPTPPSFSPPPPPIPPPPSFSPPPPPIPPPPSSPPPPPPVPEYPPL

SEQ ID NO: 2205801 - protein, 15 aa, Cryptosporidium hominis
VASTRKSESLPTSAE

SEQ ID NO: 2205802 - protein, 5 aa, Cryptosporidium hominis
VATQA

SEQ ID NO: 2205803 - protein, 77 aa, Cryptosporidium hominis
VCESSDTGSGSSDLESSKNSDNDTESDAASQGSHESNTSSGGESSTSSQRSTWGPPSRLQPYDVGDGGSQASSPVDQ

SEQ ID NO: 2205804 - protein, 6 aa, Cryptosporidium hominis
VCPNGD

SEQ ID NO: 2205805 - protein, 7 aa, Cryptosporidium hominis
VCTPKGY

SEQ ID NO: 2205806 - protein, 7 aa, Cryptosporidium hominis
VDLAGQD

SEQ ID NO: 2205807 - protein, 5 aa, Cryptosporidium hominis
VDPSR

SEQ ID NO: 2205808 - protein, 4 aa, Cryptosporidium hominis
VDSI

SEQ ID NO: 2205809 - protein, 9 aa, Cryptosporidium hominis
VDSPDAGIA

SEQ ID NO: 2205810 - protein, 20 aa, Cryptosporidium hominis
VDSVDKKKSLKSAAKAKSRE

SEQ ID NO: 2205811 - protein, 8 aa, Cryptosporidium hominis
VDTDKDGY

SEQ ID NO: 2205812 - protein, 12 aa, Cryptosporidium hominis
VDTVTESGEIDI

SEQ ID NO: 2205813 - protein, 13 aa, Cryptosporidium hominis
VEAAPDESEIDSE

SEQ ID NO: 2205814 - protein, 6 aa, Cryptosporidium hominis
VECPPG

SEQ ID NO: 2205815 - protein, 12 aa, Cryptosporidium hominis
VEDEAISGPSNS

SEQ ID NO: 2205816 - protein, 8 aa, Cryptosporidium hominis
VEDGKETV

SEQ ID NO: 2205817 - protein, 14 aa, Cryptosporidium hominis
VEESPESGEEREGE

SEQ ID NO: 2205818 - protein, 8 aa, Cryptosporidium hominis
VEGNNSNK

SEQ ID NO: 2205819 - protein, 11 aa, Cryptosporidium hominis
VEGNPSNTTLN

SEQ ID NO: 2205820 - protein, 14 aa, Cryptosporidium hominis
VEGSEKSARESEEK

SEQ ID NO: 2205821 - protein, 12 aa, Cryptosporidium hominis
VEKTRSNTKNPF

SEQ ID NO: 2205822 - protein, 9 aa, Cryptosporidium hominis
VENPKNPSF

SEQ ID NO: 2205823 - protein, 11 aa, Cryptosporidium hominis
VEPSRDPSLSQ

SEQ ID NO: 2205824 - protein, 10 aa, Cryptosporidium hominis
VEPSTSQQRS

SEQ ID NO: 2205825 - protein, 9 aa, Cryptosporidium hominis
VERDKTTWK

SEQ ID NO: 2205826 - protein, 6 aa, Cryptosporidium hominis
VESEYD

SEQ ID NO: 2205827 - protein, 10 aa, Cryptosporidium hominis
VESQSQRIDE

SEQ ID NO: 2205828 - protein, 8 aa, Cryptosporidium hominis
VEYDSSEM

SEQ ID NO: 2205829 - protein, 5 aa, Cryptosporidium hominis
VFSPD

SEQ ID NO: 2205830 - protein, 13 aa, Cryptosporidium hominis
VGAESTNQEVNEQ

SEQ ID NO: 2205831 - protein, 24 aa, Cryptosporidium hominis
VGEKGPASQSESKTDLETSHPDKF

SEQ ID NO: 2205832 - protein, 8 aa, Cryptosporidium hominis
VGENQEKC

SEQ ID NO: 2205833 - protein, 6 aa, Cryptosporidium hominis
VGENSG

SEQ ID NO: 2205834 - protein, 13 aa, Cryptosporidium hominis
VGESNPLPAQTKS

SEQ ID NO: 2205835 - protein, 13 aa, Cryptosporidium hominis
VGGNHEEQEPEEV

SEQ ID NO: 2205836 - protein, 8 aa, Cryptosporidium hominis
VGGRSEDS

SEQ ID NO: 2205837 - protein, 19 aa, Cryptosporidium hominis
VGGTKKSSLGGSGSSGSEI

SEQ ID NO: 2205838 - protein, 5 aa, Cryptosporidium hominis
VGKAK

SEQ ID NO: 2205839 - protein, 13 aa, Cryptosporidium hominis
VGNEPGDEPNIPA

SEQ ID NO: 2205840 - protein, 6 aa, Cryptosporidium hominis
VGNVDN

SEQ ID NO: 2205841 - protein, 7 aa, Cryptosporidium hominis
VGPPRGQ

SEQ ID NO: 2205842 - protein, 5 aa, Cryptosporidium hominis
VGPTF

SEQ ID NO: 2205843 - protein, 6 aa, Cryptosporidium hominis
VGPVGT

SEQ ID NO: 2205844 - protein, 12 aa, Cryptosporidium hominis
VGQSYDKKDGNC

SEQ ID NO: 2205845 - protein, 6 aa, Cryptosporidium hominis
VGSNSQ

SEQ ID NO: 2205846 - protein, 4 aa, Cryptosporidium hominis
VGSQ

SEQ ID NO: 2205847 - protein, 16 aa, Cryptosporidium hominis
VGSRPESDTTTGVKGE

SEQ ID NO: 2205848 - protein, 5 aa, Cryptosporidium hominis
VGTKR

SEQ ID NO: 2205849 - protein, 9 aa, Cryptosporidium hominis
VHKSSSTSL

SEQ ID NO: 2205850 - protein, 6 aa, Cryptosporidium hominis
VIDTGS

SEQ ID NO: 2205851 - protein, 17 aa, Cryptosporidium hominis
VIPDSSGTTVVTSGNPI

SEQ ID NO: 2205852 - protein, 9 aa, Cryptosporidium hominis
VKAGNVKPI

SEQ ID NO: 2205853 - protein, 7 aa, Cryptosporidium hominis
VKDPSTI

SEQ ID NO: 2205854 - protein, 7 aa, Cryptosporidium hominis
VKDSNKY

SEQ ID NO: 2205855 - protein, 19 aa, Cryptosporidium hominis
VKDTDEEKKNNETDNEKDS

SEQ ID NO: 2205856 - protein, 7 aa, Cryptosporidium hominis
VKEYSPE

SEQ ID NO: 2205857 - protein, 11 aa, Cryptosporidium hominis
VKGECKKGKCV

SEQ ID NO: 2205858 - protein, 14 aa, Cryptosporidium hominis
VKGNAEKNQNTNQN

SEQ ID NO: 2205859 - protein, 8 aa, Cryptosporidium hominis
VKGSNPVT

SEQ ID NO: 2205860 - protein, 36 aa, Cryptosporidium hominis
VKGTNEEEDGSLPTSTTTKTISESYPKSDEKDEKEE

SEQ ID NO: 2205861 - protein, 7 aa, Cryptosporidium hominis
VKHQSQR

SEQ ID NO: 2205862 - protein, 6 aa, Cryptosporidium hominis
VKPSKS

SEQ ID NO: 2205863 - protein, 7 aa, Cryptosporidium hominis
VKPVQKS

SEQ ID NO: 2205864 - protein, 4 aa, Cryptosporidium hominis
VKQS

SEQ ID NO: 2205865 - protein, 21 aa, Cryptosporidium hominis
VKRRHNEDKRKKERSKGIPSR

SEQ ID NO: 2205866 - protein, 22 aa, Cryptosporidium hominis
VKRVNSKVRSTGIERTKNPEVL

SEQ ID NO: 2205867 - protein, 10 aa, Cryptosporidium hominis
VKSNPSKPNI

SEQ ID NO: 2205868 - protein, 20 aa, Cryptosporidium hominis
VKTESAPRLTECPPGTTLEN

SEQ ID NO: 2205869 - protein, 8 aa, Cryptosporidium hominis
VKYSEDES

SEQ ID NO: 2205870 - protein, 7 aa, Cryptosporidium hominis
VLKGESK

SEQ ID NO: 2205871 - protein, 4 aa, Cryptosporidium hominis
VNAN

SEQ ID NO: 2205872 - protein, 4 aa, Cryptosporidium hominis
VNCN

SEQ ID NO: 2205873 - protein, 7 aa, Cryptosporidium hominis
VNESNPT

SEQ ID NO: 2205874 - protein, 9 aa, Cryptosporidium hominis
VNESSKAEV

SEQ ID NO: 2205875 - protein, 9 aa, Cryptosporidium hominis
VNGKNDSKF

SEQ ID NO: 2205876 - protein, 8 aa, Cryptosporidium hominis
VNKDPTEL

SEQ ID NO: 2205877 - protein, 7 aa, Cryptosporidium hominis
VNNETAL

SEQ ID NO: 2205878 - protein, 10 aa, Cryptosporidium hominis
VNNNKDIDNH

SEQ ID NO: 2205879 - protein, 7 aa, Cryptosporidium hominis
VNPPNIK

SEQ ID NO: 2205880 - protein, 10 aa, Cryptosporidium hominis
VNPTDEGIDA

SEQ ID NO: 2205881 - protein, 12 aa, Cryptosporidium hominis
VNQEHEKNIPNK

SEQ ID NO: 2205882 - protein, 6 aa, Cryptosporidium hominis
VNQTSS

SEQ ID NO: 2205883 - protein, 5 aa, Cryptosporidium hominis
VNSQH

SEQ ID NO: 2205884 - protein, 57 aa, Cryptosporidium hominis
VNSSLDSSSGQISESVAAEEAGIDKEQKLDLTGESSPTVEAERVTGEVKADETSNEV

SEQ ID NO: 2205885 - protein, 9 aa, Cryptosporidium hominis
VPALPPRRQ

SEQ ID NO: 2205886 - protein, 17 aa, Cryptosporidium hominis
VPASAPAPAPAPASAPG

SEQ ID NO: 2205887 - protein, 4 aa, Cryptosporidium hominis
VPDD

SEQ ID NO: 2205888 - protein, 11 aa, Cryptosporidium hominis
VPDETSEEQNT

SEQ ID NO: 2205889 - protein, 12 aa, Cryptosporidium hominis
VPDPKQSDVAPA

SEQ ID NO: 2205890 - protein, 5 aa, Cryptosporidium hominis
VPGSP

SEQ ID NO: 2205891 - protein, 10 aa, Cryptosporidium hominis
VPGTNSHGTN

SEQ ID NO: 2205892 - protein, 6 aa, Cryptosporidium hominis
VPKKEF

SEQ ID NO: 2205893 - protein, 6 aa, Cryptosporidium hominis
VPKPVA

SEQ ID NO: 2205894 - protein, 8 aa, Cryptosporidium hominis
VPNQESSK

SEQ ID NO: 2205895 - protein, 4 aa, Cryptosporidium hominis
VPPR

SEQ ID NO: 2205896 - protein, 29 aa, Cryptosporidium hominis
VPPTPIPTPKAPTLSPLPPLPPTSKVPTL

SEQ ID NO: 2205897 - protein, 7 aa, Cryptosporidium hominis
VPQTTAL

SEQ ID NO: 2205898 - protein, 17 aa, Cryptosporidium hominis
VPRPDSLKSRYPENTSH

SEQ ID NO: 2205899 - protein, 7 aa, Cryptosporidium hominis
VPSENEI

SEQ ID NO: 2205900 - protein, 9 aa, Cryptosporidium hominis
VPSGSYDKS

SEQ ID NO: 2205901 - protein, 9 aa, Cryptosporidium hominis
VPSKSCPSG

SEQ ID NO: 2205902 - protein, 5 aa, Cryptosporidium hominis
VPTQK

SEQ ID NO: 2205903 - protein, 8 aa, Cryptosporidium hominis
VQDEEENV

SEQ ID NO: 2205904 - protein, 4 aa, Cryptosporidium hominis
VQNS

SEQ ID NO: 2205905 - protein, 7 aa, Cryptosporidium hominis
VQQYDGP

SEQ ID NO: 2205906 - protein, 15 aa, Cryptosporidium hominis
VQSDTAPPNPECPPG

SEQ ID NO: 2205907 - protein, 11 aa, Cryptosporidium hominis
VQSNKSSKSMI

SEQ ID NO: 2205908 - protein, 10 aa, Cryptosporidium hominis
VQSSSDSSSI

SEQ ID NO: 2205909 - protein, 12 aa, Cryptosporidium hominis
VQSTSQKGYSHG

SEQ ID NO: 2205910 - protein, 5 aa, Cryptosporidium hominis
VQTTR

SEQ ID NO: 2205911 - protein, 23 aa, Cryptosporidium hominis
VQTTTSPKTPECPPGSALDGDSC

SEQ ID NO: 2205912 - protein, 17 aa, Cryptosporidium hominis
VREEEQISGSKNNTDEP

SEQ ID NO: 2205913 - protein, 8 aa, Cryptosporidium hominis
VRGTTNLK

SEQ ID NO: 2205914 - protein, 14 aa, Cryptosporidium hominis
VRNGGKSSVDSQEN

SEQ ID NO: 2205915 - protein, 11 aa, Cryptosporidium hominis
VRNPGEHGHSD

SEQ ID NO: 2205916 - protein, 8 aa, Cryptosporidium hominis
VRSPTQSQ

SEQ ID NO: 2205917 - protein, 8 aa, Cryptosporidium hominis
VRSSQPAA

SEQ ID NO: 2205918 - protein, 4 aa, Cryptosporidium hominis
VSAN

SEQ ID NO: 2205919 - protein, 9 aa, Cryptosporidium hominis
VSASKVNEK

SEQ ID NO: 2205920 - protein, 41 aa, Cryptosporidium hominis
VSDETTTTTKSTTTTTTAVTTASPSPRTPSSDYSPSPLTES

SEQ ID NO: 2205921 - protein, 4 aa, Cryptosporidium hominis
VSEF

SEQ ID NO: 2205922 - protein, 6 aa, Cryptosporidium hominis
VSESNT

SEQ ID NO: 2205923 - protein, 6 aa, Cryptosporidium hominis
VSEYRT

SEQ ID NO: 2205924 - protein, 8 aa, Cryptosporidium hominis
VSGTPSVS

SEQ ID NO: 2205925 - protein, 4 aa, Cryptosporidium hominis
VSGY

SEQ ID NO: 2205926 - protein, 10 aa, Cryptosporidium hominis
VSKDVEEDLK

SEQ ID NO: 2205927 - protein, 26 aa, Cryptosporidium hominis
VSKQKSVETNGSSDEQKEEEDKEIDN

SEQ ID NO: 2205928 - protein, 8 aa, Cryptosporidium hominis
VSNDPIRT

SEQ ID NO: 2205929 - protein, 6 aa, Cryptosporidium hominis
VSNEKS

SEQ ID NO: 2205930 - protein, 10 aa, Cryptosporidium hominis
VSNNPKDNPD

SEQ ID NO: 2205931 - protein, 7 aa, Cryptosporidium hominis
VSNTQVQ

SEQ ID NO: 2205932 - protein, 5 aa, Cryptosporidium hominis
VSPDG

SEQ ID NO: 2205933 - protein, 9 aa, Cryptosporidium hominis
VSPENQHDY

SEQ ID NO: 2205934 - protein, 6 aa, Cryptosporidium hominis
VSPKTV

SEQ ID NO: 2205935 - protein, 6 aa, Cryptosporidium hominis
VSPQCG

SEQ ID NO: 2205936 - protein, 4 aa, Cryptosporidium hominis
VSPR

SEQ ID NO: 2205937 - protein, 55 aa, Cryptosporidium hominis
VSPTSVPTSALASASAPVPAPVPAPAPVPAPTPSLTTYPTPVPYPVPGPTLAPTT

SEQ ID NO: 2205938 - protein, 8 aa, Cryptosporidium hominis
VSQAPEDV

SEQ ID NO: 2205939 - protein, 38 aa, Cryptosporidium hominis
VSQPGPYQTNVKPRPPYPLPQTPQLYPSPSPYPSPTPM

SEQ ID NO: 2205940 - protein, 9 aa, Cryptosporidium hominis
VSQRLNGDE

SEQ ID NO: 2205941 - protein, 14 aa, Cryptosporidium hominis
VSRNDDPNSNHGDK

SEQ ID NO: 2205942 - protein, 15 aa, Cryptosporidium hominis
VSRNKNNSSNESIDF

SEQ ID NO: 2205943 - protein, 8 aa, Cryptosporidium hominis
VSRNNDNM

SEQ ID NO: 2205944 - protein, 7 aa, Cryptosporidium hominis
VSSNNTQ

SEQ ID NO: 2205945 - protein, 4 aa, Cryptosporidium hominis
VSSP

SEQ ID NO: 2205946 - protein, 7 aa, Cryptosporidium hominis
VSSSNTR

SEQ ID NO: 2205947 - protein, 20 aa, Cryptosporidium hominis
VSSSNTYENLRSSRTANYSP

SEQ ID NO: 2205948 - protein, 8 aa, Cryptosporidium hominis
VSTKETNE

SEQ ID NO: 2205949 - protein, 6 aa, Cryptosporidium hominis
VSTPVS

SEQ ID NO: 2205950 - protein, 6 aa, Cryptosporidium hominis
VSTQHE

SEQ ID NO: 2205951 - protein, 4 aa, Cryptosporidium hominis
VTDD

SEQ ID NO: 2205952 - protein, 29 aa, Cryptosporidium hominis
VTESSSNLDNRSLRGSSITKKDSDKTSEN

SEQ ID NO: 2205953 - protein, 6 aa, Cryptosporidium hominis
VTETGK

SEQ ID NO: 2205954 - protein, 23 aa, Cryptosporidium hominis
VTGSPLKTPRTDSLSEASAQGAH

SEQ ID NO: 2205955 - protein, 16 aa, Cryptosporidium hominis
VTKPTELKSETTLPNG

SEQ ID NO: 2205956 - protein, 6 aa, Cryptosporidium hominis
VTNKEI

SEQ ID NO: 2205957 - protein, 10 aa, Cryptosporidium hominis
VTNPGKTTLS

SEQ ID NO: 2205958 - protein, 127 aa, Cryptosporidium hominis
VTPDQDSNSANSENLDEGEKKEDGDKKEEGDNKEEGEKKEGDKNEDDEKKEGDKNEEGEKKEEVEKKEEGDNKEEGEKKEEGDKKEDGEKKEEDKKEDGEKKEEDKKEDGEKKDGIEKFGENSDIEN

SEQ ID NO: 2205959 - protein, 4 aa, Cryptosporidium hominis
VTPE

SEQ ID NO: 2205960 - protein, 13 aa, Cryptosporidium hominis
VTPNDDIQSFNST

SEQ ID NO: 2205961 - protein, 7 aa, Cryptosporidium hominis
VTQEDAE

SEQ ID NO: 2205962 - protein, 8 aa, Cryptosporidium hominis
VTSEESEK

SEQ ID NO: 2205963 - protein, 25 aa, Cryptosporidium hominis
VTSENEEEQERKDVDEEDEDEDAEP

SEQ ID NO: 2205964 - protein, 12 aa, Cryptosporidium hominis
VTTPRKDYSPDF

SEQ ID NO: 2205965 - protein, 17 aa, Cryptosporidium hominis
VVQSNNSEELKSLSEES

SEQ ID NO: 2205966 - protein, 10 aa, Cryptosporidium hominis
VVTGDQGPDY

SEQ ID NO: 2205967 - protein, 12 aa, Cryptosporidium hominis
VYGSDGIYSEKS

SEQ ID NO: 2205968 - protein, 9 aa, Cryptosporidium hominis
VYKSNSKSE

SEQ ID NO: 2205969 - protein, 5 aa, Cryptosporidium hominis
VYSDS

SEQ ID NO: 2205970 - protein, 9 aa, Cryptosporidium hominis
VYSEEDNSF

SEQ ID NO: 2205971 - protein, 7 aa, Cryptosporidium hominis
VYSPKSS

SEQ ID NO: 2205972 - protein, 9 aa, Cryptosporidium hominis
WDGPNSKIT

SEQ ID NO: 2205973 - protein, 9 aa, Cryptosporidium hominis
WDNGDCKGH

SEQ ID NO: 2205974 - protein, 14 aa, Cryptosporidium hominis
WDSSRKKKAKFTKS

SEQ ID NO: 2205975 - protein, 4 aa, Cryptosporidium hominis
WGKM

SEQ ID NO: 2205976 - protein, 8 aa, Cryptosporidium hominis
WNPTGPFG

SEQ ID NO: 2205977 - protein, 4 aa, Cryptosporidium hominis
WSPN

SEQ ID NO: 2205978 - protein, 6 aa, Cryptosporidium hominis
WTGNGK

SEQ ID NO: 2205979 - protein, 5 aa, Cryptosporidium hominis
WTGNS

SEQ ID NO: 2205980 - protein, 6 aa, Cryptosporidium hominis
YAESSN

SEQ ID NO: 2205981 - protein, 13 aa, Cryptosporidium hominis
YAKENEESVPKSD

SEQ ID NO: 2205982 - protein, 9 aa, Cryptosporidium hominis
YATNSAQRI

SEQ ID NO: 2205983 - protein, 14 aa, Cryptosporidium hominis
YDDDQSLAEARREG

SEQ ID NO: 2205984 - protein, 25 aa, Cryptosporidium hominis
YDDSDDENSSDNEELGDLSGAKHNI

SEQ ID NO: 2205985 - protein, 15 aa, Cryptosporidium hominis
YDEERDTAGIASQAA

SEQ ID NO: 2205986 - protein, 9 aa, Cryptosporidium hominis
YDENENACK

SEQ ID NO: 2205987 - protein, 7 aa, Cryptosporidium hominis
YDISDGE

SEQ ID NO: 2205988 - protein, 9 aa, Cryptosporidium hominis
YDKSSSSNI

SEQ ID NO: 2205989 - protein, 4 aa, Cryptosporidium hominis
YDPD

SEQ ID NO: 2205990 - protein, 10 aa, Cryptosporidium hominis
YDPLSSDSAS

SEQ ID NO: 2205991 - protein, 13 aa, Cryptosporidium hominis
YDPSEVGLDSPEA

SEQ ID NO: 2205992 - protein, 19 aa, Cryptosporidium hominis
YDRKNQNEKIKRKDQLRNQ

SEQ ID NO: 2205993 - protein, 7 aa, Cryptosporidium hominis
YDRNEID

SEQ ID NO: 2205994 - protein, 5 aa, Cryptosporidium hominis
YDSDL

SEQ ID NO: 2205995 - protein, 4 aa, Cryptosporidium hominis
YDSE

SEQ ID NO: 2205996 - protein, 8 aa, Cryptosporidium hominis
YDSEGQKL

SEQ ID NO: 2205997 - protein, 9 aa, Cryptosporidium hominis
YDSNRKDEE

SEQ ID NO: 2205998 - protein, 8 aa, Cryptosporidium hominis
YDSPSLKE

SEQ ID NO: 2205999 - protein, 4 aa, Cryptosporidium hominis
YEAR

SEQ ID NO: 2206000 - protein, 9 aa, Cryptosporidium hominis
YEASGEADD

SEQ ID NO: 2206001 - protein, 6 aa, Cryptosporidium hominis
YEDDER

SEQ ID NO: 2206002 - protein, 11 aa, Cryptosporidium hominis
YEDESKLADNC

SEQ ID NO: 2206003 - protein, 11 aa, Cryptosporidium hominis
YEDPKNEIDDE

SEQ ID NO: 2206004 - protein, 5 aa, Cryptosporidium hominis
YEDSE

SEQ ID NO: 2206005 - protein, 11 aa, Cryptosporidium hominis
YEEATKKCAKQ

SEQ ID NO: 2206006 - protein, 8 aa, Cryptosporidium hominis
YEGSESED

SEQ ID NO: 2206007 - protein, 11 aa, Cryptosporidium hominis
YEISPNATVSR

SEQ ID NO: 2206008 - protein, 8 aa, Cryptosporidium hominis
YEKKQQVD

SEQ ID NO: 2206009 - protein, 5 aa, Cryptosporidium hominis
YEKSL

SEQ ID NO: 2206010 - protein, 8 aa, Cryptosporidium hominis
YENDPCRK

SEQ ID NO: 2206011 - protein, 14 aa, Cryptosporidium hominis
YEPGKENKHGDSDV

SEQ ID NO: 2206012 - protein, 6 aa, Cryptosporidium hominis
YEQRGD

SEQ ID NO: 2206013 - protein, 10 aa, Cryptosporidium hominis
YERNNGTIPI

SEQ ID NO: 2206014 - protein, 7 aa, Cryptosporidium hominis
YERRPYE

SEQ ID NO: 2206015 - protein, 4 aa, Cryptosporidium hominis
YESN

SEQ ID NO: 2206016 - protein, 5 aa, Cryptosporidium hominis
YETPQ

SEQ ID NO: 2206017 - protein, 9 aa, Cryptosporidium hominis
YGDQSTALG

SEQ ID NO: 2206018 - protein, 5 aa, Cryptosporidium hominis
YGEMQ

SEQ ID NO: 2206019 - protein, 11 aa, Cryptosporidium hominis
YGEQGAGELIG

SEQ ID NO: 2206020 - protein, 5 aa, Cryptosporidium hominis
YGKSI

SEQ ID NO: 2206021 - protein, 4 aa, Cryptosporidium hominis
YGNR

SEQ ID NO: 2206022 - protein, 24 aa, Cryptosporidium hominis
YGNRNQGSGRITDKSSDERPESGL

SEQ ID NO: 2206023 - protein, 11 aa, Cryptosporidium hominis
YGQRAPKSLNI

SEQ ID NO: 2206024 - protein, 6 aa, Cryptosporidium hominis
YGQSET

SEQ ID NO: 2206025 - protein, 5 aa, Cryptosporidium hominis
YGVDP

SEQ ID NO: 2206026 - protein, 6 aa, Cryptosporidium hominis
YHENTF

SEQ ID NO: 2206027 - protein, 15 aa, Cryptosporidium hominis
YHPDRNPSPDASEKF

SEQ ID NO: 2206028 - protein, 5 aa, Cryptosporidium hominis
YHPTT

SEQ ID NO: 2206029 - protein, 10 aa, Cryptosporidium hominis
YKANSKTPEV

SEQ ID NO: 2206030 - protein, 6 aa, Cryptosporidium hominis
YKEADH

SEQ ID NO: 2206031 - protein, 9 aa, Cryptosporidium hominis
YKGKDGSWY

SEQ ID NO: 2206032 - protein, 6 aa, Cryptosporidium hominis
YKGRTN

SEQ ID NO: 2206033 - protein, 6 aa, Cryptosporidium hominis
YKIPES

SEQ ID NO: 2206034 - protein, 6 aa, Cryptosporidium hominis
YKKPED

SEQ ID NO: 2206035 - protein, 8 aa, Cryptosporidium hominis
YKKSNDSL

SEQ ID NO: 2206036 - protein, 22 aa, Cryptosporidium hominis
YKNNLSSVEDNINNSQKDRSSF

SEQ ID NO: 2206037 - protein, 6 aa, Cryptosporidium hominis
YKPINT

SEQ ID NO: 2206038 - protein, 8 aa, Cryptosporidium hominis
YKPTEDTF

SEQ ID NO: 2206039 - protein, 6 aa, Cryptosporidium hominis
YKSGYN

SEQ ID NO: 2206040 - protein, 10 aa, Cryptosporidium hominis
YKSSQPPKGF

SEQ ID NO: 2206041 - protein, 5 aa, Cryptosporidium hominis
YKTEE

SEQ ID NO: 2206042 - protein, 4 aa, Cryptosporidium hominis
YLNT

SEQ ID NO: 2206043 - protein, 6 aa, Cryptosporidium hominis
YLPNGR

SEQ ID NO: 2206044 - protein, 32 aa, Cryptosporidium hominis
YLPSPQSTPQPISQYPDSYSGSRPPSGFPNQI

SEQ ID NO: 2206045 - protein, 5 aa, Cryptosporidium hominis
YLTSG

SEQ ID NO: 2206046 - protein, 4 aa, Cryptosporidium hominis
YMPG

SEQ ID NO: 2206047 - protein, 5 aa, Cryptosporidium hominis
YNAQN

SEQ ID NO: 2206048 - protein, 19 aa, Cryptosporidium hominis
YNDSKKQWRDQKSGYRQTL

SEQ ID NO: 2206049 - protein, 6 aa, Cryptosporidium hominis
YNGDRS

SEQ ID NO: 2206050 - protein, 8 aa, Cryptosporidium hominis
YNGEQERI

SEQ ID NO: 2206051 - protein, 8 aa, Cryptosporidium hominis
YNGPRTAN

SEQ ID NO: 2206052 - protein, 4 aa, Cryptosporidium hominis
YNKN

SEQ ID NO: 2206053 - protein, 7 aa, Cryptosporidium hominis
YNNGNNI

SEQ ID NO: 2206054 - protein, 7 aa, Cryptosporidium hominis
YNPENQS

SEQ ID NO: 2206055 - protein, 5 aa, Cryptosporidium hominis
YNQRM

SEQ ID NO: 2206056 - protein, 8 aa, Cryptosporidium hominis
YNQVDSDS

SEQ ID NO: 2206057 - protein, 5 aa, Cryptosporidium hominis
YNRAS

SEQ ID NO: 2206058 - protein, 9 aa, Cryptosporidium hominis
YNSASRSGR

SEQ ID NO: 2206059 - protein, 12 aa, Cryptosporidium hominis
YNSGIGPKSMDA

SEQ ID NO: 2206060 - protein, 11 aa, Cryptosporidium hominis
YNSGNSKRIEN

SEQ ID NO: 2206061 - protein, 18 aa, Cryptosporidium hominis
YNSNRSDHNGNFRYYERR

SEQ ID NO: 2206062 - protein, 5 aa, Cryptosporidium hominis
YNSVS

SEQ ID NO: 2206063 - protein, 4 aa, Cryptosporidium hominis
YPAA

SEQ ID NO: 2206064 - protein, 13 aa, Cryptosporidium hominis
YPAKDSSHYSGLS

SEQ ID NO: 2206065 - protein, 63 aa, Cryptosporidium hominis
YPAQNSSLTPIPNQTQYSTNNTTNGITLEPNSNKKATERSKSQNPDQSSEMSHSKKQDFSPSY

SEQ ID NO: 2206066 - protein, 8 aa, Cryptosporidium hominis
YPEISGKD

SEQ ID NO: 2206067 - protein, 6 aa, Cryptosporidium hominis
YPERTY

SEQ ID NO: 2206068 - protein, 4 aa, Cryptosporidium hominis
YPGN

SEQ ID NO: 2206069 - protein, 8 aa, Cryptosporidium hominis
YPKSGMTP

SEQ ID NO: 2206070 - protein, 4 aa, Cryptosporidium hominis
YPNE

SEQ ID NO: 2206071 - protein, 4 aa, Cryptosporidium hominis
YPNN

SEQ ID NO: 2206072 - protein, 14 aa, Cryptosporidium hominis
YPNTKCTKKNPCKK

SEQ ID NO: 2206073 - protein, 5 aa, Cryptosporidium hominis
YPPQI

SEQ ID NO: 2206074 - protein, 4 aa, Cryptosporidium hominis
YPRT

SEQ ID NO: 2206075 - protein, 11 aa, Cryptosporidium hominis
YPSLRPNVNPT

SEQ ID NO: 2206076 - protein, 8 aa, Cryptosporidium hominis
YPTSPDVV

SEQ ID NO: 2206077 - protein, 20 aa, Cryptosporidium hominis
YQASGETRSLRPNDQSSQVV

SEQ ID NO: 2206078 - protein, 4 aa, Cryptosporidium hominis
YQEQ

SEQ ID NO: 2206079 - protein, 12 aa, Cryptosporidium hominis
YQNSPTNMNGNN

SEQ ID NO: 2206080 - protein, 11 aa, Cryptosporidium hominis
YQPEEKGASIG

SEQ ID NO: 2206081 - protein, 10 aa, Cryptosporidium hominis
YQSDSDVAAE

SEQ ID NO: 2206082 - protein, 6 aa, Cryptosporidium hominis
YQTNKN

SEQ ID NO: 2206083 - protein, 7 aa, Cryptosporidium hominis
YRGGSGE

SEQ ID NO: 2206084 - protein, 4 aa, Cryptosporidium hominis
YRPQ

SEQ ID NO: 2206085 - protein, 5 aa, Cryptosporidium hominis
YRPSQ

SEQ ID NO: 2206086 - protein, 23 aa, Cryptosporidium hominis
YSASEYEQFESESTPISKYKTPK

SEQ ID NO: 2206087 - protein, 5 aa, Cryptosporidium hominis
YSEEN

SEQ ID NO: 2206088 - protein, 9 aa, Cryptosporidium hominis
YSEKKRQLM

SEQ ID NO: 2206089 - protein, 8 aa, Cryptosporidium hominis
YSEQNDEY

SEQ ID NO: 2206090 - protein, 10 aa, Cryptosporidium hominis
YSGSETLSQD

SEQ ID NO: 2206091 - protein, 11 aa, Cryptosporidium hominis
YSGSSKSNKSI

SEQ ID NO: 2206092 - protein, 24 aa, Cryptosporidium hominis
YSIPTESNSDGRLTGMSRGRSRNR

SEQ ID NO: 2206093 - protein, 11 aa, Cryptosporidium hominis
YSKDDPDFSPR

SEQ ID NO: 2206094 - protein, 6 aa, Cryptosporidium hominis
YSKGAS

SEQ ID NO: 2206095 - protein, 11 aa, Cryptosporidium hominis
YSKKSSTEEDW

SEQ ID NO: 2206096 - protein, 11 aa, Cryptosporidium hominis
YSKNDSTISRN

SEQ ID NO: 2206097 - protein, 8 aa, Cryptosporidium hominis
YSLETGKQ

SEQ ID NO: 2206098 - protein, 6 aa, Cryptosporidium hominis
YSNSED

SEQ ID NO: 2206099 - protein, 5 aa, Cryptosporidium hominis
YSPDL

SEQ ID NO: 2206100 - protein, 8 aa, Cryptosporidium hominis
YSPEGANK

SEQ ID NO: 2206101 - protein, 4 aa, Cryptosporidium hominis
YSPG

SEQ ID NO: 2206102 - protein, 167 aa, Cryptosporidium hominis
YSPKPSNFEERGRSRTRNRRTTTRGSSSRDKGTSKNKTSRNTSRSASRNRSGSRNATRFRSKSRNVSRSTSRNRDRSTSRNRDRSTSRNVSRSTSRNRGRSKNVSRNRTRSRTRSRTGGRARSRGRSRGRSRSYNKNSNSTSGGESPSTSAYSHEENQQEEQAPSES

SEQ ID NO: 2206103 - protein, 9 aa, Cryptosporidium hominis
YSPLNPHRT

SEQ ID NO: 2206104 - protein, 12 aa, Cryptosporidium hominis
YSQGSTGESEEK

SEQ ID NO: 2206105 - protein, 6 aa, Cryptosporidium hominis
YSRTGS

SEQ ID NO: 2206106 - protein, 4 aa, Cryptosporidium hominis
YSSN

SEQ ID NO: 2206107 - protein, 6 aa, Cryptosporidium hominis
YSSNDG

SEQ ID NO: 2206108 - protein, 18 aa, Cryptosporidium hominis
YSSNETAGLPASRTHYPA

SEQ ID NO: 2206109 - protein, 7 aa, Cryptosporidium hominis
YSSQKLD

SEQ ID NO: 2206110 - protein, 12 aa, Cryptosporidium hominis
YSTKDKNKSRSV

SEQ ID NO: 2206111 - protein, 22 aa, Cryptosporidium hominis
YSYNQNPGNSANNLQNYNSNQR

SEQ ID NO: 2206112 - protein, 6 aa, Cryptosporidium hominis
YSYSKT

SEQ ID NO: 2206113 - protein, 7 aa, Cryptosporidium hominis
YTEPGKH

SEQ ID NO: 2206114 - protein, 8 aa, Cryptosporidium hominis
YTGSQKGE

SEQ ID NO: 2206115 - protein, 12 aa, Cryptosporidium hominis
YTHGSSSKVGYT

SEQ ID NO: 2206116 - protein, 7 aa, Cryptosporidium hominis
YTKDGKK

SEQ ID NO: 2206117 - protein, 9 aa, Cryptosporidium hominis
YTPQGTVQG

SEQ ID NO: 2206118 - protein, 16 aa, Cryptosporidium hominis
YTQNGGGPKELDDSKK

SEQ ID NO: 2206119 - protein, 6 aa, Cryptosporidium hominis
YTRRGD

SEQ ID NO: 2206120 - protein, 5 aa, Cryptosporidium hominis
YTSDN

SEQ ID NO: 2206121 - protein, 7 aa, Cryptosporidium hominis
YTSQNTS

SEQ ID NO: 2206122 - protein, 4 aa, Cryptosporidium hominis
YTSS

SEQ ID NO: 2206123 - protein, 7 aa, Cryptosporidium hominis
YTTSKEV

SEQ ID NO: 2206124 - protein, 12 aa, Cryptosporidium hominis
YVPEPQNNETTI

SEQ ID NO: 2206125 - protein, 18 aa, Cryptosporidium hominis
FTTCCPKSSSVDFRLKVS

SEQ ID NO: 2206126 - protein, 24 aa, Cryptosporidium hominis
AADSFFGAIEWIWMYKLSNIDNIN

SEQ ID NO: 2206127 - protein, 17 aa, Cryptosporidium hominis
AAELYFNGLRPRPATLA

SEQ ID NO: 2206128 - protein, 23 aa, Cryptosporidium hominis
AAHHSLGIVGFHFRNYSPKPSNF

SEQ ID NO: 2206129 - protein, 25 aa, Cryptosporidium hominis
AAIMRDIDWIFVIGHFPCYSSGEHG

SEQ ID NO: 2206130 - protein, 20 aa, Cryptosporidium hominis
AAITLFSFFDSFSLVLTDFS

SEQ ID NO: 2206131 - protein, 27 aa, Cryptosporidium hominis
AAKIKDQWLTSPCRTILTVSGSKGKEI

SEQ ID NO: 2206132 - protein, 17 aa, Cryptosporidium hominis
AAMTIRFLWSEGGSQFD

SEQ ID NO: 2206133 - protein, 24 aa, Cryptosporidium hominis
AANGLEWWGASSWQECRERCRSNL

SEQ ID NO: 2206134 - protein, 20 aa, Cryptosporidium hominis
AARAKLGYYREINPFNKSEK

SEQ ID NO: 2206135 - protein, 37 aa, Cryptosporidium hominis
ACEEYLECRFDFVVPRKACVNDCFQSRNFAKQELNGI

SEQ ID NO: 2206136 - protein, 18 aa, Cryptosporidium hominis
ACGSETKFSVSTSECEGL

SEQ ID NO: 2206137 - protein, 18 aa, Cryptosporidium hominis
ACINLILRNYVLTKRYDL

SEQ ID NO: 2206138 - protein, 21 aa, Cryptosporidium hominis
ACLGLRILITMYDEMRNDVQC

SEQ ID NO: 2206139 - protein, 19 aa, Cryptosporidium hominis
ADLTWPDFVLVDDIENRFR

SEQ ID NO: 2206140 - protein, 24 aa, Cryptosporidium hominis
ADPNHGFIPLFMVENFTETAAFPA

SEQ ID NO: 2206141 - protein, 22 aa, Cryptosporidium hominis
ADSEGLAPVGGFAKIQELQAFE

SEQ ID NO: 2206142 - protein, 19 aa, Cryptosporidium hominis
ADTIHGFAPLIPDYEYNVG

SEQ ID NO: 2206143 - protein, 21 aa, Cryptosporidium hominis
ADTNMQWKIVSILIPDIQSHL

SEQ ID NO: 2206144 - protein, 25 aa, Cryptosporidium hominis
ADYELACPPGLIVISDKCAKYADKV

SEQ ID NO: 2206145 - protein, 17 aa, Cryptosporidium hominis
ADYEYRKSIVSEFQADP

SEQ ID NO: 2206146 - protein, 19 aa, Cryptosporidium hominis
AEDRLCPLSSAITILNEYL

SEQ ID NO: 2206147 - protein, 25 aa, Cryptosporidium hominis
AEIICSATRFWVMCGSYMDSEVDAL

SEQ ID NO: 2206148 - protein, 25 aa, Cryptosporidium hominis
AEQAEDGRLFWEFNENSQLQVKGTN

SEQ ID NO: 2206149 - protein, 21 aa, Cryptosporidium hominis
AESKKNCKILASATPRDNSET

SEQ ID NO: 2206150 - protein, 31 aa, Cryptosporidium hominis
AESLLIFPDEPEMALSAFVKPVSMSKDSELS

SEQ ID NO: 2206151 - protein, 23 aa, Cryptosporidium hominis
AETLLGTVTIEFTAELKHRDPIK

SEQ ID NO: 2206152 - protein, 25 aa, Cryptosporidium hominis
AEYPTDIRLLSSIAVLTQRITDRAF

SEQ ID NO: 2206153 - protein, 18 aa, Cryptosporidium hominis
AFTKQEWLATSSGSFVGR

SEQ ID NO: 2206154 - protein, 23 aa, Cryptosporidium hominis
AFVRDCRLFLSESFSNLLDSELS

SEQ ID NO: 2206155 - protein, 18 aa, Cryptosporidium hominis
AFVRPCNQLNCQVNCMNP

SEQ ID NO: 2206156 - protein, 18 aa, Cryptosporidium hominis
AGCHEFTLDPSLLKVISE

SEQ ID NO: 2206157 - protein, 17 aa, Cryptosporidium hominis
AGGILPGIFMSRNFSYQ

SEQ ID NO: 2206158 - protein, 18 aa, Cryptosporidium hominis
AGIKEVIKYFDIADNTSN

SEQ ID NO: 2206159 - protein, 18 aa, Cryptosporidium hominis
AGNLPYTILVSIPKAALP

SEQ ID NO: 2206160 - protein, 18 aa, Cryptosporidium hominis
AGSLCFTDSMDSYPTSNS

SEQ ID NO: 2206161 - protein, 19 aa, Cryptosporidium hominis
AHSAWCKATTPEGKCVATD

SEQ ID NO: 2206162 - protein, 18 aa, Cryptosporidium hominis
AIDGFAHFDFLYKKLYDI

SEQ ID NO: 2206163 - protein, 22 aa, Cryptosporidium hominis
AIDLRDICRFVGKVEPWIYTKR

SEQ ID NO: 2206164 - protein, 30 aa, Cryptosporidium hominis
AIGICKIPSLWYLELIYCMHKGVTHFTTGI

SEQ ID NO: 2206165 - protein, 24 aa, Cryptosporidium hominis
AIGLLRYGFLYALINEINNQFQKK

SEQ ID NO: 2206166 - protein, 19 aa, Cryptosporidium hominis
AIGNCIDRFARVMKLDNYP

SEQ ID NO: 2206167 - protein, 24 aa, Cryptosporidium hominis
AIKRREMLLRISINNSAGEILGRF

SEQ ID NO: 2206168 - protein, 25 aa, Cryptosporidium hominis
AIKSAKIYIPISVFKSAEQVVTDIQ

SEQ ID NO: 2206169 - protein, 24 aa, Cryptosporidium hominis
AILAFCSEVYYGASTQDFKVKAEF

SEQ ID NO: 2206170 - protein, 18 aa, Cryptosporidium hominis
AINCLKCEHKFNQQTHSD

SEQ ID NO: 2206171 - protein, 20 aa, Cryptosporidium hominis
AINLLLRLVLKGCPNILDDV

SEQ ID NO: 2206172 - protein, 25 aa, Cryptosporidium hominis
AIVKILEITLSFLKLIKEVSISETI

SEQ ID NO: 2206173 - protein, 21 aa, Cryptosporidium hominis
AIYATDHRGFLTISSPCDGNL

SEQ ID NO: 2206174 - protein, 19 aa, Cryptosporidium hominis
AKALKGIVPVVAIDDQSDM

SEQ ID NO: 2206175 - protein, 22 aa, Cryptosporidium hominis
AKARPHSTVGIMLDTKGPEIRT

SEQ ID NO: 2206176 - protein, 18 aa, Cryptosporidium hominis
AKESLKFKNNKELNKGND

SEQ ID NO: 2206177 - protein, 21 aa, Cryptosporidium hominis
AKFKYLMQVLLRYKPDPYSQN

SEQ ID NO: 2206178 - protein, 17 aa, Cryptosporidium hominis
AKICSNLLFGNFYDQFR

SEQ ID NO: 2206179 - protein, 20 aa, Cryptosporidium hominis
AKLEEIRKIKNKSIKESTAG

SEQ ID NO: 2206180 - protein, 18 aa, Cryptosporidium hominis
AKLMGSFLVIPSLELPGG

SEQ ID NO: 2206181 - protein, 25 aa, Cryptosporidium hominis
AKPEVARGLKIARGVKTYVLNSIHH

SEQ ID NO: 2206182 - protein, 20 aa, Cryptosporidium hominis
AKSNIWLVYRYEGVSLGNLL

SEQ ID NO: 2206183 - protein, 17 aa, Cryptosporidium hominis
AKTRGDGLYGFELLFEK

SEQ ID NO: 2206184 - protein, 17 aa, Cryptosporidium hominis
AKVEWIFSRQADAWLTN

SEQ ID NO: 2206185 - protein, 30 aa, Cryptosporidium hominis
AKYKPLSHIFFSFLLNFSFEKRSEVVLIDK

SEQ ID NO: 2206186 - protein, 21 aa, Cryptosporidium hominis
ALCNLLSLLPDQVFFNHLSNT

SEQ ID NO: 2206187 - protein, 20 aa, Cryptosporidium hominis
ALKLCRRDLQNPVDFVNPNC

SEQ ID NO: 2206188 - protein, 20 aa, Cryptosporidium hominis
ALKVCPPEVPILSQEKTSSQ

SEQ ID NO: 2206189 - protein, 19 aa, Cryptosporidium hominis
ALLDSFGLLVDSSFSESCL

SEQ ID NO: 2206190 - protein, 25 aa, Cryptosporidium hominis
ALLKLREFEKILSLKHSAARRLFHS

SEQ ID NO: 2206191 - protein, 26 aa, Cryptosporidium hominis
ALLVYFVATNAVRIRGGDQNKLESEN

SEQ ID NO: 2206192 - protein, 17 aa, Cryptosporidium hominis
ALMREVYQREKIEQICK

SEQ ID NO: 2206193 - protein, 18 aa, Cryptosporidium hominis
ALNKLLLFKNELELKCVT

SEQ ID NO: 2206194 - protein, 27 aa, Cryptosporidium hominis
ALNLIPNKFRIVNIWNEENPSLRRGNS

SEQ ID NO: 2206195 - protein, 24 aa, Cryptosporidium hominis
ALNSKSFIVRRWGKNVQSKLRKLR

SEQ ID NO: 2206196 - protein, 19 aa, Cryptosporidium hominis
ALQLACRMCLVIPEHDLQS

SEQ ID NO: 2206197 - protein, 24 aa, Cryptosporidium hominis
ALVARMLSMLWSKPLIGVNHCVAH

SEQ ID NO: 2206198 - protein, 17 aa, Cryptosporidium hominis
ALYRLTSKFFVRMVRHL

SEQ ID NO: 2206199 - protein, 20 aa, Cryptosporidium hominis
AMFYNYKFGKDIYLCSIIYS

SEQ ID NO: 2206200 - protein, 23 aa, Cryptosporidium hominis
AMGTPWPEKGPYEFTKLFNNNDK

SEQ ID NO: 2206201 - protein, 24 aa, Cryptosporidium hominis
ANDGIAYKNLCEFRNAQCDDQSLI

SEQ ID NO: 2206202 - protein, 25 aa, Cryptosporidium hominis
ANGAFPFDAVNVMSRVCAQAETCID

SEQ ID NO: 2206203 - protein, 24 aa, Cryptosporidium hominis
ANIECPEGFEVLKTDLSVECIHKT

SEQ ID NO: 2206204 - protein, 20 aa, Cryptosporidium hominis
ANIYSPVWGCYQFMDPPSEN

SEQ ID NO: 2206205 - protein, 19 aa, Cryptosporidium hominis
ANLQYCLGGHLGLLKTQIL

SEQ ID NO: 2206206 - protein, 25 aa, Cryptosporidium hominis
ANNYDLNSLFLLTGRDYSGERGIDF

SEQ ID NO: 2206207 - protein, 18 aa, Cryptosporidium hominis
ANRELLIEFLKFMHTNRM

SEQ ID NO: 2206208 - protein, 23 aa, Cryptosporidium hominis
ANRIWFPLEEQIELNLKKLRKCT

SEQ ID NO: 2206209 - protein, 22 aa, Cryptosporidium hominis
ANSGRIVAAMKFLSSLASNDYS

SEQ ID NO: 2206210 - protein, 27 aa, Cryptosporidium hominis
ANSPGFKFLLLETIDLLVAVNGWDFIS

SEQ ID NO: 2206211 - protein, 25 aa, Cryptosporidium hominis
ANVTCPDLLIHLTHLAQKGMVESMN

SEQ ID NO: 2206212 - protein, 19 aa, Cryptosporidium hominis
APCSCCGSKASCCENNLCV

SEQ ID NO: 2206213 - protein, 24 aa, Cryptosporidium hominis
APIGVPRNRLGLRNTEGSSEKKNI

SEQ ID NO: 2206214 - protein, 19 aa, Cryptosporidium hominis
APKKPPLPANWRLPPGNES

SEQ ID NO: 2206215 - protein, 25 aa, Cryptosporidium hominis
APTLRGRLLFELKLIEKELIAAFVR

SEQ ID NO: 2206216 - protein, 21 aa, Cryptosporidium hominis
APYLLKRIHSLIKENNEVVLS

SEQ ID NO: 2206217 - protein, 23 aa, Cryptosporidium hominis
AQSRTGLTMTISDIWATAKDISS

SEQ ID NO: 2206218 - protein, 24 aa, Cryptosporidium hominis
AQTCNSINGPFCKYLNQISDSSEF

SEQ ID NO: 2206219 - protein, 28 aa, Cryptosporidium hominis
AQVGRWYRRMLRGIWLPFYTAAMFMLQN

SEQ ID NO: 2206220 - protein, 30 aa, Cryptosporidium hominis
ARFNDYCPKTFGGQCLVQITSLQSTNAIGI

SEQ ID NO: 2206221 - protein, 20 aa, Cryptosporidium hominis
ARKLLRELFLHRKHKQRLFF

SEQ ID NO: 2206222 - protein, 19 aa, Cryptosporidium hominis
ARLIPESKLAASELEPIKG

SEQ ID NO: 2206223 - protein, 18 aa, Cryptosporidium hominis
ARLTRSTSDFGLLEPQFL

SEQ ID NO: 2206224 - protein, 20 aa, Cryptosporidium hominis
ARREGVAVAISRLIASASES

SEQ ID NO: 2206225 - protein, 22 aa, Cryptosporidium hominis
ASCDSRWCKMHENPSAKFEDGT

SEQ ID NO: 2206226 - protein, 18 aa, Cryptosporidium hominis
ASCRAARMLPIPTEMVDV

SEQ ID NO: 2206227 - protein, 25 aa, Cryptosporidium hominis
ASDIPAELSLKVVYDMLKRREAEGL

SEQ ID NO: 2206228 - protein, 24 aa, Cryptosporidium hominis
ASEYPWGFCPFPCGGFGNITSIVQ

SEQ ID NO: 2206229 - protein, 27 aa, Cryptosporidium hominis
ASFKYRKCKYWSWRATDFSCSLKSKSS

SEQ ID NO: 2206230 - protein, 18 aa, Cryptosporidium hominis
ASIPFCVVREKIDQIDEH

SEQ ID NO: 2206231 - protein, 24 aa, Cryptosporidium hominis
ASIRNIWDSFPLFGGINENNVIGF

SEQ ID NO: 2206232 - protein, 23 aa, Cryptosporidium hominis
ASNLFAIILSHFEWEHIQLRWRV

SEQ ID NO: 2206233 - protein, 18 aa, Cryptosporidium hominis
ASNLRKSYRPEQSKSQMF

SEQ ID NO: 2206234 - protein, 18 aa, Cryptosporidium hominis
ASPYFVYERVIEIYNSDS

SEQ ID NO: 2206235 - protein, 20 aa, Cryptosporidium hominis
ASQFRGEILFVKSGTNLAHE

SEQ ID NO: 2206236 - protein, 17 aa, Cryptosporidium hominis
ASQPMKERWVKAPPFKR

SEQ ID NO: 2206237 - protein, 19 aa, Cryptosporidium hominis
ASRHQLLFILRQVLEVAIK

SEQ ID NO: 2206238 - protein, 36 aa, Cryptosporidium hominis
ASSLKVCVGTSWLPRPCGLDPFGEIPEGWKVPDPKQ

SEQ ID NO: 2206239 - protein, 26 aa, Cryptosporidium hominis
ASYTILESCFHFWKDLHEYYVSSMFT

SEQ ID NO: 2206240 - protein, 24 aa, Cryptosporidium hominis
ATAKAIGLKIVWSSSPRETQIQVS

SEQ ID NO: 2206241 - protein, 24 aa, Cryptosporidium hominis
ATALKNLWALLSLIVNLTECSNIY

SEQ ID NO: 2206242 - protein, 19 aa, Cryptosporidium hominis
ATCAEISKLSPPVHCGSVD

SEQ ID NO: 2206243 - protein, 20 aa, Cryptosporidium hominis
ATLACKQLGYSFGSILPSCT

SEQ ID NO: 2206244 - protein, 18 aa, Cryptosporidium hominis
ATLQKAVQQNHEWYLLAM

SEQ ID NO: 2206245 - protein, 18 aa, Cryptosporidium hominis
ATPPENRPEDSVVLTRGA

SEQ ID NO: 2206246 - protein, 22 aa, Cryptosporidium hominis
ATSRRVLGWTIELPFPGSDESK

SEQ ID NO: 2206247 - protein, 19 aa, Cryptosporidium hominis
AVDYGCLDGKCTGSYQDLR

SEQ ID NO: 2206248 - protein, 23 aa, Cryptosporidium hominis
AWTTELVILWKMARQRDITTCKT

SEQ ID NO: 2206249 - protein, 22 aa, Cryptosporidium hominis
AYPKEYYVSFLPEDGERCQELL

SEQ ID NO: 2206250 - protein, 24 aa, Cryptosporidium hominis
AYRALSIPFSDYFLDTDKKTLQSL

SEQ ID NO: 2206251 - protein, 19 aa, Cryptosporidium hominis
CADGLELSPFMDIQSGDTL

SEQ ID NO: 2206252 - protein, 20 aa, Cryptosporidium hominis
CAPVEFPYCGTNGVTYINNC

SEQ ID NO: 2206253 - protein, 21 aa, Cryptosporidium hominis
CARNLRLMFRQKVIINGNVRL

SEQ ID NO: 2206254 - protein, 21 aa, Cryptosporidium hominis
CASTSRWMSCNSGIGIDEKLN

SEQ ID NO: 2206255 - protein, 23 aa, Cryptosporidium hominis
CCATLDHFVSFIFTTLEKEKIVL

SEQ ID NO: 2206256 - protein, 22 aa, Cryptosporidium hominis
CCSVIYDLFLSKVFPHLSTNHY

SEQ ID NO: 2206257 - protein, 21 aa, Cryptosporidium hominis
CDEDCKRLSFQSWLATSILDQ

SEQ ID NO: 2206258 - protein, 18 aa, Cryptosporidium hominis
CDYIHNIISSNWVDPNSL

SEQ ID NO: 2206259 - protein, 27 aa, Cryptosporidium hominis
CENNRQFPCCLNTLGGFTCVEQIMSGD

SEQ ID NO: 2206260 - protein, 24 aa, Cryptosporidium hominis
CESKSRLVFIPNIHEYKDCTSTNQ

SEQ ID NO: 2206261 - protein, 26 aa, Cryptosporidium hominis
CFAIDANGILFVWGMNLTGQIGIKKL

SEQ ID NO: 2206262 - protein, 20 aa, Cryptosporidium hominis
CFILGFSGYGNRGMWSAAVA

SEQ ID NO: 2206263 - protein, 19 aa, Cryptosporidium hominis
CGHCKAFAPEYEKAAKALK

SEQ ID NO: 2206264 - protein, 19 aa, Cryptosporidium hominis
CGLNPCLSVGLIDITNNGK

SEQ ID NO: 2206265 - protein, 23 aa, Cryptosporidium hominis
CGYDISKPFPFYFLVIVECDILY

SEQ ID NO: 2206266 - protein, 21 aa, Cryptosporidium hominis
CHILPLLLFIILAIPFNSNVP

SEQ ID NO: 2206267 - protein, 30 aa, Cryptosporidium hominis
CHLEGAKCVPARCRGVKAIPARIVGYDGRT

SEQ ID NO: 2206268 - protein, 17 aa, Cryptosporidium hominis
CHPSCNGCSCTTAKCTG

SEQ ID NO: 2206269 - protein, 17 aa, Cryptosporidium hominis
CINKLRTLLDYTNKKDK

SEQ ID NO: 2206270 - protein, 17 aa, Cryptosporidium hominis
CITCLNCGSHEYPPFDI

SEQ ID NO: 2206271 - protein, 25 aa, Cryptosporidium hominis
CKAMKRIGRRICCCCCSTSCDSDSE

SEQ ID NO: 2206272 - protein, 19 aa, Cryptosporidium hominis
CKDPEIMKLWYSGPLISTD

SEQ ID NO: 2206273 - protein, 19 aa, Cryptosporidium hominis
CKEAIYLDDIPKLMSKFNY

SEQ ID NO: 2206274 - protein, 20 aa, Cryptosporidium hominis
CKEFKNFPHFDTKYNFATFT

SEQ ID NO: 2206275 - protein, 25 aa, Cryptosporidium hominis
CKLTRKSLFYCIKIIIMSYYKSSIR

SEQ ID NO: 2206276 - protein, 21 aa, Cryptosporidium hominis
CKNLFREIFEKSYSRIPVNTM

SEQ ID NO: 2206277 - protein, 21 aa, Cryptosporidium hominis
CKTPCTREYHPICGNDGVTYA

SEQ ID NO: 2206278 - protein, 17 aa, Cryptosporidium hominis
CKYFHRFNEGSVISGKY

SEQ ID NO: 2206279 - protein, 29 aa, Cryptosporidium hominis
CKYPEMYPGIHLHFGYWDGFRGRGNLIRL

SEQ ID NO: 2206280 - protein, 25 aa, Cryptosporidium hominis
CLECFTSSLCERIHLFRKHSYGKDL

SEQ ID NO: 2206281 - protein, 17 aa, Cryptosporidium hominis
CLICLLNYTTFNQLGRV

SEQ ID NO: 2206282 - protein, 41 aa, Cryptosporidium hominis
CLLEILERIIELNLEYALPQVKLMACRLHPELEQTDEETNQ

SEQ ID NO: 2206283 - protein, 29 aa, Cryptosporidium hominis
CLNCNDIFKCPNCDLEIFPSENEIEFNSL

SEQ ID NO: 2206284 - protein, 28 aa, Cryptosporidium hominis
CMDNLNCWRKLLPCTTLDFSSKIGSYGI

SEQ ID NO: 2206285 - protein, 17 aa, Cryptosporidium hominis
CMLEMFKKCKINDQVQL

SEQ ID NO: 2206286 - protein, 19 aa, Cryptosporidium hominis
CNHAGLTDPIWISTAFGSI

SEQ ID NO: 2206287 - protein, 23 aa, Cryptosporidium hominis
CNRKLLGGEKCKYFHRFNEGSVI

SEQ ID NO: 2206288 - protein, 22 aa, Cryptosporidium hominis
CNSMRLRIIAGKHFVNAQLFLK

SEQ ID NO: 2206289 - protein, 18 aa, Cryptosporidium hominis
CPEKLAILMFLFQNTLYD

SEQ ID NO: 2206290 - protein, 18 aa, Cryptosporidium hominis
CPTGVPLTGLRLIMRKGE

SEQ ID NO: 2206291 - protein, 29 aa, Cryptosporidium hominis
CPVENDAPFGRTLIRNLFRIYKRNFPSDK

SEQ ID NO: 2206292 - protein, 20 aa, Cryptosporidium hominis
CQTFHRYNEFNTRKSQIQCL

SEQ ID NO: 2206293 - protein, 17 aa, Cryptosporidium hominis
CRESLRVVSNGMKVSSF

SEQ ID NO: 2206294 - protein, 24 aa, Cryptosporidium hominis
CRNLCKGGQVFTPFLPPKEPDCSS

SEQ ID NO: 2206295 - protein, 19 aa, Cryptosporidium hominis
CSCIKANVFKLCTSEEIRN

SEQ ID NO: 2206296 - protein, 19 aa, Cryptosporidium hominis
CSDTASFIFQLPVGERELV

SEQ ID NO: 2206297 - protein, 24 aa, Cryptosporidium hominis
CSETDSRFCVILIMEKNDFRMDKR

SEQ ID NO: 2206298 - protein, 18 aa, Cryptosporidium hominis
CSGIFKMPSLPAIDLRPL

SEQ ID NO: 2206299 - protein, 17 aa, Cryptosporidium hominis
CSILKGYQDLESRVREV

SEQ ID NO: 2206300 - protein, 18 aa, Cryptosporidium hominis
CSKELVRGVGSLLVNLQG

SEQ ID NO: 2206301 - protein, 18 aa, Cryptosporidium hominis
CSKRELQKLLKLLENTML

SEQ ID NO: 2206302 - protein, 19 aa, Cryptosporidium hominis
CSSQRAKLMGSFLVIPSLE

SEQ ID NO: 2206303 - protein, 25 aa, Cryptosporidium hominis
CSTYPKGYFTFWLQKKFSENKFVVG

SEQ ID NO: 2206304 - protein, 19 aa, Cryptosporidium hominis
CSVADSFPWGSWSTCSSTC

SEQ ID NO: 2206305 - protein, 23 aa, Cryptosporidium hominis
CTKKNPCKKCKKLISEFKSGEFE

SEQ ID NO: 2206306 - protein, 17 aa, Cryptosporidium hominis
CVFIIIFFGSLFSNILH

SEQ ID NO: 2206307 - protein, 22 aa, Cryptosporidium hominis
CVHNYFWRVPCGEIVESDLLAN

SEQ ID NO: 2206308 - protein, 22 aa, Cryptosporidium hominis
CVKLASDVNIIFGSHRDEFQNA

SEQ ID NO: 2206309 - protein, 23 aa, Cryptosporidium hominis
CWDNLNEWKRLKLVHKYNQMERE

SEQ ID NO: 2206310 - protein, 17 aa, Cryptosporidium hominis
CWFKCTKVWEYPLCGSD

SEQ ID NO: 2206311 - protein, 23 aa, Cryptosporidium hominis
DAALRLVSGLDFDVGATGESFVF

SEQ ID NO: 2206312 - protein, 21 aa, Cryptosporidium hominis
DAESFSRRLATGFEDSDPSSM

SEQ ID NO: 2206313 - protein, 17 aa, Cryptosporidium hominis
DAIKKCSDLTRKLSRNI

SEQ ID NO: 2206314 - protein, 20 aa, Cryptosporidium hominis
DAKKRISFSDIIKESSENNN

SEQ ID NO: 2206315 - protein, 18 aa, Cryptosporidium hominis
DALESCGMEIQRLHSGVA

SEQ ID NO: 2206316 - protein, 21 aa, Cryptosporidium hominis
DANYLYVCIIELLKTPQRDLP

SEQ ID NO: 2206317 - protein, 20 aa, Cryptosporidium hominis
DARDKYFLNYVEDFDSKGSE

SEQ ID NO: 2206318 - protein, 27 aa, Cryptosporidium hominis
DCASICLQCLILYSSVRRSFFPTQADR

SEQ ID NO: 2206319 - protein, 24 aa, Cryptosporidium hominis
DCCFNSCFSGLIPYDSDHHLANSD

SEQ ID NO: 2206320 - protein, 29 aa, Cryptosporidium hominis
DCKTCSGNCRTWMIGNGICDNSCNNKDCN

SEQ ID NO: 2206321 - protein, 17 aa, Cryptosporidium hominis
DDAVELINFAISMAKNE

SEQ ID NO: 2206322 - protein, 20 aa, Cryptosporidium hominis
DDHSKCFILGFSGYGNRGMW

SEQ ID NO: 2206323 - protein, 20 aa, Cryptosporidium hominis
DDTCKPKAGTHLATVQLDVL

SEQ ID NO: 2206324 - protein, 24 aa, Cryptosporidium hominis
DDTSWGELTAIYDYLERVMENKYV

SEQ ID NO: 2206325 - protein, 25 aa, Cryptosporidium hominis
DDYLKKLYLIFTIKILHINNFDANK

SEQ ID NO: 2206326 - protein, 23 aa, Cryptosporidium hominis
DEGKTRFSIPMLKLGELLEQNSL

SEQ ID NO: 2206327 - protein, 23 aa, Cryptosporidium hominis
DEKLKFLHWGVCDSNDADKITAI

SEQ ID NO: 2206328 - protein, 28 aa, Cryptosporidium hominis
DENNKRPKIRLGLLEDINDLLILEAGFR

SEQ ID NO: 2206329 - protein, 24 aa, Cryptosporidium hominis
DEPSLWKSLPLILPKLPSYPEQIR

SEQ ID NO: 2206330 - protein, 23 aa, Cryptosporidium hominis
DFASGRLSPYFKSEEPPSEEDND

SEQ ID NO: 2206331 - protein, 21 aa, Cryptosporidium hominis
DFCERCVRLMDNWENSEPHMI

SEQ ID NO: 2206332 - protein, 18 aa, Cryptosporidium hominis
DFFKANGTDIVIKQLLKN

SEQ ID NO: 2206333 - protein, 18 aa, Cryptosporidium hominis
DFFSYDIILHGFSKAFTR

SEQ ID NO: 2206334 - protein, 20 aa, Cryptosporidium hominis
DFIPIEILNWRARRPLFNET

SEQ ID NO: 2206335 - protein, 29 aa, Cryptosporidium hominis
DFNYKARISLRLEAQYSLAHSLIAAILTL

SEQ ID NO: 2206336 - protein, 21 aa, Cryptosporidium hominis
DFPPAFDRVRGPDCVVKCDDN

SEQ ID NO: 2206337 - protein, 33 aa, Cryptosporidium hominis
DGGDCVGWCAPECRPTWLGDGQCDIDCFNSKCN

SEQ ID NO: 2206338 - protein, 18 aa, Cryptosporidium hominis
DGIWCKTSRLKLDGRMTW

SEQ ID NO: 2206339 - protein, 33 aa, Cryptosporidium hominis
DGKKVKVILVRKRRPVFNWLRKWRNKRKIKNKA

SEQ ID NO: 2206340 - protein, 20 aa, Cryptosporidium hominis
DGLRISAPIIPKTQSTTPPP

SEQ ID NO: 2206341 - protein, 21 aa, Cryptosporidium hominis
DGSKCKGSECMRPATTTTTRS

SEQ ID NO: 2206342 - protein, 24 aa, Cryptosporidium hominis
DGSKFFPFFISKYIRSLQKSNYFG

SEQ ID NO: 2206343 - protein, 26 aa, Cryptosporidium hominis
DGYLPLKHFFVSFLLNSTFERRKNMV

SEQ ID NO: 2206344 - protein, 22 aa, Cryptosporidium hominis
DGYPDILVILKFGNGTRQTKLI

SEQ ID NO: 2206345 - protein, 18 aa, Cryptosporidium hominis
DHHISQIISFIKEKIQSI

SEQ ID NO: 2206346 - protein, 19 aa, Cryptosporidium hominis
DIDLKIIFMQYIKSTLRCI

SEQ ID NO: 2206347 - protein, 19 aa, Cryptosporidium hominis
DIELRIVTLRNFYLSATRN

SEQ ID NO: 2206348 - protein, 18 aa, Cryptosporidium hominis
DIILHGFSKAFTRDQAAY

SEQ ID NO: 2206349 - protein, 25 aa, Cryptosporidium hominis
DIISFLTIIFLIFIYKVFGYVERPE

SEQ ID NO: 2206350 - protein, 18 aa, Cryptosporidium hominis
DILGRFWLEETIKSVQVI

SEQ ID NO: 2206351 - protein, 27 aa, Cryptosporidium hominis
DILRYPEVVSTPGERLVSMFRKSKISK

SEQ ID NO: 2206352 - protein, 24 aa, Cryptosporidium hominis
DILSRPQVIYGRRGYDFQDIKCDG

SEQ ID NO: 2206353 - protein, 25 aa, Cryptosporidium hominis
DILSVFIEACIRPYVSFKGNEIMYV

SEQ ID NO: 2206354 - protein, 20 aa, Cryptosporidium hominis
DIPYLLKLVNVLSDSYGFSI

SEQ ID NO: 2206355 - protein, 17 aa, Cryptosporidium hominis
DIQGISVADIELFGISA

SEQ ID NO: 2206356 - protein, 20 aa, Cryptosporidium hominis
DIYFIIKLLKYVYIKEKNIQ

SEQ ID NO: 2206357 - protein, 17 aa, Cryptosporidium hominis
DKIFLKKYEWGNEISQW

SEQ ID NO: 2206358 - protein, 18 aa, Cryptosporidium hominis
DKLPMTRRPIIHPFTRKI

SEQ ID NO: 2206359 - protein, 22 aa, Cryptosporidium hominis
DKSSRKQLLFLRASYTILESCF

SEQ ID NO: 2206360 - protein, 24 aa, Cryptosporidium hominis
DKYLIDTPCRIYRPDRREDIIELR

SEQ ID NO: 2206361 - protein, 22 aa, Cryptosporidium hominis
DKYSPLLPRWARDQTKDPFIVE

SEQ ID NO: 2206362 - protein, 20 aa, Cryptosporidium hominis
DKYSRRIFKDNSVNCNAQTY

SEQ ID NO: 2206363 - protein, 18 aa, Cryptosporidium hominis
DLEELCFDLVKSVISGCQ

SEQ ID NO: 2206364 - protein, 18 aa, Cryptosporidium hominis
DLNWLYCQDLPKYLNKLD

SEQ ID NO: 2206365 - protein, 20 aa, Cryptosporidium hominis
DLRKGLVPYLELVKAVRSGD

SEQ ID NO: 2206366 - protein, 26 aa, Cryptosporidium hominis
DLVRKLPCRHIYHFNCIDEWVKIKSN

SEQ ID NO: 2206367 - protein, 19 aa, Cryptosporidium hominis
DMLRECDYIHNIISSNWVD

SEQ ID NO: 2206368 - protein, 19 aa, Cryptosporidium hominis
DMVVLPFKYKIDLPPEVLP

SEQ ID NO: 2206369 - protein, 21 aa, Cryptosporidium hominis
DNKHIIGMTFLEFTNTKRSIA

SEQ ID NO: 2206370 - protein, 30 aa, Cryptosporidium hominis
DNLFGGISLKFYIRMCTNLINHFPRLHHGV

SEQ ID NO: 2206371 - protein, 17 aa, Cryptosporidium hominis
DNLKLEKLFPININLLS

SEQ ID NO: 2206372 - protein, 22 aa, Cryptosporidium hominis
DNLWIRNAINLIEMGIETLSTE

SEQ ID NO: 2206373 - protein, 20 aa, Cryptosporidium hominis
DNMCVVEKLLPAEVECPKGF

SEQ ID NO: 2206374 - protein, 23 aa, Cryptosporidium hominis
DNNSFFPAFGIFNKGDALALNNF

SEQ ID NO: 2206375 - protein, 25 aa, Cryptosporidium hominis
DNNVPLRWDIVSGISSGGFNALVSS

SEQ ID NO: 2206376 - protein, 21 aa, Cryptosporidium hominis
DNSINYCIYKYVDINMWSGFK

SEQ ID NO: 2206377 - protein, 26 aa, Cryptosporidium hominis
DPELQLFWNREVRMITDALVARDPNL

SEQ ID NO: 2206378 - protein, 20 aa, Cryptosporidium hominis
DPENGKVVGRWTMVYDEGFE

SEQ ID NO: 2206379 - protein, 26 aa, Cryptosporidium hominis
DPHPEGMVGYGGRYIFKFLAVGSGST

SEQ ID NO: 2206380 - protein, 18 aa, Cryptosporidium hominis
DPIVKVMIDREVKSKFNV

SEQ ID NO: 2206381 - protein, 17 aa, Cryptosporidium hominis
DPNGFKIDFAIVKKSIN

SEQ ID NO: 2206382 - protein, 23 aa, Cryptosporidium hominis
DPSRIVKVDVDFHLPQKNLDTFI

SEQ ID NO: 2206383 - protein, 17 aa, Cryptosporidium hominis
DQFKRGYRIGANSKKVD

SEQ ID NO: 2206384 - protein, 30 aa, Cryptosporidium hominis
DQPIFTLNGYRILKSIWYGSRLYKYNLSII

SEQ ID NO: 2206385 - protein, 26 aa, Cryptosporidium hominis
DQQCKDFGISSCRRALINILNIYSKV

SEQ ID NO: 2206386 - protein, 21 aa, Cryptosporidium hominis
DRNEEEFNLISLVNSETKARD

SEQ ID NO: 2206387 - protein, 22 aa, Cryptosporidium hominis
DRSEFSDPVIMESLENVPAKTD

SEQ ID NO: 2206388 - protein, 29 aa, Cryptosporidium hominis
DSAIDVCVQRGFFAEALLLAVKFGGIYLD

SEQ ID NO: 2206389 - protein, 22 aa, Cryptosporidium hominis
DSCAGCPNAPICASGQAKKKPI

SEQ ID NO: 2206390 - protein, 23 aa, Cryptosporidium hominis
DSDICFKSCMAFSTLDGQVHVAD

SEQ ID NO: 2206391 - protein, 17 aa, Cryptosporidium hominis
DSFIRKKDLCVGLQQDI

SEQ ID NO: 2206392 - protein, 20 aa, Cryptosporidium hominis
DSISIKCCSTIISPELIAKV

SEQ ID NO: 2206393 - protein, 27 aa, Cryptosporidium hominis
DSKSSCACCSCSRSGNTKEPKPEKESK

SEQ ID NO: 2206394 - protein, 23 aa, Cryptosporidium hominis
DSKSSSIPIDFVRSNYVIYIQSI

SEQ ID NO: 2206395 - protein, 30 aa, Cryptosporidium hominis
DSLPLKHFKSVLKYLLDIAVNDEPSKLDDQ

SEQ ID NO: 2206396 - protein, 22 aa, Cryptosporidium hominis
DSLPPTWHVYGIRPIQASIIRT

SEQ ID NO: 2206397 - protein, 20 aa, Cryptosporidium hominis
DSNLCTLHLLLKKYSQNRSG

SEQ ID NO: 2206398 - protein, 25 aa, Cryptosporidium hominis
DSNSLRPPVPFQLVQGIEECELEIY

SEQ ID NO: 2206399 - protein, 25 aa, Cryptosporidium hominis
DSVSQYDLLAILFVVKTRQGEAPLV

SEQ ID NO: 2206400 - protein, 22 aa, Cryptosporidium hominis
DSVYRLSLMRLCLLDISEGKLG

SEQ ID NO: 2206401 - protein, 27 aa, Cryptosporidium hominis
DSWSVGCLFSQMLFRLGTLKTNYFTRV

SEQ ID NO: 2206402 - protein, 28 aa, Cryptosporidium hominis
DTFGILSLESAYGWKMVNQTIRVPVTVP

SEQ ID NO: 2206403 - protein, 24 aa, Cryptosporidium hominis
DTFLRSGYVAEIKPVYSDSELKLE

SEQ ID NO: 2206404 - protein, 23 aa, Cryptosporidium hominis
DTNIIFRVRIVYRPISIAEDPEE

SEQ ID NO: 2206405 - protein, 23 aa, Cryptosporidium hominis
DTSLPVIFQIAIKTLRQFHLGSV

SEQ ID NO: 2206406 - protein, 20 aa, Cryptosporidium hominis
DVDVSWQYLRFLMEDDEKLE

SEQ ID NO: 2206407 - protein, 28 aa, Cryptosporidium hominis
DVNGSCIFCFSIFLTLYSRIQCQYVEVG

SEQ ID NO: 2206408 - protein, 26 aa, Cryptosporidium hominis
DVTALKWNPKVPHIMSSSSSNGTTAI

SEQ ID NO: 2206409 - protein, 20 aa, Cryptosporidium hominis
DWLYEIGDEITLELVEEKIR

SEQ ID NO: 2206410 - protein, 19 aa, Cryptosporidium hominis
DWYRLELISRELTNYYQDV

SEQ ID NO: 2206411 - protein, 21 aa, Cryptosporidium hominis
DYKRNNWFFKLLISQYNAISQ

SEQ ID NO: 2206412 - protein, 17 aa, Cryptosporidium hominis
DYLELGIPDMDYGVENQ

SEQ ID NO: 2206413 - protein, 20 aa, Cryptosporidium hominis
DYSYEFLNLLLSKEETDSLV

SEQ ID NO: 2206414 - protein, 25 aa, Cryptosporidium hominis
EADEIRFVLPDGFTFLKSNDNELIH

SEQ ID NO: 2206415 - protein, 18 aa, Cryptosporidium hominis
EAEFLRTTFCISAAVFCY

SEQ ID NO: 2206416 - protein, 24 aa, Cryptosporidium hominis
EAGIKSLLAILSFTQVGSNSQLNL

SEQ ID NO: 2206417 - protein, 22 aa, Cryptosporidium hominis
EAKILASILFYYSNLLNIPITT

SEQ ID NO: 2206418 - protein, 17 aa, Cryptosporidium hominis
EALMWIPGVLVDFSQWK

SEQ ID NO: 2206419 - protein, 19 aa, Cryptosporidium hominis
EALYNYCYNLFADFYSTGN

SEQ ID NO: 2206420 - protein, 22 aa, Cryptosporidium hominis
EANEFKHSLTIASDGSSIGILP

SEQ ID NO: 2206421 - protein, 19 aa, Cryptosporidium hominis
EASKLLGAQAFWGSNEKQI

SEQ ID NO: 2206422 - protein, 21 aa, Cryptosporidium hominis
EAVANRFSFWSGPSQTLNYTG

SEQ ID NO: 2206423 - protein, 23 aa, Cryptosporidium hominis
EAVSPQCGPYCSTYPKGYFTFWL

SEQ ID NO: 2206424 - protein, 27 aa, Cryptosporidium hominis
EAYLRGYLHLSFRISRLGLCLRTKITE

SEQ ID NO: 2206425 - protein, 24 aa, Cryptosporidium hominis
ECPKGFTLEIITGMCIKREIEELI

SEQ ID NO: 2206426 - protein, 22 aa, Cryptosporidium hominis
EDLANSFSCLFDESTECVPVES

SEQ ID NO: 2206427 - protein, 23 aa, Cryptosporidium hominis
EDSEIKARILAGNESDFKTERIS

SEQ ID NO: 2206428 - protein, 20 aa, Cryptosporidium hominis
EDWRNSRMTGLRVYNDGDHI

SEQ ID NO: 2206429 - protein, 25 aa, Cryptosporidium hominis
EEEKFEKFEEEFPMDYSPKVLSEEG

SEQ ID NO: 2206430 - protein, 19 aa, Cryptosporidium hominis
EEFKYRSELITNVDKKLNY

SEQ ID NO: 2206431 - protein, 21 aa, Cryptosporidium hominis
EEFNEMYGLLQFPQIVDIATR

SEQ ID NO: 2206432 - protein, 20 aa, Cryptosporidium hominis
EELLKFNLTNVIEIWLQILN

SEQ ID NO: 2206433 - protein, 17 aa, Cryptosporidium hominis
EELSVPIAIPNIYEEGK

SEQ ID NO: 2206434 - protein, 34 aa, Cryptosporidium hominis
EENKSEFFKSCFRTIRFLLKEQWKRHESQKKYNN

SEQ ID NO: 2206435 - protein, 22 aa, Cryptosporidium hominis
EENRRAKVWKGLKINSQPNNVN

SEQ ID NO: 2206436 - protein, 23 aa, Cryptosporidium hominis
EESKLRIGLFGVEVPKTANNFYS

SEQ ID NO: 2206437 - protein, 25 aa, Cryptosporidium hominis
EETFCAPGSRLTGLLVHTSTKIPHS

SEQ ID NO: 2206438 - protein, 22 aa, Cryptosporidium hominis
EETWYPHSFCNVLPVLPVIPIS

SEQ ID NO: 2206439 - protein, 22 aa, Cryptosporidium hominis
EEYKGSLPNVWSKETDKYEKEA

SEQ ID NO: 2206440 - protein, 23 aa, Cryptosporidium hominis
EEYSLVCSSGFVLLGDRCALFTN

SEQ ID NO: 2206441 - protein, 17 aa, Cryptosporidium hominis
EEYWTPFGIDPALLKKD

SEQ ID NO: 2206442 - protein, 17 aa, Cryptosporidium hominis
EFAFKKKIEPVGEAFFY

SEQ ID NO: 2206443 - protein, 17 aa, Cryptosporidium hominis
EFESFKLGRVEPQKLKI

SEQ ID NO: 2206444 - protein, 19 aa, Cryptosporidium hominis
EFETRIASTYSHIPEKLGF

SEQ ID NO: 2206445 - protein, 20 aa, Cryptosporidium hominis
EFIPRCMMRLLTYLGKLGSE

SEQ ID NO: 2206446 - protein, 21 aa, Cryptosporidium hominis
EFQADPSFEVMLNRASEMIER

SEQ ID NO: 2206447 - protein, 25 aa, Cryptosporidium hominis
EGCPCSKNIFSLECSCSVYPKNPGC

SEQ ID NO: 2206448 - protein, 25 aa, Cryptosporidium hominis
EGFREGWWGISIDITRPVVINSMDL

SEQ ID NO: 2206449 - protein, 23 aa, Cryptosporidium hominis
EGIKENPPRYELLPLAKPNEEQV

SEQ ID NO: 2206450 - protein, 24 aa, Cryptosporidium hominis
EGLPKRMVQDLCRLEEQDEEFLKS

SEQ ID NO: 2206451 - protein, 23 aa, Cryptosporidium hominis
EGREEKKTFGIEWGINETQSLYN

SEQ ID NO: 2206452 - protein, 17 aa, Cryptosporidium hominis
EGSLKLDEDAVILGAER

SEQ ID NO: 2206453 - protein, 19 aa, Cryptosporidium hominis
EGVGSFGTKGRGEGDDFDR

SEQ ID NO: 2206454 - protein, 20 aa, Cryptosporidium hominis
EHRKAVLLEQVIRFPTIKIY

SEQ ID NO: 2206455 - protein, 18 aa, Cryptosporidium hominis
EIDLKCSFNDGVYYNTAI

SEQ ID NO: 2206456 - protein, 19 aa, Cryptosporidium hominis
EIHDKFRFQNEGMHSSYYS

SEQ ID NO: 2206457 - protein, 25 aa, Cryptosporidium hominis
EIKESCPYLLLQITNLEHWPKIMLT

SEQ ID NO: 2206458 - protein, 18 aa, Cryptosporidium hominis
EINFCKKVGLNILGVVEN

SEQ ID NO: 2206459 - protein, 20 aa, Cryptosporidium hominis
EINKYFSPYSSIHYLTSSEI

SEQ ID NO: 2206460 - protein, 24 aa, Cryptosporidium hominis
EISCNCKGSFIYSFAESRDQNRAL

SEQ ID NO: 2206461 - protein, 20 aa, Cryptosporidium hominis
EISPEVMKSIPISIKCTTVS

SEQ ID NO: 2206462 - protein, 18 aa, Cryptosporidium hominis
EITPRIKLAEEINKLQFA

SEQ ID NO: 2206463 - protein, 19 aa, Cryptosporidium hominis
EITRSCYRLIRYFQKSGVP

SEQ ID NO: 2206464 - protein, 24 aa, Cryptosporidium hominis
EKCPKRRSKRGRSRTGVTSLDEST

SEQ ID NO: 2206465 - protein, 23 aa, Cryptosporidium hominis
EKEGNKGLCSHSMNDENSASCSQ

SEQ ID NO: 2206466 - protein, 20 aa, Cryptosporidium hominis
EKELEALRFMEKIENLSANV

SEQ ID NO: 2206467 - protein, 19 aa, Cryptosporidium hominis
EKGKMRFNYIPKFSEINQS

SEQ ID NO: 2206468 - protein, 20 aa, Cryptosporidium hominis
EKGSCKGGYCVGPKCNGNEY

SEQ ID NO: 2206469 - protein, 17 aa, Cryptosporidium hominis
EKIKSPIPIIPVEEEVK

SEQ ID NO: 2206470 - protein, 25 aa, Cryptosporidium hominis
EKINLKQWEEWLLKLDHFQLEHLDN

SEQ ID NO: 2206471 - protein, 21 aa, Cryptosporidium hominis
EKIRLMNSIRIFALDLSQNCI

SEQ ID NO: 2206472 - protein, 20 aa, Cryptosporidium hominis
EKKISKRDAWLRHLQSREST

SEQ ID NO: 2206473 - protein, 18 aa, Cryptosporidium hominis
EKKKLCIADLKKIHEKSL

SEQ ID NO: 2206474 - protein, 26 aa, Cryptosporidium hominis
EKLAPSIECGRGLKWSESKNICVGVK

SEQ ID NO: 2206475 - protein, 20 aa, Cryptosporidium hominis
EKMIFNVMMRFTENSYLQSC

SEQ ID NO: 2206476 - protein, 27 aa, Cryptosporidium hominis
EKNIPNKVRAMIELAMYLAPEECPARK

SEQ ID NO: 2206477 - protein, 26 aa, Cryptosporidium hominis
EKRFPESIQVLGIRLFGRFQGINTNV

SEQ ID NO: 2206478 - protein, 20 aa, Cryptosporidium hominis
EKSHGLFTVAVQWKKMKGID

SEQ ID NO: 2206479 - protein, 21 aa, Cryptosporidium hominis
EKVARRRSLSLSRETFLSIDE

SEQ ID NO: 2206480 - protein, 22 aa, Cryptosporidium hominis
EKYPLKWIKQVQKYGLSDDCDW

SEQ ID NO: 2206481 - protein, 17 aa, Cryptosporidium hominis
EKYSMVVYFFLIGHQYN

SEQ ID NO: 2206482 - protein, 23 aa, Cryptosporidium hominis
ELASRLKTFLSVEQIIYLVQEII

SEQ ID NO: 2206483 - protein, 24 aa, Cryptosporidium hominis
ELCSIKVVIITAFDVLKSSLFIVF

SEQ ID NO: 2206484 - protein, 19 aa, Cryptosporidium hominis
ELDQRIGYSNVLLNALIYD

SEQ ID NO: 2206485 - protein, 20 aa, Cryptosporidium hominis
ELFCKEIFSAGFVADATSES

SEQ ID NO: 2206486 - protein, 20 aa, Cryptosporidium hominis
ELFEPDFIRQVLKEELPQDI

SEQ ID NO: 2206487 - protein, 19 aa, Cryptosporidium hominis
ELFHCSKNQLDLSFKLLQK

SEQ ID NO: 2206488 - protein, 22 aa, Cryptosporidium hominis
ELKEILKVVCEPMYRMFVYSSQ

SEQ ID NO: 2206489 - protein, 24 aa, Cryptosporidium hominis
ELKLPRISRKNVISEYTVEDLVSK

SEQ ID NO: 2206490 - protein, 19 aa, Cryptosporidium hominis
ELKVDARNLFDIGGVHSNN

SEQ ID NO: 2206491 - protein, 23 aa, Cryptosporidium hominis
ELLRQEFIFRRSLMNTMNKEQDE

SEQ ID NO: 2206492 - protein, 17 aa, Cryptosporidium hominis
ELLTNSWMNLSKIPTEI

SEQ ID NO: 2206493 - protein, 17 aa, Cryptosporidium hominis
ELNNFYRELFKEVDTDK

SEQ ID NO: 2206494 - protein, 19 aa, Cryptosporidium hominis
ELQRLPFIYKDSELKEKIE

SEQ ID NO: 2206495 - protein, 22 aa, Cryptosporidium hominis
ELRKDRELLTKVILDLRDSKDL

SEQ ID NO: 2206496 - protein, 19 aa, Cryptosporidium hominis
ELRLIIAPLALALVPVGEV

SEQ ID NO: 2206497 - protein, 17 aa, Cryptosporidium hominis
ELSELLLELWSDLANSK

SEQ ID NO: 2206498 - protein, 27 aa, Cryptosporidium hominis
ELSVDLSWYKVCAFSISIIDTKTSFMN

SEQ ID NO: 2206499 - protein, 24 aa, Cryptosporidium hominis
ELTEHDLRQALVCSKKTTDGLEIC

SEQ ID NO: 2206500 - protein, 25 aa, Cryptosporidium hominis
ELVRLSRIAGLEFRDMCEVAIQIAN

SEQ ID NO: 2206501 - protein, 23 aa, Cryptosporidium hominis
EMIKRSYMGPMLMNAENKGNLFN

SEQ ID NO: 2206502 - protein, 20 aa, Cryptosporidium hominis
EMLPLPLGPPIPGTEPGIEG

SEQ ID NO: 2206503 - protein, 18 aa, Cryptosporidium hominis
EMRRKLKPAEMLTKSQSP

SEQ ID NO: 2206504 - protein, 25 aa, Cryptosporidium hominis
ENDHLYWRRGELLNHELNSLILDAL

SEQ ID NO: 2206505 - protein, 18 aa, Cryptosporidium hominis
ENGIPYWIIRNSWGANWG

SEQ ID NO: 2206506 - protein, 26 aa, Cryptosporidium hominis
ENGNVLRLMLNFSKIGLWIWDNNLLL

SEQ ID NO: 2206507 - protein, 23 aa, Cryptosporidium hominis
ENISLLLKFERIIFTKRSDQAKK

SEQ ID NO: 2206508 - protein, 17 aa, Cryptosporidium hominis
ENLKILLSIYQGVASRK

SEQ ID NO: 2206509 - protein, 19 aa, Cryptosporidium hominis
ENSIEVFCHDVSRRWFSKW

SEQ ID NO: 2206510 - protein, 32 aa, Cryptosporidium hominis
ENSWFVKFYAPWCGHCKSLAPDWEELGSMADG

SEQ ID NO: 2206511 - protein, 25 aa, Cryptosporidium hominis
ENTCTKGLCVIAFLPHIADSSDSER

SEQ ID NO: 2206512 - protein, 20 aa, Cryptosporidium hominis
ENTFKNRKILALIISINSEF

SEQ ID NO: 2206513 - protein, 24 aa, Cryptosporidium hominis
EPAKNTFIFKNRYEEMKNTQSTSG

SEQ ID NO: 2206514 - protein, 24 aa, Cryptosporidium hominis
EPDCSSSISCKKCDYNSIIKNDPS

SEQ ID NO: 2206515 - protein, 18 aa, Cryptosporidium hominis
EPEIPTDVSIQIERKLGG

SEQ ID NO: 2206516 - protein, 24 aa, Cryptosporidium hominis
EPFALLECHALTWIDFSVVMDIKF

SEQ ID NO: 2206517 - protein, 19 aa, Cryptosporidium hominis
EPLDCPLPLTKEIKQSISH

SEQ ID NO: 2206518 - protein, 17 aa, Cryptosporidium hominis
EQFCKKGLHSKRSSKLF

SEQ ID NO: 2206519 - protein, 24 aa, Cryptosporidium hominis
EQGTRIENLYSWYEVVVPPKPQYC

SEQ ID NO: 2206520 - protein, 22 aa, Cryptosporidium hominis
EQQISPLFQFRAKLYFEGNTWK

SEQ ID NO: 2206521 - protein, 21 aa, Cryptosporidium hominis
ERKGFKIVAMKFLVATAQQIE

SEQ ID NO: 2206522 - protein, 22 aa, Cryptosporidium hominis
ERLDIKTSLPFNSIQRIYTLVE

SEQ ID NO: 2206523 - protein, 18 aa, Cryptosporidium hominis
ERNSPLKIVDSWFSAEEV

SEQ ID NO: 2206524 - protein, 23 aa, Cryptosporidium hominis
ERQWFFLDSWYGGLGTAARKVHP

SEQ ID NO: 2206525 - protein, 19 aa, Cryptosporidium hominis
ERSGPNFSTDFGSVATNEA

SEQ ID NO: 2206526 - protein, 18 aa, Cryptosporidium hominis
ERSSRMEFVITRNAEIAI

SEQ ID NO: 2206527 - protein, 18 aa, Cryptosporidium hominis
ERTLRFLTFQAEQVDRIK

SEQ ID NO: 2206528 - protein, 21 aa, Cryptosporidium hominis
ERYARVRFGSCNETENMVDSL

SEQ ID NO: 2206529 - protein, 23 aa, Cryptosporidium hominis
ESCKRRCAISRNIGKCRGIENRL

SEQ ID NO: 2206530 - protein, 24 aa, Cryptosporidium hominis
ESDQVCTLKEFIYFLDYINTKKFE

SEQ ID NO: 2206531 - protein, 25 aa, Cryptosporidium hominis
ESELFWKMKTNLILTTDARFEGAQL

SEQ ID NO: 2206532 - protein, 34 aa, Cryptosporidium hominis
ESIKLLKRKLLFSWPRTRLRRSLLDSNRRKKMEE

SEQ ID NO: 2206533 - protein, 19 aa, Cryptosporidium hominis
ESISRRKLLDIKYLEYDLP

SEQ ID NO: 2206534 - protein, 25 aa, Cryptosporidium hominis
ESKPPTLKCLDGFSLDNNSNCKQVI

SEQ ID NO: 2206535 - protein, 17 aa, Cryptosporidium hominis
ESLPLWLEDDSLKKVIH

SEQ ID NO: 2206536 - protein, 17 aa, Cryptosporidium hominis
ESMNLLLGIDQVLKFEA

SEQ ID NO: 2206537 - protein, 32 aa, Cryptosporidium hominis
ESPVDPFWLIQAYRMLLIYSVLLDDAGIFVNL

SEQ ID NO: 2206538 - protein, 20 aa, Cryptosporidium hominis
ESQLLCEGHHSIHLETLPSE

SEQ ID NO: 2206539 - protein, 21 aa, Cryptosporidium hominis
ESRISTSYCVKELSSPYNLEC

SEQ ID NO: 2206540 - protein, 25 aa, Cryptosporidium hominis
ESSKFRLELISSLTNIYLQLAANMH

SEQ ID NO: 2206541 - protein, 25 aa, Cryptosporidium hominis
ESTGPFGGLAPRPPSPLKTIPRKTK

SEQ ID NO: 2206542 - protein, 22 aa, Cryptosporidium hominis
ESYLMIHTEIWVHPEKQIREEY

SEQ ID NO: 2206543 - protein, 25 aa, Cryptosporidium hominis
ETFVFKSGYLFLTNFWLDMRSNFDN

SEQ ID NO: 2206544 - protein, 19 aa, Cryptosporidium hominis
ETGFVRTGIKIAAYDDYDE

SEQ ID NO: 2206545 - protein, 22 aa, Cryptosporidium hominis
ETGLKNKLWNFLYERSLQDTSL

SEQ ID NO: 2206546 - protein, 22 aa, Cryptosporidium hominis
ETKGTESLKMMGNLANGSYVLR

SEQ ID NO: 2206547 - protein, 17 aa, Cryptosporidium hominis
ETPEGLVSIGFLERKAN

SEQ ID NO: 2206548 - protein, 19 aa, Cryptosporidium hominis
ETTECYVMIYTTSLYISSN

SEQ ID NO: 2206549 - protein, 22 aa, Cryptosporidium hominis
ETWTASCPLSSWHDEFSDALVS

SEQ ID NO: 2206550 - protein, 29 aa, Cryptosporidium hominis
ETYENLCLFGVAKCMNRDLQLVANVTCPD

SEQ ID NO: 2206551 - protein, 17 aa, Cryptosporidium hominis
EVAILVDVGFLYDPPKI

SEQ ID NO: 2206552 - protein, 18 aa, Cryptosporidium hominis
EVCFNKKGGFECKCGTGF

SEQ ID NO: 2206553 - protein, 25 aa, Cryptosporidium hominis
EVGVAIGEPIWKIYNTSTIGRAQRR

SEQ ID NO: 2206554 - protein, 25 aa, Cryptosporidium hominis
EVIEINLDVLIVFYAPWCGHCRKLE

SEQ ID NO: 2206555 - protein, 24 aa, Cryptosporidium hominis
EVIIFKLKLGKIIKNENKKPDNEV

SEQ ID NO: 2206556 - protein, 24 aa, Cryptosporidium hominis
EVTKFSVFQTIAWNELGELMKSSY

SEQ ID NO: 2206557 - protein, 22 aa, Cryptosporidium hominis
EVVAVKLLRLGPTSDLLEQFIN

SEQ ID NO: 2206558 - protein, 20 aa, Cryptosporidium hominis
EVVPKMALKFESLKYEDPKN

SEQ ID NO: 2206559 - protein, 18 aa, Cryptosporidium hominis
EVVVQCKSVAFPPNPKYN

SEQ ID NO: 2206560 - protein, 26 aa, Cryptosporidium hominis
EWAHTLSSVWMLSRFYESFPISAITG

SEQ ID NO: 2206561 - protein, 17 aa, Cryptosporidium hominis
EWCLPKFVENNPFNYNL

SEQ ID NO: 2206562 - protein, 20 aa, Cryptosporidium hominis
EWLEKTNAWELWNKAIYKLQ

SEQ ID NO: 2206563 - protein, 17 aa, Cryptosporidium hominis
EWWSVGVNFIGRNSSTH

SEQ ID NO: 2206564 - protein, 20 aa, Cryptosporidium hominis
EYIKEYKGRTNAMVVKTSGE

SEQ ID NO: 2206565 - protein, 29 aa, Cryptosporidium hominis
EYLISFSMLLKRRFRKFIFKKYSPSRIRS

SEQ ID NO: 2206566 - protein, 25 aa, Cryptosporidium hominis
FAGLKFLRQTHVPFLITKEELDKLQ

SEQ ID NO: 2206567 - protein, 17 aa, Cryptosporidium hominis
FAIEICMIPSIWYLELI

SEQ ID NO: 2206568 - protein, 25 aa, Cryptosporidium hominis
FAIFICSSSLRWERCAVKGSIKSKF

SEQ ID NO: 2206569 - protein, 18 aa, Cryptosporidium hominis
FAILLLFGVFLTISEASE

SEQ ID NO: 2206570 - protein, 18 aa, Cryptosporidium hominis
FAKYRRAAILFRDTSLPV

SEQ ID NO: 2206571 - protein, 17 aa, Cryptosporidium hominis
FALSFGKFRNIDLLQSG

SEQ ID NO: 2206572 - protein, 17 aa, Cryptosporidium hominis
FASFKLMSLYILKKIYK

SEQ ID NO: 2206573 - protein, 19 aa, Cryptosporidium hominis
FATFMGPFFITKRCIDLMH

SEQ ID NO: 2206574 - protein, 17 aa, Cryptosporidium hominis
FCNVLPVLPVIPISFPQ

SEQ ID NO: 2206575 - protein, 20 aa, Cryptosporidium hominis
FDDFSGFDLLLGVYPSTTIK

SEQ ID NO: 2206576 - protein, 18 aa, Cryptosporidium hominis
FDEGRRQFCSGKYSADSH

SEQ ID NO: 2206577 - protein, 26 aa, Cryptosporidium hominis
FDGLKLSAQCNDCWAKTAHCGVKHCA

SEQ ID NO: 2206578 - protein, 17 aa, Cryptosporidium hominis
FDKKLKIWVRGNNNRIP

SEQ ID NO: 2206579 - protein, 21 aa, Cryptosporidium hominis
FDKTGFCPFSNVIIQHACTEL

SEQ ID NO: 2206580 - protein, 27 aa, Cryptosporidium hominis
FDLKLIYKPNCFERACFKKPEKVFFEN

SEQ ID NO: 2206581 - protein, 18 aa, Cryptosporidium hominis
FDLRFKHDVLSSYELYGF

SEQ ID NO: 2206582 - protein, 23 aa, Cryptosporidium hominis
FDNRNCPRCPIVGQYEVTIVSKS

SEQ ID NO: 2206583 - protein, 23 aa, Cryptosporidium hominis
FDTEVLLFELIKFYGSYYSSNLM

SEQ ID NO: 2206584 - protein, 21 aa, Cryptosporidium hominis
FDVLKSSLFIVFFFEKSSLNV

SEQ ID NO: 2206585 - protein, 17 aa, Cryptosporidium hominis
FEANEGFAQLIFSILDL

SEQ ID NO: 2206586 - protein, 19 aa, Cryptosporidium hominis
FEEKLNLAFGYPAVVAINN

SEQ ID NO: 2206587 - protein, 24 aa, Cryptosporidium hominis
FEFLRDIVRFLPFQWYSQYLTALA

SEQ ID NO: 2206588 - protein, 20 aa, Cryptosporidium hominis
FEIECMRELMKIGTQFTSEI

SEQ ID NO: 2206589 - protein, 21 aa, Cryptosporidium hominis
FEKMVFKSFYNLSLFFLKWFK

SEQ ID NO: 2206590 - protein, 25 aa, Cryptosporidium hominis
FEKRLSVCRRNEYNLKKIIYENKRG

SEQ ID NO: 2206591 - protein, 25 aa, Cryptosporidium hominis
FENWIKRFSKEYHENTFKNRKILAL

SEQ ID NO: 2206592 - protein, 21 aa, Cryptosporidium hominis
FERPPKCIFKTEIQFKVIDLP

SEQ ID NO: 2206593 - protein, 17 aa, Cryptosporidium hominis
FESFCSLVLALSKVEKK

SEQ ID NO: 2206594 - protein, 25 aa, Cryptosporidium hominis
FETRSLCFNSIYLSKFWSSLNKITS

SEQ ID NO: 2206595 - protein, 20 aa, Cryptosporidium hominis
FFDGTLIHWSLQYIFSQIYN

SEQ ID NO: 2206596 - protein, 18 aa, Cryptosporidium hominis
FFDIYFLNPEKVFSKRDF

SEQ ID NO: 2206597 - protein, 17 aa, Cryptosporidium hominis
FFGCVFVSVYSGEEKTF

SEQ ID NO: 2206598 - protein, 19 aa, Cryptosporidium hominis
FFLALDLFATYYLEYASSG

SEQ ID NO: 2206599 - protein, 19 aa, Cryptosporidium hominis
FFLTICLEIWETEGNRLQI

SEQ ID NO: 2206600 - protein, 20 aa, Cryptosporidium hominis
FFNRECVNALAAMSISKEYG

SEQ ID NO: 2206601 - protein, 18 aa, Cryptosporidium hominis
FFNSFFSNRVCLFETFKL

SEQ ID NO: 2206602 - protein, 28 aa, Cryptosporidium hominis
FFNSICWRILSTYPITFKTSIGIISQPI

SEQ ID NO: 2206603 - protein, 17 aa, Cryptosporidium hominis
FGASYYIWNDGGNPGSY

SEQ ID NO: 2206604 - protein, 23 aa, Cryptosporidium hominis
FGDWGEPTAILSAVSRSMANLAS

SEQ ID NO: 2206605 - protein, 24 aa, Cryptosporidium hominis
FGEDIPFVAVIPVGSKPGLNIFKQ

SEQ ID NO: 2206606 - protein, 19 aa, Cryptosporidium hominis
FGEKCKIAALLSNILDTNA

SEQ ID NO: 2206607 - protein, 18 aa, Cryptosporidium hominis
FGGFFPMLVPNDKFSNGV

SEQ ID NO: 2206608 - protein, 17 aa, Cryptosporidium hominis
FGKDSKFRVFVSAFDVE

SEQ ID NO: 2206609 - protein, 23 aa, Cryptosporidium hominis
FGLRLPPTHSKWYVFTRTADKWD

SEQ ID NO: 2206610 - protein, 19 aa, Cryptosporidium hominis
FGQVSDWLLKEHIKNSLNL

SEQ ID NO: 2206611 - protein, 17 aa, Cryptosporidium hominis
FHNSCLGVLSFGLRGYL

SEQ ID NO: 2206612 - protein, 19 aa, Cryptosporidium hominis
FIACILYFISLVSANGVCI

SEQ ID NO: 2206613 - protein, 19 aa, Cryptosporidium hominis
FICQCYCSVSQYIFENGKM

SEQ ID NO: 2206614 - protein, 30 aa, Cryptosporidium hominis
FIFICIFLVFCKLPYISRCEQLESEEIPTG

SEQ ID NO: 2206615 - protein, 19 aa, Cryptosporidium hominis
FIGGNEWDNVQGLKFLSFA

SEQ ID NO: 2206616 - protein, 27 aa, Cryptosporidium hominis
FIISILQWYFFFLLVILMAGRIYGESS

SEQ ID NO: 2206617 - protein, 17 aa, Cryptosporidium hominis
FIIYQFFFNSFFSNRVC

SEQ ID NO: 2206618 - protein, 21 aa, Cryptosporidium hominis
FILGFFLIFLGVHSESSLLSE

SEQ ID NO: 2206619 - protein, 25 aa, Cryptosporidium hominis
FILVELSIYISLLLKLLALVNPEDV

SEQ ID NO: 2206620 - protein, 25 aa, Cryptosporidium hominis
FINCHDPRYGLTIIKPPLYDYLFEL

SEQ ID NO: 2206621 - protein, 26 aa, Cryptosporidium hominis
FIPPKGFENLPGFYGLYSSIGKSKAV

SEQ ID NO: 2206622 - protein, 18 aa, Cryptosporidium hominis
FIQYCRRGIRSLAYERYI

SEQ ID NO: 2206623 - protein, 25 aa, Cryptosporidium hominis
FKATSFPFKISVDYSEVVPGTNSHG

SEQ ID NO: 2206624 - protein, 31 aa, Cryptosporidium hominis
FKFRNCPGTLKNLLFWKGKDMELIRDHIVSA

SEQ ID NO: 2206625 - protein, 24 aa, Cryptosporidium hominis
FKFSDLPFKLTKSINDRENNKKQN

SEQ ID NO: 2206626 - protein, 24 aa, Cryptosporidium hominis
FKHIVSVALAICYDTLRWQQATCV

SEQ ID NO: 2206627 - protein, 19 aa, Cryptosporidium hominis
FKIHGKLNFLLPLKHDRLF

SEQ ID NO: 2206628 - protein, 25 aa, Cryptosporidium hominis
FKIKNVFGPNIFKLFKKKEQKPARK

SEQ ID NO: 2206629 - protein, 20 aa, Cryptosporidium hominis
FKIPDCKLNILYKAVNTLLH

SEQ ID NO: 2206630 - protein, 19 aa, Cryptosporidium hominis
FKIRSRNSSFFKYSAESCN

SEQ ID NO: 2206631 - protein, 20 aa, Cryptosporidium hominis
FKISNLAGMSNWKYSILATL

SEQ ID NO: 2206632 - protein, 21 aa, Cryptosporidium hominis
FKKKIEPVGEAFFYRYEGKYS

SEQ ID NO: 2206633 - protein, 21 aa, Cryptosporidium hominis
FKLMIACPYAISNHCMQNNCG

SEQ ID NO: 2206634 - protein, 20 aa, Cryptosporidium hominis
FKLMSLYILKKIYKVAYENP

SEQ ID NO: 2206635 - protein, 29 aa, Cryptosporidium hominis
FKMKIRRLKCLQFILLLLSFVSFKIFMFG

SEQ ID NO: 2206636 - protein, 22 aa, Cryptosporidium hominis
FKMPEFNWNLFSEKLVFTSKNF

SEQ ID NO: 2206637 - protein, 20 aa, Cryptosporidium hominis
FKNTTLCTEILTLIDKLKQL

SEQ ID NO: 2206638 - protein, 19 aa, Cryptosporidium hominis
FKRGYRIGANSKKVDEFSD

SEQ ID NO: 2206639 - protein, 18 aa, Cryptosporidium hominis
FKRHECPKADGDSIKREP

SEQ ID NO: 2206640 - protein, 20 aa, Cryptosporidium hominis
FKSFTCSSCNKSKIQEGDCI

SEQ ID NO: 2206641 - protein, 22 aa, Cryptosporidium hominis
FKSLQRNGFRPDLRLNGLPTTN

SEQ ID NO: 2206642 - protein, 19 aa, Cryptosporidium hominis
FKSSYSMQALCETSFMSYY

SEQ ID NO: 2206643 - protein, 17 aa, Cryptosporidium hominis
FKTFSRLTINYLKSIIF

SEQ ID NO: 2206644 - protein, 27 aa, Cryptosporidium hominis
FKVSIFYFVLGLILDFGKVSCIPTGIS

SEQ ID NO: 2206645 - protein, 21 aa, Cryptosporidium hominis
FKWFFTATLVFIFGLLILSSR

SEQ ID NO: 2206646 - protein, 17 aa, Cryptosporidium hominis
FLDKVIGGDARFTNIKG

SEQ ID NO: 2206647 - protein, 17 aa, Cryptosporidium hominis
FLFGLVYLLPLNFNYYN

SEQ ID NO: 2206648 - protein, 21 aa, Cryptosporidium hominis
FLFSSLCTGIGLKSPSTSSGS

SEQ ID NO: 2206649 - protein, 18 aa, Cryptosporidium hominis
FLGFSCLSKVVLGGDEAH

SEQ ID NO: 2206650 - protein, 24 aa, Cryptosporidium hominis
FLIIRAMILSMTYLVNKFIPVEEN

SEQ ID NO: 2206651 - protein, 17 aa, Cryptosporidium hominis
FLILCVFTSGTPIPTPN

SEQ ID NO: 2206652 - protein, 18 aa, Cryptosporidium hominis
FLIVFLGSFTFCEQLGHN

SEQ ID NO: 2206653 - protein, 21 aa, Cryptosporidium hominis
FLKEEIKIENSIPINNIYSQE

SEQ ID NO: 2206654 - protein, 19 aa, Cryptosporidium hominis
FLLFIKLGVFSLTINTSPK

SEQ ID NO: 2206655 - protein, 19 aa, Cryptosporidium hominis
FLLKWIIFSYIVINNINGI

SEQ ID NO: 2206656 - protein, 17 aa, Cryptosporidium hominis
FLLLFFTKYLKITNGAE

SEQ ID NO: 2206657 - protein, 18 aa, Cryptosporidium hominis
FLSAIKMLWKEGREQSFE

SEQ ID NO: 2206658 - protein, 17 aa, Cryptosporidium hominis
FLTPFIGLVLLLNFAHG

SEQ ID NO: 2206659 - protein, 17 aa, Cryptosporidium hominis
FLVGQIVQHLWWNYYGV

SEQ ID NO: 2206660 - protein, 17 aa, Cryptosporidium hominis
FMEIKWNPGSSLSNGVI

SEQ ID NO: 2206661 - protein, 25 aa, Cryptosporidium hominis
FNKAKEFLLLLSRNARLIENNLGGQ

SEQ ID NO: 2206662 - protein, 20 aa, Cryptosporidium hominis
FNKFRTYKKYSFGTANLASI

SEQ ID NO: 2206663 - protein, 17 aa, Cryptosporidium hominis
FNLRPARLYNELERAMR

SEQ ID NO: 2206664 - protein, 18 aa, Cryptosporidium hominis
FNLTNVIEIWLQILNVSN

SEQ ID NO: 2206665 - protein, 22 aa, Cryptosporidium hominis
FNPPCSNGKVSGIFRYTDNDNY

SEQ ID NO: 2206666 - protein, 27 aa, Cryptosporidium hominis
FNQGNCGSCYAVSSVYILAKRAELKLN

SEQ ID NO: 2206667 - protein, 18 aa, Cryptosporidium hominis
FNSGISFIAILGPLRTFL

SEQ ID NO: 2206668 - protein, 18 aa, Cryptosporidium hominis
FNVAHTFGNATCNVDSTN

SEQ ID NO: 2206669 - protein, 20 aa, Cryptosporidium hominis
FPAGLGPPLVRVQKVKGEMK

SEQ ID NO: 2206670 - protein, 21 aa, Cryptosporidium hominis
FPAPGYYRFQLKVRTPVETRK

SEQ ID NO: 2206671 - protein, 21 aa, Cryptosporidium hominis
FPDKLFYVIRYFNFIMILTEY

SEQ ID NO: 2206672 - protein, 19 aa, Cryptosporidium hominis
FPGFSTPMVKEFDPNTSRH

SEQ ID NO: 2206673 - protein, 23 aa, Cryptosporidium hominis
FPGNPRFTGGLQERIFSSFPAIF

SEQ ID NO: 2206674 - protein, 17 aa, Cryptosporidium hominis
FPGRNDWTFLAVKDPEN

SEQ ID NO: 2206675 - protein, 23 aa, Cryptosporidium hominis
FPISEIPSFIEFCEIVHSIFTDN

SEQ ID NO: 2206676 - protein, 21 aa, Cryptosporidium hominis
FPKPGSEIFSFYTYLSDSIDF

SEQ ID NO: 2206677 - protein, 17 aa, Cryptosporidium hominis
FPKTGYRGCGSNFDFYY

SEQ ID NO: 2206678 - protein, 20 aa, Cryptosporidium hominis
FPNPIKGFRNMFCKRLEKKY

SEQ ID NO: 2206679 - protein, 18 aa, Cryptosporidium hominis
FPNYAVLFDEGRRQFCSG

SEQ ID NO: 2206680 - protein, 22 aa, Cryptosporidium hominis
FPPELVCPPGYTMEAGVAQGTR

SEQ ID NO: 2206681 - protein, 19 aa, Cryptosporidium hominis
FQIPCTFYSPMITVSVPKS

SEQ ID NO: 2206682 - protein, 23 aa, Cryptosporidium hominis
FQLLWRYIISEGIQINAATKEND

SEQ ID NO: 2206683 - protein, 19 aa, Cryptosporidium hominis
FQPGRAMGTPWPEKGPYEF

SEQ ID NO: 2206684 - protein, 25 aa, Cryptosporidium hominis
FQSCLKSVPDRWIPVGLNTTEFTFK

SEQ ID NO: 2206685 - protein, 33 aa, Cryptosporidium hominis
FQSRNFAKQELNGIMRGCMWCTQEVMCNTLSSL

SEQ ID NO: 2206686 - protein, 17 aa, Cryptosporidium hominis
FRDNLKKSLLVQDQNKP

SEQ ID NO: 2206687 - protein, 17 aa, Cryptosporidium hominis
FRFASPQNKDRMREAFV

SEQ ID NO: 2206688 - protein, 27 aa, Cryptosporidium hominis
FRILISGYPRSKWRGADFSTLAYRNSI

SEQ ID NO: 2206689 - protein, 18 aa, Cryptosporidium hominis
FRMVRDVAPRLGYLKPSS

SEQ ID NO: 2206690 - protein, 24 aa, Cryptosporidium hominis
FRNMFCKRLEKKYREYVADILQLR

SEQ ID NO: 2206691 - protein, 19 aa, Cryptosporidium hominis
FRRFVRLFRSINISTLLVP

SEQ ID NO: 2206692 - protein, 17 aa, Cryptosporidium hominis
FRYLYEQGYGRTKKRVI

SEQ ID NO: 2206693 - protein, 18 aa, Cryptosporidium hominis
FSCLIIKWNFSLSQDSLH

SEQ ID NO: 2206694 - protein, 25 aa, Cryptosporidium hominis
FSDPEPKCLPGFEFDNKSETCVNKS

SEQ ID NO: 2206695 - protein, 19 aa, Cryptosporidium hominis
FSETLFALQGFKIIEKQVS

SEQ ID NO: 2206696 - protein, 17 aa, Cryptosporidium hominis
FSHDYFYDEIPEISLCI

SEQ ID NO: 2206697 - protein, 18 aa, Cryptosporidium hominis
FSKFKSAISRPFRAHKLK

SEQ ID NO: 2206698 - protein, 18 aa, Cryptosporidium hominis
FSKLYSFNPLKIKKYSQE

SEQ ID NO: 2206699 - protein, 18 aa, Cryptosporidium hominis
FSLAKCKASISLFSDIAI

SEQ ID NO: 2206700 - protein, 18 aa, Cryptosporidium hominis
FSLEDISAFHKPEHLTEA

SEQ ID NO: 2206701 - protein, 18 aa, Cryptosporidium hominis
FSLGSHRRITEACRKIDP

SEQ ID NO: 2206702 - protein, 19 aa, Cryptosporidium hominis
FSMLVLESVIKILKNQRSK

SEQ ID NO: 2206703 - protein, 24 aa, Cryptosporidium hominis
FSNIFKWDIGNSYQYAEPYLQLVL

SEQ ID NO: 2206704 - protein, 28 aa, Cryptosporidium hominis
FSQFKYYMKMCLISFPAILGSKSKNFQE

SEQ ID NO: 2206705 - protein, 24 aa, Cryptosporidium hominis
FSRWRRQFMCIVMAISDIPKDVSL

SEQ ID NO: 2206706 - protein, 24 aa, Cryptosporidium hominis
FSSKTCVCKPCAMRDNRGSADSSM

SEQ ID NO: 2206707 - protein, 19 aa, Cryptosporidium hominis
FSSLCYNVYRINNVANGIV

SEQ ID NO: 2206708 - protein, 19 aa, Cryptosporidium hominis
FSYDITMYSHFKILKSSDF

SEQ ID NO: 2206709 - protein, 18 aa, Cryptosporidium hominis
FSYPGAILEFERNRQWGV

SEQ ID NO: 2206710 - protein, 23 aa, Cryptosporidium hominis
FTEDSCFNRTLPINCDNSNSTLL

SEQ ID NO: 2206711 - protein, 25 aa, Cryptosporidium hominis
FTISEGIPALIPRIEELASSKINSS

SEQ ID NO: 2206712 - protein, 33 aa, Cryptosporidium hominis
FTKIDSVVLFYVPWCVYCRGIMPEFEKAANIFK

SEQ ID NO: 2206713 - protein, 30 aa, Cryptosporidium hominis
FTKYIEHFGKLIVSHELCFEKNKLIENATQ

SEQ ID NO: 2206714 - protein, 26 aa, Cryptosporidium hominis
FTKYRPKIRELINFGQETLRVAEKYN

SEQ ID NO: 2206715 - protein, 17 aa, Cryptosporidium hominis
FTLDPSLLKVISEMSNP

SEQ ID NO: 2206716 - protein, 25 aa, Cryptosporidium hominis
FTMPEKSCPPGFVFSGKQCVQSDTA

SEQ ID NO: 2206717 - protein, 19 aa, Cryptosporidium hominis
FTNFIRVCVHNYFWRVPCG

SEQ ID NO: 2206718 - protein, 20 aa, Cryptosporidium hominis
FTSNFFLQEEFELEKSSSIG

SEQ ID NO: 2206719 - protein, 25 aa, Cryptosporidium hominis
FTVAVQWKKMKGIDVSQCSNGIAEI

SEQ ID NO: 2206720 - protein, 17 aa, Cryptosporidium hominis
FVCECPKGYTLDKNQQD

SEQ ID NO: 2206721 - protein, 18 aa, Cryptosporidium hominis
FVDAESKKNCKILASATP

SEQ ID NO: 2206722 - protein, 17 aa, Cryptosporidium hominis
FVDFKYYPICGTNGKTY

SEQ ID NO: 2206723 - protein, 17 aa, Cryptosporidium hominis
FVEIFQLILHNTDFAEN

SEQ ID NO: 2206724 - protein, 24 aa, Cryptosporidium hominis
FVGHSLGGIIIRAALPHLHMFSSQ

SEQ ID NO: 2206725 - protein, 17 aa, Cryptosporidium hominis
FVHKGAFFFSQLDSSST

SEQ ID NO: 2206726 - protein, 27 aa, Cryptosporidium hominis
FVIFLLSALCLAFVPNFAVLGAENEIE

SEQ ID NO: 2206727 - protein, 23 aa, Cryptosporidium hominis
FVLEAFKSVYLLFNAIKLSDDPN

SEQ ID NO: 2206728 - protein, 24 aa, Cryptosporidium hominis
FVLSIGLLLINLTIIFASDINEQD

SEQ ID NO: 2206729 - protein, 17 aa, Cryptosporidium hominis
FVRHTIFQGSYDMEEFQ

SEQ ID NO: 2206730 - protein, 25 aa, Cryptosporidium hominis
FVVDKLVAKFCRLVTSMMNIDSVSQ

SEQ ID NO: 2206731 - protein, 19 aa, Cryptosporidium hominis
FWESLRFSNSIMDKKHGVN

SEQ ID NO: 2206732 - protein, 18 aa, Cryptosporidium hominis
FWSNRKRSIINLTNNTYI

SEQ ID NO: 2206733 - protein, 20 aa, Cryptosporidium hominis
FYEFKNFFSPIFRRNSRWSI

SEQ ID NO: 2206734 - protein, 25 aa, Cryptosporidium hominis
FYIRLRSGQWFALKQQVEYDSSEMG

SEQ ID NO: 2206735 - protein, 17 aa, Cryptosporidium hominis
FYLFTLYTSLIYPVSYG

SEQ ID NO: 2206736 - protein, 18 aa, Cryptosporidium hominis
FYQMEFVEIFQLILHNTD

SEQ ID NO: 2206737 - protein, 21 aa, Cryptosporidium hominis
FYSPNNMKLAIVGREPLDKLE

SEQ ID NO: 2206738 - protein, 25 aa, Cryptosporidium hominis
FYTDDCAACVTIIERLEKLNEEIRN

SEQ ID NO: 2206739 - protein, 17 aa, Cryptosporidium hominis
FYTIEMKELNGIVSEVF

SEQ ID NO: 2206740 - protein, 28 aa, Cryptosporidium hominis
FYYGLLAEVDFNFQFNWNDICLISESTI

SEQ ID NO: 2206741 - protein, 33 aa, Cryptosporidium hominis
GANNQLRCENGIFSPKVYCIAMREIERQKSSIS

SEQ ID NO: 2206742 - protein, 18 aa, Cryptosporidium hominis
GANRGAWQTGVLRGLLGQ

SEQ ID NO: 2206743 - protein, 18 aa, Cryptosporidium hominis
GARLMRFRIDRKTAGHPR

SEQ ID NO: 2206744 - protein, 21 aa, Cryptosporidium hominis
GASASGIFRQFGDKITQQANP

SEQ ID NO: 2206745 - protein, 24 aa, Cryptosporidium hominis
GASEAALQWWVDYGNGGKKPKPVL

SEQ ID NO: 2206746 - protein, 17 aa, Cryptosporidium hominis
GCAEYKAKVYGSDGIYS

SEQ ID NO: 2206747 - protein, 28 aa, Cryptosporidium hominis
GCTTEVPRLEGCVARPAHCTGGSCSPAK

SEQ ID NO: 2206748 - protein, 22 aa, Cryptosporidium hominis
GDALMPVSSWISISVNRISGFI

SEQ ID NO: 2206749 - protein, 17 aa, Cryptosporidium hominis
GDAYLFNEVYYLKKYGQ

SEQ ID NO: 2206750 - protein, 22 aa, Cryptosporidium hominis
GDCGDCFAVTAATIITSRLWIK

SEQ ID NO: 2206751 - protein, 22 aa, Cryptosporidium hominis
GDLGLPHLFDLRFKHDVLSSYE

SEQ ID NO: 2206752 - protein, 24 aa, Cryptosporidium hominis
GDQNCTRLLLHFVNKHTGNTLYKN

SEQ ID NO: 2206753 - protein, 23 aa, Cryptosporidium hominis
GDRCALFTNKICPNGNCERLISK

SEQ ID NO: 2206754 - protein, 26 aa, Cryptosporidium hominis
GDRYLAKYISRWKGRVSGTKKSSLGN

SEQ ID NO: 2206755 - protein, 23 aa, Cryptosporidium hominis
GDVFKYPHDIFVGVDNKDYDLSK

SEQ ID NO: 2206756 - protein, 23 aa, Cryptosporidium hominis
GEAIFPRLLDFRVSDACKVVSAM

SEQ ID NO: 2206757 - protein, 18 aa, Cryptosporidium hominis
GEEFKFRNCPGTLKNLLF

SEQ ID NO: 2206758 - protein, 18 aa, Cryptosporidium hominis
GEFEKELRKVDKIERKFA

SEQ ID NO: 2206759 - protein, 23 aa, Cryptosporidium hominis
GEIGCSFHSIGWISGSRDLAVKY

SEQ ID NO: 2206760 - protein, 24 aa, Cryptosporidium hominis
GEILGRFRYRLSLLDHTLNFLQRI

SEQ ID NO: 2206761 - protein, 21 aa, Cryptosporidium hominis
GESIPPLGPFDRIRGPDCKTP

SEQ ID NO: 2206762 - protein, 21 aa, Cryptosporidium hominis
GESVLRPLLSDAIPNEYGTLD

SEQ ID NO: 2206763 - protein, 23 aa, Cryptosporidium hominis
GEVLSWGCNDDGALGRLSSKFKA

SEQ ID NO: 2206764 - protein, 21 aa, Cryptosporidium hominis
GEYFEKLSLLLAGVANLGDNS

SEQ ID NO: 2206765 - protein, 18 aa, Cryptosporidium hominis
GFASFGIIASSSQIIGQN

SEQ ID NO: 2206766 - protein, 20 aa, Cryptosporidium hominis
GFKYGKKLPKELIKDLDKDL

SEQ ID NO: 2206767 - protein, 31 aa, Cryptosporidium hominis
GFLDQRIALEWIHKYIVNFGGDPNRIILAGH

SEQ ID NO: 2206768 - protein, 22 aa, Cryptosporidium hominis
GFSLYMIFIFLLGDVTGIHINR

SEQ ID NO: 2206769 - protein, 24 aa, Cryptosporidium hominis
GFSPRAFPTILFVKAGTRTPIPYD

SEQ ID NO: 2206770 - protein, 26 aa, Cryptosporidium hominis
GFYSSTLRRMLFRAADVGKIKEISLT

SEQ ID NO: 2206771 - protein, 23 aa, Cryptosporidium hominis
GGDGGFDFGGFGGFGGFGGFGDF

SEQ ID NO: 2206772 - protein, 17 aa, Cryptosporidium hominis
GGHLGLLKTQILTFKIL

SEQ ID NO: 2206773 - protein, 20 aa, Cryptosporidium hominis
GGIRVPGVRALLDQYFGSFG

SEQ ID NO: 2206774 - protein, 21 aa, Cryptosporidium hominis
GGKEFLCGFEGHGKNDSLNLS

SEQ ID NO: 2206775 - protein, 26 aa, Cryptosporidium hominis
GGLILLGRGLSYPSLRPNVNPTGLIT

SEQ ID NO: 2206776 - protein, 21 aa, Cryptosporidium hominis
GGRRRRGRGDGKEEGSEDKDT

SEQ ID NO: 2206777 - protein, 28 aa, Cryptosporidium hominis
GGSCSPAKVRGARCVKREILPNHHCAKE

SEQ ID NO: 2206778 - protein, 19 aa, Cryptosporidium hominis
GGTSLSGKVPEHFQYIFRR

SEQ ID NO: 2206779 - protein, 17 aa, Cryptosporidium hominis
GICISILIFSISGVKCR

SEQ ID NO: 2206780 - protein, 18 aa, Cryptosporidium hominis
GIERLNLHLRIRNANIEK

SEQ ID NO: 2206781 - protein, 22 aa, Cryptosporidium hominis
GIFKTKVAPFLTEYHLSIKQEY

SEQ ID NO: 2206782 - protein, 18 aa, Cryptosporidium hominis
GIILFLILHVLIKFKHVI

SEQ ID NO: 2206783 - protein, 24 aa, Cryptosporidium hominis
GIKKACIKFDYFRTSSCGNLVSNY

SEQ ID NO: 2206784 - protein, 27 aa, Cryptosporidium hominis
GINGTFPPFVKWPYRGGSGETLYLLNE

SEQ ID NO: 2206785 - protein, 18 aa, Cryptosporidium hominis
GISAGDGRELWKMGPNGQ

SEQ ID NO: 2206786 - protein, 19 aa, Cryptosporidium hominis
GISSGEWGNEFAINNILSS

SEQ ID NO: 2206787 - protein, 17 aa, Cryptosporidium hominis
GITPSEVINPFIPTCVN

SEQ ID NO: 2206788 - protein, 18 aa, Cryptosporidium hominis
GIVVKGCQTQCSHRFDTD

SEQ ID NO: 2206789 - protein, 20 aa, Cryptosporidium hominis
GKALIRGSCISVNTTRLDSP

SEQ ID NO: 2206790 - protein, 23 aa, Cryptosporidium hominis
GKCVAGDCSHRCYCDECVAPKCQ

SEQ ID NO: 2206791 - protein, 26 aa, Cryptosporidium hominis
GKHEIPMDVRIRFDDFSGFDLLLGVY

SEQ ID NO: 2206792 - protein, 20 aa, Cryptosporidium hominis
GKHKNLCFIYLKNGEISLEE

SEQ ID NO: 2206793 - protein, 19 aa, Cryptosporidium hominis
GKISTWFKNNYLKHFYNNK

SEQ ID NO: 2206794 - protein, 18 aa, Cryptosporidium hominis
GKKLGGSLVKESKPNLEV

SEQ ID NO: 2206795 - protein, 22 aa, Cryptosporidium hominis
GKKPIGSFCTMKGWKKFYSDSM

SEQ ID NO: 2206796 - protein, 18 aa, Cryptosporidium hominis
GKLASLIAADWTGNGKVD

SEQ ID NO: 2206797 - protein, 24 aa, Cryptosporidium hominis
GKNHVDTGIQFFSIESSDLKKLQK

SEQ ID NO: 2206798 - protein, 19 aa, Cryptosporidium hominis
GKRNGIRIAPWKMIPDSMW

SEQ ID NO: 2206799 - protein, 22 aa, Cryptosporidium hominis
GKSRLESELQLGTQRTSLNSKV

SEQ ID NO: 2206800 - protein, 19 aa, Cryptosporidium hominis
GKVPEHFQYIFRRSYLLVY

SEQ ID NO: 2206801 - protein, 23 aa, Cryptosporidium hominis
GKVSPRIASVINTLVGQFEKLNL

SEQ ID NO: 2206802 - protein, 17 aa, Cryptosporidium hominis
GKYSSKINFLKEEIKIE

SEQ ID NO: 2206803 - protein, 24 aa, Cryptosporidium hominis
GLDKRGFRPITFHMMHDTSRMEFF

SEQ ID NO: 2206804 - protein, 17 aa, Cryptosporidium hominis
GLGFLILAICLNVEVKS

SEQ ID NO: 2206805 - protein, 20 aa, Cryptosporidium hominis
GLITLAFKFAQEVGVRTQDC

SEQ ID NO: 2206806 - protein, 24 aa, Cryptosporidium hominis
GLKSEFLVKYCTFSDPSFSHITGN

SEQ ID NO: 2206807 - protein, 26 aa, Cryptosporidium hominis
GLNDVFMLIYLVGRLKGYYDDWKIVT

SEQ ID NO: 2206808 - protein, 23 aa, Cryptosporidium hominis
GLPSPRIAKKYIMTFVQSDPEDN

SEQ ID NO: 2206809 - protein, 17 aa, Cryptosporidium hominis
GLQFGHGNMVQWVGGPV

SEQ ID NO: 2206810 - protein, 19 aa, Cryptosporidium hominis
GLRMLESIRLFGVFHDSFR

SEQ ID NO: 2206811 - protein, 21 aa, Cryptosporidium hominis
GLSIFWKGPIHTVPTINLTLV

SEQ ID NO: 2206812 - protein, 17 aa, Cryptosporidium hominis
GLSRTGMELGARPKTSV

SEQ ID NO: 2206813 - protein, 28 aa, Cryptosporidium hominis
GLTPIDFCGLSEKMILKGDVLNYFNIIC

SEQ ID NO: 2206814 - protein, 28 aa, Cryptosporidium hominis
GLVKEYSYFLSVYYRLRCENGNEYHDGT

SEQ ID NO: 2206815 - protein, 17 aa, Cryptosporidium hominis
GLVSIGFLERKANYDDY

SEQ ID NO: 2206816 - protein, 20 aa, Cryptosporidium hominis
GLVTMLPIVRYMKLLNSYGE

SEQ ID NO: 2206817 - protein, 24 aa, Cryptosporidium hominis
GMMHFFKKEMESLIRESSKPNSLI

SEQ ID NO: 2206818 - protein, 25 aa, Cryptosporidium hominis
GNSECISCSYSLLPKSVQIGSTVLI

SEQ ID NO: 2206819 - protein, 22 aa, Cryptosporidium hominis
GNTEWKLPGFFSQKRFVDQLNE

SEQ ID NO: 2206820 - protein, 28 aa, Cryptosporidium hominis
GNTLGWYARPFNWWPMDPSITLHNAVKG

SEQ ID NO: 2206821 - protein, 20 aa, Cryptosporidium hominis
GPDCKTVFVDFKYYPICGTN

SEQ ID NO: 2206822 - protein, 25 aa, Cryptosporidium hominis
GPDKHIGWQVTRRAIDVAARDKMIK

SEQ ID NO: 2206823 - protein, 21 aa, Cryptosporidium hominis
GPISVCLHCFMGTISDCSSIS

SEQ ID NO: 2206824 - protein, 19 aa, Cryptosporidium hominis
GPIYLIRRITLRTKNNHLS

SEQ ID NO: 2206825 - protein, 24 aa, Cryptosporidium hominis
GPNAGEITQGFSLAVKLGATKKDF

SEQ ID NO: 2206826 - protein, 27 aa, Cryptosporidium hominis
GPRVENRNYLTLPFTRDGHCEKGTIYN

SEQ ID NO: 2206827 - protein, 34 aa, Cryptosporidium hominis
GQETLRVAEKYNKKKSWRKKTRKFKLEFLELSNE

SEQ ID NO: 2206828 - protein, 27 aa, Cryptosporidium hominis
GQKTRLSRRFTNDWINFLNLLKTIEID

SEQ ID NO: 2206829 - protein, 23 aa, Cryptosporidium hominis
GQLKDILPGYAFLDTNYIGGCFF

SEQ ID NO: 2206830 - protein, 21 aa, Cryptosporidium hominis
GREPYKFGLLSTMGSGKLYDM

SEQ ID NO: 2206831 - protein, 18 aa, Cryptosporidium hominis
GRHIKKLLNFIRADNMVI

SEQ ID NO: 2206832 - protein, 20 aa, Cryptosporidium hominis
GRHYRYNWANLLGQKFFIPG

SEQ ID NO: 2206833 - protein, 24 aa, Cryptosporidium hominis
GRKAPKSYLEMSFESISQLRSDFG

SEQ ID NO: 2206834 - protein, 17 aa, Cryptosporidium hominis
GRNDWTFLAVKDPENGK

SEQ ID NO: 2206835 - protein, 17 aa, Cryptosporidium hominis
GRYGMSIDSSGSDSDSD

SEQ ID NO: 2206836 - protein, 17 aa, Cryptosporidium hominis
GRYIFKFLAVGSGSTVS

SEQ ID NO: 2206837 - protein, 23 aa, Cryptosporidium hominis
GRYSNVFFAWKIDLSPETKNKIG

SEQ ID NO: 2206838 - protein, 26 aa, Cryptosporidium hominis
GSDLIIYKSECDFLASKARLSDLTIL

SEQ ID NO: 2206839 - protein, 27 aa, Cryptosporidium hominis
GSFVGRGKIPAGINLGSSINFVLVPSS

SEQ ID NO: 2206840 - protein, 19 aa, Cryptosporidium hominis
GSHEYPPFDIMKSITGKNC

SEQ ID NO: 2206841 - protein, 23 aa, Cryptosporidium hominis
GSIFQRNTLKGMGFFNKFIIMNN

SEQ ID NO: 2206842 - protein, 19 aa, Cryptosporidium hominis
GSIKDNCKIYRDENDDYEH

SEQ ID NO: 2206843 - protein, 26 aa, Cryptosporidium hominis
GSISRISKIPGFVRHTIFQGSYDMEE

SEQ ID NO: 2206844 - protein, 21 aa, Cryptosporidium hominis
GSKLRNSKCKIIVQTNIPYLL

SEQ ID NO: 2206845 - protein, 24 aa, Cryptosporidium hominis
GSPKMCYKATCVKKDCNHIAIHTV

SEQ ID NO: 2206846 - protein, 24 aa, Cryptosporidium hominis
GSPTYCILRAFIFVNDIVEKNNIE

SEQ ID NO: 2206847 - protein, 22 aa, Cryptosporidium hominis
GSSRIPSLVLLEGYFSQIHSFS

SEQ ID NO: 2206848 - protein, 22 aa, Cryptosporidium hominis
GTDFMIPSVVCFGTNENLSQQL

SEQ ID NO: 2206849 - protein, 26 aa, Cryptosporidium hominis
GTEIWSREFCEIVQGFKIDEISCNCK

SEQ ID NO: 2206850 - protein, 24 aa, Cryptosporidium hominis
GTKRKRKSIGLTFQKSSYTNSFCS

SEQ ID NO: 2206851 - protein, 17 aa, Cryptosporidium hominis
GTNRFARDLSFMDEPHV

SEQ ID NO: 2206852 - protein, 19 aa, Cryptosporidium hominis
GTPILARRAGFFSRNMIRP

SEQ ID NO: 2206853 - protein, 19 aa, Cryptosporidium hominis
GTPSFETSIHFGINLYVLT

SEQ ID NO: 2206854 - protein, 20 aa, Cryptosporidium hominis
GTSECHTIFTWELLSSNCKQ

SEQ ID NO: 2206855 - protein, 17 aa, Cryptosporidium hominis
GTTAIWDLKMKKSAISF

SEQ ID NO: 2206856 - protein, 21 aa, Cryptosporidium hominis
GVAIISGFVHKGAFFFSQLDS

SEQ ID NO: 2206857 - protein, 24 aa, Cryptosporidium hominis
GVDALKKVGGWLHKHRNSLPYWPS

SEQ ID NO: 2206858 - protein, 20 aa, Cryptosporidium hominis
GVDFLKLLFEIVLTLFEEYT

SEQ ID NO: 2206859 - protein, 17 aa, Cryptosporidium hominis
GVDSCSIESGIASLRAY

SEQ ID NO: 2206860 - protein, 19 aa, Cryptosporidium hominis
GVEIWRRTLLSGKDEELCG

SEQ ID NO: 2206861 - protein, 54 aa, Cryptosporidium hominis
GVIHKSGCKIVPFSTLLSLPRHSFEIWKSFGLVLQFEFLIAMTYSIEHEMNFDD

SEQ ID NO: 2206862 - protein, 22 aa, Cryptosporidium hominis
GVLFLILSWVGLVVPKLEIRIS

SEQ ID NO: 2206863 - protein, 20 aa, Cryptosporidium hominis
GVPIYRPYAPFRYFAAETFN

SEQ ID NO: 2206864 - protein, 18 aa, Cryptosporidium hominis
GVRLQIYLRNGFEGQVPN

SEQ ID NO: 2206865 - protein, 21 aa, Cryptosporidium hominis
GVSGCSMANVYAKNGKKVLLL

SEQ ID NO: 2206866 - protein, 25 aa, Cryptosporidium hominis
GWYITAFCRAVYFAEKDVCISRGVK

SEQ ID NO: 2206867 - protein, 20 aa, Cryptosporidium hominis
GYAKIRRGKNIGGIENQAVF

SEQ ID NO: 2206868 - protein, 19 aa, Cryptosporidium hominis
GYELSGFRILISGYPRSKW

SEQ ID NO: 2206869 - protein, 25 aa, Cryptosporidium hominis
GYIGFPNFQLMSGSLVGYKQYNPIK

SEQ ID NO: 2206870 - protein, 21 aa, Cryptosporidium hominis
GYLPILERIYYLNGTVALPMS

SEQ ID NO: 2206871 - protein, 20 aa, Cryptosporidium hominis
GYLSKLPTFQKFVSRHRKLA

SEQ ID NO: 2206872 - protein, 19 aa, Cryptosporidium hominis
GYTAWFCGTNEDFAKYASN

SEQ ID NO: 2206873 - protein, 18 aa, Cryptosporidium hominis
GYVGGCYGCCDEDRMKEE

SEQ ID NO: 2206874 - protein, 23 aa, Cryptosporidium hominis
HDDIRFLFWKMRDYSLQNPEMNL

SEQ ID NO: 2206875 - protein, 21 aa, Cryptosporidium hominis
HEAAERIKVQMVNSGETEESA

SEQ ID NO: 2206876 - protein, 18 aa, Cryptosporidium hominis
HEYAQWIFVNNGFLAKSS

SEQ ID NO: 2206877 - protein, 17 aa, Cryptosporidium hominis
HFAVWKVDFDLGPDYTD

SEQ ID NO: 2206878 - protein, 26 aa, Cryptosporidium hominis
HFNWKMGVPEGGYPVGHWTQVVRAAA

SEQ ID NO: 2206879 - protein, 30 aa, Cryptosporidium hominis
HFSCSWKKDYLEFIDALTFDQFYKYWQYFG

SEQ ID NO: 2206880 - protein, 25 aa, Cryptosporidium hominis
HFSGGSVVHFYGRFASPPTGGIINF

SEQ ID NO: 2206881 - protein, 21 aa, Cryptosporidium hominis
HGDKVPFPPLHGSIGGRSGNV

SEQ ID NO: 2206882 - protein, 23 aa, Cryptosporidium hominis
HGEFCSLTCPVGYRMKDLTKMKS

SEQ ID NO: 2206883 - protein, 19 aa, Cryptosporidium hominis
HGNMVQWVGGPVNFDNMVD

SEQ ID NO: 2206884 - protein, 23 aa, Cryptosporidium hominis
HHGMLKPKYDMNLRSKVKNPDRL

SEQ ID NO: 2206885 - protein, 22 aa, Cryptosporidium hominis
HIGCMFKLEGWVSGNSETIISE

SEQ ID NO: 2206886 - protein, 20 aa, Cryptosporidium hominis
HIKVPKFILFSGHDTTVIPT

SEQ ID NO: 2206887 - protein, 23 aa, Cryptosporidium hominis
HIQLRWRVLDLAKHILNEKENKL

SEQ ID NO: 2206888 - protein, 27 aa, Cryptosporidium hominis
HISLRRKWTLFCWFFSILIREISSDLP

SEQ ID NO: 2206889 - protein, 22 aa, Cryptosporidium hominis
HIVEWLKRHILIEISNVDGNIP

SEQ ID NO: 2206890 - protein, 24 aa, Cryptosporidium hominis
HIVLLFVIFCDFTERSFLPTISLV

SEQ ID NO: 2206891 - protein, 21 aa, Cryptosporidium hominis
HKHRNSLPYWPSINISPPKNR

SEQ ID NO: 2206892 - protein, 23 aa, Cryptosporidium hominis
HKTSSSFEWGKLVETLRNHIRML

SEQ ID NO: 2206893 - protein, 25 aa, Cryptosporidium hominis
HLDNFLNKWIEVFGENCSDDYLKKL

SEQ ID NO: 2206894 - protein, 17 aa, Cryptosporidium hominis
HNFDLNKEIILNLENKW

SEQ ID NO: 2206895 - protein, 27 aa, Cryptosporidium hominis
HNFQDSSCLRISILSLKSEVCESSDTG

SEQ ID NO: 2206896 - protein, 25 aa, Cryptosporidium hominis
HNTAAKRRALLFVQKYLKSIKLLHF

SEQ ID NO: 2206897 - protein, 19 aa, Cryptosporidium hominis
HRCYCDECVAPKCQPGSCT

SEQ ID NO: 2206898 - protein, 24 aa, Cryptosporidium hominis
HRLPNLKEKLVFISRSISILIYQN

SEQ ID NO: 2206899 - protein, 17 aa, Cryptosporidium hominis
HRLSELLVLPFGLWDSR

SEQ ID NO: 2206900 - protein, 20 aa, Cryptosporidium hominis
HRWKTLSILIILFVISVDHD

SEQ ID NO: 2206901 - protein, 18 aa, Cryptosporidium hominis
HSEICRLCGCDSTKNVNV

SEQ ID NO: 2206902 - protein, 18 aa, Cryptosporidium hominis
HSIIGLTLICDGKPLNPV

SEQ ID NO: 2206903 - protein, 18 aa, Cryptosporidium hominis
HSRIAFSLLLRSNAIKAM

SEQ ID NO: 2206904 - protein, 24 aa, Cryptosporidium hominis
HTCKNGYFSFDFNPPCSNGKVSGI

SEQ ID NO: 2206905 - protein, 17 aa, Cryptosporidium hominis
HTDCPKIVSNMLHSLSE

SEQ ID NO: 2206906 - protein, 18 aa, Cryptosporidium hominis
HVYGRLGKKVGLVPEVFN

SEQ ID NO: 2206907 - protein, 17 aa, Cryptosporidium hominis
HYMDFNSGISFIAILGP

SEQ ID NO: 2206908 - protein, 22 aa, Cryptosporidium hominis
HYYNICGGYAVYCNRWLFTNRP

SEQ ID NO: 2206909 - protein, 18 aa, Cryptosporidium hominis
IAAALGMKSNIGAVATCN

SEQ ID NO: 2206910 - protein, 17 aa, Cryptosporidium hominis
IAEALLHEVDLRFFNRE

SEQ ID NO: 2206911 - protein, 17 aa, Cryptosporidium hominis
IAGKHFVNAQLFLKYRS

SEQ ID NO: 2206912 - protein, 17 aa, Cryptosporidium hominis
IAKYFGWDNSHDVEGVV

SEQ ID NO: 2206913 - protein, 26 aa, Cryptosporidium hominis
IALKAECGYFEGFKNLIVDILDFLVE

SEQ ID NO: 2206914 - protein, 17 aa, Cryptosporidium hominis
IALWSRKENKVLIFNVC

SEQ ID NO: 2206915 - protein, 29 aa, Cryptosporidium hominis
IANKEIFSNIQFKYCYNMPLLKTTESNSD

SEQ ID NO: 2206916 - protein, 17 aa, Cryptosporidium hominis
IASKFGKDSKFRVFVSA

SEQ ID NO: 2206917 - protein, 23 aa, Cryptosporidium hominis
IASRFPILGALFSAASKAFDKVT

SEQ ID NO: 2206918 - protein, 24 aa, Cryptosporidium hominis
ICFGIRSDKGIGYNVCTKNRNMRN

SEQ ID NO: 2206919 - protein, 19 aa, Cryptosporidium hominis
ICIRMDFWGSESCDKLPMT

SEQ ID NO: 2206920 - protein, 19 aa, Cryptosporidium hominis
ICQYVSFLSKFALDLVPGI

SEQ ID NO: 2206921 - protein, 20 aa, Cryptosporidium hominis
ICSAAKLIHDGSVEKQPISR

SEQ ID NO: 2206922 - protein, 21 aa, Cryptosporidium hominis
ICSMTTFWSKICIKNNSNNYD

SEQ ID NO: 2206923 - protein, 24 aa, Cryptosporidium hominis
ICSNLLFGNFYDQFRVIRKAWNGV

SEQ ID NO: 2206924 - protein, 27 aa, Cryptosporidium hominis
ICSNSSRFAEFLLELIELIQSIIYLIT

SEQ ID NO: 2206925 - protein, 23 aa, Cryptosporidium hominis
IDEGRISKIGRFYLINQNRQENQ

SEQ ID NO: 2206926 - protein, 17 aa, Cryptosporidium hominis
IDGILPVLKSSNSQSKD

SEQ ID NO: 2206927 - protein, 17 aa, Cryptosporidium hominis
IDISSRYSALLDSILSF

SEQ ID NO: 2206928 - protein, 23 aa, Cryptosporidium hominis
IDLALCIKGALQLNNTVTSKSKR

SEQ ID NO: 2206929 - protein, 21 aa, Cryptosporidium hominis
IDSICELLRASIKMPPEQISP

SEQ ID NO: 2206930 - protein, 23 aa, Cryptosporidium hominis
IDSICRLSVKWFENYPKFVKVLR

SEQ ID NO: 2206931 - protein, 19 aa, Cryptosporidium hominis
IDYNKLIDKFGCKLITKDM

SEQ ID NO: 2206932 - protein, 17 aa, Cryptosporidium hominis
IEAWAEKFWNSGHAETH

SEQ ID NO: 2206933 - protein, 19 aa, Cryptosporidium hominis
IEDYCKFAFRCISNGSNTL

SEQ ID NO: 2206934 - protein, 23 aa, Cryptosporidium hominis
IEELCKIKEILLTALDLLKTGLF

SEQ ID NO: 2206935 - protein, 17 aa, Cryptosporidium hominis
IEFKCSYNKSGISQVTE

SEQ ID NO: 2206936 - protein, 20 aa, Cryptosporidium hominis
IEFSANITLSYEFSKQSSGL

SEQ ID NO: 2206937 - protein, 22 aa, Cryptosporidium hominis
IEGICKGSIFWETCSNKHLQPL

SEQ ID NO: 2206938 - protein, 21 aa, Cryptosporidium hominis
IEISTGLDFSGLKEFTINYLK

SEQ ID NO: 2206939 - protein, 19 aa, Cryptosporidium hominis
IEKFRSKWSKSRELKKRKV

SEQ ID NO: 2206940 - protein, 18 aa, Cryptosporidium hominis
IEKLRGTYRSTLSKQFST

SEQ ID NO: 2206941 - protein, 18 aa, Cryptosporidium hominis
IELRRLVDEAAYFASKSE

SEQ ID NO: 2206942 - protein, 24 aa, Cryptosporidium hominis
IELYCKEFLSFGFIDETVKIEGDD

SEQ ID NO: 2206943 - protein, 18 aa, Cryptosporidium hominis
IENELSFTNYLYEIYMRA

SEQ ID NO: 2206944 - protein, 27 aa, Cryptosporidium hominis
IEPPISPKLLCPKGYDLVDGSCFFSHI

SEQ ID NO: 2206945 - protein, 18 aa, Cryptosporidium hominis
IESKLKIGQLRKEIKYLS

SEQ ID NO: 2206946 - protein, 20 aa, Cryptosporidium hominis
IESSDFFPKPGSEIFSFYTY

SEQ ID NO: 2206947 - protein, 19 aa, Cryptosporidium hominis
IEVRYARLSDFIYLLKMIL

SEQ ID NO: 2206948 - protein, 29 aa, Cryptosporidium hominis
IFCNFALIFCRRIPCEFERNRDVVRHRNS

SEQ ID NO: 2206949 - protein, 26 aa, Cryptosporidium hominis
IFCQLMCLIKLLNLFNSLNNLSMARQ

SEQ ID NO: 2206950 - protein, 19 aa, Cryptosporidium hominis
IFIQLSWVFGTESQNGKHR

SEQ ID NO: 2206951 - protein, 18 aa, Cryptosporidium hominis
IFIYTWLMLFEKVDGSFL

SEQ ID NO: 2206952 - protein, 20 aa, Cryptosporidium hominis
IFKQFGRGFPTGGYESTSNS

SEQ ID NO: 2206953 - protein, 17 aa, Cryptosporidium hominis
IFLAARDGHSLKIMTEM

SEQ ID NO: 2206954 - protein, 22 aa, Cryptosporidium hominis
IFLIILCLSNVYSTWNLEWLHS

SEQ ID NO: 2206955 - protein, 19 aa, Cryptosporidium hominis
IFNDQYLPFLQGIYVCKSY

SEQ ID NO: 2206956 - protein, 26 aa, Cryptosporidium hominis
IFTSKAYVLKLLRLDIDPETSEEAVN

SEQ ID NO: 2206957 - protein, 18 aa, Cryptosporidium hominis
IFVDRKNVILGMQTSKLY

SEQ ID NO: 2206958 - protein, 18 aa, Cryptosporidium hominis
IGCSNGYSFISFGGSKLS

SEQ ID NO: 2206959 - protein, 17 aa, Cryptosporidium hominis
IGDEITLELVEEKIRKV

SEQ ID NO: 2206960 - protein, 20 aa, Cryptosporidium hominis
IGELLTCVPGDLSIISFSED

SEQ ID NO: 2206961 - protein, 22 aa, Cryptosporidium hominis
IGFNLASLFIGPGVGNFLSIDS

SEQ ID NO: 2206962 - protein, 18 aa, Cryptosporidium hominis
IGILEGFSKYFYSLSYER

SEQ ID NO: 2206963 - protein, 21 aa, Cryptosporidium hominis
IGLYRRIRVELRKKEDVKFIK

SEQ ID NO: 2206964 - protein, 30 aa, Cryptosporidium hominis
IGNMKFNYDFRIIIKEKWIYITSPQGQTLV

SEQ ID NO: 2206965 - protein, 20 aa, Cryptosporidium hominis
IGSSCPKCTFSDPINENNDD

SEQ ID NO: 2206966 - protein, 31 aa, Cryptosporidium hominis
IGTSLGGFVAMRIAQRFPKHIGKLVLDAPPG

SEQ ID NO: 2206967 - protein, 18 aa, Cryptosporidium hominis
IHLLVFFGISANNIRLSF

SEQ ID NO: 2206968 - protein, 17 aa, Cryptosporidium hominis
IHTVKVCPDGNCEQLIR

SEQ ID NO: 2206969 - protein, 24 aa, Cryptosporidium hominis
IIDAIECKNFYLSMVNKELPLQII

SEQ ID NO: 2206970 - protein, 20 aa, Cryptosporidium hominis
IIDDCLKKRLKTEAAVALKD

SEQ ID NO: 2206971 - protein, 23 aa, Cryptosporidium hominis
IIFIEGWGGGKLVRVESLKTSPK

SEQ ID NO: 2206972 - protein, 25 aa, Cryptosporidium hominis
IIFSILICKVRLEVVIENEDPKADI

SEQ ID NO: 2206973 - protein, 18 aa, Cryptosporidium hominis
IIGDISVFRRYFHQNQKN

SEQ ID NO: 2206974 - protein, 17 aa, Cryptosporidium hominis
IIKSELLTNSWMNLSKI

SEQ ID NO: 2206975 - protein, 19 aa, Cryptosporidium hominis
IILEFLLDRYKVLTEQYLE

SEQ ID NO: 2206976 - protein, 19 aa, Cryptosporidium hominis
IINNLNLGFKFSDLPFKLT

SEQ ID NO: 2206977 - protein, 21 aa, Cryptosporidium hominis
IIRKLHDAISFGNSESKIKFG

SEQ ID NO: 2206978 - protein, 22 aa, Cryptosporidium hominis
IISILAVIAVFYSFTSTESDLV

SEQ ID NO: 2206979 - protein, 17 aa, Cryptosporidium hominis
IKAVFGLHVQEWEDVAD

SEQ ID NO: 2206980 - protein, 22 aa, Cryptosporidium hominis
IKCFLLILFFNLATFFLVHAVV

SEQ ID NO: 2206981 - protein, 24 aa, Cryptosporidium hominis
IKDAPYKISLMKYTYSVLSSQNKI

SEQ ID NO: 2206982 - protein, 19 aa, Cryptosporidium hominis
IKDLGQFLLLSIDKMEVTK

SEQ ID NO: 2206983 - protein, 18 aa, Cryptosporidium hominis
IKDSCRNLALSGSIPKNI

SEQ ID NO: 2206984 - protein, 20 aa, Cryptosporidium hominis
IKDVDAINVFIKRENSKLST

SEQ ID NO: 2206985 - protein, 19 aa, Cryptosporidium hominis
IKELHVIYETLTIKLQSLS

SEQ ID NO: 2206986 - protein, 21 aa, Cryptosporidium hominis
IKEQIVRDVAALNAIVKLEAE

SEQ ID NO: 2206987 - protein, 19 aa, Cryptosporidium hominis
IKEYFPGPVERRQFVPACM

SEQ ID NO: 2206988 - protein, 23 aa, Cryptosporidium hominis
IKGIALQCGNSWLEEANLGLVGP

SEQ ID NO: 2206989 - protein, 22 aa, Cryptosporidium hominis
IKIKFDELMGAYDGKIIVFTDN

SEQ ID NO: 2206990 - protein, 17 aa, Cryptosporidium hominis
IKKGTGLNRQICNNYDD

SEQ ID NO: 2206991 - protein, 20 aa, Cryptosporidium hominis
IKKQLSFKCINKLRTLLDYT

SEQ ID NO: 2206992 - protein, 20 aa, Cryptosporidium hominis
IKKTIPLKLEKHILLQQQKD

SEQ ID NO: 2206993 - protein, 17 aa, Cryptosporidium hominis
IKLISFIFNDRYFFLEK

SEQ ID NO: 2206994 - protein, 24 aa, Cryptosporidium hominis
IKLTEKRLNPIFIGEKGNMLILPN

SEQ ID NO: 2206995 - protein, 24 aa, Cryptosporidium hominis
IKNDPSTVCSYTFSNEFVDSDFDT

SEQ ID NO: 2206996 - protein, 20 aa, Cryptosporidium hominis
IKQNKFRCKVETAGAERSNS

SEQ ID NO: 2206997 - protein, 18 aa, Cryptosporidium hominis
IKRLCSIINQRTNFKGKD

SEQ ID NO: 2206998 - protein, 21 aa, Cryptosporidium hominis
IKSKARRRLLSAKIHSAPSAF

SEQ ID NO: 2206999 - protein, 17 aa, Cryptosporidium hominis
IKSKEFLDIKSANNQNL

SEQ ID NO: 2207000 - protein, 25 aa, Cryptosporidium hominis
IKSREWIMIVNFYRPGCGPCKQLVQ

SEQ ID NO: 2207001 - protein, 26 aa, Cryptosporidium hominis
IKSYFRGVFKIGRIVWNREREILYSL

SEQ ID NO: 2207002 - protein, 24 aa, Cryptosporidium hominis
IKVSELLIEVPFFKSKLFSQNMYK

SEQ ID NO: 2207003 - protein, 28 aa, Cryptosporidium hominis
ILDSMMSLGFYSCFRIICTKKKSGISKR

SEQ ID NO: 2207004 - protein, 20 aa, Cryptosporidium hominis
ILECPLLFTLQFSALSVEEL

SEQ ID NO: 2207005 - protein, 22 aa, Cryptosporidium hominis
ILEGACTYFASYLNMASFSVFQ

SEQ ID NO: 2207006 - protein, 18 aa, Cryptosporidium hominis
ILEIVRLAYCSIQQNPDL

SEQ ID NO: 2207007 - protein, 26 aa, Cryptosporidium hominis
ILEYPCPRSTPGLNWMISSKLVDTGI

SEQ ID NO: 2207008 - protein, 29 aa, Cryptosporidium hominis
ILGDLQIKFLVHFFRNRVVLLDPSHGLSC

SEQ ID NO: 2207009 - protein, 30 aa, Cryptosporidium hominis
ILIKSNRLSNGFVCMGILNGTEIWSREFCE

SEQ ID NO: 2207010 - protein, 17 aa, Cryptosporidium hominis
ILKERDIKVPTKIEHLK

SEQ ID NO: 2207011 - protein, 27 aa, Cryptosporidium hominis
ILKIRLKNLKLAFSKYCMPEKERILFL

SEQ ID NO: 2207012 - protein, 17 aa, Cryptosporidium hominis
ILLCEYSFSLGNIQNKF

SEQ ID NO: 2207013 - protein, 19 aa, Cryptosporidium hominis
ILLLLRFISIFDLREVKEN

SEQ ID NO: 2207014 - protein, 20 aa, Cryptosporidium hominis
ILNHNIKLISFLHAEGGKDL

SEQ ID NO: 2207015 - protein, 25 aa, Cryptosporidium hominis
ILRKCPPNRIGLGPFKGVRSYETSE

SEQ ID NO: 2207016 - protein, 27 aa, Cryptosporidium hominis
ILSAIKSCLNIKCKNLPNEVPGGFYSH

SEQ ID NO: 2207017 - protein, 17 aa, Cryptosporidium hominis
ILTEYLIRQGLKDIDAF

SEQ ID NO: 2207018 - protein, 18 aa, Cryptosporidium hominis
ILTPCSYMYPIVISLKNI

SEQ ID NO: 2207019 - protein, 33 aa, Cryptosporidium hominis
IMGPSLRDVIKFFKSSALLKWLKSTRTDDFNYK

SEQ ID NO: 2207020 - protein, 18 aa, Cryptosporidium hominis
IMLERICETNIYPSAVSC

SEQ ID NO: 2207021 - protein, 17 aa, Cryptosporidium hominis
INDLLILEAGFRRFVRL

SEQ ID NO: 2207022 - protein, 25 aa, Cryptosporidium hominis
INDMKNSECLYDFLLGSISSFESTV

SEQ ID NO: 2207023 - protein, 23 aa, Cryptosporidium hominis
INEIIKCRGGKNWITAQEHMIKM

SEQ ID NO: 2207024 - protein, 23 aa, Cryptosporidium hominis
INESKLNLGLITFYGFPKSKDSS

SEQ ID NO: 2207025 - protein, 17 aa, Cryptosporidium hominis
INEWWSVGVNFIGRNSS

SEQ ID NO: 2207026 - protein, 19 aa, Cryptosporidium hominis
INIDISFNLNVEKLRFIKI

SEQ ID NO: 2207027 - protein, 22 aa, Cryptosporidium hominis
INIRYHINRAFDILHFNIRGLS

SEQ ID NO: 2207028 - protein, 17 aa, Cryptosporidium hominis
INKEFYVSAYLYCESIR

SEQ ID NO: 2207029 - protein, 22 aa, Cryptosporidium hominis
INKKRITPIIISRNSSSNKRSI

SEQ ID NO: 2207030 - protein, 25 aa, Cryptosporidium hominis
INLSEIEWLNERDIENDKKIDETNL

SEQ ID NO: 2207031 - protein, 24 aa, Cryptosporidium hominis
INNKSCVYWSYGIWDQTIGERSTF

SEQ ID NO: 2207032 - protein, 26 aa, Cryptosporidium hominis
INQAYCIRVEPRVTSLLNNSINENIS

SEQ ID NO: 2207033 - protein, 24 aa, Cryptosporidium hominis
INQYPLRFNNIFIIQQNDIWTTLK

SEQ ID NO: 2207034 - protein, 17 aa, Cryptosporidium hominis
INSISWFNNYSVNGYTN

SEQ ID NO: 2207035 - protein, 17 aa, Cryptosporidium hominis
IPDYNLNPVYKFDPKKS

SEQ ID NO: 2207036 - protein, 25 aa, Cryptosporidium hominis
IPIFPTDIPQVFTIKSVPKAWDHIN

SEQ ID NO: 2207037 - protein, 17 aa, Cryptosporidium hominis
IPINFKISNLAGMSNWK

SEQ ID NO: 2207038 - protein, 31 aa, Cryptosporidium hominis
IPINSIPNGFKFSFGLYSNFIHFCQRGIREL

SEQ ID NO: 2207039 - protein, 25 aa, Cryptosporidium hominis
IPITAVRMWFVRKIEGNNIFSRLVG

SEQ ID NO: 2207040 - protein, 21 aa, Cryptosporidium hominis
IPKSRGSITLDEMGLPEINSS

SEQ ID NO: 2207041 - protein, 21 aa, Cryptosporidium hominis
IPLGFSPLRVLPPSNFPKTGY

SEQ ID NO: 2207042 - protein, 21 aa, Cryptosporidium hominis
IPLVLCLAFLSNFLRINDQIL

SEQ ID NO: 2207043 - protein, 24 aa, Cryptosporidium hominis
IPNGEIPYGITFEGLHRKPTTTVL

SEQ ID NO: 2207044 - protein, 17 aa, Cryptosporidium hominis
IPPESYALSLFRYNVNP

SEQ ID NO: 2207045 - protein, 20 aa, Cryptosporidium hominis
IPSLELPGGSKLNVEPLINL

SEQ ID NO: 2207046 - protein, 20 aa, Cryptosporidium hominis
IPSPPSFPAPPPPYISSGTP

SEQ ID NO: 2207047 - protein, 27 aa, Cryptosporidium hominis
IPSWYHKPCGVNFTFSGKLVSFSSKST

SEQ ID NO: 2207048 - protein, 18 aa, Cryptosporidium hominis
IPTDVSIQIERKLGGPLK

SEQ ID NO: 2207049 - protein, 21 aa, Cryptosporidium hominis
IPYWIIRNSWGANWGNKGYAK

SEQ ID NO: 2207050 - protein, 19 aa, Cryptosporidium hominis
IQCGDEFFKPIGNPNLIEA

SEQ ID NO: 2207051 - protein, 24 aa, Cryptosporidium hominis
IQDIYCGRASTFFVLKDVNKNILQ

SEQ ID NO: 2207052 - protein, 18 aa, Cryptosporidium hominis
IQFTHTWVQNSTFAEVKS

SEQ ID NO: 2207053 - protein, 26 aa, Cryptosporidium hominis
IQGNCLGGIIGIAAALGMKSNIGAVA

SEQ ID NO: 2207054 - protein, 20 aa, Cryptosporidium hominis
IQIFGPRPWNMDFLSMDVVR

SEQ ID NO: 2207055 - protein, 19 aa, Cryptosporidium hominis
IQKLNVFLKRCISNNEISF

SEQ ID NO: 2207056 - protein, 33 aa, Cryptosporidium hominis
IQNKGRLRNIFKRKKLTASEKLERLMSLKKNIE

SEQ ID NO: 2207057 - protein, 17 aa, Cryptosporidium hominis
IQSAGESIKNFITDKVN

SEQ ID NO: 2207058 - protein, 19 aa, Cryptosporidium hominis
IQSICPSEYVLSPNMKKCI

SEQ ID NO: 2207059 - protein, 17 aa, Cryptosporidium hominis
IQVLIQLVLICFFMLLG

SEQ ID NO: 2207060 - protein, 17 aa, Cryptosporidium hominis
IRAACRVLNSIGNYVDI

SEQ ID NO: 2207061 - protein, 17 aa, Cryptosporidium hominis
IRKNIESNLLLSFETKM

SEQ ID NO: 2207062 - protein, 17 aa, Cryptosporidium hominis
IRLFGVFHDSFRNLLKK

SEQ ID NO: 2207063 - protein, 20 aa, Cryptosporidium hominis
IRPNTEYDLFCFSEEVSRII

SEQ ID NO: 2207064 - protein, 19 aa, Cryptosporidium hominis
IRSQFKWDGPNSKITFESK

SEQ ID NO: 2207065 - protein, 26 aa, Cryptosporidium hominis
IRTLLHIPSFLGMCGNDIDVTKPTEL

SEQ ID NO: 2207066 - protein, 17 aa, Cryptosporidium hominis
IRTVLVYSGLAFTETRF

SEQ ID NO: 2207067 - protein, 20 aa, Cryptosporidium hominis
ISCLILVALLQYATSDQKVE

SEQ ID NO: 2207068 - protein, 19 aa, Cryptosporidium hominis
ISENLKAVNLIFVDRKNVI

SEQ ID NO: 2207069 - protein, 23 aa, Cryptosporidium hominis
ISERHIIFLQAFIHHFSALSNIQ

SEQ ID NO: 2207070 - protein, 19 aa, Cryptosporidium hominis
ISIWDRIQLNLDRGDNTGA

SEQ ID NO: 2207071 - protein, 19 aa, Cryptosporidium hominis
ISKAFRYLYEQGYGRTKKR

SEQ ID NO: 2207072 - protein, 39 aa, Cryptosporidium hominis
ISKEDIETWMNLPLKLKLPVINYYFLLVATMGRSSEKGD

SEQ ID NO: 2207073 - protein, 26 aa, Cryptosporidium hominis
ISKSQCVFFLSASYTGMFPRFEHSTE

SEQ ID NO: 2207074 - protein, 19 aa, Cryptosporidium hominis
ISLFPRKIGRRDILTYSNN

SEQ ID NO: 2207075 - protein, 18 aa, Cryptosporidium hominis
ISLNELLKGVSRNKNNSS

SEQ ID NO: 2207076 - protein, 21 aa, Cryptosporidium hominis
ISPKKAYLIWKETLIAMNFAI

SEQ ID NO: 2207077 - protein, 18 aa, Cryptosporidium hominis
ISQLIPAWIEALTMMTEG

SEQ ID NO: 2207078 - protein, 20 aa, Cryptosporidium hominis
ISRESILGVRWLEEIHSHIY

SEQ ID NO: 2207079 - protein, 21 aa, Cryptosporidium hominis
ISRRFLVEICKSFQISKNPED

SEQ ID NO: 2207080 - protein, 27 aa, Cryptosporidium hominis
ISSSKSKLLRRILGMKLKRVNNKISKI

SEQ ID NO: 2207081 - protein, 28 aa, Cryptosporidium hominis
ISTCLKEGCAYFIGRSAAMTPVLVVRAS

SEQ ID NO: 2207082 - protein, 19 aa, Cryptosporidium hominis
ISWECFTKVHNVIWIPNKK

SEQ ID NO: 2207083 - protein, 24 aa, Cryptosporidium hominis
ITAKKCLRKSLTQLQSFYVRFFDL

SEQ ID NO: 2207084 - protein, 18 aa, Cryptosporidium hominis
ITCVGRLSLSQSEFKIFK

SEQ ID NO: 2207085 - protein, 21 aa, Cryptosporidium hominis
ITGLGPHRHADFIVSSMGEAL

SEQ ID NO: 2207086 - protein, 18 aa, Cryptosporidium hominis
ITGVSVKAFIVYVKYKAD

SEQ ID NO: 2207087 - protein, 18 aa, Cryptosporidium hominis
ITHLESVKSWSLENDAKH

SEQ ID NO: 2207088 - protein, 17 aa, Cryptosporidium hominis
ITKSWWLNISKLSDPTI

SEQ ID NO: 2207089 - protein, 19 aa, Cryptosporidium hominis
ITLLDLIGQFFLNNKIDTK

SEQ ID NO: 2207090 - protein, 20 aa, Cryptosporidium hominis
ITNLEHWPKIMLTPELSQVI

SEQ ID NO: 2207091 - protein, 17 aa, Cryptosporidium hominis
ITPLRMIIEGVGGRSED

SEQ ID NO: 2207092 - protein, 17 aa, Cryptosporidium hominis
ITWCVYMHGALIGGHSI

SEQ ID NO: 2207093 - protein, 20 aa, Cryptosporidium hominis
ITWQLIMGVVRRIKPTGQGK

SEQ ID NO: 2207094 - protein, 25 aa, Cryptosporidium hominis
IVDFALKHNLDFIALSFVQNGADVQ

SEQ ID NO: 2207095 - protein, 24 aa, Cryptosporidium hominis
IVFLALKVRIILQLLPSKYSRDYS

SEQ ID NO: 2207096 - protein, 17 aa, Cryptosporidium hominis
IVIKFIIIHYLKNFGID

SEQ ID NO: 2207097 - protein, 26 aa, Cryptosporidium hominis
IVLFSYKSLFSLRVCQKDGSWSDIKV

SEQ ID NO: 2207098 - protein, 27 aa, Cryptosporidium hominis
IVRAEIRIFFELNTKYGYYRINTLEKI

SEQ ID NO: 2207099 - protein, 23 aa, Cryptosporidium hominis
IVRGFCTEAGMMHFFKKEMESLI

SEQ ID NO: 2207100 - protein, 24 aa, Cryptosporidium hominis
IWDEHWPPYASTFIIEIYNNPIPS

SEQ ID NO: 2207101 - protein, 24 aa, Cryptosporidium hominis
IWDLKMKKSAISFRDPAQRSRPST

SEQ ID NO: 2207102 - protein, 20 aa, Cryptosporidium hominis
IWKNYFESIYSTAFELQNIP

SEQ ID NO: 2207103 - protein, 17 aa, Cryptosporidium hominis
IYAYAASSYTVLGVQTR

SEQ ID NO: 2207104 - protein, 20 aa, Cryptosporidium hominis
IYLDDIAKYFGWDNSHDVEG

SEQ ID NO: 2207105 - protein, 19 aa, Cryptosporidium hominis
IYNELKYEILISSPSCIIR

SEQ ID NO: 2207106 - protein, 23 aa, Cryptosporidium hominis
IYSEKSSICKAALQVGVISTNTG

SEQ ID NO: 2207107 - protein, 27 aa, Cryptosporidium hominis
IYTPCSRCKARVRTIFRTSYKVRCPGQ

SEQ ID NO: 2207108 - protein, 17 aa, Cryptosporidium hominis
KAEEGIRPSQGELSIQN

SEQ ID NO: 2207109 - protein, 18 aa, Cryptosporidium hominis
KAFGKLCSKTMNRYIQIF

SEQ ID NO: 2207110 - protein, 19 aa, Cryptosporidium hominis
KAIDLLTPFIKGGKIGLFG

SEQ ID NO: 2207111 - protein, 20 aa, Cryptosporidium hominis
KAKSCKKFFMSPAPRSPRCS

SEQ ID NO: 2207112 - protein, 19 aa, Cryptosporidium hominis
KALHSWSPIVDGVIIKDSC

SEQ ID NO: 2207113 - protein, 19 aa, Cryptosporidium hominis
KAQFSEFIDYEGLCEKKIR

SEQ ID NO: 2207114 - protein, 21 aa, Cryptosporidium hominis
KAQTITLFFFLIAFISLNEFF

SEQ ID NO: 2207115 - protein, 18 aa, Cryptosporidium hominis
KASILAMKGIGINLSDEL

SEQ ID NO: 2207116 - protein, 31 aa, Cryptosporidium hominis
KATMKDKIVKFFFERRLKNYQEQCRKLATAS

SEQ ID NO: 2207117 - protein, 24 aa, Cryptosporidium hominis
KAVLSAAWEAFDYWITVQDSDLPS

SEQ ID NO: 2207118 - protein, 22 aa, Cryptosporidium hominis
KAVQQNHEWYLLAMGQFTQLKF

SEQ ID NO: 2207119 - protein, 22 aa, Cryptosporidium hominis
KCESDPKCPEGFTLNNSTISCE

SEQ ID NO: 2207120 - protein, 18 aa, Cryptosporidium hominis
KCGNCVGGECKPGKCVGG

SEQ ID NO: 2207121 - protein, 19 aa, Cryptosporidium hominis
KCLLSSEFSTLVSDIISKL

SEQ ID NO: 2207122 - protein, 25 aa, Cryptosporidium hominis
KCNCNKELLGNNVCDIECNSIECNM

SEQ ID NO: 2207123 - protein, 19 aa, Cryptosporidium hominis
KCQPGSCTPGTCTTGSCNV

SEQ ID NO: 2207124 - protein, 24 aa, Cryptosporidium hominis
KDAQLPLIMCPEGYEQRGDDCILD

SEQ ID NO: 2207125 - protein, 19 aa, Cryptosporidium hominis
KDEEIMLERICETNIYPSA

SEQ ID NO: 2207126 - protein, 26 aa, Cryptosporidium hominis
KDFIQSEAFCLLSMSPFTSQVKNILG

SEQ ID NO: 2207127 - protein, 22 aa, Cryptosporidium hominis
KDFYNYRMILRAEATGVGCSIA

SEQ ID NO: 2207128 - protein, 17 aa, Cryptosporidium hominis
KDGVCNRLLQVDSLSQC

SEQ ID NO: 2207129 - protein, 25 aa, Cryptosporidium hominis
KDIFPYKDSIAFATFMGPFFITKRC

SEQ ID NO: 2207130 - protein, 17 aa, Cryptosporidium hominis
KDILSAGILKGSIKNHI

SEQ ID NO: 2207131 - protein, 24 aa, Cryptosporidium hominis
KDLKNSWLRHLCRTGGEQQFSSNY

SEQ ID NO: 2207132 - protein, 17 aa, Cryptosporidium hominis
KDLMIGLVLPGLEQEVE

SEQ ID NO: 2207133 - protein, 24 aa, Cryptosporidium hominis
KDRNLSFYFSFYLDNWSLVKLKAI

SEQ ID NO: 2207134 - protein, 19 aa, Cryptosporidium hominis
KDYCRAVPLDGFADFAECA

SEQ ID NO: 2207135 - protein, 18 aa, Cryptosporidium hominis
KEAMFRKIIRKTAEYNEN

SEQ ID NO: 2207136 - protein, 24 aa, Cryptosporidium hominis
KEEIKIPYLYVVLCDQSLAKVPMG

SEQ ID NO: 2207137 - protein, 19 aa, Cryptosporidium hominis
KEELKRSAEKLGLDLDEQK

SEQ ID NO: 2207138 - protein, 22 aa, Cryptosporidium hominis
KEERKRVGAGLDREEVRRDLER

SEQ ID NO: 2207139 - protein, 17 aa, Cryptosporidium hominis
KEFPVSLYYAVKEFKQA

SEQ ID NO: 2207140 - protein, 20 aa, Cryptosporidium hominis
KEFYVSAYLYCESIRRVSGT

SEQ ID NO: 2207141 - protein, 19 aa, Cryptosporidium hominis
KEIDYGALFNCKYKYPERT

SEQ ID NO: 2207142 - protein, 17 aa, Cryptosporidium hominis
KEIKNVVFYAYTTKLFY

SEQ ID NO: 2207143 - protein, 21 aa, Cryptosporidium hominis
KEIRIHSSLLYLANYRTKKVV

SEQ ID NO: 2207144 - protein, 24 aa, Cryptosporidium hominis
KEIVPRSSFYGRVAKDCPILETKC

SEQ ID NO: 2207145 - protein, 17 aa, Cryptosporidium hominis
KEKKSSCFSKKKKQDYV

SEQ ID NO: 2207146 - protein, 19 aa, Cryptosporidium hominis
KEKYKGLATTLAMLCHALS

SEQ ID NO: 2207147 - protein, 19 aa, Cryptosporidium hominis
KENEFKAFVTENGLENEDS

SEQ ID NO: 2207148 - protein, 23 aa, Cryptosporidium hominis
KEQLKISLFNVMFYNENISDNDM

SEQ ID NO: 2207149 - protein, 19 aa, Cryptosporidium hominis
KEQVEAFCYMVFEKLYGKK

SEQ ID NO: 2207150 - protein, 19 aa, Cryptosporidium hominis
KERLAKLPVNMKIQSSSIK

SEQ ID NO: 2207151 - protein, 20 aa, Cryptosporidium hominis
KESHKGLIWLGASATAEFFA

SEQ ID NO: 2207152 - protein, 20 aa, Cryptosporidium hominis
KESKQMCLLLKPANHKSCTK

SEQ ID NO: 2207153 - protein, 19 aa, Cryptosporidium hominis
KESNSSCASCSSSKKSKKR

SEQ ID NO: 2207154 - protein, 26 aa, Cryptosporidium hominis
KESQLWIKDYVLRNAAYRHYQFEKSH

SEQ ID NO: 2207155 - protein, 20 aa, Cryptosporidium hominis
KETKADILFHIHKILEESSE

SEQ ID NO: 2207156 - protein, 20 aa, Cryptosporidium hominis
KEVKSMFSVFAFNQKRFGKK

SEQ ID NO: 2207157 - protein, 17 aa, Cryptosporidium hominis
KFFMSPAPRSPRCSNYK

SEQ ID NO: 2207158 - protein, 22 aa, Cryptosporidium hominis
KFILFLTILELFIDVILAEEKN

SEQ ID NO: 2207159 - protein, 19 aa, Cryptosporidium hominis
KFLPPKVPKDFVCNEENKS

SEQ ID NO: 2207160 - protein, 21 aa, Cryptosporidium hominis
KFNDFCLVGIILFNTKSYSRT

SEQ ID NO: 2207161 - protein, 22 aa, Cryptosporidium hominis
KFRQEFLLAINSFRSIVGKFAT

SEQ ID NO: 2207162 - protein, 18 aa, Cryptosporidium hominis
KGAFSIESSDFFPKPGSE

SEQ ID NO: 2207163 - protein, 19 aa, Cryptosporidium hominis
KGECKKGKCVAGDCSHRCY

SEQ ID NO: 2207164 - protein, 18 aa, Cryptosporidium hominis
KGFDSTFFTKSRNEFENA

SEQ ID NO: 2207165 - protein, 21 aa, Cryptosporidium hominis
KGGEILGSPLRLRSRVLKDEF

SEQ ID NO: 2207166 - protein, 36 aa, Cryptosporidium hominis
KGGSEKEWIMSFAPKLRPGRMQRRRDLFNEEEIEEA

SEQ ID NO: 2207167 - protein, 20 aa, Cryptosporidium hominis
KGGSKHSTWSRIMGNVGPNL

SEQ ID NO: 2207168 - protein, 17 aa, Cryptosporidium hominis
KGIDLPIEEKIRNDIDD

SEQ ID NO: 2207169 - protein, 17 aa, Cryptosporidium hominis
KGKLTILDSRPILYALN

SEQ ID NO: 2207170 - protein, 17 aa, Cryptosporidium hominis
KGKQGLVTLIYNEEIFL

SEQ ID NO: 2207171 - protein, 17 aa, Cryptosporidium hominis
KGQTLWYGFMVTYPEGK

SEQ ID NO: 2207172 - protein, 17 aa, Cryptosporidium hominis
KGSCKCGNCVGGECKPG

SEQ ID NO: 2207173 - protein, 25 aa, Cryptosporidium hominis
KGSYGEVWRGLAFTEYLSEPFGNCG

SEQ ID NO: 2207174 - protein, 21 aa, Cryptosporidium hominis
KHKQRISTCIVGNVPNYSVAN

SEQ ID NO: 2207175 - protein, 19 aa, Cryptosporidium hominis
KIDPRLVNHKKLFKILNFH

SEQ ID NO: 2207176 - protein, 17 aa, Cryptosporidium hominis
KIDVEGLNSLPPNEYNP

SEQ ID NO: 2207177 - protein, 24 aa, Cryptosporidium hominis
KIEITRIVPELGRFNIVVKSDTPG

SEQ ID NO: 2207178 - protein, 24 aa, Cryptosporidium hominis
KIERYCIKSGKGKIILSAGALNTP

SEQ ID NO: 2207179 - protein, 17 aa, Cryptosporidium hominis
KIIRGEIVPEEGRVPLQ

SEQ ID NO: 2207180 - protein, 21 aa, Cryptosporidium hominis
KIKHKKKKCKMYMEISSRDIS

SEQ ID NO: 2207181 - protein, 18 aa, Cryptosporidium hominis
KIKSIRITLVCLKKNGGT

SEQ ID NO: 2207182 - protein, 33 aa, Cryptosporidium hominis
KILKMLEKRLEVLLKRFVALGCENPEARKNPKL

SEQ ID NO: 2207183 - protein, 17 aa, Cryptosporidium hominis
KILPRRNWGEGIATLNG

SEQ ID NO: 2207184 - protein, 28 aa, Cryptosporidium hominis
KIPKEFKYSNGILKKFIQYCRRGIRSLA

SEQ ID NO: 2207185 - protein, 24 aa, Cryptosporidium hominis
KIPKPTLHYGRPNWLVVGQQGPSW

SEQ ID NO: 2207186 - protein, 27 aa, Cryptosporidium hominis
KIPSKDEAWWNVSYNVRKEPRRMDYSE

SEQ ID NO: 2207187 - protein, 24 aa, Cryptosporidium hominis
KIRTFPFNTLSSFSYLKEISETRT

SEQ ID NO: 2207188 - protein, 21 aa, Cryptosporidium hominis
KISDLRPLRLSTFGHLSRSET

SEQ ID NO: 2207189 - protein, 24 aa, Cryptosporidium hominis
KIYRDVCSEVSYTLQELNPFENSS

SEQ ID NO: 2207190 - protein, 20 aa, Cryptosporidium hominis
KIYRQRATGVFGIGLKSSLD

SEQ ID NO: 2207191 - protein, 18 aa, Cryptosporidium hominis
KKERGISSTEEYEISSEE

SEQ ID NO: 2207192 - protein, 20 aa, Cryptosporidium hominis
KKEYAYGAVMNHNISDLRNQ

SEQ ID NO: 2207193 - protein, 18 aa, Cryptosporidium hominis
KKFSENKFVVGVNYNNLL

SEQ ID NO: 2207194 - protein, 19 aa, Cryptosporidium hominis
KKFYSDSMLKFMNKKREAL

SEQ ID NO: 2207195 - protein, 19 aa, Cryptosporidium hominis
KKGLAGIIPIVYPTVAIMP

SEQ ID NO: 2207196 - protein, 19 aa, Cryptosporidium hominis
KKGLIPKLLEEIRSGVKLK

SEQ ID NO: 2207197 - protein, 18 aa, Cryptosporidium hominis
KKGNKFTRFFKRLFKKPS

SEQ ID NO: 2207198 - protein, 19 aa, Cryptosporidium hominis
KKIKFPDKLFYVIRYFNFI

SEQ ID NO: 2207199 - protein, 19 aa, Cryptosporidium hominis
KKINFNLLESCNEYMQQSR

SEQ ID NO: 2207200 - protein, 26 aa, Cryptosporidium hominis
KKISCSQIKSIFGFKDSCNVGKFAFP

SEQ ID NO: 2207201 - protein, 27 aa, Cryptosporidium hominis
KKKYPEAYHPLALEIFSTISKEDIETW

SEQ ID NO: 2207202 - protein, 18 aa, Cryptosporidium hominis
KKLPRSVPTMPIPNPTAS

SEQ ID NO: 2207203 - protein, 18 aa, Cryptosporidium hominis
KKNYKRLKKVLKLQRKKK

SEQ ID NO: 2207204 - protein, 25 aa, Cryptosporidium hominis
KKPEDVKYIIGPFASLVQKRGQDPR

SEQ ID NO: 2207205 - protein, 19 aa, Cryptosporidium hominis
KKRSARVVRKLALLEKLKL

SEQ ID NO: 2207206 - protein, 18 aa, Cryptosporidium hominis
KKRSDEFIAKNKDRKGVI

SEQ ID NO: 2207207 - protein, 30 aa, Cryptosporidium hominis
KKSKSINSLRKWELHYFYPLAKQILESIEK

SEQ ID NO: 2207208 - protein, 20 aa, Cryptosporidium hominis
KKSLLKKRSDEFIAKNKDRK

SEQ ID NO: 2207209 - protein, 28 aa, Cryptosporidium hominis
KKSSFDPWIVCLRRYENAIPFHGSSKQR

SEQ ID NO: 2207210 - protein, 17 aa, Cryptosporidium hominis
KKSTTIYWVYPIPPESY

SEQ ID NO: 2207211 - protein, 24 aa, Cryptosporidium hominis
KKTKKRKGPLISVTKINNMINKNH

SEQ ID NO: 2207212 - protein, 21 aa, Cryptosporidium hominis
KKTRRDPFKRSKSQLSNIMET

SEQ ID NO: 2207213 - protein, 18 aa, Cryptosporidium hominis
KKTTDGLEICRLKRISNL

SEQ ID NO: 2207214 - protein, 25 aa, Cryptosporidium hominis
KKVKRFKLTRGKRVLFIGYQKSPVS

SEQ ID NO: 2207215 - protein, 18 aa, Cryptosporidium hominis
KKVTAQCILGRMRSESDG

SEQ ID NO: 2207216 - protein, 22 aa, Cryptosporidium hominis
KKVVLKKPIKFHTLKTFQSLDE

SEQ ID NO: 2207217 - protein, 21 aa, Cryptosporidium hominis
KKYEWGNEISQWVDLESSNYS

SEQ ID NO: 2207218 - protein, 24 aa, Cryptosporidium hominis
KLAAFSLEGRDAYLYSKGADVLKT

SEQ ID NO: 2207219 - protein, 28 aa, Cryptosporidium hominis
KLCGLEADISYSRGRFVINVQSYSSNFE

SEQ ID NO: 2207220 - protein, 19 aa, Cryptosporidium hominis
KLCLSRLTYNLYRLAVFCQ

SEQ ID NO: 2207221 - protein, 20 aa, Cryptosporidium hominis
KLDEDAVILGAERKESNKGI

SEQ ID NO: 2207222 - protein, 21 aa, Cryptosporidium hominis
KLDRLNEILDFVFSNANLNLL

SEQ ID NO: 2207223 - protein, 33 aa, Cryptosporidium hominis
KLEALVKEWNRHLNWVRDIPKLCNDQLSTMNKL

SEQ ID NO: 2207224 - protein, 20 aa, Cryptosporidium hominis
KLFGKILLKYGEVHGVAIGN

SEQ ID NO: 2207225 - protein, 20 aa, Cryptosporidium hominis
KLFTRIAFGSIWSDKKYRGQ

SEQ ID NO: 2207226 - protein, 20 aa, Cryptosporidium hominis
KLGIHPSEIIFLDYSQSIKW

SEQ ID NO: 2207227 - protein, 24 aa, Cryptosporidium hominis
KLISEIAFEMFVLIRKEGIPNVDM

SEQ ID NO: 2207228 - protein, 23 aa, Cryptosporidium hominis
KLISSNWENTGWIVMEYYDGISL

SEQ ID NO: 2207229 - protein, 18 aa, Cryptosporidium hominis
KLKRSGLRKKEVLNTLIF

SEQ ID NO: 2207230 - protein, 24 aa, Cryptosporidium hominis
KLLKMDGLLCLLFVIFIFAQYLNF

SEQ ID NO: 2207231 - protein, 23 aa, Cryptosporidium hominis
KLLKTFSCLKLHSLLVKVKYIYA

SEQ ID NO: 2207232 - protein, 18 aa, Cryptosporidium hominis
KLLSKDVESRSFIVESKD

SEQ ID NO: 2207233 - protein, 28 aa, Cryptosporidium hominis
KLNDGFFDIFAFYFFKDYAAIQYLLDGT

SEQ ID NO: 2207234 - protein, 21 aa, Cryptosporidium hominis
KLPVLEVAFTKQEWLATSSGS

SEQ ID NO: 2207235 - protein, 18 aa, Cryptosporidium hominis
KLQVIKRLTESGAKSNEE

SEQ ID NO: 2207236 - protein, 18 aa, Cryptosporidium hominis
KLRWDLVGGTSIGAINAL

SEQ ID NO: 2207237 - protein, 27 aa, Cryptosporidium hominis
KLSSPRKLLRRLCCCCSSSCSSDDSCC

SEQ ID NO: 2207238 - protein, 19 aa, Cryptosporidium hominis
KLSYSFRSGTGFEDDSEIS

SEQ ID NO: 2207239 - protein, 22 aa, Cryptosporidium hominis
KMIDAICPDGFLPNGDDCIQFS

SEQ ID NO: 2207240 - protein, 29 aa, Cryptosporidium hominis
KMKASRIKICFKARICSRMMKKEEGTDNL

SEQ ID NO: 2207241 - protein, 21 aa, Cryptosporidium hominis
KMKEYRKLKGKKKKLLDEEIE

SEQ ID NO: 2207242 - protein, 17 aa, Cryptosporidium hominis
KMPGIPCGLLGSMDATK

SEQ ID NO: 2207243 - protein, 20 aa, Cryptosporidium hominis
KMRKELYKQSLMVQAEIERK

SEQ ID NO: 2207244 - protein, 18 aa, Cryptosporidium hominis
KNDISIGITKKFQISSFP

SEQ ID NO: 2207245 - protein, 17 aa, Cryptosporidium hominis
KNEKRWRTIGGVFDSEN

SEQ ID NO: 2207246 - protein, 22 aa, Cryptosporidium hominis
KNFWWLSKIRFSSGHYITKVHE

SEQ ID NO: 2207247 - protein, 21 aa, Cryptosporidium hominis
KNGFFGKLFGFFGRKNGGKKD

SEQ ID NO: 2207248 - protein, 19 aa, Cryptosporidium hominis
KNILKFATHYIGGFFGSKK

SEQ ID NO: 2207249 - protein, 25 aa, Cryptosporidium hominis
KNKPKRAMTAFMYFASSRRAEITAA

SEQ ID NO: 2207250 - protein, 23 aa, Cryptosporidium hominis
KNLAKNGYRTLRFDFYGHGLSQY

SEQ ID NO: 2207251 - protein, 20 aa, Cryptosporidium hominis
KNLESILNLPLRVTLQELDI

SEQ ID NO: 2207252 - protein, 20 aa, Cryptosporidium hominis
KNLFHRCEIAVITDKILKKQ

SEQ ID NO: 2207253 - protein, 21 aa, Cryptosporidium hominis
KNLYRILPRKLWNRIHSLAAK

SEQ ID NO: 2207254 - protein, 20 aa, Cryptosporidium hominis
KNSDQLFGHMIERWDQPIFT

SEQ ID NO: 2207255 - protein, 17 aa, Cryptosporidium hominis
KNVILGMQTSKLYEYSR

SEQ ID NO: 2207256 - protein, 18 aa, Cryptosporidium hominis
KNVQEWKIIREVSILKLL

SEQ ID NO: 2207257 - protein, 17 aa, Cryptosporidium hominis
KNWRARSNFSLTDVAFS

SEQ ID NO: 2207258 - protein, 19 aa, Cryptosporidium hominis
KPALCSPTLDMAESKRQFG

SEQ ID NO: 2207259 - protein, 23 aa, Cryptosporidium hominis
KPARKIIISRPIMRTLTEETDDE

SEQ ID NO: 2207260 - protein, 17 aa, Cryptosporidium hominis
KPDMTGASEALRNLKSV

SEQ ID NO: 2207261 - protein, 22 aa, Cryptosporidium hominis
KPFSLKCPHGYNLENGQCIQEI

SEQ ID NO: 2207262 - protein, 26 aa, Cryptosporidium hominis
KPIRSEILRILAILEEIEFNSKEVIK

SEQ ID NO: 2207263 - protein, 37 aa, Cryptosporidium hominis
KPKSPTYKEKLLSFFSGNGGGMFGFGKSSTTTTTTTT

SEQ ID NO: 2207264 - protein, 20 aa, Cryptosporidium hominis
KPLGSIRISFGYLSTFNDVL

SEQ ID NO: 2207265 - protein, 23 aa, Cryptosporidium hominis
KPLTKKGLHELLRKHRTGDNRNS

SEQ ID NO: 2207266 - protein, 24 aa, Cryptosporidium hominis
KPMEFYRYAVLLSISLIKDKNVDI

SEQ ID NO: 2207267 - protein, 20 aa, Cryptosporidium hominis
KPNFPFTIIDVAPFVNANAN

SEQ ID NO: 2207268 - protein, 20 aa, Cryptosporidium hominis
KPRQLTCSDTASFIFQLPVG

SEQ ID NO: 2207269 - protein, 19 aa, Cryptosporidium hominis
KPWLLQRIPELTGLSYNDV

SEQ ID NO: 2207270 - protein, 23 aa, Cryptosporidium hominis
KQDYGRECTFEWMNDLVTMYYNA

SEQ ID NO: 2207271 - protein, 24 aa, Cryptosporidium hominis
KQFGKILIMEICILYYDPKSFLDQ

SEQ ID NO: 2207272 - protein, 25 aa, Cryptosporidium hominis
KQGIPCIIYKLISLDFEYSGQDEMK

SEQ ID NO: 2207273 - protein, 23 aa, Cryptosporidium hominis
KQLKNCFKYKHILVPLEKKLIYM

SEQ ID NO: 2207274 - protein, 21 aa, Cryptosporidium hominis
KQLLVKAGILKIRLKNLKLAF

SEQ ID NO: 2207275 - protein, 24 aa, Cryptosporidium hominis
KQNLLVQCKILYQAFYSYKNSVRS

SEQ ID NO: 2207276 - protein, 21 aa, Cryptosporidium hominis
KQNSFYSYWGQGGIVADQAQP

SEQ ID NO: 2207277 - protein, 19 aa, Cryptosporidium hominis
KQVIELKPLLNCPPDTVLE

SEQ ID NO: 2207278 - protein, 18 aa, Cryptosporidium hominis
KQYIFTNFIRVCVHNYFW

SEQ ID NO: 2207279 - protein, 22 aa, Cryptosporidium hominis
KRADQLTTLKLCLSRLTYNLYR

SEQ ID NO: 2207280 - protein, 19 aa, Cryptosporidium hominis
KRDMYSLKTAWQCKTKKTT

SEQ ID NO: 2207281 - protein, 24 aa, Cryptosporidium hominis
KRGKKAYFRIFFNIVLKGKPLYTI

SEQ ID NO: 2207282 - protein, 24 aa, Cryptosporidium hominis
KRHLKALEIKKSWEDGGVKGAVID

SEQ ID NO: 2207283 - protein, 18 aa, Cryptosporidium hominis
KRIEYRKTLLTNSGNGPD

SEQ ID NO: 2207284 - protein, 25 aa, Cryptosporidium hominis
KRKYPNVKLRFIIRPKTLRFFPKSS

SEQ ID NO: 2207285 - protein, 20 aa, Cryptosporidium hominis
KRLRQSEIFHMKNSFRKVLR

SEQ ID NO: 2207286 - protein, 17 aa, Cryptosporidium hominis
KRPYLPQGIVPSPISTT

SEQ ID NO: 2207287 - protein, 20 aa, Cryptosporidium hominis
KRSLSRCLLLIILLVILEIL

SEQ ID NO: 2207288 - protein, 20 aa, Cryptosporidium hominis
KRSSLPIDVRCRGENMLAKM

SEQ ID NO: 2207289 - protein, 20 aa, Cryptosporidium hominis
KRWPRIYKIELTKIPIRARK

SEQ ID NO: 2207290 - protein, 18 aa, Cryptosporidium hominis
KSCEYAFSMVKHLITSGF

SEQ ID NO: 2207291 - protein, 21 aa, Cryptosporidium hominis
KSEILNLSDLMAYDVATDVAQ

SEQ ID NO: 2207292 - protein, 20 aa, Cryptosporidium hominis
KSEKGCVLYLYTQDSPNPTE

SEQ ID NO: 2207293 - protein, 22 aa, Cryptosporidium hominis
KSEKLCTCVKHLQEISPEVMKS

SEQ ID NO: 2207294 - protein, 24 aa, Cryptosporidium hominis
KSFNIPGIPIFGGPRVENRNYLTL

SEQ ID NO: 2207295 - protein, 17 aa, Cryptosporidium hominis
KSFWKSKEGEVGYETRC

SEQ ID NO: 2207296 - protein, 25 aa, Cryptosporidium hominis
KSFYNLSLFFLKWFKTGPEQGDCRF

SEQ ID NO: 2207297 - protein, 19 aa, Cryptosporidium hominis
KSGVPFIFRAASKIQGSKN

SEQ ID NO: 2207298 - protein, 25 aa, Cryptosporidium hominis
KSHNIRPYFDFSQFNICLVPQVEEF

SEQ ID NO: 2207299 - protein, 21 aa, Cryptosporidium hominis
KSIKHIPGFHFHNPEISYRNG

SEQ ID NO: 2207300 - protein, 18 aa, Cryptosporidium hominis
KSIPKLRGLAQISPEEAN

SEQ ID NO: 2207301 - protein, 25 aa, Cryptosporidium hominis
KSKKKPLTRRGLEYLLRKHKSRARK

SEQ ID NO: 2207302 - protein, 17 aa, Cryptosporidium hominis
KSKLILSFFPHKRKNLT

SEQ ID NO: 2207303 - protein, 25 aa, Cryptosporidium hominis
KSKRKPLTRKGLEDLIKKHKASANR

SEQ ID NO: 2207304 - protein, 25 aa, Cryptosporidium hominis
KSKRKPLTRKGLEDLIKKHKTGTSQ

SEQ ID NO: 2207305 - protein, 26 aa, Cryptosporidium hominis
KSKRKPLTRKGLEDLIKKHKTRARKN

SEQ ID NO: 2207306 - protein, 24 aa, Cryptosporidium hominis
KSLPLEGPEKFSHCNHHHHHKRKH

SEQ ID NO: 2207307 - protein, 17 aa, Cryptosporidium hominis
KSLRNMAYTVFTAPNGD

SEQ ID NO: 2207308 - protein, 30 aa, Cryptosporidium hominis
KSNDPRILLPRIFSHGCGTAAKLSESKLAK

SEQ ID NO: 2207309 - protein, 28 aa, Cryptosporidium hominis
KSNLSSLGSRPGIKGSYKQEGREEKKTF

SEQ ID NO: 2207310 - protein, 18 aa, Cryptosporidium hominis
KSPEEFVADCKRVITMLQ

SEQ ID NO: 2207311 - protein, 17 aa, Cryptosporidium hominis
KSPNLGIESSEIENKIL

SEQ ID NO: 2207312 - protein, 25 aa, Cryptosporidium hominis
KSPRWYLPNFWYYTIEEFESPVNSP

SEQ ID NO: 2207313 - protein, 24 aa, Cryptosporidium hominis
KSRARKNLNRRISSDLDDEEEENV

SEQ ID NO: 2207314 - protein, 31 aa, Cryptosporidium hominis
KSSCTGSVCAYGCAYGCSMGCGGKNGNTGNP

SEQ ID NO: 2207315 - protein, 25 aa, Cryptosporidium hominis
KSSDFCIISELLLQRGSLKEIKESC

SEQ ID NO: 2207316 - protein, 19 aa, Cryptosporidium hominis
KSSSEFNIGFLMEKYMTTY

SEQ ID NO: 2207317 - protein, 20 aa, Cryptosporidium hominis
KSVSEYRAKFSEDFSDELPH

SEQ ID NO: 2207318 - protein, 23 aa, Cryptosporidium hominis
KSYSCIFHLKIILNAINIIREFI

SEQ ID NO: 2207319 - protein, 19 aa, Cryptosporidium hominis
KTFILPFVMFPDEKSFENF

SEQ ID NO: 2207320 - protein, 25 aa, Cryptosporidium hominis
KTFYSIDIVGLFSYLPNEFELSRIS

SEQ ID NO: 2207321 - protein, 18 aa, Cryptosporidium hominis
KTGAISGIGFHWKKPPKP

SEQ ID NO: 2207322 - protein, 17 aa, Cryptosporidium hominis
KTMFLWNETIFFENLSI

SEQ ID NO: 2207323 - protein, 19 aa, Cryptosporidium hominis
KTMRISWECFTKVHNVIWI

SEQ ID NO: 2207324 - protein, 18 aa, Cryptosporidium hominis
KTNRFSFNLNSLKNKFRD

SEQ ID NO: 2207325 - protein, 31 aa, Cryptosporidium hominis
KTPLKKNYARWAVSFLKGWISSRNPFRYLCD

SEQ ID NO: 2207326 - protein, 21 aa, Cryptosporidium hominis
KTQVKGAYLVVERETTLSKTP

SEQ ID NO: 2207327 - protein, 20 aa, Cryptosporidium hominis
KTTNIWVFFHLFQEADEIRF

SEQ ID NO: 2207328 - protein, 19 aa, Cryptosporidium hominis
KVACSLDPLVIISSVENEI

SEQ ID NO: 2207329 - protein, 21 aa, Cryptosporidium hominis
KVASIRPGRGIEIVLNSHSQR

SEQ ID NO: 2207330 - protein, 19 aa, Cryptosporidium hominis
KVECPPGLSLGEDGICIHS

SEQ ID NO: 2207331 - protein, 30 aa, Cryptosporidium hominis
KVKNLKNQICEFSKIFDFYLISISKNIGLK

SEQ ID NO: 2207332 - protein, 23 aa, Cryptosporidium hominis
KVLEIPLLVAAPFMLTSDSNGSA

SEQ ID NO: 2207333 - protein, 20 aa, Cryptosporidium hominis
KVNNDYYVWGGMRGEANIEA

SEQ ID NO: 2207334 - protein, 22 aa, Cryptosporidium hominis
KVPMFYSKIFAITKSWWLNISK

SEQ ID NO: 2207335 - protein, 19 aa, Cryptosporidium hominis
KVRKALKISPHFVQRKKSN

SEQ ID NO: 2207336 - protein, 19 aa, Cryptosporidium hominis
KWDRCPSDEQIPNKKSNSD

SEQ ID NO: 2207337 - protein, 18 aa, Cryptosporidium hominis
KYCKSHNFKPPALDKDSC

SEQ ID NO: 2207338 - protein, 18 aa, Cryptosporidium hominis
KYDPKRDMCIKFEEKKPV

SEQ ID NO: 2207339 - protein, 26 aa, Cryptosporidium hominis
KYENNTRNALDYGDLNDPGFIIRIVD

SEQ ID NO: 2207340 - protein, 26 aa, Cryptosporidium hominis
KYERRPYEDIGLLDFRILDPLTAPAK

SEQ ID NO: 2207341 - protein, 19 aa, Cryptosporidium hominis
KYKYPERTYSKMYLGHLKT

SEQ ID NO: 2207342 - protein, 23 aa, Cryptosporidium hominis
KYLRMNRVLEIDSAWLKNTYPEI

SEQ ID NO: 2207343 - protein, 30 aa, Cryptosporidium hominis
KYMTKEEFLGECKRELPKFRSNLTETQVYF

SEQ ID NO: 2207344 - protein, 27 aa, Cryptosporidium hominis
KYMTLQDIRYEICKFGVIHKSGCKIVP

SEQ ID NO: 2207345 - protein, 19 aa, Cryptosporidium hominis
KYNLSRFSMLVLESVIKIL

SEQ ID NO: 2207346 - protein, 29 aa, Cryptosporidium hominis
KYPNIEVPLDWQSRVFIKYYPEESSIKVH

SEQ ID NO: 2207347 - protein, 23 aa, Cryptosporidium hominis
KYSLNILRHVFRALRRIVSDDFV

SEQ ID NO: 2207348 - protein, 17 aa, Cryptosporidium hominis
KYVDINMWSGFKYGKKL

SEQ ID NO: 2207349 - protein, 19 aa, Cryptosporidium hominis
KYYPICGTNGKTYENVSHF

SEQ ID NO: 2207350 - protein, 18 aa, Cryptosporidium hominis
LAERVFILQSEISELSVD

SEQ ID NO: 2207351 - protein, 17 aa, Cryptosporidium hominis
LALALILYWRERQYDIS

SEQ ID NO: 2207352 - protein, 18 aa, Cryptosporidium hominis
LALDPRNIFDVDLLGVKI

SEQ ID NO: 2207353 - protein, 19 aa, Cryptosporidium hominis
LALSICQKGLGLGVRVGVG

SEQ ID NO: 2207354 - protein, 18 aa, Cryptosporidium hominis
LASLEIWDEHWPPYASTF

SEQ ID NO: 2207355 - protein, 20 aa, Cryptosporidium hominis
LASRGYRVFITPPITMIPTP

SEQ ID NO: 2207356 - protein, 18 aa, Cryptosporidium hominis
LASTSAVMSCTLGKATCL

SEQ ID NO: 2207357 - protein, 20 aa, Cryptosporidium hominis
LATLLSELLFYDWKRPDVGR

SEQ ID NO: 2207358 - protein, 19 aa, Cryptosporidium hominis
LAVSELGAGFKAGSLCFTD

SEQ ID NO: 2207359 - protein, 27 aa, Cryptosporidium hominis
LCARNFRNSIEIWGNMASCQSSQIIGL

SEQ ID NO: 2207360 - protein, 19 aa, Cryptosporidium hominis
LCGEFDFDITHWNVEPYPN

SEQ ID NO: 2207361 - protein, 17 aa, Cryptosporidium hominis
LCKLLPKNFFHSREKTL

SEQ ID NO: 2207362 - protein, 27 aa, Cryptosporidium hominis
LCVARKGDQWDGSLCQTFHRYNEFNTR

SEQ ID NO: 2207363 - protein, 18 aa, Cryptosporidium hominis
LDAAILLVKSRSEEAVIT

SEQ ID NO: 2207364 - protein, 24 aa, Cryptosporidium hominis
LDDLHPKKNLNIFKSGIKKEKGKK

SEQ ID NO: 2207365 - protein, 26 aa, Cryptosporidium hominis
LDDLRAHKILKYSTCIGELKHGEFCS

SEQ ID NO: 2207366 - protein, 17 aa, Cryptosporidium hominis
LDEFGLGFDKMIENNQE

SEQ ID NO: 2207367 - protein, 21 aa, Cryptosporidium hominis
LDHFNSFCVNSLLNYYCNSPS

SEQ ID NO: 2207368 - protein, 20 aa, Cryptosporidium hominis
LDLLKTGLFIVFIFERSTFY

SEQ ID NO: 2207369 - protein, 18 aa, Cryptosporidium hominis
LDLLPKKRTHPITWQLIM

SEQ ID NO: 2207370 - protein, 17 aa, Cryptosporidium hominis
LDLLVDCQDEFGNWKSM

SEQ ID NO: 2207371 - protein, 20 aa, Cryptosporidium hominis
LDLSCTRIEEETKPKSKSKL

SEQ ID NO: 2207372 - protein, 25 aa, Cryptosporidium hominis
LDPDLRLVKIPGVKCSGDFQFTNPI

SEQ ID NO: 2207373 - protein, 21 aa, Cryptosporidium hominis
LDPSHGLSCSGPYISNQAVTE

SEQ ID NO: 2207374 - protein, 20 aa, Cryptosporidium hominis
LEAMLRLLIIYKNDFTNDLM

SEQ ID NO: 2207375 - protein, 19 aa, Cryptosporidium hominis
LEDAICPPGYLDNGSDCVQ

SEQ ID NO: 2207376 - protein, 18 aa, Cryptosporidium hominis
LEGFSKYFYSLSYERKQN

SEQ ID NO: 2207377 - protein, 24 aa, Cryptosporidium hominis
LEGSSCSLQDLFNAGWKFDKKLKI

SEQ ID NO: 2207378 - protein, 20 aa, Cryptosporidium hominis
LEIFLWFSPDEIYSYQRAID

SEQ ID NO: 2207379 - protein, 17 aa, Cryptosporidium hominis
LEILKEKLLDKLRGRGF

SEQ ID NO: 2207380 - protein, 23 aa, Cryptosporidium hominis
LEIMSKVGFPIAVMGSIPAVSYV

SEQ ID NO: 2207381 - protein, 25 aa, Cryptosporidium hominis
LEKDELMKWIKFVSERSSLKEVEAE

SEQ ID NO: 2207382 - protein, 31 aa, Cryptosporidium hominis
LEKIKILPFWIFKVSDEFSIILIESQSIANR

SEQ ID NO: 2207383 - protein, 32 aa, Cryptosporidium hominis
LEKISFQIFETWNRLVSILPFVLHKLEQTCKM

SEQ ID NO: 2207384 - protein, 19 aa, Cryptosporidium hominis
LEKLFPININLLSPDKSNF

SEQ ID NO: 2207385 - protein, 20 aa, Cryptosporidium hominis
LELATRCFMSTFITSLEPQN

SEQ ID NO: 2207386 - protein, 20 aa, Cryptosporidium hominis
LELAYLYFLEQFRKVCLGDY

SEQ ID NO: 2207387 - protein, 17 aa, Cryptosporidium hominis
LELIVRGFSEFRTYKGI

SEQ ID NO: 2207388 - protein, 20 aa, Cryptosporidium hominis
LELWSSFRTAPTILVIIQSN

SEQ ID NO: 2207389 - protein, 18 aa, Cryptosporidium hominis
LELYIILILTEKGEVLSW

SEQ ID NO: 2207390 - protein, 17 aa, Cryptosporidium hominis
LENRNAKGLPFFPDYKE

SEQ ID NO: 2207391 - protein, 20 aa, Cryptosporidium hominis
LEQQSICRLVQLVRPSQLPN

SEQ ID NO: 2207392 - protein, 18 aa, Cryptosporidium hominis
LERARQWAEIAAWRFQSD

SEQ ID NO: 2207393 - protein, 17 aa, Cryptosporidium hominis
LESIPRFQLEDLQLNPE

SEQ ID NO: 2207394 - protein, 20 aa, Cryptosporidium hominis
LFCLLILCFNSVLIFCNSSL

SEQ ID NO: 2207395 - protein, 17 aa, Cryptosporidium hominis
LFDYCRRSTNQTMDQLI

SEQ ID NO: 2207396 - protein, 19 aa, Cryptosporidium hominis
LFFFAIYIMIGISNASDVT

SEQ ID NO: 2207397 - protein, 18 aa, Cryptosporidium hominis
LFFFLEFSLIITNSSTYI

SEQ ID NO: 2207398 - protein, 18 aa, Cryptosporidium hominis
LFFIRKKYVPSFNPESSC

SEQ ID NO: 2207399 - protein, 19 aa, Cryptosporidium hominis
LFFSFLILLCEYSFSLGNI

SEQ ID NO: 2207400 - protein, 18 aa, Cryptosporidium hominis
LFIDDRMAEEVTYLLNIA

SEQ ID NO: 2207401 - protein, 24 aa, Cryptosporidium hominis
LFKEIIKSGFLQPSIPMISDTAKN

SEQ ID NO: 2207402 - protein, 18 aa, Cryptosporidium hominis
LFLGEKTISFLFVNNDVP

SEQ ID NO: 2207403 - protein, 22 aa, Cryptosporidium hominis
LFLLSLWLFLYDLHNFQDSSCL

SEQ ID NO: 2207404 - protein, 17 aa, Cryptosporidium hominis
LFLSFFSTISLCSRLEW

SEQ ID NO: 2207405 - protein, 18 aa, Cryptosporidium hominis
LFNQTLLYYRVNQTYFLM

SEQ ID NO: 2207406 - protein, 23 aa, Cryptosporidium hominis
LFRRVSRCCILIQDFVDIALMII

SEQ ID NO: 2207407 - protein, 19 aa, Cryptosporidium hominis
LFSKFKHIVFCSSHQDMYA

SEQ ID NO: 2207408 - protein, 18 aa, Cryptosporidium hominis
LFSNIIILCLYLGILKCV

SEQ ID NO: 2207409 - protein, 26 aa, Cryptosporidium hominis
LFTNRPWKSRIIIQSNFEELLVITKS

SEQ ID NO: 2207410 - protein, 18 aa, Cryptosporidium hominis
LFVHKGFYFVDAESKKNC

SEQ ID NO: 2207411 - protein, 17 aa, Cryptosporidium hominis
LFVRTGPYKYVTLQPSY

SEQ ID NO: 2207412 - protein, 19 aa, Cryptosporidium hominis
LGAGFKAGSLCFTDSMDSY

SEQ ID NO: 2207413 - protein, 24 aa, Cryptosporidium hominis
LGDRCARFAPKVCPSGGCEKIEST

SEQ ID NO: 2207414 - protein, 21 aa, Cryptosporidium hominis
LGGGKRGAGGVSRGASKGTVR

SEQ ID NO: 2207415 - protein, 17 aa, Cryptosporidium hominis
LGGTCVNVGCVPKKLMH

SEQ ID NO: 2207416 - protein, 18 aa, Cryptosporidium hominis
LGHMAISIITFFEEYSLI

SEQ ID NO: 2207417 - protein, 23 aa, Cryptosporidium hominis
LGILAIFIKLAITYANQHANEPE

SEQ ID NO: 2207418 - protein, 18 aa, Cryptosporidium hominis
LGLKEIYPTPVYTPDEVG

SEQ ID NO: 2207419 - protein, 17 aa, Cryptosporidium hominis
LGLLFGLVSVHSLSLRA

SEQ ID NO: 2207420 - protein, 22 aa, Cryptosporidium hominis
LGNNLPDLFGYSTFDIITSIET

SEQ ID NO: 2207421 - protein, 18 aa, Cryptosporidium hominis
LGPFDRVRGPGCKTPCTK

SEQ ID NO: 2207422 - protein, 21 aa, Cryptosporidium hominis
LGSGAPRPGRSPKKDKFGNPE

SEQ ID NO: 2207423 - protein, 20 aa, Cryptosporidium hominis
LGTGCFPKDVLVAPFKMDQV

SEQ ID NO: 2207424 - protein, 25 aa, Cryptosporidium hominis
LGVQTRLLPLFSFVSRYSTINESYK

SEQ ID NO: 2207425 - protein, 26 aa, Cryptosporidium hominis
LHALICIWLLFRIILEPVNGKNDSKF

SEQ ID NO: 2207426 - protein, 17 aa, Cryptosporidium hominis
LHLKAFPLFSTQLNISK

SEQ ID NO: 2207427 - protein, 23 aa, Cryptosporidium hominis
LHTFGDLWTIPWNCCKNKDLNEN

SEQ ID NO: 2207428 - protein, 20 aa, Cryptosporidium hominis
LHVGHLVPFLFTKYLQDTFK

SEQ ID NO: 2207429 - protein, 18 aa, Cryptosporidium hominis
LIAAFVRMLLLLQERSKE

SEQ ID NO: 2207430 - protein, 17 aa, Cryptosporidium hominis
LIALLSIILRLTNDLNM

SEQ ID NO: 2207431 - protein, 19 aa, Cryptosporidium hominis
LIDLSFVWVPSALKSRNTH

SEQ ID NO: 2207432 - protein, 19 aa, Cryptosporidium hominis
LIESYYLRLNERLYNPQEV

SEQ ID NO: 2207433 - protein, 18 aa, Cryptosporidium hominis
LIFAALCNLLSLLPDQVF

SEQ ID NO: 2207434 - protein, 21 aa, Cryptosporidium hominis
LIGDEIVCLVLQFTSPKVECP

SEQ ID NO: 2207435 - protein, 23 aa, Cryptosporidium hominis
LIIYFCINYSFGASNQSKSDEDH

SEQ ID NO: 2207436 - protein, 22 aa, Cryptosporidium hominis
LIKRLAHNVIRSGLKTICSSYN

SEQ ID NO: 2207437 - protein, 24 aa, Cryptosporidium hominis
LILFLYKIEVFESVEIEGIQLIGK

SEQ ID NO: 2207438 - protein, 23 aa, Cryptosporidium hominis
LILFSIILIIGWVESSSNSLQME

SEQ ID NO: 2207439 - protein, 22 aa, Cryptosporidium hominis
LILSVLCVPLFNIDLYNYYPHF

SEQ ID NO: 2207440 - protein, 18 aa, Cryptosporidium hominis
LIQISWLKNSLVLSQLMP

SEQ ID NO: 2207441 - protein, 18 aa, Cryptosporidium hominis
LISKRPYLPQGIVPSPIS

SEQ ID NO: 2207442 - protein, 18 aa, Cryptosporidium hominis
LIVPFLVLFTAVEGTPDY

SEQ ID NO: 2207443 - protein, 18 aa, Cryptosporidium hominis
LKALKLVRQRCFHHSESS

SEQ ID NO: 2207444 - protein, 23 aa, Cryptosporidium hominis
LKAVANMCLYTPNIAVFASSHIE

SEQ ID NO: 2207445 - protein, 25 aa, Cryptosporidium hominis
LKENAEWQMLKLIQYFFEDQSQNSI

SEQ ID NO: 2207446 - protein, 22 aa, Cryptosporidium hominis
LKEQVAFPVLELEKNMINKEKL

SEQ ID NO: 2207447 - protein, 18 aa, Cryptosporidium hominis
LKESAVLERARQWAEIAA

SEQ ID NO: 2207448 - protein, 17 aa, Cryptosporidium hominis
LKFIKKNLEEFSSNEYY

SEQ ID NO: 2207449 - protein, 17 aa, Cryptosporidium hominis
LKGDVLNYFNIICVDEL

SEQ ID NO: 2207450 - protein, 18 aa, Cryptosporidium hominis
LKHQVEIGNMKFNYDFRI

SEQ ID NO: 2207451 - protein, 17 aa, Cryptosporidium hominis
LKILLSIYQGVASRKSY

SEQ ID NO: 2207452 - protein, 19 aa, Cryptosporidium hominis
LKIPNMHVWWEMKEKHENL

SEQ ID NO: 2207453 - protein, 17 aa, Cryptosporidium hominis
LKIWNLTFLGRRVAFEV

SEQ ID NO: 2207454 - protein, 17 aa, Cryptosporidium hominis
LKLEKHILLQQQKDRAL

SEQ ID NO: 2207455 - protein, 22 aa, Cryptosporidium hominis
LKLELIPRYKVSATDEIVYNIR

SEQ ID NO: 2207456 - protein, 29 aa, Cryptosporidium hominis
LKLHPKLLIDPLKYDECVNLFTEANIHDT

SEQ ID NO: 2207457 - protein, 25 aa, Cryptosporidium hominis
LKLRRGCWYGMRIFDGDGKMTDRTE

SEQ ID NO: 2207458 - protein, 17 aa, Cryptosporidium hominis
LKNDVLYIFYGDKNGME

SEQ ID NO: 2207459 - protein, 17 aa, Cryptosporidium hominis
LKNGFMFRVSLTERYSK

SEQ ID NO: 2207460 - protein, 24 aa, Cryptosporidium hominis
LKNLWMCLVSGIFKILKHKQRIST

SEQ ID NO: 2207461 - protein, 22 aa, Cryptosporidium hominis
LKNQLLRYIPRDNVSVIGVPNQ

SEQ ID NO: 2207462 - protein, 17 aa, Cryptosporidium hominis
LKPSKLVQMHYERIIRG

SEQ ID NO: 2207463 - protein, 24 aa, Cryptosporidium hominis
LKQLESRYLKLLSEVSRIGPQLMR

SEQ ID NO: 2207464 - protein, 20 aa, Cryptosporidium hominis
LKQWCSGMMTNWYRQLQKMG

SEQ ID NO: 2207465 - protein, 20 aa, Cryptosporidium hominis
LKRTILLVIISIILKSINTY

SEQ ID NO: 2207466 - protein, 18 aa, Cryptosporidium hominis
LKSGFKLDTINIPPFSLS

SEQ ID NO: 2207467 - protein, 26 aa, Cryptosporidium hominis
LKSIEFEMSEGLGISKDSCFNPELLS

SEQ ID NO: 2207468 - protein, 23 aa, Cryptosporidium hominis
LKSKEIYKICKFTSKPVLNVVMH

SEQ ID NO: 2207469 - protein, 18 aa, Cryptosporidium hominis
LKSLKTPPYYSGSHENIA

SEQ ID NO: 2207470 - protein, 19 aa, Cryptosporidium hominis
LKTLLTYLFTYFKESNIDL

SEQ ID NO: 2207471 - protein, 17 aa, Cryptosporidium hominis
LKTPPYYSGSHENIANS

SEQ ID NO: 2207472 - protein, 22 aa, Cryptosporidium hominis
LKVCMKFNMLDIMLYPRLNNKT

SEQ ID NO: 2207473 - protein, 22 aa, Cryptosporidium hominis
LKVKSEYSLLELVSQMTESESE

SEQ ID NO: 2207474 - protein, 17 aa, Cryptosporidium hominis
LKYEILISSPSCIIRTL

SEQ ID NO: 2207475 - protein, 19 aa, Cryptosporidium hominis
LLATIIFCNFALIFCRRIP

SEQ ID NO: 2207476 - protein, 24 aa, Cryptosporidium hominis
LLAVKFGGIYLDYVQKQYLKKHEY

SEQ ID NO: 2207477 - protein, 24 aa, Cryptosporidium hominis
LLECTDALNSWSYFAKMTVKKLLD

SEQ ID NO: 2207478 - protein, 19 aa, Cryptosporidium hominis
LLEEMLIQATTAFSILHSS

SEQ ID NO: 2207479 - protein, 28 aa, Cryptosporidium hominis
LLEQIFKCLILLRLDKYSRRIFKDNSVN

SEQ ID NO: 2207480 - protein, 24 aa, Cryptosporidium hominis
LLEYLKIKIIKVVHLLNEYNVNEI

SEQ ID NO: 2207481 - protein, 22 aa, Cryptosporidium hominis
LLFCCIYLVAAINGTKRKRKSI

SEQ ID NO: 2207482 - protein, 19 aa, Cryptosporidium hominis
LLFCVKFAREVILTTGNEN

SEQ ID NO: 2207483 - protein, 18 aa, Cryptosporidium hominis
LLFIAITLLFISKVKSSR

SEQ ID NO: 2207484 - protein, 18 aa, Cryptosporidium hominis
LLFILRQVLEVAIKNPKL

SEQ ID NO: 2207485 - protein, 17 aa, Cryptosporidium hominis
LLFMFIRNVKSFENGLL

SEQ ID NO: 2207486 - protein, 17 aa, Cryptosporidium hominis
LLFTFLKSVIFCQEIDK

SEQ ID NO: 2207487 - protein, 26 aa, Cryptosporidium hominis
LLILLSVLVIFEFCLGTDLTADLDSY

SEQ ID NO: 2207488 - protein, 17 aa, Cryptosporidium hominis
LLIPLVVNSSLPSIIPG

SEQ ID NO: 2207489 - protein, 22 aa, Cryptosporidium hominis
LLKRNLELFNQTLLYYRVNQTY

SEQ ID NO: 2207490 - protein, 19 aa, Cryptosporidium hominis
LLLHLQLLIVSVRSNGGDE

SEQ ID NO: 2207491 - protein, 20 aa, Cryptosporidium hominis
LLLIFLIQISWLKNSLVLSQ

SEQ ID NO: 2207492 - protein, 18 aa, Cryptosporidium hominis
LLLLFIFFSYCMCGDMIS

SEQ ID NO: 2207493 - protein, 22 aa, Cryptosporidium hominis
LLNLWFAYSFVFGNDLDSKKNY

SEQ ID NO: 2207494 - protein, 17 aa, Cryptosporidium hominis
LLNNFFLTYYSRPSKII

SEQ ID NO: 2207495 - protein, 25 aa, Cryptosporidium hominis
LLNSFPCPFSKVLMKTEDSQSEIED

SEQ ID NO: 2207496 - protein, 18 aa, Cryptosporidium hominis
LLQPGSWSVFQGVKQDSV

SEQ ID NO: 2207497 - protein, 18 aa, Cryptosporidium hominis
LLQSIKFVFVAILDQNSL

SEQ ID NO: 2207498 - protein, 23 aa, Cryptosporidium hominis
LLRMFKEKLVIRLNDIDEINQQI

SEQ ID NO: 2207499 - protein, 25 aa, Cryptosporidium hominis
LLRNFCYLGFLELWSSFRTAPTILV

SEQ ID NO: 2207500 - protein, 20 aa, Cryptosporidium hominis
LLSIPGCVKKLAKFSHKAKV

SEQ ID NO: 2207501 - protein, 17 aa, Cryptosporidium hominis
LLSNDIPVYEISVFQTS

SEQ ID NO: 2207502 - protein, 19 aa, Cryptosporidium hominis
LLSVLLIKLALMNYYDISP

SEQ ID NO: 2207503 - protein, 23 aa, Cryptosporidium hominis
LLTTCIKFLLSIYLGESLKVLPT

SEQ ID NO: 2207504 - protein, 17 aa, Cryptosporidium hominis
LLYKQSFISKFINSLSK

SEQ ID NO: 2207505 - protein, 23 aa, Cryptosporidium hominis
LMCESCQLITFALKEYISKKLSI

SEQ ID NO: 2207506 - protein, 26 aa, Cryptosporidium hominis
LMEAAKSYSALRFAYGNTKVVQSNNS

SEQ ID NO: 2207507 - protein, 22 aa, Cryptosporidium hominis
LMKYLNCFMITFFSINIDAINV

SEQ ID NO: 2207508 - protein, 18 aa, Cryptosporidium hominis
LMLGVAIGTAIGYKLYPN

SEQ ID NO: 2207509 - protein, 29 aa, Cryptosporidium hominis
LMRCCALKYLIVFKSHFNNASSLDILQQS

SEQ ID NO: 2207510 - protein, 17 aa, Cryptosporidium hominis
LMTKLNILLSFEANEGF

SEQ ID NO: 2207511 - protein, 17 aa, Cryptosporidium hominis
LMWIPGVLVDFSQWKKM

SEQ ID NO: 2207512 - protein, 26 aa, Cryptosporidium hominis
LMYMEKFRFLYIISEPSLDGKDIDIV

SEQ ID NO: 2207513 - protein, 17 aa, Cryptosporidium hominis
LNAKEIIRNSGILNTDN

SEQ ID NO: 2207514 - protein, 25 aa, Cryptosporidium hominis
LNALPRCQCLPGYIGDGRTKGTGCQ

SEQ ID NO: 2207515 - protein, 17 aa, Cryptosporidium hominis
LNFCNSMRLRIIAGKHF

SEQ ID NO: 2207516 - protein, 18 aa, Cryptosporidium hominis
LNFFPYCATNGVTYINEC

SEQ ID NO: 2207517 - protein, 17 aa, Cryptosporidium hominis
LNFKSWMEKVGAFFDNS

SEQ ID NO: 2207518 - protein, 19 aa, Cryptosporidium hominis
LNFLLPLKHDRLFLNKLLT

SEQ ID NO: 2207519 - protein, 24 aa, Cryptosporidium hominis
LNGNWYVKLGEMWYIDNSSSLDFV

SEQ ID NO: 2207520 - protein, 18 aa, Cryptosporidium hominis
LNILLSFEANEGFAQLIF

SEQ ID NO: 2207521 - protein, 19 aa, Cryptosporidium hominis
LNKEIINNLNLGFKFSDLP

SEQ ID NO: 2207522 - protein, 20 aa, Cryptosporidium hominis
LNKFCQLLFKQLRNTLLFSN

SEQ ID NO: 2207523 - protein, 23 aa, Cryptosporidium hominis
LNKKIRECRELKKKIDERTEMYD

SEQ ID NO: 2207524 - protein, 22 aa, Cryptosporidium hominis
LNLDYAITWAINEDNWGYLNDY

SEQ ID NO: 2207525 - protein, 20 aa, Cryptosporidium hominis
LNLEIIKKCQVMARRQAKII

SEQ ID NO: 2207526 - protein, 23 aa, Cryptosporidium hominis
LNLIEEREIWNLYGGDALMPVSS

SEQ ID NO: 2207527 - protein, 20 aa, Cryptosporidium hominis
LNNYGIYFAIEFKDDAVCYL

SEQ ID NO: 2207528 - protein, 17 aa, Cryptosporidium hominis
LNSKFASIGRSFGSIGN

SEQ ID NO: 2207529 - protein, 20 aa, Cryptosporidium hominis
LNSTKFIYNSRVKAVEVLYK

SEQ ID NO: 2207530 - protein, 25 aa, Cryptosporidium hominis
LNTSEIPLVLPFEVLDLNMSVHRSL

SEQ ID NO: 2207531 - protein, 21 aa, Cryptosporidium hominis
LPDIHKVAAMTFQLPNLRDES

SEQ ID NO: 2207532 - protein, 18 aa, Cryptosporidium hominis
LPIRLHVPIIPIDNSVKI

SEQ ID NO: 2207533 - protein, 17 aa, Cryptosporidium hominis
LPLEPYQRIMTFAIEIC

SEQ ID NO: 2207534 - protein, 20 aa, Cryptosporidium hominis
LPLRQSLIFFYYAGIKEVIK

SEQ ID NO: 2207535 - protein, 26 aa, Cryptosporidium hominis
LPNIYSVKILQEFPHYHIPENHIFSE

SEQ ID NO: 2207536 - protein, 21 aa, Cryptosporidium hominis
LPPEYSCMMFLLVEQAKNIIR

SEQ ID NO: 2207537 - protein, 18 aa, Cryptosporidium hominis
LPPKRFISKYSKNDSTIS

SEQ ID NO: 2207538 - protein, 18 aa, Cryptosporidium hominis
LPPSNFPKTGYRGCGSNF

SEQ ID NO: 2207539 - protein, 22 aa, Cryptosporidium hominis
LPQKNLDTFIGRAAHIQVIENQ

SEQ ID NO: 2207540 - protein, 22 aa, Cryptosporidium hominis
LPQVRKMLNGWPKELSNKERVY

SEQ ID NO: 2207541 - protein, 18 aa, Cryptosporidium hominis
LPRIISISLSCRRIKKQI

SEQ ID NO: 2207542 - protein, 19 aa, Cryptosporidium hominis
LPSSIPYYLLSDEDFSQVR

SEQ ID NO: 2207543 - protein, 18 aa, Cryptosporidium hominis
LPSSPLYIKGKKFGIKNL

SEQ ID NO: 2207544 - protein, 18 aa, Cryptosporidium hominis
LPTFQKFVSRHRKLAFTL

SEQ ID NO: 2207545 - protein, 23 aa, Cryptosporidium hominis
LPYKPNYPIMIFKDGWQQPDYLI

SEQ ID NO: 2207546 - protein, 17 aa, Cryptosporidium hominis
LPYWPSINISPPKNRIT

SEQ ID NO: 2207547 - protein, 20 aa, Cryptosporidium hominis
LQAVILVCLLYLCIHVEGNG

SEQ ID NO: 2207548 - protein, 26 aa, Cryptosporidium hominis
LQEFFYGIEFSWRGYSSIFPDSLNEI

SEQ ID NO: 2207549 - protein, 20 aa, Cryptosporidium hominis
LQILFGWFSFSNGFASVTVS

SEQ ID NO: 2207550 - protein, 17 aa, Cryptosporidium hominis
LQIPRIAFPTAVQSSVF

SEQ ID NO: 2207551 - protein, 29 aa, Cryptosporidium hominis
LQLSLQLLHLQLRLPRKSKKRSFYKASHL

SEQ ID NO: 2207552 - protein, 21 aa, Cryptosporidium hominis
LQPELYCLLFTNSMRPSIFSF

SEQ ID NO: 2207553 - protein, 19 aa, Cryptosporidium hominis
LQQAFPFGFLTRVSDCNRL

SEQ ID NO: 2207554 - protein, 27 aa, Cryptosporidium hominis
LQSDFEALMGMSFIKLKQILKELSVEG

SEQ ID NO: 2207555 - protein, 20 aa, Cryptosporidium hominis
LQVTELCIFASKLAESSTED

SEQ ID NO: 2207556 - protein, 21 aa, Cryptosporidium hominis
LQYLKECKIGVKFGSNEEELK

SEQ ID NO: 2207557 - protein, 19 aa, Cryptosporidium hominis
LQYLLGIILLIGIVHALIF

SEQ ID NO: 2207558 - protein, 23 aa, Cryptosporidium hominis
LRDHPSLSIFGFFRGLSTDHARI

SEQ ID NO: 2207559 - protein, 21 aa, Cryptosporidium hominis
LREEYIPIIFFDIYAKCCSPN

SEQ ID NO: 2207560 - protein, 21 aa, Cryptosporidium hominis
LREIQKLQEMFVAPTSDNTRP

SEQ ID NO: 2207561 - protein, 18 aa, Cryptosporidium hominis
LRFPENFVASKGVETIFI

SEQ ID NO: 2207562 - protein, 19 aa, Cryptosporidium hominis
LRGILLPLVDMFQVSIGCA

SEQ ID NO: 2207563 - protein, 19 aa, Cryptosporidium hominis
LRGSLDCFLNFYTSFSQPF

SEQ ID NO: 2207564 - protein, 18 aa, Cryptosporidium hominis
LRGVPIIKKHSNSPSQLL

SEQ ID NO: 2207565 - protein, 21 aa, Cryptosporidium hominis
LRKKLLLACSGIHMHLFEIKP

SEQ ID NO: 2207566 - protein, 20 aa, Cryptosporidium hominis
LRLDPSPTYFESYYQFRKAL

SEQ ID NO: 2207567 - protein, 23 aa, Cryptosporidium hominis
LRLPATSKEWFVYIRAQTVTFSG

SEQ ID NO: 2207568 - protein, 19 aa, Cryptosporidium hominis
LRNFLHVVKQLHLNTLRKD

SEQ ID NO: 2207569 - protein, 18 aa, Cryptosporidium hominis
LRNGEVRFNLKYLSDDDE

SEQ ID NO: 2207570 - protein, 17 aa, Cryptosporidium hominis
LRNGGKLKIVLDGKSRD

SEQ ID NO: 2207571 - protein, 24 aa, Cryptosporidium hominis
LRNVDSDNPLECILLVEGPKSKRN

SEQ ID NO: 2207572 - protein, 22 aa, Cryptosporidium hominis
LRPIPLKTSRDFEARRKNLESI

SEQ ID NO: 2207573 - protein, 20 aa, Cryptosporidium hominis
LRQVLQLTLCCLSYDFMGTV

SEQ ID NO: 2207574 - protein, 17 aa, Cryptosporidium hominis
LRRLYPQSSDLDMKSLV

SEQ ID NO: 2207575 - protein, 19 aa, Cryptosporidium hominis
LRRRAAFPATHTDHRPFKP

SEQ ID NO: 2207576 - protein, 17 aa, Cryptosporidium hominis
LRRTVGYKMLSKEDRDL

SEQ ID NO: 2207577 - protein, 20 aa, Cryptosporidium hominis
LRSAPYLVGHYVRLLAQLVK

SEQ ID NO: 2207578 - protein, 24 aa, Cryptosporidium hominis
LRSESNRLVFAYQLIDGSLVPSSA

SEQ ID NO: 2207579 - protein, 18 aa, Cryptosporidium hominis
LRSFKGGEILGSPLRLRS

SEQ ID NO: 2207580 - protein, 26 aa, Cryptosporidium hominis
LRSSESFNNSFLFNFEKMVFKSFYNL

SEQ ID NO: 2207581 - protein, 19 aa, Cryptosporidium hominis
LRTATKWRVLQGHTQQVDA

SEQ ID NO: 2207582 - protein, 26 aa, Cryptosporidium hominis
LRTSFREGCGFVHFLKSKGALPTASS

SEQ ID NO: 2207583 - protein, 22 aa, Cryptosporidium hominis
LRYIEGYINNWVKILKMLEKRL

SEQ ID NO: 2207584 - protein, 18 aa, Cryptosporidium hominis
LSAAMLVCQKRDYIPKQI

SEQ ID NO: 2207585 - protein, 17 aa, Cryptosporidium hominis
LSAQFPVISPFESLSLV

SEQ ID NO: 2207586 - protein, 19 aa, Cryptosporidium hominis
LSCQDSKKSLAILILMFQR

SEQ ID NO: 2207587 - protein, 19 aa, Cryptosporidium hominis
LSCRAPFSLVGGDCLYNAE

SEQ ID NO: 2207588 - protein, 23 aa, Cryptosporidium hominis
LSDCTLPIWKNILKFATHYIGGF

SEQ ID NO: 2207589 - protein, 19 aa, Cryptosporidium hominis
LSDFIYLLKMILKKSKIHN

SEQ ID NO: 2207590 - protein, 18 aa, Cryptosporidium hominis
LSECKMLLPYGVDQKEII

SEQ ID NO: 2207591 - protein, 20 aa, Cryptosporidium hominis
LSESIFRFSSYFHSPLLNND

SEQ ID NO: 2207592 - protein, 24 aa, Cryptosporidium hominis
LSEVSRIGPQLMRVDEELSKLQES

SEQ ID NO: 2207593 - protein, 23 aa, Cryptosporidium hominis
LSFFSGLFLLNYVFSTNTTKIAC

SEQ ID NO: 2207594 - protein, 18 aa, Cryptosporidium hominis
LSGFSGKISTWFKNNYLK

SEQ ID NO: 2207595 - protein, 17 aa, Cryptosporidium hominis
LSGIPTRSLRISTISKE

SEQ ID NO: 2207596 - protein, 29 aa, Cryptosporidium hominis
LSGKWKNPINFILRCRESLRVVSNGMKVS

SEQ ID NO: 2207597 - protein, 18 aa, Cryptosporidium hominis
LSHFELMAMVKLREELEK

SEQ ID NO: 2207598 - protein, 21 aa, Cryptosporidium hominis
LSICYLMLKVALTTFVFGSKE

SEQ ID NO: 2207599 - protein, 33 aa, Cryptosporidium hominis
LSIKQEYFSEALIKFCSYLKSFSPKRIHLDPAM

SEQ ID NO: 2207600 - protein, 23 aa, Cryptosporidium hominis
LSILLKLSFYIQYIVYFPNTGKL

SEQ ID NO: 2207601 - protein, 19 aa, Cryptosporidium hominis
LSIRRELNELTRLLNKKHS

SEQ ID NO: 2207602 - protein, 24 aa, Cryptosporidium hominis
LSKLFCFPIPIFLTLNSFPETVES

SEQ ID NO: 2207603 - protein, 18 aa, Cryptosporidium hominis
LSKRYGILEYRFDEICKA

SEQ ID NO: 2207604 - protein, 21 aa, Cryptosporidium hominis
LSLIFFLNWFLIIKRIEGIDL

SEQ ID NO: 2207605 - protein, 19 aa, Cryptosporidium hominis
LSLVWLSIYDKIQIRHRNE

SEQ ID NO: 2207606 - protein, 24 aa, Cryptosporidium hominis
LSNLPDIFYGNGIQILLQPFSDLS

SEQ ID NO: 2207607 - protein, 17 aa, Cryptosporidium hominis
LSNYYLLEFNQEEERIR

SEQ ID NO: 2207608 - protein, 24 aa, Cryptosporidium hominis
LSPKMTIPLIYRVFLPSDVLPGKN

SEQ ID NO: 2207609 - protein, 25 aa, Cryptosporidium hominis
LSPPLRYTIFIALLKLVSELTFERS

SEQ ID NO: 2207610 - protein, 26 aa, Cryptosporidium hominis
LSQNNNFCKLYDDFILSAYPKEYYVS

SEQ ID NO: 2207611 - protein, 33 aa, Cryptosporidium hominis
LSQSLPCFKFTRREFLPLFSVFFQKKAIRNLEY

SEQ ID NO: 2207612 - protein, 17 aa, Cryptosporidium hominis
LSRLKLFNRNHMKKKMG

SEQ ID NO: 2207613 - protein, 21 aa, Cryptosporidium hominis
LSSFLLWLVSTSFLINLARSS

SEQ ID NO: 2207614 - protein, 22 aa, Cryptosporidium hominis
LSSKSRGAFKRTIKQKKALENQ

SEQ ID NO: 2207615 - protein, 18 aa, Cryptosporidium hominis
LSSPRPQRRKLWGRGHKG

SEQ ID NO: 2207616 - protein, 17 aa, Cryptosporidium hominis
LSSRPGQYFRHLQTTVE

SEQ ID NO: 2207617 - protein, 17 aa, Cryptosporidium hominis
LSTLEWNIIQSRWELLK

SEQ ID NO: 2207618 - protein, 17 aa, Cryptosporidium hominis
LSVGYGLNSQIPLSTQS

SEQ ID NO: 2207619 - protein, 20 aa, Cryptosporidium hominis
LSYDVWSVGIVMLQMIWGNL

SEQ ID NO: 2207620 - protein, 26 aa, Cryptosporidium hominis
LTDPKVRIGLFKGYISLEEMQSRTII

SEQ ID NO: 2207621 - protein, 22 aa, Cryptosporidium hominis
LTEAVSFFIYLNSFKFIQNYHI

SEQ ID NO: 2207622 - protein, 17 aa, Cryptosporidium hominis
LTGMQWWVYDSFKTIIG

SEQ ID NO: 2207623 - protein, 26 aa, Cryptosporidium hominis
LTSGIWKPKERFAGFQPPIINSAQGA

SEQ ID NO: 2207624 - protein, 19 aa, Cryptosporidium hominis
LTSRFTNRFTRNSNRRRRR

SEQ ID NO: 2207625 - protein, 17 aa, Cryptosporidium hominis
LVCPPGFSSSKPIQPIS

SEQ ID NO: 2207626 - protein, 17 aa, Cryptosporidium hominis
LVDETLQILGLSRMVVG

SEQ ID NO: 2207627 - protein, 17 aa, Cryptosporidium hominis
LVDFCPIAEALLHEVDL

SEQ ID NO: 2207628 - protein, 18 aa, Cryptosporidium hominis
LVFIFAIVALFGNFRNTE

SEQ ID NO: 2207629 - protein, 18 aa, Cryptosporidium hominis
LVFIFGLLILSSRAEEIE

SEQ ID NO: 2207630 - protein, 17 aa, Cryptosporidium hominis
LVKIIRIKMEEINSRLN

SEQ ID NO: 2207631 - protein, 30 aa, Cryptosporidium hominis
LVKKEAFDLADFCKVMHALGPFSDKSGTIG

SEQ ID NO: 2207632 - protein, 24 aa, Cryptosporidium hominis
LVLTLSLLAGFVFGTNENPNFLRL

SEQ ID NO: 2207633 - protein, 25 aa, Cryptosporidium hominis
LVNHKKLFKILNFHVDKVIFSSLDK

SEQ ID NO: 2207634 - protein, 18 aa, Cryptosporidium hominis
LVQLGFNVAHTFGNATCN

SEQ ID NO: 2207635 - protein, 24 aa, Cryptosporidium hominis
LVRKSREALQVSIFTYFMAQKKLA

SEQ ID NO: 2207636 - protein, 22 aa, Cryptosporidium hominis
LVRTWYRVFRKLGSTKNRMKKS

SEQ ID NO: 2207637 - protein, 44 aa, Cryptosporidium hominis
LVSSGHYEFSFIKVKCGGKFCSRLRKALCCCTGGDDEDQQQPIE

SEQ ID NO: 2207638 - protein, 26 aa, Cryptosporidium hominis
LVVPKLEIRISRYQFDNFKNMINKLS

SEQ ID NO: 2207639 - protein, 18 aa, Cryptosporidium hominis
LVYYFPFGDDKVSKMFLY

SEQ ID NO: 2207640 - protein, 19 aa, Cryptosporidium hominis
LWIYYEHHRLPNLKEKLVF

SEQ ID NO: 2207641 - protein, 17 aa, Cryptosporidium hominis
LWKLIIVSISGILRNER

SEQ ID NO: 2207642 - protein, 17 aa, Cryptosporidium hominis
LWNRIHSLAAKGLHPLI

SEQ ID NO: 2207643 - protein, 20 aa, Cryptosporidium hominis
LWSHMVIPLLYQGDRAPQNL

SEQ ID NO: 2207644 - protein, 20 aa, Cryptosporidium hominis
LYDIMKHYIVLGTLKVIATL

SEQ ID NO: 2207645 - protein, 18 aa, Cryptosporidium hominis
LYDKLFIHLIDAKIWHGP

SEQ ID NO: 2207646 - protein, 19 aa, Cryptosporidium hominis
LYDLHNFQDSSCLRISILS

SEQ ID NO: 2207647 - protein, 23 aa, Cryptosporidium hominis
LYFLEQFRKVCLGDYAKQFIQPE

SEQ ID NO: 2207648 - protein, 20 aa, Cryptosporidium hominis
LYFNGLRPRPATLAQKQNEI

SEQ ID NO: 2207649 - protein, 23 aa, Cryptosporidium hominis
LYGKSDIFSIVIIPDCEDNELID

SEQ ID NO: 2207650 - protein, 36 aa, Cryptosporidium hominis
LYKLDYKLKFLRRMLRKDKKMIIQIHALGYLVNTIK

SEQ ID NO: 2207651 - protein, 19 aa, Cryptosporidium hominis
LYLLCSIFVGSSHSEEVPA

SEQ ID NO: 2207652 - protein, 20 aa, Cryptosporidium hominis
LYNSALRKGWFLPQNIPVAN

SEQ ID NO: 2207653 - protein, 24 aa, Cryptosporidium hominis
LYTGFRFIASVLLKRQEIFRLEDS

SEQ ID NO: 2207654 - protein, 23 aa, Cryptosporidium hominis
LYVKPKAGLVLSNYQLPDGSQKL

SEQ ID NO: 2207655 - protein, 17 aa, Cryptosporidium hominis
LYVSKEFNNKCENIKSY

SEQ ID NO: 2207656 - protein, 20 aa, Cryptosporidium hominis
MAALTRPSSPNVVYSQNNVA

SEQ ID NO: 2207657 - protein, 17 aa, Cryptosporidium hominis
MAEEVTYLLNIASYIAV

SEQ ID NO: 2207658 - protein, 21 aa, Cryptosporidium hominis
MASFARGYSRYVLETVSLAVS

SEQ ID NO: 2207659 - protein, 20 aa, Cryptosporidium hominis
MCISEFDLSISSKYWDPVYF

SEQ ID NO: 2207660 - protein, 23 aa, Cryptosporidium hominis
MDDKGGSMFDVFASKAEGAEGGD

SEQ ID NO: 2207661 - protein, 24 aa, Cryptosporidium hominis
MDFALPLNCLAKLVVVKSQGEKVV

SEQ ID NO: 2207662 - protein, 31 aa, Cryptosporidium hominis
MDKGDCLHRCNSRCINMWLGDGQCDPNCDTI

SEQ ID NO: 2207663 - protein, 25 aa, Cryptosporidium hominis
MDLEIGEIFVNFDFSLLSNGDFIDS

SEQ ID NO: 2207664 - protein, 23 aa, Cryptosporidium hominis
MEFAEKYLFFPGKVETIDIIVDC

SEQ ID NO: 2207665 - protein, 21 aa, Cryptosporidium hominis
MGAKHTSSCIVDFQPVNATHM

SEQ ID NO: 2207666 - protein, 24 aa, Cryptosporidium hominis
MHFGMAPFFSGMLMSYTLQDVIGS

SEQ ID NO: 2207667 - protein, 24 aa, Cryptosporidium hominis
MIAKCARLIINAHLSNNSVDYLSY

SEQ ID NO: 2207668 - protein, 18 aa, Cryptosporidium hominis
MINIFKAQFSEFIDYEGL

SEQ ID NO: 2207669 - protein, 25 aa, Cryptosporidium hominis
MIPSIWYLELIHCMHFGMAPFFSGM

SEQ ID NO: 2207670 - protein, 18 aa, Cryptosporidium hominis
MKDKLGVKPEDETIKRVD

SEQ ID NO: 2207671 - protein, 20 aa, Cryptosporidium hominis
MKGERFLGIICDARDYKPIN

SEQ ID NO: 2207672 - protein, 17 aa, Cryptosporidium hominis
MKLAEAIARGSDVEDPL

SEQ ID NO: 2207673 - protein, 22 aa, Cryptosporidium hominis
MKPASVDCPIGFSRQGSQCVKI

SEQ ID NO: 2207674 - protein, 17 aa, Cryptosporidium hominis
MKRLKMYLYPSFDKKPK

SEQ ID NO: 2207675 - protein, 19 aa, Cryptosporidium hominis
MKVSVAIKSYFRGVFKIGR

SEQ ID NO: 2207676 - protein, 22 aa, Cryptosporidium hominis
MLESAFSFGIGCGYYQDPDNLA

SEQ ID NO: 2207677 - protein, 21 aa, Cryptosporidium hominis
MLNSRSSIVLDKLRQKFPNCP

SEQ ID NO: 2207678 - protein, 24 aa, Cryptosporidium hominis
MLYDLCNQIKEAIMFLSDSIDEFS

SEQ ID NO: 2207679 - protein, 19 aa, Cryptosporidium hominis
MNAKRFDKELDIEKEEEVE

SEQ ID NO: 2207680 - protein, 25 aa, Cryptosporidium hominis
MNFAILPKWRDSWQDEIRKPSPLDE

SEQ ID NO: 2207681 - protein, 19 aa, Cryptosporidium hominis
MNFMLKKSIIKLCSIVVNS

SEQ ID NO: 2207682 - protein, 26 aa, Cryptosporidium hominis
MNHCRSSGISFLLSRPVTKLLEQSIV

SEQ ID NO: 2207683 - protein, 34 aa, Cryptosporidium hominis
MNICLLSCQLFYILHCCDIPEFFEDRIGPFMESF

SEQ ID NO: 2207684 - protein, 23 aa, Cryptosporidium hominis
MNNNFKLSFTFDVKFEGSELKVI

SEQ ID NO: 2207685 - protein, 22 aa, Cryptosporidium hominis
MPEIDPKFPRNFVIYTEDVPKK

SEQ ID NO: 2207686 - protein, 32 aa, Cryptosporidium hominis
MPPMKRPQAPLIYRCRFSGPDLLKNSNLEHFI

SEQ ID NO: 2207687 - protein, 23 aa, Cryptosporidium hominis
MPRTQRGPSDWGYTTTAINGRTK

SEQ ID NO: 2207688 - protein, 18 aa, Cryptosporidium hominis
MRELMKIGTQFTSEIAQG

SEQ ID NO: 2207689 - protein, 19 aa, Cryptosporidium hominis
MRNALCLDPDLRLVKIPGV

SEQ ID NO: 2207690 - protein, 17 aa, Cryptosporidium hominis
MSIKIKELHVIYETLTI

SEQ ID NO: 2207691 - protein, 30 aa, Cryptosporidium hominis
MSKCELINSIGIWWCQKALPQLITDKETAY

SEQ ID NO: 2207692 - protein, 22 aa, Cryptosporidium hominis
MSSLKPVYVFIHGGLYLFGSSN

SEQ ID NO: 2207693 - protein, 25 aa, Cryptosporidium hominis
MSSQKYPSLDLHSGYGQSKVQSSTG

SEQ ID NO: 2207694 - protein, 18 aa, Cryptosporidium hominis
MTENCVGALSSLLELHLP

SEQ ID NO: 2207695 - protein, 24 aa, Cryptosporidium hominis
MTNNLRSVVSFCRDAALSKDARDK

SEQ ID NO: 2207696 - protein, 22 aa, Cryptosporidium hominis
MTPIKNIICDSVSLQKSLQKFQ

SEQ ID NO: 2207697 - protein, 17 aa, Cryptosporidium hominis
MTRGYKDLRGVKELDGG

SEQ ID NO: 2207698 - protein, 25 aa, Cryptosporidium hominis
MYLGMAPKFFGMVFSYSLQDIVGAA

SEQ ID NO: 2207699 - protein, 25 aa, Cryptosporidium hominis
NAAPELMSSLGFNKPNFPFTIIDVA

SEQ ID NO: 2207700 - protein, 19 aa, Cryptosporidium hominis
NAGGLRRSYFNNLENVEST

SEQ ID NO: 2207701 - protein, 18 aa, Cryptosporidium hominis
NAGWKFDKKLKIWVRGNN

SEQ ID NO: 2207702 - protein, 17 aa, Cryptosporidium hominis
NAIFEEWMDLISNTDLS

SEQ ID NO: 2207703 - protein, 17 aa, Cryptosporidium hominis
NALGLICTGMEDGNMSL

SEQ ID NO: 2207704 - protein, 18 aa, Cryptosporidium hominis
NALLPGERYNLYTSLSKK

SEQ ID NO: 2207705 - protein, 29 aa, Cryptosporidium hominis
NCFYDSVYEMCLFDCTLLNKKDACEEYLE

SEQ ID NO: 2207706 - protein, 18 aa, Cryptosporidium hominis
NCQVKSIISGDCYSCCLT

SEQ ID NO: 2207707 - protein, 24 aa, Cryptosporidium hominis
NCSSNFDFYFPLRPYTMVGNLIDD

SEQ ID NO: 2207708 - protein, 17 aa, Cryptosporidium hominis
NCTGRHALSEGCPCSKN

SEQ ID NO: 2207709 - protein, 29 aa, Cryptosporidium hominis
NDLLTLRKLRIIPGIIFRVKLSGSPIEPS

SEQ ID NO: 2207710 - protein, 23 aa, Cryptosporidium hominis
NDLMYKWRLLSNDIPVYEISVFQ

SEQ ID NO: 2207711 - protein, 17 aa, Cryptosporidium hominis
NDLSLLNSFPCPFSKVL

SEQ ID NO: 2207712 - protein, 18 aa, Cryptosporidium hominis
NDMSARVPSEYIREKSRS

SEQ ID NO: 2207713 - protein, 20 aa, Cryptosporidium hominis
NDRGLGFVVDFISQAAYPVT

SEQ ID NO: 2207714 - protein, 19 aa, Cryptosporidium hominis
NDSGKLVVFGVDMSGEKEL

SEQ ID NO: 2207715 - protein, 26 aa, Cryptosporidium hominis
NDVEINWKGRVLVIGDIHGDLKSLIT

SEQ ID NO: 2207716 - protein, 20 aa, Cryptosporidium hominis
NEALKKYKTFFVPSTDGRIN

SEQ ID NO: 2207717 - protein, 19 aa, Cryptosporidium hominis
NEIDAGFQITTPGPKFVQN

SEQ ID NO: 2207718 - protein, 17 aa, Cryptosporidium hominis
NEIEFPPSWHFFENHNS

SEQ ID NO: 2207719 - protein, 18 aa, Cryptosporidium hominis
NEIKELYVSKEFNNKCEN

SEQ ID NO: 2207720 - protein, 20 aa, Cryptosporidium hominis
NEIPNVGGIPSFTQDYDQWI

SEQ ID NO: 2207721 - protein, 23 aa, Cryptosporidium hominis
NEKEFTEDFMFDHSRDVRAVKIQ

SEQ ID NO: 2207722 - protein, 20 aa, Cryptosporidium hominis
NEKLAWSLVENMFSEDSVER

SEQ ID NO: 2207723 - protein, 23 aa, Cryptosporidium hominis
NELLQVFTSLGFQTWQVVSQNSS

SEQ ID NO: 2207724 - protein, 31 aa, Cryptosporidium hominis
NELRLRKLQFLEMFSRGGLESRAKPEHCEPG

SEQ ID NO: 2207725 - protein, 25 aa, Cryptosporidium hominis
NERNRLESNLAFVLQIGTSIWGSNK

SEQ ID NO: 2207726 - protein, 23 aa, Cryptosporidium hominis
NETRDSLDFACKIMDNIRKYTRL

SEQ ID NO: 2207727 - protein, 17 aa, Cryptosporidium hominis
NEVPGGFYSHGETKFVP

SEQ ID NO: 2207728 - protein, 25 aa, Cryptosporidium hominis
NEVSGELWIPFAISQIIYRKSKVLM

SEQ ID NO: 2207729 - protein, 17 aa, Cryptosporidium hominis
NEYNSAVPFGWTNIPLG

SEQ ID NO: 2207730 - protein, 25 aa, Cryptosporidium hominis
NEYRIAEDYYRYALNSMKMAKDDWE

SEQ ID NO: 2207731 - protein, 17 aa, Cryptosporidium hominis
NFELIYIIIKFSLITEI

SEQ ID NO: 2207732 - protein, 23 aa, Cryptosporidium hominis
NFPEVPGKIKSFVDFNGDKFTDI

SEQ ID NO: 2207733 - protein, 18 aa, Cryptosporidium hominis
NFQIRTCNHVIWTSEVLL

SEQ ID NO: 2207734 - protein, 27 aa, Cryptosporidium hominis
NFSPAKTLFGWREVLFDQAMESIGKYD

SEQ ID NO: 2207735 - protein, 28 aa, Cryptosporidium hominis
NFVSIFVPRLIDFTLKGKQGLVTLIYNE

SEQ ID NO: 2207736 - protein, 18 aa, Cryptosporidium hominis
NGCSCTTAKCTGGECTPA

SEQ ID NO: 2207737 - protein, 20 aa, Cryptosporidium hominis
NGDEAMAFGAAFVAANQSAT

SEQ ID NO: 2207738 - protein, 24 aa, Cryptosporidium hominis
NGERLSLLSGFSIIGLRSAGGCGF

SEQ ID NO: 2207739 - protein, 20 aa, Cryptosporidium hominis
NGLIKQFLSDVVWGELDFLI

SEQ ID NO: 2207740 - protein, 19 aa, Cryptosporidium hominis
NGPTKYYGRHKMNIYEDEY

SEQ ID NO: 2207741 - protein, 25 aa, Cryptosporidium hominis
NGQVVMWRRLRGYNLSQLNIVADTE

SEQ ID NO: 2207742 - protein, 28 aa, Cryptosporidium hominis
NGSLIPSEFWWKKVKGVKGKSKEKNIFK

SEQ ID NO: 2207743 - protein, 21 aa, Cryptosporidium hominis
NHGSTNMCISEFDLSISSKYW

SEQ ID NO: 2207744 - protein, 25 aa, Cryptosporidium hominis
NHSKLLWKATIPINEFIIEDSNEIK

SEQ ID NO: 2207745 - protein, 28 aa, Cryptosporidium hominis
NIDFQYLLVRLCHLFSFRIECLATNVYN

SEQ ID NO: 2207746 - protein, 20 aa, Cryptosporidium hominis
NIECPAYMNLTFASTGSPIC

SEQ ID NO: 2207747 - protein, 28 aa, Cryptosporidium hominis
NIGCSMLSDSVWREDLCTSNISPSKQES

SEQ ID NO: 2207748 - protein, 18 aa, Cryptosporidium hominis
NIGLNYLATRTFTRKDLT

SEQ ID NO: 2207749 - protein, 24 aa, Cryptosporidium hominis
NIIILCLYLGILKCVNSHISNEIQ

SEQ ID NO: 2207750 - protein, 18 aa, Cryptosporidium hominis
NIIKLGFGADSCFAIDAN

SEQ ID NO: 2207751 - protein, 24 aa, Cryptosporidium hominis
NIKLELLPDMAFLIGDQRKRRGIP

SEQ ID NO: 2207752 - protein, 26 aa, Cryptosporidium hominis
NIPKRFNVIQQLCWDLGGHMGAANTQ

SEQ ID NO: 2207753 - protein, 23 aa, Cryptosporidium hominis
NISKLAITEGFIFSPKSLNLIEC

SEQ ID NO: 2207754 - protein, 18 aa, Cryptosporidium hominis
NIVDFEFQIPCTFYSPMI

SEQ ID NO: 2207755 - protein, 33 aa, Cryptosporidium hominis
NIYEEGKLAGGLAWALGVGKYVCNSKSAFSSLI

SEQ ID NO: 2207756 - protein, 21 aa, Cryptosporidium hominis
NKAYGIEDFEIIAARIDPTNL

SEQ ID NO: 2207757 - protein, 25 aa, Cryptosporidium hominis
NKDFVSYVDFDFCYNRVESGSLQEN

SEQ ID NO: 2207758 - protein, 31 aa, Cryptosporidium hominis
NKEFKPVIKVDFLSPSFCDWRVDESKNITSL

SEQ ID NO: 2207759 - protein, 17 aa, Cryptosporidium hominis
NKEIILNLENKWPNITN

SEQ ID NO: 2207760 - protein, 24 aa, Cryptosporidium hominis
NKESFCRYVSLVLEDDFFEKSILF

SEQ ID NO: 2207761 - protein, 22 aa, Cryptosporidium hominis
NKFKSNALLLSFLTSNIPQYLR

SEQ ID NO: 2207762 - protein, 17 aa, Cryptosporidium hominis
NKGKRIEYRKTLLTNSG

SEQ ID NO: 2207763 - protein, 18 aa, Cryptosporidium hominis
NKIEFPLDMKNCQVKSII

SEQ ID NO: 2207764 - protein, 18 aa, Cryptosporidium hominis
NKKPKGKCVHCSHCSSTK

SEQ ID NO: 2207765 - protein, 21 aa, Cryptosporidium hominis
NKLRILYKIDQSNWFRLTEVS

SEQ ID NO: 2207766 - protein, 26 aa, Cryptosporidium hominis
NKLRKRLRRIPNFFRNLFRRNKNKAK

SEQ ID NO: 2207767 - protein, 23 aa, Cryptosporidium hominis
NKRGGFQCTCPKGFQLGMDGKVC

SEQ ID NO: 2207768 - protein, 26 aa, Cryptosporidium hominis
NKRVYEKFVPGRGFDKILQKKLINTY

SEQ ID NO: 2207769 - protein, 25 aa, Cryptosporidium hominis
NKRYAGQFLLIILLFVFYKLAFSSE

SEQ ID NO: 2207770 - protein, 20 aa, Cryptosporidium hominis
NLADICSILKGYQDLESRVR

SEQ ID NO: 2207771 - protein, 18 aa, Cryptosporidium hominis
NLCCKTLASYKWMVKNWP

SEQ ID NO: 2207772 - protein, 19 aa, Cryptosporidium hominis
NLCLFAFPGKDNFSGEKYP

SEQ ID NO: 2207773 - protein, 19 aa, Cryptosporidium hominis
NLDRLRFEEEVAYQDNTIR

SEQ ID NO: 2207774 - protein, 19 aa, Cryptosporidium hominis
NLEFKRWGECTSEESQPNK

SEQ ID NO: 2207775 - protein, 17 aa, Cryptosporidium hominis
NLKWRHVSNSNGIYQVY

SEQ ID NO: 2207776 - protein, 21 aa, Cryptosporidium hominis
NLLKLIQSVLFDYESSLTPSR

SEQ ID NO: 2207777 - protein, 18 aa, Cryptosporidium hominis
NLLLKNDVLYIFYGDKNG

SEQ ID NO: 2207778 - protein, 19 aa, Cryptosporidium hominis
NLLSPGFIFMVLLRDDIEH

SEQ ID NO: 2207779 - protein, 21 aa, Cryptosporidium hominis
NLPGCKVHLPIIGDKDRHDIV

SEQ ID NO: 2207780 - protein, 25 aa, Cryptosporidium hominis
NLQLKESIFSTGLRIPNYNNHSEIC

SEQ ID NO: 2207781 - protein, 21 aa, Cryptosporidium hominis
NLSLIPYKIFNPIMNVTSLSG

SEQ ID NO: 2207782 - protein, 23 aa, Cryptosporidium hominis
NLWRYKLTEYISFFLDDESEEGL

SEQ ID NO: 2207783 - protein, 18 aa, Cryptosporidium hominis
NLWSFNSIMMLLHSSRNN

SEQ ID NO: 2207784 - protein, 22 aa, Cryptosporidium hominis
NMDGLRKANAMFRSFSSHAYED

SEQ ID NO: 2207785 - protein, 24 aa, Cryptosporidium hominis
NMGNSEWRSASNLSPEQQIVYTAF

SEQ ID NO: 2207786 - protein, 17 aa, Cryptosporidium hominis
NMKNVFHPSEWEYIQKD

SEQ ID NO: 2207787 - protein, 24 aa, Cryptosporidium hominis
NNENSRWTWNRIEKPIFRTNTAKP

SEQ ID NO: 2207788 - protein, 26 aa, Cryptosporidium hominis
NNFQECLEFSKILFDYCRRSTNQTMD

SEQ ID NO: 2207789 - protein, 24 aa, Cryptosporidium hominis
NNGPKFKICLNKPDSFIVLASGAI

SEQ ID NO: 2207790 - protein, 19 aa, Cryptosporidium hominis
NNIFSRLVGLRIRCGSKWR

SEQ ID NO: 2207791 - protein, 21 aa, Cryptosporidium hominis
NNLIPLQFKLMIACPYAISNH

SEQ ID NO: 2207792 - protein, 23 aa, Cryptosporidium hominis
NNLKSAPIFTYRKDHITNYKTRG

SEQ ID NO: 2207793 - protein, 23 aa, Cryptosporidium hominis
NNNMKCPFNIIIPAPDFFSYDII

SEQ ID NO: 2207794 - protein, 25 aa, Cryptosporidium hominis
NNNRIPLPIMVRYGLTEDGKLAAFS

SEQ ID NO: 2207795 - protein, 20 aa, Cryptosporidium hominis
NNPKLIPGMIKIGEDLKFSP

SEQ ID NO: 2207796 - protein, 27 aa, Cryptosporidium hominis
NNQPLIYKFCLNSWLGDGYCDEDCNNE

SEQ ID NO: 2207797 - protein, 22 aa, Cryptosporidium hominis
NNSLPIGKIRNIWKGLQSTVLK

SEQ ID NO: 2207798 - protein, 21 aa, Cryptosporidium hominis
NNYLFYYPMDPFWNYANNSSN

SEQ ID NO: 2207799 - protein, 32 aa, Cryptosporidium hominis
NPAIKLYSFFRIKRTFISHILFGLASKYRIIF

SEQ ID NO: 2207800 - protein, 28 aa, Cryptosporidium hominis
NPDLKLLWRYISPHLIEIDMGGSRPKLQ

SEQ ID NO: 2207801 - protein, 19 aa, Cryptosporidium hominis
NPEVEVISLSPSVTPVEYI

SEQ ID NO: 2207802 - protein, 20 aa, Cryptosporidium hominis
NQCPIFFELKAPYTTLESIR

SEQ ID NO: 2207803 - protein, 23 aa, Cryptosporidium hominis
NQDIKRLVGYQHKMINSSSLYIV

SEQ ID NO: 2207804 - protein, 22 aa, Cryptosporidium hominis
NQGFSTYRIFNLRNENKQLLVK

SEQ ID NO: 2207805 - protein, 19 aa, Cryptosporidium hominis
NQIKWRFEKDHERYLSESQ

SEQ ID NO: 2207806 - protein, 25 aa, Cryptosporidium hominis
NQIPVPKWEGLAIAGWNNMKSDEKR

SEQ ID NO: 2207807 - protein, 18 aa, Cryptosporidium hominis
NQLIWKNYFESIYSTAFE

SEQ ID NO: 2207808 - protein, 17 aa, Cryptosporidium hominis
NQLSCSVADSFPWGSWS

SEQ ID NO: 2207809 - protein, 23 aa, Cryptosporidium hominis
NQPRAVFSYKLVKQTIIEMLGTN

SEQ ID NO: 2207810 - protein, 24 aa, Cryptosporidium hominis
NRDEVQVGLFLGSPCIYENGNSGI

SEQ ID NO: 2207811 - protein, 24 aa, Cryptosporidium hominis
NRLKECYGEEICHVSLLDIFIREN

SEQ ID NO: 2207812 - protein, 22 aa, Cryptosporidium hominis
NRMKRSEFWARREIEREIIGLN

SEQ ID NO: 2207813 - protein, 21 aa, Cryptosporidium hominis
NRNAKGLPFFPDYKEIDILQE

SEQ ID NO: 2207814 - protein, 26 aa, Cryptosporidium hominis
NRQKLLLLSFLFKYSMNLSLADSNSD

SEQ ID NO: 2207815 - protein, 20 aa, Cryptosporidium hominis
NRYIQIFGMIGIGNHGISCN

SEQ ID NO: 2207816 - protein, 18 aa, Cryptosporidium hominis
NSEFGRLGLIESNIDSEV

SEQ ID NO: 2207817 - protein, 18 aa, Cryptosporidium hominis
NSEIFFLALDLFATYYLE

SEQ ID NO: 2207818 - protein, 17 aa, Cryptosporidium hominis
NSGLRLNDFYSSKFENE

SEQ ID NO: 2207819 - protein, 23 aa, Cryptosporidium hominis
NSKFKIKLPPVIKYHDICNHVAK

SEQ ID NO: 2207820 - protein, 23 aa, Cryptosporidium hominis
NSKKEIFSSFMVDSKPLSINETL

SEQ ID NO: 2207821 - protein, 18 aa, Cryptosporidium hominis
NSLAILKNRGFWYEDTVS

SEQ ID NO: 2207822 - protein, 20 aa, Cryptosporidium hominis
NSNSGLILFHLIINDNGLFL

SEQ ID NO: 2207823 - protein, 19 aa, Cryptosporidium hominis
NSQFIGISILKLQANAPSP

SEQ ID NO: 2207824 - protein, 21 aa, Cryptosporidium hominis
NSRDLMCILEVGLQPDVIPTG

SEQ ID NO: 2207825 - protein, 25 aa, Cryptosporidium hominis
NSVMILYIFWRLFEFSYRNFDKALP

SEQ ID NO: 2207826 - protein, 25 aa, Cryptosporidium hominis
NTFHFGGGGPFGFGGGGGGRRQGGN

SEQ ID NO: 2207827 - protein, 25 aa, Cryptosporidium hominis
NTIGGYRCGCYKGFRLNLTGPEENR

SEQ ID NO: 2207828 - protein, 24 aa, Cryptosporidium hominis
NTILRECAIIELMQNVMMVHNDNP

SEQ ID NO: 2207829 - protein, 19 aa, Cryptosporidium hominis
NTNSTLWRIYPKDFDKLNE

SEQ ID NO: 2207830 - protein, 28 aa, Cryptosporidium hominis
NTRLLLKAECQWSPWRRETGCSSTCDSG

SEQ ID NO: 2207831 - protein, 25 aa, Cryptosporidium hominis
NTRWKCLKITVVKDYRYWVFSCNGE

SEQ ID NO: 2207832 - protein, 20 aa, Cryptosporidium hominis
NTSISRGWWILSRKLIIKTH

SEQ ID NO: 2207833 - protein, 22 aa, Cryptosporidium hominis
NTSSNFCWEYSGNVMYLPITSA

SEQ ID NO: 2207834 - protein, 26 aa, Cryptosporidium hominis
NTVMIPHSWTILREEYIPIIFFDIYA

SEQ ID NO: 2207835 - protein, 19 aa, Cryptosporidium hominis
NVCTPKGYPISVAGLQCNG

SEQ ID NO: 2207836 - protein, 23 aa, Cryptosporidium hominis
NVCVEVLKFSHDYFYDEIPEISL

SEQ ID NO: 2207837 - protein, 20 aa, Cryptosporidium hominis
NVEWLCFKPKTSITQIQAAT

SEQ ID NO: 2207838 - protein, 19 aa, Cryptosporidium hominis
NVFHPSEWEYIQKDISKFM

SEQ ID NO: 2207839 - protein, 18 aa, Cryptosporidium hominis
NVITEFRRFMGSTDPKKS

SEQ ID NO: 2207840 - protein, 21 aa, Cryptosporidium hominis
NVKPRPPYPLPQTPQLYPSPS

SEQ ID NO: 2207841 - protein, 18 aa, Cryptosporidium hominis
NVLPEFISGTPLEPLPSS

SEQ ID NO: 2207842 - protein, 21 aa, Cryptosporidium hominis
NVRTSWVIALERAFNETGTFH

SEQ ID NO: 2207843 - protein, 26 aa, Cryptosporidium hominis
NVVPEPRYIPTVKIYDSQIEDLSFPE

SEQ ID NO: 2207844 - protein, 28 aa, Cryptosporidium hominis
NYLKKSKISWLIERCFIYTKKKDINNGI

SEQ ID NO: 2207845 - protein, 19 aa, Cryptosporidium hominis
NYLKSFAIELSKLKLDEIK

SEQ ID NO: 2207846 - protein, 17 aa, Cryptosporidium hominis
NYVGAIFTLNKAKITYQ

SEQ ID NO: 2207847 - protein, 24 aa, Cryptosporidium hominis
PADPKHGFVPLYILDNSTETAALP

SEQ ID NO: 2207848 - protein, 23 aa, Cryptosporidium hominis
PAEVNCPEGFEWLSETLNCQSQE

SEQ ID NO: 2207849 - protein, 20 aa, Cryptosporidium hominis
PAGSIPRGHKCIVITNVPII

SEQ ID NO: 2207850 - protein, 23 aa, Cryptosporidium hominis
PAKECPPNFILQGLQCIQTSSAP

SEQ ID NO: 2207851 - protein, 20 aa, Cryptosporidium hominis
PALIEDIQFPPAEYDVIEVQ

SEQ ID NO: 2207852 - protein, 19 aa, Cryptosporidium hominis
PAPFRLAILAMLVSDFVTD

SEQ ID NO: 2207853 - protein, 23 aa, Cryptosporidium hominis
PAQRSRPSTLAWVPNQPTQIVVG

SEQ ID NO: 2207854 - protein, 17 aa, Cryptosporidium hominis
PARCVGGKCGRVHCDGC

SEQ ID NO: 2207855 - protein, 21 aa, Cryptosporidium hominis
PATECSECPDSMFPEKSEDGE

SEQ ID NO: 2207856 - protein, 18 aa, Cryptosporidium hominis
PATFELVWGKYFQLIYET

SEQ ID NO: 2207857 - protein, 17 aa, Cryptosporidium hominis
PCEFKRARCRDPSLRRA

SEQ ID NO: 2207858 - protein, 26 aa, Cryptosporidium hominis
PCHITCPREYAPVCATDAETYENLCL

SEQ ID NO: 2207859 - protein, 21 aa, Cryptosporidium hominis
PCNTNPCGDCMVYLEDSQLNK

SEQ ID NO: 2207860 - protein, 20 aa, Cryptosporidium hominis
PCQFMHPITIQFIGSYPKSG

SEQ ID NO: 2207861 - protein, 18 aa, Cryptosporidium hominis
PDASQREFDCNWQIQNGL

SEQ ID NO: 2207862 - protein, 23 aa, Cryptosporidium hominis
PDDKIKGLIRYFKFNKGSYGEVW

SEQ ID NO: 2207863 - protein, 23 aa, Cryptosporidium hominis
PDIIQRTALPIKQSFWRPLNQQD

SEQ ID NO: 2207864 - protein, 18 aa, Cryptosporidium hominis
PDKYFSFRGAEEHSIDDL

SEQ ID NO: 2207865 - protein, 20 aa, Cryptosporidium hominis
PDLRISGKLYSPGEGSLVDQ

SEQ ID NO: 2207866 - protein, 18 aa, Cryptosporidium hominis
PDVLCLLSTCNEDYTDGP

SEQ ID NO: 2207867 - protein, 17 aa, Cryptosporidium hominis
PEDEWDAVVSWIQENAN

SEQ ID NO: 2207868 - protein, 17 aa, Cryptosporidium hominis
PEDLPEWAHTLSSVWML

SEQ ID NO: 2207869 - protein, 22 aa, Cryptosporidium hominis
PEECKLPCISIIKFPSVDEGKM

SEQ ID NO: 2207870 - protein, 18 aa, Cryptosporidium hominis
PEEKPDFTYARKVFELVV

SEQ ID NO: 2207871 - protein, 20 aa, Cryptosporidium hominis
PEFISGTPLEPLPSSFDYRL

SEQ ID NO: 2207872 - protein, 17 aa, Cryptosporidium hominis
PEGLVSIGFLERKANYD

SEQ ID NO: 2207873 - protein, 17 aa, Cryptosporidium hominis
PEGTAKESLKFKNNKEL

SEQ ID NO: 2207874 - protein, 21 aa, Cryptosporidium hominis
PEIRLLQLYTILNKYAVQKGF

SEQ ID NO: 2207875 - protein, 19 aa, Cryptosporidium hominis
PEIWTMWKAIITQKDRDLN

SEQ ID NO: 2207876 - protein, 21 aa, Cryptosporidium hominis
PEKECPTGFVLIGKQCTQTTQ

SEQ ID NO: 2207877 - protein, 20 aa, Cryptosporidium hominis
PELVHAYKLNDGFFDIFAFY

SEQ ID NO: 2207878 - protein, 25 aa, Cryptosporidium hominis
PENIDLRLNVVYPVGHFLGIIEANK

SEQ ID NO: 2207879 - protein, 17 aa, Cryptosporidium hominis
PEVTHRGLIGEILSQIE

SEQ ID NO: 2207880 - protein, 22 aa, Cryptosporidium hominis
PEYCSKIPMIPMIPTTVEQIFI

SEQ ID NO: 2207881 - protein, 17 aa, Cryptosporidium hominis
PEYIKLHYILENSIQAF

SEQ ID NO: 2207882 - protein, 26 aa, Cryptosporidium hominis
PEYNELFIKWLKRCNESKVIHQKYQL

SEQ ID NO: 2207883 - protein, 18 aa, Cryptosporidium hominis
PEYSEIKEYFPGPVERRQ

SEQ ID NO: 2207884 - protein, 25 aa, Cryptosporidium hominis
PFDLFSMGFGNLFGMGSGRGDGERY

SEQ ID NO: 2207885 - protein, 25 aa, Cryptosporidium hominis
PFLKSLCYSCWDLMRVYDRYFAEKY

SEQ ID NO: 2207886 - protein, 17 aa, Cryptosporidium hominis
PFLSLAYIFSREMIKDK

SEQ ID NO: 2207887 - protein, 21 aa, Cryptosporidium hominis
PFWTSCRHLLQLIGQLDPKTY

SEQ ID NO: 2207888 - protein, 18 aa, Cryptosporidium hominis
PGIFPIKYLRNLGYHVDG

SEQ ID NO: 2207889 - protein, 19 aa, Cryptosporidium hominis
PGLNIFKQFGRGFPTGGYE

SEQ ID NO: 2207890 - protein, 20 aa, Cryptosporidium hominis
PGYLDRFMDRYGFTEDEYIA

SEQ ID NO: 2207891 - protein, 19 aa, Cryptosporidium hominis
PHDNCVKEGDSLYLELYRD

SEQ ID NO: 2207892 - protein, 30 aa, Cryptosporidium hominis
PHFKRPRKKVRFDFELNQEYSLEDIQRKDR

SEQ ID NO: 2207893 - protein, 18 aa, Cryptosporidium hominis
PHGFALAGEECISMKEFA

SEQ ID NO: 2207894 - protein, 19 aa, Cryptosporidium hominis
PHLDGRHVVFGKLVDDESK

SEQ ID NO: 2207895 - protein, 27 aa, Cryptosporidium hominis
PHLHMFSSQFYLYWSLSTPHLGCISNN

SEQ ID NO: 2207896 - protein, 25 aa, Cryptosporidium hominis
PIDKLKQIINWDGPVKFTPTQKRGP

SEQ ID NO: 2207897 - protein, 25 aa, Cryptosporidium hominis
PIDPNHGFIPLFMVENFTETAAFPA

SEQ ID NO: 2207898 - protein, 24 aa, Cryptosporidium hominis
PILKKSALNKKGWFSNIDIKVQEK

SEQ ID NO: 2207899 - protein, 25 aa, Cryptosporidium hominis
PINTDRFKWYVAIGNDLSFTARYYV

SEQ ID NO: 2207900 - protein, 29 aa, Cryptosporidium hominis
PIPEIPGPPSRRGSGPISDRVIPISTDEI

SEQ ID NO: 2207901 - protein, 35 aa, Cryptosporidium hominis
PIQSGCRCILEGTKLLVCTCDDFNYHFDVEQGILT

SEQ ID NO: 2207902 - protein, 19 aa, Cryptosporidium hominis
PIRSLLIKACDDALFHEKD

SEQ ID NO: 2207903 - protein, 18 aa, Cryptosporidium hominis
PIVRYMKLLNSYGEYMSN

SEQ ID NO: 2207904 - protein, 17 aa, Cryptosporidium hominis
PKAGTHLATVQLDVLTK

SEQ ID NO: 2207905 - protein, 18 aa, Cryptosporidium hominis
PKKFPGLATLLSELLFYD

SEQ ID NO: 2207906 - protein, 24 aa, Cryptosporidium hominis
PKLLEEIRSGVKLKPTGSSASSEI

SEQ ID NO: 2207907 - protein, 22 aa, Cryptosporidium hominis
PKLRSEPIPVYYDNDTVFKLVG

SEQ ID NO: 2207908 - protein, 24 aa, Cryptosporidium hominis
PKNRPDGLPSISFIGIENEVMPLH

SEQ ID NO: 2207909 - protein, 25 aa, Cryptosporidium hominis
PKNVLKEKIELFKLTGTVISIPLPL

SEQ ID NO: 2207910 - protein, 24 aa, Cryptosporidium hominis
PKYSSDFIPRIYLLSRSIPKENFY

SEQ ID NO: 2207911 - protein, 19 aa, Cryptosporidium hominis
PLCKSYRIEIAKSPIISIV

SEQ ID NO: 2207912 - protein, 22 aa, Cryptosporidium hominis
PLEGIVKGYCLFRSVSDEAKED

SEQ ID NO: 2207913 - protein, 22 aa, Cryptosporidium hominis
PLFEDEWRAIIDFMSDPSSPIQ

SEQ ID NO: 2207914 - protein, 17 aa, Cryptosporidium hominis
PLFFDMENCFKEDDEDL

SEQ ID NO: 2207915 - protein, 22 aa, Cryptosporidium hominis
PLFKEIFQAPKFSLRNTPKGVV

SEQ ID NO: 2207916 - protein, 18 aa, Cryptosporidium hominis
PLFTEASNLKWRHVSNSN

SEQ ID NO: 2207917 - protein, 23 aa, Cryptosporidium hominis
PLKKNKECEHCILKGDKNIKTQV

SEQ ID NO: 2207918 - protein, 19 aa, Cryptosporidium hominis
PLKMSEFRSLSFIGSPVLM

SEQ ID NO: 2207919 - protein, 18 aa, Cryptosporidium hominis
PLLRVFKSFYSMEKNSNS

SEQ ID NO: 2207920 - protein, 17 aa, Cryptosporidium hominis
PLLSDAIPNEYGTLDKF

SEQ ID NO: 2207921 - protein, 18 aa, Cryptosporidium hominis
PLNEVYTLPEIFSSNKKT

SEQ ID NO: 2207922 - protein, 29 aa, Cryptosporidium hominis
PLSCEESWIGDGWCDKECFSDDCGNDGGD

SEQ ID NO: 2207923 - protein, 25 aa, Cryptosporidium hominis
PLSSPRPSRRKLWGRGNRGGHSHSD

SEQ ID NO: 2207924 - protein, 24 aa, Cryptosporidium hominis
PLWKYKPAEYISFFFTDYSNKSLY

SEQ ID NO: 2207925 - protein, 19 aa, Cryptosporidium hominis
PMCPPGIMTKYDFPKLYKL

SEQ ID NO: 2207926 - protein, 21 aa, Cryptosporidium hominis
PNAISGFYWILPRCAPEPIRV

SEQ ID NO: 2207927 - protein, 24 aa, Cryptosporidium hominis
PNEKIRYFCWYTAKSAYPNDSSFE

SEQ ID NO: 2207928 - protein, 27 aa, Cryptosporidium hominis
PNFIISVGDNFYRWGVSSVDDPIWENM

SEQ ID NO: 2207929 - protein, 17 aa, Cryptosporidium hominis
PNHRYIPLFEVMENNET

SEQ ID NO: 2207930 - protein, 26 aa, Cryptosporidium hominis
PNIPYFNHFCSLSFIKNLKLIRKNAN

SEQ ID NO: 2207931 - protein, 20 aa, Cryptosporidium hominis
PNLCRCYGFSLSSAQDSFSA

SEQ ID NO: 2207932 - protein, 20 aa, Cryptosporidium hominis
PNLLCSISIQGRFISDFYFF

SEQ ID NO: 2207933 - protein, 29 aa, Cryptosporidium hominis
PNQIDGSIALCFLAFIIFLVVKVGGTNNE

SEQ ID NO: 2207934 - protein, 17 aa, Cryptosporidium hominis
PPEKIFVAQKCMISKCN

SEQ ID NO: 2207935 - protein, 23 aa, Cryptosporidium hominis
PPEVPKRTVSLIPGRDPYKKRSG

SEQ ID NO: 2207936 - protein, 24 aa, Cryptosporidium hominis
PPGYYRPQAGVAIRSHGHKASGAS

SEQ ID NO: 2207937 - protein, 17 aa, Cryptosporidium hominis
PPHPIPFTLPDPDYGNS

SEQ ID NO: 2207938 - protein, 23 aa, Cryptosporidium hominis
PPIPGMPVPWPLPTATQQLNSTT

SEQ ID NO: 2207939 - protein, 18 aa, Cryptosporidium hominis
PPKCLIVANGDFSGSSPL

SEQ ID NO: 2207940 - protein, 24 aa, Cryptosporidium hominis
PPKNRITFYGCDWTICEREVENQI

SEQ ID NO: 2207941 - protein, 26 aa, Cryptosporidium hominis
PPKPQYCSTMKLSLNRVGEKGPASQS

SEQ ID NO: 2207942 - protein, 18 aa, Cryptosporidium hominis
PPLPANWRLPPGNESHNR

SEQ ID NO: 2207943 - protein, 17 aa, Cryptosporidium hominis
PPTGFGGFFPMLVPNDK

SEQ ID NO: 2207944 - protein, 21 aa, Cryptosporidium hominis
PPYPIPTPFAYPAPAPYPYLY

SEQ ID NO: 2207945 - protein, 20 aa, Cryptosporidium hominis
PQGFTKLLFAESLYDINEQQ

SEQ ID NO: 2207946 - protein, 18 aa, Cryptosporidium hominis
PQILRLNSMTQPWDHFRD

SEQ ID NO: 2207947 - protein, 20 aa, Cryptosporidium hominis
PQMYRERIISPSFEELDQET

SEQ ID NO: 2207948 - protein, 29 aa, Cryptosporidium hominis
PQRQPCGRCGFGAKCCYQNLCVGRDIGSS

SEQ ID NO: 2207949 - protein, 23 aa, Cryptosporidium hominis
PQSTRFLTYDLLMLQNVGEEPTD

SEQ ID NO: 2207950 - protein, 25 aa, Cryptosporidium hominis
PQTKGRGSLNFALSVQKFAIVVQML

SEQ ID NO: 2207951 - protein, 19 aa, Cryptosporidium hominis
PQYLQRRLSSIDERVALEE

SEQ ID NO: 2207952 - protein, 20 aa, Cryptosporidium hominis
PRASYPISHTSVLVDSKHRY

SEQ ID NO: 2207953 - protein, 23 aa, Cryptosporidium hominis
PRHEYKYAPVLKHSVGVDGSEVT

SEQ ID NO: 2207954 - protein, 21 aa, Cryptosporidium hominis
PRHPFPLPSSPLYIKGKKFGI

SEQ ID NO: 2207955 - protein, 20 aa, Cryptosporidium hominis
PRITCIKGYSIVKESTGTFC

SEQ ID NO: 2207956 - protein, 27 aa, Cryptosporidium hominis
PRNQRKYSFKFSDINGVDKTLKSFCSD

SEQ ID NO: 2207957 - protein, 25 aa, Cryptosporidium hominis
PRVMNEIRYTVLLCGGGLVTMLPIV

SEQ ID NO: 2207958 - protein, 20 aa, Cryptosporidium hominis
PRVRHFRRSLVLLPPEPYQR

SEQ ID NO: 2207959 - protein, 19 aa, Cryptosporidium hominis
PSESPIKMLESELMKLQDL

SEQ ID NO: 2207960 - protein, 26 aa, Cryptosporidium hominis
PSFCSLSIDLCNSVDFSLYTAFSSFN

SEQ ID NO: 2207961 - protein, 19 aa, Cryptosporidium hominis
PSKGLGSGAPRPGRSPKKD

SEQ ID NO: 2207962 - protein, 19 aa, Cryptosporidium hominis
PSKREFLCMEIFNNKEICS

SEQ ID NO: 2207963 - protein, 17 aa, Cryptosporidium hominis
PSLQLWDLRNVSYPFKE

SEQ ID NO: 2207964 - protein, 17 aa, Cryptosporidium hominis
PSNALNMGNSEWRSASN

SEQ ID NO: 2207965 - protein, 24 aa, Cryptosporidium hominis
PSNLRSEMIFEIKATKTLDELRNT

SEQ ID NO: 2207966 - protein, 18 aa, Cryptosporidium hominis
PSQHWFRTELPDILERRA

SEQ ID NO: 2207967 - protein, 20 aa, Cryptosporidium hominis
PSRLEFISNIGRRFQGKSLN

SEQ ID NO: 2207968 - protein, 25 aa, Cryptosporidium hominis
PSTWYLELIHCMYLGMAPKFFGMVF

SEQ ID NO: 2207969 - protein, 19 aa, Cryptosporidium hominis
PSYRELSIISSRKEKKRPK

SEQ ID NO: 2207970 - protein, 28 aa, Cryptosporidium hominis
PTAKMVPPKPAVRRIFQAPGAQGIIQPT

SEQ ID NO: 2207971 - protein, 17 aa, Cryptosporidium hominis
PTDAWKFGMVRRNGNCE

SEQ ID NO: 2207972 - protein, 18 aa, Cryptosporidium hominis
PTDSPVLLRFETLKKLDK

SEQ ID NO: 2207973 - protein, 30 aa, Cryptosporidium hominis
PTDSSLLGDVWRKLYVDQHIATSSVNEVDA

SEQ ID NO: 2207974 - protein, 17 aa, Cryptosporidium hominis
PTFPFTSNFFLQEEFEL

SEQ ID NO: 2207975 - protein, 17 aa, Cryptosporidium hominis
PTGLITVLFFAVVTYDN

SEQ ID NO: 2207976 - protein, 18 aa, Cryptosporidium hominis
PTLEFSLYNSGIFKGFYD

SEQ ID NO: 2207977 - protein, 17 aa, Cryptosporidium hominis
PTLRRRAAFPATHTDHR

SEQ ID NO: 2207978 - protein, 18 aa, Cryptosporidium hominis
PTRPCTRYSYSGTGTCSI

SEQ ID NO: 2207979 - protein, 17 aa, Cryptosporidium hominis
PTTTIKMTLKFPNTAPV

SEQ ID NO: 2207980 - protein, 23 aa, Cryptosporidium hominis
PVDTRAKYGLVLHPEERLCKEKL

SEQ ID NO: 2207981 - protein, 18 aa, Cryptosporidium hominis
PVKGCPYGFNLNELEQIC

SEQ ID NO: 2207982 - protein, 23 aa, Cryptosporidium hominis
PWKMIPDSMWKHSPFQSFERVVY

SEQ ID NO: 2207983 - protein, 18 aa, Cryptosporidium hominis
PYESLIGIRAWFPNPESK

SEQ ID NO: 2207984 - protein, 20 aa, Cryptosporidium hominis
PYIRLKEEFQQRIDNVYSNI

SEQ ID NO: 2207985 - protein, 24 aa, Cryptosporidium hominis
PYKKKRLTKGLKWKKRKDSKKNED

SEQ ID NO: 2207986 - protein, 22 aa, Cryptosporidium hominis
PYLEIPEVFLFPEDARLKENCI

SEQ ID NO: 2207987 - protein, 17 aa, Cryptosporidium hominis
PYLPQGIVPSPISTTTT

SEQ ID NO: 2207988 - protein, 22 aa, Cryptosporidium hominis
QAIDAICPPEFLDNGKDCVKYS

SEQ ID NO: 2207989 - protein, 18 aa, Cryptosporidium hominis
QAKNRLGKEYQKFKSSQE

SEQ ID NO: 2207990 - protein, 19 aa, Cryptosporidium hominis
QALFYWSIEAEKFLNDYKR

SEQ ID NO: 2207991 - protein, 17 aa, Cryptosporidium hominis
QCDDQSLIFVGFGKCLP

SEQ ID NO: 2207992 - protein, 17 aa, Cryptosporidium hominis
QCDPNCDTIECFYDKGD

SEQ ID NO: 2207993 - protein, 23 aa, Cryptosporidium hominis
QCGEGLKGLLDRQLIPGDPDALE

SEQ ID NO: 2207994 - protein, 17 aa, Cryptosporidium hominis
QCIGQWIKFLIKDQTVS

SEQ ID NO: 2207995 - protein, 19 aa, Cryptosporidium hominis
QCPDGFRLLGDMCQQSTVK

SEQ ID NO: 2207996 - protein, 20 aa, Cryptosporidium hominis
QDCNKEFGCRVERENLRTIA

SEQ ID NO: 2207997 - protein, 20 aa, Cryptosporidium hominis
QDQYLRRFISSYDQVLKELK

SEQ ID NO: 2207998 - protein, 24 aa, Cryptosporidium hominis
QDVYKKFGGIFWARNIPRVSITNM

SEQ ID NO: 2207999 - protein, 20 aa, Cryptosporidium hominis
QEDYMVISFIIFLSKRLDLA

SEQ ID NO: 2208000 - protein, 17 aa, Cryptosporidium hominis
QEIDKYPCRFIDQKQAL

SEQ ID NO: 2208001 - protein, 18 aa, Cryptosporidium hominis
QENIDFLLNMLLVLFEYG

SEQ ID NO: 2208002 - protein, 30 aa, Cryptosporidium hominis
QENWSIPVEEIINATFIYPGTQQPDLVPNQ

SEQ ID NO: 2208003 - protein, 24 aa, Cryptosporidium hominis
QESFPAQLRPYFAWVPTSHRNPKR

SEQ ID NO: 2208004 - protein, 18 aa, Cryptosporidium hominis
QESYIKLKLLSNTNDNVS

SEQ ID NO: 2208005 - protein, 21 aa, Cryptosporidium hominis
QEYFCIKRSNCIVAISGVGLT

SEQ ID NO: 2208006 - protein, 20 aa, Cryptosporidium hominis
QFFKKCLDAEESGLITPLDS

SEQ ID NO: 2208007 - protein, 18 aa, Cryptosporidium hominis
QFLSDVVWGELDFLIIDT

SEQ ID NO: 2208008 - protein, 19 aa, Cryptosporidium hominis
QFNRLCLITGYSNSEDRLK

SEQ ID NO: 2208009 - protein, 21 aa, Cryptosporidium hominis
QGLVVPPGFYFNKTTSQYEPL

SEQ ID NO: 2208010 - protein, 26 aa, Cryptosporidium hominis
QGSCIKGDRLLYGWYTIRDIYNKGEW

SEQ ID NO: 2208011 - protein, 17 aa, Cryptosporidium hominis
QHFQRSMMGLALSFGSG

SEQ ID NO: 2208012 - protein, 17 aa, Cryptosporidium hominis
QIGEMLLYISIRDFPVY

SEQ ID NO: 2208013 - protein, 24 aa, Cryptosporidium hominis
QIGSFKFKYLTKMDFRELHLIESY

SEQ ID NO: 2208014 - protein, 22 aa, Cryptosporidium hominis
QIQCLCNALSSYALKGTVTPLN

SEQ ID NO: 2208015 - protein, 18 aa, Cryptosporidium hominis
QIRKFKGLFRDFKDDEEL

SEQ ID NO: 2208016 - protein, 26 aa, Cryptosporidium hominis
QISGIKSALGIMGFKLSEGSGIPLAV

SEQ ID NO: 2208017 - protein, 18 aa, Cryptosporidium hominis
QISSFPTIMVYKTASKAP

SEQ ID NO: 2208018 - protein, 18 aa, Cryptosporidium hominis
QKEKSMNFMLKKSIIKLC

SEQ ID NO: 2208019 - protein, 17 aa, Cryptosporidium hominis
QKICEIVNVIIREPASF

SEQ ID NO: 2208020 - protein, 29 aa, Cryptosporidium hominis
QKKFEIHRPPKLLFFFGSMNKFEAYPSHL

SEQ ID NO: 2208021 - protein, 28 aa, Cryptosporidium hominis
QKKRALSLFRVLKYLYKGHTTGWYITAF

SEQ ID NO: 2208022 - protein, 31 aa, Cryptosporidium hominis
QKKSEFCVSLYLFRFKGLRQIMIVIRGLLSL

SEQ ID NO: 2208023 - protein, 17 aa, Cryptosporidium hominis
QKLGERGLLVWGTVSPE

SEQ ID NO: 2208024 - protein, 20 aa, Cryptosporidium hominis
QKRRKLLRRFKNLDLENKKH

SEQ ID NO: 2208025 - protein, 24 aa, Cryptosporidium hominis
QKSSIKFASLILGLSQYDTKILNI

SEQ ID NO: 2208026 - protein, 25 aa, Cryptosporidium hominis
QKYPGGYKNRWDMISEYLKNTKTKE

SEQ ID NO: 2208027 - protein, 18 aa, Cryptosporidium hominis
QLKHSSTAKFGLPHQAKN

SEQ ID NO: 2208028 - protein, 23 aa, Cryptosporidium hominis
QLKLRSWLMCPEIENIDLIVMPE

SEQ ID NO: 2208029 - protein, 19 aa, Cryptosporidium hominis
QLLFKQLRNTLLFSNHLDP

SEQ ID NO: 2208030 - protein, 19 aa, Cryptosporidium hominis
QLVLICFFMLLGQIKGDKT

SEQ ID NO: 2208031 - protein, 26 aa, Cryptosporidium hominis
QLYIKLIPAILLWIFFISGKVSSSNT

SEQ ID NO: 2208032 - protein, 17 aa, Cryptosporidium hominis
QLYQDWRKDENKVVPSW

SEQ ID NO: 2208033 - protein, 25 aa, Cryptosporidium hominis
QNDIWSDRFVNGFSSIELENNNSGV

SEQ ID NO: 2208034 - protein, 18 aa, Cryptosporidium hominis
QNLLSTKILFLILESMYP

SEQ ID NO: 2208035 - protein, 20 aa, Cryptosporidium hominis
QNLRKMLCCCRGNSNNLSTQ

SEQ ID NO: 2208036 - protein, 18 aa, Cryptosporidium hominis
QNPGFCVPMSIYTPCSRC

SEQ ID NO: 2208037 - protein, 19 aa, Cryptosporidium hominis
QPFSGRVGTFSSFSGAAPA

SEQ ID NO: 2208038 - protein, 20 aa, Cryptosporidium hominis
QPGINWEHFTEVLKVDSEGN

SEQ ID NO: 2208039 - protein, 21 aa, Cryptosporidium hominis
QPLVLKYKFFSEIISSYNYSV

SEQ ID NO: 2208040 - protein, 33 aa, Cryptosporidium hominis
QPMKERWVKAPPFKRPEGINVESGLVPEIVKVF

SEQ ID NO: 2208041 - protein, 18 aa, Cryptosporidium hominis
QQATCVLESEGYYSLHEK

SEQ ID NO: 2208042 - protein, 25 aa, Cryptosporidium hominis
QQTRWGKLLSYCIKCRALTEYMLIK

SEQ ID NO: 2208043 - protein, 24 aa, Cryptosporidium hominis
QRGIRELAYRLIVRDKPTNTEPEG

SEQ ID NO: 2208044 - protein, 17 aa, Cryptosporidium hominis
QRKEVWDFVKANQIPLF

SEQ ID NO: 2208045 - protein, 24 aa, Cryptosporidium hominis
QRKKIECKFIKNLIFILIIFSEKN

SEQ ID NO: 2208046 - protein, 25 aa, Cryptosporidium hominis
QRLSDSALCLVKLPTTIWALTPLNW

SEQ ID NO: 2208047 - protein, 23 aa, Cryptosporidium hominis
QRLTGLRFSWPDGTTVVTSGRGS

SEQ ID NO: 2208048 - protein, 24 aa, Cryptosporidium hominis
QSCTLSLFQGCFSSEFVLSLPDSS

SEQ ID NO: 2208049 - protein, 24 aa, Cryptosporidium hominis
QSGFYRLRSRLYFLNDGVAYNAIP

SEQ ID NO: 2208050 - protein, 23 aa, Cryptosporidium hominis
QTEIKFQLCIEQLAELSERLADK

SEQ ID NO: 2208051 - protein, 23 aa, Cryptosporidium hominis
QTKGGVLRKREFENFDLSNDAIE

SEQ ID NO: 2208052 - protein, 17 aa, Cryptosporidium hominis
QTSCWNRANVNKSRVII

SEQ ID NO: 2208053 - protein, 21 aa, Cryptosporidium hominis
QVEKRLSIFEAYRDIASTLNL

SEQ ID NO: 2208054 - protein, 17 aa, Cryptosporidium hominis
QVLKTSRQVVFKSPVQF

SEQ ID NO: 2208055 - protein, 28 aa, Cryptosporidium hominis
QVMMPVAAFIRPRLVVDEALLQAFGEIA

SEQ ID NO: 2208056 - protein, 22 aa, Cryptosporidium hominis
QVRTSSVFGRSIIDYNDKLKAR

SEQ ID NO: 2208057 - protein, 28 aa, Cryptosporidium hominis
QVSIGCAAPCPYQRYFIQTDRILKRIAK

SEQ ID NO: 2208058 - protein, 20 aa, Cryptosporidium hominis
QVVNPEWKFFTNVLELLLFQ

SEQ ID NO: 2208059 - protein, 25 aa, Cryptosporidium hominis
QVYLNIKFTYRWNAPGALKIENETV

SEQ ID NO: 2208060 - protein, 19 aa, Cryptosporidium hominis
QWNLLILLLHLQLLIVSVR

SEQ ID NO: 2208061 - protein, 25 aa, Cryptosporidium hominis
QWPLYTEIWRSCAYVYKRKATGGEK

SEQ ID NO: 2208062 - protein, 21 aa, Cryptosporidium hominis
QYKGGEVWRHIYYEIEKVDFP

SEQ ID NO: 2208063 - protein, 39 aa, Cryptosporidium hominis
QYKKFKCPRLIASFFRDRILGYSCPYLSNINEFFNFVEN

SEQ ID NO: 2208064 - protein, 31 aa, Cryptosporidium hominis
QYLPFLQGIYVCKSYPNTKCTKKNPCKKCKK

SEQ ID NO: 2208065 - protein, 20 aa, Cryptosporidium hominis
QYTEACLQSLVAAAAEYPTD

SEQ ID NO: 2208066 - protein, 25 aa, Cryptosporidium hominis
RAGLTKFTSAFGIHILGDYRVPDDK

SEQ ID NO: 2208067 - protein, 19 aa, Cryptosporidium hominis
RAGSGWTQQHICEGIYLLN

SEQ ID NO: 2208068 - protein, 17 aa, Cryptosporidium hominis
RALDFAASRHQLLFILR

SEQ ID NO: 2208069 - protein, 18 aa, Cryptosporidium hominis
RALINILNIYSKVLKEEL

SEQ ID NO: 2208070 - protein, 35 aa, Cryptosporidium hominis
RAQDEVVFGYNMVKGKFVVPSIMSLNSLPQHCSLA

SEQ ID NO: 2208071 - protein, 18 aa, Cryptosporidium hominis
RCGSKWRKTKLGSSMGDR

SEQ ID NO: 2208072 - protein, 17 aa, Cryptosporidium hominis
RCIDLMHYFALARGVRS

SEQ ID NO: 2208073 - protein, 17 aa, Cryptosporidium hominis
RCLLLIILLVILEILCA

SEQ ID NO: 2208074 - protein, 17 aa, Cryptosporidium hominis
RCTKCKTTNVSESSIAY

SEQ ID NO: 2208075 - protein, 32 aa, Cryptosporidium hominis
RCVGGKCGRVHCDGCSSSLCHLEGAKCVPARC

SEQ ID NO: 2208076 - protein, 20 aa, Cryptosporidium hominis
RDEFTWRASQDLYKLEWKIG

SEQ ID NO: 2208077 - protein, 19 aa, Cryptosporidium hominis
RDICTECNIFSSQMALISV

SEQ ID NO: 2208078 - protein, 25 aa, Cryptosporidium hominis
RDLKAGDPFFNFNFQYMQDRFGHCS

SEQ ID NO: 2208079 - protein, 22 aa, Cryptosporidium hominis
RDLRGICMACVGPESYNQLFNW

SEQ ID NO: 2208080 - protein, 17 aa, Cryptosporidium hominis
RDLSNYYLLEFNQEEER

SEQ ID NO: 2208081 - protein, 21 aa, Cryptosporidium hominis
RDYYSEFKFYFKTIYSEYWIN

SEQ ID NO: 2208082 - protein, 25 aa, Cryptosporidium hominis
REASVFLFICLSVRSFSKIGGVAHL

SEQ ID NO: 2208083 - protein, 17 aa, Cryptosporidium hominis
RECMKKLSITSVNMSAL

SEQ ID NO: 2208084 - protein, 29 aa, Cryptosporidium hominis
REHLETFVRMFGCKIYRSVPNVLEIVPQN

SEQ ID NO: 2208085 - protein, 17 aa, Cryptosporidium hominis
REILYSLSKEFWTDGHG

SEQ ID NO: 2208086 - protein, 17 aa, Cryptosporidium hominis
REVKRFEVRASSLKLKS

SEQ ID NO: 2208087 - protein, 17 aa, Cryptosporidium hominis
REYFPGTLLQLRDAIES

SEQ ID NO: 2208088 - protein, 22 aa, Cryptosporidium hominis
RFFEINGVPPLTYLSPANETLL

SEQ ID NO: 2208089 - protein, 19 aa, Cryptosporidium hominis
RFKQENKFKEKKKKKSPNK

SEQ ID NO: 2208090 - protein, 25 aa, Cryptosporidium hominis
RFPNLKPTRVCFSQWKAILDQNKED

SEQ ID NO: 2208091 - protein, 37 aa, Cryptosporidium hominis
RFRGELYSDGSIGWLCSKRINGRWTGWIPVSESRVPP

SEQ ID NO: 2208092 - protein, 20 aa, Cryptosporidium hominis
RFSFKTFPNFVPPDIPKIAG

SEQ ID NO: 2208093 - protein, 19 aa, Cryptosporidium hominis
RFTSFVSRTCRRFTSRLTS

SEQ ID NO: 2208094 - protein, 18 aa, Cryptosporidium hominis
RFVESCTNILRTLSVNGL

SEQ ID NO: 2208095 - protein, 22 aa, Cryptosporidium hominis
RFWNYELCNLYAVSQFKKDAST

SEQ ID NO: 2208096 - protein, 23 aa, Cryptosporidium hominis
RGLLHVSALFKYSKKYKNSSSTL

SEQ ID NO: 2208097 - protein, 17 aa, Cryptosporidium hominis
RGLLVWGTVSPEYQGVV

SEQ ID NO: 2208098 - protein, 25 aa, Cryptosporidium hominis
RGNLIRLVFELSQLPYIGHAFGGYN

SEQ ID NO: 2208099 - protein, 28 aa, Cryptosporidium hominis
RGPAERLPVSKIWRATPPENRPEDSVVL

SEQ ID NO: 2208100 - protein, 19 aa, Cryptosporidium hominis
RIAFPTAVQSSVFPSLGII

SEQ ID NO: 2208101 - protein, 22 aa, Cryptosporidium hominis
RIDSRYNFFGLRKGETIINERE

SEQ ID NO: 2208102 - protein, 23 aa, Cryptosporidium hominis
RIFAWGSTEFGQFGIKPVEDKME

SEQ ID NO: 2208103 - protein, 19 aa, Cryptosporidium hominis
RIKTSVLEKMYNIAKFGPQ

SEQ ID NO: 2208104 - protein, 19 aa, Cryptosporidium hominis
RILLLLSTISYAYSEKKRQ

SEQ ID NO: 2208105 - protein, 18 aa, Cryptosporidium hominis
RINRKKIMDKLRQRTLPR

SEQ ID NO: 2208106 - protein, 17 aa, Cryptosporidium hominis
RIPSISMTTMYASKASP

SEQ ID NO: 2208107 - protein, 25 aa, Cryptosporidium hominis
RISIPESIPSVGSDNVFFDSDDPSN

SEQ ID NO: 2208108 - protein, 17 aa, Cryptosporidium hominis
RIWQCTQSGLLGGLLGI

SEQ ID NO: 2208109 - protein, 25 aa, Cryptosporidium hominis
RKAKYDLPTFLNFVGDFSGTFSLPL

SEQ ID NO: 2208110 - protein, 17 aa, Cryptosporidium hominis
RKGEMRAPIIGIPSKKP

SEQ ID NO: 2208111 - protein, 17 aa, Cryptosporidium hominis
RKIHPRHPFPLPSSPLY

SEQ ID NO: 2208112 - protein, 19 aa, Cryptosporidium hominis
RKIVNTFLRTNCSPPEVLH

SEQ ID NO: 2208113 - protein, 21 aa, Cryptosporidium hominis
RKLCSGPILLIILSLSNSTQV

SEQ ID NO: 2208114 - protein, 24 aa, Cryptosporidium hominis
RKNKCSSILIPICGSDGVTYRNPC

SEQ ID NO: 2208115 - protein, 24 aa, Cryptosporidium hominis
RKQIPAILARKICASTSRWMSCNS

SEQ ID NO: 2208116 - protein, 28 aa, Cryptosporidium hominis
RKRILHLKMKLSFSVVLTLLIYTIGKPH

SEQ ID NO: 2208117 - protein, 25 aa, Cryptosporidium hominis
RKRNGIKFEENWVFGQILCSASNIS

SEQ ID NO: 2208118 - protein, 20 aa, Cryptosporidium hominis
RKSLYSFKSSYSMQALCETS

SEQ ID NO: 2208119 - protein, 19 aa, Cryptosporidium hominis
RKYISNILIENAVRKVSRP

SEQ ID NO: 2208120 - protein, 19 aa, Cryptosporidium hominis
RLENWKSHFEEVSSLDSHV

SEQ ID NO: 2208121 - protein, 19 aa, Cryptosporidium hominis
RLLMDLKKIKSIRITLVCL

SEQ ID NO: 2208122 - protein, 19 aa, Cryptosporidium hominis
RLLRLKEGITYILDTKEDF

SEQ ID NO: 2208123 - protein, 17 aa, Cryptosporidium hominis
RLREYFPGTLLQLRDAI

SEQ ID NO: 2208124 - protein, 19 aa, Cryptosporidium hominis
RLVGLRIRCGSKWRKTKLG

SEQ ID NO: 2208125 - protein, 18 aa, Cryptosporidium hominis
RLVLLIVIPVIAGKDYYK

SEQ ID NO: 2208126 - protein, 24 aa, Cryptosporidium hominis
RNASIGVIWIYEPGLLLAEELVSP

SEQ ID NO: 2208127 - protein, 18 aa, Cryptosporidium hominis
RNEMISLLWNRAANMGDT

SEQ ID NO: 2208128 - protein, 17 aa, Cryptosporidium hominis
RNNCCSVIYDLFLSKVF

SEQ ID NO: 2208129 - protein, 17 aa, Cryptosporidium hominis
RNPFRYLCDNSPARKLL

SEQ ID NO: 2208130 - protein, 20 aa, Cryptosporidium hominis
RNRVVLLDPSHGLSCSGPYI

SEQ ID NO: 2208131 - protein, 19 aa, Cryptosporidium hominis
RNWGEGIATLNGHIYQLTW

SEQ ID NO: 2208132 - protein, 24 aa, Cryptosporidium hominis
RPFSHKYPGLGISQSIIYDVFNHG

SEQ ID NO: 2208133 - protein, 17 aa, Cryptosporidium hominis
RPGCGPCKQLVQAYGNL

SEQ ID NO: 2208134 - protein, 19 aa, Cryptosporidium hominis
RPIPIGGGALYLCSIDYYA

SEQ ID NO: 2208135 - protein, 19 aa, Cryptosporidium hominis
RPSPSPPPLPPRPSPSPPP

SEQ ID NO: 2208136 - protein, 27 aa, Cryptosporidium hominis
RPVECDGWNPTGPFGRRLEQIIINDEG

SEQ ID NO: 2208137 - protein, 22 aa, Cryptosporidium hominis
RPYAPFRYFAAETFNEMRNNCC

SEQ ID NO: 2208138 - protein, 19 aa, Cryptosporidium hominis
RPYVSFKGNEIMYVHESSN

SEQ ID NO: 2208139 - protein, 29 aa, Cryptosporidium hominis
RQKFRQICKEAGYSTGRWDVYNDRAYSQY

SEQ ID NO: 2208140 - protein, 17 aa, Cryptosporidium hominis
RRPCGRCRRGSTCCENN

SEQ ID NO: 2208141 - protein, 17 aa, Cryptosporidium hominis
RRRSRGVLDREPEIPTD

SEQ ID NO: 2208142 - protein, 20 aa, Cryptosporidium hominis
RRVCAVGPLVIYAEDNGIVK

SEQ ID NO: 2208143 - protein, 27 aa, Cryptosporidium hominis
RSDIILSGKCLNGIIFTAMALDSGVIK

SEQ ID NO: 2208144 - protein, 30 aa, Cryptosporidium hominis
RSEISENHLLNWRFDMMPMHKVIIPKRNSI

SEQ ID NO: 2208145 - protein, 24 aa, Cryptosporidium hominis
RSIERARQLFIEYLGGMDAGKLNE

SEQ ID NO: 2208146 - protein, 26 aa, Cryptosporidium hominis
RSPNWKGNFVPWRFVESCTNILRTLS

SEQ ID NO: 2208147 - protein, 17 aa, Cryptosporidium hominis
RSRYAIEGWLSHKNKSP

SEQ ID NO: 2208148 - protein, 21 aa, Cryptosporidium hominis
RSSDSSLHMGALMNAGYEETK

SEQ ID NO: 2208149 - protein, 20 aa, Cryptosporidium hominis
RSSFSSIFLCSKHEIKEIPH

SEQ ID NO: 2208150 - protein, 17 aa, Cryptosporidium hominis
RSSLGNGGKTAKCIQSR

SEQ ID NO: 2208151 - protein, 20 aa, Cryptosporidium hominis
RTANDLFEFAIKFQSSSASI

SEQ ID NO: 2208152 - protein, 19 aa, Cryptosporidium hominis
RTEWADLLFQISNNNRKIT

SEQ ID NO: 2208153 - protein, 26 aa, Cryptosporidium hominis
RTPLLKDLWPGDIMDCIMTTICTRNH

SEQ ID NO: 2208154 - protein, 17 aa, Cryptosporidium hominis
RTSFPADPKHGFVPLYI

SEQ ID NO: 2208155 - protein, 22 aa, Cryptosporidium hominis
RTTIEGMVKTIPYTPGKNSSNI

SEQ ID NO: 2208156 - protein, 20 aa, Cryptosporidium hominis
RVIFDRRSRYAIEGWLSHKN

SEQ ID NO: 2208157 - protein, 18 aa, Cryptosporidium hominis
RVIIPIIVGNFKYNPENQ

SEQ ID NO: 2208158 - protein, 21 aa, Cryptosporidium hominis
RVREVVSLFYRAGAVDRNSLF

SEQ ID NO: 2208159 - protein, 19 aa, Cryptosporidium hominis
RVSDCNRLLMDLKKIKSIR

SEQ ID NO: 2208160 - protein, 25 aa, Cryptosporidium hominis
RVSTIIKALAWIAIVCLVKNASSEG

SEQ ID NO: 2208161 - protein, 19 aa, Cryptosporidium hominis
RVYYYPIGFNLASLFIGPG

SEQ ID NO: 2208162 - protein, 24 aa, Cryptosporidium hominis
RWGEKGFCRIIRGVNELSIEHAAV

SEQ ID NO: 2208163 - protein, 17 aa, Cryptosporidium hominis
RWIPVGLNTTEFTFKAG

SEQ ID NO: 2208164 - protein, 17 aa, Cryptosporidium hominis
RWLFTNRPWKSRIIIQS

SEQ ID NO: 2208165 - protein, 19 aa, Cryptosporidium hominis
RYDLSLWSTIGFPAILTPC

SEQ ID NO: 2208166 - protein, 26 aa, Cryptosporidium hominis
RYGKYSNKYLYGIREIELMTNNLRSV

SEQ ID NO: 2208167 - protein, 18 aa, Cryptosporidium hominis
RYQLELSTGIFINNDVIR

SEQ ID NO: 2208168 - protein, 20 aa, Cryptosporidium hominis
RYWGVCFEGYEEYFGNMIPL

SEQ ID NO: 2208169 - protein, 19 aa, Cryptosporidium hominis
RYYAFKLADSYGHRLDLLP

SEQ ID NO: 2208170 - protein, 19 aa, Cryptosporidium hominis
SAAMTPVLVVRASTIISIK

SEQ ID NO: 2208171 - protein, 24 aa, Cryptosporidium hominis
SACKYELSDLLKLIKKLNLEVREL

SEQ ID NO: 2208172 - protein, 25 aa, Cryptosporidium hominis
SAELACGRYNFMFHCEVVEISKEMF

SEQ ID NO: 2208173 - protein, 23 aa, Cryptosporidium hominis
SAGGCGFRKLLCFGSGNYGEGRP

SEQ ID NO: 2208174 - protein, 18 aa, Cryptosporidium hominis
SAISRPFRAHKLKKALGK

SEQ ID NO: 2208175 - protein, 18 aa, Cryptosporidium hominis
SAKISWCPISTKNKLSLL

SEQ ID NO: 2208176 - protein, 23 aa, Cryptosporidium hominis
SALDICAVINPWNSMECSGITGV

SEQ ID NO: 2208177 - protein, 19 aa, Cryptosporidium hominis
SALICYLCARNFRNSIEIW

SEQ ID NO: 2208178 - protein, 18 aa, Cryptosporidium hominis
SALVIGVSILNRYQDIDT

SEQ ID NO: 2208179 - protein, 19 aa, Cryptosporidium hominis
SAPTSNFCKNCGSRTFRVG

SEQ ID NO: 2208180 - protein, 24 aa, Cryptosporidium hominis
SATAEFFADIALCPMEMIKIKMQT

SEQ ID NO: 2208181 - protein, 18 aa, Cryptosporidium hominis
SAVPFGWTNIPLGVSPIR

SEQ ID NO: 2208182 - protein, 24 aa, Cryptosporidium hominis
SCIMAESLIQFGIKNEYFNRLCIN

SEQ ID NO: 2208183 - protein, 20 aa, Cryptosporidium hominis
SCIYMKNLVKRKWDIDWEHG

SEQ ID NO: 2208184 - protein, 24 aa, Cryptosporidium hominis
SCPKNCQKFGHLCKCIDEIPIQSI

SEQ ID NO: 2208185 - protein, 21 aa, Cryptosporidium hominis
SCSNGCKLIFCSSCHENSDSK

SEQ ID NO: 2208186 - protein, 18 aa, Cryptosporidium hominis
SCYHELCRLLGKLNTANQ

SEQ ID NO: 2208187 - protein, 18 aa, Cryptosporidium hominis
SDDLRGVPIIKKHSNSPS

SEQ ID NO: 2208188 - protein, 17 aa, Cryptosporidium hominis
SDEEYWTPFGIDPALLK

SEQ ID NO: 2208189 - protein, 21 aa, Cryptosporidium hominis
SDFGSVFSALLDSFGLLVDSS

SEQ ID NO: 2208190 - protein, 30 aa, Cryptosporidium hominis
SDGSCKECIKLKKSCSHCSNFVSSKRSREY

SEQ ID NO: 2208191 - protein, 28 aa, Cryptosporidium hominis
SDIESPRTLPIIFTMNLRTRKPYINQKE

SEQ ID NO: 2208192 - protein, 18 aa, Cryptosporidium hominis
SDILREVRTSISSCSGVV

SEQ ID NO: 2208193 - protein, 18 aa, Cryptosporidium hominis
SDKIMPLAMIKGRNTDDS

SEQ ID NO: 2208194 - protein, 27 aa, Cryptosporidium hominis
SDKVCPDCSLKVLPRIILGKYLVLEFK

SEQ ID NO: 2208195 - protein, 25 aa, Cryptosporidium hominis
SDKYSSKCTSIWRGKVGGTKKSSLG

SEQ ID NO: 2208196 - protein, 24 aa, Cryptosporidium hominis
SDLIVLKFSDSVVGIVDSSKARTT

SEQ ID NO: 2208197 - protein, 20 aa, Cryptosporidium hominis
SDMGISIGVINICSSNKIKI

SEQ ID NO: 2208198 - protein, 24 aa, Cryptosporidium hominis
SDNLCKLMPLSYCNSQDVSFVLED

SEQ ID NO: 2208199 - protein, 21 aa, Cryptosporidium hominis
SEAIFKLYLMNSRELDIRSLK

SEQ ID NO: 2208200 - protein, 18 aa, Cryptosporidium hominis
SEDIVLRPSRFPRLVRLD

SEQ ID NO: 2208201 - protein, 17 aa, Cryptosporidium hominis
SEECKFPQIDIEDSNLC

SEQ ID NO: 2208202 - protein, 24 aa, Cryptosporidium hominis
SEFEDKIRWFGLSKYSSQKLDSFT

SEQ ID NO: 2208203 - protein, 26 aa, Cryptosporidium hominis
SEHVNVCAIVKAVGRQPDGGLILLGR

SEQ ID NO: 2208204 - protein, 19 aa, Cryptosporidium hominis
SEIIFLDYSQSIKWNIETS

SEQ ID NO: 2208205 - protein, 17 aa, Cryptosporidium hominis
SEIKHSTQIFGKLVTLP

SEQ ID NO: 2208206 - protein, 22 aa, Cryptosporidium hominis
SEIKVLGVRALNAYTIEPWMTN

SEQ ID NO: 2208207 - protein, 17 aa, Cryptosporidium hominis
SEILLKEMELIAEQKAK

SEQ ID NO: 2208208 - protein, 18 aa, Cryptosporidium hominis
SEILSGLYGSSLEPIIIS

SEQ ID NO: 2208209 - protein, 22 aa, Cryptosporidium hominis
SEIVKYILPYSSYDEYLDENEI

SEQ ID NO: 2208210 - protein, 22 aa, Cryptosporidium hominis
SEKELKERKSLIVKLHEEKNNI

SEQ ID NO: 2208211 - protein, 22 aa, Cryptosporidium hominis
SEKSWQRKLLKAAQPPYLEFHN

SEQ ID NO: 2208212 - protein, 21 aa, Cryptosporidium hominis
SELKANMGVHFDVNLDPDSDS

SEQ ID NO: 2208213 - protein, 18 aa, Cryptosporidium hominis
SELKNCRQAIRSISGAGC

SEQ ID NO: 2208214 - protein, 17 aa, Cryptosporidium hominis
SELKRFSLGSHRRITEA

SEQ ID NO: 2208215 - protein, 20 aa, Cryptosporidium hominis
SELLFYDWKRPDVGRETPYD

SEQ ID NO: 2208216 - protein, 28 aa, Cryptosporidium hominis
SENGRPISRFNISGIPEFISKAQEGGAI

SEQ ID NO: 2208217 - protein, 18 aa, Cryptosporidium hominis
SEPLSWMTFGDWGEPTAI

SEQ ID NO: 2208218 - protein, 25 aa, Cryptosporidium hominis
SEQNLLAALCWSLPFKFIKCDIDFE

SEQ ID NO: 2208219 - protein, 25 aa, Cryptosporidium hominis
SESDAEYGYMYGLKSNTLFEPVSTL

SEQ ID NO: 2208220 - protein, 19 aa, Cryptosporidium hominis
SESKIKFGSFDISENDLPK

SEQ ID NO: 2208221 - protein, 26 aa, Cryptosporidium hominis
SESRTGSRGCFGRFTSFVSRTCRRFT

SEQ ID NO: 2208222 - protein, 19 aa, Cryptosporidium hominis
SEVAKLVNVFEKFDDEDRF

SEQ ID NO: 2208223 - protein, 27 aa, Cryptosporidium hominis
SEVINPFIPTCVNALMTMSMFSPASKL

SEQ ID NO: 2208224 - protein, 35 aa, Cryptosporidium hominis
SEVMKLGLHLGDFIYPRLFPIFASDLCIARKMMKR

SEQ ID NO: 2208225 - protein, 23 aa, Cryptosporidium hominis
SEYLEYLLLKNGFMFRVSLTERY

SEQ ID NO: 2208226 - protein, 17 aa, Cryptosporidium hominis
SFCSLVLALSKVEKKYF

SEQ ID NO: 2208227 - protein, 24 aa, Cryptosporidium hominis
SFDALKYRFQRTFNNSSPVIILQQ

SEQ ID NO: 2208228 - protein, 26 aa, Cryptosporidium hominis
SFFSNRVCLFETFKLIEEKRNSQFIG

SEQ ID NO: 2208229 - protein, 19 aa, Cryptosporidium hominis
SFHPFPMLKDQIVELETNS

SEQ ID NO: 2208230 - protein, 17 aa, Cryptosporidium hominis
SFICKDLLRTSEAAQEK

SEQ ID NO: 2208231 - protein, 19 aa, Cryptosporidium hominis
SFLSSILLLNGIESLKFNE

SEQ ID NO: 2208232 - protein, 27 aa, Cryptosporidium hominis
SFSSEIPRLGQYLVFYGHSESTSAASI

SEQ ID NO: 2208233 - protein, 19 aa, Cryptosporidium hominis
SGARFCCEGADNEMIENPF

SEQ ID NO: 2208234 - protein, 19 aa, Cryptosporidium hominis
SGEIFKLGIGVLEESPDKI

SEQ ID NO: 2208235 - protein, 19 aa, Cryptosporidium hominis
SGGWLRKQTSPNFIKRLLK

SEQ ID NO: 2208236 - protein, 18 aa, Cryptosporidium hominis
SGIIFKDYFKTFSRLTIN

SEQ ID NO: 2208237 - protein, 23 aa, Cryptosporidium hominis
SGIYFLVFPVLLTFSSNSINVFE

SEQ ID NO: 2208238 - protein, 19 aa, Cryptosporidium hominis
SGLCPYPNPDEIVWLFNAF

SEQ ID NO: 2208239 - protein, 18 aa, Cryptosporidium hominis
SGLSSFWTPPTGFGGFFP

SEQ ID NO: 2208240 - protein, 17 aa, Cryptosporidium hominis
SGMTCRAARFVPMKRDM

SEQ ID NO: 2208241 - protein, 21 aa, Cryptosporidium hominis
SGNLELKCTSSNEVWSMTILD

SEQ ID NO: 2208242 - protein, 23 aa, Cryptosporidium hominis
SGSCSSTKCVGCTTEVPRLEGCV

SEQ ID NO: 2208243 - protein, 26 aa, Cryptosporidium hominis
SGSPRTRFWRRFKRYVINMFSSNKGM

SEQ ID NO: 2208244 - protein, 17 aa, Cryptosporidium hominis
SGSRPPSGFPNQITQKA

SEQ ID NO: 2208245 - protein, 20 aa, Cryptosporidium hominis
SGVVKILHGYGIHLDSTPND

SEQ ID NO: 2208246 - protein, 25 aa, Cryptosporidium hominis
SHKCFLMLGFEVEFLENPILNNSGV

SEQ ID NO: 2208247 - protein, 20 aa, Cryptosporidium hominis
SHPLLMPPPIYKHGKVKCIP

SEQ ID NO: 2208248 - protein, 19 aa, Cryptosporidium hominis
SIDLRGYRIISIHLESLLE

SEQ ID NO: 2208249 - protein, 23 aa, Cryptosporidium hominis
SIEARISIIRSYKESCLDIKSSN

SEQ ID NO: 2208250 - protein, 17 aa, Cryptosporidium hominis
SIGGGFIRLNITEADSW

SEQ ID NO: 2208251 - protein, 25 aa, Cryptosporidium hominis
SIIECAEALITFFKLKAETYYDSTE

SEQ ID NO: 2208252 - protein, 27 aa, Cryptosporidium hominis
SILSEQNVNCFLVFRALPENLKQATSI

SEQ ID NO: 2208253 - protein, 25 aa, Cryptosporidium hominis
SILSVLRLIVYLIKSVFNIFSNISS

SEQ ID NO: 2208254 - protein, 24 aa, Cryptosporidium hominis
SIPDQDFLNALALSGKMKYEKKQQ

SEQ ID NO: 2208255 - protein, 19 aa, Cryptosporidium hominis
SIQACFKLGLAKRQEDVVI

SEQ ID NO: 2208256 - protein, 24 aa, Cryptosporidium hominis
SIRVRKGVSFNEALARLCLDATNK

SEQ ID NO: 2208257 - protein, 21 aa, Cryptosporidium hominis
SISQLRSDFGSVFSALLDSFG

SEQ ID NO: 2208258 - protein, 24 aa, Cryptosporidium hominis
SISSKLVLGRSWLPSTKNIIDICR

SEQ ID NO: 2208259 - protein, 25 aa, Cryptosporidium hominis
SIYMKNFHWHVAEKITHYLIFLSSQ

SEQ ID NO: 2208260 - protein, 26 aa, Cryptosporidium hominis
SKDGKSFSCKACGSSTLLGSLPSHLG

SEQ ID NO: 2208261 - protein, 19 aa, Cryptosporidium hominis
SKEDKCYVLLLSGGANRGA

SEQ ID NO: 2208262 - protein, 18 aa, Cryptosporidium hominis
SKEIGSGCNCSNVENLYK

SEQ ID NO: 2208263 - protein, 20 aa, Cryptosporidium hominis
SKELEPYLTLSGFIDQDTMK

SEQ ID NO: 2208264 - protein, 23 aa, Cryptosporidium hominis
SKERIKKEFAHRLTNRKIYTNLQ

SEQ ID NO: 2208265 - protein, 21 aa, Cryptosporidium hominis
SKEVKTMLNVFGKRMSSMKFS

SEQ ID NO: 2208266 - protein, 20 aa, Cryptosporidium hominis
SKFNFPEFGSGGNIQAHHVN

SEQ ID NO: 2208267 - protein, 17 aa, Cryptosporidium hominis
SKFPLAHQLGLMQLQSF

SEQ ID NO: 2208268 - protein, 17 aa, Cryptosporidium hominis
SKIHCSSFRSFSENDQL

SEQ ID NO: 2208269 - protein, 17 aa, Cryptosporidium hominis
SKIRVYLSHLFPEEDSL

SEQ ID NO: 2208270 - protein, 18 aa, Cryptosporidium hominis
SKKKFFFLKCESDKNQKV

SEQ ID NO: 2208271 - protein, 19 aa, Cryptosporidium hominis
SKLKAAIRSVHQWESCRVK

SEQ ID NO: 2208272 - protein, 29 aa, Cryptosporidium hominis
SKMRPFSGLFPVLVGEVIDNSINYCIYKY

SEQ ID NO: 2208273 - protein, 20 aa, Cryptosporidium hominis
SKNLVPLLAKREILIRKSEK

SEQ ID NO: 2208274 - protein, 18 aa, Cryptosporidium hominis
SKRQPCCSHKSKKYKMSR

SEQ ID NO: 2208275 - protein, 23 aa, Cryptosporidium hominis
SKSAPAPVVKHFADESSSDPKSE

SEQ ID NO: 2208276 - protein, 21 aa, Cryptosporidium hominis
SKSEMSRLLFDVRDYITDVIL

SEQ ID NO: 2208277 - protein, 25 aa, Cryptosporidium hominis
SKSPLRLAVPGGIFDAGFRGELKIP

SEQ ID NO: 2208278 - protein, 22 aa, Cryptosporidium hominis
SKTELFTKVGLFVEGFTLDSVA

SEQ ID NO: 2208279 - protein, 18 aa, Cryptosporidium hominis
SKTNIFTIEAYRQFTSPK

SEQ ID NO: 2208280 - protein, 25 aa, Cryptosporidium hominis
SKTRGMVCFGWGKRYKMIVNCPEGT

SEQ ID NO: 2208281 - protein, 19 aa, Cryptosporidium hominis
SKWSKSRELKKRKVLDKLR

SEQ ID NO: 2208282 - protein, 25 aa, Cryptosporidium hominis
SKYCMPEKERILFLMRQTIVGKYKS

SEQ ID NO: 2208283 - protein, 24 aa, Cryptosporidium hominis
SKYNEWLPILFIQRYTKPSTLINC

SEQ ID NO: 2208284 - protein, 26 aa, Cryptosporidium hominis
SLAAMKIPFYLRQELIQSSNITPKRK

SEQ ID NO: 2208285 - protein, 18 aa, Cryptosporidium hominis
SLFDEIWTIHNLNGNKVV

SEQ ID NO: 2208286 - protein, 30 aa, Cryptosporidium hominis
SLINYGGIFLKSTYLSSIQILMESAKNLTK

SEQ ID NO: 2208287 - protein, 22 aa, Cryptosporidium hominis
SLLFLFLLYFSFGSSLKSNPLG

SEQ ID NO: 2208288 - protein, 18 aa, Cryptosporidium hominis
SLNFKCVIPNSAYSSLEF

SEQ ID NO: 2208289 - protein, 25 aa, Cryptosporidium hominis
SLQIEYICLLSLLTLSFAMTNCSFF

SEQ ID NO: 2208290 - protein, 22 aa, Cryptosporidium hominis
SLSKELFVKINSFLSQNDKNGD

SEQ ID NO: 2208291 - protein, 17 aa, Cryptosporidium hominis
SLSPDVLFPGWDNNDQI

SEQ ID NO: 2208292 - protein, 25 aa, Cryptosporidium hominis
SLYYNCISALKALEAKLIITPPSSD

SEQ ID NO: 2208293 - protein, 17 aa, Cryptosporidium hominis
SMFPGRNDWTFLAVKDP

SEQ ID NO: 2208294 - protein, 33 aa, Cryptosporidium hominis
SMYRYGNIRYLLSREFLYLFGKFGELEDYNIYT

SEQ ID NO: 2208295 - protein, 31 aa, Cryptosporidium hominis
SNGRVIRKLASGLECDKCELCTEDKKCFYHN

SEQ ID NO: 2208296 - protein, 19 aa, Cryptosporidium hominis
SNHLIRTVLVYSGLAFTET

SEQ ID NO: 2208297 - protein, 18 aa, Cryptosporidium hominis
SNIQVVFRKYGIEYFKFM

SEQ ID NO: 2208298 - protein, 23 aa, Cryptosporidium hominis
SNKLDRFISIIIEKAIQKSMKNS

SEQ ID NO: 2208299 - protein, 24 aa, Cryptosporidium hominis
SNLDRWNETLAIISIYTQPNGIRL

SEQ ID NO: 2208300 - protein, 23 aa, Cryptosporidium hominis
SNLFSLIPCKVFAWDSNGGTCTL

SEQ ID NO: 2208301 - protein, 26 aa, Cryptosporidium hominis
SNLRFFNRFYCGILMHKSLLKLIIES

SEQ ID NO: 2208302 - protein, 20 aa, Cryptosporidium hominis
SNLSRQVCYSYYKKRAATVC

SEQ ID NO: 2208303 - protein, 24 aa, Cryptosporidium hominis
SNRSRLSEVLAMHLRMRNRIVSLA

SEQ ID NO: 2208304 - protein, 21 aa, Cryptosporidium hominis
SNVWPVKMRFVYPSCHNMVKD

SEQ ID NO: 2208305 - protein, 29 aa, Cryptosporidium hominis
SPCDGNLSFRLPLNHSFERSDIILSGKCL

SEQ ID NO: 2208306 - protein, 23 aa, Cryptosporidium hominis
SPDLKSKFLKFFSSDGENNSVDG

SEQ ID NO: 2208307 - protein, 22 aa, Cryptosporidium hominis
SPEPRCREGFVFSVEDAACIKV

SEQ ID NO: 2208308 - protein, 21 aa, Cryptosporidium hominis
SPEYTPSVVLGKRLSYQCTYK

SEQ ID NO: 2208309 - protein, 17 aa, Cryptosporidium hominis
SPIILLLAILGIASALD

SEQ ID NO: 2208310 - protein, 22 aa, Cryptosporidium hominis
SPIRIGENMQHIGIFSYSGIIS

SEQ ID NO: 2208311 - protein, 26 aa, Cryptosporidium hominis
SPPVLSWVCPTDYPGFRGGKNDFIDA

SEQ ID NO: 2208312 - protein, 20 aa, Cryptosporidium hominis
SPRRISVIDLNMGPQEMVNA

SEQ ID NO: 2208313 - protein, 18 aa, Cryptosporidium hominis
SPYCSYGNEPICPYQKVI

SEQ ID NO: 2208314 - protein, 25 aa, Cryptosporidium hominis
SPYNLECPNGFILDRERSSCVSQVF

SEQ ID NO: 2208315 - protein, 23 aa, Cryptosporidium hominis
SQAHPCGKCSSGSTCCSENLCVG

SEQ ID NO: 2208316 - protein, 17 aa, Cryptosporidium hominis
SQFLKSRYVRVNFINSL

SEQ ID NO: 2208317 - protein, 19 aa, Cryptosporidium hominis
SQHSMALIWNGSYSNKFML

SEQ ID NO: 2208318 - protein, 22 aa, Cryptosporidium hominis
SQKEWNHIYALQNYIIERKGEM

SEQ ID NO: 2208319 - protein, 19 aa, Cryptosporidium hominis
SQSGFSIEFGCNYKNLKDT

SEQ ID NO: 2208320 - protein, 19 aa, Cryptosporidium hominis
SRALCSCAKKTLKDLKNNK

SEQ ID NO: 2208321 - protein, 24 aa, Cryptosporidium hominis
SRASISGLISFVFQIISEEKVETE

SEQ ID NO: 2208322 - protein, 29 aa, Cryptosporidium hominis
SRATFKITCFRILRKLYREGSVSLRSSVL

SEQ ID NO: 2208323 - protein, 18 aa, Cryptosporidium hominis
SRIKSIRSILESELSGYL

SEQ ID NO: 2208324 - protein, 26 aa, Cryptosporidium hominis
SRILFSRLRPFISFQSTFIPLKMSEF

SEQ ID NO: 2208325 - protein, 24 aa, Cryptosporidium hominis
SRKFKLRNPLGLDYSKRWNSIIDL

SEQ ID NO: 2208326 - protein, 22 aa, Cryptosporidium hominis
SRKTLLQFCRDVCYKYFTDEAR

SEQ ID NO: 2208327 - protein, 20 aa, Cryptosporidium hominis
SRLGLCLRTKITENWDSLKS

SEQ ID NO: 2208328 - protein, 21 aa, Cryptosporidium hominis
SRLPISISKGFIKSQTHNKMD

SEQ ID NO: 2208329 - protein, 17 aa, Cryptosporidium hominis
SRLYKYNLSIIYNYARS

SEQ ID NO: 2208330 - protein, 25 aa, Cryptosporidium hominis
SRNRRFKFRFGEVPIDSSIETSSSS

SEQ ID NO: 2208331 - protein, 18 aa, Cryptosporidium hominis
SRPARSVGRVAIKSRARC

SEQ ID NO: 2208332 - protein, 17 aa, Cryptosporidium hominis
SRPGQYFRHLQTTVEQD

SEQ ID NO: 2208333 - protein, 20 aa, Cryptosporidium hominis
SRPIPIPARSGSNKGPSSPS

SEQ ID NO: 2208334 - protein, 20 aa, Cryptosporidium hominis
SRPPPPVPQRPIGSLRPVAP

SEQ ID NO: 2208335 - protein, 18 aa, Cryptosporidium hominis
SRPPSGFPNQITQKAVMV

SEQ ID NO: 2208336 - protein, 21 aa, Cryptosporidium hominis
SRSKSLLGRIFSRKKKNKPDE

SEQ ID NO: 2208337 - protein, 19 aa, Cryptosporidium hominis
SRSPYAEWCLPKFVENNPF

SEQ ID NO: 2208338 - protein, 18 aa, Cryptosporidium hominis
SRVKMLIEHFEKENARNV

SEQ ID NO: 2208339 - protein, 22 aa, Cryptosporidium hominis
SRWELLKMKHFYIEKKEKILME

SEQ ID NO: 2208340 - protein, 18 aa, Cryptosporidium hominis
SSASFLVMFLMEFAEKYL

SEQ ID NO: 2208341 - protein, 26 aa, Cryptosporidium hominis
SSDLKIAAFRLLRRCMSDPSNALDFL

SEQ ID NO: 2208342 - protein, 24 aa, Cryptosporidium hominis
SSDRCLLMLGWHFRSHLRQVFQSY

SEQ ID NO: 2208343 - protein, 21 aa, Cryptosporidium hominis
SSEAFGLWIDQVYNFTIKSLE

SEQ ID NO: 2208344 - protein, 19 aa, Cryptosporidium hominis
SSFDYRLVGIDKDNNSFFP

SEQ ID NO: 2208345 - protein, 20 aa, Cryptosporidium hominis
SSFELPELVHAYKLNDGFFD

SEQ ID NO: 2208346 - protein, 24 aa, Cryptosporidium hominis
SSFRKLLSCFGCCKGKCKKKKSKK

SEQ ID NO: 2208347 - protein, 23 aa, Cryptosporidium hominis
SSIEEMMILLAFERILTQKTASS

SEQ ID NO: 2208348 - protein, 23 aa, Cryptosporidium hominis
SSIKSVKLIYCEDDSDLLQDNRY

SEQ ID NO: 2208349 - protein, 26 aa, Cryptosporidium hominis
SSISKKCSPGLCSEGCIPQVTSEESE

SEQ ID NO: 2208350 - protein, 25 aa, Cryptosporidium hominis
SSKGDLRAACLVASAIAPGRPFAPL

SEQ ID NO: 2208351 - protein, 26 aa, Cryptosporidium hominis
SSKVYSPKLARAISRLEKKKTTTHAI

SEQ ID NO: 2208352 - protein, 26 aa, Cryptosporidium hominis
SSLMKYSVEMFVIAGMFVSGEEGAET

SEQ ID NO: 2208353 - protein, 25 aa, Cryptosporidium hominis
SSLNSRCTSIAWGSFNLEENALGLI

SEQ ID NO: 2208354 - protein, 19 aa, Cryptosporidium hominis
SSMLPSCGIELPKRPKKSY

SEQ ID NO: 2208355 - protein, 25 aa, Cryptosporidium hominis
SSMYRKCLRALWDMFQYDDEINLKI

SEQ ID NO: 2208356 - protein, 24 aa, Cryptosporidium hominis
SSNTRFQINLPFYDKMDLEKYNIY

SEQ ID NO: 2208357 - protein, 23 aa, Cryptosporidium hominis
SSQAKICYKKWKTVKQSLKSLEA

SEQ ID NO: 2208358 - protein, 24 aa, Cryptosporidium hominis
SSRRHCKGILSSIGIVPEEELIQI

SEQ ID NO: 2208359 - protein, 23 aa, Cryptosporidium hominis
SSSFYKNCKDLNCKGQCLKPLEE

SEQ ID NO: 2208360 - protein, 19 aa, Cryptosporidium hominis
SSSPPFVIIYWDSVSDSLS

SEQ ID NO: 2208361 - protein, 23 aa, Cryptosporidium hominis
SSTKPLPVIPSFLLSTSKNEENS

SEQ ID NO: 2208362 - protein, 24 aa, Cryptosporidium hominis
SSTWGLNAGEAWFNSSVAKGGDAN

SEQ ID NO: 2208363 - protein, 22 aa, Cryptosporidium hominis
SSVLFYDFSYDITMYSHFKILK

SEQ ID NO: 2208364 - protein, 25 aa, Cryptosporidium hominis
SSYELYGFRVAMMIRSERIGAIAPL

SEQ ID NO: 2208365 - protein, 25 aa, Cryptosporidium hominis
STAILGELSFKYSLDGIRSGIIDSE

SEQ ID NO: 2208366 - protein, 18 aa, Cryptosporidium hominis
STCIGELKHGEFCSLTCP

SEQ ID NO: 2208367 - protein, 24 aa, Cryptosporidium hominis
STFWKVLLGNIFLIILCLSNVYST

SEQ ID NO: 2208368 - protein, 17 aa, Cryptosporidium hominis
STGKTWERPSGAQGNNN

SEQ ID NO: 2208369 - protein, 24 aa, Cryptosporidium hominis
STLAYRNSISLGFLFSKTEDILSR

SEQ ID NO: 2208370 - protein, 18 aa, Cryptosporidium hominis
STSDFGLLEPQFLPGTIT

SEQ ID NO: 2208371 - protein, 18 aa, Cryptosporidium hominis
STSFFACSIDYYLINIPT

SEQ ID NO: 2208372 - protein, 25 aa, Cryptosporidium hominis
STYSIEYSIQWELRIKDMQDTYLYL

SEQ ID NO: 2208373 - protein, 24 aa, Cryptosporidium hominis
SVERRLYIASLLGFDFNNASTTAN

SEQ ID NO: 2208374 - protein, 28 aa, Cryptosporidium hominis
SVGRVAIKSRARCSGIIVLCKTGPLETG

SEQ ID NO: 2208375 - protein, 18 aa, Cryptosporidium hominis
SVIVLILAIVISSNYCFG

SEQ ID NO: 2208376 - protein, 18 aa, Cryptosporidium hominis
SVKIPPFVLSKFYGSPTY

SEQ ID NO: 2208377 - protein, 24 aa, Cryptosporidium hominis
SVLRPLRGFRCMGSMGRSKTKKNN

SEQ ID NO: 2208378 - protein, 21 aa, Cryptosporidium hominis
SVNGLLKYRVSIWGIPLSSYK

SEQ ID NO: 2208379 - protein, 23 aa, Cryptosporidium hominis
SVNRISGFIYFTLNDQIFASFPD

SEQ ID NO: 2208380 - protein, 25 aa, Cryptosporidium hominis
SVPKYGKPFLRKGPIRPPSSPPPLS

SEQ ID NO: 2208381 - protein, 25 aa, Cryptosporidium hominis
SVPLIKLPNFNLPIFGIPPTPPQVL

SEQ ID NO: 2208382 - protein, 18 aa, Cryptosporidium hominis
SVPTMPIPNPTASSTTVD

SEQ ID NO: 2208383 - protein, 19 aa, Cryptosporidium hominis
SVTLFCRDLINSVTNPGKT

SEQ ID NO: 2208384 - protein, 21 aa, Cryptosporidium hominis
SVVAYGECIKRLNGINSALDV

SEQ ID NO: 2208385 - protein, 23 aa, Cryptosporidium hominis
SVVCASCNNLLRHGIYDPPMSSS

SEQ ID NO: 2208386 - protein, 25 aa, Cryptosporidium hominis
SVVKGCPNAGFVVVCQFDSAVNLSK

SEQ ID NO: 2208387 - protein, 19 aa, Cryptosporidium hominis
SWFFRLWSESTVLTSPVLY

SEQ ID NO: 2208388 - protein, 17 aa, Cryptosporidium hominis
SWGANWGNKGYAKIRRG

SEQ ID NO: 2208389 - protein, 21 aa, Cryptosporidium hominis
SWNDFQFWPSLALDVTDRPKM

SEQ ID NO: 2208390 - protein, 25 aa, Cryptosporidium hominis
SYNILKICKDHRRLKQEQQKLIITW

SEQ ID NO: 2208391 - protein, 18 aa, Cryptosporidium hominis
SYTLIGLFGDSIEFKNPK

SEQ ID NO: 2208392 - protein, 26 aa, Cryptosporidium hominis
SYTNSFCSLLGCKDGRGYAGSGDGEC

SEQ ID NO: 2208393 - protein, 21 aa, Cryptosporidium hominis
TAKVLGVRANTRFVVDKLVAK

SEQ ID NO: 2208394 - protein, 19 aa, Cryptosporidium hominis
TAPGTAQICCDFVQEIHAS

SEQ ID NO: 2208395 - protein, 20 aa, Cryptosporidium hominis
TDKYTYRYWVLESDQGVICM

SEQ ID NO: 2208396 - protein, 19 aa, Cryptosporidium hominis
TDLNGGYVYGSKIKGVSRT

SEQ ID NO: 2208397 - protein, 20 aa, Cryptosporidium hominis
TDQKCKIEVCDLCCNSAFDG

SEQ ID NO: 2208398 - protein, 23 aa, Cryptosporidium hominis
TDVKFKIILISTILESLHVANFT

SEQ ID NO: 2208399 - protein, 24 aa, Cryptosporidium hominis
TEGCCLAFGCPDFVVNGDFLSPPA

SEQ ID NO: 2208400 - protein, 20 aa, Cryptosporidium hominis
TEKFILKHDSLLLLVPKVLP

SEQ ID NO: 2208401 - protein, 17 aa, Cryptosporidium hominis
TELFVRTGPYKYVTLQP

SEQ ID NO: 2208402 - protein, 25 aa, Cryptosporidium hominis
TELPFRKGSRFKIYLSCQDAPHSQK

SEQ ID NO: 2208403 - protein, 17 aa, Cryptosporidium hominis
TENGEVYLWGSYKDSGG

SEQ ID NO: 2208404 - protein, 25 aa, Cryptosporidium hominis
TERELKIKSALIARRVKMLKKMSSQ

SEQ ID NO: 2208405 - protein, 26 aa, Cryptosporidium hominis
TEWTLKLPRWRSSPLGLPPDHPVNAQ

SEQ ID NO: 2208406 - protein, 21 aa, Cryptosporidium hominis
TFAKQDLKSGFKLDTINIPPF

SEQ ID NO: 2208407 - protein, 25 aa, Cryptosporidium hominis
TFEWSKEGFVGKYLRTMKLAIRVND

SEQ ID NO: 2208408 - protein, 22 aa, Cryptosporidium hominis
TFLGRRVAFEVAMVDAMAHYTV

SEQ ID NO: 2208409 - protein, 18 aa, Cryptosporidium hominis
TFSLPLTYKIFLPDDVLP

SEQ ID NO: 2208410 - protein, 17 aa, Cryptosporidium hominis
TGKRWPRIYKIELTKIP

SEQ ID NO: 2208411 - protein, 25 aa, Cryptosporidium hominis
TGMFPRFEHSTELTILLDQHSVSNK

SEQ ID NO: 2208412 - protein, 25 aa, Cryptosporidium hominis
TGQSIKRGGIIVGISDSIKEEQDLM

SEQ ID NO: 2208413 - protein, 23 aa, Cryptosporidium hominis
TGRLRFLQFTSAYGLEDINDPQF

SEQ ID NO: 2208414 - protein, 20 aa, Cryptosporidium hominis
TGTCSIDGILPVLKSSNSQS

SEQ ID NO: 2208415 - protein, 18 aa, Cryptosporidium hominis
TGTCSLGSVVDSDFNVRG

SEQ ID NO: 2208416 - protein, 24 aa, Cryptosporidium hominis
TGVKVLFHGGGKYPAKYLLPGMKV

SEQ ID NO: 2208417 - protein, 20 aa, Cryptosporidium hominis
THILCANAIHLGSPNYRTVY

SEQ ID NO: 2208418 - protein, 23 aa, Cryptosporidium hominis
TIHHPIDIFKIFFADENELETGI

SEQ ID NO: 2208419 - protein, 22 aa, Cryptosporidium hominis
TIITSRLWIKYSNEPDILRKIY

SEQ ID NO: 2208420 - protein, 17 aa, Cryptosporidium hominis
TIIYSVVREVFFGIILY

SEQ ID NO: 2208421 - protein, 23 aa, Cryptosporidium hominis
TIKRVDDQFIVIVKKLKQKSNEV

SEQ ID NO: 2208422 - protein, 24 aa, Cryptosporidium hominis
TINYLKSIIFSISYIKTDSVISKY

SEQ ID NO: 2208423 - protein, 21 aa, Cryptosporidium hominis
TISILLFKGVWYIYEGKGYYS

SEQ ID NO: 2208424 - protein, 20 aa, Cryptosporidium hominis
TISVIPWKVINNTILNLVPE

SEQ ID NO: 2208425 - protein, 25 aa, Cryptosporidium hominis
TITAKRRKGVFSKCVEFHGQKENCE

SEQ ID NO: 2208426 - protein, 20 aa, Cryptosporidium hominis
TIVSELDFGNGEEVKDLDKS

SEQ ID NO: 2208427 - protein, 22 aa, Cryptosporidium hominis
TKAVDFMDEFHLLEISLSRSGL

SEQ ID NO: 2208428 - protein, 23 aa, Cryptosporidium hominis
TKIACNACIYRPVVSNLNTHFYG

SEQ ID NO: 2208429 - protein, 17 aa, Cryptosporidium hominis
TKILFLILESMYPNRKL

SEQ ID NO: 2208430 - protein, 24 aa, Cryptosporidium hominis
TKLLSFDPSNKFALSITNGPYIDE

SEQ ID NO: 2208431 - protein, 21 aa, Cryptosporidium hominis
TKLMLLQPFIIFSCIEVVKQQ

SEQ ID NO: 2208432 - protein, 24 aa, Cryptosporidium hominis
TKPEATFPFCFENVEFPLDPTRSS

SEQ ID NO: 2208433 - protein, 18 aa, Cryptosporidium hominis
TKPLIPKFPIEEESHSAA

SEQ ID NO: 2208434 - protein, 22 aa, Cryptosporidium hominis
TKSLCIKFNLINSKKENIDDIS

SEQ ID NO: 2208435 - protein, 19 aa, Cryptosporidium hominis
TKYTKERILAITLESNEGF

SEQ ID NO: 2208436 - protein, 18 aa, Cryptosporidium hominis
TLASYKWMVKNWPKKKWY

SEQ ID NO: 2208437 - protein, 22 aa, Cryptosporidium hominis
TLEEIDEIFKLDSILKDLNLIL

SEQ ID NO: 2208438 - protein, 17 aa, Cryptosporidium hominis
TLGSIKMDLEKISENIS

SEQ ID NO: 2208439 - protein, 19 aa, Cryptosporidium hominis
TLIAMNFAILPKWRDSWQD

SEQ ID NO: 2208440 - protein, 18 aa, Cryptosporidium hominis
TLINCYKHPISPISTNSE

SEQ ID NO: 2208441 - protein, 18 aa, Cryptosporidium hominis
TLLAVPFVVDRESSFEMD

SEQ ID NO: 2208442 - protein, 23 aa, Cryptosporidium hominis
TLLRIKPILLYWQDEGIINQYPL

SEQ ID NO: 2208443 - protein, 24 aa, Cryptosporidium hominis
TLSKRLGSVFPVFADHQALVTWKG

SEQ ID NO: 2208444 - protein, 17 aa, Cryptosporidium hominis
TLTCSKLLTNENIYQTL

SEQ ID NO: 2208445 - protein, 24 aa, Cryptosporidium hominis
TMSTGFKMWWNEVVNSVGAESTNQ

SEQ ID NO: 2208446 - protein, 21 aa, Cryptosporidium hominis
TNLIHFCLAGNFLDVNNAANG

SEQ ID NO: 2208447 - protein, 18 aa, Cryptosporidium hominis
TNLKRLGYSIANGRPSAI

SEQ ID NO: 2208448 - protein, 20 aa, Cryptosporidium hominis
TPKYTVIFMHGFVVDSSALY

SEQ ID NO: 2208449 - protein, 22 aa, Cryptosporidium hominis
TPPKPSISWKAFKLKLYEEFRI

SEQ ID NO: 2208450 - protein, 21 aa, Cryptosporidium hominis
TPPSGVAMYSYFLLAESPPFV

SEQ ID NO: 2208451 - protein, 18 aa, Cryptosporidium hominis
TPPSPPPSPFYASISDET

SEQ ID NO: 2208452 - protein, 25 aa, Cryptosporidium hominis
TPSPNIPPPPSFPAPPPPFTLSGTP

SEQ ID NO: 2208453 - protein, 20 aa, Cryptosporidium hominis
TPSPNIPSPPSFPAPPPPYI

SEQ ID NO: 2208454 - protein, 25 aa, Cryptosporidium hominis
TQILVFSCFLCFFAAVESSVNKIDT

SEQ ID NO: 2208455 - protein, 24 aa, Cryptosporidium hominis
TQKLKNRFKGMIQSAGESIKNFIT

SEQ ID NO: 2208456 - protein, 29 aa, Cryptosporidium hominis
TRFFKRLFKKPSCIRCVKSKKQSKKQKSN

SEQ ID NO: 2208457 - protein, 19 aa, Cryptosporidium hominis
TRGDGLYGFELLFEKTGDY

SEQ ID NO: 2208458 - protein, 20 aa, Cryptosporidium hominis
TRLSSMYHEGVIKGEYELFI

SEQ ID NO: 2208459 - protein, 31 aa, Cryptosporidium hominis
TRPIFSSSVLRLGILKNWRKSKSKSISNKIL

SEQ ID NO: 2208460 - protein, 36 aa, Cryptosporidium hominis
TRQYPWSSIPWHKVDHAMVITGWGWETYGNERIPYW

SEQ ID NO: 2208461 - protein, 20 aa, Cryptosporidium hominis
TRSGICSLLPQNLREKAIQL

SEQ ID NO: 2208462 - protein, 21 aa, Cryptosporidium hominis
TRTADKWDQGCFVECEGDMSR

SEQ ID NO: 2208463 - protein, 19 aa, Cryptosporidium hominis
TRTIALLKPFVPLFPSYTL

SEQ ID NO: 2208464 - protein, 25 aa, Cryptosporidium hominis
TRTTVAGLMYFYSLLVSEFASKAPN

SEQ ID NO: 2208465 - protein, 20 aa, Cryptosporidium hominis
TSAASICLSHKIFSISSSNV

SEQ ID NO: 2208466 - protein, 18 aa, Cryptosporidium hominis
TSIDKMRPIKEDDDDSNF

SEQ ID NO: 2208467 - protein, 17 aa, Cryptosporidium hominis
TSKFFVRMVRHLDHYDQ

SEQ ID NO: 2208468 - protein, 20 aa, Cryptosporidium hominis
TSKLGFLGMCSPSVSSCVRH

SEQ ID NO: 2208469 - protein, 18 aa, Cryptosporidium hominis
TSLNGMAISGFRFNEIKK

SEQ ID NO: 2208470 - protein, 21 aa, Cryptosporidium hominis
TSMLPWGAFKIENNPIKEVEK

SEQ ID NO: 2208471 - protein, 36 aa, Cryptosporidium hominis
TSNFAFRYLVSRVFGPKAGEAMKIYSNNNFANSASI

SEQ ID NO: 2208472 - protein, 18 aa, Cryptosporidium hominis
TSPKFKMPFLSRFQLTPH

SEQ ID NO: 2208473 - protein, 22 aa, Cryptosporidium hominis
TSPQFFCTKGYTFNELDSTCIY

SEQ ID NO: 2208474 - protein, 22 aa, Cryptosporidium hominis
TSPSPRLNVPFVQYSGRDLKAG

SEQ ID NO: 2208475 - protein, 26 aa, Cryptosporidium hominis
TSRISNLKFRTHRKGSYKRRKNKSNK

SEQ ID NO: 2208476 - protein, 23 aa, Cryptosporidium hominis
TSSSRSSLLLSRQSSVSASSVFS

SEQ ID NO: 2208477 - protein, 25 aa, Cryptosporidium hominis
TSSSSCRQIAWGLVIIEGQNISILN

SEQ ID NO: 2208478 - protein, 25 aa, Cryptosporidium hominis
TSTEMFKLILVNGTEYALVNNETAY

SEQ ID NO: 2208479 - protein, 31 aa, Cryptosporidium hominis
TTIKQLKRLIAWRRSYIPSSIHLEIIGIDRR

SEQ ID NO: 2208480 - protein, 20 aa, Cryptosporidium hominis
TTLPNGLRKDLFPYVIEHNK

SEQ ID NO: 2208481 - protein, 21 aa, Cryptosporidium hominis
TTNHPWKLVIEVNSDYNKLQS

SEQ ID NO: 2208482 - protein, 17 aa, Cryptosporidium hominis
TTPEYPGSLDIPEETGP

SEQ ID NO: 2208483 - protein, 20 aa, Cryptosporidium hominis
TVACFVFFFYSKETSAAELP

SEQ ID NO: 2208484 - protein, 24 aa, Cryptosporidium hominis
TVLNEFKNRFALINSSLNAQLGGL

SEQ ID NO: 2208485 - protein, 24 aa, Cryptosporidium hominis
TWIDFSVVMDIKFRMKRRGMFLET

SEQ ID NO: 2208486 - protein, 19 aa, Cryptosporidium hominis
TWLSLFAHYAKLQMDSIDF

SEQ ID NO: 2208487 - protein, 22 aa, Cryptosporidium hominis
TWTSRVMFGYSLDLSVVKRYSL

SEQ ID NO: 2208488 - protein, 17 aa, Cryptosporidium hominis
TYFNLRPARLYNELERA

SEQ ID NO: 2208489 - protein, 27 aa, Cryptosporidium hominis
TYQLKNLRIDWEFPPFTYSIAAKVDGE

SEQ ID NO: 2208490 - protein, 20 aa, Cryptosporidium hominis
TYRHICSVVKNIRRGEIKGL

SEQ ID NO: 2208491 - protein, 18 aa, Cryptosporidium hominis
TYSIFCQLMCLIKLLNLF

SEQ ID NO: 2208492 - protein, 17 aa, Cryptosporidium hominis
TYSLLFTFLKSVIFCQE

SEQ ID NO: 2208493 - protein, 18 aa, Cryptosporidium hominis
TYTTRWWKASPIGQKLAV

SEQ ID NO: 2208494 - protein, 24 aa, Cryptosporidium hominis
VADMKSLILEMAFNYNSLYSPLGM

SEQ ID NO: 2208495 - protein, 26 aa, Cryptosporidium hominis
VAFNLRYNLKKCKKSVSNMLDGKATM

SEQ ID NO: 2208496 - protein, 19 aa, Cryptosporidium hominis
VAHIEMGRLVTKVENPIVL

SEQ ID NO: 2208497 - protein, 26 aa, Cryptosporidium hominis
VAHRYMGRLVEWFNIIQASLDDDIIK

SEQ ID NO: 2208498 - protein, 18 aa, Cryptosporidium hominis
VAIMPIQLYQDWRKDENK

SEQ ID NO: 2208499 - protein, 24 aa, Cryptosporidium hominis
VANGIPRWIGEKLYPDSFEYPCVS

SEQ ID NO: 2208500 - protein, 18 aa, Cryptosporidium hominis
VAVAISRLIASASESSEN

SEQ ID NO: 2208501 - protein, 21 aa, Cryptosporidium hominis
VCASCDNLLRHGIYDPPMSSS

SEQ ID NO: 2208502 - protein, 17 aa, Cryptosporidium hominis
VCSREVFAPYSLSCTAD

SEQ ID NO: 2208503 - protein, 17 aa, Cryptosporidium hominis
VCVILYLTHGTIEANSI

SEQ ID NO: 2208504 - protein, 22 aa, Cryptosporidium hominis
VDCYRLRLENWILEQELVLISE

SEQ ID NO: 2208505 - protein, 18 aa, Cryptosporidium hominis
VDLFNMTFSYGRYDSDLT

SEQ ID NO: 2208506 - protein, 25 aa, Cryptosporidium hominis
VDLMARFHGQWSLFYKMFRQKFRQI

SEQ ID NO: 2208507 - protein, 22 aa, Cryptosporidium hominis
VDLRDLCAVASKMSMESFLRTR

SEQ ID NO: 2208508 - protein, 20 aa, Cryptosporidium hominis
VDVPTLFFWGAEDRLCPLSS

SEQ ID NO: 2208509 - protein, 19 aa, Cryptosporidium hominis
VEACLGGQHFQRSMMGLAL

SEQ ID NO: 2208510 - protein, 18 aa, Cryptosporidium hominis
VECDRVWQEVILGITEGT

SEQ ID NO: 2208511 - protein, 25 aa, Cryptosporidium hominis
VEDSGCCSCCSCSSKRKKTKKGENS

SEQ ID NO: 2208512 - protein, 17 aa, Cryptosporidium hominis
VEICKSFQISKNPEDLV

SEQ ID NO: 2208513 - protein, 19 aa, Cryptosporidium hominis
VEICRRFLVSPLIGIARDV

SEQ ID NO: 2208514 - protein, 19 aa, Cryptosporidium hominis
VERKLLLNFADFGNSNNNY

SEQ ID NO: 2208515 - protein, 21 aa, Cryptosporidium hominis
VESLSLLSMVLLVHLNGVKSQ

SEQ ID NO: 2208516 - protein, 23 aa, Cryptosporidium hominis
VETDCLRLIGAENLFILDEGVLS

SEQ ID NO: 2208517 - protein, 19 aa, Cryptosporidium hominis
VFIDPDFSRGMGFSLLNKY

SEQ ID NO: 2208518 - protein, 19 aa, Cryptosporidium hominis
VFLMDKFDWNSSFTVEGQS

SEQ ID NO: 2208519 - protein, 19 aa, Cryptosporidium hominis
VFQKFRLRLDVSDNISKYE

SEQ ID NO: 2208520 - protein, 18 aa, Cryptosporidium hominis
VFRALRRIVSDDFVTTLL

SEQ ID NO: 2208521 - protein, 18 aa, Cryptosporidium hominis
VFRKYGIEYFKFMNEALK

SEQ ID NO: 2208522 - protein, 18 aa, Cryptosporidium hominis
VFSKRDFLSLKSMLLSNF

SEQ ID NO: 2208523 - protein, 22 aa, Cryptosporidium hominis
VGDSYKFGMSYEFKSEDDSELI

SEQ ID NO: 2208524 - protein, 17 aa, Cryptosporidium hominis
VGSKVQPITSFHILAKI

SEQ ID NO: 2208525 - protein, 17 aa, Cryptosporidium hominis
VGSSAFIGNSLRYEFIN

SEQ ID NO: 2208526 - protein, 18 aa, Cryptosporidium hominis
VHGFPPFLREGKDIVSAG

SEQ ID NO: 2208527 - protein, 22 aa, Cryptosporidium hominis
VIECSCQGLAPYALIGTINSTE

SEQ ID NO: 2208528 - protein, 17 aa, Cryptosporidium hominis
VIFPKLKRSGLRKKEVL

SEQ ID NO: 2208529 - protein, 18 aa, Cryptosporidium hominis
VISIKDLGQFLLLSIDKM

SEQ ID NO: 2208530 - protein, 19 aa, Cryptosporidium hominis
VISTRLGYISDLSAAMLVC

SEQ ID NO: 2208531 - protein, 18 aa, Cryptosporidium hominis
VIVCGRSSLGNGGKTAKC

SEQ ID NO: 2208532 - protein, 22 aa, Cryptosporidium hominis
VKADALGVPMFSGFNHSILDET

SEQ ID NO: 2208533 - protein, 19 aa, Cryptosporidium hominis
VKALRLGWAPTLIGYSAQG

SEQ ID NO: 2208534 - protein, 18 aa, Cryptosporidium hominis
VKDVGGSCPTDINRTGGI

SEQ ID NO: 2208535 - protein, 20 aa, Cryptosporidium hominis
VKGEQLIRCDSSPMNLCGSD

SEQ ID NO: 2208536 - protein, 23 aa, Cryptosporidium hominis
VKGRLRLQFLKKRGFSAREGSLE

SEQ ID NO: 2208537 - protein, 19 aa, Cryptosporidium hominis
VKISTQYLPNGRELVQKCI

SEQ ID NO: 2208538 - protein, 25 aa, Cryptosporidium hominis
VKLGCKKPNCIKRLSKNDEPKYSSD

SEQ ID NO: 2208539 - protein, 18 aa, Cryptosporidium hominis
VKNWPKKKWYMKLDDDTF

SEQ ID NO: 2208540 - protein, 21 aa, Cryptosporidium hominis
VKQSERINVEPAKETKIENEV

SEQ ID NO: 2208541 - protein, 36 aa, Cryptosporidium hominis
VKQVFERFQFCLSHRRFQSTLSFEFLRDIVRFLPFQ

SEQ ID NO: 2208542 - protein, 23 aa, Cryptosporidium hominis
VKSFAYKYGHYFKRRIKKIEIFL

SEQ ID NO: 2208543 - protein, 18 aa, Cryptosporidium hominis
VKSKFNVKFSINLNIYGA

SEQ ID NO: 2208544 - protein, 26 aa, Cryptosporidium hominis
VKSLKEYRLPIGYIPIARRYQRLKES

SEQ ID NO: 2208545 - protein, 21 aa, Cryptosporidium hominis
VLEDNAFRWGGNYICQELVQE

SEQ ID NO: 2208546 - protein, 20 aa, Cryptosporidium hominis
VLFAFLFRAINIFAQNNDAK

SEQ ID NO: 2208547 - protein, 20 aa, Cryptosporidium hominis
VLFEYGIERFLGSAAITLFS

SEQ ID NO: 2208548 - protein, 19 aa, Cryptosporidium hominis
VLIFNVCVEVLKFSHDYFY

SEQ ID NO: 2208549 - protein, 20 aa, Cryptosporidium hominis
VLLECLILFGERYSPEYIFA

SEQ ID NO: 2208550 - protein, 18 aa, Cryptosporidium hominis
VLLLFLLICSVRIVEGNN

SEQ ID NO: 2208551 - protein, 18 aa, Cryptosporidium hominis
VLSFCSAVYISIYSEKGV

SEQ ID NO: 2208552 - protein, 24 aa, Cryptosporidium hominis
VLVSYELFSAILLGKEGNNGANKD

SEQ ID NO: 2208553 - protein, 19 aa, Cryptosporidium hominis
VMFLMEFAEKYLFFPGKVE

SEQ ID NO: 2208554 - protein, 20 aa, Cryptosporidium hominis
VMIDREVKSKFNVKFSINLN

SEQ ID NO: 2208555 - protein, 27 aa, Cryptosporidium hominis
VNAQLFLKYRSSILILVLVFLAILDGS

SEQ ID NO: 2208556 - protein, 20 aa, Cryptosporidium hominis
VNFPFGARLMRFRIDRKTAG

SEQ ID NO: 2208557 - protein, 21 aa, Cryptosporidium hominis
VNFRKIHPFRIMGSQHSSFIE

SEQ ID NO: 2208558 - protein, 25 aa, Cryptosporidium hominis
VNFRPGEEWFGRRGLGGSHAEETFC

SEQ ID NO: 2208559 - protein, 24 aa, Cryptosporidium hominis
VNLELKLIFPIPYQKNLWRYKLTE

SEQ ID NO: 2208560 - protein, 24 aa, Cryptosporidium hominis
VNLLTLMLLQGHFGQIGCKSSDKG

SEQ ID NO: 2208561 - protein, 25 aa, Cryptosporidium hominis
VNMGLKALLGCILLISGLLSIVDES

SEQ ID NO: 2208562 - protein, 17 aa, Cryptosporidium hominis
VNQTIRVPVTVPVNSTK

SEQ ID NO: 2208563 - protein, 19 aa, Cryptosporidium hominis
VNRDLKGLAILLSNEKQED

SEQ ID NO: 2208564 - protein, 21 aa, Cryptosporidium hominis
VNVILEFFDIYFLNPEKVFSK

SEQ ID NO: 2208565 - protein, 19 aa, Cryptosporidium hominis
VPLFPSYTLIGLFGDSIEF

SEQ ID NO: 2208566 - protein, 19 aa, Cryptosporidium hominis
VPMYKKRAVNLAFIQALTL

SEQ ID NO: 2208567 - protein, 19 aa, Cryptosporidium hominis
VPSGIKFDYIIVGAGANGL

SEQ ID NO: 2208568 - protein, 19 aa, Cryptosporidium hominis
VPSNFQWGFYLGDGTINLV

SEQ ID NO: 2208569 - protein, 26 aa, Cryptosporidium hominis
VQFRNYCFAFVWTLWKSGNEPDLRIS

SEQ ID NO: 2208570 - protein, 29 aa, Cryptosporidium hominis
VQHLWWNYYGVVVGWDWELNAPKQWADNI

SEQ ID NO: 2208571 - protein, 30 aa, Cryptosporidium hominis
VQNINLLKMNICYPPNIPYSQVKPEKKYYL

SEQ ID NO: 2208572 - protein, 22 aa, Cryptosporidium hominis
VQNSFHLLRVMFITNIDLGLTL

SEQ ID NO: 2208573 - protein, 27 aa, Cryptosporidium hominis
VQNSRKCFRMYFDGSPVVMCAKSDEER

SEQ ID NO: 2208574 - protein, 20 aa, Cryptosporidium hominis
VRAKASIVPITFYSTKELDS

SEQ ID NO: 2208575 - protein, 18 aa, Cryptosporidium hominis
VRANTRFVVDKLVAKFCR

SEQ ID NO: 2208576 - protein, 28 aa, Cryptosporidium hominis
VRGFSEFRTYKGIFSELVFHDKTASNAK

SEQ ID NO: 2208577 - protein, 20 aa, Cryptosporidium hominis
VRGKELMYLQLLERAFVKFF

SEQ ID NO: 2208578 - protein, 33 aa, Cryptosporidium hominis
VRGLKLLKNVLCKYPRINLRYYISPTIEEYKQF

SEQ ID NO: 2208579 - protein, 24 aa, Cryptosporidium hominis
VRVDLYYGMKGIRLHLGNGEQNRR

SEQ ID NO: 2208580 - protein, 23 aa, Cryptosporidium hominis
VSAHQKGVMSIEFSPIDPNLLLS

SEQ ID NO: 2208581 - protein, 20 aa, Cryptosporidium hominis
VSAPPHLFKVILAVNPRKEK

SEQ ID NO: 2208582 - protein, 22 aa, Cryptosporidium hominis
VSDIQKGGPIFSFEGETSVPKY

SEQ ID NO: 2208583 - protein, 23 aa, Cryptosporidium hominis
VSDISWLEGYLMETDRLKGDWAT

SEQ ID NO: 2208584 - protein, 22 aa, Cryptosporidium hominis
VSDKKMYDEWLKTMTVSEEIIL

SEQ ID NO: 2208585 - protein, 18 aa, Cryptosporidium hominis
VSEELWSSILTRVSSIMC

SEQ ID NO: 2208586 - protein, 18 aa, Cryptosporidium hominis
VSEIGGPFVFVDTKEKYS

SEQ ID NO: 2208587 - protein, 22 aa, Cryptosporidium hominis
VSEYRTGTIALWNSGFDLKSIS

SEQ ID NO: 2208588 - protein, 34 aa, Cryptosporidium hominis
VSIAKFCKGLFERFILRHIEWLRITIKSIESDNI

SEQ ID NO: 2208589 - protein, 22 aa, Cryptosporidium hominis
VSIAPFFLEVDLFYSENLEQIL

SEQ ID NO: 2208590 - protein, 17 aa, Cryptosporidium hominis
VSLALKIRPYLTNFRYL

SEQ ID NO: 2208591 - protein, 17 aa, Cryptosporidium hominis
VSLEPTLEFSLYNSGIF

SEQ ID NO: 2208592 - protein, 25 aa, Cryptosporidium hominis
VSLLKLRNGISFGQNLRKMLCCCRG

SEQ ID NO: 2208593 - protein, 28 aa, Cryptosporidium hominis
VSNLPLNPPEIWLGSKSPEEFVADCKRV

SEQ ID NO: 2208594 - protein, 24 aa, Cryptosporidium hominis
VSNSIICLCIRLLTLAQYPPFWTS

SEQ ID NO: 2208595 - protein, 28 aa, Cryptosporidium hominis
VSPCDGSIVWLSERWLQYGKSSGLNTSQ

SEQ ID NO: 2208596 - protein, 17 aa, Cryptosporidium hominis
VSPTMAWQFKLWYNRGN

SEQ ID NO: 2208597 - protein, 18 aa, Cryptosporidium hominis
VSPWGWDIISQFVEACQE

SEQ ID NO: 2208598 - protein, 26 aa, Cryptosporidium hominis
VSSKRYVCSGIRVLSGCLNNPYTRNY

SEQ ID NO: 2208599 - protein, 19 aa, Cryptosporidium hominis
VSSLICTYGSRILSKPDSS

SEQ ID NO: 2208600 - protein, 19 aa, Cryptosporidium hominis
VTSKFLLIFYKYILLLLRF

SEQ ID NO: 2208601 - protein, 18 aa, Cryptosporidium hominis
VVALTCLSLLFLNGDIRR

SEQ ID NO: 2208602 - protein, 17 aa, Cryptosporidium hominis
VVGAFSIIVIKKPYGEM

SEQ ID NO: 2208603 - protein, 17 aa, Cryptosporidium hominis
VVKNIRRGEIKGLIPKG

SEQ ID NO: 2208604 - protein, 19 aa, Cryptosporidium hominis
VVTKKSSPLFVERAKRMKI

SEQ ID NO: 2208605 - protein, 18 aa, Cryptosporidium hominis
VWIMKKWSSSQCISQLAL

SEQ ID NO: 2208606 - protein, 17 aa, Cryptosporidium hominis
VWNREREILYSLSKEFW

SEQ ID NO: 2208607 - protein, 19 aa, Cryptosporidium hominis
VYIRKSCEKEFPGFSTPMV

SEQ ID NO: 2208608 - protein, 18 aa, Cryptosporidium hominis
VYLSHLFPEEDSLPLKHF

SEQ ID NO: 2208609 - protein, 21 aa, Cryptosporidium hominis
VYNCRSALMTLGVEKFPGTKS

SEQ ID NO: 2208610 - protein, 25 aa, Cryptosporidium hominis
VYNFTIKSLEEWSVLPNSKHYLLGL

SEQ ID NO: 2208611 - protein, 24 aa, Cryptosporidium hominis
VYSGEYYKSLGLNFDPQRLQESFE

SEQ ID NO: 2208612 - protein, 24 aa, Cryptosporidium hominis
VYSSQCLFRRLPVIQDNTSRQLVM

SEQ ID NO: 2208613 - protein, 22 aa, Cryptosporidium hominis
WARNIPRVSITNMINLISHTGN

SEQ ID NO: 2208614 - protein, 18 aa, Cryptosporidium hominis
WDARLIDLSFVWVPSALK

SEQ ID NO: 2208615 - protein, 20 aa, Cryptosporidium hominis
WDNVQGLKFLSFAYFENTGY

SEQ ID NO: 2208616 - protein, 18 aa, Cryptosporidium hominis
WDSLKSVLLPTSYFDFSV

SEQ ID NO: 2208617 - protein, 24 aa, Cryptosporidium hominis
WDTLDYVVAAAFQYLRIRRHLYQV

SEQ ID NO: 2208618 - protein, 27 aa, Cryptosporidium hominis
WDVYDYVICLCFYYLIKRERIRIDWFT

SEQ ID NO: 2208619 - protein, 21 aa, Cryptosporidium hominis
WFAVILCISLLNGISIWDRIQ

SEQ ID NO: 2208620 - protein, 17 aa, Cryptosporidium hominis
WIPSCPNNTLSISVSKY

SEQ ID NO: 2208621 - protein, 31 aa, Cryptosporidium hominis
WKAFKLKLYEEFRIGLNLQQRIKLNSELDLS

SEQ ID NO: 2208622 - protein, 17 aa, Cryptosporidium hominis
WKFDKKLKIWVRGNNNR

SEQ ID NO: 2208623 - protein, 24 aa, Cryptosporidium hominis
WKFERYCVFAEKLLNDNGENDFIK

SEQ ID NO: 2208624 - protein, 24 aa, Cryptosporidium hominis
WKFFTNVLELLLFQPGRAMGTPWP

SEQ ID NO: 2208625 - protein, 21 aa, Cryptosporidium hominis
WKIIREVSILKLLNGYSDHHV

SEQ ID NO: 2208626 - protein, 19 aa, Cryptosporidium hominis
WLLKEHIKNSLNLIKVNSK

SEQ ID NO: 2208627 - protein, 18 aa, Cryptosporidium hominis
WNDICLISESTIPEEYDN

SEQ ID NO: 2208628 - protein, 19 aa, Cryptosporidium hominis
WNIETSQIFYSDIKQSCIP

SEQ ID NO: 2208629 - protein, 28 aa, Cryptosporidium hominis
WNSMKPCLKECITLLGLLILIRMYSVRA

SEQ ID NO: 2208630 - protein, 24 aa, Cryptosporidium hominis
WPNETEKWAKISFLESGSITETNF

SEQ ID NO: 2208631 - protein, 18 aa, Cryptosporidium hominis
WRFEKDHERYLSESQKSL

SEQ ID NO: 2208632 - protein, 30 aa, Cryptosporidium hominis
WSKYDLASSVFKYSELDADLPRDNKFASKP

SEQ ID NO: 2208633 - protein, 20 aa, Cryptosporidium hominis
WSLPFKFIKCDIDFEENVLE

SEQ ID NO: 2208634 - protein, 20 aa, Cryptosporidium hominis
WSPNIPGIFATASHNDKVSI

SEQ ID NO: 2208635 - protein, 17 aa, Cryptosporidium hominis
WSQEDYMVISFIIFLSK

SEQ ID NO: 2208636 - protein, 21 aa, Cryptosporidium hominis
WTKSYRYTAFFKYINEHEDIN

SEQ ID NO: 2208637 - protein, 19 aa, Cryptosporidium hominis
WTQQHICEGIYLLNTYRGE

SEQ ID NO: 2208638 - protein, 22 aa, Cryptosporidium hominis
WWEKELDIVTAIILTIFKYQYR

SEQ ID NO: 2208639 - protein, 18 aa, Cryptosporidium hominis
WYMEIIIYLIKFIVNNTQ

SEQ ID NO: 2208640 - protein, 18 aa, Cryptosporidium hominis
YAANWGMKCMNGQFQHSP

SEQ ID NO: 2208641 - protein, 27 aa, Cryptosporidium hominis
YAPAINEWLFLTVAYNFNEKRVVMYIN

SEQ ID NO: 2208642 - protein, 22 aa, Cryptosporidium hominis
YAQKIIVGILMARREKGYGPAA

SEQ ID NO: 2208643 - protein, 20 aa, Cryptosporidium hominis
YAYPSRKNCFCRDESSEKCE

SEQ ID NO: 2208644 - protein, 17 aa, Cryptosporidium hominis
YCHTTLLGWWDSYPESV

SEQ ID NO: 2208645 - protein, 17 aa, Cryptosporidium hominis
YCIKCRALTEYMLIKSR

SEQ ID NO: 2208646 - protein, 21 aa, Cryptosporidium hominis
YCKDDEIISYIGVNNQVVDHS

SEQ ID NO: 2208647 - protein, 23 aa, Cryptosporidium hominis
YDASKFRKSLGVFERSYAAVTDI

SEQ ID NO: 2208648 - protein, 17 aa, Cryptosporidium hominis
YDDLNKICIYEVKLHEV

SEQ ID NO: 2208649 - protein, 24 aa, Cryptosporidium hominis
YDEIPEISLCILRNSGFQLLQSIK

SEQ ID NO: 2208650 - protein, 22 aa, Cryptosporidium hominis
YDELCIAVSQMSKMFSDKSRKP

SEQ ID NO: 2208651 - protein, 24 aa, Cryptosporidium hominis
YDFPELHLLASSLFFEISKHDKYL

SEQ ID NO: 2208652 - protein, 24 aa, Cryptosporidium hominis
YDGKRTVEAFKEFINEHSSFPQEK

SEQ ID NO: 2208653 - protein, 22 aa, Cryptosporidium hominis
YDKSRLQEELSIEFETKTDSIL

SEQ ID NO: 2208654 - protein, 20 aa, Cryptosporidium hominis
YDLACPAGYALVGDKCATTR

SEQ ID NO: 2208655 - protein, 18 aa, Cryptosporidium hominis
YDQFRVIRKAWNGVSSIM

SEQ ID NO: 2208656 - protein, 17 aa, Cryptosporidium hominis
YDSEMLEFASRSCPNTS

SEQ ID NO: 2208657 - protein, 18 aa, Cryptosporidium hominis
YDTLRWQQATCVLESEGY

SEQ ID NO: 2208658 - protein, 20 aa, Cryptosporidium hominis
YDVFISKCGYEYRLYGIENK

SEQ ID NO: 2208659 - protein, 17 aa, Cryptosporidium hominis
YEDGNCYSTILNEVSGE

SEQ ID NO: 2208660 - protein, 24 aa, Cryptosporidium hominis
YEKSIKLVSRMVGSLVNKKIPYSN

SEQ ID NO: 2208661 - protein, 25 aa, Cryptosporidium hominis
YENTFKIIFFWGMKDDLVPFAPALD

SEQ ID NO: 2208662 - protein, 18 aa, Cryptosporidium hominis
YESLLKRNLELFNQTLLY

SEQ ID NO: 2208663 - protein, 21 aa, Cryptosporidium hominis
YFFVDPNYFWSLNATTQVETK

SEQ ID NO: 2208664 - protein, 26 aa, Cryptosporidium hominis
YFGEMIAISFIRPVLCINANDCLKNR

SEQ ID NO: 2208665 - protein, 17 aa, Cryptosporidium hominis
YFGFLVYVIGSSVNAND

SEQ ID NO: 2208666 - protein, 23 aa, Cryptosporidium hominis
YFKSNYIFELSFVYDESREYNIV

SEQ ID NO: 2208667 - protein, 26 aa, Cryptosporidium hominis
YFKTDCTRSLFDFLVAQRFIKPTLNI

SEQ ID NO: 2208668 - protein, 25 aa, Cryptosporidium hominis
YFNAWRRSFGYNGFIVYPRIKTSVL

SEQ ID NO: 2208669 - protein, 17 aa, Cryptosporidium hominis
YFNYDVVTQLTLRQEGV

SEQ ID NO: 2208670 - protein, 19 aa, Cryptosporidium hominis
YGFTEIREIFLLEKDHAIH

SEQ ID NO: 2208671 - protein, 18 aa, Cryptosporidium hominis
YGKKVLRFPENFVASKGV

SEQ ID NO: 2208672 - protein, 18 aa, Cryptosporidium hominis
YHGEVIKGIRGGAGYLMS

SEQ ID NO: 2208673 - protein, 20 aa, Cryptosporidium hominis
YHQWKVGPIILTKKETENIG

SEQ ID NO: 2208674 - protein, 19 aa, Cryptosporidium hominis
YIGELYPDILRIEKKISCS

SEQ ID NO: 2208675 - protein, 17 aa, Cryptosporidium hominis
YIIIPLLYLTFNYQSTF

SEQ ID NO: 2208676 - protein, 18 aa, Cryptosporidium hominis
YIKELIKNFCESVYSVKV

SEQ ID NO: 2208677 - protein, 25 aa, Cryptosporidium hominis
YILKTVKIKLYFLAKRVNVAYSTLY

SEQ ID NO: 2208678 - protein, 20 aa, Cryptosporidium hominis
YILNCFLSAIKMLWKEGREQ

SEQ ID NO: 2208679 - protein, 26 aa, Cryptosporidium hominis
YINTKKFEIDFCIRLLKNFQNQQENM

SEQ ID NO: 2208680 - protein, 18 aa, Cryptosporidium hominis
YKFFSEIISSYNYSVTPN

SEQ ID NO: 2208681 - protein, 23 aa, Cryptosporidium hominis
YKFRIHPKDALKHPFFTIHPSKH

SEQ ID NO: 2208682 - protein, 26 aa, Cryptosporidium hominis
YKGAGFPVLCGESIRLLHSATEKFVQ

SEQ ID NO: 2208683 - protein, 19 aa, Cryptosporidium hominis
YKIKVNSLFNVYKQDYGRE

SEQ ID NO: 2208684 - protein, 19 aa, Cryptosporidium hominis
YKNAGSWFRITVLEDNPYE

SEQ ID NO: 2208685 - protein, 34 aa, Cryptosporidium hominis
YKNVASLLVEFPFKVKEVFSKFSAPIRVNYPNID

SEQ ID NO: 2208686 - protein, 17 aa, Cryptosporidium hominis
YKQHCMISPHGRNPRNP

SEQ ID NO: 2208687 - protein, 19 aa, Cryptosporidium hominis
YKYFIEFSDKVCPDCSLKV

SEQ ID NO: 2208688 - protein, 19 aa, Cryptosporidium hominis
YKYYLESIGKSPAAQSSQY

SEQ ID NO: 2208689 - protein, 28 aa, Cryptosporidium hominis
YLAKRKIHKLKKCLKKIARIEEEEEEAH

SEQ ID NO: 2208690 - protein, 18 aa, Cryptosporidium hominis
YLATRTFTRKDLTVTGVK

SEQ ID NO: 2208691 - protein, 18 aa, Cryptosporidium hominis
YLDFCKIGIWYSKEISNL

SEQ ID NO: 2208692 - protein, 25 aa, Cryptosporidium hominis
YLERKKPELVLSIGLSEAIDNNNLN

SEQ ID NO: 2208693 - protein, 17 aa, Cryptosporidium hominis
YLFHFKQSKTAAIEAVN

SEQ ID NO: 2208694 - protein, 28 aa, Cryptosporidium hominis
YLILFRDLKHIFGFGNPKIFSLNTCPVP

SEQ ID NO: 2208695 - protein, 27 aa, Cryptosporidium hominis
YLISAFLIEMWHRFRAAESLFDPTRYK

SEQ ID NO: 2208696 - protein, 18 aa, Cryptosporidium hominis
YLKKKLSKQIPDVTILMN

SEQ ID NO: 2208697 - protein, 17 aa, Cryptosporidium hominis
YLSEKFVASEYFKTDCT

SEQ ID NO: 2208698 - protein, 18 aa, Cryptosporidium hominis
YLVSLAIQCGDEFFKPIG

SEQ ID NO: 2208699 - protein, 19 aa, Cryptosporidium hominis
YLYEQGYGRTKKRVILGWS

SEQ ID NO: 2208700 - protein, 25 aa, Cryptosporidium hominis
YMDGWGSVCSDGFNSVSERVACTQM

SEQ ID NO: 2208701 - protein, 17 aa, Cryptosporidium hominis
YMISPKKAYLIWKETLI

SEQ ID NO: 2208702 - protein, 19 aa, Cryptosporidium hominis
YMKFIRPTTENVLIKAEAT

SEQ ID NO: 2208703 - protein, 17 aa, Cryptosporidium hominis
YNKEASISYSKDVELSP

SEQ ID NO: 2208704 - protein, 17 aa, Cryptosporidium hominis
YNLIKLFIDDRMAEEVT

SEQ ID NO: 2208705 - protein, 19 aa, Cryptosporidium hominis
YNLNPVYKFDPKKSNEEYY

SEQ ID NO: 2208706 - protein, 27 aa, Cryptosporidium hominis
YNQAIQWLRLGKHIPKAVLFTNKDSSS

SEQ ID NO: 2208707 - protein, 24 aa, Cryptosporidium hominis
YNQFFPRVKFITRIVEKNKENKDS

SEQ ID NO: 2208708 - protein, 22 aa, Cryptosporidium hominis
YPEEYSHIAGTLFSAMYQYFPI

SEQ ID NO: 2208709 - protein, 17 aa, Cryptosporidium hominis
YPILLRIGKMNDKIQGS

SEQ ID NO: 2208710 - protein, 17 aa, Cryptosporidium hominis
YPPSRFAYLHGETVEAA

SEQ ID NO: 2208711 - protein, 17 aa, Cryptosporidium hominis
YPRIKTSVLEKMYNIAK

SEQ ID NO: 2208712 - protein, 25 aa, Cryptosporidium hominis
YPSSLPLNERWELISSCIPGKDSSQ

SEQ ID NO: 2208713 - protein, 20 aa, Cryptosporidium hominis
YQECLKKLTGSILVTKGLEI

SEQ ID NO: 2208714 - protein, 23 aa, Cryptosporidium hominis
YQKDARFNLVYVDTIHVYLSVLK

SEQ ID NO: 2208715 - protein, 22 aa, Cryptosporidium hominis
YRFDEICKAFELMGDNPPREKC

SEQ ID NO: 2208716 - protein, 17 aa, Cryptosporidium hominis
YRIEIAKSPIISIVSHS

SEQ ID NO: 2208717 - protein, 18 aa, Cryptosporidium hominis
YRLIRYFQKSGVPFIFRA

SEQ ID NO: 2208718 - protein, 25 aa, Cryptosporidium hominis
YRLLPPGPIKYLFHFKQSKTAAIEA

SEQ ID NO: 2208719 - protein, 20 aa, Cryptosporidium hominis
YRQSPAIWYSSLKKVMYLDF

SEQ ID NO: 2208720 - protein, 21 aa, Cryptosporidium hominis
YRSETKFPFGSIKPLWYRQIP

SEQ ID NO: 2208721 - protein, 18 aa, Cryptosporidium hominis
YRYEGVSLGNLLFDIDDN

SEQ ID NO: 2208722 - protein, 38 aa, Cryptosporidium hominis
YSALLNCCGEVFIWGMKDCCGLEGQLIKNGNEKILKER

SEQ ID NO: 2208723 - protein, 18 aa, Cryptosporidium hominis
YSCNHGSTNMCISEFDLS

SEQ ID NO: 2208724 - protein, 17 aa, Cryptosporidium hominis
YSCVICLNNICDEDLVR

SEQ ID NO: 2208725 - protein, 24 aa, Cryptosporidium hominis
YSDSELKLELNLNVGASLTGSVGT

SEQ ID NO: 2208726 - protein, 24 aa, Cryptosporidium hominis
YSEMCSGCMDLLPVWNSISSKIAS

SEQ ID NO: 2208727 - protein, 22 aa, Cryptosporidium hominis
YSEVEYDLIWLLVPMEPGKGEE

SEQ ID NO: 2208728 - protein, 18 aa, Cryptosporidium hominis
YSGPYVRTSATAGKVSPR

SEQ ID NO: 2208729 - protein, 24 aa, Cryptosporidium hominis
YSLILSQFSEIFLKSSRKDITRRF

SEQ ID NO: 2208730 - protein, 21 aa, Cryptosporidium hominis
YSVVREVFFGIILYCLPNVSR

SEQ ID NO: 2208731 - protein, 19 aa, Cryptosporidium hominis
YTAIIHLLKLEGSRIKNLR

SEQ ID NO: 2208732 - protein, 20 aa, Cryptosporidium hominis
YTGKAIQIFGPRPWNMDFLS

SEQ ID NO: 2208733 - protein, 18 aa, Cryptosporidium hominis
YTTPIAMLLPLFRPTSMD

SEQ ID NO: 2208734 - protein, 17 aa, Cryptosporidium hominis
YTYPRKYISNILIENAV

SEQ ID NO: 2208735 - protein, 25 aa, Cryptosporidium hominis
YVLERCNNGTFLPHIGEILEKYQSD

SEQ ID NO: 2208736 - protein, 24 aa, Cryptosporidium hominis
YWEYLPRNKFSILINADNSKAREE

SEQ ID NO: 2208737 - protein, 34 aa, Cryptosporidium hominis
YWILPRCAPEPIRVWCDIKFGASYYIWNDGGNPG

SEQ ID NO: 2208738 - protein, 18 aa, Cryptosporidium hominis
YWQYFGSSSKLFISYQSQ

SEQ ID NO: 2208739 - protein, 18 aa, Cryptosporidium hominis
YWTPFGIDPALLKKDIDS

SEQ ID NO: 2208740 - protein, 17 aa, Cryptosporidium hominis
YYNPFLYEFELNTKIVC

SEQ ID NO: 2208741 - protein, 17 aa, Cryptosporidium hominis
GFIPLFMVENFTETAAF

SEQ ID NO: 2208742 - protein, 17 aa, Cryptosporidium hominis
KPLTRKGLEDLIKKHKT

SEQ ID NO: 2208743 - protein, 17 aa, Cryptosporidium hominis
AALQWWVDYGNGGKKPK

SEQ ID NO: 2208744 - protein, 18 aa, Cryptosporidium hominis
ACCSCSRSGNTKEPKPEK

SEQ ID NO: 2208745 - protein, 17 aa, Cryptosporidium hominis
AELSLKVVYDMLKRREA

SEQ ID NO: 2208746 - protein, 23 aa, Cryptosporidium hominis
AIDANGILFVWGMNLTGQIGIKK

SEQ ID NO: 2208747 - protein, 18 aa, Cryptosporidium hominis
AILPKWRDSWQDEIRKPS

SEQ ID NO: 2208748 - protein, 26 aa, Cryptosporidium hominis
AKQELNGIMRGCMWCTQEVMCNTLSS

SEQ ID NO: 2208749 - protein, 18 aa, Cryptosporidium hominis
ALLVYFVATNAVRIRGGD

SEQ ID NO: 2208750 - protein, 19 aa, Cryptosporidium hominis
APEPIRVWCDIKFGASYYI

SEQ ID NO: 2208751 - protein, 23 aa, Cryptosporidium hominis
AQLFLKYRSSILILVLVFLAILD

SEQ ID NO: 2208752 - protein, 17 aa, Cryptosporidium hominis
ARCRGVKAIPARIVGYD

SEQ ID NO: 2208753 - protein, 18 aa, Cryptosporidium hominis
ARISLRLEAQYSLAHSLI

SEQ ID NO: 2208754 - protein, 19 aa, Cryptosporidium hominis
CAPGSRLTGLLVHTSTKIP

SEQ ID NO: 2208755 - protein, 17 aa, Cryptosporidium hominis
CCSCCSCSSKRKKTKKG

SEQ ID NO: 2208756 - protein, 17 aa, Cryptosporidium hominis
CFLMLGFEVEFLENPIL

SEQ ID NO: 2208757 - protein, 19 aa, Cryptosporidium hominis
CFRTIRFLLKEQWKRHESQ

SEQ ID NO: 2208758 - protein, 26 aa, Cryptosporidium hominis
CGGKFCSRLRKALCCCTGGDDEDQQQ

SEQ ID NO: 2208759 - protein, 20 aa, Cryptosporidium hominis
CHITCPREYAPVCATDAETY

SEQ ID NO: 2208760 - protein, 17 aa, Cryptosporidium hominis
CIFCFSIFLTLYSRIQC

SEQ ID NO: 2208761 - protein, 25 aa, Cryptosporidium hominis
CVGWCAPECRPTWLGDGQCDIDCFN

SEQ ID NO: 2208762 - protein, 21 aa, Cryptosporidium hominis
DFEALMGMSFIKLKQILKELS

SEQ ID NO: 2208763 - protein, 18 aa, Cryptosporidium hominis
DGFFDIFAFYFFKDYAAI

SEQ ID NO: 2208764 - protein, 22 aa, Cryptosporidium hominis
DGSIALCFLAFIIFLVVKVGGT

SEQ ID NO: 2208765 - protein, 17 aa, Cryptosporidium hominis
DKHIGWQVTRRAIDVAA

SEQ ID NO: 2208766 - protein, 17 aa, Cryptosporidium hominis
DLFSMGFGNLFGMGSGR

SEQ ID NO: 2208767 - protein, 19 aa, Cryptosporidium hominis
DNFLNKWIEVFGENCSDDY

SEQ ID NO: 2208768 - protein, 22 aa, Cryptosporidium hominis
DPKVRIGLFKGYISLEEMQSRT

SEQ ID NO: 2208769 - protein, 19 aa, Cryptosporidium hominis
DPNHGFIPLFMVENFTETA

SEQ ID NO: 2208770 - protein, 18 aa, Cryptosporidium hominis
DRFVNGFSSIELENNNSG

SEQ ID NO: 2208771 - protein, 18 aa, Cryptosporidium hominis
EATFPFCFENVEFPLDPT

SEQ ID NO: 2208772 - protein, 17 aa, Cryptosporidium hominis
ECISCSYSLLPKSVQIG

SEQ ID NO: 2208773 - protein, 18 aa, Cryptosporidium hominis
EFFKSCFRTIRFLLKEQW

SEQ ID NO: 2208774 - protein, 19 aa, Cryptosporidium hominis
EHFGKLIVSHELCFEKNKL

SEQ ID NO: 2208775 - protein, 17 aa, Cryptosporidium hominis
EIGCSFHSIGWISGSRD

SEQ ID NO: 2208776 - protein, 20 aa, Cryptosporidium hominis
EIHRPPKLLFFFGSMNKFEA

SEQ ID NO: 2208777 - protein, 18 aa, Cryptosporidium hominis
EMCLFDCTLLNKKDACEE

SEQ ID NO: 2208778 - protein, 19 aa, Cryptosporidium hominis
ENNKRPKIRLGLLEDINDL

SEQ ID NO: 2208779 - protein, 23 aa, Cryptosporidium hominis
ENTFKIIFFWGMKDDLVPFAPAL

SEQ ID NO: 2208780 - protein, 19 aa, Cryptosporidium hominis
EQIFKCLILLRLDKYSRRI

SEQ ID NO: 2208781 - protein, 20 aa, Cryptosporidium hominis
ESKLRIGLFGVEVPKTANNF

SEQ ID NO: 2208782 - protein, 19 aa, Cryptosporidium hominis
ESWIGDGWCDKECFSDDCG

SEQ ID NO: 2208783 - protein, 18 aa, Cryptosporidium hominis
EVPLDWQSRVFIKYYPEE

SEQ ID NO: 2208784 - protein, 17 aa, Cryptosporidium hominis
EVVSTPGERLVSMFRKS

SEQ ID NO: 2208785 - protein, 22 aa, Cryptosporidium hominis
EYLECRFDFVVPRKACVNDCFQ

SEQ ID NO: 2208786 - protein, 19 aa, Cryptosporidium hominis
EYLPRNKFSILINADNSKA

SEQ ID NO: 2208787 - protein, 23 aa, Cryptosporidium hominis
EYPCPRSTPGLNWMISSKLVDTG

SEQ ID NO: 2208788 - protein, 18 aa, Cryptosporidium hominis
FEIDFCIRLLKNFQNQQE

SEQ ID NO: 2208789 - protein, 18 aa, Cryptosporidium hominis
FIEACIRPYVSFKGNEIM

SEQ ID NO: 2208790 - protein, 17 aa, Cryptosporidium hominis
FIFICIFLVFCKLPYIS

SEQ ID NO: 2208791 - protein, 24 aa, Cryptosporidium hominis
FKFTRREFLPLFSVFFQKKAIRNL

SEQ ID NO: 2208792 - protein, 20 aa, Cryptosporidium hominis
FKRLFKKPSCIRCVKSKKQS

SEQ ID NO: 2208793 - protein, 22 aa, Cryptosporidium hominis
FKYRKCKYWSWRATDFSCSLKS

SEQ ID NO: 2208794 - protein, 17 aa, Cryptosporidium hominis
FLLKWIIFSYIVINNIN

SEQ ID NO: 2208795 - protein, 17 aa, Cryptosporidium hominis
FLLLLSRNARLIENNLG

SEQ ID NO: 2208796 - protein, 18 aa, Cryptosporidium hominis
FPPFVKWPYRGGSGETLY

SEQ ID NO: 2208797 - protein, 20 aa, Cryptosporidium hominis
FPTDIPQVFTIKSVPKAWDH

SEQ ID NO: 2208798 - protein, 19 aa, Cryptosporidium hominis
FQIFETWNRLVSILPFVLH

SEQ ID NO: 2208799 - protein, 17 aa, Cryptosporidium hominis
FQSTLSFEFLRDIVRFL

SEQ ID NO: 2208800 - protein, 17 aa, Cryptosporidium hominis
FRLELISSLTNIYLQLA

SEQ ID NO: 2208801 - protein, 20 aa, Cryptosporidium hominis
FRNYCFAFVWTLWKSGNEPD

SEQ ID NO: 2208802 - protein, 19 aa, Cryptosporidium hominis
FSNRVCLFETFKLIEEKRN

SEQ ID NO: 2208803 - protein, 17 aa, Cryptosporidium hominis
FVGRGKIPAGINLGSSI

SEQ ID NO: 2208804 - protein, 17 aa, Cryptosporidium hominis
FVRMFGCKIYRSVPNVL

SEQ ID NO: 2208805 - protein, 19 aa, Cryptosporidium hominis
FVSYVDFDFCYNRVESGSL

SEQ ID NO: 2208806 - protein, 20 aa, Cryptosporidium hominis
FYVPWCVYCRGIMPEFEKAA

SEQ ID NO: 2208807 - protein, 19 aa, Cryptosporidium hominis
GCAAPCPYQRYFIQTDRIL

SEQ ID NO: 2208808 - protein, 20 aa, Cryptosporidium hominis
GCPNAGFVVVCQFDSAVNLS

SEQ ID NO: 2208809 - protein, 17 aa, Cryptosporidium hominis
GDNFYRWGVSSVDDPIW

SEQ ID NO: 2208810 - protein, 17 aa, Cryptosporidium hominis
GEIPYGITFEGLHRKPT

SEQ ID NO: 2208811 - protein, 20 aa, Cryptosporidium hominis
GELWIPFAISQIIYRKSKVL

SEQ ID NO: 2208812 - protein, 20 aa, Cryptosporidium hominis
GFSLYMIFIFLLGDVTGIHI

SEQ ID NO: 2208813 - protein, 23 aa, Cryptosporidium hominis
GGISLKFYIRMCTNLINHFPRLH

SEQ ID NO: 2208814 - protein, 19 aa, Cryptosporidium hominis
GKTRFSIPMLKLGELLEQN

SEQ ID NO: 2208815 - protein, 17 aa, Cryptosporidium hominis
GNCRTWMIGNGICDNSC

SEQ ID NO: 2208816 - protein, 24 aa, Cryptosporidium hominis
GNLSFRLPLNHSFERSDIILSGKC

SEQ ID NO: 2208817 - protein, 17 aa, Cryptosporidium hominis
GNSEWRSASNLSPEQQI

SEQ ID NO: 2208818 - protein, 19 aa, Cryptosporidium hominis
GRVIRKLASGLECDKCELC

SEQ ID NO: 2208819 - protein, 17 aa, Cryptosporidium hominis
GSLNFALSVQKFAIVVQ

SEQ ID NO: 2208820 - protein, 17 aa, Cryptosporidium hominis
GWWGISIDITRPVVINS

SEQ ID NO: 2208821 - protein, 19 aa, Cryptosporidium hominis
HKVDHAMVITGWGWETYGN

SEQ ID NO: 2208822 - protein, 22 aa, Cryptosporidium hominis
HVNVCAIVKAVGRQPDGGLILL

SEQ ID NO: 2208823 - protein, 18 aa, Cryptosporidium hominis
IAEDYYRYALNSMKMAKD

SEQ ID NO: 2208824 - protein, 17 aa, Cryptosporidium hominis
IAISFIRPVLCINANDC

SEQ ID NO: 2208825 - protein, 18 aa, Cryptosporidium hominis
ICKEAGYSTGRWDVYNDR

SEQ ID NO: 2208826 - protein, 20 aa, Cryptosporidium hominis
IDVCVQRGFFAEALLLAVKF

SEQ ID NO: 2208827 - protein, 17 aa, Cryptosporidium hominis
IECKFIKNLIFILIIFS

SEQ ID NO: 2208828 - protein, 19 aa, Cryptosporidium hominis
IEMWHRFRAAESLFDPTRY

SEQ ID NO: 2208829 - protein, 24 aa, Cryptosporidium hominis
IFLVFCKLPYISRCEQLESEEIPT

SEQ ID NO: 2208830 - protein, 19 aa, Cryptosporidium hominis
IFSNIQFKYCYNMPLLKTT

SEQ ID NO: 2208831 - protein, 19 aa, Cryptosporidium hominis
IFYFVLGLILDFGKVSCIP

SEQ ID NO: 2208832 - protein, 20 aa, Cryptosporidium hominis
IGLLRYGFLYALINEINNQF

SEQ ID NO: 2208833 - protein, 17 aa, Cryptosporidium hominis
IGPQLMRVDEELSKLQE

SEQ ID NO: 2208834 - protein, 17 aa, Cryptosporidium hominis
IGRRICCCCCSTSCDSD

SEQ ID NO: 2208835 - protein, 24 aa, Cryptosporidium hominis
IHKSGCKIVPFSTLLSLPRHSFEI

SEQ ID NO: 2208836 - protein, 18 aa, Cryptosporidium hominis
IIFKLKLGKIIKNENKKP

SEQ ID NO: 2208837 - protein, 22 aa, Cryptosporidium hominis
IIFSILICKVRLEVVIENEDPK

SEQ ID NO: 2208838 - protein, 17 aa, Cryptosporidium hominis
IISELLLQRGSLKEIKE

SEQ ID NO: 2208839 - protein, 19 aa, Cryptosporidium hominis
IKCFLLILFFNLATFFLVH

SEQ ID NO: 2208840 - protein, 18 aa, Cryptosporidium hominis
IKFTYRWNAPGALKIENE

SEQ ID NO: 2208841 - protein, 18 aa, Cryptosporidium hominis
IKSLEEWSVLPNSKHYLL

SEQ ID NO: 2208842 - protein, 17 aa, Cryptosporidium hominis
IKSRARCSGIIVLCKTG

SEQ ID NO: 2208843 - protein, 18 aa, Cryptosporidium hominis
ILERIIELNLEYALPQVK

SEQ ID NO: 2208844 - protein, 18 aa, Cryptosporidium hominis
ILFRDLKHIFGFGNPKIF

SEQ ID NO: 2208845 - protein, 18 aa, Cryptosporidium hominis
ILFSRLRPFISFQSTFIP

SEQ ID NO: 2208846 - protein, 21 aa, Cryptosporidium hominis
ILVFSCFLCFFAAVESSVNKI

SEQ ID NO: 2208847 - protein, 26 aa, Cryptosporidium hominis
IMSFAPKLRPGRMQRRRDLFNEEEIE

SEQ ID NO: 2208848 - protein, 20 aa, Cryptosporidium hominis
IPDLRPYYRFYLQILVYIFH

SEQ ID NO: 2208849 - protein, 17 aa, Cryptosporidium hominis
IPFYLRQELIQSSNITP

SEQ ID NO: 2208850 - protein, 19 aa, Cryptosporidium hominis
IPNKFRIVNIWNEENPSLR

SEQ ID NO: 2208851 - protein, 20 aa, Cryptosporidium hominis
IPSEFWWKKVKGVKGKSKEK

SEQ ID NO: 2208852 - protein, 18 aa, Cryptosporidium hominis
IPYGITFEGLHRKPTTTV

SEQ ID NO: 2208853 - protein, 17 aa, Cryptosporidium hominis
IQVLGIRLFGRFQGINT

SEQ ID NO: 2208854 - protein, 19 aa, Cryptosporidium hominis
IRFVLPDGFTFLKSNDNEL

SEQ ID NO: 2208855 - protein, 17 aa, Cryptosporidium hominis
IRYEICKFGVIHKSGCK

SEQ ID NO: 2208856 - protein, 17 aa, Cryptosporidium hominis
ISILQWYFFFLLVILMA

SEQ ID NO: 2208857 - protein, 19 aa, Cryptosporidium hominis
ISKIPGFVRHTIFQGSYDM

SEQ ID NO: 2208858 - protein, 18 aa, Cryptosporidium hominis
IWLLFRIILEPVNGKNDS

SEQ ID NO: 2208859 - protein, 24 aa, Cryptosporidium hominis
KDKIVKFFFERRLKNYQEQCRKLA

SEQ ID NO: 2208860 - protein, 18 aa, Cryptosporidium hominis
KEDIETWMNLPLKLKLPV

SEQ ID NO: 2208861 - protein, 19 aa, Cryptosporidium hominis
KIHKLKKCLKKIARIEEEE

SEQ ID NO: 2208862 - protein, 19 aa, Cryptosporidium hominis
KIPSLWYLELIYCMHKGVT

SEQ ID NO: 2208863 - protein, 19 aa, Cryptosporidium hominis
KITCFRILRKLYREGSVSL

SEQ ID NO: 2208864 - protein, 19 aa, Cryptosporidium hominis
KKDYLEFIDALTFDQFYKY

SEQ ID NO: 2208865 - protein, 25 aa, Cryptosporidium hominis
KKFKCPRLIASFFRDRILGYSCPYL

SEQ ID NO: 2208866 - protein, 17 aa, Cryptosporidium hominis
KKKSWRKKTRKFKLEFL

SEQ ID NO: 2208867 - protein, 24 aa, Cryptosporidium hominis
KKYPEAYHPLALEIFSTISKEDIE

SEQ ID NO: 2208868 - protein, 17 aa, Cryptosporidium hominis
KLKLPVINYYFLLVATM

SEQ ID NO: 2208869 - protein, 20 aa, Cryptosporidium hominis
KLQFLEMFSRGGLESRAKPE

SEQ ID NO: 2208870 - protein, 25 aa, Cryptosporidium hominis
KMLEKRLEVLLKRFVALGCENPEAR

SEQ ID NO: 2208871 - protein, 20 aa, Cryptosporidium hominis
KNDPSTVCSYTFSNEFVDSD

SEQ ID NO: 2208872 - protein, 19 aa, Cryptosporidium hominis
KNFHWHVAEKITHYLIFLS

SEQ ID NO: 2208873 - protein, 18 aa, Cryptosporidium hominis
KNRFKGMIQSAGESIKNF

SEQ ID NO: 2208874 - protein, 18 aa, Cryptosporidium hominis
KNTFIFKNRYEEMKNTQS

SEQ ID NO: 2208875 - protein, 25 aa, Cryptosporidium hominis
KNYARWAVSFLKGWISSRNPFRYLC

SEQ ID NO: 2208876 - protein, 17 aa, Cryptosporidium hominis
KPLTRKGLEDLIKKHKA

SEQ ID NO: 2208877 - protein, 17 aa, Cryptosporidium hominis
KRGFRPITFHMMHDTSR

SEQ ID NO: 2208878 - protein, 22 aa, Cryptosporidium hominis
KRKLLFSWPRTRLRRSLLDSNR

SEQ ID NO: 2208879 - protein, 18 aa, Cryptosporidium hominis
KRLIAWRRSYIPSSIHLE

SEQ ID NO: 2208880 - protein, 18 aa, Cryptosporidium hominis
KRNLELFNQTLLYYRVNQ

SEQ ID NO: 2208881 - protein, 21 aa, Cryptosporidium hominis
KSKISWLIERCFIYTKKKDIN

SEQ ID NO: 2208882 - protein, 21 aa, Cryptosporidium hominis
KSKLLRRILGMKLKRVNNKIS

SEQ ID NO: 2208883 - protein, 17 aa, Cryptosporidium hominis
KTDCTRSLFDFLVAQRF

SEQ ID NO: 2208884 - protein, 19 aa, Cryptosporidium hominis
KTFGGQCLVQITSLQSTNA

SEQ ID NO: 2208885 - protein, 19 aa, Cryptosporidium hominis
LEADISYSRGRFVINVQSY

SEQ ID NO: 2208886 - protein, 17 aa, Cryptosporidium hominis
LEGTKLLVCTCDDFNYH

SEQ ID NO: 2208887 - protein, 17 aa, Cryptosporidium hominis
LFERFILRHIEWLRITI

SEQ ID NO: 2208888 - protein, 17 aa, Cryptosporidium hominis
LFFFAIYIMIGISNASD

SEQ ID NO: 2208889 - protein, 17 aa, Cryptosporidium hominis
LFWKMKTNLILTTDARF

SEQ ID NO: 2208890 - protein, 23 aa, Cryptosporidium hominis
LHMFSSQFYLYWSLSTPHLGCIS

SEQ ID NO: 2208891 - protein, 18 aa, Cryptosporidium hominis
LIAFEFCSVASNGLVGKN

SEQ ID NO: 2208892 - protein, 17 aa, Cryptosporidium hominis
LIFCRRIPCEFERNRDV

SEQ ID NO: 2208893 - protein, 27 aa, Cryptosporidium hominis
LIKSNRLSNGFVCMGILNGTEIWSREF

SEQ ID NO: 2208894 - protein, 21 aa, Cryptosporidium hominis
LIQAYRMLLIYSVLLDDAGIF

SEQ ID NO: 2208895 - protein, 17 aa, Cryptosporidium hominis
LIYKFCLNSWLGDGYCD

SEQ ID NO: 2208896 - protein, 19 aa, Cryptosporidium hominis
LKLLWRYISPHLIEIDMGG

SEQ ID NO: 2208897 - protein, 17 aa, Cryptosporidium hominis
LKLPRWRSSPLGLPPDH

SEQ ID NO: 2208898 - protein, 18 aa, Cryptosporidium hominis
LKLREFEKILSLKHSAAR

SEQ ID NO: 2208899 - protein, 17 aa, Cryptosporidium hominis
LKLSAQCNDCWAKTAHC

SEQ ID NO: 2208900 - protein, 25 aa, Cryptosporidium hominis
LKLYEEFRIGLNLQQRIKLNSELDL

SEQ ID NO: 2208901 - protein, 19 aa, Cryptosporidium hominis
LLFCCIYLVAAINGTKRKR

SEQ ID NO: 2208902 - protein, 17 aa, Cryptosporidium hominis
LLFIAITLLFISKVKSS

SEQ ID NO: 2208903 - protein, 18 aa, Cryptosporidium hominis
LLLIFLIQISWLKNSLVL

SEQ ID NO: 2208904 - protein, 21 aa, Cryptosporidium hominis
LLNLWFAYSFVFGNDLDSKKN

SEQ ID NO: 2208905 - protein, 24 aa, Cryptosporidium hominis
LLTLRKLRIIPGIIFRVKLSGSPI

SEQ ID NO: 2208906 - protein, 17 aa, Cryptosporidium hominis
LLVRLCHLFSFRIECLA

SEQ ID NO: 2208907 - protein, 17 aa, Cryptosporidium hominis
LNIKFTYRWNAPGALKI

SEQ ID NO: 2208908 - protein, 17 aa, Cryptosporidium hominis
LNSLFLLTGRDYSGERG

SEQ ID NO: 2208909 - protein, 18 aa, Cryptosporidium hominis
LPFWIFKVSDEFSIILIE

SEQ ID NO: 2208910 - protein, 19 aa, Cryptosporidium hominis
LPLNERWELISSCIPGKDS

SEQ ID NO: 2208911 - protein, 32 aa, Cryptosporidium hominis
LPRHSFEIWKSFGLVLQFEFLIAMTYSIEHEM

SEQ ID NO: 2208912 - protein, 17 aa, Cryptosporidium hominis
LQLFWNREVRMITDALV

SEQ ID NO: 2208913 - protein, 19 aa, Cryptosporidium hominis
LRYPEVVSTPGERLVSMFR

SEQ ID NO: 2208914 - protein, 17 aa, Cryptosporidium hominis
LSEVLAMHLRMRNRIVS

SEQ ID NO: 2208915 - protein, 18 aa, Cryptosporidium hominis
LSLLSGFSIIGLRSAGGC

SEQ ID NO: 2208916 - protein, 17 aa, Cryptosporidium hominis
LTLSLLAGFVFGTNENP

SEQ ID NO: 2208917 - protein, 17 aa, Cryptosporidium hominis
LTTCIKFLLSIYLGESL

SEQ ID NO: 2208918 - protein, 18 aa, Cryptosporidium hominis
LVCSSGFVLLGDRCALFT

SEQ ID NO: 2208919 - protein, 22 aa, Cryptosporidium hominis
LVSYELFSAILLGKEGNNGANK

SEQ ID NO: 2208920 - protein, 18 aa, Cryptosporidium hominis
MDVRIRFDDFSGFDLLLG

SEQ ID NO: 2208921 - protein, 18 aa, Cryptosporidium hominis
MKDCCGLEGQLIKNGNEK

SEQ ID NO: 2208922 - protein, 17 aa, Cryptosporidium hominis
MKWIKFVSERSSLKEVE

SEQ ID NO: 2208923 - protein, 18 aa, Cryptosporidium hominis
MSEGLGISKDSCFNPELL

SEQ ID NO: 2208924 - protein, 18 aa, Cryptosporidium hominis
MVGYGGRYIFKFLAVGSG

SEQ ID NO: 2208925 - protein, 17 aa, Cryptosporidium hominis
MVPPKPAVRRIFQAPGA

SEQ ID NO: 2208926 - protein, 24 aa, Cryptosporidium hominis
NDIFKCPNCDLEIFPSENEIEFNS

SEQ ID NO: 2208927 - protein, 23 aa, Cryptosporidium hominis
NDMKNSECLYDFLLGSISSFEST

SEQ ID NO: 2208928 - protein, 20 aa, Cryptosporidium hominis
NFAFRYLVSRVFGPKAGEAM

SEQ ID NO: 2208929 - protein, 20 aa, Cryptosporidium hominis
NFIKRLLKAILRIFRLGGKV

SEQ ID NO: 2208930 - protein, 17 aa, Cryptosporidium hominis
NGFKFSFGLYSNFIHFC

SEQ ID NO: 2208931 - protein, 24 aa, Cryptosporidium hominis
NINLLKMNICYPPNIPYSQVKPEK

SEQ ID NO: 2208932 - protein, 23 aa, Cryptosporidium hominis
NLKNQICEFSKIFDFYLISISKN

SEQ ID NO: 2208933 - protein, 18 aa, Cryptosporidium hominis
NLLFWKGKDMELIRDHIV

SEQ ID NO: 2208934 - protein, 19 aa, Cryptosporidium hominis
NNQLRCENGIFSPKVYCIA

SEQ ID NO: 2208935 - protein, 18 aa, Cryptosporidium hominis
NVPLRWDIVSGISSGGFN

SEQ ID NO: 2208936 - protein, 20 aa, Cryptosporidium hominis
PCGRCGFGAKCCYQNLCVGR

SEQ ID NO: 2208937 - protein, 19 aa, Cryptosporidium hominis
PEKSCPPGFVFSGKQCVQS

SEQ ID NO: 2208938 - protein, 20 aa, Cryptosporidium hominis
PGIHLHFGYWDGFRGRGNLI

SEQ ID NO: 2208939 - protein, 20 aa, Cryptosporidium hominis
PGKDSSQCLARYKLIRERLL

SEQ ID NO: 2208940 - protein, 18 aa, Cryptosporidium hominis
PISRFNISGIPEFISKAQ

SEQ ID NO: 2208941 - protein, 17 aa, Cryptosporidium hominis
PKAGLVLSNYQLPDGSQ

SEQ ID NO: 2208942 - protein, 18 aa, Cryptosporidium hominis
PKLARAISRLEKKKTTTH

SEQ ID NO: 2208943 - protein, 17 aa, Cryptosporidium hominis
PKRMVQDLCRLEEQDEE

SEQ ID NO: 2208944 - protein, 23 aa, Cryptosporidium hominis
PLKHFKSVLKYLLDIAVNDEPSK

SEQ ID NO: 2208945 - protein, 18 aa, Cryptosporidium hominis
PPNRIGLGPFKGVRSYET

SEQ ID NO: 2208946 - protein, 17 aa, Cryptosporidium hominis
PQYCSTMKLSLNRVGEK

SEQ ID NO: 2208947 - protein, 20 aa, Cryptosporidium hominis
PRCQCLPGYIGDGRTKGTGC

SEQ ID NO: 2208948 - protein, 22 aa, Cryptosporidium hominis
PRKKVRFDFELNQEYSLEDIQR

SEQ ID NO: 2208949 - protein, 20 aa, Cryptosporidium hominis
PSLWKSLPLILPKLPSYPEQ

SEQ ID NO: 2208950 - protein, 17 aa, Cryptosporidium hominis
PTYCILRAFIFVNDIVE

SEQ ID NO: 2208951 - protein, 18 aa, Cryptosporidium hominis
PVEEIINATFIYPGTQQP

SEQ ID NO: 2208952 - protein, 21 aa, Cryptosporidium hominis
PYFNHFCSLSFIKNLKLIRKN

SEQ ID NO: 2208953 - protein, 22 aa, Cryptosporidium hominis
QDSSCLRISILSLKSEVCESSD

SEQ ID NO: 2208954 - protein, 20 aa, Cryptosporidium hominis
QLFYILHCCDIPEFFEDRIG

SEQ ID NO: 2208955 - protein, 22 aa, Cryptosporidium hominis
QLKNLRIDWEFPPFTYSIAAKV

SEQ ID NO: 2208956 - protein, 25 aa, Cryptosporidium hominis
QRIALEWIHKYIVNFGGDPNRIILA

SEQ ID NO: 2208957 - protein, 19 aa, Cryptosporidium hominis
QSGCRCILEGTKLLVCTCD

SEQ ID NO: 2208958 - protein, 17 aa, Cryptosporidium hominis
RAFVKFFIKFLIFLQQK

SEQ ID NO: 2208959 - protein, 20 aa, Cryptosporidium hominis
RALSLFRVLKYLYKGHTTGW

SEQ ID NO: 2208960 - protein, 20 aa, Cryptosporidium hominis
RCENGIFSPKVYCIAMREIE

SEQ ID NO: 2208961 - protein, 20 aa, Cryptosporidium hominis
RDLKHIFGFGNPKIFSLNTC

SEQ ID NO: 2208962 - protein, 18 aa, Cryptosporidium hominis
REGCGFVHFLKSKGALPT

SEQ ID NO: 2208963 - protein, 17 aa, Cryptosporidium hominis
REYAPVCATDAETYENL

SEQ ID NO: 2208964 - protein, 24 aa, Cryptosporidium hominis
RILHLKMKLSFSVVLTLLIYTIGK

SEQ ID NO: 2208965 - protein, 18 aa, Cryptosporidium hominis
RILLLLSTISYAYSEKKR

SEQ ID NO: 2208966 - protein, 18 aa, Cryptosporidium hominis
RILLPRIFSHGCGTAAKL

SEQ ID NO: 2208967 - protein, 17 aa, Cryptosporidium hominis
RITFYGCDWTICEREVE

SEQ ID NO: 2208968 - protein, 19 aa, Cryptosporidium hominis
RKLASGLECDKCELCTEDK

SEQ ID NO: 2208969 - protein, 17 aa, Cryptosporidium hominis
RKLLPCTTLDFSSKIGS

SEQ ID NO: 2208970 - protein, 18 aa, Cryptosporidium hominis
RKYSFKFSDINGVDKTLK

SEQ ID NO: 2208971 - protein, 19 aa, Cryptosporidium hominis
RLKNLKLAFSKYCMPEKER

SEQ ID NO: 2208972 - protein, 24 aa, Cryptosporidium hominis
RLLLKAECQWSPWRRETGCSSTCD

SEQ ID NO: 2208973 - protein, 19 aa, Cryptosporidium hominis
RNYLTLPFTRDGHCEKGTI

SEQ ID NO: 2208974 - protein, 20 aa, Cryptosporidium hominis
RPQAPLIYRCRFSGPDLLKN

SEQ ID NO: 2208975 - protein, 21 aa, Cryptosporidium hominis
RSEILRILAILEEIEFNSKEV

SEQ ID NO: 2208976 - protein, 19 aa, Cryptosporidium hominis
RSSGISFLLSRPVTKLLEQ

SEQ ID NO: 2208977 - protein, 18 aa, Cryptosporidium hominis
RTGLTMTISDIWATAKDI

SEQ ID NO: 2208978 - protein, 17 aa, Cryptosporidium hominis
RTGSRGCFGRFTSFVSR

SEQ ID NO: 2208979 - protein, 18 aa, Cryptosporidium hominis
RVHCDGCSSSLCHLEGAK

SEQ ID NO: 2208980 - protein, 22 aa, Cryptosporidium hominis
RYLLSREFLYLFGKFGELEDYN

SEQ ID NO: 2208981 - protein, 19 aa, Cryptosporidium hominis
SAIKSCLNIKCKNLPNEVP

SEQ ID NO: 2208982 - protein, 23 aa, Cryptosporidium hominis
SDPEPKCLPGFEFDNKSETCVNK

SEQ ID NO: 2208983 - protein, 17 aa, Cryptosporidium hominis
SEAALQWWVDYGNGGKK

SEQ ID NO: 2208984 - protein, 24 aa, Cryptosporidium hominis
SENHLLNWRFDMMPMHKVIIPKRN

SEQ ID NO: 2208985 - protein, 22 aa, Cryptosporidium hominis
SEQNVNCFLVFRALPENLKQAT

SEQ ID NO: 2208986 - protein, 19 aa, Cryptosporidium hominis
SFSCKACGSSTLLGSLPSH

SEQ ID NO: 2208987 - protein, 17 aa, Cryptosporidium hominis
SGIYFLVFPVLLTFSSN

SEQ ID NO: 2208988 - protein, 18 aa, Cryptosporidium hominis
SIEFEMSEGLGISKDSCF

SEQ ID NO: 2208989 - protein, 23 aa, Cryptosporidium hominis
SISKKCSPGLCSEGCIPQVTSEE

SEQ ID NO: 2208990 - protein, 18 aa, Cryptosporidium hominis
SKFFPFFISKYIRSLQKS

SEQ ID NO: 2208991 - protein, 22 aa, Cryptosporidium hominis
SKRYVCSGIRVLSGCLNNPYTR

SEQ ID NO: 2208992 - protein, 23 aa, Cryptosporidium hominis
SLKVCVGTSWLPRPCGLDPFGEI

SEQ ID NO: 2208993 - protein, 23 aa, Cryptosporidium hominis
SLLKLRNGISFGQNLRKMLCCCR

SEQ ID NO: 2208994 - protein, 18 aa, Cryptosporidium hominis
SLPCFKFTRREFLPLFSV

SEQ ID NO: 2208995 - protein, 21 aa, Cryptosporidium hominis
SLRPPVPFQLVQGIEECELEI

SEQ ID NO: 2208996 - protein, 19 aa, Cryptosporidium hominis
SMLSDSVWREDLCTSNISP

SEQ ID NO: 2208997 - protein, 22 aa, Cryptosporidium hominis
SMYRKCLRALWDMFQYDDEINL

SEQ ID NO: 2208998 - protein, 17 aa, Cryptosporidium hominis
SNNFDFYNGYGFDFLFM

SEQ ID NO: 2208999 - protein, 20 aa, Cryptosporidium hominis
SPRTLPIIFTMNLRTRKPYI

SEQ ID NO: 2209000 - protein, 32 aa, Cryptosporidium hominis
SPTYKEKLLSFFSGNGGGMFGFGKSSTTTTTT

SEQ ID NO: 2209001 - protein, 17 aa, Cryptosporidium hominis
SRWTWNRIEKPIFRTNT

SEQ ID NO: 2209002 - protein, 23 aa, Cryptosporidium hominis
SSEIPRLGQYLVFYGHSESTSAA

SEQ ID NO: 2209003 - protein, 21 aa, Cryptosporidium hominis
SSSCRQIAWGLVIIEGQNISI

SEQ ID NO: 2209004 - protein, 20 aa, Cryptosporidium hominis
SSVLRLGILKNWRKSKSKSI

SEQ ID NO: 2209005 - protein, 23 aa, Cryptosporidium hominis
STEMFKLILVNGTEYALVNNETA

SEQ ID NO: 2209006 - protein, 17 aa, Cryptosporidium hominis
STLRRMLFRAADVGKIK

SEQ ID NO: 2209007 - protein, 17 aa, Cryptosporidium hominis
SYGEVWRGLAFTEYLSE

SEQ ID NO: 2209008 - protein, 21 aa, Cryptosporidium hominis
TCLKEGCAYFIGRSAAMTPVL

SEQ ID NO: 2209009 - protein, 18 aa, Cryptosporidium hominis
TDDCAACVTIIERLEKLN

SEQ ID NO: 2209010 - protein, 18 aa, Cryptosporidium hominis
TDSRFCVILIMEKNDFRM

SEQ ID NO: 2209011 - protein, 18 aa, Cryptosporidium hominis
TKGLCVIAFLPHIADSSD

SEQ ID NO: 2209012 - protein, 17 aa, Cryptosporidium hominis
TPIDFCGLSEKMILKGD

SEQ ID NO: 2209013 - protein, 19 aa, Cryptosporidium hominis
TRLLPLFSFVSRYSTINES

SEQ ID NO: 2209014 - protein, 23 aa, Cryptosporidium hominis
TTEVPRLEGCVARPAHCTGGSCS

SEQ ID NO: 2209015 - protein, 18 aa, Cryptosporidium hominis
VAEKYNKKKSWRKKTRKF

SEQ ID NO: 2209016 - protein, 18 aa, Cryptosporidium hominis
VKILQEFPHYHIPENHIF

SEQ ID NO: 2209017 - protein, 17 aa, Cryptosporidium hominis
VKPKAGLVLSNYQLPDG

SEQ ID NO: 2209018 - protein, 22 aa, Cryptosporidium hominis
VLNEFKNRFALINSSLNAQLGG

SEQ ID NO: 2209019 - protein, 18 aa, Cryptosporidium hominis
VQQNHEWYLLAMGQFTQL

SEQ ID NO: 2209020 - protein, 17 aa, Cryptosporidium hominis
VQTRLLPLFSFVSRYST

SEQ ID NO: 2209021 - protein, 17 aa, Cryptosporidium hominis
VQVGLFLGSPCIYENGN

SEQ ID NO: 2209022 - protein, 23 aa, Cryptosporidium hominis
VVPEPRYIPTVKIYDSQIEDLSF

SEQ ID NO: 2209023 - protein, 17 aa, Cryptosporidium hominis
VYEKFVPGRGFDKILQK

SEQ ID NO: 2209024 - protein, 19 aa, Cryptosporidium hominis
WFAVILCISLLNGISIWDR

SEQ ID NO: 2209025 - protein, 18 aa, Cryptosporidium hominis
WGKLLSYCIKCRALTEYM

SEQ ID NO: 2209026 - protein, 20 aa, Cryptosporidium hominis
WSREFCEIVQGFKIDEISCN

SEQ ID NO: 2209027 - protein, 20 aa, Cryptosporidium hominis
WSVGCLFSQMLFRLGTLKTN

SEQ ID NO: 2209028 - protein, 24 aa, Cryptosporidium hominis
WWNYYGVVVGWDWELNAPKQWADN

SEQ ID NO: 2209029 - protein, 20 aa, Cryptosporidium hominis
WYHKPCGVNFTFSGKLVSFS

SEQ ID NO: 2209030 - protein, 27 aa, Cryptosporidium hominis
YEEGKLAGGLAWALGVGKYVCNSKSAF

SEQ ID NO: 2209031 - protein, 20 aa, Cryptosporidium hominis
YENNTRNALDYGDLNDPGFI

SEQ ID NO: 2209032 - protein, 17 aa, Cryptosporidium hominis
YGFLYALINEINNQFQK

SEQ ID NO: 2209033 - protein, 22 aa, Cryptosporidium hominis
YKKKRLTKGLKWKKRKDSKKNE

SEQ ID NO: 2209034 - protein, 27 aa, Cryptosporidium hominis
YKLDYKLKFLRRMLRKDKKMIIQIHAL

SEQ ID NO: 2209035 - protein, 19 aa, Cryptosporidium hominis
YMEKFRFLYIISEPSLDGK

SEQ ID NO: 2209036 - protein, 20 aa, Cryptosporidium hominis
YNLECPNGFILDRERSSCVS

SEQ ID NO: 2209037 - protein, 20 aa, Cryptosporidium hominis
YSSKCTSIWRGKVGGTKKSS

SEQ ID NO: 2209038 - protein, 19 aa, Cryptosporidium hominis
YVICLCFYYLIKRERIRID

SEQ ID NO: 2209039 - protein, 19 aa, Cryptosporidium hominis
YYMKMCLISFPAILGSKSK

SEQ ID NO: 2209040 - protein, 19 aa, Cryptosporidium hominis
NCKTPFVTLDLDPICGSDG

SEQ ID NO: 2209041 - protein, 27 aa, Cryptosporidium hominis
AAIMRDIDWIFVIGHFPCYSSGEHGDN

SEQ ID NO: 2209042 - protein, 31 aa, Cryptosporidium hominis
AALPHLHMFSSQFYLYWSLSTPHLGCISNNS

SEQ ID NO: 2209043 - protein, 18 aa, Cryptosporidium hominis
AAMTIRFLWSEGGSQFDF

SEQ ID NO: 2209044 - protein, 25 aa, Cryptosporidium hominis
AASEYLEYLLLKNGFMFRVSLTERY

SEQ ID NO: 2209045 - protein, 25 aa, Cryptosporidium hominis
AASRHQLLFILRQVLEVAIKNPKLK

SEQ ID NO: 2209046 - protein, 28 aa, Cryptosporidium hominis
ADSFFGAIEWIWMYKLSNIDNINKYATW

SEQ ID NO: 2209047 - protein, 26 aa, Cryptosporidium hominis
ADYYFGNRQWSYIYDFSLNSKYINGV

SEQ ID NO: 2209048 - protein, 26 aa, Cryptosporidium hominis
AEEDKIEMLPLPLGPPIPGTEPGIEG

SEQ ID NO: 2209049 - protein, 26 aa, Cryptosporidium hominis
AEELVSPCFGIISYYPNMQITVMKGE

SEQ ID NO: 2209050 - protein, 19 aa, Cryptosporidium hominis
AERALYILRTAVSVLEHRE

SEQ ID NO: 2209051 - protein, 21 aa, Cryptosporidium hominis
AETYEFMRILAEDPTGAQYVA

SEQ ID NO: 2209052 - protein, 17 aa, Cryptosporidium hominis
AFIFHIFNIGNLLEHYM

SEQ ID NO: 2209053 - protein, 19 aa, Cryptosporidium hominis
AFMRILSLPFGLEKEKAEE

SEQ ID NO: 2209054 - protein, 20 aa, Cryptosporidium hominis
AFSLAAMKIPFYLRQELIQS

SEQ ID NO: 2209055 - protein, 21 aa, Cryptosporidium hominis
AFVFVILQVSNYHPTTPYFSL

SEQ ID NO: 2209056 - protein, 45 aa, Cryptosporidium hominis
AGILKIRLKNLKLAFSKYCMPEKERILFLMRQTIVGKYKSTKLYR

SEQ ID NO: 2209057 - protein, 21 aa, Cryptosporidium hominis
AGNLPYTILVSIPKAALPVSR

SEQ ID NO: 2209058 - protein, 26 aa, Cryptosporidium hominis
AGSKVLEIPLLVAAPFMLTSDSNGSA

SEQ ID NO: 2209059 - protein, 22 aa, Cryptosporidium hominis
AGVTVLLNITLELSKLGLGNNL

SEQ ID NO: 2209060 - protein, 24 aa, Cryptosporidium hominis
AIDGFAHFDFLYKKLYDIINTIHY

SEQ ID NO: 2209061 - protein, 26 aa, Cryptosporidium hominis
AIIPEIRLLQLYTILNKYAVQKGFSC

SEQ ID NO: 2209062 - protein, 19 aa, Cryptosporidium hominis
AIKSNKYLKKKLSKQIPDV

SEQ ID NO: 2209063 - protein, 20 aa, Cryptosporidium hominis
AILSFAYVGIFKVYGEEQKV

SEQ ID NO: 2209064 - protein, 28 aa, Cryptosporidium hominis
AIRRPKTHHLFPNPIKGFRNMFCKRLEK

SEQ ID NO: 2209065 - protein, 26 aa, Cryptosporidium hominis
AISDYALVGFPILRKFDPTDGSYDPF

SEQ ID NO: 2209066 - protein, 18 aa, Cryptosporidium hominis
AISQVYLELLKKGVIHCN

SEQ ID NO: 2209067 - protein, 30 aa, Cryptosporidium hominis
AKFCKGLFERFILRHIEWLRITIKSIESDN

SEQ ID NO: 2209068 - protein, 35 aa, Cryptosporidium hominis
AKHNPQLYLILFRDLKHIFGFGNPKIFSLNTCPVP

SEQ ID NO: 2209069 - protein, 24 aa, Cryptosporidium hominis
AKHYCKQILLTSLQLFLGINLWNN

SEQ ID NO: 2209070 - protein, 20 aa, Cryptosporidium hominis
AKKLGIKLPFHSFSPEAYLR

SEQ ID NO: 2209071 - protein, 26 aa, Cryptosporidium hominis
AKKVYSQVLFYMKSLCRTQREKLSNL

SEQ ID NO: 2209072 - protein, 21 aa, Cryptosporidium hominis
AKLNPTKLLPYQFSKTKSSQG

SEQ ID NO: 2209073 - protein, 21 aa, Cryptosporidium hominis
AKTLFGWREVLFDQAMESIGK

SEQ ID NO: 2209074 - protein, 23 aa, Cryptosporidium hominis
AKVKGRLRLQFLKKRGFSAREGS

SEQ ID NO: 2209075 - protein, 24 aa, Cryptosporidium hominis
ALEKGPIYLIRRITLRTKNNHLSF

SEQ ID NO: 2209076 - protein, 22 aa, Cryptosporidium hominis
ALFVLLFGYISFIGGFEPWGAQ

SEQ ID NO: 2209077 - protein, 27 aa, Cryptosporidium hominis
ALGSKTIKYGLLKYLSLNDYDSRIKSI

SEQ ID NO: 2209078 - protein, 19 aa, Cryptosporidium hominis
ALICQYVSFLSKFALDLVP

SEQ ID NO: 2209079 - protein, 27 aa, Cryptosporidium hominis
ALIESAVYMELILKLIALFNADEANAK

SEQ ID NO: 2209080 - protein, 20 aa, Cryptosporidium hominis
ALLDSILSFENWIKRFSKEY

SEQ ID NO: 2209081 - protein, 22 aa, Cryptosporidium hominis
ALLIIYFCINYSFGASNQSKSD

SEQ ID NO: 2209082 - protein, 21 aa, Cryptosporidium hominis
ALLVYFVATNAVRIRGGDQNK

SEQ ID NO: 2209083 - protein, 23 aa, Cryptosporidium hominis
ALNSKSFIVRRWGKNVQSKLRKL

SEQ ID NO: 2209084 - protein, 22 aa, Cryptosporidium hominis
ALQIYKLFNKLKSQAPSLGSKF

SEQ ID NO: 2209085 - protein, 22 aa, Cryptosporidium hominis
ALQVSIFTYFMAQKKLAEMRIL

SEQ ID NO: 2209086 - protein, 18 aa, Cryptosporidium hominis
ALSFLTIPKSRGSITLDE

SEQ ID NO: 2209087 - protein, 30 aa, Cryptosporidium hominis
ANIDFDTEVLLFELIKFYGSYYSSNLMTIS

SEQ ID NO: 2209088 - protein, 24 aa, Cryptosporidium hominis
ANKDKFKFISRKTLLQFCRDVCYK

SEQ ID NO: 2209089 - protein, 32 aa, Cryptosporidium hominis
ANNQLRCENGIFSPKVYCIAMREIERQKSSIS

SEQ ID NO: 2209090 - protein, 24 aa, Cryptosporidium hominis
ANSALVYAILFVTSTLQYSVMENC

SEQ ID NO: 2209091 - protein, 24 aa, Cryptosporidium hominis
APELMSSLGFNKPNFPFTIIDVAP

SEQ ID NO: 2209092 - protein, 26 aa, Cryptosporidium hominis
APEPIRVWCDIKFGASYYIWNDGGNP

SEQ ID NO: 2209093 - protein, 26 aa, Cryptosporidium hominis
APFGRTLIRNLFRIYKRNFPSDKRIK

SEQ ID NO: 2209094 - protein, 24 aa, Cryptosporidium hominis
APLVKKLPRSVPTMPIPNPTASST

SEQ ID NO: 2209095 - protein, 20 aa, Cryptosporidium hominis
APMIGFCPDGSEVPPSGLCT

SEQ ID NO: 2209096 - protein, 27 aa, Cryptosporidium hominis
AQIKNRRFFDFTLTTEVYPPVSGIFGI

SEQ ID NO: 2209097 - protein, 22 aa, Cryptosporidium hominis
ASKITVFGILNMILRNALENPK

SEQ ID NO: 2209098 - protein, 27 aa, Cryptosporidium hominis
ASLEEIPFGRYPPYPPYPGSQFDRYPP

SEQ ID NO: 2209099 - protein, 25 aa, Cryptosporidium hominis
ASLTVLRPIVLKPPVPALPPRRQVT

SEQ ID NO: 2209100 - protein, 17 aa, Cryptosporidium hominis
ASRFRRHVPTDAPLWGK

SEQ ID NO: 2209101 - protein, 24 aa, Cryptosporidium hominis
ASRGYRVFITPPITMIPTPEHPGL

SEQ ID NO: 2209102 - protein, 24 aa, Cryptosporidium hominis
ASVFLFICLSVRSFSKIGGVAHLE

SEQ ID NO: 2209103 - protein, 23 aa, Cryptosporidium hominis
ATIFISFLLIFQGILFDNGDSPS

SEQ ID NO: 2209104 - protein, 20 aa, Cryptosporidium hominis
AVGTYFKVFYPEVTTPRKDY

SEQ ID NO: 2209105 - protein, 29 aa, Cryptosporidium hominis
AVIVTINYRLGILGWLRTKNLSSGNMGFL

SEQ ID NO: 2209106 - protein, 20 aa, Cryptosporidium hominis
AVNLHTFGDLWTIPWNCCKN

SEQ ID NO: 2209107 - protein, 17 aa, Cryptosporidium hominis
AWELWNKAIYKLQWTLN

SEQ ID NO: 2209108 - protein, 18 aa, Cryptosporidium hominis
AYFASALKRPTAYSSPAI

SEQ ID NO: 2209109 - protein, 17 aa, Cryptosporidium hominis
AYHPLALEIFSTISKED

SEQ ID NO: 2209110 - protein, 19 aa, Cryptosporidium hominis
AYRNSISLGFLFSKTEDIL

SEQ ID NO: 2209111 - protein, 17 aa, Cryptosporidium hominis
CCLMPNYCSKEATCKSD

SEQ ID NO: 2209112 - protein, 24 aa, Cryptosporidium hominis
CDDVNLEFLHWGKCSKSICNKPAQ

SEQ ID NO: 2209113 - protein, 21 aa, Cryptosporidium hominis
CDEYSNVLLRIPFPSSEISGS

SEQ ID NO: 2209114 - protein, 24 aa, Cryptosporidium hominis
CDHTMHFLKSMDYFFLSSSELFEL

SEQ ID NO: 2209115 - protein, 17 aa, Cryptosporidium hominis
CDYIPNPGDLRPIPLKT

SEQ ID NO: 2209116 - protein, 19 aa, Cryptosporidium hominis
CFISQITWCVYMHGALIGG

SEQ ID NO: 2209117 - protein, 33 aa, Cryptosporidium hominis
CFKYKHILVPLEKKLIYMMKSVSNVLVSYEKSF

SEQ ID NO: 2209118 - protein, 17 aa, Cryptosporidium hominis
CFNSCFSGLIPYDSDHH

SEQ ID NO: 2209119 - protein, 24 aa, Cryptosporidium hominis
CFNTLDFLKFSLEDISAFHKPEHL

SEQ ID NO: 2209120 - protein, 28 aa, Cryptosporidium hominis
CFYDSVYEMCLFDCTLLNKKDACEEYLE

SEQ ID NO: 2209121 - protein, 26 aa, Cryptosporidium hominis
CGGGLVTMLPIVRYMKLLNSYGEYMS

SEQ ID NO: 2209122 - protein, 28 aa, Cryptosporidium hominis
CGGLNDVFMLIYLVGRLKGYYDDWKIVT

SEQ ID NO: 2209123 - protein, 27 aa, Cryptosporidium hominis
CHILPLLLFIILAIPFNSNVPSHGKSI

SEQ ID NO: 2209124 - protein, 18 aa, Cryptosporidium hominis
CKARVRTIFRTSYKVRCP

SEQ ID NO: 2209125 - protein, 39 aa, Cryptosporidium hominis
CKIKEILLTALDLLKTGLFIVFIFERSTFYGFLSQIHDK

SEQ ID NO: 2209126 - protein, 23 aa, Cryptosporidium hominis
CKTPDVKALRRLAAAKETSTVYE

SEQ ID NO: 2209127 - protein, 17 aa, Cryptosporidium hominis
CKTPFVTFDLKLICGSD

SEQ ID NO: 2209128 - protein, 26 aa, Cryptosporidium hominis
CLDPKIQLQKMPGIPCGLLGSMDATK

SEQ ID NO: 2209129 - protein, 19 aa, Cryptosporidium hominis
CLICLLNYTTFNQLGRVDE

SEQ ID NO: 2209130 - protein, 29 aa, Cryptosporidium hominis
CLKECITLLGLLILIRMYSVRAENYIAKK

SEQ ID NO: 2209131 - protein, 23 aa, Cryptosporidium hominis
CLNGIIFTAMALDSGVIKGSVIP

SEQ ID NO: 2209132 - protein, 17 aa, Cryptosporidium hominis
CLTYSKKSIQNVCEDGF

SEQ ID NO: 2209133 - protein, 17 aa, Cryptosporidium hominis
CLVLQFTSPKVECPPGL

SEQ ID NO: 2209134 - protein, 18 aa, Cryptosporidium hominis
CMHFGMAPFFSGMLMSYT

SEQ ID NO: 2209135 - protein, 21 aa, Cryptosporidium hominis
CNSVDFSLYTAFSSFNERELG

SEQ ID NO: 2209136 - protein, 25 aa, Cryptosporidium hominis
CRNPELYLAKPMGFPCREEDRNKNL

SEQ ID NO: 2209137 - protein, 17 aa, Cryptosporidium hominis
CRQIAWGLVIIEGQNIS

SEQ ID NO: 2209138 - protein, 24 aa, Cryptosporidium hominis
CRSNLFSLIPCKVFAWDSNGGTCT

SEQ ID NO: 2209139 - protein, 25 aa, Cryptosporidium hominis
CSGIFKMPSLPAIDLRPLNLALMNP

SEQ ID NO: 2209140 - protein, 23 aa, Cryptosporidium hominis
CSIDYYLINIPTPVSFNIDIELD

SEQ ID NO: 2209141 - protein, 23 aa, Cryptosporidium hominis
CSKIPMIPMIPTTVEQIFIIYPT

SEQ ID NO: 2209142 - protein, 24 aa, Cryptosporidium hominis
CSLQDLFNAGWKFDKKLKIWVRGN

SEQ ID NO: 2209143 - protein, 23 aa, Cryptosporidium hominis
CSQNYYNSLLAVGPIYDAVHEMT

SEQ ID NO: 2209144 - protein, 17 aa, Cryptosporidium hominis
CTLLSVVALFNDLNTDL

SEQ ID NO: 2209145 - protein, 20 aa, Cryptosporidium hominis
CTRLVPGALQYVCPVGTREG

SEQ ID NO: 2209146 - protein, 31 aa, Cryptosporidium hominis
CTSKQLIEDMLLFDQLPLDPQLSYTEGWKNK

SEQ ID NO: 2209147 - protein, 17 aa, Cryptosporidium hominis
CVAFTMPEKSCPPGFVF

SEQ ID NO: 2209148 - protein, 21 aa, Cryptosporidium hominis
CVFIIIFFGSLFSNILHIKGA

SEQ ID NO: 2209149 - protein, 18 aa, Cryptosporidium hominis
CVLGDWTHWSGCDSALCS

SEQ ID NO: 2209150 - protein, 21 aa, Cryptosporidium hominis
CVSLYLFRFKGLRQIMIVIRG

SEQ ID NO: 2209151 - protein, 18 aa, Cryptosporidium hominis
CVVAFMRILSLPFGLEKE

SEQ ID NO: 2209152 - protein, 24 aa, Cryptosporidium hominis
DAATQTIPIVTLTSTAKPLSKSEL

SEQ ID NO: 2209153 - protein, 25 aa, Cryptosporidium hominis
DACEEYLECRFDFVVPRKACVNDCF

SEQ ID NO: 2209154 - protein, 26 aa, Cryptosporidium hominis
DADNVIFATSLLLLTNIYSDNLGMSS

SEQ ID NO: 2209155 - protein, 32 aa, Cryptosporidium hominis
DAMAHYTVFERQWFFLDSWYGGLGTAARKVHP

SEQ ID NO: 2209156 - protein, 28 aa, Cryptosporidium hominis
DANYNNRRFIIINRLLIPLVVNSSLPSI

SEQ ID NO: 2209157 - protein, 21 aa, Cryptosporidium hominis
DASYPIIPITVSLGPYLFDIA

SEQ ID NO: 2209158 - protein, 20 aa, Cryptosporidium hominis
DAYLLLFKMMDHDKQKMLLL

SEQ ID NO: 2209159 - protein, 22 aa, Cryptosporidium hominis
DCKTPFVTADYRPICGSDGKTY

SEQ ID NO: 2209160 - protein, 18 aa, Cryptosporidium hominis
DEFHLLEISLSRSGLSSA

SEQ ID NO: 2209161 - protein, 22 aa, Cryptosporidium hominis
DEMKDLELIPKGSKYNLTIKVD

SEQ ID NO: 2209162 - protein, 19 aa, Cryptosporidium hominis
DEMLNKGAIPGIVSEESGR

SEQ ID NO: 2209163 - protein, 20 aa, Cryptosporidium hominis
DEPTPPHPIPFTLPDPDYGN

SEQ ID NO: 2209164 - protein, 19 aa, Cryptosporidium hominis
DFANFFIKNFSISGSVLGN

SEQ ID NO: 2209165 - protein, 22 aa, Cryptosporidium hominis
DFLKLLFEIVLTLFEEYTKKCA

SEQ ID NO: 2209166 - protein, 21 aa, Cryptosporidium hominis
DFMKPLEKVFTLIWDEIILGN

SEQ ID NO: 2209167 - protein, 25 aa, Cryptosporidium hominis
DFPELHLLASSLFFEISKHDKYLSS

SEQ ID NO: 2209168 - protein, 26 aa, Cryptosporidium hominis
DFSKDWYMEIIIYLIKFIVNNTQSVK

SEQ ID NO: 2209169 - protein, 26 aa, Cryptosporidium hominis
DFYKYPNRLVFLKTALEDPMECYVIQ

SEQ ID NO: 2209170 - protein, 24 aa, Cryptosporidium hominis
DGESNYYFFKKAISSSTLVGSSFN

SEQ ID NO: 2209171 - protein, 25 aa, Cryptosporidium hominis
DGNVIFIFKSLQRNGFRPDLRLNGL

SEQ ID NO: 2209172 - protein, 17 aa, Cryptosporidium hominis
DGRLFWEFNENSQLQVK

SEQ ID NO: 2209173 - protein, 28 aa, Cryptosporidium hominis
DGTCYIVEYAPFSLTCNDPYTLFDNKEC

SEQ ID NO: 2209174 - protein, 20 aa, Cryptosporidium hominis
DHFVSFIFTTLEKEKIVLPN

SEQ ID NO: 2209175 - protein, 19 aa, Cryptosporidium hominis
DHRGFLTISSPCDGNLSFR

SEQ ID NO: 2209176 - protein, 23 aa, Cryptosporidium hominis
DHTLNFLQRIWEQNIYHCDLCHP

SEQ ID NO: 2209177 - protein, 21 aa, Cryptosporidium hominis
DICRFVGKVEPWIYTKRSGFT

SEQ ID NO: 2209178 - protein, 26 aa, Cryptosporidium hominis
DIGAPQQVGIFLKSNTRWKCLKITVV

SEQ ID NO: 2209179 - protein, 26 aa, Cryptosporidium hominis
DIICKPYESLIGIRAWFPNPESKGRK

SEQ ID NO: 2209180 - protein, 25 aa, Cryptosporidium hominis
DIINTIHYPGFQFIDDVRVDLYYGM

SEQ ID NO: 2209181 - protein, 28 aa, Cryptosporidium hominis
DIISFLTIIFLIFIYKVFGYVERPERKL

SEQ ID NO: 2209182 - protein, 22 aa, Cryptosporidium hominis
DIISLYLQYKRITRILLNIYNS

SEQ ID NO: 2209183 - protein, 25 aa, Cryptosporidium hominis
DILVSTTFMLIAHASPNPIPGKSPE

SEQ ID NO: 2209184 - protein, 31 aa, Cryptosporidium hominis
DIMNSRLILILFSIILIIGWVESSSNSLQME

SEQ ID NO: 2209185 - protein, 25 aa, Cryptosporidium hominis
DINLALPFMEIKWNPGSSLSNGVIS

SEQ ID NO: 2209186 - protein, 18 aa, Cryptosporidium hominis
DIPFVAVIPVGSKPGLNI

SEQ ID NO: 2209187 - protein, 18 aa, Cryptosporidium hominis
DIPYLLKLVNVLSDSYGF

SEQ ID NO: 2209188 - protein, 19 aa, Cryptosporidium hominis
DKDGLCCLMPNYCSKEATC

SEQ ID NO: 2209189 - protein, 22 aa, Cryptosporidium hominis
DKDIKLEFWFNLGGNKKKQKCY

SEQ ID NO: 2209190 - protein, 22 aa, Cryptosporidium hominis
DKEPILLRSKKTGYTFKEFCDD

SEQ ID NO: 2209191 - protein, 24 aa, Cryptosporidium hominis
DKFRQEFLLAINSFRSIVGKFATN

SEQ ID NO: 2209192 - protein, 28 aa, Cryptosporidium hominis
DKHRLSELLVLPFGLWDSRHSYSIQIIT

SEQ ID NO: 2209193 - protein, 24 aa, Cryptosporidium hominis
DKIKGLIRYFKFNKGSYGEVWRGL

SEQ ID NO: 2209194 - protein, 21 aa, Cryptosporidium hominis
DKIPMLYQRQHAQRTREKLVS

SEQ ID NO: 2209195 - protein, 41 aa, Cryptosporidium hominis
DKKRTPSPIIPPPPSFPAPPPPSFHAPPPPSIPSGTTSRTP

SEQ ID NO: 2209196 - protein, 23 aa, Cryptosporidium hominis
DKLAIKTLRKRMKFIKMRLNSLG

SEQ ID NO: 2209197 - protein, 19 aa, Cryptosporidium hominis
DKLSYLQKNPPITGSIFAD

SEQ ID NO: 2209198 - protein, 18 aa, Cryptosporidium hominis
DKLVSAPPHLFKVILAVN

SEQ ID NO: 2209199 - protein, 18 aa, Cryptosporidium hominis
DLLLSLPNQDLYNDESHA

SEQ ID NO: 2209200 - protein, 24 aa, Cryptosporidium hominis
DLNTRSIYLDRIVWSWSSRKIEDN

SEQ ID NO: 2209201 - protein, 29 aa, Cryptosporidium hominis
DLQIKFLVHFFRNRVVLLDPSHGLSCSGP

SEQ ID NO: 2209202 - protein, 25 aa, Cryptosporidium hominis
DLSLAKFLIIPLRIGKENLNEQLKL

SEQ ID NO: 2209203 - protein, 24 aa, Cryptosporidium hominis
DLSLIKLSSPRKLLRRLCCCCSSS

SEQ ID NO: 2209204 - protein, 31 aa, Cryptosporidium hominis
DLTTLSYYQNIFLALKNLFNLVFKEKEAEIS

SEQ ID NO: 2209205 - protein, 23 aa, Cryptosporidium hominis
DNLWSFNSIMMLLHSSRNNQGEN

SEQ ID NO: 2209206 - protein, 21 aa, Cryptosporidium hominis
DNNILRIDYTNRLLLEGVPFL

SEQ ID NO: 2209207 - protein, 25 aa, Cryptosporidium hominis
DNNSFFPAFGIFNKGDALALNNFTN

SEQ ID NO: 2209208 - protein, 23 aa, Cryptosporidium hominis
DNVLPEFISGTPLEPLPSSFDYR

SEQ ID NO: 2209209 - protein, 23 aa, Cryptosporidium hominis
DPDTNIIFRVRIVYRPISIAEDP

SEQ ID NO: 2209210 - protein, 22 aa, Cryptosporidium hominis
DPELTFIFTNLEYIGELYPDIL

SEQ ID NO: 2209211 - protein, 20 aa, Cryptosporidium hominis
DPITGELLFDAEALSRNITS

SEQ ID NO: 2209212 - protein, 24 aa, Cryptosporidium hominis
DPKHGFVPLYILDNSTETAALPAS

SEQ ID NO: 2209213 - protein, 24 aa, Cryptosporidium hominis
DPLIAQKLFLGEKTISFLFVNNDV

SEQ ID NO: 2209214 - protein, 27 aa, Cryptosporidium hominis
DPNHGFTPLFTKLYLYNDTAALPASRT

SEQ ID NO: 2209215 - protein, 27 aa, Cryptosporidium hominis
DQAFTFWTKSYRYTAFFKYINEHEDIN

SEQ ID NO: 2209216 - protein, 24 aa, Cryptosporidium hominis
DQAYIFWESLRFSNSIMDKKHGVN

SEQ ID NO: 2209217 - protein, 27 aa, Cryptosporidium hominis
DQLDAALRLVSGLDFDVGATGESFVFG

SEQ ID NO: 2209218 - protein, 22 aa, Cryptosporidium hominis
DQPIFTLNGYRILKSIWYGSRL

SEQ ID NO: 2209219 - protein, 17 aa, Cryptosporidium hominis
DQQQPIEIGPPTNFQHL

SEQ ID NO: 2209220 - protein, 23 aa, Cryptosporidium hominis
DQVYLNIKFTYRWNAPGALKIEN

SEQ ID NO: 2209221 - protein, 22 aa, Cryptosporidium hominis
DRMLWGIIKSELLTNSWMNLSK

SEQ ID NO: 2209222 - protein, 23 aa, Cryptosporidium hominis
DRNSLFDLSILVKESLESAYRAL

SEQ ID NO: 2209223 - protein, 31 aa, Cryptosporidium hominis
DSAIDVCVQRGFFAEALLLAVKFGGIYLDYV

SEQ ID NO: 2209224 - protein, 30 aa, Cryptosporidium hominis
DSANQLRGILLPLVDMFQVSIGCAAPCPYQ

SEQ ID NO: 2209225 - protein, 34 aa, Cryptosporidium hominis
DSCFAIDANGILFVWGMNLTGQIGIKKLIDSEVV

SEQ ID NO: 2209226 - protein, 25 aa, Cryptosporidium hominis
DSDSKLIWLNFTLSKDLQGDPNTFE

SEQ ID NO: 2209227 - protein, 25 aa, Cryptosporidium hominis
DSFSNGFYKLLRKMKMITKAANDPD

SEQ ID NO: 2209228 - protein, 25 aa, Cryptosporidium hominis
DSGGYIGFPNFQLMSGSLVGYKQYN

SEQ ID NO: 2209229 - protein, 26 aa, Cryptosporidium hominis
DSGLKIWNLTFLGRRVAFEVAMVDAM

SEQ ID NO: 2209230 - protein, 51 aa, Cryptosporidium hominis
DSIHTSIMEGLYKLDYKLKFLRRMLRKDKKMIIQIHALGYLVNTIKEQIVR

SEQ ID NO: 2209231 - protein, 17 aa, Cryptosporidium hominis
DSQILGEKSLQEGLPES

SEQ ID NO: 2209232 - protein, 24 aa, Cryptosporidium hominis
DSTCNYEMLIISPVICSHPLLMPP

SEQ ID NO: 2209233 - protein, 23 aa, Cryptosporidium hominis
DSVYRLSLMRLCLLDISEGKLGY

SEQ ID NO: 2209234 - protein, 22 aa, Cryptosporidium hominis
DTGGEFVVALYPGLKQYTGAAG

SEQ ID NO: 2209235 - protein, 18 aa, Cryptosporidium hominis
DTIYSYEASLNPPRKIRD

SEQ ID NO: 2209236 - protein, 30 aa, Cryptosporidium hominis
DTKEKYSMVVYFFLIGHQYNRMMTISMLIP

SEQ ID NO: 2209237 - protein, 18 aa, Cryptosporidium hominis
DTLWSTVVFISPDAYVTA

SEQ ID NO: 2209238 - protein, 22 aa, Cryptosporidium hominis
DVFAIARFYMAVDTIPIYEFGG

SEQ ID NO: 2209239 - protein, 20 aa, Cryptosporidium hominis
DVKFKIILISTILESLHVAN

SEQ ID NO: 2209240 - protein, 27 aa, Cryptosporidium hominis
DVLKSSLFIVFFFEKSSLNVLLNEIFQ

SEQ ID NO: 2209241 - protein, 18 aa, Cryptosporidium hominis
DVLYIFYGDKNGMERSIF

SEQ ID NO: 2209242 - protein, 20 aa, Cryptosporidium hominis
DVNVLRMYMASGLLNSVQLD

SEQ ID NO: 2209243 - protein, 21 aa, Cryptosporidium hominis
DVRIRFDDFSGFDLLLGVYPS

SEQ ID NO: 2209244 - protein, 26 aa, Cryptosporidium hominis
DVYKKFGGIFWARNIPRVSITNMINL

SEQ ID NO: 2209245 - protein, 21 aa, Cryptosporidium hominis
DVYKTAFYPPPLEFLQYGVSN

SEQ ID NO: 2209246 - protein, 19 aa, Cryptosporidium hominis
DYGALFNCKYKYPERTYSK

SEQ ID NO: 2209247 - protein, 28 aa, Cryptosporidium hominis
DYGDLNDPGFIIRIVDEEPLYGVSETQR

SEQ ID NO: 2209248 - protein, 20 aa, Cryptosporidium hominis
DYNSLFPLSPYNSVSNEYLI

SEQ ID NO: 2209249 - protein, 25 aa, Cryptosporidium hominis
DYTNRLLLEGVPFLNLLPNVENEYA

SEQ ID NO: 2209250 - protein, 26 aa, Cryptosporidium hominis
DYTTPIAMLLPLFRPTSMDTRSEDLE

SEQ ID NO: 2209251 - protein, 18 aa, Cryptosporidium hominis
EAEFLRTTFCISAAVFCY

SEQ ID NO: 2209252 - protein, 18 aa, Cryptosporidium hominis
EALRFMEKIENLSANVRE

SEQ ID NO: 2209253 - protein, 24 aa, Cryptosporidium hominis
EANLQYCLGGHLGLLKTQILTFKI

SEQ ID NO: 2209254 - protein, 31 aa, Cryptosporidium hominis
EASQLASFNILIQPLLNLVLNAPGDDSDIKR

SEQ ID NO: 2209255 - protein, 23 aa, Cryptosporidium hominis
EAYLRGYLHLSFRISRLGLCLRT

SEQ ID NO: 2209256 - protein, 24 aa, Cryptosporidium hominis
ECAEALITFFKLKAETYYDSTERY

SEQ ID NO: 2209257 - protein, 19 aa, Cryptosporidium hominis
ECAGTTWMPLPCALDPHKP

SEQ ID NO: 2209258 - protein, 27 aa, Cryptosporidium hominis
ECANSPGFKFLLLETIDLLVAVNGWDF

SEQ ID NO: 2209259 - protein, 18 aa, Cryptosporidium hominis
ECISCSYSLLPKSVQIGS

SEQ ID NO: 2209260 - protein, 22 aa, Cryptosporidium hominis
EDARLKENCITSLIVVFEKNLQ

SEQ ID NO: 2209261 - protein, 26 aa, Cryptosporidium hominis
EDDRFSFKTFPNFVPPDIPKIAGQRL

SEQ ID NO: 2209262 - protein, 27 aa, Cryptosporidium hominis
EDGYLPLKHFFVSFLLNSTFERRKNMV

SEQ ID NO: 2209263 - protein, 29 aa, Cryptosporidium hominis
EDHRSPHQLPLYYIVLQSLGILSDMVSST

SEQ ID NO: 2209264 - protein, 22 aa, Cryptosporidium hominis
EDLIYLPQISILSQELLISSKK

SEQ ID NO: 2209265 - protein, 23 aa, Cryptosporidium hominis
EDLLRLHLKAFPLFSTQLNISKR

SEQ ID NO: 2209266 - protein, 27 aa, Cryptosporidium hominis
EDSVERRLYIASLLGFDFNNASTTANQ

SEQ ID NO: 2209267 - protein, 25 aa, Cryptosporidium hominis
EDTFSVLLLFLLICSVRIVEGNNFK

SEQ ID NO: 2209268 - protein, 17 aa, Cryptosporidium hominis
EEDYRKYCKSHNFKPPA

SEQ ID NO: 2209269 - protein, 20 aa, Cryptosporidium hominis
EEKRRALYNLVLKQMASQPM

SEQ ID NO: 2209270 - protein, 17 aa, Cryptosporidium hominis
EEPIERPPLGPFNRIRG

SEQ ID NO: 2209271 - protein, 23 aa, Cryptosporidium hominis
EERSKYHNYPWLVMSEDLKLRRG

SEQ ID NO: 2209272 - protein, 29 aa, Cryptosporidium hominis
EESIKLLKRKLLFSWPRTRLRRSLLDSNR

SEQ ID NO: 2209273 - protein, 45 aa, Cryptosporidium hominis
EESKIRVYLSHLFPEEDSLPLKHFKSVLKYLLDIAVNDEPSKLDD

SEQ ID NO: 2209274 - protein, 24 aa, Cryptosporidium hominis
EESQTLEFCRNEMISLLWNRAANM

SEQ ID NO: 2209275 - protein, 26 aa, Cryptosporidium hominis
EETKTFLLNYLYKCGPDMLRSAPYLV

SEQ ID NO: 2209276 - protein, 25 aa, Cryptosporidium hominis
EETLFPYELATRRLLQYLKECKIGV

SEQ ID NO: 2209277 - protein, 19 aa, Cryptosporidium hominis
EFIDALTFDQFYKYWQYFG

SEQ ID NO: 2209278 - protein, 30 aa, Cryptosporidium hominis
EFLGINGTFPPFVKWPYRGGSGETLYLLNE

SEQ ID NO: 2209279 - protein, 24 aa, Cryptosporidium hominis
EFNKAKEFLLLLSRNARLIENNLG

SEQ ID NO: 2209280 - protein, 18 aa, Cryptosporidium hominis
EFSYVNNLWSLWSNIRQD

SEQ ID NO: 2209281 - protein, 18 aa, Cryptosporidium hominis
EGDSLYLELYRDGSKKIN

SEQ ID NO: 2209282 - protein, 21 aa, Cryptosporidium hominis
EGTIVLFSYKSLFSLRVCQKD

SEQ ID NO: 2209283 - protein, 26 aa, Cryptosporidium hominis
EHGYLPILERIYYLNGTVALPMSRVS

SEQ ID NO: 2209284 - protein, 21 aa, Cryptosporidium hominis
EHLLMNWMFADMNINKSLIPV

SEQ ID NO: 2209285 - protein, 20 aa, Cryptosporidium hominis
EHNYAFIAFFQEGEQKLEVL

SEQ ID NO: 2209286 - protein, 19 aa, Cryptosporidium hominis
EIAKILYWRIKTDTELSAF

SEQ ID NO: 2209287 - protein, 25 aa, Cryptosporidium hominis
EIDEIFKLDSILKDLNLILKSNNTD

SEQ ID NO: 2209288 - protein, 18 aa, Cryptosporidium hominis
EIEKLRGTYRSTLSKQFS

SEQ ID NO: 2209289 - protein, 24 aa, Cryptosporidium hominis
EIEWSLFNIGVYRNWDIIAMIETK

SEQ ID NO: 2209290 - protein, 19 aa, Cryptosporidium hominis
EIIPEILSITEVLSRNVIA

SEQ ID NO: 2209291 - protein, 20 aa, Cryptosporidium hominis
EIKILYSKLKKILLKLLECL

SEQ ID NO: 2209292 - protein, 18 aa, Cryptosporidium hominis
EIKKTIPLKLEKHILLQQ

SEQ ID NO: 2209293 - protein, 19 aa, Cryptosporidium hominis
EIMSKVGFPIAVMGSIPAV

SEQ ID NO: 2209294 - protein, 27 aa, Cryptosporidium hominis
EINDERLQWLFLVESASIPNPLVYSTE

SEQ ID NO: 2209295 - protein, 22 aa, Cryptosporidium hominis
EINKYFSPYSSIHYLTSSEIPN

SEQ ID NO: 2209296 - protein, 25 aa, Cryptosporidium hominis
EINLDVLIVFYAPWCGHCRKLEPDY

SEQ ID NO: 2209297 - protein, 19 aa, Cryptosporidium hominis
EIREIFLLEKDHAIHRPYL

SEQ ID NO: 2209298 - protein, 17 aa, Cryptosporidium hominis
EIRRDLFKLFPPTDSNS

SEQ ID NO: 2209299 - protein, 18 aa, Cryptosporidium hominis
EISILKNVIFLYNYLIFL

SEQ ID NO: 2209300 - protein, 18 aa, Cryptosporidium hominis
EIVMDQYYFMYYHQGRRG

SEQ ID NO: 2209301 - protein, 24 aa, Cryptosporidium hominis
EKAIEFCYNLEPFALLECHALTWI

SEQ ID NO: 2209302 - protein, 24 aa, Cryptosporidium hominis
EKEANRELLIEFLKFMHTNRMNIR

SEQ ID NO: 2209303 - protein, 25 aa, Cryptosporidium hominis
EKEKLPLQKKKKWYEKRDPITGELL

SEQ ID NO: 2209304 - protein, 20 aa, Cryptosporidium hominis
EKELIAAFVRMLLLLQERSK

SEQ ID NO: 2209305 - protein, 35 aa, Cryptosporidium hominis
EKESPVDPFWLIQAYRMLLIYSVLLDDAGIFVNLN

SEQ ID NO: 2209306 - protein, 25 aa, Cryptosporidium hominis
EKGDRHKIFTKAIISTIISKNEIKI

SEQ ID NO: 2209307 - protein, 25 aa, Cryptosporidium hominis
EKLGFLKPMEFYRYAVLLSISLIKD

SEQ ID NO: 2209308 - protein, 18 aa, Cryptosporidium hominis
EKLIRIIDVKLSSCLTYI

SEQ ID NO: 2209309 - protein, 48 aa, Cryptosporidium hominis
EKLLKTFSCLKLHSLLVKVKYIYAKLKTLLTYLFTYFKESNIDLEGLR

SEQ ID NO: 2209310 - protein, 22 aa, Cryptosporidium hominis
EKMIFNVMMRFTENSYLQSCSD

SEQ ID NO: 2209311 - protein, 23 aa, Cryptosporidium hominis
EKPNWLFMPMKIGNAEGLVLPDG

SEQ ID NO: 2209312 - protein, 26 aa, Cryptosporidium hominis
EKQILKYQYPLITEFDPLIAQKLFLG

SEQ ID NO: 2209313 - protein, 23 aa, Cryptosporidium hominis
EKRLNPIFIGEKGNMLILPNRRH

SEQ ID NO: 2209314 - protein, 30 aa, Cryptosporidium hominis
EKRSLSRCLLLIILLVILEILCANGEGRIS

SEQ ID NO: 2209315 - protein, 34 aa, Cryptosporidium hominis
EKRTPSPNIPPPPSFPAPPPPFTLSGTPSHTLTQ

SEQ ID NO: 2209316 - protein, 17 aa, Cryptosporidium hominis
EKSMNFMLKKSIIKLCS

SEQ ID NO: 2209317 - protein, 20 aa, Cryptosporidium hominis
ELAWTTELVILWKMARQRDI

SEQ ID NO: 2209318 - protein, 32 aa, Cryptosporidium hominis
ELEREIASLMEKFLLLLDYGVDNFLGHMAISI

SEQ ID NO: 2209319 - protein, 17 aa, Cryptosporidium hominis
ELIINQIKWRFEKDHER

SEQ ID NO: 2209320 - protein, 24 aa, Cryptosporidium hominis
ELKNASLTRTFYSKPSSALASELN

SEQ ID NO: 2209321 - protein, 17 aa, Cryptosporidium hominis
ELLFDAEALSRNITSTI

SEQ ID NO: 2209322 - protein, 19 aa, Cryptosporidium hominis
ELLKTPQRDLPISKPTPLY

SEQ ID NO: 2209323 - protein, 19 aa, Cryptosporidium hominis
ELLLILSKEKNVTEKQSEI

SEQ ID NO: 2209324 - protein, 18 aa, Cryptosporidium hominis
ELLPDMAFLIGDQRKRRG

SEQ ID NO: 2209325 - protein, 24 aa, Cryptosporidium hominis
ELLPEYIKLHYILENSIQAFKFIH

SEQ ID NO: 2209326 - protein, 29 aa, Cryptosporidium hominis
ELNSEFYKYNYDLYRIRGPNCKKPCSSLD

SEQ ID NO: 2209327 - protein, 43 aa, Cryptosporidium hominis
ELPKFRSNLTETQVYFLCLKALKSSLDKIYNSPVGKLLNSDSV

SEQ ID NO: 2209328 - protein, 19 aa, Cryptosporidium hominis
ELQGYLGCGFSSLLDYQTK

SEQ ID NO: 2209329 - protein, 24 aa, Cryptosporidium hominis
ELRLIIAPLALALVPVGEVKKIIS

SEQ ID NO: 2209330 - protein, 18 aa, Cryptosporidium hominis
ELRLRKLQFLEMFSRGGL

SEQ ID NO: 2209331 - protein, 21 aa, Cryptosporidium hominis
ELSVVPNDQLSLVINSIPGAD

SEQ ID NO: 2209332 - protein, 34 aa, Cryptosporidium hominis
ELTDYYILNLEKFKIKLISFIFNDRYFFLEKSIV

SEQ ID NO: 2209333 - protein, 18 aa, Cryptosporidium hominis
ELTKNFLRKILISTRNSL

SEQ ID NO: 2209334 - protein, 18 aa, Cryptosporidium hominis
ELVILWKMARQRDITTCK

SEQ ID NO: 2209335 - protein, 19 aa, Cryptosporidium hominis
ELYAGLEVPYFSAKQKKYG

SEQ ID NO: 2209336 - protein, 29 aa, Cryptosporidium hominis
ELYDKLFIHLIDAKIWHGPASAVPGIVRL

SEQ ID NO: 2209337 - protein, 22 aa, Cryptosporidium hominis
EMDQLLFKIIGRGDKFAAIIAQ

SEQ ID NO: 2209338 - protein, 20 aa, Cryptosporidium hominis
EMSYIGSIFHRVIPGFMAQG

SEQ ID NO: 2209339 - protein, 26 aa, Cryptosporidium hominis
ENGNVLRLMLNFSKIGLWIWDNNLLL

SEQ ID NO: 2209340 - protein, 26 aa, Cryptosporidium hominis
ENLEFRYWGVCFEGYEEYFGNMIPLG

SEQ ID NO: 2209341 - protein, 21 aa, Cryptosporidium hominis
ENLLKLIQSVLFDYESSLTPS

SEQ ID NO: 2209342 - protein, 18 aa, Cryptosporidium hominis
ENLWKAIYNQMHIDLLLG

SEQ ID NO: 2209343 - protein, 48 aa, Cryptosporidium hominis
ENPAIKLYSFFRIKRTFISHILFGLASKYRIIFKELQRLPFIYKDSEL

SEQ ID NO: 2209344 - protein, 27 aa, Cryptosporidium hominis
ENSDNFMIFLDVINYILVSTLSASKVT

SEQ ID NO: 2209345 - protein, 19 aa, Cryptosporidium hominis
EPRTILRRKKPNLFAEVTK

SEQ ID NO: 2209346 - protein, 18 aa, Cryptosporidium hominis
EPVYLPIPTQKKLNKEII

SEQ ID NO: 2209347 - protein, 28 aa, Cryptosporidium hominis
EQDLVIVRRMISLFNAYFENVKLRSDYD

SEQ ID NO: 2209348 - protein, 26 aa, Cryptosporidium hominis
EQKKDNFYIRLRSGQWFALKQQVEYD

SEQ ID NO: 2209349 - protein, 17 aa, Cryptosporidium hominis
EQKPARKIIISRPIMRT

SEQ ID NO: 2209350 - protein, 25 aa, Cryptosporidium hominis
EQLRNPYSAPLFSPSDILEARETHF

SEQ ID NO: 2209351 - protein, 21 aa, Cryptosporidium hominis
EQMDYLVSAGIYRVIISIVEG

SEQ ID NO: 2209352 - protein, 30 aa, Cryptosporidium hominis
EQSLKAYHYFNIPCYYGIVNYYLKQSFNTF

SEQ ID NO: 2209353 - protein, 17 aa, Cryptosporidium hominis
EQTPKIPPIPKSDSKNL

SEQ ID NO: 2209354 - protein, 32 aa, Cryptosporidium hominis
ERCQELLNRLKQNSFYSYWGQGGIVADQAQPI

SEQ ID NO: 2209355 - protein, 26 aa, Cryptosporidium hominis
ERIIELNLEYALPQVKLMACRLHPEL

SEQ ID NO: 2209356 - protein, 31 aa, Cryptosporidium hominis
ERLFSYAIGICKIPSLWYLELIYCMHKGVTH

SEQ ID NO: 2209357 - protein, 34 aa, Cryptosporidium hominis
ERNLFAEFILVELSIYISLLLKLLALVNPEDVED

SEQ ID NO: 2209358 - protein, 27 aa, Cryptosporidium hominis
ERTTNYSALQFFTTLESKAMGTLSKPS

SEQ ID NO: 2209359 - protein, 27 aa, Cryptosporidium hominis
ERYFKKYITAPLLFAKAIRFYYTSKVM

SEQ ID NO: 2209360 - protein, 31 aa, Cryptosporidium hominis
ESEKKVLLFFTKTILNMLFEVSLLSIPGCVK

SEQ ID NO: 2209361 - protein, 27 aa, Cryptosporidium hominis
ESILSVLRLIVYLIKSVFNIFSNISSN

SEQ ID NO: 2209362 - protein, 26 aa, Cryptosporidium hominis
ESKVRSWFFRLWSESTVLTSPVLYIE

SEQ ID NO: 2209363 - protein, 26 aa, Cryptosporidium hominis
ESLQIEYICLLSLLTLSFAMTNCSFF

SEQ ID NO: 2209364 - protein, 26 aa, Cryptosporidium hominis
ESNPKNPFLVVWDPSKLSASLQAPTD

SEQ ID NO: 2209365 - protein, 27 aa, Cryptosporidium hominis
ESPRTLPIIFTMNLRTRKPYINQKEAF

SEQ ID NO: 2209366 - protein, 29 aa, Cryptosporidium hominis
ESQEKFVLDFFDLLLSPLNFTNEIMDLEI

SEQ ID NO: 2209367 - protein, 21 aa, Cryptosporidium hominis
ESQLWIKDYVLRNAAYRHYQF

SEQ ID NO: 2209368 - protein, 26 aa, Cryptosporidium hominis
ESSIYFCEYLWVIAYIIEEKKSFKTQ

SEQ ID NO: 2209369 - protein, 26 aa, Cryptosporidium hominis
ETCIDYPVLYHAIHSSVPKPVAVPEA

SEQ ID NO: 2209370 - protein, 18 aa, Cryptosporidium hominis
ETCSNKHLQPLFKFDLEN

SEQ ID NO: 2209371 - protein, 30 aa, Cryptosporidium hominis
ETELVQESLPYFIRLLYNGQVITNRLKECY

SEQ ID NO: 2209372 - protein, 21 aa, Cryptosporidium hominis
ETFVRMFGCKIYRSVPNVLEI

SEQ ID NO: 2209373 - protein, 23 aa, Cryptosporidium hominis
EVEYDLIWLLVPMEPGKGEESIK

SEQ ID NO: 2209374 - protein, 26 aa, Cryptosporidium hominis
EVNLVYTSYLLFLISCSHKDFYQMEF

SEQ ID NO: 2209375 - protein, 27 aa, Cryptosporidium hominis
EVSGELWIPFAISQIIYRKSKVLMNPL

SEQ ID NO: 2209376 - protein, 26 aa, Cryptosporidium hominis
EYENTFKIIFFWGMKDDLVPFAPALD

SEQ ID NO: 2209377 - protein, 23 aa, Cryptosporidium hominis
EYFNRLCINLISYDIWNFSGNFD

SEQ ID NO: 2209378 - protein, 23 aa, Cryptosporidium hominis
EYPTIAEEAIFITLGQYGHLSQI

SEQ ID NO: 2209379 - protein, 18 aa, Cryptosporidium hominis
FADEPRTILRRKKPNLFA

SEQ ID NO: 2209380 - protein, 20 aa, Cryptosporidium hominis
FAEKYLFFPGKVETIDIIVD

SEQ ID NO: 2209381 - protein, 25 aa, Cryptosporidium hominis
FAIEICMIPSIWYLELIHCMHFGMA

SEQ ID NO: 2209382 - protein, 21 aa, Cryptosporidium hominis
FAILLLFGVFLTISEASEGPI

SEQ ID NO: 2209383 - protein, 18 aa, Cryptosporidium hominis
FAKAIRFYYTSKVMLKSG

SEQ ID NO: 2209384 - protein, 18 aa, Cryptosporidium hominis
FALIFSISSINGSNLSES

SEQ ID NO: 2209385 - protein, 34 aa, Cryptosporidium hominis
FAPPSPPHSPPPPPPPPPPPPPSSPPSPPPSPPT

SEQ ID NO: 2209386 - protein, 28 aa, Cryptosporidium hominis
FASFKLMSLYILKKIYKVAYENPKLNLD

SEQ ID NO: 2209387 - protein, 23 aa, Cryptosporidium hominis
FAYLFQLLWRYIISEGIQINAAT

SEQ ID NO: 2209388 - protein, 17 aa, Cryptosporidium hominis
FCEIVQGFKIDEISCNC

SEQ ID NO: 2209389 - protein, 27 aa, Cryptosporidium hominis
FCNVLPVLPVIPISFPQILRLNSMTQP

SEQ ID NO: 2209390 - protein, 17 aa, Cryptosporidium hominis
FCQTALKSLIRAILKAN

SEQ ID NO: 2209391 - protein, 17 aa, Cryptosporidium hominis
FDFSQFNICLVPQVEEF

SEQ ID NO: 2209392 - protein, 18 aa, Cryptosporidium hominis
FDVRSALICYLCARNFRN

SEQ ID NO: 2209393 - protein, 20 aa, Cryptosporidium hominis
FEALMGMSFIKLKQILKELS

SEQ ID NO: 2209394 - protein, 18 aa, Cryptosporidium hominis
FEDLSFKYRNDPINFFWI

SEQ ID NO: 2209395 - protein, 34 aa, Cryptosporidium hominis
FEFLRDIVRFLPFQWYSQYLTALANLLLTKSQEW

SEQ ID NO: 2209396 - protein, 18 aa, Cryptosporidium hominis
FETAPMIGFCPDGSEVPP

SEQ ID NO: 2209397 - protein, 23 aa, Cryptosporidium hominis
FETFIKEIIPPPQLIDPKYDIRS

SEQ ID NO: 2209398 - protein, 23 aa, Cryptosporidium hominis
FFDGTLIHWSLQYIFSQIYNRNI

SEQ ID NO: 2209399 - protein, 34 aa, Cryptosporidium hominis
FFIIYQFFFNSFFSNRVCLFETFKLIEEKRNSQF

SEQ ID NO: 2209400 - protein, 17 aa, Cryptosporidium hominis
FFQVFKILSKEAASIYG

SEQ ID NO: 2209401 - protein, 25 aa, Cryptosporidium hominis
FGGQNKIISPLLYSLLQLTAGVQGT

SEQ ID NO: 2209402 - protein, 25 aa, Cryptosporidium hominis
FGKILIMEICILYYDPKSFLDQEFV

SEQ ID NO: 2209403 - protein, 17 aa, Cryptosporidium hominis
FGLLGLFSAVKGEMQQI

SEQ ID NO: 2209404 - protein, 24 aa, Cryptosporidium hominis
FGNTPFSYINTVKELPVGLKPQDA

SEQ ID NO: 2209405 - protein, 31 aa, Cryptosporidium hominis
FGSLLKECKLLTLIILLISLAQLNYATSNIS

SEQ ID NO: 2209406 - protein, 18 aa, Cryptosporidium hominis
FHLKIILNAINIIREFIP

SEQ ID NO: 2209407 - protein, 22 aa, Cryptosporidium hominis
FIACILYFISLVSANGVCILKK

SEQ ID NO: 2209408 - protein, 17 aa, Cryptosporidium hominis
FIAFFQEGEQKLEVLHK

SEQ ID NO: 2209409 - protein, 23 aa, Cryptosporidium hominis
FIAYLFLFFYCLNVARCDNKINN

SEQ ID NO: 2209410 - protein, 25 aa, Cryptosporidium hominis
FIDGNNLVLVLFYDYSITSKNIIHG

SEQ ID NO: 2209411 - protein, 31 aa, Cryptosporidium hominis
FIEEMDDLTIMLYLLAKEFPSKNHFANIAKD

SEQ ID NO: 2209412 - protein, 19 aa, Cryptosporidium hominis
FIESSKFRLELISSLTNIY

SEQ ID NO: 2209413 - protein, 26 aa, Cryptosporidium hominis
FIFAIYFFALFFNNIFQIKAAEAPDG

SEQ ID NO: 2209414 - protein, 27 aa, Cryptosporidium hominis
FIFICIFLVFCKLPYISRCEQLESEEI

SEQ ID NO: 2209415 - protein, 17 aa, Cryptosporidium hominis
FIFSPKSLNLIECTNNV

SEQ ID NO: 2209416 - protein, 30 aa, Cryptosporidium hominis
FIISILQWYFFFLLVILMAGRIYGESSRES

SEQ ID NO: 2209417 - protein, 19 aa, Cryptosporidium hominis
FIIVGLLIGLISCEERENI

SEQ ID NO: 2209418 - protein, 18 aa, Cryptosporidium hominis
FILEVSFLNAASLETGSE

SEQ ID NO: 2209419 - protein, 25 aa, Cryptosporidium hominis
FILGFFLIFLGVHSESSLLSEGTAS

SEQ ID NO: 2209420 - protein, 19 aa, Cryptosporidium hominis
FIMQEKHIYFGGTKYFFKS

SEQ ID NO: 2209421 - protein, 18 aa, Cryptosporidium hominis
FINTFIPILSKKSSKTSY

SEQ ID NO: 2209422 - protein, 22 aa, Cryptosporidium hominis
FIPRCMMRLLTYLGKLGSELVN

SEQ ID NO: 2209423 - protein, 19 aa, Cryptosporidium hominis
FIRVCVHNYFWRVPCGEIV

SEQ ID NO: 2209424 - protein, 25 aa, Cryptosporidium hominis
FKAKKDLMKFTPQKGIELGKKIARN

SEQ ID NO: 2209425 - protein, 18 aa, Cryptosporidium hominis
FKCPRLIASFFRDRILGY

SEQ ID NO: 2209426 - protein, 25 aa, Cryptosporidium hominis
FKKDEYIFFLETLIPQISTIDESFN

SEQ ID NO: 2209427 - protein, 22 aa, Cryptosporidium hominis
FKLFLGILSFALVSALDLDLNK

SEQ ID NO: 2209428 - protein, 17 aa, Cryptosporidium hominis
FKLFLQKFEEKFMHVLD

SEQ ID NO: 2209429 - protein, 31 aa, Cryptosporidium hominis
FKNWSLLAILNILLFITKFQSGATSATDELF

SEQ ID NO: 2209430 - protein, 20 aa, Cryptosporidium hominis
FKVPLVIQLTDDEKFIFKSN

SEQ ID NO: 2209431 - protein, 26 aa, Cryptosporidium hominis
FKVSIFYFVLGLILDFGKVSCIPTGI

SEQ ID NO: 2209432 - protein, 29 aa, Cryptosporidium hominis
FKWFFTATLVFIFGLLILSSRAEEIEGED

SEQ ID NO: 2209433 - protein, 23 aa, Cryptosporidium hominis
FLFGLVYLLPLNFNYYNSENCVK

SEQ ID NO: 2209434 - protein, 19 aa, Cryptosporidium hominis
FLFIIYSSSRDVETKPGIS

SEQ ID NO: 2209435 - protein, 25 aa, Cryptosporidium hominis
FLGSAAITLFSFFDSFSLVLTDFSN

SEQ ID NO: 2209436 - protein, 19 aa, Cryptosporidium hominis
FLIFLLSSIEIPSVDSKRK

SEQ ID NO: 2209437 - protein, 19 aa, Cryptosporidium hominis
FLIISLLSISEVYSEQNDE

SEQ ID NO: 2209438 - protein, 17 aa, Cryptosporidium hominis
FLIIYFRERERTKTRER

SEQ ID NO: 2209439 - protein, 20 aa, Cryptosporidium hominis
FLILCVFTSGTPIPTPNEIV

SEQ ID NO: 2209440 - protein, 19 aa, Cryptosporidium hominis
FLIVFLGSFTFCEQLGHNN

SEQ ID NO: 2209441 - protein, 18 aa, Cryptosporidium hominis
FLKFMHTNRMNIRKWILF

SEQ ID NO: 2209442 - protein, 25 aa, Cryptosporidium hominis
FLLFIKLGVFSLTINTSPKPNPFTV

SEQ ID NO: 2209443 - protein, 21 aa, Cryptosporidium hominis
FLLIILLVLSCAYANQFSNFG

SEQ ID NO: 2209444 - protein, 24 aa, Cryptosporidium hominis
FLLKWIIFSYIVINNINGIKSINT

SEQ ID NO: 2209445 - protein, 21 aa, Cryptosporidium hominis
FLLLFFTKYLKITNGAEAPIK

SEQ ID NO: 2209446 - protein, 19 aa, Cryptosporidium hominis
FLMHFVINYGKIPRVIFDR

SEQ ID NO: 2209447 - protein, 17 aa, Cryptosporidium hominis
FLSLIKNKKLFKFIKRK

SEQ ID NO: 2209448 - protein, 25 aa, Cryptosporidium hominis
FLTPFIGLVLLLNFAHGIPKTSSSN

SEQ ID NO: 2209449 - protein, 27 aa, Cryptosporidium hominis
FMTETLDLMIYLARKFNPKLLGEGLAI

SEQ ID NO: 2209450 - protein, 23 aa, Cryptosporidium hominis
FNEMLFIEKLDAIPYIKVIVVLK

SEQ ID NO: 2209451 - protein, 35 aa, Cryptosporidium hominis
FNFEKMVFKSFYNLSLFFLKWFKTGPEQGDCRFYK

SEQ ID NO: 2209452 - protein, 30 aa, Cryptosporidium hominis
FNKDFFVGKSIFNLFLIPKITDLNGGYVYG

SEQ ID NO: 2209453 - protein, 17 aa, Cryptosporidium hominis
FNKKLLFGFIPNCKKND

SEQ ID NO: 2209454 - protein, 19 aa, Cryptosporidium hominis
FNSDCIYGLRTLSIGARHA

SEQ ID NO: 2209455 - protein, 26 aa, Cryptosporidium hominis
FNSYIGYWDVINSLGVLIVNLGYKKD

SEQ ID NO: 2209456 - protein, 19 aa, Cryptosporidium hominis
FPEFLGNRSFPITPPVVLS

SEQ ID NO: 2209457 - protein, 25 aa, Cryptosporidium hominis
FPLAFTSFVLCTLEYEIWNLENNVE

SEQ ID NO: 2209458 - protein, 21 aa, Cryptosporidium hominis
FPLAHQLGLMQLQSFKAKDEQ

SEQ ID NO: 2209459 - protein, 30 aa, Cryptosporidium hominis
FQGKSLNVNLLRLYRLICKLDSILNTFFSN

SEQ ID NO: 2209460 - protein, 18 aa, Cryptosporidium hominis
FQIRTCNHVIWTSEVLLS

SEQ ID NO: 2209461 - protein, 24 aa, Cryptosporidium hominis
FQSNIPIPRGLNLGLPQLSPYLPS

SEQ ID NO: 2209462 - protein, 17 aa, Cryptosporidium hominis
FQWGFYLGDGTINLVTD

SEQ ID NO: 2209463 - protein, 20 aa, Cryptosporidium hominis
FSCLIIKWNFSLSQDSLHSV

SEQ ID NO: 2209464 - protein, 23 aa, Cryptosporidium hominis
FSEALIKFCSYLKSFSPKRIHLD

SEQ ID NO: 2209465 - protein, 17 aa, Cryptosporidium hominis
FSGFDLLLGVYPSTTIK

SEQ ID NO: 2209466 - protein, 25 aa, Cryptosporidium hominis
FSIPKLSLDINFSPAKTLFGWREVL

SEQ ID NO: 2209467 - protein, 24 aa, Cryptosporidium hominis
FSKVDVPTLFFWGAEDRLCPLSSA

SEQ ID NO: 2209468 - protein, 22 aa, Cryptosporidium hominis
FSLPLTYKIFLPDDVLPSVTVV

SEQ ID NO: 2209469 - protein, 18 aa, Cryptosporidium hominis
FSMLVLESVIKILKNQRS

SEQ ID NO: 2209470 - protein, 18 aa, Cryptosporidium hominis
FSQGPPPHLPPSSNSYSN

SEQ ID NO: 2209471 - protein, 17 aa, Cryptosporidium hominis
FSSIFLCSKHEIKEIPH

SEQ ID NO: 2209472 - protein, 26 aa, Cryptosporidium hominis
FSSKNIIINKYLNTYFSYWSEIHQRF

SEQ ID NO: 2209473 - protein, 19 aa, Cryptosporidium hominis
FSSLMHWYHFSKKRRKLKG

SEQ ID NO: 2209474 - protein, 19 aa, Cryptosporidium hominis
FSSSFPHIFGGRTDVHCLV

SEQ ID NO: 2209475 - protein, 20 aa, Cryptosporidium hominis
FTERSFLPTISLVRTKIIHK

SEQ ID NO: 2209476 - protein, 18 aa, Cryptosporidium hominis
FTISEGIPALIPRIEELA

SEQ ID NO: 2209477 - protein, 24 aa, Cryptosporidium hominis
FTITPFLFSAVALNKPVFSPDSQI

SEQ ID NO: 2209478 - protein, 29 aa, Cryptosporidium hominis
FTKIDSVVLFYVPWCVYCRGIMPEFEKAA

SEQ ID NO: 2209479 - protein, 21 aa, Cryptosporidium hominis
FTNDWINFLNLLKTIEIDSKT

SEQ ID NO: 2209480 - protein, 25 aa, Cryptosporidium hominis
FTNLEYIGELYPDILRIEKKISCSQ

SEQ ID NO: 2209481 - protein, 31 aa, Cryptosporidium hominis
FTSSHYVPYTFLTYGFRRSFERRSATRLLKI

SEQ ID NO: 2209482 - protein, 19 aa, Cryptosporidium hominis
FTTPYHFLELNPSSIRELI

SEQ ID NO: 2209483 - protein, 25 aa, Cryptosporidium hominis
FTYARKVFELVVIRKLTLLHSRGDL

SEQ ID NO: 2209484 - protein, 17 aa, Cryptosporidium hominis
FVFIAIFALNSHSTLAE

SEQ ID NO: 2209485 - protein, 23 aa, Cryptosporidium hominis
FVGIFLKNSLSPDVLFPGWDNND

SEQ ID NO: 2209486 - protein, 26 aa, Cryptosporidium hominis
FVIFLLSALCLAFVPNFAVLGAENEI

SEQ ID NO: 2209487 - protein, 19 aa, Cryptosporidium hominis
FVKIRVFVETLNPVKHQSQ

SEQ ID NO: 2209488 - protein, 24 aa, Cryptosporidium hominis
FVLSIGLLLINLTIIFASDINEQD

SEQ ID NO: 2209489 - protein, 19 aa, Cryptosporidium hominis
FVMISEFFGRWLDTSNSLF

SEQ ID NO: 2209490 - protein, 31 aa, Cryptosporidium hominis
FVNLNSHYFQKIFNYLLDTQYLRSIDSLQLQ

SEQ ID NO: 2209491 - protein, 19 aa, Cryptosporidium hominis
FVPIYKSPFMKLSQISLEK

SEQ ID NO: 2209492 - protein, 24 aa, Cryptosporidium hominis
FVRDCRLFLSESFSNLLDSELSEL

SEQ ID NO: 2209493 - protein, 18 aa, Cryptosporidium hominis
FVSFLFFIFQYPSSISFH

SEQ ID NO: 2209494 - protein, 18 aa, Cryptosporidium hominis
FVTGKRWPRIYKIELTKI

SEQ ID NO: 2209495 - protein, 18 aa, Cryptosporidium hominis
FVTISVNGFYAFDPIVIP

SEQ ID NO: 2209496 - protein, 25 aa, Cryptosporidium hominis
FVVVSFYKMFGYPTGLGALISKTDQ

SEQ ID NO: 2209497 - protein, 18 aa, Cryptosporidium hominis
FYDHYIFNQCTCSKKKSG

SEQ ID NO: 2209498 - protein, 26 aa, Cryptosporidium hominis
FYKGEIKFLPLFEFLNVYAETFVMGG

SEQ ID NO: 2209499 - protein, 25 aa, Cryptosporidium hominis
FYLFTLYTSLIYPVSYGSNYYQTIS

SEQ ID NO: 2209500 - protein, 20 aa, Cryptosporidium hominis
FYLIILLKTSNCQIPGGNYE

SEQ ID NO: 2209501 - protein, 20 aa, Cryptosporidium hominis
FYLIVIVGLVVSAESGDLYI

SEQ ID NO: 2209502 - protein, 23 aa, Cryptosporidium hominis
FYLLLLIIFGLIVQIQAADGGEG

SEQ ID NO: 2209503 - protein, 23 aa, Cryptosporidium hominis
FYSKIFAITKSWWLNISKLSDPT

SEQ ID NO: 2209504 - protein, 18 aa, Cryptosporidium hominis
GAISGIGFHWKKPPKPGQ

SEQ ID NO: 2209505 - protein, 21 aa, Cryptosporidium hominis
GARLYSPTYFKPAAASDEEYW

SEQ ID NO: 2209506 - protein, 25 aa, Cryptosporidium hominis
GASNLFAIILSHFEWEHIQLRWRVL

SEQ ID NO: 2209507 - protein, 25 aa, Cryptosporidium hominis
GCYIPCQPPFKDSFYSHWCSNDLSL

SEQ ID NO: 2209508 - protein, 17 aa, Cryptosporidium hominis
GDDFIVCKVLNSVTIGE

SEQ ID NO: 2209509 - protein, 22 aa, Cryptosporidium hominis
GDRLLYGWYTIRDIYNKGEWGV

SEQ ID NO: 2209510 - protein, 27 aa, Cryptosporidium hominis
GDSVSQYDLLAILFVVKTRQGEAPLVK

SEQ ID NO: 2209511 - protein, 24 aa, Cryptosporidium hominis
GEELHLIYYGLLTLNCFTHQTQGE

SEQ ID NO: 2209512 - protein, 22 aa, Cryptosporidium hominis
GEIFVNFDFSLLSNGDFIDSSV

SEQ ID NO: 2209513 - protein, 18 aa, Cryptosporidium hominis
GEMIAISFIRPVLCINAN

SEQ ID NO: 2209514 - protein, 26 aa, Cryptosporidium hominis
GESIDFTVRRWIGKPFSQMVTLTNSI

SEQ ID NO: 2209515 - protein, 24 aa, Cryptosporidium hominis
GFKNLIVDILDFLVELRLLSNIEA

SEQ ID NO: 2209516 - protein, 23 aa, Cryptosporidium hominis
GFLDQRIALEWIHKYIVNFGGDP

SEQ ID NO: 2209517 - protein, 25 aa, Cryptosporidium hominis
GFSEFRTYKGIFSELVFHDKTASNA

SEQ ID NO: 2209518 - protein, 25 aa, Cryptosporidium hominis
GFSENYLSFFNLKNSNIVGIVCSTN

SEQ ID NO: 2209519 - protein, 26 aa, Cryptosporidium hominis
GFSLYMIFIFLLGDVTGIHINRELQN

SEQ ID NO: 2209520 - protein, 18 aa, Cryptosporidium hominis
GFWPVSAIRFAGGDLVVQ

SEQ ID NO: 2209521 - protein, 27 aa, Cryptosporidium hominis
GGELVLTIVPSLPKYFGGKGAFSIESS

SEQ ID NO: 2209522 - protein, 22 aa, Cryptosporidium hominis
GGISLKFYIRMCTNLINHFPRL

SEQ ID NO: 2209523 - protein, 26 aa, Cryptosporidium hominis
GGQYYSALLNCCGEVFIWGMKDCCGL

SEQ ID NO: 2209524 - protein, 23 aa, Cryptosporidium hominis
GGVNFFSILSRLVSLKNYMKRLH

SEQ ID NO: 2209525 - protein, 25 aa, Cryptosporidium hominis
GGYAVYCNRWLFTNRPWKSRIIIQS

SEQ ID NO: 2209526 - protein, 24 aa, Cryptosporidium hominis
GHTIDYFIISTPPSYTLPKSEKLC

SEQ ID NO: 2209527 - protein, 25 aa, Cryptosporidium hominis
GHTTGWYITAFCRAVYFAEKDVCIS

SEQ ID NO: 2209528 - protein, 25 aa, Cryptosporidium hominis
GIAYYDYDFLYSWEPKSYNLTVNVT

SEQ ID NO: 2209529 - protein, 19 aa, Cryptosporidium hominis
GICISILIFSISGVKCRLY

SEQ ID NO: 2209530 - protein, 34 aa, Cryptosporidium hominis
GIIHQGNFQLFRGKLPIVTLSSTSILLPLDSISD

SEQ ID NO: 2209531 - protein, 22 aa, Cryptosporidium hominis
GIILFLILHVLIKFKHVIGEIT

SEQ ID NO: 2209532 - protein, 24 aa, Cryptosporidium hominis
GISFIAILGPLRTFLDLMNKNWGI

SEQ ID NO: 2209533 - protein, 24 aa, Cryptosporidium hominis
GKDGKTICWTLLNNQQPEIFTEIH

SEQ ID NO: 2209534 - protein, 23 aa, Cryptosporidium hominis
GKECVLTNYYPLEAICQDGTRSK

SEQ ID NO: 2209535 - protein, 25 aa, Cryptosporidium hominis
GKFNPYTMSLLFMIKERQQHDPRIL

SEQ ID NO: 2209536 - protein, 24 aa, Cryptosporidium hominis
GKHKNLCFIYLKNGEISLEEQSML

SEQ ID NO: 2209537 - protein, 31 aa, Cryptosporidium hominis
GKKRVSTIIKALAWIAIVCLVKNASSEGLSG

SEQ ID NO: 2209538 - protein, 23 aa, Cryptosporidium hominis
GKLSLHIMVLALILVIQLTQCVK

SEQ ID NO: 2209539 - protein, 20 aa, Cryptosporidium hominis
GKNDALYAKSLLLTKLINKE

SEQ ID NO: 2209540 - protein, 19 aa, Cryptosporidium hominis
GKVEPWIYTKRSGFTNHCI

SEQ ID NO: 2209541 - protein, 21 aa, Cryptosporidium hominis
GKYYKEFGLPYLYDDIGNVRS

SEQ ID NO: 2209542 - protein, 24 aa, Cryptosporidium hominis
GLATSNFAFRYLVSRVFGPKAGEA

SEQ ID NO: 2209543 - protein, 19 aa, Cryptosporidium hominis
GLGFLILAICLNVEVKSQQ

SEQ ID NO: 2209544 - protein, 17 aa, Cryptosporidium hominis
GLILLGRGLSYPSLRPN

SEQ ID NO: 2209545 - protein, 17 aa, Cryptosporidium hominis
GLLVQLSLSLERCLASN

SEQ ID NO: 2209546 - protein, 20 aa, Cryptosporidium hominis
GLSHIIPLDKAPIRPQKRQD

SEQ ID NO: 2209547 - protein, 22 aa, Cryptosporidium hominis
GLSSFWTPPTGFGGFFPMLVPN

SEQ ID NO: 2209548 - protein, 20 aa, Cryptosporidium hominis
GLYSMNYWVQQLTTFTSTSL

SEQ ID NO: 2209549 - protein, 20 aa, Cryptosporidium hominis
GMMTNWYRQLQKMGLVVPKL

SEQ ID NO: 2209550 - protein, 26 aa, Cryptosporidium hominis
GNNNRIPLPIMVRYGLTEDGKLAAFS

SEQ ID NO: 2209551 - protein, 17 aa, Cryptosporidium hominis
GNNPNIIYSQFNRLCLI

SEQ ID NO: 2209552 - protein, 25 aa, Cryptosporidium hominis
GNSGKIIIYPVLPIPTFEFNGEKSV

SEQ ID NO: 2209553 - protein, 19 aa, Cryptosporidium hominis
GNVMYLPITSAFSTGWDNT

SEQ ID NO: 2209554 - protein, 24 aa, Cryptosporidium hominis
GPPQWDTWWSELGGFFTGVGELME

SEQ ID NO: 2209555 - protein, 17 aa, Cryptosporidium hominis
GQRLKEWVILKYKQIHD

SEQ ID NO: 2209556 - protein, 22 aa, Cryptosporidium hominis
GQSRIHLFTWAADKLWEDSDVM

SEQ ID NO: 2209557 - protein, 23 aa, Cryptosporidium hominis
GRGPVLPYMEFGRRLQKISYENF

SEQ ID NO: 2209558 - protein, 25 aa, Cryptosporidium hominis
GRHLRLMRAGFGIMAYLLSENLCIE

SEQ ID NO: 2209559 - protein, 19 aa, Cryptosporidium hominis
GRISKIGRFYLINQNRQEN

SEQ ID NO: 2209560 - protein, 23 aa, Cryptosporidium hominis
GRNVYIQIFRDSYVTLYTNKAVG

SEQ ID NO: 2209561 - protein, 23 aa, Cryptosporidium hominis
GSEIFSFYTYLSDSIDFIQSEVR

SEQ ID NO: 2209562 - protein, 18 aa, Cryptosporidium hominis
GSEYFGFYPPQSEIFPIA

SEQ ID NO: 2209563 - protein, 23 aa, Cryptosporidium hominis
GSSSDLIVLKFSDSVVGIVDSSK

SEQ ID NO: 2209564 - protein, 23 aa, Cryptosporidium hominis
GSVSHGFLCLGLNKLKTFKTESW

SEQ ID NO: 2209565 - protein, 25 aa, Cryptosporidium hominis
GTIPGIFPIKYLRNLGYHVDGGFIA

SEQ ID NO: 2209566 - protein, 24 aa, Cryptosporidium hominis
GTLDKFIKGFYILMAETGVRLQIY

SEQ ID NO: 2209567 - protein, 26 aa, Cryptosporidium hominis
GVKGEGHYIFFRAPGYMPGASAVLIG

SEQ ID NO: 2209568 - protein, 22 aa, Cryptosporidium hominis
GVLFLILSWVGLVVPKLEIRIS

SEQ ID NO: 2209569 - protein, 17 aa, Cryptosporidium hominis
GWCAPECRPTWLGDGQC

SEQ ID NO: 2209570 - protein, 19 aa, Cryptosporidium hominis
GWDNTLLIQFDLSSYAKTI

SEQ ID NO: 2209571 - protein, 28 aa, Cryptosporidium hominis
GWLHKHRNSLPYWPSINISPPKNRITFY

SEQ ID NO: 2209572 - protein, 28 aa, Cryptosporidium hominis
GYDISKPFPFYFLVIVECDILYNLIKLF

SEQ ID NO: 2209573 - protein, 26 aa, Cryptosporidium hominis
GYEEYFGNMIPLGPFDRVRGPGCKTP

SEQ ID NO: 2209574 - protein, 34 aa, Cryptosporidium hominis
GYEQGTQSFIIPPPPSFPAPPPPSIPSGTPSRTP

SEQ ID NO: 2209575 - protein, 21 aa, Cryptosporidium hominis
GYFTFWLQKKFSENKFVVGVN

SEQ ID NO: 2209576 - protein, 22 aa, Cryptosporidium hominis
GYPDILVILKFGNGTRQTKLIE

SEQ ID NO: 2209577 - protein, 21 aa, Cryptosporidium hominis
GYSFGSILPSCTYVNGGNVCT

SEQ ID NO: 2209578 - protein, 25 aa, Cryptosporidium hominis
HADHAPYNLICPVGSRLVADKCVTY

SEQ ID NO: 2209579 - protein, 34 aa, Cryptosporidium hominis
HAYKLNDGFFDIFAFYFFKDYAAIQYLLDGTVCR

SEQ ID NO: 2209580 - protein, 18 aa, Cryptosporidium hominis
HDHYERTLRFLTFQAEQV

SEQ ID NO: 2209581 - protein, 27 aa, Cryptosporidium hominis
HDIVDFALKHNLDFIALSFVQNGADVQ

SEQ ID NO: 2209582 - protein, 21 aa, Cryptosporidium hominis
HFFRRNIFLSHRDFEKILDVY

SEQ ID NO: 2209583 - protein, 20 aa, Cryptosporidium hominis
HGFEYLFSQAKNRKLPIFYK

SEQ ID NO: 2209584 - protein, 17 aa, Cryptosporidium hominis
HIFFIHQFVATEAFTFR

SEQ ID NO: 2209585 - protein, 29 aa, Cryptosporidium hominis
HISLRQWADLYIILPLSANTLAKLSNGLC

SEQ ID NO: 2209586 - protein, 33 aa, Cryptosporidium hominis
HISLRRKWTLFCWFFSILIREISSDLPPNCIHG

SEQ ID NO: 2209587 - protein, 22 aa, Cryptosporidium hominis
HIVLLFVIFCDFTERSFLPTIS

SEQ ID NO: 2209588 - protein, 18 aa, Cryptosporidium hominis
HKGFYFVDAESKKNCKIL

SEQ ID NO: 2209589 - protein, 17 aa, Cryptosporidium hominis
HKRQPIYDFLGSKTALV

SEQ ID NO: 2209590 - protein, 22 aa, Cryptosporidium hominis
HLFDYFFYGFGVEIVEFATQSN

SEQ ID NO: 2209591 - protein, 22 aa, Cryptosporidium hominis
HNFNYELGYIKRDYYKLVKAVR

SEQ ID NO: 2209592 - protein, 35 aa, Cryptosporidium hominis
HNHSKQNLLVQCKILYQAFYSYKNSVRSRLLKKIS

SEQ ID NO: 2209593 - protein, 20 aa, Cryptosporidium hominis
HNKRSSFSSIFLCSKHEIKE

SEQ ID NO: 2209594 - protein, 27 aa, Cryptosporidium hominis
HNMKEIYKILLESLLTLKKFYEAVTES

SEQ ID NO: 2209595 - protein, 17 aa, Cryptosporidium hominis
HPEGTIVLFSYKSLFSL

SEQ ID NO: 2209596 - protein, 24 aa, Cryptosporidium hominis
HPIDKKCVAAIFLILQACISELGK

SEQ ID NO: 2209597 - protein, 22 aa, Cryptosporidium hominis
HPITWQLIMGVVRRIKPTGQGK

SEQ ID NO: 2209598 - protein, 18 aa, Cryptosporidium hominis
HQMLVNRIWYDGTSFKTL

SEQ ID NO: 2209599 - protein, 24 aa, Cryptosporidium hominis
HRWKTLSILIILFVISVDHDLARK

SEQ ID NO: 2209600 - protein, 29 aa, Cryptosporidium hominis
HSGATPPIPGMPVPWPLPTATQQLNSTTS

SEQ ID NO: 2209601 - protein, 21 aa, Cryptosporidium hominis
HSLSYLSLFDGLQLGISLFSQ

SEQ ID NO: 2209602 - protein, 17 aa, Cryptosporidium hominis
HSSHLNTVLLVEPEMLP

SEQ ID NO: 2209603 - protein, 17 aa, Cryptosporidium hominis
HSYIPEIALKRVPNLDS

SEQ ID NO: 2209604 - protein, 20 aa, Cryptosporidium hominis
IAAFRLLRRCMSDPSNALDF

SEQ ID NO: 2209605 - protein, 40 aa, Cryptosporidium hominis
IAGKHFVNAQLFLKYRSSILILVLVFLAILDGSFSGEESP

SEQ ID NO: 2209606 - protein, 20 aa, Cryptosporidium hominis
IAIISLINPLNVLYHVVDIR

SEQ ID NO: 2209607 - protein, 24 aa, Cryptosporidium hominis
IANEYADYELACPPGLIVISDKCA

SEQ ID NO: 2209608 - protein, 20 aa, Cryptosporidium hominis
IAPGRPFAPLIKGSIKSKCQ

SEQ ID NO: 2209609 - protein, 24 aa, Cryptosporidium hominis
IAPTLPNMPPMKRPQAPLIYRCRF

SEQ ID NO: 2209610 - protein, 32 aa, Cryptosporidium hominis
IARNASIGVIWIYEPGLLLAEELVSPCFGIIS

SEQ ID NO: 2209611 - protein, 31 aa, Cryptosporidium hominis
ICQKGLQLPLRQSLIFFYYAGIKEVIKYFDI

SEQ ID NO: 2209612 - protein, 18 aa, Cryptosporidium hominis
ICYKKWKTVKQSLKSLEA

SEQ ID NO: 2209613 - protein, 17 aa, Cryptosporidium hominis
ICYLMLKVALTTFVFGS

SEQ ID NO: 2209614 - protein, 19 aa, Cryptosporidium hominis
IDDPVFVFLISFISDYHNT

SEQ ID NO: 2209615 - protein, 25 aa, Cryptosporidium hominis
IDFQYLLVRLCHLFSFRIECLATNV

SEQ ID NO: 2209616 - protein, 28 aa, Cryptosporidium hominis
IDGSIALCFLAFIIFLVVKVGGTNNENL

SEQ ID NO: 2209617 - protein, 18 aa, Cryptosporidium hominis
IDSLINFFENEDIKAKEE

SEQ ID NO: 2209618 - protein, 19 aa, Cryptosporidium hominis
IDTLAPLQIFPNLTLNAEC

SEQ ID NO: 2209619 - protein, 24 aa, Cryptosporidium hominis
IDVNLLPLGWESVLNKSIELKKKM

SEQ ID NO: 2209620 - protein, 28 aa, Cryptosporidium hominis
IEDSNLCTLHLLLKKYSQNRSGSPNSKV

SEQ ID NO: 2209621 - protein, 21 aa, Cryptosporidium hominis
IEEMMILLAFERILTQKTASS

SEQ ID NO: 2209622 - protein, 17 aa, Cryptosporidium hominis
IEFLKFMHTNRMNIRKW

SEQ ID NO: 2209623 - protein, 24 aa, Cryptosporidium hominis
IEFSPIDPNLLLSSGKDGKTICWT

SEQ ID NO: 2209624 - protein, 17 aa, Cryptosporidium hominis
IEGLSHIIPLDKAPIRP

SEQ ID NO: 2209625 - protein, 22 aa, Cryptosporidium hominis
IEGWQWDNTSNNWLWGPLRNQD

SEQ ID NO: 2209626 - protein, 24 aa, Cryptosporidium hominis
IENLYSWYEVVVPPKPQYCSTMKL

SEQ ID NO: 2209627 - protein, 31 aa, Cryptosporidium hominis
IESLLEQIFKCLILLRLDKYSRRIFKDNSVN

SEQ ID NO: 2209628 - protein, 22 aa, Cryptosporidium hominis
IESPQLNLQLNLQLNLQLNLQL

SEQ ID NO: 2209629 - protein, 27 aa, Cryptosporidium hominis
IETQPIKPNWLWFSPDINIRYHINRAF

SEQ ID NO: 2209630 - protein, 25 aa, Cryptosporidium hominis
IEVIENFYEFWRGFQSNRDFSIHEE

SEQ ID NO: 2209631 - protein, 20 aa, Cryptosporidium hominis
IFFLLPFLGRTMDPDLNFKN

SEQ ID NO: 2209632 - protein, 17 aa, Cryptosporidium hominis
IFFVFIGGINENKGILN

SEQ ID NO: 2209633 - protein, 18 aa, Cryptosporidium hominis
IFHRVIPGFMAQGGDFTN

SEQ ID NO: 2209634 - protein, 20 aa, Cryptosporidium hominis
IFIAILLVNTFGPSYYMGLV

SEQ ID NO: 2209635 - protein, 23 aa, Cryptosporidium hominis
IFIFFVLFDIFATSQYEISPNAT

SEQ ID NO: 2209636 - protein, 19 aa, Cryptosporidium hominis
IFIQLSWVFGTESQNGKHR

SEQ ID NO: 2209637 - protein, 25 aa, Cryptosporidium hominis
IFIYTWLMLFEKVDGSFLTGNNIAA

SEQ ID NO: 2209638 - protein, 19 aa, Cryptosporidium hominis
IFKEILYQIFQGLNSAHSL

SEQ ID NO: 2209639 - protein, 23 aa, Cryptosporidium hominis
IFLILIFLICQTQGISNDLSSLT

SEQ ID NO: 2209640 - protein, 21 aa, Cryptosporidium hominis
IFLLFLISSPFGYSVYVTREE

SEQ ID NO: 2209641 - protein, 20 aa, Cryptosporidium hominis
IFLLLSIIIVSEAQIKLWNL

SEQ ID NO: 2209642 - protein, 19 aa, Cryptosporidium hominis
IFPRLLDFRVSDACKVVSA

SEQ ID NO: 2209643 - protein, 26 aa, Cryptosporidium hominis
IFSLPATFELVWGKYFQLIYETAIDS

SEQ ID NO: 2209644 - protein, 26 aa, Cryptosporidium hominis
IFTGALILLEYLKIKIIKVVHLLNEY

SEQ ID NO: 2209645 - protein, 17 aa, Cryptosporidium hominis
IFWDNSACIFELDTGRP

SEQ ID NO: 2209646 - protein, 25 aa, Cryptosporidium hominis
IGAIAPLYRVATPIDLPPITAKDIS

SEQ ID NO: 2209647 - protein, 21 aa, Cryptosporidium hominis
IGDISVFRRYFHQNQKNNKLG

SEQ ID NO: 2209648 - protein, 19 aa, Cryptosporidium hominis
IGFKLKLHPKLLIDPLKYD

SEQ ID NO: 2209649 - protein, 20 aa, Cryptosporidium hominis
IGLGLYVDPRRLLIDSTLVK

SEQ ID NO: 2209650 - protein, 30 aa, Cryptosporidium hominis
IGNILIVVLLRAMFYNYKFGKDIYLCSIIY

SEQ ID NO: 2209651 - protein, 25 aa, Cryptosporidium hominis
IGRNALVRTWYRVFRKLGSTKNRMK

SEQ ID NO: 2209652 - protein, 23 aa, Cryptosporidium hominis
IGYSNVLLNALIYDKSRLQEELS

SEQ ID NO: 2209653 - protein, 25 aa, Cryptosporidium hominis
IHEFDRYIFMQYLEGVTLSEVLKRL

SEQ ID NO: 2209654 - protein, 20 aa, Cryptosporidium hominis
IHLLVFFGISANNIRLSFKE

SEQ ID NO: 2209655 - protein, 18 aa, Cryptosporidium hominis
IIALTTLIQNVRSSNIIL

SEQ ID NO: 2209656 - protein, 27 aa, Cryptosporidium hominis
IICLCIRLLTLAQYPPFWTSCRHLLQL

SEQ ID NO: 2209657 - protein, 25 aa, Cryptosporidium hominis
IICSATRFWVMCGSYMDSEVDALAS

SEQ ID NO: 2209658 - protein, 21 aa, Cryptosporidium hominis
IIFFSFLDLIYSQVNIMTDEY

SEQ ID NO: 2209659 - protein, 24 aa, Cryptosporidium hominis
IIFKDYFKTFSRLTINYLKSIIFS

SEQ ID NO: 2209660 - protein, 20 aa, Cryptosporidium hominis
IIFLQLFMSIRGGLNLSDGT

SEQ ID NO: 2209661 - protein, 21 aa, Cryptosporidium hominis
IIFSILICKVRLEVVIENEDP

SEQ ID NO: 2209662 - protein, 23 aa, Cryptosporidium hominis
IIFVFSLSFLSFEHRNERDIVSE

SEQ ID NO: 2209663 - protein, 19 aa, Cryptosporidium hominis
IIHLLKLEGSRIKNLRSEC

SEQ ID NO: 2209664 - protein, 20 aa, Cryptosporidium hominis
IIIGEPKCRSLKIRKRILHL

SEQ ID NO: 2209665 - protein, 18 aa, Cryptosporidium hominis
IIIGLLSITFVQASTVQS

SEQ ID NO: 2209666 - protein, 19 aa, Cryptosporidium hominis
IIIPAPDFFSYDIILHGFS

SEQ ID NO: 2209667 - protein, 23 aa, Cryptosporidium hominis
IILIALIFTQTNLHVNDLIIFQE

SEQ ID NO: 2209668 - protein, 18 aa, Cryptosporidium hominis
IIREVSILKLLNGYSDHH

SEQ ID NO: 2209669 - protein, 41 aa, Cryptosporidium hominis
IIRSKGGYFPLQSYGFQSYAIKLVFTSLFVTISVNGFYAFD

SEQ ID NO: 2209670 - protein, 27 aa, Cryptosporidium hominis
IISERHIIFLQAFIHHFSALSNIQLQP

SEQ ID NO: 2209671 - protein, 27 aa, Cryptosporidium hominis
IISILAVIAVFYSFTSTESDLVSSGHY

SEQ ID NO: 2209672 - protein, 26 aa, Cryptosporidium hominis
IITNLLLILFLYKIEVFESVEIEGIQ

SEQ ID NO: 2209673 - protein, 18 aa, Cryptosporidium hominis
IIYKSECDFLASKARLSD

SEQ ID NO: 2209674 - protein, 32 aa, Cryptosporidium hominis
IIYRKSKVLMNPLLNYLSLSLRTKILNALESN

SEQ ID NO: 2209675 - protein, 24 aa, Cryptosporidium hominis
IKAIDLLTPFIKGGKIGLFGGAGV

SEQ ID NO: 2209676 - protein, 26 aa, Cryptosporidium hominis
IKCFLLILFFNLATFFLVHAVVSEST

SEQ ID NO: 2209677 - protein, 20 aa, Cryptosporidium hominis
IKDIIVESLLRIYPNIELTG

SEQ ID NO: 2209678 - protein, 25 aa, Cryptosporidium hominis
IKESCPYLLLQITNLEHWPKIMLTP

SEQ ID NO: 2209679 - protein, 19 aa, Cryptosporidium hominis
IKFFKSSALLKWLKSTRTD

SEQ ID NO: 2209680 - protein, 20 aa, Cryptosporidium hominis
IKLEILKEKLLDKLRGRGFT

SEQ ID NO: 2209681 - protein, 24 aa, Cryptosporidium hominis
ILDSRPILYALNKKRSKLGENAVN

SEQ ID NO: 2209682 - protein, 22 aa, Cryptosporidium hominis
ILEFFDIYFLNPEKVFSKRDFL

SEQ ID NO: 2209683 - protein, 20 aa, Cryptosporidium hominis
ILFLILITSVFVKSENFRSA

SEQ ID NO: 2209684 - protein, 19 aa, Cryptosporidium hominis
ILFLVYAKSQKPIKNEIEL

SEQ ID NO: 2209685 - protein, 18 aa, Cryptosporidium hominis
ILFRDTSLPVIFQIAIKT

SEQ ID NO: 2209686 - protein, 17 aa, Cryptosporidium hominis
ILILEKKEFKKSASNIL

SEQ ID NO: 2209687 - protein, 23 aa, Cryptosporidium hominis
ILILWILLLTQLIPECTSSSLNS

SEQ ID NO: 2209688 - protein, 21 aa, Cryptosporidium hominis
ILKEFTPLSFNLNSPVWGKGY

SEQ ID NO: 2209689 - protein, 20 aa, Cryptosporidium hominis
ILKTLIIFVLINIIGSDSGA

SEQ ID NO: 2209690 - protein, 26 aa, Cryptosporidium hominis
ILLAFFYIVFVKCDLPIHVTTADIIG

SEQ ID NO: 2209691 - protein, 19 aa, Cryptosporidium hominis
ILLFYPISTSLGKESELFW

SEQ ID NO: 2209692 - protein, 17 aa, Cryptosporidium hominis
ILLVVSIFSGFVNCCPE

SEQ ID NO: 2209693 - protein, 29 aa, Cryptosporidium hominis
ILVLNILLFGLPIVVESSSFILPGSHDIN

SEQ ID NO: 2209694 - protein, 24 aa, Cryptosporidium hominis
ILVRKRRPVFNWLRKWRNKRKIKN

SEQ ID NO: 2209695 - protein, 17 aa, Cryptosporidium hominis
ILVTPPVTTPVATPIPA

SEQ ID NO: 2209696 - protein, 23 aa, Cryptosporidium hominis
IMENSLFFLLPSNTISKKSIFNF

SEQ ID NO: 2209697 - protein, 18 aa, Cryptosporidium hominis
IMTKYDFPKLYKLSNSSL

SEQ ID NO: 2209698 - protein, 19 aa, Cryptosporidium hominis
INDYPTMKFFRNKVAEEYY

SEQ ID NO: 2209699 - protein, 25 aa, Cryptosporidium hominis
INEDRYWHFIRKLYSNSYLIRRDLL

SEQ ID NO: 2209700 - protein, 19 aa, Cryptosporidium hominis
INIFKAQFSEFIDYEGLCE

SEQ ID NO: 2209701 - protein, 17 aa, Cryptosporidium hominis
INLLSIAGLSQYAHARL

SEQ ID NO: 2209702 - protein, 22 aa, Cryptosporidium hominis
INNILSSFIILGDLQIKFLVHF

SEQ ID NO: 2209703 - protein, 21 aa, Cryptosporidium hominis
INSIGIWWCQKALPQLITDKE

SEQ ID NO: 2209704 - protein, 25 aa, Cryptosporidium hominis
INTDRFKWYVAIGNDLSFTARYYVK

SEQ ID NO: 2209705 - protein, 18 aa, Cryptosporidium hominis
IPFGPQAPHLAMVDIFGV

SEQ ID NO: 2209706 - protein, 31 aa, Cryptosporidium hominis
IPGDYILKTVKIKLYFLAKRVNVAYSTLYSR

SEQ ID NO: 2209707 - protein, 26 aa, Cryptosporidium hominis
IPLVLCLAFLSNFLRINDQILSLNTH

SEQ ID NO: 2209708 - protein, 17 aa, Cryptosporidium hominis
IPMDVRIRFDDFSGFDL

SEQ ID NO: 2209709 - protein, 17 aa, Cryptosporidium hominis
IPPLGPFDRIRGPDCKT

SEQ ID NO: 2209710 - protein, 23 aa, Cryptosporidium hominis
IPSVTLFCRDLINSVTNPGKTTL

SEQ ID NO: 2209711 - protein, 28 aa, Cryptosporidium hominis
IPTPKAPTLSPLPPLPPTSKVPTLPTLP

SEQ ID NO: 2209712 - protein, 18 aa, Cryptosporidium hominis
IPVHDQAYIFWESLRFSN

SEQ ID NO: 2209713 - protein, 18 aa, Cryptosporidium hominis
IPYGITFEGLHRKPTTTV

SEQ ID NO: 2209714 - protein, 22 aa, Cryptosporidium hominis
IQALTLLILIKNDFSALESDEL

SEQ ID NO: 2209715 - protein, 31 aa, Cryptosporidium hominis
IQENIDFLLNMLLVLFEYGIERFLGSAAITL

SEQ ID NO: 2209716 - protein, 25 aa, Cryptosporidium hominis
IQILGYPSILLFKSGMKTEPILYNG

SEQ ID NO: 2209717 - protein, 26 aa, Cryptosporidium hominis
IQLQPELYCLLFTNSMRPSIFSFVSN

SEQ ID NO: 2209718 - protein, 31 aa, Cryptosporidium hominis
IQNIELLTVIYPFLTPPSYKKVLTPVEVIST

SEQ ID NO: 2209719 - protein, 25 aa, Cryptosporidium hominis
IQNKGRLRNIFKRKKLTASEKLERL

SEQ ID NO: 2209720 - protein, 20 aa, Cryptosporidium hominis
IQVPPMPFCQEPAIYHEGHC

SEQ ID NO: 2209721 - protein, 17 aa, Cryptosporidium hominis
IRAWFPNPESKGRKDLR

SEQ ID NO: 2209722 - protein, 30 aa, Cryptosporidium hominis
IRHRNEGALIILFLLSPIYRVINDENFDGD

SEQ ID NO: 2209723 - protein, 17 aa, Cryptosporidium hominis
IRKGTVSPPPPPPLPLS

SEQ ID NO: 2209724 - protein, 25 aa, Cryptosporidium hominis
IRKLTLLHSRGDLPSLSLWAKKMKD

SEQ ID NO: 2209725 - protein, 19 aa, Cryptosporidium hominis
IRLFGVFHDSFRNLLKKLE

SEQ ID NO: 2209726 - protein, 17 aa, Cryptosporidium hominis
IRLVFELSQLPYIGHAF

SEQ ID NO: 2209727 - protein, 17 aa, Cryptosporidium hominis
IRMLNFSYRTGLRVGNV

SEQ ID NO: 2209728 - protein, 25 aa, Cryptosporidium hominis
IRNTLVLFIIFFIHNINCKAQEKPE

SEQ ID NO: 2209729 - protein, 17 aa, Cryptosporidium hominis
IRTFPPELVCPPGYTME

SEQ ID NO: 2209730 - protein, 23 aa, Cryptosporidium hominis
ISCLILVALLQYATSDQKVEQKD

SEQ ID NO: 2209731 - protein, 17 aa, Cryptosporidium hominis
ISDVYKTAFYPPPLEFL

SEQ ID NO: 2209732 - protein, 35 aa, Cryptosporidium hominis
ISETRTIALLKPFVPLFPSYTLIGLFGDSIEFKNP

SEQ ID NO: 2209733 - protein, 24 aa, Cryptosporidium hominis
ISKPTPLYKAVRAKALELWEKIDS

SEQ ID NO: 2209734 - protein, 25 aa, Cryptosporidium hominis
ISPKLLCPKGYDLVDGSCFFSHIIP

SEQ ID NO: 2209735 - protein, 19 aa, Cryptosporidium hominis
ISPLFPERTMIDGSLNDAP

SEQ ID NO: 2209736 - protein, 27 aa, Cryptosporidium hominis
ISSSKSKLLRRILGMKLKRVNNKISKI

SEQ ID NO: 2209737 - protein, 38 aa, Cryptosporidium hominis
ISSTLDSVPLIKLPNFNLPIFGIPPTPPQVLKTTSTTT

SEQ ID NO: 2209738 - protein, 17 aa, Cryptosporidium hominis
ITKPFLSLAYIFSREMI

SEQ ID NO: 2209739 - protein, 26 aa, Cryptosporidium hominis
ITLIIYLVILDYCICAEFVESLESII

SEQ ID NO: 2209740 - protein, 18 aa, Cryptosporidium hominis
ITSRLWIKYSNEPDILRK

SEQ ID NO: 2209741 - protein, 27 aa, Cryptosporidium hominis
IVEKPFERYFNAWRRSFGYNGFIVYPR

SEQ ID NO: 2209742 - protein, 24 aa, Cryptosporidium hominis
IVGQFEYNLLNPIFNYIPRTGQIY

SEQ ID NO: 2209743 - protein, 26 aa, Cryptosporidium hominis
IVINNMTIFGIMKYNLLNNGNCSAKD

SEQ ID NO: 2209744 - protein, 23 aa, Cryptosporidium hominis
IVINTFTIFLYKTLKNLGRTSLK

SEQ ID NO: 2209745 - protein, 19 aa, Cryptosporidium hominis
IVKLDELVLLINFDQMLLN

SEQ ID NO: 2209746 - protein, 19 aa, Cryptosporidium hominis
IVKYILPYSSYDEYLDENE

SEQ ID NO: 2209747 - protein, 19 aa, Cryptosporidium hominis
IVLLYTNTNYIINNRISTQ

SEQ ID NO: 2209748 - protein, 35 aa, Cryptosporidium hominis
IVMEKPHPRYGKYSNKYLYGIREIELMTNNLRSVV

SEQ ID NO: 2209749 - protein, 29 aa, Cryptosporidium hominis
IVQFRNYCFAFVWTLWKSGNEPDLRISGK

SEQ ID NO: 2209750 - protein, 18 aa, Cryptosporidium hominis
IVSILIPDIQSHLGKMCP

SEQ ID NO: 2209751 - protein, 20 aa, Cryptosporidium hominis
IWSREFCEIVQGFKIDEISC

SEQ ID NO: 2209752 - protein, 19 aa, Cryptosporidium hominis
IYDKIQIRHRNEGALIILF

SEQ ID NO: 2209753 - protein, 19 aa, Cryptosporidium hominis
IYGIDRMLFCSPSVGYYLE

SEQ ID NO: 2209754 - protein, 18 aa, Cryptosporidium hominis
IYHAFKNKSTQRLLIQAI

SEQ ID NO: 2209755 - protein, 24 aa, Cryptosporidium hominis
IYIEKLNKLIKPSSSRRLVIVELI

SEQ ID NO: 2209756 - protein, 27 aa, Cryptosporidium hominis
IYKSCWFKCTKVWEYPLCGSDGITYSS

SEQ ID NO: 2209757 - protein, 43 aa, Cryptosporidium hominis
IYNELQLYNNLLLSILLKLSFYIQYIVYFPNTGKLFGGNEDYS

SEQ ID NO: 2209758 - protein, 27 aa, Cryptosporidium hominis
IYPERNFLPIRIALASLAYYAISTHQS

SEQ ID NO: 2209759 - protein, 20 aa, Cryptosporidium hominis
IYPPLTSELLPFQYSMAFNP

SEQ ID NO: 2209760 - protein, 21 aa, Cryptosporidium hominis
IYSPAILMKSGIGPTEVLRKH

SEQ ID NO: 2209761 - protein, 22 aa, Cryptosporidium hominis
KAIFVFNRLVRIFEMCFQVIFF

SEQ ID NO: 2209762 - protein, 20 aa, Cryptosporidium hominis
KAIYNQMHIDLLLGRQQRVS

SEQ ID NO: 2209763 - protein, 21 aa, Cryptosporidium hominis
KAKKIKTINFGLDLTENPNSV

SEQ ID NO: 2209764 - protein, 30 aa, Cryptosporidium hominis
KAKNDIGVLPDVLYLLGSLAIIPNIKSEIG

SEQ ID NO: 2209765 - protein, 17 aa, Cryptosporidium hominis
KALNLIPNKFRIVNIWN

SEQ ID NO: 2209766 - protein, 29 aa, Cryptosporidium hominis
KAQTITLFFFLIAFISLNEFFSEASSTQQ

SEQ ID NO: 2209767 - protein, 42 aa, Cryptosporidium hominis
KASSLRYIEGYINNWVKILKMLEKRLEVLLKRFVALGCENPE

SEQ ID NO: 2209768 - protein, 31 aa, Cryptosporidium hominis
KATLSPPLRYTIFIALLKLVSELTFERSKRN

SEQ ID NO: 2209769 - protein, 21 aa, Cryptosporidium hominis
KATYELFYFNNTQSYKYENNT

SEQ ID NO: 2209770 - protein, 21 aa, Cryptosporidium hominis
KAWYVFLKASTPSNSGCLIPC

SEQ ID NO: 2209771 - protein, 17 aa, Cryptosporidium hominis
KAYSKRTRPILTSPRGS

SEQ ID NO: 2209772 - protein, 18 aa, Cryptosporidium hominis
KDDKWIQSFYKNYTNMAN

SEQ ID NO: 2209773 - protein, 26 aa, Cryptosporidium hominis
KDIDLKIIFMQYIKSTLRCIQLYESK

SEQ ID NO: 2209774 - protein, 17 aa, Cryptosporidium hominis
KDILRYPEVVSTPGERL

SEQ ID NO: 2209775 - protein, 19 aa, Cryptosporidium hominis
KDRELLTKVILDLRDSKDL

SEQ ID NO: 2209776 - protein, 25 aa, Cryptosporidium hominis
KDSGPFETLPLGPFDRVRGPDCVTP

SEQ ID NO: 2209777 - protein, 36 aa, Cryptosporidium hominis
KEITRSCYRLIRYFQKSGVPFIFRAASKIQGSKNYN

SEQ ID NO: 2209778 - protein, 25 aa, Cryptosporidium hominis
KELSVKKIIFLLRSQEIQDAITDAY

SEQ ID NO: 2209779 - protein, 25 aa, Cryptosporidium hominis
KELTKDLHIMIFVHGLQGSAFDMRN

SEQ ID NO: 2209780 - protein, 25 aa, Cryptosporidium hominis
KENAEWQMLKLIQYFFEDQSQNSIA

SEQ ID NO: 2209781 - protein, 18 aa, Cryptosporidium hominis
KENSWFVKFYAPWCGHCK

SEQ ID NO: 2209782 - protein, 24 aa, Cryptosporidium hominis
KEPNNIWPRLLKDQKLKIPNMHVW

SEQ ID NO: 2209783 - protein, 20 aa, Cryptosporidium hominis
KETHTCKNGYFSFDFNPPCS

SEQ ID NO: 2209784 - protein, 30 aa, Cryptosporidium hominis
KETVLLRNFCYLGFLELWSSFRTAPTILVI

SEQ ID NO: 2209785 - protein, 17 aa, Cryptosporidium hominis
KEWVILKYKQIHDFLMA

SEQ ID NO: 2209786 - protein, 23 aa, Cryptosporidium hominis
KFDLATILFSVVAYGECIKRLNG

SEQ ID NO: 2209787 - protein, 21 aa, Cryptosporidium hominis
KFESSSYFMSLLVPGTHAFAK

SEQ ID NO: 2209788 - protein, 19 aa, Cryptosporidium hominis
KFEVEIAKILYWRIKTDTE

SEQ ID NO: 2209789 - protein, 21 aa, Cryptosporidium hominis
KFGIKNLFRKNAARAKLGYYR

SEQ ID NO: 2209790 - protein, 24 aa, Cryptosporidium hominis
KFILFLTILELFIDVILAEEKNEP

SEQ ID NO: 2209791 - protein, 30 aa, Cryptosporidium hominis
KFLVGQIVQHLWWNYYGVVVGWDWELNAPK

SEQ ID NO: 2209792 - protein, 20 aa, Cryptosporidium hominis
KFNDFCLVGIILFNTKSYSR

SEQ ID NO: 2209793 - protein, 19 aa, Cryptosporidium hominis
KFNPPQGSFNYLLPTNTPG

SEQ ID NO: 2209794 - protein, 29 aa, Cryptosporidium hominis
KFPFGSIKPLWYRQIPYTMAKFYFFERIN

SEQ ID NO: 2209795 - protein, 17 aa, Cryptosporidium hominis
KFSEDFSDELPHETYDR

SEQ ID NO: 2209796 - protein, 18 aa, Cryptosporidium hominis
KFSKLYSFNPLKIKKYSQ

SEQ ID NO: 2209797 - protein, 17 aa, Cryptosporidium hominis
KGAFFFSQLDSSSTLCK

SEQ ID NO: 2209798 - protein, 21 aa, Cryptosporidium hominis
KGEFSFIINSLKWNGSNRINQ

SEQ ID NO: 2209799 - protein, 19 aa, Cryptosporidium hominis
KGELFYLYTGRGPSSESLH

SEQ ID NO: 2209800 - protein, 28 aa, Cryptosporidium hominis
KGFYDPITRQYPWSSIPWHKVDHAMVIT

SEQ ID NO: 2209801 - protein, 18 aa, Cryptosporidium hominis
KGMGFFNKFIIMNNPKRT

SEQ ID NO: 2209802 - protein, 19 aa, Cryptosporidium hominis
KGNFVPWRFVESCTNILRT

SEQ ID NO: 2209803 - protein, 22 aa, Cryptosporidium hominis
KHIPAYIMYSPALVTLDFLESN

SEQ ID NO: 2209804 - protein, 22 aa, Cryptosporidium hominis
KHYLLGLWSHMVIPLLYQGDRA

SEQ ID NO: 2209805 - protein, 20 aa, Cryptosporidium hominis
KHYRYARGVLGKRPIRYKKA

SEQ ID NO: 2209806 - protein, 19 aa, Cryptosporidium hominis
KIDPRLVNHKKLFKILNFH

SEQ ID NO: 2209807 - protein, 23 aa, Cryptosporidium hominis
KIECKFIKNLIFILIIFSEKNYS

SEQ ID NO: 2209808 - protein, 21 aa, Cryptosporidium hominis
KIINEKIVISRLPISISKGFI

SEQ ID NO: 2209809 - protein, 19 aa, Cryptosporidium hominis
KIKENSFFQVFKILSKEAA

SEQ ID NO: 2209810 - protein, 24 aa, Cryptosporidium hominis
KIKGIFKIVIVENPDVLLHLREHL

SEQ ID NO: 2209811 - protein, 19 aa, Cryptosporidium hominis
KILGLLEWNKDILSVFIEA

SEQ ID NO: 2209812 - protein, 22 aa, Cryptosporidium hominis
KINGIIFIEESGPFELEPLGPF

SEQ ID NO: 2209813 - protein, 33 aa, Cryptosporidium hominis
KINVSSMYRLLPPGPIKYLFHFKQSKTAAIEAV

SEQ ID NO: 2209814 - protein, 18 aa, Cryptosporidium hominis
KIPPIPKSDSKNLPKPSK

SEQ ID NO: 2209815 - protein, 33 aa, Cryptosporidium hominis
KIRRLKCLQFILLLLSFVSFKIFMFGMANANID

SEQ ID NO: 2209816 - protein, 19 aa, Cryptosporidium hominis
KITAIIFTKDSGPFETLPL

SEQ ID NO: 2209817 - protein, 21 aa, Cryptosporidium hominis
KITHYLIFLSSQIYCSLNTYN

SEQ ID NO: 2209818 - protein, 26 aa, Cryptosporidium hominis
KITKFIYSMLFSQFKYYMKMCLISFP

SEQ ID NO: 2209819 - protein, 19 aa, Cryptosporidium hominis
KIVKFFFERRLKNYQEQCR

SEQ ID NO: 2209820 - protein, 20 aa, Cryptosporidium hominis
KKDYLEFIDALTFDQFYKYW

SEQ ID NO: 2209821 - protein, 25 aa, Cryptosporidium hominis
KKEELLIVRIQLVEKIAVSRQLFVG

SEQ ID NO: 2209822 - protein, 29 aa, Cryptosporidium hominis
KKGNISNLIFPFLKIYKKSFLNIVNINDL

SEQ ID NO: 2209823 - protein, 37 aa, Cryptosporidium hominis
KKIKFPDKLFYVIRYFNFIMILTEYLIRQGLKDIDAF

SEQ ID NO: 2209824 - protein, 20 aa, Cryptosporidium hominis
KKIPNLIHALFNSELRKQRK

SEQ ID NO: 2209825 - protein, 25 aa, Cryptosporidium hominis
KKKEYPLFNSLIFTKKMAVKISTQY

SEQ ID NO: 2209826 - protein, 34 aa, Cryptosporidium hominis
KKNKKFKIKNVFGPNIFKLFKKKEQKPARKIIIS

SEQ ID NO: 2209827 - protein, 20 aa, Cryptosporidium hominis
KKPHYLLLVHQKETLFNNSS

SEQ ID NO: 2209828 - protein, 21 aa, Cryptosporidium hominis
KKQLSFKCINKLRTLLDYTNK

SEQ ID NO: 2209829 - protein, 24 aa, Cryptosporidium hominis
KKTTDGLEICRLKRISNLDNASIS

SEQ ID NO: 2209830 - protein, 17 aa, Cryptosporidium hominis
KKVMFGFTQNEWNRILV

SEQ ID NO: 2209831 - protein, 31 aa, Cryptosporidium hominis
KKWVKSLKEYRLPIGYIPIARRYQRLKESAV

SEQ ID NO: 2209832 - protein, 17 aa, Cryptosporidium hominis
KLDKLRCPANCPDYGIV

SEQ ID NO: 2209833 - protein, 17 aa, Cryptosporidium hominis
KLEKLFPININLLSPDK

SEQ ID NO: 2209834 - protein, 19 aa, Cryptosporidium hominis
KLKIWVRGNNNRIPLPIMV

SEQ ID NO: 2209835 - protein, 32 aa, Cryptosporidium hominis
KLLKMDGLLCLLFVIFIFAQYLNFASCFLDEQ

SEQ ID NO: 2209836 - protein, 22 aa, Cryptosporidium hominis
KLLSYVILTKYFIIADIFNLEI

SEQ ID NO: 2209837 - protein, 25 aa, Cryptosporidium hominis
KLNLGLITFYGFPKSKDSSKDINLA

SEQ ID NO: 2209838 - protein, 18 aa, Cryptosporidium hominis
KLRERGRFAFVEDACLGL

SEQ ID NO: 2209839 - protein, 21 aa, Cryptosporidium hominis
KLSILRLLMTDGNAYQSDLSD

SEQ ID NO: 2209840 - protein, 32 aa, Cryptosporidium hominis
KLSTQYKYAYLDRLPILLPNKSSSEFNIGFLM

SEQ ID NO: 2209841 - protein, 20 aa, Cryptosporidium hominis
KLVTLPFINSPIESISHSEK

SEQ ID NO: 2209842 - protein, 19 aa, Cryptosporidium hominis
KLVWEDYFELLYEKILDPN

SEQ ID NO: 2209843 - protein, 34 aa, Cryptosporidium hominis
KLYAKILCNQLLPEIFVYTFHNVFELLISKREQK

SEQ ID NO: 2209844 - protein, 23 aa, Cryptosporidium hominis
KLYFETNLLRQFGEWQHYYVEAK

SEQ ID NO: 2209845 - protein, 17 aa, Cryptosporidium hominis
KLYSFNPLKIKKYSQED

SEQ ID NO: 2209846 - protein, 19 aa, Cryptosporidium hominis
KMIDAICPDGFLPNGDDCI

SEQ ID NO: 2209847 - protein, 24 aa, Cryptosporidium hominis
KMLTDFIPIEILNWRARRPLFNET

SEQ ID NO: 2209848 - protein, 33 aa, Cryptosporidium hominis
KNDCVKWYQDYLLQCPPFLDLKDEIFAYRTDLI

SEQ ID NO: 2209849 - protein, 29 aa, Cryptosporidium hominis
KNDEPSLWKSLPLILPKLPSYPEQIREYI

SEQ ID NO: 2209850 - protein, 20 aa, Cryptosporidium hominis
KNDWLVILVTPFCQPCIDTE

SEQ ID NO: 2209851 - protein, 22 aa, Cryptosporidium hominis
KNFLIIRAMILSMTYLVNKFIP

SEQ ID NO: 2209852 - protein, 25 aa, Cryptosporidium hominis
KNIVFLYIILEIVRLAYCSIQQNPD

SEQ ID NO: 2209853 - protein, 27 aa, Cryptosporidium hominis
KNKNNDIYFIIKLLKYVYIKEKNIQKK

SEQ ID NO: 2209854 - protein, 21 aa, Cryptosporidium hominis
KNLESILNLPLRVTLQELDIE

SEQ ID NO: 2209855 - protein, 20 aa, Cryptosporidium hominis
KNLISLPYVVKGMDLSFSGI

SEQ ID NO: 2209856 - protein, 23 aa, Cryptosporidium hominis
KPARKIIISRPIMRTLTEETDDE

SEQ ID NO: 2209857 - protein, 17 aa, Cryptosporidium hominis
KPFLSLAYIFSREMIKD

SEQ ID NO: 2209858 - protein, 20 aa, Cryptosporidium hominis
KPKKHSFFHIHYYDITNTAK

SEQ ID NO: 2209859 - protein, 21 aa, Cryptosporidium hominis
KPQARSQPNAFRRGMMASMSQ

SEQ ID NO: 2209860 - protein, 17 aa, Cryptosporidium hominis
KQCSPNWIRKRDLKDKN

SEQ ID NO: 2209861 - protein, 18 aa, Cryptosporidium hominis
KQIINWDGPVKFTPTQKR

SEQ ID NO: 2209862 - protein, 24 aa, Cryptosporidium hominis
KQKRRKLLRRFKNLDLENKKHGLK

SEQ ID NO: 2209863 - protein, 25 aa, Cryptosporidium hominis
KQLESRYLKLLSEVSRIGPQLMRVD

SEQ ID NO: 2209864 - protein, 21 aa, Cryptosporidium hominis
KQLLSILKKLLHKFNKEYKNS

SEQ ID NO: 2209865 - protein, 23 aa, Cryptosporidium hominis
KQTDLIKLSILGKSLQLSNSNSD

SEQ ID NO: 2209866 - protein, 24 aa, Cryptosporidium hominis
KRDKIGLMLFSYNPRSMELENVWV

SEQ ID NO: 2209867 - protein, 24 aa, Cryptosporidium hominis
KRGRFSKFKSAISRPFRAHKLKKA

SEQ ID NO: 2209868 - protein, 35 aa, Cryptosporidium hominis
KRILHLKMKLSFSVVLTLLIYTIGKPHGCEAGLLD

SEQ ID NO: 2209869 - protein, 21 aa, Cryptosporidium hominis
KRINGRWTGWIPVSESRVPPQ

SEQ ID NO: 2209870 - protein, 22 aa, Cryptosporidium hominis
KRKCDLLPRIISISLSCRRIKK

SEQ ID NO: 2209871 - protein, 18 aa, Cryptosporidium hominis
KRKEIDYGALFNCKYKYP

SEQ ID NO: 2209872 - protein, 26 aa, Cryptosporidium hominis
KRNHVYWVPIIYPSNVYKVSLEGLSI

SEQ ID NO: 2209873 - protein, 24 aa, Cryptosporidium hominis
KRNQAILFKIIQKNQGFSTYRIFN

SEQ ID NO: 2209874 - protein, 46 aa, Cryptosporidium hominis
KRPKIRLGLLEDINDLLILEAGFRRFVRLFRSINISTLLVPNNSTH

SEQ ID NO: 2209875 - protein, 26 aa, Cryptosporidium hominis
KRVDDQFIVIVKKLKQKSNEVPTDTK

SEQ ID NO: 2209876 - protein, 23 aa, Cryptosporidium hominis
KRVYGVLPVNPFAGNIFTPSLSE

SEQ ID NO: 2209877 - protein, 24 aa, Cryptosporidium hominis
KSAILRGYFLFQNYFECKDLTETQ

SEQ ID NO: 2209878 - protein, 26 aa, Cryptosporidium hominis
KSEFEDKIRWFGLSKYSSQKLDSFTK

SEQ ID NO: 2209879 - protein, 24 aa, Cryptosporidium hominis
KSKEHVIVTFFAPWCGHCTALEPE

SEQ ID NO: 2209880 - protein, 20 aa, Cryptosporidium hominis
KSKKIFIPGFKKKKIVEKKQ

SEQ ID NO: 2209881 - protein, 17 aa, Cryptosporidium hominis
KSLKKLPKIYSGKNEKL

SEQ ID NO: 2209882 - protein, 21 aa, Cryptosporidium hominis
KSNIWLVYRYEGVSLGNLLFD

SEQ ID NO: 2209883 - protein, 29 aa, Cryptosporidium hominis
KSPTYKEKLLSFFSGNGGGMFGFGKSSTT

SEQ ID NO: 2209884 - protein, 21 aa, Cryptosporidium hominis
KSRDEFTWRASQDLYKLEWKI

SEQ ID NO: 2209885 - protein, 23 aa, Cryptosporidium hominis
KSREWIMIVNFYRPGCGPCKQLV

SEQ ID NO: 2209886 - protein, 19 aa, Cryptosporidium hominis
KSRPNILQPYMLISNPKLS

SEQ ID NO: 2209887 - protein, 32 aa, Cryptosporidium hominis
KTFLKKLFTKISSFPKVWPLHLRSEELPFIKD

SEQ ID NO: 2209888 - protein, 19 aa, Cryptosporidium hominis
KTIIILQKLITVFNKVDGV

SEQ ID NO: 2209889 - protein, 27 aa, Cryptosporidium hominis
KTLENLYRQLFILNQDIKRLVGYQHKM

SEQ ID NO: 2209890 - protein, 24 aa, Cryptosporidium hominis
KTMFLWNETIFFENLSINELYSPS

SEQ ID NO: 2209891 - protein, 22 aa, Cryptosporidium hominis
KTQWDFILSAIKSCLNIKCKNL

SEQ ID NO: 2209892 - protein, 30 aa, Cryptosporidium hominis
KVAPYLQYSIINYPLQLFANIYSPVWGCYQ

SEQ ID NO: 2209893 - protein, 17 aa, Cryptosporidium hominis
KVKSGGHQMWISSKSRN

SEQ ID NO: 2209894 - protein, 21 aa, Cryptosporidium hominis
KVRAMIELAMYLAPEECPARK

SEQ ID NO: 2209895 - protein, 21 aa, Cryptosporidium hominis
KVSELLIEVPFFKSKLFSQNM

SEQ ID NO: 2209896 - protein, 18 aa, Cryptosporidium hominis
KVSGIFRYTDNDNYYQVI

SEQ ID NO: 2209897 - protein, 26 aa, Cryptosporidium hominis
KYKPLSHIFFSFLLNFSFEKRSEVVL

SEQ ID NO: 2209898 - protein, 22 aa, Cryptosporidium hominis
LACSGIHMHLFEIKPKGVSFTK

SEQ ID NO: 2209899 - protein, 21 aa, Cryptosporidium hominis
LAITEGFIFSPKSLNLIECTN

SEQ ID NO: 2209900 - protein, 19 aa, Cryptosporidium hominis
LALLAILVGVCANNYVSPR

SEQ ID NO: 2209901 - protein, 21 aa, Cryptosporidium hominis
LAPVQIVCFPTTKIKSIIASI

SEQ ID NO: 2209902 - protein, 17 aa, Cryptosporidium hominis
LATALLQQIHLLPTYMF

SEQ ID NO: 2209903 - protein, 17 aa, Cryptosporidium hominis
LAVGPIYDAVHEMTKIL

SEQ ID NO: 2209904 - protein, 25 aa, Cryptosporidium hominis
LCKDPEIMKLWYSGPLISTDTSLSL

SEQ ID NO: 2209905 - protein, 19 aa, Cryptosporidium hominis
LCLFIASYSALCKFSKKGI

SEQ ID NO: 2209906 - protein, 28 aa, Cryptosporidium hominis
LCLSRLTYNLYRLAVFCQTALKSLIRAI

SEQ ID NO: 2209907 - protein, 23 aa, Cryptosporidium hominis
LCVGIINPKIPPPGELPIRSGNG

SEQ ID NO: 2209908 - protein, 29 aa, Cryptosporidium hominis
LDLKDEIFAYRTDLIPPPAAGRGPVLPYM

SEQ ID NO: 2209909 - protein, 17 aa, Cryptosporidium hominis
LDLVPGIVNDDFRNALE

SEQ ID NO: 2209910 - protein, 22 aa, Cryptosporidium hominis
LEILFGETSVFFQNLVIVCGRS

SEQ ID NO: 2209911 - protein, 26 aa, Cryptosporidium hominis
LEKQGIPCIIYKLISLDFEYSGQDEM

SEQ ID NO: 2209912 - protein, 37 aa, Cryptosporidium hominis
LELFNQTLLYYRVNQTYFLMILSLEKLILSSHEVLLE

SEQ ID NO: 2209913 - protein, 24 aa, Cryptosporidium hominis
LELSKLIWGIIKSPSFKKIKFSKD

SEQ ID NO: 2209914 - protein, 23 aa, Cryptosporidium hominis
LELYIILILTEKGEVLSWGCNDD

SEQ ID NO: 2209915 - protein, 32 aa, Cryptosporidium hominis
LEPKKFPGLATLLSELLFYDWKRPDVGRETPY

SEQ ID NO: 2209916 - protein, 17 aa, Cryptosporidium hominis
LEPTLEFSLYNSGIFKG

SEQ ID NO: 2209917 - protein, 25 aa, Cryptosporidium hominis
LEQQISPLFQFRAKLYFEGNTWKVD

SEQ ID NO: 2209918 - protein, 22 aa, Cryptosporidium hominis
LFAFLKAIYATDHRGFLTISSP

SEQ ID NO: 2209919 - protein, 17 aa, Cryptosporidium hominis
LFANIYSPVWGCYQFMD

SEQ ID NO: 2209920 - protein, 17 aa, Cryptosporidium hominis
LFATHFLTKTGFRNSES

SEQ ID NO: 2209921 - protein, 25 aa, Cryptosporidium hominis
LFCLLILCFNSVLIFCNSSLESIPR

SEQ ID NO: 2209922 - protein, 17 aa, Cryptosporidium hominis
LFELVDFCPIAEALLHE

SEQ ID NO: 2209923 - protein, 21 aa, Cryptosporidium hominis
LFFFAIYIMIGISNASDVTSS

SEQ ID NO: 2209924 - protein, 18 aa, Cryptosporidium hominis
LFFFELQNAWSSLNSSLN

SEQ ID NO: 2209925 - protein, 20 aa, Cryptosporidium hominis
LFFFLEFSLIITNSSTYIPN

SEQ ID NO: 2209926 - protein, 24 aa, Cryptosporidium hominis
LFFSFLILLCEYSFSLGNIQNKFE

SEQ ID NO: 2209927 - protein, 17 aa, Cryptosporidium hominis
LFGFIPNCKKNDISIGI

SEQ ID NO: 2209928 - protein, 20 aa, Cryptosporidium hominis
LFKILNFHVDKVIFSSLDKD

SEQ ID NO: 2209929 - protein, 17 aa, Cryptosporidium hominis
LFKLFPPTDSNSETVPL

SEQ ID NO: 2209930 - protein, 19 aa, Cryptosporidium hominis
LFLALALLRNAAGDEFSDY

SEQ ID NO: 2209931 - protein, 18 aa, Cryptosporidium hominis
LFLFCSIVLGSDLNETFQ

SEQ ID NO: 2209932 - protein, 20 aa, Cryptosporidium hominis
LFLFKLFDGTFGKSYYDILG

SEQ ID NO: 2209933 - protein, 21 aa, Cryptosporidium hominis
LFLIFMKKAKIVMADLTFMYD

SEQ ID NO: 2209934 - protein, 26 aa, Cryptosporidium hominis
LFLLSLWLFLYDLHNFQDSSCLRISI

SEQ ID NO: 2209935 - protein, 19 aa, Cryptosporidium hominis
LFLSFFSTISLCSRLEWTG

SEQ ID NO: 2209936 - protein, 18 aa, Cryptosporidium hominis
LFLSIKTNLIHFCLAGNF

SEQ ID NO: 2209937 - protein, 18 aa, Cryptosporidium hominis
LFLSLLALAFGNGENSIS

SEQ ID NO: 2209938 - protein, 24 aa, Cryptosporidium hominis
LFRRVSRCCILIQDFVDIALMIIS

SEQ ID NO: 2209939 - protein, 24 aa, Cryptosporidium hominis
LFSNIIILCLYLGILKCVNSHISN

SEQ ID NO: 2209940 - protein, 23 aa, Cryptosporidium hominis
LGAYPSFHIFGATPGLQLTSPSP

SEQ ID NO: 2209941 - protein, 27 aa, Cryptosporidium hominis
LGDGSKFFPFFISKYIRSLQKSNYFGE

SEQ ID NO: 2209942 - protein, 23 aa, Cryptosporidium hominis
LGDLGLPHLFDLRFKHDVLSSYE

SEQ ID NO: 2209943 - protein, 17 aa, Cryptosporidium hominis
LGGILIQERIMGPSLRD

SEQ ID NO: 2209944 - protein, 21 aa, Cryptosporidium hominis
LGILAIFIKLAITYANQHANE

SEQ ID NO: 2209945 - protein, 18 aa, Cryptosporidium hominis
LGKLPRMSALSRSITPIN

SEQ ID NO: 2209946 - protein, 30 aa, Cryptosporidium hominis
LGLHLGDFIYPRLFPIFASDLCIARKMMKR

SEQ ID NO: 2209947 - protein, 24 aa, Cryptosporidium hominis
LGLLFGLVSVHSLSLRAGSQELAI

SEQ ID NO: 2209948 - protein, 23 aa, Cryptosporidium hominis
LGLNGLYHQWKVGPIILTKKETE

SEQ ID NO: 2209949 - protein, 20 aa, Cryptosporidium hominis
LGQIDTFYQALYDSSRDLKN

SEQ ID NO: 2209950 - protein, 25 aa, Cryptosporidium hominis
LGSYKNTFRCISKLSFDGLKLSAQC

SEQ ID NO: 2209951 - protein, 26 aa, Cryptosporidium hominis
LHALICIWLLFRIILEPVNGKNDSKF

SEQ ID NO: 2209952 - protein, 44 aa, Cryptosporidium hominis
LIEETEKFILKHDSLLLLVPKVLPMHMNYVKMPLPQIEPQPREI

SEQ ID NO: 2209953 - protein, 22 aa, Cryptosporidium hominis
LIFAALCNLLSLLPDQVFFNHL

SEQ ID NO: 2209954 - protein, 22 aa, Cryptosporidium hominis
LIFAILAGYLISLSACAEKFKY

SEQ ID NO: 2209955 - protein, 20 aa, Cryptosporidium hominis
LIFDSIELIINQIKWRFEKD

SEQ ID NO: 2209956 - protein, 17 aa, Cryptosporidium hominis
LIFLVSIFTTKICSSLT

SEQ ID NO: 2209957 - protein, 17 aa, Cryptosporidium hominis
LIGDGNVIFIFKSLQRN

SEQ ID NO: 2209958 - protein, 25 aa, Cryptosporidium hominis
LIGPNEVIIFKLKLGKIIKNENKKP

SEQ ID NO: 2209959 - protein, 21 aa, Cryptosporidium hominis
LIIEDLHRLFEMNGNSEGNLI

SEQ ID NO: 2209960 - protein, 18 aa, Cryptosporidium hominis
LIIFIEGWGGGKLVRVES

SEQ ID NO: 2209961 - protein, 18 aa, Cryptosporidium hominis
LIIYYVGGLFGESTDYSP

SEQ ID NO: 2209962 - protein, 25 aa, Cryptosporidium hominis
LIKNKKLFKFIKRKASKRASKMMYE

SEQ ID NO: 2209963 - protein, 28 aa, Cryptosporidium hominis
LILAALPYKPNYPIMIFKDGWQQPDYLI

SEQ ID NO: 2209964 - protein, 21 aa, Cryptosporidium hominis
LILFTLAIYSQYIHANEDDVT

SEQ ID NO: 2209965 - protein, 25 aa, Cryptosporidium hominis
LILVNLLTLMLLQGHFGQIGCKSSD

SEQ ID NO: 2209966 - protein, 26 aa, Cryptosporidium hominis
LISACKYELSDLLKLIKKLNLEVREL

SEQ ID NO: 2209967 - protein, 24 aa, Cryptosporidium hominis
LISCFTILILFLQFNTVYSESVEP

SEQ ID NO: 2209968 - protein, 24 aa, Cryptosporidium hominis
LISVIKRLRLIYNSYIAELESNID

SEQ ID NO: 2209969 - protein, 18 aa, Cryptosporidium hominis
LITSLFLSGVINSNLDWI

SEQ ID NO: 2209970 - protein, 20 aa, Cryptosporidium hominis
LIVPFLVLFTAVEGTPDYSG

SEQ ID NO: 2209971 - protein, 19 aa, Cryptosporidium hominis
LIVTHILCANAIHLGSPNY

SEQ ID NO: 2209972 - protein, 17 aa, Cryptosporidium hominis
LIYSIALIKQNIIDLFG

SEQ ID NO: 2209973 - protein, 35 aa, Cryptosporidium hominis
LKCVTSKFLLIFYKYILLLLRFISIFDLREVKENL

SEQ ID NO: 2209974 - protein, 25 aa, Cryptosporidium hominis
LKGKPIPYIPTLSDKDLKPLFSKSR

SEQ ID NO: 2209975 - protein, 31 aa, Cryptosporidium hominis
LKHTRYYKKPEDVKYIIGPFASLVQKRGQDP

SEQ ID NO: 2209976 - protein, 25 aa, Cryptosporidium hominis
LKKNYARWAVSFLKGWISSRNPFRY

SEQ ID NO: 2209977 - protein, 27 aa, Cryptosporidium hominis
LKNVIFLYNYLIFLFGSRFSKPEEVLI

SEQ ID NO: 2209978 - protein, 24 aa, Cryptosporidium hominis
LKPTDSPVLLRFETLKKLDKVVSN

SEQ ID NO: 2209979 - protein, 20 aa, Cryptosporidium hominis
LKQGFYSSTLRRMLFRAADV

SEQ ID NO: 2209980 - protein, 26 aa, Cryptosporidium hominis
LKRTILLVIISIILKSINTYGIETYS

SEQ ID NO: 2209981 - protein, 24 aa, Cryptosporidium hominis
LKVLPRIILGKYLVLEFKLQSPTK

SEQ ID NO: 2209982 - protein, 20 aa, Cryptosporidium hominis
LLAFLSISLIVTAKDGESNY

SEQ ID NO: 2209983 - protein, 21 aa, Cryptosporidium hominis
LLAIFYFGLSASQDLSILSDP

SEQ ID NO: 2209984 - protein, 26 aa, Cryptosporidium hominis
LLATIIFCNFALIFCRRIPCEFERNR

SEQ ID NO: 2209985 - protein, 26 aa, Cryptosporidium hominis
LLEKIKILPFWIFKVSDEFSIILIES

SEQ ID NO: 2209986 - protein, 31 aa, Cryptosporidium hominis
LLENNTISILLFKGVWYIYEGKGYYSPIRIG

SEQ ID NO: 2209987 - protein, 19 aa, Cryptosporidium hominis
LLFAIFLVINQVIDGVKSE

SEQ ID NO: 2209988 - protein, 21 aa, Cryptosporidium hominis
LLFCCIYLVAAINGTKRKRKS

SEQ ID NO: 2209989 - protein, 18 aa, Cryptosporidium hominis
LLFCVKFAREVILTTGNE

SEQ ID NO: 2209990 - protein, 21 aa, Cryptosporidium hominis
LLFIAITLLFISKVKSSRIIY

SEQ ID NO: 2209991 - protein, 19 aa, Cryptosporidium hominis
LLFMFIRNVKSFENGLLRL

SEQ ID NO: 2209992 - protein, 18 aa, Cryptosporidium hominis
LLFSFFNISKDTHTIIFT

SEQ ID NO: 2209993 - protein, 26 aa, Cryptosporidium hominis
LLGLITKIYRQMVYFDFSILLPNHTN

SEQ ID NO: 2209994 - protein, 32 aa, Cryptosporidium hominis
LLKETYSIFCQLMCLIKLLNLFNSLNNLSMAR

SEQ ID NO: 2209995 - protein, 28 aa, Cryptosporidium hominis
LLKHISVFLLLIAFFDQLVEFNDLTATF

SEQ ID NO: 2209996 - protein, 23 aa, Cryptosporidium hominis
LLLAVKFGGIYLDYVQKQYLKKH

SEQ ID NO: 2209997 - protein, 18 aa, Cryptosporidium hominis
LLLGIFLEFVDRNDAIKV

SEQ ID NO: 2209998 - protein, 23 aa, Cryptosporidium hominis
LLLIFLIQISWLKNSLVLSQLMP

SEQ ID NO: 2209999 - protein, 25 aa, Cryptosporidium hominis
LLLLFIFFSYCMCGDMISAIIESAS

SEQ ID NO: 2210000 - protein, 25 aa, Cryptosporidium hominis
LLLLFIYLILLFENVTDDFLVKKDV

SEQ ID NO: 2210001 - protein, 18 aa, Cryptosporidium hominis
LLNCPPDTVLEQTTMTCV

SEQ ID NO: 2210002 - protein, 21 aa, Cryptosporidium hominis
LLNLWFAYSFVFGNDLDSKKN

SEQ ID NO: 2210003 - protein, 17 aa, Cryptosporidium hominis
LLRIPFPSSEISGSNFI

SEQ ID NO: 2210004 - protein, 18 aa, Cryptosporidium hominis
LLRKAFYTYTSTFRYVNV

SEQ ID NO: 2210005 - protein, 24 aa, Cryptosporidium hominis
LLSNIDIWYVPFVNPDGYAAIERT

SEQ ID NO: 2210006 - protein, 19 aa, Cryptosporidium hominis
LLSPPNFGFPYNLNSKAGI

SEQ ID NO: 2210007 - protein, 20 aa, Cryptosporidium hominis
LLSVLLIKLALMNYYDISPK

SEQ ID NO: 2210008 - protein, 19 aa, Cryptosporidium hominis
LLTFFSLSELICSQINEAD

SEQ ID NO: 2210009 - protein, 22 aa, Cryptosporidium hominis
LLTQQALFYWSIEAEKFLNDYK

SEQ ID NO: 2210010 - protein, 21 aa, Cryptosporidium hominis
LLTTLVLILFLFNYEHNEQET

SEQ ID NO: 2210011 - protein, 23 aa, Cryptosporidium hominis
LLTVLFIGLFNDSVSQFTQNLKI

SEQ ID NO: 2210012 - protein, 17 aa, Cryptosporidium hominis
LLVKAGILKIRLKNLKL

SEQ ID NO: 2210013 - protein, 20 aa, Cryptosporidium hominis
LLVNTFGPSYYMGLVDAAVA

SEQ ID NO: 2210014 - protein, 18 aa, Cryptosporidium hominis
LMIGLVLPGLEQEVENFT

SEQ ID NO: 2210015 - protein, 25 aa, Cryptosporidium hominis
LMKYLNCFMITFFSINIDAINVGEN

SEQ ID NO: 2210016 - protein, 18 aa, Cryptosporidium hominis
LNDRLMIASILSAKLDFL

SEQ ID NO: 2210017 - protein, 36 aa, Cryptosporidium hominis
LNEYLISFSMLLKRRFRKFIFKKYSPSRIRSQFAKM

SEQ ID NO: 2210018 - protein, 17 aa, Cryptosporidium hominis
LNFCNSMRLRIIAGKHF

SEQ ID NO: 2210019 - protein, 29 aa, Cryptosporidium hominis
LNFGQFFNSICWRILSTYPITFKTSIGII

SEQ ID NO: 2210020 - protein, 18 aa, Cryptosporidium hominis
LNGKTCLLLTACFASTLS

SEQ ID NO: 2210021 - protein, 29 aa, Cryptosporidium hominis
LNKTTNIWVFFHLFQEADEIRFVLPDGFT

SEQ ID NO: 2210022 - protein, 35 aa, Cryptosporidium hominis
LNLCCKTLASYKWMVKNWPKKKWYMKLDDDTFVIL

SEQ ID NO: 2210023 - protein, 24 aa, Cryptosporidium hominis
LNPHRTPFYDYYLSSVGQSYDKKD

SEQ ID NO: 2210024 - protein, 25 aa, Cryptosporidium hominis
LNSAEVLIYLAEKWRYQPTYISEPL

SEQ ID NO: 2210025 - protein, 32 aa, Cryptosporidium hominis
LNSKYINGVPIYRPYAPFRYFAAETFNEMRNN

SEQ ID NO: 2210026 - protein, 18 aa, Cryptosporidium hominis
LNTVLLVEPEMLPTVAVA

SEQ ID NO: 2210027 - protein, 27 aa, Cryptosporidium hominis
LNYEAKILASILFYYSNLLNIPITTED

SEQ ID NO: 2210028 - protein, 20 aa, Cryptosporidium hominis
LPEWRSWWEKEGDSKKILKQ

SEQ ID NO: 2210029 - protein, 33 aa, Cryptosporidium hominis
LPKDRNLSFYFSFYLDNWSLVKLKAIGRNKNSI

SEQ ID NO: 2210030 - protein, 17 aa, Cryptosporidium hominis
LPTILTSLYTRLVHGCD

SEQ ID NO: 2210031 - protein, 25 aa, Cryptosporidium hominis
LQDNRYLFLQYLIKKSLNFEQKCQL

SEQ ID NO: 2210032 - protein, 23 aa, Cryptosporidium hominis
LQDTSLVKFLPPKVPKDFVCNEE

SEQ ID NO: 2210033 - protein, 36 aa, Cryptosporidium hominis
LQESLINYGGIFLKSTYLSSIQILMESAKNLTKKIK

SEQ ID NO: 2210034 - protein, 19 aa, Cryptosporidium hominis
LQHKILPRRNWGEGIATLN

SEQ ID NO: 2210035 - protein, 23 aa, Cryptosporidium hominis
LQILFGWFSFSNGFASVTVSTTL

SEQ ID NO: 2210036 - protein, 19 aa, Cryptosporidium hominis
LQSGFYRLRSRLYFLNDGV

SEQ ID NO: 2210037 - protein, 27 aa, Cryptosporidium hominis
LQSGQFYPFKILPGPYKPFNTNLLDPQ

SEQ ID NO: 2210038 - protein, 24 aa, Cryptosporidium hominis
LQYLLGIILLIGIVHALIFDQAKV

SEQ ID NO: 2210039 - protein, 20 aa, Cryptosporidium hominis
LRGSLDCFLNFYTSFSQPFS

SEQ ID NO: 2210040 - protein, 23 aa, Cryptosporidium hominis
LRIRRHLYQVWSGGWLRKQTSPN

SEQ ID NO: 2210041 - protein, 17 aa, Cryptosporidium hominis
LRKGLVPYLELVKAVRS

SEQ ID NO: 2210042 - protein, 17 aa, Cryptosporidium hominis
LRKLQFLEMFSRGGLES

SEQ ID NO: 2210043 - protein, 18 aa, Cryptosporidium hominis
LRLMFRQKVIINGNVRLA

SEQ ID NO: 2210044 - protein, 19 aa, Cryptosporidium hominis
LRNQELFYEGYMDSKNDGN

SEQ ID NO: 2210045 - protein, 18 aa, Cryptosporidium hominis
LRRKSFATYLSPHSSYYY

SEQ ID NO: 2210046 - protein, 32 aa, Cryptosporidium hominis
LRSESNRLVFAYQLIDGSLVPSSALALNSKSF

SEQ ID NO: 2210047 - protein, 25 aa, Cryptosporidium hominis
LSAPSPISYFFVLSSLIQYVSYTHK

SEQ ID NO: 2210048 - protein, 27 aa, Cryptosporidium hominis
LSEESAINLLLRLVLKGCPNILDDVLT

SEQ ID NO: 2210049 - protein, 26 aa, Cryptosporidium hominis
LSFGKFRNIDLLQSGFYRLRSRLYFL

SEQ ID NO: 2210050 - protein, 23 aa, Cryptosporidium hominis
LSHKYHNIFFAHALTNNTEVLNF

SEQ ID NO: 2210051 - protein, 17 aa, Cryptosporidium hominis
LSICYLMLKVALTTFVF

SEQ ID NO: 2210052 - protein, 21 aa, Cryptosporidium hominis
LSILVIYLNLTASYCRRNRKT

SEQ ID NO: 2210053 - protein, 20 aa, Cryptosporidium hominis
LSIVSLKYGLNKLQSIGMDK

SEQ ID NO: 2210054 - protein, 19 aa, Cryptosporidium hominis
LSKFALDLVPGIVNDDFRN

SEQ ID NO: 2210055 - protein, 19 aa, Cryptosporidium hominis
LSLGNFYPSFMSETGGLDP

SEQ ID NO: 2210056 - protein, 26 aa, Cryptosporidium hominis
LSLIFFLNWFLIIKRIEGIDLNDDKE

SEQ ID NO: 2210057 - protein, 21 aa, Cryptosporidium hominis
LSLILVLCFLGPTYQASGETR

SEQ ID NO: 2210058 - protein, 23 aa, Cryptosporidium hominis
LSLKSMLLSNFQKVSLKPSKLVQ

SEQ ID NO: 2210059 - protein, 17 aa, Cryptosporidium hominis
LSMDVFAIARFYMAVDT

SEQ ID NO: 2210060 - protein, 20 aa, Cryptosporidium hominis
LSMVLLVHLNGVKSQIYGSA

SEQ ID NO: 2210061 - protein, 24 aa, Cryptosporidium hominis
LSPHSSYYYPRTSSYLYTLYGKHP

SEQ ID NO: 2210062 - protein, 37 aa, Cryptosporidium hominis
LSQSLPCFKFTRREFLPLFSVFFQKKAIRNLEYYNLN

SEQ ID NO: 2210063 - protein, 40 aa, Cryptosporidium hominis
LSSAIPPPPSFSPPPPPIPPPPPPIPSPPSPIPSSPSPIP

SEQ ID NO: 2210064 - protein, 27 aa, Cryptosporidium hominis
LSSFLLWLVSTSFLINLARSSLIGIDI

SEQ ID NO: 2210065 - protein, 23 aa, Cryptosporidium hominis
LSVKWFENYPKFVKVLRKVDSRI

SEQ ID NO: 2210066 - protein, 18 aa, Cryptosporidium hominis
LSWVCPTDYPGFRGGKND

SEQ ID NO: 2210067 - protein, 17 aa, Cryptosporidium hominis
LSYTPRFPNLKPTRVCF

SEQ ID NO: 2210068 - protein, 24 aa, Cryptosporidium hominis
LTEAVSFFIYLNSFKFIQNYHINL

SEQ ID NO: 2210069 - protein, 18 aa, Cryptosporidium hominis
LTGGFFNPTQTYTTRWWK

SEQ ID NO: 2210070 - protein, 22 aa, Cryptosporidium hominis
LTGMSRGRSRNRRFKFRFGEVP

SEQ ID NO: 2210071 - protein, 25 aa, Cryptosporidium hominis
LTGTVISIPLPLFTEASNLKWRHVS

SEQ ID NO: 2210072 - protein, 27 aa, Cryptosporidium hominis
LTILEKLVMDLFRKYGFNAATCQALLV

SEQ ID NO: 2210073 - protein, 19 aa, Cryptosporidium hominis
LTISLIFIVLIGFVQGNEN

SEQ ID NO: 2210074 - protein, 23 aa, Cryptosporidium hominis
LTKIKLVSDVLPIPFKKSEQKYE

SEQ ID NO: 2210075 - protein, 25 aa, Cryptosporidium hominis
LTLQTVLFFLYFSIVKGGNLTELNK

SEQ ID NO: 2210076 - protein, 24 aa, Cryptosporidium hominis
LTLSFAPLFVTCLYDSSSQVKVIN

SEQ ID NO: 2210077 - protein, 29 aa, Cryptosporidium hominis
LTNFSTLLRIKPILLYWQDEGIINQYPLR

SEQ ID NO: 2210078 - protein, 17 aa, Cryptosporidium hominis
LTNLGYNDSKKQWRDQK

SEQ ID NO: 2210079 - protein, 20 aa, Cryptosporidium hominis
LTTLKLCLSRLTYNLYRLAV

SEQ ID NO: 2210080 - protein, 23 aa, Cryptosporidium hominis
LTYNSVLPILATSALPVVTADPY

SEQ ID NO: 2210081 - protein, 22 aa, Cryptosporidium hominis
LVALFAIVQLVVSTSVIGILEG

SEQ ID NO: 2210082 - protein, 19 aa, Cryptosporidium hominis
LVDGVSQIVKLPNGKEGKN

SEQ ID NO: 2210083 - protein, 20 aa, Cryptosporidium hominis
LVFIFAIVALFGNFRNTEHE

SEQ ID NO: 2210084 - protein, 18 aa, Cryptosporidium hominis
LVLLINFDQMLLNLESKS

SEQ ID NO: 2210085 - protein, 27 aa, Cryptosporidium hominis
LVLLLLQLILWITLIQELSIVKAADSR

SEQ ID NO: 2210086 - protein, 22 aa, Cryptosporidium hominis
LVRIFEMCFQVIFFNGNNLTEK

SEQ ID NO: 2210087 - protein, 24 aa, Cryptosporidium hominis
LVRLIQNVVLFRPFTKEEALKILE

SEQ ID NO: 2210088 - protein, 18 aa, Cryptosporidium hominis
LVSFFYKENMKRLKMYLY

SEQ ID NO: 2210089 - protein, 19 aa, Cryptosporidium hominis
LVVIFFFIVKTSKGEENEK

SEQ ID NO: 2210090 - protein, 19 aa, Cryptosporidium hominis
LVVPPGFYFNKTTSQYEPL

SEQ ID NO: 2210091 - protein, 21 aa, Cryptosporidium hominis
LWGLLIFPALFQKCHGNKYRT

SEQ ID NO: 2210092 - protein, 20 aa, Cryptosporidium hominis
LWKLIIVSISGILRNERASC

SEQ ID NO: 2210093 - protein, 18 aa, Cryptosporidium hominis
LYISIRDFPVYWNDLLVS

SEQ ID NO: 2210094 - protein, 27 aa, Cryptosporidium hominis
LYPEFDMDSIFYMPLHNKLPTLSVTFD

SEQ ID NO: 2210095 - protein, 17 aa, Cryptosporidium hominis
LYPSLVSFFYKENMKRL

SEQ ID NO: 2210096 - protein, 27 aa, Cryptosporidium hominis
LYSYPQFPQLLTPCNHMYPMNIIIGNT

SEQ ID NO: 2210097 - protein, 19 aa, Cryptosporidium hominis
LYTGFRFIASVLLKRQEIF

SEQ ID NO: 2210098 - protein, 19 aa, Cryptosporidium hominis
LYYNPFLYEFELNTKIVCH

SEQ ID NO: 2210099 - protein, 29 aa, Cryptosporidium hominis
MAHRYKIQGFPTLLMFPAGEKREITPVNY

SEQ ID NO: 2210100 - protein, 17 aa, Cryptosporidium hominis
MAKHLYTGFRFIASVLL

SEQ ID NO: 2210101 - protein, 20 aa, Cryptosporidium hominis
MCESCQLITFALKEYISKKL

SEQ ID NO: 2210102 - protein, 20 aa, Cryptosporidium hominis
MDQYYFMYYHQGRRGGKGKW

SEQ ID NO: 2210103 - protein, 19 aa, Cryptosporidium hominis
MDSPYLTSLLFLSVHENFK

SEQ ID NO: 2210104 - protein, 18 aa, Cryptosporidium hominis
MFIQLRSSNENKIIMPSD

SEQ ID NO: 2210105 - protein, 24 aa, Cryptosporidium hominis
MFRGLLHVSALFKYSKKYKNSSST

SEQ ID NO: 2210106 - protein, 18 aa, Cryptosporidium hominis
MHYHIPLELQLFHKKQFN

SEQ ID NO: 2210107 - protein, 25 aa, Cryptosporidium hominis
MKAKPSQYIGIRQLVALGSGSPLAM

SEQ ID NO: 2210108 - protein, 28 aa, Cryptosporidium hominis
MKFNYDFRIIIKEKWIYITSPQGQTLVS

SEQ ID NO: 2210109 - protein, 21 aa, Cryptosporidium hominis
MLDIMLYPRLNNKTLLSEFKI

SEQ ID NO: 2210110 - protein, 18 aa, Cryptosporidium hominis
MLESIRLFGVFHDSFRNL

SEQ ID NO: 2210111 - protein, 20 aa, Cryptosporidium hominis
MLIIPLIDLALCIKGALQLN

SEQ ID NO: 2210112 - protein, 18 aa, Cryptosporidium hominis
MMSLGFYSCFRIICTKKK

SEQ ID NO: 2210113 - protein, 27 aa, Cryptosporidium hominis
MNRQKLLLLSFLFKYSMNLSLADSNSD

SEQ ID NO: 2210114 - protein, 19 aa, Cryptosporidium hominis
MPSFFKMKIRRLKCLQFIL

SEQ ID NO: 2210115 - protein, 18 aa, Cryptosporidium hominis
MPTVPSTLPIAQPLQRPL

SEQ ID NO: 2210116 - protein, 27 aa, Cryptosporidium hominis
MQIEKIPLVYYFPFGDDKVSKMFLYDE

SEQ ID NO: 2210117 - protein, 18 aa, Cryptosporidium hominis
MQWKIVSILIPDIQSHLG

SEQ ID NO: 2210118 - protein, 23 aa, Cryptosporidium hominis
MRNRRRVCAVGPLVIYAEDNGIV

SEQ ID NO: 2210119 - protein, 23 aa, Cryptosporidium hominis
MSNSLANLFIKNGQRYLDICNDG

SEQ ID NO: 2210120 - protein, 27 aa, Cryptosporidium hominis
MSSEPELIKLIRKNIESNLLLSFETKM

SEQ ID NO: 2210121 - protein, 18 aa, Cryptosporidium hominis
MVCFGWGKRYKMIVNCPE

SEQ ID NO: 2210122 - protein, 30 aa, Cryptosporidium hominis
NAGDQIPFFLNYWTDKYTYRYWVLESDQGV

SEQ ID NO: 2210123 - protein, 23 aa, Cryptosporidium hominis
NALIRIMQLMFNLITTGDLSTWT

SEQ ID NO: 2210124 - protein, 24 aa, Cryptosporidium hominis
NAQTYTFFAVLKTTSKQLLSILKK

SEQ ID NO: 2210125 - protein, 20 aa, Cryptosporidium hominis
NAVKTILFPKYLSAQSNQML

SEQ ID NO: 2210126 - protein, 25 aa, Cryptosporidium hominis
NAVNMNMLKWDYSLQGYAQNWATVC

SEQ ID NO: 2210127 - protein, 23 aa, Cryptosporidium hominis
NAYDYLIPFIPSEVLDPVMKKFS

SEQ ID NO: 2210128 - protein, 18 aa, Cryptosporidium hominis
NCHHSWNDLLKFIETEYN

SEQ ID NO: 2210129 - protein, 26 aa, Cryptosporidium hominis
NCPGTLKNLLFWKGKDMELIRDHIVS

SEQ ID NO: 2210130 - protein, 31 aa, Cryptosporidium hominis
NCSDDYLKKLYLIFTIKILHINNFDANKSLQ

SEQ ID NO: 2210131 - protein, 26 aa, Cryptosporidium hominis
NCSSNFDFYFPLRPYTMVGNLIDDED

SEQ ID NO: 2210132 - protein, 18 aa, Cryptosporidium hominis
NCVGALSSLLELHLPRNQ

SEQ ID NO: 2210133 - protein, 23 aa, Cryptosporidium hominis
NDLIIFQESYIKLKLLSNTNDNV

SEQ ID NO: 2210134 - protein, 31 aa, Cryptosporidium hominis
NEFLQHTKAIRSLLHHLIQVTNPNIMDILQQ

SEQ ID NO: 2210135 - protein, 74 aa, Cryptosporidium hominis
NEIKIPKYMTLQDIRYEICKFGVIHKSGCKIVPFSTLLSLPRHSFEIWKSFGLVLQFEFLIAMTYSIEHEMNFD

SEQ ID NO: 2210136 - protein, 17 aa, Cryptosporidium hominis
NEIQTIGLLINHTNLQK

SEQ ID NO: 2210137 - protein, 19 aa, Cryptosporidium hominis
NENLYTNLLLNFISNRPLN

SEQ ID NO: 2210138 - protein, 24 aa, Cryptosporidium hominis
NENSRWTWNRIEKPIFRTNTAKPI

SEQ ID NO: 2210139 - protein, 21 aa, Cryptosporidium hominis
NEQFYSLLPKLTYIDLQNYMR

SEQ ID NO: 2210140 - protein, 23 aa, Cryptosporidium hominis
NESMHYLLTLVKTFFGKIRSSNF

SEQ ID NO: 2210141 - protein, 18 aa, Cryptosporidium hominis
NETKNTLYLLFDTTNKNF

SEQ ID NO: 2210142 - protein, 18 aa, Cryptosporidium hominis
NEVTVFQGFLKASKSGQE

SEQ ID NO: 2210143 - protein, 23 aa, Cryptosporidium hominis
NFEEPKLSCRAPFSLVGGDCLYN

SEQ ID NO: 2210144 - protein, 18 aa, Cryptosporidium hominis
NFINSLTWILQQNNPYSD

SEQ ID NO: 2210145 - protein, 22 aa, Cryptosporidium hominis
NFLLVLLFTVSFTSNNFVKNFI

SEQ ID NO: 2210146 - protein, 23 aa, Cryptosporidium hominis
NGEFEVFLMDKFDWNSSFTVEGQ

SEQ ID NO: 2210147 - protein, 22 aa, Cryptosporidium hominis
NGEYYNQFFPRVKFITRIVEKN

SEQ ID NO: 2210148 - protein, 25 aa, Cryptosporidium hominis
NGILKKFIQYCRRGIRSLAYERYIS

SEQ ID NO: 2210149 - protein, 25 aa, Cryptosporidium hominis
NGPPDRVYYYPIGFNLASLFIGPGV

SEQ ID NO: 2210150 - protein, 29 aa, Cryptosporidium hominis
NGTKNNAIGLLRYGFLYALINEINNQFQK

SEQ ID NO: 2210151 - protein, 20 aa, Cryptosporidium hominis
NHFANIAKDILRYPEVVSTP

SEQ ID NO: 2210152 - protein, 22 aa, Cryptosporidium hominis
NHIRVIIMFNYMNKILSQIGKQ

SEQ ID NO: 2210153 - protein, 18 aa, Cryptosporidium hominis
NHKKLFKILNFHVDKVIF

SEQ ID NO: 2210154 - protein, 20 aa, Cryptosporidium hominis
NHSKLLWKATIPINEFIIED

SEQ ID NO: 2210155 - protein, 20 aa, Cryptosporidium hominis
NIFSLECSCSVYPKNPGCPC

SEQ ID NO: 2210156 - protein, 19 aa, Cryptosporidium hominis
NIISLYYPDVLCLLSTCNE

SEQ ID NO: 2210157 - protein, 23 aa, Cryptosporidium hominis
NIKARLPTTKRKLRKEVLFPLIN

SEQ ID NO: 2210158 - protein, 20 aa, Cryptosporidium hominis
NILIFFAGQILSEPLPFSSD

SEQ ID NO: 2210159 - protein, 22 aa, Cryptosporidium hominis
NIMEFYDDWYKGPKSKRLCSQN

SEQ ID NO: 2210160 - protein, 24 aa, Cryptosporidium hominis
NINSRLLMLWDVDKTLWDSYNFIQ

SEQ ID NO: 2210161 - protein, 30 aa, Cryptosporidium hominis
NIPKNIFTSKAYVLKLLRLDIDPETSEEAV

SEQ ID NO: 2210162 - protein, 18 aa, Cryptosporidium hominis
NIQFKYCYNMPLLKTTES

SEQ ID NO: 2210163 - protein, 28 aa, Cryptosporidium hominis
NISFDSLNNLLYKQSFISKFINSLSKAL

SEQ ID NO: 2210164 - protein, 22 aa, Cryptosporidium hominis
NISLLLKFERIIFTKRSDQAKK

SEQ ID NO: 2210165 - protein, 18 aa, Cryptosporidium hominis
NKIPWDKELLYVCDLGLS

SEQ ID NO: 2210166 - protein, 26 aa, Cryptosporidium hominis
NKPKRAMTAFMYFASSRRAEITAANP

SEQ ID NO: 2210167 - protein, 25 aa, Cryptosporidium hominis
NKQGLRVIRFKLENFRMIDFSFSLD

SEQ ID NO: 2210168 - protein, 22 aa, Cryptosporidium hominis
NKRSPQNAVILPTPSKFSNKNP

SEQ ID NO: 2210169 - protein, 32 aa, Cryptosporidium hominis
NKRYAGQFLLIILLFVFYKLAFSSEISEISES

SEQ ID NO: 2210170 - protein, 23 aa, Cryptosporidium hominis
NKTQYIPRFSSTKPLPVIPSFLL

SEQ ID NO: 2210171 - protein, 22 aa, Cryptosporidium hominis
NKVTGFVFNLKTKLIIGRSSDS

SEQ ID NO: 2210172 - protein, 24 aa, Cryptosporidium hominis
NKYATWVPAVTGLPKRRPISSLLK

SEQ ID NO: 2210173 - protein, 21 aa, Cryptosporidium hominis
NKYSFIRLKNDIQVFLVSQRS

SEQ ID NO: 2210174 - protein, 31 aa, Cryptosporidium hominis
NLELKLIFPIPYQKNLWRYKLTEYISFFLDD

SEQ ID NO: 2210175 - protein, 25 aa, Cryptosporidium hominis
NLENLALSMYFFFTVNNLIKEKGGF

SEQ ID NO: 2210176 - protein, 25 aa, Cryptosporidium hominis
NLHSRIAFSLLLRSNAIKAMEYPQN

SEQ ID NO: 2210177 - protein, 32 aa, Cryptosporidium hominis
NLKNQICEFSKIFDFYLISISKNIGLKSVSNE

SEQ ID NO: 2210178 - protein, 22 aa, Cryptosporidium hominis
NLKQWEEWLLKLDHFQLEHLDN

SEQ ID NO: 2210179 - protein, 26 aa, Cryptosporidium hominis
NLLSPGFIFMVLLRDDIEHLPNNWEE

SEQ ID NO: 2210180 - protein, 20 aa, Cryptosporidium hominis
NLNLDYAITWAINEDNWGYL

SEQ ID NO: 2210181 - protein, 21 aa, Cryptosporidium hominis
NLNSIFPLKVEIKDLAIPFRS

SEQ ID NO: 2210182 - protein, 30 aa, Cryptosporidium hominis
NLPDIFYGNGIQILLQPFSDLSINPSEILK

SEQ ID NO: 2210183 - protein, 41 aa, Cryptosporidium hominis
NLQLNLQLNLQLNLQLSLQLLHLQLRLPRKSKKRSFYKASH

SEQ ID NO: 2210184 - protein, 23 aa, Cryptosporidium hominis
NLTKRACLNPAYTSLRKSARLAQ

SEQ ID NO: 2210185 - protein, 24 aa, Cryptosporidium hominis
NMIDSIISLFPRKIGRRDILTYSN

SEQ ID NO: 2210186 - protein, 23 aa, Cryptosporidium hominis
NMNKLAYDFTLEGIAKSSAKQCQ

SEQ ID NO: 2210187 - protein, 22 aa, Cryptosporidium hominis
NMNLKRFKIFSKDFPVKFSSDT

SEQ ID NO: 2210188 - protein, 20 aa, Cryptosporidium hominis
NMSLFKPILSTYDSNRKDEE

SEQ ID NO: 2210189 - protein, 24 aa, Cryptosporidium hominis
NNCCSVIYDLFLSKVFPHLSTNHY

SEQ ID NO: 2210190 - protein, 27 aa, Cryptosporidium hominis
NNEKLLMHIFSRHFAFSEPFIKQGKYP

SEQ ID NO: 2210191 - protein, 28 aa, Cryptosporidium hominis
NNFCKLYDDFILSAYPKEYYVSFLPEDG

SEQ ID NO: 2210192 - protein, 27 aa, Cryptosporidium hominis
NNFNILSDDILLKNPYKYIDDSESSDS

SEQ ID NO: 2210193 - protein, 19 aa, Cryptosporidium hominis
NNIVWAPTAPYPWKHHTAS

SEQ ID NO: 2210194 - protein, 17 aa, Cryptosporidium hominis
NNLFVHKGFYFVDAESK

SEQ ID NO: 2210195 - protein, 24 aa, Cryptosporidium hominis
NNLIPLQFKLMIACPYAISNHCMQ

SEQ ID NO: 2210196 - protein, 24 aa, Cryptosporidium hominis
NNNCERISYIPPILSCPQNFERSG

SEQ ID NO: 2210197 - protein, 25 aa, Cryptosporidium hominis
NNQIKVYLEQLFNPIVKAIKSNKYL

SEQ ID NO: 2210198 - protein, 27 aa, Cryptosporidium hominis
NNSNLSLIPYKIFNPIMNVTSLSGGNI

SEQ ID NO: 2210199 - protein, 25 aa, Cryptosporidium hominis
NNTDEPIWMRIRSFDWTNLQHVYGR

SEQ ID NO: 2210200 - protein, 22 aa, Cryptosporidium hominis
NPDEIVWLFNAFPEIPTEVNNG

SEQ ID NO: 2210201 - protein, 25 aa, Cryptosporidium hominis
NPEKALEILLKKYVSFKIGINGASV

SEQ ID NO: 2210202 - protein, 25 aa, Cryptosporidium hominis
NPISNGYNLPLYPSQNYLYSNNYSY

SEQ ID NO: 2210203 - protein, 27 aa, Cryptosporidium hominis
NPKIIHERLLIIFQLINSQSSTPNCKM

SEQ ID NO: 2210204 - protein, 27 aa, Cryptosporidium hominis
NPNAISGFYWILPRCAPEPIRVWCDIK

SEQ ID NO: 2210205 - protein, 24 aa, Cryptosporidium hominis
NPSLQLWDLRNVSYPFKEAVSAHQ

SEQ ID NO: 2210206 - protein, 27 aa, Cryptosporidium hominis
NPTQTYTTRWWKASPIGQKLAVLLSSE

SEQ ID NO: 2210207 - protein, 23 aa, Cryptosporidium hominis
NQSNYIDIIKKLFNRIIFGDVSE

SEQ ID NO: 2210208 - protein, 27 aa, Cryptosporidium hominis
NQTMDQLISKVLYFYSRIHEICGEFTN

SEQ ID NO: 2210209 - protein, 20 aa, Cryptosporidium hominis
NRIDSRYNFFGLRKGETIIN

SEQ ID NO: 2210210 - protein, 24 aa, Cryptosporidium hominis
NRISGFIYFTLNDQIFASFPDYPS

SEQ ID NO: 2210211 - protein, 24 aa, Cryptosporidium hominis
NRNMRNIWMNAITEMVLCEKTGVR

SEQ ID NO: 2210212 - protein, 24 aa, Cryptosporidium hominis
NRNVVFTENFFLKHIPGAIKGEEE

SEQ ID NO: 2210213 - protein, 27 aa, Cryptosporidium hominis
NSCIASIRNIWDSFPLFGGINENNVIG

SEQ ID NO: 2210214 - protein, 22 aa, Cryptosporidium hominis
NSDNLWVPKYGLGGFIPTITPT

SEQ ID NO: 2210215 - protein, 29 aa, Cryptosporidium hominis
NSEGVQFFRSFIAYLPAISRGLATSNFAF

SEQ ID NO: 2210216 - protein, 17 aa, Cryptosporidium hominis
NSFFQVFKILSKEAASI

SEQ ID NO: 2210217 - protein, 24 aa, Cryptosporidium hominis
NSKFKIKLPPVIKYHDICNHVAKI

SEQ ID NO: 2210218 - protein, 25 aa, Cryptosporidium hominis
NSNEVSFLTGIKLIDEIISPQKKAS

SEQ ID NO: 2210219 - protein, 31 aa, Cryptosporidium hominis
NSNTQFKSPFYLPPIKYLSAPSPISYFFVLS

SEQ ID NO: 2210220 - protein, 34 aa, Cryptosporidium hominis
NSRSSIVLDKLRQKFPNCPLSCEESWIGDGWCDK

SEQ ID NO: 2210221 - protein, 23 aa, Cryptosporidium hominis
NSSPTVFLFCDLLDKLVNGPSSR

SEQ ID NO: 2210222 - protein, 21 aa, Cryptosporidium hominis
NTGPLLLVSIIAKTNTIYPYV

SEQ ID NO: 2210223 - protein, 24 aa, Cryptosporidium hominis
NTIGGYRCGCYKGFRLNLTGPEEN

SEQ ID NO: 2210224 - protein, 23 aa, Cryptosporidium hominis
NTKSAIRRTLSRRAGFNLSNLLA

SEQ ID NO: 2210225 - protein, 22 aa, Cryptosporidium hominis
NTKYSFLIPFNKVLQIRHKVVL

SEQ ID NO: 2210226 - protein, 19 aa, Cryptosporidium hominis
NTLYLLFDTTNKNFVSIFV

SEQ ID NO: 2210227 - protein, 31 aa, Cryptosporidium hominis
NTNFNQWNLLILLLHLQLLIVSVRSNGGDEF

SEQ ID NO: 2210228 - protein, 25 aa, Cryptosporidium hominis
NTNGSQFFITFTPTPHLDGRHVVFG

SEQ ID NO: 2210229 - protein, 24 aa, Cryptosporidium hominis
NTSEIPLVLPFEVLDLNMSVHRSL

SEQ ID NO: 2210230 - protein, 17 aa, Cryptosporidium hominis
NTYFSYWSEIHQRFIPN

SEQ ID NO: 2210231 - protein, 29 aa, Cryptosporidium hominis
NTYFTVIFPIPHQSPLWKYKPAEYISFFF

SEQ ID NO: 2210232 - protein, 24 aa, Cryptosporidium hominis
NVFLILFFQAFLVVLASTEFESFK

SEQ ID NO: 2210233 - protein, 25 aa, Cryptosporidium hominis
NVKPRPPYPLPQTPQLYPSPSPYPS

SEQ ID NO: 2210234 - protein, 21 aa, Cryptosporidium hominis
NVLSLLVYFVSSLPEYSFPYL

SEQ ID NO: 2210235 - protein, 25 aa, Cryptosporidium hominis
NVNPTGLITVLFFAVVTYDNVLPEF

SEQ ID NO: 2210236 - protein, 19 aa, Cryptosporidium hominis
NWLWGPLRNQDGTPLLPLS

SEQ ID NO: 2210237 - protein, 17 aa, Cryptosporidium hominis
NYDFPELHLLASSLFFE

SEQ ID NO: 2210238 - protein, 26 aa, Cryptosporidium hominis
NYLKKSKISWLIERCFIYTKKKDINN

SEQ ID NO: 2210239 - protein, 31 aa, Cryptosporidium hominis
NYLVTKLMYMEKFRFLYIISEPSLDGKDIDI

SEQ ID NO: 2210240 - protein, 17 aa, Cryptosporidium hominis
NYMYTLLNSISAIEGLF

SEQ ID NO: 2210241 - protein, 28 aa, Cryptosporidium hominis
NYRLNKFCQLLFKQLRNTLLFSNHLDPN

SEQ ID NO: 2210242 - protein, 25 aa, Cryptosporidium hominis
PACNGLMIVLLDHAEFVHSYFTSLV

SEQ ID NO: 2210243 - protein, 25 aa, Cryptosporidium hominis
PAIYHEGHCLIVTAPLKQCPPGYEI

SEQ ID NO: 2210244 - protein, 25 aa, Cryptosporidium hominis
PARKLLRELFLHRKHKQRLFFTNTM

SEQ ID NO: 2210245 - protein, 26 aa, Cryptosporidium hominis
PCDGSIVWLSERWLQYGKSSGLNTSQ

SEQ ID NO: 2210246 - protein, 25 aa, Cryptosporidium hominis
PCPYQRYFIQTDRILKRIAKIEAKT

SEQ ID NO: 2210247 - protein, 24 aa, Cryptosporidium hominis
PDDIELRIVTLRNFYLSATRNPVL

SEQ ID NO: 2210248 - protein, 18 aa, Cryptosporidium hominis
PDFFSYDIILHGFSKAFT

SEQ ID NO: 2210249 - protein, 30 aa, Cryptosporidium hominis
PECIKTISVPYILKCESPFILDGDKCVEKT

SEQ ID NO: 2210250 - protein, 24 aa, Cryptosporidium hominis
PEGKYWEYLPRNKFSILINADNSK

SEQ ID NO: 2210251 - protein, 24 aa, Cryptosporidium hominis
PEKIKSPIPIIPVEEEVKPNNSVD

SEQ ID NO: 2210252 - protein, 17 aa, Cryptosporidium hominis
PEKSCPPGFVFSGKQCV

SEQ ID NO: 2210253 - protein, 30 aa, Cryptosporidium hominis
PELSPKMTIPLIYRVFLPSDVLPGKNVVGS

SEQ ID NO: 2210254 - protein, 17 aa, Cryptosporidium hominis
PESIQVLGIRLFGRFQG

SEQ ID NO: 2210255 - protein, 23 aa, Cryptosporidium hominis
PESLELAYLYFLEQFRKVCLGDY

SEQ ID NO: 2210256 - protein, 25 aa, Cryptosporidium hominis
PESYNQLFNWLVNRPKQLGQSRIHL

SEQ ID NO: 2210257 - protein, 17 aa, Cryptosporidium hominis
PFEEIYLTKHPELLNTD

SEQ ID NO: 2210258 - protein, 17 aa, Cryptosporidium hominis
PFNTVLLYIYLGNTERN

SEQ ID NO: 2210259 - protein, 17 aa, Cryptosporidium hominis
PFTIIDVAPFVNANANI

SEQ ID NO: 2210260 - protein, 21 aa, Cryptosporidium hominis
PHSPPPLPSPPPPPPPSPSPS

SEQ ID NO: 2210261 - protein, 21 aa, Cryptosporidium hominis
PHSWTILREEYIPIIFFDIYA

SEQ ID NO: 2210262 - protein, 19 aa, Cryptosporidium hominis
PIDKLKQIINWDGPVKFTP

SEQ ID NO: 2210263 - protein, 19 aa, Cryptosporidium hominis
PIFFELKAPYTTLESIRNG

SEQ ID NO: 2210264 - protein, 19 aa, Cryptosporidium hominis
PIFRRNSRWSIVKPVPEIG

SEQ ID NO: 2210265 - protein, 19 aa, Cryptosporidium hominis
PIGFNLASLFIGPGVGNFL

SEQ ID NO: 2210266 - protein, 17 aa, Cryptosporidium hominis
PIGIFIAILLVNTFGPS

SEQ ID NO: 2210267 - protein, 33 aa, Cryptosporidium hominis
PILEEEGLSIFWKGPIHTVPTINLTLVQRLPNK

SEQ ID NO: 2210268 - protein, 44 aa, Cryptosporidium hominis
PIPTPPSFSPPPPPIPPPPSFSPPPPPIPPPPSSPPPPPPVPEY

SEQ ID NO: 2210269 - protein, 19 aa, Cryptosporidium hominis
PKCLIVANGDFSGSSPLLI

SEQ ID NO: 2210270 - protein, 27 aa, Cryptosporidium hominis
PKDNPDLKLLWRYISPHLIEIDMGGSR

SEQ ID NO: 2210271 - protein, 20 aa, Cryptosporidium hominis
PKINLPCDYIPNPGDLRPIP

SEQ ID NO: 2210272 - protein, 25 aa, Cryptosporidium hominis
PKRVEILLAEPSFNNLLTRLVNTVN

SEQ ID NO: 2210273 - protein, 29 aa, Cryptosporidium hominis
PKSVRFVQSGQPPYVLSSRPGQYFRHLQT

SEQ ID NO: 2210274 - protein, 36 aa, Cryptosporidium hominis
PKYSSDFIPRIYLLSRSIPKENFYRVPEIISSLRSE

SEQ ID NO: 2210275 - protein, 17 aa, Cryptosporidium hominis
PLDTIYSYEASLNPPRK

SEQ ID NO: 2210276 - protein, 24 aa, Cryptosporidium hominis
PLRFNNIFIIQQNDIWTTLKDILG

SEQ ID NO: 2210277 - protein, 17 aa, Cryptosporidium hominis
PLSFNLNSPVWGKGYSN

SEQ ID NO: 2210278 - protein, 24 aa, Cryptosporidium hominis
PLTRRGLEYLLRKHKSRARKNLNR

SEQ ID NO: 2210279 - protein, 18 aa, Cryptosporidium hominis
PLWITCDLNLDYKNFDTI

SEQ ID NO: 2210280 - protein, 18 aa, Cryptosporidium hominis
PMNFAIFICSSSLRWERC

SEQ ID NO: 2210281 - protein, 21 aa, Cryptosporidium hominis
PMNTYYYFQHYYTIVTDIYQP

SEQ ID NO: 2210282 - protein, 18 aa, Cryptosporidium hominis
PMPIHPLQTPPHSPPPLP

SEQ ID NO: 2210283 - protein, 26 aa, Cryptosporidium hominis
PMTRRPIIHPFTRKIYDLSKRYGILE

SEQ ID NO: 2210284 - protein, 25 aa, Cryptosporidium hominis
PNEKIRYFCWYTAKSAYPNDSSFEA

SEQ ID NO: 2210285 - protein, 24 aa, Cryptosporidium hominis
PNELLGLLQIPLLDDLLVVSTQGM

SEQ ID NO: 2210286 - protein, 25 aa, Cryptosporidium hominis
PNIECPAYMNLTFASTGSPICIGSR

SEQ ID NO: 2210287 - protein, 20 aa, Cryptosporidium hominis
PNIIYSQFNRLCLITGYSNS

SEQ ID NO: 2210288 - protein, 20 aa, Cryptosporidium hominis
PPEYSCMMFLLVEQAKNIIR

SEQ ID NO: 2210289 - protein, 23 aa, Cryptosporidium hominis
PPGIPITAVRMWFVRKIEGNNIF

SEQ ID NO: 2210290 - protein, 33 aa, Cryptosporidium hominis
PPPPPPLPSTSFPQPPPPPPPLPIPLSESSKVS

SEQ ID NO: 2210291 - protein, 42 aa, Cryptosporidium hominis
PPPPPPPPPPPPPPPPPPLPPSQHLLPPPPPLPLSGDSKVSD

SEQ ID NO: 2210292 - protein, 24 aa, Cryptosporidium hominis
PPPPPVPEYPPLSSAIPPPPSFSP

SEQ ID NO: 2210293 - protein, 18 aa, Cryptosporidium hominis
PPVDLIDVSIYSSIGEIL

SEQ ID NO: 2210294 - protein, 17 aa, Cryptosporidium hominis
PPVLSWVCPTDYPGFRG

SEQ ID NO: 2210295 - protein, 18 aa, Cryptosporidium hominis
PPYQGAPLVPNFHCIFPQ

SEQ ID NO: 2210296 - protein, 22 aa, Cryptosporidium hominis
PQAPLIYRCRFSGPDLLKNSNL

SEQ ID NO: 2210297 - protein, 24 aa, Cryptosporidium hominis
PQASYSFLSIFYTIVEALKDQFPK

SEQ ID NO: 2210298 - protein, 41 aa, Cryptosporidium hominis
PQEELSVPIAIPNIYEEGKLAGGLAWALGVGKYVCNSKSAF

SEQ ID NO: 2210299 - protein, 19 aa, Cryptosporidium hominis
PQPVVLNPILYTISSIFQS

SEQ ID NO: 2210300 - protein, 19 aa, Cryptosporidium hominis
PQRDLPISKPTPLYKAVRA

SEQ ID NO: 2210301 - protein, 18 aa, Cryptosporidium hominis
PRVLDIICKPYESLIGIR

SEQ ID NO: 2210302 - protein, 20 aa, Cryptosporidium hominis
PSFNHYLFELLGVCIRNSSD

SEQ ID NO: 2210303 - protein, 17 aa, Cryptosporidium hominis
PSGLFRDTNECLALQQY

SEQ ID NO: 2210304 - protein, 19 aa, Cryptosporidium hominis
PSIIPFNRVLERKSIYFDS

SEQ ID NO: 2210305 - protein, 22 aa, Cryptosporidium hominis
PSIRYMYGPAKFDSVEPLKEFM

SEQ ID NO: 2210306 - protein, 21 aa, Cryptosporidium hominis
PSKTYVLWNLLDISNPPKQSA

SEQ ID NO: 2210307 - protein, 27 aa, Cryptosporidium hominis
PSPNIPSPPSFPAPPPPYISSGTPSRT

SEQ ID NO: 2210308 - protein, 28 aa, Cryptosporidium hominis
PSQRFHSMPLAYTTLKPTKGMLSTESRL

SEQ ID NO: 2210309 - protein, 31 aa, Cryptosporidium hominis
PSTPTAKMVPPKPAVRRIFQAPGAQGIIQPT

SEQ ID NO: 2210310 - protein, 30 aa, Cryptosporidium hominis
PTKIEHLKNIIKLGFGADSCFAIDANGILF

SEQ ID NO: 2210311 - protein, 23 aa, Cryptosporidium hominis
PTMAWQFKLWYNRGNCSRVKGND

SEQ ID NO: 2210312 - protein, 19 aa, Cryptosporidium hominis
PTPMPMPMPIHPLQTPPHS

SEQ ID NO: 2210313 - protein, 32 aa, Cryptosporidium hominis
PTSKVPTLPTLPLLPPLPPTPKAPTLPTPTIS

SEQ ID NO: 2210314 - protein, 26 aa, Cryptosporidium hominis
PTSNNDLMYKWRLLSNDIPVYEISVF

SEQ ID NO: 2210315 - protein, 17 aa, Cryptosporidium hominis
PVAAFIRPRLVVDEALL

SEQ ID NO: 2210316 - protein, 24 aa, Cryptosporidium hominis
PVEEIINATFIYPGTQQPDLVPNQ

SEQ ID NO: 2210317 - protein, 25 aa, Cryptosporidium hominis
PVGPPPPIVPPPVGPPPPVGLPPPQ

SEQ ID NO: 2210318 - protein, 18 aa, Cryptosporidium hominis
PVIILQQAFPFGFLTRVS

SEQ ID NO: 2210319 - protein, 20 aa, Cryptosporidium hominis
PVKPYDKVLIVVVPSSDLNN

SEQ ID NO: 2210320 - protein, 18 aa, Cryptosporidium hominis
PVPALPPRRQVTRLKLRT

SEQ ID NO: 2210321 - protein, 27 aa, Cryptosporidium hominis
PYEDIGLLDFRILDPLTAPAKPPTFLP

SEQ ID NO: 2210322 - protein, 20 aa, Cryptosporidium hominis
PYFNHFCSLSFIKNLKLIRK

SEQ ID NO: 2210323 - protein, 24 aa, Cryptosporidium hominis
PYLEIPEVFLFPEDARLKENCITS

SEQ ID NO: 2210324 - protein, 18 aa, Cryptosporidium hominis
PYNLISACKYELSDLLKL

SEQ ID NO: 2210325 - protein, 25 aa, Cryptosporidium hominis
PYSQNAYPLIIIPVLIGIPQIDKNG

SEQ ID NO: 2210326 - protein, 17 aa, Cryptosporidium hominis
QADFFVESLYKDVDISQ

SEQ ID NO: 2210327 - protein, 18 aa, Cryptosporidium hominis
QDLRRILYSLNRGSLRSF

SEQ ID NO: 2210328 - protein, 23 aa, Cryptosporidium hominis
QDPYFRMVRDVAPRLGYLKPSSI

SEQ ID NO: 2210329 - protein, 23 aa, Cryptosporidium hominis
QDQYLRRFISSYDQVLKELKAKL

SEQ ID NO: 2210330 - protein, 18 aa, Cryptosporidium hominis
QDTFKVPLVIQLTDDEKF

SEQ ID NO: 2210331 - protein, 20 aa, Cryptosporidium hominis
QDVLFFVDNIYRFTQAGSEV

SEQ ID NO: 2210332 - protein, 29 aa, Cryptosporidium hominis
QDYLSDCTLPIWKNILKFATHYIGGFFGS

SEQ ID NO: 2210333 - protein, 26 aa, Cryptosporidium hominis
QEDYMVISFIIFLSKRLDLATKTFEI

SEQ ID NO: 2210334 - protein, 26 aa, Cryptosporidium hominis
QEEERIRLLRLKEGITYILDTKEDFK

SEQ ID NO: 2210335 - protein, 18 aa, Cryptosporidium hominis
QFPVISPFESLSLVWLSI

SEQ ID NO: 2210336 - protein, 18 aa, Cryptosporidium hominis
QFRVPLMALARDLRGICM

SEQ ID NO: 2210337 - protein, 20 aa, Cryptosporidium hominis
QFSEFIDYEGLCEKKIRRYI

SEQ ID NO: 2210338 - protein, 18 aa, Cryptosporidium hominis
QGRFISDFYFFESNGQGL

SEQ ID NO: 2210339 - protein, 25 aa, Cryptosporidium hominis
QHKYRIFSRLSEKLFPLYKDADLYE

SEQ ID NO: 2210340 - protein, 32 aa, Cryptosporidium hominis
QIASLNRFFEINGVPPLTYLSPANETLLPNNV

SEQ ID NO: 2210341 - protein, 25 aa, Cryptosporidium hominis
QIFETWNRLVSILPFVLHKLEQTCK

SEQ ID NO: 2210342 - protein, 19 aa, Cryptosporidium hominis
QIFGKLVTLPFINSPIESI

SEQ ID NO: 2210343 - protein, 23 aa, Cryptosporidium hominis
QILEQFGVTVSALKSLLSSNLEK

SEQ ID NO: 2210344 - protein, 21 aa, Cryptosporidium hominis
QIRGSNVGAKFVFLISRQGGG

SEQ ID NO: 2210345 - protein, 18 aa, Cryptosporidium hominis
QIVLRKLDPVKADALGVP

SEQ ID NO: 2210346 - protein, 30 aa, Cryptosporidium hominis
QKGGSEKEWIMSFAPKLRPGRMQRRRDLFN

SEQ ID NO: 2210347 - protein, 28 aa, Cryptosporidium hominis
QKNLLLSDILRKCPPNRIGLGPFKGVRS

SEQ ID NO: 2210348 - protein, 24 aa, Cryptosporidium hominis
QKNNKLGLAILPIGALGISYSDFN

SEQ ID NO: 2210349 - protein, 25 aa, Cryptosporidium hominis
QLERYILNCFLSAIKMLWKEGREQS

SEQ ID NO: 2210350 - protein, 21 aa, Cryptosporidium hominis
QLEYSIPLFEDEWRAIIDFMS

SEQ ID NO: 2210351 - protein, 19 aa, Cryptosporidium hominis
QLGIFVLGLIIICFGVSEC

SEQ ID NO: 2210352 - protein, 25 aa, Cryptosporidium hominis
QLISKRPYLPQGIVPSPISTTTTTT

SEQ ID NO: 2210353 - protein, 28 aa, Cryptosporidium hominis
QLKNLRIDWEFPPFTYSIAAKVDGEMRQ

SEQ ID NO: 2210354 - protein, 32 aa, Cryptosporidium hominis
QLKPQLKVVKRTKPLIPKFPIEEESHSAAIDH

SEQ ID NO: 2210355 - protein, 20 aa, Cryptosporidium hominis
QLLAEIFSCVLRMSAKRYSG

SEQ ID NO: 2210356 - protein, 18 aa, Cryptosporidium hominis
QLLKEKFVQIYPVVARSV

SEQ ID NO: 2210357 - protein, 19 aa, Cryptosporidium hominis
QLMTINEIIKCRGGKNWIT

SEQ ID NO: 2210358 - protein, 17 aa, Cryptosporidium hominis
QLTWTSRVMFGYSLDLS

SEQ ID NO: 2210359 - protein, 35 aa, Cryptosporidium hominis
QNDIPYEGFSPRAFPTILFVKAGTRTPIPYDGKRT

SEQ ID NO: 2210360 - protein, 21 aa, Cryptosporidium hominis
QNELMQYYHSGSTNKYIINNQ

SEQ ID NO: 2210361 - protein, 26 aa, Cryptosporidium hominis
QNGLSFIFFSKVVFPNLLKATLSPPL

SEQ ID NO: 2210362 - protein, 25 aa, Cryptosporidium hominis
QNLLAALCWSLPFKFIKCDIDFEEN

SEQ ID NO: 2210363 - protein, 24 aa, Cryptosporidium hominis
QNLTKVPIYQLVHIPELLSNATHL

SEQ ID NO: 2210364 - protein, 26 aa, Cryptosporidium hominis
QNMAGNPFPAGLGPPLVRVQKVKGEM

SEQ ID NO: 2210365 - protein, 21 aa, Cryptosporidium hominis
QNPSKLAAPLIAKLSSSRNCI

SEQ ID NO: 2210366 - protein, 26 aa, Cryptosporidium hominis
QNSFHLLRVMFITNIDLGLTLNPLEI

SEQ ID NO: 2210367 - protein, 21 aa, Cryptosporidium hominis
QNVNCFLVFRALPENLKQATS

SEQ ID NO: 2210368 - protein, 17 aa, Cryptosporidium hominis
QPEEKRRALYNLVLKQM

SEQ ID NO: 2210369 - protein, 20 aa, Cryptosporidium hominis
QPLVLKYKFFSEIISSYNYS

SEQ ID NO: 2210370 - protein, 36 aa, Cryptosporidium hominis
QPVKRYTSYLRGPAERLPVSKIWRATPPENRPEDSV

SEQ ID NO: 2210371 - protein, 21 aa, Cryptosporidium hominis
QQPIEIGPPTNFQHLQTGGLN

SEQ ID NO: 2210372 - protein, 26 aa, Cryptosporidium hominis
QQTYIDYLNALPRCQCLPGYIGDGRT

SEQ ID NO: 2210373 - protein, 36 aa, Cryptosporidium hominis
QRFRPQRIIIRDIGDTYWHLIGPYKASKIPGYVLPE

SEQ ID NO: 2210374 - protein, 20 aa, Cryptosporidium hominis
QSFISKFINSLSKALNLIPN

SEQ ID NO: 2210375 - protein, 23 aa, Cryptosporidium hominis
QSGSPFFTRVLPDSDICFKSCMA

SEQ ID NO: 2210376 - protein, 32 aa, Cryptosporidium hominis
QTLLRNFLHVVKQLHLNTLRKDPLRLREYFPG

SEQ ID NO: 2210377 - protein, 27 aa, Cryptosporidium hominis
QVCTLKEFIYFLDYINTKKFEIDFCIR

SEQ ID NO: 2210378 - protein, 32 aa, Cryptosporidium hominis
QVFKSPNREAYTVNWIGWELTLTNDRDSGLKI

SEQ ID NO: 2210379 - protein, 31 aa, Cryptosporidium hominis
QVGRWYRRMLRGIWLPFYTAAMFMLQNGNKV

SEQ ID NO: 2210380 - protein, 30 aa, Cryptosporidium hominis
QYIRMLAILHSKKYILPKTAYNIWRDSVLS

SEQ ID NO: 2210381 - protein, 23 aa, Cryptosporidium hominis
RAEIRIFFELNTKYGYYRINTLE

SEQ ID NO: 2210382 - protein, 26 aa, Cryptosporidium hominis
RATFKITCFRILRKLYREGSVSLRSS

SEQ ID NO: 2210383 - protein, 19 aa, Cryptosporidium hominis
RCLLMLGWHFRSHLRQVFQ

SEQ ID NO: 2210384 - protein, 17 aa, Cryptosporidium hominis
RCPGQESFPAQLRPYFA

SEQ ID NO: 2210385 - protein, 26 aa, Cryptosporidium hominis
RCVQYLPANKICPPGFNLSGQQCMAP

SEQ ID NO: 2210386 - protein, 32 aa, Cryptosporidium hominis
RDEIRKIFNDQYLPFLQGIYVCKSYPNTKCTK

SEQ ID NO: 2210387 - protein, 25 aa, Cryptosporidium hominis
RDHPSLSIFGFFRGLSTDHARIPSS

SEQ ID NO: 2210388 - protein, 21 aa, Cryptosporidium hominis
RDLFNVLLECLILFGERYSPE

SEQ ID NO: 2210389 - protein, 21 aa, Cryptosporidium hominis
RDNCLYPAKLKPKKSSLDSFS

SEQ ID NO: 2210390 - protein, 25 aa, Cryptosporidium hominis
RDVETSIYLAKRKIHKLKKCLKKIA

SEQ ID NO: 2210391 - protein, 26 aa, Cryptosporidium hominis
REEPPVFERYLYSYPKDYGHYFFNRI

SEQ ID NO: 2210392 - protein, 24 aa, Cryptosporidium hominis
REGCGFVHFLKSKGALPTASSEVS

SEQ ID NO: 2210393 - protein, 23 aa, Cryptosporidium hominis
REQNVPALIPPLPKIINDKTAFD

SEQ ID NO: 2210394 - protein, 26 aa, Cryptosporidium hominis
RFFNRFYCGILMHKSLLKLIIESLKD

SEQ ID NO: 2210395 - protein, 28 aa, Cryptosporidium hominis
RGASEAALQWWVDYGNGGKKPKPVLSSS

SEQ ID NO: 2210396 - protein, 21 aa, Cryptosporidium hominis
RGDICVLVDIMRPNLKCEKGF

SEQ ID NO: 2210397 - protein, 19 aa, Cryptosporidium hominis
RGHKCIVITNVPIIPSCPS

SEQ ID NO: 2210398 - protein, 26 aa, Cryptosporidium hominis
RGKKAYFRIFFNIVLKGKPLYTIEKE

SEQ ID NO: 2210399 - protein, 17 aa, Cryptosporidium hominis
RGKLEQQSICRLVQLVR

SEQ ID NO: 2210400 - protein, 17 aa, Cryptosporidium hominis
RGLKIARGVKTYVLNSI

SEQ ID NO: 2210401 - protein, 23 aa, Cryptosporidium hominis
RGPDCKTVFVDFKYYPICGTNGK

SEQ ID NO: 2210402 - protein, 17 aa, Cryptosporidium hominis
RGSDLASIRSFTISKLS

SEQ ID NO: 2210403 - protein, 27 aa, Cryptosporidium hominis
RGSSSPPFVIIYWDSVSDSLSILKENA

SEQ ID NO: 2210404 - protein, 17 aa, Cryptosporidium hominis
RGTYRSTLSKQFSTGKT

SEQ ID NO: 2210405 - protein, 25 aa, Cryptosporidium hominis
RHFRRSLVLLPPEPYQRVMTFAIEQ

SEQ ID NO: 2210406 - protein, 17 aa, Cryptosporidium hominis
RHIYHFNCIDEWVKIKS

SEQ ID NO: 2210407 - protein, 17 aa, Cryptosporidium hominis
RHVPTDAPLWGKSATLT

SEQ ID NO: 2210408 - protein, 18 aa, Cryptosporidium hominis
RIAKKYIMTFVQSDPEDN

SEQ ID NO: 2210409 - protein, 17 aa, Cryptosporidium hominis
RIFVDLMARFHGQWSLF

SEQ ID NO: 2210410 - protein, 27 aa, Cryptosporidium hominis
RIIFRSLLIYLLIIVLNNELGQTILSN

SEQ ID NO: 2210411 - protein, 20 aa, Cryptosporidium hominis
RILLLLSTISYAYSEKKRQL

SEQ ID NO: 2210412 - protein, 24 aa, Cryptosporidium hominis
RKDPLRLREYFPGTLLQLRDAIES

SEQ ID NO: 2210413 - protein, 20 aa, Cryptosporidium hominis
RKFKLEFLELSNEFLQHTKA

SEQ ID NO: 2210414 - protein, 17 aa, Cryptosporidium hominis
RKGWFLPQNIPVANNEL

SEQ ID NO: 2210415 - protein, 27 aa, Cryptosporidium hominis
RKIEQLALALILYWRERQYDISSIDPI

SEQ ID NO: 2210416 - protein, 23 aa, Cryptosporidium hominis
RKLCSGPILLIILSLSNSTQVDK

SEQ ID NO: 2210417 - protein, 20 aa, Cryptosporidium hominis
RKLRKEVLFPLINIEDYLNN

SEQ ID NO: 2210418 - protein, 23 aa, Cryptosporidium hominis
RKNMNLPGCKVHLPIIGDKDRHD

SEQ ID NO: 2210419 - protein, 27 aa, Cryptosporidium hominis
RKSLFYCIKIIIMSYYKSSIRQFTGIS

SEQ ID NO: 2210420 - protein, 28 aa, Cryptosporidium hominis
RKVQNDPKNFWWLSKIRFSSGHYITKVH

SEQ ID NO: 2210421 - protein, 26 aa, Cryptosporidium hominis
RLDRPNFNNFLFAPSDLNLAGVEEAW

SEQ ID NO: 2210422 - protein, 25 aa, Cryptosporidium hominis
RLESNLAFVLQIGTSIWGSNKAFSP

SEQ ID NO: 2210423 - protein, 20 aa, Cryptosporidium hominis
RLLMDLKKIKSIRITLVCLK

SEQ ID NO: 2210424 - protein, 17 aa, Cryptosporidium hominis
RLLSLSYQLLDPGFMKI

SEQ ID NO: 2210425 - protein, 20 aa, Cryptosporidium hominis
RLMIASILSAKLDFLTIDQI

SEQ ID NO: 2210426 - protein, 17 aa, Cryptosporidium hominis
RLNLLRLAPGGTFGRLT

SEQ ID NO: 2210427 - protein, 21 aa, Cryptosporidium hominis
RLQAVILVCLLYLCIHVEGNG

SEQ ID NO: 2210428 - protein, 25 aa, Cryptosporidium hominis
RLRRIPNFFRNLFRRNKNKAKANGK

SEQ ID NO: 2210429 - protein, 52 aa, Cryptosporidium hominis
RLSDSALCLVKLPTTIWALTPLNWQLNYIRGITPPIFRRSPTSHIVTSDPLI

SEQ ID NO: 2210430 - protein, 23 aa, Cryptosporidium hominis
RLVLLIVIPVIAGKDYYKILGVP

SEQ ID NO: 2210431 - protein, 24 aa, Cryptosporidium hominis
RLYKYNLSIIYNYARSFDALKYRF

SEQ ID NO: 2210432 - protein, 25 aa, Cryptosporidium hominis
RMENLYNSALRKGWFLPQNIPVANN

SEQ ID NO: 2210433 - protein, 20 aa, Cryptosporidium hominis
RMFMLKDNGKYYKEFGLPYL

SEQ ID NO: 2210434 - protein, 19 aa, Cryptosporidium hominis
RNKLKPGFILLINDSTVNS

SEQ ID NO: 2210435 - protein, 36 aa, Cryptosporidium hominis
RNNSGFQLYIKLIPAILLWIFFISGKVSSSNTYENL

SEQ ID NO: 2210436 - protein, 45 aa, Cryptosporidium hominis
RNRIVSLALKIRPYLTNFRYLKTQLYFMMLINLNYQTSCVNKPVE

SEQ ID NO: 2210437 - protein, 27 aa, Cryptosporidium hominis
RNSEIFFLALDLFATYYLEYASSGGIG

SEQ ID NO: 2210438 - protein, 25 aa, Cryptosporidium hominis
RNVYEPYALQCPDGFRLLGDMCQQS

SEQ ID NO: 2210439 - protein, 17 aa, Cryptosporidium hominis
RPKIRELINFGQETLRV

SEQ ID NO: 2210440 - protein, 27 aa, Cryptosporidium hominis
RQSPAIWYSSLKKVMYLDFYNAIHEVG

SEQ ID NO: 2210441 - protein, 17 aa, Cryptosporidium hominis
RRDFKNTTLCTEILTLI

SEQ ID NO: 2210442 - protein, 17 aa, Cryptosporidium hominis
RRDLFKLFPPTDSNSET

SEQ ID NO: 2210443 - protein, 18 aa, Cryptosporidium hominis
RRHHLINYIFQKDGASLY

SEQ ID NO: 2210444 - protein, 34 aa, Cryptosporidium hominis
RSDFGSVFSALLDSFGLLVDSSFSESCLSLIDSL

SEQ ID NO: 2210445 - protein, 23 aa, Cryptosporidium hominis
RSKDAFIKYIKKLTGPAVQVAES

SEQ ID NO: 2210446 - protein, 17 aa, Cryptosporidium hominis
RSKWRGADFSTLAYRNS

SEQ ID NO: 2210447 - protein, 20 aa, Cryptosporidium hominis
RSLFDFLVAQRFIKPTLNIY

SEQ ID NO: 2210448 - protein, 23 aa, Cryptosporidium hominis
RSPEMRILRFDGFEVPDFPFSDT

SEQ ID NO: 2210449 - protein, 17 aa, Cryptosporidium hominis
RSTWGPPSRLQPYDVGD

SEQ ID NO: 2210450 - protein, 27 aa, Cryptosporidium hominis
RTEWTLKLPRWRSSPLGLPPDHPVNAQ

SEQ ID NO: 2210451 - protein, 17 aa, Cryptosporidium hominis
RTPLLKDLWPGDIMDCI

SEQ ID NO: 2210452 - protein, 26 aa, Cryptosporidium hominis
RTRSLGPKYRFVHAPVGYEKSKNAYL

SEQ ID NO: 2210453 - protein, 25 aa, Cryptosporidium hominis
RTTVAGLMYFYSLLVSEFASKAPNS

SEQ ID NO: 2210454 - protein, 27 aa, Cryptosporidium hominis
RVAEKYNKKKSWRKKTRKFKLEFLELS

SEQ ID NO: 2210455 - protein, 17 aa, Cryptosporidium hominis
RVRTIFRTSYKVRCPGQ

SEQ ID NO: 2210456 - protein, 20 aa, Cryptosporidium hominis
RVVRKLALLEKLKLKRKPKT

SEQ ID NO: 2210457 - protein, 26 aa, Cryptosporidium hominis
RVYEKFVPGRGFDKILQKKLINTYDS

SEQ ID NO: 2210458 - protein, 20 aa, Cryptosporidium hominis
RWRDRDFPFYNMLMSTVATT

SEQ ID NO: 2210459 - protein, 26 aa, Cryptosporidium hominis
RYARLSDFIYLLKMILKKSKIHNSNL

SEQ ID NO: 2210460 - protein, 25 aa, Cryptosporidium hominis
RYGLTIIKPPLYDYLFELANKIQQD

SEQ ID NO: 2210461 - protein, 24 aa, Cryptosporidium hominis
RYLAKYISRWKGRVSGTKKSSLGN

SEQ ID NO: 2210462 - protein, 26 aa, Cryptosporidium hominis
SAINDIAIELFFIRKKYVPSFNPESS

SEQ ID NO: 2210463 - protein, 18 aa, Cryptosporidium hominis
SALILIYLSILVDSASND

SEQ ID NO: 2210464 - protein, 27 aa, Cryptosporidium hominis
SAPSRYGPGFPPLTRPVGYLSVPCPNN

SEQ ID NO: 2210465 - protein, 21 aa, Cryptosporidium hominis
SASFKYRKCKYWSWRATDFSC

SEQ ID NO: 2210466 - protein, 18 aa, Cryptosporidium hominis
SCCSGFWGRLRSFFGSCF

SEQ ID NO: 2210467 - protein, 28 aa, Cryptosporidium hominis
SCPEKLAILMFLFQNTLYDVLPSHLNEN

SEQ ID NO: 2210468 - protein, 25 aa, Cryptosporidium hominis
SCVNNYLFYYPMDPFWNYANNSSNP

SEQ ID NO: 2210469 - protein, 18 aa, Cryptosporidium hominis
SDIILSGKCLNGIIFTAM

SEQ ID NO: 2210470 - protein, 23 aa, Cryptosporidium hominis
SDPKCPEGFTLNNSTISCEYEKS

SEQ ID NO: 2210471 - protein, 31 aa, Cryptosporidium hominis
SDYKIQVLIQLVLICFFMLLGQIKGDKTNTK

SEQ ID NO: 2210472 - protein, 18 aa, Cryptosporidium hominis
SEAIFKLYLMNSRELDIR

SEQ ID NO: 2210473 - protein, 17 aa, Cryptosporidium hominis
SECDFLASKARLSDLTI

SEQ ID NO: 2210474 - protein, 24 aa, Cryptosporidium hominis
SEDSYFYINQGKKPAFLLTSMHHS

SEQ ID NO: 2210475 - protein, 24 aa, Cryptosporidium hominis
SEFFKSCFRTIRFLLKEQWKRHES

SEQ ID NO: 2210476 - protein, 18 aa, Cryptosporidium hominis
SELNSCIASIRNIWDSFP

SEQ ID NO: 2210477 - protein, 26 aa, Cryptosporidium hominis
SELQNLLSTKILFLILESMYPNRKLE

SEQ ID NO: 2210478 - protein, 24 aa, Cryptosporidium hominis
SENKLRILYKIDQSNWFRLTEVSG

SEQ ID NO: 2210479 - protein, 24 aa, Cryptosporidium hominis
SENYNLPDKIFLKKYEWGNEISQW

SEQ ID NO: 2210480 - protein, 25 aa, Cryptosporidium hominis
SERVKSWRYLGYIKLSKTKKELEDI

SEQ ID NO: 2210481 - protein, 26 aa, Cryptosporidium hominis
SETGLKNKLWNFLYERSLQDTSLVKF

SEQ ID NO: 2210482 - protein, 21 aa, Cryptosporidium hominis
SFDLLLEPILSNPESPLFVPP

SEQ ID NO: 2210483 - protein, 30 aa, Cryptosporidium hominis
SFKYRNDPINFFWISAFRNGKNSHFLDTFK

SEQ ID NO: 2210484 - protein, 17 aa, Cryptosporidium hominis
SFLSSILLLNGIESLKF

SEQ ID NO: 2210485 - protein, 27 aa, Cryptosporidium hominis
SFPAQLRPYFAWVPTSHRNPKREKGIF

SEQ ID NO: 2210486 - protein, 20 aa, Cryptosporidium hominis
SFPKVAPYTSRLFGAAIHKS

SEQ ID NO: 2210487 - protein, 24 aa, Cryptosporidium hominis
SFSDMVVLPFKYKIDLPPEVLPGS

SEQ ID NO: 2210488 - protein, 20 aa, Cryptosporidium hominis
SFTLNNLVYNILNINLAEKP

SEQ ID NO: 2210489 - protein, 17 aa, Cryptosporidium hominis
SFYISTYSNIYKLPVLE

SEQ ID NO: 2210490 - protein, 17 aa, Cryptosporidium hominis
SFYVRFFDLKLIYKPNC

SEQ ID NO: 2210491 - protein, 32 aa, Cryptosporidium hominis
SGAQAFTKDALFYYPLISPTKRGIVGFCEEDI

SEQ ID NO: 2210492 - protein, 20 aa, Cryptosporidium hominis
SGIKFDYIIVGAGANGLITA

SEQ ID NO: 2210493 - protein, 25 aa, Cryptosporidium hominis
SGIYFLVFPVLLTFSSNSINVFEYT

SEQ ID NO: 2210494 - protein, 26 aa, Cryptosporidium hominis
SGKDRDLLLQLLLTQKMLGNLKQFHS

SEQ ID NO: 2210495 - protein, 34 aa, Cryptosporidium hominis
SGKVPEHFQYIFRRSYLLVYIASIFVESYVLPQF

SEQ ID NO: 2210496 - protein, 26 aa, Cryptosporidium hominis
SGMRIAQFFILNKTKTFILPFVMFPD

SEQ ID NO: 2210497 - protein, 27 aa, Cryptosporidium hominis
SGNEKNGFFGKLFGFFGRKNGGKKDKV

SEQ ID NO: 2210498 - protein, 22 aa, Cryptosporidium hominis
SGPAPFRLAILAMLVSDFVTDN

SEQ ID NO: 2210499 - protein, 25 aa, Cryptosporidium hominis
SGSKDKDFALVKRLLSKFLSSKDKF

SEQ ID NO: 2210500 - protein, 26 aa, Cryptosporidium hominis
SGVAMYSYFLLAESPPFVGSLSLFAP

SEQ ID NO: 2210501 - protein, 20 aa, Cryptosporidium hominis
SHEPILPFQNVIEAPFGIAQ

SEQ ID NO: 2210502 - protein, 23 aa, Cryptosporidium hominis
SHIYQLNKFLLSVWNHFVIEKHP

SEQ ID NO: 2210503 - protein, 24 aa, Cryptosporidium hominis
SICDHTPLFFYLNDTFGHQIEPYK

SEQ ID NO: 2210504 - protein, 29 aa, Cryptosporidium hominis
SIDDLLSILILECPLLFTLQFSALSVEEL

SEQ ID NO: 2210505 - protein, 17 aa, Cryptosporidium hominis
SIDIVGLFSYLPNEFEL

SEQ ID NO: 2210506 - protein, 22 aa, Cryptosporidium hominis
SIFFVFLNHFLGFSADVQIAGN

SEQ ID NO: 2210507 - protein, 17 aa, Cryptosporidium hominis
SIFLSLLKHSFGYQANQ

SEQ ID NO: 2210508 - protein, 18 aa, Cryptosporidium hominis
SIGLILAALPYKPNYPIM

SEQ ID NO: 2210509 - protein, 18 aa, Cryptosporidium hominis
SIHSIFLPSLQGSQTKMS

SEQ ID NO: 2210510 - protein, 27 aa, Cryptosporidium hominis
SIKHDDIRFLFWKMRDYSLQNPEMNLI

SEQ ID NO: 2210511 - protein, 21 aa, Cryptosporidium hominis
SILIAFEFCSVASNGLVGKNH

SEQ ID NO: 2210512 - protein, 17 aa, Cryptosporidium hominis
SIMNVPLFSAISAENYS

SEQ ID NO: 2210513 - protein, 28 aa, Cryptosporidium hominis
SINSLRKWELHYFYPLAKQILESIEKDP

SEQ ID NO: 2210514 - protein, 18 aa, Cryptosporidium hominis
SISFQYLMYLSEYLELPL

SEQ ID NO: 2210515 - protein, 30 aa, Cryptosporidium hominis
SISILIYQNKIILEFLLDRYKVLTEQYLEF

SEQ ID NO: 2210516 - protein, 20 aa, Cryptosporidium hominis
SISLNLLYAIYLSAIMINDL

SEQ ID NO: 2210517 - protein, 37 aa, Cryptosporidium hominis
SISRRKLLDIKYLEYDLPYLHIEADPFLLLQQRRPCG

SEQ ID NO: 2210518 - protein, 27 aa, Cryptosporidium hominis
SITDAISLVIIKLLRRNKISKKASEDA

SEQ ID NO: 2210519 - protein, 24 aa, Cryptosporidium hominis
SITSDDIFFLSKSPGKTLVIGASY

SEQ ID NO: 2210520 - protein, 21 aa, Cryptosporidium hominis
SIYLFALLSSFSLMKVLSKLF

SEQ ID NO: 2210521 - protein, 27 aa, Cryptosporidium hominis
SIYPDRLHRPVFPKKSVRRFYKDIEFQ

SEQ ID NO: 2210522 - protein, 18 aa, Cryptosporidium hominis
SIYTRAFVIAKEDDILVS

SEQ ID NO: 2210523 - protein, 22 aa, Cryptosporidium hominis
SKDLTQLYIQLAKLEMEISLVK

SEQ ID NO: 2210524 - protein, 22 aa, Cryptosporidium hominis
SKFLTEFVASEFYYGLLAEVDF

SEQ ID NO: 2210525 - protein, 26 aa, Cryptosporidium hominis
SKKGNKFTRFFKRLFKKPSCIRCVKS

SEQ ID NO: 2210526 - protein, 28 aa, Cryptosporidium hominis
SKKSTTIYWVYPIPPESYALSLFRYNVN

SEQ ID NO: 2210527 - protein, 21 aa, Cryptosporidium hominis
SKLFCFPIPIFLTLNSFPETV

SEQ ID NO: 2210528 - protein, 17 aa, Cryptosporidium hominis
SKLPTILTSLYTRLVHG

SEQ ID NO: 2210529 - protein, 19 aa, Cryptosporidium hominis
SKPWLLQRIPELTGLSYND

SEQ ID NO: 2210530 - protein, 26 aa, Cryptosporidium hominis
SKSAFSSLISPTLSKNLLVSAPSQEQ

SEQ ID NO: 2210531 - protein, 17 aa, Cryptosporidium hominis
SKSLLGRIFSRKKKNKP

SEQ ID NO: 2210532 - protein, 18 aa, Cryptosporidium hominis
SKTRGMVCFGWGKRYKMI

SEQ ID NO: 2210533 - protein, 27 aa, Cryptosporidium hominis
SKYNEWLPILFIQRYTKPSTLINCYKH

SEQ ID NO: 2210534 - protein, 30 aa, Cryptosporidium hominis
SLALGYHIDKYSPLLPRWARDQTKDPFIVE

SEQ ID NO: 2210535 - protein, 17 aa, Cryptosporidium hominis
SLATLLVGASASGIFRQ

SEQ ID NO: 2210536 - protein, 23 aa, Cryptosporidium hominis
SLEIWDEHWPPYASTFIIEIYNN

SEQ ID NO: 2210537 - protein, 18 aa, Cryptosporidium hominis
SLFSLLSRKVLSQDNGFI

SEQ ID NO: 2210538 - protein, 29 aa, Cryptosporidium hominis
SLHVGHLVPFLFTKYLQDTFKVPLVIQLT

SEQ ID NO: 2210539 - protein, 19 aa, Cryptosporidium hominis
SLIIFCSAVLHQEPLGLVD

SEQ ID NO: 2210540 - protein, 21 aa, Cryptosporidium hominis
SLIKYYNMKLSKLKAAIRSVH

SEQ ID NO: 2210541 - protein, 21 aa, Cryptosporidium hominis
SLILKLKQCSPNWIRKRDLKD

SEQ ID NO: 2210542 - protein, 36 aa, Cryptosporidium hominis
SLIPSNDLLTLRKLRIIPGIIFRVKLSGSPIEPSTI

SEQ ID NO: 2210543 - protein, 29 aa, Cryptosporidium hominis
SLKVCVGTSWLPRPCGLDPFGEIPEGWKV

SEQ ID NO: 2210544 - protein, 25 aa, Cryptosporidium hominis
SLLFLFLLYFSFGSSLKSNPLGNGN

SEQ ID NO: 2210545 - protein, 17 aa, Cryptosporidium hominis
SLLLGLIVSVFAEKGVR

SEQ ID NO: 2210546 - protein, 19 aa, Cryptosporidium hominis
SLPPTWHVYGIRPIQASII

SEQ ID NO: 2210547 - protein, 19 aa, Cryptosporidium hominis
SLQLFLGINLWNNQQIYQE

SEQ ID NO: 2210548 - protein, 25 aa, Cryptosporidium hominis
SLTTYPTPVPYPVPGPTLAPTTLTY

SEQ ID NO: 2210549 - protein, 28 aa, Cryptosporidium hominis
SLWSTIGFPAILTPCSYMYPIVISLKNI

SEQ ID NO: 2210550 - protein, 19 aa, Cryptosporidium hominis
SLYLELYRDGSKKINVSSM

SEQ ID NO: 2210551 - protein, 21 aa, Cryptosporidium hominis
SLYVHAGLLPKYAKLGLDRLD

SEQ ID NO: 2210552 - protein, 27 aa, Cryptosporidium hominis
SMEPWDARLIDLSFVWVPSALKSRNTH

SEQ ID NO: 2210553 - protein, 21 aa, Cryptosporidium hominis
SMFRESTLPTPPPQTTDSTEA

SEQ ID NO: 2210554 - protein, 20 aa, Cryptosporidium hominis
SMNFMLKKSIIKLCSIVVNS

SEQ ID NO: 2210555 - protein, 25 aa, Cryptosporidium hominis
SMVRNPIRTLLHIPSFLGMCGNDID

SEQ ID NO: 2210556 - protein, 21 aa, Cryptosporidium hominis
SNALLLSFLTSNIPQYLRLPT

SEQ ID NO: 2210557 - protein, 24 aa, Cryptosporidium hominis
SNENSLYDLWIYYEHHRLPNLKEK

SEQ ID NO: 2210558 - protein, 23 aa, Cryptosporidium hominis
SNEYLIRCISAEGIVYSPDICPN

SEQ ID NO: 2210559 - protein, 23 aa, Cryptosporidium hominis
SNFELIYIIIKFSLITEIQKLNV

SEQ ID NO: 2210560 - protein, 18 aa, Cryptosporidium hominis
SNFKFINFGYMKSTLEVS

SEQ ID NO: 2210561 - protein, 17 aa, Cryptosporidium hominis
SNFPFIYDGVCAGPITK

SEQ ID NO: 2210562 - protein, 18 aa, Cryptosporidium hominis
SNGFVCMGILNGTEIWSR

SEQ ID NO: 2210563 - protein, 27 aa, Cryptosporidium hominis
SNIVENPLFLFYKLEDKTINKVCSIIS

SEQ ID NO: 2210564 - protein, 24 aa, Cryptosporidium hominis
SNLKNAFVLLILIFEGNDEDTFSV

SEQ ID NO: 2210565 - protein, 26 aa, Cryptosporidium hominis
SNNEERKVPLFLSKSPLVVNSGGGGG

SEQ ID NO: 2210566 - protein, 20 aa, Cryptosporidium hominis
SNPFNINYLKDLPPKRFISK

SEQ ID NO: 2210567 - protein, 31 aa, Cryptosporidium hominis
SNQLLLSFFSGLFLLNYVFSTNTTKIACNAC

SEQ ID NO: 2210568 - protein, 25 aa, Cryptosporidium hominis
SNRYPFIYHGFIECSFGDECQPTKE

SEQ ID NO: 2210569 - protein, 26 aa, Cryptosporidium hominis
SNSGLILFHLIINDNGLFLKGTSGTD

SEQ ID NO: 2210570 - protein, 24 aa, Cryptosporidium hominis
SNTRFQINLPFYDKMDLEKYNIYC

SEQ ID NO: 2210571 - protein, 22 aa, Cryptosporidium hominis
SNVCKLLEEDYRKYCKSHNFKP

SEQ ID NO: 2210572 - protein, 18 aa, Cryptosporidium hominis
SNYYQTISEVSLVKLKTL

SEQ ID NO: 2210573 - protein, 24 aa, Cryptosporidium hominis
SPIILLLAILGIASALDSVQLSEI

SEQ ID NO: 2210574 - protein, 19 aa, Cryptosporidium hominis
SPLRLAVPGGIFDAGFRGE

SEQ ID NO: 2210575 - protein, 23 aa, Cryptosporidium hominis
SPPTPPMPAFPPSPPPTTPGVPS

SEQ ID NO: 2210576 - protein, 24 aa, Cryptosporidium hominis
SPQSTRFLTYDLLMLQNVGEEPTD

SEQ ID NO: 2210577 - protein, 19 aa, Cryptosporidium hominis
SPSILPSIPYNKYQFDCND

SEQ ID NO: 2210578 - protein, 28 aa, Cryptosporidium hominis
SPVICSHPLLMPPPIYKHGKVKCIPKNL

SEQ ID NO: 2210579 - protein, 22 aa, Cryptosporidium hominis
SPYKDIFPYKDSIAFATFMGPF

SEQ ID NO: 2210580 - protein, 20 aa, Cryptosporidium hominis
SPYNLECPNGFILDRERSSC

SEQ ID NO: 2210581 - protein, 25 aa, Cryptosporidium hominis
SQFKYYMKMCLISFPAILGSKSKNF

SEQ ID NO: 2210582 - protein, 26 aa, Cryptosporidium hominis
SQFSDLISPFYTVPLPIHNSEYWVNG

SEQ ID NO: 2210583 - protein, 24 aa, Cryptosporidium hominis
SQHSMALIWNGSYSNKFMLEEEEE

SEQ ID NO: 2210584 - protein, 28 aa, Cryptosporidium hominis
SQLRNNALFINYLVNYFSIPQGAISQLH

SEQ ID NO: 2210585 - protein, 26 aa, Cryptosporidium hominis
SQPMKERWVKAPPFKRPEGINVESGL

SEQ ID NO: 2210586 - protein, 24 aa, Cryptosporidium hominis
SQPNTKLMLLQPFIIFSCIEVVKQ

SEQ ID NO: 2210587 - protein, 35 aa, Cryptosporidium hominis
SRFAEFLLELIELIQSIIYLITGYNLETSISEDFS

SEQ ID NO: 2210588 - protein, 29 aa, Cryptosporidium hominis
SRILFSRLRPFISFQSTFIPLKMSEFRSL

SEQ ID NO: 2210589 - protein, 17 aa, Cryptosporidium hominis
SRKKPHYLLLVHQKETL

SEQ ID NO: 2210590 - protein, 17 aa, Cryptosporidium hominis
SRLLKKISDLNFVEVLN

SEQ ID NO: 2210591 - protein, 23 aa, Cryptosporidium hominis
SRNRRFKFRFGEVPIDSSIETSS

SEQ ID NO: 2210592 - protein, 21 aa, Cryptosporidium hominis
SRRVLGWTIELPFPGSDESKA

SEQ ID NO: 2210593 - protein, 31 aa, Cryptosporidium hominis
SRSQKKRALSLFRVLKYLYKGHTTGWYITAF

SEQ ID NO: 2210594 - protein, 21 aa, Cryptosporidium hominis
SRTELPFRKGSRFKIYLSCQD

SEQ ID NO: 2210595 - protein, 25 aa, Cryptosporidium hominis
SSASFLVMFLMEFAEKYLFFPGKVE

SEQ ID NO: 2210596 - protein, 21 aa, Cryptosporidium hominis
SSEIPRLGQYLVFYGHSESTS

SEQ ID NO: 2210597 - protein, 20 aa, Cryptosporidium hominis
SSGKFKWFRSNTDTVNRLKT

SEQ ID NO: 2210598 - protein, 22 aa, Cryptosporidium hominis
SSIGFFNPLLRVFKSFYSMEKN

SEQ ID NO: 2210599 - protein, 34 aa, Cryptosporidium hominis
SSIQKKFEIHRPPKLLFFFGSMNKFEAYPSHLTG

SEQ ID NO: 2210600 - protein, 32 aa, Cryptosporidium hominis
SSISKHFNKILNLLINSITGGGEWINVGIEKM

SEQ ID NO: 2210601 - protein, 24 aa, Cryptosporidium hominis
SSLKPVYVFIHGGLYLFGSSNSET

SEQ ID NO: 2210602 - protein, 20 aa, Cryptosporidium hominis
SSLLELHLPRNQRKYSFKFS

SEQ ID NO: 2210603 - protein, 18 aa, Cryptosporidium hominis
SSLLLSRQSSVSASSVFS

SEQ ID NO: 2210604 - protein, 18 aa, Cryptosporidium hominis
SSPEEWWDHGPAQLFKQL

SEQ ID NO: 2210605 - protein, 21 aa, Cryptosporidium hominis
SSPVLECPPGYSLETGKQCVR

SEQ ID NO: 2210606 - protein, 18 aa, Cryptosporidium hominis
SSQMALISVIKRLRLIYN

SEQ ID NO: 2210607 - protein, 17 aa, Cryptosporidium hominis
SSQPLVLKYKFFSEIIS

SEQ ID NO: 2210608 - protein, 23 aa, Cryptosporidium hominis
SSTDWIPCCLPGYGNYTVSLHDS

SEQ ID NO: 2210609 - protein, 23 aa, Cryptosporidium hominis
SSVSNILKLLRLDIDLKTSEEAG

SEQ ID NO: 2210610 - protein, 17 aa, Cryptosporidium hominis
SSWNDFQFWPSLALDVT

SEQ ID NO: 2210611 - protein, 18 aa, Cryptosporidium hominis
STEKAWYVFLKASTPSNS

SEQ ID NO: 2210612 - protein, 31 aa, Cryptosporidium hominis
STFWKVLLGNIFLIILCLSNVYSTWNLEWLH

SEQ ID NO: 2210613 - protein, 25 aa, Cryptosporidium hominis
STKNKLSLLALGGCGLNPCLSVGLI

SEQ ID NO: 2210614 - protein, 21 aa, Cryptosporidium hominis
STRWWSTILHTFTNFGKKPIG

SEQ ID NO: 2210615 - protein, 22 aa, Cryptosporidium hominis
STSHWIIGLIIFTTLTQEMQTS

SEQ ID NO: 2210616 - protein, 26 aa, Cryptosporidium hominis
STSVIGILEGFSKYFYSLSYERKQNI

SEQ ID NO: 2210617 - protein, 29 aa, Cryptosporidium hominis
STTTKSFVGPIIIPIYTSTTTKTTTTQPV

SEQ ID NO: 2210618 - protein, 20 aa, Cryptosporidium hominis
STYLFKATSFPFKISVDYSE

SEQ ID NO: 2210619 - protein, 21 aa, Cryptosporidium hominis
STYSFFPSNLYNKIINQFSKL

SEQ ID NO: 2210620 - protein, 18 aa, Cryptosporidium hominis
SVFILASKIHCSSFRSFS

SEQ ID NO: 2210621 - protein, 22 aa, Cryptosporidium hominis
SVFSALLLGLNSPVYAITTESN

SEQ ID NO: 2210622 - protein, 20 aa, Cryptosporidium hominis
SVFTGFPGVYYNGALVFGPG

SEQ ID NO: 2210623 - protein, 25 aa, Cryptosporidium hominis
SVIVLILAIVISSNYCFGKDDTNNN

SEQ ID NO: 2210624 - protein, 25 aa, Cryptosporidium hominis
SVKIPPFVLSKFYGSPTYCILRAFI

SEQ ID NO: 2210625 - protein, 18 aa, Cryptosporidium hominis
SVLIFCNSSLESIPRFQL

SEQ ID NO: 2210626 - protein, 24 aa, Cryptosporidium hominis
SVNGLLKYRVSIWGIPLSSYKTNN

SEQ ID NO: 2210627 - protein, 31 aa, Cryptosporidium hominis
SYDLGAKKIILNRILFMLSANESRYVELLKD

SEQ ID NO: 2210628 - protein, 25 aa, Cryptosporidium hominis
SYGHRLDLLPKKRTHPITWQLIMGV

SEQ ID NO: 2210629 - protein, 19 aa, Cryptosporidium hominis
SYIILSYNKELFSKNLLLH

SEQ ID NO: 2210630 - protein, 22 aa, Cryptosporidium hominis
SYLFFLLIFTATDAFNPIGNII

SEQ ID NO: 2210631 - protein, 19 aa, Cryptosporidium hominis
SYPGAILEFERNRQWGVIA

SEQ ID NO: 2210632 - protein, 26 aa, Cryptosporidium hominis
SYQYAEPYLQLVLAKTTVVGCSFQTN

SEQ ID NO: 2210633 - protein, 18 aa, Cryptosporidium hominis
SYSLLPKSVQIGSTVLIA

SEQ ID NO: 2210634 - protein, 59 aa, Cryptosporidium hominis
TAAKRRALLFVQKYLKSIKLLHFKVDSAKKIVFLALKVRIILQLLPSKYSRDYSSEELE

SEQ ID NO: 2210635 - protein, 22 aa, Cryptosporidium hominis
TAIWDLKMKKSAISFRDPAQRS

SEQ ID NO: 2210636 - protein, 31 aa, Cryptosporidium hominis
TALLQQIHLLPTYMFSSLYYQFADIDNLCYI

SEQ ID NO: 2210637 - protein, 20 aa, Cryptosporidium hominis
TARLISKYRPSQTIIACTAK

SEQ ID NO: 2210638 - protein, 34 aa, Cryptosporidium hominis
TAYNIWRDSVLSIGIEILPPFTPSLTPGIIARPE

SEQ ID NO: 2210639 - protein, 18 aa, Cryptosporidium hominis
TCIAIYRAKRRKFQTFDN

SEQ ID NO: 2210640 - protein, 22 aa, Cryptosporidium hominis
TCIKFLLSIYLGESLKVLPTNT

SEQ ID NO: 2210641 - protein, 19 aa, Cryptosporidium hominis
TCSVERLNLLRLAPGGTFG

SEQ ID NO: 2210642 - protein, 24 aa, Cryptosporidium hominis
TETFINEFTKYRPKIRELINFGQE

SEQ ID NO: 2210643 - protein, 21 aa, Cryptosporidium hominis
TETVLLLLVLLILSHNGTSAL

SEQ ID NO: 2210644 - protein, 17 aa, Cryptosporidium hominis
TEYLSYLLKYNDNGPNR

SEQ ID NO: 2210645 - protein, 26 aa, Cryptosporidium hominis
TFDQFYKYWQYFGSSSKLFISYQSQN

SEQ ID NO: 2210646 - protein, 24 aa, Cryptosporidium hominis
TFFLYIFYLLFGSGILGQIQKDMT

SEQ ID NO: 2210647 - protein, 19 aa, Cryptosporidium hominis
TFLYLLCSIFVGSSHSEEV

SEQ ID NO: 2210648 - protein, 23 aa, Cryptosporidium hominis
TFSRSLLGMILLFNNEFQNIQQQ

SEQ ID NO: 2210649 - protein, 31 aa, Cryptosporidium hominis
TGGNSVMILYIFWRLFEFSYRNFDKALPSHS

SEQ ID NO: 2210650 - protein, 20 aa, Cryptosporidium hominis
TGMQWWVYDSFKTIIGLNAS

SEQ ID NO: 2210651 - protein, 24 aa, Cryptosporidium hominis
THFNFRYTGTGTSPCYLILGEIGC

SEQ ID NO: 2210652 - protein, 26 aa, Cryptosporidium hominis
TIASEYPWGFCPFPCGGFGNITSIVQ

SEQ ID NO: 2210653 - protein, 24 aa, Cryptosporidium hominis
TIEDFNWINIFLKNIHLTEVVQIH

SEQ ID NO: 2210654 - protein, 19 aa, Cryptosporidium hominis
TIHHPIDIFKIFFADENEL

SEQ ID NO: 2210655 - protein, 26 aa, Cryptosporidium hominis
TIKQLKRLIAWRRSYIPSSIHLEIIG

SEQ ID NO: 2210656 - protein, 17 aa, Cryptosporidium hominis
TILLLDDLVAHFNFGCV

SEQ ID NO: 2210657 - protein, 22 aa, Cryptosporidium hominis
TIPDIFIYEFANLINTLFPGII

SEQ ID NO: 2210658 - protein, 18 aa, Cryptosporidium hominis
TIPLKLEKHILLQQQKDR

SEQ ID NO: 2210659 - protein, 44 aa, Cryptosporidium hominis
TISKEDIETWMNLPLKLKLPVINYYFLLVATMGRSSEKGDRHKI

SEQ ID NO: 2210660 - protein, 29 aa, Cryptosporidium hominis
TISSPCDGNLSFRLPLNHSFERSDIILSG

SEQ ID NO: 2210661 - protein, 26 aa, Cryptosporidium hominis
TISTPTLPPQTLPPALPPALPPTITP

SEQ ID NO: 2210662 - protein, 19 aa, Cryptosporidium hominis
TISTYLTFSNNFLGGCYYN

SEQ ID NO: 2210663 - protein, 23 aa, Cryptosporidium hominis
TISVIPWKVINNTILNLVPEIRK

SEQ ID NO: 2210664 - protein, 19 aa, Cryptosporidium hominis
TIVFAFALIKDARSQDVIL

SEQ ID NO: 2210665 - protein, 27 aa, Cryptosporidium hominis
TIVGKYKSTKLYRDEIRKIFNDQYLPF

SEQ ID NO: 2210666 - protein, 20 aa, Cryptosporidium hominis
TKAKTTLLKKVMFGFTQNEW

SEQ ID NO: 2210667 - protein, 17 aa, Cryptosporidium hominis
TKKFEIDFCIRLLKNFQ

SEQ ID NO: 2210668 - protein, 34 aa, Cryptosporidium hominis
TKMQVKKVKLLLILLSVLVIFEFCLGTDLTADLD

SEQ ID NO: 2210669 - protein, 24 aa, Cryptosporidium hominis
TKRCIDLMHYFALARGVRSPTQSQ

SEQ ID NO: 2210670 - protein, 44 aa, Cryptosporidium hominis
TKREEYRFKIHGKLNFLLPLKHDRLFLNKLLTSFYKSINDREKE

SEQ ID NO: 2210671 - protein, 26 aa, Cryptosporidium hominis
TKRKRKSIGLTFQKSSYTNSFCSLLG

SEQ ID NO: 2210672 - protein, 17 aa, Cryptosporidium hominis
TKSWWLNISKLSDPTIN

SEQ ID NO: 2210673 - protein, 24 aa, Cryptosporidium hominis
TLADALLGFNLPLKYIDGKNINIE

SEQ ID NO: 2210674 - protein, 24 aa, Cryptosporidium hominis
TLEWNIIQSRWELLKMKHFYIEKK

SEQ ID NO: 2210675 - protein, 19 aa, Cryptosporidium hominis
TLHTVVIPLVRGKELMYLQ

SEQ ID NO: 2210676 - protein, 26 aa, Cryptosporidium hominis
TLIYNEEIFLLNKLLLINSNGEISTT

SEQ ID NO: 2210677 - protein, 20 aa, Cryptosporidium hominis
TLKSLLENMLIFSGIARNSL

SEQ ID NO: 2210678 - protein, 18 aa, Cryptosporidium hominis
TLPIAQPLQRPLGPLQAE

SEQ ID NO: 2210679 - protein, 26 aa, Cryptosporidium hominis
TLSSVWMLSRFYESFPISAITGEYLL

SEQ ID NO: 2210680 - protein, 27 aa, Cryptosporidium hominis
TLVLVEAIRVLLGLLYSGSPDSEYSAA

SEQ ID NO: 2210681 - protein, 23 aa, Cryptosporidium hominis
TMECPPGYYRPQAGVAIRSHGHK

SEQ ID NO: 2210682 - protein, 17 aa, Cryptosporidium hominis
TMKDKIVKFFFERRLKN

SEQ ID NO: 2210683 - protein, 26 aa, Cryptosporidium hominis
TNAIGIFGFQLQLAGVVFAIKSAKIY

SEQ ID NO: 2210684 - protein, 27 aa, Cryptosporidium hominis
TNKNFVSIFVPRLIDFTLKGKQGLVTL

SEQ ID NO: 2210685 - protein, 29 aa, Cryptosporidium hominis
TNRMNIRKWILFYLNENLNLDYAITWAIN

SEQ ID NO: 2210686 - protein, 28 aa, Cryptosporidium hominis
TNTAKFKYLMQVLLRYKPDPYSQNAYPL

SEQ ID NO: 2210687 - protein, 24 aa, Cryptosporidium hominis
TPAPTPIPIPAPTPVPLPRTQLLS

SEQ ID NO: 2210688 - protein, 23 aa, Cryptosporidium hominis
TPGERLVSMFRKSKISKCSKKTS

SEQ ID NO: 2210689 - protein, 22 aa, Cryptosporidium hominis
TPLSNFSIPCKEAIYLDDIPKL

SEQ ID NO: 2210690 - protein, 22 aa, Cryptosporidium hominis
TPPPSPFPPPSPFPPPSPSPPP

SEQ ID NO: 2210691 - protein, 23 aa, Cryptosporidium hominis
TPRPTRIPPPRPPLPKFTGNKDA

SEQ ID NO: 2210692 - protein, 36 aa, Cryptosporidium hominis
TPSPPPPPLPPRPSPSPPPLPPRPSPSPPPTPHSYT

SEQ ID NO: 2210693 - protein, 17 aa, Cryptosporidium hominis
TPYPIATYGYLFGLVNS

SEQ ID NO: 2210694 - protein, 17 aa, Cryptosporidium hominis
TQHLLIEKFPGLVIQSV

SEQ ID NO: 2210695 - protein, 22 aa, Cryptosporidium hominis
TQILVFSCFLCFFAAVESSVNK

SEQ ID NO: 2210696 - protein, 21 aa, Cryptosporidium hominis
TQLTSLYRKNLLKYKQINNKS

SEQ ID NO: 2210697 - protein, 24 aa, Cryptosporidium hominis
TQPKPFKMYLVSLAIQCGDEFFKP

SEQ ID NO: 2210698 - protein, 20 aa, Cryptosporidium hominis
TQQHICEGIYLLNTYRGEGD

SEQ ID NO: 2210699 - protein, 25 aa, Cryptosporidium hominis
TRDKFFGVNFPFGARLMRFRIDRKT

SEQ ID NO: 2210700 - protein, 20 aa, Cryptosporidium hominis
TRFQVLSIILLLIHGFCNKS

SEQ ID NO: 2210701 - protein, 19 aa, Cryptosporidium hominis
TRKFKKIYPGNGLLHSLLI

SEQ ID NO: 2210702 - protein, 17 aa, Cryptosporidium hominis
TRKPYINQKEAFTLLED

SEQ ID NO: 2210703 - protein, 19 aa, Cryptosporidium hominis
TSLPVIFQIAIKTLRQFHL

SEQ ID NO: 2210704 - protein, 32 aa, Cryptosporidium hominis
TSPHVIYGYSPTGWWIETLPYPNNYNQWFLRT

SEQ ID NO: 2210705 - protein, 23 aa, Cryptosporidium hominis
TSPKFKMPFLSRFQLTPHGNFNS

SEQ ID NO: 2210706 - protein, 22 aa, Cryptosporidium hominis
TSRMEFFDYLLNGSMRPPTYSC

SEQ ID NO: 2210707 - protein, 23 aa, Cryptosporidium hominis
TSSLCERIHLFRKHSYGKDLVNT

SEQ ID NO: 2210708 - protein, 22 aa, Cryptosporidium hominis
TSTQYSVYGLLFTATDDSDQTT

SEQ ID NO: 2210709 - protein, 19 aa, Cryptosporidium hominis
TSVFFQNLVIVCGRSSLGN

SEQ ID NO: 2210710 - protein, 30 aa, Cryptosporidium hominis
TSYAPAINEWLFLTVAYNFNEKRVVMYING

SEQ ID NO: 2210711 - protein, 25 aa, Cryptosporidium hominis
TSYIAFFEELFSLIYEQIIRKNRLH

SEQ ID NO: 2210712 - protein, 25 aa, Cryptosporidium hominis
TTAKLEKFIKPLNLIMKCSVVKETS

SEQ ID NO: 2210713 - protein, 34 aa, Cryptosporidium hominis
TTALGNTLGWYARPFNWWPMDPSITLHNAVKGDF

SEQ ID NO: 2210714 - protein, 23 aa, Cryptosporidium hominis
TTFLVLTLSLLAGFVFGTNENPN

SEQ ID NO: 2210715 - protein, 27 aa, Cryptosporidium hominis
TTLCTEILTLIDKLKQLESRYLKLLSE

SEQ ID NO: 2210716 - protein, 21 aa, Cryptosporidium hominis
TTLPNGLRKDLFPYVIEHNKI

SEQ ID NO: 2210717 - protein, 23 aa, Cryptosporidium hominis
TTPMPPTIPMRPPPRPSRPPPPV

SEQ ID NO: 2210718 - protein, 25 aa, Cryptosporidium hominis
TTYIPSWYHKPCGVNFTFSGKLVSF

SEQ ID NO: 2210719 - protein, 23 aa, Cryptosporidium hominis
TVACFVFFFYSKETSAAELPNSS

SEQ ID NO: 2210720 - protein, 25 aa, Cryptosporidium hominis
TVDSLDYLDFCKIGIWYSKEISNLE

SEQ ID NO: 2210721 - protein, 19 aa, Cryptosporidium hominis
TVEAFARVIYKLNQFTVLE

SEQ ID NO: 2210722 - protein, 25 aa, Cryptosporidium hominis
TVGEYYYLTNYYSLSKELFVKINSF

SEQ ID NO: 2210723 - protein, 24 aa, Cryptosporidium hominis
TVNSTTPVYIFPTSSSKKTTTTTA

SEQ ID NO: 2210724 - protein, 42 aa, Cryptosporidium hominis
TVQTTATFEFLYRTIDPRIKDAPYKISLMKYTYSVLSSQNKI

SEQ ID NO: 2210725 - protein, 17 aa, Cryptosporidium hominis
TVSFLSIVSLKYGLNKL

SEQ ID NO: 2210726 - protein, 19 aa, Cryptosporidium hominis
TWHVYGIRPIQASIIRTRF

SEQ ID NO: 2210727 - protein, 20 aa, Cryptosporidium hominis
TWLSLFAHYAKLQMDSIDFS

SEQ ID NO: 2210728 - protein, 25 aa, Cryptosporidium hominis
TYCNDFLPIIIQLKNIPDFVPDESL

SEQ ID NO: 2210729 - protein, 19 aa, Cryptosporidium hominis
TYLSIMFRGLLHVSALFKY

SEQ ID NO: 2210730 - protein, 57 aa, Cryptosporidium hominis
TYPAHPMTPPYPIPTPFAYPAPAPYPYLYPYPYHLTPFPYSPVPFPYPAQNSSLTPI

SEQ ID NO: 2210731 - protein, 20 aa, Cryptosporidium hominis
TYSLLFTFLKSVIFCQEIDK

SEQ ID NO: 2210732 - protein, 26 aa, Cryptosporidium hominis
VAHRYMGRLVEWFNIIQASLDDDIIK

SEQ ID NO: 2210733 - protein, 21 aa, Cryptosporidium hominis
VAIGEPIWKIYNTSTIGRAQR

SEQ ID NO: 2210734 - protein, 26 aa, Cryptosporidium hominis
VAKSRPYLLPPNTPIEYLTIKKFLQD

SEQ ID NO: 2210735 - protein, 28 aa, Cryptosporidium hominis
VAPTLRGRLLFELKLIEKELIAAFVRML

SEQ ID NO: 2210736 - protein, 22 aa, Cryptosporidium hominis
VARMLSMLWSKPLIGVNHCVAH

SEQ ID NO: 2210737 - protein, 18 aa, Cryptosporidium hominis
VCKVLNSVTIGERKNMNL

SEQ ID NO: 2210738 - protein, 17 aa, Cryptosporidium hominis
VCVILYLTHGTIEANSI

SEQ ID NO: 2210739 - protein, 23 aa, Cryptosporidium hominis
VDDPEIWTMWKAIITQKDRDLNM

SEQ ID NO: 2210740 - protein, 18 aa, Cryptosporidium hominis
VDFRVYLGDLGLPHLFDL

SEQ ID NO: 2210741 - protein, 32 aa, Cryptosporidium hominis
VDLMARFHGQWSLFYKMFRQKFRQICKEAGYS

SEQ ID NO: 2210742 - protein, 25 aa, Cryptosporidium hominis
VDNANLEIFLWFSPDEIYSYQRAID

SEQ ID NO: 2210743 - protein, 22 aa, Cryptosporidium hominis
VDPDVPLIWSAENKDYFASGYS

SEQ ID NO: 2210744 - protein, 33 aa, Cryptosporidium hominis
VDRHYSLKSPRWYLPNFWYYTIEEFESPVNSPH

SEQ ID NO: 2210745 - protein, 19 aa, Cryptosporidium hominis
VECDILYNLIKLFIDDRMA

SEQ ID NO: 2210746 - protein, 24 aa, Cryptosporidium hominis
VEICRRFLVSPLIGIARDVRSYFL

SEQ ID NO: 2210747 - protein, 17 aa, Cryptosporidium hominis
VEILNKLPRQIVESFIN

SEQ ID NO: 2210748 - protein, 17 aa, Cryptosporidium hominis
VEQIFIIYPTVKAWDHL

SEQ ID NO: 2210749 - protein, 20 aa, Cryptosporidium hominis
VFFIILNVFLKLSENGERLS

SEQ ID NO: 2210750 - protein, 20 aa, Cryptosporidium hominis
VFISGLRYQLELSTGIFINN

SEQ ID NO: 2210751 - protein, 17 aa, Cryptosporidium hominis
VFISRSISILIYQNKII

SEQ ID NO: 2210752 - protein, 25 aa, Cryptosporidium hominis
VFKMPEFNWNLFSEKLVFTSKNFLG

SEQ ID NO: 2210753 - protein, 23 aa, Cryptosporidium hominis
VGAKFVFLISRQGGGKFIYTGNG

SEQ ID NO: 2210754 - protein, 21 aa, Cryptosporidium hominis
VGWDEFLLKKGGAANAYTSAD

SEQ ID NO: 2210755 - protein, 24 aa, Cryptosporidium hominis
VHILILSVLCVPLFNIDLYNYYPH

SEQ ID NO: 2210756 - protein, 25 aa, Cryptosporidium hominis
VIAVLNLLIYHLMNIYVEIDDPVFV

SEQ ID NO: 2210757 - protein, 17 aa, Cryptosporidium hominis
VIFLSYGSIHSANNQTE

SEQ ID NO: 2210758 - protein, 22 aa, Cryptosporidium hominis
VILQIIIAIKLSVGRITINVHN

SEQ ID NO: 2210759 - protein, 19 aa, Cryptosporidium hominis
VIRSIYHAFKNKSTQRLLI

SEQ ID NO: 2210760 - protein, 20 aa, Cryptosporidium hominis
VISTRLGYISDLSAAMLVCQ

SEQ ID NO: 2210761 - protein, 22 aa, Cryptosporidium hominis
VITFLSLSFIINQAYCIRVEPR

SEQ ID NO: 2210762 - protein, 35 aa, Cryptosporidium hominis
VITRSQPFMLKFLEEPLDCPLPLTKEIKQSISHHI

SEQ ID NO: 2210763 - protein, 19 aa, Cryptosporidium hominis
VKALRLGWAPTLIGYSAQG

SEQ ID NO: 2210764 - protein, 33 aa, Cryptosporidium hominis
VKAVRKIHPRHPFPLPSSPLYIKGKKFGIKNLF

SEQ ID NO: 2210765 - protein, 22 aa, Cryptosporidium hominis
VKGCPYGFNLNELEQICVQENF

SEQ ID NO: 2210766 - protein, 28 aa, Cryptosporidium hominis
VKSFFGKIKSFFKKKPSSVKLGCKKPNC

SEQ ID NO: 2210767 - protein, 22 aa, Cryptosporidium hominis
VKTKLFFYDLSSKKFVVAKYKC

SEQ ID NO: 2210768 - protein, 24 aa, Cryptosporidium hominis
VLEDDFFEKSILFAIKTYSKKSST

SEQ ID NO: 2210769 - protein, 21 aa, Cryptosporidium hominis
VLFAFLFRAINIFAQNNDAKS

SEQ ID NO: 2210770 - protein, 19 aa, Cryptosporidium hominis
VLFECQFFNQCNYGNYVCQ

SEQ ID NO: 2210771 - protein, 25 aa, Cryptosporidium hominis
VLGVQTRLLPLFSFVSRYSTINESY

SEQ ID NO: 2210772 - protein, 17 aa, Cryptosporidium hominis
VLIILKTHCLNSSGNLN

SEQ ID NO: 2210773 - protein, 20 aa, Cryptosporidium hominis
VLLLIIQLYLSRCSESSEDV

SEQ ID NO: 2210774 - protein, 18 aa, Cryptosporidium hominis
VLPIKPSGLFRDTNECLA

SEQ ID NO: 2210775 - protein, 26 aa, Cryptosporidium hominis
VLVKHNLFVFFLYSLVHSNSYFISYC

SEQ ID NO: 2210776 - protein, 20 aa, Cryptosporidium hominis
VNCKVLAIDALSPGIHNILS

SEQ ID NO: 2210777 - protein, 22 aa, Cryptosporidium hominis
VNEYLLQIYELPPSSKRSFIDE

SEQ ID NO: 2210778 - protein, 25 aa, Cryptosporidium hominis
VNGSCIFCFSIFLTLYSRIQCQYVE

SEQ ID NO: 2210779 - protein, 30 aa, Cryptosporidium hominis
VNMGLKALLGCILLISGLLSIVDESFDVIT

SEQ ID NO: 2210780 - protein, 20 aa, Cryptosporidium hominis
VPAPIGVPRNRLGLRNTEGS

SEQ ID NO: 2210781 - protein, 26 aa, Cryptosporidium hominis
VPNVVPEPRYIPTVKIYDSQIEDLSF

SEQ ID NO: 2210782 - protein, 35 aa, Cryptosporidium hominis
VQNINLLKMNICYPPNIPYSQVKPEKKYYLNDEVI

SEQ ID NO: 2210783 - protein, 33 aa, Cryptosporidium hominis
VQQNHEWYLLAMGQFTQLKFYNSFLNEKVSGDL

SEQ ID NO: 2210784 - protein, 24 aa, Cryptosporidium hominis
VRDLLLSLNDYFLGLVLDATQQNE

SEQ ID NO: 2210785 - protein, 38 aa, Cryptosporidium hominis
VRMVSMYRYGNIRYLLSREFLYLFGKFGELEDYNIYTS

SEQ ID NO: 2210786 - protein, 17 aa, Cryptosporidium hominis
VRTKLLLSTLKQADFFV

SEQ ID NO: 2210787 - protein, 17 aa, Cryptosporidium hominis
VSKFILFPVSIGNEKYG

SEQ ID NO: 2210788 - protein, 27 aa, Cryptosporidium hominis
VSNYHPTTPYFSLLQTSPASSIEPHVS

SEQ ID NO: 2210789 - protein, 20 aa, Cryptosporidium hominis
VSRPIPIGGGALYLCSIDYY

SEQ ID NO: 2210790 - protein, 46 aa, Cryptosporidium hominis
VSRYINKYMISPKKAYLIWKETLIAMNFAILPKWRDSWQDEIRKPS

SEQ ID NO: 2210791 - protein, 24 aa, Cryptosporidium hominis
VSSLTLFTFNLLSQLRHFSGGSVV

SEQ ID NO: 2210792 - protein, 22 aa, Cryptosporidium hominis
VTCPDLLIHLTHLAQKGMVESM

SEQ ID NO: 2210793 - protein, 26 aa, Cryptosporidium hominis
VTSVPKYGKPFLRKGPIRPPSSPPPL

SEQ ID NO: 2210794 - protein, 18 aa, Cryptosporidium hominis
VTTITFKVKCPVNCGSEK

SEQ ID NO: 2210795 - protein, 17 aa, Cryptosporidium hominis
VTTLDYILAFISKEKFD

SEQ ID NO: 2210796 - protein, 22 aa, Cryptosporidium hominis
VTVVPFPPFIPVAGGYVPEPQN

SEQ ID NO: 2210797 - protein, 18 aa, Cryptosporidium hominis
VVIITAFDVLKSSLFIVF

SEQ ID NO: 2210798 - protein, 25 aa, Cryptosporidium hominis
VVLDHSFLNLRRSSFRKLLSCFGCC

SEQ ID NO: 2210799 - protein, 32 aa, Cryptosporidium hominis
VVNPEWKFFTNVLELLLFQPGRAMGTPWPEKG

SEQ ID NO: 2210800 - protein, 23 aa, Cryptosporidium hominis
VVSQIFYGIFLQGPRVTWQSSLF

SEQ ID NO: 2210801 - protein, 19 aa, Cryptosporidium hominis
VVVFFGLVLSSVYSEENEL

SEQ ID NO: 2210802 - protein, 17 aa, Cryptosporidium hominis
VWDFVKANQIPLFGEIS

SEQ ID NO: 2210803 - protein, 17 aa, Cryptosporidium hominis
VYVFFTNEEERLKQEGM

SEQ ID NO: 2210804 - protein, 38 aa, Cryptosporidium hominis
WDVYDYVICLCFYYLIKRERIRIDWFTLGPLSGSPRTR

SEQ ID NO: 2210805 - protein, 22 aa, Cryptosporidium hominis
WEHIQLRWRVLDLAKHILNEKE

SEQ ID NO: 2210806 - protein, 29 aa, Cryptosporidium hominis
WENSEPHMILFRAPKYFSKFPQVFYVACG

SEQ ID NO: 2210807 - protein, 18 aa, Cryptosporidium hominis
WERIALFSKWSDFVKGIP

SEQ ID NO: 2210808 - protein, 24 aa, Cryptosporidium hominis
WFAVILCISLLNGISIWDRIQLNL

SEQ ID NO: 2210809 - protein, 23 aa, Cryptosporidium hominis
WIDFSVVMDIKFRMKRRGMFLET

SEQ ID NO: 2210810 - protein, 18 aa, Cryptosporidium hominis
WIQSFYKNYTNMANIKYE

SEQ ID NO: 2210811 - protein, 24 aa, Cryptosporidium hominis
WKNPINFILRCRESLRVVSNGMKV

SEQ ID NO: 2210812 - protein, 19 aa, Cryptosporidium hominis
WKTYVICHYDFGNLGYIPY

SEQ ID NO: 2210813 - protein, 18 aa, Cryptosporidium hominis
WKYHGEVIKGIRGGAGYL

SEQ ID NO: 2210814 - protein, 24 aa, Cryptosporidium hominis
WLSQFENSWIFIPQGKAVPENIIE

SEQ ID NO: 2210815 - protein, 17 aa, Cryptosporidium hominis
WNALIFNKMGEIHPEVL

SEQ ID NO: 2210816 - protein, 19 aa, Cryptosporidium hominis
WNDFQFWPSLALDVTDRPK

SEQ ID NO: 2210817 - protein, 20 aa, Cryptosporidium hominis
WNETLAIISIYTQPNGIRLG

SEQ ID NO: 2210818 - protein, 18 aa, Cryptosporidium hominis
WNKIPFGANWYEQGFPVG

SEQ ID NO: 2210819 - protein, 18 aa, Cryptosporidium hominis
WRYQPTYISEPLLVVTKS

SEQ ID NO: 2210820 - protein, 25 aa, Cryptosporidium hominis
WYLELIHCMYLGMAPKFFGMVFSYS

SEQ ID NO: 2210821 - protein, 17 aa, Cryptosporidium hominis
WYSLLDSINIFAISMLS

SEQ ID NO: 2210822 - protein, 24 aa, Cryptosporidium hominis
YARDDFFRNKFLQGLAEEAKKEES

SEQ ID NO: 2210823 - protein, 19 aa, Cryptosporidium hominis
YCSTYPKGYFTFWLQKKFS

SEQ ID NO: 2210824 - protein, 17 aa, Cryptosporidium hominis
YDFQDPLGPLFVPGKHC

SEQ ID NO: 2210825 - protein, 26 aa, Cryptosporidium hominis
YDLNRMQWRFFLTSYNPELDNVRIIK

SEQ ID NO: 2210826 - protein, 20 aa, Cryptosporidium hominis
YDLPTFLNFVGDFSGTFSLP

SEQ ID NO: 2210827 - protein, 18 aa, Cryptosporidium hominis
YDRKVAVDQLISTSLNNL

SEQ ID NO: 2210828 - protein, 17 aa, Cryptosporidium hominis
YDYKMLTDFIPIEILNW

SEQ ID NO: 2210829 - protein, 22 aa, Cryptosporidium hominis
YEFKNFFSPIFRRNSRWSIVKP

SEQ ID NO: 2210830 - protein, 26 aa, Cryptosporidium hominis
YEFKYVQYFESFSFLKIKASAPTSNF

SEQ ID NO: 2210831 - protein, 18 aa, Cryptosporidium hominis
YEGLCEKKIRRYIAHINS

SEQ ID NO: 2210832 - protein, 18 aa, Cryptosporidium hominis
YEQIKIPKEFKYSNGILK

SEQ ID NO: 2210833 - protein, 20 aa, Cryptosporidium hominis
YERTLRFLTFQAEQVDRIKQ

SEQ ID NO: 2210834 - protein, 18 aa, Cryptosporidium hominis
YETPQYVPLLLGPYGDQS

SEQ ID NO: 2210835 - protein, 27 aa, Cryptosporidium hominis
YETVWGAISVPPLITPCQFINPITLTV

SEQ ID NO: 2210836 - protein, 25 aa, Cryptosporidium hominis
YFDDFFMVFAHNLVNYRTIITNCYF

SEQ ID NO: 2210837 - protein, 18 aa, Cryptosporidium hominis
YFFVDPNYFWSLNATTQV

SEQ ID NO: 2210838 - protein, 21 aa, Cryptosporidium hominis
YFGFLVYVIGSSVNANDLALP

SEQ ID NO: 2210839 - protein, 19 aa, Cryptosporidium hominis
YFGFYPPQSEIFPIAKKYY

SEQ ID NO: 2210840 - protein, 17 aa, Cryptosporidium hominis
YFSFYISTYSNIYKLPV

SEQ ID NO: 2210841 - protein, 18 aa, Cryptosporidium hominis
YGCYSLLGKLPRMSALSR

SEQ ID NO: 2210842 - protein, 19 aa, Cryptosporidium hominis
YGFFMETLLHLKKKSEKNG

SEQ ID NO: 2210843 - protein, 20 aa, Cryptosporidium hominis
YGGRYIFKFLAVGSGSTVST

SEQ ID NO: 2210844 - protein, 25 aa, Cryptosporidium hominis
YGRHRTSYYFTLSKLLFLESKEEEP

SEQ ID NO: 2210845 - protein, 27 aa, Cryptosporidium hominis
YGRHYRYNWANLLGQKFFIPGNRINDE

SEQ ID NO: 2210846 - protein, 28 aa, Cryptosporidium hominis
YGVFLLTIFNILLILKASENGKVCEPRE

SEQ ID NO: 2210847 - protein, 17 aa, Cryptosporidium hominis
YHDGYRYRLNGNWYVKL

SEQ ID NO: 2210848 - protein, 18 aa, Cryptosporidium hominis
YIAKKKILGLLEWNKDIL

SEQ ID NO: 2210849 - protein, 27 aa, Cryptosporidium hominis
YIEKIKGIFSVGYFDALIVGNIGYEKS

SEQ ID NO: 2210850 - protein, 22 aa, Cryptosporidium hominis
YIIIPLLYLTFNYQSTFSQDFS

SEQ ID NO: 2210851 - protein, 20 aa, Cryptosporidium hominis
YIISIIILVVRGAPTLNVRN

SEQ ID NO: 2210852 - protein, 22 aa, Cryptosporidium hominis
YILLVILQKLSFSILSHSFNEN

SEQ ID NO: 2210853 - protein, 18 aa, Cryptosporidium hominis
YILQVLSLIAFINSLVRQ

SEQ ID NO: 2210854 - protein, 17 aa, Cryptosporidium hominis
YILSSFKLCGLEADISY

SEQ ID NO: 2210855 - protein, 17 aa, Cryptosporidium hominis
YIRMCTNLINHFPRLHH

SEQ ID NO: 2210856 - protein, 23 aa, Cryptosporidium hominis
YKGAGFPVLCGESIRLLHSATEK

SEQ ID NO: 2210857 - protein, 19 aa, Cryptosporidium hominis
YKIIMFPQTVFFKNEINKV

SEQ ID NO: 2210858 - protein, 17 aa, Cryptosporidium hominis
YKLVKAVRKIHPRHPFP

SEQ ID NO: 2210859 - protein, 25 aa, Cryptosporidium hominis
YKRNNWFFKLLISQYNAISQVYLEL

SEQ ID NO: 2210860 - protein, 38 aa, Cryptosporidium hominis
YKRRQLFEKNLYRILPRKLWNRIHSLAAKGLHPLILTK

SEQ ID NO: 2210861 - protein, 20 aa, Cryptosporidium hominis
YLEFRFFDEVIKVGEGFKQG

SEQ ID NO: 2210862 - protein, 18 aa, Cryptosporidium hominis
YLELIHCMHFGMAPFFSG

SEQ ID NO: 2210863 - protein, 22 aa, Cryptosporidium hominis
YLISAFLIEMWHRFRAAESLFD

SEQ ID NO: 2210864 - protein, 19 aa, Cryptosporidium hominis
YLMIHTEIWVHPEKQIREE

SEQ ID NO: 2210865 - protein, 20 aa, Cryptosporidium hominis
YLPIIFDEFHFCNTSCLILS

SEQ ID NO: 2210866 - protein, 26 aa, Cryptosporidium hominis
YLSVLKNLWMCLVSGIFKILKHKQRI

SEQ ID NO: 2210867 - protein, 26 aa, Cryptosporidium hominis
YLVGHYVRLLAQLVKFGLLDSLSPRP

SEQ ID NO: 2210868 - protein, 18 aa, Cryptosporidium hominis
YMSGPWMSPLEHKKWVKS

SEQ ID NO: 2210869 - protein, 21 aa, Cryptosporidium hominis
YNGFIVYPRIKTSVLEKMYNI

SEQ ID NO: 2210870 - protein, 25 aa, Cryptosporidium hominis
YNNQPLIYKFCLNSWLGDGYCDEDC

SEQ ID NO: 2210871 - protein, 22 aa, Cryptosporidium hominis
YNQAIQWLRLGKHIPKAVLFTN

SEQ ID NO: 2210872 - protein, 17 aa, Cryptosporidium hominis
YNQWFLRTQTCAYPSEI

SEQ ID NO: 2210873 - protein, 26 aa, Cryptosporidium hominis
YPIATYGYLFGLVNSHGLCLKLPGFE

SEQ ID NO: 2210874 - protein, 31 aa, Cryptosporidium hominis
YPNVKLRFIIRPKTLRFFPKSSYFFPETKDK

SEQ ID NO: 2210875 - protein, 17 aa, Cryptosporidium hominis
YPPPLKHSGFLTQPGHL

SEQ ID NO: 2210876 - protein, 25 aa, Cryptosporidium hominis
YPPVSGIFGIAFRVRDLSNYYLLEF

SEQ ID NO: 2210877 - protein, 18 aa, Cryptosporidium hominis
YPTPFSDIPYLLKLVNVL

SEQ ID NO: 2210878 - protein, 18 aa, Cryptosporidium hominis
YRDFPPAFDRVRGPDCVV

SEQ ID NO: 2210879 - protein, 25 aa, Cryptosporidium hominis
YRILKSIWYGSRLYKYNLSIIYNYA

SEQ ID NO: 2210880 - protein, 19 aa, Cryptosporidium hominis
YRPIRSLLIKACDDALFHE

SEQ ID NO: 2210881 - protein, 20 aa, Cryptosporidium hominis
YRVPEIISSLRSESNRLVFA

SEQ ID NO: 2210882 - protein, 24 aa, Cryptosporidium hominis
YRYRLNGNWYVKLGEMWYIDNSSS

SEQ ID NO: 2210883 - protein, 23 aa, Cryptosporidium hominis
YSKVFNLILLLDEHKNNLSRSKE

SEQ ID NO: 2210884 - protein, 25 aa, Cryptosporidium hominis
YSLNILRHVFRALRRIVSDDFVTTL

SEQ ID NO: 2210885 - protein, 21 aa, Cryptosporidium hominis
YSPYDLACPAGYALVGDKCAT

SEQ ID NO: 2210886 - protein, 25 aa, Cryptosporidium hominis
YSSDLLSMRTEWADLLFQISNNNRK

SEQ ID NO: 2210887 - protein, 27 aa, Cryptosporidium hominis
YSVVREVFFGIILYCLPNVSRFLHIFE

SEQ ID NO: 2210888 - protein, 22 aa, Cryptosporidium hominis
YTMAKFYFFERINQMFYDKVFT

SEQ ID NO: 2210889 - protein, 18 aa, Cryptosporidium hominis
YVEKLQGIRIKEINSRRI

SEQ ID NO: 2210890 - protein, 17 aa, Cryptosporidium hominis
YVFTRTADKWDQGCFVE

SEQ ID NO: 2210891 - protein, 18 aa, Cryptosporidium hominis
YVNNLWSLWSNIRQDYLS

SEQ ID NO: 2210892 - protein, 17 aa, Cryptosporidium hominis
YVRFFDLKLIYKPNCFE

SEQ ID NO: 2210893 - protein, 19 aa, Cryptosporidium hominis
YWDPVYFGPLSSNSSKILG

SEQ ID NO: 2210894 - protein, 19 aa, Cryptosporidium hominis
AALQWWVDYGNGGKKPKPV

SEQ ID NO: 2210895 - protein, 23 aa, Cryptosporidium hominis
AKFKYLMQVLLRYKPDPYSQNAY

SEQ ID NO: 2210896 - protein, 20 aa, Cryptosporidium hominis
AKKIILNRILFMLSANESRY

SEQ ID NO: 2210897 - protein, 24 aa, Cryptosporidium hominis
AKRRALLFVQKYLKSIKLLHFKVD

SEQ ID NO: 2210898 - protein, 19 aa, Cryptosporidium hominis
ALFVLLFGYISFIGGFEPW

SEQ ID NO: 2210899 - protein, 20 aa, Cryptosporidium hominis
ALLIIYFCINYSFGASNQSK

SEQ ID NO: 2210900 - protein, 18 aa, Cryptosporidium hominis
ALLVYFVATNAVRIRGGD

SEQ ID NO: 2210901 - protein, 20 aa, Cryptosporidium hominis
ASFNILIQPLLNLVLNAPGD

SEQ ID NO: 2210902 - protein, 28 aa, Cryptosporidium hominis
AYPAPAPYPYLYPYPYHLTPFPYSPVPF

SEQ ID NO: 2210903 - protein, 22 aa, Cryptosporidium hominis
CEFSKIFDFYLISISKNIGLKS

SEQ ID NO: 2210904 - protein, 17 aa, Cryptosporidium hominis
CFLAFIIFLVVKVGGTN

SEQ ID NO: 2210905 - protein, 26 aa, Cryptosporidium hominis
CHILPLLLFIILAIPFNSNVPSHGKS

SEQ ID NO: 2210906 - protein, 22 aa, Cryptosporidium hominis
CITLLGLLILIRMYSVRAENYI

SEQ ID NO: 2210907 - protein, 22 aa, Cryptosporidium hominis
CKGLFERFILRHIEWLRITIKS

SEQ ID NO: 2210908 - protein, 18 aa, Cryptosporidium hominis
CVFIIIFFGSLFSNILHI

SEQ ID NO: 2210909 - protein, 30 aa, Cryptosporidium hominis
CVTSKFLLIFYKYILLLLRFISIFDLREVK

SEQ ID NO: 2210910 - protein, 18 aa, Cryptosporidium hominis
DFIYPRLFPIFASDLCIA

SEQ ID NO: 2210911 - protein, 18 aa, Cryptosporidium hominis
DFTVRRWIGKPFSQMVTL

SEQ ID NO: 2210912 - protein, 18 aa, Cryptosporidium hominis
DFYFPLRPYTMVGNLIDD

SEQ ID NO: 2210913 - protein, 26 aa, Cryptosporidium hominis
DGLLCLLFVIFIFAQYLNFASCFLDE

SEQ ID NO: 2210914 - protein, 26 aa, Cryptosporidium hominis
DIMNSRLILILFSIILIIGWVESSSN

SEQ ID NO: 2210915 - protein, 17 aa, Cryptosporidium hominis
DMLLFDQLPLDPQLSYT

SEQ ID NO: 2210916 - protein, 28 aa, Cryptosporidium hominis
DSVPLIKLPNFNLPIFGIPPTPPQVLKT

SEQ ID NO: 2210917 - protein, 23 aa, Cryptosporidium hominis
DTEVLLFELIKFYGSYYSSNLMT

SEQ ID NO: 2210918 - protein, 17 aa, Cryptosporidium hominis
DTYWHLIGPYKASKIPG

SEQ ID NO: 2210919 - protein, 24 aa, Cryptosporidium hominis
EEMDDLTIMLYLLAKEFPSKNHFA

SEQ ID NO: 2210920 - protein, 18 aa, Cryptosporidium hominis
EKIKILPFWIFKVSDEFS

SEQ ID NO: 2210921 - protein, 23 aa, Cryptosporidium hominis
EKLAILMFLFQNTLYDVLPSHLN

SEQ ID NO: 2210922 - protein, 21 aa, Cryptosporidium hominis
EKLVMDLFRKYGFNAATCQAL

SEQ ID NO: 2210923 - protein, 18 aa, Cryptosporidium hominis
ELIQSIIYLITGYNLETS

SEQ ID NO: 2210924 - protein, 21 aa, Cryptosporidium hominis
ELRLIIAPLALALVPVGEVKK

SEQ ID NO: 2210925 - protein, 24 aa, Cryptosporidium hominis
ENSEPHMILFRAPKYFSKFPQVFY

SEQ ID NO: 2210926 - protein, 20 aa, Cryptosporidium hominis
EQIFKCLILLRLDKYSRRIF

SEQ ID NO: 2210927 - protein, 17 aa, Cryptosporidium hominis
ETIYSYCEFLYLQCLIS

SEQ ID NO: 2210928 - protein, 23 aa, Cryptosporidium hominis
ETQVYFLCLKALKSSLDKIYNSP

SEQ ID NO: 2210929 - protein, 18 aa, Cryptosporidium hominis
FFEINGVPPLTYLSPANE

SEQ ID NO: 2210930 - protein, 20 aa, Cryptosporidium hominis
FFIIYQFFFNSFFSNRVCLF

SEQ ID NO: 2210931 - protein, 17 aa, Cryptosporidium hominis
FGAIEWIWMYKLSNIDN

SEQ ID NO: 2210932 - protein, 18 aa, Cryptosporidium hominis
FIACILYFISLVSANGVC

SEQ ID NO: 2210933 - protein, 24 aa, Cryptosporidium hominis
FIFAIYFFALFFNNIFQIKAAEAP

SEQ ID NO: 2210934 - protein, 24 aa, Cryptosporidium hominis
FIFICIFLVFCKLPYISRCEQLES

SEQ ID NO: 2210935 - protein, 28 aa, Cryptosporidium hominis
FIISILQWYFFFLLVILMAGRIYGESSR

SEQ ID NO: 2210936 - protein, 18 aa, Cryptosporidium hominis
FILGFFLIFLGVHSESSL

SEQ ID NO: 2210937 - protein, 18 aa, Cryptosporidium hominis
FIVIVKKLKQKSNEVPTD

SEQ ID NO: 2210938 - protein, 18 aa, Cryptosporidium hominis
FKCTKVWEYPLCGSDGIT

SEQ ID NO: 2210939 - protein, 26 aa, Cryptosporidium hominis
FKWFFTATLVFIFGLLILSSRAEEIE

SEQ ID NO: 2210940 - protein, 17 aa, Cryptosporidium hominis
FLFGLVYLLPLNFNYYN

SEQ ID NO: 2210941 - protein, 18 aa, Cryptosporidium hominis
FLFIIYSSSRDVETKPGI

SEQ ID NO: 2210942 - protein, 17 aa, Cryptosporidium hominis
FLIFLLSSIEIPSVDSK

SEQ ID NO: 2210943 - protein, 22 aa, Cryptosporidium hominis
FLLFIKLGVFSLTINTSPKPNP

SEQ ID NO: 2210944 - protein, 19 aa, Cryptosporidium hominis
FLLIILLVLSCAYANQFSN

SEQ ID NO: 2210945 - protein, 20 aa, Cryptosporidium hominis
FLLKWIIFSYIVINNINGIK

SEQ ID NO: 2210946 - protein, 18 aa, Cryptosporidium hominis
FLLLFFTKYLKITNGAEA

SEQ ID NO: 2210947 - protein, 19 aa, Cryptosporidium hominis
FMIFLDVINYILVSTLSAS

SEQ ID NO: 2210948 - protein, 18 aa, Cryptosporidium hominis
FSCLIIKWNFSLSQDSLH

SEQ ID NO: 2210949 - protein, 24 aa, Cryptosporidium hominis
FTKDALFYYPLISPTKRGIVGFCE

SEQ ID NO: 2210950 - protein, 18 aa, Cryptosporidium hominis
FVIFLLSALCLAFVPNFA

SEQ ID NO: 2210951 - protein, 17 aa, Cryptosporidium hominis
FVLSIGLLLINLTIIFA

SEQ ID NO: 2210952 - protein, 20 aa, Cryptosporidium hominis
FYLFTLYTSLIYPVSYGSNY

SEQ ID NO: 2210953 - protein, 18 aa, Cryptosporidium hominis
FYLIVIVGLVVSAESGDL

SEQ ID NO: 2210954 - protein, 23 aa, Cryptosporidium hominis
GDQIPFFLNYWTDKYTYRYWVLE

SEQ ID NO: 2210955 - protein, 25 aa, Cryptosporidium hominis
GFSLYMIFIFLLGDVTGIHINRELQ

SEQ ID NO: 2210956 - protein, 18 aa, Cryptosporidium hominis
GVLFLILSWVGLVVPKLE

SEQ ID NO: 2210957 - protein, 24 aa, Cryptosporidium hominis
HNPQLYLILFRDLKHIFGFGNPKI

SEQ ID NO: 2210958 - protein, 20 aa, Cryptosporidium hominis
HPRHPFPLPSSPLYIKGKKF

SEQ ID NO: 2210959 - protein, 27 aa, Cryptosporidium hominis
HSFEIWKSFGLVLQFEFLIAMTYSIEH

SEQ ID NO: 2210960 - protein, 17 aa, Cryptosporidium hominis
HTSIMEGLYKLDYKLKF

SEQ ID NO: 2210961 - protein, 17 aa, Cryptosporidium hominis
IFIFFVLFDIFATSQYE

SEQ ID NO: 2210962 - protein, 17 aa, Cryptosporidium hominis
IFIQLSWVFGTESQNGK

SEQ ID NO: 2210963 - protein, 23 aa, Cryptosporidium hominis
IFIYTWLMLFEKVDGSFLTGNNI

SEQ ID NO: 2210964 - protein, 21 aa, Cryptosporidium hominis
IFLILIFLICQTQGISNDLSS

SEQ ID NO: 2210965 - protein, 19 aa, Cryptosporidium hominis
IFLLFLISSPFGYSVYVTR

SEQ ID NO: 2210966 - protein, 18 aa, Cryptosporidium hominis
IGLLLINLTIIFASDINE

SEQ ID NO: 2210967 - protein, 19 aa, Cryptosporidium hominis
IIFSILICKVRLEVVIENE

SEQ ID NO: 2210968 - protein, 20 aa, Cryptosporidium hominis
IIFVFSLSFLSFEHRNERDI

SEQ ID NO: 2210969 - protein, 17 aa, Cryptosporidium hominis
IILFLILHVLIKFKHVI

SEQ ID NO: 2210970 - protein, 20 aa, Cryptosporidium hominis
IILIALIFTQTNLHVNDLII

SEQ ID NO: 2210971 - protein, 24 aa, Cryptosporidium hominis
IITNLLLILFLYKIEVFESVEIEG

SEQ ID NO: 2210972 - protein, 24 aa, Cryptosporidium hominis
IKCFLLILFFNLATFFLVHAVVSE

SEQ ID NO: 2210973 - protein, 23 aa, Cryptosporidium hominis
IKRTFISHILFGLASKYRIIFKE

SEQ ID NO: 2210974 - protein, 21 aa, Cryptosporidium hominis
ILILWILLLTQLIPECTSSSL

SEQ ID NO: 2210975 - protein, 20 aa, Cryptosporidium hominis
ILLAFFYIVFVKCDLPIHVT

SEQ ID NO: 2210976 - protein, 24 aa, Cryptosporidium hominis
ILVLNILLFGLPIVVESSSFILPG

SEQ ID NO: 2210977 - protein, 18 aa, Cryptosporidium hominis
ILVRNFYLYELYSFFKAL

SEQ ID NO: 2210978 - protein, 24 aa, Cryptosporidium hominis
INVSSMYRLLPPGPIKYLFHFKQS

SEQ ID NO: 2210979 - protein, 17 aa, Cryptosporidium hominis
IRNTLVLFIIFFIHNIN

SEQ ID NO: 2210980 - protein, 27 aa, Cryptosporidium hominis
ISLRRKWTLFCWFFSILIREISSDLPP

SEQ ID NO: 2210981 - protein, 19 aa, Cryptosporidium hominis
ITLIIYLVILDYCICAEFV

SEQ ID NO: 2210982 - protein, 24 aa, Cryptosporidium hominis
IVENPLFLFYKLEDKTINKVCSII

SEQ ID NO: 2210983 - protein, 20 aa, Cryptosporidium hominis
IVFLYIILEIVRLAYCSIQQ

SEQ ID NO: 2210984 - protein, 17 aa, Cryptosporidium hominis
IYSYCEFLYLQCLISGY

SEQ ID NO: 2210985 - protein, 27 aa, Cryptosporidium hominis
KAQTITLFFFLIAFISLNEFFSEASST

SEQ ID NO: 2210986 - protein, 20 aa, Cryptosporidium hominis
KECKLLTLIILLISLAQLNY

SEQ ID NO: 2210987 - protein, 19 aa, Cryptosporidium hominis
KFFPFFISKYIRSLQKSNY

SEQ ID NO: 2210988 - protein, 21 aa, Cryptosporidium hominis
KFILFLTILELFIDVILAEEK

SEQ ID NO: 2210989 - protein, 26 aa, Cryptosporidium hominis
KFPDKLFYVIRYFNFIMILTEYLIRQ

SEQ ID NO: 2210990 - protein, 19 aa, Cryptosporidium hominis
KFTRFFKRLFKKPSCIRCV

SEQ ID NO: 2210991 - protein, 17 aa, Cryptosporidium hominis
KIHPRHPFPLPSSPLYI

SEQ ID NO: 2210992 - protein, 20 aa, Cryptosporidium hominis
KIKNVFGPNIFKLFKKKEQK

SEQ ID NO: 2210993 - protein, 29 aa, Cryptosporidium hominis
KKIVFLALKVRIILQLLPSKYSRDYSSEE

SEQ ID NO: 2210994 - protein, 20 aa, Cryptosporidium hominis
KNLWMCLVSGIFKILKHKQR

SEQ ID NO: 2210995 - protein, 24 aa, Cryptosporidium hominis
KQNLLVQCKILYQAFYSYKNSVRS

SEQ ID NO: 2210996 - protein, 20 aa, Cryptosporidium hominis
KSPFYLPPIKYLSAPSPISY

SEQ ID NO: 2210997 - protein, 22 aa, Cryptosporidium hominis
KTGLFIVFIFERSTFYGFLSQI

SEQ ID NO: 2210998 - protein, 25 aa, Cryptosporidium hominis
KYRSSILILVLVFLAILDGSFSGEE

SEQ ID NO: 2210999 - protein, 17 aa, Cryptosporidium hominis
LATLLSELLFYDWKRPD

SEQ ID NO: 2211000 - protein, 24 aa, Cryptosporidium hominis
LELKLIFPIPYQKNLWRYKLTEYI

SEQ ID NO: 2211001 - protein, 17 aa, Cryptosporidium hominis
LFAFLKAIYATDHRGFL

SEQ ID NO: 2211002 - protein, 18 aa, Cryptosporidium hominis
LFFFAIYIMIGISNASDV

SEQ ID NO: 2211003 - protein, 21 aa, Cryptosporidium hominis
LFFSFLILLCEYSFSLGNIQN

SEQ ID NO: 2211004 - protein, 18 aa, Cryptosporidium hominis
LFLFKLFDGTFGKSYYDI

SEQ ID NO: 2211005 - protein, 19 aa, Cryptosporidium hominis
LFLIFMKKAKIVMADLTFM

SEQ ID NO: 2211006 - protein, 24 aa, Cryptosporidium hominis
LFLLSLWLFLYDLHNFQDSSCLRI

SEQ ID NO: 2211007 - protein, 22 aa, Cryptosporidium hominis
LFSNIIILCLYLGILKCVNSHI

SEQ ID NO: 2211008 - protein, 25 aa, Cryptosporidium hominis
LHALICIWLLFRIILEPVNGKNDSK

SEQ ID NO: 2211009 - protein, 20 aa, Cryptosporidium hominis
LIEKLFVKNFIRFLVLLQSK

SEQ ID NO: 2211010 - protein, 18 aa, Cryptosporidium hominis
LIFAALCNLLSLLPDQVF

SEQ ID NO: 2211011 - protein, 18 aa, Cryptosporidium hominis
LIFAILAGYLISLSACAE

SEQ ID NO: 2211012 - protein, 18 aa, Cryptosporidium hominis
LILFTLAIYSQYIHANED

SEQ ID NO: 2211013 - protein, 22 aa, Cryptosporidium hominis
LILVNLLTLMLLQGHFGQIGCK

SEQ ID NO: 2211014 - protein, 24 aa, Cryptosporidium hominis
LKCLQFILLLLSFVSFKIFMFGMA

SEQ ID NO: 2211015 - protein, 19 aa, Cryptosporidium hominis
LKHDRLFLNKLLTSFYKSI

SEQ ID NO: 2211016 - protein, 23 aa, Cryptosporidium hominis
LKKLYLIFTIKILHINNFDANKS

SEQ ID NO: 2211017 - protein, 18 aa, Cryptosporidium hominis
LLAFLSISLIVTAKDGES

SEQ ID NO: 2211018 - protein, 18 aa, Cryptosporidium hominis
LLAIFYFGLSASQDLSIL

SEQ ID NO: 2211019 - protein, 22 aa, Cryptosporidium hominis
LLERAFVKFFIKFLIFLQQKKD

SEQ ID NO: 2211020 - protein, 20 aa, Cryptosporidium hominis
LLFCCIYLVAAINGTKRKRK

SEQ ID NO: 2211021 - protein, 17 aa, Cryptosporidium hominis
LLFIAITLLFISKVKSS

SEQ ID NO: 2211022 - protein, 20 aa, Cryptosporidium hominis
LLLIFLIQISWLKNSLVLSQ

SEQ ID NO: 2211023 - protein, 22 aa, Cryptosporidium hominis
LLLLFIFFSYCMCGDMISAIIE

SEQ ID NO: 2211024 - protein, 20 aa, Cryptosporidium hominis
LLLLFIYLILLFENVTDDFL

SEQ ID NO: 2211025 - protein, 18 aa, Cryptosporidium hominis
LLNLWFAYSFVFGNDLDS

SEQ ID NO: 2211026 - protein, 17 aa, Cryptosporidium hominis
LLTFFSLSELICSQINE

SEQ ID NO: 2211027 - protein, 20 aa, Cryptosporidium hominis
LLTVIYPFLTPPSYKKVLTP

SEQ ID NO: 2211028 - protein, 18 aa, Cryptosporidium hominis
LLTVLFIGLFNDSVSQFT

SEQ ID NO: 2211029 - protein, 18 aa, Cryptosporidium hominis
LMYLQLLERAFVKFFIKF

SEQ ID NO: 2211030 - protein, 25 aa, Cryptosporidium hominis
LNDGFFDIFAFYFFKDYAAIQYLLD

SEQ ID NO: 2211031 - protein, 22 aa, Cryptosporidium hominis
LQPELYCLLFTNSMRPSIFSFV

SEQ ID NO: 2211032 - protein, 20 aa, Cryptosporidium hominis
LQYLLGIILLIGIVHALIFD

SEQ ID NO: 2211033 - protein, 24 aa, Cryptosporidium hominis
LSPPLRYTIFIALLKLVSELTFER

SEQ ID NO: 2211034 - protein, 23 aa, Cryptosporidium hominis
LSSFLLWLVSTSFLINLARSSLI

SEQ ID NO: 2211035 - protein, 18 aa, Cryptosporidium hominis
LSVLRLIVYLIKSVFNIF

SEQ ID NO: 2211036 - protein, 18 aa, Cryptosporidium hominis
LTIIFLIFIYKVFGYVER

SEQ ID NO: 2211037 - protein, 19 aa, Cryptosporidium hominis
LTLQTVLFFLYFSIVKGGN

SEQ ID NO: 2211038 - protein, 18 aa, Cryptosporidium hominis
LVHFFRNRVVLLDPSHGL

SEQ ID NO: 2211039 - protein, 19 aa, Cryptosporidium hominis
MEGLYKLDYKLKFLRRMLR

SEQ ID NO: 2211040 - protein, 26 aa, Cryptosporidium hominis
MGLKALLGCILLISGLLSIVDESFDV

SEQ ID NO: 2211041 - protein, 26 aa, Cryptosporidium hominis
MKLSFSVVLTLLIYTIGKPHGCEAGL

SEQ ID NO: 2211042 - protein, 19 aa, Cryptosporidium hominis
MLIIPLIDLALCIKGALQL

SEQ ID NO: 2211043 - protein, 23 aa, Cryptosporidium hominis
MNIRKWILFYLNENLNLDYAITW

SEQ ID NO: 2211044 - protein, 17 aa, Cryptosporidium hominis
MPSFFKMKIRRLKCLQF

SEQ ID NO: 2211045 - protein, 17 aa, Cryptosporidium hominis
MTIPLIYRVFLPSDVLP

SEQ ID NO: 2211046 - protein, 22 aa, Cryptosporidium hominis
MVFKSFYNLSLFFLKWFKTGPE

SEQ ID NO: 2211047 - protein, 19 aa, Cryptosporidium hominis
NAIGLLRYGFLYALINEIN

SEQ ID NO: 2211048 - protein, 24 aa, Cryptosporidium hominis
NAISGFYWILPRCAPEPIRVWCDI

SEQ ID NO: 2211049 - protein, 22 aa, Cryptosporidium hominis
NDIGVLPDVLYLLGSLAIIPNI

SEQ ID NO: 2211050 - protein, 21 aa, Cryptosporidium hominis
NDVFMLIYLVGRLKGYYDDWK

SEQ ID NO: 2211051 - protein, 22 aa, Cryptosporidium hominis
NEERKVPLFLSKSPLVVNSGGG

SEQ ID NO: 2211052 - protein, 17 aa, Cryptosporidium hominis
NFDFYFPLRPYTMVGNL

SEQ ID NO: 2211053 - protein, 20 aa, Cryptosporidium hominis
NFLLPLKHDRLFLNKLLTSF

SEQ ID NO: 2211054 - protein, 18 aa, Cryptosporidium hominis
NFLLVLLFTVSFTSNNFV

SEQ ID NO: 2211055 - protein, 17 aa, Cryptosporidium hominis
NHVYWVPIIYPSNVYKV

SEQ ID NO: 2211056 - protein, 18 aa, Cryptosporidium hominis
NLSLFFLKWFKTGPEQGD

SEQ ID NO: 2211057 - protein, 23 aa, Cryptosporidium hominis
NNDIYFIIKLLKYVYIKEKNIQK

SEQ ID NO: 2211058 - protein, 19 aa, Cryptosporidium hominis
NPFLVVWDPSKLSASLQAP

SEQ ID NO: 2211059 - protein, 18 aa, Cryptosporidium hominis
NPKNPFLVVWDPSKLSAS

SEQ ID NO: 2211060 - protein, 24 aa, Cryptosporidium hominis
NRQKLLLLSFLFKYSMNLSLADSN

SEQ ID NO: 2211061 - protein, 18 aa, Cryptosporidium hominis
NRRFIIINRLLIPLVVNS

SEQ ID NO: 2211062 - protein, 29 aa, Cryptosporidium hominis
NSGFQLYIKLIPAILLWIFFISGKVSSSN

SEQ ID NO: 2211063 - protein, 29 aa, Cryptosporidium hominis
NTNFNQWNLLILLLHLQLLIVSVRSNGGD

SEQ ID NO: 2211064 - protein, 21 aa, Cryptosporidium hominis
NVFLILFFQAFLVVLASTEFE

SEQ ID NO: 2211065 - protein, 19 aa, Cryptosporidium hominis
NYCFAFVWTLWKSGNEPDL

SEQ ID NO: 2211066 - protein, 22 aa, Cryptosporidium hominis
PAINEWLFLTVAYNFNEKRVVM

SEQ ID NO: 2211067 - protein, 19 aa, Cryptosporidium hominis
PEHFQYIFRRSYLLVYIAS

SEQ ID NO: 2211068 - protein, 23 aa, Cryptosporidium hominis
PLPPSQHLLPPPPPLPLSGDSKV

SEQ ID NO: 2211069 - protein, 20 aa, Cryptosporidium hominis
PPFVIIYWDSVSDSLSILKE

SEQ ID NO: 2211070 - protein, 18 aa, Cryptosporidium hominis
PPIPGMPVPWPLPTATQQ

SEQ ID NO: 2211071 - protein, 19 aa, Cryptosporidium hominis
QESLPYFIRLLYNGQVITN

SEQ ID NO: 2211072 - protein, 18 aa, Cryptosporidium hominis
QFFRSFIAYLPAISRGLA

SEQ ID NO: 2211073 - protein, 20 aa, Cryptosporidium hominis
QGIPCIIYKLISLDFEYSGQ

SEQ ID NO: 2211074 - protein, 24 aa, Cryptosporidium hominis
QLFEKNLYRILPRKLWNRIHSLAA

SEQ ID NO: 2211075 - protein, 18 aa, Cryptosporidium hominis
QLFLKYRSSILILVLVFL

SEQ ID NO: 2211076 - protein, 21 aa, Cryptosporidium hominis
QLRGILLPLVDMFQVSIGCAA

SEQ ID NO: 2211077 - protein, 19 aa, Cryptosporidium hominis
QLYFMMLINLNYQTSCVNK

SEQ ID NO: 2211078 - protein, 22 aa, Cryptosporidium hominis
QVLIQLVLICFFMLLGQIKGDK

SEQ ID NO: 2211079 - protein, 18 aa, Cryptosporidium hominis
QWADLYIILPLSANTLAK

SEQ ID NO: 2211080 - protein, 18 aa, Cryptosporidium hominis
RFLPFQWYSQYLTALANL

SEQ ID NO: 2211081 - protein, 18 aa, Cryptosporidium hominis
RILLLLSTISYAYSEKKR

SEQ ID NO: 2211082 - protein, 23 aa, Cryptosporidium hominis
RLFSYAIGICKIPSLWYLELIYC

SEQ ID NO: 2211083 - protein, 24 aa, Cryptosporidium hominis
RNEGALIILFLLSPIYRVINDENF

SEQ ID NO: 2211084 - protein, 21 aa, Cryptosporidium hominis
RPYLTNFRYLKTQLYFMMLIN

SEQ ID NO: 2211085 - protein, 25 aa, Cryptosporidium hominis
RVNQTYFLMILSLEKLILSSHEVLL

SEQ ID NO: 2211086 - protein, 28 aa, Cryptosporidium hominis
RYAGQFLLIILLFVFYKLAFSSEISEIS

SEQ ID NO: 2211087 - protein, 22 aa, Cryptosporidium hominis
SEIFFLALDLFATYYLEYASSG

SEQ ID NO: 2211088 - protein, 19 aa, Cryptosporidium hominis
SFYFSFYLDNWSLVKLKAI

SEQ ID NO: 2211089 - protein, 19 aa, Cryptosporidium hominis
SFYIQYIVYFPNTGKLFGG

SEQ ID NO: 2211090 - protein, 20 aa, Cryptosporidium hominis
SGIYFLVFPVLLTFSSNSIN

SEQ ID NO: 2211091 - protein, 17 aa, Cryptosporidium hominis
SGLILFHLIINDNGLFL

SEQ ID NO: 2211092 - protein, 21 aa, Cryptosporidium hominis
SIFCQLMCLIKLLNLFNSLNN

SEQ ID NO: 2211093 - protein, 38 aa, Cryptosporidium hominis
SKEDIETWMNLPLKLKLPVINYYFLLVATMGRSSEKGD

SEQ ID NO: 2211094 - protein, 23 aa, Cryptosporidium hominis
SKHFNKILNLLINSITGGGEWIN

SEQ ID NO: 2211095 - protein, 26 aa, Cryptosporidium hominis
SLKSPRWYLPNFWYYTIEEFESPVNS

SEQ ID NO: 2211096 - protein, 23 aa, Cryptosporidium hominis
SLLFLFLLYFSFGSSLKSNPLGN

SEQ ID NO: 2211097 - protein, 20 aa, Cryptosporidium hominis
SLNVNLLRLYRLICKLDSIL

SEQ ID NO: 2211098 - protein, 18 aa, Cryptosporidium hominis
SLPRHSFEIWKSFGLVLQ

SEQ ID NO: 2211099 - protein, 23 aa, Cryptosporidium hominis
SNLCTLHLLLKKYSQNRSGSPNS

SEQ ID NO: 2211100 - protein, 20 aa, Cryptosporidium hominis
SNLIFPFLKIYKKSFLNIVN

SEQ ID NO: 2211101 - protein, 21 aa, Cryptosporidium hominis
SPHQLPLYYIVLQSLGILSDM

SEQ ID NO: 2211102 - protein, 21 aa, Cryptosporidium hominis
SPIILLLAILGIASALDSVQL

SEQ ID NO: 2211103 - protein, 25 aa, Cryptosporidium hominis
SPVDPFWLIQAYRMLLIYSVLLDDA

SEQ ID NO: 2211104 - protein, 19 aa, Cryptosporidium hominis
SRCLLLIILLVILEILCAN

SEQ ID NO: 2211105 - protein, 17 aa, Cryptosporidium hominis
SSNFDFYFPLRPYTMVG

SEQ ID NO: 2211106 - protein, 23 aa, Cryptosporidium hominis
STFWKVLLGNIFLIILCLSNVYS

SEQ ID NO: 2211107 - protein, 19 aa, Cryptosporidium hominis
SVFSALLLGLNSPVYAITT

SEQ ID NO: 2211108 - protein, 18 aa, Cryptosporidium hominis
SVLKNLWMCLVSGIFKIL

SEQ ID NO: 2211109 - protein, 24 aa, Cryptosporidium hominis
SVMILYIFWRLFEFSYRNFDKALP

SEQ ID NO: 2211110 - protein, 18 aa, Cryptosporidium hominis
SVYEMCLFDCTLLNKKDA

SEQ ID NO: 2211111 - protein, 18 aa, Cryptosporidium hominis
SYLFFLLIFTATDAFNPI

SEQ ID NO: 2211112 - protein, 18 aa, Cryptosporidium hominis
TCFRILRKLYREGSVSLR

SEQ ID NO: 2211113 - protein, 23 aa, Cryptosporidium hominis
TFFLYIFYLLFGSGILGQIQKDM

SEQ ID NO: 2211114 - protein, 17 aa, Cryptosporidium hominis
TFLYLLCSIFVGSSHSE

SEQ ID NO: 2211115 - protein, 18 aa, Cryptosporidium hominis
TLPTLPLLPPLPPTPKAP

SEQ ID NO: 2211116 - protein, 21 aa, Cryptosporidium hominis
TTFLVLTLSLLAGFVFGTNEN

SEQ ID NO: 2211117 - protein, 18 aa, Cryptosporidium hominis
TVACFVFFFYSKETSAAE

SEQ ID NO: 2211118 - protein, 19 aa, Cryptosporidium hominis
VCVQRGFFAEALLLAVKFG

SEQ ID NO: 2211119 - protein, 17 aa, Cryptosporidium hominis
VDDQFIVIVKKLKQKSN

SEQ ID NO: 2211120 - protein, 18 aa, Cryptosporidium hominis
VIHKSGCKIVPFSTLLSL

SEQ ID NO: 2211121 - protein, 18 aa, Cryptosporidium hominis
VITFLSLSFIINQAYCIR

SEQ ID NO: 2211122 - protein, 17 aa, Cryptosporidium hominis
VIWIYEPGLLLAEELVS

SEQ ID NO: 2211123 - protein, 25 aa, Cryptosporidium hominis
VKKVKLLLILLSVLVIFEFCLGTDL

SEQ ID NO: 2211124 - protein, 24 aa, Cryptosporidium hominis
VKWYQDYLLQCPPFLDLKDEIFAY

SEQ ID NO: 2211125 - protein, 17 aa, Cryptosporidium hominis
VLFAFLFRAINIFAQNN

SEQ ID NO: 2211126 - protein, 19 aa, Cryptosporidium hominis
VLLLLQLILWITLIQELSI

SEQ ID NO: 2211127 - protein, 17 aa, Cryptosporidium hominis
VLMNPLLNYLSLSLRTK

SEQ ID NO: 2211128 - protein, 20 aa, Cryptosporidium hominis
VPYILKCESPFILDGDKCVE

SEQ ID NO: 2211129 - protein, 18 aa, Cryptosporidium hominis
VSIFYFVLGLILDFGKVS

SEQ ID NO: 2211130 - protein, 18 aa, Cryptosporidium hominis
WFAVILCISLLNGISIWD

SEQ ID NO: 2211131 - protein, 18 aa, Cryptosporidium hominis
WVPIIYPSNVYKVSLEGL

SEQ ID NO: 2211132 - protein, 24 aa, Cryptosporidium hominis
YENTFKIIFFWGMKDDLVPFAPAL

SEQ ID NO: 2211133 - protein, 18 aa, Cryptosporidium hominis
YFGFLVYVIGSSVNANDL

SEQ ID NO: 2211134 - protein, 22 aa, Cryptosporidium hominis
YGVFLLTIFNILLILKASENGK

SEQ ID NO: 2211135 - protein, 17 aa, Cryptosporidium hominis
YIIIPLLYLTFNYQSTF

SEQ ID NO: 2211136 - protein, 18 aa, Cryptosporidium hominis
YKKFGGIFWARNIPRVSI

SEQ ID NO: 2211137 - protein, 19 aa, Cryptosporidium hominis
YLKTQLYFMMLINLNYQTS

SEQ ID NO: 2211138 - protein, 17 aa, Cryptosporidium hominis
YMEKFRFLYIISEPSLD

SEQ ID NO: 2211139 - protein, 23 aa, Cryptosporidium hominis
YNNLLLSILLKLSFYIQYIVYFP

SEQ ID NO: 2211140 - protein, 18 aa, Cryptosporidium hominis
YSPLLPRWARDQTKDPFI

SEQ ID NO: 2211141 - protein, 25 aa, Cryptosporidium hominis
YSSDFIPRIYLLSRSIPKENFYRVP

SEQ ID NO: 2211142 - protein, 25 aa, Cryptosporidium hominis
YTVFERQWFFLDSWYGGLGTAARKV

SEQ ID NO: 2211143 - protein, 5 aa, Cryptosporidium parvum
GFGGT

SEQ ID NO: 2211144 - protein, 4 aa, Cryptosporidium parvum
ENSE

SEQ ID NO: 2211145 - protein, 4 aa, Cryptosporidium parvum
ISSN

SEQ ID NO: 2211146 - protein, 6 aa, Cryptosporidium parvum
KTGTLT

SEQ ID NO: 2211147 - protein, 4 aa, Cryptosporidium parvum
SKKI

SEQ ID NO: 2211148 - protein, 4 aa, Cryptosporidium parvum
ANIP

SEQ ID NO: 2211149 - protein, 4 aa, Cryptosporidium parvum
AQET

SEQ ID NO: 2211150 - protein, 4 aa, Cryptosporidium parvum
ATSA

SEQ ID NO: 2211151 - protein, 4 aa, Cryptosporidium parvum
DGNN

SEQ ID NO: 2211152 - protein, 4 aa, Cryptosporidium parvum
DGRS

SEQ ID NO: 2211153 - protein, 4 aa, Cryptosporidium parvum
DITS

SEQ ID NO: 2211154 - protein, 4 aa, Cryptosporidium parvum
DPNI

SEQ ID NO: 2211155 - protein, 6 aa, Cryptosporidium parvum
DRPGSL

SEQ ID NO: 2211156 - protein, 7 aa, Cryptosporidium parvum
DSSRTNQ

SEQ ID NO: 2211157 - protein, 5 aa, Cryptosporidium parvum
ECSAG

SEQ ID NO: 2211158 - protein, 4 aa, Cryptosporidium parvum
EDNS

SEQ ID NO: 2211159 - protein, 4 aa, Cryptosporidium parvum
EEHE

SEQ ID NO: 2211160 - protein, 4 aa, Cryptosporidium parvum
EEVN

SEQ ID NO: 2211161 - protein, 4 aa, Cryptosporidium parvum
EKSI

SEQ ID NO: 2211162 - protein, 4 aa, Cryptosporidium parvum
ENDI

SEQ ID NO: 2211163 - protein, 4 aa, Cryptosporidium parvum
ERRT

SEQ ID NO: 2211164 - protein, 4 aa, Cryptosporidium parvum
ESIS

SEQ ID NO: 2211165 - protein, 4 aa, Cryptosporidium parvum
EYPG

SEQ ID NO: 2211166 - protein, 5 aa, Cryptosporidium parvum
EYSSN

SEQ ID NO: 2211167 - protein, 4 aa, Cryptosporidium parvum
FPAD

SEQ ID NO: 2211168 - protein, 4 aa, Cryptosporidium parvum
GEKN

SEQ ID NO: 2211169 - protein, 4 aa, Cryptosporidium parvum
GPRL

SEQ ID NO: 2211170 - protein, 5 aa, Cryptosporidium parvum
GQSLP

SEQ ID NO: 2211171 - protein, 4 aa, Cryptosporidium parvum
GTLT

SEQ ID NO: 2211172 - protein, 4 aa, Cryptosporidium parvum
GTSK

SEQ ID NO: 2211173 - protein, 4 aa, Cryptosporidium parvum
GVNK

SEQ ID NO: 2211174 - protein, 4 aa, Cryptosporidium parvum
IGGA

SEQ ID NO: 2211175 - protein, 4 aa, Cryptosporidium parvum
INSK

SEQ ID NO: 2211176 - protein, 14 aa, Cryptosporidium parvum
ITQPKPKPKPKQIV

SEQ ID NO: 2211177 - protein, 4 aa, Cryptosporidium parvum
IVSP

SEQ ID NO: 2211178 - protein, 4 aa, Cryptosporidium parvum
KDEL

SEQ ID NO: 2211179 - protein, 4 aa, Cryptosporidium parvum
KEEK

SEQ ID NO: 2211180 - protein, 7 aa, Cryptosporidium parvum
KEQEELR

SEQ ID NO: 2211181 - protein, 4 aa, Cryptosporidium parvum
KGKG

SEQ ID NO: 2211182 - protein, 5 aa, Cryptosporidium parvum
KISQI

SEQ ID NO: 2211183 - protein, 4 aa, Cryptosporidium parvum
KKVS

SEQ ID NO: 2211184 - protein, 4 aa, Cryptosporidium parvum
LEEN

SEQ ID NO: 2211185 - protein, 5 aa, Cryptosporidium parvum
LKTSL

SEQ ID NO: 2211186 - protein, 9 aa, Cryptosporidium parvum
LNNVSDEKV

SEQ ID NO: 2211187 - protein, 4 aa, Cryptosporidium parvum
LSER

SEQ ID NO: 2211188 - protein, 4 aa, Cryptosporidium parvum
NEFP

SEQ ID NO: 2211189 - protein, 5 aa, Cryptosporidium parvum
NFNKS

SEQ ID NO: 2211190 - protein, 4 aa, Cryptosporidium parvum
NIDS

SEQ ID NO: 2211191 - protein, 4 aa, Cryptosporidium parvum
NIED

SEQ ID NO: 2211192 - protein, 5 aa, Cryptosporidium parvum
NIKNK

SEQ ID NO: 2211193 - protein, 5 aa, Cryptosporidium parvum
NKTGT

SEQ ID NO: 2211194 - protein, 5 aa, Cryptosporidium parvum
NKTKK

SEQ ID NO: 2211195 - protein, 4 aa, Cryptosporidium parvum
NLPV

SEQ ID NO: 2211196 - protein, 4 aa, Cryptosporidium parvum
NNEA

SEQ ID NO: 2211197 - protein, 4 aa, Cryptosporidium parvum
NPIN

SEQ ID NO: 2211198 - protein, 4 aa, Cryptosporidium parvum
NPKF

SEQ ID NO: 2211199 - protein, 4 aa, Cryptosporidium parvum
NPNN

SEQ ID NO: 2211200 - protein, 4 aa, Cryptosporidium parvum
NSNN

SEQ ID NO: 2211201 - protein, 4 aa, Cryptosporidium parvum
NSPY

SEQ ID NO: 2211202 - protein, 4 aa, Cryptosporidium parvum
NTRS

SEQ ID NO: 2211203 - protein, 14 aa, Cryptosporidium parvum
PGYGSRPGSTRGPT

SEQ ID NO: 2211204 - protein, 4 aa, Cryptosporidium parvum
PSDI

SEQ ID NO: 2211205 - protein, 4 aa, Cryptosporidium parvum
PTGT

SEQ ID NO: 2211206 - protein, 4 aa, Cryptosporidium parvum
RKSN

SEQ ID NO: 2211207 - protein, 4 aa, Cryptosporidium parvum
RSKS

SEQ ID NO: 2211208 - protein, 8 aa, Cryptosporidium parvum
RTGSGKTT

SEQ ID NO: 2211209 - protein, 4 aa, Cryptosporidium parvum
SETF

SEQ ID NO: 2211210 - protein, 4 aa, Cryptosporidium parvum
SETR

SEQ ID NO: 2211211 - protein, 4 aa, Cryptosporidium parvum
SGGV

SEQ ID NO: 2211212 - protein, 5 aa, Cryptosporidium parvum
SGNVN

SEQ ID NO: 2211213 - protein, 4 aa, Cryptosporidium parvum
SITN

SEQ ID NO: 2211214 - protein, 4 aa, Cryptosporidium parvum
SLSE

SEQ ID NO: 2211215 - protein, 6 aa, Cryptosporidium parvum
SNNEFS

SEQ ID NO: 2211216 - protein, 4 aa, Cryptosporidium parvum
SPIS

SEQ ID NO: 2211217 - protein, 5 aa, Cryptosporidium parvum
SQLTP

SEQ ID NO: 2211218 - protein, 4 aa, Cryptosporidium parvum
SSIS

SEQ ID NO: 2211219 - protein, 4 aa, Cryptosporidium parvum
SSSF

SEQ ID NO: 2211220 - protein, 4 aa, Cryptosporidium parvum
SSSQ

SEQ ID NO: 2211221 - protein, 4 aa, Cryptosporidium parvum
STST

SEQ ID NO: 2211222 - protein, 13 aa, Cryptosporidium parvum
STTSSLENGNSSV

SEQ ID NO: 2211223 - protein, 4 aa, Cryptosporidium parvum
SYPI

SEQ ID NO: 2211224 - protein, 4 aa, Cryptosporidium parvum
TDES

SEQ ID NO: 2211225 - protein, 7 aa, Cryptosporidium parvum
TIPESQG

SEQ ID NO: 2211226 - protein, 7 aa, Cryptosporidium parvum
TPIQNGN

SEQ ID NO: 2211227 - protein, 10 aa, Cryptosporidium parvum
TQTAPKQQPK

SEQ ID NO: 2211228 - protein, 4 aa, Cryptosporidium parvum
TSIP

SEQ ID NO: 2211229 - protein, 5 aa, Cryptosporidium parvum
TTRST

SEQ ID NO: 2211230 - protein, 7 aa, Cryptosporidium parvum
VPQPRQT

SEQ ID NO: 2211231 - protein, 4 aa, Cryptosporidium parvum
YNQE

SEQ ID NO: 2211232 - protein, 4 aa, Cryptosporidium parvum
YSSN

SEQ ID NO: 2211233 - protein, 10 aa, Cryptosporidium parvum
AAAEVDSEMS

SEQ ID NO: 2211234 - protein, 7 aa, Cryptosporidium parvum
AAANNEW

SEQ ID NO: 2211235 - protein, 20 aa, Cryptosporidium parvum
AAASGGSLAGSQGRSGGELS

SEQ ID NO: 2211236 - protein, 7 aa, Cryptosporidium parvum
AAASRPI

SEQ ID NO: 2211237 - protein, 9 aa, Cryptosporidium parvum
AAASYSSKI

SEQ ID NO: 2211238 - protein, 8 aa, Cryptosporidium parvum
AADGKHAR

SEQ ID NO: 2211239 - protein, 43 aa, Cryptosporidium parvum
AADISKEDVEAQTSTSSYASQEVSSEAKQQACRPKLNRKQEKL

SEQ ID NO: 2211240 - protein, 10 aa, Cryptosporidium parvum
AADPKYTISG

SEQ ID NO: 2211241 - protein, 10 aa, Cryptosporidium parvum
AADRDPEGMT

SEQ ID NO: 2211242 - protein, 9 aa, Cryptosporidium parvum
AAEAAQTRE

SEQ ID NO: 2211243 - protein, 16 aa, Cryptosporidium parvum
AAEAPDDNSSDDLSQE

SEQ ID NO: 2211244 - protein, 7 aa, Cryptosporidium parvum
AAEETTR

SEQ ID NO: 2211245 - protein, 11 aa, Cryptosporidium parvum
AAEGGEGSNFE

SEQ ID NO: 2211246 - protein, 5 aa, Cryptosporidium parvum
AAELQ

SEQ ID NO: 2211247 - protein, 6 aa, Cryptosporidium parvum
AAENKT

SEQ ID NO: 2211248 - protein, 19 aa, Cryptosporidium parvum
AAESNSSQKEQKKHAGKAQ

SEQ ID NO: 2211249 - protein, 7 aa, Cryptosporidium parvum
AAETTCE

SEQ ID NO: 2211250 - protein, 7 aa, Cryptosporidium parvum
AAEYKSN

SEQ ID NO: 2211251 - protein, 8 aa, Cryptosporidium parvum
AAGGASAA

SEQ ID NO: 2211252 - protein, 4 aa, Cryptosporidium parvum
AAGN

SEQ ID NO: 2211253 - protein, 5 aa, Cryptosporidium parvum
AAGST

SEQ ID NO: 2211254 - protein, 4 aa, Cryptosporidium parvum
AAKT

SEQ ID NO: 2211255 - protein, 10 aa, Cryptosporidium parvum
AALDPQSKIS

SEQ ID NO: 2211256 - protein, 9 aa, Cryptosporidium parvum
AALGRRGQA

SEQ ID NO: 2211257 - protein, 20 aa, Cryptosporidium parvum
AALSGNNESESSSEGFRSDN

SEQ ID NO: 2211258 - protein, 7 aa, Cryptosporidium parvum
AAMDARQ

SEQ ID NO: 2211259 - protein, 7 aa, Cryptosporidium parvum
AAMGKTG

SEQ ID NO: 2211260 - protein, 5 aa, Cryptosporidium parvum
AANAA

SEQ ID NO: 2211261 - protein, 5 aa, Cryptosporidium parvum
AANAD

SEQ ID NO: 2211262 - protein, 6 aa, Cryptosporidium parvum
AANRIL

SEQ ID NO: 2211263 - protein, 4 aa, Cryptosporidium parvum
AANS

SEQ ID NO: 2211264 - protein, 10 aa, Cryptosporidium parvum
AANSSSNSVN

SEQ ID NO: 2211265 - protein, 36 aa, Cryptosporidium parvum
AAPAQGESASARAPTDTGSTPSSNTNVSEAYRTSSN

SEQ ID NO: 2211266 - protein, 7 aa, Cryptosporidium parvum
AAPSLGT

SEQ ID NO: 2211267 - protein, 10 aa, Cryptosporidium parvum
AAQLGREAKA

SEQ ID NO: 2211268 - protein, 7 aa, Cryptosporidium parvum
AAQQQPS

SEQ ID NO: 2211269 - protein, 6 aa, Cryptosporidium parvum
AAQTDD

SEQ ID NO: 2211270 - protein, 13 aa, Cryptosporidium parvum
AASGDSGSKNTSV

SEQ ID NO: 2211271 - protein, 6 aa, Cryptosporidium parvum
AASHSS

SEQ ID NO: 2211272 - protein, 6 aa, Cryptosporidium parvum
AASIEN

SEQ ID NO: 2211273 - protein, 7 aa, Cryptosporidium parvum
AASSQEG

SEQ ID NO: 2211274 - protein, 8 aa, Cryptosporidium parvum
AASSSSMI

SEQ ID NO: 2211275 - protein, 6 aa, Cryptosporidium parvum
AASVGD

SEQ ID NO: 2211276 - protein, 9 aa, Cryptosporidium parvum
AATANTGIQ

SEQ ID NO: 2211277 - protein, 4 aa, Cryptosporidium parvum
AAYE

SEQ ID NO: 2211278 - protein, 9 aa, Cryptosporidium parvum
AAYGTAKAG

SEQ ID NO: 2211279 - protein, 5 aa, Cryptosporidium parvum
AAYKG

SEQ ID NO: 2211280 - protein, 5 aa, Cryptosporidium parvum
ACETT

SEQ ID NO: 2211281 - protein, 12 aa, Cryptosporidium parvum
ACQNGQMNDVGA

SEQ ID NO: 2211282 - protein, 7 aa, Cryptosporidium parvum
ACTGPNE

SEQ ID NO: 2211283 - protein, 5 aa, Cryptosporidium parvum
ADASY

SEQ ID NO: 2211284 - protein, 9 aa, Cryptosporidium parvum
ADDNDKDLW

SEQ ID NO: 2211285 - protein, 4 aa, Cryptosporidium parvum
ADDY

SEQ ID NO: 2211286 - protein, 16 aa, Cryptosporidium parvum
ADEEPNPETCSPNPQK

SEQ ID NO: 2211287 - protein, 6 aa, Cryptosporidium parvum
ADFDGD

SEQ ID NO: 2211288 - protein, 6 aa, Cryptosporidium parvum
ADGATK

SEQ ID NO: 2211289 - protein, 6 aa, Cryptosporidium parvum
ADGNHS

SEQ ID NO: 2211290 - protein, 7 aa, Cryptosporidium parvum
ADGNIED

SEQ ID NO: 2211291 - protein, 6 aa, Cryptosporidium parvum
ADHGRP

SEQ ID NO: 2211292 - protein, 7 aa, Cryptosporidium parvum
ADIANTE

SEQ ID NO: 2211293 - protein, 4 aa, Cryptosporidium parvum
ADIP

SEQ ID NO: 2211294 - protein, 5 aa, Cryptosporidium parvum
ADKGY

SEQ ID NO: 2211295 - protein, 12 aa, Cryptosporidium parvum
ADKTNNNINSNS

SEQ ID NO: 2211296 - protein, 11 aa, Cryptosporidium parvum
ADLAPGSSEMN

SEQ ID NO: 2211297 - protein, 6 aa, Cryptosporidium parvum
ADLNGE

SEQ ID NO: 2211298 - protein, 13 aa, Cryptosporidium parvum
ADLSPSKPEHMPT

SEQ ID NO: 2211299 - protein, 15 aa, Cryptosporidium parvum
ADNDKKNESNSGNNC

SEQ ID NO: 2211300 - protein, 14 aa, Cryptosporidium parvum
ADNKRTLKGTSKKF

SEQ ID NO: 2211301 - protein, 13 aa, Cryptosporidium parvum
ADNSNESSSIGSS

SEQ ID NO: 2211302 - protein, 47 aa, Cryptosporidium parvum
ADNTENTQIQKNVQDANNSPSDSKNENQDNNSDNKNSSSRYSNSQPT

SEQ ID NO: 2211303 - protein, 6 aa, Cryptosporidium parvum
ADNYGN

SEQ ID NO: 2211304 - protein, 7 aa, Cryptosporidium parvum
ADPAWSA

SEQ ID NO: 2211305 - protein, 5 aa, Cryptosporidium parvum
ADPER

SEQ ID NO: 2211306 - protein, 5 aa, Cryptosporidium parvum
ADPKD

SEQ ID NO: 2211307 - protein, 13 aa, Cryptosporidium parvum
ADPNEKDKYRRTP

SEQ ID NO: 2211308 - protein, 8 aa, Cryptosporidium parvum
ADPNTRTD

SEQ ID NO: 2211309 - protein, 8 aa, Cryptosporidium parvum
ADPPKSLQ

SEQ ID NO: 2211310 - protein, 10 aa, Cryptosporidium parvum
ADQNEPQQRQ

SEQ ID NO: 2211311 - protein, 4 aa, Cryptosporidium parvum
ADRT

SEQ ID NO: 2211312 - protein, 9 aa, Cryptosporidium parvum
ADSGQVVAN

SEQ ID NO: 2211313 - protein, 4 aa, Cryptosporidium parvum
ADSI

SEQ ID NO: 2211314 - protein, 11 aa, Cryptosporidium parvum
ADSKDQSSCNE

SEQ ID NO: 2211315 - protein, 8 aa, Cryptosporidium parvum
ADSSSASG

SEQ ID NO: 2211316 - protein, 9 aa, Cryptosporidium parvum
ADTASGWGG

SEQ ID NO: 2211317 - protein, 12 aa, Cryptosporidium parvum
ADTDFDNDKPQK

SEQ ID NO: 2211318 - protein, 7 aa, Cryptosporidium parvum
ADTNGDG

SEQ ID NO: 2211319 - protein, 19 aa, Cryptosporidium parvum
ADTRASSDKNSKTSESCSC

SEQ ID NO: 2211320 - protein, 8 aa, Cryptosporidium parvum
ADWDNGNA

SEQ ID NO: 2211321 - protein, 7 aa, Cryptosporidium parvum
AEDGGDC

SEQ ID NO: 2211322 - protein, 5 aa, Cryptosporidium parvum
AEEDA

SEQ ID NO: 2211323 - protein, 5 aa, Cryptosporidium parvum
AEESL

SEQ ID NO: 2211324 - protein, 5 aa, Cryptosporidium parvum
AEESY

SEQ ID NO: 2211325 - protein, 8 aa, Cryptosporidium parvum
AEFNESQK

SEQ ID NO: 2211326 - protein, 12 aa, Cryptosporidium parvum
AEFNNEKDSKEL

SEQ ID NO: 2211327 - protein, 13 aa, Cryptosporidium parvum
AEFQQDRDIEQES

SEQ ID NO: 2211328 - protein, 17 aa, Cryptosporidium parvum
AEGSNISKSLEKNTNTE

SEQ ID NO: 2211329 - protein, 12 aa, Cryptosporidium parvum
AEGSYTDSESRI

SEQ ID NO: 2211330 - protein, 16 aa, Cryptosporidium parvum
AEGTHQEEIENGMTKY

SEQ ID NO: 2211331 - protein, 4 aa, Cryptosporidium parvum
AEHT

SEQ ID NO: 2211332 - protein, 8 aa, Cryptosporidium parvum
AEISSEIS

SEQ ID NO: 2211333 - protein, 8 aa, Cryptosporidium parvum
AEKDFEED

SEQ ID NO: 2211334 - protein, 9 aa, Cryptosporidium parvum
AEKEAENKR

SEQ ID NO: 2211335 - protein, 4 aa, Cryptosporidium parvum
AEKG

SEQ ID NO: 2211336 - protein, 6 aa, Cryptosporidium parvum
AEKRCK

SEQ ID NO: 2211337 - protein, 9 aa, Cryptosporidium parvum
AEKSRAGIS

SEQ ID NO: 2211338 - protein, 5 aa, Cryptosporidium parvum
AEKTI

SEQ ID NO: 2211339 - protein, 4 aa, Cryptosporidium parvum
AELA

SEQ ID NO: 2211340 - protein, 11 aa, Cryptosporidium parvum
AELERSNRSGF

SEQ ID NO: 2211341 - protein, 5 aa, Cryptosporidium parvum
AELTN

SEQ ID NO: 2211342 - protein, 6 aa, Cryptosporidium parvum
AENDEV

SEQ ID NO: 2211343 - protein, 8 aa, Cryptosporidium parvum
AENDINEK

SEQ ID NO: 2211344 - protein, 4 aa, Cryptosporidium parvum
AENE

SEQ ID NO: 2211345 - protein, 4 aa, Cryptosporidium parvum
AENN

SEQ ID NO: 2211346 - protein, 13 aa, Cryptosporidium parvum
AENPESENREEEA

SEQ ID NO: 2211347 - protein, 4 aa, Cryptosporidium parvum
AENR

SEQ ID NO: 2211348 - protein, 4 aa, Cryptosporidium parvum
AENS

SEQ ID NO: 2211349 - protein, 7 aa, Cryptosporidium parvum
AENTDTV

SEQ ID NO: 2211350 - protein, 24 aa, Cryptosporidium parvum
AENTSNSKKSKKSSKKSENAQNSA

SEQ ID NO: 2211351 - protein, 15 aa, Cryptosporidium parvum
AEPCEGSTTHNNNQE

SEQ ID NO: 2211352 - protein, 6 aa, Cryptosporidium parvum
AEPNIA

SEQ ID NO: 2211353 - protein, 19 aa, Cryptosporidium parvum
AEREGGYLNSKDESQECKG

SEQ ID NO: 2211354 - protein, 48 aa, Cryptosporidium parvum
  misc_feature (16)..(16): Xaa can be any naturally occurring amino acid
AERNGQNRIILNNLRXSAFRRNTSTGGGSSSSRRRSGRGYNRSIRDDL

SEQ ID NO: 2211355 - protein, 6 aa, Cryptosporidium parvum
AERNSR

SEQ ID NO: 2211356 - protein, 8 aa, Cryptosporidium parvum
AESHGFNQ

SEQ ID NO: 2211357 - protein, 9 aa, Cryptosporidium parvum
AESKPTVTG

SEQ ID NO: 2211358 - protein, 11 aa, Cryptosporidium parvum
AESQDYPKNEN

SEQ ID NO: 2211359 - protein, 5 aa, Cryptosporidium parvum
AESVE

SEQ ID NO: 2211360 - protein, 4 aa, Cryptosporidium parvum
AESY

SEQ ID NO: 2211361 - protein, 6 aa, Cryptosporidium parvum
AETAYI

SEQ ID NO: 2211362 - protein, 11 aa, Cryptosporidium parvum
AETEVKYSDET

SEQ ID NO: 2211363 - protein, 8 aa, Cryptosporidium parvum
AETQYNNE

SEQ ID NO: 2211364 - protein, 6 aa, Cryptosporidium parvum
AETSEK

SEQ ID NO: 2211365 - protein, 18 aa, Cryptosporidium parvum
AEYEEEEEEEGDEAANET

SEQ ID NO: 2211366 - protein, 5 aa, Cryptosporidium parvum
AEYNS

SEQ ID NO: 2211367 - protein, 6 aa, Cryptosporidium parvum
AEYRPP

SEQ ID NO: 2211368 - protein, 9 aa, Cryptosporidium parvum
AEYSESELD

SEQ ID NO: 2211369 - protein, 6 aa, Cryptosporidium parvum
AFASPD

SEQ ID NO: 2211370 - protein, 11 aa, Cryptosporidium parvum
AFDSGKTYSPA

SEQ ID NO: 2211371 - protein, 4 aa, Cryptosporidium parvum
AFGQ

SEQ ID NO: 2211372 - protein, 6 aa, Cryptosporidium parvum
AFGRNE

SEQ ID NO: 2211373 - protein, 10 aa, Cryptosporidium parvum
AFQQSTTGIL

SEQ ID NO: 2211374 - protein, 6 aa, Cryptosporidium parvum
AFSNGN

SEQ ID NO: 2211375 - protein, 5 aa, Cryptosporidium parvum
AFSSQ

SEQ ID NO: 2211376 - protein, 8 aa, Cryptosporidium parvum
AFSTSGQL

SEQ ID NO: 2211377 - protein, 5 aa, Cryptosporidium parvum
AFYSN

SEQ ID NO: 2211378 - protein, 6 aa, Cryptosporidium parvum
AGATGF

SEQ ID NO: 2211379 - protein, 6 aa, Cryptosporidium parvum
AGCAPW

SEQ ID NO: 2211380 - protein, 5 aa, Cryptosporidium parvum
AGCNR

SEQ ID NO: 2211381 - protein, 6 aa, Cryptosporidium parvum
AGEAAA

SEQ ID NO: 2211382 - protein, 4 aa, Cryptosporidium parvum
AGED

SEQ ID NO: 2211383 - protein, 9 aa, Cryptosporidium parvum
AGENSSTLI

SEQ ID NO: 2211384 - protein, 8 aa, Cryptosporidium parvum
AGGIARDV

SEQ ID NO: 2211385 - protein, 8 aa, Cryptosporidium parvum
AGGKEAQT

SEQ ID NO: 2211386 - protein, 5 aa, Cryptosporidium parvum
AGGPS

SEQ ID NO: 2211387 - protein, 8 aa, Cryptosporidium parvum
AGGSGGEY

SEQ ID NO: 2211388 - protein, 8 aa, Cryptosporidium parvum
AGGSISDN

SEQ ID NO: 2211389 - protein, 9 aa, Cryptosporidium parvum
AGIGESDSD

SEQ ID NO: 2211390 - protein, 11 aa, Cryptosporidium parvum
AGKENDSESEL

SEQ ID NO: 2211391 - protein, 5 aa, Cryptosporidium parvum
AGKFN

SEQ ID NO: 2211392 - protein, 11 aa, Cryptosporidium parvum
AGKNTEEGDSK

SEQ ID NO: 2211393 - protein, 19 aa, Cryptosporidium parvum
AGKQSNSQEIDNNKSEEEI

SEQ ID NO: 2211394 - protein, 9 aa, Cryptosporidium parvum
AGKYEPRSK

SEQ ID NO: 2211395 - protein, 12 aa, Cryptosporidium parvum
AGLNNKETLRSN

SEQ ID NO: 2211396 - protein, 10 aa, Cryptosporidium parvum
AGNLSSYPNG

SEQ ID NO: 2211397 - protein, 8 aa, Cryptosporidium parvum
AGNSDIST

SEQ ID NO: 2211398 - protein, 5 aa, Cryptosporidium parvum
AGNYK

SEQ ID NO: 2211399 - protein, 6 aa, Cryptosporidium parvum
AGPDYD

SEQ ID NO: 2211400 - protein, 6 aa, Cryptosporidium parvum
AGQDVG

SEQ ID NO: 2211401 - protein, 9 aa, Cryptosporidium parvum
AGQPSQKNH

SEQ ID NO: 2211402 - protein, 6 aa, Cryptosporidium parvum
AGRKCG

SEQ ID NO: 2211403 - protein, 7 aa, Cryptosporidium parvum
AGSCPKD

SEQ ID NO: 2211404 - protein, 9 aa, Cryptosporidium parvum
AGSEYTQNI

SEQ ID NO: 2211405 - protein, 9 aa, Cryptosporidium parvum
AGSGSNDNA

SEQ ID NO: 2211406 - protein, 7 aa, Cryptosporidium parvum
AGSPKSL

SEQ ID NO: 2211407 - protein, 5 aa, Cryptosporidium parvum
AGSPL

SEQ ID NO: 2211408 - protein, 6 aa, Cryptosporidium parvum
AGSSAF

SEQ ID NO: 2211409 - protein, 20 aa, Cryptosporidium parvum
AGSSSKSSGTRQGGTCSTTC

SEQ ID NO: 2211410 - protein, 8 aa, Cryptosporidium parvum
AGTKYNPE

SEQ ID NO: 2211411 - protein, 9 aa, Cryptosporidium parvum
AGTNNSRTA

SEQ ID NO: 2211412 - protein, 6 aa, Cryptosporidium parvum
AGTPAN

SEQ ID NO: 2211413 - protein, 7 aa, Cryptosporidium parvum
AGTPQIR

SEQ ID NO: 2211414 - protein, 13 aa, Cryptosporidium parvum
AGTRTYDERRDES

SEQ ID NO: 2211415 - protein, 57 aa, Cryptosporidium parvum; identical to SEQ ID NO: 2111258

SEQ ID NO: 2211416 - protein, 11 aa, Cryptosporidium parvum
AHESDTNKLDR

SEQ ID NO: 2211417 - protein, 16 aa, Cryptosporidium parvum
AHQKSGSFASSNTKRR

SEQ ID NO: 2211418 - protein, 6 aa, Cryptosporidium parvum
AHSKEI

SEQ ID NO: 2211419 - protein, 14 aa, Cryptosporidium parvum
AIDTGSSVSTAPSS

SEQ ID NO: 2211420 - protein, 4 aa, Cryptosporidium parvum
AIGR

SEQ ID NO: 2211421 - protein, 4 aa, Cryptosporidium parvum
AIKG

SEQ ID NO: 2211422 - protein, 10 aa, Cryptosporidium parvum
AIKNNSFGYP

SEQ ID NO: 2211423 - protein, 7 aa, Cryptosporidium parvum
AIPDTRQ

SEQ ID NO: 2211424 - protein, 8 aa, Cryptosporidium parvum
AIPPPERE

SEQ ID NO: 2211425 - protein, 7 aa, Cryptosporidium parvum
AIPSNCS

SEQ ID NO: 2211426 - protein, 12 aa, Cryptosporidium parvum
AIPYPEPQGSVR

SEQ ID NO: 2211427 - protein, 5 aa, Cryptosporidium parvum
AISGS

SEQ ID NO: 2211428 - protein, 11 aa, Cryptosporidium parvum
AISGTNSNLDS

SEQ ID NO: 2211429 - protein, 6 aa, Cryptosporidium parvum
AISSSN

SEQ ID NO: 2211430 - protein, 6 aa, Cryptosporidium parvum
AITEEK

SEQ ID NO: 2211431 - protein, 5 aa, Cryptosporidium parvum
AITTG

SEQ ID NO: 2211432 - protein, 6 aa, Cryptosporidium parvum
AIYSSI

SEQ ID NO: 2211433 - protein, 19 aa, Cryptosporidium parvum
AKAEAEVETETETESETIA

SEQ ID NO: 2211434 - protein, 7 aa, Cryptosporidium parvum
AKANVTD

SEQ ID NO: 2211435 - protein, 7 aa, Cryptosporidium parvum
AKATPIT

SEQ ID NO: 2211436 - protein, 8 aa, Cryptosporidium parvum
AKCKAQDN

SEQ ID NO: 2211437 - protein, 13 aa, Cryptosporidium parvum
AKCPGDESFPPSL

SEQ ID NO: 2211438 - protein, 8 aa, Cryptosporidium parvum
AKDDKESS

SEQ ID NO: 2211439 - protein, 5 aa, Cryptosporidium parvum
AKDGG

SEQ ID NO: 2211440 - protein, 8 aa, Cryptosporidium parvum
AKDGRNYI

SEQ ID NO: 2211441 - protein, 6 aa, Cryptosporidium parvum
AKDGTY

SEQ ID NO: 2211442 - protein, 5 aa, Cryptosporidium parvum
AKDHE

SEQ ID NO: 2211443 - protein, 6 aa, Cryptosporidium parvum
AKDMTS

SEQ ID NO: 2211444 - protein, 6 aa, Cryptosporidium parvum
AKDQCE

SEQ ID NO: 2211445 - protein, 17 aa, Cryptosporidium parvum
AKEAEVSGNLNQGDQQA

SEQ ID NO: 2211446 - protein, 18 aa, Cryptosporidium parvum
AKEFKSKNAQGDIARNGM

SEQ ID NO: 2211447 - protein, 5 aa, Cryptosporidium parvum
AKEIG

SEQ ID NO: 2211448 - protein, 5 aa, Cryptosporidium parvum
AKESP

SEQ ID NO: 2211449 - protein, 16 aa, Cryptosporidium parvum
AKGKAALDDTTQKGKK

SEQ ID NO: 2211450 - protein, 12 aa, Cryptosporidium parvum
AKGKENKKEGGG

SEQ ID NO: 2211451 - protein, 7 aa, Cryptosporidium parvum
AKGLYGP

SEQ ID NO: 2211452 - protein, 6 aa, Cryptosporidium parvum
AKIDEY

SEQ ID NO: 2211453 - protein, 8 aa, Cryptosporidium parvum
AKIEGSSN

SEQ ID NO: 2211454 - protein, 4 aa, Cryptosporidium parvum
AKIG

SEQ ID NO: 2211455 - protein, 35 aa, Cryptosporidium parvum
AKIGQSNKYNKIEKASSVSNALENSKESLKKINRT

SEQ ID NO: 2211456 - protein, 6 aa, Cryptosporidium parvum
AKINAK

SEQ ID NO: 2211457 - protein, 8 aa, Cryptosporidium parvum
AKINSEKK

SEQ ID NO: 2211458 - protein, 8 aa, Cryptosporidium parvum
AKKHDYKK

SEQ ID NO: 2211459 - protein, 7 aa, Cryptosporidium parvum
AKKSQKN

SEQ ID NO: 2211460 - protein, 6 aa, Cryptosporidium parvum
AKKSVE

SEQ ID NO: 2211461 - protein, 8 aa, Cryptosporidium parvum
AKLNPTNL

SEQ ID NO: 2211462 - protein, 19 aa, Cryptosporidium parvum
AKNKDSCADNDEEQASTFK

SEQ ID NO: 2211463 - protein, 6 aa, Cryptosporidium parvum
AKNLGA

SEQ ID NO: 2211464 - protein, 9 aa, Cryptosporidium parvum
AKNNKEDFD

SEQ ID NO: 2211465 - protein, 4 aa, Cryptosporidium parvum
AKNS

SEQ ID NO: 2211466 - protein, 12 aa, Cryptosporidium parvum
AKNSSRSSINYS

SEQ ID NO: 2211467 - protein, 7 aa, Cryptosporidium parvum
AKNTQKN

SEQ ID NO: 2211468 - protein, 6 aa, Cryptosporidium parvum
AKNYNI

SEQ ID NO: 2211469 - protein, 17 aa, Cryptosporidium parvum
AKQARKHRREAYEAKQR

SEQ ID NO: 2211470 - protein, 5 aa, Cryptosporidium parvum
AKQCQ

SEQ ID NO: 2211471 - protein, 40 aa, Cryptosporidium parvum; identical to SEQ ID NO: 2111303

SEQ ID NO: 2211472 - protein, 10 aa, Cryptosporidium parvum
AKQTNKNLNK

SEQ ID NO: 2211473 - protein, 22 aa, Cryptosporidium parvum
AKQTPGGSTENKYNTSNATPTP

SEQ ID NO: 2211474 - protein, 7 aa, Cryptosporidium parvum
AKRKEEI

SEQ ID NO: 2211475 - protein, 7 aa, Cryptosporidium parvum
AKRNPKV

SEQ ID NO: 2211476 - protein, 12 aa, Cryptosporidium parvum
AKSEPKESPGMI

SEQ ID NO: 2211477 - protein, 5 aa, Cryptosporidium parvum
AKSFE

SEQ ID NO: 2211478 - protein, 11 aa, Cryptosporidium parvum
AKSFQRTTNHK

SEQ ID NO: 2211479 - protein, 8 aa, Cryptosporidium parvum
AKSGEKDN

SEQ ID NO: 2211480 - protein, 7 aa, Cryptosporidium parvum
AKSGSNG

SEQ ID NO: 2211481 - protein, 17 aa, Cryptosporidium parvum
AKSKSNEETSRDPNTNF

SEQ ID NO: 2211482 - protein, 5 aa, Cryptosporidium parvum
AKSMG

SEQ ID NO: 2211483 - protein, 8 aa, Cryptosporidium parvum
AKSNCPEG

SEQ ID NO: 2211484 - protein, 8 aa, Cryptosporidium parvum
AKSNQNGG

SEQ ID NO: 2211485 - protein, 15 aa, Cryptosporidium parvum
AKSQPSVDSSARGSL

SEQ ID NO: 2211486 - protein, 8 aa, Cryptosporidium parvum
AKSTSKSL

SEQ ID NO: 2211487 - protein, 4 aa, Cryptosporidium parvum
AKSY

SEQ ID NO: 2211488 - protein, 6 aa, Cryptosporidium parvum
AKTERL

SEQ ID NO: 2211489 - protein, 37 aa, Cryptosporidium parvum
AKTNKGNLSQIPNSNYTSDNNNNYHNNSNNHYNHPPS

SEQ ID NO: 2211490 - protein, 4 aa, Cryptosporidium parvum
AKTR

SEQ ID NO: 2211491 - protein, 8 aa, Cryptosporidium parvum
AKTRSSNV

SEQ ID NO: 2211492 - protein, 22 aa, Cryptosporidium parvum
AKTRTKGTGWARKGGGGGGVGK

SEQ ID NO: 2211493 - protein, 4 aa, Cryptosporidium parvum
AKVN

SEQ ID NO: 2211494 - protein, 10 aa, Cryptosporidium parvum
AKYNSSRKHI

SEQ ID NO: 2211495 - protein, 17 aa, Cryptosporidium parvum
AKYQDEAIRNKENKVKK

SEQ ID NO: 2211496 - protein, 12 aa, Cryptosporidium parvum
AKYQSQSNYSGE

SEQ ID NO: 2211497 - protein, 7 aa, Cryptosporidium parvum
ALDMETE

SEQ ID NO: 2211498 - protein, 7 aa, Cryptosporidium parvum
ALDPEDK

SEQ ID NO: 2211499 - protein, 6 aa, Cryptosporidium parvum
ALEESN

SEQ ID NO: 2211500 - protein, 16 aa, Cryptosporidium parvum
ALEQNSLNSNSSLENS

SEQ ID NO: 2211501 - protein, 4 aa, Cryptosporidium parvum
ALES

SEQ ID NO: 2211502 - protein, 10 aa, Cryptosporidium parvum
ALETGNANRI

SEQ ID NO: 2211503 - protein, 5 aa, Cryptosporidium parvum
ALFPS

SEQ ID NO: 2211504 - protein, 4 aa, Cryptosporidium parvum
ALGA

SEQ ID NO: 2211505 - protein, 6 aa, Cryptosporidium parvum
ALGGSK

SEQ ID NO: 2211506 - protein, 5 aa, Cryptosporidium parvum
ALGNN

SEQ ID NO: 2211507 - protein, 4 aa, Cryptosporidium parvum
ALGS

SEQ ID NO: 2211508 - protein, 8 aa, Cryptosporidium parvum
ALKSTNKI

SEQ ID NO: 2211509 - protein, 10 aa, Cryptosporidium parvum
ALNERGEEIT

SEQ ID NO: 2211510 - protein, 5 aa, Cryptosporidium parvum
ALPNT

SEQ ID NO: 2211511 - protein, 8 aa, Cryptosporidium parvum
ALPSQEPR

SEQ ID NO: 2211512 - protein, 9 aa, Cryptosporidium parvum
ALQGQSSEI

SEQ ID NO: 2211513 - protein, 7 aa, Cryptosporidium parvum
ALQPGDI

SEQ ID NO: 2211514 - protein, 7 aa, Cryptosporidium parvum
ALQPYQG

SEQ ID NO: 2211515 - protein, 9 aa, Cryptosporidium parvum
ALRSSSIER

SEQ ID NO: 2211516 - protein, 9 aa, Cryptosporidium parvum
ALSEDNVSN

SEQ ID NO: 2211517 - protein, 25 aa, Cryptosporidium parvum
ALSKEKHKLSATKSISTVFKKKVEI

SEQ ID NO: 2211518 - protein, 7 aa, Cryptosporidium parvum
ALTTDYT

SEQ ID NO: 2211519 - protein, 5 aa, Cryptosporidium parvum
AMQTA

SEQ ID NO: 2211520 - protein, 13 aa, Cryptosporidium parvum
AMRERIRENKKRK

SEQ ID NO: 2211521 - protein, 5 aa, Cryptosporidium parvum
AMRNG

SEQ ID NO: 2211522 - protein, 6 aa, Cryptosporidium parvum
ANAVNA

SEQ ID NO: 2211523 - protein, 6 aa, Cryptosporidium parvum
ANAYRP

SEQ ID NO: 2211524 - protein, 11 aa, Cryptosporidium parvum
ANCDGGSRRRI

SEQ ID NO: 2211525 - protein, 5 aa, Cryptosporidium parvum
ANDDI

SEQ ID NO: 2211526 - protein, 27 aa, Cryptosporidium parvum
ANDNSNVHSTINTSNSCKSERVNSNNR

SEQ ID NO: 2211527 - protein, 20 aa, Cryptosporidium parvum
ANDTAELEDPLATARKETSI

SEQ ID NO: 2211528 - protein, 9 aa, Cryptosporidium parvum
ANEEKKSTI

SEQ ID NO: 2211529 - protein, 6 aa, Cryptosporidium parvum
ANEENW

SEQ ID NO: 2211530 - protein, 10 aa, Cryptosporidium parvum
ANERRANNSK

SEQ ID NO: 2211531 - protein, 13 aa, Cryptosporidium parvum
ANFGNTNGTTENN

SEQ ID NO: 2211532 - protein, 6 aa, Cryptosporidium parvum
ANFGSE

SEQ ID NO: 2211533 - protein, 5 aa, Cryptosporidium parvum
ANFQD

SEQ ID NO: 2211534 - protein, 8 aa, Cryptosporidium parvum
ANGEDVES

SEQ ID NO: 2211535 - protein, 7 aa, Cryptosporidium parvum
ANGNILD

SEQ ID NO: 2211536 - protein, 21 aa, Cryptosporidium parvum
ANGQAGRRSISQERKANKNEK

SEQ ID NO: 2211537 - protein, 8 aa, Cryptosporidium parvum
ANGQTPNL

SEQ ID NO: 2211538 - protein, 9 aa, Cryptosporidium parvum
ANIENERTK

SEQ ID NO: 2211539 - protein, 5 aa, Cryptosporidium parvum
ANIGG

SEQ ID NO: 2211540 - protein, 15 aa, Cryptosporidium parvum
ANISDDDDDNDLNKS

SEQ ID NO: 2211541 - protein, 9 aa, Cryptosporidium parvum
ANKENESDI

SEQ ID NO: 2211542 - protein, 9 aa, Cryptosporidium parvum
ANKKEDFAE

SEQ ID NO: 2211543 - protein, 8 aa, Cryptosporidium parvum
ANKLKNNV

SEQ ID NO: 2211544 - protein, 6 aa, Cryptosporidium parvum
ANKSKN

SEQ ID NO: 2211545 - protein, 30 aa, Cryptosporidium parvum
ANKTNKSATSHSQRTPRNRNRKVPREFRNG

SEQ ID NO: 2211546 - protein, 4 aa, Cryptosporidium parvum
ANLE

SEQ ID NO: 2211547 - protein, 6 aa, Cryptosporidium parvum
ANLENK

SEQ ID NO: 2211548 - protein, 12 aa, Cryptosporidium parvum
ANLQSGNFTSDN

SEQ ID NO: 2211549 - protein, 7 aa, Cryptosporidium parvum
ANLSPSN

SEQ ID NO: 2211550 - protein, 18 aa, Cryptosporidium parvum
ANNEENKVNKDELNSGIN

SEQ ID NO: 2211551 - protein, 20 aa, Cryptosporidium parvum
ANNLAQSSQSINTGNPNSHV

SEQ ID NO: 2211552 - protein, 10 aa, Cryptosporidium parvum
ANNPDLVPNP

SEQ ID NO: 2211553 - protein, 15 aa, Cryptosporidium parvum
ANNSNQNDLSAISSN

SEQ ID NO: 2211554 - protein, 7 aa, Cryptosporidium parvum
ANNSNSH

SEQ ID NO: 2211555 - protein, 6 aa, Cryptosporidium parvum
ANNSQQ

SEQ ID NO: 2211556 - protein, 8 aa, Cryptosporidium parvum
ANNTPPDE

SEQ ID NO: 2211557 - protein, 5 aa, Cryptosporidium parvum
ANNVQ

SEQ ID NO: 2211558 - protein, 32 aa, Cryptosporidium parvum
ANPAGGGGGGIGGTTTNINGNGLKDNGIGGDS

SEQ ID NO: 2211559 - protein, 13 aa, Cryptosporidium parvum
ANPENSEDQGLKE

SEQ ID NO: 2211560 - protein, 6 aa, Cryptosporidium parvum
ANPGGE

SEQ ID NO: 2211561 - protein, 4 aa, Cryptosporidium parvum
ANPK

SEQ ID NO: 2211562 - protein, 12 aa, Cryptosporidium parvum
ANPMTKERQFNA

SEQ ID NO: 2211563 - protein, 4 aa, Cryptosporidium parvum
ANPN

SEQ ID NO: 2211564 - protein, 17 aa, Cryptosporidium parvum
ANPNKYYTGPNSNYYGD

SEQ ID NO: 2211565 - protein, 8 aa, Cryptosporidium parvum
ANPTKEVY

SEQ ID NO: 2211566 - protein, 6 aa, Cryptosporidium parvum
ANQDYN

SEQ ID NO: 2211567 - protein, 28 aa, Cryptosporidium parvum
ANQGHGNNSGEGSGNGGGGAGNSSGGIG

SEQ ID NO: 2211568 - protein, 11 aa, Cryptosporidium parvum
ANRSSNENNLP

SEQ ID NO: 2211569 - protein, 6 aa, Cryptosporidium parvum
ANRTTL

SEQ ID NO: 2211570 - protein, 13 aa, Cryptosporidium parvum
ANSDGNVSNSVET

SEQ ID NO: 2211571 - protein, 9 aa, Cryptosporidium parvum
ANSEKVQKS

SEQ ID NO: 2211572 - protein, 4 aa, Cryptosporidium parvum
ANSG

SEQ ID NO: 2211573 - protein, 9 aa, Cryptosporidium parvum
ANSGTGTKN

SEQ ID NO: 2211574 - protein, 7 aa, Cryptosporidium parvum
ANSINDV

SEQ ID NO: 2211575 - protein, 25 aa, Cryptosporidium parvum
ANSNLSNNSSEAKINHDKDPNNRLK

SEQ ID NO: 2211576 - protein, 4 aa, Cryptosporidium parvum
ANSP

SEQ ID NO: 2211577 - protein, 8 aa, Cryptosporidium parvum
ANSSRNND

SEQ ID NO: 2211578 - protein, 6 aa, Cryptosporidium parvum
ANSVGK

SEQ ID NO: 2211579 - protein, 12 aa, Cryptosporidium parvum
ANTQNISEDPKD

SEQ ID NO: 2211580 - protein, 15 aa, Cryptosporidium parvum
ANTQSNTQSTIRPNK

SEQ ID NO: 2211581 - protein, 15 aa, Cryptosporidium parvum
ANTTNLRSESSAYKK

SEQ ID NO: 2211582 - protein, 13 aa, Cryptosporidium parvum
ANWNPDLSTPKNS

SEQ ID NO: 2211583 - protein, 7 aa, Cryptosporidium parvum
APAPTAL

SEQ ID NO: 2211584 - protein, 8 aa, Cryptosporidium parvum
APDTNPYD

SEQ ID NO: 2211585 - protein, 4 aa, Cryptosporidium parvum
APDW

SEQ ID NO: 2211586 - protein, 11 aa, Cryptosporidium parvum
APEEMKNKTVE

SEQ ID NO: 2211587 - protein, 10 aa, Cryptosporidium parvum
APEGRGPSQP

SEQ ID NO: 2211588 - protein, 9 aa, Cryptosporidium parvum
APEHGKNVP

SEQ ID NO: 2211589 - protein, 11 aa, Cryptosporidium parvum
APEYEKAAKAL

SEQ ID NO: 2211590 - protein, 6 aa, Cryptosporidium parvum
APGGHY

SEQ ID NO: 2211591 - protein, 6 aa, Cryptosporidium parvum
APGIGK

SEQ ID NO: 2211592 - protein, 4 aa, Cryptosporidium parvum
APGQ

SEQ ID NO: 2211593 - protein, 23 aa, Cryptosporidium parvum
APHRGGCGQDKDNYSELGSGGLP

SEQ ID NO: 2211594 - protein, 5 aa, Cryptosporidium parvum
APIES

SEQ ID NO: 2211595 - protein, 4 aa, Cryptosporidium parvum
APIG

SEQ ID NO: 2211596 - protein, 14 aa, Cryptosporidium parvum
APKNGKAVWNGGER

SEQ ID NO: 2211597 - protein, 10 aa, Cryptosporidium parvum
APKRTGYRPV

SEQ ID NO: 2211598 - protein, 9 aa, Cryptosporidium parvum
APKSSPKYK

SEQ ID NO: 2211599 - protein, 4 aa, Cryptosporidium parvum
APLD

SEQ ID NO: 2211600 - protein, 5 aa, Cryptosporidium parvum
APLGT

SEQ ID NO: 2211601 - protein, 6 aa, Cryptosporidium parvum
APLSPQ

SEQ ID NO: 2211602 - protein, 6 aa, Cryptosporidium parvum
APNNEK

SEQ ID NO: 2211603 - protein, 5 aa, Cryptosporidium parvum
APNTK

SEQ ID NO: 2211604 - protein, 8 aa, Cryptosporidium parvum
APPESSIE

SEQ ID NO: 2211605 - protein, 8 aa, Cryptosporidium parvum
APPKEGLQ

SEQ ID NO: 2211606 - protein, 8 aa, Cryptosporidium parvum
APPKTAAQ

SEQ ID NO: 2211607 - protein, 5 aa, Cryptosporidium parvum
APPLS

SEQ ID NO: 2211608 - protein, 7 aa, Cryptosporidium parvum
APPSIPA

SEQ ID NO: 2211609 - protein, 6 aa, Cryptosporidium parvum
APPSSQ

SEQ ID NO: 2211610 - protein, 5 aa, Cryptosporidium parvum
APRSA

SEQ ID NO: 2211611 - protein, 11 aa, Cryptosporidium parvum
APRSSELSTKI

SEQ ID NO: 2211612 - protein, 12 aa, Cryptosporidium parvum
APRTNGENKDES

SEQ ID NO: 2211613 - protein, 14 aa, Cryptosporidium parvum
APSCEDSIQNGDEW

SEQ ID NO: 2211614 - protein, 7 aa, Cryptosporidium parvum
APSFTEE

SEQ ID NO: 2211615 - protein, 10 aa, Cryptosporidium parvum
APSIGASANS

SEQ ID NO: 2211616 - protein, 11 aa, Cryptosporidium parvum
APSISSSPNSF

SEQ ID NO: 2211617 - protein, 7 aa, Cryptosporidium parvum
APSQKGN

SEQ ID NO: 2211618 - protein, 6 aa, Cryptosporidium parvum
APTDSK

SEQ ID NO: 2211619 - protein, 12 aa, Cryptosporidium parvum
APTEPNTKLGED

SEQ ID NO: 2211620 - protein, 7 aa, Cryptosporidium parvum
APTESEV

SEQ ID NO: 2211621 - protein, 7 aa, Cryptosporidium parvum
APTFQPR

SEQ ID NO: 2211622 - protein, 10 aa, Cryptosporidium parvum
APTMQDKDGN

SEQ ID NO: 2211623 - protein, 14 aa, Cryptosporidium parvum
APVGEDGQANASKR

SEQ ID NO: 2211624 - protein, 4 aa, Cryptosporidium parvum
APYT

SEQ ID NO: 2211625 - protein, 7 aa, Cryptosporidium parvum
AQAEKTP

SEQ ID NO: 2211626 - protein, 13 aa, Cryptosporidium parvum
AQDSLPPGIPGNT

SEQ ID NO: 2211627 - protein, 5 aa, Cryptosporidium parvum
AQETQ

SEQ ID NO: 2211628 - protein, 4 aa, Cryptosporidium parvum
AQGA

SEQ ID NO: 2211629 - protein, 10 aa, Cryptosporidium parvum
AQHQQESNSF

SEQ ID NO: 2211630 - protein, 30 aa, Cryptosporidium parvum
AQKESSEASKDSNATTTTVKGKKGEYNNGY

SEQ ID NO: 2211631 - protein, 15 aa, Cryptosporidium parvum
AQKNISSLSSQSNHL

SEQ ID NO: 2211632 - protein, 6 aa, Cryptosporidium parvum
AQLNKE

SEQ ID NO: 2211633 - protein, 11 aa, Cryptosporidium parvum
AQNGNSNNPEN

SEQ ID NO: 2211634 - protein, 14 aa, Cryptosporidium parvum
AQNNGESNQKNNYE

SEQ ID NO: 2211635 - protein, 7 aa, Cryptosporidium parvum
AQNPTYG

SEQ ID NO: 2211636 - protein, 5 aa, Cryptosporidium parvum
AQQRL

SEQ ID NO: 2211637 - protein, 7 aa, Cryptosporidium parvum
AQRPNSD

SEQ ID NO: 2211638 - protein, 8 aa, Cryptosporidium parvum
AQRRDKNT

SEQ ID NO: 2211639 - protein, 5 aa, Cryptosporidium parvum
AQRRI

SEQ ID NO: 2211640 - protein, 7 aa, Cryptosporidium parvum
AQSASSA

SEQ ID NO: 2211641 - protein, 13 aa, Cryptosporidium parvum
AQSASSQSIEAQQ

SEQ ID NO: 2211642 - protein, 6 aa, Cryptosporidium parvum
AQSGSR

SEQ ID NO: 2211643 - protein, 4 aa, Cryptosporidium parvum
AQTA

SEQ ID NO: 2211644 - protein, 5 aa, Cryptosporidium parvum
AQTKA

SEQ ID NO: 2211645 - protein, 10 aa, Cryptosporidium parvum
AQTKKNPDIS

SEQ ID NO: 2211646 - protein, 9 aa, Cryptosporidium parvum
ARAEETQNS

SEQ ID NO: 2211647 - protein, 7 aa, Cryptosporidium parvum
ARALSSN

SEQ ID NO: 2211648 - protein, 7 aa, Cryptosporidium parvum
ARDHGPG

SEQ ID NO: 2211649 - protein, 5 aa, Cryptosporidium parvum
ARDLP

SEQ ID NO: 2211650 - protein, 11 aa, Cryptosporidium parvum
AREENKSDIRP

SEQ ID NO: 2211651 - protein, 4 aa, Cryptosporidium parvum
ARER

SEQ ID NO: 2211652 - protein, 34 aa, Cryptosporidium parvum
ARESVSEDPVPEDSKESEMNDREHQSGELSNNGL

SEQ ID NO: 2211653 - protein, 10 aa, Cryptosporidium parvum
ARGNRKGEEH

SEQ ID NO: 2211654 - protein, 13 aa, Cryptosporidium parvum
ARGTASSYSSSDF

SEQ ID NO: 2211655 - protein, 7 aa, Cryptosporidium parvum
ARINTQE

SEQ ID NO: 2211656 - protein, 9 aa, Cryptosporidium parvum
ARKDLNVSN

SEQ ID NO: 2211657 - protein, 7 aa, Cryptosporidium parvum
ARKDNLN

SEQ ID NO: 2211658 - protein, 4 aa, Cryptosporidium parvum
ARKG

SEQ ID NO: 2211659 - protein, 4 aa, Cryptosporidium parvum
ARKN

SEQ ID NO: 2211660 - protein, 7 aa, Cryptosporidium parvum
ARKRKNG

SEQ ID NO: 2211661 - protein, 5 aa, Cryptosporidium parvum
ARKSV

SEQ ID NO: 2211662 - protein, 16 aa, Cryptosporidium parvum
ARNPTMDYEASGEADD

SEQ ID NO: 2211663 - protein, 6 aa, Cryptosporidium parvum
ARNTAT

SEQ ID NO: 2211664 - protein, 21 aa, Cryptosporidium parvum
ARPITNQVKKPKNLSHSGENY

SEQ ID NO: 2211665 - protein, 10 aa, Cryptosporidium parvum
ARPNEKRGEM

SEQ ID NO: 2211666 - protein, 7 aa, Cryptosporidium parvum
ARQEGRE

SEQ ID NO: 2211667 - protein, 6 aa, Cryptosporidium parvum
ARQSIQ

SEQ ID NO: 2211668 - protein, 18 aa, Cryptosporidium parvum
ARRQSYKGNSSGNSVEDK

SEQ ID NO: 2211669 - protein, 10 aa, Cryptosporidium parvum
ARSQNQGSAR

SEQ ID NO: 2211670 - protein, 9 aa, Cryptosporidium parvum
ARTSFEDDS

SEQ ID NO: 2211671 - protein, 13 aa, Cryptosporidium parvum
ASCGGGVKRRQRE

SEQ ID NO: 2211672 - protein, 6 aa, Cryptosporidium parvum
ASDRSS

SEQ ID NO: 2211673 - protein, 14 aa, Cryptosporidium parvum
ASDTRTATREEVES

SEQ ID NO: 2211674 - protein, 15 aa, Cryptosporidium parvum
ASEAASSKIKEDNAI

SEQ ID NO: 2211675 - protein, 6 aa, Cryptosporidium parvum
ASEDEE

SEQ ID NO: 2211676 - protein, 9 aa, Cryptosporidium parvum
ASENGHTGV

SEQ ID NO: 2211677 - protein, 10 aa, Cryptosporidium parvum
ASESSPSHSM

SEQ ID NO: 2211678 - protein, 6 aa, Cryptosporidium parvum
ASESSV

SEQ ID NO: 2211679 - protein, 4 aa, Cryptosporidium parvum
ASGA

SEQ ID NO: 2211680 - protein, 11 aa, Cryptosporidium parvum
ASGGSNSGTPL

SEQ ID NO: 2211681 - protein, 7 aa, Cryptosporidium parvum
ASGLPQE

SEQ ID NO: 2211682 - protein, 7 aa, Cryptosporidium parvum
ASGPNLE

SEQ ID NO: 2211683 - protein, 8 aa, Cryptosporidium parvum
ASGSDNIA

SEQ ID NO: 2211684 - protein, 18 aa, Cryptosporidium parvum
ASGSPSYSSKESERNGLG

SEQ ID NO: 2211685 - protein, 11 aa, Cryptosporidium parvum
ASHYSDLNQKG

SEQ ID NO: 2211686 - protein, 7 aa, Cryptosporidium parvum
ASIATET

SEQ ID NO: 2211687 - protein, 5 aa, Cryptosporidium parvum
ASIKS

SEQ ID NO: 2211688 - protein, 9 aa, Cryptosporidium parvum
ASINSPIDE

SEQ ID NO: 2211689 - protein, 4 aa, Cryptosporidium parvum
ASIR

SEQ ID NO: 2211690 - protein, 4 aa, Cryptosporidium parvum
ASKE

SEQ ID NO: 2211691 - protein, 13 aa, Cryptosporidium parvum
ASKHSSCSSCGNA

SEQ ID NO: 2211692 - protein, 12 aa, Cryptosporidium parvum
ASKNTNKDLNSP

SEQ ID NO: 2211693 - protein, 27 aa, Cryptosporidium parvum
ASKSNSKKSASASPKLALSPKNEDSTQ

SEQ ID NO: 2211694 - protein, 9 aa, Cryptosporidium parvum
ASKYKNYTV

SEQ ID NO: 2211695 - protein, 5 aa, Cryptosporidium parvum
ASLAR

SEQ ID NO: 2211696 - protein, 10 aa, Cryptosporidium parvum
ASLEGSTKTR

SEQ ID NO: 2211697 - protein, 18 aa, Cryptosporidium parvum
ASMADSTTGTNGQNPGEL

SEQ ID NO: 2211698 - protein, 27 aa, Cryptosporidium parvum
ASMEDGDLSNSGEDKKKSTGDSQLESN

SEQ ID NO: 2211699 - protein, 12 aa, Cryptosporidium parvum
ASMSSNNSTTNL

SEQ ID NO: 2211700 - protein, 6 aa, Cryptosporidium parvum
ASNATV

SEQ ID NO: 2211701 - protein, 29 aa, Cryptosporidium parvum
ASNAYPQTVKNGISSSNHLPEKKPTLPSS

SEQ ID NO: 2211702 - protein, 9 aa, Cryptosporidium parvum
ASNEDKISD

SEQ ID NO: 2211703 - protein, 7 aa, Cryptosporidium parvum
ASNEFNQ

SEQ ID NO: 2211704 - protein, 4 aa, Cryptosporidium parvum
ASNG

SEQ ID NO: 2211705 - protein, 6 aa, Cryptosporidium parvum
ASNGRT

SEQ ID NO: 2211706 - protein, 8 aa, Cryptosporidium parvum
ASNIKRRK

SEQ ID NO: 2211707 - protein, 6 aa, Cryptosporidium parvum
ASNIQI

SEQ ID NO: 2211708 - protein, 7 aa, Cryptosporidium parvum
ASNISKN

SEQ ID NO: 2211709 - protein, 6 aa, Cryptosporidium parvum
ASNPIS

SEQ ID NO: 2211710 - protein, 15 aa, Cryptosporidium parvum
ASNSSLQDGFENDSH

SEQ ID NO: 2211711 - protein, 8 aa, Cryptosporidium parvum
ASNTAGEA

SEQ ID NO: 2211712 - protein, 8 aa, Cryptosporidium parvum
ASNYGNEG

SEQ ID NO: 2211713 - protein, 13 aa, Cryptosporidium parvum
ASPASNNQRRSSL

SEQ ID NO: 2211714 - protein, 7 aa, Cryptosporidium parvum
ASPEDEA

SEQ ID NO: 2211715 - protein, 10 aa, Cryptosporidium parvum
ASPEDTGIDY

SEQ ID NO: 2211716 - protein, 23 aa, Cryptosporidium parvum
ASPKDLKKNKEFRSKYKNTEIGQ

SEQ ID NO: 2211717 - protein, 9 aa, Cryptosporidium parvum
ASPMGGDPK

SEQ ID NO: 2211718 - protein, 6 aa, Cryptosporidium parvum
ASPNEF

SEQ ID NO: 2211719 - protein, 13 aa, Cryptosporidium parvum
ASPSISPNRRKEK

SEQ ID NO: 2211720 - protein, 18 aa, Cryptosporidium parvum
ASPSNVSLSASNDSRKGT

SEQ ID NO: 2211721 - protein, 7 aa, Cryptosporidium parvum
ASQGNNY

SEQ ID NO: 2211722 - protein, 50 aa, Cryptosporidium parvum
ASQNNQGSEGTHNEVKSQNIVSNNEDGECTNRGNNKGSNNIKTVSSYQRE

SEQ ID NO: 2211723 - protein, 32 aa, Cryptosporidium parvum
ASQSPRQGSPRASSSGILETSSPYANRHTPEQ

SEQ ID NO: 2211724 - protein, 8 aa, Cryptosporidium parvum
ASRAASSP

SEQ ID NO: 2211725 - protein, 9 aa, Cryptosporidium parvum
ASRKIPGSK

SEQ ID NO: 2211726 - protein, 9 aa, Cryptosporidium parvum
ASRSQLSNS

SEQ ID NO: 2211727 - protein, 8 aa, Cryptosporidium parvum
ASRTAENS

SEQ ID NO: 2211728 - protein, 6 aa, Cryptosporidium parvum
ASSATV

SEQ ID NO: 2211729 - protein, 7 aa, Cryptosporidium parvum
ASSDNPN

SEQ ID NO: 2211730 - protein, 4 aa, Cryptosporidium parvum
ASSE

SEQ ID NO: 2211731 - protein, 21 aa, Cryptosporidium parvum
ASSENEDDELQNQNEGAGSGV

SEQ ID NO: 2211732 - protein, 7 aa, Cryptosporidium parvum
ASSGIGK

SEQ ID NO: 2211733 - protein, 4 aa, Cryptosporidium parvum
ASSH

SEQ ID NO: 2211734 - protein, 17 aa, Cryptosporidium parvum
ASSKPRTSFGATDENSI

SEQ ID NO: 2211735 - protein, 14 aa, Cryptosporidium parvum
ASSLEAGLSHSSTI

SEQ ID NO: 2211736 - protein, 7 aa, Cryptosporidium parvum
ASSNRSA

SEQ ID NO: 2211737 - protein, 7 aa, Cryptosporidium parvum
ASSPELV

SEQ ID NO: 2211738 - protein, 7 aa, Cryptosporidium parvum
ASSPSNV

SEQ ID NO: 2211739 - protein, 9 aa, Cryptosporidium parvum
ASSQKTQAC

SEQ ID NO: 2211740 - protein, 28 aa, Cryptosporidium parvum
ASSQNFRRKKKPKNGVSSSISANGAPLG

SEQ ID NO: 2211741 - protein, 9 aa, Cryptosporidium parvum
ASSSISRNS

SEQ ID NO: 2211742 - protein, 10 aa, Cryptosporidium parvum
ASSSNKSSIS

SEQ ID NO: 2211743 - protein, 9 aa, Cryptosporidium parvum
ASSSSNSKV

SEQ ID NO: 2211744 - protein, 10 aa, Cryptosporidium parvum
ASSVKRTKRH

SEQ ID NO: 2211745 - protein, 4 aa, Cryptosporidium parvum
ASSY

SEQ ID NO: 2211746 - protein, 8 aa, Cryptosporidium parvum
ASTKSEKR

SEQ ID NO: 2211747 - protein, 7 aa, Cryptosporidium parvum
ASTPNDL

SEQ ID NO: 2211748 - protein, 36 aa, Cryptosporidium parvum
ASTQHRVPRDNPSKGKKNKRKVRKQKPFTGAEKLPR

SEQ ID NO: 2211749 - protein, 4 aa, Cryptosporidium parvum
ASTS

SEQ ID NO: 2211750 - protein, 8 aa, Cryptosporidium parvum
ASTSEQLN

SEQ ID NO: 2211751 - protein, 6 aa, Cryptosporidium parvum
ASTSGF

SEQ ID NO: 2211752 - protein, 9 aa, Cryptosporidium parvum
ASTSTGQDI

SEQ ID NO: 2211753 - protein, 25 aa, Cryptosporidium parvum
ASTTTTTTKVDTKNYNVQSPTDNSI

SEQ ID NO: 2211754 - protein, 14 aa, Cryptosporidium parvum
ASVPPGPYTGTGIS

SEQ ID NO: 2211755 - protein, 7 aa, Cryptosporidium parvum
ASYPTSL

SEQ ID NO: 2211756 - protein, 8 aa, Cryptosporidium parvum
ASYSTSSI

SEQ ID NO: 2211757 - protein, 7 aa, Cryptosporidium parvum
ATAPSGM

SEQ ID NO: 2211758 - protein, 7 aa, Cryptosporidium parvum
ATAQNQD

SEQ ID NO: 2211759 - protein, 13 aa, Cryptosporidium parvum
ATCGSGSTTRTRK

SEQ ID NO: 2211760 - protein, 4 aa, Cryptosporidium parvum
ATDK

SEQ ID NO: 2211761 - protein, 6 aa, Cryptosporidium parvum
ATDKHE

SEQ ID NO: 2211762 - protein, 11 aa, Cryptosporidium parvum
ATDKKKAKVSA

SEQ ID NO: 2211763 - protein, 4 aa, Cryptosporidium parvum
ATDP

SEQ ID NO: 2211764 - protein, 5 aa, Cryptosporidium parvum
ATDPS

SEQ ID NO: 2211765 - protein, 11 aa, Cryptosporidium parvum
ATDSEKTNSGI

SEQ ID NO: 2211766 - protein, 5 aa, Cryptosporidium parvum
ATEED

SEQ ID NO: 2211767 - protein, 12 aa, Cryptosporidium parvum
ATEFEPNYEAPT

SEQ ID NO: 2211768 - protein, 24 aa, Cryptosporidium parvum
ATFATKKESRRTNRTDKDSKIRRT

SEQ ID NO: 2211769 - protein, 6 aa, Cryptosporidium parvum
ATGSDH

SEQ ID NO: 2211770 - protein, 7 aa, Cryptosporidium parvum
ATGTKSG

SEQ ID NO: 2211771 - protein, 17 aa, Cryptosporidium parvum
ATHGGKTDFNAHPHQDY

SEQ ID NO: 2211772 - protein, 7 aa, Cryptosporidium parvum
ATHGSEL

SEQ ID NO: 2211773 - protein, 26 aa, Cryptosporidium parvum
ATHPPPNSANSTPNNESTQSNRNSLS

SEQ ID NO: 2211774 - protein, 6 aa, Cryptosporidium parvum
ATIKNG

SEQ ID NO: 2211775 - protein, 23 aa, Cryptosporidium parvum
ATINSNNESNLNNNNNNNVSSEY

SEQ ID NO: 2211776 - protein, 6 aa, Cryptosporidium parvum
ATISKT

SEQ ID NO: 2211777 - protein, 4 aa, Cryptosporidium parvum
ATKS

SEQ ID NO: 2211778 - protein, 4 aa, Cryptosporidium parvum
ATLP

SEQ ID NO: 2211779 - protein, 16 aa, Cryptosporidium parvum
ATLSQTTDMKDISSKQ

SEQ ID NO: 2211780 - protein, 6 aa, Cryptosporidium parvum
ATNMKS

SEQ ID NO: 2211781 - protein, 8 aa, Cryptosporidium parvum
ATNSGKMD

SEQ ID NO: 2211782 - protein, 5 aa, Cryptosporidium parvum
ATPNE

SEQ ID NO: 2211783 - protein, 6 aa, Cryptosporidium parvum
ATPYNY

SEQ ID NO: 2211784 - protein, 8 aa, Cryptosporidium parvum
ATQKSQAV

SEQ ID NO: 2211785 - protein, 11 aa, Cryptosporidium parvum
ATQSTQKWRNY

SEQ ID NO: 2211786 - protein, 7 aa, Cryptosporidium parvum
ATSAENT

SEQ ID NO: 2211787 - protein, 6 aa, Cryptosporidium parvum
ATSGNF

SEQ ID NO: 2211788 - protein, 4 aa, Cryptosporidium parvum
ATSN

SEQ ID NO: 2211789 - protein, 22 aa, Cryptosporidium parvum
ATSNANNGPSSHSNMNNGPIEM

SEQ ID NO: 2211790 - protein, 9 aa, Cryptosporidium parvum
ATSSTGIPS

SEQ ID NO: 2211791 - protein, 11 aa, Cryptosporidium parvum
ATSSVDSHTDS

SEQ ID NO: 2211792 - protein, 6 aa, Cryptosporidium parvum
ATSTSS

SEQ ID NO: 2211793 - protein, 9 aa, Cryptosporidium parvum
ATTAPIAPA

SEQ ID NO: 2211794 - protein, 24 aa, Cryptosporidium parvum
ATTPDRPDSDYETWSPYDGRNSEK

SEQ ID NO: 2211795 - protein, 6 aa, Cryptosporidium parvum
ATVRPE

SEQ ID NO: 2211796 - protein, 10 aa, Cryptosporidium parvum
ATVSGISSGV

SEQ ID NO: 2211797 - protein, 28 aa, Cryptosporidium parvum
ATVSNDRHQAQNNNLDTGIHTSNSLSSE

SEQ ID NO: 2211798 - protein, 15 aa, Cryptosporidium parvum
AVEKNTDKDGSAFSV

SEQ ID NO: 2211799 - protein, 12 aa, Cryptosporidium parvum
AVENPKQSKTIT

SEQ ID NO: 2211800 - protein, 6 aa, Cryptosporidium parvum
AVGGRR

SEQ ID NO: 2211801 - protein, 7 aa, Cryptosporidium parvum
AVNGPNS

SEQ ID NO: 2211802 - protein, 20 aa, Cryptosporidium parvum
AVNQDGKSASLTAPNGPSQK

SEQ ID NO: 2211803 - protein, 30 aa, Cryptosporidium parvum
AVNSDVDTDTTSEDIENDETLNSNNKGHLS

SEQ ID NO: 2211804 - protein, 26 aa, Cryptosporidium parvum
AVPSPRDEEAKKSASNDEKQKLITSK

SEQ ID NO: 2211805 - protein, 71 aa, Cryptosporidium parvum
AVQQKGEAKVMGEKKSQEKSKASGVSSLGRSKRKSEGESEDGEATTNSNSSEEKKKPESGVIEDSDTLSDK

SEQ ID NO: 2211806 - protein, 15 aa, Cryptosporidium parvum
AVTKSSLKQKKQKTF

SEQ ID NO: 2211807 - protein, 12 aa, Cryptosporidium parvum
AWGEGHDSYRRS

SEQ ID NO: 2211808 - protein, 5 aa, Cryptosporidium parvum
AYDTL

SEQ ID NO: 2211809 - protein, 13 aa, Cryptosporidium parvum
AYEEESNHDESDE

SEQ ID NO: 2211810 - protein, 5 aa, Cryptosporidium parvum
AYGNK

SEQ ID NO: 2211811 - protein, 6 aa, Cryptosporidium parvum
AYKEQG

SEQ ID NO: 2211812 - protein, 4 aa, Cryptosporidium parvum
AYMP

SEQ ID NO: 2211813 - protein, 23 aa, Cryptosporidium parvum
AYNEQLDKESKEYQKFIQKYNNI

SEQ ID NO: 2211814 - protein, 11 aa, Cryptosporidium parvum
AYNGNKTPLPE

SEQ ID NO: 2211815 - protein, 7 aa, Cryptosporidium parvum
AYNSSSY

SEQ ID NO: 2211816 - protein, 5 aa, Cryptosporidium parvum
AYPSR

SEQ ID NO: 2211817 - protein, 5 aa, Cryptosporidium parvum
AYQNS

SEQ ID NO: 2211818 - protein, 6 aa, Cryptosporidium parvum
AYSENN

SEQ ID NO: 2211819 - protein, 5 aa, Cryptosporidium parvum
AYSNN

SEQ ID NO: 2211820 - protein, 25 aa, Cryptosporidium parvum
AYSNSKKNSKEKSPQKNKSKKKSKI

SEQ ID NO: 2211821 - protein, 10 aa, Cryptosporidium parvum
AYYSENERRW

SEQ ID NO: 2211822 - protein, 5 aa, Cryptosporidium parvum
CACSE

SEQ ID NO: 2211823 - protein, 9 aa, Cryptosporidium parvum
CADNNPTGS

SEQ ID NO: 2211824 - protein, 5 aa, Cryptosporidium parvum
CAGKT

SEQ ID NO: 2211825 - protein, 11 aa, Cryptosporidium parvum
CANEEQNEKNG

SEQ ID NO: 2211826 - protein, 4 aa, Cryptosporidium parvum
CAQQ

SEQ ID NO: 2211827 - protein, 26 aa, Cryptosporidium parvum
CDDDTNQDSSSLSMTGKTSKLINKDE

SEQ ID NO: 2211828 - protein, 5 aa, Cryptosporidium parvum
CDDES

SEQ ID NO: 2211829 - protein, 9 aa, Cryptosporidium parvum
CDDSNFNDI

SEQ ID NO: 2211830 - protein, 9 aa, Cryptosporidium parvum
CDEKNNGEL

SEQ ID NO: 2211831 - protein, 18 aa, Cryptosporidium parvum
CDENPDIISSSKPSGNFP

SEQ ID NO: 2211832 - protein, 6 aa, Cryptosporidium parvum
CDNFEN

SEQ ID NO: 2211833 - protein, 19 aa, Cryptosporidium parvum
CDPQEYSGEYPFSEPETRA

SEQ ID NO: 2211834 - protein, 8 aa, Cryptosporidium parvum
CDSANSRG

SEQ ID NO: 2211835 - protein, 5 aa, Cryptosporidium parvum
CDSDL

SEQ ID NO: 2211836 - protein, 9 aa, Cryptosporidium parvum
CDSNDTDKN

SEQ ID NO: 2211837 - protein, 4 aa, Cryptosporidium parvum
CDSP

SEQ ID NO: 2211838 - protein, 7 aa, Cryptosporidium parvum
CDSSVEQ

SEQ ID NO: 2211839 - protein, 12 aa, Cryptosporidium parvum
CEDQPEVAKKGI

SEQ ID NO: 2211840 - protein, 4 aa, Cryptosporidium parvum
CEEE

SEQ ID NO: 2211841 - protein, 7 aa, Cryptosporidium parvum
CEENNPC

SEQ ID NO: 2211842 - protein, 9 aa, Cryptosporidium parvum
CEGERNEYF

SEQ ID NO: 2211843 - protein, 5 aa, Cryptosporidium parvum
CENDD

SEQ ID NO: 2211844 - protein, 5 aa, Cryptosporidium parvum
CEPMN

SEQ ID NO: 2211845 - protein, 5 aa, Cryptosporidium parvum
CEQAP

SEQ ID NO: 2211846 - protein, 5 aa, Cryptosporidium parvum
CETSD

SEQ ID NO: 2211847 - protein, 11 aa, Cryptosporidium parvum
CFKTSKPSSFC

SEQ ID NO: 2211848 - protein, 5 aa, Cryptosporidium parvum
CFQSN

SEQ ID NO: 2211849 - protein, 6 aa, Cryptosporidium parvum
CGDGSK

SEQ ID NO: 2211850 - protein, 26 aa, Cryptosporidium parvum
CGEIPSSEKLGRGSNQYSESEDAKFG

SEQ ID NO: 2211851 - protein, 6 aa, Cryptosporidium parvum
CGENRK

SEQ ID NO: 2211852 - protein, 18 aa, Cryptosporidium parvum
CGEVSNEEFKKSQSYSNS

SEQ ID NO: 2211853 - protein, 11 aa, Cryptosporidium parvum
CGKGNSTRSRS

SEQ ID NO: 2211854 - protein, 10 aa, Cryptosporidium parvum
CGKSSSKNTI

SEQ ID NO: 2211855 - protein, 4 aa, Cryptosporidium parvum
CGLT

SEQ ID NO: 2211856 - protein, 5 aa, Cryptosporidium parvum
CGSNP

SEQ ID NO: 2211857 - protein, 12 aa, Cryptosporidium parvum
CGSSTPEAQHNH

SEQ ID NO: 2211858 - protein, 5 aa, Cryptosporidium parvum
CGTNT

SEQ ID NO: 2211859 - protein, 24 aa, Cryptosporidium parvum
CGTTTRNREVKGENCTELPTESKK

SEQ ID NO: 2211860 - protein, 14 aa, Cryptosporidium parvum
CHIKGGDNGCMKSP

SEQ ID NO: 2211861 - protein, 6 aa, Cryptosporidium parvum
CHPEQR

SEQ ID NO: 2211862 - protein, 5 aa, Cryptosporidium parvum
CKASA

SEQ ID NO: 2211863 - protein, 6 aa, Cryptosporidium parvum
CKDSPI

SEQ ID NO: 2211864 - protein, 7 aa, Cryptosporidium parvum
CKEGYTG

SEQ ID NO: 2211865 - protein, 6 aa, Cryptosporidium parvum
CKNEDQ

SEQ ID NO: 2211866 - protein, 5 aa, Cryptosporidium parvum
CKNTN

SEQ ID NO: 2211867 - protein, 6 aa, Cryptosporidium parvum
CKPGEE

SEQ ID NO: 2211868 - protein, 17 aa, Cryptosporidium parvum
CKQAGSPSSGTEENSPL

SEQ ID NO: 2211869 - protein, 15 aa, Cryptosporidium parvum
CKRNLSQMYAGWMPQ

SEQ ID NO: 2211870 - protein, 5 aa, Cryptosporidium parvum
CKSKN

SEQ ID NO: 2211871 - protein, 23 aa, Cryptosporidium parvum
CKSNESKSLECETSKGNPPAPTK

SEQ ID NO: 2211872 - protein, 30 aa, Cryptosporidium parvum
CKSPPGIKNKLNSRRNDLNGFDENSSMDEP

SEQ ID NO: 2211873 - protein, 6 aa, Cryptosporidium parvum
CKTQKV

SEQ ID NO: 2211874 - protein, 6 aa, Cryptosporidium parvum
CLDKAS

SEQ ID NO: 2211875 - protein, 7 aa, Cryptosporidium parvum
CLNTEQS

SEQ ID NO: 2211876 - protein, 4 aa, Cryptosporidium parvum
CLSN

SEQ ID NO: 2211877 - protein, 12 aa, Cryptosporidium parvum
CNCPKSTPEQLE

SEQ ID NO: 2211878 - protein, 5 aa, Cryptosporidium parvum
CNDRS

SEQ ID NO: 2211879 - protein, 7 aa, Cryptosporidium parvum
CNDSSLD

SEQ ID NO: 2211880 - protein, 9 aa, Cryptosporidium parvum
CNIRGSSTI

SEQ ID NO: 2211881 - protein, 22 aa, Cryptosporidium parvum
CNKQTNSQQNITSTCGNKKPEA

SEQ ID NO: 2211882 - protein, 12 aa, Cryptosporidium parvum
CNNGIKGTLGNT

SEQ ID NO: 2211883 - protein, 7 aa, Cryptosporidium parvum
CNNNGQR

SEQ ID NO: 2211884 - protein, 6 aa, Cryptosporidium parvum
CNNNNN

SEQ ID NO: 2211885 - protein, 12 aa, Cryptosporidium parvum
CNNNSSSSNSQF

SEQ ID NO: 2211886 - protein, 31 aa, Cryptosporidium parvum
CNNPNNSTNNNVNKGSNSNENSVNNTTYGGT

SEQ ID NO: 2211887 - protein, 12 aa, Cryptosporidium parvum
CNNSNRKVNDLQ

SEQ ID NO: 2211888 - protein, 6 aa, Cryptosporidium parvum
CNNTST

SEQ ID NO: 2211889 - protein, 21 aa, Cryptosporidium parvum
CNQSGDGDSNIESEIRENSNG

SEQ ID NO: 2211890 - protein, 9 aa, Cryptosporidium parvum
CNSNENQDK

SEQ ID NO: 2211891 - protein, 23 aa, Cryptosporidium parvum
CNSNSNNKNNDSNQQEISTSSKY

SEQ ID NO: 2211892 - protein, 7 aa, Cryptosporidium parvum
CNSSGLQ

SEQ ID NO: 2211893 - protein, 12 aa, Cryptosporidium parvum
CNSSKEKFDYPK

SEQ ID NO: 2211894 - protein, 5 aa, Cryptosporidium parvum
CNTRS

SEQ ID NO: 2211895 - protein, 8 aa, Cryptosporidium parvum
CNYPRNNE

SEQ ID NO: 2211896 - protein, 6 aa, Cryptosporidium parvum
CPANSF

SEQ ID NO: 2211897 - protein, 4 aa, Cryptosporidium parvum
CPEE

SEQ ID NO: 2211898 - protein, 6 aa, Cryptosporidium parvum
CPENCP

SEQ ID NO: 2211899 - protein, 6 aa, Cryptosporidium parvum
CPNDTC

SEQ ID NO: 2211900 - protein, 7 aa, Cryptosporidium parvum
CPNGHDE

SEQ ID NO: 2211901 - protein, 5 aa, Cryptosporidium parvum
CPNGY

SEQ ID NO: 2211902 - protein, 12 aa, Cryptosporidium parvum
CPPGSSMTEDNK

SEQ ID NO: 2211903 - protein, 7 aa, Cryptosporidium parvum
CPPYSLP

SEQ ID NO: 2211904 - protein, 5 aa, Cryptosporidium parvum
CPQGS

SEQ ID NO: 2211905 - protein, 8 aa, Cryptosporidium parvum
CPRGIPGE

SEQ ID NO: 2211906 - protein, 10 aa, Cryptosporidium parvum
CQAGGDNNHL

SEQ ID NO: 2211907 - protein, 10 aa, Cryptosporidium parvum
CQEKEDSLLS

SEQ ID NO: 2211908 - protein, 8 aa, Cryptosporidium parvum
CQIGTRSR

SEQ ID NO: 2211909 - protein, 9 aa, Cryptosporidium parvum
CQKDENNNW

SEQ ID NO: 2211910 - protein, 18 aa, Cryptosporidium parvum
CQKGISGSFGSYAYKNTG

SEQ ID NO: 2211911 - protein, 10 aa, Cryptosporidium parvum
CQKNSSASQF

SEQ ID NO: 2211912 - protein, 6 aa, Cryptosporidium parvum
CQNNNC

SEQ ID NO: 2211913 - protein, 7 aa, Cryptosporidium parvum
CQQNSGK

SEQ ID NO: 2211914 - protein, 5 aa, Cryptosporidium parvum
CQSSD

SEQ ID NO: 2211915 - protein, 5 aa, Cryptosporidium parvum
CRRGH

SEQ ID NO: 2211916 - protein, 4 aa, Cryptosporidium parvum
CRRQ

SEQ ID NO: 2211917 - protein, 8 aa, Cryptosporidium parvum
CSDKSTKE

SEQ ID NO: 2211918 - protein, 5 aa, Cryptosporidium parvum
CSEDA

SEQ ID NO: 2211919 - protein, 4 aa, Cryptosporidium parvum
CSEG

SEQ ID NO: 2211920 - protein, 49 aa, Cryptosporidium parvum
CSENSSLGDQCTQNTFNRKAQGENKSKTKSREEKKSAQNNKKNNTKTKD

SEQ ID NO: 2211921 - protein, 12 aa, Cryptosporidium parvum
CSGNKEKSGFEL

SEQ ID NO: 2211922 - protein, 8 aa, Cryptosporidium parvum
CSGTQTRD

SEQ ID NO: 2211923 - protein, 10 aa, Cryptosporidium parvum
CSKDNSSVND

SEQ ID NO: 2211924 - protein, 7 aa, Cryptosporidium parvum
CSKNSDK

SEQ ID NO: 2211925 - protein, 11 aa, Cryptosporidium parvum
CSKSASHSSIQ

SEQ ID NO: 2211926 - protein, 16 aa, Cryptosporidium parvum
CSKSEEDEVQSPAGRY

SEQ ID NO: 2211927 - protein, 10 aa, Cryptosporidium parvum
CSLSGGEKQR

SEQ ID NO: 2211928 - protein, 4 aa, Cryptosporidium parvum
CSNI

SEQ ID NO: 2211929 - protein, 6 aa, Cryptosporidium parvum
CSNSEM

SEQ ID NO: 2211930 - protein, 19 aa, Cryptosporidium parvum
CSNTTDETHKNNSKGTSEC

SEQ ID NO: 2211931 - protein, 5 aa, Cryptosporidium parvum
CSPNQ

SEQ ID NO: 2211932 - protein, 8 aa, Cryptosporidium parvum
CSPPGKDL

SEQ ID NO: 2211933 - protein, 11 aa, Cryptosporidium parvum
CSPSQGGLGTD

SEQ ID NO: 2211934 - protein, 15 aa, Cryptosporidium parvum
CSPSSCDNQPKEPTH

SEQ ID NO: 2211935 - protein, 6 aa, Cryptosporidium parvum
CSQVTN

SEQ ID NO: 2211936 - protein, 6 aa, Cryptosporidium parvum
CSREAC

SEQ ID NO: 2211937 - protein, 9 aa, Cryptosporidium parvum
CSSAAQDES

SEQ ID NO: 2211938 - protein, 7 aa, Cryptosporidium parvum
CSSGFST

SEQ ID NO: 2211939 - protein, 12 aa, Cryptosporidium parvum
CSSISNGPGMTT

SEQ ID NO: 2211940 - protein, 6 aa, Cryptosporidium parvum
CSSNEK

SEQ ID NO: 2211941 - protein, 9 aa, Cryptosporidium parvum
CSSPNSDLG

SEQ ID NO: 2211942 - protein, 12 aa, Cryptosporidium parvum
CSSSSQLEPLGE

SEQ ID NO: 2211943 - protein, 6 aa, Cryptosporidium parvum
CSTDCQ

SEQ ID NO: 2211944 - protein, 7 aa, Cryptosporidium parvum
CSTEKNT

SEQ ID NO: 2211945 - protein, 13 aa, Cryptosporidium parvum
CSTNKIPKSEFGE

SEQ ID NO: 2211946 - protein, 6 aa, Cryptosporidium parvum
CSTQNI

SEQ ID NO: 2211947 - protein, 9 aa, Cryptosporidium parvum
CSTSDDSEV

SEQ ID NO: 2211948 - protein, 4 aa, Cryptosporidium parvum
CSTV

SEQ ID NO: 2211949 - protein, 6 aa, Cryptosporidium parvum
CSYSPN

SEQ ID NO: 2211950 - protein, 4 aa, Cryptosporidium parvum
CTEN

SEQ ID NO: 2211951 - protein, 4 aa, Cryptosporidium parvum
CTGR

SEQ ID NO: 2211952 - protein, 14 aa, Cryptosporidium parvum
CTHGPYSPPSNRRN

SEQ ID NO: 2211953 - protein, 5 aa, Cryptosporidium parvum
CTKGI

SEQ ID NO: 2211954 - protein, 17 aa, Cryptosporidium parvum
CTNSSNSFLKSTDEIGT

SEQ ID NO: 2211955 - protein, 20 aa, Cryptosporidium parvum
CTNSTTTNTSNDNNKNSGFE

SEQ ID NO: 2211956 - protein, 7 aa, Cryptosporidium parvum
CTPCPEN

SEQ ID NO: 2211957 - protein, 5 aa, Cryptosporidium parvum
CTRKS

SEQ ID NO: 2211958 - protein, 8 aa, Cryptosporidium parvum
CTTRKEEE

SEQ ID NO: 2211959 - protein, 5 aa, Cryptosporidium parvum
CVRGG

SEQ ID NO: 2211960 - protein, 7 aa, Cryptosporidium parvum
CVSRSSD

SEQ ID NO: 2211961 - protein, 5 aa, Cryptosporidium parvum
DAALG

SEQ ID NO: 2211962 - protein, 6 aa, Cryptosporidium parvum
DAANGN

SEQ ID NO: 2211963 - protein, 9 aa, Cryptosporidium parvum
DAANKRSGA

SEQ ID NO: 2211964 - protein, 11 aa, Cryptosporidium parvum
DAEDNNNSNND

SEQ ID NO: 2211965 - protein, 4 aa, Cryptosporidium parvum
DAEN

SEQ ID NO: 2211966 - protein, 6 aa, Cryptosporidium parvum
DAENVR

SEQ ID NO: 2211967 - protein, 6 aa, Cryptosporidium parvum
DAFKRG

SEQ ID NO: 2211968 - protein, 24 aa, Cryptosporidium parvum
DAFQESTGNTKSNSNKLGSKYTSL

SEQ ID NO: 2211969 - protein, 11 aa, Cryptosporidium parvum
DAGIRGTAQQS

SEQ ID NO: 2211970 - protein, 13 aa, Cryptosporidium parvum
DAGNDSGKNDSSF

SEQ ID NO: 2211971 - protein, 25 aa, Cryptosporidium parvum
DAGNELRNRNENHLNEGNTEESDKD

SEQ ID NO: 2211972 - protein, 10 aa, Cryptosporidium parvum
DAGTGTLGNN

SEQ ID NO: 2211973 - protein, 6 aa, Cryptosporidium parvum
DAGTSI

SEQ ID NO: 2211974 - protein, 4 aa, Cryptosporidium parvum
DAKD

SEQ ID NO: 2211975 - protein, 9 aa, Cryptosporidium parvum
DAKESNDGL

SEQ ID NO: 2211976 - protein, 11 aa, Cryptosporidium parvum
DAKSIPSSIKN

SEQ ID NO: 2211977 - protein, 10 aa, Cryptosporidium parvum
DALDENQDNT

SEQ ID NO: 2211978 - protein, 7 aa, Cryptosporidium parvum
DANEDAD

SEQ ID NO: 2211979 - protein, 15 aa, Cryptosporidium parvum
DANLSNENRNNSAED

SEQ ID NO: 2211980 - protein, 10 aa, Cryptosporidium parvum
DANTRKEGSL

SEQ ID NO: 2211981 - protein, 5 aa, Cryptosporidium parvum
DAPVD

SEQ ID NO: 2211982 - protein, 12 aa, Cryptosporidium parvum
DAQSTDGIASNS

SEQ ID NO: 2211983 - protein, 11 aa, Cryptosporidium parvum
DARKSVSTSLD

SEQ ID NO: 2211984 - protein, 4 aa, Cryptosporidium parvum
DARN

SEQ ID NO: 2211985 - protein, 27 aa, Cryptosporidium parvum
DARSIADENDDNTNKKPSYKKNSSINN

SEQ ID NO: 2211986 - protein, 4 aa, Cryptosporidium parvum
DASE

SEQ ID NO: 2211987 - protein, 12 aa, Cryptosporidium parvum
DASEDSSGSEND

SEQ ID NO: 2211988 - protein, 8 aa, Cryptosporidium parvum
DASKENLS

SEQ ID NO: 2211989 - protein, 7 aa, Cryptosporidium parvum
DASNKYK

SEQ ID NO: 2211990 - protein, 8 aa, Cryptosporidium parvum
DASRGSQT

SEQ ID NO: 2211991 - protein, 12 aa, Cryptosporidium parvum
DASRSTEYGGTD

SEQ ID NO: 2211992 - protein, 8 aa, Cryptosporidium parvum
DASSNINS

SEQ ID NO: 2211993 - protein, 10 aa, Cryptosporidium parvum
DASTSSPESI

SEQ ID NO: 2211994 - protein, 7 aa, Cryptosporidium parvum
DASYTEK

SEQ ID NO: 2211995 - protein, 12 aa, Cryptosporidium parvum
DATTEGSENVGD

SEQ ID NO: 2211996 - protein, 11 aa, Cryptosporidium parvum
DATTSTNTLGT

SEQ ID NO: 2211997 - protein, 9 aa, Cryptosporidium parvum
DAYGDGPWH

SEQ ID NO: 2211998 - protein, 23 aa, Cryptosporidium parvum
DAYNQNHNNKSKVDNSIVSNNDH

SEQ ID NO: 2211999 - protein, 4 aa, Cryptosporidium parvum
DCDP

SEQ ID NO: 2212000 - protein, 14 aa, Cryptosporidium parvum
DCDQSKRDIQSDDS

SEQ ID NO: 2212001 - protein, 5 aa, Cryptosporidium parvum
DCNPT

SEQ ID NO: 2212002 - protein, 16 aa, Cryptosporidium parvum
DCPPPKSAKSDGIPTA

SEQ ID NO: 2212003 - protein, 5 aa, Cryptosporidium parvum
DCRNN

SEQ ID NO: 2212004 - protein, 6 aa, Cryptosporidium parvum
DCSNNH

SEQ ID NO: 2212005 - protein, 26 aa, Cryptosporidium parvum
DCSSDSENNTYGSQKYDTKNSNCDIN

SEQ ID NO: 2212006 - protein, 10 aa, Cryptosporidium parvum
DCTDSDGRTP

SEQ ID NO: 2212007 - protein, 7 aa, Cryptosporidium parvum
DCTKDSL

SEQ ID NO: 2212008 - protein, 7 aa, Cryptosporidium parvum
DCTSTNQ

SEQ ID NO: 2212009 - protein, 9 aa, Cryptosporidium parvum
DDADPDKVS

SEQ ID NO: 2212010 - protein, 6 aa, Cryptosporidium parvum
DDAGKN

SEQ ID NO: 2212011 - protein, 7 aa, Cryptosporidium parvum
DDAPDND

SEQ ID NO: 2212012 - protein, 4 aa, Cryptosporidium parvum
DDCR

SEQ ID NO: 2212013 - protein, 13 aa, Cryptosporidium parvum
DDDDDDNNNNSNN

SEQ ID NO: 2212014 - protein, 37 aa, Cryptosporidium parvum
DDDDDEEDSIDFDEEDDIVEDSNLSENEAEIEILNDQ

SEQ ID NO: 2212015 - protein, 26 aa, Cryptosporidium parvum
DDDDGNNDDGNNDDGNDNDNKENRKA

SEQ ID NO: 2212016 - protein, 10 aa, Cryptosporidium parvum
DDDDKKLSED

SEQ ID NO: 2212017 - protein, 9 aa, Cryptosporidium parvum
DDDETNDLT

SEQ ID NO: 2212018 - protein, 5 aa, Cryptosporidium parvum
DDDFE

SEQ ID NO: 2212019 - protein, 7 aa, Cryptosporidium parvum
DDDNTEE

SEQ ID NO: 2212020 - protein, 10 aa, Cryptosporidium parvum
DDDRHNDETF

SEQ ID NO: 2212021 - protein, 9 aa, Cryptosporidium parvum
DDEDEDDHA

SEQ ID NO: 2212022 - protein, 22 aa, Cryptosporidium parvum
DDEETEESEASGDDRLESKGSR

SEQ ID NO: 2212023 - protein, 10 aa, Cryptosporidium parvum
DDEGNESINK

SEQ ID NO: 2212024 - protein, 13 aa, Cryptosporidium parvum
DDEKRHKKYPVDE

SEQ ID NO: 2212025 - protein, 6 aa, Cryptosporidium parvum
DDELEN

SEQ ID NO: 2212026 - protein, 9 aa, Cryptosporidium parvum
DDENDYQDE

SEQ ID NO: 2212027 - protein, 9 aa, Cryptosporidium parvum
DDESYSNYR

SEQ ID NO: 2212028 - protein, 5 aa, Cryptosporidium parvum
DDETL

SEQ ID NO: 2212029 - protein, 5 aa, Cryptosporidium parvum
DDEYC

SEQ ID NO: 2212030 - protein, 9 aa, Cryptosporidium parvum
DDFESNPQV

SEQ ID NO: 2212031 - protein, 5 aa, Cryptosporidium parvum
DDFSN

SEQ ID NO: 2212032 - protein, 13 aa, Cryptosporidium parvum
DDGDCEKNSPQKA

SEQ ID NO: 2212033 - protein, 54 aa, Cryptosporidium parvum
DDGDCKGVQSEQDDNEIQGKDSERNDIESEHKNRNYHEKNNIKDDQGDEDSREF

SEQ ID NO: 2212034 - protein, 35 aa, Cryptosporidium parvum
DDGDCKGVQSEQNDNEIQGKDNESSAGRKEGYEID

SEQ ID NO: 2212035 - protein, 5 aa, Cryptosporidium parvum
DDGDS

SEQ ID NO: 2212036 - protein, 4 aa, Cryptosporidium parvum
DDGE

SEQ ID NO: 2212037 - protein, 9 aa, Cryptosporidium parvum
DDGEDFQNA

SEQ ID NO: 2212038 - protein, 6 aa, Cryptosporidium parvum
DDGEEF

SEQ ID NO: 2212039 - protein, 6 aa, Cryptosporidium parvum
DDGKSI

SEQ ID NO: 2212040 - protein, 5 aa, Cryptosporidium parvum
DDHHR

SEQ ID NO: 2212041 - protein, 6 aa, Cryptosporidium parvum
DDHLTS

SEQ ID NO: 2212042 - protein, 13 aa, Cryptosporidium parvum
DDHNNGLEPDESA

SEQ ID NO: 2212043 - protein, 8 aa, Cryptosporidium parvum
DDHSNHAA

SEQ ID NO: 2212044 - protein, 4 aa, Cryptosporidium parvum
DDIL

SEQ ID NO: 2212045 - protein, 20 aa, Cryptosporidium parvum
DDKGAQENGGIDEEEYDDEF

SEQ ID NO: 2212046 - protein, 9 aa, Cryptosporidium parvum
DDKKEIENR

SEQ ID NO: 2212047 - protein, 6 aa, Cryptosporidium parvum
DDKLSG

SEQ ID NO: 2212048 - protein, 7 aa, Cryptosporidium parvum
DDKSKEL

SEQ ID NO: 2212049 - protein, 17 aa, Cryptosporidium parvum
DDKSTKAKANSSTPTRK

SEQ ID NO: 2212050 - protein, 17 aa, Cryptosporidium parvum
DDLDRDQDHQFGKGNNR

SEQ ID NO: 2212051 - protein, 11 aa, Cryptosporidium parvum
DDLKEKNEKSK

SEQ ID NO: 2212052 - protein, 15 aa, Cryptosporidium parvum
DDLQDQDQDQQHDKG

SEQ ID NO: 2212053 - protein, 35 aa, Cryptosporidium parvum
DDNDELNGQYSDKENNYKKDNEIFGESDDSDHEYD

SEQ ID NO: 2212054 - protein, 39 aa, Cryptosporidium parvum
DDNDNDDDNSNNNDNSDLKDQISKNSHNSLRRRNTSLNN

SEQ ID NO: 2212055 - protein, 11 aa, Cryptosporidium parvum
DDNGKSKSANL

SEQ ID NO: 2212056 - protein, 14 aa, Cryptosporidium parvum
DDNPSNTGNINGGI

SEQ ID NO: 2212057 - protein, 10 aa, Cryptosporidium parvum
DDNQKGSINE

SEQ ID NO: 2212058 - protein, 4 aa, Cryptosporidium parvum
DDNY

SEQ ID NO: 2212059 - protein, 4 aa, Cryptosporidium parvum
DDPI

SEQ ID NO: 2212060 - protein, 6 aa, Cryptosporidium parvum
DDPKVS

SEQ ID NO: 2212061 - protein, 6 aa, Cryptosporidium parvum
DDPNPL

SEQ ID NO: 2212062 - protein, 7 aa, Cryptosporidium parvum
DDPSASL

SEQ ID NO: 2212063 - protein, 5 aa, Cryptosporidium parvum
DDPSS

SEQ ID NO: 2212064 - protein, 88 aa, Cryptosporidium parvum
DDPSSYPSDMPSDEPSHNPDDDEEPCDDDDEEQCDEEDEEEEKYQREKEKEKNEDKHDQVDSGRKHRRKRKLRKSKSNLRSRGSGKHF

SEQ ID NO: 2212065 - protein, 10 aa, Cryptosporidium parvum
DDQDNQKENF

SEQ ID NO: 2212066 - protein, 14 aa, Cryptosporidium parvum
DDQDQYQEQEQSNL

SEQ ID NO: 2212067 - protein, 10 aa, Cryptosporidium parvum
DDQTSRSLPD

SEQ ID NO: 2212068 - protein, 23 aa, Cryptosporidium parvum
DDRERVPTSTSVHGSSLKNSERL

SEQ ID NO: 2212069 - protein, 8 aa, Cryptosporidium parvum
DDRLPESL

SEQ ID NO: 2212070 - protein, 4 aa, Cryptosporidium parvum
DDRY

SEQ ID NO: 2212071 - protein, 20 aa, Cryptosporidium parvum
DDSANNNCSSEISNTQNYEY

SEQ ID NO: 2212072 - protein, 8 aa, Cryptosporidium parvum
DDSAVNGK

SEQ ID NO: 2212073 - protein, 16 aa, Cryptosporidium parvum
DDSDAHLDSPDEGTKL

SEQ ID NO: 2212074 - protein, 6 aa, Cryptosporidium parvum
DDSDDV

SEQ ID NO: 2212075 - protein, 10 aa, Cryptosporidium parvum
DDSDPSLINN

SEQ ID NO: 2212076 - protein, 7 aa, Cryptosporidium parvum
DDSDTKL

SEQ ID NO: 2212077 - protein, 7 aa, Cryptosporidium parvum
DDSFGTK

SEQ ID NO: 2212078 - protein, 7 aa, Cryptosporidium parvum
DDSFSGN

SEQ ID NO: 2212079 - protein, 5 aa, Cryptosporidium parvum
DDSGI

SEQ ID NO: 2212080 - protein, 9 aa, Cryptosporidium parvum
DDSLKYSNN

SEQ ID NO: 2212081 - protein, 7 aa, Cryptosporidium parvum
DDSLPRN

SEQ ID NO: 2212082 - protein, 6 aa, Cryptosporidium parvum
DDSNFS

SEQ ID NO: 2212083 - protein, 16 aa, Cryptosporidium parvum
DDSNSLSSNINNHSKN

SEQ ID NO: 2212084 - protein, 7 aa, Cryptosporidium parvum
DDSPESI

SEQ ID NO: 2212085 - protein, 4 aa, Cryptosporidium parvum
DDSQ

SEQ ID NO: 2212086 - protein, 22 aa, Cryptosporidium parvum
DDSSDEEDTINPVGPPDADPSV

SEQ ID NO: 2212087 - protein, 22 aa, Cryptosporidium parvum
DDSSDEEGKINPVGPPDEEPSV

SEQ ID NO: 2212088 - protein, 10 aa, Cryptosporidium parvum
DDSSNSLSEE

SEQ ID NO: 2212089 - protein, 15 aa, Cryptosporidium parvum
DDSTPSFNKEKSITI

SEQ ID NO: 2212090 - protein, 4 aa, Cryptosporidium parvum
DDSY

SEQ ID NO: 2212091 - protein, 7 aa, Cryptosporidium parvum
DDTDSMT

SEQ ID NO: 2212092 - protein, 4 aa, Cryptosporidium parvum
DDTL

SEQ ID NO: 2212093 - protein, 15 aa, Cryptosporidium parvum
DDTMEDERGADARTC

SEQ ID NO: 2212094 - protein, 6 aa, Cryptosporidium parvum
DDTQGR

SEQ ID NO: 2212095 - protein, 9 aa, Cryptosporidium parvum
DDTTSPVTE

SEQ ID NO: 2212096 - protein, 9 aa, Cryptosporidium parvum
DDYNTRYSN

SEQ ID NO: 2212097 - protein, 25 aa, Cryptosporidium parvum
DDYRDDEAEDESEDGENESQIDSET

SEQ ID NO: 2212098 - protein, 23 aa, Cryptosporidium parvum
DDYSKNNQNCEKKLNSNNMKGIV

SEQ ID NO: 2212099 - protein, 7 aa, Cryptosporidium parvum
DDYTDSA

SEQ ID NO: 2212100 - protein, 8 aa, Cryptosporidium parvum
DEADDSKK

SEQ ID NO: 2212101 - protein, 8 aa, Cryptosporidium parvum
DEALDNEP

SEQ ID NO: 2212102 - protein, 12 aa, Cryptosporidium parvum
DECAENNKITQK

SEQ ID NO: 2212103 - protein, 7 aa, Cryptosporidium parvum
DEDDNMR

SEQ ID NO: 2212104 - protein, 8 aa, Cryptosporidium parvum
DEDEQVSK

SEQ ID NO: 2212105 - protein, 10 aa, Cryptosporidium parvum
DEDGNGQINQ

SEQ ID NO: 2212106 - protein, 4 aa, Cryptosporidium parvum
DEDK

SEQ ID NO: 2212107 - protein, 10 aa, Cryptosporidium parvum
DEDKGTIPYS

SEQ ID NO: 2212108 - protein, 11 aa, Cryptosporidium parvum
DEDKSASENYK

SEQ ID NO: 2212109 - protein, 5 aa, Cryptosporidium parvum
DEDNI

SEQ ID NO: 2212110 - protein, 16 aa, Cryptosporidium parvum
DEDNIEKLEKRDEREK

SEQ ID NO: 2212111 - protein, 5 aa, Cryptosporidium parvum
DEDNQ

SEQ ID NO: 2212112 - protein, 9 aa, Cryptosporidium parvum
DEDNSSGGI

SEQ ID NO: 2212113 - protein, 46 aa, Cryptosporidium parvum
DEDQEVSSCGKLDQKKSRWDNGEVETLREAKETVETNSSEQSSEVC

SEQ ID NO: 2212114 - protein, 7 aa, Cryptosporidium parvum
DEDRNLN

SEQ ID NO: 2212115 - protein, 7 aa, Cryptosporidium parvum
DEDSEDK

SEQ ID NO: 2212116 - protein, 15 aa, Cryptosporidium parvum
DEDSESRKKSSFGIK

SEQ ID NO: 2212117 - protein, 6 aa, Cryptosporidium parvum
DEDSSL

SEQ ID NO: 2212118 - protein, 5 aa, Cryptosporidium parvum
DEDSV

SEQ ID NO: 2212119 - protein, 6 aa, Cryptosporidium parvum
DEDTNK

SEQ ID NO: 2212120 - protein, 10 aa, Cryptosporidium parvum
DEDTTTSKTS

SEQ ID NO: 2212121 - protein, 20 aa, Cryptosporidium parvum
DEEDMLGDDPVRNFSKESLD

SEQ ID NO: 2212122 - protein, 13 aa, Cryptosporidium parvum
DEEGDNDENLGTK

SEQ ID NO: 2212123 - protein, 9 aa, Cryptosporidium parvum
DEEGNPSKV

SEQ ID NO: 2212124 - protein, 6 aa, Cryptosporidium parvum
DEEGRG

SEQ ID NO: 2212125 - protein, 6 aa, Cryptosporidium parvum
DEEKAL

SEQ ID NO: 2212126 - protein, 9 aa, Cryptosporidium parvum
DEENALNKR

SEQ ID NO: 2212127 - protein, 6 aa, Cryptosporidium parvum
DEENDS

SEQ ID NO: 2212128 - protein, 8 aa, Cryptosporidium parvum
DEEQYSKY

SEQ ID NO: 2212129 - protein, 5 aa, Cryptosporidium parvum
DEEVS

SEQ ID NO: 2212130 - protein, 8 aa, Cryptosporidium parvum
DEEYGKAS

SEQ ID NO: 2212131 - protein, 8 aa, Cryptosporidium parvum
DEEYTNEI

SEQ ID NO: 2212132 - protein, 6 aa, Cryptosporidium parvum
DEFKDE

SEQ ID NO: 2212133 - protein, 11 aa, Cryptosporidium parvum
DEFKEEKLKKK

SEQ ID NO: 2212134 - protein, 4 aa, Cryptosporidium parvum
DEFT

SEQ ID NO: 2212135 - protein, 8 aa, Cryptosporidium parvum
DEGGPSSF

SEQ ID NO: 2212136 - protein, 6 aa, Cryptosporidium parvum
DEGTDG

SEQ ID NO: 2212137 - protein, 5 aa, Cryptosporidium parvum
DEGVY

SEQ ID NO: 2212138 - protein, 4 aa, Cryptosporidium parvum
DEHI

SEQ ID NO: 2212139 - protein, 43 aa, Cryptosporidium parvum
DEINASINGHNRAQRHAKPTASASSYTPQKHHPTVSVNSEKKI

SEQ ID NO: 2212140 - protein, 19 aa, Cryptosporidium parvum
DEKDKRKCSESTENDNFEP

SEQ ID NO: 2212141 - protein, 6 aa, Cryptosporidium parvum
DEKDTY

SEQ ID NO: 2212142 - protein, 13 aa, Cryptosporidium parvum
DEKESKGEKYPVK

SEQ ID NO: 2212143 - protein, 13 aa, Cryptosporidium parvum
DEKKSKEIQDKSE

SEQ ID NO: 2212144 - protein, 10 aa, Cryptosporidium parvum
DEKNESTNDI

SEQ ID NO: 2212145 - protein, 10 aa, Cryptosporidium parvum
DEKPYKRRER

SEQ ID NO: 2212146 - protein, 15 aa, Cryptosporidium parvum
DEKQNIEEDYEKEMR

SEQ ID NO: 2212147 - protein, 14 aa, Cryptosporidium parvum
DEKSFKKVKKSVER

SEQ ID NO: 2212148 - protein, 9 aa, Cryptosporidium parvum
DEKSLEPLS

SEQ ID NO: 2212149 - protein, 4 aa, Cryptosporidium parvum
DELD

SEQ ID NO: 2212150 - protein, 5 aa, Cryptosporidium parvum
DELEE

SEQ ID NO: 2212151 - protein, 23 aa, Cryptosporidium parvum
DELSDSYKKHDITSNSKKKESTY

SEQ ID NO: 2212152 - protein, 17 aa, Cryptosporidium parvum
DEMEGYEEELENNDDGL

SEQ ID NO: 2212153 - protein, 7 aa, Cryptosporidium parvum
DENDNIG

SEQ ID NO: 2212154 - protein, 9 aa, Cryptosporidium parvum
DENEKSFNI

SEQ ID NO: 2212155 - protein, 21 aa, Cryptosporidium parvum
DENEQIGVDDNDDDNDEAENL

SEQ ID NO: 2212156 - protein, 8 aa, Cryptosporidium parvum
DENGSKKI

SEQ ID NO: 2212157 - protein, 21 aa, Cryptosporidium parvum
DENKEQKETKVYTKQSEEDTF

SEQ ID NO: 2212158 - protein, 9 aa, Cryptosporidium parvum
DENKESREV

SEQ ID NO: 2212159 - protein, 9 aa, Cryptosporidium parvum
DENKVQKKK

SEQ ID NO: 2212160 - protein, 12 aa, Cryptosporidium parvum
DENLSNSSRIPS

SEQ ID NO: 2212161 - protein, 7 aa, Cryptosporidium parvum
DENNSTV

SEQ ID NO: 2212162 - protein, 10 aa, Cryptosporidium parvum
DENPKKRENF

SEQ ID NO: 2212163 - protein, 11 aa, Cryptosporidium parvum
DENQHENEKTD

SEQ ID NO: 2212164 - protein, 11 aa, Cryptosporidium parvum
DENQKSGINER

SEQ ID NO: 2212165 - protein, 6 aa, Cryptosporidium parvum
DENRNI

SEQ ID NO: 2212166 - protein, 7 aa, Cryptosporidium parvum
DENRSRI

SEQ ID NO: 2212167 - protein, 5 aa, Cryptosporidium parvum
DENSF

SEQ ID NO: 2212168 - protein, 10 aa, Cryptosporidium parvum
DENSTNEKNI

SEQ ID NO: 2212169 - protein, 7 aa, Cryptosporidium parvum
DENVDDD

SEQ ID NO: 2212170 - protein, 6 aa, Cryptosporidium parvum
DEPDDM

SEQ ID NO: 2212171 - protein, 9 aa, Cryptosporidium parvum
DEPETLPGL

SEQ ID NO: 2212172 - protein, 5 aa, Cryptosporidium parvum
DEPNY

SEQ ID NO: 2212173 - protein, 6 aa, Cryptosporidium parvum
DEQAWN

SEQ ID NO: 2212174 - protein, 5 aa, Cryptosporidium parvum
DEQKE

SEQ ID NO: 2212175 - protein, 6 aa, Cryptosporidium parvum
DEQSGI

SEQ ID NO: 2212176 - protein, 5 aa, Cryptosporidium parvum
DEQTE

SEQ ID NO: 2212177 - protein, 8 aa, Cryptosporidium parvum
DEQWDASP

SEQ ID NO: 2212178 - protein, 6 aa, Cryptosporidium parvum
DERGLK

SEQ ID NO: 2212179 - protein, 7 aa, Cryptosporidium parvum
DERNIDS

SEQ ID NO: 2212180 - protein, 36 aa, Cryptosporidium parvum
DERPGRYNPKNQEEQEIEYDDDTGGTTEYGKKPNSL

SEQ ID NO: 2212181 - protein, 9 aa, Cryptosporidium parvum
DERPNDRVQ

SEQ ID NO: 2212182 - protein, 6 aa, Cryptosporidium parvum
DERTAK

SEQ ID NO: 2212183 - protein, 6 aa, Cryptosporidium parvum
DERTEN

SEQ ID NO: 2212184 - protein, 16 aa, Cryptosporidium parvum
DESEDEHEISSDEKRV

SEQ ID NO: 2212185 - protein, 7 aa, Cryptosporidium parvum
DESERNA

SEQ ID NO: 2212186 - protein, 7 aa, Cryptosporidium parvum
DESERNN

SEQ ID NO: 2212187 - protein, 5 aa, Cryptosporidium parvum
DESGP

SEQ ID NO: 2212188 - protein, 4 aa, Cryptosporidium parvum
DESH

SEQ ID NO: 2212189 - protein, 7 aa, Cryptosporidium parvum
DESHHRD

SEQ ID NO: 2212190 - protein, 6 aa, Cryptosporidium parvum
DESKRL

SEQ ID NO: 2212191 - protein, 10 aa, Cryptosporidium parvum
DESNEKYSTL

SEQ ID NO: 2212192 - protein, 21 aa, Cryptosporidium parvum
DESNSDTQSTETHYNSKDGTG

SEQ ID NO: 2212193 - protein, 7 aa, Cryptosporidium parvum
DESPSRR

SEQ ID NO: 2212194 - protein, 4 aa, Cryptosporidium parvum
DESQ

SEQ ID NO: 2212195 - protein, 4 aa, Cryptosporidium parvum
DETD

SEQ ID NO: 2212196 - protein, 4 aa, Cryptosporidium parvum
DETG

SEQ ID NO: 2212197 - protein, 7 aa, Cryptosporidium parvum
DETGNEF

SEQ ID NO: 2212198 - protein, 9 aa, Cryptosporidium parvum
DETSKNKPG

SEQ ID NO: 2212199 - protein, 7 aa, Cryptosporidium parvum
DETSTGI

SEQ ID NO: 2212200 - protein, 30 aa, Cryptosporidium parvum
DEVQERKIGNDQFSNQHKNSLNRGDSFSGN

SEQ ID NO: 2212201 - protein, 7 aa, Cryptosporidium parvum
DEVQSNN

SEQ ID NO: 2212202 - protein, 5 aa, Cryptosporidium parvum
DEVVT

SEQ ID NO: 2212203 - protein, 18 aa, Cryptosporidium parvum
DEWGNDSGPMSNYSKQNT

SEQ ID NO: 2212204 - protein, 25 aa, Cryptosporidium parvum
DEYEHETDDDITDNNWSDDETELKK

SEQ ID NO: 2212205 - protein, 22 aa, Cryptosporidium parvum
DFASSSDSIKQVNKGNQVNGRI

SEQ ID NO: 2212206 - protein, 12 aa, Cryptosporidium parvum
DFDGPRKVAKAT

SEQ ID NO: 2212207 - protein, 18 aa, Cryptosporidium parvum
DFDNNQELSNQNDSTMEN

SEQ ID NO: 2212208 - protein, 5 aa, Cryptosporidium parvum
DFDSN

SEQ ID NO: 2212209 - protein, 80 aa, Cryptosporidium parvum
DFEDGDYEKTSGFETSSDEQRKDSTSVQDSSSNLSIGGNQEGDAVSDDSGFTGKNQDDEPDNSNANGVSSNENQDDPKDK

SEQ ID NO: 2212210 - protein, 4 aa, Cryptosporidium parvum
DFEG

SEQ ID NO: 2212211 - protein, 14 aa, Cryptosporidium parvum
DFEKNKKRNNNQSK

SEQ ID NO: 2212212 - protein, 7 aa, Cryptosporidium parvum
DFENEES

SEQ ID NO: 2212213 - protein, 16 aa, Cryptosporidium parvum
DFEPESGIDESKQTKS

SEQ ID NO: 2212214 - protein, 10 aa, Cryptosporidium parvum
DFESSNSEIS

SEQ ID NO: 2212215 - protein, 11 aa, Cryptosporidium parvum
DFETNEYPNSY

SEQ ID NO: 2212216 - protein, 12 aa, Cryptosporidium parvum
DFGNNNPRVQQT

SEQ ID NO: 2212217 - protein, 7 aa, Cryptosporidium parvum
DFGQNKY

SEQ ID NO: 2212218 - protein, 12 aa, Cryptosporidium parvum
DFGRSNESHNSK

SEQ ID NO: 2212219 - protein, 11 aa, Cryptosporidium parvum
DFGSKGYRVTT

SEQ ID NO: 2212220 - protein, 9 aa, Cryptosporidium parvum
DFKENKKDG

SEQ ID NO: 2212221 - protein, 4 aa, Cryptosporidium parvum
DFNR

SEQ ID NO: 2212222 - protein, 8 aa, Cryptosporidium parvum
DFNSDNKK

SEQ ID NO: 2212223 - protein, 10 aa, Cryptosporidium parvum
DFQDNQKTYN

SEQ ID NO: 2212224 - protein, 22 aa, Cryptosporidium parvum
DFRKKQEEERRRKEEEEKLASE

SEQ ID NO: 2212225 - protein, 12 aa, Cryptosporidium parvum
DFRRESKNPSLS

SEQ ID NO: 2212226 - protein, 30 aa, Cryptosporidium parvum
DFSEGSSTEASTDTDTDSTEAQGEDISKEL

SEQ ID NO: 2212227 - protein, 6 aa, Cryptosporidium parvum
DFSENA

SEQ ID NO: 2212228 - protein, 7 aa, Cryptosporidium parvum
DFSENEI

SEQ ID NO: 2212229 - protein, 4 aa, Cryptosporidium parvum
DFSN

SEQ ID NO: 2212230 - protein, 30 aa, Cryptosporidium parvum
DFSNGNSSQNKLTASNESENNSKESQEYAT

SEQ ID NO: 2212231 - protein, 10 aa, Cryptosporidium parvum
DFSPRKREGR

SEQ ID NO: 2212232 - protein, 5 aa, Cryptosporidium parvum
DFTEE

SEQ ID NO: 2212233 - protein, 4 aa, Cryptosporidium parvum
DFTQ

SEQ ID NO: 2212234 - protein, 13 aa, Cryptosporidium parvum
DFVSNNDEKDSIL

SEQ ID NO: 2212235 - protein, 8 aa, Cryptosporidium parvum
DGANGIPT

SEQ ID NO: 2212236 - protein, 7 aa, Cryptosporidium parvum
DGAPSET

SEQ ID NO: 2212237 - protein, 6 aa, Cryptosporidium parvum
DGASDF

SEQ ID NO: 2212238 - protein, 5 aa, Cryptosporidium parvum
DGATS

SEQ ID NO: 2212239 - protein, 6 aa, Cryptosporidium parvum
DGDLVD

SEQ ID NO: 2212240 - protein, 7 aa, Cryptosporidium parvum
DGDQTLI

SEQ ID NO: 2212241 - protein, 4 aa, Cryptosporidium parvum
DGEE

SEQ ID NO: 2212242 - protein, 4 aa, Cryptosporidium parvum
DGEK

SEQ ID NO: 2212243 - protein, 5 aa, Cryptosporidium parvum
DGESN

SEQ ID NO: 2212244 - protein, 8 aa, Cryptosporidium parvum
DGETGLPL

SEQ ID NO: 2212245 - protein, 6 aa, Cryptosporidium parvum
DGETYS

SEQ ID NO: 2212246 - protein, 7 aa, Cryptosporidium parvum
DGEVNTK

SEQ ID NO: 2212247 - protein, 9 aa, Cryptosporidium parvum
DGFGDGGGD

SEQ ID NO: 2212248 - protein, 7 aa, Cryptosporidium parvum
DGFNSTT

SEQ ID NO: 2212249 - protein, 8 aa, Cryptosporidium parvum
DGFPQQPK

SEQ ID NO: 2212250 - protein, 7 aa, Cryptosporidium parvum
DGFSNTV

SEQ ID NO: 2212251 - protein, 8 aa, Cryptosporidium parvum
DGFSPGPK

SEQ ID NO: 2212252 - protein, 5 aa, Cryptosporidium parvum
DGFTS

SEQ ID NO: 2212253 - protein, 54 aa, Cryptosporidium parvum
DGGDCSDDNITRNPKLPIKSPNDSDISSGSTSNSYQNSSASKNNNSGKNSCKDN

SEQ ID NO: 2212254 - protein, 6 aa, Cryptosporidium parvum
DGGPAV

SEQ ID NO: 2212255 - protein, 7 aa, Cryptosporidium parvum
DGGPNAS

SEQ ID NO: 2212256 - protein, 4 aa, Cryptosporidium parvum
DGGQ

SEQ ID NO: 2212257 - protein, 8 aa, Cryptosporidium parvum
DGGSDDTL

SEQ ID NO: 2212258 - protein, 6 aa, Cryptosporidium parvum
DGHQNE

SEQ ID NO: 2212259 - protein, 4 aa, Cryptosporidium parvum
DGIE

SEQ ID NO: 2212260 - protein, 11 aa, Cryptosporidium parvum
DGIENDTHDEK

SEQ ID NO: 2212261 - protein, 7 aa, Cryptosporidium parvum
DGIENGA

SEQ ID NO: 2212262 - protein, 8 aa, Cryptosporidium parvum
DGKEEAQL

SEQ ID NO: 2212263 - protein, 5 aa, Cryptosporidium parvum
DGKKE

SEQ ID NO: 2212264 - protein, 11 aa, Cryptosporidium parvum
DGKNNSSDYYT

SEQ ID NO: 2212265 - protein, 17 aa, Cryptosporidium parvum
DGKQARRLGVSSNSGEF

SEQ ID NO: 2212266 - protein, 33 aa, Cryptosporidium parvum
DGKTSREPEDSIQSKEMNSNENDGSVKNADKNI

SEQ ID NO: 2212267 - protein, 6 aa, Cryptosporidium parvum
DGKYYE

SEQ ID NO: 2212268 - protein, 6 aa, Cryptosporidium parvum
DGLPEQ

SEQ ID NO: 2212269 - protein, 10 aa, Cryptosporidium parvum
DGLTRGPSTR

SEQ ID NO: 2212270 - protein, 28 aa, Cryptosporidium parvum
DGMKKEKDSKEGSGGKSRERGQSIQEQL

SEQ ID NO: 2212271 - protein, 8 aa, Cryptosporidium parvum
DGMNTDRY

SEQ ID NO: 2212272 - protein, 29 aa, Cryptosporidium parvum
DGMSNKPCLSSPINNNTNSQKAASTENVS

SEQ ID NO: 2212273 - protein, 4 aa, Cryptosporidium parvum
DGNQ

SEQ ID NO: 2212274 - protein, 16 aa, Cryptosporidium parvum
DGNSDTNNDNSNNNNK

SEQ ID NO: 2212275 - protein, 5 aa, Cryptosporidium parvum
DGNSI

SEQ ID NO: 2212276 - protein, 14 aa, Cryptosporidium parvum
DGNSTSTTSNDNSE

SEQ ID NO: 2212277 - protein, 20 aa, Cryptosporidium parvum
DGNYKHENKRNGKVVSDNAR

SEQ ID NO: 2212278 - protein, 8 aa, Cryptosporidium parvum
DGNYSNIP

SEQ ID NO: 2212279 - protein, 23 aa, Cryptosporidium parvum
DGPAANPSNTNEKIKTTSQNLDT

SEQ ID NO: 2212280 - protein, 5 aa, Cryptosporidium parvum
DGPND

SEQ ID NO: 2212281 - protein, 13 aa, Cryptosporidium parvum
DGQQDIKCEDQNH

SEQ ID NO: 2212282 - protein, 9 aa, Cryptosporidium parvum
DGQTKKTTL

SEQ ID NO: 2212283 - protein, 15 aa, Cryptosporidium parvum
DGSGKKKKSVYPNNI

SEQ ID NO: 2212284 - protein, 11 aa, Cryptosporidium parvum
DGSISQTRGFR

SEQ ID NO: 2212285 - protein, 9 aa, Cryptosporidium parvum
DGSNSEHIK

SEQ ID NO: 2212286 - protein, 7 aa, Cryptosporidium parvum
DGSPNPD

SEQ ID NO: 2212287 - protein, 6 aa, Cryptosporidium parvum
DGSSIR

SEQ ID NO: 2212288 - protein, 13 aa, Cryptosporidium parvum
DGSSKEDSETAAK

SEQ ID NO: 2212289 - protein, 25 aa, Cryptosporidium parvum
DGSTANNHTIKDTGNYNIDQPSKGT

SEQ ID NO: 2212290 - protein, 8 aa, Cryptosporidium parvum
DGSVRSAA

SEQ ID NO: 2212291 - protein, 7 aa, Cryptosporidium parvum
DGSYSED

SEQ ID NO: 2212292 - protein, 5 aa, Cryptosporidium parvum
DGTIR

SEQ ID NO: 2212293 - protein, 12 aa, Cryptosporidium parvum
DGTNDVAAVKDS

SEQ ID NO: 2212294 - protein, 7 aa, Cryptosporidium parvum
DGTNDVG

SEQ ID NO: 2212295 - protein, 7 aa, Cryptosporidium parvum
DGTPENL

SEQ ID NO: 2212296 - protein, 15 aa, Cryptosporidium parvum
DGTRPKPKSSLPRNI

SEQ ID NO: 2212297 - protein, 5 aa, Cryptosporidium parvum
DGTVK

SEQ ID NO: 2212298 - protein, 4 aa, Cryptosporidium parvum
DGWE

SEQ ID NO: 2212299 - protein, 20 aa, Cryptosporidium parvum
DHAQEQAKNTWDSLSSGAKA

SEQ ID NO: 2212300 - protein, 6 aa, Cryptosporidium parvum
DHDAEL

SEQ ID NO: 2212301 - protein, 9 aa, Cryptosporidium parvum
DHDEDQKVV

SEQ ID NO: 2212302 - protein, 13 aa, Cryptosporidium parvum
DHEHRKGPSTNQE

SEQ ID NO: 2212303 - protein, 9 aa, Cryptosporidium parvum
DHEMSTNTS

SEQ ID NO: 2212304 - protein, 4 aa, Cryptosporidium parvum
DHEN

SEQ ID NO: 2212305 - protein, 5 aa, Cryptosporidium parvum
DHEQK

SEQ ID NO: 2212306 - protein, 4 aa, Cryptosporidium parvum
DHGI

SEQ ID NO: 2212307 - protein, 11 aa, Cryptosporidium parvum
DHISNDNYNRD

SEQ ID NO: 2212308 - protein, 14 aa, Cryptosporidium parvum
DHKMDSSESEVENY

SEQ ID NO: 2212309 - protein, 13 aa, Cryptosporidium parvum
DHLSAHGGTRDDI

SEQ ID NO: 2212310 - protein, 7 aa, Cryptosporidium parvum
DHLTSQA

SEQ ID NO: 2212311 - protein, 6 aa, Cryptosporidium parvum
DHNKDS

SEQ ID NO: 2212312 - protein, 6 aa, Cryptosporidium parvum
DHNLNS

SEQ ID NO: 2212313 - protein, 12 aa, Cryptosporidium parvum
DHNPYSKNKKSL

SEQ ID NO: 2212314 - protein, 9 aa, Cryptosporidium parvum
DHNSDNQDT

SEQ ID NO: 2212315 - protein, 7 aa, Cryptosporidium parvum
DHNSPLS

SEQ ID NO: 2212316 - protein, 8 aa, Cryptosporidium parvum
DHNSSKYP

SEQ ID NO: 2212317 - protein, 13 aa, Cryptosporidium parvum
DHNSSSMSESSEL

SEQ ID NO: 2212318 - protein, 6 aa, Cryptosporidium parvum
DHPGLT

SEQ ID NO: 2212319 - protein, 5 aa, Cryptosporidium parvum
DHQEA

SEQ ID NO: 2212320 - protein, 7 aa, Cryptosporidium parvum
DHQKNNF

SEQ ID NO: 2212321 - protein, 7 aa, Cryptosporidium parvum
DHQNGNF

SEQ ID NO: 2212322 - protein, 4 aa, Cryptosporidium parvum
DHSR

SEQ ID NO: 2212323 - protein, 12 aa, Cryptosporidium parvum
DHSSHSTHRPRR

SEQ ID NO: 2212324 - protein, 6 aa, Cryptosporidium parvum
DHSTFK

SEQ ID NO: 2212325 - protein, 7 aa, Cryptosporidium parvum
DHTCEEK

SEQ ID NO: 2212326 - protein, 20 aa, Cryptosporidium parvum
DHTNTKGSLKRPNSNESHGS

SEQ ID NO: 2212327 - protein, 11 aa, Cryptosporidium parvum
DHTSDTGNVES

SEQ ID NO: 2212328 - protein, 14 aa, Cryptosporidium parvum
DHVKPQKEPPLRSD

SEQ ID NO: 2212329 - protein, 11 aa, Cryptosporidium parvum
DHYKNNRKDEH

SEQ ID NO: 2212330 - protein, 6 aa, Cryptosporidium parvum
DIDDED

SEQ ID NO: 2212331 - protein, 5 aa, Cryptosporidium parvum
DIDED

SEQ ID NO: 2212332 - protein, 9 aa, Cryptosporidium parvum
DIEKNTTNL

SEQ ID NO: 2212333 - protein, 12 aa, Cryptosporidium parvum
DIEKQEKNIENI

SEQ ID NO: 2212334 - protein, 9 aa, Cryptosporidium parvum
DIESTSDKQ

SEQ ID NO: 2212335 - protein, 6 aa, Cryptosporidium parvum
DIETDL

SEQ ID NO: 2212336 - protein, 5 aa, Cryptosporidium parvum
DIGGL

SEQ ID NO: 2212337 - protein, 5 aa, Cryptosporidium parvum
DIGKT

SEQ ID NO: 2212338 - protein, 9 aa, Cryptosporidium parvum
DIKESSNGL

SEQ ID NO: 2212339 - protein, 14 aa, Cryptosporidium parvum
DIKNTRDNSNTPSE

SEQ ID NO: 2212340 - protein, 8 aa, Cryptosporidium parvum
DIKPTENI

SEQ ID NO: 2212341 - protein, 7 aa, Cryptosporidium parvum
DIKQKRE

SEQ ID NO: 2212342 - protein, 12 aa, Cryptosporidium parvum
DIKTEKYKEPIV

SEQ ID NO: 2212343 - protein, 15 aa, Cryptosporidium parvum
DILDSSKQHDKKTKF

SEQ ID NO: 2212344 - protein, 6 aa, Cryptosporidium parvum
DILGPQ

SEQ ID NO: 2212345 - protein, 4 aa, Cryptosporidium parvum
DINI

SEQ ID NO: 2212346 - protein, 4 aa, Cryptosporidium parvum
DINS

SEQ ID NO: 2212347 - protein, 9 aa, Cryptosporidium parvum
DINSEETGI

SEQ ID NO: 2212348 - protein, 22 aa, Cryptosporidium parvum
DINTNEKKEEQKSESENKDSDL

SEQ ID NO: 2212349 - protein, 9 aa, Cryptosporidium parvum
DINTSDNDI

SEQ ID NO: 2212350 - protein, 12 aa, Cryptosporidium parvum
DINYSDKQISRE

SEQ ID NO: 2212351 - protein, 5 aa, Cryptosporidium parvum
DIPKA

SEQ ID NO: 2212352 - protein, 28 aa, Cryptosporidium parvum
DIPLNSKNSTSLKISNDNNSLEPETDVK

SEQ ID NO: 2212353 - protein, 25 aa, Cryptosporidium parvum
DIPLSSSSSLLSSPSSSSRSKTNRS

SEQ ID NO: 2212354 - protein, 29 aa, Cryptosporidium parvum
DIPRNTTIEEPATKIDSEQKVSASLDTET

SEQ ID NO: 2212355 - protein, 5 aa, Cryptosporidium parvum
DIQNN

SEQ ID NO: 2212356 - protein, 48 aa, Cryptosporidium parvum
DIQSSTESDQKEEEIPSKEQKGKENDIEKETEGIHSTGNDSNHFNQGQ

SEQ ID NO: 2212357 - protein, 4 aa, Cryptosporidium parvum
DISA

SEQ ID NO: 2212358 - protein, 7 aa, Cryptosporidium parvum
DISEDSK

SEQ ID NO: 2212359 - protein, 5 aa, Cryptosporidium parvum
DISIG

SEQ ID NO: 2212360 - protein, 12 aa, Cryptosporidium parvum
DISKDYKSLLVP

SEQ ID NO: 2212361 - protein, 5 aa, Cryptosporidium parvum
DISQT

SEQ ID NO: 2212362 - protein, 18 aa, Cryptosporidium parvum
DISSISGSHRFSRSSYNS

SEQ ID NO: 2212363 - protein, 5 aa, Cryptosporidium parvum
DISTD

SEQ ID NO: 2212364 - protein, 13 aa, Cryptosporidium parvum
DISTEKNGDISTG

SEQ ID NO: 2212365 - protein, 13 aa, Cryptosporidium parvum
DITKGTESKNSII

SEQ ID NO: 2212366 - protein, 27 aa, Cryptosporidium parvum
DITNKDESSSLSNEGQPSSRSFSPTQH

SEQ ID NO: 2212367 - protein, 5 aa, Cryptosporidium parvum
DITPH

SEQ ID NO: 2212368 - protein, 20 aa, Cryptosporidium parvum
DITQKKSNTNTNTNTTSKIE

SEQ ID NO: 2212369 - protein, 13 aa, Cryptosporidium parvum
DIYNGASNEDTRE

SEQ ID NO: 2212370 - protein, 20 aa, Cryptosporidium parvum
DKAEKTSQVTPSDADIETRV

SEQ ID NO: 2212371 - protein, 5 aa, Cryptosporidium parvum
DKAKS

SEQ ID NO: 2212372 - protein, 4 aa, Cryptosporidium parvum
DKAL

SEQ ID NO: 2212373 - protein, 4 aa, Cryptosporidium parvum
DKAT

SEQ ID NO: 2212374 - protein, 7 aa, Cryptosporidium parvum
DKCPGYK

SEQ ID NO: 2212375 - protein, 9 aa, Cryptosporidium parvum
DKDCSKENE

SEQ ID NO: 2212376 - protein, 5 aa, Cryptosporidium parvum
DKDDA

SEQ ID NO: 2212377 - protein, 8 aa, Cryptosporidium parvum
DKDDYDDD

SEQ ID NO: 2212378 - protein, 38 aa, Cryptosporidium parvum
DKDEGNNEENNEENKKSDKNEYKEKVNENIEKTKYEGN

SEQ ID NO: 2212379 - protein, 8 aa, Cryptosporidium parvum
DKDHGRSV

SEQ ID NO: 2212380 - protein, 5 aa, Cryptosporidium parvum
DKDKP

SEQ ID NO: 2212381 - protein, 19 aa, Cryptosporidium parvum
DKDNSKEGEDTNMGENGNG

SEQ ID NO: 2212382 - protein, 9 aa, Cryptosporidium parvum
DKDSKVQNF

SEQ ID NO: 2212383 - protein, 5 aa, Cryptosporidium parvum
DKDSS

SEQ ID NO: 2212384 - protein, 7 aa, Cryptosporidium parvum
DKEDSTS

SEQ ID NO: 2212385 - protein, 30 aa, Cryptosporidium parvum
DKEKNSQFSENSEEFSEELSEENSARPPVV

SEQ ID NO: 2212386 - protein, 8 aa, Cryptosporidium parvum
DKENSNFI

SEQ ID NO: 2212387 - protein, 5 aa, Cryptosporidium parvum
DKEQL

SEQ ID NO: 2212388 - protein, 6 aa, Cryptosporidium parvum
DKERID

SEQ ID NO: 2212389 - protein, 6 aa, Cryptosporidium parvum
DKESMH

SEQ ID NO: 2212390 - protein, 15 aa, Cryptosporidium parvum
DKESSKRSEVTPEES

SEQ ID NO: 2212391 - protein, 7 aa, Cryptosporidium parvum
DKETNKY

SEQ ID NO: 2212392 - protein, 8 aa, Cryptosporidium parvum
DKETSRFD

SEQ ID NO: 2212393 - protein, 9 aa, Cryptosporidium parvum
DKEVNEESN

SEQ ID NO: 2212394 - protein, 7 aa, Cryptosporidium parvum
DKEYRND

SEQ ID NO: 2212395 - protein, 6 aa, Cryptosporidium parvum
DKFFGE

SEQ ID NO: 2212396 - protein, 4 aa, Cryptosporidium parvum
DKFR

SEQ ID NO: 2212397 - protein, 6 aa, Cryptosporidium parvum
DKFSSR

SEQ ID NO: 2212398 - protein, 5 aa, Cryptosporidium parvum
DKGNL

SEQ ID NO: 2212399 - protein, 5 aa, Cryptosporidium parvum
DKGNS

SEQ ID NO: 2212400 - protein, 14 aa, Cryptosporidium parvum
DKGSVPKKIGNHKN

SEQ ID NO: 2212401 - protein, 6 aa, Cryptosporidium parvum
DKGVSI

SEQ ID NO: 2212402 - protein, 7 aa, Cryptosporidium parvum
DKIATNT

SEQ ID NO: 2212403 - protein, 4 aa, Cryptosporidium parvum
DKIE

SEQ ID NO: 2212404 - protein, 7 aa, Cryptosporidium parvum
DKIEPED

SEQ ID NO: 2212405 - protein, 9 aa, Cryptosporidium parvum
DKIESKPVR

SEQ ID NO: 2212406 - protein, 8 aa, Cryptosporidium parvum
DKIQEKQK

SEQ ID NO: 2212407 - protein, 4 aa, Cryptosporidium parvum
DKIS

SEQ ID NO: 2212408 - protein, 6 aa, Cryptosporidium parvum
DKITYN

SEQ ID NO: 2212409 - protein, 15 aa, Cryptosporidium parvum
DKKADNSTKEEDKGF

SEQ ID NO: 2212410 - protein, 6 aa, Cryptosporidium parvum
DKKDIS

SEQ ID NO: 2212411 - protein, 6 aa, Cryptosporidium parvum
DKKEGI

SEQ ID NO: 2212412 - protein, 12 aa, Cryptosporidium parvum
DKKETNSNIKDS

SEQ ID NO: 2212413 - protein, 11 aa, Cryptosporidium parvum
DKKKSSKSDQL

SEQ ID NO: 2212414 - protein, 8 aa, Cryptosporidium parvum
DKKNGKEK

SEQ ID NO: 2212415 - protein, 4 aa, Cryptosporidium parvum
DKKS

SEQ ID NO: 2212416 - protein, 11 aa, Cryptosporidium parvum
DKKSESNSDIN

SEQ ID NO: 2212417 - protein, 9 aa, Cryptosporidium parvum
DKKSKPRYD

SEQ ID NO: 2212418 - protein, 13 aa, Cryptosporidium parvum
DKKTKIDAKLPNP

SEQ ID NO: 2212419 - protein, 7 aa, Cryptosporidium parvum
DKKVGDN

SEQ ID NO: 2212420 - protein, 8 aa, Cryptosporidium parvum
DKLGGEAH

SEQ ID NO: 2212421 - protein, 9 aa, Cryptosporidium parvum
DKLNDRNTR

SEQ ID NO: 2212422 - protein, 7 aa, Cryptosporidium parvum
DKLPDGS

SEQ ID NO: 2212423 - protein, 4 aa, Cryptosporidium parvum
DKLY

SEQ ID NO: 2212424 - protein, 6 aa, Cryptosporidium parvum
DKMDNI

SEQ ID NO: 2212425 - protein, 4 aa, Cryptosporidium parvum
DKND

SEQ ID NO: 2212426 - protein, 7 aa, Cryptosporidium parvum
DKNDELP

SEQ ID NO: 2212427 - protein, 5 aa, Cryptosporidium parvum
DKNGI

SEQ ID NO: 2212428 - protein, 7 aa, Cryptosporidium parvum
DKNGLIP

SEQ ID NO: 2212429 - protein, 6 aa, Cryptosporidium parvum
DKNGPI

SEQ ID NO: 2212430 - protein, 8 aa, Cryptosporidium parvum
DKNISSQN

SEQ ID NO: 2212431 - protein, 17 aa, Cryptosporidium parvum
DKNKTIDEVRTNDSEPV

SEQ ID NO: 2212432 - protein, 9 aa, Cryptosporidium parvum
DKNLNSSRK

SEQ ID NO: 2212433 - protein, 8 aa, Cryptosporidium parvum
DKNNPDLN

SEQ ID NO: 2212434 - protein, 6 aa, Cryptosporidium parvum
DKNNTN

SEQ ID NO: 2212435 - protein, 7 aa, Cryptosporidium parvum
DKNPDCE

SEQ ID NO: 2212436 - protein, 10 aa, Cryptosporidium parvum
DKNQRNSGIK

SEQ ID NO: 2212437 - protein, 6 aa, Cryptosporidium parvum
DKNSDS

SEQ ID NO: 2212438 - protein, 13 aa, Cryptosporidium parvum
DKNSECKTCGSNP

SEQ ID NO: 2212439 - protein, 8 aa, Cryptosporidium parvum
DKNSTIAG

SEQ ID NO: 2212440 - protein, 7 aa, Cryptosporidium parvum
DKNTGNE

SEQ ID NO: 2212441 - protein, 19 aa, Cryptosporidium parvum
DKNTKLSSSNDEKKSKTTR

SEQ ID NO: 2212442 - protein, 19 aa, Cryptosporidium parvum
DKPDGDNRPSSQEIPSQDQ

SEQ ID NO: 2212443 - protein, 6 aa, Cryptosporidium parvum
DKPGEF

SEQ ID NO: 2212444 - protein, 9 aa, Cryptosporidium parvum
DKPGTIDEG

SEQ ID NO: 2212445 - protein, 5 aa, Cryptosporidium parvum
DKPKS

SEQ ID NO: 2212446 - protein, 5 aa, Cryptosporidium parvum
DKQIY

SEQ ID NO: 2212447 - protein, 8 aa, Cryptosporidium parvum
DKQKHETI

SEQ ID NO: 2212448 - protein, 5 aa, Cryptosporidium parvum
DKQNN

SEQ ID NO: 2212449 - protein, 28 aa, Cryptosporidium parvum
DKRGKQAGKTKDKKNNVKKKRAPTVENQ

SEQ ID NO: 2212450 - protein, 5 aa, Cryptosporidium parvum
DKRGL

SEQ ID NO: 2212451 - protein, 7 aa, Cryptosporidium parvum
DKSAETE

SEQ ID NO: 2212452 - protein, 15 aa, Cryptosporidium parvum
DKSANQRKQEQFHQR

SEQ ID NO: 2212453 - protein, 5 aa, Cryptosporidium parvum
DKSCD

SEQ ID NO: 2212454 - protein, 7 aa, Cryptosporidium parvum
DKSDSIT

SEQ ID NO: 2212455 - protein, 7 aa, Cryptosporidium parvum
DKSDYSF

SEQ ID NO: 2212456 - protein, 11 aa, Cryptosporidium parvum
DKSFANKSHAY

SEQ ID NO: 2212457 - protein, 5 aa, Cryptosporidium parvum
DKSIH

SEQ ID NO: 2212458 - protein, 9 aa, Cryptosporidium parvum
DKSIPNTGT

SEQ ID NO: 2212459 - protein, 9 aa, Cryptosporidium parvum
DKSKRSAFL

SEQ ID NO: 2212460 - protein, 7 aa, Cryptosporidium parvum
DKSLNGT

SEQ ID NO: 2212461 - protein, 9 aa, Cryptosporidium parvum
DKSLQNRKE

SEQ ID NO: 2212462 - protein, 7 aa, Cryptosporidium parvum
DKSLTDS

SEQ ID NO: 2212463 - protein, 5 aa, Cryptosporidium parvum
DKSND

SEQ ID NO: 2212464 - protein, 8 aa, Cryptosporidium parvum
DKSNPAGY

SEQ ID NO: 2212465 - protein, 7 aa, Cryptosporidium parvum
DKSPELN

SEQ ID NO: 2212466 - protein, 8 aa, Cryptosporidium parvum
DKSPNGNL

SEQ ID NO: 2212467 - protein, 7 aa, Cryptosporidium parvum
DKSPYSS

SEQ ID NO: 2212468 - protein, 12 aa, Cryptosporidium parvum
DKSSNESYQSFK

SEQ ID NO: 2212469 - protein, 8 aa, Cryptosporidium parvum
DKSSSYTT

SEQ ID NO: 2212470 - protein, 6 aa, Cryptosporidium parvum
DKSTAS

SEQ ID NO: 2212471 - protein, 21 aa, Cryptosporidium parvum
DKSYNQHNNNVQDNFRCYTRI

SEQ ID NO: 2212472 - protein, 8 aa, Cryptosporidium parvum
DKSYQRNE

SEQ ID NO: 2212473 - protein, 8 aa, Cryptosporidium parvum
DKTDLNKG

SEQ ID NO: 2212474 - protein, 8 aa, Cryptosporidium parvum
DKTPKVRE

SEQ ID NO: 2212475 - protein, 12 aa, Cryptosporidium parvum
DKTQPGEIKSLS

SEQ ID NO: 2212476 - protein, 21 aa, Cryptosporidium parvum
DKTQSQSSENNISKNNERYNR

SEQ ID NO: 2212477 - protein, 7 aa, Cryptosporidium parvum
DKTQVGE

SEQ ID NO: 2212478 - protein, 5 aa, Cryptosporidium parvum
DKTSI

SEQ ID NO: 2212479 - protein, 5 aa, Cryptosporidium parvum
DKVDN

SEQ ID NO: 2212480 - protein, 6 aa, Cryptosporidium parvum
DKVSWN

SEQ ID NO: 2212481 - protein, 6 aa, Cryptosporidium parvum
DKWDGD

SEQ ID NO: 2212482 - protein, 7 aa, Cryptosporidium parvum
DKYQKSS

SEQ ID NO: 2212483 - protein, 13 aa, Cryptosporidium parvum
DKYRRESQTLRNS

SEQ ID NO: 2212484 - protein, 8 aa, Cryptosporidium parvum
DLDDEDKR

SEQ ID NO: 2212485 - protein, 14 aa, Cryptosporidium parvum
DLDGKFEDEESLTI

SEQ ID NO: 2212486 - protein, 31 aa, Cryptosporidium parvum
DLDKVKRSNKRRKRSSISSSSSSSSYGGNSH

SEQ ID NO: 2212487 - protein, 6 aa, Cryptosporidium parvum
DLDSKD

SEQ ID NO: 2212488 - protein, 8 aa, Cryptosporidium parvum
DLDSSTAL

SEQ ID NO: 2212489 - protein, 8 aa, Cryptosporidium parvum
DLEDDKSY

SEQ ID NO: 2212490 - protein, 14 aa, Cryptosporidium parvum
DLEDNLETKEETYY

SEQ ID NO: 2212491 - protein, 12 aa, Cryptosporidium parvum
DLEESPKSGRNI

SEQ ID NO: 2212492 - protein, 8 aa, Cryptosporidium parvum
DLENKSSK

SEQ ID NO: 2212493 - protein, 6 aa, Cryptosporidium parvum
DLEPSG

SEQ ID NO: 2212494 - protein, 5 aa, Cryptosporidium parvum
DLERS

SEQ ID NO: 2212495 - protein, 7 aa, Cryptosporidium parvum
DLGDGNA

SEQ ID NO: 2212496 - protein, 4 aa, Cryptosporidium parvum
DLHS

SEQ ID NO: 2212497 - protein, 5 aa, Cryptosporidium parvum
DLIPT

SEQ ID NO: 2212498 - protein, 11 aa, Cryptosporidium parvum
DLKQPKTNNYT

SEQ ID NO: 2212499 - protein, 10 aa, Cryptosporidium parvum
DLKSKKTSLK

SEQ ID NO: 2212500 - protein, 4 aa, Cryptosporidium parvum
DLKT

SEQ ID NO: 2212501 - protein, 7 aa, Cryptosporidium parvum
DLNGEDP

SEQ ID NO: 2212502 - protein, 7 aa, Cryptosporidium parvum
DLNPKMS

SEQ ID NO: 2212503 - protein, 4 aa, Cryptosporidium parvum
DLNS

SEQ ID NO: 2212504 - protein, 6 aa, Cryptosporidium parvum
DLNSEQ

SEQ ID NO: 2212505 - protein, 16 aa, Cryptosporidium parvum
DLNSKNNSLSTIPRKR

SEQ ID NO: 2212506 - protein, 4 aa, Cryptosporidium parvum
DLNT

SEQ ID NO: 2212507 - protein, 8 aa, Cryptosporidium parvum
DLNYNSNE

SEQ ID NO: 2212508 - protein, 6 aa, Cryptosporidium parvum
DLPERS

SEQ ID NO: 2212509 - protein, 5 aa, Cryptosporidium parvum
DLPSE

SEQ ID NO: 2212510 - protein, 7 aa, Cryptosporidium parvum
DLPSEPC

SEQ ID NO: 2212511 - protein, 14 aa, Cryptosporidium parvum
DLPSSSSSSSSSLS

SEQ ID NO: 2212512 - protein, 4 aa, Cryptosporidium parvum
DLPT

SEQ ID NO: 2212513 - protein, 6 aa, Cryptosporidium parvum
DLQATP

SEQ ID NO: 2212514 - protein, 6 aa, Cryptosporidium parvum
DLQTSS

SEQ ID NO: 2212515 - protein, 13 aa, Cryptosporidium parvum
DLRSGGTQKRLSR

SEQ ID NO: 2212516 - protein, 8 aa, Cryptosporidium parvum
DLRSTKRP

SEQ ID NO: 2212517 - protein, 6 aa, Cryptosporidium parvum
DLSAQE

SEQ ID NO: 2212518 - protein, 7 aa, Cryptosporidium parvum
DLSDDSE

SEQ ID NO: 2212519 - protein, 10 aa, Cryptosporidium parvum
DLSENEKEKK

SEQ ID NO: 2212520 - protein, 9 aa, Cryptosporidium parvum
DLSEPIKGN

SEQ ID NO: 2212521 - protein, 24 aa, Cryptosporidium parvum
DLSGGESSNEIDPEEFGRRKSSLD

SEQ ID NO: 2212522 - protein, 7 aa, Cryptosporidium parvum
DLSPTNV

SEQ ID NO: 2212523 - protein, 16 aa, Cryptosporidium parvum
DLSQSSSNSSYNSSPI

SEQ ID NO: 2212524 - protein, 4 aa, Cryptosporidium parvum
DLSR

SEQ ID NO: 2212525 - protein, 12 aa, Cryptosporidium parvum
DLSRNNTFSKET

SEQ ID NO: 2212526 - protein, 13 aa, Cryptosporidium parvum
DLSSNRSLQSYKH

SEQ ID NO: 2212527 - protein, 6 aa, Cryptosporidium parvum
DLSSPK

SEQ ID NO: 2212528 - protein, 8 aa, Cryptosporidium parvum
DLSTDSSI

SEQ ID NO: 2212529 - protein, 10 aa, Cryptosporidium parvum
DLSTGNGENW

SEQ ID NO: 2212530 - protein, 10 aa, Cryptosporidium parvum
DLTAGRENSS

SEQ ID NO: 2212531 - protein, 10 aa, Cryptosporidium parvum
DLTNDNNVGN

SEQ ID NO: 2212532 - protein, 4 aa, Cryptosporidium parvum
DLTP

SEQ ID NO: 2212533 - protein, 4 aa, Cryptosporidium parvum
DLTS

SEQ ID NO: 2212534 - protein, 21 aa, Cryptosporidium parvum
DMDDSKLSKKEKKKRKKRKKM

SEQ ID NO: 2212535 - protein, 7 aa, Cryptosporidium parvum
DMDNSTY

SEQ ID NO: 2212536 - protein, 6 aa, Cryptosporidium parvum
DMESTV

SEQ ID NO: 2212537 - protein, 30 aa, Cryptosporidium parvum
DMHGGNSTAGAYGQSMGTKRGVQPGGMNHP

SEQ ID NO: 2212538 - protein, 7 aa, Cryptosporidium parvum
DMKEQED

SEQ ID NO: 2212539 - protein, 4 aa, Cryptosporidium parvum
DMQK

SEQ ID NO: 2212540 - protein, 7 aa, Cryptosporidium parvum
DMSNHRN

SEQ ID NO: 2212541 - protein, 14 aa, Cryptosporidium parvum
DNCYPGQGGGNTGM

SEQ ID NO: 2212542 - protein, 43 aa, Cryptosporidium parvum
DNDDEDCNKDDDIDEDNELEDDDQDERINNQSDESNDENFSNK

SEQ ID NO: 2212543 - protein, 6 aa, Cryptosporidium parvum
DNDEEL

SEQ ID NO: 2212544 - protein, 9 aa, Cryptosporidium parvum
DNDEENSID

SEQ ID NO: 2212545 - protein, 7 aa, Cryptosporidium parvum
DNDEGIN

SEQ ID NO: 2212546 - protein, 12 aa, Cryptosporidium parvum
DNDEKNKGRKSK

SEQ ID NO: 2212547 - protein, 14 aa, Cryptosporidium parvum
DNDNNVDNNNIDNE

SEQ ID NO: 2212548 - protein, 18 aa, Cryptosporidium parvum
DNDRENNYFEQDEGDIGA

SEQ ID NO: 2212549 - protein, 12 aa, Cryptosporidium parvum
DNDSDNFNPHET

SEQ ID NO: 2212550 - protein, 13 aa, Cryptosporidium parvum
DNDSTKEIKKEHD

SEQ ID NO: 2212551 - protein, 4 aa, Cryptosporidium parvum
DNED

SEQ ID NO: 2212552 - protein, 5 aa, Cryptosporidium parvum
DNEGH

SEQ ID NO: 2212553 - protein, 6 aa, Cryptosporidium parvum
DNEGRT

SEQ ID NO: 2212554 - protein, 5 aa, Cryptosporidium parvum
DNEIE

SEQ ID NO: 2212555 - protein, 15 aa, Cryptosporidium parvum
DNEKRQVYDTTQGGE

SEQ ID NO: 2212556 - protein, 26 aa, Cryptosporidium parvum
DNEKSEVNEFNQGEAINRDQSERDEF

SEQ ID NO: 2212557 - protein, 4 aa, Cryptosporidium parvum
DNEL

SEQ ID NO: 2212558 - protein, 21 aa, Cryptosporidium parvum
DNEMEETTINPPSKSQAPKSR

SEQ ID NO: 2212559 - protein, 10 aa, Cryptosporidium parvum
DNENSGISSK

SEQ ID NO: 2212560 - protein, 14 aa, Cryptosporidium parvum
DNERKEKRTNDLET

SEQ ID NO: 2212561 - protein, 4 aa, Cryptosporidium parvum
DNES

SEQ ID NO: 2212562 - protein, 21 aa, Cryptosporidium parvum
DNESTYNFDDNNNKSINDSEI

SEQ ID NO: 2212563 - protein, 6 aa, Cryptosporidium parvum
DNFESS

SEQ ID NO: 2212564 - protein, 14 aa, Cryptosporidium parvum
DNFRQQQSHYKPPT

SEQ ID NO: 2212565 - protein, 9 aa, Cryptosporidium parvum
DNGAESSSF

SEQ ID NO: 2212566 - protein, 6 aa, Cryptosporidium parvum
DNGHDY

SEQ ID NO: 2212567 - protein, 6 aa, Cryptosporidium parvum
DNGNCG

SEQ ID NO: 2212568 - protein, 11 aa, Cryptosporidium parvum
DNGNCNEKKTK

SEQ ID NO: 2212569 - protein, 6 aa, Cryptosporidium parvum
DNGSYS

SEQ ID NO: 2212570 - protein, 8 aa, Cryptosporidium parvum
DNIPSENE

SEQ ID NO: 2212571 - protein, 5 aa, Cryptosporidium parvum
DNITE

SEQ ID NO: 2212572 - protein, 8 aa, Cryptosporidium parvum
DNKAHPQT

SEQ ID NO: 2212573 - protein, 9 aa, Cryptosporidium parvum
DNKEPRNKI

SEQ ID NO: 2212574 - protein, 6 aa, Cryptosporidium parvum
DNKGRT

SEQ ID NO: 2212575 - protein, 17 aa, Cryptosporidium parvum
DNKKDDDAAQEDQEAEL

SEQ ID NO: 2212576 - protein, 7 aa, Cryptosporidium parvum
DNKKEKM

SEQ ID NO: 2212577 - protein, 7 aa, Cryptosporidium parvum
DNKNLTS

SEQ ID NO: 2212578 - protein, 10 aa, Cryptosporidium parvum
DNKQEEFKNQ

SEQ ID NO: 2212579 - protein, 8 aa, Cryptosporidium parvum
DNKRQENT

SEQ ID NO: 2212580 - protein, 10 aa, Cryptosporidium parvum
DNKSSQHNGC

SEQ ID NO: 2212581 - protein, 24 aa, Cryptosporidium parvum
DNLEDSVSEIEGEISSNLSSFEEN

SEQ ID NO: 2212582 - protein, 9 aa, Cryptosporidium parvum
DNLTRSKYG

SEQ ID NO: 2212583 - protein, 4 aa, Cryptosporidium parvum
DNMK

SEQ ID NO: 2212584 - protein, 41 aa, Cryptosporidium parvum
DNMKKETNSINNKKHKDIGELDEGDISNESQNNLDQETKNI

SEQ ID NO: 2212585 - protein, 6 aa, Cryptosporidium parvum
DNMNID

SEQ ID NO: 2212586 - protein, 5 aa, Cryptosporidium parvum
DNNCS

SEQ ID NO: 2212587 - protein, 8 aa, Cryptosporidium parvum
DNNDDEDK

SEQ ID NO: 2212588 - protein, 11 aa, Cryptosporidium parvum
DNNDQKLGGSR

SEQ ID NO: 2212589 - protein, 26 aa, Cryptosporidium parvum
DNNEDVEGNKTFEKSNDLGENDNIEN

SEQ ID NO: 2212590 - protein, 18 aa, Cryptosporidium parvum
DNNENKDDGDDDNNKIPS

SEQ ID NO: 2212591 - protein, 5 aa, Cryptosporidium parvum
DNNEQ

SEQ ID NO: 2212592 - protein, 25 aa, Cryptosporidium parvum
DNNEQTNKTDANWKRRPSSNKGTEH

SEQ ID NO: 2212593 - protein, 16 aa, Cryptosporidium parvum
DNNKNNEIKIEQKESV

SEQ ID NO: 2212594 - protein, 11 aa, Cryptosporidium parvum
DNNNNNSDLKN

SEQ ID NO: 2212595 - protein, 8 aa, Cryptosporidium parvum
DNNPPREF

SEQ ID NO: 2212596 - protein, 5 aa, Cryptosporidium parvum
DNNPY

SEQ ID NO: 2212597 - protein, 4 aa, Cryptosporidium parvum
DNNS

SEQ ID NO: 2212598 - protein, 6 aa, Cryptosporidium parvum
DNNSDF

SEQ ID NO: 2212599 - protein, 7 aa, Cryptosporidium parvum
DNNSEKF

SEQ ID NO: 2212600 - protein, 26 aa, Cryptosporidium parvum
  misc_feature (15)..(15): Xaa can be any naturally occurring amino acid
  misc_feature (17)..(18): Xaa can be any naturally occurring amino acid
  misc_feature (20)..(23): Xaa can be any naturally occurring amino acid
  misc_feature (25)..(25): Xaa can be any naturally occurring amino acid
DNNTNQLNCQELQNXEXXIXXXXRXD

SEQ ID NO: 2212601 - protein, 5 aa, Cryptosporidium parvum
DNNTS

SEQ ID NO: 2212602 - protein, 6 aa, Cryptosporidium parvum
DNNTTS

SEQ ID NO: 2212603 - protein, 13 aa, Cryptosporidium parvum
DNNVGGIDGRNEV

SEQ ID NO: 2212604 - protein, 7 aa, Cryptosporidium parvum
DNNYKQL

SEQ ID NO: 2212605 - protein, 7 aa, Cryptosporidium parvum
DNPDAPL

SEQ ID NO: 2212606 - protein, 9 aa, Cryptosporidium parvum
DNPDQRIGE

SEQ ID NO: 2212607 - protein, 5 aa, Cryptosporidium parvum
DNPFS

SEQ ID NO: 2212608 - protein, 5 aa, Cryptosporidium parvum
DNPKL

SEQ ID NO: 2212609 - protein, 12 aa, Cryptosporidium parvum
DNPMDSNGTDNL

SEQ ID NO: 2212610 - protein, 5 aa, Cryptosporidium parvum
DNPNN

SEQ ID NO: 2212611 - protein, 10 aa, Cryptosporidium parvum
DNPSVAESGY

SEQ ID NO: 2212612 - protein, 5 aa, Cryptosporidium parvum
DNPTS

SEQ ID NO: 2212613 - protein, 8 aa, Cryptosporidium parvum
DNPTTLYT

SEQ ID NO: 2212614 - protein, 17 aa, Cryptosporidium parvum
DNQANGISSKSEPKSTN

SEQ ID NO: 2212615 - protein, 22 aa, Cryptosporidium parvum
DNQLSTDTEDEDDDAAERSSST

SEQ ID NO: 2212616 - protein, 13 aa, Cryptosporidium parvum
DNQNSNTNNRNVS

SEQ ID NO: 2212617 - protein, 14 aa, Cryptosporidium parvum
DNQSKTKDPNSPIS

SEQ ID NO: 2212618 - protein, 7 aa, Cryptosporidium parvum
DNRDNSI

SEQ ID NO: 2212619 - protein, 11 aa, Cryptosporidium parvum
DNREINERKTK

SEQ ID NO: 2212620 - protein, 13 aa, Cryptosporidium parvum
DNRGSTDSSIQPS

SEQ ID NO: 2212621 - protein, 9 aa, Cryptosporidium parvum
DNRNTAEAI

SEQ ID NO: 2212622 - protein, 6 aa, Cryptosporidium parvum
DNRQEG

SEQ ID NO: 2212623 - protein, 8 aa, Cryptosporidium parvum
DNRSSESF

SEQ ID NO: 2212624 - protein, 8 aa, Cryptosporidium parvum
DNRTSKNL

SEQ ID NO: 2212625 - protein, 12 aa, Cryptosporidium parvum
DNSAENTKLKEE

SEQ ID NO: 2212626 - protein, 7 aa, Cryptosporidium parvum
DNSEERT

SEQ ID NO: 2212627 - protein, 8 aa, Cryptosporidium parvum
DNSEESEI

SEQ ID NO: 2212628 - protein, 24 aa, Cryptosporidium parvum
DNSEGGLSPINSAESEGLNGSIGD

SEQ ID NO: 2212629 - protein, 5 aa, Cryptosporidium parvum
DNSGE

SEQ ID NO: 2212630 - protein, 8 aa, Cryptosporidium parvum
DNSHVNEN

SEQ ID NO: 2212631 - protein, 4 aa, Cryptosporidium parvum
DNSL

SEQ ID NO: 2212632 - protein, 5 aa, Cryptosporidium parvum
DNSLR

SEQ ID NO: 2212633 - protein, 17 aa, Cryptosporidium parvum
DNSNESSDPDNKSIRKK

SEQ ID NO: 2212634 - protein, 12 aa, Cryptosporidium parvum
DNSNINTNDQSI

SEQ ID NO: 2212635 - protein, 8 aa, Cryptosporidium parvum
DNSNNKLS

SEQ ID NO: 2212636 - protein, 36 aa, Cryptosporidium parvum
DNSNNSTSAGIGISTSTNTNINTGNCTKNDNMSSNL

SEQ ID NO: 2212637 - protein, 17 aa, Cryptosporidium parvum
DNSSDLGGTNDQDTKNL

SEQ ID NO: 2212638 - protein, 8 aa, Cryptosporidium parvum
DNSSISSV

SEQ ID NO: 2212639 - protein, 4 aa, Cryptosporidium parvum
DNST

SEQ ID NO: 2212640 - protein, 7 aa, Cryptosporidium parvum
DNSTSKI

SEQ ID NO: 2212641 - protein, 5 aa, Cryptosporidium parvum
DNSTT

SEQ ID NO: 2212642 - protein, 8 aa, Cryptosporidium parvum
DNSYSESN

SEQ ID NO: 2212643 - protein, 10 aa, Cryptosporidium parvum
DNTDFKENNN

SEQ ID NO: 2212644 - protein, 12 aa, Cryptosporidium parvum
DNTDVQRSRARK

SEQ ID NO: 2212645 - protein, 5 aa, Cryptosporidium parvum
DNTEL

SEQ ID NO: 2212646 - protein, 7 aa, Cryptosporidium parvum
DNTHQEN

SEQ ID NO: 2212647 - protein, 4 aa, Cryptosporidium parvum
DNTI

SEQ ID NO: 2212648 - protein, 16 aa, Cryptosporidium parvum
DNTKNYSQIKKNKSYK

SEQ ID NO: 2212649 - protein, 29 aa, Cryptosporidium parvum
DNTKSQNITTHKQEAKEDFPDISDTIGRH

SEQ ID NO: 2212650 - protein, 16 aa, Cryptosporidium parvum
DNTPKNTKQEETIKEQ

SEQ ID NO: 2212651 - protein, 5 aa, Cryptosporidium parvum
DNTPS

SEQ ID NO: 2212652 - protein, 7 aa, Cryptosporidium parvum
DNVGRNN

SEQ ID NO: 2212653 - protein, 5 aa, Cryptosporidium parvum
DNVIK

SEQ ID NO: 2212654 - protein, 17 aa, Cryptosporidium parvum
DNVKDSEVVKSSKSSSL

SEQ ID NO: 2212655 - protein, 4 aa, Cryptosporidium parvum
DNYE

SEQ ID NO: 2212656 - protein, 19 aa, Cryptosporidium parvum
DNYNNSEDNIENDYSIDSN

SEQ ID NO: 2212657 - protein, 7 aa, Cryptosporidium parvum
DNYNSEQ

SEQ ID NO: 2212658 - protein, 8 aa, Cryptosporidium parvum
DNYRPSIQ

SEQ ID NO: 2212659 - protein, 8 aa, Cryptosporidium parvum
DNYSEQEK

SEQ ID NO: 2212660 - protein, 11 aa, Cryptosporidium parvum
DPAAEGINPQE

SEQ ID NO: 2212661 - protein, 8 aa, Cryptosporidium parvum
DPAHGSTI

SEQ ID NO: 2212662 - protein, 5 aa, Cryptosporidium parvum
DPAQR

SEQ ID NO: 2212663 - protein, 8 aa, Cryptosporidium parvum
DPATREYR

SEQ ID NO: 2212664 - protein, 6 aa, Cryptosporidium parvum
DPDDSI

SEQ ID NO: 2212665 - protein, 8 aa, Cryptosporidium parvum
DPDDSSLI

SEQ ID NO: 2212666 - protein, 10 aa, Cryptosporidium parvum
DPDDYGTSNK

SEQ ID NO: 2212667 - protein, 5 aa, Cryptosporidium parvum
DPDKG

SEQ ID NO: 2212668 - protein, 8 aa, Cryptosporidium parvum
DPDYYENP

SEQ ID NO: 2212669 - protein, 11 aa, Cryptosporidium parvum
DPEAQDDETSS

SEQ ID NO: 2212670 - protein, 6 aa, Cryptosporidium parvum
DPEFDQ

SEQ ID NO: 2212671 - protein, 10 aa, Cryptosporidium parvum
DPEGQRSSED

SEQ ID NO: 2212672 - protein, 5 aa, Cryptosporidium parvum
DPEKC

SEQ ID NO: 2212673 - protein, 5 aa, Cryptosporidium parvum
DPEKI

SEQ ID NO: 2212674 - protein, 4 aa, Cryptosporidium parvum
DPEN

SEQ ID NO: 2212675 - protein, 5 aa, Cryptosporidium parvum
DPENL

SEQ ID NO: 2212676 - protein, 9 aa, Cryptosporidium parvum
DPESQIEST

SEQ ID NO: 2212677 - protein, 5 aa, Cryptosporidium parvum
DPETN

SEQ ID NO: 2212678 - protein, 6 aa, Cryptosporidium parvum
DPETQE

SEQ ID NO: 2212679 - protein, 4 aa, Cryptosporidium parvum
DPFH

SEQ ID NO: 2212680 - protein, 14 aa, Cryptosporidium parvum
DPFNSKNRDYKAYR

SEQ ID NO: 2212681 - protein, 5 aa, Cryptosporidium parvum
DPFPL

SEQ ID NO: 2212682 - protein, 8 aa, Cryptosporidium parvum
DPFSRRRT

SEQ ID NO: 2212683 - protein, 7 aa, Cryptosporidium parvum
DPGGHNG

SEQ ID NO: 2212684 - protein, 4 aa, Cryptosporidium parvum
DPGY

SEQ ID NO: 2212685 - protein, 4 aa, Cryptosporidium parvum
DPIE

SEQ ID NO: 2212686 - protein, 4 aa, Cryptosporidium parvum
DPIQ

SEQ ID NO: 2212687 - protein, 14 aa, Cryptosporidium parvum
DPKCTQDLSAETDS

SEQ ID NO: 2212688 - protein, 6 aa, Cryptosporidium parvum
DPKELA

SEQ ID NO: 2212689 - protein, 10 aa, Cryptosporidium parvum
DPKGSYSDEE

SEQ ID NO: 2212690 - protein, 6 aa, Cryptosporidium parvum
DPKKNT

SEQ ID NO: 2212691 - protein, 10 aa, Cryptosporidium parvum
DPKNGEFSED

SEQ ID NO: 2212692 - protein, 4 aa, Cryptosporidium parvum
DPKS

SEQ ID NO: 2212693 - protein, 6 aa, Cryptosporidium parvum
DPKSGN

SEQ ID NO: 2212694 - protein, 8 aa, Cryptosporidium parvum
DPKSPEFE

SEQ ID NO: 2212695 - protein, 9 aa, Cryptosporidium parvum
DPKSPLYKG

SEQ ID NO: 2212696 - protein, 17 aa, Cryptosporidium parvum
DPKTGEKDRSTESLSRK

SEQ ID NO: 2212697 - protein, 19 aa, Cryptosporidium parvum
DPKTNEEAVDHNQNGTGNI

SEQ ID NO: 2212698 - protein, 27 aa, Cryptosporidium parvum
DPKTNEEVVDRNQDYAGNRSPAKYTSR

SEQ ID NO: 2212699 - protein, 7 aa, Cryptosporidium parvum
DPKTNSP

SEQ ID NO: 2212700 - protein, 8 aa, Cryptosporidium parvum
DPKTSKDV

SEQ ID NO: 2212701 - protein, 4 aa, Cryptosporidium parvum
DPKY

SEQ ID NO: 2212702 - protein, 16 aa, Cryptosporidium parvum
DPLNSSENNRKLDQDN

SEQ ID NO: 2212703 - protein, 6 aa, Cryptosporidium parvum
DPLSET

SEQ ID NO: 2212704 - protein, 11 aa, Cryptosporidium parvum
DPLSSTESDDI

SEQ ID NO: 2212705 - protein, 6 aa, Cryptosporidium parvum
DPNASR

SEQ ID NO: 2212706 - protein, 9 aa, Cryptosporidium parvum
DPNDPGSSF

SEQ ID NO: 2212707 - protein, 8 aa, Cryptosporidium parvum
DPNDPSQH

SEQ ID NO: 2212708 - protein, 5 aa, Cryptosporidium parvum
DPNEM

SEQ ID NO: 2212709 - protein, 8 aa, Cryptosporidium parvum
DPNGSKIS

SEQ ID NO: 2212710 - protein, 5 aa, Cryptosporidium parvum
DPNHE

SEQ ID NO: 2212711 - protein, 4 aa, Cryptosporidium parvum
DPNL

SEQ ID NO: 2212712 - protein, 8 aa, Cryptosporidium parvum
DPNRSNIN

SEQ ID NO: 2212713 - protein, 5 aa, Cryptosporidium parvum
DPNSF

SEQ ID NO: 2212714 - protein, 8 aa, Cryptosporidium parvum
DPNSNSES

SEQ ID NO: 2212715 - protein, 14 aa, Cryptosporidium parvum
DPNTEYNDFGSPVR

SEQ ID NO: 2212716 - protein, 7 aa, Cryptosporidium parvum
DPNTNSI

SEQ ID NO: 2212717 - protein, 8 aa, Cryptosporidium parvum
DPPRPGVK

SEQ ID NO: 2212718 - protein, 5 aa, Cryptosporidium parvum
DPPRS

SEQ ID NO: 2212719 - protein, 10 aa, Cryptosporidium parvum
DPPSEKPSEY

SEQ ID NO: 2212720 - protein, 14 aa, Cryptosporidium parvum
DPPSQGKHSSMQQQ

SEQ ID NO: 2212721 - protein, 8 aa, Cryptosporidium parvum
DPQQPRTS

SEQ ID NO: 2212722 - protein, 6 aa, Cryptosporidium parvum
DPQSES

SEQ ID NO: 2212723 - protein, 4 aa, Cryptosporidium parvum
DPRP

SEQ ID NO: 2212724 - protein, 6 aa, Cryptosporidium parvum
DPRTGL

SEQ ID NO: 2212725 - protein, 14 aa, Cryptosporidium parvum
DPSAPKSSKVTISK

SEQ ID NO: 2212726 - protein, 7 aa, Cryptosporidium parvum
DPSDGNT

SEQ ID NO: 2212727 - protein, 8 aa, Cryptosporidium parvum
DPSDSDGV

SEQ ID NO: 2212728 - protein, 5 aa, Cryptosporidium parvum
DPSER

SEQ ID NO: 2212729 - protein, 12 aa, Cryptosporidium parvum
DPSLERNNTRKK

SEQ ID NO: 2212730 - protein, 5 aa, Cryptosporidium parvum
DPSQL

SEQ ID NO: 2212731 - protein, 6 aa, Cryptosporidium parvum
DPSSIE

SEQ ID NO: 2212732 - protein, 8 aa, Cryptosporidium parvum
DPSSNQTC

SEQ ID NO: 2212733 - protein, 10 aa, Cryptosporidium parvum
DPSTKNYRGD

SEQ ID NO: 2212734 - protein, 8 aa, Cryptosporidium parvum
DPSTPLRN

SEQ ID NO: 2212735 - protein, 5 aa, Cryptosporidium parvum
DPTEK

SEQ ID NO: 2212736 - protein, 6 aa, Cryptosporidium parvum
DPTEKD

SEQ ID NO: 2212737 - protein, 4 aa, Cryptosporidium parvum
DPTI

SEQ ID NO: 2212738 - protein, 5 aa, Cryptosporidium parvum
DPTIG

SEQ ID NO: 2212739 - protein, 5 aa, Cryptosporidium parvum
DPTNL

SEQ ID NO: 2212740 - protein, 7 aa, Cryptosporidium parvum
DPTNSDE

SEQ ID NO: 2212741 - protein, 11 aa, Cryptosporidium parvum
DPTNVGNSEFE

SEQ ID NO: 2212742 - protein, 5 aa, Cryptosporidium parvum
DPTTS

SEQ ID NO: 2212743 - protein, 19 aa, Cryptosporidium parvum
DPTYRTDRTHRVSHDQKSA

SEQ ID NO: 2212744 - protein, 6 aa, Cryptosporidium parvum
DPYDNE

SEQ ID NO: 2212745 - protein, 7 aa, Cryptosporidium parvum
DPYGDAQ

SEQ ID NO: 2212746 - protein, 5 aa, Cryptosporidium parvum
DPYSV

SEQ ID NO: 2212747 - protein, 6 aa, Cryptosporidium parvum
DQANSL

SEQ ID NO: 2212748 - protein, 10 aa, Cryptosporidium parvum
DQANSSNNTL

SEQ ID NO: 2212749 - protein, 8 aa, Cryptosporidium parvum
DQDFSSNS

SEQ ID NO: 2212750 - protein, 10 aa, Cryptosporidium parvum
DQDIQPSNSI

SEQ ID NO: 2212751 - protein, 19 aa, Cryptosporidium parvum
DQDLDQDEEQDPEQEDCHN

SEQ ID NO: 2212752 - protein, 9 aa, Cryptosporidium parvum
DQDSSKVSR

SEQ ID NO: 2212753 - protein, 5 aa, Cryptosporidium parvum
DQDTI

SEQ ID NO: 2212754 - protein, 9 aa, Cryptosporidium parvum
DQDYEKDAN

SEQ ID NO: 2212755 - protein, 4 aa, Cryptosporidium parvum
DQEE

SEQ ID NO: 2212756 - protein, 19 aa, Cryptosporidium parvum
DQEEEEDDDDEDSSGNDQR

SEQ ID NO: 2212757 - protein, 18 aa, Cryptosporidium parvum
DQEEGYEINGDNSLKQGA

SEQ ID NO: 2212758 - protein, 9 aa, Cryptosporidium parvum
DQEETEKMV

SEQ ID NO: 2212759 - protein, 6 aa, Cryptosporidium parvum
DQEIGG

SEQ ID NO: 2212760 - protein, 9 aa, Cryptosporidium parvum
DQEKSNINV

SEQ ID NO: 2212761 - protein, 13 aa, Cryptosporidium parvum
DQESQLTTSRYPE

SEQ ID NO: 2212762 - protein, 9 aa, Cryptosporidium parvum
DQFKSQKNL

SEQ ID NO: 2212763 - protein, 26 aa, Cryptosporidium parvum
DQGIDRYRNSQDPHKIKDDPIEKNSP

SEQ ID NO: 2212764 - protein, 11 aa, Cryptosporidium parvum
DQGIRNDGRDL

SEQ ID NO: 2212765 - protein, 10 aa, Cryptosporidium parvum
DQGNNSRDEE

SEQ ID NO: 2212766 - protein, 4 aa, Cryptosporidium parvum
DQIA

SEQ ID NO: 2212767 - protein, 6 aa, Cryptosporidium parvum
DQISDD

SEQ ID NO: 2212768 - protein, 9 aa, Cryptosporidium parvum
DQKEINKNE

SEQ ID NO: 2212769 - protein, 15 aa, Cryptosporidium parvum
DQKLNKENNDNLKPN

SEQ ID NO: 2212770 - protein, 15 aa, Cryptosporidium parvum
DQKSESSKNPNIEEK

SEQ ID NO: 2212771 - protein, 5 aa, Cryptosporidium parvum
DQKSR

SEQ ID NO: 2212772 - protein, 6 aa, Cryptosporidium parvum
DQKSTN

SEQ ID NO: 2212773 - protein, 8 aa, Cryptosporidium parvum
DQKTPKLE

SEQ ID NO: 2212774 - protein, 9 aa, Cryptosporidium parvum
DQLKGGPHY

SEQ ID NO: 2212775 - protein, 12 aa, Cryptosporidium parvum
DQLSSKANNDEI

SEQ ID NO: 2212776 - protein, 18 aa, Cryptosporidium parvum
DQNDPNDKSKNDKSKKYM

SEQ ID NO: 2212777 - protein, 8 aa, Cryptosporidium parvum
DQNKRSDL

SEQ ID NO: 2212778 - protein, 5 aa, Cryptosporidium parvum
DQNKY

SEQ ID NO: 2212779 - protein, 8 aa, Cryptosporidium parvum
DQNNQGGI

SEQ ID NO: 2212780 - protein, 8 aa, Cryptosporidium parvum
DQNQRKAK

SEQ ID NO: 2212781 - protein, 18 aa, Cryptosporidium parvum
DQPHGGGSSISGEPFSSS

SEQ ID NO: 2212782 - protein, 13 aa, Cryptosporidium parvum
DQPSPISPAPPPF

SEQ ID NO: 2212783 - protein, 7 aa, Cryptosporidium parvum
DQQITDE

SEQ ID NO: 2212784 - protein, 6 aa, Cryptosporidium parvum
DQQPTA

SEQ ID NO: 2212785 - protein, 12 aa, Cryptosporidium parvum
DQRIPDEYKDPE

SEQ ID NO: 2212786 - protein, 6 aa, Cryptosporidium parvum
DQRKHE

SEQ ID NO: 2212787 - protein, 8 aa, Cryptosporidium parvum
DQRLVQEG

SEQ ID NO: 2212788 - protein, 7 aa, Cryptosporidium parvum
DQSDMAE

SEQ ID NO: 2212789 - protein, 12 aa, Cryptosporidium parvum
DQSENSQIDSSD

SEQ ID NO: 2212790 - protein, 8 aa, Cryptosporidium parvum
DQSGGKGL

SEQ ID NO: 2212791 - protein, 8 aa, Cryptosporidium parvum
DQSKVPTK

SEQ ID NO: 2212792 - protein, 9 aa, Cryptosporidium parvum
DQSNTEKFT

SEQ ID NO: 2212793 - protein, 19 aa, Cryptosporidium parvum
DQSPTSPAQPQKIDPNSNH

SEQ ID NO: 2212794 - protein, 5 aa, Cryptosporidium parvum
DQSSI

SEQ ID NO: 2212795 - protein, 7 aa, Cryptosporidium parvum
DQSSQEL

SEQ ID NO: 2212796 - protein, 8 aa, Cryptosporidium parvum
DQSTPTVN

SEQ ID NO: 2212797 - protein, 14 aa, Cryptosporidium parvum
DQSTQDKEFSPKSC

SEQ ID NO: 2212798 - protein, 5 aa, Cryptosporidium parvum
DQSTS

SEQ ID NO: 2212799 - protein, 19 aa, Cryptosporidium parvum
DQTIENSNNRSKLQKKREI

SEQ ID NO: 2212800 - protein, 6 aa, Cryptosporidium parvum
DQTISG

SEQ ID NO: 2212801 - protein, 4 aa, Cryptosporidium parvum
DQTP

SEQ ID NO: 2212802 - protein, 27 aa, Cryptosporidium parvum
DQTQDQDHKQERGDSESNKRLEKTNFE

SEQ ID NO: 2212803 - protein, 6 aa, Cryptosporidium parvum
DQVKKA

SEQ ID NO: 2212804 - protein, 11 aa, Cryptosporidium parvum
DQVNDNLKKEK

SEQ ID NO: 2212805 - protein, 9 aa, Cryptosporidium parvum
DQVNENTNI

SEQ ID NO: 2212806 - protein, 18 aa, Cryptosporidium parvum
DRANTDNSIKSFDDSVDG

SEQ ID NO: 2212807 - protein, 11 aa, Cryptosporidium parvum
DRAQDKCRAPN

SEQ ID NO: 2212808 - protein, 4 aa, Cryptosporidium parvum
DRAR

SEQ ID NO: 2212809 - protein, 4 aa, Cryptosporidium parvum
DRDE

SEQ ID NO: 2212810 - protein, 4 aa, Cryptosporidium parvum
DRDS

SEQ ID NO: 2212811 - protein, 5 aa, Cryptosporidium parvum
DREGI

SEQ ID NO: 2212812 - protein, 4 aa, Cryptosporidium parvum
DRES

SEQ ID NO: 2212813 - protein, 5 aa, Cryptosporidium parvum
DRETS

SEQ ID NO: 2212814 - protein, 4 aa, Cryptosporidium parvum
DRFG

SEQ ID NO: 2212815 - protein, 10 aa, Cryptosporidium parvum
DRGDDTGASI

SEQ ID NO: 2212816 - protein, 10 aa, Cryptosporidium parvum
DRGREEKSEG

SEQ ID NO: 2212817 - protein, 7 aa, Cryptosporidium parvum
DRGRLGY

SEQ ID NO: 2212818 - protein, 14 aa, Cryptosporidium parvum
DRHDRSEKDFTGFG

SEQ ID NO: 2212819 - protein, 5 aa, Cryptosporidium parvum
DRHPN

SEQ ID NO: 2212820 - protein, 12 aa, Cryptosporidium parvum
DRKRSGLSRRIT

SEQ ID NO: 2212821 - protein, 4 aa, Cryptosporidium parvum
DRKY

SEQ ID NO: 2212822 - protein, 8 aa, Cryptosporidium parvum
DRLPSVTY

SEQ ID NO: 2212823 - protein, 4 aa, Cryptosporidium parvum
DRME

SEQ ID NO: 2212824 - protein, 6 aa, Cryptosporidium parvum
DRNDKD

SEQ ID NO: 2212825 - protein, 4 aa, Cryptosporidium parvum
DRNG

SEQ ID NO: 2212826 - protein, 10 aa, Cryptosporidium parvum
DRNKDHIKDN

SEQ ID NO: 2212827 - protein, 6 aa, Cryptosporidium parvum
DRNQTN

SEQ ID NO: 2212828 - protein, 7 aa, Cryptosporidium parvum
DRNSEGS

SEQ ID NO: 2212829 - protein, 7 aa, Cryptosporidium parvum
DRNSQIE

SEQ ID NO: 2212830 - protein, 7 aa, Cryptosporidium parvum
DRNSTDE

SEQ ID NO: 2212831 - protein, 7 aa, Cryptosporidium parvum
DRPEAQE

SEQ ID NO: 2212832 - protein, 7 aa, Cryptosporidium parvum
DRPFPPN

SEQ ID NO: 2212833 - protein, 13 aa, Cryptosporidium parvum
DRPNDDFKPLDSI

SEQ ID NO: 2212834 - protein, 6 aa, Cryptosporidium parvum
DRQETA

SEQ ID NO: 2212835 - protein, 5 aa, Cryptosporidium parvum
DRQLS

SEQ ID NO: 2212836 - protein, 7 aa, Cryptosporidium parvum
DRQYSDK

SEQ ID NO: 2212837 - protein, 9 aa, Cryptosporidium parvum
DRRKKEKIS

SEQ ID NO: 2212838 - protein, 4 aa, Cryptosporidium parvum
DRSA

SEQ ID NO: 2212839 - protein, 4 aa, Cryptosporidium parvum
DRSI

SEQ ID NO: 2212840 - protein, 11 aa, Cryptosporidium parvum
DRSNTTKKIVK

SEQ ID NO: 2212841 - protein, 10 aa, Cryptosporidium parvum
DRTDNNYQFS

SEQ ID NO: 2212842 - protein, 32 aa, Cryptosporidium parvum
DSAERLKSSVNSQINEIEDSENERLNSNRNRY

SEQ ID NO: 2212843 - protein, 7 aa, Cryptosporidium parvum
DSAGNNP

SEQ ID NO: 2212844 - protein, 7 aa, Cryptosporidium parvum
DSASPNE

SEQ ID NO: 2212845 - protein, 9 aa, Cryptosporidium parvum
DSASSQSSL

SEQ ID NO: 2212846 - protein, 10 aa, Cryptosporidium parvum
DSCAKSGDLA

SEQ ID NO: 2212847 - protein, 5 aa, Cryptosporidium parvum
DSCHR

SEQ ID NO: 2212848 - protein, 6 aa, Cryptosporidium parvum
DSDEAD

SEQ ID NO: 2212849 - protein, 4 aa, Cryptosporidium parvum
DSDF

SEQ ID NO: 2212850 - protein, 9 aa, Cryptosporidium parvum
DSDGQGALG

SEQ ID NO: 2212851 - protein, 7 aa, Cryptosporidium parvum
DSDHTNF

SEQ ID NO: 2212852 - protein, 12 aa, Cryptosporidium parvum
DSDKKELRSSKD

SEQ ID NO: 2212853 - protein, 5 aa, Cryptosporidium parvum
DSDLQ

SEQ ID NO: 2212854 - protein, 11 aa, Cryptosporidium parvum
DSDNAFNKSKT

SEQ ID NO: 2212855 - protein, 17 aa, Cryptosporidium parvum
DSDNSHSSFKYNSNNSL

SEQ ID NO: 2212856 - protein, 36 aa, Cryptosporidium parvum
DSDTDSDSSEPGTPTSKSSSSGSESDTSVPGTPVTK

SEQ ID NO: 2212857 - protein, 8 aa, Cryptosporidium parvum
DSEDGRDR

SEQ ID NO: 2212858 - protein, 7 aa, Cryptosporidium parvum
DSEETRF

SEQ ID NO: 2212859 - protein, 11 aa, Cryptosporidium parvum
DSEHSGDREVQ

SEQ ID NO: 2212860 - protein, 9 aa, Cryptosporidium parvum
DSEINNNSK

SEQ ID NO: 2212861 - protein, 18 aa, Cryptosporidium parvum
DSEKKSSKNHLNRETSYQ

SEQ ID NO: 2212862 - protein, 5 aa, Cryptosporidium parvum
DSEKL

SEQ ID NO: 2212863 - protein, 9 aa, Cryptosporidium parvum
DSEKNQAIS

SEQ ID NO: 2212864 - protein, 4 aa, Cryptosporidium parvum
DSEN

SEQ ID NO: 2212865 - protein, 7 aa, Cryptosporidium parvum
DSENFER

SEQ ID NO: 2212866 - protein, 7 aa, Cryptosporidium parvum
DSENPRE

SEQ ID NO: 2212867 - protein, 4 aa, Cryptosporidium parvum
DSEQ

SEQ ID NO: 2212868 - protein, 6 aa, Cryptosporidium parvum
DSESDS

SEQ ID NO: 2212869 - protein, 19 aa, Cryptosporidium parvum
DSESEYSANFSEKSQIDSR

SEQ ID NO: 2212870 - protein, 12 aa, Cryptosporidium parvum
DSESISKGFSPD

SEQ ID NO: 2212871 - protein, 7 aa, Cryptosporidium parvum
DSESLLN

SEQ ID NO: 2212872 - protein, 14 aa, Cryptosporidium parvum
DSETQKNEDSSKEM

SEQ ID NO: 2212873 - protein, 4 aa, Cryptosporidium parvum
DSEW

SEQ ID NO: 2212874 - protein, 7 aa, Cryptosporidium parvum
DSEWRNR

SEQ ID NO: 2212875 - protein, 4 aa, Cryptosporidium parvum
DSFN

SEQ ID NO: 2212876 - protein, 4 aa, Cryptosporidium parvum
DSFR

SEQ ID NO: 2212877 - protein, 6 aa, Cryptosporidium parvum
DSFSPD

SEQ ID NO: 2212878 - protein, 11 aa, Cryptosporidium parvum
DSGADSNPFAE

SEQ ID NO: 2212879 - protein, 6 aa, Cryptosporidium parvum
DSGANW

SEQ ID NO: 2212880 - protein, 6 aa, Cryptosporidium parvum
DSGESC

SEQ ID NO: 2212881 - protein, 14 aa, Cryptosporidium parvum
DSGLGDELKRSNQL

SEQ ID NO: 2212882 - protein, 7 aa, Cryptosporidium parvum
DSGLQDV

SEQ ID NO: 2212883 - protein, 7 aa, Cryptosporidium parvum
DSGNEFK

SEQ ID NO: 2212884 - protein, 11 aa, Cryptosporidium parvum
DSHSNKCPTRI

SEQ ID NO: 2212885 - protein, 8 aa, Cryptosporidium parvum
DSHTRSST

SEQ ID NO: 2212886 - protein, 7 aa, Cryptosporidium parvum
DSIGSNL

SEQ ID NO: 2212887 - protein, 9 aa, Cryptosporidium parvum
DSINRRNEE

SEQ ID NO: 2212888 - protein, 8 aa, Cryptosporidium parvum
DSINSNGE

SEQ ID NO: 2212889 - protein, 4 aa, Cryptosporidium parvum
DSIS

SEQ ID NO: 2212890 - protein, 8 aa, Cryptosporidium parvum
DSKDPSAV

SEQ ID NO: 2212891 - protein, 9 aa, Cryptosporidium parvum
DSKIKEDKL

SEQ ID NO: 2212892 - protein, 5 aa, Cryptosporidium parvum
DSKKL

SEQ ID NO: 2212893 - protein, 8 aa, Cryptosporidium parvum
DSKKQVEI

SEQ ID NO: 2212894 - protein, 4 aa, Cryptosporidium parvum
DSKN

SEQ ID NO: 2212895 - protein, 9 aa, Cryptosporidium parvum
DSKNAINND

SEQ ID NO: 2212896 - protein, 6 aa, Cryptosporidium parvum
DSKNKY

SEQ ID NO: 2212897 - protein, 9 aa, Cryptosporidium parvum
DSKNSGKIN

SEQ ID NO: 2212898 - protein, 8 aa, Cryptosporidium parvum
DSKNTSNN

SEQ ID NO: 2212899 - protein, 10 aa, Cryptosporidium parvum
DSKPQCPEGT

SEQ ID NO: 2212900 - protein, 11 aa, Cryptosporidium parvum
DSKPTGGGSIG

SEQ ID NO: 2212901 - protein, 7 aa, Cryptosporidium parvum
DSKQPEL

SEQ ID NO: 2212902 - protein, 7 aa, Cryptosporidium parvum
DSKTKDR

SEQ ID NO: 2212903 - protein, 7 aa, Cryptosporidium parvum
DSKTSIW

SEQ ID NO: 2212904 - protein, 10 aa, Cryptosporidium parvum
DSKVDEARNW

SEQ ID NO: 2212905 - protein, 7 aa, Cryptosporidium parvum
DSKVNTQ

SEQ ID NO: 2212906 - protein, 5 aa, Cryptosporidium parvum
DSLDS

SEQ ID NO: 2212907 - protein, 6 aa, Cryptosporidium parvum
DSLGRR

SEQ ID NO: 2212908 - protein, 10 aa, Cryptosporidium parvum
DSLKGRSKNV

SEQ ID NO: 2212909 - protein, 6 aa, Cryptosporidium parvum
DSLKPN

SEQ ID NO: 2212910 - protein, 4 aa, Cryptosporidium parvum
DSLN

SEQ ID NO: 2212911 - protein, 9 aa, Cryptosporidium parvum
DSLNSSSEH

SEQ ID NO: 2212912 - protein, 9 aa, Cryptosporidium parvum
DSLNTDQSI

SEQ ID NO: 2212913 - protein, 6 aa, Cryptosporidium parvum
DSLSGD

SEQ ID NO: 2212914 - protein, 28 aa, Cryptosporidium parvum
DSLSNKDLTYGQNDGESAKNRENSKTCS

SEQ ID NO: 2212915 - protein, 5 aa, Cryptosporidium parvum
DSLTS

SEQ ID NO: 2212916 - protein, 4 aa, Cryptosporidium parvum
DSLY

SEQ ID NO: 2212917 - protein, 11 aa, Cryptosporidium parvum
DSMMDENKDHG

SEQ ID NO: 2212918 - protein, 4 aa, Cryptosporidium parvum
DSMS

SEQ ID NO: 2212919 - protein, 9 aa, Cryptosporidium parvum
DSNCEENEG

SEQ ID NO: 2212920 - protein, 7 aa, Cryptosporidium parvum
DSNCGNN

SEQ ID NO: 2212921 - protein, 7 aa, Cryptosporidium parvum
DSNCKHT

SEQ ID NO: 2212922 - protein, 16 aa, Cryptosporidium parvum
DSNDSTGYTTKPTLCT

SEQ ID NO: 2212923 - protein, 6 aa, Cryptosporidium parvum
DSNEYN

SEQ ID NO: 2212924 - protein, 5 aa, Cryptosporidium parvum
DSNFG

SEQ ID NO: 2212925 - protein, 7 aa, Cryptosporidium parvum
DSNGEEC

SEQ ID NO: 2212926 - protein, 4 aa, Cryptosporidium parvum
DSNI

SEQ ID NO: 2212927 - protein, 6 aa, Cryptosporidium parvum
DSNKTH

SEQ ID NO: 2212928 - protein, 10 aa, Cryptosporidium parvum
DSNNEKKNKK

SEQ ID NO: 2212929 - protein, 21 aa, Cryptosporidium parvum
DSNNHNKEINDEDRESLTMRR

SEQ ID NO: 2212930 - protein, 5 aa, Cryptosporidium parvum
DSNNI

SEQ ID NO: 2212931 - protein, 16 aa, Cryptosporidium parvum
DSNRKATADATYVPVN

SEQ ID NO: 2212932 - protein, 16 aa, Cryptosporidium parvum
DSNSELLEKSDRNEAF

SEQ ID NO: 2212933 - protein, 7 aa, Cryptosporidium parvum
DSNSKSE

SEQ ID NO: 2212934 - protein, 11 aa, Cryptosporidium parvum
DSNSSQINKDD

SEQ ID NO: 2212935 - protein, 7 aa, Cryptosporidium parvum
DSNSSVN

SEQ ID NO: 2212936 - protein, 10 aa, Cryptosporidium parvum
DSNSTDSNKL

SEQ ID NO: 2212937 - protein, 14 aa, Cryptosporidium parvum
DSNTDSDVDANKTD

SEQ ID NO: 2212938 - protein, 8 aa, Cryptosporidium parvum
DSNVNPTE

SEQ ID NO: 2212939 - protein, 6 aa, Cryptosporidium parvum
DSNYEN

SEQ ID NO: 2212940 - protein, 7 aa, Cryptosporidium parvum
DSPDGKY

SEQ ID NO: 2212941 - protein, 7 aa, Cryptosporidium parvum
DSPELNN

SEQ ID NO: 2212942 - protein, 9 aa, Cryptosporidium parvum
DSPKEEYKN

SEQ ID NO: 2212943 - protein, 23 aa, Cryptosporidium parvum
DSPKSHASKYGKKQVNKNMQNHS

SEQ ID NO: 2212944 - protein, 8 aa, Cryptosporidium parvum
DSPNHGEV

SEQ ID NO: 2212945 - protein, 15 aa, Cryptosporidium parvum
DSPNWKFGNVDLEIT

SEQ ID NO: 2212946 - protein, 10 aa, Cryptosporidium parvum
DSPTRAARRG

SEQ ID NO: 2212947 - protein, 7 aa, Cryptosporidium parvum
DSPWNTS

SEQ ID NO: 2212948 - protein, 7 aa, Cryptosporidium parvum
DSQDGAL

SEQ ID NO: 2212949 - protein, 13 aa, Cryptosporidium parvum
DSQDHSKDSITNQ

SEQ ID NO: 2212950 - protein, 11 aa, Cryptosporidium parvum
DSQNSIENRND

SEQ ID NO: 2212951 - protein, 4 aa, Cryptosporidium parvum
DSQQ

SEQ ID NO: 2212952 - protein, 4 aa, Cryptosporidium parvum
DSQT

SEQ ID NO: 2212953 - protein, 14 aa, Cryptosporidium parvum
DSQYIDNNSSRLSS

SEQ ID NO: 2212954 - protein, 19 aa, Cryptosporidium parvum
DSRKQDIESKQSSTKKSGH

SEQ ID NO: 2212955 - protein, 8 aa, Cryptosporidium parvum
DSRSNTND

SEQ ID NO: 2212956 - protein, 9 aa, Cryptosporidium parvum
DSRTPSGTN

SEQ ID NO: 2212957 - protein, 9 aa, Cryptosporidium parvum
DSSDSEREK

SEQ ID NO: 2212958 - protein, 15 aa, Cryptosporidium parvum
DSSEISVSTSSSSIW

SEQ ID NO: 2212959 - protein, 7 aa, Cryptosporidium parvum
DSSELKK

SEQ ID NO: 2212960 - protein, 13 aa, Cryptosporidium parvum
DSSENKDESNTLV

SEQ ID NO: 2212961 - protein, 4 aa, Cryptosporidium parvum
DSSG

SEQ ID NO: 2212962 - protein, 8 aa, Cryptosporidium parvum
DSSGNEIW

SEQ ID NO: 2212963 - protein, 7 aa, Cryptosporidium parvum
DSSHSKI

SEQ ID NO: 2212964 - protein, 12 aa, Cryptosporidium parvum
DSSINNNESSGF

SEQ ID NO: 2212965 - protein, 11 aa, Cryptosporidium parvum
DSSIRNPNECE

SEQ ID NO: 2212966 - protein, 9 aa, Cryptosporidium parvum
DSSKKREPL

SEQ ID NO: 2212967 - protein, 6 aa, Cryptosporidium parvum
DSSKYG

SEQ ID NO: 2212968 - protein, 8 aa, Cryptosporidium parvum
DSSKYSKC

SEQ ID NO: 2212969 - protein, 8 aa, Cryptosporidium parvum
DSSLSNEK

SEQ ID NO: 2212970 - protein, 7 aa, Cryptosporidium parvum
DSSMSNT

SEQ ID NO: 2212971 - protein, 12 aa, Cryptosporidium parvum
DSSMSSSKDVPS

SEQ ID NO: 2212972 - protein, 6 aa, Cryptosporidium parvum
DSSNIE

SEQ ID NO: 2212973 - protein, 7 aa, Cryptosporidium parvum
DSSQGKL

SEQ ID NO: 2212974 - protein, 4 aa, Cryptosporidium parvum
DSSR

SEQ ID NO: 2212975 - protein, 9 aa, Cryptosporidium parvum
DSSRGRNEL

SEQ ID NO: 2212976 - protein, 10 aa, Cryptosporidium parvum
DSSRNPRKNF

SEQ ID NO: 2212977 - protein, 8 aa, Cryptosporidium parvum
DSSSLSDE

SEQ ID NO: 2212978 - protein, 11 aa, Cryptosporidium parvum
DSSSSYGNQNN

SEQ ID NO: 2212979 - protein, 5 aa, Cryptosporidium parvum
DSSTF

SEQ ID NO: 2212980 - protein, 5 aa, Cryptosporidium parvum
DSSVA

SEQ ID NO: 2212981 - protein, 7 aa, Cryptosporidium parvum
DSSYSEL

SEQ ID NO: 2212982 - protein, 8 aa, Cryptosporidium parvum
DSTASQQE

SEQ ID NO: 2212983 - protein, 22 aa, Cryptosporidium parvum
DSTISGSSSLEYDSGKKPEIND

SEQ ID NO: 2212984 - protein, 6 aa, Cryptosporidium parvum
DSTNRR

SEQ ID NO: 2212985 - protein, 6 aa, Cryptosporidium parvum
DSTPTS

SEQ ID NO: 2212986 - protein, 8 aa, Cryptosporidium parvum
DSTTSDIN

SEQ ID NO: 2212987 - protein, 4 aa, Cryptosporidium parvum
DSTV

SEQ ID NO: 2212988 - protein, 7 aa, Cryptosporidium parvum
DSVNSKY

SEQ ID NO: 2212989 - protein, 10 aa, Cryptosporidium parvum
DSVSKTQKDT

SEQ ID NO: 2212990 - protein, 7 aa, Cryptosporidium parvum
DSYEYDE

SEQ ID NO: 2212991 - protein, 11 aa, Cryptosporidium parvum
DSYSSKSVNSK

SEQ ID NO: 2212992 - protein, 6 aa, Cryptosporidium parvum
DTANAP

SEQ ID NO: 2212993 - protein, 29 aa, Cryptosporidium parvum
DTAREGQTEDKQEIVRSTEEVSKGKADIK

SEQ ID NO: 2212994 - protein, 10 aa, Cryptosporidium parvum
DTARRGQITE

SEQ ID NO: 2212995 - protein, 8 aa, Cryptosporidium parvum
DTASQSGI

SEQ ID NO: 2212996 - protein, 16 aa, Cryptosporidium parvum
DTAVAAEENIENQNGN

SEQ ID NO: 2212997 - protein, 7 aa, Cryptosporidium parvum
DTDDGEI

SEQ ID NO: 2212998 - protein, 17 aa, Cryptosporidium parvum
DTDDSRNKNDFDKESSS

SEQ ID NO: 2212999 - protein, 5 aa, Cryptosporidium parvum
DTDDV

SEQ ID NO: 2213000 - protein, 6 aa, Cryptosporidium parvum
DTDWDE

SEQ ID NO: 2213001 - protein, 6 aa, Cryptosporidium parvum
DTEGNN

SEQ ID NO: 2213002 - protein, 10 aa, Cryptosporidium parvum
DTEHETESDN

SEQ ID NO: 2213003 - protein, 12 aa, Cryptosporidium parvum
DTEKNNNLPNTD

SEQ ID NO: 2213004 - protein, 4 aa, Cryptosporidium parvum
DTEL

SEQ ID NO: 2213005 - protein, 5 aa, Cryptosporidium parvum
DTGKQ

SEQ ID NO: 2213006 - protein, 8 aa, Cryptosporidium parvum
DTGNKKSF

SEQ ID NO: 2213007 - protein, 8 aa, Cryptosporidium parvum
DTGTGKTT

SEQ ID NO: 2213008 - protein, 8 aa, Cryptosporidium parvum
DTGTGLSD

SEQ ID NO: 2213009 - protein, 5 aa, Cryptosporidium parvum
DTHAN

SEQ ID NO: 2213010 - protein, 4 aa, Cryptosporidium parvum
DTHN

SEQ ID NO: 2213011 - protein, 14 aa, Cryptosporidium parvum
DTISNALSQSQQTI

SEQ ID NO: 2213012 - protein, 5 aa, Cryptosporidium parvum
DTIVS

SEQ ID NO: 2213013 - protein, 7 aa, Cryptosporidium parvum
DTKVSSA

SEQ ID NO: 2213014 - protein, 8 aa, Cryptosporidium parvum
DTKVSSAN

SEQ ID NO: 2213015 - protein, 7 aa, Cryptosporidium parvum
DTLQKRT

SEQ ID NO: 2213016 - protein, 6 aa, Cryptosporidium parvum
DTNEAL

SEQ ID NO: 2213017 - protein, 5 aa, Cryptosporidium parvum
DTNNF

SEQ ID NO: 2213018 - protein, 13 aa, Cryptosporidium parvum
DTNNLQDKNNSLG

SEQ ID NO: 2213019 - protein, 4 aa, Cryptosporidium parvum
DTNQ

SEQ ID NO: 2213020 - protein, 5 aa, Cryptosporidium parvum
DTNQI

SEQ ID NO: 2213021 - protein, 7 aa, Cryptosporidium parvum
DTNTGSQ

SEQ ID NO: 2213022 - protein, 5 aa, Cryptosporidium parvum
DTNYS

SEQ ID NO: 2213023 - protein, 6 aa, Cryptosporidium parvum
DTPGLK

SEQ ID NO: 2213024 - protein, 15 aa, Cryptosporidium parvum
DTPMTGSVDEGKYVR

SEQ ID NO: 2213025 - protein, 9 aa, Cryptosporidium parvum
DTPNNLSAN

SEQ ID NO: 2213026 - protein, 14 aa, Cryptosporidium parvum
DTPSSLSYGESGKS

SEQ ID NO: 2213027 - protein, 8 aa, Cryptosporidium parvum
DTPSSYKK

SEQ ID NO: 2213028 - protein, 12 aa, Cryptosporidium parvum
DTPTLEEEPCTS

SEQ ID NO: 2213029 - protein, 5 aa, Cryptosporidium parvum
DTQDF

SEQ ID NO: 2213030 - protein, 8 aa, Cryptosporidium parvum
DTQDTEDL

SEQ ID NO: 2213031 - protein, 6 aa, Cryptosporidium parvum
DTQKTN

SEQ ID NO: 2213032 - protein, 5 aa, Cryptosporidium parvum
DTRDY

SEQ ID NO: 2213033 - protein, 4 aa, Cryptosporidium parvum
DTRL

SEQ ID NO: 2213034 - protein, 14 aa, Cryptosporidium parvum
DTRPKAGTNPYSED

SEQ ID NO: 2213035 - protein, 10 aa, Cryptosporidium parvum
DTRPQTQKQA

SEQ ID NO: 2213036 - protein, 20 aa, Cryptosporidium parvum
DTRRRKSQNGDKNESFLNEP

SEQ ID NO: 2213037 - protein, 5 aa, Cryptosporidium parvum
DTRYS

SEQ ID NO: 2213038 - protein, 6 aa, Cryptosporidium parvum
DTSEVT

SEQ ID NO: 2213039 - protein, 8 aa, Cryptosporidium parvum
DTSKLGGK

SEQ ID NO: 2213040 - protein, 7 aa, Cryptosporidium parvum
DTSLSSD

SEQ ID NO: 2213041 - protein, 4 aa, Cryptosporidium parvum
DTSN

SEQ ID NO: 2213042 - protein, 4 aa, Cryptosporidium parvum
DTSR

SEQ ID NO: 2213043 - protein, 12 aa, Cryptosporidium parvum
DTSSSNSNIADS

SEQ ID NO: 2213044 - protein, 11 aa, Cryptosporidium parvum
DTSVPGSTRSQ

SEQ ID NO: 2213045 - protein, 4 aa, Cryptosporidium parvum
DTTE

SEQ ID NO: 2213046 - protein, 11 aa, Cryptosporidium parvum
DTTKQYKEGSA

SEQ ID NO: 2213047 - protein, 8 aa, Cryptosporidium parvum
DTTMESQN

SEQ ID NO: 2213048 - protein, 15 aa, Cryptosporidium parvum
DTVKKTEEDSDATDI

SEQ ID NO: 2213049 - protein, 5 aa, Cryptosporidium parvum
DTVNP

SEQ ID NO: 2213050 - protein, 7 aa, Cryptosporidium parvum
DTVSTSN

SEQ ID NO: 2213051 - protein, 6 aa, Cryptosporidium parvum
DTYSDH

SEQ ID NO: 2213052 - protein, 10 aa, Cryptosporidium parvum
DVAPPNETVY

SEQ ID NO: 2213053 - protein, 7 aa, Cryptosporidium parvum
DVEAQSQ

SEQ ID NO: 2213054 - protein, 10 aa, Cryptosporidium parvum
DVEDSEHGHS

SEQ ID NO: 2213055 - protein, 13 aa, Cryptosporidium parvum
DVENTISKSPNAK

SEQ ID NO: 2213056 - protein, 13 aa, Cryptosporidium parvum
DVESTGYTSEERW

SEQ ID NO: 2213057 - protein, 12 aa, Cryptosporidium parvum
DVETENKSSRYD

SEQ ID NO: 2213058 - protein, 7 aa, Cryptosporidium parvum
DVGTSET

SEQ ID NO: 2213059 - protein, 7 aa, Cryptosporidium parvum
DVKSDKR

SEQ ID NO: 2213060 - protein, 5 aa, Cryptosporidium parvum
DVNGG

SEQ ID NO: 2213061 - protein, 12 aa, Cryptosporidium parvum
DVNSSNSNTLNL

SEQ ID NO: 2213062 - protein, 6 aa, Cryptosporidium parvum
DVRDSN

SEQ ID NO: 2213063 - protein, 8 aa, Cryptosporidium parvum
DVSPNNTE

SEQ ID NO: 2213064 - protein, 12 aa, Cryptosporidium parvum
DVSSGQQIQAGQ

SEQ ID NO: 2213065 - protein, 8 aa, Cryptosporidium parvum
DVTDDQSM

SEQ ID NO: 2213066 - protein, 32 aa, Cryptosporidium parvum
DVTNSRLSGKNSGNKGSNKTKESSKKSRKSRV

SEQ ID NO: 2213067 - protein, 5 aa, Cryptosporidium parvum
DVTPG

SEQ ID NO: 2213068 - protein, 10 aa, Cryptosporidium parvum
DWESPGKSDM

SEQ ID NO: 2213069 - protein, 8 aa, Cryptosporidium parvum
DWGENEPI

SEQ ID NO: 2213070 - protein, 28 aa, Cryptosporidium parvum
DWNPSKKLSEIDKEEEMSLSSGNNGNDL

SEQ ID NO: 2213071 - protein, 10 aa, Cryptosporidium parvum
DWTGSDSAEK

SEQ ID NO: 2213072 - protein, 7 aa, Cryptosporidium parvum
DYDDNSS

SEQ ID NO: 2213073 - protein, 9 aa, Cryptosporidium parvum
DYDEDDPID

SEQ ID NO: 2213074 - protein, 21 aa, Cryptosporidium parvum
DYDKSKRISNALSSNLNSEGC

SEQ ID NO: 2213075 - protein, 4 aa, Cryptosporidium parvum
DYDS

SEQ ID NO: 2213076 - protein, 10 aa, Cryptosporidium parvum
DYEEEEVNQI

SEQ ID NO: 2213077 - protein, 19 aa, Cryptosporidium parvum
DYEKAVESKQVAQQQAERA

SEQ ID NO: 2213078 - protein, 6 aa, Cryptosporidium parvum
DYEKEA

SEQ ID NO: 2213079 - protein, 4 aa, Cryptosporidium parvum
DYET

SEQ ID NO: 2213080 - protein, 5 aa, Cryptosporidium parvum
DYGDQ

SEQ ID NO: 2213081 - protein, 11 aa, Cryptosporidium parvum
DYGSNHSKNQI

SEQ ID NO: 2213082 - protein, 12 aa, Cryptosporidium parvum
DYNDKNATYYTR

SEQ ID NO: 2213083 - protein, 11 aa, Cryptosporidium parvum
DYNEEKSNITN

SEQ ID NO: 2213084 - protein, 11 aa, Cryptosporidium parvum
DYNNQNGNRME

SEQ ID NO: 2213085 - protein, 15 aa, Cryptosporidium parvum
DYNSIQKNEDAKTIN

SEQ ID NO: 2213086 - protein, 11 aa, Cryptosporidium parvum
DYNSKEEYQKV

SEQ ID NO: 2213087 - protein, 5 aa, Cryptosporidium parvum
DYNTK

SEQ ID NO: 2213088 - protein, 12 aa, Cryptosporidium parvum
DYNTNTSNSLGY

SEQ ID NO: 2213089 - protein, 7 aa, Cryptosporidium parvum
DYPSVGP

SEQ ID NO: 2213090 - protein, 7 aa, Cryptosporidium parvum
DYQQNKV

SEQ ID NO: 2213091 - protein, 7 aa, Cryptosporidium parvum
DYRSTSA

SEQ ID NO: 2213092 - protein, 7 aa, Cryptosporidium parvum
DYSPSSE

SEQ ID NO: 2213093 - protein, 35 aa, Cryptosporidium parvum
DYTAEQLKKDKGMVSKSQTESSLLSSPNSGGSYFS

SEQ ID NO: 2213094 - protein, 6 aa, Cryptosporidium parvum
DYTDEN

SEQ ID NO: 2213095 - protein, 9 aa, Cryptosporidium parvum
DYTNGRQQF

SEQ ID NO: 2213096 - protein, 5 aa, Cryptosporidium parvum
EAAKY

SEQ ID NO: 2213097 - protein, 5 aa, Cryptosporidium parvum
EAATN

SEQ ID NO: 2213098 - protein, 6 aa, Cryptosporidium parvum
EADKED

SEQ ID NO: 2213099 - protein, 5 aa, Cryptosporidium parvum
EAEKS

SEQ ID NO: 2213100 - protein, 9 aa, Cryptosporidium parvum
EAENEGNGF

SEQ ID NO: 2213101 - protein, 6 aa, Cryptosporidium parvum
EAENLK

SEQ ID NO: 2213102 - protein, 27 aa, Cryptosporidium parvum
EAEQNVRRSRVNSGYSHNKGQHGSSFQ

SEQ ID NO: 2213103 - protein, 5 aa, Cryptosporidium parvum
EAETP

SEQ ID NO: 2213104 - protein, 7 aa, Cryptosporidium parvum
EAGPTDK

SEQ ID NO: 2213105 - protein, 15 aa, Cryptosporidium parvum
EAINSAKKNAENIGV

SEQ ID NO: 2213106 - protein, 11 aa, Cryptosporidium parvum
EAIQQNGTAAS

SEQ ID NO: 2213107 - protein, 14 aa, Cryptosporidium parvum
EAIRRANQTPPPTL

SEQ ID NO: 2213108 - protein, 12 aa, Cryptosporidium parvum
EAISSATSSIWS

SEQ ID NO: 2213109 - protein, 6 aa, Cryptosporidium parvum
EAKNRG

SEQ ID NO: 2213110 - protein, 13 aa, Cryptosporidium parvum
EALEEQGRNKDKN

SEQ ID NO: 2213111 - protein, 16 aa, Cryptosporidium parvum
EANCENNDNHSKQKAD

SEQ ID NO: 2213112 - protein, 8 aa, Cryptosporidium parvum
EANEKNMT

SEQ ID NO: 2213113 - protein, 45 aa, Cryptosporidium parvum
EANESNSENNIEKKASHEEQSEVDDKKAQESDKGEDEQSTKPKSF

SEQ ID NO: 2213114 - protein, 10 aa, Cryptosporidium parvum
EANNKAGGEK

SEQ ID NO: 2213115 - protein, 13 aa, Cryptosporidium parvum
EANNNSSGSETPF

SEQ ID NO: 2213116 - protein, 5 aa, Cryptosporidium parvum
EANQD

SEQ ID NO: 2213117 - protein, 6 aa, Cryptosporidium parvum
EANTEL

SEQ ID NO: 2213118 - protein, 8 aa, Cryptosporidium parvum
EAPAPGQN

SEQ ID NO: 2213119 - protein, 6 aa, Cryptosporidium parvum
EAPPAL

SEQ ID NO: 2213120 - protein, 5 aa, Cryptosporidium parvum
EAPRS

SEQ ID NO: 2213121 - protein, 8 aa, Cryptosporidium parvum
EARKNNNL

SEQ ID NO: 2213122 - protein, 21 aa, Cryptosporidium parvum
EASATKDVPENTVKGSLDTFT

SEQ ID NO: 2213123 - protein, 9 aa, Cryptosporidium parvum
EASDQHNDT

SEQ ID NO: 2213124 - protein, 10 aa, Cryptosporidium parvum
EASEISNLSS

SEQ ID NO: 2213125 - protein, 4 aa, Cryptosporidium parvum
EASL

SEQ ID NO: 2213126 - protein, 4 aa, Cryptosporidium parvum
EASN

SEQ ID NO: 2213127 - protein, 15 aa, Cryptosporidium parvum
EASNYKAKISSHEKK

SEQ ID NO: 2213128 - protein, 6 aa, Cryptosporidium parvum
EASTDA

SEQ ID NO: 2213129 - protein, 6 aa, Cryptosporidium parvum
EATGIE

SEQ ID NO: 2213130 - protein, 4 aa, Cryptosporidium parvum
EATI

SEQ ID NO: 2213131 - protein, 8 aa, Cryptosporidium parvum
EATPREQA

SEQ ID NO: 2213132 - protein, 7 aa, Cryptosporidium parvum
EAVGGKY

SEQ ID NO: 2213133 - protein, 5 aa, Cryptosporidium parvum
EAWGE

SEQ ID NO: 2213134 - protein, 9 aa, Cryptosporidium parvum
ECDESERHG

SEQ ID NO: 2213135 - protein, 11 aa, Cryptosporidium parvum
ECDKESKNRRI

SEQ ID NO: 2213136 - protein, 4 aa, Cryptosporidium parvum
ECDP

SEQ ID NO: 2213137 - protein, 5 aa, Cryptosporidium parvum
ECEEH

SEQ ID NO: 2213138 - protein, 7 aa, Cryptosporidium parvum
ECENDNQ

SEQ ID NO: 2213139 - protein, 24 aa, Cryptosporidium parvum
ECENKTIDAENIGDIQSKNSENIK

SEQ ID NO: 2213140 - protein, 7 aa, Cryptosporidium parvum
ECERKNK

SEQ ID NO: 2213141 - protein, 6 aa, Cryptosporidium parvum
ECESDS

SEQ ID NO: 2213142 - protein, 40 aa, Cryptosporidium parvum
ECISPSPRTRSSQRLRPSTPTSYSSSSSSFSSSSSKREFP

SEQ ID NO: 2213143 - protein, 13 aa, Cryptosporidium parvum
ECNTDKDCKPGQV

SEQ ID NO: 2213144 - protein, 11 aa, Cryptosporidium parvum
ECRSTTSKKVA

SEQ ID NO: 2213145 - protein, 5 aa, Cryptosporidium parvum
ECSDK

SEQ ID NO: 2213146 - protein, 10 aa, Cryptosporidium parvum
ECTDPDSELY

SEQ ID NO: 2213147 - protein, 7 aa, Cryptosporidium parvum
EDANDHN

SEQ ID NO: 2213148 - protein, 13 aa, Cryptosporidium parvum
EDANSESSCLRKD

SEQ ID NO: 2213149 - protein, 11 aa, Cryptosporidium parvum
EDASNNYDIGG

SEQ ID NO: 2213150 - protein, 4 aa, Cryptosporidium parvum
EDAT

SEQ ID NO: 2213151 - protein, 4 aa, Cryptosporidium parvum
EDDD

SEQ ID NO: 2213152 - protein, 10 aa, Cryptosporidium parvum
EDDDTSTDCE

SEQ ID NO: 2213153 - protein, 8 aa, Cryptosporidium parvum
EDDEDSEL

SEQ ID NO: 2213154 - protein, 16 aa, Cryptosporidium parvum
EDDINSKDEVIDSNSD

SEQ ID NO: 2213155 - protein, 5 aa, Cryptosporidium parvum
EDDPI

SEQ ID NO: 2213156 - protein, 20 aa, Cryptosporidium parvum
EDDSLENEDLEEQNQGDLEY

SEQ ID NO: 2213157 - protein, 10 aa, Cryptosporidium parvum
EDEAKQAGIS

SEQ ID NO: 2213158 - protein, 24 aa, Cryptosporidium parvum
EDEDDQNSNNRNSEKNELDSPSKS

SEQ ID NO: 2213159 - protein, 5 aa, Cryptosporidium parvum
EDEEH

SEQ ID NO: 2213160 - protein, 26 aa, Cryptosporidium parvum
EDEEIREDLKSSSQKENTEVYEKDET

SEQ ID NO: 2213161 - protein, 11 aa, Cryptosporidium parvum
EDEEKEDTQRK

SEQ ID NO: 2213162 - protein, 6 aa, Cryptosporidium parvum
EDEEKI

SEQ ID NO: 2213163 - protein, 6 aa, Cryptosporidium parvum
EDEELE

SEQ ID NO: 2213164 - protein, 4 aa, Cryptosporidium parvum
EDEI

SEQ ID NO: 2213165 - protein, 7 aa, Cryptosporidium parvum
EDEIGEN

SEQ ID NO: 2213166 - protein, 8 aa, Cryptosporidium parvum
EDEKQLDF

SEQ ID NO: 2213167 - protein, 9 aa, Cryptosporidium parvum
EDENEGINS

SEQ ID NO: 2213168 - protein, 8 aa, Cryptosporidium parvum
EDENINGI

SEQ ID NO: 2213169 - protein, 6 aa, Cryptosporidium parvum
EDERNE

SEQ ID NO: 2213170 - protein, 13 aa, Cryptosporidium parvum
EDERSQSSNSDSC

SEQ ID NO: 2213171 - protein, 6 aa, Cryptosporidium parvum
EDETFS

SEQ ID NO: 2213172 - protein, 14 aa, Cryptosporidium parvum
EDETKQGNSGKKEW

SEQ ID NO: 2213173 - protein, 7 aa, Cryptosporidium parvum
EDETSSV

SEQ ID NO: 2213174 - protein, 4 aa, Cryptosporidium parvum
EDEV

SEQ ID NO: 2213175 - protein, 5 aa, Cryptosporidium parvum
EDEVD

SEQ ID NO: 2213176 - protein, 13 aa, Cryptosporidium parvum
EDGCIDDRSHHTL

SEQ ID NO: 2213177 - protein, 7 aa, Cryptosporidium parvum
EDGDEGF

SEQ ID NO: 2213178 - protein, 35 aa, Cryptosporidium parvum
EDGFDENQDTSIQSDSQDDTTGHKSDVKSPNSENF

SEQ ID NO: 2213179 - protein, 12 aa, Cryptosporidium parvum
EDGKFKSSHKKS

SEQ ID NO: 2213180 - protein, 7 aa, Cryptosporidium parvum
EDGLENH

SEQ ID NO: 2213181 - protein, 6 aa, Cryptosporidium parvum
EDGRGE

SEQ ID NO: 2213182 - protein, 7 aa, Cryptosporidium parvum
EDGSVSR

SEQ ID NO: 2213183 - protein, 5 aa, Cryptosporidium parvum
EDGYA

SEQ ID NO: 2213184 - protein, 5 aa, Cryptosporidium parvum
EDHDQ

SEQ ID NO: 2213185 - protein, 10 aa, Cryptosporidium parvum
EDHIKESYPE

SEQ ID NO: 2213186 - protein, 4 aa, Cryptosporidium parvum
EDHP

SEQ ID NO: 2213187 - protein, 4 aa, Cryptosporidium parvum
EDIS

SEQ ID NO: 2213188 - protein, 8 aa, Cryptosporidium parvum
EDISQQTY

SEQ ID NO: 2213189 - protein, 5 aa, Cryptosporidium parvum
EDKEL

SEQ ID NO: 2213190 - protein, 35 aa, Cryptosporidium parvum
EDKFQGNDESIDKNNEENKNSKPGTNTRKLENKSI

SEQ ID NO: 2213191 - protein, 7 aa, Cryptosporidium parvum
EDKKKTI

SEQ ID NO: 2213192 - protein, 8 aa, Cryptosporidium parvum
EDKTIGKN

SEQ ID NO: 2213193 - protein, 4 aa, Cryptosporidium parvum
EDLK

SEQ ID NO: 2213194 - protein, 17 aa, Cryptosporidium parvum
EDLKSRQTTIESNSYSN

SEQ ID NO: 2213195 - protein, 15 aa, Cryptosporidium parvum
EDLNKKENETEENFG

SEQ ID NO: 2213196 - protein, 8 aa, Cryptosporidium parvum
EDLNSEYE

SEQ ID NO: 2213197 - protein, 4 aa, Cryptosporidium parvum
EDMN

SEQ ID NO: 2213198 - protein, 5 aa, Cryptosporidium parvum
EDNAR

SEQ ID NO: 2213199 - protein, 19 aa, Cryptosporidium parvum
EDNDDDDKNNLINDESNNM

SEQ ID NO: 2213200 - protein, 11 aa, Cryptosporidium parvum
EDNDSSTKHKA

SEQ ID NO: 2213201 - protein, 4 aa, Cryptosporidium parvum
EDNE

SEQ ID NO: 2213202 - protein, 8 aa, Cryptosporidium parvum
EDNEPGHG

SEQ ID NO: 2213203 - protein, 7 aa, Cryptosporidium parvum
EDNFQNN

SEQ ID NO: 2213204 - protein, 19 aa, Cryptosporidium parvum
EDNGYNGGISTDSGKQLSP

SEQ ID NO: 2213205 - protein, 9 aa, Cryptosporidium parvum
EDNKYNKEF

SEQ ID NO: 2213206 - protein, 6 aa, Cryptosporidium parvum
EDNNNM

SEQ ID NO: 2213207 - protein, 6 aa, Cryptosporidium parvum
EDNPKI

SEQ ID NO: 2213208 - protein, 6 aa, Cryptosporidium parvum
EDNSHK

SEQ ID NO: 2213209 - protein, 9 aa, Cryptosporidium parvum
EDNSQWEET

SEQ ID NO: 2213210 - protein, 12 aa, Cryptosporidium parvum
EDNTQKTSNGYN

SEQ ID NO: 2213211 - protein, 8 aa, Cryptosporidium parvum
EDNVQGRD

SEQ ID NO: 2213212 - protein, 6 aa, Cryptosporidium parvum
EDNYST

SEQ ID NO: 2213213 - protein, 8 aa, Cryptosporidium parvum
EDPEAQAN

SEQ ID NO: 2213214 - protein, 15 aa, Cryptosporidium parvum
EDPIKTTGYQALSTS

SEQ ID NO: 2213215 - protein, 4 aa, Cryptosporidium parvum
EDPL

SEQ ID NO: 2213216 - protein, 4 aa, Cryptosporidium parvum
EDPS

SEQ ID NO: 2213217 - protein, 6 aa, Cryptosporidium parvum
EDPSYY

SEQ ID NO: 2213218 - protein, 8 aa, Cryptosporidium parvum
EDPTSTFD

SEQ ID NO: 2213219 - protein, 12 aa, Cryptosporidium parvum
EDPTSTSDQSEE

SEQ ID NO: 2213220 - protein, 4 aa, Cryptosporidium parvum
EDQD

SEQ ID NO: 2213221 - protein, 18 aa, Cryptosporidium parvum
EDQEPKIAGNKVKSITSS

SEQ ID NO: 2213222 - protein, 20 aa, Cryptosporidium parvum
EDQGTTSTQNSSQNESSNKK

SEQ ID NO: 2213223 - protein, 12 aa, Cryptosporidium parvum
EDQLGKRKGQTG

SEQ ID NO: 2213224 - protein, 8 aa, Cryptosporidium parvum
EDQPEVKE

SEQ ID NO: 2213225 - protein, 10 aa, Cryptosporidium parvum
EDQSLQTPQS

SEQ ID NO: 2213226 - protein, 17 aa, Cryptosporidium parvum
EDSDDIRDNKKTNTSCS

SEQ ID NO: 2213227 - protein, 12 aa, Cryptosporidium parvum
EDSEHNVDSKEL

SEQ ID NO: 2213228 - protein, 13 aa, Cryptosporidium parvum
EDSEQLPKSKISR

SEQ ID NO: 2213229 - protein, 7 aa, Cryptosporidium parvum
EDSHNRK

SEQ ID NO: 2213230 - protein, 9 aa, Cryptosporidium parvum
EDSKADGKV

SEQ ID NO: 2213231 - protein, 29 aa, Cryptosporidium parvum
EDSNNSNSSGSSSSVNNNNNNQLEEENYR

SEQ ID NO: 2213232 - protein, 11 aa, Cryptosporidium parvum
EDSNPNNPQME

SEQ ID NO: 2213233 - protein, 9 aa, Cryptosporidium parvum
EDSPGNGKV

SEQ ID NO: 2213234 - protein, 7 aa, Cryptosporidium parvum
EDSSRQQ

SEQ ID NO: 2213235 - protein, 8 aa, Cryptosporidium parvum
EDSSSEKL

SEQ ID NO: 2213236 - protein, 12 aa, Cryptosporidium parvum
EDTAAQIADPPM

SEQ ID NO: 2213237 - protein, 10 aa, Cryptosporidium parvum
EDTEKNNPAE

SEQ ID NO: 2213238 - protein, 4 aa, Cryptosporidium parvum
EDTI

SEQ ID NO: 2213239 - protein, 4 aa, Cryptosporidium parvum
EDTK

SEQ ID NO: 2213240 - protein, 5 aa, Cryptosporidium parvum
EDTKS

SEQ ID NO: 2213241 - protein, 8 aa, Cryptosporidium parvum
EDWPSQGK

SEQ ID NO: 2213242 - protein, 13 aa, Cryptosporidium parvum
EDYERDEYNSEQQ

SEQ ID NO: 2213243 - protein, 5 aa, Cryptosporidium parvum
EDYET

SEQ ID NO: 2213244 - protein, 7 aa, Cryptosporidium parvum
EDYIDPE

SEQ ID NO: 2213245 - protein, 14 aa, Cryptosporidium parvum
EDYKLTKDTSYYQR

SEQ ID NO: 2213246 - protein, 7 aa, Cryptosporidium parvum
EDYRNKR

SEQ ID NO: 2213247 - protein, 5 aa, Cryptosporidium parvum
EEAAF

SEQ ID NO: 2213248 - protein, 13 aa, Cryptosporidium parvum
EEAEKPKNKNPSL

SEQ ID NO: 2213249 - protein, 11 aa, Cryptosporidium parvum
EEAKRQQKKAE

SEQ ID NO: 2213250 - protein, 14 aa, Cryptosporidium parvum
EEAKYNEQKEIQTR

SEQ ID NO: 2213251 - protein, 25 aa, Cryptosporidium parvum
EEANSIKGRENFDENTRSSDQSCSI

SEQ ID NO: 2213252 - protein, 9 aa, Cryptosporidium parvum
EEANSSNCT

SEQ ID NO: 2213253 - protein, 10 aa, Cryptosporidium parvum
EEARKRDPEF

SEQ ID NO: 2213254 - protein, 10 aa, Cryptosporidium parvum
EEASKGEQEY

SEQ ID NO: 2213255 - protein, 8 aa, Cryptosporidium parvum
EECKNENG

SEQ ID NO: 2213256 - protein, 7 aa, Cryptosporidium parvum
EECNKNS

SEQ ID NO: 2213257 - protein, 19 aa, Cryptosporidium parvum
EECNSRDNPFGGFPNKNKP

SEQ ID NO: 2213258 - protein, 4 aa, Cryptosporidium parvum
EECP

SEQ ID NO: 2213259 - protein, 6 aa, Cryptosporidium parvum
EEDDAM

SEQ ID NO: 2213260 - protein, 8 aa, Cryptosporidium parvum
EEDDEENS

SEQ ID NO: 2213261 - protein, 8 aa, Cryptosporidium parvum
EEDETEQR

SEQ ID NO: 2213262 - protein, 5 aa, Cryptosporidium parvum
EEDFP

SEQ ID NO: 2213263 - protein, 16 aa, Cryptosporidium parvum
EEDGTPEQGNTHSSGM

SEQ ID NO: 2213264 - protein, 7 aa, Cryptosporidium parvum
EEDIDRN

SEQ ID NO: 2213265 - protein, 33 aa, Cryptosporidium parvum
EEDKDDERLKKKRKKEIITTRGNGENDNKIGKN

SEQ ID NO: 2213266 - protein, 4 aa, Cryptosporidium parvum
EEDL

SEQ ID NO: 2213267 - protein, 4 aa, Cryptosporidium parvum
EEDM

SEQ ID NO: 2213268 - protein, 22 aa, Cryptosporidium parvum
EEDNDSEIEVEKDNNNSNTDEF

SEQ ID NO: 2213269 - protein, 21 aa, Cryptosporidium parvum
EEDQNLQENQNPRRERDLEQP

SEQ ID NO: 2213270 - protein, 10 aa, Cryptosporidium parvum
EEDQSKQKSL

SEQ ID NO: 2213271 - protein, 4 aa, Cryptosporidium parvum
EEDS

SEQ ID NO: 2213272 - protein, 13 aa, Cryptosporidium parvum
EEDSTDSKIGNSL

SEQ ID NO: 2213273 - protein, 5 aa, Cryptosporidium parvum
EEDTY

SEQ ID NO: 2213274 - protein, 4 aa, Cryptosporidium parvum
EEDY

SEQ ID NO: 2213275 - protein, 16 aa, Cryptosporidium parvum
EEEDDNLSLSHDEGGL

SEQ ID NO: 2213276 - protein, 11 aa, Cryptosporidium parvum
EEEDSKEGNSE

SEQ ID NO: 2213277 - protein, 21 aa, Cryptosporidium parvum
EEEEAKSDSGILQSKEGESSR

SEQ ID NO: 2213278 - protein, 8 aa, Cryptosporidium parvum
EEEEEHGD

SEQ ID NO: 2213279 - protein, 33 aa, Cryptosporidium parvum; identical to SEQ ID NO: 2112422

SEQ ID NO: 2213280 - protein, 13 aa, Cryptosporidium parvum
EEEEKAVRSTDTV

SEQ ID NO: 2213281 - protein, 37 aa, Cryptosporidium parvum
EEEEKEKKEAQPQENTNHDGLSENEKEFDHEESQGRL

SEQ ID NO: 2213282 - protein, 10 aa, Cryptosporidium parvum
EEEEKTLEEN

SEQ ID NO: 2213283 - protein, 41 aa, Cryptosporidium parvum
EEEEVSKSISNTSENEEHSYSSENGEETRAYGKNSSAGVSY

SEQ ID NO: 2213284 - protein, 28 aa, Cryptosporidium parvum
EEEIEKEARERQVRKSECTNKNTGTEND

SEQ ID NO: 2213285 - protein, 9 aa, Cryptosporidium parvum
EEEIPKNNT

SEQ ID NO: 2213286 - protein, 11 aa, Cryptosporidium parvum
EEEKGTTKEGG

SEQ ID NO: 2213287 - protein, 6 aa, Cryptosporidium parvum
EEEKTK

SEQ ID NO: 2213288 - protein, 4 aa, Cryptosporidium parvum
EEEM

SEQ ID NO: 2213289 - protein, 7 aa, Cryptosporidium parvum
EEENNRI

SEQ ID NO: 2213290 - protein, 45 aa, Cryptosporidium parvum
EEEQEEEERQEGEERQEEEQEQEQEEKESMKEHEEKENKKKEKKV

SEQ ID NO: 2213291 - protein, 16 aa, Cryptosporidium parvum
EEEQEEENEEEDDDEY

SEQ ID NO: 2213292 - protein, 19 aa, Cryptosporidium parvum
EEESNSVSNLSSSNEEQID

SEQ ID NO: 2213293 - protein, 5 aa, Cryptosporidium parvum
EEFKS

SEQ ID NO: 2213294 - protein, 10 aa, Cryptosporidium parvum
EEGDRDSEFT

SEQ ID NO: 2213295 - protein, 5 aa, Cryptosporidium parvum
EEGED

SEQ ID NO: 2213296 - protein, 4 aa, Cryptosporidium parvum
EEGF

SEQ ID NO: 2213297 - protein, 4 aa, Cryptosporidium parvum
EEGG

SEQ ID NO: 2213298 - protein, 9 aa, Cryptosporidium parvum
EEGKEIEEK

SEQ ID NO: 2213299 - protein, 6 aa, Cryptosporidium parvum
EEGTGI

SEQ ID NO: 2213300 - protein, 8 aa, Cryptosporidium parvum
EEHSPNNK

SEQ ID NO: 2213301 - protein, 7 aa, Cryptosporidium parvum
EEIDNKS

SEQ ID NO: 2213302 - protein, 5 aa, Cryptosporidium parvum
EEIDQ

SEQ ID NO: 2213303 - protein, 17 aa, Cryptosporidium parvum
EEIENTNKEIKKREDEI

SEQ ID NO: 2213304 - protein, 5 aa, Cryptosporidium parvum
EEISN

SEQ ID NO: 2213305 - protein, 9 aa, Cryptosporidium parvum
EEITDSKDL

SEQ ID NO: 2213306 - protein, 9 aa, Cryptosporidium parvum
EEKDSSGKI

SEQ ID NO: 2213307 - protein, 7 aa, Cryptosporidium parvum
EEKEINK

SEQ ID NO: 2213308 - protein, 16 aa, Cryptosporidium parvum
EEKENSNSDSIKEETK

SEQ ID NO: 2213309 - protein, 13 aa, Cryptosporidium parvum
EEKLEKREEEIAN

SEQ ID NO: 2213310 - protein, 11 aa, Cryptosporidium parvum
EEKNNSNQTPL

SEQ ID NO: 2213311 - protein, 9 aa, Cryptosporidium parvum
EEKQEEDNM

SEQ ID NO: 2213312 - protein, 10 aa, Cryptosporidium parvum
EEKRKQKIMT

SEQ ID NO: 2213313 - protein, 4 aa, Cryptosporidium parvum
EEKT

SEQ ID NO: 2213314 - protein, 8 aa, Cryptosporidium parvum
EELDPPSY

SEQ ID NO: 2213315 - protein, 9 aa, Cryptosporidium parvum
EELDSRTND

SEQ ID NO: 2213316 - protein, 5 aa, Cryptosporidium parvum
EELEQ

SEQ ID NO: 2213317 - protein, 31 aa, Cryptosporidium parvum
EELKSTLKTSVPTINDNDEAKKFAENTYSDT

SEQ ID NO: 2213318 - protein, 9 aa, Cryptosporidium parvum
EELQPNRND

SEQ ID NO: 2213319 - protein, 6 aa, Cryptosporidium parvum
EELSEA

SEQ ID NO: 2213320 - protein, 22 aa, Cryptosporidium parvum
EELTNSETSNTSSSSSSSYPNF

SEQ ID NO: 2213321 - protein, 7 aa, Cryptosporidium parvum
EENDNQI

SEQ ID NO: 2213322 - protein, 13 aa, Cryptosporidium parvum
EENEENVDKKSEI

SEQ ID NO: 2213323 - protein, 5 aa, Cryptosporidium parvum
EENFK

SEQ ID NO: 2213324 - protein, 9 aa, Cryptosporidium parvum
EENFTEQSS

SEQ ID NO: 2213325 - protein, 11 aa, Cryptosporidium parvum
EENGRRPTRNE

SEQ ID NO: 2213326 - protein, 4 aa, Cryptosporidium parvum
EENH

SEQ ID NO: 2213327 - protein, 14 aa, Cryptosporidium parvum
EENIQNSDRQPREL

SEQ ID NO: 2213328 - protein, 6 aa, Cryptosporidium parvum
EENKNC

SEQ ID NO: 2213329 - protein, 10 aa, Cryptosporidium parvum
EENKSKSKVL

SEQ ID NO: 2213330 - protein, 4 aa, Cryptosporidium parvum
EENM

SEQ ID NO: 2213331 - protein, 9 aa, Cryptosporidium parvum
EENMDETNE

SEQ ID NO: 2213332 - protein, 9 aa, Cryptosporidium parvum
EENNINEKN

SEQ ID NO: 2213333 - protein, 11 aa, Cryptosporidium parvum
EENNKRISSNK

SEQ ID NO: 2213334 - protein, 8 aa, Cryptosporidium parvum
EENNSTEA

SEQ ID NO: 2213335 - protein, 4 aa, Cryptosporidium parvum
EENP

SEQ ID NO: 2213336 - protein, 11 aa, Cryptosporidium parvum
EENPDKFTHDD

SEQ ID NO: 2213337 - protein, 7 aa, Cryptosporidium parvum
EENQDDH

SEQ ID NO: 2213338 - protein, 5 aa, Cryptosporidium parvum
EENTI

SEQ ID NO: 2213339 - protein, 6 aa, Cryptosporidium parvum
EEPIQD

SEQ ID NO: 2213340 - protein, 8 aa, Cryptosporidium parvum
EEPKNKDE

SEQ ID NO: 2213341 - protein, 7 aa, Cryptosporidium parvum
EEPNDDS

SEQ ID NO: 2213342 - protein, 36 aa, Cryptosporidium parvum
EEQAIEVSGSSTSESNSDDEDEVEGSSSSGGRSAKR

SEQ ID NO: 2213343 - protein, 8 aa, Cryptosporidium parvum
EEQGGGKD

SEQ ID NO: 2213344 - protein, 49 aa, Cryptosporidium parvum
EEQLRSSEANQTSSSDKNSSDSEKSKETTVNNEDSKISSNNIRRRKNRA

SEQ ID NO: 2213345 - protein, 6 aa, Cryptosporidium parvum
EEQNKQ

SEQ ID NO: 2213346 - protein, 5 aa, Cryptosporidium parvum
EEQSE

SEQ ID NO: 2213347 - protein, 9 aa, Cryptosporidium parvum
EEQSNTCTD

SEQ ID NO: 2213348 - protein, 5 aa, Cryptosporidium parvum
EERGI

SEQ ID NO: 2213349 - protein, 9 aa, Cryptosporidium parvum
EERKDNYKQ

SEQ ID NO: 2213350 - protein, 6 aa, Cryptosporidium parvum
EERPSD

SEQ ID NO: 2213351 - protein, 7 aa, Cryptosporidium parvum
EERRNDR

SEQ ID NO: 2213352 - protein, 5 aa, Cryptosporidium parvum
EERSL

SEQ ID NO: 2213353 - protein, 9 aa, Cryptosporidium parvum
EERSQEQCT

SEQ ID NO: 2213354 - protein, 12 aa, Cryptosporidium parvum
EERTGEDISKQL

SEQ ID NO: 2213355 - protein, 8 aa, Cryptosporidium parvum
EERVEETT

SEQ ID NO: 2213356 - protein, 7 aa, Cryptosporidium parvum
EESANQL

SEQ ID NO: 2213357 - protein, 6 aa, Cryptosporidium parvum
EESDEL

SEQ ID NO: 2213358 - protein, 7 aa, Cryptosporidium parvum
EESDHTK

SEQ ID NO: 2213359 - protein, 5 aa, Cryptosporidium parvum
EESDM

SEQ ID NO: 2213360 - protein, 7 aa, Cryptosporidium parvum
EESEFKD

SEQ ID NO: 2213361 - protein, 10 aa, Cryptosporidium parvum
EESEYSSRKS

SEQ ID NO: 2213362 - protein, 9 aa, Cryptosporidium parvum
EESGGSNIS

SEQ ID NO: 2213363 - protein, 14 aa, Cryptosporidium parvum
EESGIQKARSVSDN

SEQ ID NO: 2213364 - protein, 17 aa, Cryptosporidium parvum
EESGRDPVTGKDDKNSL

SEQ ID NO: 2213365 - protein, 17 aa, Cryptosporidium parvum
EESIEDKFDDEENEFNN

SEQ ID NO: 2213366 - protein, 7 aa, Cryptosporidium parvum
EESKIHP

SEQ ID NO: 2213367 - protein, 9 aa, Cryptosporidium parvum
EESKPENTL

SEQ ID NO: 2213368 - protein, 4 aa, Cryptosporidium parvum
EESL

SEQ ID NO: 2213369 - protein, 4 aa, Cryptosporidium parvum
EESM

SEQ ID NO: 2213370 - protein, 8 aa, Cryptosporidium parvum
EESMENSK

SEQ ID NO: 2213371 - protein, 4 aa, Cryptosporidium parvum
EESN

SEQ ID NO: 2213372 - protein, 6 aa, Cryptosporidium parvum
EESNTN

SEQ ID NO: 2213373 - protein, 7 aa, Cryptosporidium parvum
EESPKEL

SEQ ID NO: 2213374 - protein, 16 aa, Cryptosporidium parvum
EESPVKEKKKESDQFD

SEQ ID NO: 2213375 - protein, 16 aa, Cryptosporidium parvum
EESQNRTPSNTIPPED

SEQ ID NO: 2213376 - protein, 8 aa, Cryptosporidium parvum
EESRGGRY

SEQ ID NO: 2213377 - protein, 9 aa, Cryptosporidium parvum
EESSDIGTL

SEQ ID NO: 2213378 - protein, 17 aa, Cryptosporidium parvum
EESSLDISSPQSRFENN

SEQ ID NO: 2213379 - protein, 22 aa, Cryptosporidium parvum
EESSSDDLSEYSCSTPDQKEDY

SEQ ID NO: 2213380 - protein, 30 aa, Cryptosporidium parvum
EESSSYKNVSNNTKISKKNKNKRNSNNHNI

SEQ ID NO: 2213381 - protein, 16 aa, Cryptosporidium parvum
EESTTGDESSTRASKH

SEQ ID NO: 2213382 - protein, 4 aa, Cryptosporidium parvum
EESY

SEQ ID NO: 2213383 - protein, 7 aa, Cryptosporidium parvum
EESYKQI

SEQ ID NO: 2213384 - protein, 6 aa, Cryptosporidium parvum
EETEQI

SEQ ID NO: 2213385 - protein, 11 aa, Cryptosporidium parvum
EETGNSIESYS

SEQ ID NO: 2213386 - protein, 9 aa, Cryptosporidium parvum
EETNNEKKL

SEQ ID NO: 2213387 - protein, 7 aa, Cryptosporidium parvum
EETNNRV

SEQ ID NO: 2213388 - protein, 6 aa, Cryptosporidium parvum
EETPFT

SEQ ID NO: 2213389 - protein, 11 aa, Cryptosporidium parvum
EETSKDRNHPL

SEQ ID NO: 2213390 - protein, 6 aa, Cryptosporidium parvum
EETSNG

SEQ ID NO: 2213391 - protein, 10 aa, Cryptosporidium parvum
EETSVAEGNN

SEQ ID NO: 2213392 - protein, 7 aa, Cryptosporidium parvum
EEVADTP

SEQ ID NO: 2213393 - protein, 9 aa, Cryptosporidium parvum
EEVEEATKM

SEQ ID NO: 2213394 - protein, 25 aa, Cryptosporidium parvum
EEVEEEEEEEEEEEEEKEKEEGEEV

SEQ ID NO: 2213395 - protein, 14 aa, Cryptosporidium parvum
EEVNIPENNVKKKS

SEQ ID NO: 2213396 - protein, 32 aa, Cryptosporidium parvum
EEVTQKKDTFPNKNPKKNQHKEVDKATLNNSY

SEQ ID NO: 2213397 - protein, 7 aa, Cryptosporidium parvum
EEVTSDS

SEQ ID NO: 2213398 - protein, 10 aa, Cryptosporidium parvum
EEYDSSESEF

SEQ ID NO: 2213399 - protein, 6 aa, Cryptosporidium parvum
EEYEED

SEQ ID NO: 2213400 - protein, 10 aa, Cryptosporidium parvum
EEYENSLKSC

SEQ ID NO: 2213401 - protein, 7 aa, Cryptosporidium parvum
EEYESES

SEQ ID NO: 2213402 - protein, 4 aa, Cryptosporidium parvum
EEYF

SEQ ID NO: 2213403 - protein, 27 aa, Cryptosporidium parvum
EEYSEEEKSQNAQDELQSDHNNENNQD

SEQ ID NO: 2213404 - protein, 7 aa, Cryptosporidium parvum
EFAGPND

SEQ ID NO: 2213405 - protein, 5 aa, Cryptosporidium parvum
EFDGN

SEQ ID NO: 2213406 - protein, 9 aa, Cryptosporidium parvum
EFDKKDDIL

SEQ ID NO: 2213407 - protein, 9 aa, Cryptosporidium parvum
EFEESGNDF

SEQ ID NO: 2213408 - protein, 9 aa, Cryptosporidium parvum
EFEKPSKIP

SEQ ID NO: 2213409 - protein, 7 aa, Cryptosporidium parvum
EFENSDE

SEQ ID NO: 2213410 - protein, 4 aa, Cryptosporidium parvum
EFES

SEQ ID NO: 2213411 - protein, 5 aa, Cryptosporidium parvum
EFESN

SEQ ID NO: 2213412 - protein, 5 aa, Cryptosporidium parvum
EFGDS

SEQ ID NO: 2213413 - protein, 14 aa, Cryptosporidium parvum
EFGNEHDKNDLNES

SEQ ID NO: 2213414 - protein, 10 aa, Cryptosporidium parvum
EFKNQNGNGY

SEQ ID NO: 2213415 - protein, 9 aa, Cryptosporidium parvum
EFNNGNQIP

SEQ ID NO: 2213416 - protein, 31 aa, Cryptosporidium parvum
EFPDDNSKASSSSAKSGSTTSSTGSNTKDEE

SEQ ID NO: 2213417 - protein, 22 aa, Cryptosporidium parvum
EFRNSEEKLESASTEEEKRTRA

SEQ ID NO: 2213418 - protein, 14 aa, Cryptosporidium parvum
EFSGKRSGNGNNLR

SEQ ID NO: 2213419 - protein, 9 aa, Cryptosporidium parvum
EFSKPEAVK

SEQ ID NO: 2213420 - protein, 12 aa, Cryptosporidium parvum
EFSKQKKNSLND

SEQ ID NO: 2213421 - protein, 5 aa, Cryptosporidium parvum
EFTKI

SEQ ID NO: 2213422 - protein, 25 aa, Cryptosporidium parvum
EGANQTMNNSNSSDINTGMNKSQKK

SEQ ID NO: 2213423 - protein, 10 aa, Cryptosporidium parvum
EGASQRIQED

SEQ ID NO: 2213424 - protein, 7 aa, Cryptosporidium parvum
EGCNSKE

SEQ ID NO: 2213425 - protein, 6 aa, Cryptosporidium parvum
EGCNTS

SEQ ID NO: 2213426 - protein, 14 aa, Cryptosporidium parvum
EGDAIGPKLQNERI

SEQ ID NO: 2213427 - protein, 12 aa, Cryptosporidium parvum
EGDASGSNSTRS

SEQ ID NO: 2213428 - protein, 11 aa, Cryptosporidium parvum
EGDDTSPKTPI

SEQ ID NO: 2213429 - protein, 12 aa, Cryptosporidium parvum
EGDEDSSSNSNG

SEQ ID NO: 2213430 - protein, 5 aa, Cryptosporidium parvum
EGDQT

SEQ ID NO: 2213431 - protein, 5 aa, Cryptosporidium parvum
EGDRN

SEQ ID NO: 2213432 - protein, 16 aa, Cryptosporidium parvum
EGDSASSDNSENPSNV

SEQ ID NO: 2213433 - protein, 7 aa, Cryptosporidium parvum
EGDTETH

SEQ ID NO: 2213434 - protein, 35 aa, Cryptosporidium parvum
EGDTTTALGGDDDETGHASSNTNDSSSSNSNNNNS

SEQ ID NO: 2213435 - protein, 5 aa, Cryptosporidium parvum
EGEEY

SEQ ID NO: 2213436 - protein, 5 aa, Cryptosporidium parvum
EGEFY

SEQ ID NO: 2213437 - protein, 4 aa, Cryptosporidium parvum
EGEI

SEQ ID NO: 2213438 - protein, 4 aa, Cryptosporidium parvum
EGEK

SEQ ID NO: 2213439 - protein, 8 aa, Cryptosporidium parvum
EGELGDTI

SEQ ID NO: 2213440 - protein, 10 aa, Cryptosporidium parvum
EGESQKGLQS

SEQ ID NO: 2213441 - protein, 10 aa, Cryptosporidium parvum
EGFASSRWTN

SEQ ID NO: 2213442 - protein, 32 aa, Cryptosporidium parvum
EGGAGTGTGTGIKQTSSCSTHNNSSNNNIGRK

SEQ ID NO: 2213443 - protein, 6 aa, Cryptosporidium parvum
EGGCEN

SEQ ID NO: 2213444 - protein, 5 aa, Cryptosporidium parvum
EGGDY

SEQ ID NO: 2213445 - protein, 12 aa, Cryptosporidium parvum
EGGFKGRKRKNG

SEQ ID NO: 2213446 - protein, 8 aa, Cryptosporidium parvum
EGGGTQLS

SEQ ID NO: 2213447 - protein, 8 aa, Cryptosporidium parvum
EGGIDAGG

SEQ ID NO: 2213448 - protein, 4 aa, Cryptosporidium parvum
EGGS

SEQ ID NO: 2213449 - protein, 8 aa, Cryptosporidium parvum
EGGSHDRT

SEQ ID NO: 2213450 - protein, 13 aa, Cryptosporidium parvum
EGGTSLSGGQKTR

SEQ ID NO: 2213451 - protein, 4 aa, Cryptosporidium parvum
EGGV

SEQ ID NO: 2213452 - protein, 5 aa, Cryptosporidium parvum
EGHSA

SEQ ID NO: 2213453 - protein, 6 aa, Cryptosporidium parvum
EGHSYT

SEQ ID NO: 2213454 - protein, 23 aa, Cryptosporidium parvum
EGIAEKDKIGGESKYKLKPGYQI

SEQ ID NO: 2213455 - protein, 10 aa, Cryptosporidium parvum
EGIKSEKKEI

SEQ ID NO: 2213456 - protein, 9 aa, Cryptosporidium parvum
EGIKSGSLN

SEQ ID NO: 2213457 - protein, 11 aa, Cryptosporidium parvum
EGISKDDEYSQ

SEQ ID NO: 2213458 - protein, 6 aa, Cryptosporidium parvum
EGISSA

SEQ ID NO: 2213459 - protein, 6 aa, Cryptosporidium parvum
EGITPG

SEQ ID NO: 2213460 - protein, 5 aa, Cryptosporidium parvum
EGITS

SEQ ID NO: 2213461 - protein, 4 aa, Cryptosporidium parvum
EGIY

SEQ ID NO: 2213462 - protein, 11 aa, Cryptosporidium parvum
EGKETKEGSIQ

SEQ ID NO: 2213463 - protein, 11 aa, Cryptosporidium parvum
EGKFTEGPNGR

SEQ ID NO: 2213464 - protein, 9 aa, Cryptosporidium parvum
EGKISAPPV

SEQ ID NO: 2213465 - protein, 5 aa, Cryptosporidium parvum
EGKKL

SEQ ID NO: 2213466 - protein, 8 aa, Cryptosporidium parvum
EGKLTRQN

SEQ ID NO: 2213467 - protein, 4 aa, Cryptosporidium parvum
EGKN

SEQ ID NO: 2213468 - protein, 9 aa, Cryptosporidium parvum
EGKNTNKKH

SEQ ID NO: 2213469 - protein, 7 aa, Cryptosporidium parvum
EGKSSFE

SEQ ID NO: 2213470 - protein, 9 aa, Cryptosporidium parvum
EGLAPNEGE

SEQ ID NO: 2213471 - protein, 13 aa, Cryptosporidium parvum
EGLEHSQKNNIAN

SEQ ID NO: 2213472 - protein, 7 aa, Cryptosporidium parvum
EGLQSNT

SEQ ID NO: 2213473 - protein, 13 aa, Cryptosporidium parvum
EGNDTGNVTKSDI

SEQ ID NO: 2213474 - protein, 12 aa, Cryptosporidium parvum
EGNNDECNEQKK

SEQ ID NO: 2213475 - protein, 7 aa, Cryptosporidium parvum
EGNNSKI

SEQ ID NO: 2213476 - protein, 4 aa, Cryptosporidium parvum
EGNT

SEQ ID NO: 2213477 - protein, 21 aa, Cryptosporidium parvum
EGPIKDEESESSGSESSNLKA

SEQ ID NO: 2213478 - protein, 10 aa, Cryptosporidium parvum
EGPPQQSPRL

SEQ ID NO: 2213479 - protein, 4 aa, Cryptosporidium parvum
EGPY

SEQ ID NO: 2213480 - protein, 4 aa, Cryptosporidium parvum
EGRK

SEQ ID NO: 2213481 - protein, 8 aa, Cryptosporidium parvum
EGRKRSTN

SEQ ID NO: 2213482 - protein, 4 aa, Cryptosporidium parvum
EGRR

SEQ ID NO: 2213483 - protein, 9 aa, Cryptosporidium parvum
EGRWESENQ

SEQ ID NO: 2213484 - protein, 23 aa, Cryptosporidium parvum
EGSLDGWTQNKPQLLTSSSDKTF

SEQ ID NO: 2213485 - protein, 5 aa, Cryptosporidium parvum
EGSNF

SEQ ID NO: 2213486 - protein, 17 aa, Cryptosporidium parvum
EGSPNDISIDDNDNYEE

SEQ ID NO: 2213487 - protein, 4 aa, Cryptosporidium parvum
EGSY

SEQ ID NO: 2213488 - protein, 9 aa, Cryptosporidium parvum
EGTFTGTSI

SEQ ID NO: 2213489 - protein, 10 aa, Cryptosporidium parvum
EGTPSNNGSH

SEQ ID NO: 2213490 - protein, 8 aa, Cryptosporidium parvum
EGTQKSDF

SEQ ID NO: 2213491 - protein, 6 aa, Cryptosporidium parvum
EGTTDF

SEQ ID NO: 2213492 - protein, 9 aa, Cryptosporidium parvum
EGTTTNGSS

SEQ ID NO: 2213493 - protein, 7 aa, Cryptosporidium parvum
EGVGNSY

SEQ ID NO: 2213494 - protein, 10 aa, Cryptosporidium parvum
EGVKPTNGSS

SEQ ID NO: 2213495 - protein, 6 aa, Cryptosporidium parvum
EGVRKN

SEQ ID NO: 2213496 - protein, 7 aa, Cryptosporidium parvum
EGYFNTS

SEQ ID NO: 2213497 - protein, 45 aa, Cryptosporidium parvum
EGYKLSGSKNSASNEKPVTLGSSSKSIGGNSTDNNVSNNNEIKSL

SEQ ID NO: 2213498 - protein, 8 aa, Cryptosporidium parvum
EGYSAGAL

SEQ ID NO: 2213499 - protein, 11 aa, Cryptosporidium parvum
EGYTPAEGARR

SEQ ID NO: 2213500 - protein, 4 aa, Cryptosporidium parvum
EHCN

SEQ ID NO: 2213501 - protein, 9 aa, Cryptosporidium parvum
EHDNDQLNT

SEQ ID NO: 2213502 - protein, 7 aa, Cryptosporidium parvum
EHGPPIE

SEQ ID NO: 2213503 - protein, 4 aa, Cryptosporidium parvum
EHIK

SEQ ID NO: 2213504 - protein, 8 aa, Cryptosporidium parvum
EHKNTSLQ

SEQ ID NO: 2213505 - protein, 5 aa, Cryptosporidium parvum
EHKQE

SEQ ID NO: 2213506 - protein, 12 aa, Cryptosporidium parvum
EHNMKKPRDDED

SEQ ID NO: 2213507 - protein, 32 aa, Cryptosporidium parvum
EHNNESKVSNIVSSSSSNSNQPPLLSNSDNHV

SEQ ID NO: 2213508 - protein, 14 aa, Cryptosporidium parvum
EHNRQMKDSKCKET

SEQ ID NO: 2213509 - protein, 5 aa, Cryptosporidium parvum
EHPGR

SEQ ID NO: 2213510 - protein, 6 aa, Cryptosporidium parvum
EHQATT

SEQ ID NO: 2213511 - protein, 6 aa, Cryptosporidium parvum
EHSDAK

SEQ ID NO: 2213512 - protein, 13 aa, Cryptosporidium parvum
EHSEDDSEDFSKA

SEQ ID NO: 2213513 - protein, 5 aa, Cryptosporidium parvum
EHSGE

SEQ ID NO: 2213514 - protein, 19 aa, Cryptosporidium parvum
EHSKRSNSNFKLNNDSDTV

SEQ ID NO: 2213515 - protein, 7 aa, Cryptosporidium parvum
EHSNKNS

SEQ ID NO: 2213516 - protein, 7 aa, Cryptosporidium parvum
EHSNNTY

SEQ ID NO: 2213517 - protein, 10 aa, Cryptosporidium parvum
EHTEKQKITP

SEQ ID NO: 2213518 - protein, 27 aa, Cryptosporidium parvum
EHYSSIENGESTEMNNIKDKDEKVRDG

SEQ ID NO: 2213519 - protein, 5 aa, Cryptosporidium parvum
EIAET

SEQ ID NO: 2213520 - protein, 12 aa, Cryptosporidium parvum
EIDEDKDEYVPN

SEQ ID NO: 2213521 - protein, 7 aa, Cryptosporidium parvum
EIDGSSI

SEQ ID NO: 2213522 - protein, 9 aa, Cryptosporidium parvum
EIDNGTQKW

SEQ ID NO: 2213523 - protein, 7 aa, Cryptosporidium parvum
EIEDSEL

SEQ ID NO: 2213524 - protein, 11 aa, Cryptosporidium parvum
EIEGGADSERY

SEQ ID NO: 2213525 - protein, 13 aa, Cryptosporidium parvum
EIEGRKKKKYDNY

SEQ ID NO: 2213526 - protein, 9 aa, Cryptosporidium parvum
EIENDKNGA

SEQ ID NO: 2213527 - protein, 15 aa, Cryptosporidium parvum
EIGADKNGENSSSNE

SEQ ID NO: 2213528 - protein, 5 aa, Cryptosporidium parvum
EIGEN

SEQ ID NO: 2213529 - protein, 6 aa, Cryptosporidium parvum
EIGNTD

SEQ ID NO: 2213530 - protein, 5 aa, Cryptosporidium parvum
EIING

SEQ ID NO: 2213531 - protein, 5 aa, Cryptosporidium parvum
EIIPP

SEQ ID NO: 2213532 - protein, 10 aa, Cryptosporidium parvum
EIKKNDSLYE

SEQ ID NO: 2213533 - protein, 7 aa, Cryptosporidium parvum
EIKNKSS

SEQ ID NO: 2213534 - protein, 19 aa, Cryptosporidium parvum
EIKQDEKENSRFETKTKNS

SEQ ID NO: 2213535 - protein, 9 aa, Cryptosporidium parvum
EINIDQSTS

SEQ ID NO: 2213536 - protein, 10 aa, Cryptosporidium parvum
EINKQSENTV

SEQ ID NO: 2213537 - protein, 4 aa, Cryptosporidium parvum
EINN

SEQ ID NO: 2213538 - protein, 9 aa, Cryptosporidium parvum
EINSDEDKI

SEQ ID NO: 2213539 - protein, 14 aa, Cryptosporidium parvum
EIPNNANSVTGSNV

SEQ ID NO: 2213540 - protein, 8 aa, Cryptosporidium parvum
EIPRGERY

SEQ ID NO: 2213541 - protein, 5 aa, Cryptosporidium parvum
EIPRT

SEQ ID NO: 2213542 - protein, 48 aa, Cryptosporidium parvum
EIPSGLEDYNTDAGTVTTDTYSDSDIDTNSIDAYSGDSTDTDNRVQDE

SEQ ID NO: 2213543 - protein, 10 aa, Cryptosporidium parvum
EIPSSTSEKE

SEQ ID NO: 2213544 - protein, 7 aa, Cryptosporidium parvum
EIPTEED

SEQ ID NO: 2213545 - protein, 21 aa, Cryptosporidium parvum
EIQDQSTGNKNTNNSPDNEMQ

SEQ ID NO: 2213546 - protein, 8 aa, Cryptosporidium parvum
EIQSKESV

SEQ ID NO: 2213547 - protein, 13 aa, Cryptosporidium parvum
EIQTNQNASEACN

SEQ ID NO: 2213548 - protein, 4 aa, Cryptosporidium parvum
EIRD

SEQ ID NO: 2213549 - protein, 4 aa, Cryptosporidium parvum
EIRR

SEQ ID NO: 2213550 - protein, 7 aa, Cryptosporidium parvum
EIRTGPI

SEQ ID NO: 2213551 - protein, 10 aa, Cryptosporidium parvum
EIRTKQQARD

SEQ ID NO: 2213552 - protein, 19 aa, Cryptosporidium parvum
EISASHSSATFTDSRNTFQ

SEQ ID NO: 2213553 - protein, 4 aa, Cryptosporidium parvum
EISE

SEQ ID NO: 2213554 - protein, 6 aa, Cryptosporidium parvum
EISEDE

SEQ ID NO: 2213555 - protein, 8 aa, Cryptosporidium parvum
EISETDPN

SEQ ID NO: 2213556 - protein, 4 aa, Cryptosporidium parvum
EISK

SEQ ID NO: 2213557 - protein, 11 aa, Cryptosporidium parvum
EISKEKAEFNE

SEQ ID NO: 2213558 - protein, 14 aa, Cryptosporidium parvum
EISNDDNLKLSDET

SEQ ID NO: 2213559 - protein, 5 aa, Cryptosporidium parvum
EISPD

SEQ ID NO: 2213560 - protein, 8 aa, Cryptosporidium parvum
EISPGGAK

SEQ ID NO: 2213561 - protein, 9 aa, Cryptosporidium parvum
EISPGKRNT

SEQ ID NO: 2213562 - protein, 8 aa, Cryptosporidium parvum
EISPNEAY

SEQ ID NO: 2213563 - protein, 7 aa, Cryptosporidium parvum
EISSDNM

SEQ ID NO: 2213564 - protein, 6 aa, Cryptosporidium parvum
EISSHS

SEQ ID NO: 2213565 - protein, 10 aa, Cryptosporidium parvum
EISTQYSKNS

SEQ ID NO: 2213566 - protein, 5 aa, Cryptosporidium parvum
EITGL

SEQ ID NO: 2213567 - protein, 5 aa, Cryptosporidium parvum
EITIN

SEQ ID NO: 2213568 - protein, 7 aa, Cryptosporidium parvum
EITKPKH

SEQ ID NO: 2213569 - protein, 7 aa, Cryptosporidium parvum
EITSNNQ

SEQ ID NO: 2213570 - protein, 6 aa, Cryptosporidium parvum
EKAKDS

SEQ ID NO: 2213571 - protein, 6 aa, Cryptosporidium parvum
EKALQA

SEQ ID NO: 2213572 - protein, 12 aa, Cryptosporidium parvum
EKANGYGRGEGS

SEQ ID NO: 2213573 - protein, 11 aa, Cryptosporidium parvum
EKAPTRPQRRK

SEQ ID NO: 2213574 - protein, 4 aa, Cryptosporidium parvum
EKAR

SEQ ID NO: 2213575 - protein, 7 aa, Cryptosporidium parvum
EKARDEK

SEQ ID NO: 2213576 - protein, 5 aa, Cryptosporidium parvum
EKARN

SEQ ID NO: 2213577 - protein, 7 aa, Cryptosporidium parvum
EKATENL

SEQ ID NO: 2213578 - protein, 8 aa, Cryptosporidium parvum
EKDEDDLP

SEQ ID NO: 2213579 - protein, 10 aa, Cryptosporidium parvum
EKDEDNITSL

SEQ ID NO: 2213580 - protein, 18 aa, Cryptosporidium parvum
EKDEKEKESEKDTKKKQN

SEQ ID NO: 2213581 - protein, 5 aa, Cryptosporidium parvum
EKDES

SEQ ID NO: 2213582 - protein, 14 aa, Cryptosporidium parvum
EKDGDRTVDRTKND

SEQ ID NO: 2213583 - protein, 8 aa, Cryptosporidium parvum
EKDPTNDS

SEQ ID NO: 2213584 - protein, 10 aa, Cryptosporidium parvum
EKDSEKSNYK

SEQ ID NO: 2213585 - protein, 7 aa, Cryptosporidium parvum
EKDYNKS

SEQ ID NO: 2213586 - protein, 5 aa, Cryptosporidium parvum
EKEED

SEQ ID NO: 2213587 - protein, 6 aa, Cryptosporidium parvum
EKEENL

SEQ ID NO: 2213588 - protein, 8 aa, Cryptosporidium parvum
EKEFSEQK

SEQ ID NO: 2213589 - protein, 9 aa, Cryptosporidium parvum
EKEGKDEKV

SEQ ID NO: 2213590 - protein, 8 aa, Cryptosporidium parvum
EKEHSGYG

SEQ ID NO: 2213591 - protein, 7 aa, Cryptosporidium parvum
EKEKMEK

SEQ ID NO: 2213592 - protein, 8 aa, Cryptosporidium parvum
EKEKRRNQ

SEQ ID NO: 2213593 - protein, 4 aa, Cryptosporidium parvum
EKEN

SEQ ID NO: 2213594 - protein, 11 aa, Cryptosporidium parvum
EKENQLGDKNW

SEQ ID NO: 2213595 - protein, 8 aa, Cryptosporidium parvum
EKEQRDVE

SEQ ID NO: 2213596 - protein, 8 aa, Cryptosporidium parvum
EKEQRQGD

SEQ ID NO: 2213597 - protein, 6 aa, Cryptosporidium parvum
EKERDD

SEQ ID NO: 2213598 - protein, 9 aa, Cryptosporidium parvum
EKERNNHQN

SEQ ID NO: 2213599 - protein, 12 aa, Cryptosporidium parvum
EKERSHKSQRES

SEQ ID NO: 2213600 - protein, 9 aa, Cryptosporidium parvum
EKERTPIEK

SEQ ID NO: 2213601 - protein, 6 aa, Cryptosporidium parvum
EKESNT

SEQ ID NO: 2213602 - protein, 17 aa, Cryptosporidium parvum
EKETKRESNELKPHDSA

SEQ ID NO: 2213603 - protein, 19 aa, Cryptosporidium parvum
EKFQGSDSIEEEDSNSELT

SEQ ID NO: 2213604 - protein, 7 aa, Cryptosporidium parvum
EKFTSSP

SEQ ID NO: 2213605 - protein, 7 aa, Cryptosporidium parvum
EKGDQIV

SEQ ID NO: 2213606 - protein, 10 aa, Cryptosporidium parvum
EKGIDKNSSR

SEQ ID NO: 2213607 - protein, 4 aa, Cryptosporidium parvum
EKGK

SEQ ID NO: 2213608 - protein, 6 aa, Cryptosporidium parvum
EKGKEI

SEQ ID NO: 2213609 - protein, 9 aa, Cryptosporidium parvum
EKGKENETF

SEQ ID NO: 2213610 - protein, 6 aa, Cryptosporidium parvum
EKGKLY

SEQ ID NO: 2213611 - protein, 10 aa, Cryptosporidium parvum
EKGLNENNTL

SEQ ID NO: 2213612 - protein, 11 aa, Cryptosporidium parvum
EKGVNSEPSPY

SEQ ID NO: 2213613 - protein, 5 aa, Cryptosporidium parvum
EKHYS

SEQ ID NO: 2213614 - protein, 7 aa, Cryptosporidium parvum
EKIDKTR

SEQ ID NO: 2213615 - protein, 12 aa, Cryptosporidium parvum
EKIINGNPSTIK

SEQ ID NO: 2213616 - protein, 15 aa, Cryptosporidium parvum
EKIKDNTNKTIGDNK

SEQ ID NO: 2213617 - protein, 5 aa, Cryptosporidium parvum
EKINP

SEQ ID NO: 2213618 - protein, 10 aa, Cryptosporidium parvum
EKIPKDQDNS

SEQ ID NO: 2213619 - protein, 6 aa, Cryptosporidium parvum
EKIQLE

SEQ ID NO: 2213620 - protein, 11 aa, Cryptosporidium parvum
EKISESQGISK

SEQ ID NO: 2213621 - protein, 25 aa, Cryptosporidium parvum
EKITIDSSGISGSLSLKDEKSECSA

SEQ ID NO: 2213622 - protein, 14 aa, Cryptosporidium parvum
EKKAESNLNDDEYS

SEQ ID NO: 2213623 - protein, 6 aa, Cryptosporidium parvum
EKKDTF

SEQ ID NO: 2213624 - protein, 7 aa, Cryptosporidium parvum
EKKECYK

SEQ ID NO: 2213625 - protein, 8 aa, Cryptosporidium parvum
EKKEEMPE

SEQ ID NO: 2213626 - protein, 8 aa, Cryptosporidium parvum
EKKELNNL

SEQ ID NO: 2213627 - protein, 26 aa, Cryptosporidium parvum
EKKENRERKQREKKIKEEKERLERER

SEQ ID NO: 2213628 - protein, 14 aa, Cryptosporidium parvum
EKKGSQSKQASEWS

SEQ ID NO: 2213629 - protein, 4 aa, Cryptosporidium parvum
EKKN

SEQ ID NO: 2213630 - protein, 16 aa, Cryptosporidium parvum
EKKNRNLTDKEKKELQ

SEQ ID NO: 2213631 - protein, 7 aa, Cryptosporidium parvum
EKKPEFE

SEQ ID NO: 2213632 - protein, 7 aa, Cryptosporidium parvum
EKKSISN

SEQ ID NO: 2213633 - protein, 26 aa, Cryptosporidium parvum
EKKSSSDTLFSKSGSNHQKSNNQQKI

SEQ ID NO: 2213634 - protein, 14 aa, Cryptosporidium parvum
EKKTNSRNFNPKNS

SEQ ID NO: 2213635 - protein, 8 aa, Cryptosporidium parvum
EKKVTSNA

SEQ ID NO: 2213636 - protein, 9 aa, Cryptosporidium parvum
EKKYNGYRY

SEQ ID NO: 2213637 - protein, 5 aa, Cryptosporidium parvum
EKLKD

SEQ ID NO: 2213638 - protein, 6 aa, Cryptosporidium parvum
EKLNAS

SEQ ID NO: 2213639 - protein, 5 aa, Cryptosporidium parvum
EKLQD

SEQ ID NO: 2213640 - protein, 5 aa, Cryptosporidium parvum
EKLSG

SEQ ID NO: 2213641 - protein, 37 aa, Cryptosporidium parvum
EKLSGRKRTEEEKDDNYNRRNNMKSNNNNRGKEESLN

SEQ ID NO: 2213642 - protein, 6 aa, Cryptosporidium parvum
EKLSPN

SEQ ID NO: 2213643 - protein, 7 aa, Cryptosporidium parvum
EKMKNSS

SEQ ID NO: 2213644 - protein, 7 aa, Cryptosporidium parvum
EKMPTTA

SEQ ID NO: 2213645 - protein, 39 aa, Cryptosporidium parvum
EKNDREKQEQGKKQEEREGERNLDNSEKSKNEKRLKNNS

SEQ ID NO: 2213646 - protein, 4 aa, Cryptosporidium parvum
EKNE

SEQ ID NO: 2213647 - protein, 10 aa, Cryptosporidium parvum
EKNEAPSYSY

SEQ ID NO: 2213648 - protein, 10 aa, Cryptosporidium parvum
EKNEQIEDKF

SEQ ID NO: 2213649 - protein, 9 aa, Cryptosporidium parvum
EKNEQKYNE

SEQ ID NO: 2213650 - protein, 4 aa, Cryptosporidium parvum
EKNF

SEQ ID NO: 2213651 - protein, 9 aa, Cryptosporidium parvum
EKNGAAVNN

SEQ ID NO: 2213652 - protein, 7 aa, Cryptosporidium parvum
EKNGNEY

SEQ ID NO: 2213653 - protein, 8 aa, Cryptosporidium parvum
EKNKDEKK

SEQ ID NO: 2213654 - protein, 6 aa, Cryptosporidium parvum
EKNKEI

SEQ ID NO: 2213655 - protein, 12 aa, Cryptosporidium parvum
EKNKETHSAMGG

SEQ ID NO: 2213656 - protein, 6 aa, Cryptosporidium parvum
EKNKLN

SEQ ID NO: 2213657 - protein, 11 aa, Cryptosporidium parvum
EKNKSSNEAVN

SEQ ID NO: 2213658 - protein, 13 aa, Cryptosporidium parvum
EKNNLTESSESDF

SEQ ID NO: 2213659 - protein, 9 aa, Cryptosporidium parvum
EKNPKGGYP

SEQ ID NO: 2213660 - protein, 20 aa, Cryptosporidium parvum
EKNQESGFDSSNLPRGITTA

SEQ ID NO: 2213661 - protein, 11 aa, Cryptosporidium parvum
EKNQTVNNYQP

SEQ ID NO: 2213662 - protein, 6 aa, Cryptosporidium parvum
EKNRYG

SEQ ID NO: 2213663 - protein, 8 aa, Cryptosporidium parvum
EKNSFRGL

SEQ ID NO: 2213664 - protein, 10 aa, Cryptosporidium parvum
EKNSSENGAS

SEQ ID NO: 2213665 - protein, 6 aa, Cryptosporidium parvum
EKNSVN

SEQ ID NO: 2213666 - protein, 12 aa, Cryptosporidium parvum
EKNTEDFKPEKI

SEQ ID NO: 2213667 - protein, 12 aa, Cryptosporidium parvum
EKNTNTISDTSN

SEQ ID NO: 2213668 - protein, 12 aa, Cryptosporidium parvum
EKNVEDSINENT

SEQ ID NO: 2213669 - protein, 4 aa, Cryptosporidium parvum
EKNY

SEQ ID NO: 2213670 - protein, 6 aa, Cryptosporidium parvum
EKPEMT

SEQ ID NO: 2213671 - protein, 7 aa, Cryptosporidium parvum
EKPHEGN

SEQ ID NO: 2213672 - protein, 7 aa, Cryptosporidium parvum
EKPLKGK

SEQ ID NO: 2213673 - protein, 15 aa, Cryptosporidium parvum
EKPQNKDKIGKLDPL

SEQ ID NO: 2213674 - protein, 13 aa, Cryptosporidium parvum
EKPVENNDTDLAK

SEQ ID NO: 2213675 - protein, 41 aa, Cryptosporidium parvum
EKQEIGKNMESQRIEQQEAGNNLSTQKMKSSNRSGSNSNYN

SEQ ID NO: 2213676 - protein, 6 aa, Cryptosporidium parvum
EKQGKS

SEQ ID NO: 2213677 - protein, 12 aa, Cryptosporidium parvum
EKQKWGHPKSAG

SEQ ID NO: 2213678 - protein, 12 aa, Cryptosporidium parvum
EKQLSASGQEIG

SEQ ID NO: 2213679 - protein, 9 aa, Cryptosporidium parvum
EKQNPKSYW

SEQ ID NO: 2213680 - protein, 8 aa, Cryptosporidium parvum
EKQPEKKQ

SEQ ID NO: 2213681 - protein, 11 aa, Cryptosporidium parvum
EKQTTKTYDEE

SEQ ID NO: 2213682 - protein, 7 aa, Cryptosporidium parvum
EKREITP

SEQ ID NO: 2213683 - protein, 7 aa, Cryptosporidium parvum
EKRGDLR

SEQ ID NO: 2213684 - protein, 8 aa, Cryptosporidium parvum
EKRNEYSE

SEQ ID NO: 2213685 - protein, 6 aa, Cryptosporidium parvum
EKRPEE

SEQ ID NO: 2213686 - protein, 4 aa, Cryptosporidium parvum
EKRS

SEQ ID NO: 2213687 - protein, 8 aa, Cryptosporidium parvum
EKRTNDSS

SEQ ID NO: 2213688 - protein, 9 aa, Cryptosporidium parvum
EKSCSTGEI

SEQ ID NO: 2213689 - protein, 7 aa, Cryptosporidium parvum
EKSDNTV

SEQ ID NO: 2213690 - protein, 8 aa, Cryptosporidium parvum
EKSDSLYD

SEQ ID NO: 2213691 - protein, 8 aa, Cryptosporidium parvum
EKSEARQN

SEQ ID NO: 2213692 - protein, 11 aa, Cryptosporidium parvum
EKSGNSTLSTN

SEQ ID NO: 2213693 - protein, 4 aa, Cryptosporidium parvum
EKSK

SEQ ID NO: 2213694 - protein, 10 aa, Cryptosporidium parvum
EKSKESKTKY

SEQ ID NO: 2213695 - protein, 24 aa, Cryptosporidium parvum
EKSKNNTLERREKGLHSDDYYEKK

SEQ ID NO: 2213696 - protein, 7 aa, Cryptosporidium parvum
EKSLRSK

SEQ ID NO: 2213697 - protein, 6 aa, Cryptosporidium parvum
EKSLTG

SEQ ID NO: 2213698 - protein, 7 aa, Cryptosporidium parvum
EKSLYSS

SEQ ID NO: 2213699 - protein, 6 aa, Cryptosporidium parvum
EKSNEL

SEQ ID NO: 2213700 - protein, 7 aa, Cryptosporidium parvum
EKSNRTQ

SEQ ID NO: 2213701 - protein, 8 aa, Cryptosporidium parvum
EKSQEQMN

SEQ ID NO: 2213702 - protein, 7 aa, Cryptosporidium parvum
EKSQRQR

SEQ ID NO: 2213703 - protein, 9 aa, Cryptosporidium parvum
EKSRPGNID

SEQ ID NO: 2213704 - protein, 9 aa, Cryptosporidium parvum
EKSTPDEQD

SEQ ID NO: 2213705 - protein, 10 aa, Cryptosporidium parvum
EKSVKENENL

SEQ ID NO: 2213706 - protein, 8 aa, Cryptosporidium parvum
EKSVSNDE

SEQ ID NO: 2213707 - protein, 4 aa, Cryptosporidium parvum
EKTD

SEQ ID NO: 2213708 - protein, 8 aa, Cryptosporidium parvum
EKTESDIP

SEQ ID NO: 2213709 - protein, 8 aa, Cryptosporidium parvum
EKTESKTV

SEQ ID NO: 2213710 - protein, 6 aa, Cryptosporidium parvum
EKTGGV

SEQ ID NO: 2213711 - protein, 9 aa, Cryptosporidium parvum
EKTLKDTNI

SEQ ID NO: 2213712 - protein, 12 aa, Cryptosporidium parvum
EKTNLEQNGSLN

SEQ ID NO: 2213713 - protein, 7 aa, Cryptosporidium parvum
EKTREQL

SEQ ID NO: 2213714 - protein, 12 aa, Cryptosporidium parvum
EKTSESKISNLN

SEQ ID NO: 2213715 - protein, 7 aa, Cryptosporidium parvum
EKTSFSE

SEQ ID NO: 2213716 - protein, 8 aa, Cryptosporidium parvum
EKTYDQHM

SEQ ID NO: 2213717 - protein, 62 aa, Cryptosporidium parvum
EKVKGKGKGRMKEEEEEEEEEEEEEGEEEEEKEEEEEEEEEGKEKEGDDEEDDGEKGETEED

SEQ ID NO: 2213718 - protein, 29 aa, Cryptosporidium parvum
EKVTGKKLKVNKENIRSMNQSNKKRKAKT

SEQ ID NO: 2213719 - protein, 7 aa, Cryptosporidium parvum
EKVTTAK

SEQ ID NO: 2213720 - protein, 5 aa, Cryptosporidium parvum
EKWEG

SEQ ID NO: 2213721 - protein, 7 aa, Cryptosporidium parvum
EKYDEPQ

SEQ ID NO: 2213722 - protein, 6 aa, Cryptosporidium parvum
EKYENS

SEQ ID NO: 2213723 - protein, 4 aa, Cryptosporidium parvum
EKYK

SEQ ID NO: 2213724 - protein, 8 aa, Cryptosporidium parvum
EKYQTGGF

SEQ ID NO: 2213725 - protein, 4 aa, Cryptosporidium parvum
EKYR

SEQ ID NO: 2213726 - protein, 13 aa, Cryptosporidium parvum
ELANEGKAVGRTS

SEQ ID NO: 2213727 - protein, 20 aa, Cryptosporidium parvum
ELDEDDYPYNPNCGAQSQSN

SEQ ID NO: 2213728 - protein, 15 aa, Cryptosporidium parvum
ELDENNSNLQLKPNS

SEQ ID NO: 2213729 - protein, 12 aa, Cryptosporidium parvum
ELDKSRKKMSSI

SEQ ID NO: 2213730 - protein, 6 aa, Cryptosporidium parvum
ELDQDN

SEQ ID NO: 2213731 - protein, 9 aa, Cryptosporidium parvum
ELDSQDSSV

SEQ ID NO: 2213732 - protein, 13 aa, Cryptosporidium parvum
ELEDEVENEKSTW

SEQ ID NO: 2213733 - protein, 25 aa, Cryptosporidium parvum
ELEEEEDDDDDNDDVDNDDDVKGKL

SEQ ID NO: 2213734 - protein, 4 aa, Cryptosporidium parvum
ELEG

SEQ ID NO: 2213735 - protein, 5 aa, Cryptosporidium parvum
ELEGR

SEQ ID NO: 2213736 - protein, 6 aa, Cryptosporidium parvum
ELEKGT

SEQ ID NO: 2213737 - protein, 9 aa, Cryptosporidium parvum
ELEKSTTEE

SEQ ID NO: 2213738 - protein, 16 aa, Cryptosporidium parvum
ELENNSNKTNHSVSTI

SEQ ID NO: 2213739 - protein, 22 aa, Cryptosporidium parvum
ELEPGNESQKQNCTIEDSNNPM

SEQ ID NO: 2213740 - protein, 12 aa, Cryptosporidium parvum
ELERSSNKPTSI

SEQ ID NO: 2213741 - protein, 7 aa, Cryptosporidium parvum
ELGDDEV

SEQ ID NO: 2213742 - protein, 6 aa, Cryptosporidium parvum
ELGDER

SEQ ID NO: 2213743 - protein, 4 aa, Cryptosporidium parvum
ELGS

SEQ ID NO: 2213744 - protein, 7 aa, Cryptosporidium parvum
ELGTPKY

SEQ ID NO: 2213745 - protein, 8 aa, Cryptosporidium parvum
ELKAEGKD

SEQ ID NO: 2213746 - protein, 9 aa, Cryptosporidium parvum
ELKEEKDEN

SEQ ID NO: 2213747 - protein, 11 aa, Cryptosporidium parvum
ELKSGSNPCTK

SEQ ID NO: 2213748 - protein, 8 aa, Cryptosporidium parvum
ELKSSSSV

SEQ ID NO: 2213749 - protein, 4 aa, Cryptosporidium parvum
ELMK

SEQ ID NO: 2213750 - protein, 8 aa, Cryptosporidium parvum
ELNDPSKV

SEQ ID NO: 2213751 - protein, 8 aa, Cryptosporidium parvum
ELNDPTAY

SEQ ID NO: 2213752 - protein, 10 aa, Cryptosporidium parvum
ELNGIEDDSY

SEQ ID NO: 2213753 - protein, 16 aa, Cryptosporidium parvum
ELNGKDDSNKIEDRSG

SEQ ID NO: 2213754 - protein, 12 aa, Cryptosporidium parvum
ELNGSNSSLPSM

SEQ ID NO: 2213755 - protein, 6 aa, Cryptosporidium parvum
ELNKPG

SEQ ID NO: 2213756 - protein, 5 aa, Cryptosporidium parvum
ELNNE

SEQ ID NO: 2213757 - protein, 13 aa, Cryptosporidium parvum
ELNNGKSKAGGWG

SEQ ID NO: 2213758 - protein, 11 aa, Cryptosporidium parvum
ELNNHKTDTNL

SEQ ID NO: 2213759 - protein, 17 aa, Cryptosporidium parvum
ELNNKDDPEKSSEKHST

SEQ ID NO: 2213760 - protein, 4 aa, Cryptosporidium parvum
ELNS

SEQ ID NO: 2213761 - protein, 7 aa, Cryptosporidium parvum
ELNTSNK

SEQ ID NO: 2213762 - protein, 8 aa, Cryptosporidium parvum
ELPDRSME

SEQ ID NO: 2213763 - protein, 19 aa, Cryptosporidium parvum
ELPEISNDEIQNTKSIKKE

SEQ ID NO: 2213764 - protein, 13 aa, Cryptosporidium parvum
ELPKNQNKVNSSK

SEQ ID NO: 2213765 - protein, 27 aa, Cryptosporidium parvum
ELPNKSNFPQIDNQKSPNRVTTGNIPN

SEQ ID NO: 2213766 - protein, 7 aa, Cryptosporidium parvum
ELPPPRT

SEQ ID NO: 2213767 - protein, 9 aa, Cryptosporidium parvum
ELPPTTSTN

SEQ ID NO: 2213768 - protein, 5 aa, Cryptosporidium parvum
ELPPY

SEQ ID NO: 2213769 - protein, 7 aa, Cryptosporidium parvum
ELPYETE

SEQ ID NO: 2213770 - protein, 10 aa, Cryptosporidium parvum
ELQESTKRRV

SEQ ID NO: 2213771 - protein, 20 aa, Cryptosporidium parvum
ELQGSNQHFKEKENHSKDLS

SEQ ID NO: 2213772 - protein, 12 aa, Cryptosporidium parvum
ELQNGNSKEARS

SEQ ID NO: 2213773 - protein, 10 aa, Cryptosporidium parvum
ELQNNGSFES

SEQ ID NO: 2213774 - protein, 9 aa, Cryptosporidium parvum
ELRQESNGM

SEQ ID NO: 2213775 - protein, 18 aa, Cryptosporidium parvum
ELRTSSSKIQDEAQSCSD

SEQ ID NO: 2213776 - protein, 5 aa, Cryptosporidium parvum
ELSEA

SEQ ID NO: 2213777 - protein, 5 aa, Cryptosporidium parvum
ELSEN

SEQ ID NO: 2213778 - protein, 7 aa, Cryptosporidium parvum
ELSHSSE

SEQ ID NO: 2213779 - protein, 9 aa, Cryptosporidium parvum
ELSKAELNR

SEQ ID NO: 2213780 - protein, 11 aa, Cryptosporidium parvum
ELSKEEARNRS

SEQ ID NO: 2213781 - protein, 16 aa, Cryptosporidium parvum
ELSNESLEKQEVDKEY

SEQ ID NO: 2213782 - protein, 7 aa, Cryptosporidium parvum
ELSPSRV

SEQ ID NO: 2213783 - protein, 11 aa, Cryptosporidium parvum
ELSTSANSYYQ

SEQ ID NO: 2213784 - protein, 5 aa, Cryptosporidium parvum
ELTDE

SEQ ID NO: 2213785 - protein, 12 aa, Cryptosporidium parvum
ELTKKQNNTSIN

SEQ ID NO: 2213786 - protein, 27 aa, Cryptosporidium parvum
ELTKTSNDNNKEKNVENVSENEIPASP

SEQ ID NO: 2213787 - protein, 17 aa, Cryptosporidium parvum
ELTQKDRTFSDVQSGTT

SEQ ID NO: 2213788 - protein, 11 aa, Cryptosporidium parvum
ELTQQKASELN

SEQ ID NO: 2213789 - protein, 5 aa, Cryptosporidium parvum
ELTSG

SEQ ID NO: 2213790 - protein, 13 aa, Cryptosporidium parvum
EMEGGKHKKKEEA

SEQ ID NO: 2213791 - protein, 12 aa, Cryptosporidium parvum
EMEKSKSDEVEV

SEQ ID NO: 2213792 - protein, 10 aa, Cryptosporidium parvum
EMEPKAEKRA

SEQ ID NO: 2213793 - protein, 4 aa, Cryptosporidium parvum
EMES

SEQ ID NO: 2213794 - protein, 6 aa, Cryptosporidium parvum
EMKEYQ

SEQ ID NO: 2213795 - protein, 4 aa, Cryptosporidium parvum
EMKG

SEQ ID NO: 2213796 - protein, 4 aa, Cryptosporidium parvum
EMKN

SEQ ID NO: 2213797 - protein, 12 aa, Cryptosporidium parvum
EMNLGTSSSIMG

SEQ ID NO: 2213798 - protein, 33 aa, Cryptosporidium parvum
EMNNSEDLLNNSNPKIARTCSNSKFRNSSKYSK

SEQ ID NO: 2213799 - protein, 5 aa, Cryptosporidium parvum
EMNTD

SEQ ID NO: 2213800 - protein, 7 aa, Cryptosporidium parvum
EMPPDDK

SEQ ID NO: 2213801 - protein, 7 aa, Cryptosporidium parvum
EMSGNSL

SEQ ID NO: 2213802 - protein, 7 aa, Cryptosporidium parvum
EMTNSAH

SEQ ID NO: 2213803 - protein, 5 aa, Cryptosporidium parvum
ENAEK

SEQ ID NO: 2213804 - protein, 5 aa, Cryptosporidium parvum
ENAEN

SEQ ID NO: 2213805 - protein, 12 aa, Cryptosporidium parvum
ENAETTKIETND

SEQ ID NO: 2213806 - protein, 11 aa, Cryptosporidium parvum
ENAPAKKEMNI

SEQ ID NO: 2213807 - protein, 4 aa, Cryptosporidium parvum
ENAQ

SEQ ID NO: 2213808 - protein, 6 aa, Cryptosporidium parvum
ENCPTG

SEQ ID NO: 2213809 - protein, 7 aa, Cryptosporidium parvum
ENDAPDY

SEQ ID NO: 2213810 - protein, 16 aa, Cryptosporidium parvum
ENDDGNQLDDDKKKSH

SEQ ID NO: 2213811 - protein, 10 aa, Cryptosporidium parvum
ENDGHKNKIS

SEQ ID NO: 2213812 - protein, 5 aa, Cryptosporidium parvum
ENDGK

SEQ ID NO: 2213813 - protein, 6 aa, Cryptosporidium parvum
ENDKPL

SEQ ID NO: 2213814 - protein, 5 aa, Cryptosporidium parvum
ENDKT

SEQ ID NO: 2213815 - protein, 6 aa, Cryptosporidium parvum
ENDMKT

SEQ ID NO: 2213816 - protein, 6 aa, Cryptosporidium parvum
ENDNEE

SEQ ID NO: 2213817 - protein, 6 aa, Cryptosporidium parvum
ENDNKK

SEQ ID NO: 2213818 - protein, 10 aa, Cryptosporidium parvum
ENDNSVSYEQ

SEQ ID NO: 2213819 - protein, 6 aa, Cryptosporidium parvum
ENDPNY

SEQ ID NO: 2213820 - protein, 5 aa, Cryptosporidium parvum
ENDRK

SEQ ID NO: 2213821 - protein, 6 aa, Cryptosporidium parvum
ENECKN

SEQ ID NO: 2213822 - protein, 4 aa, Cryptosporidium parvum
ENED

SEQ ID NO: 2213823 - protein, 6 aa, Cryptosporidium parvum
ENEDFN

SEQ ID NO: 2213824 - protein, 9 aa, Cryptosporidium parvum
ENEDKYYEK

SEQ ID NO: 2213825 - protein, 18 aa, Cryptosporidium parvum
ENEEDNQLRGSRTGDNSL

SEQ ID NO: 2213826 - protein, 5 aa, Cryptosporidium parvum
ENEEL

SEQ ID NO: 2213827 - protein, 7 aa, Cryptosporidium parvum
ENEESTF

SEQ ID NO: 2213828 - protein, 6 aa, Cryptosporidium parvum
ENEFQS

SEQ ID NO: 2213829 - protein, 8 aa, Cryptosporidium parvum
ENEGFGSN

SEQ ID NO: 2213830 - protein, 8 aa, Cryptosporidium parvum
ENEGSPDQ

SEQ ID NO: 2213831 - protein, 8 aa, Cryptosporidium parvum
ENEHRRED

SEQ ID NO: 2213832 - protein, 16 aa, Cryptosporidium parvum
ENEHSPEEDEDFEEEY

SEQ ID NO: 2213833 - protein, 6 aa, Cryptosporidium parvum
ENEKGQ

SEQ ID NO: 2213834 - protein, 6 aa, Cryptosporidium parvum
ENELNT

SEQ ID NO: 2213835 - protein, 18 aa, Cryptosporidium parvum
ENELSENEKISNGKRISE

SEQ ID NO: 2213836 - protein, 9 aa, Cryptosporidium parvum
ENEMTDSEV

SEQ ID NO: 2213837 - protein, 6 aa, Cryptosporidium parvum
ENENGE

SEQ ID NO: 2213838 - protein, 5 aa, Cryptosporidium parvum
ENENL

SEQ ID NO: 2213839 - protein, 8 aa, Cryptosporidium parvum
ENEPEMTK

SEQ ID NO: 2213840 - protein, 7 aa, Cryptosporidium parvum
ENEPSIN

SEQ ID NO: 2213841 - protein, 13 aa, Cryptosporidium parvum
ENERGKLSGEGLF

SEQ ID NO: 2213842 - protein, 10 aa, Cryptosporidium parvum
ENERQPNPNY

SEQ ID NO: 2213843 - protein, 5 aa, Cryptosporidium parvum
ENERV

SEQ ID NO: 2213844 - protein, 82 aa, Cryptosporidium parvum
ENESTSSYKRSSGLSIDNRTDQTHEGSGKSNYEARRTSIGNNSDNITEESFEDPLDSSNSGGSSEEGSENEGIRSDTDVEEE

SEQ ID NO: 2213845 - protein, 5 aa, Cryptosporidium parvum
ENETG

SEQ ID NO: 2213846 - protein, 6 aa, Cryptosporidium parvum
ENETKS

SEQ ID NO: 2213847 - protein, 10 aa, Cryptosporidium parvum
ENETLNSKTK

SEQ ID NO: 2213848 - protein, 7 aa, Cryptosporidium parvum
ENEYVNE

SEQ ID NO: 2213849 - protein, 6 aa, Cryptosporidium parvum
ENFPPS

SEQ ID NO: 2213850 - protein, 13 aa, Cryptosporidium parvum
ENFTENDSEPTVQ

SEQ ID NO: 2213851 - protein, 35 aa, Cryptosporidium parvum
ENGANLSSSRKFVSSSSVSTFDDSSDNSPSESSSF

SEQ ID NO: 2213852 - protein, 10 aa, Cryptosporidium parvum
ENGDASRPHL

SEQ ID NO: 2213853 - protein, 7 aa, Cryptosporidium parvum
ENGEADN

SEQ ID NO: 2213854 - protein, 6 aa, Cryptosporidium parvum
ENGETF

SEQ ID NO: 2213855 - protein, 7 aa, Cryptosporidium parvum
ENGFKKS

SEQ ID NO: 2213856 - protein, 17 aa, Cryptosporidium parvum
ENGKSNTNTLEGSANSA

SEQ ID NO: 2213857 - protein, 8 aa, Cryptosporidium parvum
ENGKTNNF

SEQ ID NO: 2213858 - protein, 7 aa, Cryptosporidium parvum
ENGQEMI

SEQ ID NO: 2213859 - protein, 10 aa, Cryptosporidium parvum
ENGQKDNLKA

SEQ ID NO: 2213860 - protein, 6 aa, Cryptosporidium parvum
ENGSST

SEQ ID NO: 2213861 - protein, 6 aa, Cryptosporidium parvum
ENHQGC

SEQ ID NO: 2213862 - protein, 8 aa, Cryptosporidium parvum
ENHSTSNK

SEQ ID NO: 2213863 - protein, 17 aa, Cryptosporidium parvum
ENHTISSESTPSSTDIS

SEQ ID NO: 2213864 - protein, 5 aa, Cryptosporidium parvum
ENHTN

SEQ ID NO: 2213865 - protein, 10 aa, Cryptosporidium parvum
ENIEKDDSNY

SEQ ID NO: 2213866 - protein, 9 aa, Cryptosporidium parvum
ENIESEKER

SEQ ID NO: 2213867 - protein, 5 aa, Cryptosporidium parvum
ENIGG

SEQ ID NO: 2213868 - protein, 8 aa, Cryptosporidium parvum
ENIGPPRR

SEQ ID NO: 2213869 - protein, 8 aa, Cryptosporidium parvum
ENINGSGN

SEQ ID NO: 2213870 - protein, 5 aa, Cryptosporidium parvum
ENIRS

SEQ ID NO: 2213871 - protein, 4 aa, Cryptosporidium parvum
ENIS

SEQ ID NO: 2213872 - protein, 26 aa, Cryptosporidium parvum
ENITSTSSANADSISNLGSNPPTNLN

SEQ ID NO: 2213873 - protein, 8 aa, Cryptosporidium parvum
ENKANKPF

SEQ ID NO: 2213874 - protein, 6 aa, Cryptosporidium parvum
ENKDIN

SEQ ID NO: 2213875 - protein, 7 aa, Cryptosporidium parvum
ENKDNVK

SEQ ID NO: 2213876 - protein, 7 aa, Cryptosporidium parvum
ENKEAEN

SEQ ID NO: 2213877 - protein, 7 aa, Cryptosporidium parvum
ENKGRVT

SEQ ID NO: 2213878 - protein, 8 aa, Cryptosporidium parvum
ENKKYPSN

SEQ ID NO: 2213879 - protein, 15 aa, Cryptosporidium parvum
ENKNHDSKTKHDNKF

SEQ ID NO: 2213880 - protein, 7 aa, Cryptosporidium parvum
ENKNQDL

SEQ ID NO: 2213881 - protein, 9 aa, Cryptosporidium parvum
ENKNSLKRK

SEQ ID NO: 2213882 - protein, 10 aa, Cryptosporidium parvum
ENKPKEHETK

SEQ ID NO: 2213883 - protein, 15 aa, Cryptosporidium parvum
ENKPSQEDSRLDNDL

SEQ ID NO: 2213884 - protein, 6 aa, Cryptosporidium parvum
ENKRES

SEQ ID NO: 2213885 - protein, 10 aa, Cryptosporidium parvum
ENKSKPFPQL

SEQ ID NO: 2213886 - protein, 8 aa, Cryptosporidium parvum
ENKSPVST

SEQ ID NO: 2213887 - protein, 29 aa, Cryptosporidium parvum
ENKYDGNKQKEESLSPGINQPIENSQGES

SEQ ID NO: 2213888 - protein, 4 aa, Cryptosporidium parvum
ENLG

SEQ ID NO: 2213889 - protein, 6 aa, Cryptosporidium parvum
ENLGGT

SEQ ID NO: 2213890 - protein, 14 aa, Cryptosporidium parvum
ENLKKKASKKEATE

SEQ ID NO: 2213891 - protein, 8 aa, Cryptosporidium parvum
ENLPPQLR

SEQ ID NO: 2213892 - protein, 7 aa, Cryptosporidium parvum
ENLSPSK

SEQ ID NO: 2213893 - protein, 8 aa, Cryptosporidium parvum
ENLTKDEI

SEQ ID NO: 2213894 - protein, 30 aa, Cryptosporidium parvum
ENMDVGNNSKSNSSLSSGTNKFSNSSKNYC

SEQ ID NO: 2213895 - protein, 4 aa, Cryptosporidium parvum
ENMH

SEQ ID NO: 2213896 - protein, 5 aa, Cryptosporidium parvum
ENNAI

SEQ ID NO: 2213897 - protein, 10 aa, Cryptosporidium parvum
ENNDCGKKEL

SEQ ID NO: 2213898 - protein, 9 aa, Cryptosporidium parvum
ENNDDYNDQ

SEQ ID NO: 2213899 - protein, 8 aa, Cryptosporidium parvum
ENNDPRDI

SEQ ID NO: 2213900 - protein, 5 aa, Cryptosporidium parvum
ENNED

SEQ ID NO: 2213901 - protein, 9 aa, Cryptosporidium parvum
ENNEGNFTK

SEQ ID NO: 2213902 - protein, 4 aa, Cryptosporidium parvum
ENNF

SEQ ID NO: 2213903 - protein, 9 aa, Cryptosporidium parvum
ENNGRYSSR

SEQ ID NO: 2213904 - protein, 6 aa, Cryptosporidium parvum
ENNIEG

SEQ ID NO: 2213905 - protein, 7 aa, Cryptosporidium parvum
ENNKERC

SEQ ID NO: 2213906 - protein, 19 aa, Cryptosporidium parvum
ENNKEVEKQNELDEQNELE

SEQ ID NO: 2213907 - protein, 5 aa, Cryptosporidium parvum
ENNKN

SEQ ID NO: 2213908 - protein, 9 aa, Cryptosporidium parvum
ENNKQTEKL

SEQ ID NO: 2213909 - protein, 5 aa, Cryptosporidium parvum
ENNKV

SEQ ID NO: 2213910 - protein, 7 aa, Cryptosporidium parvum
ENNLDDN

SEQ ID NO: 2213911 - protein, 8 aa, Cryptosporidium parvum
ENNNEQHK

SEQ ID NO: 2213912 - protein, 18 aa, Cryptosporidium parvum
ENNNLDNNDINSNSVNEE

SEQ ID NO: 2213913 - protein, 7 aa, Cryptosporidium parvum
ENNNNSI

SEQ ID NO: 2213914 - protein, 15 aa, Cryptosporidium parvum
ENNNSNKNKEASYGH

SEQ ID NO: 2213915 - protein, 5 aa, Cryptosporidium parvum
ENNQI

SEQ ID NO: 2213916 - protein, 6 aa, Cryptosporidium parvum
ENNQLS

SEQ ID NO: 2213917 - protein, 11 aa, Cryptosporidium parvum
ENNSESVLPGI

SEQ ID NO: 2213918 - protein, 5 aa, Cryptosporidium parvum
ENNTN

SEQ ID NO: 2213919 - protein, 8 aa, Cryptosporidium parvum
ENNTTEAD

SEQ ID NO: 2213920 - protein, 9 aa, Cryptosporidium parvum
ENPCNQTTS

SEQ ID NO: 2213921 - protein, 7 aa, Cryptosporidium parvum
ENPESKP

SEQ ID NO: 2213922 - protein, 4 aa, Cryptosporidium parvum
ENPI

SEQ ID NO: 2213923 - protein, 6 aa, Cryptosporidium parvum
ENPKEP

SEQ ID NO: 2213924 - protein, 9 aa, Cryptosporidium parvum
ENPNSNEYR

SEQ ID NO: 2213925 - protein, 4 aa, Cryptosporidium parvum
ENPQ

SEQ ID NO: 2213926 - protein, 7 aa, Cryptosporidium parvum
ENPQSIE

SEQ ID NO: 2213927 - protein, 6 aa, Cryptosporidium parvum
ENPSNK

SEQ ID NO: 2213928 - protein, 5 aa, Cryptosporidium parvum
ENPTV

SEQ ID NO: 2213929 - protein, 146 aa, Cryptosporidium parvum
ENPYADDRNQNNENQNNDENQDNDENQNNDGNQDNDENQNNDGNQNNDGNQDNEQSNGSEAPTPMPPTSGSGGEKPVPKPRTRALGGGRPVPKPRTRALGGGRPVPKPRTKSSGSGNNGGSTPISEQEQVGSDGGEGGPDDDEAVF

SEQ ID NO: 2213930 - protein, 16 aa, Cryptosporidium parvum
ENPYSYPYSSSPGGGY

SEQ ID NO: 2213931 - protein, 20 aa, Cryptosporidium parvum
ENQDKEDEINQGTGNNNTNN

SEQ ID NO: 2213932 - protein, 25 aa, Cryptosporidium parvum
ENQINEKKKSKDDEIVDTRKRRQHN

SEQ ID NO: 2213933 - protein, 8 aa, Cryptosporidium parvum
ENQKSRQQ

SEQ ID NO: 2213934 - protein, 20 aa, Cryptosporidium parvum
ENQNNDLRTISKSNSTESNV

SEQ ID NO: 2213935 - protein, 14 aa, Cryptosporidium parvum
ENQSEENNIKTNKK

SEQ ID NO: 2213936 - protein, 6 aa, Cryptosporidium parvum
ENQSLT

SEQ ID NO: 2213937 - protein, 15 aa, Cryptosporidium parvum
ENQSNLNNACKPTNS

SEQ ID NO: 2213938 - protein, 10 aa, Cryptosporidium parvum
ENQSSNQAIN

SEQ ID NO: 2213939 - protein, 35 aa, Cryptosporidium parvum
ENQTHEYQSKEAEKLLRSDSKDEENEKQGHIQPNN

SEQ ID NO: 2213940 - protein, 5 aa, Cryptosporidium parvum
ENREY

SEQ ID NO: 2213941 - protein, 12 aa, Cryptosporidium parvum
ENRNQNTKLENK

SEQ ID NO: 2213942 - protein, 7 aa, Cryptosporidium parvum
ENRPISS

SEQ ID NO: 2213943 - protein, 4 aa, Cryptosporidium parvum
ENRS

SEQ ID NO: 2213944 - protein, 7 aa, Cryptosporidium parvum
ENRTTGC

SEQ ID NO: 2213945 - protein, 7 aa, Cryptosporidium parvum
ENSEEID

SEQ ID NO: 2213946 - protein, 9 aa, Cryptosporidium parvum
ENSEHTSPL

SEQ ID NO: 2213947 - protein, 8 aa, Cryptosporidium parvum
ENSESNEN

SEQ ID NO: 2213948 - protein, 11 aa, Cryptosporidium parvum
ENSETENIQGL

SEQ ID NO: 2213949 - protein, 4 aa, Cryptosporidium parvum
ENSG

SEQ ID NO: 2213950 - protein, 5 aa, Cryptosporidium parvum
ENSGI

SEQ ID NO: 2213951 - protein, 10 aa, Cryptosporidium parvum
ENSGKNSQKN

SEQ ID NO: 2213952 - protein, 5 aa, Cryptosporidium parvum
ENSIY

SEQ ID NO: 2213953 - protein, 8 aa, Cryptosporidium parvum
ENSKTNYE

SEQ ID NO: 2213954 - protein, 14 aa, Cryptosporidium parvum
ENSLEDNKAKIDDS

SEQ ID NO: 2213955 - protein, 6 aa, Cryptosporidium parvum
ENSNDW

SEQ ID NO: 2213956 - protein, 18 aa, Cryptosporidium parvum
ENSNLQDKQDNGRNISQE

SEQ ID NO: 2213957 - protein, 7 aa, Cryptosporidium parvum
ENSNNIS

SEQ ID NO: 2213958 - protein, 6 aa, Cryptosporidium parvum
ENSNRG

SEQ ID NO: 2213959 - protein, 8 aa, Cryptosporidium parvum
ENSQKHNI

SEQ ID NO: 2213960 - protein, 10 aa, Cryptosporidium parvum
ENSQTSDPIN

SEQ ID NO: 2213961 - protein, 6 aa, Cryptosporidium parvum
ENSSRS

SEQ ID NO: 2213962 - protein, 9 aa, Cryptosporidium parvum
ENSSTDGYM

SEQ ID NO: 2213963 - protein, 5 aa, Cryptosporidium parvum
ENSTN

SEQ ID NO: 2213964 - protein, 6 aa, Cryptosporidium parvum
ENSTRQ

SEQ ID NO: 2213965 - protein, 8 aa, Cryptosporidium parvum
ENTIHGGG

SEQ ID NO: 2213966 - protein, 15 aa, Cryptosporidium parvum
ENTLKNEDTPILRLL

SEQ ID NO: 2213967 - protein, 11 aa, Cryptosporidium parvum
ENTNFDSSKAE

SEQ ID NO: 2213968 - protein, 28 aa, Cryptosporidium parvum
ENTSNYREYPSTESKLDSGSKPVESGTE

SEQ ID NO: 2213969 - protein, 10 aa, Cryptosporidium parvum
ENTSTSSSIN

SEQ ID NO: 2213970 - protein, 16 aa, Cryptosporidium parvum
ENTTIATTLTGNQKTR

SEQ ID NO: 2213971 - protein, 14 aa, Cryptosporidium parvum
ENTVNEKAKQKRTN

SEQ ID NO: 2213972 - protein, 6 aa, Cryptosporidium parvum
ENTYDS

SEQ ID NO: 2213973 - protein, 4 aa, Cryptosporidium parvum
ENVD

SEQ ID NO: 2213974 - protein, 8 aa, Cryptosporidium parvum
ENVEEDKW

SEQ ID NO: 2213975 - protein, 6 aa, Cryptosporidium parvum
ENVENK

SEQ ID NO: 2213976 - protein, 9 aa, Cryptosporidium parvum
ENVKDGSSW

SEQ ID NO: 2213977 - protein, 5 aa, Cryptosporidium parvum
ENVKK

SEQ ID NO: 2213978 - protein, 15 aa, Cryptosporidium parvum
ENVNTVNGRELGGGN

SEQ ID NO: 2213979 - protein, 7 aa, Cryptosporidium parvum
ENYEKKA

SEQ ID NO: 2213980 - protein, 15 aa, Cryptosporidium parvum
ENYNNTSDDVIGNNR

SEQ ID NO: 2213981 - protein, 4 aa, Cryptosporidium parvum
ENYQ

SEQ ID NO: 2213982 - protein, 5 aa, Cryptosporidium parvum
ENYQK

SEQ ID NO: 2213983 - protein, 7 aa, Cryptosporidium parvum
ENYSKTP

SEQ ID NO: 2213984 - protein, 6 aa, Cryptosporidium parvum
EPADFG

SEQ ID NO: 2213985 - protein, 9 aa, Cryptosporidium parvum
EPAPPKSIS

SEQ ID NO: 2213986 - protein, 4 aa, Cryptosporidium parvum
EPDN

SEQ ID NO: 2213987 - protein, 8 aa, Cryptosporidium parvum
EPDPNKRI

SEQ ID NO: 2213988 - protein, 5 aa, Cryptosporidium parvum
EPDSF

SEQ ID NO: 2213989 - protein, 4 aa, Cryptosporidium parvum
EPDY

SEQ ID NO: 2213990 - protein, 19 aa, Cryptosporidium parvum
EPEAGQNFKYNNNSKNYSL

SEQ ID NO: 2213991 - protein, 16 aa, Cryptosporidium parvum
EPEENDENNGNQGAIS

SEQ ID NO: 2213992 - protein, 14 aa, Cryptosporidium parvum
EPEGLEEVDNGDYT

SEQ ID NO: 2213993 - protein, 10 aa, Cryptosporidium parvum
EPEMPTSEFQ

SEQ ID NO: 2213994 - protein, 8 aa, Cryptosporidium parvum
EPENEEAL

SEQ ID NO: 2213995 - protein, 6 aa, Cryptosporidium parvum
EPENTL

SEQ ID NO: 2213996 - protein, 7 aa, Cryptosporidium parvum
EPFTPEK

SEQ ID NO: 2213997 - protein, 4 aa, Cryptosporidium parvum
EPGD

SEQ ID NO: 2213998 - protein, 14 aa, Cryptosporidium parvum
EPGEGPESPNQKVA

SEQ ID NO: 2213999 - protein, 9 aa, Cryptosporidium parvum
EPGIEADNG

SEQ ID NO: 2214000 - protein, 12 aa, Cryptosporidium parvum
EPIDSSENSAPL

SEQ ID NO: 2214001 - protein, 12 aa, Cryptosporidium parvum
EPIGSVTEESLR

SEQ ID NO: 2214002 - protein, 4 aa, Cryptosporidium parvum
EPIN

SEQ ID NO: 2214003 - protein, 4 aa, Cryptosporidium parvum
EPIT

SEQ ID NO: 2214004 - protein, 8 aa, Cryptosporidium parvum
EPKEETDT

SEQ ID NO: 2214005 - protein, 20 aa, Cryptosporidium parvum
EPKNLTSPSSLSSYLSPSAV

SEQ ID NO: 2214006 - protein, 4 aa, Cryptosporidium parvum
EPKT

SEQ ID NO: 2214007 - protein, 12 aa, Cryptosporidium parvum
EPKTPDEGGISY

SEQ ID NO: 2214008 - protein, 8 aa, Cryptosporidium parvum
EPKTPEEI

SEQ ID NO: 2214009 - protein, 15 aa, Cryptosporidium parvum
EPLETTSIEERNPDQ

SEQ ID NO: 2214010 - protein, 6 aa, Cryptosporidium parvum
EPLSHS

SEQ ID NO: 2214011 - protein, 8 aa, Cryptosporidium parvum
EPNDHPKK

SEQ ID NO: 2214012 - protein, 5 aa, Cryptosporidium parvum
EPNES

SEQ ID NO: 2214013 - protein, 29 aa, Cryptosporidium parvum
EPNPAAKYASRPSNESPLSSDENSYPLPP

SEQ ID NO: 2214014 - protein, 11 aa, Cryptosporidium parvum
EPNSNSNQANC

SEQ ID NO: 2214015 - protein, 5 aa, Cryptosporidium parvum
EPNTI

SEQ ID NO: 2214016 - protein, 27 aa, Cryptosporidium parvum
EPNYGTNSGKYDEAESKSPGVTPEENA

SEQ ID NO: 2214017 - protein, 19 aa, Cryptosporidium parvum
EPPEELSSDLQKQNGSDNY

SEQ ID NO: 2214018 - protein, 5 aa, Cryptosporidium parvum
EPPEF

SEQ ID NO: 2214019 - protein, 16 aa, Cryptosporidium parvum
EPPPDTFEDQTSARSY

SEQ ID NO: 2214020 - protein, 7 aa, Cryptosporidium parvum
EPPPDVF

SEQ ID NO: 2214021 - protein, 14 aa, Cryptosporidium parvum
EPPPNTNGDQGLQQ

SEQ ID NO: 2214022 - protein, 8 aa, Cryptosporidium parvum
EPPPSNRA

SEQ ID NO: 2214023 - protein, 5 aa, Cryptosporidium parvum
EPRAS

SEQ ID NO: 2214024 - protein, 8 aa, Cryptosporidium parvum
EPRKLPGP

SEQ ID NO: 2214025 - protein, 4 aa, Cryptosporidium parvum
EPRV

SEQ ID NO: 2214026 - protein, 11 aa, Cryptosporidium parvum
EPSKATVSRST

SEQ ID NO: 2214027 - protein, 6 aa, Cryptosporidium parvum
EPSKEY

SEQ ID NO: 2214028 - protein, 12 aa, Cryptosporidium parvum
EPSKRNNKEKEI

SEQ ID NO: 2214029 - protein, 16 aa, Cryptosporidium parvum
EPSLTDTYESVRPNEQ

SEQ ID NO: 2214030 - protein, 16 aa, Cryptosporidium parvum
EPSPTNSKSTSSVSSG

SEQ ID NO: 2214031 - protein, 7 aa, Cryptosporidium parvum
EPSSEGI

SEQ ID NO: 2214032 - protein, 4 aa, Cryptosporidium parvum
EPST

SEQ ID NO: 2214033 - protein, 6 aa, Cryptosporidium parvum
EPSTLN

SEQ ID NO: 2214034 - protein, 6 aa, Cryptosporidium parvum
EPTVGK

SEQ ID NO: 2214035 - protein, 15 aa, Cryptosporidium parvum
EPYSESINEQNDQDW

SEQ ID NO: 2214036 - protein, 9 aa, Cryptosporidium parvum
EPYSPKYPI

SEQ ID NO: 2214037 - protein, 4 aa, Cryptosporidium parvum
EQAN

SEQ ID NO: 2214038 - protein, 6 aa, Cryptosporidium parvum
EQDENQ

SEQ ID NO: 2214039 - protein, 8 aa, Cryptosporidium parvum
EQDETSIG

SEQ ID NO: 2214040 - protein, 21 aa, Cryptosporidium parvum
EQDSCQNHSNFSSKSFSTLEP

SEQ ID NO: 2214041 - protein, 8 aa, Cryptosporidium parvum
EQDTHESH

SEQ ID NO: 2214042 - protein, 8 aa, Cryptosporidium parvum
EQEIKEPA

SEQ ID NO: 2214043 - protein, 5 aa, Cryptosporidium parvum
EQENY

SEQ ID NO: 2214044 - protein, 4 aa, Cryptosporidium parvum
EQES

SEQ ID NO: 2214045 - protein, 5 aa, Cryptosporidium parvum
EQESQ

SEQ ID NO: 2214046 - protein, 4 aa, Cryptosporidium parvum
EQGK

SEQ ID NO: 2214047 - protein, 10 aa, Cryptosporidium parvum
EQGSRSELAT

SEQ ID NO: 2214048 - protein, 9 aa, Cryptosporidium parvum
EQGSTKIQE

SEQ ID NO: 2214049 - protein, 14 aa, Cryptosporidium parvum
EQGVGGSRRTEDSI

SEQ ID NO: 2214050 - protein, 6 aa, Cryptosporidium parvum
EQKDIS

SEQ ID NO: 2214051 - protein, 6 aa, Cryptosporidium parvum
EQKDVT

SEQ ID NO: 2214052 - protein, 14 aa, Cryptosporidium parvum
EQKEKNNEQADSSM

SEQ ID NO: 2214053 - protein, 31 aa, Cryptosporidium parvum
EQKRKSITSALSQKGNANIKQKSNISQNNKT

SEQ ID NO: 2214054 - protein, 11 aa, Cryptosporidium parvum
EQKRNKNDEDY

SEQ ID NO: 2214055 - protein, 8 aa, Cryptosporidium parvum
EQKSKITL

SEQ ID NO: 2214056 - protein, 8 aa, Cryptosporidium parvum
EQNDPSYS

SEQ ID NO: 2214057 - protein, 7 aa, Cryptosporidium parvum
EQNQEGS

SEQ ID NO: 2214058 - protein, 12 aa, Cryptosporidium parvum
EQNQEKHENQEM

SEQ ID NO: 2214059 - protein, 12 aa, Cryptosporidium parvum
EQNSTNIRKNRN

SEQ ID NO: 2214060 - protein, 10 aa, Cryptosporidium parvum
EQNSTVENNG

SEQ ID NO: 2214061 - protein, 5 aa, Cryptosporidium parvum
EQNTF

SEQ ID NO: 2214062 - protein, 7 aa, Cryptosporidium parvum
EQPNQSA

SEQ ID NO: 2214063 - protein, 23 aa, Cryptosporidium parvum
EQQQSGQTQFDNDNESSTKLDGG

SEQ ID NO: 2214064 - protein, 12 aa, Cryptosporidium parvum
EQRGLQRTSESP

SEQ ID NO: 2214065 - protein, 6 aa, Cryptosporidium parvum
EQRTED

SEQ ID NO: 2214066 - protein, 6 aa, Cryptosporidium parvum
EQSDSI

SEQ ID NO: 2214067 - protein, 5 aa, Cryptosporidium parvum
EQSHP

SEQ ID NO: 2214068 - protein, 10 aa, Cryptosporidium parvum
EQSNQAAEKI

SEQ ID NO: 2214069 - protein, 5 aa, Cryptosporidium parvum
EQSPS

SEQ ID NO: 2214070 - protein, 11 aa, Cryptosporidium parvum
EQSTSNITSGD

SEQ ID NO: 2214071 - protein, 5 aa, Cryptosporidium parvum
EQTDF

SEQ ID NO: 2214072 - protein, 8 aa, Cryptosporidium parvum
EQTENCSP

SEQ ID NO: 2214073 - protein, 19 aa, Cryptosporidium parvum
EQTIESRPTITDDKSPIPY

SEQ ID NO: 2214074 - protein, 4 aa, Cryptosporidium parvum
EQTN

SEQ ID NO: 2214075 - protein, 11 aa, Cryptosporidium parvum
EQTNNGASKAT

SEQ ID NO: 2214076 - protein, 4 aa, Cryptosporidium parvum
EQVE

SEQ ID NO: 2214077 - protein, 6 aa, Cryptosporidium parvum
EQVEDS

SEQ ID NO: 2214078 - protein, 5 aa, Cryptosporidium parvum
EQVSN

SEQ ID NO: 2214079 - protein, 10 aa, Cryptosporidium parvum
EQYKEERNSQ

SEQ ID NO: 2214080 - protein, 7 aa, Cryptosporidium parvum
ERASGAL

SEQ ID NO: 2214081 - protein, 48 aa, Cryptosporidium parvum
ERDESSTAQNTETASDSTNSRIAKNDENGNKDLEVAKDDETNNNSAIQ

SEQ ID NO: 2214082 - protein, 9 aa, Cryptosporidium parvum
ERDNPSEIV

SEQ ID NO: 2214083 - protein, 7 aa, Cryptosporidium parvum
ERDRSNT

SEQ ID NO: 2214084 - protein, 15 aa, Cryptosporidium parvum
EREAAGNDIQGLSGP

SEQ ID NO: 2214085 - protein, 4 aa, Cryptosporidium parvum
EREF

SEQ ID NO: 2214086 - protein, 19 aa, Cryptosporidium parvum
EREIEGEVDSTSSSQITQI

SEQ ID NO: 2214087 - protein, 8 aa, Cryptosporidium parvum
EREMSENS

SEQ ID NO: 2214088 - protein, 14 aa, Cryptosporidium parvum
EREWESSKSTRNVS

SEQ ID NO: 2214089 - protein, 8 aa, Cryptosporidium parvum
ERFPSSSK

SEQ ID NO: 2214090 - protein, 18 aa, Cryptosporidium parvum
ERGEGGMHGGNPTPSSPL

SEQ ID NO: 2214091 - protein, 7 aa, Cryptosporidium parvum
ERGGDNS

SEQ ID NO: 2214092 - protein, 20 aa, Cryptosporidium parvum
ERGIRRRQEATSGYQSHGNR

SEQ ID NO: 2214093 - protein, 6 aa, Cryptosporidium parvum
ERGNVY

SEQ ID NO: 2214094 - protein, 4 aa, Cryptosporidium parvum
ERGT

SEQ ID NO: 2214095 - protein, 6 aa, Cryptosporidium parvum
ERISKA

SEQ ID NO: 2214096 - protein, 5 aa, Cryptosporidium parvum
ERKDE

SEQ ID NO: 2214097 - protein, 60 aa, Cryptosporidium parvum
ERKEDDKDKDHSVSEDNDLNPRRKCQKTSQLSTKQSGNLNNNNIGKSGDNLGDNKLTSGK

SEQ ID NO: 2214098 - protein, 5 aa, Cryptosporidium parvum
ERKNI

SEQ ID NO: 2214099 - protein, 5 aa, Cryptosporidium parvum
ERKSG

SEQ ID NO: 2214100 - protein, 5 aa, Cryptosporidium parvum
ERKST

SEQ ID NO: 2214101 - protein, 8 aa, Cryptosporidium parvum
ERKSTSLT

SEQ ID NO: 2214102 - protein, 8 aa, Cryptosporidium parvum
ERKTKRKK

SEQ ID NO: 2214103 - protein, 5 aa, Cryptosporidium parvum
ERKYP

SEQ ID NO: 2214104 - protein, 14 aa, Cryptosporidium parvum
ERKYQSSKSLDNIG

SEQ ID NO: 2214105 - protein, 7 aa, Cryptosporidium parvum
ERLPESL

SEQ ID NO: 2214106 - protein, 8 aa, Cryptosporidium parvum
ERLSDEEI

SEQ ID NO: 2214107 - protein, 8 aa, Cryptosporidium parvum
ERNDTSAL

SEQ ID NO: 2214108 - protein, 9 aa, Cryptosporidium parvum
ERNENEKHI

SEQ ID NO: 2214109 - protein, 6 aa, Cryptosporidium parvum
ERNKSN

SEQ ID NO: 2214110 - protein, 4 aa, Cryptosporidium parvum
ERNQ

SEQ ID NO: 2214111 - protein, 5 aa, Cryptosporidium parvum
ERNQA

SEQ ID NO: 2214112 - protein, 4 aa, Cryptosporidium parvum
ERNS

SEQ ID NO: 2214113 - protein, 4 aa, Cryptosporidium parvum
ERPE

SEQ ID NO: 2214114 - protein, 11 aa, Cryptosporidium parvum
ERPEIQSYSSK

SEQ ID NO: 2214115 - protein, 4 aa, Cryptosporidium parvum
ERPF

SEQ ID NO: 2214116 - protein, 6 aa, Cryptosporidium parvum
ERPMEE

SEQ ID NO: 2214117 - protein, 10 aa, Cryptosporidium parvum
ERPNHSSFTS

SEQ ID NO: 2214118 - protein, 5 aa, Cryptosporidium parvum
ERPSI

SEQ ID NO: 2214119 - protein, 5 aa, Cryptosporidium parvum
ERQDA

SEQ ID NO: 2214120 - protein, 5 aa, Cryptosporidium parvum
ERQNI

SEQ ID NO: 2214121 - protein, 8 aa, Cryptosporidium parvum
ERQSNNSK

SEQ ID NO: 2214122 - protein, 10 aa, Cryptosporidium parvum
ERRGKARKYK

SEQ ID NO: 2214123 - protein, 4 aa, Cryptosporidium parvum
ERRK

SEQ ID NO: 2214124 - protein, 8 aa, Cryptosporidium parvum
ERRKSNKS

SEQ ID NO: 2214125 - protein, 25 aa, Cryptosporidium parvum
ERRKYSSDNNRSKFNKNNNINNNSS

SEQ ID NO: 2214126 - protein, 5 aa, Cryptosporidium parvum
ERRPS

SEQ ID NO: 2214127 - protein, 7 aa, Cryptosporidium parvum
ERRQSNI

SEQ ID NO: 2214128 - protein, 8 aa, Cryptosporidium parvum
ERSDSKEL

SEQ ID NO: 2214129 - protein, 26 aa, Cryptosporidium parvum
ERSKVNDKGIDGKDVKGQNTDYDENL

SEQ ID NO: 2214130 - protein, 4 aa, Cryptosporidium parvum
ERSN

SEQ ID NO: 2214131 - protein, 13 aa, Cryptosporidium parvum
ERSNHTVGHTKNY

SEQ ID NO: 2214132 - protein, 9 aa, Cryptosporidium parvum
ERSNYKENG

SEQ ID NO: 2214133 - protein, 5 aa, Cryptosporidium parvum
ERSQA

SEQ ID NO: 2214134 - protein, 26 aa, Cryptosporidium parvum
ERSQLSDFQNEDINTRLSERKEIREA

SEQ ID NO: 2214135 - protein, 6 aa, Cryptosporidium parvum
ERSQSV

SEQ ID NO: 2214136 - protein, 5 aa, Cryptosporidium parvum
ERSSD

SEQ ID NO: 2214137 - protein, 8 aa, Cryptosporidium parvum
ERSSVSEI

SEQ ID NO: 2214138 - protein, 7 aa, Cryptosporidium parvum
ERSTDTY

SEQ ID NO: 2214139 - protein, 12 aa, Cryptosporidium parvum
ERVPTGTEEGDS

SEQ ID NO: 2214140 - protein, 5 aa, Cryptosporidium parvum
ERVTK

SEQ ID NO: 2214141 - protein, 6 aa, Cryptosporidium parvum
ERYEQK

SEQ ID NO: 2214142 - protein, 10 aa, Cryptosporidium parvum
ERYSNENIRG

SEQ ID NO: 2214143 - protein, 6 aa, Cryptosporidium parvum
ERYSPF

SEQ ID NO: 2214144 - protein, 23 aa, Cryptosporidium parvum
ESAFNGDSHINGNRYADGSEGFG

SEQ ID NO: 2214145 - protein, 4 aa, Cryptosporidium parvum
ESAI

SEQ ID NO: 2214146 - protein, 4 aa, Cryptosporidium parvum
ESAK

SEQ ID NO: 2214147 - protein, 10 aa, Cryptosporidium parvum
ESANNSNDNK

SEQ ID NO: 2214148 - protein, 11 aa, Cryptosporidium parvum
ESARRGDPQGA

SEQ ID NO: 2214149 - protein, 11 aa, Cryptosporidium parvum
ESASKSKINTD

SEQ ID NO: 2214150 - protein, 4 aa, Cryptosporidium parvum
ESCK

SEQ ID NO: 2214151 - protein, 7 aa, Cryptosporidium parvum
ESCNKDV

SEQ ID NO: 2214152 - protein, 4 aa, Cryptosporidium parvum
ESCR

SEQ ID NO: 2214153 - protein, 8 aa, Cryptosporidium parvum
ESDDEFGN

SEQ ID NO: 2214154 - protein, 23 aa, Cryptosporidium parvum
ESDDFQKDQLDEEGKEEERREFS

SEQ ID NO: 2214155 - protein, 9 aa, Cryptosporidium parvum
ESDDKWKKN

SEQ ID NO: 2214156 - protein, 4 aa, Cryptosporidium parvum
ESDE

SEQ ID NO: 2214157 - protein, 12 aa, Cryptosporidium parvum
ESDENKGRSPTF

SEQ ID NO: 2214158 - protein, 12 aa, Cryptosporidium parvum
ESDHDETSYNGP

SEQ ID NO: 2214159 - protein, 7 aa, Cryptosporidium parvum
ESDNQNI

SEQ ID NO: 2214160 - protein, 9 aa, Cryptosporidium parvum
ESDQEVDDE

SEQ ID NO: 2214161 - protein, 10 aa, Cryptosporidium parvum
ESDSENAENM

SEQ ID NO: 2214162 - protein, 7 aa, Cryptosporidium parvum
ESDSRHQ

SEQ ID NO: 2214163 - protein, 11 aa, Cryptosporidium parvum
ESDSSPEDIKK

SEQ ID NO: 2214164 - protein, 8 aa, Cryptosporidium parvum
ESDSTPIE

SEQ ID NO: 2214165 - protein, 6 aa, Cryptosporidium parvum
ESDSYS

SEQ ID NO: 2214166 - protein, 4 aa, Cryptosporidium parvum
ESED

SEQ ID NO: 2214167 - protein, 10 aa, Cryptosporidium parvum
ESEEFDSTTY

SEQ ID NO: 2214168 - protein, 5 aa, Cryptosporidium parvum
ESEEI

SEQ ID NO: 2214169 - protein, 6 aa, Cryptosporidium parvum
ESEEKN

SEQ ID NO: 2214170 - protein, 15 aa, Cryptosporidium parvum
ESEKISPEDGPYSGK

SEQ ID NO: 2214171 - protein, 8 aa, Cryptosporidium parvum
ESELTSRI

SEQ ID NO: 2214172 - protein, 6 aa, Cryptosporidium parvum
ESEPIP

SEQ ID NO: 2214173 - protein, 8 aa, Cryptosporidium parvum
ESESENVS

SEQ ID NO: 2214174 - protein, 9 aa, Cryptosporidium parvum
ESESKLGSI

SEQ ID NO: 2214175 - protein, 10 aa, Cryptosporidium parvum
ESESNLKSSI

SEQ ID NO: 2214176 - protein, 6 aa, Cryptosporidium parvum
ESETPR

SEQ ID NO: 2214177 - protein, 4 aa, Cryptosporidium parvum
ESFE

SEQ ID NO: 2214178 - protein, 4 aa, Cryptosporidium parvum
ESFN

SEQ ID NO: 2214179 - protein, 4 aa, Cryptosporidium parvum
ESFS

SEQ ID NO: 2214180 - protein, 30 aa, Cryptosporidium parvum
ESFSASGSNKNNVAKQTRIKENKRYSRVES

SEQ ID NO: 2214181 - protein, 20 aa, Cryptosporidium parvum
ESFSPSNQNTSRISNEKEQI

SEQ ID NO: 2214182 - protein, 14 aa, Cryptosporidium parvum
ESFTSENNNKRNKD

SEQ ID NO: 2214183 - protein, 6 aa, Cryptosporidium parvum
ESGGKY

SEQ ID NO: 2214184 - protein, 5 aa, Cryptosporidium parvum
ESGIE

SEQ ID NO: 2214185 - protein, 13 aa, Cryptosporidium parvum
ESGKSGIQTVGAA

SEQ ID NO: 2214186 - protein, 6 aa, Cryptosporidium parvum
ESGKYA

SEQ ID NO: 2214187 - protein, 7 aa, Cryptosporidium parvum
ESGKYDP

SEQ ID NO: 2214188 - protein, 6 aa, Cryptosporidium parvum
ESGLSY

SEQ ID NO: 2214189 - protein, 6 aa, Cryptosporidium parvum
ESGLTN

SEQ ID NO: 2214190 - protein, 7 aa, Cryptosporidium parvum
ESGNSQF

SEQ ID NO: 2214191 - protein, 10 aa, Cryptosporidium parvum
ESGPETPEEC

SEQ ID NO: 2214192 - protein, 5 aa, Cryptosporidium parvum
ESGQI

SEQ ID NO: 2214193 - protein, 8 aa, Cryptosporidium parvum
ESGSGKTT

SEQ ID NO: 2214194 - protein, 5 aa, Cryptosporidium parvum
ESGSI

SEQ ID NO: 2214195 - protein, 7 aa, Cryptosporidium parvum
ESGSTSI

SEQ ID NO: 2214196 - protein, 12 aa, Cryptosporidium parvum
ESGYKENNQMGS

SEQ ID NO: 2214197 - protein, 4 aa, Cryptosporidium parvum
ESHH

SEQ ID NO: 2214198 - protein, 7 aa, Cryptosporidium parvum
ESHSGEG

SEQ ID NO: 2214199 - protein, 4 aa, Cryptosporidium parvum
ESIK

SEQ ID NO: 2214200 - protein, 7 aa, Cryptosporidium parvum
ESIKRSP

SEQ ID NO: 2214201 - protein, 4 aa, Cryptosporidium parvum
ESIN

SEQ ID NO: 2214202 - protein, 6 aa, Cryptosporidium parvum
ESINNS

SEQ ID NO: 2214203 - protein, 10 aa, Cryptosporidium parvum
ESINRSKEHK

SEQ ID NO: 2214204 - protein, 7 aa, Cryptosporidium parvum
ESIPENK

SEQ ID NO: 2214205 - protein, 12 aa, Cryptosporidium parvum
ESIQQSKTSTKL

SEQ ID NO: 2214206 - protein, 8 aa, Cryptosporidium parvum
ESITEYPE

SEQ ID NO: 2214207 - protein, 10 aa, Cryptosporidium parvum
ESITNKITTD

SEQ ID NO: 2214208 - protein, 40 aa, Cryptosporidium parvum
ESKAVEKDKKKNKETEKISDKDDEYDNTENSQKSDIYESS

SEQ ID NO: 2214209 - protein, 8 aa, Cryptosporidium parvum
ESKDAYLS

SEQ ID NO: 2214210 - protein, 10 aa, Cryptosporidium parvum
ESKDLNYSNN

SEQ ID NO: 2214211 - protein, 16 aa, Cryptosporidium parvum
ESKEEIKKPKSFNKPN

SEQ ID NO: 2214212 - protein, 8 aa, Cryptosporidium parvum
ESKELTNR

SEQ ID NO: 2214213 - protein, 7 aa, Cryptosporidium parvum
ESKESVR

SEQ ID NO: 2214214 - protein, 9 aa, Cryptosporidium parvum
ESKFSDQEK

SEQ ID NO: 2214215 - protein, 9 aa, Cryptosporidium parvum
ESKGLSGPA

SEQ ID NO: 2214216 - protein, 4 aa, Cryptosporidium parvum
ESKN

SEQ ID NO: 2214217 - protein, 13 aa, Cryptosporidium parvum
ESKNDESNNNLQD

SEQ ID NO: 2214218 - protein, 7 aa, Cryptosporidium parvum
ESKNEIS

SEQ ID NO: 2214219 - protein, 5 aa, Cryptosporidium parvum
ESKNG

SEQ ID NO: 2214220 - protein, 9 aa, Cryptosporidium parvum
ESKNKDKFS

SEQ ID NO: 2214221 - protein, 9 aa, Cryptosporidium parvum
ESKNKQFNT

SEQ ID NO: 2214222 - protein, 19 aa, Cryptosporidium parvum
ESKNKTKNKKQKPITKKLK

SEQ ID NO: 2214223 - protein, 14 aa, Cryptosporidium parvum
ESKNKTRLNGNQNL

SEQ ID NO: 2214224 - protein, 7 aa, Cryptosporidium parvum
ESKPCNG

SEQ ID NO: 2214225 - protein, 6 aa, Cryptosporidium parvum
ESKPTL

SEQ ID NO: 2214226 - protein, 5 aa, Cryptosporidium parvum
ESKSD

SEQ ID NO: 2214227 - protein, 11 aa, Cryptosporidium parvum
ESKSDAEYKDQ

SEQ ID NO: 2214228 - protein, 5 aa, Cryptosporidium parvum
ESKSN

SEQ ID NO: 2214229 - protein, 6 aa, Cryptosporidium parvum
ESKSYS

SEQ ID NO: 2214230 - protein, 15 aa, Cryptosporidium parvum
ESKTPQCLAGNGSSH

SEQ ID NO: 2214231 - protein, 7 aa, Cryptosporidium parvum
ESKTSKE

SEQ ID NO: 2214232 - protein, 7 aa, Cryptosporidium parvum
ESKYYRE

SEQ ID NO: 2214233 - protein, 7 aa, Cryptosporidium parvum
ESLERKP

SEQ ID NO: 2214234 - protein, 4 aa, Cryptosporidium parvum
ESLL

SEQ ID NO: 2214235 - protein, 4 aa, Cryptosporidium parvum
ESLN

SEQ ID NO: 2214236 - protein, 6 aa, Cryptosporidium parvum
ESLNSR

SEQ ID NO: 2214237 - protein, 17 aa, Cryptosporidium parvum
ESLNSTSTLQRGETFDS

SEQ ID NO: 2214238 - protein, 4 aa, Cryptosporidium parvum
ESLS

SEQ ID NO: 2214239 - protein, 5 aa, Cryptosporidium parvum
ESLSE

SEQ ID NO: 2214240 - protein, 9 aa, Cryptosporidium parvum
ESLSSESCG

SEQ ID NO: 2214241 - protein, 7 aa, Cryptosporidium parvum
ESLTPTG

SEQ ID NO: 2214242 - protein, 10 aa, Cryptosporidium parvum
ESMNGNDTDK

SEQ ID NO: 2214243 - protein, 8 aa, Cryptosporidium parvum
ESMNTSEY

SEQ ID NO: 2214244 - protein, 4 aa, Cryptosporidium parvum
ESMQ

SEQ ID NO: 2214245 - protein, 11 aa, Cryptosporidium parvum
ESMQLSQSDER

SEQ ID NO: 2214246 - protein, 9 aa, Cryptosporidium parvum
ESNAAKQHS

SEQ ID NO: 2214247 - protein, 8 aa, Cryptosporidium parvum
ESNAESAL

SEQ ID NO: 2214248 - protein, 6 aa, Cryptosporidium parvum
ESNDPE

SEQ ID NO: 2214249 - protein, 5 aa, Cryptosporidium parvum
ESNEF

SEQ ID NO: 2214250 - protein, 7 aa, Cryptosporidium parvum
ESNEPNI

SEQ ID NO: 2214251 - protein, 6 aa, Cryptosporidium parvum
ESNFAQ

SEQ ID NO: 2214252 - protein, 8 aa, Cryptosporidium parvum
ESNFNENN

SEQ ID NO: 2214253 - protein, 8 aa, Cryptosporidium parvum
ESNFTKQE

SEQ ID NO: 2214254 - protein, 23 aa, Cryptosporidium parvum
ESNGDSNEAQALGDQSDVNKTNA

SEQ ID NO: 2214255 - protein, 7 aa, Cryptosporidium parvum
ESNHHNS

SEQ ID NO: 2214256 - protein, 6 aa, Cryptosporidium parvum
ESNKQA

SEQ ID NO: 2214257 - protein, 6 aa, Cryptosporidium parvum
ESNNNN

SEQ ID NO: 2214258 - protein, 8 aa, Cryptosporidium parvum
ESNNNSEW

SEQ ID NO: 2214259 - protein, 6 aa, Cryptosporidium parvum
ESNPEL

SEQ ID NO: 2214260 - protein, 5 aa, Cryptosporidium parvum
ESNPI

SEQ ID NO: 2214261 - protein, 9 aa, Cryptosporidium parvum
ESNQASKEL

SEQ ID NO: 2214262 - protein, 5 aa, Cryptosporidium parvum
ESNQN

SEQ ID NO: 2214263 - protein, 12 aa, Cryptosporidium parvum
ESNQTNSDEEIS

SEQ ID NO: 2214264 - protein, 8 aa, Cryptosporidium parvum
ESNRRKTN

SEQ ID NO: 2214265 - protein, 4 aa, Cryptosporidium parvum
ESNS

SEQ ID NO: 2214266 - protein, 8 aa, Cryptosporidium parvum
ESNSAISG

SEQ ID NO: 2214267 - protein, 8 aa, Cryptosporidium parvum
ESNSETSY

SEQ ID NO: 2214268 - protein, 5 aa, Cryptosporidium parvum
ESNSH

SEQ ID NO: 2214269 - protein, 29 aa, Cryptosporidium parvum
ESNSKDEEYNKSISKANSKCKKLSKEVKG

SEQ ID NO: 2214270 - protein, 4 aa, Cryptosporidium parvum
ESNT

SEQ ID NO: 2214271 - protein, 17 aa, Cryptosporidium parvum
ESNTGIGGITSSNNNAE

SEQ ID NO: 2214272 - protein, 7 aa, Cryptosporidium parvum
ESNVNRN

SEQ ID NO: 2214273 - protein, 10 aa, Cryptosporidium parvum
ESNVTSTESI

SEQ ID NO: 2214274 - protein, 4 aa, Cryptosporidium parvum
ESPD

SEQ ID NO: 2214275 - protein, 7 aa, Cryptosporidium parvum
ESPEEEI

SEQ ID NO: 2214276 - protein, 6 aa, Cryptosporidium parvum
ESPEKQ

SEQ ID NO: 2214277 - protein, 15 aa, Cryptosporidium parvum
ESPKSTTSVNTSSSI

SEQ ID NO: 2214278 - protein, 7 aa, Cryptosporidium parvum
ESPKYNE

SEQ ID NO: 2214279 - protein, 7 aa, Cryptosporidium parvum
ESPNEQE

SEQ ID NO: 2214280 - protein, 6 aa, Cryptosporidium parvum
ESPSAL

SEQ ID NO: 2214281 - protein, 9 aa, Cryptosporidium parvum
ESPSEKEYN

SEQ ID NO: 2214282 - protein, 7 aa, Cryptosporidium parvum
ESPSGVP

SEQ ID NO: 2214283 - protein, 5 aa, Cryptosporidium parvum
ESPYN

SEQ ID NO: 2214284 - protein, 17 aa, Cryptosporidium parvum
ESQDLTKVKKEKSTKSG

SEQ ID NO: 2214285 - protein, 14 aa, Cryptosporidium parvum
ESQDQAPGAPVESV

SEQ ID NO: 2214286 - protein, 6 aa, Cryptosporidium parvum
ESQEGI

SEQ ID NO: 2214287 - protein, 8 aa, Cryptosporidium parvum
ESQEQFSK

SEQ ID NO: 2214288 - protein, 17 aa, Cryptosporidium parvum
ESQGRAFRPQKVSGHTL

SEQ ID NO: 2214289 - protein, 7 aa, Cryptosporidium parvum
ESQNESI

SEQ ID NO: 2214290 - protein, 5 aa, Cryptosporidium parvum
ESQNS

SEQ ID NO: 2214291 - protein, 12 aa, Cryptosporidium parvum
ESQNSLGNQIPA

SEQ ID NO: 2214292 - protein, 7 aa, Cryptosporidium parvum
ESREKAL

SEQ ID NO: 2214293 - protein, 14 aa, Cryptosporidium parvum
ESRKHTPKSQTTVK

SEQ ID NO: 2214294 - protein, 5 aa, Cryptosporidium parvum
ESRKN

SEQ ID NO: 2214295 - protein, 4 aa, Cryptosporidium parvum
ESRN

SEQ ID NO: 2214296 - protein, 7 aa, Cryptosporidium parvum
ESRNDID

SEQ ID NO: 2214297 - protein, 12 aa, Cryptosporidium parvum
ESRNKKNSEEYK

SEQ ID NO: 2214298 - protein, 21 aa, Cryptosporidium parvum
ESRQGYSQDDYNTDNLQDCEK

SEQ ID NO: 2214299 - protein, 5 aa, Cryptosporidium parvum
ESRRN

SEQ ID NO: 2214300 - protein, 8 aa, Cryptosporidium parvum
ESRRQIAS

SEQ ID NO: 2214301 - protein, 4 aa, Cryptosporidium parvum
ESRS

SEQ ID NO: 2214302 - protein, 8 aa, Cryptosporidium parvum
ESRSKCCS

SEQ ID NO: 2214303 - protein, 9 aa, Cryptosporidium parvum
ESRSSYSHR

SEQ ID NO: 2214304 - protein, 13 aa, Cryptosporidium parvum
ESRTNCSSGGVSS

SEQ ID NO: 2214305 - protein, 9 aa, Cryptosporidium parvum
ESSEAAELR

SEQ ID NO: 2214306 - protein, 13 aa, Cryptosporidium parvum
ESSEITTESESSE

SEQ ID NO: 2214307 - protein, 6 aa, Cryptosporidium parvum
ESSEQY

SEQ ID NO: 2214308 - protein, 14 aa, Cryptosporidium parvum
ESSFSSADRTQSSK

SEQ ID NO: 2214309 - protein, 20 aa, Cryptosporidium parvum
ESSFTKESDHYDGNKTGTSN

SEQ ID NO: 2214310 - protein, 4 aa, Cryptosporidium parvum
ESSI

SEQ ID NO: 2214311 - protein, 5 aa, Cryptosporidium parvum
ESSIG

SEQ ID NO: 2214312 - protein, 13 aa, Cryptosporidium parvum
ESSIGKNIDPNEI

SEQ ID NO: 2214313 - protein, 10 aa, Cryptosporidium parvum
ESSIPNKKSL

SEQ ID NO: 2214314 - protein, 5 aa, Cryptosporidium parvum
ESSIQ

SEQ ID NO: 2214315 - protein, 16 aa, Cryptosporidium parvum
ESSKNSGEFDKQYQDL

SEQ ID NO: 2214316 - protein, 6 aa, Cryptosporidium parvum
ESSKSM

SEQ ID NO: 2214317 - protein, 5 aa, Cryptosporidium parvum
ESSNA

SEQ ID NO: 2214318 - protein, 8 aa, Cryptosporidium parvum
ESSNIGVN

SEQ ID NO: 2214319 - protein, 9 aa, Cryptosporidium parvum
ESSNTAYNS

SEQ ID NO: 2214320 - protein, 8 aa, Cryptosporidium parvum
ESSPLSEP

SEQ ID NO: 2214321 - protein, 20 aa, Cryptosporidium parvum
ESSPVGIGREEPNKDPYLPD

SEQ ID NO: 2214322 - protein, 7 aa, Cryptosporidium parvum
ESSRKKA

SEQ ID NO: 2214323 - protein, 7 aa, Cryptosporidium parvum
ESSSASC

SEQ ID NO: 2214324 - protein, 21 aa, Cryptosporidium parvum
ESSSKRAFGSKLNNNKITSEY

SEQ ID NO: 2214325 - protein, 5 aa, Cryptosporidium parvum
ESSSL

SEQ ID NO: 2214326 - protein, 8 aa, Cryptosporidium parvum
ESSTMDPQ

SEQ ID NO: 2214327 - protein, 9 aa, Cryptosporidium parvum
ESSTTEGLN

SEQ ID NO: 2214328 - protein, 4 aa, Cryptosporidium parvum
ESSV

SEQ ID NO: 2214329 - protein, 25 aa, Cryptosporidium parvum
ESSVEMKRNRTNFEEVNENNSTYST

SEQ ID NO: 2214330 - protein, 15 aa, Cryptosporidium parvum
ESSVNNYEQSQVQNS

SEQ ID NO: 2214331 - protein, 9 aa, Cryptosporidium parvum
ESSVPNNDS

SEQ ID NO: 2214332 - protein, 13 aa, Cryptosporidium parvum
ESTCNSDLAPNNL

SEQ ID NO: 2214333 - protein, 11 aa, Cryptosporidium parvum
ESTCSNKSEIK

SEQ ID NO: 2214334 - protein, 4 aa, Cryptosporidium parvum
ESTD

SEQ ID NO: 2214335 - protein, 5 aa, Cryptosporidium parvum
ESTDE

SEQ ID NO: 2214336 - protein, 8 aa, Cryptosporidium parvum
ESTDQRNI

SEQ ID NO: 2214337 - protein, 10 aa, Cryptosporidium parvum
ESTFGGKNSH

SEQ ID NO: 2214338 - protein, 11 aa, Cryptosporidium parvum
ESTGKNQINSI

SEQ ID NO: 2214339 - protein, 7 aa, Cryptosporidium parvum
ESTGNSK

SEQ ID NO: 2214340 - protein, 4 aa, Cryptosporidium parvum
ESTL

SEQ ID NO: 2214341 - protein, 4 aa, Cryptosporidium parvum
ESTQ

SEQ ID NO: 2214342 - protein, 5 aa, Cryptosporidium parvum
ESTQD

SEQ ID NO: 2214343 - protein, 8 aa, Cryptosporidium parvum
ESTSGISR

SEQ ID NO: 2214344 - protein, 6 aa, Cryptosporidium parvum
ESTSPF

SEQ ID NO: 2214345 - protein, 8 aa, Cryptosporidium parvum
ESTSSGIS

SEQ ID NO: 2214346 - protein, 11 aa, Cryptosporidium parvum
ESTTPDNLSEL

SEQ ID NO: 2214347 - protein, 8 aa, Cryptosporidium parvum
ESTVSSEK

SEQ ID NO: 2214348 - protein, 4 aa, Cryptosporidium parvum
ESVD

SEQ ID NO: 2214349 - protein, 10 aa, Cryptosporidium parvum
ESVEKGISKM

SEQ ID NO: 2214350 - protein, 6 aa, Cryptosporidium parvum
ESVKDV

SEQ ID NO: 2214351 - protein, 12 aa, Cryptosporidium parvum
ESVKSDNSKGNL

SEQ ID NO: 2214352 - protein, 4 aa, Cryptosporidium parvum
ESVN

SEQ ID NO: 2214353 - protein, 11 aa, Cryptosporidium parvum
ESVNENCCEDD

SEQ ID NO: 2214354 - protein, 5 aa, Cryptosporidium parvum
ESVNY

SEQ ID NO: 2214355 - protein, 5 aa, Cryptosporidium parvum
ESVPE

SEQ ID NO: 2214356 - protein, 8 aa, Cryptosporidium parvum
ESWDSSIG

SEQ ID NO: 2214357 - protein, 6 aa, Cryptosporidium parvum
ESYKSS

SEQ ID NO: 2214358 - protein, 4 aa, Cryptosporidium parvum
ESYN

SEQ ID NO: 2214359 - protein, 5 aa, Cryptosporidium parvum
ESYNK

SEQ ID NO: 2214360 - protein, 5 aa, Cryptosporidium parvum
ESYNN

SEQ ID NO: 2214361 - protein, 6 aa, Cryptosporidium parvum
ESYNSF

SEQ ID NO: 2214362 - protein, 5 aa, Cryptosporidium parvum
ESYPE

SEQ ID NO: 2214363 - protein, 7 aa, Cryptosporidium parvum
ESYSANI

SEQ ID NO: 2214364 - protein, 17 aa, Cryptosporidium parvum
ESYSRIDDEDEEDDEEL

SEQ ID NO: 2214365 - protein, 14 aa, Cryptosporidium parvum
ESYSSCSADDHGSE

SEQ ID NO: 2214366 - protein, 4 aa, Cryptosporidium parvum
ESYT

SEQ ID NO: 2214367 - protein, 5 aa, Cryptosporidium parvum
ETAGF

SEQ ID NO: 2214368 - protein, 9 aa, Cryptosporidium parvum
ETASNMTNI

SEQ ID NO: 2214369 - protein, 5 aa, Cryptosporidium parvum
ETAYN

SEQ ID NO: 2214370 - protein, 7 aa, Cryptosporidium parvum
ETDIGNT

SEQ ID NO: 2214371 - protein, 11 aa, Cryptosporidium parvum
ETDINSDTDEE

SEQ ID NO: 2214372 - protein, 7 aa, Cryptosporidium parvum
ETDRPHF

SEQ ID NO: 2214373 - protein, 9 aa, Cryptosporidium parvum
ETDSQDSEY

SEQ ID NO: 2214374 - protein, 20 aa, Cryptosporidium parvum
ETDTSDSRMTSNDTNSVDGS

SEQ ID NO: 2214375 - protein, 6 aa, Cryptosporidium parvum
ETEAKE

SEQ ID NO: 2214376 - protein, 5 aa, Cryptosporidium parvum
ETEFP

SEQ ID NO: 2214377 - protein, 9 aa, Cryptosporidium parvum
ETEKTGNKN

SEQ ID NO: 2214378 - protein, 7 aa, Cryptosporidium parvum
ETETEPQ

SEQ ID NO: 2214379 - protein, 7 aa, Cryptosporidium parvum
ETGDDEI

SEQ ID NO: 2214380 - protein, 6 aa, Cryptosporidium parvum
ETGEER

SEQ ID NO: 2214381 - protein, 6 aa, Cryptosporidium parvum
ETGHRA

SEQ ID NO: 2214382 - protein, 14 aa, Cryptosporidium parvum
ETGINKGNTNQFED

SEQ ID NO: 2214383 - protein, 5 aa, Cryptosporidium parvum
ETGKG

SEQ ID NO: 2214384 - protein, 16 aa, Cryptosporidium parvum
ETGPKKTNSFVSSSSL

SEQ ID NO: 2214385 - protein, 15 aa, Cryptosporidium parvum
ETGRLTDDPVEGKDI

SEQ ID NO: 2214386 - protein, 9 aa, Cryptosporidium parvum
ETGRNKRRR

SEQ ID NO: 2214387 - protein, 6 aa, Cryptosporidium parvum
ETGRRQ

SEQ ID NO: 2214388 - protein, 6 aa, Cryptosporidium parvum
ETGTGS

SEQ ID NO: 2214389 - protein, 15 aa, Cryptosporidium parvum
ETGVESKNVSGKHEE

SEQ ID NO: 2214390 - protein, 6 aa, Cryptosporidium parvum
ETHEKT

SEQ ID NO: 2214391 - protein, 13 aa, Cryptosporidium parvum
ETHSSGGNHNDSN

SEQ ID NO: 2214392 - protein, 7 aa, Cryptosporidium parvum
ETIRGEN

SEQ ID NO: 2214393 - protein, 7 aa, Cryptosporidium parvum
ETITSSM

SEQ ID NO: 2214394 - protein, 23 aa, Cryptosporidium parvum
ETKEETQKNNVNDVESLKNDRDR

SEQ ID NO: 2214395 - protein, 4 aa, Cryptosporidium parvum
ETKM

SEQ ID NO: 2214396 - protein, 7 aa, Cryptosporidium parvum
ETKNKDR

SEQ ID NO: 2214397 - protein, 6 aa, Cryptosporidium parvum
ETKNST

SEQ ID NO: 2214398 - protein, 14 aa, Cryptosporidium parvum
ETLDYSQAKSNYPE

SEQ ID NO: 2214399 - protein, 10 aa, Cryptosporidium parvum
ETLGIGEDNY

SEQ ID NO: 2214400 - protein, 8 aa, Cryptosporidium parvum
ETLRKTAS

SEQ ID NO: 2214401 - protein, 7 aa, Cryptosporidium parvum
ETLRQTQ

SEQ ID NO: 2214402 - protein, 4 aa, Cryptosporidium parvum
ETMN

SEQ ID NO: 2214403 - protein, 7 aa, Cryptosporidium parvum
ETNDNIE

SEQ ID NO: 2214404 - protein, 12 aa, Cryptosporidium parvum
ETNEMTKHKANG

SEQ ID NO: 2214405 - protein, 10 aa, Cryptosporidium parvum
ETNHGNGGRG

SEQ ID NO: 2214406 - protein, 7 aa, Cryptosporidium parvum
ETNHNKS

SEQ ID NO: 2214407 - protein, 7 aa, Cryptosporidium parvum
ETNINDS

SEQ ID NO: 2214408 - protein, 4 aa, Cryptosporidium parvum
ETNK

SEQ ID NO: 2214409 - protein, 13 aa, Cryptosporidium parvum
ETNKNDKSFKETA

SEQ ID NO: 2214410 - protein, 11 aa, Cryptosporidium parvum
ETNKSNNNDMV

SEQ ID NO: 2214411 - protein, 5 aa, Cryptosporidium parvum
ETNMD

SEQ ID NO: 2214412 - protein, 14 aa, Cryptosporidium parvum
ETNNDFSASEINPE

SEQ ID NO: 2214413 - protein, 15 aa, Cryptosporidium parvum
ETNNLKQGNMKGVTR

SEQ ID NO: 2214414 - protein, 6 aa, Cryptosporidium parvum
ETNQQK

SEQ ID NO: 2214415 - protein, 4 aa, Cryptosporidium parvum
ETNS

SEQ ID NO: 2214416 - protein, 8 aa, Cryptosporidium parvum
ETNSKGDL

SEQ ID NO: 2214417 - protein, 5 aa, Cryptosporidium parvum
ETNSY

SEQ ID NO: 2214418 - protein, 6 aa, Cryptosporidium parvum
ETNTGI

SEQ ID NO: 2214419 - protein, 6 aa, Cryptosporidium parvum
ETPEIT

SEQ ID NO: 2214420 - protein, 8 aa, Cryptosporidium parvum
ETPGKLDD

SEQ ID NO: 2214421 - protein, 7 aa, Cryptosporidium parvum
ETPITTR

SEQ ID NO: 2214422 - protein, 29 aa, Cryptosporidium parvum
ETPKRTPHENLGETSSERASRREEEGTAF

SEQ ID NO: 2214423 - protein, 4 aa, Cryptosporidium parvum
ETPS

SEQ ID NO: 2214424 - protein, 5 aa, Cryptosporidium parvum
ETPTK

SEQ ID NO: 2214425 - protein, 9 aa, Cryptosporidium parvum
ETPVKGGNK

SEQ ID NO: 2214426 - protein, 6 aa, Cryptosporidium parvum
ETQFGD

SEQ ID NO: 2214427 - protein, 17 aa, Cryptosporidium parvum
ETQLKDSSVANSSQNIR

SEQ ID NO: 2214428 - protein, 14 aa, Cryptosporidium parvum
ETQNQENFEKVTDK

SEQ ID NO: 2214429 - protein, 8 aa, Cryptosporidium parvum
ETQSGDLD

SEQ ID NO: 2214430 - protein, 10 aa, Cryptosporidium parvum
ETQVSHSNTN

SEQ ID NO: 2214431 - protein, 5 aa, Cryptosporidium parvum
ETQYV

SEQ ID NO: 2214432 - protein, 14 aa, Cryptosporidium parvum
ETRGEFNLKLKINK

SEQ ID NO: 2214433 - protein, 5 aa, Cryptosporidium parvum
ETRIS

SEQ ID NO: 2214434 - protein, 4 aa, Cryptosporidium parvum
ETRK

SEQ ID NO: 2214435 - protein, 7 aa, Cryptosporidium parvum
ETRKKAD

SEQ ID NO: 2214436 - protein, 44 aa, Cryptosporidium parvum
ETRKPTKKHKNRKSDSSGLKGRKKNSKKELADNSETLDRGPNKI

SEQ ID NO: 2214437 - protein, 11 aa, Cryptosporidium parvum
ETRNRGKKQSR

SEQ ID NO: 2214438 - protein, 8 aa, Cryptosporidium parvum
ETRRNLSQ

SEQ ID NO: 2214439 - protein, 11 aa, Cryptosporidium parvum
ETRSQTNSKNY

SEQ ID NO: 2214440 - protein, 12 aa, Cryptosporidium parvum
ETRTNQKDKLPV

SEQ ID NO: 2214441 - protein, 5 aa, Cryptosporidium parvum
ETSCY

SEQ ID NO: 2214442 - protein, 12 aa, Cryptosporidium parvum
ETSDIEKEKFNR

SEQ ID NO: 2214443 - protein, 14 aa, Cryptosporidium parvum
ETSFNQTDNPNLVN

SEQ ID NO: 2214444 - protein, 12 aa, Cryptosporidium parvum
ETSFPESSKTTI

SEQ ID NO: 2214445 - protein, 6 aa, Cryptosporidium parvum
ETSIEY

SEQ ID NO: 2214446 - protein, 5 aa, Cryptosporidium parvum
ETSKV

SEQ ID NO: 2214447 - protein, 7 aa, Cryptosporidium parvum
ETSKVSP

SEQ ID NO: 2214448 - protein, 12 aa, Cryptosporidium parvum
ETSNNNSIQNTC

SEQ ID NO: 2214449 - protein, 9 aa, Cryptosporidium parvum
ETSNSSDDL

SEQ ID NO: 2214450 - protein, 6 aa, Cryptosporidium parvum
ETSQSK

SEQ ID NO: 2214451 - protein, 10 aa, Cryptosporidium parvum
ETSSCNSSPC

SEQ ID NO: 2214452 - protein, 5 aa, Cryptosporidium parvum
ETSWS

SEQ ID NO: 2214453 - protein, 7 aa, Cryptosporidium parvum
ETTGDRP

SEQ ID NO: 2214454 - protein, 6 aa, Cryptosporidium parvum
ETTGTN

SEQ ID NO: 2214455 - protein, 22 aa, Cryptosporidium parvum
ETTNAPNLDGSYHGDDEFPSVS

SEQ ID NO: 2214456 - protein, 19 aa, Cryptosporidium parvum
ETTNRGGQNDQDSKNQIRG

SEQ ID NO: 2214457 - protein, 14 aa, Cryptosporidium parvum
ETVNEDNEEEKERK

SEQ ID NO: 2214458 - protein, 5 aa, Cryptosporidium parvum
ETVNP

SEQ ID NO: 2214459 - protein, 10 aa, Cryptosporidium parvum
ETYDPNSDEF

SEQ ID NO: 2214460 - protein, 6 aa, Cryptosporidium parvum
ETYGEG

SEQ ID NO: 2214461 - protein, 14 aa, Cryptosporidium parvum
ETYHTDSKEATSSC

SEQ ID NO: 2214462 - protein, 4 aa, Cryptosporidium parvum
ETYT

SEQ ID NO: 2214463 - protein, 12 aa, Cryptosporidium parvum
EVADDSSAIVNS

SEQ ID NO: 2214464 - protein, 5 aa, Cryptosporidium parvum
EVDER

SEQ ID NO: 2214465 - protein, 6 aa, Cryptosporidium parvum
EVDGQP

SEQ ID NO: 2214466 - protein, 9 aa, Cryptosporidium parvum
EVDSNSPEI

SEQ ID NO: 2214467 - protein, 9 aa, Cryptosporidium parvum
EVDSQSREV

SEQ ID NO: 2214468 - protein, 6 aa, Cryptosporidium parvum
EVEEDV

SEQ ID NO: 2214469 - protein, 17 aa, Cryptosporidium parvum
EVEEKYRQNRRGGRETL

SEQ ID NO: 2214470 - protein, 4 aa, Cryptosporidium parvum
EVER

SEQ ID NO: 2214471 - protein, 21 aa, Cryptosporidium parvum
EVESENDQKRINGEPTGDQQK

SEQ ID NO: 2214472 - protein, 21 aa, Cryptosporidium parvum
EVETKVDEKTNSQTDNKMTTE

SEQ ID NO: 2214473 - protein, 14 aa, Cryptosporidium parvum
EVGDARNPSQTKIA

SEQ ID NO: 2214474 - protein, 9 aa, Cryptosporidium parvum
EVKDSNSYS

SEQ ID NO: 2214475 - protein, 15 aa, Cryptosporidium parvum
EVKGANKYPSNKYSG

SEQ ID NO: 2214476 - protein, 8 aa, Cryptosporidium parvum
EVKSNNKL

SEQ ID NO: 2214477 - protein, 9 aa, Cryptosporidium parvum
EVNDTYSGI

SEQ ID NO: 2214478 - protein, 6 aa, Cryptosporidium parvum
EVNKEN

SEQ ID NO: 2214479 - protein, 7 aa, Cryptosporidium parvum
EVNTSNL

SEQ ID NO: 2214480 - protein, 9 aa, Cryptosporidium parvum
EVQEPSSIA

SEQ ID NO: 2214481 - protein, 5 aa, Cryptosporidium parvum
EVQGS

SEQ ID NO: 2214482 - protein, 9 aa, Cryptosporidium parvum
EVRKTDSDK

SEQ ID NO: 2214483 - protein, 10 aa, Cryptosporidium parvum
EVSDSISGVQ

SEQ ID NO: 2214484 - protein, 7 aa, Cryptosporidium parvum
EVSPAPL

SEQ ID NO: 2214485 - protein, 6 aa, Cryptosporidium parvum
EVSPEY

SEQ ID NO: 2214486 - protein, 5 aa, Cryptosporidium parvum
EVSTG

SEQ ID NO: 2214487 - protein, 6 aa, Cryptosporidium parvum
EVTGGQ

SEQ ID NO: 2214488 - protein, 16 aa, Cryptosporidium parvum
EVTSRANKSNGKISTF

SEQ ID NO: 2214489 - protein, 12 aa, Cryptosporidium parvum
EVVGDDDNKYQL

SEQ ID NO: 2214490 - protein, 12 aa, Cryptosporidium parvum
EVYNKGGRLFLE

SEQ ID NO: 2214491 - protein, 13 aa, Cryptosporidium parvum
EWGSSRRSFSNSS

SEQ ID NO: 2214492 - protein, 8 aa, Cryptosporidium parvum
EWKNSSLQ

SEQ ID NO: 2214493 - protein, 6 aa, Cryptosporidium parvum
EWKPSI

SEQ ID NO: 2214494 - protein, 4 aa, Cryptosporidium parvum
EWNA

SEQ ID NO: 2214495 - protein, 11 aa, Cryptosporidium parvum
EYDEISKSSIP

SEQ ID NO: 2214496 - protein, 4 aa, Cryptosporidium parvum
EYDQ

SEQ ID NO: 2214497 - protein, 6 aa, Cryptosporidium parvum
EYEETK

SEQ ID NO: 2214498 - protein, 9 aa, Cryptosporidium parvum
EYEKGSDGE

SEQ ID NO: 2214499 - protein, 8 aa, Cryptosporidium parvum
EYEKTSFK

SEQ ID NO: 2214500 - protein, 6 aa, Cryptosporidium parvum
EYGEED

SEQ ID NO: 2214501 - protein, 7 aa, Cryptosporidium parvum
EYGNSLP

SEQ ID NO: 2214502 - protein, 13 aa, Cryptosporidium parvum
EYISSNEKLPLNS

SEQ ID NO: 2214503 - protein, 4 aa, Cryptosporidium parvum
EYKA

SEQ ID NO: 2214504 - protein, 18 aa, Cryptosporidium parvum
EYKNSYEGSADLHNATSG

SEQ ID NO: 2214505 - protein, 16 aa, Cryptosporidium parvum
EYLKPETKTKPESLHK

SEQ ID NO: 2214506 - protein, 9 aa, Cryptosporidium parvum
EYNEEEKEI

SEQ ID NO: 2214507 - protein, 7 aa, Cryptosporidium parvum
EYNEPRS

SEQ ID NO: 2214508 - protein, 8 aa, Cryptosporidium parvum
EYNERKEK

SEQ ID NO: 2214509 - protein, 12 aa, Cryptosporidium parvum
EYNKKSKKKLEE

SEQ ID NO: 2214510 - protein, 8 aa, Cryptosporidium parvum
EYNKSAEN

SEQ ID NO: 2214511 - protein, 14 aa, Cryptosporidium parvum
EYNNNQEQIPPQFN

SEQ ID NO: 2214512 - protein, 10 aa, Cryptosporidium parvum
EYNSEEDNED

SEQ ID NO: 2214513 - protein, 19 aa, Cryptosporidium parvum
EYNSNTSTISSDNHKPVFP

SEQ ID NO: 2214514 - protein, 10 aa, Cryptosporidium parvum
EYNSSKSTGY

SEQ ID NO: 2214515 - protein, 6 aa, Cryptosporidium parvum
EYNSTD

SEQ ID NO: 2214516 - protein, 6 aa, Cryptosporidium parvum
EYPETA

SEQ ID NO: 2214517 - protein, 4 aa, Cryptosporidium parvum
EYPN

SEQ ID NO: 2214518 - protein, 8 aa, Cryptosporidium parvum
EYPNTETM

SEQ ID NO: 2214519 - protein, 11 aa, Cryptosporidium parvum
EYQEREGANQM

SEQ ID NO: 2214520 - protein, 7 aa, Cryptosporidium parvum
EYQTTHA

SEQ ID NO: 2214521 - protein, 4 aa, Cryptosporidium parvum
EYRN

SEQ ID NO: 2214522 - protein, 7 aa, Cryptosporidium parvum
EYRPDPS

SEQ ID NO: 2214523 - protein, 5 aa, Cryptosporidium parvum
EYRSR

SEQ ID NO: 2214524 - protein, 4 aa, Cryptosporidium parvum
EYSE

SEQ ID NO: 2214525 - protein, 20 aa, Cryptosporidium parvum
EYSGNNNICTKSDGSPNNHE

SEQ ID NO: 2214526 - protein, 10 aa, Cryptosporidium parvum
EYSGQSDPPM

SEQ ID NO: 2214527 - protein, 6 aa, Cryptosporidium parvum
EYSKTT

SEQ ID NO: 2214528 - protein, 6 aa, Cryptosporidium parvum
EYSPQD

SEQ ID NO: 2214529 - protein, 8 aa, Cryptosporidium parvum
EYSYKSGG

SEQ ID NO: 2214530 - protein, 35 aa, Cryptosporidium parvum
FADDENLSSSESNEDTNSLGSDLESITKKNDDDKY

SEQ ID NO: 2214531 - protein, 7 aa, Cryptosporidium parvum
FAGRNTE

SEQ ID NO: 2214532 - protein, 4 aa, Cryptosporidium parvum
FANR

SEQ ID NO: 2214533 - protein, 6 aa, Cryptosporidium parvum
FARNEG

SEQ ID NO: 2214534 - protein, 5 aa, Cryptosporidium parvum
FASNE

SEQ ID NO: 2214535 - protein, 27 aa, Cryptosporidium parvum
FATPSDDEKNMESNSCSIRSKSNYLNG

SEQ ID NO: 2214536 - protein, 5 aa, Cryptosporidium parvum
FAVNG

SEQ ID NO: 2214537 - protein, 12 aa, Cryptosporidium parvum
FCSGNNSRIDIS

SEQ ID NO: 2214538 - protein, 10 aa, Cryptosporidium parvum
FDAENEEKVG

SEQ ID NO: 2214539 - protein, 9 aa, Cryptosporidium parvum
FDDDNDITS

SEQ ID NO: 2214540 - protein, 17 aa, Cryptosporidium parvum
FDDPKNPSKKSSVEIKD

SEQ ID NO: 2214541 - protein, 9 aa, Cryptosporidium parvum
FDEDDGYAS

SEQ ID NO: 2214542 - protein, 7 aa, Cryptosporidium parvum
FDEGDSV

SEQ ID NO: 2214543 - protein, 13 aa, Cryptosporidium parvum
FDESADGFGRGEG

SEQ ID NO: 2214544 - protein, 32 aa, Cryptosporidium parvum
FDESDSSKNHVVQPKSEENIEGKSSLKNGRTI

SEQ ID NO: 2214545 - protein, 39 aa, Cryptosporidium parvum
FDGSRNISPRNTSSKYCEKSESEDKTSSEGMKGGYSSDT

SEQ ID NO: 2214546 - protein, 13 aa, Cryptosporidium parvum
FDGSSDVPSSTTG

SEQ ID NO: 2214547 - protein, 9 aa, Cryptosporidium parvum
FDKSNESKF

SEQ ID NO: 2214548 - protein, 24 aa, Cryptosporidium parvum
FDLETQKSHSAVEDDAEANIPYED

SEQ ID NO: 2214549 - protein, 11 aa, Cryptosporidium parvum
FDNNANNKRNV

SEQ ID NO: 2214550 - protein, 9 aa, Cryptosporidium parvum
FDNNSKGEY

SEQ ID NO: 2214551 - protein, 4 aa, Cryptosporidium parvum
FDNV

SEQ ID NO: 2214552 - protein, 10 aa, Cryptosporidium parvum
FDPEKQSHND

SEQ ID NO: 2214553 - protein, 8 aa, Cryptosporidium parvum
FDPGKFTD

SEQ ID NO: 2214554 - protein, 6 aa, Cryptosporidium parvum
FDPSPI

SEQ ID NO: 2214555 - protein, 7 aa, Cryptosporidium parvum
FDPYSSH

SEQ ID NO: 2214556 - protein, 11 aa, Cryptosporidium parvum
FDQDGNGKISV

SEQ ID NO: 2214557 - protein, 20 aa, Cryptosporidium parvum
FDRGSKEALEASNKTKIEEL

SEQ ID NO: 2214558 - protein, 5 aa, Cryptosporidium parvum
FDSEK

SEQ ID NO: 2214559 - protein, 4 aa, Cryptosporidium parvum
FDSN

SEQ ID NO: 2214560 - protein, 38 aa, Cryptosporidium parvum
FDSYPNSPEMTDTSSLHTSNSRNGRHCASDKSIPTQSS

SEQ ID NO: 2214561 - protein, 5 aa, Cryptosporidium parvum
FDTDK

SEQ ID NO: 2214562 - protein, 6 aa, Cryptosporidium parvum
FDTENS

SEQ ID NO: 2214563 - protein, 5 aa, Cryptosporidium parvum
FDTGG

SEQ ID NO: 2214564 - protein, 7 aa, Cryptosporidium parvum
FDTNPCS

SEQ ID NO: 2214565 - protein, 7 aa, Cryptosporidium parvum
FDTSNEK

SEQ ID NO: 2214566 - protein, 7 aa, Cryptosporidium parvum
FDTSRIR

SEQ ID NO: 2214567 - protein, 5 aa, Cryptosporidium parvum
FEESN

SEQ ID NO: 2214568 - protein, 8 aa, Cryptosporidium parvum
FEGEEAKN

SEQ ID NO: 2214569 - protein, 9 aa, Cryptosporidium parvum
FEGSEKSSH

SEQ ID NO: 2214570 - protein, 5 aa, Cryptosporidium parvum
FEGTT

SEQ ID NO: 2214571 - protein, 9 aa, Cryptosporidium parvum
FEKGRETNY

SEQ ID NO: 2214572 - protein, 4 aa, Cryptosporidium parvum
FEKK

SEQ ID NO: 2214573 - protein, 7 aa, Cryptosporidium parvum
FEKNEME

SEQ ID NO: 2214574 - protein, 19 aa, Cryptosporidium parvum
FEKNNESDDDLTSYNKYKN

SEQ ID NO: 2214575 - protein, 8 aa, Cryptosporidium parvum
FEKQQEKK

SEQ ID NO: 2214576 - protein, 24 aa, Cryptosporidium parvum
FEKSSSDNSYLNNERNSIGERVIL

SEQ ID NO: 2214577 - protein, 10 aa, Cryptosporidium parvum
FENDSKTSRK

SEQ ID NO: 2214578 - protein, 10 aa, Cryptosporidium parvum
FENDTENSYE

SEQ ID NO: 2214579 - protein, 21 aa, Cryptosporidium parvum
FENKNGNNTNTNSSASSKKLK

SEQ ID NO: 2214580 - protein, 7 aa, Cryptosporidium parvum
FENNKDK

SEQ ID NO: 2214581 - protein, 6 aa, Cryptosporidium parvum
FENNTH

SEQ ID NO: 2214582 - protein, 12 aa, Cryptosporidium parvum
FEPGTSIGGEIG

SEQ ID NO: 2214583 - protein, 6 aa, Cryptosporidium parvum
FERPNI

SEQ ID NO: 2214584 - protein, 4 aa, Cryptosporidium parvum
FESD

SEQ ID NO: 2214585 - protein, 5 aa, Cryptosporidium parvum
FESDT

SEQ ID NO: 2214586 - protein, 10 aa, Cryptosporidium parvum
FESEIDPKSP

SEQ ID NO: 2214587 - protein, 6 aa, Cryptosporidium parvum
FESENY

SEQ ID NO: 2214588 - protein, 7 aa, Cryptosporidium parvum
FESKNDN

SEQ ID NO: 2214589 - protein, 20 aa, Cryptosporidium parvum
FESPENLNKNAIKNNTERNN

SEQ ID NO: 2214590 - protein, 12 aa, Cryptosporidium parvum
FESRPTEKSSPV

SEQ ID NO: 2214591 - protein, 6 aa, Cryptosporidium parvum
FESSGK

SEQ ID NO: 2214592 - protein, 18 aa, Cryptosporidium parvum
FESSSNASDQSKSSSFDT

SEQ ID NO: 2214593 - protein, 5 aa, Cryptosporidium parvum
FESTT

SEQ ID NO: 2214594 - protein, 13 aa, Cryptosporidium parvum
FETPESQNSPHQT

SEQ ID NO: 2214595 - protein, 8 aa, Cryptosporidium parvum
FETSNTHK

SEQ ID NO: 2214596 - protein, 5 aa, Cryptosporidium parvum
FETTL

SEQ ID NO: 2214597 - protein, 16 aa, Cryptosporidium parvum
FGASSVEDANYKNGEH

SEQ ID NO: 2214598 - protein, 9 aa, Cryptosporidium parvum
FGDKSRFSS

SEQ ID NO: 2214599 - protein, 8 aa, Cryptosporidium parvum
FGEATQDN

SEQ ID NO: 2214600 - protein, 14 aa, Cryptosporidium parvum
FGEELRKSSRDEDQ

SEQ ID NO: 2214601 - protein, 11 aa, Cryptosporidium parvum
FGEGQEAIKKS

SEQ ID NO: 2214602 - protein, 6 aa, Cryptosporidium parvum
FGENTS

SEQ ID NO: 2214603 - protein, 13 aa, Cryptosporidium parvum
FGETELTNDVETQ

SEQ ID NO: 2214604 - protein, 5 aa, Cryptosporidium parvum
FGGDN

SEQ ID NO: 2214605 - protein, 4 aa, Cryptosporidium parvum
FGIG

SEQ ID NO: 2214606 - protein, 6 aa, Cryptosporidium parvum
FGKGRR

SEQ ID NO: 2214607 - protein, 14 aa, Cryptosporidium parvum
FGLPNDKKNEISGN

SEQ ID NO: 2214608 - protein, 8 aa, Cryptosporidium parvum
FGNGQNNF

SEQ ID NO: 2214609 - protein, 10 aa, Cryptosporidium parvum
FGNNGLDDRQ

SEQ ID NO: 2214610 - protein, 8 aa, Cryptosporidium parvum
FGNSESEN

SEQ ID NO: 2214611 - protein, 5 aa, Cryptosporidium parvum
FGPNI

SEQ ID NO: 2214612 - protein, 7 aa, Cryptosporidium parvum
FGQENSG

SEQ ID NO: 2214613 - protein, 7 aa, Cryptosporidium parvum
FGQPESE

SEQ ID NO: 2214614 - protein, 12 aa, Cryptosporidium parvum
FGRDEKVNNSCA

SEQ ID NO: 2214615 - protein, 8 aa, Cryptosporidium parvum
FGREGKYG

SEQ ID NO: 2214616 - protein, 7 aa, Cryptosporidium parvum
FGSNQGE

SEQ ID NO: 2214617 - protein, 17 aa, Cryptosporidium parvum
FGSSTEELVSSKSRRWE

SEQ ID NO: 2214618 - protein, 10 aa, Cryptosporidium parvum
FGTRSSRQTN

SEQ ID NO: 2214619 - protein, 6 aa, Cryptosporidium parvum
FGYSGD

SEQ ID NO: 2214620 - protein, 12 aa, Cryptosporidium parvum
FHSKGGSTDQNV

SEQ ID NO: 2214621 - protein, 13 aa, Cryptosporidium parvum
FHSSSGPASLTEY

SEQ ID NO: 2214622 - protein, 15 aa, Cryptosporidium parvum
FIEKTKDNKNMTKNF

SEQ ID NO: 2214623 - protein, 9 aa, Cryptosporidium parvum
FKDCSDSNS

SEQ ID NO: 2214624 - protein, 10 aa, Cryptosporidium parvum
FKGNSNRHNW

SEQ ID NO: 2214625 - protein, 5 aa, Cryptosporidium parvum
FKGTD

SEQ ID NO: 2214626 - protein, 10 aa, Cryptosporidium parvum
FKHKKNNSNN

SEQ ID NO: 2214627 - protein, 11 aa, Cryptosporidium parvum
FKKDDSNNIQE

SEQ ID NO: 2214628 - protein, 6 aa, Cryptosporidium parvum
FKKNYK

SEQ ID NO: 2214629 - protein, 31 aa, Cryptosporidium parvum
FKKSETLDKEPEIEKEPSENHVENEKKYEIE

SEQ ID NO: 2214630 - protein, 8 aa, Cryptosporidium parvum
FKKTNKKS

SEQ ID NO: 2214631 - protein, 8 aa, Cryptosporidium parvum
FKNKSNEI

SEQ ID NO: 2214632 - protein, 11 aa, Cryptosporidium parvum
FKNNTANSINN

SEQ ID NO: 2214633 - protein, 16 aa, Cryptosporidium parvum
FKNQNEKTFGTENPVD

SEQ ID NO: 2214634 - protein, 8 aa, Cryptosporidium parvum
FKNQTSPI

SEQ ID NO: 2214635 - protein, 10 aa, Cryptosporidium parvum
FKPTKSESLL

SEQ ID NO: 2214636 - protein, 38 aa, Cryptosporidium parvum
FKPTSSDEDPLLGSDESDGDVSDSKDATSKERKKLSRL

SEQ ID NO: 2214637 - protein, 10 aa, Cryptosporidium parvum
FKQEKSHPSF

SEQ ID NO: 2214638 - protein, 7 aa, Cryptosporidium parvum
FKQGRQS

SEQ ID NO: 2214639 - protein, 21 aa, Cryptosporidium parvum
FKQSKSKNNKNQNNNYSELPP

SEQ ID NO: 2214640 - protein, 9 aa, Cryptosporidium parvum
FKRSHSSKL

SEQ ID NO: 2214641 - protein, 7 aa, Cryptosporidium parvum
FKSGKNE

SEQ ID NO: 2214642 - protein, 10 aa, Cryptosporidium parvum
FKSNSSGISR

SEQ ID NO: 2214643 - protein, 7 aa, Cryptosporidium parvum
FKSTTKV

SEQ ID NO: 2214644 - protein, 4 aa, Cryptosporidium parvum
FKTR

SEQ ID NO: 2214645 - protein, 10 aa, Cryptosporidium parvum
FKTSNSNLIE

SEQ ID NO: 2214646 - protein, 9 aa, Cryptosporidium parvum
FKTTPGSDD

SEQ ID NO: 2214647 - protein, 11 aa, Cryptosporidium parvum
FKTTSKGRWSE

SEQ ID NO: 2214648 - protein, 8 aa, Cryptosporidium parvum
FNASKKRT

SEQ ID NO: 2214649 - protein, 7 aa, Cryptosporidium parvum
FNDSDKN

SEQ ID NO: 2214650 - protein, 5 aa, Cryptosporidium parvum
FNEDE

SEQ ID NO: 2214651 - protein, 5 aa, Cryptosporidium parvum
FNEDQ

SEQ ID NO: 2214652 - protein, 7 aa, Cryptosporidium parvum
FNGDRSD

SEQ ID NO: 2214653 - protein, 17 aa, Cryptosporidium parvum
FNKKNKGKKRYDNNENM

SEQ ID NO: 2214654 - protein, 17 aa, Cryptosporidium parvum
FNKKQDIKTQKFSPSLG

SEQ ID NO: 2214655 - protein, 11 aa, Cryptosporidium parvum
FNKLSKDEPIS

SEQ ID NO: 2214656 - protein, 9 aa, Cryptosporidium parvum
FNNEKEITN

SEQ ID NO: 2214657 - protein, 8 aa, Cryptosporidium parvum
FNNGDNTQ

SEQ ID NO: 2214658 - protein, 20 aa, Cryptosporidium parvum
FNNGYSSKWEKSTDIDFSNS

SEQ ID NO: 2214659 - protein, 6 aa, Cryptosporidium parvum
FNNNKN

SEQ ID NO: 2214660 - protein, 7 aa, Cryptosporidium parvum
FNPPDPR

SEQ ID NO: 2214661 - protein, 6 aa, Cryptosporidium parvum
FNPPSN

SEQ ID NO: 2214662 - protein, 5 aa, Cryptosporidium parvum
FNPSY

SEQ ID NO: 2214663 - protein, 8 aa, Cryptosporidium parvum
FNQPPNEM

SEQ ID NO: 2214664 - protein, 4 aa, Cryptosporidium parvum
FNQR

SEQ ID NO: 2214665 - protein, 8 aa, Cryptosporidium parvum
FNRDGTTD

SEQ ID NO: 2214666 - protein, 22 aa, Cryptosporidium parvum
FNRSGSKTGSIAPKSSEYGPTV

SEQ ID NO: 2214667 - protein, 8 aa, Cryptosporidium parvum
FNSAENTN

SEQ ID NO: 2214668 - protein, 9 aa, Cryptosporidium parvum
FNSDEENQA

SEQ ID NO: 2214669 - protein, 4 aa, Cryptosporidium parvum
FNSE

SEQ ID NO: 2214670 - protein, 20 aa, Cryptosporidium parvum
FNSEETETDFPPSRSSGDKY

SEQ ID NO: 2214671 - protein, 11 aa, Cryptosporidium parvum
FNSQGNGEQSQ

SEQ ID NO: 2214672 - protein, 7 aa, Cryptosporidium parvum
FNSRGER

SEQ ID NO: 2214673 - protein, 5 aa, Cryptosporidium parvum
FNSSK

SEQ ID NO: 2214674 - protein, 9 aa, Cryptosporidium parvum
FNSSNNYDQ

SEQ ID NO: 2214675 - protein, 9 aa, Cryptosporidium parvum
FNSSTSNLN

SEQ ID NO: 2214676 - protein, 5 aa, Cryptosporidium parvum
FNTGN

SEQ ID NO: 2214677 - protein, 40 aa, Cryptosporidium parvum
FNTNNKSHNNPNNDTRYPATSNMNKHDTDISGNNQKKYSI

SEQ ID NO: 2214678 - protein, 8 aa, Cryptosporidium parvum
FNTNQQNE

SEQ ID NO: 2214679 - protein, 6 aa, Cryptosporidium parvum
FNTNSP

SEQ ID NO: 2214680 - protein, 10 aa, Cryptosporidium parvum
FNTYDSEEIE

SEQ ID NO: 2214681 - protein, 4 aa, Cryptosporidium parvum
FPDE

SEQ ID NO: 2214682 - protein, 6 aa, Cryptosporidium parvum
FPDHKV

SEQ ID NO: 2214683 - protein, 12 aa, Cryptosporidium parvum
FPDKNSKKNNIP

SEQ ID NO: 2214684 - protein, 6 aa, Cryptosporidium parvum
FPDNYN

SEQ ID NO: 2214685 - protein, 10 aa, Cryptosporidium parvum
FPDSEITSKD

SEQ ID NO: 2214686 - protein, 9 aa, Cryptosporidium parvum
FPDSNGYFG

SEQ ID NO: 2214687 - protein, 11 aa, Cryptosporidium parvum
FPDTQNSPFSK

SEQ ID NO: 2214688 - protein, 5 aa, Cryptosporidium parvum
FPEDE

SEQ ID NO: 2214689 - protein, 6 aa, Cryptosporidium parvum
FPEIND

SEQ ID NO: 2214690 - protein, 13 aa, Cryptosporidium parvum
FPGLDRSSNMQSS

SEQ ID NO: 2214691 - protein, 5 aa, Cryptosporidium parvum
FPIND

SEQ ID NO: 2214692 - protein, 5 aa, Cryptosporidium parvum
FPITE

SEQ ID NO: 2214693 - protein, 9 aa, Cryptosporidium parvum
FPKETGEDY

SEQ ID NO: 2214694 - protein, 11 aa, Cryptosporidium parvum
FPKNSQCNNEI

SEQ ID NO: 2214695 - protein, 11 aa, Cryptosporidium parvum
FPKTQDKIEEY

SEQ ID NO: 2214696 - protein, 6 aa, Cryptosporidium parvum
FPMNDD

SEQ ID NO: 2214697 - protein, 5 aa, Cryptosporidium parvum
FPNAQ

SEQ ID NO: 2214698 - protein, 24 aa, Cryptosporidium parvum
FPNNPFPDAKDPMIADPDGELEAK

SEQ ID NO: 2214699 - protein, 6 aa, Cryptosporidium parvum
FPNSTI

SEQ ID NO: 2214700 - protein, 9 aa, Cryptosporidium parvum
FPPAIPGPF

SEQ ID NO: 2214701 - protein, 7 aa, Cryptosporidium parvum
FPPNADQ

SEQ ID NO: 2214702 - protein, 9 aa, Cryptosporidium parvum
FPPNQNWGP

SEQ ID NO: 2214703 - protein, 7 aa, Cryptosporidium parvum
FPPSLSR

SEQ ID NO: 2214704 - protein, 9 aa, Cryptosporidium parvum
FPSNSSSTF

SEQ ID NO: 2214705 - protein, 5 aa, Cryptosporidium parvum
FPTES

SEQ ID NO: 2214706 - protein, 8 aa, Cryptosporidium parvum
FPTGSSDI

SEQ ID NO: 2214707 - protein, 5 aa, Cryptosporidium parvum
FPTKY

SEQ ID NO: 2214708 - protein, 4 aa, Cryptosporidium parvum
FPTN

SEQ ID NO: 2214709 - protein, 4 aa, Cryptosporidium parvum
FPTT

SEQ ID NO: 2214710 - protein, 16 aa, Cryptosporidium parvum
FPTTDTNTNNTTTNTI

SEQ ID NO: 2214711 - protein, 11 aa, Cryptosporidium parvum
FPVKQSPSKTH

SEQ ID NO: 2214712 - protein, 11 aa, Cryptosporidium parvum
FQDNSDHNLNP

SEQ ID NO: 2214713 - protein, 17 aa, Cryptosporidium parvum
FQDSSKSNESETKEQNL

SEQ ID NO: 2214714 - protein, 5 aa, Cryptosporidium parvum
FQESG

SEQ ID NO: 2214715 - protein, 7 aa, Cryptosporidium parvum
FQGNGSI

SEQ ID NO: 2214716 - protein, 8 aa, Cryptosporidium parvum
FQGSPEEI

SEQ ID NO: 2214717 - protein, 6 aa, Cryptosporidium parvum
FQKDES

SEQ ID NO: 2214718 - protein, 9 aa, Cryptosporidium parvum
FQKSNNNRC

SEQ ID NO: 2214719 - protein, 11 aa, Cryptosporidium parvum
FQKSTGESNIT

SEQ ID NO: 2214720 - protein, 7 aa, Cryptosporidium parvum
FQNGSIS

SEQ ID NO: 2214721 - protein, 13 aa, Cryptosporidium parvum
FQNSKNNNFIDPG

SEQ ID NO: 2214722 - protein, 11 aa, Cryptosporidium parvum
FQNSSSTSIPS

SEQ ID NO: 2214723 - protein, 11 aa, Cryptosporidium parvum
FQNYSDNKLDP

SEQ ID NO: 2214724 - protein, 9 aa, Cryptosporidium parvum
FQSDSGSFN

SEQ ID NO: 2214725 - protein, 9 aa, Cryptosporidium parvum
FQSENSKGL

SEQ ID NO: 2214726 - protein, 8 aa, Cryptosporidium parvum
FQSETDTE

SEQ ID NO: 2214727 - protein, 11 aa, Cryptosporidium parvum
FQSKTKTKAFE

SEQ ID NO: 2214728 - protein, 13 aa, Cryptosporidium parvum
FQSPRHTQNNADL

SEQ ID NO: 2214729 - protein, 8 aa, Cryptosporidium parvum
FQSQSRRT

SEQ ID NO: 2214730 - protein, 12 aa, Cryptosporidium parvum
FQTNDGVPNEPR

SEQ ID NO: 2214731 - protein, 10 aa, Cryptosporidium parvum
FRKQDTSREL

SEQ ID NO: 2214732 - protein, 5 aa, Cryptosporidium parvum
FRKRT

SEQ ID NO: 2214733 - protein, 5 aa, Cryptosporidium parvum
FRRPV

SEQ ID NO: 2214734 - protein, 10 aa, Cryptosporidium parvum
FRTENNSTTI

SEQ ID NO: 2214735 - protein, 6 aa, Cryptosporidium parvum
FRTKGQ

SEQ ID NO: 2214736 - protein, 4 aa, Cryptosporidium parvum
FSDH

SEQ ID NO: 2214737 - protein, 5 aa, Cryptosporidium parvum
FSDNE

SEQ ID NO: 2214738 - protein, 4 aa, Cryptosporidium parvum
FSDS

SEQ ID NO: 2214739 - protein, 24 aa, Cryptosporidium parvum
FSEATIESTKNNESTEHPKDSNFQ

SEQ ID NO: 2214740 - protein, 9 aa, Cryptosporidium parvum
FSEDNKDSK

SEQ ID NO: 2214741 - protein, 7 aa, Cryptosporidium parvum
FSEEDAQ

SEQ ID NO: 2214742 - protein, 10 aa, Cryptosporidium parvum
FSEETRNEKI

SEQ ID NO: 2214743 - protein, 12 aa, Cryptosporidium parvum
FSEKFEDSSPSK

SEQ ID NO: 2214744 - protein, 5 aa, Cryptosporidium parvum
FSEKK

SEQ ID NO: 2214745 - protein, 10 aa, Cryptosporidium parvum
FSEKSQRSNI

SEQ ID NO: 2214746 - protein, 22 aa, Cryptosporidium parvum
FSENNKSSEVRPFQDSQQDSSF

SEQ ID NO: 2214747 - protein, 10 aa, Cryptosporidium parvum
FSENSNNKLE

SEQ ID NO: 2214748 - protein, 6 aa, Cryptosporidium parvum
FSEREE

SEQ ID NO: 2214749 - protein, 46 aa, Cryptosporidium parvum
FSESSRNEETDLNENNQEGVDELDDEEESTNRVGAQESNSLTRENR

SEQ ID NO: 2214750 - protein, 16 aa, Cryptosporidium parvum
FSGAKDLESAYSNDTG

SEQ ID NO: 2214751 - protein, 6 aa, Cryptosporidium parvum
FSGENN

SEQ ID NO: 2214752 - protein, 10 aa, Cryptosporidium parvum
FSGERNGDQI

SEQ ID NO: 2214753 - protein, 6 aa, Cryptosporidium parvum
FSGKDE

SEQ ID NO: 2214754 - protein, 7 aa, Cryptosporidium parvum
FSGTPSE

SEQ ID NO: 2214755 - protein, 7 aa, Cryptosporidium parvum
FSHKENE

SEQ ID NO: 2214756 - protein, 13 aa, Cryptosporidium parvum
FSIGESSIRKTRA

SEQ ID NO: 2214757 - protein, 4 aa, Cryptosporidium parvum
FSKD

SEQ ID NO: 2214758 - protein, 14 aa, Cryptosporidium parvum
FSKKESNIQTNDNL

SEQ ID NO: 2214759 - protein, 9 aa, Cryptosporidium parvum
FSKKYPNFT

SEQ ID NO: 2214760 - protein, 5 aa, Cryptosporidium parvum
FSKSI

SEQ ID NO: 2214761 - protein, 7 aa, Cryptosporidium parvum
FSKSSQS

SEQ ID NO: 2214762 - protein, 4 aa, Cryptosporidium parvum
FSND

SEQ ID NO: 2214763 - protein, 7 aa, Cryptosporidium parvum
FSNEEKK

SEQ ID NO: 2214764 - protein, 6 aa, Cryptosporidium parvum
FSNGPF

SEQ ID NO: 2214765 - protein, 7 aa, Cryptosporidium parvum
FSNGQTE

SEQ ID NO: 2214766 - protein, 6 aa, Cryptosporidium parvum
FSNGSS

SEQ ID NO: 2214767 - protein, 11 aa, Cryptosporidium parvum
FSNNNNKSSIG

SEQ ID NO: 2214768 - protein, 19 aa, Cryptosporidium parvum
FSNNSNSSCSSGNISNNNI

SEQ ID NO: 2214769 - protein, 19 aa, Cryptosporidium parvum
FSNPGTVSNYGNNISSTSQ

SEQ ID NO: 2214770 - protein, 12 aa, Cryptosporidium parvum
FSNSNAANESSN

SEQ ID NO: 2214771 - protein, 8 aa, Cryptosporidium parvum
FSNSNKEH

SEQ ID NO: 2214772 - protein, 10 aa, Cryptosporidium parvum
FSNYSPKINN

SEQ ID NO: 2214773 - protein, 8 aa, Cryptosporidium parvum
FSPEEQRM

SEQ ID NO: 2214774 - protein, 11 aa, Cryptosporidium parvum
FSPEKKNEYKM

SEQ ID NO: 2214775 - protein, 9 aa, Cryptosporidium parvum
FSPNKEEIL

SEQ ID NO: 2214776 - protein, 9 aa, Cryptosporidium parvum
FSPNKNSLS

SEQ ID NO: 2214777 - protein, 7 aa, Cryptosporidium parvum
FSPPEFS

SEQ ID NO: 2214778 - protein, 4 aa, Cryptosporidium parvum
FSPR

SEQ ID NO: 2214779 - protein, 13 aa, Cryptosporidium parvum
FSPSNNQNESLSE

SEQ ID NO: 2214780 - protein, 6 aa, Cryptosporidium parvum
FSPSTI

SEQ ID NO: 2214781 - protein, 6 aa, Cryptosporidium parvum
FSPTNY

SEQ ID NO: 2214782 - protein, 9 aa, Cryptosporidium parvum
FSQASLAGT

SEQ ID NO: 2214783 - protein, 22 aa, Cryptosporidium parvum
FSQGPAPPDPVQAANGQPQYYP

SEQ ID NO: 2214784 - protein, 8 aa, Cryptosporidium parvum
FSQQTNSI

SEQ ID NO: 2214785 - protein, 4 aa, Cryptosporidium parvum
FSQT

SEQ ID NO: 2214786 - protein, 6 aa, Cryptosporidium parvum
FSQTKG

SEQ ID NO: 2214787 - protein, 4 aa, Cryptosporidium parvum
FSRE

SEQ ID NO: 2214788 - protein, 22 aa, Cryptosporidium parvum
FSRNNTKTLNISPTGNEQSPSF

SEQ ID NO: 2214789 - protein, 12 aa, Cryptosporidium parvum
FSRSKSKDEKNQ

SEQ ID NO: 2214790 - protein, 9 aa, Cryptosporidium parvum
FSSDEYDNS

SEQ ID NO: 2214791 - protein, 9 aa, Cryptosporidium parvum
FSSEDNDEY

SEQ ID NO: 2214792 - protein, 18 aa, Cryptosporidium parvum
FSSKDENGQDEKKMKGNS

SEQ ID NO: 2214793 - protein, 6 aa, Cryptosporidium parvum
FSSLSS

SEQ ID NO: 2214794 - protein, 37 aa, Cryptosporidium parvum
FSSNQKIGTTGLKSDTENHPNSENRASQESKPRNDSA

SEQ ID NO: 2214795 - protein, 12 aa, Cryptosporidium parvum
FSSQDKDYKNST

SEQ ID NO: 2214796 - protein, 13 aa, Cryptosporidium parvum
FSSQDRRKRGKND

SEQ ID NO: 2214797 - protein, 5 aa, Cryptosporidium parvum
FSSQE

SEQ ID NO: 2214798 - protein, 9 aa, Cryptosporidium parvum
FSSQSNDKA

SEQ ID NO: 2214799 - protein, 8 aa, Cryptosporidium parvum
FSSRKEKE

SEQ ID NO: 2214800 - protein, 4 aa, Cryptosporidium parvum
FSSS

SEQ ID NO: 2214801 - protein, 14 aa, Cryptosporidium parvum
FSSSSLKNSENISS

SEQ ID NO: 2214802 - protein, 12 aa, Cryptosporidium parvum
FSSTGNSPNSMD

SEQ ID NO: 2214803 - protein, 5 aa, Cryptosporidium parvum
FSSTS

SEQ ID NO: 2214804 - protein, 9 aa, Cryptosporidium parvum
FSSTSRKYK

SEQ ID NO: 2214805 - protein, 4 aa, Cryptosporidium parvum
FSSY

SEQ ID NO: 2214806 - protein, 7 aa, Cryptosporidium parvum
FSTEEQG

SEQ ID NO: 2214807 - protein, 7 aa, Cryptosporidium parvum
FSTENSG

SEQ ID NO: 2214808 - protein, 13 aa, Cryptosporidium parvum
FSTENSHILYYIN

SEQ ID NO: 2214809 - protein, 12 aa, Cryptosporidium parvum
FSTGESKNKDVH

SEQ ID NO: 2214810 - protein, 9 aa, Cryptosporidium parvum
FSTKNSDDK

SEQ ID NO: 2214811 - protein, 5 aa, Cryptosporidium parvum
FSTNL

SEQ ID NO: 2214812 - protein, 22 aa, Cryptosporidium parvum
FSTPNIRRTPNSSNSDINDQNI

SEQ ID NO: 2214813 - protein, 5 aa, Cryptosporidium parvum
FSTSE

SEQ ID NO: 2214814 - protein, 6 aa, Cryptosporidium parvum
FSTSTN

SEQ ID NO: 2214815 - protein, 6 aa, Cryptosporidium parvum
FSVSSN

SEQ ID NO: 2214816 - protein, 9 aa, Cryptosporidium parvum
FTATGAAAS

SEQ ID NO: 2214817 - protein, 6 aa, Cryptosporidium parvum
FTATKH

SEQ ID NO: 2214818 - protein, 5 aa, Cryptosporidium parvum
FTDEE

SEQ ID NO: 2214819 - protein, 10 aa, Cryptosporidium parvum
FTDKSENKDI

SEQ ID NO: 2214820 - protein, 8 aa, Cryptosporidium parvum
FTESYSSA

SEQ ID NO: 2214821 - protein, 5 aa, Cryptosporidium parvum
FTGSN

SEQ ID NO: 2214822 - protein, 6 aa, Cryptosporidium parvum
FTKRND

SEQ ID NO: 2214823 - protein, 11 aa, Cryptosporidium parvum
FTKTESSGIIK

SEQ ID NO: 2214824 - protein, 14 aa, Cryptosporidium parvum
FTNGTSQSSQPLNS

SEQ ID NO: 2214825 - protein, 7 aa, Cryptosporidium parvum
FTNKDVS

SEQ ID NO: 2214826 - protein, 4 aa, Cryptosporidium parvum
FTNT

SEQ ID NO: 2214827 - protein, 8 aa, Cryptosporidium parvum
FTPNTSEN

SEQ ID NO: 2214828 - protein, 6 aa, Cryptosporidium parvum
FTPSSE

SEQ ID NO: 2214829 - protein, 9 aa, Cryptosporidium parvum
FTQGQKNDD

SEQ ID NO: 2214830 - protein, 17 aa, Cryptosporidium parvum
FTSDETGIKLPKKSGYK

SEQ ID NO: 2214831 - protein, 11 aa, Cryptosporidium parvum
FTSDRKRSSTV

SEQ ID NO: 2214832 - protein, 16 aa, Cryptosporidium parvum
FTSGNEDKSTENYSNS

SEQ ID NO: 2214833 - protein, 4 aa, Cryptosporidium parvum
FTSN

SEQ ID NO: 2214834 - protein, 4 aa, Cryptosporidium parvum
FTTD

SEQ ID NO: 2214835 - protein, 5 aa, Cryptosporidium parvum
FTTPG

SEQ ID NO: 2214836 - protein, 6 aa, Cryptosporidium parvum
FTTTTA

SEQ ID NO: 2214837 - protein, 11 aa, Cryptosporidium parvum
FTVSSSNGLIT

SEQ ID NO: 2214838 - protein, 9 aa, Cryptosporidium parvum
FVGSKPPEI

SEQ ID NO: 2214839 - protein, 12 aa, Cryptosporidium parvum
FVGSNNDQQKLE

SEQ ID NO: 2214840 - protein, 7 aa, Cryptosporidium parvum
FVPPERN

SEQ ID NO: 2214841 - protein, 9 aa, Cryptosporidium parvum
FVPSSNTQR

SEQ ID NO: 2214842 - protein, 32 aa, Cryptosporidium parvum
FVQSNGNSNVIPGTNGVGSGVVSGNNNSNYNN

SEQ ID NO: 2214843 - protein, 6 aa, Cryptosporidium parvum
FYGNDN

SEQ ID NO: 2214844 - protein, 11 aa, Cryptosporidium parvum
FYKSKNDSLNP

SEQ ID NO: 2214845 - protein, 15 aa, Cryptosporidium parvum
FYSNNNNNNNGSNNE

SEQ ID NO: 2214846 - protein, 9 aa, Cryptosporidium parvum
FYSQNDIDQ

SEQ ID NO: 2214847 - protein, 7 aa, Cryptosporidium parvum
FYSSNRD

SEQ ID NO: 2214848 - protein, 5 aa, Cryptosporidium parvum
FYTSN

SEQ ID NO: 2214849 - protein, 18 aa, Cryptosporidium parvum
GAASSNSQIRSSTEHISS

SEQ ID NO: 2214850 - protein, 5 aa, Cryptosporidium parvum
GADPE

SEQ ID NO: 2214851 - protein, 5 aa, Cryptosporidium parvum
GADSA

SEQ ID NO: 2214852 - protein, 5 aa, Cryptosporidium parvum
GAEAS

SEQ ID NO: 2214853 - protein, 7 aa, Cryptosporidium parvum
GAEKTSQ

SEQ ID NO: 2214854 - protein, 11 aa, Cryptosporidium parvum
GAIQGSSLSEA

SEQ ID NO: 2214855 - protein, 8 aa, Cryptosporidium parvum
GAKGSRVN

SEQ ID NO: 2214856 - protein, 6 aa, Cryptosporidium parvum
GAKHLS

SEQ ID NO: 2214857 - protein, 6 aa, Cryptosporidium parvum
GAKHPK

SEQ ID NO: 2214858 - protein, 18 aa, Cryptosporidium parvum
GAKSSQNLDENRDYSNIQ

SEQ ID NO: 2214859 - protein, 9 aa, Cryptosporidium parvum
GALRPSGAF

SEQ ID NO: 2214860 - protein, 8 aa, Cryptosporidium parvum
GANAHPQF

SEQ ID NO: 2214861 - protein, 96 aa, Cryptosporidium parvum
GANDNVQTKDESKEGSKDMSEEEQSTQETSSDSSNNDNDNDISSGTEEKSDSETEKGEDNKSGTSGAIDEKNDENANTDSKEEQNNATNGQDGSLL

SEQ ID NO: 2214862 - protein, 6 aa, Cryptosporidium parvum
GANPNF

SEQ ID NO: 2214863 - protein, 4 aa, Cryptosporidium parvum
GAPA

SEQ ID NO: 2214864 - protein, 5 aa, Cryptosporidium parvum
GAPDR

SEQ ID NO: 2214865 - protein, 6 aa, Cryptosporidium parvum
GAPEGI

SEQ ID NO: 2214866 - protein, 6 aa, Cryptosporidium parvum
GAPESI

SEQ ID NO: 2214867 - protein, 4 aa, Cryptosporidium parvum
GAPI

SEQ ID NO: 2214868 - protein, 6 aa, Cryptosporidium parvum
GAPNSQ

SEQ ID NO: 2214869 - protein, 34 aa, Cryptosporidium parvum
GAPSRRRGSSPSRQDRSRRLRQDSIDAPTQGNQG

SEQ ID NO: 2214870 - protein, 5 aa, Cryptosporidium parvum
GARLN

SEQ ID NO: 2214871 - protein, 4 aa, Cryptosporidium parvum
GARN

SEQ ID NO: 2214872 - protein, 74 aa, Cryptosporidium parvum
GARPKTRVGGPKPRSSSSSSSSSRSRSSARRRSRSRSRSRRSSKSRVRSSRSRVRSSRSRGRSRSRDKSSEARA

SEQ ID NO: 2214873 - protein, 4 aa, Cryptosporidium parvum
GASA

SEQ ID NO: 2214874 - protein, 11 aa, Cryptosporidium parvum
GASDEDSGSVD

SEQ ID NO: 2214875 - protein, 5 aa, Cryptosporidium parvum
GASES

SEQ ID NO: 2214876 - protein, 5 aa, Cryptosporidium parvum
GASGI

SEQ ID NO: 2214877 - protein, 6 aa, Cryptosporidium parvum
GASGVA

SEQ ID NO: 2214878 - protein, 17 aa, Cryptosporidium parvum
GASGVSSVPNPYGVEMQ

SEQ ID NO: 2214879 - protein, 22 aa, Cryptosporidium parvum
GASNNNSSLTSIESQQSDDEEI

SEQ ID NO: 2214880 - protein, 42 aa, Cryptosporidium parvum
GASQTEELQHSSDNLRRENTTAAQENTQEHSEDSQSNNRAKT

SEQ ID NO: 2214881 - protein, 43 aa, Cryptosporidium parvum
GASTTRGQANLNASNANTPTNLQESQNAFTPKSAASGPKSSSL

SEQ ID NO: 2214882 - protein, 7 aa, Cryptosporidium parvum
GATGIGK

SEQ ID NO: 2214883 - protein, 9 aa, Cryptosporidium parvum
GATTGNPNS

SEQ ID NO: 2214884 - protein, 17 aa, Cryptosporidium parvum
GATVPDNRKSLSKETGI

SEQ ID NO: 2214885 - protein, 6 aa, Cryptosporidium parvum
GAVTSD

SEQ ID NO: 2214886 - protein, 6 aa, Cryptosporidium parvum
GCDSEK

SEQ ID NO: 2214887 - protein, 5 aa, Cryptosporidium parvum
GCEGT

SEQ ID NO: 2214888 - protein, 5 aa, Cryptosporidium parvum
GCGKD

SEQ ID NO: 2214889 - protein, 6 aa, Cryptosporidium parvum
GCKGEE

SEQ ID NO: 2214890 - protein, 5 aa, Cryptosporidium parvum
GCRNL

SEQ ID NO: 2214891 - protein, 9 aa, Cryptosporidium parvum
GCSLSGGQR

SEQ ID NO: 2214892 - protein, 11 aa, Cryptosporidium parvum
GCSLSGGQRAR

SEQ ID NO: 2214893 - protein, 9 aa, Cryptosporidium parvum
GDASIASPF

SEQ ID NO: 2214894 - protein, 6 aa, Cryptosporidium parvum
GDDDPE

SEQ ID NO: 2214895 - protein, 6 aa, Cryptosporidium parvum
GDDPKR

SEQ ID NO: 2214896 - protein, 6 aa, Cryptosporidium parvum
GDDSGD

SEQ ID NO: 2214897 - protein, 6 aa, Cryptosporidium parvum
GDECQK

SEQ ID NO: 2214898 - protein, 7 aa, Cryptosporidium parvum
GDECRSE

SEQ ID NO: 2214899 - protein, 12 aa, Cryptosporidium parvum
GDEHRSNVTGGA

SEQ ID NO: 2214900 - protein, 4 aa, Cryptosporidium parvum
GDEK

SEQ ID NO: 2214901 - protein, 4 aa, Cryptosporidium parvum
GDEM

SEQ ID NO: 2214902 - protein, 41 aa, Cryptosporidium parvum; identical to SEQ ID NO: 2113395

SEQ ID NO: 2214903 - protein, 4 aa, Cryptosporidium parvum
GDER

SEQ ID NO: 2214904 - protein, 5 aa, Cryptosporidium parvum
GDERL

SEQ ID NO: 2214905 - protein, 8 aa, Cryptosporidium parvum
GDESKRRR

SEQ ID NO: 2214906 - protein, 7 aa, Cryptosporidium parvum
GDESNDS

SEQ ID NO: 2214907 - protein, 6 aa, Cryptosporidium parvum
GDESPM

SEQ ID NO: 2214908 - protein, 7 aa, Cryptosporidium parvum
GDEWDNK

SEQ ID NO: 2214909 - protein, 5 aa, Cryptosporidium parvum
GDFDH

SEQ ID NO: 2214910 - protein, 6 aa, Cryptosporidium parvum
GDGAND

SEQ ID NO: 2214911 - protein, 8 aa, Cryptosporidium parvum
GDGEYLDP

SEQ ID NO: 2214912 - protein, 13 aa, Cryptosporidium parvum
GDGGHLRPSIHTY

SEQ ID NO: 2214913 - protein, 7 aa, Cryptosporidium parvum
GDGGNDC

SEQ ID NO: 2214914 - protein, 8 aa, Cryptosporidium parvum
GDGGNDCG

SEQ ID NO: 2214915 - protein, 7 aa, Cryptosporidium parvum
GDGGNDV

SEQ ID NO: 2214916 - protein, 4 aa, Cryptosporidium parvum
GDGK

SEQ ID NO: 2214917 - protein, 6 aa, Cryptosporidium parvum
GDGPKK

SEQ ID NO: 2214918 - protein, 12 aa, Cryptosporidium parvum
GDGVNDAPALKA

SEQ ID NO: 2214919 - protein, 10 aa, Cryptosporidium parvum
GDIEPGIDGG

SEQ ID NO: 2214920 - protein, 10 aa, Cryptosporidium parvum
GDIETKSHSG

SEQ ID NO: 2214921 - protein, 9 aa, Cryptosporidium parvum
GDIPGSDEI

SEQ ID NO: 2214922 - protein, 26 aa, Cryptosporidium parvum
GDKMEDESIGNQIKDAAKEEDEKNEL

SEQ ID NO: 2214923 - protein, 6 aa, Cryptosporidium parvum
GDKNLD

SEQ ID NO: 2214924 - protein, 6 aa, Cryptosporidium parvum
GDKNPF

SEQ ID NO: 2214925 - protein, 12 aa, Cryptosporidium parvum
GDKRGKHKKITP

SEQ ID NO: 2214926 - protein, 12 aa, Cryptosporidium parvum
GDKSFKNSDNID

SEQ ID NO: 2214927 - protein, 6 aa, Cryptosporidium parvum
GDKSLA

SEQ ID NO: 2214928 - protein, 7 aa, Cryptosporidium parvum
GDKVTGY

SEQ ID NO: 2214929 - protein, 12 aa, Cryptosporidium parvum
GDLDQDYSHSHD

SEQ ID NO: 2214930 - protein, 8 aa, Cryptosporidium parvum
GDMSSSPS

SEQ ID NO: 2214931 - protein, 14 aa, Cryptosporidium parvum
GDNESSWATERPSL

SEQ ID NO: 2214932 - protein, 12 aa, Cryptosporidium parvum
GDNIGSLENDNS

SEQ ID NO: 2214933 - protein, 8 aa, Cryptosporidium parvum
GDNKSPEC

SEQ ID NO: 2214934 - protein, 8 aa, Cryptosporidium parvum
GDNNENLS

SEQ ID NO: 2214935 - protein, 13 aa, Cryptosporidium parvum
GDNNKKDTNNLSS

SEQ ID NO: 2214936 - protein, 7 aa, Cryptosporidium parvum
GDNRSGV

SEQ ID NO: 2214937 - protein, 5 aa, Cryptosporidium parvum
GDNSD

SEQ ID NO: 2214938 - protein, 21 aa, Cryptosporidium parvum
GDNSEDNEEEEDDESSGGGDS

SEQ ID NO: 2214939 - protein, 10 aa, Cryptosporidium parvum
GDNTPLGEFP

SEQ ID NO: 2214940 - protein, 8 aa, Cryptosporidium parvum
GDNVYPNP

SEQ ID NO: 2214941 - protein, 4 aa, Cryptosporidium parvum
GDPL

SEQ ID NO: 2214942 - protein, 5 aa, Cryptosporidium parvum
GDPSF

SEQ ID NO: 2214943 - protein, 6 aa, Cryptosporidium parvum
GDQARE

SEQ ID NO: 2214944 - protein, 8 aa, Cryptosporidium parvum
GDQDRSGV

SEQ ID NO: 2214945 - protein, 8 aa, Cryptosporidium parvum
GDQERLSE

SEQ ID NO: 2214946 - protein, 13 aa, Cryptosporidium parvum
GDQTIQSRTIESS

SEQ ID NO: 2214947 - protein, 6 aa, Cryptosporidium parvum
GDRLSA

SEQ ID NO: 2214948 - protein, 12 aa, Cryptosporidium parvum
GDRRKNKRNTLL

SEQ ID NO: 2214949 - protein, 4 aa, Cryptosporidium parvum
GDRS

SEQ ID NO: 2214950 - protein, 8 aa, Cryptosporidium parvum
GDSANKEL

SEQ ID NO: 2214951 - protein, 8 aa, Cryptosporidium parvum
GDSGVGKS

SEQ ID NO: 2214952 - protein, 16 aa, Cryptosporidium parvum
GDSKTNNGNSNVISGD

SEQ ID NO: 2214953 - protein, 9 aa, Cryptosporidium parvum
GDSNPTPLT

SEQ ID NO: 2214954 - protein, 8 aa, Cryptosporidium parvum
GDSTGKIN

SEQ ID NO: 2214955 - protein, 5 aa, Cryptosporidium parvum
GDSVN

SEQ ID NO: 2214956 - protein, 6 aa, Cryptosporidium parvum
GDSVPA

SEQ ID NO: 2214957 - protein, 7 aa, Cryptosporidium parvum
GDTEMDK

SEQ ID NO: 2214958 - protein, 8 aa, Cryptosporidium parvum
GDTESSRN

SEQ ID NO: 2214959 - protein, 5 aa, Cryptosporidium parvum
GDTGL

SEQ ID NO: 2214960 - protein, 6 aa, Cryptosporidium parvum
GDTPSH

SEQ ID NO: 2214961 - protein, 4 aa, Cryptosporidium parvum
GDVE

SEQ ID NO: 2214962 - protein, 6 aa, Cryptosporidium parvum
GDVEGK

SEQ ID NO: 2214963 - protein, 5 aa, Cryptosporidium parvum
GDVLP

SEQ ID NO: 2214964 - protein, 14 aa, Cryptosporidium parvum
GDYESRKASNLEEQ

SEQ ID NO: 2214965 - protein, 11 aa, Cryptosporidium parvum
GDYIKEGRRNY

SEQ ID NO: 2214966 - protein, 6 aa, Cryptosporidium parvum
GEAEAK

SEQ ID NO: 2214967 - protein, 8 aa, Cryptosporidium parvum
GECEAKGA

SEQ ID NO: 2214968 - protein, 6 aa, Cryptosporidium parvum
GEDIKK

SEQ ID NO: 2214969 - protein, 10 aa, Cryptosporidium parvum
GEDSLKGTGN

SEQ ID NO: 2214970 - protein, 11 aa, Cryptosporidium parvum
GEDSQYSSNSE

SEQ ID NO: 2214971 - protein, 9 aa, Cryptosporidium parvum
GEEETKEKF

SEQ ID NO: 2214972 - protein, 23 aa, Cryptosporidium parvum
GEEIRNNNEVGDDKEDNFEQSSE

SEQ ID NO: 2214973 - protein, 6 aa, Cryptosporidium parvum
GEEKCS

SEQ ID NO: 2214974 - protein, 7 aa, Cryptosporidium parvum
GEEKECP

SEQ ID NO: 2214975 - protein, 4 aa, Cryptosporidium parvum
GEEN

SEQ ID NO: 2214976 - protein, 5 aa, Cryptosporidium parvum
GEERE

SEQ ID NO: 2214977 - protein, 4 aa, Cryptosporidium parvum
GEET

SEQ ID NO: 2214978 - protein, 6 aa, Cryptosporidium parvum
GEEYGN

SEQ ID NO: 2214979 - protein, 8 aa, Cryptosporidium parvum
GEEYPPIP

SEQ ID NO: 2214980 - protein, 6 aa, Cryptosporidium parvum
GEFERS

SEQ ID NO: 2214981 - protein, 4 aa, Cryptosporidium parvum
GEGN

SEQ ID NO: 2214982 - protein, 5 aa, Cryptosporidium parvum
GEGNL

SEQ ID NO: 2214983 - protein, 7 aa, Cryptosporidium parvum
GEGPKPL

SEQ ID NO: 2214984 - protein, 10 aa, Cryptosporidium parvum
GEHISERTPI

SEQ ID NO: 2214985 - protein, 5 aa, Cryptosporidium parvum
GEIDS

SEQ ID NO: 2214986 - protein, 10 aa, Cryptosporidium parvum
GEINPDQSNV

SEQ ID NO: 2214987 - protein, 7 aa, Cryptosporidium parvum
GEINTSE

SEQ ID NO: 2214988 - protein, 6 aa, Cryptosporidium parvum
GEIQDP

SEQ ID NO: 2214989 - protein, 4 aa, Cryptosporidium parvum
GEIT

SEQ ID NO: 2214990 - protein, 7 aa, Cryptosporidium parvum
GEITSNK

SEQ ID NO: 2214991 - protein, 4 aa, Cryptosporidium parvum
GEKD

SEQ ID NO: 2214992 - protein, 19 aa, Cryptosporidium parvum
GEKETVGKASCTSSTNTQI

SEQ ID NO: 2214993 - protein, 5 aa, Cryptosporidium parvum
GEKKK

SEQ ID NO: 2214994 - protein, 10 aa, Cryptosporidium parvum
GEKKPDESAP

SEQ ID NO: 2214995 - protein, 8 aa, Cryptosporidium parvum
GEKKSENF

SEQ ID NO: 2214996 - protein, 6 aa, Cryptosporidium parvum
GEKKSH

SEQ ID NO: 2214997 - protein, 24 aa, Cryptosporidium parvum
GEKNKEIKYSSDNHINNKANTVTR

SEQ ID NO: 2214998 - protein, 5 aa, Cryptosporidium parvum
GEKRD

SEQ ID NO: 2214999 - protein, 7 aa, Cryptosporidium parvum
GEKSLGD

SEQ ID NO: 2215000 - protein, 6 aa, Cryptosporidium parvum
GEKSVS

SEQ ID NO: 2215001 - protein, 4 aa, Cryptosporidium parvum
GEKT

SEQ ID NO: 2215002 - protein, 11 aa, Cryptosporidium parvum
GEKTFSSHTDI

SEQ ID NO: 2215003 - protein, 8 aa, Cryptosporidium parvum
GEKTLSPS

SEQ ID NO: 2215004 - protein, 14 aa, Cryptosporidium parvum
GELGSSSKKKFSKR

SEQ ID NO: 2215005 - protein, 4 aa, Cryptosporidium parvum
GELK

SEQ ID NO: 2215006 - protein, 12 aa, Cryptosporidium parvum
GELNSESLNGSK

SEQ ID NO: 2215007 - protein, 5 aa, Cryptosporidium parvum
GELSG

SEQ ID NO: 2215008 - protein, 7 aa, Cryptosporidium parvum
GENDDNF

SEQ ID NO: 2215009 - protein, 10 aa, Cryptosporidium parvum
GENEEEEEEE

SEQ ID NO: 2215010 - protein, 7 aa, Cryptosporidium parvum
GENFKNK

SEQ ID NO: 2215011 - protein, 26 aa, Cryptosporidium parvum
GENGNITSLKGNESKLNNGESKKSGL

SEQ ID NO: 2215012 - protein, 4 aa, Cryptosporidium parvum
GENI

SEQ ID NO: 2215013 - protein, 6 aa, Cryptosporidium parvum
GENLSE

SEQ ID NO: 2215014 - protein, 6 aa, Cryptosporidium parvum
GENQNF

SEQ ID NO: 2215015 - protein, 8 aa, Cryptosporidium parvum
GENQVDSK

SEQ ID NO: 2215016 - protein, 21 aa, Cryptosporidium parvum
GENRDQIKNSINGDYSFSTGN

SEQ ID NO: 2215017 - protein, 13 aa, Cryptosporidium parvum
GENTEIPQVRGAK

SEQ ID NO: 2215018 - protein, 6 aa, Cryptosporidium parvum
GENTTQ

SEQ ID NO: 2215019 - protein, 6 aa, Cryptosporidium parvum
GEPARV

SEQ ID NO: 2215020 - protein, 4 aa, Cryptosporidium parvum
GEPP

SEQ ID NO: 2215021 - protein, 5 aa, Cryptosporidium parvum
GEPRI

SEQ ID NO: 2215022 - protein, 7 aa, Cryptosporidium parvum
GEPTNSY

SEQ ID NO: 2215023 - protein, 8 aa, Cryptosporidium parvum
GEQGMAKE

SEQ ID NO: 2215024 - protein, 25 aa, Cryptosporidium parvum
GEQINSKQNYNNRVSSESVTIQKKN

SEQ ID NO: 2215025 - protein, 9 aa, Cryptosporidium parvum
GEQQPSPNE

SEQ ID NO: 2215026 - protein, 10 aa, Cryptosporidium parvum
GEQSRNPSTI

SEQ ID NO: 2215027 - protein, 14 aa, Cryptosporidium parvum
GERAWTPSPPPPKD

SEQ ID NO: 2215028 - protein, 5 aa, Cryptosporidium parvum
GEREP

SEQ ID NO: 2215029 - protein, 11 aa, Cryptosporidium parvum
GERVSKKHPST

SEQ ID NO: 2215030 - protein, 7 aa, Cryptosporidium parvum
GESDDGK

SEQ ID NO: 2215031 - protein, 10 aa, Cryptosporidium parvum
GESEERDRNQ

SEQ ID NO: 2215032 - protein, 36 aa, Cryptosporidium parvum
GESFSNSENQNITNVRTKSGKSHAPDKLSQVGNGLP

SEQ ID NO: 2215033 - protein, 7 aa, Cryptosporidium parvum
GESGSME

SEQ ID NO: 2215034 - protein, 6 aa, Cryptosporidium parvum
GESHSG

SEQ ID NO: 2215035 - protein, 17 aa, Cryptosporidium parvum
GESPSFEDVNEKESDGV

SEQ ID NO: 2215036 - protein, 4 aa, Cryptosporidium parvum
GESS

SEQ ID NO: 2215037 - protein, 6 aa, Cryptosporidium parvum
GESSTK

SEQ ID NO: 2215038 - protein, 4 aa, Cryptosporidium parvum
GESV

SEQ ID NO: 2215039 - protein, 7 aa, Cryptosporidium parvum
GESYDGQ

SEQ ID NO: 2215040 - protein, 10 aa, Cryptosporidium parvum
GETDSGPKKT

SEQ ID NO: 2215041 - protein, 14 aa, Cryptosporidium parvum
GETGNDNTSDQTLK

SEQ ID NO: 2215042 - protein, 5 aa, Cryptosporidium parvum
GETGT

SEQ ID NO: 2215043 - protein, 8 aa, Cryptosporidium parvum
GETHHSNN

SEQ ID NO: 2215044 - protein, 110 aa, Cryptosporidium parvum
GETKKQTQKKNTRRQSAKSATSTKEKLASLNSKEDTVVTRRTTRSSTKQKTPSRKVTSETTQSKEVKPKQTSYNAAPARRTTRNSSKTSNEKPAETSTGKRRVTRSSSKM

SEQ ID NO: 2215045 - protein, 6 aa, Cryptosporidium parvum
GETKNI

SEQ ID NO: 2215046 - protein, 5 aa, Cryptosporidium parvum
GETNQ

SEQ ID NO: 2215047 - protein, 13 aa, Cryptosporidium parvum
GETPKNIEYCEDQ

SEQ ID NO: 2215048 - protein, 9 aa, Cryptosporidium parvum
GETSEYPKN

SEQ ID NO: 2215049 - protein, 9 aa, Cryptosporidium parvum
GETSTGKTS

SEQ ID NO: 2215050 - protein, 4 aa, Cryptosporidium parvum
GEVE

SEQ ID NO: 2215051 - protein, 8 aa, Cryptosporidium parvum
GEWSSEEK

SEQ ID NO: 2215052 - protein, 12 aa, Cryptosporidium parvum
GEYADINSAKSY

SEQ ID NO: 2215053 - protein, 5 aa, Cryptosporidium parvum
GEYED

SEQ ID NO: 2215054 - protein, 45 aa, Cryptosporidium parvum
GFGAGQAESSTEGSVERSNQEENSDQSSEESSTSQNEKKIGEASS

SEQ ID NO: 2215055 - protein, 4 aa, Cryptosporidium parvum
GFGG

SEQ ID NO: 2215056 - protein, 22 aa, Cryptosporidium parvum
GFKPPRRTTTTTTQSPPYSSRG

SEQ ID NO: 2215057 - protein, 4 aa, Cryptosporidium parvum
GFNN

SEQ ID NO: 2215058 - protein, 8 aa, Cryptosporidium parvum
GFNNPGGK

SEQ ID NO: 2215059 - protein, 11 aa, Cryptosporidium parvum
GFPGKSKRGEL

SEQ ID NO: 2215060 - protein, 5 aa, Cryptosporidium parvum
GFPKY

SEQ ID NO: 2215061 - protein, 13 aa, Cryptosporidium parvum
GFQNSKNKNTNLM

SEQ ID NO: 2215062 - protein, 6 aa, Cryptosporidium parvum
GFQNSN

SEQ ID NO: 2215063 - protein, 5 aa, Cryptosporidium parvum
GFRSR

SEQ ID NO: 2215064 - protein, 7 aa, Cryptosporidium parvum
GFSSDDR

SEQ ID NO: 2215065 - protein, 11 aa, Cryptosporidium parvum
GFSSNKSQESL

SEQ ID NO: 2215066 - protein, 9 aa, Cryptosporidium parvum
GFTGKAGNY

SEQ ID NO: 2215067 - protein, 11 aa, Cryptosporidium parvum
GFTGPSCKTGK

SEQ ID NO: 2215068 - protein, 11 aa, Cryptosporidium parvum
GGAANAYTSAD

SEQ ID NO: 2215069 - protein, 4 aa, Cryptosporidium parvum
GGAI

SEQ ID NO: 2215070 - protein, 27 aa, Cryptosporidium parvum
GGATGNGEGDGGAGGVTNSSSSNNTIE

SEQ ID NO: 2215071 - protein, 7 aa, Cryptosporidium parvum
GGDLPTS

SEQ ID NO: 2215072 - protein, 5 aa, Cryptosporidium parvum
GGDYS

SEQ ID NO: 2215073 - protein, 17 aa, Cryptosporidium parvum
GGEDESGNTSLEQNKTN

SEQ ID NO: 2215074 - protein, 5 aa, Cryptosporidium parvum
GGEEH

SEQ ID NO: 2215075 - protein, 8 aa, Cryptosporidium parvum
GGENTNNE

SEQ ID NO: 2215076 - protein, 5 aa, Cryptosporidium parvum
GGETL

SEQ ID NO: 2215077 - protein, 4 aa, Cryptosporidium parvum
GGEW

SEQ ID NO: 2215078 - protein, 7 aa, Cryptosporidium parvum
GGFRQET

SEQ ID NO: 2215079 - protein, 6 aa, Cryptosporidium parvum
GGFSSF

SEQ ID NO: 2215080 - protein, 6 aa, Cryptosporidium parvum
GGGFNR

SEQ ID NO: 2215081 - protein, 5 aa, Cryptosporidium parvum
GGGIG

SEQ ID NO: 2215082 - protein, 11 aa, Cryptosporidium parvum
GGGISMNGTGS

SEQ ID NO: 2215083 - protein, 4 aa, Cryptosporidium parvum
GGGK

SEQ ID NO: 2215084 - protein, 4 aa, Cryptosporidium parvum
GGGL

SEQ ID NO: 2215085 - protein, 5 aa, Cryptosporidium parvum
GGGNE

SEQ ID NO: 2215086 - protein, 7 aa, Cryptosporidium parvum
GGGPAPL

SEQ ID NO: 2215087 - protein, 5 aa, Cryptosporidium parvum
GGGPC

SEQ ID NO: 2215088 - protein, 29 aa, Cryptosporidium parvum
GGGRGGNGSRYRVRDGGHGSINNHHNSNN

SEQ ID NO: 2215089 - protein, 6 aa, Cryptosporidium parvum
GGGSNA

SEQ ID NO: 2215090 - protein, 17 aa, Cryptosporidium parvum
GGGVGEEARQLSGDKWK

SEQ ID NO: 2215091 - protein, 21 aa, Cryptosporidium parvum
GGGVGVEGGGGGGKFSRLDSN

SEQ ID NO: 2215092 - protein, 32 aa, Cryptosporidium parvum
GGGVSSGVGGDQQVPLQQSSYTPPVISGQPGQ

SEQ ID NO: 2215093 - protein, 6 aa, Cryptosporidium parvum
GGHSEA

SEQ ID NO: 2215094 - protein, 8 aa, Cryptosporidium parvum
GGIASNSN

SEQ ID NO: 2215095 - protein, 6 aa, Cryptosporidium parvum
GGINAS

SEQ ID NO: 2215096 - protein, 4 aa, Cryptosporidium parvum
GGIS

SEQ ID NO: 2215097 - protein, 7 aa, Cryptosporidium parvum
GGISNKA

SEQ ID NO: 2215098 - protein, 5 aa, Cryptosporidium parvum
GGKER

SEQ ID NO: 2215099 - protein, 7 aa, Cryptosporidium parvum
GGKGRTG

SEQ ID NO: 2215100 - protein, 5 aa, Cryptosporidium parvum
GGKLT

SEQ ID NO: 2215101 - protein, 11 aa, Cryptosporidium parvum
GGKNDLNNQTY

SEQ ID NO: 2215102 - protein, 5 aa, Cryptosporidium parvum
GGKQF

SEQ ID NO: 2215103 - protein, 4 aa, Cryptosporidium parvum
GGKR

SEQ ID NO: 2215104 - protein, 14 aa, Cryptosporidium parvum
GGKVNSNSISNDIN

SEQ ID NO: 2215105 - protein, 4 aa, Cryptosporidium parvum
GGNC

SEQ ID NO: 2215106 - protein, 20 aa, Cryptosporidium parvum
GGNCHNGDNHNNDNNNNNAF

SEQ ID NO: 2215107 - protein, 10 aa, Cryptosporidium parvum
GGNDPYDEKY

SEQ ID NO: 2215108 - protein, 4 aa, Cryptosporidium parvum
GGNH

SEQ ID NO: 2215109 - protein, 9 aa, Cryptosporidium parvum
GGNKFNQEY

SEQ ID NO: 2215110 - protein, 4 aa, Cryptosporidium parvum
GGNS

SEQ ID NO: 2215111 - protein, 10 aa, Cryptosporidium parvum
GGNSGGSNEA

SEQ ID NO: 2215112 - protein, 14 aa, Cryptosporidium parvum
GGNSNSGKKEAQNI

SEQ ID NO: 2215113 - protein, 5 aa, Cryptosporidium parvum
GGNTT

SEQ ID NO: 2215114 - protein, 40 aa, Cryptosporidium parvum
GGPFSSPSDSSTFSSSSTTTTTTTTSPVSTTTSNASTLTN

SEQ ID NO: 2215115 - protein, 4 aa, Cryptosporidium parvum
GGPL

SEQ ID NO: 2215116 - protein, 7 aa, Cryptosporidium parvum
GGPLDTN

SEQ ID NO: 2215117 - protein, 5 aa, Cryptosporidium parvum
GGPMS

SEQ ID NO: 2215118 - protein, 7 aa, Cryptosporidium parvum
GGPTKYK

SEQ ID NO: 2215119 - protein, 4 aa, Cryptosporidium parvum
GGPV

SEQ ID NO: 2215120 - protein, 207 aa, Cryptosporidium parvum
GGPVAPPASTTTLPPVTTQSTDTTLSTDTTLSTDTNPPTTATSPTTTATSPPTTATSPPTTATSPPTTATSPPTTATSPPTTATSPPTTATSPPTTATSPPTTATSPPTTATSPPTTATSPPTTATSPPTTATSPPTTATSPPTTATSPPTTATSPPTTATSPPTTATSPPTTTPTTMTTTAPSTVSTELTTTTAAATTKSSVDPGV

SEQ ID NO: 2215121 - protein, 6 aa, Cryptosporidium parvum
GGQSIP

SEQ ID NO: 2215122 - protein, 6 aa, Cryptosporidium parvum
GGRGDE

SEQ ID NO: 2215123 - protein, 9 aa, Cryptosporidium parvum
GGRGEGESA

SEQ ID NO: 2215124 - protein, 6 aa, Cryptosporidium parvum
GGRKPL

SEQ ID NO: 2215125 - protein, 17 aa, Cryptosporidium parvum
GGRKSISKIEKSNGSKQ

SEQ ID NO: 2215126 - protein, 9 aa, Cryptosporidium parvum
GGRRPRPKS

SEQ ID NO: 2215127 - protein, 26 aa, Cryptosporidium parvum
GGRSGENLLKGGSGSSKFGSKDEQQL

SEQ ID NO: 2215128 - protein, 12 aa, Cryptosporidium parvum
GGRVRGTKRDQL

SEQ ID NO: 2215129 - protein, 9 aa, Cryptosporidium parvum
GGSANKNVG

SEQ ID NO: 2215130 - protein, 8 aa, Cryptosporidium parvum
GGSCRRPS

SEQ ID NO: 2215131 - protein, 15 aa, Cryptosporidium parvum
GGSFHPSSSNNAINT

SEQ ID NO: 2215132 - protein, 8 aa, Cryptosporidium parvum
GGSGCGKS

SEQ ID NO: 2215133 - protein, 19 aa, Cryptosporidium parvum
GGSGTTTGVGISGSSGNNK

SEQ ID NO: 2215134 - protein, 7 aa, Cryptosporidium parvum
GGSHNDT

SEQ ID NO: 2215135 - protein, 12 aa, Cryptosporidium parvum
GGSIGRERSRSA

SEQ ID NO: 2215136 - protein, 6 aa, Cryptosporidium parvum
GGSLGS

SEQ ID NO: 2215137 - protein, 9 aa, Cryptosporidium parvum
GGSNKHREH

SEQ ID NO: 2215138 - protein, 16 aa, Cryptosporidium parvum
GGSNSDNEDPGPPQSI

SEQ ID NO: 2215139 - protein, 8 aa, Cryptosporidium parvum
GGSPNYEG

SEQ ID NO: 2215140 - protein, 6 aa, Cryptosporidium parvum
GGSQFD

SEQ ID NO: 2215141 - protein, 11 aa, Cryptosporidium parvum
GGSSGENQLPE

SEQ ID NO: 2215142 - protein, 6 aa, Cryptosporidium parvum
GGSSSN

SEQ ID NO: 2215143 - protein, 10 aa, Cryptosporidium parvum
GGSSTSKWAT

SEQ ID NO: 2215144 - protein, 5 aa, Cryptosporidium parvum
GGSTW

SEQ ID NO: 2215145 - protein, 6 aa, Cryptosporidium parvum
GGSYGS

SEQ ID NO: 2215146 - protein, 8 aa, Cryptosporidium parvum
GGTDDING

SEQ ID NO: 2215147 - protein, 5 aa, Cryptosporidium parvum
GGTGA

SEQ ID NO: 2215148 - protein, 6 aa, Cryptosporidium parvum
GGTGCQ

SEQ ID NO: 2215149 - protein, 7 aa, Cryptosporidium parvum
GGTGGIG

SEQ ID NO: 2215150 - protein, 9 aa, Cryptosporidium parvum
GGTGISQPD

SEQ ID NO: 2215151 - protein, 23 aa, Cryptosporidium parvum
GGTIGVGTRGVGGGLEQGEGLGG

SEQ ID NO: 2215152 - protein, 6 aa, Cryptosporidium parvum
GGTRTL

SEQ ID NO: 2215153 - protein, 4 aa, Cryptosporidium parvum
GGVG

SEQ ID NO: 2215154 - protein, 24 aa, Cryptosporidium parvum
GGVNGAKKSSSGDKGGSSGHGMPG

SEQ ID NO: 2215155 - protein, 15 aa, Cryptosporidium parvum
GGVQCPTEKEITERA

SEQ ID NO: 2215156 - protein, 11 aa, Cryptosporidium parvum
GGYENDQSQLN

SEQ ID NO: 2215157 - protein, 8 aa, Cryptosporidium parvum
GHASIYSS

SEQ ID NO: 2215158 - protein, 27 aa, Cryptosporidium parvum
GHASTSRVKGRSSSGSSSSSSSGDFNV

SEQ ID NO: 2215159 - protein, 5 aa, Cryptosporidium parvum
GHGKP

SEQ ID NO: 2215160 - protein, 5 aa, Cryptosporidium parvum
GHNGM

SEQ ID NO: 2215161 - protein, 9 aa, Cryptosporidium parvum
GHPTLSTSF

SEQ ID NO: 2215162 - protein, 5 aa, Cryptosporidium parvum
GHSTN

SEQ ID NO: 2215163 - protein, 7 aa, Cryptosporidium parvum
GIADPEP

SEQ ID NO: 2215164 - protein, 5 aa, Cryptosporidium parvum
GIANE

SEQ ID NO: 2215165 - protein, 7 aa, Cryptosporidium parvum
GIASKSL

SEQ ID NO: 2215166 - protein, 18 aa, Cryptosporidium parvum
GIDEEGAELNKKEEKAPK

SEQ ID NO: 2215167 - protein, 6 aa, Cryptosporidium parvum
GIDENA

SEQ ID NO: 2215168 - protein, 5 aa, Cryptosporidium parvum
GIDKP

SEQ ID NO: 2215169 - protein, 11 aa, Cryptosporidium parvum
GIDVSKSSYLS

SEQ ID NO: 2215170 - protein, 9 aa, Cryptosporidium parvum
GIEAAKKSH

SEQ ID NO: 2215171 - protein, 5 aa, Cryptosporidium parvum
GIEDH

SEQ ID NO: 2215172 - protein, 19 aa, Cryptosporidium parvum
GIEKTEEKNINNHHNSKKK

SEQ ID NO: 2215173 - protein, 7 aa, Cryptosporidium parvum
GIELSSD

SEQ ID NO: 2215174 - protein, 4 aa, Cryptosporidium parvum
GIET

SEQ ID NO: 2215175 - protein, 13 aa, Cryptosporidium parvum
GIGGDKSNKSIPR

SEQ ID NO: 2215176 - protein, 38 aa, Cryptosporidium parvum; identical to SEQ ID NO: 2113580

SEQ ID NO: 2215177 - protein, 9 aa, Cryptosporidium parvum
GIGNNHESA

SEQ ID NO: 2215178 - protein, 4 aa, Cryptosporidium parvum
GIGQ

SEQ ID NO: 2215179 - protein, 17 aa, Cryptosporidium parvum
GIGSGSGYRKEESNDFE

SEQ ID NO: 2215180 - protein, 32 aa, Cryptosporidium parvum
GIGSTSTSSGQNKNKKKSNSTSSSNATPLPPK

SEQ ID NO: 2215181 - protein, 14 aa, Cryptosporidium parvum
GIKGELNGNQIDEN

SEQ ID NO: 2215182 - protein, 6 aa, Cryptosporidium parvum
GIKRRT

SEQ ID NO: 2215183 - protein, 16 aa, Cryptosporidium parvum
GINPDKPRGLAKAVTV

SEQ ID NO: 2215184 - protein, 5 aa, Cryptosporidium parvum
GINSS

SEQ ID NO: 2215185 - protein, 11 aa, Cryptosporidium parvum
GINSSGSGGGV

SEQ ID NO: 2215186 - protein, 6 aa, Cryptosporidium parvum
GINSYK

SEQ ID NO: 2215187 - protein, 9 aa, Cryptosporidium parvum
GINTSESEY

SEQ ID NO: 2215188 - protein, 5 aa, Cryptosporidium parvum
GIPED

SEQ ID NO: 2215189 - protein, 7 aa, Cryptosporidium parvum
GIPPNAH

SEQ ID NO: 2215190 - protein, 7 aa, Cryptosporidium parvum
GIPQGSS

SEQ ID NO: 2215191 - protein, 4 aa, Cryptosporidium parvum
GIPR

SEQ ID NO: 2215192 - protein, 4 aa, Cryptosporidium parvum
GIPS

SEQ ID NO: 2215193 - protein, 5 aa, Cryptosporidium parvum
GIPSS

SEQ ID NO: 2215194 - protein, 4 aa, Cryptosporidium parvum
GIPY

SEQ ID NO: 2215195 - protein, 4 aa, Cryptosporidium parvum
GIQP

SEQ ID NO: 2215196 - protein, 11 aa, Cryptosporidium parvum
GIRESKNQSSF

SEQ ID NO: 2215197 - protein, 7 aa, Cryptosporidium parvum
GIRHEPE

SEQ ID NO: 2215198 - protein, 22 aa, Cryptosporidium parvum
GIRKNQRKTCNSGRSDEDGVDI

SEQ ID NO: 2215199 - protein, 11 aa, Cryptosporidium parvum
GIRQDGRKLTE

SEQ ID NO: 2215200 - protein, 11 aa, Cryptosporidium parvum
GIRTEKKNVPE

SEQ ID NO: 2215201 - protein, 10 aa, Cryptosporidium parvum
GISGSNSPTV

SEQ ID NO: 2215202 - protein, 5 aa, Cryptosporidium parvum
GISNN

SEQ ID NO: 2215203 - protein, 6 aa, Cryptosporidium parvum
GISPPN

SEQ ID NO: 2215204 - protein, 7 aa, Cryptosporidium parvum
GISRESY

SEQ ID NO: 2215205 - protein, 9 aa, Cryptosporidium parvum
GISSPGLAL

SEQ ID NO: 2215206 - protein, 5 aa, Cryptosporidium parvum
GISSY

SEQ ID NO: 2215207 - protein, 4 aa, Cryptosporidium parvum
GITS

SEQ ID NO: 2215208 - protein, 27 aa, Cryptosporidium parvum
GITTTATAAATTTTTTGGGGGTIGGTP

SEQ ID NO: 2215209 - protein, 11 aa, Cryptosporidium parvum
GIVNNDPKQRE

SEQ ID NO: 2215210 - protein, 6 aa, Cryptosporidium parvum
GIYSEN

SEQ ID NO: 2215211 - protein, 13 aa, Cryptosporidium parvum
GIYSKNKNFNQNT

SEQ ID NO: 2215212 - protein, 38 aa, Cryptosporidium parvum
GKAGSQSKSSDESGNPIDPSTNMPYDPKTGKLIDPESG

SEQ ID NO: 2215213 - protein, 24 aa, Cryptosporidium parvum
GKAKVESGNGFGDKNKELSTMDGS

SEQ ID NO: 2215214 - protein, 6 aa, Cryptosporidium parvum
GKCPVN

SEQ ID NO: 2215215 - protein, 6 aa, Cryptosporidium parvum
GKDAQN

SEQ ID NO: 2215216 - protein, 8 aa, Cryptosporidium parvum
GKDEEHCK

SEQ ID NO: 2215217 - protein, 8 aa, Cryptosporidium parvum
GKDERAYE

SEQ ID NO: 2215218 - protein, 14 aa, Cryptosporidium parvum
GKDGKESVNPKKNK

SEQ ID NO: 2215219 - protein, 14 aa, Cryptosporidium parvum
GKDGKYSKEKVTNI

SEQ ID NO: 2215220 - protein, 13 aa, Cryptosporidium parvum
GKDKEGPKKSNNI

SEQ ID NO: 2215221 - protein, 7 aa, Cryptosporidium parvum
GKDRNTR

SEQ ID NO: 2215222 - protein, 8 aa, Cryptosporidium parvum
GKDSPLNN

SEQ ID NO: 2215223 - protein, 7 aa, Cryptosporidium parvum
GKDSPQI

SEQ ID NO: 2215224 - protein, 9 aa, Cryptosporidium parvum
GKDSSLINE

SEQ ID NO: 2215225 - protein, 9 aa, Cryptosporidium parvum
GKDSTVKKN

SEQ ID NO: 2215226 - protein, 9 aa, Cryptosporidium parvum
GKEAPGITT

SEQ ID NO: 2215227 - protein, 5 aa, Cryptosporidium parvum
GKEAW

SEQ ID NO: 2215228 - protein, 4 aa, Cryptosporidium parvum
GKED

SEQ ID NO: 2215229 - protein, 4 aa, Cryptosporidium parvum
GKEE

SEQ ID NO: 2215230 - protein, 6 aa, Cryptosporidium parvum
GKEESI

SEQ ID NO: 2215231 - protein, 4 aa, Cryptosporidium parvum
GKEI

SEQ ID NO: 2215232 - protein, 13 aa, Cryptosporidium parvum
GKENDEANSEEQF

SEQ ID NO: 2215233 - protein, 9 aa, Cryptosporidium parvum
GKENKSFKK

SEQ ID NO: 2215234 - protein, 10 aa, Cryptosporidium parvum
GKENLEREGV

SEQ ID NO: 2215235 - protein, 9 aa, Cryptosporidium parvum
GKENSGEIG

SEQ ID NO: 2215236 - protein, 11 aa, Cryptosporidium parvum
GKEQAEETGKY

SEQ ID NO: 2215237 - protein, 7 aa, Cryptosporidium parvum
GKEQISQ

SEQ ID NO: 2215238 - protein, 6 aa, Cryptosporidium parvum
GKEREK

SEQ ID NO: 2215239 - protein, 4 aa, Cryptosporidium parvum
GKES

SEQ ID NO: 2215240 - protein, 9 aa, Cryptosporidium parvum
GKETDKIKE

SEQ ID NO: 2215241 - protein, 7 aa, Cryptosporidium parvum
GKETLGE

SEQ ID NO: 2215242 - protein, 7 aa, Cryptosporidium parvum
GKETSGQ

SEQ ID NO: 2215243 - protein, 6 aa, Cryptosporidium parvum
GKEYRN

SEQ ID NO: 2215244 - protein, 14 aa, Cryptosporidium parvum
GKFGKNKDNLASKD

SEQ ID NO: 2215245 - protein, 8 aa, Cryptosporidium parvum
GKFQGAGS

SEQ ID NO: 2215246 - protein, 12 aa, Cryptosporidium parvum
GKGDNSGIDSSN

SEQ ID NO: 2215247 - protein, 18 aa, Cryptosporidium parvum
GKGISSSSPISLSSTNQF

SEQ ID NO: 2215248 - protein, 9 aa, Cryptosporidium parvum
GKGNKIGEH

SEQ ID NO: 2215249 - protein, 7 aa, Cryptosporidium parvum
GKGNNNI

SEQ ID NO: 2215250 - protein, 9 aa, Cryptosporidium parvum
GKGPNKNSW

SEQ ID NO: 2215251 - protein, 4 aa, Cryptosporidium parvum
GKGS

SEQ ID NO: 2215252 - protein, 8 aa, Cryptosporidium parvum
GKGSKHDL

SEQ ID NO: 2215253 - protein, 5 aa, Cryptosporidium parvum
GKHGC

SEQ ID NO: 2215254 - protein, 7 aa, Cryptosporidium parvum
GKHTPRN

SEQ ID NO: 2215255 - protein, 6 aa, Cryptosporidium parvum
GKIDSS

SEQ ID NO: 2215256 - protein, 6 aa, Cryptosporidium parvum
GKIIDS

SEQ ID NO: 2215257 - protein, 4 aa, Cryptosporidium parvum
GKIN

SEQ ID NO: 2215258 - protein, 7 aa, Cryptosporidium parvum
GKISQKY

SEQ ID NO: 2215259 - protein, 9 aa, Cryptosporidium parvum
GKKDGPSST

SEQ ID NO: 2215260 - protein, 11 aa, Cryptosporidium parvum
GKKENNTINQT

SEQ ID NO: 2215261 - protein, 7 aa, Cryptosporidium parvum
GKKGNLH

SEQ ID NO: 2215262 - protein, 16 aa, Cryptosporidium parvum
GKKIGLKKSTEASSNL

SEQ ID NO: 2215263 - protein, 13 aa, Cryptosporidium parvum
GKKKEKNKITKIN

SEQ ID NO: 2215264 - protein, 8 aa, Cryptosporidium parvum
GKKPINSG

SEQ ID NO: 2215265 - protein, 21 aa, Cryptosporidium parvum
GKKPSVVSSSTSIKAPGTQIG

SEQ ID NO: 2215266 - protein, 37 aa, Cryptosporidium parvum
GKKSKSNEKEEKKKDDGDEDGDEDGDEDEDEDEDEDP

SEQ ID NO: 2215267 - protein, 4 aa, Cryptosporidium parvum
GKKV

SEQ ID NO: 2215268 - protein, 7 aa, Cryptosporidium parvum
GKKYNSL

SEQ ID NO: 2215269 - protein, 10 aa, Cryptosporidium parvum
GKLDSAPNIV

SEQ ID NO: 2215270 - protein, 11 aa, Cryptosporidium parvum
GKLEDYGIENG

SEQ ID NO: 2215271 - protein, 17 aa, Cryptosporidium parvum
GKLNDQEENKDDLDEDL

SEQ ID NO: 2215272 - protein, 12 aa, Cryptosporidium parvum
GKLNSTLSPSEI

SEQ ID NO: 2215273 - protein, 6 aa, Cryptosporidium parvum
GKLSDP

SEQ ID NO: 2215274 - protein, 5 aa, Cryptosporidium parvum
GKMIE

SEQ ID NO: 2215275 - protein, 7 aa, Cryptosporidium parvum
GKNEYAS

SEQ ID NO: 2215276 - protein, 9 aa, Cryptosporidium parvum
GKNFTSFSS

SEQ ID NO: 2215277 - protein, 28 aa, Cryptosporidium parvum
GKNHSSKEGGNSQKNAVAANNRTCENGR

SEQ ID NO: 2215278 - protein, 7 aa, Cryptosporidium parvum
GKNIKAS

SEQ ID NO: 2215279 - protein, 8 aa, Cryptosporidium parvum
GKNKDDLL

SEQ ID NO: 2215280 - protein, 10 aa, Cryptosporidium parvum
GKNKQKNEKI

SEQ ID NO: 2215281 - protein, 17 aa, Cryptosporidium parvum
GKNMEREAEEDEQMNSR

SEQ ID NO: 2215282 - protein, 10 aa, Cryptosporidium parvum
GKNNRKEELY

SEQ ID NO: 2215283 - protein, 8 aa, Cryptosporidium parvum
GKNPDKSG

SEQ ID NO: 2215284 - protein, 5 aa, Cryptosporidium parvum
GKNSD

SEQ ID NO: 2215285 - protein, 7 aa, Cryptosporidium parvum
GKNSSNN

SEQ ID NO: 2215286 - protein, 34 aa, Cryptosporidium parvum
GKNTYNKSDDGYQKDVTKYQSTSTTPTETSTTKH

SEQ ID NO: 2215287 - protein, 9 aa, Cryptosporidium parvum
GKPGNNDDF

SEQ ID NO: 2215288 - protein, 6 aa, Cryptosporidium parvum
GKPNES

SEQ ID NO: 2215289 - protein, 8 aa, Cryptosporidium parvum
GKPPNSLQ

SEQ ID NO: 2215290 - protein, 10 aa, Cryptosporidium parvum
GKQWGSSDRY

SEQ ID NO: 2215291 - protein, 9 aa, Cryptosporidium parvum
GKRDLASNF

SEQ ID NO: 2215292 - protein, 5 aa, Cryptosporidium parvum
GKRFR

SEQ ID NO: 2215293 - protein, 12 aa, Cryptosporidium parvum
GKRKKRNSISQE

SEQ ID NO: 2215294 - protein, 8 aa, Cryptosporidium parvum
GKRNFNNK

SEQ ID NO: 2215295 - protein, 22 aa, Cryptosporidium parvum
GKRNQANKQKYSGKSQNKYKTY

SEQ ID NO: 2215296 - protein, 4 aa, Cryptosporidium parvum
GKRP

SEQ ID NO: 2215297 - protein, 5 aa, Cryptosporidium parvum
GKRPI

SEQ ID NO: 2215298 - protein, 5 aa, Cryptosporidium parvum
GKRPK

SEQ ID NO: 2215299 - protein, 6 aa, Cryptosporidium parvum
GKRSQK

SEQ ID NO: 2215300 - protein, 12 aa, Cryptosporidium parvum
GKSASILGGPTI

SEQ ID NO: 2215301 - protein, 9 aa, Cryptosporidium parvum
GKSGSGKST

SEQ ID NO: 2215302 - protein, 8 aa, Cryptosporidium parvum
GKSGSGKT

SEQ ID NO: 2215303 - protein, 12 aa, Cryptosporidium parvum
GKSHYKSPQKVE

SEQ ID NO: 2215304 - protein, 7 aa, Cryptosporidium parvum
GKSISSN

SEQ ID NO: 2215305 - protein, 9 aa, Cryptosporidium parvum
GKSKFNKIS

SEQ ID NO: 2215306 - protein, 11 aa, Cryptosporidium parvum
GKSNFAYTGAS

SEQ ID NO: 2215307 - protein, 6 aa, Cryptosporidium parvum
GKSNPT

SEQ ID NO: 2215308 - protein, 4 aa, Cryptosporidium parvum
GKSP

SEQ ID NO: 2215309 - protein, 32 aa, Cryptosporidium parvum
GKSPPKAPKKSPKSTKTVSSVTSKTTTTSTTF

SEQ ID NO: 2215310 - protein, 8 aa, Cryptosporidium parvum
GKSQVETQ

SEQ ID NO: 2215311 - protein, 10 aa, Cryptosporidium parvum
GKSTYSTVRG

SEQ ID NO: 2215312 - protein, 4 aa, Cryptosporidium parvum
GKSY

SEQ ID NO: 2215313 - protein, 7 aa, Cryptosporidium parvum
GKSYPKK

SEQ ID NO: 2215314 - protein, 4 aa, Cryptosporidium parvum
GKTA

SEQ ID NO: 2215315 - protein, 51 aa, Cryptosporidium parvum
GKTETGTSPCRGSSHIPDHQNSSYRSNSRDSVSTMDTRREAGRERSYDSLM

SEQ ID NO: 2215316 - protein, 6 aa, Cryptosporidium parvum
GKTLDS

SEQ ID NO: 2215317 - protein, 21 aa, Cryptosporidium parvum
GKTNKRCSQNALSGSQPTVNE

SEQ ID NO: 2215318 - protein, 6 aa, Cryptosporidium parvum
GKTSKR

SEQ ID NO: 2215319 - protein, 9 aa, Cryptosporidium parvum
GKTSNSTLY

SEQ ID NO: 2215320 - protein, 8 aa, Cryptosporidium parvum
GKTTDKRN

SEQ ID NO: 2215321 - protein, 14 aa, Cryptosporidium parvum
GKTTQISNLGGSVD

SEQ ID NO: 2215322 - protein, 9 aa, Cryptosporidium parvum
GKVSPNNSL

SEQ ID NO: 2215323 - protein, 6 aa, Cryptosporidium parvum
GKYGPG

SEQ ID NO: 2215324 - protein, 5 aa, Cryptosporidium parvum
GKYQS

SEQ ID NO: 2215325 - protein, 26 aa, Cryptosporidium parvum
GLAEEGVEQSTSGCDLSPSVAAQRQL

SEQ ID NO: 2215326 - protein, 9 aa, Cryptosporidium parvum
GLAGAASSG

SEQ ID NO: 2215327 - protein, 13 aa, Cryptosporidium parvum
GLAQDDQSNKKSK

SEQ ID NO: 2215328 - protein, 10 aa, Cryptosporidium parvum
GLCSGDSELS

SEQ ID NO: 2215329 - protein, 9 aa, Cryptosporidium parvum
GLDHSNRKN

SEQ ID NO: 2215330 - protein, 5 aa, Cryptosporidium parvum
GLEDD

SEQ ID NO: 2215331 - protein, 37 aa, Cryptosporidium parvum
GLEGPSRTEQNREGSSSSSSLPPIPSSVSSRSISGEN

SEQ ID NO: 2215332 - protein, 6 aa, Cryptosporidium parvum
GLEKSS

SEQ ID NO: 2215333 - protein, 8 aa, Cryptosporidium parvum
GLESGSGW

SEQ ID NO: 2215334 - protein, 41 aa, Cryptosporidium parvum
GLGEEPSTSTGIGRKRKMPSLQKSAKKIKKLERGGPSPIKK

SEQ ID NO: 2215335 - protein, 7 aa, Cryptosporidium parvum
GLGEISA

SEQ ID NO: 2215336 - protein, 11 aa, Cryptosporidium parvum
GLGFDDEASKY

SEQ ID NO: 2215337 - protein, 45 aa, Cryptosporidium parvum
GLGGQEYDHKAGDSISNSKQSIKASKEVGSSSVNKKKQKSTSKPR

SEQ ID NO: 2215338 - protein, 4 aa, Cryptosporidium parvum
GLGS

SEQ ID NO: 2215339 - protein, 8 aa, Cryptosporidium parvum
GLKDQEVR

SEQ ID NO: 2215340 - protein, 10 aa, Cryptosporidium parvum
GLKNDDRDHH

SEQ ID NO: 2215341 - protein, 5 aa, Cryptosporidium parvum
GLKNQ

SEQ ID NO: 2215342 - protein, 9 aa, Cryptosporidium parvum
GLNNSDGSL

SEQ ID NO: 2215343 - protein, 5 aa, Cryptosporidium parvum
GLNPS

SEQ ID NO: 2215344 - protein, 8 aa, Cryptosporidium parvum
GLNSEEIS

SEQ ID NO: 2215345 - protein, 11 aa, Cryptosporidium parvum
GLNSSSLLDSS

SEQ ID NO: 2215346 - protein, 4 aa, Cryptosporidium parvum
GLPA

SEQ ID NO: 2215347 - protein, 7 aa, Cryptosporidium parvum
GLPGGVG

SEQ ID NO: 2215348 - protein, 5 aa, Cryptosporidium parvum
GLPGP

SEQ ID NO: 2215349 - protein, 9 aa, Cryptosporidium parvum
GLPISSSSS

SEQ ID NO: 2215350 - protein, 14 aa, Cryptosporidium parvum
GLPNTAIKSSEVES

SEQ ID NO: 2215351 - protein, 16 aa, Cryptosporidium parvum
GLPRDPVSGLPQLPNG

SEQ ID NO: 2215352 - protein, 9 aa, Cryptosporidium parvum
GLPTDPYSN

SEQ ID NO: 2215353 - protein, 7 aa, Cryptosporidium parvum
GLPTTNE

SEQ ID NO: 2215354 - protein, 5 aa, Cryptosporidium parvum
GLQQK

SEQ ID NO: 2215355 - protein, 5 aa, Cryptosporidium parvum
GLQTA

SEQ ID NO: 2215356 - protein, 6 aa, Cryptosporidium parvum
GLSDSV

SEQ ID NO: 2215357 - protein, 5 aa, Cryptosporidium parvum
GLSEQ

SEQ ID NO: 2215358 - protein, 8 aa, Cryptosporidium parvum
GLSGLGEK

SEQ ID NO: 2215359 - protein, 11 aa, Cryptosporidium parvum
GLSKNGNSKTF

SEQ ID NO: 2215360 - protein, 5 aa, Cryptosporidium parvum
GLSNN

SEQ ID NO: 2215361 - protein, 6 aa, Cryptosporidium parvum
GLSPKS

SEQ ID NO: 2215362 - protein, 4 aa, Cryptosporidium parvum
GLSQ

SEQ ID NO: 2215363 - protein, 4 aa, Cryptosporidium parvum
GLSS

SEQ ID NO: 2215364 - protein, 8 aa, Cryptosporidium parvum
GLTSKGTK

SEQ ID NO: 2215365 - protein, 11 aa, Cryptosporidium parvum
GLVESNDKSVA

SEQ ID NO: 2215366 - protein, 4 aa, Cryptosporidium parvum
GLVN

SEQ ID NO: 2215367 - protein, 6 aa, Cryptosporidium parvum
GMASEK

SEQ ID NO: 2215368 - protein, 4 aa, Cryptosporidium parvum
GMDP

SEQ ID NO: 2215369 - protein, 4 aa, Cryptosporidium parvum
GMHT

SEQ ID NO: 2215370 - protein, 20 aa, Cryptosporidium parvum
GMPGGMPGGMPGMPGGMPGM

SEQ ID NO: 2215371 - protein, 5 aa, Cryptosporidium parvum
GMPGN

SEQ ID NO: 2215372 - protein, 9 aa, Cryptosporidium parvum
GMPTSQQKA

SEQ ID NO: 2215373 - protein, 10 aa, Cryptosporidium parvum
GMSNGNDSQL

SEQ ID NO: 2215374 - protein, 5 aa, Cryptosporidium parvum
GMSQD

SEQ ID NO: 2215375 - protein, 7 aa, Cryptosporidium parvum
GMYTNDN

SEQ ID NO: 2215376 - protein, 11 aa, Cryptosporidium parvum
GNADEGSPSEF

SEQ ID NO: 2215377 - protein, 9 aa, Cryptosporidium parvum
GNAEGKICS

SEQ ID NO: 2215378 - protein, 6 aa, Cryptosporidium parvum
GNANNE

SEQ ID NO: 2215379 - protein, 9 aa, Cryptosporidium parvum
GNASSDSQI

SEQ ID NO: 2215380 - protein, 7 aa, Cryptosporidium parvum
GNCQNEN

SEQ ID NO: 2215381 - protein, 12 aa, Cryptosporidium parvum
GNDDDDKKESRA

SEQ ID NO: 2215382 - protein, 9 aa, Cryptosporidium parvum
GNDESSIKS

SEQ ID NO: 2215383 - protein, 6 aa, Cryptosporidium parvum
GNDGIT

SEQ ID NO: 2215384 - protein, 10 aa, Cryptosporidium parvum
GNDHGSTRSI

SEQ ID NO: 2215385 - protein, 17 aa, Cryptosporidium parvum
GNDKVKVTNSAVSSPAE

SEQ ID NO: 2215386 - protein, 4 aa, Cryptosporidium parvum
GNDN

SEQ ID NO: 2215387 - protein, 10 aa, Cryptosporidium parvum
GNDPNPAVNG

SEQ ID NO: 2215388 - protein, 7 aa, Cryptosporidium parvum
GNDQGVE

SEQ ID NO: 2215389 - protein, 9 aa, Cryptosporidium parvum
GNDQTRRSR

SEQ ID NO: 2215390 - protein, 6 aa, Cryptosporidium parvum
GNDSAG

SEQ ID NO: 2215391 - protein, 19 aa, Cryptosporidium parvum
GNEDKNHNYGNTFNSEENM

SEQ ID NO: 2215392 - protein, 6 aa, Cryptosporidium parvum
GNEDTI

SEQ ID NO: 2215393 - protein, 8 aa, Cryptosporidium parvum
GNEEMSAS

SEQ ID NO: 2215394 - protein, 14 aa, Cryptosporidium parvum
GNEGGLLSGGQRQR

SEQ ID NO: 2215395 - protein, 7 aa, Cryptosporidium parvum
GNEHEKR

SEQ ID NO: 2215396 - protein, 9 aa, Cryptosporidium parvum
GNENEENNM

SEQ ID NO: 2215397 - protein, 9 aa, Cryptosporidium parvum
GNENESQNL

SEQ ID NO: 2215398 - protein, 9 aa, Cryptosporidium parvum
GNERTSSIR

SEQ ID NO: 2215399 - protein, 7 aa, Cryptosporidium parvum
GNERYSE

SEQ ID NO: 2215400 - protein, 8 aa, Cryptosporidium parvum
GNESDLSS

SEQ ID NO: 2215401 - protein, 4 aa, Cryptosporidium parvum
GNET

SEQ ID NO: 2215402 - protein, 7 aa, Cryptosporidium parvum
GNETNNL

SEQ ID NO: 2215403 - protein, 7 aa, Cryptosporidium parvum
GNETNTN

SEQ ID NO: 2215404 - protein, 8 aa, Cryptosporidium parvum
GNEYDTSR

SEQ ID NO: 2215405 - protein, 4 aa, Cryptosporidium parvum
GNFD

SEQ ID NO: 2215406 - protein, 5 aa, Cryptosporidium parvum
GNGGS

SEQ ID NO: 2215407 - protein, 6 aa, Cryptosporidium parvum
GNGHGI

SEQ ID NO: 2215408 - protein, 9 aa, Cryptosporidium parvum
GNGQSETKF

SEQ ID NO: 2215409 - protein, 26 aa, Cryptosporidium parvum
GNGSEDIENDNDEYVDKQERDQEDQV

SEQ ID NO: 2215410 - protein, 5 aa, Cryptosporidium parvum
GNHDK

SEQ ID NO: 2215411 - protein, 7 aa, Cryptosporidium parvum
GNHRNDT

SEQ ID NO: 2215412 - protein, 7 aa, Cryptosporidium parvum
GNIDSNG

SEQ ID NO: 2215413 - protein, 4 aa, Cryptosporidium parvum
GNIG

SEQ ID NO: 2215414 - protein, 6 aa, Cryptosporidium parvum
GNIKKN

SEQ ID NO: 2215415 - protein, 11 aa, Cryptosporidium parvum
GNIKSSYGTLA

SEQ ID NO: 2215416 - protein, 4 aa, Cryptosporidium parvum
GNIN

SEQ ID NO: 2215417 - protein, 4 aa, Cryptosporidium parvum
GNIS

SEQ ID NO: 2215418 - protein, 5 aa, Cryptosporidium parvum
GNISE

SEQ ID NO: 2215419 - protein, 4 aa, Cryptosporidium parvum
GNKC

SEQ ID NO: 2215420 - protein, 8 aa, Cryptosporidium parvum
GNKDNLDL

SEQ ID NO: 2215421 - protein, 11 aa, Cryptosporidium parvum
GNKEKKNTVNE

SEQ ID NO: 2215422 - protein, 7 aa, Cryptosporidium parvum
GNKELNE

SEQ ID NO: 2215423 - protein, 5 aa, Cryptosporidium parvum
GNKKG

SEQ ID NO: 2215424 - protein, 9 aa, Cryptosporidium parvum
GNKKGKQNV

SEQ ID NO: 2215425 - protein, 31 aa, Cryptosporidium parvum; identical to SEQ ID NO: 2113709

SEQ ID NO: 2215426 - protein, 5 aa, Cryptosporidium parvum
GNKRS

SEQ ID NO: 2215427 - protein, 8 aa, Cryptosporidium parvum
GNKRYSIT

SEQ ID NO: 2215428 - protein, 18 aa, Cryptosporidium parvum
GNKSNAKTSKRSNDGRSI

SEQ ID NO: 2215429 - protein, 5 aa, Cryptosporidium parvum
GNKSS

SEQ ID NO: 2215430 - protein, 14 aa, Cryptosporidium parvum
GNKVSYEPKSEGGL

SEQ ID NO: 2215431 - protein, 9 aa, Cryptosporidium parvum
GNKYSQANC

SEQ ID NO: 2215432 - protein, 7 aa, Cryptosporidium parvum
GNLDSDY

SEQ ID NO: 2215433 - protein, 9 aa, Cryptosporidium parvum
GNLEESENS

SEQ ID NO: 2215434 - protein, 23 aa, Cryptosporidium parvum
GNLKESKKIYESSVNNESNSEIY

SEQ ID NO: 2215435 - protein, 6 aa, Cryptosporidium parvum
GNLNKT

SEQ ID NO: 2215436 - protein, 10 aa, Cryptosporidium parvum
GNLPSATSVE

SEQ ID NO: 2215437 - protein, 12 aa, Cryptosporidium parvum
GNLSRNGSNEDL

SEQ ID NO: 2215438 - protein, 5 aa, Cryptosporidium parvum
GNNAL

SEQ ID NO: 2215439 - protein, 9 aa, Cryptosporidium parvum
GNNDNDNKI

SEQ ID NO: 2215440 - protein, 6 aa, Cryptosporidium parvum
GNNGQS

SEQ ID NO: 2215441 - protein, 15 aa, Cryptosporidium parvum
GNNGQTNYSAANGNI

SEQ ID NO: 2215442 - protein, 8 aa, Cryptosporidium parvum
GNNKSNQN

SEQ ID NO: 2215443 - protein, 9 aa, Cryptosporidium parvum
GNNLDADKS

SEQ ID NO: 2215444 - protein, 22 aa, Cryptosporidium parvum
GNNLGNDLNYGNDNNATTSASS

SEQ ID NO: 2215445 - protein, 4 aa, Cryptosporidium parvum
GNNN

SEQ ID NO: 2215446 - protein, 19 aa, Cryptosporidium parvum
GNNNNIEDLERDSKKEENM

SEQ ID NO: 2215447 - protein, 7 aa, Cryptosporidium parvum
GNNPYEP

SEQ ID NO: 2215448 - protein, 10 aa, Cryptosporidium parvum
GNNSSPSSRI

SEQ ID NO: 2215449 - protein, 4 aa, Cryptosporidium parvum
GNNT

SEQ ID NO: 2215450 - protein, 7 aa, Cryptosporidium parvum
GNNTAGI

SEQ ID NO: 2215451 - protein, 5 aa, Cryptosporidium parvum
GNNTL

SEQ ID NO: 2215452 - protein, 7 aa, Cryptosporidium parvum
GNNTNSS

SEQ ID NO: 2215453 - protein, 6 aa, Cryptosporidium parvum
GNPLER

SEQ ID NO: 2215454 - protein, 7 aa, Cryptosporidium parvum
GNPSNRY

SEQ ID NO: 2215455 - protein, 9 aa, Cryptosporidium parvum
GNPTSKPFG

SEQ ID NO: 2215456 - protein, 8 aa, Cryptosporidium parvum
GNQETDNH

SEQ ID NO: 2215457 - protein, 37 aa, Cryptosporidium parvum
GNQPENDQETLNQNGNLPKMNDYSNQSVSESLSHSNT

SEQ ID NO: 2215458 - protein, 8 aa, Cryptosporidium parvum
GNQRGIED

SEQ ID NO: 2215459 - protein, 5 aa, Cryptosporidium parvum
GNQYY

SEQ ID NO: 2215460 - protein, 4 aa, Cryptosporidium parvum
GNRV

SEQ ID NO: 2215461 - protein, 20 aa, Cryptosporidium parvum
GNSAKNRDHDHDKKKGTQDQ

SEQ ID NO: 2215462 - protein, 5 aa, Cryptosporidium parvum
GNSKD

SEQ ID NO: 2215463 - protein, 16 aa, Cryptosporidium parvum
GNSKNVNKDKTNEIAS

SEQ ID NO: 2215464 - protein, 5 aa, Cryptosporidium parvum
GNSNH

SEQ ID NO: 2215465 - protein, 7 aa, Cryptosporidium parvum
GNSQLKT

SEQ ID NO: 2215466 - protein, 9 aa, Cryptosporidium parvum
GNSSNDEDL

SEQ ID NO: 2215467 - protein, 8 aa, Cryptosporidium parvum
GNSSNFNR

SEQ ID NO: 2215468 - protein, 7 aa, Cryptosporidium parvum
GNSSNGY

SEQ ID NO: 2215469 - protein, 8 aa, Cryptosporidium parvum
GNSSNKNE

SEQ ID NO: 2215470 - protein, 19 aa, Cryptosporidium parvum
GNSSNNNNNNNNNNNNNGI

SEQ ID NO: 2215471 - protein, 6 aa, Cryptosporidium parvum
GNSSNS

SEQ ID NO: 2215472 - protein, 4 aa, Cryptosporidium parvum
GNSV

SEQ ID NO: 2215473 - protein, 22 aa, Cryptosporidium parvum
GNSYKTGCGSYSRSDNSKFTHS

SEQ ID NO: 2215474 - protein, 5 aa, Cryptosporidium parvum
GNSYY

SEQ ID NO: 2215475 - protein, 6 aa, Cryptosporidium parvum
GNTDEI

SEQ ID NO: 2215476 - protein, 4 aa, Cryptosporidium parvum
GNTL

SEQ ID NO: 2215477 - protein, 6 aa, Cryptosporidium parvum
GNTLPP

SEQ ID NO: 2215478 - protein, 12 aa, Cryptosporidium parvum
GNTNEGNSENQV

SEQ ID NO: 2215479 - protein, 21 aa, Cryptosporidium parvum
GNTSGGISKRRGSKDKNEYKF

SEQ ID NO: 2215480 - protein, 8 aa, Cryptosporidium parvum
GNTSKEEI

SEQ ID NO: 2215481 - protein, 10 aa, Cryptosporidium parvum
GNTSNKKSSS

SEQ ID NO: 2215482 - protein, 4 aa, Cryptosporidium parvum
GNVG

SEQ ID NO: 2215483 - protein, 9 aa, Cryptosporidium parvum
GNVKEVGNH

SEQ ID NO: 2215484 - protein, 7 aa, Cryptosporidium parvum
GNYNCEE

SEQ ID NO: 2215485 - protein, 12 aa, Cryptosporidium parvum
GNYPGQQNAGEI

SEQ ID NO: 2215486 - protein, 5 aa, Cryptosporidium parvum
GNYQY

SEQ ID NO: 2215487 - protein, 8 aa, Cryptosporidium parvum
GPAGTEFE

SEQ ID NO: 2215488 - protein, 6 aa, Cryptosporidium parvum
GPDPYL

SEQ ID NO: 2215489 - protein, 4 aa, Cryptosporidium parvum
GPEL

SEQ ID NO: 2215490 - protein, 7 aa, Cryptosporidium parvum
GPENHSS

SEQ ID NO: 2215491 - protein, 8 aa, Cryptosporidium parvum
GPERPPMD

SEQ ID NO: 2215492 - protein, 4 aa, Cryptosporidium parvum
GPES

SEQ ID NO: 2215493 - protein, 7 aa, Cryptosporidium parvum
GPESKFG

SEQ ID NO: 2215494 - protein, 5 aa, Cryptosporidium parvum
GPFEE

SEQ ID NO: 2215495 - protein, 5 aa, Cryptosporidium parvum
GPFPS

SEQ ID NO: 2215496 - protein, 5 aa, Cryptosporidium parvum
GPFSP

SEQ ID NO: 2215497 - protein, 16 aa, Cryptosporidium parvum
GPGAYDSGSIANKADF

SEQ ID NO: 2215498 - protein, 15 aa, Cryptosporidium parvum
GPGEINKPQKKSTEY

SEQ ID NO: 2215499 - protein, 20 aa, Cryptosporidium parvum
GPGKEGNSKKNKNSSNAEKT

SEQ ID NO: 2215500 - protein, 5 aa, Cryptosporidium parvum
GPGSI

SEQ ID NO: 2215501 - protein, 5 aa, Cryptosporidium parvum
GPHKS

SEQ ID NO: 2215502 - protein, 9 aa, Cryptosporidium parvum
GPHNNTENK

SEQ ID NO: 2215503 - protein, 20 aa, Cryptosporidium parvum
GPIIGQKPKTAISSGSSTWS

SEQ ID NO: 2215504 - protein, 9 aa, Cryptosporidium parvum
GPITNSQKV

SEQ ID NO: 2215505 - protein, 24 aa, Cryptosporidium parvum
GPKAATKPLLDETNSQIWKKQESK

SEQ ID NO: 2215506 - protein, 6 aa, Cryptosporidium parvum
GPKEEM

SEQ ID NO: 2215507 - protein, 6 aa, Cryptosporidium parvum
GPKERY

SEQ ID NO: 2215508 - protein, 12 aa, Cryptosporidium parvum
GPKEVEGKNDSV

SEQ ID NO: 2215509 - protein, 9 aa, Cryptosporidium parvum
GPKNSCNAN

SEQ ID NO: 2215510 - protein, 5 aa, Cryptosporidium parvum
GPLTE

SEQ ID NO: 2215511 - protein, 7 aa, Cryptosporidium parvum
GPLYDSQ

SEQ ID NO: 2215512 - protein, 10 aa, Cryptosporidium parvum
GPNDTPPTSD

SEQ ID NO: 2215513 - protein, 5 aa, Cryptosporidium parvum
GPNKL

SEQ ID NO: 2215514 - protein, 11 aa, Cryptosporidium parvum
GPNNCSQRRPF

SEQ ID NO: 2215515 - protein, 5 aa, Cryptosporidium parvum
GPNNK

SEQ ID NO: 2215516 - protein, 4 aa, Cryptosporidium parvum
GPNS

SEQ ID NO: 2215517 - protein, 5 aa, Cryptosporidium parvum
GPPGC

SEQ ID NO: 2215518 - protein, 8 aa, Cryptosporidium parvum
GPPGTGKT

SEQ ID NO: 2215519 - protein, 5 aa, Cryptosporidium parvum
GPQFT

SEQ ID NO: 2215520 - protein, 5 aa, Cryptosporidium parvum
GPQSI

SEQ ID NO: 2215521 - protein, 8 aa, Cryptosporidium parvum
GPRDKETI

SEQ ID NO: 2215522 - protein, 5 aa, Cryptosporidium parvum
GPRYF

SEQ ID NO: 2215523 - protein, 5 aa, Cryptosporidium parvum
GPSGC

SEQ ID NO: 2215524 - protein, 10 aa, Cryptosporidium parvum
GPSGSGKSTL

SEQ ID NO: 2215525 - protein, 9 aa, Cryptosporidium parvum
GPSGSGKTS

SEQ ID NO: 2215526 - protein, 9 aa, Cryptosporidium parvum
GPSGSGKTT

SEQ ID NO: 2215527 - protein, 4 aa, Cryptosporidium parvum
GPSI

SEQ ID NO: 2215528 - protein, 5 aa, Cryptosporidium parvum
GPSIT

SEQ ID NO: 2215529 - protein, 4 aa, Cryptosporidium parvum
GPSL

SEQ ID NO: 2215530 - protein, 8 aa, Cryptosporidium parvum
GPSLTPGQ

SEQ ID NO: 2215531 - protein, 4 aa, Cryptosporidium parvum
GPSV

SEQ ID NO: 2215532 - protein, 6 aa, Cryptosporidium parvum
GPSVAG

SEQ ID NO: 2215533 - protein, 5 aa, Cryptosporidium parvum
GPSVT

SEQ ID NO: 2215534 - protein, 6 aa, Cryptosporidium parvum
GPTAVG

SEQ ID NO: 2215535 - protein, 4 aa, Cryptosporidium parvum
GPTK

SEQ ID NO: 2215536 - protein, 16 aa, Cryptosporidium parvum
GPTKNKEGNGNEGHRL

SEQ ID NO: 2215537 - protein, 5 aa, Cryptosporidium parvum
GPWPV

SEQ ID NO: 2215538 - protein, 5 aa, Cryptosporidium parvum
GPYTQ

SEQ ID NO: 2215539 - protein, 12 aa, Cryptosporidium parvum
GQAPNKTNLVNH

SEQ ID NO: 2215540 - protein, 21 aa, Cryptosporidium parvum
GQAPVTPTTLDGSSTTTSPTF

SEQ ID NO: 2215541 - protein, 4 aa, Cryptosporidium parvum
GQDP

SEQ ID NO: 2215542 - protein, 7 aa, Cryptosporidium parvum
GQDSKGQ

SEQ ID NO: 2215543 - protein, 18 aa, Cryptosporidium parvum
GQEIKKEEEEEEEEEDPR

SEQ ID NO: 2215544 - protein, 6 aa, Cryptosporidium parvum
GQELEN

SEQ ID NO: 2215545 - protein, 4 aa, Cryptosporidium parvum
GQEV

SEQ ID NO: 2215546 - protein, 10 aa, Cryptosporidium parvum
GQGIHDKPSL

SEQ ID NO: 2215547 - protein, 4 aa, Cryptosporidium parvum
GQID

SEQ ID NO: 2215548 - protein, 7 aa, Cryptosporidium parvum
GQILSAG

SEQ ID NO: 2215549 - protein, 5 aa, Cryptosporidium parvum
GQIPE

SEQ ID NO: 2215550 - protein, 7 aa, Cryptosporidium parvum
GQISPGR

SEQ ID NO: 2215551 - protein, 25 aa, Cryptosporidium parvum
GQKENLNSNTNSWKSKSKMSSNPQK

SEQ ID NO: 2215552 - protein, 8 aa, Cryptosporidium parvum
GQKKSENI

SEQ ID NO: 2215553 - protein, 12 aa, Cryptosporidium parvum
GQKQDKSGNYVS

SEQ ID NO: 2215554 - protein, 10 aa, Cryptosporidium parvum
GQKSHTTKKF

SEQ ID NO: 2215555 - protein, 9 aa, Cryptosporidium parvum
GQKSKLRKM

SEQ ID NO: 2215556 - protein, 8 aa, Cryptosporidium parvum
GQKSSNTI

SEQ ID NO: 2215557 - protein, 11 aa, Cryptosporidium parvum
GQLNDSRINNK

SEQ ID NO: 2215558 - protein, 25 aa, Cryptosporidium parvum
GQLRKTRSASDLIGEKRGSIEITTR

SEQ ID NO: 2215559 - protein, 5 aa, Cryptosporidium parvum
GQNCK

SEQ ID NO: 2215560 - protein, 5 aa, Cryptosporidium parvum
GQNDF

SEQ ID NO: 2215561 - protein, 8 aa, Cryptosporidium parvum
GQNLNQQQ

SEQ ID NO: 2215562 - protein, 8 aa, Cryptosporidium parvum
GQNLSDGT

SEQ ID NO: 2215563 - protein, 13 aa, Cryptosporidium parvum
GQNRGTYNSTIEG

SEQ ID NO: 2215564 - protein, 9 aa, Cryptosporidium parvum
GQNRLSSSK

SEQ ID NO: 2215565 - protein, 4 aa, Cryptosporidium parvum
GQNS

SEQ ID NO: 2215566 - protein, 4 aa, Cryptosporidium parvum
GQPL

SEQ ID NO: 2215567 - protein, 5 aa, Cryptosporidium parvum
GQPRW

SEQ ID NO: 2215568 - protein, 8 aa, Cryptosporidium parvum
GQPTTIPG

SEQ ID NO: 2215569 - protein, 5 aa, Cryptosporidium parvum
GQPVY

SEQ ID NO: 2215570 - protein, 7 aa, Cryptosporidium parvum
GQQPKDL

SEQ ID NO: 2215571 - protein, 5 aa, Cryptosporidium parvum
GQRDT

SEQ ID NO: 2215572 - protein, 4 aa, Cryptosporidium parvum
GQSF

SEQ ID NO: 2215573 - protein, 16 aa, Cryptosporidium parvum
GQSKGDYFKNGELGND

SEQ ID NO: 2215574 - protein, 8 aa, Cryptosporidium parvum
GQTESNKS

SEQ ID NO: 2215575 - protein, 8 aa, Cryptosporidium parvum
GQTGKPQL

SEQ ID NO: 2215576 - protein, 39 aa, Cryptosporidium parvum
GQTPSSKASTSGRSYTSENLPSIGSHARSTTPDVNSSTV

SEQ ID NO: 2215577 - protein, 16 aa, Cryptosporidium parvum
GQTYQVDGKKTIPGSA

SEQ ID NO: 2215578 - protein, 4 aa, Cryptosporidium parvum
GQVA

SEQ ID NO: 2215579 - protein, 9 aa, Cryptosporidium parvum
GRAPVDPLP

SEQ ID NO: 2215580 - protein, 5 aa, Cryptosporidium parvum
GRCKS

SEQ ID NO: 2215581 - protein, 4 aa, Cryptosporidium parvum
GRDD

SEQ ID NO: 2215582 - protein, 4 aa, Cryptosporidium parvum
GRDG

SEQ ID NO: 2215583 - protein, 8 aa, Cryptosporidium parvum
GRDHKTKS

SEQ ID NO: 2215584 - protein, 4 aa, Cryptosporidium parvum
GREK

SEQ ID NO: 2215585 - protein, 13 aa, Cryptosporidium parvum
GREKKDNNTMNAP

SEQ ID NO: 2215586 - protein, 9 aa, Cryptosporidium parvum
GREVEESNA

SEQ ID NO: 2215587 - protein, 17 aa, Cryptosporidium parvum
GRGSEKSREQKHNENAV

SEQ ID NO: 2215588 - protein, 4 aa, Cryptosporidium parvum
GRIE

SEQ ID NO: 2215589 - protein, 17 aa, Cryptosporidium parvum
GRIGGNSITGASNISDL

SEQ ID NO: 2215590 - protein, 10 aa, Cryptosporidium parvum
GRIHSQTNTI

SEQ ID NO: 2215591 - protein, 4 aa, Cryptosporidium parvum
GRKD

SEQ ID NO: 2215592 - protein, 14 aa, Cryptosporidium parvum
GRKEIENEQTTIKK

SEQ ID NO: 2215593 - protein, 5 aa, Cryptosporidium parvum
GRKPF

SEQ ID NO: 2215594 - protein, 10 aa, Cryptosporidium parvum
GRKRNENTTS

SEQ ID NO: 2215595 - protein, 9 aa, Cryptosporidium parvum
GRKWKPPRA

SEQ ID NO: 2215596 - protein, 8 aa, Cryptosporidium parvum
GRLDENSD

SEQ ID NO: 2215597 - protein, 13 aa, Cryptosporidium parvum
GRLDKSVASKVDG

SEQ ID NO: 2215598 - protein, 9 aa, Cryptosporidium parvum
GRLKGREYN

SEQ ID NO: 2215599 - protein, 14 aa, Cryptosporidium parvum
GRNGARATFTSDGK

SEQ ID NO: 2215600 - protein, 5 aa, Cryptosporidium parvum
GRNGS

SEQ ID NO: 2215601 - protein, 5 aa, Cryptosporidium parvum
GRNIE

SEQ ID NO: 2215602 - protein, 8 aa, Cryptosporidium parvum
GRNIPVNN

SEQ ID NO: 2215603 - protein, 8 aa, Cryptosporidium parvum
GRNPETVI

SEQ ID NO: 2215604 - protein, 6 aa, Cryptosporidium parvum
GRNPQG

SEQ ID NO: 2215605 - protein, 19 aa, Cryptosporidium parvum
GRNSLQTNTDKNKKCNQGL

SEQ ID NO: 2215606 - protein, 20 aa, Cryptosporidium parvum
GRNSTRKEDEDSGLSPTSAS

SEQ ID NO: 2215607 - protein, 5 aa, Cryptosporidium parvum
GRPFY

SEQ ID NO: 2215608 - protein, 11 aa, Cryptosporidium parvum
GRQDRETFKER

SEQ ID NO: 2215609 - protein, 5 aa, Cryptosporidium parvum
GRRPC

SEQ ID NO: 2215610 - protein, 6 aa, Cryptosporidium parvum
GRRQIQ

SEQ ID NO: 2215611 - protein, 18 aa, Cryptosporidium parvum
GRRQTKKTTYGDGSQGNF

SEQ ID NO: 2215612 - protein, 10 aa, Cryptosporidium parvum
GRSDTSTNVT

SEQ ID NO: 2215613 - protein, 31 aa, Cryptosporidium parvum
GRSEKKISNKNQISSKKSTKDSENHSISTSI

SEQ ID NO: 2215614 - protein, 9 aa, Cryptosporidium parvum
GRSGSGKST

SEQ ID NO: 2215615 - protein, 9 aa, Cryptosporidium parvum
GRSKGFENV

SEQ ID NO: 2215616 - protein, 4 aa, Cryptosporidium parvum
GRSN

SEQ ID NO: 2215617 - protein, 6 aa, Cryptosporidium parvum
GRSPRM

SEQ ID NO: 2215618 - protein, 26 aa, Cryptosporidium parvum
GRSSGKGSSGNCCGGSNSKRKGSCGS

SEQ ID NO: 2215619 - protein, 6 aa, Cryptosporidium parvum
GRSSLA

SEQ ID NO: 2215620 - protein, 5 aa, Cryptosporidium parvum
GRSSN

SEQ ID NO: 2215621 - protein, 12 aa, Cryptosporidium parvum
GRSYADNNENAG

SEQ ID NO: 2215622 - protein, 8 aa, Cryptosporidium parvum
GRTGAGKS

SEQ ID NO: 2215623 - protein, 10 aa, Cryptosporidium parvum
GRTGSGKSSI

SEQ ID NO: 2215624 - protein, 9 aa, Cryptosporidium parvum
GRTGSGKST

SEQ ID NO: 2215625 - protein, 10 aa, Cryptosporidium parvum
GRTGSGKSTL

SEQ ID NO: 2215626 - protein, 9 aa, Cryptosporidium parvum
GRTGSGKTS

SEQ ID NO: 2215627 - protein, 4 aa, Cryptosporidium parvum
GRTT

SEQ ID NO: 2215628 - protein, 5 aa, Cryptosporidium parvum
GRTTN

SEQ ID NO: 2215629 - protein, 15 aa, Cryptosporidium parvum
GRTTPNITPSNHSDY

SEQ ID NO: 2215630 - protein, 24 aa, Cryptosporidium parvum
GRVNGAKKSSSGDKGVSSGPGMDN

SEQ ID NO: 2215631 - protein, 9 aa, Cryptosporidium parvum
GRWETSSGL

SEQ ID NO: 2215632 - protein, 7 aa, Cryptosporidium parvum
GRYSANN

SEQ ID NO: 2215633 - protein, 4 aa, Cryptosporidium parvum
GSAD

SEQ ID NO: 2215634 - protein, 4 aa, Cryptosporidium parvum
GSAG

SEQ ID NO: 2215635 - protein, 8 aa, Cryptosporidium parvum
GSANHGIN

SEQ ID NO: 2215636 - protein, 5 aa, Cryptosporidium parvum
GSCEN

SEQ ID NO: 2215637 - protein, 5 aa, Cryptosporidium parvum
GSCNG

SEQ ID NO: 2215638 - protein, 7 aa, Cryptosporidium parvum
GSDAAAP

SEQ ID NO: 2215639 - protein, 5 aa, Cryptosporidium parvum
GSDEF

SEQ ID NO: 2215640 - protein, 8 aa, Cryptosporidium parvum
GSDEYSER

SEQ ID NO: 2215641 - protein, 17 aa, Cryptosporidium parvum
GSDFADEKTGYSPFPGN

SEQ ID NO: 2215642 - protein, 11 aa, Cryptosporidium parvum
GSDGRGKCECN

SEQ ID NO: 2215643 - protein, 7 aa, Cryptosporidium parvum
GSDGSSI

SEQ ID NO: 2215644 - protein, 6 aa, Cryptosporidium parvum
GSDIGG

SEQ ID NO: 2215645 - protein, 22 aa, Cryptosporidium parvum
GSDNQNPSSDKTSQNEKQNESL

SEQ ID NO: 2215646 - protein, 8 aa, Cryptosporidium parvum
GSDPSIRD

SEQ ID NO: 2215647 - protein, 14 aa, Cryptosporidium parvum
GSDSPTSKESCPSN

SEQ ID NO: 2215648 - protein, 4 aa, Cryptosporidium parvum
GSDT

SEQ ID NO: 2215649 - protein, 6 aa, Cryptosporidium parvum
GSEGMQ

SEQ ID NO: 2215650 - protein, 5 aa, Cryptosporidium parvum
GSEKH

SEQ ID NO: 2215651 - protein, 17 aa, Cryptosporidium parvum
GSEKKTENFSNSRIDNS

SEQ ID NO: 2215652 - protein, 4 aa, Cryptosporidium parvum
GSEN

SEQ ID NO: 2215653 - protein, 9 aa, Cryptosporidium parvum
GSENYSDST

SEQ ID NO: 2215654 - protein, 9 aa, Cryptosporidium parvum
GSEPISNSS

SEQ ID NO: 2215655 - protein, 11 aa, Cryptosporidium parvum
GSERSSSSELK

SEQ ID NO: 2215656 - protein, 4 aa, Cryptosporidium parvum
GSES

SEQ ID NO: 2215657 - protein, 6 aa, Cryptosporidium parvum
GSESAI

SEQ ID NO: 2215658 - protein, 7 aa, Cryptosporidium parvum
GSESIYN

SEQ ID NO: 2215659 - protein, 5 aa, Cryptosporidium parvum
GSESS

SEQ ID NO: 2215660 - protein, 12 aa, Cryptosporidium parvum
GSETNPEKKSRH

SEQ ID NO: 2215661 - protein, 4 aa, Cryptosporidium parvum
GSEY

SEQ ID NO: 2215662 - protein, 12 aa, Cryptosporidium parvum
GSFGKGPNSKLT

SEQ ID NO: 2215663 - protein, 4 aa, Cryptosporidium parvum
GSFP

SEQ ID NO: 2215664 - protein, 7 aa, Cryptosporidium parvum
GSFPPTS

SEQ ID NO: 2215665 - protein, 6 aa, Cryptosporidium parvum
GSFPSN

SEQ ID NO: 2215666 - protein, 8 aa, Cryptosporidium parvum
GSFSTNKN

SEQ ID NO: 2215667 - protein, 18 aa, Cryptosporidium parvum
GSFTGDNCPNNQSSTYGK

SEQ ID NO: 2215668 - protein, 6 aa, Cryptosporidium parvum
GSGDAQ

SEQ ID NO: 2215669 - protein, 8 aa, Cryptosporidium parvum
GSGDEKKI

SEQ ID NO: 2215670 - protein, 8 aa, Cryptosporidium parvum
GSGEFDQS

SEQ ID NO: 2215671 - protein, 37 aa, Cryptosporidium parvum
GSGGGSNSRAEGLEQNDHASKSIECEDTPSNRMEGGE

SEQ ID NO: 2215672 - protein, 11 aa, Cryptosporidium parvum
GSGNIYRPPSS

SEQ ID NO: 2215673 - protein, 7 aa, Cryptosporidium parvum
GSGNQSI

SEQ ID NO: 2215674 - protein, 54 aa, Cryptosporidium parvum
GSGPGAGAGVGVGQGCGVGQGCGAGPGSGVGVGPGSGVGVGVGPGSRVGAVGPG

SEQ ID NO: 2215675 - protein, 6 aa, Cryptosporidium parvum
GSGRDY

SEQ ID NO: 2215676 - protein, 5 aa, Cryptosporidium parvum
GSGSV

SEQ ID NO: 2215677 - protein, 4 aa, Cryptosporidium parvum
GSGT

SEQ ID NO: 2215678 - protein, 8 aa, Cryptosporidium parvum
GSGTEEIC

SEQ ID NO: 2215679 - protein, 18 aa, Cryptosporidium parvum
GSGTGTGTGAGRRSSLGN

SEQ ID NO: 2215680 - protein, 11 aa, Cryptosporidium parvum
GSGTLGEAPKQ

SEQ ID NO: 2215681 - protein, 7 aa, Cryptosporidium parvum
GSGTTSF

SEQ ID NO: 2215682 - protein, 6 aa, Cryptosporidium parvum
GSGVAT

SEQ ID NO: 2215683 - protein, 7 aa, Cryptosporidium parvum
GSHETIG

SEQ ID NO: 2215684 - protein, 5 aa, Cryptosporidium parvum
GSHYD

SEQ ID NO: 2215685 - protein, 15 aa, Cryptosporidium parvum
GSIIGGANQDSGGFG

SEQ ID NO: 2215686 - protein, 4 aa, Cryptosporidium parvum
GSIK

SEQ ID NO: 2215687 - protein, 9 aa, Cryptosporidium parvum
GSIKTQNKS

SEQ ID NO: 2215688 - protein, 32 aa, Cryptosporidium parvum; identical to SEQ ID NO: 2113878

SEQ ID NO: 2215689 - protein, 22 aa, Cryptosporidium parvum
GSISNITNNELENSKFDGQETN

SEQ ID NO: 2215690 - protein, 15 aa, Cryptosporidium parvum
GSKCSGISNSIPQAT

SEQ ID NO: 2215691 - protein, 4 aa, Cryptosporidium parvum
GSKD

SEQ ID NO: 2215692 - protein, 17 aa, Cryptosporidium parvum
GSKDEIPKIQRPKPKLS

SEQ ID NO: 2215693 - protein, 8 aa, Cryptosporidium parvum
GSKESIPT

SEQ ID NO: 2215694 - protein, 9 aa, Cryptosporidium parvum
GSKEYAGAP

SEQ ID NO: 2215695 - protein, 8 aa, Cryptosporidium parvum
GSKKIDQT

SEQ ID NO: 2215696 - protein, 4 aa, Cryptosporidium parvum
GSKN

SEQ ID NO: 2215697 - protein, 5 aa, Cryptosporidium parvum
GSKNL

SEQ ID NO: 2215698 - protein, 6 aa, Cryptosporidium parvum
GSKNVL

SEQ ID NO: 2215699 - protein, 8 aa, Cryptosporidium parvum
GSKREKYP

SEQ ID NO: 2215700 - protein, 8 aa, Cryptosporidium parvum
GSKTCSYR

SEQ ID NO: 2215701 - protein, 7 aa, Cryptosporidium parvum
GSKTEFT

SEQ ID NO: 2215702 - protein, 5 aa, Cryptosporidium parvum
GSKTR

SEQ ID NO: 2215703 - protein, 33 aa, Cryptosporidium parvum
GSLAGGAAGGVTGGVAGGVAGGAAGGLTGGGVA

SEQ ID NO: 2215704 - protein, 5 aa, Cryptosporidium parvum
GSLDP

SEQ ID NO: 2215705 - protein, 14 aa, Cryptosporidium parvum
GSLDTTNNDDLGSQ

SEQ ID NO: 2215706 - protein, 7 aa, Cryptosporidium parvum
GSLEGQT

SEQ ID NO: 2215707 - protein, 5 aa, Cryptosporidium parvum
GSLKR

SEQ ID NO: 2215708 - protein, 17 aa, Cryptosporidium parvum
GSLQPSFQSTQSKDIGI
